United States Patent 11,640,849 (METHODS FOR HISTOLOGICAL DIAGNOSIS AND TREATMENT OF DISEASES) - sequence listing, part 27

SEQ ID NO: 1048861 - protein, 17 aa, Mycobacterium
LALSNGVLVHRKVAADE

SEQ ID NO: 1048862 - protein, 18 aa, Mycobacterium
LALWDWGFELEDVRAHFD

SEQ ID NO: 1048863 - protein, 22 aa, Mycobacterium
LAMGPRCLMTSMELMMPTDASF

SEQ ID NO: 1048864 - protein, 26 aa, Mycobacterium
LAMLRRLMMDDSFFRGELIYVFDGDE

SEQ ID NO: 1048865 - protein, 25 aa, Mycobacterium
LAMNARIALHVRVLYGRDPHHITEA

SEQ ID NO: 1048866 - protein, 19 aa, Mycobacterium
LAMTPALLRVFGFRTGVGR

SEQ ID NO: 1048867 - protein, 21 aa, Mycobacterium
LANAIARACGARVTRLPMTAA

SEQ ID NO: 1048868 - protein, 17 aa, Mycobacterium
LANHGLHIEVLIDPESP

SEQ ID NO: 1048869 - protein, 24 aa, Mycobacterium
LANLSHLRRPHIITIDDVPDSAGE

SEQ ID NO: 1048870 - protein, 18 aa, Mycobacterium
LANQWGRTLAAHGAQTGS

SEQ ID NO: 1048871 - protein, 18 aa, Mycobacterium
LAPALAPAAGLRHAVAPL

SEQ ID NO: 1048872 - protein, 24 aa, Mycobacterium
LAPENGCRMGICHTCTRRKTSGTV

SEQ ID NO: 1048873 - protein, 21 aa, Mycobacterium
LAPFRWRLAPVPLNLDHPYWF

SEQ ID NO: 1048874 - protein, 17 aa, Mycobacterium
LAPGQALVLDFEPPETR

SEQ ID NO: 1048875 - protein, 18 aa, Mycobacterium
LAPGTGLRDGLERILRGR

SEQ ID NO: 1048876 - protein, 18 aa, Mycobacterium
LAPGTPLARVFWPRTRIV

SEQ ID NO: 1048877 - protein, 23 aa, Mycobacterium
LAPLPRRRLRETLDRYPNAKEFF

SEQ ID NO: 1048878 - protein, 24 aa, Mycobacterium
LAPPPETLRSFGLPTMSPTIGGHE

SEQ ID NO: 1048879 - protein, 21 aa, Mycobacterium
LAPQCCAVVAYGALLGDALLG

SEQ ID NO: 1048880 - protein, 19 aa, Mycobacterium
LAPTLPRSSTATIDAVDDD

SEQ ID NO: 1048881 - protein, 17 aa, Mycobacterium
LAQAAGVPVAFLTAWYG

SEQ ID NO: 1048882 - protein, 24 aa, Mycobacterium
LAQIKRLKIGSGRRLASTTKETLV

SEQ ID NO: 1048883 - protein, 17 aa, Mycobacterium
LAQPLRVAIAGDWHSDA

SEQ ID NO: 1048884 - protein, 17 aa, Mycobacterium
LAQQLRAANAMREDAAQ

SEQ ID NO: 1048885 - protein, 19 aa, Mycobacterium
LAQRCKRLGRYVVGIGVAG

SEQ ID NO: 1048886 - protein, 25 aa, Mycobacterium
LAQRQGIEILGPVGVAARTAATVAD

SEQ ID NO: 1048887 - protein, 23 aa, Mycobacterium
LAQWRFRQTRWPSSVSGAGFRVG

SEQ ID NO: 1048888 - protein, 20 aa, Mycobacterium
LARAAGLAIAERGGVLTDLS

SEQ ID NO: 1048889 - protein, 24 aa, Mycobacterium
LARAIPLPTQFEFMAVSSYGSSTS

SEQ ID NO: 1048890 - protein, 22 aa, Mycobacterium
LARCPRLKILATSREFFDIDTE

SEQ ID NO: 1048891 - protein, 20 aa, Mycobacterium
LAREDLSVWVVTGDGDALSI

SEQ ID NO: 1048892 - protein, 24 aa, Mycobacterium
LAREGGLSSTMWAGPAVIGKSVRQ

SEQ ID NO: 1048893 - protein, 17 aa, Mycobacterium
LARELGSEFDIYVLDFP

SEQ ID NO: 1048894 - protein, 19 aa, Mycobacterium
LARELPHQLLRSWYILYFQ

SEQ ID NO: 1048895 - protein, 34 aa, Mycobacterium
LARGDYQGLVGVPLFDIAAAPGFGNTTTSSSSGF

SEQ ID NO: 1048896 - protein, 18 aa, Mycobacterium
LARHGARVILAVRNTSKG

SEQ ID NO: 1048897 - protein, 20 aa, Mycobacterium
LARKMEVLAMGTSDLPVGCS

SEQ ID NO: 1048898 - protein, 19 aa, Mycobacterium
LARLQEVWMGRQIAEVKSK

SEQ ID NO: 1048899 - protein, 19 aa, Mycobacterium
LARMLPMVRDVRRIGSAAL

SEQ ID NO: 1048900 - protein, 22 aa, Mycobacterium
LARPEFKAMFLDDLLNGSRKQL

SEQ ID NO: 1048901 - protein, 17 aa, Mycobacterium
LARRPYREPGQRSRDEY

SEQ ID NO: 1048902 - protein, 21 aa, Mycobacterium
LARSMNFYAAMSIADGNLDPL

SEQ ID NO: 1048903 - protein, 17 aa, Mycobacterium
LARVPRSVVEPSGTWTV

SEQ ID NO: 1048904 - protein, 31 aa, Mycobacterium
LASCEFAVLIPLGVDTSVLWSALRQPEVSTS

SEQ ID NO: 1048905 - protein, 18 aa, Mycobacterium
LASDARLTGKTGLTGNAR

SEQ ID NO: 1048906 - protein, 24 aa, Mycobacterium
LASESAYFLLAFTKIGLMPDGGAS

SEQ ID NO: 1048907 - protein, 25 aa, Mycobacterium
LASGEQWLSVCGFRRAENAEPAEPA

SEQ ID NO: 1048908 - protein, 19 aa, Mycobacterium
LASKATRDADGWVLDATKS

SEQ ID NO: 1048909 - protein, 21 aa, Mycobacterium
LASLPALMVVAPYHTPIPLWT

SEQ ID NO: 1048910 - protein, 18 aa, Mycobacterium
LASLPGCALLVDADEMRR

SEQ ID NO: 1048911 - protein, 25 aa, Mycobacterium
LASMMPMRVIGMLLGIPESDQIGVR

SEQ ID NO: 1048912 - protein, 25 aa, Mycobacterium
LASRMPCPYLNPGRYVCDRPLVQGM

SEQ ID NO: 1048913 - protein, 26 aa, Mycobacterium
LASRTWTPPRVMRWKTCSTSGHRHRP

SEQ ID NO: 1048914 - protein, 24 aa, Mycobacterium
LASVPWDGCDAALSARLAYPEVRA

SEQ ID NO: 1048915 - protein, 22 aa, Mycobacterium
LATAITWHKYVAGLVVQAKLAI

SEQ ID NO: 1048916 - protein, 20 aa, Mycobacterium
LATAPPGYRLSIPDSTCDLG

SEQ ID NO: 1048917 - protein, 18 aa, Mycobacterium
LATARGWITALRAYNNSG

SEQ ID NO: 1048918 - protein, 18 aa, Mycobacterium
LATARRFAEILPHAQLVN

SEQ ID NO: 1048919 - protein, 23 aa, Mycobacterium
LATCAIEGIPIKVALINNGNLGM

SEQ ID NO: 1048920 - protein, 18 aa, Mycobacterium
LATDVLRQLRMVKEAAEV

SEQ ID NO: 1048921 - protein, 18 aa, Mycobacterium
LATEAGISRASFYIYFDD

SEQ ID NO: 1048922 - protein, 21 aa, Mycobacterium
LATEEMIRWVTPVKQFMRTAS

SEQ ID NO: 1048923 - protein, 17 aa, Mycobacterium
LATMAWPPPGTPPDRHW

SEQ ID NO: 1048924 - protein, 23 aa, Mycobacterium
LATPEIMGSLNLADRSYARLAQH

SEQ ID NO: 1048925 - protein, 21 aa, Mycobacterium
LATQAACRVLRDGGTAADAVV

SEQ ID NO: 1048926 - protein, 18 aa, Mycobacterium
LATRHLLQHPGLQRAAGR

SEQ ID NO: 1048927 - protein, 18 aa, Mycobacterium
LATTGALGCFGMSRREAL

SEQ ID NO: 1048928 - protein, 34 aa, Mycobacterium
LATTSCTWRRDRVRPCLPVRTWAPVASPSISRHW

SEQ ID NO: 1048929 - protein, 18 aa, Mycobacterium
LATVKFVFDRWLSTDPPS

SEQ ID NO: 1048930 - protein, 17 aa, Mycobacterium
LATVLGWSHCDHTGPVR

SEQ ID NO: 1048931 - protein, 19 aa, Mycobacterium
LAVAESMFPADPSAWGPAV

SEQ ID NO: 1048932 - protein, 17 aa, Mycobacterium
LAVALHANFPPERITLH

SEQ ID NO: 1048933 - protein, 17 aa, Mycobacterium
LAVFHPKGGIVRRELED

SEQ ID NO: 1048934 - protein, 17 aa, Mycobacterium
LAVGFWADPSDLRANWQ

SEQ ID NO: 1048935 - protein, 20 aa, Mycobacterium
LAVGHWLRRWWPASQRDDIA

SEQ ID NO: 1048936 - protein, 19 aa, Mycobacterium
LAVGRRLRDRYGLDEKPTA

SEQ ID NO: 1048937 - protein, 23 aa, Mycobacterium
LAVGVHRLLCWGIVGTPLTLVPA

SEQ ID NO: 1048938 - protein, 25 aa, Mycobacterium
LAVLPRLAPRARITVGLDRVELALA

SEQ ID NO: 1048939 - protein, 18 aa, Mycobacterium
LAVLQAGMLFHSRVDGPS

SEQ ID NO: 1048940 - protein, 20 aa, Mycobacterium
LAVMPWNFPLWQAGRFAAPA

SEQ ID NO: 1048941 - protein, 24 aa, Mycobacterium
LAVQRAAAVLLILNPAHPISRVAG

SEQ ID NO: 1048942 - protein, 17 aa, Mycobacterium
LAVRRITERPGLTVGLE

SEQ ID NO: 1048943 - protein, 21 aa, Mycobacterium
LAVRRITERPGLTVGLEPLLN

SEQ ID NO: 1048944 - protein, 17 aa, Mycobacterium
LAVSFSGVQLLQRGSAN

SEQ ID NO: 1048945 - protein, 20 aa, Mycobacterium
LAVTGCLIAGVPVVPVPADV

SEQ ID NO: 1048946 - protein, 17 aa, Mycobacterium
LAVTGYVWEAGVGAVFG

SEQ ID NO: 1048947 - protein, 19 aa, Mycobacterium
LAVYLGLPVCAALTAELDR

SEQ ID NO: 1048948 - protein, 17 aa, Mycobacterium
LAWPADLKVGPDGMGNS

SEQ ID NO: 1048949 - protein, 37 aa, Mycobacterium
LAYGCSKVGLPLVRRALELLPDVGFVNAYRLTETSST

SEQ ID NO: 1048950 - protein, 23 aa, Mycobacterium
LAYGDMGLALSILAPGGVASALT

SEQ ID NO: 1048951 - protein, 18 aa, Mycobacterium
LAYGYARNQMSAYVELQE

SEQ ID NO: 1048952 - protein, 17 aa, Mycobacterium
LAYTWKQVVTTPLFAEN

SEQ ID NO: 1048953 - protein, 21 aa, Mycobacterium
LCAMAKRFVTDTCFDVADKAL

SEQ ID NO: 1048954 - protein, 19 aa, Mycobacterium
LCAQREVVDAFFAAGRSGN

SEQ ID NO: 1048955 - protein, 24 aa, Mycobacterium
LCASQLVGLGIMRYGLRSEPMHSM

SEQ ID NO: 1048956 - protein, 19 aa, Mycobacterium
LCDELKIAPEPELTGTAAV

SEQ ID NO: 1048957 - protein, 23 aa, Mycobacterium
LCEIKDVQIRDGLHILGQKPTGE

SEQ ID NO: 1048958 - protein, 20 aa, Mycobacterium
LCELKDIIERSAAAGDPCGT

SEQ ID NO: 1048959 - protein, 26 aa, Mycobacterium
LCGLIEVRFPDGWSVAPRRLPFDLGA

SEQ ID NO: 1048960 - protein, 26 aa, Mycobacterium
LCLAEAGWPVRVWIDLLPRQTTSAVA

SEQ ID NO: 1048961 - protein, 19 aa, Mycobacterium
LCLGLQCIVIEAARSVGLT

SEQ ID NO: 1048962 - protein, 19 aa, Mycobacterium
LCNSAGFGTSGRFCELPPE

SEQ ID NO: 1048963 - protein, 20 aa, Mycobacterium
LCPLRLRDSDGWPLYPIRPD

SEQ ID NO: 1048964 - protein, 25 aa, Mycobacterium
LCQMSEVFPGTQIMAAFGQTEMSPV

SEQ ID NO: 1048965 - protein, 24 aa, Mycobacterium
LCRDNCHYCTFVTVPGKLRAQGAG

SEQ ID NO: 1048966 - protein, 20 aa, Mycobacterium
LCRTLPWPAYLTEAFQNLGP

SEQ ID NO: 1048967 - protein, 17 aa, Mycobacterium
LCSPTRAALLTGRNHHV

SEQ ID NO: 1048968 - protein, 20 aa, Mycobacterium
LCVSGGAAMPVEVMRGFEQA

SEQ ID NO: 1048969 - protein, 29 aa, Mycobacterium
LDAAISVCRACPRLVTWREEVAVAKRRAF

SEQ ID NO: 1048970 - protein, 18 aa, Mycobacterium
LDAAITFYSKLFNAEPAK

SEQ ID NO: 1048971 - protein, 17 aa, Mycobacterium
LDAAIVFAPVGDLVLPA

SEQ ID NO: 1048972 - protein, 21 aa, Mycobacterium
LDAALRFIVDYQYSYSGVRMV

SEQ ID NO: 1048973 - protein, 19 aa, Mycobacterium
LDAEFPKFRQLLPAEHTAV

SEQ ID NO: 1048974 - protein, 18 aa, Mycobacterium
LDAFGIDVHGRRCLDAGA

SEQ ID NO: 1048975 - protein, 20 aa, Mycobacterium
LDAGKAMRLFYEHPEKSLDA

SEQ ID NO: 1048976 - protein, 18 aa, Mycobacterium
LDAIGAEIDGAVAGQDSL

SEQ ID NO: 1048977 - protein, 18 aa, Mycobacterium
LDALAPLLGTWAGQGAGE

SEQ ID NO: 1048978 - protein, 24 aa, Mycobacterium
LDALARNKMRVVAGLTSKAMSVAS

SEQ ID NO: 1048979 - protein, 19 aa, Mycobacterium
LDALGCLLDTYGLTVAIET

SEQ ID NO: 1048980 - protein, 18 aa, Mycobacterium
LDALPEFAPPYELLNEPG

SEQ ID NO: 1048981 - protein, 18 aa, Mycobacterium
LDAMSSWWTSVHGHGHPV

SEQ ID NO: 1048982 - protein, 23 aa, Mycobacterium
LDAPAVLGWAGFCDVAQRYSLGM

SEQ ID NO: 1048983 - protein, 23 aa, Mycobacterium
LDAQRWARQRAQRAIAKASPAGA

SEQ ID NO: 1048984 - protein, 24 aa, Mycobacterium
LDARAYRLPWPADTVVYELDQPQV

SEQ ID NO: 1048985 - protein, 19 aa, Mycobacterium
LDASLLLVVLTRFLPPDDP

SEQ ID NO: 1048986 - protein, 23 aa, Mycobacterium
LDAVAEHYMHFGGVSPINGINRA

SEQ ID NO: 1048987 - protein, 17 aa, Mycobacterium
LDAYLVAAVDMFIGEVG

SEQ ID NO: 1048988 - protein, 18 aa, Mycobacterium
LDCCQESDGGVALVVTST

SEQ ID NO: 1048989 - protein, 17 aa, Mycobacterium
LDCRAYRLNWPPEAVVF

SEQ ID NO: 1048990 - protein, 18 aa, Mycobacterium
LDDATARVRVRAIVPDGD

SEQ ID NO: 1048991 - protein, 22 aa, Mycobacterium
LDDEQVRLAVIQRLSWIKRQRG

SEQ ID NO: 1048992 - protein, 19 aa, Mycobacterium
LDDEVRWVLTKGKLPTSLW

SEQ ID NO: 1048993 - protein, 26 aa, Mycobacterium
LDDKGRLTLPAKFRDALAGGLMVTKS

SEQ ID NO: 1048994 - protein, 19 aa, Mycobacterium
LDDLDVLDWPDQVKTMQRN

SEQ ID NO: 1048995 - protein, 23 aa, Mycobacterium
LDDLRTARAFLCALTGSPVTLGF

SEQ ID NO: 1048996 - protein, 24 aa, Mycobacterium
LDDQRHVIGDSWQLMSTPTISFPK

SEQ ID NO: 1048997 - protein, 18 aa, Mycobacterium
LDEARRGLTNAIVAYLEN

SEQ ID NO: 1048998 - protein, 20 aa, Mycobacterium
LDEFAYRLSGSADLYEHTGR

SEQ ID NO: 1048999 - protein, 30 aa, Mycobacterium
LDEFLPQFLKGCIQLGAWPLLDTTWEMAPV

SEQ ID NO: 1049000 - protein, 18 aa, Mycobacterium
LDELGWRGLIAQSTDLDA

SEQ ID NO: 1049001 - protein, 23 aa, Mycobacterium
LDELRATSFANLTMRAVAARAGV

SEQ ID NO: 1049002 - protein, 19 aa, Mycobacterium
LDEMVNFAAAMEREGMQIP

SEQ ID NO: 1049003 - protein, 23 aa, Mycobacterium
LDERSWCALRALAAHPAAGAALD

SEQ ID NO: 1049004 - protein, 23 aa, Mycobacterium
LDERWTLLVVRELLLGSTHFNDL

SEQ ID NO: 1049005 - protein, 23 aa, Mycobacterium
LDEVRASGVLPTWEETQRFIDGL

SEQ ID NO: 1049006 - protein, 21 aa, Mycobacterium
LDFAGNADFAIAIRTALMRNG

SEQ ID NO: 1049007 - protein, 20 aa, Mycobacterium
LDFLVAVARSCVGHVVSVVV

SEQ ID NO: 1049008 - protein, 19 aa, Mycobacterium
LDFMGCCAFEVLAEQAGRC

SEQ ID NO: 1049009 - protein, 19 aa, Mycobacterium
LDFMPVVFSLFQWGKRHLP

SEQ ID NO: 1049010 - protein, 20 aa, Mycobacterium
LDFSDLRAGGAPLVTVDKHS

SEQ ID NO: 1049011 - protein, 17 aa, Mycobacterium
LDFTFGGLPAYQQRLGR

SEQ ID NO: 1049012 - protein, 17 aa, Mycobacterium
LDGAQILADRLNQPDVA

SEQ ID NO: 1049013 - protein, 24 aa, Mycobacterium
LDGDARGGAALSVREVTGVPILFA

SEQ ID NO: 1049014 - protein, 24 aa, Mycobacterium
LDGDFPVAIPLPIVPAGPIRARVN

SEQ ID NO: 1049015 - protein, 20 aa, Mycobacterium
LDGFCSASLMVDHPACRRAV

SEQ ID NO: 1049016 - protein, 18 aa, Mycobacterium
LDGGFGVGNTHLLASSYY

SEQ ID NO: 1049017 - protein, 25 aa, Mycobacterium
LDGLKPGGLLLLRIPDRDAVYGWTT

SEQ ID NO: 1049018 - protein, 25 aa, Mycobacterium
LDGLQCPQGVAICDRQVYVIDSGAK

SEQ ID NO: 1049019 - protein, 19 aa, Mycobacterium
LDGSAEWVPKVWRDMDTRM

SEQ ID NO: 1049020 - protein, 17 aa, Mycobacterium
LDGSLGMREAPGRGTDV

SEQ ID NO: 1049021 - protein, 17 aa, Mycobacterium
LDGTETFDVTGIEELNS

SEQ ID NO: 1049022 - protein, 21 aa, Mycobacterium
LDGVDAFAAHLVVSYRIEALP

SEQ ID NO: 1049023 - protein, 18 aa, Mycobacterium
LDGVRFIGINGGPPFPFT

SEQ ID NO: 1049024 - protein, 17 aa, Mycobacterium
LDGYEFVTGCNDFGGGL

SEQ ID NO: 1049025 - protein, 22 aa, Mycobacterium
LDGYRDSWRYGVSMLARALTGA

SEQ ID NO: 1049026 - protein, 24 aa, Mycobacterium
LDHAMWFMRGFRADEWLLYDQSSP

SEQ ID NO: 1049027 - protein, 25 aa, Mycobacterium
LDHIVAHPIIRWVGSANELNAGYAA

SEQ ID NO: 1049028 - protein, 18 aa, Mycobacterium
LDHLLPVPGSRVITVSSL

SEQ ID NO: 1049029 - protein, 18 aa, Mycobacterium
LDHLRHLGRIPATMRYTA

SEQ ID NO: 1049030 - protein, 25 aa, Mycobacterium
LDHMPEQYQLPGIVHGLRWIADGDY

SEQ ID NO: 1049031 - protein, 21 aa, Mycobacterium
LDIARTSLLTAGWPETVPGVT

SEQ ID NO: 1049032 - protein, 20 aa, Mycobacterium
LDIGCGWGATMRRAIEKYDV

SEQ ID NO: 1049033 - protein, 19 aa, Mycobacterium
LDIGCGWGSTMRHAIEEYD

SEQ ID NO: 1049034 - protein, 19 aa, Mycobacterium
LDIGCGWGTTMKRAVERFD

SEQ ID NO: 1049035 - protein, 24 aa, Mycobacterium
LDIGLRGFLPASLVEMRRVRDLQP

SEQ ID NO: 1049036 - protein, 18 aa, Mycobacterium
LDILADWPVDELPKAALY

SEQ ID NO: 1049037 - protein, 17 aa, Mycobacterium
LDIPITGTLGVFTVGGF

SEQ ID NO: 1049038 - protein, 31 aa, Mycobacterium; identical to SEQ ID NO: 622303

SEQ ID NO: 1049039 - protein, 17 aa, Mycobacterium
LDKARRLLWPVKQKYGS

SEQ ID NO: 1049040 - protein, 19 aa, Mycobacterium
LDKDHVWLNGQVTPIDQLE

SEQ ID NO: 1049041 - protein, 21 aa, Mycobacterium
LDKIFYRSGTGVTLQATAYSN

SEQ ID NO: 1049042 - protein, 17 aa, Mycobacterium
LDKMGWRSSDTAELSYT

SEQ ID NO: 1049043 - protein, 17 aa, Mycobacterium
LDLCAGPGGKTALLAAL

SEQ ID NO: 1049044 - protein, 19 aa, Mycobacterium
LDLDAGYWRAGGRVKVGPK

SEQ ID NO: 1049045 - protein, 22 aa, Mycobacterium
LDLDLASYVLEWHARVPDWRDY

SEQ ID NO: 1049046 - protein, 23 aa, Mycobacterium
LDLEVIDAFLSWYVPDLDVSDHT

SEQ ID NO: 1049047 - protein, 18 aa, Mycobacterium
LDLGCWYPTGEAVAAIDS

SEQ ID NO: 1049048 - protein, 21 aa, Mycobacterium
LDLKAARLLPAGRMDDEEDLA

SEQ ID NO: 1049049 - protein, 26 aa, Mycobacterium
LDLLVPRDGTADWKHRLTQAGVRPAG

SEQ ID NO: 1049050 - protein, 17 aa, Mycobacterium
LDLRIAALATKLAGFGP

SEQ ID NO: 1049051 - protein, 26 aa, Mycobacterium
LDLSKLARPTSTWTYMVNDNPLSDDT

SEQ ID NO: 1049052 - protein, 24 aa, Mycobacterium
LDLTGRRAASAGAHRVAVVRLPRI

SEQ ID NO: 1049053 - protein, 18 aa, Mycobacterium
LDLTTFWAGPSCTHLLAM

SEQ ID NO: 1049054 - protein, 17 aa, Mycobacterium
LDLVLAILRARQLFAGA

SEQ ID NO: 1049055 - protein, 30 aa, Mycobacterium
LDMKVGVRLAARARHIPVLMATSDRGLVDI

SEQ ID NO: 1049056 - protein, 19 aa, Mycobacterium
LDMPLGLEHICLRRINWLP

SEQ ID NO: 1049057 - protein, 17 aa, Mycobacterium
LDMSVAALAGMRREQSM

SEQ ID NO: 1049058 - protein, 18 aa, Mycobacterium
LDNLTFVGERLFVSSFTG

SEQ ID NO: 1049059 - protein, 18 aa, Mycobacterium
LDNLTFVINCNLQRLDGP

SEQ ID NO: 1049060 - protein, 27 aa, Mycobacterium
LDNPWLTGLCTMRWAGRLLPAASRKLP

SEQ ID NO: 1049061 - protein, 23 aa, Mycobacterium
LDNRAAAALMSRLRGVVERPDPL

SEQ ID NO: 1049062 - protein, 24 aa, Mycobacterium
LDNSRPPTELSFNLGADASQVRCQ

SEQ ID NO: 1049063 - protein, 19 aa, Mycobacterium
LDPALSIGDIVIADRVVQH

SEQ ID NO: 1049064 - protein, 17 aa, Mycobacterium
LDPCCRKASALAGRAQG

SEQ ID NO: 1049065 - protein, 17 aa, Mycobacterium
LDPDCKSLLIHTQHYEV

SEQ ID NO: 1049066 - protein, 17 aa, Mycobacterium
LDPDWLFDIQVKRIHEY

SEQ ID NO: 1049067 - protein, 21 aa, Mycobacterium
LDPEMTSPYAWYQYFINTSDA

SEQ ID NO: 1049068 - protein, 17 aa, Mycobacterium
LDPSHTVGWTLVGDQPE

SEQ ID NO: 1049069 - protein, 25 aa, Mycobacterium
LDPTDRKTVCLFGDSAGAVVVGPTT

SEQ ID NO: 1049070 - protein, 17 aa, Mycobacterium
LDPYAIGVPGVYLCSQS

SEQ ID NO: 1049071 - protein, 17 aa, Mycobacterium
LDQEGRDDLALRIAVQP

SEQ ID NO: 1049072 - protein, 24 aa, Mycobacterium
LDQLSLPVLRSWLATAAGAGAART

SEQ ID NO: 1049073 - protein, 19 aa, Mycobacterium
LDQLVQRAGDLLDANREAI

SEQ ID NO: 1049074 - protein, 25 aa, Mycobacterium
LDQRRPELVSSIGSLARVLERLSAS

SEQ ID NO: 1049075 - protein, 21 aa, Mycobacterium
LDRAHTAAIVWSDEPDGDHGQ

SEQ ID NO: 1049076 - protein, 21 aa, Mycobacterium
LDRALELGADYAFDSRDDQLH

SEQ ID NO: 1049077 - protein, 25 aa, Mycobacterium
LDRGHPLWECYIIDGIEGGRIAIML

SEQ ID NO: 1049078 - protein, 19 aa, Mycobacterium
LDRLAELGVSEIFGVPGDY

SEQ ID NO: 1049079 - protein, 21 aa, Mycobacterium
LDRLFPRSVYYSLRMAEHNLD

SEQ ID NO: 1049080 - protein, 18 aa, Mycobacterium
LDRLTRIRAHWPVGTLPL

SEQ ID NO: 1049081 - protein, 20 aa, Mycobacterium
LDRPFAWALIKLDGADTPLL

SEQ ID NO: 1049082 - protein, 23 aa, Mycobacterium
LDRPLWECWVIEGLEHNRWAILL

SEQ ID NO: 1049083 - protein, 27 aa, Mycobacterium
LDRRGNRHFSFGIGVHRCVGSNVARTV

SEQ ID NO: 1049084 - protein, 23 aa, Mycobacterium
LDRRSRAAGWGVMSNAAHPGLTK

SEQ ID NO: 1049085 - protein, 17 aa, Mycobacterium
LDRSHTAAIIWSDRPNG

SEQ ID NO: 1049086 - protein, 19 aa, Mycobacterium
LDRSRPLWEMWVIEGVAGT

SEQ ID NO: 1049087 - protein, 17 aa, Mycobacterium
LDSFPPGGALVVGNHSG

SEQ ID NO: 1049088 - protein, 25 aa, Mycobacterium
LDSHLPVMCDFWETVLFRAGRYRGS

SEQ ID NO: 1049089 - protein, 20 aa, Mycobacterium
LDSPCAREGDSWELLGNARW

SEQ ID NO: 1049090 - protein, 30 aa, Mycobacterium
LDSRAYRLDWPGGTMVYEIDLPKVLDYKEH

SEQ ID NO: 1049091 - protein, 27 aa, Mycobacterium
LDSRAYRLKWPNGATVFEIDLPKVLEF

SEQ ID NO: 1049092 - protein, 20 aa, Mycobacterium
LDSRFAHFCHELERGTDPLC

SEQ ID NO: 1049093 - protein, 26 aa, Mycobacterium
LDTAGRLGGFLTLRWTYCDPPSELPK

SEQ ID NO: 1049094 - protein, 22 aa, Mycobacterium
LDTDCRVYRVAGLRVADASAMP

SEQ ID NO: 1049095 - protein, 28 aa, Mycobacterium
LDTGRLLPLRRLVTRGAIVIDEPHRPLS

SEQ ID NO: 1049096 - protein, 25 aa, Mycobacterium
LDTRFAQQMKILFPIFTSNDAKEGA

SEQ ID NO: 1049097 - protein, 28 aa, Mycobacterium
LDTRLCHFYRGIGLTIYEGYGLTETSAA

SEQ ID NO: 1049098 - protein, 18 aa, Mycobacterium
LDTWHTLGLCGTGSHDCV

SEQ ID NO: 1049099 - protein, 19 aa, Mycobacterium
LDVAHCVYAGLTTDTGSFR

SEQ ID NO: 1049100 - protein, 18 aa, Mycobacterium
LDVARMVLFGQVGRELVN

SEQ ID NO: 1049101 - protein, 20 aa, Mycobacterium
LDVASLDFAGPMRRAEILKA

SEQ ID NO: 1049102 - protein, 26 aa, Mycobacterium
LDVDGGKGWPAQWYHGAPGIGLGRIG

SEQ ID NO: 1049103 - protein, 18 aa, Mycobacterium
LDVEFSVAAGEVLAILGP

SEQ ID NO: 1049104 - protein, 18 aa, Mycobacterium
LDVGCGHGALSIDIAQAG

SEQ ID NO: 1049105 - protein, 19 aa, Mycobacterium
LDVLERRAATFAEVQEHYY

SEQ ID NO: 1049106 - protein, 25 aa, Mycobacterium
LDVRRCPRNILTFSHGAHHCLGAAA

SEQ ID NO: 1049107 - protein, 25 aa, Mycobacterium
LDVTGARIGEHWRIGADGLVLEVSA

SEQ ID NO: 1049108 - protein, 26 aa, Mycobacterium
LDVTLRGAVSIARRLQDPLAELVKIE

SEQ ID NO: 1049109 - protein, 25 aa, Mycobacterium
LDWDDELLSFFSIPRAMLPAIASSS

SEQ ID NO: 1049110 - protein, 25 aa, Mycobacterium
LDWDDELLSFFSIPRAMLPAIEPSS

SEQ ID NO: 1049111 - protein, 22 aa, Mycobacterium
LDWSDAPFANWFVGGKLNVAYN

SEQ ID NO: 1049112 - protein, 17 aa, Mycobacterium
LDYADLVADRERLLNLK

SEQ ID NO: 1049113 - protein, 23 aa, Mycobacterium
LDYDCPRAVLDKATLITPGLESP

SEQ ID NO: 1049114 - protein, 19 aa, Mycobacterium
LDYFPEDFLLVIDESHVTV

SEQ ID NO: 1049115 - protein, 17 aa, Mycobacterium
LDYRGKRVLIIGSGATA

SEQ ID NO: 1049116 - protein, 17 aa, Mycobacterium
LDYRSRRSMMTFKTDHF

SEQ ID NO: 1049117 - protein, 25 aa, Mycobacterium
LEADSFSGWFLTVLGAARVAFAQFT

SEQ ID NO: 1049118 - protein, 22 aa, Mycobacterium
LEAFANFGFPESHALSFASLVF

SEQ ID NO: 1049119 - protein, 22 aa, Mycobacterium
LEAFQSGLSWLIILRKRENFRR

SEQ ID NO: 1049120 - protein, 24 aa, Mycobacterium
LEAGSKVKVTIMFRGREQSRPELG

SEQ ID NO: 1049121 - protein, 18 aa, Mycobacterium
LEAIAFGSIPRYTALKEH

SEQ ID NO: 1049122 - protein, 26 aa, Mycobacterium
LEAKPVLWRLIATITRQWIDTTRELI

SEQ ID NO: 1049123 - protein, 22 aa, Mycobacterium
LEALDSWPVNIALLGKGNTVNP

SEQ ID NO: 1049124 - protein, 19 aa, Mycobacterium
LEALQWRGDNIAKLPTPTS

SEQ ID NO: 1049125 - protein, 30 aa, Mycobacterium; identical to SEQ ID NO: 689032

SEQ ID NO: 1049126 - protein, 21 aa, Mycobacterium
LEAPTAWLFGPEAHGLSAEVA

SEQ ID NO: 1049127 - protein, 25 aa, Mycobacterium
LEARANRLVHRFRRAGLREGDAVAI

SEQ ID NO: 1049128 - protein, 23 aa, Mycobacterium
LEARGKTAMLAKVRRAPALIKVE

SEQ ID NO: 1049129 - protein, 17 aa, Mycobacterium
LEARIDSLAARNSKLME

SEQ ID NO: 1049130 - protein, 22 aa, Mycobacterium
LEAVAVCRRAGIPVIADGGLQY

SEQ ID NO: 1049131 - protein, 18 aa, Mycobacterium
LEAVRKRPGMYIGSTGER

SEQ ID NO: 1049132 - protein, 18 aa, Mycobacterium
LEAYRRLATATSDSGVAA

SEQ ID NO: 1049133 - protein, 17 aa, Mycobacterium
LECTMAGMATCTLTHLI

SEQ ID NO: 1049134 - protein, 25 aa, Mycobacterium
LEDAEFGLACAIGIAPCMHAGQGCA

SEQ ID NO: 1049135 - protein, 17 aa, Mycobacterium
LEDFDVFHPDRMASRIL

SEQ ID NO: 1049136 - protein, 23 aa, Mycobacterium
LEDGRFAFYIKVHHTVVDGVAGF

SEQ ID NO: 1049137 - protein, 25 aa, Mycobacterium
LEDGSTWRVEIERAHMEEDTGKLTH

SEQ ID NO: 1049138 - protein, 19 aa, Mycobacterium
LEDLRGAVRVRVIDDIIMM

SEQ ID NO: 1049139 - protein, 29 aa, Mycobacterium
LEDPQLIARKLFRDMTHPLIARPLPAETG

SEQ ID NO: 1049140 - protein, 18 aa, Mycobacterium
LEDSNSWMSRLGRSELNY

SEQ ID NO: 1049141 - protein, 19 aa, Mycobacterium
LEDSNSWMSRLGRSELNYG

SEQ ID NO: 1049142 - protein, 17 aa, Mycobacterium
LEEARPWAHRHPATPPA

SEQ ID NO: 1049143 - protein, 23 aa, Mycobacterium
LEEFDEYLALQCGRSAHTRRAYL

SEQ ID NO: 1049144 - protein, 25 aa, Mycobacterium
LEESFAERGVRLFKNARAQSVTRTE

SEQ ID NO: 1049145 - protein, 22 aa, Mycobacterium
LEFIQFHPTMLFAAGTGTGGRR

SEQ ID NO: 1049146 - protein, 17 aa, Mycobacterium
LEFKARVLQRHGVEPKA

SEQ ID NO: 1049147 - protein, 23 aa, Mycobacterium
LEFRVLRDRLFDTLAAVEPEVDQ

SEQ ID NO: 1049148 - protein, 30 aa, Mycobacterium; identical to SEQ ID NO: 689198

SEQ ID NO: 1049149 - protein, 18 aa, Mycobacterium
LEGASATELLQWTDETFG

SEQ ID NO: 1049150 - protein, 17 aa, Mycobacterium
LEGDIPTGGLAWCGAPV

SEQ ID NO: 1049151 - protein, 18 aa, Mycobacterium
LEGFRPGVMERMGLGPED

SEQ ID NO: 1049152 - protein, 17 aa, Mycobacterium
LEGGEAFTAEEQPAELD

SEQ ID NO: 1049153 - protein, 17 aa, Mycobacterium
LEGGNPVAMPWQDSVNA

SEQ ID NO: 1049154 - protein, 17 aa, Mycobacterium
LEGKLAKVRFVVQNEQR

SEQ ID NO: 1049155 - protein, 20 aa, Mycobacterium
LEGKTLPGIEVLGRPQPGQT

SEQ ID NO: 1049156 - protein, 17 aa, Mycobacterium
LEGLFARLAAGSTPDSN

SEQ ID NO: 1049157 - protein, 27 aa, Mycobacterium
LEGPSYTRPPSWRGLDVPEILLSGDHA

SEQ ID NO: 1049158 - protein, 18 aa, Mycobacterium
LEGRIALEDILKRFPEWD

SEQ ID NO: 1049159 - protein, 22 aa, Mycobacterium
LEGVRLGKGLGFYDRSLTNRNP

SEQ ID NO: 1049160 - protein, 18 aa, Mycobacterium
LEHICLRRINWLPKSENM

SEQ ID NO: 1049161 - protein, 26 aa, Mycobacterium
LEHTPLKMCWVPGYSDYYSEAPGGRS

SEQ ID NO: 1049162 - protein, 17 aa, Mycobacterium
LEIAKEMQFMIERIYIY

SEQ ID NO: 1049163 - protein, 26 aa, Mycobacterium
LEIDRHWPALCRVVERPDWLADPRYG

SEQ ID NO: 1049164 - protein, 23 aa, Mycobacterium
LEIGTGWGELCIRAASRGAQVRS

SEQ ID NO: 1049165 - protein, 17 aa, Mycobacterium
LEILPAKQREILILRVV

SEQ ID NO: 1049166 - protein, 25 aa, Mycobacterium
LEIVRPRLVVALGRDGERVLTFFYP

SEQ ID NO: 1049167 - protein, 24 aa, Mycobacterium
LEKAKAMGAMALFGECYPDEVRVV

SEQ ID NO: 1049168 - protein, 17 aa, Mycobacterium
LEKEMIDTCRRLLDTYH

SEQ ID NO: 1049169 - protein, 20 aa, Mycobacterium
LEKHGPPVYVRHEIVHNRHV

SEQ ID NO: 1049170 - protein, 17 aa, Mycobacterium
LELAHRFFMPLGDHMRE

SEQ ID NO: 1049171 - protein, 21 aa, Mycobacterium
LELAMPILPQQALLYRLCGDR

SEQ ID NO: 1049172 - protein, 20 aa, Mycobacterium
LELAWTTGLVRWEDDPQPGW

SEQ ID NO: 1049173 - protein, 28 aa, Mycobacterium
LELGFRSSIQKEWEWRISRGESLKNLEA

SEQ ID NO: 1049174 - protein, 25 aa, Mycobacterium
LELIDRIGVGKVMWSSDYPHNESTS

SEQ ID NO: 1049175 - protein, 17 aa, Mycobacterium
LELIGLMGVPPRDWDQE

SEQ ID NO: 1049176 - protein, 19 aa, Mycobacterium
LELLRRVQNRIGRQVWLID

SEQ ID NO: 1049177 - protein, 17 aa, Mycobacterium
LELPKIGVDLENIAAAL

SEQ ID NO: 1049178 - protein, 18 aa, Mycobacterium
LELSHAWDAATLRVVSKA

SEQ ID NO: 1049179 - protein, 17 aa, Mycobacterium
LELSTGVAVAFPRSPFV

SEQ ID NO: 1049180 - protein, 20 aa, Mycobacterium
LELSVALALLPVLPGLAQGR

SEQ ID NO: 1049181 - protein, 25 aa, Mycobacterium
LELYFRRAGAWLALLHCLAATDMHH

SEQ ID NO: 1049182 - protein, 20 aa, Mycobacterium
LELYRRLPGDLSVLTPSPAS

SEQ ID NO: 1049183 - protein, 17 aa, Mycobacterium
LEMLPVECVARGYLTGS

SEQ ID NO: 1049184 - protein, 19 aa, Mycobacterium
LEMNTRLQVEHPVTEETTG

SEQ ID NO: 1049185 - protein, 19 aa, Mycobacterium
LENRFVGRVGLFRNQPGDI

SEQ ID NO: 1049186 - protein, 17 aa, Mycobacterium
LEPDFVAQAGFSLQQTL

SEQ ID NO: 1049187 - protein, 18 aa, Mycobacterium
LEPERIGVTLSEELQLHP

SEQ ID NO: 1049188 - protein, 24 aa, Mycobacterium
LEPETFAGLISLRLPSEEELAEAG

SEQ ID NO: 1049189 - protein, 17 aa, Mycobacterium
LEPGIYEWRVEVEGYAR

SEQ ID NO: 1049190 - protein, 17 aa, Mycobacterium
LEPPAGPALGLNLGNWC

SEQ ID NO: 1049191 - protein, 17 aa, Mycobacterium
LEPPVQLAGRMARKDTE

SEQ ID NO: 1049192 - protein, 20 aa, Mycobacterium
LEPRPTILGERTSISFRQGA

SEQ ID NO: 1049193 - protein, 25 aa, Mycobacterium
LEPTARRVLAHFGLDAHFEVIAGAT

SEQ ID NO: 1049194 - protein, 23 aa, Mycobacterium
LEQAVGLFIDRGFHSVKLEDIAE

SEQ ID NO: 1049195 - protein, 21 aa, Mycobacterium
LEQHFGHLVDYGFTAAMEDEL

SEQ ID NO: 1049196 - protein, 22 aa, Mycobacterium
LEQICRPEVTAQLARWDGGVAL

SEQ ID NO: 1049197 - protein, 20 aa, Mycobacterium
LEQQVCFALAITNRAVLAVY

SEQ ID NO: 1049198 - protein, 20 aa, Mycobacterium
LEQRASALGVDLRWGDELTG

SEQ ID NO: 1049199 - protein, 19 aa, Mycobacterium
LEQTRISGVLINLRPDRPA

SEQ ID NO: 1049200 - protein, 18 aa, Mycobacterium
LERLACGEPANAPEDDAA

SEQ ID NO: 1049201 - protein, 23 aa, Mycobacterium
LERLGKVWAAMAITEPAFGSDSA

SEQ ID NO: 1049202 - protein, 21 aa, Mycobacterium
LERLKGLFLASFEAIEHRHAQ

SEQ ID NO: 1049203 - protein, 26 aa, Mycobacterium
LERLRPGDFYRPAHQNIYDAILDLYG

SEQ ID NO: 1049204 - protein, 34 aa, Mycobacterium
LERLYPRTAAELFSWGRSWLETCQNAFANLDVDP

SEQ ID NO: 1049205 - protein, 18 aa, Mycobacterium
LERRGFLEVETPMLQTLA

SEQ ID NO: 1049206 - protein, 24 aa, Mycobacterium
LESAAKWREIFGADNYFLELMDHG

SEQ ID NO: 1049207 - protein, 17 aa, Mycobacterium
LESAAVSEVRWNAVVLA

SEQ ID NO: 1049208 - protein, 18 aa, Mycobacterium
LESALLDCYLSCHEEDAL

SEQ ID NO: 1049209 - protein, 17 aa, Mycobacterium
LESEALAAVCPIFRDAE

SEQ ID NO: 1049210 - protein, 25 aa, Mycobacterium
LESLRARFGTLTGVERPVATGDFIS

SEQ ID NO: 1049211 - protein, 21 aa, Mycobacterium
LESRLDNVVYRAGLARTRRMA

SEQ ID NO: 1049212 - protein, 19 aa, Mycobacterium
LESTGIFLIYAALYQLAKH

SEQ ID NO: 1049213 - protein, 19 aa, Mycobacterium
LESTMRFILSAKSAYVNGQ

SEQ ID NO: 1049214 - protein, 17 aa, Mycobacterium
LETEGHRILKLNIGNPA

SEQ ID NO: 1049215 - protein, 23 aa, Mycobacterium
LETHLGWVAKSGWNIDVANGVPE

SEQ ID NO: 1049216 - protein, 17 aa, Mycobacterium
LETLRKLARDCEVDEHV

SEQ ID NO: 1049217 - protein, 20 aa, Mycobacterium
LETPTPYFAVGQGYDNFTQT

SEQ ID NO: 1049218 - protein, 21 aa, Mycobacterium
LETRIPLSYEHYRRLHNLTLP

SEQ ID NO: 1049219 - protein, 17 aa, Mycobacterium
LEVADGMLTVFVGPSGC

SEQ ID NO: 1049220 - protein, 19 aa, Mycobacterium
LEVAIRCMIEEPFAGFTGD

SEQ ID NO: 1049221 - protein, 28 aa, Mycobacterium
LEVAPGKVLSGWGAILLMFDVIQLSATS

SEQ ID NO: 1049222 - protein, 21 aa, Mycobacterium
LEVDRDCFARIASGLPSNVIR

SEQ ID NO: 1049223 - protein, 22 aa, Mycobacterium
LEVEPFEAMIVFVRTKQATEEV

SEQ ID NO: 1049224 - protein, 19 aa, Mycobacterium
LEVFTGVNLAIDRGSRVVV

SEQ ID NO: 1049225 - protein, 19 aa, Mycobacterium
LEVGLPQPIVDIFATHHLA

SEQ ID NO: 1049226 - protein, 23 aa, Mycobacterium
LEVLRPLVRDALARGDLRADSDT

SEQ ID NO: 1049227 - protein, 17 aa, Mycobacterium
LEVPGNIYTRLGNPTTD

SEQ ID NO: 1049228 - protein, 18 aa, Mycobacterium
LEVSWEALERSGIDPTTL

SEQ ID NO: 1049229 - protein, 17 aa, Mycobacterium
LEYALAHDERFGIWGGL

SEQ ID NO: 1049230 - protein, 19 aa, Mycobacterium
LEYGPALIRARLAELGAAA

SEQ ID NO: 1049231 - protein, 24 aa, Mycobacterium
LEYLEMFYNLGIAGRAMRRIGAIE

SEQ ID NO: 1049232 - protein, 17 aa, Mycobacterium
LFAAIVVLMQWGDKHLP

SEQ ID NO: 1049233 - protein, 19 aa, Mycobacterium
LFAGRGVIDVQQWGVAPDG

SEQ ID NO: 1049234 - protein, 18 aa, Mycobacterium
LFAQRCIAGLTANAEHLR

SEQ ID NO: 1049235 - protein, 17 aa, Mycobacterium
LFARCLVEGFDEILVLA

SEQ ID NO: 1049236 - protein, 19 aa, Mycobacterium
LFASWRSDPSFVLNLSPFD

SEQ ID NO: 1049237 - protein, 17 aa, Mycobacterium
LFDFFFLAEGLRLREHR

SEQ ID NO: 1049238 - protein, 24 aa, Mycobacterium
LFDGSDTVTLVWLGQRRIPGIDSG

SEQ ID NO: 1049239 - protein, 20 aa, Mycobacterium
LFDNELIPIAGLTHDEIIRP

SEQ ID NO: 1049240 - protein, 18 aa, Mycobacterium
LFDTALIVNQAFLAPARI

SEQ ID NO: 1049241 - protein, 28 aa, Mycobacterium
LFEELLGRFGVVLVGQPVEWTRSNRHTG

SEQ ID NO: 1049242 - protein, 25 aa, Mycobacterium
LFEGEGFSSILSRNIIEISYSTLSE

SEQ ID NO: 1049243 - protein, 25 aa, Mycobacterium
LFEGEGFSSILSRNIIEISYSTPSE

SEQ ID NO: 1049244 - protein, 17 aa, Mycobacterium
LFFANLVDHCLATRRDE

SEQ ID NO: 1049245 - protein, 25 aa, Mycobacterium
LFFSLPWYYRSGYDVLLYTLPFHGK

SEQ ID NO: 1049246 - protein, 24 aa, Mycobacterium
LFGAGKMFLPQVVKSARVMKKAVA

SEQ ID NO: 1049247 - protein, 19 aa, Mycobacterium
LFGMFSRSHVFPIGQFADG

SEQ ID NO: 1049248 - protein, 17 aa, Mycobacterium
LFGSHGQAFQALSAQAE

SEQ ID NO: 1049249 - protein, 19 aa, Mycobacterium
LFGWTGWSVGAVVRGEPSA

SEQ ID NO: 1049250 - protein, 18 aa, Mycobacterium
LFHRLTVQSAIGRRVERF

SEQ ID NO: 1049251 - protein, 20 aa, Mycobacterium
LFITGRIKDLLIVDGSNHYP

SEQ ID NO: 1049252 - protein, 18 aa, Mycobacterium
LFLDELWPDFTREHLENA

SEQ ID NO: 1049253 - protein, 27 aa, Mycobacterium
LFLKDGRLHYVYNWLGERIQTISAPEP

SEQ ID NO: 1049254 - protein, 26 aa, Mycobacterium
LFLRVDRLQFFVSCLVYLPRDRYTTA

SEQ ID NO: 1049255 - protein, 19 aa, Mycobacterium
LFNALHAKIDFGSLAKTLT

SEQ ID NO: 1049256 - protein, 17 aa, Mycobacterium
LFNEDFAGLVVSGDDAW

SEQ ID NO: 1049257 - protein, 17 aa, Mycobacterium
LFNVKVGGARRCAAQSW

SEQ ID NO: 1049258 - protein, 22 aa, Mycobacterium
LFPHAVRWRGVIYLEAGLHRAV

SEQ ID NO: 1049259 - protein, 19 aa, Mycobacterium
LFPLIARSYALQFAQNELV

SEQ ID NO: 1049260 - protein, 17 aa, Mycobacterium
LFPTADGYLGLFVTHDG

SEQ ID NO: 1049261 - protein, 20 aa, Mycobacterium
LFQPSYRYASAVRHEIGVPT

SEQ ID NO: 1049262 - protein, 18 aa, Mycobacterium
LFQSHMWDGSAVPIDENL

SEQ ID NO: 1049263 - protein, 31 aa, Mycobacterium
LFQWLTEMYPVWGRLDAELEFAAASAGLAGL

SEQ ID NO: 1049264 - protein, 18 aa, Mycobacterium
LFRQLEYFVAVAQERHFA

SEQ ID NO: 1049265 - protein, 18 aa, Mycobacterium
LFRRLSFDLISIPTDIVA

SEQ ID NO: 1049266 - protein, 20 aa, Mycobacterium
LFRTECPDNVVVLDRCGSHQ

SEQ ID NO: 1049267 - protein, 18 aa, Mycobacterium
LFRYPGIRSDSDLHTFSY

SEQ ID NO: 1049268 - protein, 27 aa, Mycobacterium
LFTGDCLFPGGVGKTWQPGDFTQLVED

SEQ ID NO: 1049269 - protein, 19 aa, Mycobacterium
LFTNWPRPVLATVAGDELQ

SEQ ID NO: 1049270 - protein, 20 aa, Mycobacterium
LFTRDGWMRMGDICEIDPDG

SEQ ID NO: 1049271 - protein, 26 aa, Mycobacterium
LFTYRPEYRGALQLVPGAQTIALAPL

SEQ ID NO: 1049272 - protein, 20 aa, Mycobacterium
LFVGECRDGGRLLELDLNGG

SEQ ID NO: 1049273 - protein, 18 aa, Mycobacterium
LGAAMARLAEAESTMIRA

SEQ ID NO: 1049274 - protein, 19 aa, Mycobacterium
LGADLLAVVARLNRLATQR

SEQ ID NO: 1049275 - protein, 20 aa, Mycobacterium
LGAFAARLWLPMLRAERDPG

SEQ ID NO: 1049276 - protein, 21 aa, Mycobacterium
LGALRAALVGELVDLAADPPA

SEQ ID NO: 1049277 - protein, 25 aa, Mycobacterium
LGAMLRRLEPDWSITLIERLDAVAA

SEQ ID NO: 1049278 - protein, 18 aa, Mycobacterium
LGANATVFAAAWGTTVGR

SEQ ID NO: 1049279 - protein, 19 aa, Mycobacterium
LGANLARLELRVLFEELLG

SEQ ID NO: 1049280 - protein, 21 aa, Mycobacterium
LGANLARREIRVVFDELRRQM

SEQ ID NO: 1049281 - protein, 20 aa, Mycobacterium
LGAPCWIDLTTSDIDRAQDF

SEQ ID NO: 1049282 - protein, 17 aa, Mycobacterium
LGAPLAQGIPAFGDSIG

SEQ ID NO: 1049283 - protein, 18 aa, Mycobacterium
LGAPRIAERFTELTREVP

SEQ ID NO: 1049284 - protein, 24 aa, Mycobacterium
LGAQCNIEHGCVVAQADTLRGAEI

SEQ ID NO: 1049285 - protein, 24 aa, Mycobacterium
LGAQMPMRVIGMLLGVPEEDQEAA

SEQ ID NO: 1049286 - protein, 20 aa, Mycobacterium
LGAQRGMIADSWQLMSNPNM

SEQ ID NO: 1049287 - protein, 23 aa, Mycobacterium
LGARFTDFAGWQMPVRCGSEVTE

SEQ ID NO: 1049288 - protein, 26 aa, Mycobacterium
LGARLHARLGALIGEGVLEVRGLGLW

SEQ ID NO: 1049289 - protein, 25 aa, Mycobacterium
LGARRFDPRLGRTPLSRIWTQFSDS

SEQ ID NO: 1049290 - protein, 20 aa, Mycobacterium
LGARVMRAAVAAARNMARSG

SEQ ID NO: 1049291 - protein, 23 aa, Mycobacterium
LGATALRPAPVGAYPAGASAYGA

SEQ ID NO: 1049292 - protein, 28 aa, Mycobacterium
LGCAAPRKAVTAAMICIKLLGSRVSENC

SEQ ID NO: 1049293 - protein, 19 aa, Mycobacterium
LGCKEALFTLGDRPEQRWP

SEQ ID NO: 1049294 - protein, 19 aa, Mycobacterium
LGDALGFDVDTPWRKLPAK

SEQ ID NO: 1049295 - protein, 17 aa, Mycobacterium
LGDGNAFLDGQIQQVSS

SEQ ID NO: 1049296 - protein, 23 aa, Mycobacterium
LGDGRQWLSWIGIDDLVDVYHRA

SEQ ID NO: 1049297 - protein, 18 aa, Mycobacterium
LGDLLPMTTIPGQISQNM

SEQ ID NO: 1049298 - protein, 20 aa, Mycobacterium
LGDPPYYAFRIVLGDLGTSG

SEQ ID NO: 1049299 - protein, 20 aa, Mycobacterium
LGDPSGFVKLVADGKHGELL

SEQ ID NO: 1049300 - protein, 24 aa, Mycobacterium
LGDPVCKPAALAKLVHTREPDVID

SEQ ID NO: 1049301 - protein, 25 aa, Mycobacterium
LGDRLRLALDSSLCGAVTGAPAALA

SEQ ID NO: 1049302 - protein, 18 aa, Mycobacterium
LGDTFRWKGENVATTQVE

SEQ ID NO: 1049303 - protein, 26 aa, Mycobacterium
LGDYRMLPRATFCQPQVASFGLTEQQ

SEQ ID NO: 1049304 - protein, 17 aa, Mycobacterium
LGEEGIYIVTWTDLDQA

SEQ ID NO: 1049305 - protein, 18 aa, Mycobacterium
LGEEGIYIVTWTDLDQAE

SEQ ID NO: 1049306 - protein, 32 aa, Mycobacterium
LGEGPAQGWEHGRFSAPYLRDSLLAASALCET

SEQ ID NO: 1049307 - protein, 23 aa, Mycobacterium
LGEGWFINQHIIWQVGDEDVAEM

SEQ ID NO: 1049308 - protein, 22 aa, Mycobacterium
LGEMCGLAGIAMERATQALLQA

SEQ ID NO: 1049309 - protein, 21 aa, Mycobacterium
LGEQFMQWFLQEQIEEVALMA

SEQ ID NO: 1049310 - protein, 17 aa, Mycobacterium
LGERAEEFLALKVEGIL

SEQ ID NO: 1049311 - protein, 17 aa, Mycobacterium
LGERDIEGPFAIQELTL

SEQ ID NO: 1049312 - protein, 33 aa, Mycobacterium; identical to SEQ ID NO: 690347

SEQ ID NO: 1049313 - protein, 23 aa, Mycobacterium
LGEVPKRREEVIGQVANVVVEEI

SEQ ID NO: 1049314 - protein, 19 aa, Mycobacterium
LGEWGIRWIPELGDEDLDP

SEQ ID NO: 1049315 - protein, 19 aa, Mycobacterium
LGFALPSMLLPMWDSELGT

SEQ ID NO: 1049316 - protein, 20 aa, Mycobacterium
LGFDTRSTWIAPVLNAFLPG

SEQ ID NO: 1049317 - protein, 30 aa, Mycobacterium
LGFPFTDHGLRLGVEASLRSLARVAPTQRH

SEQ ID NO: 1049318 - protein, 18 aa, Mycobacterium
LGFSPELVTAVSPSGVVV

SEQ ID NO: 1049319 - protein, 17 aa, Mycobacterium
LGFVEAQGGGTILLARG

SEQ ID NO: 1049320 - protein, 17 aa, Mycobacterium
LGGAFAGGGGDGGAGAV

SEQ ID NO: 1049321 - protein, 17 aa, Mycobacterium
LGGAGGNAGGLFGSGGA

SEQ ID NO: 1049322 - protein, 18 aa, Mycobacterium
LGGAVFFDEMHTLHEKGY

SEQ ID NO: 1049323 - protein, 22 aa, Mycobacterium
LGGFAWKIALGLPGSLGAPRPR

SEQ ID NO: 1049324 - protein, 17 aa, Mycobacterium
LGGHVWADGGIRHPRDV

SEQ ID NO: 1049325 - protein, 19 aa, Mycobacterium
LGGLCPSTPVSDWLFTDTA

SEQ ID NO: 1049326 - protein, 19 aa, Mycobacterium
LGGLEKLAMLGVTWVHVGL

SEQ ID NO: 1049327 - protein, 24 aa, Mycobacterium
LGGLKVTTANAWFAARPSGTEDVY

SEQ ID NO: 1049328 - protein, 18 aa, Mycobacterium
LGGMDYLSPERVELRYTM

SEQ ID NO: 1049329 - protein, 25 aa, Mycobacterium
LGGNGGDATGFGMTGGDGAMGGAVT

SEQ ID NO: 1049330 - protein, 17 aa, Mycobacterium
LGGPIAGGPVPPGSIPH

SEQ ID NO: 1049331 - protein, 17 aa, Mycobacterium
LGGRAGYYDGIGAARDV

SEQ ID NO: 1049332 - protein, 17 aa, Mycobacterium
LGGRPVRVPAAAASVAS

SEQ ID NO: 1049333 - protein, 26 aa, Mycobacterium
LGGRWADSFGGLVFDATGITDPAGLK

SEQ ID NO: 1049334 - protein, 34 aa, Mycobacterium
LGGSYAIQIAKRWLFPELRFDEHLIIGEYLLLIK

SEQ ID NO: 1049335 - protein, 18 aa, Mycobacterium
LGGTIGWADPESGSAFGY

SEQ ID NO: 1049336 - protein, 18 aa, Mycobacterium
LGGVLYLFVRGMCGPDTP

SEQ ID NO: 1049337 - protein, 18 aa, Mycobacterium
LGGVYDRLAARGYEYGPA

SEQ ID NO: 1049338 - protein, 17 aa, Mycobacterium
LGHKAVLDVARGQVRAL

SEQ ID NO: 1049339 - protein, 18 aa, Mycobacterium
LGHQLGLPAGIASDGSEV

SEQ ID NO: 1049340 - protein, 21 aa, Mycobacterium
LGHSRKGLFLVHADAVDSVLG

SEQ ID NO: 1049341 - protein, 22 aa, Mycobacterium
LGHSRKGLFLVHADAVDSVLGT

SEQ ID NO: 1049342 - protein, 17 aa, Mycobacterium
LGHVLLCTQRVARRLVA

SEQ ID NO: 1049343 - protein, 20 aa, Mycobacterium
LGIAQWCFDTTLAYTKQRKQ

SEQ ID NO: 1049344 - protein, 28 aa, Mycobacterium
LGIEFPIFAFTHCRDVVLAVSKAGGFGV

SEQ ID NO: 1049345 - protein, 17 aa, Mycobacterium
LGIGFGNMVQTRAFLTE

SEQ ID NO: 1049346 - protein, 22 aa, Mycobacterium
LGIPELRAAIAADYHRQHGISV

SEQ ID NO: 1049347 - protein, 25 aa, Mycobacterium
LGIPVGRAVQSWDVLAQFGNMLSVS

SEQ ID NO: 1049348 - protein, 19 aa, Mycobacterium
LGIVPLLLLDMWEHAFYLQ

SEQ ID NO: 1049349 - protein, 22 aa, Mycobacterium
LGKDGGTMPITLWIVDTSAQAP

SEQ ID NO: 1049350 - protein, 23 aa, Mycobacterium
LGKHLGVGVTSIYWYFRKKDDLL

SEQ ID NO: 1049351 - protein, 22 aa, Mycobacterium
LGKKLRAGIELEDGPVRVDGFA

SEQ ID NO: 1049352 - protein, 26 aa, Mycobacterium
LGKSMRIFKSEMREMQSETKAEPSAI

SEQ ID NO: 1049353 - protein, 28 aa, Mycobacterium
LGKTPPGHLWRWELTPISGTRTLVTHTY

SEQ ID NO: 1049354 - protein, 31 aa, Mycobacterium
LGLDFMRSCSIKHQMASVIFSLEMSKTEIVM

SEQ ID NO: 1049355 - protein, 26 aa, Mycobacterium
LGLESCDHFAHRGARRITLVSRSGES

SEQ ID NO: 1049356 - protein, 20 aa, Mycobacterium
LGLHTCWVAEAWGSDAPSAL

SEQ ID NO: 1049357 - protein, 28 aa, Mycobacterium
LGLLGFSVAERFGGPGVNDFRYNAIVID

SEQ ID NO: 1049358 - protein, 27 aa, Mycobacterium
LGLLKGACAQVNMDLGLLAPEKAQAII

SEQ ID NO: 1049359 - protein, 29 aa, Mycobacterium
LGLPTGFDVIRYGNGVNILYADFNTTVDF

SEQ ID NO: 1049360 - protein, 21 aa, Mycobacterium
LGLPVFGICYGFQVMAQALGG

SEQ ID NO: 1049361 - protein, 24 aa, Mycobacterium
LGLQAADVAAHWPVPGPRDDKYTQ

SEQ ID NO: 1049362 - protein, 19 aa, Mycobacterium
LGLQLGYWAAQPPGNAAEL

SEQ ID NO: 1049363 - protein, 17 aa, Mycobacterium
LGLRVLRNIERVIREEM

SEQ ID NO: 1049364 - protein, 18 aa, Mycobacterium
LGLRWPAEIAPFGVHLVI

SEQ ID NO: 1049365 - protein, 17 aa, Mycobacterium
LGLSYLLPRAIGSSRAF

SEQ ID NO: 1049366 - protein, 20 aa, Mycobacterium
LGLTGRPLIGNGANGAAGTG

SEQ ID NO: 1049367 - protein, 19 aa, Mycobacterium
LGLVPRPATDFLDALVSLD

SEQ ID NO: 1049368 - protein, 21 aa, Mycobacterium
LGMEPYDRFWVRDEVTGEEYQ

SEQ ID NO: 1049369 - protein, 17 aa, Mycobacterium
LGMFPLFQYWGPTANIT

SEQ ID NO: 1049370 - protein, 22 aa, Mycobacterium
LGMNDVKTWIAFGASPRASLGI

SEQ ID NO: 1049371 - protein, 23 aa, Mycobacterium
LGNARWLPLVIAHGLLDELVPFP

SEQ ID NO: 1049372 - protein, 20 aa, Mycobacterium
LGNAVKFFAGRLVKAAEREA

SEQ ID NO: 1049373 - protein, 17 aa, Mycobacterium
LGNGGDGGPGIFGGTGG

SEQ ID NO: 1049374 - protein, 24 aa, Mycobacterium
LGNGGGGTGGFGLPPATGGFGGRG

SEQ ID NO: 1049375 - protein, 19 aa, Mycobacterium
LGNLPRLNSAVVRAIGSEL

SEQ ID NO: 1049376 - protein, 22 aa, Mycobacterium
LGPAGRFASIYDRVRAWAAKPG

SEQ ID NO: 1049377 - protein, 18 aa, Mycobacterium
LGPDFLVEVLEIRAALGP

SEQ ID NO: 1049378 - protein, 27 aa, Mycobacterium
LGPGARARFGDVLPFLVKVLAADEPLS

SEQ ID NO: 1049379 - protein, 19 aa, Mycobacterium
LGPGEGFGEQAILRDVPRT

SEQ ID NO: 1049380 - protein, 23 aa, Mycobacterium
LGPIGVDGVGLIGHGGDGGNAGD

SEQ ID NO: 1049381 - protein, 21 aa, Mycobacterium
LGPLRRCRALGTAVGTFLSTL

SEQ ID NO: 1049382 - protein, 30 aa, Mycobacterium
LGPRLSRASACLMLSIPDGSTWALADRRSD

SEQ ID NO: 1049383 - protein, 23 aa, Mycobacterium
LGPSGKRPGAIAERVKKTWELGD

SEQ ID NO: 1049384 - protein, 28 aa, Mycobacterium
LGQMLVKLCLKDGIPLINIVRKPEQEEL

SEQ ID NO: 1049385 - protein, 17 aa, Mycobacterium
LGQRFLLLVDHTRYPPD

SEQ ID NO: 1049386 - protein, 17 aa, Mycobacterium
LGQWPFTSGPGFGHTRN

SEQ ID NO: 1049387 - protein, 20 aa, Mycobacterium
LGQYADWIFCLVRTDPQAPK

SEQ ID NO: 1049388 - protein, 21 aa, Mycobacterium
LGRDDVCYVSMPLFHSNAVLV

SEQ ID NO: 1049389 - protein, 21 aa, Mycobacterium
LGRDFPPGFLFLDPPDHTRLR

SEQ ID NO: 1049390 - protein, 19 aa, Mycobacterium
LGRELGKGAVIVVNLSGRG

SEQ ID NO: 1049391 - protein, 22 aa, Mycobacterium
LGRHQFPLVITDTVAQFLHAVS

SEQ ID NO: 1049392 - protein, 18 aa, Mycobacterium
LGRHRPDRRRWWGGGIIR

SEQ ID NO: 1049393 - protein, 26 aa, Mycobacterium
LGRLAPKARVVLCGVISSYLTGEHPG

SEQ ID NO: 1049394 - protein, 22 aa, Mycobacterium
LGRMILQAGVEGCLREVLVLAA

SEQ ID NO: 1049395 - protein, 26 aa, Mycobacterium
LGRPRADAGIGPRLELLADLVTRPTR

SEQ ID NO: 1049396 - protein, 28 aa, Mycobacterium
LGRPYVWGVTGPDRFDCSGLVQWAYAQA

SEQ ID NO: 1049397 - protein, 19 aa, Mycobacterium
LGRRAEMLLENPVMPGPDR

SEQ ID NO: 1049398 - protein, 22 aa, Mycobacterium
LGRRIALMFASRGGTVRIYARR

SEQ ID NO: 1049399 - protein, 25 aa, Mycobacterium
LGRRVAVVACEFDFLAGSIGVAAAE

SEQ ID NO: 1049400 - protein, 22 aa, Mycobacterium
LGRSGFLLAPWTAEQIVSELVP

SEQ ID NO: 1049401 - protein, 18 aa, Mycobacterium
LGRTEQRDILGLLISARG

SEQ ID NO: 1049402 - protein, 22 aa, Mycobacterium
LGRYRGEPMLAPVVFTSALDLG

SEQ ID NO: 1049403 - protein, 20 aa, Mycobacterium
LGSALARLEGRIALEDILKR

SEQ ID NO: 1049404 - protein, 17 aa, Mycobacterium
LGSDPKGAVAALLNDAR

SEQ ID NO: 1049405 - protein, 25 aa, Mycobacterium
LGSDWPRLVAPVFDGKKAVVFDDRW

SEQ ID NO: 1049406 - protein, 17 aa, Mycobacterium
LGSHASFDLTVRTKGDV

SEQ ID NO: 1049407 - protein, 23 aa, Mycobacterium
LGSIPEFNRDALVSTLQDLYGLA

SEQ ID NO: 1049408 - protein, 17 aa, Mycobacterium
LGSIRLPGSHFRNDIGL

SEQ ID NO: 1049409 - protein, 29 aa, Mycobacterium
LGSKMNRFFLRGALVARLLSEAAWKQYPQ

SEQ ID NO: 1049410 - protein, 18 aa, Mycobacterium
LGSLERLGVPFGLHSDCP

SEQ ID NO: 1049411 - protein, 22 aa, Mycobacterium
LGSLVAGSRYRGDFEERLKKVL

SEQ ID NO: 1049412 - protein, 19 aa, Mycobacterium
LGSSGVWELFWPDFPADGL

SEQ ID NO: 1049413 - protein, 17 aa, Mycobacterium
LGSTPAWGGSARLAKTL

SEQ ID NO: 1049414 - protein, 17 aa, Mycobacterium
LGSVAKLLPGLEGKIAD

SEQ ID NO: 1049415 - protein, 19 aa, Mycobacterium
LGTARLLSFPIDYASITRL

SEQ ID NO: 1049416 - protein, 25 aa, Mycobacterium
LGTDGAPGGWLIGNDGAGGSGAAGS

SEQ ID NO: 1049417 - protein, 18 aa, Mycobacterium
LGTSVLCNSYRHPAVLAK

SEQ ID NO: 1049418 - protein, 19 aa, Mycobacterium
LGVDIPINLTLGGTQFGGL

SEQ ID NO: 1049419 - protein, 21 aa, Mycobacterium
LGVEEELLRLGAKPGCAVTIG

SEQ ID NO: 1049420 - protein, 18 aa, Mycobacterium
LGVERAIIGDSWQSMSNP

SEQ ID NO: 1049421 - protein, 17 aa, Mycobacterium
LGVGQVIQGWDQGVQGM

SEQ ID NO: 1049422 - protein, 20 aa, Mycobacterium
LGVRWASPVNDLSCVNADAV

SEQ ID NO: 1049423 - protein, 18 aa, Mycobacterium
LGVSHLYLSPILTAVAGS

SEQ ID NO: 1049424 - protein, 26 aa, Mycobacterium
LGYPELVAPLTFLAIAGRRVQLEIFN

SEQ ID NO: 1049425 - protein, 17 aa, Mycobacterium
LGYSDLKEGDFIESYEL

SEQ ID NO: 1049426 - protein, 24 aa, Mycobacterium
LGYWRRADLTGTRFVACPFGQTPG

SEQ ID NO: 1049427 - protein, 25 aa, Mycobacterium
LHAAKGLEWHAVFLVGLADGTLPIS

SEQ ID NO: 1049428 - protein, 25 aa, Mycobacterium
LHADELPGMLVLRILAGHLAEAEAR

SEQ ID NO: 1049429 - protein, 23 aa, Mycobacterium
LHAHVLLQRDVHYIVRDDAVHLI

SEQ ID NO: 1049430 - protein, 25 aa, Mycobacterium
LHAMAKLAPQHLVVVLGHCHERISP

SEQ ID NO: 1049431 - protein, 18 aa, Mycobacterium
LHEAELQLAEFIGLEEVK

SEQ ID NO: 1049432 - protein, 30 aa, Mycobacterium; identical to SEQ ID NO: 691152

SEQ ID NO: 1049433 - protein, 18 aa, Mycobacterium
LHEEAGLQAEHWQVLIDL

SEQ ID NO: 1049434 - protein, 17 aa, Mycobacterium
LHEIFDIDVPVGVIVSP

SEQ ID NO: 1049435 - protein, 24 aa, Mycobacterium
LHERLLRRDIPAVVLNAKNDAEEA

SEQ ID NO: 1049436 - protein, 21 aa, Mycobacterium
LHFPQELVVGLAVTRLGRSSV

SEQ ID NO: 1049437 - protein, 34 aa, Mycobacterium; identical to SEQ ID NO: 691173

SEQ ID NO: 1049438 - protein, 24 aa, Mycobacterium
LHGQKLRGGYALTRIREGSEEAWL

SEQ ID NO: 1049439 - protein, 18 aa, Mycobacterium
LHGRIEVDEPYVLILPTY

SEQ ID NO: 1049440 - protein, 17 aa, Mycobacterium
LHGSLFEFRCARCNKPY

SEQ ID NO: 1049441 - protein, 21 aa, Mycobacterium
LHGSRISGRYALIQTNGDQWL

SEQ ID NO: 1049442 - protein, 19 aa, Mycobacterium
LHHALALAGRHLRRHPNAQ

SEQ ID NO: 1049443 - protein, 23 aa, Mycobacterium
LHHFNTVWSRRQLPNVSMFHYTD

SEQ ID NO: 1049444 - protein, 18 aa, Mycobacterium
LHHQSKWTVGGMVKGAGM

SEQ ID NO: 1049445 - protein, 17 aa, Mycobacterium
LHHSARSRPREVWLDAR

SEQ ID NO: 1049446 - protein, 20 aa, Mycobacterium
LHHVPGLAFLPNRRPAEPNQ

SEQ ID NO: 1049447 - protein, 17 aa, Mycobacterium
LHIDERHGGSGYGLPEL

SEQ ID NO: 1049448 - protein, 18 aa, Mycobacterium
LHIPRTTWHDGVRFEEVS

SEQ ID NO: 1049449 - protein, 26 aa, Mycobacterium
LHKQRTGLPHVTWKYATSIDGRSAAA

SEQ ID NO: 1049450 - protein, 19 aa, Mycobacterium
LHLAARAYTATGLSHNLAP

SEQ ID NO: 1049451 - protein, 23 aa, Mycobacterium
LHLAELREGVWIRPDNLDPQRLP

SEQ ID NO: 1049452 - protein, 17 aa, Mycobacterium
LHLDILVDRMRREFKVE

SEQ ID NO: 1049453 - protein, 18 aa, Mycobacterium
LHLPEMLLLLATDLAAVD

SEQ ID NO: 1049454 - protein, 19 aa, Mycobacterium
LHMMARLRTGQPLGPVQLV

SEQ ID NO: 1049455 - protein, 21 aa, Mycobacterium
LHNGTVYRWNRSVYDVADGRP

SEQ ID NO: 1049456 - protein, 17 aa, Mycobacterium
LHPDERLAASLLAKGLP

SEQ ID NO: 1049457 - protein, 19 aa, Mycobacterium
LHPHTRMLNRVKVHPQMII

SEQ ID NO: 1049458 - protein, 31 aa, Mycobacterium; identical to SEQ ID NO: 691303

SEQ ID NO: 1049459 - protein, 33 aa, Mycobacterium
LHPPRLSAAINHERVRLGIGLSPPVSARLRDTR

SEQ ID NO: 1049460 - protein, 25 aa, Mycobacterium
LHPQQRVAMRVAWKALENSGINPGS

SEQ ID NO: 1049461 - protein, 21 aa, Mycobacterium
LHPRALAAYRRAEGRVKRDAP

SEQ ID NO: 1049462 - protein, 30 aa, Mycobacterium
LHRALADLMPWLADRVDALKSFDDVKLLDV

SEQ ID NO: 1049463 - protein, 23 aa, Mycobacterium
LHREELDAFVVRRLNLPFRDVDW

SEQ ID NO: 1049464 - protein, 19 aa, Mycobacterium
LHRFGESIGQLAAAIRGGD

SEQ ID NO: 1049465 - protein, 34 aa, Mycobacterium
LHRLLRRYRLELARPDYRACWDYGGMPVPKDGMP

SEQ ID NO: 1049466 - protein, 20 aa, Mycobacterium
LHRTRRIAAHISDDARSRVR

SEQ ID NO: 1049467 - protein, 18 aa, Mycobacterium
LHSIIIIKKWNAIDRVLP

SEQ ID NO: 1049468 - protein, 18 aa, Mycobacterium
LHSPLRGVARGQTLVLYR

SEQ ID NO: 1049469 - protein, 20 aa, Mycobacterium
LHTARLALCQATRQAIANGL

SEQ ID NO: 1049470 - protein, 27 aa, Mycobacterium
LHTHLPWLAHHGRWPVGEEWLYQSWSA

SEQ ID NO: 1049471 - protein, 18 aa, Mycobacterium
LHTLRADIDYGLHEAKTT

SEQ ID NO: 1049472 - protein, 18 aa, Mycobacterium
LHTLRADIDYGLYEAKTT

SEQ ID NO: 1049473 - protein, 24 aa, Mycobacterium
LHVGHLVPLLVLRRFQRAGHRPIV

SEQ ID NO: 1049474 - protein, 19 aa, Mycobacterium
LHYEMPLILNVPTFTICCA

SEQ ID NO: 1049475 - protein, 24 aa, Mycobacterium
LHYGPPFCSVLGIGHEPADPDHIY

SEQ ID NO: 1049476 - protein, 19 aa, Mycobacterium
LIAALRAIFAAWNCGDRLN

SEQ ID NO: 1049477 - protein, 18 aa, Mycobacterium
LIAGVPVVPVPADVGVAE

SEQ ID NO: 1049478 - protein, 17 aa, Mycobacterium
LIAIPGIGARRLEQYGA

SEQ ID NO: 1049479 - protein, 20 aa, Mycobacterium
LIARRVREARVFSEVIPHTT

SEQ ID NO: 1049480 - protein, 21 aa, Mycobacterium
LIARRVREARVFSEVIPHTTS

SEQ ID NO: 1049481 - protein, 22 aa, Mycobacterium
LIARRVREARVFSEVIPHTTSI

SEQ ID NO: 1049482 - protein, 27 aa, Mycobacterium
LIASQLIGLAMTRYVWQIEPIASMSDS

SEQ ID NO: 1049483 - protein, 17 aa, Mycobacterium
LIDCGLGSLNAFTNAGL

SEQ ID NO: 1049484 - protein, 17 aa, Mycobacterium
LIDEVFAAVGETISDRL

SEQ ID NO: 1049485 - protein, 23 aa, Mycobacterium
LIDPALLRPGRLERLVFVEPPDA

SEQ ID NO: 1049486 - protein, 18 aa, Mycobacterium
LIDRASRWLLNYRPQPLA

SEQ ID NO: 1049487 - protein, 22 aa, Mycobacterium
LIDREIRRPTYVFAAVDHAGAD

SEQ ID NO: 1049488 - protein, 25 aa, Mycobacterium
LIDRPLRPSFVNGLRNEIQVVVTIL

SEQ ID NO: 1049489 - protein, 19 aa, Mycobacterium
LIDVIREWGDIGIVLITAR

SEQ ID NO: 1049490 - protein, 20 aa, Mycobacterium
LIEELGIDVFLVMPFTTDFM

SEQ ID NO: 1049491 - protein, 21 aa, Mycobacterium
LIEGPSGWGEFGAFLEYQPPE

SEQ ID NO: 1049492 - protein, 20 aa, Mycobacterium
LIEHTNLPLVTVFVKENDTL

SEQ ID NO: 1049493 - protein, 26 aa, Mycobacterium
LIEPDLRYLVNWGYGDPAYGWSTSPP

SEQ ID NO: 1049494 - protein, 19 aa, Mycobacterium
LIERGWRFERTKVGGRNEH

SEQ ID NO: 1049495 - protein, 21 aa, Mycobacterium
LIETARLWISLGHHDRHGIWH

SEQ ID NO: 1049496 - protein, 20 aa, Mycobacterium
LIGGGLSLLVSDGVYQGAYL

SEQ ID NO: 1049497 - protein, 17 aa, Mycobacterium
LIGGHNMLPGTITSADR

SEQ ID NO: 1049498 - protein, 18 aa, Mycobacterium
LIGKRPRKSAAEVAGPDV

SEQ ID NO: 1049499 - protein, 17 aa, Mycobacterium
LIGLMGVPPRDWDQEKA

SEQ ID NO: 1049500 - protein, 21 aa, Mycobacterium
LIGQFGIGFYSSFMVADKVEL

SEQ ID NO: 1049501 - protein, 25 aa, Mycobacterium
LIGQFGIGFYSSFMVANKVELLTRK

SEQ ID NO: 1049502 - protein, 18 aa, Mycobacterium
LIGRDGVEIDELWRGGPY

SEQ ID NO: 1049503 - protein, 23 aa, Mycobacterium
LIGSPCWRAAAASRGDLKPVGGL

SEQ ID NO: 1049504 - protein, 17 aa, Mycobacterium
LIGSYAFLHLNQTGLER

SEQ ID NO: 1049505 - protein, 21 aa, Mycobacterium
LIHGFSMLWLNGVLPSDPGEC

SEQ ID NO: 1049506 - protein, 22 aa, Mycobacterium
LIHKRAHGVAVVVSEGRPIGLV

SEQ ID NO: 1049507 - protein, 19 aa, Mycobacterium
LIHRESFTPFNIELLPCGQ

SEQ ID NO: 1049508 - protein, 18 aa, Mycobacterium
LIIHAAVAYASVEFSDIT

SEQ ID NO: 1049509 - protein, 21 aa, Mycobacterium
LIKNIEVAARVGGGDPAGNPT

SEQ ID NO: 1049510 - protein, 20 aa, Mycobacterium
LILGDKVVSMLVAFSTGCDA

SEQ ID NO: 1049511 - protein, 19 aa, Mycobacterium
LIMAYEWPADRQSLSWTLQ

SEQ ID NO: 1049512 - protein, 22 aa, Mycobacterium
LIMDSLRYWVIEMHVDGFRFDL

SEQ ID NO: 1049513 - protein, 19 aa, Mycobacterium
LIMDSLRYWVTEMHVDGFR

SEQ ID NO: 1049514 - protein, 28 aa, Mycobacterium
LINAPLLAATGRPLIGNGANGAPGTGAN

SEQ ID NO: 1049515 - protein, 27 aa, Mycobacterium
LINEVLKGAWGYRGWVMSDWGGTPGWE

SEQ ID NO: 1049516 - protein, 19 aa, Mycobacterium
LINQPVLTLTGRPQIGNDA

SEQ ID NO: 1049517 - protein, 17 aa, Mycobacterium
LINRYQPSVLWNDIGYP

SEQ ID NO: 1049518 - protein, 22 aa, Mycobacterium
LIPDQRAGCSLADSISPDELRA

SEQ ID NO: 1049519 - protein, 23 aa, Mycobacterium
LIPRPQRMYLRFGEPIDTTQPDG

SEQ ID NO: 1049520 - protein, 24 aa, Mycobacterium
LIQARGLVDVAIPRGGAGLIDAVV

SEQ ID NO: 1049521 - protein, 17 aa, Mycobacterium
LIREANRLAEFATTQLA

SEQ ID NO: 1049522 - protein, 18 aa, Mycobacterium
LIRFAEAAIQVMGKGGDH

SEQ ID NO: 1049523 - protein, 18 aa, Mycobacterium
LIRGHGRLAGPRRISVSD

SEQ ID NO: 1049524 - protein, 22 aa, Mycobacterium
LIRHLGVLEVPRLQLREAAHRC

SEQ ID NO: 1049525 - protein, 19 aa, Mycobacterium
LIRLQCYEGLTANEALYDW

SEQ ID NO: 1049526 - protein, 17 aa, Mycobacterium
LISAWLYRPAGADPARP

SEQ ID NO: 1049527 - protein, 17 aa, Mycobacterium
LISELKQEYTIVIVTHN

SEQ ID NO: 1049528 - protein, 17 aa, Mycobacterium
LITPRDGGGYGITAQWD

SEQ ID NO: 1049529 - protein, 17 aa, Mycobacterium
LITRTGVTRFMPVYPTE

SEQ ID NO: 1049530 - protein, 26 aa, Mycobacterium
LIVEVPELRLPVLATSLFWVSSSILN

SEQ ID NO: 1049531 - protein, 19 aa, Mycobacterium
LIVLRSMGIPGRYVSGYLH

SEQ ID NO: 1049532 - protein, 21 aa, Mycobacterium
LIVLRSMGIPGRYVSGYLHPK

SEQ ID NO: 1049533 - protein, 19 aa, Mycobacterium
LIVPGCDHASLLVRTNDRY

SEQ ID NO: 1049534 - protein, 17 aa, Mycobacterium
LIVSWEYPPVVIGGLGR

SEQ ID NO: 1049535 - protein, 20 aa, Mycobacterium
LIYGAAAFGFWADKAPRYLA

SEQ ID NO: 1049536 - protein, 25 aa, Mycobacterium
LKAAEARAGALAWQHHEPELAQYAE

SEQ ID NO: 1049537 - protein, 17 aa, Mycobacterium
LKAAYLMDTVGNKHART

SEQ ID NO: 1049538 - protein, 23 aa, Mycobacterium
LKADGSTACGCWIYSGVCADEVN

SEQ ID NO: 1049539 - protein, 20 aa, Mycobacterium
LKAELDQLIANRPVIAAEIN

SEQ ID NO: 1049540 - protein, 22 aa, Mycobacterium
LKASPQFSDRRQAVAAVFSQMR

SEQ ID NO: 1049541 - protein, 21 aa, Mycobacterium
LKATLKHLACLEYSTVEIQNK

SEQ ID NO: 1049542 - protein, 22 aa, Mycobacterium
LKCAIADGCADVPALKACTAAG

SEQ ID NO: 1049543 - protein, 17 aa, Mycobacterium
LKDDGVIVLHDCNPTHP

SEQ ID NO: 1049544 - protein, 22 aa, Mycobacterium
LKDDLPVAWKHRSERYTEKLAT

SEQ ID NO: 1049545 - protein, 20 aa, Mycobacterium
LKDLEIRGAGNVLGVEQSGH

SEQ ID NO: 1049546 - protein, 18 aa, Mycobacterium
LKDLPIWGTVFEGQVRSL

SEQ ID NO: 1049547 - protein, 19 aa, Mycobacterium
LKDLVIVRGVNHYPQDIEF

SEQ ID NO: 1049548 - protein, 18 aa, Mycobacterium
LKDSGFYWATRSGVTVSM

SEQ ID NO: 1049549 - protein, 19 aa, Mycobacterium
LKEFMVRNTYIYPPKPSMR

SEQ ID NO: 1049550 - protein, 19 aa, Mycobacterium
LKELVLKPVEGSGGYGIVF

SEQ ID NO: 1049551 - protein, 21 aa, Mycobacterium
LKENIKRQWWRSVVTGREDVV

SEQ ID NO: 1049552 - protein, 17 aa, Mycobacterium
LKEVVRIAADEAGVAPP

SEQ ID NO: 1049553 - protein, 17 aa, Mycobacterium
LKFKHWKAPKNALEQLL

SEQ ID NO: 1049554 - protein, 20 aa, Mycobacterium
LKGAVLFVTDLARAIPLPTQ

SEQ ID NO: 1049555 - protein, 21 aa, Mycobacterium
LKGLAELLERVSVPVHVNTHE

SEQ ID NO: 1049556 - protein, 18 aa, Mycobacterium
LKGLDLSALDGYLRSFGI

SEQ ID NO: 1049557 - protein, 21 aa, Mycobacterium
LKGLTIRGSIVGTRQDMAEAL

SEQ ID NO: 1049558 - protein, 21 aa, Mycobacterium
LKGVPGRWRLCALVREHLTGQ

SEQ ID NO: 1049559 - protein, 21 aa, Mycobacterium
LKHDLTPIVCIGEHLDVREAG

SEQ ID NO: 1049560 - protein, 21 aa, Mycobacterium
LKHRAGDTFCEIVPRHLKDLD

SEQ ID NO: 1049561 - protein, 28 aa, Mycobacterium
LKHRLARSLFLYALCNGWIGEGTTVVEA

SEQ ID NO: 1049562 - protein, 22 aa, Mycobacterium
LKILKGAGIVAGERSGREMLYR

SEQ ID NO: 1049563 - protein, 17 aa, Mycobacterium
LKILLNVAFDGEKLSNE

SEQ ID NO: 1049564 - protein, 18 aa, Mycobacterium
LKLAEHMVEGAAISAALL

SEQ ID NO: 1049565 - protein, 24 aa, Mycobacterium
LKLDRKIAERRVFPAVDVNPSGTR

SEQ ID NO: 1049566 - protein, 21 aa, Mycobacterium
LKLEVGERVEVVGGNVATRSA

SEQ ID NO: 1049567 - protein, 17 aa, Mycobacterium
LKLGRELGKGAVIVVNL

SEQ ID NO: 1049568 - protein, 22 aa, Mycobacterium
LKLGSRNPLLLARQVGSVANLT

SEQ ID NO: 1049569 - protein, 20 aa, Mycobacterium
LKLRGEGMVQLEPHRGHVVL

SEQ ID NO: 1049570 - protein, 19 aa, Mycobacterium
LKLRPSRGTHLVFDANAFG

SEQ ID NO: 1049571 - protein, 22 aa, Mycobacterium
LKLSHPDLLYSPTQSWVYDENF

SEQ ID NO: 1049572 - protein, 19 aa, Mycobacterium
LKNKIALMCDVDIDGIIST

SEQ ID NO: 1049573 - protein, 20 aa, Mycobacterium
LKNPEFDSTLVTRAFSGRYA

SEQ ID NO: 1049574 - protein, 22 aa, Mycobacterium
LKNRGFENFNIFDRESDVGGTW

SEQ ID NO: 1049575 - protein, 19 aa, Mycobacterium
LKPPELAAVVSCVLYETRG

SEQ ID NO: 1049576 - protein, 20 aa, Mycobacterium
LKPREWYDEKGITLRLGSAA

SEQ ID NO: 1049577 - protein, 17 aa, Mycobacterium
LKPVEAALILSESGVPT

SEQ ID NO: 1049578 - protein, 25 aa, Mycobacterium
LKQLLPIVLPIVLAYIGNQLGSGEG

SEQ ID NO: 1049579 - protein, 20 aa, Mycobacterium
LKSLGAQVHPCARISKASER

SEQ ID NO: 1049580 - protein, 17 aa, Mycobacterium
LKTGILVNAIIGQKRVG

SEQ ID NO: 1049581 - protein, 19 aa, Mycobacterium
LKTHCKTALVVRREGPVIR

SEQ ID NO: 1049582 - protein, 19 aa, Mycobacterium
LKTKFVFVGAGGNALSLLQ

SEQ ID NO: 1049583 - protein, 21 aa, Mycobacterium
LKTQWAQAGARLGLSLDPKFS

SEQ ID NO: 1049584 - protein, 20 aa, Mycobacterium
LKVARALDVDVGRLFSDESA

SEQ ID NO: 1049585 - protein, 30 aa, Mycobacterium
LKVEASHCYPHFSRFLAEVVRVLRPGGYLL

SEQ ID NO: 1049586 - protein, 17 aa, Mycobacterium
LKVGIGLDVGPAYVGIV

SEQ ID NO: 1049587 - protein, 18 aa, Mycobacterium
LKVGMVLEGVVTNVAAFG

SEQ ID NO: 1049588 - protein, 18 aa, Mycobacterium
LKVPQAWAEANQAVVPAA

SEQ ID NO: 1049589 - protein, 18 aa, Mycobacterium
LKVVHVFAPMVAPANGWA

SEQ ID NO: 1049590 - protein, 17 aa, Mycobacterium
LKYQGMVGGVPRVETHL

SEQ ID NO: 1049591 - protein, 17 aa, Mycobacterium
LKYYERIGACKANAAGI

SEQ ID NO: 1049592 - protein, 17 aa, Mycobacterium
LLAAALQDWQMRLTRRI

SEQ ID NO: 1049593 - protein, 17 aa, Mycobacterium
LLAAFVAGEQLAFEELF

SEQ ID NO: 1049594 - protein, 18 aa, Mycobacterium
LLACWLLDSHDMGADAAV

SEQ ID NO: 1049595 - protein, 17 aa, Mycobacterium
LLAERLGVRQTISLGTV

SEQ ID NO: 1049596 - protein, 18 aa, Mycobacterium
LLAIVSAMVCNRIDKVIV

SEQ ID NO: 1049597 - protein, 31 aa, Mycobacterium; identical to SEQ ID NO: 82064

SEQ ID NO: 1049598 - protein, 17 aa, Mycobacterium
LLALAWPEEHGGGGGSI

SEQ ID NO: 1049599 - protein, 19 aa, Mycobacterium
LLALLPLVGVWRGEGEGRG

SEQ ID NO: 1049600 - protein, 25 aa, Mycobacterium
LLAPESRSAAIAYRASMDAFVAADD

SEQ ID NO: 1049601 - protein, 18 aa, Mycobacterium
LLAPEVEKAYQLLAPESR

SEQ ID NO: 1049602 - protein, 36 aa, Mycobacterium
LLAPLQLLAYCAACTNRLRLGVAVLVTSLHDPLQLA

SEQ ID NO: 1049603 - protein, 20 aa, Mycobacterium
LLARIGDAFLAVPDGFTTHP

SEQ ID NO: 1049604 - protein, 24 aa, Mycobacterium
LLARRMGKTRVIAETGAGQHGVAT

SEQ ID NO: 1049605 - protein, 27 aa, Mycobacterium
LLARVLEPYSYKGCRYLLDARYHADDD

SEQ ID NO: 1049606 - protein, 18 aa, Mycobacterium
LLASGRGRGKMCIGISAY

SEQ ID NO: 1049607 - protein, 27 aa, Mycobacterium
LLASLPLKRAVVLRGLLSWPEDSAAAH

SEQ ID NO: 1049608 - protein, 22 aa, Mycobacterium
LLATGPISWLLQLGADLSTGYT

SEQ ID NO: 1049609 - protein, 17 aa, Mycobacterium
LLAVQAWATHHDTTLRA

SEQ ID NO: 1049610 - protein, 24 aa, Mycobacterium
LLAVRPEFEQALANKGWAALPGLQ

SEQ ID NO: 1049611 - protein, 22 aa, Mycobacterium
LLCAYSRYLRQAGFPYSQSYIE

SEQ ID NO: 1049612 - protein, 34 aa, Mycobacterium; identical to SEQ ID NO: 692431

SEQ ID NO: 1049613 - protein, 18 aa, Mycobacterium
LLDAEGLFDPRLKRPIPF

SEQ ID NO: 1049614 - protein, 18 aa, Mycobacterium
LLDAYRAAATVSFDPNVR

SEQ ID NO: 1049615 - protein, 21 aa, Mycobacterium
LLDIGCGWGATMRRAIEKYDV

SEQ ID NO: 1049616 - protein, 25 aa, Mycobacterium
LLDIGCGWGGALQRAVEKYDVNVIG

SEQ ID NO: 1049617 - protein, 21 aa, Mycobacterium
LLDIGCGWGSVLKRAVEKYDV

SEQ ID NO: 1049618 - protein, 17 aa, Mycobacterium
LLDRHRPLWELHVVEGL

SEQ ID NO: 1049619 - protein, 23 aa, Mycobacterium
LLDRLQVVALPMRVRFRGITTRE

SEQ ID NO: 1049620 - protein, 21 aa, Mycobacterium
LLDVGCGWGATMRRAFEKYDV

SEQ ID NO: 1049621 - protein, 21 aa, Mycobacterium
LLDVVTPLDWARQGMAAGTPF

SEQ ID NO: 1049622 - protein, 20 aa, Mycobacterium
LLDYALRSGESFSSRHRFVD

SEQ ID NO: 1049623 - protein, 22 aa, Mycobacterium
LLEAFKGMTLLELSDFVKKFED

SEQ ID NO: 1049624 - protein, 29 aa, Mycobacterium
LLEALPERERTVLVLRFFDSMTQTQIAER

SEQ ID NO: 1049625 - protein, 25 aa, Mycobacterium
LLEPNLRVLVNFGYGDPAYGYDTGP

SEQ ID NO: 1049626 - protein, 24 aa, Mycobacterium
LLEVEEVFLPLARLLHLQVAARQR

SEQ ID NO: 1049627 - protein, 18 aa, Mycobacterium
LLEVTWEALEHAGIPTES

SEQ ID NO: 1049628 - protein, 38 aa, Mycobacterium
LLGAATRFRVKWGYCCAVCSVWPGSRCARSPRHRARCH

SEQ ID NO: 1049629 - protein, 18 aa, Mycobacterium
LLGADIITAFAQRLDDQE

SEQ ID NO: 1049630 - protein, 18 aa, Mycobacterium
LLGAHGGLHQKWFNLYDE

SEQ ID NO: 1049631 - protein, 24 aa, Mycobacterium
LLGIPVSRVHRKLCEGYLVAVRRG

SEQ ID NO: 1049632 - protein, 25 aa, Mycobacterium
LLGIPVSRVHRKLCEGYLVAVRRGD

SEQ ID NO: 1049633 - protein, 28 aa, Mycobacterium
LLGKKCYSLRIASAMARDEGWLAEHMLI

SEQ ID NO: 1049634 - protein, 23 aa, Mycobacterium
LLGKRHRFGYTLGVDGGYLTGGT

SEQ ID NO: 1049635 - protein, 24 aa, Mycobacterium
LLGQSYFALGMVQFSTSIALQAIP

SEQ ID NO: 1049636 - protein, 19 aa, Mycobacterium
LLGRLGYRAYGWRLGLNIG

SEQ ID NO: 1049637 - protein, 17 aa, Mycobacterium
LLGRPLIGNGANAAPGS

SEQ ID NO: 1049638 - protein, 23 aa, Mycobacterium
LLGTARSWAWLSGRNYVTPDDVK

SEQ ID NO: 1049639 - protein, 18 aa, Mycobacterium
LLGTGAPWFESWLEHTDH

SEQ ID NO: 1049640 - protein, 25 aa, Mycobacterium
LLGVDEVWAVGGAQVVALLAYGGTD

SEQ ID NO: 1049641 - protein, 27 aa, Mycobacterium
LLHGFPESWYSWRHQIPALAAADYRVV

SEQ ID NO: 1049642 - protein, 19 aa, Mycobacterium
LLHKVVLARALQLTAETAL

SEQ ID NO: 1049643 - protein, 19 aa, Mycobacterium
LLILDGRPIWEPVVHYGPF

SEQ ID NO: 1049644 - protein, 23 aa, Mycobacterium
LLKGGRPAYTPVLVVQHGTTPAQ

SEQ ID NO: 1049645 - protein, 17 aa, Mycobacterium
LLKGQKSGILFVAAESL

SEQ ID NO: 1049646 - protein, 22 aa, Mycobacterium
LLKLPIPVQRRVAAGVLSAGHA

SEQ ID NO: 1049647 - protein, 20 aa, Mycobacterium
LLKPFTARYFEVILGVWERR

SEQ ID NO: 1049648 - protein, 24 aa, Mycobacterium
LLKSKLRTGGLLLNHCITRHDNKS

SEQ ID NO: 1049649 - protein, 19 aa, Mycobacterium
LLKSLGAAEVIGRLPADPD

SEQ ID NO: 1049650 - protein, 18 aa, Mycobacterium
LLKTYARIRGRWHAALPV

SEQ ID NO: 1049651 - protein, 20 aa, Mycobacterium
LLLACHLAGCGYSMCESVDD

SEQ ID NO: 1049652 - protein, 27 aa, Mycobacterium
LLLFSALELLHAWALIHDDVIDASSTR

SEQ ID NO: 1049653 - protein, 24 aa, Mycobacterium
LLLGGSGPRMMRLVAQYADWWNLQ

SEQ ID NO: 1049654 - protein, 23 aa, Mycobacterium
LLLLRRWDCGGVDHPGFPDRIAV

SEQ ID NO: 1049655 - protein, 22 aa, Mycobacterium
LLLRRWDCGGVDHPGFPDRIAV

SEQ ID NO: 1049656 - protein, 17 aa, Mycobacterium
LLLSRGATDITVLCVVA

SEQ ID NO: 1049657 - protein, 25 aa, Mycobacterium
LLLTDFKGGSTFLGMEKLPHTAAVI

SEQ ID NO: 1049658 - protein, 25 aa, Mycobacterium
LLMAAKLRNLFVVSGKLQVGRLWVE

SEQ ID NO: 1049659 - protein, 17 aa, Mycobacterium
LLMPLFHGNLMKSYESI

SEQ ID NO: 1049660 - protein, 24 aa, Mycobacterium
LLNGPRYWLMNSIEKEPQGLPESK

SEQ ID NO: 1049661 - protein, 24 aa, Mycobacterium
LLNWRRLAPKPSFSAPVSGAGRFG

SEQ ID NO: 1049662 - protein, 21 aa, Mycobacterium
LLPDNLRWLVTVDAMHTQVVT

SEQ ID NO: 1049663 - protein, 17 aa, Mycobacterium
LLPEAANLQVTRYALPN

SEQ ID NO: 1049664 - protein, 17 aa, Mycobacterium
LLPEQRLLSAEVRSVVV

SEQ ID NO: 1049665 - protein, 18 aa, Mycobacterium
LLPFALAGTCQRIEQVRC

SEQ ID NO: 1049666 - protein, 19 aa, Mycobacterium
LLPFGRPQLTGGPLRSAAK

SEQ ID NO: 1049667 - protein, 18 aa, Mycobacterium
LLPGDGAEALAYSHKRGW

SEQ ID NO: 1049668 - protein, 22 aa, Mycobacterium
LLPGDRVALCAASNIEFVVGLL

SEQ ID NO: 1049669 - protein, 19 aa, Mycobacterium
LLPGRDGLVHISKLGKGKR

SEQ ID NO: 1049670 - protein, 18 aa, Mycobacterium
LLPITKFFPATDVAILAR

SEQ ID NO: 1049671 - protein, 18 aa, Mycobacterium
LLPNRGVIVIPTRDGEQG

SEQ ID NO: 1049672 - protein, 17 aa, Mycobacterium
LLPNSPRVSVCAQSALD

SEQ ID NO: 1049673 - protein, 18 aa, Mycobacterium
LLPTAVEEMVRWTSPSPS

SEQ ID NO: 1049674 - protein, 25 aa, Mycobacterium
LLQAALCASRFVVVPMKTDDLSRTG

SEQ ID NO: 1049675 - protein, 18 aa, Mycobacterium
LLQDRGFGEVGSVTATDC

SEQ ID NO: 1049676 - protein, 18 aa, Mycobacterium
LLQGAWLAAWELADAGIP

SEQ ID NO: 1049677 - protein, 18 aa, Mycobacterium
LLQGCPQLHILATSRELL

SEQ ID NO: 1049678 - protein, 21 aa, Mycobacterium
LLQLKSWRLNTAKEQNVPAYV

SEQ ID NO: 1049679 - protein, 18 aa, Mycobacterium
LLQPEQWGGLQCDPTLFY

SEQ ID NO: 1049680 - protein, 18 aa, Mycobacterium
LLRAINPVLGFLLRTPLA

SEQ ID NO: 1049681 - protein, 17 aa, Mycobacterium
LLRDLPLHTDVNDTTKT

SEQ ID NO: 1049682 - protein, 21 aa, Mycobacterium
LLRFPGAYSPLVARLVAEIGF

SEQ ID NO: 1049683 - protein, 26 aa, Mycobacterium
LLRGDELGQLGFNYTLNIPTLPVDLD

SEQ ID NO: 1049684 - protein, 29 aa, Mycobacterium
LLRGDPRLPEWRLMAARAVARRDELARQK

SEQ ID NO: 1049685 - protein, 19 aa, Mycobacterium
LLRGTARLAARLGDVQSRL

SEQ ID NO: 1049686 - protein, 19 aa, Mycobacterium
LLRHGDFGLGTFNRLDGEM

SEQ ID NO: 1049687 - protein, 18 aa, Mycobacterium
LLRKIRMLSVPRELSAAR

SEQ ID NO: 1049688 - protein, 21 aa, Mycobacterium
LLRMPGFGLDGPWRDNPAFAY

SEQ ID NO: 1049689 - protein, 24 aa, Mycobacterium
LLRNRPAQMAAFLGVLLAGATVVT

SEQ ID NO: 1049690 - protein, 19 aa, Mycobacterium
LLRPVSVFINLAMQAHSAN

SEQ ID NO: 1049691 - protein, 29 aa, Mycobacterium
LLRQLRLGEYDVLVGINLLREGLDLPEVS

SEQ ID NO: 1049692 - protein, 20 aa, Mycobacterium
LLRRDLPLLAEVSGQVPVSV

SEQ ID NO: 1049693 - protein, 18 aa, Mycobacterium
LLRRWWAEGEVAAVVGHQ

SEQ ID NO: 1049694 - protein, 23 aa, Mycobacterium
LLRSELPPGGRLGIYGFGGSAHI

SEQ ID NO: 1049695 - protein, 17 aa, Mycobacterium
LLRYRLPDGSALDDTEV

SEQ ID NO: 1049696 - protein, 23 aa, Mycobacterium
LLSEPILRPGSWIGGDRDGNPNV

SEQ ID NO: 1049697 - protein, 23 aa, Mycobacterium
LLSGFERRGRWNVPKKLTTLTLW

SEQ ID NO: 1049698 - protein, 24 aa, Mycobacterium
LLSKHIRLIAAFDHRHVFLDPNPD

SEQ ID NO: 1049699 - protein, 23 aa, Mycobacterium
LLSKLVRHHLLLPVVATRSDLND

SEQ ID NO: 1049700 - protein, 24 aa, Mycobacterium
LLSMRTGQGYAEFAVSSFGTDAAI

SEQ ID NO: 1049701 - protein, 19 aa, Mycobacterium
LLSPFPRDRGWPVDDLLSV

SEQ ID NO: 1049702 - protein, 17 aa, Mycobacterium
LLSSAALGRLVTSIAGE

SEQ ID NO: 1049703 - protein, 20 aa, Mycobacterium
LLSTVFTRWERDGEVRAVVV

SEQ ID NO: 1049704 - protein, 21 aa, Mycobacterium
LLSVPVRHVYAALWRVGLLEV

SEQ ID NO: 1049705 - protein, 20 aa, Mycobacterium
LLTEPDLLRRWWAEGEVAAV

SEQ ID NO: 1049706 - protein, 17 aa, Mycobacterium
LLTGEPWPRITGADLLP

SEQ ID NO: 1049707 - protein, 18 aa, Mycobacterium
LLTLLLFDIGSFAGLAPL

SEQ ID NO: 1049708 - protein, 18 aa, Mycobacterium
LLTRELFYTAVTRAARKV

SEQ ID NO: 1049709 - protein, 19 aa, Mycobacterium
LLTSLPFAPGYGVEIGLLV

SEQ ID NO: 1049710 - protein, 19 aa, Mycobacterium
LLVESGMAPLFPLVVVVHA

SEQ ID NO: 1049711 - protein, 17 aa, Mycobacterium
LLVFLPLAHVLARALTL

SEQ ID NO: 1049712 - protein, 20 aa, Mycobacterium
LLVGLPFPARPAGVSEAAIG

SEQ ID NO: 1049713 - protein, 17 aa, Mycobacterium
LLVINGSLVNPSLRKTV

SEQ ID NO: 1049714 - protein, 26 aa, Mycobacterium
LLVLAHDVRMRWCGPEVEVEGIISLK

SEQ ID NO: 1049715 - protein, 25 aa, Mycobacterium
LLVPPGDGPWRLGMSTAGTFENLRL

SEQ ID NO: 1049716 - protein, 23 aa, Mycobacterium
LLVRDRAPCLVEPHLQRLTTSAR

SEQ ID NO: 1049717 - protein, 17 aa, Mycobacterium
LLVVRRAPGVWHLVSTV

SEQ ID NO: 1049718 - protein, 21 aa, Mycobacterium
LLWLGDHVIDDLCVLPGSAYA

SEQ ID NO: 1049719 - protein, 17 aa, Mycobacterium
LLWRRDEFDLGPDDAIL

SEQ ID NO: 1049720 - protein, 18 aa, Mycobacterium
LLYFPVMGANEIWRIDPD

SEQ ID NO: 1049721 - protein, 29 aa, Mycobacterium
LLYKLLRSDWLEPRWMVGIDPQSEGLARA

SEQ ID NO: 1049722 - protein, 17 aa, Mycobacterium
LLYQRIGQFAAVRRGLW

SEQ ID NO: 1049723 - protein, 22 aa, Mycobacterium
LLYRLCGDRNPLHSDPEFAAAA

SEQ ID NO: 1049724 - protein, 24 aa, Mycobacterium
LLYTVVLHRFLRWRQPGYDPARHL

SEQ ID NO: 1049725 - protein, 17 aa, Mycobacterium
LMAGHELVTEGFAPGQV

SEQ ID NO: 1049726 - protein, 18 aa, Mycobacterium
LMALPRLVPPAGALDSPR

SEQ ID NO: 1049727 - protein, 18 aa, Mycobacterium
LMAQLLRIATKSAPDLRA

SEQ ID NO: 1049728 - protein, 18 aa, Mycobacterium
LMCDVRFAAAGAKFAAVF

SEQ ID NO: 1049729 - protein, 19 aa, Mycobacterium
LMDAVPVTLGQEFSGYARQ

SEQ ID NO: 1049730 - protein, 18 aa, Mycobacterium
LMDLLGSPQLSYPSIHIG

SEQ ID NO: 1049731 - protein, 18 aa, Mycobacterium
LMETRPSALVAIAALSRL

SEQ ID NO: 1049732 - protein, 20 aa, Mycobacterium
LMEVAANYAIHAVLPATNFF

SEQ ID NO: 1049733 - protein, 27 aa, Mycobacterium
LMGIPGPSGLHFAGRVGTGFTERDLAN

SEQ ID NO: 1049734 - protein, 20 aa, Mycobacterium
LMGNCGVGFAPCRQQDHDVL

SEQ ID NO: 1049735 - protein, 18 aa, Mycobacterium
LMGSIAERHGRLDVLVNN

SEQ ID NO: 1049736 - protein, 20 aa, Mycobacterium
LMHQRRLFPLIARSYALQFA

SEQ ID NO: 1049737 - protein, 25 aa, Mycobacterium
LMILRRPRAGLSYEALLVTVEQRLA

SEQ ID NO: 1049738 - protein, 19 aa, Mycobacterium
LMMRHMMFVGYSLQDEDFH

SEQ ID NO: 1049739 - protein, 23 aa, Mycobacterium
LMNADGWGAGFFDSRYDDPAPRR

SEQ ID NO: 1049740 - protein, 18 aa, Mycobacterium
LMPDGVVQYVFKRRLYRG

SEQ ID NO: 1049741 - protein, 25 aa, Mycobacterium
LMPEPFRIAREMVRVLGPGGRIAIL

SEQ ID NO: 1049742 - protein, 18 aa, Mycobacterium
LMPEPVPPAPPAPLYPES

SEQ ID NO: 1049743 - protein, 25 aa, Mycobacterium
LMPIGPRRRLWSLLGDSLRPRRLDD

SEQ ID NO: 1049744 - protein, 18 aa, Mycobacterium
LMPTSSVNLGNWAASRLV

SEQ ID NO: 1049745 - protein, 22 aa, Mycobacterium
LMQQRGAQLWQWLQDGAQVYVC

SEQ ID NO: 1049746 - protein, 18 aa, Mycobacterium
LMQRFYTTSWRFAPFLWQ

SEQ ID NO: 1049747 - protein, 18 aa, Mycobacterium
LMRELWRGDRVDFDGEYY

SEQ ID NO: 1049748 - protein, 19 aa, Mycobacterium
LMRIGALLRRSDMSLLDQW

SEQ ID NO: 1049749 - protein, 24 aa, Mycobacterium
LMRNRVDLIVGHGRFVDPHSIVVE

SEQ ID NO: 1049750 - protein, 25 aa, Mycobacterium
LMRSCTGWPSRVWIDEPRRTAPDGS

SEQ ID NO: 1049751 - protein, 18 aa, Mycobacterium
LMRSGAKDQLRFTAPPRL

SEQ ID NO: 1049752 - protein, 17 aa, Mycobacterium
LMTARFLSYEEIAGQLD

SEQ ID NO: 1049753 - protein, 20 aa, Mycobacterium
LMVFFDLWVSAGMTPRVDPL

SEQ ID NO: 1049754 - protein, 17 aa, Mycobacterium
LMVRAGRVHAARLAAVE

SEQ ID NO: 1049755 - protein, 17 aa, Mycobacterium
LMVSWEYPPVVIGGLGR

SEQ ID NO: 1049756 - protein, 28 aa, Mycobacterium
LMWGEYRPGELVRGRWGLLEPPAPWLPE

SEQ ID NO: 1049757 - protein, 26 aa, Mycobacterium
LNAGGLFGVLTNVVWTNRGPCAIEGF

SEQ ID NO: 1049758 - protein, 18 aa, Mycobacterium
LNAGSGFNVGFGNSGINN

SEQ ID NO: 1049759 - protein, 18 aa, Mycobacterium
LNAGWNFTEPGVDGYPYR

SEQ ID NO: 1049760 - protein, 20 aa, Mycobacterium
LNAKIPKGFRAKGNLFVFVD

SEQ ID NO: 1049761 - protein, 24 aa, Mycobacterium
LNAQAAAFQAEFEGLLSGGAAAYV

SEQ ID NO: 1049762 - protein, 23 aa, Mycobacterium
LNCDFGVGIVRKGSAESQLSYTA

SEQ ID NO: 1049763 - protein, 22 aa, Mycobacterium
LNDGRYAVYIKFHHSLQDGVSA

SEQ ID NO: 1049764 - protein, 22 aa, Mycobacterium
LNDNRVDAIVGWHQAGGNLATL

SEQ ID NO: 1049765 - protein, 19 aa, Mycobacterium
LNEFRWDGTRLRRRRLDAG

SEQ ID NO: 1049766 - protein, 17 aa, Mycobacterium
LNEHAVESAVLFPNTGF

SEQ ID NO: 1049767 - protein, 27 aa, Mycobacterium
LNEVGWRQAGLAARYIAHRGGIAAVVS

SEQ ID NO: 1049768 - protein, 17 aa, Mycobacterium
LNFFVHDPFTLEPYSRD

SEQ ID NO: 1049769 - protein, 18 aa, Mycobacterium
LNGLGARYVPQRVVEHLP

SEQ ID NO: 1049770 - protein, 17 aa, Mycobacterium
LNGQKIWSSRAPFADMG

SEQ ID NO: 1049771 - protein, 17 aa, Mycobacterium
LNIQIGRRQVVKAEVSS

SEQ ID NO: 1049772 - protein, 23 aa, Mycobacterium
LNLARDIGCVFSIDTDAHAPGQL

SEQ ID NO: 1049773 - protein, 22 aa, Mycobacterium
LNLEVRYRARLHVPVHGAVHTE

SEQ ID NO: 1049774 - protein, 18 aa, Mycobacterium
LNLLALLASHGMLLALDL

SEQ ID NO: 1049775 - protein, 19 aa, Mycobacterium
LNLLTTKPFLYVFNADESV

SEQ ID NO: 1049776 - protein, 21 aa, Mycobacterium
LNLSIRDGWWDEWYDGENGWE

SEQ ID NO: 1049777 - protein, 17 aa, Mycobacterium
LNLVSYVLGDSRFDRAI

SEQ ID NO: 1049778 - protein, 31 aa, Mycobacterium; identical to SEQ ID NO: 693667

SEQ ID NO: 1049779 - protein, 23 aa, Mycobacterium
LNPNHYLAVAIDYLYTHRPSWPA

SEQ ID NO: 1049780 - protein, 22 aa, Mycobacterium
LNPRLREFALREGLADARLRMA

SEQ ID NO: 1049781 - protein, 17 aa, Mycobacterium
LNPSTGVELLIPDFNGK

SEQ ID NO: 1049782 - protein, 24 aa, Mycobacterium
LNQGEVCTCPSRGLIQADIYDRFL

SEQ ID NO: 1049783 - protein, 26 aa, Mycobacterium
LNQSSGRIKLAWFLLNAARYMPAQLY

SEQ ID NO: 1049784 - protein, 18 aa, Mycobacterium
LNRRAMQLFGPIYRRSIA

SEQ ID NO: 1049785 - protein, 19 aa, Mycobacterium
LNRRCPNVAAFYASLEVTN

SEQ ID NO: 1049786 - protein, 17 aa, Mycobacterium
LNSAVVRAIGSELLSIR

SEQ ID NO: 1049787 - protein, 22 aa, Mycobacterium
LNTAVWSGGSFIYVPPGVHVDI

SEQ ID NO: 1049788 - protein, 17 aa, Mycobacterium
LNTHPLPNIGRVVISGN

SEQ ID NO: 1049789 - protein, 19 aa, Mycobacterium
LNTMPGFTTISMYPRMWVA

SEQ ID NO: 1049790 - protein, 17 aa, Mycobacterium
LNTTRRAECQIIVTDAE

SEQ ID NO: 1049791 - protein, 26 aa, Mycobacterium
LNVAISRAQYAAVIVRSELLTRYLPG

SEQ ID NO: 1049792 - protein, 18 aa, Mycobacterium
LNVGCIPSKALLRNAELA

SEQ ID NO: 1049793 - protein, 17 aa, Mycobacterium
LNVPYFFMASDGVEAHD

SEQ ID NO: 1049794 - protein, 23 aa, Mycobacterium
LNVSGGVLYRYWVDTDRAARFLL

SEQ ID NO: 1049795 - protein, 17 aa, Mycobacterium
LNWVTWVDGETTYSPLP

SEQ ID NO: 1049796 - protein, 19 aa, Mycobacterium
LNYRSVMVLGTARVVEDPD

SEQ ID NO: 1049797 - protein, 21 aa, Mycobacterium
LNYYGPLRLIRGLAPGMLERG

SEQ ID NO: 1049798 - protein, 27 aa, Mycobacterium
LPAAPACPPCPPSPISQPPRPPAPPFA

SEQ ID NO: 1049799 - protein, 20 aa, Mycobacterium
LPADDPRIWPNIVAAQLGWD

SEQ ID NO: 1049800 - protein, 20 aa, Mycobacterium
LPADDRLRAALKRQPIPPEQ

SEQ ID NO: 1049801 - protein, 19 aa, Mycobacterium
LPADKFIRLSAPGASAPSH

SEQ ID NO: 1049802 - protein, 17 aa, Mycobacterium
LPADTGIVGPMIDHGFP

SEQ ID NO: 1049803 - protein, 24 aa, Mycobacterium
LPAEEFSSVVSFTMLHHVPTTELQ

SEQ ID NO: 1049804 - protein, 25 aa, Mycobacterium
LPAEERYRVAITVADVTRAQLVRLP

SEQ ID NO: 1049805 - protein, 17 aa, Mycobacterium
LPAGRRYGVVAGTGRLL

SEQ ID NO: 1049806 - protein, 19 aa, Mycobacterium
LPAHVAANFEGLVVRVEDS

SEQ ID NO: 1049807 - protein, 21 aa, Mycobacterium
LPALLDMFGYFNAVTTARRAH

SEQ ID NO: 1049808 - protein, 26 aa, Mycobacterium
LPAMLSRLVIMGGMFDADGNDVGADW

SEQ ID NO: 1049809 - protein, 19 aa, Mycobacterium
LPAPLRAAFQPGVHYNRFG

SEQ ID NO: 1049810 - protein, 25 aa, Mycobacterium
LPAPRVSPFPAVFQDLSLVVAADVS

SEQ ID NO: 1049811 - protein, 17 aa, Mycobacterium
LPARARFSARTFWDDID

SEQ ID NO: 1049812 - protein, 18 aa, Mycobacterium
LPARARFSARTFWDDIDA

SEQ ID NO: 1049813 - protein, 19 aa, Mycobacterium
LPASGGVVLTGRLSLAAQG

SEQ ID NO: 1049814 - protein, 25 aa, Mycobacterium
LPASTAVAYPAHWTTSAVDALGAAL

SEQ ID NO: 1049815 - protein, 17 aa, Mycobacterium
LPATWPLQVVGSTSGSG

SEQ ID NO: 1049816 - protein, 20 aa, Mycobacterium
LPAVRTSLYADPQFQAKYPM

SEQ ID NO: 1049817 - protein, 19 aa, Mycobacterium
LPAVSVVEPLKLMPEPVPP

SEQ ID NO: 1049818 - protein, 21 aa, Mycobacterium
LPCHTGVRLLGGSSHALGRVT

SEQ ID NO: 1049819 - protein, 23 aa, Mycobacterium
LPCPDHRPIGIDLREDWPSALRQ

SEQ ID NO: 1049820 - protein, 28 aa, Mycobacterium
LPDAAAEPVEFAQRLSIAIATEVAALRE

SEQ ID NO: 1049821 - protein, 23 aa, Mycobacterium
LPDAMTVVGAVFRPNGNLSQALD

SEQ ID NO: 1049822 - protein, 20 aa, Mycobacterium
LPDDLKFTLVEPLRLLFKDE

SEQ ID NO: 1049823 - protein, 28 aa, Mycobacterium
LPDGISRLRFRLRWRGYRLTVDANHSTV

SEQ ID NO: 1049824 - protein, 17 aa, Mycobacterium
LPDGMALAELLADSDPP

SEQ ID NO: 1049825 - protein, 26 aa, Mycobacterium
LPDGRELACLEWGDPTGYPTFYFHGT

SEQ ID NO: 1049826 - protein, 22 aa, Mycobacterium
LPDGRRVVGEWVHGPHLPTGPA

SEQ ID NO: 1049827 - protein, 18 aa, Mycobacterium
LPDGTPFPTLYYLTHPEL

SEQ ID NO: 1049828 - protein, 17 aa, Mycobacterium
LPDGWDADMPRWEPGSK

SEQ ID NO: 1049829 - protein, 25 aa, Mycobacterium
LPDLPGITEAWPWTNRQATEASSAP

SEQ ID NO: 1049830 - protein, 23 aa, Mycobacterium
LPDPRLDKLAELFGSERIVAAPV

SEQ ID NO: 1049831 - protein, 28 aa, Mycobacterium
LPDPVGLLRCCGGADLAAMAGFCAQAAV

SEQ ID NO: 1049832 - protein, 35 aa, Mycobacterium
LPDPVGLLRCCGGADLAAMAGFCAQAAVRRTPLLL

SEQ ID NO: 1049833 - protein, 20 aa, Mycobacterium
LPDRACWALQHRLTRRYISA

SEQ ID NO: 1049834 - protein, 23 aa, Mycobacterium
LPDREFDALFTRDKPVIFAYHGY

SEQ ID NO: 1049835 - protein, 20 aa, Mycobacterium
LPDRLRAAGFHDVEVEVQAG

SEQ ID NO: 1049836 - protein, 21 aa, Mycobacterium
LPDRRVALYVLPRTLDDVPGL

SEQ ID NO: 1049837 - protein, 18 aa, Mycobacterium
LPDSPDLVQLLLACLARG

SEQ ID NO: 1049838 - protein, 28 aa, Mycobacterium
LPDTAKVLSRFVDAIVWRTFGQDRLQAM

SEQ ID NO: 1049839 - protein, 24 aa, Mycobacterium
LPDTRRYLGRHLSVLELISADTAA

SEQ ID NO: 1049840 - protein, 28 aa, Mycobacterium
LPEAQLDRFAIRLELRYLSEQDETAMLR

SEQ ID NO: 1049841 - protein, 19 aa, Mycobacterium
LPEEARASLGKQVPHPSRL

SEQ ID NO: 1049842 - protein, 18 aa, Mycobacterium
LPEFDPFWHRCVEHDVLV

SEQ ID NO: 1049843 - protein, 22 aa, Mycobacterium
LPEGLAAIPAIRVDIGSGTGEF

SEQ ID NO: 1049844 - protein, 19 aa, Mycobacterium
LPEHCGTPYGMTPNPIQAL

SEQ ID NO: 1049845 - protein, 22 aa, Mycobacterium
LPEIGHACGHNIIAASAVGTAL

SEQ ID NO: 1049846 - protein, 20 aa, Mycobacterium
LPELHLGSTPAWGGSARLAK

SEQ ID NO: 1049847 - protein, 27 aa, Mycobacterium
LPEPALRLVAVARLRLLCRASGITDVS

SEQ ID NO: 1049848 - protein, 25 aa, Mycobacterium
LPEPLKCLVENLWALHTNRYDYVAN

SEQ ID NO: 1049849 - protein, 23 aa, Mycobacterium
LPEPTFVPVLGRIAAGGPILAEE

SEQ ID NO: 1049850 - protein, 27 aa, Mycobacterium
LPERGAPGAVCRWCGHGEPLLRCTRCG

SEQ ID NO: 1049851 - protein, 21 aa, Mycobacterium
LPERNTGAGVAARIGAALESM

SEQ ID NO: 1049852 - protein, 23 aa, Mycobacterium
LPEWERDRVRAVIDPAVIVDEHN

SEQ ID NO: 1049853 - protein, 23 aa, Mycobacterium
LPEWPQMLLRALMFRLAVHALHP

SEQ ID NO: 1049854 - protein, 23 aa, Mycobacterium
LPFYHDMGLVLGVCAPILGGYQA

SEQ ID NO: 1049855 - protein, 25 aa, Mycobacterium
LPGDRWCVVAVNWLRAHYDGCAAPV

SEQ ID NO: 1049856 - protein, 17 aa, Mycobacterium
LPGENFVLAVQWHPEES

SEQ ID NO: 1049857 - protein, 18 aa, Mycobacterium
LPGFAARAVLGEFADEGL

SEQ ID NO: 1049858 - protein, 19 aa, Mycobacterium
LPGGALALVNDAGMRRYIG

SEQ ID NO: 1049859 - protein, 32 aa, Mycobacterium
LPGGLFSLAKLLVIRGEKQYVFGLNDSTSVGP

SEQ ID NO: 1049860 - protein, 18 aa, Mycobacterium
LPGGLPVSGIDVAGAGGT

SEQ ID NO: 1049861 - protein, 17 aa, Mycobacterium
LPGLLTILHDGGYHDTE

SEQ ID NO: 1049862 - protein, 17 aa, Mycobacterium
LPGLLTILHDGSFHETE

SEQ ID NO: 1049863 - protein, 19 aa, Mycobacterium
LPGNAHFIFRGCEGDVLLM

SEQ ID NO: 1049864 - protein, 20 aa, Mycobacterium
LPGNAHFIFRGCEGDVLLML

SEQ ID NO: 1049865 - protein, 20 aa, Mycobacterium
LPGPAVPGVAPWAGDFLLDT

SEQ ID NO: 1049866 - protein, 18 aa, Mycobacterium
LPGPLRWLERRTRDEQLH

SEQ ID NO: 1049867 - protein, 20 aa, Mycobacterium
LPGPPGRWVQADGRHPFIGA

SEQ ID NO: 1049868 - protein, 21 aa, Mycobacterium
LPGRRYYGGCEHVDVVENIAR

SEQ ID NO: 1049869 - protein, 17 aa, Mycobacterium
LPGSLPVRDTSGSSCAR

SEQ ID NO: 1049870 - protein, 17 aa, Mycobacterium
LPGVGVWTAAETVQRAF

SEQ ID NO: 1049871 - protein, 26 aa, Mycobacterium
LPGVSGANPCRRAQRRVRPLPAGLFS

SEQ ID NO: 1049872 - protein, 17 aa, Mycobacterium
LPHADIVPMVKPQFEVG

SEQ ID NO: 1049873 - protein, 23 aa, Mycobacterium
LPHIASAVAIARQWLDCPDRGVG

SEQ ID NO: 1049874 - protein, 20 aa, Mycobacterium
LPHQLLRSWYILYFQLPWLP

SEQ ID NO: 1049875 - protein, 19 aa, Mycobacterium
LPHVAGFRRSHWQARDARS

SEQ ID NO: 1049876 - protein, 18 aa, Mycobacterium
LPILGVVKHYCSIAARSI

SEQ ID NO: 1049877 - protein, 25 aa, Mycobacterium
LPITLGGTMAKYDWTINGEPYSKTH

SEQ ID NO: 1049878 - protein, 17 aa, Mycobacterium
LPIVLSVGERRAYTAND

SEQ ID NO: 1049879 - protein, 19 aa, Mycobacterium
LPKFSDIRYNYALAGGATM

SEQ ID NO: 1049880 - protein, 18 aa, Mycobacterium
LPKIYLELLDAARGLERL

SEQ ID NO: 1049881 - protein, 18 aa, Mycobacterium
LPKLVERFIDVQLLIVGR

SEQ ID NO: 1049882 - protein, 20 aa, Mycobacterium
LPKQYRGVIQYVQVNGRTKI

SEQ ID NO: 1049883 - protein, 19 aa, Mycobacterium
LPLALGVEALGGPVDAIDA

SEQ ID NO: 1049884 - protein, 18 aa, Mycobacterium
LPLDEVKFSYELGACTKD

SEQ ID NO: 1049885 - protein, 20 aa, Mycobacterium
LPLDPSGMLSRVLPPEEENK

SEQ ID NO: 1049886 - protein, 17 aa, Mycobacterium
LPLFHAFGQTAGLNAAV

SEQ ID NO: 1049887 - protein, 19 aa, Mycobacterium
LPLFHDMGMMGLLIIPMYE

SEQ ID NO: 1049888 - protein, 24 aa, Mycobacterium
LPLGGGRHARAWFACYDLLHRLGG

SEQ ID NO: 1049889 - protein, 27 aa, Mycobacterium
LPLLEPLRALPVLGDPLADLVQPNLKV

SEQ ID NO: 1049890 - protein, 17 aa, Mycobacterium
LPLMNALLGANDDVVAP

SEQ ID NO: 1049891 - protein, 26 aa, Mycobacterium
LPLPGHSPCGLGFRPDGTLLIASAHD

SEQ ID NO: 1049892 - protein, 20 aa, Mycobacterium
LPLPTPVGMEVMPPEPPLPA

SEQ ID NO: 1049893 - protein, 20 aa, Mycobacterium
LPLQPSQYWARQCYVGASFL

SEQ ID NO: 1049894 - protein, 23 aa, Mycobacterium
LPLRSRDRLPLMNALLGANDDVV

SEQ ID NO: 1049895 - protein, 17 aa, Mycobacterium
LPLSGWMTIETTPLRPH

SEQ ID NO: 1049896 - protein, 33 aa, Mycobacterium; identical to SEQ ID NO: 694511

SEQ ID NO: 1049897 - protein, 39 aa, Mycobacterium; identical to SEQ ID NO: 622529

SEQ ID NO: 1049898 - protein, 17 aa, Mycobacterium
LPMLDMWTDVFANPGKR

SEQ ID NO: 1049899 - protein, 26 aa, Mycobacterium
LPNDHRRAIAALGFGVLSKSYFRFDR

SEQ ID NO: 1049900 - protein, 26 aa, Mycobacterium
LPNEVPRGVCGHLSYTEIIGAAVIAD

SEQ ID NO: 1049901 - protein, 17 aa, Mycobacterium
LPNGRTAWIPPPQLDRG

SEQ ID NO: 1049902 - protein, 18 aa, Mycobacterium
LPNMRTVLHCLPPKDWTE

SEQ ID NO: 1049903 - protein, 18 aa, Mycobacterium
LPNRLYWLSASLGADGTQ

SEQ ID NO: 1049904 - protein, 21 aa, Mycobacterium
LPNSCRFAVALFGLLRAGAIP

SEQ ID NO: 1049905 - protein, 22 aa, Mycobacterium
LPPATYFSGGKLQWILEDVDGV

SEQ ID NO: 1049906 - protein, 17 aa, Mycobacterium
LPPELPATARAWRDGQL

SEQ ID NO: 1049907 - protein, 17 aa, Mycobacterium
LPPIFSALISTRPQAAM

SEQ ID NO: 1049908 - protein, 22 aa, Mycobacterium
LPPKRRSGRLAALVDAATGSLS

SEQ ID NO: 1049909 - protein, 17 aa, Mycobacterium
LPPPAALTGEWFGALAV

SEQ ID NO: 1049910 - protein, 19 aa, Mycobacterium
LPPSPAWPVNPLAPDDVPP

SEQ ID NO: 1049911 - protein, 17 aa, Mycobacterium
LPPTFALVGFARRDWDT

SEQ ID NO: 1049912 - protein, 19 aa, Mycobacterium
LPPTLAFDYPTPVALATHL

SEQ ID NO: 1049913 - protein, 22 aa, Mycobacterium
LPQCDLRTAVFGYQVNRDMASA

SEQ ID NO: 1049914 - protein, 19 aa, Mycobacterium
LPQDRRQVLAAGDSNSDAT

SEQ ID NO: 1049915 - protein, 19 aa, Mycobacterium
LPQIPVRLHARSWHRYPEP

SEQ ID NO: 1049916 - protein, 20 aa, Mycobacterium
LPQPPVLSFRGARVEVRLPG

SEQ ID NO: 1049917 - protein, 20 aa, Mycobacterium
LPQPRLTAYRQLDRWLDHYL

SEQ ID NO: 1049918 - protein, 20 aa, Mycobacterium
LPQRRPRRILFVSGGSGITP

SEQ ID NO: 1049919 - protein, 19 aa, Mycobacterium
LPQTVTLAFTSYAGLDVGR

SEQ ID NO: 1049920 - protein, 17 aa, Mycobacterium
LPQYGVVAVTGYEEATA

SEQ ID NO: 1049921 - protein, 25 aa, Mycobacterium
LPRDSRLVLTTGWPLRSARPRRAGG

SEQ ID NO: 1049922 - protein, 28 aa, Mycobacterium
LPRGLRMVGRGVLRPGLTVLNGSTPVGV

SEQ ID NO: 1049923 - protein, 17 aa, Mycobacterium
LPRIPWAVASLRTEQRW

SEQ ID NO: 1049924 - protein, 25 aa, Mycobacterium
LPRLKPRVFYDLVVEVALIRPGPIQ

SEQ ID NO: 1049925 - protein, 21 aa, Mycobacterium
LPRLRGWGESMSRQAGGRAGG

SEQ ID NO: 1049926 - protein, 19 aa, Mycobacterium
LPRRAHVCLLTGAEAGTDT

SEQ ID NO: 1049927 - protein, 20 aa, Mycobacterium
LPRTMLRFAGGREITLGDLG

SEQ ID NO: 1049928 - protein, 17 aa, Mycobacterium
LPRWTMIDKALGLGSPD

SEQ ID NO: 1049929 - protein, 18 aa, Mycobacterium
LPSEAEWEVAARGGLTGA

SEQ ID NO: 1049930 - protein, 22 aa, Mycobacterium
LPSEFFFEIAQWANGDSQAVAA

SEQ ID NO: 1049931 - protein, 19 aa, Mycobacterium
LPSGAKFGSLVHAVLETSD

SEQ ID NO: 1049932 - protein, 17 aa, Mycobacterium
LPSGEIDYFGRLDHQVQ

SEQ ID NO: 1049933 - protein, 20 aa, Mycobacterium
LPSGIAVPGAPIIPLLVQVN

SEQ ID NO: 1049934 - protein, 25 aa, Mycobacterium
LPSGTLWALDLIEVPSRLRPAMTAM

SEQ ID NO: 1049935 - protein, 17 aa, Mycobacterium
LPSRGVGVIELRGESVT

SEQ ID NO: 1049936 - protein, 17 aa, Mycobacterium
LPSRPHLEWQLRRRVLA

SEQ ID NO: 1049937 - protein, 17 aa, Mycobacterium
LPSYIYRSVDPVVAEML

SEQ ID NO: 1049938 - protein, 26 aa, Mycobacterium
LPTAAPRWVVDPDFNLDFHVRRVRVS

SEQ ID NO: 1049939 - protein, 18 aa, Mycobacterium
LPTDFPAPSVASFSGARF

SEQ ID NO: 1049940 - protein, 17 aa, Mycobacterium
LPTHVLNVLHLLLPAGE

SEQ ID NO: 1049941 - protein, 17 aa, Mycobacterium
LPTLLRYQVPLWPERLL

SEQ ID NO: 1049942 - protein, 18 aa, Mycobacterium
LPTMAALLIKESVNQTVD

SEQ ID NO: 1049943 - protein, 20 aa, Mycobacterium
LPTMEKAGLIQRGQQVSVRE

SEQ ID NO: 1049944 - protein, 17 aa, Mycobacterium
LPTMPPWHVQENKWRAA

SEQ ID NO: 1049945 - protein, 24 aa, Mycobacterium
LPTQLCAFAAGVLRAEAAHEPGHY

SEQ ID NO: 1049946 - protein, 17 aa, Mycobacterium
LPTQRRLATNTQTGLAS

SEQ ID NO: 1049947 - protein, 21 aa, Mycobacterium
LPTRAGWHLPGYWQTRTPNVN

SEQ ID NO: 1049948 - protein, 24 aa, Mycobacterium
LPTRPRATLVLRKDADHSIKRLRL

SEQ ID NO: 1049949 - protein, 25 aa, Mycobacterium
LPTSPAESFTAMWADVRRPELRQLE

SEQ ID NO: 1049950 - protein, 21 aa, Mycobacterium
LPTTYRLLGRTPRRLRRLRAA

SEQ ID NO: 1049951 - protein, 17 aa, Mycobacterium
LPTVRIRRIYACYDAGR

SEQ ID NO: 1049952 - protein, 24 aa, Mycobacterium
LPTYAVICCPAFGAAGKIGTLNHA

SEQ ID NO: 1049953 - protein, 19 aa, Mycobacterium
LPVAYAAVGPSFWGEGQYP

SEQ ID NO: 1049954 - protein, 19 aa, Mycobacterium
LPVDPRLGRMILQAGVEGC

SEQ ID NO: 1049955 - protein, 19 aa, Mycobacterium
LPVDVARAITGPATLIGQS

SEQ ID NO: 1049956 - protein, 17 aa, Mycobacterium
LPVRQLVTDTGWGTGLD

SEQ ID NO: 1049957 - protein, 20 aa, Mycobacterium
LPVRVETWEGLVFVSLDVTA

SEQ ID NO: 1049958 - protein, 22 aa, Mycobacterium
LPVSRRRVLVFSGDISGRTGMG

SEQ ID NO: 1049959 - protein, 18 aa, Mycobacterium
LPVTFSLVVGNVGEPSWP

SEQ ID NO: 1049960 - protein, 17 aa, Mycobacterium
LPVTGYADLVRAVKARV

SEQ ID NO: 1049961 - protein, 17 aa, Mycobacterium
LPVYDAIVVDSPPTGRI

SEQ ID NO: 1049962 - protein, 20 aa, Mycobacterium
LPWLAVTGHIVHHGGDNLSA

SEQ ID NO: 1049963 - protein, 24 aa, Mycobacterium
LPWLTRLGAVYTYDAPWHRGRDVD

SEQ ID NO: 1049964 - protein, 24 aa, Mycobacterium
LPWMAELSGEFGLTRPPADQLDEL

SEQ ID NO: 1049965 - protein, 22 aa, Mycobacterium
LPYDEAEKFFLARLDEWDDVIA

SEQ ID NO: 1049966 - protein, 18 aa, Mycobacterium
LPYILRLFDIQGLSTRSA

SEQ ID NO: 1049967 - protein, 20 aa, Mycobacterium
LPYLTLRLTGVASLTVDVKR

SEQ ID NO: 1049968 - protein, 24 aa, Mycobacterium
LQAAARRSGVPVTEVTEMLPNDTD

SEQ ID NO: 1049969 - protein, 24 aa, Mycobacterium
LQAAGRLGEFSDWAKSLNQRTILR

SEQ ID NO: 1049970 - protein, 21 aa, Mycobacterium
LQAALERFGGLDIMVNNAGIT

SEQ ID NO: 1049971 - protein, 17 aa, Mycobacterium
LQAALSRLATLLGSAAS

SEQ ID NO: 1049972 - protein, 18 aa, Mycobacterium
LQAAVLWFIAHKTPKVVK

SEQ ID NO: 1049973 - protein, 19 aa, Mycobacterium
LQADLGAIVVEANTIDEEL

SEQ ID NO: 1049974 - protein, 17 aa, Mycobacterium
LQAGRIAVPLSVPQGGA

SEQ ID NO: 1049975 - protein, 20 aa, Mycobacterium
LQAKEVVSAFEAARAAMIHP

SEQ ID NO: 1049976 - protein, 25 aa, Mycobacterium
LQALAPLLGSWVGRGMGKYPTIQPF

SEQ ID NO: 1049977 - protein, 29 aa, Mycobacterium
LQALGWAGTIWAGWGRPSSGITAPIRPRW

SEQ ID NO: 1049978 - protein, 21 aa, Mycobacterium
LQAPYELVVEVARAGKLPVTL

SEQ ID NO: 1049979 - protein, 17 aa, Mycobacterium
LQATLLMFINEQCNASR

SEQ ID NO: 1049980 - protein, 18 aa, Mycobacterium
LQAYSMTMYAGWRAVIAG

SEQ ID NO: 1049981 - protein, 17 aa, Mycobacterium
LQEELHKTIVFVTHDFG

SEQ ID NO: 1049982 - protein, 17 aa, Mycobacterium
LQELTRLAVHQKTGVRS

SEQ ID NO: 1049983 - protein, 20 aa, Mycobacterium
LQEWFRRVPEFQICAAQATR

SEQ ID NO: 1049984 - protein, 22 aa, Mycobacterium
LQGHRCGACRIEIGRSELARIS

SEQ ID NO: 1049985 - protein, 19 aa, Mycobacterium
LQGLAARCLSDIVSAATQR

SEQ ID NO: 1049986 - protein, 17 aa, Mycobacterium
LQGWTLDRLPAVDRAIL

SEQ ID NO: 1049987 - protein, 17 aa, Mycobacterium
LQHEMYTVKGIKLAINY

SEQ ID NO: 1049988 - protein, 19 aa, Mycobacterium
LQIEGLRVAKAERAQGLGT

SEQ ID NO: 1049989 - protein, 19 aa, Mycobacterium
LQIRQSLDLTFAHGVAVAA

SEQ ID NO: 1049990 - protein, 24 aa, Mycobacterium
LQLFLDELRVCLHCCGAPDLTSLR

SEQ ID NO: 1049991 - protein, 18 aa, Mycobacterium
LQLGGLYVLVLDEADEML

SEQ ID NO: 1049992 - protein, 17 aa, Mycobacterium
LQLGRLKDSVGLRPEQV

SEQ ID NO: 1049993 - protein, 18 aa, Mycobacterium
LQLHGGYGYLREYGLEKI

SEQ ID NO: 1049994 - protein, 26 aa, Mycobacterium
LQLPADWEPLGAIAIGYAQQPAELRD

SEQ ID NO: 1049995 - protein, 21 aa, Mycobacterium
LQLRFCNVIDEFTREALATRP

SEQ ID NO: 1049996 - protein, 21 aa, Mycobacterium
LQLRLAPELTNLIEEYLPDDV

SEQ ID NO: 1049997 - protein, 24 aa, Mycobacterium
LQLRRRQHRRLKLGHQQRSAGSPQ

SEQ ID NO: 1049998 - protein, 25 aa, Mycobacterium
LQLSKRGGGVALLLTNIREHGAPIK

SEQ ID NO: 1049999 - protein, 21 aa, Mycobacterium
LQMEQYFARFGGVRDYLMDVV

SEQ ID NO: 1050000 - protein, 18 aa, Mycobacterium
LQPAGAICEIVSRKDEGS

SEQ ID NO: 1050001 - protein, 18 aa, Mycobacterium
LQPFDGYTDPAASEKKLV

SEQ ID NO: 1050002 - protein, 24 aa, Mycobacterium
LQPFPLPALTCLLRSITLRLTIAP

SEQ ID NO: 1050003 - protein, 20 aa, Mycobacterium
LQPGQAVCHFGITTGETCGT

SEQ ID NO: 1050004 - protein, 25 aa, Mycobacterium
LQPIEWRYTNDPSWVMRDKGERLHY

SEQ ID NO: 1050005 - protein, 18 aa, Mycobacterium
LQPKSALCRRPTSRPKRS

SEQ ID NO: 1050006 - protein, 17 aa, Mycobacterium
LQPWKDLLRDVAATEAM

SEQ ID NO: 1050007 - protein, 19 aa, Mycobacterium
LQQAIPLINTYVMSLGESV

SEQ ID NO: 1050008 - protein, 17 aa, Mycobacterium
LQQVQSWLFNQPNTSVL

SEQ ID NO: 1050009 - protein, 17 aa, Mycobacterium
LQRAGFVLEARLCRHAV

SEQ ID NO: 1050010 - protein, 17 aa, Mycobacterium
LQRAGLRTLCMEANTYA

SEQ ID NO: 1050011 - protein, 20 aa, Mycobacterium
LQRFVPFDVDESVLSAAVSA

SEQ ID NO: 1050012 - protein, 19 aa, Mycobacterium
LQRHVEAGQRIVAEVRAAA

SEQ ID NO: 1050013 - protein, 21 aa, Mycobacterium
LQRKGFEFKELEAAGLSRQGR

SEQ ID NO: 1050014 - protein, 22 aa, Mycobacterium
LQRLGRPVFGPTFEVDVGSDLR

SEQ ID NO: 1050015 - protein, 22 aa, Mycobacterium
LQRPDEVAARRGLRSGMLPRSW

SEQ ID NO: 1050016 - protein, 25 aa, Mycobacterium
LQRQWLHARSLAFAHPADGRRVEIV

SEQ ID NO: 1050017 - protein, 19 aa, Mycobacterium
LQRREAWQIIDHVNSLTDP

SEQ ID NO: 1050018 - protein, 17 aa, Mycobacterium
LQRVWDLAAVAAGPSWA

SEQ ID NO: 1050019 - protein, 24 aa, Mycobacterium
LQSARAQILAGFCDVALVVGADTT

SEQ ID NO: 1050020 - protein, 38 aa, Mycobacterium
LQSLETDLLGLINPPTMALFGRALIGNGANGAAGTGAA

SEQ ID NO: 1050021 - protein, 17 aa, Mycobacterium
LQSLLAQMDEFIEAEIE

SEQ ID NO: 1050022 - protein, 24 aa, Mycobacterium
LQSRAARLVACWGDNDGPDLRSRL

SEQ ID NO: 1050023 - protein, 23 aa, Mycobacterium
LQSYEIPRDFIIETTPWTLQNGL

SEQ ID NO: 1050024 - protein, 18 aa, Mycobacterium
LQTAAGYYQSVVSGLTSG

SEQ ID NO: 1050025 - protein, 22 aa, Mycobacterium
LQTLEQDLLAGINAPSQMLTGR

SEQ ID NO: 1050026 - protein, 18 aa, Mycobacterium
LQTLLPGLFPSSGDTTTT

SEQ ID NO: 1050027 - protein, 22 aa, Mycobacterium
LQTLPLDVLNAVNAPFQALTDR

SEQ ID NO: 1050028 - protein, 23 aa, Mycobacterium
LQTLRAGRWSGYIRTEIDLPTFA

SEQ ID NO: 1050029 - protein, 18 aa, Mycobacterium
LQTTRRFDALKIFLTLRA

SEQ ID NO: 1050030 - protein, 24 aa, Mycobacterium
LQTVAALLRLQARRTTNAEGREAL

SEQ ID NO: 1050031 - protein, 18 aa, Mycobacterium
LQVAASSFSSVTAGLASG

SEQ ID NO: 1050032 - protein, 21 aa, Mycobacterium
LQVDGRGGGPVAGVLDAGYDV

SEQ ID NO: 1050033 - protein, 17 aa, Mycobacterium
LQVLALVAMEPPVGPGA

SEQ ID NO: 1050034 - protein, 22 aa, Mycobacterium
LQVNARQALTLADQATAAGDAA

SEQ ID NO: 1050035 - protein, 25 aa, Mycobacterium
LQVSCGRVAHSLWAVIVDPDTGTEL

SEQ ID NO: 1050036 - protein, 29 aa, Mycobacterium
LQVWAEPFIPLRVPKIFNLRTDPYERADI

SEQ ID NO: 1050037 - protein, 25 aa, Mycobacterium
LQYADGGCQLAFWRHDEHLVCEARD

SEQ ID NO: 1050038 - protein, 20 aa, Mycobacterium
LQYAKTWRTLAKLSLPNKYL

SEQ ID NO: 1050039 - protein, 17 aa, Mycobacterium
LRAAAEFLGRRPNATQD

SEQ ID NO: 1050040 - protein, 20 aa, Mycobacterium
LRAAALPGVVDIVPGARTVL

SEQ ID NO: 1050041 - protein, 17 aa, Mycobacterium
LRAANAMREDAAQSPGW

SEQ ID NO: 1050042 - protein, 20 aa, Mycobacterium
LRADLLRPWANWITPEAERT

SEQ ID NO: 1050043 - protein, 22 aa, Mycobacterium
LRAEARAHFGFADDARVLLVFG

SEQ ID NO: 1050044 - protein, 23 aa, Mycobacterium
LRAELTVACDGRWSIARQAAGLK

SEQ ID NO: 1050045 - protein, 17 aa, Mycobacterium
LRAEYVVGCDGGRSLVR

SEQ ID NO: 1050046 - protein, 18 aa, Mycobacterium
LRAFTFPFDQVRILIVGQ

SEQ ID NO: 1050047 - protein, 21 aa, Mycobacterium
LRAGFDANLVVLDRDLRVAAV

SEQ ID NO: 1050048 - protein, 20 aa, Mycobacterium
LRAGLGVAMGNAHPDALAAA

SEQ ID NO: 1050049 - protein, 19 aa, Mycobacterium
LRAGLRAADCALFVIAANE

SEQ ID NO: 1050050 - protein, 18 aa, Mycobacterium
LRAGLSVLDIGCGPGTIT

SEQ ID NO: 1050051 - protein, 20 aa, Mycobacterium
LRAIFAAWNCGDRLNFRGQF

SEQ ID NO: 1050052 - protein, 20 aa, Mycobacterium
LRAIGAIRRFGGRSSARTWL

SEQ ID NO: 1050053 - protein, 17 aa, Mycobacterium
LRALAWGDTTVRIAADA

SEQ ID NO: 1050054 - protein, 19 aa, Mycobacterium
LRALFSPGVRTFFGRPCVV

SEQ ID NO: 1050055 - protein, 17 aa, Mycobacterium
LRALHAVGIVNENDTVA

SEQ ID NO: 1050056 - protein, 18 aa, Mycobacterium
LRALMFRLAVHALHPRST

SEQ ID NO: 1050057 - protein, 23 aa, Mycobacterium
LRALPTDGWLRIVATCVEIGQGW

SEQ ID NO: 1050058 - protein, 19 aa, Mycobacterium
LRALVDVGAHNGFQANEDN

SEQ ID NO: 1050059 - protein, 19 aa, Mycobacterium
LRAMLRPGDHVVIPDDAYG

SEQ ID NO: 1050060 - protein, 25 aa, Mycobacterium
LRANGFEVGMRLGIGSRETYIPALK

SEQ ID NO: 1050061 - protein, 21 aa, Mycobacterium
LRAQGIRLVYETPRRGTADSR

SEQ ID NO: 1050062 - protein, 20 aa, Mycobacterium
LRAQPGLLFTNLPFPLSDSS

SEQ ID NO: 1050063 - protein, 25 aa, Mycobacterium
LRAQRAHVLWAHRRARRRLAALRLL

SEQ ID NO: 1050064 - protein, 24 aa, Mycobacterium
LRARNPKLIYARLSAFGGNGPHGT

SEQ ID NO: 1050065 - protein, 17 aa, Mycobacterium
LRATLPLVDAGAASPRE

SEQ ID NO: 1050066 - protein, 26 aa, Mycobacterium
LRAVPVDLRHDWPQALRDAGFQTSLP

SEQ ID NO: 1050067 - protein, 18 aa, Mycobacterium
LRCGEVLSSVLLECTMAG

SEQ ID NO: 1050068 - protein, 18 aa, Mycobacterium
LRCGRSEHTRRAYLGDLR

SEQ ID NO: 1050069 - protein, 27 aa, Mycobacterium
LRCRGVVCQTCPCQPAQFQAHRAQCCG

SEQ ID NO: 1050070 - protein, 28 aa, Mycobacterium
LRCYLDDRPIFLGRNGRISVFSSERALA

SEQ ID NO: 1050071 - protein, 23 aa, Mycobacterium
LRDAARAAVRLMHHGRSAENGEG

SEQ ID NO: 1050072 - protein, 23 aa, Mycobacterium
LRDAIEVLTWVVGNATRLGFDAR

SEQ ID NO: 1050073 - protein, 20 aa, Mycobacterium
LRDGDSWLINGSKMFTTGAH

SEQ ID NO: 1050074 - protein, 18 aa, Mycobacterium
LRDGMAVITPGDRSDVVL

SEQ ID NO: 1050075 - protein, 18 aa, Mycobacterium
LRDGRPVTGGAFCRHDPD

SEQ ID NO: 1050076 - protein, 20 aa, Mycobacterium
LRDHFRCIAPDYLGFGLSEH

SEQ ID NO: 1050077 - protein, 25 aa, Mycobacterium
LRDIWLLRMRTALAGARGGGGDYQR

SEQ ID NO: 1050078 - protein, 25 aa, Mycobacterium
LRDKICADAVAFARHIGYTCAGTVE

SEQ ID NO: 1050079 - protein, 17 aa, Mycobacterium
LRDKLSAPRVIWVMVPA

SEQ ID NO: 1050080 - protein, 23 aa, Mycobacterium
LRDLFGRHVGTDVARRALEEGSG

SEQ ID NO: 1050081 - protein, 21 aa, Mycobacterium
LRDLPELAVRWQAEVPPDARL

SEQ ID NO: 1050082 - protein, 18 aa, Mycobacterium
LRDLTTIALKISPLRAHA

SEQ ID NO: 1050083 - protein, 17 aa, Mycobacterium
LRDRIRFGTEIVSARFE

SEQ ID NO: 1050084 - protein, 23 aa, Mycobacterium
LRDRLGSIPGVMVEHKRFGVATH

SEQ ID NO: 1050085 - protein, 20 aa, Mycobacterium
LRDTWLSARRDLLDRRNRAR

SEQ ID NO: 1050086 - protein, 26 aa, Mycobacterium
LRDYASRPARPGHRRIVLRFLTSPIE

SEQ ID NO: 1050087 - protein, 24 aa, Mycobacterium
LRDYVLAVKACFSAFRTGTLDHHG

SEQ ID NO: 1050088 - protein, 26 aa, Mycobacterium
LREADGDRYLPIWIGQSEAAAIALEQ

SEQ ID NO: 1050089 - protein, 25 aa, Mycobacterium
LREDLWRLVDMKVESVIAIDDRTLA

SEQ ID NO: 1050090 - protein, 18 aa, Mycobacterium
LREFHRVLAPGGLVAVSS

SEQ ID NO: 1050091 - protein, 18 aa, Mycobacterium
LREFKTGAARMALEAQVP

SEQ ID NO: 1050092 - protein, 24 aa, Mycobacterium
LREFLDSLGGLWAEGKLADKIYAA

SEQ ID NO: 1050093 - protein, 18 aa, Mycobacterium
LREGFPVNILNPVKAVPE

SEQ ID NO: 1050094 - protein, 24 aa, Mycobacterium
LREHGVRVLVIRPGQVRTRMSAHV

SEQ ID NO: 1050095 - protein, 23 aa, Mycobacterium
LREHVPDAGGMIIASDRTAARAY

SEQ ID NO: 1050096 - protein, 21 aa, Mycobacterium
LREIGRLFGRIAHLLDAVADY

SEQ ID NO: 1050097 - protein, 20 aa, Mycobacterium
LREINWKVLVEQFLEGYHIR

SEQ ID NO: 1050098 - protein, 20 aa, Mycobacterium
LREKIGAVTMGRVLTLIIVP

SEQ ID NO: 1050099 - protein, 17 aa, Mycobacterium
LRENGGYHAAREEQGQQ

SEQ ID NO: 1050100 - protein, 18 aa, Mycobacterium
LRERAELAAHWLSHGQWT

SEQ ID NO: 1050101 - protein, 23 aa, Mycobacterium
LRERIPISIAALGPRNVELTAEI

SEQ ID NO: 1050102 - protein, 25 aa, Mycobacterium
LRERLGFGELRWAVSGAAPIPKETL

SEQ ID NO: 1050103 - protein, 20 aa, Mycobacterium
LRESVRLMRELWRGDRVDFD

SEQ ID NO: 1050104 - protein, 21 aa, Mycobacterium
LRETGFWRFVSDPEDDPSESQ

SEQ ID NO: 1050105 - protein, 17 aa, Mycobacterium
LREVGLEVMGSARRVVV

SEQ ID NO: 1050106 - protein, 26 aa, Mycobacterium
LREYIDWQPFFNAWEMKGRFPDILNN

SEQ ID NO: 1050107 - protein, 18 aa, Mycobacterium
LREYPYRDAYLLRDARLF

SEQ ID NO: 1050108 - protein, 20 aa, Mycobacterium
LRFASWRDIHQTAVRVAGRL

SEQ ID NO: 1050109 - protein, 19 aa, Mycobacterium
LRFGVDRLRIGGHGEVPRG

SEQ ID NO: 1050110 - protein, 25 aa, Mycobacterium
LRFLKEDPWERLATLRAAMPNICLQ

SEQ ID NO: 1050111 - protein, 21 aa, Mycobacterium
LRFLMRNPRRALSRTEILDRV

SEQ ID NO: 1050112 - protein, 27 aa, Mycobacterium
LRFYRLAQELVWQWMFGRITADSRDAA

SEQ ID NO: 1050113 - protein, 18 aa, Mycobacterium
LRFYTEILGFQTKHDVPM

SEQ ID NO: 1050114 - protein, 17 aa, Mycobacterium
LRGAHDLCGLPVTVFRC

SEQ ID NO: 1050115 - protein, 29 aa, Mycobacterium
LRGAREMLRRGASQLKLMAGGGVTSAYDP

SEQ ID NO: 1050116 - protein, 29 aa, Mycobacterium
LRGATIPIIAGFPFPLAVEILPAHLPLPA

SEQ ID NO: 1050117 - protein, 19 aa, Mycobacterium
LRGGWVSEFFDAYYSRPRT

SEQ ID NO: 1050118 - protein, 22 aa, Mycobacterium
LRGKGFDAHGVMCDVRHLSEVN

SEQ ID NO: 1050119 - protein, 22 aa, Mycobacterium
LRGLARGGIFVTLGYAAGSIPA

SEQ ID NO: 1050120 - protein, 24 aa, Mycobacterium
LRGLCRRSREEVFTADGYYCSADL

SEQ ID NO: 1050121 - protein, 18 aa, Mycobacterium
LRGLGPRMVLPGHGPDLA

SEQ ID NO: 1050122 - protein, 17 aa, Mycobacterium
LRGLLRRSSHLAPPADE

SEQ ID NO: 1050123 - protein, 17 aa, Mycobacterium
LRGLPAVDFGVGVSAGR

SEQ ID NO: 1050124 - protein, 24 aa, Mycobacterium
LRGNNWVAFNGCCEPGWAHRDSIL

SEQ ID NO: 1050125 - protein, 17 aa, Mycobacterium
LRGRPVIVGGGVVLAAS

SEQ ID NO: 1050126 - protein, 17 aa, Mycobacterium
LRGSLFVIDSADLPPIE

SEQ ID NO: 1050127 - protein, 19 aa, Mycobacterium
LRGVARGQTLVLYRPDPDG

SEQ ID NO: 1050128 - protein, 17 aa, Mycobacterium
LRGVGLRLLVPDQHWEK

SEQ ID NO: 1050129 - protein, 17 aa, Mycobacterium
LRGVRDFVLRRHPASYR

SEQ ID NO: 1050130 - protein, 17 aa, Mycobacterium
LRGVVCAPDGAVDDAAR

SEQ ID NO: 1050131 - protein, 17 aa, Mycobacterium
LRIAALATKLAGFGPQA

SEQ ID NO: 1050132 - protein, 17 aa, Mycobacterium
LRIERHVSNAQRVAEFL

SEQ ID NO: 1050133 - protein, 17 aa, Mycobacterium
LRILAGVDGEIRRFIAQ

SEQ ID NO: 1050134 - protein, 19 aa, Mycobacterium
LRIPSGVAYAIVNRRLLGK

SEQ ID NO: 1050135 - protein, 19 aa, Mycobacterium
LRITCSDAVALVTDYLEDA

SEQ ID NO: 1050136 - protein, 31 aa, Mycobacterium
LRITPTGSWIFRKCAAWGLGRPDTADRLSVS

SEQ ID NO: 1050137 - protein, 19 aa, Mycobacterium
LRKAGLVVSERRGMHVFHR

SEQ ID NO: 1050138 - protein, 18 aa, Mycobacterium
LRKAQLVTFTAMDIDDPR

SEQ ID NO: 1050139 - protein, 22 aa, Mycobacterium
LRKEAYVLHARRYLADGGPIHP

SEQ ID NO: 1050140 - protein, 19 aa, Mycobacterium
LRKGDIITITHGRRGGLAV

SEQ ID NO: 1050141 - protein, 28 aa, Mycobacterium
LRKLLPQEWLRFGWFFLVTRHDPKGLRE

SEQ ID NO: 1050142 - protein, 23 aa, Mycobacterium
LRKLRYILNFARLADFEPGAAGS

SEQ ID NO: 1050143 - protein, 17 aa, Mycobacterium
LRKSVLIELEREFPEEF

SEQ ID NO: 1050144 - protein, 20 aa, Mycobacterium
LRLADVGALLRAHLDASDPL

SEQ ID NO: 1050145 - protein, 17 aa, Mycobacterium
LRLASGAVEILGLQQQT

SEQ ID NO: 1050146 - protein, 19 aa, Mycobacterium
LRLDARFGSVYRRRGHPPL

SEQ ID NO: 1050147 - protein, 20 aa, Mycobacterium
LRLFSDAGSTSMLEAAAAWG

SEQ ID NO: 1050148 - protein, 25 aa, Mycobacterium
LRLGGLARTRLGTVPVEERLIELGP

SEQ ID NO: 1050149 - protein, 25 aa, Mycobacterium
LRLIEIELDQCWDLLRQRRALRETG

SEQ ID NO: 1050150 - protein, 19 aa, Mycobacterium
LRLLAERVVGDPDGRNVLL

SEQ ID NO: 1050151 - protein, 17 aa, Mycobacterium
LRLLCRASGITDVSAPS

SEQ ID NO: 1050152 - protein, 18 aa, Mycobacterium
LRLLCVGQVLGVSASGYE

SEQ ID NO: 1050153 - protein, 17 aa, Mycobacterium
LRLLEGFRQRENLNWSA

SEQ ID NO: 1050154 - protein, 18 aa, Mycobacterium
LRLLGALPTLYDPRTTHT

SEQ ID NO: 1050155 - protein, 18 aa, Mycobacterium
LRLLHPVIPFITEALWQA

SEQ ID NO: 1050156 - protein, 20 aa, Mycobacterium
LRLLLPAGLETTYRSSGNLL

SEQ ID NO: 1050157 - protein, 19 aa, Mycobacterium
LRLPFGRLWGYDVSVSDLG

SEQ ID NO: 1050158 - protein, 19 aa, Mycobacterium
LRLRPRAVMTGRRRWSLPA

SEQ ID NO: 1050159 - protein, 17 aa, Mycobacterium
LRLTPARSLDQQAQDVI

SEQ ID NO: 1050160 - protein, 32 aa, Mycobacterium
LRLWRPPCGPGQWCTLGLFAARDEPSLRKLLT

SEQ ID NO: 1050161 - protein, 23 aa, Mycobacterium
LRMLRSFDPRSGAYVLDVEDPYY

SEQ ID NO: 1050162 - protein, 28 aa, Mycobacterium
LRMRPGDCGRDYRVLSVALLEVTFCGFP

SEQ ID NO: 1050163 - protein, 19 aa, Mycobacterium
LRNEWLFGQSWGIDVAVST

SEQ ID NO: 1050164 - protein, 24 aa, Mycobacterium
LRNFCRRHEVLLIFDEIATGFGHT

SEQ ID NO: 1050165 - protein, 18 aa, Mycobacterium
LRNGVIIRKARAHGLATP

SEQ ID NO: 1050166 - protein, 21 aa, Mycobacterium
LRNHARWAVLLRNLRYLIVDE

SEQ ID NO: 1050167 - protein, 19 aa, Mycobacterium
LRNKFGYNAWVLVYDIETV

SEQ ID NO: 1050168 - protein, 19 aa, Mycobacterium
LRNLFKLSSLASFEGQLGK

SEQ ID NO: 1050169 - protein, 18 aa, Mycobacterium
LRNNFSWTNSYYDDMAWL

SEQ ID NO: 1050170 - protein, 21 aa, Mycobacterium
LRNRFAAPFFDALRAYAAAPV

SEQ ID NO: 1050171 - protein, 29 aa, Mycobacterium
LRNWLNWVPCGWPQARAEPHRARITRPAL

SEQ ID NO: 1050172 - protein, 22 aa, Mycobacterium
LRPEAVAGELRSRVQEPSGIQM

SEQ ID NO: 1050173 - protein, 23 aa, Mycobacterium
LRPEELRRMAIPVVARAEKDLRA

SEQ ID NO: 1050174 - protein, 17 aa, Mycobacterium
LRPELANHLELFVDMHR

SEQ ID NO: 1050175 - protein, 32 aa, Mycobacterium
LRPGDRLLDVGCGWGGMVRYAARHGARVIGAT

SEQ ID NO: 1050176 - protein, 17 aa, Mycobacterium
LRPGWRGRSGLHQLYPL

SEQ ID NO: 1050177 - protein, 17 aa, Mycobacterium
LRPISGGLLMQQRDQLD

SEQ ID NO: 1050178 - protein, 18 aa, Mycobacterium
LRPNLAVSAQRTGPRNNQ

SEQ ID NO: 1050179 - protein, 19 aa, Mycobacterium
LRPPKGVLLYGPPGCGKTL

SEQ ID NO: 1050180 - protein, 25 aa, Mycobacterium
LRPPSLKAICPWEGFTDAYRDMFNP

SEQ ID NO: 1050181 - protein, 17 aa, Mycobacterium
LRPRLVYDRGTGTLTAR

SEQ ID NO: 1050182 - protein, 21 aa, Mycobacterium
LRPVRAAIIAPSFTEPAAALS

SEQ ID NO: 1050183 - protein, 18 aa, Mycobacterium
LRPVSVFINLAMQAHSAN

SEQ ID NO: 1050184 - protein, 20 aa, Mycobacterium
LRPYYIKTLRIWGDNLEANK

SEQ ID NO: 1050185 - protein, 23 aa, Mycobacterium
LRQDGMLALARLQRKMRLVESPY

SEQ ID NO: 1050186 - protein, 18 aa, Mycobacterium
LRQGALAGIMVDAVARAA

SEQ ID NO: 1050187 - protein, 17 aa, Mycobacterium
LRQGERVALRSGSNLEF

SEQ ID NO: 1050188 - protein, 18 aa, Mycobacterium
LRQLAIGSEGVFGVITKV

SEQ ID NO: 1050189 - protein, 18 aa, Mycobacterium
LRQLGCSTGTLQDFGPDF

SEQ ID NO: 1050190 - protein, 17 aa, Mycobacterium
LRQLGCSTGTLQDYGPD

SEQ ID NO: 1050191 - protein, 20 aa, Mycobacterium
LRQLTGRPSTDFTIPPQGSR

SEQ ID NO: 1050192 - protein, 18 aa, Mycobacterium
LRRAESRPTVPLEDVYPV

SEQ ID NO: 1050193 - protein, 17 aa, Mycobacterium
LRRAGAVLLGKLHMCEA

SEQ ID NO: 1050194 - protein, 19 aa, Mycobacterium
LRRAHSIGRFLGGAERWLR

SEQ ID NO: 1050195 - protein, 24 aa, Mycobacterium
LRRAVARLPLRLVYPDGTSIGAAD

SEQ ID NO: 1050196 - protein, 21 aa, Mycobacterium
LRRAVRLLAQLTRQVAVVQYP

SEQ ID NO: 1050197 - protein, 29 aa, Mycobacterium
LRREGIAHLPVRVRDGTGLVGPLVIPGVT

SEQ ID NO: 1050198 - protein, 20 aa, Mycobacterium
LRRELLRDGQAFYVHNRASS

SEQ ID NO: 1050199 - protein, 21 aa, Mycobacterium
LRRELPDLGVRVVNVVDIMRL

SEQ ID NO: 1050200 - protein, 30 aa, Mycobacterium; identical to SEQ ID NO: 696620

SEQ ID NO: 1050201 - protein, 22 aa, Mycobacterium
LRRESARPAKELAYVVNDIGAI

SEQ ID NO: 1050202 - protein, 17 aa, Mycobacterium
LRRGRRYSVARRLAGLF

SEQ ID NO: 1050203 - protein, 17 aa, Mycobacterium
LRRHLMLSAMVRSIRWD

SEQ ID NO: 1050204 - protein, 18 aa, Mycobacterium
LRRLCANMLCKLGVFSGT

SEQ ID NO: 1050205 - protein, 19 aa, Mycobacterium
LRRLEGVPIATVVRLPNAD

SEQ ID NO: 1050206 - protein, 28 aa, Mycobacterium
LRRLGYRSRPLWRPFIRVGTVSAQQRNA

SEQ ID NO: 1050207 - protein, 20 aa, Mycobacterium
LRRLPRLRDAVVTPEQAFAG

SEQ ID NO: 1050208 - protein, 28 aa, Mycobacterium
LRRMPEWSPQCRWMHQFGPLRQGTRTLN

SEQ ID NO: 1050209 - protein, 20 aa, Mycobacterium
LRRNGWKGFGPVPYAHESNQ

SEQ ID NO: 1050210 - protein, 20 aa, Mycobacterium
LRRRAQEAGGQFTIESPAAG

SEQ ID NO: 1050211 - protein, 19 aa, Mycobacterium
LRRRCLYHWIDYPEPARAA

SEQ ID NO: 1050212 - protein, 22 aa, Mycobacterium
LRRRDIGVGELLSMVQAGLNHT

SEQ ID NO: 1050213 - protein, 17 aa, Mycobacterium
LRRRFPSGLGQDYIDRA

SEQ ID NO: 1050214 - protein, 22 aa, Mycobacterium
LRRRGWPALESEHTWTPDDAGK

SEQ ID NO: 1050215 - protein, 26 aa, Mycobacterium
LRRRLRPRGGRALSVVITRIGTGSAS

SEQ ID NO: 1050216 - protein, 22 aa, Mycobacterium
LRRRLSGEVIDFVELDMPEHVL

SEQ ID NO: 1050217 - protein, 18 aa, Mycobacterium
LRRSCAAAGTSAQTPDAR

SEQ ID NO: 1050218 - protein, 20 aa, Mycobacterium
LRRSGRIGGAKAWLGTALAL

SEQ ID NO: 1050219 - protein, 30 aa, Mycobacterium
LRRSPRSDRLFCVPATIDLAGAEIELVSMV

SEQ ID NO: 1050220 - protein, 25 aa, Mycobacterium
LRRSYELLRPGGRLVGYGVSNMQEG

SEQ ID NO: 1050221 - protein, 22 aa, Mycobacterium
LRRVAAWADGWYGFNLDGVGAV

SEQ ID NO: 1050222 - protein, 20 aa, Mycobacterium
LRRWHIDGLLCIGDAAHAMS

SEQ ID NO: 1050223 - protein, 17 aa, Mycobacterium
LRRWLPMDMNRPLKSTL

SEQ ID NO: 1050224 - protein, 19 aa, Mycobacterium
LRRYMNWIPAEYVDAMAPT

SEQ ID NO: 1050225 - protein, 18 aa, Mycobacterium
LRSAAAAFLAVASGLTGN

SEQ ID NO: 1050226 - protein, 19 aa, Mycobacterium
LRSAHPLAPVLPLIRRLLI

SEQ ID NO: 1050227 - protein, 17 aa, Mycobacterium
LRSAQLITFTAMDIDDP

SEQ ID NO: 1050228 - protein, 19 aa, Mycobacterium
LRSAQLITFTAMDIDDPLR

SEQ ID NO: 1050229 - protein, 17 aa, Mycobacterium
LRSASYPRLEHITQDNP

SEQ ID NO: 1050230 - protein, 19 aa, Mycobacterium
LRSDMRAAAVFATDTARSC

SEQ ID NO: 1050231 - protein, 18 aa, Mycobacterium
LRSEARKGRMLPYVIELD

SEQ ID NO: 1050232 - protein, 22 aa, Mycobacterium
LRSELPPGGRLGIYGFGGSAHI

SEQ ID NO: 1050233 - protein, 18 aa, Mycobacterium
LRSFKRLLNDAGPHTEVS

SEQ ID NO: 1050234 - protein, 18 aa, Mycobacterium
LRSGECDLALAGGVTINA

SEQ ID NO: 1050235 - protein, 18 aa, Mycobacterium
LRSGESFSSRHRFVDTAG

SEQ ID NO: 1050236 - protein, 18 aa, Mycobacterium
LRSGGSIISVVAENPPAG

SEQ ID NO: 1050237 - protein, 26 aa, Mycobacterium
LRSKTRLAALRAKDFGKREVMVVHTL

SEQ ID NO: 1050238 - protein, 25 aa, Mycobacterium
LRSLLRPGGELRYLEHIASAGARGR

SEQ ID NO: 1050239 - protein, 23 aa, Mycobacterium
LRSPELPGWHLARGVRLTTSDLD

SEQ ID NO: 1050240 - protein, 18 aa, Mycobacterium
LRSPLLAVVKNGKLHGVI

SEQ ID NO: 1050241 - protein, 18 aa, Mycobacterium
LRSQAALRHEWEAQHVNV

SEQ ID NO: 1050242 - protein, 18 aa, Mycobacterium
LRSQGITAPAGFRAAGIA

SEQ ID NO: 1050243 - protein, 18 aa, Mycobacterium
LRSRCRHVALVTPPTTAI

SEQ ID NO: 1050244 - protein, 21 aa, Mycobacterium
LRSRGLPTMFPTIGGHEGSGI

SEQ ID NO: 1050245 - protein, 20 aa, Mycobacterium
LRSSEPIWWDEQFPGQGGGF

SEQ ID NO: 1050246 - protein, 26 aa, Mycobacterium
LRSVATWLRTMFAIMPLPVGTRDQDL

SEQ ID NO: 1050247 - protein, 18 aa, Mycobacterium
LRSWLAFGAEKVAEVAVL

SEQ ID NO: 1050248 - protein, 27 aa, Mycobacterium
LRSWRPRTALWGIHLVFRGGLRRAGVP

SEQ ID NO: 1050249 - protein, 17 aa, Mycobacterium
LRTAGSWEAAQTHVSVS

SEQ ID NO: 1050250 - protein, 25 aa, Mycobacterium
LRTEKSVMFIIPWGSHWIIGTTDTD

SEQ ID NO: 1050251 - protein, 22 aa, Mycobacterium
LRTELALPFSEWAVRHRLTPLT

SEQ ID NO: 1050252 - protein, 24 aa, Mycobacterium
LRTELRRAPHLGFLIDFDEAKISL

SEQ ID NO: 1050253 - protein, 19 aa, Mycobacterium
LRTEMGYPLHGHELSLDIS

SEQ ID NO: 1050254 - protein, 32 aa, Mycobacterium
LRTFSKAYGLAGLRVGYAVGQPDVIAPLDKVY

SEQ ID NO: 1050255 - protein, 18 aa, Mycobacterium
LRTGQPLGPVQLVEEAQD

SEQ ID NO: 1050256 - protein, 19 aa, Mycobacterium
LRTLLAGPIRDDAEVFEAL

SEQ ID NO: 1050257 - protein, 25 aa, Mycobacterium
LRTLQRLGFRCGVVSGGFRRIIEPL

SEQ ID NO: 1050258 - protein, 27 aa, Mycobacterium
LRTLRGGGTFTPRTWVALATEYFLAGH

SEQ ID NO: 1050259 - protein, 18 aa, Mycobacterium
LRTNLAAVILQMAALQLG

SEQ ID NO: 1050260 - protein, 18 aa, Mycobacterium
LRTPAQVREQWAQEFGLK

SEQ ID NO: 1050261 - protein, 25 aa, Mycobacterium
LRTRKAGAVGLVMAEPLTYFFSDPA

SEQ ID NO: 1050262 - protein, 17 aa, Mycobacterium
LRTTAMSLSHLARELGY

SEQ ID NO: 1050263 - protein, 18 aa, Mycobacterium
LRTVAVDLRQDWPKALTE

SEQ ID NO: 1050264 - protein, 17 aa, Mycobacterium
LRTVRCVSGTVELMMSC

SEQ ID NO: 1050265 - protein, 37 aa, Mycobacterium
LRTWLPTRRSPRTKARHRLRCPAPRRHTQDGSPLRLA

SEQ ID NO: 1050266 - protein, 20 aa, Mycobacterium
LRVAMFPAVEPDDISALTQC

SEQ ID NO: 1050267 - protein, 20 aa, Mycobacterium
LRVDPRMVLTATTIRQLGAA

SEQ ID NO: 1050268 - protein, 25 aa, Mycobacterium
LRVGEMVLAGYGFRTDPRSHAEIAA

SEQ ID NO: 1050269 - protein, 19 aa, Mycobacterium
LRVGQPVVAVGSPLGLAGT

SEQ ID NO: 1050270 - protein, 26 aa, Mycobacterium
LRVHARTGLPCPVCGDTVREVSFADK

SEQ ID NO: 1050271 - protein, 21 aa, Mycobacterium
LRVITFAVRVRTMYPPEVGLH

SEQ ID NO: 1050272 - protein, 17 aa, Mycobacterium
LRVKLGPVYLDAAVEPP

SEQ ID NO: 1050273 - protein, 17 aa, Mycobacterium
LRVKPSLAHKSTAQTKL

SEQ ID NO: 1050274 - protein, 17 aa, Mycobacterium
LRVLRNIERVIREEMNA

SEQ ID NO: 1050275 - protein, 18 aa, Mycobacterium
LRVPYVINPRMVRGLDYY

SEQ ID NO: 1050276 - protein, 18 aa, Mycobacterium
LRVQMRGEIARLQKRLGT

SEQ ID NO: 1050277 - protein, 17 aa, Mycobacterium
LRVQQCWVEPRAWETLQ

SEQ ID NO: 1050278 - protein, 19 aa, Mycobacterium
LRVRLPLPKLTVAVENPQA

SEQ ID NO: 1050279 - protein, 18 aa, Mycobacterium
LRVRVKSRAPAIVDTHNA

SEQ ID NO: 1050280 - protein, 17 aa, Mycobacterium
LRVSAPLEAAGSLRTAL

SEQ ID NO: 1050281 - protein, 22 aa, Mycobacterium
LRVTHPAAIVWAAQMGTVTLHP

SEQ ID NO: 1050282 - protein, 22 aa, Mycobacterium
LRVTPKISWSLNLRGEPVANDE

SEQ ID NO: 1050283 - protein, 25 aa, Mycobacterium
LRVVQYWIDHGVKFFRVDNPHTKPP

SEQ ID NO: 1050284 - protein, 17 aa, Mycobacterium
LRWKGYLKPGSRDDATE

SEQ ID NO: 1050285 - protein, 18 aa, Mycobacterium
LRWPCPVPGAMAVSEVGD

SEQ ID NO: 1050286 - protein, 19 aa, Mycobacterium
LRYAEPVRRYLLGRYTGVN

SEQ ID NO: 1050287 - protein, 18 aa, Mycobacterium
LRYGIPEFKMEKRVLNRR

SEQ ID NO: 1050288 - protein, 17 aa, Mycobacterium
LRYGPDVTTIATVPADA

SEQ ID NO: 1050289 - protein, 17 aa, Mycobacterium
LRYLGSQGPQIDWSKVH

SEQ ID NO: 1050290 - protein, 35 aa, Mycobacterium; identical to SEQ ID NO: 697071

SEQ ID NO: 1050291 - protein, 18 aa, Mycobacterium
LRYPAKVTGFFGMNTAAP

SEQ ID NO: 1050292 - protein, 18 aa, Mycobacterium
LRYPESHNLYILDRRNGA

SEQ ID NO: 1050293 - protein, 17 aa, Mycobacterium
LRYSLGRPAALLEPKHY

SEQ ID NO: 1050294 - protein, 22 aa, Mycobacterium
LRYYPAALFEVISQVNAEVRDA

SEQ ID NO: 1050295 - protein, 21 aa, Mycobacterium
LSAAVHGWVLAPANRDRALEF

SEQ ID NO: 1050296 - protein, 17 aa, Mycobacterium
LSAAYGIEPDSSRIDYY

SEQ ID NO: 1050297 - protein, 19 aa, Mycobacterium
LSADGDRGGAGATGGVGGA

SEQ ID NO: 1050298 - protein, 19 aa, Mycobacterium
LSADGRCKAFAGAADGTGF

SEQ ID NO: 1050299 - protein, 18 aa, Mycobacterium
LSADWVMPELLQFEAALA

SEQ ID NO: 1050300 - protein, 23 aa, Mycobacterium
LSAGHARALLSLEAGPEAQEELA

SEQ ID NO: 1050301 - protein, 31 aa, Mycobacterium
LSAILIPLGELINMIPFPSFLADDFTVLDGL

SEQ ID NO: 1050302 - protein, 23 aa, Mycobacterium
LSAKLELLAAVAATGVREVEATA

SEQ ID NO: 1050303 - protein, 21 aa, Mycobacterium
LSAKSRATFQAALAGVEGGRG

SEQ ID NO: 1050304 - protein, 19 aa, Mycobacterium
LSALLAWPTDHLTEAAAHW

SEQ ID NO: 1050305 - protein, 17 aa, Mycobacterium
LSALVAHLVGADALVLL

SEQ ID NO: 1050306 - protein, 20 aa, Mycobacterium
LSAPECTHYPLAEAAEAIRT

SEQ ID NO: 1050307 - protein, 25 aa, Mycobacterium
LSAPGPCRAAGTSDLTFASGWLEFR

SEQ ID NO: 1050308 - protein, 19 aa, Mycobacterium
LSAQALVFHDQFVQMLNAG

SEQ ID NO: 1050309 - protein, 22 aa, Mycobacterium
LSAQVAAFHRQLVAGLHSGAAA

SEQ ID NO: 1050310 - protein, 17 aa, Mycobacterium
LSAQWSGTVADFLVVQV

SEQ ID NO: 1050311 - protein, 24 aa, Mycobacterium
LSARRMHGYWALHEGCLQLRGDAG

SEQ ID NO: 1050312 - protein, 22 aa, Mycobacterium
LSATRARFLVHAAMALVVDLGR

SEQ ID NO: 1050313 - protein, 23 aa, Mycobacterium
LSDAEQTQWPGWVPVGRMGVPED

SEQ ID NO: 1050314 - protein, 24 aa, Mycobacterium
LSDAESWPSWAPVITKVTWTSPPP

SEQ ID NO: 1050315 - protein, 21 aa, Mycobacterium
LSDDEFGFFVVMLAVAGNETT

SEQ ID NO: 1050316 - protein, 24 aa, Mycobacterium
LSDELRARLDAALAKPAAQQPSWP

SEQ ID NO: 1050317 - protein, 24 aa, Mycobacterium
LSDLELYLFFSLLFSAGAETTRNA

SEQ ID NO: 1050318 - protein, 25 aa, Mycobacterium
LSDLIKRGGLRPGRTEREVARDLEG

SEQ ID NO: 1050319 - protein, 19 aa, Mycobacterium
LSDLRRFSGARVPMADLEL

SEQ ID NO: 1050320 - protein, 22 aa, Mycobacterium
LSDPCGYLQWLRELVGQQAWIV

SEQ ID NO: 1050321 - protein, 21 aa, Mycobacterium
LSDRRQAMLGGHAVVLHPGPM

SEQ ID NO: 1050322 - protein, 23 aa, Mycobacterium
LSDVRRYGATYANYVGKPLSYVL

SEQ ID NO: 1050323 - protein, 18 aa, Mycobacterium
LSDYRGAKNVLLVFFPLA

SEQ ID NO: 1050324 - protein, 21 aa, Mycobacterium
LSEAELMAWAVPQAANQFWML

SEQ ID NO: 1050325 - protein, 24 aa, Mycobacterium
LSEALKRRCLFLHIDFPTPEMERR

SEQ ID NO: 1050326 - protein, 30 aa, Mycobacterium; identical to SEQ ID NO: 697300

SEQ ID NO: 1050327 - protein, 18 aa, Mycobacterium
LSEIRWPTTDSMESGIDM

SEQ ID NO: 1050328 - protein, 17 aa, Mycobacterium
LSERIIFLGSEVNDEVA

SEQ ID NO: 1050329 - protein, 17 aa, Mycobacterium
LSEVFGGVSEVLGSPFP

SEQ ID NO: 1050330 - protein, 18 aa, Mycobacterium
LSEYDWRSGEAREKYDQI

SEQ ID NO: 1050331 - protein, 22 aa, Mycobacterium
LSEYLHCIAKEFAKEVANRRQV

SEQ ID NO: 1050332 - protein, 25 aa, Mycobacterium
LSFIPSLGWINSWINYGINWVNSLI

SEQ ID NO: 1050333 - protein, 24 aa, Mycobacterium
LSFMARYVLHNGFLESDKLAEVWS

SEQ ID NO: 1050334 - protein, 25 aa, Mycobacterium
LSFPEGYGRLGGGYFALAVTLEELG

SEQ ID NO: 1050335 - protein, 27 aa, Mycobacterium
LSFSRYELLRLLAFSRTGALPITKASD

SEQ ID NO: 1050336 - protein, 25 aa, Mycobacterium
LSFYRPNQPGAYPIVLATYEIVCSK

SEQ ID NO: 1050337 - protein, 18 aa, Mycobacterium
LSGALVLGWGEPNTSDSG

SEQ ID NO: 1050338 - protein, 22 aa, Mycobacterium
LSGAPMPDWLGNALSATPGLSA

SEQ ID NO: 1050339 - protein, 19 aa, Mycobacterium
LSGASRDGLYLAVANNGQH

SEQ ID NO: 1050340 - protein, 17 aa, Mycobacterium
LSGEIFSCFSMTEPQGG

SEQ ID NO: 1050341 - protein, 17 aa, Mycobacterium
LSGFVGADGGRRRRRRP

SEQ ID NO: 1050342 - protein, 27 aa, Mycobacterium
LSGGKRLRPIFAYRGWPAVTTEDPDPD

SEQ ID NO: 1050343 - protein, 23 aa, Mycobacterium
LSGGRFTLGIGRGIAAIYGAFGI

SEQ ID NO: 1050344 - protein, 25 aa, Mycobacterium
LSGGRVSLGVGFGWNTDELADHGVP

SEQ ID NO: 1050345 - protein, 24 aa, Mycobacterium
LSGIGFGLGVDRTMLALRAEGKSV

SEQ ID NO: 1050346 - protein, 17 aa, Mycobacterium
LSGLSMRSLAAALGTGP

SEQ ID NO: 1050347 - protein, 20 aa, Mycobacterium
LSGNFCRCTGYQGIVAATRR

SEQ ID NO: 1050348 - protein, 18 aa, Mycobacterium
LSGRAESVQQIWFGLSTL

SEQ ID NO: 1050349 - protein, 23 aa, Mycobacterium
LSGRIRHVMIPGMIVEEDDRPIP

SEQ ID NO: 1050350 - protein, 19 aa, Mycobacterium
LSGSALIRMARPVASPALD

SEQ ID NO: 1050351 - protein, 21 aa, Mycobacterium
LSGSGPAYFLLMVEALVDAGV

SEQ ID NO: 1050352 - protein, 17 aa, Mycobacterium
LSGSIRWASNLYQDSVL

SEQ ID NO: 1050353 - protein, 19 aa, Mycobacterium
LSGVSGRVASALEGTSAAA

SEQ ID NO: 1050354 - protein, 18 aa, Mycobacterium
LSHEVGYGRLIAGLDDAL

SEQ ID NO: 1050355 - protein, 19 aa, Mycobacterium
LSHEVGYGRLIAGLDDALV

SEQ ID NO: 1050356 - protein, 17 aa, Mycobacterium
LSHPYLDTVLFLLGVTR

SEQ ID NO: 1050357 - protein, 29 aa, Mycobacterium
LSIGSFRFWFIGQRWEWSDEVAGMHGYEP

SEQ ID NO: 1050358 - protein, 18 aa, Mycobacterium
LSIHAAEFHGSFVQAVKC

SEQ ID NO: 1050359 - protein, 18 aa, Mycobacterium
LSIKPVFLRENWYCPECM

SEQ ID NO: 1050360 - protein, 19 aa, Mycobacterium
LSINAEFERPLSPERAREL

SEQ ID NO: 1050361 - protein, 17 aa, Mycobacterium
LSIVGFGLKSHVKYSDV

SEQ ID NO: 1050362 - protein, 17 aa, Mycobacterium
LSKARLHLVTGKGGTGK

SEQ ID NO: 1050363 - protein, 24 aa, Mycobacterium
LSKELRPWVPVVSLVKGLEQGTNK

SEQ ID NO: 1050364 - protein, 20 aa, Mycobacterium
LSKLRYHKIVLMADADVDGQ

SEQ ID NO: 1050365 - protein, 19 aa, Mycobacterium
LSLARACGYVHPALVPLQA

SEQ ID NO: 1050366 - protein, 18 aa, Mycobacterium
LSLIGAGMRSHPGVTATF

SEQ ID NO: 1050367 - protein, 24 aa, Mycobacterium
LSLKVPARHFVLFSSISGLIGSRW

SEQ ID NO: 1050368 - protein, 27 aa, Mycobacterium
LSLMVKAGVQWGLFGGAVENLGTERHH

SEQ ID NO: 1050369 - protein, 19 aa, Mycobacterium
LSLRVMSWGAAPAPDALLC

SEQ ID NO: 1050370 - protein, 19 aa, Mycobacterium
LSLTIGWPELAEAALAIRA

SEQ ID NO: 1050371 - protein, 24 aa, Mycobacterium
LSLWWTWTPGASWRHPAGPHSSIA

SEQ ID NO: 1050372 - protein, 19 aa, Mycobacterium
LSMAEWQGAAVYREAQPGK

SEQ ID NO: 1050373 - protein, 17 aa, Mycobacterium
LSMPLILLDGITNRETM

SEQ ID NO: 1050374 - protein, 18 aa, Mycobacterium
LSNFSQGLSNFWSATTAS

SEQ ID NO: 1050375 - protein, 26 aa, Mycobacterium
LSNLSCGRFLLGLGASGPRVIEGLHG

SEQ ID NO: 1050376 - protein, 20 aa, Mycobacterium
LSPAGCQRVAIAAQDGLART

SEQ ID NO: 1050377 - protein, 19 aa, Mycobacterium
LSPALTFGGANLNFFPMGA

SEQ ID NO: 1050378 - protein, 17 aa, Mycobacterium
LSPEALVAMALDSEDDD

SEQ ID NO: 1050379 - protein, 27 aa, Mycobacterium
LSPEIMGLGPIEACKKALQRAGMSISD

SEQ ID NO: 1050380 - protein, 32 aa, Mycobacterium
LSPERVELRYTMPLGEIIFDFFDSLISRTRGY

SEQ ID NO: 1050381 - protein, 22 aa, Mycobacterium
LSPKWQKIWKPVVCAVQGMCTA

SEQ ID NO: 1050382 - protein, 20 aa, Mycobacterium
LSPLGVIERGVWGAVNGPAV

SEQ ID NO: 1050383 - protein, 23 aa, Mycobacterium
LSPLQAKALWAFNMAPLTLTAVP

SEQ ID NO: 1050384 - protein, 18 aa, Mycobacterium
LSPRGRRLGLTDTNNGLR

SEQ ID NO: 1050385 - protein, 17 aa, Mycobacterium
LSPSFNWDTTGMTDEEM

SEQ ID NO: 1050386 - protein, 26 aa, Mycobacterium
LSQGRFSFVAGMGYRPQEYHAAGKDW

SEQ ID NO: 1050387 - protein, 22 aa, Mycobacterium
LSQLRPLPFRLVLDGTEEIETD

SEQ ID NO: 1050388 - protein, 20 aa, Mycobacterium
LSRAAGVPARVAFQTLDSPE

SEQ ID NO: 1050389 - protein, 17 aa, Mycobacterium
LSRAIHGIATFPKLGGA

SEQ ID NO: 1050390 - protein, 19 aa, Mycobacterium
LSRMEPFVGDFVGRGLTRA

SEQ ID NO: 1050391 - protein, 18 aa, Mycobacterium
LSRPMCMSYLIDGLEDGR

SEQ ID NO: 1050392 - protein, 18 aa, Mycobacterium
LSRVNRLQPFDGYTDPAA

SEQ ID NO: 1050393 - protein, 22 aa, Mycobacterium
LSRVPLWVEETLRYDTSSQILA

SEQ ID NO: 1050394 - protein, 18 aa, Mycobacterium
LSRVSSRLRIHGSTGIDL

SEQ ID NO: 1050395 - protein, 18 aa, Mycobacterium
LSRYPDERAKWWSDFDGL

SEQ ID NO: 1050396 - protein, 18 aa, Mycobacterium
LSSAQLVAAYTKLRPDAA

SEQ ID NO: 1050397 - protein, 17 aa, Mycobacterium
LSSMAVAGMLGSAFGAG

SEQ ID NO: 1050398 - protein, 17 aa, Mycobacterium
LSTCSWSTPSTPAANTD

SEQ ID NO: 1050399 - protein, 25 aa, Mycobacterium
LSTFPHPRYELIPQMTVHDGDQAVR

SEQ ID NO: 1050400 - protein, 17 aa, Mycobacterium
LSTGVAVAFPRSPFVTA

SEQ ID NO: 1050401 - protein, 18 aa, Mycobacterium
LSTIDSWVRLLTSVRPSL

SEQ ID NO: 1050402 - protein, 18 aa, Mycobacterium
LSTITVNTTLVWGLHDTV

SEQ ID NO: 1050403 - protein, 17 aa, Mycobacterium
LSTPIPITILLTQPPPV

SEQ ID NO: 1050404 - protein, 19 aa, Mycobacterium
LSTQVGVFSDQFVAALSAS

SEQ ID NO: 1050405 - protein, 22 aa, Mycobacterium
LSTRFEALPGRKADTDAAARRL

SEQ ID NO: 1050406 - protein, 24 aa, Mycobacterium
LSTRPEYDIPIYLAALSPAMLRLT

SEQ ID NO: 1050407 - protein, 25 aa, Mycobacterium
LSTSRELPWRRPIASLNYLLSSHVW

SEQ ID NO: 1050408 - protein, 17 aa, Mycobacterium
LSVAKGLLLRRDNDREA

SEQ ID NO: 1050409 - protein, 17 aa, Mycobacterium
LSVEADAAGGLHLVFDF

SEQ ID NO: 1050410 - protein, 17 aa, Mycobacterium
LSVEPQVAFFGDNIPLL

SEQ ID NO: 1050411 - protein, 18 aa, Mycobacterium
LSVGDLLVPGRRSNYGAE

SEQ ID NO: 1050412 - protein, 21 aa, Mycobacterium
LSVGQVFDWAPALTLSAGLAA

SEQ ID NO: 1050413 - protein, 20 aa, Mycobacterium
LSVIPRQRVLVVSTGTELVP

SEQ ID NO: 1050414 - protein, 19 aa, Mycobacterium
LSVPANWTSVIPTLNGGAI

SEQ ID NO: 1050415 - protein, 18 aa, Mycobacterium
LSVQLSGWMLMEAAHSVA

SEQ ID NO: 1050416 - protein, 19 aa, Mycobacterium
LSVSLKFQGFEVHTATNGA

SEQ ID NO: 1050417 - protein, 18 aa, Mycobacterium
LSVYPRELFVYELAESAQ

SEQ ID NO: 1050418 - protein, 28 aa, Mycobacterium
LSYASVRRWPHRGLRSLLTIRVGDAVEP

SEQ ID NO: 1050419 - protein, 20 aa, Mycobacterium
LSYCIDWSYDHCTPIQQQLW

SEQ ID NO: 1050420 - protein, 33 aa, Mycobacterium
LSYSDGDIWDWAVDWDTWVGMSALLSFPTVHQP

SEQ ID NO: 1050421 - protein, 20 aa, Mycobacterium
LTAAASYAALFGTWEPVVSA

SEQ ID NO: 1050422 - protein, 20 aa, Mycobacterium
LTAAGDCYTGAALVGASPEL

SEQ ID NO: 1050423 - protein, 27 aa, Mycobacterium
LTADFNFAWPTARIAVIGADGAAQLLM

SEQ ID NO: 1050424 - protein, 17 aa, Mycobacterium
LTAGLQPVDCRFCHVTV

SEQ ID NO: 1050425 - protein, 25 aa, Mycobacterium
LTAIRLGALAPELVDELVLIDVTPS

SEQ ID NO: 1050426 - protein, 26 aa, Mycobacterium
LTAKSMPYKSGFGPFAPEIYRAPVSY

SEQ ID NO: 1050427 - protein, 18 aa, Mycobacterium
LTALPMRRAIVMVICGKA

SEQ ID NO: 1050428 - protein, 22 aa, Mycobacterium
LTANAYLGAWGIVDCLNSGADV

SEQ ID NO: 1050429 - protein, 18 aa, Mycobacterium
LTAPPVRFIKTIGDAVML

SEQ ID NO: 1050430 - protein, 24 aa, Mycobacterium
LTAQNRLRFAAGNFYINDKPTGAV

SEQ ID NO: 1050431 - protein, 20 aa, Mycobacterium
LTARAAGVVCMRVHERGVGE

SEQ ID NO: 1050432 - protein, 23 aa, Mycobacterium
LTARLPGYMLPSAIVTVESLPLT

SEQ ID NO: 1050433 - protein, 26 aa, Mycobacterium
LTARVLQRWSVAPVRPAVTVVQALPK

SEQ ID NO: 1050434 - protein, 27 aa, Mycobacterium
LTATLLTARCPVMFAPAMHTEMWLHPA

SEQ ID NO: 1050435 - protein, 19 aa, Mycobacterium
LTDAIALLIAEGHPVHVVV

SEQ ID NO: 1050436 - protein, 22 aa, Mycobacterium
LTDAVTQHWGPPPGELFVDRSN

SEQ ID NO: 1050437 - protein, 20 aa, Mycobacterium
LTDEARMAPDLRGRISMASI

SEQ ID NO: 1050438 - protein, 19 aa, Mycobacterium
LTDHCRADLAGGPVVGPPP

SEQ ID NO: 1050439 - protein, 20 aa, Mycobacterium
LTDPRLAGIHFTGSTATFQH

SEQ ID NO: 1050440 - protein, 17 aa, Mycobacterium
LTDRKAIGIGEYMQTSV

SEQ ID NO: 1050441 - protein, 23 aa, Mycobacterium
LTEAIKLVALVADRGAQVRMEFA

SEQ ID NO: 1050442 - protein, 18 aa, Mycobacterium
LTEPRYLIGRKILTPPSG

SEQ ID NO: 1050443 - protein, 17 aa, Mycobacterium
LTESGVPSAVWVVTANG

SEQ ID NO: 1050444 - protein, 21 aa, Mycobacterium
LTESRTALAEVLGRSDSPDLS

SEQ ID NO: 1050445 - protein, 19 aa, Mycobacterium
LTFAHGVAVAARLAERAVA

SEQ ID NO: 1050446 - protein, 19 aa, Mycobacterium
LTFETARFIKFIVTEIFPG

SEQ ID NO: 1050447 - protein, 18 aa, Mycobacterium
LTGCAKLFRQGYTDIDQF

SEQ ID NO: 1050448 - protein, 18 aa, Mycobacterium
LTGGLPFFGGAGNNYSMH

SEQ ID NO: 1050449 - protein, 22 aa, Mycobacterium
LTGGVVKPILWGPGKAAAVQRF

SEQ ID NO: 1050450 - protein, 17 aa, Mycobacterium
LTGHKWFTSAPMCDIFL

SEQ ID NO: 1050451 - protein, 17 aa, Mycobacterium
LTGKTGLTGNARLTGKT

SEQ ID NO: 1050452 - protein, 24 aa, Mycobacterium
LTGPYRLTMGLYRSLKASTAVGGA

SEQ ID NO: 1050453 - protein, 17 aa, Mycobacterium
LTGQAWQGAAAKAMAAV

SEQ ID NO: 1050454 - protein, 19 aa, Mycobacterium
LTGQGGWPMTCFLTPDGRP

SEQ ID NO: 1050455 - protein, 19 aa, Mycobacterium
LTGRASYGGIGARRPAAAV

SEQ ID NO: 1050456 - protein, 26 aa, Mycobacterium
LTGRPAISLPLHWTPAGLPLGVQFVG

SEQ ID NO: 1050457 - protein, 26 aa, Mycobacterium
LTGRPSAFAARCRVHLPQDVVSGPGD

SEQ ID NO: 1050458 - protein, 18 aa, Mycobacterium
LTGRRWFDEHGVSFARHY

SEQ ID NO: 1050459 - protein, 22 aa, Mycobacterium
LTGTGQFGFGGLNSGSGNIGLF

SEQ ID NO: 1050460 - protein, 23 aa, Mycobacterium
LTGTRPLREWLAALTDGIALLTR

SEQ ID NO: 1050461 - protein, 18 aa, Mycobacterium
LTGTVAQVFGDRLVSVTY

SEQ ID NO: 1050462 - protein, 25 aa, Mycobacterium
LTGVQRVFFGWAQMWRSKSRDAETI

SEQ ID NO: 1050463 - protein, 18 aa, Mycobacterium
LTHAVSDPTGPTRAAVAI

SEQ ID NO: 1050464 - protein, 24 aa, Mycobacterium
LTHEIVHFSQFILAEIFPGGWLPT

SEQ ID NO: 1050465 - protein, 23 aa, Mycobacterium
LTHPQYLVMLALWDNQRTSSGQG

SEQ ID NO: 1050466 - protein, 17 aa, Mycobacterium
LTIEGFDALAYHWGIVE

SEQ ID NO: 1050467 - protein, 23 aa, Mycobacterium
LTIPDRPTGIVVFAHGSGSSRHS

SEQ ID NO: 1050468 - protein, 17 aa, Mycobacterium
LTIPILLIRGKLSDVVT

SEQ ID NO: 1050469 - protein, 17 aa, Mycobacterium
LTIRGMEIRTFMGDYPD

SEQ ID NO: 1050470 - protein, 24 aa, Mycobacterium
LTIVYEPYPLVGVITPWNGPLSVP

SEQ ID NO: 1050471 - protein, 20 aa, Mycobacterium
LTKLQSSWHGSGNESYSSVQ

SEQ ID NO: 1050472 - protein, 18 aa, Mycobacterium
LTLARLAAEAGLPDGVLN

SEQ ID NO: 1050473 - protein, 25 aa, Mycobacterium
LTLDQACLLMFPRRDLTVDESQSVG

SEQ ID NO: 1050474 - protein, 19 aa, Mycobacterium
LTLEEALGHVEWVARALLD

SEQ ID NO: 1050475 - protein, 18 aa, Mycobacterium
LTLNRPEALNAFNEALYD

SEQ ID NO: 1050476 - protein, 18 aa, Mycobacterium
LTLPGRSLLFVRNVGHLM

SEQ ID NO: 1050477 - protein, 17 aa, Mycobacterium
LTLPRGMVPTDRNSDPK

SEQ ID NO: 1050478 - protein, 28 aa, Mycobacterium
LTLRGALVRDPHAWSGYLTEAIDTFADR

SEQ ID NO: 1050479 - protein, 25 aa, Mycobacterium
LTLRLRAAGIPILGKTNMDEFAMGS

SEQ ID NO: 1050480 - protein, 21 aa, Mycobacterium
LTLRPRLIEVLGVDPLTDAGM

SEQ ID NO: 1050481 - protein, 20 aa, Mycobacterium
LTLTAVPGFVPWTKPSFNVI

SEQ ID NO: 1050482 - protein, 25 aa, Mycobacterium
LTLTEFRLFHFLVRHAGQAFTHTRL

SEQ ID NO: 1050483 - protein, 22 aa, Mycobacterium
LTMGIGGGYVTSWVGDPGAVIE

SEQ ID NO: 1050484 - protein, 22 aa, Mycobacterium
LTMGIGGGYVTSWVGDPGAVTE

SEQ ID NO: 1050485 - protein, 17 aa, Mycobacterium
LTMLGGLQRHFADQIRD

SEQ ID NO: 1050486 - protein, 20 aa, Mycobacterium
LTMRGLKTLVLRMQRHSENA

SEQ ID NO: 1050487 - protein, 23 aa, Mycobacterium
LTNALRGYAAWITGLRRVESPTR

SEQ ID NO: 1050488 - protein, 17 aa, Mycobacterium
LTNFGSALPEFAAQLSG

SEQ ID NO: 1050489 - protein, 34 aa, Mycobacterium; identical to SEQ ID NO: 698385

SEQ ID NO: 1050490 - protein, 18 aa, Mycobacterium
LTPALGIGAFADKTLVHS

SEQ ID NO: 1050491 - protein, 18 aa, Mycobacterium
LTPAPGRIALYSTVHGVT

SEQ ID NO: 1050492 - protein, 26 aa, Mycobacterium
LTPDGRPFYCGTYYPKAGFLQLLSAV

SEQ ID NO: 1050493 - protein, 17 aa, Mycobacterium
LTPDRYVHELLVEHLHV

SEQ ID NO: 1050494 - protein, 23 aa, Mycobacterium
LTPEEIVRFCVTLVVAGSETTTF

SEQ ID NO: 1050495 - protein, 23 aa, Mycobacterium
LTPGDKGFQGGLGGSGGVGGAGG

SEQ ID NO: 1050496 - protein, 17 aa, Mycobacterium
LTPILCLTKTDLAPPEP

SEQ ID NO: 1050497 - protein, 18 aa, Mycobacterium
LTPLAVDPAHPFPFVSGL

SEQ ID NO: 1050498 - protein, 18 aa, Mycobacterium
LTPLKDLKDATSPEKLKR

SEQ ID NO: 1050499 - protein, 24 aa, Mycobacterium
LTPLRPWRSALVEALAVSRSLPVD

SEQ ID NO: 1050500 - protein, 25 aa, Mycobacterium
LTPLRPWRSALVEALAVSRSLPVDR

SEQ ID NO: 1050501 - protein, 22 aa, Mycobacterium
LTPWAQRGVMLLNRVLTVRPSN

SEQ ID NO: 1050502 - protein, 19 aa, Mycobacterium
LTQAALPRRAHVCLLTGAE

SEQ ID NO: 1050503 - protein, 23 aa, Mycobacterium
LTQNICFLYHLLGGGTGDWDVPI

SEQ ID NO: 1050504 - protein, 19 aa, Mycobacterium
LTQRYGARLELLYTELADS

SEQ ID NO: 1050505 - protein, 25 aa, Mycobacterium
LTRALKDWADRGVRVVGLDAGGDTA

SEQ ID NO: 1050506 - protein, 19 aa, Mycobacterium
LTRDAGWGNAMRWLLTGDE

SEQ ID NO: 1050507 - protein, 19 aa, Mycobacterium
LTRITCGYAATTDSVEVVR

SEQ ID NO: 1050508 - protein, 18 aa, Mycobacterium
LTRKQMYSSVGFRPTSRQ

SEQ ID NO: 1050509 - protein, 18 aa, Mycobacterium
LTRMPTVQVDIGYITNPL

SEQ ID NO: 1050510 - protein, 26 aa, Mycobacterium
LTRTRAPVEFDRVLGMLDRLASSLQV

SEQ ID NO: 1050511 - protein, 28 aa, Mycobacterium
LTSCDAFEHFPPPILKPVILAAKSKKMF

SEQ ID NO: 1050512 - protein, 17 aa, Mycobacterium
LTSHTPCCRYRLYRNKA

SEQ ID NO: 1050513 - protein, 18 aa, Mycobacterium
LTSHTPCCRYRLYRNKAA

SEQ ID NO: 1050514 - protein, 25 aa, Mycobacterium
LTSIALPRIRDFRGLSPKQFDGVGN

SEQ ID NO: 1050515 - protein, 17 aa, Mycobacterium
LTSKPWVKTTMAPGSQV

SEQ ID NO: 1050516 - protein, 24 aa, Mycobacterium
LTSRLRPVPLRHPRFVVDVNLGRL

SEQ ID NO: 1050517 - protein, 26 aa, Mycobacterium
LTSRPCPTCRGVGVVIPDPCHQCMGD

SEQ ID NO: 1050518 - protein, 25 aa, Mycobacterium
LTTEGFPNLFLIAGPNSPSVLSNMA

SEQ ID NO: 1050519 - protein, 20 aa, Mycobacterium
LTTIALKISPLRAHASGDYP

SEQ ID NO: 1050520 - protein, 17 aa, Mycobacterium
LTTRPGTLTAIIGGSGA

SEQ ID NO: 1050521 - protein, 20 aa, Mycobacterium
LTTRTLFFARSLPAVAHFLD

SEQ ID NO: 1050522 - protein, 18 aa, Mycobacterium
LTTVIAITGGGRFALQIR

SEQ ID NO: 1050523 - protein, 17 aa, Mycobacterium
LTVGIGVGGRREDYLAV

SEQ ID NO: 1050524 - protein, 23 aa, Mycobacterium
LTVKSLDEAIGFVNSRPKPLSAY

SEQ ID NO: 1050525 - protein, 23 aa, Mycobacterium
LTVNGKIPGLSMKTLSGDLTTNP

SEQ ID NO: 1050526 - protein, 24 aa, Mycobacterium
LTVRGISRIVTWLFVNAAGAETLS

SEQ ID NO: 1050527 - protein, 17 aa, Mycobacterium
LTYNDVFIMPNRSLVAS

SEQ ID NO: 1050528 - protein, 17 aa, Mycobacterium
LTYPEVFAQAVVLAGPP

SEQ ID NO: 1050529 - protein, 25 aa, Mycobacterium
LTYRKVFPFLLRLYHRILQTSDPNS

SEQ ID NO: 1050530 - protein, 17 aa, Mycobacterium
LVAAALGGFGARFLAQH

SEQ ID NO: 1050531 - protein, 30 aa, Mycobacterium; identical to SEQ ID NO: 698696

SEQ ID NO: 1050532 - protein, 31 aa, Mycobacterium; identical to SEQ ID NO: 698713

SEQ ID NO: 1050533 - protein, 19 aa, Mycobacterium
LVAEFDFRSLVGVVAVMAD

SEQ ID NO: 1050534 - protein, 18 aa, Mycobacterium
LVAEIDRGTWTPAPVFAM

SEQ ID NO: 1050535 - protein, 24 aa, Mycobacterium
LVAERLAPGSWQWWQAGHQSTEPG

SEQ ID NO: 1050536 - protein, 25 aa, Mycobacterium
LVAERLAPGSWQWWQAGHQSTEPGH

SEQ ID NO: 1050537 - protein, 18 aa, Mycobacterium
LVAETFASGSARRDSDAD

SEQ ID NO: 1050538 - protein, 17 aa, Mycobacterium
LVAGGRGLIAFTSSPGS

SEQ ID NO: 1050539 - protein, 25 aa, Mycobacterium
LVAGLRLRLPIIGTDLGTFDTASTA

SEQ ID NO: 1050540 - protein, 17 aa, Mycobacterium
LVAGLYRAAVAREAEAF

SEQ ID NO: 1050541 - protein, 24 aa, Mycobacterium
LVALGDRMAWRVLATGECEKLTPM

SEQ ID NO: 1050542 - protein, 17 aa, Mycobacterium
LVALMPMSMRSQAGAGN

SEQ ID NO: 1050543 - protein, 17 aa, Mycobacterium
LVAPYFRSAIESAVDSW

SEQ ID NO: 1050544 - protein, 22 aa, Mycobacterium
LVAQHRGYKCVFVCPDKVSEDK

SEQ ID NO: 1050545 - protein, 18 aa, Mycobacterium
LVASFAIDELLDYRSRRP

SEQ ID NO: 1050546 - protein, 18 aa, Mycobacterium
LVASFAIDELLDYRSRRS

SEQ ID NO: 1050547 - protein, 17 aa, Mycobacterium
LVATNFFGLNTIPITLN

SEQ ID NO: 1050548 - protein, 39 aa, Mycobacterium
LVCASIYQATKFYELFVAAGFKGKCAIVTSYEPNASDIS

SEQ ID NO: 1050549 - protein, 19 aa, Mycobacterium
LVCRSCGSTIEVADHEVET

SEQ ID NO: 1050550 - protein, 23 aa, Mycobacterium
LVDARTIVTLSGFAPPTLHAVGI

SEQ ID NO: 1050551 - protein, 19 aa, Mycobacterium
LVDARYCALEVHDRDKRVL

SEQ ID NO: 1050552 - protein, 17 aa, Mycobacterium
LVDCLAFELKMGPAELR

SEQ ID NO: 1050553 - protein, 17 aa, Mycobacterium
LVDDLTVQLALGGLLPG

SEQ ID NO: 1050554 - protein, 18 aa, Mycobacterium
LVDFCAERGLLVTAEPLD

SEQ ID NO: 1050555 - protein, 20 aa, Mycobacterium
LVDSDLRWYKDYTGTGNSLN

SEQ ID NO: 1050556 - protein, 24 aa, Mycobacterium
LVDVPNYRRFWAITRHADVMDIER

SEQ ID NO: 1050557 - protein, 23 aa, Mycobacterium
LVDVRFPVQYVIRPHTLEHQDHR

SEQ ID NO: 1050558 - protein, 24 aa, Mycobacterium
LVECAEFFKDTTFRVFQAPYVGAV

SEQ ID NO: 1050559 - protein, 19 aa, Mycobacterium
LVEHFILEDWWGRWLGRWT

SEQ ID NO: 1050560 - protein, 24 aa, Mycobacterium
LVELRRAICARFIREPRYRFVELP

SEQ ID NO: 1050561 - protein, 22 aa, Mycobacterium
LVENFLRMTFGFPAEPYHPDPE

SEQ ID NO: 1050562 - protein, 18 aa, Mycobacterium
LVEPLGFDLSEPKLRRAG

SEQ ID NO: 1050563 - protein, 17 aa, Mycobacterium
LVERFKTIQPWLTDGIA

SEQ ID NO: 1050564 - protein, 23 aa, Mycobacterium
LVESCGFDRAVLFRVHEGRLVME

SEQ ID NO: 1050565 - protein, 17 aa, Mycobacterium
LVETFGYGWSDIQRFTI

SEQ ID NO: 1050566 - protein, 24 aa, Mycobacterium
LVEVLEIRAALGPLIGRLAAERNS

SEQ ID NO: 1050567 - protein, 18 aa, Mycobacterium
LVFAKGAFPAALETKPNE

SEQ ID NO: 1050568 - protein, 18 aa, Mycobacterium
LVFDTVITRTVRFPETSV

SEQ ID NO: 1050569 - protein, 20 aa, Mycobacterium
LVFNAFLACGGYTPDQAARE

SEQ ID NO: 1050570 - protein, 19 aa, Mycobacterium
LVFPVKRLADLGFRVLATE

SEQ ID NO: 1050571 - protein, 30 aa, Mycobacterium; identical to SEQ ID NO: 698943

SEQ ID NO: 1050572 - protein, 23 aa, Mycobacterium
LVFSSFFNALPIRRLGIHERAEM

SEQ ID NO: 1050573 - protein, 23 aa, Mycobacterium
LVGASRKRFLGSLLAGPDGAVRP

SEQ ID NO: 1050574 - protein, 19 aa, Mycobacterium
LVGDAARFLLEGMPVQVAF

SEQ ID NO: 1050575 - protein, 27 aa, Mycobacterium
LVGELIRLAGVLGCSLGRDRAEELAQH

SEQ ID NO: 1050576 - protein, 25 aa, Mycobacterium
LVGELLRLGSVLGIELGPDRAAELA

SEQ ID NO: 1050577 - protein, 25 aa, Mycobacterium
LVGERWTLLILREAFFGVQRFGQLA

SEQ ID NO: 1050578 - protein, 20 aa, Mycobacterium
LVGGAWQGASSVAMGTAAAS

SEQ ID NO: 1050579 - protein, 17 aa, Mycobacterium
LVGGFSLPTLAAELSAA

SEQ ID NO: 1050580 - protein, 21 aa, Mycobacterium
LVGHSLGGLLVQLVAARTRHI

SEQ ID NO: 1050581 - protein, 17 aa, Mycobacterium
LVGKLAVPTSWSNALPK

SEQ ID NO: 1050582 - protein, 23 aa, Mycobacterium
LVGLPGREGFPGIAVGSDGLTEL

SEQ ID NO: 1050583 - protein, 17 aa, Mycobacterium
LVGRLVLTNCDAFETFP

SEQ ID NO: 1050584 - protein, 23 aa, Mycobacterium
LVGVAGKALRDWDALMVVEEGKP

SEQ ID NO: 1050585 - protein, 19 aa, Mycobacterium
LVHAWDFAFATDRRVVVSD

SEQ ID NO: 1050586 - protein, 18 aa, Mycobacterium
LVHESMAPGLTAAAAALR

SEQ ID NO: 1050587 - protein, 18 aa, Mycobacterium
LVHLASLYHDDVMDEAEV

SEQ ID NO: 1050588 - protein, 17 aa, Mycobacterium
LVIAGGVLVIYVATVTQ

SEQ ID NO: 1050589 - protein, 26 aa, Mycobacterium
LVIEQRGPRELRLKVGADPTGEAFNS

SEQ ID NO: 1050590 - protein, 23 aa, Mycobacterium
LVIGCGEAGLLAGIKLKQAGLPF

SEQ ID NO: 1050591 - protein, 17 aa, Mycobacterium
LVIPRGVVYCLLGRNGA

SEQ ID NO: 1050592 - protein, 17 aa, Mycobacterium
LVITPGYDLRYLIGSRA

SEQ ID NO: 1050593 - protein, 24 aa, Mycobacterium
LVKHPAHGLTLISLDRAVLEEVLR

SEQ ID NO: 1050594 - protein, 24 aa, Mycobacterium
LVLANWKLGIVLEKTYAAAVRAGP

SEQ ID NO: 1050595 - protein, 18 aa, Mycobacterium
LVLDECHHLLATWGALVA

SEQ ID NO: 1050596 - protein, 19 aa, Mycobacterium
LVLDEKWHATVRSRIAGEV

SEQ ID NO: 1050597 - protein, 22 aa, Mycobacterium
LVLDFYRCAMLPASADWDPAGA

SEQ ID NO: 1050598 - protein, 21 aa, Mycobacterium
LVLDYERVMLRLGEGENGEPQ

SEQ ID NO: 1050599 - protein, 24 aa, Mycobacterium
LVLGGGFGGLLCAAHLKKAGVADV

SEQ ID NO: 1050600 - protein, 17 aa, Mycobacterium
LVLGPGMRIQAPPNLVS

SEQ ID NO: 1050601 - protein, 18 aa, Mycobacterium
LVLLQFQAGIKIDFRSEV

SEQ ID NO: 1050602 - protein, 19 aa, Mycobacterium
LVLMPSRPVSLLMQEYRGL

SEQ ID NO: 1050603 - protein, 22 aa, Mycobacterium
LVLMPSRPVSLLMQEYRGLTSH

SEQ ID NO: 1050604 - protein, 22 aa, Mycobacterium
LVLPIRFAGIHVYGDIAEGVRA

SEQ ID NO: 1050605 - protein, 25 aa, Mycobacterium
LVMARGIEIGHIFQLGRKYTDAFTA

SEQ ID NO: 1050606 - protein, 25 aa, Mycobacterium
LVMPELKGKLDGYALRVPIPTGSVT

SEQ ID NO: 1050607 - protein, 26 aa, Mycobacterium
LVNEMQINWVWNPPWGPDKITEDGRE

SEQ ID NO: 1050608 - protein, 18 aa, Mycobacterium
LVNLKVTLLDGAFHEVDS

SEQ ID NO: 1050609 - protein, 17 aa, Mycobacterium
LVNRILLTSGKIYYEMV

SEQ ID NO: 1050610 - protein, 22 aa, Mycobacterium
LVPHRKVEMMDPFMMIFTSGTS

SEQ ID NO: 1050611 - protein, 26 aa, Mycobacterium
LVPHYDVYPAFAFRFDVKNPAVSITF

SEQ ID NO: 1050612 - protein, 21 aa, Mycobacterium
LVPQHLMRRLFFTAATVDAAT

SEQ ID NO: 1050613 - protein, 23 aa, Mycobacterium
LVQALDRTAGWYADAETGNAALL

SEQ ID NO: 1050614 - protein, 18 aa, Mycobacterium
LVQIIRWLRPGAVIAIAK

SEQ ID NO: 1050615 - protein, 19 aa, Mycobacterium
LVQIRWAQRVNISAKTGRA

SEQ ID NO: 1050616 - protein, 17 aa, Mycobacterium
LVQRGTLRVGDSVVAGD

SEQ ID NO: 1050617 - protein, 20 aa, Mycobacterium
LVRAFGSLHGLLAASASDLQ

SEQ ID NO: 1050618 - protein, 19 aa, Mycobacterium
LVRAVGVDFFTRWVTGDLV

SEQ ID NO: 1050619 - protein, 24 aa, Mycobacterium
LVRELTMVAPLVLSRDVPVQVQVV

SEQ ID NO: 1050620 - protein, 24 aa, Mycobacterium
LVRLPWDYRRVYGVDPAEQSVASA

SEQ ID NO: 1050621 - protein, 24 aa, Mycobacterium
LVRPEVMAGTGFLGAHADEVYRLE

SEQ ID NO: 1050622 - protein, 19 aa, Mycobacterium
LVRPIAIGWIADRCLPSSA

SEQ ID NO: 1050623 - protein, 17 aa, Mycobacterium
LVRQAREAGVGLTGPGG

SEQ ID NO: 1050624 - protein, 18 aa, Mycobacterium
LVRREYMTAIGPVDLLCR

SEQ ID NO: 1050625 - protein, 17 aa, Mycobacterium
LVSAAAHGQFARLVYTV

SEQ ID NO: 1050626 - protein, 19 aa, Mycobacterium
LVSEVPRTLPLDGNQTPPA

SEQ ID NO: 1050627 - protein, 21 aa, Mycobacterium
LVSGRASFELTQKALMAGIPV

SEQ ID NO: 1050628 - protein, 17 aa, Mycobacterium
LVSKGFTPRRIRELEPR

SEQ ID NO: 1050629 - protein, 19 aa, Mycobacterium
LVSSAGPAWARLADPDIGW

SEQ ID NO: 1050630 - protein, 18 aa, Mycobacterium
LVTGFARIHGHPVGIIAN

SEQ ID NO: 1050631 - protein, 24 aa, Mycobacterium
LVTHPRVLAALPILGAANRIPASY

SEQ ID NO: 1050632 - protein, 31 aa, Mycobacterium; identical to SEQ ID NO: 699355

SEQ ID NO: 1050633 - protein, 24 aa, Mycobacterium
LVVGRERNVLLALMLSSQEQYSAD

SEQ ID NO: 1050634 - protein, 18 aa, Mycobacterium
LVVHDWGSALGFYRALRY

SEQ ID NO: 1050635 - protein, 23 aa, Mycobacterium
LVVNIKVATVFGGKYVSFTSPQS

SEQ ID NO: 1050636 - protein, 18 aa, Mycobacterium
LVVVRRGEKVVVEVSVAV

SEQ ID NO: 1050637 - protein, 18 aa, Mycobacterium
LVVVVHADMEVRLRRLVH

SEQ ID NO: 1050638 - protein, 30 aa, Mycobacterium
LVVWLPEERICLCGNTFGPLFGHIPNLVTM

SEQ ID NO: 1050639 - protein, 17 aa, Mycobacterium
LVWEGAGGDALRQRTGA

SEQ ID NO: 1050640 - protein, 23 aa, Mycobacterium
LVWNTLLALGFEWGVALQHLEIG

SEQ ID NO: 1050641 - protein, 26 aa, Mycobacterium
LVYERGGWYFTSRVLEWDSVPSRHPL

SEQ ID NO: 1050642 - protein, 18 aa, Mycobacterium
LWAGVAVSDLEFIQFHPT

SEQ ID NO: 1050643 - protein, 29 aa, Mycobacterium
LWAIMVSLAELWRSAGVLPDAVIGHSQGE

SEQ ID NO: 1050644 - protein, 23 aa, Mycobacterium
LWALDSLARCPDRTAGTRVLYVS

SEQ ID NO: 1050645 - protein, 20 aa, Mycobacterium
LWCGYTWQYWLATRSVKPEE

SEQ ID NO: 1050646 - protein, 18 aa, Mycobacterium
LWCTPPVLESSLRMPPGV

SEQ ID NO: 1050647 - protein, 17 aa, Mycobacterium
LWDKGLAYEGYRVLPYC

SEQ ID NO: 1050648 - protein, 18 aa, Mycobacterium
LWDQGQFVRECARVLRPS

SEQ ID NO: 1050649 - protein, 18 aa, Mycobacterium
LWGQGWPLGVDRAIAPVQ

SEQ ID NO: 1050650 - protein, 40 aa, Mycobacterium
LWGREVIGTASGVVRFIGVDGYRWMVRCVVNGPHETIDTL

SEQ ID NO: 1050651 - protein, 17 aa, Mycobacterium
LWLAIMSPAALARVEAV

SEQ ID NO: 1050652 - protein, 19 aa, Mycobacterium
LWLEVMKPMASNAVDREAA

SEQ ID NO: 1050653 - protein, 19 aa, Mycobacterium
LWLNESFATFASVLCQSEA

SEQ ID NO: 1050654 - protein, 18 aa, Mycobacterium
LWLQCAIAGTPRLPDERA

SEQ ID NO: 1050655 - protein, 17 aa, Mycobacterium
LWLRSESNISVIEHGSP

SEQ ID NO: 1050656 - protein, 17 aa, Mycobacterium
LWMVPQNIAGLVTALGG

SEQ ID NO: 1050657 - protein, 22 aa, Mycobacterium
LWPVFAEVPAGWRVVFGEAARA

SEQ ID NO: 1050658 - protein, 20 aa, Mycobacterium
LWQRRHAILRNFPIIGHLRF

SEQ ID NO: 1050659 - protein, 19 aa, Mycobacterium
LWRAAGRRRRWLVAAHIPP

SEQ ID NO: 1050660 - protein, 24 aa, Mycobacterium
LWTPEHGEPFLSAWTPVAQPQTIM

SEQ ID NO: 1050661 - protein, 18 aa, Mycobacterium
LYAAGATAIYPPGTVIAD

SEQ ID NO: 1050662 - protein, 18 aa, Mycobacterium
LYAEMWAQDAGAMYGYAA

SEQ ID NO: 1050663 - protein, 26 aa, Mycobacterium
LYAHEGRLKYCYNFLGIDHYMVAATK

SEQ ID NO: 1050664 - protein, 22 aa, Mycobacterium
LYAHPRAGAPVAMESRARLFPR

SEQ ID NO: 1050665 - protein, 25 aa, Mycobacterium
LYAPQRWKYLTSGLLGLQRGTDAGD

SEQ ID NO: 1050666 - protein, 27 aa, Mycobacterium
LYAPSPPARCTLHWGADRPARLRVPVT

SEQ ID NO: 1050667 - protein, 18 aa, Mycobacterium
LYATLTPSKWSDFGKASD

SEQ ID NO: 1050668 - protein, 18 aa, Mycobacterium
LYGGCVVMVPYLETRTPR

SEQ ID NO: 1050669 - protein, 19 aa, Mycobacterium
LYGLRKSRARQRAQELLDQ

SEQ ID NO: 1050670 - protein, 26 aa, Mycobacterium
LYIQLYLGGFGLELSDIESLRTWGSK

SEQ ID NO: 1050671 - protein, 18 aa, Mycobacterium
LYISYLRKKIDNGREPMI

SEQ ID NO: 1050672 - protein, 22 aa, Mycobacterium
LYLEGCEWYRRYGMTDSVLPPT

SEQ ID NO: 1050673 - protein, 18 aa, Mycobacterium
LYNWRRAYGGMDLDAAKE

SEQ ID NO: 1050674 - protein, 17 aa, Mycobacterium
LYPAWRGRGLATRAVDL

SEQ ID NO: 1050675 - protein, 25 aa, Mycobacterium
LYPRKGVSELTRFTPEAVVEKYGLT

SEQ ID NO: 1050676 - protein, 32 aa, Mycobacterium
LYPSMSSEDAWAMIKVTPMIGVNDDPSEVFTL

SEQ ID NO: 1050677 - protein, 18 aa, Mycobacterium
LYPVLDRYDYVLVDCQPS

SEQ ID NO: 1050678 - protein, 21 aa, Mycobacterium
LYPVVRKSFRVGAESVSLKAL

SEQ ID NO: 1050679 - protein, 17 aa, Mycobacterium
LYQYTVRLLTGIADNPE

SEQ ID NO: 1050680 - protein, 28 aa, Mycobacterium
LYRFQFDQVRRLLAWATPYREMMGPFVA

SEQ ID NO: 1050681 - protein, 18 aa, Mycobacterium
LYRGAPFGVGCFVGVWQP

SEQ ID NO: 1050682 - protein, 20 aa, Mycobacterium
LYRGDTFSCTSIDGGGHSIH

SEQ ID NO: 1050683 - protein, 21 aa, Mycobacterium
LYRLYELRLRQGLAATSSELP

SEQ ID NO: 1050684 - protein, 20 aa, Mycobacterium
LYRVAYECVEDLAADAVVYA

SEQ ID NO: 1050685 - protein, 25 aa, Mycobacterium
LYRVPRLKVAVIEAGSKWLFPLLDQ

SEQ ID NO: 1050686 - protein, 18 aa, Mycobacterium
LYRVVIKDHMEPFAAGLR

SEQ ID NO: 1050687 - protein, 17 aa, Mycobacterium
LYSHIAWLRTIKDKISF

SEQ ID NO: 1050688 - protein, 18 aa, Mycobacterium
LYSVRSRRSWGIGDLTDL

SEQ ID NO: 1050689 - protein, 25 aa, Mycobacterium
LYTHRPSWPAGIAVGKTAVSSSIID

SEQ ID NO: 1050690 - protein, 25 aa, Mycobacterium
LYTVLRLRLAPVLVHVGRPCTRGRR

SEQ ID NO: 1050691 - protein, 25 aa, Mycobacterium
LYVPWSERTGKHWLGSFTTTFRYNE

SEQ ID NO: 1050692 - protein, 17 aa, Mycobacterium
LYVTGRIADLIVIDGHN

SEQ ID NO: 1050693 - protein, 19 aa, Mycobacterium
LYWMLTLVPYRERGHILLA

SEQ ID NO: 1050694 - protein, 27 aa, Mycobacterium
LYYIHGFLRERMRILQDEFIKRGQEDP

SEQ ID NO: 1050695 - protein, 19 aa, Mycobacterium
MAAAAAPYVAWMSTTAAQA

SEQ ID NO: 1050696 - protein, 17 aa, Mycobacterium
MAAAAAPYVTWINTTGV

SEQ ID NO: 1050697 - protein, 24 aa, Mycobacterium
MAAAGRPAGMPMMPMPMGAGAGAG

SEQ ID NO: 1050698 - protein, 18 aa, Mycobacterium
MAAALGMLEARHIVGDQQ

SEQ ID NO: 1050699 - protein, 17 aa, Mycobacterium
MAADAGLTSSSWARGPH

SEQ ID NO: 1050700 - protein, 19 aa, Mycobacterium
MAADMAVDFHDTGVATVSI

SEQ ID NO: 1050701 - protein, 20 aa, Mycobacterium
MAAELYRRHQVFSRALDECD

SEQ ID NO: 1050702 - protein, 24 aa, Mycobacterium
MAAEPPESAAHLIVAAAANRAPSA

SEQ ID NO: 1050703 - protein, 20 aa, Mycobacterium
MAAGELIGCFGLTEPDVGSD

SEQ ID NO: 1050704 - protein, 19 aa, Mycobacterium
MAAGTPFALAHTFGQTGPF

SEQ ID NO: 1050705 - protein, 19 aa, Mycobacterium
MAALAAMWRSFDIPPNVTI

SEQ ID NO: 1050706 - protein, 17 aa, Mycobacterium
MAARGIGFLGWNTRFRG

SEQ ID NO: 1050707 - protein, 20 aa, Mycobacterium
MAASMGEFLLAAGTKGKRYA

SEQ ID NO: 1050708 - protein, 18 aa, Mycobacterium
MAAVQLARHWGLEVFVTA

SEQ ID NO: 1050709 - protein, 19 aa, Mycobacterium
MACATRLAATFPQVCSRPA

SEQ ID NO: 1050710 - protein, 17 aa, Mycobacterium
MACIESGSAWVFHLFEK

SEQ ID NO: 1050711 - protein, 25 aa, Mycobacterium
MADATAGSVFACFVRPQFQGRGVGS

SEQ ID NO: 1050712 - protein, 18 aa, Mycobacterium
MADEGRNDIRIEAALAKL

SEQ ID NO: 1050713 - protein, 18 aa, Mycobacterium
MADPRWLDPSVDPNERTP

SEQ ID NO: 1050714 - protein, 23 aa, Mycobacterium
MADWLEAFVPLRTHVLVRFGRWQ

SEQ ID NO: 1050715 - protein, 21 aa, Mycobacterium
MAEEVMAPLGPILVAAAGIGP

SEQ ID NO: 1050716 - protein, 21 aa, Mycobacterium
MAEEVMAPLGPILVTATGIRP

SEQ ID NO: 1050717 - protein, 22 aa, Mycobacterium
MAEGRGSVVVEGRDIGTVVLPD

SEQ ID NO: 1050718 - protein, 24 aa, Mycobacterium
MAELAARVAAVVRPDAVISRDEID

SEQ ID NO: 1050719 - protein, 23 aa, Mycobacterium
MAERIRSGSVWINDAHQINCRLL

SEQ ID NO: 1050720 - protein, 19 aa, Mycobacterium
MAETVARRGGIVVLPQDLP

SEQ ID NO: 1050721 - protein, 18 aa, Mycobacterium
MAFYNFPLRLLKRTWDAE

SEQ ID NO: 1050722 - protein, 24 aa, Mycobacterium
MAGFPVTVKGLSRFTDPAESRTVI

SEQ ID NO: 1050723 - protein, 26 aa, Mycobacterium
MAGGAGGRGGLLLGDGGAGAPGAASF

SEQ ID NO: 1050724 - protein, 18 aa, Mycobacterium
MAGRALVHRAVCEQLIDH

SEQ ID NO: 1050725 - protein, 19 aa, Mycobacterium
MALSEAMGAQFDRIQQEAL

SEQ ID NO: 1050726 - protein, 18 aa, Mycobacterium
MAMLTRREVEVLRLMAAG

SEQ ID NO: 1050727 - protein, 22 aa, Mycobacterium
MANCSPMSAFSICVPRRVPALL

SEQ ID NO: 1050728 - protein, 26 aa, Mycobacterium
MAPELRGTEIARHFDLVGFDPRGVGH

SEQ ID NO: 1050729 - protein, 19 aa, Mycobacterium
MAPICQLFHTLPIPWVEAE

SEQ ID NO: 1050730 - protein, 23 aa, Mycobacterium
MAPLTLAGVPGFLSTVPPPFNIV

SEQ ID NO: 1050731 - protein, 20 aa, Mycobacterium
MAQGLGMPALARVLSWASVG

SEQ ID NO: 1050732 - protein, 19 aa, Mycobacterium
MAQIGLRVTTLGPKGVDLV

SEQ ID NO: 1050733 - protein, 17 aa, Mycobacterium
MAQPGRCVVVAVDAAGI

SEQ ID NO: 1050734 - protein, 25 aa, Mycobacterium
MARDEGRWAVRWVSTGLHPKLGEHQ

SEQ ID NO: 1050735 - protein, 18 aa, Mycobacterium
MARLRSPLLAVVKNGKLH

SEQ ID NO: 1050736 - protein, 17 aa, Mycobacterium
MASERGWGSTMVLTEPD

SEQ ID NO: 1050737 - protein, 17 aa, Mycobacterium
MASRTAFFDEFFLDATR

SEQ ID NO: 1050738 - protein, 18 aa, Mycobacterium
MATAAPACGISWNLLAGI

SEQ ID NO: 1050739 - protein, 19 aa, Mycobacterium
MATDPAGAFFGLWQPLGHR

SEQ ID NO: 1050740 - protein, 23 aa, Mycobacterium
MATGELRATMALTEPGGGSDLQN

SEQ ID NO: 1050741 - protein, 17 aa, Mycobacterium
MATRFDPAAAWAMAARE

SEQ ID NO: 1050742 - protein, 26 aa, Mycobacterium
MATTWPDKRIDLYFPGERPLTAYHPR

SEQ ID NO: 1050743 - protein, 29 aa, Mycobacterium
MATVFKLPFGEIPGQVFIGMRTSDVLTHA

SEQ ID NO: 1050744 - protein, 19 aa, Mycobacterium
MAVERIELFVEALLKGGRP

SEQ ID NO: 1050745 - protein, 31 aa, Mycobacterium; identical to SEQ ID NO: 700114

SEQ ID NO: 1050746 - protein, 37 aa, Mycobacterium
MAVTGCDGVVIGRGCLGRPWLFAELSAAFTGRPAPAP

SEQ ID NO: 1050747 - protein, 21 aa, Mycobacterium
MAWRWGIAAGELTSMDAPAGL

SEQ ID NO: 1050748 - protein, 20 aa, Mycobacterium
MCGLEIRVADGLSGGRVVSI

SEQ ID NO: 1050749 - protein, 17 aa, Mycobacterium
MCTAGAFYFINESDVVI

SEQ ID NO: 1050750 - protein, 19 aa, Mycobacterium
MCWTTCSINSPAEIANDDA

SEQ ID NO: 1050751 - protein, 19 aa, Mycobacterium
MDAAWALFEAYIKILTGEV

SEQ ID NO: 1050752 - protein, 17 aa, Mycobacterium
MDAGRDYSCEIGSMTAA

SEQ ID NO: 1050753 - protein, 23 aa, Mycobacterium
MDDGLRFAIREGGRTVGAGRVVK

SEQ ID NO: 1050754 - protein, 18 aa, Mycobacterium
MDDGRCGPILGASADDPA

SEQ ID NO: 1050755 - protein, 26 aa, Mycobacterium
MDEARMVVLMQRFGLDRMIVNSAADW

SEQ ID NO: 1050756 - protein, 17 aa, Mycobacterium
MDEERRTTLNLKACIKA

SEQ ID NO: 1050757 - protein, 24 aa, Mycobacterium
MDGKAATISVVWTNSGSAAATEKW

SEQ ID NO: 1050758 - protein, 18 aa, Mycobacterium
MDGQCLFGPVLVDPPTGA

SEQ ID NO: 1050759 - protein, 17 aa, Mycobacterium
MDIAVAVVDGVDAAIAH

SEQ ID NO: 1050760 - protein, 24 aa, Mycobacterium
MDNRCKRSVVLDLSTDTGRELAYE

SEQ ID NO: 1050761 - protein, 20 aa, Mycobacterium
MDPDVLLREFLKATADPANR

SEQ ID NO: 1050762 - protein, 26 aa, Mycobacterium
MDPQHRMLLELSWEALERSGIDPTGL

SEQ ID NO: 1050763 - protein, 26 aa, Mycobacterium
MDPQQRLLLEVAWEALEHAGIPPSSL

SEQ ID NO: 1050764 - protein, 26 aa, Mycobacterium
MDPQQRMFLELSWEALERAGIEPGGL

SEQ ID NO: 1050765 - protein, 18 aa, Mycobacterium
MDQPYPVAMAKLGQAIAA

SEQ ID NO: 1050766 - protein, 26 aa, Mycobacterium
MDSRLWRLLLAPGRGIGRLVTGVMGL

SEQ ID NO: 1050767 - protein, 17 aa, Mycobacterium
MDVPFGFYACSIATDRL

SEQ ID NO: 1050768 - protein, 17 aa, Mycobacterium
MDVRFLPNPHWVDELRP

SEQ ID NO: 1050769 - protein, 26 aa, Mycobacterium
MDYFDPSLQYEGRMGDYAIQAAESVH

SEQ ID NO: 1050770 - protein, 19 aa, Mycobacterium
MEAALGIPDCNLVAALDRY

SEQ ID NO: 1050771 - protein, 17 aa, Mycobacterium
MEARVALTELFKRIRGY

SEQ ID NO: 1050772 - protein, 17 aa, Mycobacterium
MEDGLRLGASHYYATSD

SEQ ID NO: 1050773 - protein, 25 aa, Mycobacterium
MEEALRLTTDYLKTRKQFGVTLSKF

SEQ ID NO: 1050774 - protein, 17 aa, Mycobacterium
MEEVLLPVMYDIPSRDD

SEQ ID NO: 1050775 - protein, 26 aa, Mycobacterium
MEGLRICARIAQAPALRGLLGPVARP

SEQ ID NO: 1050776 - protein, 19 aa, Mycobacterium
MEKSIPMDRVICGDVGYGK

SEQ ID NO: 1050777 - protein, 17 aa, Mycobacterium
MENRWLPMKRTALALNH

SEQ ID NO: 1050778 - protein, 18 aa, Mycobacterium
MERARKVLSEALGDSESP

SEQ ID NO: 1050779 - protein, 18 aa, Mycobacterium
MERRILLSRVPELPEHIA

SEQ ID NO: 1050780 - protein, 23 aa, Mycobacterium
MERRLREALTVYVDAMRYPRGTE

SEQ ID NO: 1050781 - protein, 20 aa, Mycobacterium
METWHPLGVVGVITAFNFPV

SEQ ID NO: 1050782 - protein, 18 aa, Mycobacterium
MEVFAGFSENADWNVGRL

SEQ ID NO: 1050783 - protein, 17 aa, Mycobacterium
MEYMLPRLRGWGESMSR

SEQ ID NO: 1050784 - protein, 22 aa, Mycobacterium
MFAAAGRYVLDRAIFDALRRIE

SEQ ID NO: 1050785 - protein, 17 aa, Mycobacterium
MFARAETPPALPFPQTP

SEQ ID NO: 1050786 - protein, 18 aa, Mycobacterium
MFDDLVCESGRVLFFELA

SEQ ID NO: 1050787 - protein, 19 aa, Mycobacterium
MFGNVIRLLPPLTISDELL

SEQ ID NO: 1050788 - protein, 17 aa, Mycobacterium
MFIEFSRQRALSADGRC

SEQ ID NO: 1050789 - protein, 18 aa, Mycobacterium
MFLEQYWGGPRTYSEQRG

SEQ ID NO: 1050790 - protein, 17 aa, Mycobacterium
MFNAGFANVGWANAGIG

SEQ ID NO: 1050791 - protein, 20 aa, Mycobacterium
MFNCTGWKIGWACGLKELIA

SEQ ID NO: 1050792 - protein, 18 aa, Mycobacterium
MFQMKFYGVALFRSRGVL

SEQ ID NO: 1050793 - protein, 19 aa, Mycobacterium
MFTRMLKLPESIRNSYDVS

SEQ ID NO: 1050794 - protein, 20 aa, Mycobacterium
MFYNLGLAGRAMRRIGAIEF

SEQ ID NO: 1050795 - protein, 19 aa, Mycobacterium
MGAAARYLHVPGEQELLGR

SEQ ID NO: 1050796 - protein, 20 aa, Mycobacterium
MGADGLRAASLTAIASANYI

SEQ ID NO: 1050797 - protein, 17 aa, Mycobacterium
MGAGAWGTALAKVLADA

SEQ ID NO: 1050798 - protein, 20 aa, Mycobacterium
MGALHSWCLAAERPGLVSAL

SEQ ID NO: 1050799 - protein, 20 aa, Mycobacterium
MGAYHGKWGFDEFSHRKSVL

SEQ ID NO: 1050800 - protein, 18 aa, Mycobacterium
MGESRVAVYPADDRSGSG

SEQ ID NO: 1050801 - protein, 17 aa, Mycobacterium
MGFIYLMQNLPQERISI

SEQ ID NO: 1050802 - protein, 18 aa, Mycobacterium
MGGAKPGSGVGYRHGPGG

SEQ ID NO: 1050803 - protein, 18 aa, Mycobacterium
MGGFPMMTEKGTFIINGT

SEQ ID NO: 1050804 - protein, 21 aa, Mycobacterium
MGGGGGNAASSGFDGGVGGQD

SEQ ID NO: 1050805 - protein, 22 aa, Mycobacterium
MGGNGGSGSWLIGGGGAGGIGG

SEQ ID NO: 1050806 - protein, 19 aa, Mycobacterium
MGGSCSIHPADATNPVAAQ

SEQ ID NO: 1050807 - protein, 20 aa, Mycobacterium
MGGVGGMGGALGGHGGAGGV

SEQ ID NO: 1050808 - protein, 19 aa, Mycobacterium
MGHRLTIAMTRWQATVNWV

SEQ ID NO: 1050809 - protein, 24 aa, Mycobacterium
MGIHAERILKLFGHEELNKVVSFC

SEQ ID NO: 1050810 - protein, 17 aa, Mycobacterium
MGIPELAAYNATKWGII

SEQ ID NO: 1050811 - protein, 17 aa, Mycobacterium
MGLAGFEEYLETKLIAT

SEQ ID NO: 1050812 - protein, 25 aa, Mycobacterium
MGMGGSIPFIAEFAEAFPDAKILVT

SEQ ID NO: 1050813 - protein, 24 aa, Mycobacterium
MGNLEFLIFNGIHAVVGTTGFTAE

SEQ ID NO: 1050814 - protein, 18 aa, Mycobacterium
MGNRCLLGANAGLGISLG

SEQ ID NO: 1050815 - protein, 24 aa, Mycobacterium
MGPAELRLRNLLKPEQFPYTTKTG

SEQ ID NO: 1050816 - protein, 25 aa, Mycobacterium
MGPDGKRWRCAVGDLAAGFDELAGD

SEQ ID NO: 1050817 - protein, 26 aa, Mycobacterium
MGPFHQWPTGSGFEYFYGFVGGEANQ

SEQ ID NO: 1050818 - protein, 19 aa, Mycobacterium
MGQADMHPDWSFGERGERF

SEQ ID NO: 1050819 - protein, 18 aa, Mycobacterium
MGRAHLAVGHHYRRGVSR

SEQ ID NO: 1050820 - protein, 19 aa, Mycobacterium
MGRATSGVQGMRFNADDRL

SEQ ID NO: 1050821 - protein, 26 aa, Mycobacterium
MGRIDPRTRWLLRELVYALLVKKDHA

SEQ ID NO: 1050822 - protein, 19 aa, Mycobacterium
MGRPEEYAKLVAAIVDNPM

SEQ ID NO: 1050823 - protein, 27 aa, Mycobacterium
MGSGRSAIKYKMDLVPLALMVSTYYYD

SEQ ID NO: 1050824 - protein, 17 aa, Mycobacterium
MGSGVAFAVGAYAESIR

SEQ ID NO: 1050825 - protein, 29 aa, Mycobacterium
MGTAELDGGYWFRSIRQTVQFAEAVRAAG

SEQ ID NO: 1050826 - protein, 22 aa, Mycobacterium
MGTSYLLPRIVGAGVARELMLT

SEQ ID NO: 1050827 - protein, 17 aa, Mycobacterium
MGVDPGWDCELAKTPEG

SEQ ID NO: 1050828 - protein, 22 aa, Mycobacterium
MGVSRAPCRVVYVIDEPDIRGF

SEQ ID NO: 1050829 - protein, 27 aa, Mycobacterium
MGVVAKRLWRDSGLKPADIQTAFIYDH

SEQ ID NO: 1050830 - protein, 17 aa, Mycobacterium
MGWWRRVSWRGSGLRWD

SEQ ID NO: 1050831 - protein, 20 aa, Mycobacterium
MHAAGLWTAFSGFLSGFPVV

SEQ ID NO: 1050832 - protein, 31 aa, Mycobacterium; identical to SEQ ID NO: 700684

SEQ ID NO: 1050833 - protein, 18 aa, Mycobacterium
MHGAAQWAAFISLCGGRP

SEQ ID NO: 1050834 - protein, 23 aa, Mycobacterium
MHGPAEVAFTCELFSRVEDVLGL

SEQ ID NO: 1050835 - protein, 21 aa, Mycobacterium
MHLYFKRAHGSTHLLASPPEL

SEQ ID NO: 1050836 - protein, 17 aa, Mycobacterium
MHSRSGLTEEVRASTVD

SEQ ID NO: 1050837 - protein, 22 aa, Mycobacterium
MIAAAQPYLAWLTYTSEAAMHA

SEQ ID NO: 1050838 - protein, 17 aa, Mycobacterium
MIADSWQLMSNPNMSFP

SEQ ID NO: 1050839 - protein, 18 aa, Mycobacterium
MIANRVSSGFALHGPSMT

SEQ ID NO: 1050840 - protein, 33 aa, Mycobacterium
MIDVSSIKELCRRWYPRIYFGQPPKGLAHRALA

SEQ ID NO: 1050841 - protein, 24 aa, Mycobacterium
MIEAKAVVISDPFMAAAPVLEERG

SEQ ID NO: 1050842 - protein, 17 aa, Mycobacterium
MIEEPFAGFTGDHIQMP

SEQ ID NO: 1050843 - protein, 24 aa, Mycobacterium
MIFCANPSAGFFILGPTMAQSLYA

SEQ ID NO: 1050844 - protein, 17 aa, Mycobacterium
MIHEFMVALDLADVTLV

SEQ ID NO: 1050845 - protein, 19 aa, Mycobacterium
MIIGLRMITPAGVLDLGRV

SEQ ID NO: 1050846 - protein, 27 aa, Mycobacterium
MIPDKGRILTAMSVFFFGLVDAPNHLA

SEQ ID NO: 1050847 - protein, 19 aa, Mycobacterium
MIRMRRLSDRFVRVKNTRA

SEQ ID NO: 1050848 - protein, 22 aa, Mycobacterium
MIRQGQDLIGEFVAHSAAFHAM

SEQ ID NO: 1050849 - protein, 25 aa, Mycobacterium
MIRVKEMWESIKIVEQCLDRLRPGP

SEQ ID NO: 1050850 - protein, 25 aa, Mycobacterium
MKAEGTFEYQALLFIPSHAQHDLFN

SEQ ID NO: 1050851 - protein, 27 aa, Mycobacterium
MKDFAFRPEPMLARMRAVFADHILVEL

SEQ ID NO: 1050852 - protein, 27 aa, Mycobacterium
MKDMVGMMIVVARHFRRAGIVPPRDLV

SEQ ID NO: 1050853 - protein, 25 aa, Mycobacterium
MKEGDDVFVALSWTKHPAPQTYQEA

SEQ ID NO: 1050854 - protein, 20 aa, Mycobacterium
MKFYGVALFRSRGVLPSRLR

SEQ ID NO: 1050855 - protein, 26 aa, Mycobacterium
MKLNNSQRFAIDWMRTNDQGNFFAGD

SEQ ID NO: 1050856 - protein, 17 aa, Mycobacterium
MKRRDIVAITAAMPGPT

SEQ ID NO: 1050857 - protein, 20 aa, Mycobacterium
MKSVHRILRNFKMPGFTVPE

SEQ ID NO: 1050858 - protein, 19 aa, Mycobacterium
MKVRAKIAAAVPISEMLDE

SEQ ID NO: 1050859 - protein, 20 aa, Mycobacterium
MLAAAAAWDGLADELSTAAA

SEQ ID NO: 1050860 - protein, 18 aa, Mycobacterium
MLAAAAWDGLSAELGAAA

SEQ ID NO: 1050861 - protein, 20 aa, Mycobacterium
MLAARPAVRYISAASLQVID

SEQ ID NO: 1050862 - protein, 31 aa, Mycobacterium; identical to SEQ ID NO: 700897

SEQ ID NO: 1050863 - protein, 17 aa, Mycobacterium
MLARCVIGLQWIPENIL

SEQ ID NO: 1050864 - protein, 20 aa, Mycobacterium
MLDLGFLPDIERILRQIPAD

SEQ ID NO: 1050865 - protein, 18 aa, Mycobacterium
MLDLKILLNVAFDGEKLS

SEQ ID NO: 1050866 - protein, 20 aa, Mycobacterium
MLDMWTDVFANPGKRTSGTG

SEQ ID NO: 1050867 - protein, 18 aa, Mycobacterium
MLEAAVIAGLTSQGVDAL

SEQ ID NO: 1050868 - protein, 24 aa, Mycobacterium
MLGCEVKAMYPLGPIFHGSGLNVT

SEQ ID NO: 1050869 - protein, 17 aa, Mycobacterium
MLGDLAAAWRSLQAGTP

SEQ ID NO: 1050870 - protein, 33 aa, Mycobacterium
MLGDVWEWTASPLRPWPGFAPMIYQRYSQPFFD

SEQ ID NO: 1050871 - protein, 20 aa, Mycobacterium
MLGESAMAWEGPSAQSYVDA

SEQ ID NO: 1050872 - protein, 27 aa, Mycobacterium
MLHPLSAPMTLRWLTDRFAGLPLTEHV

SEQ ID NO: 1050873 - protein, 32 aa, Mycobacterium
MLLEPGLGFFPWGMVDQHFIKRGRFGRLVVGM

SEQ ID NO: 1050874 - protein, 29 aa, Mycobacterium
MLLHGFGSFWWSWRHQLRGLTGARVVAVD

SEQ ID NO: 1050875 - protein, 17 aa, Mycobacterium
MLLHGGGTVHWLEPPAG

SEQ ID NO: 1050876 - protein, 20 aa, Mycobacterium
MLLLWIRGVRFMYTVDPLLA

SEQ ID NO: 1050877 - protein, 19 aa, Mycobacterium
MLLQPGVLGIAWGTAIRQL

SEQ ID NO: 1050878 - protein, 25 aa, Mycobacterium
MLLQPGVLSLAWGSVVRQLAAGLGL

SEQ ID NO: 1050879 - protein, 26 aa, Mycobacterium
MLNELDRVGGRYGLHTMCEGGGTANV

SEQ ID NO: 1050880 - protein, 20 aa, Mycobacterium
MLPPGVSTLSWLDAAQLPLA

SEQ ID NO: 1050881 - protein, 23 aa, Mycobacterium
MLQRPEEVAARRGLPIEDVAPAG

SEQ ID NO: 1050882 - protein, 21 aa, Mycobacterium
MLRAARFVSQLGFAVAPRVRD

SEQ ID NO: 1050883 - protein, 19 aa, Mycobacterium
MLRAECARLNRAGLTTCLE

SEQ ID NO: 1050884 - protein, 22 aa, Mycobacterium
MLRAGRRALVMQVDIFGDSADE

SEQ ID NO: 1050885 - protein, 27 aa, Mycobacterium
MLRAMRPDLTIGFFLHIPFPPVELFMQ

SEQ ID NO: 1050886 - protein, 19 aa, Mycobacterium
MLRASWRRLGGHAAALLPG

SEQ ID NO: 1050887 - protein, 18 aa, Mycobacterium
MLRAVGMVDEDFAKAQIG

SEQ ID NO: 1050888 - protein, 21 aa, Mycobacterium
MLRHRGPQLLPAVFSKVQERC

SEQ ID NO: 1050889 - protein, 25 aa, Mycobacterium
MLTCAIRPSGIWGTGDQLMFRKLFE

SEQ ID NO: 1050890 - protein, 19 aa, Mycobacterium
MLTGIRVEISGEKVVLAAT

SEQ ID NO: 1050891 - protein, 18 aa, Mycobacterium
MLTVYDYSTARAFDDAGI

SEQ ID NO: 1050892 - protein, 34 aa, Mycobacterium
MLYWQFRGTFIPKTRLTMIAPRAGLVTDPGAKVT

SEQ ID NO: 1050893 - protein, 20 aa, Mycobacterium
MMAASAAWNGLAVELGTTAA

SEQ ID NO: 1050894 - protein, 19 aa, Mycobacterium
MMAELCRELGLPLVVDAAQ

SEQ ID NO: 1050895 - protein, 19 aa, Mycobacterium
MMAHREIVRAGYAYVAISA

SEQ ID NO: 1050896 - protein, 39 aa, Mycobacterium
MMAVTGCDGVVIGRGCLGRPWLFAELSAAFTGRPAPAPP

SEQ ID NO: 1050897 - protein, 17 aa, Mycobacterium
MMCDIRIASQRASFAES

SEQ ID NO: 1050898 - protein, 21 aa, Mycobacterium
MMDTERELFKLGIPAKTRHNE

SEQ ID NO: 1050899 - protein, 21 aa, Mycobacterium
MMNAGVAAVRMFSDDGICVHD

SEQ ID NO: 1050900 - protein, 22 aa, Mycobacterium
MMPGLDGFEFIAAIRADPVLAA

SEQ ID NO: 1050901 - protein, 17 aa, Mycobacterium
MMSSMLGGMGIPGMGRK

SEQ ID NO: 1050902 - protein, 20 aa, Mycobacterium
MMSVLTGLGLKSFGAEGEDF

SEQ ID NO: 1050903 - protein, 17 aa, Mycobacterium
MNAALGITEQGFNFGDA

SEQ ID NO: 1050904 - protein, 18 aa, Mycobacterium
MNAMMWVRGFAADYDEWA

SEQ ID NO: 1050905 - protein, 17 aa, Mycobacterium
MNEVYGWEMPNIEGDAY

SEQ ID NO: 1050906 - protein, 18 aa, Mycobacterium
MNGAHHFNEVILDNAHVP

SEQ ID NO: 1050907 - protein, 19 aa, Mycobacterium
MNNGFFWRGTGQGLIGADY

SEQ ID NO: 1050908 - protein, 18 aa, Mycobacterium
MPACGDLTPWAQRGVMLL

SEQ ID NO: 1050909 - protein, 17 aa, Mycobacterium
MPAKPAGVVAIFPTVTA

SEQ ID NO: 1050910 - protein, 18 aa, Mycobacterium
MPALAAGCTVVIKPSELT

SEQ ID NO: 1050911 - protein, 20 aa, Mycobacterium
MPALARVLSWASVGVDPAAT

SEQ ID NO: 1050912 - protein, 26 aa, Mycobacterium
MPALDAFLHYRMIDVSSIKELCRRWY

SEQ ID NO: 1050913 - protein, 21 aa, Mycobacterium
MPAPPPPMFPWMQPTPQPLAP

SEQ ID NO: 1050914 - protein, 19 aa, Mycobacterium
MPARGNVAGVIRAGSTSGG

SEQ ID NO: 1050915 - protein, 25 aa, Mycobacterium
MPAYLSTSLFAFWIVDSAYSLDGRR

SEQ ID NO: 1050916 - protein, 21 aa, Mycobacterium
MPDPVKIILQALQGFLNFLRN

SEQ ID NO: 1050917 - protein, 24 aa, Mycobacterium
MPDRVKCLHVLIAHSLAKGPGVNP

SEQ ID NO: 1050918 - protein, 26 aa, Mycobacterium
MPEELRPNDEWVLFGYDGVFQAFRDG

SEQ ID NO: 1050919 - protein, 17 aa, Mycobacterium
MPEGVPPAARRPEPTLP

SEQ ID NO: 1050920 - protein, 21 aa, Mycobacterium
MPEPFAFSMVLPLAVPGHDRG

SEQ ID NO: 1050921 - protein, 22 aa, Mycobacterium
MPEVLEVRGEVFFRVADFQALN

SEQ ID NO: 1050922 - protein, 25 aa, Mycobacterium
MPGGYPIELGMTIRLARDKNYDLLL

SEQ ID NO: 1050923 - protein, 31 aa, Mycobacterium; identical to SEQ ID NO: 701339

SEQ ID NO: 1050924 - protein, 20 aa, Mycobacterium
MPGLPSAPVPPFPPTPPSPT

SEQ ID NO: 1050925 - protein, 20 aa, Mycobacterium
MPGMDGFGVLRRLQADGIDA

SEQ ID NO: 1050926 - protein, 17 aa, Mycobacterium
MPLLKREGRMLAIKRGA

SEQ ID NO: 1050927 - protein, 19 aa, Mycobacterium
MPLPGASLLHGRLLSLAAT

SEQ ID NO: 1050928 - protein, 20 aa, Mycobacterium
MPLPGASLLHGRLLSLAATS

SEQ ID NO: 1050929 - protein, 19 aa, Mycobacterium
MPLTDGVHRVCYKGLSVDD

SEQ ID NO: 1050930 - protein, 21 aa, Mycobacterium
MPNSLPGHWTGHVTLARRVGG

SEQ ID NO: 1050931 - protein, 19 aa, Mycobacterium
MPPAEAIALGMQRLGRNAI

SEQ ID NO: 1050932 - protein, 25 aa, Mycobacterium
MPPQRWLDTVAETWTTPKADLGRRL

SEQ ID NO: 1050933 - protein, 23 aa, Mycobacterium
MPQFDPAKAWSLIVDERVSLAGA

SEQ ID NO: 1050934 - protein, 22 aa, Mycobacterium
MPQVHRDIRGLAALGDIYADAS

SEQ ID NO: 1050935 - protein, 24 aa, Mycobacterium
MPVVELRSGGLGVREIKRIAKAVG

SEQ ID NO: 1050936 - protein, 17 aa, Mycobacterium
MPYVEACHHMYGGQYGQ

SEQ ID NO: 1050937 - protein, 23 aa, Mycobacterium
MPYWESVEPFPLPQEAGVEPDPR

SEQ ID NO: 1050938 - protein, 22 aa, Mycobacterium
MQFISETWRLYGVDANNDGIVS

SEQ ID NO: 1050939 - protein, 17 aa, Mycobacterium
MQGCIMLPTLGVGMEQA

SEQ ID NO: 1050940 - protein, 18 aa, Mycobacterium
MQHVLAAPHRLYTVRILV

SEQ ID NO: 1050941 - protein, 18 aa, Mycobacterium
MQLSCPDMIAAGAGSIIN

SEQ ID NO: 1050942 - protein, 23 aa, Mycobacterium
MQPVELPSGWAPVTGGFVGAVAA

SEQ ID NO: 1050943 - protein, 24 aa, Mycobacterium
MQRLGMANLDWLVVRDLVMIESAT

SEQ ID NO: 1050944 - protein, 19 aa, Mycobacterium
MRAAVEAAENWGTYVTVHA

SEQ ID NO: 1050945 - protein, 19 aa, Mycobacterium
MRADIAAVGRRVMAACGLQ

SEQ ID NO: 1050946 - protein, 26 aa, Mycobacterium
MRDELRSLLRFVLDLLSDYGLTDFYL

SEQ ID NO: 1050947 - protein, 19 aa, Mycobacterium
MRDVKRVKQRFGVTVNDVV

SEQ ID NO: 1050948 - protein, 23 aa, Mycobacterium
MRDWVACLVCPLTEHLAVLGNPT

SEQ ID NO: 1050949 - protein, 27 aa, Mycobacterium
MRECNASFKTAVKFINWRTPGEGSPVA

SEQ ID NO: 1050950 - protein, 20 aa, Mycobacterium
MRGGFGGWSPTSFGGSSGSS

SEQ ID NO: 1050951 - protein, 19 aa, Mycobacterium
MRGGLVGNEEFIAWEPFSH

SEQ ID NO: 1050952 - protein, 24 aa, Mycobacterium
MRGPSSIWYRIRINLQHIPPEARP

SEQ ID NO: 1050953 - protein, 18 aa, Mycobacterium
MRGRLQLHHVRAKFLGAE

SEQ ID NO: 1050954 - protein, 20 aa, Mycobacterium
MRHAASYWRGLSKVGKAVDA

SEQ ID NO: 1050955 - protein, 24 aa, Mycobacterium
MRINGVNRLACKVLMRDLLPKKSG

SEQ ID NO: 1050956 - protein, 19 aa, Mycobacterium
MRKNELIAAIQEFRDRTNG

SEQ ID NO: 1050957 - protein, 23 aa, Mycobacterium
MRKSELIAAIEECRGQANGTSVN

SEQ ID NO: 1050958 - protein, 20 aa, Mycobacterium
MRLDSRFFLEDSAGIPARGG

SEQ ID NO: 1050959 - protein, 23 aa, Mycobacterium
MRLLGVTCLEELSAKHVTQLQRL

SEQ ID NO: 1050960 - protein, 19 aa, Mycobacterium
MRMIRRPAHDAARYDQVWK

SEQ ID NO: 1050961 - protein, 18 aa, Mycobacterium
MRNPVRFQQAITHAFNGA

SEQ ID NO: 1050962 - protein, 18 aa, Mycobacterium
MRNRVTWTVTKWDPPREV

SEQ ID NO: 1050963 - protein, 20 aa, Mycobacterium
MRPDCLRRLDEVDAVVIDPR

SEQ ID NO: 1050964 - protein, 18 aa, Mycobacterium
MRPELLVRMFESIDNLTM

SEQ ID NO: 1050965 - protein, 24 aa, Mycobacterium
MRPHDPPWCRPLLGVRRGVTHDAC

SEQ ID NO: 1050966 - protein, 19 aa, Mycobacterium
MRPSSSRDTAFFWDGVKAH

SEQ ID NO: 1050967 - protein, 19 aa, Mycobacterium
MRQHWGIENSLHWIRAVTF

SEQ ID NO: 1050968 - protein, 24 aa, Mycobacterium
MRRFLAAFAPFGLRPDALRPGYGL

SEQ ID NO: 1050969 - protein, 30 aa, Mycobacterium
MRRPSNWLLAARCVRGLLSMSSGEPDQALN

SEQ ID NO: 1050970 - protein, 25 aa, Mycobacterium
MRRRIDIACGLVVEPQVAFLDEPTT

SEQ ID NO: 1050971 - protein, 18 aa, Mycobacterium
MRRSAPIWWNEQPTGCGG

SEQ ID NO: 1050972 - protein, 26 aa, Mycobacterium
MRRSHPECFLRGAYIPVLASGTAEDH

SEQ ID NO: 1050973 - protein, 19 aa, Mycobacterium
MRSAVGLGARGIRINCTGP

SEQ ID NO: 1050974 - protein, 22 aa, Mycobacterium
MRSEPGRFGLVGANGGIMSKYS

SEQ ID NO: 1050975 - protein, 18 aa, Mycobacterium
MRTFGGLLMAQSFVANSR

SEQ ID NO: 1050976 - protein, 18 aa, Mycobacterium
MRTRNGFSGWTTHATATV

SEQ ID NO: 1050977 - protein, 20 aa, Mycobacterium
MRVRQPGFFLGHTLTPSTPA

SEQ ID NO: 1050978 - protein, 20 aa, Mycobacterium
MRWGGARGGIRVHDGLARGR

SEQ ID NO: 1050979 - protein, 22 aa, Mycobacterium
MRYILDCIDMVLSEGARYAVLR

SEQ ID NO: 1050980 - protein, 23 aa, Mycobacterium
MSAAAAPYVSWLNAAAVRAGEAA

SEQ ID NO: 1050981 - protein, 22 aa, Mycobacterium
MSAALDAASTWGLDPFGAAVPP

SEQ ID NO: 1050982 - protein, 21 aa, Mycobacterium
MSALRAVTLVPGYGAAKAGII

SEQ ID NO: 1050983 - protein, 20 aa, Mycobacterium
MSAPYVEGALIDFVDTIEKQ

SEQ ID NO: 1050984 - protein, 22 aa, Mycobacterium
MSDEITELFGPGLAETAVIRNG

SEQ ID NO: 1050985 - protein, 21 aa, Mycobacterium
MSDLTIPFDVVVSGVRKQPYS

SEQ ID NO: 1050986 - protein, 20 aa, Mycobacterium
MSDVIRLARHAHHYLAVFDR

SEQ ID NO: 1050987 - protein, 26 aa, Mycobacterium
MSGGAGGAGGWLIGNGGHGGIGGLGI

SEQ ID NO: 1050988 - protein, 21 aa, Mycobacterium
MSGGIEGAGIDWAREQGTGQP

SEQ ID NO: 1050989 - protein, 26 aa, Mycobacterium
MSKAFAFAGGRLGYLVATPALIDALL

SEQ ID NO: 1050990 - protein, 20 aa, Mycobacterium
MSLASWLRTRIVDRSTRDGN

SEQ ID NO: 1050991 - protein, 17 aa, Mycobacterium
MSLATEEMIRWVTPVKQ

SEQ ID NO: 1050992 - protein, 25 aa, Mycobacterium
MSLDERLHHLFARMPDARVHLYGKD

SEQ ID NO: 1050993 - protein, 17 aa, Mycobacterium
MSNPILCDLILIRSALS

SEQ ID NO: 1050994 - protein, 20 aa, Mycobacterium
MSPELRSNVDVVRGDITDAQ

SEQ ID NO: 1050995 - protein, 22 aa, Mycobacterium
MSPGERLLGLDLANGGHLTHGM

SEQ ID NO: 1050996 - protein, 20 aa, Mycobacterium
MSRGAIFHHFRDKDALFFAL

SEQ ID NO: 1050997 - protein, 28 aa, Mycobacterium
MSRSTPRAGDGFIRLDVDGVAIYASPNA

SEQ ID NO: 1050998 - protein, 20 aa, Mycobacterium
MSVAAKRAEAMLADEPMSAE

SEQ ID NO: 1050999 - protein, 18 aa, Mycobacterium
MSVPQGWTQAAPAMRLVS

SEQ ID NO: 1051000 - protein, 18 aa, Mycobacterium
MSWRAHVFAPVSGIPGVQ

SEQ ID NO: 1051001 - protein, 23 aa, Mycobacterium
MSYICAGHPYPLVVSPNASPVFL

SEQ ID NO: 1051002 - protein, 17 aa, Mycobacterium
MTAALQVSGHRVWYYEN

SEQ ID NO: 1051003 - protein, 17 aa, Mycobacterium
MTAEQRGTVALMHGERE

SEQ ID NO: 1051004 - protein, 17 aa, Mycobacterium
MTEHGWEADEWPDLYQR

SEQ ID NO: 1051005 - protein, 18 aa, Mycobacterium
MTEPMMADFVEIRRAAGL

SEQ ID NO: 1051006 - protein, 20 aa, Mycobacterium
MTEREIDRAITLYVEEGLSI

SEQ ID NO: 1051007 - protein, 18 aa, Mycobacterium
MTETSPLATMAWPPPGTP

SEQ ID NO: 1051008 - protein, 23 aa, Mycobacterium
MTIPGMLSGTVPLVLTVPPDAEV

SEQ ID NO: 1051009 - protein, 21 aa, Mycobacterium
MTKGVLWRQHDIFMTSFGGRD

SEQ ID NO: 1051010 - protein, 17 aa, Mycobacterium
MTLRFGSKVPGSAMEVR

SEQ ID NO: 1051011 - protein, 20 aa, Mycobacterium
MTMYAGWRAVIAGFVARRLS

SEQ ID NO: 1051012 - protein, 18 aa, Mycobacterium
MTMYLHLPFVSIPIPINP

SEQ ID NO: 1051013 - protein, 35 aa, Mycobacterium; identical to SEQ ID NO: 618869

SEQ ID NO: 1051014 - protein, 19 aa, Mycobacterium
MTQAAAPYAAWLCTAAAQS

SEQ ID NO: 1051015 - protein, 19 aa, Mycobacterium
MTQRFGLGRDDVCYVSMPL

SEQ ID NO: 1051016 - protein, 23 aa, Mycobacterium
MTSRARWKIEVAGELDVDLEPTI

SEQ ID NO: 1051017 - protein, 20 aa, Mycobacterium
MTSVPMLREFLVSNLVLVLS

SEQ ID NO: 1051018 - protein, 27 aa, Mycobacterium
MTTEIRYPLNLIHLATVMWFDGPALGN

SEQ ID NO: 1051019 - protein, 18 aa, Mycobacterium
MTTFGFILGEVFRRITGR

SEQ ID NO: 1051020 - protein, 25 aa, Mycobacterium
MTTPKWVHNRIQPIAIRDVLHYLVA

SEQ ID NO: 1051021 - protein, 18 aa, Mycobacterium
MTVGALSVPHSWITAPAT

SEQ ID NO: 1051022 - protein, 28 aa, Mycobacterium
MVAACLKWEGGYVWACKNYDGDVQSGTV

SEQ ID NO: 1051023 - protein, 20 aa, Mycobacterium
MVAARRAAGRIVDMLDAGDR

SEQ ID NO: 1051024 - protein, 19 aa, Mycobacterium
MVAAVLPFASWLSATASVA

SEQ ID NO: 1051025 - protein, 22 aa, Mycobacterium
MVADSFHLPIVFLADNPGMLPG

SEQ ID NO: 1051026 - protein, 26 aa, Mycobacterium
MVAIRGELDLVMWGEWPLEASPLRQA

SEQ ID NO: 1051027 - protein, 18 aa, Mycobacterium
MVETFGWTTIVDVLIIAY

SEQ ID NO: 1051028 - protein, 20 aa, Mycobacterium
MVIKDGRFGPYVTDGETNAS

SEQ ID NO: 1051029 - protein, 18 aa, Mycobacterium
MVLPELRALANQAGVKGT

SEQ ID NO: 1051030 - protein, 17 aa, Mycobacterium
MVLPELRALANQVGVKG

SEQ ID NO: 1051031 - protein, 20 aa, Mycobacterium
MVNLHRRYRITTAQLAAATE

SEQ ID NO: 1051032 - protein, 25 aa, Mycobacterium
MVNYACIEWAVGVFRSEANGTTECV

SEQ ID NO: 1051033 - protein, 17 aa, Mycobacterium
MVPTGWLVWSCNVAHIN

SEQ ID NO: 1051034 - protein, 22 aa, Mycobacterium
MVQPGLLSWRDVARVMSENPAR

SEQ ID NO: 1051035 - protein, 17 aa, Mycobacterium
MVRRGLDPFTFRIAQTV

SEQ ID NO: 1051036 - protein, 21 aa, Mycobacterium
MVRRILRSMFAVGVDRWEPAP

SEQ ID NO: 1051037 - protein, 17 aa, Mycobacterium
MVSAASAWNRLASELSF

SEQ ID NO: 1051038 - protein, 26 aa, Mycobacterium
MVSLACGLERARQLVASWSDRLSIAA

SEQ ID NO: 1051039 - protein, 24 aa, Mycobacterium
MVSLARTLISYGIEPDAVIGHSQG

SEQ ID NO: 1051040 - protein, 17 aa, Mycobacterium
MVSRLRAAVSARRDPNF

SEQ ID NO: 1051041 - protein, 52 aa, Mycobacterium
MVYTETKLNSSFSFGRPKCLVKVIQKLSGLSINRFIAIDFVGFAKMVQALGG

SEQ ID NO: 1051042 - protein, 17 aa, Mycobacterium
MWGAPLHRRWHGSRLRD

SEQ ID NO: 1051043 - protein, 25 aa, Mycobacterium
MWQTTECWRQWINIGNFPDHPWRAY

SEQ ID NO: 1051044 - protein, 19 aa, Mycobacterium
MWRLADRQLDEFLGAAECE

SEQ ID NO: 1051045 - protein, 19 aa, Mycobacterium
MYALNFLDKGIGFTKAATG

SEQ ID NO: 1051046 - protein, 18 aa, Mycobacterium
MYARRLGPKRARLLNPLA

SEQ ID NO: 1051047 - protein, 18 aa, Mycobacterium
MYEIPGATHHYAGPDQRD

SEQ ID NO: 1051048 - protein, 18 aa, Mycobacterium
MYLCRELTDLSLPKIGQA

SEQ ID NO: 1051049 - protein, 29 aa, Mycobacterium
MYPIYATCVELGIPIFVCAGIPGPRLPFR

SEQ ID NO: 1051050 - protein, 18 aa, Mycobacterium
MYSNYGFTALAEAVAQES

SEQ ID NO: 1051051 - protein, 21 aa, Mycobacterium
MYTVKGIKLAINYGLNKVRFP

SEQ ID NO: 1051052 - protein, 19 aa, Mycobacterium
MYYRHRGYAPFSLPSAFTD

SEQ ID NO: 1051053 - protein, 25 aa, Mycobacterium
NAAAVLPTTVLQAAGADEVSAAVAA

SEQ ID NO: 1051054 - protein, 30 aa, Mycobacterium; identical to SEQ ID NO: 702371

SEQ ID NO: 1051055 - protein, 18 aa, Mycobacterium
NAAGLGVHAVIFGSGCAD

SEQ ID NO: 1051056 - protein, 24 aa, Mycobacterium
NAAGLPSLMVLTGVSSARDAVHAD

SEQ ID NO: 1051057 - protein, 20 aa, Mycobacterium
NAAISALVLPSAFRPVPDPN

SEQ ID NO: 1051058 - protein, 21 aa, Mycobacterium
NAASAFRVVRDHVTSVFRHDD

SEQ ID NO: 1051059 - protein, 19 aa, Mycobacterium
NAASSGFDGGVGGQDGTGG

SEQ ID NO: 1051060 - protein, 22 aa, Mycobacterium
NACDEMHRVGRWVEGVPMADDK

SEQ ID NO: 1051061 - protein, 19 aa, Mycobacterium
NADIAMAFERYRTVTCDHS

SEQ ID NO: 1051062 - protein, 23 aa, Mycobacterium
NAEDARYLLAAAVEKGTDAVVVT

SEQ ID NO: 1051063 - protein, 24 aa, Mycobacterium
NAERMRHGMYWSGDLAYRDSQGWI

SEQ ID NO: 1051064 - protein, 26 aa, Mycobacterium
NAEVELAWEILDPVLDNWASSGKPDP

SEQ ID NO: 1051065 - protein, 20 aa, Mycobacterium
NAGGLFLSWVDRVTGPADRD

SEQ ID NO: 1051066 - protein, 19 aa, Mycobacterium
NAGKLIVVVLPDFGERYLS

SEQ ID NO: 1051067 - protein, 19 aa, Mycobacterium
NAGLFSGIAGNGGDGGQGG

SEQ ID NO: 1051068 - protein, 19 aa, Mycobacterium
NAGLRRFVFTSSYATVDRR

SEQ ID NO: 1051069 - protein, 19 aa, Mycobacterium
NAGVFGWGRLWELTDEQWD

SEQ ID NO: 1051070 - protein, 19 aa, Mycobacterium
NAGVHACAVIMSSEPLTEA

SEQ ID NO: 1051071 - protein, 33 aa, Mycobacterium
NAINGAVNTAAWFVMAAIPNSVFLGHTLNAIET

SEQ ID NO: 1051072 - protein, 18 aa, Mycobacterium
NAIRDFIETTGIPFLPMS

SEQ ID NO: 1051073 - protein, 24 aa, Mycobacterium
NAIYKRWHCGELDVPLPGGESAND

SEQ ID NO: 1051074 - protein, 19 aa, Mycobacterium
NALALARRGYPVDVVELTP

SEQ ID NO: 1051075 - protein, 23 aa, Mycobacterium
NALARRLLVKRYGAAVLGPYTSK

SEQ ID NO: 1051076 - protein, 19 aa, Mycobacterium
NALCSVYGHLHIPRTTWHD

SEQ ID NO: 1051077 - protein, 18 aa, Mycobacterium
NALIEARVGTVIYGVADP

SEQ ID NO: 1051078 - protein, 25 aa, Mycobacterium
NALLDLFLRIIVELFQRHWSSTEHQ

SEQ ID NO: 1051079 - protein, 23 aa, Mycobacterium
NAMLAGLAPRFGVGVVATTGAHF

SEQ ID NO: 1051080 - protein, 27 aa, Mycobacterium
NAMPPTSVMGLWTFDGHKGQTEVTTGQ

SEQ ID NO: 1051081 - protein, 30 aa, Mycobacterium
NANRHLAFSGGRHFCLGAALARVEGEVGLR

SEQ ID NO: 1051082 - protein, 23 aa, Mycobacterium
NAPAQALLGHPIIGTGGSGSQSA

SEQ ID NO: 1051083 - protein, 18 aa, Mycobacterium
NAPAQALLGRPLIGNGAN

SEQ ID NO: 1051084 - protein, 26 aa, Mycobacterium
NAPFLQFTGRPLVGPGTDGAPGTGQA

SEQ ID NO: 1051085 - protein, 25 aa, Mycobacterium
NAPTEALLGRPLIGDGADGAPGESG

SEQ ID NO: 1051086 - protein, 26 aa, Mycobacterium
NAPTQALLDRPLIGNGANGAAGTGAN

SEQ ID NO: 1051087 - protein, 19 aa, Mycobacterium
NAQAALRIEQVEQMVLEQF

SEQ ID NO: 1051088 - protein, 29 aa, Mycobacterium
NARFTIHAGEAFGLPSIHEAIAFCGADRL

SEQ ID NO: 1051089 - protein, 25 aa, Mycobacterium
NARGGRLSRQSAWQVLQDAAERADI

SEQ ID NO: 1051090 - protein, 20 aa, Mycobacterium
NASLFGFGGAGGVGGISGND

SEQ ID NO: 1051091 - protein, 21 aa, Mycobacterium
NATANCFPMIQISGSSQRAIM

SEQ ID NO: 1051092 - protein, 22 aa, Mycobacterium
NATEFCRSADAIAISEHAIASD

SEQ ID NO: 1051093 - protein, 21 aa, Mycobacterium
NATRIPMTWFEVDQVPLWAKV

SEQ ID NO: 1051094 - protein, 18 aa, Mycobacterium
NAVACGRSVQAGYEGLSR

SEQ ID NO: 1051095 - protein, 17 aa, Mycobacterium
NAVDAAAGRDLVASNAG

SEQ ID NO: 1051096 - protein, 25 aa, Mycobacterium
NAVRDWPKPLGFVWGLDDPVATTNV

SEQ ID NO: 1051097 - protein, 19 aa, Mycobacterium
NAVVGRPVSEYGFEPVRFD

SEQ ID NO: 1051098 - protein, 19 aa, Mycobacterium
NAYFPMLIPENYFNREAEH

SEQ ID NO: 1051099 - protein, 20 aa, Mycobacterium
NAYFPMLIPENYFNREAEHV

SEQ ID NO: 1051100 - protein, 19 aa, Mycobacterium
NCDPAKFDGSIGVYGTSSP

SEQ ID NO: 1051101 - protein, 19 aa, Mycobacterium
NCRLCKSLRESTALDAGGS

SEQ ID NO: 1051102 - protein, 19 aa, Mycobacterium
NDCPAELWSALDAQALAAE

SEQ ID NO: 1051103 - protein, 25 aa, Mycobacterium
NDGATAWRAVVEYADTAGDRAFAST

SEQ ID NO: 1051104 - protein, 23 aa, Mycobacterium
NDGTLWCEKPMYIQLDFLVRRFA

SEQ ID NO: 1051105 - protein, 19 aa, Mycobacterium
NDIDPEWAFQDLGFDSVKA

SEQ ID NO: 1051106 - protein, 22 aa, Mycobacterium
NDIVAVLALYRPGPMGMNAHND

SEQ ID NO: 1051107 - protein, 26 aa, Mycobacterium
NDKRMADAFLRMGPGWRDVVLPRLAA

SEQ ID NO: 1051108 - protein, 18 aa, Mycobacterium
NDLAPERHRVAFIEMVCE

SEQ ID NO: 1051109 - protein, 24 aa, Mycobacterium
NDLRQRIGMVFQHFNLFPHRNVVD

SEQ ID NO: 1051110 - protein, 25 aa, Mycobacterium
NDPDWQRFHLIGATNPVYFALLARR

SEQ ID NO: 1051111 - protein, 19 aa, Mycobacterium
NDRASCKYMKMITPAALLR

SEQ ID NO: 1051112 - protein, 18 aa, Mycobacterium
NDSEYGLCAAVFSRDLAH

SEQ ID NO: 1051113 - protein, 17 aa, Mycobacterium
NDVRYLLDPRVVDGTSW

SEQ ID NO: 1051114 - protein, 23 aa, Mycobacterium
NDWVLIKLAGPGVVRLVEIDTSY

SEQ ID NO: 1051115 - protein, 23 aa, Mycobacterium
NDYDLSSLFLLASTAALFSPSIK

SEQ ID NO: 1051116 - protein, 24 aa, Mycobacterium
NEAAFKLSRLTGRTKLVAAQEGFH

SEQ ID NO: 1051117 - protein, 22 aa, Mycobacterium
NEAFASVVLKFQKDLNIPDEKL

SEQ ID NO: 1051118 - protein, 20 aa, Mycobacterium
NEAFASVVLSWARVHEPEMA

SEQ ID NO: 1051119 - protein, 18 aa, Mycobacterium
NEARGRWAAAPLATTSCT

SEQ ID NO: 1051120 - protein, 23 aa, Mycobacterium
NEAVPYLSDRGWLLTSTPLPELR

SEQ ID NO: 1051121 - protein, 22 aa, Mycobacterium
NECCRLRKVVPLTNALRGYAAW

SEQ ID NO: 1051122 - protein, 22 aa, Mycobacterium
NEDEVDAFLDLVENELTRLIEE

SEQ ID NO: 1051123 - protein, 18 aa, Mycobacterium
NEEFMWRLADRQLDEFLG

SEQ ID NO: 1051124 - protein, 28 aa, Mycobacterium
NEEQRRWAAMGIERGWQATMVLTEPDAG

SEQ ID NO: 1051125 - protein, 25 aa, Mycobacterium
NEGDVFCSVVRRVVLPDSFIAIDGQ

SEQ ID NO: 1051126 - protein, 22 aa, Mycobacterium
NEHKRHRYAFTPFGGGAHKCLG

SEQ ID NO: 1051127 - protein, 23 aa, Mycobacterium
NEHYRLRVDPERGGGVESLVRDH

SEQ ID NO: 1051128 - protein, 17 aa, Mycobacterium
NEIAGGLGVSRVPIQEA

SEQ ID NO: 1051129 - protein, 23 aa, Mycobacterium
NEILGDGLLVFFGVPNTDGEAAE

SEQ ID NO: 1051130 - protein, 23 aa, Mycobacterium
NEILRLQSVYTRPSFSSRTTSTR

SEQ ID NO: 1051131 - protein, 22 aa, Mycobacterium
NEIPCVCALLTLLPDNLRWLVT

SEQ ID NO: 1051132 - protein, 23 aa, Mycobacterium
NEIPCVRALLTLLPDNLRWLVTV

SEQ ID NO: 1051133 - protein, 17 aa, Mycobacterium
NEIQVVVTILSLDPNDL

SEQ ID NO: 1051134 - protein, 20 aa, Mycobacterium
NEIRWDIRPSPHLGTIELRI

SEQ ID NO: 1051135 - protein, 17 aa, Mycobacterium
NEIVCGMAEVVKAGFIA

SEQ ID NO: 1051136 - protein, 24 aa, Mycobacterium
NELAQRVAAVAGFLRQRLIGDYSV

SEQ ID NO: 1051137 - protein, 26 aa, Mycobacterium
NELREMLPHNAVEYFVSYYDYYQPEA

SEQ ID NO: 1051138 - protein, 25 aa, Mycobacterium
NELSAAIATAAPWLRDGDVVVVTSK

SEQ ID NO: 1051139 - protein, 20 aa, Mycobacterium
NELWEFTPSGLMARREASIN

SEQ ID NO: 1051140 - protein, 19 aa, Mycobacterium
NERWRFVITAHHIVIDGWS

SEQ ID NO: 1051141 - protein, 20 aa, Mycobacterium
NETAYAWSTILARGATSGPV

SEQ ID NO: 1051142 - protein, 23 aa, Mycobacterium
NETRTGDRWRLASPHGGLHVDRT

SEQ ID NO: 1051143 - protein, 19 aa, Mycobacterium
NEVEINVACSLGMLTAEQV

SEQ ID NO: 1051144 - protein, 18 aa, Mycobacterium
NEVLQCYLDLVLDGLVAR

SEQ ID NO: 1051145 - protein, 17 aa, Mycobacterium
NEVLSSPGYREAAQRAA

SEQ ID NO: 1051146 - protein, 36 aa, Mycobacterium; identical to SEQ ID NO: 702953

SEQ ID NO: 1051147 - protein, 21 aa, Mycobacterium
NEVYRLPKHLDEKVARIHVEA

SEQ ID NO: 1051148 - protein, 21 aa, Mycobacterium
NEVYRRVCAALAEALSQHNVV

SEQ ID NO: 1051149 - protein, 18 aa, Mycobacterium
NEYARLAAANIHSLTFAE

SEQ ID NO: 1051150 - protein, 19 aa, Mycobacterium
NEYYSLHPHTRMLNRVKVH

SEQ ID NO: 1051151 - protein, 22 aa, Mycobacterium
NFASILPLRCRLGDNPTFAELV

SEQ ID NO: 1051152 - protein, 24 aa, Mycobacterium
NFDARWGGAEGMYARRLGPKRARL

SEQ ID NO: 1051153 - protein, 30 aa, Mycobacterium; identical to SEQ ID NO: 702976

SEQ ID NO: 1051154 - protein, 20 aa, Mycobacterium
NFEAGPALRFMSGNLCHQIE

SEQ ID NO: 1051155 - protein, 18 aa, Mycobacterium
NFELWSFAVSSVNGCSHC

SEQ ID NO: 1051156 - protein, 26 aa, Mycobacterium
NFGSALPEFAAQLSGAISATVGSSLP

SEQ ID NO: 1051157 - protein, 26 aa, Mycobacterium
NFHDLGRLGGWAILAAVAPQGSATQA

SEQ ID NO: 1051158 - protein, 23 aa, Mycobacterium
NFKPGTLTSLGFNYANLHALNPH

SEQ ID NO: 1051159 - protein, 22 aa, Mycobacterium
NFKVDRPGTVTLTFTPADGSEP

SEQ ID NO: 1051160 - protein, 26 aa, Mycobacterium
NFLDGARAYVRFAIGHPGHYAVMFDW

SEQ ID NO: 1051161 - protein, 24 aa, Mycobacterium
NFLNPRPGTPFGDLEVLPAGEALK

SEQ ID NO: 1051162 - protein, 18 aa, Mycobacterium
NFPGHGWEAKFFAAYGVA

SEQ ID NO: 1051163 - protein, 22 aa, Mycobacterium
NFPGMGMVERWLLKTQFPETTL

SEQ ID NO: 1051164 - protein, 21 aa, Mycobacterium
NFRDVVAALGMYPGQAPPLGA

SEQ ID NO: 1051165 - protein, 22 aa, Mycobacterium
NFRDVVAALGMYPGQAPPLGAE

SEQ ID NO: 1051166 - protein, 26 aa, Mycobacterium
NFSGRARLSSVLWTFTVTKQDGVVCP

SEQ ID NO: 1051167 - protein, 18 aa, Mycobacterium
NFYHMLATRYGYGAEADR

SEQ ID NO: 1051168 - protein, 23 aa, Mycobacterium
NGAAGRTGGWLAGNGGNGGTGVL

SEQ ID NO: 1051169 - protein, 19 aa, Mycobacterium
NGAIGGFSGGNGGAGGSGG

SEQ ID NO: 1051170 - protein, 23 aa, Mycobacterium
NGARPFLFTDTVGFVRHLPPQLV

SEQ ID NO: 1051171 - protein, 19 aa, Mycobacterium
NGASADWIGNGGSGGAGGS

SEQ ID NO: 1051172 - protein, 25 aa, Mycobacterium
NGATKRVVLGRMMQTSVAMVKEGWF

SEQ ID NO: 1051173 - protein, 19 aa, Mycobacterium
NGAVRAHFLTDRMIFDSQL

SEQ ID NO: 1051174 - protein, 17 aa, Mycobacterium
NGDGLQGFGGWNSGSGN

SEQ ID NO: 1051175 - protein, 24 aa, Mycobacterium
NGELPAVRVGRSFRVHAKAVHDML

SEQ ID NO: 1051176 - protein, 24 aa, Mycobacterium
NGEPFWFPNWTRLVYAGDGLFCSE

SEQ ID NO: 1051177 - protein, 24 aa, Mycobacterium
NGERTGNVCLVTLGLNLFSRGVDP

SEQ ID NO: 1051178 - protein, 22 aa, Mycobacterium
NGESMGAVARELHYTDVSALYT

SEQ ID NO: 1051179 - protein, 19 aa, Mycobacterium
NGFPNCFIESIAQAGLTVN

SEQ ID NO: 1051180 - protein, 22 aa, Mycobacterium
NGFQVLCEAGLLPGALIRNVGL

SEQ ID NO: 1051181 - protein, 21 aa, Mycobacterium
NGGAASLLFGNGGSGGDGGDG

SEQ ID NO: 1051182 - protein, 20 aa, Mycobacterium
NGGAGGDGWTNGDGGDVGLF

SEQ ID NO: 1051183 - protein, 25 aa, Mycobacterium
NGGAGGFGGIGLNGSGGDGGHGGAG

SEQ ID NO: 1051184 - protein, 25 aa, Mycobacterium
NGGAGGGGLWFGNGGAGGIGGFDAH

SEQ ID NO: 1051185 - protein, 26 aa, Mycobacterium
NGGAGGSAGLWGAGGAGGAGGAGATP

SEQ ID NO: 1051186 - protein, 25 aa, Mycobacterium
NGGAGGSVGLWGHGGNGGIGGAGGA

SEQ ID NO: 1051187 - protein, 25 aa, Mycobacterium
NGGAGGTGGWLFGDGGAGGTGGAGG

SEQ ID NO: 1051188 - protein, 25 aa, Mycobacterium
NGGAVSRFGLARAVFEECGTDPQRV

SEQ ID NO: 1051189 - protein, 23 aa, Mycobacterium
NGGDGGWLIGRGGSGGVGQKGGN

SEQ ID NO: 1051190 - protein, 21 aa, Mycobacterium
NGGGGGWLSGDAGAGGQGGAS

SEQ ID NO: 1051191 - protein, 24 aa, Mycobacterium
NGGLGVAVTKSWGMVDNRTISAIT

SEQ ID NO: 1051192 - protein, 17 aa, Mycobacterium
NGGLLLRDLDLPDFRDY

SEQ ID NO: 1051193 - protein, 18 aa, Mycobacterium
NGGNARLLGNGGDGGPGI

SEQ ID NO: 1051194 - protein, 24 aa, Mycobacterium
NGGNGGDGGVRFGGGANGSGGTGG

SEQ ID NO: 1051195 - protein, 24 aa, Mycobacterium
NGGNGGIGGTGFIGGNGGNGGGGG

SEQ ID NO: 1051196 - protein, 24 aa, Mycobacterium
NGGSGAHGGWLIGNAGNGGDSGSG

SEQ ID NO: 1051197 - protein, 30 aa, Mycobacterium
NGGSGGFAFTFGTGNIIAGVGGGGGTGSTG

SEQ ID NO: 1051198 - protein, 28 aa, Mycobacterium
NGGSGGRAALLYGVGRDGGAGGAGGDGV

SEQ ID NO: 1051199 - protein, 25 aa, Mycobacterium
NGGVGGNAFAAGFSGTGGAAGVGAG

SEQ ID NO: 1051200 - protein, 25 aa, Mycobacterium
NGLACADGVVIPTECEYFSLRGLAL

SEQ ID NO: 1051201 - protein, 17 aa, Mycobacterium
NGLALGDKWAPGPSTYL

SEQ ID NO: 1051202 - protein, 18 aa, Mycobacterium
NGLSRSAIAVYRVPEPIV

SEQ ID NO: 1051203 - protein, 18 aa, Mycobacterium
NGPDCGITNVNIGTSDAK

SEQ ID NO: 1051204 - protein, 25 aa, Mycobacterium
NGQSWLATLWSEFGPNANIWNTIAS

SEQ ID NO: 1051205 - protein, 27 aa, Mycobacterium
NGQTLFEICARLTTKHGICSTRQAISQ

SEQ ID NO: 1051206 - protein, 23 aa, Mycobacterium
NGSEVFERGGPYLTRGAADLVPT

SEQ ID NO: 1051207 - protein, 19 aa, Mycobacterium
NGSGEAIGGAPGAGGTGAV

SEQ ID NO: 1051208 - protein, 19 aa, Mycobacterium
NGTSRWLVAVRMVSEGVDV

SEQ ID NO: 1051209 - protein, 24 aa, Mycobacterium
NGVLDRIAPWFAHYKSLRHASELM

SEQ ID NO: 1051210 - protein, 19 aa, Mycobacterium
NGVLSRVWHGIYGRGELTS

SEQ ID NO: 1051211 - protein, 17 aa, Mycobacterium
NGVRIARKSLQQRRPTW

SEQ ID NO: 1051212 - protein, 24 aa, Mycobacterium
NGYTRLSWAVLNWNSNAIAVYDAV

SEQ ID NO: 1051213 - protein, 17 aa, Mycobacterium
NHARRCVFWEVDPATLG

SEQ ID NO: 1051214 - protein, 25 aa, Mycobacterium
NHGGPRLTGIAGLAVDGQRAQVRGS

SEQ ID NO: 1051215 - protein, 21 aa, Mycobacterium
NHLGPTLSMRGIDNAAYYRLV

SEQ ID NO: 1051216 - protein, 20 aa, Mycobacterium
NHSDAGLFGSVAQLVKVRSG

SEQ ID NO: 1051217 - protein, 33 aa, Mycobacterium
NHYDCRSTRELRDWLLIRAWEAGVTPIGVQPVP

SEQ ID NO: 1051218 - protein, 20 aa, Mycobacterium
NHYPIGWAMAFNTPYKLFKR

SEQ ID NO: 1051219 - protein, 18 aa, Mycobacterium
NIAARVGFSLAVGEHLEY

SEQ ID NO: 1051220 - protein, 23 aa, Mycobacterium
NIAPRPTTPFAQALRLALIDAAP

SEQ ID NO: 1051221 - protein, 18 aa, Mycobacterium
NIASTLWRSVVDHDARRY

SEQ ID NO: 1051222 - protein, 26 aa, Mycobacterium
NICRPHAPASMPTRPLLEITAGYVKR

SEQ ID NO: 1051223 - protein, 18 aa, Mycobacterium
NIGEGIAQVARWGVKDRL

SEQ ID NO: 1051224 - protein, 24 aa, Mycobacterium
NIGLLAKFMPNFLFAPDAALPLIP

SEQ ID NO: 1051225 - protein, 20 aa, Mycobacterium
NIGNPAPFGFEAPDVIMRDM

SEQ ID NO: 1051226 - protein, 21 aa, Mycobacterium
NIGRLPMAWIDPGTADLRRVL

SEQ ID NO: 1051227 - protein, 20 aa, Mycobacterium
NIMENPAWYTAYTPYQPEIS

SEQ ID NO: 1051228 - protein, 25 aa, Mycobacterium
NIPIDLRQDWPAALLDSGFDASKPT

SEQ ID NO: 1051229 - protein, 24 aa, Mycobacterium
NIRFLSGDYWDFWDHTVPISDRSL

SEQ ID NO: 1051230 - protein, 18 aa, Mycobacterium
NITGSARFRNLIKAEDYD

SEQ ID NO: 1051231 - protein, 26 aa, Mycobacterium
NKALADFAHRGWIRLEGKSVLISDSE

SEQ ID NO: 1051232 - protein, 23 aa, Mycobacterium
NKDGGYLAANWAVYRAELALVET

SEQ ID NO: 1051233 - protein, 24 aa, Mycobacterium
NKEKAQQLGLTWLVEIGAHGVVAG

SEQ ID NO: 1051234 - protein, 24 aa, Mycobacterium
NKHVAFGYGVHFCMGAALARMEVA

SEQ ID NO: 1051235 - protein, 19 aa, Mycobacterium
NKITLPWPITVRATAESVA

SEQ ID NO: 1051236 - protein, 17 aa, Mycobacterium
NKKWVWAGADVIEPEFT

SEQ ID NO: 1051237 - protein, 19 aa, Mycobacterium
NKNGMPWASAQLEDLTGGI

SEQ ID NO: 1051238 - protein, 18 aa, Mycobacterium
NKSRLLAVAMGDVTSPGL

SEQ ID NO: 1051239 - protein, 24 aa, Mycobacterium
NKVRFPAPVPVGSRVRAQSSLVGV

SEQ ID NO: 1051240 - protein, 24 aa, Mycobacterium
NLAAEVSGCLRVGKARNNSADTGL

SEQ ID NO: 1051241 - protein, 18 aa, Mycobacterium
NLAGSRYAVRDGMATLNP

SEQ ID NO: 1051242 - protein, 23 aa, Mycobacterium
NLAHWPGFLVLYYAALRPLHDDG

SEQ ID NO: 1051243 - protein, 26 aa, Mycobacterium
NLAKACARAGAALIHVSTDYVFDGDH

SEQ ID NO: 1051244 - protein, 19 aa, Mycobacterium
NLAQYPSILVELGNMKNPA

SEQ ID NO: 1051245 - protein, 17 aa, Mycobacterium
NLEALALAESWDNGKPI

SEQ ID NO: 1051246 - protein, 23 aa, Mycobacterium
NLESGARQRLVFGRNEPGLQHRH

SEQ ID NO: 1051247 - protein, 24 aa, Mycobacterium
NLGEVLRRYPQVVAPEMNLGQLAL

SEQ ID NO: 1051248 - protein, 24 aa, Mycobacterium
NLGHLEAAAGIAGFMKSVLAVGHG

SEQ ID NO: 1051249 - protein, 22 aa, Mycobacterium
NLGHLEAAAGITSFIKATLAVA

SEQ ID NO: 1051250 - protein, 17 aa, Mycobacterium
NLGLNWSLFGAATSHGG

SEQ ID NO: 1051251 - protein, 26 aa, Mycobacterium
NLGVTLGRRVALAAGAVRAESAATVD

SEQ ID NO: 1051252 - protein, 18 aa, Mycobacterium
NLHAPVARYWPEFRQAGK

SEQ ID NO: 1051253 - protein, 20 aa, Mycobacterium
NLHAYLRGFALEVMANSDNV

SEQ ID NO: 1051254 - protein, 26 aa, Mycobacterium
NLHGWQWRLEDGRCLTTRGHQLRSSR

SEQ ID NO: 1051255 - protein, 21 aa, Mycobacterium
NLHPGELLVAIEIPVGPQLHR

SEQ ID NO: 1051256 - protein, 20 aa, Mycobacterium
NLIDPSAWEFVWVVDPPLFE

SEQ ID NO: 1051257 - protein, 25 aa, Mycobacterium
NLITAPQYAGWDIFYSLFTGNPTTI

SEQ ID NO: 1051258 - protein, 31 aa, Mycobacterium
NLKCLCRKHHLLKTFWGWRDQQLPDGTVIWG

SEQ ID NO: 1051259 - protein, 25 aa, Mycobacterium
NLKGPFRLSALVGERMVAADGGSII

SEQ ID NO: 1051260 - protein, 27 aa, Mycobacterium
NLLHKGAQIMSSFDWTRNTFDPTVEAV

SEQ ID NO: 1051261 - protein, 28 aa, Mycobacterium
NLLLDLQAGFKLSYLFVSHDLSVVKHLA

SEQ ID NO: 1051262 - protein, 17 aa, Mycobacterium
NLMLFSGRAHPELAEQV

SEQ ID NO: 1051263 - protein, 23 aa, Mycobacterium
NLPAALAHLPADIQLGTHSLMAA

SEQ ID NO: 1051264 - protein, 20 aa, Mycobacterium
NLPFPMLADIKRELVAAAGV

SEQ ID NO: 1051265 - protein, 39 aa, Mycobacterium
NLPRVNARGGPGGRPGCWQTITRDLWPAPYLVMNVGANM

SEQ ID NO: 1051266 - protein, 26 aa, Mycobacterium
NLRLRDGRWYWHWDPAMMTAPGDDPE

SEQ ID NO: 1051267 - protein, 26 aa, Mycobacterium
NLRPTRAGAVPTIWNDVMHYLEKNPG

SEQ ID NO: 1051268 - protein, 20 aa, Mycobacterium
NLSAGKWPSLVSVAQLGAGG

SEQ ID NO: 1051269 - protein, 17 aa, Mycobacterium
NLSGTWRTLRAAVPAMI

SEQ ID NO: 1051270 - protein, 22 aa, Mycobacterium
NLVAALDRYNTYAARGEDPDFH

SEQ ID NO: 1051271 - protein, 21 aa, Mycobacterium
NLVCSCPSPAAFESTLPPKSA

SEQ ID NO: 1051272 - protein, 24 aa, Mycobacterium
NLVFQLLWYPSCVGDLALPSFSEN

SEQ ID NO: 1051273 - protein, 30 aa, Mycobacterium; identical to SEQ ID NO: 622888

SEQ ID NO: 1051274 - protein, 18 aa, Mycobacterium
NLVPRLFNLDRDFIQEIR

SEQ ID NO: 1051275 - protein, 20 aa, Mycobacterium
NLVSRGWVCVSLNYRVSPLH

SEQ ID NO: 1051276 - protein, 21 aa, Mycobacterium
NLYLRDLVMALQWIQDNIAEF

SEQ ID NO: 1051277 - protein, 17 aa, Mycobacterium
NMCRMLTADTEFHGTAL

SEQ ID NO: 1051278 - protein, 24 aa, Mycobacterium
NMDDARWDSVIAVNLLAPLRLTEG

SEQ ID NO: 1051279 - protein, 22 aa, Mycobacterium
NMGDGRRLVGLQALPDPDNNGR

SEQ ID NO: 1051280 - protein, 17 aa, Mycobacterium
NMRGDIVARAMRLVADG

SEQ ID NO: 1051281 - protein, 23 aa, Mycobacterium
NMVRARPVAKVPLQQAQGLVLAD

SEQ ID NO: 1051282 - protein, 26 aa, Mycobacterium
NNADFNKYVSYFCPSERSGLGDASQL

SEQ ID NO: 1051283 - protein, 18 aa, Mycobacterium
NNIGFGLTGNNQVGINFA

SEQ ID NO: 1051284 - protein, 25 aa, Mycobacterium
NNIGQLSMWQLPRDQTGDIGVSNNN

SEQ ID NO: 1051285 - protein, 22 aa, Mycobacterium
NNKCPLTSYVLVGFSQGAVIAG

SEQ ID NO: 1051286 - protein, 19 aa, Mycobacterium
NNKIALVIDDLVSTQPWSP

SEQ ID NO: 1051287 - protein, 26 aa, Mycobacterium
NNNWFAAYAYWYFKLYGHQNVKLLDG

SEQ ID NO: 1051288 - protein, 17 aa, Mycobacterium
NNPFRVFNSMLATGDSR

SEQ ID NO: 1051289 - protein, 22 aa, Mycobacterium
NNQPGLVVLLTFGTGIGSAVIN

SEQ ID NO: 1051290 - protein, 25 aa, Mycobacterium
NNRLPKVSWVLPGFLLSEHPAFPVN

SEQ ID NO: 1051291 - protein, 17 aa, Mycobacterium
NNTPFQWGKQMASHLGG

SEQ ID NO: 1051292 - protein, 17 aa, Mycobacterium
NNVGRGYWGWPEDTERV

SEQ ID NO: 1051293 - protein, 26 aa, Mycobacterium
NPAKLAELQRLWLIEATKYNVVPLDD

SEQ ID NO: 1051294 - protein, 24 aa, Mycobacterium
NPALKPIARCLPGTATITHQGRKS

SEQ ID NO: 1051295 - protein, 21 aa, Mycobacterium
NPALNAVVIRWFDHARETASA

SEQ ID NO: 1051296 - protein, 17 aa, Mycobacterium
NPAQWLAARGWVVEPVR

SEQ ID NO: 1051297 - protein, 18 aa, Mycobacterium
NPARPAWTAYDTFSSLGD

SEQ ID NO: 1051298 - protein, 23 aa, Mycobacterium
NPDDLRPGAMVFRPTPGPVDRRD

SEQ ID NO: 1051299 - protein, 24 aa, Mycobacterium
NPDHTAVAIALLFENFTSVLVGTS

SEQ ID NO: 1051300 - protein, 21 aa, Mycobacterium
NPDSFPGWLHDGDVVTLEVEG

SEQ ID NO: 1051301 - protein, 19 aa, Mycobacterium
NPEHVGSCEVFYRDIGDYL

SEQ ID NO: 1051302 - protein, 17 aa, Mycobacterium
NPFTPSWGEPYLEIAQR

SEQ ID NO: 1051303 - protein, 19 aa, Mycobacterium
NPGCANCSMKHSALGGCAT

SEQ ID NO: 1051304 - protein, 23 aa, Mycobacterium
NPGEHRLRRLVGWFDHAVELGAS

SEQ ID NO: 1051305 - protein, 25 aa, Mycobacterium
NPGPWKESLRLLAEEVMPRLNARIA

SEQ ID NO: 1051306 - protein, 19 aa, Mycobacterium
NPHVARLLGTYEIGIPGEP

SEQ ID NO: 1051307 - protein, 24 aa, Mycobacterium
NPIEGVAAWIDGRLDLAFDDAVKA

SEQ ID NO: 1051308 - protein, 17 aa, Mycobacterium
NPIIFNLPATVEMATPN

SEQ ID NO: 1051309 - protein, 17 aa, Mycobacterium
NPITAWKALSEGNERFV

SEQ ID NO: 1051310 - protein, 20 aa, Mycobacterium
NPLGAFGIGGYFGMADLGQI

SEQ ID NO: 1051311 - protein, 18 aa, Mycobacterium
NPLMPQVHRDIRGLAALG

SEQ ID NO: 1051312 - protein, 23 aa, Mycobacterium
NPMLAKRVGAWVPLEEVPEVWAA

SEQ ID NO: 1051313 - protein, 22 aa, Mycobacterium
NPMWEGFGYPGAPRIEPGGDEA

SEQ ID NO: 1051314 - protein, 26 aa, Mycobacterium
NPNWDCPKLRVGAGSFITPVRIYDID

SEQ ID NO: 1051315 - protein, 22 aa, Mycobacterium
NPPEVKSVGLGNVNGVTLGYTS

SEQ ID NO: 1051316 - protein, 17 aa, Mycobacterium
NPQSWKLLRGKVALPSH

SEQ ID NO: 1051317 - protein, 18 aa, Mycobacterium
NPREIKRFLNAFQVRNRI

SEQ ID NO: 1051318 - protein, 17 aa, Mycobacterium
NPRELAATTALRAGTPE

SEQ ID NO: 1051319 - protein, 23 aa, Mycobacterium
NPRFCEGDALLVWIPLNAANIFG

SEQ ID NO: 1051320 - protein, 21 aa, Mycobacterium
NPRIRLASVLCKISEVPPYNR

SEQ ID NO: 1051321 - protein, 23 aa, Mycobacterium
NPRWDKRFLGKHLITAHPMGGCA

SEQ ID NO: 1051322 - protein, 22 aa, Mycobacterium
NPSVVLLGCFVFASGTSSTRIR

SEQ ID NO: 1051323 - protein, 19 aa, Mycobacterium
NPTRSRRRYRRNSRSVPAS

SEQ ID NO: 1051324 - protein, 20 aa, Mycobacterium
NPVARFLGIVNMLTNKFETN

SEQ ID NO: 1051325 - protein, 35 aa, Mycobacterium
NPVSALVSFEVFIRPALRLAMGLPDPRRPQRTAVM

SEQ ID NO: 1051326 - protein, 23 aa, Mycobacterium
NPVTIGYRLARGILHNLKTADPA

SEQ ID NO: 1051327 - protein, 19 aa, Mycobacterium
NPYAAFFVFSLGWPTSEVP

SEQ ID NO: 1051328 - protein, 23 aa, Mycobacterium
NQGEVCTCPSRSLIQADIYDEFL

SEQ ID NO: 1051329 - protein, 18 aa, Mycobacterium
NQHGWQWSAGCGTDAAPY

SEQ ID NO: 1051330 - protein, 17 aa, Mycobacterium
NQLERIGSALSAANLTA

SEQ ID NO: 1051331 - protein, 17 aa, Mycobacterium
NQLKVPVAVVGASGAAA

SEQ ID NO: 1051332 - protein, 24 aa, Mycobacterium
NQLLWRRDELGLGVGDAVLQTTEP

SEQ ID NO: 1051333 - protein, 23 aa, Mycobacterium
NQLWVCGLPGYGPGDLIDFEFSG

SEQ ID NO: 1051334 - protein, 22 aa, Mycobacterium
NQPGVVAITGWLVRPTRQDDAR

SEQ ID NO: 1051335 - protein, 17 aa, Mycobacterium
NQRLRLETTPDRLTTRV

SEQ ID NO: 1051336 - protein, 17 aa, Mycobacterium
NQRLRLETTTERLTTRV

SEQ ID NO: 1051337 - protein, 27 aa, Mycobacterium
NQSTALADVSIRWQLKQSAAPELFQQY

SEQ ID NO: 1051338 - protein, 25 aa, Mycobacterium
NQVWSRCHSYAFDYSVWEIFGALLG

SEQ ID NO: 1051339 - protein, 17 aa, Mycobacterium
NQWPADVVEYFGEASTG

SEQ ID NO: 1051340 - protein, 25 aa, Mycobacterium
NQYKDVILGLVFLKFVSDARDGRKP

SEQ ID NO: 1051341 - protein, 20 aa, Mycobacterium
NRAAPPLALRAVRTIGREGY

SEQ ID NO: 1051342 - protein, 19 aa, Mycobacterium
NRAAYKFIDYDVNPDGFTE

SEQ ID NO: 1051343 - protein, 24 aa, Mycobacterium
NRALPGEELWRFVDKLAGRIASYP

SEQ ID NO: 1051344 - protein, 19 aa, Mycobacterium
NRALRCGRRQRALEQMAAH

SEQ ID NO: 1051345 - protein, 17 aa, Mycobacterium
NRDVRWFDIEPCYVYHP

SEQ ID NO: 1051346 - protein, 17 aa, Mycobacterium
NREKLPYILRLFDIQGL

SEQ ID NO: 1051347 - protein, 21 aa, Mycobacterium
NRELMRLALRVIKADYHAFDT

SEQ ID NO: 1051348 - protein, 22 aa, Mycobacterium
NRGQFSAVISLDLRRFNELHSL

SEQ ID NO: 1051349 - protein, 22 aa, Mycobacterium
NRGRLYAAVQAFFDFIEHDSQG

SEQ ID NO: 1051350 - protein, 25 aa, Mycobacterium
NRGWCAWMPAIARLFPDAKVIACVR

SEQ ID NO: 1051351 - protein, 17 aa, Mycobacterium
NRIAATDTPWTWRSNSV

SEQ ID NO: 1051352 - protein, 19 aa, Mycobacterium
NRIYRVMVDLGLPLWDDTL

SEQ ID NO: 1051353 - protein, 19 aa, Mycobacterium
NRLGPTINFRGIDNSAYYR

SEQ ID NO: 1051354 - protein, 18 aa, Mycobacterium
NRLHAQKALLVWLLERGR

SEQ ID NO: 1051355 - protein, 18 aa, Mycobacterium
NRLKLGGVKITLDGSPQG

SEQ ID NO: 1051356 - protein, 17 aa, Mycobacterium
NRLPILGVVKHYCSIAA

SEQ ID NO: 1051357 - protein, 20 aa, Mycobacterium
NRMISWPYTKLMNSNNMVDQ

SEQ ID NO: 1051358 - protein, 19 aa, Mycobacterium
NRMMRKWLSANNFLGQASP

SEQ ID NO: 1051359 - protein, 18 aa, Mycobacterium
NRMPAMFTCGRTVGWCAH

SEQ ID NO: 1051360 - protein, 29 aa, Mycobacterium
NRMTWPHGRLRYYIAMLVELSQLRPLPFR

SEQ ID NO: 1051361 - protein, 21 aa, Mycobacterium
NRNQGAFGFSEPCTDCRGSGS

SEQ ID NO: 1051362 - protein, 19 aa, Mycobacterium
NRPDCIYLGAAGHVLGTGA

SEQ ID NO: 1051363 - protein, 23 aa, Mycobacterium
NRPGYLRFDFNWQGPLTEEQRGQ

SEQ ID NO: 1051364 - protein, 23 aa, Mycobacterium
NRPHQRAALAYGALDRILAQRPR

SEQ ID NO: 1051365 - protein, 19 aa, Mycobacterium
NRPIVDFSLTHSYVAAPVM

SEQ ID NO: 1051366 - protein, 29 aa, Mycobacterium
NRPTPDRVRELVVAWGKLYPQFGTVAALN

SEQ ID NO: 1051367 - protein, 24 aa, Mycobacterium
NRRRARADLSVPIRGVRPIRKPAP

SEQ ID NO: 1051368 - protein, 22 aa, Mycobacterium
NRRRLIEFCLLATQYDALAATI

SEQ ID NO: 1051369 - protein, 25 aa, Mycobacterium
NRRRRRGRRGRGRGRGEQGANDGQD

SEQ ID NO: 1051370 - protein, 18 aa, Mycobacterium
NRSACVRIPITGSNPKAK

SEQ ID NO: 1051371 - protein, 17 aa, Mycobacterium
NRSLDCVDDELAGAAHF

SEQ ID NO: 1051372 - protein, 19 aa, Mycobacterium
NRSQFVSVVVSNLLGQNAP

SEQ ID NO: 1051373 - protein, 25 aa, Mycobacterium
NRSVISALWWVHWRVTKNPEEAQRR

SEQ ID NO: 1051374 - protein, 18 aa, Mycobacterium
NRSWNCGVEGPTDDPAIN

SEQ ID NO: 1051375 - protein, 20 aa, Mycobacterium
NRTAFCEGYAAASGNDPRDS

SEQ ID NO: 1051376 - protein, 20 aa, Mycobacterium
NRVGLDHIAFRVGSIDELNS

SEQ ID NO: 1051377 - protein, 25 aa, Mycobacterium
NRVLPLLGGLAVMYGELPPLPTITR

SEQ ID NO: 1051378 - protein, 22 aa, Mycobacterium
NRVREVAAFIPGAMRGITSEKQ

SEQ ID NO: 1051379 - protein, 17 aa, Mycobacterium
NRVRRKHGLPSLSLNLC

SEQ ID NO: 1051380 - protein, 20 aa, Mycobacterium
NRVSSGFALHGPSMTVDCGQ

SEQ ID NO: 1051381 - protein, 19 aa, Mycobacterium
NRYQPSVLWNDIGYPPKSN

SEQ ID NO: 1051382 - protein, 20 aa, Mycobacterium
NRYTPMPAISHAILTYNRGR

SEQ ID NO: 1051383 - protein, 21 aa, Mycobacterium
NRYTPMPAISHAILTYNRGRT

SEQ ID NO: 1051384 - protein, 18 aa, Mycobacterium
NSAAMCRYEAASVQAVAL

SEQ ID NO: 1051385 - protein, 26 aa, Mycobacterium
NSEFVWACTAVGYTFVGPDADVLDLV

SEQ ID NO: 1051386 - protein, 25 aa, Mycobacterium
NSEWIKRYAPRYVTGLQLGTSGDDG

SEQ ID NO: 1051387 - protein, 23 aa, Mycobacterium
NSEYAGYFDIDWDLDEHGRIVLP

SEQ ID NO: 1051388 - protein, 17 aa, Mycobacterium
NSFGYLYVTPGFQAPEI

SEQ ID NO: 1051389 - protein, 29 aa, Mycobacterium
NSFSKYYAMTGWRLGWLLVPTELRRAVDC

SEQ ID NO: 1051390 - protein, 18 aa, Mycobacterium
NSGTGNWGIGNSGNSYNT

SEQ ID NO: 1051391 - protein, 19 aa, Mycobacterium
NSGTGNWGIGNSGNYNTGV

SEQ ID NO: 1051392 - protein, 17 aa, Mycobacterium
NSGVPLILLLSLLSFVP

SEQ ID NO: 1051393 - protein, 20 aa, Mycobacterium
NSHLAFGFGTHFCMGNQLAR

SEQ ID NO: 1051394 - protein, 24 aa, Mycobacterium
NSIGGFRNAMTFVLTGLNIEAKAE

SEQ ID NO: 1051395 - protein, 24 aa, Mycobacterium
NSIRMMSMAGRWRKRGADITFAQL

SEQ ID NO: 1051396 - protein, 29 aa, Mycobacterium
NSLAEIGIGFCFAPLFQPSYRYASAVRHE

SEQ ID NO: 1051397 - protein, 34 aa, Mycobacterium
NSLAEIGIGFCFAPLFQPSYRYASAVRHEIGVPT

SEQ ID NO: 1051398 - protein, 19 aa, Mycobacterium
NSLARAIRFGHKVIESAWS

SEQ ID NO: 1051399 - protein, 17 aa, Mycobacterium
NSLARWYAVPLQGPYSA

SEQ ID NO: 1051400 - protein, 25 aa, Mycobacterium
NSLQRLDPQLPRQAVHLDIADTNMV

SEQ ID NO: 1051401 - protein, 23 aa, Mycobacterium
NSLRAVTLGGDWVGADLARRLAR

SEQ ID NO: 1051402 - protein, 30 aa, Mycobacterium; identical to SEQ ID NO: 622925

SEQ ID NO: 1051403 - protein, 18 aa, Mycobacterium
NSMEAVGGPSTWRLGGAI

SEQ ID NO: 1051404 - protein, 25 aa, Mycobacterium
NSMQVCKKSDCPFSTSASENLQIPQ

SEQ ID NO: 1051405 - protein, 18 aa, Mycobacterium
NSPHVVAVGFTFDPHTHI

SEQ ID NO: 1051406 - protein, 18 aa, Mycobacterium
NSRRWAGVPFYLRTGKRL

SEQ ID NO: 1051407 - protein, 20 aa, Mycobacterium
NSRVSTNWMPQITRPTQADF

SEQ ID NO: 1051408 - protein, 22 aa, Mycobacterium
NSSVMKLVIERLYSCSGLLNEN

SEQ ID NO: 1051409 - protein, 24 aa, Mycobacterium
NSTGMCAALGLLAAIISGRGGQVD

SEQ ID NO: 1051410 - protein, 17 aa, Mycobacterium
NSTRMYLGPGSSPILTA

SEQ ID NO: 1051411 - protein, 24 aa, Mycobacterium
NSVKYRVQRAIKRRGRPLTADRLD

SEQ ID NO: 1051412 - protein, 32 aa, Mycobacterium; identical to SEQ ID NO: 619644

SEQ ID NO: 1051413 - protein, 18 aa, Mycobacterium
NTAAWARALGRIVAAVPG

SEQ ID NO: 1051414 - protein, 18 aa, Mycobacterium
NTALRWVQNALSFIGFVP

SEQ ID NO: 1051415 - protein, 28 aa, Mycobacterium
NTATDGFRSGDMSGFFNTAAGGSSYTGV

SEQ ID NO: 1051416 - protein, 24 aa, Mycobacterium
NTHVPEFLERIGIGAPEVEQDIIN

SEQ ID NO: 1051417 - protein, 24 aa, Mycobacterium
NTIELRVTSPLSRSSGNVHNSPLV

SEQ ID NO: 1051418 - protein, 18 aa, Mycobacterium
NTKLRLLAERVVGDPDGR

SEQ ID NO: 1051419 - protein, 18 aa, Mycobacterium
NTLAHLRSQAALRHEWEA

SEQ ID NO: 1051420 - protein, 17 aa, Mycobacterium
NTLWPRTLVATAAVQNL

SEQ ID NO: 1051421 - protein, 18 aa, Mycobacterium
NTPAPLPCTPRGIVHLLR

SEQ ID NO: 1051422 - protein, 28 aa, Mycobacterium
NTQVCPVCLGLPGSLPVLNRVAVESTIR

SEQ ID NO: 1051423 - protein, 21 aa, Mycobacterium
NTREAIKICRTARTILGGNGI

SEQ ID NO: 1051424 - protein, 17 aa, Mycobacterium
NTRGSGLASAYAAVCSG

SEQ ID NO: 1051425 - protein, 24 aa, Mycobacterium
NTRRPPRTSTWVLGPLRRDVSRAS

SEQ ID NO: 1051426 - protein, 24 aa, Mycobacterium
NTSNGTAGPGAWGNNVTTSIGDAN

SEQ ID NO: 1051427 - protein, 17 aa, Mycobacterium
NTSQWLIAVRMVSEGVD

SEQ ID NO: 1051428 - protein, 19 aa, Mycobacterium
NTSQWLIAVRMVSEGVDIP

SEQ ID NO: 1051429 - protein, 18 aa, Mycobacterium
NTTIPTKRSETFTTADDN

SEQ ID NO: 1051430 - protein, 24 aa, Mycobacterium
NTTQLRPLIGVALQEVALDLWMSP

SEQ ID NO: 1051431 - protein, 18 aa, Mycobacterium
NTVLEFSNTVTRVHEDPR

SEQ ID NO: 1051432 - protein, 17 aa, Mycobacterium
NTVPLRIKMTAPDYAGL

SEQ ID NO: 1051433 - protein, 18 aa, Mycobacterium
NTVPLRIRLNAASYAALL

SEQ ID NO: 1051434 - protein, 20 aa, Mycobacterium
NTYSRLALGIGVHDITAGYR

SEQ ID NO: 1051435 - protein, 18 aa, Mycobacterium
NTYYDWFLDHDFIAFYGT

SEQ ID NO: 1051436 - protein, 25 aa, Mycobacterium
NVARFPTFDWPRIDAPYIRPDADMD

SEQ ID NO: 1051437 - protein, 17 aa, Mycobacterium
NVEEVRFDQGYAQRLPY

SEQ ID NO: 1051438 - protein, 45 aa, Mycobacterium; identical to SEQ ID NO: 704694

SEQ ID NO: 1051439 - protein, 17 aa, Mycobacterium
NVFRIDPVHTFIETCRR

SEQ ID NO: 1051440 - protein, 19 aa, Mycobacterium
NVIGCGALHVLWSDLGEVR

SEQ ID NO: 1051441 - protein, 19 aa, Mycobacterium
NVINGAVNTAAWYTTATIP

SEQ ID NO: 1051442 - protein, 18 aa, Mycobacterium
NVKPGRVLFELSYPNEAI

SEQ ID NO: 1051443 - protein, 24 aa, Mycobacterium
NVLARAIVRLSLSYVSMPPEADHN

SEQ ID NO: 1051444 - protein, 20 aa, Mycobacterium
NVLCTPGVWMRHRKLANTAP

SEQ ID NO: 1051445 - protein, 17 aa, Mycobacterium
NVMGWKIGTSGFQIVLS

SEQ ID NO: 1051446 - protein, 24 aa, Mycobacterium
NVMPQWAGSSWYELRYTDPHNADR

SEQ ID NO: 1051447 - protein, 19 aa, Mycobacterium
NVPAGFMAPSLNGIGGDGG

SEQ ID NO: 1051448 - protein, 24 aa, Mycobacterium
NVQAGLRTDYLFRIANHRGGIVLG

SEQ ID NO: 1051449 - protein, 28 aa, Mycobacterium
NVQFHWLRIEDVPEIWRRLESVGLSSIE

SEQ ID NO: 1051450 - protein, 20 aa, Mycobacterium
NVRAVIAFKVGNDTESIIAA

SEQ ID NO: 1051451 - protein, 24 aa, Mycobacterium
NVRCGLLRTSLTWTTPDGRATDLE

SEQ ID NO: 1051452 - protein, 20 aa, Mycobacterium
NVRPSLRADPDLTRERIQRL

SEQ ID NO: 1051453 - protein, 22 aa, Mycobacterium
NVRTSLRISPTVYVRLICPPEL

SEQ ID NO: 1051454 - protein, 17 aa, Mycobacterium
NVTKLKLAEHMVEGAAI

SEQ ID NO: 1051455 - protein, 28 aa, Mycobacterium
NVTRMLELVYHFGRPMRARRRGGILLVG

SEQ ID NO: 1051456 - protein, 21 aa, Mycobacterium
NVVDALAWVMGEQGAKTLRGG

SEQ ID NO: 1051457 - protein, 17 aa, Mycobacterium
NVVLGFPTLAGYLNNTG

SEQ ID NO: 1051458 - protein, 20 aa, Mycobacterium
NVVTAWRLLGSIDPRLRPHR

SEQ ID NO: 1051459 - protein, 22 aa, Mycobacterium
NVYRSELLFRHRIDPYRSGQRI

SEQ ID NO: 1051460 - protein, 19 aa, Mycobacterium
NWAKPIVMQSSWARQGDPA

SEQ ID NO: 1051461 - protein, 22 aa, Mycobacterium
NWIKEFDPRFNVRYRDDKSYPV

SEQ ID NO: 1051462 - protein, 17 aa, Mycobacterium
NWLAKRLGLKRIRIEIL

SEQ ID NO: 1051463 - protein, 18 aa, Mycobacterium
NWMRAREALIKTDVFGTE

SEQ ID NO: 1051464 - protein, 19 aa, Mycobacterium
NWRVPLAGPDGRQVLLEDI

SEQ ID NO: 1051465 - protein, 22 aa, Mycobacterium
NWWEWHELIGPLAADGYRVLCP

SEQ ID NO: 1051466 - protein, 18 aa, Mycobacterium
NYAGLIFWDTELWMYPNL

SEQ ID NO: 1051467 - protein, 17 aa, Mycobacterium
NYAKRLRRIEGQVRGIA

SEQ ID NO: 1051468 - protein, 24 aa, Mycobacterium
NYDDFFKRCFDIMPEDGRMTVQSS

SEQ ID NO: 1051469 - protein, 28 aa, Mycobacterium
NYDMSMARFLYWGCDIWLNNPLRPLEAC

SEQ ID NO: 1051470 - protein, 23 aa, Mycobacterium
NYGDGGLHVGWLSSGDHVVGLAS

SEQ ID NO: 1051471 - protein, 25 aa, Mycobacterium
NYGGLSVYSGEWWHFDGPGAGVDRP

SEQ ID NO: 1051472 - protein, 17 aa, Mycobacterium
NYHLAWAMAAMSMRRRT

SEQ ID NO: 1051473 - protein, 18 aa, Mycobacterium
NYLGAVQLILKFIPGMRE

SEQ ID NO: 1051474 - protein, 20 aa, Mycobacterium
NYLRRAVVALIGLGANPAED

SEQ ID NO: 1051475 - protein, 26 aa, Mycobacterium
NYQRYAKEAMPFLEAVGATIEYAGEA

SEQ ID NO: 1051476 - protein, 25 aa, Mycobacterium
NYRARRFYQKNGFQLDGRSFAWTLV

SEQ ID NO: 1051477 - protein, 21 aa, Mycobacterium
NYRLMPKHSIGMALDDCHDGY

SEQ ID NO: 1051478 - protein, 17 aa, Mycobacterium
NYSMVFDSYAEVPANVS

SEQ ID NO: 1051479 - protein, 21 aa, Mycobacterium
PAAAARYAANPAQAIADAHLT

SEQ ID NO: 1051480 - protein, 17 aa, Mycobacterium
PAAALRARTAFRKLAPS

SEQ ID NO: 1051481 - protein, 19 aa, Mycobacterium
PAAARIPGGSGLPGGLDAG

SEQ ID NO: 1051482 - protein, 25 aa, Mycobacterium
PAAERLAACGAREVIFTNTLPITEA

SEQ ID NO: 1051483 - protein, 17 aa, Mycobacterium
PAALLRCLVEGADEVHV

SEQ ID NO: 1051484 - protein, 18 aa, Mycobacterium
PAALVSERDVVRVVATGK

SEQ ID NO: 1051485 - protein, 17 aa, Mycobacterium
PAAPFCPNNQPPRPPAP

SEQ ID NO: 1051486 - protein, 27 aa, Mycobacterium
PAAPLPDARPFGVMLIAAAFGDQVAID

SEQ ID NO: 1051487 - protein, 18 aa, Mycobacterium
PAARRIDGAYGDRNLVCS

SEQ ID NO: 1051488 - protein, 24 aa, Mycobacterium
PAARRRLAAILAHHGLAVVTMNAF

SEQ ID NO: 1051489 - protein, 26 aa, Mycobacterium
PAATREMIKTGGFDAVCFTSSSTVRN

SEQ ID NO: 1051490 - protein, 24 aa, Mycobacterium
PAATSRARWPPPRGLPTGNPSRRW

SEQ ID NO: 1051491 - protein, 26 aa, Mycobacterium
PAAVECFKSGSPMNVMGFAVKTADDY

SEQ ID NO: 1051492 - protein, 18 aa, Mycobacterium
PACPIWALTAAPSAWIAS

SEQ ID NO: 1051493 - protein, 18 aa, Mycobacterium
PACTFALTEARIGVAPAI

SEQ ID NO: 1051494 - protein, 20 aa, Mycobacterium
PACWMDELLYARAATIYAGS

SEQ ID NO: 1051495 - protein, 18 aa, Mycobacterium
PADAAAIGESVWKVQMLS

SEQ ID NO: 1051496 - protein, 20 aa, Mycobacterium
PADARLRIKRRRTERERLQA

SEQ ID NO: 1051497 - protein, 24 aa, Mycobacterium
PADESIGPGDRWIIEQIAATAPKV

SEQ ID NO: 1051498 - protein, 30 aa, Mycobacterium
PADGFKVIATRSRLMARLAGQGAMALLELD

SEQ ID NO: 1051499 - protein, 30 aa, Mycobacterium; identical to SEQ ID NO: 705062

SEQ ID NO: 1051500 - protein, 27 aa, Mycobacterium
PADLNFLWLPLAHAFGKVMLSLPLLIG

SEQ ID NO: 1051501 - protein, 25 aa, Mycobacterium
PADRHPHCAWTVIIDEAYPEVKGIP

SEQ ID NO: 1051502 - protein, 25 aa, Mycobacterium
PADTRWHPVNALPPMAFDHGPMVTH

SEQ ID NO: 1051503 - protein, 18 aa, Mycobacterium
PADVCALADALGLDKFGV

SEQ ID NO: 1051504 - protein, 28 aa, Mycobacterium
PAEACYRAELAALPGVRVLHGYTQSGGG

SEQ ID NO: 1051505 - protein, 23 aa, Mycobacterium
PAEGARSITIFAAASLKTAFTQI

SEQ ID NO: 1051506 - protein, 19 aa, Mycobacterium
PAEIDVASAGFCAAEAGHR

SEQ ID NO: 1051507 - protein, 19 aa, Mycobacterium
PAELEWTLARTDHVDADTE

SEQ ID NO: 1051508 - protein, 19 aa, Mycobacterium
PAEPLEFIELPTPEPQAGE

SEQ ID NO: 1051509 - protein, 25 aa, Mycobacterium
PAFALGDYEWILAFEAPELDRIVDL

SEQ ID NO: 1051510 - protein, 17 aa, Mycobacterium
PAFEWYYQSGLSVIMPV

SEQ ID NO: 1051511 - protein, 17 aa, Mycobacterium
PAFGVRVLDAFEEAPQS

SEQ ID NO: 1051512 - protein, 17 aa, Mycobacterium
PAFRGIVGLAVTGSGAA

SEQ ID NO: 1051513 - protein, 26 aa, Mycobacterium
PAGAFFGLWQPLGHRGFEIIGEAGAA

SEQ ID NO: 1051514 - protein, 24 aa, Mycobacterium
PAGEALKAVGAFRLALPRTMLRFA

SEQ ID NO: 1051515 - protein, 20 aa, Mycobacterium
PAGELPRWWDSLPTDRPIVY

SEQ ID NO: 1051516 - protein, 25 aa, Mycobacterium
PAGHYTLRAAIDWQQHKPNGSHLVD

SEQ ID NO: 1051517 - protein, 18 aa, Mycobacterium
PAGLAARLVERFRNDFEL

SEQ ID NO: 1051518 - protein, 17 aa, Mycobacterium
PAGLIYALGAPIAADTA

SEQ ID NO: 1051519 - protein, 20 aa, Mycobacterium
PAGLRRAAVSSFGLSGTNAH

SEQ ID NO: 1051520 - protein, 31 aa, Mycobacterium; identical to SEQ ID NO: 705231

SEQ ID NO: 1051521 - protein, 17 aa, Mycobacterium
PAGREWRAAGPSSSSMS

SEQ ID NO: 1051522 - protein, 17 aa, Mycobacterium
PAGRWGMGSLQEIDHVP

SEQ ID NO: 1051523 - protein, 23 aa, Mycobacterium
PAGSDLRRALALVKTLDELDSLL

SEQ ID NO: 1051524 - protein, 23 aa, Mycobacterium
PAGSELRNALALVKTLDELDCLL

SEQ ID NO: 1051525 - protein, 24 aa, Mycobacterium
PAGSELRNALALVKTLDELDCLLN

SEQ ID NO: 1051526 - protein, 17 aa, Mycobacterium
PAGSPVPGVGGKGGNPG

SEQ ID NO: 1051527 - protein, 18 aa, Mycobacterium
PAGVFSWSPPAALVTALS

SEQ ID NO: 1051528 - protein, 18 aa, Mycobacterium
PAGVLVVGQRGECGGIGH

SEQ ID NO: 1051529 - protein, 20 aa, Mycobacterium
PAGWRVAFGADTRADCLSYV

SEQ ID NO: 1051530 - protein, 18 aa, Mycobacterium
PAGWSHFDADRWELSTSP

SEQ ID NO: 1051531 - protein, 17 aa, Mycobacterium
PAGYGAVVWTADRSTVL

SEQ ID NO: 1051532 - protein, 22 aa, Mycobacterium
PAIRARWERRLAQVGPARLHAD

SEQ ID NO: 1051533 - protein, 19 aa, Mycobacterium
PAITALHFVGAGMRILEIV

SEQ ID NO: 1051534 - protein, 23 aa, Mycobacterium
PAIYRAVARHDPAGAVLVMASNG

SEQ ID NO: 1051535 - protein, 19 aa, Mycobacterium
PAKLPAIRQQIWTLIRAAK

SEQ ID NO: 1051536 - protein, 19 aa, Mycobacterium
PAKPIAVNVIDFGTDPDQA

SEQ ID NO: 1051537 - protein, 19 aa, Mycobacterium
PAKQGYLIATLRDFMADDD

SEQ ID NO: 1051538 - protein, 27 aa, Mycobacterium
PAKRRRFPVEIVRRTRAAVGPDFIICY

SEQ ID NO: 1051539 - protein, 26 aa, Mycobacterium
PAKYLNRLSDLLFILSRVANTGNDVL

SEQ ID NO: 1051540 - protein, 19 aa, Mycobacterium
PALAKLWTQACDWEPVIPK

SEQ ID NO: 1051541 - protein, 20 aa, Mycobacterium
PALASRGFSHDDFGAVADIV

SEQ ID NO: 1051542 - protein, 17 aa, Mycobacterium
PALDVDGGKGWPAQWYH

SEQ ID NO: 1051543 - protein, 18 aa, Mycobacterium
PALIPFSGPARKVLELTF

SEQ ID NO: 1051544 - protein, 21 aa, Mycobacterium
PALLSRLAYQLADRLVFSTIR

SEQ ID NO: 1051545 - protein, 19 aa, Mycobacterium
PALLTRAARVISMTTGSGW

SEQ ID NO: 1051546 - protein, 18 aa, Mycobacterium
PALNAFAITFADRMPGSE

SEQ ID NO: 1051547 - protein, 19 aa, Mycobacterium
PALRARIAAFQDQLAQTVQ

SEQ ID NO: 1051548 - protein, 19 aa, Mycobacterium
PALRSSCVVAAVRSATVGM

SEQ ID NO: 1051549 - protein, 19 aa, Mycobacterium
PALSTNLSFPETVRAQWFT

SEQ ID NO: 1051550 - protein, 18 aa, Mycobacterium
PALTDLAYFLGCALQPNE

SEQ ID NO: 1051551 - protein, 17 aa, Mycobacterium
PALTVGRDEIDLAIAAV

SEQ ID NO: 1051552 - protein, 19 aa, Mycobacterium
PALVGVPRGKLILVNDDDL

SEQ ID NO: 1051553 - protein, 21 aa, Mycobacterium
PALWTSCGHDPVAVLGAVKPA

SEQ ID NO: 1051554 - protein, 22 aa, Mycobacterium
PALYAEHWEPLWAACAQAGLVI

SEQ ID NO: 1051555 - protein, 17 aa, Mycobacterium
PAMARRLQERYGEQARI

SEQ ID NO: 1051556 - protein, 21 aa, Mycobacterium
PAMHTEMWLHPATVDNVATLR

SEQ ID NO: 1051557 - protein, 26 aa, Mycobacterium
PAMSKFEVLTAMAFAAFADAPVDVAV

SEQ ID NO: 1051558 - protein, 22 aa, Mycobacterium
PANGWTMVSWDGIPVAPATLPT

SEQ ID NO: 1051559 - protein, 25 aa, Mycobacterium
PAPARRIGGHPAKRTFQALRIAVND

SEQ ID NO: 1051560 - protein, 28 aa, Mycobacterium
PAPDPGKWAGFELHRSITITEEFTLGVE

SEQ ID NO: 1051561 - protein, 17 aa, Mycobacterium
PAPGRTALATAVRLTAR

SEQ ID NO: 1051562 - protein, 17 aa, Mycobacterium
PAPGVAAGLRWTAVAGA

SEQ ID NO: 1051563 - protein, 18 aa, Mycobacterium
PAPIETFPVLSQSVVHRE

SEQ ID NO: 1051564 - protein, 21 aa, Mycobacterium
PAPLHRTGWIDDWLPAELNRR

SEQ ID NO: 1051565 - protein, 24 aa, Mycobacterium
PAPLPADRSLAVLIVIENGHDPVQ

SEQ ID NO: 1051566 - protein, 19 aa, Mycobacterium
PAPLPEVFNHWYGPIPPIK

SEQ ID NO: 1051567 - protein, 18 aa, Mycobacterium
PAPLRLLLVGGNTVVEDG

SEQ ID NO: 1051568 - protein, 19 aa, Mycobacterium
PAPLRTGDVLPIGDRSQDY

SEQ ID NO: 1051569 - protein, 17 aa, Mycobacterium
PAPPEFVTDVGRKQDAA

SEQ ID NO: 1051570 - protein, 22 aa, Mycobacterium
PAPPPWLPVVLPAPPSPPAPPC

SEQ ID NO: 1051571 - protein, 23 aa, Mycobacterium
PAPQARLGLIAAIRDAGLDCHVM

SEQ ID NO: 1051572 - protein, 17 aa, Mycobacterium
PAPRLGEHGYHYRTAEL

SEQ ID NO: 1051573 - protein, 19 aa, Mycobacterium
PAPTEPRRGVAIVNSPLVH

SEQ ID NO: 1051574 - protein, 23 aa, Mycobacterium
PAPVVRFLARWVGRAGTKILEPS

SEQ ID NO: 1051575 - protein, 22 aa, Mycobacterium
PAQALFGRPLIGDGAGGAPGQS

SEQ ID NO: 1051576 - protein, 25 aa, Mycobacterium
PARAELKAAEFGREVIRQFEPDIQI

SEQ ID NO: 1051577 - protein, 32 aa, Mycobacterium; identical to SEQ ID NO: 705526

SEQ ID NO: 1051578 - protein, 20 aa, Mycobacterium
PARFREVLDQAAAAGGVHII

SEQ ID NO: 1051579 - protein, 24 aa, Mycobacterium
PARKRRMFDLLVRMGYKEIEVGFP

SEQ ID NO: 1051580 - protein, 25 aa, Mycobacterium
PARLKVGIISAGRVGTALGVALERA

SEQ ID NO: 1051581 - protein, 26 aa, Mycobacterium
PARMPEAMACRTRFYDQFFVDATRSG

SEQ ID NO: 1051582 - protein, 24 aa, Mycobacterium
PARPMSSCRNSLVWAVATGCCNSS

SEQ ID NO: 1051583 - protein, 19 aa, Mycobacterium
PARVFFCNSGTEANEAAFK

SEQ ID NO: 1051584 - protein, 20 aa, Mycobacterium
PASALRPMFVYRHQQLADDL

SEQ ID NO: 1051585 - protein, 25 aa, Mycobacterium
PASFYRLGPDGKRQPAHFDGLPVEF

SEQ ID NO: 1051586 - protein, 20 aa, Mycobacterium
PASGRGYAAMLTWMRSKGNL

SEQ ID NO: 1051587 - protein, 29 aa, Mycobacterium
PASGRPLAMPRLDMVTGLYYLTTEVEGDK

SEQ ID NO: 1051588 - protein, 23 aa, Mycobacterium
PASKLVRLGLCLSSISRGELDAG

SEQ ID NO: 1051589 - protein, 24 aa, Mycobacterium
PASLREARRGMALAAELRLPLVLV

SEQ ID NO: 1051590 - protein, 17 aa, Mycobacterium
PASLVLFSPLIDLTFGL

SEQ ID NO: 1051591 - protein, 23 aa, Mycobacterium
PASMPARVAVSVFSIEFLVHAWD

SEQ ID NO: 1051592 - protein, 18 aa, Mycobacterium
PASQVVRFIVPRYVQDDP

SEQ ID NO: 1051593 - protein, 17 aa, Mycobacterium
PASRAWRTNSRATSNSS

SEQ ID NO: 1051594 - protein, 23 aa, Mycobacterium
PATAGWKGYGDFQHTAEEAARMN

SEQ ID NO: 1051595 - protein, 17 aa, Mycobacterium
PATDFLDALVSLDLLAR

SEQ ID NO: 1051596 - protein, 22 aa, Mycobacterium
PATEFAGFLWVSLHPAARLDVP

SEQ ID NO: 1051597 - protein, 18 aa, Mycobacterium
PATEFTLQAWSGAIIGLG

SEQ ID NO: 1051598 - protein, 30 aa, Mycobacterium
PATGAALIWPAGWSVWPERVYGDTRLELAD

SEQ ID NO: 1051599 - protein, 25 aa, Mycobacterium
PATGDELRATLLALLGSPHLCSRAF

SEQ ID NO: 1051600 - protein, 34 aa, Mycobacterium
PATGGFGGRGGRLFGSPGAQGRRALMCLSAACRC

SEQ ID NO: 1051601 - protein, 31 aa, Mycobacterium
PATHIGGLWWILTCLMRGGLCITGGENTLSL

SEQ ID NO: 1051602 - protein, 20 aa, Mycobacterium
PATIGSYRSALNWLGDNASC

SEQ ID NO: 1051603 - protein, 29 aa, Mycobacterium
PATLARFAQRFARFHLHPRALRPSYGLAE

SEQ ID NO: 1051604 - protein, 30 aa, Mycobacterium; identical to SEQ ID NO: 705659

SEQ ID NO: 1051605 - protein, 24 aa, Mycobacterium
PATPFALALRMLVIALKNNEILNS

SEQ ID NO: 1051606 - protein, 20 aa, Mycobacterium
PATRIPLHGRIEVDEPYVLI

SEQ ID NO: 1051607 - protein, 20 aa, Mycobacterium
PATRSYRYVDYWGTAVTAFD

SEQ ID NO: 1051608 - protein, 18 aa, Mycobacterium
PAVFAGEIVDRFVVGASG

SEQ ID NO: 1051609 - protein, 23 aa, Mycobacterium
PAVPAGRAWVSMAVPVAAAGRAG

SEQ ID NO: 1051610 - protein, 17 aa, Mycobacterium
PAVSIKHLRVIRGKHSA

SEQ ID NO: 1051611 - protein, 17 aa, Mycobacterium
PAVSPLRVRARQAATAA

SEQ ID NO: 1051612 - protein, 25 aa, Mycobacterium
PAWDVSCGLYAALVVVAALRRRDQT

SEQ ID NO: 1051613 - protein, 24 aa, Mycobacterium
PAYAELKPDHWLVEVCREEMLRLG

SEQ ID NO: 1051614 - protein, 23 aa, Mycobacterium
PAYGRLRPVTDLASVLVADNPGL

SEQ ID NO: 1051615 - protein, 23 aa, Mycobacterium
PAYGWFGLFSAVRVRAGSDAVRA

SEQ ID NO: 1051616 - protein, 19 aa, Mycobacterium
PAYRNIAAPVLVIGFSDDI

SEQ ID NO: 1051617 - protein, 23 aa, Mycobacterium
PAYRPVLAAHGWEGLQPELNALS

SEQ ID NO: 1051618 - protein, 18 aa, Mycobacterium
PCESACVLGINQDPVTIK

SEQ ID NO: 1051619 - protein, 19 aa, Mycobacterium
PCESACVLGINQDPVTIKQ

SEQ ID NO: 1051620 - protein, 18 aa, Mycobacterium
PCFRLRCWPFPPSARSGC

SEQ ID NO: 1051621 - protein, 18 aa, Mycobacterium
PCLLKDTMQLAAFSNNNF

SEQ ID NO: 1051622 - protein, 17 aa, Mycobacterium
PCRLGRRPAISGDSAIQ

SEQ ID NO: 1051623 - protein, 21 aa, Mycobacterium
PCSALKPGSPPPCKTPSCAIR

SEQ ID NO: 1051624 - protein, 23 aa, Mycobacterium
PCTMCAGALVLARVARLVFGAWE

SEQ ID NO: 1051625 - protein, 20 aa, Mycobacterium
PDAACGAGAVVVWDQGTYAN

SEQ ID NO: 1051626 - protein, 18 aa, Mycobacterium
PDAAGIRALAGLWRSLTR

SEQ ID NO: 1051627 - protein, 26 aa, Mycobacterium
PDADWPELVRRWRAGYFSALDASSGG

SEQ ID NO: 1051628 - protein, 26 aa, Mycobacterium
PDAFLREVVDFELPAPGSYATGIAFL

SEQ ID NO: 1051629 - protein, 24 aa, Mycobacterium
PDAGHWSVPPSRRFIPEDQTVAEE

SEQ ID NO: 1051630 - protein, 18 aa, Mycobacterium
PDALLCQMSEVFPGTQIM

SEQ ID NO: 1051631 - protein, 20 aa, Mycobacterium
PDALLTRGLYQYRPQLPFVL

SEQ ID NO: 1051632 - protein, 17 aa, Mycobacterium
PDALPLDAAAPLLCAGI

SEQ ID NO: 1051633 - protein, 22 aa, Mycobacterium
PDAPESLPLLVFPHAGAGASAY

SEQ ID NO: 1051634 - protein, 17 aa, Mycobacterium
PDAPKHRGISCLILDLQ

SEQ ID NO: 1051635 - protein, 17 aa, Mycobacterium
PDAPLLKYQIITLVALI

SEQ ID NO: 1051636 - protein, 20 aa, Mycobacterium
PDAPVKIFLTASPETRARRR

SEQ ID NO: 1051637 - protein, 19 aa, Mycobacterium
PDAQRMTARLARYRSIGLP

SEQ ID NO: 1051638 - protein, 25 aa, Mycobacterium
PDAQRRVQRVWSDIRTEVLGGQYLD

SEQ ID NO: 1051639 - protein, 20 aa, Mycobacterium
PDARVSTPLHWHEVADCDPQ

SEQ ID NO: 1051640 - protein, 19 aa, Mycobacterium
PDAVARCRSAWMTLRDRRI

SEQ ID NO: 1051641 - protein, 19 aa, Mycobacterium
PDAVRRAAGAAARALGTAK

SEQ ID NO: 1051642 - protein, 19 aa, Mycobacterium
PDCWWKDRRGAMVRLVGKL

SEQ ID NO: 1051643 - protein, 17 aa, Mycobacterium
PDDAVTWVLDPIDGTVN

SEQ ID NO: 1051644 - protein, 21 aa, Mycobacterium
PDDLLPEWVLPPEDIPFIYPD

SEQ ID NO: 1051645 - protein, 23 aa, Mycobacterium
PDEANFEYGLDCILDHAGRLIDE

SEQ ID NO: 1051646 - protein, 23 aa, Mycobacterium
PDEFARRLPLMAAKRVFSEPIAL

SEQ ID NO: 1051647 - protein, 19 aa, Mycobacterium
PDEFCARLVAAGYRVIRFD

SEQ ID NO: 1051648 - protein, 20 aa, Mycobacterium
PDEFGLCRYLAAGLAVLRTV

SEQ ID NO: 1051649 - protein, 26 aa, Mycobacterium
PDEHTCLYHYAWVRDRLLMVSLADVA

SEQ ID NO: 1051650 - protein, 23 aa, Mycobacterium
PDELRAWKAEHPGAVVVSYVNTT

SEQ ID NO: 1051651 - protein, 21 aa, Mycobacterium
PDEMYKYLAAVSRQPDHAKIR

SEQ ID NO: 1051652 - protein, 25 aa, Mycobacterium
PDESRPPFWQDMVELGWLGLHIDER

SEQ ID NO: 1051653 - protein, 22 aa, Mycobacterium
PDETSAVWAYDFAWHPAPIFQT

SEQ ID NO: 1051654 - protein, 19 aa, Mycobacterium
PDETVPCLTQQQALAEAPE

SEQ ID NO: 1051655 - protein, 25 aa, Mycobacterium
PDEVPEFLAEYGWRLVEQAGPDELV

SEQ ID NO: 1051656 - protein, 18 aa, Mycobacterium
PDFIGLFDRICRVGRSLR

SEQ ID NO: 1051657 - protein, 22 aa, Mycobacterium
PDFIICYRMSMADYVEGGQSWD

SEQ ID NO: 1051658 - protein, 18 aa, Mycobacterium
PDFQAGRITTAFIDERPQ

SEQ ID NO: 1051659 - protein, 17 aa, Mycobacterium
PDFSGLELPAFQQMFWR

SEQ ID NO: 1051660 - protein, 17 aa, Mycobacterium
PDGGLAFSADVTNRSQV

SEQ ID NO: 1051661 - protein, 17 aa, Mycobacterium
PDGIYEEIDWDTAIVEI

SEQ ID NO: 1051662 - protein, 26 aa, Mycobacterium
PDGLTVPRPAVFFDFDGTLSEIVDDP

SEQ ID NO: 1051663 - protein, 24 aa, Mycobacterium
PDGPRAVIEVGLIGGRTRANLASH

SEQ ID NO: 1051664 - protein, 21 aa, Mycobacterium
PDGRLGKGILFLHVHVFARYY

SEQ ID NO: 1051665 - protein, 21 aa, Mycobacterium
PDGVLMRRAAFGLATEIGREL

SEQ ID NO: 1051666 - protein, 18 aa, Mycobacterium
PDGVVAWTGDPAAGAGII

SEQ ID NO: 1051667 - protein, 24 aa, Mycobacterium
PDGYLQRQVRRWGSQWDLVRLPDD

SEQ ID NO: 1051668 - protein, 24 aa, Mycobacterium
PDHDVTIGLVFRARMAEPDLLPKL

SEQ ID NO: 1051669 - protein, 21 aa, Mycobacterium
PDHELRRIAALCAAFDVDGMR

SEQ ID NO: 1051670 - protein, 20 aa, Mycobacterium
PDHRLAVVFGAGGERDPGKR

SEQ ID NO: 1051671 - protein, 18 aa, Mycobacterium
PDIEAAVLVPAKTLGEAA

SEQ ID NO: 1051672 - protein, 23 aa, Mycobacterium
PDIFVEFSRWRGLSADGRCKAFA

SEQ ID NO: 1051673 - protein, 18 aa, Mycobacterium
PDIVKAYFRARAAPGGQR

SEQ ID NO: 1051674 - protein, 27 aa, Mycobacterium
PDKYAYTAVRWKNILRQSALYGACQKW

SEQ ID NO: 1051675 - protein, 20 aa, Mycobacterium
PDLALRPLGGAVIWANDESF

SEQ ID NO: 1051676 - protein, 18 aa, Mycobacterium
PDLDVAPIEAVFRKGAYC

SEQ ID NO: 1051677 - protein, 17 aa, Mycobacterium
PDLELAAGVGDVTTITR

SEQ ID NO: 1051678 - protein, 20 aa, Mycobacterium
PDLFNRFTHDAFWRDPERIP

SEQ ID NO: 1051679 - protein, 17 aa, Mycobacterium
PDLKLAKQFAEGVKAEF

SEQ ID NO: 1051680 - protein, 33 aa, Mycobacterium
PDLKPIAAPERLRSGWLNGIKHWQVDYTGKCPV

SEQ ID NO: 1051681 - protein, 25 aa, Mycobacterium
PDLLAGRALAGFGLTEPGAGSDAGS

SEQ ID NO: 1051682 - protein, 20 aa, Mycobacterium
PDLLALGALLHDIGKGRGAD

SEQ ID NO: 1051683 - protein, 21 aa, Mycobacterium
PDLLPKLLAVDALPAEIKADV

SEQ ID NO: 1051684 - protein, 21 aa, Mycobacterium
PDLPSRLAALRGPVSAVLATP

SEQ ID NO: 1051685 - protein, 17 aa, Mycobacterium
PDLRLLGALPTLYDPRT

SEQ ID NO: 1051686 - protein, 17 aa, Mycobacterium
PDLWLRAISDYRITFTG

SEQ ID NO: 1051687 - protein, 21 aa, Mycobacterium
PDMADRVAALAAHATPERLLR

SEQ ID NO: 1051688 - protein, 24 aa, Mycobacterium
PDMGELICAAIVFAGPPQTPQTLS

SEQ ID NO: 1051689 - protein, 19 aa, Mycobacterium
PDNGAAFWRELCAPTAPSL

SEQ ID NO: 1051690 - protein, 23 aa, Mycobacterium
PDNGIKIFGPGGHKLDDATENRI

SEQ ID NO: 1051691 - protein, 25 aa, Mycobacterium
PDNQWLRVWEIPGAAHADNYTIQVA

SEQ ID NO: 1051692 - protein, 23 aa, Mycobacterium
PDPADWFAAHGWTTDSVQVGAEA

SEQ ID NO: 1051693 - protein, 25 aa, Mycobacterium
PDPDHLVHLQFRRFAGCPICNLHLR

SEQ ID NO: 1051694 - protein, 18 aa, Mycobacterium
PDPDLLLLFSALELLHAW

SEQ ID NO: 1051695 - protein, 19 aa, Mycobacterium
PDPFCEIESSLLRHLTTDH

SEQ ID NO: 1051696 - protein, 25 aa, Mycobacterium
PDPGHSFPAIALCQRFAEAGDTPTL

SEQ ID NO: 1051697 - protein, 22 aa, Mycobacterium
PDPGIRRAILVAASMSVREHGV

SEQ ID NO: 1051698 - protein, 19 aa, Mycobacterium
PDPIGEVLRGYTLPNGLQL

SEQ ID NO: 1051699 - protein, 21 aa, Mycobacterium
PDPIGEVLRGYTLPNGLQLRQ

SEQ ID NO: 1051700 - protein, 18 aa, Mycobacterium
PDPLYCAGARVVSQHPVN

SEQ ID NO: 1051701 - protein, 25 aa, Mycobacterium
PDPQFRPAELNKRVGTVEMFTATTA

SEQ ID NO: 1051702 - protein, 21 aa, Mycobacterium
PDPQMSLPITLGGTMAKYDWT

SEQ ID NO: 1051703 - protein, 25 aa, Mycobacterium
PDPQWRGGALIAVQFVLNYEEGAES

SEQ ID NO: 1051704 - protein, 25 aa, Mycobacterium
PDPRASHVVETWADVLDRLERDPMD

SEQ ID NO: 1051705 - protein, 17 aa, Mycobacterium
PDPRGGYPPEAGGYPPQ

SEQ ID NO: 1051706 - protein, 18 aa, Mycobacterium
PDPWPKARHHKRRLIQPS

SEQ ID NO: 1051707 - protein, 20 aa, Mycobacterium
PDQLARLAGRLMDCLNPDGR

SEQ ID NO: 1051708 - protein, 18 aa, Mycobacterium
PDQLNAFNRTMCEEMAAA

SEQ ID NO: 1051709 - protein, 23 aa, Mycobacterium
PDQRAAPLVPIYLGDDITDEDAF

SEQ ID NO: 1051710 - protein, 19 aa, Mycobacterium
PDRCIAGACIAQLAPDLSR

SEQ ID NO: 1051711 - protein, 25 aa, Mycobacterium
PDRDAPRVIAAWLLAGGQLASDQIL

SEQ ID NO: 1051712 - protein, 17 aa, Mycobacterium
PDRDLCAQREVVDAFFA

SEQ ID NO: 1051713 - protein, 18 aa, Mycobacterium
PDRIAVMPARLARISCQS

SEQ ID NO: 1051714 - protein, 21 aa, Mycobacterium
PDRLAKMGGVFDTVGTHGQVI

SEQ ID NO: 1051715 - protein, 27 aa, Mycobacterium
PDRLRSEAAFARLCGVAPIPASSGKTH

SEQ ID NO: 1051716 - protein, 18 aa, Mycobacterium
PDRRDWRLVREVLVAETD

SEQ ID NO: 1051717 - protein, 23 aa, Mycobacterium
PDRVFRLPDNVSFEAGAGLLFND

SEQ ID NO: 1051718 - protein, 25 aa, Mycobacterium
PDRVIDCAPLWCAVDLRDGNQALID

SEQ ID NO: 1051719 - protein, 19 aa, Mycobacterium
PDRVRARWAQIISDSGGVM

SEQ ID NO: 1051720 - protein, 17 aa, Mycobacterium
PDSAAAFGEQLRQVQRE

SEQ ID NO: 1051721 - protein, 26 aa, Mycobacterium
PDSGWIRTWLDTVLELPWNITTEDSV

SEQ ID NO: 1051722 - protein, 23 aa, Mycobacterium
PDSLLRRLKQYSGRLATEAVSAM

SEQ ID NO: 1051723 - protein, 20 aa, Mycobacterium
PDSPEGLIVFLMRRHAAMEL

SEQ ID NO: 1051724 - protein, 24 aa, Mycobacterium
PDSSGNPYLAFAAMLMAGLDGIKN

SEQ ID NO: 1051725 - protein, 24 aa, Mycobacterium
PDTEIGRLVPFVEWLRDAYPEQVI

SEQ ID NO: 1051726 - protein, 20 aa, Mycobacterium
PDTKLIVMIGEIGGDAEERA

SEQ ID NO: 1051727 - protein, 28 aa, Mycobacterium
PDTKVAPAYRSSVSLSISASAATSSVRE

SEQ ID NO: 1051728 - protein, 18 aa, Mycobacterium
PDTLLGWLQSDLAANQVR

SEQ ID NO: 1051729 - protein, 20 aa, Mycobacterium
PDTNTAVAIGTRMLHEQIMS

SEQ ID NO: 1051730 - protein, 23 aa, Mycobacterium
PDTQHPIGIPVVGTRGYHILRVD

SEQ ID NO: 1051731 - protein, 20 aa, Mycobacterium
PDTWVLWNLTGGPRGGVHVT

SEQ ID NO: 1051732 - protein, 21 aa, Mycobacterium
PDVDARPALVVATPGAEPRAA

SEQ ID NO: 1051733 - protein, 17 aa, Mycobacterium
PDVFYWAHATFFVGTIH

SEQ ID NO: 1051734 - protein, 19 aa, Mycobacterium
PDVIDSAGWFAIDAAEIAR

SEQ ID NO: 1051735 - protein, 17 aa, Mycobacterium
PDVMAQVVGFHLNRGVL

SEQ ID NO: 1051736 - protein, 23 aa, Mycobacterium
PDVMMGIVEMLRLVTDRGDTVIV

SEQ ID NO: 1051737 - protein, 19 aa, Mycobacterium
PDWSHWPVRVLGHADPTTI

SEQ ID NO: 1051738 - protein, 22 aa, Mycobacterium
PDWSVPFVAWGYHPLWHGPIGR

SEQ ID NO: 1051739 - protein, 21 aa, Mycobacterium
PDYPAALYANYLPRYLRGISD

SEQ ID NO: 1051740 - protein, 23 aa, Mycobacterium
PDYWRAAQDLGFGPAGAAAAHLP

SEQ ID NO: 1051741 - protein, 18 aa, Mycobacterium
PEAAGYWPAAAVANYAMS

SEQ ID NO: 1051742 - protein, 18 aa, Mycobacterium
PEAFAVAREAAWRVLGQR

SEQ ID NO: 1051743 - protein, 19 aa, Mycobacterium
PEAIALRRCDGTSALPYGE

SEQ ID NO: 1051744 - protein, 17 aa, Mycobacterium
PEALNAFNEALYDATAQ

SEQ ID NO: 1051745 - protein, 21 aa, Mycobacterium
PEARPELGLSAFVFMAEEAAK

SEQ ID NO: 1051746 - protein, 20 aa, Mycobacterium
PEAYPADRARAIEPKAGAAT

SEQ ID NO: 1051747 - protein, 22 aa, Mycobacterium
PEDLVGMCLFLLGDQASRITGQ

SEQ ID NO: 1051748 - protein, 24 aa, Mycobacterium
PEDQARVILFLACELSAFVTGHTI

SEQ ID NO: 1051749 - protein, 21 aa, Mycobacterium
PEEFIKLGRIIGEIVPYYEPI

SEQ ID NO: 1051750 - protein, 18 aa, Mycobacterium
PEEHGGGGGSIWQQTVLR

SEQ ID NO: 1051751 - protein, 18 aa, Mycobacterium
PEELTGLYLYLASAASSY

SEQ ID NO: 1051752 - protein, 25 aa, Mycobacterium
PEENFREMLPLGGWEITYLGPTTYR

SEQ ID NO: 1051753 - protein, 17 aa, Mycobacterium
PEERRALQLPPGAPVLT

SEQ ID NO: 1051754 - protein, 20 aa, Mycobacterium
PEETLCWLYEMMVVTRELDA

SEQ ID NO: 1051755 - protein, 18 aa, Mycobacterium
PEEVSHGPSHLGIIAHTE

SEQ ID NO: 1051756 - protein, 19 aa, Mycobacterium
PEFAEDWVNLVALAVNEEN

SEQ ID NO: 1051757 - protein, 27 aa, Mycobacterium
PEFEKEAWLSMVMLEWGSCGQIATAIP

SEQ ID NO: 1051758 - protein, 20 aa, Mycobacterium
PEFVAPVVAYLCTEECADNG

SEQ ID NO: 1051759 - protein, 17 aa, Mycobacterium
PEGEFWVPQRLGGGAPS

SEQ ID NO: 1051760 - protein, 21 aa, Mycobacterium
PEGFLSTHLVAGVAPGTIVRL

SEQ ID NO: 1051761 - protein, 19 aa, Mycobacterium
PEGHFAIYLGDAFEHVVAD

SEQ ID NO: 1051762 - protein, 20 aa, Mycobacterium
PEGKIRTVYEPVVKTTIIAP

SEQ ID NO: 1051763 - protein, 17 aa, Mycobacterium
PEGKQIFGRLVAAADAV

SEQ ID NO: 1051764 - protein, 22 aa, Mycobacterium
PEGRGLFFRTLYPALWRFPPIK

SEQ ID NO: 1051765 - protein, 19 aa, Mycobacterium
PEGTIVFCGVHFMAETAKI

SEQ ID NO: 1051766 - protein, 17 aa, Mycobacterium
PEGYLLAAREITARHGA

SEQ ID NO: 1051767 - protein, 20 aa, Mycobacterium
PEHGRPVMFVHGYLMGGQLW

SEQ ID NO: 1051768 - protein, 23 aa, Mycobacterium
PEHVCTGVGRLLMTAARERLWRV

SEQ ID NO: 1051769 - protein, 19 aa, Mycobacterium
PEIVKHPLFELVGVGVSNP

SEQ ID NO: 1051770 - protein, 23 aa, Mycobacterium
PEIWARLVRALGFVTDDDLRPLR

SEQ ID NO: 1051771 - protein, 20 aa, Mycobacterium
PEKAASAWSEALASGTAKRD

SEQ ID NO: 1051772 - protein, 28 aa, Mycobacterium
PEKEFLAPRVRALWGGKPGRPLAWHSLG

SEQ ID NO: 1051773 - protein, 23 aa, Mycobacterium
PEKLEIKTALWGQIDQAAPPDTI

SEQ ID NO: 1051774 - protein, 21 aa, Mycobacterium
PEKLKRLVAQISEKPESVQHH

SEQ ID NO: 1051775 - protein, 18 aa, Mycobacterium
PELAFAEHRSCAKTQALV

SEQ ID NO: 1051776 - protein, 19 aa, Mycobacterium
PELAKLAGRLTVFQRTPPW

SEQ ID NO: 1051777 - protein, 22 aa, Mycobacterium
PELGRFGVWLGSRSITPELAGQ

SEQ ID NO: 1051778 - protein, 19 aa, Mycobacterium
PELHGNILCIGFGGGMAAG

SEQ ID NO: 1051779 - protein, 17 aa, Mycobacterium
PELLDIVSRDNRRVYDM

SEQ ID NO: 1051780 - protein, 20 aa, Mycobacterium
PELLDRLDIVVASVHSKLSM

SEQ ID NO: 1051781 - protein, 21 aa, Mycobacterium
PELLEGLRVIARVSSLCAQMS

SEQ ID NO: 1051782 - protein, 20 aa, Mycobacterium
PELLVARFGDQVTCQPFAGS

SEQ ID NO: 1051783 - protein, 21 aa, Mycobacterium
PELPVGVRLIFEAAEELMPGG

SEQ ID NO: 1051784 - protein, 25 aa, Mycobacterium
PELQAKLLADFGAWLDVTGDAYFNT

SEQ ID NO: 1051785 - protein, 21 aa, Mycobacterium
PELRGPLAGVPFLIKDLDQEY

SEQ ID NO: 1051786 - protein, 23 aa, Mycobacterium
PELTAACGTALMADDPAVQPLRT

SEQ ID NO: 1051787 - protein, 17 aa, Mycobacterium
PEMAEYVSTIFTEVIVA

SEQ ID NO: 1051788 - protein, 31 aa, Mycobacterium; identical to SEQ ID NO: 707005

SEQ ID NO: 1051789 - protein, 17 aa, Mycobacterium
PEMTSPYAWYQYFINTS

SEQ ID NO: 1051790 - protein, 25 aa, Mycobacterium
PENDMYPRLVVAVVRAVGDAAMDTY

SEQ ID NO: 1051791 - protein, 24 aa, Mycobacterium
PENKAALADWTWGRQSVDLLAQSP

SEQ ID NO: 1051792 - protein, 19 aa, Mycobacterium
PEPAIGQAMIRRAGADVTV

SEQ ID NO: 1051793 - protein, 17 aa, Mycobacterium
PEPDHLRLVTLPWSRDL

SEQ ID NO: 1051794 - protein, 27 aa, Mycobacterium
PEPDLPLRFALNLSVFVGVTAEGTQLI

SEQ ID NO: 1051795 - protein, 26 aa, Mycobacterium
PEPFAFSMTLPLAMPGHDRGTHFIDL

SEQ ID NO: 1051796 - protein, 17 aa, Mycobacterium
PEPFSSDLFARIYSSSS

SEQ ID NO: 1051797 - protein, 18 aa, Mycobacterium
PEPGEPRSHYVYYPDSAD

SEQ ID NO: 1051798 - protein, 17 aa, Mycobacterium
PEPGLDRAMLFLLATAK

SEQ ID NO: 1051799 - protein, 30 aa, Mycobacterium
PEPGQTLCSTWDLTDWRGKPIRIGFAVHSA

SEQ ID NO: 1051800 - protein, 21 aa, Mycobacterium
PEPLGRFSAITREWFTNTFAA

SEQ ID NO: 1051801 - protein, 17 aa, Mycobacterium
PEPLLPMATEAHAKTDE

SEQ ID NO: 1051802 - protein, 22 aa, Mycobacterium
PEPLPTPIVAFAVRHSGAVAGI

SEQ ID NO: 1051803 - protein, 21 aa, Mycobacterium
PEPRQRVMLPPWAAGSPGHNA

SEQ ID NO: 1051804 - protein, 22 aa, Mycobacterium
PEQCPPLSAVIYAAGTLDDALI

SEQ ID NO: 1051805 - protein, 17 aa, Mycobacterium
PERELAEQLGVNRTSLR

SEQ ID NO: 1051806 - protein, 17 aa, Mycobacterium
PERITLHGNNKSVAELT

SEQ ID NO: 1051807 - protein, 28 aa, Mycobacterium
PERPTPGPLKWNLTLGVATDTRESLANS

SEQ ID NO: 1051808 - protein, 26 aa, Mycobacterium
PERVASYRAAGYWTGRSIGSLLRQAA

SEQ ID NO: 1051809 - protein, 25 aa, Mycobacterium
PESHGRGAVNAGLAITTVTANTTIA

SEQ ID NO: 1051810 - protein, 23 aa, Mycobacterium
PESKSFGGIEMLKQATVQMSSMS

SEQ ID NO: 1051811 - protein, 27 aa, Mycobacterium
PESLLWRWAGDMRIAFEGGTAGLMQTM

SEQ ID NO: 1051812 - protein, 25 aa, Mycobacterium
PESLPDDFILYWGFLATAQVLTGRY

SEQ ID NO: 1051813 - protein, 19 aa, Mycobacterium
PESLPPVLEVVARTRSGVI

SEQ ID NO: 1051814 - protein, 20 aa, Mycobacterium
PESPRPVVQVPLGNDLIHAP

SEQ ID NO: 1051815 - protein, 22 aa, Mycobacterium
PESSRVRWVRALADLRVARLLA

SEQ ID NO: 1051816 - protein, 34 aa, Mycobacterium
PESVFPGIEHWPARAVKDHGQVLVALKKHDDKAA

SEQ ID NO: 1051817 - protein, 17 aa, Mycobacterium
PETAQGIFVNFANVLTT

SEQ ID NO: 1051818 - protein, 20 aa, Mycobacterium
PETEVGSLIARKIEVSTAKR

SEQ ID NO: 1051819 - protein, 22 aa, Mycobacterium
PETIAYGLIPRAHRGIVAVNEL

SEQ ID NO: 1051820 - protein, 21 aa, Mycobacterium
PETRTRAVLMIAIEHESPDRL

SEQ ID NO: 1051821 - protein, 27 aa, Mycobacterium
PETTRYEAWSFPDFSTGVAALRAITQT

SEQ ID NO: 1051822 - protein, 18 aa, Mycobacterium
PETVLDIAGQVGYDGLPS

SEQ ID NO: 1051823 - protein, 24 aa, Mycobacterium
PETYWWAHATFQMMVHRLAEHWDV

SEQ ID NO: 1051824 - protein, 20 aa, Mycobacterium
PEVDGLVWHAYVPAIDPGQR

SEQ ID NO: 1051825 - protein, 20 aa, Mycobacterium
PEVLAVAGRDLASIGSAISQ

SEQ ID NO: 1051826 - protein, 22 aa, Mycobacterium
PEVLDRLTPRLAPPDWSPDSPS

SEQ ID NO: 1051827 - protein, 20 aa, Mycobacterium
PEVPGATVIDGRGCLATPGL

SEQ ID NO: 1051828 - protein, 21 aa, Mycobacterium
PEVPGCPPSTLATNPRAASPS

SEQ ID NO: 1051829 - protein, 18 aa, Mycobacterium
PEVPVFALTTGPRWPDVS

SEQ ID NO: 1051830 - protein, 17 aa, Mycobacterium
PEVQAPLQAGHMRVAVA

SEQ ID NO: 1051831 - protein, 20 aa, Mycobacterium
PEVVIPMLVPDGAHTYPDGA

SEQ ID NO: 1051832 - protein, 20 aa, Mycobacterium
PEVVQATLALPVSDLVADGE

SEQ ID NO: 1051833 - protein, 19 aa, Mycobacterium
PEYGPCWHLGVLPLQDGGT

SEQ ID NO: 1051834 - protein, 20 aa, Mycobacterium
PFAASLLFGYVGAFMYEGDV

SEQ ID NO: 1051835 - protein, 18 aa, Mycobacterium
PFAGRLLGDMGADVIKVE

SEQ ID NO: 1051836 - protein, 17 aa, Mycobacterium
PFAPLLLVLLQFQAGIK

SEQ ID NO: 1051837 - protein, 19 aa, Mycobacterium
PFATPRTMLNVAIGGARRC

SEQ ID NO: 1051838 - protein, 19 aa, Mycobacterium
PFCDELRAIGPVVSSYGTH

SEQ ID NO: 1051839 - protein, 20 aa, Mycobacterium
PFDGDGMLHVVGFRDGKAFY

SEQ ID NO: 1051840 - protein, 18 aa, Mycobacterium
PFDLLLQLIFAHRLDVTE

SEQ ID NO: 1051841 - protein, 24 aa, Mycobacterium
PFEHARPTAIMTWMRQHCGIENNL

SEQ ID NO: 1051842 - protein, 24 aa, Mycobacterium
PFEVQLMGAAALHLGNVAEMKTGE

SEQ ID NO: 1051843 - protein, 26 aa, Mycobacterium
PFEYWRQRLKTMKGQWAPFQSLIELA

SEQ ID NO: 1051844 - protein, 19 aa, Mycobacterium
PFFEFLTDLLDGWVAYFAE

SEQ ID NO: 1051845 - protein, 19 aa, Mycobacterium
PFFGAGITSLFAATAKTAG

SEQ ID NO: 1051846 - protein, 20 aa, Mycobacterium
PFFGSLLEFITSAPVVAAIV

SEQ ID NO: 1051847 - protein, 21 aa, Mycobacterium
PFGGAYRLIDFVLSNLVNARY

SEQ ID NO: 1051848 - protein, 18 aa, Mycobacterium
PFGGPGRAPTMLVTDISM

SEQ ID NO: 1051849 - protein, 23 aa, Mycobacterium
PFGRPLRNVRCRIVSPSGRDCLD

SEQ ID NO: 1051850 - protein, 23 aa, Mycobacterium
PFILRGIALLGMDSVLMPIGPRR

SEQ ID NO: 1051851 - protein, 18 aa, Mycobacterium
PFLTGGSMIETVTMEAST

SEQ ID NO: 1051852 - protein, 24 aa, Mycobacterium
PFRPRERLYRSGDVGRRLPSGEID

SEQ ID NO: 1051853 - protein, 18 aa, Mycobacterium
PFSLPASEKIAVLEDYSG

SEQ ID NO: 1051854 - protein, 29 aa, Mycobacterium
PFSQETVNGWFKRVYDLGLPLNIHANGDG

SEQ ID NO: 1051855 - protein, 18 aa, Mycobacterium
PFSREKVISGVRRACQGR

SEQ ID NO: 1051856 - protein, 22 aa, Mycobacterium
PFTDGRWLLSHNGIVDRAVLQR

SEQ ID NO: 1051857 - protein, 25 aa, Mycobacterium
PFTGLADPHGLAFDSVDTCYVVDHV

SEQ ID NO: 1051858 - protein, 26 aa, Mycobacterium
PFTGLNFPAGVAVDLNGNIYVADLNN

SEQ ID NO: 1051859 - protein, 18 aa, Mycobacterium
PFTPRAKKVLELSLREAL

SEQ ID NO: 1051860 - protein, 19 aa, Mycobacterium
PFTVDRWTPDKVYSGGYKA

SEQ ID NO: 1051861 - protein, 25 aa, Mycobacterium
PFTVTRPDGLPVWIYQFKISPHPTI

SEQ ID NO: 1051862 - protein, 21 aa, Mycobacterium
PFTYLRPGTVLGTGGKLGAFV

SEQ ID NO: 1051863 - protein, 23 aa, Mycobacterium
PFVEVYLAREWARGGDLDGAIAH

SEQ ID NO: 1051864 - protein, 25 aa, Mycobacterium
PFVLPVAVLEKMRFVHTVVDQVTQA

SEQ ID NO: 1051865 - protein, 25 aa, Mycobacterium
PFWQACIKAGIPVSMHASDSGYSEF

SEQ ID NO: 1051866 - protein, 21 aa, Mycobacterium
PGACDSTLLIAERVQSYADVW

SEQ ID NO: 1051867 - protein, 24 aa, Mycobacterium
PGADAWCVAALAAVLVQENLCDEA

SEQ ID NO: 1051868 - protein, 19 aa, Mycobacterium
PGADRLASEANRRRRELLR

SEQ ID NO: 1051869 - protein, 17 aa, Mycobacterium
PGAEGFPEGTFPAIVAV

SEQ ID NO: 1051870 - protein, 31 aa, Mycobacterium
PGAEGWRTTETWPPPGVVYRKFALRADGQLG

SEQ ID NO: 1051871 - protein, 17 aa, Mycobacterium
PGANALFRAPSNLTGIC

SEQ ID NO: 1051872 - protein, 21 aa, Mycobacterium
PGAREYLVLGGGLNRAAASAI

SEQ ID NO: 1051873 - protein, 26 aa, Mycobacterium
PGARSPRPATVWIAQDGSHRLVRANV

SEQ ID NO: 1051874 - protein, 24 aa, Mycobacterium
PGASARRCPMVWSTSSHILGVSRH

SEQ ID NO: 1051875 - protein, 18 aa, Mycobacterium
PGATVLLRLDQDVPEDVR

SEQ ID NO: 1051876 - protein, 35 aa, Mycobacterium; identical to SEQ ID NO: 707641

SEQ ID NO: 1051877 - protein, 17 aa, Mycobacterium
PGAVIGRMVMGARGMAI

SEQ ID NO: 1051878 - protein, 17 aa, Mycobacterium
PGAWNFRDVADSTAALR

SEQ ID NO: 1051879 - protein, 17 aa, Mycobacterium
PGAWPGLAQAEQLHGKE

SEQ ID NO: 1051880 - protein, 19 aa, Mycobacterium
PGCDHEIRSGTAHVVVWPI

SEQ ID NO: 1051881 - protein, 18 aa, Mycobacterium
PGDAYWLLRHAIACPDPV

SEQ ID NO: 1051882 - protein, 24 aa, Mycobacterium
PGDGWRVAMGTLTFERGVSTLGQQ

SEQ ID NO: 1051883 - protein, 24 aa, Mycobacterium
PGDIERFGCRFGCVVQDGFGSTEG

SEQ ID NO: 1051884 - protein, 18 aa, Mycobacterium
PGDQLVLGASNPVRDAAL

SEQ ID NO: 1051885 - protein, 19 aa, Mycobacterium
PGDVISLGATSWRITEITH

SEQ ID NO: 1051886 - protein, 18 aa, Mycobacterium
PGDWLPRQWPVEVTELKP

SEQ ID NO: 1051887 - protein, 23 aa, Mycobacterium
PGECCRLRKVVPLRQALSNFSAW

SEQ ID NO: 1051888 - protein, 20 aa, Mycobacterium
PGEGPWRLGEGPWREGEGPW

SEQ ID NO: 1051889 - protein, 18 aa, Mycobacterium
PGELNRFVFAMPEQLGRV

SEQ ID NO: 1051890 - protein, 26 aa, Mycobacterium
PGEVPARLEALGALGGLDRAALHSQL

SEQ ID NO: 1051891 - protein, 22 aa, Mycobacterium
PGFAEAFLPGGRAPKPGELFTF

SEQ ID NO: 1051892 - protein, 26 aa, Mycobacterium
PGFTVPEFRRKAVIIAVGGIYDPRIH

SEQ ID NO: 1051893 - protein, 24 aa, Mycobacterium
PGGAGGAGGWLLGDGGNGGIGGAG

SEQ ID NO: 1051894 - protein, 23 aa, Mycobacterium
PGGARSGLRAAVDILDDIDDIHI

SEQ ID NO: 1051895 - protein, 25 aa, Mycobacterium
PGGCAGLRYNLFFDDRALDGDLTAE

SEQ ID NO: 1051896 - protein, 19 aa, Mycobacterium
PGGDIKPEHLILIGQIAQE

SEQ ID NO: 1051897 - protein, 23 aa, Mycobacterium
PGGLPEFLVARFGAEAANVVVTA

SEQ ID NO: 1051898 - protein, 18 aa, Mycobacterium
PGGLSCFMLPHILPDGTR

SEQ ID NO: 1051899 - protein, 21 aa, Mycobacterium
PGGLSTCLDPSINDFWTTYQT

SEQ ID NO: 1051900 - protein, 19 aa, Mycobacterium
PGGPALKPAALGGGAGAGA

SEQ ID NO: 1051901 - protein, 26 aa, Mycobacterium
PGGPFGPRPGFGFGPGPAQRRALHSA

SEQ ID NO: 1051902 - protein, 24 aa, Mycobacterium
PGGRGGGGGHSLVGPGGDGGLGST

SEQ ID NO: 1051903 - protein, 17 aa, Mycobacterium
PGGSHSWFAGYRGDLAF

SEQ ID NO: 1051904 - protein, 26 aa, Mycobacterium
PGHLVTRWLATFTFFRAALGVAAPRL

SEQ ID NO: 1051905 - protein, 21 aa, Mycobacterium
PGHSRWYIERFRAMARAGEDL

SEQ ID NO: 1051906 - protein, 21 aa, Mycobacterium
PGHVGAAWRGTWHGGLEFTKK

SEQ ID NO: 1051907 - protein, 17 aa, Mycobacterium
PGIAELGEVVWIVDLNR

SEQ ID NO: 1051908 - protein, 21 aa, Mycobacterium
PGIFAGRMVLFSAQPVRSGAD

SEQ ID NO: 1051909 - protein, 24 aa, Mycobacterium
PGIRRRVAADLQILQRFAQAVELA

SEQ ID NO: 1051910 - protein, 18 aa, Mycobacterium
PGIYEWRVEVEGYARATA

SEQ ID NO: 1051911 - protein, 22 aa, Mycobacterium
PGKGNAMGPAFWSELPEVFAAL

SEQ ID NO: 1051912 - protein, 19 aa, Mycobacterium
PGKGPEFLITTTLTVPSGT

SEQ ID NO: 1051913 - protein, 24 aa, Mycobacterium
PGKHRLMTWRGGYHGDTFTPMSVC

SEQ ID NO: 1051914 - protein, 19 aa, Mycobacterium
PGKLPARTCIGVTALALDA

SEQ ID NO: 1051915 - protein, 25 aa, Mycobacterium
PGKRPRSSMAPTFVFDGAPAEHSSM

SEQ ID NO: 1051916 - protein, 19 aa, Mycobacterium
PGLAKTRLAATVGDQTAAD

SEQ ID NO: 1051917 - protein, 24 aa, Mycobacterium
PGLHRPRTLLGKRLNDLVRDTYSE

SEQ ID NO: 1051918 - protein, 22 aa, Mycobacterium
PGLLHRAFSVFLFDDSRRMALQ

SEQ ID NO: 1051919 - protein, 17 aa, Mycobacterium
PGLRAALHERRPWRRWI

SEQ ID NO: 1051920 - protein, 28 aa, Mycobacterium
PGLRALARLGIYWAQEALAFGMTKRPNV

SEQ ID NO: 1051921 - protein, 17 aa, Mycobacterium
PGLRETGFWRFVSDPED

SEQ ID NO: 1051922 - protein, 27 aa, Mycobacterium
PGLRVGWFEGGIAWVPWALQDAEHLVA

SEQ ID NO: 1051923 - protein, 28 aa, Mycobacterium
PGLSARPAATCLIDWGTADRHAHREGVL

SEQ ID NO: 1051924 - protein, 18 aa, Mycobacterium
PGLSFSPWVVIYLVVDSM

SEQ ID NO: 1051925 - protein, 26 aa, Mycobacterium
PGLSGLGGAGGRGGYLIGSGGNGGAG

SEQ ID NO: 1051926 - protein, 17 aa, Mycobacterium
PGLSMAGLLGRNIEDAA

SEQ ID NO: 1051927 - protein, 18 aa, Mycobacterium
PGLSPAHSELRAWAVSST

SEQ ID NO: 1051928 - protein, 17 aa, Mycobacterium
PGLTARLAGEWPTPARR

SEQ ID NO: 1051929 - protein, 17 aa, Mycobacterium
PGLVNALVQMRIDGQPA

SEQ ID NO: 1051930 - protein, 17 aa, Mycobacterium
PGMFAIRAVLAATMGPA

SEQ ID NO: 1051931 - protein, 21 aa, Mycobacterium
PGMIERRAGGILISGSAAGNS

SEQ ID NO: 1051932 - protein, 20 aa, Mycobacterium
PGMREMLAITGAIKGAGLGK

SEQ ID NO: 1051933 - protein, 17 aa, Mycobacterium
PGMTLLDIGCGWGGALQ

SEQ ID NO: 1051934 - protein, 27 aa, Mycobacterium
PGNSLFITVNCWGRLVTGVGAALGKGA

SEQ ID NO: 1051935 - protein, 19 aa, Mycobacterium
PGNVIRLGADVGDTVTAGQ

SEQ ID NO: 1051936 - protein, 19 aa, Mycobacterium
PGNYRYAVNNSFGFGGHNV

SEQ ID NO: 1051937 - protein, 19 aa, Mycobacterium
PGPDAYKVLKKGSGQQEVA

SEQ ID NO: 1051938 - protein, 25 aa, Mycobacterium
PGPHRRPGAQRGRRITWRHRRCRSR

SEQ ID NO: 1051939 - protein, 17 aa, Mycobacterium
PGPKVSWLGEIVLHGAD

SEQ ID NO: 1051940 - protein, 32 aa, Mycobacterium
PGPQDLPAKPVWPVPPPAPVPRAPEAPAAMAP

SEQ ID NO: 1051941 - protein, 21 aa, Mycobacterium
PGPRTPLYCAGRRVCEHYPVS

SEQ ID NO: 1051942 - protein, 20 aa, Mycobacterium
PGPVGEVLRGYTLPNGLQLR

SEQ ID NO: 1051943 - protein, 18 aa, Mycobacterium
PGPVQFVLLDGWKDLYLP

SEQ ID NO: 1051944 - protein, 19 aa, Mycobacterium
PGPWLRTGDLGAFSEGELF

SEQ ID NO: 1051945 - protein, 21 aa, Mycobacterium
PGQAGADGGLLFGNGGNGGSG

SEQ ID NO: 1051946 - protein, 19 aa, Mycobacterium
PGQILVLGGGEARDLDLPE

SEQ ID NO: 1051947 - protein, 19 aa, Mycobacterium
PGQLQGWLTGAAGLDSRSG

SEQ ID NO: 1051948 - protein, 24 aa, Mycobacterium
PGQNGADGGLLWGTGGTGDATHPA

SEQ ID NO: 1051949 - protein, 18 aa, Mycobacterium
PGQPLDIYQEFRCAVRRS

SEQ ID NO: 1051950 - protein, 26 aa, Mycobacterium
PGQRIPRKWLDSGVIVMADTLEELAA

SEQ ID NO: 1051951 - protein, 19 aa, Mycobacterium
PGRPVFALVDLRGQSADEV

SEQ ID NO: 1051952 - protein, 22 aa, Mycobacterium
PGSAKFDLVASFADDGKTLGGF

SEQ ID NO: 1051953 - protein, 24 aa, Mycobacterium
PGSMAAVDFVGWYNAHPNFEHSTP

SEQ ID NO: 1051954 - protein, 27 aa, Mycobacterium
PGSPPPCKTPSCAIRRAAGEPRRAAPP

SEQ ID NO: 1051955 - protein, 19 aa, Mycobacterium
PGSRGRYLLGSGASLSRHY

SEQ ID NO: 1051956 - protein, 17 aa, Mycobacterium
PGSWMALSIRLPAGVSR

SEQ ID NO: 1051957 - protein, 18 aa, Mycobacterium
PGTPAFSVGYVQDSGGNL

SEQ ID NO: 1051958 - protein, 18 aa, Mycobacterium
PGTRAVVIYLEYLGITLG

SEQ ID NO: 1051959 - protein, 25 aa, Mycobacterium
PGTSIACSRWGMLSPEGQCKTFDAD

SEQ ID NO: 1051960 - protein, 24 aa, Mycobacterium
PGVDEMRMFGGLAFLIGGHMAVPV

SEQ ID NO: 1051961 - protein, 17 aa, Mycobacterium
PGVEGFRRAHRQARNAH

SEQ ID NO: 1051962 - protein, 27 aa, Mycobacterium
PGVLARVAALFSRRGFNIESLAVGATE

SEQ ID NO: 1051963 - protein, 17 aa, Mycobacterium
PGVMSWSEMSLLKPVAP

SEQ ID NO: 1051964 - protein, 21 aa, Mycobacterium
PGVNCSPPLAPAGMRTSPVGS

SEQ ID NO: 1051965 - protein, 24 aa, Mycobacterium
PGVNELFALLAYGEVAAFYRLTDE

SEQ ID NO: 1051966 - protein, 24 aa, Mycobacterium
PGVPMVFPPWFERFQIKYINPALK

SEQ ID NO: 1051967 - protein, 17 aa, Mycobacterium
PGVRLDGAVIFDGVKVE

SEQ ID NO: 1051968 - protein, 19 aa, Mycobacterium
PGVRYRAFDLFEPGRPRMH

SEQ ID NO: 1051969 - protein, 23 aa, Mycobacterium
PGWHPRPALPGAPQRLQGLATAD

SEQ ID NO: 1051970 - protein, 27 aa, Mycobacterium
PGWMQKAGLEWLYRLASEPRRLARRYL

SEQ ID NO: 1051971 - protein, 19 aa, Mycobacterium
PGYHSGYFVGAAIDAYCPQ

SEQ ID NO: 1051972 - protein, 19 aa, Mycobacterium
PHAELLAVISHREVIDRGL

SEQ ID NO: 1051973 - protein, 19 aa, Mycobacterium
PHAQLGNIFHTWVQQFYGA

SEQ ID NO: 1051974 - protein, 18 aa, Mycobacterium
PHCQEMFEAVVAGATDPE

SEQ ID NO: 1051975 - protein, 20 aa, Mycobacterium
PHEIAELVCFLASDRAAFIT

SEQ ID NO: 1051976 - protein, 17 aa, Mycobacterium
PHFDAGIAGKVMHSTGD

SEQ ID NO: 1051977 - protein, 18 aa, Mycobacterium
PHFDGYPAVLVVLSEIEA

SEQ ID NO: 1051978 - protein, 19 aa, Mycobacterium
PHGDYRFGQQIVVSHDGGD

SEQ ID NO: 1051979 - protein, 19 aa, Mycobacterium
PHGGPDPRGGYPPEAGGYP

SEQ ID NO: 1051980 - protein, 25 aa, Mycobacterium
PHHTRPVRFVWLQSHATRIALLDAM

SEQ ID NO: 1051981 - protein, 20 aa, Mycobacterium
PHIAVAPDLVASAANQLERI

SEQ ID NO: 1051982 - protein, 18 aa, Mycobacterium
PHLEWQLRRRVLALGNVE

SEQ ID NO: 1051983 - protein, 18 aa, Mycobacterium
PHLQCISFDLPAVTDITR

SEQ ID NO: 1051984 - protein, 18 aa, Mycobacterium
PHLRKRSASPDVMGRFSP

SEQ ID NO: 1051985 - protein, 19 aa, Mycobacterium
PHMLRHSFATHLLEGGADV

SEQ ID NO: 1051986 - protein, 21 aa, Mycobacterium
PHPIQGIGAGFVPPVLDLALV

SEQ ID NO: 1051987 - protein, 18 aa, Mycobacterium
PHPPHWLVELLAQRLTTL

SEQ ID NO: 1051988 - protein, 25 aa, Mycobacterium
PHPRASALLISRLVSWVDDLWCRAI

SEQ ID NO: 1051989 - protein, 21 aa, Mycobacterium
PHPRKPRPAFQDVSCPDVQLL

SEQ ID NO: 1051990 - protein, 27 aa, Mycobacterium
PHPYFPRLRLELDKRLGWKAEVEAALE

SEQ ID NO: 1051991 - protein, 17 aa, Mycobacterium
PHRSIWLHVEGHSLEQI

SEQ ID NO: 1051992 - protein, 17 aa, Mycobacterium
PHRVCRYLEDLAGDYHR

SEQ ID NO: 1051993 - protein, 21 aa, Mycobacterium
PHRVVCGGISILDRWDTTADP

SEQ ID NO: 1051994 - protein, 25 aa, Mycobacterium
PHSDVPKLLAAGAAAVFPTGTPLDD

SEQ ID NO: 1051995 - protein, 30 aa, Mycobacterium
PHSPMAGTGWLPGWRLTFGGEDIGWEGALA

SEQ ID NO: 1051996 - protein, 19 aa, Mycobacterium
PHSRAVMRAMTVAALTVDV

SEQ ID NO: 1051997 - protein, 31 aa, Mycobacterium
PHTKPPNFWAWLIGRIKAVDPDVLFLSEAFT

SEQ ID NO: 1051998 - protein, 25 aa, Mycobacterium
PHTVRPEYAPGWLAVTEDPAALLGL

SEQ ID NO: 1051999 - protein, 19 aa, Mycobacterium
PHVVVTGIAMTTALATDAE

SEQ ID NO: 1052000 - protein, 24 aa, Mycobacterium
PHWHPMDLLVLLFGVDLAWAQSPH

SEQ ID NO: 1052001 - protein, 23 aa, Mycobacterium
PHYAGRLVADEIRVLEQLTSSTE

SEQ ID NO: 1052002 - protein, 17 aa, Mycobacterium
PHYHTGIVVGHTVSGAW

SEQ ID NO: 1052003 - protein, 24 aa, Mycobacterium
PIAADDFWYLWRQMVSQPGVVDPA

SEQ ID NO: 1052004 - protein, 19 aa, Mycobacterium
PIAALGHWVHVYVDRVSRK

SEQ ID NO: 1052005 - protein, 17 aa, Mycobacterium
PIAATGIANVWEICHQL

SEQ ID NO: 1052006 - protein, 23 aa, Mycobacterium
PIAIVGMSCRYPGGIESPDDLWD

SEQ ID NO: 1052007 - protein, 20 aa, Mycobacterium
PIARDLASHRIRVMTIAPGL

SEQ ID NO: 1052008 - protein, 22 aa, Mycobacterium
PIARSVLDTALLLDATTTVPGP

SEQ ID NO: 1052009 - protein, 18 aa, Mycobacterium
PIASELILPIAVAVQNRI

SEQ ID NO: 1052010 - protein, 25 aa, Mycobacterium
PIDPWAGSYYVEWLTHQLAQRARAH

SEQ ID NO: 1052011 - protein, 24 aa, Mycobacterium
PIGRLEELMPIYSELLSLLADSGA

SEQ ID NO: 1052012 - protein, 24 aa, Mycobacterium
PIGRPELTAMFGTRPVILWHRSFH

SEQ ID NO: 1052013 - protein, 17 aa, Mycobacterium
PIITLARTFMIQPTHIR

SEQ ID NO: 1052014 - protein, 17 aa, Mycobacterium
PILHGLCTYGMTCKAIT

SEQ ID NO: 1052015 - protein, 19 aa, Mycobacterium
PILLCHGNPTWSFLYRHII

SEQ ID NO: 1052016 - protein, 25 aa, Mycobacterium
PILNARFALNAANARWGSLYDALYG

SEQ ID NO: 1052017 - protein, 22 aa, Mycobacterium
PIPCPHTLELALGVSLGVFRLL

SEQ ID NO: 1052018 - protein, 19 aa, Mycobacterium
PIPDMAQWGIFLRNHDELT

SEQ ID NO: 1052019 - protein, 24 aa, Mycobacterium
PIPLPIKTSYAWAAARHCGDDPVR

SEQ ID NO: 1052020 - protein, 20 aa, Mycobacterium
PIPLRGRIAVIVDDGVATGA

SEQ ID NO: 1052021 - protein, 29 aa, Mycobacterium
PIPNEKFRYGFAIAPELVRTVLRDQEPDW

SEQ ID NO: 1052022 - protein, 17 aa, Mycobacterium
PIPPIAFQLLWYPSTMW

SEQ ID NO: 1052023 - protein, 25 aa, Mycobacterium
PIPRPPSIRDSQCFLDHMRNCQEAV

SEQ ID NO: 1052024 - protein, 18 aa, Mycobacterium
PIQAFRAWMEGPIMPPEG

SEQ ID NO: 1052025 - protein, 19 aa, Mycobacterium
PIRMEVEKRVPAPHEEGEE

SEQ ID NO: 1052026 - protein, 18 aa, Mycobacterium
PISAGFALLLTRRLGLSD

SEQ ID NO: 1052027 - protein, 18 aa, Mycobacterium
PISAMLFRTRAARRHRAL

SEQ ID NO: 1052028 - protein, 18 aa, Mycobacterium
PISMALREVREWAQNTKD

SEQ ID NO: 1052029 - protein, 28 aa, Mycobacterium
PISSPFRFSICRRRLASATRPIARRRDS

SEQ ID NO: 1052030 - protein, 20 aa, Mycobacterium
PISTLPMAVPVNLRADADGA

SEQ ID NO: 1052031 - protein, 20 aa, Mycobacterium
PITGTLGVFTVGGFTIPAST

SEQ ID NO: 1052032 - protein, 18 aa, Mycobacterium
PITPEFVERVIAQQAERG

SEQ ID NO: 1052033 - protein, 24 aa, Mycobacterium
PIVDSSVLLGDWLIQLPREVTVPA

SEQ ID NO: 1052034 - protein, 18 aa, Mycobacterium
PIWSSWYAGRPVLVTAND

SEQ ID NO: 1052035 - protein, 18 aa, Mycobacterium
PIYNFRYPNMLRLHYEKK

SEQ ID NO: 1052036 - protein, 20 aa, Mycobacterium
PIYPCQDGYVRLCVMAPRQW

SEQ ID NO: 1052037 - protein, 25 aa, Mycobacterium
PIYTKRMQWALNFEGTDVPTIFKGL

SEQ ID NO: 1052038 - protein, 17 aa, Mycobacterium
PKAGLSIAMGFAPDDEL

SEQ ID NO: 1052039 - protein, 18 aa, Mycobacterium
PKAGPLIATKLHILTRKT

SEQ ID NO: 1052040 - protein, 23 aa, Mycobacterium
PKAVLSPRAWMAASRGMKGQSWR

SEQ ID NO: 1052041 - protein, 24 aa, Mycobacterium
PKCSYGNCNRLRQLTGRPSTDFTI

SEQ ID NO: 1052042 - protein, 27 aa, Mycobacterium
PKDVLQAQCTFSWPPQMDLPGYKPNTK

SEQ ID NO: 1052043 - protein, 32 aa, Mycobacterium; identical to SEQ ID NO: 708928

SEQ ID NO: 1052044 - protein, 17 aa, Mycobacterium
PKGLAHRALADIHESIR

SEQ ID NO: 1052045 - protein, 20 aa, Mycobacterium
PKHPDLRLTPARSLDQQAQD

SEQ ID NO: 1052046 - protein, 20 aa, Mycobacterium
PKHRGISCLILDLQSPGVRV

SEQ ID NO: 1052047 - protein, 20 aa, Mycobacterium
PKIFFQIYWLGGRDAIAERV

SEQ ID NO: 1052048 - protein, 25 aa, Mycobacterium
PKIIDLQLRGCFAMTETGHGSDVQS

SEQ ID NO: 1052049 - protein, 21 aa, Mycobacterium
PKIRTGYNLPISHVGGPRVER

SEQ ID NO: 1052050 - protein, 20 aa, Mycobacterium
PKITAANFTDGWLRTGDLGT

SEQ ID NO: 1052051 - protein, 19 aa, Mycobacterium
PKITLACEVCKHRNYITKK

SEQ ID NO: 1052052 - protein, 19 aa, Mycobacterium
PKITMACEVCKHRNYITKK

SEQ ID NO: 1052053 - protein, 22 aa, Mycobacterium
PKKQVRCVYVAVGQKGTTIASV

SEQ ID NO: 1052054 - protein, 21 aa, Mycobacterium
PKLAKRLGLQRQWLHARSLAF

SEQ ID NO: 1052055 - protein, 22 aa, Mycobacterium
PKLDAAALLHRLSLKVPARHFV

SEQ ID NO: 1052056 - protein, 22 aa, Mycobacterium
PKLDAAALLHRLSLKVPVRHFV

SEQ ID NO: 1052057 - protein, 19 aa, Mycobacterium
PKLGAFCSSEPGAGSDVGA

SEQ ID NO: 1052058 - protein, 18 aa, Mycobacterium
PKLGCYGIQRIHLLRNVM

SEQ ID NO: 1052059 - protein, 18 aa, Mycobacterium
PKLGCYGIQRIHPLKNVM

SEQ ID NO: 1052060 - protein, 20 aa, Mycobacterium
PKLGIAQPVVLNFDNGIPVD

SEQ ID NO: 1052061 - protein, 17 aa, Mycobacterium
PKLGRAAVSRGCLATID

SEQ ID NO: 1052062 - protein, 21 aa, Mycobacterium
PKLIEHLTRVNAAKSETLTAL

SEQ ID NO: 1052063 - protein, 19 aa, Mycobacterium
PKLRRAGLDYHDLASVTVH

SEQ ID NO: 1052064 - protein, 22 aa, Mycobacterium
PKPLGMPLQYMVSGMAVRATNK

SEQ ID NO: 1052065 - protein, 19 aa, Mycobacterium
PKPLICAVNGLGVGIGATI

SEQ ID NO: 1052066 - protein, 18 aa, Mycobacterium
PKPPPQRITLTLPAIQRS

SEQ ID NO: 1052067 - protein, 20 aa, Mycobacterium
PKPRSGSLLRSMDLQTITLE

SEQ ID NO: 1052068 - protein, 20 aa, Mycobacterium
PKPTPIWGVPDGNRLLVITD

SEQ ID NO: 1052069 - protein, 20 aa, Mycobacterium
PKRWLGYPFGAPTLALPEYN

SEQ ID NO: 1052070 - protein, 17 aa, Mycobacterium
PKSILLANHGLHIEILI

SEQ ID NO: 1052071 - protein, 22 aa, Mycobacterium
PKSRQSWPTHFKKRSTDADTSA

SEQ ID NO: 1052072 - protein, 20 aa, Mycobacterium
PKVAAILAFAMAVNEQRGRI

SEQ ID NO: 1052073 - protein, 17 aa, Mycobacterium
PKVKAVVTGADLAEKGL

SEQ ID NO: 1052074 - protein, 19 aa, Mycobacterium
PKVRAMELIEEMEKTRRGL

SEQ ID NO: 1052075 - protein, 19 aa, Mycobacterium
PKVSAQWQAQVALFADQPG

SEQ ID NO: 1052076 - protein, 20 aa, Mycobacterium
PKVVLDFPVSRRTSPQLMTI

SEQ ID NO: 1052077 - protein, 23 aa, Mycobacterium
PKVVLVTGACRFLGGYLTARLAQ

SEQ ID NO: 1052078 - protein, 18 aa, Mycobacterium
PKWSDGHRSVRLMRHPIQ

SEQ ID NO: 1052079 - protein, 25 aa, Mycobacterium
PKYVRYEVFGPPGTVVTVNYLDAQA

SEQ ID NO: 1052080 - protein, 19 aa, Mycobacterium
PLAELGLNSLMAMAIRREA

SEQ ID NO: 1052081 - protein, 25 aa, Mycobacterium
PLAGLHFFPAPALPAGMLSTLATKA

SEQ ID NO: 1052082 - protein, 19 aa, Mycobacterium
PLAMHLRTGVAMLSYSDDL

SEQ ID NO: 1052083 - protein, 24 aa, Mycobacterium
PLAPVLPLIRRLLIDDAADSGVIV

SEQ ID NO: 1052084 - protein, 25 aa, Mycobacterium
PLARLYSWHRAMRIFDGPDEVHMRS

SEQ ID NO: 1052085 - protein, 21 aa, Mycobacterium
PLATMAGYYLGWWDIDRSALA

SEQ ID NO: 1052086 - protein, 25 aa, Mycobacterium
PLATPGVAVGDHFELLAMASTASSQ

SEQ ID NO: 1052087 - protein, 30 aa, Mycobacterium
PLAVIGGAFARYGGVWAHDDTRKSFGIAGA

SEQ ID NO: 1052088 - protein, 18 aa, Mycobacterium
PLDGFRVLDFTQNVAGPL

SEQ ID NO: 1052089 - protein, 24 aa, Mycobacterium
PLDRGRPLWELYLIQGLSGGRVAI

SEQ ID NO: 1052090 - protein, 27 aa, Mycobacterium
PLDRLIAFGRERICFVHAHHELLSEAN

SEQ ID NO: 1052091 - protein, 22 aa, Mycobacterium
PLDWGEVVRLGVKVAGALEAAH

SEQ ID NO: 1052092 - protein, 17 aa, Mycobacterium
PLDWLVSKFAREVPGVA

SEQ ID NO: 1052093 - protein, 22 aa, Mycobacterium
PLEHIRPGLPRTLIHVSGSEVL

SEQ ID NO: 1052094 - protein, 17 aa, Mycobacterium
PLETVGEVIGWVNRHVG

SEQ ID NO: 1052095 - protein, 19 aa, Mycobacterium
PLFAKRARVALGDDGARQR

SEQ ID NO: 1052096 - protein, 18 aa, Mycobacterium
PLFSAGLGGRLGDGRQWL

SEQ ID NO: 1052097 - protein, 22 aa, Mycobacterium
PLFTDFAPRLLVSHPTEVKVAH

SEQ ID NO: 1052098 - protein, 18 aa, Mycobacterium
PLFTPRFDGAFTAGLYSV

SEQ ID NO: 1052099 - protein, 26 aa, Mycobacterium
PLGATGLAQCCELTWQLRGTADRRQV

SEQ ID NO: 1052100 - protein, 19 aa, Mycobacterium
PLGAVAPVTRGAARPAVAP

SEQ ID NO: 1052101 - protein, 18 aa, Mycobacterium
PLGDAVGYAVRFTDQVSE

SEQ ID NO: 1052102 - protein, 19 aa, Mycobacterium
PLGGASVGYWGEIASRHGL

SEQ ID NO: 1052103 - protein, 25 aa, Mycobacterium
PLGLTLPEFVCLRILSASPGLSSAE

SEQ ID NO: 1052104 - protein, 18 aa, Mycobacterium
PLGPLGVTMRLYAPRPEV

SEQ ID NO: 1052105 - protein, 18 aa, Mycobacterium
PLGPYGFSGWVGPEPHGA

SEQ ID NO: 1052106 - protein, 18 aa, Mycobacterium
PLGQWLNEHGWRANAQNA

SEQ ID NO: 1052107 - protein, 22 aa, Mycobacterium
PLGSALYRAFAVLLTCASALEA

SEQ ID NO: 1052108 - protein, 17 aa, Mycobacterium
PLGSWLAELPDERLITL

SEQ ID NO: 1052109 - protein, 20 aa, Mycobacterium
PLHAECAGLIYLASELDGYP

SEQ ID NO: 1052110 - protein, 21 aa, Mycobacterium
PLIGGGLSLLVSDGVYQGAYL

SEQ ID NO: 1052111 - protein, 21 aa, Mycobacterium
PLIHGAAQWTVMTALTTGQTV

SEQ ID NO: 1052112 - protein, 18 aa, Mycobacterium
PLIRLSIEREDLEDWLRR

SEQ ID NO: 1052113 - protein, 23 aa, Mycobacterium
PLIYSCQELHPLPTGTVMGIPAS

SEQ ID NO: 1052114 - protein, 24 aa, Mycobacterium
PLLAEERRLLLAAMGRARRQLLVT

SEQ ID NO: 1052115 - protein, 24 aa, Mycobacterium
PLLARATPYIGHFQIRNRGTLGGS

SEQ ID NO: 1052116 - protein, 21 aa, Mycobacterium
PLLEGKIRSAFAITEPAVASS

SEQ ID NO: 1052117 - protein, 24 aa, Mycobacterium
PLLEPLRGVPFIGNTLADLVQPDL

SEQ ID NO: 1052118 - protein, 25 aa, Mycobacterium
PLLGVPFSAPYSFDTPFGPVALTLN

SEQ ID NO: 1052119 - protein, 23 aa, Mycobacterium
PLLHGEIRSAFSMTEPAVASSDA

SEQ ID NO: 1052120 - protein, 24 aa, Mycobacterium
PLLIAEAGGGPWAINQSLQLGRPA

SEQ ID NO: 1052121 - protein, 22 aa, Mycobacterium
PLLLEMPMAYTARALEDSTCLY

SEQ ID NO: 1052122 - protein, 19 aa, Mycobacterium
PLLLGERAAPWWVILYRTG

SEQ ID NO: 1052123 - protein, 18 aa, Mycobacterium
PLLMGFELPDAATTAEVG

SEQ ID NO: 1052124 - protein, 17 aa, Mycobacterium
PLLPMATEAHAKTDEDK

SEQ ID NO: 1052125 - protein, 21 aa, Mycobacterium
PLLQRAGCFRTGYRDGETLRE

SEQ ID NO: 1052126 - protein, 17 aa, Mycobacterium
PLLVACDLQRPAAVNQL

SEQ ID NO: 1052127 - protein, 18 aa, Mycobacterium
PLMEAIVLSGRIVDIRPV

SEQ ID NO: 1052128 - protein, 25 aa, Mycobacterium
PLNGSIRFGIIPTVAPYVLPTVLAG

SEQ ID NO: 1052129 - protein, 24 aa, Mycobacterium
PLNIPVVIHLPFQGLLVPPHPITA

SEQ ID NO: 1052130 - protein, 18 aa, Mycobacterium
PLNSQLRRLPLVIVANGV

SEQ ID NO: 1052131 - protein, 17 aa, Mycobacterium
PLPAPVIDVIYDGPDLA

SEQ ID NO: 1052132 - protein, 22 aa, Mycobacterium
PLPARVADAMWSRASLCGSPGR

SEQ ID NO: 1052133 - protein, 26 aa, Mycobacterium
PLPCTPRGIVHLLRRYDVPIAGAHVV

SEQ ID NO: 1052134 - protein, 18 aa, Mycobacterium
PLPEDLQAAIALGGEMGR

SEQ ID NO: 1052135 - protein, 18 aa, Mycobacterium
PLPGMPFGQLAGNGGNGV

SEQ ID NO: 1052136 - protein, 24 aa, Mycobacterium
PLPGPRLPHDMAFTENYAILNDFP

SEQ ID NO: 1052137 - protein, 22 aa, Mycobacterium
PLPPEGASAIVFRDTTHAAELA

SEQ ID NO: 1052138 - protein, 24 aa, Mycobacterium
PLPRWPITVSRGWVGSVSLAVAEV

SEQ ID NO: 1052139 - protein, 22 aa, Mycobacterium
PLPSKWRIAFGEPIYTADYGSG

SEQ ID NO: 1052140 - protein, 30 aa, Mycobacterium
PLPSLGFFVLDGWLRPVPVGVVGELYVAGG

SEQ ID NO: 1052141 - protein, 26 aa, Mycobacterium
PLPSLRMRTTLGIAHWQLEGRIDGRD

SEQ ID NO: 1052142 - protein, 19 aa, Mycobacterium
PLPTEKNVYCVVRSPHKYK

SEQ ID NO: 1052143 - protein, 19 aa, Mycobacterium
PLQAATQWDALSHVYYDDQ

SEQ ID NO: 1052144 - protein, 18 aa, Mycobacterium
PLQLCERLSDITGATVYL

SEQ ID NO: 1052145 - protein, 19 aa, Mycobacterium
PLQQLLRLLPGCKAPSSSG

SEQ ID NO: 1052146 - protein, 39 aa, Mycobacterium
PLQVLERDVLGLVNAPAQALLGRPIIGNGADGAPGSGAN

SEQ ID NO: 1052147 - protein, 25 aa, Mycobacterium
PLRAEAAFEYAARLGYDGVELMVWS

SEQ ID NO: 1052148 - protein, 20 aa, Mycobacterium
PLRAESLAGLAPALIAVAGF

SEQ ID NO: 1052149 - protein, 22 aa, Mycobacterium
PLRARHFVRWLTIWNDTVDAMY

SEQ ID NO: 1052150 - protein, 20 aa, Mycobacterium
PLRIHFWVCGVFEVHDGRIT

SEQ ID NO: 1052151 - protein, 19 aa, Mycobacterium
PLRIKLPAHVAANFEGLVV

SEQ ID NO: 1052152 - protein, 23 aa, Mycobacterium
PLRLLFKDEVRAVGRELGLPEEI

SEQ ID NO: 1052153 - protein, 21 aa, Mycobacterium
PLSALLHVARTVARRAERSAW

SEQ ID NO: 1052154 - protein, 32 aa, Mycobacterium
PLSCAIGAPVLFGRASVVFARLVVPTVELLGL

SEQ ID NO: 1052155 - protein, 23 aa, Mycobacterium
PLSENRFKVELLKRVVEKQLTVV

SEQ ID NO: 1052156 - protein, 42 aa, Mycobacterium
PLSHSQLAAWFQYRIEGAREEFNMPLALRFEGPLDSVALAAA

SEQ ID NO: 1052157 - protein, 18 aa, Mycobacterium
PLSTVYYWMFGGWLRKRR

SEQ ID NO: 1052158 - protein, 18 aa, Mycobacterium
PLSVDLPDLIAAAVASRS

SEQ ID NO: 1052159 - protein, 17 aa, Mycobacterium
PLSVVSIYGGRAYEPQI

SEQ ID NO: 1052160 - protein, 19 aa, Mycobacterium
PLTALERLAGPDIRAVAVS

SEQ ID NO: 1052161 - protein, 28 aa, Mycobacterium
PLTRAADHSKLWFAMAAGLLASRSQSAQ

SEQ ID NO: 1052162 - protein, 17 aa, Mycobacterium
PLTSQLVAIGFTKLAHR

SEQ ID NO: 1052163 - protein, 20 aa, Mycobacterium
PLTVRLGERPTLMFDNPTMM

SEQ ID NO: 1052164 - protein, 29 aa, Mycobacterium
PLVAEASVPWVLMHWRPVSDDNPHQVPNY

SEQ ID NO: 1052165 - protein, 18 aa, Mycobacterium
PLVEGLRALGHQVNLADQ

SEQ ID NO: 1052166 - protein, 18 aa, Mycobacterium
PLVILLHGFPESWYSWRH

SEQ ID NO: 1052167 - protein, 21 aa, Mycobacterium
PLVILVIRLAWLTNHVADGIG

SEQ ID NO: 1052168 - protein, 22 aa, Mycobacterium
PLVILVIRLAWLTNHVADGIGP

SEQ ID NO: 1052169 - protein, 17 aa, Mycobacterium
PLVRLASIYVSRATAED

SEQ ID NO: 1052170 - protein, 17 aa, Mycobacterium
PLVRWPTLTKSGRWRAE

SEQ ID NO: 1052171 - protein, 18 aa, Mycobacterium
PLWELHVIEGLEGKQFAI

SEQ ID NO: 1052172 - protein, 19 aa, Mycobacterium
PLWSESWYADFVDAAEGLG

SEQ ID NO: 1052173 - protein, 22 aa, Mycobacterium
PLYMAGARLDSLVPLGPPVMDV

SEQ ID NO: 1052174 - protein, 30 aa, Mycobacterium
PMADTVLRYELMGRFLPNSMFLQAAERDLI

SEQ ID NO: 1052175 - protein, 22 aa, Mycobacterium
PMAKDVDRMLCQIVAEHGGLDP

SEQ ID NO: 1052176 - protein, 19 aa, Mycobacterium
PMDGILVPAGPYTATIPDL

SEQ ID NO: 1052177 - protein, 21 aa, Mycobacterium
PMDRVICGDVGYGKTEIAVRA

SEQ ID NO: 1052178 - protein, 20 aa, Mycobacterium
PMFVPWLVGPLLTGEGIHLV

SEQ ID NO: 1052179 - protein, 19 aa, Mycobacterium
PMGLIGVIGPWNYPLTNSF

SEQ ID NO: 1052180 - protein, 20 aa, Mycobacterium
PMGLVHGGVYCSMVESMASM

SEQ ID NO: 1052181 - protein, 25 aa, Mycobacterium
PMGTVADIYRHFGLTLTDEARAAMA

SEQ ID NO: 1052182 - protein, 21 aa, Mycobacterium
PMIASNRVRPIIGSRLPIGQA

SEQ ID NO: 1052183 - protein, 24 aa, Mycobacterium
PMINNEFIRHWLADLVAETGSGPG

SEQ ID NO: 1052184 - protein, 25 aa, Mycobacterium
PMIRKGAMKNTAWIKAYEDANVDTG

SEQ ID NO: 1052185 - protein, 29 aa, Mycobacterium
PMKKTPRRLCLRITLGSGRNKVTATFFNA

SEQ ID NO: 1052186 - protein, 33 aa, Mycobacterium
PMKPKLDVLDFWSIVRPELPGVNGLCTQVTAFM

SEQ ID NO: 1052187 - protein, 21 aa, Mycobacterium
PMLAAALAWDGLSTELSSATA

SEQ ID NO: 1052188 - protein, 18 aa, Mycobacterium
PMLAPVVFTSALDLGELF

SEQ ID NO: 1052189 - protein, 20 aa, Mycobacterium
PMLEAAVAWDGLSAELGTAA

SEQ ID NO: 1052190 - protein, 18 aa, Mycobacterium
PMNPNGGVLARFPDLTLP

SEQ ID NO: 1052191 - protein, 20 aa, Mycobacterium
PMRADIRLLGAILGDTVREQ

SEQ ID NO: 1052192 - protein, 23 aa, Mycobacterium
PMRTARLLGSLAIIEPSVSGSNL

SEQ ID NO: 1052193 - protein, 26 aa, Mycobacterium
PMSFEWKDRETLLYALGVGAGIDDLS

SEQ ID NO: 1052194 - protein, 25 aa, Mycobacterium
PMSPEEWRTFAARASLYAARQKAKE

SEQ ID NO: 1052195 - protein, 18 aa, Mycobacterium
PMVGVLIAIGDGRPYNTA

SEQ ID NO: 1052196 - protein, 18 aa, Mycobacterium
PMVKMLLNTALDRLAEKL

SEQ ID NO: 1052197 - protein, 20 aa, Mycobacterium
PMVRDVRRIGSAALDLCMVA

SEQ ID NO: 1052198 - protein, 19 aa, Mycobacterium
PNAIPLVLTRRTVWASSYM

SEQ ID NO: 1052199 - protein, 21 aa, Mycobacterium
PNAKPSALLDHEARRASEIDV

SEQ ID NO: 1052200 - protein, 21 aa, Mycobacterium
PNARMSWQQVTDWDFVCEQLA

SEQ ID NO: 1052201 - protein, 19 aa, Mycobacterium
PNDGCCSHGAFLSDDDDRA

SEQ ID NO: 1052202 - protein, 19 aa, Mycobacterium
PNDVLAGLPGSLGKLAGIL

SEQ ID NO: 1052203 - protein, 25 aa, Mycobacterium
PNFAIGAVLSMHFAKQAAPFFDSAE

SEQ ID NO: 1052204 - protein, 18 aa, Mycobacterium
PNFAYSLFAKRLRKQAKP

SEQ ID NO: 1052205 - protein, 24 aa, Mycobacterium
PNFVSDLNAIMGIYYVHTQYPTLT

SEQ ID NO: 1052206 - protein, 17 aa, Mycobacterium
PNGARRAIAAGLHAIEY

SEQ ID NO: 1052207 - protein, 18 aa, Mycobacterium
PNGGWRLITTQLNNERVM

SEQ ID NO: 1052208 - protein, 23 aa, Mycobacterium
PNLDEVRLLVGIDVIDTQSQHAA

SEQ ID NO: 1052209 - protein, 24 aa, Mycobacterium
PNLDMRLGSILGRRPTALERPRFD

SEQ ID NO: 1052210 - protein, 21 aa, Mycobacterium
PNLFYGTGIPTCIVILDKENA

SEQ ID NO: 1052211 - protein, 30 aa, Mycobacterium; identical to SEQ ID NO: 709989

SEQ ID NO: 1052212 - protein, 24 aa, Mycobacterium
PNLLECGRGLAAARGASLRWVEAN

SEQ ID NO: 1052213 - protein, 22 aa, Mycobacterium
PNMPNLAALAARGAMRHLDPVF

SEQ ID NO: 1052214 - protein, 17 aa, Mycobacterium
PNPAWDHAGFHRLAKAM

SEQ ID NO: 1052215 - protein, 23 aa, Mycobacterium
PNPKATVALLRRVEDVLDIEVPL

SEQ ID NO: 1052216 - protein, 17 aa, Mycobacterium
PNPRFLQRMILVLNQIQ

SEQ ID NO: 1052217 - protein, 20 aa, Mycobacterium
PNQHGIVGNGWYFRELGEVL

SEQ ID NO: 1052218 - protein, 17 aa, Mycobacterium
PNQWLLRMLVTQTERAE

SEQ ID NO: 1052219 - protein, 17 aa, Mycobacterium
PNSRLANQIWRTNVLGA

SEQ ID NO: 1052220 - protein, 19 aa, Mycobacterium
PNTIPRGGVLATQRLLDEL

SEQ ID NO: 1052221 - protein, 26 aa, Mycobacterium
PNTRMNEIRLWLPYDEVLPRRQPPSV

SEQ ID NO: 1052222 - protein, 23 aa, Mycobacterium
PPAAPDRPRIVVSRTRPPAIALA

SEQ ID NO: 1052223 - protein, 18 aa, Mycobacterium
PPAEFRWEDVQPLVDREP

SEQ ID NO: 1052224 - protein, 20 aa, Mycobacterium
PPAFLRLVHEAVVHIVGNTH

SEQ ID NO: 1052225 - protein, 27 aa, Mycobacterium
PPAGDPGRLFGRMLGCDLGMNPPFEMD

SEQ ID NO: 1052226 - protein, 17 aa, Mycobacterium
PPAGPALGLNLGNWCQH

SEQ ID NO: 1052227 - protein, 17 aa, Mycobacterium
PPAGVRSYGPLRASLGT

SEQ ID NO: 1052228 - protein, 21 aa, Mycobacterium
PPALEKAWHTHGYYGSVNHNV

SEQ ID NO: 1052229 - protein, 17 aa, Mycobacterium
PPAPEPPVPPAPPAPGS

SEQ ID NO: 1052230 - protein, 25 aa, Mycobacterium
PPAPEVPSPYAFRLADPDADAEKIA

SEQ ID NO: 1052231 - protein, 26 aa, Mycobacterium
PPAVLCLRVARALLPDVPHIAVFDTA

SEQ ID NO: 1052232 - protein, 18 aa, Mycobacterium
PPCQPKNVMFMYCTASAE

SEQ ID NO: 1052233 - protein, 25 aa, Mycobacterium
PPCTPVCVLLMVFEAPTITGLAHRV

SEQ ID NO: 1052234 - protein, 24 aa, Mycobacterium
PPDARISVAPLGFVAEGRSLIGSY

SEQ ID NO: 1052235 - protein, 17 aa, Mycobacterium
PPDGWALVVSDDDVPVG

SEQ ID NO: 1052236 - protein, 18 aa, Mycobacterium
PPEAAAWLASAIDAAYGQ

SEQ ID NO: 1052237 - protein, 18 aa, Mycobacterium
PPEAIDWLLPAGARDVLD

SEQ ID NO: 1052238 - protein, 20 aa, Mycobacterium
PPEAIGPRYVEAIGGIDRTL

SEQ ID NO: 1052239 - protein, 23 aa, Mycobacterium
PPEGDPLRWCSASGTAIPEGNDG

SEQ ID NO: 1052240 - protein, 21 aa, Mycobacterium
PPELYAWLHYEPIPDRDDPAK

SEQ ID NO: 1052241 - protein, 19 aa, Mycobacterium
PPERVVGSSVGLIYRDGSL

SEQ ID NO: 1052242 - protein, 26 aa, Mycobacterium
PPESNAPALLGLIGLWYSNFLGAQSR

SEQ ID NO: 1052243 - protein, 18 aa, Mycobacterium
PPFAQRVPDRLWALQRKL

SEQ ID NO: 1052244 - protein, 18 aa, Mycobacterium
PPFGSIPAGSGGDGGNGG

SEQ ID NO: 1052245 - protein, 18 aa, Mycobacterium
PPFPPFTFETATQKVQAA

SEQ ID NO: 1052246 - protein, 28 aa, Mycobacterium
PPGATPIGRWCWRPRPTRPIPAASTTAA

SEQ ID NO: 1052247 - protein, 19 aa, Mycobacterium
PPGCGKTFVVRALASTGQL

SEQ ID NO: 1052248 - protein, 20 aa, Mycobacterium
PPGKEKPLGLGDEPEPQEAD

SEQ ID NO: 1052249 - protein, 26 aa, Mycobacterium
PPGKHAASAFAMWFPIEGEQDSHEYG

SEQ ID NO: 1052250 - protein, 23 aa, Mycobacterium
PPGLPPFILCTNVSTLPPIRTPE

SEQ ID NO: 1052251 - protein, 17 aa, Mycobacterium
PPGWSEVAETPAPRSHD

SEQ ID NO: 1052252 - protein, 20 aa, Mycobacterium
PPKPSMRIISDIFAYTSVKM

SEQ ID NO: 1052253 - protein, 23 aa, Mycobacterium
PPLAEPFVAAALDRAAPPHQPGT

SEQ ID NO: 1052254 - protein, 18 aa, Mycobacterium
PPLAGSLLIGGEGRVAEP

SEQ ID NO: 1052255 - protein, 18 aa, Mycobacterium
PPLCIDMTAADYFADTLD

SEQ ID NO: 1052256 - protein, 20 aa, Mycobacterium
PPLIEVYEYTKGFVGAPPDG

SEQ ID NO: 1052257 - protein, 23 aa, Mycobacterium
PPLLGVDPVAPVAARLPPAPEPP

SEQ ID NO: 1052258 - protein, 17 aa, Mycobacterium
PPLPHGLLITHVNLGLD

SEQ ID NO: 1052259 - protein, 21 aa, Mycobacterium
PPLPIRTALPPGPPTVAGPLP

SEQ ID NO: 1052260 - protein, 17 aa, Mycobacterium
PPLSCPITALGGVGDVT

SEQ ID NO: 1052261 - protein, 21 aa, Mycobacterium
PPMIRYPIPPMIHGATQSATW

SEQ ID NO: 1052262 - protein, 25 aa, Mycobacterium
PPPAIAVNRVRLLTLIATNFFGQNT

SEQ ID NO: 1052263 - protein, 20 aa, Mycobacterium
PPPASPRWEPDADFELDYHM

SEQ ID NO: 1052264 - protein, 23 aa, Mycobacterium
PPPDQCPLCPSPTGLTSEVPARD

SEQ ID NO: 1052265 - protein, 35 aa, Mycobacterium
PPPIKTPPRPPAPPWPTTPPVAPTVVAAPPAPPSP

SEQ ID NO: 1052266 - protein, 20 aa, Mycobacterium
PPPLRVGRIALFNDTHLTRL

SEQ ID NO: 1052267 - protein, 17 aa, Mycobacterium
PPPPQRFPLSEAQAALQ

SEQ ID NO: 1052268 - protein, 20 aa, Mycobacterium
PPPPRPGSPPSPPLPPTAPE

SEQ ID NO: 1052269 - protein, 17 aa, Mycobacterium
PPPPRRVRIGGPPQPPG

SEQ ID NO: 1052270 - protein, 23 aa, Mycobacterium
PPPTEIYGGAGGPGGGASLDSLN

SEQ ID NO: 1052271 - protein, 24 aa, Mycobacterium
PPPVPLDAAILFAPVGELVLPALA

SEQ ID NO: 1052272 - protein, 18 aa, Mycobacterium
PPQADWLDPMIALSFAAA

SEQ ID NO: 1052273 - protein, 17 aa, Mycobacterium
PPQKWPTVIKHPKTGQE

SEQ ID NO: 1052274 - protein, 17 aa, Mycobacterium
PPQWFRVPSNTYFNEGA

SEQ ID NO: 1052275 - protein, 17 aa, Mycobacterium
PPRAVPRAHRFPSGPVS

SEQ ID NO: 1052276 - protein, 19 aa, Mycobacterium
PPRIRRAYAALAAVSTKPG

SEQ ID NO: 1052277 - protein, 17 aa, Mycobacterium
PPRPGVIRDRGTQLQRA

SEQ ID NO: 1052278 - protein, 19 aa, Mycobacterium
PPRRSVGYLVFGIGRHGSD

SEQ ID NO: 1052279 - protein, 24 aa, Mycobacterium
PPRTADMKALFSAIIDDEPLPLEN

SEQ ID NO: 1052280 - protein, 25 aa, Mycobacterium
PPRWLPGPRELRAWALAAGSPEADR

SEQ ID NO: 1052281 - protein, 19 aa, Mycobacterium
PPSIREIGDAVGLTSTSSV

SEQ ID NO: 1052282 - protein, 19 aa, Mycobacterium
PPSLGLLTINALVAAPEVL

SEQ ID NO: 1052283 - protein, 17 aa, Mycobacterium
PPSLTRTRHEAVEHKHS

SEQ ID NO: 1052284 - protein, 21 aa, Mycobacterium
PPSQANFVWLPLEDRTTDFVT

SEQ ID NO: 1052285 - protein, 19 aa, Mycobacterium
PPSSPIFHVQWTRRCGSRS

SEQ ID NO: 1052286 - protein, 23 aa, Mycobacterium
PPTEGWRRLVYVLSGQLVNLGES

SEQ ID NO: 1052287 - protein, 19 aa, Mycobacterium
PPTPCSRCPAPGRRRPARL

SEQ ID NO: 1052288 - protein, 22 aa, Mycobacterium
PPVCGCGGLIRPDIVWFGEPLP

SEQ ID NO: 1052289 - protein, 21 aa, Mycobacterium
PPVESGNGWRVVVATAAATAT

SEQ ID NO: 1052290 - protein, 32 aa, Mycobacterium
PPVPNPAPGFTAMEPCAPPPPSPGVPPVPPAP

SEQ ID NO: 1052291 - protein, 20 aa, Mycobacterium
PPVRTLMGYQWSRRDEWLHR

SEQ ID NO: 1052292 - protein, 17 aa, Mycobacterium
PPWDPGAALVVRSDIEA

SEQ ID NO: 1052293 - protein, 21 aa, Mycobacterium
PPWLRRWVRDGYAWVQPRLSP

SEQ ID NO: 1052294 - protein, 18 aa, Mycobacterium
PPYFEGMAAAPAPVSDIT

SEQ ID NO: 1052295 - protein, 25 aa, Mycobacterium
PQARARAGWLWSRRRGIVTGLSASA

SEQ ID NO: 1052296 - protein, 22 aa, Mycobacterium
PQARRRGIATAMVRAALAKTGG

SEQ ID NO: 1052297 - protein, 28 aa, Mycobacterium
PQAYREFLTEIGYLLPAPEDFTITTSGV

SEQ ID NO: 1052298 - protein, 18 aa, Mycobacterium
PQDPATLCGPVISDKQRK

SEQ ID NO: 1052299 - protein, 27 aa, Mycobacterium
PQDPRPRLVGALAMAVVRIALDDWLGQ

SEQ ID NO: 1052300 - protein, 21 aa, Mycobacterium
PQFHPSYRQASVVRREIGVPT

SEQ ID NO: 1052301 - protein, 26 aa, Mycobacterium
PQFNKFGNFRGWAAAHGRHSNIGYDA

SEQ ID NO: 1052302 - protein, 19 aa, Mycobacterium
PQGAFGFRHNPIHLMTIDG

SEQ ID NO: 1052303 - protein, 23 aa, Mycobacterium
PQGELAGAYLLVWTTTPWTLPSN

SEQ ID NO: 1052304 - protein, 20 aa, Mycobacterium
PQGHGVPIAWSVDHDPRLSR

SEQ ID NO: 1052305 - protein, 18 aa, Mycobacterium
PQGMCLADFGAAALDANR

SEQ ID NO: 1052306 - protein, 23 aa, Mycobacterium
PQGQALVFWDCYRPHDVQVKMFQ

SEQ ID NO: 1052307 - protein, 23 aa, Mycobacterium
PQGTVLRWAQLFGNPLTWSDLAW

SEQ ID NO: 1052308 - protein, 24 aa, Mycobacterium
PQHGAELGLPMWPVSARTPAGLAA

SEQ ID NO: 1052309 - protein, 32 aa, Mycobacterium; identical to SEQ ID NO: 710604

SEQ ID NO: 1052310 - protein, 18 aa, Mycobacterium
PQLARLAAAGGFRNWDSM

SEQ ID NO: 1052311 - protein, 24 aa, Mycobacterium
PQLFKQLLMVAGMERYYQIARCYR

SEQ ID NO: 1052312 - protein, 18 aa, Mycobacterium
PQLPLYMLGCEVKAMYPL

SEQ ID NO: 1052313 - protein, 17 aa, Mycobacterium
PQLVEAFRSTLEEVIDA

SEQ ID NO: 1052314 - protein, 17 aa, Mycobacterium
PQLVPRLQFSDLVLVRS

SEQ ID NO: 1052315 - protein, 20 aa, Mycobacterium
PQMRPIRWWRAASGSANSAA

SEQ ID NO: 1052316 - protein, 19 aa, Mycobacterium
PQNIAGLVTALGGRAAVEN

SEQ ID NO: 1052317 - protein, 28 aa, Mycobacterium
PQPGLALIKSWAAQGWLHRIVDERHGQN

SEQ ID NO: 1052318 - protein, 18 aa, Mycobacterium
PQPLPGHIGEALDALDKD

SEQ ID NO: 1052319 - protein, 18 aa, Mycobacterium
PQPVWRPILETLTENFSR

SEQ ID NO: 1052320 - protein, 20 aa, Mycobacterium
PQQNMWWWDVLRHGRNSEYA

SEQ ID NO: 1052321 - protein, 18 aa, Mycobacterium
PQRHIAFSGDARAALLEA

SEQ ID NO: 1052322 - protein, 21 aa, Mycobacterium
PQRRPGWYGNITVLQWLSPLP

SEQ ID NO: 1052323 - protein, 18 aa, Mycobacterium
PQRTAELATEYGVGSSIA

SEQ ID NO: 1052324 - protein, 24 aa, Mycobacterium
PQRWSELTPAPGWTIAHQIAHLLW

SEQ ID NO: 1052325 - protein, 20 aa, Mycobacterium
PQSRRSWAVLGEMAELGADA

SEQ ID NO: 1052326 - protein, 24 aa, Mycobacterium
PQTSDFLHGRWLVLRRGKRNIAGV

SEQ ID NO: 1052327 - protein, 22 aa, Mycobacterium
PQVDLRVGSWFVSTHPTSHFVT

SEQ ID NO: 1052328 - protein, 21 aa, Mycobacterium
PQVHTLLDFHFRPHVTAASGK

SEQ ID NO: 1052329 - protein, 18 aa, Mycobacterium
PQVNRWVNRFSGHAVSPE

SEQ ID NO: 1052330 - protein, 18 aa, Mycobacterium
PQVVKEVAPVPVLAAGGI

SEQ ID NO: 1052331 - protein, 19 aa, Mycobacterium
PQYKHSVVMGVNKNKVPGG

SEQ ID NO: 1052332 - protein, 20 aa, Mycobacterium
PQYMGINWVGPAIMRYGTPA

SEQ ID NO: 1052333 - protein, 18 aa, Mycobacterium
PQYQAWKHTQLVIDVVPG

SEQ ID NO: 1052334 - protein, 22 aa, Mycobacterium
PQYRIAVADARTRRDGRSIEVI

SEQ ID NO: 1052335 - protein, 18 aa, Mycobacterium
PRAAELLHAATIAIAGQV

SEQ ID NO: 1052336 - protein, 23 aa, Mycobacterium
PRAALPATMMARWFRTEQARALF

SEQ ID NO: 1052337 - protein, 19 aa, Mycobacterium
PRAAPPVRKLAKELMVDLA

SEQ ID NO: 1052338 - protein, 19 aa, Mycobacterium
PRAGLSTIFSPSRSTFGVD

SEQ ID NO: 1052339 - protein, 23 aa, Mycobacterium
PRAGNLFLSLADRIPFALTAWTV

SEQ ID NO: 1052340 - protein, 17 aa, Mycobacterium
PRAGQPSAWPQWAEPDV

SEQ ID NO: 1052341 - protein, 18 aa, Mycobacterium
PRALMKLAGITGRLRDVP

SEQ ID NO: 1052342 - protein, 19 aa, Mycobacterium
PRAQVPPIQAFRQRFGEHF

SEQ ID NO: 1052343 - protein, 19 aa, Mycobacterium
PRATFLLMQAVYPVMVEAG

SEQ ID NO: 1052344 - protein, 21 aa, Mycobacterium
PRAVAEYGQLVSLFPLQKALP

SEQ ID NO: 1052345 - protein, 23 aa, Mycobacterium
PRDCGPGLHHICLEVEGPEQLEI

SEQ ID NO: 1052346 - protein, 20 aa, Mycobacterium
PRDGGGYGITAQWDDDIHHA

SEQ ID NO: 1052347 - protein, 32 aa, Mycobacterium
PRDLGEPYAVKRFTQTLAIRTDAPGIGGDGGV

SEQ ID NO: 1052348 - protein, 20 aa, Mycobacterium
PRDRGWPVDDLLSVSDLEGW

SEQ ID NO: 1052349 - protein, 22 aa, Mycobacterium
PRDRMPIFPVPEGHDPASWLHH

SEQ ID NO: 1052350 - protein, 23 aa, Mycobacterium
PREAAVAAIVDWISRRENATPTG

SEQ ID NO: 1052351 - protein, 19 aa, Mycobacterium
PRELAGWIVEALTKADGIA

SEQ ID NO: 1052352 - protein, 19 aa, Mycobacterium
PRERVYRLLDPGSPFLELA

SEQ ID NO: 1052353 - protein, 20 aa, Mycobacterium
PRFLHSFPPMPLQYKGLMTS

SEQ ID NO: 1052354 - protein, 19 aa, Mycobacterium
PRFNHPNVHAIHRDIRTVI

SEQ ID NO: 1052355 - protein, 17 aa, Mycobacterium
PRFSVSRVDIDRGGPTY

SEQ ID NO: 1052356 - protein, 26 aa, Mycobacterium
PRFYPDMPSRFAVIPRRGSTADIRWF

SEQ ID NO: 1052357 - protein, 21 aa, Mycobacterium
PRGALIFRRPAGLVCALNAGD

SEQ ID NO: 1052358 - protein, 25 aa, Mycobacterium
PRGHRKIPAAEFFTGLWETAMEPDE

SEQ ID NO: 1052359 - protein, 23 aa, Mycobacterium
PRGIPGRLSWLVLRHLHAAALRA

SEQ ID NO: 1052360 - protein, 21 aa, Mycobacterium
PRGKFATAVLITSEGSGRTGA

SEQ ID NO: 1052361 - protein, 17 aa, Mycobacterium
PRGPGMERSDLLEANGA

SEQ ID NO: 1052362 - protein, 20 aa, Mycobacterium
PRGREVSVEREVFPSLLSDP

SEQ ID NO: 1052363 - protein, 18 aa, Mycobacterium
PRGTDWHPHRGFETVTYM

SEQ ID NO: 1052364 - protein, 17 aa, Mycobacterium
PRGVFSRQLVLGENLDT

SEQ ID NO: 1052365 - protein, 21 aa, Mycobacterium
PRGVLEIAYRCPNGEPGVVKT

SEQ ID NO: 1052366 - protein, 19 aa, Mycobacterium
PRGYRIVPRPGAVTRRAIS

SEQ ID NO: 1052367 - protein, 18 aa, Mycobacterium
PRHLRPRSNSVILRETKV

SEQ ID NO: 1052368 - protein, 23 aa, Mycobacterium
PRHPHLVKLVARCANVEGAGKVT

SEQ ID NO: 1052369 - protein, 19 aa, Mycobacterium
PRIDVTVRISGFFRDAFPH

SEQ ID NO: 1052370 - protein, 25 aa, Mycobacterium
PRIGPRAARVVSIFLDGATLHAMIS

SEQ ID NO: 1052371 - protein, 24 aa, Mycobacterium
PRIGSPRWDSAIIGLDCETKVLDE

SEQ ID NO: 1052372 - protein, 25 aa, Mycobacterium
PRIPPERLRYAPGQFLTLRVPSERT

SEQ ID NO: 1052373 - protein, 23 aa, Mycobacterium
PRIVREFPFNFMLWDLDRRIRTG

SEQ ID NO: 1052374 - protein, 27 aa, Mycobacterium
PRKDRWHSLARLAIRDDIYGALRSLCF

SEQ ID NO: 1052375 - protein, 20 aa, Mycobacterium
PRKVSPLTVQMIMPNGAAAV

SEQ ID NO: 1052376 - protein, 24 aa, Mycobacterium
PRLADGIDIVGGWAEKVGLDVALA

SEQ ID NO: 1052377 - protein, 23 aa, Mycobacterium
PRLAESWDSVGLVCGDPGEPVES

SEQ ID NO: 1052378 - protein, 18 aa, Mycobacterium
PRLARQVVPENWLRAYDV

SEQ ID NO: 1052379 - protein, 17 aa, Mycobacterium
PRLAVLEAVGDHPHADT

SEQ ID NO: 1052380 - protein, 23 aa, Mycobacterium
PRLGDMGLVPAMTVKCAVALVKS

SEQ ID NO: 1052381 - protein, 18 aa, Mycobacterium
PRLGLGRDQRFLVPRRSA

SEQ ID NO: 1052382 - protein, 20 aa, Mycobacterium
PRLPIQPIDYEQWMVHWLTA

SEQ ID NO: 1052383 - protein, 17 aa, Mycobacterium
PRLPQMPATAEQIDELA

SEQ ID NO: 1052384 - protein, 19 aa, Mycobacterium
PRLQRRTAPAVAPVTLDPN

SEQ ID NO: 1052385 - protein, 19 aa, Mycobacterium
PRLRMRHMPFRITPIERDA

SEQ ID NO: 1052386 - protein, 19 aa, Mycobacterium
PRLRPGTVVVPDQLVDRTR

SEQ ID NO: 1052387 - protein, 17 aa, Mycobacterium
PRLVRLTHRGSRLAKNP

SEQ ID NO: 1052388 - protein, 17 aa, Mycobacterium
PRLYGLRGTRAGATAAS

SEQ ID NO: 1052389 - protein, 19 aa, Mycobacterium
PRPAAFAGVGGYFDALSWR

SEQ ID NO: 1052390 - protein, 18 aa, Mycobacterium
PRPAPVPEPVSAPGELNA

SEQ ID NO: 1052391 - protein, 31 aa, Mycobacterium
PRPARRAIVPACALLPPVFPVWGKYPGKLTA

SEQ ID NO: 1052392 - protein, 19 aa, Mycobacterium
PRPDVIEGIVSFLEKRPPQ

SEQ ID NO: 1052393 - protein, 25 aa, Mycobacterium
PRPDWPAEAIVVGPLHFEPTDQLLK

SEQ ID NO: 1052394 - protein, 17 aa, Mycobacterium
PRPGLVNALVQMRIDGQ

SEQ ID NO: 1052395 - protein, 18 aa, Mycobacterium
PRPGSYPAQMLVDWVRVW

SEQ ID NO: 1052396 - protein, 21 aa, Mycobacterium
PRPLHEAAAAWTALAAEHASA

SEQ ID NO: 1052397 - protein, 19 aa, Mycobacterium
PRPMCPKCRCLHWDTVESG

SEQ ID NO: 1052398 - protein, 23 aa, Mycobacterium
PRPPMVTSGLRIGTPALATRGFG

SEQ ID NO: 1052399 - protein, 23 aa, Mycobacterium
PRPRAPLAAATIWAIDDFTADNG

SEQ ID NO: 1052400 - protein, 18 aa, Mycobacterium
PRPSRHRPDIPTAFDEVI

SEQ ID NO: 1052401 - protein, 22 aa, Mycobacterium
PRQHRDALRTKGWKNVVAHQTR

SEQ ID NO: 1052402 - protein, 18 aa, Mycobacterium
PRQICAQQTMAFARASDA

SEQ ID NO: 1052403 - protein, 25 aa, Mycobacterium
PRQLLLIHCGRLSVEKHVDRSIGAL

SEQ ID NO: 1052404 - protein, 17 aa, Mycobacterium
PRQVMPVHGTWRMLRAN

SEQ ID NO: 1052405 - protein, 28 aa, Mycobacterium
PRRFEVIAIGITPQGSWVLTDGNPDALA

SEQ ID NO: 1052406 - protein, 19 aa, Mycobacterium
PRRGSSPATRMGLMPVTAA

SEQ ID NO: 1052407 - protein, 18 aa, Mycobacterium
PRRGVAIVNSPLVHIGGV

SEQ ID NO: 1052408 - protein, 19 aa, Mycobacterium
PRRLLKWIYHIESRKAQRD

SEQ ID NO: 1052409 - protein, 30 aa, Mycobacterium; identical to SEQ ID NO: 711352

SEQ ID NO: 1052410 - protein, 27 aa, Mycobacterium
PRRRPRRAVWIRCWTRTATSRRPWTRP

SEQ ID NO: 1052411 - protein, 28 aa, Mycobacterium
PRSAGRIVSFDAAGGWNIEEEGYQAVGS

SEQ ID NO: 1052412 - protein, 20 aa, Mycobacterium
PRSDEADVEMALDAAHAAAP

SEQ ID NO: 1052413 - protein, 18 aa, Mycobacterium
PRSGAYVLDVEDPYYGGH

SEQ ID NO: 1052414 - protein, 19 aa, Mycobacterium
PRSGEVIVREPGHWYSAGA

SEQ ID NO: 1052415 - protein, 26 aa, Mycobacterium
PRSLGVTLWAQRLMPLGLAEALGRAL

SEQ ID NO: 1052416 - protein, 29 aa, Mycobacterium
PRSLLERLPRLKLITIVGMNLPNLDLAAA

SEQ ID NO: 1052417 - protein, 21 aa, Mycobacterium
PRSRMGRIAWSWFRHPVKSHE

SEQ ID NO: 1052418 - protein, 24 aa, Mycobacterium
PRSRPCVATALTLYSEILDRIEGD

SEQ ID NO: 1052419 - protein, 24 aa, Mycobacterium
PRSTEVLAALGLPTEMDYMGYADS

SEQ ID NO: 1052420 - protein, 23 aa, Mycobacterium
PRSTRPRCPTCSTTRSPRGLSRY

SEQ ID NO: 1052421 - protein, 20 aa, Mycobacterium
PRTAEVLVEMSAAGLCHTDD

SEQ ID NO: 1052422 - protein, 18 aa, Mycobacterium
PRTGFPASTVHRLAANLA

SEQ ID NO: 1052423 - protein, 17 aa, Mycobacterium
PRTGRHLGNFPQAFTHL

SEQ ID NO: 1052424 - protein, 21 aa, Mycobacterium
PRTHPHPILFVGGMSVAAARR

SEQ ID NO: 1052425 - protein, 20 aa, Mycobacterium
PRTKRGVISYAARDIGERLD

SEQ ID NO: 1052426 - protein, 25 aa, Mycobacterium
PRTNEPPWLWPAELASVLLAGPAEQ

SEQ ID NO: 1052427 - protein, 26 aa, Mycobacterium
PRTNLARYGIAPTYPRDFVSDVRNNR

SEQ ID NO: 1052428 - protein, 21 aa, Mycobacterium
PRTRSAAPLPRSGDTVADITA

SEQ ID NO: 1052429 - protein, 19 aa, Mycobacterium
PRTVALTVYGDLETSTLRE

SEQ ID NO: 1052430 - protein, 26 aa, Mycobacterium
PRVAQDFDATVCWMADSGVLEPGRDY

SEQ ID NO: 1052431 - protein, 18 aa, Mycobacterium
PRVDRFFAAIEAEMLYAL

SEQ ID NO: 1052432 - protein, 25 aa, Mycobacterium
PRVFKRIRPAFTYQRSLDVLTAARQ

SEQ ID NO: 1052433 - protein, 17 aa, Mycobacterium
PRVGAIFLDDGPVHICT

SEQ ID NO: 1052434 - protein, 21 aa, Mycobacterium
PRVLCTNKLRVARIRGADEDQ

SEQ ID NO: 1052435 - protein, 18 aa, Mycobacterium
PRVLDWLERADVDVLAIQ

SEQ ID NO: 1052436 - protein, 17 aa, Mycobacterium
PRVLSDWLDGGRGDLDP

SEQ ID NO: 1052437 - protein, 17 aa, Mycobacterium
PRVPGMEPLVMGGLGLA

SEQ ID NO: 1052438 - protein, 18 aa, Mycobacterium
PRVTLPYTDEAWQTICDV

SEQ ID NO: 1052439 - protein, 23 aa, Mycobacterium
PRVTRKLGDLITFVIHIPLSIDL

SEQ ID NO: 1052440 - protein, 23 aa, Mycobacterium
PRVWEKLKAGIEFTISHETDEMK

SEQ ID NO: 1052441 - protein, 20 aa, Mycobacterium
PRVYPCRTCATPAEVDNLVR

SEQ ID NO: 1052442 - protein, 21 aa, Mycobacterium
PRYAELIKRTQWWGRQMLIWG

SEQ ID NO: 1052443 - protein, 17 aa, Mycobacterium
PRYGDARGRATNAVELI

SEQ ID NO: 1052444 - protein, 17 aa, Mycobacterium
PRYIVDLIAKVTTVAVE

SEQ ID NO: 1052445 - protein, 19 aa, Mycobacterium
PRYLNYRKTSIYGGSNEVQ

SEQ ID NO: 1052446 - protein, 20 aa, Mycobacterium
PRYLSKSGVVAVGEIGYDSM

SEQ ID NO: 1052447 - protein, 23 aa, Mycobacterium
PSAADVLGSWPWPALGSVTAHLC

SEQ ID NO: 1052448 - protein, 17 aa, Mycobacterium
PSAGHPITIEPTKGRVQ

SEQ ID NO: 1052449 - protein, 26 aa, Mycobacterium
PSAGSAWPRHLLPALTTAGFATELRN

SEQ ID NO: 1052450 - protein, 18 aa, Mycobacterium
PSALLRIAAKRGGRIRGV

SEQ ID NO: 1052451 - protein, 24 aa, Mycobacterium
PSANARWGNNVAILAGDYLLATAS

SEQ ID NO: 1052452 - protein, 17 aa, Mycobacterium
PSAPARLVVLASGTGSL

SEQ ID NO: 1052453 - protein, 24 aa, Mycobacterium
PSAPPCCRLACARPRAITKAPRGN

SEQ ID NO: 1052454 - protein, 17 aa, Mycobacterium
PSASALRRVLRRARDGV

SEQ ID NO: 1052455 - protein, 20 aa, Mycobacterium
PSAWSAEGLLVYLPDDAQGA

SEQ ID NO: 1052456 - protein, 19 aa, Mycobacterium
PSDAGGLVIRTSDGLEAEN

SEQ ID NO: 1052457 - protein, 26 aa, Mycobacterium
PSDDPCAFSFSGLKTAVACYVEAHPD

SEQ ID NO: 1052458 - protein, 24 aa, Mycobacterium
PSDFRLWVCLHEVAHRVQFTANPW

SEQ ID NO: 1052459 - protein, 23 aa, Mycobacterium
PSDLRVPFEPREVIARIVDGSEF

SEQ ID NO: 1052460 - protein, 19 aa, Mycobacterium
PSDRGWDIDAMFDPDPDAR

SEQ ID NO: 1052461 - protein, 24 aa, Mycobacterium
PSEDIRTAARWIGTAANWMSCWTM

SEQ ID NO: 1052462 - protein, 21 aa, Mycobacterium
PSFRSTALSDRWMLIFTSNTG

SEQ ID NO: 1052463 - protein, 26 aa, Mycobacterium
PSGEGLHVGHPLGYIATDVFARYHRM

SEQ ID NO: 1052464 - protein, 22 aa, Mycobacterium
PSGFACQSFAALSLDPPLVLFC

SEQ ID NO: 1052465 - protein, 20 aa, Mycobacterium
PSGLRGLREKYGLDISPQNF

SEQ ID NO: 1052466 - protein, 19 aa, Mycobacterium
PSGPMPAAPGAPVESAPGR

SEQ ID NO: 1052467 - protein, 19 aa, Mycobacterium
PSGRLMAMIHEGRTETAQY

SEQ ID NO: 1052468 - protein, 22 aa, Mycobacterium
PSGSGRLLVAVRFGTTRLLDNV

SEQ ID NO: 1052469 - protein, 24 aa, Mycobacterium
PSIDGEVLLNWMLLAATASSVNGD

SEQ ID NO: 1052470 - protein, 23 aa, Mycobacterium
PSIPRSGSARVHYHVPLHLDPPA

SEQ ID NO: 1052471 - protein, 17 aa, Mycobacterium
PSLDDVFLSMTTDPSEA

SEQ ID NO: 1052472 - protein, 17 aa, Mycobacterium
PSLDEMVNFAAAMEREG

SEQ ID NO: 1052473 - protein, 17 aa, Mycobacterium
PSLDRWVINLTTGAVST

SEQ ID NO: 1052474 - protein, 21 aa, Mycobacterium
PSLQWLRPIAPAFRPRWRDPS

SEQ ID NO: 1052475 - protein, 22 aa, Mycobacterium
PSLRFGLAFCEASGPRLVRRTG

SEQ ID NO: 1052476 - protein, 23 aa, Mycobacterium
PSLRVPFRRVHLSTGAHFDLYDT

SEQ ID NO: 1052477 - protein, 20 aa, Mycobacterium
PSLYSALAEQCRRLDALGIG

SEQ ID NO: 1052478 - protein, 19 aa, Mycobacterium
PSMFADVRRELAVKAVAQA

SEQ ID NO: 1052479 - protein, 24 aa, Mycobacterium
PSNLMIDPGLGFAKAGQHNWTLLH

SEQ ID NO: 1052480 - protein, 25 aa, Mycobacterium
PSNRRLVLLPFSWIIFIIHEKALGI

SEQ ID NO: 1052481 - protein, 25 aa, Mycobacterium
PSPDRATGQFLWQNIFGVWPVTGEV

SEQ ID NO: 1052482 - protein, 28 aa, Mycobacterium
PSPFGPGRPGWHIECAAIALSRVGSGLD

SEQ ID NO: 1052483 - protein, 19 aa, Mycobacterium
PSPHVDWSAGTVRVLTEPV

SEQ ID NO: 1052484 - protein, 20 aa, Mycobacterium
PSPLEWGCVRFSIIQRADHF

SEQ ID NO: 1052485 - protein, 18 aa, Mycobacterium
PSPNDIDPEWAFQDLGFD

SEQ ID NO: 1052486 - protein, 23 aa, Mycobacterium
PSPPICPLPPIPPLPPTPPTPPA

SEQ ID NO: 1052487 - protein, 20 aa, Mycobacterium
PSPTLPMLLPLEQIGVPAPI

SEQ ID NO: 1052488 - protein, 22 aa, Mycobacterium
PSQPCVWSPPPTPPCTPVCVLL

SEQ ID NO: 1052489 - protein, 23 aa, Mycobacterium
PSRDIPRFVSLWQSGRLPVESLV

SEQ ID NO: 1052490 - protein, 20 aa, Mycobacterium
PSREDALLCGDFYDVVQTVD

SEQ ID NO: 1052491 - protein, 18 aa, Mycobacterium
PSRGRLPLNSQLRRLPLV

SEQ ID NO: 1052492 - protein, 20 aa, Mycobacterium
PSRGWFELADALTAAGADLE

SEQ ID NO: 1052493 - protein, 21 aa, Mycobacterium
PSRRSRFWADRPVTVEPATDG

SEQ ID NO: 1052494 - protein, 24 aa, Mycobacterium
PSRSEAFPLVILEAMARAVPVAAS

SEQ ID NO: 1052495 - protein, 20 aa, Mycobacterium
PSSHTADLADWLSSRQPELV

SEQ ID NO: 1052496 - protein, 23 aa, Mycobacterium
PSSVIRIAPPVGRQLDWTVCRTV

SEQ ID NO: 1052497 - protein, 25 aa, Mycobacterium
PSTAPHPRKPRPAFQDVSCPDVQLL

SEQ ID NO: 1052498 - protein, 23 aa, Mycobacterium
PSTCSAAARYGFRYWVESRRHQR

SEQ ID NO: 1052499 - protein, 21 aa, Mycobacterium
PSTDAILTCRLIDRPLRPSFV

SEQ ID NO: 1052500 - protein, 24 aa, Mycobacterium
PSTDEPFSALAFKVATHPFFGKLT

SEQ ID NO: 1052501 - protein, 19 aa, Mycobacterium
PSTGTNLWGAFGLLAEMVA

SEQ ID NO: 1052502 - protein, 25 aa, Mycobacterium
PSTVADMMLYLAWSMAGRGAQEGRT

SEQ ID NO: 1052503 - protein, 20 aa, Mycobacterium
PSVAELDKWVIYVPREHTEP

SEQ ID NO: 1052504 - protein, 19 aa, Mycobacterium
PSVSARVAVEAGIAQCWHK

SEQ ID NO: 1052505 - protein, 23 aa, Mycobacterium
PSYTRGYIGTALRLLERKIAQQP

SEQ ID NO: 1052506 - protein, 20 aa, Mycobacterium
PSYVRICSALPRTETFKVLK

SEQ ID NO: 1052507 - protein, 32 aa, Mycobacterium; identical to SEQ ID NO: 711986

SEQ ID NO: 1052508 - protein, 20 aa, Mycobacterium
PTALRPAMHLGLRVLAQGTP

SEQ ID NO: 1052509 - protein, 18 aa, Mycobacterium
PTAPALMGNTVVWKPSVT

SEQ ID NO: 1052510 - protein, 24 aa, Mycobacterium
PTAPEPAAAFAPLPPVPPSPPAPP

SEQ ID NO: 1052511 - protein, 18 aa, Mycobacterium
PTAQDWADLVGTIHYEVV

SEQ ID NO: 1052512 - protein, 22 aa, Mycobacterium
PTARCTTVGVPIDYDKPGGAQA

SEQ ID NO: 1052513 - protein, 24 aa, Mycobacterium
PTASLDIWWCQGFSEPEAGSDLAS

SEQ ID NO: 1052514 - protein, 26 aa, Mycobacterium
PTASLKALCALPMVVNATADLVFSAN

SEQ ID NO: 1052515 - protein, 25 aa, Mycobacterium
PTAWLAEGLLPFLPAAAQHALFTAI

SEQ ID NO: 1052516 - protein, 19 aa, Mycobacterium
PTCAFLCRTAESALDVSAQ

SEQ ID NO: 1052517 - protein, 22 aa, Mycobacterium
PTCGSGSLLLKVAAEAPRGITI

SEQ ID NO: 1052518 - protein, 23 aa, Mycobacterium
PTDIQTAVLYDHFTPFTLIQLEE

SEQ ID NO: 1052519 - protein, 19 aa, Mycobacterium
PTDRLALLGSRLRGGATVE

SEQ ID NO: 1052520 - protein, 24 aa, Mycobacterium
PTEAKVAAVNAVIAERNSEAANAA

SEQ ID NO: 1052521 - protein, 30 aa, Mycobacterium
PTESGFPPRIWDMLLERFGREVDRRLGDGT

SEQ ID NO: 1052522 - protein, 19 aa, Mycobacterium
PTFQKGLAHHVAAWRAARL

SEQ ID NO: 1052523 - protein, 24 aa, Mycobacterium
PTGDAELLIIGWGSSYGPIGEACR

SEQ ID NO: 1052524 - protein, 24 aa, Mycobacterium
PTGIYTADIMDFWRPNYRSTALVD

SEQ ID NO: 1052525 - protein, 20 aa, Mycobacterium
PTGLAGLGILISEAVRGEGG

SEQ ID NO: 1052526 - protein, 24 aa, Mycobacterium
PTGNAFSGTIAWVQIDLGADSHDH

SEQ ID NO: 1052527 - protein, 20 aa, Mycobacterium
PTGQHWRLLSTIKELDPSWA

SEQ ID NO: 1052528 - protein, 25 aa, Mycobacterium
PTGQRLRLLESLDLFGVAIAIEALR

SEQ ID NO: 1052529 - protein, 22 aa, Mycobacterium
PTGTRPDTWLQWLHAEHYPALL

SEQ ID NO: 1052530 - protein, 20 aa, Mycobacterium
PTIKGMWTVPVFGNPTGVTY

SEQ ID NO: 1052531 - protein, 18 aa, Mycobacterium
PTITRFAFQGGVQNIQRG

SEQ ID NO: 1052532 - protein, 29 aa, Mycobacterium
PTKGIFTSNFGYRWGVLHAGIDLANSIGT

SEQ ID NO: 1052533 - protein, 18 aa, Mycobacterium
PTKLDRWRRDVTFNTDGA

SEQ ID NO: 1052534 - protein, 24 aa, Mycobacterium
PTKPGSYPIVLGTYEIVCSKYPDS

SEQ ID NO: 1052535 - protein, 24 aa, Mycobacterium
PTLHAVGIWVATSFPSFSKRTFNL

SEQ ID NO: 1052536 - protein, 28 aa, Mycobacterium
PTLHSALLVRFGEIFGHGLTTWLDNAAA

SEQ ID NO: 1052537 - protein, 20 aa, Mycobacterium
PTLLRKGERLLVFLPLAHVL

SEQ ID NO: 1052538 - protein, 17 aa, Mycobacterium
PTLLTPGQRLLVFLPLA

SEQ ID NO: 1052539 - protein, 24 aa, Mycobacterium
PTLMGRPVLVGGMGGRGVVAGASY

SEQ ID NO: 1052540 - protein, 17 aa, Mycobacterium
PTLMSFKKGKLLFNQPG

SEQ ID NO: 1052541 - protein, 26 aa, Mycobacterium
PTLNLKEWKAEWGVVDPQEARGALTT

SEQ ID NO: 1052542 - protein, 17 aa, Mycobacterium
PTLPNRLYWLSASLGAD

SEQ ID NO: 1052543 - protein, 21 aa, Mycobacterium
PTLPQSYPWDTNPRSFDPSSN

SEQ ID NO: 1052544 - protein, 18 aa, Mycobacterium
PTMDFVKIAAGMGVPARR

SEQ ID NO: 1052545 - protein, 19 aa, Mycobacterium
PTMRHLPGAAVIAKVADRA

SEQ ID NO: 1052546 - protein, 25 aa, Mycobacterium
PTMVRDFQRIIGMEARVQIQGQAGK

SEQ ID NO: 1052547 - protein, 26 aa, Mycobacterium
PTNALLGRPLIGNGTDGLAGTGAAGG

SEQ ID NO: 1052548 - protein, 27 aa, Mycobacterium
PTPDLKALIDRLWPASDFSAPRRWWPP

SEQ ID NO: 1052549 - protein, 25 aa, Mycobacterium
PTPDMRLDMPLVDFFSRGGALKSSW

SEQ ID NO: 1052550 - protein, 17 aa, Mycobacterium
PTPHWRLITSGSGDLAD

SEQ ID NO: 1052551 - protein, 20 aa, Mycobacterium
PTPILTHLRFDITRSVTDQG

SEQ ID NO: 1052552 - protein, 20 aa, Mycobacterium
PTPLMLPGFAARAVLGEFAD

SEQ ID NO: 1052553 - protein, 17 aa, Mycobacterium
PTPPLPIPQDLSPNDLM

SEQ ID NO: 1052554 - protein, 22 aa, Mycobacterium
PTPRISYADAMRRFGSDKPDLR

SEQ ID NO: 1052555 - protein, 29 aa, Mycobacterium
PTPSELAVFCRDRLAAFEVPTRFQEASAL

SEQ ID NO: 1052556 - protein, 21 aa, Mycobacterium
PTQAIFGRPLIGDGAAGTATD

SEQ ID NO: 1052557 - protein, 24 aa, Mycobacterium
PTQALVGRPLIGNGANGTAANPNG

SEQ ID NO: 1052558 - protein, 25 aa, Mycobacterium
PTQKEIFIPGGRMFRDLTRLSAAGI

SEQ ID NO: 1052559 - protein, 26 aa, Mycobacterium
PTRAPAFLIGRLVSWVDDLWCRAIGA

SEQ ID NO: 1052560 - protein, 20 aa, Mycobacterium
PTRIYSCAYFEPPELTLEEA

SEQ ID NO: 1052561 - protein, 18 aa, Mycobacterium
PTRLALLDEFSKVWDYRG

SEQ ID NO: 1052562 - protein, 17 aa, Mycobacterium
PTRRPVPLRLRDWNEVY

SEQ ID NO: 1052563 - protein, 19 aa, Mycobacterium
PTRRVPLGLIAGARSGDKG

SEQ ID NO: 1052564 - protein, 25 aa, Mycobacterium
PTSAEFRKLLAEWKAAGRASKDVDD

SEQ ID NO: 1052565 - protein, 19 aa, Mycobacterium
PTSAIAAAAADEISAAIAE

SEQ ID NO: 1052566 - protein, 18 aa, Mycobacterium
PTSGTAWVAGHDVCTAPE

SEQ ID NO: 1052567 - protein, 17 aa, Mycobacterium
PTSTYVFQKLACEYFAH

SEQ ID NO: 1052568 - protein, 17 aa, Mycobacterium
PTSVLQIHGTADDRVPY

SEQ ID NO: 1052569 - protein, 19 aa, Mycobacterium
PTTAEVFAANGPFVGTAQQ

SEQ ID NO: 1052570 - protein, 30 aa, Mycobacterium
PTTMPAGNGTPGFTGRDTGGPGGPGADSTE

SEQ ID NO: 1052571 - protein, 24 aa, Mycobacterium
PTVDAMLAQCCEWERELAAVAPDN

SEQ ID NO: 1052572 - protein, 23 aa, Mycobacterium
PTVGLDPVLRVDLWQQFAELARA

SEQ ID NO: 1052573 - protein, 22 aa, Mycobacterium
PTWQELWIELMSSFTTAEGFVY

SEQ ID NO: 1052574 - protein, 20 aa, Mycobacterium
PTYRLIKVTDIYAGTTPGSK

SEQ ID NO: 1052575 - protein, 24 aa, Mycobacterium
PTYSFARQRFWLGEGAGRKADSSD

SEQ ID NO: 1052576 - protein, 25 aa, Mycobacterium
PVAADRRCGPGLYSRQVAYAASLVA

SEQ ID NO: 1052577 - protein, 17 aa, Mycobacterium
PVAAFQDAISWGRAERA

SEQ ID NO: 1052578 - protein, 18 aa, Mycobacterium
PVADWLGEHGWRASATTS

SEQ ID NO: 1052579 - protein, 17 aa, Mycobacterium
PVAESLLALGLPGLSVN

SEQ ID NO: 1052580 - protein, 23 aa, Mycobacterium
PVAEVRKALMLRAEVPVITVDAR

SEQ ID NO: 1052581 - protein, 17 aa, Mycobacterium
PVAPMCDFTVMTRQGAI

SEQ ID NO: 1052582 - protein, 18 aa, Mycobacterium
PVATRLSGLEPLNITDDS

SEQ ID NO: 1052583 - protein, 17 aa, Mycobacterium
PVDEVWVGVVNEFDGKP

SEQ ID NO: 1052584 - protein, 21 aa, Mycobacterium
PVDRLTGWAWVPLTTDTARNA

SEQ ID NO: 1052585 - protein, 18 aa, Mycobacterium
PVEAGVYRVNRVVNPERV

SEQ ID NO: 1052586 - protein, 20 aa, Mycobacterium
PVEDRGRRYIAMVLVDSSGA

SEQ ID NO: 1052587 - protein, 18 aa, Mycobacterium
PVEGWGLYEHGALGRHDP

SEQ ID NO: 1052588 - protein, 19 aa, Mycobacterium
PVEQRAAVVAVDMQRYSIP

SEQ ID NO: 1052589 - protein, 23 aa, Mycobacterium
PVFNAPFSNFWLTPRQHRDALRT

SEQ ID NO: 1052590 - protein, 24 aa, Mycobacterium
PVFPGETLTTLIWRTEPGKAVYRT

SEQ ID NO: 1052591 - protein, 17 aa, Mycobacterium
PVGDFLSAGGHLQVSGR

SEQ ID NO: 1052592 - protein, 19 aa, Mycobacterium
PVGDPRPPLLPLDEHGRAK

SEQ ID NO: 1052593 - protein, 26 aa, Mycobacterium
PVGGWPEPLRSAALAGRAPAKPVGQL

SEQ ID NO: 1052594 - protein, 26 aa, Mycobacterium
PVGLARFCTLRSWLSQWSYDDARGDG

SEQ ID NO: 1052595 - protein, 24 aa, Mycobacterium
PVGNAGNITAYWKGYTEYHRDGII

SEQ ID NO: 1052596 - protein, 23 aa, Mycobacterium
PVGPGLYSWLPLGLRVLRNIERV

SEQ ID NO: 1052597 - protein, 21 aa, Mycobacterium
PVGPVGRRGCGAAVAPVALAP

SEQ ID NO: 1052598 - protein, 19 aa, Mycobacterium
PVHAVRLAGLVAHQEVLFG

SEQ ID NO: 1052599 - protein, 17 aa, Mycobacterium
PVHQLPQPIAWPGSSDR

SEQ ID NO: 1052600 - protein, 19 aa, Mycobacterium
PVIGTVMRQGYQLGEHVLR

SEQ ID NO: 1052601 - protein, 25 aa, Mycobacterium
PVIPPELRPLVQLDGGRFATSDLND

SEQ ID NO: 1052602 - protein, 18 aa, Mycobacterium
PVISRLGFDVCLDHSLAS

SEQ ID NO: 1052603 - protein, 23 aa, Mycobacterium
PVKAGGTCNRAAPSGATLAPSTR

SEQ ID NO: 1052604 - protein, 21 aa, Mycobacterium
PVKCEAWNPDTGKYGPIYDET

SEQ ID NO: 1052605 - protein, 22 aa, Mycobacterium
PVKGQGRGSVRHTAVADVGAAK

SEQ ID NO: 1052606 - protein, 19 aa, Mycobacterium
PVKPAPPFVPGHEGCGTVV

SEQ ID NO: 1052607 - protein, 23 aa, Mycobacterium
PVKTRKCVFCAKKDQAIDYKDTA

SEQ ID NO: 1052608 - protein, 23 aa, Mycobacterium
PVLECLRAGVPSTALYVALGVEA

SEQ ID NO: 1052609 - protein, 19 aa, Mycobacterium
PVLFGPAMRAMTAVAASDA

SEQ ID NO: 1052610 - protein, 22 aa, Mycobacterium
PVLKRTWGPEGLRMAEEADEVQ

SEQ ID NO: 1052611 - protein, 21 aa, Mycobacterium
PVLQPVFGVGMFGLAHDTLGV

SEQ ID NO: 1052612 - protein, 20 aa, Mycobacterium
PVLRACGFDTPYPPARLERL

SEQ ID NO: 1052613 - protein, 17 aa, Mycobacterium
PVLRPAPRAADDGFQVS

SEQ ID NO: 1052614 - protein, 17 aa, Mycobacterium
PVLTRGSAMGARTTCPA

SEQ ID NO: 1052615 - protein, 22 aa, Mycobacterium
PVLVKASAGGGGRGMRVVRELS

SEQ ID NO: 1052616 - protein, 22 aa, Mycobacterium
PVMLDMLRWHGAEEVEHKAVAF

SEQ ID NO: 1052617 - protein, 19 aa, Mycobacterium
PVMQGRTALYGPRHLLQVI

SEQ ID NO: 1052618 - protein, 26 aa, Mycobacterium
PVNGEMLIAIAGRVARAVVAESPGVQ

SEQ ID NO: 1052619 - protein, 18 aa, Mycobacterium
PVNGTVFAVTPTLREAYA

SEQ ID NO: 1052620 - protein, 17 aa, Mycobacterium
PVPEFPQQPALELDGWA

SEQ ID NO: 1052621 - protein, 18 aa, Mycobacterium
PVPGKPALLLGAFDLGGL

SEQ ID NO: 1052622 - protein, 18 aa, Mycobacterium
PVPGQSSGDLTSLQVRSD

SEQ ID NO: 1052623 - protein, 19 aa, Mycobacterium
PVPGVVMYPDVGGFRPTFQ

SEQ ID NO: 1052624 - protein, 26 aa, Mycobacterium
PVPLPTYPFQHHRYWLTTGPGNDAAG

SEQ ID NO: 1052625 - protein, 20 aa, Mycobacterium
PVPLRDGTQLMLRPVLPGDS

SEQ ID NO: 1052626 - protein, 26 aa, Mycobacterium
PVPPPRPELATAFPPSPPSPPLPAAP

SEQ ID NO: 1052627 - protein, 24 aa, Mycobacterium
PVPSCARWTIADLIWHVGVVHTFW

SEQ ID NO: 1052628 - protein, 18 aa, Mycobacterium
PVPTNFTSSLLLGSSAQV

SEQ ID NO: 1052629 - protein, 25 aa, Mycobacterium
PVPVAYHTFGGWKRSGFGDLNQHGP

SEQ ID NO: 1052630 - protein, 26 aa, Mycobacterium
PVQIVPVHAALPWSERVATPAEFDSI

SEQ ID NO: 1052631 - protein, 17 aa, Mycobacterium
PVQLVRIGRLYLIGIPG

SEQ ID NO: 1052632 - protein, 17 aa, Mycobacterium
PVRACPFDWSAQSRLAR

SEQ ID NO: 1052633 - protein, 20 aa, Mycobacterium
PVRADFSPALTLRSLTTATA

SEQ ID NO: 1052634 - protein, 25 aa, Mycobacterium
PVRCRRWAIGTGHPRPRRIWLPTSA

SEQ ID NO: 1052635 - protein, 24 aa, Mycobacterium
PVREAIHAVFLFHAIKAGLDMGIV

SEQ ID NO: 1052636 - protein, 20 aa, Mycobacterium
PVRIDRFEVLAVRPGPEVGL

SEQ ID NO: 1052637 - protein, 21 aa, Mycobacterium
PVRIDRFEVLAVRPGPEVGLA

SEQ ID NO: 1052638 - protein, 19 aa, Mycobacterium
PVRRGRIPINATVPAVPPA

SEQ ID NO: 1052639 - protein, 19 aa, Mycobacterium
PVRRPRGPALLDYIAEYRR

SEQ ID NO: 1052640 - protein, 19 aa, Mycobacterium
PVRTCVGCRKRELAVELLR

SEQ ID NO: 1052641 - protein, 17 aa, Mycobacterium
PVRWRPDNPDSIVDKNA

SEQ ID NO: 1052642 - protein, 24 aa, Mycobacterium
PVSASCRRGWRWLSTGSASPTSTR

SEQ ID NO: 1052643 - protein, 22 aa, Mycobacterium
PVSDLRASLPTAVLAPAADGLA

SEQ ID NO: 1052644 - protein, 18 aa, Mycobacterium
PVSEYGFEPVRFDEMRRG

SEQ ID NO: 1052645 - protein, 25 aa, Mycobacterium
PVSMLIPRVVGFKLTGEIQPGVTAT

SEQ ID NO: 1052646 - protein, 20 aa, Mycobacterium
PVSVCIGWGGLRIADVEKGL

SEQ ID NO: 1052647 - protein, 19 aa, Mycobacterium
PVSVVRPTTKYEMKAHNAG

SEQ ID NO: 1052648 - protein, 38 aa, Mycobacterium
PVTLVAGVPRPARGCSTRPVPPTGSAPMPRSYPTNGSA

SEQ ID NO: 1052649 - protein, 17 aa, Mycobacterium
PVTPWQHTQFWVEDRSG

SEQ ID NO: 1052650 - protein, 21 aa, Mycobacterium
PVTQWTRWRQPVIGMPSTPRF

SEQ ID NO: 1052651 - protein, 24 aa, Mycobacterium
PVTRIGMGIPYTWAKMQMTWSGQR

SEQ ID NO: 1052652 - protein, 17 aa, Mycobacterium
PVTVLLKALGWTSEQIT

SEQ ID NO: 1052653 - protein, 17 aa, Mycobacterium
PVVEALVGLGFAAKQAE

SEQ ID NO: 1052654 - protein, 20 aa, Mycobacterium
PVVERNASVYLWHDVEGRAP

SEQ ID NO: 1052655 - protein, 29 aa, Mycobacterium
PVVPYLHFEGLRTLALPLRIHLESAGFGI

SEQ ID NO: 1052656 - protein, 20 aa, Mycobacterium
PVVRERFGIGWSGVDEASYR

SEQ ID NO: 1052657 - protein, 20 aa, Mycobacterium
PVVRGEACADSFYAALESAV

SEQ ID NO: 1052658 - protein, 26 aa, Mycobacterium
PVWCSDIRAGAGLVLAGLVADGDTEV

SEQ ID NO: 1052659 - protein, 26 aa, Mycobacterium
PVYLEIGVSHGFAFRRIAADEKTAID

SEQ ID NO: 1052660 - protein, 17 aa, Mycobacterium
PWAKAVDESGRFRGRAE

SEQ ID NO: 1052661 - protein, 18 aa, Mycobacterium
PWAPVSLGDYCAGSNHVL

SEQ ID NO: 1052662 - protein, 20 aa, Mycobacterium
PWARLGVNVDADFEPLYIIS

SEQ ID NO: 1052663 - protein, 20 aa, Mycobacterium
PWARLGVNVDADFEPLYIIT

SEQ ID NO: 1052664 - protein, 19 aa, Mycobacterium
PWEPWLHALPVEFDSADQV

SEQ ID NO: 1052665 - protein, 21 aa, Mycobacterium
PWFLDAYRRAWEWADSTGWRP

SEQ ID NO: 1052666 - protein, 20 aa, Mycobacterium
PWGGVAQEPFLNVVLIADDP

SEQ ID NO: 1052667 - protein, 23 aa, Mycobacterium
PWGSLQRWATTRPKSAIIKRTEL

SEQ ID NO: 1052668 - protein, 18 aa, Mycobacterium
PWGVGSMLTELKHVLVEY

SEQ ID NO: 1052669 - protein, 23 aa, Mycobacterium
PWIRIADLDGRYLGQFTLRPNLA

SEQ ID NO: 1052670 - protein, 19 aa, Mycobacterium
PWLADLVRRSPWAEMFQSS

SEQ ID NO: 1052671 - protein, 17 aa, Mycobacterium
PWLDRAVEIAAGYGGTV

SEQ ID NO: 1052672 - protein, 23 aa, Mycobacterium
PWLPERWASWVPRLLWRRWSPTY

SEQ ID NO: 1052673 - protein, 18 aa, Mycobacterium
PWLVCVHGTEMGRAPLDL

SEQ ID NO: 1052674 - protein, 22 aa, Mycobacterium
PWPREVLDDLLAVLLAGPTAVV

SEQ ID NO: 1052675 - protein, 19 aa, Mycobacterium
PWPTYPLMYRVSAAHEEGG

SEQ ID NO: 1052676 - protein, 18 aa, Mycobacterium
PWQAEMEDAFGFTETVDQ

SEQ ID NO: 1052677 - protein, 18 aa, Mycobacterium
PWQEVLSGVSGRVASALE

SEQ ID NO: 1052678 - protein, 19 aa, Mycobacterium
PWRHFARTHAIGQIVPGKV

SEQ ID NO: 1052679 - protein, 21 aa, Mycobacterium
PWRHPELKAAGAAMATTALAS

SEQ ID NO: 1052680 - protein, 69 aa, Mycobacterium
PWRPNLSPRGLRWCRRRWWRLTVRTWCRWCFRIFSGKTRQRLPPWRRHMRRSGLSMCPVMSAYHSGASA

SEQ ID NO: 1052681 - protein, 27 aa, Mycobacterium
PWSEWLPQQRWYAGRNRELAAAEPGAV

SEQ ID NO: 1052682 - protein, 19 aa, Mycobacterium
PWTVSKLYYIHGFLRERMR

SEQ ID NO: 1052683 - protein, 24 aa, Mycobacterium
PWWHPIRLAHQMAYLDIISNGRYT

SEQ ID NO: 1052684 - protein, 18 aa, Mycobacterium
PYAAPRTRQHIFLAPANR

SEQ ID NO: 1052685 - protein, 17 aa, Mycobacterium
PYCGSPYSFLPQLSPGD

SEQ ID NO: 1052686 - protein, 18 aa, Mycobacterium
PYDLQAALADSTRTFEQV

SEQ ID NO: 1052687 - protein, 28 aa, Mycobacterium
PYDLVAEMPRFGWPTVVVSGGHDLTTPA

SEQ ID NO: 1052688 - protein, 27 aa, Mycobacterium
PYENEWGWTWPLNRRVLYNRASADPQG

SEQ ID NO: 1052689 - protein, 21 aa, Mycobacterium
PYFDDLFLMAAEQRFLSVERI

SEQ ID NO: 1052690 - protein, 18 aa, Mycobacterium
PYFDYLRRQSPVLRLPQY

SEQ ID NO: 1052691 - protein, 17 aa, Mycobacterium
PYGRLWATILQHRFGGS

SEQ ID NO: 1052692 - protein, 17 aa, Mycobacterium
PYLKVSVVTAGITADTI

SEQ ID NO: 1052693 - protein, 17 aa, Mycobacterium
PYLLLMGSLQVADEVTI

SEQ ID NO: 1052694 - protein, 17 aa, Mycobacterium
PYMVPLIDREIRRPTYV

SEQ ID NO: 1052695 - protein, 31 aa, Mycobacterium
PYNTLSFLWRELAGFSRDDWALPLAVVVEGR

SEQ ID NO: 1052696 - protein, 33 aa, Mycobacterium
PYPLCARLREHGRLHLPEANFVLFSSFGDCDEV

SEQ ID NO: 1052697 - protein, 29 aa, Mycobacterium
PYQYRLTSRYEIPCTVAGTVTVDGTHYRV

SEQ ID NO: 1052698 - protein, 19 aa, Mycobacterium
PYRASRSAFAFKDTLSAGI

SEQ ID NO: 1052699 - protein, 18 aa, Mycobacterium
PYRQRPTPIPTLEQAISA

SEQ ID NO: 1052700 - protein, 24 aa, Mycobacterium
PYSVLVAAFMVWIASYGRQRDMVV

SEQ ID NO: 1052701 - protein, 25 aa, Mycobacterium
PYVINPRMVRGLDYYTKTTFEFVHD

SEQ ID NO: 1052702 - protein, 18 aa, Mycobacterium
PYYVCVLAALGRLPDLVH

SEQ ID NO: 1052703 - protein, 20 aa, Mycobacterium
QAAADTPFFVWMNMTHMHLR

SEQ ID NO: 1052704 - protein, 25 aa, Mycobacterium
QAAAQRLPFLPIRAGLGSSVPDFWD

SEQ ID NO: 1052705 - protein, 23 aa, Mycobacterium
QAACSFCELTIVVQFGTMPYEQA

SEQ ID NO: 1052706 - protein, 26 aa, Mycobacterium
QAAEFHERFVRAMAAGAASYATAEAA

SEQ ID NO: 1052707 - protein, 25 aa, Mycobacterium
QAAELLERVSILLAPFDADEWESPS

SEQ ID NO: 1052708 - protein, 22 aa, Mycobacterium
QAAETFGILNLAGAGDHIVSSP

SEQ ID NO: 1052709 - protein, 17 aa, Mycobacterium
QAAGFSDGIQGGRWSRW

SEQ ID NO: 1052710 - protein, 22 aa, Mycobacterium
QAAGIARRTLFRYYASKNAIPW

SEQ ID NO: 1052711 - protein, 17 aa, Mycobacterium
QAAGLPVDFTGFVTHRD

SEQ ID NO: 1052712 - protein, 21 aa, Mycobacterium
QAAGVPVAFLTAWYGLSDLAG

SEQ ID NO: 1052713 - protein, 23 aa, Mycobacterium
QAAKLGAWGIIASVQPNFDARWG

SEQ ID NO: 1052714 - protein, 18 aa, Mycobacterium
QAANSSISRGFVKTLSTA

SEQ ID NO: 1052715 - protein, 20 aa, Mycobacterium
QAAPAMRLVSSVLSTNLAAA

SEQ ID NO: 1052716 - protein, 22 aa, Mycobacterium
QAAPRRPVIRPVPVDDSGFDVQ

SEQ ID NO: 1052717 - protein, 21 aa, Mycobacterium
QAAQFHSQFVQAMQAGAGSYA

SEQ ID NO: 1052718 - protein, 24 aa, Mycobacterium
QAARPRLGALAYRMLGSLADAEDV

SEQ ID NO: 1052719 - protein, 24 aa, Mycobacterium
QAARRCASVLLDLHVVDGRLRRAS

SEQ ID NO: 1052720 - protein, 21 aa, Mycobacterium
QAATFHAQFAQLMAANAGRYA

SEQ ID NO: 1052721 - protein, 27 aa, Mycobacterium
QADEFTCSSCFLVQHRSRLASEKNGVM

SEQ ID NO: 1052722 - protein, 28 aa, Mycobacterium
QADEFTCSSCFLVQHRSRLASEKNGVMI

SEQ ID NO: 1052723 - protein, 23 aa, Mycobacterium
QADKNNVCVLVITGNDRVSSGDF

SEQ ID NO: 1052724 - protein, 21 aa, Mycobacterium
QADLFHAQFVQLLNSGASAYT

SEQ ID NO: 1052725 - protein, 24 aa, Mycobacterium
QAEAAYRKGLSFAEAIETVELGEY

SEQ ID NO: 1052726 - protein, 21 aa, Mycobacterium
QAEGGAFYGPRGFYEAAGGGV

SEQ ID NO: 1052727 - protein, 21 aa, Mycobacterium
QAEGLGQLFVRLLTANFEEAV

SEQ ID NO: 1052728 - protein, 34 aa, Mycobacterium
QAEQRCGSLVWNLPRVFGPIAIAYRVNGLTSLNL

SEQ ID NO: 1052729 - protein, 25 aa, Mycobacterium
QAESIRKFCILPVDFTVLTGELTPT

SEQ ID NO: 1052730 - protein, 28 aa, Mycobacterium
QAFDGLRLAGRPVRRPDLTIATEDHNVP

SEQ ID NO: 1052731 - protein, 18 aa, Mycobacterium
QAFVEWRGQTRSELTEVG

SEQ ID NO: 1052732 - protein, 25 aa, Mycobacterium
QAGAFQTEFTRLLATAGDSYAITEA

SEQ ID NO: 1052733 - protein, 24 aa, Mycobacterium
QAGDAEAAFAHFGRRFDDLNTEIT

SEQ ID NO: 1052734 - protein, 24 aa, Mycobacterium
QAGEIYFEGGYSFEYLNDPSKTAA

SEQ ID NO: 1052735 - protein, 25 aa, Mycobacterium
QAGGAGGSAGLWGAGGAGGAGGSAT

SEQ ID NO: 1052736 - protein, 29 aa, Mycobacterium
QAGSRISAALNRYADWAQEMAGYAEAVGQ

SEQ ID NO: 1052737 - protein, 21 aa, Mycobacterium
QAIEDHLRYSLGRPAALLEPK

SEQ ID NO: 1052738 - protein, 25 aa, Mycobacterium
QAIGSAKAVCWCLDGGESSGRRRIR

SEQ ID NO: 1052739 - protein, 19 aa, Mycobacterium
QAIGVAFGATVDRAPELLH

SEQ ID NO: 1052740 - protein, 37 aa, Mycobacterium; identical to SEQ ID NO: 713455

SEQ ID NO: 1052741 - protein, 19 aa, Mycobacterium
QALEQQLLAAINAPTQTLL

SEQ ID NO: 1052742 - protein, 21 aa, Mycobacterium
QALLGRPLIGDGADGAPGQPG

SEQ ID NO: 1052743 - protein, 24 aa, Mycobacterium
QALLGRPLIGDGTAGAPGQNGGDG

SEQ ID NO: 1052744 - protein, 26 aa, Mycobacterium
QALLGRPLIGNGADGATVGRIGTPGG

SEQ ID NO: 1052745 - protein, 22 aa, Mycobacterium
QALLGRPLIGNGADGTAANPNG

SEQ ID NO: 1052746 - protein, 21 aa, Mycobacterium
QALNAGANWYAGVESANSSTL

SEQ ID NO: 1052747 - protein, 28 aa, Mycobacterium
QALQRLGQGGGFFSFGIMHYYMTGIHTP

SEQ ID NO: 1052748 - protein, 20 aa, Mycobacterium
QALRHICHWMCPTCRRGFEP

SEQ ID NO: 1052749 - protein, 23 aa, Mycobacterium
QALSELRLAGVDGPYSVLLAADV

SEQ ID NO: 1052750 - protein, 22 aa, Mycobacterium
QALSRAASRYAASEVANVEQNL

SEQ ID NO: 1052751 - protein, 21 aa, Mycobacterium
QALTGRPLIGNGANGAPGTGA

SEQ ID NO: 1052752 - protein, 19 aa, Mycobacterium
QALTGRPLIGNGTPGAAGS

SEQ ID NO: 1052753 - protein, 25 aa, Mycobacterium
QALYREGFFGLSWPREYGGRELAPV

SEQ ID NO: 1052754 - protein, 17 aa, Mycobacterium
QAMGIHAERILKLFGHE

SEQ ID NO: 1052755 - protein, 19 aa, Mycobacterium
QAMLDMPLEEFQRIQDTNV

SEQ ID NO: 1052756 - protein, 17 aa, Mycobacterium
QAMPETEQLIVGRNRDS

SEQ ID NO: 1052757 - protein, 17 aa, Mycobacterium
QAPHCILNTRISRNRRF

SEQ ID NO: 1052758 - protein, 17 aa, Mycobacterium
QAPLSFPIPGWNICVDF

SEQ ID NO: 1052759 - protein, 22 aa, Mycobacterium
QAQIPFGASVDGAVIGGLAGIS

SEQ ID NO: 1052760 - protein, 17 aa, Mycobacterium
QARARAAGWRVLLADEL

SEQ ID NO: 1052761 - protein, 17 aa, Mycobacterium
QARELLEPFGDRVSIAA

SEQ ID NO: 1052762 - protein, 27 aa, Mycobacterium
QARIEFKLRDWLFARQRYWGEPFPIVY

SEQ ID NO: 1052763 - protein, 23 aa, Mycobacterium
QARLAAVSMFGRLGRHAEVADAV

SEQ ID NO: 1052764 - protein, 22 aa, Mycobacterium
QARLLCEKAAWTIDRHGNKEAR

SEQ ID NO: 1052765 - protein, 19 aa, Mycobacterium
QARSITLTFIRNAQSQADA

SEQ ID NO: 1052766 - protein, 21 aa, Mycobacterium
QARVGSYLRYGAYPYAIAIRE

SEQ ID NO: 1052767 - protein, 29 aa, Mycobacterium
QASRLEAIGMQLQRSHSFFVGDPQIGKTL

SEQ ID NO: 1052768 - protein, 28 aa, Mycobacterium
QASSRYPGGLALRFARVVRYRDDKGPAD

SEQ ID NO: 1052769 - protein, 23 aa, Mycobacterium
QATAGAPAHDWLTLTGGAIGYGI

SEQ ID NO: 1052770 - protein, 25 aa, Mycobacterium
QATFRKLQLANRVELTRYAIEHGLD

SEQ ID NO: 1052771 - protein, 37 aa, Mycobacterium; identical to SEQ ID NO: 713608

SEQ ID NO: 1052772 - protein, 17 aa, Mycobacterium
QATREWLATNPARIGQA

SEQ ID NO: 1052773 - protein, 20 aa, Mycobacterium
QAVKLPWDLPERDMALILRG

SEQ ID NO: 1052774 - protein, 29 aa, Mycobacterium
QAVLGRPLIGDGANGWPNTGGDGGAGGLL

SEQ ID NO: 1052775 - protein, 18 aa, Mycobacterium
QAVRRCVATAVQRARAGA

SEQ ID NO: 1052776 - protein, 29 aa, Mycobacterium
QAYQRLANQLMAFHDQFAQALTAGASAYT

SEQ ID NO: 1052777 - protein, 19 aa, Mycobacterium
QAYRVLSIHAAEFHGSFVQ

SEQ ID NO: 1052778 - protein, 19 aa, Mycobacterium
QAYTLSLFASLAMSDVLPG

SEQ ID NO: 1052779 - protein, 19 aa, Mycobacterium
QAYYTGYGVAPAIKRTYQR

SEQ ID NO: 1052780 - protein, 18 aa, Mycobacterium
QCAEVVGILQTVFDFTAQ

SEQ ID NO: 1052781 - protein, 24 aa, Mycobacterium
QCDLRVVAPEAFFQFPTSKYGLAL

SEQ ID NO: 1052782 - protein, 21 aa, Mycobacterium
QCGRSAHTRRAYLGDLRSLLD

SEQ ID NO: 1052783 - protein, 20 aa, Mycobacterium
QCLDRLRPGPTMIEDRKLAW

SEQ ID NO: 1052784 - protein, 20 aa, Mycobacterium
QCPTLNYAVSVVEACMSADT

SEQ ID NO: 1052785 - protein, 27 aa, Mycobacterium
QCRGVCQDFAHLTLIVLRSMGIPGRYV

SEQ ID NO: 1052786 - protein, 28 aa, Mycobacterium
QCRGVCQDFAHLTLIVLRSMGIPGRYVS

SEQ ID NO: 1052787 - protein, 31 aa, Mycobacterium
QCRRERRPWVPAAICLADFGAVSTKQQEPYG

SEQ ID NO: 1052788 - protein, 21 aa, Mycobacterium
QCYVGASFLRPVECAQRHRIG

SEQ ID NO: 1052789 - protein, 23 aa, Mycobacterium
QDAAAIGEICRRLDGIPLAIELA

SEQ ID NO: 1052790 - protein, 18 aa, Mycobacterium
QDAEWIRTRVTDVVQDAH

SEQ ID NO: 1052791 - protein, 19 aa, Mycobacterium
QDAKPVIGTVMRQGYQLGE

SEQ ID NO: 1052792 - protein, 29 aa, Mycobacterium
QDEVSAAIAAQFSGHGLAYQQLSTQVGVF

SEQ ID NO: 1052793 - protein, 22 aa, Mycobacterium
QDEVSQAIAAVFSTHAQAYQAA

SEQ ID NO: 1052794 - protein, 18 aa, Mycobacterium
QDFLDKVPHAEFVELSNA

SEQ ID NO: 1052795 - protein, 18 aa, Mycobacterium
QDFSLFHVLRYGFRPSKI

SEQ ID NO: 1052796 - protein, 18 aa, Mycobacterium
QDFYGTVFGWTFESAGPE

SEQ ID NO: 1052797 - protein, 22 aa, Mycobacterium
QDGGAGGWLLGDGGAGGSGEAG

SEQ ID NO: 1052798 - protein, 17 aa, Mycobacterium
QDGLWLRIMDVVPALEA

SEQ ID NO: 1052799 - protein, 18 aa, Mycobacterium
QDISGGTIFAYWVANPTA

SEQ ID NO: 1052800 - protein, 24 aa, Mycobacterium
QDLSELLWSFAPPARPRPATLAEI

SEQ ID NO: 1052801 - protein, 19 aa, Mycobacterium
QDLWPAPRPDSSSLPYPAV

SEQ ID NO: 1052802 - protein, 27 aa, Mycobacterium
QDPFDAVVCSLVLCSVTDQLGVLQHLR

SEQ ID NO: 1052803 - protein, 21 aa, Mycobacterium
QDPRADYAIARVSGDGSLQAR

SEQ ID NO: 1052804 - protein, 23 aa, Mycobacterium
QDQMSVLTGHIFAGHLRSIIGSM

SEQ ID NO: 1052805 - protein, 23 aa, Mycobacterium
QDRRGAAEPLGLRLDTSPAQLRA

SEQ ID NO: 1052806 - protein, 20 aa, Mycobacterium
QDRTSLVGFVVWQDNMHEDL

SEQ ID NO: 1052807 - protein, 25 aa, Mycobacterium
QDSALSPRGYRAMSGIPRLQFSHTD

SEQ ID NO: 1052808 - protein, 18 aa, Mycobacterium
QDSDPHWPLLQAERSALL

SEQ ID NO: 1052809 - protein, 22 aa, Mycobacterium
QDSRLPLRPANFVSGLESMPVV

SEQ ID NO: 1052810 - protein, 19 aa, Mycobacterium
QDTAYAWAYNLGKGGKTRI

SEQ ID NO: 1052811 - protein, 24 aa, Mycobacterium
QDVETRLPVAKGIFSVLSTDKDAS

SEQ ID NO: 1052812 - protein, 20 aa, Mycobacterium
QDVPEPLSGYVQKLRRYAYR

SEQ ID NO: 1052813 - protein, 18 aa, Mycobacterium
QEALLPAMDAVRCAADTL

SEQ ID NO: 1052814 - protein, 20 aa, Mycobacterium
QEAWLRLNATTDRPEGAQEL

SEQ ID NO: 1052815 - protein, 23 aa, Mycobacterium
QEDAKFVYVDGHLYSDLGQPGTY

SEQ ID NO: 1052816 - protein, 18 aa, Mycobacterium
QEDKRWTPQWTDDQRAAG

SEQ ID NO: 1052817 - protein, 19 aa, Mycobacterium
QEDPFGKWLEHWHPDHDPF

SEQ ID NO: 1052818 - protein, 18 aa, Mycobacterium
QEGLGFFGAAIVDQKLSS

SEQ ID NO: 1052819 - protein, 17 aa, Mycobacterium
QEHCWRVGVVAQSHATV

SEQ ID NO: 1052820 - protein, 23 aa, Mycobacterium
QEIARICFYAGQLGDRRVVLTAA

SEQ ID NO: 1052821 - protein, 24 aa, Mycobacterium
QEIDLRFADALSMADNVMTFRYVI

SEQ ID NO: 1052822 - protein, 19 aa, Mycobacterium
QEILFPALLPRAPYETTNR

SEQ ID NO: 1052823 - protein, 21 aa, Mycobacterium
QEIMTELEIAPTRRLRGLGDR

SEQ ID NO: 1052824 - protein, 23 aa, Mycobacterium
QEITRSRCAAISVPGDRSTEKLV

SEQ ID NO: 1052825 - protein, 22 aa, Mycobacterium
QELESAAALLAGVGSNVGAASS

SEQ ID NO: 1052826 - protein, 24 aa, Mycobacterium
QELMATRGPAYWLKHNPYAEWYQN

SEQ ID NO: 1052827 - protein, 20 aa, Mycobacterium
QELPNRVAIQLNDTHPSIAV

SEQ ID NO: 1052828 - protein, 23 aa, Mycobacterium
QELRDLLDVAFRSSNDFIDATIA

SEQ ID NO: 1052829 - protein, 23 aa, Mycobacterium
QELYLPDVIAILRRDGQTVSARH

SEQ ID NO: 1052830 - protein, 17 aa, Mycobacterium
QEMLWNRLCEALTPGNV

SEQ ID NO: 1052831 - protein, 25 aa, Mycobacterium
QEPTVLPSRFPNLLANGSGGIAVGM

SEQ ID NO: 1052832 - protein, 24 aa, Mycobacterium
QERRTDWLNNFYFGGDHGVSDSVA

SEQ ID NO: 1052833 - protein, 22 aa, Mycobacterium
QESLTKLQSSWHGSGNESYSSV

SEQ ID NO: 1052834 - protein, 19 aa, Mycobacterium
QESYLRWAAVDLSAVRDTK

SEQ ID NO: 1052835 - protein, 27 aa, Mycobacterium
QETNWLEWKSTLDLSVAAGKFAVAKAV

SEQ ID NO: 1052836 - protein, 24 aa, Mycobacterium
QEVCALLAGGGYAEYVAVPAGQVL

SEQ ID NO: 1052837 - protein, 22 aa, Mycobacterium
QEVDAEFALPSRRLVQIMVANA

SEQ ID NO: 1052838 - protein, 18 aa, Mycobacterium
QEVLKYGRTSGVELADYD

SEQ ID NO: 1052839 - protein, 21 aa, Mycobacterium
QEYGLPIAIKAAFGGGGRGMK

SEQ ID NO: 1052840 - protein, 20 aa, Mycobacterium
QFDEAYSFGGLPTGRGGKFT

SEQ ID NO: 1052841 - protein, 21 aa, Mycobacterium
QFDKPYLLAMANAGPGTNGSQ

SEQ ID NO: 1052842 - protein, 23 aa, Mycobacterium
QFGRPLAKFHAVQNLIADIAAET

SEQ ID NO: 1052843 - protein, 18 aa, Mycobacterium
QFHLSRLQVINWGVFDGY

SEQ ID NO: 1052844 - protein, 20 aa, Mycobacterium
QFIDYCVDLLLGTAAAYAPH

SEQ ID NO: 1052845 - protein, 17 aa, Mycobacterium
QFNASPVAQGWLHSFLA

SEQ ID NO: 1052846 - protein, 17 aa, Mycobacterium
QFPAYSLTALIGGDLSK

SEQ ID NO: 1052847 - protein, 19 aa, Mycobacterium
QFQFRSAATTSEYAARGNA

SEQ ID NO: 1052848 - protein, 18 aa, Mycobacterium
QFRDLICARAVDIAIGPA

SEQ ID NO: 1052849 - protein, 18 aa, Mycobacterium
QFRVPRKVVKGGSFLCAD

SEQ ID NO: 1052850 - protein, 22 aa, Mycobacterium
QFTANPWLAGYMQQALGLLTTE

SEQ ID NO: 1052851 - protein, 17 aa, Mycobacterium
QFVPAMFTRMLKLPESI

SEQ ID NO: 1052852 - protein, 22 aa, Mycobacterium
QFVSSPGYEHAWLNPDNTEVSI

SEQ ID NO: 1052853 - protein, 27 aa, Mycobacterium
QFYHPLDMFGEWNRAYGPAGFLQYQFV

SEQ ID NO: 1052854 - protein, 17 aa, Mycobacterium
QGAECASMVWSAQDDLA

SEQ ID NO: 1052855 - protein, 20 aa, Mycobacterium
QGAGVFLHLTVGDNIGIVPR

SEQ ID NO: 1052856 - protein, 24 aa, Mycobacterium
QGAWMCGAAVTMLHQPTHRSDLQA

SEQ ID NO: 1052857 - protein, 24 aa, Mycobacterium
QGAWPRFGLELPELLPEKLSGVKR

SEQ ID NO: 1052858 - protein, 22 aa, Mycobacterium
QGCCVVGWPTLHGFEYGTERYV

SEQ ID NO: 1052859 - protein, 18 aa, Mycobacterium
QGDLGFFWVTAVTADATI

SEQ ID NO: 1052860 - protein, 23 aa, Mycobacterium
QGESRAGYNGALDIDLVFSSFFN

SEQ ID NO: 1052861 - protein, 26 aa, Mycobacterium
QGGAGGRGGLLIGLGGNGGTGGFSGP

SEQ ID NO: 1052862 - protein, 20 aa, Mycobacterium
QGGGGGRGFDGSLGAGGAEG

SEQ ID NO: 1052863 - protein, 21 aa, Mycobacterium
QGGGSKATWVLAPRSLATGRE

SEQ ID NO: 1052864 - protein, 28 aa, Mycobacterium
QGGLKKAVFDWSIGVGLKVSASRQAGRQ

SEQ ID NO: 1052865 - protein, 25 aa, Mycobacterium
QGGTGGRAGLLIGNAGAGGAGGEGT

SEQ ID NO: 1052866 - protein, 23 aa, Mycobacterium
QGHLPGVVARMFFLHAAAQRSIT

SEQ ID NO: 1052867 - protein, 28 aa, Mycobacterium
QGHWLLARLGKRVLRPGGVELTRTLLAR

SEQ ID NO: 1052868 - protein, 17 aa, Mycobacterium
QGISSAHSWAVTQHPTV

SEQ ID NO: 1052869 - protein, 22 aa, Mycobacterium
QGIYQCRACGAELFRSTEKFES

SEQ ID NO: 1052870 - protein, 26 aa, Mycobacterium
QGKFPYRNDGALGWFGTSPVGTFPAN

SEQ ID NO: 1052871 - protein, 17 aa, Mycobacterium
QGLAQGYALRLADRLVD

SEQ ID NO: 1052872 - protein, 25 aa, Mycobacterium
QGLEAAKPFIAALCTAQQELADASG

SEQ ID NO: 1052873 - protein, 18 aa, Mycobacterium
QGLKSLICDAMLSVASDR

SEQ ID NO: 1052874 - protein, 17 aa, Mycobacterium
QGLRADDAMIMFTGGTT

SEQ ID NO: 1052875 - protein, 18 aa, Mycobacterium
QGLWAAHLRPEVGGQGFG

SEQ ID NO: 1052876 - protein, 17 aa, Mycobacterium
QGMCTAGAFYFINESDV

SEQ ID NO: 1052877 - protein, 18 aa, Mycobacterium
QGMQRFAPLNSWPDNVSL

SEQ ID NO: 1052878 - protein, 19 aa, Mycobacterium
QGPAGWLRAKTGSLTAINS

SEQ ID NO: 1052879 - protein, 20 aa, Mycobacterium
QGPAGWLRAKTGSLTAINSL

SEQ ID NO: 1052880 - protein, 18 aa, Mycobacterium
QGPPGRAPIPVYGPGPAG

SEQ ID NO: 1052881 - protein, 26 aa, Mycobacterium
QGQCPPRQFQRARVVVFAGDHGITRS

SEQ ID NO: 1052882 - protein, 18 aa, Mycobacterium
QGQLLSWGLPATHALVET

SEQ ID NO: 1052883 - protein, 17 aa, Mycobacterium
QGRFPEFTTPDPSYHGV

SEQ ID NO: 1052884 - protein, 23 aa, Mycobacterium
QGRKAEFAEHGWDADEIPDPQDP

SEQ ID NO: 1052885 - protein, 26 aa, Mycobacterium
QGTSSRGAWQFIAPTFAAYHQPGTST

SEQ ID NO: 1052886 - protein, 22 aa, Mycobacterium
QGVPISAILFGGRRKTTVPLVT

SEQ ID NO: 1052887 - protein, 23 aa, Mycobacterium
QGVPKTGAFWHIDYMFMPEPFAF

SEQ ID NO: 1052888 - protein, 20 aa, Mycobacterium
QGVQRFYVWFADFAAADTLA

SEQ ID NO: 1052889 - protein, 20 aa, Mycobacterium
QGWDMHPGHLVTRWLATFTF

SEQ ID NO: 1052890 - protein, 24 aa, Mycobacterium
QGYRRLRAQLAAFHEQFVQAVSTS

SEQ ID NO: 1052891 - protein, 19 aa, Mycobacterium
QHAVEGWKQIGAPDVLDVV

SEQ ID NO: 1052892 - protein, 18 aa, Mycobacterium
QHAWQHFQAIEARGGFAN

SEQ ID NO: 1052893 - protein, 22 aa, Mycobacterium
QHCADRMGLGFLANVGTAATAR

SEQ ID NO: 1052894 - protein, 33 aa, Mycobacterium
QHDLFNRDAVFGIQLYVKRVFIMGDCDQLMPEY

SEQ ID NO: 1052895 - protein, 22 aa, Mycobacterium
QHLAKLRMARLVRTRRDKTTIF

SEQ ID NO: 1052896 - protein, 17 aa, Mycobacterium
QHLRGVVTVCGQTYEIG

SEQ ID NO: 1052897 - protein, 21 aa, Mycobacterium
QHPGYRLSVRATRSQGRLDLS

SEQ ID NO: 1052898 - protein, 25 aa, Mycobacterium
QHPKMPLVPLIDGWESVAEMEAALG

SEQ ID NO: 1052899 - protein, 23 aa, Mycobacterium
QHPRCVYQILKRHYARYTPEMVE

SEQ ID NO: 1052900 - protein, 24 aa, Mycobacterium
QHRWRDGVMKLVFMGVPLRGVSSL

SEQ ID NO: 1052901 - protein, 18 aa, Mycobacterium
QHSYMLGSYSEWEPVAEM

SEQ ID NO: 1052902 - protein, 28 aa, Mycobacterium
QHVKPGKGPAFVRTKLKNVLSGKVVDKT

SEQ ID NO: 1052903 - protein, 20 aa, Mycobacterium
QHYQGEPLGGFTGWRPQMPV

SEQ ID NO: 1052904 - protein, 19 aa, Mycobacterium
QIAELLVRAVGRSHQVRVA

SEQ ID NO: 1052905 - protein, 24 aa, Mycobacterium
QIDPRWSKLADMFTPDGPEATGRG

SEQ ID NO: 1052906 - protein, 27 aa, Mycobacterium
QIEQFRLLVLRTAWLIDKHHDYQKVRR

SEQ ID NO: 1052907 - protein, 25 aa, Mycobacterium
QILPSNTVSLGWSSWAIQWLSRIPA

SEQ ID NO: 1052908 - protein, 22 aa, Mycobacterium
QIRPDGWWARCSRHGQVDSSEL

SEQ ID NO: 1052909 - protein, 17 aa, Mycobacterium
QIRRFDNDWALVHVTVN

SEQ ID NO: 1052910 - protein, 23 aa, Mycobacterium
QIRVADEWGELVAYLDMGWEELM

SEQ ID NO: 1052911 - protein, 17 aa, Mycobacterium
QKADAAYRRRNFTPEAT

SEQ ID NO: 1052912 - protein, 19 aa, Mycobacterium
QKASRIRQITAIKTRESLQ

SEQ ID NO: 1052913 - protein, 30 aa, Mycobacterium
QKFDGPYFVMQWLLRQPHRAILPVAGDPTM

SEQ ID NO: 1052914 - protein, 20 aa, Mycobacterium
QKLKVLVSIFGRETPVELTF

SEQ ID NO: 1052915 - protein, 24 aa, Mycobacterium
QKPVGTVCFCVLVGDGRNVTRTLR

SEQ ID NO: 1052916 - protein, 27 aa, Mycobacterium
QKRLRQYRYEFLDADGYPTTVDPPAAE

SEQ ID NO: 1052917 - protein, 24 aa, Mycobacterium
QKRREFLTDVSLLGGLIIASADTA

SEQ ID NO: 1052918 - protein, 17 aa, Mycobacterium
QKSAYLFGATHGAGSIS

SEQ ID NO: 1052919 - protein, 32 aa, Mycobacterium; identical to SEQ ID NO: 623251

SEQ ID NO: 1052920 - protein, 18 aa, Mycobacterium
QKVEAGWVAVRRSNATPI

SEQ ID NO: 1052921 - protein, 20 aa, Mycobacterium
QKVIYSIQWLVVNSLGHQLP

SEQ ID NO: 1052922 - protein, 19 aa, Mycobacterium
QLAEWEWPEHPRFLMCTPL

SEQ ID NO: 1052923 - protein, 30 aa, Mycobacterium
QLAGGFARYSVDKAWVVPHFEKMLYDNALL

SEQ ID NO: 1052924 - protein, 22 aa, Mycobacterium
QLAGKARLRIALAAPTGKAAAR

SEQ ID NO: 1052925 - protein, 24 aa, Mycobacterium
QLALRLAAELGVVGVLAVELFETT

SEQ ID NO: 1052926 - protein, 23 aa, Mycobacterium
QLALVLRGKYLVDVQSVTKVKGV

SEQ ID NO: 1052927 - protein, 22 aa, Mycobacterium
QLARHLGAPAVRLEQLHADYLA

SEQ ID NO: 1052928 - protein, 24 aa, Mycobacterium
QLASTRSGVFWIRDILPVQKLREI

SEQ ID NO: 1052929 - protein, 27 aa, Mycobacterium
QLAVYRMAWAALRGCPESSVRTAFHYV

SEQ ID NO: 1052930 - protein, 31 aa, Mycobacterium
QLCDAWAQRGWLAFRYNLPYRRRRPKGPPSG

SEQ ID NO: 1052931 - protein, 29 aa, Mycobacterium
QLDKKWLKPTAYMMAKFGMTLCALGIAEE

SEQ ID NO: 1052932 - protein, 24 aa, Mycobacterium
QLDLPAADAIMLLAAHISRHGTLT

SEQ ID NO: 1052933 - protein, 19 aa, Mycobacterium
QLDVMRVPGIIVARTDAEA

SEQ ID NO: 1052934 - protein, 26 aa, Mycobacterium
QLDWLLGNGGLDWAVKRTADSSQRLY

SEQ ID NO: 1052935 - protein, 17 aa, Mycobacterium
QLEVKRFNSAEGVHNYF

SEQ ID NO: 1052936 - protein, 24 aa, Mycobacterium
QLFFPEPRCRVVTAVGPYDPGERS

SEQ ID NO: 1052937 - protein, 24 aa, Mycobacterium
QLGEIPVLLARTGYTREDGFELYV

SEQ ID NO: 1052938 - protein, 31 aa, Mycobacterium
QLGLRLALDRSFADWGMRLVFLRVGGVTIEI

SEQ ID NO: 1052939 - protein, 19 aa, Mycobacterium
QLHGGYGYMREYPVARAYL

SEQ ID NO: 1052940 - protein, 18 aa, Mycobacterium
QLHIPAHLAYGDRCAGGV

SEQ ID NO: 1052941 - protein, 22 aa, Mycobacterium
QLHRRTCNVVRELKACGATGDR

SEQ ID NO: 1052942 - protein, 20 aa, Mycobacterium
QLIRAGEKVVMFYASGNWDE

SEQ ID NO: 1052943 - protein, 22 aa, Mycobacterium
QLLADLSFADYLMWVSRDDGVL

SEQ ID NO: 1052944 - protein, 17 aa, Mycobacterium
QLLADRGLLSGLLSQDE

SEQ ID NO: 1052945 - protein, 19 aa, Mycobacterium
QLLETAWEAIEHAGLDPAS

SEQ ID NO: 1052946 - protein, 27 aa, Mycobacterium
QLLLGGLPVRRLWGIGPVAEEKLHRLG

SEQ ID NO: 1052947 - protein, 24 aa, Mycobacterium
QLLPLRPLLRNGWSQRGKSKLDLA

SEQ ID NO: 1052948 - protein, 24 aa, Mycobacterium
QLLPRLEAGMIPKVEGCLRAVTGG

SEQ ID NO: 1052949 - protein, 25 aa, Mycobacterium
QLMKAALPLGLWVPVLPGTRQVTIG

SEQ ID NO: 1052950 - protein, 25 aa, Mycobacterium
QLMQKPRSTPGYVVVQGAVIFASAD

SEQ ID NO: 1052951 - protein, 26 aa, Mycobacterium
QLNRLRRWYCDGALCIGDAAHAMSPV

SEQ ID NO: 1052952 - protein, 19 aa, Mycobacterium
QLNSIALYLNFDMLGSPNA

SEQ ID NO: 1052953 - protein, 17 aa, Mycobacterium
QLPDLAGRHVAVIGQGS

SEQ ID NO: 1052954 - protein, 18 aa, Mycobacterium
QLPGHKVYPWVAKVRHST

SEQ ID NO: 1052955 - protein, 18 aa, Mycobacterium
QLPGLPVYVYDNNAQGYP

SEQ ID NO: 1052956 - protein, 21 aa, Mycobacterium
QLPKICLDIGRGVRGTIGHTQ

SEQ ID NO: 1052957 - protein, 22 aa, Mycobacterium
QLPPRPVTFSALSQERPSSTVI

SEQ ID NO: 1052958 - protein, 29 aa, Mycobacterium
QLQPGRVVVLPWDRHIAAGTEIHLDQLGP

SEQ ID NO: 1052959 - protein, 20 aa, Mycobacterium
QLRAKRAWDEHRFDREISPI

SEQ ID NO: 1052960 - protein, 23 aa, Mycobacterium
QLREELGALLLQVLFQARIAQDA

SEQ ID NO: 1052961 - protein, 27 aa, Mycobacterium
QLRGFHDQLVRLMRAGAAAYASVEATA

SEQ ID NO: 1052962 - protein, 18 aa, Mycobacterium
QLRIWLLDRRNAGGPELC

SEQ ID NO: 1052963 - protein, 19 aa, Mycobacterium
QLRLERVVLVGVWTEGTAA

SEQ ID NO: 1052964 - protein, 27 aa, Mycobacterium
QLRQRLATAPVIIEWCQLPAGTTRQAY

SEQ ID NO: 1052965 - protein, 19 aa, Mycobacterium
QLRRLPLVIVANGVLTRSV

SEQ ID NO: 1052966 - protein, 25 aa, Mycobacterium
QLRSRSWWSGFDVVLLVDDWHMIVG

SEQ ID NO: 1052967 - protein, 23 aa, Mycobacterium
QLSRARALLLGRDYVIPEDVKAL

SEQ ID NO: 1052968 - protein, 18 aa, Mycobacterium
QLTLKVVPLFTLHRDDEL

SEQ ID NO: 1052969 - protein, 18 aa, Mycobacterium
QLTMRVFTGLTMLDTIQG

SEQ ID NO: 1052970 - protein, 24 aa, Mycobacterium
QLTQPVRWDLCTATIREHSVTAIV

SEQ ID NO: 1052971 - protein, 26 aa, Mycobacterium
QLTVRIRKGGVLVRTCPPNVRDLPPL

SEQ ID NO: 1052972 - protein, 27 aa, Mycobacterium
QLTVRYALRRAGALRVWPQRARAYREI

SEQ ID NO: 1052973 - protein, 17 aa, Mycobacterium
QLVREWTSDAVKDGVLA

SEQ ID NO: 1052974 - protein, 17 aa, Mycobacterium
QLVVPILNARFALNAAN

SEQ ID NO: 1052975 - protein, 17 aa, Mycobacterium
QLVVSGWSAGAGTAAVV

SEQ ID NO: 1052976 - protein, 19 aa, Mycobacterium
QLWARLSVFAGSFDLDLAH

SEQ ID NO: 1052977 - protein, 17 aa, Mycobacterium
QLWDQVIGVLTSNFEQA

SEQ ID NO: 1052978 - protein, 25 aa, Mycobacterium
QLWRSMAGRCGHLYTGHSVVRLTEQ

SEQ ID NO: 1052979 - protein, 23 aa, Mycobacterium
QMAEPKWVLAMGVCASSGGMFNN

SEQ ID NO: 1052980 - protein, 21 aa, Mycobacterium
QMALPPCHAFFQFYVADGRLS

SEQ ID NO: 1052981 - protein, 23 aa, Mycobacterium
QMCKTIPLEAPWEAKRAAKWDRM

SEQ ID NO: 1052982 - protein, 24 aa, Mycobacterium
QMDGRMGFEVKIHRAAADGAAVLT

SEQ ID NO: 1052983 - protein, 17 aa, Mycobacterium
QMENGHVVVCGRVKDVI

SEQ ID NO: 1052984 - protein, 17 aa, Mycobacterium
QMFGRHGLHLGGLDAQL

SEQ ID NO: 1052985 - protein, 26 aa, Mycobacterium
QMGIGGGWYEHEWRAYGYGFPSAGVR

SEQ ID NO: 1052986 - protein, 22 aa, Mycobacterium
QMIADRELETWMVIDMSASLDF

SEQ ID NO: 1052987 - protein, 24 aa, Mycobacterium
QMLTGRPLIGNGANGVDGTGAAGG

SEQ ID NO: 1052988 - protein, 25 aa, Mycobacterium
QMNPKLVQDFAKGLAPYVANIAGDS

SEQ ID NO: 1052989 - protein, 24 aa, Mycobacterium
QMPDAMAVRARFFDAFFQDATRAG

SEQ ID NO: 1052990 - protein, 21 aa, Mycobacterium
QMPDERTYFWIARTTTAEPSR

SEQ ID NO: 1052991 - protein, 26 aa, Mycobacterium
QMPIHMRLPKLKGFRNRFRTEYEIVN

SEQ ID NO: 1052992 - protein, 17 aa, Mycobacterium
QMRSIGVPLGMSDPDKP

SEQ ID NO: 1052993 - protein, 28 aa, Mycobacterium
QMSRAGWSAVRWRNLTGGIVALHAGYKP

SEQ ID NO: 1052994 - protein, 19 aa, Mycobacterium
QMVKIAAAVRLHKQAHLPY

SEQ ID NO: 1052995 - protein, 17 aa, Mycobacterium
QMVRHVFHVSGAAAKKD

SEQ ID NO: 1052996 - protein, 26 aa, Mycobacterium
QNARLAARLTGWWIDIRGDSPEQSAE

SEQ ID NO: 1052997 - protein, 21 aa, Mycobacterium
QNERSRLAVNQGRTADDPMDR

SEQ ID NO: 1052998 - protein, 17 aa, Mycobacterium
QNIFGVWPVTGEVSEQL

SEQ ID NO: 1052999 - protein, 19 aa, Mycobacterium
QNKIRAMQVLGARLQAIAE

SEQ ID NO: 1053000 - protein, 21 aa, Mycobacterium
QNLRGGGPVRLKSSGKDYFDL

SEQ ID NO: 1053001 - protein, 25 aa, Mycobacterium
QNLSELPGRVIAAFGNGAPATTVTA

SEQ ID NO: 1053002 - protein, 19 aa, Mycobacterium
QNRFSWKNTGQILADTGLH

SEQ ID NO: 1053003 - protein, 18 aa, Mycobacterium
QNRVRATRIEFWAFDLLF

SEQ ID NO: 1053004 - protein, 19 aa, Mycobacterium
QNTCRWRDLRKITIAQVQG

SEQ ID NO: 1053005 - protein, 20 aa, Mycobacterium
QNVRLPWQLDGTEYVLHLID

SEQ ID NO: 1053006 - protein, 19 aa, Mycobacterium
QNYRCPFGVGGERGVDLAV

SEQ ID NO: 1053007 - protein, 19 aa, Mycobacterium
QPAAVSWFRPTAHIVDTDP

SEQ ID NO: 1053008 - protein, 25 aa, Mycobacterium
QPACGKSGCSTYKWETFLTSELPEW

SEQ ID NO: 1053009 - protein, 17 aa, Mycobacterium
QPAEMYSAICIAATLIV

SEQ ID NO: 1053010 - protein, 27 aa, Mycobacterium
QPAISLPLEWTPEGLPLGVQLVAAYGR

SEQ ID NO: 1053011 - protein, 29 aa, Mycobacterium
QPEAMTPHWGRGTLVGKLTVPPSWAAATP

SEQ ID NO: 1053012 - protein, 18 aa, Mycobacterium
QPEAYTWLTAELANLRLA

SEQ ID NO: 1053013 - protein, 22 aa, Mycobacterium
QPELRKGRYPDRKTARRVSEVV

SEQ ID NO: 1053014 - protein, 24 aa, Mycobacterium
QPFGRALPQYGFRPTFVARPPAAG

SEQ ID NO: 1053015 - protein, 17 aa, Mycobacterium
QPFRALIQAVLRHSGGV

SEQ ID NO: 1053016 - protein, 25 aa, Mycobacterium
QPGCISYEPAFAIDVEWTLLASLAR

SEQ ID NO: 1053017 - protein, 18 aa, Mycobacterium
QPGHIELVLAHHSDIAEI

SEQ ID NO: 1053018 - protein, 24 aa, Mycobacterium
QPHAKGGGAHGHFEVTHDVSKYTR

SEQ ID NO: 1053019 - protein, 17 aa, Mycobacterium
QPIDHQIHVGFPLVDHD

SEQ ID NO: 1053020 - protein, 18 aa, Mycobacterium
QPIDHQIHVGFPLVDHDF

SEQ ID NO: 1053021 - protein, 22 aa, Mycobacterium
QPIRRYHVDAAILFSDIVVPLR

SEQ ID NO: 1053022 - protein, 18 aa, Mycobacterium
QPLACVLYACAQLPDLAG

SEQ ID NO: 1053023 - protein, 18 aa, Mycobacterium
QPLAQIGDLARRTQAAGL

SEQ ID NO: 1053024 - protein, 17 aa, Mycobacterium
QPLGVVLAVMPWNFPLW

SEQ ID NO: 1053025 - protein, 17 aa, Mycobacterium
QPLLGRVVADLARATAA

SEQ ID NO: 1053026 - protein, 18 aa, Mycobacterium
QPLMPQLIRSWLGRRSQT

SEQ ID NO: 1053027 - protein, 17 aa, Mycobacterium
QPLRDIWLLRMRTALAG

SEQ ID NO: 1053028 - protein, 17 aa, Mycobacterium
QPMVAILWGRDASTLKS

SEQ ID NO: 1053029 - protein, 23 aa, Mycobacterium
QPNIAGLILRLAQLTKRSIDADI

SEQ ID NO: 1053030 - protein, 23 aa, Mycobacterium
QPPRGRKAAVLGSPIAHSRSPQL

SEQ ID NO: 1053031 - protein, 17 aa, Mycobacterium
QPPWRPDRLEQHEYQPF

SEQ ID NO: 1053032 - protein, 22 aa, Mycobacterium
QPRALARHNCRDRPQVNDVAQV

SEQ ID NO: 1053033 - protein, 20 aa, Mycobacterium
QPRMTKLVWKVTEIDPGVSW

SEQ ID NO: 1053034 - protein, 19 aa, Mycobacterium
QPTEFNDIVAVLALYRPGP

SEQ ID NO: 1053035 - protein, 19 aa, Mycobacterium
QPTIPGWRAETLGDDIAWM

SEQ ID NO: 1053036 - protein, 27 aa, Mycobacterium
QPVRSGADLQQCWRQYVAGEVTEYPVN

SEQ ID NO: 1053037 - protein, 24 aa, Mycobacterium
QPVYRVAAKLRLMADELIERDSGI

SEQ ID NO: 1053038 - protein, 22 aa, Mycobacterium
QPWVIRELSLHQLLHVTDGTKL

SEQ ID NO: 1053039 - protein, 22 aa, Mycobacterium
QPYSVCLPSTYAPGRAMPLTLL

SEQ ID NO: 1053040 - protein, 29 aa, Mycobacterium
QPYWGRPVPGWGSERPWLLIVGLAPAAHG

SEQ ID NO: 1053041 - protein, 35 aa, Mycobacterium
QQALALPAADADFSLSIFGLQLVKTGTANATTTFG

SEQ ID NO: 1053042 - protein, 17 aa, Mycobacterium
QQARRPDLILLDLNLPK

SEQ ID NO: 1053043 - protein, 24 aa, Mycobacterium
QQCADMCAIPISFIKETVKRAQAE

SEQ ID NO: 1053044 - protein, 25 aa, Mycobacterium
QQIAARLSESFALLSRGYRGSPTHQ

SEQ ID NO: 1053045 - protein, 19 aa, Mycobacterium
QQIPEVYKGFAALSGAAFA

SEQ ID NO: 1053046 - protein, 26 aa, Mycobacterium
QQIRYDLGCGFPLLTTKKVHFKSVVY

SEQ ID NO: 1053047 - protein, 21 aa, Mycobacterium
QQKLDVLDFWQIIKPEMPGIN

SEQ ID NO: 1053048 - protein, 18 aa, Mycobacterium
QQKLFARQMEVFAGFSEN

SEQ ID NO: 1053049 - protein, 17 aa, Mycobacterium
QQLAVLAVRLEMAAVYL

SEQ ID NO: 1053050 - protein, 21 aa, Mycobacterium
QQLKGLILISRLEMVNTLGVV

SEQ ID NO: 1053051 - protein, 21 aa, Mycobacterium
QQLTLPFAAPHTMFNVKVGGA

SEQ ID NO: 1053052 - protein, 19 aa, Mycobacterium
QQLTLPFATPRTMLNVAIG

SEQ ID NO: 1053053 - protein, 19 aa, Mycobacterium
QQLTLPFRAPKTMFNVRIG

SEQ ID NO: 1053054 - protein, 22 aa, Mycobacterium
QQLWARLSVFAGSFDLDAAQYV

SEQ ID NO: 1053055 - protein, 21 aa, Mycobacterium
QQQRLCIARAIAVQPDVLLMD

SEQ ID NO: 1053056 - protein, 20 aa, Mycobacterium
QQSRFEWLLAALRLADRLIP

SEQ ID NO: 1053057 - protein, 25 aa, Mycobacterium
QQSWVVSFQLNWPRDHGPTVTSWML

SEQ ID NO: 1053058 - protein, 18 aa, Mycobacterium
QQVVLLCAYSRYLRQAGF

SEQ ID NO: 1053059 - protein, 17 aa, Mycobacterium
QQWREWELELSDPSQSA

SEQ ID NO: 1053060 - protein, 25 aa, Mycobacterium
QQYGVDAQQLFGFLRENNRLSSLVT

SEQ ID NO: 1053061 - protein, 17 aa, Mycobacterium
QRAAAALDRAIQQRVGA

SEQ ID NO: 1053062 - protein, 19 aa, Mycobacterium
QRAADEITHLGGVAITPDD

SEQ ID NO: 1053063 - protein, 18 aa, Mycobacterium
QRAAGEMRARLRGLDAAA

SEQ ID NO: 1053064 - protein, 20 aa, Mycobacterium
QRAASSFAVREVAPDVLLIG

SEQ ID NO: 1053065 - protein, 20 aa, Mycobacterium
QRAASSVKEKNDWSYEKWTK

SEQ ID NO: 1053066 - protein, 26 aa, Mycobacterium
QRADGALRRSIKFATFLDAIDAVRRV

SEQ ID NO: 1053067 - protein, 23 aa, Mycobacterium
QRADGTLEFLGRMDRQLKLRGVR

SEQ ID NO: 1053068 - protein, 24 aa, Mycobacterium
QRAEGRYALMPGIIGALAGSGTPL

SEQ ID NO: 1053069 - protein, 24 aa, Mycobacterium
QRAGAGPLRLFGHRRVSNAHLRAA

SEQ ID NO: 1053070 - protein, 17 aa, Mycobacterium
QRAIGYERAAEMTLTGD

SEQ ID NO: 1053071 - protein, 20 aa, Mycobacterium
QRANARLVVFPELSLTGYQL

SEQ ID NO: 1053072 - protein, 23 aa, Mycobacterium
QRAPRLRLVQKLGAGVNTIDVAT

SEQ ID NO: 1053073 - protein, 19 aa, Mycobacterium
QRAVLLLRDVLQWKAAEVA

SEQ ID NO: 1053074 - protein, 22 aa, Mycobacterium
QRAWLNLVQPLTIVEGFALLSV

SEQ ID NO: 1053075 - protein, 19 aa, Mycobacterium
QRCPDRPGLVDELGTLTWR

SEQ ID NO: 1053076 - protein, 19 aa, Mycobacterium
QRDAPSLRGRPVIVGGGVV

SEQ ID NO: 1053077 - protein, 19 aa, Mycobacterium
QRDLNSLVYVLAGRGAVGP

SEQ ID NO: 1053078 - protein, 30 aa, Mycobacterium
QRDRFGWPILRRTQRWCQLFSEPGAGSDLA

SEQ ID NO: 1053079 - protein, 21 aa, Mycobacterium
QRDRFLFKINVGYPTPEEERE

SEQ ID NO: 1053080 - protein, 19 aa, Mycobacterium
QRDVWRLVAYLSDPACADD

SEQ ID NO: 1053081 - protein, 29 aa, Mycobacterium
QRDWDFARALGLPVVEVIAGGDISQAAYT

SEQ ID NO: 1053082 - protein, 18 aa, Mycobacterium
QREAFAWHIDLAKRTGKP

SEQ ID NO: 1053083 - protein, 24 aa, Mycobacterium
QRENLNWSAPRLHLVDLQYSDVRL

SEQ ID NO: 1053084 - protein, 25 aa, Mycobacterium
QREVTEFFDVLPLMADNLYNAVDRR

SEQ ID NO: 1053085 - protein, 27 aa, Mycobacterium
QRFAGMLVAGVFLREFVADAVDWAHID

SEQ ID NO: 1053086 - protein, 18 aa, Mycobacterium
QRFIDRFAPFNLRDTAIR

SEQ ID NO: 1053087 - protein, 21 aa, Mycobacterium
QRFLAEQGYGYIIRDADDLLG

SEQ ID NO: 1053088 - protein, 18 aa, Mycobacterium
QRFLLLVDHTRYPPDGVS

SEQ ID NO: 1053089 - protein, 26 aa, Mycobacterium
QRFLPPTFRGEMIWCQLFSEPGAGSD

SEQ ID NO: 1053090 - protein, 17 aa, Mycobacterium
QRGNWPLGFPDDKRPSY

SEQ ID NO: 1053091 - protein, 20 aa, Mycobacterium
QRHSSLLPLLHNYRQPERPV

SEQ ID NO: 1053092 - protein, 19 aa, Mycobacterium
QRHTLNLAIWDRADLPERN

SEQ ID NO: 1053093 - protein, 17 aa, Mycobacterium
QRIAIEALFAQARRQDE

SEQ ID NO: 1053094 - protein, 32 aa, Mycobacterium; identical to SEQ ID NO: 715723

SEQ ID NO: 1053095 - protein, 27 aa, Mycobacterium
QRIGQFAAVRRGLWLTGGRRPWVALKL

SEQ ID NO: 1053096 - protein, 22 aa, Mycobacterium
QRIHPLKNVMILAGAGVGGGSL

SEQ ID NO: 1053097 - protein, 19 aa, Mycobacterium
QRITATMLVPSMLYALMDH

SEQ ID NO: 1053098 - protein, 20 aa, Mycobacterium
QRLAAHRAQLRAAVEDRLAG

SEQ ID NO: 1053099 - protein, 32 aa, Mycobacterium; identical to SEQ ID NO: 715760

SEQ ID NO: 1053100 - protein, 25 aa, Mycobacterium
QRLGRGTPLWGGWITGPTWLGPEEF

SEQ ID NO: 1053101 - protein, 18 aa, Mycobacterium
QRLLPRPLAHTSVHVAVA

SEQ ID NO: 1053102 - protein, 19 aa, Mycobacterium
QRLQLEFAELADADTGESP

SEQ ID NO: 1053103 - protein, 23 aa, Mycobacterium
QRLSDFMTEYVFPAEADYDKYRE

SEQ ID NO: 1053104 - protein, 21 aa, Mycobacterium
QRLSPISGRAGIAGRAALSRL

SEQ ID NO: 1053105 - protein, 18 aa, Mycobacterium
QRLVNRSAAIAIAPGPFV

SEQ ID NO: 1053106 - protein, 19 aa, Mycobacterium
QRLVVRGRIGTLLRYTQTL

SEQ ID NO: 1053107 - protein, 22 aa, Mycobacterium
QRMAALCDRVVLVVAGQAVPIK

SEQ ID NO: 1053108 - protein, 24 aa, Mycobacterium
QRMLPRRRGHVINIGSVGSMLPTE

SEQ ID NO: 1053109 - protein, 18 aa, Mycobacterium
QRMVPRGRGHVINVASLA

SEQ ID NO: 1053110 - protein, 20 aa, Mycobacterium
QRPAGRRELLSLRLSSAKIA

SEQ ID NO: 1053111 - protein, 21 aa, Mycobacterium
QRPALWFEVMDRVRATVTVAP

SEQ ID NO: 1053112 - protein, 21 aa, Mycobacterium
QRPDEVAARRGLRSGMLPRSW

SEQ ID NO: 1053113 - protein, 22 aa, Mycobacterium
QRPDGTLEFLGRMDRQLKVHGV

SEQ ID NO: 1053114 - protein, 18 aa, Mycobacterium
QRPELWNLYNGRHHKGEH

SEQ ID NO: 1053115 - protein, 20 aa, Mycobacterium
QRPELWPNAVEEILRLDSPV

SEQ ID NO: 1053116 - protein, 24 aa, Mycobacterium
QRPGDPTLRRLLPDFYKPGETDPM

SEQ ID NO: 1053117 - protein, 18 aa, Mycobacterium
QRPGVPILHLRGDADPYV

SEQ ID NO: 1053118 - protein, 24 aa, Mycobacterium
QRPNARGVPFIFVRTDSAGNISKR

SEQ ID NO: 1053119 - protein, 24 aa, Mycobacterium
QRPRPWYPIPLLLGGSGPRMMRLV

SEQ ID NO: 1053120 - protein, 17 aa, Mycobacterium
QRPSWRVGTRTVKVKAG

SEQ ID NO: 1053121 - protein, 23 aa, Mycobacterium
QRQLEMRLNRQLADIEKLQVNAR

SEQ ID NO: 1053122 - protein, 20 aa, Mycobacterium
QRQNERWNRHGFDLDMAALV

SEQ ID NO: 1053123 - protein, 19 aa, Mycobacterium
QRRFRDAFTATAHFQVNEA

SEQ ID NO: 1053124 - protein, 19 aa, Mycobacterium
QRRFWFMWDDLVRGAIGAI

SEQ ID NO: 1053125 - protein, 18 aa, Mycobacterium
QRRGAAFVSACALVSGSG

SEQ ID NO: 1053126 - protein, 23 aa, Mycobacterium
QRRGGPCPSTYPAPIVDHGTERA

SEQ ID NO: 1053127 - protein, 17 aa, Mycobacterium
QRRGQLKILDLVRPDPY

SEQ ID NO: 1053128 - protein, 19 aa, Mycobacterium
QRRLAVVFGAGGDRDPGKR

SEQ ID NO: 1053129 - protein, 20 aa, Mycobacterium
QRRSASVTAVAWRTSAGAAA

SEQ ID NO: 1053130 - protein, 21 aa, Mycobacterium
QRRSDLDAALLASVGLANNGS

SEQ ID NO: 1053131 - protein, 24 aa, Mycobacterium
QRSQRHCPLRRLIGRAPPDPRDRG

SEQ ID NO: 1053132 - protein, 17 aa, Mycobacterium
QRTAPWVESLEGGLDHV

SEQ ID NO: 1053133 - protein, 18 aa, Mycobacterium
QRTEPSFDVTALLNGYEP

SEQ ID NO: 1053134 - protein, 21 aa, Mycobacterium
QRTFGGWQLADLVSVDGSVVP

SEQ ID NO: 1053135 - protein, 20 aa, Mycobacterium
QRVAFVLHDGFAMPFAEVAG

SEQ ID NO: 1053136 - protein, 19 aa, Mycobacterium
QRVALDLLLDESVGIVSMG

SEQ ID NO: 1053137 - protein, 22 aa, Mycobacterium
QRVDAVLRAKVDGAWNLHEATR

SEQ ID NO: 1053138 - protein, 18 aa, Mycobacterium
QRVEITARGRGPVVRGEA

SEQ ID NO: 1053139 - protein, 17 aa, Mycobacterium
QRVPRWPQARAVCDDVL

SEQ ID NO: 1053140 - protein, 17 aa, Mycobacterium
QRVPVVITAKVQATARM

SEQ ID NO: 1053141 - protein, 20 aa, Mycobacterium
QRWIAAGLFEPAVREKAGMH

SEQ ID NO: 1053142 - protein, 24 aa, Mycobacterium
QRWSAEQHLVFACGRYEGIDQRVA

SEQ ID NO: 1053143 - protein, 24 aa, Mycobacterium
QRYEGGSTLFGRWELPAFMQIVAG

SEQ ID NO: 1053144 - protein, 21 aa, Mycobacterium
QRYRAALDMAEYADHHGFTAV

SEQ ID NO: 1053145 - protein, 18 aa, Mycobacterium
QRYRDRYIFAGLQPGQRI

SEQ ID NO: 1053146 - protein, 25 aa, Mycobacterium
QRYRVSRAALREAVRLLEYHSVARM

SEQ ID NO: 1053147 - protein, 19 aa, Mycobacterium
QSALKCLCLVTRSLDPTGT

SEQ ID NO: 1053148 - protein, 19 aa, Mycobacterium
QSCDACEDGALTVVGFQWQ

SEQ ID NO: 1053149 - protein, 18 aa, Mycobacterium
QSDDYRADLAYWKETLDG

SEQ ID NO: 1053150 - protein, 19 aa, Mycobacterium
QSDVGFAMWQYYLATGDRQ

SEQ ID NO: 1053151 - protein, 18 aa, Mycobacterium
QSERCWDGGIQLPAAVTG

SEQ ID NO: 1053152 - protein, 23 aa, Mycobacterium
QSGEVWISFLIVAPKYVASVATD

SEQ ID NO: 1053153 - protein, 20 aa, Mycobacterium
QSGGFGCMLQMGHEWANPAA

SEQ ID NO: 1053154 - protein, 24 aa, Mycobacterium
QSGKYRRVLAMAWEKQSESNAMWA

SEQ ID NO: 1053155 - protein, 22 aa, Mycobacterium
QSGMYELEFPAPQLSTSDGRGP

SEQ ID NO: 1053156 - protein, 23 aa, Mycobacterium
QSGPKFRAANIVMRVVYTNPDCE

SEQ ID NO: 1053157 - protein, 26 aa, Mycobacterium
QSGRFEFRAGPIFTNLLMADEINRTP

SEQ ID NO: 1053158 - protein, 18 aa, Mycobacterium
QSGWGAGHGGLFNRTSWV

SEQ ID NO: 1053159 - protein, 24 aa, Mycobacterium
QSHATRIALLDAMKDKWRHDLVGD

SEQ ID NO: 1053160 - protein, 25 aa, Mycobacterium
QSLAAIHRAMWALGDYALMAEEVMA

SEQ ID NO: 1053161 - protein, 26 aa, Mycobacterium
QSLDFFFRKIVRDHGQALQFVTAQIT

SEQ ID NO: 1053162 - protein, 19 aa, Mycobacterium
QSLDLTFAHGVAVAARLAE

SEQ ID NO: 1053163 - protein, 21 aa, Mycobacterium
QSLQLHYARTLEIWAAALEAK

SEQ ID NO: 1053164 - protein, 21 aa, Mycobacterium
QSLWQTERFQAHNVIRRVIAE

SEQ ID NO: 1053165 - protein, 18 aa, Mycobacterium
QSNAWFVGPDMLRDVGLL

SEQ ID NO: 1053166 - protein, 20 aa, Mycobacterium
QSPKRGCWNTCTEDRCCDCT

SEQ ID NO: 1053167 - protein, 18 aa, Mycobacterium
QSPLDEFHRLAVNAFALL

SEQ ID NO: 1053168 - protein, 19 aa, Mycobacterium
QSTFPLTIDALGIPTTLNL

SEQ ID NO: 1053169 - protein, 22 aa, Mycobacterium
QSTYYWCDSIIIILTTLAQLNR

SEQ ID NO: 1053170 - protein, 20 aa, Mycobacterium
QSWPTVADWVNWLSRDADKP

SEQ ID NO: 1053171 - protein, 25 aa, Mycobacterium
QSYGSRCVRPPILYGDVARSHPMTV

SEQ ID NO: 1053172 - protein, 17 aa, Mycobacterium
QTADGLPVFGAFWDRDA

SEQ ID NO: 1053173 - protein, 20 aa, Mycobacterium
QTCRTEVFFFPAASHVEKAG

SEQ ID NO: 1053174 - protein, 23 aa, Mycobacterium
QTDCWVFPRGMRRDGGVGAGSIT

SEQ ID NO: 1053175 - protein, 18 aa, Mycobacterium
QTELDYWRDALAGLPDEI

SEQ ID NO: 1053176 - protein, 18 aa, Mycobacterium
QTFRSERYPEYKANRSST

SEQ ID NO: 1053177 - protein, 32 aa, Mycobacterium
QTGGPRLKTLMSRTAGLSLHYVGRVPTHGATT

SEQ ID NO: 1053178 - protein, 24 aa, Mycobacterium
QTGKPLRLAEEFDVPGSVDNIRFF

SEQ ID NO: 1053179 - protein, 24 aa, Mycobacterium
QTGTRIGFENVWAANGSNEILQQL

SEQ ID NO: 1053180 - protein, 22 aa, Mycobacterium
QTHKLPVPFIVLATDNPIEHEG

SEQ ID NO: 1053181 - protein, 19 aa, Mycobacterium
QTIEQDLLGAVNAPTQVLF

SEQ ID NO: 1053182 - protein, 19 aa, Mycobacterium
QTLASGRTRNVQWRKQQLL

SEQ ID NO: 1053183 - protein, 22 aa, Mycobacterium
QTLDLRGAVLTRELTFRDDAGR

SEQ ID NO: 1053184 - protein, 23 aa, Mycobacterium
QTLLGQLCTFVMVAKEADASHPA

SEQ ID NO: 1053185 - protein, 20 aa, Mycobacterium
QTLLGRPLIGDGAAGTATNP

SEQ ID NO: 1053186 - protein, 21 aa, Mycobacterium
QTLLGRPLIGDGAAGTVANPN

SEQ ID NO: 1053187 - protein, 22 aa, Mycobacterium
QTLLGRPLIGNGANGAPGQNGA

SEQ ID NO: 1053188 - protein, 21 aa, Mycobacterium
QTLLGRPLIGNGANGAPGTGA

SEQ ID NO: 1053189 - protein, 24 aa, Mycobacterium
QTLNDCPLRWLAERHGGTNPRDLR

SEQ ID NO: 1053190 - protein, 18 aa, Mycobacterium
QTLPASAVTLVLHAMTLA

SEQ ID NO: 1053191 - protein, 23 aa, Mycobacterium
QTLTGRPLFGNGADATTPGANGG

SEQ ID NO: 1053192 - protein, 21 aa, Mycobacterium
QTLTGRPLIGNGANGAPGTGA

SEQ ID NO: 1053193 - protein, 20 aa, Mycobacterium
QTLTGRPLIGNGTPGAAGSG

SEQ ID NO: 1053194 - protein, 24 aa, Mycobacterium
QTNVEFLRFLLADERVRAGDLDTA

SEQ ID NO: 1053195 - protein, 18 aa, Mycobacterium
QTPGLRCQLDAAPLTNRL

SEQ ID NO: 1053196 - protein, 26 aa, Mycobacterium
QTPLGQALRIAWWSYVHRVDTDMEAA

SEQ ID NO: 1053197 - protein, 25 aa, Mycobacterium
QTPTLLFPFAAPRVVGDLSEAGSRS

SEQ ID NO: 1053198 - protein, 24 aa, Mycobacterium
QTRLLLRKSMHLLRDKQLWWRVGR

SEQ ID NO: 1053199 - protein, 19 aa, Mycobacterium
QTRLLPGLIDGTVTAGIGL

SEQ ID NO: 1053200 - protein, 23 aa, Mycobacterium
QTRRWNPKMKRFIFTDRNGIYII

SEQ ID NO: 1053201 - protein, 20 aa, Mycobacterium
QTRVFFCNSGTEANELAFKL

SEQ ID NO: 1053202 - protein, 24 aa, Mycobacterium
QTSGWSLTAQDVFNNVARTCIEAM

SEQ ID NO: 1053203 - protein, 19 aa, Mycobacterium
QTVDGAVFGRVMEVSQLIG

SEQ ID NO: 1053204 - protein, 23 aa, Mycobacterium
QTVKTSPLYRAWADASGDDPHAM

SEQ ID NO: 1053205 - protein, 23 aa, Mycobacterium
QVAAGIRSSARWRGRPKNQDAYP

SEQ ID NO: 1053206 - protein, 22 aa, Mycobacterium
QVAALCDRRRGLGADGILRVTT

SEQ ID NO: 1053207 - protein, 28 aa, Mycobacterium
QVARIDTWDGFYCFAAELTSPMLEVPFS

SEQ ID NO: 1053208 - protein, 24 aa, Mycobacterium
QVARKLFAERGFHGTTLADITSAA

SEQ ID NO: 1053209 - protein, 22 aa, Mycobacterium
QVCESFAISWLVIRAPSDLAGA

SEQ ID NO: 1053210 - protein, 20 aa, Mycobacterium
QVFAETTLDVAFSIVVKPGV

SEQ ID NO: 1053211 - protein, 31 aa, Mycobacterium; identical to SEQ ID NO: 716414

SEQ ID NO: 1053212 - protein, 25 aa, Mycobacterium
QVFLVDCGRGVLQRAAAVGVGAAGL

SEQ ID NO: 1053213 - protein, 17 aa, Mycobacterium
QVFPVLTPLAVDPAHPF

SEQ ID NO: 1053214 - protein, 20 aa, Mycobacterium
QVFVLRPCIVAGPHAYSLAE

SEQ ID NO: 1053215 - protein, 27 aa, Mycobacterium
QVGALCARFRISGLPVVDDSGALAGII

SEQ ID NO: 1053216 - protein, 18 aa, Mycobacterium
QVGAVMTTRAWSRAVQEA

SEQ ID NO: 1053217 - protein, 32 aa, Mycobacterium
QVGLTVCYDIRFPALYTELARRGAELIVVSAS

SEQ ID NO: 1053218 - protein, 18 aa, Mycobacterium
QVGMPRAVVITKLDHARA

SEQ ID NO: 1053219 - protein, 20 aa, Mycobacterium
QVGNFPGLWTEWNGKYRDTV

SEQ ID NO: 1053220 - protein, 18 aa, Mycobacterium
QVGTAVRAFLQSTIGAGQ

SEQ ID NO: 1053221 - protein, 32 aa, Mycobacterium
QVIDAAVALGRRVSFVGRSMVRNMSIARDLGF

SEQ ID NO: 1053222 - protein, 18 aa, Mycobacterium
QVIEHLWDQGQFVRECAR

SEQ ID NO: 1053223 - protein, 26 aa, Mycobacterium
QVLHDLYQRWPFFRSVLSNMAQVMAK

SEQ ID NO: 1053224 - protein, 25 aa, Mycobacterium
QVLRLWQTALIRLFRLQISDEIEVG

SEQ ID NO: 1053225 - protein, 25 aa, Mycobacterium
QVLRTPESWVLIDFEGESGQPLRER

SEQ ID NO: 1053226 - protein, 20 aa, Mycobacterium
QVLTRFTKFDVETAAPTAQY

SEQ ID NO: 1053227 - protein, 18 aa, Mycobacterium
QVPGCRFSGLGGATETAI

SEQ ID NO: 1053228 - protein, 17 aa, Mycobacterium
QVQGISSAHSWAVTQHP

SEQ ID NO: 1053229 - protein, 25 aa, Mycobacterium
QVQPRACPAMSAPLAIAPSGLDAAR

SEQ ID NO: 1053230 - protein, 31 aa, Mycobacterium
QVSGERFGVCGYCMGGRISVLLAGRQPDRVA

SEQ ID NO: 1053231 - protein, 23 aa, Mycobacterium
QVSRLKSSVAMELVRKQRGLAVA

SEQ ID NO: 1053232 - protein, 28 aa, Mycobacterium
QVSRLPEALSRFPITRVISSPQRRAVQT

SEQ ID NO: 1053233 - protein, 18 aa, Mycobacterium
QVTEAFWNAIRHAKPIAV

SEQ ID NO: 1053234 - protein, 19 aa, Mycobacterium
QVVDCIDYTAALDTLSIAL

SEQ ID NO: 1053235 - protein, 18 aa, Mycobacterium
QVVGLVCEHFGPRLVRGR

SEQ ID NO: 1053236 - protein, 20 aa, Mycobacterium
QVVIRRRLTLGVLVSCAPEV

SEQ ID NO: 1053237 - protein, 22 aa, Mycobacterium
QVVLQRRLPVVVVDQPKELAGV

SEQ ID NO: 1053238 - protein, 23 aa, Mycobacterium
QVVSGDLLAAINAPVLSLTGRPL

SEQ ID NO: 1053239 - protein, 19 aa, Mycobacterium
QVVSIPTMILFKDGEPVKR

SEQ ID NO: 1053240 - protein, 24 aa, Mycobacterium
QVVVCGKPSFYTGRGTFSLRLNEI

SEQ ID NO: 1053241 - protein, 20 aa, Mycobacterium
QVVYRSGVRHVPRLRRHSLA

SEQ ID NO: 1053242 - protein, 18 aa, Mycobacterium
QVWRRERLEYQGKHYTIP

SEQ ID NO: 1053243 - protein, 22 aa, Mycobacterium
QVYWDHMCCNVLENNFAARAVL

SEQ ID NO: 1053244 - protein, 19 aa, Mycobacterium
QWAGEGIDGVGGHRPGQHC

SEQ ID NO: 1053245 - protein, 22 aa, Mycobacterium
QWDLRFAVPEVCLLEAVADVPR

SEQ ID NO: 1053246 - protein, 20 aa, Mycobacterium
QWIHPRIGHRTVLEHFGYTT

SEQ ID NO: 1053247 - protein, 26 aa, Mycobacterium
QWKPLGGFPVTAGWFSAIRRGQARLH

SEQ ID NO: 1053248 - protein, 19 aa, Mycobacterium
QWKRELVARTSLTEEEIGE

SEQ ID NO: 1053249 - protein, 20 aa, Mycobacterium
QWLAARGWVVEPVRNTLELE

SEQ ID NO: 1053250 - protein, 23 aa, Mycobacterium
QWLDVLHWSQLVIQLADGDPTKG

SEQ ID NO: 1053251 - protein, 20 aa, Mycobacterium
QWLNEHGWRANAQNACDEMH

SEQ ID NO: 1053252 - protein, 29 aa, Mycobacterium
QWLPYEARVQISMRWNRGYIRTHTREEAQ

SEQ ID NO: 1053253 - protein, 25 aa, Mycobacterium
QWSRLWRSDVRVVGRPQLQDALRST

SEQ ID NO: 1053254 - protein, 19 aa, Mycobacterium
QWVPPFKWWRILRTRKVLE

SEQ ID NO: 1053255 - protein, 24 aa, Mycobacterium
QYAFSRPIVGHIFTNYDGVLKVDG

SEQ ID NO: 1053256 - protein, 19 aa, Mycobacterium
QYAQLRKAKGITHEQAREI

SEQ ID NO: 1053257 - protein, 24 aa, Mycobacterium
QYDDLRAGLRMNIIANPGVDKANF

SEQ ID NO: 1053258 - protein, 19 aa, Mycobacterium
QYDPLMSPLVWDLAHIGQQ

SEQ ID NO: 1053259 - protein, 17 aa, Mycobacterium
QYFSRFGGVRDYLMAVV

SEQ ID NO: 1053260 - protein, 23 aa, Mycobacterium
QYGDENFLIVGMDTRAGANSNVG

SEQ ID NO: 1053261 - protein, 18 aa, Mycobacterium
QYGKTWRTLAKLSLPNKY

SEQ ID NO: 1053262 - protein, 25 aa, Mycobacterium
QYGLRPLVRLVSWGLAGVAPDVMGI

SEQ ID NO: 1053263 - protein, 23 aa, Mycobacterium
QYGVDAQQLFGFLRENNRLSSLV

SEQ ID NO: 1053264 - protein, 19 aa, Mycobacterium
QYIPRADVVADRLTSTDTS

SEQ ID NO: 1053265 - protein, 24 aa, Mycobacterium
QYLAQLYAAIGIRASDAAQQLLGK

SEQ ID NO: 1053266 - protein, 23 aa, Mycobacterium
QYLEMWAQDAAAMYAYAGTAAAA

SEQ ID NO: 1053267 - protein, 20 aa, Mycobacterium
QYRHAFGRRLLELPAGLRDA

SEQ ID NO: 1053268 - protein, 21 aa, Mycobacterium
QYRLPSYYRWLLYEADHRGPG

SEQ ID NO: 1053269 - protein, 17 aa, Mycobacterium
RAAAAGVHLSWREANAE

SEQ ID NO: 1053270 - protein, 20 aa, Mycobacterium
RAAAAPTMGLLAAGADEVSV

SEQ ID NO: 1053271 - protein, 19 aa, Mycobacterium
RAAAESFSAQGYHAVSMET

SEQ ID NO: 1053272 - protein, 20 aa, Mycobacterium
RAAALPGVVDIVGASRTVLV

SEQ ID NO: 1053273 - protein, 27 aa, Mycobacterium
RAAAMSFSAAAVWRIRRAAPLLPTVLL

SEQ ID NO: 1053274 - protein, 18 aa, Mycobacterium
RAAAPKVSFGGRISAQRR

SEQ ID NO: 1053275 - protein, 18 aa, Mycobacterium
RAAAVWLQALADLVETLL

SEQ ID NO: 1053276 - protein, 19 aa, Mycobacterium
RAADDAVQMLGWRGYVENH

SEQ ID NO: 1053277 - protein, 18 aa, Mycobacterium
RAADFIKANVSKPVVGYV

SEQ ID NO: 1053278 - protein, 19 aa, Mycobacterium
RAADLGVTCSIFVDQIHYW

SEQ ID NO: 1053279 - protein, 17 aa, Mycobacterium
RAADPVFMLTGPIPATR

SEQ ID NO: 1053280 - protein, 23 aa, Mycobacterium
RAADVGGTWYWNRYPGIACDVES

SEQ ID NO: 1053281 - protein, 25 aa, Mycobacterium
RAAEHPRPDYVLLHISDTHLVGGDD

SEQ ID NO: 1053282 - protein, 41 aa, Mycobacterium; identical to SEQ ID NO: 204938

SEQ ID NO: 1053283 - protein, 20 aa, Mycobacterium
RAAEVMALLGPNGAGKTTTV

SEQ ID NO: 1053284 - protein, 19 aa, Mycobacterium
RAAEVMRYTALEAIMHPGA

SEQ ID NO: 1053285 - protein, 24 aa, Mycobacterium
RAAEVPAAVIARLGVDPTELEQLH

SEQ ID NO: 1053286 - protein, 19 aa, Mycobacterium
RAAFAAATRGGWRAAGVRD

SEQ ID NO: 1053287 - protein, 17 aa, Mycobacterium
RAAFAEVVACHEALRTV

SEQ ID NO: 1053288 - protein, 18 aa, Mycobacterium
RAAGAARHGSVRIATETA

SEQ ID NO: 1053289 - protein, 20 aa, Mycobacterium
RAAGCSRATLYRYFESREAL

SEQ ID NO: 1053290 - protein, 18 aa, Mycobacterium
RAAGELARTLGRSTAVNL

SEQ ID NO: 1053291 - protein, 26 aa, Mycobacterium
RAAGKRIVPVCSMVVTVLDKHPEYDA

SEQ ID NO: 1053292 - protein, 18 aa, Mycobacterium
RAAGLPAATINWGPWSEV

SEQ ID NO: 1053293 - protein, 22 aa, Mycobacterium
RAAHNIGHFRFVECSRLVNGRP

SEQ ID NO: 1053294 - protein, 18 aa, Mycobacterium
RAAHPFGVAAPRIAASAL

SEQ ID NO: 1053295 - protein, 22 aa, Mycobacterium
RAAIRPTTRLIWVETPTNPLLS

SEQ ID NO: 1053296 - protein, 18 aa, Mycobacterium
RAAISAFWDKAIEPTTRI

SEQ ID NO: 1053297 - protein, 18 aa, Mycobacterium
RAAIWAVLVRDFFQAWVR

SEQ ID NO: 1053298 - protein, 25 aa, Mycobacterium
RAALAWRSEFGSVHYWDEQVTKAAL

SEQ ID NO: 1053299 - protein, 20 aa, Mycobacterium
RAALEGYWRDQLCGAPPEID

SEQ ID NO: 1053300 - protein, 30 aa, Mycobacterium
RAALGVLKAEQWRPGAVLQNARELADICDV

SEQ ID NO: 1053301 - protein, 17 aa, Mycobacterium
RAALRRFKITDVADLRS

SEQ ID NO: 1053302 - protein, 32 aa, Mycobacterium; identical to SEQ ID NO: 716957

SEQ ID NO: 1053303 - protein, 25 aa, Mycobacterium
RAAMPKTVWTTGCSSWYLNDDWVPE

SEQ ID NO: 1053304 - protein, 22 aa, Mycobacterium
RAAMPNICLQMLLRGRNTVGYT

SEQ ID NO: 1053305 - protein, 20 aa, Mycobacterium
RAAMRPGETVLVLGGAGGVG

SEQ ID NO: 1053306 - protein, 22 aa, Mycobacterium
RAARFGLPFSPPMAMPELEAVY

SEQ ID NO: 1053307 - protein, 18 aa, Mycobacterium
RAARLMVEAVRRHHPGSL

SEQ ID NO: 1053308 - protein, 28 aa, Mycobacterium
RAASEFTLQAWAGSPGFRGDPAGPPISI

SEQ ID NO: 1053309 - protein, 18 aa, Mycobacterium
RAATDFRSTAVLIHAGGE

SEQ ID NO: 1053310 - protein, 19 aa, Mycobacterium
RAATLGPWTLVLDECHHLL

SEQ ID NO: 1053311 - protein, 21 aa, Mycobacterium
RAAVDSGYYPGQFQVGQTGKT

SEQ ID NO: 1053312 - protein, 20 aa, Mycobacterium
RAAVGPDFIICYRMSMADYV

SEQ ID NO: 1053313 - protein, 20 aa, Mycobacterium
RAAVSSFGLGGTNAHAIVEQ

SEQ ID NO: 1053314 - protein, 17 aa, Mycobacterium
RAAVVAVDMQRYSIPDT

SEQ ID NO: 1053315 - protein, 17 aa, Mycobacterium
RAAWADINSEIGKYNAR

SEQ ID NO: 1053316 - protein, 17 aa, Mycobacterium
RACEALYHFAWDEFCDW

SEQ ID NO: 1053317 - protein, 22 aa, Mycobacterium
RACFRCELCMEELRRRDDLLLV

SEQ ID NO: 1053318 - protein, 17 aa, Mycobacterium
RACGGCDRGGYRADARR

SEQ ID NO: 1053319 - protein, 18 aa, Mycobacterium
RADCLSYVEQHWADIRPK

SEQ ID NO: 1053320 - protein, 24 aa, Mycobacterium
RADELVLLLVVHHICWDDDSWEVF

SEQ ID NO: 1053321 - protein, 25 aa, Mycobacterium
RADGFIVLAQLHWDMLTPYHRLGGP

SEQ ID NO: 1053322 - protein, 17 aa, Mycobacterium
RADGIVVDPMLPPQLAD

SEQ ID NO: 1053323 - protein, 19 aa, Mycobacterium
RADIAAFVGAEPDELVFTK

SEQ ID NO: 1053324 - protein, 24 aa, Mycobacterium
RADLGIGPHQVWWLSELTADPAVT

SEQ ID NO: 1053325 - protein, 21 aa, Mycobacterium
RADLPAGSLIIFYTDGLMERA

SEQ ID NO: 1053326 - protein, 24 aa, Mycobacterium
RADMARPRFGSWLRNPTRGSLAMD

SEQ ID NO: 1053327 - protein, 21 aa, Mycobacterium
RADRFPRIEFSADAIEKTADG

SEQ ID NO: 1053328 - protein, 17 aa, Mycobacterium
RAECTSGGAAIQIGAVI

SEQ ID NO: 1053329 - protein, 26 aa, Mycobacterium
RAEDGNLWFEWSRSLDNPTEYVLVEA

SEQ ID NO: 1053330 - protein, 19 aa, Mycobacterium
RAEGYVLTPGRYVGTGASC

SEQ ID NO: 1053331 - protein, 18 aa, Mycobacterium
RAEHPEIGFTCVVVGECA

SEQ ID NO: 1053332 - protein, 24 aa, Mycobacterium
RAEKDLRAPFAPRGWFEGLTIEQL

SEQ ID NO: 1053333 - protein, 24 aa, Mycobacterium
RAELIAWLLERGFSFEHIQASAAA

SEQ ID NO: 1053334 - protein, 20 aa, Mycobacterium
RAELPRRCVLDGEIVIATGH

SEQ ID NO: 1053335 - protein, 17 aa, Mycobacterium
RAEMITLPMVYVNVPEM

SEQ ID NO: 1053336 - protein, 21 aa, Mycobacterium
RAEMSRLRRVVGEHLIASRPY

SEQ ID NO: 1053337 - protein, 23 aa, Mycobacterium
RAEPNRRDWRVLSIMHLSDTPRP

SEQ ID NO: 1053338 - protein, 26 aa, Mycobacterium
RAFDDGVFCALALPPAVGENEALMRC

SEQ ID NO: 1053339 - protein, 17 aa, Mycobacterium
RAFRTGIPGAHRRADRP

SEQ ID NO: 1053340 - protein, 17 aa, Mycobacterium
RAGAIARFAPVMGEVVS

SEQ ID NO: 1053341 - protein, 19 aa, Mycobacterium
RAGDLNWLFRPGGPGIGSE

SEQ ID NO: 1053342 - protein, 23 aa, Mycobacterium
RAGDPEFLPLVRRLARFLPADLR

SEQ ID NO: 1053343 - protein, 26 aa, Mycobacterium
RAGGFKHRAKVEISWVGSDDCQTDGG

SEQ ID NO: 1053344 - protein, 20 aa, Mycobacterium
RAGGIDFRLFRTIVFRTDLI

SEQ ID NO: 1053345 - protein, 20 aa, Mycobacterium
RAGGRIVGYAMLVRADTDDC

SEQ ID NO: 1053346 - protein, 17 aa, Mycobacterium
RAGGTGGAGGVAGSGVL

SEQ ID NO: 1053347 - protein, 24 aa, Mycobacterium
RAGGYRGAVAYARTKRMQVAFTPL

SEQ ID NO: 1053348 - protein, 18 aa, Mycobacterium
RAGIARQLGDLGVKSIDV

SEQ ID NO: 1053349 - protein, 23 aa, Mycobacterium
RAGIPPFYVMDVWLAAAERQRTH

SEQ ID NO: 1053350 - protein, 23 aa, Mycobacterium
RAGIPTLILWIWIEQPIWLAQIK

SEQ ID NO: 1053351 - protein, 17 aa, Mycobacterium
RAGISSFGISGTNAHVI

SEQ ID NO: 1053352 - protein, 18 aa, Mycobacterium
RAGLPPTLAVAGSYLDGI

SEQ ID NO: 1053353 - protein, 22 aa, Mycobacterium
RAGLQRRLERRIGMPLEDTNMV

SEQ ID NO: 1053354 - protein, 18 aa, Mycobacterium
RAGLSTIFSPSRSTFGVD

SEQ ID NO: 1053355 - protein, 19 aa, Mycobacterium
RAGLSTVFIPARNEPDLDD

SEQ ID NO: 1053356 - protein, 21 aa, Mycobacterium
RAGQPCRRCATGIERQGPDGS

SEQ ID NO: 1053357 - protein, 24 aa, Mycobacterium
RAGRCGRVAPGICIRLYSEDDFAA

SEQ ID NO: 1053358 - protein, 30 aa, Mycobacterium
RAGTPVQVLGFREHASWALASDALEFVDLE

SEQ ID NO: 1053359 - protein, 24 aa, Mycobacterium
RAGVARSGFYFYFDSKYSVLAQLM

SEQ ID NO: 1053360 - protein, 17 aa, Mycobacterium
RAGVVLIAGAETWRTRT

SEQ ID NO: 1053361 - protein, 17 aa, Mycobacterium
RAGVYAMVETAAAVSTI

SEQ ID NO: 1053362 - protein, 25 aa, Mycobacterium
RAGYGSLIQMIWIYDRAVDVEGLRR

SEQ ID NO: 1053363 - protein, 21 aa, Mycobacterium
RAHAAQWALPGGRVDPGENAI

SEQ ID NO: 1053364 - protein, 22 aa, Mycobacterium
RAHAVAVPPMFSDLVSAPTRRQ

SEQ ID NO: 1053365 - protein, 19 aa, Mycobacterium
RAHAVVLFRAGLLTEEQRD

SEQ ID NO: 1053366 - protein, 18 aa, Mycobacterium
RAHGSTHLLASPPELLRR

SEQ ID NO: 1053367 - protein, 17 aa, Mycobacterium
RAHISPRLQAYVEPSTN

SEQ ID NO: 1053368 - protein, 19 aa, Mycobacterium
RAHPAKVLLERAGSLVHST

SEQ ID NO: 1053369 - protein, 23 aa, Mycobacterium
RAIAASGIPRAQLFVTTKLATPD

SEQ ID NO: 1053370 - protein, 19 aa, Mycobacterium
RAIDACAPPSSTTSGVVTT

SEQ ID NO: 1053371 - protein, 18 aa, Mycobacterium
RAIDGITAGLGWVKAAET

SEQ ID NO: 1053372 - protein, 24 aa, Mycobacterium
RAIGEVLLAHVLIVKGEFGTAAAM

SEQ ID NO: 1053373 - protein, 22 aa, Mycobacterium
RAIGVNPFLTISMFAERTAELM

SEQ ID NO: 1053374 - protein, 17 aa, Mycobacterium
RAIHGIATFPKLGGAAG

SEQ ID NO: 1053375 - protein, 17 aa, Mycobacterium
RAIIAACPLTWPWNLLG

SEQ ID NO: 1053376 - protein, 23 aa, Mycobacterium
RAIKAVGRLARRKVRYAQVQLPA

SEQ ID NO: 1053377 - protein, 25 aa, Mycobacterium
RAILDEWKTISGLDRKVDDALWKRY

SEQ ID NO: 1053378 - protein, 19 aa, Mycobacterium
RAIPGRLAADVAVCRGLIR

SEQ ID NO: 1053379 - protein, 17 aa, Mycobacterium
RAIPGVRAVRELPAPAG

SEQ ID NO: 1053380 - protein, 24 aa, Mycobacterium
RAIRAALPLLRAADWACVVTLSAH

SEQ ID NO: 1053381 - protein, 20 aa, Mycobacterium
RAIRARGHFSTEQSALKCLY

SEQ ID NO: 1053382 - protein, 19 aa, Mycobacterium
RAIRENRFDAAFGGARRDE

SEQ ID NO: 1053383 - protein, 21 aa, Mycobacterium
RAIWPEADWDALGAKPHLAVA

SEQ ID NO: 1053384 - protein, 17 aa, Mycobacterium
RAKLVERINNLRVGHSL

SEQ ID NO: 1053385 - protein, 27 aa, Mycobacterium
RAKNMFALGLVSWMYGRPIQTSETFIR

SEQ ID NO: 1053386 - protein, 21 aa, Mycobacterium
RAKPAVPFGGAYRLIDFVLSN

SEQ ID NO: 1053387 - protein, 21 aa, Mycobacterium
RAKRLHECAMVIAGDHDDVVP

SEQ ID NO: 1053388 - protein, 25 aa, Mycobacterium
RAKTWRGRVGYLLRPPGWSEVAETP

SEQ ID NO: 1053389 - protein, 17 aa, Mycobacterium
RAKYGWTDVSRFAALGI

SEQ ID NO: 1053390 - protein, 27 aa, Mycobacterium
RALADLRVARLLAYRAVALRDDPTSGA

SEQ ID NO: 1053391 - protein, 36 aa, Mycobacterium
RALAFPTRMFTVLFALGRLPGWIAHWREMHDEGDSK

SEQ ID NO: 1053392 - protein, 20 aa, Mycobacterium
RALAGLWRSLTRKEVFPTQP

SEQ ID NO: 1053393 - protein, 18 aa, Mycobacterium
RALALQRYGRAVTFAEPV

SEQ ID NO: 1053394 - protein, 25 aa, Mycobacterium
RALGASFAEFGGWLMPVSYTGTVSE

SEQ ID NO: 1053395 - protein, 18 aa, Mycobacterium
RALGHPLSIVAIAEHLGV

SEQ ID NO: 1053396 - protein, 17 aa, Mycobacterium
RALGSVLGRGRPEESPL

SEQ ID NO: 1053397 - protein, 26 aa, Mycobacterium
RALHGLGPRWVLVKGGHLRSSTRSCD

SEQ ID NO: 1053398 - protein, 18 aa, Mycobacterium
RALLMALIATNIFGQNTP

SEQ ID NO: 1053399 - protein, 19 aa, Mycobacterium
RALLREFVRLWEHLLTDGG

SEQ ID NO: 1053400 - protein, 17 aa, Mycobacterium
RALLSRIGDHARGLHQA

SEQ ID NO: 1053401 - protein, 23 aa, Mycobacterium
RALREASYRLGARTLYHQFGAPL

SEQ ID NO: 1053402 - protein, 17 aa, Mycobacterium
RALSAQLTMIGQFAQIA

SEQ ID NO: 1053403 - protein, 18 aa, Mycobacterium
RALSWLPLYHDMGLILGV

SEQ ID NO: 1053404 - protein, 25 aa, Mycobacterium
RALTKRPGDVVARSELLNVLPGNGD

SEQ ID NO: 1053405 - protein, 29 aa, Mycobacterium
RALTPGYPFRCKRVLLGDDFYRALQHAHV

SEQ ID NO: 1053406 - protein, 26 aa, Mycobacterium
RALVLYCFTLPFAMVETFGWTTIVDV

SEQ ID NO: 1053407 - protein, 17 aa, Mycobacterium
RALVRMLREAGAVEVHV

SEQ ID NO: 1053408 - protein, 17 aa, Mycobacterium
RAMCEARRLPAVRIGVV

SEQ ID NO: 1053409 - protein, 19 aa, Mycobacterium
RAMFAPKLDAAALLHRLSL

SEQ ID NO: 1053410 - protein, 26 aa, Mycobacterium
RAMTAELRFPAGHSGRIEFSMWSSHL

SEQ ID NO: 1053411 - protein, 18 aa, Mycobacterium
RANILVLCGPIWLGDNSS

SEQ ID NO: 1053412 - protein, 22 aa, Mycobacterium
RANLADIWRRRDLPRDGKAPVL

SEQ ID NO: 1053413 - protein, 22 aa, Mycobacterium
RANRTPIDWDGYTPPLPAQGLG

SEQ ID NO: 1053414 - protein, 21 aa, Mycobacterium
RANWEAGGWGDVAQGMVAVTS

SEQ ID NO: 1053415 - protein, 18 aa, Mycobacterium
RAPAHGLAGLLVADLISM

SEQ ID NO: 1053416 - protein, 19 aa, Mycobacterium
RAPAHGLAGLLVADLISMW

SEQ ID NO: 1053417 - protein, 17 aa, Mycobacterium
RAPALLISRLVNWGIVD

SEQ ID NO: 1053418 - protein, 17 aa, Mycobacterium
RAPALLISRLVSWGIVD

SEQ ID NO: 1053419 - protein, 22 aa, Mycobacterium
RAPALLISRLVSWVDDLWCRAI

SEQ ID NO: 1053420 - protein, 22 aa, Mycobacterium
RAPAPFHLLPLVARELGKDTEI

SEQ ID NO: 1053421 - protein, 24 aa, Mycobacterium
RAPGRMTTKWGGFIDDVAGFDADF

SEQ ID NO: 1053422 - protein, 19 aa, Mycobacterium
RAPIPSAEPRRRGFLPRVA

SEQ ID NO: 1053423 - protein, 19 aa, Mycobacterium
RAPRLWLVTEGGLVVHDKP

SEQ ID NO: 1053424 - protein, 19 aa, Mycobacterium
RAQEPDWDASLAIGAVAVI

SEQ ID NO: 1053425 - protein, 26 aa, Mycobacterium
RAQRRVRPLPAGLFSRVEEFARKCSA

SEQ ID NO: 1053426 - protein, 19 aa, Mycobacterium
RAQRVAVHLLDKLGIAASD

SEQ ID NO: 1053427 - protein, 18 aa, Mycobacterium
RAQRWARQRAKRQARGQD

SEQ ID NO: 1053428 - protein, 20 aa, Mycobacterium
RAQVPDFFPHAGSVSDKGGV

SEQ ID NO: 1053429 - protein, 20 aa, Mycobacterium
RARAFYRRLGYHAAHVGLKR

SEQ ID NO: 1053430 - protein, 24 aa, Mycobacterium
RARAGEITAEMAFIAAREGMSAEL

SEQ ID NO: 1053431 - protein, 23 aa, Mycobacterium
RARDAGAMAYLVKPFTVSDLVPA

SEQ ID NO: 1053432 - protein, 21 aa, Mycobacterium
RARDVWNNRILPFAHNLSVGQ

SEQ ID NO: 1053433 - protein, 17 aa, Mycobacterium
RAREFVMKDSYSFDIDS

SEQ ID NO: 1053434 - protein, 17 aa, Mycobacterium
RARELALEIARRPRLRL

SEQ ID NO: 1053435 - protein, 19 aa, Mycobacterium
RARHGKFGAVVARDRAGAV

SEQ ID NO: 1053436 - protein, 19 aa, Mycobacterium
RARLACSLAEQGRAVAVVS

SEQ ID NO: 1053437 - protein, 25 aa, Mycobacterium
RARLFPRGLAAFIELRDQRCRTPYC

SEQ ID NO: 1053438 - protein, 19 aa, Mycobacterium
RARLRQSWLERGASEAELG

SEQ ID NO: 1053439 - protein, 26 aa, Mycobacterium
RARQRAQELLDQFGLTYAGKRLVRTY

SEQ ID NO: 1053440 - protein, 19 aa, Mycobacterium
RARRAHATSRVANRDNNPG

SEQ ID NO: 1053441 - protein, 18 aa, Mycobacterium
RARRFYERDGWNFDGTRR

SEQ ID NO: 1053442 - protein, 20 aa, Mycobacterium
RARVPGALAATLREFAASSA

SEQ ID NO: 1053443 - protein, 28 aa, Mycobacterium
RARVQSVLLPRLLDWLSYAPDPDGGLLA

SEQ ID NO: 1053444 - protein, 24 aa, Mycobacterium
RARVRALGVAGAFHTQFMAPALEG

SEQ ID NO: 1053445 - protein, 22 aa, Mycobacterium
RARWEECLAELGVGELHAELAR

SEQ ID NO: 1053446 - protein, 17 aa, Mycobacterium
RARWRIRQVREARRRVD

SEQ ID NO: 1053447 - protein, 23 aa, Mycobacterium
RASARLATAFTQTWVATSDDDAN

SEQ ID NO: 1053448 - protein, 19 aa, Mycobacterium
RASARLVGPLASYLVVNVS

SEQ ID NO: 1053449 - protein, 17 aa, Mycobacterium
RASAVAVGAAWFNARVA

SEQ ID NO: 1053450 - protein, 19 aa, Mycobacterium
RASCPIFGFPTMTSGYPLP

SEQ ID NO: 1053451 - protein, 17 aa, Mycobacterium
RASEFATGLAFDEASRR

SEQ ID NO: 1053452 - protein, 25 aa, Mycobacterium
RASFAESFVALGIIPGDGGTWFLQR

SEQ ID NO: 1053453 - protein, 19 aa, Mycobacterium
RASGRSIGVPGILRMLEMV

SEQ ID NO: 1053454 - protein, 18 aa, Mycobacterium
RASLCGSPGRATTTGSPE

SEQ ID NO: 1053455 - protein, 20 aa, Mycobacterium
RASLGRKVRQGELLLIVDDA

SEQ ID NO: 1053456 - protein, 21 aa, Mycobacterium
RASLRPSETAFTFIDYERDWA

SEQ ID NO: 1053457 - protein, 23 aa, Mycobacterium
RASNARFAVYLGDLGSDTAARAR

SEQ ID NO: 1053458 - protein, 17 aa, Mycobacterium
RASVGALGIPVLDTSAV

SEQ ID NO: 1053459 - protein, 25 aa, Mycobacterium
RATAWRLTGLGLWVIAHDPYCADAR

SEQ ID NO: 1053460 - protein, 17 aa, Mycobacterium
RATCPGWTTQACLLSLR

SEQ ID NO: 1053461 - protein, 19 aa, Mycobacterium
RATIYRYAGGKAKIRDVVI

SEQ ID NO: 1053462 - protein, 18 aa, Mycobacterium
RATLHHRAAALVGSLMRE

SEQ ID NO: 1053463 - protein, 28 aa, Mycobacterium
RATQHLPWHPGRCAEVLVGEAVVGHAGQ

SEQ ID NO: 1053464 - protein, 30 aa, Mycobacterium
RATRVKRPSCSGGWAPTRMRSLVRQRRSCS

SEQ ID NO: 1053465 - protein, 25 aa, Mycobacterium
RAVAAAAATPARCSAMAGPAERADP

SEQ ID NO: 1053466 - protein, 18 aa, Mycobacterium
RAVAAVCEHDRRLAEKYG

SEQ ID NO: 1053467 - protein, 28 aa, Mycobacterium
RAVAIRVAGWIDRLGTVWVEGQLAQITI

SEQ ID NO: 1053468 - protein, 18 aa, Mycobacterium
RAVDAGAAGYVFNLGHGV

SEQ ID NO: 1053469 - protein, 20 aa, Mycobacterium
RAVEKFDYTKGYKFSTYATW

SEQ ID NO: 1053470 - protein, 19 aa, Mycobacterium
RAVGVLADLQGPKIRLGRF

SEQ ID NO: 1053471 - protein, 17 aa, Mycobacterium
RAVHRLTGLGAQVVGLD

SEQ ID NO: 1053472 - protein, 21 aa, Mycobacterium
RAVLAALEIGCRLIDTAAAYG

SEQ ID NO: 1053473 - protein, 22 aa, Mycobacterium
RAVLAALEIGCRLIDTAAAYGN

SEQ ID NO: 1053474 - protein, 25 aa, Mycobacterium
RAVPEAPDGPGWRITGQKVWTSYAQ

SEQ ID NO: 1053475 - protein, 26 aa, Mycobacterium
RAVQAWRGFSRWLMRAYDVLVDEDQI

SEQ ID NO: 1053476 - protein, 23 aa, Mycobacterium
RAVRRWTEFYKHESCGKCTPCRE

SEQ ID NO: 1053477 - protein, 23 aa, Mycobacterium
RAVSAALEIGCRLIDTAAAYGNE

SEQ ID NO: 1053478 - protein, 20 aa, Mycobacterium
RAVSELVAIVANGQPLTPEV

SEQ ID NO: 1053479 - protein, 21 aa, Mycobacterium
RAVSRAGDWFGSPVNAASRIT

SEQ ID NO: 1053480 - protein, 20 aa, Mycobacterium
RAVVEPAFWLGQPRTGPSSF

SEQ ID NO: 1053481 - protein, 20 aa, Mycobacterium
RAVVIGAGFIGCEVAASLRG

SEQ ID NO: 1053482 - protein, 24 aa, Mycobacterium
RAVVLKRMQRWLVDNADQVIATIC

SEQ ID NO: 1053483 - protein, 18 aa, Mycobacterium
RAVWEKFGEFGLDARAFS

SEQ ID NO: 1053484 - protein, 19 aa, Mycobacterium
RAYGWRLGLNIGPTSKVVD

SEQ ID NO: 1053485 - protein, 19 aa, Mycobacterium
RAYKMWLPPLVDPTPLDEL

SEQ ID NO: 1053486 - protein, 19 aa, Mycobacterium
RAYKPLNWMSPPCWLTEEP

SEQ ID NO: 1053487 - protein, 20 aa, Mycobacterium
RAYNKFRRGPGAFKVDFAIE

SEQ ID NO: 1053488 - protein, 25 aa, Mycobacterium
RAYPRSDRGAKVFGITGNHAPEWAA

SEQ ID NO: 1053489 - protein, 19 aa, Mycobacterium
RAYQPRIVFVDADNKQIDV

SEQ ID NO: 1053490 - protein, 24 aa, Mycobacterium
RAYRLERPLFFALQCMPLNRVRRK

SEQ ID NO: 1053491 - protein, 24 aa, Mycobacterium
RAYRREVLEALDLDTLESRGYCFQ

SEQ ID NO: 1053492 - protein, 24 aa, Mycobacterium
RAYRREVLEKIDLASVDSKGYCFQ

SEQ ID NO: 1053493 - protein, 18 aa, Mycobacterium
RAYRVVRYDAAREEAEVA

SEQ ID NO: 1053494 - protein, 24 aa, Mycobacterium
RCANEGLCAIGLRFSEDKTAPRER

SEQ ID NO: 1053495 - protein, 21 aa, Mycobacterium
RCAPALAWVVCGHHIGLPDTT

SEQ ID NO: 1053496 - protein, 17 aa, Mycobacterium
RCATPGPHRAFHIAAGG

SEQ ID NO: 1053497 - protein, 24 aa, Mycobacterium
RCAVAIPTSSGWRMLSGDETGWLL

SEQ ID NO: 1053498 - protein, 25 aa, Mycobacterium
RCDRVAGLALRHARLRGVDPADKRV

SEQ ID NO: 1053499 - protein, 25 aa, Mycobacterium
RCEKALAEYVSWSLLDVVRAVPGAP

SEQ ID NO: 1053500 - protein, 26 aa, Mycobacterium
RCGLSALPADYSGIVVVTAGDTPLLD

SEQ ID NO: 1053501 - protein, 25 aa, Mycobacterium
RCGQCPLAECAWRRAGYPPATGPAR

SEQ ID NO: 1053502 - protein, 17 aa, Mycobacterium
RCNRPLPLHPGAVTYLV

SEQ ID NO: 1053503 - protein, 20 aa, Mycobacterium
RCQGHTLCAMIAPDSFQLSD

SEQ ID NO: 1053504 - protein, 19 aa, Mycobacterium
RCRRCGSMNAAGYSGRLEV

SEQ ID NO: 1053505 - protein, 21 aa, Mycobacterium
RCSRWAMKRGRPGGCHRDRAL

SEQ ID NO: 1053506 - protein, 28 aa, Mycobacterium
RCTAEADAAFDQARRRFEEAWNRQNGEH

SEQ ID NO: 1053507 - protein, 18 aa, Mycobacterium
RCTGCAPCWWNWSGFTTT

SEQ ID NO: 1053508 - protein, 24 aa, Mycobacterium
RCVEYARGRFDAIVPAQVHADLPY

SEQ ID NO: 1053509 - protein, 29 aa, Mycobacterium
RCWDGGIQLPAAVTGCLRRFSCHDNARVA

SEQ ID NO: 1053510 - protein, 17 aa, Mycobacterium
RCWKQIIHFTPKFTAPE

SEQ ID NO: 1053511 - protein, 18 aa, Mycobacterium
RDAALALLRAEIQPGDVV

SEQ ID NO: 1053512 - protein, 22 aa, Mycobacterium
RDALCRIRLVLPDPVGLLRCCG

SEQ ID NO: 1053513 - protein, 23 aa, Mycobacterium
RDAMPTFRQVFLAGASDMALERR

SEQ ID NO: 1053514 - protein, 17 aa, Mycobacterium
RDARLGSVAKLLPGLEG

SEQ ID NO: 1053515 - protein, 17 aa, Mycobacterium
RDASGIAQVVFREADVL

SEQ ID NO: 1053516 - protein, 22 aa, Mycobacterium
RDDALRLARRIAAALNAPGGGA

SEQ ID NO: 1053517 - protein, 23 aa, Mycobacterium
RDDGRPGWRPLPELLATSDIVSL

SEQ ID NO: 1053518 - protein, 18 aa, Mycobacterium
RDDLALRIAVQPGGCAGL

SEQ ID NO: 1053519 - protein, 17 aa, Mycobacterium
RDDLLLVAGMRVSQREK

SEQ ID NO: 1053520 - protein, 18 aa, Mycobacterium
RDDLSLRIAVQPGGCAGL

SEQ ID NO: 1053521 - protein, 20 aa, Mycobacterium
RDDPRSWIAQPMMELSTVPT

SEQ ID NO: 1053522 - protein, 19 aa, Mycobacterium
RDDRWEWSDELARMHGYEP

SEQ ID NO: 1053523 - protein, 23 aa, Mycobacterium
RDEALRLFAERGPDAVTMRDIAT

SEQ ID NO: 1053524 - protein, 23 aa, Mycobacterium
RDEGWLAEHMLILKLISPENKAY

SEQ ID NO: 1053525 - protein, 17 aa, Mycobacterium
RDELPSVLADGFSAAVF

SEQ ID NO: 1053526 - protein, 27 aa, Mycobacterium
RDELTDLLWRMGIRTVGQFAALSRTDV

SEQ ID NO: 1053527 - protein, 27 aa, Mycobacterium
RDELTLAWQRLRPWPDVVAGLTRLKTK

SEQ ID NO: 1053528 - protein, 26 aa, Mycobacterium
RDEPELRFELCLGVNGVHYPHETGRE

SEQ ID NO: 1053529 - protein, 19 aa, Mycobacterium
RDETIAAIAARAGDLQAPG

SEQ ID NO: 1053530 - protein, 25 aa, Mycobacterium
RDEVRESTVRFCLRGLGVAPDTIAQ

SEQ ID NO: 1053531 - protein, 21 aa, Mycobacterium
RDFVRRGAGWLAHAHETQSRG

SEQ ID NO: 1053532 - protein, 28 aa, Mycobacterium
RDGAGVARMPLARALRSAQRHDYLGNYV

SEQ ID NO: 1053533 - protein, 17 aa, Mycobacterium
RDGALLPGLAAGALGIH

SEQ ID NO: 1053534 - protein, 23 aa, Mycobacterium
RDGEAIGALLTRMGAQDTRLVWE

SEQ ID NO: 1053535 - protein, 26 aa, Mycobacterium
RDGGIPWRLPEDLAHFKRLTMGHTVV

SEQ ID NO: 1053536 - protein, 20 aa, Mycobacterium
RDGLLPGSLQVRRRAKSWYE

SEQ ID NO: 1053537 - protein, 19 aa, Mycobacterium
RDGLLRLLVDVQYTRNDLS

SEQ ID NO: 1053538 - protein, 24 aa, Mycobacterium
RDGNRFELGLTFHHALLDGWSVAE

SEQ ID NO: 1053539 - protein, 27 aa, Mycobacterium
RDGRDAGRRRPPVLSEAEFLARREAVE

SEQ ID NO: 1053540 - protein, 17 aa, Mycobacterium
RDGRLMRDPSLLVTRPT

SEQ ID NO: 1053541 - protein, 19 aa, Mycobacterium
RDGSDWVLNGRKMWITNGS

SEQ ID NO: 1053542 - protein, 26 aa, Mycobacterium
RDGVACYPARFQLVLAANPCPCAPAD

SEQ ID NO: 1053543 - protein, 21 aa, Mycobacterium
RDHGLRYLLVINGSLVNPSLR

SEQ ID NO: 1053544 - protein, 20 aa, Mycobacterium
RDHIATAVEVLWRGQRLRAL

SEQ ID NO: 1053545 - protein, 29 aa, Mycobacterium
RDHPDFPAAAARLGDRLSIHDQPNLGGSG

SEQ ID NO: 1053546 - protein, 23 aa, Mycobacterium
RDIEALGYGAVWVGGSPPAELAW

SEQ ID NO: 1053547 - protein, 19 aa, Mycobacterium
RDINEIYCDHCALWSQDTT

SEQ ID NO: 1053548 - protein, 17 aa, Mycobacterium
RDIPFRVGAVVGSPASY

SEQ ID NO: 1053549 - protein, 24 aa, Mycobacterium
RDIRFVRLWFTDVLGFLKSVAIAP

SEQ ID NO: 1053550 - protein, 22 aa, Mycobacterium
RDIRFVRLWFTDVLGYLKSVAI

SEQ ID NO: 1053551 - protein, 25 aa, Mycobacterium
RDISAKKNEPEWMLQTRLKALRIFE

SEQ ID NO: 1053552 - protein, 25 aa, Mycobacterium
RDITTAPPVLAAWVATAAPGAMAGA

SEQ ID NO: 1053553 - protein, 20 aa, Mycobacterium
RDIVLKGRRSGIPFVAAESF

SEQ ID NO: 1053554 - protein, 17 aa, Mycobacterium
RDKRKGGVLEFDTTVVG

SEQ ID NO: 1053555 - protein, 20 aa, Mycobacterium
RDKRSLVFPVKRLADLGFRV

SEQ ID NO: 1053556 - protein, 25 aa, Mycobacterium
RDLEGRLPFELQRVVLSNGSVILER

SEQ ID NO: 1053557 - protein, 22 aa, Mycobacterium
RDLGLDSVRFVLLMKRLGVDRE

SEQ ID NO: 1053558 - protein, 20 aa, Mycobacterium
RDLGSMGIRVLAIAPSLFLT

SEQ ID NO: 1053559 - protein, 24 aa, Mycobacterium
RDLICTIPGIGGFTADVVVAETGA

SEQ ID NO: 1053560 - protein, 21 aa, Mycobacterium
RDLKARIAALEASRTSYEKIV

SEQ ID NO: 1053561 - protein, 17 aa, Mycobacterium
RDLPCHTGVRLLGGSSH

SEQ ID NO: 1053562 - protein, 24 aa, Mycobacterium
RDLRLLAADMVFDLPVVGEAARKA

SEQ ID NO: 1053563 - protein, 18 aa, Mycobacterium
RDLYEAVSQLAFLPFPFD

SEQ ID NO: 1053564 - protein, 25 aa, Mycobacterium
RDMLAAPEQFDWLATRLEIARKLRN

SEQ ID NO: 1053565 - protein, 18 aa, Mycobacterium
RDNPRPGLVNALVQMRID

SEQ ID NO: 1053566 - protein, 25 aa, Mycobacterium
RDNRAVHALARIMLHGRIPHIQTSW

SEQ ID NO: 1053567 - protein, 24 aa, Mycobacterium
RDNSEARAALGFMDTELQIDYRDT

SEQ ID NO: 1053568 - protein, 20 aa, Mycobacterium
RDPAPRPTPPLPIPQDLSPN

SEQ ID NO: 1053569 - protein, 21 aa, Mycobacterium
RDPEKVLELFSGAQCQMPASS

SEQ ID NO: 1053570 - protein, 25 aa, Mycobacterium
RDPETFRYSWGPAIAGLDTPTTAQL

SEQ ID NO: 1053571 - protein, 17 aa, Mycobacterium
RDPIPAAESPTVPSDIG

SEQ ID NO: 1053572 - protein, 26 aa, Mycobacterium
RDPLRLPGNAHFTFRGCEGDALLMLL

SEQ ID NO: 1053573 - protein, 19 aa, Mycobacterium
RDPMAMLPFMGYNVGDYVQ

SEQ ID NO: 1053574 - protein, 17 aa, Mycobacterium
RDQLCGAPPEIDIPRDF

SEQ ID NO: 1053575 - protein, 25 aa, Mycobacterium
RDQRWKRYNIFNLVWNTLLALGFEW

SEQ ID NO: 1053576 - protein, 17 aa, Mycobacterium
RDRAGAVEGLRALAAGQ

SEQ ID NO: 1053577 - protein, 22 aa, Mycobacterium
RDRCPADLFAALLASQNPPVLR

SEQ ID NO: 1053578 - protein, 19 aa, Mycobacterium
RDRGELMGIGISFFTEAVG

SEQ ID NO: 1053579 - protein, 17 aa, Mycobacterium
RDRISLTHRRFDRLIRT

SEQ ID NO: 1053580 - protein, 23 aa, Mycobacterium
RDRLDHRFRLLVGSRRGLGRHQT

SEQ ID NO: 1053581 - protein, 17 aa, Mycobacterium
RDRLPKIYLELLDAARG

SEQ ID NO: 1053582 - protein, 23 aa, Mycobacterium
RDRMGKLLLELTFDSPRRLEMLH

SEQ ID NO: 1053583 - protein, 26 aa, Mycobacterium
RDRPGTMPLLEAWTALSALARDTTYI

SEQ ID NO: 1053584 - protein, 18 aa, Mycobacterium
RDRPSIRTGRWTRMAGSS

SEQ ID NO: 1053585 - protein, 24 aa, Mycobacterium
RDRQRPGTELAIRQRYPLGHARLE

SEQ ID NO: 1053586 - protein, 21 aa, Mycobacterium
RDRRQPLRFALGIMDEPRRHL

SEQ ID NO: 1053587 - protein, 20 aa, Mycobacterium
RDRRRWRAAGRGRRLRRHRG

SEQ ID NO: 1053588 - protein, 18 aa, Mycobacterium
RDRWKRAVALVESLTGDA

SEQ ID NO: 1053589 - protein, 19 aa, Mycobacterium
RDSDGWPLYPIRPDHSYVN

SEQ ID NO: 1053590 - protein, 20 aa, Mycobacterium
RDSGGPAPIFQWLIYPRTDF

SEQ ID NO: 1053591 - protein, 19 aa, Mycobacterium
RDSVEWFAQRGILVALGEF

SEQ ID NO: 1053592 - protein, 30 aa, Mycobacterium; identical to SEQ ID NO: 719040

SEQ ID NO: 1053593 - protein, 19 aa, Mycobacterium
RDTLGFSVLHVVRDNPTSL

SEQ ID NO: 1053594 - protein, 21 aa, Mycobacterium
RDTLLWAKLIDKYKGTMTAAP

SEQ ID NO: 1053595 - protein, 18 aa, Mycobacterium
RDTNCAGISPESRASTGG

SEQ ID NO: 1053596 - protein, 19 aa, Mycobacterium
RDTVWAFAEGFGYAYERTV

SEQ ID NO: 1053597 - protein, 19 aa, Mycobacterium
RDVAAPSIVERCPVQTTHP

SEQ ID NO: 1053598 - protein, 19 aa, Mycobacterium
RDVLAKTSSEWDITDAAAT

SEQ ID NO: 1053599 - protein, 19 aa, Mycobacterium
RDVPPPAALDAPLDAPGIN

SEQ ID NO: 1053600 - protein, 20 aa, Mycobacterium
RDVSHGCINLSPTNAKWFFD

SEQ ID NO: 1053601 - protein, 23 aa, Mycobacterium
RDWDVPLEMGASWIHGTTDNPLV

SEQ ID NO: 1053602 - protein, 22 aa, Mycobacterium
RDWQRLCQKWDLASAPLDRQIE

SEQ ID NO: 1053603 - protein, 28 aa, Mycobacterium
RDWRQWWYWAPGASWRHPWGPDSDVDDR

SEQ ID NO: 1053604 - protein, 25 aa, Mycobacterium
RDYAALRRWAHRFYPGAQTSPADFG

SEQ ID NO: 1053605 - protein, 21 aa, Mycobacterium
RDYHPAIGFYRRLFGWQTEQV

SEQ ID NO: 1053606 - protein, 18 aa, Mycobacterium
RDYRWGRRGTAASVTSPA

SEQ ID NO: 1053607 - protein, 26 aa, Mycobacterium
REAAHLRAFLTFAEHAPRFALDQAHS

SEQ ID NO: 1053608 - protein, 23 aa, Mycobacterium
REAAKPGSYFWLKGGSRPVQPSA

SEQ ID NO: 1053609 - protein, 30 aa, Mycobacterium
REACKASLDRLGLDYVDLYLIHWPAPAVGK

SEQ ID NO: 1053610 - protein, 27 aa, Mycobacterium
READVEFARLYGFARPMGPRMMCGETD

SEQ ID NO: 1053611 - protein, 17 aa, Mycobacterium
REAFVERGIQHGPAFSG

SEQ ID NO: 1053612 - protein, 23 aa, Mycobacterium
REAKKICLGCEVRHECLEYALAH

SEQ ID NO: 1053613 - protein, 24 aa, Mycobacterium
REALKSALQYPALTGPVFDTLTVE

SEQ ID NO: 1053614 - protein, 20 aa, Mycobacterium
REAPPFFVLHGERDELVPSG

SEQ ID NO: 1053615 - protein, 30 aa, Mycobacterium; identical to SEQ ID NO: 719238

SEQ ID NO: 1053616 - protein, 19 aa, Mycobacterium
REAYPGDVFYLHSRLLERC

SEQ ID NO: 1053617 - protein, 19 aa, Mycobacterium
RECDAICQVVRVFHDDDVT

SEQ ID NO: 1053618 - protein, 25 aa, Mycobacterium
REDKPFWWSHFDRLNYPIDEWSDST

SEQ ID NO: 1053619 - protein, 20 aa, Mycobacterium
REDLDLFRRLSFDLISIPTD

SEQ ID NO: 1053620 - protein, 25 aa, Mycobacterium
REDLPSAIYHRFARVHSYAAVHRSM

SEQ ID NO: 1053621 - protein, 18 aa, Mycobacterium
REDLQIVRSYKLRGAYNL

SEQ ID NO: 1053622 - protein, 20 aa, Mycobacterium
REDSEFAVLGRQVAVGGQLL

SEQ ID NO: 1053623 - protein, 21 aa, Mycobacterium
REDVLGGRGSRIGRPIPDLEC

SEQ ID NO: 1053624 - protein, 21 aa, Mycobacterium
REEAIRIAAAAKREYEASMSR

SEQ ID NO: 1053625 - protein, 23 aa, Mycobacterium
REELGDLLLQVLFHARIAEDAAL

SEQ ID NO: 1053626 - protein, 24 aa, Mycobacterium
REFAEWRNSKVAGMAYDAARVRGL

SEQ ID NO: 1053627 - protein, 21 aa, Mycobacterium
REFLGGLGMHQDFRLLRVVSA

SEQ ID NO: 1053628 - protein, 24 aa, Mycobacterium
REGAKLFHAKGWRVAAVDRDGAGL

SEQ ID NO: 1053629 - protein, 18 aa, Mycobacterium
REGDSWELLGNARWLPLV

SEQ ID NO: 1053630 - protein, 20 aa, Mycobacterium
REGFECGMTLGYSDLKEGDF

SEQ ID NO: 1053631 - protein, 23 aa, Mycobacterium
REGFRACKRCRPDASPGSPEWNM

SEQ ID NO: 1053632 - protein, 19 aa, Mycobacterium
REGHPFLWSLSDPRPDGLV

SEQ ID NO: 1053633 - protein, 21 aa, Mycobacterium
REGQWGAPLLFYLDAGIPPLS

SEQ ID NO: 1053634 - protein, 20 aa, Mycobacterium
REGSEEAWLLVKRSDDHAVA

SEQ ID NO: 1053635 - protein, 22 aa, Mycobacterium
REGYDVWEPGAFTGTFRGNAMA

SEQ ID NO: 1053636 - protein, 26 aa, Mycobacterium
REHDILAFERQWWKFAGVKEDAIKEL

SEQ ID NO: 1053637 - protein, 20 aa, Mycobacterium
REHGARLLVRLAGVNDRDTA

SEQ ID NO: 1053638 - protein, 28 aa, Mycobacterium
REHILTCARELFALNGLDRTSVRSVAAA

SEQ ID NO: 1053639 - protein, 28 aa, Mycobacterium
REHLTRAWTGLRAMRSYALATMDVEQPG

SEQ ID NO: 1053640 - protein, 26 aa, Mycobacterium
REHTWKRSSFSGAEIFGKTVGVVGLG

SEQ ID NO: 1053641 - protein, 18 aa, Mycobacterium
REIAELLDYVRPRGIIYH

SEQ ID NO: 1053642 - protein, 20 aa, Mycobacterium
REIAPLIFGVPVLVPDPAEY

SEQ ID NO: 1053643 - protein, 23 aa, Mycobacterium
REIGKAVGMLMLLNGFTEEEAFD

SEQ ID NO: 1053644 - protein, 17 aa, Mycobacterium
REIIYRMGVTPPQPKQI

SEQ ID NO: 1053645 - protein, 21 aa, Mycobacterium
REIPRTDELWYFEEREDVGDW

SEQ ID NO: 1053646 - protein, 25 aa, Mycobacterium
REIRPAHPALHRWFEDRARVDPDAE

SEQ ID NO: 1053647 - protein, 20 aa, Mycobacterium
REITSAISRAHRVRVADVVL

SEQ ID NO: 1053648 - protein, 22 aa, Mycobacterium
REKALKSFRRGSVNVLVATDVA

SEQ ID NO: 1053649 - protein, 18 aa, Mycobacterium
REKHAALRGSMTVLAVNT

SEQ ID NO: 1053650 - protein, 31 aa, Mycobacterium
RELALEIARRPRLRLVALMSYEGHIAGFGDQ

SEQ ID NO: 1053651 - protein, 38 aa, Mycobacterium; identical to SEQ ID NO: 719517

SEQ ID NO: 1053652 - protein, 17 aa, Mycobacterium
RELAQALLKHWATGKPL

SEQ ID NO: 1053653 - protein, 24 aa, Mycobacterium
RELEWPAMRISHCRPPDSDRDVVL

SEQ ID NO: 1053654 - protein, 20 aa, Mycobacterium
RELIDRYPLRGIKGPMGTAQ

SEQ ID NO: 1053655 - protein, 21 aa, Mycobacterium
RELIIGSAYVCFRRQGFQKTT

SEQ ID NO: 1053656 - protein, 23 aa, Mycobacterium
RELKLGTGGLRDVEFVAQLLQLV

SEQ ID NO: 1053657 - protein, 25 aa, Mycobacterium
RELLAACRRHRALLVIDEAHGLGVR

SEQ ID NO: 1053658 - protein, 20 aa, Mycobacterium
RELLPYSDLDLVLLHDGKPV

SEQ ID NO: 1053659 - protein, 17 aa, Mycobacterium
RELLSRERITVLNQTPS

SEQ ID NO: 1053660 - protein, 19 aa, Mycobacterium
RELLTMSWISVSPSCLTAL

SEQ ID NO: 1053661 - protein, 17 aa, Mycobacterium
RELPGGALALVNDAGMR

SEQ ID NO: 1053662 - protein, 24 aa, Mycobacterium
RELQELRKSTGLDVSDRIQVLISV

SEQ ID NO: 1053663 - protein, 29 aa, Mycobacterium
RELQIRGSEHFSRLVQPWNCTAVPVHDPS

SEQ ID NO: 1053664 - protein, 22 aa, Mycobacterium
RELSDLAALARRTGAADDPFIR

SEQ ID NO: 1053665 - protein, 19 aa, Mycobacterium
RELSGGRRSFILVPGIDVP

SEQ ID NO: 1053666 - protein, 21 aa, Mycobacterium
RELTAELALALGAATAQHLAS

SEQ ID NO: 1053667 - protein, 20 aa, Mycobacterium
RELTDLPLIVKGICHPDDAR

SEQ ID NO: 1053668 - protein, 17 aa, Mycobacterium
RELTHGVMADSVLVSPS

SEQ ID NO: 1053669 - protein, 30 aa, Mycobacterium; identical to SEQ ID NO: 719656

SEQ ID NO: 1053670 - protein, 25 aa, Mycobacterium
RENFRRAFCGFDIEKVAGYTDADVQ

SEQ ID NO: 1053671 - protein, 19 aa, Mycobacterium
RENIREVHRADLIGQHIGE

SEQ ID NO: 1053672 - protein, 20 aa, Mycobacterium
REPGRLRIALSTKIPTPLPV

SEQ ID NO: 1053673 - protein, 18 aa, Mycobacterium
REPGRPLWVGSIKSNMAH

SEQ ID NO: 1053674 - protein, 24 aa, Mycobacterium
REPKPMVYSGLYPVDGSDYPNLRD

SEQ ID NO: 1053675 - protein, 17 aa, Mycobacterium
REPLPGLGHAVEIRAYR

SEQ ID NO: 1053676 - protein, 26 aa, Mycobacterium
REPMPWNGPLFKFALFQVASEEFNLF

SEQ ID NO: 1053677 - protein, 23 aa, Mycobacterium
REPRGPWGPGRAVEAADAFEAVR

SEQ ID NO: 1053678 - protein, 18 aa, Mycobacterium
REPYRKLINQGYIQAFAY

SEQ ID NO: 1053679 - protein, 24 aa, Mycobacterium
REQALRFGADLRMEDVQSVSLDGP

SEQ ID NO: 1053680 - protein, 17 aa, Mycobacterium
REQALRHICHWMCPTCR

SEQ ID NO: 1053681 - protein, 18 aa, Mycobacterium
REQARLQAAQLERRRALA

SEQ ID NO: 1053682 - protein, 18 aa, Mycobacterium
REQFAYLSYGRVMDTTRM

SEQ ID NO: 1053683 - protein, 18 aa, Mycobacterium
REQLGWVALNGRRNAALN

SEQ ID NO: 1053684 - protein, 21 aa, Mycobacterium
REQRAALPPMHEGRVDVIGGG

SEQ ID NO: 1053685 - protein, 17 aa, Mycobacterium
REQREALAHGRYLGLGL

SEQ ID NO: 1053686 - protein, 18 aa, Mycobacterium
REQWRLRKLDELGWIVIR

SEQ ID NO: 1053687 - protein, 30 aa, Mycobacterium; identical to SEQ ID NO: 719786

SEQ ID NO: 1053688 - protein, 19 aa, Mycobacterium
RERARRKFAEYSRVDWEVI

SEQ ID NO: 1053689 - protein, 22 aa, Mycobacterium
RERFAPMRILTGIEVDILEDGS

SEQ ID NO: 1053690 - protein, 22 aa, Mycobacterium
RERGLEMSRLLISSWDIPGICD

SEQ ID NO: 1053691 - protein, 18 aa, Mycobacterium
RERLRDLFGRHVGTDVAR

SEQ ID NO: 1053692 - protein, 19 aa, Mycobacterium
RERLSGWSADLGHHRPADC

SEQ ID NO: 1053693 - protein, 22 aa, Mycobacterium
RERYPAWDRFTAVRDRLDPNRV

SEQ ID NO: 1053694 - protein, 17 aa, Mycobacterium
RESAATAATAAWAVTAA

SEQ ID NO: 1053695 - protein, 25 aa, Mycobacterium
RESLRTLGLRRIRHTVVRDDNAQTR

SEQ ID NO: 1053696 - protein, 26 aa, Mycobacterium
RESTDLRPARSFAVDYAGWVGLSQEG

SEQ ID NO: 1053697 - protein, 21 aa, Mycobacterium
RESYRGFLERHVALYHDEWEK

SEQ ID NO: 1053698 - protein, 25 aa, Mycobacterium
RETPHVPIPYCYAVDLRFLLSPPVG

SEQ ID NO: 1053699 - protein, 21 aa, Mycobacterium
RETPLPGALLVRVARSHLRVG

SEQ ID NO: 1053700 - protein, 23 aa, Mycobacterium
REVAAEFERPVLLFSGGKDSIVM

SEQ ID NO: 1053701 - protein, 28 aa, Mycobacterium
REVAIDLRQDWPSALRAAGFDPSARTAW

SEQ ID NO: 1053702 - protein, 19 aa, Mycobacterium
REVLFCPDQFLGAHVRRST

SEQ ID NO: 1053703 - protein, 23 aa, Mycobacterium
REVRIGMARPMWIDDPDFDITYH

SEQ ID NO: 1053704 - protein, 19 aa, Mycobacterium
REVSLSVLQVWQAFTEAVS

SEQ ID NO: 1053705 - protein, 20 aa, Mycobacterium
REVVARTGLQDCRTHGRTWD

SEQ ID NO: 1053706 - protein, 18 aa, Mycobacterium
REWSDWATRTAMPSLRIP

SEQ ID NO: 1053707 - protein, 27 aa, Mycobacterium
REYAYFSHAWLRPAAGVGEMFDTLLVF

SEQ ID NO: 1053708 - protein, 17 aa, Mycobacterium
REYYPAGTTVNVDAKLY

SEQ ID NO: 1053709 - protein, 19 aa, Mycobacterium
RFAALLSNAKTIFWNGPMG

SEQ ID NO: 1053710 - protein, 20 aa, Mycobacterium
RFAANAVGDWVMKRTAAEAI

SEQ ID NO: 1053711 - protein, 24 aa, Mycobacterium
RFAAPVPGRHGWHVPPVAAPPLER

SEQ ID NO: 1053712 - protein, 20 aa, Mycobacterium
RFAEILPHAQLVNLYGPTET

SEQ ID NO: 1053713 - protein, 26 aa, Mycobacterium
RFAFNGWKALGWMDANVWRHVAPKGW

SEQ ID NO: 1053714 - protein, 18 aa, Mycobacterium
RFAGLALEGELQFDQNTS

SEQ ID NO: 1053715 - protein, 18 aa, Mycobacterium
RFAIVRAMAIKETRDIVI

SEQ ID NO: 1053716 - protein, 18 aa, Mycobacterium
RFAPEGPMGRLCAETAER

SEQ ID NO: 1053717 - protein, 21 aa, Mycobacterium
RFAQFTKPVTLVWGMGDRCFK

SEQ ID NO: 1053718 - protein, 18 aa, Mycobacterium
RFDALKIFLTLRALGERR

SEQ ID NO: 1053719 - protein, 21 aa, Mycobacterium
RFDFNEVFFTDVFVADDMLVG

SEQ ID NO: 1053720 - protein, 21 aa, Mycobacterium
RFDPAAAWAMAARERVMSLSI

SEQ ID NO: 1053721 - protein, 18 aa, Mycobacterium
RFDVDDVYLGNGVSELIT

SEQ ID NO: 1053722 - protein, 18 aa, Mycobacterium
RFDVDWAEYGFADESARH

SEQ ID NO: 1053723 - protein, 17 aa, Mycobacterium
RFEKRLRAPAAKMHADE

SEQ ID NO: 1053724 - protein, 23 aa, Mycobacterium
RFEREMMDLYGISPVGHPQPRRL

SEQ ID NO: 1053725 - protein, 17 aa, Mycobacterium
RFFEYFGHASVRRGIRL

SEQ ID NO: 1053726 - protein, 23 aa, Mycobacterium
RFGADLPPLDGIYLAAFAGGPVL

SEQ ID NO: 1053727 - protein, 19 aa, Mycobacterium
RFGEVEARGVALTRRGRER

SEQ ID NO: 1053728 - protein, 17 aa, Mycobacterium
RFGLDATAVRRDPGWSV

SEQ ID NO: 1053729 - protein, 19 aa, Mycobacterium
RFGLDRMIVNSAADWGRSD

SEQ ID NO: 1053730 - protein, 18 aa, Mycobacterium
RFGSVAAQLREFLDSLGG

SEQ ID NO: 1053731 - protein, 21 aa, Mycobacterium
RFGVDLPPLEGIYLAAFAGRP

SEQ ID NO: 1053732 - protein, 22 aa, Mycobacterium
RFGVDLPPLEGIYLAAFAGRPV

SEQ ID NO: 1053733 - protein, 18 aa, Mycobacterium
RFHLGRKGAVHGGALGML

SEQ ID NO: 1053734 - protein, 17 aa, Mycobacterium
RFHNWKIVFQEQRCQGT

SEQ ID NO: 1053735 - protein, 17 aa, Mycobacterium
RFHRRLASFSRLIRFDH

SEQ ID NO: 1053736 - protein, 18 aa, Mycobacterium
RFHTLMAEMSGEVFDSAL

SEQ ID NO: 1053737 - protein, 26 aa, Mycobacterium
RFIGGRPSTFGWIPFGGGTRRCVGAA

SEQ ID NO: 1053738 - protein, 19 aa, Mycobacterium
RFIGQRVAAVVADSVAVAE

SEQ ID NO: 1053739 - protein, 20 aa, Mycobacterium
RFLEREGWIAWSGPAISELL

SEQ ID NO: 1053740 - protein, 25 aa, Mycobacterium
RFLFGLDLIDRVVFWMLPLDDSLPW

SEQ ID NO: 1053741 - protein, 21 aa, Mycobacterium
RFLLTAGAIGSLFKERASISG

SEQ ID NO: 1053742 - protein, 27 aa, Mycobacterium
RFLPLEELIAAFLPVLFPGMEIVEHHA

SEQ ID NO: 1053743 - protein, 36 aa, Mycobacterium
RFPRPFTRDKIEAVLGWPRGHIMWLYEQDIQPDEER

SEQ ID NO: 1053744 - protein, 18 aa, Mycobacterium
RFSALRRHYVYRLSTAPY

SEQ ID NO: 1053745 - protein, 20 aa, Mycobacterium
RFSPFSGFGFFASGLSGFAE

SEQ ID NO: 1053746 - protein, 23 aa, Mycobacterium
RFSSDLLIGLGIEPCIDELLDAD

SEQ ID NO: 1053747 - protein, 18 aa, Mycobacterium
RFSVPVPNLTPWRDSTVG

SEQ ID NO: 1053748 - protein, 18 aa, Mycobacterium
RFTPEAAERTAVPGVATG

SEQ ID NO: 1053749 - protein, 17 aa, Mycobacterium
RFVEALNAGAQSYVGAE

SEQ ID NO: 1053750 - protein, 23 aa, Mycobacterium
RFVFANADAFSWRETFESLVPVD

SEQ ID NO: 1053751 - protein, 24 aa, Mycobacterium
RFYERKEIRDIVAYLRVLDNPGDA

SEQ ID NO: 1053752 - protein, 18 aa, Mycobacterium
RFYTNVLKLGSRNPLLLA

SEQ ID NO: 1053753 - protein, 33 aa, Mycobacterium; identical to SEQ ID NO: 720379

SEQ ID NO: 1053754 - protein, 20 aa, Mycobacterium
RGAAELDTLFPGLLTDLVAA

SEQ ID NO: 1053755 - protein, 25 aa, Mycobacterium
RGADGWRLDAAYAVPQQFWAKVLPR

SEQ ID NO: 1053756 - protein, 17 aa, Mycobacterium
RGADLRANFTIKGVGDP

SEQ ID NO: 1053757 - protein, 21 aa, Mycobacterium
RGADVALGLAQVVIRPDTSAV

SEQ ID NO: 1053758 - protein, 18 aa, Mycobacterium
RGAELGFPTANVAPPMYS

SEQ ID NO: 1053759 - protein, 17 aa, Mycobacterium
RGAELIVVSASWGSGPG

SEQ ID NO: 1053760 - protein, 18 aa, Mycobacterium
RGAELLGIELAGTGWHYQ

SEQ ID NO: 1053761 - protein, 26 aa, Mycobacterium
RGAEYSVDFVPKVRIEVVVDDSIVDK

SEQ ID NO: 1053762 - protein, 28 aa, Mycobacterium
RGAFHWWLVLATLRWGVICQYQAWRHLS

SEQ ID NO: 1053763 - protein, 19 aa, Mycobacterium
RGALTTALPTPAAREVYLL

SEQ ID NO: 1053764 - protein, 20 aa, Mycobacterium
RGAPNVKIQGFSFWGGVGIK

SEQ ID NO: 1053765 - protein, 25 aa, Mycobacterium
RGAPPHWCTAWGGPSTRWAPSSSAP

SEQ ID NO: 1053766 - protein, 20 aa, Mycobacterium
RGAPTPGFGRISAVRLQVSG

SEQ ID NO: 1053767 - protein, 27 aa, Mycobacterium
RGAPVPGVYVAGWIKRGPSGFIGTNKS

SEQ ID NO: 1053768 - protein, 23 aa, Mycobacterium
RGAPVVFPLIGVVPGFQKAIAGQ

SEQ ID NO: 1053769 - protein, 17 aa, Mycobacterium
RGASLGVQIRYETGATE

SEQ ID NO: 1053770 - protein, 19 aa, Mycobacterium
RGASLRWVEANAQALPFDT

SEQ ID NO: 1053771 - protein, 23 aa, Mycobacterium
RGATALRGIWGFHGDRRTHGDKL

SEQ ID NO: 1053772 - protein, 20 aa, Mycobacterium
RGCGDSWSAACLVRSGVGEG

SEQ ID NO: 1053773 - protein, 18 aa, Mycobacterium
RGDCEVSKIIVLDDLTAT

SEQ ID NO: 1053774 - protein, 25 aa, Mycobacterium
RGDDAWRPTLRRVMRAKMDPRKNPL

SEQ ID NO: 1053775 - protein, 20 aa, Mycobacterium
RGDHWVPPGLTARLAGEWPT

SEQ ID NO: 1053776 - protein, 26 aa, Mycobacterium
RGDLALKMGLPVLAVVAFAQSFGDGV

SEQ ID NO: 1053777 - protein, 20 aa, Mycobacterium
RGDLKTSVFALYQPPAPPSM

SEQ ID NO: 1053778 - protein, 28 aa, Mycobacterium
RGEIARRVFATCRRLGLGTVAVYTDPDA

SEQ ID NO: 1053779 - protein, 22 aa, Mycobacterium
RGEMLERMGWIVIRVVAEDRRV

SEQ ID NO: 1053780 - protein, 26 aa, Mycobacterium
RGEPLPWQDLRAAFTERGWLDLTHTR

SEQ ID NO: 1053781 - protein, 21 aa, Mycobacterium
RGERNWDYRYAWVRDSTFALW

SEQ ID NO: 1053782 - protein, 27 aa, Mycobacterium
RGFHVYARIAPQWSFSQVRLAAQTVAR

SEQ ID NO: 1053783 - protein, 17 aa, Mycobacterium
RGFPLRDRVAAMVPDVP

SEQ ID NO: 1053784 - protein, 17 aa, Mycobacterium
RGGAVSGIGGHNAAMAV

SEQ ID NO: 1053785 - protein, 21 aa, Mycobacterium
RGGCMAAKFFTGLPLDGPDPE

SEQ ID NO: 1053786 - protein, 27 aa, Mycobacterium
RGGDGNTRYTPRGNVGGHGGNGGTGGA

SEQ ID NO: 1053787 - protein, 23 aa, Mycobacterium
RGGGAALPFKRRLFGQIVAAAVR

SEQ ID NO: 1053788 - protein, 21 aa, Mycobacterium
RGGKISFTHLLGYALVQAVKK

SEQ ID NO: 1053789 - protein, 18 aa, Mycobacterium
RGGLMVHDVFDHTSQLKL

SEQ ID NO: 1053790 - protein, 17 aa, Mycobacterium
RGGPDGRDARVQFRCHR

SEQ ID NO: 1053791 - protein, 19 aa, Mycobacterium
RGGSAVGLIGNGGAGGVGG

SEQ ID NO: 1053792 - protein, 26 aa, Mycobacterium
RGGSGGAGGDAWLFGSGGSGGSGGAG

SEQ ID NO: 1053793 - protein, 20 aa, Mycobacterium
RGGSGGLLFGNGGLAGQGGS

SEQ ID NO: 1053794 - protein, 17 aa, Mycobacterium
RGGVSLHGVDKTFGTAA

SEQ ID NO: 1053795 - protein, 29 aa, Mycobacterium
RGHGYGVHAIKVFDAFPLTHHVECVALLT

SEQ ID NO: 1053796 - protein, 17 aa, Mycobacterium
RGHICPKGASLGALHDD

SEQ ID NO: 1053797 - protein, 23 aa, Mycobacterium
RGHLRKFGLSRVRVRELAHAGQL

SEQ ID NO: 1053798 - protein, 17 aa, Mycobacterium
RGIGGSDVTAWLRTINT

SEQ ID NO: 1053799 - protein, 20 aa, Mycobacterium
RGIGKIDRRALVRRFAAATD

SEQ ID NO: 1053800 - protein, 17 aa, Mycobacterium
RGIGLAIAQRLATDGHR

SEQ ID NO: 1053801 - protein, 21 aa, Mycobacterium
RGIVHRESFQIILVDTPGLHR

SEQ ID NO: 1053802 - protein, 21 aa, Mycobacterium
RGKCTPRRAAPPAQHVANLSF

SEQ ID NO: 1053803 - protein, 24 aa, Mycobacterium
RGKGCDICKPVVASILASTGSDHI

SEQ ID NO: 1053804 - protein, 17 aa, Mycobacterium
RGKHKPTFAPNVDGGDF

SEQ ID NO: 1053805 - protein, 25 aa, Mycobacterium
RGLAREIACAFDLDFVDPADVAPLP

SEQ ID NO: 1053806 - protein, 17 aa, Mycobacterium
RGLDRLRRASGSRGPYL

SEQ ID NO: 1053807 - protein, 18 aa, Mycobacterium
RGLESFPPTGGVLVVSNH

SEQ ID NO: 1053808 - protein, 28 aa, Mycobacterium
RGLIAEFGISWILPRLTSWAVALDLLLS

SEQ ID NO: 1053809 - protein, 21 aa, Mycobacterium
RGLKAAITAVRAWRRAKPGKA

SEQ ID NO: 1053810 - protein, 17 aa, Mycobacterium
RGLLLTTLWYIREVDPT

SEQ ID NO: 1053811 - protein, 25 aa, Mycobacterium
RGLPEVFRALLALILIVLRRDTGAA

SEQ ID NO: 1053812 - protein, 27 aa, Mycobacterium
RGLPLPIIAGNLFRFELLRTRHDLRQR

SEQ ID NO: 1053813 - protein, 18 aa, Mycobacterium
RGLSLGRQGLDGMSRISG

SEQ ID NO: 1053814 - protein, 18 aa, Mycobacterium
RGLSQMAVYNCYGPTEMT

SEQ ID NO: 1053815 - protein, 24 aa, Mycobacterium
RGLVAVAGLRPIAAGYLLMSCKNR

SEQ ID NO: 1053816 - protein, 18 aa, Mycobacterium
RGLVEGHVRISLDAPDLV

SEQ ID NO: 1053817 - protein, 18 aa, Mycobacterium
RGMGKYPTIQPFEYLEEV

SEQ ID NO: 1053818 - protein, 18 aa, Mycobacterium
RGMYRYRAATKQCAHKAQ

SEQ ID NO: 1053819 - protein, 21 aa, Mycobacterium
RGNFASGYRGKLWTFRQYSGF

SEQ ID NO: 1053820 - protein, 19 aa, Mycobacterium
RGPALLDYIAEYRRRAGIT

SEQ ID NO: 1053821 - protein, 18 aa, Mycobacterium
RGPDFSAMLEPVFGRDAL

SEQ ID NO: 1053822 - protein, 23 aa, Mycobacterium
RGPGRPPLMFRAVQQMDRGGARH

SEQ ID NO: 1053823 - protein, 26 aa, Mycobacterium
RGPIDRFHRRLLWPIRSSAGEVIGFG

SEQ ID NO: 1053824 - protein, 20 aa, Mycobacterium
RGPNAGSRFLLDQPITSAGR

SEQ ID NO: 1053825 - protein, 17 aa, Mycobacterium
RGPRAEVVLSLRNPEPA

SEQ ID NO: 1053826 - protein, 17 aa, Mycobacterium
RGPRISRGMRTPFVAPI

SEQ ID NO: 1053827 - protein, 18 aa, Mycobacterium
RGPSKFLAELKLLPQEEW

SEQ ID NO: 1053828 - protein, 18 aa, Mycobacterium
RGPSPWTIGERELFAAFV

SEQ ID NO: 1053829 - protein, 19 aa, Mycobacterium
RGQLGIWLDLQINGAGPRW

SEQ ID NO: 1053830 - protein, 18 aa, Mycobacterium
RGQPGCRGPATSLGYLGG

SEQ ID NO: 1053831 - protein, 25 aa, Mycobacterium
RGQRLLQSCPVCLYAGSIMPDDLLA

SEQ ID NO: 1053832 - protein, 18 aa, Mycobacterium
RGRDRAELRRTAGDSLAR

SEQ ID NO: 1053833 - protein, 17 aa, Mycobacterium
RGREVLHRLIATCDVIA

SEQ ID NO: 1053834 - protein, 17 aa, Mycobacterium
RGRFGRLVVGMQASGAK

SEQ ID NO: 1053835 - protein, 26 aa, Mycobacterium
RGRFLRWALPVAYRLPGLGRLRAPVT

SEQ ID NO: 1053836 - protein, 20 aa, Mycobacterium
RGRGGFAGMVVGSVAESVAQ

SEQ ID NO: 1053837 - protein, 21 aa, Mycobacterium
RGRHAEALGHCSALLAKDTAN

SEQ ID NO: 1053838 - protein, 22 aa, Mycobacterium
RGRLAQRPARDFTLADHPGAEG

SEQ ID NO: 1053839 - protein, 29 aa, Mycobacterium
RGRNVPKLRQVIGCVFQDFRLLQQKTVYE

SEQ ID NO: 1053840 - protein, 19 aa, Mycobacterium
RGRPFGAWMHGNEGTEGAL

SEQ ID NO: 1053841 - protein, 25 aa, Mycobacterium
RGRRPRFYRPPPRPDVIATLDSAGL

SEQ ID NO: 1053842 - protein, 25 aa, Mycobacterium
RGSAKRITAVMPFYPYARQDKKHRG

SEQ ID NO: 1053843 - protein, 25 aa, Mycobacterium
RGSAMGARTTCPARTAVTADSSVAI

SEQ ID NO: 1053844 - protein, 20 aa, Mycobacterium
RGSFRGARVPIVIDDDDDRA

SEQ ID NO: 1053845 - protein, 17 aa, Mycobacterium
RGSGIGIVPAATRGGQR

SEQ ID NO: 1053846 - protein, 19 aa, Mycobacterium
RGSGYGVAALCGGGGQGDA

SEQ ID NO: 1053847 - protein, 18 aa, Mycobacterium
RGSLKGLRLSYFGDGANN

SEQ ID NO: 1053848 - protein, 23 aa, Mycobacterium
RGSPRAVLRVAPLSVAGLLAATV

SEQ ID NO: 1053849 - protein, 18 aa, Mycobacterium
RGSRIGRPIPDLECLLTD

SEQ ID NO: 1053850 - protein, 20 aa, Mycobacterium
RGSTRPDGVVAWTGDPAAGA

SEQ ID NO: 1053851 - protein, 18 aa, Mycobacterium
RGTAKGPAGQNFTFLPGT

SEQ ID NO: 1053852 - protein, 17 aa, Mycobacterium
RGTDTKIAWKGDEAVEL

SEQ ID NO: 1053853 - protein, 23 aa, Mycobacterium
RGTGARGLRAIMEEVLLPVMYDI

SEQ ID NO: 1053854 - protein, 22 aa, Mycobacterium
RGTRLPVWLTQWGYQRPPEETV

SEQ ID NO: 1053855 - protein, 27 aa, Mycobacterium
RGVGQGRLYFGIGLPELTLPPLDVPGI

SEQ ID NO: 1053856 - protein, 21 aa, Mycobacterium
RGVGSAENFSVVEALADSLGG

SEQ ID NO: 1053857 - protein, 17 aa, Mycobacterium
RGVGVIELRGESLTPGY

SEQ ID NO: 1053858 - protein, 17 aa, Mycobacterium
RGVGVIELRGESVTPGY

SEQ ID NO: 1053859 - protein, 20 aa, Mycobacterium
RGVLPSRLRLIYLADGQVLD

SEQ ID NO: 1053860 - protein, 17 aa, Mycobacterium
RGVLSVRAKIKVRLTQL

SEQ ID NO: 1053861 - protein, 17 aa, Mycobacterium
RGVPVERIYRDVRLLRL

SEQ ID NO: 1053862 - protein, 19 aa, Mycobacterium
RGVVVPPEQVEVFRGDGSY

SEQ ID NO: 1053863 - protein, 21 aa, Mycobacterium
RGVVYCLLGRNGAGKTTTIRM

SEQ ID NO: 1053864 - protein, 19 aa, Mycobacterium
RGWEHRWALSVLHTALGGG

SEQ ID NO: 1053865 - protein, 25 aa, Mycobacterium
RGWGEPRAATTWASGTPATTTSASA

SEQ ID NO: 1053866 - protein, 25 aa, Mycobacterium
RGWVQYEPYGTVLIIGAWNYPFYLT

SEQ ID NO: 1053867 - protein, 18 aa, Mycobacterium
RGYTGWDVTSPAYVLENP

SEQ ID NO: 1053868 - protein, 18 aa, Mycobacterium
RHAALHCARLQRISAGRR

SEQ ID NO: 1053869 - protein, 17 aa, Mycobacterium
RHADALLVTGVVTRNMA

SEQ ID NO: 1053870 - protein, 18 aa, Mycobacterium
RHAEGWSHYLDRLVAAAL

SEQ ID NO: 1053871 - protein, 30 aa, Mycobacterium; identical to SEQ ID NO: 721267

SEQ ID NO: 1053872 - protein, 22 aa, Mycobacterium
RHEFNCPVRLFEIGASAGLNLR

SEQ ID NO: 1053873 - protein, 22 aa, Mycobacterium
RHFRPEFFAAMRRLCDEHDALL

SEQ ID NO: 1053874 - protein, 17 aa, Mycobacterium
RHGDTEWSKSGKHTGRT

SEQ ID NO: 1053875 - protein, 20 aa, Mycobacterium
RHGFDLDMAALVYFDDRTDA

SEQ ID NO: 1053876 - protein, 20 aa, Mycobacterium
RHGKELTWSQVLMAANTPML

SEQ ID NO: 1053877 - protein, 21 aa, Mycobacterium
RHGLSWLLPDIDCVHPLDDGS

SEQ ID NO: 1053878 - protein, 20 aa, Mycobacterium
RHGLTLNTTVLFAWAVVLSR

SEQ ID NO: 1053879 - protein, 17 aa, Mycobacterium
RHLEVIALTPARLLVVV

SEQ ID NO: 1053880 - protein, 22 aa, Mycobacterium
RHLRTPITAALSRRLGQQIQLG

SEQ ID NO: 1053881 - protein, 25 aa, Mycobacterium
RHNEKLCGMRNLDEGFVPELYDPTL

SEQ ID NO: 1053882 - protein, 25 aa, Mycobacterium
RHNFLGAPFWVGRGFGLNLSVVTDP

SEQ ID NO: 1053883 - protein, 31 aa, Mycobacterium; identical to SEQ ID NO: 721409

SEQ ID NO: 1053884 - protein, 26 aa, Mycobacterium
RHPASGAARLFADWTAGQSDGGPSVI

SEQ ID NO: 1053885 - protein, 19 aa, Mycobacterium
RHPETPGGLHLAIDAAVHA

SEQ ID NO: 1053886 - protein, 19 aa, Mycobacterium
RHPEVRFGERLEDDLVRRD

SEQ ID NO: 1053887 - protein, 23 aa, Mycobacterium
RHPLRPAAFGPRAALPATMMARW

SEQ ID NO: 1053888 - protein, 22 aa, Mycobacterium
RHRADGCIELLGRDSATINSGG

SEQ ID NO: 1053889 - protein, 19 aa, Mycobacterium
RHRAMIQAFVEWRGQTRSE

SEQ ID NO: 1053890 - protein, 17 aa, Mycobacterium
RHRCGLAAKGVAAKGGW

SEQ ID NO: 1053891 - protein, 24 aa, Mycobacterium
RHRRFRFYLNVEIGRQLSHADLLA

SEQ ID NO: 1053892 - protein, 18 aa, Mycobacterium
RHRWLLEQVSFIAAIEHY

SEQ ID NO: 1053893 - protein, 17 aa, Mycobacterium
RHSIALRDYLVVTRSVD

SEQ ID NO: 1053894 - protein, 23 aa, Mycobacterium
RHSQPYAWPGRVIGKIAGEIPLE

SEQ ID NO: 1053895 - protein, 18 aa, Mycobacterium
RIAAAGTRFSQLEVQRGI

SEQ ID NO: 1053896 - protein, 25 aa, Mycobacterium
RIAEHEMPGLMSLRREYAEVQPLKG

SEQ ID NO: 1053897 - protein, 22 aa, Mycobacterium
RIAERSGLPPGVINVVPGEGPE

SEQ ID NO: 1053898 - protein, 29 aa, Mycobacterium
RIAGRVGLRPDVRRVPLFGLGCVAGAAGV

SEQ ID NO: 1053899 - protein, 18 aa, Mycobacterium
RIAHTLGLHGPAMTVDTA

SEQ ID NO: 1053900 - protein, 18 aa, Mycobacterium
RIARCALVKAFVASSDCS

SEQ ID NO: 1053901 - protein, 17 aa, Mycobacterium
RIARLGAGWIAISPSPQ

SEQ ID NO: 1053902 - protein, 24 aa, Mycobacterium
RIASTLLLDRDWLLIKTDFLMHAA

SEQ ID NO: 1053903 - protein, 19 aa, Mycobacterium
RIAVTPLGITSVRFTGGEP

SEQ ID NO: 1053904 - protein, 21 aa, Mycobacterium
RIDGAGARRVQPTGSGADENT

SEQ ID NO: 1053905 - protein, 20 aa, Mycobacterium
RIDGAYGDRNLVCSCPPVEA

SEQ ID NO: 1053906 - protein, 23 aa, Mycobacterium
RIDHIIGLFRLWWIPEGAAPTEG

SEQ ID NO: 1053907 - protein, 18 aa, Mycobacterium
RIDVPVYLGCDWQNVPLN

SEQ ID NO: 1053908 - protein, 27 aa, Mycobacterium
RIEILPITIGLPFGLTMFFPANFPLPA

SEQ ID NO: 1053909 - protein, 26 aa, Mycobacterium
RIERELPEWLSADVAILGEPTSGYIE

SEQ ID NO: 1053910 - protein, 23 aa, Mycobacterium
RIERIETRLAMSIPAGAGATSAP

SEQ ID NO: 1053911 - protein, 17 aa, Mycobacterium
RIGALSVGLDRKDGAAW

SEQ ID NO: 1053912 - protein, 21 aa, Mycobacterium
RIGAYERYWLYPGAQNLANFR

SEQ ID NO: 1053913 - protein, 20 aa, Mycobacterium
RIGDLPVRAVVSSPLLRCRT

SEQ ID NO: 1053914 - protein, 26 aa, Mycobacterium
RIGELCAPGSRIAVGALGSRLDRKQL

SEQ ID NO: 1053915 - protein, 20 aa, Mycobacterium
RIGGAKAWLGTALALKPLLR

SEQ ID NO: 1053916 - protein, 19 aa, Mycobacterium
RIGMPATRFLGPALGSLHM

SEQ ID NO: 1053917 - protein, 26 aa, Mycobacterium
RIGRKPRGSYQIAILGLKGGAGKTTT

SEQ ID NO: 1053918 - protein, 18 aa, Mycobacterium
RIGSALSAANLTAAAPTT

SEQ ID NO: 1053919 - protein, 17 aa, Mycobacterium
RIHLESAGFGIDCYNRL

SEQ ID NO: 1053920 - protein, 26 aa, Mycobacterium
RIIARMLAVMLRRRVAEAGMDTGGVE

SEQ ID NO: 1053921 - protein, 25 aa, Mycobacterium
RIKLDRAAYVYPMFEQALRIANGES

SEQ ID NO: 1053922 - protein, 17 aa, Mycobacterium
RILDRLYGYEVSPVLWK

SEQ ID NO: 1053923 - protein, 20 aa, Mycobacterium
RILFHDWEHEMSPDLHIVQI

SEQ ID NO: 1053924 - protein, 25 aa, Mycobacterium
RILIQQLLEFGWRPDDSVILAAAGT

SEQ ID NO: 1053925 - protein, 21 aa, Mycobacterium
RIPAFYFACSATVLGPYDDAP

SEQ ID NO: 1053926 - protein, 27 aa, Mycobacterium
RIPDDLAFAESRIRPSTIAAEDLLHDI

SEQ ID NO: 1053927 - protein, 22 aa, Mycobacterium
RIPVTSVMSFMFPNWHEFSRNV

SEQ ID NO: 1053928 - protein, 26 aa, Mycobacterium
RIQALLSEAARTWADRLIGAASDASV

SEQ ID NO: 1053929 - protein, 35 aa, Mycobacterium; identical to SEQ ID NO: 721867

SEQ ID NO: 1053930 - protein, 31 aa, Mycobacterium
RIQLPAMRVLVAPVCYGESLSAVEAAAVIAT

SEQ ID NO: 1053931 - protein, 20 aa, Mycobacterium
RIRGLLAQRIDLMPPLRWRV

SEQ ID NO: 1053932 - protein, 19 aa, Mycobacterium
RIRYHGGEFIDLIVGGETY

SEQ ID NO: 1053933 - protein, 26 aa, Mycobacterium
RISALRWGGRAPRVIFLHDGGQNAHT

SEQ ID NO: 1053934 - protein, 24 aa, Mycobacterium
RISARPASPLAEWIARGSVDDISF

SEQ ID NO: 1053935 - protein, 21 aa, Mycobacterium
RISDVLLPFLVTRQLICGAGK

SEQ ID NO: 1053936 - protein, 17 aa, Mycobacterium
RISFGRFGDDLAERVSD

SEQ ID NO: 1053937 - protein, 18 aa, Mycobacterium
RISGVLINLRPDRPADKA

SEQ ID NO: 1053938 - protein, 19 aa, Mycobacterium
RISHAFNLRGPSIAVQTAC

SEQ ID NO: 1053939 - protein, 17 aa, Mycobacterium
RISNALVAMAIESLGAH

SEQ ID NO: 1053940 - protein, 17 aa, Mycobacterium
RITFPYRNIERLRDRPE

SEQ ID NO: 1053941 - protein, 21 aa, Mycobacterium
RIVLTHELFHYAARVDTALDA

SEQ ID NO: 1053942 - protein, 26 aa, Mycobacterium
RIVNQLPRKVAMEMLLTGEPITASDA

SEQ ID NO: 1053943 - protein, 24 aa, Mycobacterium
RIVRRMLAAVGFPVQALVRIDIGG

SEQ ID NO: 1053944 - protein, 20 aa, Mycobacterium
RIVTIEALEHFGFHRYDDFF

SEQ ID NO: 1053945 - protein, 18 aa, Mycobacterium
RIWDEARDSLGHLPFTQG

SEQ ID NO: 1053946 - protein, 17 aa, Mycobacterium
RIYPEMRKLVQAHVARG

SEQ ID NO: 1053947 - protein, 27 aa, Mycobacterium
RKAARRRAVELLELVGIAQPERRARAF

SEQ ID NO: 1053948 - protein, 25 aa, Mycobacterium
RKADELGCRSLALVAFGTGVGGFPL

SEQ ID NO: 1053949 - protein, 20 aa, Mycobacterium
RKAGRQVFKDYVAFPALTSV

SEQ ID NO: 1053950 - protein, 18 aa, Mycobacterium
RKAKGITHEQAREIMNDA

SEQ ID NO: 1053951 - protein, 17 aa, Mycobacterium
RKATARWREHGFELEFG

SEQ ID NO: 1053952 - protein, 25 aa, Mycobacterium
RKAVREIAGELVALYAKRQASPGHA

SEQ ID NO: 1053953 - protein, 20 aa, Mycobacterium
RKCIECFLCQNVCHVIRDHE

SEQ ID NO: 1053954 - protein, 21 aa, Mycobacterium
RKCSASPFMVLLAAYGVLVRR

SEQ ID NO: 1053955 - protein, 22 aa, Mycobacterium
RKDFRVVLGADRMGRVGALDHE

SEQ ID NO: 1053956 - protein, 20 aa, Mycobacterium
RKDIPIHYLLADTFTVCDRY

SEQ ID NO: 1053957 - protein, 20 aa, Mycobacterium
RKEDPRFIRGRGNYVDDVAL

SEQ ID NO: 1053958 - protein, 25 aa, Mycobacterium
RKGGKARSYPDWTVPELKKRAKELG

SEQ ID NO: 1053959 - protein, 27 aa, Mycobacterium
RKGIPGPRKLPALIWRILSAPLNAYAR

SEQ ID NO: 1053960 - protein, 24 aa, Mycobacterium
RKGRCRCGTIPDLIQLIPAAWQRT

SEQ ID NO: 1053961 - protein, 19 aa, Mycobacterium
RKGVPRAKLTGTIQNDILK

SEQ ID NO: 1053962 - protein, 19 aa, Mycobacterium
RKHPHSMGEWSMASRTHVA

SEQ ID NO: 1053963 - protein, 20 aa, Mycobacterium
RKHRLRFMIKAEMQEVRSVN

SEQ ID NO: 1053964 - protein, 17 aa, Mycobacterium
RKIEIGCYQGLRHRRGL

SEQ ID NO: 1053965 - protein, 20 aa, Mycobacterium
RKKADTRRALSDAALALAFE

SEQ ID NO: 1053966 - protein, 19 aa, Mycobacterium
RKKFGRLIFIGSVSGSWGI

SEQ ID NO: 1053967 - protein, 18 aa, Mycobacterium
RKKLASLAFQHTAEYDIA

SEQ ID NO: 1053968 - protein, 19 aa, Mycobacterium
RKKPPFGIGQIGKSFRNEI

SEQ ID NO: 1053969 - protein, 19 aa, Mycobacterium
RKLAQMTLDGIGPAVRSAA

SEQ ID NO: 1053970 - protein, 19 aa, Mycobacterium
RKLDAMSANLARLTDLTTE

SEQ ID NO: 1053971 - protein, 25 aa, Mycobacterium
RKLDRKATLAFAFSHRSYLDGMLLP

SEQ ID NO: 1053972 - protein, 17 aa, Mycobacterium
RKLLVRHLAARRIRSLE

SEQ ID NO: 1053973 - protein, 21 aa, Mycobacterium
RKLPAKARKAILEGADEQVHV

SEQ ID NO: 1053974 - protein, 17 aa, Mycobacterium
RKLQAIITKTHQGTAEL

SEQ ID NO: 1053975 - protein, 19 aa, Mycobacterium
RKLSPELTRPFTPPPTFMN

SEQ ID NO: 1053976 - protein, 21 aa, Mycobacterium
RKNGLPVYALAPFATRGLQKM

SEQ ID NO: 1053977 - protein, 28 aa, Mycobacterium
RKNPRWCQLCFEKAPGGAVTLPIGVLFA

SEQ ID NO: 1053978 - protein, 21 aa, Mycobacterium
RKPACGVCVLAKDCPSYGLGP

SEQ ID NO: 1053979 - protein, 18 aa, Mycobacterium
RKPFSVALFDEIEKAHQE

SEQ ID NO: 1053980 - protein, 17 aa, Mycobacterium
RKPGPRQAMLDAIDLAL

SEQ ID NO: 1053981 - protein, 25 aa, Mycobacterium
RKPSRVPVWFMRQAGRSLPEYRALR

SEQ ID NO: 1053982 - protein, 20 aa, Mycobacterium
RKPWPRPQIASYLFDQHCSA

SEQ ID NO: 1053983 - protein, 19 aa, Mycobacterium
RKPYGVDFVHNTWRFGIDR

SEQ ID NO: 1053984 - protein, 20 aa, Mycobacterium
RKQAVVAFDYAYHGRTNLTM

SEQ ID NO: 1053985 - protein, 25 aa, Mycobacterium
RKQGGRCVLMAPPGSPAHHVLSLVQ

SEQ ID NO: 1053986 - protein, 19 aa, Mycobacterium
RKQPGAQIFATFDADGQHR

SEQ ID NO: 1053987 - protein, 19 aa, Mycobacterium
RKRPDCKINVGPKRIAVTA

SEQ ID NO: 1053988 - protein, 26 aa, Mycobacterium
RKTCAPWLDAEWRLVSHDVRVIVALG

SEQ ID NO: 1053989 - protein, 22 aa, Mycobacterium
RKVAVEEFGFHVGLAQLAGNAL

SEQ ID NO: 1053990 - protein, 23 aa, Mycobacterium
RKVIQDFGRPVGLTLYVVTSVAQ

SEQ ID NO: 1053991 - protein, 18 aa, Mycobacterium
RKVMEELHRIRKDGEAGE

SEQ ID NO: 1053992 - protein, 19 aa, Mycobacterium
RKYGPPVYVRHEIVHNRHV

SEQ ID NO: 1053993 - protein, 17 aa, Mycobacterium
RLAAALDPAEYVFLDDD

SEQ ID NO: 1053994 - protein, 19 aa, Mycobacterium
RLAAEAGLPDGVLNVVTGL

SEQ ID NO: 1053995 - protein, 21 aa, Mycobacterium
RLAAGLPAYGACAGMIMLASE

SEQ ID NO: 1053996 - protein, 18 aa, Mycobacterium
RLAAPRYEVAAALEQAAL

SEQ ID NO: 1053997 - protein, 17 aa, Mycobacterium
RLAARFLALEGLPKGTF

SEQ ID NO: 1053998 - protein, 18 aa, Mycobacterium
RLADAPVIETITGLRPDR

SEQ ID NO: 1053999 - protein, 22 aa, Mycobacterium
RLADHPRVLAVLDRILMPNYLL

SEQ ID NO: 1054000 - protein, 19 aa, Mycobacterium
RLADYRITVTVARQRVVLD

SEQ ID NO: 1054001 - protein, 19 aa, Mycobacterium
RLAEFRIGPEEVKYPPLGS

SEQ ID NO: 1054002 - protein, 26 aa, Mycobacterium
RLAGAEIRVGYFLVEDHALRLLNLRR

SEQ ID NO: 1054003 - protein, 19 aa, Mycobacterium
RLAGEWPTPARRALPSALD

SEQ ID NO: 1054004 - protein, 21 aa, Mycobacterium
RLAGVAPKAARWWLLVSEGEA

SEQ ID NO: 1054005 - protein, 21 aa, Mycobacterium
RLAKRITTIVASAIEYEIKDP

SEQ ID NO: 1054006 - protein, 18 aa, Mycobacterium
RLALDRQRIDQIAGGLRQ

SEQ ID NO: 1054007 - protein, 19 aa, Mycobacterium
RLALDRQRIDQIAGGLRQV

SEQ ID NO: 1054008 - protein, 20 aa, Mycobacterium
RLAMHPDAYVRPSPTSGTLG

SEQ ID NO: 1054009 - protein, 24 aa, Mycobacterium
RLANALRSWSVLRFEVTEDPSPGV

SEQ ID NO: 1054010 - protein, 26 aa, Mycobacterium
RLANQIWRTNVLGAYHVAQSAWRHGV

SEQ ID NO: 1054011 - protein, 17 aa, Mycobacterium
RLARLLIAGGVRPGDKV

SEQ ID NO: 1054012 - protein, 25 aa, Mycobacterium
RLARPPMVLQHGRLRGHAVAVPNLA

SEQ ID NO: 1054013 - protein, 20 aa, Mycobacterium
RLATHLGRGLGRVATDAVLR

SEQ ID NO: 1054014 - protein, 24 aa, Mycobacterium
RLAVEAMTALIARHVDVEAVLAAA

SEQ ID NO: 1054015 - protein, 20 aa, Mycobacterium
RLCNWCPHQQHCPAYGGTPP

SEQ ID NO: 1054016 - protein, 24 aa, Mycobacterium
RLCPQAVVVPPRMRAYMRASDAVF

SEQ ID NO: 1054017 - protein, 22 aa, Mycobacterium
RLCSETLELLLRSTGYNDDITL

SEQ ID NO: 1054018 - protein, 19 aa, Mycobacterium
RLCTACFDGKYPIELPGET

SEQ ID NO: 1054019 - protein, 22 aa, Mycobacterium
RLDAESAFQVLAKWSQKSNTKL

SEQ ID NO: 1054020 - protein, 22 aa, Mycobacterium
RLDDWGNRAALTKAVPTPGSLP

SEQ ID NO: 1054021 - protein, 17 aa, Mycobacterium
RLDEYFPVLYTGENGMV

SEQ ID NO: 1054022 - protein, 19 aa, Mycobacterium
RLDGIPLAIELAASRMASM

SEQ ID NO: 1054023 - protein, 19 aa, Mycobacterium
RLDGVKSLVPAAADAELFI

SEQ ID NO: 1054024 - protein, 18 aa, Mycobacterium
RLDIPAATAVRFEPGVAH

SEQ ID NO: 1054025 - protein, 27 aa, Mycobacterium
RLDIPSWMARAGFQMMDPLKTAKARVD

SEQ ID NO: 1054026 - protein, 22 aa, Mycobacterium
RLDKTRFRSHPDLDVCTHGLTL

SEQ ID NO: 1054027 - protein, 25 aa, Mycobacterium
RLDQLSLPVLRSWLATAAGAGAART

SEQ ID NO: 1054028 - protein, 17 aa, Mycobacterium
RLDRLPHAVAADRDRME

SEQ ID NO: 1054029 - protein, 23 aa, Mycobacterium
RLDTELIGNVSIRVVDIGRPDAW

SEQ ID NO: 1054030 - protein, 25 aa, Mycobacterium
RLDVDRSTIILAMWQYLLHRYTSQD

SEQ ID NO: 1054031 - protein, 19 aa, Mycobacterium
RLEDLPVLYELAAEEEGAA

SEQ ID NO: 1054032 - protein, 20 aa, Mycobacterium
RLEIAVLLQEWFRRVPEFQI

SEQ ID NO: 1054033 - protein, 22 aa, Mycobacterium
RLELAQCYADWLGTAGVERGLL

SEQ ID NO: 1054034 - protein, 18 aa, Mycobacterium
RLELKKFCRNCGSHQAHR

SEQ ID NO: 1054035 - protein, 18 aa, Mycobacterium
RLELSLMTARVVQRLPDL

SEQ ID NO: 1054036 - protein, 23 aa, Mycobacterium
RLEPGSYGLLVGRYRDLVLEIAN

SEQ ID NO: 1054037 - protein, 19 aa, Mycobacterium
RLERLRSSPTVFIDAAHNP

SEQ ID NO: 1054038 - protein, 18 aa, Mycobacterium
RLESFTVIGQRGDDFADR

SEQ ID NO: 1054039 - protein, 21 aa, Mycobacterium
RLEVDEVLFATGRAPRTDDIG

SEQ ID NO: 1054040 - protein, 18 aa, Mycobacterium
RLEVGRVAVRQGPITSAA

SEQ ID NO: 1054041 - protein, 17 aa, Mycobacterium
RLEWDLRNGVIIRKARA

SEQ ID NO: 1054042 - protein, 19 aa, Mycobacterium
RLFDDLRLEHGRLDQPIPV

SEQ ID NO: 1054043 - protein, 19 aa, Mycobacterium
RLFSGPKPAELHPFVPLTG

SEQ ID NO: 1054044 - protein, 20 aa, Mycobacterium
RLGAQLSQWSSATVDIAVAM

SEQ ID NO: 1054045 - protein, 17 aa, Mycobacterium
RLGDAFEVIEIDSGPGN

SEQ ID NO: 1054046 - protein, 24 aa, Mycobacterium
RLGDEVRQPISIIPTGSIALDVAL

SEQ ID NO: 1054047 - protein, 17 aa, Mycobacterium
RLGECDLALAGGVTVMA

SEQ ID NO: 1054048 - protein, 23 aa, Mycobacterium
RLGFGRTVLRDHVGVAPGCGLAG

SEQ ID NO: 1054049 - protein, 21 aa, Mycobacterium
RLGGAARERAGEFGLDRWYQQ

SEQ ID NO: 1054050 - protein, 24 aa, Mycobacterium
RLGHFYRGVGLTIYEGYGLTETSA

SEQ ID NO: 1054051 - protein, 24 aa, Mycobacterium
RLGITTDWKSRWYADKQYADYVKE

SEQ ID NO: 1054052 - protein, 17 aa, Mycobacterium
RLGLAGANIEIRSTSLR

SEQ ID NO: 1054053 - protein, 32 aa, Mycobacterium
RLGLKRLLRSDILPLSFGFPFGISAAIPPNLP

SEQ ID NO: 1054054 - protein, 18 aa, Mycobacterium
RLGLLPMYAVNQDKHGTA

SEQ ID NO: 1054055 - protein, 24 aa, Mycobacterium
RLGPKAFEQCAGFLRIRDGEDPLD

SEQ ID NO: 1054056 - protein, 21 aa, Mycobacterium
RLGPTSLIWKFYGDVRTQLFG

SEQ ID NO: 1054057 - protein, 18 aa, Mycobacterium
RLGRFSGIRYRREFAEWR

SEQ ID NO: 1054058 - protein, 23 aa, Mycobacterium
RLGRNAIVAAFNFDRARPVLETF

SEQ ID NO: 1054059 - protein, 17 aa, Mycobacterium
RLGRYVVGIGVAGASSG

SEQ ID NO: 1054060 - protein, 19 aa, Mycobacterium
RLGSLAFPIAAGTGTGTGA

SEQ ID NO: 1054061 - protein, 18 aa, Mycobacterium
RLGVIAWRRQHPEIATKA

SEQ ID NO: 1054062 - protein, 21 aa, Mycobacterium
RLGVRWASPVNDLSCVNADAV

SEQ ID NO: 1054063 - protein, 19 aa, Mycobacterium
RLGVTKGSFYWHFADMEGY

SEQ ID NO: 1054064 - protein, 26 aa, Mycobacterium
RLGWAQRRVELPAGRYETIMPPSTVA

SEQ ID NO: 1054065 - protein, 20 aa, Mycobacterium
RLGWVRELGRIIGRDSDPVR

SEQ ID NO: 1054066 - protein, 18 aa, Mycobacterium
RLHHRGVEVIEIVGENAE

SEQ ID NO: 1054067 - protein, 17 aa, Mycobacterium
RLHMRRHQQILAPKFAV

SEQ ID NO: 1054068 - protein, 19 aa, Mycobacterium
RLHNLVAFGEPLCDSEAVL

SEQ ID NO: 1054069 - protein, 20 aa, Mycobacterium
RLIDCANAYCTVGEMVCALK

SEQ ID NO: 1054070 - protein, 17 aa, Mycobacterium
RLIFALVPRRMRKHPRG

SEQ ID NO: 1054071 - protein, 17 aa, Mycobacterium
RLIFPLNTILELENVPE

SEQ ID NO: 1054072 - protein, 24 aa, Mycobacterium
RLIRDARRPLIMVGGGTRANRPAV

SEQ ID NO: 1054073 - protein, 24 aa, Mycobacterium
RLIRFPELAAYPFVVLDRDHTLRR

SEQ ID NO: 1054074 - protein, 22 aa, Mycobacterium
RLITELQGWLAAITGYDEVSLQ

SEQ ID NO: 1054075 - protein, 18 aa, Mycobacterium
RLIVELLYATGIRVSELR

SEQ ID NO: 1054076 - protein, 20 aa, Mycobacterium
RLKEPLYRLYELRLRQGLAA

SEQ ID NO: 1054077 - protein, 20 aa, Mycobacterium
RLLAAPGCFVEIARRDIREA

SEQ ID NO: 1054078 - protein, 28 aa, Mycobacterium
RLLACYDGAAGCWRIEAGTYTVAVGASA

SEQ ID NO: 1054079 - protein, 18 aa, Mycobacterium
RLLAERLGVRQTIGLGTV

SEQ ID NO: 1054080 - protein, 21 aa, Mycobacterium
RLLDCCQETDGAVAIVVTSAE

SEQ ID NO: 1054081 - protein, 17 aa, Mycobacterium
RLLDFLVQQRGRIVSAT

SEQ ID NO: 1054082 - protein, 23 aa, Mycobacterium
RLLILRPGFVIGRMTEGMAPAPL

SEQ ID NO: 1054083 - protein, 19 aa, Mycobacterium
RLLLPLPMFHVAALTTVIM

SEQ ID NO: 1054084 - protein, 17 aa, Mycobacterium
RLLNDAGPHTEVSLAGR

SEQ ID NO: 1054085 - protein, 20 aa, Mycobacterium
RLLPGCKAPSSSGGSPSPTP

SEQ ID NO: 1054086 - protein, 24 aa, Mycobacterium
RLLQRLGADVAEYGFVETSAKQDG

SEQ ID NO: 1054087 - protein, 19 aa, Mycobacterium
RLLSFPIDYASITRLLFSR

SEQ ID NO: 1054088 - protein, 23 aa, Mycobacterium
RLLSLAEHRVFIEAARDFCNQAY

SEQ ID NO: 1054089 - protein, 18 aa, Mycobacterium
RLLWPVKQKYGSEISWAD

SEQ ID NO: 1054090 - protein, 22 aa, Mycobacterium
RLMRDYPYLAGFLRAVRAENAD

SEQ ID NO: 1054091 - protein, 21 aa, Mycobacterium
RLNRLGGIVGTAFQIADDIID

SEQ ID NO: 1054092 - protein, 25 aa, Mycobacterium
RLNVEMLARGTAWLDTGTFDSLLDA

SEQ ID NO: 1054093 - protein, 18 aa, Mycobacterium
RLPDLRLADQDSRLPLRP

SEQ ID NO: 1054094 - protein, 22 aa, Mycobacterium
RLPDRSIYLAAHRGPPRGSGLL

SEQ ID NO: 1054095 - protein, 24 aa, Mycobacterium
RLPEFSKPALIAWSADDKFFALED

SEQ ID NO: 1054096 - protein, 24 aa, Mycobacterium
RLPEIPQLRWRVTGAPLGLDRPWF

SEQ ID NO: 1054097 - protein, 21 aa, Mycobacterium
RLPEVLAAGARRIVVVRAITA

SEQ ID NO: 1054098 - protein, 23 aa, Mycobacterium
RLPKRRWWGWGINPQFRILRQPA

SEQ ID NO: 1054099 - protein, 17 aa, Mycobacterium
RLPLDRAALDAALADKA

SEQ ID NO: 1054100 - protein, 18 aa, Mycobacterium
RLPTEIEWEKACAWDPVT

SEQ ID NO: 1054101 - protein, 23 aa, Mycobacterium
RLPVDIRERWAIREVALHILLDG

SEQ ID NO: 1054102 - protein, 24 aa, Mycobacterium
RLQDRLRHAVLWAPAVTDAALRRA

SEQ ID NO: 1054103 - protein, 30 aa, Mycobacterium
RLQTEFVRLQEWVRHAGARVVVIFEGRDAA

SEQ ID NO: 1054104 - protein, 18 aa, Mycobacterium
RLQVINWGVFDGYHSIPF

SEQ ID NO: 1054105 - protein, 18 aa, Mycobacterium
RLRAELREAVFGASDFDV

SEQ ID NO: 1054106 - protein, 23 aa, Mycobacterium
RLRAGPRPGARFHQAGRRRIRRQ

SEQ ID NO: 1054107 - protein, 19 aa, Mycobacterium
RLRAIAAEWTRGAVKTVPP

SEQ ID NO: 1054108 - protein, 18 aa, Mycobacterium
RLRALLRRTGVTTVDSGA

SEQ ID NO: 1054109 - protein, 17 aa, Mycobacterium
RLRARRALVRVQGLLGP

SEQ ID NO: 1054110 - protein, 26 aa, Mycobacterium
RLRCSVAMGASYLRYAMAMRDRLPLV

SEQ ID NO: 1054111 - protein, 19 aa, Mycobacterium
RLRDLPAPVRVFQVRAPGL

SEQ ID NO: 1054112 - protein, 26 aa, Mycobacterium
RLRDLPRRPVHPELRVEDRAIDGPGG

SEQ ID NO: 1054113 - protein, 17 aa, Mycobacterium
RLRDVRNGMSIPPALTL

SEQ ID NO: 1054114 - protein, 21 aa, Mycobacterium
RLREAVRVFGFHLSGLDMRQN

SEQ ID NO: 1054115 - protein, 17 aa, Mycobacterium
RLRELIDRYPLRGIKGP

SEQ ID NO: 1054116 - protein, 17 aa, Mycobacterium
RLRELLVEVQERVEQIV

SEQ ID NO: 1054117 - protein, 19 aa, Mycobacterium
RLRELTGAGMLACKNALAE

SEQ ID NO: 1054118 - protein, 23 aa, Mycobacterium
RLRKDIFDLYGYSAVVHVLSASG

SEQ ID NO: 1054119 - protein, 27 aa, Mycobacterium
RLRLAMKELGVALWLDAPLVELLTDAG

SEQ ID NO: 1054120 - protein, 20 aa, Mycobacterium
RLRLFHGRGGTVGRGGGPSY

SEQ ID NO: 1054121 - protein, 21 aa, Mycobacterium
RLRLVGGLPANLGVEIPANSE

SEQ ID NO: 1054122 - protein, 18 aa, Mycobacterium
RLRPRGVVVVATRDEPPL

SEQ ID NO: 1054123 - protein, 18 aa, Mycobacterium
RLRPSGRGADVWEELHPT

SEQ ID NO: 1054124 - protein, 17 aa, Mycobacterium
RLRQALIQTSRLSVALR

SEQ ID NO: 1054125 - protein, 20 aa, Mycobacterium
RLRQVWPRYDAMRIELAVGQ

SEQ ID NO: 1054126 - protein, 17 aa, Mycobacterium
RLRRLREDHGLTQVALA

SEQ ID NO: 1054127 - protein, 17 aa, Mycobacterium
RLRRRRLGAHGGVGGLV

SEQ ID NO: 1054128 - protein, 18 aa, Mycobacterium
RLRRSIAATAGRDHPLLG

SEQ ID NO: 1054129 - protein, 19 aa, Mycobacterium
RLRSIAHLGVRTRDYAYFV

SEQ ID NO: 1054130 - protein, 25 aa, Mycobacterium
RLSAAKTRLAPVFSAAARESVVLAM

SEQ ID NO: 1054131 - protein, 24 aa, Mycobacterium
RLSALARNAAELGLIPDTDHLELL

SEQ ID NO: 1054132 - protein, 24 aa, Mycobacterium
RLSCADRIGFGWVPLLVFVRPATK

SEQ ID NO: 1054133 - protein, 23 aa, Mycobacterium
RLSDIKGPMALLVGQVVGAWIFT

SEQ ID NO: 1054134 - protein, 17 aa, Mycobacterium
RLSDLLFILSRVANTGN

SEQ ID NO: 1054135 - protein, 34 aa, Mycobacterium
RLSECQSLRYVFCGGEPLSLATARRFAEILPHAQ

SEQ ID NO: 1054136 - protein, 21 aa, Mycobacterium
RLSGASSRFFAHNDLDALERN

SEQ ID NO: 1054137 - protein, 33 aa, Mycobacterium
RLSGGRLTLGVGVGWSREEFAALGVPFQDRVGR

SEQ ID NO: 1054138 - protein, 19 aa, Mycobacterium
RLSGRLDDAMALRHRTILS

SEQ ID NO: 1054139 - protein, 25 aa, Mycobacterium
RLSGYEIPTQISIVAEIPRTASGKP

SEQ ID NO: 1054140 - protein, 25 aa, Mycobacterium
RLSIPDSTCDLGRFIAEKTAGVHAA

SEQ ID NO: 1054141 - protein, 18 aa, Mycobacterium
RLSIPFTTGLLVGSGETL

SEQ ID NO: 1054142 - protein, 20 aa, Mycobacterium
RLSYFLDLRGPSVAVDTACS

SEQ ID NO: 1054143 - protein, 19 aa, Mycobacterium
RLTAPLRRRPDGIYEEIDW

SEQ ID NO: 1054144 - protein, 21 aa, Mycobacterium
RLTCVFVDHGLLRAGERAQVE

SEQ ID NO: 1054145 - protein, 23 aa, Mycobacterium
RLTEESWNYGQFHFGKDRRMNRV

SEQ ID NO: 1054146 - protein, 18 aa, Mycobacterium
RLTEVLAQAPARRGRHKN

SEQ ID NO: 1054147 - protein, 20 aa, Mycobacterium
RLTLDEGRELAVGKRHKQGR

SEQ ID NO: 1054148 - protein, 21 aa, Mycobacterium
RLTLLRDWLGPGYGHPTSQGT

SEQ ID NO: 1054149 - protein, 21 aa, Mycobacterium
RLTLSQLRLRELLVEVQERVE

SEQ ID NO: 1054150 - protein, 23 aa, Mycobacterium
RLTRWTRLYPDVRVESAIIAGHA

SEQ ID NO: 1054151 - protein, 19 aa, Mycobacterium
RLTSALGIVHSRFSTNTFP

SEQ ID NO: 1054152 - protein, 25 aa, Mycobacterium
RLTSCGRPTLFARVALLGEDGKPVP

SEQ ID NO: 1054153 - protein, 21 aa, Mycobacterium
RLVARTRLRLPAQRIRAANFA

SEQ ID NO: 1054154 - protein, 21 aa, Mycobacterium
RLVDCIKQGSTDFGWHRRNSI

SEQ ID NO: 1054155 - protein, 27 aa, Mycobacterium
RLVDGDIIWAPAIDGAFVLTTRGGDFD

SEQ ID NO: 1054156 - protein, 18 aa, Mycobacterium
RLVDLGVIRGFYTDIDPV

SEQ ID NO: 1054157 - protein, 17 aa, Mycobacterium
RLVDYRLSPLLASAQST

SEQ ID NO: 1054158 - protein, 17 aa, Mycobacterium
RLVHEVVVADELLTAAQ

SEQ ID NO: 1054159 - protein, 19 aa, Mycobacterium
RLVIAGGVLVIYVATVTQL

SEQ ID NO: 1054160 - protein, 26 aa, Mycobacterium
RLVQGGGFAGPLFDGFDNLYVGQPGA

SEQ ID NO: 1054161 - protein, 18 aa, Mycobacterium
RLVRLGVEEELLRLGAKP

SEQ ID NO: 1054162 - protein, 22 aa, Mycobacterium
RLWARLHGRDVWQEPCADVDDV

SEQ ID NO: 1054163 - protein, 17 aa, Mycobacterium
RLWKLERAMREWARSDK

SEQ ID NO: 1054164 - protein, 23 aa, Mycobacterium
RLYDRFEPIHAVTYFAPEARAAL

SEQ ID NO: 1054165 - protein, 23 aa, Mycobacterium
RLYHCAIPGKFVERMPPGVEGQV

SEQ ID NO: 1054166 - protein, 23 aa, Mycobacterium
RLYPESLDIMGWDVGSHGLQLRL

SEQ ID NO: 1054167 - protein, 32 aa, Mycobacterium
RLYRRRIAPGGFRYGAMFGVEVQFWVFEETLI

SEQ ID NO: 1054168 - protein, 24 aa, Mycobacterium
RMAIPELPEELFIESLTQLIAVDN

SEQ ID NO: 1054169 - protein, 23 aa, Mycobacterium
RMASLRGLLKFRAGVRPPIPLDE

SEQ ID NO: 1054170 - protein, 20 aa, Mycobacterium
RMDLVDGKLICLVRAKSDTE

SEQ ID NO: 1054171 - protein, 29 aa, Mycobacterium
RMEADWEASYLLSLRAAWQADNKIPNSKE

SEQ ID NO: 1054172 - protein, 18 aa, Mycobacterium
RMELKKFCRNCGKHQSHR

SEQ ID NO: 1054173 - protein, 19 aa, Mycobacterium
RMGALALHVAKIARRRHPQ

SEQ ID NO: 1054174 - protein, 19 aa, Mycobacterium
RMGMLGEFGLTWPWESLHL

SEQ ID NO: 1054175 - protein, 28 aa, Mycobacterium
RMHLLFGVCSTTIWARRVLAGAPFDDVG

SEQ ID NO: 1054176 - protein, 22 aa, Mycobacterium
RMHRACLALTFGGSTNEVQRDI

SEQ ID NO: 1054177 - protein, 23 aa, Mycobacterium
RMIAEPYPRLLVARDQVNQGAAA

SEQ ID NO: 1054178 - protein, 19 aa, Mycobacterium
RMLATACGDQGDVVTILAY

SEQ ID NO: 1054179 - protein, 24 aa, Mycobacterium
RMLDEIYSLLDLRNATCHQTIDRF

SEQ ID NO: 1054180 - protein, 17 aa, Mycobacterium
RMLELAGKFAAEHPELL

SEQ ID NO: 1054181 - protein, 19 aa, Mycobacterium
RMLFGEDLWEWVNPNNVAR

SEQ ID NO: 1054182 - protein, 20 aa, Mycobacterium
RMLIVPGSMRVRAQAEKEGL

SEQ ID NO: 1054183 - protein, 19 aa, Mycobacterium
RMLSRRRPGQVEQPQQADD

SEQ ID NO: 1054184 - protein, 20 aa, Mycobacterium
RMNGGFFPSVREYSTLYGLS

SEQ ID NO: 1054185 - protein, 18 aa, Mycobacterium
RMNSIAFDVMVPLKEVLE

SEQ ID NO: 1054186 - protein, 18 aa, Mycobacterium
RMPAFGLDGPWRERVGFA

SEQ ID NO: 1054187 - protein, 19 aa, Mycobacterium
RMPLHPVAIELLRQVGPMA

SEQ ID NO: 1054188 - protein, 20 aa, Mycobacterium
RMQQRWPVVMVDEFQDTDAV

SEQ ID NO: 1054189 - protein, 27 aa, Mycobacterium
RMRPGNWAGAYACWGTENREAAVRFVK

SEQ ID NO: 1054190 - protein, 17 aa, Mycobacterium
RMRTRWINFATQDNPAG

SEQ ID NO: 1054191 - protein, 17 aa, Mycobacterium
RMSMPPRVALLACASGG

SEQ ID NO: 1054192 - protein, 29 aa, Mycobacterium
RMTTPVPKREWKEVVLLAGGGSDVAVVCL

SEQ ID NO: 1054193 - protein, 19 aa, Mycobacterium
RMVFHEITEPAILEAAENP

SEQ ID NO: 1054194 - protein, 21 aa, Mycobacterium
RNADGLFTAVVQERGSGDVLM

SEQ ID NO: 1054195 - protein, 28 aa, Mycobacterium
RNAILFRPSPYAVRCCEQSIEILRTAAE

SEQ ID NO: 1054196 - protein, 24 aa, Mycobacterium
RNAIRPGATGVWVLVQRPSSFSQD

SEQ ID NO: 1054197 - protein, 21 aa, Mycobacterium
RNAKARLLRDNIVVVENLSIR

SEQ ID NO: 1054198 - protein, 23 aa, Mycobacterium
RNAKLASIPVGFAGRAALGVGKR

SEQ ID NO: 1054199 - protein, 25 aa, Mycobacterium
RNAPRRCGSRPAWRPMRATRVKRPS

SEQ ID NO: 1054200 - protein, 19 aa, Mycobacterium
RNAWNEFIPFLDYDTEIRK

SEQ ID NO: 1054201 - protein, 23 aa, Mycobacterium
RNDGRIKFILFRHLQAAGFAAAA

SEQ ID NO: 1054202 - protein, 20 aa, Mycobacterium
RNDHGRWPQSVGLSVWGTSA

SEQ ID NO: 1054203 - protein, 26 aa, Mycobacterium
RNEDGRWTVQLAWKAGRSDNLAHFRF

SEQ ID NO: 1054204 - protein, 19 aa, Mycobacterium
RNEGQWALGNREPFNANEE

SEQ ID NO: 1054205 - protein, 23 aa, Mycobacterium
RNELVALVISNLFGQNAPAIAAT

SEQ ID NO: 1054206 - protein, 21 aa, Mycobacterium
RNGERYQFLRWGQGAFDDFKV

SEQ ID NO: 1054207 - protein, 26 aa, Mycobacterium
RNGIDTEVWFPAGPVGTASVLAQGSG

SEQ ID NO: 1054208 - protein, 24 aa, Mycobacterium
RNGIDVARWPFAVRKPRTGPPELL

SEQ ID NO: 1054209 - protein, 18 aa, Mycobacterium
RNHARLMRKTFMSNPILC

SEQ ID NO: 1054210 - protein, 26 aa, Mycobacterium
RNIASIPGGLRWTWETMKPLYTNGAV

SEQ ID NO: 1054211 - protein, 19 aa, Mycobacterium
RNIFPADIERLAASVHGIR

SEQ ID NO: 1054212 - protein, 21 aa, Mycobacterium
RNILESFTLLTNVSKLFAQRC

SEQ ID NO: 1054213 - protein, 21 aa, Mycobacterium
RNLKSAHLVLTVNGKIPGLSM

SEQ ID NO: 1054214 - protein, 24 aa, Mycobacterium
RNLPRMLVPLANILGPALFQSAQM

SEQ ID NO: 1054215 - protein, 17 aa, Mycobacterium
RNMAFYNFPLRLLKRTW

SEQ ID NO: 1054216 - protein, 17 aa, Mycobacterium
RNNVLKLSHGEFVAVSR

SEQ ID NO: 1054217 - protein, 17 aa, Mycobacterium
RNNVLKLSQGEFVTVSK

SEQ ID NO: 1054218 - protein, 19 aa, Mycobacterium
RNPAALCYALLAYGFTFRD

SEQ ID NO: 1054219 - protein, 24 aa, Mycobacterium
RNPDELRRHIGYVVQGAGVFLHLT

SEQ ID NO: 1054220 - protein, 27 aa, Mycobacterium
RNPERVWGWYLWRHYLVADVAPNPGHQ

SEQ ID NO: 1054221 - protein, 21 aa, Mycobacterium
RNPQDMRLFWGAHAGSPPACW

SEQ ID NO: 1054222 - protein, 26 aa, Mycobacterium
RNRALGLLYRWVEQAFGGREHDLTGA

SEQ ID NO: 1054223 - protein, 24 aa, Mycobacterium
RNRDELRLSVALRCPQPCDVDALA

SEQ ID NO: 1054224 - protein, 24 aa, Mycobacterium
RNRRGELEMSVAMVIANHPDLADH

SEQ ID NO: 1054225 - protein, 21 aa, Mycobacterium
RNRTSPFAFTGNRFEFRAPGS

SEQ ID NO: 1054226 - protein, 27 aa, Mycobacterium
RNTHGVSWLPLYHDMGLSMIGFPAVYG

SEQ ID NO: 1054227 - protein, 19 aa, Mycobacterium
RNVAFGYGRHQCVGQQLAR

SEQ ID NO: 1054228 - protein, 21 aa, Mycobacterium
RNVDYSAFNEVHWVAPAEAVW

SEQ ID NO: 1054229 - protein, 17 aa, Mycobacterium
RNVPLKVVHVFAPMVAP

SEQ ID NO: 1054230 - protein, 19 aa, Mycobacterium
RNVRADVRAALWPLLVGNI

SEQ ID NO: 1054231 - protein, 25 aa, Mycobacterium
RNVWTNAVIFCGHFPDGAEKFTKAD

SEQ ID NO: 1054232 - protein, 19 aa, Mycobacterium
RNWEFFRAPLGGIVSMHQE

SEQ ID NO: 1054233 - protein, 27 aa, Mycobacterium
RNWLNWVPCGWPQARAEPHRARITRPA

SEQ ID NO: 1054234 - protein, 37 aa, Mycobacterium; identical to SEQ ID NO: 724017

SEQ ID NO: 1054235 - protein, 26 aa, Mycobacterium
RPADGAPAWLRFFGCNPRHHSLAFLP

SEQ ID NO: 1054236 - protein, 22 aa, Mycobacterium
RPAEEMLYLAMEDFRVDVVVGK

SEQ ID NO: 1054237 - protein, 27 aa, Mycobacterium
RPAGIRRLFIRWSEWSGSGLWVNLTCR

SEQ ID NO: 1054238 - protein, 18 aa, Mycobacterium
RPAGIWTYEAHRVAAKRP

SEQ ID NO: 1054239 - protein, 20 aa, Mycobacterium
RPAKSARPWAPPTGPTSSPT

SEQ ID NO: 1054240 - protein, 18 aa, Mycobacterium
RPALAAWFASTRPPIGGE

SEQ ID NO: 1054241 - protein, 32 aa, Mycobacterium
RPARGPLRRRARLHPPRLRRPGLLVRSPPPRR

SEQ ID NO: 1054242 - protein, 21 aa, Mycobacterium
RPASVTSWWRLAACPRPRWPR

SEQ ID NO: 1054243 - protein, 30 aa, Mycobacterium
RPAVDHTRRYLRACQQLGYQDPFLAKGFDP

SEQ ID NO: 1054244 - protein, 18 aa, Mycobacterium
RPAYTGTLTLRYRRGTVL

SEQ ID NO: 1054245 - protein, 33 aa, Mycobacterium
RPDALRPGYGLAEATVFVTGWRGPAVKTLTLDQ

SEQ ID NO: 1054246 - protein, 19 aa, Mycobacterium
RPDALVLDVMMPRLDGLEV

SEQ ID NO: 1054247 - protein, 21 aa, Mycobacterium
RPDDAWLASWSRAEAAVPHPI

SEQ ID NO: 1054248 - protein, 20 aa, Mycobacterium
RPDHRLRLEHVGAIRPEQLR

SEQ ID NO: 1054249 - protein, 27 aa, Mycobacterium
RPDNVFVAGFIGSPAMNMFILPIVDSS

SEQ ID NO: 1054250 - protein, 25 aa, Mycobacterium
RPDRMSARRFWLRYAADSVGSLTLD

SEQ ID NO: 1054251 - protein, 26 aa, Mycobacterium
RPDRMSARRFWLRYAADSVGSLTLDE

SEQ ID NO: 1054252 - protein, 29 aa, Mycobacterium
RPDRSTTLALRWLVGYSRQRREKTMIERL

SEQ ID NO: 1054253 - protein, 26 aa, Mycobacterium
RPDSATGLAPLRWGTGFMLGSNRFGP

SEQ ID NO: 1054254 - protein, 19 aa, Mycobacterium
RPDSGVALYQRFVAEMKAA

SEQ ID NO: 1054255 - protein, 21 aa, Mycobacterium
RPDSIPAILDWYTQRGRTPRL

SEQ ID NO: 1054256 - protein, 19 aa, Mycobacterium
RPDVFSVRVGNLGPGEQAT

SEQ ID NO: 1054257 - protein, 20 aa, Mycobacterium
RPEALGGLGGAAPQQLLPAV

SEQ ID NO: 1054258 - protein, 21 aa, Mycobacterium
RPEDLRFLVRLARQQGERLGR

SEQ ID NO: 1054259 - protein, 20 aa, Mycobacterium
RPEDVSGMLAAQGIVTEIGG

SEQ ID NO: 1054260 - protein, 19 aa, Mycobacterium
RPEFLNRIDDIIVFHQLTR

SEQ ID NO: 1054261 - protein, 25 aa, Mycobacterium
RPEGPGPAAARFFAALAVGDTATAA

SEQ ID NO: 1054262 - protein, 17 aa, Mycobacterium
RPEHLAHALVILMTVGG

SEQ ID NO: 1054263 - protein, 19 aa, Mycobacterium
RPELGYRLLQRLGADVAEY

SEQ ID NO: 1054264 - protein, 28 aa, Mycobacterium
RPEPTLPVPAGWPFGEEFPRTCGAARLA

SEQ ID NO: 1054265 - protein, 26 aa, Mycobacterium
RPERLRSGWLNGIKHWQVDYHSDSSG

SEQ ID NO: 1054266 - protein, 22 aa, Mycobacterium
RPFDEACAGPWWALAANHPGLP

SEQ ID NO: 1054267 - protein, 18 aa, Mycobacterium
RPFGVPFIHIPVTRDTRA

SEQ ID NO: 1054268 - protein, 24 aa, Mycobacterium
RPFRPRPARRSTWANRCTPTCCTS

SEQ ID NO: 1054269 - protein, 19 aa, Mycobacterium
RPGEHTGNFIATRTPDGTA

SEQ ID NO: 1054270 - protein, 18 aa, Mycobacterium
RPGEKPTRIEVILIAAYR

SEQ ID NO: 1054271 - protein, 30 aa, Mycobacterium
RPGLDVVPGGPFVRRIAPVMAAEMGNPQTA

SEQ ID NO: 1054272 - protein, 21 aa, Mycobacterium
RPGLEHYAGPAPEDFGAYRTY

SEQ ID NO: 1054273 - protein, 19 aa, Mycobacterium
RPGPEFRPSEVARLGYLAG

SEQ ID NO: 1054274 - protein, 19 aa, Mycobacterium
RPGQVRTRMSAHVKEAPLT

SEQ ID NO: 1054275 - protein, 18 aa, Mycobacterium
RPGRPLGASTAEFADLAA

SEQ ID NO: 1054276 - protein, 17 aa, Mycobacterium
RPGRPRAAPPVRKLAKE

SEQ ID NO: 1054277 - protein, 22 aa, Mycobacterium
RPGSRPSLAELDGFVRSAIAGY

SEQ ID NO: 1054278 - protein, 25 aa, Mycobacterium
RPGTELRRLTPRSSDQLLFDGLPWV

SEQ ID NO: 1054279 - protein, 21 aa, Mycobacterium
RPGTRRMYSNYGFTALAEAVA

SEQ ID NO: 1054280 - protein, 18 aa, Mycobacterium
RPGTVSAITRWAQRHDVP

SEQ ID NO: 1054281 - protein, 32 aa, Mycobacterium; identical to SEQ ID NO: 724332

SEQ ID NO: 1054282 - protein, 20 aa, Mycobacterium
RPGWHHTVHGLVYGQIDRTP

SEQ ID NO: 1054283 - protein, 17 aa, Mycobacterium
RPHIDLYLLTDESIAAG

SEQ ID NO: 1054284 - protein, 19 aa, Mycobacterium
RPHLRLENRVLPAGPTVID

SEQ ID NO: 1054285 - protein, 29 aa, Mycobacterium
RPIDAFVVRKAAKVHGMQRLIEGSEVSGK

SEQ ID NO: 1054286 - protein, 17 aa, Mycobacterium
RPIGLIIGLQLSANPFV

SEQ ID NO: 1054287 - protein, 18 aa, Mycobacterium
RPILAVDIQLRPALERAL

SEQ ID NO: 1054288 - protein, 17 aa, Mycobacterium
RPIRINRVGDLGVLDSD

SEQ ID NO: 1054289 - protein, 17 aa, Mycobacterium
RPIRINRVGNLGMLDSD

SEQ ID NO: 1054290 - protein, 20 aa, Mycobacterium
RPIRSYFYWEKHCYDVPICW

SEQ ID NO: 1054291 - protein, 19 aa, Mycobacterium
RPIWEPVVHYGPFVMNSKA

SEQ ID NO: 1054292 - protein, 17 aa, Mycobacterium
RPKFRWIELPERIEAGL

SEQ ID NO: 1054293 - protein, 19 aa, Mycobacterium
RPKRYIPGFAPELEDESEL

SEQ ID NO: 1054294 - protein, 20 aa, Mycobacterium
RPKTPSVRAGRPRWRCRIRV

SEQ ID NO: 1054295 - protein, 17 aa, Mycobacterium
RPLEMGAAMADCDERTL

SEQ ID NO: 1054296 - protein, 19 aa, Mycobacterium
RPLGIPVIVLAGQVDLDKS

SEQ ID NO: 1054297 - protein, 20 aa, Mycobacterium
RPLLEHPAALHASIREESFF

SEQ ID NO: 1054298 - protein, 20 aa, Mycobacterium
RPLLEITAGYVKRAAAAFPH

SEQ ID NO: 1054299 - protein, 23 aa, Mycobacterium
RPLSCAIAAVSVGVVDGRVRVDL

SEQ ID NO: 1054300 - protein, 21 aa, Mycobacterium
RPLSLGRLDRGWVVASETAAL

SEQ ID NO: 1054301 - protein, 30 aa, Mycobacterium
RPLSPKRQSGCPAFQVCPRAFTGTASAMPP

SEQ ID NO: 1054302 - protein, 20 aa, Mycobacterium
RPLYRFPVFGFFALSIGAAA

SEQ ID NO: 1054303 - protein, 19 aa, Mycobacterium
RPMHEKIVGRIAVSDLARR

SEQ ID NO: 1054304 - protein, 18 aa, Mycobacterium
RPMMLKRFVKGIDVEAVF

SEQ ID NO: 1054305 - protein, 19 aa, Mycobacterium
RPMRARRRGGILLVGSTAA

SEQ ID NO: 1054306 - protein, 19 aa, Mycobacterium
RPNASRLCNWCPHQQHCPA

SEQ ID NO: 1054307 - protein, 26 aa, Mycobacterium
RPNAYRFGTVGWPFPATEAKIATDGE

SEQ ID NO: 1054308 - protein, 21 aa, Mycobacterium
RPPAILYHVSRTLAIQPVAIG

SEQ ID NO: 1054309 - protein, 24 aa, Mycobacterium
RPPHLKAIFPVAATTDLYEAAVHH

SEQ ID NO: 1054310 - protein, 18 aa, Mycobacterium
RPPRETWETNPFYRQLDA

SEQ ID NO: 1054311 - protein, 19 aa, Mycobacterium
RPPRVVIIGAGFGGIAAAV

SEQ ID NO: 1054312 - protein, 17 aa, Mycobacterium
RPPTSAMLFPNSSRRIF

SEQ ID NO: 1054313 - protein, 18 aa, Mycobacterium
RPQDGAIITGWDYPSCEA

SEQ ID NO: 1054314 - protein, 19 aa, Mycobacterium
RPQDWPAYDDPFGDWHEDP

SEQ ID NO: 1054315 - protein, 20 aa, Mycobacterium
RPQVWDVLEEVIAEHPVLLN

SEQ ID NO: 1054316 - protein, 20 aa, Mycobacterium
RPRGMSYLVVGGRRGGSAMA

SEQ ID NO: 1054317 - protein, 20 aa, Mycobacterium
RPRITLFAARNAASAKKDAE

SEQ ID NO: 1054318 - protein, 19 aa, Mycobacterium
RPRLDSVDSKERFRQLVDL

SEQ ID NO: 1054319 - protein, 20 aa, Mycobacterium
RPRLWLSPAGRATCPPATLT

SEQ ID NO: 1054320 - protein, 20 aa, Mycobacterium
RPRPQWWFDDEAVYGPDGLA

SEQ ID NO: 1054321 - protein, 22 aa, Mycobacterium
RPRSEIMTFLAAREAAHHRLFS

SEQ ID NO: 1054322 - protein, 28 aa, Mycobacterium
RPRSLEIVSCPSCGRAQVDVYTLANEVT

SEQ ID NO: 1054323 - protein, 18 aa, Mycobacterium
RPSHRAVGHCAASNCAPG

SEQ ID NO: 1054324 - protein, 28 aa, Mycobacterium
RPSLSAALPPAALWGREAYIRGLLDDTV

SEQ ID NO: 1054325 - protein, 29 aa, Mycobacterium
RPSLSAALPPAALWGREAYIRGLLDDTVT

SEQ ID NO: 1054326 - protein, 26 aa, Mycobacterium
RPSLSAALPPSALWGREAYARGLFGN

SEQ ID NO: 1054327 - protein, 19 aa, Mycobacterium
RPSYGLAEATVFVATREWG

SEQ ID NO: 1054328 - protein, 19 aa, Mycobacterium
RPTGKIVLIAPAALDPAGT

SEQ ID NO: 1054329 - protein, 24 aa, Mycobacterium
RPTTVVEFGMSFGISTIHLAAAVR

SEQ ID NO: 1054330 - protein, 20 aa, Mycobacterium
RPVRLCLDLDAGYWRAGGRV

SEQ ID NO: 1054331 - protein, 25 aa, Mycobacterium
RPVTTADEIVRWATPMTSFQRTALE

SEQ ID NO: 1054332 - protein, 21 aa, Mycobacterium
RPVVLEWADYVAADDYHAAGQ

SEQ ID NO: 1054333 - protein, 22 aa, Mycobacterium
RPVVRAKLWLQCAIAGTPRLPD

SEQ ID NO: 1054334 - protein, 20 aa, Mycobacterium
RPWDQLWLSAAVEHPTRDEW

SEQ ID NO: 1054335 - protein, 27 aa, Mycobacterium
RPWSERKKLVWWDAELGEWTGHDVPDF

SEQ ID NO: 1054336 - protein, 19 aa, Mycobacterium
RQAAACAYVATTIAAGLGG

SEQ ID NO: 1054337 - protein, 19 aa, Mycobacterium
RQAAARWPDRVGVVDAGAS

SEQ ID NO: 1054338 - protein, 18 aa, Mycobacterium
RQAAPFLSYGQFTGLAPR

SEQ ID NO: 1054339 - protein, 19 aa, Mycobacterium
RQAGISFLLIDMATPGITL

SEQ ID NO: 1054340 - protein, 19 aa, Mycobacterium
RQALADGIIDCVATDHAPH

SEQ ID NO: 1054341 - protein, 17 aa, Mycobacterium
RQALPAVPLVASGGIRT

SEQ ID NO: 1054342 - protein, 20 aa, Mycobacterium
RQAVIRARLGQLGIPVEGED

SEQ ID NO: 1054343 - protein, 18 aa, Mycobacterium
RQAVLAALVERFGAKAAK

SEQ ID NO: 1054344 - protein, 20 aa, Mycobacterium
RQDIDDIFWLQATIARELAV

SEQ ID NO: 1054345 - protein, 19 aa, Mycobacterium
RQEDFIGVHFFSPVDKMPL

SEQ ID NO: 1054346 - protein, 17 aa, Mycobacterium
RQFDAVSFTSAPAAAAV

SEQ ID NO: 1054347 - protein, 20 aa, Mycobacterium
RQGAQLAKLTRWFTPAEVLQ

SEQ ID NO: 1054348 - protein, 19 aa, Mycobacterium
RQGDRWVINGAKTWSTSAF

SEQ ID NO: 1054349 - protein, 25 aa, Mycobacterium
RQGEFRPDLAAGWLTEAFYSLVSGA

SEQ ID NO: 1054350 - protein, 18 aa, Mycobacterium
RQGGCPLPTLAITDLHVV

SEQ ID NO: 1054351 - protein, 31 aa, Mycobacterium; identical to SEQ ID NO: 724884

SEQ ID NO: 1054352 - protein, 31 aa, Mycobacterium; identical to SEQ ID NO: 724905

SEQ ID NO: 1054353 - protein, 17 aa, Mycobacterium
RQIKDLAHAGAPLHAEC

SEQ ID NO: 1054354 - protein, 22 aa, Mycobacterium
RQIPAERLRCVLGDSLRSPELP

SEQ ID NO: 1054355 - protein, 22 aa, Mycobacterium
RQIRTLAGFSTMFPVAAGAVGI

SEQ ID NO: 1054356 - protein, 17 aa, Mycobacterium
RQIVLEIADWLRDESHP

SEQ ID NO: 1054357 - protein, 17 aa, Mycobacterium
RQKHCLMNADGWGAGFF

SEQ ID NO: 1054358 - protein, 20 aa, Mycobacterium
RQKLRRKGCDLLVVNAVGGD

SEQ ID NO: 1054359 - protein, 25 aa, Mycobacterium
RQLAEKACEEWFGEHQLDWLHRLRR

SEQ ID NO: 1054360 - protein, 18 aa, Mycobacterium
RQLDLLLCGRMILWHVLF

SEQ ID NO: 1054361 - protein, 22 aa, Mycobacterium
RQLDWTVCRTVTTLMRSKVSAR

SEQ ID NO: 1054362 - protein, 18 aa, Mycobacterium
RQLEVKRFNSAEGVHNYF

SEQ ID NO: 1054363 - protein, 17 aa, Mycobacterium
RQLKPLGRQAEVARRAQ

SEQ ID NO: 1054364 - protein, 20 aa, Mycobacterium
RQLLFARFGQMITRHLEHTA

SEQ ID NO: 1054365 - protein, 18 aa, Mycobacterium
RQLNAVAVAAGWHNDDGG

SEQ ID NO: 1054366 - protein, 28 aa, Mycobacterium
RQLPRDSRLVLTTGWPLRSARPRRAGGA

SEQ ID NO: 1054367 - protein, 48 aa, Mycobacterium
RQLRCRRHVRRRHPGGLGPGRRWRRRWTGRLRRRRLVRATRRHWRRRR

SEQ ID NO: 1054368 - protein, 27 aa, Mycobacterium
RQLRSELKMLPALPVAELRAQADELAR

SEQ ID NO: 1054369 - protein, 19 aa, Mycobacterium
RQLVASWSDRLSIAAVNGV

SEQ ID NO: 1054370 - protein, 19 aa, Mycobacterium
RQLYLDILADWPVDELPKA

SEQ ID NO: 1054371 - protein, 23 aa, Mycobacterium
RQMDLPPKLAIPMRVIASVAAIL

SEQ ID NO: 1054372 - protein, 24 aa, Mycobacterium
RQMIADRELETWLVVDMSASLDFG

SEQ ID NO: 1054373 - protein, 24 aa, Mycobacterium
RQMIADRELETWMVIDMSASLDFG

SEQ ID NO: 1054374 - protein, 20 aa, Mycobacterium
RQPKSLRVCTLLRKPEAVGA

SEQ ID NO: 1054375 - protein, 26 aa, Mycobacterium
RQPVTRARVSAVRGVNVDAVMRTLLA

SEQ ID NO: 1054376 - protein, 24 aa, Mycobacterium
RQQKRLLAKWPDMTVPAAIEDSIE

SEQ ID NO: 1054377 - protein, 26 aa, Mycobacterium
RQQRESALRWLAKVGAEQLVDRRPRQ

SEQ ID NO: 1054378 - protein, 26 aa, Mycobacterium
RQRAEARLGYALNRTHTAAVIWSDEP

SEQ ID NO: 1054379 - protein, 26 aa, Mycobacterium
RQRILNNLCRYGLWDVTLESRVDVVL

SEQ ID NO: 1054380 - protein, 23 aa, Mycobacterium
RQRSWFRRDHRVHWCDAGATGPS

SEQ ID NO: 1054381 - protein, 19 aa, Mycobacterium
RQRVAPLVAKHRLGGTPRP

SEQ ID NO: 1054382 - protein, 17 aa, Mycobacterium
RQRVRLLADRCNYPPGM

SEQ ID NO: 1054383 - protein, 23 aa, Mycobacterium
RQSAARGKRAAVCNTPKPCTEPP

SEQ ID NO: 1054384 - protein, 21 aa, Mycobacterium
RQSASLYLGRHVHPVVDDTTI

SEQ ID NO: 1054385 - protein, 19 aa, Mycobacterium
RQSNIRWGFDQEHRKPYGV

SEQ ID NO: 1054386 - protein, 18 aa, Mycobacterium
RQTVLALLADHNLGEHDS

SEQ ID NO: 1054387 - protein, 18 aa, Mycobacterium
RQTWACGPESMLNQAEKV

SEQ ID NO: 1054388 - protein, 17 aa, Mycobacterium
RQVCARTLGPPALPAEV

SEQ ID NO: 1054389 - protein, 18 aa, Mycobacterium
RQVFELVDIAFAQRRKTS

SEQ ID NO: 1054390 - protein, 23 aa, Mycobacterium
RQVKEAFTARSVLAPRDIRVTSF

SEQ ID NO: 1054391 - protein, 22 aa, Mycobacterium
RQWLRHDGWPVLQAVAEYWAGR

SEQ ID NO: 1054392 - protein, 22 aa, Mycobacterium
RQWWQRRLPEMAGAPQLPTVAV

SEQ ID NO: 1054393 - protein, 17 aa, Mycobacterium
RQYEQVMLLRAAVGTAT

SEQ ID NO: 1054394 - protein, 17 aa, Mycobacterium
RQYMAWISLEDEVRALL

SEQ ID NO: 1054395 - protein, 25 aa, Mycobacterium
RRAADLPPAVGVLVEYTGAGAEAAH

SEQ ID NO: 1054396 - protein, 19 aa, Mycobacterium
RRAAFGLATEIGRELTRRS

SEQ ID NO: 1054397 - protein, 24 aa, Mycobacterium
RRAAHGRPLWYLMPDGVVQYVSKR

SEQ ID NO: 1054398 - protein, 22 aa, Mycobacterium
RRADIPFGATVAVIGLGAVGLC

SEQ ID NO: 1054399 - protein, 20 aa, Mycobacterium
RRADMPLSIRSDYHPFLVAG

SEQ ID NO: 1054400 - protein, 19 aa, Mycobacterium
RRADVAVVFAIRAEGEGFD

SEQ ID NO: 1054401 - protein, 17 aa, Mycobacterium
RRAGSMLALSKPLQSGR

SEQ ID NO: 1054402 - protein, 18 aa, Mycobacterium
RRAIQGFLESGVDLDDVL

SEQ ID NO: 1054403 - protein, 18 aa, Mycobacterium
RRALDFLRGLRRQDTIAT

SEQ ID NO: 1054404 - protein, 18 aa, Mycobacterium
RRALPQWAGVTTAERSAV

SEQ ID NO: 1054405 - protein, 19 aa, Mycobacterium
RRAPLPLAPMQANLWYLQQ

SEQ ID NO: 1054406 - protein, 19 aa, Mycobacterium
RRAQVRGGDIAVVIGAGGI

SEQ ID NO: 1054407 - protein, 37 aa, Mycobacterium
RRARGSSSSTRWSVERCHVSSFPAWRRASEPRWTRAC

SEQ ID NO: 1054408 - protein, 27 aa, Mycobacterium
RRARRLARALHQWGFGASRERSQLAPY

SEQ ID NO: 1054409 - protein, 20 aa, Mycobacterium
RRARVLMRFIELVNQNTDEL

SEQ ID NO: 1054410 - protein, 18 aa, Mycobacterium
RRAVLLPALTSAGFSVDH

SEQ ID NO: 1054411 - protein, 30 aa, Mycobacterium; identical to SEQ ID NO: 84320

SEQ ID NO: 1054412 - protein, 17 aa, Mycobacterium
RRCAYPHGGHMINLHIA

SEQ ID NO: 1054413 - protein, 25 aa, Mycobacterium
RRCDEALAEFVSWSLLDVVAGVAGA

SEQ ID NO: 1054414 - protein, 17 aa, Mycobacterium
RRCDPRTSVPPGSVALA

SEQ ID NO: 1054415 - protein, 18 aa, Mycobacterium
RRDGEVLMAQLLRIATKS

SEQ ID NO: 1054416 - protein, 20 aa, Mycobacterium
RRDGWWKGLDSYDLVLDALG

SEQ ID NO: 1054417 - protein, 24 aa, Mycobacterium
RRDHGGVIFIDLRDASGIAQVVFR

SEQ ID NO: 1054418 - protein, 23 aa, Mycobacterium
RRDLPIMYPLEVRFSAPDDAFLS

SEQ ID NO: 1054419 - protein, 19 aa, Mycobacterium
RRDLVKQAKHKGEEARVSV

SEQ ID NO: 1054420 - protein, 20 aa, Mycobacterium
RRDPGWSVLRSFKRLLNDAG

SEQ ID NO: 1054421 - protein, 20 aa, Mycobacterium
RREGWDYPDMARESGTNALN

SEQ ID NO: 1054422 - protein, 20 aa, Mycobacterium
RRELLAVLTKRGRDLVRRVT

SEQ ID NO: 1054423 - protein, 24 aa, Mycobacterium
RREPRPYPKLSLSQRDSIFDYTYE

SEQ ID NO: 1054424 - protein, 18 aa, Mycobacterium
RRESGWGAQRGMAGGQWI

SEQ ID NO: 1054425 - protein, 20 aa, Mycobacterium
RRESRFPISEILAKTPPIPD

SEQ ID NO: 1054426 - protein, 30 aa, Mycobacterium
RRFAEAAAFQCGFCTAGLVVTASTFGDDEL

SEQ ID NO: 1054427 - protein, 22 aa, Mycobacterium
RRFAGCPICNLHLRSISGRHDE

SEQ ID NO: 1054428 - protein, 18 aa, Mycobacterium
RRFARNDYDILLIGHEGH

SEQ ID NO: 1054429 - protein, 19 aa, Mycobacterium
RRFGDAFIPMDETLAHAAV

SEQ ID NO: 1054430 - protein, 20 aa, Mycobacterium
RRFLEACRQGRGWDHYRRQP

SEQ ID NO: 1054431 - protein, 20 aa, Mycobacterium
RRFSTVIEFFSYTPEELIAL

SEQ ID NO: 1054432 - protein, 19 aa, Mycobacterium
RRFTPGASLRAKRSRDGGT

SEQ ID NO: 1054433 - protein, 27 aa, Mycobacterium
RRGAPILPCRGMEAVPIGEDVVYRIPL

SEQ ID NO: 1054434 - protein, 20 aa, Mycobacterium
RRGGGIGLAAMCAGGGMGSA

SEQ ID NO: 1054435 - protein, 17 aa, Mycobacterium
RRGGRIAPELTGLWTAG

SEQ ID NO: 1054436 - protein, 17 aa, Mycobacterium
RRGIYCGTVGLVSPIAG

SEQ ID NO: 1054437 - protein, 19 aa, Mycobacterium
RRGLMLLDFEEHMFHRRIM

SEQ ID NO: 1054438 - protein, 26 aa, Mycobacterium
RRGLTPGPWRLIRVVGDYYKPGFHPS

SEQ ID NO: 1054439 - protein, 20 aa, Mycobacterium
RRGRQVCLVDVELSQDSRTA

SEQ ID NO: 1054440 - protein, 17 aa, Mycobacterium
RRGVIVCAGGFIANSEW

SEQ ID NO: 1054441 - protein, 19 aa, Mycobacterium
RRHIHRYPELGRQEFATTQ

SEQ ID NO: 1054442 - protein, 25 aa, Mycobacterium
RRHMLADSGAVAWLGPAPAQDAEPD

SEQ ID NO: 1054443 - protein, 17 aa, Mycobacterium
RRHPGRRSPLWHQRQRA

SEQ ID NO: 1054444 - protein, 25 aa, Mycobacterium
RRHPNRIALRLDEIEIPYGALDTAS

SEQ ID NO: 1054445 - protein, 18 aa, Mycobacterium
RRHRCRRSARRRRRHRQQ

SEQ ID NO: 1054446 - protein, 19 aa, Mycobacterium
RRHRWGRRCHPSQWQQGQQ

SEQ ID NO: 1054447 - protein, 18 aa, Mycobacterium
RRHTGLVAAHSWSDVDVS

SEQ ID NO: 1054448 - protein, 19 aa, Mycobacterium
RRIEEEVVRAALVDHDGVL

SEQ ID NO: 1054449 - protein, 17 aa, Mycobacterium
RRIEPRLADAPVIETIT

SEQ ID NO: 1054450 - protein, 19 aa, Mycobacterium
RRIGAALGPGWPRSVKSTL

SEQ ID NO: 1054451 - protein, 20 aa, Mycobacterium
RRIGETFFTTAYFDPNMAHM

SEQ ID NO: 1054452 - protein, 20 aa, Mycobacterium
RRIGQVCWRQHHASYWNPNW

SEQ ID NO: 1054453 - protein, 19 aa, Mycobacterium
RRIIPPWTTLGSRLASMPK

SEQ ID NO: 1054454 - protein, 21 aa, Mycobacterium
RRITWRHRRCRSRRCRRGGLR

SEQ ID NO: 1054455 - protein, 17 aa, Mycobacterium
RRIVDLGGDPLEGAGAA

SEQ ID NO: 1054456 - protein, 18 aa, Mycobacterium
RRIYACYDAGRVINPKLA

SEQ ID NO: 1054457 - protein, 24 aa, Mycobacterium
RRKDRRQSLAQSWRRQIGPPRQLP

SEQ ID NO: 1054458 - protein, 21 aa, Mycobacterium
RRKEMLHNSALRGEHMKGHAT

SEQ ID NO: 1054459 - protein, 25 aa, Mycobacterium
RRKLTPHYRIGCKRILNSSSYYPAV

SEQ ID NO: 1054460 - protein, 17 aa, Mycobacterium
RRKPYSWLRQVLPDPQY

SEQ ID NO: 1054461 - protein, 20 aa, Mycobacterium
RRKVDPCGVFASDMARRLEL

SEQ ID NO: 1054462 - protein, 19 aa, Mycobacterium
RRKVMEELHRIRKDGEAGE

SEQ ID NO: 1054463 - protein, 24 aa, Mycobacterium
RRLAAWCRSSASGDWAQFESRLAR

SEQ ID NO: 1054464 - protein, 22 aa, Mycobacterium
RRLAEKLWYLRILTDEKSASDL

SEQ ID NO: 1054465 - protein, 17 aa, Mycobacterium
RRLAELLGRGADGPRVM

SEQ ID NO: 1054466 - protein, 17 aa, Mycobacterium
RRLALTGTPFRSDDSPI

SEQ ID NO: 1054467 - protein, 25 aa, Mycobacterium
RRLARLRGATLLAHNYQLPAIQDVA

SEQ ID NO: 1054468 - protein, 19 aa, Mycobacterium
RRLEESRELIAAKLGARPS

SEQ ID NO: 1054469 - protein, 20 aa, Mycobacterium
RRLFAGGGFGGRRFDTGGFG

SEQ ID NO: 1054470 - protein, 21 aa, Mycobacterium
RRLFRQFSFPGGIPSHVAAQT

SEQ ID NO: 1054471 - protein, 22 aa, Mycobacterium
RRLGAFRHFLRPALLQNETAVH

SEQ ID NO: 1054472 - protein, 20 aa, Mycobacterium
RRLGIPLAQELSAYLRGLDP

SEQ ID NO: 1054473 - protein, 28 aa, Mycobacterium
RRLGPKRARLLNPLALLASQGVPLAFGS

SEQ ID NO: 1054474 - protein, 19 aa, Mycobacterium
RRLHEMRDLLAYMEKVLAG

SEQ ID NO: 1054475 - protein, 24 aa, Mycobacterium
RRLIDGRWVRWDADRAAGAYAHRW

SEQ ID NO: 1054476 - protein, 24 aa, Mycobacterium
RRLIKVLRKRGRILQSAPNVDKPA

SEQ ID NO: 1054477 - protein, 17 aa, Mycobacterium
RRLLDVVPGILIVDEAY

SEQ ID NO: 1054478 - protein, 27 aa, Mycobacterium
RRLPKFCTGEFITAIAMTEPGTGSDLQ

SEQ ID NO: 1054479 - protein, 17 aa, Mycobacterium
RRLPSMYHQFMELAGVD

SEQ ID NO: 1054480 - protein, 17 aa, Mycobacterium
RRLRCCRSRCPRCRRAI

SEQ ID NO: 1054481 - protein, 25 aa, Mycobacterium
RRLRSKARLKFLIKDWGIEKFREVL

SEQ ID NO: 1054482 - protein, 17 aa, Mycobacterium
RRLTEVRKNGVLPYLRP

SEQ ID NO: 1054483 - protein, 17 aa, Mycobacterium
RRLTGTVAQVFGDRLVS

SEQ ID NO: 1054484 - protein, 25 aa, Mycobacterium
RRLTLPKRWLGYPFGAPTLALPEYN

SEQ ID NO: 1054485 - protein, 19 aa, Mycobacterium
RRLTNKWSAHFVLTPQERA

SEQ ID NO: 1054486 - protein, 18 aa, Mycobacterium
RRLVGLFCQQGHFDRSKA

SEQ ID NO: 1054487 - protein, 21 aa, Mycobacterium
RRLVLAEARLAAYTRELGEEP

SEQ ID NO: 1054488 - protein, 19 aa, Mycobacterium
RRLVPPWVTLGLRIALLPR

SEQ ID NO: 1054489 - protein, 19 aa, Mycobacterium
RRMAQLFPDASIIEVPGSK

SEQ ID NO: 1054490 - protein, 23 aa, Mycobacterium
RRMEKEIADVIALQEELGLDVLV

SEQ ID NO: 1054491 - protein, 33 aa, Mycobacterium; identical to SEQ ID NO: 725935

SEQ ID NO: 1054492 - protein, 31 aa, Mycobacterium
RRNAVAADLRTDWPATLHAAGFEPGQPSAWS

SEQ ID NO: 1054493 - protein, 22 aa, Mycobacterium
RRNPGAVVRYIMSRLDDPTPNT

SEQ ID NO: 1054494 - protein, 21 aa, Mycobacterium
RRNRGPVRCRICNKELTTPAA

SEQ ID NO: 1054495 - protein, 20 aa, Mycobacterium
RRNVGVLGVAWGEYLNRVPG

SEQ ID NO: 1054496 - protein, 21 aa, Mycobacterium
RRPAHDAARYDQVWKEHVLPL

SEQ ID NO: 1054497 - protein, 24 aa, Mycobacterium
RRPCGQTQFAAPVWMPRAKRPSIR

SEQ ID NO: 1054498 - protein, 17 aa, Mycobacterium
RRPDPALLKQLFGTIWG

SEQ ID NO: 1054499 - protein, 25 aa, Mycobacterium
RRPDRPGVEHLLRYGATDRVLLSGT

SEQ ID NO: 1054500 - protein, 21 aa, Mycobacterium
RRPELGRAPADLSILPNTGAD

SEQ ID NO: 1054501 - protein, 20 aa, Mycobacterium
RRPEMPALLAELGLSGLQRS

SEQ ID NO: 1054502 - protein, 21 aa, Mycobacterium
RRPRMLYDYFQQLFAQVTNPP

SEQ ID NO: 1054503 - protein, 17 aa, Mycobacterium
RRPRRLVYTSSMAAYGY

SEQ ID NO: 1054504 - protein, 28 aa, Mycobacterium
RRPSAGPAGLPSCTGTASAAVAIQQPAV

SEQ ID NO: 1054505 - protein, 20 aa, Mycobacterium
RRPSLVPVEAIELLGGTVQY

SEQ ID NO: 1054506 - protein, 17 aa, Mycobacterium
RRQCPTLNYAVSVVEAC

SEQ ID NO: 1054507 - protein, 17 aa, Mycobacterium
RRQIFAGVRLAWSIEDA

SEQ ID NO: 1054508 - protein, 36 aa, Mycobacterium
RRQLHQAAARLCARVGLRGVATVEFLVAGDKFVFLE

SEQ ID NO: 1054509 - protein, 24 aa, Mycobacterium
RRQRRRWWHRWLVIRRRRCGRGRR

SEQ ID NO: 1054510 - protein, 34 aa, Mycobacterium
RRRADVGAWADERARLPIDPEWGPGWHLGVVGLD

SEQ ID NO: 1054511 - protein, 18 aa, Mycobacterium
RRRAEIIAAVSDDAVVVE

SEQ ID NO: 1054512 - protein, 18 aa, Mycobacterium
RRRDLPRDGKAPVLVQVP

SEQ ID NO: 1054513 - protein, 21 aa, Mycobacterium
RRRFETSWNRENGAHPINDSP

SEQ ID NO: 1054514 - protein, 21 aa, Mycobacterium
RRRGFKLSEHYTAPPMPFWFT

SEQ ID NO: 1054515 - protein, 19 aa, Mycobacterium
RRRGSHFAELDRERSGVKQ

SEQ ID NO: 1054516 - protein, 20 aa, Mycobacterium
RRRGSHFSEFDWERTGIKQS

SEQ ID NO: 1054517 - protein, 25 aa, Mycobacterium
RRRHGLAGMFALRFDQFALSLLSRE

SEQ ID NO: 1054518 - protein, 18 aa, Mycobacterium
RRRIPVVIHEANARAGLA

SEQ ID NO: 1054519 - protein, 18 aa, Mycobacterium
RRRLRMICHGLGHTEGFR

SEQ ID NO: 1054520 - protein, 19 aa, Mycobacterium
RRRMAQWLTAIGVEPVRKG

SEQ ID NO: 1054521 - protein, 24 aa, Mycobacterium
RRRPDIAVTILRLANMIGPAMDTT

SEQ ID NO: 1054522 - protein, 19 aa, Mycobacterium
RRRPEARWRRQPSDVPTLV

SEQ ID NO: 1054523 - protein, 20 aa, Mycobacterium
RRRPIPGLHWPWVARIGTVV

SEQ ID NO: 1054524 - protein, 18 aa, Mycobacterium
RRRQRVRLSEWVVRCSIG

SEQ ID NO: 1054525 - protein, 25 aa, Mycobacterium
RRRQVYPWVGWLVCHGVAPGDVLVC

SEQ ID NO: 1054526 - protein, 24 aa, Mycobacterium
RRRRARKGTLEFGDLAIHPDSCTV

SEQ ID NO: 1054527 - protein, 20 aa, Mycobacterium
RRRRELLRRNNLDGTLQEIK

SEQ ID NO: 1054528 - protein, 22 aa, Mycobacterium
RRRRLIKYISQIDVQRYRSLIE

SEQ ID NO: 1054529 - protein, 18 aa, Mycobacterium
RRRTDWRAYSSWPVAAGD

SEQ ID NO: 1054530 - protein, 18 aa, Mycobacterium
RRRVLLAEPRGYCAGVDR

SEQ ID NO: 1054531 - protein, 22 aa, Mycobacterium
RRRWCRCCPEWTQSRQRRRPRR

SEQ ID NO: 1054532 - protein, 22 aa, Mycobacterium
RRSAESLYDFNLATYDEGDTFD

SEQ ID NO: 1054533 - protein, 22 aa, Mycobacterium
RRSARRRRRHRQQSHQRRQRRQ

SEQ ID NO: 1054534 - protein, 30 aa, Mycobacterium
RRSGIPFVAAESFIAIDLLPPEIVASLLET

SEQ ID NO: 1054535 - protein, 18 aa, Mycobacterium
RRSGLIALLCKTDPHATP

SEQ ID NO: 1054536 - protein, 19 aa, Mycobacterium
RRSLSYFPPSAWSYPPSLP

SEQ ID NO: 1054537 - protein, 21 aa, Mycobacterium
RRSNCLVPIPALSTYRGGQLL

SEQ ID NO: 1054538 - protein, 20 aa, Mycobacterium
RRSRHPTNILVRVETSADVV

SEQ ID NO: 1054539 - protein, 18 aa, Mycobacterium
RRSRTPALDAGRELAKAL

SEQ ID NO: 1054540 - protein, 24 aa, Mycobacterium
RRSVPRLQRMLGHLETSLKELERA

SEQ ID NO: 1054541 - protein, 20 aa, Mycobacterium
RRTGIDVSWNDERDLWWHDV

SEQ ID NO: 1054542 - protein, 20 aa, Mycobacterium
RRTGRCVVLHEGPRSLGYGA

SEQ ID NO: 1054543 - protein, 21 aa, Mycobacterium
RRTLDGWQEWAKQRGHRGLAY

SEQ ID NO: 1054544 - protein, 24 aa, Mycobacterium
RRTQHNVYIPWSMTVTPISQSDVG

SEQ ID NO: 1054545 - protein, 21 aa, Mycobacterium
RRTVTVRPWAAVSPSVTGLTA

SEQ ID NO: 1054546 - protein, 24 aa, Mycobacterium
RRTWRARVSDRFGDYGFVGLVSAV

SEQ ID NO: 1054547 - protein, 24 aa, Mycobacterium
RRVDPRNSTVLVWGAVNAGVAANA

SEQ ID NO: 1054548 - protein, 20 aa, Mycobacterium
RRVHDIAGWHVELYVDAAHL

SEQ ID NO: 1054549 - protein, 26 aa, Mycobacterium
RRVHGRKWCKLFPPGTLPQAVPGSPI

SEQ ID NO: 1054550 - protein, 18 aa, Mycobacterium
RRVIRSWLLAGGAIGLTD

SEQ ID NO: 1054551 - protein, 20 aa, Mycobacterium
RRVKRLEGWLNDLIPQLLND

SEQ ID NO: 1054552 - protein, 19 aa, Mycobacterium
RRVLGLDCDVRAAATASGA

SEQ ID NO: 1054553 - protein, 19 aa, Mycobacterium
RRVLLTLPISHVYGLPPGK

SEQ ID NO: 1054554 - protein, 26 aa, Mycobacterium
RRVLRRARDGFALNIDEAVVAMTARG

SEQ ID NO: 1054555 - protein, 19 aa, Mycobacterium
RRVPLKSTLLAAHMVVNAR

SEQ ID NO: 1054556 - protein, 17 aa, Mycobacterium
RRVRARLARRITAQRSA

SEQ ID NO: 1054557 - protein, 18 aa, Mycobacterium
RRVRVLEQMWLNALWGGP

SEQ ID NO: 1054558 - protein, 17 aa, Mycobacterium
RRVTARRGPLRANVAVQ

SEQ ID NO: 1054559 - protein, 25 aa, Mycobacterium
RRVVAALGPRVLRLAARRSAGAHPY

SEQ ID NO: 1054560 - protein, 17 aa, Mycobacterium
RRWPDTRSIISALLTSH

SEQ ID NO: 1054561 - protein, 26 aa, Mycobacterium
RRWPSKAELVLAAFIEGVRQVAVAPN

SEQ ID NO: 1054562 - protein, 26 aa, Mycobacterium
RRWWPRRYRRSSAYWKLVELDQRFGI

SEQ ID NO: 1054563 - protein, 21 aa, Mycobacterium
RRYGVAMGTPLVPVLGNLAVI

SEQ ID NO: 1054564 - protein, 28 aa, Mycobacterium
RRYPHRGVDTGGVWVWRDAQAVDIGYHC

SEQ ID NO: 1054565 - protein, 21 aa, Mycobacterium
RRYTAEFLQAASLQPDNVVSV

SEQ ID NO: 1054566 - protein, 25 aa, Mycobacterium
RRYVAKYTICPAVAHGLDHEVGSVE

SEQ ID NO: 1054567 - protein, 21 aa, Mycobacterium
RRYYFDSVINPSVIWVDLDKV

SEQ ID NO: 1054568 - protein, 17 aa, Mycobacterium
RRYYRVSGADAYTMRRD

SEQ ID NO: 1054569 - protein, 17 aa, Mycobacterium
RSAACWADRLVFVNGHG

SEQ ID NO: 1054570 - protein, 23 aa, Mycobacterium
RSADRLEALAGRLGSDTHPLPAD

SEQ ID NO: 1054571 - protein, 20 aa, Mycobacterium
RSAEAVWRDGFNQLGRGQKV

SEQ ID NO: 1054572 - protein, 17 aa, Mycobacterium
RSAEIMAATVDFFESRG

SEQ ID NO: 1054573 - protein, 19 aa, Mycobacterium
RSAIAVYRVPEPIVTGTAA

SEQ ID NO: 1054574 - protein, 18 aa, Mycobacterium
RSALMSMVAANVFGLNAP

SEQ ID NO: 1054575 - protein, 26 aa, Mycobacterium
RSAPARSGFRVGERVSAFGVLGGYAE

SEQ ID NO: 1054576 - protein, 26 aa, Mycobacterium
RSAPGPGGGAWCHLMDGPPPPGPGGG

SEQ ID NO: 1054577 - protein, 27 aa, Mycobacterium
RSAQYWGAVALARWKAEHLADDLPRQW

SEQ ID NO: 1054578 - protein, 25 aa, Mycobacterium
RSARKIACPILFCVCETDSVAPAGP

SEQ ID NO: 1054579 - protein, 19 aa, Mycobacterium
RSARSFWGMTRRFKPADFS

SEQ ID NO: 1054580 - protein, 18 aa, Mycobacterium
RSDALVWAGSPTRAPAFL

SEQ ID NO: 1054581 - protein, 21 aa, Mycobacterium
RSDALWRGKLVGLVRRVLNTP

SEQ ID NO: 1054582 - protein, 20 aa, Mycobacterium
RSDDFSAWPVIGGKNGESSV

SEQ ID NO: 1054583 - protein, 21 aa, Mycobacterium
RSDPRAPAYIYFTSGSTGRPK

SEQ ID NO: 1054584 - protein, 17 aa, Mycobacterium
RSDVCVELVDTLSGLAA

SEQ ID NO: 1054585 - protein, 18 aa, Mycobacterium
RSEGAGVVVLKRLSDAQR

SEQ ID NO: 1054586 - protein, 21 aa, Mycobacterium
RSEGDAFGRLILLYDPDGSDA

SEQ ID NO: 1054587 - protein, 19 aa, Mycobacterium
RSELARFGMAPTYPFEFMA

SEQ ID NO: 1054588 - protein, 18 aa, Mycobacterium
RSEQDVVDVLDWCTREQI

SEQ ID NO: 1054589 - protein, 24 aa, Mycobacterium
RSERCRCCRCARCRRCRRHQRHRR

SEQ ID NO: 1054590 - protein, 31 aa, Mycobacterium
RSEVAADLRADWPRALKAAGFDPQRSSAWSV

SEQ ID NO: 1054591 - protein, 24 aa, Mycobacterium
RSFGAPMDVWWFRLPRRPDDPTGL

SEQ ID NO: 1054592 - protein, 17 aa, Mycobacterium
RSFVLRVPIINAPMGEI

SEQ ID NO: 1054593 - protein, 18 aa, Mycobacterium
RSGAAVAWLNPRTPQPTA

SEQ ID NO: 1054594 - protein, 24 aa, Mycobacterium
RSGAPRGSVYYHFPDGRNQILIEA

SEQ ID NO: 1054595 - protein, 18 aa, Mycobacterium
RSGDAGALQKHWNAAMEV

SEQ ID NO: 1054596 - protein, 20 aa, Mycobacterium
RSGGRPAAMYRFTDSQLRVT

SEQ ID NO: 1054597 - protein, 18 aa, Mycobacterium
RSGIPRRGGYTLEHLASD

SEQ ID NO: 1054598 - protein, 23 aa, Mycobacterium
RSGKNVFTPVGWVYPDLSKPRVK

SEQ ID NO: 1054599 - protein, 19 aa, Mycobacterium
RSGLHQLYPLLAHVVLFGG

SEQ ID NO: 1054600 - protein, 18 aa, Mycobacterium
RSGLPVGVEPGRAKQGPE

SEQ ID NO: 1054601 - protein, 23 aa, Mycobacterium
RSGPRSSFLRLFPTVVKGTHVEL

SEQ ID NO: 1054602 - protein, 25 aa, Mycobacterium
RSGREMLYRLADYHLTHIVVDAVAH

SEQ ID NO: 1054603 - protein, 19 aa, Mycobacterium
RSGRRGVVVPPEQVEVFRG

SEQ ID NO: 1054604 - protein, 27 aa, Mycobacterium
RSGTIAGIHLEGPWLSPARCGAHDHTQ

SEQ ID NO: 1054605 - protein, 19 aa, Mycobacterium
RSHVFPIGQFADGIAHTLR

SEQ ID NO: 1054606 - protein, 17 aa, Mycobacterium
RSIKTAKLRAAQRVQRF

SEQ ID NO: 1054607 - protein, 20 aa, Mycobacterium
RSIKTLFAAMGLRPLRHSPL

SEQ ID NO: 1054608 - protein, 19 aa, Mycobacterium
RSITLRLTIAPVQRTWSEL

SEQ ID NO: 1054609 - protein, 24 aa, Mycobacterium
RSITWDQGIEMARHTDITADLGVP

SEQ ID NO: 1054610 - protein, 22 aa, Mycobacterium
RSIYQDGWWACARLDKAPWDLS

SEQ ID NO: 1054611 - protein, 21 aa, Mycobacterium
RSKGVGVFFCTQLPTDLPKDV

SEQ ID NO: 1054612 - protein, 24 aa, Mycobacterium
RSKIIKFSGCYHGHVDALLADAGS

SEQ ID NO: 1054613 - protein, 20 aa, Mycobacterium
RSLAHAVLMMIPEAWERHAS

SEQ ID NO: 1054614 - protein, 24 aa, Mycobacterium
RSLARRPAAEVKRVINGTSPDEAI

SEQ ID NO: 1054615 - protein, 21 aa, Mycobacterium
RSLCRELLRQGGLALHGALEK

SEQ ID NO: 1054616 - protein, 20 aa, Mycobacterium
RSLDFYGMYVLPELEGLDGF

SEQ ID NO: 1054617 - protein, 20 aa, Mycobacterium
RSLEHLVDVVLHFEGDRNGG

SEQ ID NO: 1054618 - protein, 18 aa, Mycobacterium
RSLLAAGITAVSGRFYGG

SEQ ID NO: 1054619 - protein, 20 aa, Mycobacterium
RSLLRAELPPGGRLGLYGFG

SEQ ID NO: 1054620 - protein, 18 aa, Mycobacterium
RSLLRARYRDRRKLLETL

SEQ ID NO: 1054621 - protein, 19 aa, Mycobacterium
RSLPFPTLVSIQLADVHVD

SEQ ID NO: 1054622 - protein, 19 aa, Mycobacterium
RSLRACIDLAALGENTIAV

SEQ ID NO: 1054623 - protein, 19 aa, Mycobacterium
RSLREGLKLCQVIDDPWSG

SEQ ID NO: 1054624 - protein, 24 aa, Mycobacterium
RSLRQLPEPVIPNGLQIRTYAGTE

SEQ ID NO: 1054625 - protein, 19 aa, Mycobacterium
RSLSGAAQTYARAEATGAA

SEQ ID NO: 1054626 - protein, 18 aa, Mycobacterium
RSMSPVEWVRFAANAVGD

SEQ ID NO: 1054627 - protein, 25 aa, Mycobacterium
RSNGLWRPSPGSVYPTLQLLDDEGL

SEQ ID NO: 1054628 - protein, 19 aa, Mycobacterium
RSPAGKPDYRWAKEQTEAR

SEQ ID NO: 1054629 - protein, 19 aa, Mycobacterium
RSPAWPVVYPHARPVPLPT

SEQ ID NO: 1054630 - protein, 30 aa, Mycobacterium
RSPEAIDPFLLDLLRLGAYQLLRTRVDAHA

SEQ ID NO: 1054631 - protein, 17 aa, Mycobacterium
RSPFAHARINGIDTTAA

SEQ ID NO: 1054632 - protein, 19 aa, Mycobacterium
RSPIALSVTLEAVRRAAKL

SEQ ID NO: 1054633 - protein, 23 aa, Mycobacterium
RSPKARAGFYGHGFTVSVSSAGR

SEQ ID NO: 1054634 - protein, 21 aa, Mycobacterium
RSPLPFARDRWVSAPVSQKID

SEQ ID NO: 1054635 - protein, 23 aa, Mycobacterium
RSPLPFGRPRWVAYHEAPDIDVA

SEQ ID NO: 1054636 - protein, 18 aa, Mycobacterium
RSPQEWYNSGFAVIAGSV

SEQ ID NO: 1054637 - protein, 23 aa, Mycobacterium
RSPSEHWEVVRIQVPATVARYVV

SEQ ID NO: 1054638 - protein, 19 aa, Mycobacterium
RSPSGRIVTQWPYTELEYA

SEQ ID NO: 1054639 - protein, 18 aa, Mycobacterium
RSPTHAWTSRSRWRGTRS

SEQ ID NO: 1054640 - protein, 20 aa, Mycobacterium
RSQEEVDHWLALDPISRYRS

SEQ ID NO: 1054641 - protein, 28 aa, Mycobacterium
RSQLPRACPLPMPGHGRCYSPAQPDSWE

SEQ ID NO: 1054642 - protein, 19 aa, Mycobacterium
RSRAARRAATQPCLAANLG

SEQ ID NO: 1054643 - protein, 22 aa, Mycobacterium
RSRANITVCVGGGIGTPERAAE

SEQ ID NO: 1054644 - protein, 23 aa, Mycobacterium
RSRGSMKAGVFSGAALTAGTQVA

SEQ ID NO: 1054645 - protein, 21 aa, Mycobacterium
RSRPLITNMIRLLKLPIPVQR

SEQ ID NO: 1054646 - protein, 18 aa, Mycobacterium
RSRQAIWDLVTSFKKLGI

SEQ ID NO: 1054647 - protein, 23 aa, Mycobacterium
RSRQGACVRATWLKVVPDQIERS

SEQ ID NO: 1054648 - protein, 19 aa, Mycobacterium
RSRQLGRLFAAVTTKYGAD

SEQ ID NO: 1054649 - protein, 17 aa, Mycobacterium
RSRRPPTSAMLFPNSSR

SEQ ID NO: 1054650 - protein, 17 aa, Mycobacterium
RSRTPALDAGRELAKAL

SEQ ID NO: 1054651 - protein, 17 aa, Mycobacterium
RSSEMIISGGVNIAPDE

SEQ ID NO: 1054652 - protein, 24 aa, Mycobacterium
RSSETLEAWTLHIYVRYESAIADL

SEQ ID NO: 1054653 - protein, 20 aa, Mycobacterium
RSSHTWFVLHELLGHKNVKN

SEQ ID NO: 1054654 - protein, 32 aa, Mycobacterium
RSSKVGLIAGCMISSGVVRRNAKARLLRDNIV

SEQ ID NO: 1054655 - protein, 20 aa, Mycobacterium
RSSPDEALMFHRGQFVGTAT

SEQ ID NO: 1054656 - protein, 18 aa, Mycobacterium
RSSSCCWATSAGPAGAYS

SEQ ID NO: 1054657 - protein, 29 aa, Mycobacterium
RSSSGYNWSCGFAGYLVGRIDMSAQVEQL

SEQ ID NO: 1054658 - protein, 24 aa, Mycobacterium
RSTFRKHRDRMAAVAIVAYKPSAS

SEQ ID NO: 1054659 - protein, 36 aa, Mycobacterium
RSTKRVCRDCGFFLPLAGSLGVMFGVCGNELAADGR

SEQ ID NO: 1054660 - protein, 20 aa, Mycobacterium
RSTLLDGLRRIGIDRLAPTD

SEQ ID NO: 1054661 - protein, 24 aa, Mycobacterium
RSTPHAAEALECLGGNGYVEESGM

SEQ ID NO: 1054662 - protein, 18 aa, Mycobacterium
RSVAKFGSPELVEEVLPG

SEQ ID NO: 1054663 - protein, 17 aa, Mycobacterium
RSVRGLVDIDLTDERSL

SEQ ID NO: 1054664 - protein, 22 aa, Mycobacterium
RSVRVGQLIAERAKAAGINTVV

SEQ ID NO: 1054665 - protein, 17 aa, Mycobacterium
RSVSAAAEMAGELAGGA

SEQ ID NO: 1054666 - protein, 17 aa, Mycobacterium
RSWNCGIEGPTDDPDIV

SEQ ID NO: 1054667 - protein, 19 aa, Mycobacterium
RSYDELARILNTFDTSFPD

SEQ ID NO: 1054668 - protein, 21 aa, Mycobacterium
RSYEISSRYLIGADGGRSLVR

SEQ ID NO: 1054669 - protein, 29 aa, Mycobacterium
RSYLTDLGIRFMPTVGWAERGDLRAEGHG

SEQ ID NO: 1054670 - protein, 20 aa, Mycobacterium
RSYVLHPYQMVKDLRTEYEV

SEQ ID NO: 1054671 - protein, 26 aa, Mycobacterium
RSYYADFEGVLAFLQRKMAQTESEQM

SEQ ID NO: 1054672 - protein, 21 aa, Mycobacterium
RTADGYASNWLCDNAHQGMRI

SEQ ID NO: 1054673 - protein, 19 aa, Mycobacterium
RTAEELGRAFPGTSVITSA

SEQ ID NO: 1054674 - protein, 19 aa, Mycobacterium
RTAFFDEFFLDATRAGIGQ

SEQ ID NO: 1054675 - protein, 20 aa, Mycobacterium
RTAFFDEFFLGAADAGVRQV

SEQ ID NO: 1054676 - protein, 20 aa, Mycobacterium
RTALDLLAPLGLPTLALASR

SEQ ID NO: 1054677 - protein, 18 aa, Mycobacterium
RTARIALLHYLDGEKRYI

SEQ ID NO: 1054678 - protein, 25 aa, Mycobacterium
RTATVPPVIRIFRAEIGAATDVLSM

SEQ ID NO: 1054679 - protein, 19 aa, Mycobacterium
RTDEAKLILGREATIVAGG

SEQ ID NO: 1054680 - protein, 30 aa, Mycobacterium; identical to SEQ ID NO: 727286

SEQ ID NO: 1054681 - protein, 18 aa, Mycobacterium
RTDFHAEVLRMQKATNAV

SEQ ID NO: 1054682 - protein, 19 aa, Mycobacterium
RTDRLPVAILAILKTGAAY

SEQ ID NO: 1054683 - protein, 21 aa, Mycobacterium
RTETFKVLKRQLAADGVDCGD

SEQ ID NO: 1054684 - protein, 20 aa, Mycobacterium
RTFPLRSSFAPSYNMTINLV

SEQ ID NO: 1054685 - protein, 18 aa, Mycobacterium
RTFVPWLSTVVNVAVNDS

SEQ ID NO: 1054686 - protein, 19 aa, Mycobacterium
RTGACGPIISVYVRDPDNN

SEQ ID NO: 1054687 - protein, 22 aa, Mycobacterium
RTGATLRWYSVTDEGRIDLDSL

SEQ ID NO: 1054688 - protein, 19 aa, Mycobacterium
RTGDELACRVAAQTAGFLL

SEQ ID NO: 1054689 - protein, 19 aa, Mycobacterium
RTGDLWLFRGRSRPDRAIQ

SEQ ID NO: 1054690 - protein, 20 aa, Mycobacterium
RTGEQPEQFAWSLVVTASDL

SEQ ID NO: 1054691 - protein, 23 aa, Mycobacterium
RTGERACAVIVAAADPPPGLPGV

SEQ ID NO: 1054692 - protein, 30 aa, Mycobacterium; identical to SEQ ID NO: 623676

SEQ ID NO: 1054693 - protein, 18 aa, Mycobacterium
RTGMGIQFLIDGKEMNMD

SEQ ID NO: 1054694 - protein, 26 aa, Mycobacterium
RTGRANPGMFSRLVIDYYGSATPITQ

SEQ ID NO: 1054695 - protein, 25 aa, Mycobacterium
RTGRRYLDMFTFFASSALGMNHPGL

SEQ ID NO: 1054696 - protein, 20 aa, Mycobacterium
RTGTLTVCTMVPMRSVPHRV

SEQ ID NO: 1054697 - protein, 23 aa, Mycobacterium
RTGVKEVRVDICARRITVATHGL

SEQ ID NO: 1054698 - protein, 21 aa, Mycobacterium
RTGWDVFGKPVALPFGIAPTG

SEQ ID NO: 1054699 - protein, 20 aa, Mycobacterium
RTGYSWGPLSLMLLATAIAQ

SEQ ID NO: 1054700 - protein, 19 aa, Mycobacterium
RTHAIGQIVPGKVTKLVPF

SEQ ID NO: 1054701 - protein, 24 aa, Mycobacterium
RTIALEHPEIWRGIIDLDESMPAE

SEQ ID NO: 1054702 - protein, 27 aa, Mycobacterium
RTIDLGSGCLMPGFVEAHGHPLMEAIV

SEQ ID NO: 1054703 - protein, 24 aa, Mycobacterium
RTIFKRLYDAGLIYQAERLVNWSP

SEQ ID NO: 1054704 - protein, 25 aa, Mycobacterium
RTITLEHPEIWCAIIDFDNSVPAQV

SEQ ID NO: 1054705 - protein, 19 aa, Mycobacterium
RTKLPIPQRTIGRTMAESV

SEQ ID NO: 1054706 - protein, 17 aa, Mycobacterium
RTKNIRLGFGIMHLPPA

SEQ ID NO: 1054707 - protein, 20 aa, Mycobacterium
RTKTAMGWSLPVESIGPALE

SEQ ID NO: 1054708 - protein, 17 aa, Mycobacterium
RTLGDFPRMLKAAASLR

SEQ ID NO: 1054709 - protein, 27 aa, Mycobacterium
RTLLERELPVYIISIGRTFRTDELDAT

SEQ ID NO: 1054710 - protein, 30 aa, Mycobacterium
RTLLERELPVYVISIGRAFRTDEVDATHTP

SEQ ID NO: 1054711 - protein, 32 aa, Mycobacterium; identical to SEQ ID NO: 727527

SEQ ID NO: 1054712 - protein, 25 aa, Mycobacterium
RTLPQLLGEHGWHSALFGMQHETSQ

SEQ ID NO: 1054713 - protein, 21 aa, Mycobacterium
RTLSYEAFIYFYPLVMMDVTR

SEQ ID NO: 1054714 - protein, 19 aa, Mycobacterium
RTLTANGLRQLISFISRMT

SEQ ID NO: 1054715 - protein, 22 aa, Mycobacterium
RTLTFPGFLKAYVETVDELAGG

SEQ ID NO: 1054716 - protein, 25 aa, Mycobacterium
RTLTVSRLLAPILAPVMYRAAIAAR

SEQ ID NO: 1054717 - protein, 20 aa, Mycobacterium
RTPAGLPIELPGHGPRFRLL

SEQ ID NO: 1054718 - protein, 19 aa, Mycobacterium
RTPGAVVVVSIFVNPLQFG

SEQ ID NO: 1054719 - protein, 17 aa, Mycobacterium
RTPLTLLLGPVEDALAD

SEQ ID NO: 1054720 - protein, 24 aa, Mycobacterium
RTPRGRVATALAWTHLGMTPPAGA

SEQ ID NO: 1054721 - protein, 17 aa, Mycobacterium
RTQAIAMLQAEQAAPGT

SEQ ID NO: 1054722 - protein, 25 aa, Mycobacterium
RTQWWGRQMLIWGVHVHVGVSSANK

SEQ ID NO: 1054723 - protein, 17 aa, Mycobacterium
RTRAELIDALQAMIDRY

SEQ ID NO: 1054724 - protein, 20 aa, Mycobacterium
RTRHTIAWDLPVGAPAGVTP

SEQ ID NO: 1054725 - protein, 17 aa, Mycobacterium
RTRIEAYSFLKHIGAVT

SEQ ID NO: 1054726 - protein, 21 aa, Mycobacterium
RTRMIEPTPMLGRLPGLEPDQ

SEQ ID NO: 1054727 - protein, 23 aa, Mycobacterium
RTRVSFEVAGKWMSADLINVSAS

SEQ ID NO: 1054728 - protein, 17 aa, Mycobacterium
RTRVVGVLESAGRPSPV

SEQ ID NO: 1054729 - protein, 21 aa, Mycobacterium
RTRYARCGDLDIAYQVIGDHP

SEQ ID NO: 1054730 - protein, 23 aa, Mycobacterium
RTSDLIPLCHQLALTGVDVDFTM

SEQ ID NO: 1054731 - protein, 26 aa, Mycobacterium
RTSGVSIYDMWARIYADTERTNLHSH

SEQ ID NO: 1054732 - protein, 23 aa, Mycobacterium
RTSVPPFTWWRGIRARQLLENYF

SEQ ID NO: 1054733 - protein, 17 aa, Mycobacterium
RTTGKVDSMLGISSADV

SEQ ID NO: 1054734 - protein, 18 aa, Mycobacterium
RTTLRTLQRLGFRCGVVS

SEQ ID NO: 1054735 - protein, 29 aa, Mycobacterium
RTTQGMPAYWCRRLANDMVDYVNSYRSHA

SEQ ID NO: 1054736 - protein, 18 aa, Mycobacterium
RTTSVHWHGIALRNDMDG

SEQ ID NO: 1054737 - protein, 18 aa, Mycobacterium
RTVDFKNTVLIFTSNLGT

SEQ ID NO: 1054738 - protein, 20 aa, Mycobacterium
RTVDLHWQRVQVLRSAVGSL

SEQ ID NO: 1054739 - protein, 30 aa, Mycobacterium; identical to SEQ ID NO: 727781

SEQ ID NO: 1054740 - protein, 26 aa, Mycobacterium
RTVRLNHEFHRAINLAADSPRLSQLM

SEQ ID NO: 1054741 - protein, 17 aa, Mycobacterium
RTVTCGTAPLAPDDADA

SEQ ID NO: 1054742 - protein, 18 aa, Mycobacterium
RTVVLERLVKFNGEQHVP

SEQ ID NO: 1054743 - protein, 21 aa, Mycobacterium
RTWAEVFWREGYQLHAHTVGD

SEQ ID NO: 1054744 - protein, 21 aa, Mycobacterium
RTWSRRWAGFYPTEKEAAPLE

SEQ ID NO: 1054745 - protein, 21 aa, Mycobacterium
RTYALLKRRGTQFVVVSAAEP

SEQ ID NO: 1054746 - protein, 26 aa, Mycobacterium
RTYGHFGQAGGFIWVDPEADLALVVL

SEQ ID NO: 1054747 - protein, 20 aa, Mycobacterium
RTYKSSGYTGMLAQLMQKPR

SEQ ID NO: 1054748 - protein, 18 aa, Mycobacterium
RVAALVAELGEDAQVGFH

SEQ ID NO: 1054749 - protein, 24 aa, Mycobacterium
RVAAMASALADWVDGPGAQTPLAD

SEQ ID NO: 1054750 - protein, 20 aa, Mycobacterium
RVAARLLAVVPTGVKDRALH

SEQ ID NO: 1054751 - protein, 18 aa, Mycobacterium
RVAAYKYPRRIWFVDELP

SEQ ID NO: 1054752 - protein, 23 aa, Mycobacterium
RVADGAQVARFICELRGLIEAPE

SEQ ID NO: 1054753 - protein, 17 aa, Mycobacterium
RVADHGWGLGYMLNQRA

SEQ ID NO: 1054754 - protein, 17 aa, Mycobacterium
RVAGLAPPRAVVVSDVV

SEQ ID NO: 1054755 - protein, 17 aa, Mycobacterium
RVAGLGDRGRIAVGYKA

SEQ ID NO: 1054756 - protein, 18 aa, Mycobacterium
RVAGMGPTMLAGRHADIL

SEQ ID NO: 1054757 - protein, 26 aa, Mycobacterium
RVAGVLAAAGWPLAGIDLSETEDGDA

SEQ ID NO: 1054758 - protein, 22 aa, Mycobacterium
RVAKNLGVTVFSTFCESHATDI

SEQ ID NO: 1054759 - protein, 18 aa, Mycobacterium
RVALPHAILVSLSEQAGS

SEQ ID NO: 1054760 - protein, 20 aa, Mycobacterium
RVALRNCAPERRHDMLHDQV

SEQ ID NO: 1054761 - protein, 18 aa, Mycobacterium
RVALRSGSNLEFVVALLA

SEQ ID NO: 1054762 - protein, 19 aa, Mycobacterium
RVALSALTMAEWFRDEAGQ

SEQ ID NO: 1054763 - protein, 25 aa, Mycobacterium
RVAQARAAPHLARITCPALVINADA

SEQ ID NO: 1054764 - protein, 20 aa, Mycobacterium
RVARFERRYGKRKAGADKDQ

SEQ ID NO: 1054765 - protein, 25 aa, Mycobacterium
RVAVHGDGWCPFPAPAPLAQTAGTA

SEQ ID NO: 1054766 - protein, 17 aa, Mycobacterium
RVAVMGCVVNGPGEARE

SEQ ID NO: 1054767 - protein, 17 aa, Mycobacterium
RVAWAGKWLAAMSPAEV

SEQ ID NO: 1054768 - protein, 28 aa, Mycobacterium
RVCDSCPSVDTIVLVAGLYRAAVAREAE

SEQ ID NO: 1054769 - protein, 20 aa, Mycobacterium
RVCHARKPACGVCVLAKDCP

SEQ ID NO: 1054770 - protein, 19 aa, Mycobacterium
RVCVARGTTSLRRIREIAP

SEQ ID NO: 1054771 - protein, 25 aa, Mycobacterium
RVCVRFPELRLCMIHGADPWWDVAI

SEQ ID NO: 1054772 - protein, 21 aa, Mycobacterium
RVDAMCPLGPILGGAGLNITV

SEQ ID NO: 1054773 - protein, 25 aa, Mycobacterium
RVDGPCIYHDVFSYLVDAPWDEIAF

SEQ ID NO: 1054774 - protein, 22 aa, Mycobacterium
RVDTVLRAKVDAAWNLHELTRD

SEQ ID NO: 1054775 - protein, 17 aa, Mycobacterium
RVDWRGQGLEGFGRPDG

SEQ ID NO: 1054776 - protein, 24 aa, Mycobacterium
RVEHHAVLDTVDWLVEHEGAEVTW

SEQ ID NO: 1054777 - protein, 20 aa, Mycobacterium
RVERFPRRASYVYQLDAFTG

SEQ ID NO: 1054778 - protein, 18 aa, Mycobacterium
RVESVAMQRGVSADDIVN

SEQ ID NO: 1054779 - protein, 22 aa, Mycobacterium
RVFADLTWKVTIRVVQLPGLSA

SEQ ID NO: 1054780 - protein, 17 aa, Mycobacterium
RVGAAVADRSSWSRWWP

SEQ ID NO: 1054781 - protein, 19 aa, Mycobacterium
RVGDVPSCLVISAEQDAII

SEQ ID NO: 1054782 - protein, 20 aa, Mycobacterium
RVGDVPSCLVISAEQDAIIR

SEQ ID NO: 1054783 - protein, 19 aa, Mycobacterium
RVGGGVFNGACAMGADSFA

SEQ ID NO: 1054784 - protein, 24 aa, Mycobacterium
RVGIWAPNRWEWVLVQYATAEIGA

SEQ ID NO: 1054785 - protein, 24 aa, Mycobacterium
RVGIWCKGVAPSTELRQWYHHQPE

SEQ ID NO: 1054786 - protein, 20 aa, Mycobacterium
RVGKKPLAWERPLRKSDLAA

SEQ ID NO: 1054787 - protein, 24 aa, Mycobacterium
RVGSRFGPYELVRLIGRGGMGEVY

SEQ ID NO: 1054788 - protein, 20 aa, Mycobacterium
RVGTALGVALERADHVVVAC

SEQ ID NO: 1054789 - protein, 24 aa, Mycobacterium
RVGVDGYLAALGRYLQFHEDRRIP

SEQ ID NO: 1054790 - protein, 17 aa, Mycobacterium
RVHPAPMETCGAVADLD

SEQ ID NO: 1054791 - protein, 18 aa, Mycobacterium
RVIAEAGHFPWIEQPVAV

SEQ ID NO: 1054792 - protein, 17 aa, Mycobacterium
RVIDRAPLWCAVDLRDG

SEQ ID NO: 1054793 - protein, 17 aa, Mycobacterium
RVIEACNDLHCAGKSLA

SEQ ID NO: 1054794 - protein, 17 aa, Mycobacterium
RVIPSDANFVLFGEFAD

SEQ ID NO: 1054795 - protein, 17 aa, Mycobacterium
RVIRSAKLLNIDTAIVG

SEQ ID NO: 1054796 - protein, 26 aa, Mycobacterium
RVISDVWLSNLLAWLTRRASATDVSK

SEQ ID NO: 1054797 - protein, 19 aa, Mycobacterium
RVISRRSKLMLRISGAGAM

SEQ ID NO: 1054798 - protein, 25 aa, Mycobacterium
RVKGPDFPTSGLIVGTQGISDAYKT

SEQ ID NO: 1054799 - protein, 20 aa, Mycobacterium
RVKLERGVELLIGLEAISEP

SEQ ID NO: 1054800 - protein, 19 aa, Mycobacterium
RVKQRFGVTVNDVVVALCA

SEQ ID NO: 1054801 - protein, 18 aa, Mycobacterium
RVLAALGPRMLRLAAQRS

SEQ ID NO: 1054802 - protein, 18 aa, Mycobacterium
RVLADWPQQQRHFVKVMP

SEQ ID NO: 1054803 - protein, 17 aa, Mycobacterium
RVLHLDDLVRFLVLALD

SEQ ID NO: 1054804 - protein, 18 aa, Mycobacterium
RVLLEGWEKFDEPVDRIV

SEQ ID NO: 1054805 - protein, 21 aa, Mycobacterium
RVLNACPHRSIWLHVEGHSLE

SEQ ID NO: 1054806 - protein, 37 aa, Mycobacterium; identical to SEQ ID NO: 728245

SEQ ID NO: 1054807 - protein, 18 aa, Mycobacterium
RVLPVIKELAARGIKVSI

SEQ ID NO: 1054808 - protein, 22 aa, Mycobacterium
RVLQIRALVLGGAMDWLQDNEA

SEQ ID NO: 1054809 - protein, 24 aa, Mycobacterium
RVLRRARDGVALNIDEAAVAMSAR

SEQ ID NO: 1054810 - protein, 25 aa, Mycobacterium
RVLSIWPDWVRRWPTASATATATAA

SEQ ID NO: 1054811 - protein, 26 aa, Mycobacterium
RVLSRDGVFSLAAFRKIVDINLVGSF

SEQ ID NO: 1054812 - protein, 24 aa, Mycobacterium
RVMKKAVAYLLPFIEAEKAQSGST

SEQ ID NO: 1054813 - protein, 18 aa, Mycobacterium
RVMLPGWYGTGSAFEQWL

SEQ ID NO: 1054814 - protein, 23 aa, Mycobacterium
RVNGVNRLACKVLMRDLLPKKAG

SEQ ID NO: 1054815 - protein, 20 aa, Mycobacterium
RVNIVATMCERGHADKMVLS

SEQ ID NO: 1054816 - protein, 25 aa, Mycobacterium
RVPAWSEFVEVHWSPWGEAYVTPVE

SEQ ID NO: 1054817 - protein, 26 aa, Mycobacterium
RVPGAEAFRSWRLLVTRYGTPAPGPA

SEQ ID NO: 1054818 - protein, 25 aa, Mycobacterium
RVPPQRRGIGFVFQHYAAFKHLTVR

SEQ ID NO: 1054819 - protein, 20 aa, Mycobacterium
RVPTEKGYREFVDRLDDVKP

SEQ ID NO: 1054820 - protein, 18 aa, Mycobacterium
RVPTERWVYPQTGTEAHD

SEQ ID NO: 1054821 - protein, 17 aa, Mycobacterium
RVQGWSQLIPEMDIAAA

SEQ ID NO: 1054822 - protein, 29 aa, Mycobacterium
RVQLKGANLEFALGYSHPVVIEAPEGITF

SEQ ID NO: 1054823 - protein, 18 aa, Mycobacterium
RVQNRIGRQVWLIDITTE

SEQ ID NO: 1054824 - protein, 17 aa, Mycobacterium
RVQPVLEKRREMAYEGK

SEQ ID NO: 1054825 - protein, 17 aa, Mycobacterium
RVRAGLQALGWAGTIWA

SEQ ID NO: 1054826 - protein, 19 aa, Mycobacterium
RVRCDGGALSTAALRTLGA

SEQ ID NO: 1054827 - protein, 18 aa, Mycobacterium
RVREFSRKAGRQVFKDYV

SEQ ID NO: 1054828 - protein, 22 aa, Mycobacterium
RVREVAALIPGAMRGLVSERQL

SEQ ID NO: 1054829 - protein, 18 aa, Mycobacterium
RVRFTSPHPAEFTDDVIE

SEQ ID NO: 1054830 - protein, 26 aa, Mycobacterium
RVRGMLRATWLVLRKHTDVLHVHLAH

SEQ ID NO: 1054831 - protein, 24 aa, Mycobacterium
RVRHVPVLDGQKLIGIVSIGDVVK

SEQ ID NO: 1054832 - protein, 18 aa, Mycobacterium
RVRLAMGVVTSIDPEILL

SEQ ID NO: 1054833 - protein, 17 aa, Mycobacterium
RVRNGSLVRVWHGVYAA

SEQ ID NO: 1054834 - protein, 21 aa, Mycobacterium
RVRRRIWELEKRRAHVPWVTW

SEQ ID NO: 1054835 - protein, 23 aa, Mycobacterium
RVRTRLIELFELFDPADPEVIAG

SEQ ID NO: 1054836 - protein, 19 aa, Mycobacterium
RVRVCKRDGELLGRPHALP

SEQ ID NO: 1054837 - protein, 20 aa, Mycobacterium
RVRVPTPRCFYCEITEDAMD

SEQ ID NO: 1054838 - protein, 28 aa, Mycobacterium
RVSAELRAAGFTVPPSQANFVWLPLEDR

SEQ ID NO: 1054839 - protein, 17 aa, Mycobacterium
RVSCVIAGCNRNRASLV

SEQ ID NO: 1054840 - protein, 24 aa, Mycobacterium
RVSDAIKLSVPFLTLEGNPPADNS

SEQ ID NO: 1054841 - protein, 17 aa, Mycobacterium
RVSFALDPMTFWRAWLG

SEQ ID NO: 1054842 - protein, 26 aa, Mycobacterium
RVSICGNTGCRKHLSMPASRPSTAAP

SEQ ID NO: 1054843 - protein, 23 aa, Mycobacterium
RVSKKLASMGFRVIPSDANFVLF

SEQ ID NO: 1054844 - protein, 18 aa, Mycobacterium
RVSNLRWSGDYVLVNVDA

SEQ ID NO: 1054845 - protein, 18 aa, Mycobacterium
RVSRAMFNELWPGFDHDD

SEQ ID NO: 1054846 - protein, 24 aa, Mycobacterium
RVSRWKPTPLGGAFDQLVTEIARR

SEQ ID NO: 1054847 - protein, 17 aa, Mycobacterium
RVSWLVMVDGGVTEVVA

SEQ ID NO: 1054848 - protein, 19 aa, Mycobacterium
RVTVLSARSQDVIGTVRVN

SEQ ID NO: 1054849 - protein, 23 aa, Mycobacterium
RVVAACRTLPVGDPCDPATLIGP

SEQ ID NO: 1054850 - protein, 22 aa, Mycobacterium
RVVAKRARRPMFASKLTGIPPD

SEQ ID NO: 1054851 - protein, 27 aa, Mycobacterium
RVVAVDLREDWPAALRAAGFDPNQPTA

SEQ ID NO: 1054852 - protein, 19 aa, Mycobacterium
RVVDTHWDPPVTASVRLIS

SEQ ID NO: 1054853 - protein, 28 aa, Mycobacterium
RVVEIGGPFSIELCGGTHVATSAQIGPV

SEQ ID NO: 1054854 - protein, 19 aa, Mycobacterium
RVVESPPPASPRWEPDADF

SEQ ID NO: 1054855 - protein, 21 aa, Mycobacterium
RVVEVPRLVSFHDLMIEKPPH

SEQ ID NO: 1054856 - protein, 18 aa, Mycobacterium
RVVGHKVGLSSPVMQQMM

SEQ ID NO: 1054857 - protein, 17 aa, Mycobacterium
RVVNPRWMAAMRRHGYK

SEQ ID NO: 1054858 - protein, 25 aa, Mycobacterium
RVWAWTLPDGGFGWSNAGLVAGDGA

SEQ ID NO: 1054859 - protein, 19 aa, Mycobacterium
RVWYAELSAAYGIEPDSSR

SEQ ID NO: 1054860 - protein, 20 aa, Mycobacterium
RVWYAELSAAYGIEPDSSRI

SEQ ID NO: 1054861 - protein, 21 aa, Mycobacterium
RWAIREVALHILLDGVDLRDG

SEQ ID NO: 1054862 - protein, 20 aa, Mycobacterium
RWAPELRDIRVLDDPHGPLD

SEQ ID NO: 1054863 - protein, 20 aa, Mycobacterium
RWATELWCTPPVLESSLRMP

SEQ ID NO: 1054864 - protein, 28 aa, Mycobacterium
RWDDPFRALEMLGSLWSSTGLQSVSAGA

SEQ ID NO: 1054865 - protein, 18 aa, Mycobacterium
RWEPSVIGPVCDQLIDEI

SEQ ID NO: 1054866 - protein, 20 aa, Mycobacterium
RWFLDRTCTHILAWEGDADS

SEQ ID NO: 1054867 - protein, 19 aa, Mycobacterium
RWFLMASPILRGGNLIVTE

SEQ ID NO: 1054868 - protein, 18 aa, Mycobacterium
RWGDELTGFRCDSQSVVA

SEQ ID NO: 1054869 - protein, 26 aa, Mycobacterium
RWIEAMPRYGPGHGVLVAQVRAGLPP

SEQ ID NO: 1054870 - protein, 26 aa, Mycobacterium
RWIGTAANWMSCWTMGLNQSTHGTWN

SEQ ID NO: 1054871 - protein, 23 aa, Mycobacterium
RWIREEHYRRMYLAINRTSHVQA

SEQ ID NO: 1054872 - protein, 21 aa, Mycobacterium
RWKRRRRRHRWGRRCHPSQWQ

SEQ ID NO: 1054873 - protein, 22 aa, Mycobacterium
RWLAALRGGARLVIGTRSAVFA

SEQ ID NO: 1054874 - protein, 20 aa, Mycobacterium
RWLAPVVRTVAPGLFWQRKY

SEQ ID NO: 1054875 - protein, 17 aa, Mycobacterium
RWLIPRLDLPATQLEQI

SEQ ID NO: 1054876 - protein, 23 aa, Mycobacterium
RWMAAMRRHGYKGAFEMAATIDY

SEQ ID NO: 1054877 - protein, 19 aa, Mycobacterium
RWNSIAEIIGRSWDDVLSA

SEQ ID NO: 1054878 - protein, 20 aa, Mycobacterium
RWNSIAEIIGRSWDDVLSAI

SEQ ID NO: 1054879 - protein, 20 aa, Mycobacterium
RWPQAGALGPLIRDPDGSVY

SEQ ID NO: 1054880 - protein, 20 aa, Mycobacterium
RWRLGGSDVAALWRRAVALV

SEQ ID NO: 1054881 - protein, 18 aa, Mycobacterium
RWRRTSGIHKVRDRRGLA

SEQ ID NO: 1054882 - protein, 17 aa, Mycobacterium
RWRVATAEASYSVVEIP

SEQ ID NO: 1054883 - protein, 26 aa, Mycobacterium
RWSPESGSLLDEWSHKVVWAAQSLPD

SEQ ID NO: 1054884 - protein, 20 aa, Mycobacterium
RWTELKSRVRDYLGTKIEFR

SEQ ID NO: 1054885 - protein, 19 aa, Mycobacterium
RWTMRWKPALNAFAITFAD

SEQ ID NO: 1054886 - protein, 21 aa, Mycobacterium
RWVLTKGKLPTSLWIEIVSTA

SEQ ID NO: 1054887 - protein, 19 aa, Mycobacterium
RWVQELKVSCEKGFPPSTL

SEQ ID NO: 1054888 - protein, 20 aa, Mycobacterium
RWVQNALSFIGFVPPDENDL

SEQ ID NO: 1054889 - protein, 17 aa, Mycobacterium
RWVRQSNIRWGFDQEHR

SEQ ID NO: 1054890 - protein, 19 aa, Mycobacterium
RWVTPRLVSKSGWRSGWRR

SEQ ID NO: 1054891 - protein, 34 aa, Mycobacterium
RWWPPCARSLTSLRPPVVRRWEWEELAGDDRPHG

SEQ ID NO: 1054892 - protein, 19 aa, Mycobacterium
RYAGGKAKIRDVVIARAAA

SEQ ID NO: 1054893 - protein, 19 aa, Mycobacterium
RYAGWAMRSYLRFAQLASD

SEQ ID NO: 1054894 - protein, 18 aa, Mycobacterium
RYAPELSDEQILALHSVL

SEQ ID NO: 1054895 - protein, 24 aa, Mycobacterium
RYARAVQIRARRGVIVCAGGFIAN

SEQ ID NO: 1054896 - protein, 17 aa, Mycobacterium
RYCRRIPWSDNESPASR

SEQ ID NO: 1054897 - protein, 18 aa, Mycobacterium
RYDAEWIVVLDDWTDGVG

SEQ ID NO: 1054898 - protein, 21 aa, Mycobacterium
RYDGRRAVVTGCASGIGERAV

SEQ ID NO: 1054899 - protein, 20 aa, Mycobacterium
RYDKLSRFPAGIVALGDAVA

SEQ ID NO: 1054900 - protein, 18 aa, Mycobacterium
RYDQVWKEHVLPLNGAYE

SEQ ID NO: 1054901 - protein, 18 aa, Mycobacterium
RYDVPIAGAHVVVIGRGV

SEQ ID NO: 1054902 - protein, 17 aa, Mycobacterium
RYDWSVVASQIMRVYET

SEQ ID NO: 1054903 - protein, 19 aa, Mycobacterium
RYESARGIKLLRREPLGTY

SEQ ID NO: 1054904 - protein, 19 aa, Mycobacterium
RYEVHFACDPRFNKLLGPI

SEQ ID NO: 1054905 - protein, 17 aa, Mycobacterium
RYEVHFACDPRYNNLLG

SEQ ID NO: 1054906 - protein, 19 aa, Mycobacterium
RYEVRLEQYALTIAVEARL

SEQ ID NO: 1054907 - protein, 21 aa, Mycobacterium
RYFDCPGHRALSLLHTGAAAG

SEQ ID NO: 1054908 - protein, 17 aa, Mycobacterium
RYFTVMVPVNRGWVRPW

SEQ ID NO: 1054909 - protein, 20 aa, Mycobacterium
RYGCPALQTTEVWEPTIPAN

SEQ ID NO: 1054910 - protein, 20 aa, Mycobacterium
RYGSSVVGFQDGWRGLLENR

SEQ ID NO: 1054911 - protein, 21 aa, Mycobacterium
RYIDRFLMYYVRTADRLQRTA

SEQ ID NO: 1054912 - protein, 19 aa, Mycobacterium
RYILPSFIEHSSFGVKESN

SEQ ID NO: 1054913 - protein, 18 aa, Mycobacterium
RYKLVWKNRLGFARLAIQ

SEQ ID NO: 1054914 - protein, 20 aa, Mycobacterium
RYLDCLSAYSAVNFGHCNPE

SEQ ID NO: 1054915 - protein, 19 aa, Mycobacterium
RYLEIWNLVFMQNERGEGT

SEQ ID NO: 1054916 - protein, 24 aa, Mycobacterium
RYLIVDECHYYRGVFGSNVAMVLR

SEQ ID NO: 1054917 - protein, 23 aa, Mycobacterium
RYLKIAAAMRREGMGFTAGFATA

SEQ ID NO: 1054918 - protein, 22 aa, Mycobacterium
RYLPRSVLLPAIRIGNKLRGGP

SEQ ID NO: 1054919 - protein, 17 aa, Mycobacterium
RYLTLISGVTTVLLTGV

SEQ ID NO: 1054920 - protein, 24 aa, Mycobacterium
RYMLDRRRTLGGFLPERPTKAKTL

SEQ ID NO: 1054921 - protein, 17 aa, Mycobacterium
RYNKLVAELLARNHAQG

SEQ ID NO: 1054922 - protein, 25 aa, Mycobacterium
RYPASEVRQALTLPAHIPVIHVDAR

SEQ ID NO: 1054923 - protein, 18 aa, Mycobacterium
RYPIGLPPDVEDWRTAGP

SEQ ID NO: 1054924 - protein, 17 aa, Mycobacterium
RYPNMLRLHYEKKRNLP

SEQ ID NO: 1054925 - protein, 23 aa, Mycobacterium
RYQVHSLHGYFLRSGDAQEPTVF

SEQ ID NO: 1054926 - protein, 22 aa, Mycobacterium
RYRDRIPILIGGGGEKKTFRIA

SEQ ID NO: 1054927 - protein, 22 aa, Mycobacterium
RYRRAIRARGHFPTEQSALKCL

SEQ ID NO: 1054928 - protein, 21 aa, Mycobacterium
RYRSEPGTGRGCESGPAGRAG

SEQ ID NO: 1054929 - protein, 19 aa, Mycobacterium
RYRSVRIGEHTTRILLAKN

SEQ ID NO: 1054930 - protein, 25 aa, Mycobacterium
RYSDLLEHLASWGIVAGAPDTQRGV

SEQ ID NO: 1054931 - protein, 23 aa, Mycobacterium
RYWGPPAKPGLILFRRAGAPATL

SEQ ID NO: 1054932 - protein, 18 aa, Mycobacterium
RYWPEFRQAGKEAITVAM

SEQ ID NO: 1054933 - protein, 24 aa, Mycobacterium
RYWRGEQRLTAIGDQCDIKSVQSG

SEQ ID NO: 1054934 - protein, 17 aa, Mycobacterium
RYYRCSWHLISTLPVIG

SEQ ID NO: 1054935 - protein, 18 aa, Mycobacterium
RYYYLLDLDENWPGHALR

SEQ ID NO: 1054936 - protein, 19 aa, Mycobacterium
SAAGQRLVQRLVLEGDGVV

SEQ ID NO: 1054937 - protein, 17 aa, Mycobacterium
SAAGRLVAIGELFVLRC

SEQ ID NO: 1054938 - protein, 18 aa, Mycobacterium
SAAIASLFSECAQAYRVL

SEQ ID NO: 1054939 - protein, 20 aa, Mycobacterium
SAAIPGIFPPVSINGRELID

SEQ ID NO: 1054940 - protein, 19 aa, Mycobacterium
SAAKRAVVIGAGFIGCEVA

SEQ ID NO: 1054941 - protein, 26 aa, Mycobacterium
SAALLRLPVSNWPALGGMGNASWVQL

SEQ ID NO: 1054942 - protein, 26 aa, Mycobacterium
SAALRPRYLMMLAEILRFHRAASRLL

SEQ ID NO: 1054943 - protein, 19 aa, Mycobacterium
SAALRRVELARPRSVVGKN

SEQ ID NO: 1054944 - protein, 17 aa, Mycobacterium
SAAMLFGNGGAGGNGGS

SEQ ID NO: 1054945 - protein, 27 aa, Mycobacterium
SAASAWNRLASELSFTADGYERVIKAL

SEQ ID NO: 1054946 - protein, 27 aa, Mycobacterium
SAASGPRIRLAYQLTPRSVRGEQRASG

SEQ ID NO: 1054947 - protein, 21 aa, Mycobacterium
SAASRLARRGGYLDVRPEAER

SEQ ID NO: 1054948 - protein, 19 aa, Mycobacterium
SAASSLRKAKKLRVRLPLP

SEQ ID NO: 1054949 - protein, 18 aa, Mycobacterium
SAATPRDVPPPAALDAPL

SEQ ID NO: 1054950 - protein, 26 aa, Mycobacterium
SAATTRWVWVRDVDVFDCSHIRQVMR

SEQ ID NO: 1054951 - protein, 24 aa, Mycobacterium
SAAVASLFSSYGHAYQSLSAQAAQ

SEQ ID NO: 1054952 - protein, 21 aa, Mycobacterium
SAAVGRISYLLGLRGPAVAVD

SEQ ID NO: 1054953 - protein, 21 aa, Mycobacterium
SAAVSEVRWNAVVLADDTVLA

SEQ ID NO: 1054954 - protein, 25 aa, Mycobacterium
SAAVSSFFGAYARDYQAFSVQVEAL

SEQ ID NO: 1054955 - protein, 20 aa, Mycobacterium
SACATRGGLLPSGPRRRYAA

SEQ ID NO: 1054956 - protein, 19 aa, Mycobacterium
SADAFCWSMVRSLVGALLA

SEQ ID NO: 1054957 - protein, 18 aa, Mycobacterium
SADFRAVVRPNFDTLYSS

SEQ ID NO: 1054958 - protein, 19 aa, Mycobacterium
SADRADWQPPWYAPESAAL

SEQ ID NO: 1054959 - protein, 24 aa, Mycobacterium
SADRARTGVFILDARQWFQSFPAA

SEQ ID NO: 1054960 - protein, 38 aa, Mycobacterium
SADRWTMFHSIAFDFSVWELWGPLLYGGCVVMVPYLET

SEQ ID NO: 1054961 - protein, 26 aa, Mycobacterium
SADSRGRFPGRYRLAVLENLSRVSSR

SEQ ID NO: 1054962 - protein, 27 aa, Mycobacterium
SAEAASAAALGQVWDATAGPTAVLSDA

SEQ ID NO: 1054963 - protein, 22 aa, Mycobacterium
SAEALGEGWFWPAAAAHPSLPR

SEQ ID NO: 1054964 - protein, 19 aa, Mycobacterium
SAEAMTWPLLEVIDGSLEE

SEQ ID NO: 1054965 - protein, 29 aa, Mycobacterium
SAEATQFQTRFVSALSNAGSAYAAAEAAA

SEQ ID NO: 1054966 - protein, 21 aa, Mycobacterium
SAEGLPVRYRRDLLCVRTHDG

SEQ ID NO: 1054967 - protein, 27 aa, Mycobacterium
SAEGRVGALRRCVPMVGQIKDPTLRDE

SEQ ID NO: 1054968 - protein, 22 aa, Mycobacterium
SAELDAAGLRRIQWWTDEAGDF

SEQ ID NO: 1054969 - protein, 24 aa, Mycobacterium
SAELFAAEVMPHFQGQAQPTLDAA

SEQ ID NO: 1054970 - protein, 18 aa, Mycobacterium
SAELRWVAEAEVVDFPLH

SEQ ID NO: 1054971 - protein, 18 aa, Mycobacterium
SAEQVRWVLQNSEAVLAF

SEQ ID NO: 1054972 - protein, 20 aa, Mycobacterium
SAEVSGLMDIFSTLFDRGIQ

SEQ ID NO: 1054973 - protein, 19 aa, Mycobacterium
SAGATRLGLSGTRAVLEGL

SEQ ID NO: 1054974 - protein, 18 aa, Mycobacterium
SAGAVAIGPVLQGLRKPV

SEQ ID NO: 1054975 - protein, 19 aa, Mycobacterium
SAGCVWINDHIPIVSEMPH

SEQ ID NO: 1054976 - protein, 17 aa, Mycobacterium
SAGEISVMFHPRRGGAD

SEQ ID NO: 1054977 - protein, 19 aa, Mycobacterium
SAGFGPLRCRGVVCQTCPC

SEQ ID NO: 1054978 - protein, 20 aa, Mycobacterium
SAGGPVLWPDLEAILVVPNN

SEQ ID NO: 1054979 - protein, 25 aa, Mycobacterium
SAGGRAVRGFPGFVDQGSHVDLRVF

SEQ ID NO: 1054980 - protein, 18 aa, Mycobacterium
SAGIAALFGAQGQAYQEL

SEQ ID NO: 1054981 - protein, 30 aa, Mycobacterium
SAGIDDAWIFARTAIRTRRWADPEQATSDL

SEQ ID NO: 1054982 - protein, 22 aa, Mycobacterium
SAGILPITWAYIALMGPDGLAT

SEQ ID NO: 1054983 - protein, 17 aa, Mycobacterium
SAGKSGLLFGAGGAGGQ

SEQ ID NO: 1054984 - protein, 23 aa, Mycobacterium
SAGLLPAITFVFSRAGCDAAVQQ

SEQ ID NO: 1054985 - protein, 24 aa, Mycobacterium
SAGLMLAWRCDLIVAADDTVFADV

SEQ ID NO: 1054986 - protein, 17 aa, Mycobacterium
SAGLWREVASELADSLR

SEQ ID NO: 1054987 - protein, 19 aa, Mycobacterium
SAGPGEALFTYLRSLVLHW

SEQ ID NO: 1054988 - protein, 18 aa, Mycobacterium
SAGRAVIVTGDFNALYSE

SEQ ID NO: 1054989 - protein, 23 aa, Mycobacterium
SAGRYRPFYLRNLLDVVQGRKLS

SEQ ID NO: 1054990 - protein, 18 aa, Mycobacterium
SAGSGLRIGRFSLDILGA

SEQ ID NO: 1054991 - protein, 19 aa, Mycobacterium
SAGVPLRLISVLKTAHSAP

SEQ ID NO: 1054992 - protein, 19 aa, Mycobacterium
SAHLRLVMPISRHTVASAI

SEQ ID NO: 1054993 - protein, 19 aa, Mycobacterium
SAHSGSWPYGLPELPGARE

SEQ ID NO: 1054994 - protein, 24 aa, Mycobacterium
SAHVPRHMFILFGMGKHKCIGDSF

SEQ ID NO: 1054995 - protein, 18 aa, Mycobacterium
SAIDADFVVVDGTLYATL

SEQ ID NO: 1054996 - protein, 17 aa, Mycobacterium
SAIGACIARRIAAVLSE

SEQ ID NO: 1054997 - protein, 19 aa, Mycobacterium
SAKAFPFPVFFQEFEVTLN

SEQ ID NO: 1054998 - protein, 23 aa, Mycobacterium
SAKARSANILARIMGASITSDGF

SEQ ID NO: 1054999 - protein, 23 aa, Mycobacterium
SAKAWPRYVRIAADLPSTATHKV

SEQ ID NO: 1055000 - protein, 20 aa, Mycobacterium
SAKDYRRWFATLPSELTDAV

SEQ ID NO: 1055001 - protein, 23 aa, Mycobacterium
SAKGRDAVQVFGVVAVCLAELAA

SEQ ID NO: 1055002 - protein, 28 aa, Mycobacterium
SAKGTFRLAFGIGDFRRDTGFGKDATTL

SEQ ID NO: 1055003 - protein, 29 aa, Mycobacterium
SAKRPKRRFRLGGFASWHAVGEGDREGVQ

SEQ ID NO: 1055004 - protein, 34 aa, Mycobacterium
SAKTYFGAIIGRYGNRIAGGVFALDGHEYHLPVN

SEQ ID NO: 1055005 - protein, 17 aa, Mycobacterium
SAKYWLAVLTELKNRGV

SEQ ID NO: 1055006 - protein, 24 aa, Mycobacterium
SALGKLSVPPSWPGSGLDVPPSVS

SEQ ID NO: 1055007 - protein, 18 aa, Mycobacterium
SALHLAVRAARTLDTSLT

SEQ ID NO: 1055008 - protein, 29 aa, Mycobacterium
SALIKSIGLRLGLPWYAYDTVTFSGEVTA

SEQ ID NO: 1055009 - protein, 19 aa, Mycobacterium
SALLNYYPHLLALSASSPW

SEQ ID NO: 1055010 - protein, 18 aa, Mycobacterium
SALLPETRTRAVLMIAIE

SEQ ID NO: 1055011 - protein, 19 aa, Mycobacterium
SALLPEWRMELPLRHLEDL

SEQ ID NO: 1055012 - protein, 19 aa, Mycobacterium
SALLSCAIPTGYGSAANRA

SEQ ID NO: 1055013 - protein, 18 aa, Mycobacterium
SALLSLNVPYFFMASDGV

SEQ ID NO: 1055014 - protein, 18 aa, Mycobacterium
SALLSRRDVVVVASVSCI

SEQ ID NO: 1055015 - protein, 24 aa, Mycobacterium
SALPERLVPLANIWEEILGTPVTN

SEQ ID NO: 1055016 - protein, 24 aa, Mycobacterium
SALPHGVEVIGYWGEAVTTAAQAR

SEQ ID NO: 1055017 - protein, 18 aa, Mycobacterium
SALPRTETFKVLKRQLAA

SEQ ID NO: 1055018 - protein, 21 aa, Mycobacterium
SALQNAASIAGLFLTTEAVVA

SEQ ID NO: 1055019 - protein, 17 aa, Mycobacterium
SALRKALELCRASDYPF

SEQ ID NO: 1055020 - protein, 21 aa, Mycobacterium
SALRLPRAIPDRRGQRHAPMS

SEQ ID NO: 1055021 - protein, 26 aa, Mycobacterium
SALTSGVGIVEGWRGAVLHRVEVDGA

SEQ ID NO: 1055022 - protein, 17 aa, Mycobacterium
SALVRAIQVCAALDQIL

SEQ ID NO: 1055023 - protein, 17 aa, Mycobacterium
SAMEAVWITAQHLGLAV

SEQ ID NO: 1055024 - protein, 25 aa, Mycobacterium
SAMMLEAITPYVTWMRSTAVQAERA

SEQ ID NO: 1055025 - protein, 18 aa, Mycobacterium
SAMYRGDAAYDWIRSELE

SEQ ID NO: 1055026 - protein, 19 aa, Mycobacterium
SANGITFHQGRLFVGECRD

SEQ ID NO: 1055027 - protein, 27 aa, Mycobacterium
SANIRRLRRPDPYKGKGVRYEGEQIRR

SEQ ID NO: 1055028 - protein, 18 aa, Mycobacterium
SANPFVLYPSYREIAHLP

SEQ ID NO: 1055029 - protein, 28 aa, Mycobacterium
SANVGLWVRTDEQWRWLANTLTVELLKE

SEQ ID NO: 1055030 - protein, 24 aa, Mycobacterium
SANVRSNALLPAFVDTPMQQSAMA

SEQ ID NO: 1055031 - protein, 19 aa, Mycobacterium
SAPAIKLLIRKAGAASADM

SEQ ID NO: 1055032 - protein, 23 aa, Mycobacterium
SAPLDRGSPLLAELAAQCEGPVG

SEQ ID NO: 1055033 - protein, 24 aa, Mycobacterium
SAPLPRFGTEAALNLLHRTRRIAA

SEQ ID NO: 1055034 - protein, 19 aa, Mycobacterium
SAPMGRGMTVGALSVPHSW

SEQ ID NO: 1055035 - protein, 17 aa, Mycobacterium
SAPMLEAAVAWDGLSAE

SEQ ID NO: 1055036 - protein, 33 aa, Mycobacterium
SAPMPPDCRTMAAASSRVSPTWVAQPLASATPA

SEQ ID NO: 1055037 - protein, 26 aa, Mycobacterium
SAPWPGRLRPGMVPATFDDMITKGVA

SEQ ID NO: 1055038 - protein, 23 aa, Mycobacterium
SAQAAVIHEMFVNTLATSSGSYA

SEQ ID NO: 1055039 - protein, 18 aa, Mycobacterium
SAQAGAYHLMRTHGGRGV

SEQ ID NO: 1055040 - protein, 24 aa, Mycobacterium
SAQAITFHEQFVRALSSAGGAYAA

SEQ ID NO: 1055041 - protein, 19 aa, Mycobacterium
SAQIAALGPDDGWQGLAAQ

SEQ ID NO: 1055042 - protein, 17 aa, Mycobacterium
SAQLGWNIVPYTVIRDG

SEQ ID NO: 1055043 - protein, 25 aa, Mycobacterium
SAQRRFAFGSLPLDQIKAAKFAVPG

SEQ ID NO: 1055044 - protein, 23 aa, Mycobacterium
SAQVAAFHQRFVEALNAGAQSYV

SEQ ID NO: 1055045 - protein, 20 aa, Mycobacterium
SARCLAAYVYAAAGEGESTT

SEQ ID NO: 1055046 - protein, 23 aa, Mycobacterium
SARDACYCYGSFVLDDEALVITH

SEQ ID NO: 1055047 - protein, 17 aa, Mycobacterium
SARFVRYHMIPAVGEKF

SEQ ID NO: 1055048 - protein, 18 aa, Mycobacterium
SARRSGMIEQIWRAFFSS

SEQ ID NO: 1055049 - protein, 23 aa, Mycobacterium
SARSGAAGCTRRASATRDQTGAG

SEQ ID NO: 1055050 - protein, 17 aa, Mycobacterium
SASGIRKNTRYVLRVAN

SEQ ID NO: 1055051 - protein, 24 aa, Mycobacterium
SASKVFWRKQLQGLETAHFTGERS

SEQ ID NO: 1055052 - protein, 24 aa, Mycobacterium
SASLMPICLGDDITDEDAFDAVRH

SEQ ID NO: 1055053 - protein, 23 aa, Mycobacterium
SASPEPVIKVWAGEVGIDDQHVV

SEQ ID NO: 1055054 - protein, 18 aa, Mycobacterium
SASPIPVKSPAAAANASG

SEQ ID NO: 1055055 - protein, 23 aa, Mycobacterium
SASPRSSIIISFNAPVGPTLNYE

SEQ ID NO: 1055056 - protein, 19 aa, Mycobacterium
SASRLGACTPRDAAAQPGG

SEQ ID NO: 1055057 - protein, 25 aa, Mycobacterium
SASTPLFFAQAIGRFVRSRRPGETA

SEQ ID NO: 1055058 - protein, 32 aa, Mycobacterium; identical to SEQ ID NO: 729703

SEQ ID NO: 1055059 - protein, 23 aa, Mycobacterium
SATGSRLAFEFVPDTAVFNDERW

SEQ ID NO: 1055060 - protein, 35 aa, Mycobacterium
SATLRPETQIAISAWGLLSPEGRCATFDAAADGFV

SEQ ID NO: 1055061 - protein, 30 aa, Mycobacterium; identical to SEQ ID NO: 729717

SEQ ID NO: 1055062 - protein, 17 aa, Mycobacterium
SATSRLALSDVPAELAA

SEQ ID NO: 1055063 - protein, 24 aa, Mycobacterium
SATVVQLFICFRQGATPVSVGPDR

SEQ ID NO: 1055064 - protein, 30 aa, Mycobacterium
SATYDYDQNFSRLGALEGAGGNGGHGGLLF

SEQ ID NO: 1055065 - protein, 32 aa, Mycobacterium; identical to SEQ ID NO: 729740

SEQ ID NO: 1055066 - protein, 19 aa, Mycobacterium
SAVAERGQALIVLTGGGNG

SEQ ID NO: 1055067 - protein, 21 aa, Mycobacterium
SAVAVGAAWFNARVAAAKHGV

SEQ ID NO: 1055068 - protein, 17 aa, Mycobacterium
SAVGISWTSELLTVTGV

SEQ ID NO: 1055069 - protein, 26 aa, Mycobacterium
SAVGMGRFALNRAVDYVKTRQVWSTP

SEQ ID NO: 1055070 - protein, 17 aa, Mycobacterium
SAVKGRLLIGSMAAGAA

SEQ ID NO: 1055071 - protein, 26 aa, Mycobacterium
SAVLLRECIDFFAPYLAAAKLTGEVR

SEQ ID NO: 1055072 - protein, 17 aa, Mycobacterium
SAVMRFLVRNGRIAAID

SEQ ID NO: 1055073 - protein, 21 aa, Mycobacterium
SAVPPDIALFLDLKQTPAQPV

SEQ ID NO: 1055074 - protein, 24 aa, Mycobacterium
SAVQLCSAASWFDVLKAERRNLRI

SEQ ID NO: 1055075 - protein, 17 aa, Mycobacterium
SAVRLVRQIPYTVACDL

SEQ ID NO: 1055076 - protein, 18 aa, Mycobacterium
SAVTSGLAGQAWQGAASA

SEQ ID NO: 1055077 - protein, 19 aa, Mycobacterium
SAWDHNWAATSVVIGADIA

SEQ ID NO: 1055078 - protein, 20 aa, Mycobacterium
SAYRCGEAWSTHIHHRPSGR

SEQ ID NO: 1055079 - protein, 18 aa, Mycobacterium
SAYSEMWFTEAHWPAFRR

SEQ ID NO: 1055080 - protein, 25 aa, Mycobacterium
SAYVPKHWQRLCEIIGQPDLLDDER

SEQ ID NO: 1055081 - protein, 19 aa, Mycobacterium
SCAEGGVLGIICASIASVM

SEQ ID NO: 1055082 - protein, 18 aa, Mycobacterium
SCIAPRGAIYAARVALPH

SEQ ID NO: 1055083 - protein, 20 aa, Mycobacterium
SCITAAGWAGLLVTVVPFTV

SEQ ID NO: 1055084 - protein, 24 aa, Mycobacterium
SCITGAGCTGVFVTLVPFAVDGGI

SEQ ID NO: 1055085 - protein, 17 aa, Mycobacterium
SCLGDHFAMLEASLALA

SEQ ID NO: 1055086 - protein, 23 aa, Mycobacterium
SCNWSCDWLESGSVLTAVLLVAN

SEQ ID NO: 1055087 - protein, 19 aa, Mycobacterium
SCPHCSGRGILLHADPVDS

SEQ ID NO: 1055088 - protein, 29 aa, Mycobacterium
SCPPENKLSCPIYTFIGSKDWIATREDME

SEQ ID NO: 1055089 - protein, 20 aa, Mycobacterium
SCRAENRAALIGYLPTGYPD

SEQ ID NO: 1055090 - protein, 26 aa, Mycobacterium
SCREGHCGACAATLRSGKVNMEVNDV

SEQ ID NO: 1055091 - protein, 17 aa, Mycobacterium
SCRGGCMAAKFFTGLPL

SEQ ID NO: 1055092 - protein, 24 aa, Mycobacterium
SCSGAWARPMPAWYSTRSPTDTAS

SEQ ID NO: 1055093 - protein, 18 aa, Mycobacterium
SCVGSDWCRYGQQDSVQL

SEQ ID NO: 1055094 - protein, 19 aa, Mycobacterium
SCVPLLKQLLEAEGVEQSK

SEQ ID NO: 1055095 - protein, 20 aa, Mycobacterium
SDAALKWAVQEATMRNVALT

SEQ ID NO: 1055096 - protein, 20 aa, Mycobacterium
SDALELTWRSLGEIGNLSSA

SEQ ID NO: 1055097 - protein, 21 aa, Mycobacterium
SDALRWSQRVIALADGDPTMG

SEQ ID NO: 1055098 - protein, 19 aa, Mycobacterium
SDAMALRQALADGIIDCVA

SEQ ID NO: 1055099 - protein, 20 aa, Mycobacterium
SDAMLRVFFEAYAIVADVLR

SEQ ID NO: 1055100 - protein, 23 aa, Mycobacterium
SDASEVSMLFVLYQMASGGGPGF

SEQ ID NO: 1055101 - protein, 18 aa, Mycobacterium
SDASRYPAEFSGGQKQRI

SEQ ID NO: 1055102 - protein, 28 aa, Mycobacterium
SDAYEQLAALGFEYGQAFRGCTALWRRD

SEQ ID NO: 1055103 - protein, 17 aa, Mycobacterium
SDAYEWGLINQVVKQGA

SEQ ID NO: 1055104 - protein, 28 aa, Mycobacterium
SDELLARMLFESCLLHAGQACILHSRLL

SEQ ID NO: 1055105 - protein, 23 aa, Mycobacterium
SDERMAPIPALLAVAGVHHHLVR

SEQ ID NO: 1055106 - protein, 28 aa, Mycobacterium
SDEVICAFGRIGSMFACNDFGYVPDIIT

SEQ ID NO: 1055107 - protein, 27 aa, Mycobacterium
SDEVPVVVVLWSPRSDVCVELVDTLSG

SEQ ID NO: 1055108 - protein, 18 aa, Mycobacterium
SDFEPARGFLLTEGVIAH

SEQ ID NO: 1055109 - protein, 19 aa, Mycobacterium
SDFLIEFIQRTAIPDMSTS

SEQ ID NO: 1055110 - protein, 19 aa, Mycobacterium
SDFLLKEYWNRPDATRDAF

SEQ ID NO: 1055111 - protein, 23 aa, Mycobacterium
SDFPTDRGWDLADLFDPDPDTPH

SEQ ID NO: 1055112 - protein, 18 aa, Mycobacterium
SDGALLAGLAARMLGIRD

SEQ ID NO: 1055113 - protein, 28 aa, Mycobacterium
SDGDARWPTFGIRLSARPGIPPTHPVRG

SEQ ID NO: 1055114 - protein, 22 aa, Mycobacterium
SDGKPTRIGYRVDEETGKRVRI

SEQ ID NO: 1055115 - protein, 18 aa, Mycobacterium
SDGLNFAAHNAYADDGAV

SEQ ID NO: 1055116 - protein, 21 aa, Mycobacterium
SDGRGPVLVHALEGFSDAGHA

SEQ ID NO: 1055117 - protein, 26 aa, Mycobacterium
SDIERLRNLWDVPALALVGIGNGAQV

SEQ ID NO: 1055118 - protein, 18 aa, Mycobacterium
SDIRLDFKPVVQTRYEPK

SEQ ID NO: 1055119 - protein, 23 aa, Mycobacterium
SDKNRFIGIPAAFPKLFRSEVDW

SEQ ID NO: 1055120 - protein, 21 aa, Mycobacterium
SDLAAAARCEFAFLRHFDSKL

SEQ ID NO: 1055121 - protein, 17 aa, Mycobacterium
SDLDIMIIALRAPADGP

SEQ ID NO: 1055122 - protein, 18 aa, Mycobacterium
SDLGDLLITHWVTTFALD

SEQ ID NO: 1055123 - protein, 18 aa, Mycobacterium
SDLIPWIEAHGDSHPDLI

SEQ ID NO: 1055124 - protein, 17 aa, Mycobacterium
SDLLEAIELGFLLELAE

SEQ ID NO: 1055125 - protein, 31 aa, Mycobacterium; identical to SEQ ID NO: 730148

SEQ ID NO: 1055126 - protein, 17 aa, Mycobacterium
SDLPAFRGARGHLPGDD

SEQ ID NO: 1055127 - protein, 19 aa, Mycobacterium
SDLPGFVLHVEICEDMFVP

SEQ ID NO: 1055128 - protein, 25 aa, Mycobacterium
SDLPLCALLAGWVRGQVRPAATAKI

SEQ ID NO: 1055129 - protein, 28 aa, Mycobacterium
SDLPSSTQLPVWLSHAGADVLRTHPIVA

SEQ ID NO: 1055130 - protein, 21 aa, Mycobacterium
SDLPYSIVRATQFFEFVLGIA

SEQ ID NO: 1055131 - protein, 20 aa, Mycobacterium
SDLRFLKFLRESIFPGGEVP

SEQ ID NO: 1055132 - protein, 17 aa, Mycobacterium
SDLSGKRVCVARGTTSL

SEQ ID NO: 1055133 - protein, 26 aa, Mycobacterium
SDLTFASGWLEFRSAGYSGVTDDIDP

SEQ ID NO: 1055134 - protein, 20 aa, Mycobacterium
SDLTGIGSVLGEANAVAARA

SEQ ID NO: 1055135 - protein, 22 aa, Mycobacterium
SDMALERRCYVIRKRAEHELGT

SEQ ID NO: 1055136 - protein, 25 aa, Mycobacterium
SDMLASRVSTFVAWLDGNAENAGLI

SEQ ID NO: 1055137 - protein, 25 aa, Mycobacterium
SDMLASRVSTFVAWLNGNAENAGLI

SEQ ID NO: 1055138 - protein, 21 aa, Mycobacterium
SDPATSVANEWGELHDTPGVF

SEQ ID NO: 1055139 - protein, 18 aa, Mycobacterium
SDPFRGRFDQGWDVLREE

SEQ ID NO: 1055140 - protein, 26 aa, Mycobacterium
SDPRIRDRLAWCYSRTQIMRYRGYCS

SEQ ID NO: 1055141 - protein, 17 aa, Mycobacterium
SDPSFVLNLSPFDRGSV

SEQ ID NO: 1055142 - protein, 22 aa, Mycobacterium
SDPSGLVPIALDGKMLRGALRA

SEQ ID NO: 1055143 - protein, 20 aa, Mycobacterium
SDPWACSRFAEHEVVVPLVV

SEQ ID NO: 1055144 - protein, 17 aa, Mycobacterium
SDQPLAIVTCYLPTDLP

SEQ ID NO: 1055145 - protein, 19 aa, Mycobacterium
SDRARFSPFQKLIILDVPD

SEQ ID NO: 1055146 - protein, 18 aa, Mycobacterium
SDRMYVRMLISEEVRANG

SEQ ID NO: 1055147 - protein, 18 aa, Mycobacterium
SDSAGLLRDWLTVAKLCR

SEQ ID NO: 1055148 - protein, 18 aa, Mycobacterium
SDSEWDREKLGERLAKLA

SEQ ID NO: 1055149 - protein, 21 aa, Mycobacterium
SDSPTVEAFSRMFERDKNELR

SEQ ID NO: 1055150 - protein, 19 aa, Mycobacterium
SDTAEFGGYLSGPRVIDAG

SEQ ID NO: 1055151 - protein, 25 aa, Mycobacterium
SDTKQRCGVTALAAQAAGVVGETAD

SEQ ID NO: 1055152 - protein, 20 aa, Mycobacterium
SDVAALWRRAVALVGGPQVG

SEQ ID NO: 1055153 - protein, 23 aa, Mycobacterium
SDVDFRPGDVLMFGPEPTGLHAA

SEQ ID NO: 1055154 - protein, 17 aa, Mycobacterium
SDVPWNSPDCEWKDRRS

SEQ ID NO: 1055155 - protein, 19 aa, Mycobacterium
SDWLHGMWKGEKFVERLTY

SEQ ID NO: 1055156 - protein, 22 aa, Mycobacterium
SDWPIGLVGVRTFASHDMVEIV

SEQ ID NO: 1055157 - protein, 26 aa, Mycobacterium
SDYAQRRFGVGIAVRAGVHRGLVYSD

SEQ ID NO: 1055158 - protein, 23 aa, Mycobacterium
SDYMRMWVQAAITMTGYQAVSQH

SEQ ID NO: 1055159 - protein, 17 aa, Mycobacterium
SDYPAAGVIVTEPVVHY

SEQ ID NO: 1055160 - protein, 21 aa, Mycobacterium
SDYRTRWEIPIGLRESDMEVA

SEQ ID NO: 1055161 - protein, 22 aa, Mycobacterium
SEAEPWLRRAGARAQARGWEFA

SEQ ID NO: 1055162 - protein, 18 aa, Mycobacterium
SEAFPGLARTAGLIRMLL

SEQ ID NO: 1055163 - protein, 24 aa, Mycobacterium
SEAGDLALRLAMAATGRRDVVAVG

SEQ ID NO: 1055164 - protein, 18 aa, Mycobacterium
SEAHASIQDGIRLSGASS

SEQ ID NO: 1055165 - protein, 32 aa, Mycobacterium
SEAISGMNAVAGWRGASRPVLARELLPERALM

SEQ ID NO: 1055166 - protein, 18 aa, Mycobacterium
SEAKWFWFEGNFGAYEEN

SEQ ID NO: 1055167 - protein, 19 aa, Mycobacterium
SEALPQVLAIELPQPECFE

SEQ ID NO: 1055168 - protein, 22 aa, Mycobacterium
SEALVADALRALAYTATGGHTL

SEQ ID NO: 1055169 - protein, 27 aa, Mycobacterium
SEAMANSIWPYVAWLRATAAATEQSAS

SEQ ID NO: 1055170 - protein, 26 aa, Mycobacterium
SEASRICASLGLPERVLTQQLRTLSG

SEQ ID NO: 1055171 - protein, 31 aa, Mycobacterium; identical to SEQ ID NO: 730412

SEQ ID NO: 1055172 - protein, 19 aa, Mycobacterium
SEDRTVLAPSEIGELEIRG

SEQ ID NO: 1055173 - protein, 24 aa, Mycobacterium
SEDVLRPLPVTTFDVRRAPAALRY

SEQ ID NO: 1055174 - protein, 28 aa, Mycobacterium
SEEFFDLVWRLMRFDKHGPLDLVLYDDN

SEQ ID NO: 1055175 - protein, 23 aa, Mycobacterium
SEEKKTALGTGFFLTWVTTHVDQ

SEQ ID NO: 1055176 - protein, 24 aa, Mycobacterium
SEEVPARVASLVERLKAAEKELER

SEQ ID NO: 1055177 - protein, 19 aa, Mycobacterium
SEFATGLAFDEASRRHTGL

SEQ ID NO: 1055178 - protein, 17 aa, Mycobacterium
SEFLTHPAFTNYRTETS

SEQ ID NO: 1055179 - protein, 29 aa, Mycobacterium
SEFPKTTKAGMEFAVLLFAVRKGFTYPRG

SEQ ID NO: 1055180 - protein, 23 aa, Mycobacterium
SEFPWCGQAAEVLRSHFGEALPV

SEQ ID NO: 1055181 - protein, 21 aa, Mycobacterium
SEFRARVAATLDRAQALANEH

SEQ ID NO: 1055182 - protein, 20 aa, Mycobacterium
SEFTDSYVKLVFVAHDVDVA

SEQ ID NO: 1055183 - protein, 20 aa, Mycobacterium
SEGAGVLVVERLAAAQRLGH

SEQ ID NO: 1055184 - protein, 24 aa, Mycobacterium
SEGDGRLGAWPALVAGSAEHARGV

SEQ ID NO: 1055185 - protein, 20 aa, Mycobacterium
SEGIGELLALIDAHQRGDSR

SEQ ID NO: 1055186 - protein, 26 aa, Mycobacterium
SEGLRRFAALSGRSVGAEKIWMGETH

SEQ ID NO: 1055187 - protein, 29 aa, Mycobacterium
SEGLSKPEIIRCQKRYLAREVFDALRTDF

SEQ ID NO: 1055188 - protein, 17 aa, Mycobacterium
SEGRLRRAVDQDKDQSY

SEQ ID NO: 1055189 - protein, 28 aa, Mycobacterium
SEGYMITASYAVRVTWSGVYVHSAPWSV

SEQ ID NO: 1055190 - protein, 17 aa, Mycobacterium
SEHLCQGWLEGYLLTGR

SEQ ID NO: 1055191 - protein, 24 aa, Mycobacterium
SEHPSSGVAFVLGERLGRVDVSEL

SEQ ID NO: 1055192 - protein, 24 aa, Mycobacterium
SEHSDYRLGLPIAGRWREVLNTDA

SEQ ID NO: 1055193 - protein, 21 aa, Mycobacterium
SEIADRVELCLIADDDSESRI

SEQ ID NO: 1055194 - protein, 17 aa, Mycobacterium
SEIAMFFILLVVAGNET

SEQ ID NO: 1055195 - protein, 22 aa, Mycobacterium
SEIEEALRYGVVKMNVDTDTQY

SEQ ID NO: 1055196 - protein, 19 aa, Mycobacterium
SEIELLPITKFFPATDVAI

SEQ ID NO: 1055197 - protein, 24 aa, Mycobacterium
SEKDVKRQLLLDALADDLKVQVGQ

SEQ ID NO: 1055198 - protein, 18 aa, Mycobacterium
SEKNTNWEGALRIPEMIR

SEQ ID NO: 1055199 - protein, 18 aa, Mycobacterium
SELAAAFEKFEDTVVRAA

SEQ ID NO: 1055200 - protein, 19 aa, Mycobacterium
SELAPLLCAGIIGYRSLLR

SEQ ID NO: 1055201 - protein, 17 aa, Mycobacterium
SELDAMRVVAKRARRPM

SEQ ID NO: 1055202 - protein, 24 aa, Mycobacterium
SELGEWLVIHEGWRSELPEQLSEG

SEQ ID NO: 1055203 - protein, 20 aa, Mycobacterium
SELILPIAVAVQNRITVNEL

SEQ ID NO: 1055204 - protein, 21 aa, Mycobacterium
SELIRDLGFDSLAFASTVSEI

SEQ ID NO: 1055205 - protein, 24 aa, Mycobacterium
SELPAAVAAQARRGDGWIKLVGDW

SEQ ID NO: 1055206 - protein, 24 aa, Mycobacterium
SELPDALQALGRPDGLTVPRPAVF

SEQ ID NO: 1055207 - protein, 20 aa, Mycobacterium
SELRSVFSAAQIIADTERMG

SEQ ID NO: 1055208 - protein, 22 aa, Mycobacterium
SEMEMKVLLWAVQRLIGGLSTI

SEQ ID NO: 1055209 - protein, 17 aa, Mycobacterium
SEPELFGMFSRSHVFPI

SEQ ID NO: 1055210 - protein, 23 aa, Mycobacterium
SEPQRSPQRWTFFGSDERGLQHV

SEQ ID NO: 1055211 - protein, 21 aa, Mycobacterium
SEPVALVGMGCRYPGGADPPE

SEQ ID NO: 1055212 - protein, 23 aa, Mycobacterium
SEQDGDQFLAWAAKDPAISDAVH

SEQ ID NO: 1055213 - protein, 27 aa, Mycobacterium
SEQDVYLRWAVAAFRLATSGVADSTQI

SEQ ID NO: 1055214 - protein, 30 aa, Mycobacterium
SERLAEWGLRCFAPTWPLGTHPRALGPDAD

SEQ ID NO: 1055215 - protein, 20 aa, Mycobacterium
SERQRALLRLADLIEDNAEE

SEQ ID NO: 1055216 - protein, 25 aa, Mycobacterium
SESAELPLFRYIGGPNAHILPVPMM

SEQ ID NO: 1055217 - protein, 26 aa, Mycobacterium
SESNAMWALSIPIPFIKPVGAGAGGY

SEQ ID NO: 1055218 - protein, 20 aa, Mycobacterium
SESQERMCAVVSPENVDAFM

SEQ ID NO: 1055219 - protein, 24 aa, Mycobacterium
SESYLRGGWWRAHVVGPEPYSGID

SEQ ID NO: 1055220 - protein, 17 aa, Mycobacterium
SETELWQLAFEVVNGYR

SEQ ID NO: 1055221 - protein, 25 aa, Mycobacterium
SETTGLRFPLFVKAVAGGGGRGMRR

SEQ ID NO: 1055222 - protein, 17 aa, Mycobacterium
SEVIAWIEAGHAADPAR

SEQ ID NO: 1055223 - protein, 20 aa, Mycobacterium
SEVLYRLHLDLASLSIAEFY

SEQ ID NO: 1055224 - protein, 25 aa, Mycobacterium
SEVRHGFVKVFCRRSTGVVIGGVVV

SEQ ID NO: 1055225 - protein, 18 aa, Mycobacterium
SEVRLSLGAGMGVGKDGL

SEQ ID NO: 1055226 - protein, 35 aa, Mycobacterium
SEWICYFPHPLRVVCGGISIPGRWDTTPDPAVTDR

SEQ ID NO: 1055227 - protein, 21 aa, Mycobacterium
SEWPPAGAVRVEISDAYEQLA

SEQ ID NO: 1055228 - protein, 18 aa, Mycobacterium
SFAARVAPFNVNFRYVKN

SEQ ID NO: 1055229 - protein, 17 aa, Mycobacterium
SFADFLRRENLVLRADL

SEQ ID NO: 1055230 - protein, 30 aa, Mycobacterium; identical to SEQ ID NO: 730824

SEQ ID NO: 1055231 - protein, 22 aa, Mycobacterium
SFAPLPRSVFEATLDLLSGKYP

SEQ ID NO: 1055232 - protein, 18 aa, Mycobacterium
SFARRVHDIAGWHVELYV

SEQ ID NO: 1055233 - protein, 20 aa, Mycobacterium
SFATRLAQLMGRVRVTDGAV

SEQ ID NO: 1055234 - protein, 20 aa, Mycobacterium
SFAVLRPGGRLVTLSAPPPA

SEQ ID NO: 1055235 - protein, 24 aa, Mycobacterium
SFDELFIGGRWCKPTIAEPITVIS

SEQ ID NO: 1055236 - protein, 20 aa, Mycobacterium
SFEFDAIVFATGFDAVTGAL

SEQ ID NO: 1055237 - protein, 18 aa, Mycobacterium
SFEHPGLDRVLQWDPRFA

SEQ ID NO: 1055238 - protein, 19 aa, Mycobacterium
SFFLRTFDLGIGTSKYLNN

SEQ ID NO: 1055239 - protein, 20 aa, Mycobacterium
SFGEDRIAVRFQYESRDATG

SEQ ID NO: 1055240 - protein, 17 aa, Mycobacterium
SFHQQFVQLMSGGATEY

SEQ ID NO: 1055241 - protein, 24 aa, Mycobacterium
SFLLRLGGIRALGFSPELVTAVSP

SEQ ID NO: 1055242 - protein, 24 aa, Mycobacterium
SFNDAVGGLGSRVAGVLSGAVGGE

SEQ ID NO: 1055243 - protein, 20 aa, Mycobacterium
SFPGWGVWLNGARVVDTEEL

SEQ ID NO: 1055244 - protein, 21 aa, Mycobacterium
SFPHGPFSVGFARFFEIWVDV

SEQ ID NO: 1055245 - protein, 20 aa, Mycobacterium
SFTPFNIELLPCGQIAHSAL

SEQ ID NO: 1055246 - protein, 20 aa, Mycobacterium
SFTTGFPLTLALDALGAPIV

SEQ ID NO: 1055247 - protein, 22 aa, Mycobacterium
SFVEGRAAMFAGLADSTLSRDD

SEQ ID NO: 1055248 - protein, 22 aa, Mycobacterium
SFVGAYGPYLAWLTAASADCMA

SEQ ID NO: 1055249 - protein, 20 aa, Mycobacterium
SFYIPPEVFDNADFKRGLKM

SEQ ID NO: 1055250 - protein, 19 aa, Mycobacterium
SGAEWRLQADFDGSGIDER

SEQ ID NO: 1055251 - protein, 19 aa, Mycobacterium
SGALRIIAVSLTKIANDIR

SEQ ID NO: 1055252 - protein, 18 aa, Mycobacterium
SGAPEHRAAAIVKATTFY

SEQ ID NO: 1055253 - protein, 24 aa, Mycobacterium
SGAPRLVAVAVEIGEPGNAGTLIR

SEQ ID NO: 1055254 - protein, 18 aa, Mycobacterium
SGARIAALAALAMFAVLQ

SEQ ID NO: 1055255 - protein, 17 aa, Mycobacterium
SGARRGGAVSGIGGHNA

SEQ ID NO: 1055256 - protein, 18 aa, Mycobacterium
SGARVALVTGDRDIEAGT

SEQ ID NO: 1055257 - protein, 25 aa, Mycobacterium
SGASGSPGGWLLGDGGAGGSGAAGS

SEQ ID NO: 1055258 - protein, 17 aa, Mycobacterium
SGASWYEAAELLAAAVR

SEQ ID NO: 1055259 - protein, 19 aa, Mycobacterium
SGAVPIGIVGDAGQWTKIG

SEQ ID NO: 1055260 - protein, 21 aa, Mycobacterium
SGDCRGKGGVCLINGVSGVFG

SEQ ID NO: 1055261 - protein, 17 aa, Mycobacterium
SGDDGGLLFGNGGNGAP

SEQ ID NO: 1055262 - protein, 17 aa, Mycobacterium
SGDEIEALWPMVIARAT

SEQ ID NO: 1055263 - protein, 18 aa, Mycobacterium
SGDFTLTIVAGRNAPEEI

SEQ ID NO: 1055264 - protein, 25 aa, Mycobacterium
SGDLAYRDSQGWIYLAPAAPPTGCG

SEQ ID NO: 1055265 - protein, 24 aa, Mycobacterium
SGDNRCYLVLPPGAGKTMIGLEAA

SEQ ID NO: 1055266 - protein, 19 aa, Mycobacterium
SGDPEVRQLILLDAPAVLG

SEQ ID NO: 1055267 - protein, 18 aa, Mycobacterium
SGDTSGYGRLVREIVLPG

SEQ ID NO: 1055268 - protein, 17 aa, Mycobacterium
SGDVLMVAWMDDDALDR

SEQ ID NO: 1055269 - protein, 21 aa, Mycobacterium
SGEAKRGSPLREELIADRYQV

SEQ ID NO: 1055270 - protein, 19 aa, Mycobacterium
SGELHAMMLDMRRTFDEMV

SEQ ID NO: 1055271 - protein, 21 aa, Mycobacterium
SGEQIELWAWVGAYDHVALCQ

SEQ ID NO: 1055272 - protein, 35 aa, Mycobacterium
SGESLAGKATVLWFSTPWCPKCQQEAPIVAKAAAA

SEQ ID NO: 1055273 - protein, 18 aa, Mycobacterium
SGESLDEVLDYLGIPVSA

SEQ ID NO: 1055274 - protein, 20 aa, Mycobacterium
SGEYAMICAAAANSRIDQRA

SEQ ID NO: 1055275 - protein, 17 aa, Mycobacterium
SGFDWGKTGVCLINGVS

SEQ ID NO: 1055276 - protein, 20 aa, Mycobacterium
SGFQGVKGGAGGVGGDGGLY

SEQ ID NO: 1055277 - protein, 19 aa, Mycobacterium
SGGAARLFGNGGAGGSGGK

SEQ ID NO: 1055278 - protein, 20 aa, Mycobacterium
SGGAGGLLFGNGGDGGAGGD

SEQ ID NO: 1055279 - protein, 23 aa, Mycobacterium
SGGAIALGHPFGMTGARITTTLL

SEQ ID NO: 1055280 - protein, 19 aa, Mycobacterium
SGGDGGILIGNGGAGGSGA

SEQ ID NO: 1055281 - protein, 17 aa, Mycobacterium
SGGEFRAAILTGAGRGF

SEQ ID NO: 1055282 - protein, 22 aa, Mycobacterium
SGGFDHDLAWRKEHQPLVEQDW

SEQ ID NO: 1055283 - protein, 21 aa, Mycobacterium
SGGFGTLLLLGHDWASPQATF

SEQ ID NO: 1055284 - protein, 25 aa, Mycobacterium
SGGFLLTFLACFDVGDRVALASPGY

SEQ ID NO: 1055285 - protein, 19 aa, Mycobacterium
SGGLPAAAFGGRAEVMERL

SEQ ID NO: 1055286 - protein, 18 aa, Mycobacterium
SGGNWAINTGNGYYGGVQ

SEQ ID NO: 1055287 - protein, 22 aa, Mycobacterium
SGGRFILAVGVGYLKREFAALG

SEQ ID NO: 1055288 - protein, 25 aa, Mycobacterium
SGGRFVFGVGAGWNIEELRDHGTDP

SEQ ID NO: 1055289 - protein, 17 aa, Mycobacterium
SGGRGGSAVGLIGNGGA

SEQ ID NO: 1055290 - protein, 18 aa, Mycobacterium
SGGRGVGSAENFSVVEAL

SEQ ID NO: 1055291 - protein, 17 aa, Mycobacterium
SGGSYVRRPLSLPFEVR

SEQ ID NO: 1055292 - protein, 22 aa, Mycobacterium
SGGTDIRWSGSFSEGVRGTGPV

SEQ ID NO: 1055293 - protein, 20 aa, Mycobacterium
SGGTIFAYWVANPTAYGVVE

SEQ ID NO: 1055294 - protein, 26 aa, Mycobacterium
SGGVGGRGGLVYGNGGVGGAGGQGAL

SEQ ID NO: 1055295 - protein, 20 aa, Mycobacterium
SGHLDWYADGMFPPMQIDAE

SEQ ID NO: 1055296 - protein, 24 aa, Mycobacterium
SGHNGGAGGLLWGNGGNGGAGAAG

SEQ ID NO: 1055297 - protein, 19 aa, Mycobacterium
SGIPGELIDAGFENVAEVG

SEQ ID NO: 1055298 - protein, 23 aa, Mycobacterium
SGITELPWTLSIFGDGPDRERLQ

SEQ ID NO: 1055299 - protein, 18 aa, Mycobacterium
SGKCEILATGLRRAADRV

SEQ ID NO: 1055300 - protein, 24 aa, Mycobacterium
SGKMTGRPRLQVVNPEAAQWLADT

SEQ ID NO: 1055301 - protein, 26 aa, Mycobacterium
SGKQRSRLALWSRRLLGEAITQAQFL

SEQ ID NO: 1055302 - protein, 17 aa, Mycobacterium
SGKRFAYEGEIFTVPEM

SEQ ID NO: 1055303 - protein, 19 aa, Mycobacterium
SGLARQAAATANNSGTTVS

SEQ ID NO: 1055304 - protein, 26 aa, Mycobacterium
SGLDARAYRLGWPAGTVVHEVDMPQV

SEQ ID NO: 1055305 - protein, 19 aa, Mycobacterium
SGLDLARLGTTATTEEITD

SEQ ID NO: 1055306 - protein, 22 aa, Mycobacterium
SGLEHTEVLPLYARLPTAEQQK

SEQ ID NO: 1055307 - protein, 20 aa, Mycobacterium
SGLELPAFQQMFWRGGPTPT

SEQ ID NO: 1055308 - protein, 25 aa, Mycobacterium
SGLGRCIGVGLARRGDHVALLARRR

SEQ ID NO: 1055309 - protein, 20 aa, Mycobacterium
SGLIGSRWLAHYTATSGYLD

SEQ ID NO: 1055310 - protein, 22 aa, Mycobacterium
SGLPSWQQALSALPGIGQAAAA

SEQ ID NO: 1055311 - protein, 17 aa, Mycobacterium
SGLPVVELLDTELIRGR

SEQ ID NO: 1055312 - protein, 17 aa, Mycobacterium
SGLRRLVPHLSEAAGFT

SEQ ID NO: 1055313 - protein, 26 aa, Mycobacterium
SGLRTEPALDILAGWLASRIDGPARR

SEQ ID NO: 1055314 - protein, 23 aa, Mycobacterium
SGLSRVAPYLARTMPQLLSVECW

SEQ ID NO: 1055315 - protein, 20 aa, Mycobacterium
SGLTSGGWLGPASLSMASAF

SEQ ID NO: 1055316 - protein, 21 aa, Mycobacterium
SGMFGDFAAADAFRNSVHSAH

SEQ ID NO: 1055317 - protein, 24 aa, Mycobacterium
SGNARPAQVAAFAVAMKMKVPTAG

SEQ ID NO: 1055318 - protein, 24 aa, Mycobacterium
SGNGVKVSTFGLENIATLGTVIGD

SEQ ID NO: 1055319 - protein, 23 aa, Mycobacterium
SGPAIEVNRLFPPGYEEQRAAAK

SEQ ID NO: 1055320 - protein, 23 aa, Mycobacterium
SGPARARYLMLRLLERAGEQRVA

SEQ ID NO: 1055321 - protein, 23 aa, Mycobacterium
SGPARKVLELTFREALRLGHNYI

SEQ ID NO: 1055322 - protein, 23 aa, Mycobacterium
SGPHLQYAGAFLRSGRTPARRPR

SEQ ID NO: 1055323 - protein, 17 aa, Mycobacterium
SGPLAIVEDLGRAGLGH

SEQ ID NO: 1055324 - protein, 22 aa, Mycobacterium
SGPSGVPRRYFTVMVPVNRGWV

SEQ ID NO: 1055325 - protein, 18 aa, Mycobacterium
SGPVHLVALPRFPEPGSA

SEQ ID NO: 1055326 - protein, 18 aa, Mycobacterium
SGPWRGLASTSMASAAAP

SEQ ID NO: 1055327 - protein, 24 aa, Mycobacterium
SGQPRLLGFHWTKIHLDDPGLGEV

SEQ ID NO: 1055328 - protein, 17 aa, Mycobacterium
SGRAESVQQIWFGLSTL

SEQ ID NO: 1055329 - protein, 26 aa, Mycobacterium
SGRDARAYRLPWPPQTVVYEIDLPQV

SEQ ID NO: 1055330 - protein, 19 aa, Mycobacterium
SGREVLYRLVDQHLAHIVV

SEQ ID NO: 1055331 - protein, 23 aa, Mycobacterium
SGRPRLAPLVYLRIDGKMFIVGS

SEQ ID NO: 1055332 - protein, 25 aa, Mycobacterium
SGRRAALAMVRRHRLLETFLVNELG

SEQ ID NO: 1055333 - protein, 17 aa, Mycobacterium
SGRRGQGALVVLIARDD

SEQ ID NO: 1055334 - protein, 17 aa, Mycobacterium
SGRRMGRAHLAVGHHYR

SEQ ID NO: 1055335 - protein, 17 aa, Mycobacterium
SGRVSDSGEGRWTSIAA

SEQ ID NO: 1055336 - protein, 18 aa, Mycobacterium
SGSEAIAHAWQQIVLGEA

SEQ ID NO: 1055337 - protein, 17 aa, Mycobacterium
SGSFIHRFVDLRRIVGL

SEQ ID NO: 1055338 - protein, 31 aa, Mycobacterium; identical to SEQ ID NO: 731545

SEQ ID NO: 1055339 - protein, 19 aa, Mycobacterium
SGSNLEFVVALLAASRANL

SEQ ID NO: 1055340 - protein, 20 aa, Mycobacterium
SGSSDYLAGRAFSFISAIDS

SEQ ID NO: 1055341 - protein, 24 aa, Mycobacterium
SGSVPQRLWAKPAITVIGIDTTSI

SEQ ID NO: 1055342 - protein, 24 aa, Mycobacterium
SGTEPKLKCYIEVRCEVAGDLAAT

SEQ ID NO: 1055343 - protein, 26 aa, Mycobacterium
SGTMGRAALVGSMSVPQGWTQAAPAM

SEQ ID NO: 1055344 - protein, 24 aa, Mycobacterium
SGVDRSTVVLGMWQHLLHRYSGQE

SEQ ID NO: 1055345 - protein, 23 aa, Mycobacterium
SGVNVCTSAAWITGGKQTPRDRE

SEQ ID NO: 1055346 - protein, 18 aa, Mycobacterium
SGVRFVSIYPGFVATEAT

SEQ ID NO: 1055347 - protein, 18 aa, Mycobacterium
SGVRHVPRLRRHSLAAQP

SEQ ID NO: 1055348 - protein, 17 aa, Mycobacterium
SGVRLIRRIARAGDLNW

SEQ ID NO: 1055349 - protein, 19 aa, Mycobacterium
SGVTLSWGCARDVVRLVSD

SEQ ID NO: 1055350 - protein, 17 aa, Mycobacterium
SGVTVVLAPPGTVGAVD

SEQ ID NO: 1055351 - protein, 17 aa, Mycobacterium
SGWASRVRLAHALGPTM

SEQ ID NO: 1055352 - protein, 24 aa, Mycobacterium
SGWEVAGDILLRFVSEGKCLRSTF

SEQ ID NO: 1055353 - protein, 28 aa, Mycobacterium
SGYLCVPLDGAVCDRLGLLPMYAVNQDK

SEQ ID NO: 1055354 - protein, 26 aa, Mycobacterium
SGYPLELLVRAAAAGWRVAEFDVSYG

SEQ ID NO: 1055355 - protein, 22 aa, Mycobacterium
SHCSWSVTGIGQFLPLDGASPA

SEQ ID NO: 1055356 - protein, 24 aa, Mycobacterium
SHDHASALIMLRLSRKSDEHPEVV

SEQ ID NO: 1055357 - protein, 19 aa, Mycobacterium
SHDLALRLAEHGLHGERLA

SEQ ID NO: 1055358 - protein, 23 aa, Mycobacterium
SHDNLRLSGTVARIPSSSGSALK

SEQ ID NO: 1055359 - protein, 24 aa, Mycobacterium
SHDRLKAELDQLIANRPVIAAEIN

SEQ ID NO: 1055360 - protein, 20 aa, Mycobacterium
SHEARFVLIGTMNPEEGELR

SEQ ID NO: 1055361 - protein, 26 aa, Mycobacterium
SHFPHLPWPWSLVDFALLPITWASGI

SEQ ID NO: 1055362 - protein, 36 aa, Mycobacterium
SHGQGYQVLSARALEFHTRLAQALSAGAGAYSGAEA

SEQ ID NO: 1055363 - protein, 24 aa, Mycobacterium
SHHPPMRTFLGVPVRVRDVSLGTL

SEQ ID NO: 1055364 - protein, 25 aa, Mycobacterium
SHIESRLAVTLSWIREFPSLGPISY

SEQ ID NO: 1055365 - protein, 22 aa, Mycobacterium
SHLKMDGSWRVGDRPPRVDHHA

SEQ ID NO: 1055366 - protein, 17 aa, Mycobacterium
SHLRSGAEMARLFAQRP

SEQ ID NO: 1055367 - protein, 23 aa, Mycobacterium
SHLYPAELARRAKVLGESVGLEV

SEQ ID NO: 1055368 - protein, 22 aa, Mycobacterium
SHPAPDWTAAALAKAAAADAAV

SEQ ID NO: 1055369 - protein, 26 aa, Mycobacterium
SHRERYTLPALRDWLRGQREDRGGAT

SEQ ID NO: 1055370 - protein, 25 aa, Mycobacterium
SHSTPRAGDGFIRLDRNGVVAFASP

SEQ ID NO: 1055371 - protein, 26 aa, Mycobacterium
SHSTPRAGDGFIRLDRNGVVAFASPN

SEQ ID NO: 1055372 - protein, 24 aa, Mycobacterium
SHSVASYPGALAFTQERVLGTLSS

SEQ ID NO: 1055373 - protein, 26 aa, Mycobacterium
SHSWFAGYRGDLAFASLIVGGGSSEY

SEQ ID NO: 1055374 - protein, 30 aa, Mycobacterium; identical to SEQ ID NO: 618954

SEQ ID NO: 1055375 - protein, 20 aa, Mycobacterium
SHWWAHRALLHLIFSGVLDR

SEQ ID NO: 1055376 - protein, 32 aa, Mycobacterium
SIADLRAIPWVLAWSQSRVMLPGWYGTGSAFE

SEQ ID NO: 1055377 - protein, 21 aa, Mycobacterium
SIALCGPAYDALRALSEAQQV

SEQ ID NO: 1055378 - protein, 25 aa, Mycobacterium
SIGAEALRVLLLEYGRSAACWADRL

SEQ ID NO: 1055379 - protein, 18 aa, Mycobacterium
SIGNRGLLNLGLGNAGNL

SEQ ID NO: 1055380 - protein, 19 aa, Mycobacterium
SIGVPGILRMLEMVHNEHG

SEQ ID NO: 1055381 - protein, 25 aa, Mycobacterium
SIGYAACHWCHVMAHESFEDDEVAA

SEQ ID NO: 1055382 - protein, 17 aa, Mycobacterium
SIIGSLVARCLPVPIDD

SEQ ID NO: 1055383 - protein, 17 aa, Mycobacterium
SIILNGVDWFRSMGSEK

SEQ ID NO: 1055384 - protein, 23 aa, Mycobacterium
SILCDPWVNPAYFASWFPFPDNS

SEQ ID NO: 1055385 - protein, 20 aa, Mycobacterium
SILELIDRVAGWLASLQGNT

SEQ ID NO: 1055386 - protein, 25 aa, Mycobacterium
SILEVKGYCYGWHFYKAADADLVIS

SEQ ID NO: 1055387 - protein, 20 aa, Mycobacterium
SILGPRSFRALRLDRNRNLI

SEQ ID NO: 1055388 - protein, 22 aa, Mycobacterium
SIPEVADLVAMLRLVGDPTAGA

SEQ ID NO: 1055389 - protein, 24 aa, Mycobacterium
SIPGPRIYPAGGFISQSGGHGDFR

SEQ ID NO: 1055390 - protein, 17 aa, Mycobacterium
SIRCFERALDLDPGLAI

SEQ ID NO: 1055391 - protein, 19 aa, Mycobacterium
SIRGEVLRILAGVDGEIRR

SEQ ID NO: 1055392 - protein, 26 aa, Mycobacterium
SIRHALDIGKTRGWMHTFFADHSKTP

SEQ ID NO: 1055393 - protein, 23 aa, Mycobacterium
SISRGELDAGLAFHSPLNYRPQL

SEQ ID NO: 1055394 - protein, 18 aa, Mycobacterium
SITCRILVDGSVVTEQTG

SEQ ID NO: 1055395 - protein, 18 aa, Mycobacterium
SIVLWPQVVKEVAPVPVL

SEQ ID NO: 1055396 - protein, 18 aa, Mycobacterium
SIVVPGFVDIHVHGGAGA

SEQ ID NO: 1055397 - protein, 20 aa, Mycobacterium
SIWGDFPAAVSWQRTSDEMR

SEQ ID NO: 1055398 - protein, 21 aa, Mycobacterium
SKAARKVWDIADRFTRDTLGF

SEQ ID NO: 1055399 - protein, 21 aa, Mycobacterium
SKAGGFGVLGAVGFTPEQLEI

SEQ ID NO: 1055400 - protein, 18 aa, Mycobacterium
SKALLRPVIAVADARLVD

SEQ ID NO: 1055401 - protein, 17 aa, Mycobacterium
SKATLMAAWTSLYNASK

SEQ ID NO: 1055402 - protein, 24 aa, Mycobacterium
SKAYARWMSAMGYRPVSTRHVNEG

SEQ ID NO: 1055403 - protein, 22 aa, Mycobacterium
SKDRWYLRCGRCSLVPISTPGP

SEQ ID NO: 1055404 - protein, 23 aa, Mycobacterium
SKDSTRYLMHFSQSGIGLPDESY

SEQ ID NO: 1055405 - protein, 19 aa, Mycobacterium
SKEAILIELIRRYQDDLHQ

SEQ ID NO: 1055406 - protein, 18 aa, Mycobacterium
SKEAVLLTLLDRVVNEAD

SEQ ID NO: 1055407 - protein, 25 aa, Mycobacterium
SKEKAQELGLTWLVEIGAHGVAAGP

SEQ ID NO: 1055408 - protein, 17 aa, Mycobacterium
SKFASAVAKNPFIGDPI

SEQ ID NO: 1055409 - protein, 24 aa, Mycobacterium
SKFRRHVIDALEFMGISVEFSHHE

SEQ ID NO: 1055410 - protein, 20 aa, Mycobacterium
SKGYCFQIEMTWRSVNSGFV

SEQ ID NO: 1055411 - protein, 22 aa, Mycobacterium
SKIMPVAPFPAVVKQRERASAR

SEQ ID NO: 1055412 - protein, 19 aa, Mycobacterium
SKKRRRGLVFGEAAGGVTY

SEQ ID NO: 1055413 - protein, 19 aa, Mycobacterium
SKLAVPIHVGGGYGGDSDW

SEQ ID NO: 1055414 - protein, 18 aa, Mycobacterium
SKLMLRISGAGAMASVEL

SEQ ID NO: 1055415 - protein, 22 aa, Mycobacterium
SKLPQVFFVNWFRRGEDHRFLW

SEQ ID NO: 1055416 - protein, 19 aa, Mycobacterium
SKMPPRGLTQAAIRYGIGL

SEQ ID NO: 1055417 - protein, 22 aa, Mycobacterium
SKNIFRPSIMTLETIDGQEIRV

SEQ ID NO: 1055418 - protein, 24 aa, Mycobacterium
SKPAAPYAKAVREWEQLERFVESR

SEQ ID NO: 1055419 - protein, 24 aa, Mycobacterium
SKRATWPRCGSPSMGSIRAKPASN

SEQ ID NO: 1055420 - protein, 17 aa, Mycobacterium
SKRVMWQGIGHGASIYS

SEQ ID NO: 1055421 - protein, 22 aa, Mycobacterium
SKRYRIAELAVRDKIPLVMLLE

SEQ ID NO: 1055422 - protein, 27 aa, Mycobacterium
SKSALVAAVYLRLLRDLPLHTDVNDTT

SEQ ID NO: 1055423 - protein, 22 aa, Mycobacterium
SKVNGMVVVGIWQPGAPAAGLV

SEQ ID NO: 1055424 - protein, 17 aa, Mycobacterium
SLADAWLGVIARHGTLR

SEQ ID NO: 1055425 - protein, 18 aa, Mycobacterium
SLADLGFSSVHTVRLAGE

SEQ ID NO: 1055426 - protein, 25 aa, Mycobacterium
SLAGLARAIADIAARARSGNLKPDE

SEQ ID NO: 1055427 - protein, 23 aa, Mycobacterium
SLAIRIDGPRSWDLDLTIDVTFE

SEQ ID NO: 1055428 - protein, 26 aa, Mycobacterium
SLALTGRPLIGNGADGGPGQAGGGGG

SEQ ID NO: 1055429 - protein, 28 aa, Mycobacterium
SLAMAAKLKGYRLICVIPENTSIERRRL

SEQ ID NO: 1055430 - protein, 24 aa, Mycobacterium
SLAQRCVFEHRAVVVGRDREALLA

SEQ ID NO: 1055431 - protein, 17 aa, Mycobacterium
SLARAMVNLHRRYRITT

SEQ ID NO: 1055432 - protein, 27 aa, Mycobacterium
SLARYKLPKAIVFRAGIQRSPSGKADY

SEQ ID NO: 1055433 - protein, 39 aa, Mycobacterium; identical to SEQ ID NO: 732247

SEQ ID NO: 1055434 - protein, 31 aa, Mycobacterium; identical to SEQ ID NO: 732256

SEQ ID NO: 1055435 - protein, 17 aa, Mycobacterium
SLDKLLMTWVEQSVGHA

SEQ ID NO: 1055436 - protein, 18 aa, Mycobacterium
SLDMSAAVLAGMRREQPL

SEQ ID NO: 1055437 - protein, 25 aa, Mycobacterium
SLDPLIGSGRFDFVADLGAQMPMRV

SEQ ID NO: 1055438 - protein, 19 aa, Mycobacterium
SLDPLRPVAHVRANAVEVG

SEQ ID NO: 1055439 - protein, 24 aa, Mycobacterium
SLEANAFHQQFWRSLSGAAASYSG

SEQ ID NO: 1055440 - protein, 26 aa, Mycobacterium
SLEVIDLRSLIPLDFETIAASIRRTG

SEQ ID NO: 1055441 - protein, 23 aa, Mycobacterium
SLEVSRQLATLSIFANSGGKTAE

SEQ ID NO: 1055442 - protein, 35 aa, Mycobacterium
SLFHVLRYGFRPSKIGFLAWHAWSDSQRGNWPLGF

SEQ ID NO: 1055443 - protein, 24 aa, Mycobacterium
SLFPGGEGRLRLTAPEDMLTTGIE

SEQ ID NO: 1055444 - protein, 28 aa, Mycobacterium
SLGESVARALGRRFVRVALGGVRDEAEI

SEQ ID NO: 1055445 - protein, 24 aa, Mycobacterium
SLGHERTMLWLGYANLLGELATDF

SEQ ID NO: 1055446 - protein, 23 aa, Mycobacterium
SLGHPRKGLFLVHTDAVDSVLGT

SEQ ID NO: 1055447 - protein, 26 aa, Mycobacterium
SLGHRIRAAIHFDDLQWERSYNRVAA

SEQ ID NO: 1055448 - protein, 18 aa, Mycobacterium
SLGLALVIQQAELHGRNA

SEQ ID NO: 1055449 - protein, 19 aa, Mycobacterium
SLGLEFLGFTGPDVQEGLA

SEQ ID NO: 1055450 - protein, 25 aa, Mycobacterium
SLGTSFPELMAGFTGGFTGLLQTGQ

SEQ ID NO: 1055451 - protein, 23 aa, Mycobacterium
SLGTTLPAALVWAYPTITDLAGA

SEQ ID NO: 1055452 - protein, 25 aa, Mycobacterium
SLHAFNLWLDEDWGFDRPDHRIIAA

SEQ ID NO: 1055453 - protein, 17 aa, Mycobacterium
SLHFKADIPEDVLARLP

SEQ ID NO: 1055454 - protein, 23 aa, Mycobacterium
SLHLEALAWFDHWLKSRDTGILA

SEQ ID NO: 1055455 - protein, 23 aa, Mycobacterium
SLHMPDFPLLPVRVETWEGLVFV

SEQ ID NO: 1055456 - protein, 24 aa, Mycobacterium
SLHPELLPALASLIATAAQRSQII

SEQ ID NO: 1055457 - protein, 23 aa, Mycobacterium
SLIAAGRAWARFEHGEVIFKAEV

SEQ ID NO: 1055458 - protein, 19 aa, Mycobacterium
SLIAYADWVCLAVRTNPEA

SEQ ID NO: 1055459 - protein, 18 aa, Mycobacterium
SLILRYGPGMGQALDANY

SEQ ID NO: 1055460 - protein, 17 aa, Mycobacterium
SLIPIAIEEGLRFETPL

SEQ ID NO: 1055461 - protein, 23 aa, Mycobacterium
SLKLGFAGSDFSYAMDLGLPQAS

SEQ ID NO: 1055462 - protein, 20 aa, Mycobacterium
SLKNSMTRRFYSRSEVTGKI

SEQ ID NO: 1055463 - protein, 23 aa, Mycobacterium
SLKVPVRHFVLFSSISGLIGSRW

SEQ ID NO: 1055464 - protein, 17 aa, Mycobacterium
SLLAAGITAVSGRFYGG

SEQ ID NO: 1055465 - protein, 17 aa, Mycobacterium
SLLALGLPGLSVNVRDG

SEQ ID NO: 1055466 - protein, 17 aa, Mycobacterium
SLLHTWFELLGPEKIVT

SEQ ID NO: 1055467 - protein, 17 aa, Mycobacterium
SLLSFGTPEQKRRWAVP

SEQ ID NO: 1055468 - protein, 28 aa, Mycobacterium
SLMDTHPFMWLPMLSRVLGSAQLLPEAV

SEQ ID NO: 1055469 - protein, 23 aa, Mycobacterium
SLMVPTDLVGIFAGSGSLLPSAS

SEQ ID NO: 1055470 - protein, 26 aa, Mycobacterium
SLNGIGGDGGDAFLIGNGGNGGAGAG

SEQ ID NO: 1055471 - protein, 18 aa, Mycobacterium
SLNPRLRPGTVVVPDQLV

SEQ ID NO: 1055472 - protein, 22 aa, Mycobacterium
SLNVPLPLRLGVNALGPAITTA

SEQ ID NO: 1055473 - protein, 24 aa, Mycobacterium
SLNYRVSPLHTWPAHIVDVKRALA

SEQ ID NO: 1055474 - protein, 19 aa, Mycobacterium
SLPDLLPLLEKVAESGKPL

SEQ ID NO: 1055475 - protein, 17 aa, Mycobacterium
SLPEVVAAFTGGLNGLV

SEQ ID NO: 1055476 - protein, 27 aa, Mycobacterium
SLPFEHARPTAIMTWMRQHWGIENSLH

SEQ ID NO: 1055477 - protein, 31 aa, Mycobacterium; identical to SEQ ID NO: 732490

SEQ ID NO: 1055478 - protein, 24 aa, Mycobacterium
SLPMGAEALALLRLPMVLPTVQLA

SEQ ID NO: 1055479 - protein, 19 aa, Mycobacterium
SLPNHWVGIGVDPEDQVAG

SEQ ID NO: 1055480 - protein, 18 aa, Mycobacterium
SLPRSAGGQVARRGQLEK

SEQ ID NO: 1055481 - protein, 23 aa, Mycobacterium
SLQANAFQAQFIQAINGAGGAYV

SEQ ID NO: 1055482 - protein, 19 aa, Mycobacterium
SLQEKLCQAAVFVTQSRQT

SEQ ID NO: 1055483 - protein, 24 aa, Mycobacterium
SLQFRTIHGYKRAFRIAGSGPAIL

SEQ ID NO: 1055484 - protein, 18 aa, Mycobacterium
SLQLDFAKTLDFWAEALE

SEQ ID NO: 1055485 - protein, 20 aa, Mycobacterium
SLQRWHDVERTMVLNYYGPL

SEQ ID NO: 1055486 - protein, 20 aa, Mycobacterium
SLQVRRRAKSWYERLNAEDP

SEQ ID NO: 1055487 - protein, 19 aa, Mycobacterium
SLRARIGALSVGLDRKDGA

SEQ ID NO: 1055488 - protein, 18 aa, Mycobacterium
SLRGRLFAVLGSSLSLGD

SEQ ID NO: 1055489 - protein, 18 aa, Mycobacterium
SLRLCVSGGAAMPVEVMR

SEQ ID NO: 1055490 - protein, 20 aa, Mycobacterium
SLRLWSRAAGSLACAGPPEG

SEQ ID NO: 1055491 - protein, 24 aa, Mycobacterium
SLRRLGVDAIDLFQLHRIDRNYPL

SEQ ID NO: 1055492 - protein, 19 aa, Mycobacterium
SLRSGECDLALAGGATVNA

SEQ ID NO: 1055493 - protein, 17 aa, Mycobacterium
SLRTAVRSFRDAAHSGD

SEQ ID NO: 1055494 - protein, 18 aa, Mycobacterium
SLRYLRRELRAETPEQQQ

SEQ ID NO: 1055495 - protein, 26 aa, Mycobacterium
SLSDAKSALGSWLPHGPAPVADYPAV

SEQ ID NO: 1055496 - protein, 24 aa, Mycobacterium
SLSDYKGRQVVVYFYPAASTPGCT

SEQ ID NO: 1055497 - protein, 18 aa, Mycobacterium
SLTGRPLIGNGANGTPGT

SEQ ID NO: 1055498 - protein, 17 aa, Mycobacterium
SLTLWEAHPHRPAIQQS

SEQ ID NO: 1055499 - protein, 18 aa, Mycobacterium
SLTLWEAHPHRPAIQQSG

SEQ ID NO: 1055500 - protein, 21 aa, Mycobacterium
SLTVTCPRDLVLSAPVKLTEG

SEQ ID NO: 1055501 - protein, 17 aa, Mycobacterium
SLVALHLAVQSLRSRQC

SEQ ID NO: 1055502 - protein, 24 aa, Mycobacterium
SLVARCLPVPIDDYVEWAKTVSYR

SEQ ID NO: 1055503 - protein, 25 aa, Mycobacterium
SLVDDLVSRCRLAMAGEPLPRADPE

SEQ ID NO: 1055504 - protein, 26 aa, Mycobacterium
SLYDSYLRAFRWATDRVGDHGIVAYV

SEQ ID NO: 1055505 - protein, 20 aa, Mycobacterium
SLYVYARETVGYALVIDGRV

SEQ ID NO: 1055506 - protein, 19 aa, Mycobacterium
SMALRYEGWNIATASDGAS

SEQ ID NO: 1055507 - protein, 26 aa, Mycobacterium
SMEAAVFPYLAWMNITGMQAEQTARQ

SEQ ID NO: 1055508 - protein, 23 aa, Mycobacterium
SMEQGRLAAYHAFGEPTDGITEL

SEQ ID NO: 1055509 - protein, 31 aa, Mycobacterium; identical to SEQ ID NO: 732727

SEQ ID NO: 1055510 - protein, 22 aa, Mycobacterium
SMGCAVIWSYLELFGTDRLASL

SEQ ID NO: 1055511 - protein, 17 aa, Mycobacterium
SMGFKTFGFGFGREDVW

SEQ ID NO: 1055512 - protein, 20 aa, Mycobacterium
SMGGMLAFEVALRFEAAGYR

SEQ ID NO: 1055513 - protein, 25 aa, Mycobacterium
SMGKPSRPTPIGSFTALSKERTVVM

SEQ ID NO: 1055514 - protein, 18 aa, Mycobacterium
SMHPSREYLSAVIRALRY

SEQ ID NO: 1055515 - protein, 19 aa, Mycobacterium
SMKMEIPVLAEIGGTVSKV

SEQ ID NO: 1055516 - protein, 18 aa, Mycobacterium
SMLRGAIISGELEAGGRL

SEQ ID NO: 1055517 - protein, 19 aa, Mycobacterium
SMLSHSLHAMAKLAPQHLV

SEQ ID NO: 1055518 - protein, 18 aa, Mycobacterium
SMPARTRVVGVLESAGRP

SEQ ID NO: 1055519 - protein, 24 aa, Mycobacterium
SMPKAVVINPYFDWANDRPPDHHY

SEQ ID NO: 1055520 - protein, 25 aa, Mycobacterium
SMPLLERAKFLAVFASNLDEFYMVR

SEQ ID NO: 1055521 - protein, 18 aa, Mycobacterium
SMRFPLPKFSDIRYNYAL

SEQ ID NO: 1055522 - protein, 17 aa, Mycobacterium
SMRGESLPAGGAATPGA

SEQ ID NO: 1055523 - protein, 17 aa, Mycobacterium
SMRRPAPPEPKSVPEPP

SEQ ID NO: 1055524 - protein, 23 aa, Mycobacterium
SMTGHAKGGAAVFQMMGLCQILR

SEQ ID NO: 1055525 - protein, 24 aa, Mycobacterium
SMTTGSGWIRPPFNVTISNIPGSP

SEQ ID NO: 1055526 - protein, 19 aa, Mycobacterium
SMVDERAAGVVISVNGQVP

SEQ ID NO: 1055527 - protein, 20 aa, Mycobacterium
SMVLLSPWLDLGMTNPNIAF

SEQ ID NO: 1055528 - protein, 25 aa, Mycobacterium
SMVPGLMHVRFGPYHVRDVKFVAAF

SEQ ID NO: 1055529 - protein, 25 aa, Mycobacterium
SMWIWRELATLLPMMMSAVSVSETC

SEQ ID NO: 1055530 - protein, 17 aa, Mycobacterium
SNAHLRAAIGALTENAA

SEQ ID NO: 1055531 - protein, 18 aa, Mycobacterium
SNALCADEILSLLGGQTT

SEQ ID NO: 1055532 - protein, 23 aa, Mycobacterium
SNALCAGAVALECGASVSQVAAA

SEQ ID NO: 1055533 - protein, 18 aa, Mycobacterium
SNATLWPLYHDVIVRPIY

SEQ ID NO: 1055534 - protein, 19 aa, Mycobacterium
SNCSSRWGHWAPPSESPPG

SEQ ID NO: 1055535 - protein, 19 aa, Mycobacterium
SNDLHLWRQLEFPGTNAQV

SEQ ID NO: 1055536 - protein, 24 aa, Mycobacterium
SNFAHPRFRAARDATAEFAWGLLI

SEQ ID NO: 1055537 - protein, 19 aa, Mycobacterium
SNGFALILVGHVTKDGAIA

SEQ ID NO: 1055538 - protein, 19 aa, Mycobacterium
SNGGLLMGIMVTKYPEKFG

SEQ ID NO: 1055539 - protein, 18 aa, Mycobacterium
SNGSRPASVTSWWRLAAC

SEQ ID NO: 1055540 - protein, 33 aa, Mycobacterium
SNLKCLCRKHHLLKTFWGWHDEQLPDATVIWSL

SEQ ID NO: 1055541 - protein, 32 aa, Mycobacterium
SNLKCLCRKHHLLKTFWGWRDLQLPDGTVIWL

SEQ ID NO: 1055542 - protein, 33 aa, Mycobacterium; identical to SEQ ID NO: 732922

SEQ ID NO: 1055543 - protein, 17 aa, Mycobacterium
SNPRFSVSRVDIDRGGP

SEQ ID NO: 1055544 - protein, 25 aa, Mycobacterium
SNQGFLRCVAALARAADSIGETDEY

SEQ ID NO: 1055545 - protein, 20 aa, Mycobacterium
SNRLPYAWNPAYPARIGVMP

SEQ ID NO: 1055546 - protein, 21 aa, Mycobacterium
SNTCSYCLSAHTYTGQRLAGL

SEQ ID NO: 1055547 - protein, 17 aa, Mycobacterium
SNTEPLLRLNVEARSAG

SEQ ID NO: 1055548 - protein, 32 aa, Mycobacterium; identical to SEQ ID NO: 732958

SEQ ID NO: 1055549 - protein, 24 aa, Mycobacterium
SNWPERDRAIIFTALLTGLRADEL

SEQ ID NO: 1055550 - protein, 17 aa, Mycobacterium
SPAAGGGTLLRWSAPLI

SEQ ID NO: 1055551 - protein, 18 aa, Mycobacterium
SPAARRRTYGDLAHADID

SEQ ID NO: 1055552 - protein, 17 aa, Mycobacterium
SPADIAVILPVMTIVGD

SEQ ID NO: 1055553 - protein, 19 aa, Mycobacterium
SPALPGLSYVVMDEVHFLA

SEQ ID NO: 1055554 - protein, 22 aa, Mycobacterium
SPARGSRHLGFAKALVHEMPHT

SEQ ID NO: 1055555 - protein, 21 aa, Mycobacterium
SPCSTPPTWATSSCCGPGPSN

SEQ ID NO: 1055556 - protein, 19 aa, Mycobacterium
SPDEFSGKILAPAHLPQEQ

SEQ ID NO: 1055557 - protein, 19 aa, Mycobacterium
SPDLLRFVAQRTLDSNTAN

SEQ ID NO: 1055558 - protein, 24 aa, Mycobacterium
SPDPRAELLAALQALAAGDPHPQL

SEQ ID NO: 1055559 - protein, 26 aa, Mycobacterium
SPEAIVRPRWLWKFGKTLRPPDLRVP

SEQ ID NO: 1055560 - protein, 27 aa, Mycobacterium
SPERLRLGALARHIAEELPLLGSCTVN

SEQ ID NO: 1055561 - protein, 23 aa, Mycobacterium
SPFPADGRDPWRLDGPWRTPLIA

SEQ ID NO: 1055562 - protein, 18 aa, Mycobacterium
SPGADFGPGGAFHAAGRC

SEQ ID NO: 1055563 - protein, 18 aa, Mycobacterium
SPGFTLYSLSGHVTRPGQ

SEQ ID NO: 1055564 - protein, 26 aa, Mycobacterium
SPGHGGNGGNAFLFGDGGTGGQGGTG

SEQ ID NO: 1055565 - protein, 18 aa, Mycobacterium
SPGLMLAMGPGFCAELVL

SEQ ID NO: 1055566 - protein, 20 aa, Mycobacterium
SPHLEAFRAKGYEVLLLTEP

SEQ ID NO: 1055567 - protein, 19 aa, Mycobacterium
SPIGKRNGWLSGLHATELL

SEQ ID NO: 1055568 - protein, 19 aa, Mycobacterium
SPIRLRTVAATVFTRPEIA

SEQ ID NO: 1055569 - protein, 20 aa, Mycobacterium
SPKLPVPNLIVFDDAHAGEQ

SEQ ID NO: 1055570 - protein, 20 aa, Mycobacterium
SPKSGFWSRSTIGSFSSLNS

SEQ ID NO: 1055571 - protein, 20 aa, Mycobacterium
SPKTTVTFFDGRTASFTVVG

SEQ ID NO: 1055572 - protein, 18 aa, Mycobacterium
SPLAFTLELTGFSRAAVQ

SEQ ID NO: 1055573 - protein, 17 aa, Mycobacterium
SPLALARQALASLPKID

SEQ ID NO: 1055574 - protein, 19 aa, Mycobacterium
SPLAVLAPRSPADCFETAL

SEQ ID NO: 1055575 - protein, 17 aa, Mycobacterium
SPLDEFHRLAVNAFALL

SEQ ID NO: 1055576 - protein, 26 aa, Mycobacterium
SPLQAAEQEVLAVINAPTNALLGRPL

SEQ ID NO: 1055577 - protein, 25 aa, Mycobacterium
SPLRTVREFREFADLMPSPVIGENI

SEQ ID NO: 1055578 - protein, 19 aa, Mycobacterium
SPMDPKLYLLWAQANATAG

SEQ ID NO: 1055579 - protein, 18 aa, Mycobacterium
SPMIGGLGYVLAPGPAAY

SEQ ID NO: 1055580 - protein, 35 aa, Mycobacterium; identical to SEQ ID NO: 733245

SEQ ID NO: 1055581 - protein, 27 aa, Mycobacterium
SPPEFANRVADAWIKAQAYRLQTFGTV

SEQ ID NO: 1055582 - protein, 27 aa, Mycobacterium
SPPEPARPNSHPGLPPSPPAPPAPPAV

SEQ ID NO: 1055583 - protein, 32 aa, Mycobacterium
SPPSPPLPPAWPPRPEMLPSAPLAPLPPLPPA

SEQ ID NO: 1055584 - protein, 18 aa, Mycobacterium
SPQAQRMLKFAFNLLDDG

SEQ ID NO: 1055585 - protein, 17 aa, Mycobacterium
SPQRLWEALLRGDDLVT

SEQ ID NO: 1055586 - protein, 23 aa, Mycobacterium
SPRADPQVPVFALGRYAGARRYA

SEQ ID NO: 1055587 - protein, 23 aa, Mycobacterium
SPRLDRLAGEAILFTRAHATAPL

SEQ ID NO: 1055588 - protein, 24 aa, Mycobacterium
SPRSNYAKSLRMFAVLPTIVAADM

SEQ ID NO: 1055589 - protein, 21 aa, Mycobacterium
SPSCAVYGSSVLILPDASIDA

SEQ ID NO: 1055590 - protein, 19 aa, Mycobacterium
SPSGPRLAGSLGTSLLSLS

SEQ ID NO: 1055591 - protein, 22 aa, Mycobacterium
SPSGRWRCAILPHVQAGCQAAS

SEQ ID NO: 1055592 - protein, 22 aa, Mycobacterium
SPSPFHLCATVARRLLNAGYTE

SEQ ID NO: 1055593 - protein, 17 aa, Mycobacterium
SPSRQAYTLSLFASLAM

SEQ ID NO: 1055594 - protein, 18 aa, Mycobacterium
SPTAPYLAGRRGAGWLKV

SEQ ID NO: 1055595 - protein, 24 aa, Mycobacterium
SPTGARLAGRHGIGLLSIGATLTI

SEQ ID NO: 1055596 - protein, 28 aa, Mycobacterium
SPTPGFCAQARCATTIYTPTRCRIGNPC

SEQ ID NO: 1055597 - protein, 22 aa, Mycobacterium
SPTRPPSPPAPPFPATDPPSPP

SEQ ID NO: 1055598 - protein, 18 aa, Mycobacterium
SPTRVRIKVEVPFAELEP

SEQ ID NO: 1055599 - protein, 18 aa, Mycobacterium
SPVAQGWLHSFLASPPPR

SEQ ID NO: 1055600 - protein, 20 aa, Mycobacterium
SPVGDGMRAMIAMSGTGRIG

SEQ ID NO: 1055601 - protein, 20 aa, Mycobacterium
SPVRGRATLTVFDRHLGQAE

SEQ ID NO: 1055602 - protein, 17 aa, Mycobacterium
SPWIGNIDLSFPYLDTA

SEQ ID NO: 1055603 - protein, 27 aa, Mycobacterium
SQAGCGMACPFCATGQGGLTRNLSTAE

SEQ ID NO: 1055604 - protein, 20 aa, Mycobacterium
SQAPPVMQICHHLHGGMGMD

SEQ ID NO: 1055605 - protein, 21 aa, Mycobacterium
SQARQGIGFGKGQVAEARVGA

SEQ ID NO: 1055606 - protein, 23 aa, Mycobacterium
SQCAKRFAGGQMFFDLPPTIVKR

SEQ ID NO: 1055607 - protein, 17 aa, Mycobacterium
SQDSFGLADKAWVLDEL

SEQ ID NO: 1055608 - protein, 24 aa, Mycobacterium
SQELSDLIFNLGIGNIGFGNLGDN

SEQ ID NO: 1055609 - protein, 21 aa, Mycobacterium
SQFTHCIDIAPTVLQAIGLPE

SEQ ID NO: 1055610 - protein, 20 aa, Mycobacterium
SQGMGPFLIGLAMGDAGGYK

SEQ ID NO: 1055611 - protein, 20 aa, Mycobacterium
SQIRPGDLVFPHPGHVQLAI

SEQ ID NO: 1055612 - protein, 23 aa, Mycobacterium
SQKRLAIEGGLPAVRTSLYADPQ

SEQ ID NO: 1055613 - protein, 25 aa, Mycobacterium
SQKYLPRWLSEGLNRLLGGEHVFTD

SEQ ID NO: 1055614 - protein, 18 aa, Mycobacterium
SQLKPVFRPNGTVTAGNA

SEQ ID NO: 1055615 - protein, 22 aa, Mycobacterium
SQLLGVVMARHIVKIEPFASLP

SEQ ID NO: 1055616 - protein, 18 aa, Mycobacterium
SQRLYSWAQERPYTTPFV

SEQ ID NO: 1055617 - protein, 28 aa, Mycobacterium
SQRVGLPGIWYAGSHGFELTAPDGTHHQ

SEQ ID NO: 1055618 - protein, 19 aa, Mycobacterium
SQSAMFLTTYINAVDPLAE

SEQ ID NO: 1055619 - protein, 26 aa, Mycobacterium
SQSLRPVLFSTFLMWVLADLFTYLPE

SEQ ID NO: 1055620 - protein, 24 aa, Mycobacterium
SQSRAARHFRIFQRLHAERHELPL

SEQ ID NO: 1055621 - protein, 19 aa, Mycobacterium
SQTPAGCSLMEWENNDNGR

SEQ ID NO: 1055622 - protein, 24 aa, Mycobacterium
SQTSLWLTFSYKGECIESNLIDAF

SEQ ID NO: 1055623 - protein, 25 aa, Mycobacterium
SQVFDGDLLFLEWAADSAHHRVDDD

SEQ ID NO: 1055624 - protein, 18 aa, Mycobacterium
SQVRAAWHVSDLPTAPGR

SEQ ID NO: 1055625 - protein, 17 aa, Mycobacterium
SQWLIAVRMVSEGVDIP

SEQ ID NO: 1055626 - protein, 20 aa, Mycobacterium
SRAAACVGFAHHVLEGLETR

SEQ ID NO: 1055627 - protein, 20 aa, Mycobacterium
SRADALAWSVKLVGEHTEEW

SEQ ID NO: 1055628 - protein, 18 aa, Mycobacterium
SRAFASSCNTTFAELSSK

SEQ ID NO: 1055629 - protein, 18 aa, Mycobacterium
SRAGWLRWSDKLAAAPLP

SEQ ID NO: 1055630 - protein, 18 aa, Mycobacterium
SRAPRWAIAYKYPPEEAQ

SEQ ID NO: 1055631 - protein, 25 aa, Mycobacterium
SRAQREGRRIYGRIAAIRTNHNGKG

SEQ ID NO: 1055632 - protein, 19 aa, Mycobacterium
SRATLGRPIELAFDTTRLT

SEQ ID NO: 1055633 - protein, 23 aa, Mycobacterium
SRAWSVLPCTVWPTRAAAPPHRM

SEQ ID NO: 1055634 - protein, 25 aa, Mycobacterium
SRCCCAIPVRFGRAAGLVAVVGNEI

SEQ ID NO: 1055635 - protein, 25 aa, Mycobacterium
SRDFAAEAAFVFAMIAVDLSRLAED

SEQ ID NO: 1055636 - protein, 25 aa, Mycobacterium
SREFHVCVVDAPTLHNVAEALRNQF

SEQ ID NO: 1055637 - protein, 18 aa, Mycobacterium
SREIEVLEFVPAEEVDPM

SEQ ID NO: 1055638 - protein, 19 aa, Mycobacterium
SREIYEAPGAMVLITAHAE

SEQ ID NO: 1055639 - protein, 22 aa, Mycobacterium
SRFCARLWFRPNGPRSPIPNDS

SEQ ID NO: 1055640 - protein, 24 aa, Mycobacterium
SRFDRGGVIFAEFEPGRSMLGTIE

SEQ ID NO: 1055641 - protein, 19 aa, Mycobacterium
SRFPPGWRLSMKSRAKDGT

SEQ ID NO: 1055642 - protein, 21 aa, Mycobacterium
SRFRHSMTMRRLRGETGSSGV

SEQ ID NO: 1055643 - protein, 19 aa, Mycobacterium
SRFRVRMTAYFVFDEAEAL

SEQ ID NO: 1055644 - protein, 20 aa, Mycobacterium
SRFTELFATVRIRLQEAVDR

SEQ ID NO: 1055645 - protein, 29 aa, Mycobacterium
SRFVATVYERLWRPAAFYLASGVTTRAEQ

SEQ ID NO: 1055646 - protein, 19 aa, Mycobacterium
SRGALLIHGHLDVVPAEAA

SEQ ID NO: 1055647 - protein, 24 aa, Mycobacterium
SRGEPHRDICLIPSSAHGTNAASA

SEQ ID NO: 1055648 - protein, 25 aa, Mycobacterium
SRGGLGEVLGCILGGGSVDKSLGSI

SEQ ID NO: 1055649 - protein, 19 aa, Mycobacterium
SRGTRRFCENGGCTFLGEH

SEQ ID NO: 1055650 - protein, 17 aa, Mycobacterium
SRHRWRVSQASLDDSGH

SEQ ID NO: 1055651 - protein, 17 aa, Mycobacterium
SRHVPLKSTLLAAHLAV

SEQ ID NO: 1055652 - protein, 28 aa, Mycobacterium
SRIATGPTVLTIRARPPGTTITEQQPTV

SEQ ID NO: 1055653 - protein, 21 aa, Mycobacterium
SRIGAKRARRVVDLGCGPGNL

SEQ ID NO: 1055654 - protein, 22 aa, Mycobacterium
SRIKLGQMCTAMSYRNPVYLAK

SEQ ID NO: 1055655 - protein, 17 aa, Mycobacterium
SRIRMLRSFDPSSGAYA

SEQ ID NO: 1055656 - protein, 25 aa, Mycobacterium
SRKPWRLNQDYLRDIHLIRRGKIDD

SEQ ID NO: 1055657 - protein, 17 aa, Mycobacterium
SRLAFIGALGPWGPLAT

SEQ ID NO: 1055658 - protein, 20 aa, Mycobacterium
SRLAGRPRRPARPTGLVLAP

SEQ ID NO: 1055659 - protein, 19 aa, Mycobacterium
SRLAQLRPGDPIVGEEGGG

SEQ ID NO: 1055660 - protein, 17 aa, Mycobacterium
SRLARIAPISREMVLNF

SEQ ID NO: 1055661 - protein, 23 aa, Mycobacterium
SRLARRGSGSASRSVFGGFSVWH

SEQ ID NO: 1055662 - protein, 21 aa, Mycobacterium
SRLGFDVCLDHSLASLHGGTE

SEQ ID NO: 1055663 - protein, 19 aa, Mycobacterium
SRLGPLFDSCRAENRAALI

SEQ ID NO: 1055664 - protein, 18 aa, Mycobacterium
SRLGPRSTVGLDFSPAAL

SEQ ID NO: 1055665 - protein, 21 aa, Mycobacterium
SRLHAKLFYQPLLESIAPAGL

SEQ ID NO: 1055666 - protein, 21 aa, Mycobacterium
SRLMPNLATVLGWSHCDHTGP

SEQ ID NO: 1055667 - protein, 17 aa, Mycobacterium
SRLVAYVVTHSGEQPEI

SEQ ID NO: 1055668 - protein, 23 aa, Mycobacterium
SRMADGEIKACWIICSNPVATVA

SEQ ID NO: 1055669 - protein, 23 aa, Mycobacterium
SRMRPDVVVAFMSRFGDVIYNNY

SEQ ID NO: 1055670 - protein, 27 aa, Mycobacterium
SRPDVVARLTADWVDRVVAGTGDAAAT

SEQ ID NO: 1055671 - protein, 18 aa, Mycobacterium
SRPHPCLSSTSYLSVGFA

SEQ ID NO: 1055672 - protein, 27 aa, Mycobacterium
SRPLDRARPLWELHVIHGLAGDRVALV

SEQ ID NO: 1055673 - protein, 21 aa, Mycobacterium
SRPPMAPSWMYMKSRSASVAS

SEQ ID NO: 1055674 - protein, 19 aa, Mycobacterium
SRPYLPLATLVVRGKPTDT

SEQ ID NO: 1055675 - protein, 21 aa, Mycobacterium
SRQLLAAQIIWTLARADIRGP

SEQ ID NO: 1055676 - protein, 24 aa, Mycobacterium
SRQRPEIDWFPWLAQQLRGASPGA

SEQ ID NO: 1055677 - protein, 17 aa, Mycobacterium
SRRGALMDHCLSVLLQA

SEQ ID NO: 1055678 - protein, 18 aa, Mycobacterium
SRRHPRLTAARAPDSGVK

SEQ ID NO: 1055679 - protein, 29 aa, Mycobacterium
SRRIFRSTRPWFRGCSHPPSSTSIPVSRP

SEQ ID NO: 1055680 - protein, 19 aa, Mycobacterium
SRRPTWWHCGCSPDAPIRT

SEQ ID NO: 1055681 - protein, 19 aa, Mycobacterium
SRRSAWWAGALTLGVAKIV

SEQ ID NO: 1055682 - protein, 23 aa, Mycobacterium
SRSAGNINPIWAYAHVPFGYAGD

SEQ ID NO: 1055683 - protein, 17 aa, Mycobacterium
SRSIDWKTPSGVHTYPL

SEQ ID NO: 1055684 - protein, 33 aa, Mycobacterium; identical to SEQ ID NO: 623906

SEQ ID NO: 1055685 - protein, 17 aa, Mycobacterium
SRSPVPIRAALPERLRS

SEQ ID NO: 1055686 - protein, 23 aa, Mycobacterium
SRSRANFAYYARRALARHPDALS

SEQ ID NO: 1055687 - protein, 25 aa, Mycobacterium
SRSWKAIEASGRFCVNVLTEKQKSV

SEQ ID NO: 1055688 - protein, 19 aa, Mycobacterium
SRTAGRWVETMLRVPDIRA

SEQ ID NO: 1055689 - protein, 18 aa, Mycobacterium
SRTLARLGLANYFAAAAV

SEQ ID NO: 1055690 - protein, 18 aa, Mycobacterium
SRVASGFVGLRVVPWLWE

SEQ ID NO: 1055691 - protein, 18 aa, Mycobacterium
SRVLPMYVGDDLTDEDAF

SEQ ID NO: 1055692 - protein, 19 aa, Mycobacterium
SRVRLSTAMALPVEHDPIT

SEQ ID NO: 1055693 - protein, 17 aa, Mycobacterium
SRWNAGKDLSFVPLRPE

SEQ ID NO: 1055694 - protein, 27 aa, Mycobacterium
SRYFRLLPQRLVERIAPKPGTGPSAAT

SEQ ID NO: 1055695 - protein, 18 aa, Mycobacterium
SRYGNLIGGEWVAPARGR

SEQ ID NO: 1055696 - protein, 18 aa, Mycobacterium
SRYLTLISGVTTVLLTGV

SEQ ID NO: 1055697 - protein, 22 aa, Mycobacterium
SRYTLNSGRGMRVRILTYGGII

SEQ ID NO: 1055698 - protein, 20 aa, Mycobacterium
SSAEQVRWVLEDSGAVLAVA

SEQ ID NO: 1055699 - protein, 20 aa, Mycobacterium
SSAGSLRPSADIIPYAAAKA

SEQ ID NO: 1055700 - protein, 19 aa, Mycobacterium
SSAIPFVFEPVRVRGATWV

SEQ ID NO: 1055701 - protein, 18 aa, Mycobacterium
SSALRGRQLVDLEEIGER

SEQ ID NO: 1055702 - protein, 20 aa, Mycobacterium
SSAPDMLRFVEANISPEGLP

SEQ ID NO: 1055703 - protein, 23 aa, Mycobacterium
SSAPDWLPRASVVHRSGTTTYPI

SEQ ID NO: 1055704 - protein, 20 aa, Mycobacterium
SSAPIRPAAATTRAAAKTGP

SEQ ID NO: 1055705 - protein, 25 aa, Mycobacterium
SSAQRFLTLDAFVAAGFQVVALLNE

SEQ ID NO: 1055706 - protein, 17 aa, Mycobacterium
SSARAALFDVQRAVEAT

SEQ ID NO: 1055707 - protein, 18 aa, Mycobacterium
SSDLRRWLPMDMNRPLKS

SEQ ID NO: 1055708 - protein, 19 aa, Mycobacterium
SSDQLLFDGLPWVSRAQEE

SEQ ID NO: 1055709 - protein, 18 aa, Mycobacterium
SSDYVGVYANDYWGPATV

SEQ ID NO: 1055710 - protein, 18 aa, Mycobacterium
SSEIMRLLIAREAVDAHL

SEQ ID NO: 1055711 - protein, 32 aa, Mycobacterium; identical to SEQ ID NO: 734192

SEQ ID NO: 1055712 - protein, 25 aa, Mycobacterium
SSEPIAIVGMSCRFPGGVDSPEGLW

SEQ ID NO: 1055713 - protein, 18 aa, Mycobacterium
SSFAPRPRMLVFVPSTSP

SEQ ID NO: 1055714 - protein, 21 aa, Mycobacterium
SSFDMCTGRLFAASLLPGAPE

SEQ ID NO: 1055715 - protein, 23 aa, Mycobacterium
SSFPAALRKARTVLSDFSIEGIA

SEQ ID NO: 1055716 - protein, 19 aa, Mycobacterium
SSFQLRWAPSLRPEAGVVL

SEQ ID NO: 1055717 - protein, 28 aa, Mycobacterium
SSFTELCARAGLDLALDRAPALADVDPG

SEQ ID NO: 1055718 - protein, 24 aa, Mycobacterium
SSGAYCLTCGAPLSDPGDIIRDVR

SEQ ID NO: 1055719 - protein, 28 aa, Mycobacterium
SSGDFPVLWPVLTRWADNDMFGHLNNAV

SEQ ID NO: 1055720 - protein, 22 aa, Mycobacterium
SSGDRLGLPLACGLDVTNRQSF

SEQ ID NO: 1055721 - protein, 25 aa, Mycobacterium
SSGGPLAAGLLDWQAIRLGHPARDL

SEQ ID NO: 1055722 - protein, 24 aa, Mycobacterium
SSGIRGGGVLLYYDARTRSVQAYD

SEQ ID NO: 1055723 - protein, 20 aa, Mycobacterium
SSGKSIRAALAFGAGSACGD

SEQ ID NO: 1055724 - protein, 20 aa, Mycobacterium
SSGLLTVHLACRSLHEGESD

SEQ ID NO: 1055725 - protein, 23 aa, Mycobacterium
SSGPFFKAYVVNLLPGQFVQLFI

SEQ ID NO: 1055726 - protein, 25 aa, Mycobacterium
SSHRAFCNQLLWRRDEFGLGGDDAL

SEQ ID NO: 1055727 - protein, 20 aa, Mycobacterium
SSIDHWGRYAYANQPVVAGW

SEQ ID NO: 1055728 - protein, 19 aa, Mycobacterium
SSIGRVLRRDIVLKGRRSG

SEQ ID NO: 1055729 - protein, 18 aa, Mycobacterium
SSIMPGKVNPVLPEAVTQ

SEQ ID NO: 1055730 - protein, 19 aa, Mycobacterium
SSLAGRAMGASTFGSSSGG

SEQ ID NO: 1055731 - protein, 25 aa, Mycobacterium
SSLAMAAAVAPYVTWMGATATQAAQ

SEQ ID NO: 1055732 - protein, 17 aa, Mycobacterium
SSLASFEGQLGKWSRMD

SEQ ID NO: 1055733 - protein, 24 aa, Mycobacterium
SSLCSRADTELGRMATDYASERAA

SEQ ID NO: 1055734 - protein, 23 aa, Mycobacterium
SSLDELAKRLIVLVEPVEAIVDR

SEQ ID NO: 1055735 - protein, 25 aa, Mycobacterium
SSLDQGGPCARTVLDTAMLHQVIAG

SEQ ID NO: 1055736 - protein, 26 aa, Mycobacterium
SSLEAFLKRRIRSHGLVTASIAAAVQ

SEQ ID NO: 1055737 - protein, 21 aa, Mycobacterium
SSLPKLAGRAIDVRWDAPHSG

SEQ ID NO: 1055738 - protein, 18 aa, Mycobacterium
SSLQITRVAFHAIKAGEG

SEQ ID NO: 1055739 - protein, 21 aa, Mycobacterium
SSLQPRPAFVVHTQALLDRPP

SEQ ID NO: 1055740 - protein, 23 aa, Mycobacterium
SSLTELFAQIGMRQEPSHDDGFA

SEQ ID NO: 1055741 - protein, 27 aa, Mycobacterium
SSLTVFSGYRFLRHAAARGIPVAIINR

SEQ ID NO: 1055742 - protein, 17 aa, Mycobacterium
SSMPDPVKIILQALQGF

SEQ ID NO: 1055743 - protein, 18 aa, Mycobacterium
SSNFMLWQSAYAEYIFQD

SEQ ID NO: 1055744 - protein, 22 aa, Mycobacterium
SSNPGINFGLGNWGNGNFGIGN

SEQ ID NO: 1055745 - protein, 31 aa, Mycobacterium
SSPNEIAHILVLRSRFDGGFTSEVRGVFTYR

SEQ ID NO: 1055746 - protein, 26 aa, Mycobacterium
SSPPDCTPWVIGGLWPTELSRDAPET

SEQ ID NO: 1055747 - protein, 21 aa, Mycobacterium
SSRGEMRWAPGRLWNSPNESA

SEQ ID NO: 1055748 - protein, 19 aa, Mycobacterium
SSRYWPADEYRAGVVQNSF

SEQ ID NO: 1055749 - protein, 19 aa, Mycobacterium
SSSDFPRTVIDGIRDASSH

SEQ ID NO: 1055750 - protein, 21 aa, Mycobacterium
SSSGHPWWTLSQLSEESATEL

SEQ ID NO: 1055751 - protein, 28 aa, Mycobacterium
SSSGYNWSCGFAGYLVGRIDMSAQVEQL

SEQ ID NO: 1055752 - protein, 26 aa, Mycobacterium
SSSIWPPGACGWPCRTSPMPTRCRTA

SEQ ID NO: 1055753 - protein, 22 aa, Mycobacterium
SSSLSAIHLACQSLRLRETDLA

SEQ ID NO: 1055754 - protein, 20 aa, Mycobacterium
SSSLVAIHLACQSLRMQDSN

SEQ ID NO: 1055755 - protein, 21 aa, Mycobacterium
SSSLVAIHLACQSLRWRETDM

SEQ ID NO: 1055756 - protein, 20 aa, Mycobacterium
SSSLVALHLACQSLRLRESD

SEQ ID NO: 1055757 - protein, 18 aa, Mycobacterium
SSSLVAVHLACLSLLSGE

SEQ ID NO: 1055758 - protein, 18 aa, Mycobacterium
SSTCWPRSTATMCTKLSQ

SEQ ID NO: 1055759 - protein, 24 aa, Mycobacterium
SSTQRLRLGTSVIQLSARTPTACA

SEQ ID NO: 1055760 - protein, 18 aa, Mycobacterium
SSVTSGLAGDAWQGAASA

SEQ ID NO: 1055761 - protein, 17 aa, Mycobacterium
SSWTPRRSQLPRACPLP

SEQ ID NO: 1055762 - protein, 18 aa, Mycobacterium
STAADVFCVTVSAGLEEP

SEQ ID NO: 1055763 - protein, 43 aa, Mycobacterium; identical to SEQ ID NO: 734497

SEQ ID NO: 1055764 - protein, 22 aa, Mycobacterium
STAEHFAKIGFKNHKHSVNNPF

SEQ ID NO: 1055765 - protein, 19 aa, Mycobacterium
STAIAALFAGHAREYHSLS

SEQ ID NO: 1055766 - protein, 19 aa, Mycobacterium
STAIASLFSASAREYQIVS

SEQ ID NO: 1055767 - protein, 17 aa, Mycobacterium
STAMLLESDFRAEGDRP

SEQ ID NO: 1055768 - protein, 17 aa, Mycobacterium
STAPPRILWLDSAAPDQ

SEQ ID NO: 1055769 - protein, 21 aa, Mycobacterium
STATRALRSARECPMCAARCT

SEQ ID NO: 1055770 - protein, 23 aa, Mycobacterium
STAVSSRFPGAITDLQLSRDGTR

SEQ ID NO: 1055771 - protein, 24 aa, Mycobacterium
STDDFPIPRRIIATSCDAEQVLAA

SEQ ID NO: 1055772 - protein, 25 aa, Mycobacterium
STDGAHGADGFSPITGGNGGDGGSG

SEQ ID NO: 1055773 - protein, 30 aa, Mycobacterium
STDGSWDAKSAWPGIELVAANHTEALRGVL

SEQ ID NO: 1055774 - protein, 26 aa, Mycobacterium
STDHRPELLLSFGFIPKVESRVGLIN

SEQ ID NO: 1055775 - protein, 21 aa, Mycobacterium
STELGRLTVPLGVAAATDDPI

SEQ ID NO: 1055776 - protein, 23 aa, Mycobacterium
STELTVLAGHDVVFLGLPHGHSA

SEQ ID NO: 1055777 - protein, 23 aa, Mycobacterium
STFIEVCYLLIYGELPATDQLAE

SEQ ID NO: 1055778 - protein, 24 aa, Mycobacterium
STFIEVCYLLIYGELPATDQLAEF

SEQ ID NO: 1055779 - protein, 17 aa, Mycobacterium
STFMQKWIAYTAKIIEA

SEQ ID NO: 1055780 - protein, 25 aa, Mycobacterium
STGGGGLLLPLGVRSLRAYGPTRNA

SEQ ID NO: 1055781 - protein, 25 aa, Mycobacterium
STGQPLDWFCLFSSGAALMGSPGQG

SEQ ID NO: 1055782 - protein, 20 aa, Mycobacterium
STGSGVGYVGGDGGTGGIGG

SEQ ID NO: 1055783 - protein, 17 aa, Mycobacterium
STHAAVWAVDEAVSRDI

SEQ ID NO: 1055784 - protein, 18 aa, Mycobacterium
STHFDWALAPYDVTASRA

SEQ ID NO: 1055785 - protein, 18 aa, Mycobacterium
STIALGILHRLAATVAKV

SEQ ID NO: 1055786 - protein, 17 aa, Mycobacterium
STIGRRLAKALGVSLLD

SEQ ID NO: 1055787 - protein, 19 aa, Mycobacterium
STIKRSQVVVLYFGRSQPG

SEQ ID NO: 1055788 - protein, 27 aa, Mycobacterium
STITPRWLLHLLNWVPVEAGVYRVNRV

SEQ ID NO: 1055789 - protein, 22 aa, Mycobacterium
STKDLKDAFTFNVATAHALTVA

SEQ ID NO: 1055790 - protein, 21 aa, Mycobacterium
STLEYKGFPKSCCTSLNEVIC

SEQ ID NO: 1055791 - protein, 17 aa, Mycobacterium
STLGLDFMRSCSIKHQM

SEQ ID NO: 1055792 - protein, 25 aa, Mycobacterium
STLQRPSMRGVPFSFIRVDRAGNMS

SEQ ID NO: 1055793 - protein, 21 aa, Mycobacterium
STLRGDFLWCQLFSEPGAGSD

SEQ ID NO: 1055794 - protein, 24 aa, Mycobacterium
STNLPRVLGGLGVAIISTSSGLLT

SEQ ID NO: 1055795 - protein, 20 aa, Mycobacterium
STPDLSGRRAVVIGNGNVAI

SEQ ID NO: 1055796 - protein, 24 aa, Mycobacterium
STPGCTKQACDFRDNLSELNEAGL

SEQ ID NO: 1055797 - protein, 18 aa, Mycobacterium
STPLLRPIMDALLPTMPV

SEQ ID NO: 1055798 - protein, 25 aa, Mycobacterium
STPNGLYPFTGIKDLSLDISLARGA

SEQ ID NO: 1055799 - protein, 18 aa, Mycobacterium
STPTRTAVDIAQAMDAVG

SEQ ID NO: 1055800 - protein, 19 aa, Mycobacterium
STPVGTLFIQPRVDTRGQQ

SEQ ID NO: 1055801 - protein, 27 aa, Mycobacterium
STRAESRWFAGAGFSLVNMTGYPEAVL

SEQ ID NO: 1055802 - protein, 18 aa, Mycobacterium
STRFFPMLTTAAGTVKPA

SEQ ID NO: 1055803 - protein, 25 aa, Mycobacterium
STRQSRKGLISSWKAFAPAWAGKVA

SEQ ID NO: 1055804 - protein, 17 aa, Mycobacterium
STSEILAAGTDEISTAV

SEQ ID NO: 1055805 - protein, 21 aa, Mycobacterium
STTNLAGWVNKVGVWSASERH

SEQ ID NO: 1055806 - protein, 25 aa, Mycobacterium
STTTFKIKNMWGLLTVKGEFTNFGG

SEQ ID NO: 1055807 - protein, 26 aa, Mycobacterium
STTWPKLKGAPMLGISVLGEAHDEAA

SEQ ID NO: 1055808 - protein, 40 aa, Mycobacterium; identical to SEQ ID NO: 734814

SEQ ID NO: 1055809 - protein, 25 aa, Mycobacterium
STVGAHGADGFSPITGGNGGGGGNG

SEQ ID NO: 1055810 - protein, 17 aa, Mycobacterium
STVGLDFSPAALQAARD

SEQ ID NO: 1055811 - protein, 26 aa, Mycobacterium
STVGSAALWRAARSGLEGDLVDLTGP

SEQ ID NO: 1055812 - protein, 29 aa, Mycobacterium
STVSSIFLMCLPDRVLAYGDCAIIPNPTV

SEQ ID NO: 1055813 - protein, 25 aa, Mycobacterium
STVVASLFSRYAQAYQVLGADMAAI

SEQ ID NO: 1055814 - protein, 24 aa, Mycobacterium
STWYFGAGELDAWEVWARVAEQLG

SEQ ID NO: 1055815 - protein, 19 aa, Mycobacterium
STYIRSCVDAGDMMAATEA

SEQ ID NO: 1055816 - protein, 23 aa, Mycobacterium
SVACQEFISQLGRNFQVIYEQAN

SEQ ID NO: 1055817 - protein, 23 aa, Mycobacterium
SVAKIAFTGAVLGGGGIALAGHA

SEQ ID NO: 1055818 - protein, 23 aa, Mycobacterium
SVAQRIGADPARAILEIVGGQGP

SEQ ID NO: 1055819 - protein, 22 aa, Mycobacterium
SVATLFGHCLGAGLELPLGCTF

SEQ ID NO: 1055820 - protein, 24 aa, Mycobacterium
SVAYRLGRSVARMEAALSAPSIFG

SEQ ID NO: 1055821 - protein, 21 aa, Mycobacterium
SVCYLPLTYDHRLVDGADAGR

SEQ ID NO: 1055822 - protein, 24 aa, Mycobacterium
SVDAVLVAQAWHWVDPARAIPEVA

SEQ ID NO: 1055823 - protein, 30 aa, Mycobacterium
SVDGGVVVSGRWPFCSGINHADMMFAGCFV

SEQ ID NO: 1055824 - protein, 20 aa, Mycobacterium
SVDLAIPMIGMLKRKAERRL

SEQ ID NO: 1055825 - protein, 19 aa, Mycobacterium
SVDSILFITVARFFGLRGP

SEQ ID NO: 1055826 - protein, 23 aa, Mycobacterium
SVDVRLDCMFRVFNNTRYTHIDP

SEQ ID NO: 1055827 - protein, 19 aa, Mycobacterium
SVDYMYSFDPDWSRDWQWS

SEQ ID NO: 1055828 - protein, 23 aa, Mycobacterium
SVEARLLVAAAISFIEDVARTWH

SEQ ID NO: 1055829 - protein, 24 aa, Mycobacterium
SVELAKSGAWCVAADFSVGMLAAG

SEQ ID NO: 1055830 - protein, 17 aa, Mycobacterium
SVELCRTQLALGHDTHT

SEQ ID NO: 1055831 - protein, 17 aa, Mycobacterium
SVEPVDLMLAAAQQAAD

SEQ ID NO: 1055832 - protein, 21 aa, Mycobacterium
SVFDREWPLRVGDINRTGRLR

SEQ ID NO: 1055833 - protein, 18 aa, Mycobacterium
SVFGRRLHRCFGRVGVQG

SEQ ID NO: 1055834 - protein, 19 aa, Mycobacterium
SVFGRRLHRCFGRVGVQGW

SEQ ID NO: 1055835 - protein, 18 aa, Mycobacterium
SVGDLVLAHGYEIGTGRH

SEQ ID NO: 1055836 - protein, 17 aa, Mycobacterium
SVGGLKVPQAWAEANQA

SEQ ID NO: 1055837 - protein, 21 aa, Mycobacterium
SVGLKPGFVVVVPVVRKEFKG

SEQ ID NO: 1055838 - protein, 20 aa, Mycobacterium
SVGRGEIFGFLGPSGAGKST

SEQ ID NO: 1055839 - protein, 27 aa, Mycobacterium
SVHREWLLIELRTDWSPKAGADDAAKT

SEQ ID NO: 1055840 - protein, 24 aa, Mycobacterium
SVHVPLRWVGPIKISGNEGQFSAH

SEQ ID NO: 1055841 - protein, 18 aa, Mycobacterium
SVIARHYLDVAALTDEEV

SEQ ID NO: 1055842 - protein, 17 aa, Mycobacterium
SVINYPASIGILSGSLA

SEQ ID NO: 1055843 - protein, 23 aa, Mycobacterium
SVKGEVIASTFDRPPSDHTSAAE

SEQ ID NO: 1055844 - protein, 22 aa, Mycobacterium
SVKGEVIASTFDRPPSDHTSVA

SEQ ID NO: 1055845 - protein, 23 aa, Mycobacterium
SVKGEVIASTFDRPPSDHTSVAE

SEQ ID NO: 1055846 - protein, 24 aa, Mycobacterium
SVLEGRLAAWAVELDAAAGRAVSA

SEQ ID NO: 1055847 - protein, 18 aa, Mycobacterium
SVLLQAWGDDPFEYDGRL

SEQ ID NO: 1055848 - protein, 18 aa, Mycobacterium
SVLPALGEEGIYIVTWTD

SEQ ID NO: 1055849 - protein, 20 aa, Mycobacterium
SVLPALGEEGIYIVTWTDLD

SEQ ID NO: 1055850 - protein, 20 aa, Mycobacterium
SVLPPLAPEIMAESKRWAFY

SEQ ID NO: 1055851 - protein, 32 aa, Mycobacterium
SVLPTSTCATSFCWWHRGARRPFWARPAKSAR

SEQ ID NO: 1055852 - protein, 19 aa, Mycobacterium
SVLRRLEGHFTLVFANADD

SEQ ID NO: 1055853 - protein, 21 aa, Mycobacterium
SVLSGDYWADLAITAGRGLLD

SEQ ID NO: 1055854 - protein, 25 aa, Mycobacterium
SVLTRSCKRWFGIGPAAYRAKTRVR

SEQ ID NO: 1055855 - protein, 17 aa, Mycobacterium
SVMACIFNFAGSEHSDY

SEQ ID NO: 1055856 - protein, 18 aa, Mycobacterium
SVMLRGTTGFGLKHELRS

SEQ ID NO: 1055857 - protein, 22 aa, Mycobacterium
SVNARIAVNLGAPVLLAVSAKG

SEQ ID NO: 1055858 - protein, 39 aa, Mycobacterium
SVPASPDARCGPRCAGRLGRSRTAANIGSHNWGIGNIGI

SEQ ID NO: 1055859 - protein, 31 aa, Mycobacterium
SVPDILVQGVLKWLAERGYDVVQSVTTANEA

SEQ ID NO: 1055860 - protein, 23 aa, Mycobacterium
SVPHYGIGYGLLRYLYAPTGRVL

SEQ ID NO: 1055861 - protein, 19 aa, Mycobacterium
SVPVGGLLAPTSVATLTLT

SEQ ID NO: 1055862 - protein, 18 aa, Mycobacterium
SVQLAVLVDRGHRELPVR

SEQ ID NO: 1055863 - protein, 29 aa, Mycobacterium
SVRAGRPRWRCRIRVRRHGCCGASAWCGY

SEQ ID NO: 1055864 - protein, 19 aa, Mycobacterium
SVRGCSQPIWADGTPHAVY

SEQ ID NO: 1055865 - protein, 22 aa, Mycobacterium
SVRWWRCSRRAVGCSNVTSPPS

SEQ ID NO: 1055866 - protein, 23 aa, Mycobacterium
SVSDALDILRWAPQAASEPVAKV

SEQ ID NO: 1055867 - protein, 19 aa, Mycobacterium
SVSGNIGAVGGNGGDGGDG

SEQ ID NO: 1055868 - protein, 19 aa, Mycobacterium
SVSLLLAHLGLDDTASRVD

SEQ ID NO: 1055869 - protein, 21 aa, Mycobacterium
SVSMTAQWWLDAREPKKEVVA

SEQ ID NO: 1055870 - protein, 20 aa, Mycobacterium
SVSRGEFIAVLGPNGTGKTS

SEQ ID NO: 1055871 - protein, 25 aa, Mycobacterium
SVSSSLVRRASCPVAVIRDEDPMIP

SEQ ID NO: 1055872 - protein, 22 aa, Mycobacterium
SVTAGLPGQAWQGSAAMQGSGV

SEQ ID NO: 1055873 - protein, 38 aa, Mycobacterium
SVTEARVARRAASRQASWLPARTASAVLAVTPGLSATV

SEQ ID NO: 1055874 - protein, 20 aa, Mycobacterium
SVTMPGKFAALQFADERTAR

SEQ ID NO: 1055875 - protein, 22 aa, Mycobacterium
SVTPGYLTMGGFIPAQDQLGWY

SEQ ID NO: 1055876 - protein, 20 aa, Mycobacterium
SVVATSIYGRLNCAIVNAQG

SEQ ID NO: 1055877 - protein, 20 aa, Mycobacterium
SVVEPLKLMPEPVPPAPPAP

SEQ ID NO: 1055878 - protein, 19 aa, Mycobacterium
SVVKLLAFAVSHGDEQLNQ

SEQ ID NO: 1055879 - protein, 18 aa, Mycobacterium
SVYEPAPRSPALGAGVPA

SEQ ID NO: 1055880 - protein, 27 aa, Mycobacterium
SVYLTRPSLFHFIRTAEEFSWRASELF

SEQ ID NO: 1055881 - protein, 21 aa, Mycobacterium
SWADVAMMLSIPYQGLGNAAI

SEQ ID NO: 1055882 - protein, 24 aa, Mycobacterium
SWDIFKCVRQVLEVFDPVDEPLPA

SEQ ID NO: 1055883 - protein, 25 aa, Mycobacterium
SWDLRKFLWAPKLGCYGIQRIHPLK

SEQ ID NO: 1055884 - protein, 18 aa, Mycobacterium
SWFPRYARHLGTDEPTLT

SEQ ID NO: 1055885 - protein, 19 aa, Mycobacterium
SWGAAPAPDALLCQMSEVF

SEQ ID NO: 1055886 - protein, 24 aa, Mycobacterium
SWHRWWPDLRLQVVEDRAEKGIRW

SEQ ID NO: 1055887 - protein, 33 aa, Mycobacterium
SWKDAAAPLWTFPRVAWERELLPGAQVVLAPTA

SEQ ID NO: 1055888 - protein, 20 aa, Mycobacterium
SWLAAHYDDLVGWRRHIHRY

SEQ ID NO: 1055889 - protein, 27 aa, Mycobacterium
SWPGVPGRPRRAGVSSFGISGTNAHVI

SEQ ID NO: 1055890 - protein, 35 aa, Mycobacterium
SWQRELWPTEEFELARSRIPIGLPETELFAGIESS

SEQ ID NO: 1055891 - protein, 23 aa, Mycobacterium
SWRSATCRMLAAAMGSRTANAGP

SEQ ID NO: 1055892 - protein, 18 aa, Mycobacterium
SWSSRPAAIRSWTAVICS

SEQ ID NO: 1055893 - protein, 18 aa, Mycobacterium
SWTEKVAAMAADEVSGAV

SEQ ID NO: 1055894 - protein, 20 aa, Mycobacterium
SWTPEGFFGRMLATIRPYRP

SEQ ID NO: 1055895 - protein, 27 aa, Mycobacterium
SWWRLAACPRPRWPRTTPTTWAATSQW

SEQ ID NO: 1055896 - protein, 18 aa, Mycobacterium
SYAEAAAISAVFTTAYYA

SEQ ID NO: 1055897 - protein, 18 aa, Mycobacterium
SYALKASPQFSDRRQAVA

SEQ ID NO: 1055898 - protein, 26 aa, Mycobacterium
SYALTKLHIKSCCATRSFVPLWDYNS

SEQ ID NO: 1055899 - protein, 21 aa, Mycobacterium
SYAQMASWCVLAACTHPDARK

SEQ ID NO: 1055900 - protein, 25 aa, Mycobacterium
SYHAELDWWTSPFVLTDGVPPLALA

SEQ ID NO: 1055901 - protein, 24 aa, Mycobacterium
SYIDYAMSVIVGRALPEVRDGLKP

SEQ ID NO: 1055902 - protein, 21 aa, Mycobacterium
SYIYYPDCAEVGIGAGAEIRG

SEQ ID NO: 1055903 - protein, 29 aa, Mycobacterium
SYKSCFLAMLRRFYELGVKELNGHLLYAL

SEQ ID NO: 1055904 - protein, 18 aa, Mycobacterium
SYLCVGVRTATPGPVSDY

SEQ ID NO: 1055905 - protein, 22 aa, Mycobacterium
SYLNKMLWILTGNFAKKGGQHL

SEQ ID NO: 1055906 - protein, 17 aa, Mycobacterium
SYLPVSFETLRVYSNPG

SEQ ID NO: 1055907 - protein, 34 aa, Mycobacterium; identical to SEQ ID NO: 735445

SEQ ID NO: 1055908 - protein, 18 aa, Mycobacterium
SYQCAIDAMSSRCFPSYA

SEQ ID NO: 1055909 - protein, 24 aa, Mycobacterium
SYQPEIWDYLKGVTEKYGLRRYVE

SEQ ID NO: 1055910 - protein, 24 aa, Mycobacterium
SYQPTLAGLRAFVAVAEKQHFGSA

SEQ ID NO: 1055911 - protein, 25 aa, Mycobacterium
SYRELPLRLFEFGTVYRYEKSGVVH

SEQ ID NO: 1055912 - protein, 20 aa, Mycobacterium
SYRRWCELMWHRASAPQVQD

SEQ ID NO: 1055913 - protein, 20 aa, Mycobacterium
SYSESFGLVAVEAQACGTRV

SEQ ID NO: 1055914 - protein, 20 aa, Mycobacterium
SYVAAPVMPTGKMIGFLHAD

SEQ ID NO: 1055915 - protein, 24 aa, Mycobacterium
SYVDAHAPYLAWLTTTSADYAATA

SEQ ID NO: 1055916 - protein, 23 aa, Mycobacterium
SYVQRMAKFLSGQLWESAGSPEV

SEQ ID NO: 1055917 - protein, 25 aa, Mycobacterium
TAAATRWPAVRFAVRNTAVQGPNAV

SEQ ID NO: 1055918 - protein, 23 aa, Mycobacterium
TAAAYPAAFPVGMLPTNQNDTGL

SEQ ID NO: 1055919 - protein, 33 aa, Mycobacterium
TAACALLVGKCCGHGSNIVLDFPVSRRVQPESS

SEQ ID NO: 1055920 - protein, 18 aa, Mycobacterium
TAACGLLVHGWDGGGPEV

SEQ ID NO: 1055921 - protein, 20 aa, Mycobacterium
TAAGACLAGSDARNAGGASA

SEQ ID NO: 1055922 - protein, 19 aa, Mycobacterium
TAAGFILDGYPRSVEQAKA

SEQ ID NO: 1055923 - protein, 25 aa, Mycobacterium
TAAGFKFTRIQSLQLHYAKTLDLWA

SEQ ID NO: 1055924 - protein, 24 aa, Mycobacterium
TAAGHRLDLLAGIRFLDQSPRRFL

SEQ ID NO: 1055925 - protein, 31 aa, Mycobacterium; identical to SEQ ID NO: 735543

SEQ ID NO: 1055926 - protein, 17 aa, Mycobacterium
TAAGLRSVATWLRTMFA

SEQ ID NO: 1055927 - protein, 26 aa, Mycobacterium
TAAGRAVFTPSLAGLVLGEYRRIAQT

SEQ ID NO: 1055928 - protein, 25 aa, Mycobacterium
TAAIARPDLLADMATQFGSQCIVLS

SEQ ID NO: 1055929 - protein, 24 aa, Mycobacterium
TAAIAVEFARLYAVELEHYEKLEG

SEQ ID NO: 1055930 - protein, 18 aa, Mycobacterium
TAAICDRMLELGVIIQPT

SEQ ID NO: 1055931 - protein, 19 aa, Mycobacterium
TAALAGLVDRFDLRGQRLG

SEQ ID NO: 1055932 - protein, 23 aa, Mycobacterium
TAALCAFGSALDPQFGPDSSAQH

SEQ ID NO: 1055933 - protein, 17 aa, Mycobacterium
TAALFALESPARVAEFT

SEQ ID NO: 1055934 - protein, 18 aa, Mycobacterium
TAALFTLDSPMHVSEFTE

SEQ ID NO: 1055935 - protein, 18 aa, Mycobacterium
TAALPSGAGLVVLDGTVT

SEQ ID NO: 1055936 - protein, 18 aa, Mycobacterium
TAALTRPGWHRRVTGMTC

SEQ ID NO: 1055937 - protein, 23 aa, Mycobacterium
TAAMSVQALINWGVAPDAGPVVV

SEQ ID NO: 1055938 - protein, 24 aa, Mycobacterium
TAAPAGPAARCPASAGTVEPAGSA

SEQ ID NO: 1055939 - protein, 21 aa, Mycobacterium
TAAPGSPWLADTWRDRFQQML

SEQ ID NO: 1055940 - protein, 17 aa, Mycobacterium
TAAQCDVIADALRSADV

SEQ ID NO: 1055941 - protein, 18 aa, Mycobacterium
TAARVAGVMWKRFTETGA

SEQ ID NO: 1055942 - protein, 22 aa, Mycobacterium
TAASDWQVEFDLPADESITNVW

SEQ ID NO: 1055943 - protein, 24 aa, Mycobacterium
TAATAWGGMAVELESAADSFASVT

SEQ ID NO: 1055944 - protein, 20 aa, Mycobacterium
TACDHVAFGVWTLWPVLVLF

SEQ ID NO: 1055945 - protein, 20 aa, Mycobacterium
TADAAITGRTAGPAVAAELA

SEQ ID NO: 1055946 - protein, 23 aa, Mycobacterium
TADLKGAVVDILISKTFDSSVIC

SEQ ID NO: 1055947 - protein, 19 aa, Mycobacterium
TADSLSFVLEDAVLTADSV

SEQ ID NO: 1055948 - protein, 17 aa, Mycobacterium
TADSSQRLYSWAQERPY

SEQ ID NO: 1055949 - protein, 18 aa, Mycobacterium
TADWECVQATLALGDLAE

SEQ ID NO: 1055950 - protein, 17 aa, Mycobacterium
TAEAFSRMFERDKNELR

SEQ ID NO: 1055951 - protein, 17 aa, Mycobacterium
TAEIVFKGRNVEIPDHF

SEQ ID NO: 1055952 - protein, 20 aa, Mycobacterium
TAELRRPDAVRVYVTGEGWR

SEQ ID NO: 1055953 - protein, 22 aa, Mycobacterium
TAENLRRQYGISRLEQDELAVT

SEQ ID NO: 1055954 - protein, 23 aa, Mycobacterium
TAERLGFTRYWVAEHHNMASVGA

SEQ ID NO: 1055955 - protein, 19 aa, Mycobacterium
TAERLQQVQSWLFNQPNTS

SEQ ID NO: 1055956 - protein, 25 aa, Mycobacterium
TAETVLVVLTCRAVAINAYERAPNP

SEQ ID NO: 1055957 - protein, 24 aa, Mycobacterium
TAFCDLETWDSCALDLSGSSGSLF

SEQ ID NO: 1055958 - protein, 24 aa, Mycobacterium
TAFPRLYGVQTRFFDDFFRSAAAG

SEQ ID NO: 1055959 - protein, 22 aa, Mycobacterium
TAFPRLYGVQTRFFDDFFSSAG

SEQ ID NO: 1055960 - protein, 18 aa, Mycobacterium
TAFRQAWGADPIDMGMGG

SEQ ID NO: 1055961 - protein, 18 aa, Mycobacterium
TAGDRPDVLVAMNPAALK

SEQ ID NO: 1055962 - protein, 17 aa, Mycobacterium
TAGFARHSSGLSVQTFL

SEQ ID NO: 1055963 - protein, 24 aa, Mycobacterium
TAGFYPEVVIAFDLADVDAQYHVP

SEQ ID NO: 1055964 - protein, 17 aa, Mycobacterium
TAGHQGGQGGMGGKGGD

SEQ ID NO: 1055965 - protein, 18 aa, Mycobacterium
TAGSGAKVLLAHSDPATQ

SEQ ID NO: 1055966 - protein, 20 aa, Mycobacterium
TAGSGEAWLAICPATPQLVQ

SEQ ID NO: 1055967 - protein, 20 aa, Mycobacterium
TAGTDRYGGYAADGGGGGGG

SEQ ID NO: 1055968 - protein, 20 aa, Mycobacterium
TAGYVKRAAAAFPHQGTEGP

SEQ ID NO: 1055969 - protein, 26 aa, Mycobacterium
TAHGPVRFPGVPTWFSRTPGRVLGPA

SEQ ID NO: 1055970 - protein, 28 aa, Mycobacterium
TAHSAEKPKCCWAAPAVATVTAVTTVET

SEQ ID NO: 1055971 - protein, 22 aa, Mycobacterium
TAHTRSGVIMGVRHTELPIHGV

SEQ ID NO: 1055972 - protein, 20 aa, Mycobacterium
TAHVMKQRRGALEGDPSGRY

SEQ ID NO: 1055973 - protein, 19 aa, Mycobacterium
TAHYLLKSVCPVADGDAIL

SEQ ID NO: 1055974 - protein, 19 aa, Mycobacterium
TAKAVGWSPTDWVDNTMDV

SEQ ID NO: 1055975 - protein, 24 aa, Mycobacterium
TAKGPAVVEFNCRFGDPETQAVLA

SEQ ID NO: 1055976 - protein, 23 aa, Mycobacterium
TAKPDALVPLARRVVGECLAEDL

SEQ ID NO: 1055977 - protein, 19 aa, Mycobacterium
TAKPGDFGLPTTIAAPVPE

SEQ ID NO: 1055978 - protein, 23 aa, Mycobacterium
TAKQVTALGRFFRIDGDEFAYSV

SEQ ID NO: 1055979 - protein, 24 aa, Mycobacterium
TAKQVTALGRFFRIDGDEFAYSVQ

SEQ ID NO: 1055980 - protein, 23 aa, Mycobacterium
TAKREIRLLSRFTGANPHVPIIG

SEQ ID NO: 1055981 - protein, 33 aa, Mycobacterium; identical to SEQ ID NO: 623966

SEQ ID NO: 1055982 - protein, 21 aa, Mycobacterium
TALIARWLATPGVRVVRVTGA

SEQ ID NO: 1055983 - protein, 17 aa, Mycobacterium
TALIYHATFAPRVAEVL

SEQ ID NO: 1055984 - protein, 21 aa, Mycobacterium
TALLGRPLIGNGADGAAPGQS

SEQ ID NO: 1055985 - protein, 20 aa, Mycobacterium
TALRFTCPYHGWTYDNGGRL

SEQ ID NO: 1055986 - protein, 20 aa, Mycobacterium
TALWEEWPPAGARASIHSYV

SEQ ID NO: 1055987 - protein, 20 aa, Mycobacterium
TALWELIWAGRVCGDTFVPV

SEQ ID NO: 1055988 - protein, 18 aa, Mycobacterium
TALYPPKRFLGAARNIEE

SEQ ID NO: 1055989 - protein, 17 aa, Mycobacterium
TAMARRVRQGELPPVDN

SEQ ID NO: 1055990 - protein, 19 aa, Mycobacterium
TAMWYAVVDGEIWLETKAK

SEQ ID NO: 1055991 - protein, 27 aa, Mycobacterium
TANYLYPRVEVEVGFILAADLPGADCT

SEQ ID NO: 1055992 - protein, 24 aa, Mycobacterium
TAPAPVRVGFRIGTPAVGELGLRD

SEQ ID NO: 1055993 - protein, 21 aa, Mycobacterium
TAPDASWMPAFEEMTRNNWLP

SEQ ID NO: 1055994 - protein, 29 aa, Mycobacterium
TAPPATYPAAMAARPAPVATAGTPGCSSA

SEQ ID NO: 1055995 - protein, 22 aa, Mycobacterium
TAPPPPWPAAPPAPAAPPTPPT

SEQ ID NO: 1055996 - protein, 21 aa, Mycobacterium
TAPPYPPSILLTGVIVNKLGR

SEQ ID NO: 1055997 - protein, 18 aa, Mycobacterium
TAPRERFSTLKARLGDAF

SEQ ID NO: 1055998 - protein, 21 aa, Mycobacterium
TAPTLPALRRYTGVLYDALDV

SEQ ID NO: 1055999 - protein, 23 aa, Mycobacterium
TAQAGAFHERFLQTLAASAASYE

SEQ ID NO: 1056000 - protein, 24 aa, Mycobacterium
TAQALKPWYGYFCKRPCFHDEYLQ

SEQ ID NO: 1056001 - protein, 25 aa, Mycobacterium
TAQDPRFRFFGNIKVGEHVEAADLA

SEQ ID NO: 1056002 - protein, 20 aa, Mycobacterium
TAQIKRWCEEAAAQFVDAPV

SEQ ID NO: 1056003 - protein, 20 aa, Mycobacterium
TAQRPAVFIFNHRNQVDPVI

SEQ ID NO: 1056004 - protein, 17 aa, Mycobacterium
TAQRPGDVLTQYGGTTV

SEQ ID NO: 1056005 - protein, 17 aa, Mycobacterium
TAQSIPWAKAVDESGRF

SEQ ID NO: 1056006 - protein, 27 aa, Mycobacterium
TARAVDAVTAWHGRLHGVVHCAGGSEN

SEQ ID NO: 1056007 - protein, 31 aa, Mycobacterium
TARESGPGLGTWWGSWRRFLPAGQGQPERRV

SEQ ID NO: 1056008 - protein, 21 aa, Mycobacterium
TARFIKFIVTEIFPGGRLPST

SEQ ID NO: 1056009 - protein, 23 aa, Mycobacterium
TARFKSPNPIHWANATHACTCEV

SEQ ID NO: 1056010 - protein, 19 aa, Mycobacterium
TARGGCQEVMLGYSDSNKD

SEQ ID NO: 1056011 - protein, 28 aa, Mycobacterium
TARGSRFRRVITMLKHWNRRQPVKLQSY

SEQ ID NO: 1056012 - protein, 22 aa, Mycobacterium
TARLRIPHQLRVGAPDQLEHDA

SEQ ID NO: 1056013 - protein, 25 aa, Mycobacterium
TARLRWSRRPEWGGLEVDADVVGTT

SEQ ID NO: 1056014 - protein, 23 aa, Mycobacterium
TARSCAEWAHLVAGTSSIREGSR

SEQ ID NO: 1056015 - protein, 24 aa, Mycobacterium
TASARLAGLLIQRGLRPGDRVGVM

SEQ ID NO: 1056016 - protein, 25 aa, Mycobacterium
TASIPRFADSVIRLKAELDPGTQAT

SEQ ID NO: 1056017 - protein, 23 aa, Mycobacterium
TASIWSRRRVLLLNSTYEPLTAL

SEQ ID NO: 1056018 - protein, 25 aa, Mycobacterium
TASKGKWDILRAMGFDEDHISDSRS

SEQ ID NO: 1056019 - protein, 24 aa, Mycobacterium
TASKGKWDTLRAMGFDEDHIGDSR

SEQ ID NO: 1056020 - protein, 25 aa, Mycobacterium
TASLLKYLIDHCGSPPPWAKEIDGA

SEQ ID NO: 1056021 - protein, 19 aa, Mycobacterium
TATGAGWAGPGDVWAGPVS

SEQ ID NO: 1056022 - protein, 18 aa, Mycobacterium
TATGRWYLQDRVIVAEAN

SEQ ID NO: 1056023 - protein, 23 aa, Mycobacterium
TATGVRYDSPFVCIFETKDGLIV

SEQ ID NO: 1056024 - protein, 18 aa, Mycobacterium
TATLRMVLAAIQTEEVSG

SEQ ID NO: 1056025 - protein, 18 aa, Mycobacterium
TATMDWTFGEVISYVSRG

SEQ ID NO: 1056026 - protein, 25 aa, Mycobacterium
TATRELDWWLGFSSTASLLGSPGQT

SEQ ID NO: 1056027 - protein, 21 aa, Mycobacterium
TAVACPRFVDFVERGVTSGRQ

SEQ ID NO: 1056028 - protein, 25 aa, Mycobacterium
TAVEALKAITINAAYQYSEEQSKGS

SEQ ID NO: 1056029 - protein, 17 aa, Mycobacterium
TAVEIDPAMARRLQERY

SEQ ID NO: 1056030 - protein, 26 aa, Mycobacterium
TAVEPRLWNMWTVLPILQDTTIVAVG

SEQ ID NO: 1056031 - protein, 18 aa, Mycobacterium
TAVEVLWRGQRLRALVAL

SEQ ID NO: 1056032 - protein, 24 aa, Mycobacterium
TAVHFRVSDLIPVYRAQRAELQRL

SEQ ID NO: 1056033 - protein, 17 aa, Mycobacterium
TAVHVYADVPGQAGGAG

SEQ ID NO: 1056034 - protein, 17 aa, Mycobacterium
TAVNDWLDENGDPKAAG

SEQ ID NO: 1056035 - protein, 22 aa, Mycobacterium
TAVNELMLFDAHNPRSLIYQLE

SEQ ID NO: 1056036 - protein, 22 aa, Mycobacterium
TAVPYRVPFPQVMPTQETQPAR

SEQ ID NO: 1056037 - protein, 22 aa, Mycobacterium
TAVYVCGPPPMLEAVRAARAEY

SEQ ID NO: 1056038 - protein, 21 aa, Mycobacterium
TAWLAEGLLMYLPAEAQDRLF

SEQ ID NO: 1056039 - protein, 22 aa, Mycobacterium
TAYGEWKGGWVDFDGTNLRVGA

SEQ ID NO: 1056040 - protein, 24 aa, Mycobacterium
TAYLECAQACGLSLLGGPPSPETA

SEQ ID NO: 1056041 - protein, 18 aa, Mycobacterium
TAYLGERHRVVGTNRFLA

SEQ ID NO: 1056042 - protein, 17 aa, Mycobacterium
TCAQVWFQDEAAAARAF

SEQ ID NO: 1056043 - protein, 20 aa, Mycobacterium
TCGGCVYDGVALDGVQLRVA

SEQ ID NO: 1056044 - protein, 26 aa, Mycobacterium
TCHLRCHRRPIPVSLLGRYLGLIPKL

SEQ ID NO: 1056045 - protein, 23 aa, Mycobacterium
TCIRLWVLEVLYRCALWSQRCYE

SEQ ID NO: 1056046 - protein, 20 aa, Mycobacterium
TCLRRGEIEMVTRYELGAAD

SEQ ID NO: 1056047 - protein, 19 aa, Mycobacterium
TCLRRGEIEMVTRYEPDVV

SEQ ID NO: 1056048 - protein, 25 aa, Mycobacterium
TCLSEARYGIVWGAMGAARSAWQCA

SEQ ID NO: 1056049 - protein, 20 aa, Mycobacterium
TCPYHGWTYDNGGRLVGLPG

SEQ ID NO: 1056050 - protein, 17 aa, Mycobacterium
TCQAAAVVPWDFDDDGM

SEQ ID NO: 1056051 - protein, 19 aa, Mycobacterium
TCRDGRIVTSTSWRLRIQG

SEQ ID NO: 1056052 - protein, 22 aa, Mycobacterium
TCTECPDGTVGEIWVCGDNVAI

SEQ ID NO: 1056053 - protein, 20 aa, Mycobacterium
TCYVSGRYAGPFGEDDLEVG

SEQ ID NO: 1056054 - protein, 17 aa, Mycobacterium
TDAAAVCGCPVGTIRSR

SEQ ID NO: 1056055 - protein, 17 aa, Mycobacterium
TDAARLTIRGPIVTADA

SEQ ID NO: 1056056 - protein, 19 aa, Mycobacterium
TDADVRAMFAPKLDAAALL

SEQ ID NO: 1056057 - protein, 20 aa, Mycobacterium
TDAETTWKLLLDNQSGIRML

SEQ ID NO: 1056058 - protein, 19 aa, Mycobacterium
TDAETTWKLLLDSQSGIRT

SEQ ID NO: 1056059 - protein, 21 aa, Mycobacterium
TDAGMRRWAGEVFAVYRDGLV

SEQ ID NO: 1056060 - protein, 18 aa, Mycobacterium
TDALCAQAVRLIFDALPR

SEQ ID NO: 1056061 - protein, 21 aa, Mycobacterium
TDALILGPLRIHFWVCGVFEV

SEQ ID NO: 1056062 - protein, 17 aa, Mycobacterium
TDAMLDWQTARFTELAV

SEQ ID NO: 1056063 - protein, 18 aa, Mycobacterium
TDAPRYAELIKRTQWWGR

SEQ ID NO: 1056064 - protein, 20 aa, Mycobacterium
TDECGSCAARTARAGGGVAG

SEQ ID NO: 1056065 - protein, 23 aa, Mycobacterium
TDEIKQRIMAMAQPDGGDNRPDV

SEQ ID NO: 1056066 - protein, 24 aa, Mycobacterium
TDEISTAVASLFADHAQDYRTISL

SEQ ID NO: 1056067 - protein, 24 aa, Mycobacterium
TDEISTAVASLFSGHGQAYQRLAN

SEQ ID NO: 1056068 - protein, 18 aa, Mycobacterium
TDEITDWQLASNAEHSST

SEQ ID NO: 1056069 - protein, 24 aa, Mycobacterium
TDEQFRIAYLFSQKVFGFAPYPAV

SEQ ID NO: 1056070 - protein, 24 aa, Mycobacterium
TDEVSAGIAALFEAHGNAYQTLGA

SEQ ID NO: 1056071 - protein, 22 aa, Mycobacterium
TDEVVDVVLLWWRDSDGDLVDT

SEQ ID NO: 1056072 - protein, 30 aa, Mycobacterium
TDFESYPQWHEWIKGVWVLAHYDDGRPSQL

SEQ ID NO: 1056073 - protein, 21 aa, Mycobacterium
TDGGSTFGGQLGGAGGAGGDG

SEQ ID NO: 1056074 - protein, 21 aa, Mycobacterium
TDGKVKWSVPLGFLAQTPPTV

SEQ ID NO: 1056075 - protein, 24 aa, Mycobacterium
TDGQWDPGKDFAMVTARETAPTQK

SEQ ID NO: 1056076 - protein, 24 aa, Mycobacterium
TDGVELRLRIGLNSGEVITGGIGP

SEQ ID NO: 1056077 - protein, 17 aa, Mycobacterium
TDGVMEWEYLVLTGTKK

SEQ ID NO: 1056078 - protein, 23 aa, Mycobacterium
TDHRPVVAIPPGWSCPQAASVPV

SEQ ID NO: 1056079 - protein, 24 aa, Mycobacterium
TDHSPRLTIANGLSAERLRRQLDV

SEQ ID NO: 1056080 - protein, 23 aa, Mycobacterium
TDIKPADLYALLRQAGQNHGPAF

SEQ ID NO: 1056081 - protein, 17 aa, Mycobacterium
TDIPVTVKFRIGIDDAH

SEQ ID NO: 1056082 - protein, 23 aa, Mycobacterium
TDIWDKGKAAVIWSETTVTTLDG

SEQ ID NO: 1056083 - protein, 23 aa, Mycobacterium
TDKAKSLLAKRGFDPVLGARPLR

SEQ ID NO: 1056084 - protein, 22 aa, Mycobacterium
TDKGRALAVAVMRKHRLAERLL

SEQ ID NO: 1056085 - protein, 23 aa, Mycobacterium
TDKYWPPVRRIDGVHGDRNLVCS

SEQ ID NO: 1056086 - protein, 21 aa, Mycobacterium
TDLDWARVLLLSEVTFASSLI

SEQ ID NO: 1056087 - protein, 24 aa, Mycobacterium
TDLEQRVADFLGFSTVLTSVGQVY

SEQ ID NO: 1056088 - protein, 18 aa, Mycobacterium
TDLLDGWVAYFAEHPRER

SEQ ID NO: 1056089 - protein, 24 aa, Mycobacterium
TDLLRPIIDLVAARAPRGYDQGNH

SEQ ID NO: 1056090 - protein, 23 aa, Mycobacterium
TDLPFGSGDPWAPMRAAVHRRTP

SEQ ID NO: 1056091 - protein, 19 aa, Mycobacterium
TDLPIGYHRVYLRSHDYET

SEQ ID NO: 1056092 - protein, 22 aa, Mycobacterium
TDNTKLEWARAFGATHTVNARE

SEQ ID NO: 1056093 - protein, 28 aa, Mycobacterium
TDPAGLKGLHDFFKPVLRNLGASARVVV

SEQ ID NO: 1056094 - protein, 19 aa, Mycobacterium
TDPSWNIKGCYITQIKGDP

SEQ ID NO: 1056095 - protein, 18 aa, Mycobacterium
TDQIRWLFGKLLAEKPGR

SEQ ID NO: 1056096 - protein, 18 aa, Mycobacterium
TDQSRIATGPTVLTIRAR

SEQ ID NO: 1056097 - protein, 19 aa, Mycobacterium
TDRFAGLPLTEHVIRTTWP

SEQ ID NO: 1056098 - protein, 19 aa, Mycobacterium
TDSAVRRYVTDAGPLLARL

SEQ ID NO: 1056099 - protein, 27 aa, Mycobacterium
TDSEAMEAFGLLCRMEGIIPAIESAHA

SEQ ID NO: 1056100 - protein, 25 aa, Mycobacterium
TDSFALLALLCRRLSNEDVTTVATE

SEQ ID NO: 1056101 - protein, 18 aa, Mycobacterium
TDSGFTAFCGHRFDVRQA

SEQ ID NO: 1056102 - protein, 20 aa, Mycobacterium
TDSVLRRERDGQWWYENLSG

SEQ ID NO: 1056103 - protein, 28 aa, Mycobacterium
TDTGSFRWASPRGLRLAARLVDIGVDNA

SEQ ID NO: 1056104 - protein, 27 aa, Mycobacterium
TDTGVPPFSVTEPGGAGGNGGAGGTGG

SEQ ID NO: 1056105 - protein, 20 aa, Mycobacterium
TDTKIAWKGDEAVELTSSTE

SEQ ID NO: 1056106 - protein, 27 aa, Mycobacterium
TDTSYEPKTGWFRSRMLSRRRPGQVEQ

SEQ ID NO: 1056107 - protein, 25 aa, Mycobacterium
TDVAEWLVRQGVPFRSAHEAAGAAV

SEQ ID NO: 1056108 - protein, 23 aa, Mycobacterium
TDVFWCTADIGWVTGHTYGVYGP

SEQ ID NO: 1056109 - protein, 23 aa, Mycobacterium
TDVGTISAAGWLTSKGNAPNNIG

SEQ ID NO: 1056110 - protein, 17 aa, Mycobacterium
TDVPLGIIPAGTGNDHA

SEQ ID NO: 1056111 - protein, 17 aa, Mycobacterium
TDYCANLSGGQRTRVSL

SEQ ID NO: 1056112 - protein, 21 aa, Mycobacterium
TDYRTLLEFFFQIHDPTTPNR

SEQ ID NO: 1056113 - protein, 24 aa, Mycobacterium
TEAAHGRRLLRIAASSTFAEHAAP

SEQ ID NO: 1056114 - protein, 21 aa, Mycobacterium
TEAAIRGELDFAQSLQQRVAT

SEQ ID NO: 1056115 - protein, 24 aa, Mycobacterium
TEACGDCPRVVLGSPLAGESLDEV

SEQ ID NO: 1056116 - protein, 25 aa, Mycobacterium
TEAFFSLVSGAGWSVQLGRVARREF

SEQ ID NO: 1056117 - protein, 20 aa, Mycobacterium
TEAGIPVIVVPGVTSAIAVP

SEQ ID NO: 1056118 - protein, 26 aa, Mycobacterium
TEALERARRALAEFQVEGLATVIPFH

SEQ ID NO: 1056119 - protein, 29 aa, Mycobacterium
TEAPAEMHFYFPKFRALCMAENATHNLHN

SEQ ID NO: 1056120 - protein, 17 aa, Mycobacterium
TEARLADHELKKAAKNG

SEQ ID NO: 1056121 - protein, 21 aa, Mycobacterium
TEARLTPLAMEMLREIDEETV

SEQ ID NO: 1056122 - protein, 20 aa, Mycobacterium
TEARRMAPMVVEYVEETGPR

SEQ ID NO: 1056123 - protein, 29 aa, Mycobacterium
TEARRPIEWRTRTPLELIVHVRGEDRFDM

SEQ ID NO: 1056124 - protein, 19 aa, Mycobacterium
TEATVPWLVSARSRAALAG

SEQ ID NO: 1056125 - protein, 19 aa, Mycobacterium
TECPAGVVGEIWVHGDNVA

SEQ ID NO: 1056126 - protein, 21 aa, Mycobacterium
TECSNRFDVVQSFTDDSLTTC

SEQ ID NO: 1056127 - protein, 21 aa, Mycobacterium
TEEAMRLVIARELAKSHHERS

SEQ ID NO: 1056128 - protein, 18 aa, Mycobacterium
TEECADNGSVFIVGGGKV

SEQ ID NO: 1056129 - protein, 22 aa, Mycobacterium
TEELRVLGLHLLHLLQTVSYNS

SEQ ID NO: 1056130 - protein, 18 aa, Mycobacterium
TEELTAWAGRIHADVGDS

SEQ ID NO: 1056131 - protein, 17 aa, Mycobacterium
TEFGDGSVRICGEAEID

SEQ ID NO: 1056132 - protein, 22 aa, Mycobacterium
TEFLPGSLIDRAEFEAENRRVV

SEQ ID NO: 1056133 - protein, 21 aa, Mycobacterium
TEGAISYVEWSFAREQHLDMA

SEQ ID NO: 1056134 - protein, 19 aa, Mycobacterium
TEGALYLRMDDFPARLVIV

SEQ ID NO: 1056135 - protein, 21 aa, Mycobacterium
TEGDRLRITWHGETVVDVPPR

SEQ ID NO: 1056136 - protein, 21 aa, Mycobacterium
TEGFRPATLHQAYLALQAWGL

SEQ ID NO: 1056137 - protein, 25 aa, Mycobacterium
TEGLRKNALFPFVDFIRALSEEQVF

SEQ ID NO: 1056138 - protein, 24 aa, Mycobacterium
TEGSELLAALAGVEHVVYAPPAGK

SEQ ID NO: 1056139 - protein, 23 aa, Mycobacterium
TEGSGFDWTGWVTAVGTTPAAVA

SEQ ID NO: 1056140 - protein, 18 aa, Mycobacterium
TEGVLKLQIPVAEKAKPR

SEQ ID NO: 1056141 - protein, 27 aa, Mycobacterium
TEGVPRWRKGSGKGWLTAEYAMLPSAT

SEQ ID NO: 1056142 - protein, 28 aa, Mycobacterium
TEGVSRWRKGSGLGWLTAEYAMLPSATH

SEQ ID NO: 1056143 - protein, 19 aa, Mycobacterium
TEHHYGVFHGREAVREWIV

SEQ ID NO: 1056144 - protein, 23 aa, Mycobacterium
TEHPAGSVLIEFGHTKVMCTASP

SEQ ID NO: 1056145 - protein, 24 aa, Mycobacterium
TEHPEMARFLITMTEPAVHRAAAD

SEQ ID NO: 1056146 - protein, 18 aa, Mycobacterium
TEIACGRPYSAINELEEL

SEQ ID NO: 1056147 - protein, 26 aa, Mycobacterium
TEIDNWRWAGVPVFLRAGKALPERVT

SEQ ID NO: 1056148 - protein, 17 aa, Mycobacterium
TELEFTEGVGFDKGYLS

SEQ ID NO: 1056149 - protein, 18 aa, Mycobacterium
TELEYARRTWRIRPRDWL

SEQ ID NO: 1056150 - protein, 24 aa, Mycobacterium
TELRVRCVRQLRDAMREHIEELRA

SEQ ID NO: 1056151 - protein, 26 aa, Mycobacterium
TELTPPRLARYVKLEVTGPAQQHVGL

SEQ ID NO: 1056152 - protein, 19 aa, Mycobacterium
TELVAPVVGLLAHESCPVN

SEQ ID NO: 1056153 - protein, 18 aa, Mycobacterium
TELVAWINGHPDFTDLPV

SEQ ID NO: 1056154 - protein, 20 aa, Mycobacterium
TELWSEAGKLGFIGVNLPEE

SEQ ID NO: 1056155 - protein, 18 aa, Mycobacterium
TEMPARIADDFLASLHKT

SEQ ID NO: 1056156 - protein, 20 aa, Mycobacterium
TENLRSYWTRSLPATIVSRA

SEQ ID NO: 1056157 - protein, 17 aa, Mycobacterium
TEPKARALRPYAEKLIT

SEQ ID NO: 1056158 - protein, 20 aa, Mycobacterium
TEPPTGFYRDGCCATGPEDV

SEQ ID NO: 1056159 - protein, 25 aa, Mycobacterium
TEPVAVVGIGCRFPGGVDSPDRLWD

SEQ ID NO: 1056160 - protein, 21 aa, Mycobacterium
TEPYSGLDWRCAQWLHDHEVA

SEQ ID NO: 1056161 - protein, 20 aa, Mycobacterium
TEQRDILGLLISARGDDGEQ

SEQ ID NO: 1056162 - protein, 21 aa, Mycobacterium
TEQRKTLVIFDEIHHGGDAKT

SEQ ID NO: 1056163 - protein, 25 aa, Mycobacterium
TERAPRPGHRRIVFKFMTSPVEIKG

SEQ ID NO: 1056164 - protein, 17 aa, Mycobacterium
TERIHELDRRLKAGPSN

SEQ ID NO: 1056165 - protein, 23 aa, Mycobacterium
TERIRLGTNILLAALRPAAMLAK

SEQ ID NO: 1056166 - protein, 19 aa, Mycobacterium
TERLWPTLLEPLRTRDQAR

SEQ ID NO: 1056167 - protein, 24 aa, Mycobacterium
TESALRFIGAATFEALSGQPVHTG

SEQ ID NO: 1056168 - protein, 26 aa, Mycobacterium
TESFRYIDCRCCGGMLKPDIVYFGES

SEQ ID NO: 1056169 - protein, 19 aa, Mycobacterium
TESPACLITDTFGITPALA

SEQ ID NO: 1056170 - protein, 17 aa, Mycobacterium
TETALTWAGTCKPGDGL

SEQ ID NO: 1056171 - protein, 23 aa, Mycobacterium
TETLTWWQIYRRAKIVAEELRGY

SEQ ID NO: 1056172 - protein, 20 aa, Mycobacterium
TEVIVAPAYAPAALDQLTKK

SEQ ID NO: 1056173 - protein, 17 aa, Mycobacterium
TEVRAPWNLPPQPDHAV

SEQ ID NO: 1056174 - protein, 19 aa, Mycobacterium
TEVTLRFDDGEVVTMHVIA

SEQ ID NO: 1056175 - protein, 26 aa, Mycobacterium
TEYGHKYGGTSFELFAKISEKNHAHS

SEQ ID NO: 1056176 - protein, 20 aa, Mycobacterium
TEYNVRFTAVVPVPNDGKGA

SEQ ID NO: 1056177 - protein, 21 aa, Mycobacterium
TFAARLNRLFDTVYPPGRGPH

SEQ ID NO: 1056178 - protein, 18 aa, Mycobacterium
TFAPILYVLTYDDLDDAI

SEQ ID NO: 1056179 - protein, 30 aa, Mycobacterium; identical to SEQ ID NO: 972637

SEQ ID NO: 1056180 - protein, 26 aa, Mycobacterium
TFCVAIDHLHCDAMFVGVVFAEIHLM

SEQ ID NO: 1056181 - protein, 17 aa, Mycobacterium
TFEEMLEMAACGAKVLM

SEQ ID NO: 1056182 - protein, 18 aa, Mycobacterium
TFETEFFTAHGFTEIEGT

SEQ ID NO: 1056183 - protein, 27 aa, Mycobacterium
TFGGGRRALRFGWSKINLHQRGAEFEP

SEQ ID NO: 1056184 - protein, 26 aa, Mycobacterium
TFGHSMGALVAFEFVRLAEANGIDVR

SEQ ID NO: 1056185 - protein, 20 aa, Mycobacterium
TFGMDSWFPSLKIYNRNGQL

SEQ ID NO: 1056186 - protein, 21 aa, Mycobacterium
TFHYPGGLVDFVKHINRTKSP

SEQ ID NO: 1056187 - protein, 20 aa, Mycobacterium
TFIEVCYLLIYGELPNTDQL

SEQ ID NO: 1056188 - protein, 21 aa, Mycobacterium
TFLDREGWDSLTINALATQLG

SEQ ID NO: 1056189 - protein, 24 aa, Mycobacterium
TFLRAIGALPRFAGRSNARTWLFS

SEQ ID NO: 1056190 - protein, 24 aa, Mycobacterium
TFPDRLDVWPAYALKITPKPHLQA

SEQ ID NO: 1056191 - protein, 18 aa, Mycobacterium
TFPGCQGPYLVDVGFGGM

SEQ ID NO: 1056192 - protein, 34 aa, Mycobacterium
TFPISAHYFTVFPLARWSAVLGRRYLRQRVDDPV

SEQ ID NO: 1056193 - protein, 19 aa, Mycobacterium
TFRDGWLHTGDMAREDEDG

SEQ ID NO: 1056194 - protein, 20 aa, Mycobacterium
TFREALRLGHNYIGTEHMLL

SEQ ID NO: 1056195 - protein, 24 aa, Mycobacterium
TFRGCEGDALLMLLDANGIECSTG

SEQ ID NO: 1056196 - protein, 21 aa, Mycobacterium
TFRLIDKVFTGWNVEYTPVAL

SEQ ID NO: 1056197 - protein, 25 aa, Mycobacterium
TFRYNEVIHYWALEGGWECFANHYP

SEQ ID NO: 1056198 - protein, 21 aa, Mycobacterium
TFSALCWGERIAFDNPDSSTL

SEQ ID NO: 1056199 - protein, 28 aa, Mycobacterium
TFSEAFDADFFAAWGKLAAVRTPTIAAV

SEQ ID NO: 1056200 - protein, 22 aa, Mycobacterium
TFTKARLSDGVLGVRPEYLAAA

SEQ ID NO: 1056201 - protein, 18 aa, Mycobacterium
TFTTLVIRQAGGFGGVPG

SEQ ID NO: 1056202 - protein, 25 aa, Mycobacterium
TFYSLDDPWITSAMAEMQQNGIDPT

SEQ ID NO: 1056203 - protein, 24 aa, Mycobacterium
TGAADGDGGILIGNGGNGGSGAVG

SEQ ID NO: 1056204 - protein, 23 aa, Mycobacterium
TGADGAPGGWLLGDGGAGGSGAP

SEQ ID NO: 1056205 - protein, 24 aa, Mycobacterium
TGADGGAGGFLWGNGGNGGSGAAG

SEQ ID NO: 1056206 - protein, 21 aa, Mycobacterium
TGAGRACRRPAVDAGLRAAGP

SEQ ID NO: 1056207 - protein, 24 aa, Mycobacterium
TGAISAGVMKRCAQVMYRFASRRE

SEQ ID NO: 1056208 - protein, 23 aa, Mycobacterium
TGAIVKRPRVVVDDTGNESIGVR

SEQ ID NO: 1056209 - protein, 23 aa, Mycobacterium
TGAKEILCIRVLGGSSRRYAGIG

SEQ ID NO: 1056210 - protein, 24 aa, Mycobacterium
TGANGAAGGWLLGDGGAGGSGAPG

SEQ ID NO: 1056211 - protein, 24 aa, Mycobacterium
TGANGGAAGWLLGDGGAGGSGGLE

SEQ ID NO: 1056212 - protein, 26 aa, Mycobacterium
TGASPRFLLDFSRRFPDATLVRLERD

SEQ ID NO: 1056213 - protein, 29 aa, Mycobacterium
TGATGLKPTWGRVSVHGVFAMAPSLDTIG

SEQ ID NO: 1056214 - protein, 17 aa, Mycobacterium
TGAYGAGLARYLHEQGV

SEQ ID NO: 1056215 - protein, 27 aa, Mycobacterium
TGCRPEAGLKVARRFAHLTYRGEIELD

SEQ ID NO: 1056216 - protein, 20 aa, Mycobacterium
TGDLPALRRVLVINGSGPKA

SEQ ID NO: 1056217 - protein, 24 aa, Mycobacterium
TGDRPATGVVRGWTTCQQRPFQGR

SEQ ID NO: 1056218 - protein, 26 aa, Mycobacterium
TGEAAAYRKLRAVVEPFAAELDAELI

SEQ ID NO: 1056219 - protein, 19 aa, Mycobacterium
TGECAPVLHGHVADLFVVP

SEQ ID NO: 1056220 - protein, 20 aa, Mycobacterium
TGEGGIRLFDGRRWTVESPH

SEQ ID NO: 1056221 - protein, 21 aa, Mycobacterium
TGEGYRCAGDIGYLDEDGYLY

SEQ ID NO: 1056222 - protein, 18 aa, Mycobacterium
TGEIKAWFDSHDESVLFV

SEQ ID NO: 1056223 - protein, 17 aa, Mycobacterium
TGELPLDLHRRAGAAGL

SEQ ID NO: 1056224 - protein, 25 aa, Mycobacterium
TGEPRLRLLGFERVELEPGQSCAVE

SEQ ID NO: 1056225 - protein, 17 aa, Mycobacterium
TGEPVLFIAGRGGAGRT

SEQ ID NO: 1056226 - protein, 18 aa, Mycobacterium
TGFEDGLFASWRSDPSFV

SEQ ID NO: 1056227 - protein, 23 aa, Mycobacterium
TGFERFLPLLFAYDLPPIAEEMR

SEQ ID NO: 1056228 - protein, 21 aa, Mycobacterium
TGFGEIFLDDVFVPDQDVIGA

SEQ ID NO: 1056229 - protein, 23 aa, Mycobacterium
TGFHIGHALSHFSYFADLAESYA

SEQ ID NO: 1056230 - protein, 24 aa, Mycobacterium
TGGAGGRGGWLIGNGAGGGTGGSG

SEQ ID NO: 1056231 - protein, 20 aa, Mycobacterium
TGGAGGWLSGSGGIGGGGGA

SEQ ID NO: 1056232 - protein, 24 aa, Mycobacterium
TGGDGGRGGLLIGSGGNGGTGGTG

SEQ ID NO: 1056233 - protein, 23 aa, Mycobacterium
TGGEIRRLTILFADLVDATILST

SEQ ID NO: 1056234 - protein, 18 aa, Mycobacterium
TGGFTEFVPLPFVHQNSP

SEQ ID NO: 1056235 - protein, 26 aa, Mycobacterium
TGGLGGLGLVVARWLVDSGAGRVVLN

SEQ ID NO: 1056236 - protein, 26 aa, Mycobacterium
TGGNAGEFQSLLGISKGGDGGTGGDG

SEQ ID NO: 1056237 - protein, 27 aa, Mycobacterium
TGGNGGRAALLIGFGGNGGNGGVGTAT

SEQ ID NO: 1056238 - protein, 26 aa, Mycobacterium
TGGNGGRAGLFFGVGGTGGNGGATST

SEQ ID NO: 1056239 - protein, 21 aa, Mycobacterium
TGGNGPDIFIAGGAGGSGGTG

SEQ ID NO: 1056240 - protein, 24 aa, Mycobacterium
TGGQRIDMFGARVDQLPLIWKRLV

SEQ ID NO: 1056241 - protein, 21 aa, Mycobacterium
TGGRHRGFVILRCLDNPQAPD

SEQ ID NO: 1056242 - protein, 22 aa, Mycobacterium
TGGRIPREYIPSVDAGAQDAMQ

SEQ ID NO: 1056243 - protein, 18 aa, Mycobacterium
TGGSNVRPLLAGPDRAEK

SEQ ID NO: 1056244 - protein, 21 aa, Mycobacterium
TGGTFSSPIGGAGGTGGTGGN

SEQ ID NO: 1056245 - protein, 22 aa, Mycobacterium
TGGTGGLLWGNGGIGGQGGTAM

SEQ ID NO: 1056246 - protein, 22 aa, Mycobacterium
TGGVEPWAYLIVGGVQLATHSW

SEQ ID NO: 1056247 - protein, 21 aa, Mycobacterium
TGGVVKPILWGPGKAAAVQRF

SEQ ID NO: 1056248 - protein, 19 aa, Mycobacterium
TGHSLRLPSWSVHRVVMPV

SEQ ID NO: 1056249 - protein, 19 aa, Mycobacterium
TGHTAEYFTRMLAGLGDAL

SEQ ID NO: 1056250 - protein, 17 aa, Mycobacterium
TGIAEEFGCAKHVDVLM

SEQ ID NO: 1056251 - protein, 30 aa, Mycobacterium
TGIDPGAVSPWWLQRRLLMCGMRVTSPAVD

SEQ ID NO: 1056252 - protein, 17 aa, Mycobacterium
TGILVNAIIGQKRVGDY

SEQ ID NO: 1056253 - protein, 18 aa, Mycobacterium
TGIQAAGSVDAFFDRRLD

SEQ ID NO: 1056254 - protein, 26 aa, Mycobacterium
TGISGLGSVVKFRWNGNGVELISNKT

SEQ ID NO: 1056255 - protein, 29 aa, Mycobacterium
TGIVSRGGSIMAAWCLAHHRESFLYTNFE

SEQ ID NO: 1056256 - protein, 26 aa, Mycobacterium
TGKAELWPDLNLGLPFTYHQGYQSPP

SEQ ID NO: 1056257 - protein, 23 aa, Mycobacterium
TGKLRPPVFGILRYIADAVDEID

SEQ ID NO: 1056258 - protein, 18 aa, Mycobacterium
TGKPHGWIHNELRRRCGG

SEQ ID NO: 1056259 - protein, 30 aa, Mycobacterium
TGLDIRPNLGIGHPCWADYLPVTRAVPQPP

SEQ ID NO: 1056260 - protein, 22 aa, Mycobacterium
TGLDTWAAMGFGYAEVGTVTAH

SEQ ID NO: 1056261 - protein, 17 aa, Mycobacterium
TGLELLYRMADFCRPDW

SEQ ID NO: 1056262 - protein, 17 aa, Mycobacterium
TGLGDVWTEICAYGTAV

SEQ ID NO: 1056263 - protein, 18 aa, Mycobacterium
TGLLDEWTPVIAGAELPE

SEQ ID NO: 1056264 - protein, 20 aa, Mycobacterium
TGLLDLLNRLGITPLPNTAG

SEQ ID NO: 1056265 - protein, 17 aa, Mycobacterium
TGLWGACCRSGVRSKTC

SEQ ID NO: 1056266 - protein, 19 aa, Mycobacterium
TGMELRAAIDAGDVVVADK

SEQ ID NO: 1056267 - protein, 19 aa, Mycobacterium
TGMGPYARTTGCAQGGGLR

SEQ ID NO: 1056268 - protein, 30 aa, Mycobacterium
TGNRLARVRWGWRVGLSAGLRRRTRRGRRA

SEQ ID NO: 1056269 - protein, 18 aa, Mycobacterium
TGPEGSGGPRCCRHRKSH

SEQ ID NO: 1056270 - protein, 18 aa, Mycobacterium
TGPGVCFFDRSPVCTHAL

SEQ ID NO: 1056271 - protein, 17 aa, Mycobacterium
TGPMLYPTPPFARLAGQ

SEQ ID NO: 1056272 - protein, 18 aa, Mycobacterium
TGPPATTTSIGWISKELP

SEQ ID NO: 1056273 - protein, 35 aa, Mycobacterium
TGPVEGWMPFGRVFETLAWGRRHVVMGANQVDRYG

SEQ ID NO: 1056274 - protein, 24 aa, Mycobacterium
TGQAGGPGGWLWGDGGDGGSGTPG

SEQ ID NO: 1056275 - protein, 24 aa, Mycobacterium
TGQKRWTMRWKPALNAFAITFADR

SEQ ID NO: 1056276 - protein, 30 aa, Mycobacterium
TGQKRWTTRWKPALNAFAITFADRMPGSET

SEQ ID NO: 1056277 - protein, 20 aa, Mycobacterium
TGQQWLDFCAMVECPELEDI

SEQ ID NO: 1056278 - protein, 22 aa, Mycobacterium
TGQSGGDGGILYGNGGDGGSGA

SEQ ID NO: 1056279 - protein, 31 aa, Mycobacterium
TGRCLTVPGRHCWRYIGAVAHSSTRESGATV

SEQ ID NO: 1056280 - protein, 23 aa, Mycobacterium
TGRELGGAQVLRSLPRTVPEQSP

SEQ ID NO: 1056281 - protein, 25 aa, Mycobacterium
TGRGDPAWRAAADDVIAKDAEMRAT

SEQ ID NO: 1056282 - protein, 24 aa, Mycobacterium
TGRIADGWLGTSFVPEGAGDAYFT

SEQ ID NO: 1056283 - protein, 28 aa, Mycobacterium
TGRPGVHGFRLLPCRTLRHQMGLVSLVQ

SEQ ID NO: 1056284 - protein, 22 aa, Mycobacterium
TGRRFEALSALSAGVKDVRAVI

SEQ ID NO: 1056285 - protein, 31 aa, Mycobacterium
TGRRIAVAAAERLIPCGLELGGKDAMIVCAD

SEQ ID NO: 1056286 - protein, 17 aa, Mycobacterium
TGRRIGQVCWRQHHASY

SEQ ID NO: 1056287 - protein, 25 aa, Mycobacterium
TGRRRRCGWFDAVIARYATRVNGIT

SEQ ID NO: 1056288 - protein, 22 aa, Mycobacterium
TGRSALAYQVHVGRWDQLDGLV

SEQ ID NO: 1056289 - protein, 23 aa, Mycobacterium
TGRTVVLRLRFDDFSRATRSHTL

SEQ ID NO: 1056290 - protein, 32 aa, Mycobacterium; identical to SEQ ID NO: 737996

SEQ ID NO: 1056291 - protein, 23 aa, Mycobacterium
TGSEAFLRYWPADQHMIGKDIIR

SEQ ID NO: 1056292 - protein, 30 aa, Mycobacterium
TGSGALAVALANRWPTARILGVDDSAAALE

SEQ ID NO: 1056293 - protein, 19 aa, Mycobacterium
TGSHPLLGIGVTDPTNGTR

SEQ ID NO: 1056294 - protein, 23 aa, Mycobacterium
TGSRWDMDPTLLVSAEVTGQSPF

SEQ ID NO: 1056295 - protein, 23 aa, Mycobacterium
TGSSFVIVDLWSLNGVSVSGRRV

SEQ ID NO: 1056296 - protein, 37 aa, Mycobacterium
TGSTIWPSASGWCWCSCRAAATARPAATEGITPCAPG

SEQ ID NO: 1056297 - protein, 19 aa, Mycobacterium
TGTPWRVGFNGFAPGFAYL

SEQ ID NO: 1056298 - protein, 27 aa, Mycobacterium
TGTVGDLLPILGIPGQMAQNFTNLLPA

SEQ ID NO: 1056299 - protein, 26 aa, Mycobacterium
TGTVVYRFTWHLPKNRTWTYDGQLKM

SEQ ID NO: 1056300 - protein, 20 aa, Mycobacterium
TGTYAINWYAFDPCCPFGGY

SEQ ID NO: 1056301 - protein, 25 aa, Mycobacterium
TGVAPRIPAIPGIAHAKVLTYTEAI

SEQ ID NO: 1056302 - protein, 28 aa, Mycobacterium
TGVELRNRLRAVTGLALSRTIIFDYTTP

SEQ ID NO: 1056303 - protein, 20 aa, Mycobacterium
TGVGCSNMGDGRRLVGLQAL

SEQ ID NO: 1056304 - protein, 21 aa, Mycobacterium
TGVGFGPPVAIPSWGVLRRPD

SEQ ID NO: 1056305 - protein, 26 aa, Mycobacterium
TGVGFPTDPGLSFGGQGGAGGRGGLL

SEQ ID NO: 1056306 - protein, 24 aa, Mycobacterium
TGVQRVFFGWAQMWRSKSRDAETI

SEQ ID NO: 1056307 - protein, 22 aa, Mycobacterium
TGVRRFALRPVTGIDPGAVSPW

SEQ ID NO: 1056308 - protein, 26 aa, Mycobacterium
TGVRSRLMLDIAGWRRRRREELVALG

SEQ ID NO: 1056309 - protein, 18 aa, Mycobacterium
TGVTYSWETVRRLVQMQT

SEQ ID NO: 1056310 - protein, 22 aa, Mycobacterium
TGWDYPSCEAIGLLKMDFLGLR

SEQ ID NO: 1056311 - protein, 25 aa, Mycobacterium
TGYTFACDYWDVVPDVFLLGKALGG

SEQ ID NO: 1056312 - protein, 25 aa, Mycobacterium
TGYTSAKVGWWYAMNASNDVIVTPR

SEQ ID NO: 1056313 - protein, 24 aa, Mycobacterium
TGYVMPHWPKPWGRAADAVEQLVI

SEQ ID NO: 1056314 - protein, 19 aa, Mycobacterium
THAHARLVAKMSYTNIGFA

SEQ ID NO: 1056315 - protein, 23 aa, Mycobacterium
THDPELFGAYLYSRAQSVMGGTS

SEQ ID NO: 1056316 - protein, 17 aa, Mycobacterium
THDVFRKGSGPGVVLIP

SEQ ID NO: 1056317 - protein, 25 aa, Mycobacterium
THDVWRWVIDIDLWGSIHTVEAFLP

SEQ ID NO: 1056318 - protein, 23 aa, Mycobacterium
THEVWKAGQPVSLSPTEFTLLRY

SEQ ID NO: 1056319 - protein, 23 aa, Mycobacterium
THFFDEYFVFAGIRQVVILSGVA

SEQ ID NO: 1056320 - protein, 25 aa, Mycobacterium
THGARAGAVVALLLPRSDHAILAIL

SEQ ID NO: 1056321 - protein, 25 aa, Mycobacterium
THGSTLRFAPPLVITAQEIDWAVRQ

SEQ ID NO: 1056322 - protein, 19 aa, Mycobacterium
THGTVIPKQIGVTTSTPGT

SEQ ID NO: 1056323 - protein, 21 aa, Mycobacterium
THLPEGSAFEQVRVQHEAVSD

SEQ ID NO: 1056324 - protein, 24 aa, Mycobacterium
THLTRLRLITSMLDRGYNIAHVRE

SEQ ID NO: 1056325 - protein, 21 aa, Mycobacterium
THMADWICFMLSDSADFLCGS

SEQ ID NO: 1056326 - protein, 23 aa, Mycobacterium
THPHLDELIGFFVNTLVLRTHTH

SEQ ID NO: 1056327 - protein, 21 aa, Mycobacterium
THRFDSCFIGAGYEDQVDEFL

SEQ ID NO: 1056328 - protein, 25 aa, Mycobacterium
THRHRELQNAIQLNSSFPSPGSAAA

SEQ ID NO: 1056329 - protein, 17 aa, Mycobacterium
THVRLRGKEQAHFLSPM

SEQ ID NO: 1056330 - protein, 19 aa, Mycobacterium
TIAKWDGDRLTLWDKVQHI

SEQ ID NO: 1056331 - protein, 23 aa, Mycobacterium
TIAMTRWQATVNWVADEPSAAEL

SEQ ID NO: 1056332 - protein, 17 aa, Mycobacterium
TIDAARHHGGRVVDDVD

SEQ ID NO: 1056333 - protein, 25 aa, Mycobacterium
TIDLDGWRIGLGICRDTGVPEHVRG

SEQ ID NO: 1056334 - protein, 23 aa, Mycobacterium
TIDTDWYLAWLAREAKNAGVCVD

SEQ ID NO: 1056335 - protein, 19 aa, Mycobacterium
TIDVVGWLDPMARDELLCR

SEQ ID NO: 1056336 - protein, 24 aa, Mycobacterium
TIDYKTYDAQGWIITATTDGTRFQ

SEQ ID NO: 1056337 - protein, 20 aa, Mycobacterium
TIELRICDGVSNLRELGALV

SEQ ID NO: 1056338 - protein, 31 aa, Mycobacterium
TIGAPSGHGGSCGLGGGTGLFGQGGAGGNGG

SEQ ID NO: 1056339 - protein, 17 aa, Mycobacterium
TIGDAWAADVVVKVAPP

SEQ ID NO: 1056340 - protein, 22 aa, Mycobacterium
TIGRPALTSIRVRAEGFEAIED

SEQ ID NO: 1056341 - protein, 18 aa, Mycobacterium
TIIGHDWGASAGYGAMTL

SEQ ID NO: 1056342 - protein, 22 aa, Mycobacterium
TIKRLPHELIRFMKTGTGRRKV

SEQ ID NO: 1056343 - protein, 25 aa, Mycobacterium
TIKSAVAFGALLSRGIGDTIRVSLS

SEQ ID NO: 1056344 - protein, 17 aa, Mycobacterium
TINLCILSPTGYIRDTF

SEQ ID NO: 1056345 - protein, 24 aa, Mycobacterium
TIPLIDIPAGPGFGNSSTSPSSGF

SEQ ID NO: 1056346 - protein, 18 aa, Mycobacterium
TIQRRTPIDPARVYATGM

SEQ ID NO: 1056347 - protein, 24 aa, Mycobacterium
TIRQRLGGIEGRRVVIVGDILHSR

SEQ ID NO: 1056348 - protein, 24 aa, Mycobacterium
TIRVCGADVPFGPDLLFAASDLPG

SEQ ID NO: 1056349 - protein, 23 aa, Mycobacterium
TIRYRLKRITDFTGRDPTQPRDA

SEQ ID NO: 1056350 - protein, 25 aa, Mycobacterium
TISARAEWAPEFAIHDLDSPDALAA

SEQ ID NO: 1056351 - protein, 17 aa, Mycobacterium
TISGLYVCEMVTARALV

SEQ ID NO: 1056352 - protein, 19 aa, Mycobacterium
TISVPTLYALGALGSLRAR

SEQ ID NO: 1056353 - protein, 18 aa, Mycobacterium
TITPLVSSFSARAANGDT

SEQ ID NO: 1056354 - protein, 18 aa, Mycobacterium
TIVKLGPEVDGWSEGDRV

SEQ ID NO: 1056355 - protein, 23 aa, Mycobacterium
TIVLPGMVVPITLDDAAQAAIDA

SEQ ID NO: 1056356 - protein, 20 aa, Mycobacterium
TIWGFPKIMADFNVREGKKF

SEQ ID NO: 1056357 - protein, 20 aa, Mycobacterium
TKCAPNLCYADIPGKANRSA

SEQ ID NO: 1056358 - protein, 19 aa, Mycobacterium
TKDHIEAIANWDPQAEPSI

SEQ ID NO: 1056359 - protein, 21 aa, Mycobacterium
TKDLFAAVVALNFEVPFRLLS

SEQ ID NO: 1056360 - protein, 22 aa, Mycobacterium
TKDLFAAVVALNFEVPFRLLSM

SEQ ID NO: 1056361 - protein, 22 aa, Mycobacterium
TKDLPAATGDDIVWADAVIFGS

SEQ ID NO: 1056362 - protein, 22 aa, Mycobacterium
TKKTGTAIRFWADPDIFETTEY

SEQ ID NO: 1056363 - protein, 29 aa, Mycobacterium
TKLGFSHFLRWERFAVVTNIEWIKQTVKF

SEQ ID NO: 1056364 - protein, 21 aa, Mycobacterium
TKLGPSLWHKDFHDAVIVECP

SEQ ID NO: 1056365 - protein, 21 aa, Mycobacterium
TKLGVAYAGQADWLIVTADGA

SEQ ID NO: 1056366 - protein, 17 aa, Mycobacterium
TKLPSPASQVWRSRRQI

SEQ ID NO: 1056367 - protein, 27 aa, Mycobacterium
TKPVAPPSWPRFRTGIAGAQSAGAARE

SEQ ID NO: 1056368 - protein, 21 aa, Mycobacterium
TKRLRAVDFTLGYEVRSIGAA

SEQ ID NO: 1056369 - protein, 19 aa, Mycobacterium
TKRPPRWVVVAELVETSRL

SEQ ID NO: 1056370 - protein, 19 aa, Mycobacterium
TKRTVIVRSRSRQVDPDNN

SEQ ID NO: 1056371 - protein, 20 aa, Mycobacterium
TKRWRNLRKITVAQVHGTVL

SEQ ID NO: 1056372 - protein, 26 aa, Mycobacterium
TKVLHLRGAFHGRSGYTLSLTNTKPV

SEQ ID NO: 1056373 - protein, 26 aa, Mycobacterium
TLAALIARHRVNLIAIGNGTASREPD

SEQ ID NO: 1056374 - protein, 18 aa, Mycobacterium
TLADAEKLAAFADENNLG

SEQ ID NO: 1056375 - protein, 25 aa, Mycobacterium
TLAPHLVKPLPFLFPLTKRGWERPY

SEQ ID NO: 1056376 - protein, 20 aa, Mycobacterium
TLAPRYVDLRPFAVNDGNDV

SEQ ID NO: 1056377 - protein, 21 aa, Mycobacterium
TLAPRYVDLRPFAVNDGNDVW

SEQ ID NO: 1056378 - protein, 24 aa, Mycobacterium
TLARADIRGPYVINADGAPLDDRF

SEQ ID NO: 1056379 - protein, 18 aa, Mycobacterium
TLAVAHGYIPPNLHFSRW

SEQ ID NO: 1056380 - protein, 29 aa, Mycobacterium
TLDALISLVLDWKRPVKVFIETKHPVRYG

SEQ ID NO: 1056381 - protein, 33 aa, Mycobacterium
TLDIYRIGQYIAWRLWINIAFDLTSDPQELHEL

SEQ ID NO: 1056382 - protein, 25 aa, Mycobacterium
TLDNRLSGGLYRWQSRYLRAEDQAA

SEQ ID NO: 1056383 - protein, 32 aa, Mycobacterium; identical to SEQ ID NO: 738703

SEQ ID NO: 1056384 - protein, 24 aa, Mycobacterium
TLEAIKLFLSVSGMVFVIAADQDM

SEQ ID NO: 1056385 - protein, 19 aa, Mycobacterium
TLEARLAHRVGLREDVKRI

SEQ ID NO: 1056386 - protein, 19 aa, Mycobacterium
TLELRVCDSCPSVDTIVLV

SEQ ID NO: 1056387 - protein, 25 aa, Mycobacterium
TLESRGYCFQVEMTWRSLNAGFAVV

SEQ ID NO: 1056388 - protein, 21 aa, Mycobacterium
TLGAGLDWKTSLQELTASRSL

SEQ ID NO: 1056389 - protein, 19 aa, Mycobacterium
TLGGPRGGIILSNDAAIAK

SEQ ID NO: 1056390 - protein, 26 aa, Mycobacterium
TLGNLRARFNIALGIGSSGFSSDRVC

SEQ ID NO: 1056391 - protein, 22 aa, Mycobacterium
TLGNWFRAAGYDTHYDGKWHIS

SEQ ID NO: 1056392 - protein, 20 aa, Mycobacterium
TLGPKGRNVVLEKKWGAPTI

SEQ ID NO: 1056393 - protein, 22 aa, Mycobacterium
TLGRSAFQLGVLERGLQMTAEY

SEQ ID NO: 1056394 - protein, 25 aa, Mycobacterium
TLGSYRWLRPHGRRTAREIAAEFST

SEQ ID NO: 1056395 - protein, 28 aa, Mycobacterium
TLIALSIFGSLAWKSGEAAAEGVAGAAG

SEQ ID NO: 1056396 - protein, 27 aa, Mycobacterium
TLIAMPALRLDAAFAHLNLGDCRGNAA

SEQ ID NO: 1056397 - protein, 24 aa, Mycobacterium
TLIPRARAKISIRIAPGGDAAAHL

SEQ ID NO: 1056398 - protein, 25 aa, Mycobacterium
TLIREKWLTANGVIGFFPANAVGDD

SEQ ID NO: 1056399 - protein, 21 aa, Mycobacterium
TLLGRPLIGNGADGALGQAGG

SEQ ID NO: 1056400 - protein, 20 aa, Mycobacterium
TLLGRPLIGNGANGAPGQNG

SEQ ID NO: 1056401 - protein, 17 aa, Mycobacterium
TLLHDWTQFGGPTMFSI

SEQ ID NO: 1056402 - protein, 19 aa, Mycobacterium
TLLPREYFERVFALQREVF

SEQ ID NO: 1056403 - protein, 25 aa, Mycobacterium
TLLRAWKSYHRFEGKSSLRTWLHRI

SEQ ID NO: 1056404 - protein, 24 aa, Mycobacterium
TLLYKKSSVLFGIDLAKRDIARGH

SEQ ID NO: 1056405 - protein, 26 aa, Mycobacterium
TLNLVGGLRRSMVKAGYCDLKEFQKV

SEQ ID NO: 1056406 - protein, 18 aa, Mycobacterium
TLNMISFQILSWADVKQL

SEQ ID NO: 1056407 - protein, 21 aa, Mycobacterium
TLNSMKALWARPKDEVSADEY

SEQ ID NO: 1056408 - protein, 23 aa, Mycobacterium
TLPALELATALNLMNERTLSASF

SEQ ID NO: 1056409 - protein, 20 aa, Mycobacterium
TLPAVIERRGYVLIVSSLAA

SEQ ID NO: 1056410 - protein, 23 aa, Mycobacterium
TLPEVLWLAQRVRETWDDVQIAL

SEQ ID NO: 1056411 - protein, 18 aa, Mycobacterium
TLPGGAIVRHAAVTRIGV

SEQ ID NO: 1056412 - protein, 23 aa, Mycobacterium
TLPHLQRLAVYTGEALDELDEPA

SEQ ID NO: 1056413 - protein, 24 aa, Mycobacterium
TLPLLKDLRRAIGESVLNLPHDTW

SEQ ID NO: 1056414 - protein, 19 aa, Mycobacterium
TLPLTGVGCVNRIVTELAV

SEQ ID NO: 1056415 - protein, 18 aa, Mycobacterium
TLPMGAPHEVWWGREEYI

SEQ ID NO: 1056416 - protein, 25 aa, Mycobacterium
TLQAQAIALSQAWGTANGTPVTVSY

SEQ ID NO: 1056417 - protein, 18 aa, Mycobacterium
TLRCALIAMAVWSTSIRL

SEQ ID NO: 1056418 - protein, 19 aa, Mycobacterium
TLRCALIAMAVWSTSIRLK

SEQ ID NO: 1056419 - protein, 19 aa, Mycobacterium
TLRDVLGGAGWEIAALDAV

SEQ ID NO: 1056420 - protein, 27 aa, Mycobacterium
TLRGALVRDPHAWSGYLAEAIDTFADR

SEQ ID NO: 1056421 - protein, 23 aa, Mycobacterium
TLRPWAAMRAQLLLAETLRAAGL

SEQ ID NO: 1056422 - protein, 20 aa, Mycobacterium
TLRSFSGLLEHLATLTRNDV

SEQ ID NO: 1056423 - protein, 17 aa, Mycobacterium
TLSILRRPDGVVVASEP

SEQ ID NO: 1056424 - protein, 19 aa, Mycobacterium
TLSRSLRLLSEFRYEQPDP

SEQ ID NO: 1056425 - protein, 20 aa, Mycobacterium
TLSTLTWRIATNVTKLPGLG

SEQ ID NO: 1056426 - protein, 23 aa, Mycobacterium
TLTGDGIGIVFRKGLPLEDMEFH

SEQ ID NO: 1056427 - protein, 17 aa, Mycobacterium
TLTGFKWLARADADRPG

SEQ ID NO: 1056428 - protein, 18 aa, Mycobacterium
TLTIGFAVAKDLAAGRLV

SEQ ID NO: 1056429 - protein, 25 aa, Mycobacterium
TLTPARILARCLLPSRRGMGRAYKD

SEQ ID NO: 1056430 - protein, 22 aa, Mycobacterium
TLTSRFPIVLWLSPTDLFLMYN

SEQ ID NO: 1056431 - protein, 26 aa, Mycobacterium
TLVCGGRLGPSLSNRGRRSVARQLGK

SEQ ID NO: 1056432 - protein, 18 aa, Mycobacterium
TLVIFDEIHHGGNAKAWG

SEQ ID NO: 1056433 - protein, 22 aa, Mycobacterium
TLVLPTHQQWRLAAGGEGTLAG

SEQ ID NO: 1056434 - protein, 18 aa, Mycobacterium
TLVSWLPFYHDMGLVLGV

SEQ ID NO: 1056435 - protein, 18 aa, Mycobacterium
TLYALGALGSLRARLTGK

SEQ ID NO: 1056436 - protein, 25 aa, Mycobacterium
TLYPSLSSDQAWAMLGVTPMIGVND

SEQ ID NO: 1056437 - protein, 19 aa, Mycobacterium
TMAGMATCTLTHLIESNES

SEQ ID NO: 1056438 - protein, 23 aa, Mycobacterium
TMAMLGRPLIGNGADGAPGQAGA

SEQ ID NO: 1056439 - protein, 25 aa, Mycobacterium
TMAVLGRPLIGDGVDAAAGSGHNGG

SEQ ID NO: 1056440 - protein, 23 aa, Mycobacterium
TMDAGCYAVHMARTFGGGTPEVV

SEQ ID NO: 1056441 - protein, 24 aa, Mycobacterium
TMEAEARLSLAERLAGWEERYPDV

SEQ ID NO: 1056442 - protein, 25 aa, Mycobacterium
TMFFPANFPLPAKIVYQVLEPIDIA

SEQ ID NO: 1056443 - protein, 22 aa, Mycobacterium
TMGDFMAATAYEVLRRQLDIFT

SEQ ID NO: 1056444 - protein, 21 aa, Mycobacterium
TMGIGGGYVTSWVGDPGAVIE

SEQ ID NO: 1056445 - protein, 17 aa, Mycobacterium
TMGLEWAAEINAKSPQA

SEQ ID NO: 1056446 - protein, 17 aa, Mycobacterium
TMGLRYATVTGVARDDL

SEQ ID NO: 1056447 - protein, 18 aa, Mycobacterium
TMGQDWGGPISMAVAVER

SEQ ID NO: 1056448 - protein, 24 aa, Mycobacterium
TMIKQLLGGLAMRRPSNWLLAARC

SEQ ID NO: 1056449 - protein, 24 aa, Mycobacterium
TMKHLRAGYWRQVRAQLAVTPVML

SEQ ID NO: 1056450 - protein, 24 aa, Mycobacterium
TMLARIAAIPGIRQRDLSSIVFIL

SEQ ID NO: 1056451 - protein, 21 aa, Mycobacterium
TMLGVALSAYEHWLSDESVSL

SEQ ID NO: 1056452 - protein, 22 aa, Mycobacterium
TMLREYLEAMRALWTQEEAAYD

SEQ ID NO: 1056453 - protein, 19 aa, Mycobacterium
TMQYRLPSMVTRPTQDIGD

SEQ ID NO: 1056454 - protein, 22 aa, Mycobacterium
TMRALTARSWRAGLRQRAAVRA

SEQ ID NO: 1056455 - protein, 22 aa, Mycobacterium
TMRRLYPVVGRFFARQTYEISL

SEQ ID NO: 1056456 - protein, 21 aa, Mycobacterium
TMRVKSFVFLAADLCTANLGF

SEQ ID NO: 1056457 - protein, 23 aa, Mycobacterium
TMSCEWFFCASGYYRYDEGYTPE

SEQ ID NO: 1056458 - protein, 36 aa, Mycobacterium; identical to SEQ ID NO: 739159

SEQ ID NO: 1056459 - protein, 27 aa, Mycobacterium
TMTKSLRAGKVFLDWSQNSGSKTTIAP

SEQ ID NO: 1056460 - protein, 25 aa, Mycobacterium
TMTPPIARPTLRWVNIVPGPLAGAL

SEQ ID NO: 1056461 - protein, 21 aa, Mycobacterium
TMVQRLLGFELAKGHGAADWS

SEQ ID NO: 1056462 - protein, 19 aa, Mycobacterium
TMVVTGLHLLGGARADANR

SEQ ID NO: 1056463 - protein, 26 aa, Mycobacterium
TNAPIADVFLVWCADEATGGMSAVLV

SEQ ID NO: 1056464 - protein, 19 aa, Mycobacterium
TNAWVPFVVASTIVVRDGG

SEQ ID NO: 1056465 - protein, 24 aa, Mycobacterium
TNDARFLLYPAMKKLTLDIASMVF

SEQ ID NO: 1056466 - protein, 23 aa, Mycobacterium
TNEGLRSRFTRSIDFPSYTSHEL

SEQ ID NO: 1056467 - protein, 24 aa, Mycobacterium
TNEVSVRALIDFTIDTFGRLDIVD

SEQ ID NO: 1056468 - protein, 18 aa, Mycobacterium
TNHLGHFALTGLLLDHLL

SEQ ID NO: 1056469 - protein, 19 aa, Mycobacterium
TNLEHWTTLIPRGATLVSL

SEQ ID NO: 1056470 - protein, 20 aa, Mycobacterium
TNLFGLNAPAIMAAEGQYEQ

SEQ ID NO: 1056471 - protein, 17 aa, Mycobacterium
TNLGIAAEGGLAGDGGD

SEQ ID NO: 1056472 - protein, 17 aa, Mycobacterium
TNLGLAIDLQGKDGKRA

SEQ ID NO: 1056473 - protein, 18 aa, Mycobacterium
TNLPRFSTDFALSDGAPA

SEQ ID NO: 1056474 - protein, 24 aa, Mycobacterium
TNLRDPWTAIGMLQQGRRWIEKAL

SEQ ID NO: 1056475 - protein, 20 aa, Mycobacterium
TNLRRLIGLFEMLRDRSQLI

SEQ ID NO: 1056476 - protein, 20 aa, Mycobacterium
TNLWGAFGLLAEMVADGRSG

SEQ ID NO: 1056477 - protein, 24 aa, Mycobacterium
TNSVFPGQLNSFGVGNSGTGNLGF

SEQ ID NO: 1056478 - protein, 23 aa, Mycobacterium
TNTPRNFARRGVRSHVLPSSVTF

SEQ ID NO: 1056479 - protein, 22 aa, Mycobacterium
TPAESYWITGIKTMTEDASWAE

SEQ ID NO: 1056480 - protein, 24 aa, Mycobacterium
TPAMAVSGVPAAPVAPGAPVAMAA

SEQ ID NO: 1056481 - protein, 25 aa, Mycobacterium
TPCGTCESCQALAPSAPGSIDVVEL

SEQ ID NO: 1056482 - protein, 18 aa, Mycobacterium
TPDARTALLNGFVTTVVH

SEQ ID NO: 1056483 - protein, 17 aa, Mycobacterium
TPDRVVFRRELPTTATG

SEQ ID NO: 1056484 - protein, 18 aa, Mycobacterium
TPDTFVFDGERRLVYRGQ

SEQ ID NO: 1056485 - protein, 22 aa, Mycobacterium
TPEARAALWRTLLGLDSMERVS

SEQ ID NO: 1056486 - protein, 19 aa, Mycobacterium
TPECLAEGQVLLRFQAAGV

SEQ ID NO: 1056487 - protein, 35 aa, Mycobacterium; identical to SEQ ID NO: 739432

SEQ ID NO: 1056488 - protein, 26 aa, Mycobacterium
TPELMPLPIALAHRLSRRLTEVRKNG

SEQ ID NO: 1056489 - protein, 24 aa, Mycobacterium
TPELYRLATMGEWRSGSNVDSALD

SEQ ID NO: 1056490 - protein, 31 aa, Mycobacterium
TPEQKRRWAVPILRAEMTASLGMSEPGAGSD

SEQ ID NO: 1056491 - protein, 34 aa, Mycobacterium
TPEQLWPFTCNLGSLTFGQSVARGVAILRDALSA

SEQ ID NO: 1056492 - protein, 21 aa, Mycobacterium
TPERRAGGAIRAELDALERAA

SEQ ID NO: 1056493 - protein, 17 aa, Mycobacterium
TPERVDTVLRAKVDAAW

SEQ ID NO: 1056494 - protein, 21 aa, Mycobacterium
TPESWRLAPVRPTAVTTVNLP

SEQ ID NO: 1056495 - protein, 22 aa, Mycobacterium
TPEVRIGASLVHLGHAARLWSP

SEQ ID NO: 1056496 - protein, 24 aa, Mycobacterium
TPFAEELVMWWNFVGRNHDEIVSY

SEQ ID NO: 1056497 - protein, 26 aa, Mycobacterium
TPFPTMYELFSVGWGQPDLRSQWKQA

SEQ ID NO: 1056498 - protein, 19 aa, Mycobacterium
TPFRIARLVEQTVRQQIAA

SEQ ID NO: 1056499 - protein, 22 aa, Mycobacterium
TPFRRDRRWGGDNTDAYYFMCP

SEQ ID NO: 1056500 - protein, 21 aa, Mycobacterium
TPGCTKEACHFRDLAAEFTAV

SEQ ID NO: 1056501 - protein, 25 aa, Mycobacterium
TPGPRAEFLAGLAAVMRPGDSLLLG

SEQ ID NO: 1056502 - protein, 18 aa, Mycobacterium
TPGQRLLVFLPLAHVLAR

SEQ ID NO: 1056503 - protein, 17 aa, Mycobacterium
TPGSIALALDGAATGGV

SEQ ID NO: 1056504 - protein, 18 aa, Mycobacterium
TPHAGEFARLAGSGPGDD

SEQ ID NO: 1056505 - protein, 17 aa, Mycobacterium
TPHCPTCGERIARQTPQ

SEQ ID NO: 1056506 - protein, 20 aa, Mycobacterium
TPIKMLLRLALDAGAGILYR

SEQ ID NO: 1056507 - protein, 21 aa, Mycobacterium
TPIKMLLRLALDAGAGILYRL

SEQ ID NO: 1056508 - protein, 18 aa, Mycobacterium
TPIPRTVALTVYGDLETS

SEQ ID NO: 1056509 - protein, 21 aa, Mycobacterium
TPKLRARQLISQWEQRRRGIY

SEQ ID NO: 1056510 - protein, 18 aa, Mycobacterium
TPLFEFAIRTALAESDLE

SEQ ID NO: 1056511 - protein, 24 aa, Mycobacterium
TPLGAREFQNFLLAKQREIATIVA

SEQ ID NO: 1056512 - protein, 24 aa, Mycobacterium
TPLPELRAANGLAPAAVDDDGPSV

SEQ ID NO: 1056513 - protein, 25 aa, Mycobacterium
TPLQPVESTIVFRVLPHTPPVTQHI

SEQ ID NO: 1056514 - protein, 20 aa, Mycobacterium
TPLQWPCPPDGASNRSPIRY

SEQ ID NO: 1056515 - protein, 23 aa, Mycobacterium
TPLTEVVCCGPAGPEVELAIVST

SEQ ID NO: 1056516 - protein, 18 aa, Mycobacterium
TPMEKMAALKPAFKEDGV

SEQ ID NO: 1056517 - protein, 18 aa, Mycobacterium
TPMGSSLANGGRPYSQTF

SEQ ID NO: 1056518 - protein, 23 aa, Mycobacterium
TPNELLKPLPLVPYTPKWLARKM

SEQ ID NO: 1056519 - protein, 33 aa, Mycobacterium; identical to SEQ ID NO: 739640

SEQ ID NO: 1056520 - protein, 18 aa, Mycobacterium
TPNVCPALHMPLQSGSDR

SEQ ID NO: 1056521 - protein, 17 aa, Mycobacterium
TPPKVKSPFGMPGMPGM

SEQ ID NO: 1056522 - protein, 18 aa, Mycobacterium
TPQAVTFRPDLRVPLITI

SEQ ID NO: 1056523 - protein, 18 aa, Mycobacterium
TPQEIFLTLKVAASEFAY

SEQ ID NO: 1056524 - protein, 24 aa, Mycobacterium
TPQSRIPTLLWAREIPVEGEPADV

SEQ ID NO: 1056525 - protein, 18 aa, Mycobacterium
TPRVLGWRDHRADPPWPV

SEQ ID NO: 1056526 - protein, 28 aa, Mycobacterium
TPSELAVFCRDRLAAFEVPTRFQEASAL

SEQ ID NO: 1056527 - protein, 25 aa, Mycobacterium
TPSLWVPDLFMLRQIHRTPRLSVNS

SEQ ID NO: 1056528 - protein, 17 aa, Mycobacterium
TPSSWGAGVREFANAAA

SEQ ID NO: 1056529 - protein, 27 aa, Mycobacterium
TPTGEVWPGRAYPLGATYDGMGTNFAI

SEQ ID NO: 1056530 - protein, 23 aa, Mycobacterium
TPTLRELGEFAVIDRLVQGRNQP

SEQ ID NO: 1056531 - protein, 24 aa, Mycobacterium
TPTQAIFGRPLIGDGANGTATSPN

SEQ ID NO: 1056532 - protein, 24 aa, Mycobacterium
TPTQWPKFVAALLAQTPVRAPWDS

SEQ ID NO: 1056533 - protein, 25 aa, Mycobacterium
TPTWLPGRLLAAVLDVTWRFYSLPR

SEQ ID NO: 1056534 - protein, 23 aa, Mycobacterium
TPVELRAAYRAALADSAGDGVVA

SEQ ID NO: 1056535 - protein, 25 aa, Mycobacterium
TPVPEYRFPGLLPGDRWCVVAVNWL

SEQ ID NO: 1056536 - protein, 25 aa, Mycobacterium
TPVVWRGPMLHRALQQFLADVYWGD

SEQ ID NO: 1056537 - protein, 25 aa, Mycobacterium
TPWGRGRPGWHLECSAMARTYLGAQ

SEQ ID NO: 1056538 - protein, 17 aa, Mycobacterium
TPWTWRSNSVHTMRTDA

SEQ ID NO: 1056539 - protein, 24 aa, Mycobacterium
TPYREMMGPFVAVYARCYLGLAAK

SEQ ID NO: 1056540 - protein, 19 aa, Mycobacterium
TPYSRMWGAYLSGMWLYRL

SEQ ID NO: 1056541 - protein, 17 aa, Mycobacterium
TPYVSWVTAAGVQAEET

SEQ ID NO: 1056542 - protein, 19 aa, Mycobacterium
TPYVTPLVRKLAEENNIDL

SEQ ID NO: 1056543 - protein, 24 aa, Mycobacterium
TQALERLETLLALIEGWVQTVVTD

SEQ ID NO: 1056544 - protein, 22 aa, Mycobacterium
TQALFGRPLIGNGADGAAGTGQ

SEQ ID NO: 1056545 - protein, 20 aa, Mycobacterium
TQALLGRGLIGDGAAGTASH

SEQ ID NO: 1056546 - protein, 25 aa, Mycobacterium
TQALLGRPLIGNGTSGALGTGQAGG

SEQ ID NO: 1056547 - protein, 24 aa, Mycobacterium
TQALLGRPLIRDGAAGAPGQDGGD

SEQ ID NO: 1056548 - protein, 22 aa, Mycobacterium
TQCQPGWLLAPPIAYGASGEHQ

SEQ ID NO: 1056549 - protein, 19 aa, Mycobacterium
TQDKAHWFFSLSPADRRDY

SEQ ID NO: 1056550 - protein, 17 aa, Mycobacterium
TQFPFLAPEDWNLPTGR

SEQ ID NO: 1056551 - protein, 17 aa, Mycobacterium
TQFVDWIRCAAGSCVLS

SEQ ID NO: 1056552 - protein, 18 aa, Mycobacterium
TQIATSFLERVVADERLR

SEQ ID NO: 1056553 - protein, 19 aa, Mycobacterium
TQIKIAIEKIFAVKVASVN

SEQ ID NO: 1056554 - protein, 17 aa, Mycobacterium
TQILAWDLPLTKKISDL

SEQ ID NO: 1056555 - protein, 26 aa, Mycobacterium
TQIMRYRGYCSLTWALNGVLPGAEAA

SEQ ID NO: 1056556 - protein, 22 aa, Mycobacterium
TQKEFLLRQQLAAIRKELGEGD

SEQ ID NO: 1056557 - protein, 21 aa, Mycobacterium
TQLAGLPFSGPVGGVRVALID

SEQ ID NO: 1056558 - protein, 23 aa, Mycobacterium
TQLERVLSAGAVAYAAAETTGTS

SEQ ID NO: 1056559 - protein, 28 aa, Mycobacterium
TQLFRSTGIPVCLWFFAKDKKARSGQVL

SEQ ID NO: 1056560 - protein, 20 aa, Mycobacterium
TQLIGNWRWSDAVFERSDID

SEQ ID NO: 1056561 - protein, 21 aa, Mycobacterium
TQLLLNRPLIGNGTDGTAANP

SEQ ID NO: 1056562 - protein, 23 aa, Mycobacterium
TQLLPDPLDTVFLVYSGSEAGDL

SEQ ID NO: 1056563 - protein, 27 aa, Mycobacterium
TQPDQRWNAVWSFHVQPHWEDRVRLLT

SEQ ID NO: 1056564 - protein, 23 aa, Mycobacterium
TQPWSPRFLRVYGTAEVVAGDQP

SEQ ID NO: 1056565 - protein, 22 aa, Mycobacterium
TQQDVWRFVAYLSDAGSADDLT

SEQ ID NO: 1056566 - protein, 17 aa, Mycobacterium
TQQDWLVDQARKYKVIK

SEQ ID NO: 1056567 - protein, 20 aa, Mycobacterium
TQRNAAAVARICERLDGLPL

SEQ ID NO: 1056568 - protein, 27 aa, Mycobacterium
TQRVKANLFYRGLTFHRYPLIGDTIYT

SEQ ID NO: 1056569 - protein, 26 aa, Mycobacterium
TQSGFTFPVLSDFWPHGAVSQAYGVF

SEQ ID NO: 1056570 - protein, 17 aa, Mycobacterium
TQVESMILPPIAHEVRV

SEQ ID NO: 1056571 - protein, 24 aa, Mycobacterium
TQVFPKLGLSHSFIRVPQAQMDDY

SEQ ID NO: 1056572 - protein, 18 aa, Mycobacterium
TQYPRFHTLMAEMSGEVF

SEQ ID NO: 1056573 - protein, 31 aa, Mycobacterium
TRAAWGAAPPRPPAGWLDRIVARMPHEDDPR

SEQ ID NO: 1056574 - protein, 18 aa, Mycobacterium
TRAGRQLWVYGRAGQPCR

SEQ ID NO: 1056575 - protein, 26 aa, Mycobacterium
TRAGVLRFVVLDGLAKPGRMAGPDPG

SEQ ID NO: 1056576 - protein, 20 aa, Mycobacterium
TRAIAAWLWSGRSATAVGLS

SEQ ID NO: 1056577 - protein, 28 aa, Mycobacterium
TRAIACYCLGRPGWRDDVHQAVQTAGAT

SEQ ID NO: 1056578 - protein, 18 aa, Mycobacterium
TRALRDGDSWLINGSKMF

SEQ ID NO: 1056579 - protein, 24 aa, Mycobacterium
TRAPNVAEGWTLTRLTAPSRLFGA

SEQ ID NO: 1056580 - protein, 26 aa, Mycobacterium
TRAQLLERFGMFGIRISIAGLAAGIA

SEQ ID NO: 1056581 - protein, 28 aa, Mycobacterium
TRARAVVARARHRGCTLLVTDGDWEGAP

SEQ ID NO: 1056582 - protein, 19 aa, Mycobacterium
TRARERWEALSALAQLVDD

SEQ ID NO: 1056583 - protein, 25 aa, Mycobacterium
TRARVLGRLRAHLCSDGRAVIGFGA

SEQ ID NO: 1056584 - protein, 44 aa, Mycobacterium
TRASRIPRMCRRCSTCCRATWTCPMPARPPCRTTWTTSRAETKR

SEQ ID NO: 1056585 - protein, 18 aa, Mycobacterium
TRAVVVRSSLPSVSQQDT

SEQ ID NO: 1056586 - protein, 17 aa, Mycobacterium
TRCSWTRTSGSSAGCSG

SEQ ID NO: 1056587 - protein, 24 aa, Mycobacterium
TRDEIIRMVDLMIGRVANQLKSSK

SEQ ID NO: 1056588 - protein, 23 aa, Mycobacterium
TRDEVRAALAVGDWTSASDSKLL

SEQ ID NO: 1056589 - protein, 26 aa, Mycobacterium
TRDGDSWRLNGFKWFASNCAGQAFVV

SEQ ID NO: 1056590 - protein, 23 aa, Mycobacterium
TREILDREILGIAEAIRASGLSA

SEQ ID NO: 1056591 - protein, 26 aa, Mycobacterium
TREKLFPLICRYALAYHVVFIPSVEV

SEQ ID NO: 1056592 - protein, 18 aa, Mycobacterium
TRELPKSIIIAGAGAIGM

SEQ ID NO: 1056593 - protein, 19 aa, Mycobacterium
TRERLAIAIAQSNTCSYCL

SEQ ID NO: 1056594 - protein, 22 aa, Mycobacterium
TRFDGPVLRDGVIPEHRAARPG

SEQ ID NO: 1056595 - protein, 30 aa, Mycobacterium; identical to SEQ ID NO: 740154

SEQ ID NO: 1056596 - protein, 21 aa, Mycobacterium
TRGRDDWAVHVALWQRRANGR

SEQ ID NO: 1056597 - protein, 21 aa, Mycobacterium
TRGTLHLVIGCGGRSLTSNQL

SEQ ID NO: 1056598 - protein, 25 aa, Mycobacterium
TRGTLQYRILRGFKKAGINNDRAAG

SEQ ID NO: 1056599 - protein, 23 aa, Mycobacterium
TRHALAAVAAWLARPDTAETVLV

SEQ ID NO: 1056600 - protein, 19 aa, Mycobacterium
TRHLSDFGFATVDRNPSPE

SEQ ID NO: 1056601 - protein, 19 aa, Mycobacterium
TRIGTAVEELVRWATPVMT

SEQ ID NO: 1056602 - protein, 21 aa, Mycobacterium
TRIGVLPTFRRRQGIATELMN

SEQ ID NO: 1056603 - protein, 35 aa, Mycobacterium
TRILSNVARRGAHLRGRRKPVLVRHRLLQSPNRVP

SEQ ID NO: 1056604 - protein, 20 aa, Mycobacterium
TRIWRDGRVEQLGWPRVKIH

SEQ ID NO: 1056605 - protein, 25 aa, Mycobacterium
TRKLARNTFYGMARWQAKLEQKQGF

SEQ ID NO: 1056606 - protein, 25 aa, Mycobacterium
TRKPLTWRSSTRIAGAFGPGLQEPT

SEQ ID NO: 1056607 - protein, 18 aa, Mycobacterium
TRKQFGVTLSKFQALTQR

SEQ ID NO: 1056608 - protein, 20 aa, Mycobacterium
TRLAATFPQVCSRPAQSLPG

SEQ ID NO: 1056609 - protein, 20 aa, Mycobacterium
TRLALEVATRVADEFPDGVW

SEQ ID NO: 1056610 - protein, 18 aa, Mycobacterium
TRLERGAGVPAVERLGYF

SEQ ID NO: 1056611 - protein, 21 aa, Mycobacterium
TRLGPPLRVVVTAVRSLLQPM

SEQ ID NO: 1056612 - protein, 18 aa, Mycobacterium
TRLHRWRLNLVTGAVKEE

SEQ ID NO: 1056613 - protein, 17 aa, Mycobacterium
TRNACYLAFDCFHPQWD

SEQ ID NO: 1056614 - protein, 18 aa, Mycobacterium
TRNGRIGVIGTRATITSH

SEQ ID NO: 1056615 - protein, 20 aa, Mycobacterium
TRNPMIVSWPARITDRGGLR

SEQ ID NO: 1056616 - protein, 25 aa, Mycobacterium
TRPEGLRRWMAITARIEPYDAGVYR

SEQ ID NO: 1056617 - protein, 21 aa, Mycobacterium
TRPEPPLPPGPPRRRAQPPTA

SEQ ID NO: 1056618 - protein, 22 aa, Mycobacterium
TRPGGRIYAGFSPLYYSPFGDH

SEQ ID NO: 1056619 - protein, 21 aa, Mycobacterium
TRPGQYEAPLGITLRELLDYA

SEQ ID NO: 1056620 - protein, 19 aa, Mycobacterium
TRPIISMNGAHHFNEVILD

SEQ ID NO: 1056621 - protein, 20 aa, Mycobacterium
TRPREYARVLSPLHRLIRDI

SEQ ID NO: 1056622 - protein, 21 aa, Mycobacterium
TRPTSIGGLGFSMKWNMGWMH

SEQ ID NO: 1056623 - protein, 19 aa, Mycobacterium
TRRGNWWYYARTFEGRQYG

SEQ ID NO: 1056624 - protein, 32 aa, Mycobacterium
TRRHWRRRRVRRHRLRNGGIRRRHRRHRRDRR

SEQ ID NO: 1056625 - protein, 25 aa, Mycobacterium
TRRNFLYPRWSDFFDGIDPRRIAEL

SEQ ID NO: 1056626 - protein, 24 aa, Mycobacterium
TRRVEGRSGVWIPAGSGRPERKIA

SEQ ID NO: 1056627 - protein, 27 aa, Mycobacterium
TRRVRMMRWGFVPSWAKPGPQGAPEGK

SEQ ID NO: 1056628 - protein, 20 aa, Mycobacterium
TRSAIDFNRPGIPVVASLPS

SEQ ID NO: 1056629 - protein, 21 aa, Mycobacterium
TRSASLFARGFLLTKRDIDWF

SEQ ID NO: 1056630 - protein, 22 aa, Mycobacterium
TRSYGGGMLMCPNADRTDDLLD

SEQ ID NO: 1056631 - protein, 21 aa, Mycobacterium
TRTLGSLALMGVRVEELLVNQ

SEQ ID NO: 1056632 - protein, 20 aa, Mycobacterium
TRTRIRPHFFPFTEPSAEVD

SEQ ID NO: 1056633 - protein, 25 aa, Mycobacterium
TRVADEFPDGVWLFELAAVSDPAAV

SEQ ID NO: 1056634 - protein, 20 aa, Mycobacterium
TRVDGGWRITGQKIWTTAAQ

SEQ ID NO: 1056635 - protein, 18 aa, Mycobacterium
TRVDSGREPVWYIAPEDE

SEQ ID NO: 1056636 - protein, 23 aa, Mycobacterium
TRVPGIGKRGAERMVVELRDKVG

SEQ ID NO: 1056637 - protein, 22 aa, Mycobacterium
TRWAARLAPYGLRWYEEPGDPL

SEQ ID NO: 1056638 - protein, 21 aa, Mycobacterium
TRYILCLEPACSMTHDEIIRQ

SEQ ID NO: 1056639 - protein, 17 aa, Mycobacterium
TRYWYYALQTCRLNEHR

SEQ ID NO: 1056640 - protein, 26 aa, Mycobacterium
TSAAVRCWCCLASWPRSTSGSGRARG

SEQ ID NO: 1056641 - protein, 19 aa, Mycobacterium
TSAHGVVVVTGRRNTYQGV

SEQ ID NO: 1056642 - protein, 17 aa, Mycobacterium
TSALCLAEAGWPVRVWI

SEQ ID NO: 1056643 - protein, 19 aa, Mycobacterium
TSANWEWFDPVYSHRILWP

SEQ ID NO: 1056644 - protein, 33 aa, Mycobacterium; identical to SEQ ID NO: 740632

SEQ ID NO: 1056645 - protein, 18 aa, Mycobacterium
TSATLAFDATGGGTLAGQ

SEQ ID NO: 1056646 - protein, 25 aa, Mycobacterium
TSAVLGFAVDGGWWVLGVHTPAAAE

SEQ ID NO: 1056647 - protein, 17 aa, Mycobacterium
TSAVSGFKNVGSLQSGL

SEQ ID NO: 1056648 - protein, 17 aa, Mycobacterium
TSDVLTHAWDLAVATGQ

SEQ ID NO: 1056649 - protein, 23 aa, Mycobacterium
TSEKHFRRARGPKVELTLADGSQ

SEQ ID NO: 1056650 - protein, 28 aa, Mycobacterium
TSELPVGDYCFWNLRNIVRFDKAIAAAV

SEQ ID NO: 1056651 - protein, 29 aa, Mycobacterium
TSESLEDWKCWARWRLIRARAPWLTSDLV

SEQ ID NO: 1056652 - protein, 24 aa, Mycobacterium
TSFGRLDALINCAGIAEPPGSSIL

SEQ ID NO: 1056653 - protein, 22 aa, Mycobacterium
TSFKAKPGQRIRIRIINVASDT

SEQ ID NO: 1056654 - protein, 27 aa, Mycobacterium
TSGEQRLSGFLLWQSAYSEMWFTEAHW

SEQ ID NO: 1056655 - protein, 24 aa, Mycobacterium
TSGFMNVATTFGFASGINNVGDYQ

SEQ ID NO: 1056656 - protein, 30 aa, Mycobacterium
TSGGRGIHVFLRIASDWDFIEVRRAGIALA

SEQ ID NO: 1056657 - protein, 17 aa, Mycobacterium
TSGGVWGLDRGYCLMVG

SEQ ID NO: 1056658 - protein, 25 aa, Mycobacterium
TSGHIYRQGAGFTMETQHYPASPNH

SEQ ID NO: 1056659 - protein, 20 aa, Mycobacterium
TSGIIWRFSISATLWSCIPR

SEQ ID NO: 1056660 - protein, 29 aa, Mycobacterium
TSGRIERFLQLWAEGSMTIAMPSTPSNYF

SEQ ID NO: 1056661 - protein, 19 aa, Mycobacterium
TSGSRPAILPVASLETPTP

SEQ ID NO: 1056662 - protein, 20 aa, Mycobacterium
TSGSRPAILPVASLETPTPA

SEQ ID NO: 1056663 - protein, 17 aa, Mycobacterium
TSIFDVPDGFALTSDDR

SEQ ID NO: 1056664 - protein, 17 aa, Mycobacterium
TSIRRAGADIVLTYWAA

SEQ ID NO: 1056665 - protein, 17 aa, Mycobacterium
TSLLNWTRTMLAVRRRH

SEQ ID NO: 1056666 - protein, 22 aa, Mycobacterium
TSLRLIPNIVVLPYRNPFVVAK

SEQ ID NO: 1056667 - protein, 18 aa, Mycobacterium
TSMALAVAVAKRLHNQGI

SEQ ID NO: 1056668 - protein, 18 aa, Mycobacterium
TSNCGTCVVDVDGVPVKS

SEQ ID NO: 1056669 - protein, 17 aa, Mycobacterium
TSNGQLVIREVYADWSA

SEQ ID NO: 1056670 - protein, 25 aa, Mycobacterium
TSPARAAYVAGDWGAIASLSPELFL

SEQ ID NO: 1056671 - protein, 17 aa, Mycobacterium
TSPEATGLLVALRALAD

SEQ ID NO: 1056672 - protein, 17 aa, Mycobacterium
TSPEPATLMAHVKLALK

SEQ ID NO: 1056673 - protein, 24 aa, Mycobacterium
TSPTSPPCAIWCTRRAARCTSTAP

SEQ ID NO: 1056674 - protein, 30 aa, Mycobacterium; identical to SEQ ID NO: 740816

SEQ ID NO: 1056675 - protein, 21 aa, Mycobacterium
TSRAVPELVVERGGTPLRSRV

SEQ ID NO: 1056676 - protein, 25 aa, Mycobacterium
TSRHVGLAGGRRARHHPGMKPISGR

SEQ ID NO: 1056677 - protein, 25 aa, Mycobacterium
TSRKDWDWLVSINVMGVVHGCEAFL

SEQ ID NO: 1056678 - protein, 31 aa, Mycobacterium
TSRPSALTLDDVVKFLLPRGAAKKTAKAAST

SEQ ID NO: 1056679 - protein, 24 aa, Mycobacterium
TSRRRWSWTSSWPGRFSTCTRAGE

SEQ ID NO: 1056680 - protein, 24 aa, Mycobacterium
TSSGRGLWELAWPPLSSAGAPGAA

SEQ ID NO: 1056681 - protein, 24 aa, Mycobacterium
TSTDTSSYCPFKGDASYYSVTTST

SEQ ID NO: 1056682 - protein, 23 aa, Mycobacterium
TSTPPVPPPRDKRVGTAAPAPTR

SEQ ID NO: 1056683 - protein, 20 aa, Mycobacterium
TSTRCERKSSGITVTLTNPH

SEQ ID NO: 1056684 - protein, 23 aa, Mycobacterium
TSTRPCATCWGVIGDQLAADRAP

SEQ ID NO: 1056685 - protein, 19 aa, Mycobacterium
TSTSPGFGGGGGGGGAGGH

SEQ ID NO: 1056686 - protein, 24 aa, Mycobacterium
TSTTETFAAITLEVNSRRWAGVPF

SEQ ID NO: 1056687 - protein, 17 aa, Mycobacterium
TSVECENGWGIMRRVTL

SEQ ID NO: 1056688 - protein, 19 aa, Mycobacterium
TSVEPLIRYHGHDMAVLVS

SEQ ID NO: 1056689 - protein, 22 aa, Mycobacterium
TSVLSRGVCGVAGQTLIVNLPG

SEQ ID NO: 1056690 - protein, 26 aa, Mycobacterium
TSVMSGRIAYTLGLEGPAITVDTACS

SEQ ID NO: 1056691 - protein, 25 aa, Mycobacterium
TSVRHPLRWHHPALVMWYPDQGSEV

SEQ ID NO: 1056692 - protein, 23 aa, Mycobacterium
TSVVINPFFDWGYDRAPMIPYHE

SEQ ID NO: 1056693 - protein, 24 aa, Mycobacterium
TSWCGYCLRLKTALKAEGIAYDEI

SEQ ID NO: 1056694 - protein, 18 aa, Mycobacterium
TSYQAGVFEAEFGDGSKL

SEQ ID NO: 1056695 - protein, 23 aa, Mycobacterium
TSYSDVADWCLLLARTEPGASRH

SEQ ID NO: 1056696 - protein, 18 aa, Mycobacterium
TTACAYDHLIPGRGVGVL

SEQ ID NO: 1056697 - protein, 25 aa, Mycobacterium
TTADLFIRYLRPIRQGAARAVPRML

SEQ ID NO: 1056698 - protein, 21 aa, Mycobacterium
TTAEGFSWTPVHTMAGPDTSA

SEQ ID NO: 1056699 - protein, 24 aa, Mycobacterium
TTAEQRAGWDLSPLQVIVSAAEPV

SEQ ID NO: 1056700 - protein, 17 aa, Mycobacterium
TTAGLSMRHALRPRPWT

SEQ ID NO: 1056701 - protein, 19 aa, Mycobacterium
TTALTDVWRALRASMRSVL

SEQ ID NO: 1056702 - protein, 25 aa, Mycobacterium
TTCLEMAFDPGFRPLVEQLRDELTV

SEQ ID NO: 1056703 - protein, 22 aa, Mycobacterium
TTDVRGGLFFVWHDHEGNPPDP

SEQ ID NO: 1056704 - protein, 23 aa, Mycobacterium
TTEEVFSALGVVVNKGNVGALED

SEQ ID NO: 1056705 - protein, 25 aa, Mycobacterium
TTEKYWLQWRLIKDIDEHQRKQLER

SEQ ID NO: 1056706 - protein, 17 aa, Mycobacterium
TTFGGAIRGLPGAPASP

SEQ ID NO: 1056707 - protein, 23 aa, Mycobacterium
TTFTKRGKLGIRWYSSKQGHGEP

SEQ ID NO: 1056708 - protein, 19 aa, Mycobacterium
TTFTPKHMGVMFGAPGGDY

SEQ ID NO: 1056709 - protein, 24 aa, Mycobacterium
TTGGDGGNGGWLLGNGGNGAADGG

SEQ ID NO: 1056710 - protein, 28 aa, Mycobacterium
TTGKAFSAPPAWRVIKLAFGQPGPNASA

SEQ ID NO: 1056711 - protein, 23 aa, Mycobacterium
TTHRYRREYGLRVTSGRKVVELR

SEQ ID NO: 1056712 - protein, 19 aa, Mycobacterium
TTIMTPVFEVHRGPTGELQ

SEQ ID NO: 1056713 - protein, 20 aa, Mycobacterium
TTIRNLVHGIGFQRDVLGAD

SEQ ID NO: 1056714 - protein, 19 aa, Mycobacterium
TTISHLLCGFDLLEPLRAR

SEQ ID NO: 1056715 - protein, 19 aa, Mycobacterium
TTKDGNWSIVKGLEIDEFS

SEQ ID NO: 1056716 - protein, 17 aa, Mycobacterium
TTLDVAFSIVVKPGVGA

SEQ ID NO: 1056717 - protein, 24 aa, Mycobacterium
TTLEELWWDRPFTLEGVDIGASVA

SEQ ID NO: 1056718 - protein, 25 aa, Mycobacterium
TTLGGNGGDGGWLFGSGGNGAAGAA

SEQ ID NO: 1056719 - protein, 18 aa, Mycobacterium
TTLMKILIVSWEYPPVVI

SEQ ID NO: 1056720 - protein, 23 aa, Mycobacterium
TTLPRDCLLVFGREGPGITDDTR

SEQ ID NO: 1056721 - protein, 19 aa, Mycobacterium
TTLPVAPCAPTVSPAPPSP

SEQ ID NO: 1056722 - protein, 17 aa, Mycobacterium
TTLRLLPHFETISYGEL

SEQ ID NO: 1056723 - protein, 22 aa, Mycobacterium
TTLSGRFGVPVITAPRPQLTAA

SEQ ID NO: 1056724 - protein, 17 aa, Mycobacterium
TTMLGESAMAWEGPSAQ

SEQ ID NO: 1056725 - protein, 19 aa, Mycobacterium
TTMQYRLPSMVTRPTQDIG

SEQ ID NO: 1056726 - protein, 18 aa, Mycobacterium
TTMRLLDELGLWERFAEL

SEQ ID NO: 1056727 - protein, 23 aa, Mycobacterium
TTNLPGPLWQASAMGKAATTTAV

SEQ ID NO: 1056728 - protein, 18 aa, Mycobacterium
TTPAGAALGARLTIEKAV

SEQ ID NO: 1056729 - protein, 24 aa, Mycobacterium
TTPARLLVEEWVRLSQRSLTPPRV

SEQ ID NO: 1056730 - protein, 24 aa, Mycobacterium
TTPDPSYHGVVFAELGAPAYALKA

SEQ ID NO: 1056731 - protein, 24 aa, Mycobacterium
TTPTELRSALTAALASNGPTVIDC

SEQ ID NO: 1056732 - protein, 20 aa, Mycobacterium
TTRKEIRDILATEILDPLGF

SEQ ID NO: 1056733 - protein, 24 aa, Mycobacterium
TTTDLTAASLLKSMPTAVNAPAQA

SEQ ID NO: 1056734 - protein, 27 aa, Mycobacterium
TTTPPVEGSWAWLPDEAKGARIHYRPR

SEQ ID NO: 1056735 - protein, 24 aa, Mycobacterium
TTTSLCPWKGVAHYYTVVVDGRTN

SEQ ID NO: 1056736 - protein, 26 aa, Mycobacterium
TTTSWLTSRHSFSFGDHYDPDNTHHG

SEQ ID NO: 1056737 - protein, 24 aa, Mycobacterium
TTVKAGLGLLGFPVGDPRPPLLPL

SEQ ID NO: 1056738 - protein, 21 aa, Mycobacterium
TTVLFAWAVVLSRLTDRRDVV

SEQ ID NO: 1056739 - protein, 17 aa, Mycobacterium
TTVPAAFAHHLPSGYSD

SEQ ID NO: 1056740 - protein, 25 aa, Mycobacterium
TTYLRRRPAPGWMRVMASSTVIGDS

SEQ ID NO: 1056741 - protein, 18 aa, Mycobacterium
TVAATVFTRPEIAAVGVP

SEQ ID NO: 1056742 - protein, 22 aa, Mycobacterium
TVADMRGVLALFEGVATGAADG

SEQ ID NO: 1056743 - protein, 19 aa, Mycobacterium
TVAIPSLFGKPGKAVSIGY

SEQ ID NO: 1056744 - protein, 24 aa, Mycobacterium
TVAVLLRITEVFGVDATFFSSQDD

SEQ ID NO: 1056745 - protein, 24 aa, Mycobacterium
TVCILDRPRHAQLIEDVRATGARI

SEQ ID NO: 1056746 - protein, 23 aa, Mycobacterium
TVDAAGLLKIWEALIIVYPNGTP

SEQ ID NO: 1056747 - protein, 30 aa, Mycobacterium
TVDGLRRDYRWAEAERHLWIADVRGTWHIR

SEQ ID NO: 1056748 - protein, 18 aa, Mycobacterium
TVDYCWLRSDIADPSARL

SEQ ID NO: 1056749 - protein, 17 aa, Mycobacterium
TVEHTIEILKGLRDRYE

SEQ ID NO: 1056750 - protein, 21 aa, Mycobacterium
TVEPWGVVTEKGRWYLVGHDR

SEQ ID NO: 1056751 - protein, 34 aa, Mycobacterium
TVERGNPDYGLRLSWDFLARSTAGLWEWAECLGN

SEQ ID NO: 1056752 - protein, 21 aa, Mycobacterium
TVERIAHAWTEVGFDAAAVTD

SEQ ID NO: 1056753 - protein, 25 aa, Mycobacterium
TVEVEVRPKIALPDFSTLKVVVDPV

SEQ ID NO: 1056754 - protein, 31 aa, Mycobacterium; identical to SEQ ID NO: 741357

SEQ ID NO: 1056755 - protein, 19 aa, Mycobacterium
TVFCERYLPTGHHIEVQVM

SEQ ID NO: 1056756 - protein, 22 aa, Mycobacterium
TVFDFTAQWALDRHTFGRPLAS

SEQ ID NO: 1056757 - protein, 23 aa, Mycobacterium
TVFDGGWILPGLVDAHCHVGLGH

SEQ ID NO: 1056758 - protein, 24 aa, Mycobacterium
TVFTLSGGHLFSLYDGCRDEGVRL

SEQ ID NO: 1056759 - protein, 20 aa, Mycobacterium
TVFVCPSVHEPLGIVNLEAM

SEQ ID NO: 1056760 - protein, 17 aa, Mycobacterium
TVGCSTATRALRSAREC

SEQ ID NO: 1056761 - protein, 18 aa, Mycobacterium
TVGECSRCLTPVTGSVQV

SEQ ID NO: 1056762 - protein, 17 aa, Mycobacterium
TVGELRYPTGEFTDAIE

SEQ ID NO: 1056763 - protein, 18 aa, Mycobacterium
TVGPYMRYGLPLVAACAA

SEQ ID NO: 1056764 - protein, 17 aa, Mycobacterium
TVIAWHRYVADLIGQAK

SEQ ID NO: 1056765 - protein, 18 aa, Mycobacterium
TVIDVLRGKLEFESGEEG

SEQ ID NO: 1056766 - protein, 28 aa, Mycobacterium
TVIRASLRPAQRWMLSAGVLSVIGSIVD

SEQ ID NO: 1056767 - protein, 24 aa, Mycobacterium
TVITRKAYGGAYCVMGSKDMGCDV

SEQ ID NO: 1056768 - protein, 17 aa, Mycobacterium
TVIWGLPDGHVYVTTPG

SEQ ID NO: 1056769 - protein, 24 aa, Mycobacterium
TVKHAMAALVDRVCEVDGREPALL

SEQ ID NO: 1056770 - protein, 27 aa, Mycobacterium
TVKPRSCAALPRILRDNGYVTGAFGKW

SEQ ID NO: 1056771 - protein, 26 aa, Mycobacterium
TVKTFKRAGGQIWLMPHNPAFDPIPG

SEQ ID NO: 1056772 - protein, 23 aa, Mycobacterium
TVKYRVGRAVARRGRAIGSDRLD

SEQ ID NO: 1056773 - protein, 24 aa, Mycobacterium
TVLAAKADSAWHLHQLTANTELAA

SEQ ID NO: 1056774 - protein, 18 aa, Mycobacterium
TVLCGELSLMAAQTNPGE

SEQ ID NO: 1056775 - protein, 19 aa, Mycobacterium
TVLDRLGLAGANIEIRSTS

SEQ ID NO: 1056776 - protein, 23 aa, Mycobacterium
TVLEMTARLAAPLLPLVTEVIWR

SEQ ID NO: 1056777 - protein, 23 aa, Mycobacterium
TVLGALRLRWLGTELNAMPIDAG

SEQ ID NO: 1056778 - protein, 17 aa, Mycobacterium
TVLPSGFEIVVRKTYGR

SEQ ID NO: 1056779 - protein, 19 aa, Mycobacterium
TVNRGCVMRPHLFLQKNQA

SEQ ID NO: 1056780 - protein, 24 aa, Mycobacterium
TVNRGCVMRPHLFLQKNQAWNLHR

SEQ ID NO: 1056781 - protein, 19 aa, Mycobacterium
TVNVCKYNLGWGAVGMCTH

SEQ ID NO: 1056782 - protein, 25 aa, Mycobacterium
TVPDNMGMLFRKHLVMFGPREVLLA

SEQ ID NO: 1056783 - protein, 17 aa, Mycobacterium
TVPFSFKEIDDDGLIAY

SEQ ID NO: 1056784 - protein, 19 aa, Mycobacterium
TVPGAGPLYYPRFLTELPY

SEQ ID NO: 1056785 - protein, 24 aa, Mycobacterium
TVPGFPNLFLIYGPGTHLAHGGSL

SEQ ID NO: 1056786 - protein, 17 aa, Mycobacterium
TVPGTRLATLIGESAQV

SEQ ID NO: 1056787 - protein, 17 aa, Mycobacterium
TVPLELVAANRSALMSM

SEQ ID NO: 1056788 - protein, 22 aa, Mycobacterium
TVPMRLSGWPGRFHTEPAPLLG

SEQ ID NO: 1056789 - protein, 28 aa, Mycobacterium
TVPRLAFPTATGRAVFFARPHLVPDEMP

SEQ ID NO: 1056790 - protein, 18 aa, Mycobacterium
TVPVELDVSAGFDITELP

SEQ ID NO: 1056791 - protein, 25 aa, Mycobacterium
TVPYRANMWALRALGARRVFAPCAV

SEQ ID NO: 1056792 - protein, 23 aa, Mycobacterium
TVQGSGWAALGWDTLGNKLLIFQ

SEQ ID NO: 1056793 - protein, 17 aa, Mycobacterium
TVRFCVANAAVAVRGLA

SEQ ID NO: 1056794 - protein, 23 aa, Mycobacterium
TVRGICRQAGLSARYFYESFPDK

SEQ ID NO: 1056795 - protein, 18 aa, Mycobacterium
TVRHCARVALGDLGVPPV

SEQ ID NO: 1056796 - protein, 24 aa, Mycobacterium
TVRNWPRRRRVLSKAANTYSRLIL

SEQ ID NO: 1056797 - protein, 18 aa, Mycobacterium
TVRPVIAVASHFPHLPWP

SEQ ID NO: 1056798 - protein, 17 aa, Mycobacterium
TVSLMMANRVEFYPLEV

SEQ ID NO: 1056799 - protein, 20 aa, Mycobacterium
TVSLRLPVRTPFAYQGVFGH

SEQ ID NO: 1056800 - protein, 24 aa, Mycobacterium
TVSWPRSAKLLDVLLAAGLDAPFS

SEQ ID NO: 1056801 - protein, 26 aa, Mycobacterium
TVSYEAGDALGVWPRNAHQLVDEWLG

SEQ ID NO: 1056802 - protein, 32 aa, Mycobacterium; identical to SEQ ID NO: 741596

SEQ ID NO: 1056803 - protein, 25 aa, Mycobacterium
TVTFSDRYEPAWVYRGNDAAAVRDG

SEQ ID NO: 1056804 - protein, 21 aa, Mycobacterium
TVTWADLRYRVAALAGSLSRR

SEQ ID NO: 1056805 - protein, 21 aa, Mycobacterium
TVVCVSRLVPRKGQDTLIKAL

SEQ ID NO: 1056806 - protein, 20 aa, Mycobacterium
TVVPDPRYVAVSDHDQLATE

SEQ ID NO: 1056807 - protein, 18 aa, Mycobacterium
TVVPLLPAQDFKRVGEGD

SEQ ID NO: 1056808 - protein, 19 aa, Mycobacterium
TVVSKVFGGYGLSAQAVLT

SEQ ID NO: 1056809 - protein, 17 aa, Mycobacterium
TVVSWLPFFHDMGLMFG

SEQ ID NO: 1056810 - protein, 20 aa, Mycobacterium
TVYFALAVRGRLQRGETVLV

SEQ ID NO: 1056811 - protein, 23 aa, Mycobacterium
TVYFPSLSGRTFVYKGMLTTPQL

SEQ ID NO: 1056812 - protein, 18 aa, Mycobacterium
TVYPGLSQRVHDMFSERG

SEQ ID NO: 1056813 - protein, 19 aa, Mycobacterium
TWAAPQWLELGRELAGSDS

SEQ ID NO: 1056814 - protein, 19 aa, Mycobacterium
TWDLLRLTRMPTVQVDIGY

SEQ ID NO: 1056815 - protein, 21 aa, Mycobacterium
TWFKHAVFYEVLVRAFYDGTA

SEQ ID NO: 1056816 - protein, 25 aa, Mycobacterium
TWGVMGIGMGYSIAAAVETGRPVVA

SEQ ID NO: 1056817 - protein, 26 aa, Mycobacterium
TWLGRDRFVLSCGHSSLTLYIQLYLG

SEQ ID NO: 1056818 - protein, 17 aa, Mycobacterium
TWLPMPPEWAALTVEKQ

SEQ ID NO: 1056819 - protein, 23 aa, Mycobacterium
TWMPSTRVRRSAWHELFAKNLEA

SEQ ID NO: 1056820 - protein, 24 aa, Mycobacterium
TWNTLYRKWLSVLGPAPAPPRPRY

SEQ ID NO: 1056821 - protein, 17 aa, Mycobacterium
TWPAEGLTYPKALADDL

SEQ ID NO: 1056822 - protein, 18 aa, Mycobacterium
TWQWESLIGESTRLVAVT

SEQ ID NO: 1056823 - protein, 23 aa, Mycobacterium
TWRTLRAAVPAMIEAGNGGSIIV

SEQ ID NO: 1056824 - protein, 24 aa, Mycobacterium
TWRYLLVPCAIEFWDEDGGAASGE

SEQ ID NO: 1056825 - protein, 17 aa, Mycobacterium
TWSERKLTEGDWTLDRE

SEQ ID NO: 1056826 - protein, 24 aa, Mycobacterium
TWWEFPRDIEAPLSEVARNRRVPL

SEQ ID NO: 1056827 - protein, 24 aa, Mycobacterium
TYAFERRRFWLSGDAVPADAAGLG

SEQ ID NO: 1056828 - protein, 17 aa, Mycobacterium
TYAQEYQTFGAHMAAFH

SEQ ID NO: 1056829 - protein, 31 aa, Mycobacterium; identical to SEQ ID NO: 936741

SEQ ID NO: 1056830 - protein, 24 aa, Mycobacterium
TYAVPRLLARNGLTLQDFDFYEIH

SEQ ID NO: 1056831 - protein, 24 aa, Mycobacterium
TYDDFKPMFIKAVKQFDPDSWADF

SEQ ID NO: 1056832 - protein, 23 aa, Mycobacterium
TYEALRRFNVRIVCVAITGYGLH

SEQ ID NO: 1056833 - protein, 17 aa, Mycobacterium
TYFFSDPAARDFVTGVA

SEQ ID NO: 1056834 - protein, 21 aa, Mycobacterium
TYGFQHRRFWLGQLDAGRTDV

SEQ ID NO: 1056835 - protein, 26 aa, Mycobacterium
TYGIDFIEACAWIKENLPGVHISGGI

SEQ ID NO: 1056836 - protein, 18 aa, Mycobacterium
TYGLIVYQEQIMFIAQKV

SEQ ID NO: 1056837 - protein, 18 aa, Mycobacterium
TYGMPRLAVYSATKHAVK

SEQ ID NO: 1056838 - protein, 19 aa, Mycobacterium
TYHAFAGSLLRDHGLLLPI

SEQ ID NO: 1056839 - protein, 24 aa, Mycobacterium
TYHDVLRLPVDVVVTEKFAADPPP

SEQ ID NO: 1056840 - protein, 18 aa, Mycobacterium
TYIRSCVDAGDVMAATEA

SEQ ID NO: 1056841 - protein, 20 aa, Mycobacterium
TYPSLAKRRAVLNAHIKLTE

SEQ ID NO: 1056842 - protein, 19 aa, Mycobacterium
TYRCPGCDHEIRSGTAHVV

SEQ ID NO: 1056843 - protein, 21 aa, Mycobacterium
TYRITPLALWNARAAGHDAEQ

SEQ ID NO: 1056844 - protein, 24 aa, Mycobacterium
TYTAGGLPLQFPPEITDDAQMQAY

SEQ ID NO: 1056845 - protein, 17 aa, Mycobacterium
VAAAAKVNTLLDIAQAN

SEQ ID NO: 1056846 - protein, 17 aa, Mycobacterium
VAAAIVVRAHCPTPTLD

SEQ ID NO: 1056847 - protein, 19 aa, Mycobacterium
VAAAVELMHNFSLVHDDVM

SEQ ID NO: 1056848 - protein, 19 aa, Mycobacterium
VAAAVVCSTPALTSEDLRT

SEQ ID NO: 1056849 - protein, 17 aa, Mycobacterium
VAADGSARFVRYHMIPA

SEQ ID NO: 1056850 - protein, 22 aa, Mycobacterium
VAAEAPRGITIYGQEKDNATWA

SEQ ID NO: 1056851 - protein, 35 aa, Mycobacterium
VAAEATRVGMPYVNQRWLGGMLTNFSTVHKRLQRL

SEQ ID NO: 1056852 - protein, 17 aa, Mycobacterium
VAAEFGAGLVCAHTGGA

SEQ ID NO: 1056853 - protein, 25 aa, Mycobacterium
VAAEIARLALFLTTPAARHITGQTL

SEQ ID NO: 1056854 - protein, 28 aa, Mycobacterium
VAAGDHAAICWPLLVGMAKAKYYLLTCE

SEQ ID NO: 1056855 - protein, 18 aa, Mycobacterium
VAAGKFAVAKAVLGFANR

SEQ ID NO: 1056856 - protein, 24 aa, Mycobacterium
VAAGRLLFRPAVEIEPSGLGRIEP

SEQ ID NO: 1056857 - protein, 22 aa, Mycobacterium
VAAGSWSRHRIEAIQRAADVTA

SEQ ID NO: 1056858 - protein, 26 aa, Mycobacterium
VAAHVPEAIPLLFGHIGEGNLHLNVL

SEQ ID NO: 1056859 - protein, 18 aa, Mycobacterium
VAAKDIWVRPTERAIVET

SEQ ID NO: 1056860 - protein, 17 aa, Mycobacterium
VAALCGSPSQARKHANA

SEQ ID NO: 1056861 - protein, 25 aa, Mycobacterium
VAALQRSDLLIALGSRFDDRVTGKL

SEQ ID NO: 1056862 - protein, 21 aa, Mycobacterium
VAAPYASWLSAAAAQAAGTAG

SEQ ID NO: 1056863 - protein, 22 aa, Mycobacterium
VAAQSWSLDRIKAVKNAADVTV

SEQ ID NO: 1056864 - protein, 19 aa, Mycobacterium
VAARGARLTIADPVGATSS

SEQ ID NO: 1056865 - protein, 19 aa, Mycobacterium
VAARGGLTGAAYTWGEESE

SEQ ID NO: 1056866 - protein, 20 aa, Mycobacterium
VAARIGIKVLGYRPGRSARK

SEQ ID NO: 1056867 - protein, 17 aa, Mycobacterium
VAARLRPTTALIVDHGL

SEQ ID NO: 1056868 - protein, 17 aa, Mycobacterium
VAARPPASLVLFSPLID

SEQ ID NO: 1056869 - protein, 20 aa, Mycobacterium
VAAVPLMLEHSGGGGIINIT

SEQ ID NO: 1056870 - protein, 20 aa, Mycobacterium
VAAVSGRLPVVVGVSDVTTA

SEQ ID NO: 1056871 - protein, 25 aa, Mycobacterium
VAAYRWHMRAGKWALNRDIAAARLS

SEQ ID NO: 1056872 - protein, 20 aa, Mycobacterium
VACDGPVIGAAALWDPPNQW

SEQ ID NO: 1056873 - protein, 19 aa, Mycobacterium
VACGRAVSRAGDWFGSPVN

SEQ ID NO: 1056874 - protein, 19 aa, Mycobacterium
VACRVRPGGRFVTLTTNPG

SEQ ID NO: 1056875 - protein, 22 aa, Mycobacterium
VADAGLVFQGWFQKTPYYPHDF

SEQ ID NO: 1056876 - protein, 19 aa, Mycobacterium
VADAVAFLVSENSSFITGS

SEQ ID NO: 1056877 - protein, 19 aa, Mycobacterium
VADAYRFLPTLGEVDLHLF

SEQ ID NO: 1056878 - protein, 23 aa, Mycobacterium
VADFPRYPLNLVSTLNALAGAYY

SEQ ID NO: 1056879 - protein, 19 aa, Mycobacterium
VADIFFLVCDGLKGLPDSV

SEQ ID NO: 1056880 - protein, 20 aa, Mycobacterium
VADLRMLFIVSGKLKEGRRW

SEQ ID NO: 1056881 - protein, 19 aa, Mycobacterium
VADRALCPEEEGITGYVDT

SEQ ID NO: 1056882 - protein, 19 aa, Mycobacterium
VADRLRGDELVKALMHSDL

SEQ ID NO: 1056883 - protein, 23 aa, Mycobacterium
VADRRYPAILAMTSLNDTRVYFV

SEQ ID NO: 1056884 - protein, 26 aa, Mycobacterium
VADVFPARLGERILAYEGAKQQDKPA

SEQ ID NO: 1056885 - protein, 18 aa, Mycobacterium
VADVGYWAETLRPLPEPP

SEQ ID NO: 1056886 - protein, 23 aa, Mycobacterium
VADYPARIVAVGVDRDCRATEVA

SEQ ID NO: 1056887 - protein, 21 aa, Mycobacterium
VADYPAVLLNGSWLTQEQAAA

SEQ ID NO: 1056888 - protein, 25 aa, Mycobacterium
VAEALGEHVFDFFLRNKRREWATYR

SEQ ID NO: 1056889 - protein, 24 aa, Mycobacterium
VAEALPRLDPALCKVMAGFFELVG

SEQ ID NO: 1056890 - protein, 17 aa, Mycobacterium
VAEEALKLTSADAALVA

SEQ ID NO: 1056891 - protein, 26 aa, Mycobacterium
VAEELGQPLPLFIKWDDADYGLRAAE

SEQ ID NO: 1056892 - protein, 21 aa, Mycobacterium
VAEGRVAGVHFLMKKNKITEI

SEQ ID NO: 1056893 - protein, 19 aa, Mycobacterium
VAEGYGLTSPNVNVSVNGG

SEQ ID NO: 1056894 - protein, 18 aa, Mycobacterium
VAEIGRRGLAGADVAAIA

SEQ ID NO: 1056895 - protein, 17 aa, Mycobacterium
VAELFAGNVTPRYQQHL

SEQ ID NO: 1056896 - protein, 23 aa, Mycobacterium
VAELGLPVVVRPSFTMGGLGSGM

SEQ ID NO: 1056897 - protein, 20 aa, Mycobacterium
VAELKKFRDARDIADGEIIM

SEQ ID NO: 1056898 - protein, 25 aa, Mycobacterium
VAELVLHAPWCLPKTRRPISRSAWP

SEQ ID NO: 1056899 - protein, 23 aa, Mycobacterium
VAEPGALIGFLGPRVYELLYDEP

SEQ ID NO: 1056900 - protein, 20 aa, Mycobacterium
VAEPPAWVVVAEDPDAVSAG

SEQ ID NO: 1056901 - protein, 22 aa, Mycobacterium
VAEPVAWFTHYYWLDDDRAPEF

SEQ ID NO: 1056902 - protein, 22 aa, Mycobacterium
VAEPYLPLRAVRHLEKGRVVIF

SEQ ID NO: 1056903 - protein, 19 aa, Mycobacterium
VAERMLCKVAAEADRATVT

SEQ ID NO: 1056904 - protein, 25 aa, Mycobacterium
VAERQRVRWQAGWDSGGAQTQIDPG

SEQ ID NO: 1056905 - protein, 26 aa, Mycobacterium
VAESGRLLAWRLNRVVDAASQLRDEL

SEQ ID NO: 1056906 - protein, 26 aa, Mycobacterium
VAEWARASEELTLWASTQTPHELRAF

SEQ ID NO: 1056907 - protein, 18 aa, Mycobacterium
VAFADSWKQTLRASDYAA

SEQ ID NO: 1056908 - protein, 19 aa, Mycobacterium
VAFAQEYGLPIAIKAAFGG

SEQ ID NO: 1056909 - protein, 19 aa, Mycobacterium
VAFCAAGPASMPAQPVRVV

SEQ ID NO: 1056910 - protein, 36 aa, Mycobacterium; identical to SEQ ID NO: 742362

SEQ ID NO: 1056911 - protein, 18 aa, Mycobacterium
VAFSSTYIRSCVDAGDMM

SEQ ID NO: 1056912 - protein, 23 aa, Mycobacterium
VAFSSTYIRSCVDAGDMMAATEA

SEQ ID NO: 1056913 - protein, 20 aa, Mycobacterium
VAGAAEFAFSVADLDGATRL

SEQ ID NO: 1056914 - protein, 21 aa, Mycobacterium
VAGALRPGDQLVLGASNPVRD

SEQ ID NO: 1056915 - protein, 22 aa, Mycobacterium
VAGAVWRPRFVEPVVKARKWAE

SEQ ID NO: 1056916 - protein, 25 aa, Mycobacterium
VAGAWTFGSSTAWNPLPRGWYPGPQ

SEQ ID NO: 1056917 - protein, 24 aa, Mycobacterium
VAGCGACAGCATRDPAMCVSGPQI

SEQ ID NO: 1056918 - protein, 23 aa, Mycobacterium
VAGEESYVLLVRVVSARALEDLL

SEQ ID NO: 1056919 - protein, 21 aa, Mycobacterium
VAGEVFGAWQTVLAGRFRAQG

SEQ ID NO: 1056920 - protein, 19 aa, Mycobacterium
VAGGYRTADQFADDISAAR

SEQ ID NO: 1056921 - protein, 19 aa, Mycobacterium
VAGIGSAVSTASRAAAAPT

SEQ ID NO: 1056922 - protein, 19 aa, Mycobacterium
VAGKTVAYAAVFTDVYGLR

SEQ ID NO: 1056923 - protein, 21 aa, Mycobacterium
VAGKTVWGVGIAPSITTASLR

SEQ ID NO: 1056924 - protein, 22 aa, Mycobacterium
VAGLPADLSVAFVEPAQNAALI

SEQ ID NO: 1056925 - protein, 26 aa, Mycobacterium
VAGLSVRPGYVLSDGFRVPGLSVPSL

SEQ ID NO: 1056926 - protein, 17 aa, Mycobacterium
VAGLTWLPFIGERYTAV

SEQ ID NO: 1056927 - protein, 25 aa, Mycobacterium
VAGMLADAAARCVIIDAETREILPS

SEQ ID NO: 1056928 - protein, 21 aa, Mycobacterium
VAGMRCGHCESAIRSEVAQIP

SEQ ID NO: 1056929 - protein, 25 aa, Mycobacterium
VAGNELPLVAGMAFSIEPGIYFPGR

SEQ ID NO: 1056930 - protein, 25 aa, Mycobacterium
VAGPAYNTGSAWGYTPKGATGVPTR

SEQ ID NO: 1056931 - protein, 20 aa, Mycobacterium
VAGRRMAETVARRGGIVVLP

SEQ ID NO: 1056932 - protein, 25 aa, Mycobacterium
VAGRSHAWIQAWTGGWWHYDPTNDT

SEQ ID NO: 1056933 - protein, 24 aa, Mycobacterium
VAGSSRLGWRLEVNDGGQWAFFDD

SEQ ID NO: 1056934 - protein, 22 aa, Mycobacterium
VAGVMWKRFTETGAIKAKSVII

SEQ ID NO: 1056935 - protein, 19 aa, Mycobacterium
VAGVPVGNVISVRLAGNHV

SEQ ID NO: 1056936 - protein, 18 aa, Mycobacterium
VAGVRGREDGFYDFETKY

SEQ ID NO: 1056937 - protein, 23 aa, Mycobacterium
VAHDWGGPVAFIMMLRYPAKVTG

SEQ ID NO: 1056938 - protein, 23 aa, Mycobacterium
VAHPDRRTVLLIGDGAAQLTVQE

SEQ ID NO: 1056939 - protein, 17 aa, Mycobacterium
VAHRAALQMSFYEGPSA

SEQ ID NO: 1056940 - protein, 18 aa, Mycobacterium
VAHSIRFGVLSRFTAFVA

SEQ ID NO: 1056941 - protein, 18 aa, Mycobacterium
VAIAALFGGFGREYQAVC

SEQ ID NO: 1056942 - protein, 24 aa, Mycobacterium
VAIDAGEKVGMVFGELVHGEVDVR

SEQ ID NO: 1056943 - protein, 19 aa, Mycobacterium
VAIDSGGEWVVLRAEQLEI

SEQ ID NO: 1056944 - protein, 23 aa, Mycobacterium
VAIEGDSAFGFSGMEVETICRYQ

SEQ ID NO: 1056945 - protein, 18 aa, Mycobacterium
VAIFDAMRGSVADDNDGE

SEQ ID NO: 1056946 - protein, 26 aa, Mycobacterium
VAIFRARPSPFYIMDEVEAALDDTNL

SEQ ID NO: 1056947 - protein, 17 aa, Mycobacterium
VAIHDRFVAALAAGAQS

SEQ ID NO: 1056948 - protein, 25 aa, Mycobacterium
VAIIERGRMLGGVCVNTGTIPSKTL

SEQ ID NO: 1056949 - protein, 26 aa, Mycobacterium
VAILDEFDEHLALRCGRSEHTRRAYL

SEQ ID NO: 1056950 - protein, 17 aa, Mycobacterium
VAILSATRYEWVILDYA

SEQ ID NO: 1056951 - protein, 21 aa, Mycobacterium
VAIRRHGRFLSMDEIAAEIGV

SEQ ID NO: 1056952 - protein, 19 aa, Mycobacterium
VAKLPGVRIIVAGGPSGSG

SEQ ID NO: 1056953 - protein, 17 aa, Mycobacterium
VAKRGATIIDARGASSA

SEQ ID NO: 1056954 - protein, 17 aa, Mycobacterium
VAKSGYAEVEFTVDRAV

SEQ ID NO: 1056955 - protein, 17 aa, Mycobacterium
VALAGGVQLMLSPFTSI

SEQ ID NO: 1056956 - protein, 24 aa, Mycobacterium
VALASSTRYEWVLVDFAVTCAGAA

SEQ ID NO: 1056957 - protein, 24 aa, Mycobacterium
VALDRLGYDEAWFGEHHSGGYELI

SEQ ID NO: 1056958 - protein, 19 aa, Mycobacterium
VALEVMRYACGDRAEEVLL

SEQ ID NO: 1056959 - protein, 20 aa, Mycobacterium
VALFADIQLIALIAQNPEAA

SEQ ID NO: 1056960 - protein, 22 aa, Mycobacterium
VALGDRMAWRVLATGECEKLTP

SEQ ID NO: 1056961 - protein, 17 aa, Mycobacterium
VALGRRGPTGAGRCTAL

SEQ ID NO: 1056962 - protein, 21 aa, Mycobacterium
VALHANFPPERITLHGNNKSV

SEQ ID NO: 1056963 - protein, 17 aa, Mycobacterium
VALHILLDGVDLRDGVD

SEQ ID NO: 1056964 - protein, 24 aa, Mycobacterium
VALKERGFRLLALTPKGDARALPE

SEQ ID NO: 1056965 - protein, 17 aa, Mycobacterium
VALKEVVRIAADEAGVA

SEQ ID NO: 1056966 - protein, 17 aa, Mycobacterium
VALLLERTHLIPIAVLA

SEQ ID NO: 1056967 - protein, 24 aa, Mycobacterium
VALLSRGKLLYGVVDNEDQPPGSR

SEQ ID NO: 1056968 - protein, 17 aa, Mycobacterium
VALRAAIAVAESGLAAA

SEQ ID NO: 1056969 - protein, 17 aa, Mycobacterium
VALRDGLQIEKPVPLSA

SEQ ID NO: 1056970 - protein, 18 aa, Mycobacterium
VALRDGRDGHIFGRRTLP

SEQ ID NO: 1056971 - protein, 23 aa, Mycobacterium
VALRNRLRLAATHAARTSADVVR

SEQ ID NO: 1056972 - protein, 18 aa, Mycobacterium
VALSLVYEGGRLTRASTR

SEQ ID NO: 1056973 - protein, 20 aa, Mycobacterium
VALTELFKRIRGYQVDEGNA

SEQ ID NO: 1056974 - protein, 21 aa, Mycobacterium
VALTGRPLIGNGADGAAGTGE

SEQ ID NO: 1056975 - protein, 25 aa, Mycobacterium
VALTPRPVPTVAIGHLHEQTVSVPE

SEQ ID NO: 1056976 - protein, 20 aa, Mycobacterium
VAMDRAEFLAALSSNTAAGL

SEQ ID NO: 1056977 - protein, 19 aa, Mycobacterium
VAMLLERTPLIPIAVLAII

SEQ ID NO: 1056978 - protein, 25 aa, Mycobacterium
VAMVLRRLLRLCARYSAHPTVIFAS

SEQ ID NO: 1056979 - protein, 20 aa, Mycobacterium
VAMVLSHRSGVIGPNARMSW

SEQ ID NO: 1056980 - protein, 18 aa, Mycobacterium
VANEVAWEQSVFGTDSAL

SEQ ID NO: 1056981 - protein, 17 aa, Mycobacterium
VANLHWQGRTFDIAIGP

SEQ ID NO: 1056982 - protein, 33 aa, Mycobacterium; identical to SEQ ID NO: 742760

SEQ ID NO: 1056983 - protein, 20 aa, Mycobacterium
VANRLCAQILLLAAEDASKD

SEQ ID NO: 1056984 - protein, 20 aa, Mycobacterium
VAPACFFPAGDRALLARFAD

SEQ ID NO: 1056985 - protein, 25 aa, Mycobacterium
VAPDSPHDWIECGEWIRELRPHIDL

SEQ ID NO: 1056986 - protein, 22 aa, Mycobacterium
VAPEAIAAAILDLTGDIRQVPS

SEQ ID NO: 1056987 - protein, 25 aa, Mycobacterium
VAPGLFWQRKYRVLQRLGESRADVR

SEQ ID NO: 1056988 - protein, 19 aa, Mycobacterium
VAPGTNWKSNPNAMRTIAA

SEQ ID NO: 1056989 - protein, 19 aa, Mycobacterium
VAPGVRMLIVPGSMRVRAQ

SEQ ID NO: 1056990 - protein, 19 aa, Mycobacterium
VAPGYIWGDTLQGYFEHQA

SEQ ID NO: 1056991 - protein, 23 aa, Mycobacterium
VAPKGMRASRRYRVPPMPFSLSV

SEQ ID NO: 1056992 - protein, 21 aa, Mycobacterium
VAQACAFINYAQGRYGVAADA

SEQ ID NO: 1056993 - protein, 25 aa, Mycobacterium
VAQEPRGAGGFGYDPVFIADGANRT

SEQ ID NO: 1056994 - protein, 26 aa, Mycobacterium
VAQMGKNGWLTLNWPKEYGGQDRSPM

SEQ ID NO: 1056995 - protein, 17 aa, Mycobacterium
VAQRVPYLQVWNLTCQA

SEQ ID NO: 1056996 - protein, 19 aa, Mycobacterium
VARAYLDSRVQTIYGGTTE

SEQ ID NO: 1056997 - protein, 27 aa, Mycobacterium
VAREAAWRVLGQRPFEVQLMGAAALHL

SEQ ID NO: 1056998 - protein, 17 aa, Mycobacterium
VARENRLRNALAELDQF

SEQ ID NO: 1056999 - protein, 29 aa, Mycobacterium
VARLRSDRALIAFPEIRNLGYFTLVVQEL

SEQ ID NO: 1057000 - protein, 22 aa, Mycobacterium
VARLRVILRRAGKGSAEPRNSR

SEQ ID NO: 1057001 - protein, 20 aa, Mycobacterium
VARQRIAVIRAVRNALERRG

SEQ ID NO: 1057002 - protein, 22 aa, Mycobacterium
VARRLAGLFASYARQRPRVLSD

SEQ ID NO: 1057003 - protein, 22 aa, Mycobacterium
VARRLEKPCYALAHGLLASLPS

SEQ ID NO: 1057004 - protein, 19 aa, Mycobacterium
VARRRGISVLGDRPPMVSV

SEQ ID NO: 1057005 - protein, 22 aa, Mycobacterium
VARSHPMTVDWISYAQSLTAKP

SEQ ID NO: 1057006 - protein, 23 aa, Mycobacterium
VASAVRASMAIPFIYPPVTLTSS

SEQ ID NO: 1057007 - protein, 23 aa, Mycobacterium
VASDQCDAWTGLAAAGDQSIGVL

SEQ ID NO: 1057008 - protein, 23 aa, Mycobacterium
VASERRIAEETAKEEGKPEQALP

SEQ ID NO: 1057009 - protein, 26 aa, Mycobacterium
VASGLRSLPWEGLKLAPGEPAIPTQT

SEQ ID NO: 1057010 - protein, 19 aa, Mycobacterium
VASGRVAYVLGLEGPAVSV

SEQ ID NO: 1057011 - protein, 19 aa, Mycobacterium
VASINWGGVPPAIFDAAED

SEQ ID NO: 1057012 - protein, 23 aa, Mycobacterium
VASRIRSAGAIFVGPWAPVSLGD

SEQ ID NO: 1057013 - protein, 17 aa, Mycobacterium
VASWRRVRAQDPAAGVL

SEQ ID NO: 1057014 - protein, 25 aa, Mycobacterium
VATAKFDFADGFATVTIVTTGTGYL

SEQ ID NO: 1057015 - protein, 20 aa, Mycobacterium
VATELDAAVGNALDNVRLHA

SEQ ID NO: 1057016 - protein, 20 aa, Mycobacterium
VATEVPWASRADRIVVIRQS

SEQ ID NO: 1057017 - protein, 25 aa, Mycobacterium
VATGLWRKFLFDRKRKSAGLPPHPS

SEQ ID NO: 1057018 - protein, 26 aa, Mycobacterium
VATQEMQRLMALPVDMRPDPSDLSFV

SEQ ID NO: 1057019 - protein, 24 aa, Mycobacterium
VATSRWWKEEREGVFVDFNQNAKD

SEQ ID NO: 1057020 - protein, 26 aa, Mycobacterium
VATTCGRPFADFELRIGPDTGEVLLR

SEQ ID NO: 1057021 - protein, 19 aa, Mycobacterium
VAVAARLAERAVAYRDLVM

SEQ ID NO: 1057022 - protein, 28 aa, Mycobacterium
VAVDLREDWPAALLRAGFDRDRPTAWLA

SEQ ID NO: 1057023 - protein, 22 aa, Mycobacterium
VAVDLRQDWPKALTEAGFDAGR

SEQ ID NO: 1057024 - protein, 23 aa, Mycobacterium
VAVEAGIAQCWHKLVGDTGKIVS

SEQ ID NO: 1057025 - protein, 17 aa, Mycobacterium
VAVGFTFDPHTHIARVI

SEQ ID NO: 1057026 - protein, 18 aa, Mycobacterium
VAVGPRPDKVLHVTALVE

SEQ ID NO: 1057027 - protein, 23 aa, Mycobacterium
VAVLELTGPMSLALWVSVEGADD

SEQ ID NO: 1057028 - protein, 17 aa, Mycobacterium
VAVLKILALQFIMSDPR

SEQ ID NO: 1057029 - protein, 18 aa, Mycobacterium
VAVLVGVDLEPTFIDRLF

SEQ ID NO: 1057030 - protein, 20 aa, Mycobacterium
VAVRAAERLIPASLELGGKD

SEQ ID NO: 1057031 - protein, 19 aa, Mycobacterium
VAVSPTGAEAGDFYVANKG

SEQ ID NO: 1057032 - protein, 25 aa, Mycobacterium
VAVYARCYLGLAAKFALDIATAVAE

SEQ ID NO: 1057033 - protein, 17 aa, Mycobacterium
VAVYFDFDNIVISRYEQ

SEQ ID NO: 1057034 - protein, 19 aa, Mycobacterium
VAYAAVFTDVYGLREGDGV

SEQ ID NO: 1057035 - protein, 18 aa, Mycobacterium
VAYAKFLVRQGADAGAGG

SEQ ID NO: 1057036 - protein, 19 aa, Mycobacterium
VAYALAGTMDFDFENQPLG

SEQ ID NO: 1057037 - protein, 17 aa, Mycobacterium
VAYALGLQGPAITIDTA

SEQ ID NO: 1057038 - protein, 23 aa, Mycobacterium
VAYELDCLIFATGFEVGTDYCRR

SEQ ID NO: 1057039 - protein, 18 aa, Mycobacterium
VCAGGPGARGYERSAAGR

SEQ ID NO: 1057040 - protein, 18 aa, Mycobacterium
VCGDEVTLRVTLSNDGAT

SEQ ID NO: 1057041 - protein, 18 aa, Mycobacterium
VCIIPGPAAVAGITRMDE

SEQ ID NO: 1057042 - protein, 17 aa, Mycobacterium
VCLPDLLLTKGEYQLKL

SEQ ID NO: 1057043 - protein, 19 aa, Mycobacterium
VCNGETLKSLSARQRRRAV

SEQ ID NO: 1057044 - protein, 18 aa, Mycobacterium
VCPALHMPLQSGSDRVLR

SEQ ID NO: 1057045 - protein, 18 aa, Mycobacterium
VCPNCNGAGVVNRNQGAF

SEQ ID NO: 1057046 - protein, 34 aa, Mycobacterium
VCQDFAHLSLIVLRGMGIPARYVSGYLHPKRNAV

SEQ ID NO: 1057047 - protein, 35 aa, Mycobacterium
VCRRSRGGRARRCPVAAAQRGSLCLHPAASGQSEL

SEQ ID NO: 1057048 - protein, 20 aa, Mycobacterium
VCTPEPITAAWAAAVPNTSG

SEQ ID NO: 1057049 - protein, 17 aa, Mycobacterium
VCTSEFITFASMQQQFA

SEQ ID NO: 1057050 - protein, 21 aa, Mycobacterium
VCVSHQLPVWTLRLHLTGRRL

SEQ ID NO: 1057051 - protein, 19 aa, Mycobacterium
VDAAIARAYARFQDYRRNT

SEQ ID NO: 1057052 - protein, 17 aa, Mycobacterium
VDAALRIIKPLRKLIKP

SEQ ID NO: 1057053 - protein, 18 aa, Mycobacterium
VDADRPFVEYGLDSLGML

SEQ ID NO: 1057054 - protein, 24 aa, Mycobacterium
VDAEFRVGTMGLGWDSEAQTVVVE

SEQ ID NO: 1057055 - protein, 20 aa, Mycobacterium
VDAFFDRRLDLIQRIENMGK

SEQ ID NO: 1057056 - protein, 23 aa, Mycobacterium
VDAGLPLAVFPAGTFNHFAKDIG

SEQ ID NO: 1057057 - protein, 18 aa, Mycobacterium
VDAIPALIAPVASIESVV

SEQ ID NO: 1057058 - protein, 18 aa, Mycobacterium
VDAISGWWNTGAANEADG

SEQ ID NO: 1057059 - protein, 24 aa, Mycobacterium
VDAKPAQVALAWLISLPGVVAIPG

SEQ ID NO: 1057060 - protein, 20 aa, Mycobacterium
VDALATWLAVKSVVGEDGAF

SEQ ID NO: 1057061 - protein, 26 aa, Mycobacterium
VDALCARFRISGLPVVDDAGALVGII

SEQ ID NO: 1057062 - protein, 26 aa, Mycobacterium
VDAQRALELPVRMGLATGEAEPHDAD

SEQ ID NO: 1057063 - protein, 17 aa, Mycobacterium
VDARGEAPLAFEGTAEP

SEQ ID NO: 1057064 - protein, 23 aa, Mycobacterium
VDCKRPGFHNGYLSTFNRDNVQL

SEQ ID NO: 1057065 - protein, 18 aa, Mycobacterium
VDDAHGFGALGATGSGAG

SEQ ID NO: 1057066 - protein, 19 aa, Mycobacterium
VDDLLSVSDLEGWGQVCDS

SEQ ID NO: 1057067 - protein, 19 aa, Mycobacterium
VDDPLAFERLVALRLIRID

SEQ ID NO: 1057068 - protein, 29 aa, Mycobacterium
VDDVPRGISFLLNRNRLNVAISRAQYAAV

SEQ ID NO: 1057069 - protein, 25 aa, Mycobacterium
VDDYLRVVGVPEIFAAGDVAAAQMD

SEQ ID NO: 1057070 - protein, 17 aa, Mycobacterium
VDELPYLTLRLTGVASL

SEQ ID NO: 1057071 - protein, 20 aa, Mycobacterium
VDEQARFGGVVPEIASRAHL

SEQ ID NO: 1057072 - protein, 18 aa, Mycobacterium
VDFFTRWVTGDLVVADVD

SEQ ID NO: 1057073 - protein, 18 aa, Mycobacterium
VDFGVGVSAGRVFAGNIG

SEQ ID NO: 1057074 - protein, 19 aa, Mycobacterium
VDFPLHPGFAASWQGLRCA

SEQ ID NO: 1057075 - protein, 17 aa, Mycobacterium
VDFSYDVIPGITAVQAL

SEQ ID NO: 1057076 - protein, 17 aa, Mycobacterium
VDFTLGYEVRSIGAAPE

SEQ ID NO: 1057077 - protein, 18 aa, Mycobacterium
VDGARKVFKLVDALEESD

SEQ ID NO: 1057078 - protein, 22 aa, Mycobacterium
VDGARWLSLEGNALVNNDLDAV

SEQ ID NO: 1057079 - protein, 19 aa, Mycobacterium
VDGDIPLLLEMPMAYTARA

SEQ ID NO: 1057080 - protein, 17 aa, Mycobacterium
VDGELYATLTPSKWSDF

SEQ ID NO: 1057081 - protein, 18 aa, Mycobacterium
VDGFDPARIWGADNHEPE

SEQ ID NO: 1057082 - protein, 19 aa, Mycobacterium
VDGFVMLGAVSFTLEQLKS

SEQ ID NO: 1057083 - protein, 19 aa, Mycobacterium
VDGGWKINGQKVWTSGAQY

SEQ ID NO: 1057084 - protein, 17 aa, Mycobacterium
VDGMATVKVSGTIDGAV

SEQ ID NO: 1057085 - protein, 24 aa, Mycobacterium
VDGNSRAPGLLGLYDDTVDGNQAL

SEQ ID NO: 1057086 - protein, 19 aa, Mycobacterium
VDGPWRLGLSSAGTFENLQ

SEQ ID NO: 1057087 - protein, 23 aa, Mycobacterium
VDGRRINSCLALAVMHDGAQITT

SEQ ID NO: 1057088 - protein, 17 aa, Mycobacterium
VDGTSWITGADEPGRHV

SEQ ID NO: 1057089 - protein, 18 aa, Mycobacterium
VDGVARFSARMLADNLPM

SEQ ID NO: 1057090 - protein, 25 aa, Mycobacterium
VDGWPNQQFALLFVDWLRANPGARA

SEQ ID NO: 1057091 - protein, 17 aa, Mycobacterium
VDGWSLAVFFTELLAVY

SEQ ID NO: 1057092 - protein, 19 aa, Mycobacterium
VDIERFDMDPSRPILHGLL

SEQ ID NO: 1057093 - protein, 25 aa, Mycobacterium
VDIGRGRNGVLYAGEVNWDAAGLGG

SEQ ID NO: 1057094 - protein, 24 aa, Mycobacterium
VDIKRDGYEWSQFYDRAQPGTLKQ

SEQ ID NO: 1057095 - protein, 24 aa, Mycobacterium
VDILEMLPTPWGLVRSGVAPDHPK

SEQ ID NO: 1057096 - protein, 21 aa, Mycobacterium
VDIRGTCVLVDGSIKTLSGSG

SEQ ID NO: 1057097 - protein, 18 aa, Mycobacterium
VDKFPRMVDYVMPSGVRI

SEQ ID NO: 1057098 - protein, 24 aa, Mycobacterium
VDKPASALLFFLASSRILNRRKGV

SEQ ID NO: 1057099 - protein, 24 aa, Mycobacterium
VDLDLPRDALIVFTGLSGSGKSSL

SEQ ID NO: 1057100 - protein, 26 aa, Mycobacterium
VDLEIAPGVVTTWMKLAVRDRILPDD

SEQ ID NO: 1057101 - protein, 25 aa, Mycobacterium
VDLGSQRRALLFLRVDRLQFFVSCL

SEQ ID NO: 1057102 - protein, 23 aa, Mycobacterium
VDLLPTLLSLLGIDIPADVEGLS

SEQ ID NO: 1057103 - protein, 17 aa, Mycobacterium
VDLLSTVFTRWERDGEV

SEQ ID NO: 1057104 - protein, 18 aa, Mycobacterium
VDLRDDWAAVLQAAGFDK

SEQ ID NO: 1057105 - protein, 19 aa, Mycobacterium
VDLRDDWPQALRDSGFDAE

SEQ ID NO: 1057106 - protein, 17 aa, Mycobacterium
VDLRITRSLALPDPPRH

SEQ ID NO: 1057107 - protein, 25 aa, Mycobacterium
VDLSRLAEDIIIWSSTEFGYVTLHD

SEQ ID NO: 1057108 - protein, 20 aa, Mycobacterium
VDLTKAMAYKGMMLSGLPNM

SEQ ID NO: 1057109 - protein, 25 aa, Mycobacterium
VDMTLWPKFDYASAANAGIDDVTLG

SEQ ID NO: 1057110 - protein, 33 aa, Mycobacterium; identical to SEQ ID NO: 743762

SEQ ID NO: 1057111 - protein, 19 aa, Mycobacterium
VDMWSMLVIARDLLSMLAD

SEQ ID NO: 1057112 - protein, 19 aa, Mycobacterium
VDNPHAWIRTPMTAEQICR

SEQ ID NO: 1057113 - protein, 29 aa, Mycobacterium
VDNTMDVWKRLCDPMAQQISSVWASSLPE

SEQ ID NO: 1057114 - protein, 25 aa, Mycobacterium
VDPELRRPITELGMVKSVEVAPDGA

SEQ ID NO: 1057115 - protein, 18 aa, Mycobacterium
VDPIRVLLIGGHSYLEAW

SEQ ID NO: 1057116 - protein, 25 aa, Mycobacterium
VDPKAVPSRLAWEAGAALADSLLTR

SEQ ID NO: 1057117 - protein, 23 aa, Mycobacterium
VDPRFHGDLSLHFKADIPEDVLA

SEQ ID NO: 1057118 - protein, 21 aa, Mycobacterium
VDQMPCALRNPAWTGAQALEA

SEQ ID NO: 1057119 - protein, 25 aa, Mycobacterium
VDQRLLVKLPSGWSLAQAAGVPVAF

SEQ ID NO: 1057120 - protein, 23 aa, Mycobacterium
VDQVLKFSKPIVAGDILHCDVHV

SEQ ID NO: 1057121 - protein, 17 aa, Mycobacterium
VDRGCLLGVTIVGPRAA

SEQ ID NO: 1057122 - protein, 26 aa, Mycobacterium
VDRKIWSGAGTFLFTRTTVGEIGILP

SEQ ID NO: 1057123 - protein, 22 aa, Mycobacterium
VDRLESYDIFALLHGGGPSGQA

SEQ ID NO: 1057124 - protein, 17 aa, Mycobacterium
VDRLRIGGHGEVPRGRR

SEQ ID NO: 1057125 - protein, 27 aa, Mycobacterium
VDRRPSWRDARWLAVVINYRAQRWSDV

SEQ ID NO: 1057126 - protein, 24 aa, Mycobacterium
VDRTLRVGWSLADLAGRAAPGLDE

SEQ ID NO: 1057127 - protein, 20 aa, Mycobacterium
VDRVKDMIVTGGFNVFPREV

SEQ ID NO: 1057128 - protein, 17 aa, Mycobacterium
VDSADGVIEWDLELDRS

SEQ ID NO: 1057129 - protein, 24 aa, Mycobacterium
VDSGEPWLSLDFHTPAREQFVEDL

SEQ ID NO: 1057130 - protein, 19 aa, Mycobacterium
VDSLACAYAAVLAGNKRYQ

SEQ ID NO: 1057131 - protein, 18 aa, Mycobacterium
VDSPWVWVLDPVDGTFNY

SEQ ID NO: 1057132 - protein, 25 aa, Mycobacterium
VDTDLRWRIVTALATAGVIDSDGPE

SEQ ID NO: 1057133 - protein, 25 aa, Mycobacterium
VDTEIPSPVAGVLLSITAEEDDVVQ

SEQ ID NO: 1057134 - protein, 27 aa, Mycobacterium
VDTESRGLVIPFWAVGFQNLGWPTGIG

SEQ ID NO: 1057135 - protein, 21 aa, Mycobacterium
VDTGGRWLLKLHGSVTESHKM

SEQ ID NO: 1057136 - protein, 17 aa, Mycobacterium
VDTGIFISGNYSNGILA

SEQ ID NO: 1057137 - protein, 20 aa, Mycobacterium
VDTKAGYAFERIPKAEVEDL

SEQ ID NO: 1057138 - protein, 19 aa, Mycobacterium
VDTLAKAGAVFVEETDQVP

SEQ ID NO: 1057139 - protein, 17 aa, Mycobacterium
VDTRRRLTPSLAVLAHD

SEQ ID NO: 1057140 - protein, 24 aa, Mycobacterium
VDTYGRPGLVPSPLYDSLLAKVIT

SEQ ID NO: 1057141 - protein, 27 aa, Mycobacterium
VDVAGLGRSWLHAGIRPLDVDVAPPTV

SEQ ID NO: 1057142 - protein, 20 aa, Mycobacterium
VDVFDCSHIRQVMRELPHVR

SEQ ID NO: 1057143 - protein, 27 aa, Mycobacterium
VDVLDWCTREQIPAIPYGGGSSVVGGV

SEQ ID NO: 1057144 - protein, 20 aa, Mycobacterium
VDVLLARPGYQHVVITGRDA

SEQ ID NO: 1057145 - protein, 24 aa, Mycobacterium
VDVVPRVAQIFGVQAVPTVVALAA

SEQ ID NO: 1057146 - protein, 20 aa, Mycobacterium
VDYLEIWDAQAWHEYQQLHE

SEQ ID NO: 1057147 - protein, 24 aa, Mycobacterium
VEAADAFEAVRIIARASAVDVMLR

SEQ ID NO: 1057148 - protein, 17 aa, Mycobacterium
VEAELESLVAANVTDPI

SEQ ID NO: 1057149 - protein, 20 aa, Mycobacterium
VEAGDIWRMCVVKDAPIRDW

SEQ ID NO: 1057150 - protein, 18 aa, Mycobacterium
VEALRVQQCWVEPRAWET

SEQ ID NO: 1057151 - protein, 20 aa, Mycobacterium
VEALRVQQCWVEPRAWETLQ

SEQ ID NO: 1057152 - protein, 20 aa, Mycobacterium
VEALVGLGFAAKQAEEATDK

SEQ ID NO: 1057153 - protein, 18 aa, Mycobacterium
VEALYAVTAEGALHLEDI

SEQ ID NO: 1057154 - protein, 25 aa, Mycobacterium
VEASHCYPRFPVFLEEVKRVLRPGG

SEQ ID NO: 1057155 - protein, 27 aa, Mycobacterium
VEASVHGHTAWGVGIAPSITTASLRAV

SEQ ID NO: 1057156 - protein, 19 aa, Mycobacterium
VEAYVGLDSFRHLAKERAL

SEQ ID NO: 1057157 - protein, 19 aa, Mycobacterium
VEDHFDRQIAWLRQMADLC

SEQ ID NO: 1057158 - protein, 20 aa, Mycobacterium
VEEARKGFFRVPLIGGTITH

SEQ ID NO: 1057159 - protein, 19 aa, Mycobacterium
VEEFGRLDVMVANAGVFGW

SEQ ID NO: 1057160 - protein, 23 aa, Mycobacterium
VEEIVELGHLFRLPIAALGNGAT

SEQ ID NO: 1057161 - protein, 20 aa, Mycobacterium
VEELGIDVFLVMPFTTDFMK

SEQ ID NO: 1057162 - protein, 20 aa, Mycobacterium
VEELVRWATPVMTFRRIAAA

SEQ ID NO: 1057163 - protein, 22 aa, Mycobacterium
VEEPARLREALVSARREAASAF

SEQ ID NO: 1057164 - protein, 19 aa, Mycobacterium
VEFIAEAISTLGAQSQDGF

SEQ ID NO: 1057165 - protein, 17 aa, Mycobacterium
VEFKQKSAYLFGATHGA

SEQ ID NO: 1057166 - protein, 18 aa, Mycobacterium
VEFLPALRSAAPDVIHPV

SEQ ID NO: 1057167 - protein, 18 aa, Mycobacterium
VEGAKGKAKEVFEAVTGR

SEQ ID NO: 1057168 - protein, 18 aa, Mycobacterium
VEGILECAELMVVALRDG

SEQ ID NO: 1057169 - protein, 17 aa, Mycobacterium
VEGSGGYGIVFGPDASD

SEQ ID NO: 1057170 - protein, 19 aa, Mycobacterium
VEHFNWLEDLGFQFERSYF

SEQ ID NO: 1057171 - protein, 25 aa, Mycobacterium
VEHLDALGFDEAWIGEHHSAGSEII

SEQ ID NO: 1057172 - protein, 17 aa, Mycobacterium
VEHLFREGRLLGWSTPA

SEQ ID NO: 1057173 - protein, 17 aa, Mycobacterium
VEHVGSALPEFALAMRD

SEQ ID NO: 1057174 - protein, 17 aa, Mycobacterium
VEHVRKPVRFADGVALA

SEQ ID NO: 1057175 - protein, 18 aa, Mycobacterium
VEIAEMFQMPPALEQAWH

SEQ ID NO: 1057176 - protein, 19 aa, Mycobacterium
VEIDELWRGGPYAYQTVAM

SEQ ID NO: 1057177 - protein, 24 aa, Mycobacterium
VEILGKGYLGLVFNGFDYTNVPVV

SEQ ID NO: 1057178 - protein, 20 aa, Mycobacterium
VEILKWAKSQGISITAEVTP

SEQ ID NO: 1057179 - protein, 18 aa, Mycobacterium
VEINEAFAAVALASTKEL

SEQ ID NO: 1057180 - protein, 22 aa, Mycobacterium
VEINEAFAPVVLAWLKEIKADP

SEQ ID NO: 1057181 - protein, 28 aa, Mycobacterium
VEIRRLAIECLRQLVAVAPAVFADFEVT

SEQ ID NO: 1057182 - protein, 24 aa, Mycobacterium
VEKFREVMETEYLKRKMIDGPAPE

SEQ ID NO: 1057183 - protein, 24 aa, Mycobacterium
VEKLASLRPVFGVKAGDATMTAGN

SEQ ID NO: 1057184 - protein, 18 aa, Mycobacterium
VELARFTADLPFALDDFQ

SEQ ID NO: 1057185 - protein, 17 aa, Mycobacterium
VELDQRFGIADRIEKRH

SEQ ID NO: 1057186 - protein, 19 aa, Mycobacterium
VELDVSAGFDITELPRAVD

SEQ ID NO: 1057187 - protein, 20 aa, Mycobacterium
VELEGSGLFARMLQHETGHL

SEQ ID NO: 1057188 - protein, 24 aa, Mycobacterium
VELICARSSPPRGVLTRRDVLIDG

SEQ ID NO: 1057189 - protein, 17 aa, Mycobacterium
VELKIVRHNMPFGEVGK

SEQ ID NO: 1057190 - protein, 24 aa, Mycobacterium
VELLADVVNRVWFLDAVRGEVDVY

SEQ ID NO: 1057191 - protein, 18 aa, Mycobacterium
VELLRPALTRHHADGSEA

SEQ ID NO: 1057192 - protein, 23 aa, Mycobacterium
VELPLMEVRALLDLGDVAKATRK

SEQ ID NO: 1057193 - protein, 21 aa, Mycobacterium
VELQLWVAACLYKGGVDIYRT

SEQ ID NO: 1057194 - protein, 22 aa, Mycobacterium
VELRAIPGPRDDWFVDPEALVH

SEQ ID NO: 1057195 - protein, 19 aa, Mycobacterium
VELRNRLKTLTGVTLSATT

SEQ ID NO: 1057196 - protein, 31 aa, Mycobacterium
VEMAGALKNVFAIAVGMGYSLGIGENPRALV

SEQ ID NO: 1057197 - protein, 17 aa, Mycobacterium
VEMFNRLLHGVAPADIS

SEQ ID NO: 1057198 - protein, 19 aa, Mycobacterium
VEMLMPCFAQLYEDLGITQ

SEQ ID NO: 1057199 - protein, 23 aa, Mycobacterium
VEMMSRRAKSRFTQGSSLADKQL

SEQ ID NO: 1057200 - protein, 21 aa, Mycobacterium
VEMRNRLKSATGLALSPTLIF

SEQ ID NO: 1057201 - protein, 21 aa, Mycobacterium
VEMRRVRDLQPYIGKEIEAKI

SEQ ID NO: 1057202 - protein, 17 aa, Mycobacterium
VENQVVLPLAMQMIDPV

SEQ ID NO: 1057203 - protein, 17 aa, Mycobacterium
VEPCAAAARELLRRGHE

SEQ ID NO: 1057204 - protein, 19 aa, Mycobacterium
VEPFGCLRSVPPPDGVGAA

SEQ ID NO: 1057205 - protein, 26 aa, Mycobacterium
VEPPRSVSHLPQWARRWQRLLFDNGW

SEQ ID NO: 1057206 - protein, 22 aa, Mycobacterium
VEPRLWNMSTVLPILQDTTIVV

SEQ ID NO: 1057207 - protein, 23 aa, Mycobacterium
VEPSAPLPEFWVNRARRKILHSA

SEQ ID NO: 1057208 - protein, 26 aa, Mycobacterium
VEPVLTRSGADWMPNFIDLLQRKLSQ

SEQ ID NO: 1057209 - protein, 25 aa, Mycobacterium
VEQIKRFRILPTLWEPGGDEITLTM

SEQ ID NO: 1057210 - protein, 17 aa, Mycobacterium
VERCLPKPLVVSVGSVG

SEQ ID NO: 1057211 - protein, 19 aa, Mycobacterium
VERFGDLVFDTVITRTVRF

SEQ ID NO: 1057212 - protein, 21 aa, Mycobacterium
VERLLGMGLVKGHGAADWSKR

SEQ ID NO: 1057213 - protein, 28 aa, Mycobacterium
VERRLGPLVFRDMLGLHFAPTRPVEDQL

SEQ ID NO: 1057214 - protein, 20 aa, Mycobacterium
VERRSVPLPLAQKIFDTEWV

SEQ ID NO: 1057215 - protein, 17 aa, Mycobacterium
VERYMKLLAPEWQIMLD

SEQ ID NO: 1057216 - protein, 23 aa, Mycobacterium
VESAWKLAKQYFKETGKPGKYKA

SEQ ID NO: 1057217 - protein, 21 aa, Mycobacterium
VESEGRKVLARQADVRDSAAL

SEQ ID NO: 1057218 - protein, 25 aa, Mycobacterium
VESFGFKYGLPMDADMVMDVRFLPN

SEQ ID NO: 1057219 - protein, 26 aa, Mycobacterium
VESGARADRDFVLRFRLDQGRLSSSA

SEQ ID NO: 1057220 - protein, 23 aa, Mycobacterium
VESGELPWSIVALGLSSVAPQQP

SEQ ID NO: 1057221 - protein, 26 aa, Mycobacterium
VESIGPALEDWAKWGQARHDYFLRAS

SEQ ID NO: 1057222 - protein, 19 aa, Mycobacterium
VESLGWLGSDVWMAHCVHL

SEQ ID NO: 1057223 - protein, 20 aa, Mycobacterium
VESLPLIASSIMSKKLAEGA

SEQ ID NO: 1057224 - protein, 27 aa, Mycobacterium
VESMASMAAFTWLSTRGGGGVVGVNNS

SEQ ID NO: 1057225 - protein, 18 aa, Mycobacterium
VETERRFYLANSVEMVPR

SEQ ID NO: 1057226 - protein, 35 aa, Mycobacterium
VETLSAYGVRYLFGVPGAKIDSVFDALRDSELEVV

SEQ ID NO: 1057227 - protein, 21 aa, Mycobacterium
VETRGRCGTFISRFDPTDAAM

SEQ ID NO: 1057228 - protein, 18 aa, Mycobacterium
VEVARRVIFQATGRFPED

SEQ ID NO: 1057229 - protein, 21 aa, Mycobacterium
VEVCRTCSWNHLVKSYVLGAA

SEQ ID NO: 1057230 - protein, 17 aa, Mycobacterium
VEVGRRVIFMVTGVLPS

SEQ ID NO: 1057231 - protein, 18 aa, Mycobacterium
VEVPFAELEPDFQRAYKE

SEQ ID NO: 1057232 - protein, 23 aa, Mycobacterium
VEVRLPGDILRRLDDFAMESGVD

SEQ ID NO: 1057233 - protein, 24 aa, Mycobacterium
VEVSEFSRHLKLLAKEIEVPVVAI

SEQ ID NO: 1057234 - protein, 19 aa, Mycobacterium
VEVVYRLSAQLAEATASIQ

SEQ ID NO: 1057235 - protein, 18 aa, Mycobacterium
VFAAAWGTTVGRLVFPAP

SEQ ID NO: 1057236 - protein, 17 aa, Mycobacterium
VFAGAYHGWGFHEDGAA

SEQ ID NO: 1057237 - protein, 21 aa, Mycobacterium
VFAGSCLSEYGAIASTDLTQV

SEQ ID NO: 1057238 - protein, 19 aa, Mycobacterium
VFAPLEMGAALQAVATILT

SEQ ID NO: 1057239 - protein, 23 aa, Mycobacterium
VFASLLRPGGRLFMREGHPFLWS

SEQ ID NO: 1057240 - protein, 21 aa, Mycobacterium
VFATRETPVWLGSVKSNIGHT

SEQ ID NO: 1057241 - protein, 20 aa, Mycobacterium
VFAVHRIDEHLAKAMDRKVW

SEQ ID NO: 1057242 - protein, 20 aa, Mycobacterium
VFDNADFKRGLKMFLSPDGH

SEQ ID NO: 1057243 - protein, 28 aa, Mycobacterium
VFDNARRNAPCVLFFDEVDALGHRRSAL

SEQ ID NO: 1057244 - protein, 19 aa, Mycobacterium
VFEGTSFGGALMTTTEVEN

SEQ ID NO: 1057245 - protein, 20 aa, Mycobacterium
VFEHRAVLVGGDRGGFMAGL

SEQ ID NO: 1057246 - protein, 17 aa, Mycobacterium
VFFYPEKAASAWSEALA

SEQ ID NO: 1057247 - protein, 24 aa, Mycobacterium
VFGEAVALFPSWETLPHERLSPGV

SEQ ID NO: 1057248 - protein, 18 aa, Mycobacterium
VFGGYGLSAQAVLTQASA

SEQ ID NO: 1057249 - protein, 17 aa, Mycobacterium
VFGKLPFLMNGIKLEVV

SEQ ID NO: 1057250 - protein, 26 aa, Mycobacterium
VFGLAARKRIPVVLFAEGGGGRPGDT

SEQ ID NO: 1057251 - protein, 19 aa, Mycobacterium
VFGSPTWRTVTGGSVNYVR

SEQ ID NO: 1057252 - protein, 19 aa, Mycobacterium
VFGTLPWHADLWLDSEDAL

SEQ ID NO: 1057253 - protein, 22 aa, Mycobacterium
VFIEDIHPAWTLEEAVVEGAQS

SEQ ID NO: 1057254 - protein, 22 aa, Mycobacterium
VFKMAAELAYLEFGDLIDAMVT

SEQ ID NO: 1057255 - protein, 19 aa, Mycobacterium
VFLPCGGAIDFLAGATNRA

SEQ ID NO: 1057256 - protein, 25 aa, Mycobacterium
VFNGACAMGADSFAAVNDVTGGAAA

SEQ ID NO: 1057257 - protein, 25 aa, Mycobacterium
VFPARTCSMGVFKRHKQIDRPCLLG

SEQ ID NO: 1057258 - protein, 18 aa, Mycobacterium
VFQQFATTVPTEFQSLVV

SEQ ID NO: 1057259 - protein, 38 aa, Mycobacterium
VFQRTPIWCFPKFDFPLPAALRWAMRIPGGKALQRLLS

SEQ ID NO: 1057260 - protein, 25 aa, Mycobacterium
VFREPLPRIGLDSLPEQGAWLQPFR

SEQ ID NO: 1057261 - protein, 23 aa, Mycobacterium
VFRLEVLPARAFGVVMRGTARYF

SEQ ID NO: 1057262 - protein, 26 aa, Mycobacterium
VFRQRYWARNHVGWRHMDDTAPNAGH

SEQ ID NO: 1057263 - protein, 18 aa, Mycobacterium
VFTEGYWATGGPSAIRDE

SEQ ID NO: 1057264 - protein, 19 aa, Mycobacterium
VFTLPSYNLNLFLDGVIQA

SEQ ID NO: 1057265 - protein, 23 aa, Mycobacterium
VFTRAQLLHEVWGYDFFGGTRTV

SEQ ID NO: 1057266 - protein, 18 aa, Mycobacterium
VFTRLCQAMGCPELATDD

SEQ ID NO: 1057267 - protein, 24 aa, Mycobacterium
VFYLHSRLLERCAKLSDELGGGSL

SEQ ID NO: 1057268 - protein, 18 aa, Mycobacterium
VGAACTAALLGGGADPAV

SEQ ID NO: 1057269 - protein, 17 aa, Mycobacterium
VGAAGWCTAAPNLWPQP

SEQ ID NO: 1057270 - protein, 22 aa, Mycobacterium
VGAETALRIGLVSEVVAPQRLW

SEQ ID NO: 1057271 - protein, 21 aa, Mycobacterium
VGAGWPAGVDPLWTGGGATPA

SEQ ID NO: 1057272 - protein, 20 aa, Mycobacterium
VGAIVEWISAVMTLLPGDLI

SEQ ID NO: 1057273 - protein, 20 aa, Mycobacterium
VGALAARAAVSGRPEAVATL

SEQ ID NO: 1057274 - protein, 26 aa, Mycobacterium
VGALCARFRISGLPVVDDSGALAGII

SEQ ID NO: 1057275 - protein, 17 aa, Mycobacterium
VGATSRPSALTLDDVVK

SEQ ID NO: 1057276 - protein, 22 aa, Mycobacterium
VGAVDCRGGAPGTRETDLLDPV

SEQ ID NO: 1057277 - protein, 17 aa, Mycobacterium
VGCASSLAIMSAATTRW

SEQ ID NO: 1057278 - protein, 21 aa, Mycobacterium
VGCRRSVPSLQRLLGHLETSL

SEQ ID NO: 1057279 - protein, 19 aa, Mycobacterium
VGCVNRIVTELAVIDVCHD

SEQ ID NO: 1057280 - protein, 19 aa, Mycobacterium
VGCYRMLPPAGAIAAGGLY

SEQ ID NO: 1057281 - protein, 24 aa, Mycobacterium
VGDCARLTVVWIADWADDTVHLSA

SEQ ID NO: 1057282 - protein, 23 aa, Mycobacterium
VGDENLRLAWPFENAPVDLLAAA

SEQ ID NO: 1057283 - protein, 31 aa, Mycobacterium; identical to SEQ ID NO: 745121

SEQ ID NO: 1057284 - protein, 21 aa, Mycobacterium
VGDHRVLVLAGRIHAYEGHDL

SEQ ID NO: 1057285 - protein, 19 aa, Mycobacterium
VGDLSWEVSFVAYDEATID

SEQ ID NO: 1057286 - protein, 24 aa, Mycobacterium
VGDPIQSIYGWRGASATNLPRFST

SEQ ID NO: 1057287 - protein, 18 aa, Mycobacterium
VGDPRLPQMPATAEQIDE

SEQ ID NO: 1057288 - protein, 20 aa, Mycobacterium
VGDPRLPQMPATAEQIDELA

SEQ ID NO: 1057289 - protein, 18 aa, Mycobacterium
VGDQGKRDVSHGCINLSP

SEQ ID NO: 1057290 - protein, 25 aa, Mycobacterium
VGEAWRYLKELRLERGPLTIEEAKA

SEQ ID NO: 1057291 - protein, 19 aa, Mycobacterium
VGEDGRFEILLGPRRPGEH

SEQ ID NO: 1057292 - protein, 17 aa, Mycobacterium
VGEIAAYAIAGVMAAND

SEQ ID NO: 1057293 - protein, 24 aa, Mycobacterium
VGELCIRGPFVMQGYYKRSREECF

SEQ ID NO: 1057294 - protein, 20 aa, Mycobacterium
VGELLAWAGVHPDYTSLAEA

SEQ ID NO: 1057295 - protein, 21 aa, Mycobacterium
VGELREVIVRVGALAAAENRN

SEQ ID NO: 1057296 - protein, 19 aa, Mycobacterium
VGELVAVAEPVAWFTHYYW

SEQ ID NO: 1057297 - protein, 18 aa, Mycobacterium
VGEPSWPDAITMVENANK

SEQ ID NO: 1057298 - protein, 19 aa, Mycobacterium
VGFAGRAALGVGKRLAGKS

SEQ ID NO: 1057299 - protein, 22 aa, Mycobacterium
VGFAHSYGATGHRLDDPARFRE

SEQ ID NO: 1057300 - protein, 23 aa, Mycobacterium
VGFDISNDFVVGYGLDYDERYRD

SEQ ID NO: 1057301 - protein, 22 aa, Mycobacterium
VGFKGSRKSTPFAAQLAAENAA

SEQ ID NO: 1057302 - protein, 20 aa, Mycobacterium
VGFQDGWRGLLENRRLQLRN

SEQ ID NO: 1057303 - protein, 27 aa, Mycobacterium
VGFQNLGWPTGIGIASYASGLDFVTIG

SEQ ID NO: 1057304 - protein, 26 aa, Mycobacterium
VGGAGGAHHFLLGTGGAGGVGGAGGN

SEQ ID NO: 1057305 - protein, 21 aa, Mycobacterium
VGGAGGHGGMGGNAGSSDAAN

SEQ ID NO: 1057306 - protein, 26 aa, Mycobacterium
VGGAGGNGGFLFGHGGDGGTGGTGAS

SEQ ID NO: 1057307 - protein, 25 aa, Mycobacterium
VGGAGGRAGLAIGGGGAGGAGGEGA

SEQ ID NO: 1057308 - protein, 26 aa, Mycobacterium
VGGAGGRGGLVFGDGGAGGAGGAGAQ

SEQ ID NO: 1057309 - protein, 21 aa, Mycobacterium
VGGELRSRYRVVLLDEYQDTG

SEQ ID NO: 1057310 - protein, 21 aa, Mycobacterium
VGGFGHLLVLGFDYRENPGPW

SEQ ID NO: 1057311 - protein, 17 aa, Mycobacterium
VGGFPNFFMLYGPNTNQ

SEQ ID NO: 1057312 - protein, 18 aa, Mycobacterium
VGGLLPRGELVVIGVTAD

SEQ ID NO: 1057313 - protein, 22 aa, Mycobacterium
VGGLRGGYEYARTGNPTRTALE

SEQ ID NO: 1057314 - protein, 26 aa, Mycobacterium
VGGNCPLWVIHQAFARPGQFLTQVAQ

SEQ ID NO: 1057315 - protein, 27 aa, Mycobacterium
VGGNGGNASSVFGFGGNGGAAGTGGAG

SEQ ID NO: 1057316 - protein, 18 aa, Mycobacterium
VGGRGSGAVMVLAGPPGV

SEQ ID NO: 1057317 - protein, 18 aa, Mycobacterium
VGGTWFWNTYPGIAVDIP

SEQ ID NO: 1057318 - protein, 17 aa, Mycobacterium
VGGVKVKLMAKVAAGEE

SEQ ID NO: 1057319 - protein, 19 aa, Mycobacterium
VGGVTIEIAQPLGDARLPA

SEQ ID NO: 1057320 - protein, 17 aa, Mycobacterium
VGHGDRGPVWVFSGQGS

SEQ ID NO: 1057321 - protein, 18 aa, Mycobacterium
VGHGDRGPVWVFSGQGSQ

SEQ ID NO: 1057322 - protein, 17 aa, Mycobacterium
VGHSLDPKADYGPLVTE

SEQ ID NO: 1057323 - protein, 19 aa, Mycobacterium
VGIAGGREKCRAVVENFGF

SEQ ID NO: 1057324 - protein, 18 aa, Mycobacterium
VGIAGIRSGGVAAVRLAT

SEQ ID NO: 1057325 - protein, 17 aa, Mycobacterium
VGIAPSITTASLRAVVS

SEQ ID NO: 1057326 - protein, 20 aa, Mycobacterium
VGIDEARLGLVLEVAAAAGL

SEQ ID NO: 1057327 - protein, 18 aa, Mycobacterium
VGIGRRRWSGAFKQSLRD

SEQ ID NO: 1057328 - protein, 23 aa, Mycobacterium
VGILLLNAPWWNPALLARDIATT

SEQ ID NO: 1057329 - protein, 18 aa, Mycobacterium
VGKHFSVNVMLDRDTIRR

SEQ ID NO: 1057330 - protein, 25 aa, Mycobacterium
VGKLRSGQTLIGFLAPRNADYSIGA

SEQ ID NO: 1057331 - protein, 18 aa, Mycobacterium
VGKTRLALEVATRVADEF

SEQ ID NO: 1057332 - protein, 26 aa, Mycobacterium
VGLAAWRLGAGRSRPGARVQHGAGIR

SEQ ID NO: 1057333 - protein, 23 aa, Mycobacterium
VGLDERYVREWLGGMTAGQVIEY

SEQ ID NO: 1057334 - protein, 22 aa, Mycobacterium
VGLGCSLVALSDIVYIAPDAYL

SEQ ID NO: 1057335 - protein, 19 aa, Mycobacterium
VGLGFPLSIHFEATYGVSP

SEQ ID NO: 1057336 - protein, 25 aa, Mycobacterium
VGLRDVLAALHWVRENIATFGGDPA

SEQ ID NO: 1057337 - protein, 17 aa, Mycobacterium
VGLVNAVVRFDVETGSD

SEQ ID NO: 1057338 - protein, 17 aa, Mycobacterium
VGLWTFRVDGWGDPIHS

SEQ ID NO: 1057339 - protein, 27 aa, Mycobacterium
VGLYCRNRIEIVIAMLGIIKAGAILIN

SEQ ID NO: 1057340 - protein, 18 aa, Mycobacterium
VGMARRPFDPAIYGWSKT

SEQ ID NO: 1057341 - protein, 20 aa, Mycobacterium
VGNIHPLWTYAHVPNGYTGD

SEQ ID NO: 1057342 - protein, 19 aa, Mycobacterium
VGPARLGRDVDLLTHIGRD

SEQ ID NO: 1057343 - protein, 20 aa, Mycobacterium
VGPCPYRLLLWRRPGRRGIA

SEQ ID NO: 1057344 - protein, 17 aa, Mycobacterium
VGPDMLRDVGLLEAATP

SEQ ID NO: 1057345 - protein, 19 aa, Mycobacterium
VGPEDRWRQIVGAQSDFAG

SEQ ID NO: 1057346 - protein, 28 aa, Mycobacterium
VGPFKKGPFRIAMAAGIPIVPIVIRNAE

SEQ ID NO: 1057347 - protein, 31 aa, Mycobacterium; identical to SEQ ID NO: 973012

SEQ ID NO: 1057348 - protein, 23 aa, Mycobacterium
VGPNPRAAYQVALPDTTFVEHIK

SEQ ID NO: 1057349 - protein, 18 aa, Mycobacterium
VGPRLAMATLSVHDANGL

SEQ ID NO: 1057350 - protein, 21 aa, Mycobacterium
VGPSWLRPLVDNIDRVPDAVR

SEQ ID NO: 1057351 - protein, 25 aa, Mycobacterium
VGPTIASAVSEWFTVDWHREIVERW

SEQ ID NO: 1057352 - protein, 24 aa, Mycobacterium
VGQDIRFGLGAVRNVGANVVGSLI

SEQ ID NO: 1057353 - protein, 18 aa, Mycobacterium
VGQGPGCDLMVCRYNDGI

SEQ ID NO: 1057354 - protein, 30 aa, Mycobacterium; identical to SEQ ID NO: 745561

SEQ ID NO: 1057355 - protein, 23 aa, Mycobacterium
VGQLGRRCLPMVVDVRDPAQVNT

SEQ ID NO: 1057356 - protein, 17 aa, Mycobacterium
VGQLIAERAKAAGINTV

SEQ ID NO: 1057357 - protein, 19 aa, Mycobacterium
VGQRCEPVFVMAAQGQPLP

SEQ ID NO: 1057358 - protein, 24 aa, Mycobacterium
VGQRGAPIGRMWVRPFASDEADPA

SEQ ID NO: 1057359 - protein, 25 aa, Mycobacterium
VGQSGEVWISFLIVAPKYVASVATD

SEQ ID NO: 1057360 - protein, 19 aa, Mycobacterium
VGQTSRFAELIGMHPQITA

SEQ ID NO: 1057361 - protein, 25 aa, Mycobacterium
VGRADLVLPMWQRLESAWGPARDVR

SEQ ID NO: 1057362 - protein, 20 aa, Mycobacterium
VGRARPVGKTVFVFPGQGSQ

SEQ ID NO: 1057363 - protein, 22 aa, Mycobacterium
VGRAVDLVQLFPAASYGKNGAN

SEQ ID NO: 1057364 - protein, 28 aa, Mycobacterium
VGREVKKLPTLRGRTVVTMFYENSTRTR

SEQ ID NO: 1057365 - protein, 17 aa, Mycobacterium
VGREWELDTLTTMLDRS

SEQ ID NO: 1057366 - protein, 20 aa, Mycobacterium
VGRGGFGIVYRAFQPSLDRT

SEQ ID NO: 1057367 - protein, 22 aa, Mycobacterium
VGRGGLDITLCRGDPMIQPPRP

SEQ ID NO: 1057368 - protein, 26 aa, Mycobacterium
VGRIATRVPQEWLLPYVHQRYDEPHD

SEQ ID NO: 1057369 - protein, 23 aa, Mycobacterium
VGRICAGAISLGVLKRGAQLMYR

SEQ ID NO: 1057370 - protein, 24 aa, Mycobacterium
VGRKKDMFIVGGFNAYPAEIEGFL

SEQ ID NO: 1057371 - protein, 19 aa, Mycobacterium
VGRLNRAAPPLALRAVRTI

SEQ ID NO: 1057372 - protein, 18 aa, Mycobacterium
VGRPDIFTLLAALAGSPI

SEQ ID NO: 1057373 - protein, 23 aa, Mycobacterium
VGRRRWNRRGAMVTDRYQRLRHH

SEQ ID NO: 1057374 - protein, 18 aa, Mycobacterium
VGSARAAARYGADTCARG

SEQ ID NO: 1057375 - protein, 22 aa, Mycobacterium
VGSASTDPVSWIGESSGVPGEL

SEQ ID NO: 1057376 - protein, 17 aa, Mycobacterium
VGSCGAAGAAEAAVAAG

SEQ ID NO: 1057377 - protein, 17 aa, Mycobacterium
VGSEFLAGLDLDRHGLS

SEQ ID NO: 1057378 - protein, 17 aa, Mycobacterium
VGSHGRGGFPGMLLGSV

SEQ ID NO: 1057379 - protein, 26 aa, Mycobacterium
VGSHSKRVFCEAVDIVSGIGYDKVDP

SEQ ID NO: 1057380 - protein, 18 aa, Mycobacterium
VGSRGRGGFAGMVVGSVA

SEQ ID NO: 1057381 - protein, 23 aa, Mycobacterium
VGSRPPLLKRIVLQTAARLSPRG

SEQ ID NO: 1057382 - protein, 20 aa, Mycobacterium
VGTAVRYTAKPGAFRRPNGQ

SEQ ID NO: 1057383 - protein, 19 aa, Mycobacterium
VGTDVARRALEEGSGSPGE

SEQ ID NO: 1057384 - protein, 31 aa, Mycobacterium
VGTEGPVPPPPRAVSVAWAVPAESCSARLGR

SEQ ID NO: 1057385 - protein, 17 aa, Mycobacterium
VGTFAGFGVDVQVRLAP

SEQ ID NO: 1057386 - protein, 27 aa, Mycobacterium
VGTGAGVSGLWLLSGMSDDGVLTTIDI

SEQ ID NO: 1057387 - protein, 19 aa, Mycobacterium
VGTVSGLYVCEMVTARALV

SEQ ID NO: 1057388 - protein, 23 aa, Mycobacterium
VGVCTNTLCAVMGGDAIFETLKD

SEQ ID NO: 1057389 - protein, 34 aa, Mycobacterium
VGVERIGLRYVLEIRVPAGVDGRIAWSNWIDEQL

SEQ ID NO: 1057390 - protein, 20 aa, Mycobacterium
VGVGDLHLTMPISLRTDDDG

SEQ ID NO: 1057391 - protein, 19 aa, Mycobacterium
VGVRWLREVAGAETVVLLG

SEQ ID NO: 1057392 - protein, 25 aa, Mycobacterium
VGVSEALSGLAPWQEVLSGVSGRVA

SEQ ID NO: 1057393 - protein, 25 aa, Mycobacterium
VGVTRARVHLALTWALARSPGGRQG

SEQ ID NO: 1057394 - protein, 17 aa, Mycobacterium
VGYAVRFTDQVSERTLV

SEQ ID NO: 1057395 - protein, 22 aa, Mycobacterium
VGYLKREFAALGVDHAERAELF

SEQ ID NO: 1057396 - protein, 19 aa, Mycobacterium
VGYPREWRRRKPYSWLRQV

SEQ ID NO: 1057397 - protein, 24 aa, Mycobacterium
VGYRDLAGFGRRFIDVDPEDLVAE

SEQ ID NO: 1057398 - protein, 24 aa, Mycobacterium
VGYRHRWARRTGLLAAGACAGFFR

SEQ ID NO: 1057399 - protein, 22 aa, Mycobacterium
VHAADGRWYGRRWRGRDPQRQR

SEQ ID NO: 1057400 - protein, 17 aa, Mycobacterium
VHAEWPGHVIAAVAPPP

SEQ ID NO: 1057401 - protein, 23 aa, Mycobacterium
VHDELPHSLAVVIDEVSPREGRE

SEQ ID NO: 1057402 - protein, 22 aa, Mycobacterium
VHDGGDHFVVFGAVHSLSEVPK

SEQ ID NO: 1057403 - protein, 19 aa, Mycobacterium
VHDHCSAIHPMAVGSEFLA

SEQ ID NO: 1057404 - protein, 19 aa, Mycobacterium
VHEGRLVMESAYFGEDREG

SEQ ID NO: 1057405 - protein, 24 aa, Mycobacterium
VHEIRWDADISRWIIRTNHGDRIR

SEQ ID NO: 1057406 - protein, 23 aa, Mycobacterium
VHFKSVVYELLWFLRGDSNVGWL

SEQ ID NO: 1057407 - protein, 23 aa, Mycobacterium
VHGFRFFDNRDLLGFVDGTENPG

SEQ ID NO: 1057408 - protein, 17 aa, Mycobacterium
VHGGVMLALCAKAARGA

SEQ ID NO: 1057409 - protein, 19 aa, Mycobacterium
VHGLWRGGIGTTWEARIKF

SEQ ID NO: 1057410 - protein, 19 aa, Mycobacterium
VHGPLALAVGRRLRDRYGL

SEQ ID NO: 1057411 - protein, 24 aa, Mycobacterium
VHGVLIPGGFGIRGIEGKISAISY

SEQ ID NO: 1057412 - protein, 17 aa, Mycobacterium
VHIGPSDHVAWLDDRKW

SEQ ID NO: 1057413 - protein, 25 aa, Mycobacterium
VHKKGSALVPSWVAFAVTGLLEQHF

SEQ ID NO: 1057414 - protein, 20 aa, Mycobacterium
VHNDSGDTARVFAIDAKSGA

SEQ ID NO: 1057415 - protein, 19 aa, Mycobacterium
VHNLTGWPAAVVRCGTSPG

SEQ ID NO: 1057416 - protein, 25 aa, Mycobacterium
VHNTWRFGIDRVLAGVAMSEASHAW

SEQ ID NO: 1057417 - protein, 17 aa, Mycobacterium
VHPSLWRQSTLAAKQGL

SEQ ID NO: 1057418 - protein, 24 aa, Mycobacterium
VHPVDLGALGWRGLLDRVDVDPAA

SEQ ID NO: 1057419 - protein, 19 aa, Mycobacterium
VHQNWRLVAVLDMGWQKYQ

SEQ ID NO: 1057420 - protein, 17 aa, Mycobacterium
VHRHLRRYMNWIPAEYV

SEQ ID NO: 1057421 - protein, 25 aa, Mycobacterium
VHRPRRASSPFGQFAAVADAVNPAV

SEQ ID NO: 1057422 - protein, 19 aa, Mycobacterium
VHSATCLPGAGADADTAGA

SEQ ID NO: 1057423 - protein, 18 aa, Mycobacterium
VHSCPGGPLARVEGRVSL

SEQ ID NO: 1057424 - protein, 33 aa, Mycobacterium
VHTEFHARAGIDMTKLPSFMWLDVDDVIQESLA

SEQ ID NO: 1057425 - protein, 19 aa, Mycobacterium
VHTHPRWIAQAFADALGPS

SEQ ID NO: 1057426 - protein, 19 aa, Mycobacterium
VHTLCGPLSGIALNLLPPT

SEQ ID NO: 1057427 - protein, 17 aa, Mycobacterium
VHVGRWDQLDGLVAASY

SEQ ID NO: 1057428 - protein, 31 aa, Mycobacterium; identical to SEQ ID NO: 85697

SEQ ID NO: 1057429 - protein, 26 aa, Mycobacterium
VHWVAPAEAVWACRSMAANPLRQRRM

SEQ ID NO: 1057430 - protein, 18 aa, Mycobacterium
VIAANRALLMALIATNIF

SEQ ID NO: 1057431 - protein, 24 aa, Mycobacterium
VIACGDCALNRGVFADAYGVVGAV

SEQ ID NO: 1057432 - protein, 18 aa, Mycobacterium
VIAGCNRNRASLVGQLAM

SEQ ID NO: 1057433 - protein, 28 aa, Mycobacterium
VIAMLACARLGIMHSVVFGGFTANTLHA

SEQ ID NO: 1057434 - protein, 22 aa, Mycobacterium
VIAPHWALLTALARHANQTAVQ

SEQ ID NO: 1057435 - protein, 18 aa, Mycobacterium
VIAQLSFPGYFLVVHDIT

SEQ ID NO: 1057436 - protein, 18 aa, Mycobacterium
VIARDSLVKTALFGSDPN

SEQ ID NO: 1057437 - protein, 21 aa, Mycobacterium
VIASGFGKNSQWYRNIVANPR

SEQ ID NO: 1057438 - protein, 18 aa, Mycobacterium
VIASRSPIALSVTLEAVR

SEQ ID NO: 1057439 - protein, 20 aa, Mycobacterium
VICCPCARSPVSPGAEALQR

SEQ ID NO: 1057440 - protein, 27 aa, Mycobacterium
VICDKGFPSYFLIVADLINYARSVDIR

SEQ ID NO: 1057441 - protein, 18 aa, Mycobacterium
VIDALKIHPNINASYNEE

SEQ ID NO: 1057442 - protein, 21 aa, Mycobacterium
VIDIGELRDGALLPGLAAGAL

SEQ ID NO: 1057443 - protein, 22 aa, Mycobacterium
VIDLLLKRGASLGVQIRYETGA

SEQ ID NO: 1057444 - protein, 17 aa, Mycobacterium
VIDVQQWGVAPDGRQHR

SEQ ID NO: 1057445 - protein, 23 aa, Mycobacterium
VIDYLADHGWRVRARTFEEMHAH

SEQ ID NO: 1057446 - protein, 21 aa, Mycobacterium
VIEAISVAMFEYIDWMSQQVV

SEQ ID NO: 1057447 - protein, 23 aa, Mycobacterium
VIELLCRARDSLACNNSVAELVE

SEQ ID NO: 1057448 - protein, 25 aa, Mycobacterium
VIEQMPLDAGHQWRRNALLGSDDVL

SEQ ID NO: 1057449 - protein, 21 aa, Mycobacterium
VIERAGGLTSMFPTRHQGLSR

SEQ ID NO: 1057450 - protein, 23 aa, Mycobacterium
VIERAGLPKGTWALELNLDAIPI

SEQ ID NO: 1057451 - protein, 17 aa, Mycobacterium
VIERLRKWVTFTPLQNV

SEQ ID NO: 1057452 - protein, 23 aa, Mycobacterium
VIETALPGLHDWLDERLAQNGHS

SEQ ID NO: 1057453 - protein, 21 aa, Mycobacterium
VIGAHRFLQRVWRLVIDENTG

SEQ ID NO: 1057454 - protein, 27 aa, Mycobacterium
VIGDGGDGGVGGWGVLAAAGGKGGDAI

SEQ ID NO: 1057455 - protein, 19 aa, Mycobacterium
VIGVLRAVLFAPEDLALVR

SEQ ID NO: 1057456 - protein, 17 aa, Mycobacterium
VIKEVALEEGVRATFMP

SEQ ID NO: 1057457 - protein, 19 aa, Mycobacterium
VILASRLAANIGEYSGIEV

SEQ ID NO: 1057458 - protein, 20 aa, Mycobacterium
VILGALPLFHAFGQTAGLNA

SEQ ID NO: 1057459 - protein, 19 aa, Mycobacterium
VILQCARALSEYGVEPRHL

SEQ ID NO: 1057460 - protein, 17 aa, Mycobacterium
VILWHRSFHELIANDGA

SEQ ID NO: 1057461 - protein, 18 aa, Mycobacterium
VIMFGGPIDSASAPNIPD

SEQ ID NO: 1057462 - protein, 17 aa, Mycobacterium
VIMRPFRPRHTGADQAA

SEQ ID NO: 1057463 - protein, 28 aa, Mycobacterium
VINAPFEAAIGRDLIGNGAPGVAGVNGG

SEQ ID NO: 1057464 - protein, 18 aa, Mycobacterium
VINRHVFESLAMNARIAL

SEQ ID NO: 1057465 - protein, 18 aa, Mycobacterium
VIPGSGLAVERIGERAHD

SEQ ID NO: 1057466 - protein, 19 aa, Mycobacterium
VIPVSASVWREGHEAVAAT

SEQ ID NO: 1057467 - protein, 29 aa, Mycobacterium
VIRQIRSITWCRRRTIQVGRIATRVPQEW

SEQ ID NO: 1057468 - protein, 17 aa, Mycobacterium
VIRRLDLRQRLAPLSRC

SEQ ID NO: 1057469 - protein, 17 aa, Mycobacterium
VIRTRADELVLLLVVHH

SEQ ID NO: 1057470 - protein, 21 aa, Mycobacterium
VIRTRGRLWLANRPDQVMWLE

SEQ ID NO: 1057471 - protein, 18 aa, Mycobacterium
VISAAEWSRLERGIIQRV

SEQ ID NO: 1057472 - protein, 20 aa, Mycobacterium
VISDGSFTPTPVGYGGNGGN

SEQ ID NO: 1057473 - protein, 24 aa, Mycobacterium
VITAFNFPVAVWAWNTAVALVCGD

SEQ ID NO: 1057474 - protein, 42 aa, Mycobacterium; identical to SEQ ID NO: 746352

SEQ ID NO: 1057475 - protein, 17 aa, Mycobacterium
VIVAPSYAPGAVDVLSC

SEQ ID NO: 1057476 - protein, 18 aa, Mycobacterium
VIVAPSYAPGAVDVLSCK

SEQ ID NO: 1057477 - protein, 21 aa, Mycobacterium
VIVCAGGFIANSEWIKRYAPR

SEQ ID NO: 1057478 - protein, 23 aa, Mycobacterium
VIVCPIGFVADHIEVVWDLDAEL

SEQ ID NO: 1057479 - protein, 17 aa, Mycobacterium
VIVESAALLGLADESTL

SEQ ID NO: 1057480 - protein, 20 aa, Mycobacterium
VIVRQMLRRVTIIDSGATEF

SEQ ID NO: 1057481 - protein, 18 aa, Mycobacterium
VIVTGDFNALYSEDQAGL

SEQ ID NO: 1057482 - protein, 18 aa, Mycobacterium
VIVVPGVTSAIAVPALAG

SEQ ID NO: 1057483 - protein, 19 aa, Mycobacterium
VKAAVDVFKEKLIRRDISM

SEQ ID NO: 1057484 - protein, 25 aa, Mycobacterium
VKAIATDGARKCVEEAFKYPGTHWR

SEQ ID NO: 1057485 - protein, 22 aa, Mycobacterium
VKAWLAEVLPNFANYAHMLGLP

SEQ ID NO: 1057486 - protein, 22 aa, Mycobacterium
VKDAAAYISGFFNTGSNLSGFF

SEQ ID NO: 1057487 - protein, 27 aa, Mycobacterium
VKDCIQVLGGIGCTWEHDAHLYLRRAH

SEQ ID NO: 1057488 - protein, 29 aa, Mycobacterium
VKDGYGRNFLLPRGMAIVASRGAQKQADE

SEQ ID NO: 1057489 - protein, 24 aa, Mycobacterium
VKDKPAWFDRAWQRIVEEVAAGRQ

SEQ ID NO: 1057490 - protein, 18 aa, Mycobacterium
VKDLCFTQGIPTTAGMAI

SEQ ID NO: 1057491 - protein, 17 aa, Mycobacterium
VKEAWHAVAGRDVADTP

SEQ ID NO: 1057492 - protein, 19 aa, Mycobacterium
VKEKNDWSYEKWTKQVTRV

SEQ ID NO: 1057493 - protein, 25 aa, Mycobacterium
VKEPDGIKFLCPVPGYDRHFAITET

SEQ ID NO: 1057494 - protein, 21 aa, Mycobacterium
VKEPFSCWASLVVHAGPPGAG

SEQ ID NO: 1057495 - protein, 33 aa, Mycobacterium; identical to SEQ ID NO: 746462

SEQ ID NO: 1057496 - protein, 22 aa, Mycobacterium
VKGGRRFSFTALVIVGDGHGMV

SEQ ID NO: 1057497 - protein, 23 aa, Mycobacterium
VKGGRRFSFTALVIVGDGNGMVG

SEQ ID NO: 1057498 - protein, 27 aa, Mycobacterium
VKGPGAVDFRLGSPIGDALKGHNVIAG

SEQ ID NO: 1057499 - protein, 24 aa, Mycobacterium
VKGPIAGTGAEMWVNVNPQAYRDL

SEQ ID NO: 1057500 - protein, 20 aa, Mycobacterium
VKIGEGICGQAHQQASTIRA

SEQ ID NO: 1057501 - protein, 17 aa, Mycobacterium
VKIHGYCVAGGTDIALH

SEQ ID NO: 1057502 - protein, 17 aa, Mycobacterium
VKIPAGWSDTAAATTSV

SEQ ID NO: 1057503 - protein, 20 aa, Mycobacterium
VKIRGYRIECGEVTAALTTL

SEQ ID NO: 1057504 - protein, 18 aa, Mycobacterium
VKKLPPRLIVSRERLQLA

SEQ ID NO: 1057505 - protein, 20 aa, Mycobacterium
VKKPAALFLNYGYQGMASLI

SEQ ID NO: 1057506 - protein, 17 aa, Mycobacterium
VKLALKETILTTELPDQ

SEQ ID NO: 1057507 - protein, 19 aa, Mycobacterium
VKLIQPVAMDDGLRFAIRE

SEQ ID NO: 1057508 - protein, 19 aa, Mycobacterium
VKLLRQAWLTATRARNALV

SEQ ID NO: 1057509 - protein, 18 aa, Mycobacterium
VKLRGGVLSVTIDRPESL

SEQ ID NO: 1057510 - protein, 19 aa, Mycobacterium
VKLTCRGRDLSTAVNRARR

SEQ ID NO: 1057511 - protein, 20 aa, Mycobacterium
VKMALHYEGWDVEIAHNGRE

SEQ ID NO: 1057512 - protein, 20 aa, Mycobacterium
VKPGSGVRGIIAKKGNIPVG

SEQ ID NO: 1057513 - protein, 18 aa, Mycobacterium
VKQHARTSLMIHDVGAIV

SEQ ID NO: 1057514 - protein, 18 aa, Mycobacterium
VKQRFVDLLPQLTILDAG

SEQ ID NO: 1057515 - protein, 19 aa, Mycobacterium
VKRHLPIFLRAAGRNYIGA

SEQ ID NO: 1057516 - protein, 18 aa, Mycobacterium
VKRHMGGDWSIEIDDKKY

SEQ ID NO: 1057517 - protein, 25 aa, Mycobacterium
VKRVYVWSCASGWVLSGLVTAELHG

SEQ ID NO: 1057518 - protein, 19 aa, Mycobacterium
VKSADPIPARTIKSADPIP

SEQ ID NO: 1057519 - protein, 17 aa, Mycobacterium
VKSALDLGVPVTGIAEA

SEQ ID NO: 1057520 - protein, 18 aa, Mycobacterium
VKSDLDFHAAIIGLLDSP

SEQ ID NO: 1057521 - protein, 18 aa, Mycobacterium
VKSFYRRPLSVGDASGAA

SEQ ID NO: 1057522 - protein, 22 aa, Mycobacterium
VKSRLHYAVRALRLTLQELGVT

SEQ ID NO: 1057523 - protein, 24 aa, Mycobacterium
VKTRAVIIGTGFSGLGMAIALQKQ

SEQ ID NO: 1057524 - protein, 17 aa, Mycobacterium
VKVAKNWQRDPKQLGRL

SEQ ID NO: 1057525 - protein, 20 aa, Mycobacterium
VKVGDLLPEKTYPLTRQDLV

SEQ ID NO: 1057526 - protein, 30 aa, Mycobacterium
VKVGGARRCAAQSWSLERIRAVKEAAGVTV

SEQ ID NO: 1057527 - protein, 17 aa, Mycobacterium
VKYHLGATGVYLQMFGD

SEQ ID NO: 1057528 - protein, 24 aa, Mycobacterium
VKYPPLGSFRHGASVSQWYANPNA

SEQ ID NO: 1057529 - protein, 24 aa, Mycobacterium
VLAASSRRSAWWVGAVTLSVAKII

SEQ ID NO: 1057530 - protein, 17 aa, Mycobacterium
VLADFGALSTWADGIDH

SEQ ID NO: 1057531 - protein, 23 aa, Mycobacterium
VLAERIGALLLEVNRRFGTPVPP

SEQ ID NO: 1057532 - protein, 25 aa, Mycobacterium
VLAERLCGWQERYPDVVTHKVVVSD

SEQ ID NO: 1057533 - protein, 18 aa, Mycobacterium
VLALSALEFDASVYDIFG

SEQ ID NO: 1057534 - protein, 20 aa, Mycobacterium
VLARELLPERALMGDASAIV

SEQ ID NO: 1057535 - protein, 25 aa, Mycobacterium
VLAYPRVVWVAGGLLKGASVDAEVA

SEQ ID NO: 1057536 - protein, 19 aa, Mycobacterium
VLCPITGAQCWAAMSRRES

SEQ ID NO: 1057537 - protein, 17 aa, Mycobacterium
VLDDGWRMFDYLVDELN

SEQ ID NO: 1057538 - protein, 22 aa, Mycobacterium
VLDELRELAAVLGVARDAEVLG

SEQ ID NO: 1057539 - protein, 17 aa, Mycobacterium
VLDGHGWFGTKDIAMLD

SEQ ID NO: 1057540 - protein, 19 aa, Mycobacterium
VLDRLKELVLKPVEGSGGY

SEQ ID NO: 1057541 - protein, 26 aa, Mycobacterium
VLDVARLLSMARMRGAQGVVGELGFF

SEQ ID NO: 1057542 - protein, 17 aa, Mycobacterium
VLECAGVHDILAKSLGS

SEQ ID NO: 1057543 - protein, 18 aa, Mycobacterium
VLELLHLGGRSLAHAVLM

SEQ ID NO: 1057544 - protein, 18 aa, Mycobacterium
VLETEYLKRPLIDGPAPE

SEQ ID NO: 1057545 - protein, 27 aa, Mycobacterium
VLEVALRLPRIGYIGAMGSRQTHDDRM

SEQ ID NO: 1057546 - protein, 18 aa, Mycobacterium
VLEVPRPDRRIRRQRGKS

SEQ ID NO: 1057547 - protein, 24 aa, Mycobacterium
VLFKGLEPKARFYFVHSYAAQRWE

SEQ ID NO: 1057548 - protein, 26 aa, Mycobacterium
VLGAGIPLFGICFGNQILGRALGLST

SEQ ID NO: 1057549 - protein, 19 aa, Mycobacterium
VLGAPAFEAIIPRLLRDLR

SEQ ID NO: 1057550 - protein, 34 aa, Mycobacterium
VLGASVPLGCRFRRCLMLGLSVVGMRWRSVLRVR

SEQ ID NO: 1057551 - protein, 23 aa, Mycobacterium
VLGDPALPHLFFVDGGALAVENA

SEQ ID NO: 1057552 - protein, 19 aa, Mycobacterium
VLGGAGWEIAALDAVTVNR

SEQ ID NO: 1057553 - protein, 25 aa, Mycobacterium
VLGLPRGGVPVAFEVAKALHAPLDV

SEQ ID NO: 1057554 - protein, 24 aa, Mycobacterium
VLGLPRGGVPVAFEVAKALRAPLD

SEQ ID NO: 1057555 - protein, 25 aa, Mycobacterium
VLGLPRGGVPVAFEVAKALRAPLDV

SEQ ID NO: 1057556 - protein, 23 aa, Mycobacterium
VLGMARCRVPVVAAVNGPAVGLG

SEQ ID NO: 1057557 - protein, 17 aa, Mycobacterium
VLGMFLNTVPLRIRLNA

SEQ ID NO: 1057558 - protein, 25 aa, Mycobacterium
VLGMPFYLMRAIDGWSPMDGGWPAP

SEQ ID NO: 1057559 - protein, 24 aa, Mycobacterium
VLGVCVGMQILFARGVEFGVETQG

SEQ ID NO: 1057560 - protein, 18 aa, Mycobacterium
VLHEGPRSLGYGAGLAAR

SEQ ID NO: 1057561 - protein, 20 aa, Mycobacterium
VLKDVDFRIARKIVQVATGR

SEQ ID NO: 1057562 - protein, 19 aa, Mycobacterium
VLLARLVARTRLRLPAQRI

SEQ ID NO: 1057563 - protein, 18 aa, Mycobacterium
VLLDPGLRESVRHGVTTV

SEQ ID NO: 1057564 - protein, 28 aa, Mycobacterium
VLLDRERCILCARCTRFSNEIAGDPFID

SEQ ID NO: 1057565 - protein, 21 aa, Mycobacterium
VLLERCSVFAGGFDLQSACAV

SEQ ID NO: 1057566 - protein, 21 aa, Mycobacterium
VLLEVAWEALEHAGLPPDSLS

SEQ ID NO: 1057567 - protein, 24 aa, Mycobacterium
VLLGECGLALAFDRDQLSGLHGVL

SEQ ID NO: 1057568 - protein, 19 aa, Mycobacterium
VLLLHGFPSSSFNFRSVIP

SEQ ID NO: 1057569 - protein, 17 aa, Mycobacterium
VLLMAVERIELFVEALL

SEQ ID NO: 1057570 - protein, 17 aa, Mycobacterium
VLLPGLPYLGLEHRAAW

SEQ ID NO: 1057571 - protein, 32 aa, Mycobacterium
VLLREAHVLCGLPVAVFRCDMILADTTWAGQL

SEQ ID NO: 1057572 - protein, 18 aa, Mycobacterium
VLNPNGWGIVSAPSVILA

SEQ ID NO: 1057573 - protein, 19 aa, Mycobacterium
VLPATNFFGLDTILNHSNQ

SEQ ID NO: 1057574 - protein, 22 aa, Mycobacterium
VLPDMVAAGWGRIVNISSSSTH

SEQ ID NO: 1057575 - protein, 25 aa, Mycobacterium
VLPFNEVLDAAGFRCNFQESVGVSC

SEQ ID NO: 1057576 - protein, 18 aa, Mycobacterium
VLPFRIDDHTAWRLLEGL

SEQ ID NO: 1057577 - protein, 20 aa, Mycobacterium
VLPGVGLYLDGGFGVGNTHL

SEQ ID NO: 1057578 - protein, 19 aa, Mycobacterium
VLPPWGIKIIRKAIHRSRG

SEQ ID NO: 1057579 - protein, 18 aa, Mycobacterium
VLPRRGVSDAHSVGFRAS

SEQ ID NO: 1057580 - protein, 27 aa, Mycobacterium
VLPVIGTKEFIAWLPTLLGLGSADAVV

SEQ ID NO: 1057581 - protein, 26 aa, Mycobacterium
VLPVIPMPFGFGIWTSHTTPIYLGAS

SEQ ID NO: 1057582 - protein, 18 aa, Mycobacterium
VLPYSWQRVSLYAGGAER

SEQ ID NO: 1057583 - protein, 23 aa, Mycobacterium
VLRCGLDGPAEFVVGSPIQAVDQ

SEQ ID NO: 1057584 - protein, 19 aa, Mycobacterium
VLRDELRGLGPLPATGRGL

SEQ ID NO: 1057585 - protein, 18 aa, Mycobacterium
VLREVEWQIGPGERTGIV

SEQ ID NO: 1057586 - protein, 24 aa, Mycobacterium
VLRLPGRGADEWVPVHVTVNRIEL

SEQ ID NO: 1057587 - protein, 20 aa, Mycobacterium
VLRTECVGGQPMDLGAEAFL

SEQ ID NO: 1057588 - protein, 22 aa, Mycobacterium
VLRTRAAAVGIDIELVDIEKKL

SEQ ID NO: 1057589 - protein, 24 aa, Mycobacterium
VLSAFKVPTVWLLLADDADIPRGP

SEQ ID NO: 1057590 - protein, 21 aa, Mycobacterium
VLSLTGRPLIGNGASGAPGTG

SEQ ID NO: 1057591 - protein, 27 aa, Mycobacterium
VLSPHWPEYLGALGFPIHYRGNHLHLR

SEQ ID NO: 1057592 - protein, 24 aa, Mycobacterium
VLSRAQLLELVWGYDFAADTNVVD

SEQ ID NO: 1057593 - protein, 18 aa, Mycobacterium
VLSRRPRMLYDYFQQLFA

SEQ ID NO: 1057594 - protein, 18 aa, Mycobacterium
VLSSPGYREAAQRAAASI

SEQ ID NO: 1057595 - protein, 17 aa, Mycobacterium
VLTAAVYVDCVTRYQQA

SEQ ID NO: 1057596 - protein, 20 aa, Mycobacterium
VLTADCVPVLMADARAGVTA

SEQ ID NO: 1057597 - protein, 17 aa, Mycobacterium
VLTCGMFGNVIRLLPPL

SEQ ID NO: 1057598 - protein, 19 aa, Mycobacterium
VLTGPRWRLGGSDVAALWR

SEQ ID NO: 1057599 - protein, 31 aa, Mycobacterium
VLTMKWSLIRVAAVWRRPALAVPLPQRGESR

SEQ ID NO: 1057600 - protein, 19 aa, Mycobacterium
VLTPLAVDPAHPFPFVSGL

SEQ ID NO: 1057601 - protein, 33 aa, Mycobacterium
VLTPLAVDPAHPFPFVSGLSLNLAVTVKQPEDG

SEQ ID NO: 1057602 - protein, 19 aa, Mycobacterium
VLTRLPLSGIRVLDLTTFW

SEQ ID NO: 1057603 - protein, 24 aa, Mycobacterium
VLTRREFAGMISVAIESADGAANT

SEQ ID NO: 1057604 - protein, 23 aa, Mycobacterium
VLTRRTVWASSYMVADRLIAALG

SEQ ID NO: 1057605 - protein, 22 aa, Mycobacterium
VLTRVDGGVGFITLNRPKAINS

SEQ ID NO: 1057606 - protein, 18 aa, Mycobacterium
VLVAGSWFPRYARHLGTD

SEQ ID NO: 1057607 - protein, 29 aa, Mycobacterium
VLVDFWASWCGPCRALAPTFQASSEAHPD

SEQ ID NO: 1057608 - protein, 21 aa, Mycobacterium
VLVDGALAWFLERGGRTLLTF

SEQ ID NO: 1057609 - protein, 22 aa, Mycobacterium
VLVHGLPLYHVHGLVLGLLGSL

SEQ ID NO: 1057610 - protein, 17 aa, Mycobacterium
VLVIRGEVRAVPAAAQA

SEQ ID NO: 1057611 - protein, 26 aa, Mycobacterium
VLVKVAYCGICHSDLSLINGTFPTQA

SEQ ID NO: 1057612 - protein, 23 aa, Mycobacterium
VLVLLLDALVEWVRVAKMMDFGV

SEQ ID NO: 1057613 - protein, 19 aa, Mycobacterium
VLVRGGVVFTGYWHNEKAT

SEQ ID NO: 1057614 - protein, 33 aa, Mycobacterium
VLVRPAPVPGYRGSRSFGFKEFDPFWQACIKAG

SEQ ID NO: 1057615 - protein, 18 aa, Mycobacterium
VLVTIGFDPVEYDPRLWN

SEQ ID NO: 1057616 - protein, 19 aa, Mycobacterium
VLWSPAGELPRWWDSLPTD

SEQ ID NO: 1057617 - protein, 24 aa, Mycobacterium
VMADAAKALAEFDIAMEVRVVSAH

SEQ ID NO: 1057618 - protein, 25 aa, Mycobacterium
VMAPRQWRGLRRWLGESPDFQDPKY

SEQ ID NO: 1057619 - protein, 25 aa, Mycobacterium
VMFKLKHERTADCVLAGYRLHKSGG

SEQ ID NO: 1057620 - protein, 25 aa, Mycobacterium
VMGQAMVRAALSYLALPPSDADEAA

SEQ ID NO: 1057621 - protein, 18 aa, Mycobacterium
VMLGAALLARNAVDKGLT

SEQ ID NO: 1057622 - protein, 17 aa, Mycobacterium
VMMPGMDGFGVLRRLQA

SEQ ID NO: 1057623 - protein, 18 aa, Mycobacterium
VMPSRRDITTAPPVLAAW

SEQ ID NO: 1057624 - protein, 22 aa, Mycobacterium
VMPTTCPECGTTLAPEKEGDAD

SEQ ID NO: 1057625 - protein, 20 aa, Mycobacterium
VMQICHHLHGGMGMDVTYPM

SEQ ID NO: 1057626 - protein, 18 aa, Mycobacterium
VMQSPMLWDPIRYDETCP

SEQ ID NO: 1057627 - protein, 26 aa, Mycobacterium
VMRQGYQLGEHVLRNALVAVVETIAD

SEQ ID NO: 1057628 - protein, 25 aa, Mycobacterium
VMRRLWKGEMVFNHDGPMGRYPVLF

SEQ ID NO: 1057629 - protein, 33 aa, Mycobacterium
VMSFVAVCGQCRWCASGMEYLCDAGIGTLTPGM

SEQ ID NO: 1057630 - protein, 19 aa, Mycobacterium
VMTGFRVSRSGWYGIDPVD

SEQ ID NO: 1057631 - protein, 21 aa, Mycobacterium
VMTLALDCGALVLPAKSDEHD

SEQ ID NO: 1057632 - protein, 18 aa, Mycobacterium
VMTNEIFGPILPVLTVKS

SEQ ID NO: 1057633 - protein, 17 aa, Mycobacterium
VMVKAQVKTGGRGKAGG

SEQ ID NO: 1057634 - protein, 24 aa, Mycobacterium
VMVPRLPPSQARVLLMAALTAELP

SEQ ID NO: 1057635 - protein, 23 aa, Mycobacterium
VMVSWLPLFHDMGMIGFLTVPMY

SEQ ID NO: 1057636 - protein, 19 aa, Mycobacterium
VNAAALMDLIAAHRIPVIS

SEQ ID NO: 1057637 - protein, 18 aa, Mycobacterium
VNAAYQLFHQVRRLVAVM

SEQ ID NO: 1057638 - protein, 17 aa, Mycobacterium
VNAFALLAADAIEAAQQ

SEQ ID NO: 1057639 - protein, 18 aa, Mycobacterium
VNAFALLAADAIEAAQQT

SEQ ID NO: 1057640 - protein, 23 aa, Mycobacterium
VNAMFRKIFSRSQGDVMDFIAMP

SEQ ID NO: 1057641 - protein, 26 aa, Mycobacterium
VNAPAQALFGRPLIGNGSNGTPGTGA

SEQ ID NO: 1057642 - protein, 25 aa, Mycobacterium
VNAPSELLFGRMIIGNGADATEAGT

SEQ ID NO: 1057643 - protein, 27 aa, Mycobacterium
VNAPTQVLFGRGLIGDGANGTAPGQAG

SEQ ID NO: 1057644 - protein, 25 aa, Mycobacterium
VNAQEWREELPLIEEWLQFIGEKLP

SEQ ID NO: 1057645 - protein, 18 aa, Mycobacterium
VNATRYLCEGSPKQVANT

SEQ ID NO: 1057646 - protein, 24 aa, Mycobacterium
VNAVQRCVAVLFAALHGDTNLRAT

SEQ ID NO: 1057647 - protein, 23 aa, Mycobacterium
VNDRMKVAFIPNFNVQSGQMIYP

SEQ ID NO: 1057648 - protein, 18 aa, Mycobacterium
VNETDMRGRLQLHHVRAK

SEQ ID NO: 1057649 - protein, 20 aa, Mycobacterium
VNFASPWRHPIISSSTISVA

SEQ ID NO: 1057650 - protein, 19 aa, Mycobacterium
VNGAPAYRLALQTREQHIR

SEQ ID NO: 1057651 - protein, 21 aa, Mycobacterium
VNGICCGAGLDWVTTSDIVIA

SEQ ID NO: 1057652 - protein, 19 aa, Mycobacterium
VNGKIRFPPNTNLVRHVEK

SEQ ID NO: 1057653 - protein, 24 aa, Mycobacterium
VNGPAIGGGLCLALAADVRVAAAS

SEQ ID NO: 1057654 - protein, 19 aa, Mycobacterium
VNGPDCGITNVNIGTSDAK

SEQ ID NO: 1057655 - protein, 20 aa, Mycobacterium
VNGSWNWSSGCDHGTWCFAG

SEQ ID NO: 1057656 - protein, 21 aa, Mycobacterium
VNGVNRLACKVLMRDLLPKKA

SEQ ID NO: 1057657 - protein, 27 aa, Mycobacterium
VNGYRGCMHACRYCFARPIHEYLDFDS

SEQ ID NO: 1057658 - protein, 23 aa, Mycobacterium
VNHEPFVTLGLHIGARTTSIVAT

SEQ ID NO: 1057659 - protein, 21 aa, Mycobacterium
VNIEYLASVVMDRDGVAYPDT

SEQ ID NO: 1057660 - protein, 29 aa, Mycobacterium
VNIPANRKRVVAVSFPRDLAITPVKCEAW

SEQ ID NO: 1057661 - protein, 18 aa, Mycobacterium
VNKLRGRNVPKLRQVIGC

SEQ ID NO: 1057662 - protein, 20 aa, Mycobacterium
VNLAAALAIQGLKTLVIDLD

SEQ ID NO: 1057663 - protein, 29 aa, Mycobacterium
VNLERAAAVNSRLGGHIVQGHVDGTGEII

SEQ ID NO: 1057664 - protein, 17 aa, Mycobacterium
VNLGAPVLLAVSAKGRD

SEQ ID NO: 1057665 - protein, 19 aa, Mycobacterium
VNLGWKLAQVVNRRSPESL

SEQ ID NO: 1057666 - protein, 17 aa, Mycobacterium
VNLKAATMLAWQQALAA

SEQ ID NO: 1057667 - protein, 22 aa, Mycobacterium
VNLNVPEIQAAIKSLPTLPQSY

SEQ ID NO: 1057668 - protein, 28 aa, Mycobacterium
VNLWAPLMWTSLVVKAWMGEHGGVVINT

SEQ ID NO: 1057669 - protein, 23 aa, Mycobacterium
VNNKCPLTSYVLVGFSQGAVIAG

SEQ ID NO: 1057670 - protein, 23 aa, Mycobacterium
VNPIYNWPLPRLAVNIVGSDHGG

SEQ ID NO: 1057671 - protein, 22 aa, Mycobacterium
VNPSGGLACFGEAIPAQAIAQV

SEQ ID NO: 1057672 - protein, 24 aa, Mycobacterium
VNPVKLRLGIGYVIQNAGLMPHQR

SEQ ID NO: 1057673 - protein, 18 aa, Mycobacterium
VNRAELAALIATDFFGQN

SEQ ID NO: 1057674 - protein, 21 aa, Mycobacterium
VNRARRIERFLSQNMMAAEQF

SEQ ID NO: 1057675 - protein, 18 aa, Mycobacterium
VNRGKRSAVIDLKSDSGQ

SEQ ID NO: 1057676 - protein, 25 aa, Mycobacterium
VNRKVLPGYILVRMDLTDDSWAAVR

SEQ ID NO: 1057677 - protein, 22 aa, Mycobacterium
VNRWFYDCPPAFHRNLGDMYVS

SEQ ID NO: 1057678 - protein, 24 aa, Mycobacterium
VNSSYRMEQGFTFELNLAGVADEH

SEQ ID NO: 1057679 - protein, 23 aa, Mycobacterium
VNTDPYGAGWLLDVQVEGSDVAA

SEQ ID NO: 1057680 - protein, 17 aa, Mycobacterium
VNTGAFISGNYSNGLLW

SEQ ID NO: 1057681 - protein, 23 aa, Mycobacterium
VNVWKDNERFLASVVAPGRDNAV

SEQ ID NO: 1057682 - protein, 25 aa, Mycobacterium
VNWFRRGEDHRFLWPGFGENSRVMK

SEQ ID NO: 1057683 - protein, 21 aa, Mycobacterium
VPAARAAGVATDMPTRVTPSV

SEQ ID NO: 1057684 - protein, 21 aa, Mycobacterium
VPAESDGAVILYVVDAAAPGV

SEQ ID NO: 1057685 - protein, 21 aa, Mycobacterium
VPAIYQVRGFDLSNITFVEGD

SEQ ID NO: 1057686 - protein, 17 aa, Mycobacterium
VPAKGWLIGEVHEGIAQ

SEQ ID NO: 1057687 - protein, 17 aa, Mycobacterium
VPAMPIWMGVRSSVMQR

SEQ ID NO: 1057688 - protein, 17 aa, Mycobacterium
VPAPGALGRHFPFDPSQ

SEQ ID NO: 1057689 - protein, 21 aa, Mycobacterium
VPAPTECRFKAAAVNASGALV

SEQ ID NO: 1057690 - protein, 21 aa, Mycobacterium
VPARLHPGMFYALPQSPQLFK

SEQ ID NO: 1057691 - protein, 17 aa, Mycobacterium
VPASLKWHDTARRSWLR

SEQ ID NO: 1057692 - protein, 17 aa, Mycobacterium
VPASRAAAFGAAVSVGA

SEQ ID NO: 1057693 - protein, 23 aa, Mycobacterium
VPASVWGGVAAVRFKHAMDRWGA

SEQ ID NO: 1057694 - protein, 21 aa, Mycobacterium
VPATVARYVVEKGSITVDGIS

SEQ ID NO: 1057695 - protein, 18 aa, Mycobacterium
VPAVRVPVHFSIAQHEKV

SEQ ID NO: 1057696 - protein, 18 aa, Mycobacterium
VPDDGRWFTRVHGDDELD

SEQ ID NO: 1057697 - protein, 18 aa, Mycobacterium
VPDGFALTSDDRGVLIVP

SEQ ID NO: 1057698 - protein, 21 aa, Mycobacterium
VPDMFTRMILSLAATGIAPGS

SEQ ID NO: 1057699 - protein, 21 aa, Mycobacterium
VPDVLRHRLVLTYDALADEIS

SEQ ID NO: 1057700 - protein, 20 aa, Mycobacterium
VPECQSPLFLHVDAQDPDRV

SEQ ID NO: 1057701 - protein, 24 aa, Mycobacterium
VPEGSVLVPFAWQGVTLHAAGASA

SEQ ID NO: 1057702 - protein, 17 aa, Mycobacterium
VPEPLKLAGSPEQKKKF

SEQ ID NO: 1057703 - protein, 19 aa, Mycobacterium
VPEQACLQIGVGGLPQAVC

SEQ ID NO: 1057704 - protein, 31 aa, Mycobacterium; identical to SEQ ID NO: 747931

SEQ ID NO: 1057705 - protein, 20 aa, Mycobacterium
VPGACYTRTGGFVDRVGDFE

SEQ ID NO: 1057706 - protein, 18 aa, Mycobacterium
VPGFPHWNAGMLSTVHKR

SEQ ID NO: 1057707 - protein, 18 aa, Mycobacterium
VPGFPNFFMLCGPNTNVG

SEQ ID NO: 1057708 - protein, 19 aa, Mycobacterium
VPGFPNFYCMYGPGTNAVN

SEQ ID NO: 1057709 - protein, 23 aa, Mycobacterium
VPGHPDHVMYVWVDALTNYLTGA

SEQ ID NO: 1057710 - protein, 24 aa, Mycobacterium
VPGPDRVPLLALLRSTPLTEDQIR

SEQ ID NO: 1057711 - protein, 17 aa, Mycobacterium
VPGRTGGLVTVRSAIKR

SEQ ID NO: 1057712 - protein, 24 aa, Mycobacterium
VPGSAGPPCGRWASTLRVSRRSVP

SEQ ID NO: 1057713 - protein, 20 aa, Mycobacterium
VPGTCWLVDLPGDGSNVNAP

SEQ ID NO: 1057714 - protein, 21 aa, Mycobacterium
VPGTVPVLVHPAPRGVLGEAA

SEQ ID NO: 1057715 - protein, 18 aa, Mycobacterium
VPGVAPWAGDFLLDTTRA

SEQ ID NO: 1057716 - protein, 21 aa, Mycobacterium
VPGVLVALDWQTLTCQSDAGC

SEQ ID NO: 1057717 - protein, 20 aa, Mycobacterium
VPGWTKPIVIGRHAFGDQYR

SEQ ID NO: 1057718 - protein, 28 aa, Mycobacterium
VPHLIRLHHSRFPQARFELHQRSGQGVL

SEQ ID NO: 1057719 - protein, 27 aa, Mycobacterium
VPIDPSWPAARVELVLSDCGPSMIVTE

SEQ ID NO: 1057720 - protein, 17 aa, Mycobacterium
VPIKGFLSFDEGVVQVT

SEQ ID NO: 1057721 - protein, 25 aa, Mycobacterium
VPILKGDKGQPCWPDGVVGSLTHCS

SEQ ID NO: 1057722 - protein, 18 aa, Mycobacterium
VPIPELPSRLAYADERRL

SEQ ID NO: 1057723 - protein, 17 aa, Mycobacterium
VPIPGAPPSPAGLDRGC

SEQ ID NO: 1057724 - protein, 19 aa, Mycobacterium
VPISPRLRDAAAALLHRLG

SEQ ID NO: 1057725 - protein, 20 aa, Mycobacterium
VPIYPGYVCAIVGSSVLGKP

SEQ ID NO: 1057726 - protein, 18 aa, Mycobacterium
VPKHAGLTYLLCDMTQPG

SEQ ID NO: 1057727 - protein, 29 aa, Mycobacterium
VPLAKACARVMLGASISQLRAEGMLARTG

SEQ ID NO: 1057728 - protein, 19 aa, Mycobacterium
VPLDINLPWFMRGPGAVTG

SEQ ID NO: 1057729 - protein, 25 aa, Mycobacterium
VPLEVLIAVVNRLGWTHGCELNALE

SEQ ID NO: 1057730 - protein, 18 aa, Mycobacterium
VPLEVSVGFGRSWDSAAH

SEQ ID NO: 1057731 - protein, 18 aa, Mycobacterium
VPLGVVGMIYEGRPNITV

SEQ ID NO: 1057732 - protein, 25 aa, Mycobacterium
VPLLRGDQWWALGMSEPEAGSDFAG

SEQ ID NO: 1057733 - protein, 23 aa, Mycobacterium
VPLPVFLGGAAVRTQYAFGPTIG

SEQ ID NO: 1057734 - protein, 24 aa, Mycobacterium
VPLPVNFEVALLFLAIGMSVTPSG

SEQ ID NO: 1057735 - protein, 32 aa, Mycobacterium
VPLRELPLPYPARSWRSYPRCSDSSSSKAVSM

SEQ ID NO: 1057736 - protein, 17 aa, Mycobacterium
VPLRVGLATGPVVAGVV

SEQ ID NO: 1057737 - protein, 17 aa, Mycobacterium
VPLSGALVLGWGEPNTS

SEQ ID NO: 1057738 - protein, 21 aa, Mycobacterium
VPLYEERYVLLAPPEMLPPGV

SEQ ID NO: 1057739 - protein, 23 aa, Mycobacterium
VPMEEIDLLLFRALSACNRLVCL

SEQ ID NO: 1057740 - protein, 19 aa, Mycobacterium
VPMLLRAGLGVAMGNAHPD

SEQ ID NO: 1057741 - protein, 21 aa, Mycobacterium
VPMREDMCIMLAARKVPGALK

SEQ ID NO: 1057742 - protein, 18 aa, Mycobacterium
VPMYFAGELVKVTPMDFM

SEQ ID NO: 1057743 - protein, 23 aa, Mycobacterium
VPNAGTYWAHPHVGLEDDHGLYL

SEQ ID NO: 1057744 - protein, 24 aa, Mycobacterium
VPNFAFGHGLTYTSFGYRDLAVSG

SEQ ID NO: 1057745 - protein, 28 aa, Mycobacterium
VPPALILENRLQLVTLIATNIFGQNTPA

SEQ ID NO: 1057746 - protein, 24 aa, Mycobacterium
VPPAPPLPPWPPLPPFATTLPVAP

SEQ ID NO: 1057747 - protein, 21 aa, Mycobacterium
VPPGFSHCLLLAEGHVVASGL

SEQ ID NO: 1057748 - protein, 17 aa, Mycobacterium
VPPIAFGHALGYGLRPG

SEQ ID NO: 1057749 - protein, 20 aa, Mycobacterium
VPQCPRRWRYLSPAIPADLE

SEQ ID NO: 1057750 - protein, 20 aa, Mycobacterium
VPQFEVMYLLAGCDAAAADT

SEQ ID NO: 1057751 - protein, 17 aa, Mycobacterium
VPQPSVADWLQLEYYAE

SEQ ID NO: 1057752 - protein, 19 aa, Mycobacterium
VPQRLIGLARIWEEILGRP

SEQ ID NO: 1057753 - protein, 18 aa, Mycobacterium
VPQWRFVAEWTSKGEILT

SEQ ID NO: 1057754 - protein, 26 aa, Mycobacterium
VPRAEVLRPGLLVLPVRGAARFFGSE

SEQ ID NO: 1057755 - protein, 24 aa, Mycobacterium
VPRAPEAPAAMAPEPTVATADLGS

SEQ ID NO: 1057756 - protein, 18 aa, Mycobacterium
VPRFEHAGGRRVSDERRG

SEQ ID NO: 1057757 - protein, 19 aa, Mycobacterium
VPRILGVTTDSEFSEAPLV

SEQ ID NO: 1057758 - protein, 26 aa, Mycobacterium
VPRLLKWDKNRVAARIDELLDLVNLD

SEQ ID NO: 1057759 - protein, 21 aa, Mycobacterium
VPRNELIAFFVASDVMLVTPL

SEQ ID NO: 1057760 - protein, 19 aa, Mycobacterium
VPRPWQLGAEMLRVTRPGG

SEQ ID NO: 1057761 - protein, 18 aa, Mycobacterium
VPRRAIAAIPTWSTLEVQ

SEQ ID NO: 1057762 - protein, 17 aa, Mycobacterium
VPSARRYLPGSLIMETT

SEQ ID NO: 1057763 - protein, 21 aa, Mycobacterium
VPSERTGSVARCYSLCSSPFT

SEQ ID NO: 1057764 - protein, 18 aa, Mycobacterium
VPSSMVLLSPWLDLGMTN

SEQ ID NO: 1057765 - protein, 44 aa, Mycobacterium
VPSVKVGFYGRVRRCGMVSPTVFWPIPRVYSGLVRIDRHETTPW

SEQ ID NO: 1057766 - protein, 18 aa, Mycobacterium
VPTGELPPIVGTAGKPPR

SEQ ID NO: 1057767 - protein, 25 aa, Mycobacterium
VPTHVKPRLLGHWGTTPGLNLIYAH

SEQ ID NO: 1057768 - protein, 19 aa, Mycobacterium
VPTLKALLDGGAKVVVAAH

SEQ ID NO: 1057769 - protein, 23 aa, Mycobacterium
VPTPGSLPALFAAQVARTPEATA

SEQ ID NO: 1057770 - protein, 19 aa, Mycobacterium
VPTSFNLIDRWWQAPASGL

SEQ ID NO: 1057771 - protein, 18 aa, Mycobacterium
VPVDLVFQSIAGTEGANS

SEQ ID NO: 1057772 - protein, 19 aa, Mycobacterium
VPVEAGVYRVNRVVNPERV

SEQ ID NO: 1057773 - protein, 21 aa, Mycobacterium
VPVEEARTWVGLAGTMTTLSA

SEQ ID NO: 1057774 - protein, 17 aa, Mycobacterium
VPVIGPFFRRGLMLLDF

SEQ ID NO: 1057775 - protein, 30 aa, Mycobacterium; identical to SEQ ID NO: 748393

SEQ ID NO: 1057776 - protein, 17 aa, Mycobacterium
VPVPRILGVTTDSEFSE

SEQ ID NO: 1057777 - protein, 21 aa, Mycobacterium
VPVPWARSGRELAERRINLVR

SEQ ID NO: 1057778 - protein, 22 aa, Mycobacterium
VPVPWARSGRELAERRINLVRR

SEQ ID NO: 1057779 - protein, 17 aa, Mycobacterium
VPVRELANASGYGNALE

SEQ ID NO: 1057780 - protein, 17 aa, Mycobacterium
VPVRWSDIDMYQHVNHA

SEQ ID NO: 1057781 - protein, 17 aa, Mycobacterium
VPVSGIRFDGVRVAPWQ

SEQ ID NO: 1057782 - protein, 20 aa, Mycobacterium
VPVSGLLALTARTLRQSEFA

SEQ ID NO: 1057783 - protein, 20 aa, Mycobacterium
VPVYLGCDWQNVPLNLPSTF

SEQ ID NO: 1057784 - protein, 19 aa, Mycobacterium
VPVYPTCHYVMGGIPTTVT

SEQ ID NO: 1057785 - protein, 25 aa, Mycobacterium
VPWEPICAPDLLLAQALLRTKQIKL

SEQ ID NO: 1057786 - protein, 20 aa, Mycobacterium
VPYFSLAMLPGGRRSTVVAG

SEQ ID NO: 1057787 - protein, 24 aa, Mycobacterium
VQAAAEWFARILFSLFSTPSPIRD

SEQ ID NO: 1057788 - protein, 25 aa, Mycobacterium
VQAAELAPGPALRCAEAVARGDASA

SEQ ID NO: 1057789 - protein, 25 aa, Mycobacterium
VQAEFDRLRALGVRFTQEPTEMGPV

SEQ ID NO: 1057790 - protein, 25 aa, Mycobacterium
VQAGPLWLIAHLSRAGWLRWSDKLA

SEQ ID NO: 1057791 - protein, 18 aa, Mycobacterium
VQALAVIDLDHGYVTAVD

SEQ ID NO: 1057792 - protein, 21 aa, Mycobacterium
VQALNGGGFLYAATEATSASP

SEQ ID NO: 1057793 - protein, 18 aa, Mycobacterium
VQALRHLALVVADEPEVG

SEQ ID NO: 1057794 - protein, 17 aa, Mycobacterium
VQFYCIDLGGGGLIYLE

SEQ ID NO: 1057795 - protein, 20 aa, Mycobacterium
VQGEAAAGVVLLRPASPGTG

SEQ ID NO: 1057796 - protein, 30 aa, Mycobacterium
VQGMPKARCLEGDLAYWCVAAADRYAYTVQ

SEQ ID NO: 1057797 - protein, 20 aa, Mycobacterium
VQHQRIRGAVTLNDGDHIRI

SEQ ID NO: 1057798 - protein, 24 aa, Mycobacterium
VQKDFGVPAGHVFATGMSNGGFMS

SEQ ID NO: 1057799 - protein, 19 aa, Mycobacterium
VQLANSLYIGRSVGGAVAQ

SEQ ID NO: 1057800 - protein, 17 aa, Mycobacterium
VQLARLVGAVPVIALDI

SEQ ID NO: 1057801 - protein, 21 aa, Mycobacterium
VQLKGPLLLVVVQRDELHVMV

SEQ ID NO: 1057802 - protein, 17 aa, Mycobacterium
VQLPEPVQMASADEAIS

SEQ ID NO: 1057803 - protein, 34 aa, Mycobacterium
VQLPVSLPFLPAHEADAYLGLLLAKAGLDNDAFT

SEQ ID NO: 1057804 - protein, 26 aa, Mycobacterium
VQLTRKRLGTGLIEAFSTSCPHCSGR

SEQ ID NO: 1057805 - protein, 22 aa, Mycobacterium
VQPDLKVLVNLGYGDPNYGYST

SEQ ID NO: 1057806 - protein, 17 aa, Mycobacterium
VQPDPFAEPGWFRTDDL

SEQ ID NO: 1057807 - protein, 22 aa, Mycobacterium
VQPNLKVIVNLGYGDPAYGYST

SEQ ID NO: 1057808 - protein, 22 aa, Mycobacterium
VQPPEVHSGALSFGPGPGPLSE

SEQ ID NO: 1057809 - protein, 23 aa, Mycobacterium
VQRLELVRRIGIEIDNDVVELGT

SEQ ID NO: 1057810 - protein, 17 aa, Mycobacterium
VQSLIRWDPVGHADAEL

SEQ ID NO: 1057811 - protein, 20 aa, Mycobacterium
VQSYAPRRQKHCLMNADGWG

SEQ ID NO: 1057812 - protein, 28 aa, Mycobacterium
VQTAAPAALVRRAKTARQAPTPTAAPGA

SEQ ID NO: 1057813 - protein, 24 aa, Mycobacterium
VQTGFARTGAMFACDHENVEPDLI

SEQ ID NO: 1057814 - protein, 24 aa, Mycobacterium
VQTGIGRTGAFFAHQHDSITPDVV

SEQ ID NO: 1057815 - protein, 24 aa, Mycobacterium
VQTGIGRTGAFYAHQHDGITPDVV

SEQ ID NO: 1057816 - protein, 17 aa, Mycobacterium
VQTIWARSVVRDLEDAY

SEQ ID NO: 1057817 - protein, 22 aa, Mycobacterium
VQTLLGRPLIGNGANATTPGGA

SEQ ID NO: 1057818 - protein, 27 aa, Mycobacterium
VQVLVPRKDMFVTPALQRFTGAIPGGG

SEQ ID NO: 1057819 - protein, 23 aa, Mycobacterium
VQVSHLMPTFAGRSLTERFGLSA

SEQ ID NO: 1057820 - protein, 26 aa, Mycobacterium
VQVVGNRPKIGWRRYEAQAVLSRLLN

SEQ ID NO: 1057821 - protein, 19 aa, Mycobacterium
VQYKALVGAGRMIPRGLLR

SEQ ID NO: 1057822 - protein, 19 aa, Mycobacterium
VRAAMCAIIARYRRHQPIL

SEQ ID NO: 1057823 - protein, 19 aa, Mycobacterium
VRAAVAMTLTSRFPIVLWL

SEQ ID NO: 1057824 - protein, 17 aa, Mycobacterium
VRAEIIATLSASKIKAT

SEQ ID NO: 1057825 - protein, 27 aa, Mycobacterium
VRAIEHCNRWAAPLAGHKWYAFVAEYF

SEQ ID NO: 1057826 - protein, 19 aa, Mycobacterium
VRALSRVVPMLKPIVPDPG

SEQ ID NO: 1057827 - protein, 25 aa, Mycobacterium
VRAPALLISRLVSWVDDLWCRAIGA

SEQ ID NO: 1057828 - protein, 18 aa, Mycobacterium
VRAPWNLPPQPDHAVGSS

SEQ ID NO: 1057829 - protein, 19 aa, Mycobacterium
VRAQLGITINWRFFSLEEI

SEQ ID NO: 1057830 - protein, 19 aa, Mycobacterium
VRARDRFATRVNIEVAPHN

SEQ ID NO: 1057831 - protein, 20 aa, Mycobacterium
VRARDRFATRVNIEVAPHNP

SEQ ID NO: 1057832 - protein, 18 aa, Mycobacterium
VRARHRLTLDEGRELAVG

SEQ ID NO: 1057833 - protein, 17 aa, Mycobacterium
VRATLEAVRSVVRQSGS

SEQ ID NO: 1057834 - protein, 19 aa, Mycobacterium
VRATVPAMLSNAGRGPALK

SEQ ID NO: 1057835 - protein, 24 aa, Mycobacterium
VRDAFKQYGDFVALDHVDFVVPAG

SEQ ID NO: 1057836 - protein, 26 aa, Mycobacterium
VRDAFRKGDCWFNTGDVMSPQGMGHA

SEQ ID NO: 1057837 - protein, 23 aa, Mycobacterium
VRDALCRIRLVLPDPVGLLRCCG

SEQ ID NO: 1057838 - protein, 17 aa, Mycobacterium
VRDALQVMIERTRAVHG

SEQ ID NO: 1057839 - protein, 20 aa, Mycobacterium
VRDGKVCALWDIANPDKFSG

SEQ ID NO: 1057840 - protein, 19 aa, Mycobacterium
VRDGLKPVHRRVLYAMYDS

SEQ ID NO: 1057841 - protein, 19 aa, Mycobacterium
VRDIWRFWYQIPILLPVIG

SEQ ID NO: 1057842 - protein, 22 aa, Mycobacterium
VRDLPYAIAESFRYLAAGERTV

SEQ ID NO: 1057843 - protein, 19 aa, Mycobacterium
VRDPARMWVSGADRRIAPS

SEQ ID NO: 1057844 - protein, 18 aa, Mycobacterium
VRDPRWIALAGPAPRIQL

SEQ ID NO: 1057845 - protein, 23 aa, Mycobacterium
VRDRLNPRLDITGILLTRYDPRT

SEQ ID NO: 1057846 - protein, 18 aa, Mycobacterium
VRDVGWTMMDIGKRIERG

SEQ ID NO: 1057847 - protein, 24 aa, Mycobacterium
VREARLCRKYGAAVVVMAFDEKGQ

SEQ ID NO: 1057848 - protein, 17 aa, Mycobacterium
VREAVGVVGAITPWNFP

SEQ ID NO: 1057849 - protein, 25 aa, Mycobacterium
VREIKRIAKAVGIDEARLGLVLEVA

SEQ ID NO: 1057850 - protein, 26 aa, Mycobacterium
VRELLELTSRLHAHLLDRHRPLWETH

SEQ ID NO: 1057851 - protein, 22 aa, Mycobacterium
VRESLRRSLSFNGYTVELAHDG

SEQ ID NO: 1057852 - protein, 23 aa, Mycobacterium
VRFEYAGAIPAELRDRYHVARLD

SEQ ID NO: 1057853 - protein, 18 aa, Mycobacterium
VRFHDWRAPFGSYGHLPN

SEQ ID NO: 1057854 - protein, 24 aa, Mycobacterium
VRFPTWTGKSGFAMREFSRRHGDF

SEQ ID NO: 1057855 - protein, 24 aa, Mycobacterium
VRFTTRAEYAFRHPVVRTVAYEAQ

SEQ ID NO: 1057856 - protein, 18 aa, Mycobacterium
VRGAGVVDLLAALNTGHE

SEQ ID NO: 1057857 - protein, 21 aa, Mycobacterium
VRGCDAFVLQSCPAPVNTWLM

SEQ ID NO: 1057858 - protein, 24 aa, Mycobacterium
VRGEDRFDMSLSFHHALLDGWSVV

SEQ ID NO: 1057859 - protein, 18 aa, Mycobacterium
VRGGEGFFNRQEVKQAMV

SEQ ID NO: 1057860 - protein, 18 aa, Mycobacterium
VRGGLGGFAGLFALRNDY

SEQ ID NO: 1057861 - protein, 18 aa, Mycobacterium
VRGLVDIDLTDERSLGAA

SEQ ID NO: 1057862 - protein, 20 aa, Mycobacterium
VRGRLQRGETVLVHGAAGGI

SEQ ID NO: 1057863 - protein, 26 aa, Mycobacterium
VRGSPEMIDWLSNYGVPFDSTVYPYK

SEQ ID NO: 1057864 - protein, 17 aa, Mycobacterium
VRGTRLAILKGIDLPLP

SEQ ID NO: 1057865 - protein, 18 aa, Mycobacterium
VRHNMPFGEVGKGEYGTY

SEQ ID NO: 1057866 - protein, 17 aa, Mycobacterium
VRIANCSGFYGDRLSAM

SEQ ID NO: 1057867 - protein, 24 aa, Mycobacterium
VRIARADEALPFTAIAADASLVRA

SEQ ID NO: 1057868 - protein, 19 aa, Mycobacterium
VRIQVPATVARYVVEKGSI

SEQ ID NO: 1057869 - protein, 17 aa, Mycobacterium
VRITRRIDLGDTVLHRL

SEQ ID NO: 1057870 - protein, 24 aa, Mycobacterium
VRKAGCDLERGWALNEVSLEKGPR

SEQ ID NO: 1057871 - protein, 32 aa, Mycobacterium
VRKEFKGANPWIMISAFYLKIDGCVGQSFVRS

SEQ ID NO: 1057872 - protein, 24 aa, Mycobacterium
VRKLYKALMLRAAGAPGATLGQRF

SEQ ID NO: 1057873 - protein, 23 aa, Mycobacterium
VRKWMRRKHVLLEAPQLPGRGWV

SEQ ID NO: 1057874 - protein, 19 aa, Mycobacterium
VRLAGLVAHQEVLFGTQGE

SEQ ID NO: 1057875 - protein, 24 aa, Mycobacterium
VRLALQLRGAGLIDDGETLRRITP

SEQ ID NO: 1057876 - protein, 20 aa, Mycobacterium
VRLDGAVIFDGVKVEAGSVI

SEQ ID NO: 1057877 - protein, 18 aa, Mycobacterium
VRLFEIGASAGLNLRADR

SEQ ID NO: 1057878 - protein, 18 aa, Mycobacterium
VRLGEVIRAAGIGEVVES

SEQ ID NO: 1057879 - protein, 17 aa, Mycobacterium
VRLGLDLIIVVFNDNGL

SEQ ID NO: 1057880 - protein, 19 aa, Mycobacterium
VRLGVKVAGALEAAHRVGT

SEQ ID NO: 1057881 - protein, 20 aa, Mycobacterium
VRLHGGPVLAELSERFGAAA

SEQ ID NO: 1057882 - protein, 23 aa, Mycobacterium
VRLKGAEAMRQAWRNDGVYVLDP

SEQ ID NO: 1057883 - protein, 21 aa, Mycobacterium
VRLKGGDPFVFARGYEEVLAC

SEQ ID NO: 1057884 - protein, 23 aa, Mycobacterium
VRLLKAGELVGVYPEATISRSFE

SEQ ID NO: 1057885 - protein, 18 aa, Mycobacterium
VRLLNMVPYFQANPRITR

SEQ ID NO: 1057886 - protein, 27 aa, Mycobacterium
VRLSEWVVRCSIGFRIGQNVTPSDLET

SEQ ID NO: 1057887 - protein, 19 aa, Mycobacterium
VRLSTRLTESPACLITDTF

SEQ ID NO: 1057888 - protein, 17 aa, Mycobacterium
VRLWRNAWNEFIPFLDY

SEQ ID NO: 1057889 - protein, 19 aa, Mycobacterium
VRMLERFDVDWAEYGFADE

SEQ ID NO: 1057890 - protein, 17 aa, Mycobacterium
VRNRFTFDCAEWDVDTE

SEQ ID NO: 1057891 - protein, 18 aa, Mycobacterium
VRPEGWQAAAGDYGQPGT

SEQ ID NO: 1057892 - protein, 19 aa, Mycobacterium
VRPGCAVAVRLDAGHSRET

SEQ ID NO: 1057893 - protein, 22 aa, Mycobacterium
VRPGPPPTVWSERWRQRWSPPT

SEQ ID NO: 1057894 - protein, 21 aa, Mycobacterium
VRPLGLDRYGVRFRIESNDGD

SEQ ID NO: 1057895 - protein, 28 aa, Mycobacterium
VRPMRRSRRPPAEMAATGAMPRLPVVPA

SEQ ID NO: 1057896 - protein, 20 aa, Mycobacterium
VRPRGIIYHRALGARFADLL

SEQ ID NO: 1057897 - protein, 17 aa, Mycobacterium
VRPTVWGAVPRVWEKLK

SEQ ID NO: 1057898 - protein, 20 aa, Mycobacterium
VRQFVKMSVFLPDRLAFPIV

SEQ ID NO: 1057899 - protein, 22 aa, Mycobacterium
VRQIPYTVACDLLLTGRHITAA

SEQ ID NO: 1057900 - protein, 22 aa, Mycobacterium
VRQLAIRAFEAIDCQGLARVDF

SEQ ID NO: 1057901 - protein, 23 aa, Mycobacterium
VRQRLNWIAAHGLLRGTARLAAR

SEQ ID NO: 1057902 - protein, 33 aa, Mycobacterium; identical to SEQ ID NO: 749339

SEQ ID NO: 1057903 - protein, 22 aa, Mycobacterium
VRRGDSLVVPQIFFTNSGAVVK

SEQ ID NO: 1057904 - protein, 23 aa, Mycobacterium
VRRGDSLVVPQIFFTNSGAVVKS

SEQ ID NO: 1057905 - protein, 18 aa, Mycobacterium
VRRITERPGLTVGLEPLL

SEQ ID NO: 1057906 - protein, 40 aa, Mycobacterium; identical to SEQ ID NO: 749367

SEQ ID NO: 1057907 - protein, 17 aa, Mycobacterium
VRRLERLPNLAVDDLHL

SEQ ID NO: 1057908 - protein, 20 aa, Mycobacterium
VRRLETTGVILGYRAVLAAE

SEQ ID NO: 1057909 - protein, 20 aa, Mycobacterium
VRRNHCGELEFVGRADEQVK

SEQ ID NO: 1057910 - protein, 19 aa, Mycobacterium
VRRQFYWHRFFSHQPDLNY

SEQ ID NO: 1057911 - protein, 23 aa, Mycobacterium
VRRRTGRTVQEWIIERRMAQARE

SEQ ID NO: 1057912 - protein, 19 aa, Mycobacterium
VRSARRGLTPGPWRLIRVV

SEQ ID NO: 1057913 - protein, 22 aa, Mycobacterium
VRSDLLPELTIRAQSNRTATQL

SEQ ID NO: 1057914 - protein, 23 aa, Mycobacterium
VRSGAGTRFVAPVNVGDGAYTGA

SEQ ID NO: 1057915 - protein, 17 aa, Mycobacterium
VRSGVLADHVAAGPLRE

SEQ ID NO: 1057916 - protein, 17 aa, Mycobacterium
VRSGWDDLVLAGGVESM

SEQ ID NO: 1057917 - protein, 18 aa, Mycobacterium
VRSHRLRNNFSWTNSYYD

SEQ ID NO: 1057918 - protein, 26 aa, Mycobacterium
VRSLVWIRGRLRPVPADMIGAALDLI

SEQ ID NO: 1057919 - protein, 24 aa, Mycobacterium
VRSMRYTLERLIRGLDTIAATGNI

SEQ ID NO: 1057920 - protein, 25 aa, Mycobacterium
VRSRLPFGTCLDTAYLHPCGSDEFK

SEQ ID NO: 1057921 - protein, 24 aa, Mycobacterium
VRSRRPGETASIFLPSVPNLLQLA

SEQ ID NO: 1057922 - protein, 19 aa, Mycobacterium
VRSRRSWGIGDLTDLTDLA

SEQ ID NO: 1057923 - protein, 23 aa, Mycobacterium
VRSYKLRGAYNLLVQLTAEELAA

SEQ ID NO: 1057924 - protein, 17 aa, Mycobacterium
VRTAMGGAQARRLCPQA

SEQ ID NO: 1057925 - protein, 33 aa, Mycobacterium; identical to SEQ ID NO: 749481

SEQ ID NO: 1057926 - protein, 20 aa, Mycobacterium
VRTELPFQTIMTGYGLTEAG

SEQ ID NO: 1057927 - protein, 24 aa, Mycobacterium
VRTFARRRIDAILAGVPAAASPDD

SEQ ID NO: 1057928 - protein, 17 aa, Mycobacterium
VRTGASFEVISPHDPAG

SEQ ID NO: 1057929 - protein, 20 aa, Mycobacterium
VRTSGYLAGPHDVYVSMNMV

SEQ ID NO: 1057930 - protein, 20 aa, Mycobacterium
VRTSGYLAGPHDVYVSMSMV

SEQ ID NO: 1057931 - protein, 26 aa, Mycobacterium
VRVAPMRPFRALGMGKRIASDFSSRA

SEQ ID NO: 1057932 - protein, 17 aa, Mycobacterium
VRVDWASIIGAGRRVAL

SEQ ID NO: 1057933 - protein, 22 aa, Mycobacterium
VRVIPCLDIDAGRVVKGVNFEN

SEQ ID NO: 1057934 - protein, 18 aa, Mycobacterium
VRVLLNTRVTEIDRAAKS

SEQ ID NO: 1057935 - protein, 18 aa, Mycobacterium
VRVLLRAGLRDGVTAARA

SEQ ID NO: 1057936 - protein, 18 aa, Mycobacterium
VRVPSLIAAMLNRNPKPS

SEQ ID NO: 1057937 - protein, 17 aa, Mycobacterium
VRVPVHFSIAQHEKVWQ

SEQ ID NO: 1057938 - protein, 28 aa, Mycobacterium
VRVRRVPEFGGCTSWVRLPIAPSNAAPV

SEQ ID NO: 1057939 - protein, 18 aa, Mycobacterium
VRWIETQDLLFIEEAAGG

SEQ ID NO: 1057940 - protein, 24 aa, Mycobacterium
VRWNCKAGKCGSCSAEINGKPRLM

SEQ ID NO: 1057941 - protein, 19 aa, Mycobacterium
VRYPSLEAFIAVMSSEQVQ

SEQ ID NO: 1057942 - protein, 18 aa, Mycobacterium
VSAAAADVANIGRALSAA

SEQ ID NO: 1057943 - protein, 19 aa, Mycobacterium
VSAAIAALFGAHAQAYQAL

SEQ ID NO: 1057944 - protein, 21 aa, Mycobacterium
VSAAIAHLFGAYGQEFQALNG

SEQ ID NO: 1057945 - protein, 22 aa, Mycobacterium
VSAAIASLFGTHALAYQAIGAQ

SEQ ID NO: 1057946 - protein, 20 aa, Mycobacterium
VSAAITALFGAHAQTYQALS

SEQ ID NO: 1057947 - protein, 22 aa, Mycobacterium
VSAALAAVFSGHALDYQALSAQ

SEQ ID NO: 1057948 - protein, 26 aa, Mycobacterium
VSAAVAALFPGHALDYQALSTQVAAF

SEQ ID NO: 1057949 - protein, 19 aa, Mycobacterium
VSADARMTPGSVVTEQVAG

SEQ ID NO: 1057950 - protein, 28 aa, Mycobacterium
VSAEAATLYDMFVRTLGVSAGTYAAAET

SEQ ID NO: 1057951 - protein, 21 aa, Mycobacterium
VSAEEAFRVLQWRSQETNTKL

SEQ ID NO: 1057952 - protein, 26 aa, Mycobacterium
VSAFGNTAVGTAFEVGVSSGFFNTGY

SEQ ID NO: 1057953 - protein, 26 aa, Mycobacterium
VSALKALEGDPKWVESVEQLMDAVDE

SEQ ID NO: 1057954 - protein, 17 aa, Mycobacterium
VSALLVRVGDHGVAPDQ

SEQ ID NO: 1057955 - protein, 19 aa, Mycobacterium
VSALNRPVSTTGESGNQNT

SEQ ID NO: 1057956 - protein, 21 aa, Mycobacterium
VSALQASLFTAYGTLDQQVSA

SEQ ID NO: 1057957 - protein, 30 aa, Mycobacterium; identical to SEQ ID NO: 749681

SEQ ID NO: 1057958 - protein, 25 aa, Mycobacterium
VSARPSDSVAIALRVGVPIYVEEAV

SEQ ID NO: 1057959 - protein, 17 aa, Mycobacterium
VSARTPAGLAAQAERLH

SEQ ID NO: 1057960 - protein, 26 aa, Mycobacterium
VSAVIAELFGTHALEYQAISTQLSVF

SEQ ID NO: 1057961 - protein, 23 aa, Mycobacterium
VSCPPRDVAALAAAVCGVLDDPA

SEQ ID NO: 1057962 - protein, 23 aa, Mycobacterium
VSDDIRRMLGYSIHPPFVGAVDG

SEQ ID NO: 1057963 - protein, 21 aa, Mycobacterium
VSDEYWFSWKYFHPDTRVIDV

SEQ ID NO: 1057964 - protein, 18 aa, Mycobacterium
VSDFLGVVYGRWTSSVLG

SEQ ID NO: 1057965 - protein, 22 aa, Mycobacterium
VSDHQLLSWARDDLATVFGVTV

SEQ ID NO: 1057966 - protein, 23 aa, Mycobacterium
VSDKGGVFEVTWNVGDLRPREQS

SEQ ID NO: 1057967 - protein, 18 aa, Mycobacterium
VSDLEGWGQVCDSGGFLD

SEQ ID NO: 1057968 - protein, 20 aa, Mycobacterium
VSDLEGYLPLGVERVLLGLP

SEQ ID NO: 1057969 - protein, 18 aa, Mycobacterium
VSDLFDFSLYVDARIEDI

SEQ ID NO: 1057970 - protein, 40 aa, Mycobacterium
VSDPIDPARLAAGDIGMFRDWHALALGDGNAFLDGQIQQV

SEQ ID NO: 1057971 - protein, 19 aa, Mycobacterium
VSEAIATLFDNYAQGYQAV

SEQ ID NO: 1057972 - protein, 18 aa, Mycobacterium
VSEDRVTVLSARSQDVIG

SEQ ID NO: 1057973 - protein, 18 aa, Mycobacterium
VSEFGYVVARAVVSARET

SEQ ID NO: 1057974 - protein, 22 aa, Mycobacterium
VSEIDCPVERVWQTVTTQEGIN

SEQ ID NO: 1057975 - protein, 22 aa, Mycobacterium
VSEWPGIDWPATQSMAEQVLAE

SEQ ID NO: 1057976 - protein, 21 aa, Mycobacterium
VSGAIAKLFGMFGQEYESIVA

SEQ ID NO: 1057977 - protein, 18 aa, Mycobacterium
VSGALSAARRGRAQPGRD

SEQ ID NO: 1057978 - protein, 23 aa, Mycobacterium
VSGARIQLFAALVHDGNRSYWDE

SEQ ID NO: 1057979 - protein, 17 aa, Mycobacterium
VSGAVGLIVAQHAGGFD

SEQ ID NO: 1057980 - protein, 22 aa, Mycobacterium
VSGDTLWAIAERFYGDGSKYQV

SEQ ID NO: 1057981 - protein, 17 aa, Mycobacterium
VSGELAFNQALVANEAA

SEQ ID NO: 1057982 - protein, 25 aa, Mycobacterium
VSGGRFCFGVGVGWLREEVANHGVD

SEQ ID NO: 1057983 - protein, 18 aa, Mycobacterium
VSGLMCRTILQALASHAP

SEQ ID NO: 1057984 - protein, 19 aa, Mycobacterium
VSGQLSPIVGALTEPRQAL

SEQ ID NO: 1057985 - protein, 24 aa, Mycobacterium
VSGRPEAVATLAPVPAGPTSTAVE

SEQ ID NO: 1057986 - protein, 24 aa, Mycobacterium
VSGVPRPRPDHVQALADFALDMVD

SEQ ID NO: 1057987 - protein, 17 aa, Mycobacterium
VSGVVVFPGTGFVELAI

SEQ ID NO: 1057988 - protein, 21 aa, Mycobacterium
VSHVYPTGASLYFTVVAGQRG

SEQ ID NO: 1057989 - protein, 25 aa, Mycobacterium
VSIFSATCYEWAILDLAILAVGAVT

SEQ ID NO: 1057990 - protein, 17 aa, Mycobacterium
VSINYSKSPRCKFPAHV

SEQ ID NO: 1057991 - protein, 17 aa, Mycobacterium
VSIPADISGAANIGTNI

SEQ ID NO: 1057992 - protein, 18 aa, Mycobacterium
VSIRCAQLSADRRTALAH

SEQ ID NO: 1057993 - protein, 22 aa, Mycobacterium
VSKLLWANWHRSLGELAMDVIG

SEQ ID NO: 1057994 - protein, 17 aa, Mycobacterium
VSLACALVCHPTLLVPD

SEQ ID NO: 1057995 - protein, 20 aa, Mycobacterium
VSLAELWKSVGVRPDAVIGH

SEQ ID NO: 1057996 - protein, 17 aa, Mycobacterium
VSLAYTVDSRWRNRDEY

SEQ ID NO: 1057997 - protein, 21 aa, Mycobacterium
VSLEAAIGFSAHGVEHVAVTT

SEQ ID NO: 1057998 - protein, 19 aa, Mycobacterium
VSLGKRKGKIVVEFGSVDD

SEQ ID NO: 1057999 - protein, 21 aa, Mycobacterium
VSLGLRPPPPQRFPLSEAQAA

SEQ ID NO: 1058000 - protein, 25 aa, Mycobacterium
VSLGSNLPAPMRWLERRTRDDTPHL

SEQ ID NO: 1058001 - protein, 22 aa, Mycobacterium
VSLPVDGRWVIVVTGGAGAISL

SEQ ID NO: 1058002 - protein, 27 aa, Mycobacterium
VSLQAAAFHERFLQTLFGGAAAYTAAE

SEQ ID NO: 1058003 - protein, 27 aa, Mycobacterium
VSMAGLQARLGLDCGKWTHEQMAQVAL

SEQ ID NO: 1058004 - protein, 23 aa, Mycobacterium
VSMSVDCARYWLDSDRPISKSDA

SEQ ID NO: 1058005 - protein, 19 aa, Mycobacterium
VSMVADLFHAEGLRDDDPS

SEQ ID NO: 1058006 - protein, 33 aa, Mycobacterium; identical to SEQ ID NO: 937704

SEQ ID NO: 1058007 - protein, 22 aa, Mycobacterium
VSNTFYEWVLGPSMTYTCAVYP

SEQ ID NO: 1058008 - protein, 29 aa, Mycobacterium
VSNYSLARWKKADAALGRPVVSNQVHFSL

SEQ ID NO: 1058009 - protein, 24 aa, Mycobacterium
VSPEELPAAWAYKRFRDLEEKESY

SEQ ID NO: 1058010 - protein, 24 aa, Mycobacterium
VSPEKRTRLGVGHFVETLETYRRQ

SEQ ID NO: 1058011 - protein, 18 aa, Mycobacterium
VSQGVAIFDAMRGSVADD

SEQ ID NO: 1058012 - protein, 27 aa, Mycobacterium
VSQWISGEFSKLVQFILNLVNAPSELL

SEQ ID NO: 1058013 - protein, 18 aa, Mycobacterium
VSRACYRGAPWLESLAYK

SEQ ID NO: 1058014 - protein, 24 aa, Mycobacterium
VSRERLQLAIAWANILLQRKVPAD

SEQ ID NO: 1058015 - protein, 22 aa, Mycobacterium
VSREVLRAGPSISEVRAAAERM

SEQ ID NO: 1058016 - protein, 18 aa, Mycobacterium
VSRILIDPSALWGPPLTT

SEQ ID NO: 1058017 - protein, 18 aa, Mycobacterium
VSRLPAPLRRGEVRPLGL

SEQ ID NO: 1058018 - protein, 18 aa, Mycobacterium
VSRRERRGASREADVTAG

SEQ ID NO: 1058019 - protein, 25 aa, Mycobacterium
VSRRITAKALWAFDLQGNRRIPRWQ

SEQ ID NO: 1058020 - protein, 18 aa, Mycobacterium
VSRRSDVFSSYENGVIPR

SEQ ID NO: 1058021 - protein, 17 aa, Mycobacterium
VSRSGWYGIDPVDADLF

SEQ ID NO: 1058022 - protein, 25 aa, Mycobacterium
VSRYTRSRFAPAFGPAASLEYLPPG

SEQ ID NO: 1058023 - protein, 23 aa, Mycobacterium
VSSCSPRTALWRLHREQGGIGQP

SEQ ID NO: 1058024 - protein, 20 aa, Mycobacterium
VSSESAWHVSARQTRGNLPA

SEQ ID NO: 1058025 - protein, 23 aa, Mycobacterium
VSSGEPLLGVWQSVVLVDLNQDN

SEQ ID NO: 1058026 - protein, 25 aa, Mycobacterium
VSSGLLRYAHCPVAIVHDEDASAPD

SEQ ID NO: 1058027 - protein, 24 aa, Mycobacterium
VSSIGGPNFLGWQHPPTSTTVTEP

SEQ ID NO: 1058028 - protein, 23 aa, Mycobacterium
VSSSILNELGWRGLVAQSTDLDA

SEQ ID NO: 1058029 - protein, 19 aa, Mycobacterium
VSTAIAALFDAHGQAYQRL

SEQ ID NO: 1058030 - protein, 35 aa, Mycobacterium
VSTAQFPRPVVRPGYSALGGRQWAAAGLTPLRPWR

SEQ ID NO: 1058031 - protein, 20 aa, Mycobacterium
VSTLKFKSALVRAIQVCAAL

SEQ ID NO: 1058032 - protein, 24 aa, Mycobacterium
VSVGPAAGMSGVFVNVNRGKRSAV

SEQ ID NO: 1058033 - protein, 18 aa, Mycobacterium
VSVRAGVEVTAFETTEAL

SEQ ID NO: 1058034 - protein, 19 aa, Mycobacterium
VSWPARITDRGGLRSQFHH

SEQ ID NO: 1058035 - protein, 20 aa, Mycobacterium
VSYDALWNGRRFVVQDTGGW

SEQ ID NO: 1058036 - protein, 23 aa, Mycobacterium
VSYWASLFPAVWSFCLALRSRGL

SEQ ID NO: 1058037 - protein, 24 aa, Mycobacterium
VSYWASLFPAVWSFCLALRSRGLG

SEQ ID NO: 1058038 - protein, 17 aa, Mycobacterium
VTADVFDADGFYRTGDI

SEQ ID NO: 1058039 - protein, 24 aa, Mycobacterium
VTALCPGPVPTEWAEIASAERFSI

SEQ ID NO: 1058040 - protein, 18 aa, Mycobacterium
VTAPMLLEVYLERIERLD

SEQ ID NO: 1058041 - protein, 18 aa, Mycobacterium
VTAREAAAFIEVGSTLSG

SEQ ID NO: 1058042 - protein, 17 aa, Mycobacterium
VTCHKILNDHGLAVPNW

SEQ ID NO: 1058043 - protein, 25 aa, Mycobacterium
VTDARRREVYWARYRDGVRTHGPAV

SEQ ID NO: 1058044 - protein, 26 aa, Mycobacterium
VTDDFPLAMAWAHLRILRLADGPDEV

SEQ ID NO: 1058045 - protein, 26 aa, Mycobacterium
VTDIPRMIFALARGEGRLAAAGIAET

SEQ ID NO: 1058046 - protein, 18 aa, Mycobacterium
VTDISRWREVGDVHAQVF

SEQ ID NO: 1058047 - protein, 23 aa, Mycobacterium
VTDMAHFFYIHFGLPTYFKNVFE

SEQ ID NO: 1058048 - protein, 18 aa, Mycobacterium
VTDRACVEECPVDCIYEG

SEQ ID NO: 1058049 - protein, 25 aa, Mycobacterium
VTDVAHGWIPPGIALPQGVRLLPPK

SEQ ID NO: 1058050 - protein, 17 aa, Mycobacterium
VTEHLRAKVAAFQSTAT

SEQ ID NO: 1058051 - protein, 20 aa, Mycobacterium
VTELKYYAATQVQLGEIPVL

SEQ ID NO: 1058052 - protein, 17 aa, Mycobacterium
VTELVGYGARFDESIPG

SEQ ID NO: 1058053 - protein, 17 aa, Mycobacterium
VTFDIDLVFSWVDGSDP

SEQ ID NO: 1058054 - protein, 24 aa, Mycobacterium
VTFFDGRTASFTVVGADPTSDIAV

SEQ ID NO: 1058055 - protein, 28 aa, Mycobacterium
VTGAAKWSLKIAREWSGERVQWGKPLGK

SEQ ID NO: 1058056 - protein, 26 aa, Mycobacterium
VTGAGRWGKYLGVQAGPLWLIAHLSR

SEQ ID NO: 1058057 - protein, 18 aa, Mycobacterium
VTGGLTFAGGPWDNYVTH

SEQ ID NO: 1058058 - protein, 21 aa, Mycobacterium
VTGPGGERWEVYTVLADSETF

SEQ ID NO: 1058059 - protein, 19 aa, Mycobacterium
VTGVPILFASTGEKLEDFD

SEQ ID NO: 1058060 - protein, 28 aa, Mycobacterium
VTGYDILFFWVARMMMFGTFVGGDEVIT

SEQ ID NO: 1058061 - protein, 25 aa, Mycobacterium
VTILEEARVPFLREPFGADITTIGL

SEQ ID NO: 1058062 - protein, 19 aa, Mycobacterium
VTKHARLLIGAVVLPLHDP

SEQ ID NO: 1058063 - protein, 20 aa, Mycobacterium
VTKRAGFSAVRYGFVPRRFR

SEQ ID NO: 1058064 - protein, 23 aa, Mycobacterium
VTKRTGIELTESMAMWPGAAVSG

SEQ ID NO: 1058065 - protein, 22 aa, Mycobacterium
VTKSGLSIREWLTALREAGLGT

SEQ ID NO: 1058066 - protein, 26 aa, Mycobacterium
VTLGPRGRHVVLAKSFGGPTVTNDGV

SEQ ID NO: 1058067 - protein, 24 aa, Mycobacterium
VTLHEVPVLSGLGMTMTGARPGGF

SEQ ID NO: 1058068 - protein, 25 aa, Mycobacterium
VTLHEVPVLSGLGMTMTGARPGGFG

SEQ ID NO: 1058069 - protein, 18 aa, Mycobacterium
VTLLPLYFELDGTFPNHE

SEQ ID NO: 1058070 - protein, 23 aa, Mycobacterium
VTLPGAAVWHMAWSDKDDAIDWQ

SEQ ID NO: 1058071 - protein, 18 aa, Mycobacterium
VTLPNYGGSTLWANTATA

SEQ ID NO: 1058072 - protein, 20 aa, Mycobacterium
VTLRVPLRRVHLSTGADFDL

SEQ ID NO: 1058073 - protein, 25 aa, Mycobacterium
VTLVRAVCAGRRLVELDGPEVGALA

SEQ ID NO: 1058074 - protein, 18 aa, Mycobacterium
VTMTGHFTRSHVGGNSAV

SEQ ID NO: 1058075 - protein, 18 aa, Mycobacterium
VTNAVRFAFWGDGINGAM

SEQ ID NO: 1058076 - protein, 25 aa, Mycobacterium
VTNCGNSWPMARLTLALSPATLPKM

SEQ ID NO: 1058077 - protein, 23 aa, Mycobacterium
VTPAVGALLSMLAKLSGGKAVAE

SEQ ID NO: 1058078 - protein, 26 aa, Mycobacterium
VTPELVRRLCWDWAPVAAAEITSTID

SEQ ID NO: 1058079 - protein, 29 aa, Mycobacterium
VTPEVLRRNLIESPAWYTAYTPYQPEISQ

SEQ ID NO: 1058080 - protein, 22 aa, Mycobacterium
VTPIKMLLRLALDVGSEVLYRL

SEQ ID NO: 1058081 - protein, 26 aa, Mycobacterium
VTPPPLPTVWPGSAYPLGATYDGAGT

SEQ ID NO: 1058082 - protein, 19 aa, Mycobacterium
VTQIARWAGCIGNRSTVIP

SEQ ID NO: 1058083 - protein, 19 aa, Mycobacterium
VTQYELWKAIWSGLNDGNF

SEQ ID NO: 1058084 - protein, 27 aa, Mycobacterium
VTRGAARPAVAPGPTRTVAAVVTRGRQ

SEQ ID NO: 1058085 - protein, 21 aa, Mycobacterium
VTRGRCVTIAVPDDGGVEKLV

SEQ ID NO: 1058086 - protein, 21 aa, Mycobacterium
VTRLQERWNQIEAKAVEIKQK

SEQ ID NO: 1058087 - protein, 26 aa, Mycobacterium
VTSCLRCADLHRSDRDPAWPAIAAQL

SEQ ID NO: 1058088 - protein, 32 aa, Mycobacterium; identical to SEQ ID NO: 750652

SEQ ID NO: 1058089 - protein, 26 aa, Mycobacterium
VTSGSVCARRCTVGGVGAIAAVAAEA

SEQ ID NO: 1058090 - protein, 24 aa, Mycobacterium
VTSKIELFTGIALLIQRDPITTAK

SEQ ID NO: 1058091 - protein, 18 aa, Mycobacterium
VTSLLRFAGGLHIVAGRV

SEQ ID NO: 1058092 - protein, 18 aa, Mycobacterium
VTSMIPASTLQQLAGVSV

SEQ ID NO: 1058093 - protein, 23 aa, Mycobacterium
VTSPRGKRQFRRAILDIGTGQVT

SEQ ID NO: 1058094 - protein, 19 aa, Mycobacterium
VTSQWRWDTLAARLAELLR

SEQ ID NO: 1058095 - protein, 32 aa, Mycobacterium
VTSWSRTGLPLSRLRLADELVEIDSAALRFDS

SEQ ID NO: 1058096 - protein, 19 aa, Mycobacterium
VTTAEIFDTTGFVGTSAQT

SEQ ID NO: 1058097 - protein, 24 aa, Mycobacterium
VTTLPAYNLKLFLDGILQVLDGDP

SEQ ID NO: 1058098 - protein, 17 aa, Mycobacterium
VTVFSTFCESHATDIPF

SEQ ID NO: 1058099 - protein, 25 aa, Mycobacterium
VTVIDPRWVLPVADGIGDLAVAHKL

SEQ ID NO: 1058100 - protein, 18 aa, Mycobacterium
VTVPELGTFVAPLPPIAV

SEQ ID NO: 1058101 - protein, 19 aa, Mycobacterium
VTVSSMAHWTGRINLADLN

SEQ ID NO: 1058102 - protein, 24 aa, Mycobacterium
VTVVDPRWVLPVPDAVLELAVAHK

SEQ ID NO: 1058103 - protein, 17 aa, Mycobacterium
VTVWPRELDIDAMTVAS

SEQ ID NO: 1058104 - protein, 19 aa, Mycobacterium
VVAAARWARSELDYLPGTT

SEQ ID NO: 1058105 - protein, 18 aa, Mycobacterium
VVAGRPAQFGFFATVPMP

SEQ ID NO: 1058106 - protein, 23 aa, Mycobacterium
VVAIARPLLAPAIESATAVQDWL

SEQ ID NO: 1058107 - protein, 19 aa, Mycobacterium
VVANGTFTQTLFGDGGNGG

SEQ ID NO: 1058108 - protein, 18 aa, Mycobacterium
VVARGELVYAVLNLYPYN

SEQ ID NO: 1058109 - protein, 31 aa, Mycobacterium
VVAYSYGLACIRNWLYWQYVVGLFGSAMSDT

SEQ ID NO: 1058110 - protein, 19 aa, Mycobacterium
VVCFPERWLDLRYVGPGTG

SEQ ID NO: 1058111 - protein, 20 aa, Mycobacterium
VVCGVQGWAAGLGANLALAA

SEQ ID NO: 1058112 - protein, 19 aa, Mycobacterium
VVCHLARDAGAPSIVGQAS

SEQ ID NO: 1058113 - protein, 21 aa, Mycobacterium
VVDARAWLRDPAPLFHTNVEG

SEQ ID NO: 1058114 - protein, 18 aa, Mycobacterium
VVDDEFPGRLLLAEANQW

SEQ ID NO: 1058115 - protein, 18 aa, Mycobacterium
VVDGCAPFVLFSVPDADE

SEQ ID NO: 1058116 - protein, 32 aa, Mycobacterium
VVDKRGHLHCPFNRMCEVVRRNDRRSAINAMD

SEQ ID NO: 1058117 - protein, 18 aa, Mycobacterium
VVDPCGWFGPRRRRWTLR

SEQ ID NO: 1058118 - protein, 17 aa, Mycobacterium
VVDRIDGAGARRVQPTG

SEQ ID NO: 1058119 - protein, 28 aa, Mycobacterium
VVEADWPLLAAAYRTRWSLHIVDDLLRD

SEQ ID NO: 1058120 - protein, 26 aa, Mycobacterium
VVELLRFCLEQGYQLRVIEQMPLDAG

SEQ ID NO: 1058121 - protein, 23 aa, Mycobacterium
VVELRLHLAALLADRGRHAEALG

SEQ ID NO: 1058122 - protein, 17 aa, Mycobacterium
VVFHLAITPDRGYCMSI

SEQ ID NO: 1058123 - protein, 24 aa, Mycobacterium
VVGELGFFFKEPWGSSTHSLAAQY

SEQ ID NO: 1058124 - protein, 27 aa, Mycobacterium
VVGESMVEAAICDGDWVVVRQQNVADN

SEQ ID NO: 1058125 - protein, 29 aa, Mycobacterium
VVGEWQLLADLSFADYLMWVARDDGALVC

SEQ ID NO: 1058126 - protein, 25 aa, Mycobacterium
VVGGARIALSRGLRPDRFLNEVRRY

SEQ ID NO: 1058127 - protein, 24 aa, Mycobacterium
VVGHRRSLLPAGITAVAGKFFGGD

SEQ ID NO: 1058128 - protein, 24 aa, Mycobacterium
VVGILDALGIKWAVVVGDREGAEL

SEQ ID NO: 1058129 - protein, 30 aa, Mycobacterium; identical to SEQ ID NO: 751062

SEQ ID NO: 1058130 - protein, 18 aa, Mycobacterium
VVHGCEAFLPAMIESGRG

SEQ ID NO: 1058131 - protein, 25 aa, Mycobacterium
VVHYAKAFGAKGIRIHSMDQFAEVF

SEQ ID NO: 1058132 - protein, 19 aa, Mycobacterium
VVIGEPFLAAAETLRAAGY

SEQ ID NO: 1058133 - protein, 19 aa, Mycobacterium
VVIGGGVAKAGRLLFDPLR

SEQ ID NO: 1058134 - protein, 24 aa, Mycobacterium
VVIGIADARWGRRVHAVVQVAAPL

SEQ ID NO: 1058135 - protein, 17 aa, Mycobacterium
VVINPVLETSEIPENMP

SEQ ID NO: 1058136 - protein, 17 aa, Mycobacterium
VVIPDPCHQCMGDGRVR

SEQ ID NO: 1058137 - protein, 17 aa, Mycobacterium
VVITAKVQATARMPRIE

SEQ ID NO: 1058138 - protein, 18 aa, Mycobacterium
VVIYLEYLGITLGELLDA

SEQ ID NO: 1058139 - protein, 24 aa, Mycobacterium
VVKHLANSVVVMFAGSIVEQGNSQ

SEQ ID NO: 1058140 - protein, 18 aa, Mycobacterium
VVKRGYRLALDTQDDTAC

SEQ ID NO: 1058141 - protein, 18 aa, Mycobacterium
VVKVVGFVASAPGFHGQP

SEQ ID NO: 1058142 - protein, 25 aa, Mycobacterium
VVLAGFPATVASFWQQAGRSGRRGQ

SEQ ID NO: 1058143 - protein, 24 aa, Mycobacterium
VVLKPAPDTPWCAAVLGELIADCT

SEQ ID NO: 1058144 - protein, 17 aa, Mycobacterium
VVLPDAPVKIFLTASPE

SEQ ID NO: 1058145 - protein, 18 aa, Mycobacterium
VVLSTVWDAWSARLAANA

SEQ ID NO: 1058146 - protein, 17 aa, Mycobacterium
VVMCCVLCPITGAQCWA

SEQ ID NO: 1058147 - protein, 19 aa, Mycobacterium
VVMVARPRLPAGVSSVGTV

SEQ ID NO: 1058148 - protein, 25 aa, Mycobacterium
VVNLLPGQFVQLFIGAALSDLGLDP

SEQ ID NO: 1058149 - protein, 24 aa, Mycobacterium
VVNWAIDWAVSWINWGIQLVNSVI

SEQ ID NO: 1058150 - protein, 25 aa, Mycobacterium
VVPEAKRFCWNCGRPVGRSDSETKG

SEQ ID NO: 1058151 - protein, 22 aa, Mycobacterium
VVPELPKTRSGKIMRRLLRDIA

SEQ ID NO: 1058152 - protein, 20 aa, Mycobacterium
VVPFRPHRGIVLIVEEPTGT

SEQ ID NO: 1058153 - protein, 19 aa, Mycobacterium
VVPGECYQAAVSVGTNPTF

SEQ ID NO: 1058154 - protein, 21 aa, Mycobacterium
VVPGECYQAAVSVGTNPTFSG

SEQ ID NO: 1058155 - protein, 17 aa, Mycobacterium
VVPHLFHRLTVQSAIGR

SEQ ID NO: 1058156 - protein, 18 aa, Mycobacterium
VVPIEGGHWVVTSRPDVV

SEQ ID NO: 1058157 - protein, 19 aa, Mycobacterium
VVPLFEWYRQLLPDRLHQI

SEQ ID NO: 1058158 - protein, 19 aa, Mycobacterium
VVPLGWPIGKYGPTTRRPV

SEQ ID NO: 1058159 - protein, 17 aa, Mycobacterium
VVPPGVVQLRLVSTASH

SEQ ID NO: 1058160 - protein, 24 aa, Mycobacterium
VVPVPPAYMGFHLSNLWGESLDYA

SEQ ID NO: 1058161 - protein, 25 aa, Mycobacterium
VVQGIWRLGAAMTMLQQPTSQADLA

SEQ ID NO: 1058162 - protein, 19 aa, Mycobacterium
VVQPRSGFDTHPHRDMEIV

SEQ ID NO: 1058163 - protein, 24 aa, Mycobacterium
VVQRMRLQPGRMFLVDTAQGRIVS

SEQ ID NO: 1058164 - protein, 24 aa, Mycobacterium
VVRALGLEAFHIFGNSWGGMLAQQ

SEQ ID NO: 1058165 - protein, 22 aa, Mycobacterium
VVRELFSGIASEIIKVEPQEAE

SEQ ID NO: 1058166 - protein, 25 aa, Mycobacterium
VVRHLVELSGAPVLRIVASGGGTCV

SEQ ID NO: 1058167 - protein, 19 aa, Mycobacterium
VVRKYPVVPGIDLTGEVVE

SEQ ID NO: 1058168 - protein, 25 aa, Mycobacterium
VVRQARFSAAFTFQYSKRPGTPAAE

SEQ ID NO: 1058169 - protein, 21 aa, Mycobacterium
VVRRLKAAGAVIIGKTNTCEL

SEQ ID NO: 1058170 - protein, 18 aa, Mycobacterium
VVSAGFMRILGPQFLSKF

SEQ ID NO: 1058171 - protein, 19 aa, Mycobacterium
VVSAVPLLNMIAMDETAAC

SEQ ID NO: 1058172 - protein, 18 aa, Mycobacterium
VVSDFAYPLPVAVICRLL

SEQ ID NO: 1058173 - protein, 19 aa, Mycobacterium
VVSGGFRRIIEPLAQELNL

SEQ ID NO: 1058174 - protein, 22 aa, Mycobacterium
VVSLSSLAARRGRIHFDDLQFE

SEQ ID NO: 1058175 - protein, 23 aa, Mycobacterium
VVSLSWRTGDDIVVTRNDVGHPV

SEQ ID NO: 1058176 - protein, 25 aa, Mycobacterium
VVSLVGGRAKYMWVSTFHSTCVRIL

SEQ ID NO: 1058177 - protein, 19 aa, Mycobacterium
VVSMLPAKYLNRLSDLLFI

SEQ ID NO: 1058178 - protein, 17 aa, Mycobacterium
VVSMLVAFSTGCDAAVG

SEQ ID NO: 1058179 - protein, 24 aa, Mycobacterium
VVSRKCGVPYLYRFELMGTADDVA

SEQ ID NO: 1058180 - protein, 18 aa, Mycobacterium
VVSRKLDKMGWRSSDTAE

SEQ ID NO: 1058181 - protein, 19 aa, Mycobacterium
VVSRLRRAGAVLLGKLHMC

SEQ ID NO: 1058182 - protein, 18 aa, Mycobacterium
VVTDHVWHRGQQVGLVDV

SEQ ID NO: 1058183 - protein, 21 aa, Mycobacterium
VVTDLRWKVTDRTESNRVTLG

SEQ ID NO: 1058184 - protein, 17 aa, Mycobacterium
VVTLRSKLLVGLAGPGG

SEQ ID NO: 1058185 - protein, 24 aa, Mycobacterium
VVTNGFAGSGGFGGAGGDAQFLGF

SEQ ID NO: 1058186 - protein, 18 aa, Mycobacterium
VVVAAGRPCQSCPNCRRG

SEQ ID NO: 1058187 - protein, 24 aa, Mycobacterium
VVVFIWEVLGRIGIGRKDALVSLG

SEQ ID NO: 1058188 - protein, 22 aa, Mycobacterium
VVVGCGPGPFTGLRAGMATGAA

SEQ ID NO: 1058189 - protein, 18 aa, Mycobacterium
VVVHLAFIKLGSRAESAQ

SEQ ID NO: 1058190 - protein, 22 aa, Mycobacterium
VVVLALRPSHAGPRSFATVLTA

SEQ ID NO: 1058191 - protein, 18 aa, Mycobacterium
VVVLGHCHERISPLVDEL

SEQ ID NO: 1058192 - protein, 19 aa, Mycobacterium
VVVLPCGAGKTLVGAAAMA

SEQ ID NO: 1058193 - protein, 17 aa, Mycobacterium
VVVLRLSGPLAGHAESV

SEQ ID NO: 1058194 - protein, 17 aa, Mycobacterium
VVVRSAWVYTGGTGSDF

SEQ ID NO: 1058195 - protein, 20 aa, Mycobacterium
VVVSARGAWLTLIHDGQPIE

SEQ ID NO: 1058196 - protein, 19 aa, Mycobacterium
VVVVACLRGVIAPWPRIST

SEQ ID NO: 1058197 - protein, 20 aa, Mycobacterium
VVVVGHSFGGAVALQLAAAH

SEQ ID NO: 1058198 - protein, 18 aa, Mycobacterium
VVVYCHAGGFALGNLDTD

SEQ ID NO: 1058199 - protein, 22 aa, Mycobacterium
VVYPHARPVPLPTYPFQHHRYW

SEQ ID NO: 1058200 - protein, 22 aa, Mycobacterium
VVYYHGGGWALGSLDTHDHVAR

SEQ ID NO: 1058201 - protein, 24 aa, Mycobacterium
VWAPLCAPCDVFAPTYEGSSDKHP

SEQ ID NO: 1058202 - protein, 17 aa, Mycobacterium
VWELFWPDFPADGLYKF

SEQ ID NO: 1058203 - protein, 24 aa, Mycobacterium
VWEPKTEKVRQLFADAGIRIPNQD

SEQ ID NO: 1058204 - protein, 21 aa, Mycobacterium
VWETWNALLHGGRLVVVGEDV

SEQ ID NO: 1058205 - protein, 19 aa, Mycobacterium
VWFDRAMVWAYAFNHEESI

SEQ ID NO: 1058206 - protein, 28 aa, Mycobacterium
VWGHRISQWLWRRNARLVARALGEINRI

SEQ ID NO: 1058207 - protein, 17 aa, Mycobacterium
VWHLCTPVIGKLRDTAT

SEQ ID NO: 1058208 - protein, 25 aa, Mycobacterium
VWLEAGKQGFLGMAVPEEYGGGGNP

SEQ ID NO: 1058209 - protein, 19 aa, Mycobacterium
VWRALRASMRSVLEETTLA

SEQ ID NO: 1058210 - protein, 24 aa, Mycobacterium
VWRTFGQDRLQAMASTATVPVVNA

SEQ ID NO: 1058211 - protein, 19 aa, Mycobacterium
VWSLHGYHECLQRLGRTAE

SEQ ID NO: 1058212 - protein, 18 aa, Mycobacterium
VWTERGGPATIVPMFLLY

SEQ ID NO: 1058213 - protein, 23 aa, Mycobacterium
VWVNCYHVYPAHSAFGGYKQSGI

SEQ ID NO: 1058214 - protein, 24 aa, Mycobacterium
VYAEIRFAPELHINRGLTFDEIVD

SEQ ID NO: 1058215 - protein, 18 aa, Mycobacterium
VYAGALLIERAAWEREVN

SEQ ID NO: 1058216 - protein, 28 aa, Mycobacterium
VYAICSLPFEHAHPTAIMTWMRQHCGIE

SEQ ID NO: 1058217 - protein, 31 aa, Mycobacterium
VYAICSLPFEHARPTAIMTWMRQHCGIENSL

SEQ ID NO: 1058218 - protein, 31 aa, Mycobacterium
VYAICSPPFEHARPTAIMTWMRQHCGIENTL

SEQ ID NO: 1058219 - protein, 24 aa, Mycobacterium
VYFALLARRRMDLYGATLEDFAQV

SEQ ID NO: 1058220 - protein, 18 aa, Mycobacterium
VYFCDSRSPWQRGSNENA

SEQ ID NO: 1058221 - protein, 21 aa, Mycobacterium
VYFVERLVDCLAFELKMGPAE

SEQ ID NO: 1058222 - protein, 19 aa, Mycobacterium
VYGVCSLDAIGGLTTGDTL

SEQ ID NO: 1058223 - protein, 18 aa, Mycobacterium
VYKGFAALSGAAFADGSL

SEQ ID NO: 1058224 - protein, 20 aa, Mycobacterium
VYKGLRRRAAAAGLDVIMIE

SEQ ID NO: 1058225 - protein, 21 aa, Mycobacterium
VYLCGPAAMVEATRTWLSANG

SEQ ID NO: 1058226 - protein, 17 aa, Mycobacterium
VYLDIPITGTLGVFTVG

SEQ ID NO: 1058227 - protein, 18 aa, Mycobacterium
VYLSAGVHPCLQSRIAAA

SEQ ID NO: 1058228 - protein, 19 aa, Mycobacterium
VYNFGELQSGLVNVGNTVS

SEQ ID NO: 1058229 - protein, 37 aa, Mycobacterium
VYRAARARLGRPLRIAHAWSLSFDASWQPMVGLLDGH

SEQ ID NO: 1058230 - protein, 18 aa, Mycobacterium
VYRAELALVETARKTGIR

SEQ ID NO: 1058231 - protein, 21 aa, Mycobacterium
VYRLTGELAEWFGVDAGTLRE

SEQ ID NO: 1058232 - protein, 18 aa, Mycobacterium
VYTLRDGKVVRVEVHTDT

SEQ ID NO: 1058233 - protein, 20 aa, Mycobacterium
VYYWMFGGWLRKRRNIRDMT

SEQ ID NO: 1058234 - protein, 18 aa, Mycobacterium
WAAAGLTPLRPWRSALVA

SEQ ID NO: 1058235 - protein, 18 aa, Mycobacterium
WAAAPLATTSCTWRRDRV

SEQ ID NO: 1058236 - protein, 18 aa, Mycobacterium
WAAKGIRVNAVAPGTIDT

SEQ ID NO: 1058237 - protein, 24 aa, Mycobacterium
WAAKRAALTLVHRVPRSAGRELAY

SEQ ID NO: 1058238 - protein, 17 aa, Mycobacterium
WAALPRAGAVVFATSGM

SEQ ID NO: 1058239 - protein, 18 aa, Mycobacterium
WAALTAEIGDRVQIVGDD

SEQ ID NO: 1058240 - protein, 22 aa, Mycobacterium
WAATLQPGWQRRRITNFQVLTA

SEQ ID NO: 1058241 - protein, 19 aa, Mycobacterium
WAAVRLDVIGVRIGRSANP

SEQ ID NO: 1058242 - protein, 23 aa, Mycobacterium
WADPESGSAFGYVHNRLLTLLLF

SEQ ID NO: 1058243 - protein, 18 aa, Mycobacterium
WADPGARRPGEINHRDGG

SEQ ID NO: 1058244 - protein, 20 aa, Mycobacterium
WAEAMSTLLKPGDVATAPVH

SEQ ID NO: 1058245 - protein, 22 aa, Mycobacterium
WAFAEGFGYAYERTVLLERMRR

SEQ ID NO: 1058246 - protein, 18 aa, Mycobacterium
WAFEGKWDGYRLLVEADH

SEQ ID NO: 1058247 - protein, 17 aa, Mycobacterium
WAGALTLGVAKIVENME

SEQ ID NO: 1058248 - protein, 18 aa, Mycobacterium
WAGEVLLREAHVLCGLPV

SEQ ID NO: 1058249 - protein, 17 aa, Mycobacterium
WAGILAYLDRCDYDYVT

SEQ ID NO: 1058250 - protein, 25 aa, Mycobacterium
WAGRGLATICLRPEPIPEDVRVLGF

SEQ ID NO: 1058251 - protein, 17 aa, Mycobacterium
WAGRVCGDTFVPVRALL

SEQ ID NO: 1058252 - protein, 19 aa, Mycobacterium
WAGTCKPGDGLGIAGDEVL

SEQ ID NO: 1058253 - protein, 17 aa, Mycobacterium
WAHFRRHGFGFPGETEA

SEQ ID NO: 1058254 - protein, 18 aa, Mycobacterium
WAKGRVALVGDAAYCCSP

SEQ ID NO: 1058255 - protein, 24 aa, Mycobacterium
WAKQRGHRGLAYVLVGEDGTLGGP

SEQ ID NO: 1058256 - protein, 17 aa, Mycobacterium
WAKSQGISITAEVTPHH

SEQ ID NO: 1058257 - protein, 19 aa, Mycobacterium
WAKTWEFQALLKARAAVGD

SEQ ID NO: 1058258 - protein, 17 aa, Mycobacterium
WALLKFLNDDRYAIDPK

SEQ ID NO: 1058259 - protein, 17 aa, Mycobacterium
WALPLAVVVEGRAVGVQ

SEQ ID NO: 1058260 - protein, 17 aa, Mycobacterium
WAPEVRAAVAMTLTSRF

SEQ ID NO: 1058261 - protein, 21 aa, Mycobacterium
WAQLDGRARLIIGGRVNRFIP

SEQ ID NO: 1058262 - protein, 18 aa, Mycobacterium
WAQLQLPRVPGMEPLVMG

SEQ ID NO: 1058263 - protein, 19 aa, Mycobacterium
WAQRQFPHDLWCDVADAGL

SEQ ID NO: 1058264 - protein, 21 aa, Mycobacterium
WARLGTFNVPNPVGSLAPSDG

SEQ ID NO: 1058265 - protein, 20 aa, Mycobacterium
WARSELDYLPGTTGVHSSGL

SEQ ID NO: 1058266 - protein, 19 aa, Mycobacterium
WASETGWPQFADRLVELAR

SEQ ID NO: 1058267 - protein, 17 aa, Mycobacterium
WAVARASGIAVAVTDPV

SEQ ID NO: 1058268 - protein, 32 aa, Mycobacterium; identical to SEQ ID NO: 751965

SEQ ID NO: 1058269 - protein, 17 aa, Mycobacterium
WCAIIDFDNSVPAQVVA

SEQ ID NO: 1058270 - protein, 17 aa, Mycobacterium
WCALAERYGDDWHRWPK

SEQ ID NO: 1058271 - protein, 20 aa, Mycobacterium
WCGHGEPLLRCTRCGSDTVR

SEQ ID NO: 1058272 - protein, 17 aa, Mycobacterium
WCRQVLDLLDQVRNAAP

SEQ ID NO: 1058273 - protein, 18 aa, Mycobacterium
WCRVYEPNGAPDAAPAPV

SEQ ID NO: 1058274 - protein, 17 aa, Mycobacterium
WCSGMRAKLGLPAVTEA

SEQ ID NO: 1058275 - protein, 25 aa, Mycobacterium
WCSNTSPGYARICAPIGPSPPSPAG

SEQ ID NO: 1058276 - protein, 28 aa, Mycobacterium
WCYATDEMRAWWGGMWADRILRSDLSAQ

SEQ ID NO: 1058277 - protein, 20 aa, Mycobacterium
WDAAFRRCTELLAPVIDTYG

SEQ ID NO: 1058278 - protein, 20 aa, Mycobacterium
WDADMPRWEPGSKALATRAA

SEQ ID NO: 1058279 - protein, 28 aa, Mycobacterium
WDADRAAGAYAHRWWVRRTLADALREAA

SEQ ID NO: 1058280 - protein, 18 aa, Mycobacterium
WDAIFAAEMAGVFKPDPA

SEQ ID NO: 1058281 - protein, 17 aa, Mycobacterium
WDAILGINVGGVISGSR

SEQ ID NO: 1058282 - protein, 18 aa, Mycobacterium
WDAPVAGTGPEVFADVAA

SEQ ID NO: 1058283 - protein, 18 aa, Mycobacterium
WDASLAIGAVAVINGAVP

SEQ ID NO: 1058284 - protein, 17 aa, Mycobacterium
WDCPFDGAVAPQQVLDI

SEQ ID NO: 1058285 - protein, 26 aa, Mycobacterium
WDEYREAMVIDRRVLLTLPISHVYGL

SEQ ID NO: 1058286 - protein, 19 aa, Mycobacterium
WDGMLDRFVPHKTVLYGTG

SEQ ID NO: 1058287 - protein, 17 aa, Mycobacterium
WDGRSHYLAAIYRTDLA

SEQ ID NO: 1058288 - protein, 20 aa, Mycobacterium
WDHGGKGIGSLFSWTQNPGG

SEQ ID NO: 1058289 - protein, 18 aa, Mycobacterium
WDHSVPLAGARIAVLGTG

SEQ ID NO: 1058290 - protein, 20 aa, Mycobacterium
WDIAEPRLALQARQDSAVAA

SEQ ID NO: 1058291 - protein, 21 aa, Mycobacterium
WDIVSGVGYTALLVAGWRALD

SEQ ID NO: 1058292 - protein, 17 aa, Mycobacterium
WDKKGYKIPGGTPSSPG

SEQ ID NO: 1058293 - protein, 26 aa, Mycobacterium
WDLDRSFKVGGCFAGPQNMKLRDVLS

SEQ ID NO: 1058294 - protein, 25 aa, Mycobacterium
WDLTGLRLATKLHEWEPKHGVRYGA

SEQ ID NO: 1058295 - protein, 19 aa, Mycobacterium
WDNVRACHPVFAGDTLYAS

SEQ ID NO: 1058296 - protein, 20 aa, Mycobacterium
WDPLDSVYFAGYAMWNYLTT

SEQ ID NO: 1058297 - protein, 19 aa, Mycobacterium
WDQRLCLVPNGDLFRAIRH

SEQ ID NO: 1058298 - protein, 20 aa, Mycobacterium
WDQRVARHRDRRPGHWSTVE

SEQ ID NO: 1058299 - protein, 31 aa, Mycobacterium
WDQVMRLRDLLKFDFYFADSAAFRANIAEEM

SEQ ID NO: 1058300 - protein, 19 aa, Mycobacterium
WDRAPALLISRLVSWGIVD

SEQ ID NO: 1058301 - protein, 18 aa, Mycobacterium
WDRPIRRSLAFGRGQHFC

SEQ ID NO: 1058302 - protein, 21 aa, Mycobacterium
WDRRPGWFRKVAGLATGVKDR

SEQ ID NO: 1058303 - protein, 23 aa, Mycobacterium
WDVRCAPAAFRFMSQARHIGKVV

SEQ ID NO: 1058304 - protein, 20 aa, Mycobacterium
WDWGFELEDVRAHFDVFYGD

SEQ ID NO: 1058305 - protein, 20 aa, Mycobacterium
WDYATAVGHDIHVPDSLADY

SEQ ID NO: 1058306 - protein, 19 aa, Mycobacterium
WEALEHAGIPPSSLRRSQT

SEQ ID NO: 1058307 - protein, 17 aa, Mycobacterium
WEALEHAGLPPDSLSGT

SEQ ID NO: 1058308 - protein, 20 aa, Mycobacterium
WEALERAGIEPGGLRGSATG

SEQ ID NO: 1058309 - protein, 17 aa, Mycobacterium
WEEALEVAIRCMIEEPF

SEQ ID NO: 1058310 - protein, 20 aa, Mycobacterium
WEFLDRLTSIALPRIRDFRG

SEQ ID NO: 1058311 - protein, 18 aa, Mycobacterium
WEFNQPWSVEDIEIGDPV

SEQ ID NO: 1058312 - protein, 23 aa, Mycobacterium
WEHTDWTTICAAYDRLLQLTDSP

SEQ ID NO: 1058313 - protein, 17 aa, Mycobacterium
WEIPIGLRESDMEVAYS

SEQ ID NO: 1058314 - protein, 18 aa, Mycobacterium
WEIQRVCGEVFGLTVRSR

SEQ ID NO: 1058315 - protein, 21 aa, Mycobacterium
WEIVKPELNYRVGWGGRTESY

SEQ ID NO: 1058316 - protein, 19 aa, Mycobacterium
WELEDLSFAILHPKKYDEI

SEQ ID NO: 1058317 - protein, 20 aa, Mycobacterium
WELPVPIIERRIRAVTPNPG

SEQ ID NO: 1058318 - protein, 18 aa, Mycobacterium
WEQIKKFAVLDRELSIES

SEQ ID NO: 1058319 - protein, 23 aa, Mycobacterium
WEQLRQTYLRLGHQVELVEPEPG

SEQ ID NO: 1058320 - protein, 18 aa, Mycobacterium
WERFYGSAHSGSWPYGLP

SEQ ID NO: 1058321 - protein, 20 aa, Mycobacterium
WESVFGGPAWTRVTDPNGTP

SEQ ID NO: 1058322 - protein, 25 aa, Mycobacterium
WETFLTSELPEWLSANRSVKPTGSA

SEQ ID NO: 1058323 - protein, 24 aa, Mycobacterium
WETTCLISPAGSVEWMCVPRPDSP

SEQ ID NO: 1058324 - protein, 18 aa, Mycobacterium
WEVSAAGPFDRWPTGMGL

SEQ ID NO: 1058325 - protein, 17 aa, Mycobacterium
WEVWARVAEQLGTDPNR

SEQ ID NO: 1058326 - protein, 19 aa, Mycobacterium
WFASNCAGQAFVVLAKPEG

SEQ ID NO: 1058327 - protein, 25 aa, Mycobacterium
WFDEHGVSFARHYTGSLACVPSRPT

SEQ ID NO: 1058328 - protein, 19 aa, Mycobacterium
WFDIEPCYVYHPLNAYSEH

SEQ ID NO: 1058329 - protein, 19 aa, Mycobacterium
WFGDQPFAVCQWTQPKLGI

SEQ ID NO: 1058330 - protein, 26 aa, Mycobacterium
WFLAPGLITDRVWKYACDNDIAMARP

SEQ ID NO: 1058331 - protein, 17 aa, Mycobacterium
WFPSLKIYNRNGQLYTA

SEQ ID NO: 1058332 - protein, 21 aa, Mycobacterium
WFRRHEVVYERLAPRCEGRDV

SEQ ID NO: 1058333 - protein, 17 aa, Mycobacterium
WFSLFTRLGMRTSIRYK

SEQ ID NO: 1058334 - protein, 23 aa, Mycobacterium
WFSSALWPFSTLGWPELTPELEK

SEQ ID NO: 1058335 - protein, 20 aa, Mycobacterium
WFTAPEALEYGFVDHIITRA

SEQ ID NO: 1058336 - protein, 17 aa, Mycobacterium
WFVDGLIGGTIGFGGEE

SEQ ID NO: 1058337 - protein, 18 aa, Mycobacterium
WGAFDMSLGKAMYAGFTL

SEQ ID NO: 1058338 - protein, 25 aa, Mycobacterium
WGAGHGGLFNRTSWVLSVDDHVDPA

SEQ ID NO: 1058339 - protein, 25 aa, Mycobacterium
WGAGRAVGGGAYWRGGAAAGAGATG

SEQ ID NO: 1058340 - protein, 31 aa, Mycobacterium; identical to SEQ ID NO: 752492

SEQ ID NO: 1058341 - protein, 18 aa, Mycobacterium
WGEAVTAVVVLRADAARD

SEQ ID NO: 1058342 - protein, 20 aa, Mycobacterium
WGEGAGMVLVERESRAQREG

SEQ ID NO: 1058343 - protein, 24 aa, Mycobacterium
WGEGPPVYLVHGWGGRRPHLGMFI

SEQ ID NO: 1058344 - protein, 17 aa, Mycobacterium
WGESMSRQAGGRAGGSG

SEQ ID NO: 1058345 - protein, 20 aa, Mycobacterium
WGGADGGAGGDARLIGNGGG

SEQ ID NO: 1058346 - protein, 24 aa, Mycobacterium
WGGATYDVALRFLKEDPWERLATL

SEQ ID NO: 1058347 - protein, 25 aa, Mycobacterium
WGGKPGRPLAWHSLGEALFNGRWIK

SEQ ID NO: 1058348 - protein, 25 aa, Mycobacterium
WGGMPMAPGMFAISWLDQLRLPVRI

SEQ ID NO: 1058349 - protein, 19 aa, Mycobacterium
WGGPISMAVAVERAERVRG

SEQ ID NO: 1058350 - protein, 17 aa, Mycobacterium
WGGPPIGAMVFREPALM

SEQ ID NO: 1058351 - protein, 22 aa, Mycobacterium
WGGYLIAAEVVEFWQGRENRVH

SEQ ID NO: 1058352 - protein, 27 aa, Mycobacterium
WGHRNPCWTCSTTAPVVQRLRLLEASY

SEQ ID NO: 1058353 - protein, 19 aa, Mycobacterium
WGHRYPAAIRLWRNAWNES

SEQ ID NO: 1058354 - protein, 18 aa, Mycobacterium
WGIAAAMTRGDITVTGID

SEQ ID NO: 1058355 - protein, 19 aa, Mycobacterium
WGLAYFGAVIFQLGTLFAQ

SEQ ID NO: 1058356 - protein, 17 aa, Mycobacterium
WGLEYLFGVLEAGKKGA

SEQ ID NO: 1058357 - protein, 19 aa, Mycobacterium
WGLNHLVSLGLRPPPPQRF

SEQ ID NO: 1058358 - protein, 20 aa, Mycobacterium
WGLRVARVELRSIDPPPSIQ

SEQ ID NO: 1058359 - protein, 17 aa, Mycobacterium
WGMPALGSIPIRVDCGD

SEQ ID NO: 1058360 - protein, 18 aa, Mycobacterium
WGNAMRWLLTGDEFDAAE

SEQ ID NO: 1058361 - protein, 18 aa, Mycobacterium
WGSQWDLVRLPDDRRDGD

SEQ ID NO: 1058362 - protein, 17 aa, Mycobacterium
WGVKGRFAGSEGGGDRA

SEQ ID NO: 1058363 - protein, 27 aa, Mycobacterium
WGVRDWWSMDWMWSALHLDDGTHLHGV

SEQ ID NO: 1058364 - protein, 24 aa, Mycobacterium
WHARVPDWRDYYLGLDQRRHYAYL

SEQ ID NO: 1058365 - protein, 18 aa, Mycobacterium
WHGDCAALHALFIAIERC

SEQ ID NO: 1058366 - protein, 17 aa, Mycobacterium
WHISRTLTNAVLRQAGT

SEQ ID NO: 1058367 - protein, 18 aa, Mycobacterium
WHPLPFRAVFDAPLCGEI

SEQ ID NO: 1058368 - protein, 17 aa, Mycobacterium
WHPQRLYPPEVLNAAII

SEQ ID NO: 1058369 - protein, 23 aa, Mycobacterium
WHRWWPDLRLQVVEDRAEKGIRW

SEQ ID NO: 1058370 - protein, 17 aa, Mycobacterium
WIAAERGYIDAVVDPHQ

SEQ ID NO: 1058371 - protein, 17 aa, Mycobacterium
WIDIRFTLPANTVDGGI

SEQ ID NO: 1058372 - protein, 22 aa, Mycobacterium
WIDTRLQWYVDLGIDAENLRLF

SEQ ID NO: 1058373 - protein, 17 aa, Mycobacterium
WIELNPHPLYLPSKGLP

SEQ ID NO: 1058374 - protein, 18 aa, Mycobacterium
WIGGPGIGAVHLDKGCYR

SEQ ID NO: 1058375 - protein, 20 aa, Mycobacterium
WIKAQAYRLQTFGTVTRLAA

SEQ ID NO: 1058376 - protein, 18 aa, Mycobacterium
WIQPTWPRRHGGRSLGLA

SEQ ID NO: 1058377 - protein, 17 aa, Mycobacterium
WIREGSGHAGGRGSARA

SEQ ID NO: 1058378 - protein, 19 aa, Mycobacterium
WIRELRPHIDLYLLTDESI

SEQ ID NO: 1058379 - protein, 18 aa, Mycobacterium
WKAFAPAWAGKVAIEAVD

SEQ ID NO: 1058380 - protein, 26 aa, Mycobacterium
WKAGPALACGNAFVLKPSERDPSVPL

SEQ ID NO: 1058381 - protein, 17 aa, Mycobacterium
WKCGVTWTQRLISLLVF

SEQ ID NO: 1058382 - protein, 28 aa, Mycobacterium
WKDNGQGVGSLFSWTGDPAVVQGPQEGI

SEQ ID NO: 1058383 - protein, 20 aa, Mycobacterium
WKDYWDFNSLAAFAPPQHFE

SEQ ID NO: 1058384 - protein, 21 aa, Mycobacterium
WKEERGQRIFIDFNQNARDRT

SEQ ID NO: 1058385 - protein, 19 aa, Mycobacterium
WKIDQVYFDPRWIANQDPR

SEQ ID NO: 1058386 - protein, 24 aa, Mycobacterium
WKIGWACGLKELIAGVRAAKQYMS

SEQ ID NO: 1058387 - protein, 17 aa, Mycobacterium
WKLAPALAAGNAVVLKP

SEQ ID NO: 1058388 - protein, 17 aa, Mycobacterium
WKLATEVDRVVAKFDRD

SEQ ID NO: 1058389 - protein, 18 aa, Mycobacterium
WKLVELDQRFGIADRIEK

SEQ ID NO: 1058390 - protein, 19 aa, Mycobacterium
WKLVRTFDDPATWTEPGVR

SEQ ID NO: 1058391 - protein, 19 aa, Mycobacterium
WKVTEIDPGVSWTWEQRGP

SEQ ID NO: 1058392 - protein, 19 aa, Mycobacterium
WKYLMALFNSKIDEHADPK

SEQ ID NO: 1058393 - protein, 17 aa, Mycobacterium
WLAAIDRGGPAGVQATR

SEQ ID NO: 1058394 - protein, 19 aa, Mycobacterium
WLAEARNLLELEPYPEMDG

SEQ ID NO: 1058395 - protein, 25 aa, Mycobacterium
WLAEHVVDGRRCGLTVVGTHLPHGG

SEQ ID NO: 1058396 - protein, 22 aa, Mycobacterium
WLALNCRRHMELYGTTREQLGW

SEQ ID NO: 1058397 - protein, 26 aa, Mycobacterium
WLAPYTGSAVAQHWMYDGKHVLIVFD

SEQ ID NO: 1058398 - protein, 17 aa, Mycobacterium
WLARRVEIAEHWREVHP

SEQ ID NO: 1058399 - protein, 26 aa, Mycobacterium
WLCDRSWNRPRWKIDEVVEAKAGRSI

SEQ ID NO: 1058400 - protein, 18 aa, Mycobacterium
WLDCPDRGVGLTITSQLH

SEQ ID NO: 1058401 - protein, 23 aa, Mycobacterium
WLDDRKWAYVRLEGRAFGDVPLN

SEQ ID NO: 1058402 - protein, 23 aa, Mycobacterium
WLEFNARVLALAADDSMPLLERA

SEQ ID NO: 1058403 - protein, 20 aa, Mycobacterium
WLEGLFHGIQTALFAQQMAA

SEQ ID NO: 1058404 - protein, 24 aa, Mycobacterium
WLEGYLLTGRHGMFDCYEAFVHIV

SEQ ID NO: 1058405 - protein, 22 aa, Mycobacterium
WLFSSKFSKKDGMDFGTLIDVA

SEQ ID NO: 1058406 - protein, 23 aa, Mycobacterium
WLFSSKFSKKDGMDFGTLIDVAV

SEQ ID NO: 1058407 - protein, 25 aa, Mycobacterium
WLGMGRDLYGRFPAFAKAFDTVADA

SEQ ID NO: 1058408 - protein, 24 aa, Mycobacterium
WLGPAQELVRAWLLGNLAAPPNAA

SEQ ID NO: 1058409 - protein, 17 aa, Mycobacterium
WLGPKRLVPPMVMVTSP

SEQ ID NO: 1058410 - protein, 26 aa, Mycobacterium
WLGSDVWMAHCVHLSKGYIAKLAATG

SEQ ID NO: 1058411 - protein, 22 aa, Mycobacterium
WLHEEWGFRYQDRIFTVPVVSL

SEQ ID NO: 1058412 - protein, 20 aa, Mycobacterium
WLHPFEKLWREKLSALAEAA

SEQ ID NO: 1058413 - protein, 19 aa, Mycobacterium
WLLAIARRVVADHIRHLQA

SEQ ID NO: 1058414 - protein, 21 aa, Mycobacterium
WLLIKTDFLMHAARHPDLAQR

SEQ ID NO: 1058415 - protein, 19 aa, Mycobacterium
WLLLADGMPIAWRGKLLTG

SEQ ID NO: 1058416 - protein, 21 aa, Mycobacterium
WLLRVQALRSAWGTPEVHRRR

SEQ ID NO: 1058417 - protein, 17 aa, Mycobacterium
WLMRRVGKSPSRKNPRW

SEQ ID NO: 1058418 - protein, 18 aa, Mycobacterium
WLNAAAVRAGEAALQAKE

SEQ ID NO: 1058419 - protein, 27 aa, Mycobacterium
WLPFFHDMGLMFGIIMPLLEGFHSVLT

SEQ ID NO: 1058420 - protein, 25 aa, Mycobacterium
WLPFYHDMGLMLGIILPMINQDTAV

SEQ ID NO: 1058421 - protein, 18 aa, Mycobacterium
WLRELWGGPFMLKGVMRV

SEQ ID NO: 1058422 - protein, 23 aa, Mycobacterium
WLTATRARNALVLVRGKPTDQLP

SEQ ID NO: 1058423 - protein, 17 aa, Mycobacterium
WLTDRFAGLPLTEHVIR

SEQ ID NO: 1058424 - protein, 17 aa, Mycobacterium
WLTGGRRPWVALKLMTY

SEQ ID NO: 1058425 - protein, 17 aa, Mycobacterium
WLTGVARYSDLLEHLAS

SEQ ID NO: 1058426 - protein, 18 aa, Mycobacterium
WLTLPAAAGPIVLALNAG

SEQ ID NO: 1058427 - protein, 17 aa, Mycobacterium
WLVSATRPAGIRRLFIR

SEQ ID NO: 1058428 - protein, 17 aa, Mycobacterium
WMAAAALVRSRADGGVV

SEQ ID NO: 1058429 - protein, 17 aa, Mycobacterium
WMADSGVLEPGRDYVIK

SEQ ID NO: 1058430 - protein, 26 aa, Mycobacterium
WMCVPRPDSPSVFGAILDRSAGHFRL

SEQ ID NO: 1058431 - protein, 27 aa, Mycobacterium
WMSPVEQIRMSLAMAGWPKSDRKRREG

SEQ ID NO: 1058432 - protein, 28 aa, Mycobacterium
WMTPTQVRWRPFQFWPANTAVNIDAAGT

SEQ ID NO: 1058433 - protein, 19 aa, Mycobacterium
WMTRLMLGFGSTVQVLEPE

SEQ ID NO: 1058434 - protein, 17 aa, Mycobacterium
WMYDGKHVLIVFDDLTK

SEQ ID NO: 1058435 - protein, 25 aa, Mycobacterium
WNAGKDLSFVPLRPERVVEVRYDHM

SEQ ID NO: 1058436 - protein, 19 aa, Mycobacterium
WNAIRHAKPIAVGLNCALG

SEQ ID NO: 1058437 - protein, 23 aa, Mycobacterium
WNCDKGRWAFTYATQPDVITTPL

SEQ ID NO: 1058438 - protein, 18 aa, Mycobacterium
WNKPSFAKELFLGRFPLE

SEQ ID NO: 1058439 - protein, 19 aa, Mycobacterium
WNPDTGKYGPIYDETTGQM

SEQ ID NO: 1058440 - protein, 29 aa, Mycobacterium
WNPQRATSMPVFRYRPFAKEVEPIRLVDR

SEQ ID NO: 1058441 - protein, 19 aa, Mycobacterium
WNRLCEALTPGNVVLADQG

SEQ ID NO: 1058442 - protein, 19 aa, Mycobacterium
WNSPRAIAYRNHYSLDDQG

SEQ ID NO: 1058443 - protein, 17 aa, Mycobacterium
WNVPRKLTTFSLWGSGV

SEQ ID NO: 1058444 - protein, 18 aa, Mycobacterium
WNVPRKLTTFSLWGSGVL

SEQ ID NO: 1058445 - protein, 17 aa, Mycobacterium
WNVVRLPPQMALASCEF

SEQ ID NO: 1058446 - protein, 21 aa, Mycobacterium
WPADEYRAGVVQNSFDKQFVR

SEQ ID NO: 1058447 - protein, 18 aa, Mycobacterium
WPALGGMGNASWVQLSGH

SEQ ID NO: 1058448 - protein, 21 aa, Mycobacterium
WPATLERLLAIGGPDAIYVPG

SEQ ID NO: 1058449 - protein, 17 aa, Mycobacterium
WPELAEAALAIRAGALW

SEQ ID NO: 1058450 - protein, 18 aa, Mycobacterium
WPGARLMTTRGLGRLAHF

SEQ ID NO: 1058451 - protein, 19 aa, Mycobacterium
WPGHVIAAVAPPPERLLVG

SEQ ID NO: 1058452 - protein, 21 aa, Mycobacterium
WPINRGEMVVAYLAGANRDPA

SEQ ID NO: 1058453 - protein, 17 aa, Mycobacterium
WPLAASGTSIYWTGLNK

SEQ ID NO: 1058454 - protein, 22 aa, Mycobacterium
WPPHCRAGSTGAQFCPDLDVAP

SEQ ID NO: 1058455 - protein, 17 aa, Mycobacterium
WPPLPPFATTLPVAPCA

SEQ ID NO: 1058456 - protein, 21 aa, Mycobacterium
WPPMPYPDTWAVWQEDEGRKV

SEQ ID NO: 1058457 - protein, 20 aa, Mycobacterium
WPPPGTPPDRHWAIRSTQGQ

SEQ ID NO: 1058458 - protein, 20 aa, Mycobacterium
WPQGTYLAWLDCRDLGISEQ

SEQ ID NO: 1058459 - protein, 20 aa, Mycobacterium
WPRNAHQLVDEWLGVTRLDG

SEQ ID NO: 1058460 - protein, 17 aa, Mycobacterium
WPRSRQLVDELPGLVAS

SEQ ID NO: 1058461 - protein, 20 aa, Mycobacterium
WPTPARRALPSALDAAQGTP

SEQ ID NO: 1058462 - protein, 23 aa, Mycobacterium
WPTVEPDWVLPVVVYYHGGGWAL

SEQ ID NO: 1058463 - protein, 18 aa, Mycobacterium
WPVARLLRDAQVNTIWEG

SEQ ID NO: 1058464 - protein, 18 aa, Mycobacterium
WPVLPWLPIWEPVPKDPP

SEQ ID NO: 1058465 - protein, 31 aa, Mycobacterium
WPYIGAKAGGLPGDLTFSWYAVDKTQQSWVV

SEQ ID NO: 1058466 - protein, 33 aa, Mycobacterium
WQAARCVANWGGARADKGLRRWRSAVRSAARQS

SEQ ID NO: 1058467 - protein, 18 aa, Mycobacterium
WQAPDPRLARQVVPENWL

SEQ ID NO: 1058468 - protein, 18 aa, Mycobacterium
WQATRYWYQAGMHPAIQL

SEQ ID NO: 1058469 - protein, 22 aa, Mycobacterium
WQDTESWTRKSILNSAYSGKFS

SEQ ID NO: 1058470 - protein, 17 aa, Mycobacterium
WQECSQVGMPRAVVITK

SEQ ID NO: 1058471 - protein, 22 aa, Mycobacterium
WQEVNALKKFYGGYDLQLAEDT

SEQ ID NO: 1058472 - protein, 19 aa, Mycobacterium
WQFAATVGERLARPGPPSS

SEQ ID NO: 1058473 - protein, 24 aa, Mycobacterium
WQGLDRLGGFLARVRGSREETVGQ

SEQ ID NO: 1058474 - protein, 17 aa, Mycobacterium
WQHGVFIGATLGSEQTA

SEQ ID NO: 1058475 - protein, 17 aa, Mycobacterium
WQKLMIYTSESARHDGV

SEQ ID NO: 1058476 - protein, 26 aa, Mycobacterium
WQLSKRTADMLLEFGNSSGLTNPAPI

SEQ ID NO: 1058477 - protein, 17 aa, Mycobacterium
WQPEPLPGQPLDRPFAW

SEQ ID NO: 1058478 - protein, 22 aa, Mycobacterium
WQPHQVPAFLAAGYRCITFDNR

SEQ ID NO: 1058479 - protein, 20 aa, Mycobacterium
WQQHPSRIWIILTGLKSIAH

SEQ ID NO: 1058480 - protein, 25 aa, Mycobacterium
WQQVTDWDFVCEQLALAEPRWEPGS

SEQ ID NO: 1058481 - protein, 19 aa, Mycobacterium
WQREMLAQIEVPYRVIDVA

SEQ ID NO: 1058482 - protein, 26 aa, Mycobacterium
WQRHVGGNGWRGDDLLLIGGPFDARA

SEQ ID NO: 1058483 - protein, 19 aa, Mycobacterium
WQRLFLFTRADTIYGGSNE

SEQ ID NO: 1058484 - protein, 28 aa, Mycobacterium
WQRLGVSGRACWLGRWRDWMLDHRDDLL

SEQ ID NO: 1058485 - protein, 17 aa, Mycobacterium
WQRRRITNFQVLTAGGQ

SEQ ID NO: 1058486 - protein, 22 aa, Mycobacterium
WQSGASTLRWRSTTAANADAEV

SEQ ID NO: 1058487 - protein, 18 aa, Mycobacterium
WQTPEGIEVKPVYIGADR

SEQ ID NO: 1058488 - protein, 17 aa, Mycobacterium
WQVEFDLPANESITSVW

SEQ ID NO: 1058489 - protein, 20 aa, Mycobacterium
WRAAELLNGLGARYVPQRVV

SEQ ID NO: 1058490 - protein, 31 aa, Mycobacterium
WRAEQPIVIVAPMFHAWGFSQLVLAASLACT

SEQ ID NO: 1058491 - protein, 19 aa, Mycobacterium
WRANRYPGCSVDIANHYYA

SEQ ID NO: 1058492 - protein, 18 aa, Mycobacterium
WRAVIAGFVARRLSVKPT

SEQ ID NO: 1058493 - protein, 17 aa, Mycobacterium
WRDARRLTVPGVACAQD

SEQ ID NO: 1058494 - protein, 34 aa, Mycobacterium
WRDCGGTRLSDRVLLRFGLHQALRLGKPLQLHIG

SEQ ID NO: 1058495 - protein, 19 aa, Mycobacterium
WRDRFQQMLQRAEARLHPQ

SEQ ID NO: 1058496 - protein, 23 aa, Mycobacterium
WRDWSVRCAALATHPAALDTRSY

SEQ ID NO: 1058497 - protein, 26 aa, Mycobacterium
WRFGTPPAANANFAWIQHILSKLAPT

SEQ ID NO: 1058498 - protein, 19 aa, Mycobacterium
WRFPPIKPFRGAYVLLEFD

SEQ ID NO: 1058499 - protein, 20 aa, Mycobacterium
WRFTPLRRLRGLHDGSAVAN

SEQ ID NO: 1058500 - protein, 20 aa, Mycobacterium
WRFVAEWTSKGEILTPGPAT

SEQ ID NO: 1058501 - protein, 24 aa, Mycobacterium
WRGMFPARLFRLGPENEPVAAFQD

SEQ ID NO: 1058502 - protein, 17 aa, Mycobacterium
WRGPIRLATEEARARAQ

SEQ ID NO: 1058503 - protein, 24 aa, Mycobacterium
WRGQRLRALVALPELVAAAPDGCG

SEQ ID NO: 1058504 - protein, 24 aa, Mycobacterium
WRIADCRAAAAAMAIRSGADELQI

SEQ ID NO: 1058505 - protein, 25 aa, Mycobacterium
WRIDRLPNGVFLDWQQFQSTYKRNT

SEQ ID NO: 1058506 - protein, 19 aa, Mycobacterium
WRIGYHPAVVEGLRRRNYR

SEQ ID NO: 1058507 - protein, 18 aa, Mycobacterium
WRILQPASRFSCASVSGS

SEQ ID NO: 1058508 - protein, 20 aa, Mycobacterium
WRINTYPGLACDVKSHLYSY

SEQ ID NO: 1058509 - protein, 18 aa, Mycobacterium
WRKGCMPLLQRVVRARVH

SEQ ID NO: 1058510 - protein, 19 aa, Mycobacterium
WRKLAPILVDSGWRVVAPF

SEQ ID NO: 1058511 - protein, 20 aa, Mycobacterium
WRKTVVSILGPRSFRALRLD

SEQ ID NO: 1058512 - protein, 20 aa, Mycobacterium
WRLATVNVDVVPRVAQIFGV

SEQ ID NO: 1058513 - protein, 19 aa, Mycobacterium
WRLQADFDGSGIDERYFDF

SEQ ID NO: 1058514 - protein, 17 aa, Mycobacterium
WRLRPTSNGQLVIREVY

SEQ ID NO: 1058515 - protein, 17 aa, Mycobacterium
WRLRTRHGLPVHDIAPM

SEQ ID NO: 1058516 - protein, 18 aa, Mycobacterium
WRMELPLRHLEDLITRLS

SEQ ID NO: 1058517 - protein, 19 aa, Mycobacterium
WRNHMKIFFNNKGVVAKST

SEQ ID NO: 1058518 - protein, 17 aa, Mycobacterium
WRNPFSYQPEIWDYLKG

SEQ ID NO: 1058519 - protein, 19 aa, Mycobacterium
WRPNYRSTALVDGKASVTA

SEQ ID NO: 1058520 - protein, 25 aa, Mycobacterium
WRQADKYDVPRICFVNKMDKIGADF

SEQ ID NO: 1058521 - protein, 18 aa, Mycobacterium
WRRALRTLELVLDGAGGV

SEQ ID NO: 1058522 - protein, 18 aa, Mycobacterium
WRRDQKLFAEVALPEQVS

SEQ ID NO: 1058523 - protein, 18 aa, Mycobacterium
WRRGPLTALERLAGPDIR

SEQ ID NO: 1058524 - protein, 25 aa, Mycobacterium
WRRGTLPPGQLGWRKVTEIRDQAAL

SEQ ID NO: 1058525 - protein, 19 aa, Mycobacterium
WRRGTPLSDAEMIFQGAHT

SEQ ID NO: 1058526 - protein, 18 aa, Mycobacterium
WRRHGVRVADVLPGLIDT

SEQ ID NO: 1058527 - protein, 17 aa, Mycobacterium
WRRRKPYSWLRQVLPDP

SEQ ID NO: 1058528 - protein, 19 aa, Mycobacterium
WRRRKPYSWLRQVLPDPQY

SEQ ID NO: 1058529 - protein, 18 aa, Mycobacterium
WRRVSWRGSGLRWDALAP

SEQ ID NO: 1058530 - protein, 18 aa, Mycobacterium
WRSFELYPPQVQVAGATA

SEQ ID NO: 1058531 - protein, 21 aa, Mycobacterium
WRSTPAPVRGALVARLGELIS

SEQ ID NO: 1058532 - protein, 21 aa, Mycobacterium
WRTAWPSRTRWDWMCPNRCTG

SEQ ID NO: 1058533 - protein, 17 aa, Mycobacterium
WRTAYLALSGRTIDAGT

SEQ ID NO: 1058534 - protein, 20 aa, Mycobacterium
WRTEHLIEAATYWSKTADQW

SEQ ID NO: 1058535 - protein, 20 aa, Mycobacterium
WRVGFSGFAPGFAYLIGGDP

SEQ ID NO: 1058536 - protein, 19 aa, Mycobacterium
WRWSDAVFERSDIDHLTGL

SEQ ID NO: 1058537 - protein, 23 aa, Mycobacterium
WSAAYLPLFRVLRTLADEGRRGL

SEQ ID NO: 1058538 - protein, 18 aa, Mycobacterium
WSALCGIVEAGGSLEKFR

SEQ ID NO: 1058539 - protein, 23 aa, Mycobacterium
WSAWLVGAWWPAPPEASAAGVTY

SEQ ID NO: 1058540 - protein, 21 aa, Mycobacterium
WSCPQAASVPVAFVTAYSALI

SEQ ID NO: 1058541 - protein, 23 aa, Mycobacterium
WSDGPPPDWHSFGRVLNKNGVVA

SEQ ID NO: 1058542 - protein, 21 aa, Mycobacterium
WSEDPFPLLRQVIANQQGYAY

SEQ ID NO: 1058543 - protein, 20 aa, Mycobacterium
WSEFGVRLQAIGAHVQKFAG

SEQ ID NO: 1058544 - protein, 18 aa, Mycobacterium
WSELIPLLESGRLDVDGI

SEQ ID NO: 1058545 - protein, 17 aa, Mycobacterium
WSERLGRFSGIRYRREF

SEQ ID NO: 1058546 - protein, 22 aa, Mycobacterium
WSERWRQRWSPPTPVALDATES

SEQ ID NO: 1058547 - protein, 40 aa, Mycobacterium
WSFDRFYAEAARRIHLLPMLRWKCVESPLGLNHPYWVEDP

SEQ ID NO: 1058548 - protein, 19 aa, Mycobacterium
WSGASYLEGLAWTAGANGN

SEQ ID NO: 1058549 - protein, 25 aa, Mycobacterium
WSGSGLWVNLTCRKRFIGDRLGEAL

SEQ ID NO: 1058550 - protein, 20 aa, Mycobacterium
WSHLYRAKNSVLISVGVLGI

SEQ ID NO: 1058551 - protein, 22 aa, Mycobacterium
WSLAGLRVGYALGTPDLLDRLT

SEQ ID NO: 1058552 - protein, 26 aa, Mycobacterium
WSLLKWLDEPCSFYDWRRSEEDGPRV

SEQ ID NO: 1058553 - protein, 17 aa, Mycobacterium
WSLPDAYPVHVGEEAPV

SEQ ID NO: 1058554 - protein, 27 aa, Mycobacterium
WSMSTVPMWCRRQCRSGARYRPESGEA

SEQ ID NO: 1058555 - protein, 19 aa, Mycobacterium
WSQASGLDLARLGTTATTE

SEQ ID NO: 1058556 - protein, 18 aa, Mycobacterium
WSQCLGVGSVDRNANFFD

SEQ ID NO: 1058557 - protein, 17 aa, Mycobacterium
WSRERYSGGGMLSHTPP

SEQ ID NO: 1058558 - protein, 19 aa, Mycobacterium
WSRTALKPADLEVAQLYDG

SEQ ID NO: 1058559 - protein, 29 aa, Mycobacterium
WSSGCDHGTWCFAGGPVIKDGRPVDFGSF

SEQ ID NO: 1058560 - protein, 17 aa, Mycobacterium
WSTILARGATSGPVGLI

SEQ ID NO: 1058561 - protein, 18 aa, Mycobacterium
WSTVDAYLRPAMGRRNLS

SEQ ID NO: 1058562 - protein, 17 aa, Mycobacterium
WSVPLGFLAQTPPTVTP

SEQ ID NO: 1058563 - protein, 17 aa, Mycobacterium
WSVSDMLEAAVLLKEVG

SEQ ID NO: 1058564 - protein, 18 aa, Mycobacterium
WTAAQAPEAAGYWPAAAV

SEQ ID NO: 1058565 - protein, 26 aa, Mycobacterium
WTAGRPCLSIHAAIVFTSPNPRVRDA

SEQ ID NO: 1058566 - protein, 20 aa, Mycobacterium
WTDMGPLDFPSINWAPIEWS

SEQ ID NO: 1058567 - protein, 17 aa, Mycobacterium
WTGAAPLASPLGSALGG

SEQ ID NO: 1058568 - protein, 17 aa, Mycobacterium
WTHRNHRALGLDLRSPE

SEQ ID NO: 1058569 - protein, 23 aa, Mycobacterium
WTKRSLNHWYRMFGPTFETSLGL

SEQ ID NO: 1058570 - protein, 26 aa, Mycobacterium
WTLAMGHAMVRAGLTLSGPGAEQPWQ

SEQ ID NO: 1058571 - protein, 17 aa, Mycobacterium
WTLRWLLGRLGYRAYGW

SEQ ID NO: 1058572 - protein, 18 aa, Mycobacterium
WTMPEPLLPMATEAHAKT

SEQ ID NO: 1058573 - protein, 22 aa, Mycobacterium
WTMTAEDRWLQFSSVSFDASLA

SEQ ID NO: 1058574 - protein, 19 aa, Mycobacterium
WTNPDCRRAGTVHLGGTFA

SEQ ID NO: 1058575 - protein, 24 aa, Mycobacterium
WTNSYYDDMAWLALALERAARIAG

SEQ ID NO: 1058576 - protein, 24 aa, Mycobacterium
WTPKRLPESLLHYMRTRGKNKVIF

SEQ ID NO: 1058577 - protein, 17 aa, Mycobacterium
WTPQWTDDQRAAGYAGW

SEQ ID NO: 1058578 - protein, 18 aa, Mycobacterium
WTPTAFPVEFLSLGAGGV

SEQ ID NO: 1058579 - protein, 17 aa, Mycobacterium
WTQGRFPEFTTPDPSYH

SEQ ID NO: 1058580 - protein, 19 aa, Mycobacterium
WTRGLPWVDKKIRESTQRR

SEQ ID NO: 1058581 - protein, 24 aa, Mycobacterium
WTRVPFEVLERISTRITNEVPEVN

SEQ ID NO: 1058582 - protein, 28 aa, Mycobacterium
WTSAAHKARWGVCLARTDPDAPKHKGIT

SEQ ID NO: 1058583 - protein, 18 aa, Mycobacterium
WTSRSRWRGTRSVPSVPS

SEQ ID NO: 1058584 - protein, 21 aa, Mycobacterium
WTWEQRGPGALAYARHDVNPL

SEQ ID NO: 1058585 - protein, 19 aa, Mycobacterium
WTWETMKPLYTNGAVYGQA

SEQ ID NO: 1058586 - protein, 17 aa, Mycobacterium
WVAALGACVSEAEIKEH

SEQ ID NO: 1058587 - protein, 31 aa, Mycobacterium
WVAELRRRGVTWSRVGGALGVTRQSAWERFS

SEQ ID NO: 1058588 - protein, 24 aa, Mycobacterium
WVAELRVRIYRGCEVTDITQDDNG

SEQ ID NO: 1058589 - protein, 26 aa, Mycobacterium
WVARIGTVVMSWRLRTRHGLPVHDIA

SEQ ID NO: 1058590 - protein, 20 aa, Mycobacterium
WVARRLVGMAAGGPTLPVTC

SEQ ID NO: 1058591 - protein, 21 aa, Mycobacterium
WVERPHYMPLFVAPQPISEPV

SEQ ID NO: 1058592 - protein, 18 aa, Mycobacterium
WVFEETLIRCPIENSLTR

SEQ ID NO: 1058593 - protein, 17 aa, Mycobacterium
WVGPAIMRYGTPAQKTR

SEQ ID NO: 1058594 - protein, 19 aa, Mycobacterium
WVHPERRGLGLGTAGTATL

SEQ ID NO: 1058595 - protein, 22 aa, Mycobacterium
WVIFEEEYFRAGAPGRASANGT

SEQ ID NO: 1058596 - protein, 20 aa, Mycobacterium
WVINGAKTWSTSAFAADYGL

SEQ ID NO: 1058597 - protein, 25 aa, Mycobacterium
WVKEVKAAMAALEIDPVFAERSVNE

SEQ ID NO: 1058598 - protein, 17 aa, Mycobacterium
WVLGPSMTYTCAVYPNE

SEQ ID NO: 1058599 - protein, 27 aa, Mycobacterium
WVMSDWGGTPGWECALGGLDQECGAQI

SEQ ID NO: 1058600 - protein, 18 aa, Mycobacterium
WVNLLNRYGDVATDGTYS

SEQ ID NO: 1058601 - protein, 17 aa, Mycobacterium
WVNLVALAVNEENASGG

SEQ ID NO: 1058602 - protein, 24 aa, Mycobacterium
WVNMLRCTLAAFGAGVGGADTVLV

SEQ ID NO: 1058603 - protein, 24 aa, Mycobacterium
WVPAHFPKDAWALGRFDGTPLYEH

SEQ ID NO: 1058604 - protein, 23 aa, Mycobacterium
WVPEVWPFAPAEHRAMLANPDLD

SEQ ID NO: 1058605 - protein, 22 aa, Mycobacterium
WVPEYRKDLAVRLSELDLLLRI

SEQ ID NO: 1058606 - protein, 19 aa, Mycobacterium
WVPGFRLVDFTGQTIRTLP

SEQ ID NO: 1058607 - protein, 20 aa, Mycobacterium
WVQRPGSRVAMMVAEMVADR

SEQ ID NO: 1058608 - protein, 17 aa, Mycobacterium
WVSLGMRLGARSYSQYL

SEQ ID NO: 1058609 - protein, 18 aa, Mycobacterium
WWAAPTILEHGTPEQIAR

SEQ ID NO: 1058610 - protein, 20 aa, Mycobacterium
WWAMLGRPAVNPVDFPVASQ

SEQ ID NO: 1058611 - protein, 17 aa, Mycobacterium
WWCRMVVLSADRVARRG

SEQ ID NO: 1058612 - protein, 19 aa, Mycobacterium
WWDVAIRLLLKYSNSRLMT

SEQ ID NO: 1058613 - protein, 17 aa, Mycobacterium
WWDVLRHGRNSEYAGYF

SEQ ID NO: 1058614 - protein, 18 aa, Mycobacterium
WWHCGCSPDAPIRTAEIR

SEQ ID NO: 1058615 - protein, 18 aa, Mycobacterium
WWHDGWDLLLTPTVASLP

SEQ ID NO: 1058616 - protein, 28 aa, Mycobacterium
WWIMFACAHPALDRQSLLALTLRLVSGV

SEQ ID NO: 1058617 - protein, 30 aa, Mycobacterium; identical to SEQ ID NO: 754587

SEQ ID NO: 1058618 - protein, 18 aa, Mycobacterium
WYAAPLLVAGGRGLIAFT

SEQ ID NO: 1058619 - protein, 25 aa, Mycobacterium
WYAFDPCCPFGGYKNSGIGRENGPE

SEQ ID NO: 1058620 - protein, 19 aa, Mycobacterium
WYCPECMEVTNSALCGHDS

SEQ ID NO: 1058621 - protein, 19 aa, Mycobacterium
WYEGPTWLQRVLRALPAAG

SEQ ID NO: 1058622 - protein, 23 aa, Mycobacterium
WYFRELGEVLLWRQSNKLVAGEK

SEQ ID NO: 1058623 - protein, 20 aa, Mycobacterium
WYGQRFPKPLARTREYVDIL

SEQ ID NO: 1058624 - protein, 18 aa, Mycobacterium
WYGTGSAFEQWLAAGPES

SEQ ID NO: 1058625 - protein, 17 aa, Mycobacterium
WYIAQSWTGFSEQPKYE

SEQ ID NO: 1058626 - protein, 20 aa, Mycobacterium
WYIREVDPTTLLLTGLTRDG

SEQ ID NO: 1058627 - protein, 18 aa, Mycobacterium
WYQIPILLPVIGPRVIAD

SEQ ID NO: 1058628 - protein, 19 aa, Mycobacterium
WYRQLLPDRLHQIGEILPN

SEQ ID NO: 1058629 - protein, 26 aa, Mycobacterium
WYTVLACFKLGIIVEGTLARACAGQA

SEQ ID NO: 1058630 - protein, 20 aa, Mycobacterium
WYWNRYPGARVDIPSVDYMY

SEQ ID NO: 1058631 - protein, 24 aa, Mycobacterium
YAACLPERFAEVMRVTREVLEAVA

SEQ ID NO: 1058632 - protein, 27 aa, Mycobacterium
YAAKAFLCSEIARWVNEEGLSIDVSTG

SEQ ID NO: 1058633 - protein, 18 aa, Mycobacterium
YAALMAGADLVLPDRHLD

SEQ ID NO: 1058634 - protein, 22 aa, Mycobacterium
YAATGKPGWFLFDGLVKHDLLT

SEQ ID NO: 1058635 - protein, 19 aa, Mycobacterium
YAAVGFEYGYTVGNPDAVV

SEQ ID NO: 1058636 - protein, 18 aa, Mycobacterium
YAAVKLALDKNVVLPANA

SEQ ID NO: 1058637 - protein, 23 aa, Mycobacterium
YADRKSVMLGFEPEPGMFVETVQ

SEQ ID NO: 1058638 - protein, 22 aa, Mycobacterium
YAEPGQVLGLTFTRKAAGQLLR

SEQ ID NO: 1058639 - protein, 18 aa, Mycobacterium
YAEPGWASETGWPQFADR

SEQ ID NO: 1058640 - protein, 18 aa, Mycobacterium
YAERHGWTVTVLGETTSD

SEQ ID NO: 1058641 - protein, 23 aa, Mycobacterium
YAFEKRRFWLSGEGVSVDASGLG

SEQ ID NO: 1058642 - protein, 19 aa, Mycobacterium
YAFQRQRFWLPRAPTGSVD

SEQ ID NO: 1058643 - protein, 20 aa, Mycobacterium
YAGADRVLGRLIKVTPSSKV

SEQ ID NO: 1058644 - protein, 19 aa, Mycobacterium
YAGALGPRGLFACSAALRP

SEQ ID NO: 1058645 - protein, 24 aa, Mycobacterium
YAGGIRAGHQLKFWTPGGSSTPLL

SEQ ID NO: 1058646 - protein, 19 aa, Mycobacterium
YAGGWLFGDGGPGAAATAT

SEQ ID NO: 1058647 - protein, 20 aa, Mycobacterium
YAGHQFGGFVPRLGDGRALL

SEQ ID NO: 1058648 - protein, 21 aa, Mycobacterium
YAGKYELFRGAVLALSQQLVD

SEQ ID NO: 1058649 - protein, 18 aa, Mycobacterium
YAGQADWLIVTADGAVVV

SEQ ID NO: 1058650 - protein, 30 aa, Mycobacterium; identical to SEQ ID NO: 965678

SEQ ID NO: 1058651 - protein, 30 aa, Mycobacterium; identical to SEQ ID NO: 973545

SEQ ID NO: 1058652 - protein, 18 aa, Mycobacterium
YAKAFGMDVIAWSQNLTE

SEQ ID NO: 1058653 - protein, 17 aa, Mycobacterium
YALAGRHVHVVTINDYL

SEQ ID NO: 1058654 - protein, 19 aa, Mycobacterium
YALPNLRALNFVIEGILGQ

SEQ ID NO: 1058655 - protein, 27 aa, Mycobacterium
YALRSVNMFAPWIRRIFIATDSTPPPW

SEQ ID NO: 1058656 - protein, 18 aa, Mycobacterium
YALTLAREGASVVVNDLG

SEQ ID NO: 1058657 - protein, 19 aa, Mycobacterium
YAMCTPLPRQGEVEDVANM

SEQ ID NO: 1058658 - protein, 22 aa, Mycobacterium
YAMVRWKNVLRQAAVYGACRKW

SEQ ID NO: 1058659 - protein, 19 aa, Mycobacterium
YANYLPRYLRGISDDADAL

SEQ ID NO: 1058660 - protein, 18 aa, Mycobacterium
YAPLPWLPDDSYRQVVTE

SEQ ID NO: 1058661 - protein, 17 aa, Mycobacterium
YARAMLTAWAADPNSPM

SEQ ID NO: 1058662 - protein, 19 aa, Mycobacterium
YARHTGGTFVFRIEDTDAA

SEQ ID NO: 1058663 - protein, 18 aa, Mycobacterium
YARQRPRVLSDWLDGGRG

SEQ ID NO: 1058664 - protein, 25 aa, Mycobacterium
YARRTWRIRPRDWLHHKGVSPAAQR

SEQ ID NO: 1058665 - protein, 20 aa, Mycobacterium
YARVDGRPVGVVANQPMHMS

SEQ ID NO: 1058666 - protein, 19 aa, Mycobacterium
YASGAARDIVARACALGVT

SEQ ID NO: 1058667 - protein, 25 aa, Mycobacterium
YASGGRGGDATIRTSGGGTITGGTA

SEQ ID NO: 1058668 - protein, 23 aa, Mycobacterium
YASLNFPSFLPGFAGQRLQQVTK

SEQ ID NO: 1058669 - protein, 18 aa, Mycobacterium
YASMFAALGTKVTVVEKR

SEQ ID NO: 1058670 - protein, 24 aa, Mycobacterium
YASRQAREAYRWMRANQPVFRDRN

SEQ ID NO: 1058671 - protein, 25 aa, Mycobacterium
YATALRRYRFGSGVAKVDFVLNGDI

SEQ ID NO: 1058672 - protein, 21 aa, Mycobacterium
YAVDLRFLLSPPVGATESTNP

SEQ ID NO: 1058673 - protein, 17 aa, Mycobacterium
YAVHLRRALVLYCFTLP

SEQ ID NO: 1058674 - protein, 20 aa, Mycobacterium
YAVHPWGLYLARPTPGRAQF

SEQ ID NO: 1058675 - protein, 17 aa, Mycobacterium
YAVLAQESVRCRRRGVN

SEQ ID NO: 1058676 - protein, 18 aa, Mycobacterium
YAVNNSFGFGGHNVAITF

SEQ ID NO: 1058677 - protein, 20 aa, Mycobacterium
YAVVDGEIWLETKAKSQKAV

SEQ ID NO: 1058678 - protein, 17 aa, Mycobacterium
YAYQRPAPIETFPVLSQ

SEQ ID NO: 1058679 - protein, 19 aa, Mycobacterium
YCHAGGFALGNLDTDHRQC

SEQ ID NO: 1058680 - protein, 18 aa, Mycobacterium
YCRRGDENLCPKSLYTGW

SEQ ID NO: 1058681 - protein, 19 aa, Mycobacterium
YCRRYRPAARRPQPIDTGV

SEQ ID NO: 1058682 - protein, 20 aa, Mycobacterium
YDAATLRALVDVGAHNGFQA

SEQ ID NO: 1058683 - protein, 17 aa, Mycobacterium
YDDAAGVTARFNRNVLA

SEQ ID NO: 1058684 - protein, 19 aa, Mycobacterium
YDDVVAWRDGHRYVTQLCR

SEQ ID NO: 1058685 - protein, 21 aa, Mycobacterium
YDEARAIALQMERLITDIGQY

SEQ ID NO: 1058686 - protein, 18 aa, Mycobacterium
YDEPWGWMQPTRHAYGAL

SEQ ID NO: 1058687 - protein, 17 aa, Mycobacterium
YDHFTPFVFTQLEELGF

SEQ ID NO: 1058688 - protein, 17 aa, Mycobacterium
YDHVAPIETFEQAVKIL

SEQ ID NO: 1058689 - protein, 17 aa, Mycobacterium
YDIPGNIEMSEWLAYLE

SEQ ID NO: 1058690 - protein, 22 aa, Mycobacterium
YDIYRGVVTYVRVVDGKITPRE

SEQ ID NO: 1058691 - protein, 22 aa, Mycobacterium
YDKYHAGIVFHRGAGRTAPAGP

SEQ ID NO: 1058692 - protein, 20 aa, Mycobacterium
YDLFARKVIPYFKGQLEAPR

SEQ ID NO: 1058693 - protein, 19 aa, Mycobacterium
YDLGGGHPLLGRRMPDLDL

SEQ ID NO: 1058694 - protein, 17 aa, Mycobacterium
YDLNLFLSGIEQAINGD

SEQ ID NO: 1058695 - protein, 17 aa, Mycobacterium
YDLSSLRVVFAGGEALP

SEQ ID NO: 1058696 - protein, 24 aa, Mycobacterium
YDPWFAKARTSGAIEAREMDEGML

SEQ ID NO: 1058697 - protein, 17 aa, Mycobacterium
YDRAIGYEAAYAGTSFA

SEQ ID NO: 1058698 - protein, 18 aa, Mycobacterium
YDRRRGRLVGALIVDDDS

SEQ ID NO: 1058699 - protein, 22 aa, Mycobacterium
YDRRWLHEQGIALTMSDLRFLK

SEQ ID NO: 1058700 - protein, 19 aa, Mycobacterium
YDRRYGLDDTHLRSIAQLN

SEQ ID NO: 1058701 - protein, 17 aa, Mycobacterium
YDSDKGFGFLSQEEGED

SEQ ID NO: 1058702 - protein, 23 aa, Mycobacterium
YDSFPRSDIVTVIIGAENWREDL

SEQ ID NO: 1058703 - protein, 19 aa, Mycobacterium
YDSSIAPGAWEAVAAARFR

SEQ ID NO: 1058704 - protein, 19 aa, Mycobacterium
YDTGLSLAAVCALEPYWEA

SEQ ID NO: 1058705 - protein, 36 aa, Mycobacterium; identical to SEQ ID NO: 755247

SEQ ID NO: 1058706 - protein, 25 aa, Mycobacterium
YEAFDRWGLMPRMFVGAAERDLTVE

SEQ ID NO: 1058707 - protein, 30 aa, Mycobacterium; identical to SEQ ID NO: 619998

SEQ ID NO: 1058708 - protein, 19 aa, Mycobacterium
YEAMWAADVAAMVGYHGGA

SEQ ID NO: 1058709 - protein, 20 aa, Mycobacterium
YECAVPVIAAVNGFCVGGGI

SEQ ID NO: 1058710 - protein, 17 aa, Mycobacterium
YEDEPAYLAVLDALRPF

SEQ ID NO: 1058711 - protein, 21 aa, Mycobacterium
YEDRPTLVLPGSGKTITGTAV

SEQ ID NO: 1058712 - protein, 17 aa, Mycobacterium
YEEKFGYVYLVCATGRS

SEQ ID NO: 1058713 - protein, 20 aa, Mycobacterium
YEELNLLVAPMVRTGAEPIG

SEQ ID NO: 1058714 - protein, 18 aa, Mycobacterium
YEGLTANEALYDWNYQHQ

SEQ ID NO: 1058715 - protein, 24 aa, Mycobacterium
YEHGNRLRCYVVGVSRGSREPLIT

SEQ ID NO: 1058716 - protein, 28 aa, Mycobacterium
YEHPYPHCWRCRNPLIYRAVSSWFVTVT

SEQ ID NO: 1058717 - protein, 18 aa, Mycobacterium
YEILGPLPRKNIDTGMGV

SEQ ID NO: 1058718 - protein, 24 aa, Mycobacterium
YELDRIGARLSEPIRIALAGTLKA

SEQ ID NO: 1058719 - protein, 17 aa, Mycobacterium
YELGRLGRQAMLLDATT

SEQ ID NO: 1058720 - protein, 32 aa, Mycobacterium; identical to SEQ ID NO: 755353

SEQ ID NO: 1058721 - protein, 19 aa, Mycobacterium
YEPGMPVWSMDGGAVEAHI

SEQ ID NO: 1058722 - protein, 18 aa, Mycobacterium
YEQLRAGIGAVFASWNSP

SEQ ID NO: 1058723 - protein, 26 aa, Mycobacterium
YERALELGCGTGFFLLNLIQAGVARR

SEQ ID NO: 1058724 - protein, 24 aa, Mycobacterium
YERFAGLVSPSLGKTFWGATPDNY

SEQ ID NO: 1058725 - protein, 18 aa, Mycobacterium
YERLGIPTIATVPWTTDR

SEQ ID NO: 1058726 - protein, 21 aa, Mycobacterium
YERNIACTRLPALRESMRRSL

SEQ ID NO: 1058727 - protein, 19 aa, Mycobacterium
YERVGKRGLGFGAEVRSKA

SEQ ID NO: 1058728 - protein, 18 aa, Mycobacterium
YESLLKGGTFGVGTLPIP

SEQ ID NO: 1058729 - protein, 17 aa, Mycobacterium
YETKKGHVIRFLEAGSK

SEQ ID NO: 1058730 - protein, 21 aa, Mycobacterium
YETRIRLLIIRSGLPAPQTEI

SEQ ID NO: 1058731 - protein, 22 aa, Mycobacterium
YEVGARLAGARVQWADSLTQLG

SEQ ID NO: 1058732 - protein, 27 aa, Mycobacterium
YEVKGCIAHGGMGWIYLALDRNVNDRP

SEQ ID NO: 1058733 - protein, 25 aa, Mycobacterium
YEVVNRLKPGIIMCREKQDSTSAVL

SEQ ID NO: 1058734 - protein, 24 aa, Mycobacterium
YEWPADRQSLSWTLQSSSLLKALE

SEQ ID NO: 1058735 - protein, 28 aa, Mycobacterium
YEYPEGKRAGLWPGLRETFKSGTSEPPL

SEQ ID NO: 1058736 - protein, 22 aa, Mycobacterium
YFCELYDLRTLWHVAAHNPWLS

SEQ ID NO: 1058737 - protein, 20 aa, Mycobacterium
YFEMLGRPWRDARRLTVPGV

SEQ ID NO: 1058738 - protein, 18 aa, Mycobacterium
YFFRDGRGPGGVRPPNNW

SEQ ID NO: 1058739 - protein, 21 aa, Mycobacterium
YFGAVIFQLGTLFAQQLLPDA

SEQ ID NO: 1058740 - protein, 31 aa, Mycobacterium; identical to SEQ ID NO: 755488

SEQ ID NO: 1058741 - protein, 24 aa, Mycobacterium
YFRTKRWPDVLAQFPEATPWRHPE

SEQ ID NO: 1058742 - protein, 20 aa, Mycobacterium
YFTRMLAGLGDALGFDVDTP

SEQ ID NO: 1058743 - protein, 23 aa, Mycobacterium
YGACPECSGLGIRKEVDPDLVVP

SEQ ID NO: 1058744 - protein, 23 aa, Mycobacterium
YGAECATWRNFFLSGATELAAGN

SEQ ID NO: 1058745 - protein, 19 aa, Mycobacterium
YGAGLARYLHEQGVEVLEV

SEQ ID NO: 1058746 - protein, 17 aa, Mycobacterium
YGAMAIFVGNSSATGIL

SEQ ID NO: 1058747 - protein, 25 aa, Mycobacterium
YGAVLPLPMVSWLYEYGNYRRFTHT

SEQ ID NO: 1058748 - protein, 20 aa, Mycobacterium
YGCTNLVLIRVHAGNDEAAL

SEQ ID NO: 1058749 - protein, 27 aa, Mycobacterium
YGDPGGLPVIFSHGFADSAVIRNPDDD

SEQ ID NO: 1058750 - protein, 18 aa, Mycobacterium
YGDRCAGGVIKPGESLIF

SEQ ID NO: 1058751 - protein, 23 aa, Mycobacterium
YGEGMANFFRMVHLAGVTTCLDM

SEQ ID NO: 1058752 - protein, 17 aa, Mycobacterium
YGGFALVLGLVIGEDQT

SEQ ID NO: 1058753 - protein, 19 aa, Mycobacterium
YGGIATRLVMYNALGDPGR

SEQ ID NO: 1058754 - protein, 24 aa, Mycobacterium
YGGMKLDLQLTVPLDYYKKFMSVN

SEQ ID NO: 1058755 - protein, 18 aa, Mycobacterium
YGGQGLAYEYQRAFDEES

SEQ ID NO: 1058756 - protein, 17 aa, Mycobacterium
YGGSPAQAAALCPDGVG

SEQ ID NO: 1058757 - protein, 26 aa, Mycobacterium
YGIVGLKTHCKTCLVVRREGPTIRRY

SEQ ID NO: 1058758 - protein, 26 aa, Mycobacterium
YGKISSRGLPHWADPGARRPGEINHR

SEQ ID NO: 1058759 - protein, 31 aa, Mycobacterium
YGKTPTQVLLRWNLQLGNAVIFGSSNAEHIV

SEQ ID NO: 1058760 - protein, 25 aa, Mycobacterium
YGLAWRTKRLIVFDVDSTLVQGEVI

SEQ ID NO: 1058761 - protein, 19 aa, Mycobacterium
YGLLRARQAFRDISEARPT

SEQ ID NO: 1058762 - protein, 27 aa, Mycobacterium
YGLPRAAFKPSYGIAEATLLVATIDHA

SEQ ID NO: 1058763 - protein, 17 aa, Mycobacterium
YGLRRYVEFNSLVDRAY

SEQ ID NO: 1058764 - protein, 19 aa, Mycobacterium
YGLTYPGVGFVVWRSPEYL

SEQ ID NO: 1058765 - protein, 24 aa, Mycobacterium
YGMAEITLAVAFSECGAGLVVDEV

SEQ ID NO: 1058766 - protein, 17 aa, Mycobacterium
YGNITVLQWLSPLPGGS

SEQ ID NO: 1058767 - protein, 19 aa, Mycobacterium
YGPPRRWLVVTGTNGKTTT

SEQ ID NO: 1058768 - protein, 19 aa, Mycobacterium
YGQAFRGCTALWRRDQKLF

SEQ ID NO: 1058769 - protein, 17 aa, Mycobacterium
YGQALAESEIQPLGRPD

SEQ ID NO: 1058770 - protein, 17 aa, Mycobacterium
YGQALAESEVQPIGQPE

SEQ ID NO: 1058771 - protein, 20 aa, Mycobacterium
YGQHVALDFVARIRGQKKFA

SEQ ID NO: 1058772 - protein, 28 aa, Mycobacterium
YGRGFPFSLVFARLYAARGYHVVLQSVR

SEQ ID NO: 1058773 - protein, 23 aa, Mycobacterium
YGRLRRGQTLFTYLHLAASRPCT

SEQ ID NO: 1058774 - protein, 24 aa, Mycobacterium
YGSASILPITWAYIRMMGADGLRA

SEQ ID NO: 1058775 - protein, 20 aa, Mycobacterium
YGSLELMTSVLMTADGKTVE

SEQ ID NO: 1058776 - protein, 17 aa, Mycobacterium
YGTVAWDVRAIWENYSG

SEQ ID NO: 1058777 - protein, 27 aa, Mycobacterium
YGVTGYDWETCWRDYRLGMPHTVLISA

SEQ ID NO: 1058778 - protein, 23 aa, Mycobacterium
YHALTWGPLMREIIWATTRKEIR

SEQ ID NO: 1058779 - protein, 18 aa, Mycobacterium
YHAYPAHAAFGGYKQSGI

SEQ ID NO: 1058780 - protein, 23 aa, Mycobacterium
YHDTEIIRWLFTPDPSLTVTRDG

SEQ ID NO: 1058781 - protein, 24 aa, Mycobacterium
YHERRAVGIGSEFASGAGSEGGHA

SEQ ID NO: 1058782 - protein, 19 aa, Mycobacterium
YHGGGWALGDLDTHDAVCR

SEQ ID NO: 1058783 - protein, 19 aa, Mycobacterium
YHGKGEFGQFLARLAEKST

SEQ ID NO: 1058784 - protein, 18 aa, Mycobacterium
YHGYPWLIHRLAYRRANH

SEQ ID NO: 1058785 - protein, 17 aa, Mycobacterium
YHIKGVIGPDEFHSGYP

SEQ ID NO: 1058786 - protein, 17 aa, Mycobacterium
YHLMGFDIGSFTPIFVM

SEQ ID NO: 1058787 - protein, 29 aa, Mycobacterium
YHLTTLFPPVRPRQWLEIRYLDSLSNVFW

SEQ ID NO: 1058788 - protein, 17 aa, Mycobacterium
YHLVSLLCYNLDPVQPV

SEQ ID NO: 1058789 - protein, 24 aa, Mycobacterium
YHNRRMPYTIGLLGSVPRLDATQG

SEQ ID NO: 1058790 - protein, 17 aa, Mycobacterium
YHPFEMAARGKKLTFET

SEQ ID NO: 1058791 - protein, 25 aa, Mycobacterium
YHQPCADGLVRVCRPGGVIGLISWT

SEQ ID NO: 1058792 - protein, 20 aa, Mycobacterium
YHQRCWLRQLTPYASREQEN

SEQ ID NO: 1058793 - protein, 31 aa, Mycobacterium; identical to SEQ ID NO: 624684

SEQ ID NO: 1058794 - protein, 25 aa, Mycobacterium
YHREIAMNMGMDGAWGQWVNRWTAE

SEQ ID NO: 1058795 - protein, 17 aa, Mycobacterium
YHRNGWDQTPTVAEIAG

SEQ ID NO: 1058796 - protein, 25 aa, Mycobacterium
YHTVWFELHEELILAVGLTREQAAR

SEQ ID NO: 1058797 - protein, 23 aa, Mycobacterium
YHYYASKSLILFDIYRQAAEGTL

SEQ ID NO: 1058798 - protein, 20 aa, Mycobacterium
YIAEYRRRAGITTETGTHLD

SEQ ID NO: 1058799 - protein, 25 aa, Mycobacterium
YIARACRCAGAALIHVSTDYVFSGD

SEQ ID NO: 1058800 - protein, 26 aa, Mycobacterium
YIARACRCAGAALIHVSTDYVFSGDF

SEQ ID NO: 1058801 - protein, 20 aa, Mycobacterium
YIATSGWHDPEWGVMRILIL

SEQ ID NO: 1058802 - protein, 21 aa, Mycobacterium
YIGCQSFSGGVIIRLDTDNSA

SEQ ID NO: 1058803 - protein, 20 aa, Mycobacterium
YIISMCWSVSDMLEAAVLLK

SEQ ID NO: 1058804 - protein, 36 aa, Mycobacterium
YIPLLIVASLPNFARRLPMLRGWVADLLDRDARDRA

SEQ ID NO: 1058805 - protein, 19 aa, Mycobacterium
YIRRRSGIDPVVYEHPSME

SEQ ID NO: 1058806 - protein, 25 aa, Mycobacterium
YISPSGRLTVVEFGGGVGGGGGAGG

SEQ ID NO: 1058807 - protein, 18 aa, Mycobacterium
YISYLRKKIDADREPMIH

SEQ ID NO: 1058808 - protein, 19 aa, Mycobacterium
YKAVRPARGRSVAVDADDE

SEQ ID NO: 1058809 - protein, 32 aa, Mycobacterium
YKELARHVQLPGFRPGKVPARLLEARFGRETL

SEQ ID NO: 1058810 - protein, 18 aa, Mycobacterium
YKGISIPTASRINGVRGG

SEQ ID NO: 1058811 - protein, 17 aa, Mycobacterium
YKGKIAVATFFAKNMLP

SEQ ID NO: 1058812 - protein, 21 aa, Mycobacterium
YKIELRDAVDLAQQRGVVAAE

SEQ ID NO: 1058813 - protein, 18 aa, Mycobacterium
YKLAAQRLNMHFNTVKYR

SEQ ID NO: 1058814 - protein, 22 aa, Mycobacterium
YKMVFGHRGINIPVIDHATGRV

SEQ ID NO: 1058815 - protein, 18 aa, Mycobacterium
YKRAFRIAGSGPAILLIH

SEQ ID NO: 1058816 - protein, 23 aa, Mycobacterium
YKSYRGMGSLGAMQGRGGAKSYS

SEQ ID NO: 1058817 - protein, 17 aa, Mycobacterium
YKVAVGDVVKVEKLESE

SEQ ID NO: 1058818 - protein, 36 aa, Mycobacterium; identical to SEQ ID NO: 756007

SEQ ID NO: 1058819 - protein, 19 aa, Mycobacterium
YKVSARGGLLLYGPPGCGK

SEQ ID NO: 1058820 - protein, 28 aa, Mycobacterium
YLALLDALRWLGLDWDEGPEVDGPYGPY

SEQ ID NO: 1058821 - protein, 19 aa, Mycobacterium
YLAPGFHGVHIHKVGKCEA

SEQ ID NO: 1058822 - protein, 20 aa, Mycobacterium
YLDALAYARRVMGLPATTVN

SEQ ID NO: 1058823 - protein, 19 aa, Mycobacterium
YLDMPRQYGALIGLVQGLL

SEQ ID NO: 1058824 - protein, 17 aa, Mycobacterium
YLEEVVFSHLDRPFLTY

SEQ ID NO: 1058825 - protein, 18 aa, Mycobacterium
YLEGLAWTAGANGNLRRA

SEQ ID NO: 1058826 - protein, 17 aa, Mycobacterium
YLFEPIVQSGLFNTLDW

SEQ ID NO: 1058827 - protein, 24 aa, Mycobacterium
YLFKHPKVDFIWVTGGPKIVALAN

SEQ ID NO: 1058828 - protein, 18 aa, Mycobacterium
YLGAPWKTQRTVNRVRGL

SEQ ID NO: 1058829 - protein, 22 aa, Mycobacterium
YLHCGPTGAGHFVKMVHNGIEY

SEQ ID NO: 1058830 - protein, 21 aa, Mycobacterium
YLKRLTAGLRRTRRRVAELED

SEQ ID NO: 1058831 - protein, 25 aa, Mycobacterium
YLLAAREITARHGALLVLDEVQTGI

SEQ ID NO: 1058832 - protein, 19 aa, Mycobacterium
YLLDPRVVDGTSWITGADE

SEQ ID NO: 1058833 - protein, 18 aa, Mycobacterium
YLLEETYELLDAVHSGSV

SEQ ID NO: 1058834 - protein, 18 aa, Mycobacterium
YLMFSVFSVRPGELGDHR

SEQ ID NO: 1058835 - protein, 23 aa, Mycobacterium
YLMPDGVVQYVFKRRLYRGPHGV

SEQ ID NO: 1058836 - protein, 23 aa, Mycobacterium
YLMVSLRSLPLVMLIGRPEARIP

SEQ ID NO: 1058837 - protein, 18 aa, Mycobacterium
YLNPFPANLGEVLRRYPQ

SEQ ID NO: 1058838 - protein, 18 aa, Mycobacterium
YLRGACRVAFDAPLVVAN

SEQ ID NO: 1058839 - protein, 24 aa, Mycobacterium
YLRMDDFPARLVIVPGTQDRLAEA

SEQ ID NO: 1058840 - protein, 25 aa, Mycobacterium
YLRPDELHLGFNFRLARTDFDAAEI

SEQ ID NO: 1058841 - protein, 17 aa, Mycobacterium
YLSDWRCRNPSSTGSSV

SEQ ID NO: 1058842 - protein, 27 aa, Mycobacterium
YLSGAKLDVIVPMSFLCDGYGLNVTLV

SEQ ID NO: 1058843 - protein, 19 aa, Mycobacterium
YLTQAIPVQIIWGSRDAVV

SEQ ID NO: 1058844 - protein, 24 aa, Mycobacterium
YLTQCCYTVHTIFDVKPETDVFWC

SEQ ID NO: 1058845 - protein, 26 aa, Mycobacterium
YLVHLRLPCRGRDSTEGFGLHAVPVP

SEQ ID NO: 1058846 - protein, 22 aa, Mycobacterium
YLVSLPAAHNFPLACPGILGSM

SEQ ID NO: 1058847 - protein, 19 aa, Mycobacterium
YLYRDGSDFVFMDSQDYEQ

SEQ ID NO: 1058848 - protein, 19 aa, Mycobacterium
YMHGGAFLKGGIHSHARLA

SEQ ID NO: 1058849 - protein, 18 aa, Mycobacterium
YMIGSSFGSIIGSLVARC

SEQ ID NO: 1058850 - protein, 25 aa, Mycobacterium
YMIPSPHLPLLDPVRAIPVIGTPIA

SEQ ID NO: 1058851 - protein, 25 aa, Mycobacterium
YMLGSRSALAWIIDRYQVKTDKASG

SEQ ID NO: 1058852 - protein, 17 aa, Mycobacterium
YMRGVPVERIYRDVRLL

SEQ ID NO: 1058853 - protein, 17 aa, Mycobacterium
YMSKIFNDAWMSSYGFL

SEQ ID NO: 1058854 - protein, 25 aa, Mycobacterium
YNASLPTKFMPAPGYSAYIAPDKYA

SEQ ID NO: 1058855 - protein, 23 aa, Mycobacterium
YNGCGVVAMFFGLRQALRFKLRQ

SEQ ID NO: 1058856 - protein, 19 aa, Mycobacterium
YNGKCLRASAGSIFAIPVI

SEQ ID NO: 1058857 - protein, 17 aa, Mycobacterium
YNGMLYFGINADRDAMS

SEQ ID NO: 1058858 - protein, 17 aa, Mycobacterium
YNHYAVGWAHALCAPYQ

SEQ ID NO: 1058859 - protein, 31 aa, Mycobacterium; identical to SEQ ID NO: 756373

SEQ ID NO: 1058860 - protein, 26 aa, Mycobacterium
YNPDYLPGTLLPPGIRATADAAEALA

SEQ ID NO: 1058861 - protein, 17 aa, Mycobacterium
YNPGHLMVVPYRRVSEL

SEQ ID NO: 1058862 - protein, 19 aa, Mycobacterium
YNPLWPNIDELVGLLESGV

SEQ ID NO: 1058863 - protein, 17 aa, Mycobacterium
YNQAFGAVSGVGGAGGA

SEQ ID NO: 1058864 - protein, 17 aa, Mycobacterium
YNQHLYDAATLRALVDV

SEQ ID NO: 1058865 - protein, 17 aa, Mycobacterium
YNRPYSCYAPIMETPWL

SEQ ID NO: 1058866 - protein, 20 aa, Mycobacterium
YNSYLRYGGLGWLRQHQPHV

SEQ ID NO: 1058867 - protein, 24 aa, Mycobacterium
YNVSNCLLALAILDAVGVSPEQAA

SEQ ID NO: 1058868 - protein, 23 aa, Mycobacterium
YPAAVTVGEVWVHDNARWAQYLR

SEQ ID NO: 1058869 - protein, 19 aa, Mycobacterium
YPAGVWVIDIGELRDGALL

SEQ ID NO: 1058870 - protein, 20 aa, Mycobacterium
YPAPPRIRRAGARARARDPA

SEQ ID NO: 1058871 - protein, 20 aa, Mycobacterium
YPDAPKLPAVVGYEVAGTVE

SEQ ID NO: 1058872 - protein, 21 aa, Mycobacterium
YPDERAKWWSDFDGLAATAVE

SEQ ID NO: 1058873 - protein, 23 aa, Mycobacterium
YPDRSGGVLPGYGGSKAALEHLT

SEQ ID NO: 1058874 - protein, 17 aa, Mycobacterium
YPGAPGQWWQQQVVLGL

SEQ ID NO: 1058875 - protein, 18 aa, Mycobacterium
YPGGCTTQSIVMRSKSGT

SEQ ID NO: 1058876 - protein, 18 aa, Mycobacterium
YPGGEIDLQIAHATEGAD

SEQ ID NO: 1058877 - protein, 18 aa, Mycobacterium
YPGRVRELLQLVSQLHSH

SEQ ID NO: 1058878 - protein, 24 aa, Mycobacterium
YPGVFRPSAAIAMAACCATGRSCP

SEQ ID NO: 1058879 - protein, 20 aa, Mycobacterium
YPGWPGLPGDVGYQDGTGGG

SEQ ID NO: 1058880 - protein, 19 aa, Mycobacterium
YPLLGPWGSARVFSPQKGA

SEQ ID NO: 1058881 - protein, 17 aa, Mycobacterium
YPMVYDMPARAKEAFGT

SEQ ID NO: 1058882 - protein, 17 aa, Mycobacterium
YPPEGFGAPKNRRGHAS

SEQ ID NO: 1058883 - protein, 19 aa, Mycobacterium
YPPGMGIPALRQAIAAQRR

SEQ ID NO: 1058884 - protein, 26 aa, Mycobacterium
YPPLRMMFDRCVEFLPALRSAAPDVI

SEQ ID NO: 1058885 - protein, 20 aa, Mycobacterium
YPPPGSRGRMEGLLVDLWDA

SEQ ID NO: 1058886 - protein, 21 aa, Mycobacterium
YPPQFWPLTSGLTLNQSVAEG

SEQ ID NO: 1058887 - protein, 21 aa, Mycobacterium
YPRELPFVIGSEVCGTVVAVG

SEQ ID NO: 1058888 - protein, 22 aa, Mycobacterium
YPRETIWRPPVLTMSAVEGTGL

SEQ ID NO: 1058889 - protein, 22 aa, Mycobacterium
YPSIGCAPCTAKPAVGEDPRSG

SEQ ID NO: 1058890 - protein, 20 aa, Mycobacterium
YPSIGCAPCTVKPAAGADPR

SEQ ID NO: 1058891 - protein, 23 aa, Mycobacterium
YPSTEFVELRPRLVYDRGTGTLT

SEQ ID NO: 1058892 - protein, 20 aa, Mycobacterium
YPTLCRLFAELGVATQESEM

SEQ ID NO: 1058893 - protein, 18 aa, Mycobacterium
YPTPGHAVGLSFSVAPDV

SEQ ID NO: 1058894 - protein, 17 aa, Mycobacterium
YPTPVALATHLGQLLSG

SEQ ID NO: 1058895 - protein, 21 aa, Mycobacterium
YPVTTLRLAMYAVEAGLREIA

SEQ ID NO: 1058896 - protein, 25 aa, Mycobacterium
YPVVRRILDRTGVALAEIIGDERSL

SEQ ID NO: 1058897 - protein, 25 aa, Mycobacterium
YPYRDAYLLRDARLFRSELSMPLIL

SEQ ID NO: 1058898 - protein, 20 aa, Mycobacterium
YPYYRRLRNEAPLYHNQELG

SEQ ID NO: 1058899 - protein, 26 aa, Mycobacterium
YQAAMFDGRFVGFADFLIRDRERYRI

SEQ ID NO: 1058900 - protein, 35 aa, Mycobacterium
YQAEIDAPCELVDFWRFNVAFTRQILDQQPVSAKG

SEQ ID NO: 1058901 - protein, 32 aa, Mycobacterium
YQALSAQMAAFHDRFMNALAGASGSYASAEAA

SEQ ID NO: 1058902 - protein, 26 aa, Mycobacterium
YQDKALEGFTMFALNQGEVCTCPSRG

SEQ ID NO: 1058903 - protein, 21 aa, Mycobacterium
YQDPFLAKGFDPIGDRYDSED

SEQ ID NO: 1058904 - protein, 26 aa, Mycobacterium
YQELSARAALFHDEFVRVLSAGADAY

SEQ ID NO: 1058905 - protein, 19 aa, Mycobacterium
YQFADHVRYLDAWFEAVGI

SEQ ID NO: 1058906 - protein, 30 aa, Mycobacterium
YQGSVREACLWSRGLAAAGVRRRASILDSG

SEQ ID NO: 1058907 - protein, 27 aa, Mycobacterium
YQINYLRCIGCGLCIEACPTRALTMTN

SEQ ID NO: 1058908 - protein, 17 aa, Mycobacterium
YQKLTGLENLQFFASLY

SEQ ID NO: 1058909 - protein, 17 aa, Mycobacterium
YQLIPTDAATGWEPVTG

SEQ ID NO: 1058910 - protein, 26 aa, Mycobacterium
YQPMCKRLVMSSGFYRAIQRDDVELV

SEQ ID NO: 1058911 - protein, 18 aa, Mycobacterium
YQPTEEWIRADAAENYDR

SEQ ID NO: 1058912 - protein, 17 aa, Mycobacterium
YQQRLGRKVRFMAKQEV

SEQ ID NO: 1058913 - protein, 26 aa, Mycobacterium
YQRALDEWRLLSAAALVGLVEATMEI

SEQ ID NO: 1058914 - protein, 20 aa, Mycobacterium
YQRARAGAAGARVVLIDGTG

SEQ ID NO: 1058915 - protein, 18 aa, Mycobacterium
YQRIFDRLRVRYVIVSAV

SEQ ID NO: 1058916 - protein, 21 aa, Mycobacterium
YQRLRDLGIAILREVGVDTGG

SEQ ID NO: 1058917 - protein, 23 aa, Mycobacterium
YQRYPRCRWDVALRRDYQRAAFE

SEQ ID NO: 1058918 - protein, 27 aa, Mycobacterium
YQTLGIAAARFHDEFVGNLRAAATSYA

SEQ ID NO: 1058919 - protein, 17 aa, Mycobacterium
YQVPLWPERLLTRDNAE

SEQ ID NO: 1058920 - protein, 22 aa, Mycobacterium
YRAERYLGIIERVRAAMPHAAI

SEQ ID NO: 1058921 - protein, 17 aa, Mycobacterium
YRAGFVAGDPDLVAELL

SEQ ID NO: 1058922 - protein, 17 aa, Mycobacterium
YRAGGLLRELGHEVINR

SEQ ID NO: 1058923 - protein, 25 aa, Mycobacterium
YRAGRDIKAGRVWTNCYHAYPAHAA

SEQ ID NO: 1058924 - protein, 22 aa, Mycobacterium
YRAPRRRWGSLLGIQPDGLEVF

SEQ ID NO: 1058925 - protein, 21 aa, Mycobacterium
YRCPIGQRLVVRGRIGTLLRY

SEQ ID NO: 1058926 - protein, 29 aa, Mycobacterium
YRDAAGYAYFAGRLGDWMRVDGENLGTAP

SEQ ID NO: 1058927 - protein, 18 aa, Mycobacterium
YRDMLRQRVAPLVAKHRL

SEQ ID NO: 1058928 - protein, 25 aa, Mycobacterium
YRELEAMPDLVARVISAIKPVAHLA

SEQ ID NO: 1058929 - protein, 19 aa, Mycobacterium
YRETLGFEVLPLSGGAEPP

SEQ ID NO: 1058930 - protein, 18 aa, Mycobacterium
YRFSAFRSAKTAPKDAGL

SEQ ID NO: 1058931 - protein, 21 aa, Mycobacterium
YRGDAAYDWIRSELENLGVTT

SEQ ID NO: 1058932 - protein, 19 aa, Mycobacterium
YRGKLWTFRQYSGFGTAEE

SEQ ID NO: 1058933 - protein, 18 aa, Mycobacterium
YRGPSARNRVMFGPPGRL

SEQ ID NO: 1058934 - protein, 22 aa, Mycobacterium
YRGQWVAARAMELLQGWERRPI

SEQ ID NO: 1058935 - protein, 20 aa, Mycobacterium
YRIECGEVTAALTTLDGVDQ

SEQ ID NO: 1058936 - protein, 23 aa, Mycobacterium
YRISEAGLGRFLAALPSPMALTA

SEQ ID NO: 1058937 - protein, 27 aa, Mycobacterium
YRISEFAEIIGFYGLSYWYPFQVTALG

SEQ ID NO: 1058938 - protein, 17 aa, Mycobacterium
YRITFTGGPNFAYDLCA

SEQ ID NO: 1058939 - protein, 17 aa, Mycobacterium
YRITPLALWNARAAGHD

SEQ ID NO: 1058940 - protein, 19 aa, Mycobacterium
YRLGMPHTVLISALGFAFA

SEQ ID NO: 1058941 - protein, 17 aa, Mycobacterium
YRLLPSRFVAALAAAGP

SEQ ID NO: 1058942 - protein, 18 aa, Mycobacterium
YRLNWPPEAVVFEIDQPK

SEQ ID NO: 1058943 - protein, 17 aa, Mycobacterium
YRLTPRTGRTHQLRVHM

SEQ ID NO: 1058944 - protein, 19 aa, Mycobacterium
YRLWPRVVAEAARQVPHPV

SEQ ID NO: 1058945 - protein, 18 aa, Mycobacterium
YRNLLVAPYGIRRGIIER

SEQ ID NO: 1058946 - protein, 19 aa, Mycobacterium
YRNLLVAPYGIRRGIIERV

SEQ ID NO: 1058947 - protein, 18 aa, Mycobacterium
YRNTGPEGINPGFMSGFV

SEQ ID NO: 1058948 - protein, 26 aa, Mycobacterium
YRPDEEKLAWARRVLVAARTERGVFA

SEQ ID NO: 1058949 - protein, 17 aa, Mycobacterium
YRPSREDALLCGDFYDV

SEQ ID NO: 1058950 - protein, 24 aa, Mycobacterium
YRPWAGEIRARHTGSLVSDRSGVI

SEQ ID NO: 1058951 - protein, 19 aa, Mycobacterium
YRQASVVRREIGVPTVFNL

SEQ ID NO: 1058952 - protein, 17 aa, Mycobacterium
YRQETIRMFGLPESGLA

SEQ ID NO: 1058953 - protein, 21 aa, Mycobacterium
YRQLDYWARTSLVVPSIRGAA

SEQ ID NO: 1058954 - protein, 27 aa, Mycobacterium
YRRFLERRLRETFGFEGSPIRINVRVR

SEQ ID NO: 1058955 - protein, 18 aa, Mycobacterium
YRRFTHTVLLRLPSGIDR

SEQ ID NO: 1058956 - protein, 24 aa, Mycobacterium
YRRLRAKARIKFLVKDWGVEKFRE

SEQ ID NO: 1058957 - protein, 20 aa, Mycobacterium
YRRLRDFERDAAIVYTSSDD

SEQ ID NO: 1058958 - protein, 30 aa, Mycobacterium; identical to SEQ ID NO: 757072

SEQ ID NO: 1058959 - protein, 17 aa, Mycobacterium
YRRVLAAGVNIVGSGPV

SEQ ID NO: 1058960 - protein, 18 aa, Mycobacterium
YRSALNWLGDNASCVLQA

SEQ ID NO: 1058961 - protein, 20 aa, Mycobacterium
YRSKCAAIARISADGTAEVC

SEQ ID NO: 1058962 - protein, 23 aa, Mycobacterium
YRSREVLELDAAKRWCRAGEVDS

SEQ ID NO: 1058963 - protein, 18 aa, Mycobacterium
YRSVRIGEHTTRILLAKN

SEQ ID NO: 1058964 - protein, 25 aa, Mycobacterium
YRTEGPANPLILVFGRVSELSTCSW

SEQ ID NO: 1058965 - protein, 20 aa, Mycobacterium
YRTGDLVRRNHCGELEFVGR

SEQ ID NO: 1058966 - protein, 19 aa, Mycobacterium
YRTLRLMESNGWVHAKPVV

SEQ ID NO: 1058967 - protein, 18 aa, Mycobacterium
YRVARAVERRGRPIDDER

SEQ ID NO: 1058968 - protein, 17 aa, Mycobacterium
YRVLRPGGVFAGSDGIP

SEQ ID NO: 1058969 - protein, 19 aa, Mycobacterium
YRVVELLGRRNAQESTAQL

SEQ ID NO: 1058970 - protein, 30 aa, Mycobacterium; identical to SEQ ID NO: 757154

SEQ ID NO: 1058971 - protein, 21 aa, Mycobacterium
YRYDDVDVFLRLIADELQGSD

SEQ ID NO: 1058972 - protein, 21 aa, Mycobacterium
YRYFPEPDLEPVAPSRELVEQ

SEQ ID NO: 1058973 - protein, 26 aa, Mycobacterium
YRYFPIEPHWLFPGVQWLPYEARVQI

SEQ ID NO: 1058974 - protein, 20 aa, Mycobacterium
YRYHPLTLRIEQIIASGELG

SEQ ID NO: 1058975 - protein, 18 aa, Mycobacterium
YRYLRALDTKHWDEFADT

SEQ ID NO: 1058976 - protein, 19 aa, Mycobacterium
YRYVDYWGTAVTAFDLHAP

SEQ ID NO: 1058977 - protein, 23 aa, Mycobacterium
YSAAELVNVLPLQNVEQDLLNLV

SEQ ID NO: 1058978 - protein, 18 aa, Mycobacterium
YSAALMVPYGIQLASTLT

SEQ ID NO: 1058979 - protein, 18 aa, Mycobacterium
YSAASCYSSITAGLAGKW

SEQ ID NO: 1058980 - protein, 23 aa, Mycobacterium
YSAPCALTGMTVGQVLDDAEMGP

SEQ ID NO: 1058981 - protein, 21 aa, Mycobacterium
YSAVPRFEHAGGRRVSDERRG

SEQ ID NO: 1058982 - protein, 18 aa, Mycobacterium
YSEPGLATARSFFTPLGM

SEQ ID NO: 1058983 - protein, 18 aa, Mycobacterium
YSFGKSFDRNRLDSLTLG

SEQ ID NO: 1058984 - protein, 19 aa, Mycobacterium
YSGTVTMTLVDLGVSAIDN

SEQ ID NO: 1058985 - protein, 20 aa, Mycobacterium
YSHKRGWEGVIAKRRDSGYQ

SEQ ID NO: 1058986 - protein, 24 aa, Mycobacterium
YSKKFDTACFRWSVDENPSVQQRL

SEQ ID NO: 1058987 - protein, 20 aa, Mycobacterium
YSLTSQWDSGFIGRYTITNS

SEQ ID NO: 1058988 - protein, 17 aa, Mycobacterium
YSMHPGWADTPGVATSL

SEQ ID NO: 1058989 - protein, 18 aa, Mycobacterium
YSPGALRQTIDFYRGSNL

SEQ ID NO: 1058990 - protein, 20 aa, Mycobacterium
YSPLVARLVAEIGFDGVYVS

SEQ ID NO: 1058991 - protein, 22 aa, Mycobacterium
YSPRVEGVHLRFGPVARGGLRW

SEQ ID NO: 1058992 - protein, 19 aa, Mycobacterium
YSPYAWRSVTYRNRDIGVR

SEQ ID NO: 1058993 - protein, 25 aa, Mycobacterium
YSRALLCDFRRSAVEDHWALFTHTQ

SEQ ID NO: 1058994 - protein, 17 aa, Mycobacterium
YSRDAKFSPAREALDNP

SEQ ID NO: 1058995 - protein, 25 aa, Mycobacterium
YSTLQAGPEFARWLDERGPADLPDI

SEQ ID NO: 1058996 - protein, 35 aa, Mycobacterium
YSTPLLKLLLVRAAHATELPYVWGNLGGPQDPTLR

SEQ ID NO: 1058997 - protein, 19 aa, Mycobacterium
YSVPMARFVQTFVRVLGDP

SEQ ID NO: 1058998 - protein, 19 aa, Mycobacterium
YTAKPGAFRRPNGQAFTSH

SEQ ID NO: 1058999 - protein, 20 aa, Mycobacterium
YTCHFIRPGWKLPRRATAGQ

SEQ ID NO: 1059000 - protein, 25 aa, Mycobacterium
YTEEMPIAVPWSLPDAYPVHVGEEA

SEQ ID NO: 1059001 - protein, 17 aa, Mycobacterium
YTGLHFMAAYELEECWQ

SEQ ID NO: 1059002 - protein, 21 aa, Mycobacterium
YTGLHWFRAALDARPVDEAII

SEQ ID NO: 1059003 - protein, 28 aa, Mycobacterium
YTKGYKFSTYATWWIRQAITRAMADQAR

SEQ ID NO: 1059004 - protein, 21 aa, Mycobacterium
YTLRFKDLRTGQRYPDEIADI

SEQ ID NO: 1059005 - protein, 22 aa, Mycobacterium
YTLRLPLDVLVVASANPEDYTN

SEQ ID NO: 1059006 - protein, 32 aa, Mycobacterium
YTNFEELCDILARYDVTFSLGDGLRPGSIADA

SEQ ID NO: 1059007 - protein, 17 aa, Mycobacterium
YTPLAWWGSSTQRLRLG

SEQ ID NO: 1059008 - protein, 17 aa, Mycobacterium
YTPLAWWGSSTQRVRLG

SEQ ID NO: 1059009 - protein, 21 aa, Mycobacterium
YTPRMRVGIHTGRPQRLAADW

SEQ ID NO: 1059010 - protein, 19 aa, Mycobacterium
YTQTLTLWRGVARVDCRTT

SEQ ID NO: 1059011 - protein, 24 aa, Mycobacterium
YTRARICASSGFGVVSIQGDTLAD

SEQ ID NO: 1059012 - protein, 24 aa, Mycobacterium
YTRTLDILERFYGLVLTDCGTGLL

SEQ ID NO: 1059013 - protein, 26 aa, Mycobacterium
YTSADIRALYAFKRLAWWPYSVAMRQ

SEQ ID NO: 1059014 - protein, 25 aa, Mycobacterium
YTSAIAMRYGWTWRTPLLGRFGSGY

SEQ ID NO: 1059015 - protein, 23 aa, Mycobacterium
YTSARPQLTFDRECPGGAGAQVR

SEQ ID NO: 1059016 - protein, 28 aa, Mycobacterium
YVALRRWLLLRLARRYGKVFSVNLPLYG

SEQ ID NO: 1059017 - protein, 21 aa, Mycobacterium
YVCFRRQGFQKTTIVDIARLA

SEQ ID NO: 1059018 - protein, 22 aa, Mycobacterium
YVDAHVPYLTWLTKTSADYAVT

SEQ ID NO: 1059019 - protein, 18 aa, Mycobacterium
YVEAPVYDEFVAKVTEKV

SEQ ID NO: 1059020 - protein, 17 aa, Mycobacterium
YVEFNSLVDRAYWDDEE

SEQ ID NO: 1059021 - protein, 18 aa, Mycobacterium
YVERYMKLLAPEWQIMLD

SEQ ID NO: 1059022 - protein, 21 aa, Mycobacterium
YVERYMKLLAPKWQMMSDPQL

SEQ ID NO: 1059023 - protein, 20 aa, Mycobacterium
YVGALGPRLTRAVAQHADGL

SEQ ID NO: 1059024 - protein, 18 aa, Mycobacterium
YVGALPGRIVRAISEAGS

SEQ ID NO: 1059025 - protein, 18 aa, Mycobacterium
YVGIPILRLHDTIYRKTN

SEQ ID NO: 1059026 - protein, 18 aa, Mycobacterium
YVGPALWPAAKDIAAAID

SEQ ID NO: 1059027 - protein, 20 aa, Mycobacterium
YVHNRLLTLLLFDIGSFAGL

SEQ ID NO: 1059028 - protein, 18 aa, Mycobacterium
YVKNEPQYLLADAGATAL

SEQ ID NO: 1059029 - protein, 23 aa, Mycobacterium
YVLAHPCPMCLGSQELNGGKRAA

SEQ ID NO: 1059030 - protein, 18 aa, Mycobacterium
YVLEWHARVPDWRDYYLG

SEQ ID NO: 1059031 - protein, 23 aa, Mycobacterium
YVLSRIMPPLARWVSAQMAKAAK

SEQ ID NO: 1059032 - protein, 22 aa, Mycobacterium
YVNGKSWLMFGPFAGWSPKFLK

SEQ ID NO: 1059033 - protein, 18 aa, Mycobacterium
YVPQRVVEHLPQRIITAA

SEQ ID NO: 1059034 - protein, 33 aa, Mycobacterium
YVPSLACGRCRAIARCRHCTGPLSLPERGAPGA

SEQ ID NO: 1059035 - protein, 18 aa, Mycobacterium
YVRAAMRAGVPIVPAVSI

SEQ ID NO: 1059036 - protein, 20 aa, Mycobacterium
YVRHCFDAIVPDELFTELPY

SEQ ID NO: 1059037 - protein, 21 aa, Mycobacterium
YVRPQFRRRGLARRLLATLAA

SEQ ID NO: 1059038 - protein, 21 aa, Mycobacterium
YVRRAPLVDGIDEFDADFFGF

SEQ ID NO: 1059039 - protein, 19 aa, Mycobacterium
YVSCASPAAAERAATVLDS

SEQ ID NO: 1059040 - protein, 19 aa, Mycobacterium
YVSDGRFTLGLGASGPQVI

SEQ ID NO: 1059041 - protein, 18 aa, Mycobacterium
YVSMSMVRKNGLRRGDAV

SEQ ID NO: 1059042 - protein, 19 aa, Mycobacterium
YVTDAGPLLARLHKLVRAD

SEQ ID NO: 1059043 - protein, 30 aa, Mycobacterium
YVVGRKALAYYTFRNWYIAQSWTGFSEQPK

SEQ ID NO: 1059044 - protein, 23 aa, Mycobacterium
YVVSGWRADTFVAGTPEPRHDEV

SEQ ID NO: 1059045 - protein, 17 aa, Mycobacterium
YWGIIKANIGIRDGRIV

SEQ ID NO: 1059046 - protein, 24 aa, Mycobacterium
YWNIFKQNIGIMIAVDQLAATQQR

SEQ ID NO: 1059047 - protein, 22 aa, Mycobacterium
YWREAFRLPSMNLRKVAAQIDS

SEQ ID NO: 1059048 - protein, 21 aa, Mycobacterium
YWSDRVYPLLWACVRDRDIVP

SEQ ID NO: 1059049 - protein, 27 aa, Mycobacterium
YYAVTPSGFEWEPGWNPIVVDESTWEP

SEQ ID NO: 1059050 - protein, 17 aa, Mycobacterium
YYLSFLLDRANRTYLAM

SEQ ID NO: 1059051 - protein, 18 aa, Mycobacterium
YYLSFLLDRANRTYLAMC

SEQ ID NO: 1059052 - protein, 26 aa, Mycobacterium
YYPTGGRWNNWAEFFHSDSINNLAYG

SEQ ID NO: 1059053 - protein, 20 aa, Mycobacterium
YYRPELDGLPEMGLVGQQLW

SEQ ID NO: 1059054 - protein, 20 aa, Mycobacterium
YYRYPFRPATIGSYRSALNW

SEQ ID NO: 1059055 - protein, 18 aa, Mycobacterium
TAWNEFIPFLDYDTEIRK

SEQ ID NO: 1059056 - protein, 19 aa, Mycobacterium
PFEHARPTAIMTWMRQHCG

SEQ ID NO: 1059057 - protein, 18 aa, Mycobacterium
PFEHARPTAIMTWMRQHC

SEQ ID NO: 1059058 - protein, 19 aa, Mycobacterium
PFEHARPTAIMTWMRQHWG

SEQ ID NO: 1059059 - protein, 22 aa, Mycobacterium
VMSGRIAYTLGLEGPAITVDTA

SEQ ID NO: 1059060 - protein, 17 aa, Mycobacterium
TAWNEFIPFLDYDTEIR

SEQ ID NO: 1059061 - protein, 21 aa, Mycobacterium
WNVLYCQARPLTLPTYAFQHQ

SEQ ID NO: 1059062 - protein, 18 aa, Mycobacterium
ESAKYCKYWLAVLTELKN

SEQ ID NO: 1059063 - protein, 24 aa, Mycobacterium
AADDVSILLAHFFSGHGRQYQAHA

SEQ ID NO: 1059064 - protein, 19 aa, Mycobacterium
INARVAFVNALPVFIASDP

SEQ ID NO: 1059065 - protein, 20 aa, Mycobacterium
LPFEHARPTAIMTWMRQHCG

SEQ ID NO: 1059066 - protein, 17 aa, Mycobacterium
PTAIMTWMRQHWGIENS

SEQ ID NO: 1059067 - protein, 18 aa, Mycobacterium
AAILASIAFHTRVTADDV

SEQ ID NO: 1059068 - protein, 22 aa, Mycobacterium
AEAYRAISLLLRRPPGREAYPG

SEQ ID NO: 1059069 - protein, 22 aa, Mycobacterium
AEQMKMFLTRLGFGSKVVVTGD

SEQ ID NO: 1059070 - protein, 18 aa, Mycobacterium
AFLGRLALVRIYNGKLRK

SEQ ID NO: 1059071 - protein, 19 aa, Mycobacterium
AKTTFGRIGVKVWIYKGDI

SEQ ID NO: 1059072 - protein, 18 aa, Mycobacterium
ALELARRGSGYGVAALCG

SEQ ID NO: 1059073 - protein, 20 aa, Mycobacterium
ASPPVKWPCFYGIDFPSPAE

SEQ ID NO: 1059074 - protein, 25 aa, Mycobacterium
CGKYKRVRFKGIICERCGVEVTRAK

SEQ ID NO: 1059075 - protein, 18 aa, Mycobacterium
DNPDRWAPPYAEAGAYNV

SEQ ID NO: 1059076 - protein, 19 aa, Mycobacterium
EGVVSLGLYSRIFRNNILA

SEQ ID NO: 1059077 - protein, 20 aa, Mycobacterium
ELGQPLPLFIKWDDADYGLR

SEQ ID NO: 1059078 - protein, 18 aa, Mycobacterium
ELRIGLATAEDIRQWSYG

SEQ ID NO: 1059079 - protein, 19 aa, Mycobacterium
EPEAFKWIQRAAMDRRTTM

SEQ ID NO: 1059080 - protein, 18 aa, Mycobacterium
FLHKELYREYALRPPKGV

SEQ ID NO: 1059081 - protein, 21 aa, Mycobacterium
FQRPNPFPAMSIRDNVVAGLK

SEQ ID NO: 1059082 - protein, 19 aa, Mycobacterium
FSLLPAWRGAAPVQAAIAA

SEQ ID NO: 1059083 - protein, 21 aa, Mycobacterium
GADLYRQFPVFAHALDACDAA

SEQ ID NO: 1059084 - protein, 17 aa, Mycobacterium
GEPFPYPVTVGYMYIMK

SEQ ID NO: 1059085 - protein, 25 aa, Mycobacterium
GHIELAAPVTHIWYFKGVPSRLGYL

SEQ ID NO: 1059086 - protein, 17 aa, Mycobacterium
GLQEKPLSIAMREIHAD

SEQ ID NO: 1059087 - protein, 17 aa, Mycobacterium
GPTRDWECYCGKYKRVR

SEQ ID NO: 1059088 - protein, 20 aa, Mycobacterium
GRIKDLLIVYGRNHSPDDIE

SEQ ID NO: 1059089 - protein, 19 aa, Mycobacterium
GSMSLSFSDPRFDEVKAPV

SEQ ID NO: 1059090 - protein, 18 aa, Mycobacterium
GTTQRFGVPMGFGGPHAG

SEQ ID NO: 1059091 - protein, 19 aa, Mycobacterium
GVVIGRGCLGRPWLFAELS

SEQ ID NO: 1059092 - protein, 23 aa, Mycobacterium
INEPRFPSFKGIMAAKKKEVTVL

SEQ ID NO: 1059093 - protein, 19 aa, Mycobacterium
IQSRLGFLLDVGLEYLSLS

SEQ ID NO: 1059094 - protein, 20 aa, Mycobacterium
KIDKGEFVFLIGPSGSGKST

SEQ ID NO: 1059095 - protein, 20 aa, Mycobacterium
KRLVDFAAGLAFALRGSFDK

SEQ ID NO: 1059096 - protein, 20 aa, Mycobacterium
KRYALPHARILMHQPLGGVT

SEQ ID NO: 1059097 - protein, 17 aa, Mycobacterium
LAMPRLDMVTGLYYLTT

SEQ ID NO: 1059098 - protein, 17 aa, Mycobacterium
LCPGSRNAPLAFALQDA

SEQ ID NO: 1059099 - protein, 23 aa, Mycobacterium
LDVGCGWGGALVRAVEKYDVNVI

SEQ ID NO: 1059100 - protein, 23 aa, Mycobacterium
LFFKEKRYDLARVGRYKVNKKLG

SEQ ID NO: 1059101 - protein, 18 aa, Mycobacterium
LFYSGFYLPMYWSSRAKL

SEQ ID NO: 1059102 - protein, 18 aa, Mycobacterium
LGYYEWREGLLRGLAAHH

SEQ ID NO: 1059103 - protein, 22 aa, Mycobacterium
LHSVKVIPSRGAWLEFDVDKRD

SEQ ID NO: 1059104 - protein, 23 aa, Mycobacterium
LRALKRLKVVAAFQQSGNSPMGM

SEQ ID NO: 1059105 - protein, 18 aa, Mycobacterium
LRQVIGCVFQDFRLLQQK

SEQ ID NO: 1059106 - protein, 21 aa, Mycobacterium
LSGQVGWLARDRWAVPLVHTA

SEQ ID NO: 1059107 - protein, 17 aa, Mycobacterium
LTFPGFLKAYVETVDEL

SEQ ID NO: 1059108 - protein, 18 aa, Mycobacterium
LYARFWHKVLYDLGHVSS

SEQ ID NO: 1059109 - protein, 18 aa, Mycobacterium
LYIALGISGAIQHRAGMQ

SEQ ID NO: 1059110 - protein, 22 aa, Mycobacterium
MVSLAALWRWAGITPDAVIGHS

SEQ ID NO: 1059111 - protein, 19 aa, Mycobacterium
NELGHPWTVLRATRSTDYL

SEQ ID NO: 1059112 - protein, 21 aa, Mycobacterium
PELTPRPSTIAMYSTVDGEPH

SEQ ID NO: 1059113 - protein, 19 aa, Mycobacterium
PFEHARPTAIMTWMRQHGG

SEQ ID NO: 1059114 - protein, 18 aa, Mycobacterium
PFEHARPTAIMTWMRQHW

SEQ ID NO: 1059115 - protein, 25 aa, Mycobacterium
PIAKELPMEYALELNRLIELQMEGA

SEQ ID NO: 1059116 - protein, 26 aa, Mycobacterium
QCGLPKLMALELFKPFVMKRLVDLNH

SEQ ID NO: 1059117 - protein, 17 aa, Mycobacterium
QVLKEIQSRLGFLLDVG

SEQ ID NO: 1059118 - protein, 20 aa, Mycobacterium
RAQLLELVWGYDFAADTNVV

SEQ ID NO: 1059119 - protein, 19 aa, Mycobacterium
RFPEELGKMGFVFNFITYG

SEQ ID NO: 1059120 - protein, 20 aa, Mycobacterium
RGGCIIRAKFLNRIKEAFDA

SEQ ID NO: 1059121 - protein, 18 aa, Mycobacterium
RIGVKVWIYKGDIVGGKR

SEQ ID NO: 1059122 - protein, 21 aa, Mycobacterium
RLSPGLKRSSLIGGIRYYDTV

SEQ ID NO: 1059123 - protein, 25 aa, Mycobacterium
RRFLERRLRETFGFEGSPIRINVRV

SEQ ID NO: 1059124 - protein, 22 aa, Mycobacterium
RSYNCLKREGVHTVGELVSRTE

SEQ ID NO: 1059125 - protein, 18 aa, Mycobacterium
RTLAVAVYNHYKRIQAGE

SEQ ID NO: 1059126 - protein, 17 aa, Mycobacterium
RTLFGVLFQDGALFGSM

SEQ ID NO: 1059127 - protein, 18 aa, Mycobacterium
RYDLAVQEIFVFTPKGDV

SEQ ID NO: 1059128 - protein, 17 aa, Mycobacterium
RYLPIWIGQSEAAAIAL

SEQ ID NO: 1059129 - protein, 23 aa, Mycobacterium
SGEQRLSGFLLWQSAYSEMWFTE

SEQ ID NO: 1059130 - protein, 17 aa, Mycobacterium
TLHVALELARRGSGYGV

SEQ ID NO: 1059131 - protein, 21 aa, Mycobacterium
TNTFPSWPLAHPFRRIAHNGE

SEQ ID NO: 1059132 - protein, 17 aa, Mycobacterium
TQLCAFAAGVLRAEAAH

SEQ ID NO: 1059133 - protein, 18 aa, Mycobacterium
VEIREFLEGYVIGQDTAK

SEQ ID NO: 1059134 - protein, 18 aa, Mycobacterium
VLCGSAFKNKGVQPMLDA

SEQ ID NO: 1059135 - protein, 19 aa, Mycobacterium
VLGNWTGIPVFKLTEAETT

SEQ ID NO: 1059136 - protein, 17 aa, Mycobacterium
VPQRLWAKPAITVIGID

SEQ ID NO: 1059137 - protein, 19 aa, Mycobacterium
WLARDRWAVPLVHTAHTLA

SEQ ID NO: 1059138 - protein, 17 aa, Mycobacterium
YPVLCGSAFKNKGVQPM

SEQ ID NO: 1059139 - protein, 18 aa, Mycobacterium
YREYALRPPKGVLLYGPP

SEQ ID NO: 1059140 - protein, 23 aa, Mycobacterium
YWYRNIRNTVRFHDTVAALLGAG

SEQ ID NO: 1059141 - protein, 23 aa, Mycobacterium
AAAAGRPWWEWAATHERAFTAAY

SEQ ID NO: 1059142 - protein, 18 aa, Mycobacterium
AADFLKAVGFVVVAPHQY

SEQ ID NO: 1059143 - protein, 23 aa, Mycobacterium
AAEHPRPDYVLLHISDTHLISDG

SEQ ID NO: 1059144 - protein, 19 aa, Mycobacterium
AAGRSCARIPTGHEESLVV

SEQ ID NO: 1059145 - protein, 17 aa, Mycobacterium
AAGYALWHKGIDGFDDL

SEQ ID NO: 1059146 - protein, 17 aa, Mycobacterium
AALQILKAETWRPEAVL

SEQ ID NO: 1059147 - protein, 19 aa, Mycobacterium
AALSRLGAVAVMMRPDADL

SEQ ID NO: 1059148 - protein, 18 aa, Mycobacterium
AAMARRCVDAGWMLSLSG

SEQ ID NO: 1059149 - protein, 19 aa, Mycobacterium
AASIGSLRVPQTWTTASQP

SEQ ID NO: 1059150 - protein, 26 aa, Mycobacterium
AATGRLGLIPLRWALACLLIDIGSVT

SEQ ID NO: 1059151 - protein, 17 aa, Mycobacterium
AATIARRLGLTGALGTV

SEQ ID NO: 1059152 - protein, 21 aa, Mycobacterium
ACGKAGCTTYKWETFLTSELP

SEQ ID NO: 1059153 - protein, 27 aa, Mycobacterium
ACLDRYARLFAWLGLWERRSDLAVIPA

SEQ ID NO: 1059154 - protein, 23 aa, Mycobacterium
ACSSSLVAIHWAMSSLRSGECDL

SEQ ID NO: 1059155 - protein, 25 aa, Mycobacterium
ADALALAICHCWRAPMIARMAEAEA

SEQ ID NO: 1059156 - protein, 20 aa, Mycobacterium
ADERFWLAVGLSRSEAYIFI

SEQ ID NO: 1059157 - protein, 27 aa, Mycobacterium
ADIEARWFGANGWRPGDPWIADTTLGR

SEQ ID NO: 1059158 - protein, 20 aa, Mycobacterium
ADLNFAWPTARIAVIGADGA

SEQ ID NO: 1059159 - protein, 21 aa, Mycobacterium
ADLPPAVGVLVEYGAGTDAAN

SEQ ID NO: 1059160 - protein, 25 aa, Mycobacterium
ADLRAIPWVLAWSQSRVMLPGWYGT

SEQ ID NO: 1059161 - protein, 30 aa, Mycobacterium
ADLWFDPLCPWCWITSRWILEVEKVRDVEV

SEQ ID NO: 1059162 - protein, 17 aa, Mycobacterium
ADPTFCYNAADIGPAGG

SEQ ID NO: 1059163 - protein, 17 aa, Mycobacterium
ADSRVAAELVFDQGLGD

SEQ ID NO: 1059164 - protein, 18 aa, Mycobacterium
ADVAAYWPVPGVHDDKYT

SEQ ID NO: 1059165 - protein, 18 aa, Mycobacterium
ADVFDLWGLPADDPRRTT

SEQ ID NO: 1059166 - protein, 20 aa, Mycobacterium
ADVWLLLSIPADWSNAEAAG

SEQ ID NO: 1059167 - protein, 21 aa, Mycobacterium
AEAMAASVFEFMSRVYQQFPR

SEQ ID NO: 1059168 - protein, 17 aa, Mycobacterium
AEDSIDCVVRLCGDLFG

SEQ ID NO: 1059169 - protein, 19 aa, Mycobacterium
AEELGRWGVGVAESGVSYA

SEQ ID NO: 1059170 - protein, 18 aa, Mycobacterium
AEEMLYLAMEDFRVDVIV

SEQ ID NO: 1059171 - protein, 19 aa, Mycobacterium
AEETLRFQAALVNHVSDAI

SEQ ID NO: 1059172 - protein, 20 aa, Mycobacterium
AEGFLATLLDWCRKNNVMFI

SEQ ID NO: 1059173 - protein, 18 aa, Mycobacterium
AEGWRLYTRARYAPYVER

SEQ ID NO: 1059174 - protein, 20 aa, Mycobacterium
AEIFPGGWLPTVPTVEEHAT

SEQ ID NO: 1059175 - protein, 18 aa, Mycobacterium
AELARLATPLGVAAAVDD

SEQ ID NO: 1059176 - protein, 19 aa, Mycobacterium
AELPWNFLQRSAIRAVSVD

SEQ ID NO: 1059177 - protein, 19 aa, Mycobacterium
AESGMSRQAFLRGAVGVLT

SEQ ID NO: 1059178 - protein, 17 aa, Mycobacterium
AEVAFTCELFSRVEDVL

SEQ ID NO: 1059179 - protein, 21 aa, Mycobacterium
AEVGLRLGLLVDVVSGRTFAA

SEQ ID NO: 1059180 - protein, 20 aa, Mycobacterium
AEVGRAQFFAGLGVSLLTAE

SEQ ID NO: 1059181 - protein, 18 aa, Mycobacterium
AFEAVRIIARVSGVDVFF

SEQ ID NO: 1059182 - protein, 19 aa, Mycobacterium
AFERQWWKFAGVKEEAIKE

SEQ ID NO: 1059183 - protein, 19 aa, Mycobacterium
AGGKCPDVLMAWDLTYAEL

SEQ ID NO: 1059184 - protein, 18 aa, Mycobacterium
AGGLLLPVYVRRLLNYHS

SEQ ID NO: 1059185 - protein, 17 aa, Mycobacterium
AGGMGVLHRNLPVGEQA

SEQ ID NO: 1059186 - protein, 20 aa, Mycobacterium
AGISRPTFYFYFASKEAVLL

SEQ ID NO: 1059187 - protein, 19 aa, Mycobacterium
AGLLLPLGVRSLRVYRPTR

SEQ ID NO: 1059188 - protein, 17 aa, Mycobacterium
AGLRSRDVVGRFGGDEF

SEQ ID NO: 1059189 - protein, 25 aa, Mycobacterium
AGQLFATGMPVEWPAVFAGSSRRRV

SEQ ID NO: 1059190 - protein, 18 aa, Mycobacterium
AGVCGREALPLGAIDITV

SEQ ID NO: 1059191 - protein, 24 aa, Mycobacterium
AGYPRLGKTVLFLGRYDEPRKGMS

SEQ ID NO: 1059192 - protein, 17 aa, Mycobacterium
AHLPGYQGWQWAVVVAA

SEQ ID NO: 1059193 - protein, 19 aa, Mycobacterium
AHMWFGNLVTMTWWDDLWL

SEQ ID NO: 1059194 - protein, 17 aa, Mycobacterium
AIAKARFVRVSPRKARR

SEQ ID NO: 1059195 - protein, 24 aa, Mycobacterium
AIELTGPWPGLRCDVDTPADLAAA

SEQ ID NO: 1059196 - protein, 19 aa, Mycobacterium
AIGGGLCLALAADVRVAST

SEQ ID NO: 1059197 - protein, 18 aa, Mycobacterium
AIGPKLPELWGGSADLAG

SEQ ID NO: 1059198 - protein, 24 aa, Mycobacterium
AIVKGLRTGVDFEYELQMAQMNKH

SEQ ID NO: 1059199 - protein, 17 aa, Mycobacterium
AKARKCVFCAKKNQQID

SEQ ID NO: 1059200 - protein, 21 aa, Mycobacterium
AKIGMQLYVKRVFIMSDCDQL

SEQ ID NO: 1059201 - protein, 18 aa, Mycobacterium
AKQRGHRGLAYVLVTDDG

SEQ ID NO: 1059202 - protein, 17 aa, Mycobacterium
AKREARLLSRFTGANPH

SEQ ID NO: 1059203 - protein, 23 aa, Mycobacterium
AKVRGHRAWPILIRTGALVLSSA

SEQ ID NO: 1059204 - protein, 23 aa, Mycobacterium
ALAGEIGRGLAFMSACGVADRNL

SEQ ID NO: 1059205 - protein, 22 aa, Mycobacterium
ALAISRWRFRFMIKAEMRRVKV

SEQ ID NO: 1059206 - protein, 21 aa, Mycobacterium
ALCAECSMISALYATGGGRLV

SEQ ID NO: 1059207 - protein, 18 aa, Mycobacterium
ALCAHLATIHPSRYLTLI

SEQ ID NO: 1059208 - protein, 19 aa, Mycobacterium
ALDEGRIVLVAGFQGVSQD

SEQ ID NO: 1059209 - protein, 17 aa, Mycobacterium
ALELTWEALEHARIPAS

SEQ ID NO: 1059210 - protein, 19 aa, Mycobacterium
ALFGLDCVIYMGALDTARQ

SEQ ID NO: 1059211 - protein, 18 aa, Mycobacterium
ALGAWAVMFGRTYLWGLA

SEQ ID NO: 1059212 - protein, 19 aa, Mycobacterium
ALGRSAAGYALWHKGIDGF

SEQ ID NO: 1059213 - protein, 19 aa, Mycobacterium
ALIGYAMKRRDIVAITAAM

SEQ ID NO: 1059214 - protein, 19 aa, Mycobacterium
ALMPMVWAACERADFVAEV

SEQ ID NO: 1059215 - protein, 21 aa, Mycobacterium
ALQVAEAFSCYGAHLPQINNV

SEQ ID NO: 1059216 - protein, 23 aa, Mycobacterium
ALSTARFEFRWNDQFALSLDPPT

SEQ ID NO: 1059217 - protein, 17 aa, Mycobacterium
AMLAVMYRPSHLMTVHF

SEQ ID NO: 1059218 - protein, 20 aa, Mycobacterium
ANALRSWSVLRFEVTEDPSP

SEQ ID NO: 1059219 - protein, 21 aa, Mycobacterium
ANLERWGGLVADGATLVSLAK

SEQ ID NO: 1059220 - protein, 23 aa, Mycobacterium
ANLRLVVSLAKRYTGRGMAFLDL

SEQ ID NO: 1059221 - protein, 22 aa, Mycobacterium
APARAYNPLFIWGESGLGKTHL

SEQ ID NO: 1059222 - protein, 19 aa, Mycobacterium
APLMSLRTDRDWIADIVRF

SEQ ID NO: 1059223 - protein, 18 aa, Mycobacterium
APQLWGGFAQHLSPINDT

SEQ ID NO: 1059224 - protein, 23 aa, Mycobacterium
AQGLEVAKPFIAALCTAQQELAD

SEQ ID NO: 1059225 - protein, 22 aa, Mycobacterium
AQIKRLKVGAGRRFSATTQRSL

SEQ ID NO: 1059226 - protein, 19 aa, Mycobacterium
ARDLWYHRILPFAYNLSQR

SEQ ID NO: 1059227 - protein, 20 aa, Mycobacterium
ARFGEWLTIHRAWRSKLPEV

SEQ ID NO: 1059228 - protein, 20 aa, Mycobacterium
ARGLPVLGLCLGLQCIVIEA

SEQ ID NO: 1059229 - protein, 21 aa, Mycobacterium
ARGRLRIGAAVGINGDVAGKA

SEQ ID NO: 1059230 - protein, 18 aa, Mycobacterium
ARHLDCWVLGTVCKGSKV

SEQ ID NO: 1059231 - protein, 18 aa, Mycobacterium
ARLAQGHTVVWIHDTTLR

SEQ ID NO: 1059232 - protein, 19 aa, Mycobacterium
ARLQRRLGATTVYVTHDQT

SEQ ID NO: 1059233 - protein, 19 aa, Mycobacterium
ARMAIAMARAGGMGVLHRN

SEQ ID NO: 1059234 - protein, 24 aa, Mycobacterium
ARPAARLIGWTARFLGMAHPGDKV

SEQ ID NO: 1059235 - protein, 17 aa, Mycobacterium
ARPAVMPMDAWREGEEF

SEQ ID NO: 1059236 - protein, 20 aa, Mycobacterium
ARPSDSVAIALRVGVPIYVE

SEQ ID NO: 1059237 - protein, 21 aa, Mycobacterium
ARRIKRLIVFDVDSTLVQGEV

SEQ ID NO: 1059238 - protein, 18 aa, Mycobacterium
ARYLRICVLTQYKSHSLD

SEQ ID NO: 1059239 - protein, 18 aa, Mycobacterium
ASAALIWRRPRWARRLQP

SEQ ID NO: 1059240 - protein, 21 aa, Mycobacterium
ASARWPAARFAIRNTAVQGPN

SEQ ID NO: 1059241 - protein, 19 aa, Mycobacterium
ASGSLAWTPLMTQFQLIDK

SEQ ID NO: 1059242 - protein, 17 aa, Mycobacterium
ASLRLLVRGGRFLEMGK

SEQ ID NO: 1059243 - protein, 23 aa, Mycobacterium
ASWSEPKGGYFINLDVLPGTARR

SEQ ID NO: 1059244 - protein, 19 aa, Mycobacterium
ASYLLSLRAAWQADNNIPN

SEQ ID NO: 1059245 - protein, 17 aa, Mycobacterium
ATFGVAYLTAWHCLCEV

SEQ ID NO: 1059246 - protein, 18 aa, Mycobacterium
ATIHPSRYLTLISGVTTV

SEQ ID NO: 1059247 - protein, 24 aa, Mycobacterium
ATPCGVCESCLSLAPNAPGHIDVV

SEQ ID NO: 1059248 - protein, 25 aa, Mycobacterium
ATTEMRLPFCWRGVSLHAGGAGRVR

SEQ ID NO: 1059249 - protein, 17 aa, Mycobacterium
ATYFSGGKLQWILENVD

SEQ ID NO: 1059250 - protein, 19 aa, Mycobacterium
AVELDERWVIIGPNGAGKT

SEQ ID NO: 1059251 - protein, 25 aa, Mycobacterium
AVIRRELDRYLPFLATTKVLIAAVR

SEQ ID NO: 1059252 - protein, 18 aa, Mycobacterium
AVLDRLAAYRARTVDIDG

SEQ ID NO: 1059253 - protein, 17 aa, Mycobacterium
AVLECREALAVNVKPKF

SEQ ID NO: 1059254 - protein, 25 aa, Mycobacterium
AVPPRGWVNLHFSLLPAWRGAAPVQ

SEQ ID NO: 1059255 - protein, 17 aa, Mycobacterium
AVQAVDCILGYTIGNDM

SEQ ID NO: 1059256 - protein, 17 aa, Mycobacterium
AVRELKWSVLSSDFEAS

SEQ ID NO: 1059257 - protein, 18 aa, Mycobacterium
AVVDFELPAASSYATGIA

SEQ ID NO: 1059258 - protein, 18 aa, Mycobacterium
AVVTRYELVDGFPRFDVD

SEQ ID NO: 1059259 - protein, 28 aa, Mycobacterium
AWPRFGLELPELLPRLTGIKRISRRAMS

SEQ ID NO: 1059260 - protein, 18 aa, Mycobacterium
AYAGWRKAVQRTLDWVDV

SEQ ID NO: 1059261 - protein, 17 aa, Mycobacterium
AYEYPHLGLAPHPGLAD

SEQ ID NO: 1059262 - protein, 18 aa, Mycobacterium
AYRREVLEAIDLDSVASK

SEQ ID NO: 1059263 - protein, 17 aa, Mycobacterium
CALAWSVETARLAREHN

SEQ ID NO: 1059264 - protein, 19 aa, Mycobacterium
CAVAETMDGFALADLDLKE

SEQ ID NO: 1059265 - protein, 19 aa, Mycobacterium
CAVGIPTNSGWRMLSGDET

SEQ ID NO: 1059266 - protein, 24 aa, Mycobacterium
CDKGFPAYFLIVADLVNHARSVGI

SEQ ID NO: 1059267 - protein, 21 aa, Mycobacterium
CGSQAWNLPVVFGPIAITYNV

SEQ ID NO: 1059268 - protein, 25 aa, Mycobacterium
CHGLQCGFCTPGFVISLTALLRDSY

SEQ ID NO: 1059269 - protein, 21 aa, Mycobacterium
CLSLPAGDRYTVWAPRWRDGG

SEQ ID NO: 1059270 - protein, 21 aa, Mycobacterium
CPVCLGLPGSLPVLNRAAVQS

SEQ ID NO: 1059271 - protein, 19 aa, Mycobacterium
CQAERRHNMLFDHVSALVA

SEQ ID NO: 1059272 - protein, 18 aa, Mycobacterium
CREALAVNVKPKFAVDAL

SEQ ID NO: 1059273 - protein, 18 aa, Mycobacterium
CRSIKFPTFLAGIDAVCR

SEQ ID NO: 1059274 - protein, 18 aa, Mycobacterium
CTLVKFELHKAISRFLQF

SEQ ID NO: 1059275 - protein, 18 aa, Mycobacterium
CWGAGYRWHLWSLAEAAV

SEQ ID NO: 1059276 - protein, 21 aa, Mycobacterium
DAELLSGPILQPGSWIGGDRD

SEQ ID NO: 1059277 - protein, 22 aa, Mycobacterium
DALQSLFCKTEHPFLQHLLTHR

SEQ ID NO: 1059278 - protein, 19 aa, Mycobacterium
DAQRWARERALCAVATASS

SEQ ID NO: 1059279 - protein, 17 aa, Mycobacterium
DAVPRVAQIFGVDAVPT

SEQ ID NO: 1059280 - protein, 20 aa, Mycobacterium
DCARLRFILTAQRDHYLPLK

SEQ ID NO: 1059281 - protein, 18 aa, Mycobacterium
DDGIPVLLVDEARDVDDD

SEQ ID NO: 1059282 - protein, 21 aa, Mycobacterium
DDIRASGLLPTWDETQNFIAN

SEQ ID NO: 1059283 - protein, 20 aa, Mycobacterium
DDPLAMYLFDLCTLPLNLAG

SEQ ID NO: 1059284 - protein, 17 aa, Mycobacterium
DEIIRMVDLMISRVANQ

SEQ ID NO: 1059285 - protein, 17 aa, Mycobacterium
DELHLSFNFLLAQIINF

SEQ ID NO: 1059286 - protein, 20 aa, Mycobacterium
DELLEALLIDAQHAYAAREA

SEQ ID NO: 1059287 - protein, 18 aa, Mycobacterium
DEVHLLPAPVFRMTADLQ

SEQ ID NO: 1059288 - protein, 21 aa, Mycobacterium
DFGELHWRSGAAVAVVLAAEN

SEQ ID NO: 1059289 - protein, 18 aa, Mycobacterium
DFSRIGFKVPHIADVKPF

SEQ ID NO: 1059290 - protein, 23 aa, Mycobacterium
DFVKLAEALGCVGLRCECEEDVV

SEQ ID NO: 1059291 - protein, 18 aa, Mycobacterium
DGFARYWLHNGWVTMGGE

SEQ ID NO: 1059292 - protein, 23 aa, Mycobacterium
DGIGMDEFVDWLIDAGCPIQRIN

SEQ ID NO: 1059293 - protein, 24 aa, Mycobacterium
DGLDRVKPFWPFQVNARLVGLADS

SEQ ID NO: 1059294 - protein, 21 aa, Mycobacterium
DGLEVPLRIAVMGCVVNGPGE

SEQ ID NO: 1059295 - protein, 18 aa, Mycobacterium
DGLFGVLTNVVWTSRGPC

SEQ ID NO: 1059296 - protein, 19 aa, Mycobacterium
DGRAVLRTHIGNLGEEVQL

SEQ ID NO: 1059297 - protein, 19 aa, Mycobacterium
DGVGFDWSAWVTALGNTPE

SEQ ID NO: 1059298 - protein, 24 aa, Mycobacterium
DHCLDMPGLFVWRRYHPTRPVGKA

SEQ ID NO: 1059299 - protein, 17 aa, Mycobacterium
DIGCGWGSTMLHAIEKY

SEQ ID NO: 1059300 - protein, 23 aa, Mycobacterium
DIHLAIPIIRAFSHFALLANVAE

SEQ ID NO: 1059301 - protein, 18 aa, Mycobacterium
DIPNDFVVGYGLDYDERY

SEQ ID NO: 1059302 - protein, 24 aa, Mycobacterium
DISPLQARCGWAIGWKKDAFLGRD

SEQ ID NO: 1059303 - protein, 17 aa, Mycobacterium
DIYRVGQYTAWRRWMEI

SEQ ID NO: 1059304 - protein, 22 aa, Mycobacterium
DKALEGFTMFALNQGEVCTCPS

SEQ ID NO: 1059305 - protein, 17 aa, Mycobacterium
DKFPRMVDYVVPTGVRI

SEQ ID NO: 1059306 - protein, 19 aa, Mycobacterium
DKLVPDWLWHSPSTVKRAF

SEQ ID NO: 1059307 - protein, 19 aa, Mycobacterium
DKPFLMPVEDVFTITGRGT

SEQ ID NO: 1059308 - protein, 24 aa, Mycobacterium
DKWTLSQIRLWGVVGFCVSGDPVA

SEQ ID NO: 1059309 - protein, 17 aa, Mycobacterium
DLFAHWRRAQGLPVSAI

SEQ ID NO: 1059310 - protein, 17 aa, Mycobacterium
DLGEGFGVWRLGDDEAM

SEQ ID NO: 1059311 - protein, 23 aa, Mycobacterium
DLKRSCLDIGLATTVLGWSPQVQ

SEQ ID NO: 1059312 - protein, 20 aa, Mycobacterium
DLPWRPDVVHAHDWLVAHPA

SEQ ID NO: 1059313 - protein, 22 aa, Mycobacterium
DMKLPISLALGWPQRVGGAARA

SEQ ID NO: 1059314 - protein, 22 aa, Mycobacterium
DMLEMLPTPWGLVRSGVAPDHP

SEQ ID NO: 1059315 - protein, 20 aa, Mycobacterium
DNLRSAFAWSRETGDIAGAL

SEQ ID NO: 1059316 - protein, 24 aa, Mycobacterium
DPGESRFYLSLGDELMRRFHGATL

SEQ ID NO: 1059317 - protein, 21 aa, Mycobacterium
DPGSVAYLFSRKGVVTLEKNG

SEQ ID NO: 1059318 - protein, 24 aa, Mycobacterium
DPLLPEVAWSWLIEALESRIDHVT

SEQ ID NO: 1059319 - protein, 17 aa, Mycobacterium
DPLYRRRILELAAALSD

SEQ ID NO: 1059320 - protein, 18 aa, Mycobacterium
DPQQRLLIEVAWEALEDA

SEQ ID NO: 1059321 - protein, 19 aa, Mycobacterium
DPYGAGWLLDVHVSDVGAL

SEQ ID NO: 1059322 - protein, 24 aa, Mycobacterium
DQARTIRIPVHMVEVINKLGRIQR

SEQ ID NO: 1059323 - protein, 23 aa, Mycobacterium
DQFTRAGALWGVPQLTDAGIAVF

SEQ ID NO: 1059324 - protein, 17 aa, Mycobacterium
DQLKSGLLLLMDSVDDL

SEQ ID NO: 1059325 - protein, 17 aa, Mycobacterium
DQPWMIYELDLHQVLHV

SEQ ID NO: 1059326 - protein, 20 aa, Mycobacterium
DQYLRLPLRQVMWGDDEGLL

SEQ ID NO: 1059327 - protein, 18 aa, Mycobacterium
DRLLAISAGKAWKVKRIR

SEQ ID NO: 1059328 - protein, 18 aa, Mycobacterium
DRMVGIDVTHAWASVWTP

SEQ ID NO: 1059329 - protein, 19 aa, Mycobacterium
DRPEDRWAQARDWLAERGY

SEQ ID NO: 1059330 - protein, 29 aa, Mycobacterium
DRRPGWRDARWVAAVIHYRAGRWSDVVKL

SEQ ID NO: 1059331 - protein, 17 aa, Mycobacterium
DRTDPRWTYGAATPGAA

SEQ ID NO: 1059332 - protein, 21 aa, Mycobacterium
DRYAAEIAHIIGYESGDVLRV

SEQ ID NO: 1059333 - protein, 19 aa, Mycobacterium
DSAGFKWLAPYTGSAIAQH

SEQ ID NO: 1059334 - protein, 24 aa, Mycobacterium
DSLGWLRDFLRSHTGGLVVISHNV

SEQ ID NO: 1059335 - protein, 22 aa, Mycobacterium
DTDLRWRIVTALATAGTLDANG

SEQ ID NO: 1059336 - protein, 17 aa, Mycobacterium
DTDRVTLFRAWYSRRNF

SEQ ID NO: 1059337 - protein, 26 aa, Mycobacterium
DTFAPRLSFFWGIGMNFFMEVAKLRA

SEQ ID NO: 1059338 - protein, 20 aa, Mycobacterium
DVALVVGVPMDFRLGFGKVF

SEQ ID NO: 1059339 - protein, 20 aa, Mycobacterium
DVIRYLRWFTFLLPEELVEL

SEQ ID NO: 1059340 - protein, 17 aa, Mycobacterium
DVLRLPMDIVVTEKFVA

SEQ ID NO: 1059341 - protein, 19 aa, Mycobacterium
DVRMRWCGPEVEIEGIISL

SEQ ID NO: 1059342 - protein, 25 aa, Mycobacterium
DVYDIAAAWARRFLDGLPHALAAAK

SEQ ID NO: 1059343 - protein, 24 aa, Mycobacterium
DWAEMLMRMYIRWAEQHKYGVEVL

SEQ ID NO: 1059344 - protein, 22 aa, Mycobacterium
DWLLGNGGLEWAVKRTADSSQR

SEQ ID NO: 1059345 - protein, 24 aa, Mycobacterium
DYFKLGYRGARFAFGYGACPDLED

SEQ ID NO: 1059346 - protein, 24 aa, Mycobacterium
DYQIWQCPVVLLADVRSVGVQGDN

SEQ ID NO: 1059347 - protein, 18 aa, Mycobacterium
EAAARLGDRLSIHDQPNL

SEQ ID NO: 1059348 - protein, 19 aa, Mycobacterium
EAFTRLALINEVVHVIRAD

SEQ ID NO: 1059349 - protein, 18 aa, Mycobacterium
EAIAVFLAPPSWEDLEAR

SEQ ID NO: 1059350 - protein, 17 aa, Mycobacterium
EALAGDNVRVWQPSAFA

SEQ ID NO: 1059351 - protein, 20 aa, Mycobacterium
EALLPRYLTIRVYAAMLESA

SEQ ID NO: 1059352 - protein, 26 aa, Mycobacterium
EALYHFAWDEFCDWYLELAKAQLADG

SEQ ID NO: 1059353 - protein, 17 aa, Mycobacterium
EAMLFGEYIRLMALVEY

SEQ ID NO: 1059354 - protein, 20 aa, Mycobacterium
EARGLFPRHLNTIVNVPTLG

SEQ ID NO: 1059355 - protein, 24 aa, Mycobacterium
EASHCYPHFPRFLAEVVRVLRPGG

SEQ ID NO: 1059356 - protein, 22 aa, Mycobacterium
EASLGITLPVALVWAYPTTADL

SEQ ID NO: 1059357 - protein, 20 aa, Mycobacterium
EDKPFWWGHFDRLNFPVGEW

SEQ ID NO: 1059358 - protein, 20 aa, Mycobacterium
EDRLRTRFEWGLITDVQPPE

SEQ ID NO: 1059359 - protein, 25 aa, Mycobacterium
EDVFAVPSSEHWKFLAYNTKDKNIG

SEQ ID NO: 1059360 - protein, 22 aa, Mycobacterium
EDWKCWARWRLIRARAPWLTDD

SEQ ID NO: 1059361 - protein, 18 aa, Mycobacterium
EEAFKYPGTHWRFEYSPE

SEQ ID NO: 1059362 - protein, 17 aa, Mycobacterium
EELAGAAHFVWLRDTLR

SEQ ID NO: 1059363 - protein, 20 aa, Mycobacterium
EELARYGVQPDWFELGDRDL

SEQ ID NO: 1059364 - protein, 20 aa, Mycobacterium
EEPKGVPVFAWKGETLEEYW

SEQ ID NO: 1059365 - protein, 19 aa, Mycobacterium
EEPPDHLIFIFATTEPEKV

SEQ ID NO: 1059366 - protein, 23 aa, Mycobacterium
EERLRAGVWLRDYLEQLVKCRRG

SEQ ID NO: 1059367 - protein, 25 aa, Mycobacterium
EEVAPWLDLVCKLGVLVAALSDELP

SEQ ID NO: 1059368 - protein, 18 aa, Mycobacterium
EEVSWRMGWIDDEQLALR

SEQ ID NO: 1059369 - protein, 19 aa, Mycobacterium
EEYWWAAEQMLTWPDPDKP

SEQ ID NO: 1059370 - protein, 18 aa, Mycobacterium
EFAEAGWTLPLSEDPAGL

SEQ ID NO: 1059371 - protein, 17 aa, Mycobacterium
EFRASKIMLGRARNNDK

SEQ ID NO: 1059372 - protein, 17 aa, Mycobacterium
EGAEFDGRFLARAVYGQ

SEQ ID NO: 1059373 - protein, 20 aa, Mycobacterium
EGLLNYLALLGWAIADDHDL

SEQ ID NO: 1059374 - protein, 18 aa, Mycobacterium
EGSLRFGDKVVLGRDNVI

SEQ ID NO: 1059375 - protein, 20 aa, Mycobacterium
EGVNLTFLPFIAKAAIDALK

SEQ ID NO: 1059376 - protein, 18 aa, Mycobacterium
EGWWGRWLGRWTAEEHLH

SEQ ID NO: 1059377 - protein, 18 aa, Mycobacterium
EHFILEGWWGRWLGRWTA

SEQ ID NO: 1059378 - protein, 25 aa, Mycobacterium
EHPYPHCWRCRNPLIYRAVSSWFVA

SEQ ID NO: 1059379 - protein, 20 aa, Mycobacterium
EIARLVPFIEWLRSAYTDLL

SEQ ID NO: 1059380 - protein, 19 aa, Mycobacterium
EICDGWLPIFFSPRMADMY

SEQ ID NO: 1059381 - protein, 18 aa, Mycobacterium
EIEMKVLLWAVQRLIVGL

SEQ ID NO: 1059382 - protein, 23 aa, Mycobacterium
EIRRLAIVCLRRLVDVAPAVFAD

SEQ ID NO: 1059383 - protein, 21 aa, Mycobacterium
EIYRAPLSYPYRDGLLNKDLA

SEQ ID NO: 1059384 - protein, 17 aa, Mycobacterium
EKIWRPKVFTISATEGT

SEQ ID NO: 1059385 - protein, 22 aa, Mycobacterium
ELDGLRLITWRGASRAEQGLSF

SEQ ID NO: 1059386 - protein, 17 aa, Mycobacterium
ELDVWSLTDLVAFSTNA

SEQ ID NO: 1059387 - protein, 19 aa, Mycobacterium
ELHEIYKLGVVAIPTNKPM

SEQ ID NO: 1059388 - protein, 20 aa, Mycobacterium
ELMPLPIALAHRLARRLTEV

SEQ ID NO: 1059389 - protein, 17 aa, Mycobacterium
ELPLRLFEFGTIYRYEK

SEQ ID NO: 1059390 - protein, 21 aa, Mycobacterium
ELSRFAEIWLRGGELDGIRVL

SEQ ID NO: 1059391 - protein, 22 aa, Mycobacterium
ENLRAGIWLEHIRRPGWQAVAA

SEQ ID NO: 1059392 - protein, 18 aa, Mycobacterium
ENLREHRKGLLVDLVTDV

SEQ ID NO: 1059393 - protein, 19 aa, Mycobacterium
EPDLKWERFITAVRLLAER

SEQ ID NO: 1059394 - protein, 20 aa, Mycobacterium
EPFLRTNVIGTFTILEAVRH

SEQ ID NO: 1059395 - protein, 19 aa, Mycobacterium
EPFTSVGLCCYRDGSDSIA

SEQ ID NO: 1059396 - protein, 19 aa, Mycobacterium
EPIAVVGIGCRFPGDVTGP

SEQ ID NO: 1059397 - protein, 20 aa, Mycobacterium
EPINFFDFMGPIIKACGENW

SEQ ID NO: 1059398 - protein, 20 aa, Mycobacterium
EPLPRTLVWSTAWEMTREAE

SEQ ID NO: 1059399 - protein, 18 aa, Mycobacterium
EPNMRWRTFCTELLTIAD

SEQ ID NO: 1059400 - protein, 24 aa, Mycobacterium
EPRLRIPNEFGLCRYLAAGLAALQ

SEQ ID NO: 1059401 - protein, 20 aa, Mycobacterium
EPSPRPVLVVDFGAQYAQLI

SEQ ID NO: 1059402 - protein, 23 aa, Mycobacterium
ERAEARLGYRLGLTHTAAVIWSD

SEQ ID NO: 1059403 - protein, 18 aa, Mycobacterium
ERALFLGQWGLRGVRGGA

SEQ ID NO: 1059404 - protein, 25 aa, Mycobacterium
ERDRMAFCSAVYWDIVAKLDASVSD

SEQ ID NO: 1059405 - protein, 18 aa, Mycobacterium
ERLVEFFGGIPILDGIGS

SEQ ID NO: 1059406 - protein, 17 aa, Mycobacterium
ERVELRYIMPLGEIIFD

SEQ ID NO: 1059407 - protein, 17 aa, Mycobacterium
ERWEHFEHHTPLRVVNC

SEQ ID NO: 1059408 - protein, 24 aa, Mycobacterium
ERYRELRDAWLLARSDLIDRRNRI

SEQ ID NO: 1059409 - protein, 28 aa, Mycobacterium
ESRLTFLAVRRWFGWSAGRIINLDIGGG

SEQ ID NO: 1059410 - protein, 17 aa, Mycobacterium
ETARLWLSLGHHDRHGV

SEQ ID NO: 1059411 - protein, 20 aa, Mycobacterium
ETAVRWSVMLSWNSKSAAAL

SEQ ID NO: 1059412 - protein, 24 aa, Mycobacterium
ETRLSELSALSWVVYSLPGVPLFD

SEQ ID NO: 1059413 - protein, 19 aa, Mycobacterium
EVGPRIVPIIPDEARTFGM

SEQ ID NO: 1059414 - protein, 18 aa, Mycobacterium
EVKKAAAEHGLWYPPDPS

SEQ ID NO: 1059415 - protein, 19 aa, Mycobacterium
EVLEAGLIQRSRLLDAVLT

SEQ ID NO: 1059416 - protein, 24 aa, Mycobacterium
EVQIGKFRLVFLIGSKQDDDTGRT

SEQ ID NO: 1059417 - protein, 23 aa, Mycobacterium
EVSTPLILCRKFQGCLNLSQWIK

SEQ ID NO: 1059418 - protein, 20 aa, Mycobacterium
EVVNAFGWTAPLGVTYPGVV

SEQ ID NO: 1059419 - protein, 19 aa, Mycobacterium
EVVRALDMLFILHADHEQN

SEQ ID NO: 1059420 - protein, 20 aa, Mycobacterium
EWMGRVHRFLGLQVGVILAS

SEQ ID NO: 1059421 - protein, 24 aa, Mycobacterium
EYRAVKEIVRVGGRFEVISPHEPA

SEQ ID NO: 1059422 - protein, 19 aa, Mycobacterium
FAAEAAFVFAMIAVDLSRL

SEQ ID NO: 1059423 - protein, 17 aa, Mycobacterium
FAAGLAFALRGSFDKVA

SEQ ID NO: 1059424 - protein, 20 aa, Mycobacterium
FAPPARCVMLIWDAPNLDMG

SEQ ID NO: 1059425 - protein, 20 aa, Mycobacterium
FCGFATHALRARITDADTKL

SEQ ID NO: 1059426 - protein, 18 aa, Mycobacterium
FCRDRLAAFEVPTRFQEA

SEQ ID NO: 1059427 - protein, 23 aa, Mycobacterium
FDEGLRATIDWYRNNESWWRPLK

SEQ ID NO: 1059428 - protein, 21 aa, Mycobacterium
FDEYRAMFALSAMDLNATILD

SEQ ID NO: 1059429 - protein, 17 aa, Mycobacterium
FDLCTLPLNLAGHCGMS

SEQ ID NO: 1059430 - protein, 21 aa, Mycobacterium
FDVKKAVVFDDRWASAREDLV

SEQ ID NO: 1059431 - protein, 17 aa, Mycobacterium
FERRGRWNVPRKLTTFS

SEQ ID NO: 1059432 - protein, 19 aa, Mycobacterium
FEVVTAMAFAAFANAPVDI

SEQ ID NO: 1059433 - protein, 25 aa, Mycobacterium
FFPSVREYSCLYGLTERRQALLPGH

SEQ ID NO: 1059434 - protein, 18 aa, Mycobacterium
FFVCSTHDWILFFTTQGR

SEQ ID NO: 1059435 - protein, 25 aa, Mycobacterium
FGKTFKSAACILSLVCVDAGNKDNN

SEQ ID NO: 1059436 - protein, 18 aa, Mycobacterium
FGTVVARERAQAVAGLRA

SEQ ID NO: 1059437 - protein, 18 aa, Mycobacterium
FGVPMGFGGPHAGYLALH

SEQ ID NO: 1059438 - protein, 17 aa, Mycobacterium
FIDEWPQLLTLRASADR

SEQ ID NO: 1059439 - protein, 21 aa, Mycobacterium
FLAKLGCSFVLVGHSERRTYH

SEQ ID NO: 1059440 - protein, 18 aa, Mycobacterium
FLERGLCDTGRWRVPLIL

SEQ ID NO: 1059441 - protein, 17 aa, Mycobacterium
FLGMAASFARRIARNTQ

SEQ ID NO: 1059442 - protein, 19 aa, Mycobacterium
FLLDFPRRFPDATVVRLER

SEQ ID NO: 1059443 - protein, 21 aa, Mycobacterium
FLLSAYIDFAALRAKFDGGTL

SEQ ID NO: 1059444 - protein, 20 aa, Mycobacterium
FLPPNCFDKAPIVNPGLEPE

SEQ ID NO: 1059445 - protein, 18 aa, Mycobacterium
FLTWHAWSDPNCGKWPPG

SEQ ID NO: 1059446 - protein, 22 aa, Mycobacterium
FLVPEFRRKAVIIAVGGVYDIR

SEQ ID NO: 1059447 - protein, 17 aa, Mycobacterium
FPDRGVILVCGANEIGK

SEQ ID NO: 1059448 - protein, 17 aa, Mycobacterium
FPLFPRGGGFPRNNDDK

SEQ ID NO: 1059449 - protein, 20 aa, Mycobacterium
FPPVELFMQIPWRTEIIEGL

SEQ ID NO: 1059450 - protein, 17 aa, Mycobacterium
FPRLMVYRGPRRKGVRY

SEQ ID NO: 1059451 - protein, 17 aa, Mycobacterium
FPTAGLIVGSQGIADAY

SEQ ID NO: 1059452 - protein, 19 aa, Mycobacterium
FRASVCVLGPLVGRCKQAR

SEQ ID NO: 1059453 - protein, 18 aa, Mycobacterium
FREHTSWALASAILEFAD

SEQ ID NO: 1059454 - protein, 23 aa, Mycobacterium
FRPEVSDGLFLRLAVTSVESLAC

SEQ ID NO: 1059455 - protein, 22 aa, Mycobacterium
FRPSKIAFLTWHAWSDPNCGKW

SEQ ID NO: 1059456 - protein, 17 aa, Mycobacterium
FRYPGIRSDSDMYTLGF

SEQ ID NO: 1059457 - protein, 18 aa, Mycobacterium
FSGYELIKRLGIRRTIAI

SEQ ID NO: 1059458 - protein, 17 aa, Mycobacterium
FSVLSLPTTLIFDTDGQ

SEQ ID NO: 1059459 - protein, 17 aa, Mycobacterium
FTEGVGFDKGFLSAYFV

SEQ ID NO: 1059460 - protein, 20 aa, Mycobacterium
FTLDGLGGWFIDAVYGDPST

SEQ ID NO: 1059461 - protein, 18 aa, Mycobacterium
FTPLRLPPELDFTALFHG

SEQ ID NO: 1059462 - protein, 18 aa, Mycobacterium
FVPPRFAKEAIIEAVEAE

SEQ ID NO: 1059463 - protein, 25 aa, Mycobacterium
FWATWCGPCKMVAPVLEEIASEQRN

SEQ ID NO: 1059464 - protein, 19 aa, Mycobacterium
FYESKEIRDLIAYLRVLDN

SEQ ID NO: 1059465 - protein, 20 aa, Mycobacterium
FYLPLVVRRRITFLAKSEYF

SEQ ID NO: 1059466 - protein, 21 aa, Mycobacterium
GADLYRQFPVFAHALDEVAAA

SEQ ID NO: 1059467 - protein, 18 aa, Mycobacterium
GAFPAWLAPIQVVGIPVT

SEQ ID NO: 1059468 - protein, 18 aa, Mycobacterium
GAGARLVTMLTRHPGGAS

SEQ ID NO: 1059469 - protein, 17 aa, Mycobacterium
GAGLDWKTSLQELTAAR

SEQ ID NO: 1059470 - protein, 23 aa, Mycobacterium
GAGVSGLWLLSGMSYDGVLTTID

SEQ ID NO: 1059471 - protein, 17 aa, Mycobacterium
GAIKLDWRADLQDPIKR

SEQ ID NO: 1059472 - protein, 17 aa, Mycobacterium
GAIVKRPRVVIDASGNE

SEQ ID NO: 1059473 - protein, 23 aa, Mycobacterium
GALCARFRISGLPVVDDSGALAG

SEQ ID NO: 1059474 - protein, 18 aa, Mycobacterium
GAPAHDWLTLTGGAIGHG

SEQ ID NO: 1059475 - protein, 20 aa, Mycobacterium
GAVVYGHLQIRVCKFGEAVV

SEQ ID NO: 1059476 - protein, 19 aa, Mycobacterium
GCGPMRALISVCAAGGQGV

SEQ ID NO: 1059477 - protein, 23 aa, Mycobacterium
GDALEALASILVRRGVSSPPVEL

SEQ ID NO: 1059478 - protein, 21 aa, Mycobacterium
GDARGGAALSVREVTGVPILF

SEQ ID NO: 1059479 - protein, 19 aa, Mycobacterium
GDCLFPGGVGKTWQRSDFT

SEQ ID NO: 1059480 - protein, 19 aa, Mycobacterium
GDGPWRLGISSAGTFENLQ

SEQ ID NO: 1059481 - protein, 17 aa, Mycobacterium
GDLHAAYGWHMRAAAWA

SEQ ID NO: 1059482 - protein, 17 aa, Mycobacterium
GDLIPSYKAHRVAEEIS

SEQ ID NO: 1059483 - protein, 22 aa, Mycobacterium
GDRGVSWLPFFHDMGLITVLLP

SEQ ID NO: 1059484 - protein, 17 aa, Mycobacterium
GDSVIYWQVPKGGTLNS

SEQ ID NO: 1059485 - protein, 23 aa, Mycobacterium
GDVEPFAALGLELQRRGHEVRIG

SEQ ID NO: 1059486 - protein, 24 aa, Mycobacterium
GDYFKRGAIELAWALLTNSFADGG

SEQ ID NO: 1059487 - protein, 20 aa, Mycobacterium
GEGFGVWRLGDDEAMLRIVT

SEQ ID NO: 1059488 - protein, 22 aa, Mycobacterium
GELPAVRVGRSFRVHAKAVHDM

SEQ ID NO: 1059489 - protein, 20 aa, Mycobacterium
GESRVPVFVFHPAGGSTVVY

SEQ ID NO: 1059490 - protein, 23 aa, Mycobacterium
GEVRVPAIALWRAQTQRAVENFP

SEQ ID NO: 1059491 - protein, 18 aa, Mycobacterium
GFIGSPVMNFFPAKLTPN

SEQ ID NO: 1059492 - protein, 19 aa, Mycobacterium
GGGCWRWLAGYYWPPVHGR

SEQ ID NO: 1059493 - protein, 23 aa, Mycobacterium
GGGMCFTFLAAQGFSVGKSLLET

SEQ ID NO: 1059494 - protein, 18 aa, Mycobacterium
GGIILGLEDSNSWMSRLG

SEQ ID NO: 1059495 - protein, 17 aa, Mycobacterium
GGLRVATVVGFPSGEHV

SEQ ID NO: 1059496 - protein, 18 aa, Mycobacterium
GGPQFLPFGISTGGGDTI

SEQ ID NO: 1059497 - protein, 21 aa, Mycobacterium
GGTVGEMFGRKVARLMEWCAM

SEQ ID NO: 1059498 - protein, 19 aa, Mycobacterium
GGVRDVVLCPGSRNAPLAF

SEQ ID NO: 1059499 - protein, 20 aa, Mycobacterium
GHARIEFKLRDWLFARQRYW

SEQ ID NO: 1059500 - protein, 18 aa, Mycobacterium
GHLSRAWLVAAIGLGVDR

SEQ ID NO: 1059501 - protein, 22 aa, Mycobacterium
GIAGFCMGGRFALVMSPKGFDA

SEQ ID NO: 1059502 - protein, 23 aa, Mycobacterium
GIAKRLRPGGVIQREISMRTVAV

SEQ ID NO: 1059503 - protein, 20 aa, Mycobacterium
GIGAPALWPGLPVRPVKGEV

SEQ ID NO: 1059504 - protein, 25 aa, Mycobacterium
GIGFRRAAGVVAWWASVHRAGAWQP

SEQ ID NO: 1059505 - protein, 19 aa, Mycobacterium
GIVRPDLVIGWWVAPTITI

SEQ ID NO: 1059506 - protein, 17 aa, Mycobacterium
GIYWAHEALAYGMTKRP

SEQ ID NO: 1059507 - protein, 21 aa, Mycobacterium
GKALARICALNALAAVDSLVG

SEQ ID NO: 1059508 - protein, 17 aa, Mycobacterium
GKGTFLFTRTTAGEIGI

SEQ ID NO: 1059509 - protein, 23 aa, Mycobacterium
GKMWRCLGCTEFTLDEPHGLDHR

SEQ ID NO: 1059510 - protein, 18 aa, Mycobacterium
GKSLYLRNQVFAEWIEKV

SEQ ID NO: 1059511 - protein, 24 aa, Mycobacterium
GLCSARMYFAYGLGNSVWFPLATG

SEQ ID NO: 1059512 - protein, 28 aa, Mycobacterium
GLLAPLTFICLFGYKAQSAFFKHANIAV

SEQ ID NO: 1059513 - protein, 24 aa, Mycobacterium
GLVSDLRINWVWNPPWGPDKISDD

SEQ ID NO: 1059514 - protein, 22 aa, Mycobacterium
GMGGLGFVFARWLAEQGAGLIV

SEQ ID NO: 1059515 - protein, 17 aa, Mycobacterium
GMLPRLLAHLVHPSTTG

SEQ ID NO: 1059516 - protein, 23 aa, Mycobacterium
GMTRILVSVAMRPPLTSSITQSS

SEQ ID NO: 1059517 - protein, 18 aa, Mycobacterium
GNFLLTLRAAILERDSTV

SEQ ID NO: 1059518 - protein, 22 aa, Mycobacterium
GNWACIVPHTWLWTTPIGAEIR

SEQ ID NO: 1059519 - protein, 21 aa, Mycobacterium
GPDIKGPLLINVRADKVATSP

SEQ ID NO: 1059520 - protein, 19 aa, Mycobacterium
GPELLSRAAALNWDTTAPA

SEQ ID NO: 1059521 - protein, 17 aa, Mycobacterium
GPERRYTVVYAREHGAR

SEQ ID NO: 1059522 - protein, 19 aa, Mycobacterium
GPGCVRWRRDIAVLLGPAV

SEQ ID NO: 1059523 - protein, 19 aa, Mycobacterium
GPSIACSRWGMLSPAGQCK

SEQ ID NO: 1059524 - protein, 20 aa, Mycobacterium
GPTAPSWRKGPWHIAGRGPR

SEQ ID NO: 1059525 - protein, 18 aa, Mycobacterium
GPVRRTGTIFIFTSPSHA

SEQ ID NO: 1059526 - protein, 19 aa, Mycobacterium
GQCKFSWPPKMDLPGYKPN

SEQ ID NO: 1059527 - protein, 18 aa, Mycobacterium
GRFYYARVASVTDTGIQP

SEQ ID NO: 1059528 - protein, 20 aa, Mycobacterium
GRLPITYSRKVFIPVTHLCR

SEQ ID NO: 1059529 - protein, 20 aa, Mycobacterium
GRLTLPAKFRDALVGGLMVT

SEQ ID NO: 1059530 - protein, 18 aa, Mycobacterium
GRMKDLLIVYGRNHYPED

SEQ ID NO: 1059531 - protein, 18 aa, Mycobacterium
GRMLWSLPKGHIEQGETA

SEQ ID NO: 1059532 - protein, 20 aa, Mycobacterium
GRSRSGRRFALWEGDGQWIA

SEQ ID NO: 1059533 - protein, 18 aa, Mycobacterium
GRSVSRWGAFLDDVGGFD

SEQ ID NO: 1059534 - protein, 20 aa, Mycobacterium
GRTAEYFTRMMAGLGEKLGF

SEQ ID NO: 1059535 - protein, 21 aa, Mycobacterium
GRWSCVRWGALTPPFYPHLHR

SEQ ID NO: 1059536 - protein, 19 aa, Mycobacterium
GRYGLSVAALARWHRPRLE

SEQ ID NO: 1059537 - protein, 18 aa, Mycobacterium
GSAKRITAVIPFYPYARQ

SEQ ID NO: 1059538 - protein, 18 aa, Mycobacterium
GSHISGVISFLGIHGSEF

SEQ ID NO: 1059539 - protein, 17 aa, Mycobacterium
GSKVKVTIMFRGREQSR

SEQ ID NO: 1059540 - protein, 20 aa, Mycobacterium
GSPYAWGGAAPGGFDCSGLV

SEQ ID NO: 1059541 - protein, 17 aa, Mycobacterium
GSVPIELDISAGFDLAK

SEQ ID NO: 1059542 - protein, 18 aa, Mycobacterium
GSYQIGILGLKGGAGKTT

SEQ ID NO: 1059543 - protein, 20 aa, Mycobacterium
GTALSGWRIIGRVFDGPARV

SEQ ID NO: 1059544 - protein, 19 aa, Mycobacterium
GTGWLPGWRLTFGGEDIGW

SEQ ID NO: 1059545 - protein, 25 aa, Mycobacterium
GTLPRPESLSAFVARVGAALPQTSS

SEQ ID NO: 1059546 - protein, 19 aa, Mycobacterium
GVAAWLVLCCRALHAGAQE

SEQ ID NO: 1059547 - protein, 18 aa, Mycobacterium
GVLARAAGILGIELGVEA

SEQ ID NO: 1059548 - protein, 24 aa, Mycobacterium
GVLARVAALFSRRGFNIESLAVGA

SEQ ID NO: 1059549 - protein, 17 aa, Mycobacterium
GVLKLSIPVAERAKPRK

SEQ ID NO: 1059550 - protein, 19 aa, Mycobacterium
GVSRNGCWTTFVICDARHA

SEQ ID NO: 1059551 - protein, 17 aa, Mycobacterium
GVSYALRDAFAVASYLG

SEQ ID NO: 1059552 - protein, 17 aa, Mycobacterium
GVVDICPQLRVVTVDGD

SEQ ID NO: 1059553 - protein, 20 aa, Mycobacterium
GVVRLRFGLTDGQPRTLDEI

SEQ ID NO: 1059554 - protein, 19 aa, Mycobacterium
GWASPRWRNLTGGIVALHA

SEQ ID NO: 1059555 - protein, 17 aa, Mycobacterium
GWLWSVRPGVIAGLAAA

SEQ ID NO: 1059556 - protein, 18 aa, Mycobacterium
GYGGFGYDSIFIPDGPGL

SEQ ID NO: 1059557 - protein, 24 aa, Mycobacterium
GYNWSCGFAGYLVGRIDMSAQVEQ

SEQ ID NO: 1059558 - protein, 20 aa, Mycobacterium
GYRWMIRCVVNGPLETIDVL

SEQ ID NO: 1059559 - protein, 22 aa, Mycobacterium
HAVKGLEWDAVFLVGLADGTLP

SEQ ID NO: 1059560 - protein, 18 aa, Mycobacterium
HAWIQAWTGGWWNYDPTN

SEQ ID NO: 1059561 - protein, 21 aa, Mycobacterium
HDIRVLYGFKRLAWWPYGVVM

SEQ ID NO: 1059562 - protein, 18 aa, Mycobacterium
HDPPWCRPLLGVRRSVPR

SEQ ID NO: 1059563 - protein, 18 aa, Mycobacterium
HDTFCPVGPWIVTDLGPL

SEQ ID NO: 1059564 - protein, 20 aa, Mycobacterium
HEHQRIAPLVAELADTLERT

SEQ ID NO: 1059565 - protein, 17 aa, Mycobacterium
HGEIPLGIYCRASLAQF

SEQ ID NO: 1059566 - protein, 21 aa, Mycobacterium
HGFGSFWWSWRHQLRGLTEAR

SEQ ID NO: 1059567 - protein, 25 aa, Mycobacterium
HGISRLRFRLRWRGFRLTVDARHAD

SEQ ID NO: 1059568 - protein, 26 aa, Mycobacterium
HGLELPRRLQIEFSRAIQKISEGEGG

SEQ ID NO: 1059569 - protein, 21 aa, Mycobacterium
HGRSGFLLAPWTAEQIMFELA

SEQ ID NO: 1059570 - protein, 18 aa, Mycobacterium
HGVCSLDAIGVRTTGDTL

SEQ ID NO: 1059571 - protein, 18 aa, Mycobacterium
HLGWVAKSGWKIDVAGGI

SEQ ID NO: 1059572 - protein, 20 aa, Mycobacterium
HLQGWKLDRLPAVDRAILRV

SEQ ID NO: 1059573 - protein, 24 aa, Mycobacterium
HPGKWRVVFFWPKDFTFICPTEIA

SEQ ID NO: 1059574 - protein, 17 aa, Mycobacterium
HPSLCLLASWVSPGSPA

SEQ ID NO: 1059575 - protein, 20 aa, Mycobacterium
HPTPGWWDWIAGPGAPIDTN

SEQ ID NO: 1059576 - protein, 24 aa, Mycobacterium
HRSIRVSDELAWMFPFCSANPTVS

SEQ ID NO: 1059577 - protein, 19 aa, Mycobacterium
HSLARLAIRDDIYASLRSL

SEQ ID NO: 1059578 - protein, 24 aa, Mycobacterium
HSRGAFPGALWLQVRDIAVTQADL

SEQ ID NO: 1059579 - protein, 18 aa, Mycobacterium
HWEAWSPYISATAVADGL

SEQ ID NO: 1059580 - protein, 19 aa, Mycobacterium
HWGNWAKIFFNNKGVVAKA

SEQ ID NO: 1059581 - protein, 18 aa, Mycobacterium
HYGIGYGLLRYMYAPTGR

SEQ ID NO: 1059582 - protein, 21 aa, Mycobacterium
HYHKIHLYDAFGFTESRTVTA

SEQ ID NO: 1059583 - protein, 19 aa, Mycobacterium
IAAGLPVRCLPGPSAVMTA

SEQ ID NO: 1059584 - protein, 25 aa, Mycobacterium
IAAVHGWCIGGALDLISAVDIRYAS

SEQ ID NO: 1059585 - protein, 17 aa, Mycobacterium
IADLGGWSTVDPQLFDK

SEQ ID NO: 1059586 - protein, 17 aa, Mycobacterium
IALSMAVYYIAVKCACP

SEQ ID NO: 1059587 - protein, 24 aa, Mycobacterium
IAPGGFRFGSRFGVELQFWSFEET

SEQ ID NO: 1059588 - protein, 24 aa, Mycobacterium
IARFKRLDGLDVRFLTGTDEHGLK

SEQ ID NO: 1059589 - protein, 23 aa, Mycobacterium
IATRLRELFSWVVPMLGPMVQDI

SEQ ID NO: 1059590 - protein, 17 aa, Mycobacterium
IAVIGMGCRFPGGVNNP

SEQ ID NO: 1059591 - protein, 17 aa, Mycobacterium
ICVEAFSGFAIVKPQVA

SEQ ID NO: 1059592 - protein, 25 aa, Mycobacterium
ICYDIRFPALYTELARRGAQLIVVC

SEQ ID NO: 1059593 - protein, 17 aa, Mycobacterium
IDLRFADALSMADNVMT

SEQ ID NO: 1059594 - protein, 19 aa, Mycobacterium
IDPWGGSYYVEWLTHQLAA

SEQ ID NO: 1059595 - protein, 17 aa, Mycobacterium
IDRRGRMLWSLPKGHIE

SEQ ID NO: 1059596 - protein, 18 aa, Mycobacterium
IDVTHAWASVWTPQQSGQ

SEQ ID NO: 1059597 - protein, 23 aa, Mycobacterium
IDYPARAPFRYVPTFLVPGPRDE

SEQ ID NO: 1059598 - protein, 17 aa, Mycobacterium
IDYVRMWVEAAIAMGTY

SEQ ID NO: 1059599 - protein, 21 aa, Mycobacterium
IEHWTRLPVEVELASEFRYRD

SEQ ID NO: 1059600 - protein, 19 aa, Mycobacterium
IELGIKWLSLYAFSTENWK

SEQ ID NO: 1059601 - protein, 19 aa, Mycobacterium
IEMTDWWSYLDGVRKTYPL

SEQ ID NO: 1059602 - protein, 22 aa, Mycobacterium
IEPRLSLQWWVRVESLAKAAGD

SEQ ID NO: 1059603 - protein, 21 aa, Mycobacterium
IERFLQLWAEGSMTFAVPSTP

SEQ ID NO: 1059604 - protein, 19 aa, Mycobacterium
IERTCEFLEWFLGSVPIAP

SEQ ID NO: 1059605 - protein, 18 aa, Mycobacterium
IFLGRNGRISVFSSERAL

SEQ ID NO: 1059606 - protein, 18 aa, Mycobacterium
IFPGGWLPTVPTVEEHAT

SEQ ID NO: 1059607 - protein, 19 aa, Mycobacterium
IFTKFNIPINVARVFHRDQ

SEQ ID NO: 1059608 - protein, 18 aa, Mycobacterium
IGGRLAARIGSGLLVDVV

SEQ ID NO: 1059609 - protein, 19 aa, Mycobacterium
IGIGFCFAPLFQPSYRYAS

SEQ ID NO: 1059610 - protein, 19 aa, Mycobacterium
IGVDGYRWMIRCVVNGPLE

SEQ ID NO: 1059611 - protein, 20 aa, Mycobacterium
IGVSHGFVFRRVAADVKIAV

SEQ ID NO: 1059612 - protein, 18 aa, Mycobacterium
IHAGEAFGLPSIHEAIAF

SEQ ID NO: 1059613 - protein, 23 aa, Mycobacterium
IHDRMPLILAEYDWDVWLNPYIP

SEQ ID NO: 1059614 - protein, 17 aa, Mycobacterium
IHPGVPVLGNHLVGNGF

SEQ ID NO: 1059615 - protein, 26 aa, Mycobacterium
IHWFFGLFSHWWSRLHSFFGGIPGLS

SEQ ID NO: 1059616 - protein, 18 aa, Mycobacterium
IIQRRKVGVIGYGSQGYA

SEQ ID NO: 1059617 - protein, 24 aa, Mycobacterium
IIRPFLRFFFKSWFRVEVSGIENL

SEQ ID NO: 1059618 - protein, 19 aa, Mycobacterium
IKLGVLPGMGGSQRLTRAI

SEQ ID NO: 1059619 - protein, 18 aa, Mycobacterium
ILGVKGRVLPMCPIALQI

SEQ ID NO: 1059620 - protein, 23 aa, Mycobacterium
ILTELWMLIGYHIPAPIPRISYA

SEQ ID NO: 1059621 - protein, 18 aa, Mycobacterium
IMSIVAFEHFGHGSYDDF

SEQ ID NO: 1059622 - protein, 19 aa, Mycobacterium
IPMQRLWVNPDCGLKTRSV

SEQ ID NO: 1059623 - protein, 19 aa, Mycobacterium
IPSPAAGVLTKIIAQEDDT

SEQ ID NO: 1059624 - protein, 23 aa, Mycobacterium
IPTEMAIEFDISWEANEAEMFEE

SEQ ID NO: 1059625 - protein, 18 aa, Mycobacterium
IPTNSGWRMLSGDETGWL

SEQ ID NO: 1059626 - protein, 23 aa, Mycobacterium
IPYKVVGGFCFYESKEIRDLIAY

SEQ ID NO: 1059627 - protein, 18 aa, Mycobacterium
IRCAGAIFVGPWAPVSLG

SEQ ID NO: 1059628 - protein, 19 aa, Mycobacterium
IREELKFSGNRTMSADDPE

SEQ ID NO: 1059629 - protein, 17 aa, Mycobacterium
ISGDASFDYGIAYDRSR

SEQ ID NO: 1059630 - protein, 25 aa, Mycobacterium
ISRQLWWGHRIPIWYGPNGEQVCVG

SEQ ID NO: 1059631 - protein, 24 aa, Mycobacterium
ISTLLLTLLFRFMRPLIEHGYVFL

SEQ ID NO: 1059632 - protein, 24 aa, Mycobacterium
ITKNSKVSTVWTWPDKPGVAGCAA

SEQ ID NO: 1059633 - protein, 19 aa, Mycobacterium
ITLSGIWLLIVPSELAKTD

SEQ ID NO: 1059634 - protein, 21 aa, Mycobacterium
ITVNVDGFWLLQALLDIRHVA

SEQ ID NO: 1059635 - protein, 17 aa, Mycobacterium
ITYNEWSFASARKLNTA

SEQ ID NO: 1059636 - protein, 17 aa, Mycobacterium
IVARTGLRDCRTHGRTW

SEQ ID NO: 1059637 - protein, 17 aa, Mycobacterium
IVKYLAYGWSSLRSRPA

SEQ ID NO: 1059638 - protein, 23 aa, Mycobacterium
IVSRGGSIMASWCLANHRESFLY

SEQ ID NO: 1059639 - protein, 17 aa, Mycobacterium
IWLLGAIGPRMVYSTNL

SEQ ID NO: 1059640 - protein, 21 aa, Mycobacterium
KAFAFAGGRLGYLIATPALVE

SEQ ID NO: 1059641 - protein, 18 aa, Mycobacterium
KAGLFPAYTLNTYVISDQ

SEQ ID NO: 1059642 - protein, 20 aa, Mycobacterium
KAGRRFARLAPIVATHRKLI

SEQ ID NO: 1059643 - protein, 17 aa, Mycobacterium
KAIVSRFYAQVPEDEIL

SEQ ID NO: 1059644 - protein, 21 aa, Mycobacterium
KARTGIMPHLLVMTATPIPRT

SEQ ID NO: 1059645 - protein, 23 aa, Mycobacterium
KCYSLRIASAMAHDEGWLAEHML

SEQ ID NO: 1059646 - protein, 21 aa, Mycobacterium
KDFWLQVGIDPVRIMTGAGTF

SEQ ID NO: 1059647 - protein, 19 aa, Mycobacterium
KDLQDIIAILGIDELSEED

SEQ ID NO: 1059648 - protein, 20 aa, Mycobacterium
KDLRPEWTIPPREEFYFGYS

SEQ ID NO: 1059649 - protein, 23 aa, Mycobacterium
KDPKRPSGSFIFAGPSGVGKTEL

SEQ ID NO: 1059650 - protein, 22 aa, Mycobacterium
KELCRRWYPRIYFGQPAKGLTH

SEQ ID NO: 1059651 - protein, 21 aa, Mycobacterium
KELRRGATVALVYLSPDAKPA

SEQ ID NO: 1059652 - protein, 23 aa, Mycobacterium
KGCPKETWCVINAGNYRGSMNVT

SEQ ID NO: 1059653 - protein, 25 aa, Mycobacterium
KGIFTSNFGYRWGVLHAGIDLANAI

SEQ ID NO: 1059654 - protein, 20 aa, Mycobacterium
KGLEFPVVFVTGWEDGMLPH

SEQ ID NO: 1059655 - protein, 17 aa, Mycobacterium
KHIEAGYQFVNTPHITK

SEQ ID NO: 1059656 - protein, 17 aa, Mycobacterium
KHIRLIAAFDHRHVFLD

SEQ ID NO: 1059657 - protein, 19 aa, Mycobacterium
KHPAVSWVRYPFLVSHPQY

SEQ ID NO: 1059658 - protein, 19 aa, Mycobacterium
KLLGFHWTKVHAAHPGLGE

SEQ ID NO: 1059659 - protein, 18 aa, Mycobacterium
KLLQEFLLQLDLDEDTRR

SEQ ID NO: 1059660 - protein, 20 aa, Mycobacterium
KLPQAGWCGSGQAVSGSATA

SEQ ID NO: 1059661 - protein, 18 aa, Mycobacterium
KLQKRLTDELAWVRSGAK

SEQ ID NO: 1059662 - protein, 19 aa, Mycobacterium
KLVPFGAFVRVEEGIEGLV

SEQ ID NO: 1059663 - protein, 19 aa, Mycobacterium
KMVFGHRGINIPVIDHATG

SEQ ID NO: 1059664 - protein, 18 aa, Mycobacterium
KNEYPGKIFAILDSDHSM

SEQ ID NO: 1059665 - protein, 17 aa, Mycobacterium
KNYISGVLLDFQPDRLP

SEQ ID NO: 1059666 - protein, 18 aa, Mycobacterium
KPGMTLLDIGCGWGTTMR

SEQ ID NO: 1059667 - protein, 17 aa, Mycobacterium
KPLPWKDLRAAFTERGW

SEQ ID NO: 1059668 - protein, 18 aa, Mycobacterium
KQPVKYFLLFSSISGLIG

SEQ ID NO: 1059669 - protein, 21 aa, Mycobacterium
KRFTERFARFNLSPSVVRPSY

SEQ ID NO: 1059670 - protein, 17 aa, Mycobacterium
KRGKISLVLVADDDSAT

SEQ ID NO: 1059671 - protein, 19 aa, Mycobacterium
KRQVRCVYVAIGQKGTTIA

SEQ ID NO: 1059672 - protein, 20 aa, Mycobacterium
KRVCRDCGFFLSLVGSLGAM

SEQ ID NO: 1059673 - protein, 23 aa, Mycobacterium
KSSRVVCCWCIQHVIAVERQLRV

SEQ ID NO: 1059674 - protein, 18 aa, Mycobacterium
KSSTAWAPRGTVLITGGT

SEQ ID NO: 1059675 - protein, 22 aa, Mycobacterium
KTAPLWRVLVALSIRHVGPTAA

SEQ ID NO: 1059676 - protein, 19 aa, Mycobacterium
KVRASEMPLLWSALPANGP

SEQ ID NO: 1059677 - protein, 21 aa, Mycobacterium
KWKFTVPFVCGATNLGEALRR

SEQ ID NO: 1059678 - protein, 24 aa, Mycobacterium
LAAEILDPLGFRWTNFGVAEEDVP

SEQ ID NO: 1059679 - protein, 17 aa, Mycobacterium
LAALRAIPRLSVVRPAD

SEQ ID NO: 1059680 - protein, 17 aa, Mycobacterium
LADGLLLRGFIDRIDVA

SEQ ID NO: 1059681 - protein, 19 aa, Mycobacterium
LADGVVRPVVFLVYSGQAR

SEQ ID NO: 1059682 - protein, 21 aa, Mycobacterium
LAEELWLRLGHTTSLANGPFP

SEQ ID NO: 1059683 - protein, 20 aa, Mycobacterium
LAGDNVRVWQPSAFASPTPS

SEQ ID NO: 1059684 - protein, 24 aa, Mycobacterium
LAHWKCYMALGYFKLAIMAAGIDL

SEQ ID NO: 1059685 - protein, 21 aa, Mycobacterium
LAISAGKAWKVKRIRNNPRIT

SEQ ID NO: 1059686 - protein, 20 aa, Mycobacterium
LAKACARIMLGSSISQLRFE

SEQ ID NO: 1059687 - protein, 21 aa, Mycobacterium
LAKRICTIVASAIEFEIKDPG

SEQ ID NO: 1059688 - protein, 27 aa, Mycobacterium
LALIAREARFHWGIAMMPTGPQGRVSV

SEQ ID NO: 1059689 - protein, 18 aa, Mycobacterium
LALTELWRSYGVEPDAVI

SEQ ID NO: 1059690 - protein, 20 aa, Mycobacterium
LARAGFRTLALQTFLTVGPK

SEQ ID NO: 1059691 - protein, 17 aa, Mycobacterium
LARQSIPEALNWARSSN

SEQ ID NO: 1059692 - protein, 17 aa, Mycobacterium
LAVVTGLRLPETVGWDY

SEQ ID NO: 1059693 - protein, 20 aa, Mycobacterium
LCDTGRWRVPLILRLDPKIG

SEQ ID NO: 1059694 - protein, 20 aa, Mycobacterium
LCGWCPHQEHCPAFGGTPPP

SEQ ID NO: 1059695 - protein, 21 aa, Mycobacterium
LCLTCTTWSWPLPPEITKPDK

SEQ ID NO: 1059696 - protein, 20 aa, Mycobacterium
LDALCALGLQYRVAAAALPN

SEQ ID NO: 1059697 - protein, 18 aa, Mycobacterium
LDDHPIFLGRNGRISVFS

SEQ ID NO: 1059698 - protein, 18 aa, Mycobacterium
LDDIKFSAGQIITFIDEL

SEQ ID NO: 1059699 - protein, 17 aa, Mycobacterium
LDDVLIFDGLNPEELVR

SEQ ID NO: 1059700 - protein, 23 aa, Mycobacterium
LDESLMWVRIVPRFLGLGVGVDS

SEQ ID NO: 1059701 - protein, 22 aa, Mycobacterium
LDHVSGRPYGLWVHGNNDTVGA

SEQ ID NO: 1059702 - protein, 22 aa, Mycobacterium
LDLGFFPDIERLLGQIPTDRQS

SEQ ID NO: 1059703 - protein, 18 aa, Mycobacterium
LDMFGEWNRAYGAAGFLQ

SEQ ID NO: 1059704 - protein, 23 aa, Mycobacterium
LDQLSLPVLRSWLATAAGAGAAR

SEQ ID NO: 1059705 - protein, 17 aa, Mycobacterium
LDRLPAVDRAILRVSIW

SEQ ID NO: 1059706 - protein, 20 aa, Mycobacterium
LDVGCGWGGMVRYAARRGVR

SEQ ID NO: 1059707 - protein, 17 aa, Mycobacterium
LDWCRKNNVMFIADEVQ

SEQ ID NO: 1059708 - protein, 19 aa, Mycobacterium
LEAEWRLVSEYVRAIVALG

SEQ ID NO: 1059709 - protein, 19 aa, Mycobacterium
LECRPRKSLGQNFVHDANT

SEQ ID NO: 1059710 - protein, 19 aa, Mycobacterium
LEHPGSWGGLVDLPESPDD

SEQ ID NO: 1059711 - protein, 17 aa, Mycobacterium
LEIFTKFNIPINVARVF

SEQ ID NO: 1059712 - protein, 17 aa, Mycobacterium
LEIGVSHGFVFRRVAAD

SEQ ID NO: 1059713 - protein, 17 aa, Mycobacterium
LEPMAAILNPSSYSPPS

SEQ ID NO: 1059714 - protein, 31 aa, Mycobacterium
LESFFRGAGWNVIKVVWGREWDALLHADRDG

SEQ ID NO: 1059715 - protein, 20 aa, Mycobacterium
LESRAAQLVACWGNNDGPEL

SEQ ID NO: 1059716 - protein, 23 aa, Mycobacterium
LEVEAVSVLTVWEGKPAYQVIFR

SEQ ID NO: 1059717 - protein, 20 aa, Mycobacterium
LEVEEVYLPLARLIHLQVAA

SEQ ID NO: 1059718 - protein, 18 aa, Mycobacterium
LFAERCIKGLSANIEHLR

SEQ ID NO: 1059719 - protein, 23 aa, Mycobacterium
LFALGRLPGWIAHWREMHDEGDS

SEQ ID NO: 1059720 - protein, 22 aa, Mycobacterium
LFALLRFWGVVPDYVIGHSVGE

SEQ ID NO: 1059721 - protein, 17 aa, Mycobacterium
LFDPVIFFWQWVEWLFG

SEQ ID NO: 1059722 - protein, 22 aa, Mycobacterium
LGNSRTGVMIGVYFNEYQSMLA

SEQ ID NO: 1059723 - protein, 19 aa, Mycobacterium
LGPRGRHVVLAKAFGGPTI

SEQ ID NO: 1059724 - protein, 22 aa, Mycobacterium
LGSLRIGNRFVHTGKPTPTAYA

SEQ ID NO: 1059725 - protein, 20 aa, Mycobacterium
LGSRFMFDWYLTDVVWHNSV

SEQ ID NO: 1059726 - protein, 18 aa, Mycobacterium
LGSYRFTDFRSRKTAPKD

SEQ ID NO: 1059727 - protein, 22 aa, Mycobacterium
LHDLYQRWPFFRSVLSNMAQVL

SEQ ID NO: 1059728 - protein, 17 aa, Mycobacterium
LHEDLRYGLDITTQATV

SEQ ID NO: 1059729 - protein, 19 aa, Mycobacterium
LHLSFNFLLAQIINFDAAA

SEQ ID NO: 1059730 - protein, 19 aa, Mycobacterium
LHTPLPLLAFTAWPEVRSQ

SEQ ID NO: 1059731 - protein, 18 aa, Mycobacterium
LIDPEAWAFVWVVDPPLF

SEQ ID NO: 1059732 - protein, 18 aa, Mycobacterium
LIEAPPWLQGALIAMLYG

SEQ ID NO: 1059733 - protein, 18 aa, Mycobacterium
LILADAIVRACQDNPDYL

SEQ ID NO: 1059734 - protein, 19 aa, Mycobacterium
LKAIEAWHALLGIGVPNDG

SEQ ID NO: 1059735 - protein, 20 aa, Mycobacterium
LKGEVKDVLLLDVTPLSLGI

SEQ ID NO: 1059736 - protein, 18 aa, Mycobacterium
LKGKLDGYALRVPIPTGS

SEQ ID NO: 1059737 - protein, 18 aa, Mycobacterium
LKLSIPVAERAKPRKISV

SEQ ID NO: 1059738 - protein, 20 aa, Mycobacterium
LKRNRRLFCVSYTLDNVGDI

SEQ ID NO: 1059739 - protein, 19 aa, Mycobacterium
LKRPIPFLPNMIGIITGRA

SEQ ID NO: 1059740 - protein, 17 aa, Mycobacterium
LKSGLLLLMDSVDDLGH

SEQ ID NO: 1059741 - protein, 17 aa, Mycobacterium
LKSSVAMELVRKQRGLM

SEQ ID NO: 1059742 - protein, 17 aa, Mycobacterium
LKVSVPEEVSWRMGWID

SEQ ID NO: 1059743 - protein, 18 aa, Mycobacterium
LKVVGAWLHAGPQIEKVR

SEQ ID NO: 1059744 - protein, 20 aa, Mycobacterium
LLDALRWLGLNWDEGPEVGG

SEQ ID NO: 1059745 - protein, 19 aa, Mycobacterium
LLDRVSSKYALVIYAAKRA

SEQ ID NO: 1059746 - protein, 17 aa, Mycobacterium
LLEMGIRVRYLHSEVDT

SEQ ID NO: 1059747 - protein, 18 aa, Mycobacterium
LLESFLFYSGFYLPMYWS

SEQ ID NO: 1059748 - protein, 19 aa, Mycobacterium
LLFGIPYDRIEVVVHPQSI

SEQ ID NO: 1059749 - protein, 20 aa, Mycobacterium
LLKSCYLLALSQNWLLNLVD

SEQ ID NO: 1059750 - protein, 19 aa, Mycobacterium
LLSNWRVNPVLAVLAASTR

SEQ ID NO: 1059751 - protein, 18 aa, Mycobacterium
LLSPHGRCAAFDAAADGF

SEQ ID NO: 1059752 - protein, 18 aa, Mycobacterium
LLSQAGFNFVRIVSEGGA

SEQ ID NO: 1059753 - protein, 17 aa, Mycobacterium
LLVIPGPHDDWFIDPDV

SEQ ID NO: 1059754 - protein, 18 aa, Mycobacterium
LMAAARLDLASVFLYAGS

SEQ ID NO: 1059755 - protein, 17 aa, Mycobacterium
LMHVRFGPYHVRDVKFV

SEQ ID NO: 1059756 - protein, 19 aa, Mycobacterium
LMPMYLRFVKGVVDAEDMS

SEQ ID NO: 1059757 - protein, 22 aa, Mycobacterium
LMSVGDLIIGWLLQRQAAVAVQ

SEQ ID NO: 1059758 - protein, 19 aa, Mycobacterium
LNMAIPWIAAERGFIDAVV

SEQ ID NO: 1059759 - protein, 19 aa, Mycobacterium
LNSKTRRPSVCNAAETLLI

SEQ ID NO: 1059760 - protein, 17 aa, Mycobacterium
LPADVFDLWGLPADDPR

SEQ ID NO: 1059761 - protein, 18 aa, Mycobacterium
LPAKRWLAQHGFDPVYGA

SEQ ID NO: 1059762 - protein, 18 aa, Mycobacterium
LPATLALPMRVIASVGAI

SEQ ID NO: 1059763 - protein, 18 aa, Mycobacterium
LPAWDLPTVFGPSAVIYH

SEQ ID NO: 1059764 - protein, 18 aa, Mycobacterium
LPAWYRPNSGLARDLAFI

SEQ ID NO: 1059765 - protein, 17 aa, Mycobacterium
LPETVGWDYGSISGLSR

SEQ ID NO: 1059766 - protein, 20 aa, Mycobacterium
LPFEHARPTAIMTWMRQHWG

SEQ ID NO: 1059767 - protein, 23 aa, Mycobacterium
LPGGFPVELGMSIRLARDKNYNL

SEQ ID NO: 1059768 - protein, 20 aa, Mycobacterium
LPGYQGWQWAVVVAAYPGAE

SEQ ID NO: 1059769 - protein, 18 aa, Mycobacterium
LPKGWVITTSGRVSGVTE

SEQ ID NO: 1059770 - protein, 22 aa, Mycobacterium
LPPEFRAAVVLCDIEGLSYEEI

SEQ ID NO: 1059771 - protein, 18 aa, Mycobacterium
LPPELDFTALFHGVDERV

SEQ ID NO: 1059772 - protein, 17 aa, Mycobacterium
LPQAVPVTRLWLTKQET

SEQ ID NO: 1059773 - protein, 19 aa, Mycobacterium
LPRRDLCMLAAKLGSDVPF

SEQ ID NO: 1059774 - protein, 19 aa, Mycobacterium
LPTVRGAFCLTFMDENTLY

SEQ ID NO: 1059775 - protein, 17 aa, Mycobacterium
LPVALVWAYPTTADLAA

SEQ ID NO: 1059776 - protein, 22 aa, Mycobacterium
LPVHCWFQGSGWGFSVHPALDC

SEQ ID NO: 1059777 - protein, 23 aa, Mycobacterium
LPVKLCYAGPFFRYERPQAGRCR

SEQ ID NO: 1059778 - protein, 18 aa, Mycobacterium
LPWPFGLIDHAARVLLPV

SEQ ID NO: 1059779 - protein, 21 aa, Mycobacterium
LPYVMALEWIGRICARIARRR

SEQ ID NO: 1059780 - protein, 18 aa, Mycobacterium
LQGKIIPDLIAWWCERDG

SEQ ID NO: 1059781 - protein, 18 aa, Mycobacterium
LQIPVLLIRGKTLLRDHL

SEQ ID NO: 1059782 - protein, 23 aa, Mycobacterium
LRAHPTKALTMLAAVPITATAKA

SEQ ID NO: 1059783 - protein, 17 aa, Mycobacterium
LRALLGIIVDGEAGLSK

SEQ ID NO: 1059784 - protein, 17 aa, Mycobacterium
LRARIGLSSSVLTQRVP

SEQ ID NO: 1059785 - protein, 17 aa, Mycobacterium
LRATWKYVDHFDATGIA

SEQ ID NO: 1059786 - protein, 17 aa, Mycobacterium
LRFADALSMADNVMTFR

SEQ ID NO: 1059787 - protein, 20 aa, Mycobacterium
LRGSEDFLSILLSAIGSRQA

SEQ ID NO: 1059788 - protein, 19 aa, Mycobacterium
LRIAQAQLVGWLEGLFHGI

SEQ ID NO: 1059789 - protein, 19 aa, Mycobacterium
LRLALGVILEIDRPAPERV

SEQ ID NO: 1059790 - protein, 18 aa, Mycobacterium
LRLLFKDEVRAVGRQLDL

SEQ ID NO: 1059791 - protein, 17 aa, Mycobacterium
LRLPETVGWDYGSISGL

SEQ ID NO: 1059792 - protein, 21 aa, Mycobacterium
LRPGAIIRDLHLLRPIYAQTA

SEQ ID NO: 1059793 - protein, 19 aa, Mycobacterium
LRTANALDFDDLIGETVGI

SEQ ID NO: 1059794 - protein, 17 aa, Mycobacterium
LRTLYCDQLLVLAALDL

SEQ ID NO: 1059795 - protein, 17 aa, Mycobacterium
LRWSNSVAILAGDYLFA

SEQ ID NO: 1059796 - protein, 20 aa, Mycobacterium
LRYIMPLGEIIFDFFDSLKS

SEQ ID NO: 1059797 - protein, 20 aa, Mycobacterium
LSALARNAAEFGLIPDTGHL

SEQ ID NO: 1059798 - protein, 22 aa, Mycobacterium
LSELQPGDVLTFYSDASHAGIY

SEQ ID NO: 1059799 - protein, 21 aa, Mycobacterium
LSFSSLSGWAQRGLRDRFLEL

SEQ ID NO: 1059800 - protein, 18 aa, Mycobacterium
LSGGHLFSIYDGCRSESI

SEQ ID NO: 1059801 - protein, 18 aa, Mycobacterium
LSKFEVVTAMAFAAFANA

SEQ ID NO: 1059802 - protein, 23 aa, Mycobacterium
LSKLARPTSTWTYMVNDAPLSDD

SEQ ID NO: 1059803 - protein, 18 aa, Mycobacterium
LSKRGGGVALLLSNIREH

SEQ ID NO: 1059804 - protein, 19 aa, Mycobacterium
LSLYTLEFFLAEANQDAGR

SEQ ID NO: 1059805 - protein, 17 aa, Mycobacterium
LSVAALARWHRPRLEVL

SEQ ID NO: 1059806 - protein, 18 aa, Mycobacterium
LSVMPPFLTGGSMIETVT

SEQ ID NO: 1059807 - protein, 17 aa, Mycobacterium
LSWGFDRIFAVSANHSV

SEQ ID NO: 1059808 - protein, 17 aa, Mycobacterium
LTALPFAPGYGVEIGLL

SEQ ID NO: 1059809 - protein, 25 aa, Mycobacterium
LTDLVFAWRACRAVKSNAIVIAADG

SEQ ID NO: 1059810 - protein, 18 aa, Mycobacterium
LTEAILVRGVDWVREITR

SEQ ID NO: 1059811 - protein, 18 aa, Mycobacterium
LTLTELWRSYGVQPDLVI

SEQ ID NO: 1059812 - protein, 18 aa, Mycobacterium
LTQQILWDRLCAALTPGN

SEQ ID NO: 1059813 - protein, 17 aa, Mycobacterium
LTRLRGATVLAHNYQLP

SEQ ID NO: 1059814 - protein, 19 aa, Mycobacterium
LTSELPKWLSANRSVKSTG

SEQ ID NO: 1059815 - protein, 17 aa, Mycobacterium
LTTRIYADFTYRSGSTT

SEQ ID NO: 1059816 - protein, 19 aa, Mycobacterium
LVAEHVKLRLGSAREATDA

SEQ ID NO: 1059817 - protein, 18 aa, Mycobacterium
LVAPLTFLAIAGRRVQLE

SEQ ID NO: 1059818 - protein, 24 aa, Mycobacterium
LVDEVRMLLRWGLRDGVTASRALG

SEQ ID NO: 1059819 - protein, 18 aa, Mycobacterium
LVGLPATVVAWGLWKSLA

SEQ ID NO: 1059820 - protein, 18 aa, Mycobacterium
LVKDFGINTANMFGFWEW

SEQ ID NO: 1059821 - protein, 20 aa, Mycobacterium
LVKVRPGYEAALAAVLGPAA

SEQ ID NO: 1059822 - protein, 17 aa, Mycobacterium
LVLRRLTEVLARDRTRH

SEQ ID NO: 1059823 - protein, 20 aa, Mycobacterium
LVMRARLTWQQVVLLRAYAK

SEQ ID NO: 1059824 - protein, 24 aa, Mycobacterium
LVNRKVLPGYILVRMDLTDDSWAA

SEQ ID NO: 1059825 - protein, 17 aa, Mycobacterium
LVQCGAALKQLRTSLTG

SEQ ID NO: 1059826 - protein, 25 aa, Mycobacterium
LYAAWRSTYRWRPGVAVLLINKTDQ

SEQ ID NO: 1059827 - protein, 18 aa, Mycobacterium
LYDRVGFAAAGKFNEFDN

SEQ ID NO: 1059828 - protein, 17 aa, Mycobacterium
LYRRRILELAAALSDDF

SEQ ID NO: 1059829 - protein, 18 aa, Mycobacterium
MADELVALLVVVPVSSWD

SEQ ID NO: 1059830 - protein, 21 aa, Mycobacterium
MALKRFAFRLGDIWVQQVKTS

SEQ ID NO: 1059831 - protein, 19 aa, Mycobacterium
MANALYWLKELHIEGLRVD

SEQ ID NO: 1059832 - protein, 18 aa, Mycobacterium
MARRVLIELLAWQFASPV

SEQ ID NO: 1059833 - protein, 21 aa, Mycobacterium
MAVWQRLHFGFGLPKPPMEPL

SEQ ID NO: 1059834 - protein, 21 aa, Mycobacterium
MDRKVWLPSGGTLVIDRTEAM

SEQ ID NO: 1059835 - protein, 20 aa, Mycobacterium
MELGCDAVLLASAVTRAVDP

SEQ ID NO: 1059836 - protein, 24 aa, Mycobacterium
MFRRCMRCGYTAFCVDVFSRRIPG

SEQ ID NO: 1059837 - protein, 17 aa, Mycobacterium
MGLIPAMTVKCAVAMVK

SEQ ID NO: 1059838 - protein, 18 aa, Mycobacterium
MIFKRLYDAGLIYRAERL

SEQ ID NO: 1059839 - protein, 17 aa, Mycobacterium
MLEVSWEALEYAGIDPL

SEQ ID NO: 1059840 - protein, 18 aa, Mycobacterium
MLGGQGFAIPIGQAMEVV

SEQ ID NO: 1059841 - protein, 20 aa, Mycobacterium
MLQARLKALRVFERKPMPRW

SEQ ID NO: 1059842 - protein, 25 aa, Mycobacterium
MLTCSIRPSGIWGRGDQTMFRKAFE

SEQ ID NO: 1059843 - protein, 17 aa, Mycobacterium
MPDSGPSTFAWPLNPER

SEQ ID NO: 1059844 - protein, 20 aa, Mycobacterium
MPPAERWHLLASTWLDLQCR

SEQ ID NO: 1059845 - protein, 19 aa, Mycobacterium
MPYKSGFGPFAPEIYRAPL

SEQ ID NO: 1059846 - protein, 21 aa, Mycobacterium
MRPDLTIGFFLHIPFPPVELF

SEQ ID NO: 1059847 - protein, 17 aa, Mycobacterium
MTPAAFVRRPGRWIREL

SEQ ID NO: 1059848 - protein, 20 aa, Mycobacterium
MTSMYPKLWAVSSVDYPTLL

SEQ ID NO: 1059849 - protein, 20 aa, Mycobacterium
MVWAACERADFVAEVQAMRR

SEQ ID NO: 1059850 - protein, 19 aa, Mycobacterium
MVWRYSDYFIVGREQCREF

SEQ ID NO: 1059851 - protein, 19 aa, Mycobacterium
NALCAAAVGLECGASVEEV

SEQ ID NO: 1059852 - protein, 19 aa, Mycobacterium
NEFFKLWLDPSMTYSCAYF

SEQ ID NO: 1059853 - protein, 23 aa, Mycobacterium
NERLFCLPAAIDLAGAEIELVSM

SEQ ID NO: 1059854 - protein, 18 aa, Mycobacterium
NHCGHCLLAFGRLSDCAS

SEQ ID NO: 1059855 - protein, 17 aa, Mycobacterium
NKLAVARRVYRPADGSC

SEQ ID NO: 1059856 - protein, 18 aa, Mycobacterium
NLCGLKAAIAIAGREAAA

SEQ ID NO: 1059857 - protein, 17 aa, Mycobacterium
NLPGVAFGHDWLTGTAR

SEQ ID NO: 1059858 - protein, 18 aa, Mycobacterium
NLVEYGFRLPSACDNRPL

SEQ ID NO: 1059859 - protein, 19 aa, Mycobacterium
NQQFGLLFVDWLKANPGVR

SEQ ID NO: 1059860 - protein, 20 aa, Mycobacterium
NRAQACLLIMSNIFGQNSTA

SEQ ID NO: 1059861 - protein, 17 aa, Mycobacterium
NRFYEWVLGPSMTYTCA

SEQ ID NO: 1059862 - protein, 21 aa, Mycobacterium
NRGDIKVALFGNHVPKTVANF

SEQ ID NO: 1059863 - protein, 19 aa, Mycobacterium
NRITGGFTVRFARPGETIV

SEQ ID NO: 1059864 - protein, 18 aa, Mycobacterium
NRLRCYVVGVTRGAREPL

SEQ ID NO: 1059865 - protein, 24 aa, Mycobacterium
NRRLAQQVEWAWQMVRDAVLDRVL

SEQ ID NO: 1059866 - protein, 18 aa, Mycobacterium
NSCLICRRLTIGWSSLHS

SEQ ID NO: 1059867 - protein, 18 aa, Mycobacterium
NSKWPMVFLIAASEFVVV

SEQ ID NO: 1059868 - protein, 22 aa, Mycobacterium
NSVDLLWLLGLWLGDGHTAAPH

SEQ ID NO: 1059869 - protein, 24 aa, Mycobacterium
NTFRHLCGLDCSHIAPANVYGPRQ

SEQ ID NO: 1059870 - protein, 20 aa, Mycobacterium
NVHAFFRFLVEMFGMVPSDV

SEQ ID NO: 1059871 - protein, 20 aa, Mycobacterium
NVPCSLALSRYCWRPMTLVS

SEQ ID NO: 1059872 - protein, 19 aa, Mycobacterium
NVPDAFAVIADRLGNSLYT

SEQ ID NO: 1059873 - protein, 18 aa, Mycobacterium
PAAGDGWRKFVTKATLGR

SEQ ID NO: 1059874 - protein, 21 aa, Mycobacterium
PAMSAFNAWILLKGLETLAIR

SEQ ID NO: 1059875 - protein, 17 aa, Mycobacterium
PAPLAMDVHPGRRAAGR

SEQ ID NO: 1059876 - protein, 22 aa, Mycobacterium
PASARGSLRLSLGHNSVEVDVE

SEQ ID NO: 1059877 - protein, 21 aa, Mycobacterium
PASIRPTLRWRLLPADYVEVA

SEQ ID NO: 1059878 - protein, 20 aa, Mycobacterium
PASYWRRWTICKSVVLRVEV

SEQ ID NO: 1059879 - protein, 20 aa, Mycobacterium
PATVWTLNWVHRLIEGAPHP

SEQ ID NO: 1059880 - protein, 18 aa, Mycobacterium
PDDVLGMLASQGVVTEVG

SEQ ID NO: 1059881 - protein, 17 aa, Mycobacterium
PDFASSCYVNAQKLSSR

SEQ ID NO: 1059882 - protein, 20 aa, Mycobacterium
PDHAYPLLVSVFLDKDFAFV

SEQ ID NO: 1059883 - protein, 22 aa, Mycobacterium
PDPRAADVVKTWVHVLDQLERD

SEQ ID NO: 1059884 - protein, 17 aa, Mycobacterium
PEASFRVGHLVDRQPTV

SEQ ID NO: 1059885 - protein, 18 aa, Mycobacterium
PEATMCRFGVPLGPVAEP

SEQ ID NO: 1059886 - protein, 21 aa, Mycobacterium
PEFIGRLPVIASVINLDMESL

SEQ ID NO: 1059887 - protein, 17 aa, Mycobacterium
PEGFGRIAATTARQVML

SEQ ID NO: 1059888 - protein, 18 aa, Mycobacterium
PELRPMVQLDGGRFATSD

SEQ ID NO: 1059889 - protein, 18 aa, Mycobacterium
PETQIAISAWGLLSPHGR

SEQ ID NO: 1059890 - protein, 18 aa, Mycobacterium
PFEHARPTAIMTLMRQHC

SEQ ID NO: 1059891 - protein, 20 aa, Mycobacterium
PGCLRALLRDEIRQLYKEVG

SEQ ID NO: 1059892 - protein, 17 aa, Mycobacterium
PGKLLGFHWTKVHAAHP

SEQ ID NO: 1059893 - protein, 17 aa, Mycobacterium
PGLLSWRDVAQVMSENP

SEQ ID NO: 1059894 - protein, 18 aa, Mycobacterium
PGLVHIYHALTWGPLMRE

SEQ ID NO: 1059895 - protein, 17 aa, Mycobacterium
PGLWRLDSLPLLVSATD

SEQ ID NO: 1059896 - protein, 20 aa, Mycobacterium
PGNCGSSWGRCWPPKVVAPS

SEQ ID NO: 1059897 - protein, 23 aa, Mycobacterium
PGTRRIYSNYGFRVLAETVQREA

SEQ ID NO: 1059898 - protein, 20 aa, Mycobacterium
PGVAFGHDWLTGTARYAGLL

SEQ ID NO: 1059899 - protein, 19 aa, Mycobacterium
PGVLIGFLGPRVYELLYGE

SEQ ID NO: 1059900 - protein, 24 aa, Mycobacterium
PHLADGIGIVGGWAEKVGLDVTLA

SEQ ID NO: 1059901 - protein, 25 aa, Mycobacterium
PHQIPRAGNMFSVFFSEAPVTDFAS

SEQ ID NO: 1059902 - protein, 24 aa, Mycobacterium
PILKGDKGEPCWPDGVVGSLTHCS

SEQ ID NO: 1059903 - protein, 19 aa, Mycobacterium
PIRGDAVISHFVRTVITMM

SEQ ID NO: 1059904 - protein, 17 aa, Mycobacterium
PKEAITHGFVDTQQLSA

SEQ ID NO: 1059905 - protein, 19 aa, Mycobacterium
PKPLAAYLFTKSRKTRDRV

SEQ ID NO: 1059906 - protein, 20 aa, Mycobacterium
PKYWGGICLNVGCIPSKVLL

SEQ ID NO: 1059907 - protein, 20 aa, Mycobacterium
PLCRPCHRRLFTIANQKGGV

SEQ ID NO: 1059908 - protein, 18 aa, Mycobacterium
PLGIYCRASLAQFMDAER

SEQ ID NO: 1059909 - protein, 23 aa, Mycobacterium
PLLEAIGLTVGWITAESTREDRK

SEQ ID NO: 1059910 - protein, 17 aa, Mycobacterium
PLLEKRGLQSFPEVLKR

SEQ ID NO: 1059911 - protein, 19 aa, Mycobacterium
PLPQTRFVLRKTLAAHLPV

SEQ ID NO: 1059912 - protein, 17 aa, Mycobacterium
PLRVKAAAVGLAADEYH

SEQ ID NO: 1059913 - protein, 19 aa, Mycobacterium
PLSRGRPGTIADRDVLADY

SEQ ID NO: 1059914 - protein, 18 aa, Mycobacterium
PMVLPSRFPNLLANGSGG

SEQ ID NO: 1059915 - protein, 18 aa, Mycobacterium
PNAGSRFLLDQAITSAGR

SEQ ID NO: 1059916 - protein, 18 aa, Mycobacterium
PNLFATHRVRAVDDYASH

SEQ ID NO: 1059917 - protein, 22 aa, Mycobacterium
PNRPMVCINLDWLPQFRGDLIP

SEQ ID NO: 1059918 - protein, 18 aa, Mycobacterium
PPFLKRVVLRTAARLSRR

SEQ ID NO: 1059919 - protein, 25 aa, Mycobacterium
PPNFPDDFLLYWGLLAAMQVRTGRL

SEQ ID NO: 1059920 - protein, 24 aa, Mycobacterium
PPTAFPQWFGRSWRRSAILRYGEN

SEQ ID NO: 1059921 - protein, 24 aa, Mycobacterium
PQAGWAVRMWLVYDLALTGISLSS

SEQ ID NO: 1059922 - protein, 20 aa, Mycobacterium
PQLTPGWKYNEWELRGVPIR

SEQ ID NO: 1059923 - protein, 18 aa, Mycobacterium
PQPATCPATFLSVCEHYQ

SEQ ID NO: 1059924 - protein, 17 aa, Mycobacterium
PRCPLVVDECRLREPEL

SEQ ID NO: 1059925 - protein, 20 aa, Mycobacterium
PRDEWPSMIRRLVSEQISLL

SEQ ID NO: 1059926 - protein, 18 aa, Mycobacterium
PRDGFLLEMIYRVYHTDN

SEQ ID NO: 1059927 - protein, 19 aa, Mycobacterium
PRFRIQWSVRQGGRRDVQW

SEQ ID NO: 1059928 - protein, 18 aa, Mycobacterium
PRLAMAVAARVLLVLGKL

SEQ ID NO: 1059929 - protein, 17 aa, Mycobacterium
PRLGSWLRNSTRGALAM

SEQ ID NO: 1059930 - protein, 20 aa, Mycobacterium
PRLRYWLDRLSTYGVLAYAA

SEQ ID NO: 1059931 - protein, 17 aa, Mycobacterium
PRLSAVSSRIFGTPHDV

SEQ ID NO: 1059932 - protein, 20 aa, Mycobacterium
PRRCIKELSWAHVAEQTLDI

SEQ ID NO: 1059933 - protein, 19 aa, Mycobacterium
PRTGLSMGEHAAITAKKMG

SEQ ID NO: 1059934 - protein, 19 aa, Mycobacterium
PRTRLCGIAWRGRFNSSSG

SEQ ID NO: 1059935 - protein, 17 aa, Mycobacterium
PRTVSVSVLMDGRIDHV

SEQ ID NO: 1059936 - protein, 17 aa, Mycobacterium
PRYTIWAQIPGASSGSP

SEQ ID NO: 1059937 - protein, 19 aa, Mycobacterium
PSGVFLRRLIHAPATTTSK

SEQ ID NO: 1059938 - protein, 25 aa, Mycobacterium
PSKVVAKRGWRHWVHTVTRINLGLS

SEQ ID NO: 1059939 - protein, 17 aa, Mycobacterium
PSVLGWAAFRDVAQHYS

SEQ ID NO: 1059940 - protein, 25 aa, Mycobacterium
PSYKACFLALVRCFYELGVKELHGH

SEQ ID NO: 1059941 - protein, 18 aa, Mycobacterium
PTGSFLFLGPTGVGKTEL

SEQ ID NO: 1059942 - protein, 18 aa, Mycobacterium
PTTCPECGTTLAPEKEGD

SEQ ID NO: 1059943 - protein, 19 aa, Mycobacterium
PVAACATAAVSVEEGVDKI

SEQ ID NO: 1059944 - protein, 23 aa, Mycobacterium
PVIGTKELIAWLPTLLGLRAGDV

SEQ ID NO: 1059945 - protein, 17 aa, Mycobacterium
PVILCVRWNRISKINSI

SEQ ID NO: 1059946 - protein, 18 aa, Mycobacterium
PVPFHLLPTVAREFGKDT

SEQ ID NO: 1059947 - protein, 19 aa, Mycobacterium
PWARLGVNVDADFEPLYII

SEQ ID NO: 1059948 - protein, 17 aa, Mycobacterium
PWLPDLVRRSPWAEMFS

SEQ ID NO: 1059949 - protein, 17 aa, Mycobacterium
PYLNLGRYRWRGRSLAQ

SEQ ID NO: 1059950 - protein, 19 aa, Mycobacterium
PYPPRAVLLAANRDPLTRH

SEQ ID NO: 1059951 - protein, 23 aa, Mycobacterium
PYSEFPRFYSLMAEMSGAMFDAA

SEQ ID NO: 1059952 - protein, 23 aa, Mycobacterium
QAAMFDGRFVGFIDFLVRDGEQY

SEQ ID NO: 1059953 - protein, 19 aa, Mycobacterium
QADKYEVPRICFVNKMDKI

SEQ ID NO: 1059954 - protein, 26 aa, Mycobacterium
QAFDGLRLAGRWVRRPDLTVATEDHN

SEQ ID NO: 1059955 - protein, 23 aa, Mycobacterium
QAGALPPLFSRLVRRSRRRQIED

SEQ ID NO: 1059956 - protein, 22 aa, Mycobacterium
QARGRGATMIFTRTKRTAQKVT

SEQ ID NO: 1059957 - protein, 22 aa, Mycobacterium
QARTAGLGDAWLAICPATPQLV

SEQ ID NO: 1059958 - protein, 21 aa, Mycobacterium
QDEYLCWAVKAFRLATSGVAD

SEQ ID NO: 1059959 - protein, 18 aa, Mycobacterium
QEDFIGIHFFSPVDKMPL

SEQ ID NO: 1059960 - protein, 23 aa, Mycobacterium
QEDKRWTPTWGEDQRAAAYAGWR

SEQ ID NO: 1059961 - protein, 18 aa, Mycobacterium
QGDPRLSAVSSRIFGTPH

SEQ ID NO: 1059962 - protein, 21 aa, Mycobacterium
QGGPCARTVLDTALLHAVIAG

SEQ ID NO: 1059963 - protein, 20 aa, Mycobacterium
QIPVGPRLGNMVVEVEHLDK

SEQ ID NO: 1059964 - protein, 19 aa, Mycobacterium
QIRALVLGCAMDWLADNQA

SEQ ID NO: 1059965 - protein, 17 aa, Mycobacterium
QKELDVFRLPGTKPPFT

SEQ ID NO: 1059966 - protein, 20 aa, Mycobacterium
QLFKQLLMVAGMERYYQIAH

SEQ ID NO: 1059967 - protein, 21 aa, Mycobacterium
QLRPGQQVRLHWVRTQSSPLE

SEQ ID NO: 1059968 - protein, 24 aa, Mycobacterium
QLTRKRLGTGLVEAFSTSCPNCTG

SEQ ID NO: 1059969 - protein, 17 aa, Mycobacterium
QMLAYNLSPSFNWDTTG

SEQ ID NO: 1059970 - protein, 18 aa, Mycobacterium
QPEIKLGVLPGMGGSQRL

SEQ ID NO: 1059971 - protein, 17 aa, Mycobacterium
QPFLLSAYIDFAALRAK

SEQ ID NO: 1059972 - protein, 25 aa, Mycobacterium
QPVSMLIPWVVGFKLSGEIQPGVTA

SEQ ID NO: 1059973 - protein, 22 aa, Mycobacterium
QQAAVNRIHWFYSLSPTDRRQY

SEQ ID NO: 1059974 - protein, 18 aa, Mycobacterium
QQLTWLPQRPVLIPGTVG

SEQ ID NO: 1059975 - protein, 18 aa, Mycobacterium
QQLWSVQVPRRLKELHLQ

SEQ ID NO: 1059976 - protein, 23 aa, Mycobacterium
QRGEPVSCFLLRIEDNMESIGRS

SEQ ID NO: 1059977 - protein, 18 aa, Mycobacterium
QRVLGLHFFNPVPVLPLV

SEQ ID NO: 1059978 - protein, 17 aa, Mycobacterium
QRYWGEPFPIIYDSDGR

SEQ ID NO: 1059979 - protein, 18 aa, Mycobacterium
QSDFGVAPGHVFVTGMSN

SEQ ID NO: 1059980 - protein, 19 aa, Mycobacterium
QTGFARTGAMFACEHDGIV

SEQ ID NO: 1059981 - protein, 18 aa, Mycobacterium
QTTLTTKVTVEWVELPQQ

SEQ ID NO: 1059982 - protein, 24 aa, Mycobacterium
QVVLSVPVSNGWIDIPFTLPTNTV

SEQ ID NO: 1059983 - protein, 21 aa, Mycobacterium
QWRQPGCSMCLGMNPDQLAPG

SEQ ID NO: 1059984 - protein, 22 aa, Mycobacterium
RAACIKAMIEKVVDRMYAEIDD

SEQ ID NO: 1059985 - protein, 19 aa, Mycobacterium
RAAGIPILGKTNMDEFAMG

SEQ ID NO: 1059986 - protein, 19 aa, Mycobacterium
RAETGIIYIDEVDKIARKS

SEQ ID NO: 1059987 - protein, 17 aa, Mycobacterium
RAGEGVSYGHDWIAQHD

SEQ ID NO: 1059988 - protein, 17 aa, Mycobacterium
RAGLPPTLVVAGSHMDG

SEQ ID NO: 1059989 - protein, 18 aa, Mycobacterium
RAGMVPLLTVLGNIIHTM

SEQ ID NO: 1059990 - protein, 24 aa, Mycobacterium
RAGVLRFVILDGLAKPGRLVGPDP

SEQ ID NO: 1059991 - protein, 18 aa, Mycobacterium
RAHLRAFVLVPWLAVDSD

SEQ ID NO: 1059992 - protein, 17 aa, Mycobacterium
RAHVPLSEMFGYVGDLR

SEQ ID NO: 1059993 - protein, 19 aa, Mycobacterium
RAIHFQEWWVRYRAQVPTH

SEQ ID NO: 1059994 - protein, 25 aa, Mycobacterium
RALGCTIKLLFICERITAADGQQRV

SEQ ID NO: 1059995 - protein, 20 aa, Mycobacterium
RALIAVRGLHRFAVAEGLVD

SEQ ID NO: 1059996 - protein, 22 aa, Mycobacterium
RALKVWADQGLRVIGLDHDGDT

SEQ ID NO: 1059997 - protein, 18 aa, Mycobacterium
RANPGMFSRLVIDYYGSA

SEQ ID NO: 1059998 - protein, 20 aa, Mycobacterium
RASHARFAVYLGDLGNDTAA

SEQ ID NO: 1059999 - protein, 18 aa, Mycobacterium
RASILVDVDDGWSYAVAE

SEQ ID NO: 1060000 - protein, 23 aa, Mycobacterium
RAYFRGECLRRFSADIAAASWDS

SEQ ID NO: 1060001 - protein, 22 aa, Mycobacterium
RAYLPGTLLPPGIRATADPADA

SEQ ID NO: 1060002 - protein, 19 aa, Mycobacterium
RAYRLDWPTGTTVYEIDQP

SEQ ID NO: 1060003 - protein, 18 aa, Mycobacterium
RCEARTGAPLLSYGTPKS

SEQ ID NO: 1060004 - protein, 18 aa, Mycobacterium
RDAALCLAVLRIGADPDG

SEQ ID NO: 1060005 - protein, 20 aa, Mycobacterium
RDALDFGKPVRFSTTIGNVN

SEQ ID NO: 1060006 - protein, 25 aa, Mycobacterium
RDLRWLRRVGLLAASACAVFFRHPS

SEQ ID NO: 1060007 - protein, 17 aa, Mycobacterium
RDLVGFGRRFIDVTADD

SEQ ID NO: 1060008 - protein, 23 aa, Mycobacterium
RDTRLRFIRTYRRIVDPLNPPPA

SEQ ID NO: 1060009 - protein, 19 aa, Mycobacterium
REANGDRYLPIWIGQSEAA

SEQ ID NO: 1060010 - protein, 17 aa, Mycobacterium
REFKRLAKATGINEPRL

SEQ ID NO: 1060011 - protein, 20 aa, Mycobacterium
RELEAMPDLVARVIAGMGPV

SEQ ID NO: 1060012 - protein, 24 aa, Mycobacterium
RELQELRKLIGLDVSDRIRVLMSV

SEQ ID NO: 1060013 - protein, 24 aa, Mycobacterium
REPIGVAGEVIWRVSMLSPADEAV

SEQ ID NO: 1060014 - protein, 21 aa, Mycobacterium
REPRGVLEIAYRCPSGEPGVV

SEQ ID NO: 1060015 - protein, 18 aa, Mycobacterium
RFCDAFNIPLVFVVDTPG

SEQ ID NO: 1060016 - protein, 17 aa, Mycobacterium
RFESCKILGIPDLLVSG

SEQ ID NO: 1060017 - protein, 18 aa, Mycobacterium
RFIGVEALLRWAHPTLGT

SEQ ID NO: 1060018 - protein, 17 aa, Mycobacterium
RFLLKRNRRLFCVSYTL

SEQ ID NO: 1060019 - protein, 19 aa, Mycobacterium
RFRFVEEMIRLGADARTDG

SEQ ID NO: 1060020 - protein, 17 aa, Mycobacterium
RFVEIPVVPWVVSAKSQ

SEQ ID NO: 1060021 - protein, 20 aa, Mycobacterium
RGAGVSWVYLAGPEKALGDI

SEQ ID NO: 1060022 - protein, 21 aa, Mycobacterium
RGCLGRPWLFAELSAAFTGRP

SEQ ID NO: 1060023 - protein, 20 aa, Mycobacterium
RGEAECAQWVASQLAEVGYQ

SEQ ID NO: 1060024 - protein, 18 aa, Mycobacterium
RGFLRCVAALARAANAIG

SEQ ID NO: 1060025 - protein, 17 aa, Mycobacterium
RGGGVALLLSNIREHGA

SEQ ID NO: 1060026 - protein, 19 aa, Mycobacterium
RGGLRWSDRLDDFRTEILG

SEQ ID NO: 1060027 - protein, 17 aa, Mycobacterium
RGGRLSRQSAWQVLQDA

SEQ ID NO: 1060028 - protein, 18 aa, Mycobacterium
RGLMPRADVDAIERAICP

SEQ ID NO: 1060029 - protein, 19 aa, Mycobacterium
RGLTAMWRRGDELFADVKL

SEQ ID NO: 1060030 - protein, 18 aa, Mycobacterium
RGQTLIGFLASRNADNWI

SEQ ID NO: 1060031 - protein, 25 aa, Mycobacterium
RGRIKQLLLKIGWPAEDLAGYVDGE

SEQ ID NO: 1060032 - protein, 23 aa, Mycobacterium
RGVACAGLVIGSWTGRPGAVQIS

SEQ ID NO: 1060033 - protein, 18 aa, Mycobacterium
RGVPMTAGCVVPRGDVLE

SEQ ID NO: 1060034 - protein, 24 aa, Mycobacterium
RHLFSVLMDREWKHGVAAAVDVTL

SEQ ID NO: 1060035 - protein, 20 aa, Mycobacterium
RHVVVSMLGPRGFRAVRLDR

SEQ ID NO: 1060036 - protein, 19 aa, Mycobacterium
RIAYQATRNVFGFAPYPSV

SEQ ID NO: 1060037 - protein, 18 aa, Mycobacterium
RICASLGLPERVLVQQLC

SEQ ID NO: 1060038 - protein, 23 aa, Mycobacterium
RIFKRIRPAFTYQRSLDVLTAAR

SEQ ID NO: 1060039 - protein, 18 aa, Mycobacterium
RIGALLLEVHRRFGTPVP

SEQ ID NO: 1060040 - protein, 17 aa, Mycobacterium
RIISWLICADVDVMAMQ

SEQ ID NO: 1060041 - protein, 17 aa, Mycobacterium
RIMRPDLTIGFFLHIPF

SEQ ID NO: 1060042 - protein, 18 aa, Mycobacterium
RISCLKGRVVASIVVSTT

SEQ ID NO: 1060043 - protein, 19 aa, Mycobacterium
RITAVIPFYPYARQDKKHR

SEQ ID NO: 1060044 - protein, 19 aa, Mycobacterium
RIVLVGSMGEPVGWDLHDR

SEQ ID NO: 1060045 - protein, 17 aa, Mycobacterium
RIVSFDAAGGWNIEEEG

SEQ ID NO: 1060046 - protein, 19 aa, Mycobacterium
RIVSIEAFEHFGHENYDDF

SEQ ID NO: 1060047 - protein, 18 aa, Mycobacterium
RKALRTCQAERRHNMLFD

SEQ ID NO: 1060048 - protein, 18 aa, Mycobacterium
RKFFEAFAPYGLKQTAVK

SEQ ID NO: 1060049 - protein, 18 aa, Mycobacterium
RKFQGCLNLSQWIKTFTQ

SEQ ID NO: 1060050 - protein, 24 aa, Mycobacterium
RKGKCKRTRTGFGRRKNTKRAIVT

SEQ ID NO: 1060051 - protein, 17 aa, Mycobacterium
RKIAERRVFPAVDVNPS

SEQ ID NO: 1060052 - protein, 20 aa, Mycobacterium
RKIWSGKGTFLFTRTTAGEI

SEQ ID NO: 1060053 - protein, 18 aa, Mycobacterium
RKKFSQKELDVFRLPGTK

SEQ ID NO: 1060054 - protein, 23 aa, Mycobacterium
RKLREIRIALTLDKTFTKPEILT

SEQ ID NO: 1060055 - protein, 21 aa, Mycobacterium
RKPCRVPVWFMRQAGRSLPEY

SEQ ID NO: 1060056 - protein, 19 aa, Mycobacterium
RLALWGRRLFGETVTQAQY

SEQ ID NO: 1060057 - protein, 17 aa, Mycobacterium
RLARLHTPLPLLAFTAW

SEQ ID NO: 1060058 - protein, 17 aa, Mycobacterium
RLASVIFSLEMSKSEIV

SEQ ID NO: 1060059 - protein, 20 aa, Mycobacterium
RLATRHLLRYPGLQHAASYG

SEQ ID NO: 1060060 - protein, 20 aa, Mycobacterium
RLDIPSWLARAGFQMLDPLK

SEQ ID NO: 1060061 - protein, 18 aa, Mycobacterium
RLEALLALIEGWVQVVVT

SEQ ID NO: 1060062 - protein, 21 aa, Mycobacterium
RLGDYDVLVGINLLREGLDLP

SEQ ID NO: 1060063 - protein, 17 aa, Mycobacterium
RLGRPVFGPTFEVDIDS

SEQ ID NO: 1060064 - protein, 19 aa, Mycobacterium
RLLIEVAWEALEDAGVAPH

SEQ ID NO: 1060065 - protein, 23 aa, Mycobacterium
RLLLEVVCARLLLPSATDAESAL

SEQ ID NO: 1060066 - protein, 20 aa, Mycobacterium
RLLTAAGFPVEMLVRTDIGA

SEQ ID NO: 1060067 - protein, 18 aa, Mycobacterium
RLMPPMPLIPGRRSKPTV

SEQ ID NO: 1060068 - protein, 22 aa, Mycobacterium
RLPANELEFFFVLTFTGSNTAK

SEQ ID NO: 1060069 - protein, 22 aa, Mycobacterium
RLRDIGGIVVIDFIDMVLESNR

SEQ ID NO: 1060070 - protein, 19 aa, Mycobacterium
RLRLELDKGFGWKAEVEAA

SEQ ID NO: 1060071 - protein, 21 aa, Mycobacterium
RLRPAMLEFMDSVAINAVEDT

SEQ ID NO: 1060072 - protein, 18 aa, Mycobacterium
RLSSWAVRIRQIYATASV

SEQ ID NO: 1060073 - protein, 28 aa, Mycobacterium
RLSYSLKEIRHWLQIFVQRFYSFSQFKR

SEQ ID NO: 1060074 - protein, 19 aa, Mycobacterium
RLTDELAWVRSGAKARQAK

SEQ ID NO: 1060075 - protein, 19 aa, Mycobacterium
RLTTAVIEWRTQGRNYLTI

SEQ ID NO: 1060076 - protein, 18 aa, Mycobacterium
RMKFEGGVHRVQRVPVTE

SEQ ID NO: 1060077 - protein, 18 aa, Mycobacterium
RNELPLIEEWFEFVGDKL

SEQ ID NO: 1060078 - protein, 21 aa, Mycobacterium
RNVEIPDHFRIHVSQRLARLE

SEQ ID NO: 1060079 - protein, 22 aa, Mycobacterium
RNYRIGVDFVPYLYLSDLQDQR

SEQ ID NO: 1060080 - protein, 19 aa, Mycobacterium
RPDFVVGLMPARWGTGFIL

SEQ ID NO: 1060081 - protein, 20 aa, Mycobacterium
RPETEAILAWVMAQRLPERP

SEQ ID NO: 1060082 - protein, 20 aa, Mycobacterium
RPFLHEITEVMAYRESMRSS

SEQ ID NO: 1060083 - protein, 19 aa, Mycobacterium
RPFYASSFMFLDPPDHTRL

SEQ ID NO: 1060084 - protein, 20 aa, Mycobacterium
RPGQKLRIVKYLAYGWSSLR

SEQ ID NO: 1060085 - protein, 20 aa, Mycobacterium
RPKHYWSIYQKMIVKGRDFD

SEQ ID NO: 1060086 - protein, 17 aa, Mycobacterium
RPLRPSFVDGLRNEIQV

SEQ ID NO: 1060087 - protein, 17 aa, Mycobacterium
RPPRGSYQIGILGLKGG

SEQ ID NO: 1060088 - protein, 17 aa, Mycobacterium
RPRMLLRTIEFLWQEGH

SEQ ID NO: 1060089 - protein, 19 aa, Mycobacterium
RPSEMARRVLIELLAWQFA

SEQ ID NO: 1060090 - protein, 19 aa, Mycobacterium
RPSEVARLGYLAGIVATML

SEQ ID NO: 1060091 - protein, 17 aa, Mycobacterium
RQLLDLMVHSVYSNKDA

SEQ ID NO: 1060092 - protein, 17 aa, Mycobacterium
RQVRFTAAFTFQYSKRP

SEQ ID NO: 1060093 - protein, 17 aa, Mycobacterium
RRAKLYYLRELRGKKAK

SEQ ID NO: 1060094 - protein, 18 aa, Mycobacterium
RRAVELLELVGITQPDRR

SEQ ID NO: 1060095 - protein, 20 aa, Mycobacterium
RRCGWFDAVIARYATRVNGI

SEQ ID NO: 1060096 - protein, 25 aa, Mycobacterium
RREMAYEGKIDWAFAELLALGSLVA

SEQ ID NO: 1060097 - protein, 17 aa, Mycobacterium
RRFWLRYAADSVGSLTL

SEQ ID NO: 1060098 - protein, 20 aa, Mycobacterium
RRIAAEIGYPVLVRPSYVLG

SEQ ID NO: 1060099 - protein, 17 aa, Mycobacterium
RRKHIEAGYQFVNTPHI

SEQ ID NO: 1060100 - protein, 20 aa, Mycobacterium
RRLIKYLSLIDVQRYRSLIE

SEQ ID NO: 1060101 - protein, 19 aa, Mycobacterium
RRLKASGVDTVFTLSGGHL

SEQ ID NO: 1060102 - protein, 25 aa, Mycobacterium
RRQQTLRASMDWSYALLTESERALF

SEQ ID NO: 1060103 - protein, 17 aa, Mycobacterium
RRRGMAVIISDFLGPIN

SEQ ID NO: 1060104 - protein, 21 aa, Mycobacterium
RRRGRRGRGRGRGEQGGSDVQ

SEQ ID NO: 1060105 - protein, 17 aa, Mycobacterium
RRRGSCAHDEMYSGPGG

SEQ ID NO: 1060106 - protein, 19 aa, Mycobacterium
RRRILELAAALSDDFERAG

SEQ ID NO: 1060107 - protein, 17 aa, Mycobacterium
RRSLLCGNIGRPVLDVL

SEQ ID NO: 1060108 - protein, 19 aa, Mycobacterium
RSAAYAMRWVAKNIVAAGL

SEQ ID NO: 1060109 - protein, 17 aa, Mycobacterium
RSAICPPTINADDMDFQ

SEQ ID NO: 1060110 - protein, 17 aa, Mycobacterium
RSDELHLSFNFLLAQII

SEQ ID NO: 1060111 - protein, 19 aa, Mycobacterium
RSLDVMAMDVVWTAEFAEA

SEQ ID NO: 1060112 - protein, 18 aa, Mycobacterium
RSLQRLLPMPSYRTVSNF

SEQ ID NO: 1060113 - protein, 23 aa, Mycobacterium
RSLRARFGTLIGVDRPVALGDFV

SEQ ID NO: 1060114 - protein, 20 aa, Mycobacterium
RSLRKRLGIHPVYKTVDTCA

SEQ ID NO: 1060115 - protein, 18 aa, Mycobacterium
RSPRCGLCPLNECAWRHA

SEQ ID NO: 1060116 - protein, 19 aa, Mycobacterium
RSREVWLMVSGTAKADAVA

SEQ ID NO: 1060117 - protein, 24 aa, Mycobacterium
RSTTLALRWLVGFSRQRREKTMIE

SEQ ID NO: 1060118 - protein, 19 aa, Mycobacterium
RSVEEVRFLMGFNRDVVRR

SEQ ID NO: 1060119 - protein, 19 aa, Mycobacterium
RTADMRVLFDAIINDDPLP

SEQ ID NO: 1060120 - protein, 17 aa, Mycobacterium
RTDRDWIADIVRFVESR

SEQ ID NO: 1060121 - protein, 22 aa, Mycobacterium
RTFARQRIDAILADVEPAGGGA

SEQ ID NO: 1060122 - protein, 23 aa, Mycobacterium
RTLALEHPEIWGSVIDLDASMPP

SEQ ID NO: 1060123 - protein, 23 aa, Mycobacterium
RTMKPDICWQLPIRHSQEWVTRP

SEQ ID NO: 1060124 - protein, 24 aa, Mycobacterium
RTSEIRYRLTFGIVQGYGGHGIGR

SEQ ID NO: 1060125 - protein, 25 aa, Mycobacterium
RTTLNLKACIKAAADRVVFINTGFL

SEQ ID NO: 1060126 - protein, 17 aa, Mycobacterium
RTWGADPTFCYNAADIG

SEQ ID NO: 1060127 - protein, 17 aa, Mycobacterium
RTWIRWNAAIMVHRAQR

SEQ ID NO: 1060128 - protein, 20 aa, Mycobacterium
RVAAMAGMLADWVEGPGAEV

SEQ ID NO: 1060129 - protein, 20 aa, Mycobacterium
RVADRLRALLGIIVDGEAGL

SEQ ID NO: 1060130 - protein, 18 aa, Mycobacterium
RVDIAAFIGAAADELVFT

SEQ ID NO: 1060131 - protein, 21 aa, Mycobacterium
RVEEVWPMIDITYVDGTVLPD

SEQ ID NO: 1060132 - protein, 23 aa, Mycobacterium
RVGPEGFRFTLEWVSNDVAANQL

SEQ ID NO: 1060133 - protein, 21 aa, Mycobacterium
RVKCALLGWMACKDALIHANS

SEQ ID NO: 1060134 - protein, 17 aa, Mycobacterium
RVLLCLPDSPDLVQLLL

SEQ ID NO: 1060135 - protein, 20 aa, Mycobacterium
RVLPYCWRDETPLSNHELRM

SEQ ID NO: 1060136 - protein, 24 aa, Mycobacterium
RVLVHPRPRLSIMAVGGELVDISR

SEQ ID NO: 1060137 - protein, 24 aa, Mycobacterium
RVMRADRGYFCFPEVDIRIPFTPG

SEQ ID NO: 1060138 - protein, 19 aa, Mycobacterium
RVSYFYDFRGPSVTIDTAC

SEQ ID NO: 1060139 - protein, 17 aa, Mycobacterium
RVVRAHVPLSEMFGYVG

SEQ ID NO: 1060140 - protein, 24 aa, Mycobacterium
RVWQPRWAIWSGHVLRSGGLIRGG

SEQ ID NO: 1060141 - protein, 23 aa, Mycobacterium
RVYMSRGWLPWLGPTSVLAPTGV

SEQ ID NO: 1060142 - protein, 18 aa, Mycobacterium
RWALSLAAPESPAFMRHL

SEQ ID NO: 1060143 - protein, 18 aa, Mycobacterium
RWLTRWADVTVHPVDQQQ

SEQ ID NO: 1060144 - protein, 19 aa, Mycobacterium
RWPELRARLTAAFASHDRD

SEQ ID NO: 1060145 - protein, 21 aa, Mycobacterium
RWPETCIEPSLTRISALMDVL

SEQ ID NO: 1060146 - protein, 19 aa, Mycobacterium
RWRWTDIPGALGVANHSSF

SEQ ID NO: 1060147 - protein, 19 aa, Mycobacterium
RWTDSFGGLVFDATGITAP

SEQ ID NO: 1060148 - protein, 17 aa, Mycobacterium
RWVMLSCHMKWTQLTSR

SEQ ID NO: 1060149 - protein, 18 aa, Mycobacterium
RYCYNFYNFLNINHYMVD

SEQ ID NO: 1060150 - protein, 18 aa, Mycobacterium
RYGGYALAGVSSFGFGGA

SEQ ID NO: 1060151 - protein, 18 aa, Mycobacterium
RYTGRGMAFLDLIQEGNL

SEQ ID NO: 1060152 - protein, 19 aa, Mycobacterium
RYVLMPGIINTLVGVRHAA

SEQ ID NO: 1060153 - protein, 20 aa, Mycobacterium
SAAAVWRVRRAAPLLPTVLL

SEQ ID NO: 1060154 - protein, 17 aa, Mycobacterium
SAALLDHGPAPTRAERF

SEQ ID NO: 1060155 - protein, 17 aa, Mycobacterium
SAFGEVWMQPSGSVGLV

SEQ ID NO: 1060156 - protein, 19 aa, Mycobacterium
SALAWAGYCRPGYRLGIVG

SEQ ID NO: 1060157 - protein, 18 aa, Mycobacterium
SALLSGKRTVLFIDEVHR

SEQ ID NO: 1060158 - protein, 20 aa, Mycobacterium
SAYPRILDFAAFRSIADEVG

SEQ ID NO: 1060159 - protein, 24 aa, Mycobacterium
SCFRCPQCTEQLRATDDLLLIAGM

SEQ ID NO: 1060160 - protein, 18 aa, Mycobacterium
SCHYCTFVTAPDMLRTQG

SEQ ID NO: 1060161 - protein, 20 aa, Mycobacterium
SCQWRLVWYRAVADLLTGDY

SEQ ID NO: 1060162 - protein, 19 aa, Mycobacterium
SDFLHGRWLVLRRGKRNIA

SEQ ID NO: 1060163 - protein, 18 aa, Mycobacterium
SDGGEIIFVQALDNVVAD

SEQ ID NO: 1060164 - protein, 22 aa, Mycobacterium
SDIKNLLPMLAVFKPTVVVSVP

SEQ ID NO: 1060165 - protein, 24 aa, Mycobacterium
SDPLRGGMRLGLIPTVAPYVLPTM

SEQ ID NO: 1060166 - protein, 19 aa, Mycobacterium
SDPNCGKWPPGFPEDKRLS

SEQ ID NO: 1060167 - protein, 22 aa, Mycobacterium
SELPGERPRLFVVTRNAASIKT

SEQ ID NO: 1060168 - protein, 21 aa, Mycobacterium
SELRPFYRPGLVHIYHALTWG

SEQ ID NO: 1060169 - protein, 17 aa, Mycobacterium
SEPWSRPSLARSGHPPR

SEQ ID NO: 1060170 - protein, 19 aa, Mycobacterium
SEQARAWWGNFLVQKANEA

SEQ ID NO: 1060171 - protein, 18 aa, Mycobacterium
SFGFKYGLPMDADIVMDV

SEQ ID NO: 1060172 - protein, 21 aa, Mycobacterium
SFLRRPACWMQLLATTQACFS

SEQ ID NO: 1060173 - protein, 18 aa, Mycobacterium
SFPDFPLPLGDPLEPTQA

SEQ ID NO: 1060174 - protein, 17 aa, Mycobacterium
SGLGFSVLHVVRDNPTN

SEQ ID NO: 1060175 - protein, 19 aa, Mycobacterium
SGLPFGTCLETIYLHPCGS

SEQ ID NO: 1060176 - protein, 19 aa, Mycobacterium
SGVISFLGIHGSEFSDSGA

SEQ ID NO: 1060177 - protein, 28 aa, Mycobacterium
SGWWRAPLRWMLRGSLVVRSRLMVRSSR

SEQ ID NO: 1060178 - protein, 20 aa, Mycobacterium
SHCRPRWPWSVPVRSAPSTF

SEQ ID NO: 1060179 - protein, 19 aa, Mycobacterium
SHLARPKVSICIHRPYSEP

SEQ ID NO: 1060180 - protein, 21 aa, Mycobacterium
SIFSATCFEWAILDLAILSVG

SEQ ID NO: 1060181 - protein, 24 aa, Mycobacterium
SKAKAGGLVEGWRMTKVVGLAGPH

SEQ ID NO: 1060182 - protein, 18 aa, Mycobacterium
SKASGLDLVRLGTTASTE

SEQ ID NO: 1060183 - protein, 21 aa, Mycobacterium
SKLGHFRLHLNFTKKALNFFG

SEQ ID NO: 1060184 - protein, 20 aa, Mycobacterium
SKMWRFGRVTVRFGKPMDFS

SEQ ID NO: 1060185 - protein, 17 aa, Mycobacterium
SKTPCWFGAYGVTKSPV

SEQ ID NO: 1060186 - protein, 19 aa, Mycobacterium
SLDEFGWLYILVTNAGIGS

SEQ ID NO: 1060187 - protein, 18 aa, Mycobacterium
SLSAALPPAALWGREAYI

SEQ ID NO: 1060188 - protein, 23 aa, Mycobacterium
SLTDWIGVISMPFGVPATPTTMR

SEQ ID NO: 1060189 - protein, 17 aa, Mycobacterium
SMGLRVGYAISYSDTIT

SEQ ID NO: 1060190 - protein, 21 aa, Mycobacterium
SPAAVCPHVEWALSSTLQTKA

SEQ ID NO: 1060191 - protein, 17 aa, Mycobacterium
SPGSPWLADTWRDRFQK

SEQ ID NO: 1060192 - protein, 20 aa, Mycobacterium
SPKASWLWLFLIDAGISKPT

SEQ ID NO: 1060193 - protein, 22 aa, Mycobacterium
SPKETWLRLWLIDVNLPVSTGQ

SEQ ID NO: 1060194 - protein, 22 aa, Mycobacterium
SPSPLRCWRRLHTGPAARAKVR

SEQ ID NO: 1060195 - protein, 19 aa, Mycobacterium
SRARYLILRLLERAGEQRV

SEQ ID NO: 1060196 - protein, 18 aa, Mycobacterium
SRATFHWVLAFADSSLLT

SEQ ID NO: 1060197 - protein, 17 aa, Mycobacterium
SRDELLEALLIDAQHAY

SEQ ID NO: 1060198 - protein, 19 aa, Mycobacterium
SRLAGVGVRSAGMWAYEAH

SEQ ID NO: 1060199 - protein, 19 aa, Mycobacterium
SRLPRLPFSAIRRMDSPRT

SEQ ID NO: 1060200 - protein, 20 aa, Mycobacterium
SRTRKVPGFALLGEQGESRD

SEQ ID NO: 1060201 - protein, 20 aa, Mycobacterium
SRVDPHWAFATKQIDVRQSP

SEQ ID NO: 1060202 - protein, 18 aa, Mycobacterium
SRWTCVFGTPACRGTVAG

SEQ ID NO: 1060203 - protein, 20 aa, Mycobacterium
SSFRYAGPAGRDWTTSDLAG

SEQ ID NO: 1060204 - protein, 21 aa, Mycobacterium
SSHTWKLWARRGRVWCASCAD

SEQ ID NO: 1060205 - protein, 17 aa, Mycobacterium
SSITLSGIWLLIVPSEL

SEQ ID NO: 1060206 - protein, 17 aa, Mycobacterium
STGRPVTVPQLYSRGFS

SEQ ID NO: 1060207 - protein, 22 aa, Mycobacterium
STRTRFSFDIGIAQLGGHAVVV

SEQ ID NO: 1060208 - protein, 19 aa, Mycobacterium
SVDCARYWLDTNRPISKSD

SEQ ID NO: 1060209 - protein, 24 aa, Mycobacterium
SVGALRVPENWATASQPVMATAHS

SEQ ID NO: 1060210 - protein, 18 aa, Mycobacterium
SVGFLFNLAVEAVPASHV

SEQ ID NO: 1060211 - protein, 21 aa, Mycobacterium
SVNMFAPWIRRIFIATDSIPP

SEQ ID NO: 1060212 - protein, 19 aa, Mycobacterium
SVPVGEAFMGRVVNPLGQP

SEQ ID NO: 1060213 - protein, 24 aa, Mycobacterium
SVSRARFGDVLPFLVKVLAADEPL

SEQ ID NO: 1060214 - protein, 18 aa, Mycobacterium
SWLARAGFQMLDPLKTVK

SEQ ID NO: 1060215 - protein, 18 aa, Mycobacterium
SYDLPWHRVITAYRHPAR

SEQ ID NO: 1060216 - protein, 21 aa, Mycobacterium
SYGSRCVRPPILYGDVSRPHP

SEQ ID NO: 1060217 - protein, 22 aa, Mycobacterium
TAANFTHGWLRTGDLGSLSVTG

SEQ ID NO: 1060218 - protein, 18 aa, Mycobacterium
TADGLGCYGPLQRALTVM

SEQ ID NO: 1060219 - protein, 17 aa, Mycobacterium
TAGGLHFAEWVGACFAE

SEQ ID NO: 1060220 - protein, 24 aa, Mycobacterium
TAHFCSMCGPKFCSMRITADIRVY

SEQ ID NO: 1060221 - protein, 18 aa, Mycobacterium
TALLRLAGRYGVCEDEVD

SEQ ID NO: 1060222 - protein, 25 aa, Mycobacterium
TATLLTARCPIMFAPAMHTEMWLHP

SEQ ID NO: 1060223 - protein, 18 aa, Mycobacterium
TAVLCGSVARVIFQTDQG

SEQ ID NO: 1060224 - protein, 24 aa, Mycobacterium
TDHRPELLLSFGFVPKAERRVGLI

SEQ ID NO: 1060225 - protein, 19 aa, Mycobacterium
TDPVIGCAAALEAHGALVT

SEQ ID NO: 1060226 - protein, 20 aa, Mycobacterium
TEAIKLVALVADRGAQVRME

SEQ ID NO: 1060227 - protein, 17 aa, Mycobacterium
TEARMAIAMARAGGMGV

SEQ ID NO: 1060228 - protein, 20 aa, Mycobacterium
TECTNRFDVVQAFTDDALTT

SEQ ID NO: 1060229 - protein, 19 aa, Mycobacterium
TEILQRWKRGVMSTVGDIS

SEQ ID NO: 1060230 - protein, 17 aa, Mycobacterium
TEIPGPVSLELAKRLNA

SEQ ID NO: 1060231 - protein, 21 aa, Mycobacterium
TEIPGSLGSYVGKNDLLASNA

SEQ ID NO: 1060232 - protein, 20 aa, Mycobacterium
TEPIELWAWVGAYDHVALCQ

SEQ ID NO: 1060233 - protein, 21 aa, Mycobacterium
TEPPPVFGVPAWLPDRHGDQG

SEQ ID NO: 1060234 - protein, 21 aa, Mycobacterium
TFRYVMMVLRHIPRSIFRKLP

SEQ ID NO: 1060235 - protein, 19 aa, Mycobacterium
TGDVLSVPVGEAFMGRVVN

SEQ ID NO: 1060236 - protein, 18 aa, Mycobacterium
TGLSIRETVLFPIVRPHS

SEQ ID NO: 1060237 - protein, 24 aa, Mycobacterium
TGPRRFSAQLALQWTAAGARIVGG

SEQ ID NO: 1060238 - protein, 18 aa, Mycobacterium
TGRPPRWVRPVVDALGFP

SEQ ID NO: 1060239 - protein, 20 aa, Mycobacterium
TGSVSFRFGDRTQINGVARD

SEQ ID NO: 1060240 - protein, 17 aa, Mycobacterium
TGVDTLMLWSAIRQSDV

SEQ ID NO: 1060241 - protein, 19 aa, Mycobacterium
THRGCGVLMGGVPGVEPAD

SEQ ID NO: 1060242 - protein, 19 aa, Mycobacterium
TIIRWKMLLVEVGPDYPDK

SEQ ID NO: 1060243 - protein, 19 aa, Mycobacterium
TIRLPVHLVEQVNKLARIK

SEQ ID NO: 1060244 - protein, 21 aa, Mycobacterium
TKIIKFSGCYHGHVDALLADA

SEQ ID NO: 1060245 - protein, 17 aa, Mycobacterium
TKWGYADCDAMEKLCTV

SEQ ID NO: 1060246 - protein, 24 aa, Mycobacterium
TLAMGHAMIRTGLSLTRHSSDLPW

SEQ ID NO: 1060247 - protein, 18 aa, Mycobacterium
TLCNRLAVVTGLRLPETV

SEQ ID NO: 1060248 - protein, 18 aa, Mycobacterium
TLEAIKCVASLNLGVPLV

SEQ ID NO: 1060249 - protein, 17 aa, Mycobacterium
TLFRAWYSRRNFGQLSG

SEQ ID NO: 1060250 - protein, 20 aa, Mycobacterium
TLNPCLKRACGHQFVNRIQG

SEQ ID NO: 1060251 - protein, 24 aa, Mycobacterium
TNRAWRLYRRLGFMDIIRRHYFAG

SEQ ID NO: 1060252 - protein, 19 aa, Mycobacterium
TPPRLAVIAMGKWGARELN

SEQ ID NO: 1060253 - protein, 18 aa, Mycobacterium
TPRPRWRLLLHSVPPTSR

SEQ ID NO: 1060254 - protein, 18 aa, Mycobacterium
TQGSGAWPACGHGLSGPS

SEQ ID NO: 1060255 - protein, 17 aa, Mycobacterium
TRFKRLFVVTPKGARQA

SEQ ID NO: 1060256 - protein, 21 aa, Mycobacterium
TRLAKARLYLCTDARRERGDL

SEQ ID NO: 1060257 - protein, 18 aa, Mycobacterium
TRRPSVCNAAETLLIDAA

SEQ ID NO: 1060258 - protein, 22 aa, Mycobacterium
TRRQTCVGLRFSDTLFLALSAG

SEQ ID NO: 1060259 - protein, 17 aa, Mycobacterium
TRYLLHFSQSGIGLPDE

SEQ ID NO: 1060260 - protein, 17 aa, Mycobacterium
TSHDIRVLYGFKRLAWW

SEQ ID NO: 1060261 - protein, 23 aa, Mycobacterium
TVAPVRVGFRFGEPAVGELGVRD

SEQ ID NO: 1060262 - protein, 18 aa, Mycobacterium
TVSPGRRVLMRYGQAKRD

SEQ ID NO: 1060263 - protein, 17 aa, Mycobacterium
TVWRAHWLLAKKPEDAQ

SEQ ID NO: 1060264 - protein, 20 aa, Mycobacterium
TWLDLQCRPALIGSRGPDAK

SEQ ID NO: 1060265 - protein, 24 aa, Mycobacterium
TYRFGGSLHLDWWYDIRRIPQVTA

SEQ ID NO: 1060266 - protein, 18 aa, Mycobacterium
VAAADWPLLAAAYQTRGV

SEQ ID NO: 1060267 - protein, 23 aa, Mycobacterium
VAEKRPQLLIGWHMQLGNIVIPK

SEQ ID NO: 1060268 - protein, 18 aa, Mycobacterium
VAKVYCGLGLLKKENIRE

SEQ ID NO: 1060269 - protein, 19 aa, Mycobacterium
VAVCSTGLIGDRLPMDKVL

SEQ ID NO: 1060270 - protein, 19 aa, Mycobacterium
VAVLARLDLGSVLIPLPEG

SEQ ID NO: 1060271 - protein, 19 aa, Mycobacterium
VCDCFNIPIVMLVDVPGFL

SEQ ID NO: 1060272 - protein, 23 aa, Mycobacterium
VCNEILPRWGVETVFVDGEDLVQ

SEQ ID NO: 1060273 - protein, 19 aa, Mycobacterium
VDAYLHVGGQWEWDSAAPA

SEQ ID NO: 1060274 - protein, 23 aa, Mycobacterium
VDERARAGLFLAMQYPVEVPGVS

SEQ ID NO: 1060275 - protein, 17 aa, Mycobacterium
VDLIKLGGYRIGAGEIE

SEQ ID NO: 1060276 - protein, 19 aa, Mycobacterium
VDLIVCPQVRIVAHQRIAV

SEQ ID NO: 1060277 - protein, 24 aa, Mycobacterium
VDPWGVGGAAHWTIDPIVGFASSS

SEQ ID NO: 1060278 - protein, 17 aa, Mycobacterium
VDRSAAYAMRWVAKNIV

SEQ ID NO: 1060279 - protein, 19 aa, Mycobacterium
VEFWAAVILDFARVPANMM

SEQ ID NO: 1060280 - protein, 21 aa, Mycobacterium
VEILRLSALRGLFSTVIEDAV

SEQ ID NO: 1060281 - protein, 18 aa, Mycobacterium
VEIPEGFTGLVADVEAIR

SEQ ID NO: 1060282 - protein, 21 aa, Mycobacterium
VEMGGPFSLELCGGTHVHNTA

SEQ ID NO: 1060283 - protein, 24 aa, Mycobacterium
VFFEALKAPLYWIATNAGLDGAVV

SEQ ID NO: 1060284 - protein, 18 aa, Mycobacterium
VFKVNGFGGWKYKKLRDV

SEQ ID NO: 1060285 - protein, 19 aa, Mycobacterium
VFWPIPRVYSGLVRVDRYA

SEQ ID NO: 1060286 - protein, 22 aa, Mycobacterium
VGELRGGFEYARTGNPMRAALE

SEQ ID NO: 1060287 - protein, 22 aa, Mycobacterium
VGLAGRWLRPGGLFAVEHDDST

SEQ ID NO: 1060288 - protein, 20 aa, Mycobacterium
VGPFQVRIPLMFNASDGHTL

SEQ ID NO: 1060289 - protein, 18 aa, Mycobacterium
VGPGGLFLALPGARSDGH

SEQ ID NO: 1060290 - protein, 18 aa, Mycobacterium
VGVAESGVSYALRDAFAV

SEQ ID NO: 1060291 - protein, 21 aa, Mycobacterium
VGVPMDFRLGFGKVFGSQTQL

SEQ ID NO: 1060292 - protein, 18 aa, Mycobacterium
VHTLLDFHFRPHITAPSG

SEQ ID NO: 1060293 - protein, 18 aa, Mycobacterium
VHVVPRWGGDANFITIIG

SEQ ID NO: 1060294 - protein, 19 aa, Mycobacterium
VHYPFPIKDLVALDDALTY

SEQ ID NO: 1060295 - protein, 18 aa, Mycobacterium
VKCACPFGPMVVSVPVRM

SEQ ID NO: 1060296 - protein, 19 aa, Mycobacterium
VKDKYKWSYRTWAKQVTRV

SEQ ID NO: 1060297 - protein, 20 aa, Mycobacterium
VKGPDFPTAGLIVGSQGIAD

SEQ ID NO: 1060298 - protein, 20 aa, Mycobacterium
VKLWTIADLGGWSTVDPQLF

SEQ ID NO: 1060299 - protein, 19 aa, Mycobacterium
VLAAVRWVPEPSVAQVVVG

SEQ ID NO: 1060300 - protein, 17 aa, Mycobacterium
VLGALGITVFAEAGFEA

SEQ ID NO: 1060301 - protein, 22 aa, Mycobacterium
VLKSGRVYRSWVISDWGAIPNW

SEQ ID NO: 1060302 - protein, 25 aa, Mycobacterium
VLLGDWPIRIPREIASAASEVIIGV

SEQ ID NO: 1060303 - protein, 18 aa, Mycobacterium
VLPDCFRPAPASDLVSVP

SEQ ID NO: 1060304 - protein, 17 aa, Mycobacterium
VLYARRELLSVMPPFLT

SEQ ID NO: 1060305 - protein, 18 aa, Mycobacterium
VMSGTGFLGAHAEEVYRV

SEQ ID NO: 1060306 - protein, 25 aa, Mycobacterium
VNGFGGWKYKKLRDVLGLLRDAYCR

SEQ ID NO: 1060307 - protein, 23 aa, Mycobacterium
VPAPPFWGSRIIKGLAVADYTGF

SEQ ID NO: 1060308 - protein, 23 aa, Mycobacterium
VPARLRPGTFYALPQSPQLFKQL

SEQ ID NO: 1060309 - protein, 26 aa, Mycobacterium
VPDILVQGVLKWLAERGYDVVQSVTT

SEQ ID NO: 1060310 - protein, 18 aa, Mycobacterium
VPESLPLADAFRRCVAAT

SEQ ID NO: 1060311 - protein, 17 aa, Mycobacterium
VPFGTSAGRVWTDGLEF

SEQ ID NO: 1060312 - protein, 21 aa, Mycobacterium
VPGIGKRGAERIVLELRDKVG

SEQ ID NO: 1060313 - protein, 25 aa, Mycobacterium
VPIDLRQDWPPALRSAGFDPSARTA

SEQ ID NO: 1060314 - protein, 21 aa, Mycobacterium
VPRRCCRPGCPHYAVATLTFV

SEQ ID NO: 1060315 - protein, 17 aa, Mycobacterium
VPRRLKELHLQLGTATA

SEQ ID NO: 1060316 - protein, 18 aa, Mycobacterium
VPSALTWRCAIVCERSSL

SEQ ID NO: 1060317 - protein, 17 aa, Mycobacterium
VPYELAVLTGRDDDRGT

SEQ ID NO: 1060318 - protein, 17 aa, Mycobacterium
VQAFRVYWETALPNQQT

SEQ ID NO: 1060319 - protein, 18 aa, Mycobacterium
VQRVFFGWAQMWRSKSRD

SEQ ID NO: 1060320 - protein, 21 aa, Mycobacterium
VQSVLLPRLLNWMSYAPDPDG

SEQ ID NO: 1060321 - protein, 18 aa, Mycobacterium
VRDAFPLPKGIIANPNCT

SEQ ID NO: 1060322 - protein, 19 aa, Mycobacterium
VRFTAAFTFQYSKRPGTPA

SEQ ID NO: 1060323 - protein, 17 aa, Mycobacterium
VRGLHRFAVAEGLVDLD

SEQ ID NO: 1060324 - protein, 18 aa, Mycobacterium
VRIPLMFNASDGHTLVNS

SEQ ID NO: 1060325 - protein, 17 aa, Mycobacterium
VRLCDAFGIPLVVIVDV

SEQ ID NO: 1060326 - protein, 20 aa, Mycobacterium
VRLLRSCGIIVVHRAALGGR

SEQ ID NO: 1060327 - protein, 21 aa, Mycobacterium
VRRMRLQPGRMFLVDTAQGRI

SEQ ID NO: 1060328 - protein, 22 aa, Mycobacterium
VRSRLMLDIAGWRRRRREELVA

SEQ ID NO: 1060329 - protein, 17 aa, Mycobacterium
VSDALGFEQAVDVQELI

SEQ ID NO: 1060330 - protein, 17 aa, Mycobacterium
VSHPEIHRHSGFARLVQ

SEQ ID NO: 1060331 - protein, 27 aa, Mycobacterium
VSPELVRRLCWDWEVLPESSVDPVNAV

SEQ ID NO: 1060332 - protein, 17 aa, Mycobacterium
VSVPLLLAGNRGEQLVN

SEQ ID NO: 1060333 - protein, 25 aa, Mycobacterium
VTARPCPTCRGVGVVIPDPCCQCVG

SEQ ID NO: 1060334 - protein, 20 aa, Mycobacterium
VTGLEFVDWKLLLAADEKLL

SEQ ID NO: 1060335 - protein, 19 aa, Mycobacterium
VTHPARWALLYGSPASGYH

SEQ ID NO: 1060336 - protein, 21 aa, Mycobacterium
VTLGEEFPRLMVYRGPRRKGV

SEQ ID NO: 1060337 - protein, 18 aa, Mycobacterium
VTTANAWCAARPSGTEDV

SEQ ID NO: 1060338 - protein, 18 aa, Mycobacterium
VVAFRIVLVGSMGEPVGW

SEQ ID NO: 1060339 - protein, 18 aa, Mycobacterium
VVEALKFHLHDLAVTFRF

SEQ ID NO: 1060340 - protein, 17 aa, Mycobacterium
VVFRPLYAVGGQELGYL

SEQ ID NO: 1060341 - protein, 21 aa, Mycobacterium
VVGAYRFLQRVWRLVVDERTG

SEQ ID NO: 1060342 - protein, 22 aa, Mycobacterium
VVIPDPCCQCVGDGRVRARREI

SEQ ID NO: 1060343 - protein, 19 aa, Mycobacterium
VVLGDAWDLLKFLNDDEYS

SEQ ID NO: 1060344 - protein, 17 aa, Mycobacterium
VVLLAGWPAVERVARTV

SEQ ID NO: 1060345 - protein, 18 aa, Mycobacterium
VVLRATWAVAQVLLQRAG

SEQ ID NO: 1060346 - protein, 19 aa, Mycobacterium
VVMRLYRDWALVLRQHNLG

SEQ ID NO: 1060347 - protein, 17 aa, Mycobacterium
VVPDFQLSLAIGKEGQN

SEQ ID NO: 1060348 - protein, 17 aa, Mycobacterium
VVVCGKPSFYIGRGTFS

SEQ ID NO: 1060349 - protein, 19 aa, Mycobacterium
VVYRACLRRAPRLQRRTAS

SEQ ID NO: 1060350 - protein, 18 aa, Mycobacterium
VWICPDHRKKGYGTAALR

SEQ ID NO: 1060351 - protein, 21 aa, Mycobacterium
VWPPVRRIDGVYGDRNLVCSC

SEQ ID NO: 1060352 - protein, 24 aa, Mycobacterium
VYFELRLADAWVWDMYRPARFVKQ

SEQ ID NO: 1060353 - protein, 17 aa, Mycobacterium
VYLALSWALSRTPGGRQ

SEQ ID NO: 1060354 - protein, 19 aa, Mycobacterium
VYQQFPRCHPLYGAGPVKA

SEQ ID NO: 1060355 - protein, 20 aa, Mycobacterium
WAAKGIDVTPFFSVLDGPHI

SEQ ID NO: 1060356 - protein, 19 aa, Mycobacterium
WAFAELLALGSLVAEGKLV

SEQ ID NO: 1060357 - protein, 22 aa, Mycobacterium
WAGYCRPGYRLGIVGDVVLVVA

SEQ ID NO: 1060358 - protein, 18 aa, Mycobacterium
WAPATFRYVMMVLRHIPR

SEQ ID NO: 1060359 - protein, 17 aa, Mycobacterium
WAVMFGRTYLWGLATAW

SEQ ID NO: 1060360 - protein, 22 aa, Mycobacterium
WCSDIRAGAGLVLAGLVADGDT

SEQ ID NO: 1060361 - protein, 18 aa, Mycobacterium
WDMYRPARFVKQVRVVTF

SEQ ID NO: 1060362 - protein, 24 aa, Mycobacterium
WDYYTIRAGDEFFPDVNRKLIDYP

SEQ ID NO: 1060363 - protein, 17 aa, Mycobacterium
WELIKVRIYTDGSRRTL

SEQ ID NO: 1060364 - protein, 20 aa, Mycobacterium
WFAAYAYWYFKLYRHDKVKL

SEQ ID NO: 1060365 - protein, 17 aa, Mycobacterium
WGADPTFCYNAADIGPA

SEQ ID NO: 1060366 - protein, 22 aa, Mycobacterium
WGGAAPGGFDCSGLVMWAYQQA

SEQ ID NO: 1060367 - protein, 17 aa, Mycobacterium
WGGMVRYAARRGVRVIG

SEQ ID NO: 1060368 - protein, 20 aa, Mycobacterium
WGHFDRLNFPVGEWADNTDV

SEQ ID NO: 1060369 - protein, 18 aa, Mycobacterium
WHPGRCAEVFVGETPIGH

SEQ ID NO: 1060370 - protein, 23 aa, Mycobacterium
WKDGEALFLRCNIWREAAENVAE

SEQ ID NO: 1060371 - protein, 18 aa, Mycobacterium
WKDLRAAFTERGWLDLTH

SEQ ID NO: 1060372 - protein, 17 aa, Mycobacterium
WLAERGYDVVQSVTTAN

SEQ ID NO: 1060373 - protein, 18 aa, Mycobacterium
WLKLKAVPMLGISVLGEV

SEQ ID NO: 1060374 - protein, 17 aa, Mycobacterium
WLPQRPVLIPGTVGDNL

SEQ ID NO: 1060375 - protein, 23 aa, Mycobacterium
WLRNFRCTPAIYAVHRYVGNQAQ

SEQ ID NO: 1060376 - protein, 17 aa, Mycobacterium
WLRRWIRGGYGWVQPRL

SEQ ID NO: 1060377 - protein, 19 aa, Mycobacterium
WPDHPGRYFIVRAGSLVAW

SEQ ID NO: 1060378 - protein, 18 aa, Mycobacterium
WPEVRSQLAMTWGTETFL

SEQ ID NO: 1060379 - protein, 19 aa, Mycobacterium
WPTVAEWVCWLAANANKPA

SEQ ID NO: 1060380 - protein, 22 aa, Mycobacterium
WQNCLLRVSFNYREGMMLHAVM

SEQ ID NO: 1060381 - protein, 18 aa, Mycobacterium
WQPKTGAVGSLWDVVRDH

SEQ ID NO: 1060382 - protein, 19 aa, Mycobacterium
WRFLKELRLDRGPLTNEEA

SEQ ID NO: 1060383 - protein, 17 aa, Mycobacterium
WRRPRWARRLQPGPVAD

SEQ ID NO: 1060384 - protein, 17 aa, Mycobacterium
WTMRWKPALNAFAITFA

SEQ ID NO: 1060385 - protein, 18 aa, Mycobacterium
WTQWIFLQIYNAWFDVAA

SEQ ID NO: 1060386 - protein, 19 aa, Mycobacterium
WVPYEVLECISTRITNEVA

SEQ ID NO: 1060387 - protein, 19 aa, Mycobacterium
WVREITRVHGAGVRWIIDL

SEQ ID NO: 1060388 - protein, 20 aa, Mycobacterium
WWILNCLMHGGLCITGGEHT

SEQ ID NO: 1060389 - protein, 19 aa, Mycobacterium
WWLQRRLLLSGIRAISPAV

SEQ ID NO: 1060390 - protein, 18 aa, Mycobacterium
WYRGAPRISDLVEQVRRS

SEQ ID NO: 1060391 - protein, 23 aa, Mycobacterium
YANRFGYNVVRHFTGHGIGTTFH

SEQ ID NO: 1060392 - protein, 23 aa, Mycobacterium
YAVPRLLARNGLSFQDFDFYEIH

SEQ ID NO: 1060393 - protein, 25 aa, Mycobacterium
YDCRSTRELRNWLLLQAYEAGVVPV

SEQ ID NO: 1060394 - protein, 17 aa, Mycobacterium
YDEWLRRFEISLRALPE

SEQ ID NO: 1060395 - protein, 18 aa, Mycobacterium
YDILFFWVARMMMLGTFV

SEQ ID NO: 1060396 - protein, 17 aa, Mycobacterium
YDRIEVVVHPQSIVHSM

SEQ ID NO: 1060397 - protein, 21 aa, Mycobacterium
YEKLEGVPLTFAGKVNRLAIM

SEQ ID NO: 1060398 - protein, 21 aa, Mycobacterium
YELIKRLGIRRTIAIPVFGDH

SEQ ID NO: 1060399 - protein, 23 aa, Mycobacterium
YFPKGPACLIGLWDQRCRTPSFC

SEQ ID NO: 1060400 - protein, 23 aa, Mycobacterium
YFTGTGLKGWFTSWFYRATGQVP

SEQ ID NO: 1060401 - protein, 22 aa, Mycobacterium
YKFSTYATWWIRQAITRAMADQ

SEQ ID NO: 1060402 - protein, 20 aa, Mycobacterium
YLHCCKELLGTNAWIVIEKI

SEQ ID NO: 1060403 - protein, 23 aa, Mycobacterium
YLLSRAPGALGLHVALTGAPFSG

SEQ ID NO: 1060404 - protein, 26 aa, Mycobacterium
YLRIAPELFLKRCIVGGFDKVFELNR

SEQ ID NO: 1060405 - protein, 18 aa, Mycobacterium
YMAQLGFRTFNEAVGQVG

SEQ ID NO: 1060406 - protein, 22 aa, Mycobacterium
YMKYLRGCAHYFSDEMLDCSLV

SEQ ID NO: 1060407 - protein, 18 aa, Mycobacterium
YNLPRFRIQWSVRQGGRR

SEQ ID NO: 1060408 - protein, 18 aa, Mycobacterium
YPKTEFNVVLPWTKAVVL

SEQ ID NO: 1060409 - protein, 17 aa, Mycobacterium
YPTFALARPRPFLHEIT

SEQ ID NO: 1060410 - protein, 25 aa, Mycobacterium
YRTLPEIILYPALFLGAARTVPGSK

SEQ ID NO: 1060411 - protein, 21 aa, Mycobacterium
YRVGQYTAWRRWMEIAFTLTS

SEQ ID NO: 1060412 - protein, 17 aa, Mycobacterium
YSYQMSIYVIRVEQETA

SEQ ID NO: 1060413 - protein, 25 aa, Mycobacterium
YVDGKRSGLWLGLRETFKSGSSQPP

SEQ ID NO: 1060414 - protein, 24 aa, Mycobacterium
YVDLVCSWGPMILGHAHPAVVDAV

SEQ ID NO: 1060415 - protein, 17 aa, Mycobacterium
YVIAYLPYLGWLRQASV

SEQ ID NO: 1060416 - protein, 17 aa, Mycobacterium
YVRRAPLLDGIDEFDAD

SEQ ID NO: 1060417 - protein, 23 aa, Mycobacterium
YVWRWDTDWFWCSRAFGAQNQQL

SEQ ID NO: 1060418 - protein, 17 aa, Mycobacterium
YYEKGLCDIIKYHVSMT

SEQ ID NO: 1060419 - protein, 18 aa, Mycobacterium
AAAARLGDRLSIHDQPNL

SEQ ID NO: 1060420 - protein, 17 aa, Mycobacterium
AAAGPLVDSWMCAISGR

SEQ ID NO: 1060421 - protein, 22 aa, Mycobacterium
AAAKTRLGPVFSTRTRENVVLA

SEQ ID NO: 1060422 - protein, 18 aa, Mycobacterium
AAAPRGRLEWLLLADGMP

SEQ ID NO: 1060423 - protein, 19 aa, Mycobacterium
AAARLGLRTAFVARPLEFG

SEQ ID NO: 1060424 - protein, 20 aa, Mycobacterium
AACPLTWPWNLLGWPSINVP

SEQ ID NO: 1060425 - protein, 21 aa, Mycobacterium
AACTNRLRLGVAVLVTSLHDP

SEQ ID NO: 1060426 - protein, 24 aa, Mycobacterium
AADDVRAGWDWLPGACGLSPERMV

SEQ ID NO: 1060427 - protein, 19 aa, Mycobacterium
AADHSKLWFAMAAGLLASR

SEQ ID NO: 1060428 - protein, 26 aa, Mycobacterium
AADIYRIAHNVAWERWTDIAFGLTSN

SEQ ID NO: 1060429 - protein, 22 aa, Mycobacterium
AADLRTDWPATLHAAGFEPGQP

SEQ ID NO: 1060430 - protein, 22 aa, Mycobacterium
AAEHPRPDYVLLHISDTHLVGG

SEQ ID NO: 1060431 - protein, 19 aa, Mycobacterium
AAFGFPGFGGNGGLLFGKA

SEQ ID NO: 1060432 - protein, 18 aa, Mycobacterium
AAFQAEFEGLLSGGAAAY

SEQ ID NO: 1060433 - protein, 25 aa, Mycobacterium
AAGDVPTLFAWRILDYWNWTNRPDR

SEQ ID NO: 1060434 - protein, 17 aa, Mycobacterium
AAGIPILGKTNMDEFAM

SEQ ID NO: 1060435 - protein, 28 aa, Mycobacterium
AAGLRAGIPMLIRWLWLDQPIWAAGIEE

SEQ ID NO: 1060436 - protein, 19 aa, Mycobacterium
AAGYLCWRGKDLATARGWI

SEQ ID NO: 1060437 - protein, 17 aa, Mycobacterium
AAHARFVAAAAKVNTLL

SEQ ID NO: 1060438 - protein, 17 aa, Mycobacterium
AAHFVWVRDALRLGGKF

SEQ ID NO: 1060439 - protein, 17 aa, Mycobacterium
AAIPDRFTKTVLASANS

SEQ ID NO: 1060440 - protein, 20 aa, Mycobacterium
AALARDFLTIWFAQLHSQVA

SEQ ID NO: 1060441 - protein, 19 aa, Mycobacterium
AALCASRFVVVPMKTDDLS

SEQ ID NO: 1060442 - protein, 17 aa, Mycobacterium
AALFPTLAAALDCGTGD

SEQ ID NO: 1060443 - protein, 17 aa, Mycobacterium
AALIARHRVNLIAIGNG

SEQ ID NO: 1060444 - protein, 17 aa, Mycobacterium
AALPATMMARWFRTEQA

SEQ ID NO: 1060445 - protein, 21 aa, Mycobacterium
AALQFPAPVKYVAPIAFNVVP

SEQ ID NO: 1060446 - protein, 23 aa, Mycobacterium
AALRPRYLMMLAEILRFHRAASR

SEQ ID NO: 1060447 - protein, 19 aa, Mycobacterium
AALTGRPLIGNGANGTPGL

SEQ ID NO: 1060448 - protein, 17 aa, Mycobacterium
AALTLVHRVPRSAGREL

SEQ ID NO: 1060449 - protein, 19 aa, Mycobacterium
AALVGSMSVPQGWTQAAPA

SEQ ID NO: 1060450 - protein, 21 aa, Mycobacterium
AAMGGSGGWFSGNGGAGGSGG

SEQ ID NO: 1060451 - protein, 18 aa, Mycobacterium
AAMIPRLIATAAELARAT

SEQ ID NO: 1060452 - protein, 19 aa, Mycobacterium
AANAAPFQGLLGAVNAPVQ

SEQ ID NO: 1060453 - protein, 20 aa, Mycobacterium
AANPRLGWVKPIGLGSDKRD

SEQ ID NO: 1060454 - protein, 17 aa, Mycobacterium
AAPAGRVLLVWDAPNLD

SEQ ID NO: 1060455 - protein, 20 aa, Mycobacterium
AAPLPKHWEFYLGNTKAILP

SEQ ID NO: 1060456 - protein, 18 aa, Mycobacterium
AAQSWSLDRFRAVAKCAG

SEQ ID NO: 1060457 - protein, 20 aa, Mycobacterium
AARLLVWRAGWMARNNHNFD

SEQ ID NO: 1060458 - protein, 18 aa, Mycobacterium
AARLTGWWIDIRGDSPEQ

SEQ ID NO: 1060459 - protein, 18 aa, Mycobacterium
AARNSAGFGAPRYGVKPI

SEQ ID NO: 1060460 - protein, 25 aa, Mycobacterium
AATDWQDFLAFRGRELCPGGRLVVL

SEQ ID NO: 1060461 - protein, 18 aa, Mycobacterium
AATGRPLIGNGANGAPGT

SEQ ID NO: 1060462 - protein, 18 aa, Mycobacterium
AATISVVWTNSGSAAATE

SEQ ID NO: 1060463 - protein, 21 aa, Mycobacterium
AATPLYLRYVIFGGERLTSSD

SEQ ID NO: 1060464 - protein, 21 aa, Mycobacterium
AATRWPAVRFAVRNTAVQGPN

SEQ ID NO: 1060465 - protein, 19 aa, Mycobacterium
AAVAALFPGHALDYQALST

SEQ ID NO: 1060466 - protein, 19 aa, Mycobacterium
AAVAKLFGGYAQQFQALGA

SEQ ID NO: 1060467 - protein, 24 aa, Mycobacterium
AAVAKRRGWPILKFNSRGGVGLRR

SEQ ID NO: 1060468 - protein, 17 aa, Mycobacterium
AAVAVAWALAHPDRCVA

SEQ ID NO: 1060469 - protein, 17 aa, Mycobacterium
AAVRCWCCLASWPRSTS

SEQ ID NO: 1060470 - protein, 18 aa, Mycobacterium
AAVRPEWPQLVDAIAEVR

SEQ ID NO: 1060471 - protein, 17 aa, Mycobacterium
AAYEVLERVGLNPKVAS

SEQ ID NO: 1060472 - protein, 18 aa, Mycobacterium
ACAGCATRDPAMCVSGPQ

SEQ ID NO: 1060473 - protein, 20 aa, Mycobacterium
ACGISWNLLAGIGRIESMHA

SEQ ID NO: 1060474 - protein, 26 aa, Mycobacterium
ACLDRYARLFAWLGLWERHTDLAVIP

SEQ ID NO: 1060475 - protein, 19 aa, Mycobacterium
ACPPCPPSPISQPPRPPAP

SEQ ID NO: 1060476 - protein, 17 aa, Mycobacterium
ACPPSAPAEHVASFIET

SEQ ID NO: 1060477 - protein, 20 aa, Mycobacterium
ACSISWPAPKRRSFTSGSCS

SEQ ID NO: 1060478 - protein, 26 aa, Mycobacterium
ADALALAICHCWRAPMIAQMAKAHAL

SEQ ID NO: 1060479 - protein, 17 aa, Mycobacterium
ADARLMAHAAFGLLNST

SEQ ID NO: 1060480 - protein, 23 aa, Mycobacterium
ADATAGSVFACFVRPQFQGRGVG

SEQ ID NO: 1060481 - protein, 19 aa, Mycobacterium
ADCHPILFLRMMERVKSGA

SEQ ID NO: 1060482 - protein, 25 aa, Mycobacterium
ADDEVSVAIAALFSGHGQAYQAISA

SEQ ID NO: 1060483 - protein, 21 aa, Mycobacterium
ADDIAHIWALLGLTVAGPDVP

SEQ ID NO: 1060484 - protein, 23 aa, Mycobacterium
ADEISAAIAELFGNHAQQYQALS

SEQ ID NO: 1060485 - protein, 19 aa, Mycobacterium
ADEIVRWATPVTSFQRTAL

SEQ ID NO: 1060486 - protein, 19 aa, Mycobacterium
ADELGCRSLALVAFGTGVG

SEQ ID NO: 1060487 - protein, 25 aa, Mycobacterium
ADEVSAAVAAVFCAHAQDYQALSAE

SEQ ID NO: 1060488 - protein, 23 aa, Mycobacterium
ADEVSVAMAALFSGHGQAYQTLS

SEQ ID NO: 1060489 - protein, 25 aa, Mycobacterium
ADEVSVGIAALFADHAQEYEVVLEE

SEQ ID NO: 1060490 - protein, 17 aa, Mycobacterium
ADFMGGFALWVDEQRRL

SEQ ID NO: 1060491 - protein, 18 aa, Mycobacterium
ADGFIVLAQLHWDMLTPY

SEQ ID NO: 1060492 - protein, 23 aa, Mycobacterium
ADGGVRLSGRWSWATGVMDGNWI

SEQ ID NO: 1060493 - protein, 23 aa, Mycobacterium
ADGRCWPEFVLGAAYEGPPGLVH

SEQ ID NO: 1060494 - protein, 18 aa, Mycobacterium
ADGRLHYVYNFLGERQQL

SEQ ID NO: 1060495 - protein, 20 aa, Mycobacterium
ADGRRWRALFDWTSQRFDML

SEQ ID NO: 1060496 - protein, 17 aa, Mycobacterium
ADLLPWIDAHDDARPEL

SEQ ID NO: 1060497 - protein, 17 aa, Mycobacterium
ADLMPWLADRVDALKSF

SEQ ID NO: 1060498 - protein, 20 aa, Mycobacterium
ADLPPAVGVLVEYTGAGAEA

SEQ ID NO: 1060499 - protein, 18 aa, Mycobacterium
ADLSRFPADIARVVVRLI

SEQ ID NO: 1060500 - protein, 24 aa, Mycobacterium
ADPGQRLVLSWGWEGHGDPAPGES

SEQ ID NO: 1060501 - protein, 19 aa, Mycobacterium
ADQDFTYRFSVPNAGTYWA

SEQ ID NO: 1060502 - protein, 18 aa, Mycobacterium
ADSEFYAVCGWDAVNDAI

SEQ ID NO: 1060503 - protein, 17 aa, Mycobacterium
ADSVMIGGKGAAGGDGG

SEQ ID NO: 1060504 - protein, 17 aa, Mycobacterium
ADTAVCWDDHGVRACFR

SEQ ID NO: 1060505 - protein, 19 aa, Mycobacterium
ADVEFARLYGFARPMGPRM

SEQ ID NO: 1060506 - protein, 25 aa, Mycobacterium
ADVIKRIGVPGIWYSGSHGFESTAP

SEQ ID NO: 1060507 - protein, 18 aa, Mycobacterium
ADVKFGIEPWFRYFQKVA

SEQ ID NO: 1060508 - protein, 23 aa, Mycobacterium
ADVPFRVMMRLLRAVGQASGLDD

SEQ ID NO: 1060509 - protein, 19 aa, Mycobacterium
ADVSIRWQLKQSAAPELFQ

SEQ ID NO: 1060510 - protein, 19 aa, Mycobacterium
ADWEPLGAIAIGYAQQPAE

SEQ ID NO: 1060511 - protein, 19 aa, Mycobacterium
AEAALYFAGERSRYVTGTV

SEQ ID NO: 1060512 - protein, 19 aa, Mycobacterium
AEADAAFDQARRRFEEAWN

SEQ ID NO: 1060513 - protein, 20 aa, Mycobacterium
AEARYLWPSVFTQVADEYDR

SEQ ID NO: 1060514 - protein, 17 aa, Mycobacterium
AEDIIIWSSTEFGYVTL

SEQ ID NO: 1060515 - protein, 24 aa, Mycobacterium
AEEALRMGLVWRICSPEELLPEAR

SEQ ID NO: 1060516 - protein, 19 aa, Mycobacterium
AEELVMWWNFVGRNHDEIV

SEQ ID NO: 1060517 - protein, 18 aa, Mycobacterium
AEEMLYLAMEDFRVDVVV

SEQ ID NO: 1060518 - protein, 21 aa, Mycobacterium
AEERYRVAITVADVTRAQLVR

SEQ ID NO: 1060519 - protein, 20 aa, Mycobacterium
AEFDRLRALGVRFTQEPTEM

SEQ ID NO: 1060520 - protein, 17 aa, Mycobacterium
AEGFSWTPVHTMAGPDT

SEQ ID NO: 1060521 - protein, 19 aa, Mycobacterium
AEGLGGWFRLGRIANQQKA

SEQ ID NO: 1060522 - protein, 17 aa, Mycobacterium
AEGRLKGILKYYDAPIV

SEQ ID NO: 1060523 - protein, 18 aa, Mycobacterium
AEIARLALFLTTPAARHI

SEQ ID NO: 1060524 - protein, 32 aa, Mycobacterium
AEIDAPCELVDFWRFNVAFTRQILDQQPVSAK

SEQ ID NO: 1060525 - protein, 20 aa, Mycobacterium
AEIFPGGWLPTIPTVEEHAT

SEQ ID NO: 1060526 - protein, 17 aa, Mycobacterium
AEIPLLVVITEVIPVQD

SEQ ID NO: 1060527 - protein, 21 aa, Mycobacterium
AEIYVPFSWFEPMWLENLGFM

SEQ ID NO: 1060528 - protein, 17 aa, Mycobacterium
AELGATCVSLWSGYSVS

SEQ ID NO: 1060529 - protein, 20 aa, Mycobacterium
AELGFPLSIHFEATYGMSPA

SEQ ID NO: 1060530 - protein, 21 aa, Mycobacterium
AELGFPLSIHFEATYGMSPAA

SEQ ID NO: 1060531 - protein, 19 aa, Mycobacterium
AELLHRMCPAEGYRDDVVV

SEQ ID NO: 1060532 - protein, 21 aa, Mycobacterium
AENGRSWSRWSFIGAGAPTAL

SEQ ID NO: 1060533 - protein, 21 aa, Mycobacterium
AEPFIPLRVPKIFNLRTDPYE

SEQ ID NO: 1060534 - protein, 19 aa, Mycobacterium
AEPKWVLAMGVCASSGGMF

SEQ ID NO: 1060535 - protein, 17 aa, Mycobacterium
AEQCRRLDALGIGYEIV

SEQ ID NO: 1060536 - protein, 17 aa, Mycobacterium
AERILKLFGHEELNKVV

SEQ ID NO: 1060537 - protein, 19 aa, Mycobacterium
AERLCGWQERYPDVVTHKV

SEQ ID NO: 1060538 - protein, 20 aa, Mycobacterium
AESWPSWAPVITKVTWTSPP

SEQ ID NO: 1060539 - protein, 18 aa, Mycobacterium
AETGIIYIDEVDKIARKS

SEQ ID NO: 1060540 - protein, 21 aa, Mycobacterium
AETRLGYSLIRAHTAAIIWSD

SEQ ID NO: 1060541 - protein, 24 aa, Mycobacterium
AEVAPRLGGPIAPCYHAAVDAQTG

SEQ ID NO: 1060542 - protein, 25 aa, Mycobacterium
AEVWRRGSVIGSWLLDLTAIALHES

SEQ ID NO: 1060543 - protein, 24 aa, Mycobacterium
AEWARASEELTLWASTQTPHELRA

SEQ ID NO: 1060544 - protein, 17 aa, Mycobacterium
AEWKVFLNLLRKRFETD

SEQ ID NO: 1060545 - protein, 22 aa, Mycobacterium
AEWKVFLNLLRKRFETDKGKWT

SEQ ID NO: 1060546 - protein, 17 aa, Mycobacterium
AEYSLRGANLWDEVKDR

SEQ ID NO: 1060547 - protein, 21 aa, Mycobacterium
AEYVYRFAPLVGIYGGTHEVF

SEQ ID NO: 1060548 - protein, 20 aa, Mycobacterium
AFAFAGGRLGYLVATPALID

SEQ ID NO: 1060549 - protein, 17 aa, Mycobacterium
AFCGFDIEKVAGYTDAD

SEQ ID NO: 1060550 - protein, 19 aa, Mycobacterium
AFDPCCPFGGYKNSGIGRE

SEQ ID NO: 1060551 - protein, 17 aa, Mycobacterium
AFFDEFFLGAADAGVRQ

SEQ ID NO: 1060552 - protein, 23 aa, Mycobacterium
AFHWWLVLATLRWGVICQYQAWR

SEQ ID NO: 1060553 - protein, 18 aa, Mycobacterium
AFIPHSVWQQMGDTFLDT

SEQ ID NO: 1060554 - protein, 22 aa, Mycobacterium
AFLREVVDFELPAPGSYATGIA

SEQ ID NO: 1060555 - protein, 18 aa, Mycobacterium
AFQTEFTRLLATAGDSYA

SEQ ID NO: 1060556 - protein, 18 aa, Mycobacterium
AFWVAHSFGGVALARAAA

SEQ ID NO: 1060557 - protein, 22 aa, Mycobacterium
AGAEIRVGYFLVEDHALRLLNL

SEQ ID NO: 1060558 - protein, 20 aa, Mycobacterium
AGAFEVARAAMIHPLEVLAN

SEQ ID NO: 1060559 - protein, 18 aa, Mycobacterium
AGAGPRYGVRLTVMPHPP

SEQ ID NO: 1060560 - protein, 18 aa, Mycobacterium
AGDLTFAGAGGFGGFGGT

SEQ ID NO: 1060561 - protein, 19 aa, Mycobacterium
AGGAGEWLFGPGGVGGAGG

SEQ ID NO: 1060562 - protein, 24 aa, Mycobacterium
AGGAGGGAWLWGAGGAGGSGSGGL

SEQ ID NO: 1060563 - protein, 24 aa, Mycobacterium
AGGAGGNGGWLFGQGGAGGIGGSG

SEQ ID NO: 1060564 - protein, 18 aa, Mycobacterium
AGGDAGLLIGDSGAGGSG

SEQ ID NO: 1060565 - protein, 23 aa, Mycobacterium
AGGDGRPGGILMGKGGDGAPGGP

SEQ ID NO: 1060566 - protein, 17 aa, Mycobacterium
AGGFGVLGAVGFTPEQL

SEQ ID NO: 1060567 - protein, 18 aa, Mycobacterium
AGGFTLDGLGGWFITGVE

SEQ ID NO: 1060568 - protein, 18 aa, Mycobacterium
AGGGGLWFGNGGAGGIGG

SEQ ID NO: 1060569 - protein, 18 aa, Mycobacterium
AGGPWAGLVGAGGGDGGI

SEQ ID NO: 1060570 - protein, 17 aa, Mycobacterium
AGGRGGWLIGNGAGGGT

SEQ ID NO: 1060571 - protein, 23 aa, Mycobacterium
AGHYTLRAAIDWQQHKPNGSHLV

SEQ ID NO: 1060572 - protein, 25 aa, Mycobacterium
AGLARVWSCHLGRPLAADSSLLGAG

SEQ ID NO: 1060573 - protein, 21 aa, Mycobacterium
AGLGRSWLHAGIRPLDVDVAP

SEQ ID NO: 1060574 - protein, 18 aa, Mycobacterium
AGLKWCRKAAELGTIDEA

SEQ ID NO: 1060575 - protein, 18 aa, Mycobacterium
AGLLKIWEALIIVYPNGT

SEQ ID NO: 1060576 - protein, 18 aa, Mycobacterium
AGLMLRIPGPRFCTDNGA

SEQ ID NO: 1060577 - protein, 20 aa, Mycobacterium
AGLQARLGLDCGKWTHEQMA

SEQ ID NO: 1060578 - protein, 21 aa, Mycobacterium
AGLSSRAEWLPAWQDGLQRAA

SEQ ID NO: 1060579 - protein, 19 aa, Mycobacterium
AGPAARCPASAGTVEPAGS

SEQ ID NO: 1060580 - protein, 19 aa, Mycobacterium
AGPALACGNAFVLKPSERD

SEQ ID NO: 1060581 - protein, 18 aa, Mycobacterium
AGRAAPRLTVWVPVAVDP

SEQ ID NO: 1060582 - protein, 18 aa, Mycobacterium
AGRPFGFRPEAILPAYGM

SEQ ID NO: 1060583 - protein, 19 aa, Mycobacterium
AGRPFGFRPEAILPAYGMA

SEQ ID NO: 1060584 - protein, 23 aa, Mycobacterium
AGRPRPPSAPAWFVDAAPGLRQF

SEQ ID NO: 1060585 - protein, 24 aa, Mycobacterium
AGSLSIRGGGYGGLGGNGGTGGAG

SEQ ID NO: 1060586 - protein, 19 aa, Mycobacterium
AGVGMDWRAVYAGWGARLV

SEQ ID NO: 1060587 - protein, 23 aa, Mycobacterium
AGVLRPLPVTAFDVRRAPAALRY

SEQ ID NO: 1060588 - protein, 24 aa, Mycobacterium
AGVVRPDLVIGWWAAPTILEHGTP

SEQ ID NO: 1060589 - protein, 20 aa, Mycobacterium
AGWSAVRWRNLTGGIVALHA

SEQ ID NO: 1060590 - protein, 25 aa, Mycobacterium
AGWWRAPLRWTLRGSLAVRSRLMVR

SEQ ID NO: 1060591 - protein, 23 aa, Mycobacterium
AHEGRLKYCYNFLGIDHYMVAAT

SEQ ID NO: 1060592 - protein, 17 aa, Mycobacterium
AHFECWTMLAAWAEQTS

SEQ ID NO: 1060593 - protein, 24 aa, Mycobacterium
AHGPVRFPGVPTWFSRTPGRVLGP

SEQ ID NO: 1060594 - protein, 18 aa, Mycobacterium
AHLSRLNVLPVYGGSSYA

SEQ ID NO: 1060595 - protein, 17 aa, Mycobacterium
AHMPRLAPARALTPPPT

SEQ ID NO: 1060596 - protein, 23 aa, Mycobacterium
AHSQLAWVLGCFTGFGQASRMTQ

SEQ ID NO: 1060597 - protein, 17 aa, Mycobacterium
AHTRLRVGLPMVPNTVF

SEQ ID NO: 1060598 - protein, 18 aa, Mycobacterium
AIALDWLRKHGCQDLASR

SEQ ID NO: 1060599 - protein, 18 aa, Mycobacterium
AILDEFDEHLALRCGRSE

SEQ ID NO: 1060600 - protein, 18 aa, Mycobacterium
AILDEWKTISGLDRKVDD

SEQ ID NO: 1060601 - protein, 17 aa, Mycobacterium
AIMLKVHHALIDGEGGL

SEQ ID NO: 1060602 - protein, 20 aa, Mycobacterium
AIQWPDGRMQFMLNERMMPA

SEQ ID NO: 1060603 - protein, 20 aa, Mycobacterium
AIRAFRAAYELGVGTVAVYA

SEQ ID NO: 1060604 - protein, 18 aa, Mycobacterium
AISGMNAVAGWRGASRPV

SEQ ID NO: 1060605 - protein, 18 aa, Mycobacterium
AISQLFGAHCQEFQVVSA

SEQ ID NO: 1060606 - protein, 23 aa, Mycobacterium
AKAAPLWRVLVALSIRHVGPTAA

SEQ ID NO: 1060607 - protein, 19 aa, Mycobacterium
AKADSAWHLHQLTANTELA

SEQ ID NO: 1060608 - protein, 19 aa, Mycobacterium
AKAFLCSEIARWVNEEGLS

SEQ ID NO: 1060609 - protein, 18 aa, Mycobacterium
AKAIIAWHEFVPAAQAGA

SEQ ID NO: 1060610 - protein, 18 aa, Mycobacterium
AKEAYGWRVETNMHETHT

SEQ ID NO: 1060611 - protein, 22 aa, Mycobacterium
AKLAELQRLWLIEATKYNVVPL

SEQ ID NO: 1060612 - protein, 17 aa, Mycobacterium
AKLGCSFVVVGHSERRT

SEQ ID NO: 1060613 - protein, 19 aa, Mycobacterium
AKLKGYRLICVIPENTSIE

SEQ ID NO: 1060614 - protein, 19 aa, Mycobacterium
AKVLSRFVDAIVWRTFGQD

SEQ ID NO: 1060615 - protein, 20 aa, Mycobacterium
AKYTICPAVAHGLDHEVGSV

SEQ ID NO: 1060616 - protein, 20 aa, Mycobacterium
ALAEFAALRWQWHDLEVGRT

SEQ ID NO: 1060617 - protein, 17 aa, Mycobacterium
ALAGFGLTEPGAGSDAG

SEQ ID NO: 1060618 - protein, 17 aa, Mycobacterium
ALALRMLVIALKNNEIL

SEQ ID NO: 1060619 - protein, 18 aa, Mycobacterium
ALARFALSLSDSVGHLTD

SEQ ID NO: 1060620 - protein, 18 aa, Mycobacterium
ALARVCALNALAAVNSLV

SEQ ID NO: 1060621 - protein, 19 aa, Mycobacterium
ALASILSWQGWDELFDLAR

SEQ ID NO: 1060622 - protein, 22 aa, Mycobacterium
ALASRARKAPGFALLGEPGQAR

SEQ ID NO: 1060623 - protein, 22 aa, Mycobacterium
ALCARFRISGLPVVDDAGALVG

SEQ ID NO: 1060624 - protein, 19 aa, Mycobacterium
ALCLGWRLFEPMLRSATGL

SEQ ID NO: 1060625 - protein, 20 aa, Mycobacterium
ALELIEWPVAVVIAAGHVIA

SEQ ID NO: 1060626 - protein, 18 aa, Mycobacterium
ALERARRALAEFQVEGLA

SEQ ID NO: 1060627 - protein, 21 aa, Mycobacterium
ALETWPLSMFERFLPRHLEII

SEQ ID NO: 1060628 - protein, 18 aa, Mycobacterium
ALFGRPLIGNGSNGTPGT

SEQ ID NO: 1060629 - protein, 17 aa, Mycobacterium
ALFKLGLSVEADAAGGL

SEQ ID NO: 1060630 - protein, 19 aa, Mycobacterium
ALGCQGAWTGSQWLMVEEA

SEQ ID NO: 1060631 - protein, 23 aa, Mycobacterium
ALGCTIKLLSICERLTTDEGQQR

SEQ ID NO: 1060632 - protein, 18 aa, Mycobacterium
ALHEQFVKLMSGGAAQYA

SEQ ID NO: 1060633 - protein, 18 aa, Mycobacterium
ALIDRLWPASDFSAPRRW

SEQ ID NO: 1060634 - protein, 21 aa, Mycobacterium
ALIERAAVEFGIKAVVRQSDS

SEQ ID NO: 1060635 - protein, 17 aa, Mycobacterium
ALIGLAHPDYRPWLAEC

SEQ ID NO: 1060636 - protein, 18 aa, Mycobacterium
ALLCPFDPLIFFRPRVQR

SEQ ID NO: 1060637 - protein, 23 aa, Mycobacterium
ALLFPGARGWITYLWVPPFASEK

SEQ ID NO: 1060638 - protein, 18 aa, Mycobacterium
ALLGRPLIGDGADGAPGE

SEQ ID NO: 1060639 - protein, 18 aa, Mycobacterium
ALLGRPLIGNGDDGVAGT

SEQ ID NO: 1060640 - protein, 20 aa, Mycobacterium
ALLGRPLIGNGTDGLAGTGA

SEQ ID NO: 1060641 - protein, 18 aa, Mycobacterium
ALLGRPLIRDGAAGAPGQ

SEQ ID NO: 1060642 - protein, 20 aa, Mycobacterium
ALNTRPRKTLGWKTPAEAFH

SEQ ID NO: 1060643 - protein, 26 aa, Mycobacterium
ALPAADADFSLSIFGLQLVKTGTANA

SEQ ID NO: 1060644 - protein, 23 aa, Mycobacterium
ALPEHTRWLPGDYRYCDVVATLA

SEQ ID NO: 1060645 - protein, 31 aa, Mycobacterium; identical to SEQ ID NO: 760650

SEQ ID NO: 1060646 - protein, 23 aa, Mycobacterium
ALRIPEMIRWPGKISAGVVSNEI

SEQ ID NO: 1060647 - protein, 17 aa, Mycobacterium
ALRRWAHRFYPGAQTSP

SEQ ID NO: 1060648 - protein, 26 aa, Mycobacterium
ALRWGAEVYHALKAVLKKAGLSTGLG

SEQ ID NO: 1060649 - protein, 18 aa, Mycobacterium
ALSGLAPWQEVLSGVSGR

SEQ ID NO: 1060650 - protein, 23 aa, Mycobacterium
ALSRECWRSVGGMDLRTFGRYGW

SEQ ID NO: 1060651 - protein, 19 aa, Mycobacterium
ALTGRPLIGNGADGGPGQA

SEQ ID NO: 1060652 - protein, 20 aa, Mycobacterium
ALTPRPVPTVAIGHLHEQTV

SEQ ID NO: 1060653 - protein, 18 aa, Mycobacterium
ALTSGVGIVEGWRGAVLH

SEQ ID NO: 1060654 - protein, 23 aa, Mycobacterium
ALTYPRRLGFGLGTSVVSLSWRT

SEQ ID NO: 1060655 - protein, 23 aa, Mycobacterium
ALVGQCWPAVFAAIGSAVTDSGV

SEQ ID NO: 1060656 - protein, 17 aa, Mycobacterium
AMAARPAPVATAGTPGC

SEQ ID NO: 1060657 - protein, 17 aa, Mycobacterium
AMAKRFVTDTCFDVADK

SEQ ID NO: 1060658 - protein, 17 aa, Mycobacterium
AMAMPIAGMAAARAVMA

SEQ ID NO: 1060659 - protein, 24 aa, Mycobacterium
AMANSIWPYVAWLRATAAATEQSA

SEQ ID NO: 1060660 - protein, 17 aa, Mycobacterium
AMARECVAAGWLLSLSG

SEQ ID NO: 1060661 - protein, 22 aa, Mycobacterium
AMDRKVWLPSGGTLVIDRTEAM

SEQ ID NO: 1060662 - protein, 19 aa, Mycobacterium
AMEAFGLLCRMEGIIPAIE

SEQ ID NO: 1060663 - protein, 22 aa, Mycobacterium
AMELGCDALLLATAVTRAADPA

SEQ ID NO: 1060664 - protein, 19 aa, Mycobacterium
AMFDGRFVGFADFLIRDRE

SEQ ID NO: 1060665 - protein, 25 aa, Mycobacterium
AMGLPLPGAIAWHAVPRWFARRKDR

SEQ ID NO: 1060666 - protein, 17 aa, Mycobacterium
AMLGRPLIGNGADGAPG

SEQ ID NO: 1060667 - protein, 18 aa, Mycobacterium
AMLSRLVIMGGMFDADGN

SEQ ID NO: 1060668 - protein, 24 aa, Mycobacterium
AMPPTSVMGLWTFDGHKGQTEVTT

SEQ ID NO: 1060669 - protein, 24 aa, Mycobacterium
AMSKFEVLTAMAFAAFADAPVDVA

SEQ ID NO: 1060670 - protein, 24 aa, Mycobacterium
AMTGWQRLHFRFGLPAPLLEPLAV

SEQ ID NO: 1060671 - protein, 17 aa, Mycobacterium
ANADFMGGFALWVDEQR

SEQ ID NO: 1060672 - protein, 18 aa, Mycobacterium
ANGIFLPHVLRYNASLPT

SEQ ID NO: 1060673 - protein, 24 aa, Mycobacterium
ANGLRLPGAHSFFVGNPQIGKTFF

SEQ ID NO: 1060674 - protein, 17 aa, Mycobacterium
ANIRWARALEHAGVHVV

SEQ ID NO: 1060675 - protein, 17 aa, Mycobacterium
ANLRFAAPSAFQNRPSG

SEQ ID NO: 1060676 - protein, 19 aa, Mycobacterium
ANLRLVVSLAKRYTGRGMA

SEQ ID NO: 1060677 - protein, 17 aa, Mycobacterium
ANQLMAFHDQFAQALTA

SEQ ID NO: 1060678 - protein, 17 aa, Mycobacterium
ANVWRRVIPKSWFYNII

SEQ ID NO: 1060679 - protein, 20 aa, Mycobacterium
APARAYNPLFIWGESGLGKT

SEQ ID NO: 1060680 - protein, 21 aa, Mycobacterium
APARSGFRVGERVSAFGVLGG

SEQ ID NO: 1060681 - protein, 19 aa, Mycobacterium
APAVLGWAGFCDVAQRYSL

SEQ ID NO: 1060682 - protein, 25 aa, Mycobacterium
APDPGKWAGFELHRSITITEEFTLG

SEQ ID NO: 1060683 - protein, 24 aa, Mycobacterium
APERLRSGWLNGIKHWQVDYTGKC

SEQ ID NO: 1060684 - protein, 21 aa, Mycobacterium
APEVIRLAPPLIITESQIDSF

SEQ ID NO: 1060685 - protein, 22 aa, Mycobacterium
APEVIRLAPPLIITESQIDSFI

SEQ ID NO: 1060686 - protein, 17 aa, Mycobacterium
APFSNFWLTPRQHRDAL

SEQ ID NO: 1060687 - protein, 17 aa, Mycobacterium
APGALGLHTALTGAPFS

SEQ ID NO: 1060688 - protein, 18 aa, Mycobacterium
APGGWLIGNDGAGGSGAA

SEQ ID NO: 1060689 - protein, 17 aa, Mycobacterium
APGPCRAAGTSDLTFAS

SEQ ID NO: 1060690 - protein, 17 aa, Mycobacterium
APHLARITCPALVINAD

SEQ ID NO: 1060691 - protein, 20 aa, Mycobacterium
APIADVFLVWCADEATGGMS

SEQ ID NO: 1060692 - protein, 19 aa, Mycobacterium
APKAFIFVSHIQRLGNGKP

SEQ ID NO: 1060693 - protein, 17 aa, Mycobacterium
APLCAPCDVFAPTYEGS

SEQ ID NO: 1060694 - protein, 18 aa, Mycobacterium
APLMWTSLVVKAWMGEHG

SEQ ID NO: 1060695 - protein, 17 aa, Mycobacterium
APLPLAAITPRWVARRL

SEQ ID NO: 1060696 - protein, 19 aa, Mycobacterium
APMFHAWGFSQLVLAASLA

SEQ ID NO: 1060697 - protein, 18 aa, Mycobacterium
APMRPFRALGMGKRIASD

SEQ ID NO: 1060698 - protein, 17 aa, Mycobacterium
APMWLPFRWPGRQGVTL

SEQ ID NO: 1060699 - protein, 17 aa, Mycobacterium
APPRPPFPPSPPEPAEL

SEQ ID NO: 1060700 - protein, 18 aa, Mycobacterium
APQARLGLIAAIRDAGLD

SEQ ID NO: 1060701 - protein, 17 aa, Mycobacterium
APRLTVWVPVAVDPGAA

SEQ ID NO: 1060702 - protein, 21 aa, Mycobacterium
APRVCRRHRLLLGRAGGQLTT

SEQ ID NO: 1060703 - protein, 19 aa, Mycobacterium
APSRLFLRYVIFGGEMLTF

SEQ ID NO: 1060704 - protein, 23 aa, Mycobacterium
APTQVLFGRGLIGDGANGTAPGQ

SEQ ID NO: 1060705 - protein, 20 aa, Mycobacterium
APVPGYRGPRSFALPEFDPF

SEQ ID NO: 1060706 - protein, 25 aa, Mycobacterium
APVPGYRGSRSFGFKEFDPFWQACI

SEQ ID NO: 1060707 - protein, 23 aa, Mycobacterium
APVWGGIHLSYVMAVPEIIEAAA

SEQ ID NO: 1060708 - protein, 23 aa, Mycobacterium
APWLEPEPICWAINHVRVRVGPG

SEQ ID NO: 1060709 - protein, 22 aa, Mycobacterium
AQAAAFHDQFLRALTGAGGAYA

SEQ ID NO: 1060710 - protein, 24 aa, Mycobacterium
AQELYFPVCFELAITKGPPAAGDR

SEQ ID NO: 1060711 - protein, 22 aa, Mycobacterium
AQLCARCKRAAIDSGIRVSTAG

SEQ ID NO: 1060712 - protein, 20 aa, Mycobacterium
AQLDRFAIRLELRYLSEQDE

SEQ ID NO: 1060713 - protein, 22 aa, Mycobacterium
AQLLERFGMFGIRISIAGLAAG

SEQ ID NO: 1060714 - protein, 19 aa, Mycobacterium
AQTVARWLVLYLRRPCGQT

SEQ ID NO: 1060715 - protein, 25 aa, Mycobacterium
ARAAGGYGGHGGWLYGSGGAGGDGG

SEQ ID NO: 1060716 - protein, 18 aa, Mycobacterium
ARAALEFCESFDGVRPAA

SEQ ID NO: 1060717 - protein, 18 aa, Mycobacterium
ARAALGFMDTELQIDYRD

SEQ ID NO: 1060718 - protein, 19 aa, Mycobacterium
ARAGWLWSRRRGIVTGLSA

SEQ ID NO: 1060719 - protein, 19 aa, Mycobacterium
ARALGLPVVEVIAGGDISQ

SEQ ID NO: 1060720 - protein, 24 aa, Mycobacterium
ARALKELFDQLGLGRVLLVGNSLG

SEQ ID NO: 1060721 - protein, 22 aa, Mycobacterium
ARAPALLISRLVSWVDDLWCRA

SEQ ID NO: 1060722 - protein, 19 aa, Mycobacterium
ARDGFALNIDEAVVAMTAR

SEQ ID NO: 1060723 - protein, 24 aa, Mycobacterium
AREEFNMPLALRFEGPLDSVALAA

SEQ ID NO: 1060724 - protein, 17 aa, Mycobacterium
ARFNGTVLLEWLNVSGG

SEQ ID NO: 1060725 - protein, 17 aa, Mycobacterium
ARFSAAFTFQYSKRPGT

SEQ ID NO: 1060726 - protein, 19 aa, Mycobacterium
ARGAGPGGPLVRWPTLTKS

SEQ ID NO: 1060727 - protein, 18 aa, Mycobacterium
ARGGAALSVREVTGVPIL

SEQ ID NO: 1060728 - protein, 17 aa, Mycobacterium
ARIALHVRVLYGRDPHH

SEQ ID NO: 1060729 - protein, 19 aa, Mycobacterium
ARKRIPVVLFAEGGGGRPG

SEQ ID NO: 1060730 - protein, 19 aa, Mycobacterium
ARLAGLLIQRGLRPGDRVG

SEQ ID NO: 1060731 - protein, 20 aa, Mycobacterium
ARLAKLFAHSAVVPRVVLVD

SEQ ID NO: 1060732 - protein, 17 aa, Mycobacterium
ARLATAFTQTWVATSDD

SEQ ID NO: 1060733 - protein, 17 aa, Mycobacterium
ARLDLCFVMTAAADACG

SEQ ID NO: 1060734 - protein, 18 aa, Mycobacterium
ARLHARLGALIGEGVLEV

SEQ ID NO: 1060735 - protein, 17 aa, Mycobacterium
ARLKGLIDVGTYNASNA

SEQ ID NO: 1060736 - protein, 18 aa, Mycobacterium
ARLKVGIISAGRVGTALG

SEQ ID NO: 1060737 - protein, 23 aa, Mycobacterium
ARLRWSRRPEWGGLEVDADVVGT

SEQ ID NO: 1060738 - protein, 21 aa, Mycobacterium
ARLTIGAGLGPMLEAANARQG

SEQ ID NO: 1060739 - protein, 17 aa, Mycobacterium
ARPAQIAAFAVAMKMKV

SEQ ID NO: 1060740 - protein, 19 aa, Mycobacterium
ARPAVMPMDAWREGDKFVV

SEQ ID NO: 1060741 - protein, 19 aa, Mycobacterium
ARPSPFYIMDEVEAALDDT

SEQ ID NO: 1060742 - protein, 17 aa, Mycobacterium
ARQEPRLNWAIGRQSEG

SEQ ID NO: 1060743 - protein, 19 aa, Mycobacterium
ARTCSMGVFKRHKQIDRPC

SEQ ID NO: 1060744 - protein, 19 aa, Mycobacterium
ARTGVFILDARQWFQSFPA

SEQ ID NO: 1060745 - protein, 23 aa, Mycobacterium
ARVKCALLGWMAFKDALAQAITA

SEQ ID NO: 1060746 - protein, 18 aa, Mycobacterium
ARVLGRLRAHLCSDGRAV

SEQ ID NO: 1060747 - protein, 18 aa, Mycobacterium
ARVPFLREPFGADITTIG

SEQ ID NO: 1060748 - protein, 19 aa, Mycobacterium
ARVRWGWRVGLSAGLRRRT

SEQ ID NO: 1060749 - protein, 18 aa, Mycobacterium
ARYGIVWGAMGAARSAWQ

SEQ ID NO: 1060750 - protein, 23 aa, Mycobacterium
ARYLFRRVVSWGRSSNVFLRNGA

SEQ ID NO: 1060751 - protein, 17 aa, Mycobacterium
ARYQAFTSFTAHVRGPV

SEQ ID NO: 1060752 - protein, 20 aa, Mycobacterium
ASAFHLQFVQAMTAGAGAYA

SEQ ID NO: 1060753 - protein, 18 aa, Mycobacterium
ASATRLTPFTSPPPITDP

SEQ ID NO: 1060754 - protein, 24 aa, Mycobacterium
ASAWNRLASELSFTADGYERVIKA

SEQ ID NO: 1060755 - protein, 19 aa, Mycobacterium
ASFAESFVALGIIPGDGGT

SEQ ID NO: 1060756 - protein, 17 aa, Mycobacterium
ASFKTAVKFINWRTPGE

SEQ ID NO: 1060757 - protein, 17 aa, Mycobacterium
ASFLRRDGSVWTTDKDG

SEQ ID NO: 1060758 - protein, 17 aa, Mycobacterium
ASFQGVLTNLGWSVDDD

SEQ ID NO: 1060759 - protein, 24 aa, Mycobacterium
ASGLRLGIVASTWHSRICDALLAG

SEQ ID NO: 1060760 - protein, 21 aa, Mycobacterium
ASGPRIRLAYQLTPRSVRGEQ

SEQ ID NO: 1060761 - protein, 19 aa, Mycobacterium
ASGWLEFRSAGYSGVTDDI

SEQ ID NO: 1060762 - protein, 18 aa, Mycobacterium
ASIPRFADSVIRLKAELD

SEQ ID NO: 1060763 - protein, 22 aa, Mycobacterium
ASKGKWDILRAMGFDEDHISDS

SEQ ID NO: 1060764 - protein, 19 aa, Mycobacterium
ASLMPICLGDDITDEDAFD

SEQ ID NO: 1060765 - protein, 19 aa, Mycobacterium
ASLPRRHQLVLSRGPYHYD

SEQ ID NO: 1060766 - protein, 29 aa, Mycobacterium
ASPDARCGPRCAGRLGRSRTAANIGSHNW

SEQ ID NO: 1060767 - protein, 22 aa, Mycobacterium
ASPLRPWPGFAPMIYQRYSQPF

SEQ ID NO: 1060768 - protein, 17 aa, Mycobacterium
ASPLYWGAVVSFAVDGA

SEQ ID NO: 1060769 - protein, 24 aa, Mycobacterium
ASPRESWLRMVLIDAGLPVPVTQI

SEQ ID NO: 1060770 - protein, 19 aa, Mycobacterium
ASPSWRKGPRHIAGRGPRD

SEQ ID NO: 1060771 - protein, 19 aa, Mycobacterium
ASQLLKFAPHPGLGPLPKD

SEQ ID NO: 1060772 - protein, 26 aa, Mycobacterium
ASSRYPGGLALRFARVVRYRDDKGPA

SEQ ID NO: 1060773 - protein, 23 aa, Mycobacterium
ASTKGDGLLVVFGHRAGQHNDAN

SEQ ID NO: 1060774 - protein, 17 aa, Mycobacterium
ASTRSGVFWIRDILPVQ

SEQ ID NO: 1060775 - protein, 19 aa, Mycobacterium
ASVALELLTGPSLLILDEP

SEQ ID NO: 1060776 - protein, 18 aa, Mycobacterium
ASVPWVLMHWRPVSDDNP

SEQ ID NO: 1060777 - protein, 17 aa, Mycobacterium
ASVVCGIGFADLSSFTV

SEQ ID NO: 1060778 - protein, 17 aa, Mycobacterium
ASVWGGVAAVRFKHAMD

SEQ ID NO: 1060779 - protein, 19 aa, Mycobacterium
ASYLLSLRAAWQADNKIPN

SEQ ID NO: 1060780 - protein, 19 aa, Mycobacterium
ASYSTYCLTHWARDRASGR

SEQ ID NO: 1060781 - protein, 18 aa, Mycobacterium
ATAESWGPLFAEARRATV

SEQ ID NO: 1060782 - protein, 17 aa, Mycobacterium
ATAKARFVRVSPRKARR

SEQ ID NO: 1060783 - protein, 18 aa, Mycobacterium
ATALRPAPVGAYPAGASA

SEQ ID NO: 1060784 - protein, 17 aa, Mycobacterium
ATARLTGRWLRGRLPTA

SEQ ID NO: 1060785 - protein, 23 aa, Mycobacterium
ATAWRLTGLGLWVIAHDPYCADA

SEQ ID NO: 1060786 - protein, 25 aa, Mycobacterium
ATDGFRSGDMSGFFNTAAGGSSYTG

SEQ ID NO: 1060787 - protein, 18 aa, Mycobacterium
ATERACWATRPVRAVQRW

SEQ ID NO: 1060788 - protein, 20 aa, Mycobacterium
ATFEWAFRWLDAHRPAESAP

SEQ ID NO: 1060789 - protein, 22 aa, Mycobacterium
ATGAAPLQPVLDLINGPTQALL

SEQ ID NO: 1060790 - protein, 18 aa, Mycobacterium
ATGQFLWQNIFGVWPVTG

SEQ ID NO: 1060791 - protein, 20 aa, Mycobacterium
ATGRPPRWVRPVVEELGFTP

SEQ ID NO: 1060792 - protein, 20 aa, Mycobacterium
ATGSFNRAWAFDQYSDAEVN

SEQ ID NO: 1060793 - protein, 17 aa, Mycobacterium
ATLAFAFSHRSYLDGML

SEQ ID NO: 1060794 - protein, 24 aa, Mycobacterium
ATLARFAQRFARFHLHPRALRPSY

SEQ ID NO: 1060795 - protein, 23 aa, Mycobacterium
ATLLTARCPVMFAPAMHTEMWLH

SEQ ID NO: 1060796 - protein, 17 aa, Mycobacterium
ATLWVARSVSWIFEYYP

SEQ ID NO: 1060797 - protein, 17 aa, Mycobacterium
ATPRRWDETGSVCASAP

SEQ ID NO: 1060798 - protein, 22 aa, Mycobacterium
ATQFQTRFVSALSNAGSAYAAA

SEQ ID NO: 1060799 - protein, 17 aa, Mycobacterium
ATQFYSMLGMRALYHQG

SEQ ID NO: 1060800 - protein, 18 aa, Mycobacterium
ATRLGLDLTHVIMRDNSY

SEQ ID NO: 1060801 - protein, 17 aa, Mycobacterium
ATSRARWPPPRGLPTGN

SEQ ID NO: 1060802 - protein, 22 aa, Mycobacterium
ATTCARRRYGIRLTVMLRPPEA

SEQ ID NO: 1060803 - protein, 17 aa, Mycobacterium
ATVGEFAPYVDMTLWPK

SEQ ID NO: 1060804 - protein, 17 aa, Mycobacterium
ATVPPVIRIFRAEIGAA

SEQ ID NO: 1060805 - protein, 17 aa, Mycobacterium
ATWSRWGQTLFPIGVLY

SEQ ID NO: 1060806 - protein, 17 aa, Mycobacterium
ATYPAAMAARPAPVATA

SEQ ID NO: 1060807 - protein, 17 aa, Mycobacterium
ATYRFPLVIAPRYTTGH

SEQ ID NO: 1060808 - protein, 17 aa, Mycobacterium
AVADLFAAFGMFAVGFY

SEQ ID NO: 1060809 - protein, 27 aa, Mycobacterium
AVAEGLAAMGFRCILPTWPLGSHTIPA

SEQ ID NO: 1060810 - protein, 23 aa, Mycobacterium
AVAKRRGWPILKFNSRGGVGIGA

SEQ ID NO: 1060811 - protein, 17 aa, Mycobacterium
AVASLFSSYGHAYQSLS

SEQ ID NO: 1060812 - protein, 18 aa, Mycobacterium
AVAVCRRAGIPVIADGGL

SEQ ID NO: 1060813 - protein, 20 aa, Mycobacterium
AVIAELFGTHALEYQAISTQ

SEQ ID NO: 1060814 - protein, 19 aa, Mycobacterium
AVLGRPLIGDGVDAAAGSG

SEQ ID NO: 1060815 - protein, 23 aa, Mycobacterium
AVLLRECIDFFAPYLAAAKLTGE

SEQ ID NO: 1060816 - protein, 17 aa, Mycobacterium
AVLPLPMVSWLYEYGNY

SEQ ID NO: 1060817 - protein, 20 aa, Mycobacterium
AVMAARWSKVLGAWPITTAL

SEQ ID NO: 1060818 - protein, 18 aa, Mycobacterium
AVNTAAWFVMAAIPNSVF

SEQ ID NO: 1060819 - protein, 23 aa, Mycobacterium
AVQAWRGFSRWLMRAYDVLVDED

SEQ ID NO: 1060820 - protein, 23 aa, Mycobacterium
AVRDWPKPLGFVWGLDDPVATTN

SEQ ID NO: 1060821 - protein, 18 aa, Mycobacterium
AVSEVRWNAVVLADDTVL

SEQ ID NO: 1060822 - protein, 18 aa, Mycobacterium
AVSFRFGDRTQINGVPRE

SEQ ID NO: 1060823 - protein, 19 aa, Mycobacterium
AVSSFFGAYARDYQAFSVQ

SEQ ID NO: 1060824 - protein, 25 aa, Mycobacterium
AVVDLCSRFLPAMVERGRGAVFNVA

SEQ ID NO: 1060825 - protein, 19 aa, Mycobacterium
AVVLRATWAVARVLAEQTP

SEQ ID NO: 1060826 - protein, 25 aa, Mycobacterium
AVVTRYELVDGFPRFDVDDVYLGNG

SEQ ID NO: 1060827 - protein, 24 aa, Mycobacterium
AVYRMAWAALRGCPESSVRTAFHY

SEQ ID NO: 1060828 - protein, 19 aa, Mycobacterium
AWAMIKVTPMIGVNDDPSE

SEQ ID NO: 1060829 - protein, 19 aa, Mycobacterium
AWPRFGLELPELLPEKLSG

SEQ ID NO: 1060830 - protein, 22 aa, Mycobacterium
AWRGELPPALALQIVERHGYDI

SEQ ID NO: 1060831 - protein, 21 aa, Mycobacterium
AWRVNCLGAFLGMRAALGALS

SEQ ID NO: 1060832 - protein, 20 aa, Mycobacterium
AYFPLGWPIACHVQGDAGVD

SEQ ID NO: 1060833 - protein, 22 aa, Mycobacterium
AYPGRFLLGIGVGHPEAITEYH

SEQ ID NO: 1060834 - protein, 17 aa, Mycobacterium
AYQRLSAQLSEFHDQFV

SEQ ID NO: 1060835 - protein, 18 aa, Mycobacterium
AYRLPWPPQTVVYEIDLP

SEQ ID NO: 1060836 - protein, 24 aa, Mycobacterium
AYSYGLACIRNWLYWQYVVGLFGS

SEQ ID NO: 1060837 - protein, 19 aa, Mycobacterium
CAALGRAFVADGFDESTAA

SEQ ID NO: 1060838 - protein, 19 aa, Mycobacterium
CAAQSWSLERIRAVKEAAG

SEQ ID NO: 1060839 - protein, 18 aa, Mycobacterium
CAGLRYNLFFDDRTLDGD

SEQ ID NO: 1060840 - protein, 17 aa, Mycobacterium
CALELGCGTGFFLLNLI

SEQ ID NO: 1060841 - protein, 18 aa, Mycobacterium
CARLRFILTAQRDHYLPL

SEQ ID NO: 1060842 - protein, 18 aa, Mycobacterium
CAYSRYLRQAGFPYSQSY

SEQ ID NO: 1060843 - protein, 17 aa, Mycobacterium
CDILARYDVTFSLGDGL

SEQ ID NO: 1060844 - protein, 24 aa, Mycobacterium
CDKGFPSYFLIVADLINYARSVDI

SEQ ID NO: 1060845 - protein, 17 aa, Mycobacterium
CDPEVVEALKFHLRDLA

SEQ ID NO: 1060846 - protein, 22 aa, Mycobacterium
CEYHGLHAFRWVAADGSARFVR

SEQ ID NO: 1060847 - protein, 17 aa, Mycobacterium
CFGMKIPSEYGGLSMSQ

SEQ ID NO: 1060848 - protein, 24 aa, Mycobacterium
CGADFRLTDAAAWERFYGSAHSGS

SEQ ID NO: 1060849 - protein, 23 aa, Mycobacterium
CGADFRLTDAGAWGRFYESPYAG

SEQ ID NO: 1060850 - protein, 24 aa, Mycobacterium
CGADFRLTDAGAWGRFYESPYAGS

SEQ ID NO: 1060851 - protein, 22 aa, Mycobacterium
CGAPVMSLRTDRDWIADIVRFV

SEQ ID NO: 1060852 - protein, 22 aa, Mycobacterium
CGQAFAEFVDWSLLDVLRGAAG

SEQ ID NO: 1060853 - protein, 17 aa, Mycobacterium
CGRCPTCQAGLRNLCDL

SEQ ID NO: 1060854 - protein, 18 aa, Mycobacterium
CGRIKDLLILAGRNIYPQ

SEQ ID NO: 1060855 - protein, 21 aa, Mycobacterium
CGTCESCQALAPSAPGSIDVV

SEQ ID NO: 1060856 - protein, 17 aa, Mycobacterium
CGVCKYCRRGDENLCPK

SEQ ID NO: 1060857 - protein, 20 aa, Mycobacterium
CGWCKDRFGLSWQIVPDRLH

SEQ ID NO: 1060858 - protein, 18 aa, Mycobacterium
CGWQERYPDVVTHKVVVS

SEQ ID NO: 1060859 - protein, 23 aa, Mycobacterium
CHNGCPLGNLIPEWNDLVRQGRW

SEQ ID NO: 1060860 - protein, 18 aa, Mycobacterium
CILEHDWATVVMVDTQDG

SEQ ID NO: 1060861 - protein, 20 aa, Mycobacterium
CIRHTCWLPVLWRLPCGKSR

SEQ ID NO: 1060862 - protein, 21 aa, Mycobacterium
CKASLDRLGLDYVDLYLIHWP

SEQ ID NO: 1060863 - protein, 22 aa, Mycobacterium
CKRGRPSYCFDTFNAEQKMTLT

SEQ ID NO: 1060864 - protein, 20 aa, Mycobacterium
CKRRMFDLLVRMGYKEIEVG

SEQ ID NO: 1060865 - protein, 17 aa, Mycobacterium
CKTPSCAIRRAAGEPRR

SEQ ID NO: 1060866 - protein, 18 aa, Mycobacterium
CLRSTFMYLGWLCGAGPN

SEQ ID NO: 1060867 - protein, 21 aa, Mycobacterium
CLSEGRIGWVAGLLDRLDHML

SEQ ID NO: 1060868 - protein, 20 aa, Mycobacterium
CMDCGIPFCHNGCPLGNLIP

SEQ ID NO: 1060869 - protein, 17 aa, Mycobacterium
CNASFKTAVKFINWRTP

SEQ ID NO: 1060870 - protein, 17 aa, Mycobacterium
CNQLLWRRDEFGLGGDD

SEQ ID NO: 1060871 - protein, 17 aa, Mycobacterium
CNQRIKFSALYAKALAL

SEQ ID NO: 1060872 - protein, 18 aa, Mycobacterium
CNRIMTQFAAFLRGVNVG

SEQ ID NO: 1060873 - protein, 19 aa, Mycobacterium
CNRWASGRFDAGVFKEDWR

SEQ ID NO: 1060874 - protein, 17 aa, Mycobacterium
CPDREVVLVFVGDGSAP

SEQ ID NO: 1060875 - protein, 21 aa, Mycobacterium
CPSWNFSRIGVGGQRFVFEQS

SEQ ID NO: 1060876 - protein, 20 aa, Mycobacterium
CQAIWRLEHGYLAGSDPRRD

SEQ ID NO: 1060877 - protein, 18 aa, Mycobacterium
CQAQRPGSWWKNFGAKMH

SEQ ID NO: 1060878 - protein, 26 aa, Mycobacterium
CQQAWCPVCALTALVIGEQHPLLTVI

SEQ ID NO: 1060879 - protein, 24 aa, Mycobacterium
CRPEAGLKVARRFAHLTYRGEIEL

SEQ ID NO: 1060880 - protein, 17 aa, Mycobacterium
CRSWPGCTAVAFERDER

SEQ ID NO: 1060881 - protein, 20 aa, Mycobacterium
CRTPTIAAVHGWCIGGALDL

SEQ ID NO: 1060882 - protein, 17 aa, Mycobacterium
CSAFEAWFVSAALDDTA

SEQ ID NO: 1060883 - protein, 20 aa, Mycobacterium
CSDCGRIYWAGSHHARLAGL

SEQ ID NO: 1060884 - protein, 19 aa, Mycobacterium
CSGFGHALGIAADMIRGGS

SEQ ID NO: 1060885 - protein, 18 aa, Mycobacterium
CSGRLRKLFHAVGVVFKG

SEQ ID NO: 1060886 - protein, 19 aa, Mycobacterium
CSIKHQMASVIFSLEMSKT

SEQ ID NO: 1060887 - protein, 19 aa, Mycobacterium
CSRPARARQGGWCAGNRDL

SEQ ID NO: 1060888 - protein, 18 aa, Mycobacterium
CSVPDIGTIWVRRATREE

SEQ ID NO: 1060889 - protein, 17 aa, Mycobacterium
CTPVCVLLMVFEAPTIT

SEQ ID NO: 1060890 - protein, 23 aa, Mycobacterium
CTYHGRILWRPGALPAFSDDRWE

SEQ ID NO: 1060891 - protein, 19 aa, Mycobacterium
CVELGIPIFVCAGIPGPRL

SEQ ID NO: 1060892 - protein, 17 aa, Mycobacterium
CWCCLASWPRSTSGSGR

SEQ ID NO: 1060893 - protein, 20 aa, Mycobacterium
DAATMPVRFVKSIGDAVMLV

SEQ ID NO: 1060894 - protein, 18 aa, Mycobacterium
DADFFAAWGKLAAVRTPT

SEQ ID NO: 1060895 - protein, 17 aa, Mycobacterium
DAESAFQVLAKWSQKSN

SEQ ID NO: 1060896 - protein, 19 aa, Mycobacterium
DAKSAWPGIELVAANHTEA

SEQ ID NO: 1060897 - protein, 22 aa, Mycobacterium
DAKWASSISGYWRRGRTEETFR

SEQ ID NO: 1060898 - protein, 18 aa, Mycobacterium
DALCALGLQSRVVGAAFP

SEQ ID NO: 1060899 - protein, 18 aa, Mycobacterium
DALGIKWAVVVGDREGAE

SEQ ID NO: 1060900 - protein, 18 aa, Mycobacterium
DAMAVRARFFDAFFQDAT

SEQ ID NO: 1060901 - protein, 19 aa, Mycobacterium
DANVWRRVIPKSWFYNIII

SEQ ID NO: 1060902 - protein, 25 aa, Mycobacterium
DARAYRLDWPAGMTVFEIDQPEVIA

SEQ ID NO: 1060903 - protein, 17 aa, Mycobacterium
DARRLREFSAFDAFSDA

SEQ ID NO: 1060904 - protein, 18 aa, Mycobacterium
DARVKIFLTASAETRARR

SEQ ID NO: 1060905 - protein, 24 aa, Mycobacterium
DAVARQEPGLSWAAGLRDDGRTTL

SEQ ID NO: 1060906 - protein, 17 aa, Mycobacterium
DCAPLWCAVDLRDGNQA

SEQ ID NO: 1060907 - protein, 21 aa, Mycobacterium
DCIQVLGGIGCTWEHDAHLYL

SEQ ID NO: 1060908 - protein, 19 aa, Mycobacterium
DDAEVFEALALLRASPGMD

SEQ ID NO: 1060909 - protein, 17 aa, Mycobacterium
DDFATWCALAERYGDDW

SEQ ID NO: 1060910 - protein, 27 aa, Mycobacterium
DDLSERVGWRWRLVWYRAVSELLTGAY

SEQ ID NO: 1060911 - protein, 18 aa, Mycobacterium
DDPCAFSFSGLKTAVACY

SEQ ID NO: 1060912 - protein, 17 aa, Mycobacterium
DDPRPVMLWAYDPLAFN

SEQ ID NO: 1060913 - protein, 17 aa, Mycobacterium
DDVDAFLAMHDLTKNDI

SEQ ID NO: 1060914 - protein, 18 aa, Mycobacterium
DDYLRVVGVPEIFAAGDV

SEQ ID NO: 1060915 - protein, 25 aa, Mycobacterium
DEDKLAVGLSRGWPPKTQRCASSRT

SEQ ID NO: 1060916 - protein, 21 aa, Mycobacterium
DEEKLAWARRVLVAARTERGV

SEQ ID NO: 1060917 - protein, 24 aa, Mycobacterium
DEHTCLYHYAWVRDRLLMVSLADV

SEQ ID NO: 1060918 - protein, 21 aa, Mycobacterium
DEIRVPWELKPRRRSNPGHRS

SEQ ID NO: 1060919 - protein, 23 aa, Mycobacterium
DEISAAVAALFSGHALDYQALST

SEQ ID NO: 1060920 - protein, 21 aa, Mycobacterium
DEIWRFTPLRRLRGLHDGSAV

SEQ ID NO: 1060921 - protein, 17 aa, Mycobacterium
DELRSLLRFVLDLLSDY

SEQ ID NO: 1060922 - protein, 22 aa, Mycobacterium
DEQFRIAYLFSQKVFGFAPYPA

SEQ ID NO: 1060923 - protein, 18 aa, Mycobacterium
DERARLPIDPEWGPGWHL

SEQ ID NO: 1060924 - protein, 17 aa, Mycobacterium
DERGMRTVMCIMNGQLR

SEQ ID NO: 1060925 - protein, 17 aa, Mycobacterium
DETLWRLLCEQVGAAAL

SEQ ID NO: 1060926 - protein, 19 aa, Mycobacterium
DEVPEFLAEYGWRLVEQAG

SEQ ID NO: 1060927 - protein, 17 aa, Mycobacterium
DEVRLLVGIDVIDTQSQ

SEQ ID NO: 1060928 - protein, 27 aa, Mycobacterium
DEVSAAIAALFSFHGQSYQTLGAQAEA

SEQ ID NO: 1060929 - protein, 17 aa, Mycobacterium
DEVSAAIAAVFSAHGQS

SEQ ID NO: 1060930 - protein, 24 aa, Mycobacterium
DEVSAAVTRMFGAYAQEFQTLSAR

SEQ ID NO: 1060931 - protein, 18 aa, Mycobacterium
DFAKAFWNVVNWADVQSR

SEQ ID NO: 1060932 - protein, 19 aa, Mycobacterium
DFIEACAWIKENLPGVHIS

SEQ ID NO: 1060933 - protein, 17 aa, Mycobacterium
DFLHGRWLVLRRGKRNI

SEQ ID NO: 1060934 - protein, 20 aa, Mycobacterium
DFLSIEIFRPLDLAMVVDPI

SEQ ID NO: 1060935 - protein, 18 aa, Mycobacterium
DFMRSCSIKHQMASVIFS

SEQ ID NO: 1060936 - protein, 18 aa, Mycobacterium
DFNFAWPTARIAVIGADG

SEQ ID NO: 1060937 - protein, 17 aa, Mycobacterium
DFPVLWPVLTRWADNDM

SEQ ID NO: 1060938 - protein, 23 aa, Mycobacterium
DFVKLAEALGCVGLRCEREEDVA

SEQ ID NO: 1060939 - protein, 28 aa, Mycobacterium
DFWFDPLCPWCWITSRWILEVEKVRDIE

SEQ ID NO: 1060940 - protein, 18 aa, Mycobacterium
DGAHGADGFSPITGGNGG

SEQ ID NO: 1060941 - protein, 20 aa, Mycobacterium
DGAPAWLRFFGCNPRHHSLA

SEQ ID NO: 1060942 - protein, 18 aa, Mycobacterium
DGCVRLPLNLSRNDVRAS

SEQ ID NO: 1060943 - protein, 22 aa, Mycobacterium
DGGIGGHGGWLFGNAGAGGPGG

SEQ ID NO: 1060944 - protein, 22 aa, Mycobacterium
DGGVGGRLFGSGGVGGSGGAGG

SEQ ID NO: 1060945 - protein, 28 aa, Mycobacterium
DGHFPKPWALGIHNVWLRIVPTTITERR

SEQ ID NO: 1060946 - protein, 17 aa, Mycobacterium
DGIGLDEFVDWLNESGC

SEQ ID NO: 1060947 - protein, 34 aa, Mycobacterium
DGIGVAAVDWCRWRLRCRGACGCRIRGNAADVHA

SEQ ID NO: 1060948 - protein, 24 aa, Mycobacterium
DGLTVPRPAVFFDFDGTLSEIVDD

SEQ ID NO: 1060949 - protein, 17 aa, Mycobacterium
DGNTRYTPRGNVGGHGG

SEQ ID NO: 1060950 - protein, 18 aa, Mycobacterium
DGPPPDWHSFGRVLNKNG

SEQ ID NO: 1060951 - protein, 18 aa, Mycobacterium
DGRMGFEVKIHRAAADGA

SEQ ID NO: 1060952 - protein, 18 aa, Mycobacterium
DGRWVRWDADRAAGAYAH

SEQ ID NO: 1060953 - protein, 21 aa, Mycobacterium
DGSCPVSLFVPDTCEPVPGVV

SEQ ID NO: 1060954 - protein, 18 aa, Mycobacterium
DGYLRAAVRPEWPQLVDA

SEQ ID NO: 1060955 - protein, 20 aa, Mycobacterium
DHAAICWPLLVGMAKAKYYL

SEQ ID NO: 1060956 - protein, 21 aa, Mycobacterium
DHGTWCFAGGPVIKDGRPVDF

SEQ ID NO: 1060957 - protein, 19 aa, Mycobacterium
DHRLGEVGRAFIVARPGFN

SEQ ID NO: 1060958 - protein, 21 aa, Mycobacterium
DIAEVLALLGVRPVWDEASRR

SEQ ID NO: 1060959 - protein, 19 aa, Mycobacterium
DIAGALAWLVSDEARYITG

SEQ ID NO: 1060960 - protein, 22 aa, Mycobacterium
DIDFAFGVGQIFALVPYAQLIL

SEQ ID NO: 1060961 - protein, 23 aa, Mycobacterium
DIDRGGVFAAFFGTIALLSVEDQ

SEQ ID NO: 1060962 - protein, 25 aa, Mycobacterium
DIFLWEIFGPLSAGGRLVFPALGPG

SEQ ID NO: 1060963 - protein, 17 aa, Mycobacterium
DIGCGWGSVLKRAVEKY

SEQ ID NO: 1060964 - protein, 20 aa, Mycobacterium
DIRALYAFKRLAWWPYSVAM

SEQ ID NO: 1060965 - protein, 19 aa, Mycobacterium
DIVSWRWTDVPGALGVTNH

SEQ ID NO: 1060966 - protein, 26 aa, Mycobacterium
DKFAPRLSFFWGIGMNFFMEVAKLRA

SEQ ID NO: 1060967 - protein, 27 aa, Mycobacterium
DKLETLRGWTFHRLEVLAVRLRGQSKA

SEQ ID NO: 1060968 - protein, 18 aa, Mycobacterium
DKPFWWSHFDRLNYPIDE

SEQ ID NO: 1060969 - protein, 18 aa, Mycobacterium
DKRIDLYFPGERPLTAYH

SEQ ID NO: 1060970 - protein, 18 aa, Mycobacterium
DLALAGGCALLLEPNGSV

SEQ ID NO: 1060971 - protein, 22 aa, Mycobacterium
DLDPGLAIARWGIAYAVGPNYN

SEQ ID NO: 1060972 - protein, 24 aa, Mycobacterium
DLDWRAAFAGLRARTVTLPTYSFA

SEQ ID NO: 1060973 - protein, 22 aa, Mycobacterium
DLEGRLPFELQRVVLSNGSVIL

SEQ ID NO: 1060974 - protein, 24 aa, Mycobacterium
DLEHWRWMWETNVLGTLRVTRALL

SEQ ID NO: 1060975 - protein, 17 aa, Mycobacterium
DLFNRFTHDAFWRDPER

SEQ ID NO: 1060976 - protein, 18 aa, Mycobacterium
DLGCGFPLLTTKKVHFKS

SEQ ID NO: 1060977 - protein, 24 aa, Mycobacterium
DLLDEAWWFPAIQWPDGRMQFMLN

SEQ ID NO: 1060978 - protein, 22 aa, Mycobacterium
DLQAGFKLSYLFVSHDLSVVKH

SEQ ID NO: 1060979 - protein, 18 aa, Mycobacterium
DLQDIIAILGIDELSEED

SEQ ID NO: 1060980 - protein, 24 aa, Mycobacterium
DLRAIPWVLAWSQSRVMLPGWYGT

SEQ ID NO: 1060981 - protein, 25 aa, Mycobacterium
DLRALSLPVLRSWLATAAGAGAART

SEQ ID NO: 1060982 - protein, 17 aa, Mycobacterium
DLREDWPAALRAAGFDP

SEQ ID NO: 1060983 - protein, 18 aa, Mycobacterium
DLSRLAEDIIIWSSTEFG

SEQ ID NO: 1060984 - protein, 19 aa, Mycobacterium
DMLASAAADVAGIGSSVGA

SEQ ID NO: 1060985 - protein, 18 aa, Mycobacterium
DNGQGVGSLFSWTGDPAV

SEQ ID NO: 1060986 - protein, 17 aa, Mycobacterium
DNIRFFAGAARRLPGQA

SEQ ID NO: 1060987 - protein, 17 aa, Mycobacterium
DNLRLSGTVARIPSSSG

SEQ ID NO: 1060988 - protein, 25 aa, Mycobacterium
DNPWLTGLCTMRWAGRLLPAASRKL

SEQ ID NO: 1060989 - protein, 25 aa, Mycobacterium
DNRAWRLYRRLGFTDILRGYYFAGD

SEQ ID NO: 1060990 - protein, 21 aa, Mycobacterium
DNRLSGGLYRWQSRYLRAEDQ

SEQ ID NO: 1060991 - protein, 17 aa, Mycobacterium
DNSRPPTELSFNLGADA

SEQ ID NO: 1060992 - protein, 26 aa, Mycobacterium
DPELAWAAVRAWNDWHLEAWAGPYPE

SEQ ID NO: 1060993 - protein, 24 aa, Mycobacterium
DPGESRFYLSLGDELMRRFNGAAL

SEQ ID NO: 1060994 - protein, 21 aa, Mycobacterium
DPGQGGNAYLFGNGGSGGQGG

SEQ ID NO: 1060995 - protein, 21 aa, Mycobacterium
DPGSVSYLFSRKGVVTLEKNG

SEQ ID NO: 1060996 - protein, 20 aa, Mycobacterium
DPICPFAWVTSRWLLEAAQS

SEQ ID NO: 1060997 - protein, 23 aa, Mycobacterium
DPLLPEVAWSWLVEALESRTEHV

SEQ ID NO: 1060998 - protein, 19 aa, Mycobacterium
DPLRWLRCLTQYRGTNSGA

SEQ ID NO: 1060999 - protein, 25 aa, Mycobacterium
DPLWLRRRVGMCFQRPTPFAGTVAD

SEQ ID NO: 1061000 - protein, 23 aa, Mycobacterium
DPPPGLPGVRAFLEGAGVARFKI

SEQ ID NO: 1061001 - protein, 23 aa, Mycobacterium
DPPYRGLVSMSFAWPTDDTGGYP

SEQ ID NO: 1061002 - protein, 23 aa, Mycobacterium
DPQISASMGIQWYRVKLDAEYAA

SEQ ID NO: 1061003 - protein, 21 aa, Mycobacterium
DPSWPAARVELVLSDCGPSMI

SEQ ID NO: 1061004 - protein, 19 aa, Mycobacterium
DPWVVPKFYWTVLGVSAFL

SEQ ID NO: 1061005 - protein, 22 aa, Mycobacterium
DQPRAPIPLSLNGTGRVGRPGT

SEQ ID NO: 1061006 - protein, 23 aa, Mycobacterium
DQRLRRLLMFVARQEPRLNWAIG

SEQ ID NO: 1061007 - protein, 22 aa, Mycobacterium
DRAAGAYAHRWWVRRTLADALR

SEQ ID NO: 1061008 - protein, 17 aa, Mycobacterium
DRARKGLSILMAPEGTR

SEQ ID NO: 1061009 - protein, 20 aa, Mycobacterium
DRERCILCARCTRFSNEIAG

SEQ ID NO: 1061010 - protein, 24 aa, Mycobacterium
DRGEAIGYAVDWARTGDVVLIAGK

SEQ ID NO: 1061011 - protein, 17 aa, Mycobacterium
DRLRLALDSSLCGAVTG

SEQ ID NO: 1061012 - protein, 17 aa, Mycobacterium
DRLVKRAATIVVGPTRD

SEQ ID NO: 1061013 - protein, 20 aa, Mycobacterium
DRPFLMPVEDVFTITGRGTV

SEQ ID NO: 1061014 - protein, 23 aa, Mycobacterium
DRPIADVCPVEWARMADRSVLQW

SEQ ID NO: 1061015 - protein, 19 aa, Mycobacterium
DRRPMLWLEVMKPMASNAV

SEQ ID NO: 1061016 - protein, 17 aa, Mycobacterium
DRSDARHGWAYRSAGAG

SEQ ID NO: 1061017 - protein, 17 aa, Mycobacterium
DRVAYILEIAKEMQFMI

SEQ ID NO: 1061018 - protein, 18 aa, Mycobacterium
DRVGIAWLRHTCGVCKYC

SEQ ID NO: 1061019 - protein, 17 aa, Mycobacterium
DRVKCLHVLIAHSLAKG

SEQ ID NO: 1061020 - protein, 21 aa, Mycobacterium
DRWTMFHSIAFDFSVWELWGP

SEQ ID NO: 1061021 - protein, 19 aa, Mycobacterium
DSAGFKWLAPYTGSAVAQH

SEQ ID NO: 1061022 - protein, 17 aa, Mycobacterium
DSAWLLVSILRQFGLAA

SEQ ID NO: 1061023 - protein, 19 aa, Mycobacterium
DSGEPWLSLDFHTPAREQF

SEQ ID NO: 1061024 - protein, 23 aa, Mycobacterium
DSGWIRTWLDTVLELPWNITTED

SEQ ID NO: 1061025 - protein, 17 aa, Mycobacterium
DSLRAAEAFARMWDMGV

SEQ ID NO: 1061026 - protein, 22 aa, Mycobacterium
DSPAAKVAIQWATREAELRNAP

SEQ ID NO: 1061027 - protein, 21 aa, Mycobacterium
DSSIWIGPRFVIPSLAMRARV

SEQ ID NO: 1061028 - protein, 17 aa, Mycobacterium
DSTCDLGRFIAEKTAGV

SEQ ID NO: 1061029 - protein, 24 aa, Mycobacterium
DSVGWLRDFLRAHTGGLIIISHNV

SEQ ID NO: 1061030 - protein, 22 aa, Mycobacterium
DTDLRWRIVTALATAGVIDSDG

SEQ ID NO: 1061031 - protein, 23 aa, Mycobacterium
DTGSFRWASPRGLRLAARLVDIG

SEQ ID NO: 1061032 - protein, 25 aa, Mycobacterium
DTGVPPFSVTEPGGAGGNGGAGGTG

SEQ ID NO: 1061033 - protein, 20 aa, Mycobacterium
DTLRLEAGMALYGHELSLET

SEQ ID NO: 1061034 - protein, 21 aa, Mycobacterium
DTRAAIKITTIFGSRYIDLHP

SEQ ID NO: 1061035 - protein, 24 aa, Mycobacterium
DTRLCHFYRGIGLTIYEGYGLTET

SEQ ID NO: 1061036 - protein, 21 aa, Mycobacterium
DTRPTVIIAYTIKGFGLPTEG

SEQ ID NO: 1061037 - protein, 26 aa, Mycobacterium
DVALIVGVPMDFRLGFGGVFGPQTQL

SEQ ID NO: 1061038 - protein, 22 aa, Mycobacterium
DVARLLSMARMRGAQGVVGELG

SEQ ID NO: 1061039 - protein, 19 aa, Mycobacterium
DVFKRMWELYLAYSEAGFR

SEQ ID NO: 1061040 - protein, 17 aa, Mycobacterium
DVGRWLPSMLVRRLENL

SEQ ID NO: 1061041 - protein, 23 aa, Mycobacterium
DVIKRIGVPGIWYSGSHGFESTA

SEQ ID NO: 1061042 - protein, 22 aa, Mycobacterium
DVIRYLRWFTFLVAEELTELEQ

SEQ ID NO: 1061043 - protein, 23 aa, Mycobacterium
DVLQAQCTFSWPPQMDLPGYKPN

SEQ ID NO: 1061044 - protein, 18 aa, Mycobacterium
DVRMRWCGPEVEVEGIIS

SEQ ID NO: 1061045 - protein, 19 aa, Mycobacterium
DVRRCPRNILTFSHGAHHC

SEQ ID NO: 1061046 - protein, 20 aa, Mycobacterium
DVTLRGAVSIARRLQDPLAE

SEQ ID NO: 1061047 - protein, 21 aa, Mycobacterium
DVVLFPAWVRFGPLKPSHLDP

SEQ ID NO: 1061048 - protein, 23 aa, Mycobacterium
DWAEMLMRMYVRWAEQHKYPVEV

SEQ ID NO: 1061049 - protein, 23 aa, Mycobacterium
DWLLGNGGLDWAVKRTADSSQRL

SEQ ID NO: 1061050 - protein, 18 aa, Mycobacterium
DWPAKLRLLEGFRQRENL

SEQ ID NO: 1061051 - protein, 20 aa, Mycobacterium
DYAGKWVIFFSHPADFTPVC

SEQ ID NO: 1061052 - protein, 25 aa, Mycobacterium
EAAAFQCGFCTAGLVVTASTFGDDE

SEQ ID NO: 1061053 - protein, 17 aa, Mycobacterium
EAAFAHFGRRFDDLNTE

SEQ ID NO: 1061054 - protein, 19 aa, Mycobacterium
EAAIGRDLIGNGAPGVAGV

SEQ ID NO: 1061055 - protein, 18 aa, Mycobacterium
EAAKRLDEALARNHSAIN

SEQ ID NO: 1061056 - protein, 22 aa, Mycobacterium
EAANVWPLQDLLGLINAPTQAL

SEQ ID NO: 1061057 - protein, 18 aa, Mycobacterium
EAASAAALGQVWDATAGP

SEQ ID NO: 1061058 - protein, 22 aa, Mycobacterium
EAATLYDMFVRTLGVSAGTYAA

SEQ ID NO: 1061059 - protein, 18 aa, Mycobacterium
EAAVALSAIAARFPQARL

SEQ ID NO: 1061060 - protein, 24 aa, Mycobacterium
EAAVCPRFRVGLLRPRTEIVVLDL

SEQ ID NO: 1061061 - protein, 18 aa, Mycobacterium
EAAYRKGLSFAEAIETVE

SEQ ID NO: 1061062 - protein, 19 aa, Mycobacterium
EADGDRYLPIWIGQSEAAA

SEQ ID NO: 1061063 - protein, 18 aa, Mycobacterium
EAECARWVAEQLAEVGYQ

SEQ ID NO: 1061064 - protein, 24 aa, Mycobacterium
EAEIACGRAAAVITELEALTAEHP

SEQ ID NO: 1061065 - protein, 17 aa, Mycobacterium
EAELMAWAVPQAANQFW

SEQ ID NO: 1061066 - protein, 21 aa, Mycobacterium
EAIDPFLLDLLRLGAYQLLRT

SEQ ID NO: 1061067 - protein, 19 aa, Mycobacterium
EAIDRFGPIFAQYYGQSEA

SEQ ID NO: 1061068 - protein, 21 aa, Mycobacterium
EAKAHRGPLCLGIDPHPELLR

SEQ ID NO: 1061069 - protein, 18 aa, Mycobacterium
EALGGGWFWPAAAAHPSL

SEQ ID NO: 1061070 - protein, 19 aa, Mycobacterium
EALGGGWFWPAAAAHPSLP

SEQ ID NO: 1061071 - protein, 25 aa, Mycobacterium
EALYHFAWDEFCDWYVELAKTQLAE

SEQ ID NO: 1061072 - protein, 18 aa, Mycobacterium
EAMVIDRRVLLTLPISHV

SEQ ID NO: 1061073 - protein, 19 aa, Mycobacterium
EANVIWKLRYTMRSQIFSR

SEQ ID NO: 1061074 - protein, 21 aa, Mycobacterium
EASLGRPLIGNGADGTAPEQA

SEQ ID NO: 1061075 - protein, 25 aa, Mycobacterium
EAVGIAAYHCGDWGQALAELRAARR

SEQ ID NO: 1061076 - protein, 20 aa, Mycobacterium
EAVMLGGLAMKWRWRQKVGK

SEQ ID NO: 1061077 - protein, 19 aa, Mycobacterium
ECSNRFDVVQSFTDDSLTT

SEQ ID NO: 1061078 - protein, 24 aa, Mycobacterium
EDAEFGLACAIGIAPCMHAGQGCA

SEQ ID NO: 1061079 - protein, 22 aa, Mycobacterium
EDFWLKVGIDPIRIMTGAGNLY

SEQ ID NO: 1061080 - protein, 19 aa, Mycobacterium
EDGNLWFEWSRSLDNPTEY

SEQ ID NO: 1061081 - protein, 17 aa, Mycobacterium
EDGRWTVQLAWKAGRSD

SEQ ID NO: 1061082 - protein, 23 aa, Mycobacterium
EDGTRIPISIVYRGGIQLPAPAM

SEQ ID NO: 1061083 - protein, 21 aa, Mycobacterium
EDLPSAIYHRFARVHSYAAVH

SEQ ID NO: 1061084 - protein, 18 aa, Mycobacterium
EDRLRTRFEWGLITDVQP

SEQ ID NO: 1061085 - protein, 18 aa, Mycobacterium
EDTERVFGAKLHSQLDEA

SEQ ID NO: 1061086 - protein, 17 aa, Mycobacterium
EEFRMAVYYADVEGFPY

SEQ ID NO: 1061087 - protein, 17 aa, Mycobacterium
EEIGGLITRLSIGGNGE

SEQ ID NO: 1061088 - protein, 17 aa, Mycobacterium
EEMIRWVTPVKQFMRTA

SEQ ID NO: 1061089 - protein, 20 aa, Mycobacterium
EEPKGVPVFAWKGESLEEYW

SEQ ID NO: 1061090 - protein, 19 aa, Mycobacterium
EEPPEHLIFIFATTEPEKV

SEQ ID NO: 1061091 - protein, 18 aa, Mycobacterium
EEVPEVWAAVTSVFRDYG

SEQ ID NO: 1061092 - protein, 19 aa, Mycobacterium
EEWRRFVGRASLYAAREKA

SEQ ID NO: 1061093 - protein, 20 aa, Mycobacterium
EFRRQRGQSGRRRSRRHRCR

SEQ ID NO: 1061094 - protein, 17 aa, Mycobacterium
EGDPKWVESVEQLMDAV

SEQ ID NO: 1061095 - protein, 22 aa, Mycobacterium
EGELRAAVLEFMDSVRRAEDTI

SEQ ID NO: 1061096 - protein, 20 aa, Mycobacterium
EGFSSILSRNIIEISYSTLS

SEQ ID NO: 1061097 - protein, 20 aa, Mycobacterium
EGFSSILSRNIIEISYSTPS

SEQ ID NO: 1061098 - protein, 20 aa, Mycobacterium
EGHCGACAATLRSGKVNMEV

SEQ ID NO: 1061099 - protein, 23 aa, Mycobacterium
EGLRRFAALSGRSVGAEKIWMGE

SEQ ID NO: 1061100 - protein, 18 aa, Mycobacterium
EGLRRFHRNLGCGLLGRR

SEQ ID NO: 1061101 - protein, 18 aa, Mycobacterium
EGTNTWVLRGPRSDELVV

SEQ ID NO: 1061102 - protein, 19 aa, Mycobacterium
EGVNLTFLPFIARAVIDAL

SEQ ID NO: 1061103 - protein, 26 aa, Mycobacterium
EGVSRWRKGSGLGWLTAEYAMLPSAT

SEQ ID NO: 1061104 - protein, 23 aa, Mycobacterium
EHIVCPWHGWQWRGDGTNALIPY

SEQ ID NO: 1061105 - protein, 19 aa, Mycobacterium
EHPAGSVLIEFGHTKVMCT

SEQ ID NO: 1061106 - protein, 25 aa, Mycobacterium
EHPYPHCWRCRNPLIYRAVSSWFVT

SEQ ID NO: 1061107 - protein, 19 aa, Mycobacterium
EIDNWRWAGVPVFLRAGKA

SEQ ID NO: 1061108 - protein, 23 aa, Mycobacterium
EIKKLPTLRGRTVITMFYENSTR

SEQ ID NO: 1061109 - protein, 19 aa, Mycobacterium
EIMGLGPIEACKKALQRAG

SEQ ID NO: 1061110 - protein, 18 aa, Mycobacterium
EIRHWLMVFAQRFYSFSQ

SEQ ID NO: 1061111 - protein, 23 aa, Mycobacterium
EIRPAHPALHRWFEDRARVDPDA

SEQ ID NO: 1061112 - protein, 22 aa, Mycobacterium
EISAAVATLFACYGQTYQTLGI

SEQ ID NO: 1061113 - protein, 26 aa, Mycobacterium
EISTTIATLFCGYARDYQNLSTQLAS

SEQ ID NO: 1061114 - protein, 19 aa, Mycobacterium
EIVVHAATELRDIGSSVNT

SEQ ID NO: 1061115 - protein, 21 aa, Mycobacterium
EKEAWLSMVMLEWGSCGQIAT

SEQ ID NO: 1061116 - protein, 22 aa, Mycobacterium
EKFRYGFAIAPELVRTVLRDQE

SEQ ID NO: 1061117 - protein, 23 aa, Mycobacterium
EKKTFRIAAHWADHLNIVAALDE

SEQ ID NO: 1061118 - protein, 22 aa, Mycobacterium
EKLFPLICRYALAYHVVFIPSV

SEQ ID NO: 1061119 - protein, 17 aa, Mycobacterium
ELACLEWGDPTGYPTFY

SEQ ID NO: 1061120 - protein, 21 aa, Mycobacterium
ELAMKAYLLWLARGCMPGKLM

SEQ ID NO: 1061121 - protein, 23 aa, Mycobacterium
ELDGLRLITWRGASRAEQGLSFA

SEQ ID NO: 1061122 - protein, 18 aa, Mycobacterium
ELDWWLGFSSTASLLGSP

SEQ ID NO: 1061123 - protein, 19 aa, Mycobacterium
ELFGPLVAGVRLVFMDAAR

SEQ ID NO: 1061124 - protein, 19 aa, Mycobacterium
ELHEIYKLGVVPIPTNRPM

SEQ ID NO: 1061125 - protein, 19 aa, Mycobacterium
ELLFGRMIIGNGADATEAG

SEQ ID NO: 1061126 - protein, 19 aa, Mycobacterium
ELLPDVGFVNAYRLTETSS

SEQ ID NO: 1061127 - protein, 19 aa, Mycobacterium
ELLRFCLEQGYQLRVIEQM

SEQ ID NO: 1061128 - protein, 18 aa, Mycobacterium
ELLTAAGIAAEWCNEPNL

SEQ ID NO: 1061129 - protein, 18 aa, Mycobacterium
ELPARLAKLFAHSAVVPR

SEQ ID NO: 1061130 - protein, 19 aa, Mycobacterium
ELPRLRVLIQIADDSGNGL

SEQ ID NO: 1061131 - protein, 19 aa, Mycobacterium
ELPWRRPIASLNYLLSSHV

SEQ ID NO: 1061132 - protein, 25 aa, Mycobacterium
ELQTRLAAGPVRFYFRVQIAGPGDS

SEQ ID NO: 1061133 - protein, 21 aa, Mycobacterium
ELRARLRLAVMRRRRARKGTL

SEQ ID NO: 1061134 - protein, 21 aa, Mycobacterium
ELRGTEIARHFDLVGFDPRGV

SEQ ID NO: 1061135 - protein, 20 aa, Mycobacterium
ELRIAQAQLVGWLEGLFHGI

SEQ ID NO: 1061136 - protein, 21 aa, Mycobacterium
ELSARAALFHDEFVRVLSAGA

SEQ ID NO: 1061137 - protein, 19 aa, Mycobacterium
ELSDLAALARRTGAADDPF

SEQ ID NO: 1061138 - protein, 18 aa, Mycobacterium
ELTGRPLIGNGANGYTNA

SEQ ID NO: 1061139 - protein, 20 aa, Mycobacterium
ELTMVAPLVLSRDVPVQVQV

SEQ ID NO: 1061140 - protein, 25 aa, Mycobacterium
ELTRRSGGIFGRRVCAVVGSGDNGG

SEQ ID NO: 1061141 - protein, 18 aa, Mycobacterium
ELVDGFPRFDVDDVYLGN

SEQ ID NO: 1061142 - protein, 30 aa, Mycobacterium
ELVGRMSVPQSWAWQQRWPITPVRQPRAAA

SEQ ID NO: 1061143 - protein, 17 aa, Mycobacterium
EMIAVAPSMLWSMTVDL

SEQ ID NO: 1061144 - protein, 20 aa, Mycobacterium
EMIRLLTLKAAYLMDTVGNK

SEQ ID NO: 1061145 - protein, 18 aa, Mycobacterium
EMLPTPWGLVRSGVAPDH

SEQ ID NO: 1061146 - protein, 23 aa, Mycobacterium
ENFARTWLDYRLKLLEATDRFGP

SEQ ID NO: 1061147 - protein, 21 aa, Mycobacterium
ENPAGSVLIEFGRTKVMCTAS

SEQ ID NO: 1061148 - protein, 23 aa, Mycobacterium
EPELRFELCLGVNGVHYPHETGR

SEQ ID NO: 1061149 - protein, 19 aa, Mycobacterium
EPFRIAREMVRVLGPGGRI

SEQ ID NO: 1061150 - protein, 18 aa, Mycobacterium
EPLKCLVENLWALHTNRY

SEQ ID NO: 1061151 - protein, 23 aa, Mycobacterium
EPLPRSLVWSAAWEMTREAELRA

SEQ ID NO: 1061152 - protein, 21 aa, Mycobacterium
EPRLSLQWWVRVESLAKAAGD

SEQ ID NO: 1061153 - protein, 18 aa, Mycobacterium
EPSRWGLSVDRLRYPVFS

SEQ ID NO: 1061154 - protein, 27 aa, Mycobacterium
EQEKLMAFCLAGALSFNLASPESDNNK

SEQ ID NO: 1061155 - protein, 21 aa, Mycobacterium
ERAELIDWLFGQGITAAEIRT

SEQ ID NO: 1061156 - protein, 20 aa, Mycobacterium
ERARCLVVALAACAAAGTVR

SEQ ID NO: 1061157 - protein, 21 aa, Mycobacterium
ERELPEWLAADVAILGEPTGG

SEQ ID NO: 1061158 - protein, 20 aa, Mycobacterium
ERERTVLVLRFFDSMTQTQI

SEQ ID NO: 1061159 - protein, 19 aa, Mycobacterium
ERFVRAMAAGAASYATAEA

SEQ ID NO: 1061160 - protein, 19 aa, Mycobacterium
ERGRGKLRRRKLRPAEHRG

SEQ ID NO: 1061161 - protein, 22 aa, Mycobacterium
ERPPRVPLSFAQSRVWFLEQLQ

SEQ ID NO: 1061162 - protein, 21 aa, Mycobacterium
ERPWWEWAATYERAFTAAYDA

SEQ ID NO: 1061163 - protein, 21 aa, Mycobacterium
ERRARRPAWRPAASIRSHSVH

SEQ ID NO: 1061164 - protein, 22 aa, Mycobacterium
ERRRFSMNYVFALYALPGPMTI

SEQ ID NO: 1061165 - protein, 17 aa, Mycobacterium
ERTMLWLGYANLLGELA

SEQ ID NO: 1061166 - protein, 17 aa, Mycobacterium
ESCDHFAHRGARRITLV

SEQ ID NO: 1061167 - protein, 28 aa, Mycobacterium
ESFFRGAGWNVIKVVWGREWDALLHADR

SEQ ID NO: 1061168 - protein, 19 aa, Mycobacterium
ESFLPRYLTTRVYAAMLES

SEQ ID NO: 1061169 - protein, 18 aa, Mycobacterium
ESHGRGAVNAGLAITTVT

SEQ ID NO: 1061170 - protein, 18 aa, Mycobacterium
ESLEEYWWCAEQMLTWPD

SEQ ID NO: 1061171 - protein, 23 aa, Mycobacterium
ESLPDDFILYWGFLATAQVLTGR

SEQ ID NO: 1061172 - protein, 18 aa, Mycobacterium
ESLPSASGSLAWTPLMTQ

SEQ ID NO: 1061173 - protein, 20 aa, Mycobacterium
ESLRARFGTLTGVERPVATG

SEQ ID NO: 1061174 - protein, 17 aa, Mycobacterium
ESLRLLAEEVMPRLNAR

SEQ ID NO: 1061175 - protein, 27 aa, Mycobacterium
ESRLTFLAVRRWFGWSAGRIINLDIGG

SEQ ID NO: 1061176 - protein, 17 aa, Mycobacterium
ETFRYSWGPAIAGLDTP

SEQ ID NO: 1061177 - protein, 20 aa, Mycobacterium
ETGPNFLGWTRPSTTTSTLT

SEQ ID NO: 1061178 - protein, 17 aa, Mycobacterium
ETIDWGRTVLALGLDTI

SEQ ID NO: 1061179 - protein, 29 aa, Mycobacterium
ETLGFFCGIGIPITEIWGMSELSCVATAS

SEQ ID NO: 1061180 - protein, 20 aa, Mycobacterium
ETVNGWFKRVYDLGLPLNIH

SEQ ID NO: 1061181 - protein, 25 aa, Mycobacterium
EVAPWLDLACKLGVLAAALSDEPPV

SEQ ID NO: 1061182 - protein, 22 aa, Mycobacterium
EVDRACAPWGLLGEDKQATLVA

SEQ ID NO: 1061183 - protein, 19 aa, Mycobacterium
EVFRALLALILIVLRRDTG

SEQ ID NO: 1061184 - protein, 17 aa, Mycobacterium
EVLPEFIERDAKAVADK

SEQ ID NO: 1061185 - protein, 22 aa, Mycobacterium
EVPMKRFDLMNGIQVRGTYAVS

SEQ ID NO: 1061186 - protein, 22 aa, Mycobacterium
EVSAAIAALFSVHGQTYQQLSA

SEQ ID NO: 1061187 - protein, 21 aa, Mycobacterium
EVSAAVATLFGTYGQTYQALA

SEQ ID NO: 1061188 - protein, 21 aa, Mycobacterium
EVSALIAGLFDAHAQAYQALS

SEQ ID NO: 1061189 - protein, 21 aa, Mycobacterium
EVSAVIAALFAAHGQAYQTLS

SEQ ID NO: 1061190 - protein, 19 aa, Mycobacterium
EVSGCLRVGKARNNSADTG

SEQ ID NO: 1061191 - protein, 17 aa, Mycobacterium
EVTEFFDVLPLMADNLY

SEQ ID NO: 1061192 - protein, 18 aa, Mycobacterium
EVVRALDMLFILHADHEQ

SEQ ID NO: 1061193 - protein, 19 aa, Mycobacterium
EVVSGLVSDIGWHAKVGTL

SEQ ID NO: 1061194 - protein, 19 aa, Mycobacterium
EVWPGRAYPLGATYDGMGT

SEQ ID NO: 1061195 - protein, 17 aa, Mycobacterium
EWRQAGCSMCLGMNPDQ

SEQ ID NO: 1061196 - protein, 18 aa, Mycobacterium
EWSPQCRWMHQFGPLRQG

SEQ ID NO: 1061197 - protein, 19 aa, Mycobacterium
EYEQMWALDVSTMATYHAG

SEQ ID NO: 1061198 - protein, 21 aa, Mycobacterium
EYGSRAGVWRVLRVCEQSGVP

SEQ ID NO: 1061199 - protein, 24 aa, Mycobacterium
FAAAFKPPMRWGVRMMGKKFLREY

SEQ ID NO: 1061200 - protein, 17 aa, Mycobacterium
FAAEAAFVFAMIAVDLS

SEQ ID NO: 1061201 - protein, 17 aa, Mycobacterium
FAAPGWVVSPGVVKALP

SEQ ID NO: 1061202 - protein, 19 aa, Mycobacterium
FADLIPWVKAHGDEHPELV

SEQ ID NO: 1061203 - protein, 17 aa, Mycobacterium
FAGAGGFGGFGGTGGQG

SEQ ID NO: 1061204 - protein, 17 aa, Mycobacterium
FAGCPICNLHLRSISGR

SEQ ID NO: 1061205 - protein, 24 aa, Mycobacterium
FAGFGGLGGEGGWVGNITLGPIGV

SEQ ID NO: 1061206 - protein, 19 aa, Mycobacterium
FAGSLWWRTVQEIGEEYPD

SEQ ID NO: 1061207 - protein, 19 aa, Mycobacterium
FAIGAVLSMHFAKQAAPFF

SEQ ID NO: 1061208 - protein, 17 aa, Mycobacterium
FALHCDIRIAAEDARFG

SEQ ID NO: 1061209 - protein, 17 aa, Mycobacterium
FAPFLWQEIEDGILPAL

SEQ ID NO: 1061210 - protein, 18 aa, Mycobacterium
FAPNFKDIVIRYITFAPY

SEQ ID NO: 1061211 - protein, 17 aa, Mycobacterium
FAQQMKILFPIFTSNDA

SEQ ID NO: 1061212 - protein, 18 aa, Mycobacterium
FAWKGESLEEYWWCAEQM

SEQ ID NO: 1061213 - protein, 17 aa, Mycobacterium
FAWRSCRAVKSNAIVIV

SEQ ID NO: 1061214 - protein, 17 aa, Mycobacterium
FCGTGAMSAMLGRNSYR

SEQ ID NO: 1061215 - protein, 25 aa, Mycobacterium
FCLAVEPWVQYGFNLASWAVGWVPW

SEQ ID NO: 1061216 - protein, 17 aa, Mycobacterium
FCLPPGGGISWAYRNLS

SEQ ID NO: 1061217 - protein, 22 aa, Mycobacterium
FDDGVFCALALPPAVGENEALM

SEQ ID NO: 1061218 - protein, 17 aa, Mycobacterium
FDFADGFATVTIVTTGT

SEQ ID NO: 1061219 - protein, 18 aa, Mycobacterium
FDGLRLAGRPVRRPDLTI

SEQ ID NO: 1061220 - protein, 18 aa, Mycobacterium
FDGRIITVPFSFKEIDDD

SEQ ID NO: 1061221 - protein, 19 aa, Mycobacterium
FDILRRWLMARGFDVAFIR

SEQ ID NO: 1061222 - protein, 19 aa, Mycobacterium
FDILRRWLMARGYDVAFIR

SEQ ID NO: 1061223 - protein, 29 aa, Mycobacterium
FDLPVGGWGQRPTAEFGYLACDAAVSDQD

SEQ ID NO: 1061224 - protein, 23 aa, Mycobacterium
FDNWPLGWGFDHFWGFPSGAAGQ

SEQ ID NO: 1061225 - protein, 19 aa, Mycobacterium
FDPLIFFRPRVQRLFDFHY

SEQ ID NO: 1061226 - protein, 17 aa, Mycobacterium
FDPRLGRTPLSRIWTQF

SEQ ID NO: 1061227 - protein, 22 aa, Mycobacterium
FDVGDRVGIAWLRYTCGVCNYC

SEQ ID NO: 1061228 - protein, 19 aa, Mycobacterium
FECCLRLGGAEVRDDEVFE

SEQ ID NO: 1061229 - protein, 17 aa, Mycobacterium
FEHARPTAIMTWMRQHC

SEQ ID NO: 1061230 - protein, 17 aa, Mycobacterium
FEHFPPPILKPVILAAK

SEQ ID NO: 1061231 - protein, 20 aa, Mycobacterium
FEVNEAFAPVVLAWAKDTGA

SEQ ID NO: 1061232 - protein, 18 aa, Mycobacterium
FFDVLPLMADNLYNAVDR

SEQ ID NO: 1061233 - protein, 17 aa, Mycobacterium
FFHRLGPVLARRVLLTG

SEQ ID NO: 1061234 - protein, 17 aa, Mycobacterium
FFPWGMVDQHFIKRGRF

SEQ ID NO: 1061235 - protein, 40 aa, Mycobacterium
FGAYAQEFQTLSARMEQFYTDCVRALLTGAGAYSGAEAAN

SEQ ID NO: 1061236 - protein, 17 aa, Mycobacterium
FGDGGADGSGAMSTGAD

SEQ ID NO: 1061237 - protein, 18 aa, Mycobacterium
FGRSGLRRNIRWDPLDSV

SEQ ID NO: 1061238 - protein, 17 aa, Mycobacterium
FGSGDPWAPMRAAVHRR

SEQ ID NO: 1061239 - protein, 18 aa, Mycobacterium
FGSSTAWNPLPRGWYPGP

SEQ ID NO: 1061240 - protein, 19 aa, Mycobacterium
FGTPPAANANFAWIQHILS

SEQ ID NO: 1061241 - protein, 17 aa, Mycobacterium
FGVCSTTIWARRVLAGA

SEQ ID NO: 1061242 - protein, 17 aa, Mycobacterium
FGVGAGWNIEELRDHGT

SEQ ID NO: 1061243 - protein, 18 aa, Mycobacterium
FGVPMGFGGPHAGYLSVH

SEQ ID NO: 1061244 - protein, 18 aa, Mycobacterium
FGYIPWGVFLPRTARLLA

SEQ ID NO: 1061245 - protein, 23 aa, Mycobacterium
FHCGDEVYGLIGFDRDGAAADYV

SEQ ID NO: 1061246 - protein, 23 aa, Mycobacterium
FHRGQDFVYHWALGDRLPADAGL

SEQ ID NO: 1061247 - protein, 19 aa, Mycobacterium
FHVYARIAPQWSFSQVRLA

SEQ ID NO: 1061248 - protein, 18 aa, Mycobacterium
FIHATGFLGGQITLQTTW

SEQ ID NO: 1061249 - protein, 20 aa, Mycobacterium
FIRDTTWVSVRWYKPGGALT

SEQ ID NO: 1061250 - protein, 17 aa, Mycobacterium
FKDAELLGMPWVVVVGR

SEQ ID NO: 1061251 - protein, 20 aa, Mycobacterium
FKLAAQTAVDWSRAWDDGRP

SEQ ID NO: 1061252 - protein, 23 aa, Mycobacterium
FKSEPWARLGVNVDADFEPLYII

SEQ ID NO: 1061253 - protein, 17 aa, Mycobacterium
FKTAVKFINWRTPGEGS

SEQ ID NO: 1061254 - protein, 19 aa, Mycobacterium
FKVPTVWLLLADDADIPRG

SEQ ID NO: 1061255 - protein, 19 aa, Mycobacterium
FLAMLRRFYELGVKELNGH

SEQ ID NO: 1061256 - protein, 18 aa, Mycobacterium
FLAPEDWNLPTGRFAGAT

SEQ ID NO: 1061257 - protein, 24 aa, Mycobacterium
FLDGARAYVRFAIGHPGHYAVMFD

SEQ ID NO: 1061258 - protein, 18 aa, Mycobacterium
FLDREGWDSLTINALATQ

SEQ ID NO: 1061259 - protein, 25 aa, Mycobacterium
FLGARFDAGLAWVHFPVGFGGLDLP

SEQ ID NO: 1061260 - protein, 17 aa, Mycobacterium
FLIGKLRDIREVVATAS

SEQ ID NO: 1061261 - protein, 23 aa, Mycobacterium
FLLPPEWVHKLVFAVLRGATAAT

SEQ ID NO: 1061262 - protein, 18 aa, Mycobacterium
FLLPRGMAIVASRGAQKQ

SEQ ID NO: 1061263 - protein, 18 aa, Mycobacterium
FLTELPYLGQALLLGIPG

SEQ ID NO: 1061264 - protein, 18 aa, Mycobacterium
FMARYVLHNGFLESDKLA

SEQ ID NO: 1061265 - protein, 18 aa, Mycobacterium
FMGGFALWVDEQRRLHHT

SEQ ID NO: 1061266 - protein, 17 aa, Mycobacterium
FMQRLNSVLPLWLQYGG

SEQ ID NO: 1061267 - protein, 17 aa, Mycobacterium
FNAVFGVGGGSAIANGA

SEQ ID NO: 1061268 - protein, 17 aa, Mycobacterium
FNGWKALGWMDANVWRH

SEQ ID NO: 1061269 - protein, 18 aa, Mycobacterium
FNKFNIPINIARVFHRDQ

SEQ ID NO: 1061270 - protein, 21 aa, Mycobacterium
FPASYWRRWSICKSVVLRVEL

SEQ ID NO: 1061271 - protein, 20 aa, Mycobacterium
FPEPRCRVVTAVGPYDPGER

SEQ ID NO: 1061272 - protein, 21 aa, Mycobacterium
FPFSLVFARLYAARGYHVVLQ

SEQ ID NO: 1061273 - protein, 22 aa, Mycobacterium
FPHLPWPWSLVDFALLPITWAS

SEQ ID NO: 1061274 - protein, 19 aa, Mycobacterium
FPNLFATHRVRAVDDYPSH

SEQ ID NO: 1061275 - protein, 17 aa, Mycobacterium
FPPAPAHSASRTTASVG

SEQ ID NO: 1061276 - protein, 21 aa, Mycobacterium
FPPVELFMQLPWRTEIIQGLL

SEQ ID NO: 1061277 - protein, 23 aa, Mycobacterium
FPQSFGFSSLGGWLATRAAGGHF

SEQ ID NO: 1061278 - protein, 17 aa, Mycobacterium
FPTKEAVLFQDYENQLE

SEQ ID NO: 1061279 - protein, 18 aa, Mycobacterium
FQRRACAALEGGHGVLVC

SEQ ID NO: 1061280 - protein, 22 aa, Mycobacterium
FQVPEFRRKAVIIAVGGVYDPR

SEQ ID NO: 1061281 - protein, 25 aa, Mycobacterium
FQWLTEMYPVWGRLDAELEFAAASA

SEQ ID NO: 1061282 - protein, 19 aa, Mycobacterium
FRASVCVLGPLVGRCKRAK

SEQ ID NO: 1061283 - protein, 17 aa, Mycobacterium
FRFVEEMIRLGADALTD

SEQ ID NO: 1061284 - protein, 18 aa, Mycobacterium
FRHFPTKEAVLFQDYENQ

SEQ ID NO: 1061285 - protein, 22 aa, Mycobacterium
FRLLPRRTMRGLIGRICEQEGV

SEQ ID NO: 1061286 - protein, 20 aa, Mycobacterium
FRLLVLRTAWLIDKHHDYQK

SEQ ID NO: 1061287 - protein, 24 aa, Mycobacterium
FRPEVSDGLFLRLAVTSVDSLACA

SEQ ID NO: 1061288 - protein, 17 aa, Mycobacterium
FRRVITMLKHWNRRQPV

SEQ ID NO: 1061289 - protein, 17 aa, Mycobacterium
FRYGAMFGVEVQFWVFE

SEQ ID NO: 1061290 - protein, 17 aa, Mycobacterium
FRYSWGPAIAGLDTPTT

SEQ ID NO: 1061291 - protein, 20 aa, Mycobacterium
FRYVMMVLRHIPRSIFRRLP

SEQ ID NO: 1061292 - protein, 17 aa, Mycobacterium
FSAAFTFQYSKRPGTPA

SEQ ID NO: 1061293 - protein, 18 aa, Mycobacterium
FSALCWGERIAFDNPDSS

SEQ ID NO: 1061294 - protein, 17 aa, Mycobacterium
FSALYAKALALGFDVVV

SEQ ID NO: 1061295 - protein, 17 aa, Mycobacterium
FSATCYEWAILDLAILA

SEQ ID NO: 1061296 - protein, 24 aa, Mycobacterium
FSGRARLSSVLWTFTVTKQDGVVC

SEQ ID NO: 1061297 - protein, 17 aa, Mycobacterium
FSSHARAYQALSVQAGQ

SEQ ID NO: 1061298 - protein, 18 aa, Mycobacterium
FSTYATWWIRQAITRAMA

SEQ ID NO: 1061299 - protein, 19 aa, Mycobacterium
FSVWELWGPLLYGGCVVMV

SEQ ID NO: 1061300 - protein, 25 aa, Mycobacterium
FTELCARAGLDLALDRAPALADVDP

SEQ ID NO: 1061301 - protein, 17 aa, Mycobacterium
FTFGTGNIIAGVGGGGG

SEQ ID NO: 1061302 - protein, 24 aa, Mycobacterium
FTFRIAQTVGWRLWMGVAFGLTSD

SEQ ID NO: 1061303 - protein, 18 aa, Mycobacterium
FTLPFAMVETFGWTTIVD

SEQ ID NO: 1061304 - protein, 17 aa, Mycobacterium
FTPALADLVRRGVVTGR

SEQ ID NO: 1061305 - protein, 17 aa, Mycobacterium
FTVLMDREWKYGVAAAV

SEQ ID NO: 1061306 - protein, 22 aa, Mycobacterium
FTVPEFRRKAVIIAVGGIYDPR

SEQ ID NO: 1061307 - protein, 18 aa, Mycobacterium
FTVPKLRAGDQVGAAVQL

SEQ ID NO: 1061308 - protein, 19 aa, Mycobacterium
FTYRFSVPNAGTYWAHPHV

SEQ ID NO: 1061309 - protein, 24 aa, Mycobacterium
FTYRPEYRGALQLVPGAQTIALAP

SEQ ID NO: 1061310 - protein, 19 aa, Mycobacterium
FVAAESFIAIDLLPPEIVA

SEQ ID NO: 1061311 - protein, 17 aa, Mycobacterium
FWAFDLLFLDGRSLLRA

SEQ ID NO: 1061312 - protein, 24 aa, Mycobacterium
FWASWCGPCRALAPTFQASSEAHP

SEQ ID NO: 1061313 - protein, 24 aa, Mycobacterium
FWASYCRPCHAFAPTYERSAQTHP

SEQ ID NO: 1061314 - protein, 20 aa, Mycobacterium
FWQREFDILVCTTIVETGLD

SEQ ID NO: 1061315 - protein, 18 aa, Mycobacterium
FYLMRAIDGWSPMDGGWP

SEQ ID NO: 1061316 - protein, 23 aa, Mycobacterium
FYPDMPSRFAVIPRRGSTADIRW

SEQ ID NO: 1061317 - protein, 19 aa, Mycobacterium
GAAAAWCGLASELRAAAES

SEQ ID NO: 1061318 - protein, 22 aa, Mycobacterium
GAADGDGGILIGNGGNGGSGAV

SEQ ID NO: 1061319 - protein, 17 aa, Mycobacterium
GAAEAWISLAEQLMEAA

SEQ ID NO: 1061320 - protein, 17 aa, Mycobacterium
GAAGCWRIEAGTYTVAV

SEQ ID NO: 1061321 - protein, 25 aa, Mycobacterium
GAAKWSLKIAREWSGERVQWGKPLG

SEQ ID NO: 1061322 - protein, 18 aa, Mycobacterium
GAALPFKRRLFGQIVAAA

SEQ ID NO: 1061323 - protein, 23 aa, Mycobacterium
GAATRFRVKWGYCCAVCSVWPGS

SEQ ID NO: 1061324 - protein, 18 aa, Mycobacterium
GAAYACFTPSPSLGIPAL

SEQ ID NO: 1061325 - protein, 18 aa, Mycobacterium
GACAMGADSFAAVNDVTG

SEQ ID NO: 1061326 - protein, 18 aa, Mycobacterium
GACRQCLVEVEGQRKPLA

SEQ ID NO: 1061327 - protein, 23 aa, Mycobacterium
GADALASIMSWQGWEQMFESARF

SEQ ID NO: 1061328 - protein, 20 aa, Mycobacterium
GADLQQCWRQYVAGEVTEYP

SEQ ID NO: 1061329 - protein, 18 aa, Mycobacterium
GAGAMRGNGGNGGSAGTG

SEQ ID NO: 1061330 - protein, 21 aa, Mycobacterium
GAGGAHHFLLGTGGAGGVGGA

SEQ ID NO: 1061331 - protein, 18 aa, Mycobacterium
GAGGFLWGNGGNGGSGAA

SEQ ID NO: 1061332 - protein, 18 aa, Mycobacterium
GAGGKGGLLFGAGGEGGA

SEQ ID NO: 1061333 - protein, 25 aa, Mycobacterium
GAGGMGGSGGWLLGNGGAGGAGGVG

SEQ ID NO: 1061334 - protein, 23 aa, Mycobacterium
GAGGNGGDAYVFGNGQPGGSGGA

SEQ ID NO: 1061335 - protein, 21 aa, Mycobacterium
GAGGNGGFLFGHGGDGGTGGT

SEQ ID NO: 1061336 - protein, 21 aa, Mycobacterium
GAGGPGLFGFNGGAGGAGGLL

SEQ ID NO: 1061337 - protein, 23 aa, Mycobacterium
GAGGRAGLVIGNGGAGGAGGESF

SEQ ID NO: 1061338 - protein, 21 aa, Mycobacterium
GAGGTGGWLFGDGGAGGTGGA

SEQ ID NO: 1061339 - protein, 17 aa, Mycobacterium
GAGGWLIGNGGAGGSGA

SEQ ID NO: 1061340 - protein, 17 aa, Mycobacterium
GAGLDWKTSLQELTASR

SEQ ID NO: 1061341 - protein, 18 aa, Mycobacterium
GAGPLRLFGHRRVSNAHL

SEQ ID NO: 1061342 - protein, 25 aa, Mycobacterium
GAGSEPMLLAARGWSELSAELQSAA

SEQ ID NO: 1061343 - protein, 17 aa, Mycobacterium
GAHCQEFQVVSAQLRGF

SEQ ID NO: 1061344 - protein, 21 aa, Mycobacterium
GAHLRGRRKPVLVRHRLLQSP

SEQ ID NO: 1061345 - protein, 18 aa, Mycobacterium
GAKFAAVFARRGLIAEFG

SEQ ID NO: 1061346 - protein, 23 aa, Mycobacterium
GALKNVFAIAVGMGYSLGIGENP

SEQ ID NO: 1061347 - protein, 19 aa, Mycobacterium
GALSSWYVWAALGLYPITA

SEQ ID NO: 1061348 - protein, 25 aa, Mycobacterium
GAMGGAVTVPVNFLAHAGSDGGIGT

SEQ ID NO: 1061349 - protein, 17 aa, Mycobacterium
GAMGRLGVWSGDGPQLD

SEQ ID NO: 1061350 - protein, 19 aa, Mycobacterium
GANPCRRAQRRVRPLPAGL

SEQ ID NO: 1061351 - protein, 20 aa, Mycobacterium
GAPAPFGSGGAYGGTGGHGG

SEQ ID NO: 1061352 - protein, 23 aa, Mycobacterium
GARARFGDVLPFLVKVLAADEPL

SEQ ID NO: 1061353 - protein, 18 aa, Mycobacterium
GARFAFVCAVDMPGLTVD

SEQ ID NO: 1061354 - protein, 22 aa, Mycobacterium
GARSPRPATVWIAQDGSHRLVR

SEQ ID NO: 1061355 - protein, 24 aa, Mycobacterium
GASPRFLLDFSRRFPDATLVRLER

SEQ ID NO: 1061356 - protein, 19 aa, Mycobacterium
GATAWRAVVEYADTAGDRA

SEQ ID NO: 1061357 - protein, 18 aa, Mycobacterium
GATIPIIAGFPFPLAVEI

SEQ ID NO: 1061358 - protein, 18 aa, Mycobacterium
GAWAGLKPPELAAVVSCV

SEQ ID NO: 1061359 - protein, 19 aa, Mycobacterium
GCAGLRYNLFFDDRALDGD

SEQ ID NO: 1061360 - protein, 19 aa, Mycobacterium
GCAGLRYNLFFDDRTLDGD

SEQ ID NO: 1061361 - protein, 20 aa, Mycobacterium
GCGMACPFCATGQGGLTRNL

SEQ ID NO: 1061362 - protein, 21 aa, Mycobacterium
GCPAKACLHWGAMWGPASDAH

SEQ ID NO: 1061363 - protein, 21 aa, Mycobacterium
GCPYRCTFCGTGAMSAMLGRN

SEQ ID NO: 1061364 - protein, 17 aa, Mycobacterium
GCRQCGRLGYRHSSTLT

SEQ ID NO: 1061365 - protein, 22 aa, Mycobacterium
GCSKVGLPLVRRALELLPDVGF

SEQ ID NO: 1061366 - protein, 17 aa, Mycobacterium
GDARGGAALSVREVTGV

SEQ ID NO: 1061367 - protein, 19 aa, Mycobacterium
GDCLFPGGVGKTWQPGDFT

SEQ ID NO: 1061368 - protein, 24 aa, Mycobacterium
GDEISAAVAACFEAQAEAYRTFGA

SEQ ID NO: 1061369 - protein, 19 aa, Mycobacterium
GDFPWRPEPGYGRTSPVGS

SEQ ID NO: 1061370 - protein, 25 aa, Mycobacterium
GDGSRGDTPLGPFNVDGHSGGDGGR

SEQ ID NO: 1061371 - protein, 17 aa, Mycobacterium
GDGVIYWQVPKGATLDS

SEQ ID NO: 1061372 - protein, 23 aa, Mycobacterium
GDIWDWAVDWDTWVGMSALLSFP

SEQ ID NO: 1061373 - protein, 19 aa, Mycobacterium
GDKGQPCWPDGVVGSLTHC

SEQ ID NO: 1061374 - protein, 18 aa, Mycobacterium
GDLAYRDSQGWIYLAPAA

SEQ ID NO: 1061375 - protein, 17 aa, Mycobacterium
GDPAWRAAADDVIAKDA

SEQ ID NO: 1061376 - protein, 22 aa, Mycobacterium
GDPRLPEWRLMAARAVARRDEL

SEQ ID NO: 1061377 - protein, 17 aa, Mycobacterium
GDRCFKPTLARRMAQLF

SEQ ID NO: 1061378 - protein, 17 aa, Mycobacterium
GDRMAWRVLATGECEKL

SEQ ID NO: 1061379 - protein, 19 aa, Mycobacterium
GDSRFPPAPAHSASRTTAS

SEQ ID NO: 1061380 - protein, 24 aa, Mycobacterium
GDYFKRGAIELAWALLTNSVADGG

SEQ ID NO: 1061381 - protein, 18 aa, Mycobacterium
GEELWRFVDKLAGRIASY

SEQ ID NO: 1061382 - protein, 17 aa, Mycobacterium
GEFSEPFIQLWDPAYTY

SEQ ID NO: 1061383 - protein, 20 aa, Mycobacterium
GEGSGRLFGLGGAGGAGGTG

SEQ ID NO: 1061384 - protein, 19 aa, Mycobacterium
GEHPSLCLLASWVSPGSPA

SEQ ID NO: 1061385 - protein, 17 aa, Mycobacterium
GEIPVLLARTGYTREDG

SEQ ID NO: 1061386 - protein, 17 aa, Mycobacterium
GEITAEMAFIAAREGMS

SEQ ID NO: 1061387 - protein, 17 aa, Mycobacterium
GEIYFEGGYSFEYLNDP

SEQ ID NO: 1061388 - protein, 17 aa, Mycobacterium
GELCAPGSRIAVGALGS

SEQ ID NO: 1061389 - protein, 20 aa, Mycobacterium
GELICAAIVFAGPPQTPQTL

SEQ ID NO: 1061390 - protein, 23 aa, Mycobacterium
GELIRLAGVLGCSLGRDRAEELA

SEQ ID NO: 1061391 - protein, 18 aa, Mycobacterium
GELLRLGSVLGIELGPDR

SEQ ID NO: 1061392 - protein, 19 aa, Mycobacterium
GELVSRLGAQRVIDTRTEA

SEQ ID NO: 1061393 - protein, 23 aa, Mycobacterium
GELYGRRELLAAMPPFLTGGSMI

SEQ ID NO: 1061394 - protein, 17 aa, Mycobacterium
GEMVLAGYGFRTDPRSH

SEQ ID NO: 1061395 - protein, 22 aa, Mycobacterium
GEPRLRLLGFERVELEPGQSCA

SEQ ID NO: 1061396 - protein, 20 aa, Mycobacterium
GEPRWPTFGIRLSARPGIPP

SEQ ID NO: 1061397 - protein, 17 aa, Mycobacterium
GEPWRNGYVESFSSRIR

SEQ ID NO: 1061398 - protein, 17 aa, Mycobacterium
GETLTTLIWRTEPGKAV

SEQ ID NO: 1061399 - protein, 18 aa, Mycobacterium
GEVVEMSFVITAPEALTA

SEQ ID NO: 1061400 - protein, 18 aa, Mycobacterium
GFFLPLAGSLGVMFGVCG

SEQ ID NO: 1061401 - protein, 18 aa, Mycobacterium
GFGGNGGLLFGKAGADGP

SEQ ID NO: 1061402 - protein, 18 aa, Mycobacterium
GFGKRWVTECLRDAYPLG

SEQ ID NO: 1061403 - protein, 28 aa, Mycobacterium
GFGKRWVTECLRDAYPLGRGHGPVSPLF

SEQ ID NO: 1061404 - protein, 17 aa, Mycobacterium
GFLGRYLALEWLERMDL

SEQ ID NO: 1061405 - protein, 21 aa, Mycobacterium
GFLLTFLACFDVGDRVALASP

SEQ ID NO: 1061406 - protein, 18 aa, Mycobacterium
GFPDGCFQTLLVSASAVE

SEQ ID NO: 1061407 - protein, 17 aa, Mycobacterium
GFRAEMGVDLNAEIFNG

SEQ ID NO: 1061408 - protein, 18 aa, Mycobacterium
GFRMPSVWLAEGHSRMAP

SEQ ID NO: 1061409 - protein, 19 aa, Mycobacterium
GFSPLRLPPELDFATLFHG

SEQ ID NO: 1061410 - protein, 18 aa, Mycobacterium
GFVPRRFRLLLVAVGARK

SEQ ID NO: 1061411 - protein, 19 aa, Mycobacterium
GGAAGWWGAGGAGGQGGTG

SEQ ID NO: 1061412 - protein, 20 aa, Mycobacterium
GGAGGFGGIGLNGSGGDGGH

SEQ ID NO: 1061413 - protein, 19 aa, Mycobacterium
GGAGGLWGGGGIGGTGGFG

SEQ ID NO: 1061414 - protein, 20 aa, Mycobacterium
GGAGGRAGLAIGGGGAGGAG

SEQ ID NO: 1061415 - protein, 24 aa, Mycobacterium
GGAGGRGGLLIGLGGNGGTGGFSG

SEQ ID NO: 1061416 - protein, 22 aa, Mycobacterium
GGAGGRGGLLLGDGGAGAPGAA

SEQ ID NO: 1061417 - protein, 24 aa, Mycobacterium
GGAGGRGGLVFGDGGAGGAGGAGA

SEQ ID NO: 1061418 - protein, 22 aa, Mycobacterium
GGAGGRGGWLFGDAGAGGQGGL

SEQ ID NO: 1061419 - protein, 17 aa, Mycobacterium
GGAGGRGGYLIGSGGNG

SEQ ID NO: 1061420 - protein, 23 aa, Mycobacterium
GGAGGSVGLWGHGGNGGIGGAGG

SEQ ID NO: 1061421 - protein, 18 aa, Mycobacterium
GGAGGWLLGDGGGGGGGA

SEQ ID NO: 1061422 - protein, 18 aa, Mycobacterium
GGAGGWLLGNGGAGGAGG

SEQ ID NO: 1061423 - protein, 21 aa, Mycobacterium
GGAGHDGHIGGGAGGTGGAGG

SEQ ID NO: 1061424 - protein, 22 aa, Mycobacterium
GGALPPPFNIVGKLSGPGVSMA

SEQ ID NO: 1061425 - protein, 20 aa, Mycobacterium
GGAMQLRYISVPALVAYAGG

SEQ ID NO: 1061426 - protein, 19 aa, Mycobacterium
GGAPPRWVGYSAPKPKTVV

SEQ ID NO: 1061427 - protein, 22 aa, Mycobacterium
GGDAGGMFGVRGLFGTGGAGGT

SEQ ID NO: 1061428 - protein, 20 aa, Mycobacterium
GGDGGHWGDGGGPGSGSRRG

SEQ ID NO: 1061429 - protein, 20 aa, Mycobacterium
GGDGGLLFGRGGAGGAGGFG

SEQ ID NO: 1061430 - protein, 19 aa, Mycobacterium
GGDGGRGGLLIGSGGNGGT

SEQ ID NO: 1061431 - protein, 18 aa, Mycobacterium
GGFELSYRLLSYPKPVVI

SEQ ID NO: 1061432 - protein, 17 aa, Mycobacterium
GGFGLGVVGGHGGDGGN

SEQ ID NO: 1061433 - protein, 26 aa, Mycobacterium
GGGAGGRGGLLFGVGGAGGAGGDGLD

SEQ ID NO: 1061434 - protein, 19 aa, Mycobacterium
GGGTFTPRTWVALATEYFL

SEQ ID NO: 1061435 - protein, 19 aa, Mycobacterium
GGGTGWFGSTGITGAGGNG

SEQ ID NO: 1061436 - protein, 19 aa, Mycobacterium
GGIRAGHQLKFWTPGGSST

SEQ ID NO: 1061437 - protein, 17 aa, Mycobacterium
GGIRGPIGLGYRVPGIV

SEQ ID NO: 1061438 - protein, 17 aa, Mycobacterium
GGLAMKWRWRQKVGKDW

SEQ ID NO: 1061439 - protein, 18 aa, Mycobacterium
GGLFGVLTNVVWTNRGPC

SEQ ID NO: 1061440 - protein, 23 aa, Mycobacterium
GGLGGRVGFLFGDGGLGGQGGDG

SEQ ID NO: 1061441 - protein, 17 aa, Mycobacterium
GGLPMMPMMGGIPSMGG

SEQ ID NO: 1061442 - protein, 17 aa, Mycobacterium
GGLRRFLDELGELPDKS

SEQ ID NO: 1061443 - protein, 23 aa, Mycobacterium
GGNGGAGGWLFGNGGTGGTGGDA

SEQ ID NO: 1061444 - protein, 17 aa, Mycobacterium
GGNGGDGGWLFGSGGNG

SEQ ID NO: 1061445 - protein, 25 aa, Mycobacterium
GGNGGNASSVFGFGGNGGAAGTGGA

SEQ ID NO: 1061446 - protein, 25 aa, Mycobacterium
GGNGGRAALLIGFGGNGGNGGVGTA

SEQ ID NO: 1061447 - protein, 24 aa, Mycobacterium
GGNGGRAGLFFGVGGTGGNGGATS

SEQ ID NO: 1061448 - protein, 19 aa, Mycobacterium
GGNGGRGGILVGDGGIGGT

SEQ ID NO: 1061449 - protein, 18 aa, Mycobacterium
GGNGGWLYGDGGAGGQGG

SEQ ID NO: 1061450 - protein, 19 aa, Mycobacterium
GGPFLSFGQVYAYVQNAQG

SEQ ID NO: 1061451 - protein, 20 aa, Mycobacterium
GGPLTWPLHISLMLAKEYAL

SEQ ID NO: 1061452 - protein, 20 aa, Mycobacterium
GGPSTWRLGGAINCGKAQPG

SEQ ID NO: 1061453 - protein, 22 aa, Mycobacterium
GGQGGAAAWLFGSGGTGGAGGF

SEQ ID NO: 1061454 - protein, 17 aa, Mycobacterium
GGRAALVLGDWPDAHDH

SEQ ID NO: 1061455 - protein, 20 aa, Mycobacterium
GGSAGLWGAGGAGGAGGAGA

SEQ ID NO: 1061456 - protein, 18 aa, Mycobacterium
GGSAGLWGRGGNGGAGGA

SEQ ID NO: 1061457 - protein, 25 aa, Mycobacterium
GGSGGRAALLYGVGRDGGAGGAGGD

SEQ ID NO: 1061458 - protein, 24 aa, Mycobacterium
GGSPAWNLPVVFGPIAVTYNISGV

SEQ ID NO: 1061459 - protein, 26 aa, Mycobacterium
GGTAINYGAGDAFGGAAGKGGTGVVG

SEQ ID NO: 1061460 - protein, 17 aa, Mycobacterium
GGTCNRAAPSGATLAPS

SEQ ID NO: 1061461 - protein, 18 aa, Mycobacterium
GGTGAWLLGNGGAGGSGG

SEQ ID NO: 1061462 - protein, 22 aa, Mycobacterium
GGTGGAGGWLFGDGGIGGTGGA

SEQ ID NO: 1061463 - protein, 21 aa, Mycobacterium
GGTGGRAGLLIGNAGAGGAGG

SEQ ID NO: 1061464 - protein, 23 aa, Mycobacterium
GGTGQGGISFLAPGGQTGGDGST

SEQ ID NO: 1061465 - protein, 25 aa, Mycobacterium
GGTRLSDRVLLRFGLHQALRLGKPL

SEQ ID NO: 1061466 - protein, 22 aa, Mycobacterium
GGVGGGGGWLFGDGGVGGIGGN

SEQ ID NO: 1061467 - protein, 24 aa, Mycobacterium
GGVGGRGGGAWAQSPTGTPNVTGG

SEQ ID NO: 1061468 - protein, 24 aa, Mycobacterium
GGVGGRGGLVYGNGGVGGAGGQGA

SEQ ID NO: 1061469 - protein, 17 aa, Mycobacterium
GGVGGWGVLAAAGGKGG

SEQ ID NO: 1061470 - protein, 17 aa, Mycobacterium
GGWLMGTGGAGGFSGAG

SEQ ID NO: 1061471 - protein, 20 aa, Mycobacterium
GGWYEHEWRAYGYGFPSAGV

SEQ ID NO: 1061472 - protein, 23 aa, Mycobacterium
GHDTFCPVGPWIVTDVDPAGLEL

SEQ ID NO: 1061473 - protein, 20 aa, Mycobacterium
GHGKVALLLGHILADRGDQV

SEQ ID NO: 1061474 - protein, 17 aa, Mycobacterium
GHIARMFSLVFGGDSTD

SEQ ID NO: 1061475 - protein, 17 aa, Mycobacterium
GHIERFENFHGFEVAGQ

SEQ ID NO: 1061476 - protein, 22 aa, Mycobacterium
GHIYRQGAGFTMETQHYPASPN

SEQ ID NO: 1061477 - protein, 25 aa, Mycobacterium
GHLHCPFNRMCEVVRRNDRRSAINA

SEQ ID NO: 1061478 - protein, 20 aa, Mycobacterium
GHLPEGLGIIGLLIDEPKPL

SEQ ID NO: 1061479 - protein, 18 aa, Mycobacterium
GHPLWECYIIDGIEGGRI

SEQ ID NO: 1061480 - protein, 17 aa, Mycobacterium
GHPRFLVPHIVASAPKV

SEQ ID NO: 1061481 - protein, 22 aa, Mycobacterium
GHSMGALVAFEFVRLAEANGID

SEQ ID NO: 1061482 - protein, 17 aa, Mycobacterium
GIAAARFHDEFVGNLRA

SEQ ID NO: 1061483 - protein, 18 aa, Mycobacterium
GIAHLPVRVRDGTGLVGP

SEQ ID NO: 1061484 - protein, 19 aa, Mycobacterium
GIDTEVWFPAGPVGTASVL

SEQ ID NO: 1061485 - protein, 18 aa, Mycobacterium
GIDVLWRKLAELAAPTDT

SEQ ID NO: 1061486 - protein, 19 aa, Mycobacterium
GIDWCKRHLEVLGAGYQLS

SEQ ID NO: 1061487 - protein, 20 aa, Mycobacterium
GIHVFLRIASDWDFIEVRRA

SEQ ID NO: 1061488 - protein, 18 aa, Mycobacterium
GILFSHAGADGSTGAPGA

SEQ ID NO: 1061489 - protein, 24 aa, Mycobacterium
GIRGFEVLEALPFDERRLRQALNA

SEQ ID NO: 1061490 - protein, 23 aa, Mycobacterium
GISRLRFRLRWRGYRLTVDANHS

SEQ ID NO: 1061491 - protein, 25 aa, Mycobacterium
GIVRLRPGLQLLRCRRGAERRVRSS

SEQ ID NO: 1061492 - protein, 20 aa, Mycobacterium
GIYQPGWKWSVHVGPTTGRA

SEQ ID NO: 1061493 - protein, 20 aa, Mycobacterium
GKFLNNWRMAELHAKEAPDR

SEQ ID NO: 1061494 - protein, 17 aa, Mycobacterium
GKGGLLFGAGGEGGAGG

SEQ ID NO: 1061495 - protein, 17 aa, Mycobacterium
GKKAVVFDDRWASARED

SEQ ID NO: 1061496 - protein, 18 aa, Mycobacterium
GKLLRYGAEFETLRDRSD

SEQ ID NO: 1061497 - protein, 20 aa, Mycobacterium
GKLPRLSKRLGVLTRTNSES

SEQ ID NO: 1061498 - protein, 21 aa, Mycobacterium
GKPLAGPGWYYPPTVITDITK

SEQ ID NO: 1061499 - protein, 18 aa, Mycobacterium
GKPSRPTPIGSFTALSKE

SEQ ID NO: 1061500 - protein, 17 aa, Mycobacterium
GKTPAQVLLRWNLQLGN

SEQ ID NO: 1061501 - protein, 21 aa, Mycobacterium
GKTVCARAAAATGAASTGVAL

SEQ ID NO: 1061502 - protein, 17 aa, Mycobacterium
GKWPWQMTHQMDGAAQI

SEQ ID NO: 1061503 - protein, 23 aa, Mycobacterium
GKYNARCGRTFVLPTEQGAYDAC

SEQ ID NO: 1061504 - protein, 21 aa, Mycobacterium
GLAAWGYRRYRICRPRRCCRK

SEQ ID NO: 1061505 - protein, 19 aa, Mycobacterium
GLAAWRLGAGRSRPGARVQ

SEQ ID NO: 1061506 - protein, 17 aa, Mycobacterium
GLAGLRVGYAVGQPDVI

SEQ ID NO: 1061507 - protein, 19 aa, Mycobacterium
GLEFPVVFVTGWEDGMFPH

SEQ ID NO: 1061508 - protein, 21 aa, Mycobacterium
GLGGLGLVVARWLVDSGAGRV

SEQ ID NO: 1061509 - protein, 17 aa, Mycobacterium
GLGGMLFGTGGSGGAGG

SEQ ID NO: 1061510 - protein, 21 aa, Mycobacterium
GLGTFSWPGAYGTWWQADPGA

SEQ ID NO: 1061511 - protein, 17 aa, Mycobacterium
GLIGCAFGNLAEVMAGV

SEQ ID NO: 1061512 - protein, 25 aa, Mycobacterium
GLLRLPERIPYAIAMELALTGDNLS

SEQ ID NO: 1061513 - protein, 19 aa, Mycobacterium
GLLSEWRATLIVRESACLD

SEQ ID NO: 1061514 - protein, 18 aa, Mycobacterium
GLMHVRFGPYHVRDVKFV

SEQ ID NO: 1061515 - protein, 24 aa, Mycobacterium
GLPLPIIAGNLFRFELLRTRHDLR

SEQ ID NO: 1061516 - protein, 17 aa, Mycobacterium
GLPRGGVPVAFEVAKAL

SEQ ID NO: 1061517 - protein, 19 aa, Mycobacterium
GLRLRLPIIGTDLGTFDTA

SEQ ID NO: 1061518 - protein, 25 aa, Mycobacterium
GLSVDRLRYPVFSWQRITLQEMTHM

SEQ ID NO: 1061519 - protein, 20 aa, Mycobacterium
GLTRRLPTLTVRVIEDQTER

SEQ ID NO: 1061520 - protein, 18 aa, Mycobacterium
GMFRDWHALALGDGNAFL

SEQ ID NO: 1061521 - protein, 21 aa, Mycobacterium
GMIPLCYDWLCGMVVSTAGIP

SEQ ID NO: 1061522 - protein, 20 aa, Mycobacterium
GMLRATWLVLRKHTDVLHVH

SEQ ID NO: 1061523 - protein, 18 aa, Mycobacterium
GMYELEFPAPQLSTSDGR

SEQ ID NO: 1061524 - protein, 21 aa, Mycobacterium
GNATDLMIGNGGNGGTGGSGA

SEQ ID NO: 1061525 - protein, 17 aa, Mycobacterium
GNCPLWVIHQAFARPGQ

SEQ ID NO: 1061526 - protein, 18 aa, Mycobacterium
GNELPLVAGMAFSIEPGI

SEQ ID NO: 1061527 - protein, 26 aa, Mycobacterium
GNGGADGSGGWLFGAGGVGGAGGVGG

SEQ ID NO: 1061528 - protein, 18 aa, Mycobacterium
GNGGGLFNIGRGGDGGNG

SEQ ID NO: 1061529 - protein, 20 aa, Mycobacterium
GNGGNVFNNFYNHVTNTGYS

SEQ ID NO: 1061530 - protein, 22 aa, Mycobacterium
GNGGRGDMLFTVGGSGGTGGDG

SEQ ID NO: 1061531 - protein, 26 aa, Mycobacterium
GNGPAGGAAGCWGRGGIGGQGGTGGE

SEQ ID NO: 1061532 - protein, 17 aa, Mycobacterium
GNIARITAIGGGTVTSS

SEQ ID NO: 1061533 - protein, 18 aa, Mycobacterium
GNLRARFNIALGIGSSGF

SEQ ID NO: 1061534 - protein, 19 aa, Mycobacterium
GNRPSQCVLVIIPTFNELE

SEQ ID NO: 1061535 - protein, 17 aa, Mycobacterium
GNSRAPGLLGLYDDTVD

SEQ ID NO: 1061536 - protein, 20 aa, Mycobacterium
GNSWPMARLTLALSPATLPK

SEQ ID NO: 1061537 - protein, 19 aa, Mycobacterium
GNTEWPKWEAVMAADPLDP

SEQ ID NO: 1061538 - protein, 24 aa, Mycobacterium
GNWAWRYDGIRAFPDFAVLWDVDA

SEQ ID NO: 1061539 - protein, 17 aa, Mycobacterium
GPCRAAGTSDLTFASGW

SEQ ID NO: 1061540 - protein, 23 aa, Mycobacterium
GPDGKRWRCAVGDLAAGFDELAG

SEQ ID NO: 1061541 - protein, 19 aa, Mycobacterium
GPEFRRFALSSGVEARHTA

SEQ ID NO: 1061542 - protein, 17 aa, Mycobacterium
GPFRIAMAAGIPIVPIV

SEQ ID NO: 1061543 - protein, 18 aa, Mycobacterium
GPGGWIFGTGGAGGNGGL

SEQ ID NO: 1061544 - protein, 18 aa, Mycobacterium
GPGQRVALVFGRCAQAVT

SEQ ID NO: 1061545 - protein, 23 aa, Mycobacterium
GPGQWCTLGLFAARDEPSLRKLL

SEQ ID NO: 1061546 - protein, 19 aa, Mycobacterium
GPKTLRSAAPWADGLAGTT

SEQ ID NO: 1061547 - protein, 19 aa, Mycobacterium
GPLRYAGWSSCFRREAGSY

SEQ ID NO: 1061548 - protein, 18 aa, Mycobacterium
GPPPLWWAQRFGIQPDLA

SEQ ID NO: 1061549 - protein, 21 aa, Mycobacterium
GPRPRLARPLSWGRAAPADTG

SEQ ID NO: 1061550 - protein, 18 aa, Mycobacterium
GPRSFALPEFDPFWHRCV

SEQ ID NO: 1061551 - protein, 18 aa, Mycobacterium
GPRSSWRATDAVLYAMSG

SEQ ID NO: 1061552 - protein, 17 aa, Mycobacterium
GPSGLHFAGRVGTGFTE

SEQ ID NO: 1061553 - protein, 19 aa, Mycobacterium
GPSMVRWARANGWSARPEA

SEQ ID NO: 1061554 - protein, 18 aa, Mycobacterium
GPTARYGALFTDVFGLRE

SEQ ID NO: 1061555 - protein, 20 aa, Mycobacterium
GPVPPPPRAVSVAWAVPAES

SEQ ID NO: 1061556 - protein, 20 aa, Mycobacterium
GQLSRWTRFSAHRVATMDPT

SEQ ID NO: 1061557 - protein, 20 aa, Mycobacterium
GQPRLLGFHWTKIHLDDPGL

SEQ ID NO: 1061558 - protein, 18 aa, Mycobacterium
GQRRPCCWPGCKHRERTG

SEQ ID NO: 1061559 - protein, 23 aa, Mycobacterium
GQSGEVWISFLIVAPKYVASVAT

SEQ ID NO: 1061560 - protein, 17 aa, Mycobacterium
GQVSGFNSGFFNWGTAN

SEQ ID NO: 1061561 - protein, 23 aa, Mycobacterium
GRADPGEIVWTWVVYEDDPTQGQ

SEQ ID NO: 1061562 - protein, 17 aa, Mycobacterium
GRAKYMWVSTFHSTCVR

SEQ ID NO: 1061563 - protein, 17 aa, Mycobacterium
GRALAGFGLTEPGAGSD

SEQ ID NO: 1061564 - protein, 19 aa, Mycobacterium
GRASWYRNRWVRSMPVCAA

SEQ ID NO: 1061565 - protein, 17 aa, Mycobacterium
GRFAMYAKMHHALIDGV

SEQ ID NO: 1061566 - protein, 19 aa, Mycobacterium
GRGAMIAMELVKSGTAEPD

SEQ ID NO: 1061567 - protein, 18 aa, Mycobacterium
GRGSIRMRGVVEIEEDSR

SEQ ID NO: 1061568 - protein, 20 aa, Mycobacterium
GRGTPLWGGWITGPTWLGPE

SEQ ID NO: 1061569 - protein, 23 aa, Mycobacterium
GRIATRVPQEWLLPYVHQRYDEP

SEQ ID NO: 1061570 - protein, 17 aa, Mycobacterium
GRIFAFDVHSIFIPVSR

SEQ ID NO: 1061571 - protein, 17 aa, Mycobacterium
GRIRYKRVCEVCGEVVE

SEQ ID NO: 1061572 - protein, 22 aa, Mycobacterium
GRKPRGSYQIAILGLKGGAGKT

SEQ ID NO: 1061573 - protein, 17 aa, Mycobacterium
GRLLAAVLDVTWRFYSL

SEQ ID NO: 1061574 - protein, 18 aa, Mycobacterium
GRLLAWRLNRVVDAASQL

SEQ ID NO: 1061575 - protein, 23 aa, Mycobacterium
GRLPKARLSEMVRRILRSMFAVG

SEQ ID NO: 1061576 - protein, 19 aa, Mycobacterium
GRLTLPAKFRDALAGGLMV

SEQ ID NO: 1061577 - protein, 17 aa, Mycobacterium
GRMLWSLPKGHIEMGET

SEQ ID NO: 1061578 - protein, 19 aa, Mycobacterium
GRPKPVPVWAALDGDHGDR

SEQ ID NO: 1061579 - protein, 19 aa, Mycobacterium
GRPQFSAVLECSAAARELG

SEQ ID NO: 1061580 - protein, 20 aa, Mycobacterium
GRRYLDMFTFFASSALGMNH

SEQ ID NO: 1061581 - protein, 18 aa, Mycobacterium
GRVKQLLLKIGWPAEDLA

SEQ ID NO: 1061582 - protein, 18 aa, Mycobacterium
GRVLLVWDAPNLDMRLGS

SEQ ID NO: 1061583 - protein, 19 aa, Mycobacterium
GRWSCVRWGTKTPPFCAEV

SEQ ID NO: 1061584 - protein, 18 aa, Mycobacterium
GSAGLWGAGGAGGAGGSA

SEQ ID NO: 1061585 - protein, 20 aa, Mycobacterium
GSALPEFAAQLSGAISATVG

SEQ ID NO: 1061586 - protein, 19 aa, Mycobacterium
GSALVPSWVAFAVTGLLEQ

SEQ ID NO: 1061587 - protein, 20 aa, Mycobacterium
GSALVPSWVAFAVTGLLEQH

SEQ ID NO: 1061588 - protein, 24 aa, Mycobacterium
GSDARRLEGSYAWGNALSAGYTAE

SEQ ID NO: 1061589 - protein, 17 aa, Mycobacterium
GSEHFSRLVQPWNCTAV

SEQ ID NO: 1061590 - protein, 20 aa, Mycobacterium
GSFFPVIPVCASTGVGTLEL

SEQ ID NO: 1061591 - protein, 21 aa, Mycobacterium
GSGGFAFTFGTGNIIAGVGGG

SEQ ID NO: 1061592 - protein, 19 aa, Mycobacterium
GSGGMFGQMGDAGDGGDAG

SEQ ID NO: 1061593 - protein, 27 aa, Mycobacterium
GSGGQGGFLRFLGGQGDGGAGGAGGVA

SEQ ID NO: 1061594 - protein, 17 aa, Mycobacterium
GSGGRGGFFFGSGGAGG

SEQ ID NO: 1061595 - protein, 18 aa, Mycobacterium
GSGGWLFGNGGTGGRGGI

SEQ ID NO: 1061596 - protein, 19 aa, Mycobacterium
GSLLDEWSHKVVWAAQSLP

SEQ ID NO: 1061597 - protein, 22 aa, Mycobacterium
GSPKGDWLLAVFGYPQAHEDDA

SEQ ID NO: 1061598 - protein, 20 aa, Mycobacterium
GSPWPSWRTHPLLFPFLHGH

SEQ ID NO: 1061599 - protein, 24 aa, Mycobacterium
GSRMYCLLRRLLFLLPPEWVHKLV

SEQ ID NO: 1061600 - protein, 22 aa, Mycobacterium
GSRRGMSGSHGSYGQPGGSGAD

SEQ ID NO: 1061601 - protein, 20 aa, Mycobacterium
GSTLRFAPPLVITAQEIDWA

SEQ ID NO: 1061602 - protein, 21 aa, Mycobacterium
GSVCARRCTVGGVGAIAAVAA

SEQ ID NO: 1061603 - protein, 20 aa, Mycobacterium
GSVHACPWGVGSMLTELKHV

SEQ ID NO: 1061604 - protein, 19 aa, Mycobacterium
GSVVKFRWNGNGVELISNK

SEQ ID NO: 1061605 - protein, 19 aa, Mycobacterium
GTAGRASAAAAVFEAAQAA

SEQ ID NO: 1061606 - protein, 25 aa, Mycobacterium
GTDEQKLRWAVPILRAQITASLGMS

SEQ ID NO: 1061607 - protein, 19 aa, Mycobacterium
GTGDNGGWLYGSGGDGGTG

SEQ ID NO: 1061608 - protein, 20 aa, Mycobacterium
GTGGHGGLLIGNGGAGGIGG

SEQ ID NO: 1061609 - protein, 20 aa, Mycobacterium
GTGWLPGWRLTFGGEDIGWE

SEQ ID NO: 1061610 - protein, 17 aa, Mycobacterium
GTIAGIHLEGPWLSPAR

SEQ ID NO: 1061611 - protein, 19 aa, Mycobacterium
GTLEKWDLGYDVLRERNPG

SEQ ID NO: 1061612 - protein, 17 aa, Mycobacterium
GTLQYRILRGFKKAGIN

SEQ ID NO: 1061613 - protein, 18 aa, Mycobacterium
GTNLKAWLYRILTNTYIN

SEQ ID NO: 1061614 - protein, 19 aa, Mycobacterium
GTSIACSRWGMLSPEGQCK

SEQ ID NO: 1061615 - protein, 25 aa, Mycobacterium
GTVGDLLPILGIPGQMAQNFTNLLP

SEQ ID NO: 1061616 - protein, 17 aa, Mycobacterium
GTVLLEWLNVSGGIDAP

SEQ ID NO: 1061617 - protein, 19 aa, Mycobacterium
GTVVYRFTWHLPKNRTWTY

SEQ ID NO: 1061618 - protein, 19 aa, Mycobacterium
GVAAGAFGVNGSDGADGNQ

SEQ ID NO: 1061619 - protein, 22 aa, Mycobacterium
GVACYPARFQLVLAANPCPCAP

SEQ ID NO: 1061620 - protein, 18 aa, Mycobacterium
GVAYGYPGAPGQWWQQQV

SEQ ID NO: 1061621 - protein, 17 aa, Mycobacterium
GVDEVWAVGGAQVVALL

SEQ ID NO: 1061622 - protein, 23 aa, Mycobacterium
GVGFRWWTRCRALELGLTGYAAN

SEQ ID NO: 1061623 - protein, 24 aa, Mycobacterium
GVGQGRLYFGIGLPELTLPPLDVP

SEQ ID NO: 1061624 - protein, 17 aa, Mycobacterium
GVLLRYVLLTAKRVTGI

SEQ ID NO: 1061625 - protein, 18 aa, Mycobacterium
GVLLRYVLLTAKRVTGIV

SEQ ID NO: 1061626 - protein, 23 aa, Mycobacterium
GVMPRFPLPLGESGPHPERVEVR

SEQ ID NO: 1061627 - protein, 18 aa, Mycobacterium
GVMWKRFTETGAIKAKSV

SEQ ID NO: 1061628 - protein, 23 aa, Mycobacterium
GVPLFDIAAAPGFGNTTTSSSSG

SEQ ID NO: 1061629 - protein, 18 aa, Mycobacterium
GVRDVVLCPGSRNAPLAF

SEQ ID NO: 1061630 - protein, 20 aa, Mycobacterium
GVREAACFEIPDPEFGALVG

SEQ ID NO: 1061631 - protein, 20 aa, Mycobacterium
GVVAKRLWRDSGLKPADIQT

SEQ ID NO: 1061632 - protein, 24 aa, Mycobacterium
GVVPGKVAGGWFWIHALNSATQAA

SEQ ID NO: 1061633 - protein, 24 aa, Mycobacterium
GWAPALLISRLVSWVDDLWCRAIG

SEQ ID NO: 1061634 - protein, 19 aa, Mycobacterium
GWRWHTWHLYPLHPGGSGG

SEQ ID NO: 1061635 - protein, 17 aa, Mycobacterium
GWVPWIGILAPQINFFY

SEQ ID NO: 1061636 - protein, 20 aa, Mycobacterium
GYAACHWCHVMAHESFEDDE

SEQ ID NO: 1061637 - protein, 18 aa, Mycobacterium
GYGRLGGGYFALAVTLEE

SEQ ID NO: 1061638 - protein, 22 aa, Mycobacterium
GYGSLIQMIWIYDRAVDVEGLR

SEQ ID NO: 1061639 - protein, 21 aa, Mycobacterium
GYPFRCKRVLLGDDFYRALQH

SEQ ID NO: 1061640 - protein, 23 aa, Mycobacterium
GYRGCMHACRYCFARPIHEYLDF

SEQ ID NO: 1061641 - protein, 19 aa, Mycobacterium
HAAKGLEWHAVFLVGLADG

SEQ ID NO: 1061642 - protein, 18 aa, Mycobacterium
HAELDWWTSPFVLTDGVP

SEQ ID NO: 1061643 - protein, 17 aa, Mycobacterium
HAFNLWLDEDWGFDRPD

SEQ ID NO: 1061644 - protein, 17 aa, Mycobacterium
HAGHLVPLLALRRFQRA

SEQ ID NO: 1061645 - protein, 24 aa, Mycobacterium
HAGKWRVVFFWPKDFTFVCPTEIA

SEQ ID NO: 1061646 - protein, 19 aa, Mycobacterium
HAMAALVDRVCEVDGREPA

SEQ ID NO: 1061647 - protein, 22 aa, Mycobacterium
HATWRINELLNWQVAAAGENIN

SEQ ID NO: 1061648 - protein, 18 aa, Mycobacterium
HAWIQAWTGGWWHYDPTN

SEQ ID NO: 1061649 - protein, 19 aa, Mycobacterium
HAWLRPAAGVGEMFDTLLV

SEQ ID NO: 1061650 - protein, 22 aa, Mycobacterium
HCLDMPGLFVWRRYHPSRPKGK

SEQ ID NO: 1061651 - protein, 17 aa, Mycobacterium
HCYDVPICWSLRSIFDA

SEQ ID NO: 1061652 - protein, 20 aa, Mycobacterium
HDLYQRWPFFRSVLSNMAQV

SEQ ID NO: 1061653 - protein, 18 aa, Mycobacterium
HDPPWCRPLLGVRRGVTH

SEQ ID NO: 1061654 - protein, 18 aa, Mycobacterium
HDPYCADARHGLAELLAE

SEQ ID NO: 1061655 - protein, 18 aa, Mycobacterium
HDVWRWVIDIDLWGSIHT

SEQ ID NO: 1061656 - protein, 18 aa, Mycobacterium
HERRAVGIGSEFASGAGS

SEQ ID NO: 1061657 - protein, 19 aa, Mycobacterium
HFFVCSTHDWILFFTTQGR

SEQ ID NO: 1061658 - protein, 23 aa, Mycobacterium
HFGRLRYAHFFKMAYQALPADGI

SEQ ID NO: 1061659 - protein, 21 aa, Mycobacterium
HGFGSFWWSWRHQLRGLTGAR

SEQ ID NO: 1061660 - protein, 20 aa, Mycobacterium
HGFPESWYSWRHQIPALAAA

SEQ ID NO: 1061661 - protein, 21 aa, Mycobacterium
HGGAGGRGGRLYGNGGVGGNG

SEQ ID NO: 1061662 - protein, 18 aa, Mycobacterium
HGGPRLTGIAGLAVDGQR

SEQ ID NO: 1061663 - protein, 20 aa, Mycobacterium
HGLGPRWVLVKGGHLRSSTR

SEQ ID NO: 1061664 - protein, 20 aa, Mycobacterium
HGLPSLGFNLCRIFTDGDYT

SEQ ID NO: 1061665 - protein, 22 aa, Mycobacterium
HGQKLRGGYALTRIREGSEEAW

SEQ ID NO: 1061666 - protein, 17 aa, Mycobacterium
HGRWPDRRAHPRDRTPL

SEQ ID NO: 1061667 - protein, 19 aa, Mycobacterium
HIASAVAIARQWLDCPDRG

SEQ ID NO: 1061668 - protein, 22 aa, Mycobacterium
HIESRLAVTLSWIREFPSLGPI

SEQ ID NO: 1061669 - protein, 19 aa, Mycobacterium
HIFWDELFIFPVLNLRLPA

SEQ ID NO: 1061670 - protein, 20 aa, Mycobacterium
HILTCARELFALNGLDRTSV

SEQ ID NO: 1061671 - protein, 17 aa, Mycobacterium
HKVPRGVGFFKRSGLVR

SEQ ID NO: 1061672 - protein, 21 aa, Mycobacterium
HLAGGCSRHAFGFNVLGPDGQ

SEQ ID NO: 1061673 - protein, 17 aa, Mycobacterium
HLFTVLMDREWKYGVAA

SEQ ID NO: 1061674 - protein, 23 aa, Mycobacterium
HLISPWGTWEWMAPAAAGAALPV

SEQ ID NO: 1061675 - protein, 21 aa, Mycobacterium
HLRLPCRGRDSTEGFGLHAVP

SEQ ID NO: 1061676 - protein, 18 aa, Mycobacterium
HMWFGDLVTMTWWDDLWL

SEQ ID NO: 1061677 - protein, 26 aa, Mycobacterium
HNQISRTMELPVKMASKAATADTAAT

SEQ ID NO: 1061678 - protein, 20 aa, Mycobacterium
HPADVLPLWVAEMDVNLAPT

SEQ ID NO: 1061679 - protein, 21 aa, Mycobacterium
HPKMPLVPLIDGWESVAEMEA

SEQ ID NO: 1061680 - protein, 18 aa, Mycobacterium
HPRYELIPQMTVHDGDQA

SEQ ID NO: 1061681 - protein, 21 aa, Mycobacterium
HQAAARLCARVGLRGVATVEF

SEQ ID NO: 1061682 - protein, 24 aa, Mycobacterium
HQIPRAGNMLSVFFSETPVTDFAA

SEQ ID NO: 1061683 - protein, 23 aa, Mycobacterium
HRERYTLPALRDWLRGQREDRGG

SEQ ID NO: 1061684 - protein, 24 aa, Mycobacterium
HRLARSLFLYALCNGWIGEGTTVV

SEQ ID NO: 1061685 - protein, 22 aa, Mycobacterium
HRLPSCRFWNLVVWNQFMATCG

SEQ ID NO: 1061686 - protein, 17 aa, Mycobacterium
HRPVVAIPPGWSCPQAA

SEQ ID NO: 1061687 - protein, 18 aa, Mycobacterium
HRSRGRFGFFGNVVLSNV

SEQ ID NO: 1061688 - protein, 20 aa, Mycobacterium
HRSRVGRLWAGFNAVAVDNP

SEQ ID NO: 1061689 - protein, 23 aa, Mycobacterium
HSAEKPKCCWAAPAVATVTAVTT

SEQ ID NO: 1061690 - protein, 20 aa, Mycobacterium
HSALLVRFGEIFGHGLTTWL

SEQ ID NO: 1061691 - protein, 19 aa, Mycobacterium
HSFPAIALCQRFAEAGDTP

SEQ ID NO: 1061692 - protein, 18 aa, Mycobacterium
HSRMAPVYLYRFDYSTPL

SEQ ID NO: 1061693 - protein, 20 aa, Mycobacterium
HSTPRAGDGFIRLDRNGVVA

SEQ ID NO: 1061694 - protein, 20 aa, Mycobacterium
HTPLKMCWVPGYSDYYSEAP

SEQ ID NO: 1061695 - protein, 18 aa, Mycobacterium
HTPLPLLAFTAWPEVRSQ

SEQ ID NO: 1061696 - protein, 17 aa, Mycobacterium
HVKPRLLGHWGTTPGLN

SEQ ID NO: 1061697 - protein, 22 aa, Mycobacterium
HVPEAIPLLFGHIGEGNLHLNV

SEQ ID NO: 1061698 - protein, 17 aa, Mycobacterium
HVPEWARRWQRLLFDNG

SEQ ID NO: 1061699 - protein, 22 aa, Mycobacterium
HVRSGVAFDILRRWLMARGYDV

SEQ ID NO: 1061700 - protein, 26 aa, Mycobacterium
HVRSGVAFDILRRWLMARGYDVAFIR

SEQ ID NO: 1061701 - protein, 22 aa, Mycobacterium
IACYCLGRPGWRDDVHQAVQTA

SEQ ID NO: 1061702 - protein, 18 aa, Mycobacterium
IADARWGRRVHAVVQVAA

SEQ ID NO: 1061703 - protein, 19 aa, Mycobacterium
IAEGCVRAGCALLGGETAE

SEQ ID NO: 1061704 - protein, 20 aa, Mycobacterium
IAHILVLRSRFDGGFTSEVR

SEQ ID NO: 1061705 - protein, 17 aa, Mycobacterium
IALCRRVAEALPHAEMV

SEQ ID NO: 1061706 - protein, 17 aa, Mycobacterium
IALHVRVLYGRDPHHIT

SEQ ID NO: 1061707 - protein, 24 aa, Mycobacterium
IALSIFGSLAWKSGEAAAEGVAGA

SEQ ID NO: 1061708 - protein, 24 aa, Mycobacterium
IAMPALRLDAAFAHLNLGDCRGNA

SEQ ID NO: 1061709 - protein, 23 aa, Mycobacterium
IAQARLGPGRIHHCMRALGGAER

SEQ ID NO: 1061710 - protein, 23 aa, Mycobacterium
IARELDRYLPFLATTKVLMAAVR

SEQ ID NO: 1061711 - protein, 23 aa, Mycobacterium
IARFKRLDGFDVRFLTGTDEHGL

SEQ ID NO: 1061712 - protein, 22 aa, Mycobacterium
IATDHLMRFPGHFSEQLLPEHL

SEQ ID NO: 1061713 - protein, 23 aa, Mycobacterium
IATDHLMRFPGRFSEQLLVDNLH

SEQ ID NO: 1061714 - protein, 19 aa, Mycobacterium
IATGPTVLTIRARPPGTTI

SEQ ID NO: 1061715 - protein, 25 aa, Mycobacterium
IAVCGQCRWCATGMEYLCDTGYGTL

SEQ ID NO: 1061716 - protein, 20 aa, Mycobacterium
IAWSHLWERLSIEFSNHTEE

SEQ ID NO: 1061717 - protein, 19 aa, Mycobacterium
ICAFGRIGSMFACNDFGYV

SEQ ID NO: 1061718 - protein, 17 aa, Mycobacterium
ICDGWLPIFYTPRMADM

SEQ ID NO: 1061719 - protein, 19 aa, Mycobacterium
ICDRPSCPQRAFPYLGRPV

SEQ ID NO: 1061720 - protein, 21 aa, Mycobacterium
ICKRRMFDLLVRMGYKEIEVG

SEQ ID NO: 1061721 - protein, 22 aa, Mycobacterium
ICRIRLALRLDLSVRMAAHAHP

SEQ ID NO: 1061722 - protein, 19 aa, Mycobacterium
IDAPALWPGLPVRPVKGEV

SEQ ID NO: 1061723 - protein, 19 aa, Mycobacterium
IDFLHRWDPVHWLQPVSAA

SEQ ID NO: 1061724 - protein, 18 aa, Mycobacterium
IDHFRYFAGAIRAQEGSL

SEQ ID NO: 1061725 - protein, 19 aa, Mycobacterium
IDLLLKRGASLGVQIRYET

SEQ ID NO: 1061726 - protein, 24 aa, Mycobacterium
IDLMPPLRWRVREVPFGIDYPVLV

SEQ ID NO: 1061727 - protein, 19 aa, Mycobacterium
IDLQLRGCFAMTETGHGSD

SEQ ID NO: 1061728 - protein, 20 aa, Mycobacterium
IDLRQDWPSALRAAGFDPSA

SEQ ID NO: 1061729 - protein, 17 aa, Mycobacterium
IDPEVYSGFAFGMGLER

SEQ ID NO: 1061730 - protein, 20 aa, Mycobacterium
IDPWAGSYYVEWLTHQLAQR

SEQ ID NO: 1061731 - protein, 19 aa, Mycobacterium
IDRGYPLFVEYLGILGAEI

SEQ ID NO: 1061732 - protein, 18 aa, Mycobacterium
IDRTVFWLIRGYEASRRA

SEQ ID NO: 1061733 - protein, 17 aa, Mycobacterium
IDVTAWPAVVVRAYTES

SEQ ID NO: 1061734 - protein, 17 aa, Mycobacterium
IEACGDCPRGIHGSPLA

SEQ ID NO: 1061735 - protein, 18 aa, Mycobacterium
IEAMPRYGPGHGVLVAQV

SEQ ID NO: 1061736 - protein, 17 aa, Mycobacterium
IEDFLGIPFVANVINGA

SEQ ID NO: 1061737 - protein, 19 aa, Mycobacterium
IEHCNRWAAPLAGHKWYAF

SEQ ID NO: 1061738 - protein, 20 aa, Mycobacterium
IEHWTRLPVEVELASEFRYR

SEQ ID NO: 1061739 - protein, 20 aa, Mycobacterium
IEKMRVAGRIAAGALVEAGK

SEQ ID NO: 1061740 - protein, 17 aa, Mycobacterium
IELARSGAKLAISDVDT

SEQ ID NO: 1061741 - protein, 19 aa, Mycobacterium
IELFTGIALLIQRDPITTA

SEQ ID NO: 1061742 - protein, 24 aa, Mycobacterium
IEPDLRYLVNWGYGDPAYGWSTSP

SEQ ID NO: 1061743 - protein, 23 aa, Mycobacterium
IEPGIYFPGRWGARIEDIVVVTE

SEQ ID NO: 1061744 - protein, 22 aa, Mycobacterium
IERELPEWLAADVAILGEPTGG

SEQ ID NO: 1061745 - protein, 24 aa, Mycobacterium
IERFLEWYAPFANFFYDTLGLPFF

SEQ ID NO: 1061746 - protein, 19 aa, Mycobacterium
IERFLQLWAEGSMTIAMPS

SEQ ID NO: 1061747 - protein, 18 aa, Mycobacterium
IERPHMYRLMFGSTSAHG

SEQ ID NO: 1061748 - protein, 20 aa, Mycobacterium
IEWQSCTPFGVVIHLRDGNR

SEQ ID NO: 1061749 - protein, 23 aa, Mycobacterium
IFMWEIFGPLVAGARLVFNPGEW

SEQ ID NO: 1061750 - protein, 22 aa, Mycobacterium
IGATGPRRCRWSVVHHSWTTRP

SEQ ID NO: 1061751 - protein, 17 aa, Mycobacterium
IGAVFGGVWSRVSGGVW

SEQ ID NO: 1061752 - protein, 23 aa, Mycobacterium
IGGAFARYGGVWAHDDTRKSFGI

SEQ ID NO: 1061753 - protein, 17 aa, Mycobacterium
IGGGLCLALAADVRVAA

SEQ ID NO: 1061754 - protein, 20 aa, Mycobacterium
IGGGMCFTFLAAQGYSVGTS

SEQ ID NO: 1061755 - protein, 18 aa, Mycobacterium
IGHIPGAVKIDWHTDLND

SEQ ID NO: 1061756 - protein, 22 aa, Mycobacterium
IGPRAARVVSIFLDGATLHAMI

SEQ ID NO: 1061757 - protein, 21 aa, Mycobacterium
IGQRGRRAAVVAAGRPPRCRP

SEQ ID NO: 1061758 - protein, 21 aa, Mycobacterium
IGRIKDLLIIYGRNHSPDDIE

SEQ ID NO: 1061759 - protein, 23 aa, Mycobacterium
IGRRGRCLRAVWVSRWPSVVHWM

SEQ ID NO: 1061760 - protein, 24 aa, Mycobacterium
IGSFRFWFIGQRWEWSDEVAGMHG

SEQ ID NO: 1061761 - protein, 17 aa, Mycobacterium
IHAGEAFGLPSIHEAIA

SEQ ID NO: 1061762 - protein, 19 aa, Mycobacterium
IIPWNFPILMGAWKLAPAL

SEQ ID NO: 1061763 - protein, 18 aa, Mycobacterium
IIPWNFPLLMATWKLAPA

SEQ ID NO: 1061764 - protein, 22 aa, Mycobacterium
IIVPGCLDLLFRGEIPDGVDPA

SEQ ID NO: 1061765 - protein, 23 aa, Mycobacterium
IKELCRRWYPRIYFGQPPKGLAH

SEQ ID NO: 1061766 - protein, 22 aa, Mycobacterium
IKKLPTLRGRTVITMFYENSTR

SEQ ID NO: 1061767 - protein, 24 aa, Mycobacterium
IKSIGLRLGLPWYAYDTVTFSGEV

SEQ ID NO: 1061768 - protein, 28 aa, Mycobacterium
IKTPPRPPAPPWPTTPPVAPTVVAAPPA

SEQ ID NO: 1061769 - protein, 17 aa, Mycobacterium
ILENRLQLVTLIATNIF

SEQ ID NO: 1061770 - protein, 19 aa, Mycobacterium
ILNNLCRYGLWDVTLESRV

SEQ ID NO: 1061771 - protein, 17 aa, Mycobacterium
ILRVAVWELLYADDVPE

SEQ ID NO: 1061772 - protein, 26 aa, Mycobacterium
ILWHVLFRFSAMYARKVPYRYEMDLV

SEQ ID NO: 1061773 - protein, 25 aa, Mycobacterium
INEVLKGAWGYRGWVMSDWGGTPGW

SEQ ID NO: 1061774 - protein, 18 aa, Mycobacterium
INFLADLNAFLGIQSLHG

SEQ ID NO: 1061775 - protein, 23 aa, Mycobacterium
INGHVRAGGFGLVSACDIVVAGP

SEQ ID NO: 1061776 - protein, 19 aa, Mycobacterium
INRLRLGVCVTDVGRRNPA

SEQ ID NO: 1061777 - protein, 24 aa, Mycobacterium
INYLRCIGCGLCIEACPTRALTMT

SEQ ID NO: 1061778 - protein, 17 aa, Mycobacterium
IPARGVVAVCDFGGSGT

SEQ ID NO: 1061779 - protein, 19 aa, Mycobacterium
IPGGLRWTWETMKPLYTNG

SEQ ID NO: 1061780 - protein, 19 aa, Mycobacterium
IPGMRAKLFDAARLAAEAI

SEQ ID NO: 1061781 - protein, 20 aa, Mycobacterium
IPGPRIYPAGGFISQSGGHG

SEQ ID NO: 1061782 - protein, 21 aa, Mycobacterium
IPIIAGFPFPLAVEILPAHLP

SEQ ID NO: 1061783 - protein, 18 aa, Mycobacterium
IPIIDIAAAPGFGNSTTT

SEQ ID NO: 1061784 - protein, 17 aa, Mycobacterium
IPLLVVITEVIPVQDTA

SEQ ID NO: 1061785 - protein, 19 aa, Mycobacterium
IPSPAAGVLTKIVAKEDDT

SEQ ID NO: 1061786 - protein, 19 aa, Mycobacterium
IPSPVAGVLLSITAEEDDV

SEQ ID NO: 1061787 - protein, 18 aa, Mycobacterium
IPTQISIVAEIPRTASGK

SEQ ID NO: 1061788 - protein, 17 aa, Mycobacterium
IPVCASTGVGTLELLEV

SEQ ID NO: 1061789 - protein, 17 aa, Mycobacterium
IPVSRVHRKLCEGYLVA

SEQ ID NO: 1061790 - protein, 18 aa, Mycobacterium
IQDIEDFLGIPFVANVIN

SEQ ID NO: 1061791 - protein, 18 aa, Mycobacterium
IQIAKRWLFPELRFDEHL

SEQ ID NO: 1061792 - protein, 17 aa, Mycobacterium
IQIPRFCDHPLLEPVGA

SEQ ID NO: 1061793 - protein, 17 aa, Mycobacterium
IQLYVKRVFIMGDCDQL

SEQ ID NO: 1061794 - protein, 18 aa, Mycobacterium
IQRSWRPSCSPTRPPMVS

SEQ ID NO: 1061795 - protein, 19 aa, Mycobacterium
IRAAERPVLFVGLRVGDPA

SEQ ID NO: 1061796 - protein, 18 aa, Mycobacterium
IRACPRFAQRLRRYPFDL

SEQ ID NO: 1061797 - protein, 18 aa, Mycobacterium
IRAGAGLVLAGLVADGDT

SEQ ID NO: 1061798 - protein, 17 aa, Mycobacterium
IRARFVVMASGPFHRPK

SEQ ID NO: 1061799 - protein, 24 aa, Mycobacterium
IRASLRPAQRWMLSAGVLSVIGSI

SEQ ID NO: 1061800 - protein, 19 aa, Mycobacterium
IRGLSKVAALEWGRDNIRV

SEQ ID NO: 1061801 - protein, 21 aa, Mycobacterium
IRGPIGLGYRVPCFVISPYSR

SEQ ID NO: 1061802 - protein, 17 aa, Mycobacterium
IRLPVHLVEQVNKLARI

SEQ ID NO: 1061803 - protein, 17 aa, Mycobacterium
IRLWLPYDEVLPRRQPP

SEQ ID NO: 1061804 - protein, 17 aa, Mycobacterium
IRPAFTYQRSLDVLTAA

SEQ ID NO: 1061805 - protein, 17 aa, Mycobacterium
IRPGDALVFAIKVLSAS

SEQ ID NO: 1061806 - protein, 17 aa, Mycobacterium
IRQTVQFERAIRTAFNS

SEQ ID NO: 1061807 - protein, 17 aa, Mycobacterium
IRTHYPLELEAEMGVIA

SEQ ID NO: 1061808 - protein, 19 aa, Mycobacterium
IRWSLDLLRRRFAKVIWVP

SEQ ID NO: 1061809 - protein, 17 aa, Mycobacterium
IRYCASAQWFARTARKP

SEQ ID NO: 1061810 - protein, 17 aa, Mycobacterium
IRYKRVCEVCGEVVEYS

SEQ ID NO: 1061811 - protein, 17 aa, Mycobacterium
IRYLPPFAYFMDSPNAF

SEQ ID NO: 1061812 - protein, 20 aa, Mycobacterium
ISAAVAALFGSYAQGYQSLS

SEQ ID NO: 1061813 - protein, 17 aa, Mycobacterium
ISALWWVHWRVTKNPEE

SEQ ID NO: 1061814 - protein, 18 aa, Mycobacterium
ISAPGVTVAHGWASELAE

SEQ ID NO: 1061815 - protein, 17 aa, Mycobacterium
ISLPLEWTPEGLPLGVQ

SEQ ID NO: 1061816 - protein, 19 aa, Mycobacterium
ISPLGCWPGSSALPTVSVP

SEQ ID NO: 1061817 - protein, 23 aa, Mycobacterium
ISPLQARCGWAIGWKKDAFFGRE

SEQ ID NO: 1061818 - protein, 18 aa, Mycobacterium
ISRIVTWLFVNAAGAETL

SEQ ID NO: 1061819 - protein, 25 aa, Mycobacterium
ISRQLWWGHRIPIWYGPDGEKVCVG

SEQ ID NO: 1061820 - protein, 23 aa, Mycobacterium
ISTTARMLIQFGFIERLAVAGDR

SEQ ID NO: 1061821 - protein, 24 aa, Mycobacterium
ISTTIATLFCGYARDYQNLSTQLA

SEQ ID NO: 1061822 - protein, 17 aa, Mycobacterium
ITATPAWEALRKHHDQI

SEQ ID NO: 1061823 - protein, 18 aa, Mycobacterium
ITAVMPFYPYARQDKKHR

SEQ ID NO: 1061824 - protein, 17 aa, Mycobacterium
ITKEVLNALGITVLAAP

SEQ ID NO: 1061825 - protein, 18 aa, Mycobacterium
ITLGGTMAKYDWTINGEP

SEQ ID NO: 1061826 - protein, 23 aa, Mycobacterium
ITPRWLLHLLNWVPVEAGVYRVN

SEQ ID NO: 1061827 - protein, 19 aa, Mycobacterium
ITVPVSLSATVDGGAGGAG

SEQ ID NO: 1061828 - protein, 17 aa, Mycobacterium
ITYRIKLEISFKMRPSQ

SEQ ID NO: 1061829 - protein, 18 aa, Mycobacterium
IVALRARAKGSFAEREGV

SEQ ID NO: 1061830 - protein, 23 aa, Mycobacterium
IVKGLRTGTDFEYELQMAQMNKH

SEQ ID NO: 1061831 - protein, 24 aa, Mycobacterium
IVPRYRTMRGFKVERRFGWDTHGL

SEQ ID NO: 1061832 - protein, 20 aa, Mycobacterium
IVRPRWLWKFGKTLRPPDLR

SEQ ID NO: 1061833 - protein, 23 aa, Mycobacterium
IVSRGGSIMAAWCLAHHRESFLY

SEQ ID NO: 1061834 - protein, 17 aa, Mycobacterium
IWARLVRALGFVTDDDL

SEQ ID NO: 1061835 - protein, 17 aa, Mycobacterium
IWCFPKFDFPLPAALRW

SEQ ID NO: 1061836 - protein, 17 aa, Mycobacterium
IWLLLGLLPAMRESGRG

SEQ ID NO: 1061837 - protein, 17 aa, Mycobacterium
IYARYQAFTSFTAHVRG

SEQ ID NO: 1061838 - protein, 18 aa, Mycobacterium
IYDMWARIYADTERTNLH

SEQ ID NO: 1061839 - protein, 17 aa, Mycobacterium
IYFEGGYSFEYLNDPSK

SEQ ID NO: 1061840 - protein, 25 aa, Mycobacterium
KAAARAVSWPTMWLSSADSPITMRH

SEQ ID NO: 1061841 - protein, 23 aa, Mycobacterium
KAAEARAGALAWQHHEPELAQYA

SEQ ID NO: 1061842 - protein, 17 aa, Mycobacterium
KAAEFGREVIRQFEPDI

SEQ ID NO: 1061843 - protein, 21 aa, Mycobacterium
KAELWPDLNLGLPFTYHQGYQ

SEQ ID NO: 1061844 - protein, 19 aa, Mycobacterium
KAFESWRWFTPSERQRALL

SEQ ID NO: 1061845 - protein, 22 aa, Mycobacterium
KAFSAPPAWRVIKLAFGQPGPN

SEQ ID NO: 1061846 - protein, 19 aa, Mycobacterium
KAIEASGRFCVNVLTEKQK

SEQ ID NO: 1061847 - protein, 19 aa, Mycobacterium
KALCALPMVVNATADLVFS

SEQ ID NO: 1061848 - protein, 18 aa, Mycobacterium
KALLRLAGRYGVGEDAID

SEQ ID NO: 1061849 - protein, 23 aa, Mycobacterium
KAPRWPSMTSWKLATEVDRVVAK

SEQ ID NO: 1061850 - protein, 20 aa, Mycobacterium
KAQELGLTWLVEIGAHGVAA

SEQ ID NO: 1061851 - protein, 18 aa, Mycobacterium
KARVVLCGVISSYLTGEH

SEQ ID NO: 1061852 - protein, 17 aa, Mycobacterium
KCAPNLCYADIPGKANR

SEQ ID NO: 1061853 - protein, 21 aa, Mycobacterium
KCNWYKLSEMPVLWAYARDLF

SEQ ID NO: 1061854 - protein, 26 aa, Mycobacterium
KCQQVWCPLCALAALVNGEQHPLTTV

SEQ ID NO: 1061855 - protein, 23 aa, Mycobacterium
KCYSLRIASAMARDEGWLAEHML

SEQ ID NO: 1061856 - protein, 20 aa, Mycobacterium
KDAEWWRLGLAEEIGGMPAP

SEQ ID NO: 1061857 - protein, 18 aa, Mycobacterium
KDIDPAWLAGVTTVGVTS

SEQ ID NO: 1061858 - protein, 19 aa, Mycobacterium
KDIDPAWLAGVTTVGVTSG

SEQ ID NO: 1061859 - protein, 19 aa, Mycobacterium
KDMLCINLLWAGRCLVVPE

SEQ ID NO: 1061860 - protein, 20 aa, Mycobacterium
KDMLCINLLWAGRCLVVPED

SEQ ID NO: 1061861 - protein, 20 aa, Mycobacterium
KDPKRPSGSFIFAGPSGVGK

SEQ ID NO: 1061862 - protein, 23 aa, Mycobacterium
KEGDDVFVALSWTKHPAPQTYQE

SEQ ID NO: 1061863 - protein, 21 aa, Mycobacterium
KEIAGRLAARIGSGLLVDVVG

SEQ ID NO: 1061864 - protein, 20 aa, Mycobacterium
KELHLRLGAATAELSQRLGR

SEQ ID NO: 1061865 - protein, 19 aa, Mycobacterium
KERGFRLLALTPKGDARAL

SEQ ID NO: 1061866 - protein, 24 aa, Mycobacterium
KETWSGHFPFDWGVSAHPKVDGKT

SEQ ID NO: 1061867 - protein, 17 aa, Mycobacterium
KEVLNALGITVLAAPGF

SEQ ID NO: 1061868 - protein, 19 aa, Mycobacterium
KFCTGEFITAIAMTEPGTG

SEQ ID NO: 1061869 - protein, 18 aa, Mycobacterium
KFPYRNDGALGWFGTSPV

SEQ ID NO: 1061870 - protein, 19 aa, Mycobacterium
KGACAQVNMDLGLLAPEKA

SEQ ID NO: 1061871 - protein, 22 aa, Mycobacterium
KGANPWIMISAFYLKIDGCVGQ

SEQ ID NO: 1061872 - protein, 20 aa, Mycobacterium
KGGADWVEWGGCGMVHPNVL

SEQ ID NO: 1061873 - protein, 19 aa, Mycobacterium
KGGNAVLFGAGGNGGIGGT

SEQ ID NO: 1061874 - protein, 18 aa, Mycobacterium
KGGSTFLGMEKLPHTAAV

SEQ ID NO: 1061875 - protein, 25 aa, Mycobacterium
KGIFTSNFGYRWGVLHAGIDLANSI

SEQ ID NO: 1061876 - protein, 17 aa, Mycobacterium
KGKLDGYALRVPIPTGS

SEQ ID NO: 1061877 - protein, 19 aa, Mycobacterium
KGLAELGCFGMKIPSEYGG

SEQ ID NO: 1061878 - protein, 18 aa, Mycobacterium
KGLISSWKAFAPAWAGKV

SEQ ID NO: 1061879 - protein, 24 aa, Mycobacterium
KGPFRIAMAVGIPIVPIVFRNAEI

SEQ ID NO: 1061880 - protein, 19 aa, Mycobacterium
KGQSWRGAAGIGEGHLGLP

SEQ ID NO: 1061881 - protein, 20 aa, Mycobacterium
KGSALVPSWVAFAVTGLLEQ

SEQ ID NO: 1061882 - protein, 24 aa, Mycobacterium
KGTFRLAFGIGDFRRDTGFGKDAT

SEQ ID NO: 1061883 - protein, 17 aa, Mycobacterium
KHLANSVVVMFAGSIVE

SEQ ID NO: 1061884 - protein, 17 aa, Mycobacterium
KHPDCLEYILVHEMTHY

SEQ ID NO: 1061885 - protein, 21 aa, Mycobacterium
KICRMIMLYHLDRGWADHLAY

SEQ ID NO: 1061886 - protein, 19 aa, Mycobacterium
KIGWACGLKELIAGVRAAK

SEQ ID NO: 1061887 - protein, 18 aa, Mycobacterium
KIKTGARVHVHWADETVG

SEQ ID NO: 1061888 - protein, 17 aa, Mycobacterium
KIRRLTIVFADLVDSTV

SEQ ID NO: 1061889 - protein, 17 aa, Mycobacterium
KKADAALGRPVVSNQVH

SEQ ID NO: 1061890 - protein, 18 aa, Mycobacterium
KKAVFDWSIGVGLKVSAS

SEQ ID NO: 1061891 - protein, 25 aa, Mycobacterium
KKFRFPTFLGAFKYYTSYTLKTFDG

SEQ ID NO: 1061892 - protein, 22 aa, Mycobacterium
KKFRFSTFLGAFKYYTSYTLKT

SEQ ID NO: 1061893 - protein, 23 aa, Mycobacterium
KKFRFSTFLGAFKYYTSYTLKTF

SEQ ID NO: 1061894 - protein, 20 aa, Mycobacterium
KKLPTLRGRTVVTMFYENST

SEQ ID NO: 1061895 - protein, 20 aa, Mycobacterium
KKLSIRLGVPCFPDDPLHFT

SEQ ID NO: 1061896 - protein, 17 aa, Mycobacterium
KKSDCPFSTSASENLQI

SEQ ID NO: 1061897 - protein, 18 aa, Mycobacterium
KKSFVCGLHGWTYDQDGN

SEQ ID NO: 1061898 - protein, 24 aa, Mycobacterium
KKTPRRLCLRITLGSGRNKVTATF

SEQ ID NO: 1061899 - protein, 19 aa, Mycobacterium
KLAEWEAGAGLGNYTRARI

SEQ ID NO: 1061900 - protein, 21 aa, Mycobacterium
KLCQRRHNLPGLDFVRGDAEN

SEQ ID NO: 1061901 - protein, 18 aa, Mycobacterium
KLDRAAYVYPMFEQALRI

SEQ ID NO: 1061902 - protein, 24 aa, Mycobacterium
KLGELRPLYPPGLVHIYHALTWGP

SEQ ID NO: 1061903 - protein, 17 aa, Mycobacterium
KLKCYIEVRCEVAGDLA

SEQ ID NO: 1061904 - protein, 17 aa, Mycobacterium
KLKCYLEVRCSVAGNLP

SEQ ID NO: 1061905 - protein, 23 aa, Mycobacterium
KLLRSDWLEPRWMVGIDPQSEGL

SEQ ID NO: 1061906 - protein, 24 aa, Mycobacterium
KLNNSQRFAIDWMRTNDQGNFFAG

SEQ ID NO: 1061907 - protein, 21 aa, Mycobacterium
KLPFGEIPGQVFIGMRTSDVL

SEQ ID NO: 1061908 - protein, 24 aa, Mycobacterium
KLQKRLQEELAWVRSGAKARQAKS

SEQ ID NO: 1061909 - protein, 21 aa, Mycobacterium
KLRSGQTLIGFLAPRNADYSI

SEQ ID NO: 1061910 - protein, 18 aa, Mycobacterium
KNALFPFVDFIRALSEEQ

SEQ ID NO: 1061911 - protein, 21 aa, Mycobacterium
KNPRRVLGLHFFNPVPVLPLV

SEQ ID NO: 1061912 - protein, 17 aa, Mycobacterium
KPAWFDRAWQRIVEEVA

SEQ ID NO: 1061913 - protein, 17 aa, Mycobacterium
KPGMTLLDIGCGWGTTM

SEQ ID NO: 1061914 - protein, 17 aa, Mycobacterium
KPGRPLAWHSLGEALFN

SEQ ID NO: 1061915 - protein, 20 aa, Mycobacterium
KPKLDVLDFWSIVRPELPGV

SEQ ID NO: 1061916 - protein, 18 aa, Mycobacterium
KPLYGSSLVTGWARLHGY

SEQ ID NO: 1061917 - protein, 23 aa, Mycobacterium
KPRSCAALPRILRDNGYVTGAFG

SEQ ID NO: 1061918 - protein, 20 aa, Mycobacterium
KPSRVPVWFMRQAGRSLPEY

SEQ ID NO: 1061919 - protein, 18 aa, Mycobacterium
KPTLARRMAQLFPDASII

SEQ ID NO: 1061920 - protein, 18 aa, Mycobacterium
KPTWGRVSVHGVFAMAPS

SEQ ID NO: 1061921 - protein, 20 aa, Mycobacterium
KPVLWRLIATITRQWIDTTR

SEQ ID NO: 1061922 - protein, 17 aa, Mycobacterium
KPWFAIGGIDGLRLPEV

SEQ ID NO: 1061923 - protein, 17 aa, Mycobacterium
KQRSRLALWSRRLLGEA

SEQ ID NO: 1061924 - protein, 20 aa, Mycobacterium
KRAKLRFIRSCSAPLTQETA

SEQ ID NO: 1061925 - protein, 19 aa, Mycobacterium
KRRRFPVEIVRRTRAAVGP

SEQ ID NO: 1061926 - protein, 19 aa, Mycobacterium
KRVCRDCGFFLPLAGSLGV

SEQ ID NO: 1061927 - protein, 21 aa, Mycobacterium
KRWLFPELRFDEHLIIGEYLL

SEQ ID NO: 1061928 - protein, 24 aa, Mycobacterium
KRWVTECLRDAYPLGRGHGPVSPL

SEQ ID NO: 1061929 - protein, 18 aa, Mycobacterium
KRYAPRYVTGLQLGTSGD

SEQ ID NO: 1061930 - protein, 17 aa, Mycobacterium
KSGCSTYKWETFLTSEL

SEQ ID NO: 1061931 - protein, 17 aa, Mycobacterium
KSLTFALRFRAPDRTLT

SEQ ID NO: 1061932 - protein, 17 aa, Mycobacterium
KSPFGMPGMPGMLAGFP

SEQ ID NO: 1061933 - protein, 18 aa, Mycobacterium
KSVMFIIPWGSHWIIGTT

SEQ ID NO: 1061934 - protein, 21 aa, Mycobacterium
KSVVQRGLWFEEFEIGTTYLH

SEQ ID NO: 1061935 - protein, 19 aa, Mycobacterium
KSYVRRLMREAGFTTVRTY

SEQ ID NO: 1061936 - protein, 18 aa, Mycobacterium
KTHCKTCLVVRREGPTIR

SEQ ID NO: 1061937 - protein, 17 aa, Mycobacterium
KTILCLKNRAIPATLHY

SEQ ID NO: 1061938 - protein, 22 aa, Mycobacterium
KTLRFWLERGVDGFRIDVAHGM

SEQ ID NO: 1061939 - protein, 17 aa, Mycobacterium
KTLSWVDANVWRRVIPK

SEQ ID NO: 1061940 - protein, 18 aa, Mycobacterium
KVAPAYRSSVSLSISASA

SEQ ID NO: 1061941 - protein, 18 aa, Mycobacterium
KVAWDFIHATGFLGGQIT

SEQ ID NO: 1061942 - protein, 17 aa, Mycobacterium
KVHLDAFNLLPYLTGEV

SEQ ID NO: 1061943 - protein, 18 aa, Mycobacterium
KVLRRFGKKPADTKTVLV

SEQ ID NO: 1061944 - protein, 18 aa, Mycobacterium
KVPRRLKELHLRLGAATA

SEQ ID NO: 1061945 - protein, 22 aa, Mycobacterium
KVSCAGLVLGSWPAHPGLVESS

SEQ ID NO: 1061946 - protein, 18 aa, Mycobacterium
KVVICLVNGWAAGGGHSL

SEQ ID NO: 1061947 - protein, 20 aa, Mycobacterium
KWLDEPCSFYDWRRSEEDGP

SEQ ID NO: 1061948 - protein, 18 aa, Mycobacterium
KWQRTEPEFAYSDRERDG

SEQ ID NO: 1061949 - protein, 24 aa, Mycobacterium
KWVTECIRAAYPLGRGHGPVSPLF

SEQ ID NO: 1061950 - protein, 18 aa, Mycobacterium
KYGGTSFELFAKISEKNH

SEQ ID NO: 1061951 - protein, 17 aa, Mycobacterium
KYRLVFEKLRLRPGDRL

SEQ ID NO: 1061952 - protein, 23 aa, Mycobacterium
LAAAKTRLGPVFSTRTRENVVLA

SEQ ID NO: 1061953 - protein, 17 aa, Mycobacterium
LAAEFVEALGLLARTPG

SEQ ID NO: 1061954 - protein, 23 aa, Mycobacterium
LAAELRLPLVLVIDTAGPALSAD

SEQ ID NO: 1061955 - protein, 22 aa, Mycobacterium
LAAERARLRFLLVDDAQQLDPQ

SEQ ID NO: 1061956 - protein, 19 aa, Mycobacterium
LAAGLLDWQAIRLGHPARD

SEQ ID NO: 1061957 - protein, 17 aa, Mycobacterium
LAALHWVRENIATFGGD

SEQ ID NO: 1061958 - protein, 20 aa, Mycobacterium
LAATRLGRFAGLVAIDRGHP

SEQ ID NO: 1061959 - protein, 22 aa, Mycobacterium
LAAWLVLCCRAMEAGAQEALAI

SEQ ID NO: 1061960 - protein, 22 aa, Mycobacterium
LACARLGIMHSVVFGGFTANTL

SEQ ID NO: 1061961 - protein, 18 aa, Mycobacterium
LACGNAFVLKPSERDPSV

SEQ ID NO: 1061962 - protein, 19 aa, Mycobacterium
LADIRIRKAILGLLDVDLL

SEQ ID NO: 1061963 - protein, 18 aa, Mycobacterium
LADLRVARLLAYRAVALR

SEQ ID NO: 1061964 - protein, 19 aa, Mycobacterium
LADMKARIDAARLLVWRAG

SEQ ID NO: 1061965 - protein, 22 aa, Mycobacterium
LAEAGWPVRVWIDLLPRQTTSA

SEQ ID NO: 1061966 - protein, 27 aa, Mycobacterium
LAELARVWKLLPFEADWFSSNELARHR

SEQ ID NO: 1061967 - protein, 18 aa, Mycobacterium
LAERDRFALLHGDYRLDN

SEQ ID NO: 1061968 - protein, 18 aa, Mycobacterium
LAEYVSWSLLDVVRAVPG

SEQ ID NO: 1061969 - protein, 17 aa, Mycobacterium
LAFALHCDIRIAAEDAR

SEQ ID NO: 1061970 - protein, 19 aa, Mycobacterium
LAFERQWWKFAGVKEDAIK

SEQ ID NO: 1061971 - protein, 17 aa, Mycobacterium
LAGGRRARHHPGMKPIS

SEQ ID NO: 1061972 - protein, 18 aa, Mycobacterium
LAGLRLALMHGRLSADEK

SEQ ID NO: 1061973 - protein, 21 aa, Mycobacterium
LAGQEAFVWIGLHEPDEKQMQ

SEQ ID NO: 1061974 - protein, 17 aa, Mycobacterium
LAGRALAGFGLTEPGAG

SEQ ID NO: 1061975 - protein, 18 aa, Mycobacterium
LAIVASTWHTKICDALLA

SEQ ID NO: 1061976 - protein, 20 aa, Mycobacterium
LAKACARAGAALIHVSTDYV

SEQ ID NO: 1061977 - protein, 17 aa, Mycobacterium
LAKMAGYHLGWWDVNGV

SEQ ID NO: 1061978 - protein, 20 aa, Mycobacterium
LALAWLLKRSPVMLPIPGTS

SEQ ID NO: 1061979 - protein, 24 aa, Mycobacterium
LALPRRLQIEFSRAIQEIAEGSAG

SEQ ID NO: 1061980 - protein, 17 aa, Mycobacterium
LANRPAIHVATYFGDPG

SEQ ID NO: 1061981 - protein, 17 aa, Mycobacterium
LAPGGAIVVGGRLDSAP

SEQ ID NO: 1061982 - protein, 19 aa, Mycobacterium
LAQIKRLKIGSGRRLASTT

SEQ ID NO: 1061983 - protein, 20 aa, Mycobacterium
LAREIACAFDLDFVDPADVA

SEQ ID NO: 1061984 - protein, 17 aa, Mycobacterium
LARLRGATLLAHNYQLP

SEQ ID NO: 1061985 - protein, 21 aa, Mycobacterium
LARRPAWLAACAEVGGGAAPG

SEQ ID NO: 1061986 - protein, 19 aa, Mycobacterium
LASLPARIAVRWRHTHNFE

SEQ ID NO: 1061987 - protein, 19 aa, Mycobacterium
LASWAVGWVPWIGILAPQI

SEQ ID NO: 1061988 - protein, 24 aa, Mycobacterium
LATEILDPLGFRWTNFGVAEEDLP

SEQ ID NO: 1061989 - protein, 19 aa, Mycobacterium
LATLWSEFGPNANIWNTIA

SEQ ID NO: 1061990 - protein, 18 aa, Mycobacterium
LATPGVAVGDHFELLAMA

SEQ ID NO: 1061991 - protein, 17 aa, Mycobacterium
LAVEKVLRGVGLRLLVP

SEQ ID NO: 1061992 - protein, 17 aa, Mycobacterium
LAWLHAPGMDFGPALAA

SEQ ID NO: 1061993 - protein, 20 aa, Mycobacterium
LAWRTKRLIVFDVDSTLVQG

SEQ ID NO: 1061994 - protein, 17 aa, Mycobacterium
LAYCAACTNRLRLGVAV

SEQ ID NO: 1061995 - protein, 18 aa, Mycobacterium
LCAFKDIIDRSAAAGDPC

SEQ ID NO: 1061996 - protein, 22 aa, Mycobacterium
LCGALRRYHEALGMPISTLPMA

SEQ ID NO: 1061997 - protein, 17 aa, Mycobacterium
LCSTWDLTDWRGKPIRI

SEQ ID NO: 1061998 - protein, 17 aa, Mycobacterium
LDAAALLHRLSLKVPVR

SEQ ID NO: 1061999 - protein, 19 aa, Mycobacterium
LDDVVKFLLPRGAAKKTAK

SEQ ID NO: 1062000 - protein, 18 aa, Mycobacterium
LDEGRIVLVAGFQGVSQD

SEQ ID NO: 1062001 - protein, 18 aa, Mycobacterium
LDERLHHLFARMPDARVH

SEQ ID NO: 1062002 - protein, 19 aa, Mycobacterium
LDEYVDWLVDAGCPIRRIP

SEQ ID NO: 1062003 - protein, 24 aa, Mycobacterium
LDGYPRPGKTVLFLGRYDEPRKGM

SEQ ID NO: 1062004 - protein, 18 aa, Mycobacterium
LDIGCGWGGALQRAVEKY

SEQ ID NO: 1062005 - protein, 23 aa, Mycobacterium
LDIRPNLGIGHPCWADYLPVTRA

SEQ ID NO: 1062006 - protein, 30 aa, Mycobacterium
LDIYRIGQYIAWRLWINIAFDLTSDPQELH

SEQ ID NO: 1062007 - protein, 17 aa, Mycobacterium
LDLAPLVADNGYNAIDR

SEQ ID NO: 1062008 - protein, 18 aa, Mycobacterium
LDLAWSLLGYDGEEPRAD

SEQ ID NO: 1062009 - protein, 20 aa, Mycobacterium
LDLCPRIRVNAIAPGSILTS

SEQ ID NO: 1062010 - protein, 17 aa, Mycobacterium
LDLPRDALIVFTGLSGS

SEQ ID NO: 1062011 - protein, 24 aa, Mycobacterium
LDLVVRAGREWKVREIPLAEVEKA

SEQ ID NO: 1062012 - protein, 17 aa, Mycobacterium
LDMLRWHGAEEVEHKAV

SEQ ID NO: 1062013 - protein, 17 aa, Mycobacterium
LDMRLGSILGRRPTALE

SEQ ID NO: 1062014 - protein, 23 aa, Mycobacterium
LDRSFKVGGCFAGPQNMKLRDVL

SEQ ID NO: 1062015 - protein, 17 aa, Mycobacterium
LDRTSWRAEQPIVIVAP

SEQ ID NO: 1062016 - protein, 23 aa, Mycobacterium
LDSRAWRLPWPDGTVVYELDQPR

SEQ ID NO: 1062017 - protein, 17 aa, Mycobacterium
LDSWPVNIALLGKGNTV

SEQ ID NO: 1062018 - protein, 19 aa, Mycobacterium
LDVGCGWGGMVRYAARHGA

SEQ ID NO: 1062019 - protein, 20 aa, Mycobacterium
LEAAAAWGSLADELQVAASS

SEQ ID NO: 1062020 - protein, 21 aa, Mycobacterium
LEALLRVLEPFGIREIAQSGM

SEQ ID NO: 1062021 - protein, 22 aa, Mycobacterium
LEELKGLWFYYAGVYKGLPLDD

SEQ ID NO: 1062022 - protein, 25 aa, Mycobacterium
LEGLSAWLEFVWKPGYADYYPELPG

SEQ ID NO: 1062023 - protein, 19 aa, Mycobacterium
LEHPEIWCAIIDFDNSVPA

SEQ ID NO: 1062024 - protein, 20 aa, Mycobacterium
LELFQARALHPLPIKTWDVR

SEQ ID NO: 1062025 - protein, 17 aa, Mycobacterium
LELGMDWDRIDQLKRSG

SEQ ID NO: 1062026 - protein, 19 aa, Mycobacterium
LELRTSWRNPPRALHLANA

SEQ ID NO: 1062027 - protein, 19 aa, Mycobacterium
LELVYHFGRPMRARRRGGI

SEQ ID NO: 1062028 - protein, 17 aa, Mycobacterium
LELYLAVLERHMNNLVS

SEQ ID NO: 1062029 - protein, 18 aa, Mycobacterium
LELYLAVLERHMNNLVSS

SEQ ID NO: 1062030 - protein, 23 aa, Mycobacterium
LEPNLRVLVNFGYGDPAYGYDTG

SEQ ID NO: 1062031 - protein, 21 aa, Mycobacterium
LERLPRLKLITIVGMNLPNLD

SEQ ID NO: 1062032 - protein, 19 aa, Mycobacterium
LESWIPLLALFAHAGAHDW

SEQ ID NO: 1062033 - protein, 20 aa, Mycobacterium
LEVEEVFLPLARLLHLQVAA

SEQ ID NO: 1062034 - protein, 23 aa, Mycobacterium
LEVIDLRSLIPLDFETIAASIRR

SEQ ID NO: 1062035 - protein, 18 aa, Mycobacterium
LEVLIAVVNRLGWTHGCE

SEQ ID NO: 1062036 - protein, 18 aa, Mycobacterium
LEVLPARAFGVVMRGTAR

SEQ ID NO: 1062037 - protein, 18 aa, Mycobacterium
LEYHWGPDWVCWDADQTF

SEQ ID NO: 1062038 - protein, 19 aa, Mycobacterium
LFAAFGMFAVGFYDLRSAR

SEQ ID NO: 1062039 - protein, 22 aa, Mycobacterium
LFALGRLPGWIAHWREMHDEGD

SEQ ID NO: 1062040 - protein, 18 aa, Mycobacterium
LFALLAYGEVAAFYRLTD

SEQ ID NO: 1062041 - protein, 17 aa, Mycobacterium
LFFPEPRCRVVTAVGPY

SEQ ID NO: 1062042 - protein, 18 aa, Mycobacterium
LFGSGRIGGDGGFGSNTG

SEQ ID NO: 1062043 - protein, 17 aa, Mycobacterium
LFGTHALEYQAISTQLS

SEQ ID NO: 1062044 - protein, 18 aa, Mycobacterium
LFLEVAWEALENAGISPQ

SEQ ID NO: 1062045 - protein, 19 aa, Mycobacterium
LFRYPGIRSDSDMHTLGFR

SEQ ID NO: 1062046 - protein, 24 aa, Mycobacterium
LFSALELLHAWALIHDDVIDASST

SEQ ID NO: 1062047 - protein, 19 aa, Mycobacterium
LFTEHAFYFGDTHVRLRGK

SEQ ID NO: 1062048 - protein, 17 aa, Mycobacterium
LFYGTGIPTCIVILDKE

SEQ ID NO: 1062049 - protein, 17 aa, Mycobacterium
LGAALWRRGIHRVLHGF

SEQ ID NO: 1062050 - protein, 17 aa, Mycobacterium
LGAAMTMLQQPTSQADL

SEQ ID NO: 1062051 - protein, 17 aa, Mycobacterium
LGALVLTSCDAFEHFPP

SEQ ID NO: 1062052 - protein, 17 aa, Mycobacterium
LGAPCWIDLTTSDIDRA

SEQ ID NO: 1062053 - protein, 18 aa, Mycobacterium
LGAQAGAFHSQFIQALTG

SEQ ID NO: 1062054 - protein, 20 aa, Mycobacterium
LGATCVSLWSGYSVSYSDAA

SEQ ID NO: 1062055 - protein, 19 aa, Mycobacterium
LGCRFRRCLMLGLSVVGMR

SEQ ID NO: 1062056 - protein, 20 aa, Mycobacterium
LGEQCAFGLALIAPRLPPFD

SEQ ID NO: 1062057 - protein, 17 aa, Mycobacterium
LGEVLGCILGGGSVDKS

SEQ ID NO: 1062058 - protein, 24 aa, Mycobacterium
LGHRIRAAIHFDDLQWERSYNRVA

SEQ ID NO: 1062059 - protein, 18 aa, Mycobacterium
LGITTGWKSRWYADKQYA

SEQ ID NO: 1062060 - protein, 17 aa, Mycobacterium
LGLDYVDLYLIHWPAPA

SEQ ID NO: 1062061 - protein, 17 aa, Mycobacterium
LGLLYRWVEQAFGGREH

SEQ ID NO: 1062062 - protein, 18 aa, Mycobacterium
LGPKRARLLNPLALLASQ

SEQ ID NO: 1062063 - protein, 19 aa, Mycobacterium
LGPRGRHVVLAKSFGGPTV

SEQ ID NO: 1062064 - protein, 21 aa, Mycobacterium
LGRPLIGDGANGWPNTGGDGG

SEQ ID NO: 1062065 - protein, 18 aa, Mycobacterium
LGSGCLMPGFVEAHGHPL

SEQ ID NO: 1062066 - protein, 22 aa, Mycobacterium
LGSGNWRSGNLGNENIGFGNTG

SEQ ID NO: 1062067 - protein, 22 aa, Mycobacterium
LGSLRVGNRFVHTGKPTAAGYA

SEQ ID NO: 1062068 - protein, 21 aa, Mycobacterium
LGSRSALAWIIDRYQVKTDKA

SEQ ID NO: 1062069 - protein, 17 aa, Mycobacterium
LGVDTSVLWSALRQPEV

SEQ ID NO: 1062070 - protein, 23 aa, Mycobacterium
LGVGWPKEFGGLGFGPIEQQIFV

SEQ ID NO: 1062071 - protein, 17 aa, Mycobacterium
LGVLPGMGGSQRLTRAI

SEQ ID NO: 1062072 - protein, 22 aa, Mycobacterium
LGVSGRACWLGRWRDWMLDHRD

SEQ ID NO: 1062073 - protein, 20 aa, Mycobacterium
LGWLCVWAVLEAVAEPGSAA

SEQ ID NO: 1062074 - protein, 18 aa, Mycobacterium
LGYDEAWFGEHHSGGYEL

SEQ ID NO: 1062075 - protein, 23 aa, Mycobacterium
LGYRVRRLAGRVVWLAPPDAPTP

SEQ ID NO: 1062076 - protein, 18 aa, Mycobacterium
LHFEGLRTLALPLRIHLE

SEQ ID NO: 1062077 - protein, 22 aa, Mycobacterium
LHGLQLFGAMGFTWGNDLQFAL

SEQ ID NO: 1062078 - protein, 19 aa, Mycobacterium
LHHTYSFLGIETYRQVSTE

SEQ ID NO: 1062079 - protein, 18 aa, Mycobacterium
LHIKSCCATRSFVPLWDY

SEQ ID NO: 1062080 - protein, 23 aa, Mycobacterium
LHKGAQIMSSFDWTRNTFDPTVE

SEQ ID NO: 1062081 - protein, 19 aa, Mycobacterium
LHLPWQWGAAWFLDQLTDG

SEQ ID NO: 1062082 - protein, 25 aa, Mycobacterium
LHPDLKWDFRLPRVVSINVSGHKYG

SEQ ID NO: 1062083 - protein, 18 aa, Mycobacterium
LHPLSAPMTLRWLTDRFA

SEQ ID NO: 1062084 - protein, 17 aa, Mycobacterium
LHRCPRPVVVVPNPMLA

SEQ ID NO: 1062085 - protein, 18 aa, Mycobacterium
LIAARWGLSRTQLDEFSA

SEQ ID NO: 1062086 - protein, 18 aa, Mycobacterium
LIAWLLERGFSFEHIQAS

SEQ ID NO: 1062087 - protein, 19 aa, Mycobacterium
LIDRIGVGKVMWSSDYPHN

SEQ ID NO: 1062088 - protein, 19 aa, Mycobacterium
LIGARLNWLLGHGESPQWS

SEQ ID NO: 1062089 - protein, 21 aa, Mycobacterium
LIGSPCWRAAAASRGDLKPVG

SEQ ID NO: 1062090 - protein, 17 aa, Mycobacterium
LIHCGRLSVEKHVDRSI

SEQ ID NO: 1062091 - protein, 17 aa, Mycobacterium
LIKVLRKRGRILQSAPN

SEQ ID NO: 1062092 - protein, 17 aa, Mycobacterium
LILADAIVRACEDNPDY

SEQ ID NO: 1062093 - protein, 18 aa, Mycobacterium
LINFPASQLLKFAPHPGL

SEQ ID NO: 1062094 - protein, 17 aa, Mycobacterium
LIQQLLEFGWRPDDSVI

SEQ ID NO: 1062095 - protein, 23 aa, Mycobacterium
LIRLHHSRFPQARFELHQRSGQG

SEQ ID NO: 1062096 - protein, 18 aa, Mycobacterium
LISLVLDWKRPVKVFIET

SEQ ID NO: 1062097 - protein, 17 aa, Mycobacterium
LKAANTWHASRAIQEAR

SEQ ID NO: 1062098 - protein, 20 aa, Mycobacterium
LKACIKAAADRVVFINTGFL

SEQ ID NO: 1062099 - protein, 22 aa, Mycobacterium
LKAEQWRPGAVLQNARELADIC

SEQ ID NO: 1062100 - protein, 17 aa, Mycobacterium
LKLSALRGLFSAVVEGP

SEQ ID NO: 1062101 - protein, 20 aa, Mycobacterium
LKTHCKTCLVVRREGPTIRR

SEQ ID NO: 1062102 - protein, 18 aa, Mycobacterium
LKTLMSRTAGLSLHYVGR

SEQ ID NO: 1062103 - protein, 17 aa, Mycobacterium
LKVARKWGADVKGVPEG

SEQ ID NO: 1062104 - protein, 23 aa, Mycobacterium
LKVGDKVGNAWLWSACGSCEQCR

SEQ ID NO: 1062105 - protein, 19 aa, Mycobacterium
LLAAMPPFLTGGSMIETVT

SEQ ID NO: 1062106 - protein, 17 aa, Mycobacterium
LLADLSFADYLMWVARD

SEQ ID NO: 1062107 - protein, 17 aa, Mycobacterium
LLAPHWPAPYGRGASPA

SEQ ID NO: 1062108 - protein, 19 aa, Mycobacterium
LLARLGKRVLRPGGVELTR

SEQ ID NO: 1062109 - protein, 23 aa, Mycobacterium
LLARRLVDVTGWLAAQPDTTALP

SEQ ID NO: 1062110 - protein, 22 aa, Mycobacterium
LLDALRWLGLDWDEGPEVDGPY

SEQ ID NO: 1062111 - protein, 19 aa, Mycobacterium
LLDLLRLGAYQLLRTRVDA

SEQ ID NO: 1062112 - protein, 18 aa, Mycobacterium
LLDRVSSKYALVIYAAKR

SEQ ID NO: 1062113 - protein, 18 aa, Mycobacterium
LLEFGWRPDDSVILAAAG

SEQ ID NO: 1062114 - protein, 18 aa, Mycobacterium
LLEPVGACRQCLVEVEGQ

SEQ ID NO: 1062115 - protein, 17 aa, Mycobacterium
LLESFLFYSGFYLPMYW

SEQ ID NO: 1062116 - protein, 18 aa, Mycobacterium
LLFGISYERIEVVVHPQS

SEQ ID NO: 1062117 - protein, 23 aa, Mycobacterium
LLGGLPVRRLWGIGPVAEEKLHR

SEQ ID NO: 1062118 - protein, 25 aa, Mycobacterium
LLGPVADLFPILALPGQDVQGFSNL

SEQ ID NO: 1062119 - protein, 17 aa, Mycobacterium
LLGVPFSAPYSFDTPFG

SEQ ID NO: 1062120 - protein, 18 aa, Mycobacterium
LLILRPGFVIGRMTEGMA

SEQ ID NO: 1062121 - protein, 17 aa, Mycobacterium
LLLAHGYDHNWVINRAD

SEQ ID NO: 1062122 - protein, 18 aa, Mycobacterium
LLLARAVLSPARIVLLDE

SEQ ID NO: 1062123 - protein, 21 aa, Mycobacterium
LLLEVVCARLLLPSASDAESA

SEQ ID NO: 1062124 - protein, 17 aa, Mycobacterium
LLLPLGVRSLRAYGPTR

SEQ ID NO: 1062125 - protein, 21 aa, Mycobacterium
LLLRLRFELDYHINLRPGRLY

SEQ ID NO: 1062126 - protein, 17 aa, Mycobacterium
LLNPLALLASQGVPLAF

SEQ ID NO: 1062127 - protein, 17 aa, Mycobacterium
LLNRVQWIYAGIASDTG

SEQ ID NO: 1062128 - protein, 20 aa, Mycobacterium
LLPTHCWFEPKGWGFQVYPA

SEQ ID NO: 1062129 - protein, 20 aa, Mycobacterium
LLPTVRGAFCLTFMDENTLY

SEQ ID NO: 1062130 - protein, 19 aa, Mycobacterium
LLQRPRCLYFRDVSAACNR

SEQ ID NO: 1062131 - protein, 23 aa, Mycobacterium
LLQRSWIAIFWGRFAQAVEMIAQ

SEQ ID NO: 1062132 - protein, 22 aa, Mycobacterium
LLREFLDWLFARYLEIVDGEPN

SEQ ID NO: 1062133 - protein, 19 aa, Mycobacterium
LLRFFFKSWFRVEVSGVEN

SEQ ID NO: 1062134 - protein, 20 aa, Mycobacterium
LLRSDILPLSFGFPFGISAA

SEQ ID NO: 1062135 - protein, 17 aa, Mycobacterium
LLSGLLRAGRQVKDLVV

SEQ ID NO: 1062136 - protein, 21 aa, Mycobacterium
LLSKLRAGKVLSLSGIMDDLI

SEQ ID NO: 1062137 - protein, 20 aa, Mycobacterium
LLVGKCCGHGSNIVLDFPVS

SEQ ID NO: 1062138 - protein, 26 aa, Mycobacterium
LLVQPAHTLSQAWITSPLGQVVDPVI

SEQ ID NO: 1062139 - protein, 19 aa, Mycobacterium
LLVRGGVVFSGYWRNEQAT

SEQ ID NO: 1062140 - protein, 24 aa, Mycobacterium
LLYGNGGAGGWLFGQGGVGGNGGT

SEQ ID NO: 1062141 - protein, 19 aa, Mycobacterium
LLYRLERPLFFAFQCLPLN

SEQ ID NO: 1062142 - protein, 18 aa, Mycobacterium
LMDSRPGYKYGDVTVLDH

SEQ ID NO: 1062143 - protein, 25 aa, Mycobacterium
LMDTHPFMWLPMLSRVLGSAQLLPE

SEQ ID NO: 1062144 - protein, 17 aa, Mycobacterium
LMLAWRCDLIVAADDTV

SEQ ID NO: 1062145 - protein, 23 aa, Mycobacterium
LMVDPRTGRMLIIDKTSSGNPAI

SEQ ID NO: 1062146 - protein, 17 aa, Mycobacterium
LNAMWRRGDEVFAEVAL

SEQ ID NO: 1062147 - protein, 24 aa, Mycobacterium
LNELDRVGGRYGLHTMCEGGGTAN

SEQ ID NO: 1062148 - protein, 17 aa, Mycobacterium
LNFSCPIEQAWDRLRAA

SEQ ID NO: 1062149 - protein, 25 aa, Mycobacterium
LNLSFPISLPISIDIGKIVIESFTL

SEQ ID NO: 1062150 - protein, 18 aa, Mycobacterium
LNLVKCVHWPSGSTTDAP

SEQ ID NO: 1062151 - protein, 19 aa, Mycobacterium
LNMAIPWIAAERGYIDAVV

SEQ ID NO: 1062152 - protein, 18 aa, Mycobacterium
LNMLIEFGDAFDYTGADF

SEQ ID NO: 1062153 - protein, 17 aa, Mycobacterium
LNMMAHLLSTIDYRPVE

SEQ ID NO: 1062154 - protein, 20 aa, Mycobacterium
LNPMPRWYIGSVLRHVDFLT

SEQ ID NO: 1062155 - protein, 26 aa, Mycobacterium
LNQLWMCGLPGYFPGDLIDFEFSGDT

SEQ ID NO: 1062156 - protein, 24 aa, Mycobacterium
LNRLRRWYCDGALCIGDAAHAMSP

SEQ ID NO: 1062157 - protein, 17 aa, Mycobacterium
LNRWPQWDIGYDSLQLA

SEQ ID NO: 1062158 - protein, 17 aa, Mycobacterium
LNSKTRRPSVCNAAETL

SEQ ID NO: 1062159 - protein, 17 aa, Mycobacterium
LNVLPVYGGSSYAIQLA

SEQ ID NO: 1062160 - protein, 25 aa, Mycobacterium
LNWWESRALYGWTVLVPRTKDQAGE

SEQ ID NO: 1062161 - protein, 17 aa, Mycobacterium
LPADAWPPTSWYADWVS

SEQ ID NO: 1062162 - protein, 18 aa, Mycobacterium
LPAHEADAYLGLLLAKAG

SEQ ID NO: 1062163 - protein, 17 aa, Mycobacterium
LPAMVCYWSELARDAAL

SEQ ID NO: 1062164 - protein, 18 aa, Mycobacterium
LPAPRYGTATTFAQARRI

SEQ ID NO: 1062165 - protein, 18 aa, Mycobacterium
LPARLAGAIAGEIRAVLR

SEQ ID NO: 1062166 - protein, 23 aa, Mycobacterium
LPAWGSLRLALPMNGNSDATFLA

SEQ ID NO: 1062167 - protein, 19 aa, Mycobacterium
LPDAISLVLSHRAPHRVVV

SEQ ID NO: 1062168 - protein, 21 aa, Mycobacterium
LPEERICLCGNTFGPLFGHIP

SEQ ID NO: 1062169 - protein, 18 aa, Mycobacterium
LPEHLHKVSLSFLVDDLV

SEQ ID NO: 1062170 - protein, 18 aa, Mycobacterium
LPEWLSADVAILGEPTSG

SEQ ID NO: 1062171 - protein, 23 aa, Mycobacterium
LPGHSPCGLGFRPDGTLLIASAH

SEQ ID NO: 1062172 - protein, 20 aa, Mycobacterium
LPGIWYAGSHGFELTAPDGT

SEQ ID NO: 1062173 - protein, 18 aa, Mycobacterium
LPGVWLIDVERVQREPSA

SEQ ID NO: 1062174 - protein, 20 aa, Mycobacterium
LPGYQGWQWAAVVASYVGAD

SEQ ID NO: 1062175 - protein, 17 aa, Mycobacterium
LPHGVEVIGYWGEAVTT

SEQ ID NO: 1062176 - protein, 17 aa, Mycobacterium
LPIVLPIVLAYIGNQLG

SEQ ID NO: 1062177 - protein, 19 aa, Mycobacterium
LPLAGSLGVMFGVCGNELA

SEQ ID NO: 1062178 - protein, 17 aa, Mycobacterium
LPLIWKRLVDAGMESGH

SEQ ID NO: 1062179 - protein, 21 aa, Mycobacterium
LPLKRAVVLRGLLSWPEDSAA

SEQ ID NO: 1062180 - protein, 18 aa, Mycobacterium
LPLLLLDEGHCLRDQALD

SEQ ID NO: 1062181 - protein, 20 aa, Mycobacterium
LPLLRPRQVIMLGRPTLHRP

SEQ ID NO: 1062182 - protein, 22 aa, Mycobacterium
LPLLRRAAGRIVVIASIGDRFT

SEQ ID NO: 1062183 - protein, 18 aa, Mycobacterium
LPLPVGIGHHRFVNDVTP

SEQ ID NO: 1062184 - protein, 22 aa, Mycobacterium
LPLTLWLARFLKFIQTEIFPGG

SEQ ID NO: 1062185 - protein, 17 aa, Mycobacterium
LPLVAGMAFSIEPGIYF

SEQ ID NO: 1062186 - protein, 17 aa, Mycobacterium
LPPGGGISWAYRNLSPY

SEQ ID NO: 1062187 - protein, 21 aa, Mycobacterium
LPQEWLRFGWFFLVTRHDPKG

SEQ ID NO: 1062188 - protein, 25 aa, Mycobacterium
LPQFLKGCIQLGAWPLLDTTWEMAP

SEQ ID NO: 1062189 - protein, 18 aa, Mycobacterium
LPQPECFESFLNHHWAFD

SEQ ID NO: 1062190 - protein, 18 aa, Mycobacterium
LPQVFFVNWFRRGEDHRF

SEQ ID NO: 1062191 - protein, 21 aa, Mycobacterium
LPRACPLPMPGHGRCYSPAQP

SEQ ID NO: 1062192 - protein, 24 aa, Mycobacterium
LPRRLADGLPIVFGTKVDSIVHKD

SEQ ID NO: 1062193 - protein, 26 aa, Mycobacterium
LPRRWPTRWPSCWAAMHAPTRRSPPP

SEQ ID NO: 1062194 - protein, 19 aa, Mycobacterium
LPRYIGGVLARLQEVWMGR

SEQ ID NO: 1062195 - protein, 18 aa, Mycobacterium
LPTLMAFKKGKLVFKQAG

SEQ ID NO: 1062196 - protein, 20 aa, Mycobacterium
LPVIFSHGFADSAVIRNPDD

SEQ ID NO: 1062197 - protein, 23 aa, Mycobacterium
LPVIPMPFGFGIWTSHTTPIYLG

SEQ ID NO: 1062198 - protein, 23 aa, Mycobacterium
LPVKLCYAGPFFRYERPQAGRYR

SEQ ID NO: 1062199 - protein, 17 aa, Mycobacterium
LPVLWRLPCGKSRTPRA

SEQ ID NO: 1062200 - protein, 17 aa, Mycobacterium
LPVYIISIGRTFRTDEL

SEQ ID NO: 1062201 - protein, 17 aa, Mycobacterium
LPVYVISIGRAFRTDEV

SEQ ID NO: 1062202 - protein, 20 aa, Mycobacterium
LQALAPLLGSWVGRGMGKYP

SEQ ID NO: 1062203 - protein, 20 aa, Mycobacterium
LQFTGRPLVGPGTDGAPGTG

SEQ ID NO: 1062204 - protein, 19 aa, Mycobacterium
LQHPDTFARLGVEPPRGVL

SEQ ID NO: 1062205 - protein, 22 aa, Mycobacterium
LQRMSTVIGRRVWENAGSPEVD

SEQ ID NO: 1062206 - protein, 22 aa, Mycobacterium
LQRMSTVLSRRLWENAGSPEVD

SEQ ID NO: 1062207 - protein, 17 aa, Mycobacterium
LQSCGLVAVGHRVVHGG

SEQ ID NO: 1062208 - protein, 19 aa, Mycobacterium
LQTGVRWKDLGLVVVDEEQ

SEQ ID NO: 1062209 - protein, 20 aa, Mycobacterium
LQWLGIDCIWLPPFYDSPLR

SEQ ID NO: 1062210 - protein, 20 aa, Mycobacterium
LRAAEAFARMWDMGVAESIS

SEQ ID NO: 1062211 - protein, 18 aa, Mycobacterium
LRAAFWDRDVPKPVQIVP

SEQ ID NO: 1062212 - protein, 18 aa, Mycobacterium
LRAAIPVMRQQRFGRIVA

SEQ ID NO: 1062213 - protein, 20 aa, Mycobacterium
LRAAVHRAAGDRGCGGRAPR

SEQ ID NO: 1062214 - protein, 18 aa, Mycobacterium
LRAAVLDFSDNVRRAERA

SEQ ID NO: 1062215 - protein, 18 aa, Mycobacterium
LRAFLTFAEHAPRFALDQ

SEQ ID NO: 1062216 - protein, 18 aa, Mycobacterium
LRAIAGLVLVAGFETTVN

SEQ ID NO: 1062217 - protein, 23 aa, Mycobacterium
LRARSAGLLTAWVATSFDVLASR

SEQ ID NO: 1062218 - protein, 19 aa, Mycobacterium
LRDLLKFDFYFADSAAFRA

SEQ ID NO: 1062219 - protein, 19 aa, Mycobacterium
LRELCKMDGAVVLSTDGSR

SEQ ID NO: 1062220 - protein, 19 aa, Mycobacterium
LRESPAWITGFEHRIESPS

SEQ ID NO: 1062221 - protein, 17 aa, Mycobacterium
LRFASWRDIHQTAVRVA

SEQ ID NO: 1062222 - protein, 19 aa, Mycobacterium
LRFGLELVECAEFFKDTTF

SEQ ID NO: 1062223 - protein, 18 aa, Mycobacterium
LRGANLWDEVKDRMDRPG

SEQ ID NO: 1062224 - protein, 19 aa, Mycobacterium
LRGLFRWWGLYTQREQGYD

SEQ ID NO: 1062225 - protein, 19 aa, Mycobacterium
LRGLLGAFMFTGPQLDQPA

SEQ ID NO: 1062226 - protein, 18 aa, Mycobacterium
LRGLRLQHLVAMGESQSA

SEQ ID NO: 1062227 - protein, 24 aa, Mycobacterium
LRITARYAQHWNFAGGTPEEFARK

SEQ ID NO: 1062228 - protein, 26 aa, Mycobacterium
LRKFLADRVVRWWLPERWAFADQVPR

SEQ ID NO: 1062229 - protein, 20 aa, Mycobacterium
LRKLFHAVGVVFKGSGFYRT

SEQ ID NO: 1062230 - protein, 19 aa, Mycobacterium
LRLDQMIRYYVEHQLDVTI

SEQ ID NO: 1062231 - protein, 21 aa, Mycobacterium
LRLECACPIPWDIDLNETAPI

SEQ ID NO: 1062232 - protein, 22 aa, Mycobacterium
LRLECACPIPWDIDLNGTAPIS

SEQ ID NO: 1062233 - protein, 23 aa, Mycobacterium
LRLGEYDVLVGINLLREGLDLPE

SEQ ID NO: 1062234 - protein, 17 aa, Mycobacterium
LRLPVLATSLFWVSSSI

SEQ ID NO: 1062235 - protein, 23 aa, Mycobacterium
LRLRDIGGIVVIDFIDMVLESNR

SEQ ID NO: 1062236 - protein, 18 aa, Mycobacterium
LRLRGMSAMFARIKRRLR

SEQ ID NO: 1062237 - protein, 18 aa, Mycobacterium
LRLRIGLNSGEVITGGIG

SEQ ID NO: 1062238 - protein, 18 aa, Mycobacterium
LRNEGLNWVTWVDGETTY

SEQ ID NO: 1062239 - protein, 23 aa, Mycobacterium
LRPEIWGEFTKRFDIDRVCEFYA

SEQ ID NO: 1062240 - protein, 24 aa, Mycobacterium
LRPTRAGAVPTIWNDVMHYLEKNP

SEQ ID NO: 1062241 - protein, 21 aa, Mycobacterium
LRPVLFSTFLMWVLADLFTYL

SEQ ID NO: 1062242 - protein, 18 aa, Mycobacterium
LRPWVPVVSLVKGLEQGT

SEQ ID NO: 1062243 - protein, 17 aa, Mycobacterium
LRQAAILALGGRPEELT

SEQ ID NO: 1062244 - protein, 20 aa, Mycobacterium
LRQRIGMVFQHFNLFPHRNV

SEQ ID NO: 1062245 - protein, 19 aa, Mycobacterium
LRQTARELAEWVGSRADSA

SEQ ID NO: 1062246 - protein, 20 aa, Mycobacterium
LRQYRYEFLDADGYPTTVDP

SEQ ID NO: 1062247 - protein, 20 aa, Mycobacterium
LRRMGELFAPFTKIAAGNPF

SEQ ID NO: 1062248 - protein, 18 aa, Mycobacterium
LRRNIRWDPLDSVYFAGY

SEQ ID NO: 1062249 - protein, 18 aa, Mycobacterium
LRRSIKFATFLDAIDAVR

SEQ ID NO: 1062250 - protein, 18 aa, Mycobacterium
LRSAAPWADGLAGTTLDL

SEQ ID NO: 1062251 - protein, 18 aa, Mycobacterium
LRSARGFGGPVIVHVVTR

SEQ ID NO: 1062252 - protein, 17 aa, Mycobacterium
LRSEAAFARLCGVAPIP

SEQ ID NO: 1062253 - protein, 24 aa, Mycobacterium
LRSELKMLPALPVAELRAQADELA

SEQ ID NO: 1062254 - protein, 20 aa, Mycobacterium
LRSGMTIGIAGWGSRRKPMA

SEQ ID NO: 1062255 - protein, 17 aa, Mycobacterium
LRSLLRFVLDLLSDYGL

SEQ ID NO: 1062256 - protein, 18 aa, Mycobacterium
LRTDRDWIADIVRFVTSR

SEQ ID NO: 1062257 - protein, 17 aa, Mycobacterium
LRTTVQFIGPLSVVDNV

SEQ ID NO: 1062258 - protein, 18 aa, Mycobacterium
LRVGLPMVPNTVFIAFGE

SEQ ID NO: 1062259 - protein, 17 aa, Mycobacterium
LRVLGLHLLHLLQTVSY

SEQ ID NO: 1062260 - protein, 18 aa, Mycobacterium
LRVRFCAPAPPAPAAPPL

SEQ ID NO: 1062261 - protein, 19 aa, Mycobacterium
LRWALPVAYRLPGLGRLRA

SEQ ID NO: 1062262 - protein, 20 aa, Mycobacterium
LRWERFAVVTNIEWIKQTVK

SEQ ID NO: 1062263 - protein, 24 aa, Mycobacterium
LRYFWPRVVGDIGWQLLDSKFAVV

SEQ ID NO: 1062264 - protein, 20 aa, Mycobacterium
LRYISVPALVAYAGGDPWAI

SEQ ID NO: 1062265 - protein, 20 aa, Mycobacterium
LRYTMPLGEIIFDFFDSLIS

SEQ ID NO: 1062266 - protein, 17 aa, Mycobacterium
LSAKLAVLWFPNQGSED

SEQ ID NO: 1062267 - protein, 21 aa, Mycobacterium
LSAPMTLRWLTDRFAGLPLTE

SEQ ID NO: 1062268 - protein, 18 aa, Mycobacterium
LSAQLSEFHDQFVRTLNA

SEQ ID NO: 1062269 - protein, 27 aa, Mycobacterium
LSAQMAAFHDRFMNALAGASGSYASAE

SEQ ID NO: 1062270 - protein, 25 aa, Mycobacterium
LSAQMARFHDQFVRSLSGAAQTYAR

SEQ ID NO: 1062271 - protein, 25 aa, Mycobacterium
LSARPAATCLIDWGTADRHAHREGV

SEQ ID NO: 1062272 - protein, 18 aa, Mycobacterium
LSDFMTEYVFPAEADYDK

SEQ ID NO: 1062273 - protein, 20 aa, Mycobacterium
LSEGIPVRLVCAGSAGSAGS

SEQ ID NO: 1062274 - protein, 24 aa, Mycobacterium
LSEWVVRCSIGFRIGQNVTPSDLE

SEQ ID NO: 1062275 - protein, 18 aa, Mycobacterium
LSGGHLFSLYDGCRDEGV

SEQ ID NO: 1062276 - protein, 20 aa, Mycobacterium
LSGYEIPTQISIVAEIPRTA

SEQ ID NO: 1062277 - protein, 21 aa, Mycobacterium
LSIWPDWVRRWPTASATATAT

SEQ ID NO: 1062278 - protein, 23 aa, Mycobacterium
LSKLARPTSTWTYMVNDNPLSDD

SEQ ID NO: 1062279 - protein, 19 aa, Mycobacterium
LSKPFTFKRVEALRPTIQQ

SEQ ID NO: 1062280 - protein, 17 aa, Mycobacterium
LSKRGGGVALLLTNIRE

SEQ ID NO: 1062281 - protein, 19 aa, Mycobacterium
LSLSRLSSVVLRSNLAART

SEQ ID NO: 1062282 - protein, 22 aa, Mycobacterium
LSMAHLRGTLDIFARAEFGPST

SEQ ID NO: 1062283 - protein, 24 aa, Mycobacterium
LSMASAFWPYVTWTSMVATQAREA

SEQ ID NO: 1062284 - protein, 41 aa, Mycobacterium
LSPRGLRWCRRRWWRLTVRTWCRWCFRIFSGKTRQRLPPWR

SEQ ID NO: 1062285 - protein, 22 aa, Mycobacterium
LSRLFRLPLNWRTLCTRSVRQC

SEQ ID NO: 1062286 - protein, 20 aa, Mycobacterium
LSVVVGESWRAEALAEMMRE

SEQ ID NO: 1062287 - protein, 17 aa, Mycobacterium
LTAQDVFNNVARTCIEA

SEQ ID NO: 1062288 - protein, 18 aa, Mycobacterium
LTDDRIAYADGWFAETHD

SEQ ID NO: 1062289 - protein, 19 aa, Mycobacterium
LTFEIARFIKFIVTEIFPG

SEQ ID NO: 1062290 - protein, 18 aa, Mycobacterium
LTGIAGLAVDGQRAQVRG

SEQ ID NO: 1062291 - protein, 19 aa, Mycobacterium
LTGLRLATKLHEWEPKHGV

SEQ ID NO: 1062292 - protein, 20 aa, Mycobacterium
LTGWRDAWEIGRTVRDNSLQ

SEQ ID NO: 1062293 - protein, 17 aa, Mycobacterium
LTILCGLAIGYPDPDFA

SEQ ID NO: 1062294 - protein, 22 aa, Mycobacterium
LTKLHIKSCCATRSFVPLWDYN

SEQ ID NO: 1062295 - protein, 22 aa, Mycobacterium
LTLHPRLGRWVQLGGHCEDDHD

SEQ ID NO: 1062296 - protein, 23 aa, Mycobacterium
LTLPATFSLYVERAWPRHRRLSL

SEQ ID NO: 1062297 - protein, 17 aa, Mycobacterium
LTLPEFVCLRILSASPG

SEQ ID NO: 1062298 - protein, 19 aa, Mycobacterium
LTLRYRRGTVLGRPLRAEG

SEQ ID NO: 1062299 - protein, 17 aa, Mycobacterium
LTMVWLAKWIREHQDDA

SEQ ID NO: 1062300 - protein, 17 aa, Mycobacterium
LTPGPWRLIRVVGDYYK

SEQ ID NO: 1062301 - protein, 21 aa, Mycobacterium
LTPPRLARYVKLEVTGPAQQH

SEQ ID NO: 1062302 - protein, 22 aa, Mycobacterium
LTRSCKRWFGIGPAAYRAKTRV

SEQ ID NO: 1062303 - protein, 25 aa, Mycobacterium
LTSRPCPTCRGVGVVIPDPCHQCMG

SEQ ID NO: 1062304 - protein, 19 aa, Mycobacterium
LTSRYEIPCTVAGTVTVDG

SEQ ID NO: 1062305 - protein, 17 aa, Mycobacterium
LTVGGLRDWLLDTAARD

SEQ ID NO: 1062306 - protein, 26 aa, Mycobacterium
LTVPGRHCWRYIGAVAHSSTRESGAT

SEQ ID NO: 1062307 - protein, 22 aa, Mycobacterium
LTVSGTRAWLNRQLRPIGARPR

SEQ ID NO: 1062308 - protein, 17 aa, Mycobacterium
LTYPFALTFPAMMSLVT

SEQ ID NO: 1062309 - protein, 24 aa, Mycobacterium
LVAEAGVAWVLMHWRLMSAERPYE

SEQ ID NO: 1062310 - protein, 25 aa, Mycobacterium
LVAEAGVAWVLMHWRLMSAERPYEA

SEQ ID NO: 1062311 - protein, 19 aa, Mycobacterium
LVAPLTFLAIAGRRVQLEI

SEQ ID NO: 1062312 - protein, 17 aa, Mycobacterium
LVDCGRGVLQRAAAVGV

SEQ ID NO: 1062313 - protein, 19 aa, Mycobacterium
LVERLVPDFLWISTEHTAQ

SEQ ID NO: 1062314 - protein, 20 aa, Mycobacterium
LVFCAAVIRAVHKYAELLRV

SEQ ID NO: 1062315 - protein, 20 aa, Mycobacterium
LVFGRRAGLGAADYVRALSS

SEQ ID NO: 1062316 - protein, 18 aa, Mycobacterium
LVIRGEKQYVFGLNDSTS

SEQ ID NO: 1062317 - protein, 17 aa, Mycobacterium
LVLDWKRPVKVFIETKH

SEQ ID NO: 1062318 - protein, 18 aa, Mycobacterium
LVLGVGPSHHWIVDDMLG

SEQ ID NO: 1062319 - protein, 17 aa, Mycobacterium
LVLLLVVHHICWDDDSW

SEQ ID NO: 1062320 - protein, 18 aa, Mycobacterium
LVLYCFTLPFAMVETFGW

SEQ ID NO: 1062321 - protein, 23 aa, Mycobacterium
LVNSWSAAFARYGRAVGQVLLTA

SEQ ID NO: 1062322 - protein, 17 aa, Mycobacterium
LVPDFLWISTEHTAQVS

SEQ ID NO: 1062323 - protein, 17 aa, Mycobacterium
LVPEYIGNLLLYFDPHA

SEQ ID NO: 1062324 - protein, 18 aa, Mycobacterium
LVPFGAFVRVEEGIEGLV

SEQ ID NO: 1062325 - protein, 18 aa, Mycobacterium
LVRRALELLPDVGFVNAY

SEQ ID NO: 1062326 - protein, 24 aa, Mycobacterium
LVRRGCPFSGLLYAGLAITAKGPA

SEQ ID NO: 1062327 - protein, 28 aa, Mycobacterium
LVSFEVFIRPALRLAMGLPDPRRPQRTA

SEQ ID NO: 1062328 - protein, 18 aa, Mycobacterium
LVSLAFLAFSGWRSRLGC

SEQ ID NO: 1062329 - protein, 17 aa, Mycobacterium
LVSWLPQYHDFGLIFMA

SEQ ID NO: 1062330 - protein, 17 aa, Mycobacterium
LVTRWLATFTFFRAALG

SEQ ID NO: 1062331 - protein, 19 aa, Mycobacterium
LVVSLAKRYTGRGMAFLDL

SEQ ID NO: 1062332 - protein, 25 aa, Mycobacterium
LVWNLPRVFGPIAIAYRVNGLTSLN

SEQ ID NO: 1062333 - protein, 18 aa, Mycobacterium
LWGGGGIGGTGGFGALNG

SEQ ID NO: 1062334 - protein, 17 aa, Mycobacterium
LWGREITSLLVAGMTAD

SEQ ID NO: 1062335 - protein, 17 aa, Mycobacterium
LWISWAMANREPQVFPD

SEQ ID NO: 1062336 - protein, 17 aa, Mycobacterium
LWLRGYNPGRLCLAGDS

SEQ ID NO: 1062337 - protein, 18 aa, Mycobacterium
LWRFTPLKRLRGLHDGSA

SEQ ID NO: 1062338 - protein, 21 aa, Mycobacterium
LWSALPSWRPTWPTVAVNNST

SEQ ID NO: 1062339 - protein, 21 aa, Mycobacterium
LYCRNRIEIVIAMLGIIKAGA

SEQ ID NO: 1062340 - protein, 18 aa, Mycobacterium
LYGYKWPTLDGMFTPHAS

SEQ ID NO: 1062341 - protein, 17 aa, Mycobacterium
LYREGFFGLSWPREYGG

SEQ ID NO: 1062342 - protein, 19 aa, Mycobacterium
LYVERAWPRHRRLSLAIED

SEQ ID NO: 1062343 - protein, 20 aa, Mycobacterium
LYYPRFLTELPYLGQALLLG

SEQ ID NO: 1062344 - protein, 18 aa, Mycobacterium
MAAKNGWAAMPFDERAGV

SEQ ID NO: 1062345 - protein, 17 aa, Mycobacterium
MAGTGFLGAHADEVYRL

SEQ ID NO: 1062346 - protein, 18 aa, Mycobacterium
MAIPELPEELFIESLTQL

SEQ ID NO: 1062347 - protein, 23 aa, Mycobacterium
MALVAYRHGIPFILVAPESTGGP

SEQ ID NO: 1062348 - protein, 24 aa, Mycobacterium
MALVAYRHGIPFILVAPESTGGPA

SEQ ID NO: 1062349 - protein, 22 aa, Mycobacterium
MARGIEIGHIFQLGRKYTDAFT

SEQ ID NO: 1062350 - protein, 18 aa, Mycobacterium
MASMAAFTWLSTRGGGGV

SEQ ID NO: 1062351 - protein, 18 aa, Mycobacterium
MASQLGMRPWRVQKAQKQ

SEQ ID NO: 1062352 - protein, 17 aa, Mycobacterium
MAWRWGIAAGELTSMDA

SEQ ID NO: 1062353 - protein, 19 aa, Mycobacterium
MDGWYEWRANPDVLSGAGS

SEQ ID NO: 1062354 - protein, 25 aa, Mycobacterium
MDPRQRLALELAWELFEDARIVAES

SEQ ID NO: 1062355 - protein, 20 aa, Mycobacterium
MEPDLKWERFITAVRLLAER

SEQ ID NO: 1062356 - protein, 17 aa, Mycobacterium
MEVPAFALALMRRSLSG

SEQ ID NO: 1062357 - protein, 20 aa, Mycobacterium
MFALGLVSWMYGRPIQTSET

SEQ ID NO: 1062358 - protein, 19 aa, Mycobacterium
MFLELSWEALERAGIEPGG

SEQ ID NO: 1062359 - protein, 17 aa, Mycobacterium
MGAMALFGECYPDEVRV

SEQ ID NO: 1062360 - protein, 24 aa, Mycobacterium
MGAWAKRTGAIFIRRQTKDIPVYR

SEQ ID NO: 1062361 - protein, 17 aa, Mycobacterium
MGIPILYPWANRLGENT

SEQ ID NO: 1062362 - protein, 19 aa, Mycobacterium
MGPMQFLPGTWARYASDGD

SEQ ID NO: 1062363 - protein, 25 aa, Mycobacterium
MIDVLRFWLGLGIDGFRLDAVPYLF

SEQ ID NO: 1062364 - protein, 23 aa, Mycobacterium
MILRRPRAGLSYEALLVTVEQRL

SEQ ID NO: 1062365 - protein, 20 aa, Mycobacterium
MKPDVCWQLPIRRSQEWVTR

SEQ ID NO: 1062366 - protein, 20 aa, Mycobacterium
MLAKRPKFDSKRLVRDDDVP

SEQ ID NO: 1062367 - protein, 18 aa, Mycobacterium
MLASRVSTFVAWLDGNAE

SEQ ID NO: 1062368 - protein, 18 aa, Mycobacterium
MLASRVSTFVAWLNGNAE

SEQ ID NO: 1062369 - protein, 18 aa, Mycobacterium
MLLELSWEALERSGIDPT

SEQ ID NO: 1062370 - protein, 18 aa, Mycobacterium
MLLPRSRYDEGVAILKSI

SEQ ID NO: 1062371 - protein, 19 aa, Mycobacterium
MLRWKCVESPLGLNHPYWV

SEQ ID NO: 1062372 - protein, 19 aa, Mycobacterium
MLYWQFRGTFIPKTRLTMI

SEQ ID NO: 1062373 - protein, 19 aa, Mycobacterium
MMFDRCVEFLPALRSAAPD

SEQ ID NO: 1062374 - protein, 20 aa, Mycobacterium
MMLEAITPYVTWMRSTAVQA

SEQ ID NO: 1062375 - protein, 24 aa, Mycobacterium
MNLPAVAFGHDWLTGVARYSDLLE

SEQ ID NO: 1062376 - protein, 17 aa, Mycobacterium
MPARPPCRTTWTTSRAE

SEQ ID NO: 1062377 - protein, 17 aa, Mycobacterium
MPARYVIHAATMELGGP

SEQ ID NO: 1062378 - protein, 17 aa, Mycobacterium
MPFYLMRAIDGWSPMDG

SEQ ID NO: 1062379 - protein, 32 aa, Mycobacterium
MPINLCRPIFRRAPALLISRLVSWVDDLWCRA

SEQ ID NO: 1062380 - protein, 26 aa, Mycobacterium
MPKARCLEGDLAYWCVAAADRYAYTV

SEQ ID NO: 1062381 - protein, 19 aa, Mycobacterium
MPLMLSEGDWDAWLNPDAP

SEQ ID NO: 1062382 - protein, 17 aa, Mycobacterium
MPLPIALAHRLSRRLTE

SEQ ID NO: 1062383 - protein, 18 aa, Mycobacterium
MPYKSGFGPFAPEIYRAP

SEQ ID NO: 1062384 - protein, 17 aa, Mycobacterium
MQVCKKSDCPFSTSASE

SEQ ID NO: 1062385 - protein, 18 aa, Mycobacterium
MRGGKFLNNWRMAELHAK

SEQ ID NO: 1062386 - protein, 18 aa, Mycobacterium
MRLDMPLVDFFSRGGALK

SEQ ID NO: 1062387 - protein, 17 aa, Mycobacterium
MRLGSILGRRPTALERP

SEQ ID NO: 1062388 - protein, 24 aa, Mycobacterium
MRPGNWAGAYACWGTENREAAVRF

SEQ ID NO: 1062389 - protein, 19 aa, Mycobacterium
MRSCTGWPSRVWIDEPRRT

SEQ ID NO: 1062390 - protein, 18 aa, Mycobacterium
MRTVMCIMNGQLRPVLVR

SEQ ID NO: 1062391 - protein, 17 aa, Mycobacterium
MRVLVAPVCYGESLSAV

SEQ ID NO: 1062392 - protein, 17 aa, Mycobacterium
MRVVRELSALPAEVEAA

SEQ ID NO: 1062393 - protein, 17 aa, Mycobacterium
MSEERVRLISPFVGGAF

SEQ ID NO: 1062394 - protein, 28 aa, Mycobacterium
MSFVAVCGQCRWCASGMEYLCDAGIGTL

SEQ ID NO: 1062395 - protein, 22 aa, Mycobacterium
MSQLRTALRLQIAAGRSIGEAL

SEQ ID NO: 1062396 - protein, 17 aa, Mycobacterium
MSWDRFVATYGRTGGPV

SEQ ID NO: 1062397 - protein, 18 aa, Mycobacterium
MTAEDRWLQFSSVSFDAS

SEQ ID NO: 1062398 - protein, 21 aa, Mycobacterium
MTAELRFPAGHSGRIEFSMWS

SEQ ID NO: 1062399 - protein, 18 aa, Mycobacterium
MTGARPGGFGVLHSRTNE

SEQ ID NO: 1062400 - protein, 25 aa, Mycobacterium
MTKSLRAGKVFLDWSQNSGSKTTIA

SEQ ID NO: 1062401 - protein, 18 aa, Mycobacterium
MTLWPKFDYASAANAGID

SEQ ID NO: 1062402 - protein, 20 aa, Mycobacterium
MTPHWGRGTLVGKLTVPPSW

SEQ ID NO: 1062403 - protein, 23 aa, Mycobacterium
MTPPIARPTLRWVNIVPGPLAGA

SEQ ID NO: 1062404 - protein, 18 aa, Mycobacterium
MTVDLEWPGSLVQSVEGL

SEQ ID NO: 1062405 - protein, 26 aa, Mycobacterium
MTWPHGRLRYYIAMLVELSQLRPLPF

SEQ ID NO: 1062406 - protein, 18 aa, Mycobacterium
MVEAAICDGDWVVVRQQN

SEQ ID NO: 1062407 - protein, 18 aa, Mycobacterium
MVFGHRGINIPVIDHATG

SEQ ID NO: 1062408 - protein, 28 aa, Mycobacterium
MVVKELTGASLVRHRMAARAVTAEVGAR

SEQ ID NO: 1062409 - protein, 23 aa, Mycobacterium
MWAQDVAAMFGYRSGAESIAAAL

SEQ ID NO: 1062410 - protein, 20 aa, Mycobacterium
MWRRGDEVFAEVALPADAGV

SEQ ID NO: 1062411 - protein, 18 aa, Mycobacterium
NAGLFLRYVIFGGENLSF

SEQ ID NO: 1062412 - protein, 24 aa, Mycobacterium
NAGTRLSGFFFRGDRSLVARSAAG

SEQ ID NO: 1062413 - protein, 20 aa, Mycobacterium
NAIWPDLFIVGGGISRKADK

SEQ ID NO: 1062414 - protein, 22 aa, Mycobacterium
NAKARGLWNLFLPAESGLTNLE

SEQ ID NO: 1062415 - protein, 19 aa, Mycobacterium
NALCAGAVALECGASVSQV

SEQ ID NO: 1062416 - protein, 18 aa, Mycobacterium
NALRSWSVLRFEVTEDPS

SEQ ID NO: 1062417 - protein, 18 aa, Mycobacterium
NAPLLGRGGAGGVGGASD

SEQ ID NO: 1062418 - protein, 18 aa, Mycobacterium
NARGVPFIFVRTDSAGNI

SEQ ID NO: 1062419 - protein, 19 aa, Mycobacterium
NAVAGWRGASRPVLARELL

SEQ ID NO: 1062420 - protein, 18 aa, Mycobacterium
NDGALGWFGTSPVGTFPA

SEQ ID NO: 1062421 - protein, 21 aa, Mycobacterium
NDMYPRLVVAVVRAVGDAAMD

SEQ ID NO: 1062422 - protein, 17 aa, Mycobacterium
NEAFAPVPLAWLCDIGA

SEQ ID NO: 1062423 - protein, 17 aa, Mycobacterium
NEDFPRLMVYRGPRRKG

SEQ ID NO: 1062424 - protein, 17 aa, Mycobacterium
NEFIRHWLADLVAETGS

SEQ ID NO: 1062425 - protein, 19 aa, Mycobacterium
NEGLCAIGLRFSEDKTAPR

SEQ ID NO: 1062426 - protein, 20 aa, Mycobacterium
NELPLRITVIRTRADELVLL

SEQ ID NO: 1062427 - protein, 19 aa, Mycobacterium
NEYWRRFGVVPDWAGKRVL

SEQ ID NO: 1062428 - protein, 19 aa, Mycobacterium
NFFPMGAWAKRTGAIFIRR

SEQ ID NO: 1062429 - protein, 18 aa, Mycobacterium
NFNAGAAMRFMSGSLSHQ

SEQ ID NO: 1062430 - protein, 20 aa, Mycobacterium
NFTGRSWPLADVRLLAPILA

SEQ ID NO: 1062431 - protein, 24 aa, Mycobacterium
NFTNVCYTGCRFCAFAQRKGDADA

SEQ ID NO: 1062432 - protein, 20 aa, Mycobacterium
NGEMLIAIAGRVARAVVAES

SEQ ID NO: 1062433 - protein, 23 aa, Mycobacterium
NGFFYRAMHPFCIGMYASAVGDY

SEQ ID NO: 1062434 - protein, 18 aa, Mycobacterium
NGFLWRGDNQGLIFGEPG

SEQ ID NO: 1062435 - protein, 20 aa, Mycobacterium
NGGAAGWLLGDGGAGGSGGL

SEQ ID NO: 1062436 - protein, 19 aa, Mycobacterium
NGGAGGWIYGHGGDGGIGG

SEQ ID NO: 1062437 - protein, 18 aa, Mycobacterium
NGGDGGWLFGSGGNGAAG

SEQ ID NO: 1062438 - protein, 19 aa, Mycobacterium
NGGDGGWLLGDGGIGGSGT

SEQ ID NO: 1062439 - protein, 18 aa, Mycobacterium
NGGNGGWAIYNSFAGDDG

SEQ ID NO: 1062440 - protein, 17 aa, Mycobacterium
NGIKIFGPGGHKLDDAT

SEQ ID NO: 1062441 - protein, 21 aa, Mycobacterium
NGLLWRGDYQGNLGAFNYTVT

SEQ ID NO: 1062442 - protein, 21 aa, Mycobacterium
NGRRPGSVVLLTLHRERPDLD

SEQ ID NO: 1062443 - protein, 17 aa, Mycobacterium
NHAAGWVRMDFIVPSRG

SEQ ID NO: 1062444 - protein, 19 aa, Mycobacterium
NIAPWLRAAHRYGAKVKWA

SEQ ID NO: 1062445 - protein, 24 aa, Mycobacterium
NIQPQGRFSWRTMPDNLEDAGVSW

SEQ ID NO: 1062446 - protein, 17 aa, Mycobacterium
NITAYWKGYTEYHADGL

SEQ ID NO: 1062447 - protein, 18 aa, Mycobacterium
NKLSCPIYTFIGSKDWIA

SEQ ID NO: 1062448 - protein, 24 aa, Mycobacterium
NKVPGARCALVWSEQTASLAREHN

SEQ ID NO: 1062449 - protein, 17 aa, Mycobacterium
NLGFGLTGDNLVGFGNA

SEQ ID NO: 1062450 - protein, 18 aa, Mycobacterium
NLGKLLTKRARVIGTTLR

SEQ ID NO: 1062451 - protein, 23 aa, Mycobacterium
NLSELPGRVIAAFGNGAPATTVT

SEQ ID NO: 1062452 - protein, 19 aa, Mycobacterium
NLVLASRGTPLWASATNGQ

SEQ ID NO: 1062453 - protein, 23 aa, Mycobacterium
NMPAEGLLGRPLIGDGTDGAPGT

SEQ ID NO: 1062454 - protein, 19 aa, Mycobacterium
NPDELRRHIGYVVQGAGVF

SEQ ID NO: 1062455 - protein, 23 aa, Mycobacterium
NPDYGLRLSWDFLARSTAGLWEW

SEQ ID NO: 1062456 - protein, 18 aa, Mycobacterium
NPGIPARGVVAVCDFGGS

SEQ ID NO: 1062457 - protein, 20 aa, Mycobacterium
NPLRFLRAGLKWCRKAAELG

SEQ ID NO: 1062458 - protein, 22 aa, Mycobacterium
NPPRNRPAPLMLRGPDQQEPAG

SEQ ID NO: 1062459 - protein, 21 aa, Mycobacterium
NPRWCQLCFEKAPGGAVTLPI

SEQ ID NO: 1062460 - protein, 23 aa, Mycobacterium
NQIWQCPVVLLADVRSVGVQGDN

SEQ ID NO: 1062461 - protein, 18 aa, Mycobacterium
NQQFALLFVDWLRANPGA

SEQ ID NO: 1062462 - protein, 18 aa, Mycobacterium
NQRWLGGMLTNFSTVHKR

SEQ ID NO: 1062463 - protein, 18 aa, Mycobacterium
NRLARWFIGQGFGPEDII

SEQ ID NO: 1062464 - protein, 21 aa, Mycobacterium
NRLLPCLPTLLALSASSPFWA

SEQ ID NO: 1062465 - protein, 19 aa, Mycobacterium
NRLRCYVVGVSRGSREPLI

SEQ ID NO: 1062466 - protein, 18 aa, Mycobacterium
NRLVHRFRRAGLREGDAV

SEQ ID NO: 1062467 - protein, 22 aa, Mycobacterium
NRPMRGCYRIALVSLKGGVGKT

SEQ ID NO: 1062468 - protein, 21 aa, Mycobacterium
NRRLVLLPFSWIIFIIHEKAL

SEQ ID NO: 1062469 - protein, 19 aa, Mycobacterium
NRVADAWIKAQAYRLQTFG

SEQ ID NO: 1062470 - protein, 29 aa, Mycobacterium
NTPGYSGVMGRLWLARGGTYVLANIRGGG

SEQ ID NO: 1062471 - protein, 21 aa, Mycobacterium
NTRMNEIRLWLPYDEVLPRRQ

SEQ ID NO: 1062472 - protein, 18 aa, Mycobacterium
NTVSLGWSSWAIQWLSRI

SEQ ID NO: 1062473 - protein, 19 aa, Mycobacterium
NVANCLVALAILDVVGVSP

SEQ ID NO: 1062474 - protein, 24 aa, Mycobacterium
NVFGRRAGIAAARYARGHDFVDMP

SEQ ID NO: 1062475 - protein, 18 aa, Mycobacterium
NWDCPKLRVGAGSFITPV

SEQ ID NO: 1062476 - protein, 20 aa, Mycobacterium
NWYTEFARLAPLMEKDTHYE

SEQ ID NO: 1062477 - protein, 20 aa, Mycobacterium
NYACIEWAVGVFRSEANGTT

SEQ ID NO: 1062478 - protein, 18 aa, Mycobacterium
NYAKSLRMFAVLPTIVAA

SEQ ID NO: 1062479 - protein, 17 aa, Mycobacterium
PAAAFAPLPPVPPSPPA

SEQ ID NO: 1062480 - protein, 17 aa, Mycobacterium
PAAAWAMAARERVMSLS

SEQ ID NO: 1062481 - protein, 18 aa, Mycobacterium
PAALLCWGVSQFDADMRP

SEQ ID NO: 1062482 - protein, 18 aa, Mycobacterium
PAAPYAKAVREWEQLERF

SEQ ID NO: 1062483 - protein, 20 aa, Mycobacterium
PACIKAMIEKVVDRMYAEID

SEQ ID NO: 1062484 - protein, 18 aa, Mycobacterium
PAEAIVVGPLHFEPTDQL

SEQ ID NO: 1062485 - protein, 17 aa, Mycobacterium
PAEAVVVGPLHFEPTDR

SEQ ID NO: 1062486 - protein, 17 aa, Mycobacterium
PAGRAWVSMAVPVAAAG

SEQ ID NO: 1062487 - protein, 18 aa, Mycobacterium
PAGRLWANPDCGLKTRNV

SEQ ID NO: 1062488 - protein, 18 aa, Mycobacterium
PAGWSVWPERVYGDTRLE

SEQ ID NO: 1062489 - protein, 18 aa, Mycobacterium
PAHDAARYDQVWKEHVLP

SEQ ID NO: 1062490 - protein, 17 aa, Mycobacterium
PAHLVVRAVGYRGIPTP

SEQ ID NO: 1062491 - protein, 20 aa, Mycobacterium
PAISLPLHWTPAGLPLGVQF

SEQ ID NO: 1062492 - protein, 19 aa, Mycobacterium
PALLRKQLKGAPMPAPKAI

SEQ ID NO: 1062493 - protein, 24 aa, Mycobacterium
PAPPKLADWMLRVRFCAPAPPAPA

SEQ ID NO: 1062494 - protein, 17 aa, Mycobacterium
PAPPWVPGPPIPPVPPL

SEQ ID NO: 1062495 - protein, 18 aa, Mycobacterium
PAPVRVGFRIGTPAVGEL

SEQ ID NO: 1062496 - protein, 17 aa, Mycobacterium
PAQIAAFAVAMKMKVPT

SEQ ID NO: 1062497 - protein, 25 aa, Mycobacterium
PAQVLLRWNLQLGNAVVFRSAKAEH

SEQ ID NO: 1062498 - protein, 19 aa, Mycobacterium
PASALLFFLASSRILNRRK

SEQ ID NO: 1062499 - protein, 20 aa, Mycobacterium
PASARGSLRLSLGHTTVEAD

SEQ ID NO: 1062500 - protein, 22 aa, Mycobacterium
PASGAARLFADWTAGQSDGGPS

SEQ ID NO: 1062501 - protein, 18 aa, Mycobacterium
PASTAVAYPAHWTTSAVD

SEQ ID NO: 1062502 - protein, 21 aa, Mycobacterium
PAYRWPLVPALALVAAMPALG

SEQ ID NO: 1062503 - protein, 19 aa, Mycobacterium
PAYWCRRLANDMVDYVNSY

SEQ ID NO: 1062504 - protein, 22 aa, Mycobacterium
PCLQSRIAAAWLWSRGSATVGG

SEQ ID NO: 1062505 - protein, 18 aa, Mycobacterium
PDAGLVLREVGLEVMGSA

SEQ ID NO: 1062506 - protein, 17 aa, Mycobacterium
PDARISVAPLGFVAEGR

SEQ ID NO: 1062507 - protein, 17 aa, Mycobacterium
PDDLAFAESRIRPSTIA

SEQ ID NO: 1062508 - protein, 17 aa, Mycobacterium
PDGPGWRITGQKVWTSY

SEQ ID NO: 1062509 - protein, 22 aa, Mycobacterium
PDGRAWPALDFVRPWDSLTDDE

SEQ ID NO: 1062510 - protein, 17 aa, Mycobacterium
PDGYRLTVDYAVRITGR

SEQ ID NO: 1062511 - protein, 19 aa, Mycobacterium
PDIDWDKGAALAWIRSLIF

SEQ ID NO: 1062512 - protein, 17 aa, Mycobacterium
PDIDWDKGKTLHWVIDR

SEQ ID NO: 1062513 - protein, 18 aa, Mycobacterium
PDIRCCILTGAGDYFCAG

SEQ ID NO: 1062514 - protein, 18 aa, Mycobacterium
PDLALRWAALLHDIGKPA

SEQ ID NO: 1062515 - protein, 20 aa, Mycobacterium
PDLDVDLVYRFIRDTTWVSV

SEQ ID NO: 1062516 - protein, 17 aa, Mycobacterium
PDLFPAWDSLSEAQQKL

SEQ ID NO: 1062517 - protein, 17 aa, Mycobacterium
PDLKALIDRLWPASDFS

SEQ ID NO: 1062518 - protein, 22 aa, Mycobacterium
PDLPLRFALNLSVFVGVTAEGT

SEQ ID NO: 1062519 - protein, 19 aa, Mycobacterium
PDLTIGFFLHIPFPPVELF

SEQ ID NO: 1062520 - protein, 25 aa, Mycobacterium
PDMKLPISLALGWPRRVPGAARYCD

SEQ ID NO: 1062521 - protein, 22 aa, Mycobacterium
PDNEFRVVLARRGQHWVSAVRV

SEQ ID NO: 1062522 - protein, 23 aa, Mycobacterium
PDPQWRGGALIAVQFVLNYEEGA

SEQ ID NO: 1062523 - protein, 17 aa, Mycobacterium
PDPRPDAALSIPGYPAQ

SEQ ID NO: 1062524 - protein, 18 aa, Mycobacterium
PDPVALLRCCGGADLAAM

SEQ ID NO: 1062525 - protein, 18 aa, Mycobacterium
PDRCVAVLAALPAWTGEP

SEQ ID NO: 1062526 - protein, 18 aa, Mycobacterium
PDSPHDWIECGEWIRELR

SEQ ID NO: 1062527 - protein, 23 aa, Mycobacterium
PDVVARLTADWVDRVVAGTGDAA

SEQ ID NO: 1062528 - protein, 22 aa, Mycobacterium
PDYLPGTLLPPGIRATADAAEA

SEQ ID NO: 1062529 - protein, 28 aa, Mycobacterium
PDYRPAPLPSWPTRLGWAVRDWPETVIG

SEQ ID NO: 1062530 - protein, 21 aa, Mycobacterium
PEALSRFPITRVISSPQRRAV

SEQ ID NO: 1062531 - protein, 18 aa, Mycobacterium
PEAPMALCLHGFPDTADG

SEQ ID NO: 1062532 - protein, 18 aa, Mycobacterium
PEATMCRFGVPLGPVAQP

SEQ ID NO: 1062533 - protein, 24 aa, Mycobacterium
PEELRPNDEWVLFGYDGVFQAFRD

SEQ ID NO: 1062534 - protein, 17 aa, Mycobacterium
PEEMARIVAFLLPDDSS

SEQ ID NO: 1062535 - protein, 20 aa, Mycobacterium
PEEWRRFVGRASLYAAREKA

SEQ ID NO: 1062536 - protein, 20 aa, Mycobacterium
PEFIGRLPVVASVTNLDKES

SEQ ID NO: 1062537 - protein, 19 aa, Mycobacterium
PEFLERIGIGAPEVEQDII

SEQ ID NO: 1062538 - protein, 20 aa, Mycobacterium
PEFRAAVVLCDIEGLSYEEI

SEQ ID NO: 1062539 - protein, 21 aa, Mycobacterium
PEGLLNYLALLGWAIADDHDL

SEQ ID NO: 1062540 - protein, 22 aa, Mycobacterium
PEGSVLVPFAWQGVTLHAAGAS

SEQ ID NO: 1062541 - protein, 26 aa, Mycobacterium
PEHIAARPGRIWLRISGYGEHSRRPA

SEQ ID NO: 1062542 - protein, 18 aa, Mycobacterium
PEHPRFLMCTPLSHAGAA

SEQ ID NO: 1062543 - protein, 21 aa, Mycobacterium
PEIRPVHLLLAMLMQNDGIAA

SEQ ID NO: 1062544 - protein, 22 aa, Mycobacterium
PEIRPVHLLLAMLMQNDGIAAP

SEQ ID NO: 1062545 - protein, 20 aa, Mycobacterium
PEKRTRLGVGHFVETLETYR

SEQ ID NO: 1062546 - protein, 21 aa, Mycobacterium
PELGRFGVWLGSRSITPELAG

SEQ ID NO: 1062547 - protein, 18 aa, Mycobacterium
PELLSRAAALNWDTTAPA

SEQ ID NO: 1062548 - protein, 19 aa, Mycobacterium
PELRPLVQLDGGRFATSDL

SEQ ID NO: 1062549 - protein, 17 aa, Mycobacterium
PELRRPITELGMVKSVE

SEQ ID NO: 1062550 - protein, 22 aa, Mycobacterium
PELVRRLCWDWAPVAAAEITST

SEQ ID NO: 1062551 - protein, 17 aa, Mycobacterium
PELWCALVAVVGADPPH

SEQ ID NO: 1062552 - protein, 21 aa, Mycobacterium
PEMLRRAMLYAIERKRAELIA

SEQ ID NO: 1062553 - protein, 19 aa, Mycobacterium
PEPLRSAALAGRAPAKPVG

SEQ ID NO: 1062554 - protein, 22 aa, Mycobacterium
PEQKRRWAVPILRAEMTASLGM

SEQ ID NO: 1062555 - protein, 21 aa, Mycobacterium
PERIIPCQLPWLLDPSAGAQL

SEQ ID NO: 1062556 - protein, 23 aa, Mycobacterium
PERLRSGWLNGIKHWQVDYHSDS

SEQ ID NO: 1062557 - protein, 24 aa, Mycobacterium
PERVWGWYLWRHYLVADVAPNPGH

SEQ ID NO: 1062558 - protein, 20 aa, Mycobacterium
PETDFPRWFGRNWRRQAMLR

SEQ ID NO: 1062559 - protein, 18 aa, Mycobacterium
PETQIAISAWGLLSPEGR

SEQ ID NO: 1062560 - protein, 22 aa, Mycobacterium
PETSVALGFGFRCGFLGLLHME

SEQ ID NO: 1062561 - protein, 20 aa, Mycobacterium
PEVVEALKFHLRDLAVTFRF

SEQ ID NO: 1062562 - protein, 20 aa, Mycobacterium
PEYIGNLLLYFDPHATVTLL

SEQ ID NO: 1062563 - protein, 18 aa, Mycobacterium
PFAGFGGWLMRRVGKSPS

SEQ ID NO: 1062564 - protein, 21 aa, Mycobacterium
PFAPRCPLVIDECRSDEPELI

SEQ ID NO: 1062565 - protein, 22 aa, Mycobacterium
PFDAVVCSLVLCSVTDQLGVLQ

SEQ ID NO: 1062566 - protein, 18 aa, Mycobacterium
PFFHDMGLMFGIIMPLLE

SEQ ID NO: 1062567 - protein, 18 aa, Mycobacterium
PFGPRPGFGFGPGPAQRR

SEQ ID NO: 1062568 - protein, 18 aa, Mycobacterium
PFTTVGLCCYRDGFDSVA

SEQ ID NO: 1062569 - protein, 19 aa, Mycobacterium
PGALIGFLGPRVYELLYDE

SEQ ID NO: 1062570 - protein, 18 aa, Mycobacterium
PGALPAFSDDRWEFYDLF

SEQ ID NO: 1062571 - protein, 18 aa, Mycobacterium
PGARLAWRENAEWAPHGG

SEQ ID NO: 1062572 - protein, 20 aa, Mycobacterium
PGAVDFRLGSPIGDALKGHN

SEQ ID NO: 1062573 - protein, 22 aa, Mycobacterium
PGDRRGWRRGRHRRQLRCRRHV

SEQ ID NO: 1062574 - protein, 24 aa, Mycobacterium
PGGLGGRGGLLWGDGGKGGDGGAP

SEQ ID NO: 1062575 - protein, 24 aa, Mycobacterium
PGHGGNGGNAFLFGDGGTGGQGGT

SEQ ID NO: 1062576 - protein, 18 aa, Mycobacterium
PGHLWRWELTPISGTRTL

SEQ ID NO: 1062577 - protein, 17 aa, Mycobacterium
PGHPEFRHTAGVEITTG

SEQ ID NO: 1062578 - protein, 19 aa, Mycobacterium
PGIASRVIGKWARTRLSGQ

SEQ ID NO: 1062579 - protein, 20 aa, Mycobacterium
PGITEAWPWTNRQATEASSA

SEQ ID NO: 1062580 - protein, 23 aa, Mycobacterium
PGKHAASAFAMWFPIEGEQDSHE

SEQ ID NO: 1062581 - protein, 19 aa, Mycobacterium
PGLGTWWGSWRRFLPAGQG

SEQ ID NO: 1062582 - protein, 17 aa, Mycobacterium
PGQKLRIVKYLAYGWSS

SEQ ID NO: 1062583 - protein, 20 aa, Mycobacterium
PGRRPVFALARFVSGREIPD

SEQ ID NO: 1062584 - protein, 18 aa, Mycobacterium
PGTDISIADVLRCIDGPL

SEQ ID NO: 1062585 - protein, 28 aa, Mycobacterium
PGVGKVNVKLYWDLKISPITFSDSTISG

SEQ ID NO: 1062586 - protein, 22 aa, Mycobacterium
PGVHGFRLLPCRTLRHQMGLVS

SEQ ID NO: 1062587 - protein, 25 aa, Mycobacterium
PGVLARVAALFSRRGFNIESLAVGA

SEQ ID NO: 1062588 - protein, 19 aa, Mycobacterium
PGYPCYRNILSALGCEVVE

SEQ ID NO: 1062589 - protein, 17 aa, Mycobacterium
PGYRLKHRVQFERLGSG

SEQ ID NO: 1062590 - protein, 20 aa, Mycobacterium
PHAKGGGAHGHFEVTHDVSK

SEQ ID NO: 1062591 - protein, 18 aa, Mycobacterium
PHAVRWRGVIYLEAGLHR

SEQ ID NO: 1062592 - protein, 18 aa, Mycobacterium
PIAIVGMSCRFPGGVDSP

SEQ ID NO: 1062593 - protein, 18 aa, Mycobacterium
PIAVVGMGCRFPGGVDNP

SEQ ID NO: 1062594 - protein, 20 aa, Mycobacterium
PICAPDLLLAQALLRTKQIK

SEQ ID NO: 1062595 - protein, 17 aa, Mycobacterium
PIEWRYTNDPSWVMRDK

SEQ ID NO: 1062596 - protein, 19 aa, Mycobacterium
PKLDVLDFWSIVRPELPGV

SEQ ID NO: 1062597 - protein, 18 aa, Mycobacterium
PKLKCYLEVRCSVAGNLP

SEQ ID NO: 1062598 - protein, 19 aa, Mycobacterium
PKREWKEVVLLAGGGSDVA

SEQ ID NO: 1062599 - protein, 23 aa, Mycobacterium
PKRRFRLGGFASWHAVGEGDREG

SEQ ID NO: 1062600 - protein, 17 aa, Mycobacterium
PLADVRLLAPILASKVV

SEQ ID NO: 1062601 - protein, 20 aa, Mycobacterium
PLDMFGEWNRAYGPAGFLQY

SEQ ID NO: 1062602 - protein, 18 aa, Mycobacterium
PLDRARPLWELHVIHGLA

SEQ ID NO: 1062603 - protein, 18 aa, Mycobacterium
PLEGIAISFSYTIAPPLA

SEQ ID NO: 1062604 - protein, 21 aa, Mycobacterium
PLLALRIPWYVTVLDLGPAGA

SEQ ID NO: 1062605 - protein, 24 aa, Mycobacterium
PLLEPLRALPVLGDPLADLVQPNL

SEQ ID NO: 1062606 - protein, 20 aa, Mycobacterium
PLLGICGGFQMLGRVIRDPD

SEQ ID NO: 1062607 - protein, 19 aa, Mycobacterium
PLPAALRWAMRIPGGKALQ

SEQ ID NO: 1062608 - protein, 18 aa, Mycobacterium
PLPADRSLAVLIVIENGH

SEQ ID NO: 1062609 - protein, 18 aa, Mycobacterium
PLWECWVIEGLEHNRWAI

SEQ ID NO: 1062610 - protein, 23 aa, Mycobacterium
PLWEHWDRCALHWFPGSHVLHVS

SEQ ID NO: 1062611 - protein, 17 aa, Mycobacterium
PLWEMYLIEGLEKGRVA

SEQ ID NO: 1062612 - protein, 19 aa, Mycobacterium
PMCKRLVMSSGFYRAIQRD

SEQ ID NO: 1062613 - protein, 20 aa, Mycobacterium
PMLAAALAWDGLSTELSSAT

SEQ ID NO: 1062614 - protein, 18 aa, Mycobacterium
PNAYRFGTVGWPFPATEA

SEQ ID NO: 1062615 - protein, 21 aa, Mycobacterium
PNDHRRAIAALGFGVLSKSYF

SEQ ID NO: 1062616 - protein, 24 aa, Mycobacterium
PNFARRLPMLRGWVADLLDRDARD

SEQ ID NO: 1062617 - protein, 19 aa, Mycobacterium
PNVAEGWTLTRLTAPSRLF

SEQ ID NO: 1062618 - protein, 17 aa, Mycobacterium
PNVWAFGDVASWRDQMG

SEQ ID NO: 1062619 - protein, 17 aa, Mycobacterium
PPCAIWCTRRAARCTST

SEQ ID NO: 1062620 - protein, 25 aa, Mycobacterium
PPEPARPNSHPGLPPSPPAPPAPPA

SEQ ID NO: 1062621 - protein, 18 aa, Mycobacterium
PPHLKAIFPVAATTDLYE

SEQ ID NO: 1062622 - protein, 18 aa, Mycobacterium
PPHVRLPLARDPAGTGHA

SEQ ID NO: 1062623 - protein, 17 aa, Mycobacterium
PPICPLPPIPPLPPTPP

SEQ ID NO: 1062624 - protein, 22 aa, Mycobacterium
PPLPPAWPPRPEMLPSAPLAPL

SEQ ID NO: 1062625 - protein, 21 aa, Mycobacterium
PPNFWAWLIGRIKAVDPDVLF

SEQ ID NO: 1062626 - protein, 17 aa, Mycobacterium
PPPRPELATAFPPSPPS

SEQ ID NO: 1062627 - protein, 18 aa, Mycobacterium
PPPTRIAFMLTDTTPTAI

SEQ ID NO: 1062628 - protein, 27 aa, Mycobacterium
PPRAPALLISRLVSWVDDLWCRAIGAA

SEQ ID NO: 1062629 - protein, 21 aa, Mycobacterium
PPSKLGWGWARFAFTSWKTLS

SEQ ID NO: 1062630 - protein, 24 aa, Mycobacterium
PPSRRCPPCPSAGLRRYPQSHHRP

SEQ ID NO: 1062631 - protein, 17 aa, Mycobacterium
PQFSAVLECASAARKLN

SEQ ID NO: 1062632 - protein, 17 aa, Mycobacterium
PQQRLLLEVAWEALEHA

SEQ ID NO: 1062633 - protein, 17 aa, Mycobacterium
PQQRVAMRVAWKALENS

SEQ ID NO: 1062634 - protein, 18 aa, Mycobacterium
PQWHEWIKGVWVLAHYDD

SEQ ID NO: 1062635 - protein, 18 aa, Mycobacterium
PRAEFLAGLAAVMRPGDS

SEQ ID NO: 1062636 - protein, 23 aa, Mycobacterium
PRAEVLRPGLLVLPVRGAARFFG

SEQ ID NO: 1062637 - protein, 31 aa, Mycobacterium
PRDLGEPYAVKRFTQTLAIRTDAPGIGGDGG

SEQ ID NO: 1062638 - protein, 21 aa, Mycobacterium
PRDSRLVLTTGWPLRSARPRR

SEQ ID NO: 1062639 - protein, 18 aa, Mycobacterium
PRERPTCDAAYWVDNLRN

SEQ ID NO: 1062640 - protein, 20 aa, Mycobacterium
PRFADSVIRLKAELDPGTQA

SEQ ID NO: 1062641 - protein, 20 aa, Mycobacterium
PRFCAECGRRMIVQIRPDGW

SEQ ID NO: 1062642 - protein, 19 aa, Mycobacterium
PRFLMCTPLSHAGAAFFTP

SEQ ID NO: 1062643 - protein, 17 aa, Mycobacterium
PRFLVPHIVASAPKVVI

SEQ ID NO: 1062644 - protein, 17 aa, Mycobacterium
PRGISFLLNRNRLNVAI

SEQ ID NO: 1062645 - protein, 19 aa, Mycobacterium
PRGVLEIAYRCPNGEPGVV

SEQ ID NO: 1062646 - protein, 22 aa, Mycobacterium
PRIRDRLAWCYSRTQIMRYRGY

SEQ ID NO: 1062647 - protein, 18 aa, Mycobacterium
PRKLPALIWRILSAPLNA

SEQ ID NO: 1062648 - protein, 18 aa, Mycobacterium
PRKTLGWKTPAEAFHEQL

SEQ ID NO: 1062649 - protein, 20 aa, Mycobacterium
PRLATMDAIASYCLTEPGAG

SEQ ID NO: 1062650 - protein, 19 aa, Mycobacterium
PRLLARNGLTLQDFDFYEI

SEQ ID NO: 1062651 - protein, 22 aa, Mycobacterium
PRLLTPLALAPRGIWLGPKELR

SEQ ID NO: 1062652 - protein, 19 aa, Mycobacterium
PRLPRTALIDVLLRCPPRT

SEQ ID NO: 1062653 - protein, 18 aa, Mycobacterium
PRLREFALREGLADARLR

SEQ ID NO: 1062654 - protein, 19 aa, Mycobacterium
PRLRRVFTFQSLYAGVAPQ

SEQ ID NO: 1062655 - protein, 17 aa, Mycobacterium
PRLTGIAGLAVDGQRAQ

SEQ ID NO: 1062656 - protein, 18 aa, Mycobacterium
PRMCRRCSTCCRATWTCP

SEQ ID NO: 1062657 - protein, 20 aa, Mycobacterium
PRNRMGLAYVERLSEVVDDI

SEQ ID NO: 1062658 - protein, 19 aa, Mycobacterium
PRPDAALSIPGYPAQGDAI

SEQ ID NO: 1062659 - protein, 20 aa, Mycobacterium
PRPELATAFPPSPPSPPLPA

SEQ ID NO: 1062660 - protein, 17 aa, Mycobacterium
PRPLAAWATTRRDASQA

SEQ ID NO: 1062661 - protein, 17 aa, Mycobacterium
PRPVMLWAYDPLAFNGE

SEQ ID NO: 1062662 - protein, 20 aa, Mycobacterium
PRPWYPIPLLLGGSGPRMMR

SEQ ID NO: 1062663 - protein, 18 aa, Mycobacterium
PRQVIMLGRPTLHRPVSA

SEQ ID NO: 1062664 - protein, 23 aa, Mycobacterium
PRSPGPRYGVVPTIMSRPPSDGY

SEQ ID NO: 1062665 - protein, 19 aa, Mycobacterium
PRSSMAPTFVFDGAPAEHS

SEQ ID NO: 1062666 - protein, 18 aa, Mycobacterium
PRSVSHLPQWARRWQRLL

SEQ ID NO: 1062667 - protein, 17 aa, Mycobacterium
PRVSLAIGGLAVIEGPV

SEQ ID NO: 1062668 - protein, 18 aa, Mycobacterium
PSDSVAIALRVGVPIYVE

SEQ ID NO: 1062669 - protein, 18 aa, Mycobacterium
PSEVARLGYLAGIVATML

SEQ ID NO: 1062670 - protein, 20 aa, Mycobacterium
PSFSEALRWGAEVYHALKAV

SEQ ID NO: 1062671 - protein, 18 aa, Mycobacterium
PSGFEWEPGWNPIVVDES

SEQ ID NO: 1062672 - protein, 17 aa, Mycobacterium
PSGSFIFAGPSGVGKTE

SEQ ID NO: 1062673 - protein, 18 aa, Mycobacterium
PSHYEPFGLVALEAAAAG

SEQ ID NO: 1062674 - protein, 19 aa, Mycobacterium
PSKLGWGWARFAFTSWKTL

SEQ ID NO: 1062675 - protein, 23 aa, Mycobacterium
PSMRSRAAILYGYGHPWTVEEFE

SEQ ID NO: 1062676 - protein, 18 aa, Mycobacterium
PSNWLLAARCVRGLLSMS

SEQ ID NO: 1062677 - protein, 21 aa, Mycobacterium
PSWMARAGFQMMDPLKTAKAR

SEQ ID NO: 1062678 - protein, 18 aa, Mycobacterium
PTARRVLAHFGLDAHFEV

SEQ ID NO: 1062679 - protein, 21 aa, Mycobacterium
PTDRKTVCLFGDSAGAVVVGP

SEQ ID NO: 1062680 - protein, 17 aa, Mycobacterium
PTFRGEMIWCQLFSEPG

SEQ ID NO: 1062681 - protein, 18 aa, Mycobacterium
PTGARLAGRHGIGLLSIG

SEQ ID NO: 1062682 - protein, 18 aa, Mycobacterium
PTGGRWNNWAEFFHSDSI

SEQ ID NO: 1062683 - protein, 20 aa, Mycobacterium
PTGPCLEGWTTLTALAQATT

SEQ ID NO: 1062684 - protein, 19 aa, Mycobacterium
PTLPVPAGWPFGEEFPRTC

SEQ ID NO: 1062685 - protein, 18 aa, Mycobacterium
PTPCPEYDVSGLTGHLLN

SEQ ID NO: 1062686 - protein, 21 aa, Mycobacterium
PTQVLLRWNLQLGNAVIFGSS

SEQ ID NO: 1062687 - protein, 23 aa, Mycobacterium
PTQVRWRPFQFWPANTAVNIDAA

SEQ ID NO: 1062688 - protein, 28 aa, Mycobacterium
PTRRSPRTKARHRLRCPAPRRHTQDGSP

SEQ ID NO: 1062689 - protein, 18 aa, Mycobacterium
PTSPPCAIWCTRRAARCT

SEQ ID NO: 1062690 - protein, 24 aa, Mycobacterium
PTSTCATSFCWWHRGARRPFWARP

SEQ ID NO: 1062691 - protein, 18 aa, Mycobacterium
PTTCPECGTPLAPEKEGD

SEQ ID NO: 1062692 - protein, 18 aa, Mycobacterium
PTTVVEFGMSFGISTIHL

SEQ ID NO: 1062693 - protein, 17 aa, Mycobacterium
PTVVAGLRLRRTVASIV

SEQ ID NO: 1062694 - protein, 17 aa, Mycobacterium
PVAVVGIGCRFPGNVTG

SEQ ID NO: 1062695 - protein, 17 aa, Mycobacterium
PVCRPDCSGLCPQCGVA

SEQ ID NO: 1062696 - protein, 19 aa, Mycobacterium
PVEGWMPFGRVFETLAWGR

SEQ ID NO: 1062697 - protein, 21 aa, Mycobacterium
PVGDYCFWNLRNIVRFDKAIA

SEQ ID NO: 1062698 - protein, 23 aa, Mycobacterium
PVIGTKEFIAWLPTLLGLGSADA

SEQ ID NO: 1062699 - protein, 18 aa, Mycobacterium
PVKLRLGIGYVIQNAGLM

SEQ ID NO: 1062700 - protein, 22 aa, Mycobacterium
PVKMPSWLGVPARLVMASLIGN

SEQ ID NO: 1062701 - protein, 23 aa, Mycobacterium
PVLTRSGADWMPNFIDLLQRKLS

SEQ ID NO: 1062702 - protein, 19 aa, Mycobacterium
PVPQRGWRRWVHAVTRINF

SEQ ID NO: 1062703 - protein, 23 aa, Mycobacterium
PVPRIVAGIPVCLCGSSEVEVAR

SEQ ID NO: 1062704 - protein, 18 aa, Mycobacterium
PVPTVAIGHLHEQTVSVP

SEQ ID NO: 1062705 - protein, 18 aa, Mycobacterium
PVSYWKLNEHEIFQHYRS

SEQ ID NO: 1062706 - protein, 20 aa, Mycobacterium
PWPRGRARRKFGFYDQDLQP

SEQ ID NO: 1062707 - protein, 18 aa, Mycobacterium
PWRAKLVPAERLIVVEST

SEQ ID NO: 1062708 - protein, 17 aa, Mycobacterium
PYPKLSLSQRDSIFDYT

SEQ ID NO: 1062709 - protein, 18 aa, Mycobacterium
QAAGRLGEFSDWAKSLNQ

SEQ ID NO: 1062710 - protein, 17 aa, Mycobacterium
QADHILRWIQRWRSSEF

SEQ ID NO: 1062711 - protein, 19 aa, Mycobacterium
QADKYDVPRICFVNKMDKI

SEQ ID NO: 1062712 - protein, 21 aa, Mycobacterium
QAEAFHAQFAQLMANGAGTYA

SEQ ID NO: 1062713 - protein, 23 aa, Mycobacterium
QAFPKSRFTGIDFSEPAIAAASQ

SEQ ID NO: 1062714 - protein, 22 aa, Mycobacterium
QAIWPHRMFSLLAGFVEAGESF

SEQ ID NO: 1062715 - protein, 20 aa, Mycobacterium
QALKPWYGYFCKRPCFHDEY

SEQ ID NO: 1062716 - protein, 18 aa, Mycobacterium
QALLDRPLIGNGANGAAG

SEQ ID NO: 1062717 - protein, 20 aa, Mycobacterium
QALLGRPIIGNGADGAPGSG

SEQ ID NO: 1062718 - protein, 21 aa, Mycobacterium
QAQRLSARLARIGEVQCDHDR

SEQ ID NO: 1062719 - protein, 22 aa, Mycobacterium
QARLVLGQALAWRGRGREAGQV

SEQ ID NO: 1062720 - protein, 23 aa, Mycobacterium
QARTIRIPVHMVEVINKLGRIQR

SEQ ID NO: 1062721 - protein, 24 aa, Mycobacterium
QDFARASFSYGLNAKWPVYLSTKN

SEQ ID NO: 1062722 - protein, 17 aa, Mycobacterium
QDIRFGLGAVRNVGANV

SEQ ID NO: 1062723 - protein, 25 aa, Mycobacterium
QDPRPRLVGALAMAVVRIALDDWLG

SEQ ID NO: 1062724 - protein, 23 aa, Mycobacterium
QDVYLRWAVAAFRLATSGVADST

SEQ ID NO: 1062725 - protein, 19 aa, Mycobacterium
QEAWLRWDAAPGRDDVADL

SEQ ID NO: 1062726 - protein, 26 aa, Mycobacterium
QEFAGLPVRRVWRPTTFYTMVLQQLT

SEQ ID NO: 1062727 - protein, 21 aa, Mycobacterium
QEMQRLMALPVDMRPDPSDLS

SEQ ID NO: 1062728 - protein, 19 aa, Mycobacterium
QEPRLNWAIGRQSEGTVLV

SEQ ID NO: 1062729 - protein, 24 aa, Mycobacterium
QEVRWCPGCGDYVILNTIRNFLPE

SEQ ID NO: 1062730 - protein, 17 aa, Mycobacterium
QFHQWFTQTLSGAGLAY

SEQ ID NO: 1062731 - protein, 23 aa, Mycobacterium
QFIKRLGTYAAIFTVPNFLELDY

SEQ ID NO: 1062732 - protein, 18 aa, Mycobacterium
QGAALWGAGFGGDGAVGG

SEQ ID NO: 1062733 - protein, 23 aa, Mycobacterium
QGFAWPWSICRWVTGENPKVGQL

SEQ ID NO: 1062734 - protein, 24 aa, Mycobacterium
QGILCGSIVSGLRMRPGNWAGAYA

SEQ ID NO: 1062735 - protein, 17 aa, Mycobacterium
QGLTVSGTRAWLNRQLR

SEQ ID NO: 1062736 - protein, 18 aa, Mycobacterium
QGRAGSRVSIRWEIPCET

SEQ ID NO: 1062737 - protein, 21 aa, Mycobacterium
QGWVNLHFSLLPAWRGAAPVQ

SEQ ID NO: 1062738 - protein, 25 aa, Mycobacterium
QGYQVLSARALEFHTRLAQALSAGA

SEQ ID NO: 1062739 - protein, 28 aa, Mycobacterium
QHRPSRLAVCLDLDWRPQFRVDLIPSYK

SEQ ID NO: 1062740 - protein, 22 aa, Mycobacterium
QHWELRIKPRFGHVPVDEITRA

SEQ ID NO: 1062741 - protein, 20 aa, Mycobacterium
QIGKFRLVFLTGPKQGDDDG

SEQ ID NO: 1062742 - protein, 25 aa, Mycobacterium
QIMRYRGYCSLTWALNGVLPGAEAA

SEQ ID NO: 1062743 - protein, 24 aa, Mycobacterium
QIPVGPRLGSVVVEVEHLDKGFGG

SEQ ID NO: 1062744 - protein, 22 aa, Mycobacterium
QIVPVHAALPWSERVATPAEFD

SEQ ID NO: 1062745 - protein, 18 aa, Mycobacterium
QKDFGVPAGHVFATGMSN

SEQ ID NO: 1062746 - protein, 18 aa, Mycobacterium
QKRGPGIQQFACRVRNLE

SEQ ID NO: 1062747 - protein, 19 aa, Mycobacterium
QLAAAVWRQAMPETEQLIV

SEQ ID NO: 1062748 - protein, 18 aa, Mycobacterium
QLAMVLGHFGIRVNIQAT

SEQ ID NO: 1062749 - protein, 19 aa, Mycobacterium
QLFKQLLMVAGMERYYQIA

SEQ ID NO: 1062750 - protein, 20 aa, Mycobacterium
QLLGEHGWHSALFGMQHETS

SEQ ID NO: 1062751 - protein, 19 aa, Mycobacterium
QLPGFRPGKVPARLLEARF

SEQ ID NO: 1062752 - protein, 17 aa, Mycobacterium
QLRCGVVVPGPPGSVSK

SEQ ID NO: 1062753 - protein, 20 aa, Mycobacterium
QLRSRFGFLAIHGGGARVDY

SEQ ID NO: 1062754 - protein, 24 aa, Mycobacterium
QLSKRTADMLLEFGNSSGLTNPAP

SEQ ID NO: 1062755 - protein, 21 aa, Mycobacterium
QLTLTELWRSYGIQPDLVIGH

SEQ ID NO: 1062756 - protein, 24 aa, Mycobacterium
QLTLTELWRSYGIQPDLVIGHSMG

SEQ ID NO: 1062757 - protein, 24 aa, Mycobacterium
QLTRKRLGTGLIEAFSTSCPHCSG

SEQ ID NO: 1062758 - protein, 23 aa, Mycobacterium
QMGKNGWLTLNWPKEYGGQDRSP

SEQ ID NO: 1062759 - protein, 25 aa, Mycobacterium
QMLVKLCLKDGIPLINIVRKPEQEE

SEQ ID NO: 1062760 - protein, 18 aa, Mycobacterium
QNAIVRWMQRESFAELRE

SEQ ID NO: 1062761 - protein, 22 aa, Mycobacterium
QPCADGLVRVCRPGGVIGLISW

SEQ ID NO: 1062762 - protein, 17 aa, Mycobacterium
QPWFTGRFATIGVSYLG

SEQ ID NO: 1062763 - protein, 26 aa, Mycobacterium
QPYPAWRELFSNILPAHIVKDVPGGF

SEQ ID NO: 1062764 - protein, 18 aa, Mycobacterium
QQALHAFRKFGFQLVIVA

SEQ ID NO: 1062765 - protein, 19 aa, Mycobacterium
QRFGEHFFYILYFQQPGVA

SEQ ID NO: 1062766 - protein, 21 aa, Mycobacterium
QRGAPIGRMWVRPFASDEADP

SEQ ID NO: 1062767 - protein, 24 aa, Mycobacterium
QRGEPVSCFLLRIEDNMESIGRSV

SEQ ID NO: 1062768 - protein, 19 aa, Mycobacterium
QRGWPVFLVSTVTRENLQP

SEQ ID NO: 1062769 - protein, 22 aa, Mycobacterium
QRIPRKWLDSGVIVMADTLEEL

SEQ ID NO: 1062770 - protein, 17 aa, Mycobacterium
QRLLVKLPSGWSLAQAA

SEQ ID NO: 1062771 - protein, 21 aa, Mycobacterium
QRLNSVLPLWLQYGGSPAQAA

SEQ ID NO: 1062772 - protein, 26 aa, Mycobacterium
QRLPPWRRHMRRSGLSMCPVMSAYHS

SEQ ID NO: 1062773 - protein, 21 aa, Mycobacterium
QRMSTVLSRRLWENAGSPEVD

SEQ ID NO: 1062774 - protein, 19 aa, Mycobacterium
QRRWAAMGIERGWQATMVL

SEQ ID NO: 1062775 - protein, 22 aa, Mycobacterium
QRWPETRIEPSLTRISALMDLL

SEQ ID NO: 1062776 - protein, 18 aa, Mycobacterium
QRYWGEPFPIVYDADGRP

SEQ ID NO: 1062777 - protein, 30 aa, Mycobacterium; identical to SEQ ID NO: 775271

SEQ ID NO: 1062778 - protein, 22 aa, Mycobacterium
QSGEVWISFLIVAPKYVASVAT

SEQ ID NO: 1062779 - protein, 21 aa, Mycobacterium
QSGSIGLGFAIPVDQAKRIAD

SEQ ID NO: 1062780 - protein, 26 aa, Mycobacterium
QSLRYVFCGGEPLSLATARRFAEILP

SEQ ID NO: 1062781 - protein, 18 aa, Mycobacterium
QSQVVAWWSPAYDEPNGG

SEQ ID NO: 1062782 - protein, 18 aa, Mycobacterium
QTGFARTGAMFACDHENV

SEQ ID NO: 1062783 - protein, 19 aa, Mycobacterium
QTGIGRTGAFFAHQHDSIT

SEQ ID NO: 1062784 - protein, 21 aa, Mycobacterium
QTGIGRTGAFFAHQHDSITPD

SEQ ID NO: 1062785 - protein, 18 aa, Mycobacterium
QTGIGRTGAFYAHQHDGI

SEQ ID NO: 1062786 - protein, 19 aa, Mycobacterium
QTLRCCIDWSYQRCSTAEQ

SEQ ID NO: 1062787 - protein, 21 aa, Mycobacterium
QTLRHAVAWSYDHLSDAEKVL

SEQ ID NO: 1062788 - protein, 18 aa, Mycobacterium
QTTECWRQWINIGNFPDH

SEQ ID NO: 1062789 - protein, 22 aa, Mycobacterium
QVAEAFSRYGAHLSRLNVLPVY

SEQ ID NO: 1062790 - protein, 23 aa, Mycobacterium
QVGYGRLGKWFWGFEQQGVVPDI

SEQ ID NO: 1062791 - protein, 17 aa, Mycobacterium
QVHRDIRGLAALGDIYA

SEQ ID NO: 1062792 - protein, 17 aa, Mycobacterium
QVIAMRVCIVIKLDRDG

SEQ ID NO: 1062793 - protein, 23 aa, Mycobacterium
QVLGFREHASWALASDALEFVDL

SEQ ID NO: 1062794 - protein, 22 aa, Mycobacterium
QVSCGRVAHSLWAVIVDPDTGT

SEQ ID NO: 1062795 - protein, 17 aa, Mycobacterium
QVTAVVCGWDYGTAYDI

SEQ ID NO: 1062796 - protein, 23 aa, Mycobacterium
QVTELRGGLLVNWDARESAFPPG

SEQ ID NO: 1062797 - protein, 23 aa, Mycobacterium
QYADGGCQLAFWRHDEHLVCEAR

SEQ ID NO: 1062798 - protein, 17 aa, Mycobacterium
QYQEVMSTYGIYNIDFD

SEQ ID NO: 1062799 - protein, 18 aa, Mycobacterium
QYQLPGIVHGLRWIADGD

SEQ ID NO: 1062800 - protein, 19 aa, Mycobacterium
RAAGDRGCGGRAPRQRRDL

SEQ ID NO: 1062801 - protein, 19 aa, Mycobacterium
RAAGLKAANTWHASRAIQE

SEQ ID NO: 1062802 - protein, 17 aa, Mycobacterium
RAAPVGRPCSLGAPAAP

SEQ ID NO: 1062803 - protein, 22 aa, Mycobacterium
RAARFGDRVFLKFGDQQMTYGE

SEQ ID NO: 1062804 - protein, 17 aa, Mycobacterium
RAARLKWWTTELQVRTA

SEQ ID NO: 1062805 - protein, 27 aa, Mycobacterium
RAAVGKPGWPGFVSVPLAAYRRHFETS

SEQ ID NO: 1062806 - protein, 17 aa, Mycobacterium
RAAVVAAGRPPRCRPTG

SEQ ID NO: 1062807 - protein, 18 aa, Mycobacterium
RADGALRRSIKFATFLDA

SEQ ID NO: 1062808 - protein, 22 aa, Mycobacterium
RAEGRYALMPGIIGALAGSGTP

SEQ ID NO: 1062809 - protein, 19 aa, Mycobacterium
RAEGVACYQLFISGLLDVT

SEQ ID NO: 1062810 - protein, 20 aa, Mycobacterium
RAESRWFAGAGFSLVNMTGY

SEQ ID NO: 1062811 - protein, 18 aa, Mycobacterium
RAFCARLLGIAAQRVRVI

SEQ ID NO: 1062812 - protein, 17 aa, Mycobacterium
RAGAALIHVSTDYVFDG

SEQ ID NO: 1062813 - protein, 19 aa, Mycobacterium
RAGAVVALLLPRSDHAILA

SEQ ID NO: 1062814 - protein, 22 aa, Mycobacterium
RAGGMGIPGFYTPAGVGTQIAD

SEQ ID NO: 1062815 - protein, 19 aa, Mycobacterium
RAGVLRFVVLDGLAKPGRM

SEQ ID NO: 1062816 - protein, 18 aa, Mycobacterium
RAHRGIVAVNELPDLAER

SEQ ID NO: 1062817 - protein, 18 aa, Mycobacterium
RAKLNWWESRALYGWTVL

SEQ ID NO: 1062818 - protein, 23 aa, Mycobacterium
RALARLGIYWAQEALAFGMTKRP

SEQ ID NO: 1062819 - protein, 18 aa, Mycobacterium
RALAVFGGLGLRLKSSDT

SEQ ID NO: 1062820 - protein, 21 aa, Mycobacterium
RALDEWRLLSAAALVGLVEAT

SEQ ID NO: 1062821 - protein, 21 aa, Mycobacterium
RALELPVRMGLATGEAEPHDA

SEQ ID NO: 1062822 - protein, 18 aa, Mycobacterium
RALIAVRGLHRFAAAEGL

SEQ ID NO: 1062823 - protein, 17 aa, Mycobacterium
RAMAAAMVRPGTQVVSV

SEQ ID NO: 1062824 - protein, 17 aa, Mycobacterium
RANPGMFSRIVIDYYGT

SEQ ID NO: 1062825 - protein, 17 aa, Mycobacterium
RANRLVHRFRRAGLREG

SEQ ID NO: 1062826 - protein, 19 aa, Mycobacterium
RAPESVQINWVYRGGRADL

SEQ ID NO: 1062827 - protein, 17 aa, Mycobacterium
RAPGARCAGSGTGRAAG

SEQ ID NO: 1062828 - protein, 19 aa, Mycobacterium
RAPLDLALFRSWKLHRELG

SEQ ID NO: 1062829 - protein, 18 aa, Mycobacterium
RAPRALPVLVIDGRDDTD

SEQ ID NO: 1062830 - protein, 17 aa, Mycobacterium
RAPRPGHRRIVFKFMTS

SEQ ID NO: 1062831 - protein, 19 aa, Mycobacterium
RAPSIDVFAGWRITSRQGG

SEQ ID NO: 1062832 - protein, 20 aa, Mycobacterium
RARARLAIGSALFGLLRADD

SEQ ID NO: 1062833 - protein, 21 aa, Mycobacterium
RARRAIAEFRIRGVSTNIPFL

SEQ ID NO: 1062834 - protein, 19 aa, Mycobacterium
RARRGIGTTAAITGHAPAP

SEQ ID NO: 1062835 - protein, 24 aa, Mycobacterium
RARRLARALHQWGFGASRERSQLA

SEQ ID NO: 1062836 - protein, 19 aa, Mycobacterium
RASAAAAVFEAAQAAIVHP

SEQ ID NO: 1062837 - protein, 21 aa, Mycobacterium
RASACSFERMRPCIHHRRHHC

SEQ ID NO: 1062838 - protein, 19 aa, Mycobacterium
RASALLISRLVSWVDDLWC

SEQ ID NO: 1062839 - protein, 17 aa, Mycobacterium
RATHPLLWKCGSPQRSA

SEQ ID NO: 1062840 - protein, 20 aa, Mycobacterium
RATPPIKWPTVIRHPKTGEE

SEQ ID NO: 1062841 - protein, 19 aa, Mycobacterium
RATPYIGHFQIRNRGTLGG

SEQ ID NO: 1062842 - protein, 19 aa, Mycobacterium
RATSMPVFRYRPFAKEVEP

SEQ ID NO: 1062843 - protein, 20 aa, Mycobacterium
RAVAEFVPRIGTLIDIVHRR

SEQ ID NO: 1062844 - protein, 19 aa, Mycobacterium
RAVARLPLRLVYPDGTSIG

SEQ ID NO: 1062845 - protein, 17 aa, Mycobacterium
RAVSVAWAVPAESCSAR

SEQ ID NO: 1062846 - protein, 23 aa, Mycobacterium
RAYFRGECLRRFGADIAAASWDS

SEQ ID NO: 1062847 - protein, 19 aa, Mycobacterium
RAYRLDWPAGTTVYEIDQP

SEQ ID NO: 1062848 - protein, 19 aa, Mycobacterium
RAYRLDWPGGTMVYEIDLP

SEQ ID NO: 1062849 - protein, 18 aa, Mycobacterium
RAYRLGWPAGTVVHEVDM

SEQ ID NO: 1062850 - protein, 19 aa, Mycobacterium
RAYRLKWPNGATVFEIDLP

SEQ ID NO: 1062851 - protein, 21 aa, Mycobacterium
RAYRLNWPSGMTVYEIDQPQV

SEQ ID NO: 1062852 - protein, 20 aa, Mycobacterium
RCAGRIPKRFWAQASSPTLV

SEQ ID NO: 1062853 - protein, 19 aa, Mycobacterium
RCLMLGLSVVGMRWRSVLR

SEQ ID NO: 1062854 - protein, 19 aa, Mycobacterium
RCVTYPLLAVQAWATHHDT

SEQ ID NO: 1062855 - protein, 18 aa, Mycobacterium
RDAALCLATLRVGADPGG

SEQ ID NO: 1062856 - protein, 19 aa, Mycobacterium
RDEDGRWGLGPAITELAAH

SEQ ID NO: 1062857 - protein, 17 aa, Mycobacterium
RDFQRIIGMEARVQIQG

SEQ ID NO: 1062858 - protein, 20 aa, Mycobacterium
RDGRWYWHWDPAMMTAPGDD

SEQ ID NO: 1062859 - protein, 18 aa, Mycobacterium
RDKRLLVFPVKRLADLGF

SEQ ID NO: 1062860 - protein, 19 aa, Mycobacterium
RDKRLLVFPVKRLADLGFH

SEQ ID NO: 1062861 - protein, 18 aa, Mycobacterium
RDLAGFGRRFIDVDPEDL

SEQ ID NO: 1062862 - protein, 25 aa, Mycobacterium
RDLELRWAGLRAHNRWLADFCSLSP

SEQ ID NO: 1062863 - protein, 20 aa, Mycobacterium
RDNRFGVCGYCRGGRVSMIV

SEQ ID NO: 1062864 - protein, 17 aa, Mycobacterium
RDRLSEVLPAYMVPAAF

SEQ ID NO: 1062865 - protein, 22 aa, Mycobacterium
RDRVRPCLPVRTWAPVASPSIS

SEQ ID NO: 1062866 - protein, 17 aa, Mycobacterium
RDSLSFKLRHLLMLEAK

SEQ ID NO: 1062867 - protein, 19 aa, Mycobacterium
RDSRLVLTTGWPLRSARPR

SEQ ID NO: 1062868 - protein, 19 aa, Mycobacterium
RDTGRWRVPLILRLDPQVG

SEQ ID NO: 1062869 - protein, 17 aa, Mycobacterium
RDVLAALHWVRENIATF

SEQ ID NO: 1062870 - protein, 25 aa, Mycobacterium
REFFGLLIRICLGIAAWLRGAFATA

SEQ ID NO: 1062871 - protein, 18 aa, Mycobacterium
REGKVPAVMYGHGAEPQH

SEQ ID NO: 1062872 - protein, 20 aa, Mycobacterium
RELEAMPDLVARVISAIKPV

SEQ ID NO: 1062873 - protein, 17 aa, Mycobacterium
RELPEWLSADVAILGEP

SEQ ID NO: 1062874 - protein, 25 aa, Mycobacterium
RELPLPYPARSWRSYPRCSDSSSSK

SEQ ID NO: 1062875 - protein, 20 aa, Mycobacterium
RELRSSGAVFGLLDIDDEFF

SEQ ID NO: 1062876 - protein, 24 aa, Mycobacterium
RELVEVPVGFKWFVDGLIGGTIGF

SEQ ID NO: 1062877 - protein, 23 aa, Mycobacterium
REMAYEGKIDWAFAELLALGSLV

SEQ ID NO: 1062878 - protein, 20 aa, Mycobacterium
REMLPHNAVEYFVSYYDYYQ

SEQ ID NO: 1062879 - protein, 17 aa, Mycobacterium
RERMRILQDEFIKRGQE

SEQ ID NO: 1062880 - protein, 17 aa, Mycobacterium
RESALRWLAKVGAEQLV

SEQ ID NO: 1062881 - protein, 20 aa, Mycobacterium
RFCVRCLDPLVGRDSFDIIA

SEQ ID NO: 1062882 - protein, 18 aa, Mycobacterium
RFGVPVPNISAWRNGLVG

SEQ ID NO: 1062883 - protein, 20 aa, Mycobacterium
RFKGLCPYAGELIVVGEAEP

SEQ ID NO: 1062884 - protein, 19 aa, Mycobacterium
RFQFDQVRRLLAWATPYRE

SEQ ID NO: 1062885 - protein, 18 aa, Mycobacterium
RFRILPTLWEPGGDEITL

SEQ ID NO: 1062886 - protein, 18 aa, Mycobacterium
RFTWHLPKNRTWTYDGQL

SEQ ID NO: 1062887 - protein, 19 aa, Mycobacterium
RFVVLDGLAKPGRMAGPDP

SEQ ID NO: 1062888 - protein, 24 aa, Mycobacterium
RFYRLAQELVWQWMFGRITADSRD

SEQ ID NO: 1062889 - protein, 19 aa, Mycobacterium
RGAFHVVRPAFGLMCDQLY

SEQ ID NO: 1062890 - protein, 18 aa, Mycobacterium
RGAGDWAMRELVVLHEVA

SEQ ID NO: 1062891 - protein, 19 aa, Mycobacterium
RGAGGFGYDPVFIADGANR

SEQ ID NO: 1062892 - protein, 21 aa, Mycobacterium
RGCLGRPWLFAELSAAFTGNP

SEQ ID NO: 1062893 - protein, 20 aa, Mycobacterium
RGDIKVALFGNHAPKTVANF

SEQ ID NO: 1062894 - protein, 18 aa, Mycobacterium
RGGFPGMLLGSVSRAVVN

SEQ ID NO: 1062895 - protein, 18 aa, Mycobacterium
RGGFPGMLLGSVSSTVAH

SEQ ID NO: 1062896 - protein, 18 aa, Mycobacterium
RGGLRWSDRRDDFRTEIL

SEQ ID NO: 1062897 - protein, 21 aa, Mycobacterium
RGGPPRLRFVAVGRHQNGELT

SEQ ID NO: 1062898 - protein, 18 aa, Mycobacterium
RGLCGYRRFFSITSLAGL

SEQ ID NO: 1062899 - protein, 17 aa, Mycobacterium
RGLPHWADPGARRPGEI

SEQ ID NO: 1062900 - protein, 21 aa, Mycobacterium
RGNLAFRWFLADGVPARPEVK

SEQ ID NO: 1062901 - protein, 17 aa, Mycobacterium
RGNLNWGSGNLGNANVG

SEQ ID NO: 1062902 - protein, 21 aa, Mycobacterium
RGPALLISRLVSWVDDLWCRA

SEQ ID NO: 1062903 - protein, 17 aa, Mycobacterium
RGPGRFFTMRLALSDIG

SEQ ID NO: 1062904 - protein, 18 aa, Mycobacterium
RGPMLHRALQQFLADVYW

SEQ ID NO: 1062905 - protein, 20 aa, Mycobacterium
RGRGLMCAFDLPTTADRDEL

SEQ ID NO: 1062906 - protein, 17 aa, Mycobacterium
RGTKVAHAHLRYLNPFP

SEQ ID NO: 1062907 - protein, 19 aa, Mycobacterium
RGVLFPKHRTDLLGCAISV

SEQ ID NO: 1062908 - protein, 17 aa, Mycobacterium
RGVVAVCDFGGSGTSIT

SEQ ID NO: 1062909 - protein, 19 aa, Mycobacterium
RGYVKRNRVAALMRDVRFL

SEQ ID NO: 1062910 - protein, 21 aa, Mycobacterium
RHIHDFPALWYVPAAGLVYIA

SEQ ID NO: 1062911 - protein, 19 aa, Mycobacterium
RHPHCAWTVIIDEAYPEVK

SEQ ID NO: 1062912 - protein, 17 aa, Mycobacterium
RHVQLPGFRPGKVPARL

SEQ ID NO: 1062913 - protein, 27 aa, Mycobacterium
RHWRRRRVRRHRLRNGGIRRRHRRHRR

SEQ ID NO: 1062914 - protein, 17 aa, Mycobacterium
RIADGWLGTSFVPEGAG

SEQ ID NO: 1062915 - protein, 20 aa, Mycobacterium
RIAGRLGLRPDVRRMPLFGL

SEQ ID NO: 1062916 - protein, 18 aa, Mycobacterium
RIAHAWSLSFDASWQPMV

SEQ ID NO: 1062917 - protein, 25 aa, Mycobacterium
RIAPRTMLCGYAWRVHVNISDAHFA

SEQ ID NO: 1062918 - protein, 20 aa, Mycobacterium
RICIPVPFYHCFGMVMGNLA

SEQ ID NO: 1062919 - protein, 20 aa, Mycobacterium
RIDTWDGFYCFAAELTSPML

SEQ ID NO: 1062920 - protein, 25 aa, Mycobacterium
RIFRSTRPWFRGCSHPPSSTSIPVS

SEQ ID NO: 1062921 - protein, 20 aa, Mycobacterium
RIGKSFLLLFGFLPFGFDDI

SEQ ID NO: 1062922 - protein, 18 aa, Mycobacterium
RILAPRSRYEEIVEAVSA

SEQ ID NO: 1062923 - protein, 18 aa, Mycobacterium
RIPSTWCGVFGLKTQRDR

SEQ ID NO: 1062924 - protein, 18 aa, Mycobacterium
RIQLMAFAYDGAWAEYTV

SEQ ID NO: 1062925 - protein, 17 aa, Mycobacterium
RIRVNAIAPGSILTSAL

SEQ ID NO: 1062926 - protein, 17 aa, Mycobacterium
RITALMCTADILALSAM

SEQ ID NO: 1062927 - protein, 19 aa, Mycobacterium
RIVPVCSMVVTVLDKHPEY

SEQ ID NO: 1062928 - protein, 19 aa, Mycobacterium
RIVREFPFNFMLWDLDRRI

SEQ ID NO: 1062929 - protein, 18 aa, Mycobacterium
RKDWDWLVSINVMGVVHG

SEQ ID NO: 1062930 - protein, 19 aa, Mycobacterium
RKIWSGAGTFLFTRTTVGE

SEQ ID NO: 1062931 - protein, 18 aa, Mycobacterium
RKKLVWWDAELGEWTGHD

SEQ ID NO: 1062932 - protein, 17 aa, Mycobacterium
RKLQLANRVELTRYAIE

SEQ ID NO: 1062933 - protein, 18 aa, Mycobacterium
RKPLTWRSSTRIAGAFGP

SEQ ID NO: 1062934 - protein, 19 aa, Mycobacterium
RKRVVAVSFPRDLAITPVK

SEQ ID NO: 1062935 - protein, 17 aa, Mycobacterium
RKSRSEMAWAFPAVPMV

SEQ ID NO: 1062936 - protein, 20 aa, Mycobacterium
RKVLPGYILVRMDLTDDSWA

SEQ ID NO: 1062937 - protein, 18 aa, Mycobacterium
RLAACPRPRWPRTTPTTW

SEQ ID NO: 1062938 - protein, 19 aa, Mycobacterium
RLADAWVWDMYRPARFVKQ

SEQ ID NO: 1062939 - protein, 18 aa, Mycobacterium
RLARFGAGWIPWGPDARD

SEQ ID NO: 1062940 - protein, 20 aa, Mycobacterium
RLAWWPTRLPTLIVSGAADR

SEQ ID NO: 1062941 - protein, 25 aa, Mycobacterium
RLDFLTVLRLDWLLAIPDEDWQPVA

SEQ ID NO: 1062942 - protein, 17 aa, Mycobacterium
RLERLWLPGPDRLLDCV

SEQ ID NO: 1062943 - protein, 18 aa, Mycobacterium
RLETLLALIEGWVQTVVT

SEQ ID NO: 1062944 - protein, 20 aa, Mycobacterium
RLEVLPARAFGVVMRGTARY

SEQ ID NO: 1062945 - protein, 18 aa, Mycobacterium
RLGRPLRIAHAWSLSFDA

SEQ ID NO: 1062946 - protein, 18 aa, Mycobacterium
RLGSDRGLARFIDQVARR

SEQ ID NO: 1062947 - protein, 20 aa, Mycobacterium
RLGVDAIDLFQLHRIDRNYP

SEQ ID NO: 1062948 - protein, 17 aa, Mycobacterium
RLHHLFARMPDARVHLY

SEQ ID NO: 1062949 - protein, 18 aa, Mycobacterium
RLHWYVPPSIRWIDRLKG

SEQ ID NO: 1062950 - protein, 20 aa, Mycobacterium
RLKRPIPFLPNTVGLITGRA

SEQ ID NO: 1062951 - protein, 17 aa, Mycobacterium
RLKVAVIEAGSKWLFPL

SEQ ID NO: 1062952 - protein, 18 aa, Mycobacterium
RLLCEQVGAAALVIPEEL

SEQ ID NO: 1062953 - protein, 20 aa, Mycobacterium
RLLLEVAWEALEHAGIPPSS

SEQ ID NO: 1062954 - protein, 18 aa, Mycobacterium
RLPWDYRRVYGVDPAEQS

SEQ ID NO: 1062955 - protein, 17 aa, Mycobacterium
RLRAGGMGIPGFYTPAG

SEQ ID NO: 1062956 - protein, 32 aa, Mycobacterium
RLRECHSLRYVFCGGEPLPIALCRRVAEALPH

SEQ ID NO: 1062957 - protein, 20 aa, Mycobacterium
RLRELLKFEFLFSARVQFEK

SEQ ID NO: 1062958 - protein, 19 aa, Mycobacterium
RLRGTAGFMTVFRRSGARH

SEQ ID NO: 1062959 - protein, 18 aa, Mycobacterium
RLRLELDKRLGWKAEVEA

SEQ ID NO: 1062960 - protein, 19 aa, Mycobacterium
RLSEVLPAYMVPAAFMVID

SEQ ID NO: 1062961 - protein, 20 aa, Mycobacterium
RLTVPLGMIILRKGYGLGAM

SEQ ID NO: 1062962 - protein, 19 aa, Mycobacterium
RLVMSSGFYRAIQRDDVEL

SEQ ID NO: 1062963 - protein, 19 aa, Mycobacterium
RLWSRIRRRPIFAAGNSNG

SEQ ID NO: 1062964 - protein, 18 aa, Mycobacterium
RLYSWHRAMRIFDGPDEV

SEQ ID NO: 1062965 - protein, 18 aa, Mycobacterium
RMEKEIADVIALQEELGL

SEQ ID NO: 1062966 - protein, 19 aa, Mycobacterium
RMHRACLALTFGGSTNEVQ

SEQ ID NO: 1062967 - protein, 19 aa, Mycobacterium
RMKGRNVLHALGFDAFGLP

SEQ ID NO: 1062968 - protein, 17 aa, Mycobacterium
RNALGFNGYSLGAAPSG

SEQ ID NO: 1062969 - protein, 17 aa, Mycobacterium
RNFLYPRWSDFFDGIDP

SEQ ID NO: 1062970 - protein, 17 aa, Mycobacterium
RNLLARCAERGVDPMEL

SEQ ID NO: 1062971 - protein, 22 aa, Mycobacterium
RNRISGAFSVRFAWPGETVVTL

SEQ ID NO: 1062972 - protein, 18 aa, Mycobacterium
RNRVAALMRDVRFLRIGE

SEQ ID NO: 1062973 - protein, 17 aa, Mycobacterium
RNTFHWVLAFARSGLST

SEQ ID NO: 1062974 - protein, 19 aa, Mycobacterium
RPADCLRPLQVHALVSEVP

SEQ ID NO: 1062975 - protein, 19 aa, Mycobacterium
RPALEAALAILRDITAGAT

SEQ ID NO: 1062976 - protein, 21 aa, Mycobacterium
RPAPEFEAWLTGLGMADANGR

SEQ ID NO: 1062977 - protein, 20 aa, Mycobacterium
RPCLSIHAAIVFTSPNPRVR

SEQ ID NO: 1062978 - protein, 21 aa, Mycobacterium
RPDELHLGFNFRLARTDFDAA

SEQ ID NO: 1062979 - protein, 22 aa, Mycobacterium
RPDIKSVDAYSLLASRGATTEG

SEQ ID NO: 1062980 - protein, 18 aa, Mycobacterium
RPDVVVAFMSRFGDVIYN

SEQ ID NO: 1062981 - protein, 19 aa, Mycobacterium
RPEGLRRWMAITARIEPYD

SEQ ID NO: 1062982 - protein, 19 aa, Mycobacterium
RPELVSSIGSLARVLERLS

SEQ ID NO: 1062983 - protein, 28 aa, Mycobacterium
RPFTRDKIEAVLGWPRGHIMWLYEQDIQ

SEQ ID NO: 1062984 - protein, 23 aa, Mycobacterium
RPGELIALLLPRTHRGIIAILAV

SEQ ID NO: 1062985 - protein, 20 aa, Mycobacterium
RPGGRLGLVWNTRDERLGWV

SEQ ID NO: 1062986 - protein, 22 aa, Mycobacterium
RPGQTRWRLAVEKVLRGVGLRL

SEQ ID NO: 1062987 - protein, 21 aa, Mycobacterium
RPGSWWKNFGAKMHYRASAML

SEQ ID NO: 1062988 - protein, 20 aa, Mycobacterium
RPGVEHLLRYGATDRVLLSG

SEQ ID NO: 1062989 - protein, 21 aa, Mycobacterium
RPGWAPAAFITACARSAWRSG

SEQ ID NO: 1062990 - protein, 19 aa, Mycobacterium
RPKHYWSIYQKMIVKGRDF

SEQ ID NO: 1062991 - protein, 17 aa, Mycobacterium
RPLFFAFQCLPLNWVRR

SEQ ID NO: 1062992 - protein, 18 aa, Mycobacterium
RPLRGWQRRAMVKYLASQ

SEQ ID NO: 1062993 - protein, 18 aa, Mycobacterium
RPLRPSFVNGLRNEIQVV

SEQ ID NO: 1062994 - protein, 18 aa, Mycobacterium
RPLWELHVIHGLAGDRVA

SEQ ID NO: 1062995 - protein, 19 aa, Mycobacterium
RPNQPGAYPIVLATYEIVC

SEQ ID NO: 1062996 - protein, 24 aa, Mycobacterium
RPPARLVGWTARFLGMVRPGDDVD

SEQ ID NO: 1062997 - protein, 19 aa, Mycobacterium
RPPFWQDMVELGWLGLHID

SEQ ID NO: 1062998 - protein, 18 aa, Mycobacterium
RPQFSAVLECASAARKLN

SEQ ID NO: 1062999 - protein, 26 aa, Mycobacterium
RPQLAVTFRNGWRWATVEGGAELAGP

SEQ ID NO: 1063000 - protein, 17 aa, Mycobacterium
RPREVHVVPELPKTRSG

SEQ ID NO: 1063001 - protein, 17 aa, Mycobacterium
RPRRAGVSSFGISGTNA

SEQ ID NO: 1063002 - protein, 23 aa, Mycobacterium
RPRRAVWIRCWTRTATSRRPWTR

SEQ ID NO: 1063003 - protein, 19 aa, Mycobacterium
RPSKIGFLAWHAWSDSQRG

SEQ ID NO: 1063004 - protein, 19 aa, Mycobacterium
RPSYSLSEIRHWLMVFAQR

SEQ ID NO: 1063005 - protein, 19 aa, Mycobacterium
RPWADAVWDTGIEFGTIGI

SEQ ID NO: 1063006 - protein, 25 aa, Mycobacterium
RPYVWGVTGPDRFDCSGLVQWAYAQ

SEQ ID NO: 1063007 - protein, 17 aa, Mycobacterium
RQLLDLMIHSVYSNKDS

SEQ ID NO: 1063008 - protein, 18 aa, Mycobacterium
RQLLFWAWLIYGGRLLRG

SEQ ID NO: 1063009 - protein, 19 aa, Mycobacterium
RQLLFWAWLIYGGRLLRGK

SEQ ID NO: 1063010 - protein, 23 aa, Mycobacterium
RQRAQELLDQFGLTYAGKRLVRT

SEQ ID NO: 1063011 - protein, 23 aa, Mycobacterium
RQRRDLFVGLLVDRRRLVDGQGA

SEQ ID NO: 1063012 - protein, 17 aa, Mycobacterium
RQRWCVRLVQGGGFAGP

SEQ ID NO: 1063013 - protein, 17 aa, Mycobacterium
RQSGCPAFQVCPRAFTG

SEQ ID NO: 1063014 - protein, 18 aa, Mycobacterium
RRAFCLVFPMSLMPSQDY

SEQ ID NO: 1063015 - protein, 30 aa, Mycobacterium
RRAGLRRWRRWRRRGRQGATHQRRHYQRYR

SEQ ID NO: 1063016 - protein, 20 aa, Mycobacterium
RRAGYKLARREGAREGRWTL

SEQ ID NO: 1063017 - protein, 18 aa, Mycobacterium
RRAKLYYLRELRGKKAKI

SEQ ID NO: 1063018 - protein, 19 aa, Mycobacterium
RRARGKLRAAVHRAAGDRG

SEQ ID NO: 1063019 - protein, 24 aa, Mycobacterium
RRECTGFIFNRVWAAIKRESLAVV

SEQ ID NO: 1063020 - protein, 17 aa, Mycobacterium
RRERRPWVPAAICLADF

SEQ ID NO: 1063021 - protein, 19 aa, Mycobacterium
RRGEPWFDPAGLFLALEGS

SEQ ID NO: 1063022 - protein, 17 aa, Mycobacterium
RRGRMLWSLPKGHIEQG

SEQ ID NO: 1063023 - protein, 22 aa, Mycobacterium
RRISAVKAFTAWAKWRGQLAAD

SEQ ID NO: 1063024 - protein, 23 aa, Mycobacterium
RRISAVKAFTAWAKWRGQLAADP

SEQ ID NO: 1063025 - protein, 17 aa, Mycobacterium
RRKHGLPSLGFNLCRIF

SEQ ID NO: 1063026 - protein, 22 aa, Mycobacterium
RRLAIECLRQLVAVAPAVFADF

SEQ ID NO: 1063027 - protein, 20 aa, Mycobacterium
RRLLGVLIDQEWKYGVATGV

SEQ ID NO: 1063028 - protein, 18 aa, Mycobacterium
RRLLRLCARYSAHPTVIF

SEQ ID NO: 1063029 - protein, 20 aa, Mycobacterium
RRLREFSAFDAFSDAELERV

SEQ ID NO: 1063030 - protein, 22 aa, Mycobacterium
RRLYTSRGWLPWHGPTSVLSPT

SEQ ID NO: 1063031 - protein, 21 aa, Mycobacterium
RRNAPCVLFFDEVDALGHRRS

SEQ ID NO: 1063032 - protein, 21 aa, Mycobacterium
RRPDLPSGKGLVIAEGVLVVQ

SEQ ID NO: 1063033 - protein, 19 aa, Mycobacterium
RRPRLRLVALMSYEGHIAG

SEQ ID NO: 1063034 - protein, 25 aa, Mycobacterium
RRPWVPAAICLADFGAVSTKQQEPY

SEQ ID NO: 1063035 - protein, 19 aa, Mycobacterium
RRRAVELLELVGIAQPERR

SEQ ID NO: 1063036 - protein, 21 aa, Mycobacterium
RRRCGWFDAVIARYATRVNGI

SEQ ID NO: 1063037 - protein, 20 aa, Mycobacterium
RRRGDKYFPAPGVQPHAAVD

SEQ ID NO: 1063038 - protein, 19 aa, Mycobacterium
RRRGRARSMGGPERLDRHH

SEQ ID NO: 1063039 - protein, 21 aa, Mycobacterium
RRRPFDLSRGPALRVVVLSVP

SEQ ID NO: 1063040 - protein, 22 aa, Mycobacterium
RRRRGRRGRGRGRGEQGANDGQ

SEQ ID NO: 1063041 - protein, 18 aa, Mycobacterium
RRRRLDWPQAALRLRGWP

SEQ ID NO: 1063042 - protein, 18 aa, Mycobacterium
RRSAIAWRAYRDGSGVDS

SEQ ID NO: 1063043 - protein, 22 aa, Mycobacterium
RRSPPGWATRSWCGFPGCAMVS

SEQ ID NO: 1063044 - protein, 24 aa, Mycobacterium
RRTSAVKAFTAWAVRRGLLATDPA

SEQ ID NO: 1063045 - protein, 17 aa, Mycobacterium
RRVLELAAALSDDFERA

SEQ ID NO: 1063046 - protein, 23 aa, Mycobacterium
RRWQRLLFDNGWLIPGNPPEFGG

SEQ ID NO: 1063047 - protein, 24 aa, Mycobacterium
RRWQRLLFDNGWLLPGQSPEFGGR

SEQ ID NO: 1063048 - protein, 26 aa, Mycobacterium
RRWRRRWTGRLRRRRLVRATRRHWRR

SEQ ID NO: 1063049 - protein, 19 aa, Mycobacterium
RRYLRACQQLGYQDPFLAK

SEQ ID NO: 1063050 - protein, 17 aa, Mycobacterium
RSAAIAYRASMDAFVAA

SEQ ID NO: 1063051 - protein, 19 aa, Mycobacterium
RSAEEVRFLMGFNRDVVRR

SEQ ID NO: 1063052 - protein, 17 aa, Mycobacterium
RSAHAVFCRAVIVGPPL

SEQ ID NO: 1063053 - protein, 18 aa, Mycobacterium
RSALAYQVHVGRWDQLDG

SEQ ID NO: 1063054 - protein, 20 aa, Mycobacterium
RSAPVVRAAPVGRPCSLGAP

SEQ ID NO: 1063055 - protein, 17 aa, Mycobacterium
RSCRAVKSNAIVIVADG

SEQ ID NO: 1063056 - protein, 17 aa, Mycobacterium
RSGEVIVRKNRHWYSTG

SEQ ID NO: 1063057 - protein, 17 aa, Mycobacterium
RSGIPFVAAESFIAIDL

SEQ ID NO: 1063058 - protein, 17 aa, Mycobacterium
RSGMLPRSWDPAGVAGE

SEQ ID NO: 1063059 - protein, 18 aa, Mycobacterium
RSGMLPRSWDPAGVAGER

SEQ ID NO: 1063060 - protein, 21 aa, Mycobacterium
RSRLMLDIASWRRKRREELAA

SEQ ID NO: 1063061 - protein, 18 aa, Mycobacterium
RSSVATWLFGIVKNTASR

SEQ ID NO: 1063062 - protein, 19 aa, Mycobacterium
RSTIILAMWQYLLHRYTSQ

SEQ ID NO: 1063063 - protein, 22 aa, Mycobacterium
RSTTLALRWLVGYSRQRREKTM

SEQ ID NO: 1063064 - protein, 20 aa, Mycobacterium
RTADMKALFSAIIDDEPLPL

SEQ ID NO: 1063065 - protein, 23 aa, Mycobacterium
RTALALNHLVCTRFRSDALQIIA

SEQ ID NO: 1063066 - protein, 21 aa, Mycobacterium
RTFARRRIDAILAGVPAAASP

SEQ ID NO: 1063067 - protein, 19 aa, Mycobacterium
RTGRAWGFEHCDIEPDMVV

SEQ ID NO: 1063068 - protein, 19 aa, Mycobacterium
RTIRGCGAPVMSLRTDRDW

SEQ ID NO: 1063069 - protein, 17 aa, Mycobacterium
RTKRWPDVLAQFPEATP

SEQ ID NO: 1063070 - protein, 18 aa, Mycobacterium
RTLCLDAKLYAGGMASTV

SEQ ID NO: 1063071 - protein, 18 aa, Mycobacterium
RTLGLRRIRHTVVRDDNA

SEQ ID NO: 1063072 - protein, 17 aa, Mycobacterium
RTLRLDQMIRYYVEHQL

SEQ ID NO: 1063073 - protein, 19 aa, Mycobacterium
RTPESWVLIDFEGESGQPL

SEQ ID NO: 1063074 - protein, 17 aa, Mycobacterium
RTPIDWDGYTPPLPAQG

SEQ ID NO: 1063075 - protein, 19 aa, Mycobacterium
RTPTIAAVHGWCIGGALDL

SEQ ID NO: 1063076 - protein, 18 aa, Mycobacterium
RTPTIASVHGWCIGGGVD

SEQ ID NO: 1063077 - protein, 18 aa, Mycobacterium
RTRIRPHFFPFTEPSAEV

SEQ ID NO: 1063078 - protein, 22 aa, Mycobacterium
RTRKAGAVGLVMAEPLTYFFSD

SEQ ID NO: 1063079 - protein, 19 aa, Mycobacterium
RTRYDAVWCSGMRAKLGLP

SEQ ID NO: 1063080 - protein, 20 aa, Mycobacterium
RTSIDAGWLLDYWSDRVYPL

SEQ ID NO: 1063081 - protein, 20 aa, Mycobacterium
RTTLNLKACIKAAADRVVFI

SEQ ID NO: 1063082 - protein, 17 aa, Mycobacterium
RTVVLRLRFDDFSRATR

SEQ ID NO: 1063083 - protein, 20 aa, Mycobacterium
RTWTPPRVMRWKTCSTSGHR

SEQ ID NO: 1063084 - protein, 18 aa, Mycobacterium
RVAARLLAVVPTGVKDRA

SEQ ID NO: 1063085 - protein, 21 aa, Mycobacterium
RVAELPLCITVTLVDGLVLAR

SEQ ID NO: 1063086 - protein, 17 aa, Mycobacterium
RVARLLAYRAVALRDDP

SEQ ID NO: 1063087 - protein, 29 aa, Mycobacterium
RVARRAASRQASWLPARTASAVLAVTPGL

SEQ ID NO: 1063088 - protein, 17 aa, Mycobacterium
RVFSEPIALNWAADGTD

SEQ ID NO: 1063089 - protein, 19 aa, Mycobacterium
RVGALRRCVPMVGQIKDPT

SEQ ID NO: 1063090 - protein, 21 aa, Mycobacterium
RVGWFEGGIAWVPWALQDAEH

SEQ ID NO: 1063091 - protein, 23 aa, Mycobacterium
RVHGRLRLGPGWVSHILQDLAVR

SEQ ID NO: 1063092 - protein, 18 aa, Mycobacterium
RVIDCAPLWCAVDLRDGN

SEQ ID NO: 1063093 - protein, 19 aa, Mycobacterium
RVIGEYGAFVLHLQEAKVD

SEQ ID NO: 1063094 - protein, 18 aa, Mycobacterium
RVIPCLDIDAGRVVKGVN

SEQ ID NO: 1063095 - protein, 20 aa, Mycobacterium
RVIRTLRRLGIRSVAVYSDA

SEQ ID NO: 1063096 - protein, 22 aa, Mycobacterium
RVKRPSCSGGWAPTRMRSLVRQ

SEQ ID NO: 1063097 - protein, 17 aa, Mycobacterium
RVLAMAWEKQSESNAMW

SEQ ID NO: 1063098 - protein, 19 aa, Mycobacterium
RVLPYCWRDETPLSNHELR

SEQ ID NO: 1063099 - protein, 23 aa, Mycobacterium
RVRMMRWGFVPSWAKPGPQGAPE

SEQ ID NO: 1063100 - protein, 21 aa, Mycobacterium
RVRPGNCFAPFHWNDAFGEYL

SEQ ID NO: 1063101 - protein, 19 aa, Mycobacterium
RVVCGGISIPGRWDTTPDP

SEQ ID NO: 1063102 - protein, 17 aa, Mycobacterium
RVVKAHVPLSEMFGYVG

SEQ ID NO: 1063103 - protein, 22 aa, Mycobacterium
RVVMPVVVRWGMYRGVRKNHPL

SEQ ID NO: 1063104 - protein, 19 aa, Mycobacterium
RVVVLPWDRHIAAGTEIHL

SEQ ID NO: 1063105 - protein, 21 aa, Mycobacterium
RWADSFGGLVFDATGITDPAG

SEQ ID NO: 1063106 - protein, 19 aa, Mycobacterium
RWLPGPRELRAWALAAGSP

SEQ ID NO: 1063107 - protein, 20 aa, Mycobacterium
RWNAVWSFHVQPHWEDRVRL

SEQ ID NO: 1063108 - protein, 18 aa, Mycobacterium
RWPFCSGINHADMMFAGC

SEQ ID NO: 1063109 - protein, 19 aa, Mycobacterium
RWYSSSWRRWAFRPWNRCP

SEQ ID NO: 1063110 - protein, 17 aa, Mycobacterium
RYLAALMPMVWTACERD

SEQ ID NO: 1063111 - protein, 19 aa, Mycobacterium
RYLECPPRALAAAKAVINN

SEQ ID NO: 1063112 - protein, 17 aa, Mycobacterium
RYLRICVLTQYKSHSLD

SEQ ID NO: 1063113 - protein, 17 aa, Mycobacterium
RYWSVALESIWHECLEP

SEQ ID NO: 1063114 - protein, 25 aa, Mycobacterium
SAAHKARWGVCLARTDPDAPKHKGI

SEQ ID NO: 1063115 - protein, 18 aa, Mycobacterium
SAAVAALFTGHAQAYQWL

SEQ ID NO: 1063116 - protein, 19 aa, Mycobacterium
SAAVAGLFGGHAQAYQAVS

SEQ ID NO: 1063117 - protein, 22 aa, Mycobacterium
SAEWKVFLGLLRSRFETDKGKW

SEQ ID NO: 1063118 - protein, 17 aa, Mycobacterium
SAFKVPTVWLLLADDAD

SEQ ID NO: 1063119 - protein, 22 aa, Mycobacterium
SAFSGRCTLILIGDPKQAIYAF

SEQ ID NO: 1063120 - protein, 26 aa, Mycobacterium
SAGCRECHWCSCSGVRIGEAIEAGKP

SEQ ID NO: 1063121 - protein, 17 aa, Mycobacterium
SAGPPCGRWASTLRVSR

SEQ ID NO: 1063122 - protein, 18 aa, Mycobacterium
SAIPLGPDLIGKGGAGGP

SEQ ID NO: 1063123 - protein, 18 aa, Mycobacterium
SAKAVCWCLDGGESSGRR

SEQ ID NO: 1063124 - protein, 22 aa, Mycobacterium
SALIERAAVEFGIKAVVRQSDS

SEQ ID NO: 1063125 - protein, 20 aa, Mycobacterium
SAQGINVRWWLPQKVKQRKD

SEQ ID NO: 1063126 - protein, 19 aa, Mycobacterium
SARAEWAPEFAIHDLDSPD

SEQ ID NO: 1063127 - protein, 18 aa, Mycobacterium
SARAWLFTVARNMIIDDR

SEQ ID NO: 1063128 - protein, 18 aa, Mycobacterium
SAVLGFAVDGGWWVLGVH

SEQ ID NO: 1063129 - protein, 19 aa, Mycobacterium
SAYPRVLDFAAFRSIADEV

SEQ ID NO: 1063130 - protein, 20 aa, Mycobacterium
SCNWSCDWLESGSVLTAVLL

SEQ ID NO: 1063131 - protein, 22 aa, Mycobacterium
SCQSVIWGLAFGQWVGASASLM

SEQ ID NO: 1063132 - protein, 20 aa, Mycobacterium
SDARHGWAYRSAGAGRSVTV

SEQ ID NO: 1063133 - protein, 17 aa, Mycobacterium
SDFIAWPIRMEVERRAP

SEQ ID NO: 1063134 - protein, 24 aa, Mycobacterium
SDGRRWRLDFAWPGLRVAAEYDGV

SEQ ID NO: 1063135 - protein, 17 aa, Mycobacterium
SDIRAGAGLVLAGLVAD

SEQ ID NO: 1063136 - protein, 21 aa, Mycobacterium
SDLELYLFFSLLFSAGAETTR

SEQ ID NO: 1063137 - protein, 18 aa, Mycobacterium
SDPARLAGWWAEHFGGTA

SEQ ID NO: 1063138 - protein, 21 aa, Mycobacterium
SDPLWKVYVDLGWTELNDPAS

SEQ ID NO: 1063139 - protein, 17 aa, Mycobacterium
SEAAFARLCGVAPIPAS

SEQ ID NO: 1063140 - protein, 20 aa, Mycobacterium
SEAIGPFALGQVSGFNSGFF

SEQ ID NO: 1063141 - protein, 19 aa, Mycobacterium
SEFHARFTQMLSAGANEYS

SEQ ID NO: 1063142 - protein, 18 aa, Mycobacterium
SEFVWACTAVGYTFVGPD

SEQ ID NO: 1063143 - protein, 20 aa, Mycobacterium
SEGWRLYTRSRFAPYVEKLL

SEQ ID NO: 1063144 - protein, 17 aa, Mycobacterium
SEIARWVNEEGLSIDVS

SEQ ID NO: 1063145 - protein, 19 aa, Mycobacterium
SEPYCPVGISPLFETIEDL

SEQ ID NO: 1063146 - protein, 18 aa, Mycobacterium
SFALLALLCRRLSNEDVT

SEQ ID NO: 1063147 - protein, 18 aa, Mycobacterium
SFELRQGHTLGIVGESGS

SEQ ID NO: 1063148 - protein, 20 aa, Mycobacterium
SFGFKYGLPMDADMVMDVRF

SEQ ID NO: 1063149 - protein, 19 aa, Mycobacterium
SFGVFRTRYDAVWCSGMRA

SEQ ID NO: 1063150 - protein, 17 aa, Mycobacterium
SFIAVCGQCRWCATGME

SEQ ID NO: 1063151 - protein, 24 aa, Mycobacterium
SFSRYELLRLLAFSRTGALPITKA

SEQ ID NO: 1063152 - protein, 26 aa, Mycobacterium
SGAAGTAGGWVFGDGGADGSGAMSTG

SEQ ID NO: 1063153 - protein, 23 aa, Mycobacterium
SGAKLDVIVPMSFLCDGYGLNVT

SEQ ID NO: 1063154 - protein, 17 aa, Mycobacterium
SGALAVALANRWPTARI

SEQ ID NO: 1063155 - protein, 18 aa, Mycobacterium
SGAPRGSVYYHFPDGRNQ

SEQ ID NO: 1063156 - protein, 20 aa, Mycobacterium
SGAVASWFGGFAQEHQTATA

SEQ ID NO: 1063157 - protein, 21 aa, Mycobacterium
SGAVPDGWRVIGRVLDGPARV

SEQ ID NO: 1063158 - protein, 17 aa, Mycobacterium
SGAWCVAADFSVRMLAT

SEQ ID NO: 1063159 - protein, 22 aa, Mycobacterium
SGFPPRIWDMLLERFGREVDRR

SEQ ID NO: 1063160 - protein, 22 aa, Mycobacterium
SGGAGGDAWLFGSGGSGGSGGA

SEQ ID NO: 1063161 - protein, 25 aa, Mycobacterium
SGGKRLRPIFAYRGWPAVTTEDPDP

SEQ ID NO: 1063162 - protein, 21 aa, Mycobacterium
SGGLGGNAWLLGSGGTGGTGG

SEQ ID NO: 1063163 - protein, 24 aa, Mycobacterium
SGGRLTLGVGVGWSREEFAALGVP

SEQ ID NO: 1063164 - protein, 23 aa, Mycobacterium
SGGRVSLGVGFGWNTDELADHGV

SEQ ID NO: 1063165 - protein, 21 aa, Mycobacterium
SGGSAGLWGRGGNGGLGGTGA

SEQ ID NO: 1063166 - protein, 19 aa, Mycobacterium
SGILDRPLLRYTVSTDEGG

SEQ ID NO: 1063167 - protein, 19 aa, Mycobacterium
SGLLSGLFGTGGGHGGLGG

SEQ ID NO: 1063168 - protein, 23 aa, Mycobacterium
SGLRSLPWEGLKLAPGEPAIPTQ

SEQ ID NO: 1063169 - protein, 18 aa, Mycobacterium
SGMWLYRLSFAKAKWHSL

SEQ ID NO: 1063170 - protein, 22 aa, Mycobacterium
SGPMLSAAMAWDGLAVELGSAA

SEQ ID NO: 1063171 - protein, 19 aa, Mycobacterium
SGRFDAGVFKEDWRFSTKV

SEQ ID NO: 1063172 - protein, 20 aa, Mycobacterium
SGRIKLAWFLLNAARYMPAQ

SEQ ID NO: 1063173 - protein, 22 aa, Mycobacterium
SGRTRAALRFIRSCSGPLTPET

SEQ ID NO: 1063174 - protein, 20 aa, Mycobacterium
SGSPGGWLLGDGGAGGSGAA

SEQ ID NO: 1063175 - protein, 17 aa, Mycobacterium
SGVRLAIVASTWHTKIC

SEQ ID NO: 1063176 - protein, 22 aa, Mycobacterium
SGVSIYDMWARIYADTERTNLH

SEQ ID NO: 1063177 - protein, 17 aa, Mycobacterium
SGWSLTAQDVFNNVART

SEQ ID NO: 1063178 - protein, 17 aa, Mycobacterium
SHALSFASLVFYSSWFK

SEQ ID NO: 1063179 - protein, 19 aa, Mycobacterium
SHCYPRFPVFLEEVKRVLR

SEQ ID NO: 1063180 - protein, 25 aa, Mycobacterium
SHFLPRIVRGECFFGIGMSEPDSGS

SEQ ID NO: 1063181 - protein, 18 aa, Mycobacterium
SHHWPTWGRERIVEFLAL

SEQ ID NO: 1063182 - protein, 22 aa, Mycobacterium
SHLAGGCSRHAFGFNVLGPDGQ

SEQ ID NO: 1063183 - protein, 17 aa, Mycobacterium
SHLTVGGLRDWLLDTAA

SEQ ID NO: 1063184 - protein, 18 aa, Mycobacterium
SHSKRVFCEAVDIVSGIG

SEQ ID NO: 1063185 - protein, 20 aa, Mycobacterium
SIFLMCLPDRVLAYGDCAII

SEQ ID NO: 1063186 - protein, 22 aa, Mycobacterium
SIPVKRLRQAGVLELLLALANE

SEQ ID NO: 1063187 - protein, 19 aa, Mycobacterium
SIQKEWEWRISRGESLKNL

SEQ ID NO: 1063188 - protein, 17 aa, Mycobacterium
SISRTSFDWGVQVPEHP

SEQ ID NO: 1063189 - protein, 18 aa, Mycobacterium
SIYQATKFYELFVAAGFK

SEQ ID NO: 1063190 - protein, 17 aa, Mycobacterium
SKIELFTGIALLIQRDP

SEQ ID NO: 1063191 - protein, 21 aa, Mycobacterium
SKIIKFSGCYHGHVDALLADA

SEQ ID NO: 1063192 - protein, 17 aa, Mycobacterium
SKLALKWTRSVKGSLAA

SEQ ID NO: 1063193 - protein, 19 aa, Mycobacterium
SKLRTGGLLLNHCITRHDN

SEQ ID NO: 1063194 - protein, 22 aa, Mycobacterium
SKMNRFFLRGALVARLLSEAAW

SEQ ID NO: 1063195 - protein, 22 aa, Mycobacterium
SKNPKEHFNFFPLTVDVEERMY

SEQ ID NO: 1063196 - protein, 26 aa, Mycobacterium
SKPLVRLRVPFTLSRNEIDDVERGSQ

SEQ ID NO: 1063197 - protein, 21 aa, Mycobacterium
SKRAKLRFIRSCSAPLTQETA

SEQ ID NO: 1063198 - protein, 17 aa, Mycobacterium
SKRPRITLFAARNAASA

SEQ ID NO: 1063199 - protein, 17 aa, Mycobacterium
SKTRRPSVCNAAETLLV

SEQ ID NO: 1063200 - protein, 19 aa, Mycobacterium
SKTVIGLNMLRLWDDRGTL

SEQ ID NO: 1063201 - protein, 18 aa, Mycobacterium
SLAIAGLFSAHAKQYQAF

SEQ ID NO: 1063202 - protein, 19 aa, Mycobacterium
SLAIPRVFGAYGRDYQAFG

SEQ ID NO: 1063203 - protein, 24 aa, Mycobacterium
SLEDWKCWARWRLIRARAPWLTSD

SEQ ID NO: 1063204 - protein, 24 aa, Mycobacterium
SLEEVFIRAGIPYKVVGGVRFYER

SEQ ID NO: 1063205 - protein, 18 aa, Mycobacterium
SLGIAEWIFPTILDRGSD

SEQ ID NO: 1063206 - protein, 19 aa, Mycobacterium
SLGVTLWAQRLMPLGLAEA

SEQ ID NO: 1063207 - protein, 18 aa, Mycobacterium
SLMPICLGDDITDEDAFD

SEQ ID NO: 1063208 - protein, 19 aa, Mycobacterium
SLRFGLAFCEASGPRLVRR

SEQ ID NO: 1063209 - protein, 20 aa, Mycobacterium
SLSSDQAWAMLGVTPMIGVN

SEQ ID NO: 1063210 - protein, 19 aa, Mycobacterium
SLVPMLSMRLAFFDHLIDI

SEQ ID NO: 1063211 - protein, 20 aa, Mycobacterium
SMFERFLPRHLEIIYEINRR

SEQ ID NO: 1063212 - protein, 22 aa, Mycobacterium
SMMPMRVIGMLLGIPESDQIGV

SEQ ID NO: 1063213 - protein, 19 aa, Mycobacterium
SMRIFKSEMREMQSETKAE

SEQ ID NO: 1063214 - protein, 19 aa, Mycobacterium
SNAPALLGLIGLWYSNFLG

SEQ ID NO: 1063215 - protein, 26 aa, Mycobacterium
SNGLLWRGDYQGLWGIDYAITIPDTA

SEQ ID NO: 1063216 - protein, 17 aa, Mycobacterium
SNGWTGLVVHGAVRDSA

SEQ ID NO: 1063217 - protein, 24 aa, Mycobacterium
SNLSCGRFLLGLGASGPRVIEGLH

SEQ ID NO: 1063218 - protein, 19 aa, Mycobacterium
SNVQVVWEKFCRYFDVEPR

SEQ ID NO: 1063219 - protein, 25 aa, Mycobacterium
SPATWIDWLVNWYLPISQLFYNTVG

SEQ ID NO: 1063220 - protein, 18 aa, Mycobacterium
SPELPGWHLARGVRLTTS

SEQ ID NO: 1063221 - protein, 19 aa, Mycobacterium
SPEMIDWLSNYGVPFDSTV

SEQ ID NO: 1063222 - protein, 24 aa, Mycobacterium
SPHWPEYLGALGFPIHYRGNHLHL

SEQ ID NO: 1063223 - protein, 18 aa, Mycobacterium
SPKETWLRLLLLDDGLPR

SEQ ID NO: 1063224 - protein, 17 aa, Mycobacterium
SPPACWRPGVPAVGEPV

SEQ ID NO: 1063225 - protein, 26 aa, Mycobacterium
SPRSDRLFCVPATIDLAGAEIELVSM

SEQ ID NO: 1063226 - protein, 23 aa, Mycobacterium
SPSGRDCLDWVAGELWVGGANVA

SEQ ID NO: 1063227 - protein, 19 aa, Mycobacterium
SPVEQIRMSLAMAGWPKSD

SEQ ID NO: 1063228 - protein, 20 aa, Mycobacterium
SQADVIWKLRYTMRSQIFSR

SEQ ID NO: 1063229 - protein, 23 aa, Mycobacterium
SQGRFSFVAGMGYRPQEYHAAGK

SEQ ID NO: 1063230 - protein, 21 aa, Mycobacterium
SQQWLICSLVHKFRGGDDDKD

SEQ ID NO: 1063231 - protein, 24 aa, Mycobacterium
SQWISGEFSKLVQFILNLVNAPSE

SEQ ID NO: 1063232 - protein, 21 aa, Mycobacterium
SRAWRLPWPAGTTVFELDQPR

SEQ ID NO: 1063233 - protein, 18 aa, Mycobacterium
SRDFLSWAVKDAIECGEL

SEQ ID NO: 1063234 - protein, 19 aa, Mycobacterium
SRDFLSWAVKDAIECGELA

SEQ ID NO: 1063235 - protein, 17 aa, Mycobacterium
SREVWLMVSGGTKAEAV

SEQ ID NO: 1063236 - protein, 18 aa, Mycobacterium
SRGEMRWAPGRLWNSPNE

SEQ ID NO: 1063237 - protein, 22 aa, Mycobacterium
SRGKWDILRRMGFDDDHIGDSR

SEQ ID NO: 1063238 - protein, 19 aa, Mycobacterium
SRGRFPGRYRLAVLENLSR

SEQ ID NO: 1063239 - protein, 19 aa, Mycobacterium
SRICASLGLPERVLTQQLR

SEQ ID NO: 1063240 - protein, 20 aa, Mycobacterium
SRIDPVLARSWLLVNGTHAD

SEQ ID NO: 1063241 - protein, 21 aa, Mycobacterium
SRISAALNRYADWAQEMAGYA

SEQ ID NO: 1063242 - protein, 23 aa, Mycobacterium
SRKRNLVEFGFRLPSAVDNRPLQ

SEQ ID NO: 1063243 - protein, 21 aa, Mycobacterium
SRLPLVPPLLEWLHAVRQPVV

SEQ ID NO: 1063244 - protein, 18 aa, Mycobacterium
SRLWRLLLAPGRGIGRLV

SEQ ID NO: 1063245 - protein, 19 aa, Mycobacterium
SRMAIAMARAGGMGVLHRN

SEQ ID NO: 1063246 - protein, 19 aa, Mycobacterium
SRMPCPYLNPGRYVCDRPL

SEQ ID NO: 1063247 - protein, 20 aa, Mycobacterium
SRPPTELSFNLGADASQVRC

SEQ ID NO: 1063248 - protein, 20 aa, Mycobacterium
SRPRPAAPMLLADSRASARR

SEQ ID NO: 1063249 - protein, 19 aa, Mycobacterium
SRQGFDLTLEHWAAHDGLS

SEQ ID NO: 1063250 - protein, 17 aa, Mycobacterium
SRQSWPTHFKKRSTDAD

SEQ ID NO: 1063251 - protein, 21 aa, Mycobacterium
SRSEMAWAFPAVPMVVRIPAA

SEQ ID NO: 1063252 - protein, 25 aa, Mycobacterium
SRSTPRAGDGFIRLDVDGVAIYASP

SEQ ID NO: 1063253 - protein, 19 aa, Mycobacterium
SRTSFNWGVPVPGHPDHVM

SEQ ID NO: 1063254 - protein, 19 aa, Mycobacterium
SRVSIRWEIPCETAPGQYR

SEQ ID NO: 1063255 - protein, 17 aa, Mycobacterium
SRVSTFVAWLDGNAENA

SEQ ID NO: 1063256 - protein, 19 aa, Mycobacterium
SRVSTFVAWLNGNAENAGL

SEQ ID NO: 1063257 - protein, 20 aa, Mycobacterium
SRYTRSRFAPAFGPAASLEY

SEQ ID NO: 1063258 - protein, 22 aa, Mycobacterium
SSFSRPATWWSKAGGPFVALTQ

SEQ ID NO: 1063259 - protein, 18 aa, Mycobacterium
SSIPPVPGKFYWMTPTQV

SEQ ID NO: 1063260 - protein, 17 aa, Mycobacterium
SSIWYRIRINLQHIPPE

SEQ ID NO: 1063261 - protein, 19 aa, Mycobacterium
SSKEARSWWGNFLVQKANE

SEQ ID NO: 1063262 - protein, 20 aa, Mycobacterium
SSLVRRASCPVAVIRDEDPM

SEQ ID NO: 1063263 - protein, 18 aa, Mycobacterium
SSLVTGWARLHGYPVGIL

SEQ ID NO: 1063264 - protein, 22 aa, Mycobacterium
SSPFRFSICRRRLASATRPIAR

SEQ ID NO: 1063265 - protein, 27 aa, Mycobacterium
SSSSTRWSVERCHVSSFPAWRRASEPR

SEQ ID NO: 1063266 - protein, 20 aa, Mycobacterium
SSTQLPVWLSHAGADVLRTH

SEQ ID NO: 1063267 - protein, 21 aa, Mycobacterium
SSWKGRWPLGRGFERFYGFLG

SEQ ID NO: 1063268 - protein, 21 aa, Mycobacterium
SSWRRWAFRPWNRCPPTRRAR

SEQ ID NO: 1063269 - protein, 18 aa, Mycobacterium
SSYVASWYAAPLLVAGGR

SEQ ID NO: 1063270 - protein, 18 aa, Mycobacterium
STAIAALFGSHGQAFQAL

SEQ ID NO: 1063271 - protein, 18 aa, Mycobacterium
STDLRPARSFAVDYAGWV

SEQ ID NO: 1063272 - protein, 27 aa, Mycobacterium
STGIPRPSYRFMREVYDLFVAPHYFGD

SEQ ID NO: 1063273 - protein, 26 aa, Mycobacterium
STGLFCDLGWFGVWAILDAVVPRGSA

SEQ ID NO: 1063274 - protein, 24 aa, Mycobacterium
STIWPSASGWCWCSCRAAATARPA

SEQ ID NO: 1063275 - protein, 23 aa, Mycobacterium
STLLLTLLFRFMRPLIENGHVFL

SEQ ID NO: 1063276 - protein, 18 aa, Mycobacterium
STPRAGDGFIRLDRNGVV

SEQ ID NO: 1063277 - protein, 18 aa, Mycobacterium
STSRELPWRRPIASLNYL

SEQ ID NO: 1063278 - protein, 17 aa, Mycobacterium
STVPMWCRRQCRSGARY

SEQ ID NO: 1063279 - protein, 18 aa, Mycobacterium
STVVLAMWQYLLHHYSQQ

SEQ ID NO: 1063280 - protein, 18 aa, Mycobacterium
STVVLGMWQHLLHRYSGQ

SEQ ID NO: 1063281 - protein, 23 aa, Mycobacterium
SVAIAGLLRLHGQQYQQFGAHLS

SEQ ID NO: 1063282 - protein, 17 aa, Mycobacterium
SVGDLVIAWLLQRQAAV

SEQ ID NO: 1063283 - protein, 20 aa, Mycobacterium
SVHVPLRWVGPIKISGNEGQ

SEQ ID NO: 1063284 - protein, 17 aa, Mycobacterium
SVLELRADYGVGIVTAL

SEQ ID NO: 1063285 - protein, 21 aa, Mycobacterium
SVNMFAPWIRRIFIATDSTPP

SEQ ID NO: 1063286 - protein, 18 aa, Mycobacterium
SVPPFTWWRGIRARQLLE

SEQ ID NO: 1063287 - protein, 25 aa, Mycobacterium
SVPPGRLGWNWARFAFNGWKALGWM

SEQ ID NO: 1063288 - protein, 20 aa, Mycobacterium
SVRHPLRWHHPALVMWYPDQ

SEQ ID NO: 1063289 - protein, 17 aa, Mycobacterium
SVTAGLASGAWQGPASA

SEQ ID NO: 1063290 - protein, 21 aa, Mycobacterium
SVWEIFGALLGAGRLVVVPEH

SEQ ID NO: 1063291 - protein, 20 aa, Mycobacterium
SWFCDGCTATTVLVIMRPFR

SEQ ID NO: 1063292 - protein, 21 aa, Mycobacterium
SWQGWDELFDLARFVGVSRPG

SEQ ID NO: 1063293 - protein, 18 aa, Mycobacterium
SWQPELWCALVAVVGADP

SEQ ID NO: 1063294 - protein, 22 aa, Mycobacterium
SWTEPKGGYFISLDVMPGTARR

SEQ ID NO: 1063295 - protein, 17 aa, Mycobacterium
SYEPAFAIDVEWTLLAS

SEQ ID NO: 1063296 - protein, 20 aa, Mycobacterium
SYGSRCVRPPILYGDVARSH

SEQ ID NO: 1063297 - protein, 18 aa, Mycobacterium
SYTRPPSWRGLDVPEILL

SEQ ID NO: 1063298 - protein, 19 aa, Mycobacterium
SYYPWGIPRQFSAVLGSGS

SEQ ID NO: 1063299 - protein, 19 aa, Mycobacterium
TAAELSSWQRSWALACQKA

SEQ ID NO: 1063300 - protein, 17 aa, Mycobacterium
TAAQMTEFYAGLLGSYP

SEQ ID NO: 1063301 - protein, 20 aa, Mycobacterium
TAATRLQVWLTRSSADTFTL

SEQ ID NO: 1063302 - protein, 17 aa, Mycobacterium
TACLRKTDWLFPQYREL

SEQ ID NO: 1063303 - protein, 17 aa, Mycobacterium
TADAGGLGGNIGVAATA

SEQ ID NO: 1063304 - protein, 24 aa, Mycobacterium
TAEEFSWRASELFDAISSGVITIE

SEQ ID NO: 1063305 - protein, 20 aa, Mycobacterium
TAGLWCRPGLPGDGSDWNHS

SEQ ID NO: 1063306 - protein, 18 aa, Mycobacterium
TAGPGAWGNNVTTSIGDA

SEQ ID NO: 1063307 - protein, 23 aa, Mycobacterium
TAGRLGGFLTLRWTYCDPPSELP

SEQ ID NO: 1063308 - protein, 24 aa, Mycobacterium
TAHFCSMCGPKFCSMRITRDVRDY

SEQ ID NO: 1063309 - protein, 17 aa, Mycobacterium
TALVAAICRQLRDELSL

SEQ ID NO: 1063310 - protein, 17 aa, Mycobacterium
TALWLPGQVHVFIHGEA

SEQ ID NO: 1063311 - protein, 23 aa, Mycobacterium
TANLLFIRFEFRTGDASGHNMAT

SEQ ID NO: 1063312 - protein, 18 aa, Mycobacterium
TANPGVGVELDFAGSSEL

SEQ ID NO: 1063313 - protein, 18 aa, Mycobacterium
TAQAYRAVAEFVPRIGTL

SEQ ID NO: 1063314 - protein, 25 aa, Mycobacterium
TAQFPRPVVRPGYSALGGRQWAAAG

SEQ ID NO: 1063315 - protein, 19 aa, Mycobacterium
TARLKCPFTSLGVAPEAAS

SEQ ID NO: 1063316 - protein, 23 aa, Mycobacterium
TARRLASSYGHWVYSIRAGGGAA

SEQ ID NO: 1063317 - protein, 18 aa, Mycobacterium
TARSWAWLSGRNYVTPDD

SEQ ID NO: 1063318 - protein, 17 aa, Mycobacterium
TATHLVSVFAHRARLVP

SEQ ID NO: 1063319 - protein, 23 aa, Mycobacterium
TATLRPGLVVLVAFDPADRQQLS

SEQ ID NO: 1063320 - protein, 17 aa, Mycobacterium
TAVMMGVYFNEYQSMLA

SEQ ID NO: 1063321 - protein, 17 aa, Mycobacterium
TAWIAEGLFGYLPPEAQ

SEQ ID NO: 1063322 - protein, 17 aa, Mycobacterium
TAWNEFIPFLDYDTKIR

SEQ ID NO: 1063323 - protein, 17 aa, Mycobacterium
TAYAANAAEGWAMATAS

SEQ ID NO: 1063324 - protein, 24 aa, Mycobacterium
TDHRPELLLSFGFIPKVESRVGLI

SEQ ID NO: 1063325 - protein, 20 aa, Mycobacterium
TDLAWSRITYWRALLTSAVD

SEQ ID NO: 1063326 - protein, 23 aa, Mycobacterium
TDLGIRFMPTVGWAERGDLRAEG

SEQ ID NO: 1063327 - protein, 18 aa, Mycobacterium
TDVVIRWNGTINEILGDG

SEQ ID NO: 1063328 - protein, 18 aa, Mycobacterium
TEAIKLVALVADRGAQVR

SEQ ID NO: 1063329 - protein, 17 aa, Mycobacterium
TEALRWAMMRGEPLLVL

SEQ ID NO: 1063330 - protein, 18 aa, Mycobacterium
TECPAGTVGEIWVQGDNV

SEQ ID NO: 1063331 - protein, 19 aa, Mycobacterium
TEGPANPLILVFGRVSELS

SEQ ID NO: 1063332 - protein, 25 aa, Mycobacterium
TEHLPLLAPLRFIPYVGDPLAELLE

SEQ ID NO: 1063333 - protein, 20 aa, Mycobacterium
TEIGRLVPFVEWLRDAYPEQ

SEQ ID NO: 1063334 - protein, 21 aa, Mycobacterium
TEIRYPLNLIHLATVMWFDGP

SEQ ID NO: 1063335 - protein, 17 aa, Mycobacterium
TELFAVFDIYRTRFGAL

SEQ ID NO: 1063336 - protein, 17 aa, Mycobacterium
TESRMAIAMARAGGMGV

SEQ ID NO: 1063337 - protein, 20 aa, Mycobacterium
TETVLLELGMDWDRIDQLKR

SEQ ID NO: 1063338 - protein, 17 aa, Mycobacterium
TETWPPPGVVYRKFALR

SEQ ID NO: 1063339 - protein, 23 aa, Mycobacterium
TFIPKTRLTMIAPRAGLVTDPGA

SEQ ID NO: 1063340 - protein, 18 aa, Mycobacterium
TFNLGFADIGIFNAGAAN

SEQ ID NO: 1063341 - protein, 22 aa, Mycobacterium
TFWRKRTWFEGGYEPSITLNFM

SEQ ID NO: 1063342 - protein, 22 aa, Mycobacterium
TGAGVSGLWLLSGMSDDGVLTT

SEQ ID NO: 1063343 - protein, 17 aa, Mycobacterium
TGARWLCETFPTRLERG

SEQ ID NO: 1063344 - protein, 18 aa, Mycobacterium
TGATALRTAIMAVKAGEV

SEQ ID NO: 1063345 - protein, 26 aa, Mycobacterium
TGEVLSVPVGDAFLGRVINPLGQPID

SEQ ID NO: 1063346 - protein, 19 aa, Mycobacterium
TGFSEHWWWGQAHDFDNAD

SEQ ID NO: 1063347 - protein, 24 aa, Mycobacterium
TGGAGGTGGWLIGHSGTNGIGGTG

SEQ ID NO: 1063348 - protein, 26 aa, Mycobacterium
TGGNAGEFQSLLGISKGGDGGTGGDG

SEQ ID NO: 1063349 - protein, 21 aa, Mycobacterium
TGLNFPAGVAVDLNGNIYVAD

SEQ ID NO: 1063350 - protein, 17 aa, Mycobacterium
TGNSWRGPAAAVMSDVA

SEQ ID NO: 1063351 - protein, 23 aa, Mycobacterium
TGRLLELLPRFGFDDQACELLAQ

SEQ ID NO: 1063352 - protein, 18 aa, Mycobacterium
THTPAVCQRCCSTHLHGD

SEQ ID NO: 1063353 - protein, 18 aa, Mycobacterium
THVPEFLERIGIGAPEVE

SEQ ID NO: 1063354 - protein, 17 aa, Mycobacterium
TIAHGFMTLSLLPRLQH

SEQ ID NO: 1063355 - protein, 18 aa, Mycobacterium
TIHGYKRAFRIAGSGPAI

SEQ ID NO: 1063356 - protein, 18 aa, Mycobacterium
TILDSWCAALGRAFVADG

SEQ ID NO: 1063357 - protein, 18 aa, Mycobacterium
TISELWLRLLEAYRDSFF

SEQ ID NO: 1063358 - protein, 33 aa, Mycobacterium
TISGKYGYSYKVLGIKFNYPFNYSFDIPAITIP

SEQ ID NO: 1063359 - protein, 18 aa, Mycobacterium
TIVLPGMVVPITLDDAAQ

SEQ ID NO: 1063360 - protein, 25 aa, Mycobacterium
TKFYELFVAAGFKGKCAIVTSYEPN

SEQ ID NO: 1063361 - protein, 19 aa, Mycobacterium
TKQRCGVTALAAQAAGVVG

SEQ ID NO: 1063362 - protein, 17 aa, Mycobacterium
TLEELWWDRPFTLEGVD

SEQ ID NO: 1063363 - protein, 17 aa, Mycobacterium
TLERLIRGLDTIAATGN

SEQ ID NO: 1063364 - protein, 17 aa, Mycobacterium
TLFRRFGSRAGLMMVLL

SEQ ID NO: 1063365 - protein, 21 aa, Mycobacterium
TLNLKEWKAEWGVVDPQEARG

SEQ ID NO: 1063366 - protein, 25 aa, Mycobacterium
TLPNGRYSWRISLPAMVCYWSELAR

SEQ ID NO: 1063367 - protein, 20 aa, Mycobacterium
TLRNWLGMWSLRVAQARAAP

SEQ ID NO: 1063368 - protein, 19 aa, Mycobacterium
TLRPLRPAFSVGLGARLGS

SEQ ID NO: 1063369 - protein, 19 aa, Mycobacterium
TLRVGWSLADLAGRAAPGL

SEQ ID NO: 1063370 - protein, 33 aa, Mycobacterium
TLRYVFCGGEPLSLALCRRFAAVLPHAELVNLY

SEQ ID NO: 1063371 - protein, 21 aa, Mycobacterium
TLSAYGVRYLFGVPGAKIDSV

SEQ ID NO: 1063372 - protein, 20 aa, Mycobacterium
TMALFGRALIGNGANGAAGT

SEQ ID NO: 1063373 - protein, 25 aa, Mycobacterium
TMPAGNGTPGFTGRDTGGPGGPGAD

SEQ ID NO: 1063374 - protein, 19 aa, Mycobacterium
TMTGARPGGFGVLHSRTNE

SEQ ID NO: 1063375 - protein, 17 aa, Mycobacterium
TMYAGWRAVIAGFVARR

SEQ ID NO: 1063376 - protein, 25 aa, Mycobacterium
TNNRFGFGVGIGWAPEEFEWCGVPY

SEQ ID NO: 1063377 - protein, 20 aa, Mycobacterium
TNRSTIRWTLHQMVASGVVR

SEQ ID NO: 1063378 - protein, 17 aa, Mycobacterium
TNVDFWAAVILDFAGVP

SEQ ID NO: 1063379 - protein, 20 aa, Mycobacterium
TPAGAVWRIGDDVTHRELGH

SEQ ID NO: 1063380 - protein, 26 aa, Mycobacterium
TPAQVLLRWNLQLGNAVVFRSAKAEH

SEQ ID NO: 1063381 - protein, 18 aa, Mycobacterium
TPGGWLLGDGGAAGLLGT

SEQ ID NO: 1063382 - protein, 18 aa, Mycobacterium
TPGGWLLGDGGAGGSGGT

SEQ ID NO: 1063383 - protein, 19 aa, Mycobacterium
TPGPLKWNLTLGVATDTRE

SEQ ID NO: 1063384 - protein, 17 aa, Mycobacterium
TPLLKLLLVRAAHATEL

SEQ ID NO: 1063385 - protein, 26 aa, Mycobacterium
TPTGSWIFRKCAAWGLGRPDTADRLS

SEQ ID NO: 1063386 - protein, 17 aa, Mycobacterium
TQIVAAFGIARDQVLAH

SEQ ID NO: 1063387 - protein, 20 aa, Mycobacterium
TRAPVEFDRVLGMLDRLASS

SEQ ID NO: 1063388 - protein, 19 aa, Mycobacterium
TRARVHLALTWALARSPGG

SEQ ID NO: 1063389 - protein, 18 aa, Mycobacterium
TRAVYKHMAKRGGGAIVN

SEQ ID NO: 1063390 - protein, 18 aa, Mycobacterium
TRGPAYWLKHNPYAEWYQ

SEQ ID NO: 1063391 - protein, 18 aa, Mycobacterium
TRKSFGIAGARVSDAIKL

SEQ ID NO: 1063392 - protein, 22 aa, Mycobacterium
TRLRPDLRPDWPQPASGGGSYR

SEQ ID NO: 1063393 - protein, 18 aa, Mycobacterium
TRPGCDVAGYQCEVHHVA

SEQ ID NO: 1063394 - protein, 18 aa, Mycobacterium
TRPRCPTCSTTRSPRGLS

SEQ ID NO: 1063395 - protein, 18 aa, Mycobacterium
TRRPSVCNAAETLLVDAA

SEQ ID NO: 1063396 - protein, 19 aa, Mycobacterium
TRSGVFWIRDILPVQKLRE

SEQ ID NO: 1063397 - protein, 17 aa, Mycobacterium
TRTRFSFEMGIAQLGGH

SEQ ID NO: 1063398 - protein, 25 aa, Mycobacterium
TRTTLPGGLTWPLGLAVAADGDLYI

SEQ ID NO: 1063399 - protein, 22 aa, Mycobacterium
TRYELVDGFPRFDVDDVYLGNG

SEQ ID NO: 1063400 - protein, 17 aa, Mycobacterium
TRYLMHFSQSGIGLPDE

SEQ ID NO: 1063401 - protein, 19 aa, Mycobacterium
TSLCPWKGVAHYYTVVVDG

SEQ ID NO: 1063402 - protein, 18 aa, Mycobacterium
TSLPNWWPSILAPIVAGV

SEQ ID NO: 1063403 - protein, 21 aa, Mycobacterium
TSSRGAWQFIAPTFAAYHQPG

SEQ ID NO: 1063404 - protein, 18 aa, Mycobacterium
TSVPAFRPGAQFKAVVSG

SEQ ID NO: 1063405 - protein, 18 aa, Mycobacterium
TSWSKPGLIPVALVIVNV

SEQ ID NO: 1063406 - protein, 22 aa, Mycobacterium
TTCGRPFADFELRIGPDTGEVL

SEQ ID NO: 1063407 - protein, 22 aa, Mycobacterium
TTEGFPNLFLIAGPNSPSVLSN

SEQ ID NO: 1063408 - protein, 21 aa, Mycobacterium
TTFKIKNMWGLLTVKGEFTNF

SEQ ID NO: 1063409 - protein, 18 aa, Mycobacterium
TTLFPPVRPRQWLEIRYL

SEQ ID NO: 1063410 - protein, 18 aa, Mycobacterium
TTLLGGLGYRGFFELGDE

SEQ ID NO: 1063411 - protein, 24 aa, Mycobacterium
TTPPVEGSWAWLPDEAKGARIHYR

SEQ ID NO: 1063412 - protein, 17 aa, Mycobacterium
TTPQHWDAILGINVGGV

SEQ ID NO: 1063413 - protein, 18 aa, Mycobacterium
TTRAEYAFRHPVVRTVAY

SEQ ID NO: 1063414 - protein, 17 aa, Mycobacterium
TTSWRFAPFLWQEIEDG

SEQ ID NO: 1063415 - protein, 18 aa, Mycobacterium
TTVPTEFQSLVVHDATGD

SEQ ID NO: 1063416 - protein, 17 aa, Mycobacterium
TTWPDKRIDLYFPGERP

SEQ ID NO: 1063417 - protein, 17 aa, Mycobacterium
TVADIYRHFGLTLTDEA

SEQ ID NO: 1063418 - protein, 22 aa, Mycobacterium
TVFPLARWSAVLGRRYLRQRVD

SEQ ID NO: 1063419 - protein, 18 aa, Mycobacterium
TVFVTGWRGPAVKTLTLD

SEQ ID NO: 1063420 - protein, 20 aa, Mycobacterium
TVIDPRWVLPVADGIGDLAV

SEQ ID NO: 1063421 - protein, 19 aa, Mycobacterium
TVLACFKLGIIVEGTLARA

SEQ ID NO: 1063422 - protein, 18 aa, Mycobacterium
TVLRYELMGRFLPNSMFL

SEQ ID NO: 1063423 - protein, 18 aa, Mycobacterium
TVTCPRDLVLSAPVKLTE

SEQ ID NO: 1063424 - protein, 21 aa, Mycobacterium
TVWIPWALRPMFFVLRPLPQF

SEQ ID NO: 1063425 - protein, 17 aa, Mycobacterium
TWLQFPQWFYLNIPVNT

SEQ ID NO: 1063426 - protein, 18 aa, Mycobacterium
TWVSVRWYKPGGALTAQQ

SEQ ID NO: 1063427 - protein, 18 aa, Mycobacterium
TYCLTHWARDRASGRFSV

SEQ ID NO: 1063428 - protein, 18 aa, Mycobacterium
TYDAQGWIITATTDGTRF

SEQ ID NO: 1063429 - protein, 17 aa, Mycobacterium
TYGRPGLVPSPLYDSLL

SEQ ID NO: 1063430 - protein, 17 aa, Mycobacterium
VAACATAAVSVEEGVDK

SEQ ID NO: 1063431 - protein, 24 aa, Mycobacterium
VAACLKWEGGYVWACKNYDGDVQS

SEQ ID NO: 1063432 - protein, 25 aa, Mycobacterium
VAADPSCGWGWLPYRAAPERAVAAV

SEQ ID NO: 1063433 - protein, 18 aa, Mycobacterium
VAALLRWLGNGNFLLLGY

SEQ ID NO: 1063434 - protein, 18 aa, Mycobacterium
VACFSGAVPDGWRVIGRV

SEQ ID NO: 1063435 - protein, 18 aa, Mycobacterium
VADEFPDGVWLFELAAVS

SEQ ID NO: 1063436 - protein, 18 aa, Mycobacterium
VAEGYGLTSPNVNVSVNG

SEQ ID NO: 1063437 - protein, 19 aa, Mycobacterium
VAELRRRGVTWSRVGGALG

SEQ ID NO: 1063438 - protein, 23 aa, Mycobacterium
VAEMPRFGWPTVVVSGGHDLTTP

SEQ ID NO: 1063439 - protein, 17 aa, Mycobacterium
VAETIGWVAALVSLGVA

SEQ ID NO: 1063440 - protein, 17 aa, Mycobacterium
VAFLLRFGTGVLPEPKT

SEQ ID NO: 1063441 - protein, 18 aa, Mycobacterium
VAHPIIRWVGSANELNAG

SEQ ID NO: 1063442 - protein, 17 aa, Mycobacterium
VAIRLGVDPRKADQMVR

SEQ ID NO: 1063443 - protein, 20 aa, Mycobacterium
VALANRWPTARILGVDDSAA

SEQ ID NO: 1063444 - protein, 17 aa, Mycobacterium
VALESIWHECLEPDSRH

SEQ ID NO: 1063445 - protein, 17 aa, Mycobacterium
VALFPSWETLPHERLSP

SEQ ID NO: 1063446 - protein, 18 aa, Mycobacterium
VALPFKWAFPRVFRAFAE

SEQ ID NO: 1063447 - protein, 18 aa, Mycobacterium
VALPRLAALAQWLEAHLP

SEQ ID NO: 1063448 - protein, 17 aa, Mycobacterium
VAMPLRLISPAPCTNCH

SEQ ID NO: 1063449 - protein, 17 aa, Mycobacterium
VANCLVALAILDVVGVS

SEQ ID NO: 1063450 - protein, 17 aa, Mycobacterium
VAPRIRNALGFNGYSLG

SEQ ID NO: 1063451 - protein, 17 aa, Mycobacterium
VAPSMLWSMTVDLEWPG

SEQ ID NO: 1063452 - protein, 17 aa, Mycobacterium
VARARHRGCTLLVTDGD

SEQ ID NO: 1063453 - protein, 19 aa, Mycobacterium
VARFCRICGALAAELINCC

SEQ ID NO: 1063454 - protein, 18 aa, Mycobacterium
VAVGDHFELLAMASTASS

SEQ ID NO: 1063455 - protein, 19 aa, Mycobacterium
VAVKDGRIVAVGAHDDVVR

SEQ ID NO: 1063456 - protein, 18 aa, Mycobacterium
VAYPAHWTTSAVDALGAA

SEQ ID NO: 1063457 - protein, 17 aa, Mycobacterium
VCGWDYGTAYDIGDGRY

SEQ ID NO: 1063458 - protein, 17 aa, Mycobacterium
VCLGLPGSLPVLNRVAV

SEQ ID NO: 1063459 - protein, 17 aa, Mycobacterium
VCSTGLIGDRLPMDKVL

SEQ ID NO: 1063460 - protein, 23 aa, Mycobacterium
VCYDIRFPALYTELARRGAELIV

SEQ ID NO: 1063461 - protein, 24 aa, Mycobacterium
VDAAWRPDTVWRYRLGSPGSSERV

SEQ ID NO: 1063462 - protein, 19 aa, Mycobacterium
VDAFAHWRRAQGLPVCAIG

SEQ ID NO: 1063463 - protein, 19 aa, Mycobacterium
VDAQQLFGFLRENNRLSSL

SEQ ID NO: 1063464 - protein, 24 aa, Mycobacterium
VDERARAGLFLAMQYPVEVPGVSV

SEQ ID NO: 1063465 - protein, 24 aa, Mycobacterium
VDGGYRLSGSWSFGSGTGHAQYIA

SEQ ID NO: 1063466 - protein, 24 aa, Mycobacterium
VDGLNRFSAILARDKDNLGRALDT

SEQ ID NO: 1063467 - protein, 19 aa, Mycobacterium
VDIAFNWDHFFPLFGDPDG

SEQ ID NO: 1063468 - protein, 19 aa, Mycobacterium
VDLIPAWNLLSAPARGQFR

SEQ ID NO: 1063469 - protein, 17 aa, Mycobacterium
VDLIPSYKAHRVAEPEP

SEQ ID NO: 1063470 - protein, 17 aa, Mycobacterium
VDRIVVHLAPWLEPEPI

SEQ ID NO: 1063471 - protein, 17 aa, Mycobacterium
VEACWNLGATVAAQLMS

SEQ ID NO: 1063472 - protein, 17 aa, Mycobacterium
VEAEYEQMWALDVSTMA

SEQ ID NO: 1063473 - protein, 18 aa, Mycobacterium
VEALKAITINAAYQYSEE

SEQ ID NO: 1063474 - protein, 23 aa, Mycobacterium
VEASHCYPHFSRFLAEVVRVLRP

SEQ ID NO: 1063475 - protein, 26 aa, Mycobacterium
VEAVWKPREEWGFGIDNIEYFRPTGE

SEQ ID NO: 1063476 - protein, 22 aa, Mycobacterium
VEDWPLLRWRMRQYRHGRWGTE

SEQ ID NO: 1063477 - protein, 21 aa, Mycobacterium
VEGWRGYNFAFTFNIADYNVI

SEQ ID NO: 1063478 - protein, 18 aa, Mycobacterium
VEHHAVLDTVDWLVEHEG

SEQ ID NO: 1063479 - protein, 21 aa, Mycobacterium
VEIGGPFSIELCGGTHVATSA

SEQ ID NO: 1063480 - protein, 20 aa, Mycobacterium
VEIRRAAGLSAELTVIEAAM

SEQ ID NO: 1063481 - protein, 18 aa, Mycobacterium
VELDERWVILGPNGAGKT

SEQ ID NO: 1063482 - protein, 19 aa, Mycobacterium
VELGIKWLSLYAFSTENWK

SEQ ID NO: 1063483 - protein, 23 aa, Mycobacterium
VELRNRLRAVTGLALSRTIIFDY

SEQ ID NO: 1063484 - protein, 22 aa, Mycobacterium
VENALKVAFDWKSRHNQALGID

SEQ ID NO: 1063485 - protein, 22 aa, Mycobacterium
VEPRLWNMWTVLPILQDTTIVA

SEQ ID NO: 1063486 - protein, 23 aa, Mycobacterium
VERMHRACLILTFGGGTNEVQRD

SEQ ID NO: 1063487 - protein, 19 aa, Mycobacterium
VESGLKVARKWGADVKGVP

SEQ ID NO: 1063488 - protein, 18 aa, Mycobacterium
VEVLEIRAALGPLIGRLA

SEQ ID NO: 1063489 - protein, 17 aa, Mycobacterium
VFAGWRITSRQGGWFVA

SEQ ID NO: 1063490 - protein, 18 aa, Mycobacterium
VFCRAVIVGPPLELVLDV

SEQ ID NO: 1063491 - protein, 18 aa, Mycobacterium
VFEALALLRASPGMDQAK

SEQ ID NO: 1063492 - protein, 18 aa, Mycobacterium
VFETLAWGRRHVVMGANQ

SEQ ID NO: 1063493 - protein, 19 aa, Mycobacterium
VFHRVIRGFMIQGGDPTGT

SEQ ID NO: 1063494 - protein, 19 aa, Mycobacterium
VFHTLRAAIPVMRQQRFGR

SEQ ID NO: 1063495 - protein, 19 aa, Mycobacterium
VFKRIRPAFTYQRSLDVLT

SEQ ID NO: 1063496 - protein, 17 aa, Mycobacterium
VFPSHYEPFGLVALEAA

SEQ ID NO: 1063497 - protein, 20 aa, Mycobacterium
VFSGYRFLRHAAARGIPVAI

SEQ ID NO: 1063498 - protein, 17 aa, Mycobacterium
VFTPSLAGLVLGEYRRI

SEQ ID NO: 1063499 - protein, 21 aa, Mycobacterium
VFWPIPRVYSGLVRIDRHETT

SEQ ID NO: 1063500 - protein, 19 aa, Mycobacterium
VGAHGADGFSPITGGNGGG

SEQ ID NO: 1063501 - protein, 19 aa, Mycobacterium
VGDRVGIAWLRYTCGVCNY

SEQ ID NO: 1063502 - protein, 18 aa, Mycobacterium
VGFIFQFFNLIPTLTAKE

SEQ ID NO: 1063503 - protein, 22 aa, Mycobacterium
VGFPTDPGLSFGGQGGAGGRGG

SEQ ID NO: 1063504 - protein, 18 aa, Mycobacterium
VGGARRCAAQSWSLDRFR

SEQ ID NO: 1063505 - protein, 20 aa, Mycobacterium
VGGARRCAAQSWSLERIRAV

SEQ ID NO: 1063506 - protein, 19 aa, Mycobacterium
VGGASGWLLGNGGAGGDGG

SEQ ID NO: 1063507 - protein, 18 aa, Mycobacterium
VGGDGGWLIGDGGAGGQG

SEQ ID NO: 1063508 - protein, 17 aa, Mycobacterium
VGGLRDWLLDTAARDDS

SEQ ID NO: 1063509 - protein, 18 aa, Mycobacterium
VGGTGGWLLGDGGAGGDG

SEQ ID NO: 1063510 - protein, 18 aa, Mycobacterium
VGIVEGWRGAVLHRVEVD

SEQ ID NO: 1063511 - protein, 20 aa, Mycobacterium
VGLIGFGGAGGFGGASGFGT

SEQ ID NO: 1063512 - protein, 22 aa, Mycobacterium
VGLPMRCVFALTAMGFLPQSAE

SEQ ID NO: 1063513 - protein, 17 aa, Mycobacterium
VGNGGNGGWAIYNSFAG

SEQ ID NO: 1063514 - protein, 21 aa, Mycobacterium
VGNRPKIGWRRYEAQAVLSRL

SEQ ID NO: 1063515 - protein, 19 aa, Mycobacterium
VGPRVARRFGRVLLELGGN

SEQ ID NO: 1063516 - protein, 23 aa, Mycobacterium
VGRGDFRAPLVIGDRLDTDIEGA

SEQ ID NO: 1063517 - protein, 19 aa, Mycobacterium
VGSLFSWTGDPAVVQGPQE

SEQ ID NO: 1063518 - protein, 22 aa, Mycobacterium
VGSWPGILARPAAEVVVGELAD

SEQ ID NO: 1063519 - protein, 18 aa, Mycobacterium
VHGLPLYHVHGLVLGLLG

SEQ ID NO: 1063520 - protein, 22 aa, Mycobacterium
VHVSAIKFPNLELGLPAIDINI

SEQ ID NO: 1063521 - protein, 18 aa, Mycobacterium
VHYPFPIDDLVAVDDALK

SEQ ID NO: 1063522 - protein, 17 aa, Mycobacterium
VICCPAFGAAGKIGTLN

SEQ ID NO: 1063523 - protein, 19 aa, Mycobacterium
VILSRCVEVPFRLDFPSTY

SEQ ID NO: 1063524 - protein, 23 aa, Mycobacterium
VIMLRRAGQRFGFAVGSMSLLSE

SEQ ID NO: 1063525 - protein, 24 aa, Mycobacterium
VIMLRRAGQRFGFAVGSMSLLSEH

SEQ ID NO: 1063526 - protein, 24 aa, Mycobacterium
VIPHVVRLAGRWLRPGGRFAVEHD

SEQ ID NO: 1063527 - protein, 23 aa, Mycobacterium
VIYFPRKVIWFLPDFTVECYHDQ

SEQ ID NO: 1063528 - protein, 19 aa, Mycobacterium
VIYHARFGPTLAETLEKAG

SEQ ID NO: 1063529 - protein, 21 aa, Mycobacterium
VKAGVQWGLFGGAVENLGTER

SEQ ID NO: 1063530 - protein, 22 aa, Mycobacterium
VKEAICKGTLWALRREAAKPGS

SEQ ID NO: 1063531 - protein, 17 aa, Mycobacterium
VKGRPPGTMRLAIVAEI

SEQ ID NO: 1063532 - protein, 18 aa, Mycobacterium
VKLFDDWSNLGSVSDLSA

SEQ ID NO: 1063533 - protein, 25 aa, Mycobacterium
VKRVLRPGGYFAYADIRPCTEIAEW

SEQ ID NO: 1063534 - protein, 17 aa, Mycobacterium
VLARALVKTGLRLVAAG

SEQ ID NO: 1063535 - protein, 18 aa, Mycobacterium
VLCLRVARALLPDVPHIA

SEQ ID NO: 1063536 - protein, 22 aa, Mycobacterium
VLDPRLRAAASWPAGVAAGRRV

SEQ ID NO: 1063537 - protein, 26 aa, Mycobacterium
VLGEPFMLPAHIDFAALRVKFDGGTL

SEQ ID NO: 1063538 - protein, 20 aa, Mycobacterium
VLIDQEWKYGVATGVETALL

SEQ ID NO: 1063539 - protein, 20 aa, Mycobacterium
VLLLRRVWTATLGLAGRVAT

SEQ ID NO: 1063540 - protein, 18 aa, Mycobacterium
VLLVPHFVRRAIGSRVRP

SEQ ID NO: 1063541 - protein, 19 aa, Mycobacterium
VLMDREWKYGVAAAVDVTL

SEQ ID NO: 1063542 - protein, 18 aa, Mycobacterium
VLNALGITVLAAPGFEAD

SEQ ID NO: 1063543 - protein, 17 aa, Mycobacterium
VLRRARDGFALNIDEAV

SEQ ID NO: 1063544 - protein, 22 aa, Mycobacterium
VLVHPRPRLSVMAVGGELVDIS

SEQ ID NO: 1063545 - protein, 25 aa, Mycobacterium
VMLGLRLRQGLPLAHLDAGERERAQ

SEQ ID NO: 1063546 - protein, 18 aa, Mycobacterium
VMRAGLTWQQVVLLCAYS

SEQ ID NO: 1063547 - protein, 21 aa, Mycobacterium
VMSRLKPGIIMCREKQDSTSA

SEQ ID NO: 1063548 - protein, 22 aa, Mycobacterium
VMSRLKPGIIMCREKQDSTSAV

SEQ ID NO: 1063549 - protein, 18 aa, Mycobacterium
VMSTYGIYNIDFDDEGAI

SEQ ID NO: 1063550 - protein, 20 aa, Mycobacterium
VMTHHRWLRALAVFGGLGLR

SEQ ID NO: 1063551 - protein, 17 aa, Mycobacterium
VMVRPLIRLSLGKRQPM

SEQ ID NO: 1063552 - protein, 17 aa, Mycobacterium
VNAVGYPLAADVALITV

SEQ ID NO: 1063553 - protein, 18 aa, Mycobacterium
VNGFCVGGGIGLVGNSDV

SEQ ID NO: 1063554 - protein, 17 aa, Mycobacterium
VNLDAGFDWTRAREQLL

SEQ ID NO: 1063555 - protein, 23 aa, Mycobacterium
VNPCGRLPITFPVGLGQTPRPEL

SEQ ID NO: 1063556 - protein, 22 aa, Mycobacterium
VNQLPRKVAMEMLLTGEPITAS

SEQ ID NO: 1063557 - protein, 20 aa, Mycobacterium
VNQRWLGGMLTNFSTVHKRL

SEQ ID NO: 1063558 - protein, 21 aa, Mycobacterium
VNQRWLGGMLTNFSTVHKRLQ

SEQ ID NO: 1063559 - protein, 22 aa, Mycobacterium
VNSWSAAFARYGRAVGQVLLTA

SEQ ID NO: 1063560 - protein, 22 aa, Mycobacterium
VNSWSAAFARYGRTVGQVLLTA

SEQ ID NO: 1063561 - protein, 18 aa, Mycobacterium
VNVYRVVSNLGVFDFGGP

SEQ ID NO: 1063562 - protein, 17 aa, Mycobacterium
VPAGWPFGEEFPRTCGA

SEQ ID NO: 1063563 - protein, 17 aa, Mycobacterium
VPAHSQLAWVLGCFTGF

SEQ ID NO: 1063564 - protein, 17 aa, Mycobacterium
VPFYHCFGMVMGNLAAT

SEQ ID NO: 1063565 - protein, 23 aa, Mycobacterium
VPGAEAFRSWRLLVTRYGTPAPG

SEQ ID NO: 1063566 - protein, 21 aa, Mycobacterium
VPGKVAGGWFWIHALNSATQA

SEQ ID NO: 1063567 - protein, 17 aa, Mycobacterium
VPGRRGGTHFPFLENPQ

SEQ ID NO: 1063568 - protein, 22 aa, Mycobacterium
VPGTRLAAVLGEFVEARCYHHQ

SEQ ID NO: 1063569 - protein, 23 aa, Mycobacterium
VPGTRLAAVLGEFVEARCYHHQS

SEQ ID NO: 1063570 - protein, 24 aa, Mycobacterium
VPHYDVYPAFAFRFDVKNPAVSIT

SEQ ID NO: 1063571 - protein, 17 aa, Mycobacterium
VPICWSLRSIFDALDGV

SEQ ID NO: 1063572 - protein, 24 aa, Mycobacterium
VPLRLAELFVEAGLPPGVFQVVHG

SEQ ID NO: 1063573 - protein, 17 aa, Mycobacterium
VPLTYPFALTFPAMMSL

SEQ ID NO: 1063574 - protein, 19 aa, Mycobacterium
VPLTYPFALTFPAMMSLVT

SEQ ID NO: 1063575 - protein, 17 aa, Mycobacterium
VPPPAPVPRAPEAPAAM

SEQ ID NO: 1063576 - protein, 17 aa, Mycobacterium
VPRWRKGSGKGWLTAEY

SEQ ID NO: 1063577 - protein, 19 aa, Mycobacterium
VPSPYAFRLADPDADAEKI

SEQ ID NO: 1063578 - protein, 18 aa, Mycobacterium
VPSRLAWEAGAALADSLL

SEQ ID NO: 1063579 - protein, 24 aa, Mycobacterium
VPSRLRPAMTAMLSGVVVVNDLSE

SEQ ID NO: 1063580 - protein, 18 aa, Mycobacterium
VPVSATWIDIRFTLPANT

SEQ ID NO: 1063581 - protein, 17 aa, Mycobacterium
VQGFWQREFDILVCTTI

SEQ ID NO: 1063582 - protein, 21 aa, Mycobacterium
VQGIWRLGAAMTMLQQPTSQA

SEQ ID NO: 1063583 - protein, 18 aa, Mycobacterium
VQLGISLGRRWWGQHVTS

SEQ ID NO: 1063584 - protein, 23 aa, Mycobacterium
VQSVLLPRLLDWLSYAPDPDGGL

SEQ ID NO: 1063585 - protein, 17 aa, Mycobacterium
VRAHCRHLATIVTIRGE

SEQ ID NO: 1063586 - protein, 24 aa, Mycobacterium
VRAVQRWAACQGKILRAVIATEQQ

SEQ ID NO: 1063587 - protein, 21 aa, Mycobacterium
VREACLWSRGLAAAGVRRRAS

SEQ ID NO: 1063588 - protein, 25 aa, Mycobacterium
VRFCDAFKIPLVFVVDTPGFLPGAE

SEQ ID NO: 1063589 - protein, 18 aa, Mycobacterium
VRGFPGFVDQGSHVDLRV

SEQ ID NO: 1063590 - protein, 20 aa, Mycobacterium
VRLNHEFHRAINLAADSPRL

SEQ ID NO: 1063591 - protein, 17 aa, Mycobacterium
VRLVCAGSAGSAGSACA

SEQ ID NO: 1063592 - protein, 19 aa, Mycobacterium
VRMGMRVEAVWKPREEWGF

SEQ ID NO: 1063593 - protein, 21 aa, Mycobacterium
VRPGDAIGVFLGRSVHLAVAA

SEQ ID NO: 1063594 - protein, 17 aa, Mycobacterium
VRPRLVVALGRDGERVL

SEQ ID NO: 1063595 - protein, 24 aa, Mycobacterium
VRRKLRLADVLAYREELHARRNRF

SEQ ID NO: 1063596 - protein, 23 aa, Mycobacterium
VRRYIIDVALRWMREFHADGLRL

SEQ ID NO: 1063597 - protein, 20 aa, Mycobacterium
VRSGVAFDILRRWLMARGFD

SEQ ID NO: 1063598 - protein, 17 aa, Mycobacterium
VRVGFRIGTPAVGELGL

SEQ ID NO: 1063599 - protein, 17 aa, Mycobacterium
VRVIVSLLMFPGQDEAD

SEQ ID NO: 1063600 - protein, 19 aa, Mycobacterium
VSAAIAAFFGAHAQAYQAL

SEQ ID NO: 1063601 - protein, 19 aa, Mycobacterium
VSAAIAAVFSAHGQSYETL

SEQ ID NO: 1063602 - protein, 19 aa, Mycobacterium
VSAAIAAVFSGHGQAYQVL

SEQ ID NO: 1063603 - protein, 19 aa, Mycobacterium
VSAAISFLFGAHAQAYQAL

SEQ ID NO: 1063604 - protein, 20 aa, Mycobacterium
VSAAVAALFSSHARAYQALS

SEQ ID NO: 1063605 - protein, 20 aa, Mycobacterium
VSAGIAALFEAHGNAYQTLG

SEQ ID NO: 1063606 - protein, 20 aa, Mycobacterium
VSAQLAAVFGDYARQFQALS

SEQ ID NO: 1063607 - protein, 21 aa, Mycobacterium
VSCAIQNLWLAARAEGLGMGW

SEQ ID NO: 1063608 - protein, 17 aa, Mycobacterium
VSELTRFTPEAVIEKYG

SEQ ID NO: 1063609 - protein, 18 aa, Mycobacterium
VSELTRFTPEAVIEKYGV

SEQ ID NO: 1063610 - protein, 20 aa, Mycobacterium
VSGCAALSKGFREGAVSARS

SEQ ID NO: 1063611 - protein, 17 aa, Mycobacterium
VSGWATKQPKVWWNTGT

SEQ ID NO: 1063612 - protein, 19 aa, Mycobacterium
VSLAATHRAMWALGDYALM

SEQ ID NO: 1063613 - protein, 19 aa, Mycobacterium
VSLAELWRSAGVLPDAVIG

SEQ ID NO: 1063614 - protein, 18 aa, Mycobacterium
VSLAELWRSVGVAPDAVI

SEQ ID NO: 1063615 - protein, 17 aa, Mycobacterium
VSLPGYPFARQRHWVEP

SEQ ID NO: 1063616 - protein, 19 aa, Mycobacterium
VSLPPWLATNLANWNTIMA

SEQ ID NO: 1063617 - protein, 19 aa, Mycobacterium
VSQRLRLLIDWTGDHLAEV

SEQ ID NO: 1063618 - protein, 17 aa, Mycobacterium
VSSPGYEHAWLNPDNTE

SEQ ID NO: 1063619 - protein, 24 aa, Mycobacterium
VSVPEEVAWRLGWIDDEQLMRRAR

SEQ ID NO: 1063620 - protein, 24 aa, Mycobacterium
VSYEAGDALGVWPRNAHQLVDEWL

SEQ ID NO: 1063621 - protein, 20 aa, Mycobacterium
VTEFNVALPWTKMVVLNPGV

SEQ ID NO: 1063622 - protein, 19 aa, Mycobacterium
VTEIIPLDGFDELELADLD

SEQ ID NO: 1063623 - protein, 23 aa, Mycobacterium
VTFSDRYEPAWVYRGNDAAAVRD

SEQ ID NO: 1063624 - protein, 18 aa, Mycobacterium
VTGCDGVVIGRGCLGRPW

SEQ ID NO: 1063625 - protein, 18 aa, Mycobacterium
VTIGLVFRARMAEPDLLP

SEQ ID NO: 1063626 - protein, 18 aa, Mycobacterium
VTIGYRLARGILHNLKTA

SEQ ID NO: 1063627 - protein, 17 aa, Mycobacterium
VTLGRRVALAAGAVRAE

SEQ ID NO: 1063628 - protein, 25 aa, Mycobacterium
VTPWLAATVSFAWRIRLISSATIDA

SEQ ID NO: 1063629 - protein, 17 aa, Mycobacterium
VTQRFEAELGRRSGLAT

SEQ ID NO: 1063630 - protein, 19 aa, Mycobacterium
VTQWTRWRQPVIGMPSTPR

SEQ ID NO: 1063631 - protein, 17 aa, Mycobacterium
VTRRLVAMLARRGYSQT

SEQ ID NO: 1063632 - protein, 17 aa, Mycobacterium
VTVAHGWASELAEAEPW

SEQ ID NO: 1063633 - protein, 18 aa, Mycobacterium
VVAADWPLLAAAYRTRGS

SEQ ID NO: 1063634 - protein, 20 aa, Mycobacterium
VVAERRLWLAVLRAQRELGA

SEQ ID NO: 1063635 - protein, 19 aa, Mycobacterium
VVCGIGFADLSSFTVLTQT

SEQ ID NO: 1063636 - protein, 18 aa, Mycobacterium
VVCPIHLGLMRGALESWG

SEQ ID NO: 1063637 - protein, 18 aa, Mycobacterium
VVDPRWVLPVPDAVLELA

SEQ ID NO: 1063638 - protein, 19 aa, Mycobacterium
VVELRSGGLGVREIKRIAK

SEQ ID NO: 1063639 - protein, 19 aa, Mycobacterium
VVFPGCEFLPLNDERRRIV

SEQ ID NO: 1063640 - protein, 19 aa, Mycobacterium
VVGDLRWSLSVSARLASIP

SEQ ID NO: 1063641 - protein, 18 aa, Mycobacterium
VVGPAIWAAMADINAVAL

SEQ ID NO: 1063642 - protein, 21 aa, Mycobacterium
VVNRLKPGIIMCREKQDSTSA

SEQ ID NO: 1063643 - protein, 18 aa, Mycobacterium
VVRAKLWLQCAIAGTPRL

SEQ ID NO: 1063644 - protein, 18 aa, Mycobacterium
VVRLRFGLTDGQPRTLDE

SEQ ID NO: 1063645 - protein, 19 aa, Mycobacterium
VVVSGRWPFCSGINHADMM

SEQ ID NO: 1063646 - protein, 17 aa, Mycobacterium
VWRFRLVPRDGGTNLTY

SEQ ID NO: 1063647 - protein, 19 aa, Mycobacterium
VYERLWRPAAFYLASGVTT

SEQ ID NO: 1063648 - protein, 19 aa, Mycobacterium
VYFELRLADAWVWDMYRPA

SEQ ID NO: 1063649 - protein, 17 aa, Mycobacterium
VYPPCSAFEAWFVSAAL

SEQ ID NO: 1063650 - protein, 18 aa, Mycobacterium
VYSGFAFGMGLERSLQFR

SEQ ID NO: 1063651 - protein, 23 aa, Mycobacterium
VYTGLGALCWIPSISRWADVFAS

SEQ ID NO: 1063652 - protein, 21 aa, Mycobacterium
VYYRRALMLAACFGRSVEYPQ

SEQ ID NO: 1063653 - protein, 17 aa, Mycobacterium
WAGPYPERIIPCQLPWL

SEQ ID NO: 1063654 - protein, 19 aa, Mycobacterium
WAGSLKRHGEWMVPTRLAL

SEQ ID NO: 1063655 - protein, 20 aa, Mycobacterium
WAGTIWAGWGRPSSGITAPI

SEQ ID NO: 1063656 - protein, 19 aa, Mycobacterium
WAIDWAVSWINWGIQLVNS

SEQ ID NO: 1063657 - protein, 18 aa, Mycobacterium
WAPGASWRHPWGPDSDVD

SEQ ID NO: 1063658 - protein, 18 aa, Mycobacterium
WAQRRVELPAGRYETIMP

SEQ ID NO: 1063659 - protein, 18 aa, Mycobacterium
WATWCGPCKMVAPVLEEI

SEQ ID NO: 1063660 - protein, 18 aa, Mycobacterium
WAVASLRTEQRWLGRIAP

SEQ ID NO: 1063661 - protein, 18 aa, Mycobacterium
WAYLPALEQVAAWHWSLN

SEQ ID NO: 1063662 - protein, 20 aa, Mycobacterium
WCIPCSLGCVMAEAAGPKSG

SEQ ID NO: 1063663 - protein, 20 aa, Mycobacterium
WCRERMAGFKVPRSVRFVDA

SEQ ID NO: 1063664 - protein, 18 aa, Mycobacterium
WCSCRAAATARPAATEGI

SEQ ID NO: 1063665 - protein, 17 aa, Mycobacterium
WCSDIRAGAGLVLAGLV

SEQ ID NO: 1063666 - protein, 17 aa, Mycobacterium
WDDELLSFFSIPRAMLP

SEQ ID NO: 1063667 - protein, 17 aa, Mycobacterium
WDELFDLARFVGVSRPG

SEQ ID NO: 1063668 - protein, 20 aa, Mycobacterium
WDLLPGYLIFRSIIPNRPPT

SEQ ID NO: 1063669 - protein, 20 aa, Mycobacterium
WDSLWVYDHFHTVPLPSDEA

SEQ ID NO: 1063670 - protein, 17 aa, Mycobacterium
WDVWKRELLGLGTEGLR

SEQ ID NO: 1063671 - protein, 24 aa, Mycobacterium
WEELAVKLMLKWPNLYYSTSAFAP

SEQ ID NO: 1063672 - protein, 22 aa, Mycobacterium
WEHGRFSAPYLRDSLLAASALC

SEQ ID NO: 1063673 - protein, 17 aa, Mycobacterium
WFAAYAYWYFKLYGHQN

SEQ ID NO: 1063674 - protein, 18 aa, Mycobacterium
WFAGAGFSLVNMTGYPEA

SEQ ID NO: 1063675 - protein, 17 aa, Mycobacterium
WFLADGVPARPEVKLVK

SEQ ID NO: 1063676 - protein, 17 aa, Mycobacterium
WGAEVYHALKSVLKKKG

SEQ ID NO: 1063677 - protein, 21 aa, Mycobacterium
WGAPVAWTFAWLYPQRCAGVV

SEQ ID NO: 1063678 - protein, 17 aa, Mycobacterium
WGEPRAATTWASGTPAT

SEQ ID NO: 1063679 - protein, 18 aa, Mycobacterium
WGLRCFAPTWPLGTHPRA

SEQ ID NO: 1063680 - protein, 17 aa, Mycobacterium
WGLRVARVELRSIDPPP

SEQ ID NO: 1063681 - protein, 23 aa, Mycobacterium
WGSAVAALARWSGDLTIAEDAVQ

SEQ ID NO: 1063682 - protein, 19 aa, Mycobacterium
WGTNGWRFRHELLREVAAE

SEQ ID NO: 1063683 - protein, 17 aa, Mycobacterium
WGWTWPLNRRVLYNRAS

SEQ ID NO: 1063684 - protein, 23 aa, Mycobacterium
WHERETYDFFGIIFDGHPSLTRI

SEQ ID NO: 1063685 - protein, 18 aa, Mycobacterium
WHPGRCAEVLVGEAVVGH

SEQ ID NO: 1063686 - protein, 20 aa, Mycobacterium
WHSLARLAIRDDIYGALRSL

SEQ ID NO: 1063687 - protein, 18 aa, Mycobacterium
WIFARTAIRTRRWADPEQ

SEQ ID NO: 1063688 - protein, 24 aa, Mycobacterium
WIGTAANWMSCWTMGLNQSTHGTW

SEQ ID NO: 1063689 - protein, 20 aa, Mycobacterium
WILHCGDAFYHVGTLDGQSK

SEQ ID NO: 1063690 - protein, 18 aa, Mycobacterium
WIRGRLRPVPADMIGAAL

SEQ ID NO: 1063691 - protein, 19 aa, Mycobacterium
WITSPLGQVVDPVINAPFE

SEQ ID NO: 1063692 - protein, 22 aa, Mycobacterium
WKDGEALFLRCNIWREAAENVA

SEQ ID NO: 1063693 - protein, 20 aa, Mycobacterium
WKDYTERGGRPFGEFAAFCY

SEQ ID NO: 1063694 - protein, 17 aa, Mycobacterium
WKEVVLLAGGGSDVAVV

SEQ ID NO: 1063695 - protein, 19 aa, Mycobacterium
WKFTVPFVCGATNLGEALR

SEQ ID NO: 1063696 - protein, 23 aa, Mycobacterium
WKIGAVPIPMHWDLPEWERDRVR

SEQ ID NO: 1063697 - protein, 20 aa, Mycobacterium
WKVFLNLLRKRFETDKGKWT

SEQ ID NO: 1063698 - protein, 18 aa, Mycobacterium
WLAAHGWAVEPVRNTLEL

SEQ ID NO: 1063699 - protein, 18 aa, Mycobacterium
WLDAEWRLVSHDVRVIVA

SEQ ID NO: 1063700 - protein, 19 aa, Mycobacterium
WLDGLVAWRRAAGLPAATI

SEQ ID NO: 1063701 - protein, 20 aa, Mycobacterium
WLDRLQGFQTLRFAGDRLQH

SEQ ID NO: 1063702 - protein, 22 aa, Mycobacterium
WLIGSPCWRAAAASRGDLKPVG

SEQ ID NO: 1063703 - protein, 19 aa, Mycobacterium
WLKPTAYMMAKFGMTLCAL

SEQ ID NO: 1063704 - protein, 21 aa, Mycobacterium
WLLAARCVRGLLSMSSGEPDQ

SEQ ID NO: 1063705 - protein, 19 aa, Mycobacterium
WLLLRLARRYGKVFSVNLP

SEQ ID NO: 1063706 - protein, 24 aa, Mycobacterium
WLTGMFDRGAWRPAAVVVVGSDTD

SEQ ID NO: 1063707 - protein, 19 aa, Mycobacterium
WLWLRGYNPGRLCLAGDST

SEQ ID NO: 1063708 - protein, 17 aa, Mycobacterium
WMAHCVHLSKGYIAKLA

SEQ ID NO: 1063709 - protein, 19 aa, Mycobacterium
WMGRVHRFLGLDVGVILAQ

SEQ ID NO: 1063710 - protein, 22 aa, Mycobacterium
WMRRPHLLRAWDAAWPASRWYR

SEQ ID NO: 1063711 - protein, 18 aa, Mycobacterium
WNAIRLLRSEGRTVVLTT

SEQ ID NO: 1063712 - protein, 21 aa, Mycobacterium
WNDWHLEAWAGPYPERIIPCQ

SEQ ID NO: 1063713 - protein, 17 aa, Mycobacterium
WNLQLGNAVIFGSSNAE

SEQ ID NO: 1063714 - protein, 18 aa, Mycobacterium
WNNWAEFFHSDSINNLAY

SEQ ID NO: 1063715 - protein, 18 aa, Mycobacterium
WNPKMKRFIFTDRNGIYI

SEQ ID NO: 1063716 - protein, 18 aa, Mycobacterium
WNRPRWKIDEVVEAKAGR

SEQ ID NO: 1063717 - protein, 20 aa, Mycobacterium
WPAPKRRSFTSGSCSPWRAD

SEQ ID NO: 1063718 - protein, 18 aa, Mycobacterium
WPFTCNLGSLTFGQSVAR

SEQ ID NO: 1063719 - protein, 17 aa, Mycobacterium
WPGIDWPATQSMAEQVL

SEQ ID NO: 1063720 - protein, 18 aa, Mycobacterium
WPHRGLRSLLTIRVGDAV

SEQ ID NO: 1063721 - protein, 18 aa, Mycobacterium
WPLGRGFERFYGFLGGET

SEQ ID NO: 1063722 - protein, 17 aa, Mycobacterium
WPQMLLRALMFRLAVHA

SEQ ID NO: 1063723 - protein, 19 aa, Mycobacterium
WPRRYRRSSAYWKLVELDQ

SEQ ID NO: 1063724 - protein, 19 aa, Mycobacterium
WPSKAELVLAAFIEGVRQV

SEQ ID NO: 1063725 - protein, 17 aa, Mycobacterium
WPTLDGMFTPHASDVTF

SEQ ID NO: 1063726 - protein, 19 aa, Mycobacterium
WRATLIVRESACLDIEHRR

SEQ ID NO: 1063727 - protein, 18 aa, Mycobacterium
WRDARWLAVVINYRAQRW

SEQ ID NO: 1063728 - protein, 18 aa, Mycobacterium
WRFTPLRRLRGLHDGSAV

SEQ ID NO: 1063729 - protein, 17 aa, Mycobacterium
WRKGPRHIAGRGPRDTY

SEQ ID NO: 1063730 - protein, 17 aa, Mycobacterium
WRLLPDRVRVLDFPTNF

SEQ ID NO: 1063731 - protein, 20 aa, Mycobacterium
WRMAAKALRPLPVAHKEMSE

SEQ ID NO: 1063732 - protein, 17 aa, Mycobacterium
WRNFFLCGAAELRDGKF

SEQ ID NO: 1063733 - protein, 19 aa, Mycobacterium
WRPQFRVDLIPSYKAHRVA

SEQ ID NO: 1063734 - protein, 21 aa, Mycobacterium
WRWDTDWFWCSRAFGAQNPTL

SEQ ID NO: 1063735 - protein, 20 aa, Mycobacterium
WRYLLVPCAIEFWDEDGGAA

SEQ ID NO: 1063736 - protein, 18 aa, Mycobacterium
WSAEGWVAVAGRVVSDGV

SEQ ID NO: 1063737 - protein, 21 aa, Mycobacterium
WSAWLVGAWWPAPPEASAAGV

SEQ ID NO: 1063738 - protein, 17 aa, Mycobacterium
WSHAWCIPCSLGCVMAE

SEQ ID NO: 1063739 - protein, 18 aa, Mycobacterium
WSLIRVAAVWRRPALAVP

SEQ ID NO: 1063740 - protein, 23 aa, Mycobacterium
WSMAVALRLAAFALLRADGSEPV

SEQ ID NO: 1063741 - protein, 20 aa, Mycobacterium
WSPESGSLLDEWSHKVVWAA

SEQ ID NO: 1063742 - protein, 25 aa, Mycobacterium
WTFLGPRPAHWWVRRRLHEVVVHRA

SEQ ID NO: 1063743 - protein, 17 aa, Mycobacterium
WTLLILREAFFGVQRFG

SEQ ID NO: 1063744 - protein, 18 aa, Mycobacterium
WTQWIFLQIYNAWFDAAA

SEQ ID NO: 1063745 - protein, 18 aa, Mycobacterium
WTTRWKPALNAFAITFAD

SEQ ID NO: 1063746 - protein, 17 aa, Mycobacterium
WTVQLAWKAGRSDNLAH

SEQ ID NO: 1063747 - protein, 18 aa, Mycobacterium
WVARLAVDFRQRFNKDVI

SEQ ID NO: 1063748 - protein, 19 aa, Mycobacterium
WVCGDNVAIGYWNKPEESE

SEQ ID NO: 1063749 - protein, 24 aa, Mycobacterium
WVRDALRLGGKFPLKAGMLTSLGF

SEQ ID NO: 1063750 - protein, 17 aa, Mycobacterium
WVRRKHGLPSLGFNLCR

SEQ ID NO: 1063751 - protein, 20 aa, Mycobacterium
WWILTCLMRGGLCITGGENT

SEQ ID NO: 1063752 - protein, 17 aa, Mycobacterium
WWPSILAPIVAGVGAWR

SEQ ID NO: 1063753 - protein, 19 aa, Mycobacterium
WYRSIRQTVQFERAIRTAF

SEQ ID NO: 1063754 - protein, 17 aa, Mycobacterium
YAGEIAHIIGCEPGDVL

SEQ ID NO: 1063755 - protein, 17 aa, Mycobacterium
YAGELLFLYNGVRPRQV

SEQ ID NO: 1063756 - protein, 18 aa, Mycobacterium
YALIWAMSVAAKRAEAML

SEQ ID NO: 1063757 - protein, 19 aa, Mycobacterium
YANRFGYNVVRDFTGHGIG

SEQ ID NO: 1063758 - protein, 25 aa, Mycobacterium
YAPSPPARCTLHWGADRPARLRVPV

SEQ ID NO: 1063759 - protein, 17 aa, Mycobacterium
YATCVELGIPIFVCAGI

SEQ ID NO: 1063760 - protein, 24 aa, Mycobacterium
YATDEMRAWWGGMWADRILRSDLS

SEQ ID NO: 1063761 - protein, 17 aa, Mycobacterium
YAVLDPMIYFGPFTPAI

SEQ ID NO: 1063762 - protein, 18 aa, Mycobacterium
YAVPRLLARNGLTLQDFD

SEQ ID NO: 1063763 - protein, 17 aa, Mycobacterium
YCCAVCSVWPGSRCARS

SEQ ID NO: 1063764 - protein, 30 aa, Mycobacterium; identical to SEQ ID NO: 781998

SEQ ID NO: 1063765 - protein, 19 aa, Mycobacterium
YDGAVFHRVIRGFMIQGGD

SEQ ID NO: 1063766 - protein, 18 aa, Mycobacterium
YDGGFLYGSGGSGYNSAT

SEQ ID NO: 1063767 - protein, 21 aa, Mycobacterium
YDILFFWVARMMMFGTFVGGD

SEQ ID NO: 1063768 - protein, 17 aa, Mycobacterium
YDIPSRFVKTIGPDPVH

SEQ ID NO: 1063769 - protein, 18 aa, Mycobacterium
YDIYRWLWLRGYNPGRLC

SEQ ID NO: 1063770 - protein, 19 aa, Mycobacterium
YDIYRWLWLRGYNPGRLCL

SEQ ID NO: 1063771 - protein, 24 aa, Mycobacterium
YDMSMARFLYWGCDIWLNNPLRPL

SEQ ID NO: 1063772 - protein, 19 aa, Mycobacterium
YDQNFSRLGALEGAGGNGG

SEQ ID NO: 1063773 - protein, 25 aa, Mycobacterium
YEDLAWFCVRAWRFGAPASYGAGGL

SEQ ID NO: 1063774 - protein, 18 aa, Mycobacterium
YELARPGTDISIADVLRC

SEQ ID NO: 1063775 - protein, 17 aa, Mycobacterium
YELDCLIFATGFEVGTD

SEQ ID NO: 1063776 - protein, 17 aa, Mycobacterium
YEMFPRSTGGWDDEGKP

SEQ ID NO: 1063777 - protein, 19 aa, Mycobacterium
YEPKTGWFRSRMLSRRRPG

SEQ ID NO: 1063778 - protein, 22 aa, Mycobacterium
YEQLAALGFEYGQAFRGCTALW

SEQ ID NO: 1063779 - protein, 17 aa, Mycobacterium
YEVLERVGLNPKVASRY

SEQ ID NO: 1063780 - protein, 24 aa, Mycobacterium
YFGDLRIGMMGVWIGAIQNMYPEL

SEQ ID NO: 1063781 - protein, 17 aa, Mycobacterium
YFMAAGTPLYAMSSILG

SEQ ID NO: 1063782 - protein, 17 aa, Mycobacterium
YFPHPLRVVCGGISIPG

SEQ ID NO: 1063783 - protein, 18 aa, Mycobacterium
YGALFTDVFGLREGDDVR

SEQ ID NO: 1063784 - protein, 18 aa, Mycobacterium
YGGDSYFGANGGAGGTGG

SEQ ID NO: 1063785 - protein, 20 aa, Mycobacterium
YGGLFIRMSWHAAGTYRIQD

SEQ ID NO: 1063786 - protein, 21 aa, Mycobacterium
YGRWLRFVTWWPIADGAAHLT

SEQ ID NO: 1063787 - protein, 17 aa, Mycobacterium
YGRWYRFLLLWPGADKG

SEQ ID NO: 1063788 - protein, 17 aa, Mycobacterium
YGVDAQQLFGFLRENNR

SEQ ID NO: 1063789 - protein, 21 aa, Mycobacterium
YGVDAQQLFGFLRENNRLSSL

SEQ ID NO: 1063790 - protein, 23 aa, Mycobacterium
YHAAPRLKLFVGLGSRFCGAAAG

SEQ ID NO: 1063791 - protein, 24 aa, Mycobacterium
YHAAPRLKLFVGLGSRFCGAAAGI

SEQ ID NO: 1063792 - protein, 18 aa, Mycobacterium
YHKIHLYDAFGFAESRTV

SEQ ID NO: 1063793 - protein, 18 aa, Mycobacterium
YILWAAWHRSGLQNRWLA

SEQ ID NO: 1063794 - protein, 19 aa, Mycobacterium
YIPPNLHFSRWNPAIDASS

SEQ ID NO: 1063795 - protein, 21 aa, Mycobacterium
YKDVILGLVFLKFVSDARDGR

SEQ ID NO: 1063796 - protein, 21 aa, Mycobacterium
YKLPKAIVFRAGIQRSPSGKA

SEQ ID NO: 1063797 - protein, 17 aa, Mycobacterium
YLALEWLERMDLVDGKL

SEQ ID NO: 1063798 - protein, 18 aa, Mycobacterium
YLDLRVKVAKNWQRDPKQ

SEQ ID NO: 1063799 - protein, 17 aa, Mycobacterium
YLERATDVVIRWNGTIN

SEQ ID NO: 1063800 - protein, 26 aa, Mycobacterium
YLRIAPELFLKRCIVGGFDRVFELNR

SEQ ID NO: 1063801 - protein, 19 aa, Mycobacterium
YLRRVMLYRSMFGTPEEHN

SEQ ID NO: 1063802 - protein, 19 aa, Mycobacterium
YLTRPSLFHFIRTAEEFSW

SEQ ID NO: 1063803 - protein, 21 aa, Mycobacterium
YLYPRVEVEVGFILAADLPGA

SEQ ID NO: 1063804 - protein, 18 aa, Mycobacterium
YMAQLGFRTINEAVGQAG

SEQ ID NO: 1063805 - protein, 24 aa, Mycobacterium
YNTLRSAGILPDLSVPISSVTNML

SEQ ID NO: 1063806 - protein, 18 aa, Mycobacterium
YPAICNFYGMEGAYLETG

SEQ ID NO: 1063807 - protein, 21 aa, Mycobacterium
YPEFLPERLLRLIAGNIGLPA

SEQ ID NO: 1063808 - protein, 22 aa, Mycobacterium
YPEFLPERLLRLIAGNIGLPAD

SEQ ID NO: 1063809 - protein, 24 aa, Mycobacterium
YPEGKRAGLWPGLRETFKSGTSEP

SEQ ID NO: 1063810 - protein, 18 aa, Mycobacterium
YPELADWGIPTAEAIVEV

SEQ ID NO: 1063811 - protein, 21 aa, Mycobacterium
YPEPARAAAIVRRTVPGASAA

SEQ ID NO: 1063812 - protein, 17 aa, Mycobacterium
YPHARPVPLPTYPFQHH

SEQ ID NO: 1063813 - protein, 20 aa, Mycobacterium
YPHRGVDTGGVWVWRDAQAV

SEQ ID NO: 1063814 - protein, 17 aa, Mycobacterium
YPIELGMTIRLARDKNY

SEQ ID NO: 1063815 - protein, 19 aa, Mycobacterium
YPLRKVHLALVLWFPDDAT

SEQ ID NO: 1063816 - protein, 19 aa, Mycobacterium
YPMFRRLREEAPLYYNAQH

SEQ ID NO: 1063817 - protein, 19 aa, Mycobacterium
YPQLAAFEFAIRAEDGIAV

SEQ ID NO: 1063818 - protein, 19 aa, Mycobacterium
YPQWHEWIKGVWVLAHYDD

SEQ ID NO: 1063819 - protein, 17 aa, Mycobacterium
YPRSDRGAKVFGITGNH

SEQ ID NO: 1063820 - protein, 17 aa, Mycobacterium
YPTGHSALLHWIGQHGL

SEQ ID NO: 1063821 - protein, 19 aa, Mycobacterium
YPVGFAWAMCTPFQFTKQF

SEQ ID NO: 1063822 - protein, 18 aa, Mycobacterium
YQGLVGVPLFDIAAAPGF

SEQ ID NO: 1063823 - protein, 17 aa, Mycobacterium
YQQSRWWSPRGWAHRQS

SEQ ID NO: 1063824 - protein, 17 aa, Mycobacterium
YRAAGYWTGRSIGSLLR

SEQ ID NO: 1063825 - protein, 20 aa, Mycobacterium
YRARAGAVFGSRMLMLEHIG

SEQ ID NO: 1063826 - protein, 17 aa, Mycobacterium
YRFPGLLPGDRWCVVAV

SEQ ID NO: 1063827 - protein, 18 aa, Mycobacterium
YRLELARPDYRACWDYGG

SEQ ID NO: 1063828 - protein, 17 aa, Mycobacterium
YRLGRSVARMEAALSAP

SEQ ID NO: 1063829 - protein, 18 aa, Mycobacterium
YRQMRNFWATLMVSQGTP

SEQ ID NO: 1063830 - protein, 17 aa, Mycobacterium
YRREVLEALDLDTLESR

SEQ ID NO: 1063831 - protein, 17 aa, Mycobacterium
YRRYRICRPRRCCRKYG

SEQ ID NO: 1063832 - protein, 19 aa, Mycobacterium
YRSRPLWRPFIRVGTVSAQ

SEQ ID NO: 1063833 - protein, 20 aa, Mycobacterium
YRWHMRAGKWALNRDIAAAR

SEQ ID NO: 1063834 - protein, 24 aa, Mycobacterium
YSNGMFWRGDYQGLVGAHYEIFIP

SEQ ID NO: 1063835 - protein, 20 aa, Mycobacterium
YTGLRWSEPVGLRVKDIDLT

SEQ ID NO: 1063836 - protein, 20 aa, Mycobacterium
YTHRPSWPAGIAVGKTAVSS

SEQ ID NO: 1063837 - protein, 18 aa, Mycobacterium
YTLNSGRGMRVRILTYGG

SEQ ID NO: 1063838 - protein, 17 aa, Mycobacterium
YTRLSWAVLNWNSNAIA

SEQ ID NO: 1063839 - protein, 23 aa, Mycobacterium
YTWPRFVCGLPREFFAAVRAELA

SEQ ID NO: 1063840 - protein, 17 aa, Mycobacterium
YVAKYTICPAVAHGLDH

SEQ ID NO: 1063841 - protein, 18 aa, Mycobacterium
YVMPHWPKPWGRAADAVE

SEQ ID NO: 1063842 - protein, 17 aa, Mycobacterium
YWFRSIRQTVQFAEAVR

SEQ ID NO: 1063843 - protein, 18 aa, Mycobacterium
YWGGVCLNVGCIPSKALL

SEQ ID NO: 1063844 - protein, 18 aa, Mycobacterium
YWGWPEDTERVFGAKLHS

SEQ ID NO: 1063845 - protein, 22 aa, Mycobacterium
YYADFEGVLAFLQRKMAQTESE

SEQ ID NO: 1063846 - protein, 19 aa, Mycobacterium
YYAMTGWRLGWLLVPTELR

SEQ ID NO: 1063847 - protein, 18 aa, Mycobacterium
YYDDMAWLALALERAARI

SEQ ID NO: 1063848 - protein, 25 aa, Mycobacterium
TEQSALKCLYLVTRSLDPTGTGQKR

SEQ ID NO: 1063849 - protein, 18 aa, Mycobacterium
ADIFFLVCDGLKGLPDSV

SEQ ID NO: 1063850 - protein, 26 aa, Mycobacterium
GQKRWTMRWKPALNAFAITFADRMPG

SEQ ID NO: 1063851 - protein, 24 aa, Mycobacterium
TVVQTCIIHLIRGTFRYAGRQHHT

SEQ ID NO: 1063852 - protein, 37 aa, Mycobacterium
WGHRYPAAIRLWRTAWNEFIPFLDYDTEIRKVICSTN

SEQ ID NO: 1063853 - protein, 24 aa, Mycobacterium
TVVQTCIIHLIRGTFRYPGRQHHT

SEQ ID NO: 1063854 - protein, 37 aa, Mycobacterium
WGHRYPAAIRLWRNAWNEFIPFLDYDTEIRKVICSTN

SEQ ID NO: 1063855 - protein, 18 aa, Mycobacterium
GNLLAQINHPHPTSPPQH

SEQ ID NO: 1063856 - protein, 18 aa, Mycobacterium
GTYGNLLAQINHPHPTSP

SEQ ID NO: 1063857 - protein, 24 aa, Mycobacterium
QINHRWFRALYRRRWKDIRRQFTT

SEQ ID NO: 1063858 - protein, 36 aa, Mycobacterium
GHRYPAAIRLWRNAWNEFIPFLDYDTEIRKVICSTN

SEQ ID NO: 1063859 - protein, 18 aa, Mycobacterium
HHHTPDQPLWLGSIKSNI

SEQ ID NO: 1063860 - protein, 17 aa, Mycobacterium
LHATYGHHHTPDQPLWL

SEQ ID NO: 1063861 - protein, 18 aa, Mycobacterium
SPHIDWSSGTVRLLTEPI

SEQ ID NO: 1063862 - protein, 18 aa, Mycobacterium
VDQPSPHIDWSSGTVRLL

SEQ ID NO: 1063863 - protein, 20 aa, Mycobacterium
AIIDSLITRPLTTATGSAPA

SEQ ID NO: 1063864 - protein, 21 aa, Mycobacterium
DALADYRHRLGLPATSLAWGY

SEQ ID NO: 1063865 - protein, 29 aa, Mycobacterium
DIDGYGIHPALFDAALHPLLALTQPPTND

SEQ ID NO: 1063866 - protein, 17 aa, Mycobacterium
ELIVHTPLLLAGHDTAD

SEQ ID NO: 1063867 - protein, 23 aa, Mycobacterium
GDQLDQVLAPKIDAAWQLHQLTY

SEQ ID NO: 1063868 - protein, 17 aa, Mycobacterium
GLLHLSWPPHPDTTTDT

SEQ ID NO: 1063869 - protein, 24 aa, Mycobacterium
LAENRGWVFTGRISPRTQPWLNEH

SEQ ID NO: 1063870 - protein, 17 aa, Mycobacterium
LHCHGISPSWNVLYCQA

SEQ ID NO: 1063871 - protein, 24 aa, Mycobacterium
LPATSLAWGYWQTHTGLTAHLTDV

SEQ ID NO: 1063872 - protein, 17 aa, Mycobacterium
NTLAPILSALITTPRRR

SEQ ID NO: 1063873 - protein, 42 aa, Mycobacterium; identical to SEQ ID NO: 975314

SEQ ID NO: 1063874 - protein, 28 aa, Mycobacterium
TDHNHLPLTPVPWPPPGTAAIEVDDFYD

SEQ ID NO: 1063875 - protein, 25 aa, Mycobacterium
TGDQVRLPYAFTGISLHATHATRLR

SEQ ID NO: 1063876 - protein, 19 aa, Mycobacterium
TTAAGLLHLSWPPHPDTTT

SEQ ID NO: 1063877 - protein, 23 aa, Mycobacterium
AKYCKYWLAVLTELKNRGVADIF

SEQ ID NO: 1063878 - protein, 24 aa, Mycobacterium
GSDPAVGVLVWPLSARSAPGLSAQ

SEQ ID NO: 1063879 - protein, 20 aa, Mycobacterium
MRQHWGIENSLHWIRDVTFD

SEQ ID NO: 1063880 - protein, 17 aa, Mycobacterium
PLLSRGLLTPQGPGKTV

SEQ ID NO: 1063881 - protein, 18 aa, Mycobacterium
TQPWLNEHAVESAVLFPG

SEQ ID NO: 1063882 - protein, 19 aa, Mycobacterium
AHLWKALCQDYEVLGFDAA

SEQ ID NO: 1063883 - protein, 23 aa, Mycobacterium
GCGLVVPCYLRQARRDTTLGNGT

SEQ ID NO: 1063884 - protein, 17 aa, Mycobacterium
HVGWLDDRKWAYVRLEG

SEQ ID NO: 1063885 - protein, 17 aa, Mycobacterium
IQSLLTSSSAYAGTETA

SEQ ID NO: 1063886 - protein, 17 aa, Mycobacterium
LCQDYEVLGFDAAAGGY

SEQ ID NO: 1063887 - protein, 18 aa, Mycobacterium
LNLEYKLEVWDSPNSAGV

SEQ ID NO: 1063888 - protein, 21 aa, Mycobacterium
LQRWFISWSKLVSLVHPTDAP

SEQ ID NO: 1063889 - protein, 18 aa, Mycobacterium
NHQDLIQSLLTSSSAYAG

SEQ ID NO: 1063890 - protein, 21 aa, Mycobacterium
QAILATVRDAAEFWGGQGSTA

SEQ ID NO: 1063891 - protein, 23 aa, Mycobacterium
QGSTAHEMFIADLGRNFQMIYEQ

SEQ ID NO: 1063892 - protein, 25 aa, Mycobacterium
QINQAFRHIVTLLQDVRDQLGTAAD

SEQ ID NO: 1063893 - protein, 18 aa, Mycobacterium
RQHWGIENSLHWIRDVTF

SEQ ID NO: 1063894 - protein, 27 aa, Mycobacterium
RVAFVNALPVFIASDPVWAKKFADARV

SEQ ID NO: 1063895 - protein, 26 aa, Mycobacterium
SLFHKGQWVIVLLTAPMPGGPMLTNS

SEQ ID NO: 1063896 - protein, 25 aa, Mycobacterium
TGLDLPPTLIFDHPTPHAVAEHLLE

SEQ ID NO: 1063897 - protein, 25 aa, Mycobacterium
VHFTQFILAEIFPGGWLPTVPTVEE

SEQ ID NO: 1063898 - protein, 17 aa, Mycobacterium
WLVALPLITLSTQDMIE

SEQ ID NO: 1063899 - protein, 22 aa, Mycobacterium
AAQLTFSAPTLPILSNLTGQIA

SEQ ID NO: 1063900 - protein, 19 aa, Mycobacterium
AEWLVRQGVPFRSAHEAAG

SEQ ID NO: 1063901 - protein, 18 aa, Mycobacterium
AGRLMFYGQGAGGAPTAS

SEQ ID NO: 1063902 - protein, 23 aa, Mycobacterium
AGSLRLDLSQYRELEAFAAFASD

SEQ ID NO: 1063903 - protein, 24 aa, Mycobacterium
AGTGWLPGWRLTFGGEDIGWEGAL

SEQ ID NO: 1063904 - protein, 19 aa, Mycobacterium
AHVDLYFEAAVAGAIPVIR

SEQ ID NO: 1063905 - protein, 25 aa, Mycobacterium
ALRQDGMLALARLQRKMRLVESPYR

SEQ ID NO: 1063906 - protein, 26 aa, Mycobacterium
APEHVHTYRITPLALWNARAAGHDAE

SEQ ID NO: 1063907 - protein, 24 aa, Mycobacterium
ARSVFNRFPYLEPLNHLQVELLRR

SEQ ID NO: 1063908 - protein, 27 aa, Mycobacterium
CMDNGMPILVFNLLTNGNIARAVAGEK

SEQ ID NO: 1063909 - protein, 22 aa, Mycobacterium
DACDAALQPFTGWSVLAVLHDE

SEQ ID NO: 1063910 - protein, 25 aa, Mycobacterium
DASPAFLGFNLFQHAIARAVIHGTY

SEQ ID NO: 1063911 - protein, 18 aa, Mycobacterium
DGSPLRYNQLDPYLPDFV

SEQ ID NO: 1063912 - protein, 27 aa, Mycobacterium
DGTKAGFDLAMLRAVRAAVTVPVIASG

SEQ ID NO: 1063913 - protein, 24 aa, Mycobacterium
DKEGRLILSKKRAQYERAWGTIEA

SEQ ID NO: 1063914 - protein, 24 aa, Mycobacterium
DRLRTRFEWGLITDVQPPELETRI

SEQ ID NO: 1063915 - protein, 26 aa, Mycobacterium
EAAVAGAIPVIRPLTQSLAGDTVLRV

SEQ ID NO: 1063916 - protein, 26 aa, Mycobacterium
EAIGLLKMDFLGLRNLTIIGDAIENI

SEQ ID NO: 1063917 - protein, 18 aa, Mycobacterium
EERRLAYVGITRARQRLY

SEQ ID NO: 1063918 - protein, 17 aa, Mycobacterium
EGGGRLVVELTPDEAAA

SEQ ID NO: 1063919 - protein, 23 aa, Mycobacterium
EGNLGLIRAVEKFDYTKGYKFST

SEQ ID NO: 1063920 - protein, 24 aa, Mycobacterium
EINTRGDIILFIDELHTLVGAGAA

SEQ ID NO: 1063921 - protein, 25 aa, Mycobacterium
EKKRHEILQLELLKPKIAILDETDS

SEQ ID NO: 1063922 - protein, 25 aa, Mycobacterium
ELCEEAPFYTLGPLATDIAPAYDHI

SEQ ID NO: 1063923 - protein, 20 aa, Mycobacterium
ELSTIRLLAKLPTIAAYAYK

SEQ ID NO: 1063924 - protein, 17 aa, Mycobacterium
ELWAWVGAYDHVALCQL

SEQ ID NO: 1063925 - protein, 18 aa, Mycobacterium
EMGIRVRYLHSEVDTLRR

SEQ ID NO: 1063926 - protein, 25 aa, Mycobacterium
EREYRTRLKTYLESQLEELGQRGSA

SEQ ID NO: 1063927 - protein, 26 aa, Mycobacterium
ESAQTLLENLFFKEKRYDLARVGRYK

SEQ ID NO: 1063928 - protein, 17 aa, Mycobacterium
EVELAKRIEAGLYATQL

SEQ ID NO: 1063929 - protein, 30 aa, Mycobacterium; identical to SEQ ID NO: 784336

SEQ ID NO: 1063930 - protein, 27 aa, Mycobacterium
EWKDGEALFLRCNIWREAAENVAESLT

SEQ ID NO: 1063931 - protein, 20 aa, Mycobacterium
EYGRTVVVLTIDPAKRLAQA

SEQ ID NO: 1063932 - protein, 25 aa, Mycobacterium
FAQAVIDAGLIWIGPSPQSIRDLGD

SEQ ID NO: 1063933 - protein, 25 aa, Mycobacterium
GCDKSLPGMLMAAARLDLASVFLYA

SEQ ID NO: 1063934 - protein, 25 aa, Mycobacterium
GDELRATLLALLGSPHLCSRAFITE

SEQ ID NO: 1063935 - protein, 23 aa, Mycobacterium
GEGKRLYPLTADRAKPAVPFGGA

SEQ ID NO: 1063936 - protein, 29 aa, Mycobacterium
GERRRVALCKLLLSKPDLLLLDEPTNHLD

SEQ ID NO: 1063937 - protein, 31 aa, Mycobacterium; identical to SEQ ID NO: 114747

SEQ ID NO: 1063938 - protein, 25 aa, Mycobacterium
GHNYIGTEHILLGLIREGEGVAAQV

SEQ ID NO: 1063939 - protein, 27 aa, Mycobacterium
GHSSLTLYIQLYLGGFGLELSDIESLR

SEQ ID NO: 1063940 - protein, 30 aa, Mycobacterium; identical to SEQ ID NO: 114827

SEQ ID NO: 1063941 - protein, 26 aa, Mycobacterium
GMGADLYRQFPVFAHALDACDAALQP

SEQ ID NO: 1063942 - protein, 33 aa, Mycobacterium; identical to SEQ ID NO: 820171

SEQ ID NO: 1063943 - protein, 19 aa, Mycobacterium
GTFTFAELLAHELSVERAS

SEQ ID NO: 1063944 - protein, 21 aa, Mycobacterium
GTYGNLLAQINHPHPTSPPQH

SEQ ID NO: 1063945 - protein, 22 aa, Mycobacterium
GVADIFFLVCDGLKGLPDSVSA

SEQ ID NO: 1063946 - protein, 19 aa, Mycobacterium
GVGLALVAQHRGYKCVFVC

SEQ ID NO: 1063947 - protein, 24 aa, Mycobacterium
GVKGRVLPMCPIALQIEADVSGLE

SEQ ID NO: 1063948 - protein, 23 aa, Mycobacterium
GVSSPRVLSDLFWMGRYGERAEN

SEQ ID NO: 1063949 - protein, 28 aa, Mycobacterium
HATPSQLALAWLLKRSPVMLPIPGTSRV

SEQ ID NO: 1063950 - protein, 33 aa, Mycobacterium; identical to SEQ ID NO: 219115

SEQ ID NO: 1063951 - protein, 24 aa, Mycobacterium
HNAVEYFVSYYDYYQPEAYIAQTD

SEQ ID NO: 1063952 - protein, 18 aa, Mycobacterium
HVRDVKFVAAFDVDAKKV

SEQ ID NO: 1063953 - protein, 18 aa, Mycobacterium
IERKLYPNVDFYTGLIYR

SEQ ID NO: 1063954 - protein, 18 aa, Mycobacterium
ILEEVWGFDFPTSGNALE

SEQ ID NO: 1063955 - protein, 18 aa, Mycobacterium
INMPVLDGVSVVTALRAM

SEQ ID NO: 1063956 - protein, 20 aa, Mycobacterium
IRLIFQRAREKASEGTPVIV

SEQ ID NO: 1063957 - protein, 20 aa, Mycobacterium
IVPGKVTKLVPFGAFVRVEE

SEQ ID NO: 1063958 - protein, 19 aa, Mycobacterium
KAAEIAINSPLLEASMEGA

SEQ ID NO: 1063959 - protein, 26 aa, Mycobacterium
KEIQSRLGFLLDVGLEYLSLSRAAAT

SEQ ID NO: 1063960 - protein, 19 aa, Mycobacterium
KLKVLVSIFGRETPVELTF

SEQ ID NO: 1063961 - protein, 18 aa, Mycobacterium
KNDFGLVAIDTLLARMEN

SEQ ID NO: 1063962 - protein, 29 aa, Mycobacterium
KSGRDSMFQAILPLRGKIINVEKARIDRV

SEQ ID NO: 1063963 - protein, 19 aa, Mycobacterium
LAWPTAQIAVMGASGAVGF

SEQ ID NO: 1063964 - protein, 25 aa, Mycobacterium
LDRLEDIWSTFTKLAPKQLIVDENL

SEQ ID NO: 1063965 - protein, 19 aa, Mycobacterium
LEVYSPNSPLGGALIDAKV

SEQ ID NO: 1063966 - protein, 17 aa, Mycobacterium
LGLIRAMEKFDYTKGFK

SEQ ID NO: 1063967 - protein, 25 aa, Mycobacterium
LHNMRTMRFLPPEKQARKARETLEV

SEQ ID NO: 1063968 - protein, 18 aa, Mycobacterium
LIRAMEKFDYTKGFKFST

SEQ ID NO: 1063969 - protein, 18 aa, Mycobacterium
LLGLIREGEGVAAQVLVK

SEQ ID NO: 1063970 - protein, 19 aa, Mycobacterium
LNRAPTLHRLGIQAFEPML

SEQ ID NO: 1063971 - protein, 24 aa, Mycobacterium
LTCDPIAGLVQIPCIERNAISAGK

SEQ ID NO: 1063972 - protein, 18 aa, Mycobacterium
LVAIDTLLARMENDRDRL

SEQ ID NO: 1063973 - protein, 21 aa, Mycobacterium
LVYAVLNLYPYNPGHLMVVPY

SEQ ID NO: 1063974 - protein, 26 aa, Mycobacterium
LYEIRTLFGVLFQDGALFGSMNLYDN

SEQ ID NO: 1063975 - protein, 19 aa, Mycobacterium
MDYLKEGIGLRAMAQRDPL

SEQ ID NO: 1063976 - protein, 24 aa, Mycobacterium
NCPDILDVPLMAEVLRGLGATVEL

SEQ ID NO: 1063977 - protein, 30 aa, Mycobacterium; identical to SEQ ID NO: 116398

SEQ ID NO: 1063978 - protein, 26 aa, Mycobacterium
PDAPTLSGFWHWAVANLPADVTELPA

SEQ ID NO: 1063979 - protein, 27 aa, Mycobacterium
PGTKGLSLFFVPKFLFDFETGELGERN

SEQ ID NO: 1063980 - protein, 21 aa, Mycobacterium
PLTQLLARWDGKITVAAVNGP

SEQ ID NO: 1063981 - protein, 18 aa, Mycobacterium
PRAVFRKFGLCRICLREM

SEQ ID NO: 1063982 - protein, 26 aa, Mycobacterium
PTEPVLKLLKITGDWQKFKGLPGAEG

SEQ ID NO: 1063983 - protein, 26 aa, Mycobacterium
PVNTWLMEQLIMIDALKRGSAKRITA

SEQ ID NO: 1063984 - protein, 17 aa, Mycobacterium
QGRKWFQLYMWRDRDRS

SEQ ID NO: 1063985 - protein, 32 aa, Mycobacterium; identical to SEQ ID NO: 116847

SEQ ID NO: 1063986 - protein, 31 aa, Mycobacterium; identical to SEQ ID NO: 975334

SEQ ID NO: 1063987 - protein, 27 aa, Mycobacterium
QTREHVLLARQVGVPYILVALNKSDAV

SEQ ID NO: 1063988 - protein, 26 aa, Mycobacterium
QVAEPYLPLRAVRHLEKGRVVIFGAG

SEQ ID NO: 1063989 - protein, 25 aa, Mycobacterium
RAARVVVPDFQLSLAIGKEGQNARL

SEQ ID NO: 1063990 - protein, 24 aa, Mycobacterium
RARAGLFLAMQYPVEVPGVSVSNF

SEQ ID NO: 1063991 - protein, 23 aa, Mycobacterium
RDDGYRFMLLGRAIERVDMTVRL

SEQ ID NO: 1063992 - protein, 31 aa, Mycobacterium; identical to SEQ ID NO: 852526

SEQ ID NO: 1063993 - protein, 20 aa, Mycobacterium
RDRLVVIIAGYRADLDKFLD

SEQ ID NO: 1063994 - protein, 21 aa, Mycobacterium
RGARVWPGVSIPDGGIRYSSD

SEQ ID NO: 1063995 - protein, 25 aa, Mycobacterium
RGGKVWINIFPDRPLTKKPAETRMG

SEQ ID NO: 1063996 - protein, 29 aa, Mycobacterium
RIAQAQLVGWLEGLFHGIQTALFAQQMAA

SEQ ID NO: 1063997 - protein, 22 aa, Mycobacterium
RIDDAFLDPLQFRADSVLGVAG

SEQ ID NO: 1063998 - protein, 25 aa, Mycobacterium
RISGKKGERIVYIRTLVTGKSSSAS

SEQ ID NO: 1063999 - protein, 36 aa, Mycobacterium; identical to SEQ ID NO: 17410

SEQ ID NO: 1064000 - protein, 19 aa, Mycobacterium
RLTGRSPILLAGMTPTTVD

SEQ ID NO: 1064001 - protein, 23 aa, Mycobacterium
RNRLNLALTLKQGGNLILLDEPT

SEQ ID NO: 1064002 - protein, 24 aa, Mycobacterium
RPGQRSFTLDDLSLRYLRRELRAE

SEQ ID NO: 1064003 - protein, 17 aa, Mycobacterium
RQVLGPNAVQAGSLNRP

SEQ ID NO: 1064004 - protein, 25 aa, Mycobacterium
RRSRGTPRIANRLLRRVRDFAEVRA

SEQ ID NO: 1064005 - protein, 26 aa, Mycobacterium
RYTGRGMPLLDLIQEGNLGLIRAMEK

SEQ ID NO: 1064006 - protein, 26 aa, Mycobacterium
SACNPYLAFAVLLAAGLRGVEKGYVL

SEQ ID NO: 1064007 - protein, 20 aa, Mycobacterium
SAGHIYAVIGLKDTTTGDTL

SEQ ID NO: 1064008 - protein, 23 aa, Mycobacterium
SDMFGELSIFDPGPRTSSATTIT

SEQ ID NO: 1064009 - protein, 23 aa, Mycobacterium
SGARITLHVALELARRGSGYGVA

SEQ ID NO: 1064010 - protein, 29 aa, Mycobacterium
SGRTVGVLANNPLRLGGCLNSESAEKAAR

SEQ ID NO: 1064011 - protein, 20 aa, Mycobacterium
SITPRDALASAGKTLVELFG

SEQ ID NO: 1064012 - protein, 26 aa, Mycobacterium
SSAAGLVALPWHAAYSASKYGLRGLS

SEQ ID NO: 1064013 - protein, 26 aa, Mycobacterium
SSNKPVLVDFWATWCGPCKMVAPVLE

SEQ ID NO: 1064014 - protein, 19 aa, Mycobacterium
SVRVIPKQADEFTCSSCFL

SEQ ID NO: 1064015 - protein, 42 aa, Mycobacterium; identical to SEQ ID NO: 975347

SEQ ID NO: 1064016 - protein, 23 aa, Mycobacterium
TGDGIGIVFRKGLPLEDMEFHQF

SEQ ID NO: 1064017 - protein, 19 aa, Mycobacterium
TIRIPVHMVEVINKLGRIQ

SEQ ID NO: 1064018 - protein, 19 aa, Mycobacterium
TIVGIPDIPGYAAKVFRAV

SEQ ID NO: 1064019 - protein, 18 aa, Mycobacterium
TMGQVAEPYLPLRAVRHL

SEQ ID NO: 1064020 - protein, 20 aa, Mycobacterium
TMTADYWYRNIRNTVRFHDT

SEQ ID NO: 1064021 - protein, 22 aa, Mycobacterium
TRAMPAYNWMTVAKSALESVNR

SEQ ID NO: 1064022 - protein, 28 aa, Mycobacterium
TTGRRRRCGWFDAVIARYATRVNGITDY

SEQ ID NO: 1064023 - protein, 19 aa, Mycobacterium
VAALFSRRGFNIESLAVGA

SEQ ID NO: 1064024 - protein, 19 aa, Mycobacterium
VARVKALLRRRGATATSSS

SEQ ID NO: 1064025 - protein, 38 aa, Mycobacterium; identical to SEQ ID NO: 122970

SEQ ID NO: 1064026 - protein, 30 aa, Mycobacterium; identical to SEQ ID NO: 118259

SEQ ID NO: 1064027 - protein, 18 aa, Mycobacterium
VHAALRQVLGPNAVQAGS

SEQ ID NO: 1064028 - protein, 25 aa, Mycobacterium
VLRGYTLPNGLQLRQQRVPLGVVGM

SEQ ID NO: 1064029 - protein, 17 aa, Mycobacterium
VMRVPLEGGGRLVVELT

SEQ ID NO: 1064030 - protein, 25 aa, Mycobacterium
VRGLPQLSSAPVWCSDIRAGAGLVL

SEQ ID NO: 1064031 - protein, 23 aa, Mycobacterium
VSLGLYSRIFRNNILASGVIPQI

SEQ ID NO: 1064032 - protein, 18 aa, Mycobacterium
VSPQLYIALGISGAIQHR

SEQ ID NO: 1064033 - protein, 26 aa, Mycobacterium
VSRALMYHYFPDKRAFFAAVVKDEAD

SEQ ID NO: 1064034 - protein, 25 aa, Mycobacterium
YGNAIINTLLLYMENHRDELVVFGA

SEQ ID NO: 1064035 - protein, 20 aa, Mycobacterium
YNKLFEERIIFLGVQVDDAS

SEQ ID NO: 1064036 - protein, 18 aa, Mycobacterium
YRNIRNTVRFHDTVAALL

SEQ ID NO: 1064037 - protein, 26 aa, Mycobacterium
YTKGFKFSTYATWWIRQAITRGMADQ

SEQ ID NO: 1064038 - protein, 24 aa, Mycobacterium
AAAKGKELVWAPATFRYVMMVLRH

SEQ ID NO: 1064039 - protein, 26 aa, Mycobacterium
AAANSWLDGFSYWRRAQGLASTTIAW

SEQ ID NO: 1064040 - protein, 24 aa, Mycobacterium
AAAVDVTLLGRFYERFADHAVEVA

SEQ ID NO: 1064041 - protein, 27 aa, Mycobacterium
AAAVTEWFTVDWHRVIVNKWRAAGVRM

SEQ ID NO: 1064042 - protein, 21 aa, Mycobacterium
AAAVWRVRRAAPLLPTVLLGR

SEQ ID NO: 1064043 - protein, 32 aa, Mycobacterium
AADAYDAYLRLHMLSHRLVAPHGLNADGLFGV

SEQ ID NO: 1064044 - protein, 23 aa, Mycobacterium
AADKYLITPVVDVLAALAESSAP

SEQ ID NO: 1064045 - protein, 26 aa, Mycobacterium
AADVDEELLLQLKAWRLSTAKEQNVP

SEQ ID NO: 1064046 - protein, 25 aa, Mycobacterium
AAEGFSVLLLPNPAPTPVVAFAVRN

SEQ ID NO: 1064047 - protein, 25 aa, Mycobacterium
AAEGLPLSAYTVLRPLRPTLHRQEC

SEQ ID NO: 1064048 - protein, 23 aa, Mycobacterium
AAEHPYQEWLDKGLVPIDELPAG

SEQ ID NO: 1064049 - protein, 20 aa, Mycobacterium
AAELAGDKPWFAIGGIDAQR

SEQ ID NO: 1064050 - protein, 32 aa, Mycobacterium
AAELLGIPWIELNPHPLYLPSKGLPPIGSGLA

SEQ ID NO: 1064051 - protein, 19 aa, Mycobacterium
AAERALGLPTLYASGRAGI

SEQ ID NO: 1064052 - protein, 30 aa, Mycobacterium
AAFDTELFGHWWYEGPIWLQRVLRALPTAG

SEQ ID NO: 1064053 - protein, 27 aa, Mycobacterium
AAFGYVRDFLSFLPPNCFDKAPIVNPG

SEQ ID NO: 1064054 - protein, 18 aa, Mycobacterium
AAFQQQFMRRLSSAGVSY

SEQ ID NO: 1064055 - protein, 24 aa, Mycobacterium
AAGIIPAVLHYAQHYCPAGRADPD

SEQ ID NO: 1064056 - protein, 39 aa, Mycobacterium
AAGIKRPDYSITGWVILTLIQHGTPWQIERFAGKALLQE

SEQ ID NO: 1064057 - protein, 24 aa, Mycobacterium
AAGRIHRPFSILILSKELAQQTKS

SEQ ID NO: 1064058 - protein, 28 aa, Mycobacterium
AAGRRLEVSTPLILCRKFQGCLNLSQWI

SEQ ID NO: 1064059 - protein, 25 aa, Mycobacterium
AAGRYVLDRAIFDALRRVSRGTGGE

SEQ ID NO: 1064060 - protein, 19 aa, Mycobacterium
AAGTIARQFLRQALGVEVL

SEQ ID NO: 1064061 - protein, 24 aa, Mycobacterium
AAGYGLISYWTAYLKANFAGEYMA

SEQ ID NO: 1064062 - protein, 23 aa, Mycobacterium
AAHKFGGPPGVGALLLRRDISCV

SEQ ID NO: 1064063 - protein, 18 aa, Mycobacterium
AAHPAVPPNIAYFLERGL

SEQ ID NO: 1064064 - protein, 25 aa, Mycobacterium
AAICTLRNWLNWVPCGWPQARAEPH

SEQ ID NO: 1064065 - protein, 21 aa, Mycobacterium
AAKMFNCTGWKIGWPAEQQIS

SEQ ID NO: 1064066 - protein, 24 aa, Mycobacterium
AAKTEPLGILPRPNELPRGCIAAG

SEQ ID NO: 1064067 - protein, 25 aa, Mycobacterium
AALARQFVMATLFHQTRSWSNVLKV

SEQ ID NO: 1064068 - protein, 19 aa, Mycobacterium
AALDLVTLAIEAAGFKPGA

SEQ ID NO: 1064069 - protein, 19 aa, Mycobacterium
AALDRYAAAGPSCERYREL

SEQ ID NO: 1064070 - protein, 17 aa, Mycobacterium
AALLKYYPDAETVQLHP

SEQ ID NO: 1064071 - protein, 20 aa, Mycobacterium
AALLLDTWALLGRQDLRAAE

SEQ ID NO: 1064072 - protein, 18 aa, Mycobacterium
AALQILKAETWRPEAVLQ

SEQ ID NO: 1064073 - protein, 28 aa, Mycobacterium
AALVIDHPFMVTALLDRAALDAQAQAGA

SEQ ID NO: 1064074 - protein, 18 aa, Mycobacterium
AAMDIFRGLPAEDLMSVA

SEQ ID NO: 1064075 - protein, 25 aa, Mycobacterium
AANSWVDLFAHWRRAQGLPVSAIAW

SEQ ID NO: 1064076 - protein, 38 aa, Mycobacterium
AAQLREFLLSLYREIILVTFERLVFDGILQEVVLFCGV

SEQ ID NO: 1064077 - protein, 23 aa, Mycobacterium
AARALIAVRGLHRFAVAEGLVDL

SEQ ID NO: 1064078 - protein, 32 aa, Mycobacterium
AARFIRFCDAFNIPLVFVVDTPGFLPGVEQEK

SEQ ID NO: 1064079 - protein, 25 aa, Mycobacterium
AARIASRLIGLVLDRGVARGSTHLG

SEQ ID NO: 1064080 - protein, 22 aa, Mycobacterium
AARRQQVIVAEKSHPAGDGGKA

SEQ ID NO: 1064081 - protein, 32 aa, Mycobacterium
AARVVEFMLLDRLFPRSIFYSLKLAEHNLDEL

SEQ ID NO: 1064082 - protein, 20 aa, Mycobacterium
AASIWPKLWRPRANGASSKS

SEQ ID NO: 1064083 - protein, 25 aa, Mycobacterium
AASKSPLPPMPIGSSVQPPPASSES

SEQ ID NO: 1064084 - protein, 17 aa, Mycobacterium
AASMGEFLLAAGTRGKR

SEQ ID NO: 1064085 - protein, 24 aa, Mycobacterium
AATGARWFCETFPARLERGAGVPA

SEQ ID NO: 1064086 - protein, 23 aa, Mycobacterium
AATHGLALDPKFSNTNPRTSPEY

SEQ ID NO: 1064087 - protein, 21 aa, Mycobacterium
AATVRALRIIKAVATVPGADP

SEQ ID NO: 1064088 - protein, 21 aa, Mycobacterium
AAVEHLFTVASGLDSAVVGEQ

SEQ ID NO: 1064089 - protein, 18 aa, Mycobacterium
AAVPRIGVVIMAGNTVYY

SEQ ID NO: 1064090 - protein, 17 aa, Mycobacterium
AAWRAAFDHEQSCVAII

SEQ ID NO: 1064091 - protein, 19 aa, Mycobacterium
ACAFLNNRTPRSANDPSKT

SEQ ID NO: 1064092 - protein, 26 aa, Mycobacterium
ACDSGPLRRLIATLPALEVSRPDWPA

SEQ ID NO: 1064093 - protein, 18 aa, Mycobacterium
ACHATPERLLRCIEAVLE

SEQ ID NO: 1064094 - protein, 21 aa, Mycobacterium
ACLDAGVRVGCFRPPTVPAGT

SEQ ID NO: 1064095 - protein, 32 aa, Mycobacterium
ACNSQVWRYPAFFHALLDAGVYPPCSTFEAWF

SEQ ID NO: 1064096 - protein, 25 aa, Mycobacterium
ADAKEPWLLDAYRRAWEWADSTGWR

SEQ ID NO: 1064097 - protein, 24 aa, Mycobacterium
ADASLRAHIWKRSSFSGTEIFGKT

SEQ ID NO: 1064098 - protein, 17 aa, Mycobacterium
ADASLSHPYLDTVLFVL

SEQ ID NO: 1064099 - protein, 20 aa, Mycobacterium
ADAVALFRLGRHRAEVVAVA

SEQ ID NO: 1064100 - protein, 19 aa, Mycobacterium
ADAYPGYVVSIGGPAYADI

SEQ ID NO: 1064101 - protein, 25 aa, Mycobacterium
ADDYLPKPFALEELLARIRALLRRT

SEQ ID NO: 1064102 - protein, 24 aa, Mycobacterium
ADFAHRGWIRLDGKSVLISDSERL

SEQ ID NO: 1064103 - protein, 26 aa, Mycobacterium
ADFKRPSPHWWFDDNTLYGPDELALP

SEQ ID NO: 1064104 - protein, 19 aa, Mycobacterium
ADFLAVIPQTRSMALVTYR

SEQ ID NO: 1064105 - protein, 19 aa, Mycobacterium
ADFPILKRVMRGGNQLAYL

SEQ ID NO: 1064106 - protein, 24 aa, Mycobacterium
ADGRLPVLPVTEFSLHNAADAFRL

SEQ ID NO: 1064107 - protein, 32 aa, Mycobacterium
ADHLIELPAVSTLLQPLLSTIPLQVFAASVAQ

SEQ ID NO: 1064108 - protein, 19 aa, Mycobacterium
ADKLQSGYLPVLRSYNYAG

SEQ ID NO: 1064109 - protein, 21 aa, Mycobacterium
ADLAVIALLRDDLDLMLATPT

SEQ ID NO: 1064110 - protein, 21 aa, Mycobacterium
ADLCEFINASPSPFHVCATVA

SEQ ID NO: 1064111 - protein, 22 aa, Mycobacterium
ADLESREVLLAKLAGAMKGTFA

SEQ ID NO: 1064112 - protein, 22 aa, Mycobacterium
ADLPPVPLDAAIVFAPVGDLVL

SEQ ID NO: 1064113 - protein, 21 aa, Mycobacterium
ADLSLPVFHPECRCKDSGPQR

SEQ ID NO: 1064114 - protein, 27 aa, Mycobacterium
ADLVTAGPLREWLHKQRTGLPHVTWKY

SEQ ID NO: 1064115 - protein, 25 aa, Mycobacterium
ADNLPPQLITWMVDFGLAAGSRITQ

SEQ ID NO: 1064116 - protein, 23 aa, Mycobacterium
ADNQLDVFVVINPTVLKANIGDF

SEQ ID NO: 1064117 - protein, 21 aa, Mycobacterium
ADPFGDVFLIIDGWSAFTSEF

SEQ ID NO: 1064118 - protein, 24 aa, Mycobacterium
ADPFPVYRALIDYGPMQLPGMPLT

SEQ ID NO: 1064119 - protein, 27 aa, Mycobacterium
ADPLDPEWLLETLGLTDVARTTYRRLS

SEQ ID NO: 1064120 - protein, 25 aa, Mycobacterium
ADPTAAIMSLALLLAHLGEDEPAAR

SEQ ID NO: 1064121 - protein, 28 aa, Mycobacterium
ADQARARRLAKRICTIVASAIEFEIKDP

SEQ ID NO: 1064122 - protein, 18 aa, Mycobacterium
ADQLLIVVALADPPPRTG

SEQ ID NO: 1064123 - protein, 19 aa, Mycobacterium
ADRLPTAHRVAEVGPLIVL

SEQ ID NO: 1064124 - protein, 26 aa, Mycobacterium
ADSAELPLFRYIGGSNAHILPVPMMN

SEQ ID NO: 1064125 - protein, 23 aa, Mycobacterium
ADSKLFTGKLPQAGWCGSGQAVS

SEQ ID NO: 1064126 - protein, 24 aa, Mycobacterium
ADTQDLLLLDDLLGIADPAVELPR

SEQ ID NO: 1064127 - protein, 19 aa, Mycobacterium
ADVDLLRQAWLTATRARNA

SEQ ID NO: 1064128 - protein, 22 aa, Mycobacterium
ADVLRAWGKLGYPRRAKRLHES

SEQ ID NO: 1064129 - protein, 21 aa, Mycobacterium
ADWSLPPIRIAVDLPDRIAGV

SEQ ID NO: 1064130 - protein, 20 aa, Mycobacterium
ADYYRNGGILHYVLRNILKS

SEQ ID NO: 1064131 - protein, 24 aa, Mycobacterium
AEAAPFIMEVIPPGSGSVSVQNQV

SEQ ID NO: 1064132 - protein, 23 aa, Mycobacterium
AEADHIASFALPIDDLDLTVRSY

SEQ ID NO: 1064133 - protein, 26 aa, Mycobacterium
AEAITDRILLLDGLPNYQRIGSLRVG

SEQ ID NO: 1064134 - protein, 19 aa, Mycobacterium
AEALLHPATWWADVVTDDF

SEQ ID NO: 1064135 - protein, 26 aa, Mycobacterium
AEARRHGWTFPYLYDETQAVARAFAA

SEQ ID NO: 1064136 - protein, 28 aa, Mycobacterium
AEASAALIWRRPRWARRLQPGPVADMLA

SEQ ID NO: 1064137 - protein, 27 aa, Mycobacterium
AEAYRAISLLLRRPPGREAYPGDVFYL

SEQ ID NO: 1064138 - protein, 22 aa, Mycobacterium
AECLPYYTELFEQIKVAAKPHL

SEQ ID NO: 1064139 - protein, 24 aa, Mycobacterium
AEDAFLTILSDLLYAAQYAGTART

SEQ ID NO: 1064140 - protein, 26 aa, Mycobacterium
AEEKFGFLLEAFTFGAPPHGGIAFGW

SEQ ID NO: 1064141 - protein, 26 aa, Mycobacterium
AEFFEPIIGINRYLRTLVDVGLGYVR

SEQ ID NO: 1064142 - protein, 25 aa, Mycobacterium
AEGKTPILYVVGRKALNYYTFRNWG

SEQ ID NO: 1064143 - protein, 19 aa, Mycobacterium
AEGLLHERRLFHSTFVTDD

SEQ ID NO: 1064144 - protein, 22 aa, Mycobacterium
AEGRLKGILKYVDAPIVSSDIV

SEQ ID NO: 1064145 - protein, 20 aa, Mycobacterium
AEHGLWYPPDPSSFEICSIG

SEQ ID NO: 1064146 - protein, 29 aa, Mycobacterium
AEIGIGFCFAPLFQPSYRYASAVRHEIGV

SEQ ID NO: 1064147 - protein, 24 aa, Mycobacterium
AEKRPQLLIGWHMQLGNIVIPKQV

SEQ ID NO: 1064148 - protein, 21 aa, Mycobacterium
AELAIRFRDKGVVGFDIAGAE

SEQ ID NO: 1064149 - protein, 23 aa, Mycobacterium
AELLDIVGLRRDDATRYPTEFSG

SEQ ID NO: 1064150 - protein, 17 aa, Mycobacterium
AELRLRADARHPPVVQG

SEQ ID NO: 1064151 - protein, 18 aa, Mycobacterium
AELVVDEALRRRVFDKIA

SEQ ID NO: 1064152 - protein, 27 aa, Mycobacterium
AEPELVGPFQVRIPLMFNASDGHTLVN

SEQ ID NO: 1064153 - protein, 23 aa, Mycobacterium
AEPLPRTLVWSTAWEMTREAELR

SEQ ID NO: 1064154 - protein, 26 aa, Mycobacterium
AEPRDWLEVSLIPTTRELTTLGRTPL

SEQ ID NO: 1064155 - protein, 19 aa, Mycobacterium
AEQFTQSGLILFGRLGGVE

SEQ ID NO: 1064156 - protein, 25 aa, Mycobacterium
AEQLFDDAPLYPPPIIPTCTTTPNG

SEQ ID NO: 1064157 - protein, 21 aa, Mycobacterium
AEQMKMFLTRLGFGSKVVVTG

SEQ ID NO: 1064158 - protein, 24 aa, Mycobacterium
AERGYGYGPVFRGLTAMWRRGDEL

SEQ ID NO: 1064159 - protein, 19 aa, Mycobacterium
AESYLDFGKILDAAAKSGA

SEQ ID NO: 1064160 - protein, 27 aa, Mycobacterium
AEVDRGTWTPAPVFAMIAQRGRVAREE

SEQ ID NO: 1064161 - protein, 20 aa, Mycobacterium
AEVMARLLVFTRERYHEFHH

SEQ ID NO: 1064162 - protein, 19 aa, Mycobacterium
AEYYGIPFGVLHFVPARVN

SEQ ID NO: 1064163 - protein, 22 aa, Mycobacterium
AFDTFAEMVAYWPPVCVGQSGE

SEQ ID NO: 1064164 - protein, 23 aa, Mycobacterium
AFDWVRDVLSYLPSNNFTDAPRY

SEQ ID NO: 1064165 - protein, 41 aa, Mycobacterium
AFEMLVRYDRPYSGYIPILGAPWLPDLVRRSPWAEMFSSAG

SEQ ID NO: 1064166 - protein, 19 aa, Mycobacterium
AFGMMLLSNSLLRPQRHCQ

SEQ ID NO: 1064167 - protein, 21 aa, Mycobacterium
AFLGRLALVRIYNGKLRKGQQ

SEQ ID NO: 1064168 - protein, 22 aa, Mycobacterium
AFLTWHAWSDPNCGKWPPGFPE

SEQ ID NO: 1064169 - protein, 25 aa, Mycobacterium
AFQDKYPMYTIIRQQLTDAAVRPVT

SEQ ID NO: 1064170 - protein, 26 aa, Mycobacterium
AFSEEFLLPRSLLTAIRHIEPTMLLI

SEQ ID NO: 1064171 - protein, 20 aa, Mycobacterium
AFTVFVLLVEYWAQGDCGSL

SEQ ID NO: 1064172 - protein, 21 aa, Mycobacterium
AFVARLYAQRHLADRGPLRGT

SEQ ID NO: 1064173 - protein, 20 aa, Mycobacterium
AFVGRIQPLKAPDIVLRAAA

SEQ ID NO: 1064174 - protein, 25 aa, Mycobacterium
AGAAHFLEHLLFKSTSTRTAMDIAQ

SEQ ID NO: 1064175 - protein, 39 aa, Mycobacterium
AGAALDFAALYPAGRLLDAPLPVWTHPRLFIDTDGQEQR

SEQ ID NO: 1064176 - protein, 21 aa, Mycobacterium
AGAAYLVDWAKDIDPAWLAGV

SEQ ID NO: 1064177 - protein, 25 aa, Mycobacterium
AGAGILYRLHLDLGSLSIAEFYPDG

SEQ ID NO: 1064178 - protein, 21 aa, Mycobacterium
AGDVFARVLATKWPRTETKPE

SEQ ID NO: 1064179 - protein, 23 aa, Mycobacterium
AGFDAAFFGITPREAAAMDPQQR

SEQ ID NO: 1064180 - protein, 24 aa, Mycobacterium
AGGPDTLLLLQHPPVYTAGRRTQP

SEQ ID NO: 1064181 - protein, 33 aa, Mycobacterium
AGGRAVVMTYWNPVLRYGVCAFARDLESAGGHG

SEQ ID NO: 1064182 - protein, 21 aa, Mycobacterium
AGHAGIHYSAVRRYFTSYKHK

SEQ ID NO: 1064183 - protein, 19 aa, Mycobacterium
AGHEHWVGLFHRIARSRIN

SEQ ID NO: 1064184 - protein, 23 aa, Mycobacterium
AGHSIRWSLTLSYDRIHGCQRTM

SEQ ID NO: 1064185 - protein, 24 aa, Mycobacterium
AGIERVRATLPRLGELAIGGTAVG

SEQ ID NO: 1064186 - protein, 21 aa, Mycobacterium
AGIKPIIGVEAYIAPGSRFDT

SEQ ID NO: 1064187 - protein, 20 aa, Mycobacterium
AGIPTYCGMFPGAFGTTIGG

SEQ ID NO: 1064188 - protein, 20 aa, Mycobacterium
AGIYVGDGMMIHSSTYGVPV

SEQ ID NO: 1064189 - protein, 26 aa, Mycobacterium
AGKLAVRLRRQGHTPLLVACDLQRPA

SEQ ID NO: 1064190 - protein, 25 aa, Mycobacterium
AGKPWTVSKLYYNHGFLRARMQLLH

SEQ ID NO: 1064191 - protein, 22 aa, Mycobacterium
AGKSMAFPTKLSRDGIIDVALG

SEQ ID NO: 1064192 - protein, 17 aa, Mycobacterium
AGLGIAFNAKPALRAVA

SEQ ID NO: 1064193 - protein, 21 aa, Mycobacterium
AGLVRLLGQLYSAFDALVDKH

SEQ ID NO: 1064194 - protein, 20 aa, Mycobacterium
AGNVIMLRRAGQRFGFAVGS

SEQ ID NO: 1064195 - protein, 29 aa, Mycobacterium
AGPDQPVLRALLDLLPIAGGSGTLSDRFL

SEQ ID NO: 1064196 - protein, 20 aa, Mycobacterium
AGPIAFLRDGDRVLLDVVGC

SEQ ID NO: 1064197 - protein, 25 aa, Mycobacterium
AGPIDEILFRWRSSFRICWLSGGWV

SEQ ID NO: 1064198 - protein, 23 aa, Mycobacterium
AGQGSRLATILSLCAHIASRCAT

SEQ ID NO: 1064199 - protein, 28 aa, Mycobacterium
AGQIGYSLLFRLASGSLLGLDRPIELRL

SEQ ID NO: 1064200 - protein, 26 aa, Mycobacterium
AGRSRLMPPMPLIPGRRSKPTVVVVT

SEQ ID NO: 1064201 - protein, 27 aa, Mycobacterium
AGSLNRPGYLRFDFNWQGSLTGEQRTQ

SEQ ID NO: 1064202 - protein, 22 aa, Mycobacterium
AGSVFKIFTTAAALDMGMGINA

SEQ ID NO: 1064203 - protein, 27 aa, Mycobacterium
AGVAKYPARVKCALLGWMACKDALIHA

SEQ ID NO: 1064204 - protein, 19 aa, Mycobacterium
AGVRFYFVHSYAAQRWEGS

SEQ ID NO: 1064205 - protein, 23 aa, Mycobacterium
AGWAVRMWLVYDLALTGISLSSP

SEQ ID NO: 1064206 - protein, 25 aa, Mycobacterium
AGYLVVSYRREALPRVQLWPIDPDG

SEQ ID NO: 1064207 - protein, 18 aa, Mycobacterium
AHATAWYGLNDLAGIKVG

SEQ ID NO: 1064208 - protein, 25 aa, Mycobacterium
AHDEGWLAEHMLILKLISPENKAYY

SEQ ID NO: 1064209 - protein, 17 aa, Mycobacterium
AHDYVPFDRGENFAFLG

SEQ ID NO: 1064210 - protein, 26 aa, Mycobacterium
AHGHRWYGPAFLLNDMLVWGFTGQVI

SEQ ID NO: 1064211 - protein, 19 aa, Mycobacterium
AHLQLVLHKLHDAGATVTQ

SEQ ID NO: 1064212 - protein, 25 aa, Mycobacterium
AHPERAVAVLAALPAWNGAPESAPA

SEQ ID NO: 1064213 - protein, 18 aa, Mycobacterium
AHPQSWKLLRGRVSLPSR

SEQ ID NO: 1064214 - protein, 19 aa, Mycobacterium
AHQELAKHALFENALDNLI

SEQ ID NO: 1064215 - protein, 17 aa, Mycobacterium
AHRVAEVGPLIVLRVGI

SEQ ID NO: 1064216 - protein, 23 aa, Mycobacterium
AHWKCYMALGYFKLAIMAAGIDL

SEQ ID NO: 1064217 - protein, 24 aa, Mycobacterium
AIAATQAAIWYLTNGLALDTRPRN

SEQ ID NO: 1064218 - protein, 21 aa, Mycobacterium
AIAHAWRQIIMGDADVAVCGG

SEQ ID NO: 1064219 - protein, 22 aa, Mycobacterium
AIAKARFVRVSPRKARRVIDLV

SEQ ID NO: 1064220 - protein, 18 aa, Mycobacterium
AIAPIRRPARSATILLPK

SEQ ID NO: 1064221 - protein, 20 aa, Mycobacterium
AICDRLGLLPMFAVNQDKHG

SEQ ID NO: 1064222 - protein, 22 aa, Mycobacterium
AICLSTRLAKARLYLCTDARRE

SEQ ID NO: 1064223 - protein, 18 aa, Mycobacterium
AIDDAGVLMIESRKIRST

SEQ ID NO: 1064224 - protein, 21 aa, Mycobacterium
AIDMKDMVGMMIVVARQLKQA

SEQ ID NO: 1064225 - protein, 21 aa, Mycobacterium
AIDQVLLPGLVDLHTHLREPG

SEQ ID NO: 1064226 - protein, 26 aa, Mycobacterium
AIDVHPIRHTIMHADLLVVRSGEKIV

SEQ ID NO: 1064227 - protein, 23 aa, Mycobacterium
AIDVRQLGTVDYHIAWQLQRDLA

SEQ ID NO: 1064228 - protein, 25 aa, Mycobacterium
AIELDGLRLITWRGASRAEQGLSFA

SEQ ID NO: 1064229 - protein, 25 aa, Mycobacterium
AIELGIKWLSLYAFSTENWKRSVEE

SEQ ID NO: 1064230 - protein, 24 aa, Mycobacterium
AIHAQFFQLGFRPIKALLSAAGGE

SEQ ID NO: 1064231 - protein, 33 aa, Mycobacterium
AIKALHKILHNFKMPGFLVPEFRRKAVIIAVGG

SEQ ID NO: 1064232 - protein, 23 aa, Mycobacterium
AILAGGCFWGIQNLFRRQPGVIS

SEQ ID NO: 1064233 - protein, 20 aa, Mycobacterium
AIMEEVLLPVMYDIPSRDDV

SEQ ID NO: 1064234 - protein, 20 aa, Mycobacterium
AIPDRGLFSMYLTSYPDSPS

SEQ ID NO: 1064235 - protein, 23 aa, Mycobacterium
AIQPIFQAISLLVAALGDVPLIG

SEQ ID NO: 1064236 - protein, 18 aa, Mycobacterium
AIRLMRRSVALASAARDE

SEQ ID NO: 1064237 - protein, 26 aa, Mycobacterium
AISESLRYVAAWNAAFLPSKDLTEGI

SEQ ID NO: 1064238 - protein, 19 aa, Mycobacterium
AITAANFTHGWLRTGDLGS

SEQ ID NO: 1064239 - protein, 26 aa, Mycobacterium
AITSRTRLIWVETPTNPLLSIADITS

SEQ ID NO: 1064240 - protein, 17 aa, Mycobacterium
AIVALGGFAWQIVLRLP

SEQ ID NO: 1064241 - protein, 24 aa, Mycobacterium
AIYDTMVLAPCDIATYAMGMAASM

SEQ ID NO: 1064242 - protein, 31 aa, Mycobacterium
AKDQLRFSAPPRLDLSLLAFALPEDYKTTEL

SEQ ID NO: 1064243 - protein, 23 aa, Mycobacterium
AKDRKPIFFYSEKAESVWGEELT

SEQ ID NO: 1064244 - protein, 24 aa, Mycobacterium
AKEQLGILARFAGATLVAKEDNVP

SEQ ID NO: 1064245 - protein, 21 aa, Mycobacterium
AKFEFNNGFATITIATTGVGH

SEQ ID NO: 1064246 - protein, 18 aa, Mycobacterium
AKGVIFVKPVLVGEVRYS

SEQ ID NO: 1064247 - protein, 22 aa, Mycobacterium
AKGVLYHVLCGRVLPPHPGLAG

SEQ ID NO: 1064248 - protein, 20 aa, Mycobacterium
AKIYAPLVDLIWMETDTTVP

SEQ ID NO: 1064249 - protein, 19 aa, Mycobacterium
AKLAIGFPASCLRLERWLA

SEQ ID NO: 1064250 - protein, 19 aa, Mycobacterium
AKLLKSCYLLALSQNWLLN

SEQ ID NO: 1064251 - protein, 27 aa, Mycobacterium
AKQLLVAAAVIGFRFGSDLLASLGIDL

SEQ ID NO: 1064252 - protein, 25 aa, Mycobacterium
AKRAIKSRHWGVPGLSWMPGEVPDP

SEQ ID NO: 1064253 - protein, 27 aa, Mycobacterium
AKRDSEWMGRVHRFLGLQVGVILASMT

SEQ ID NO: 1064254 - protein, 25 aa, Mycobacterium
AKRLEEVWVPFEPYPVIMPRNSEAL

SEQ ID NO: 1064255 - protein, 23 aa, Mycobacterium
AKRLFSYTSPLHLYAEEIEPRTG

SEQ ID NO: 1064256 - protein, 30 aa, Mycobacterium; identical to SEQ ID NO: 124058

SEQ ID NO: 1064257 - protein, 18 aa, Mycobacterium
AKSNILMLGPTGCGKTYL

SEQ ID NO: 1064258 - protein, 17 aa, Mycobacterium
AKTDVLVSYLPVGSEEA

SEQ ID NO: 1064259 - protein, 18 aa, Mycobacterium
AKTFLWEEKLRMLPVYNP

SEQ ID NO: 1064260 - protein, 26 aa, Mycobacterium
AKTSWDLRKFLWAPKLGCYGIQRIHL

SEQ ID NO: 1064261 - protein, 24 aa, Mycobacterium
AKVDAWLEGLADPQVRQLILLYAP

SEQ ID NO: 1064262 - protein, 27 aa, Mycobacterium
AKVRGHRAWPILIRTGALVLSSAATGV

SEQ ID NO: 1064263 - protein, 40 aa, Mycobacterium
AKVSGSRFYFLTGRGALLQLGLLQLALRLAVENDFIPMIP

SEQ ID NO: 1064264 - protein, 26 aa, Mycobacterium
ALAALPDAVRRRVIRGWLLNGGATGL

SEQ ID NO: 1064265 - protein, 26 aa, Mycobacterium
ALADFARLYVVMGGKPISGIPAGCTD

SEQ ID NO: 1064266 - protein, 21 aa, Mycobacterium
ALAERALVPVLPSVEEFPYAI

SEQ ID NO: 1064267 - protein, 19 aa, Mycobacterium
ALAILTARHLDCWVLGTVC

SEQ ID NO: 1064268 - protein, 25 aa, Mycobacterium
ALARAGFRTLALQTFLTVGPKEVRA

SEQ ID NO: 1064269 - protein, 17 aa, Mycobacterium
ALARAWRHDLLHAGYRV

SEQ ID NO: 1064270 - protein, 26 aa, Mycobacterium
ALAYGDMGLTLPILAPGGVAATLTYW

SEQ ID NO: 1064271 - protein, 18 aa, Mycobacterium
ALDKVFWCRVGTSGGIGL

SEQ ID NO: 1064272 - protein, 18 aa, Mycobacterium
ALDLLRWVNRYTEITRDQ

SEQ ID NO: 1064273 - protein, 19 aa, Mycobacterium
ALDPQRVVLLPDGTEDYWS

SEQ ID NO: 1064274 - protein, 25 aa, Mycobacterium
ALDTADWLWIPVRRSWRLNERHYGA

SEQ ID NO: 1064275 - protein, 17 aa, Mycobacterium
ALDVTRILITDPDVLAF

SEQ ID NO: 1064276 - protein, 23 aa, Mycobacterium
ALEEIRKILTDAGIEICYDKPSH

SEQ ID NO: 1064277 - protein, 26 aa, Mycobacterium
ALERLEALLALIEGWVQVVVTAALGD

SEQ ID NO: 1064278 - protein, 21 aa, Mycobacterium
ALFGPIGMIVAVALRTDIRES

SEQ ID NO: 1064279 - protein, 24 aa, Mycobacterium
ALGDYEWLLAFEAPGLDRIVDLMR

SEQ ID NO: 1064280 - protein, 29 aa, Mycobacterium
ALGFPTRMFTVLFALGRLPGWIAHWREMH

SEQ ID NO: 1064281 - protein, 23 aa, Mycobacterium
ALGGGCELAMMCDLLIAADTAKF

SEQ ID NO: 1064282 - protein, 25 aa, Mycobacterium
ALGKNLLVAIMPWEGHNYEDAIILS

SEQ ID NO: 1064283 - protein, 27 aa, Mycobacterium
ALGTALARLGMFAPALSYLEEPAGPVA

SEQ ID NO: 1064284 - protein, 22 aa, Mycobacterium
ALIDVAHWASEFPWCGQAADVL

SEQ ID NO: 1064285 - protein, 18 aa, Mycobacterium
ALILASPEDRPALKKAGF

SEQ ID NO: 1064286 - protein, 24 aa, Mycobacterium
ALITIADLIAWRRKHEKHIERVAE

SEQ ID NO: 1064287 - protein, 18 aa, Mycobacterium
ALLKVLRGVYSRGEMTTA

SEQ ID NO: 1064288 - protein, 21 aa, Mycobacterium
ALLREGVGVFGFHLCGLDMRQ

SEQ ID NO: 1064289 - protein, 18 aa, Mycobacterium
ALLRLPVANWSILGSMGN

SEQ ID NO: 1064290 - protein, 27 aa, Mycobacterium
ALNCEIVPWCRFARKNYFYPDVPKNYQ

SEQ ID NO: 1064291 - protein, 18 aa, Mycobacterium
ALNYYTFRNWGIAESWTG

SEQ ID NO: 1064292 - protein, 19 aa, Mycobacterium
ALQLEYNWIKEFDPRFNIR

SEQ ID NO: 1064293 - protein, 18 aa, Mycobacterium
ALQVLAARLQAMAEEQAL

SEQ ID NO: 1064294 - protein, 33 aa, Mycobacterium
ALRADGISAPVLAWLHPPGIDFGPALLADVQIA

SEQ ID NO: 1064295 - protein, 23 aa, Mycobacterium
ALRAPLDVLVVRKLGVPFQPELA

SEQ ID NO: 1064296 - protein, 20 aa, Mycobacterium
ALRELLPLRRADQDEYLCWA

SEQ ID NO: 1064297 - protein, 22 aa, Mycobacterium
ALRWSGMIAERVCRLLRTPSVD

SEQ ID NO: 1064298 - protein, 19 aa, Mycobacterium
ALSLKLIDPPPSFARQVRR

SEQ ID NO: 1064299 - protein, 18 aa, Mycobacterium
ALTINKMCLSGLDAIALA

SEQ ID NO: 1064300 - protein, 25 aa, Mycobacterium
ALTNDFFVNLLDMSTTCSPSATDDG

SEQ ID NO: 1064301 - protein, 18 aa, Mycobacterium
ALTQLREVLGYDLRCYSD

SEQ ID NO: 1064302 - protein, 17 aa, Mycobacterium
ALTRAIHKLPIKARIVT

SEQ ID NO: 1064303 - protein, 18 aa, Mycobacterium
ALVESALWEASLFEEHGF

SEQ ID NO: 1064304 - protein, 20 aa, Mycobacterium
ALVLQYFHVAPWVAWSDAGH

SEQ ID NO: 1064305 - protein, 24 aa, Mycobacterium
ALVSLVLDWHRPVKIFVETKHPVR

SEQ ID NO: 1064306 - protein, 20 aa, Mycobacterium
ALVVMESRARYFPKGPACLI

SEQ ID NO: 1064307 - protein, 21 aa, Mycobacterium
ALWAATFLRRRGAAADAVLLN

SEQ ID NO: 1064308 - protein, 19 aa, Mycobacterium
ALWEASLFEEHGFGNIKIS

SEQ ID NO: 1064309 - protein, 17 aa, Mycobacterium
AMAAVRRVFATDNLRLV

SEQ ID NO: 1064310 - protein, 35 aa, Mycobacterium
AMAPLVAEAGVAWVLMHWRLMSAERPYEAPNYRDV

SEQ ID NO: 1064311 - protein, 21 aa, Mycobacterium
AMARRCVDAGWMLSLSGTVSF

SEQ ID NO: 1064312 - protein, 27 aa, Mycobacterium
AMARRFDTIARLWDVIGETGIGFCLDT

SEQ ID NO: 1064313 - protein, 22 aa, Mycobacterium
AMAVWFLCRLAPVPEVARLSAG

SEQ ID NO: 1064314 - protein, 26 aa, Mycobacterium
AMDELHRHLFSVLMDREWKHGVAAAV

SEQ ID NO: 1064315 - protein, 25 aa, Mycobacterium
AMELLEEVILALRRLHQPVIAAING

SEQ ID NO: 1064316 - protein, 20 aa, Mycobacterium
AMFDPSAVFYMNKITVGPDA

SEQ ID NO: 1064317 - protein, 28 aa, Mycobacterium
AMGYEPEDLPWEVPLVELGLDSLMAVRI

SEQ ID NO: 1064318 - protein, 30 aa, Mycobacterium
AMLGQPVSMLIPWVVGFKLSGEIQPGVTAT

SEQ ID NO: 1064319 - protein, 19 aa, Mycobacterium
AMPEKFVGAFKIDPTMDLQ

SEQ ID NO: 1064320 - protein, 20 aa, Mycobacterium
AMSLAPLAYTLFQRTLRHDP

SEQ ID NO: 1064321 - protein, 24 aa, Mycobacterium
AMTLTDWEYQRMRDLGIAILREVG

SEQ ID NO: 1064322 - protein, 24 aa, Mycobacterium
AMVRRARRLLPGDPDFGDPLSTAG

SEQ ID NO: 1064323 - protein, 23 aa, Mycobacterium
ANAAVLHALMSPGERLLGLDLAN

SEQ ID NO: 1064324 - protein, 23 aa, Mycobacterium
ANDPQAIYLNYIGSAGGVFQRGD

SEQ ID NO: 1064325 - protein, 20 aa, Mycobacterium
ANHSVWFHRQVNFDDWVLYS

SEQ ID NO: 1064326 - protein, 26 aa, Mycobacterium
ANIVKVALEAPLKQIAFNSGMEPGVV

SEQ ID NO: 1064327 - protein, 24 aa, Mycobacterium
ANLNYLLSCILVGIGYPAISARPV

SEQ ID NO: 1064328 - protein, 22 aa, Mycobacterium
ANLVWTPQPAMPGQLRAVTNWT

SEQ ID NO: 1064329 - protein, 25 aa, Mycobacterium
ANMVDTFVLLALARTGDQLQGIKKG

SEQ ID NO: 1064330 - protein, 24 aa, Mycobacterium
ANNDPWYTSLWHNIADAPHLPPGA

SEQ ID NO: 1064331 - protein, 19 aa, Mycobacterium
ANNTHLWVYCGNGTPSELG

SEQ ID NO: 1064332 - protein, 26 aa, Mycobacterium
ANPHVPVIGIPLLPFDVSDLEALRAI

SEQ ID NO: 1064333 - protein, 25 aa, Mycobacterium
ANPLELAGWLAEVLAQAGGIADVEV

SEQ ID NO: 1064334 - protein, 29 aa, Mycobacterium
ANQPWLADHVIGGVVLFPGAGFVELVIRA

SEQ ID NO: 1064335 - protein, 20 aa, Mycobacterium
ANRLCAQILLLAAEDAFKDI

SEQ ID NO: 1064336 - protein, 24 aa, Mycobacterium
ANRPRRAFRRIIGSGLEALLREKD

SEQ ID NO: 1064337 - protein, 17 aa, Mycobacterium
ANSAPWLPIERAAPLDG

SEQ ID NO: 1064338 - protein, 22 aa, Mycobacterium
ANSVFRLPALTSIPIRVDCDDR

SEQ ID NO: 1064339 - protein, 21 aa, Mycobacterium
ANTLYVPPEPFFANQQWAHIT

SEQ ID NO: 1064340 - protein, 38 aa, Mycobacterium
APAALGFHYDTGLYLQFRAIGPDDFHLAYAASLASTGG

SEQ ID NO: 1064341 - protein, 20 aa, Mycobacterium
APAHDWLTLTGGAIGHGIPA

SEQ ID NO: 1064342 - protein, 17 aa, Mycobacterium
APAMHTEMWLHPATVDN

SEQ ID NO: 1064343 - protein, 23 aa, Mycobacterium
APARAYNPLFIWGESGLGKTHLL

SEQ ID NO: 1064344 - protein, 30 aa, Mycobacterium
APEQPPTAFPQWFGRSWRRSAILRYGENPH

SEQ ID NO: 1064345 - protein, 23 aa, Mycobacterium
APFYDGYPRLHAKLTAFGVAVSV

SEQ ID NO: 1064346 - protein, 26 aa, Mycobacterium
APGQGELLKPFTARYFAAIPGVWTRR

SEQ ID NO: 1064347 - protein, 23 aa, Mycobacterium
APKQLPFIEINASYYPARPIDLK

SEQ ID NO: 1064348 - protein, 18 aa, Mycobacterium
APLPHYIEEVEAINFDAD

SEQ ID NO: 1064349 - protein, 17 aa, Mycobacterium
APLVLHPGSGVQVQVVV

SEQ ID NO: 1064350 - protein, 28 aa, Mycobacterium
APNLVKLRPYFDHPLFVEMFVDAITAAA

SEQ ID NO: 1064351 - protein, 25 aa, Mycobacterium
APPMGPLAPLLPAAPDIGLHILVTC

SEQ ID NO: 1064352 - protein, 23 aa, Mycobacterium
APQGLDYVVAFLGALQAGRIAVP

SEQ ID NO: 1064353 - protein, 24 aa, Mycobacterium
APQHDVLMYPAWRSSALLGHLQDR

SEQ ID NO: 1064354 - protein, 23 aa, Mycobacterium
APRLLLEVVCARLLLPSATDAES

SEQ ID NO: 1064355 - protein, 18 aa, Mycobacterium
APSWRKGPWHIAGRGPRD

SEQ ID NO: 1064356 - protein, 19 aa, Mycobacterium
APYVTPLVRKLATENNIDL

SEQ ID NO: 1064357 - protein, 17 aa, Mycobacterium
AQCAINARVAFVNALPV

SEQ ID NO: 1064358 - protein, 26 aa, Mycobacterium
AQEAGVLSRMRPLFSFALGARIGNGR

SEQ ID NO: 1064359 - protein, 17 aa, Mycobacterium
AQFIPLFSGFEQQFIGG

SEQ ID NO: 1064360 - protein, 23 aa, Mycobacterium
AQFTVVLPRRDGIEYSVEHAPSG

SEQ ID NO: 1064361 - protein, 17 aa, Mycobacterium
AQHLLSIRDVLGPLGMG

SEQ ID NO: 1064362 - protein, 27 aa, Mycobacterium
AQKPHGFKALDITLPVPTRWTQVPDPN

SEQ ID NO: 1064363 - protein, 20 aa, Mycobacterium
AQLFHTSGHLDWYAEGIFPP

SEQ ID NO: 1064364 - protein, 23 aa, Mycobacterium
AQLSILVTLLDQGPIRMTDLAAH

SEQ ID NO: 1064365 - protein, 18 aa, Mycobacterium
AQLSVNVAGGYRGLRGSH

SEQ ID NO: 1064366 - protein, 20 aa, Mycobacterium
AQMAKIPLTRRLTSVLSASL

SEQ ID NO: 1064367 - protein, 23 aa, Mycobacterium
AQRRDMMWICRDGDRAKNHLLEA

SEQ ID NO: 1064368 - protein, 25 aa, Mycobacterium
AQSPVSFFAYPGMPSDLVPAGCEVH

SEQ ID NO: 1064369 - protein, 24 aa, Mycobacterium
AQVAVRLALQLWQEGLIDDAEALR

SEQ ID NO: 1064370 - protein, 24 aa, Mycobacterium
AQVLDPQHRLFLQCAWHALEDAGC

SEQ ID NO: 1064371 - protein, 25 aa, Mycobacterium
AQVRSRSWWSGFDVVLLVDDWHMIV

SEQ ID NO: 1064372 - protein, 22 aa, Mycobacterium
AQVTAMVTRILALQAKPTPADA

SEQ ID NO: 1064373 - protein, 24 aa, Mycobacterium
AQYRAMLYLHKFFYYLISVREKEL

SEQ ID NO: 1064374 - protein, 17 aa, Mycobacterium
ARAALQILKAETWRPEA

SEQ ID NO: 1064375 - protein, 20 aa, Mycobacterium
ARAFVNRPLVLLADEPTGNL

SEQ ID NO: 1064376 - protein, 18 aa, Mycobacterium
ARAGFQMLDPLKTVKARV

SEQ ID NO: 1064377 - protein, 38 aa, Mycobacterium
ARAGMVPLLTVLGNIIHTMALKAINWFGQVSTTVAALE

SEQ ID NO: 1064378 - protein, 23 aa, Mycobacterium
ARALILVRWLGAPVLSFHLRDAS

SEQ ID NO: 1064379 - protein, 35 aa, Mycobacterium
ARDFLVPARLRPGTFYALPQSPQLFKQLLMVAGME

SEQ ID NO: 1064380 - protein, 24 aa, Mycobacterium
ARDGRLVHFALDTPWEAQVRPGDI

SEQ ID NO: 1064381 - protein, 24 aa, Mycobacterium
ARDPQLHHCWLHDTATLPPGGESF

SEQ ID NO: 1064382 - protein, 25 aa, Mycobacterium
ARDRAIRRYGQLEERFLALGGYSAE

SEQ ID NO: 1064383 - protein, 31 aa, Mycobacterium
AREFQVVSIPTMILFQGGQPVKRIVGAKGKA

SEQ ID NO: 1064384 - protein, 20 aa, Mycobacterium
AREHGARLLVRLAGVSDRDA

SEQ ID NO: 1064385 - protein, 17 aa, Mycobacterium
AREILLPSTGNLRRPID

SEQ ID NO: 1064386 - protein, 18 aa, Mycobacterium
ARELVSPGLVKRADVVVG

SEQ ID NO: 1064387 - protein, 29 aa, Mycobacterium
ARHQFAALGLNWLVLHNHRRVILQPNQFH

SEQ ID NO: 1064388 - protein, 24 aa, Mycobacterium
ARIALHVRVLYGRDPHHITEAQYK

SEQ ID NO: 1064389 - protein, 31 aa, Mycobacterium
ARIEFKLRDWLFARQRYWGEPFPIIYDSDGR

SEQ ID NO: 1064390 - protein, 19 aa, Mycobacterium
ARIGAPLMLRGIGVRRVAV

SEQ ID NO: 1064391 - protein, 20 aa, Mycobacterium
ARILLRSGKLVFLAANKVDG

SEQ ID NO: 1064392 - protein, 22 aa, Mycobacterium
ARIPNTGIAYPAAFLVGLLPTN

SEQ ID NO: 1064393 - protein, 17 aa, Mycobacterium
ARKAGRRFARLAPIVAT

SEQ ID NO: 1064394 - protein, 22 aa, Mycobacterium
ARKTLVLPVRFAGVHVYGDVTR

SEQ ID NO: 1064395 - protein, 23 aa, Mycobacterium
ARLDIGVLAIRKSGKLPLSVLSE

SEQ ID NO: 1064396 - protein, 19 aa, Mycobacterium
ARLQFSPAVHSRVRRWLVD

SEQ ID NO: 1064397 - protein, 25 aa, Mycobacterium
ARLTWQQVVLLRAYAKYLRQAGFNY

SEQ ID NO: 1064398 - protein, 22 aa, Mycobacterium
ARNAGLLAVRILGSSDLQLRAQ

SEQ ID NO: 1064399 - protein, 21 aa, Mycobacterium
ARNILESYQLLTNVSRLFAER

SEQ ID NO: 1064400 - protein, 25 aa, Mycobacterium
ARPLREAVPLIPAQQLLVETDAPFL

SEQ ID NO: 1064401 - protein, 18 aa, Mycobacterium
ARPRQLLMGAIDAPSRNL

SEQ ID NO: 1064402 - protein, 21 aa, Mycobacterium
ARRGKMFARLIKNIEVAARVG

SEQ ID NO: 1064403 - protein, 24 aa, Mycobacterium
ARRLRKDIFDLYGYNAVVHVLSAS

SEQ ID NO: 1064404 - protein, 18 aa, Mycobacterium
ARRMSEISEAPLYIDDSP

SEQ ID NO: 1064405 - protein, 27 aa, Mycobacterium
ARRQRSWFHRDHRVHWLDVGTVDRVGV

SEQ ID NO: 1064406 - protein, 26 aa, Mycobacterium
ARRVYMSRGWLPWLGPTSVLAPTGVI

SEQ ID NO: 1064407 - protein, 25 aa, Mycobacterium
ARSEIEMKVLLWAVQRLIVGLSKIG

SEQ ID NO: 1064408 - protein, 24 aa, Mycobacterium
ARSNRRFLERVTIPFRGGIGAMLC

SEQ ID NO: 1064409 - protein, 18 aa, Mycobacterium
ARSPKVTALLQLAAYADA

SEQ ID NO: 1064410 - protein, 23 aa, Mycobacterium
ARTFGMDSWFPSLKIYNHNGQLY

SEQ ID NO: 1064411 - protein, 23 aa, Mycobacterium
ARTGIMPHLLVMTATPIPRTVAL

SEQ ID NO: 1064412 - protein, 20 aa, Mycobacterium
ARTNAIIGALARLGNRELVD

SEQ ID NO: 1064413 - protein, 26 aa, Mycobacterium
ARTNKLPVTLFTAGGIATPADAAMMM

SEQ ID NO: 1064414 - protein, 18 aa, Mycobacterium
ARTVALIGDLAFVHDSSG

SEQ ID NO: 1064415 - protein, 31 aa, Mycobacterium
ARVSGVDVFFRAVQYLPWHPGRCAEVFVGET

SEQ ID NO: 1064416 - protein, 37 aa, Mycobacterium
ARYQPLGVVLAVMPWNFPLWQTVRFAAPALMAGNVGL

SEQ ID NO: 1064417 - protein, 20 aa, Mycobacterium
ASACAVFFRHPSRVPPTRAG

SEQ ID NO: 1064418 - protein, 24 aa, Mycobacterium
ASAMQTVLPALSSWRRAERTQSEL

SEQ ID NO: 1064419 - protein, 18 aa, Mycobacterium
ASATPLPVIGVPVPLARL

SEQ ID NO: 1064420 - protein, 24 aa, Mycobacterium
ASDGGLWLAIMSPAALARVDSITA

SEQ ID NO: 1064421 - protein, 25 aa, Mycobacterium
ASDSAGFKWLAPYTGSAIAQHWMYD

SEQ ID NO: 1064422 - protein, 24 aa, Mycobacterium
ASGNPYLAFSAMLMAGLDGIKNKI

SEQ ID NO: 1064423 - protein, 24 aa, Mycobacterium
ASGRTLTFPGFLKAYVETVDELAG

SEQ ID NO: 1064424 - protein, 25 aa, Mycobacterium
ASGSLAWTPLMTQFQLIDKSIAPEP

SEQ ID NO: 1064425 - protein, 25 aa, Mycobacterium
ASHCYPHFPRFLAEVVRVLRPGGHL

SEQ ID NO: 1064426 - protein, 20 aa, Mycobacterium
ASIRPTLRWRLLPADYVEVA

SEQ ID NO: 1064427 - protein, 25 aa, Mycobacterium
ASITEHPFDLLAWARFRVTVNTDNR

SEQ ID NO: 1064428 - protein, 24 aa, Mycobacterium
ASLPDGVLMKRAAYGLASVIIREL

SEQ ID NO: 1064429 - protein, 24 aa, Mycobacterium
ASLPLPKVPQPFTSPAYLQYTSGS

SEQ ID NO: 1064430 - protein, 27 aa, Mycobacterium
ASLSHPYLDTVLFVLGVTRGEIEAADA

SEQ ID NO: 1064431 - protein, 29 aa, Mycobacterium
ASLVEKLVPDFLWISTEHTARLSLDALER

SEQ ID NO: 1064432 - protein, 28 aa, Mycobacterium
ASPARGAVSLLLLLISCEWPGSAISKLK

SEQ ID NO: 1064433 - protein, 18 aa, Mycobacterium
ASPYLGFGSLRPLLEVAA

SEQ ID NO: 1064434 - protein, 17 aa, Mycobacterium
ASRLDGSPLRYNQLDPY

SEQ ID NO: 1064435 - protein, 25 aa, Mycobacterium
ASTASGIRVLYLRGLPAAANFDSGS

SEQ ID NO: 1064436 - protein, 19 aa, Mycobacterium
ASTLRRDMWSDLAAAGLDS

SEQ ID NO: 1064437 - protein, 26 aa, Mycobacterium
ASVNWDRFYPTFALARPRPFLHEITE

SEQ ID NO: 1064438 - protein, 25 aa, Mycobacterium
ASVPDILVQGVLKWLAERGYDVVQS

SEQ ID NO: 1064439 - protein, 28 aa, Mycobacterium
ASYEFLRLLEHRLQLQRLKRTHLLPEDG

SEQ ID NO: 1064440 - protein, 31 aa, Mycobacterium
ATARPPTFVLFTTGFLEACYRRFLERRLRET

SEQ ID NO: 1064441 - protein, 21 aa, Mycobacterium
ATEAFVLASLARQKARTSQGT

SEQ ID NO: 1064442 - protein, 23 aa, Mycobacterium
ATFGVAYLTAWHCLCEVGRLSPG

SEQ ID NO: 1064443 - protein, 24 aa, Mycobacterium
ATGAFLFLGGMPTASRNTAGGGLV

SEQ ID NO: 1064444 - protein, 21 aa, Mycobacterium
ATGELPCCLVAVRSTWKSSPP

SEQ ID NO: 1064445 - protein, 24 aa, Mycobacterium
ATGLESTMRFILSAKSAYVNGQVF

SEQ ID NO: 1064446 - protein, 29 aa, Mycobacterium
ATGRLGLIPLRWALACLLIDIGSVTFSEP

SEQ ID NO: 1064447 - protein, 25 aa, Mycobacterium
ATHAALQVLQFWFGQDRAGTLVVLT

SEQ ID NO: 1064448 - protein, 27 aa, Mycobacterium
ATHSGICRTWWSSKWPTRAGDARCARG

SEQ ID NO: 1064449 - protein, 21 aa, Mycobacterium
ATIAKLWELFVAEDATLVEVN

SEQ ID NO: 1064450 - protein, 20 aa, Mycobacterium
ATILGFLPHVRRITLVSIDF

SEQ ID NO: 1064451 - protein, 26 aa, Mycobacterium
ATISALANFFRIKPAYFTNDEYYEKL

SEQ ID NO: 1064452 - protein, 17 aa, Mycobacterium
ATKARAPFQTLLANRIT

SEQ ID NO: 1064453 - protein, 28 aa, Mycobacterium
ATLALQEVFLMVPKLPLQRLKGPERSKN

SEQ ID NO: 1064454 - protein, 26 aa, Mycobacterium
ATLMRVSKMTVYRLVHNGELPAVRVG

SEQ ID NO: 1064455 - protein, 22 aa, Mycobacterium
ATPVGLIDLGAFLTLTTFNGTG

SEQ ID NO: 1064456 - protein, 25 aa, Mycobacterium
ATQHQAYLALRDWGLPVSEHTTLVN

SEQ ID NO: 1064457 - protein, 20 aa, Mycobacterium
ATTAWLIERLQRPTLVMAPN

SEQ ID NO: 1064458 - protein, 23 aa, Mycobacterium
ATTMHRMIYSADDNIRMPIYLTV

SEQ ID NO: 1064459 - protein, 22 aa, Mycobacterium
ATTPRMSTYLVALIAGPYAAWY

SEQ ID NO: 1064460 - protein, 21 aa, Mycobacterium
ATTPYIAVVGSLETLWTSHER

SEQ ID NO: 1064461 - protein, 20 aa, Mycobacterium
ATVWTLNWVHRLIEGAPHPK

SEQ ID NO: 1064462 - protein, 22 aa, Mycobacterium
ATWAVAQVLLQRAGSRPATVIV

SEQ ID NO: 1064463 - protein, 28 aa, Mycobacterium
AVAAHTSRLRLLAEIDTRAVVLAATQDE

SEQ ID NO: 1064464 - protein, 26 aa, Mycobacterium
AVADRSSWHRWWPDLRLQVVEDRAEK

SEQ ID NO: 1064465 - protein, 20 aa, Mycobacterium
AVALAHHSGYRTMISHRSGE

SEQ ID NO: 1064466 - protein, 24 aa, Mycobacterium
AVDMLEMLPTPWGLVRSGVAPDHP

SEQ ID NO: 1064467 - protein, 17 aa, Mycobacterium
AVDQLLRLSAGPQARAI

SEQ ID NO: 1064468 - protein, 19 aa, Mycobacterium
AVDRFLMGATALPAPVKPS

SEQ ID NO: 1064469 - protein, 18 aa, Mycobacterium
AVDVGYGQLAWSVRCDPR

SEQ ID NO: 1064470 - protein, 18 aa, Mycobacterium
AVEAIWVAAQRYGFAVQP

SEQ ID NO: 1064471 - protein, 29 aa, Mycobacterium
AVECGIGFRRAAGVVAWWASVHRAGAWQP

SEQ ID NO: 1064472 - protein, 20 aa, Mycobacterium
AVGALLSLLTKLSGGKAVAE

SEQ ID NO: 1064473 - protein, 31 aa, Mycobacterium
AVGFVVVAPHQYFPRLRLELDKGFGWKAEVE

SEQ ID NO: 1064474 - protein, 24 aa, Mycobacterium
AVGGDPWPWVLGGGEDHALVACFA

SEQ ID NO: 1064475 - protein, 27 aa, Mycobacterium
AVGTDVPLLGQIPLDPALVAAGDSGIP

SEQ ID NO: 1064476 - protein, 17 aa, Mycobacterium
AVHDLTLAVLPGMIERK

SEQ ID NO: 1064477 - protein, 20 aa, Mycobacterium
AVKMALQYWRSRGQPAKRRL

SEQ ID NO: 1064478 - protein, 17 aa, Mycobacterium
AVLDHPLLVASATPKRA

SEQ ID NO: 1064479 - protein, 20 aa, Mycobacterium
AVLLTLLDRVFNKANAALET

SEQ ID NO: 1064480 - protein, 36 aa, Mycobacterium
AVLTSPVSFLQRPARWMHMLASEFPVFSAAPNFAFE

SEQ ID NO: 1064481 - protein, 19 aa, Mycobacterium
AVMPMDAWREGEEFVVEFD

SEQ ID NO: 1064482 - protein, 29 aa, Mycobacterium
AVNVVNVKLICRDISMFKAFDANEPRISG

SEQ ID NO: 1064483 - protein, 18 aa, Mycobacterium
AVPHYVSHPPNPKATVAL

SEQ ID NO: 1064484 - protein, 18 aa, Mycobacterium
AVQPISPVFLYAHSVDEL

SEQ ID NO: 1064485 - protein, 19 aa, Mycobacterium
AVQSAGFRLAGVLHSAMVL

SEQ ID NO: 1064486 - protein, 17 aa, Mycobacterium
AVRLVVGPQPRTFVQAP

SEQ ID NO: 1064487 - protein, 17 aa, Mycobacterium
AVRRAVAATRNGRIGVI

SEQ ID NO: 1064488 - protein, 23 aa, Mycobacterium
AVSSFFAKNFLPLLTSTREVLEV

SEQ ID NO: 1064489 - protein, 23 aa, Mycobacterium
AVTDACEILLILKDNLAGYHREL

SEQ ID NO: 1064490 - protein, 25 aa, Mycobacterium
AVTLVTLYEQYVVRFGLDYREEIEP

SEQ ID NO: 1064491 - protein, 29 aa, Mycobacterium
AVTSRGIGFIPWSPLAAGPLAAPDGPLQR

SEQ ID NO: 1064492 - protein, 17 aa, Mycobacterium
AVTVWAKVLAVAANRRA

SEQ ID NO: 1064493 - protein, 20 aa, Mycobacterium
AVVRYIMARLQAQLATPVSG

SEQ ID NO: 1064494 - protein, 19 aa, Mycobacterium
AVVYGYFPAVSEDNDIVVL

SEQ ID NO: 1064495 - protein, 18 aa, Mycobacterium
AVYPLVIRAGGGSPRDTL

SEQ ID NO: 1064496 - protein, 17 aa, Mycobacterium
AVYPRAEFEQLARRASK

SEQ ID NO: 1064497 - protein, 17 aa, Mycobacterium
AWARRFLDGLPHALAAA

SEQ ID NO: 1064498 - protein, 19 aa, Mycobacterium
AWIQAWTGGWWNYDPTNDV

SEQ ID NO: 1064499 - protein, 23 aa, Mycobacterium
AWRNGDWYVARLNPSPLSHEDRR

SEQ ID NO: 1064500 - protein, 20 aa, Mycobacterium
AWWGNFLVQKANEANITLDE

SEQ ID NO: 1064501 - protein, 25 aa, Mycobacterium
AYAEGLRALYLYTATFQDAAVAEAV

SEQ ID NO: 1064502 - protein, 21 aa, Mycobacterium
AYDMWPWKQRLRQFARRSRTT

SEQ ID NO: 1064503 - protein, 23 aa, Mycobacterium
AYEGKIDWAFAELLALGSLVAEG

SEQ ID NO: 1064504 - protein, 17 aa, Mycobacterium
AYFVGGLSLRDATRAIC

SEQ ID NO: 1064505 - protein, 28 aa, Mycobacterium
AYKDVSLILIFGWFKQLVEAATALVRPV

SEQ ID NO: 1064506 - protein, 19 aa, Mycobacterium
AYPAAFLVGLLPTNPNDTG

SEQ ID NO: 1064507 - protein, 23 aa, Mycobacterium
AYQVEPFVYLMPEGQLPFTGAVI

SEQ ID NO: 1064508 - protein, 20 aa, Mycobacterium
AYRILAVKQHVLFGETSTSS

SEQ ID NO: 1064509 - protein, 17 aa, Mycobacterium
AYRLVREGHVVELQARP

SEQ ID NO: 1064510 - protein, 18 aa, Mycobacterium
AYTTVMTVLQRLAKKNLV

SEQ ID NO: 1064511 - protein, 17 aa, Mycobacterium
AYYLGIPGLLDADQMRA

SEQ ID NO: 1064512 - protein, 25 aa, Mycobacterium
CAASNIEFVVGLLAASRAGLIVVPL

SEQ ID NO: 1064513 - protein, 27 aa, Mycobacterium
CALDLQLAPIVPVRFRIALHTGEVQIS

SEQ ID NO: 1064514 - protein, 20 aa, Mycobacterium
CALFGLDCVIYMGALDTARQ

SEQ ID NO: 1064515 - protein, 17 aa, Mycobacterium
CAMVLLKRLPDALRDGN

SEQ ID NO: 1064516 - protein, 24 aa, Mycobacterium
CAPAAFRFMSQARHIGKVVLTMPS

SEQ ID NO: 1064517 - protein, 23 aa, Mycobacterium
CAWLVAMIVLERLSLGQWVAFVL

SEQ ID NO: 1064518 - protein, 17 aa, Mycobacterium
CDIVTITQYLRPSMRHH

SEQ ID NO: 1064519 - protein, 25 aa, Mycobacterium
CDKSKIPLLLLQNIPGFMIGWDCKA

SEQ ID NO: 1064520 - protein, 17 aa, Mycobacterium
CEAFEPIASHVYMTTAR

SEQ ID NO: 1064521 - protein, 17 aa, Mycobacterium
CELVGQLAPLSSVLGRL

SEQ ID NO: 1064522 - protein, 21 aa, Mycobacterium
CGAEPLFLQDYIAVGRTVPER

SEQ ID NO: 1064523 - protein, 26 aa, Mycobacterium
CGGKRPDRPGWFYPPTVITDITKDMA

SEQ ID NO: 1064524 - protein, 25 aa, Mycobacterium
CGKTYLAQTLAKMLNVPFAIADATA

SEQ ID NO: 1064525 - protein, 25 aa, Mycobacterium
CGSLRDNLWHLLGSKIAAVIVVDDR

SEQ ID NO: 1064526 - protein, 21 aa, Mycobacterium
CGTGFFLLNLIQSGVARRGSV

SEQ ID NO: 1064527 - protein, 17 aa, Mycobacterium
CHGLQCGFCTPGFVISL

SEQ ID NO: 1064528 - protein, 25 aa, Mycobacterium
CIAPRTRLCGIAWRGRFNSSSGFDE

SEQ ID NO: 1064529 - protein, 18 aa, Mycobacterium
CIAVQRWGELSPTRDNVV

SEQ ID NO: 1064530 - protein, 31 aa, Mycobacterium
CIEAQRALEYFATLWRHGGSPLLRSLIDAGT

SEQ ID NO: 1064531 - protein, 20 aa, Mycobacterium
CLAEPLVAENLLDGVPGALN

SEQ ID NO: 1064532 - protein, 27 aa, Mycobacterium
CLPTDRLLNLLIYIKGYLDGTLTFRRS

SEQ ID NO: 1064533 - protein, 22 aa, Mycobacterium
CLSGLGSLFIGNDGLRDGTGER

SEQ ID NO: 1064534 - protein, 23 aa, Mycobacterium
CMEENRVLIGRIVELLVTTGEGR

SEQ ID NO: 1064535 - protein, 17 aa, Mycobacterium
CNQWNRFAIASRIILDD

SEQ ID NO: 1064536 - protein, 22 aa, Mycobacterium
CPKKLLRPKVPILVLVGEPIEP

SEQ ID NO: 1064537 - protein, 24 aa, Mycobacterium
CPQNLDYLISFFGALYSGRIAVPL

SEQ ID NO: 1064538 - protein, 22 aa, Mycobacterium
CQIMPDVHRRWADAGYVENKTK

SEQ ID NO: 1064539 - protein, 23 aa, Mycobacterium
CRGDPMIQPPRPLEVTSILAGGV

SEQ ID NO: 1064540 - protein, 19 aa, Mycobacterium
CRKALRLTPQDIGLCSARM

SEQ ID NO: 1064541 - protein, 17 aa, Mycobacterium
CRLIGVFEQLRGQSQLI

SEQ ID NO: 1064542 - protein, 18 aa, Mycobacterium
CRRHGALLLVDEAHGLGV

SEQ ID NO: 1064543 - protein, 21 aa, Mycobacterium
CRRRGLIFSQLAASLTVTGTS

SEQ ID NO: 1064544 - protein, 29 aa, Mycobacterium
CSGRLRKLFNSVGVVFKGSGFYRTDSRES

SEQ ID NO: 1064545 - protein, 24 aa, Mycobacterium
CSKIEALLRVLEPFGVREIVQSGV

SEQ ID NO: 1064546 - protein, 29 aa, Mycobacterium
CSSSVSLYRLRWLSPWPAAFGFHEFFFFH

SEQ ID NO: 1064547 - protein, 21 aa, Mycobacterium
CSWNYLVRSYVLGAARSAPPP

SEQ ID NO: 1064548 - protein, 23 aa, Mycobacterium
CTPTVREVLWARMRITPREKHSP

SEQ ID NO: 1064549 - protein, 17 aa, Mycobacterium
CTVYPLKETYDGADINF

SEQ ID NO: 1064550 - protein, 27 aa, Mycobacterium
CVAARIPAVMFWAAVPHYVSHPPNPKA

SEQ ID NO: 1064551 - protein, 18 aa, Mycobacterium
CVASRILGQYDPFAASKS

SEQ ID NO: 1064552 - protein, 17 aa, Mycobacterium
CVFQDFRLLQQKTVYEN

SEQ ID NO: 1064553 - protein, 24 aa, Mycobacterium
CVQQAIRRRAFTGALRIAGSPDTS

SEQ ID NO: 1064554 - protein, 26 aa, Mycobacterium
CVVDGRTVLPLLPAQDFKRVGEGDTG

SEQ ID NO: 1064555 - protein, 18 aa, Mycobacterium
CVVVAYGALLGSPLLAVP

SEQ ID NO: 1064556 - protein, 22 aa, Mycobacterium
CVWAEKRFAAFDNPVIALEVYA

SEQ ID NO: 1064557 - protein, 20 aa, Mycobacterium
CWRTFLTCDANLAVTLPSGL

SEQ ID NO: 1064558 - protein, 18 aa, Mycobacterium
CYLGSWPAGLATGPTVSP

SEQ ID NO: 1064559 - protein, 35 aa, Mycobacterium
DAAAELGYKGLLAPLTFICLFGYKAQSAFFKHANI

SEQ ID NO: 1064560 - protein, 26 aa, Mycobacterium
DAASALMLAKLRHGLPGAVFISARTG

SEQ ID NO: 1064561 - protein, 20 aa, Mycobacterium
DACVKLLETLSGLAVADSGT

SEQ ID NO: 1064562 - protein, 17 aa, Mycobacterium
DADPLFERGGITYWDSW

SEQ ID NO: 1064563 - protein, 19 aa, Mycobacterium
DAEFPKFRQLLPAEHTAVA

SEQ ID NO: 1064564 - protein, 19 aa, Mycobacterium
DAEGLLPAITFVFSRFGCD

SEQ ID NO: 1064565 - protein, 32 aa, Mycobacterium
DAEGLSHEVGYGRLIAGLDDALVGLSAGESRV

SEQ ID NO: 1064566 - protein, 23 aa, Mycobacterium
DAEVWDRLTGNFWLPEKVPVSND

SEQ ID NO: 1064567 - protein, 18 aa, Mycobacterium
DAEYRLDIDAALELDRSI

SEQ ID NO: 1064568 - protein, 17 aa, Mycobacterium
DAFDADFFSAWGKLAAV

SEQ ID NO: 1064569 - protein, 31 aa, Mycobacterium
DAGAMAYLVKPFTISDLIPAIALAMSRFSEL

SEQ ID NO: 1064570 - protein, 29 aa, Mycobacterium
DAGHCPAYFLLLIKTLLQPGLRELADITV

SEQ ID NO: 1064571 - protein, 22 aa, Mycobacterium
DAGRPFGFRPEAILPAYGMAET

SEQ ID NO: 1064572 - protein, 22 aa, Mycobacterium
DAGTAPLSVLLTAGLDGLNIGV

SEQ ID NO: 1064573 - protein, 17 aa, Mycobacterium
DAGWQLFVDDVIASLEV

SEQ ID NO: 1064574 - protein, 20 aa, Mycobacterium
DAIMFEPRYAVRKPDGGWGE

SEQ ID NO: 1064575 - protein, 39 aa, Mycobacterium
DAKAFARLGIRCFGFTPLRLPPELDFTALFHGVDERVSI

SEQ ID NO: 1064576 - protein, 19 aa, Mycobacterium
DAKLIIASAYLPQHDNARA

SEQ ID NO: 1064577 - protein, 17 aa, Mycobacterium
DALGRWLFTCNTEVAVG

SEQ ID NO: 1064578 - protein, 27 aa, Mycobacterium
DALPHPRWWIDLLTTEPLAFASLDRWS

SEQ ID NO: 1064579 - protein, 30 aa, Mycobacterium
DALRVGVLPTPAVAYLTGAYDADFGVMISA

SEQ ID NO: 1064580 - protein, 18 aa, Mycobacterium
DAMCRKALRLTPQDIGLC

SEQ ID NO: 1064581 - protein, 31 aa, Mycobacterium
DAPKRLGNFMNSRLGRLLLTPGRGIGRLVTG

SEQ ID NO: 1064582 - protein, 23 aa, Mycobacterium
DAPRLVLLGSPMHGVILASSTGE

SEQ ID NO: 1064583 - protein, 24 aa, Mycobacterium
DARPQLTPGWKYNEWELRGVPIRL

SEQ ID NO: 1064584 - protein, 36 aa, Mycobacterium
DASEGPLPQTRFVLRKTLAAHLPVILVVNKTDRPDA

SEQ ID NO: 1064585 - protein, 23 aa, Mycobacterium
DASLRLLVRGGRFLEMGKTDIRD

SEQ ID NO: 1064586 - protein, 17 aa, Mycobacterium
DASLTLAAYPHFFELKR

SEQ ID NO: 1064587 - protein, 21 aa, Mycobacterium
DATNLQRVLARRSVIIQTGTV

SEQ ID NO: 1064588 - protein, 17 aa, Mycobacterium
DATNPRSLVYQLDRLRV

SEQ ID NO: 1064589 - protein, 25 aa, Mycobacterium
DATQGTRLVPIPGAPPSLAGLQQEC

SEQ ID NO: 1064590 - protein, 29 aa, Mycobacterium
DATTLFEALLPRYLTIRVYAAMLESAASE

SEQ ID NO: 1064591 - protein, 23 aa, Mycobacterium
DAVQVRLRLAGRLIDRIDGDLVL

SEQ ID NO: 1064592 - protein, 17 aa, Mycobacterium
DAVRLRGLMSHLVYADQ

SEQ ID NO: 1064593 - protein, 21 aa, Mycobacterium
DAVRVFLTPESARQFATRSNR

SEQ ID NO: 1064594 - protein, 21 aa, Mycobacterium
DAVSFTLLQDQLQSVLETLSE

SEQ ID NO: 1064595 - protein, 25 aa, Mycobacterium
DAVTEMAVTLWLTATRHLLNHICEY

SEQ ID NO: 1064596 - protein, 29 aa, Mycobacterium
DAVWRVRAYGDFLSYCLLAEGAIDVAAEP

SEQ ID NO: 1064597 - protein, 18 aa, Mycobacterium
DAWMTRLVLGFGSAVQVQ

SEQ ID NO: 1064598 - protein, 23 aa, Mycobacterium
DCDFMLVKLTYWGRDFPTTVGRA

SEQ ID NO: 1064599 - protein, 25 aa, Mycobacterium
DCFALVPLEVCTEALVRVVRKFRPH

SEQ ID NO: 1064600 - protein, 17 aa, Mycobacterium
DCFLMEIGNDNQDQLIN

SEQ ID NO: 1064601 - protein, 25 aa, Mycobacterium
DCFNIPIVMLVDVPGFLPGTEQEYD

SEQ ID NO: 1064602 - protein, 17 aa, Mycobacterium
DCPPVEIATTVLVSFPD

SEQ ID NO: 1064603 - protein, 25 aa, Mycobacterium
DCTGYIVQLPLPKYLDENTALERVD

SEQ ID NO: 1064604 - protein, 18 aa, Mycobacterium
DCVVTLGGCWLVTTVRQF

SEQ ID NO: 1064605 - protein, 23 aa, Mycobacterium
DDDQFLTIAKIRAVRQLWARIAE

SEQ ID NO: 1064606 - protein, 25 aa, Mycobacterium
DDEQLVLDLLLQEKILVTQGSGFNW

SEQ ID NO: 1064607 - protein, 18 aa, Mycobacterium
DDGRLLARIYSESDLLVA

SEQ ID NO: 1064608 - protein, 18 aa, Mycobacterium
DDISIRLRRLDPADFDVV

SEQ ID NO: 1064609 - protein, 22 aa, Mycobacterium
DDLIDRCWAPKVYGAWNLHQAL

SEQ ID NO: 1064610 - protein, 21 aa, Mycobacterium
DDLLDALSLWTPMQSVAAYDA

SEQ ID NO: 1064611 - protein, 18 aa, Mycobacterium
DDMAWMRQLLDWQREAAE

SEQ ID NO: 1064612 - protein, 17 aa, Mycobacterium
DDMLRRAFAADMAFLRN

SEQ ID NO: 1064613 - protein, 28 aa, Mycobacterium
DDPEFHPPRLGDLKRSCLDIGLATTVLG

SEQ ID NO: 1064614 - protein, 25 aa, Mycobacterium
DDPEPFLRTNVIGTFTILEAVRHHS

SEQ ID NO: 1064615 - protein, 24 aa, Mycobacterium
DDQLAYVIVFQIVENCGAVRRVRT

SEQ ID NO: 1064616 - protein, 24 aa, Mycobacterium
DDRVRRHAVLTERVAGLAQQRFAA

SEQ ID NO: 1064617 - protein, 27 aa, Mycobacterium
DDTHLAWDLITYWRALLTSAVNLPPHE

SEQ ID NO: 1064618 - protein, 29 aa, Mycobacterium
DDVAVADWIAMFNMWPIKSTPGLRCQTDV

SEQ ID NO: 1064619 - protein, 32 aa, Mycobacterium
DDVLVHGLPLFHVHGLVLGLLGSLRIGNRFVH

SEQ ID NO: 1064620 - protein, 23 aa, Mycobacterium
DDYLAILDIRPFTRGHTLVLPKQ

SEQ ID NO: 1064621 - protein, 26 aa, Mycobacterium
DDYLVKPFVLAELVARVKALLRRRGA

SEQ ID NO: 1064622 - protein, 25 aa, Mycobacterium
DEAAELMINLFWHGLKGAPADRDFG

SEQ ID NO: 1064623 - protein, 28 aa, Mycobacterium
DEADEMLDLGFFPDIERLLGQIPTDRQS

SEQ ID NO: 1064624 - protein, 31 aa, Mycobacterium
DEAIGFINARPKPLAAYLFTKSRKTRDRVIK

SEQ ID NO: 1064625 - protein, 35 aa, Mycobacterium
DEALGIDVFFEALKAPLYWIATNAGLDGAVVVDKV

SEQ ID NO: 1064626 - protein, 30 aa, Mycobacterium
DEDLVGAYLLVWTTTPWTLPSNLAVAVHPD

SEQ ID NO: 1064627 - protein, 23 aa, Mycobacterium
DEGADIIMIKPASGYLDVVATAA

SEQ ID NO: 1064628 - protein, 18 aa, Mycobacterium
DEIHLLRHNTRQPRTRVD

SEQ ID NO: 1064629 - protein, 26 aa, Mycobacterium
DEIPLPLQWGEYRPGGLTSGPWGLLE

SEQ ID NO: 1064630 - protein, 18 aa, Mycobacterium
DELCFPGLAAEWAEYGDR

SEQ ID NO: 1064631 - protein, 25 aa, Mycobacterium
DELIDYLTMLSWNALCGIVEVGGSL

SEQ ID NO: 1064632 - protein, 20 aa, Mycobacterium
DELIISHLQGWKLDRLPAVD

SEQ ID NO: 1064633 - protein, 18 aa, Mycobacterium
DELNFLQFAVIDALLVLQ

SEQ ID NO: 1064634 - protein, 33 aa, Mycobacterium
DEPEWMLQARLKALRVFERKPMPRWGSNLDGID

SEQ ID NO: 1064635 - protein, 22 aa, Mycobacterium
DEQGNYIFPEGFDPDSNEWLEG

SEQ ID NO: 1064636 - protein, 24 aa, Mycobacterium
DEVVDVVLLWWRDGDGDLVDTLMD

SEQ ID NO: 1064637 - protein, 21 aa, Mycobacterium
DEWLRRFEISLRALPERQRHS

SEQ ID NO: 1064638 - protein, 17 aa, Mycobacterium
DFDDYGYLFWFYTAICG

SEQ ID NO: 1064639 - protein, 26 aa, Mycobacterium
DFLAVELSSFQLHWAPSLRPEAGVVL

SEQ ID NO: 1064640 - protein, 19 aa, Mycobacterium
DFNQLWVCGLPGYGPGDLI

SEQ ID NO: 1064641 - protein, 20 aa, Mycobacterium
DFRSLARIPADNSLVLVLRL

SEQ ID NO: 1064642 - protein, 22 aa, Mycobacterium
DFTHVWWLFTDAACTATGYSRC

SEQ ID NO: 1064643 - protein, 27 aa, Mycobacterium
DFVGSVLAVLRRLQGHFTLVFANADEP

SEQ ID NO: 1064644 - protein, 22 aa, Mycobacterium
DFVLRAPVKLAEGIQVVVCGKP

SEQ ID NO: 1064645 - protein, 23 aa, Mycobacterium
DFVRWCRQVLDLLDQLRNAAPEP

SEQ ID NO: 1064646 - protein, 34 aa, Mycobacterium
DFYGSVDAYIRVFDSFVERFALGGALVVCNDDPG

SEQ ID NO: 1064647 - protein, 26 aa, Mycobacterium
DGDPLDALVLLPEPLFPGVLVEARPV

SEQ ID NO: 1064648 - protein, 24 aa, Mycobacterium
DGGMHSLWTDILARQVFAPQVPRD

SEQ ID NO: 1064649 - protein, 32 aa, Mycobacterium; identical to SEQ ID NO: 216905

SEQ ID NO: 1064650 - protein, 28 aa, Mycobacterium
DGGSGLLKLLSRLDIMPLPNTAGCRSAA

SEQ ID NO: 1064651 - protein, 19 aa, Mycobacterium
DGIKRPLIVFTPKSMLRNK

SEQ ID NO: 1064652 - protein, 24 aa, Mycobacterium
DGLGGWFIDAVYGDPSTVVGIGLP

SEQ ID NO: 1064653 - protein, 19 aa, Mycobacterium
DGLHRALSKLFSILRRRTP

SEQ ID NO: 1064654 - protein, 25 aa, Mycobacterium
DGLIDRLPRMLGTQAAGAAPLVLGE

SEQ ID NO: 1064655 - protein, 23 aa, Mycobacterium
DGLPNVNFLAELQERIPPANAER

SEQ ID NO: 1064656 - protein, 22 aa, Mycobacterium
DGLPRLYLSRYASAGRSRLMPP

SEQ ID NO: 1064657 - protein, 23 aa, Mycobacterium
DGLTMLAAHPDLVINRNAPTVLT

SEQ ID NO: 1064658 - protein, 19 aa, Mycobacterium
DGLVFRPFGTKKNNWWVLC

SEQ ID NO: 1064659 - protein, 20 aa, Mycobacterium
DGNQIMALLDIPAGPQVGEA

SEQ ID NO: 1064660 - protein, 31 aa, Mycobacterium
DGNRPRDLLLDAYLLRAMGIAGWAPALTACA

SEQ ID NO: 1064661 - protein, 23 aa, Mycobacterium
DGPELRSRLPERANVTLAGMNFT

SEQ ID NO: 1064662 - protein, 17 aa, Mycobacterium
DGPLVLRNRALLELLYS

SEQ ID NO: 1064663 - protein, 25 aa, Mycobacterium
DGRRLEVSLPADLALANPAGCNPAG

SEQ ID NO: 1064664 - protein, 23 aa, Mycobacterium
DGRVRARREITVKIPSGVGDGMR

SEQ ID NO: 1064665 - protein, 30 aa, Mycobacterium
DGSQPLCSRLPRLPFSAIRRMDSPRTTVEL

SEQ ID NO: 1064666 - protein, 24 aa, Mycobacterium
DGTILALHHPPIPSVLDMAVTVEL

SEQ ID NO: 1064667 - protein, 25 aa, Mycobacterium
DGTMTHAWLITGPPGSGRSVAAVCF

SEQ ID NO: 1064668 - protein, 32 aa, Mycobacterium
DGTWIPVSIVHRAAIRFPAPAVLYGYGAYEIC

SEQ ID NO: 1064669 - protein, 25 aa, Mycobacterium
DGVTRELVWPAMRISYCRPPGSDRN

SEQ ID NO: 1064670 - protein, 19 aa, Mycobacterium
DGYVHDMLGFRDAGGADND

SEQ ID NO: 1064671 - protein, 26 aa, Mycobacterium
DHCLDMPGLFVWRRYHPTRPVGKALL

SEQ ID NO: 1064672 - protein, 21 aa, Mycobacterium
DHHADVFSGGPERLLLLAVVV

SEQ ID NO: 1064673 - protein, 24 aa, Mycobacterium
DHPGRYFIVRAGSLVAWSAGQGVK

SEQ ID NO: 1064674 - protein, 21 aa, Mycobacterium
DHRGLITGGSLPRWVLPYVSY

SEQ ID NO: 1064675 - protein, 22 aa, Mycobacterium
DHSGILVLPPGTALPGADGADV

SEQ ID NO: 1064676 - protein, 24 aa, Mycobacterium
DHSGPLVTELLTEAGFVVDGVVAV

SEQ ID NO: 1064677 - protein, 17 aa, Mycobacterium
DHTFDFYAMLAAITSRT

SEQ ID NO: 1064678 - protein, 26 aa, Mycobacterium
DHVFNRLDIPSWLARAGFQMLDPLKT

SEQ ID NO: 1064679 - protein, 21 aa, Mycobacterium
DHVIRLWHLPAANCRTRDLPL

SEQ ID NO: 1064680 - protein, 17 aa, Mycobacterium
DHWWYRNGRFGVGSSRG

SEQ ID NO: 1064681 - protein, 29 aa, Mycobacterium
DHYHDWDMLRANLLQLLIDGTVRPHEPAY

SEQ ID NO: 1064682 - protein, 26 aa, Mycobacterium
DIAEEYYLSFLLDRANRTYLAMCSVE

SEQ ID NO: 1064683 - protein, 18 aa, Mycobacterium
DIALDFPGSWFRRGSTDN

SEQ ID NO: 1064684 - protein, 23 aa, Mycobacterium
DIEQWYVSRFLAMRGTAFADPES

SEQ ID NO: 1064685 - protein, 26 aa, Mycobacterium
DIERDLRVIVHGWLAFTFEVCRQRIM

SEQ ID NO: 1064686 - protein, 22 aa, Mycobacterium
DIHLAIPIIRAFSHFALLANVA

SEQ ID NO: 1064687 - protein, 22 aa, Mycobacterium
DIHPQLRMQIAMLTVEEATAEV

SEQ ID NO: 1064688 - protein, 17 aa, Mycobacterium
DIIRRHYFAGDPRAFAI

SEQ ID NO: 1064689 - protein, 17 aa, Mycobacterium
DIKRAYRKLARELHPDI

SEQ ID NO: 1064690 - protein, 19 aa, Mycobacterium
DILAFERQWWKFAGVKEEA

SEQ ID NO: 1064691 - protein, 18 aa, Mycobacterium
DILTRLTAPVIRGLGVGI

SEQ ID NO: 1064692 - protein, 19 aa, Mycobacterium
DILVDRMRREFKVEANVGK

SEQ ID NO: 1064693 - protein, 18 aa, Mycobacterium
DIPPTRFKRKEHWLDVHF

SEQ ID NO: 1064694 - protein, 24 aa, Mycobacterium
DIRESIHLRALGRQSPLDEFHRLA

SEQ ID NO: 1064695 - protein, 19 aa, Mycobacterium
DISAGFDLAKLPDAVGRLG

SEQ ID NO: 1064696 - protein, 28 aa, Mycobacterium
DITVNVDGFWLLQALLDIRHVAPELRCR

SEQ ID NO: 1064697 - protein, 22 aa, Mycobacterium
DIVCLRRRLVAKLALRRRDEST

SEQ ID NO: 1064698 - protein, 23 aa, Mycobacterium
DIVGLAGRWLRPGGLFAVEHDDS

SEQ ID NO: 1064699 - protein, 20 aa, Mycobacterium
DIVMDVRFLPNPHWVDELRS

SEQ ID NO: 1064700 - protein, 19 aa, Mycobacterium
DKALLARIGDAFLAVPEGF

SEQ ID NO: 1064701 - protein, 23 aa, Mycobacterium
DKARPVLMLIPELFRPHLSRVTV

SEQ ID NO: 1064702 - protein, 25 aa, Mycobacterium
DKGLLSPVIHYAGDLSLAGLARAIV

SEQ ID NO: 1064703 - protein, 27 aa, Mycobacterium
DKGLRRWRAVARAAARQSRRAHIPSVD

SEQ ID NO: 1064704 - protein, 26 aa, Mycobacterium
DKGRILTAMSVFFFSFVDAPNHLAGP

SEQ ID NO: 1064705 - protein, 27 aa, Mycobacterium
DKGRLTLPAKFRDALVGGLMVTKSQDH

SEQ ID NO: 1064706 - protein, 42 aa, Mycobacterium
DKGYKCSIRKPWWSTPSLWIPDLFMLRQIHLAPRLTVNAAAA

SEQ ID NO: 1064707 - protein, 31 aa, Mycobacterium
DKLLTELGWVLRRTPVLPTGQHWRLLSTVKE

SEQ ID NO: 1064708 - protein, 19 aa, Mycobacterium
DKPSLIRLAGIDDALAGGA

SEQ ID NO: 1064709 - protein, 24 aa, Mycobacterium
DKRFIGVEALLRWAHPTLGTLLPA

SEQ ID NO: 1064710 - protein, 23 aa, Mycobacterium
DKTNWLVRHPPLHRLTLSTHDMA

SEQ ID NO: 1064711 - protein, 25 aa, Mycobacterium
DKWTLSQIRLWGVVGFCVSGDPVAL

SEQ ID NO: 1064712 - protein, 27 aa, Mycobacterium
DLADVIKRIGVPGIWYSGSHGFESTAP

SEQ ID NO: 1064713 - protein, 17 aa, Mycobacterium
DLALMPVTSIPVSGPVG

SEQ ID NO: 1064714 - protein, 20 aa, Mycobacterium
DLAPLEPFAKQFVDLDLTVV

SEQ ID NO: 1064715 - protein, 26 aa, Mycobacterium
DLAYRVAVGLYRYSLLDIIDIADITE

SEQ ID NO: 1064716 - protein, 34 aa, Mycobacterium
DLDDVLRRAVRLLAQLTCQVAVVQYPTLSTSTVR

SEQ ID NO: 1064717 - protein, 27 aa, Mycobacterium
DLDIENYWFRRHQVVYQWLAQRCTGCE

SEQ ID NO: 1064718 - protein, 22 aa, Mycobacterium
DLDSLEFVAFDRVPPGPGEIEV

SEQ ID NO: 1064719 - protein, 17 aa, Mycobacterium
DLFLLCALVAEIEGPTL

SEQ ID NO: 1064720 - protein, 19 aa, Mycobacterium
DLFTLTEKALLRTELFRNK

SEQ ID NO: 1064721 - protein, 21 aa, Mycobacterium
DLGLPVVVRPSFTMGGLGSGM

SEQ ID NO: 1064722 - protein, 24 aa, Mycobacterium
DLGPVALALLKRGLPTDTELTIEL

SEQ ID NO: 1064723 - protein, 21 aa, Mycobacterium
DLIDRALPDRGLRGHLGDLPT

SEQ ID NO: 1064724 - protein, 27 aa, Mycobacterium
DLINPHPMFVPWLVGPLLTGDGIHLVK

SEQ ID NO: 1064725 - protein, 17 aa, Mycobacterium
DLKPGMTLLDIGCGWGT

SEQ ID NO: 1064726 - protein, 21 aa, Mycobacterium
DLLAALRRAVPATKGNIRRLV

SEQ ID NO: 1064727 - protein, 21 aa, Mycobacterium
DLLCLTFNGLSKAYRVAGYRS

SEQ ID NO: 1064728 - protein, 20 aa, Mycobacterium
DLLKGVRYYAGGCTTQSIVM

SEQ ID NO: 1064729 - protein, 20 aa, Mycobacterium
DLLLERWRVLFEPIMLQSNV

SEQ ID NO: 1064730 - protein, 20 aa, Mycobacterium
DLLPEAFAVAREAAWRVLDQ

SEQ ID NO: 1064731 - protein, 20 aa, Mycobacterium
DLLRAWRLINATTRYPIDAE

SEQ ID NO: 1064732 - protein, 20 aa, Mycobacterium
DLLTQLAIPIPTAAILPMVT

SEQ ID NO: 1064733 - protein, 35 aa, Mycobacterium
DLLVAGWRVVALQPYGGAWLNSWLDRDLGVSGRLS

SEQ ID NO: 1064734 - protein, 17 aa, Mycobacterium
DLLVARRRPAAGDGWRK

SEQ ID NO: 1064735 - protein, 24 aa, Mycobacterium
DLPEFNLKTALKFTRDRKCIVVNT

SEQ ID NO: 1064736 - protein, 22 aa, Mycobacterium
DLPRDSLIVFTGLSGSGKSSLA

SEQ ID NO: 1064737 - protein, 18 aa, Mycobacterium
DLPSLLTALTRPAQDSNR

SEQ ID NO: 1064738 - protein, 19 aa, Mycobacterium
DLQPYRLLRGGDSEYWFDG

SEQ ID NO: 1064739 - protein, 38 aa, Mycobacterium
DLRAEIAAPMYLTLTTWSRATIGLAYASALINAGRYDE

SEQ ID NO: 1064740 - protein, 21 aa, Mycobacterium
DLRAQGMNLVIRYVDQPGALG

SEQ ID NO: 1064741 - protein, 18 aa, Mycobacterium
DLRMRLGEGTGATAALLV

SEQ ID NO: 1064742 - protein, 24 aa, Mycobacterium
DLSDDFFRLFLDPTLTYSCAYFER

SEQ ID NO: 1064743 - protein, 22 aa, Mycobacterium
DLSFISLATVLSALAGCALPSA

SEQ ID NO: 1064744 - protein, 26 aa, Mycobacterium
DLSMALLGTGFAYSVVRRAAQAALLA

SEQ ID NO: 1064745 - protein, 31 aa, Mycobacterium
DLSPDAWWQQLTWLPQRPVLIPGTVGDNLVL

SEQ ID NO: 1064746 - protein, 23 aa, Mycobacterium
DLSVRDMTVCILDRPRHAQLIDD

SEQ ID NO: 1064747 - protein, 26 aa, Mycobacterium
DLVADRGCLLNLRPPAYLDDFLSLQR

SEQ ID NO: 1064748 - protein, 17 aa, Mycobacterium
DLVARVIAGMGPVADLA

SEQ ID NO: 1064749 - protein, 25 aa, Mycobacterium
DLVDRHLPAFLRFAGREFIGVQGTQ

SEQ ID NO: 1064750 - protein, 21 aa, Mycobacterium
DLVFSGRFFDAAEALALGLID

SEQ ID NO: 1064751 - protein, 25 aa, Mycobacterium
DLVLPARWWFWPMDVITLVWSVQSQ

SEQ ID NO: 1064752 - protein, 20 aa, Mycobacterium
DLVLQQFKIANGEKLELIKD

SEQ ID NO: 1064753 - protein, 17 aa, Mycobacterium
DMLAPWEVLDTVSRLVI

SEQ ID NO: 1064754 - protein, 26 aa, Mycobacterium
DMPGMGSLLLPPWTLTRSGPDSVEMT

SEQ ID NO: 1064755 - protein, 25 aa, Mycobacterium
DMTRTFVLGPAADWQLEIYQLVADA

SEQ ID NO: 1064756 - protein, 24 aa, Mycobacterium
DMVVLGLPRGGVPVAFEVAKALRA

SEQ ID NO: 1064757 - protein, 32 aa, Mycobacterium
DNGGVYFVPAFSGLFSPYWRSDARGAIVGLSR

SEQ ID NO: 1064758 - protein, 27 aa, Mycobacterium
DNPHKVAMLGLTFDDVLLLPAASDVVP

SEQ ID NO: 1064759 - protein, 21 aa, Mycobacterium
DNQLLLVLTPESVVQRYGDDK

SEQ ID NO: 1064760 - protein, 18 aa, Mycobacterium
DNRAALIGYLPTGYPDVP

SEQ ID NO: 1064761 - protein, 26 aa, Mycobacterium
DNRGSQFYLAMYWAQELATQTDDQHL

SEQ ID NO: 1064762 - protein, 21 aa, Mycobacterium
DNRRSLLCGNIGRPVLDVLTE

SEQ ID NO: 1064763 - protein, 24 aa, Mycobacterium
DNRSYGHPIVLRPVSSEDAMTADW

SEQ ID NO: 1064764 - protein, 22 aa, Mycobacterium
DNTVLLSDNAKLLVSRRPIPGC

SEQ ID NO: 1064765 - protein, 28 aa, Mycobacterium
DNVDVLMSIYLYTASLMHCMTVSLALQG

SEQ ID NO: 1064766 - protein, 20 aa, Mycobacterium
DNVRVWQPSAFASPTPSAQK

SEQ ID NO: 1064767 - protein, 31 aa, Mycobacterium
DPAGFTETLTWWQVYRRSMSVAYELRIYASD

SEQ ID NO: 1064768 - protein, 25 aa, Mycobacterium
DPAKNQLAVLLYAAWRSTYRWRPGV

SEQ ID NO: 1064769 - protein, 25 aa, Mycobacterium
DPATNYDVMFVPQGIGADLIATIEG

SEQ ID NO: 1064770 - protein, 25 aa, Mycobacterium
DPDDTSVRFLLTAGAIGSLYKELAS

SEQ ID NO: 1064771 - protein, 24 aa, Mycobacterium
DPDFNRPLRPLARVAHLDFVEPAT

SEQ ID NO: 1064772 - protein, 18 aa, Mycobacterium
DPDGILNVALRDLAEDLG

SEQ ID NO: 1064773 - protein, 28 aa, Mycobacterium
DPDWARDYGWPQFADRILELARAAVSGS

SEQ ID NO: 1064774 - protein, 17 aa, Mycobacterium
DPFTLRNLVIKAATFEA

SEQ ID NO: 1064775 - protein, 23 aa, Mycobacterium
DPGLINRDLAFSDLGFDSQMTVT

SEQ ID NO: 1064776 - protein, 18 aa, Mycobacterium
DPGSVAYLFSRKGVVTLE

SEQ ID NO: 1064777 - protein, 18 aa, Mycobacterium
DPGVMWQFAQAVRGLADG

SEQ ID NO: 1064778 - protein, 25 aa, Mycobacterium
DPHPELLRAWDLPTTADGLAAFCDI

SEQ ID NO: 1064779 - protein, 29 aa, Mycobacterium
DPMDCAELLDWPAKLRLLEGFRQRENLNW

SEQ ID NO: 1064780 - protein, 18 aa, Mycobacterium
DPMLVKRLRRLRASRQKA

SEQ ID NO: 1064781 - protein, 18 aa, Mycobacterium
DPNAVDLPAWYRPNSGLA

SEQ ID NO: 1064782 - protein, 31 aa, Mycobacterium
DPQVRQLILLYAPSVLGWAAFRDVAQHYSLG

SEQ ID NO: 1064783 - protein, 21 aa, Mycobacterium
DPRDGFLLEMIYRVYHTDNRC

SEQ ID NO: 1064784 - protein, 23 aa, Mycobacterium
DPRFRFFGNVIVGKHIEPAELAE

SEQ ID NO: 1064785 - protein, 20 aa, Mycobacterium
DPRFTVAAIPPRNDPRDAVV

SEQ ID NO: 1064786 - protein, 17 aa, Mycobacterium
DPRLPVFELIAEPLHAN

SEQ ID NO: 1064787 - protein, 17 aa, Mycobacterium
DPRLVHVIWNAMYSIRP

SEQ ID NO: 1064788 - protein, 30 aa, Mycobacterium
DPSPPAPPPAIPGVLPPASLPPIQSVTAVP

SEQ ID NO: 1064789 - protein, 20 aa, Mycobacterium
DPTIKGMWTVPVFGNPTGVT

SEQ ID NO: 1064790 - protein, 21 aa, Mycobacterium
DPVAIAIIHSPGRPIDAFVVR

SEQ ID NO: 1064791 - protein, 25 aa, Mycobacterium
DPVMIDATRALFPRCKHQSGEGNDG

SEQ ID NO: 1064792 - protein, 24 aa, Mycobacterium
DQEEHKWLTRALQIRTRVVADVAR

SEQ ID NO: 1064793 - protein, 20 aa, Mycobacterium
DQGLSLTLFFKDTATTRDVN

SEQ ID NO: 1064794 - protein, 27 aa, Mycobacterium
DQIGKGDVLVLLESMKMEIPVLAGVAG

SEQ ID NO: 1064795 - protein, 19 aa, Mycobacterium
DQNAVVGSLFSVIRQLGAP

SEQ ID NO: 1064796 - protein, 19 aa, Mycobacterium
DQPYWGRPVPGWGSEQPRL

SEQ ID NO: 1064797 - protein, 20 aa, Mycobacterium
DQQEFRLVRSSQRKPLEIVD

SEQ ID NO: 1064798 - protein, 24 aa, Mycobacterium
DQRAATMRYWPIAVSYGSVTGASE

SEQ ID NO: 1064799 - protein, 27 aa, Mycobacterium
DQSEKASWFGKTFKSAACILSLVCVDA

SEQ ID NO: 1064800 - protein, 17 aa, Mycobacterium
DQSPLIATAFHLLTGTT

SEQ ID NO: 1064801 - protein, 22 aa, Mycobacterium
DQSRLFVQSLKDAAGDYMDSDH

SEQ ID NO: 1064802 - protein, 18 aa, Mycobacterium
DQSTWYRGAPRISDLVEQ

SEQ ID NO: 1064803 - protein, 25 aa, Mycobacterium
DQVATLFRMWLRDAVRRVAAGALEV

SEQ ID NO: 1064804 - protein, 23 aa, Mycobacterium
DQVRYFLLREIPFGQDGNYSEEA

SEQ ID NO: 1064805 - protein, 21 aa, Mycobacterium
DQVVCRWLTRWADVTVHPVDQ

SEQ ID NO: 1064806 - protein, 21 aa, Mycobacterium
DRAILRVSIWELLYADDVPEP

SEQ ID NO: 1064807 - protein, 25 aa, Mycobacterium
DRATGLPWMTDLIDEFALRPPSPEQ

SEQ ID NO: 1064808 - protein, 25 aa, Mycobacterium
DRATLRISSQLLANWLRHGVITSED

SEQ ID NO: 1064809 - protein, 24 aa, Mycobacterium
DRAYKPLNWMSPPCWLTEDVAGAS

SEQ ID NO: 1064810 - protein, 28 aa, Mycobacterium
DRDGSDAMRWFLMASPILRGGNLIITEP

SEQ ID NO: 1064811 - protein, 31 aa, Mycobacterium
DRDRNVYIAWAGPLLAWWAQRFGVTADLVEA

SEQ ID NO: 1064812 - protein, 30 aa, Mycobacterium
DREGEAIAWHLMQTLKPRVPVKRMVFHEIT

SEQ ID NO: 1064813 - protein, 18 aa, Mycobacterium
DREILGIAEAIRASGLSA

SEQ ID NO: 1064814 - protein, 29 aa, Mycobacterium
DRFVSLQCRLLLSIAQLWQGDMDGAIVRS

SEQ ID NO: 1064815 - protein, 29 aa, Mycobacterium
DRGFFDDLVTPFLGLYRDDNLRPNSHVEK

SEQ ID NO: 1064816 - protein, 22 aa, Mycobacterium
DRGNISALRRDQVPMLGGRTHG

SEQ ID NO: 1064817 - protein, 21 aa, Mycobacterium
DRHFWLVKGGEWLASCHYGAM

SEQ ID NO: 1064818 - protein, 19 aa, Mycobacterium
DRHVGVLCASIRKPRRRSG

SEQ ID NO: 1064819 - protein, 18 aa, Mycobacterium
DRITTVGGMALPISCYIS

SEQ ID NO: 1064820 - protein, 23 aa, Mycobacterium
DRIVNWLVDKFKGTSGIDLTKDK

SEQ ID NO: 1064821 - protein, 18 aa, Mycobacterium
DRIVRRPGARWATDLLSA

SEQ ID NO: 1064822 - protein, 19 aa, Mycobacterium
DRLAVRRRWVAAELAMAVG

SEQ ID NO: 1064823 - protein, 30 aa, Mycobacterium
DRLGGPGSWLLALPPYHIGGLQVLVRSVLA

SEQ ID NO: 1064824 - protein, 20 aa, Mycobacterium
DRMAFCSAVYWDIVAKLDAS

SEQ ID NO: 1064825 - protein, 24 aa, Mycobacterium
DRMGKLLLELTFDSPRRLEMLHGD

SEQ ID NO: 1064826 - protein, 18 aa, Mycobacterium
DRPARTVALIGDLAFVHD

SEQ ID NO: 1064827 - protein, 27 aa, Mycobacterium
DRPGTITPFALLQLADRGQFFVSPGQD

SEQ ID NO: 1064828 - protein, 26 aa, Mycobacterium
DRPVPQLLAMGLLRRIDADTVILPRR

SEQ ID NO: 1064829 - protein, 23 aa, Mycobacterium
DRQVRGLLLDVLRAKDSPVTGTE

SEQ ID NO: 1064830 - protein, 28 aa, Mycobacterium
DRRLSFMTYGRLLLGATPLGQPLDASRR

SEQ ID NO: 1064831 - protein, 18 aa, Mycobacterium
DRRPHLGILDVACQAVSS

SEQ ID NO: 1064832 - protein, 23 aa, Mycobacterium
DRSGRVLTFAFISNDAGPTGRAA

SEQ ID NO: 1064833 - protein, 17 aa, Mycobacterium
DRSYRMHPAICAAVSTL

SEQ ID NO: 1064834 - protein, 28 aa, Mycobacterium
DRYLGAKIIVDLLLYPAIGLRAHKYLAM

SEQ ID NO: 1064835 - protein, 17 aa, Mycobacterium
DRYLLVTGLPLAHWKCY

SEQ ID NO: 1064836 - protein, 24 aa, Mycobacterium
DSADPLALLIYTSGSTGAPKGAMY

SEQ ID NO: 1064837 - protein, 27 aa, Mycobacterium
DSAEWKVFLNLLRKRFETDKGKWTKIA

SEQ ID NO: 1064838 - protein, 23 aa, Mycobacterium
DSALPDRFILFGPPMLGVIESGQ

SEQ ID NO: 1064839 - protein, 23 aa, Mycobacterium
DSELIPLPPNWGGYLIVPEVVEF

SEQ ID NO: 1064840 - protein, 18 aa, Mycobacterium
DSGGSNVVFQLLRYPPTT

SEQ ID NO: 1064841 - protein, 24 aa, Mycobacterium
DSGLLLVHHPLLLHGVDTVAVSTP

SEQ ID NO: 1064842 - protein, 28 aa, Mycobacterium
DSHPGKWRVVFFWPKDFTFICPTEIAAF

SEQ ID NO: 1064843 - protein, 24 aa, Mycobacterium
DSILRVLAMHRFAKSPMLVGGQML

SEQ ID NO: 1064844 - protein, 23 aa, Mycobacterium
DSIVLGGGMCFTFLAAQGFSVGK

SEQ ID NO: 1064845 - protein, 23 aa, Mycobacterium
DSKPQIILFQLVDNASGHVLAQA

SEQ ID NO: 1064846 - protein, 25 aa, Mycobacterium
DSKVTVLLFRRKYSPFLCQLLHDRT

SEQ ID NO: 1064847 - protein, 21 aa, Mycobacterium
DSNLYLHDLVLALPSMRDHIV

SEQ ID NO: 1064848 - protein, 23 aa, Mycobacterium
DSRHVWEFAPRDKTDLAALVRAA

SEQ ID NO: 1064849 - protein, 25 aa, Mycobacterium
DSRPYAPIIGYLNLSSPRDAGVAMA

SEQ ID NO: 1064850 - protein, 17 aa, Mycobacterium
DSRVRILARRESARIIS

SEQ ID NO: 1064851 - protein, 25 aa, Mycobacterium
DSTTVGLFTYPVLQAADVLAYDTDL

SEQ ID NO: 1064852 - protein, 18 aa, Mycobacterium
DSVITTHGLSWGFDRIFA

SEQ ID NO: 1064853 - protein, 20 aa, Mycobacterium
DSVLVRMIALGVPGEAWARH

SEQ ID NO: 1064854 - protein, 17 aa, Mycobacterium
DSYIPYDLSENRALRPG

SEQ ID NO: 1064855 - protein, 21 aa, Mycobacterium
DTAPTWPDRLPDPVNSSVAVD

SEQ ID NO: 1064856 - protein, 24 aa, Mycobacterium
DTDQIIPAVFLKRVTRNGFEDGLF

SEQ ID NO: 1064857 - protein, 17 aa, Mycobacterium
DTDSELFGRYWPANLHM

SEQ ID NO: 1064858 - protein, 19 aa, Mycobacterium
DTEPPRRSWPRPTGSDRTT

SEQ ID NO: 1064859 - protein, 25 aa, Mycobacterium
DTFVVPDMFIPKMAAKIYDLADPTS

SEQ ID NO: 1064860 - protein, 25 aa, Mycobacterium
DTKQLRTLRDGVVLLNTARSQLHDT

SEQ ID NO: 1064861 - protein, 22 aa, Mycobacterium
DTNLALLPVGYADGVFRSLGGR

SEQ ID NO: 1064862 - protein, 21 aa, Mycobacterium
DTRMQWYVELGIDPQNLRLFE

SEQ ID NO: 1064863 - protein, 28 aa, Mycobacterium
DTRRLIDRAGRWLLNYRPQPLAVGAEIN

SEQ ID NO: 1064864 - protein, 35 aa, Mycobacterium
DTRSGQLLVYTIDPLILRQTYPVRHAPYGLAGSRT

SEQ ID NO: 1064865 - protein, 23 aa, Mycobacterium
DTTVLYHPMAYFARPTLSRRTLG

SEQ ID NO: 1064866 - protein, 25 aa, Mycobacterium
DTVDGFILDGYPRSLEQAKALHEML

SEQ ID NO: 1064867 - protein, 19 aa, Mycobacterium
DTVVAVVDPGWRRGAAQGH

SEQ ID NO: 1064868 - protein, 26 aa, Mycobacterium
DTVVQTCIIHLIRGTFRYAGRQHHTA

SEQ ID NO: 1064869 - protein, 17 aa, Mycobacterium
DTYDYVVLAERTAAIIA

SEQ ID NO: 1064870 - protein, 32 aa, Mycobacterium
DTYIFYMRNFLMANALYWLKELHIEGLRVDAV

SEQ ID NO: 1064871 - protein, 20 aa, Mycobacterium
DTYRAFLHVAAEKALSAAAA

SEQ ID NO: 1064872 - protein, 29 aa, Mycobacterium
DTYSQWRQWWKILPPIKALQQLRQAWADM

SEQ ID NO: 1064873 - protein, 21 aa, Mycobacterium
DVAAKRIAWIKILNAGQTCVA

SEQ ID NO: 1064874 - protein, 22 aa, Mycobacterium
DVAALQLPTCRCKPVTTAQVRV

SEQ ID NO: 1064875 - protein, 32 aa, Mycobacterium
DVAMILRTKKSVMFIIPWGNHWIIGTTDTDWN

SEQ ID NO: 1064876 - protein, 29 aa, Mycobacterium
DVDTEIARLVPFIEWLRSAYTDLLISVDT

SEQ ID NO: 1064877 - protein, 26 aa, Mycobacterium
DVEFFNEFYALDLVLTQTPSGPVTTG

SEQ ID NO: 1064878 - protein, 19 aa, Mycobacterium
DVEFLWKLIEQKPGLEITV

SEQ ID NO: 1064879 - protein, 28 aa, Mycobacterium
DVELAWRLDAAGYYGPPRRWLVVTGTNG

SEQ ID NO: 1064880 - protein, 26 aa, Mycobacterium
DVEVPAPPFWGSRIIKGLAVADYTGF

SEQ ID NO: 1064881 - protein, 17 aa, Mycobacterium
DVFVMGPGSGRETAIRS

SEQ ID NO: 1064882 - protein, 23 aa, Mycobacterium
DVGYQIATIFTATQFRLGTPTDD

SEQ ID NO: 1064883 - protein, 20 aa, Mycobacterium
DVHIYLITSIRNLITIEISY

SEQ ID NO: 1064884 - protein, 35 aa, Mycobacterium
DVHRRLLTQLTAFKVPHRFAIIERLPRSTNGKLLR

SEQ ID NO: 1064885 - protein, 20 aa, Mycobacterium
DVIADLAFPLAVAVICRLLG

SEQ ID NO: 1064886 - protein, 21 aa, Mycobacterium
DVICDKGFPAYFLIVADLVNH

SEQ ID NO: 1064887 - protein, 30 aa, Mycobacterium
DVLALQAVRQRWPRMLPLTVRARRAATAAH

SEQ ID NO: 1064888 - protein, 26 aa, Mycobacterium
DVLTQGWFTGLVPITVPIAGSSFGDA

SEQ ID NO: 1064889 - protein, 18 aa, Mycobacterium
DVLVSYLPVGSEEADKFY

SEQ ID NO: 1064890 - protein, 21 aa, Mycobacterium
DVPLIGFAGAPFTLASYLVEG

SEQ ID NO: 1064891 - protein, 19 aa, Mycobacterium
DVRLFRAGLQCGVELVINS

SEQ ID NO: 1064892 - protein, 17 aa, Mycobacterium
DVRVIDHPLATARLAVL

SEQ ID NO: 1064893 - protein, 24 aa, Mycobacterium
DVSQLVYLHLRFHGYGEGKWTDSA

SEQ ID NO: 1064894 - protein, 23 aa, Mycobacterium
DVSRPLWTATLVEGLAAGRAAML

SEQ ID NO: 1064895 - protein, 21 aa, Mycobacterium
DVTLVQILRWLRPGAVIAITK

SEQ ID NO: 1064896 - protein, 17 aa, Mycobacterium
DVTRILITDPDVLAFTD

SEQ ID NO: 1064897 - protein, 24 aa, Mycobacterium
DVTSLYKVGLGSVRFLMSVGDLII

SEQ ID NO: 1064898 - protein, 21 aa, Mycobacterium
DVVGAYRFLQRVWRLVVDERT

SEQ ID NO: 1064899 - protein, 24 aa, Mycobacterium
DVVNVYVELTQLLRDRHGHQLYSE

SEQ ID NO: 1064900 - protein, 20 aa, Mycobacterium
DVYAVGYLTSAEHPLFTIRI

SEQ ID NO: 1064901 - protein, 18 aa, Mycobacterium
DVYRMLRVTNPSPYMYLL

SEQ ID NO: 1064902 - protein, 17 aa, Mycobacterium
DWPRYGGYALAGVSSFG

SEQ ID NO: 1064903 - protein, 27 aa, Mycobacterium
DWSVSPIPLVALYLRRPDAKPITADNE

SEQ ID NO: 1064904 - protein, 20 aa, Mycobacterium
DWTRLARRMSEISEAPLYID

SEQ ID NO: 1064905 - protein, 18 aa, Mycobacterium
DYDTADRLYFEPLTFEDV

SEQ ID NO: 1064906 - protein, 26 aa, Mycobacterium
DYFTYRDVLGFIYAQAKFQLLGKENS

SEQ ID NO: 1064907 - protein, 27 aa, Mycobacterium
DYGTYFKDHLYIAGRIKDLVIIDGRNH

SEQ ID NO: 1064908 - protein, 26 aa, Mycobacterium
DYLILEMSARRPGNIAALAAIAPPKI

SEQ ID NO: 1064909 - protein, 22 aa, Mycobacterium
DYQTLFREYGFTPEAVVAAAEQ

SEQ ID NO: 1064910 - protein, 17 aa, Mycobacterium
DYRGLYELMVVTRGLDT

SEQ ID NO: 1064911 - protein, 23 aa, Mycobacterium
DYRTLLEFFFQIHDPTTRNRQGN

SEQ ID NO: 1064912 - protein, 18 aa, Mycobacterium
DYVAGFYVAVKAGTIVVP

SEQ ID NO: 1064913 - protein, 19 aa, Mycobacterium
DYVMALGYLQAPVVVAGNN

SEQ ID NO: 1064914 - protein, 20 aa, Mycobacterium
EAAIRELLYAIGEDPDREGL

SEQ ID NO: 1064915 - protein, 23 aa, Mycobacterium
EAAKYIIRLMKGTGLAANVAMAA

SEQ ID NO: 1064916 - protein, 22 aa, Mycobacterium
EAALALLHLLAAATPPTQRPHR

SEQ ID NO: 1064917 - protein, 19 aa, Mycobacterium
EACDAVLALLARLDSSRRT

SEQ ID NO: 1064918 - protein, 31 aa, Mycobacterium
EAEERLETICRLIMLYHLDRGWADHLAYLAD

SEQ ID NO: 1064919 - protein, 19 aa, Mycobacterium
EAFIQLAARFLGPAVSGVQ

SEQ ID NO: 1064920 - protein, 25 aa, Mycobacterium
EAFKYPGTHWRFEYSPESYTGTELE

SEQ ID NO: 1064921 - protein, 25 aa, Mycobacterium
EAGPAALVVVLLPDGGRGYMSKIFN

SEQ ID NO: 1064922 - protein, 22 aa, Mycobacterium
EAGRINHAYLFSGPRGCGKTSS

SEQ ID NO: 1064923 - protein, 25 aa, Mycobacterium
EAIAIDPQHRLLLETSWDAIEHAGL

SEQ ID NO: 1064924 - protein, 24 aa, Mycobacterium
EAIEAFRLLCRTEGILPALESAHA

SEQ ID NO: 1064925 - protein, 26 aa, Mycobacterium
EAIRAIGIPVYLLPGNHDPLDASSVY

SEQ ID NO: 1064926 - protein, 17 aa, Mycobacterium
EAKDLVDGVPKLLLEKV

SEQ ID NO: 1064927 - protein, 21 aa, Mycobacterium
EAKLQMEQYFARFGGVRDYLM

SEQ ID NO: 1064928 - protein, 23 aa, Mycobacterium
EALDLARRLAKEEGLLVGISAGA

SEQ ID NO: 1064929 - protein, 28 aa, Mycobacterium
EALFGTPDTWLLWNLTGGPRGGVHVTDV

SEQ ID NO: 1064930 - protein, 19 aa, Mycobacterium
EALKMWASSLNIAGSGWSG

SEQ ID NO: 1064931 - protein, 17 aa, Mycobacterium
EANVVNFRHQLGRLGLG

SEQ ID NO: 1064932 - protein, 17 aa, Mycobacterium
EAPSHFDSGAAAGPKVA

SEQ ID NO: 1064933 - protein, 27 aa, Mycobacterium
EAQISKPMLYLYYGSKEDLFGACLNRE

SEQ ID NO: 1064934 - protein, 23 aa, Mycobacterium
EAQRLLSALLRAPVSVAATTTEG

SEQ ID NO: 1064935 - protein, 17 aa, Mycobacterium
EATLQRIWSQCLGVSSV

SEQ ID NO: 1064936 - protein, 26 aa, Mycobacterium
EAVLEEPYILLVSSKVSTVKDLLPLL

SEQ ID NO: 1064937 - protein, 19 aa, Mycobacterium
EAVLPFNRLRRADGAAIDS

SEQ ID NO: 1064938 - protein, 24 aa, Mycobacterium
EDAKPLLRVWPSEVPTGVGCMKQF

SEQ ID NO: 1064939 - protein, 24 aa, Mycobacterium
EDALGDMFLAALFGDHPVGRPVIG

SEQ ID NO: 1064940 - protein, 24 aa, Mycobacterium
EDGRWTWDVFTVTGSLRTWGGGAV

SEQ ID NO: 1064941 - protein, 22 aa, Mycobacterium
EDHALRLLNLRRVARSVEGVGS

SEQ ID NO: 1064942 - protein, 26 aa, Mycobacterium
EDIQGRFYCSISVPLDLYSCGVYEGQ

SEQ ID NO: 1064943 - protein, 18 aa, Mycobacterium
EDLLRADRIFLNAGGHAV

SEQ ID NO: 1064944 - protein, 17 aa, Mycobacterium
EDLTGLRARVRPKRAEV

SEQ ID NO: 1064945 - protein, 17 aa, Mycobacterium
EDNAFGRLILLYDPDGS

SEQ ID NO: 1064946 - protein, 25 aa, Mycobacterium
EDPENVFFYITVYNEPYPQPPEPEN

SEQ ID NO: 1064947 - protein, 27 aa, Mycobacterium
EDPNRDPVFAEDWVNLVALAVNEENAV

SEQ ID NO: 1064948 - protein, 20 aa, Mycobacterium
EDRPYTTPFVVDPALRSQVV

SEQ ID NO: 1064949 - protein, 29 aa, Mycobacterium
EEAAYPLGKAFRPKVWPPVRRIDGVYGDR

SEQ ID NO: 1064950 - protein, 35 aa, Mycobacterium
EEERRLLYVGITRARVYLALSWALSRTPGGRQSRK

SEQ ID NO: 1064951 - protein, 22 aa, Mycobacterium
EEIDKMVWATRWGADTIMDLST

SEQ ID NO: 1064952 - protein, 23 aa, Mycobacterium
EEIKRAYRKLARYLHPDANPDNS

SEQ ID NO: 1064953 - protein, 23 aa, Mycobacterium
EELAVLWELGYRRFAYVDQRKHS

SEQ ID NO: 1064954 - protein, 27 aa, Mycobacterium
EELGIDVFLVMPFTTDFMKLTPDRYVH

SEQ ID NO: 1064955 - protein, 22 aa, Mycobacterium
EELIGILGGETRQLAFAKTPPT

SEQ ID NO: 1064956 - protein, 24 aa, Mycobacterium
EELLARIRALLRRTKPDDAAESVA

SEQ ID NO: 1064957 - protein, 26 aa, Mycobacterium
EELQHPYLIFNTLLPFGFESGCRLAA

SEQ ID NO: 1064958 - protein, 25 aa, Mycobacterium
EEPAFDIFALVPPPGDVGLGRIGTL

SEQ ID NO: 1064959 - protein, 25 aa, Mycobacterium
EEPPDHLIFIFATTEPEKVLPTIRS

SEQ ID NO: 1064960 - protein, 17 aa, Mycobacterium
EERILAKLAKHARTTFA

SEQ ID NO: 1064961 - protein, 27 aa, Mycobacterium
EEVAPWLDLVCKLGVLVAALSDELPAS

SEQ ID NO: 1064962 - protein, 20 aa, Mycobacterium
EEVSWRMGWIDDEQLALRAH

SEQ ID NO: 1064963 - protein, 22 aa, Mycobacterium
EFDISRLRYHKIVLMADADVDG

SEQ ID NO: 1064964 - protein, 19 aa, Mycobacterium
EFGAFLEYQPLEASAWLVA

SEQ ID NO: 1064965 - protein, 19 aa, Mycobacterium
EFGAFVSLLPGRDGLVHIS

SEQ ID NO: 1064966 - protein, 18 aa, Mycobacterium
EFGQLPAGAFLVGSQSAG

SEQ ID NO: 1064967 - protein, 21 aa, Mycobacterium
EFLIELFEIRAALGSLIGCLV

SEQ ID NO: 1064968 - protein, 25 aa, Mycobacterium
EFMVRNTYIYPPEPSMRIISDIFAY

SEQ ID NO: 1064969 - protein, 19 aa, Mycobacterium
EFNIPTQDARWFRLCTVDG

SEQ ID NO: 1064970 - protein, 17 aa, Mycobacterium
EFPHGFVPELFNALNAK

SEQ ID NO: 1064971 - protein, 19 aa, Mycobacterium
EFPVFSAAPNFAFELATKK

SEQ ID NO: 1064972 - protein, 17 aa, Mycobacterium
EFRKLWISRINAAARAN

SEQ ID NO: 1064973 - protein, 17 aa, Mycobacterium
EFTVRLPLNGWQPHREL

SEQ ID NO: 1064974 - protein, 19 aa, Mycobacterium
EFVMLIADNHWRVDEVPVE

SEQ ID NO: 1064975 - protein, 28 aa, Mycobacterium
EGAHGLLVVTPYYSKPPQTGLFAHFTAV

SEQ ID NO: 1064976 - protein, 28 aa, Mycobacterium
EGAPQLDPALFDLGLPVFGICYGFQAMA

SEQ ID NO: 1064977 - protein, 17 aa, Mycobacterium
EGEPAHLIDWKGNDWYA

SEQ ID NO: 1064978 - protein, 23 aa, Mycobacterium
EGFLATLLDWCRKNNVMFIADEV

SEQ ID NO: 1064979 - protein, 27 aa, Mycobacterium
EGGQMPIHMRLPKLKGFRNRLRTEYAV

SEQ ID NO: 1064980 - protein, 19 aa, Mycobacterium
EGHAFFALGTFMVSLDSNL

SEQ ID NO: 1064981 - protein, 33 aa, Mycobacterium
EGKIGAIRYARARGLPVLGLCLGLQCIVIEATR

SEQ ID NO: 1064982 - protein, 17 aa, Mycobacterium
EGKIRHIGLSEINLDQL

SEQ ID NO: 1064983 - protein, 32 aa, Mycobacterium
EGLFDPRLKRPIPFLPNMIGIITGRASAAERD

SEQ ID NO: 1064984 - protein, 27 aa, Mycobacterium
EGLRATIDWYRNNESWWRPLKDAVEAR

SEQ ID NO: 1064985 - protein, 24 aa, Mycobacterium
EGMAVYRVFEALDELGAIVEEARG

SEQ ID NO: 1064986 - protein, 33 aa, Mycobacterium
EGQLIHRFLPMEELIAAFLPVLFPGTEIVEHHA

SEQ ID NO: 1064987 - protein, 17 aa, Mycobacterium
EGQRRYVESLSAYARQF

SEQ ID NO: 1064988 - protein, 18 aa, Mycobacterium
EGRGIVMRVPLEGGGRLV

SEQ ID NO: 1064989 - protein, 33 aa, Mycobacterium
EGRINPDVKMNYLASPPLVIAYALAGTMDFDFE

SEQ ID NO: 1064990 - protein, 24 aa, Mycobacterium
EGRKRIVRRLLTAAGFPVEMLVRT

SEQ ID NO: 1064991 - protein, 29 aa, Mycobacterium
EGRPRLRYWLDRLSTYGVLAYAAVVYGYF

SEQ ID NO: 1064992 - protein, 23 aa, Mycobacterium
EGRVLVGPLDWAVELDERWVIIG

SEQ ID NO: 1064993 - protein, 23 aa, Mycobacterium
EGSHALMTIGSVLNTGCLDLDRV

SEQ ID NO: 1064994 - protein, 32 aa, Mycobacterium
EGSKPVIGDVLRHGYKLGDQVLRHALVGVVDT

SEQ ID NO: 1064995 - protein, 25 aa, Mycobacterium
EGSSKALLTWATHQVPFLAAVEEGP

SEQ ID NO: 1064996 - protein, 24 aa, Mycobacterium
EGVARLLKLYPMLNPTGCMAAKRI

SEQ ID NO: 1064997 - protein, 29 aa, Mycobacterium
EGVDFTNIYFYTVLFHVLLASNSIAIERG

SEQ ID NO: 1064998 - protein, 19 aa, Mycobacterium
EGYDMFMAMLDGVKEESVG

SEQ ID NO: 1064999 - protein, 25 aa, Mycobacterium
EHDAHLHLRRALVSAALLGGDAPAV

SEQ ID NO: 1065000 - protein, 28 aa, Mycobacterium
EHESKPFFGSLLEFITSGPVMAAIVEGP

SEQ ID NO: 1065001 - protein, 20 aa, Mycobacterium
EHLVAWLKAVVYGAAERWTD

SEQ ID NO: 1065002 - protein, 21 aa, Mycobacterium
EHMGPPLRLIGDGELVSVAGE

SEQ ID NO: 1065003 - protein, 24 aa, Mycobacterium
EHNTRFKRLFVVTPKGARQAKPID

SEQ ID NO: 1065004 - protein, 18 aa, Mycobacterium
EHPVLLPVLFFRTHRSID

SEQ ID NO: 1065005 - protein, 26 aa, Mycobacterium
EHQAIVRDVLAAGDFWGGAGSVACQE

SEQ ID NO: 1065006 - protein, 18 aa, Mycobacterium
EHRRFRFFLNVEIGRHLS

SEQ ID NO: 1065007 - protein, 23 aa, Mycobacterium
EHVFDFFLRNKRAEWANYRSHVS

SEQ ID NO: 1065008 - protein, 19 aa, Mycobacterium
EHYTAIFWGGGFRLPQLDG

SEQ ID NO: 1065009 - protein, 18 aa, Mycobacterium
EIAESDLLLERWRVLFEP

SEQ ID NO: 1065010 - protein, 25 aa, Mycobacterium
EIDGSLPERLRVLALTLASERTVVA

SEQ ID NO: 1065011 - protein, 21 aa, Mycobacterium
EIEALYYLHPLTGEVIRQVDS

SEQ ID NO: 1065012 - protein, 19 aa, Mycobacterium
EIETYPVDRPILQCVRHSV

SEQ ID NO: 1065013 - protein, 18 aa, Mycobacterium
EILLRAEVIIVDELEFTP

SEQ ID NO: 1065014 - protein, 24 aa, Mycobacterium
EIPCVCALLTLLPDNLRWLVTVDA

SEQ ID NO: 1065015 - protein, 17 aa, Mycobacterium
EIRYLLDRRRALGGFLP

SEQ ID NO: 1065016 - protein, 26 aa, Mycobacterium
EISSGTYRFVYRKRFNKKCETALTVL

SEQ ID NO: 1065017 - protein, 18 aa, Mycobacterium
EITLQPLRRYDVDAAILF

SEQ ID NO: 1065018 - protein, 37 aa, Mycobacterium; identical to SEQ ID NO: 125850

SEQ ID NO: 1065019 - protein, 33 aa, Mycobacterium
EKADDPLAMYLFDLCTLPLNLAGHCGMSVPSGL

SEQ ID NO: 1065020 - protein, 25 aa, Mycobacterium
EKAQQLGLTWLVEIGAHGVVAGPDS

SEQ ID NO: 1065021 - protein, 27 aa, Mycobacterium
EKEKWTKYLLDPAQIRLLRKLKHANAM

SEQ ID NO: 1065022 - protein, 36 aa, Mycobacterium; identical to SEQ ID NO: 114216

SEQ ID NO: 1065023 - protein, 20 aa, Mycobacterium
EKIGVMFGCMNYSTRVTLAD

SEQ ID NO: 1065024 - protein, 23 aa, Mycobacterium
EKSTFIEVCYLLIYGELPATDQL

SEQ ID NO: 1065025 - protein, 28 aa, Mycobacterium
EKTKRLPAWIYSLPHEHQLALIGGLVDA

SEQ ID NO: 1065026 - protein, 23 aa, Mycobacterium
EKVRRKPFSVVLFDEIEKAHQEI

SEQ ID NO: 1065027 - protein, 37 aa, Mycobacterium
ELAGAAHFVWLRDTLRLGEKFPLKAGMLTSLGFGHVS

SEQ ID NO: 1065028 - protein, 18 aa, Mycobacterium
ELCLTIAPLIVGGRARRI

SEQ ID NO: 1065029 - protein, 25 aa, Mycobacterium
ELCRRWYPRIYFGQPAKGLTHRALA

SEQ ID NO: 1065030 - protein, 19 aa, Mycobacterium
ELDLIQWRLDVWNASVQVS

SEQ ID NO: 1065031 - protein, 26 aa, Mycobacterium
ELDRRGLLRRIGGAPYLHTLISTVPT

SEQ ID NO: 1065032 - protein, 23 aa, Mycobacterium
ELDSWRYQVTWLSSPATPSSITL

SEQ ID NO: 1065033 - protein, 26 aa, Mycobacterium
ELEENPYLPPYYHPGPDSPEIRYLLD

SEQ ID NO: 1065034 - protein, 32 aa, Mycobacterium
ELEHHANLIPWQELARRIGATLRWYGVTDDGQ

SEQ ID NO: 1065035 - protein, 20 aa, Mycobacterium
ELFALWNFAALQQVYLMSGL

SEQ ID NO: 1065036 - protein, 24 aa, Mycobacterium
ELGSEPLFDLWPNLGTKVEDEPDD

SEQ ID NO: 1065037 - protein, 20 aa, Mycobacterium
ELHDLIGRMRRSVASFKARY

SEQ ID NO: 1065038 - protein, 28 aa, Mycobacterium
ELIAAVVNRVWFLDAVLGKVDVYNMGWY

SEQ ID NO: 1065039 - protein, 21 aa, Mycobacterium
ELIKDPIPCGHAIEFRINGED

SEQ ID NO: 1065040 - protein, 17 aa, Mycobacterium
ELKVLPRDEWPSMIRRL

SEQ ID NO: 1065041 - protein, 17 aa, Mycobacterium
ELLLPAMAGLVASLTFN

SEQ ID NO: 1065042 - protein, 18 aa, Mycobacterium
ELLVVRHAPGVWHLVSTV

SEQ ID NO: 1065043 - protein, 35 aa, Mycobacterium
ELMDTALIVDQPFLLSAYIDFAALRAKFDGGTLAP

SEQ ID NO: 1065044 - protein, 17 aa, Mycobacterium
ELMLCFNQLGYSAYAQS

SEQ ID NO: 1065045 - protein, 26 aa, Mycobacterium
ELPAQLIVRSIGYRGVPTPGLPFDDS

SEQ ID NO: 1065046 - protein, 20 aa, Mycobacterium
ELPVLLYDIPGRSVVPIEPD

SEQ ID NO: 1065047 - protein, 22 aa, Mycobacterium
ELQVVEVVVGLPWTLTDRTGSS

SEQ ID NO: 1065048 - protein, 20 aa, Mycobacterium
ELRARDFVALVSGALHAETE

SEQ ID NO: 1065049 - protein, 21 aa, Mycobacterium
ELRLKYRYLDLRRDGPGSAIR

SEQ ID NO: 1065050 - protein, 17 aa, Mycobacterium
ELRRYIVFNSLVDRGHW

SEQ ID NO: 1065051 - protein, 32 aa, Mycobacterium
ELSNVANLPITLWPGMKIGQLCVLRLTSPAEH

SEQ ID NO: 1065052 - protein, 20 aa, Mycobacterium
ELSPHLVVYDVTRSFNSTQG

SEQ ID NO: 1065053 - protein, 22 aa, Mycobacterium
ELTGLVRYPQPLAPAAAAEHAG

SEQ ID NO: 1065054 - protein, 18 aa, Mycobacterium
ELTTQLTDMLAPHDPHGP

SEQ ID NO: 1065055 - protein, 30 aa, Mycobacterium
ELVATGVPILLGASRKRFLGRLLAGADGAV

SEQ ID NO: 1065056 - protein, 18 aa, Mycobacterium
ELVGLMGIPPLGWNPDQA

SEQ ID NO: 1065057 - protein, 26 aa, Mycobacterium
ELVGQGHLLAPGSPLRRLVEGSGVVS

SEQ ID NO: 1065058 - protein, 18 aa, Mycobacterium
ELVPVYPTCHYVMGGIPT

SEQ ID NO: 1065059 - protein, 25 aa, Mycobacterium
ELYGMHIAWLSKLGHFRLHLNFTKK

SEQ ID NO: 1065060 - protein, 17 aa, Mycobacterium
EMFRKLLDQGQAGDNVG

SEQ ID NO: 1065061 - protein, 34 aa, Mycobacterium
EMHLFTILGQRQLLFWAWLIYGGRLLRGKLPRVD

SEQ ID NO: 1065062 - protein, 28 aa, Mycobacterium
EMLHDLYQRWPFFRSVLSNMAQVLAKSD

SEQ ID NO: 1065063 - protein, 19 aa, Mycobacterium
ENGFVLVCSDYTALLRVER

SEQ ID NO: 1065064 - protein, 26 aa, Mycobacterium
ENGRSWSQWSFIGVGAPSALTIRDGE

SEQ ID NO: 1065065 - protein, 21 aa, Mycobacterium
ENKAYYFAAAFPSACGKTNLA

SEQ ID NO: 1065066 - protein, 24 aa, Mycobacterium
ENKYRLIFEKLRLQPGDRLLDVGC

SEQ ID NO: 1065067 - protein, 26 aa, Mycobacterium
ENLQSLIFGLWQMISAYHAARSEPAP

SEQ ID NO: 1065068 - protein, 25 aa, Mycobacterium
ENRDLFLALLSVSGVGPRLAMATLA

SEQ ID NO: 1065069 - protein, 26 aa, Mycobacterium
ENSPGFLGFQLLRPIKGENRYFVVTH

SEQ ID NO: 1065070 - protein, 18 aa, Mycobacterium
ENSRIRMLRSFDPSSGAY

SEQ ID NO: 1065071 - protein, 27 aa, Mycobacterium
ENTGADVSIIFVPPRFAKEAIIEAVEA

SEQ ID NO: 1065072 - protein, 20 aa, Mycobacterium
EPAHLIDWKGNDWYAGKTET

SEQ ID NO: 1065073 - protein, 19 aa, Mycobacterium
EPDKLSWDAWRNEDSRWTV

SEQ ID NO: 1065074 - protein, 25 aa, Mycobacterium
EPGAYICVYPFVRSYDWYLLPDQER

SEQ ID NO: 1065075 - protein, 25 aa, Mycobacterium
EPGDRSVHYPFPIKDLVALDDALTY

SEQ ID NO: 1065076 - protein, 24 aa, Mycobacterium
EPGEICFHVLLLAGGYWNFPNVTA

SEQ ID NO: 1065077 - protein, 24 aa, Mycobacterium
EPGSWLLIDTFNASAIPDMWASTL

SEQ ID NO: 1065078 - protein, 26 aa, Mycobacterium
EPGTQFTARQIPLPVGVTLVSDPEML

SEQ ID NO: 1065079 - protein, 26 aa, Mycobacterium
EPHYGPPPLLLRMVEAGLLGKKSGQG

SEQ ID NO: 1065080 - protein, 22 aa, Mycobacterium
EPINFFDFMGPIIKACGENWPR

SEQ ID NO: 1065081 - protein, 24 aa, Mycobacterium
EPPYVAVPYLDRMDLAYAAADLVI

SEQ ID NO: 1065082 - protein, 17 aa, Mycobacterium
EPRFPSFKGIMAAKKKE

SEQ ID NO: 1065083 - protein, 21 aa, Mycobacterium
EPVLLLHPFMMSQTVWEIVAP

SEQ ID NO: 1065084 - protein, 17 aa, Mycobacterium
EPWRGEPLLEYLRKMVF

SEQ ID NO: 1065085 - protein, 19 aa, Mycobacterium
EPYRRLINQGYIQAFAYTD

SEQ ID NO: 1065086 - protein, 25 aa, Mycobacterium
EQALSNIRFWAPLSLAAEQKHSIDD

SEQ ID NO: 1065087 - protein, 26 aa, Mycobacterium
EQLRQTIPELPWLSRKRIQQEWGISD

SEQ ID NO: 1065088 - protein, 23 aa, Mycobacterium
EQNLILFGRLYGLSKSVARVRTQ

SEQ ID NO: 1065089 - protein, 22 aa, Mycobacterium
EQPVLSIRWKVHQQAFRAPRSS

SEQ ID NO: 1065090 - protein, 28 aa, Mycobacterium
EQREALLLTQLLGLPYADAAAVCGCPVG

SEQ ID NO: 1065091 - protein, 23 aa, Mycobacterium
EQSALKCLYLVTRSLDPTGTGQK

SEQ ID NO: 1065092 - protein, 26 aa, Mycobacterium
ERAPTAFYFYSITHWQLASWPRGRIV

SEQ ID NO: 1065093 - protein, 28 aa, Mycobacterium
ERELRRQILTLWQTALIRLARLQISDEI

SEQ ID NO: 1065094 - protein, 24 aa, Mycobacterium
EREQTILVFDLGGGTFDVSLLEIG

SEQ ID NO: 1065095 - protein, 23 aa, Mycobacterium
ERERGITIKAQNVRLSWSVTAGG

SEQ ID NO: 1065096 - protein, 27 aa, Mycobacterium
ERGRIKQLLLKIGWPAEDLAGYVDGEA

SEQ ID NO: 1065097 - protein, 25 aa, Mycobacterium
ERGYHLELITPVPLPRKLTGDLARL

SEQ ID NO: 1065098 - protein, 19 aa, Mycobacterium
ERIHNAVKRALFALVAASL

SEQ ID NO: 1065099 - protein, 24 aa, Mycobacterium
ERKALLDRLLAQQLPDGWDADLPN

SEQ ID NO: 1065100 - protein, 24 aa, Mycobacterium
ERPDSRRLLLLQGLRDRVVDALDA

SEQ ID NO: 1065101 - protein, 25 aa, Mycobacterium
ERQLQELLSLLPTPDPQLIAEPCRW

SEQ ID NO: 1065102 - protein, 19 aa, Mycobacterium
ERRAGWVGLPLAGVQTRLV

SEQ ID NO: 1065103 - protein, 18 aa, Mycobacterium
ERVAGLAQQRFAAGPRLA

SEQ ID NO: 1065104 - protein, 28 aa, Mycobacterium
ERYRELRDAWLLARSDLIDRRNRIRELV

SEQ ID NO: 1065105 - protein, 26 aa, Mycobacterium
ESCDTLIVIPNDRLLQMGDTAVSLMD

SEQ ID NO: 1065106 - protein, 17 aa, Mycobacterium
ESDHHADVFSGGPERLL

SEQ ID NO: 1065107 - protein, 26 aa, Mycobacterium
ESDNLAVKGIYWARRDAQPCHRRIVT

SEQ ID NO: 1065108 - protein, 18 aa, Mycobacterium
ESEAFWININRETQMPAR

SEQ ID NO: 1065109 - protein, 20 aa, Mycobacterium
ESFPVCEFFISLTSKHIGVI

SEQ ID NO: 1065110 - protein, 20 aa, Mycobacterium
ESFTLVYDALVARGGQESVL

SEQ ID NO: 1065111 - protein, 27 aa, Mycobacterium
ESIGVRAICYLPLTYDHRLIDGADAGR

SEQ ID NO: 1065112 - protein, 24 aa, Mycobacterium
ESKLLALLHRFGIAAPASADRSRA

SEQ ID NO: 1065113 - protein, 18 aa, Mycobacterium
ESMISTMAQLYVYGHDLD

SEQ ID NO: 1065114 - protein, 36 aa, Mycobacterium
ESQFFPLHNALFDLPPYRGKWPEIWVAAHGPRMLQA

SEQ ID NO: 1065115 - protein, 20 aa, Mycobacterium
ESVGFLFNLAVEAVPASHVA

SEQ ID NO: 1065116 - protein, 22 aa, Mycobacterium
ETALTLQFAYAARAKLAGAQVG

SEQ ID NO: 1065117 - protein, 24 aa, Mycobacterium
ETCIGWTCPRWPARSFLSSTCTPR

SEQ ID NO: 1065118 - protein, 23 aa, Mycobacterium
ETDKPFLMPVEDVFTITGRGTVV

SEQ ID NO: 1065119 - protein, 24 aa, Mycobacterium
ETEAILAWVMAQRLPERPVIVDAC

SEQ ID NO: 1065120 - protein, 24 aa, Mycobacterium
ETGYVMPHWPQPWGRSADAVEQLV

SEQ ID NO: 1065121 - protein, 20 aa, Mycobacterium
ETLKLPRTVLMCPMTLASQV

SEQ ID NO: 1065122 - protein, 18 aa, Mycobacterium
ETLRKDITWALELMGLHL

SEQ ID NO: 1065123 - protein, 26 aa, Mycobacterium
ETLTAEFIYLLYCNQIRQNWAVLSNH

SEQ ID NO: 1065124 - protein, 22 aa, Mycobacterium
ETMTRRAPVLTTPLLVVHGSED

SEQ ID NO: 1065125 - protein, 18 aa, Mycobacterium
ETQQPEQLAYYSGLAALA

SEQ ID NO: 1065126 - protein, 28 aa, Mycobacterium
ETSKRYMHHYNFPPFSTGETGRVGSPKR

SEQ ID NO: 1065127 - protein, 25 aa, Mycobacterium
ETSRTFGWGPRPLLVSIRSGAVQSM

SEQ ID NO: 1065128 - protein, 18 aa, Mycobacterium
ETTPFSLENGLLTGIRKL

SEQ ID NO: 1065129 - protein, 24 aa, Mycobacterium
ETTRGYMRCGTLMKDLFPSYTTRT

SEQ ID NO: 1065130 - protein, 19 aa, Mycobacterium
ETWKRLCDPMAQQISTVWA

SEQ ID NO: 1065131 - protein, 17 aa, Mycobacterium
EVAPYCLGLSYVVFTDI

SEQ ID NO: 1065132 - protein, 18 aa, Mycobacterium
EVASLAYMRGRTLNDAFI

SEQ ID NO: 1065133 - protein, 19 aa, Mycobacterium
EVFGEEKATWWQRAVEVWP

SEQ ID NO: 1065134 - protein, 29 aa, Mycobacterium
EVGFFRGVMQLTHPAFLILDSPDGRNRGS

SEQ ID NO: 1065135 - protein, 23 aa, Mycobacterium
EVGPTLHRLIQGADGRVIVACFA

SEQ ID NO: 1065136 - protein, 29 aa, Mycobacterium
EVIELRPDIDWDKGKTLHWVIDRLHHAGT

SEQ ID NO: 1065137 - protein, 24 aa, Mycobacterium
EVKDAGELALLRLAAEAADAALTE

SEQ ID NO: 1065138 - protein, 35 aa, Mycobacterium
EVLERSLIHLGLKHYFLVDFPQKPGALRRFLDEVL

SEQ ID NO: 1065139 - protein, 24 aa, Mycobacterium
EVMGRHAGWIALSSGLASGAHMTL

SEQ ID NO: 1065140 - protein, 23 aa, Mycobacterium
EVQADIRRKMEIGCYQGLRHRRG

SEQ ID NO: 1065141 - protein, 26 aa, Mycobacterium
EVQIGKFRLVFLIGSKQDDDTGRTAG

SEQ ID NO: 1065142 - protein, 18 aa, Mycobacterium
EVQTVQRSLLGQMVTARP

SEQ ID NO: 1065143 - protein, 23 aa, Mycobacterium
EVREKIERRYVNALGAAELAQGS

SEQ ID NO: 1065144 - protein, 25 aa, Mycobacterium
EVRGEVFFRVVDFQALNTSLVEEGK

SEQ ID NO: 1065145 - protein, 24 aa, Mycobacterium
EVRSEFLNQLQKGAIRKGVVSSIV

SEQ ID NO: 1065146 - protein, 24 aa, Mycobacterium
EVSDPYVLVLPTYGGGRTAPDLQA

SEQ ID NO: 1065147 - protein, 20 aa, Mycobacterium
EVTHWIQFTANRWLFDYMSK

SEQ ID NO: 1065148 - protein, 24 aa, Mycobacterium
EVVRAWLSYAPTVVQLPDGRIKLS

SEQ ID NO: 1065149 - protein, 18 aa, Mycobacterium
EVVVAILINPVKKGMFDL

SEQ ID NO: 1065150 - protein, 24 aa, Mycobacterium
EVWELFWTGFPADGLYRFRVNCAD

SEQ ID NO: 1065151 - protein, 26 aa, Mycobacterium
EYFEAKAVLFDPHSLLRARTVVVCID

SEQ ID NO: 1065152 - protein, 18 aa, Mycobacterium
EYGTWLMAGHLDAAEIVQ

SEQ ID NO: 1065153 - protein, 18 aa, Mycobacterium
EYIRPDNLTVWLTDPVQA

SEQ ID NO: 1065154 - protein, 27 aa, Mycobacterium
EYRSLLDHPVFCWYTERICEQRAVLDN

SEQ ID NO: 1065155 - protein, 26 aa, Mycobacterium
EYVDGKRSGLWLGLRETFKSGSSQPP

SEQ ID NO: 1065156 - protein, 26 aa, Mycobacterium
EYVHLRHGQILFTYLHLAASRPCTDA

SEQ ID NO: 1065157 - protein, 25 aa, Mycobacterium
FADEFHPELQFDKPYLLAMANAGPG

SEQ ID NO: 1065158 - protein, 21 aa, Mycobacterium
FADVLIAFGRFPIIDDRDPQL

SEQ ID NO: 1065159 - protein, 31 aa, Mycobacterium
FADVMPEDLIKFGLIPEFIGRLPVIASVINL

SEQ ID NO: 1065160 - protein, 29 aa, Mycobacterium
FAEREGVNLTFLPFIAKAAIDALKIHPNI

SEQ ID NO: 1065161 - protein, 19 aa, Mycobacterium
FAGAKILRQYGIGPRPGVA

SEQ ID NO: 1065162 - protein, 22 aa, Mycobacterium
FAGRVLQPLGLRKAATQDLSGF

SEQ ID NO: 1065163 - protein, 17 aa, Mycobacterium
FAHYLRASGLESCDEFV

SEQ ID NO: 1065164 - protein, 17 aa, Mycobacterium
FAIAIRTALMRDGIAYV

SEQ ID NO: 1065165 - protein, 17 aa, Mycobacterium
FANSLRTAERLTIQINE

SEQ ID NO: 1065166 - protein, 31 aa, Mycobacterium
FAPEIYRAPLSYPYRDGLLNKDLATDGKLAG

SEQ ID NO: 1065167 - protein, 25 aa, Mycobacterium
FAPPARCVMLIWDAPNLDMGLDAIV

SEQ ID NO: 1065168 - protein, 17 aa, Mycobacterium
FAPVFDPVQVEIGFHTP

SEQ ID NO: 1065169 - protein, 23 aa, Mycobacterium
FAQALRLALIDAAPEVAQDPVVV

SEQ ID NO: 1065170 - protein, 20 aa, Mycobacterium
FASRLELMARLTIGVRLGNL

SEQ ID NO: 1065171 - protein, 24 aa, Mycobacterium
FATLAGWYGATLRITRLRPSGRDA

SEQ ID NO: 1065172 - protein, 24 aa, Mycobacterium
FATTELFLERLGLTSLAELPDIAP

SEQ ID NO: 1065173 - protein, 30 aa, Mycobacterium
FAWKGETLEEYWWAAEQMLTWPDPDKPVNM

SEQ ID NO: 1065174 - protein, 24 aa, Mycobacterium
FCPDQFLGAHVRRVTGRKNVYVWM

SEQ ID NO: 1065175 - protein, 19 aa, Mycobacterium
FCSPKTYRDYFETVYGPMI

SEQ ID NO: 1065176 - protein, 18 aa, Mycobacterium
FCWRTIRGQECSAYWPAG

SEQ ID NO: 1065177 - protein, 26 aa, Mycobacterium
FDADFFSAWGKLAAVRTPMIAAVAGY

SEQ ID NO: 1065178 - protein, 22 aa, Mycobacterium
FDAIGIQYGLAFSGLTAVYTAA

SEQ ID NO: 1065179 - protein, 39 aa, Mycobacterium
FDDDPLLPSATLWVARSVSWIFEYYPMRQAHELPDGSFQ

SEQ ID NO: 1065180 - protein, 20 aa, Mycobacterium
FDDLAWIKTQWPGKFVVKGI

SEQ ID NO: 1065181 - protein, 23 aa, Mycobacterium
FDDLRRRHLVPEPPYGKGVAAAA

SEQ ID NO: 1065182 - protein, 22 aa, Mycobacterium
FDLEPRRSILHGLLGELDIRLL

SEQ ID NO: 1065183 - protein, 30 aa, Mycobacterium
FDPSARTAWLAEGLLMYLPATAQDGLFTEI

SEQ ID NO: 1065184 - protein, 20 aa, Mycobacterium
FDQHLWIAVEMRVVKYTPGS

SEQ ID NO: 1065185 - protein, 20 aa, Mycobacterium
FDQIMMDVALHKLPVTMVID

SEQ ID NO: 1065186 - protein, 18 aa, Mycobacterium
FDRKFRGYRFGTGPVYRD

SEQ ID NO: 1065187 - protein, 17 aa, Mycobacterium
FDRLRLIQRIADRLPDK

SEQ ID NO: 1065188 - protein, 19 aa, Mycobacterium
FDTQVLHRLPVTSWDVRCA

SEQ ID NO: 1065189 - protein, 18 aa, Mycobacterium
FDVIVTDNLFGDIITDLA

SEQ ID NO: 1065190 - protein, 17 aa, Mycobacterium
FEAYPQWNDGVKGVWVL

SEQ ID NO: 1065191 - protein, 22 aa, Mycobacterium
FEDGGWIWFDITAETRVTLCSG

SEQ ID NO: 1065192 - protein, 21 aa, Mycobacterium
FEGELFITGRIKDLLVVDGSN

SEQ ID NO: 1065193 - protein, 24 aa, Mycobacterium
FEIADFGVVGDLFKVAPQLTDGIK

SEQ ID NO: 1065194 - protein, 23 aa, Mycobacterium
FELNVYIPMMARNILESYQLLTN

SEQ ID NO: 1065195 - protein, 25 aa, Mycobacterium
FEPKPDWKHLFSYQPEIWDYLKGVT

SEQ ID NO: 1065196 - protein, 19 aa, Mycobacterium
FERFDWARLLLIEDPFSQN

SEQ ID NO: 1065197 - protein, 25 aa, Mycobacterium
FERKADGFAQLTWFLGGRSASLSQL

SEQ ID NO: 1065198 - protein, 18 aa, Mycobacterium
FFAGGDLTAMINTGSEEA

SEQ ID NO: 1065199 - protein, 25 aa, Mycobacterium
FFVCSTHDWILFFTTQGRVYRAKAY

SEQ ID NO: 1065200 - protein, 17 aa, Mycobacterium
FFYDVWATRSTSHPEWN

SEQ ID NO: 1065201 - protein, 18 aa, Mycobacterium
FGDMPNDVPMLLRAGHGV

SEQ ID NO: 1065202 - protein, 18 aa, Mycobacterium
FGFKYGLPMDADIVMDVR

SEQ ID NO: 1065203 - protein, 18 aa, Mycobacterium
FGGNPVCTAAALAVLRVL

SEQ ID NO: 1065204 - protein, 21 aa, Mycobacterium
FGGYVALPAYLAARGIPRVRR

SEQ ID NO: 1065205 - protein, 17 aa, Mycobacterium
FGIPGVGNIRFVQALAA

SEQ ID NO: 1065206 - protein, 18 aa, Mycobacterium
FGLLAHLFRGQTNCVGLG

SEQ ID NO: 1065207 - protein, 17 aa, Mycobacterium
FGLLRLSEHMAATAGQP

SEQ ID NO: 1065208 - protein, 27 aa, Mycobacterium
FGMTNFQAMNFLGESPVAIGPAHQAKA

SEQ ID NO: 1065209 - protein, 28 aa, Mycobacterium
FGRLADRGWLVLALPHKLLRSWCPTTLA

SEQ ID NO: 1065210 - protein, 20 aa, Mycobacterium
FGSGQMQLPFVLQSAEVMKA

SEQ ID NO: 1065211 - protein, 31 aa, Mycobacterium
FGTAFEGTPPGLPPLVFCTDATAFPTMRTPP

SEQ ID NO: 1065212 - protein, 19 aa, Mycobacterium
FGVWPHLSVCWALGWICTF

SEQ ID NO: 1065213 - protein, 20 aa, Mycobacterium
FIEHDGQGYRLIFENDNITE

SEQ ID NO: 1065214 - protein, 26 aa, Mycobacterium
FIMSDCDQLMPMYLRFVKGVVDAEDM

SEQ ID NO: 1065215 - protein, 17 aa, Mycobacterium
FIPLFSGFEQQFIGGFC

SEQ ID NO: 1065216 - protein, 17 aa, Mycobacterium
FIQPFRADEWRLYNQTS

SEQ ID NO: 1065217 - protein, 18 aa, Mycobacterium
FITEARGCWLTDADGRRY

SEQ ID NO: 1065218 - protein, 19 aa, Mycobacterium
FKIANGEKLELIKDPIPCG

SEQ ID NO: 1065219 - protein, 17 aa, Mycobacterium
FLDKKPRFIKLTGAKVS

SEQ ID NO: 1065220 - protein, 22 aa, Mycobacterium
FLDKQLRLFKCGKVTTARHGLF

SEQ ID NO: 1065221 - protein, 24 aa, Mycobacterium
FLEHSRIIHFRAIDEFWIGSADMM

SEQ ID NO: 1065222 - protein, 23 aa, Mycobacterium
FLERRLRETFGFEGSPIRINVRV

SEQ ID NO: 1065223 - protein, 20 aa, Mycobacterium
FLETDLFNQGVRPAINVGVS

SEQ ID NO: 1065224 - protein, 20 aa, Mycobacterium
FLEYQPLEASAWLVAGIEAA

SEQ ID NO: 1065225 - protein, 23 aa, Mycobacterium
FLLLGYQRCRVHYGLVSCDRSTG

SEQ ID NO: 1065226 - protein, 17 aa, Mycobacterium
FLLPPNWTQLGALIGHT

SEQ ID NO: 1065227 - protein, 21 aa, Mycobacterium
FLMSRGPGSTPLWGAAEAWIS

SEQ ID NO: 1065228 - protein, 19 aa, Mycobacterium
FLQFAVIDALLVLQADSTP

SEQ ID NO: 1065229 - protein, 20 aa, Mycobacterium
FLQGRIGFPAIVATIADVLQ

SEQ ID NO: 1065230 - protein, 24 aa, Mycobacterium
FLRMEADWEASYLLSLRAAWQADN

SEQ ID NO: 1065231 - protein, 19 aa, Mycobacterium
FLTVMLLPNAIAEIGGSRL

SEQ ID NO: 1065232 - protein, 17 aa, Mycobacterium
FLVQHRSRLASEKNGVM

SEQ ID NO: 1065233 - protein, 22 aa, Mycobacterium
FMSVMYAYDLPATGTPAVLAEP

SEQ ID NO: 1065234 - protein, 17 aa, Mycobacterium
FMVLRDPAADISLIVTC

SEQ ID NO: 1065235 - protein, 31 aa, Mycobacterium
FNGTVATYLHKRAADLPPAVGVLVEYGAGTD

SEQ ID NO: 1065236 - protein, 17 aa, Mycobacterium
FPAVLQDVSLVVSTQVP

SEQ ID NO: 1065237 - protein, 17 aa, Mycobacterium
FPAYLDPLRQSLPGKAI

SEQ ID NO: 1065238 - protein, 19 aa, Mycobacterium
FPKGPACLIGLWDQRCRTP

SEQ ID NO: 1065239 - protein, 21 aa, Mycobacterium
FPRLMVYRGPRRKGVRYFGPY

SEQ ID NO: 1065240 - protein, 23 aa, Mycobacterium
FPTCPVVRLLWKVIDLAAAVEGA

SEQ ID NO: 1065241 - protein, 35 aa, Mycobacterium
FPVGGMSVSWLPFYHDMGLILGVCVPILGGCPAVL

SEQ ID NO: 1065242 - protein, 19 aa, Mycobacterium
FPVLLGGAALTRSYVENDL

SEQ ID NO: 1065243 - protein, 20 aa, Mycobacterium
FQAVLDVSLAVLPRSVTAFI

SEQ ID NO: 1065244 - protein, 23 aa, Mycobacterium
FQDDFIEWSVSFSQKPFPSPCGI

SEQ ID NO: 1065245 - protein, 20 aa, Mycobacterium
FQGTVKSAVAFGALLSKGIG

SEQ ID NO: 1065246 - protein, 18 aa, Mycobacterium
FQILPWATTAGHHHSARM

SEQ ID NO: 1065247 - protein, 24 aa, Mycobacterium
FQSLIAPYVAPSMEYKLLPQFRGR

SEQ ID NO: 1065248 - protein, 20 aa, Mycobacterium
FRADSVRFFASARSQGRKLA

SEQ ID NO: 1065249 - protein, 17 aa, Mycobacterium
FRDAEALTFPLLSDHDC

SEQ ID NO: 1065250 - protein, 21 aa, Mycobacterium
FREHTSWALASAILEFADLED

SEQ ID NO: 1065251 - protein, 20 aa, Mycobacterium
FRGCEGDVLLMLLDANGIEC

SEQ ID NO: 1065252 - protein, 23 aa, Mycobacterium
FRIDDAFTCWMYSKGDRLEHNLP

SEQ ID NO: 1065253 - protein, 18 aa, Mycobacterium
FRQLLSGRDFAVDDVVAT

SEQ ID NO: 1065254 - protein, 17 aa, Mycobacterium
FRRHSYLSPLATGVITG

SEQ ID NO: 1065255 - protein, 21 aa, Mycobacterium
FRRVFSWLPAQFASQNDAPVG

SEQ ID NO: 1065256 - protein, 20 aa, Mycobacterium
FRVSRSGWYGLDPVAADLFI

SEQ ID NO: 1065257 - protein, 21 aa, Mycobacterium
FSDVFVAWLLEAGHDLQRIDD

SEQ ID NO: 1065258 - protein, 25 aa, Mycobacterium
FSFHIEHWSLVVEIYRTRLAGLVPQ

SEQ ID NO: 1065259 - protein, 34 aa, Mycobacterium
FSGFDPWLPSLGNPLSFLSPFNIAFALGTPMDIG

SEQ ID NO: 1065260 - protein, 22 aa, Mycobacterium
FSITLLKGHSWTTPLKAACRPA

SEQ ID NO: 1065261 - protein, 19 aa, Mycobacterium
FSLHVKATMMKVSHPIVFG

SEQ ID NO: 1065262 - protein, 20 aa, Mycobacterium
FSPAVHSRVRRWLVDGDFDV

SEQ ID NO: 1065263 - protein, 22 aa, Mycobacterium
FSSAFYGPFREAVSCSLSGDRR

SEQ ID NO: 1065264 - protein, 26 aa, Mycobacterium
FSSNNRPFLPPPAPRALLALLTGPPT

SEQ ID NO: 1065265 - protein, 28 aa, Mycobacterium
FSSRKKDFIPPAPRYTTGVLAKYVKLVS

SEQ ID NO: 1065266 - protein, 28 aa, Mycobacterium
FSTNTFPSWPLAHPFRRIAHNGEINTVT

SEQ ID NO: 1065267 - protein, 25 aa, Mycobacterium
FTEFVPLPFVHQNSPLYLAGAARPG

SEQ ID NO: 1065268 - protein, 19 aa, Mycobacterium
FTEVRPWKDQSANGRLRRA

SEQ ID NO: 1065269 - protein, 17 aa, Mycobacterium
FTGDGIMAIFGAPTALE

SEQ ID NO: 1065270 - protein, 26 aa, Mycobacterium
FTLPETLWLVVRGFSNLLFAYPTLDR

SEQ ID NO: 1065271 - protein, 20 aa, Mycobacterium
FTQLLYDDHIGKVSLIGAGM

SEQ ID NO: 1065272 - protein, 28 aa, Mycobacterium
FTSDIKNLLPMLAVFKPTVVVSVPRVFE

SEQ ID NO: 1065273 - protein, 33 aa, Mycobacterium
FVAGFIGSPVMNFFPAKLTPNGLTLPLGELNLS

SEQ ID NO: 1065274 - protein, 24 aa, Mycobacterium
FVDNYNLNMAIPWIAAERGFIDAV

SEQ ID NO: 1065275 - protein, 17 aa, Mycobacterium
FVEQPAYCRAAQVGAAV

SEQ ID NO: 1065276 - protein, 18 aa, Mycobacterium
FVGAFKIDPTMDLQRDAI

SEQ ID NO: 1065277 - protein, 18 aa, Mycobacterium
FVGFIDFLVRDGEQYRVV

SEQ ID NO: 1065278 - protein, 19 aa, Mycobacterium
FVGHLFVAIAGASLTRVRR

SEQ ID NO: 1065279 - protein, 25 aa, Mycobacterium
FVGVTAYDYMLTLAGRLRPEDLDAY

SEQ ID NO: 1065280 - protein, 25 aa, Mycobacterium
FVIDGKMFIIGRIKDLLIVYGRNHS

SEQ ID NO: 1065281 - protein, 25 aa, Mycobacterium
FVLRELTIPILTPGSTPLRVLHISD

SEQ ID NO: 1065282 - protein, 19 aa, Mycobacterium
FVNALQPVEWRYVNDPSWV

SEQ ID NO: 1065283 - protein, 23 aa, Mycobacterium
FVPATMFCEFLYCQLFSGSAAGS

SEQ ID NO: 1065284 - protein, 17 aa, Mycobacterium
FVPELFNALNAKTTFSS

SEQ ID NO: 1065285 - protein, 18 aa, Mycobacterium
FVPKVRIEVVIDDSIAEK

SEQ ID NO: 1065286 - protein, 24 aa, Mycobacterium
FVQTRLRENVLLQTKVCQPGNAGP

SEQ ID NO: 1065287 - protein, 30 aa, Mycobacterium
FVRLCDAFGIPLVVIVDVPGYLPGVDQEWG

SEQ ID NO: 1065288 - protein, 18 aa, Mycobacterium
FVRPVAIDLNYIPLVGSV

SEQ ID NO: 1065289 - protein, 20 aa, Mycobacterium
FVRSEGCAMVLLKRLPDALR

SEQ ID NO: 1065290 - protein, 26 aa, Mycobacterium
FVRTETIPEFLAALQTPRRVLIMVKA

SEQ ID NO: 1065291 - protein, 26 aa, Mycobacterium
FVSARALGCTIKLLFICERITAADGQ

SEQ ID NO: 1065292 - protein, 25 aa, Mycobacterium
FYVPEHTHMPLPLRPHYLVTDEYHC

SEQ ID NO: 1065293 - protein, 22 aa, Mycobacterium
GAAILAVLLGPEVALLDGPGTV

SEQ ID NO: 1065294 - protein, 27 aa, Mycobacterium
GAAILHAMLELPLYRTLVAARGNWQEV

SEQ ID NO: 1065295 - protein, 17 aa, Mycobacterium
GAAIWHMAWSDKDDAID

SEQ ID NO: 1065296 - protein, 20 aa, Mycobacterium
GAAQLLMKRFPDPSSPDVQA

SEQ ID NO: 1065297 - protein, 18 aa, Mycobacterium
GAAWLARNYSDTGLLGSI

SEQ ID NO: 1065298 - protein, 35 aa, Mycobacterium
GADTPIAVLSRRPRMLYDYFHQLFAQVTNPPLDAI

SEQ ID NO: 1065299 - protein, 28 aa, Mycobacterium
GADVEAVLPTVWPIVQAVAECGADAALE

SEQ ID NO: 1065300 - protein, 30 aa, Mycobacterium
GAEHAVLHLLYARFWHKVLYDLGHVSSREP

SEQ ID NO: 1065301 - protein, 18 aa, Mycobacterium
GAERLFDLAYLPGAADSD

SEQ ID NO: 1065302 - protein, 26 aa, Mycobacterium
GAGGLLLPVYVRRLLNYHSMRNAQYC

SEQ ID NO: 1065303 - protein, 28 aa, Mycobacterium
GAGISRPTFYFYFPSKNAVLLSLLDDLN

SEQ ID NO: 1065304 - protein, 18 aa, Mycobacterium
GAGLGKDVLLLTDGRFSG

SEQ ID NO: 1065305 - protein, 22 aa, Mycobacterium
GAHLRPWSIPGHRIVELDWDQS

SEQ ID NO: 1065306 - protein, 20 aa, Mycobacterium
GAKEILCIRVLGGSSRRYAS

SEQ ID NO: 1065307 - protein, 36 aa, Mycobacterium
GAKTTTYLIPVNHLPLTLPLRYLGWSDALVDQIDAV

SEQ ID NO: 1065308 - protein, 17 aa, Mycobacterium
GAKYRGEFEQRLKVVLD

SEQ ID NO: 1065309 - protein, 28 aa, Mycobacterium
GALEQGPMDLVWSPIPLSSDGHGGGLPS

SEQ ID NO: 1065310 - protein, 21 aa, Mycobacterium
GALIRIGHDASLLDLLPGGAT

SEQ ID NO: 1065311 - protein, 18 aa, Mycobacterium
GALPLLAPMSEVAGRLSA

SEQ ID NO: 1065312 - protein, 17 aa, Mycobacterium
GALWLRTSAFGDDKDRV

SEQ ID NO: 1065313 - protein, 30 aa, Mycobacterium
GAMVGPFTYLRPGTVLGTKGKLGAFVETKN

SEQ ID NO: 1065314 - protein, 27 aa, Mycobacterium
GANLNSTLLALLPLVGVWRGEGEGRGP

SEQ ID NO: 1065315 - protein, 20 aa, Mycobacterium
GAPALWPGLPVRPVKGEVLR

SEQ ID NO: 1065316 - protein, 17 aa, Mycobacterium
GAPRGLVVVPTRELCLQ

SEQ ID NO: 1065317 - protein, 19 aa, Mycobacterium
GAPTLHRLQWIIDQLLTTY

SEQ ID NO: 1065318 - protein, 22 aa, Mycobacterium
GAPVIASIARKLGALTVGVVTR

SEQ ID NO: 1065319 - protein, 25 aa, Mycobacterium
GAREHALLLALSRDPQVKGLVVAPG

SEQ ID NO: 1065320 - protein, 25 aa, Mycobacterium
GARKSPRLWIVTRGAQQLNAGESVT

SEQ ID NO: 1065321 - protein, 25 aa, Mycobacterium
GARPQVLLLPLGPLAEHNIRATFAT

SEQ ID NO: 1065322 - protein, 17 aa, Mycobacterium
GARVVVVAPYEGPLRDA

SEQ ID NO: 1065323 - protein, 17 aa, Mycobacterium
GASFIDFTPLPELVELQ

SEQ ID NO: 1065324 - protein, 22 aa, Mycobacterium
GASNWYTEFARLVRLMDKDVHY

SEQ ID NO: 1065325 - protein, 24 aa, Mycobacterium
GAVEVPRLLKPLLPGGIHVDHKSV

SEQ ID NO: 1065326 - protein, 19 aa, Mycobacterium
GAVPSVFHRHRGDPRGHLP

SEQ ID NO: 1065327 - protein, 22 aa, Mycobacterium
GAYAPLPWLPDEVCQQALTSIV

SEQ ID NO: 1065328 - protein, 21 aa, Mycobacterium
GAYFKGGINPVTVWVSMEYVR

SEQ ID NO: 1065329 - protein, 19 aa, Mycobacterium
GCATPARVFKGTRMAGRMG

SEQ ID NO: 1065330 - protein, 21 aa, Mycobacterium
GCGPMRALISVCAAGGQGVAV

SEQ ID NO: 1065331 - protein, 27 aa, Mycobacterium
GCTTYKWETFLTSELPKWLSANRSVKS

SEQ ID NO: 1065332 - protein, 26 aa, Mycobacterium
GDDHTTYFVPMPPLLEKRGLQSFPEV

SEQ ID NO: 1065333 - protein, 17 aa, Mycobacterium
GDEFVALILGKITHTEL

SEQ ID NO: 1065334 - protein, 24 aa, Mycobacterium
GDGLFKLLSLSMFELAKPVSDLVD

SEQ ID NO: 1065335 - protein, 25 aa, Mycobacterium
GDGWIKLIGDWDRPPDRRSCPVVVG

SEQ ID NO: 1065336 - protein, 18 aa, Mycobacterium
GDHARIAAWRREASLRRT

SEQ ID NO: 1065337 - protein, 17 aa, Mycobacterium
GDLLERLAVSGATLLSS

SEQ ID NO: 1065338 - protein, 22 aa, Mycobacterium
GDPKRQVRCVYVAIGQKGTTIA

SEQ ID NO: 1065339 - protein, 18 aa, Mycobacterium
GDPYGGWSEPLFTTVLAG

SEQ ID NO: 1065340 - protein, 17 aa, Mycobacterium
GDQLDALCALGLQYRVA

SEQ ID NO: 1065341 - protein, 20 aa, Mycobacterium
GDRVLLCLPDSPDLVQLLLA

SEQ ID NO: 1065342 - protein, 17 aa, Mycobacterium
GDRVVCRPFAGSAPRAT

SEQ ID NO: 1065343 - protein, 35 aa, Mycobacterium
GDTVRRLARLHTPLPLLAFTAWPEVRSQLAMTWGT

SEQ ID NO: 1065344 - protein, 26 aa, Mycobacterium
GDVGDVILGERLILSSGFVAVTVVVK

SEQ ID NO: 1065345 - protein, 26 aa, Mycobacterium
GDYRGQRVTVYFYPAALTPGCTKQAC

SEQ ID NO: 1065346 - protein, 27 aa, Mycobacterium
GEACARSIAWYLAMARRSQGNEDAAVA

SEQ ID NO: 1065347 - protein, 30 aa, Mycobacterium; identical to SEQ ID NO: 114672

SEQ ID NO: 1065348 - protein, 17 aa, Mycobacterium
GEFAVHLALAAGGKCFY

SEQ ID NO: 1065349 - protein, 21 aa, Mycobacterium
GEFFLVYQPIVRLNDKRFIGV

SEQ ID NO: 1065350 - protein, 17 aa, Mycobacterium
GEFWVPHRLGGGAPSLI

SEQ ID NO: 1065351 - protein, 17 aa, Mycobacterium
GEGAFPPDRVKILSTGG

SEQ ID NO: 1065352 - protein, 23 aa, Mycobacterium
GEHTTRILLAKNPAGWQEALSMV

SEQ ID NO: 1065353 - protein, 18 aa, Mycobacterium
GEITALKALIQLCADQDL

SEQ ID NO: 1065354 - protein, 19 aa, Mycobacterium
GELFNIPLTAHFLGGAVIG

SEQ ID NO: 1065355 - protein, 22 aa, Mycobacterium
GELSRVMLALEVVLATSAAGTT

SEQ ID NO: 1065356 - protein, 19 aa, Mycobacterium
GEMMLWVPDQWAISVESPF

SEQ ID NO: 1065357 - protein, 21 aa, Mycobacterium
GEPRSKLLRRLIEVGAGILER

SEQ ID NO: 1065358 - protein, 24 aa, Mycobacterium
GEQLAALYRGPWRAIVKFTVYREC

SEQ ID NO: 1065359 - protein, 21 aa, Mycobacterium
GERPRLFVVTRNAASIKTGDL

SEQ ID NO: 1065360 - protein, 24 aa, Mycobacterium
GERSSHTWFVLRELLGYQNVKNYD

SEQ ID NO: 1065361 - protein, 25 aa, Mycobacterium
GESRFHLRLAQLAGNALPAWRDVVA

SEQ ID NO: 1065362 - protein, 30 aa, Mycobacterium
GETNRAWRLYRRLGFMDIIRRHYFAGDPRA

SEQ ID NO: 1065363 - protein, 22 aa, Mycobacterium
GEVLVPFVGAIVKLVSLDDGIV

SEQ ID NO: 1065364 - protein, 18 aa, Mycobacterium
GFCSTSLMVDYPVFRRTV

SEQ ID NO: 1065365 - protein, 32 aa, Mycobacterium
GFERRGRWNVPRKLTTFSLWGSGVLDLRYADF

SEQ ID NO: 1065366 - protein, 17 aa, Mycobacterium
GFFLSLVGSLGAMFGVC

SEQ ID NO: 1065367 - protein, 22 aa, Mycobacterium
GFLDERALFLGQWGLRGVRGGA

SEQ ID NO: 1065368 - protein, 31 aa, Mycobacterium
GFLLSLIYNSYITRFFWFIFTEISQATGCQL

SEQ ID NO: 1065369 - protein, 30 aa, Mycobacterium
GFNFYHKHFGLPYAFGKYDQLFVPEFNAGA

SEQ ID NO: 1065370 - protein, 30 aa, Mycobacterium
GFSVARRLALLLTFKRCLPAIGPSAMRSTS

SEQ ID NO: 1065371 - protein, 29 aa, Mycobacterium
GGARALEWIIGHPDQVRAGLLLAVGVRAT

SEQ ID NO: 1065372 - protein, 28 aa, Mycobacterium
GGAVLLVYDPLFYSKKLRHVLVRHEQGA

SEQ ID NO: 1065373 - protein, 26 aa, Mycobacterium
GGCAGLRYNLFFDDRTLDGDLTAEFG

SEQ ID NO: 1065374 - protein, 25 aa, Mycobacterium
GGCWRWLAGYYWPPVHGRCLAWWVG

SEQ ID NO: 1065375 - protein, 22 aa, Mycobacterium
GGEAVMIWTLRLQLGGMIERMI

SEQ ID NO: 1065376 - protein, 26 aa, Mycobacterium
GGEEALYLRPFIFATEPGLGVRPAKQ

SEQ ID NO: 1065377 - protein, 26 aa, Mycobacterium
GGFDCSGLVMWAYQQAGIALPHSSQA

SEQ ID NO: 1065378 - protein, 17 aa, Mycobacterium
GGGPGPAISVFAPSFDP

SEQ ID NO: 1065379 - protein, 19 aa, Mycobacterium
GGGWYVDLVLISDSDLAPA

SEQ ID NO: 1065380 - protein, 24 aa, Mycobacterium
GGHLSRAWLVAAIGLGVDRVVWMS

SEQ ID NO: 1065381 - protein, 23 aa, Mycobacterium
GGHPRGRVTLTPTTAYHADASPD

SEQ ID NO: 1065382 - protein, 19 aa, Mycobacterium
GGKFILVLLYFALDLVVES

SEQ ID NO: 1065383 - protein, 20 aa, Mycobacterium
GGKTFPLPNPFLVMATQNPI

SEQ ID NO: 1065384 - protein, 23 aa, Mycobacterium
GGLAGRIAVVIGAGAMGALSSSY

SEQ ID NO: 1065385 - protein, 21 aa, Mycobacterium
GGLVMLARITALRSNPDGNRT

SEQ ID NO: 1065386 - protein, 22 aa, Mycobacterium
GGPAALPPLPPSLPRRQSQTHF

SEQ ID NO: 1065387 - protein, 27 aa, Mycobacterium
GGPATIVPMFLLYDYTFLPTGADSKAK

SEQ ID NO: 1065388 - protein, 24 aa, Mycobacterium
GGPERLLLLAVVVALRDVRSDGEK

SEQ ID NO: 1065389 - protein, 27 aa, Mycobacterium
GGRFHGLPHPTILAAARLLGVDEVWAV

SEQ ID NO: 1065390 - protein, 24 aa, Mycobacterium
GGRGLLVLLNTLRLPLTGVPACTV

SEQ ID NO: 1065391 - protein, 17 aa, Mycobacterium
GGRLVVELTPDEAAALS

SEQ ID NO: 1065392 - protein, 29 aa, Mycobacterium
GGSTWRDPRLWWQLRNPFTPSWGESYIEI

SEQ ID NO: 1065393 - protein, 20 aa, Mycobacterium
GGTPTAFDRVLATRFGVNAA

SEQ ID NO: 1065394 - protein, 22 aa, Mycobacterium
GHAVVLHPGPMLRGMEIASSVA

SEQ ID NO: 1065395 - protein, 23 aa, Mycobacterium
GHDASLLDLLPGGATAVITIRTA

SEQ ID NO: 1065396 - protein, 29 aa, Mycobacterium
GHDTEAIADLLRLLGPLTAADAAAWSNGC

SEQ ID NO: 1065397 - protein, 20 aa, Mycobacterium
GHEESLVVELANLAKARGVD

SEQ ID NO: 1065398 - protein, 30 aa, Mycobacterium
GHGNRCWLGRALCWLPRRWAEHPTVSTLPS

SEQ ID NO: 1065399 - protein, 24 aa, Mycobacterium
GHLDGFLYLDYLIGRHARSAKRAI

SEQ ID NO: 1065400 - protein, 19 aa, Mycobacterium
GHLGLVNIAIWADPQRSMA

SEQ ID NO: 1065401 - protein, 22 aa, Mycobacterium
GHPIFGVKRGLLDKLIPVKRIT

SEQ ID NO: 1065402 - protein, 24 aa, Mycobacterium
GHSVLRAFTYPFDNVRVLIVGQDP

SEQ ID NO: 1065403 - protein, 24 aa, Mycobacterium
GHTDGAGFLIRIQRHCRPSALGGP

SEQ ID NO: 1065404 - protein, 24 aa, Mycobacterium
GHTRRAVVRLLLESGSITAGEISD

SEQ ID NO: 1065405 - protein, 20 aa, Mycobacterium
GHTVVWIHDTTLRTEPLAFS

SEQ ID NO: 1065406 - protein, 26 aa, Mycobacterium
GHVRFSRETLYLRFMSARAPSDELMH

SEQ ID NO: 1065407 - protein, 18 aa, Mycobacterium
GIAPPRDLVFAFVADEEH

SEQ ID NO: 1065408 - protein, 26 aa, Mycobacterium
GIDATATAALWFALETDLPVLVDADG

SEQ ID NO: 1065409 - protein, 18 aa, Mycobacterium
GIELISRVLLGSSVLPGN

SEQ ID NO: 1065410 - protein, 26 aa, Mycobacterium
GIGGVRVIRVCTFSAGLPAPEDSTGT

SEQ ID NO: 1065411 - protein, 21 aa, Mycobacterium
GIGRHMHMDPFLPNEGAPGRG

SEQ ID NO: 1065412 - protein, 18 aa, Mycobacterium
GIGTVRFQIGSDGKLKTL

SEQ ID NO: 1065413 - protein, 20 aa, Mycobacterium
GIIDITIPRGLWTPQIKIPI

SEQ ID NO: 1065414 - protein, 20 aa, Mycobacterium
GILHLLRRYGVEIAGTHVVI

SEQ ID NO: 1065415 - protein, 21 aa, Mycobacterium
GINWGPWAEVGRAQFFAGLGV

SEQ ID NO: 1065416 - protein, 26 aa, Mycobacterium
GIRCLSAGAIIHTGVFRASYTDAVVH

SEQ ID NO: 1065417 - protein, 31 aa, Mycobacterium
GISHAADRPWRLWLPGRPEVSTYRRSPRAPA

SEQ ID NO: 1065418 - protein, 25 aa, Mycobacterium
GISRPTFYFYFASKEAVLLTLLDRV

SEQ ID NO: 1065419 - protein, 17 aa, Mycobacterium
GITPALARIYRASGQDV

SEQ ID NO: 1065420 - protein, 23 aa, Mycobacterium
GIVGPHFSFSWYRGSPIGRERKT

SEQ ID NO: 1065421 - protein, 24 aa, Mycobacterium
GIVRPDLVIGWWVAPTITILAHGI

SEQ ID NO: 1065422 - protein, 17 aa, Mycobacterium
GIWSESVFPSLGTWSGS

SEQ ID NO: 1065423 - protein, 19 aa, Mycobacterium
GKALKFYASVRMDVRRIET

SEQ ID NO: 1065424 - protein, 38 aa, Mycobacterium
GKDIIRFHAVYWPAFLMSAGIELPRRIFAHGFLHNHGE

SEQ ID NO: 1065425 - protein, 25 aa, Mycobacterium
GKDLRPEWTIPPREEFYFGYSDKDI

SEQ ID NO: 1065426 - protein, 24 aa, Mycobacterium
GKDLSVMDFIWEVLGRIGIGRKDA

SEQ ID NO: 1065427 - protein, 22 aa, Mycobacterium
GKGMRSLQRLLPMPSYRTVSNF

SEQ ID NO: 1065428 - protein, 24 aa, Mycobacterium
GKGSPEWWVVNVKPGRVLFELSYP

SEQ ID NO: 1065429 - protein, 35 aa, Mycobacterium
GKKFLSEEYLKALTPLVLAIWYMDDGSFTVGSKRV

SEQ ID NO: 1065430 - protein, 25 aa, Mycobacterium
GKNNSGLIVLLTFGTGIGSAVIHNG

SEQ ID NO: 1065431 - protein, 17 aa, Mycobacterium
GKRHRLLAPGCRGEPGY

SEQ ID NO: 1065432 - protein, 24 aa, Mycobacterium
GKSVFLKSLIGLLRPERGSILIDG

SEQ ID NO: 1065433 - protein, 19 aa, Mycobacterium
GKTLRLVGRSSGLSRWQSR

SEQ ID NO: 1065434 - protein, 22 aa, Mycobacterium
GKTNLIEALWYSTTLSSHRVGT

SEQ ID NO: 1065435 - protein, 23 aa, Mycobacterium
GKTTVLARRIAYLIAARSVGVSQ

SEQ ID NO: 1065436 - protein, 24 aa, Mycobacterium
GKVDVYNMGWYKYLDSRATDEQRR

SEQ ID NO: 1065437 - protein, 22 aa, Mycobacterium
GKVFNFGYPEHAELLRATGVEV

SEQ ID NO: 1065438 - protein, 22 aa, Mycobacterium
GKVRRVRLLPVDPPATRQAVDA

SEQ ID NO: 1065439 - protein, 18 aa, Mycobacterium
GLAEIQLPDLQPGSSIMP

SEQ ID NO: 1065440 - protein, 18 aa, Mycobacterium
GLAFKSGNAALLRGSSSA

SEQ ID NO: 1065441 - protein, 28 aa, Mycobacterium
GLCDTGRWRVPLILRLDPKIGSDDIRAV

SEQ ID NO: 1065442 - protein, 23 aa, Mycobacterium
GLDYQIWQCPVVLLADVRSVGVQ

SEQ ID NO: 1065443 - protein, 18 aa, Mycobacterium
GLELRPRKLREAAVLWER

SEQ ID NO: 1065444 - protein, 24 aa, Mycobacterium
GLESVYRLRLALPQLDFAALTLGR

SEQ ID NO: 1065445 - protein, 30 aa, Mycobacterium
GLEYIVAFMGALQAGLIAVPLPAPQFGIHD

SEQ ID NO: 1065446 - protein, 25 aa, Mycobacterium
GLGGFAGLFALRSGYREPVLAASTD

SEQ ID NO: 1065447 - protein, 25 aa, Mycobacterium
GLGLDFLRHIERCAVLVHVVDCTSV

SEQ ID NO: 1065448 - protein, 18 aa, Mycobacterium
GLGVQGYLLALRYLAEIA

SEQ ID NO: 1065449 - protein, 23 aa, Mycobacterium
GLHNLLAYQWAHPGKQLLFMGQE

SEQ ID NO: 1065450 - protein, 26 aa, Mycobacterium
GLIDPEAWAFVWVVDPPLFERADEAT

SEQ ID NO: 1065451 - protein, 18 aa, Mycobacterium
GLKPSRGRLPLDSELRRL

SEQ ID NO: 1065452 - protein, 26 aa, Mycobacterium
GLKPVHRRVLYAMLDSGFRPDRSHAK

SEQ ID NO: 1065453 - protein, 20 aa, Mycobacterium
GLLAGHYRADRFWSSQLLDD

SEQ ID NO: 1065454 - protein, 25 aa, Mycobacterium
GLLAGSALLVVKRGPNAGSRFLLDQ

SEQ ID NO: 1065455 - protein, 19 aa, Mycobacterium
GLLGDELRHLGRSNQVVAT

SEQ ID NO: 1065456 - protein, 25 aa, Mycobacterium
GLLGELDIRLLPEMSNREKIPYILR

SEQ ID NO: 1065457 - protein, 20 aa, Mycobacterium
GLMPARWGTGFILGTNKFGP

SEQ ID NO: 1065458 - protein, 23 aa, Mycobacterium
GLMTYRQWYPGKEFARVTAREIR

SEQ ID NO: 1065459 - protein, 17 aa, Mycobacterium
GLPAMRIGVVDQGSDSI

SEQ ID NO: 1065460 - protein, 27 aa, Mycobacterium
GLPDNLRFKLVEPLRLLFKDEVRAVGR

SEQ ID NO: 1065461 - protein, 19 aa, Mycobacterium
GLPVLGICRGAQLLNIALG

SEQ ID NO: 1065462 - protein, 24 aa, Mycobacterium
GLPVPVTSRHTLLLGPPGTGKTSV

SEQ ID NO: 1065463 - protein, 21 aa, Mycobacterium
GLQIMAPALADDRLYRVGAAY

SEQ ID NO: 1065464 - protein, 22 aa, Mycobacterium
GLQSFPEVLKRLSPRLVGWGSG

SEQ ID NO: 1065465 - protein, 33 aa, Mycobacterium
GLRKLVAQEWFRFSWFFLVIRRDPKGLREWIRL

SEQ ID NO: 1065466 - protein, 27 aa, Mycobacterium
GLSGNVEYFLWLRAQTDLELSTDGLEA

SEQ ID NO: 1065467 - protein, 25 aa, Mycobacterium
GLSLSPTLIFDYPNSAALVGYIRTE

SEQ ID NO: 1065468 - protein, 27 aa, Mycobacterium
GLTGVQRVFFGWAQMWRSKSRDAETIR

SEQ ID NO: 1065469 - protein, 27 aa, Mycobacterium
GLVDRALIAAYAGGLAPILCLTKTDLA

SEQ ID NO: 1065470 - protein, 18 aa, Mycobacterium
GLVYDMLRWCGHSRLSNT

SEQ ID NO: 1065471 - protein, 19 aa, Mycobacterium
GMAASFARRIARNTQLLLL

SEQ ID NO: 1065472 - protein, 25 aa, Mycobacterium
GMAKGAGMLAPSLATMLCVLTTDAV

SEQ ID NO: 1065473 - protein, 19 aa, Mycobacterium
GMATLNPLATQIIGQLSSL

SEQ ID NO: 1065474 - protein, 23 aa, Mycobacterium
GMESLLGAIYLHHGIEVARQVIL

SEQ ID NO: 1065475 - protein, 18 aa, Mycobacterium
GMHALIWRHGTIIAHAAV

SEQ ID NO: 1065476 - protein, 19 aa, Mycobacterium
GMHPALLDAVLHALGLAIE

SEQ ID NO: 1065477 - protein, 34 aa, Mycobacterium
GMHRKPIVMLDPWGHYEGLWAWLHGLIDSGYVSP

SEQ ID NO: 1065478 - protein, 18 aa, Mycobacterium
GMLQRQVELAPAALGFHY

SEQ ID NO: 1065479 - protein, 25 aa, Mycobacterium
GMQSVDQLRRWLDSLLSVTAGKLRG

SEQ ID NO: 1065480 - protein, 30 aa, Mycobacterium
GMRDIRKHIAWYLHGFPAGSELRNALALVK

SEQ ID NO: 1065481 - protein, 18 aa, Mycobacterium
GMSNGGFMSNKLACDRAD

SEQ ID NO: 1065482 - protein, 24 aa, Mycobacterium
GMVRTALFNWAYARHTGGTFVLRI

SEQ ID NO: 1065483 - protein, 17 aa, Mycobacterium
GMVWRYSDYFIVGREQC

SEQ ID NO: 1065484 - protein, 20 aa, Mycobacterium
GNGMLLSKHIRLIAAFDHRH

SEQ ID NO: 1065485 - protein, 20 aa, Mycobacterium
GNIIGRPMGWESLLTEPLQA

SEQ ID NO: 1065486 - protein, 22 aa, Mycobacterium
GNLALVPLSLYFAEGKVKVELA

SEQ ID NO: 1065487 - protein, 24 aa, Mycobacterium
GNLGSAVFALYDPPAPLAMDVHPG

SEQ ID NO: 1065488 - protein, 17 aa, Mycobacterium
GNLLAQINHPHPTSPPQ

SEQ ID NO: 1065489 - protein, 22 aa, Mycobacterium
GNPVELLVIPGPHDDWFIDPDV

SEQ ID NO: 1065490 - protein, 27 aa, Mycobacterium
GNTPVIWRGPMLHRALQQFLSDVYWGD

SEQ ID NO: 1065491 - protein, 19 aa, Mycobacterium
GNVVIVYEPVWAIGTGRVA

SEQ ID NO: 1065492 - protein, 24 aa, Mycobacterium
GNYRHPIMLYFHGGGFVIGTTSIP

SEQ ID NO: 1065493 - protein, 20 aa, Mycobacterium
GPALLLGSRGRRLDVRQART

SEQ ID NO: 1065494 - protein, 24 aa, Mycobacterium
GPATLTDLVFAWRACRAVKSNAIV

SEQ ID NO: 1065495 - protein, 21 aa, Mycobacterium
GPDTGLLVRYRAIVSNTLTTA

SEQ ID NO: 1065496 - protein, 17 aa, Mycobacterium
GPEHAWLRETGRAEYQP

SEQ ID NO: 1065497 - protein, 22 aa, Mycobacterium
GPFDLTLMPIGAYHPAWVDILL

SEQ ID NO: 1065498 - protein, 22 aa, Mycobacterium
GPFYDGAVFHRVIQGFMIQGGD

SEQ ID NO: 1065499 - protein, 26 aa, Mycobacterium
GPGHPTPGWWDWIAGPGAPIDTNRWC

SEQ ID NO: 1065500 - protein, 21 aa, Mycobacterium
GPIEALPIAAFSMMRAMSTRN

SEQ ID NO: 1065501 - protein, 17 aa, Mycobacterium
GPIHIGGTRWAAVGDAL

SEQ ID NO: 1065502 - protein, 17 aa, Mycobacterium
GPKIRIHKFKNKTGYHK

SEQ ID NO: 1065503 - protein, 18 aa, Mycobacterium
GPLLPPTVPGWRSRAERF

SEQ ID NO: 1065504 - protein, 26 aa, Mycobacterium
GPLVGVWQRAPLQALARLHVLAAADQ

SEQ ID NO: 1065505 - protein, 21 aa, Mycobacterium
GPVRRTGTIFIFTSPSHATEV

SEQ ID NO: 1065506 - protein, 21 aa, Mycobacterium
GPYLRAHPTKALTMLAAVPIT

SEQ ID NO: 1065507 - protein, 23 aa, Mycobacterium
GQARGWFYTLHVLATALFDRPAF

SEQ ID NO: 1065508 - protein, 19 aa, Mycobacterium
GQEWGLEYLFGVLDSEISG

SEQ ID NO: 1065509 - protein, 25 aa, Mycobacterium
GQIPPNLHFSQWNPAIDAASTRFFV

SEQ ID NO: 1065510 - protein, 24 aa, Mycobacterium
GQITWAEIIALRRRAYAMLDNPVM

SEQ ID NO: 1065511 - protein, 23 aa, Mycobacterium
GQLGEVWISFLIVAPKYVASVAT

SEQ ID NO: 1065512 - protein, 25 aa, Mycobacterium
GQNARLAARLTGWRIDIRGDSPPCS

SEQ ID NO: 1065513 - protein, 19 aa, Mycobacterium
GQRFLLMADKMRYPPDGVS

SEQ ID NO: 1065514 - protein, 26 aa, Mycobacterium
GQRRRVELARILFAASRAGTGASGSG

SEQ ID NO: 1065515 - protein, 25 aa, Mycobacterium
GQSKLANLLFTYELQRRLATRQTTI

SEQ ID NO: 1065516 - protein, 17 aa, Mycobacterium
GRAAMDELATRLWMCGC

SEQ ID NO: 1065517 - protein, 17 aa, Mycobacterium
GRAEDRRLLARSASLRC

SEQ ID NO: 1065518 - protein, 18 aa, Mycobacterium
GRAGFNSGYLISCSARPV

SEQ ID NO: 1065519 - protein, 24 aa, Mycobacterium
GRATLVLADWLADAGPACVTGLPD

SEQ ID NO: 1065520 - protein, 21 aa, Mycobacterium
GRCIVVFQPHLYSRTKALSRE

SEQ ID NO: 1065521 - protein, 18 aa, Mycobacterium
GRCVLGDGWSRRVDKPSA

SEQ ID NO: 1065522 - protein, 18 aa, Mycobacterium
GRDLVRLGIDGRRWGALP

SEQ ID NO: 1065523 - protein, 21 aa, Mycobacterium
GRDVWIPLGNPSYLRQELEMS

SEQ ID NO: 1065524 - protein, 19 aa, Mycobacterium
GRETIYFPSLSSQTFVYKG

SEQ ID NO: 1065525 - protein, 24 aa, Mycobacterium
GRGYAAMLTWMRSKGNLTKVGVEG

SEQ ID NO: 1065526 - protein, 26 aa, Mycobacterium
GRIDPRTRWLLRELVFALLVKKDHAA

SEQ ID NO: 1065527 - protein, 25 aa, Mycobacterium
GRIDRRGRMLWSLPKGHIEQGETAE

SEQ ID NO: 1065528 - protein, 20 aa, Mycobacterium
GRLATVSTLPIMLDSTEIPV

SEQ ID NO: 1065529 - protein, 20 aa, Mycobacterium
GRLNGFFKDSVLLEQPSVFD

SEQ ID NO: 1065530 - protein, 31 aa, Mycobacterium
GRLPILKGPPFLKRVVLRTAARLSRRGRRLG

SEQ ID NO: 1065531 - protein, 17 aa, Mycobacterium
GRLTLVSRLGNNKVRDL

SEQ ID NO: 1065532 - protein, 23 aa, Mycobacterium
GRNMTMVLAPHRGAKTRASARHP

SEQ ID NO: 1065533 - protein, 27 aa, Mycobacterium
GRPLAMPRLDMVTGLYYLTTAVDGDTG

SEQ ID NO: 1065534 - protein, 17 aa, Mycobacterium
GRQVWYFDSASNQFRRM

SEQ ID NO: 1065535 - protein, 24 aa, Mycobacterium
GRRTFTAAHLLLAAGTWGTQRLLF

SEQ ID NO: 1065536 - protein, 18 aa, Mycobacterium
GRRYVDLVCSWGPMILGH

SEQ ID NO: 1065537 - protein, 25 aa, Mycobacterium
GRSGKALLFVSLGGLPYSSRSKRLL

SEQ ID NO: 1065538 - protein, 17 aa, Mycobacterium
GRTFSGYIHKPLAETLS

SEQ ID NO: 1065539 - protein, 21 aa, Mycobacterium
GRTWQPHQVPAFLAAGYRVIT

SEQ ID NO: 1065540 - protein, 18 aa, Mycobacterium
GRVDARGKFHTLWSEDRS

SEQ ID NO: 1065541 - protein, 27 aa, Mycobacterium
GRWAQAYGFPLMPIDGILVGTAAMATK

SEQ ID NO: 1065542 - protein, 23 aa, Mycobacterium
GRWPLPTATTPHQLWLRAVAAGG

SEQ ID NO: 1065543 - protein, 19 aa, Mycobacterium
GRYADAWIPIVLVRPTDYS

SEQ ID NO: 1065544 - protein, 26 aa, Mycobacterium
GRYKAWQETAFQYAWLLAAVDVDQYG

SEQ ID NO: 1065545 - protein, 18 aa, Mycobacterium
GSAIAQHWMYDGKHVLIV

SEQ ID NO: 1065546 - protein, 29 aa, Mycobacterium
GSCWVRSSWLARYWPACSATAGCLPDRSG

SEQ ID NO: 1065547 - protein, 22 aa, Mycobacterium
GSDIARIRRFAHPVLLERSRAA

SEQ ID NO: 1065548 - protein, 23 aa, Mycobacterium
GSEDFLSILLSAIGSRQAVQFPY

SEQ ID NO: 1065549 - protein, 19 aa, Mycobacterium
GSGGYRMQIRDVRNLVAAR

SEQ ID NO: 1065550 - protein, 26 aa, Mycobacterium
GSGRRALLFLRADRLQYFVSCLVYVP

SEQ ID NO: 1065551 - protein, 19 aa, Mycobacterium
GSIAKLVKVRPGYEAALAA

SEQ ID NO: 1065552 - protein, 26 aa, Mycobacterium
GSIERFFGILTEHYAGAFPAWLAPIQ

SEQ ID NO: 1065553 - protein, 27 aa, Mycobacterium
GSKHKGYRLVLPSAGRWREVLNTDTIA

SEQ ID NO: 1065554 - protein, 26 aa, Mycobacterium
GSKSELAATIAGYRASKTLEGNIHAP

SEQ ID NO: 1065555 - protein, 21 aa, Mycobacterium
GSLRQLGPINWVIAKLAASLL

SEQ ID NO: 1065556 - protein, 30 aa, Mycobacterium
GSPEHAALFGLPLCEPIYPTPAGLVAAVPD

SEQ ID NO: 1065557 - protein, 17 aa, Mycobacterium
GSPWLADTWRDRFQKML

SEQ ID NO: 1065558 - protein, 22 aa, Mycobacterium
GSPYVAPRLFSVTGGPGAGVGS

SEQ ID NO: 1065559 - protein, 24 aa, Mycobacterium
GSRTPWRLNQNYLRDIRLIRRGKV

SEQ ID NO: 1065560 - protein, 30 aa, Mycobacterium
GSVRFLMSVGDLIIGWLLQRQAAVAVQALD

SEQ ID NO: 1065561 - protein, 20 aa, Mycobacterium
GSVRVPPALVPFVGTELLES

SEQ ID NO: 1065562 - protein, 18 aa, Mycobacterium
GSWYEMFPRPTGCWDADG

SEQ ID NO: 1065563 - protein, 22 aa, Mycobacterium
GTAYLAGFAWGMSRDYSVLVEM

SEQ ID NO: 1065564 - protein, 29 aa, Mycobacterium
GTCRPQYRKLLQEFLLQLDLDEDTRRRAE

SEQ ID NO: 1065565 - protein, 24 aa, Mycobacterium
GTFEGWLHRITTNLFLDMVRRRAR

SEQ ID NO: 1065566 - protein, 25 aa, Mycobacterium
GTGMGIDRLLMSLTGLSIRETVLFP

SEQ ID NO: 1065567 - protein, 25 aa, Mycobacterium
GTGRLILFSGCRWVAILGSFSSSRW

SEQ ID NO: 1065568 - protein, 22 aa, Mycobacterium
GTHNAPIFSREPFHPCRPANTS

SEQ ID NO: 1065569 - protein, 21 aa, Mycobacterium
GTICLGGLIVIKFTEADVVLR

SEQ ID NO: 1065570 - protein, 23 aa, Mycobacterium
GTIFPILPIRRCRMHTRPAISRT

SEQ ID NO: 1065571 - protein, 24 aa, Mycobacterium
GTIKIEMNFLPDVYVPCEVCQGAR

SEQ ID NO: 1065572 - protein, 23 aa, Mycobacterium
GTKCTYIQAVYYPATNQIQTIMQ

SEQ ID NO: 1065573 - protein, 22 aa, Mycobacterium
GTLTAAHWLSQEDVPVVGVPKT

SEQ ID NO: 1065574 - protein, 24 aa, Mycobacterium
GTMRLGAYPAVLQPASIVAQAYGT

SEQ ID NO: 1065575 - protein, 18 aa, Mycobacterium
GTPGLWVEFGNRLPVILL

SEQ ID NO: 1065576 - protein, 18 aa, Mycobacterium
GTPLVRLNSVVPAGTGVV

SEQ ID NO: 1065577 - protein, 25 aa, Mycobacterium
GTPRMISCSFLFLCSGYYNYEQGYA

SEQ ID NO: 1065578 - protein, 17 aa, Mycobacterium
GTQRLLFRMRDQGKLPR

SEQ ID NO: 1065579 - protein, 29 aa, Mycobacterium
GTRGISSPRLLFDMFWVGHCAELAEVMAR

SEQ ID NO: 1065580 - protein, 17 aa, Mycobacterium
GTSLISYVLPPSPIVRI

SEQ ID NO: 1065581 - protein, 23 aa, Mycobacterium
GTVKPAIVLVLGVGVAGLQALAT

SEQ ID NO: 1065582 - protein, 23 aa, Mycobacterium
GTVRNWPWQRLALSKTANKYSRL

SEQ ID NO: 1065583 - protein, 22 aa, Mycobacterium
GTVTDWLVARIFPVSPTSGSLV

SEQ ID NO: 1065584 - protein, 20 aa, Mycobacterium
GTWVAFPTVEQLERAVFDMV

SEQ ID NO: 1065585 - protein, 25 aa, Mycobacterium
GTYLNSFYEIRPLPYAEAGYGYPEA

SEQ ID NO: 1065586 - protein, 30 aa, Mycobacterium
GVAPLDLTIVSWLPFYHDMGLVLGVVAPIL

SEQ ID NO: 1065587 - protein, 31 aa, Mycobacterium
GVDESRLTFLAVRRWFGWSAGRIINLDIGGG

SEQ ID NO: 1065588 - protein, 30 aa, Mycobacterium
GVDYMTVHAGVLLRYVLLTAKRVTGIVSRG

SEQ ID NO: 1065589 - protein, 23 aa, Mycobacterium
GVEHTWLGFIDSGLPKGDPPPPL

SEQ ID NO: 1065590 - protein, 17 aa, Mycobacterium
GVEPDKRPQACRRAVAV

SEQ ID NO: 1065591 - protein, 25 aa, Mycobacterium
GVGALLLRRDISCVPLLHGGGQERD

SEQ ID NO: 1065592 - protein, 23 aa, Mycobacterium
GVGWLKFLRSLTARWLSGVATSV

SEQ ID NO: 1065593 - protein, 25 aa, Mycobacterium
GVIGKILPAEDMPFLPDGTPVDIIL

SEQ ID NO: 1065594 - protein, 23 aa, Mycobacterium
GVKAWLDTALVLKPLLGIEDGKL

SEQ ID NO: 1065595 - protein, 24 aa, Mycobacterium
GVKGFFEKTFAPLGLKKIQAEVLA

SEQ ID NO: 1065596 - protein, 25 aa, Mycobacterium
GVLAGYPLVNLKVTLLDGAYHDVDS

SEQ ID NO: 1065597 - protein, 17 aa, Mycobacterium
GVLIHRDALVIGARCHG

SEQ ID NO: 1065598 - protein, 17 aa, Mycobacterium
GVLVSPFDFLDLGDHVG

SEQ ID NO: 1065599 - protein, 23 aa, Mycobacterium
GVPISVILFGARRKTTVPLVTQA

SEQ ID NO: 1065600 - protein, 19 aa, Mycobacterium
GVPVFAWKGETLEEYWWAA

SEQ ID NO: 1065601 - protein, 23 aa, Mycobacterium
GVPVVMKALLDAGLLHGDCLTVT

SEQ ID NO: 1065602 - protein, 20 aa, Mycobacterium
GVQVDTDLRWRIVTALATAG

SEQ ID NO: 1065603 - protein, 25 aa, Mycobacterium
GVRAEVDMFWFAPFGAQLRTQAAVD

SEQ ID NO: 1065604 - protein, 19 aa, Mycobacterium
GVRPRFYRSLARPEVIAIL

SEQ ID NO: 1065605 - protein, 27 aa, Mycobacterium
GVRSRLMLDIAGWRRRRREELVALGDR

SEQ ID NO: 1065606 - protein, 19 aa, Mycobacterium
GVRTAWSAIFEDLSRRARP

SEQ ID NO: 1065607 - protein, 17 aa, Mycobacterium
GVSGLWLLSGMSYDGVL

SEQ ID NO: 1065608 - protein, 20 aa, Mycobacterium
GVSNSRWVDYRGVDPLHRYH

SEQ ID NO: 1065609 - protein, 26 aa, Mycobacterium
GVSRRHLEIRWDGQVALLSDLNSTNG

SEQ ID NO: 1065610 - protein, 20 aa, Mycobacterium
GVVLHYFLHAEPAGVAAWQL

SEQ ID NO: 1065611 - protein, 25 aa, Mycobacterium
GVVNGTKAFLPYLISSGDGHVINIS

SEQ ID NO: 1065612 - protein, 17 aa, Mycobacterium
GVWAPGELVAKLTYFGL

SEQ ID NO: 1065613 - protein, 17 aa, Mycobacterium
GWDLWDPANAMTGELGV

SEQ ID NO: 1065614 - protein, 20 aa, Mycobacterium
GWDYPACEAIGLLKMDFLGL

SEQ ID NO: 1065615 - protein, 17 aa, Mycobacterium
GWEDGMLPHMRTLGDPT

SEQ ID NO: 1065616 - protein, 18 aa, Mycobacterium
GWELVRHAGPLPSNPDED

SEQ ID NO: 1065617 - protein, 22 aa, Mycobacterium
GWFDSLMTFTLPETLWLVVRGF

SEQ ID NO: 1065618 - protein, 24 aa, Mycobacterium
GWHDARVIPYGPIQLDPSAIVLHY

SEQ ID NO: 1065619 - protein, 18 aa, Mycobacterium
GWLRAKTGSLTAINSLVG

SEQ ID NO: 1065620 - protein, 28 aa, Mycobacterium
GWRLYTRARYAPYVERLLLDGARTKLTR

SEQ ID NO: 1065621 - protein, 19 aa, Mycobacterium
GWYPRLVVGLGNPGKNYGR

SEQ ID NO: 1065622 - protein, 19 aa, Mycobacterium
GYAPMIGGLGYALASGIDA

SEQ ID NO: 1065623 - protein, 21 aa, Mycobacterium
GYAVESMLAYFTRLIERRRSE

SEQ ID NO: 1065624 - protein, 18 aa, Mycobacterium
GYDVVVAKFPFTANAKAH

SEQ ID NO: 1065625 - protein, 31 aa, Mycobacterium
GYPLHSFPGEPPYLRGPYPTMYVNQPWTIRQ

SEQ ID NO: 1065626 - protein, 19 aa, Mycobacterium
GYTVPTLWSGSLSDSTLIT

SEQ ID NO: 1065627 - protein, 17 aa, Mycobacterium
GYVVSIGGPAYADIEVA

SEQ ID NO: 1065628 - protein, 22 aa, Mycobacterium
HAAAFPCLVAVVPPAADPVSLQ

SEQ ID NO: 1065629 - protein, 21 aa, Mycobacterium
HACDLVDLFLLCALVAEIEGP

SEQ ID NO: 1065630 - protein, 21 aa, Mycobacterium
HADAFIVLPGGLGTLDELFEA

SEQ ID NO: 1065631 - protein, 17 aa, Mycobacterium
HADLVIGAVLVPGAKAP

SEQ ID NO: 1065632 - protein, 26 aa, Mycobacterium
HAFDLVLSSHLLFTYADRLSPDFHYQ

SEQ ID NO: 1065633 - protein, 28 aa, Mycobacterium
HAFWDTEGFVLPVLTYTAPHAVADALRW

SEQ ID NO: 1065634 - protein, 19 aa, Mycobacterium
HAFYLQYKNVKADYVKAFW

SEQ ID NO: 1065635 - protein, 19 aa, Mycobacterium
HAHIDHMGSAIWFASKHRT

SEQ ID NO: 1065636 - protein, 19 aa, Mycobacterium
HAIELRTYRFGGSLHLDWW

SEQ ID NO: 1065637 - protein, 20 aa, Mycobacterium
HAIGYSDVLPWTAGVIGSGV

SEQ ID NO: 1065638 - protein, 17 aa, Mycobacterium
HAIPATFVPCYLPQWEV

SEQ ID NO: 1065639 - protein, 17 aa, Mycobacterium
HAPQLLTLPDVFPNGLA

SEQ ID NO: 1065640 - protein, 36 aa, Mycobacterium
HATGVIILTCGMFGNIIRLLPPLTISDELLAEGLDI

SEQ ID NO: 1065641 - protein, 20 aa, Mycobacterium
HAVAALIAAVLYEIERKLQP

SEQ ID NO: 1065642 - protein, 21 aa, Mycobacterium
HAVWALMDYGFRVVISSRFGD

SEQ ID NO: 1065643 - protein, 26 aa, Mycobacterium
HAVWGHRISHWLWNRRARLAARAFAE

SEQ ID NO: 1065644 - protein, 17 aa, Mycobacterium
HAYPPRFAQSWDSVGLV

SEQ ID NO: 1065645 - protein, 29 aa, Mycobacterium
HCATIGQPLDWFCLFSSGAALLGSPGQGA

SEQ ID NO: 1065646 - protein, 19 aa, Mycobacterium
HCNYFCRFAYRVAESQPRC

SEQ ID NO: 1065647 - protein, 18 aa, Mycobacterium
HCRAPNYPYVLPHMRAAA

SEQ ID NO: 1065648 - protein, 23 aa, Mycobacterium
HDGYQWLRRLGYDPEQIVLAGDS

SEQ ID NO: 1065649 - protein, 20 aa, Mycobacterium
HDLDIWTLFSRAVGPEDYAD

SEQ ID NO: 1065650 - protein, 17 aa, Mycobacterium
HDTRVHYVEPAKWIAAL

SEQ ID NO: 1065651 - protein, 19 aa, Mycobacterium
HDVDYWKKGLRHSVHFTQG

SEQ ID NO: 1065652 - protein, 39 aa, Mycobacterium
HEAQIEDLIFLRKALNRADIPFLFIRNHKNRPVLAINIK

SEQ ID NO: 1065653 - protein, 26 aa, Mycobacterium
HEATRDLDLLMFVLCSSIAATVGSPG

SEQ ID NO: 1065654 - protein, 18 aa, Mycobacterium
HEIGGRSAFTLVPDVVDL

SEQ ID NO: 1065655 - protein, 25 aa, Mycobacterium
HELGWFARQALRLFDDLRLDHGRLD

SEQ ID NO: 1065656 - protein, 23 aa, Mycobacterium
HENAYFPMLIPENYFNREAEHVE

SEQ ID NO: 1065657 - protein, 18 aa, Mycobacterium
HFGRTDVELPWEQLNKVD

SEQ ID NO: 1065658 - protein, 18 aa, Mycobacterium
HFNAVELMLCFNQLGYSA

SEQ ID NO: 1065659 - protein, 21 aa, Mycobacterium
HFVPNLTIGLPVVQSLLAASD

SEQ ID NO: 1065660 - protein, 18 aa, Mycobacterium
HFVRTVITMMATASAWAA

SEQ ID NO: 1065661 - protein, 19 aa, Mycobacterium
HGALRSAWIGYWVSSSATG

SEQ ID NO: 1065662 - protein, 24 aa, Mycobacterium
HGDAPLPLLFVVSAVAELAESDCV

SEQ ID NO: 1065663 - protein, 21 aa, Mycobacterium
HGDIPVIRPLKIRSSAIVCIA

SEQ ID NO: 1065664 - protein, 24 aa, Mycobacterium
HGDLLVTVKVAVPLNLEGAAQKAL

SEQ ID NO: 1065665 - protein, 26 aa, Mycobacterium
HGESWSLAIALRLAAYELLRADGNEP

SEQ ID NO: 1065666 - protein, 22 aa, Mycobacterium
HGGIAFGWDRTNALLAGMESIR

SEQ ID NO: 1065667 - protein, 19 aa, Mycobacterium
HGGLGWVYLAFDHNVNDRP

SEQ ID NO: 1065668 - protein, 21 aa, Mycobacterium
HGNECIPIGTSLIAETSRATI

SEQ ID NO: 1065669 - protein, 23 aa, Mycobacterium
HGQRGIVGKFVYQPVMIVNGADN

SEQ ID NO: 1065670 - protein, 23 aa, Mycobacterium
HGTVMLRMPLHSVAIELLCEVGP

SEQ ID NO: 1065671 - protein, 27 aa, Mycobacterium
HGVGRLKRPWLDDYLGPDVMELNQRIK

SEQ ID NO: 1065672 - protein, 18 aa, Mycobacterium
HGWGYRPVGLGLREKHCR

SEQ ID NO: 1065673 - protein, 25 aa, Mycobacterium
HHINLRPARLYPGVNSLLAGKPDID

SEQ ID NO: 1065674 - protein, 36 aa, Mycobacterium
HHKSTYIFLADRHSGWWRAPLRWMLRGSLVVRSRLM

SEQ ID NO: 1065675 - protein, 18 aa, Mycobacterium
HHNAALARAALCMATAVL

SEQ ID NO: 1065676 - protein, 22 aa, Mycobacterium
HHPQRILVMRYMTPKTIIVTGV

SEQ ID NO: 1065677 - protein, 33 aa, Mycobacterium
HHSRRGLLLLVGRRRRLIKYLSLIDVQRYRSLI

SEQ ID NO: 1065678 - protein, 25 aa, Mycobacterium
HHTGKPHGWIHNELRRRCGGPPIAA

SEQ ID NO: 1065679 - protein, 27 aa, Mycobacterium
HIAGVDTFFVATAPRYSFVSSSLVKEV

SEQ ID NO: 1065680 - protein, 17 aa, Mycobacterium
HIDRGYPLFVENLANLG

SEQ ID NO: 1065681 - protein, 18 aa, Mycobacterium
HIRQIWIPQESIIAICTE

SEQ ID NO: 1065682 - protein, 28 aa, Mycobacterium
HIVQVATLGRIALVLISHRHPDHTDGID

SEQ ID NO: 1065683 - protein, 25 aa, Mycobacterium
HIYHALTWGPLMREIIWTATGKEIR

SEQ ID NO: 1065684 - protein, 17 aa, Mycobacterium
HKLTRAKCFGFLPSDPN

SEQ ID NO: 1065685 - protein, 20 aa, Mycobacterium
HKNWNPHDYIPWSDGKNFYA

SEQ ID NO: 1065686 - protein, 18 aa, Mycobacterium
HKVADGVRMLIVPGSMRV

SEQ ID NO: 1065687 - protein, 18 aa, Mycobacterium
HKVPRRLLKAARLGLIDL

SEQ ID NO: 1065688 - protein, 25 aa, Mycobacterium
HKVRHRTFHYPGGLVDFVKHINRTK

SEQ ID NO: 1065689 - protein, 18 aa, Mycobacterium
HLCMCGVSSLLHADKSTA

SEQ ID NO: 1065690 - protein, 17 aa, Mycobacterium
HLDAGQQVWLITATPYE

SEQ ID NO: 1065691 - protein, 29 aa, Mycobacterium
HLGDNITFVIRIPLSIDLLVDLRLDKQRF

SEQ ID NO: 1065692 - protein, 26 aa, Mycobacterium
HLHQGIALQVPPYHYVHSDDLLAAAT

SEQ ID NO: 1065693 - protein, 25 aa, Mycobacterium
HLNRSTFILAVTPISLRPGVLAEAV

SEQ ID NO: 1065694 - protein, 25 aa, Mycobacterium
HLSIARLAWVFWTRDVGGEYGTLHA

SEQ ID NO: 1065695 - protein, 17 aa, Mycobacterium
HLWHPYSTIGAATGVIP

SEQ ID NO: 1065696 - protein, 17 aa, Mycobacterium
HMQLPGMGIGDKEEFAI

SEQ ID NO: 1065697 - protein, 18 aa, Mycobacterium
HMTVAQNLGFALKISKIS

SEQ ID NO: 1065698 - protein, 21 aa, Mycobacterium
HNGVPLYVELPVTVELEVTHT

SEQ ID NO: 1065699 - protein, 18 aa, Mycobacterium
HNMLFDHVSALVAKAMGL

SEQ ID NO: 1065700 - protein, 17 aa, Mycobacterium
HPDLVINRNAPTVLTPH

SEQ ID NO: 1065701 - protein, 18 aa, Mycobacterium
HPGQMIIVAARPGVGKAL

SEQ ID NO: 1065702 - protein, 25 aa, Mycobacterium
HPHDRIDPWWAKLTDMLAPDVPQTS

SEQ ID NO: 1065703 - protein, 24 aa, Mycobacterium
HPLWIVRRTMVDLIRPVEFQEMLR

SEQ ID NO: 1065704 - protein, 22 aa, Mycobacterium
HPSLCLLASWVSPGSPAGRRLC

SEQ ID NO: 1065705 - protein, 21 aa, Mycobacterium
HPSVSAVLYPGLPSHPGHEVA

SEQ ID NO: 1065706 - protein, 19 aa, Mycobacterium
HPVLPRFGAGPYEAIEAYE

SEQ ID NO: 1065707 - protein, 20 aa, Mycobacterium
HQLVLYLESLLDDLIVQPVM

SEQ ID NO: 1065708 - protein, 24 aa, Mycobacterium
HQSSGVIPIMKLLEDAFSYANQLG

SEQ ID NO: 1065709 - protein, 23 aa, Mycobacterium
HQYMLELAALFDAGVLRPLPVKT

SEQ ID NO: 1065710 - protein, 17 aa, Mycobacterium
HRFSLAGWRRCCRPGSE

SEQ ID NO: 1065711 - protein, 24 aa, Mycobacterium
HRHKLFYCKVLADHLPELIPVVYT

SEQ ID NO: 1065712 - protein, 18 aa, Mycobacterium
HRPRRALATPWWEAGHRN

SEQ ID NO: 1065713 - protein, 26 aa, Mycobacterium
HRPVPLWQHVLVGKRLFDLFDYDSNV

SEQ ID NO: 1065714 - protein, 18 aa, Mycobacterium
HRQLIPGLITPGRAYAVH

SEQ ID NO: 1065715 - protein, 19 aa, Mycobacterium
HRQQSNAVWILLASHHRTE

SEQ ID NO: 1065716 - protein, 17 aa, Mycobacterium
HRRHGRRVLKLAKLPIR

SEQ ID NO: 1065717 - protein, 24 aa, Mycobacterium
HRSIPGVTEKWDLYLRGVELATGY

SEQ ID NO: 1065718 - protein, 19 aa, Mycobacterium
HRSTRTRSHRGKRGELLPR

SEQ ID NO: 1065719 - protein, 19 aa, Mycobacterium
HRVCRYLEDLAGDYHRFYD

SEQ ID NO: 1065720 - protein, 25 aa, Mycobacterium
HRYPAAIRLWRNAWNEFIPFLDYDT

SEQ ID NO: 1065721 - protein, 22 aa, Mycobacterium
HSAHYYFRDFWGADSGMLAALY

SEQ ID NO: 1065722 - protein, 24 aa, Mycobacterium
HSATAWLSYLRPAVSTADFARELR

SEQ ID NO: 1065723 - protein, 26 aa, Mycobacterium
HSEVDTLRRVELLRQLRLGDYDVLVG

SEQ ID NO: 1065724 - protein, 26 aa, Mycobacterium
HSHYWLSGQVGWLARDRWAVPLVHTA

SEQ ID NO: 1065725 - protein, 30 aa, Mycobacterium
HSKIPVIVDIHFQPKYIFAAIDAGCAAVRV

SEQ ID NO: 1065726 - protein, 17 aa, Mycobacterium
HSLGYAYRDRRARKGEF

SEQ ID NO: 1065727 - protein, 23 aa, Mycobacterium
HSPALILDVLGRGWEMTEFWYRL

SEQ ID NO: 1065728 - protein, 20 aa, Mycobacterium
HSRFPSAVVGFVVAIPTPCL

SEQ ID NO: 1065729 - protein, 24 aa, Mycobacterium
HSRGAFPGALWLQVRDIAVTQADL

SEQ ID NO: 1065730 - protein, 22 aa, Mycobacterium
HSSLLPLLHNYQKPEKPLHGSL

SEQ ID NO: 1065731 - protein, 28 aa, Mycobacterium
HSVVISILLPDIPMVAWWPNIAPTMSGQ

SEQ ID NO: 1065732 - protein, 29 aa, Mycobacterium
HTGDPEFLPLLRRLSRLLPVDVRVLDIAC

SEQ ID NO: 1065733 - protein, 26 aa, Mycobacterium
HTGGIDLARVLRVAAAMYCDADEICG

SEQ ID NO: 1065734 - protein, 27 aa, Mycobacterium
HTGLWDLGYTLSRRRGYRPVRTMVLAS

SEQ ID NO: 1065735 - protein, 22 aa, Mycobacterium
HTQPRVIVLPGPATALTSDDHG

SEQ ID NO: 1065736 - protein, 17 aa, Mycobacterium
HTRGYIATALHLLERKI

SEQ ID NO: 1065737 - protein, 22 aa, Mycobacterium
HTRTINRVGLILRTRDVEGKQA

SEQ ID NO: 1065738 - protein, 22 aa, Mycobacterium
HTSIALVAYSAPGPGWGKVIPA

SEQ ID NO: 1065739 - protein, 25 aa, Mycobacterium
HTTYDPLCRPCHRRLFTIANQKGGV

SEQ ID NO: 1065740 - protein, 17 aa, Mycobacterium
HTVVLPTGENFTLHLIP

SEQ ID NO: 1065741 - protein, 18 aa, Mycobacterium
HVAQGCELVLVLGGDGTF

SEQ ID NO: 1065742 - protein, 18 aa, Mycobacterium
HVHAWALRMSPDGNVWGA

SEQ ID NO: 1065743 - protein, 18 aa, Mycobacterium
HVLNRSLSRARRLAGKIG

SEQ ID NO: 1065744 - protein, 18 aa, Mycobacterium
HVLRRQLTKANDLGFSCY

SEQ ID NO: 1065745 - protein, 23 aa, Mycobacterium
HVRNLIRRFVEIGVPGYHIEDQR

SEQ ID NO: 1065746 - protein, 17 aa, Mycobacterium
HVVEVVVGENFTFGKKA

SEQ ID NO: 1065747 - protein, 18 aa, Mycobacterium
HWISAMSAAYHRADTHPL

SEQ ID NO: 1065748 - protein, 26 aa, Mycobacterium
HYAGAFPAWLAPIQVVGIPVTGEHVS

SEQ ID NO: 1065749 - protein, 26 aa, Mycobacterium
HYDLSNEFFALFQDPTRTYSCAYFEP

SEQ ID NO: 1065750 - protein, 26 aa, Mycobacterium
HYDRHLTLHGLRLVFERNREAQRGRL

SEQ ID NO: 1065751 - protein, 25 aa, Mycobacterium
IAAFGAHVIAYDPYVAPARAAQLGI

SEQ ID NO: 1065752 - protein, 20 aa, Mycobacterium
IAALPRIRRSYPGTTLTIAG

SEQ ID NO: 1065753 - protein, 17 aa, Mycobacterium
IAAWRREASLRRTRKRR

SEQ ID NO: 1065754 - protein, 19 aa, Mycobacterium
IACSRWGMLSPAGQCKAFD

SEQ ID NO: 1065755 - protein, 24 aa, Mycobacterium
IADIKPHGLFLSNGPGDPATADHV

SEQ ID NO: 1065756 - protein, 27 aa, Mycobacterium
IADLRAIPWVLAWSQSRVMLPGWYGTG

SEQ ID NO: 1065757 - protein, 19 aa, Mycobacterium
IADYPFTTLVPNLGVVSVG

SEQ ID NO: 1065758 - protein, 23 aa, Mycobacterium
IADYPQVSLGIYASPRQTVIAGP

SEQ ID NO: 1065759 - protein, 17 aa, Mycobacterium
IAEFLGFTKVLASVGQV

SEQ ID NO: 1065760 - protein, 22 aa, Mycobacterium
IAKIAVKLAVGYTLDEILNDIT

SEQ ID NO: 1065761 - protein, 28 aa, Mycobacterium
IALQELMRLVFFLKRGDLEALDKVFWCR

SEQ ID NO: 1065762 - protein, 18 aa, Mycobacterium
IAMYLCRELTDLSLPKIG

SEQ ID NO: 1065763 - protein, 27 aa, Mycobacterium
IAPEPRQRVMLPPWAAGSPGHNAQDGG

SEQ ID NO: 1065764 - protein, 19 aa, Mycobacterium
IAPLAEPGWVAIRALVPRR

SEQ ID NO: 1065765 - protein, 18 aa, Mycobacterium
IARALRWQFDGIDRAGSD

SEQ ID NO: 1065766 - protein, 19 aa, Mycobacterium
IARATVLAAGLPVTAGGVQ

SEQ ID NO: 1065767 - protein, 23 aa, Mycobacterium
IAREARFHWGIAMMPTGPQGRVS

SEQ ID NO: 1065768 - protein, 18 aa, Mycobacterium
IARGGFPEDCFQTLLISA

SEQ ID NO: 1065769 - protein, 31 aa, Mycobacterium
IARPDLQVVLLEPLLRRVTFLREVVAELGLD

SEQ ID NO: 1065770 - protein, 18 aa, Mycobacterium
IATVLGRWPVAAGSASVL

SEQ ID NO: 1065771 - protein, 26 aa, Mycobacterium
IAVPIPSFGVWALDLLRWVNRYTEIT

SEQ ID NO: 1065772 - protein, 26 aa, Mycobacterium
IAVRNRILAIRWWIPSGVELDTGTRA

SEQ ID NO: 1065773 - protein, 25 aa, Mycobacterium
IAVSSGMLRIYPTLDPRLVHVIWNA

SEQ ID NO: 1065774 - protein, 18 aa, Mycobacterium
IAVYNHFGGIRTPIAEGA

SEQ ID NO: 1065775 - protein, 17 aa, Mycobacterium
ICIYKHLLGVRRSKNYL

SEQ ID NO: 1065776 - protein, 19 aa, Mycobacterium
ICLQGKIIPDLIAWWCERD

SEQ ID NO: 1065777 - protein, 19 aa, Mycobacterium
ICRPNWLQTAGWQILACGT

SEQ ID NO: 1065778 - protein, 27 aa, Mycobacterium
ICSAVVEGLMLGSYRFTDFRSRKTAPK

SEQ ID NO: 1065779 - protein, 19 aa, Mycobacterium
IDAFVVRKYAKTHGLQRLI

SEQ ID NO: 1065780 - protein, 24 aa, Mycobacterium
IDAGRALVLAFNKWDLVDEDRCDL

SEQ ID NO: 1065781 - protein, 18 aa, Mycobacterium
IDALLATLGGQTALNTAV

SEQ ID NO: 1065782 - protein, 25 aa, Mycobacterium
IDALTMGLERKDGAAWLARNYSDTG

SEQ ID NO: 1065783 - protein, 27 aa, Mycobacterium
IDANRASWIVMYIQAMSLPAFAQTVRE

SEQ ID NO: 1065784 - protein, 21 aa, Mycobacterium
IDEAWFGEHHFMRLRVDGVPG

SEQ ID NO: 1065785 - protein, 25 aa, Mycobacterium
IDEFDADFFGLPPLAAQVLDPQHRL

SEQ ID NO: 1065786 - protein, 24 aa, Mycobacterium
IDEITLSVPFLSLAGKAPADSREI

SEQ ID NO: 1065787 - protein, 19 aa, Mycobacterium
IDEKLLKFQLRNLRGYFND

SEQ ID NO: 1065788 - protein, 17 aa, Mycobacterium
IDELIAMPVFGGANQRR

SEQ ID NO: 1065789 - protein, 23 aa, Mycobacterium
IDELQRRILAGERDVVLLGATGT

SEQ ID NO: 1065790 - protein, 24 aa, Mycobacterium
IDGIRQFVILASGLDSRAYRLDWP

SEQ ID NO: 1065791 - protein, 19 aa, Mycobacterium
IDPLAWMDMFGADALRFTL

SEQ ID NO: 1065792 - protein, 18 aa, Mycobacterium
IDRTALILDIFAQHATSR

SEQ ID NO: 1065793 - protein, 24 aa, Mycobacterium
IDSALDGVLFLDEAYALVATGAKN

SEQ ID NO: 1065794 - protein, 19 aa, Mycobacterium
IDSLSAEELIAMTIKPVDD

SEQ ID NO: 1065795 - protein, 36 aa, Mycobacterium
IDTFAPRLSFFWGIGMNFFMEVAKLRAGRLLWSELV

SEQ ID NO: 1065796 - protein, 24 aa, Mycobacterium
IDVTPTRLQFALDEGRIVLVAGFQ

SEQ ID NO: 1065797 - protein, 29 aa, Mycobacterium
IDYRKFFDRSLIGRVPLIGGGLSLLVSDG

SEQ ID NO: 1065798 - protein, 18 aa, Mycobacterium
IDYWGTVVTAFDLRAPHT

SEQ ID NO: 1065799 - protein, 23 aa, Mycobacterium
IEASDRLLYVRHAVLVLCCGCFV

SEQ ID NO: 1065800 - protein, 23 aa, Mycobacterium
IEEAWPEHKKLFDKAWTSQDVIE

SEQ ID NO: 1065801 - protein, 22 aa, Mycobacterium
IEECEHWGLWGPAAKETVVQPA

SEQ ID NO: 1065802 - protein, 17 aa, Mycobacterium
IEENLPVIVVMPSPKGS

SEQ ID NO: 1065803 - protein, 25 aa, Mycobacterium
IEEQSPIVGIWHSGGARLAEGVRAL

SEQ ID NO: 1065804 - protein, 25 aa, Mycobacterium
IEERVAVYVPKLIEMQGDGPYILAG

SEQ ID NO: 1065805 - protein, 29 aa, Mycobacterium
IEGTWVGEVWIYIQLLPAVDSKSLAEVEQ

SEQ ID NO: 1065806 - protein, 28 aa, Mycobacterium
IEHVLATQTLPLRPFKTMAVTVDGRLPA

SEQ ID NO: 1065807 - protein, 21 aa, Mycobacterium
IEKVDPVKLNLTLNAAAEAPS

SEQ ID NO: 1065808 - protein, 21 aa, Mycobacterium
IEMALAKFWFSEMVCRIVYEL

SEQ ID NO: 1065809 - protein, 24 aa, Mycobacterium
IEMTDWWSYLDGVRKTYPLSYSPQ

SEQ ID NO: 1065810 - protein, 22 aa, Mycobacterium
IEPRLSLQWWVRVESLAKAAGD

SEQ ID NO: 1065811 - protein, 17 aa, Mycobacterium
IEQAPKFRTGGYVSTFV

SEQ ID NO: 1065812 - protein, 23 aa, Mycobacterium
IERRMLLRAYGAELILTPGADGM

SEQ ID NO: 1065813 - protein, 25 aa, Mycobacterium
IERRYRTWIRWNAAIMVHRAQRPGV

SEQ ID NO: 1065814 - protein, 18 aa, Mycobacterium
IESALPGWTAVLLGQWSR

SEQ ID NO: 1065815 - protein, 24 aa, Mycobacterium
IEVIPDVLRHRLVLTYNALADEIS

SEQ ID NO: 1065816 - protein, 27 aa, Mycobacterium
IEVVGCFLALLELYRTRAIAFEQAEPL

SEQ ID NO: 1065817 - protein, 26 aa, Mycobacterium
IEVVKGGLILDIGLRGFLPASLVEMR

SEQ ID NO: 1065818 - protein, 17 aa, Mycobacterium
IEYKFGFVGNPWGELEG

SEQ ID NO: 1065819 - protein, 20 aa, Mycobacterium
IFARYDVTFSLGDGLRPGSI

SEQ ID NO: 1065820 - protein, 18 aa, Mycobacterium
IFDTLPKLDGDTAAKMAQ

SEQ ID NO: 1065821 - protein, 18 aa, Mycobacterium
IFMGPALSVLGRPKVEGL

SEQ ID NO: 1065822 - protein, 18 aa, Mycobacterium
IFPLVVMGSIRYDLDDLL

SEQ ID NO: 1065823 - protein, 22 aa, Mycobacterium
IGALLMGIPTAGGLHFAEWVGA

SEQ ID NO: 1065824 - protein, 20 aa, Mycobacterium
IGFKVPHIADVKPFGRHVMF

SEQ ID NO: 1065825 - protein, 25 aa, Mycobacterium
IGHDNLQVHYLRHTCTSWSRRAGTG

SEQ ID NO: 1065826 - protein, 18 aa, Mycobacterium
IGHRLSTIVAAAMGYEPE

SEQ ID NO: 1065827 - protein, 25 aa, Mycobacterium
IGRGCLGRPWLFAELSAAFTGRPAP

SEQ ID NO: 1065828 - protein, 18 aa, Mycobacterium
IGRNFYRALLAQQEHGIA

SEQ ID NO: 1065829 - protein, 23 aa, Mycobacterium
IGRRILERGFGFSAGGFAQHAHI

SEQ ID NO: 1065830 - protein, 23 aa, Mycobacterium
IGSFQLYRNAKNLSWLANFSDIR

SEQ ID NO: 1065831 - protein, 33 aa, Mycobacterium
IGTYGMALVAYRHGIPFILVAPESTGGPATATG

SEQ ID NO: 1065832 - protein, 29 aa, Mycobacterium
IGVKNYPAYFNFLKLKLRTGGLLLNHCIT

SEQ ID NO: 1065833 - protein, 29 aa, Mycobacterium
IGVLYARRELLSVMPPFLTGGSMIETVTM

SEQ ID NO: 1065834 - protein, 22 aa, Mycobacterium
IGWVPQLKIWSISSGLGRYSSS

SEQ ID NO: 1065835 - protein, 19 aa, Mycobacterium
IHCLPRGNRGAVRRIRLLN

SEQ ID NO: 1065836 - protein, 18 aa, Mycobacterium
IHESIRELRFYRRTAFVP

SEQ ID NO: 1065837 - protein, 18 aa, Mycobacterium
IHIIETFVPAILAAGRGG

SEQ ID NO: 1065838 - protein, 17 aa, Mycobacterium
IIASAYLPQHDNARAFD

SEQ ID NO: 1065839 - protein, 17 aa, Mycobacterium
IIGHPLIEFVHPDSMPA

SEQ ID NO: 1065840 - protein, 24 aa, Mycobacterium
IIIDWHTPPRARKPQRRVRLRGRL

SEQ ID NO: 1065841 - protein, 20 aa, Mycobacterium
IITRLARWCWAARPPRPRVR

SEQ ID NO: 1065842 - protein, 26 aa, Mycobacterium
IKDAQTPTLLFPFAAPRVIGDLSEAG

SEQ ID NO: 1065843 - protein, 23 aa, Mycobacterium
IKDSLSPQLLFTDLGLKYVGPVD

SEQ ID NO: 1065844 - protein, 20 aa, Mycobacterium
IKGIVDHLWHFIAGALTGLK

SEQ ID NO: 1065845 - protein, 18 aa, Mycobacterium
IKHDVTIAAPLNLPATMP

SEQ ID NO: 1065846 - protein, 27 aa, Mycobacterium
IKLTSGQYGWLLSIPAIMSHWSELARN

SEQ ID NO: 1065847 - protein, 21 aa, Mycobacterium
IKTWLSGWWAGAGVGVSHTNN

SEQ ID NO: 1065848 - protein, 20 aa, Mycobacterium
IKVLRDYTVRTPKPGHRRIV

SEQ ID NO: 1065849 - protein, 20 aa, Mycobacterium
IKYNGEEYLILSARDVLAVV

SEQ ID NO: 1065850 - protein, 27 aa, Mycobacterium
ILAPQGLDYIIAFLGAMQAGFIAVPLS

SEQ ID NO: 1065851 - protein, 30 aa, Mycobacterium
ILAPQGLEYIIAFLGALQAGFIAVPLSPPQ

SEQ ID NO: 1065852 - protein, 26 aa, Mycobacterium
ILESAGLLRFLPQLSERLLGETLLLP

SEQ ID NO: 1065853 - protein, 25 aa, Mycobacterium
ILETGHMFFLSDPYGFFAVVEQFLQ

SEQ ID NO: 1065854 - protein, 25 aa, Mycobacterium
ILGATIAPTLYRLARGINDRLVTER

SEQ ID NO: 1065855 - protein, 19 aa, Mycobacterium
ILLLSRPPTNAMTRQFYRE

SEQ ID NO: 1065856 - protein, 18 aa, Mycobacterium
ILLQILHAERYAYHPLSV

SEQ ID NO: 1065857 - protein, 26 aa, Mycobacterium
ILPRQDEVFPYYAHFGRNLVQPSADE

SEQ ID NO: 1065858 - protein, 17 aa, Mycobacterium
ILPYETLVGTGLTETYP

SEQ ID NO: 1065859 - protein, 17 aa, Mycobacterium
ILRHSFPMRSTTDLSQR

SEQ ID NO: 1065860 - protein, 17 aa, Mycobacterium
ILVDFRKTPRLATATFL

SEQ ID NO: 1065861 - protein, 27 aa, Mycobacterium
ILVTGYDILFFWVARMMMLGTFVGGDD

SEQ ID NO: 1065862 - protein, 24 aa, Mycobacterium
IMGRRGLTLSNHRLADGWTTMELT

SEQ ID NO: 1065863 - protein, 26 aa, Mycobacterium
IMTELDIAPTRRLRGLGERQRKALLE

SEQ ID NO: 1065864 - protein, 19 aa, Mycobacterium
INLGPINDVPITPTASQAC

SEQ ID NO: 1065865 - protein, 22 aa, Mycobacterium
INTSAFEWYYQSGLSVVMPVGG

SEQ ID NO: 1065866 - protein, 33 aa, Mycobacterium
INTSDADVIRYLRWFTFLLPEELVELEQTTVSR

SEQ ID NO: 1065867 - protein, 22 aa, Mycobacterium
INVNNMVLVAFWASWCGPDRLF

SEQ ID NO: 1065868 - protein, 22 aa, Mycobacterium
IPAMTVKCAVAMVKSIRAGEGV

SEQ ID NO: 1065869 - protein, 25 aa, Mycobacterium
IPCVRALLTLLPDNLRWLVTVDAMH

SEQ ID NO: 1065870 - protein, 20 aa, Mycobacterium
IPEAVLPRDAATAASSVESC

SEQ ID NO: 1065871 - protein, 19 aa, Mycobacterium
IPGTWLCRNGMEGTLIEGD

SEQ ID NO: 1065872 - protein, 18 aa, Mycobacterium
IPIMLGAEGPKNVALAAE

SEQ ID NO: 1065873 - protein, 17 aa, Mycobacterium
IPIWNAHVQITVAEDIR

SEQ ID NO: 1065874 - protein, 17 aa, Mycobacterium
IPPELRPMVQLDGGRFA

SEQ ID NO: 1065875 - protein, 22 aa, Mycobacterium
IPPHNLYELADAVFWCLENHDA

SEQ ID NO: 1065876 - protein, 21 aa, Mycobacterium
IPRLLSNWRVNPVLAVLAAST

SEQ ID NO: 1065877 - protein, 17 aa, Mycobacterium
IPSTPWQHTRHWITTPL

SEQ ID NO: 1065878 - protein, 18 aa, Mycobacterium
IPVYRSQRSLLQRLLDRH

SEQ ID NO: 1065879 - protein, 20 aa, Mycobacterium
IPWRVGIVDFLLWLGRLSSV

SEQ ID NO: 1065880 - protein, 22 aa, Mycobacterium
IQAQDFFFRKIVRDKGVALSYV

SEQ ID NO: 1065881 - protein, 22 aa, Mycobacterium
IQRTWVQQLAVLPALYAAEVGR

SEQ ID NO: 1065882 - protein, 18 aa, Mycobacterium
IQTILYQEVIVFTLLFEV

SEQ ID NO: 1065883 - protein, 20 aa, Mycobacterium
IRAEFQRITQDLLDRTRQPF

SEQ ID NO: 1065884 - protein, 21 aa, Mycobacterium
IRAILAGHLHYSTNATFVGIP

SEQ ID NO: 1065885 - protein, 18 aa, Mycobacterium
IRCSSAALVWGLGRVVAL

SEQ ID NO: 1065886 - protein, 24 aa, Mycobacterium
IRGRLTLGVLVLCPPEVAAYTALR

SEQ ID NO: 1065887 - protein, 18 aa, Mycobacterium
IRIPSTLFGLLTAIPRCS

SEQ ID NO: 1065888 - protein, 26 aa, Mycobacterium
IRLDRLDPLYRRRILELAAALSDDFE

SEQ ID NO: 1065889 - protein, 17 aa, Mycobacterium
IRLLIADVAGRKLRDVH

SEQ ID NO: 1065890 - protein, 20 aa, Mycobacterium
IRSALAALGLLHSPGDDLTT

SEQ ID NO: 1065891 - protein, 20 aa, Mycobacterium
IRTERVIPGAWYPRSGHLQP

SEQ ID NO: 1065892 - protein, 27 aa, Mycobacterium
IRVSDELAWMFPFCSANPTVSCASVSI

SEQ ID NO: 1065893 - protein, 24 aa, Mycobacterium
ISEDELFIVGRMKDLLIVYGRNHY

SEQ ID NO: 1065894 - protein, 29 aa, Mycobacterium
ISEEILTELWMLIGYHIPAPIPRISYADA

SEQ ID NO: 1065895 - protein, 24 aa, Mycobacterium
ISEFASQRWQWHDLDVSRTAIVPD

SEQ ID NO: 1065896 - protein, 25 aa, Mycobacterium
ISLTPLEFDLLVALARKPRQVFTRD

SEQ ID NO: 1065897 - protein, 24 aa, Mycobacterium
ISPNGTVVVLVFPSVFFANLAPAM

SEQ ID NO: 1065898 - protein, 19 aa, Mycobacterium
ISRCTVTVGLPQDFDRYQV

SEQ ID NO: 1065899 - protein, 19 aa, Mycobacterium
ISTYSYASLAKALLLIMNS

SEQ ID NO: 1065900 - protein, 18 aa, Mycobacterium
ISVAISTQLIWPAQLECE

SEQ ID NO: 1065901 - protein, 21 aa, Mycobacterium
ISVGCNNSCTFCIVPSLRGKE

SEQ ID NO: 1065902 - protein, 22 aa, Mycobacterium
ISYIPVGVSYEFLDKLRPHCKT

SEQ ID NO: 1065903 - protein, 22 aa, Mycobacterium
ITAIDLALMLHPTPAVGGVPAE

SEQ ID NO: 1065904 - protein, 19 aa, Mycobacterium
ITAPRGWELVRHAGPLPSN

SEQ ID NO: 1065905 - protein, 23 aa, Mycobacterium
ITATQLAVPCGMQPLWGPDNRQT

SEQ ID NO: 1065906 - protein, 28 aa, Mycobacterium
ITDNSTLAYLLKFDSILGRLPHDVSLEE

SEQ ID NO: 1065907 - protein, 22 aa, Mycobacterium
ITDVTSYLRGPSVLVAHGELAD

SEQ ID NO: 1065908 - protein, 18 aa, Mycobacterium
ITERFGFSEIMRSTLEKD

SEQ ID NO: 1065909 - protein, 25 aa, Mycobacterium
ITEVYDYLRLLYARAGTPHCPICGE

SEQ ID NO: 1065910 - protein, 19 aa, Mycobacterium
ITGLRLMTRMVQTSSSLAA

SEQ ID NO: 1065911 - protein, 17 aa, Mycobacterium
ITLVRPGYCLGAGGTVL

SEQ ID NO: 1065912 - protein, 29 aa, Mycobacterium
ITLYSPLRHWNAKPGTRLAIIGLGGLGHM

SEQ ID NO: 1065913 - protein, 18 aa, Mycobacterium
ITMSAPYLSQLRSGNRTN

SEQ ID NO: 1065914 - protein, 27 aa, Mycobacterium
ITRGLAEIIRLGMALGAQVTTLAGLAG

SEQ ID NO: 1065915 - protein, 18 aa, Mycobacterium
ITTEYFLRSVFQDTPREE

SEQ ID NO: 1065916 - protein, 26 aa, Mycobacterium
IVAPLTFVTIFAKYVQLDFFRNVDVG

SEQ ID NO: 1065917 - protein, 17 aa, Mycobacterium
IVCLRRLVDVAPAVFAD

SEQ ID NO: 1065918 - protein, 31 aa, Mycobacterium
IVDQVLVLPEGTRFLVLAPVVRTRKGEFADL

SEQ ID NO: 1065919 - protein, 18 aa, Mycobacterium
IVSFLRYIDANRASWIVM

SEQ ID NO: 1065920 - protein, 22 aa, Mycobacterium
IVSSKAFETWLAELGFSGDEKT

SEQ ID NO: 1065921 - protein, 27 aa, Mycobacterium
IVTTETFTPILYTLTYDNFDEAISLNN

SEQ ID NO: 1065922 - protein, 18 aa, Mycobacterium
IVVLKYPGGVVIAGDRRS

SEQ ID NO: 1065923 - protein, 27 aa, Mycobacterium
IWSPEARVIAERQLWLAVLRAQAELSV

SEQ ID NO: 1065924 - protein, 25 aa, Mycobacterium
IYLNTFRHLCGLDCSHIAPANVYGP

SEQ ID NO: 1065925 - protein, 17 aa, Mycobacterium
IYPLPEVLEVRGEVFFR

SEQ ID NO: 1065926 - protein, 17 aa, Mycobacterium
IYRTRLAGLVPQTEEVV

SEQ ID NO: 1065927 - protein, 23 aa, Mycobacterium
IYSETAFDQAYLATLLGFQLVES

SEQ ID NO: 1065928 - protein, 28 aa, Mycobacterium
IYSFTGASPCFLLDFPRRFPDATVVRLE

SEQ ID NO: 1065929 - protein, 36 aa, Mycobacterium
IYTLTDEAPLLATYAFLPIVRAFTKPAGIKVQTSDI

SEQ ID NO: 1065930 - protein, 25 aa, Mycobacterium
KAAAAGRPWWEWAATHERAFTAAYD

SEQ ID NO: 1065931 - protein, 17 aa, Mycobacterium
KAAGNVIMLRRAGQRFG

SEQ ID NO: 1065932 - protein, 23 aa, Mycobacterium
KAALEVNWPFVLASMLENAVKGG

SEQ ID NO: 1065933 - protein, 23 aa, Mycobacterium
KAARFVRVCDCFNIPIVMLVDVP

SEQ ID NO: 1065934 - protein, 22 aa, Mycobacterium
KACFLALVRCFYELGVKELHGH

SEQ ID NO: 1065935 - protein, 24 aa, Mycobacterium
KADLVSEFFCRLLNYMNANDFDTV

SEQ ID NO: 1065936 - protein, 18 aa, Mycobacterium
KADVLPDCFRPAPASDLV

SEQ ID NO: 1065937 - protein, 32 aa, Mycobacterium
KAEIHDRILVVAKLLDLQPYLDRKPKDLSGGQ

SEQ ID NO: 1065938 - protein, 19 aa, Mycobacterium
KAFDEGWVQPLPPQQLTGK

SEQ ID NO: 1065939 - protein, 20 aa, Mycobacterium
KAGEILVRQRGTKFHPGVNV

SEQ ID NO: 1065940 - protein, 19 aa, Mycobacterium
KAGFAWPEPTVRALPGLAE

SEQ ID NO: 1065941 - protein, 29 aa, Mycobacterium
KAGRRFARLAPIVATHRKLISARDDLQTA

SEQ ID NO: 1065942 - protein, 17 aa, Mycobacterium
KAGWLSVYVPSAEVLHH

SEQ ID NO: 1065943 - protein, 24 aa, Mycobacterium
KAKKLRVRLPLPKLVVAVYNSQRL

SEQ ID NO: 1065944 - protein, 27 aa, Mycobacterium
KAKTAPLWRVLVALSIRHVGPTAARAL

SEQ ID NO: 1065945 - protein, 21 aa, Mycobacterium
KANRRHLFEHKPSTRTRRLDG

SEQ ID NO: 1065946 - protein, 24 aa, Mycobacterium
KAQSAQYTFILDKLSQLADGDEHR

SEQ ID NO: 1065947 - protein, 20 aa, Mycobacterium
KARPSPFYIMDEVEAALDDV

SEQ ID NO: 1065948 - protein, 26 aa, Mycobacterium
KAVLAVQRGFIPRHLNFHQLTTHASE

SEQ ID NO: 1065949 - protein, 18 aa, Mycobacterium
KAWQTMFDTYLYQRAKHT

SEQ ID NO: 1065950 - protein, 18 aa, Mycobacterium
KCETALTVLAPHREQLTG

SEQ ID NO: 1065951 - protein, 21 aa, Mycobacterium
KCEVIYRFFADIADPPDGNEC

SEQ ID NO: 1065952 - protein, 36 aa, Mycobacterium
KDIVEKIIHWFFGLFSHWWSRLHSFFGGIPGLSGAT

SEQ ID NO: 1065953 - protein, 23 aa, Mycobacterium
KDKHTVLSKAPWVDIVFGTHNLG

SEQ ID NO: 1065954 - protein, 21 aa, Mycobacterium
KDLEKIIYFAAYVITTVDEEM

SEQ ID NO: 1065955 - protein, 21 aa, Mycobacterium
KDLVDGVPKLLLEKVAKEAAD

SEQ ID NO: 1065956 - protein, 17 aa, Mycobacterium
KDREMPQGTVKWFNAEK

SEQ ID NO: 1065957 - protein, 35 aa, Mycobacterium
KDVMISWLPCFHDMGMIGFLTVPMYFGAELVKVTP

SEQ ID NO: 1065958 - protein, 17 aa, Mycobacterium
KDVRAVLKIARSALLSG

SEQ ID NO: 1065959 - protein, 18 aa, Mycobacterium
KEANGAPYVTPLVRKLAT

SEQ ID NO: 1065960 - protein, 34 aa, Mycobacterium
KEDAQVWIGDLPCWLADYGYWDLPKRAVGRRYRI

SEQ ID NO: 1065961 - protein, 34 aa, Mycobacterium
KELGLTTPMSLLRFIKFILTEIFPGGRLPKISQV

SEQ ID NO: 1065962 - protein, 23 aa, Mycobacterium
KEQTYFFRLSAYVDKLLAHYDAN

SEQ ID NO: 1065963 - protein, 23 aa, Mycobacterium
KFQDLMARRVPLYRRVATIRVDT

SEQ ID NO: 1065964 - protein, 20 aa, Mycobacterium
KFVALLARLAHLLASAVADV

SEQ ID NO: 1065965 - protein, 19 aa, Mycobacterium
KGAIRKLTISSEAYPVLCG

SEQ ID NO: 1065966 - protein, 25 aa, Mycobacterium
KGEVKDVLLLDVTPLSLGIETKGGV

SEQ ID NO: 1065967 - protein, 17 aa, Mycobacterium
KGFRNRLRTEYAVVNVG

SEQ ID NO: 1065968 - protein, 20 aa, Mycobacterium
KGGFVLKRPPLPTGDAAADR

SEQ ID NO: 1065969 - protein, 17 aa, Mycobacterium
KGKYTDTIYQVAEETKK

SEQ ID NO: 1065970 - protein, 21 aa, Mycobacterium
KGMLTGPVTILAWSFVRDDQP

SEQ ID NO: 1065971 - protein, 24 aa, Mycobacterium
KGNIRRLVSLGPLLDGLEVRIVDE

SEQ ID NO: 1065972 - protein, 23 aa, Mycobacterium
KGQRLAYNRVWVKALGALPNDPT

SEQ ID NO: 1065973 - protein, 21 aa, Mycobacterium
KGSALARLLSLGCRGIRPLNF

SEQ ID NO: 1065974 - protein, 19 aa, Mycobacterium
KGVELVVGRALIVVVDDRT

SEQ ID NO: 1065975 - protein, 28 aa, Mycobacterium
KHPAVSWVRYPFLVSHPQYDLAKRQMSG

SEQ ID NO: 1065976 - protein, 24 aa, Mycobacterium
KHRLDRIFLVAPSSTPHRLVTTVG

SEQ ID NO: 1065977 - protein, 29 aa, Mycobacterium
KHSGPSRARYLILRLLERAGEQRVTIPAL

SEQ ID NO: 1065978 - protein, 18 aa, Mycobacterium
KHYWSIYQKMIVKGRDFD

SEQ ID NO: 1065979 - protein, 17 aa, Mycobacterium
KIANDIRLMGSGPLTGL

SEQ ID NO: 1065980 - protein, 21 aa, Mycobacterium
KIAVASRVPGLNAKGACIGPM

SEQ ID NO: 1065981 - protein, 27 aa, Mycobacterium
KIHRSSLLAMFALGPQLPRSPTRATSL

SEQ ID NO: 1065982 - protein, 18 aa, Mycobacterium
KIIPDLIAWWCERDGVRP

SEQ ID NO: 1065983 - protein, 17 aa, Mycobacterium
KIRIHKFKNKTGYHKRQ

SEQ ID NO: 1065984 - protein, 17 aa, Mycobacterium
KIWSGKGTFLFTRTTAG

SEQ ID NO: 1065985 - protein, 18 aa, Mycobacterium
KLAIKTGAALLPVHCWFQ

SEQ ID NO: 1065986 - protein, 20 aa, Mycobacterium
KLAVARRVYRPADGSCANCG

SEQ ID NO: 1065987 - protein, 21 aa, Mycobacterium
KLAVFGSGFCHLCSQRLGHCQ

SEQ ID NO: 1065988 - protein, 26 aa, Mycobacterium
KLDAQLINELPLPRPKFEIFVYSPRV

SEQ ID NO: 1065989 - protein, 19 aa, Mycobacterium
KLDVAPLHPYTVVVAQGVS

SEQ ID NO: 1065990 - protein, 24 aa, Mycobacterium
KLELERLFVLTFETEFFSQHGFTE

SEQ ID NO: 1065991 - protein, 30 aa, Mycobacterium
KLIEMQGDGPYILAGWSLGGVLAYACAIGL

SEQ ID NO: 1065992 - protein, 21 aa, Mycobacterium
KLIHYGQLRQWSRLTGSVTML

SEQ ID NO: 1065993 - protein, 17 aa, Mycobacterium
KLLRNVLRAQSPTKPIW

SEQ ID NO: 1065994 - protein, 17 aa, Mycobacterium
KLNPAPIRSIPVLIGGT

SEQ ID NO: 1065995 - protein, 42 aa, Mycobacterium
KLPSVLYWDRILFCAKEATYKAWFPLTKRWLGFEDAHITFDV

SEQ ID NO: 1065996 - protein, 23 aa, Mycobacterium
KLTKWSIPLLRPGGQILAIKGEH

SEQ ID NO: 1065997 - protein, 18 aa, Mycobacterium
KLVVVDYLQLMTSGKRFE

SEQ ID NO: 1065998 - protein, 33 aa, Mycobacterium
KLVYELKFGDVVTPPLRLIVYGGSRVIAADVRF

SEQ ID NO: 1065999 - protein, 17 aa, Mycobacterium
KMGLPVFAVVAFAQSFG

SEQ ID NO: 1066000 - protein, 20 aa, Mycobacterium
KMVRKRMRALKYAKQLVDDV

SEQ ID NO: 1066001 - protein, 20 aa, Mycobacterium
KMYKITGTLKQGIDNRNAKK

SEQ ID NO: 1066002 - protein, 33 aa, Mycobacterium
KNGQRRLVNRKVLPGYILVRMDLTDDSWAAVRN

SEQ ID NO: 1066003 - protein, 22 aa, Mycobacterium
KNRHWYSTGADFKRPSPHWWFD

SEQ ID NO: 1066004 - protein, 20 aa, Mycobacterium
KPAYIAGDLAYYLDKRQRGF

SEQ ID NO: 1066005 - protein, 23 aa, Mycobacterium
KPEFINRLDDVLIFDGLNPEELV

SEQ ID NO: 1066006 - protein, 30 aa, Mycobacterium
KPFRLPANELEFFFVLTFTGSNTAKHTTGY

SEQ ID NO: 1066007 - protein, 24 aa, Mycobacterium
KPGNNLPLRNIPAGTLIHAVELRP

SEQ ID NO: 1066008 - protein, 25 aa, Mycobacterium
KPITHPLRADIPIMLGAEGPKNVAL

SEQ ID NO: 1066009 - protein, 17 aa, Mycobacterium
KPLLLMVNVEKPLPSDI

SEQ ID NO: 1066010 - protein, 31 aa, Mycobacterium
KPVLYQHFSSKLELYLAVLERHMNNLVSSVQ

SEQ ID NO: 1066011 - protein, 17 aa, Mycobacterium
KQAWLRDLATWQPDLVV

SEQ ID NO: 1066012 - protein, 32 aa, Mycobacterium
KQKWDRIRYHGGAFIELIVGRSTYDLAAAAAV

SEQ ID NO: 1066013 - protein, 23 aa, Mycobacterium
KQLQLIPWEFIGGLGVSRSAAPI

SEQ ID NO: 1066014 - protein, 17 aa, Mycobacterium
KQLYTLDLGSLVAGSRY

SEQ ID NO: 1066015 - protein, 18 aa, Mycobacterium
KRDIYGDTRLGLFPFRRN

SEQ ID NO: 1066016 - protein, 27 aa, Mycobacterium
KRGAIELAWALLTNSFADGGYGLDPER

SEQ ID NO: 1066017 - protein, 17 aa, Mycobacterium
KRGFDPVLGARPLRRTI

SEQ ID NO: 1066018 - protein, 24 aa, Mycobacterium
KRIERGLALTALLHATLTDVRSPA

SEQ ID NO: 1066019 - protein, 28 aa, Mycobacterium
KRIMLWRNYFDLFDLFKATMRSLVALRI

SEQ ID NO: 1066020 - protein, 18 aa, Mycobacterium
KRLPYSLKVLAENLLRNE

SEQ ID NO: 1066021 - protein, 17 aa, Mycobacterium
KRLRQWMMRITAYADRL

SEQ ID NO: 1066022 - protein, 17 aa, Mycobacterium
KRRVPTTALAQLPLLLL

SEQ ID NO: 1066023 - protein, 23 aa, Mycobacterium
KRYALPHARILMHQPLGGVTGSA

SEQ ID NO: 1066024 - protein, 18 aa, Mycobacterium
KSAAALVLPTRWSHCMHA

SEQ ID NO: 1066025 - protein, 23 aa, Mycobacterium
KSEGIAVFRFFRGPMPVPNGYVT

SEQ ID NO: 1066026 - protein, 25 aa, Mycobacterium
KSLAAAPFADILWMETKTADLADAR

SEQ ID NO: 1066027 - protein, 22 aa, Mycobacterium
KSLVHMGFRVIPSDANFVLFGH

SEQ ID NO: 1066028 - protein, 26 aa, Mycobacterium
KSPFFGDRRKAFLEDLAIVTGGQVVN

SEQ ID NO: 1066029 - protein, 23 aa, Mycobacterium
KSTIAAALALTLAAGGRKVLLIE

SEQ ID NO: 1066030 - protein, 20 aa, Mycobacterium
KSTLLRLLSGIYEPTRGWAK

SEQ ID NO: 1066031 - protein, 22 aa, Mycobacterium
KTAANYHCTWFESCKTINEPVH

SEQ ID NO: 1066032 - protein, 25 aa, Mycobacterium
KTAQLLDWFCSFSTAAALVGSPGQG

SEQ ID NO: 1066033 - protein, 24 aa, Mycobacterium
KTAVPELMMLYAESLISGANPKPV

SEQ ID NO: 1066034 - protein, 20 aa, Mycobacterium
KTIDLALGGVLFIDEAYALV

SEQ ID NO: 1066035 - protein, 35 aa, Mycobacterium
KTLNTTVVSWLPLFHDMGLILGVCAPMVAGRSSVL

SEQ ID NO: 1066036 - protein, 20 aa, Mycobacterium
KTLSTLPKPTSPSATICASQ

SEQ ID NO: 1066037 - protein, 24 aa, Mycobacterium
KTLTCVLPAYLNALAGKGVHIVTV

SEQ ID NO: 1066038 - protein, 18 aa, Mycobacterium
KTMVVTGLHLLGGARADA

SEQ ID NO: 1066039 - protein, 17 aa, Mycobacterium
KTPRLATATFLKNAKRA

SEQ ID NO: 1066040 - protein, 23 aa, Mycobacterium
KVEVFHYTRKWLQQISLDRSVSH

SEQ ID NO: 1066041 - protein, 29 aa, Mycobacterium
KVFDGVNLALLVGARPRGPGMERGDLLEA

SEQ ID NO: 1066042 - protein, 24 aa, Mycobacterium
KVGRIARVLGPRGLMPNPKTGTVT

SEQ ID NO: 1066043 - protein, 27 aa, Mycobacterium
KVNGFGGWKYKKLRDVLGLLRDAYCRH

SEQ ID NO: 1066044 - protein, 19 aa, Mycobacterium
KVPILVLVGEPIEPTLGVA

SEQ ID NO: 1066045 - protein, 21 aa, Mycobacterium
KVPLHQIAVSALELGLRGSRK

SEQ ID NO: 1066046 - protein, 18 aa, Mycobacterium
KVSALLEALPKVGKVKAQ

SEQ ID NO: 1066047 - protein, 24 aa, Mycobacterium
KVSENQLFYLMSRGLAEDEAMAMV

SEQ ID NO: 1066048 - protein, 17 aa, Mycobacterium
KVSPLAVQMIMPNGAAA

SEQ ID NO: 1066049 - protein, 19 aa, Mycobacterium
KVTVEWVELPQQGGLIAHL

SEQ ID NO: 1066050 - protein, 19 aa, Mycobacterium
KVVDLLTPYVRGGKIALFG

SEQ ID NO: 1066051 - protein, 24 aa, Mycobacterium
KVVSWYDNEWGYSNRLVDLVGLVG

SEQ ID NO: 1066052 - protein, 21 aa, Mycobacterium
KWFVDSLLGGMIGFGGEESTG

SEQ ID NO: 1066053 - protein, 21 aa, Mycobacterium
KWLFDKLLGIKPRWNVRRQRS

SEQ ID NO: 1066054 - protein, 20 aa, Mycobacterium
KWNWINTLHKMGTSTVGIHA

SEQ ID NO: 1066055 - protein, 30 aa, Mycobacterium
KYALRSVNMFAPWIRRIFIATDSIPPSWLA

SEQ ID NO: 1066056 - protein, 18 aa, Mycobacterium
KYFISDQEVRWCPGCGSS

SEQ ID NO: 1066057 - protein, 25 aa, Mycobacterium
KYTFMPIGELWYRKSGTYRGKIQNL

SEQ ID NO: 1066058 - protein, 24 aa, Mycobacterium
KYVRMPHHRLVMRQLAFGYTYEEL

SEQ ID NO: 1066059 - protein, 22 aa, Mycobacterium
KYYDKVDVTVLPPFTDLRSVQT

SEQ ID NO: 1066060 - protein, 22 aa, Mycobacterium
LAAAATLLRRVGSALAPAQLPA

SEQ ID NO: 1066061 - protein, 23 aa, Mycobacterium
LAAEICDGWLPIFFSPRMADMYN

SEQ ID NO: 1066062 - protein, 24 aa, Mycobacterium
LAAGHLTLVPALRDALADVGRPDI

SEQ ID NO: 1066063 - protein, 17 aa, Mycobacterium
LAAIALLSHSMLDGWRA

SEQ ID NO: 1066064 - protein, 26 aa, Mycobacterium
LAALRPYVTGYYLVAFDSPLMVTNRT

SEQ ID NO: 1066065 - protein, 17 aa, Mycobacterium
LAAPLVLHPGSGVQVQV

SEQ ID NO: 1066066 - protein, 22 aa, Mycobacterium
LAARFTRALRFGTSGLRGPVRG

SEQ ID NO: 1066067 - protein, 18 aa, Mycobacterium
LAATIARRLGLTGALGTV

SEQ ID NO: 1066068 - protein, 19 aa, Mycobacterium
LAAVKRLYLLGKNDQPTGT

SEQ ID NO: 1066069 - protein, 23 aa, Mycobacterium
LADIALRRPSLDDVFLSMTTDPS

SEQ ID NO: 1066070 - protein, 25 aa, Mycobacterium
LADSPILVVNYRLLPKHSIGMALDD

SEQ ID NO: 1066071 - protein, 24 aa, Mycobacterium
LADYLESLHRLSGLGRRTVLPGHG

SEQ ID NO: 1066072 - protein, 32 aa, Mycobacterium
LAEAAAVPVVFLTALFGLADLAGIRAGESVLI

SEQ ID NO: 1066073 - protein, 23 aa, Mycobacterium
LAEEPELILLDNFPVWQTQVAVQ

SEQ ID NO: 1066074 - protein, 26 aa, Mycobacterium
LAEFKAMFQMKFYALTLLHSRGVLPA

SEQ ID NO: 1066075 - protein, 21 aa, Mycobacterium
LAEFVGACVGLLFSSGYAANL

SEQ ID NO: 1066076 - protein, 27 aa, Mycobacterium
LAEHNLLPDVLYTSLLRRAITTAHLAL

SEQ ID NO: 1066077 - protein, 20 aa, Mycobacterium
LAELDFLQSAPWIDTSRLRD

SEQ ID NO: 1066078 - protein, 24 aa, Mycobacterium
LAELPAGSLVGTSSPRRAAQLRAL

SEQ ID NO: 1066079 - protein, 32 aa, Mycobacterium; identical to SEQ ID NO: 219853

SEQ ID NO: 1066080 - protein, 18 aa, Mycobacterium
LAFAKTPPTVVMLAGLQG

SEQ ID NO: 1066081 - protein, 35 aa, Mycobacterium
LAGAFLRAGTINRILAYVAPILLGGPVTAVDDVGV

SEQ ID NO: 1066082 - protein, 19 aa, Mycobacterium
LAGTLPYFDLIVALGCEAG

SEQ ID NO: 1066083 - protein, 23 aa, Mycobacterium
LAICKRYLRNAPARIVLAAMPDD

SEQ ID NO: 1066084 - protein, 35 aa, Mycobacterium; identical to SEQ ID NO: 830984

SEQ ID NO: 1066085 - protein, 19 aa, Mycobacterium
LAKHPLPFSLVNPGFVVGS

SEQ ID NO: 1066086 - protein, 25 aa, Mycobacterium
LALAALDLDPILDLRMRLGEGTGAT

SEQ ID NO: 1066087 - protein, 25 aa, Mycobacterium
LALRDRLIVEMLYATGIRVSELCGL

SEQ ID NO: 1066088 - protein, 20 aa, Mycobacterium
LALTELWRSYGVEPDAVIGH

SEQ ID NO: 1066089 - protein, 17 aa, Mycobacterium
LALVFNEGPDYAAAGVF

SEQ ID NO: 1066090 - protein, 25 aa, Mycobacterium
LAMDPQQRMLLELSWEALERAGIDP

SEQ ID NO: 1066091 - protein, 19 aa, Mycobacterium
LAPEWQIMLDPELTGYFAN

SEQ ID NO: 1066092 - protein, 17 aa, Mycobacterium
LAPSLTGIDGSGLGWGL

SEQ ID NO: 1066093 - protein, 24 aa, Mycobacterium
LAQKWELLLLFSDAIAAAVNPVGL

SEQ ID NO: 1066094 - protein, 26 aa, Mycobacterium
LAQMAYMLPRLRGWGESMSRQVGGRA

SEQ ID NO: 1066095 - protein, 19 aa, Mycobacterium
LARICALNALAAVDSLVGL

SEQ ID NO: 1066096 - protein, 32 aa, Mycobacterium
LARMLIAGEDPRFIARRLLILASEDIGLADST

SEQ ID NO: 1066097 - protein, 17 aa, Mycobacterium
LARPRPFLHEITEVMAY

SEQ ID NO: 1066098 - protein, 17 aa, Mycobacterium
LASKPWVKTTMAPGSQV

SEQ ID NO: 1066099 - protein, 19 aa, Mycobacterium
LASLGVFEEAFRRGKEAIE

SEQ ID NO: 1066100 - protein, 29 aa, Mycobacterium
LASNAVHIAYPYYLFKGRIPVTKKTFKAR

SEQ ID NO: 1066101 - protein, 18 aa, Mycobacterium
LATATWKRKLYAAPVTTN

SEQ ID NO: 1066102 - protein, 26 aa, Mycobacterium
LATIHPSRYLTLISGVTTVLLTGVHG

SEQ ID NO: 1066103 - protein, 19 aa, Mycobacterium
LATLSPNCFASKNRVALAI

SEQ ID NO: 1066104 - protein, 19 aa, Mycobacterium
LATLVVNSIRKTLKAVAVK

SEQ ID NO: 1066105 - protein, 19 aa, Mycobacterium
LATNLLWTSIGTTLIETQV

SEQ ID NO: 1066106 - protein, 23 aa, Mycobacterium
LATVIPFHRAVVSDPALIGDNNS

SEQ ID NO: 1066107 - protein, 17 aa, Mycobacterium
LATVWRAHWLLAKKPED

SEQ ID NO: 1066108 - protein, 22 aa, Mycobacterium
LAVDFRQRFKKDVVIDMLCYRR

SEQ ID NO: 1066109 - protein, 25 aa, Mycobacterium
LAVKPTSDLIPLCHQFALTGVGVDF

SEQ ID NO: 1066110 - protein, 18 aa, Mycobacterium
LAVLRPIGFVLMAFDVGD

SEQ ID NO: 1066111 - protein, 17 aa, Mycobacterium
LAVSQDISHYFRAQRSV

SEQ ID NO: 1066112 - protein, 17 aa, Mycobacterium
LAVVPKSTALVLWQPRK

SEQ ID NO: 1066113 - protein, 19 aa, Mycobacterium
LAWFLSGLVPPTNPTTIMA

SEQ ID NO: 1066114 - protein, 17 aa, Mycobacterium
LAYLLVQTAIHTAKFVA

SEQ ID NO: 1066115 - protein, 26 aa, Mycobacterium
LCEAGLLPGALIRNVGLHFICRDVWL

SEQ ID NO: 1066116 - protein, 17 aa, Mycobacterium
LCLGGIYDFGGPTADEL

SEQ ID NO: 1066117 - protein, 20 aa, Mycobacterium
LCPAPCESACVLGINQDPVT

SEQ ID NO: 1066118 - protein, 19 aa, Mycobacterium
LCRIRLVLPDPVGLLRCCG

SEQ ID NO: 1066119 - protein, 19 aa, Mycobacterium
LCRSIKFPTFLAGIDAVCR

SEQ ID NO: 1066120 - protein, 30 aa, Mycobacterium
LCSARMYFAYGLGNSVWFPLATGGSAVISS

SEQ ID NO: 1066121 - protein, 23 aa, Mycobacterium
LCSTTLIVWIPTLEPRRVPGLWA

SEQ ID NO: 1066122 - protein, 18 aa, Mycobacterium
LCYACFDGRYPIELPSEA

SEQ ID NO: 1066123 - protein, 21 aa, Mycobacterium
LDAALDRFGPPVGDLSWVVKD

SEQ ID NO: 1066124 - protein, 32 aa, Mycobacterium
LDACLDRYARLFAWLGLWERRSDLAVIPADGE

SEQ ID NO: 1066125 - protein, 30 aa, Mycobacterium
LDAMLVTCLINVRYLSGFTGSNGALLVFAD

SEQ ID NO: 1066126 - protein, 24 aa, Mycobacterium
LDARQWFQSFPAVAGSSLFANLRD

SEQ ID NO: 1066127 - protein, 31 aa, Mycobacterium
LDDGTPFPTLYYLTHPVLIAAASRLESTGLM

SEQ ID NO: 1066128 - protein, 22 aa, Mycobacterium
LDDPLVLLHQEKISSLPELLPM

SEQ ID NO: 1066129 - protein, 19 aa, Mycobacterium
LDELARPRFTLHTRDPRAG

SEQ ID NO: 1066130 - protein, 18 aa, Mycobacterium
LDFHFRPHITAPSGKQGM

SEQ ID NO: 1066131 - protein, 18 aa, Mycobacterium
LDGLPWQAGQPPRLGVHR

SEQ ID NO: 1066132 - protein, 22 aa, Mycobacterium
LDGRAILRRLVTADPTAYGYLV

SEQ ID NO: 1066133 - protein, 19 aa, Mycobacterium
LDIGLATTVLGWSPQVQLD

SEQ ID NO: 1066134 - protein, 30 aa, Mycobacterium
LDISPLQARCGWAIGWKKDAFLGRDALLAE

SEQ ID NO: 1066135 - protein, 25 aa, Mycobacterium
LDKYHLRYPLNRALRYGVKATFSTA

SEQ ID NO: 1066136 - protein, 17 aa, Mycobacterium
LDLLLGLANEAEGTAMM

SEQ ID NO: 1066137 - protein, 27 aa, Mycobacterium
LDLPATLALPMRVIASVGAILCQLDAH

SEQ ID NO: 1066138 - protein, 21 aa, Mycobacterium
LDLSDYMDDVAVLSGLQTHEV

SEQ ID NO: 1066139 - protein, 18 aa, Mycobacterium
LDMFRPGDRRAARAALGL

SEQ ID NO: 1066140 - protein, 18 aa, Mycobacterium
LDMLLTAGERISNALVAM

SEQ ID NO: 1066141 - protein, 19 aa, Mycobacterium
LDPFTRCWELRPDGQWTAS

SEQ ID NO: 1066142 - protein, 18 aa, Mycobacterium
LDPLPLNELIERDSNRHP

SEQ ID NO: 1066143 - protein, 21 aa, Mycobacterium
LDPYLPDFVMCRADIAPILLG

SEQ ID NO: 1066144 - protein, 31 aa, Mycobacterium
LDRNIDALAIDGQLIVIGLQGGVKGELNLGK

SEQ ID NO: 1066145 - protein, 20 aa, Mycobacterium
LDRQLSERLLTIGWQQRTLP

SEQ ID NO: 1066146 - protein, 33 aa, Mycobacterium
LDRRVWLRPFRNLVYAMPPYICPPAEIAQITSA

SEQ ID NO: 1066147 - protein, 20 aa, Mycobacterium
LDSRCAVLDMYLVGSVRSSA

SEQ ID NO: 1066148 - protein, 17 aa, Mycobacterium
LDTLLSEVPWRIERRRM

SEQ ID NO: 1066149 - protein, 24 aa, Mycobacterium
LDVDVVFSASFNALPIRRLGLHER

SEQ ID NO: 1066150 - protein, 25 aa, Mycobacterium
LDWDDELLSFFSIPRAMLPAIASSS

SEQ ID NO: 1066151 - protein, 30 aa, Mycobacterium
LEACWGDVAMLLSIPYQGLGNAAISAVATN

SEQ ID NO: 1066152 - protein, 20 aa, Mycobacterium
LEALLTRLNLPDDVPIEAKM

SEQ ID NO: 1066153 - protein, 19 aa, Mycobacterium
LEDQIQVWALRLAAELPVA

SEQ ID NO: 1066154 - protein, 31 aa, Mycobacterium
LEDWKCWARWRLIRARAPWLTDDLVAADFDF

SEQ ID NO: 1066155 - protein, 17 aa, Mycobacterium
LEEQVVVLRLLAAQQEA

SEQ ID NO: 1066156 - protein, 26 aa, Mycobacterium
LEFRPKVLIAGWSAYPRILDFAAFRS

SEQ ID NO: 1066157 - protein, 19 aa, Mycobacterium
LEFRSLVGMPFQRPNPFPK

SEQ ID NO: 1066158 - protein, 23 aa, Mycobacterium
LEHPGYYQVMFIKSLLDSSNDEL

SEQ ID NO: 1066159 - protein, 18 aa, Mycobacterium
LELAPNAVALMQVGLTTA

SEQ ID NO: 1066160 - protein, 18 aa, Mycobacterium
LELDWVHFLPSNGGLVLL

SEQ ID NO: 1066161 - protein, 34 aa, Mycobacterium
LEQRIPSRPVIIGPVTFLLLSKGINGGGAPIQRL

SEQ ID NO: 1066162 - protein, 20 aa, Mycobacterium
LERMRSAPTVFIDAAHNPAG

SEQ ID NO: 1066163 - protein, 24 aa, Mycobacterium
LESLRYDLAVQEIFVFTPKGDVIT

SEQ ID NO: 1066164 - protein, 28 aa, Mycobacterium
LESNAPVLLGLIGLWYSDFLGAQSRAVL

SEQ ID NO: 1066165 - protein, 26 aa, Mycobacterium
LESVLTVLALRDGVIPPTLNYQTPDP

SEQ ID NO: 1066166 - protein, 24 aa, Mycobacterium
LEVAERILLNSKTRRPSVCNAAET

SEQ ID NO: 1066167 - protein, 40 aa, Mycobacterium
LEVSLPAKRWLAQHGFDPVYGARPLRRLVQQAIGDQLAKM

SEQ ID NO: 1066168 - protein, 17 aa, Mycobacterium
LEYTTAISYIPVGVSYE

SEQ ID NO: 1066169 - protein, 26 aa, Mycobacterium
LFAAGGKRFRPLFTVLSAQIGPRPDA

SEQ ID NO: 1066170 - protein, 24 aa, Mycobacterium
LFADTLFDSILYVTFQELATRVSH

SEQ ID NO: 1066171 - protein, 31 aa, Mycobacterium
LFAVEVALFAVLQHWGLQPDFVMGHSIGELA

SEQ ID NO: 1066172 - protein, 17 aa, Mycobacterium
LFNATRYALLNGAALVP

SEQ ID NO: 1066173 - protein, 20 aa, Mycobacterium
LFNLRFQMATGQLNNNRRLR

SEQ ID NO: 1066174 - protein, 21 aa, Mycobacterium
LGAMQAGFIAVPLSVPQAGSH

SEQ ID NO: 1066175 - protein, 27 aa, Mycobacterium
LGANFAEFGGWLMPVSYAGTVSEHSAT

SEQ ID NO: 1066176 - protein, 28 aa, Mycobacterium
LGAWAVMFGRTYLWGLATAWQTGVENVL

SEQ ID NO: 1066177 - protein, 22 aa, Mycobacterium
LGCYGIQRIHLLRNVMILAGAG

SEQ ID NO: 1066178 - protein, 19 aa, Mycobacterium
LGDGWSRRVDKPSAIPILA

SEQ ID NO: 1066179 - protein, 22 aa, Mycobacterium
LGDGWVHFDAPAGMLIPDSVAT

SEQ ID NO: 1066180 - protein, 24 aa, Mycobacterium
LGDNGYVPIPDSFKSRLSTAANAI

SEQ ID NO: 1066181 - protein, 20 aa, Mycobacterium
LGEGFGVWRLGDDEAMLRIV

SEQ ID NO: 1066182 - protein, 24 aa, Mycobacterium
LGFDVDTPWRKLPAKARKAILEGS

SEQ ID NO: 1066183 - protein, 17 aa, Mycobacterium
LGFFSLLGLMGQGEMFP

SEQ ID NO: 1066184 - protein, 17 aa, Mycobacterium
LGFTQEALLHYPPPELT

SEQ ID NO: 1066185 - protein, 17 aa, Mycobacterium
LGGGLPMAPMVPGGGSG

SEQ ID NO: 1066186 - protein, 18 aa, Mycobacterium
LGGLPFSGPIGGVRVALI

SEQ ID NO: 1066187 - protein, 24 aa, Mycobacterium
LGGLSIALLAYQLSLNGQSAPVID

SEQ ID NO: 1066188 - protein, 19 aa, Mycobacterium
LGGWLLADLMTVDGSVLPV

SEQ ID NO: 1066189 - protein, 18 aa, Mycobacterium
LGHPWTVLRATRSTDYLI

SEQ ID NO: 1066190 - protein, 23 aa, Mycobacterium
LGIELMSFDDLLARADFISVHLP

SEQ ID NO: 1066191 - protein, 26 aa, Mycobacterium
LGITLPVALVWAYPTTADLAAALCER

SEQ ID NO: 1066192 - protein, 21 aa, Mycobacterium
LGKDVLLLTDGRFSGGTTGFC

SEQ ID NO: 1066193 - protein, 22 aa, Mycobacterium
LGKMGFVFNFITYGGHQIDGVA

SEQ ID NO: 1066194 - protein, 25 aa, Mycobacterium
LGLDSVRFTLLMKQLGLSQEAEMQS

SEQ ID NO: 1066195 - protein, 18 aa, Mycobacterium
LGLFITWLRHVGPQASAA

SEQ ID NO: 1066196 - protein, 24 aa, Mycobacterium
LGLRSLRLWHEGGFTDRLAPEVIT

SEQ ID NO: 1066197 - protein, 25 aa, Mycobacterium
LGLSTYKMVFGHRGINIPVIDHATG

SEQ ID NO: 1066198 - protein, 20 aa, Mycobacterium
LGLYTVGEFATAGRWDRIVV

SEQ ID NO: 1066199 - protein, 23 aa, Mycobacterium
LGNTGRILLRPSGTEPMIRVMVE

SEQ ID NO: 1066200 - protein, 23 aa, Mycobacterium
LGPIRPPQRLAPYSYALGAQVKH

SEQ ID NO: 1066201 - protein, 19 aa, Mycobacterium
LGPVDLPQGVRRPAGTPLG

SEQ ID NO: 1066202 - protein, 17 aa, Mycobacterium
LGPVWPRNPWTAAYRQE

SEQ ID NO: 1066203 - protein, 24 aa, Mycobacterium
LGQPLPLFIKWDDADYGLRAAEHG

SEQ ID NO: 1066204 - protein, 24 aa, Mycobacterium
LGRVWLRAGYRFLKTQTALVDQAL

SEQ ID NO: 1066205 - protein, 20 aa, Mycobacterium
LGSLRSAVLAHRADLGLAHD

SEQ ID NO: 1066206 - protein, 31 aa, Mycobacterium
LGTGESLAYKMWLPPLLDPLPLNELIERDSN

SEQ ID NO: 1066207 - protein, 18 aa, Mycobacterium
LGTTRWLVAILENHQRPD

SEQ ID NO: 1066208 - protein, 22 aa, Mycobacterium
LGVEHLLPIAPPPQETPPRWRR

SEQ ID NO: 1066209 - protein, 24 aa, Mycobacterium
LGVNWRVRCEAGVPVPAVGALPAC

SEQ ID NO: 1066210 - protein, 20 aa, Mycobacterium
LGVYVDLVPVILDAGADYVE

SEQ ID NO: 1066211 - protein, 17 aa, Mycobacterium
LGWFDRTARTSDKYTRS

SEQ ID NO: 1066212 - protein, 19 aa, Mycobacterium
LHAELARRDLAAAAAILPT

SEQ ID NO: 1066213 - protein, 23 aa, Mycobacterium
LHAGSIEIWKLITAAVKHDPYGR

SEQ ID NO: 1066214 - protein, 17 aa, Mycobacterium
LHDRLALRRIAGLSTEL

SEQ ID NO: 1066215 - protein, 24 aa, Mycobacterium
LHEAKLAMHDLAGRGWTLGGITSD

SEQ ID NO: 1066216 - protein, 18 aa, Mycobacterium
LHELIAWLVARPLDKMRP

SEQ ID NO: 1066217 - protein, 37 aa, Mycobacterium
LHEMAHMWFGNLVTMTWWDDLWLNESFATFASVLCQS

SEQ ID NO: 1066218 - protein, 27 aa, Mycobacterium
LHEVRIMLDQYWPSVPHVLIEPGVRTG

SEQ ID NO: 1066219 - protein, 27 aa, Mycobacterium
LHFICRDVWLRVISTSTAWTSRFEPET

SEQ ID NO: 1066220 - protein, 18 aa, Mycobacterium
LHKLINVIKVVEQEADNS

SEQ ID NO: 1066221 - protein, 18 aa, Mycobacterium
LHKVVLARALQLVADAPL

SEQ ID NO: 1066222 - protein, 20 aa, Mycobacterium
LHLLERKIAHLPPKKHGNIP

SEQ ID NO: 1066223 - protein, 20 aa, Mycobacterium
LHPAVIERAGLPKGICAIEL

SEQ ID NO: 1066224 - protein, 23 aa, Mycobacterium
LHPYRVRHLLDRYGALIGDVLAL

SEQ ID NO: 1066225 - protein, 23 aa, Mycobacterium
LHQAMAYSIAVVQFRVHLQEATK

SEQ ID NO: 1066226 - protein, 19 aa, Mycobacterium
LHSLFTYDRRWLHEQGIPL

SEQ ID NO: 1066227 - protein, 19 aa, Mycobacterium
LHSTRWLALADIDRLKANE

SEQ ID NO: 1066228 - protein, 21 aa, Mycobacterium
LHVVALPMRVRFRGITTREVA

SEQ ID NO: 1066229 - protein, 18 aa, Mycobacterium
LIALYEHQVFTEGVIWGI

SEQ ID NO: 1066230 - protein, 17 aa, Mycobacterium
LIARIRAVLRRGGDDDS

SEQ ID NO: 1066231 - protein, 17 aa, Mycobacterium
LIDVLAAALPPGPAYYS

SEQ ID NO: 1066232 - protein, 21 aa, Mycobacterium
LIGMGVIPLQFPQGESASSLG

SEQ ID NO: 1066233 - protein, 23 aa, Mycobacterium
LIGSRWLAHYTATSAFLDILGYA

SEQ ID NO: 1066234 - protein, 19 aa, Mycobacterium
LIGWTARFLGMAHPGDKVD

SEQ ID NO: 1066235 - protein, 17 aa, Mycobacterium
LIKGLDSDAIYNSWASP

SEQ ID NO: 1066236 - protein, 20 aa, Mycobacterium
LIKTILCLKNKAIPATLHYT

SEQ ID NO: 1066237 - protein, 18 aa, Mycobacterium
LIKVLNNPTTSPFGNPIP

SEQ ID NO: 1066238 - protein, 18 aa, Mycobacterium
LILDHDEHMRPDTSKEGL

SEQ ID NO: 1066239 - protein, 17 aa, Mycobacterium
LILKKIPYLTKTLDFLM

SEQ ID NO: 1066240 - protein, 18 aa, Mycobacterium
LINQHFLLTGLSPNRREL

SEQ ID NO: 1066241 - protein, 17 aa, Mycobacterium
LIRTSLASYARYWREAF

SEQ ID NO: 1066242 - protein, 19 aa, Mycobacterium
LISPENKAYYFAAAFPSAC

SEQ ID NO: 1066243 - protein, 17 aa, Mycobacterium
LISWIELFDWLSVSLIC

SEQ ID NO: 1066244 - protein, 21 aa, Mycobacterium
LITGHPLLRHRGPQLLTAVFS

SEQ ID NO: 1066245 - protein, 18 aa, Mycobacterium
LIVPWWLLRQHLAIQFEV

SEQ ID NO: 1066246 - protein, 29 aa, Mycobacterium
LIVVASAATRWVWLADALALDVPEVQKAL

SEQ ID NO: 1066247 - protein, 20 aa, Mycobacterium
LKDPFLFDPPLLLAAEILIK

SEQ ID NO: 1066248 - protein, 17 aa, Mycobacterium
LKEIRTDDLWLFRNRSR

SEQ ID NO: 1066249 - protein, 18 aa, Mycobacterium
LKHLVGALLGLLNERESS

SEQ ID NO: 1066250 - protein, 19 aa, Mycobacterium
LKKHFRPEFLNRIDDIIVF

SEQ ID NO: 1066251 - protein, 27 aa, Mycobacterium
LKKNYGIAAQPYWRPPYAKHNATVDAV

SEQ ID NO: 1066252 - protein, 22 aa, Mycobacterium
LKQILQILRYGAEYAGKILAQP

SEQ ID NO: 1066253 - protein, 23 aa, Mycobacterium
LKVRIQLLRYYKSVAFHLINAFL

SEQ ID NO: 1066254 - protein, 18 aa, Mycobacterium
LLAAGTRGKRYALPHARI

SEQ ID NO: 1066255 - protein, 18 aa, Mycobacterium
LLAEQLDWLLGNGGLEWA

SEQ ID NO: 1066256 - protein, 19 aa, Mycobacterium
LLAFTHLETDYRKSTDNAA

SEQ ID NO: 1066257 - protein, 18 aa, Mycobacterium
LLAFTWLNPHVYPRHRGA

SEQ ID NO: 1066258 - protein, 17 aa, Mycobacterium
LLAHAHPLLRDVGRIVD

SEQ ID NO: 1066259 - protein, 25 aa, Mycobacterium
LLAHSAGYVELFYGRPRNASSWELV

SEQ ID NO: 1066260 - protein, 27 aa, Mycobacterium
LLANWLTYCGWLCDDALIRRLENEVDA

SEQ ID NO: 1066261 - protein, 30 aa, Mycobacterium
LLCAGIIGYRSLLRSELPPGGRLGIYGFGG

SEQ ID NO: 1066262 - protein, 28 aa, Mycobacterium
LLCLFDPVIFFWQWVEWLFGFRYCIEIY

SEQ ID NO: 1066263 - protein, 19 aa, Mycobacterium
LLDRLHVVALPMRVRFRGI

SEQ ID NO: 1066264 - protein, 29 aa, Mycobacterium
LLDVDDEFFIILRPAPSGTRLLLSDATAA

SEQ ID NO: 1066265 - protein, 28 aa, Mycobacterium
LLEGRDLLFARLLQYRAFKRVAQIFAEL

SEQ ID NO: 1066266 - protein, 18 aa, Mycobacterium
LLEQPSVFDNKKTVKVLL

SEQ ID NO: 1066267 - protein, 17 aa, Mycobacterium
LLFSVFEGGLRHGLFHG

SEQ ID NO: 1066268 - protein, 26 aa, Mycobacterium
LLGRHYLPPFQYFYESARNAFQVLPG

SEQ ID NO: 1066269 - protein, 39 aa, Mycobacterium
LLGSPLLAVPPRGWVNLHFSLLPAWRGAAPVQAAIAAGD

SEQ ID NO: 1066270 - protein, 27 aa, Mycobacterium
LLGYGCKQVEYLQWKKALMGNIRHTVR

SEQ ID NO: 1066271 - protein, 30 aa, Mycobacterium
LLHSRGVLPARLRLIYLADSQLLDYAPDRD

SEQ ID NO: 1066272 - protein, 17 aa, Mycobacterium
LLIVVALADPPPRTGLV

SEQ ID NO: 1066273 - protein, 18 aa, Mycobacterium
LLLATRSASRHPAIPVSD

SEQ ID NO: 1066274 - protein, 17 aa, Mycobacterium
LLLMVNVEKPLPSDITV

SEQ ID NO: 1066275 - protein, 19 aa, Mycobacterium
LLLQQMVRLALVWSAKTTS

SEQ ID NO: 1066276 - protein, 18 aa, Mycobacterium
LLLRLRFELDHHINLRPA

SEQ ID NO: 1066277 - protein, 20 aa, Mycobacterium
LLLVLLTRFLAPDDPRVLNT

SEQ ID NO: 1066278 - protein, 17 aa, Mycobacterium
LLNRISLTPGEAIFLPA

SEQ ID NO: 1066279 - protein, 24 aa, Mycobacterium
LLPCERVHWLLDMGSPLLELASLA

SEQ ID NO: 1066280 - protein, 17 aa, Mycobacterium
LLPTVLLGRAGRYLTSS

SEQ ID NO: 1066281 - protein, 20 aa, Mycobacterium
LLQVDMWEHAFYLQYKNVKA

SEQ ID NO: 1066282 - protein, 17 aa, Mycobacterium
LLRDLVTKHLPGVRYQR

SEQ ID NO: 1066283 - protein, 20 aa, Mycobacterium
LLRFRFTTIGDLFGVLEMGW

SEQ ID NO: 1066284 - protein, 17 aa, Mycobacterium
LLRIELADRPGSLGSLA

SEQ ID NO: 1066285 - protein, 18 aa, Mycobacterium
LLRLDPRLAPIKAAVLPL

SEQ ID NO: 1066286 - protein, 19 aa, Mycobacterium
LLRPARPNSPVFVSELSEW

SEQ ID NO: 1066287 - protein, 19 aa, Mycobacterium
LLSKMRPIPDPAAPEAKAK

SEQ ID NO: 1066288 - protein, 20 aa, Mycobacterium
LLTALHQRTGRFTSPHLQSV

SEQ ID NO: 1066289 - protein, 19 aa, Mycobacterium
LLVFNKVICAFGRTGSMFT

SEQ ID NO: 1066290 - protein, 20 aa, Mycobacterium
LLVPGSVLAIEPMLTLGTGK

SEQ ID NO: 1066291 - protein, 21 aa, Mycobacterium
LLVRIDRLRRLLDSEGLFDPR

SEQ ID NO: 1066292 - protein, 17 aa, Mycobacterium
LLWVVESMLQCGVVTEF

SEQ ID NO: 1066293 - protein, 18 aa, Mycobacterium
LLYRFRAIDRLPEAPSAA

SEQ ID NO: 1066294 - protein, 18 aa, Mycobacterium
LLYSDAIVRFLTEFAKHT

SEQ ID NO: 1066295 - protein, 18 aa, Mycobacterium
LMAPTYAVPRLLARNGLS

SEQ ID NO: 1066296 - protein, 17 aa, Mycobacterium
LMEPMLEEFVRVAAQVE

SEQ ID NO: 1066297 - protein, 20 aa, Mycobacterium
LMHCMTVSLALQGAPDWMRC

SEQ ID NO: 1066298 - protein, 19 aa, Mycobacterium
LMHVLGTSVYVPDLLMRAP

SEQ ID NO: 1066299 - protein, 20 aa, Mycobacterium
LMLPVLVPAFQEVARSVPKN

SEQ ID NO: 1066300 - protein, 18 aa, Mycobacterium
LMPYTDQIKWLFDKLLGI

SEQ ID NO: 1066301 - protein, 28 aa, Mycobacterium
LMSAFERRFFPIYPASTKLQSWDIYACV

SEQ ID NO: 1066302 - protein, 18 aa, Mycobacterium
LMTEWRLRETPHVPIPYV

SEQ ID NO: 1066303 - protein, 22 aa, Mycobacterium
LMVARLFSGAWLTHLGYSPDAW

SEQ ID NO: 1066304 - protein, 18 aa, Mycobacterium
LMWVRIVPRFLGLGVGVD

SEQ ID NO: 1066305 - protein, 22 aa, Mycobacterium
LNDDSRPRKLRPGDSLLVDPKA

SEQ ID NO: 1066306 - protein, 34 aa, Mycobacterium
LNPESRFLREIPPELIDWRRSILTDSYSTPASGA

SEQ ID NO: 1066307 - protein, 24 aa, Mycobacterium
LNPYLDILPHFDTLLIMSVEPGFG

SEQ ID NO: 1066308 - protein, 22 aa, Mycobacterium
LNRGVLAAVRWVPEPSVAQVVV

SEQ ID NO: 1066309 - protein, 24 aa, Mycobacterium
LNTPNILDHVWCYRFGGPVNMVES

SEQ ID NO: 1066310 - protein, 20 aa, Mycobacterium
LNVAGRWQHLELESAELVAF

SEQ ID NO: 1066311 - protein, 25 aa, Mycobacterium
LPADTWLVDLGSHLLRDLARPVRVM

SEQ ID NO: 1066312 - protein, 19 aa, Mycobacterium
LPADYFQGVAMAGGIAVLL

SEQ ID NO: 1066313 - protein, 21 aa, Mycobacterium
LPAMSLGWDLWDPANAMTGEL

SEQ ID NO: 1066314 - protein, 20 aa, Mycobacterium
LPAWDLPTVFGPSAVIYHIN

SEQ ID NO: 1066315 - protein, 25 aa, Mycobacterium
LPDDDPPPIFELAAKLGAIVSNESA

SEQ ID NO: 1066316 - protein, 30 aa, Mycobacterium
LPDQDVFVSRLPRYFPKPLRERFTPEIRSH

SEQ ID NO: 1066317 - protein, 18 aa, Mycobacterium
LPELDGCVDLFVANPPYV

SEQ ID NO: 1066318 - protein, 18 aa, Mycobacterium
LPELIRRAVTVKAGVVSA

SEQ ID NO: 1066319 - protein, 23 aa, Mycobacterium
LPGEMQPMWVPDQRWVMLSCHMK

SEQ ID NO: 1066320 - protein, 21 aa, Mycobacterium
LPGEWPYRRGGDALRDVHSGW

SEQ ID NO: 1066321 - protein, 26 aa, Mycobacterium
LPGNPTVFPGHWYSTAPSATLSMVKC

SEQ ID NO: 1066322 - protein, 42 aa, Mycobacterium
LPIERTCEFLEWFLGSVPIAPIWLCPLRLRDHNSWPLYPIQP

SEQ ID NO: 1066323 - protein, 32 aa, Mycobacterium
LPRGVTFIGQPLWGSIGYTLPAALGAGLAHRN

SEQ ID NO: 1066324 - protein, 22 aa, Mycobacterium
LPSVLPTALRELIRYVRPPWLR

SEQ ID NO: 1066325 - protein, 30 aa, Mycobacterium
LPTIRSRTHHYPFRLLSPRTMRALVGRICA

SEQ ID NO: 1066326 - protein, 18 aa, Mycobacterium
LPTLRITAAVPTRANYRV

SEQ ID NO: 1066327 - protein, 32 aa, Mycobacterium
LPTPDPQLIAEPCRWVYYPWRHVVVSMLGPRG

SEQ ID NO: 1066328 - protein, 18 aa, Mycobacterium
LPTVKFTDRTLAEVRRRG

SEQ ID NO: 1066329 - protein, 19 aa, Mycobacterium
LPTVWPCTVYPLKETYDGA

SEQ ID NO: 1066330 - protein, 24 aa, Mycobacterium
LPVKLCYAGPFFRYERPQAGRCRQ

SEQ ID NO: 1066331 - protein, 24 aa, Mycobacterium
LPVTHVYPQLIDIIRSRHLRTVTL

SEQ ID NO: 1066332 - protein, 24 aa, Mycobacterium
LPVWTLRLHLTGKRLWHDPRRRDC

SEQ ID NO: 1066333 - protein, 27 aa, Mycobacterium
LPVYDKPMIYYPLSTLMMAGIRDILVI

SEQ ID NO: 1066334 - protein, 20 aa, Mycobacterium
LQARLMSQALRKMTGALSNS

SEQ ID NO: 1066335 - protein, 18 aa, Mycobacterium
LQIRRSLELVFCHGVAVV

SEQ ID NO: 1066336 - protein, 29 aa, Mycobacterium
LQLAKVAVAFVLWPNLLLARAAVVALSLT

SEQ ID NO: 1066337 - protein, 18 aa, Mycobacterium
LQNKTRALQVLAARLQAM

SEQ ID NO: 1066338 - protein, 19 aa, Mycobacterium
LQPDHRLAVVFGAGGERDP

SEQ ID NO: 1066339 - protein, 30 aa, Mycobacterium
LQTITLEDALKLLLLPRVVGVDPASGEEIT

SEQ ID NO: 1066340 - protein, 28 aa, Mycobacterium
LQVAFNNLMELLPAGSWLDHVYDTPSRG

SEQ ID NO: 1066341 - protein, 19 aa, Mycobacterium
LRAGIWLEHIRRPGWQAVA

SEQ ID NO: 1066342 - protein, 26 aa, Mycobacterium
LRAGVPTLILWIFIEQPVWAAQIKRL

SEQ ID NO: 1066343 - protein, 23 aa, Mycobacterium
LRATDDLLLIAGMRISQRSKLLN

SEQ ID NO: 1066344 - protein, 17 aa, Mycobacterium
LRATRSTDYLILEMSAR

SEQ ID NO: 1066345 - protein, 24 aa, Mycobacterium
LRCEPRLPWIWWRSRLGSVAVATG

SEQ ID NO: 1066346 - protein, 20 aa, Mycobacterium
LRCYRTFREFGDTAPALPVP

SEQ ID NO: 1066347 - protein, 33 aa, Mycobacterium
LRDDRMWEFLDRLTSIALPRIRDFRGLSPKQFD

SEQ ID NO: 1066348 - protein, 19 aa, Mycobacterium
LRDRAFYAPAQSRYRVFIV

SEQ ID NO: 1066349 - protein, 23 aa, Mycobacterium
LREFMADLLLLNGPLYSGASQRL

SEQ ID NO: 1066350 - protein, 22 aa, Mycobacterium
LREYPDIFKQYLGTVIPAGDNK

SEQ ID NO: 1066351 - protein, 18 aa, Mycobacterium
LRGGMRLGLIPTVAPYVL

SEQ ID NO: 1066352 - protein, 19 aa, Mycobacterium
LRMLSLAEHQVFIEAARDF

SEQ ID NO: 1066353 - protein, 23 aa, Mycobacterium
LRNVEFVIFVKPKIDEDSHMLGR

SEQ ID NO: 1066354 - protein, 17 aa, Mycobacterium
LRNVLRAQSPTKPIWEL

SEQ ID NO: 1066355 - protein, 32 aa, Mycobacterium
LRQKRLMTLIHFWLVHRFKADTVIYVTPTEDN

SEQ ID NO: 1066356 - protein, 19 aa, Mycobacterium
LRQQRVPLGVVGMIYEGRP

SEQ ID NO: 1066357 - protein, 17 aa, Mycobacterium
LRQRILSCPRAGSIRVH

SEQ ID NO: 1066358 - protein, 21 aa, Mycobacterium
LRQSVMLDLLLGLANEAEGTA

SEQ ID NO: 1066359 - protein, 22 aa, Mycobacterium
LRQTVIDRGLIGDKLSLEELDR

SEQ ID NO: 1066360 - protein, 26 aa, Mycobacterium
LRRAFAADMAFLRNCGIHPVVVHGGG

SEQ ID NO: 1066361 - protein, 17 aa, Mycobacterium
LRRGQTLIGFLASRNAD

SEQ ID NO: 1066362 - protein, 20 aa, Mycobacterium
LRRHGPVTIYGVDKFPRMVD

SEQ ID NO: 1066363 - protein, 18 aa, Mycobacterium
LRRLAVFDVLINNADRKG

SEQ ID NO: 1066364 - protein, 26 aa, Mycobacterium
LRRMGYLQRMSTVLSRRLWENAGSPE

SEQ ID NO: 1066365 - protein, 21 aa, Mycobacterium
LRRVMNCGTVIALIFRRTTLH

SEQ ID NO: 1066366 - protein, 19 aa, Mycobacterium
LRRWWPRRYRRSSVYWKLM

SEQ ID NO: 1066367 - protein, 19 aa, Mycobacterium
LRRYDVDAAILFSDIVVPL

SEQ ID NO: 1066368 - protein, 24 aa, Mycobacterium
LRSGVTPILLGALPFDAESPAALM

SEQ ID NO: 1066369 - protein, 25 aa, Mycobacterium
LRSKPGDWYVIHSYAGYENKVKANL

SEQ ID NO: 1066370 - protein, 18 aa, Mycobacterium
LRSYVRVPYRARVPMTRA

SEQ ID NO: 1066371 - protein, 32 aa, Mycobacterium
LRTYRFGGSLHLDWWYDIRRIPQVTAEALAQS

SEQ ID NO: 1066372 - protein, 23 aa, Mycobacterium
LRVLTERDLLRRHDAPPVNRVFE

SEQ ID NO: 1066373 - protein, 22 aa, Mycobacterium
LRVSWCTVLRSSQGKLLRLAAS

SEQ ID NO: 1066374 - protein, 27 aa, Mycobacterium
LRVTNPSPYMYLLHVPNSDGATGFSIV

SEQ ID NO: 1066375 - protein, 27 aa, Mycobacterium
LRVVAPDAYFQFPTSKYGLALDNWSIR

SEQ ID NO: 1066376 - protein, 24 aa, Mycobacterium
LRVYAKSINLPRVLGGLGVVIIST

SEQ ID NO: 1066377 - protein, 20 aa, Mycobacterium
LSDPLWSARLLTDAPQEIVA

SEQ ID NO: 1066378 - protein, 18 aa, Mycobacterium
LSDPNRFKFHGDGYYLKS

SEQ ID NO: 1066379 - protein, 31 aa, Mycobacterium
LSDSFWDEIFRELSIPYLPVRWRTDNPDSIV

SEQ ID NO: 1066380 - protein, 17 aa, Mycobacterium
LSELLWSFAPQPRSRPA

SEQ ID NO: 1066381 - protein, 27 aa, Mycobacterium
LSELSALSWVVYSLPGVPLFDHHELGD

SEQ ID NO: 1066382 - protein, 25 aa, Mycobacterium
LSERLLGETLLLPSAPVYWAGIDSE

SEQ ID NO: 1066383 - protein, 17 aa, Mycobacterium
LSGWRIIGRVFDGPARV

SEQ ID NO: 1066384 - protein, 25 aa, Mycobacterium
LSGYVDAIVWRTFGQHRLDAMAATA

SEQ ID NO: 1066385 - protein, 19 aa, Mycobacterium
LSHLVCCFYIGLWDRVFGP

SEQ ID NO: 1066386 - protein, 24 aa, Mycobacterium
LSLGQWVAFVLHDWCAVRLADVAD

SEQ ID NO: 1066387 - protein, 37 aa, Mycobacterium; identical to SEQ ID NO: 215192

SEQ ID NO: 1066388 - protein, 17 aa, Mycobacterium
LSMLRAHVTRRLDAMAA

SEQ ID NO: 1066389 - protein, 32 aa, Mycobacterium
LSNASTIFWNGPMGVFEFPAYAAGTRGVAEAI

SEQ ID NO: 1066390 - protein, 18 aa, Mycobacterium
LSPSPLRCWRRLHTGPAA

SEQ ID NO: 1066391 - protein, 25 aa, Mycobacterium
LSRDQVLQMLWLPDDRLEELLALAH

SEQ ID NO: 1066392 - protein, 27 aa, Mycobacterium
LSRNILENPAWYTPYTPYQPEISQGRL

SEQ ID NO: 1066393 - protein, 22 aa, Mycobacterium
LSRPAVFVVEDVHWIDEVSDSM

SEQ ID NO: 1066394 - protein, 18 aa, Mycobacterium
LSRRRLVRIPWDLDAYGI

SEQ ID NO: 1066395 - protein, 24 aa, Mycobacterium
LSRRYRVPVLSVHAPCLLISQRVW

SEQ ID NO: 1066396 - protein, 25 aa, Mycobacterium
LSRSLEEVFIPTGIPYKVVGGFCFY

SEQ ID NO: 1066397 - protein, 25 aa, Mycobacterium
LSRSMLEVLPLTHIRGRSLHDSFVI

SEQ ID NO: 1066398 - protein, 27 aa, Mycobacterium
LSRSVFAKGIFPAVDPLASSSTILDPG

SEQ ID NO: 1066399 - protein, 19 aa, Mycobacterium
LSTKFTRLTGRSPILLAGM

SEQ ID NO: 1066400 - protein, 24 aa, Mycobacterium
LSTKGLSITAWFIDPGARQVEGRI

SEQ ID NO: 1066401 - protein, 22 aa, Mycobacterium
LSTSIYFGWYTTQSGLRANSGS

SEQ ID NO: 1066402 - protein, 17 aa, Mycobacterium
LSVGHRQFDIRASTLDV

SEQ ID NO: 1066403 - protein, 24 aa, Mycobacterium
LSVHFDVYQWLTVLQEYLVLALMA

SEQ ID NO: 1066404 - protein, 17 aa, Mycobacterium
LSVLSLYGNVGGGRTGG

SEQ ID NO: 1066405 - protein, 26 aa, Mycobacterium
LSVVVHTMVVPGLLSWRDVAQVMSEN

SEQ ID NO: 1066406 - protein, 19 aa, Mycobacterium
LSWSFAQVPALPGRGPELR

SEQ ID NO: 1066407 - protein, 25 aa, Mycobacterium
LTAYSPQQLINKLALQRVLGVQMAT

SEQ ID NO: 1066408 - protein, 24 aa, Mycobacterium
LTDLYGPRRLLTDGVLPPELLFGH

SEQ ID NO: 1066409 - protein, 18 aa, Mycobacterium
LTEGMRFDKGYISGYFVT

SEQ ID NO: 1066410 - protein, 19 aa, Mycobacterium
LTEIWPVINHNPAVRHRPG

SEQ ID NO: 1066411 - protein, 18 aa, Mycobacterium
LTFAAALEGDGLIGVRIM

SEQ ID NO: 1066412 - protein, 30 aa, Mycobacterium
LTGEAMDSLRDRLFPLATVVTPNLDEVRLL

SEQ ID NO: 1066413 - protein, 22 aa, Mycobacterium
LTGKPFAASAPRIGAPRWDTVI

SEQ ID NO: 1066414 - protein, 22 aa, Mycobacterium
LTGLAVLDLYAGSGALGLEALS

SEQ ID NO: 1066415 - protein, 17 aa, Mycobacterium
LTGVDIHPGAVLGAGLF

SEQ ID NO: 1066416 - protein, 20 aa, Mycobacterium
LTGVRVFFPDPWPKVRHHKR

SEQ ID NO: 1066417 - protein, 19 aa, Mycobacterium
LTIAHRYVIVSKLRRTAGN

SEQ ID NO: 1066418 - protein, 27 aa, Mycobacterium
LTIHDYVWRWDTDWFWCSRAFGAQNQQ

SEQ ID NO: 1066419 - protein, 20 aa, Mycobacterium
LTLAVLPGMIERKAGGILIS

SEQ ID NO: 1066420 - protein, 21 aa, Mycobacterium
LTLEALTTRGVACAGLVIGSW

SEQ ID NO: 1066421 - protein, 27 aa, Mycobacterium
LTLEDFLEQMLAVRKMGLIGNLLGMLP

SEQ ID NO: 1066422 - protein, 23 aa, Mycobacterium
LTLKRPCIPTNDIRLRAGTRGES

SEQ ID NO: 1066423 - protein, 17 aa, Mycobacterium
LTMAEWFRDEASQDVLL

SEQ ID NO: 1066424 - protein, 25 aa, Mycobacterium
LTMGDLRFLKFLRESIFPGGELPSQ

SEQ ID NO: 1066425 - protein, 25 aa, Mycobacterium
LTNATMPYILKLADQGWQEACQSDP

SEQ ID NO: 1066426 - protein, 30 aa, Mycobacterium
LTNDHGVVPGLWRLDSLPLLVSATDWEVLE

SEQ ID NO: 1066427 - protein, 19 aa, Mycobacterium
LTPEERLLRAIFGEKAREV

SEQ ID NO: 1066428 - protein, 17 aa, Mycobacterium
LTPGRGIGRLVTGAMGL

SEQ ID NO: 1066429 - protein, 27 aa, Mycobacterium
LTPQQRAWLNLVQPLTIIEGFALLSVP

SEQ ID NO: 1066430 - protein, 20 aa, Mycobacterium
LTQLGLQSPALFYLNSPSNP

SEQ ID NO: 1066431 - protein, 27 aa, Mycobacterium
LTSRIRTLFALEGIATRVVLIYHNRLV

SEQ ID NO: 1066432 - protein, 18 aa, Mycobacterium
LTSTLFEPVDAASAPLHT

SEQ ID NO: 1066433 - protein, 23 aa, Mycobacterium
LTTLFIDEWPQLLTLRASADRDT

SEQ ID NO: 1066434 - protein, 19 aa, Mycobacterium
LTVRQRLAAFITPIPVQLR

SEQ ID NO: 1066435 - protein, 29 aa, Mycobacterium
LVAATLPYGLLPLVVPQLKTITLGGAVTG

SEQ ID NO: 1066436 - protein, 25 aa, Mycobacterium
LVALARRVVTALNAPYRPGLGDFGF

SEQ ID NO: 1066437 - protein, 24 aa, Mycobacterium
LVATDFALARFVVDYRKILIDTTA

SEQ ID NO: 1066438 - protein, 25 aa, Mycobacterium
LVDEVRMLLRWGLRDGVTASRALGY

SEQ ID NO: 1066439 - protein, 19 aa, Mycobacterium
LVDRFFEARKMMSSVLGGM

SEQ ID NO: 1066440 - protein, 25 aa, Mycobacterium
LVEHFILEGWWGRWLGRWTAEEHLH

SEQ ID NO: 1066441 - protein, 25 aa, Mycobacterium
LVELGIPEHPMLVPAFALALMRRSL

SEQ ID NO: 1066442 - protein, 19 aa, Mycobacterium
LVEPAAHLAVLQAVPSPDT

SEQ ID NO: 1066443 - protein, 21 aa, Mycobacterium
LVHPGDLVILISYGTMEDAEA

SEQ ID NO: 1066444 - protein, 17 aa, Mycobacterium
LVILISYGTMEDAEAHA

SEQ ID NO: 1066445 - protein, 17 aa, Mycobacterium
LVIRLAWLTNHVADGIG

SEQ ID NO: 1066446 - protein, 17 aa, Mycobacterium
LVKALLFSVFEGGLRHG

SEQ ID NO: 1066447 - protein, 24 aa, Mycobacterium
LVKQYTWLFEMDGVELEFTNDALE

SEQ ID NO: 1066448 - protein, 29 aa, Mycobacterium
LVKVTPIDFLRDTLLWAKLIDKYKGTVIC

SEQ ID NO: 1066449 - protein, 31 aa, Mycobacterium
LVKYRTLPEIILYPALFLGAARTVPGSKYAA

SEQ ID NO: 1066450 - protein, 19 aa, Mycobacterium
LVLAGRIHPYEGHDLRHVV

SEQ ID NO: 1066451 - protein, 27 aa, Mycobacterium
LVLARIERLVFGAWQPKTGAVGSLWDV

SEQ ID NO: 1066452 - protein, 26 aa, Mycobacterium
LVLDTVSFYKPAQPGSYPIVLATYEI

SEQ ID NO: 1066453 - protein, 25 aa, Mycobacterium
LVLRNRALLELLYSTGSRISEAVGL

SEQ ID NO: 1066454 - protein, 21 aa, Mycobacterium
LVLSGARFTPYLSIPGAENAF

SEQ ID NO: 1066455 - protein, 21 aa, Mycobacterium
LVLWSWCWWKDGIRVLLRWVS

SEQ ID NO: 1066456 - protein, 20 aa, Mycobacterium
LVNLISPKLTVAVRLAPSTG

SEQ ID NO: 1066457 - protein, 20 aa, Mycobacterium
LVNLVIALLSTRGYMTAEKI

SEQ ID NO: 1066458 - protein, 23 aa, Mycobacterium
LVPAFALALMRRSLAGSNIGGIT

SEQ ID NO: 1066459 - protein, 18 aa, Mycobacterium
LVQLLTQATLLLRIDRGR

SEQ ID NO: 1066460 - protein, 31 aa, Mycobacterium
LVQRARDLWYHRILPFAYNLSQRQAVYAPAG

SEQ ID NO: 1066461 - protein, 27 aa, Mycobacterium
LVQRGSPFRGLLYVGLAVTASGPAVVE

SEQ ID NO: 1066462 - protein, 21 aa, Mycobacterium
LVRSLRRIALKLSLIVACIRL

SEQ ID NO: 1066463 - protein, 27 aa, Mycobacterium
LVSDLRINWVWNPPWGPDKISDDGREQ

SEQ ID NO: 1066464 - protein, 17 aa, Mycobacterium
LVSLDEFGQLPAGAFLV

SEQ ID NO: 1066465 - protein, 26 aa, Mycobacterium
LVSLRPVFNLYNKRWPIRGESENLAP

SEQ ID NO: 1066466 - protein, 17 aa, Mycobacterium
LVVFDNLMRLDSRFFLE

SEQ ID NO: 1066467 - protein, 17 aa, Mycobacterium
LVVFHDNINEQLGFAIL

SEQ ID NO: 1066468 - protein, 19 aa, Mycobacterium
LVWIPLPLLELPLGGNSAG

SEQ ID NO: 1066469 - protein, 20 aa, Mycobacterium
LVYHELFQYYSSTANLDHLP

SEQ ID NO: 1066470 - protein, 19 aa, Mycobacterium
LWSTPFAEVLNWSGSHSPG

SEQ ID NO: 1066471 - protein, 20 aa, Mycobacterium
LYATQLMTELSERGTKLPTA

SEQ ID NO: 1066472 - protein, 20 aa, Mycobacterium
LYGFSDAENRDLFLALLSVS

SEQ ID NO: 1066473 - protein, 33 aa, Mycobacterium
LYGGNNNWFAAYAYWYFKLYRHDKVKLLDGGRK

SEQ ID NO: 1066474 - protein, 26 aa, Mycobacterium
LYHFAWDEFCDWYLELAKAQLADGLT

SEQ ID NO: 1066475 - protein, 17 aa, Mycobacterium
LYKLRPGDPSILTPSPA

SEQ ID NO: 1066476 - protein, 27 aa, Mycobacterium
LYSKNIKALLDLLIKDGKFAPDFDDEV

SEQ ID NO: 1066477 - protein, 27 aa, Mycobacterium
MAAARLDLASVFLYAGSILPGRTKLSD

SEQ ID NO: 1066478 - protein, 22 aa, Mycobacterium
MAAHLSAGQLLLLHGGTSGIGS

SEQ ID NO: 1066479 - protein, 25 aa, Mycobacterium
MAANLVVLGPGSWFTSVIPHVLVPG

SEQ ID NO: 1066480 - protein, 17 aa, Mycobacterium
MALLDIPAGPQVGEAWR

SEQ ID NO: 1066481 - protein, 29 aa, Mycobacterium
MANHAVGWVRMDFIVPSRGLIGFRTDFLT

SEQ ID NO: 1066482 - protein, 26 aa, Mycobacterium
MAPPNLIRAILQAPVDLLFNGGIGTY

SEQ ID NO: 1066483 - protein, 18 aa, Mycobacterium
MASVKWELEDLSFAILHP

SEQ ID NO: 1066484 - protein, 18 aa, Mycobacterium
MDEFVDWLIDAGCPIQRI

SEQ ID NO: 1066485 - protein, 20 aa, Mycobacterium
MDGFGVLRWLRRRHSHPSVV

SEQ ID NO: 1066486 - protein, 25 aa, Mycobacterium
MDTHARLLVWELIDTLRRDGVTVVL

SEQ ID NO: 1066487 - protein, 17 aa, Mycobacterium
MELLALPQDEWSGRLRR

SEQ ID NO: 1066488 - protein, 18 aa, Mycobacterium
MERLAPLGPVYQAGTLSG

SEQ ID NO: 1066489 - protein, 28 aa, Mycobacterium
MEWISAVMTLLPGDLILTGTPAGVGPVE

SEQ ID NO: 1066490 - protein, 18 aa, Mycobacterium
MFGCMNYSTRVTLADGST

SEQ ID NO: 1066491 - protein, 26 aa, Mycobacterium
MFGPPGRLYTYCSHGIHVCANVSCGP

SEQ ID NO: 1066492 - protein, 25 aa, Mycobacterium
MGADLYRQFPVFAHALDEVAAALNP

SEQ ID NO: 1066493 - protein, 17 aa, Mycobacterium
MGAIALFGEAYPDEVRV

SEQ ID NO: 1066494 - protein, 24 aa, Mycobacterium
MGAMHSWCLAAERPDLVSALVVED

SEQ ID NO: 1066495 - protein, 17 aa, Mycobacterium
MGCLYPNRVFLGVGTGE

SEQ ID NO: 1066496 - protein, 25 aa, Mycobacterium
MGEGEAMLFGEYIRLMALVEYSADE

SEQ ID NO: 1066497 - protein, 20 aa, Mycobacterium
MGIPPLGWNPDQAFEQLRLE

SEQ ID NO: 1066498 - protein, 19 aa, Mycobacterium
MGNLEFLIGNGIHAVVGTT

SEQ ID NO: 1066499 - protein, 17 aa, Mycobacterium
MGPIIKACGENWPRVRI

SEQ ID NO: 1066500 - protein, 25 aa, Mycobacterium
MGVHPDFVAILFLEGTRRLRRAQRG

SEQ ID NO: 1066501 - protein, 22 aa, Mycobacterium
MHAQFICHGQFAEFVQPSNTSS

SEQ ID NO: 1066502 - protein, 18 aa, Mycobacterium
MHVIVGQGKLDQILQSRP

SEQ ID NO: 1066503 - protein, 25 aa, Mycobacterium
MHVYHYAPYEKTALLRLAGRYGVCE

SEQ ID NO: 1066504 - protein, 24 aa, Mycobacterium
MIAAFAAHLLAAAAPPSPLDVPSD

SEQ ID NO: 1066505 - protein, 21 aa, Mycobacterium
MIACELALCGVQPIVPDCFAN

SEQ ID NO: 1066506 - protein, 22 aa, Mycobacterium
MIEALDLLLEFRDRSTKKEVKQ

SEQ ID NO: 1066507 - protein, 17 aa, Mycobacterium
MIGSWFAGTYESPGDLM

SEQ ID NO: 1066508 - protein, 19 aa, Mycobacterium
MKPDICWQLPIRHSQEWVT

SEQ ID NO: 1066509 - protein, 17 aa, Mycobacterium
MLADFLAVIPQTRSMAL

SEQ ID NO: 1066510 - protein, 18 aa, Mycobacterium
MLNQPTPEQIFDRIAIRV

SEQ ID NO: 1066511 - protein, 45 aa, Mycobacterium
MLRIMRPDLTIGFFLHIPFPPVELFMQIPWRTEIIEGLLGADLVG

SEQ ID NO: 1066512 - protein, 20 aa, Mycobacterium
MLRLINPRRWSERTVIALVM

SEQ ID NO: 1066513 - protein, 39 aa, Mycobacterium
MLTDVKLLARLFGVPYFPVTPLFPLAGPAGLVPLPSKWR

SEQ ID NO: 1066514 - protein, 24 aa, Mycobacterium
MLTTPQLKAFYRDLQDERLTSALG

SEQ ID NO: 1066515 - protein, 25 aa, Mycobacterium
MLYVQSLLDDWSFPGTDPAVRVRWE

SEQ ID NO: 1066516 - protein, 18 aa, Mycobacterium
MMFPLAGGLGVISNRASE

SEQ ID NO: 1066517 - protein, 20 aa, Mycobacterium
MMIHFSIEFLGQGAAFLGNI

SEQ ID NO: 1066518 - protein, 17 aa, Mycobacterium
MMLSGLPNMIYTVGYTN

SEQ ID NO: 1066519 - protein, 19 aa, Mycobacterium
MNLVIRYVDQPGALGKIGT

SEQ ID NO: 1066520 - protein, 30 aa, Mycobacterium
MNSLWELSLPRRDLCMLAAKLGSDVPFALH

SEQ ID NO: 1066521 - protein, 19 aa, Mycobacterium
MPEAIAVFLAPPSWEDLEA

SEQ ID NO: 1066522 - protein, 19 aa, Mycobacterium
MPGAYVAGWIKRGPTGFIG

SEQ ID NO: 1066523 - protein, 17 aa, Mycobacterium
MPGVYQRLLPADVLAIV

SEQ ID NO: 1066524 - protein, 17 aa, Mycobacterium
MPLAIELAAARIRTLSL

SEQ ID NO: 1066525 - protein, 25 aa, Mycobacterium
MPVPAPMVKMLLNTALDRLAEKLKL

SEQ ID NO: 1066526 - protein, 18 aa, Mycobacterium
MPVTSIPVSGPVGVLDAL

SEQ ID NO: 1066527 - protein, 18 aa, Mycobacterium
MQESEFRKALRTCQAERR

SEQ ID NO: 1066528 - protein, 18 aa, Mycobacterium
MQFALEHPGYYQVMFIKS

SEQ ID NO: 1066529 - protein, 25 aa, Mycobacterium
MQKDTLFCIASMIKPVTVAAVMSLL

SEQ ID NO: 1066530 - protein, 25 aa, Mycobacterium
MQLTLTELWRSYGVQPDLVIGHSLG

SEQ ID NO: 1066531 - protein, 24 aa, Mycobacterium
MRAEGIACYQLFISGLLDITDNVD

SEQ ID NO: 1066532 - protein, 25 aa, Mycobacterium
MRHGEVLIDVRFWGTRLAESTVGPV

SEQ ID NO: 1066533 - protein, 17 aa, Mycobacterium
MRTAAPDFRLFWDNAYA

SEQ ID NO: 1066534 - protein, 21 aa, Mycobacterium
MRVYGSNNFPARVLTAVGVDR

SEQ ID NO: 1066535 - protein, 18 aa, Mycobacterium
MSLPRVSIFLSLLDVHVQ

SEQ ID NO: 1066536 - protein, 20 aa, Mycobacterium
MSRQAFLRGAVGVLTTGAVF

SEQ ID NO: 1066537 - protein, 17 aa, Mycobacterium
MSYTLRLARGVVDPRFV

SEQ ID NO: 1066538 - protein, 18 aa, Mycobacterium
MTALLNYYPHLLALSVFS

SEQ ID NO: 1066539 - protein, 20 aa, Mycobacterium
MTHEIAHHFGIDDDQLYQLG

SEQ ID NO: 1066540 - protein, 18 aa, Mycobacterium
MTMGMDGAWGQWVNRWTA

SEQ ID NO: 1066541 - protein, 18 aa, Mycobacterium
MTTALWLCGLDVAAGTTV

SEQ ID NO: 1066542 - protein, 25 aa, Mycobacterium
MTVRQNIAFPLMLAKVKKAEIAQKV

SEQ ID NO: 1066543 - protein, 17 aa, Mycobacterium
MVDALLTALHQRTGRFT

SEQ ID NO: 1066544 - protein, 23 aa, Mycobacterium
MVDEFIFIHLHLEKELTAEQVTM

SEQ ID NO: 1066545 - protein, 17 aa, Mycobacterium
MVGKLKVEIGDRVQVIG

SEQ ID NO: 1066546 - protein, 22 aa, Mycobacterium
MVKVVLALQHDKLPPSINFAGP

SEQ ID NO: 1066547 - protein, 19 aa, Mycobacterium
MVMCIINDQLKPILVRDRR

SEQ ID NO: 1066548 - protein, 21 aa, Mycobacterium
MVYRHSGYPGGLRKRTIGELM

SEQ ID NO: 1066549 - protein, 27 aa, Mycobacterium
MWFTETHWPAFRRVDFLRALRDYSMRH

SEQ ID NO: 1066550 - protein, 17 aa, Mycobacterium
MWTVPVFGNPTGVTYSW

SEQ ID NO: 1066551 - protein, 19 aa, Mycobacterium
MYGLFHGPRLKEMDARHGG

SEQ ID NO: 1066552 - protein, 19 aa, Mycobacterium
MYVRHDVVVVEQKICSLED

SEQ ID NO: 1066553 - protein, 27 aa, Mycobacterium
NAANRYPEFLPERLLRLIAGNIGLPAD

SEQ ID NO: 1066554 - protein, 34 aa, Mycobacterium
NAATHRFLAHLPGYQGWQWAVVVAAYPGAEHATV

SEQ ID NO: 1066555 - protein, 21 aa, Mycobacterium
NAFATPLLQHGLPLGVDVVIY

SEQ ID NO: 1066556 - protein, 18 aa, Mycobacterium
NAGGPRKVSPLAVQMIMP

SEQ ID NO: 1066557 - protein, 17 aa, Mycobacterium
NAGNPLRVVYRYVRSRL

SEQ ID NO: 1066558 - protein, 21 aa, Mycobacterium
NAGSRFLLDQAITSAGRHPDS

SEQ ID NO: 1066559 - protein, 25 aa, Mycobacterium
NAGVYAFDITALRSALIRLNSNNTQ

SEQ ID NO: 1066560 - protein, 22 aa, Mycobacterium
NAHILPVPMMNILNGGAHADTA

SEQ ID NO: 1066561 - protein, 20 aa, Mycobacterium
NAHLILQQPPTPNPTQTPED

SEQ ID NO: 1066562 - protein, 20 aa, Mycobacterium
NAIGIFHAFLDDPGVRLVGF

SEQ ID NO: 1066563 - protein, 20 aa, Mycobacterium
NAIPTIEPIQAYAGPDFADG

SEQ ID NO: 1066564 - protein, 22 aa, Mycobacterium
NAKLVRLTELPSGSPVAVVVRQ

SEQ ID NO: 1066565 - protein, 17 aa, Mycobacterium
NALLKSVLSQTSAGGVL

SEQ ID NO: 1066566 - protein, 27 aa, Mycobacterium
NALPEWPQMLLRALMFRLAVHALHPRS

SEQ ID NO: 1066567 - protein, 20 aa, Mycobacterium
NAPSLSMWALRVAEGPIVAT

SEQ ID NO: 1066568 - protein, 23 aa, Mycobacterium
NARTRFVLVGMPGPPPARTGTDR

SEQ ID NO: 1066569 - protein, 18 aa, Mycobacterium
NASRLIAVLAAVIAGPYK

SEQ ID NO: 1066570 - protein, 24 aa, Mycobacterium
NATLWPLYHDVIVKPIYHCEWWER

SEQ ID NO: 1066571 - protein, 24 aa, Mycobacterium
NATPLGGLKVTTANAWCAARPSGT

SEQ ID NO: 1066572 - protein, 24 aa, Mycobacterium
NATRARIVLFRKPIERRAHDTVEL

SEQ ID NO: 1066573 - protein, 19 aa, Mycobacterium
NATRYALLNGAALVPLPAL

SEQ ID NO: 1066574 - protein, 24 aa, Mycobacterium
NAVVLRQRLLLRGIAAEIVELTLA

SEQ ID NO: 1066575 - protein, 26 aa, Mycobacterium
NAWVDGLVAYRRSLGLPAVGINWGPW

SEQ ID NO: 1066576 - protein, 34 aa, Mycobacterium; identical to SEQ ID NO: 840110

SEQ ID NO: 1066577 - protein, 23 aa, Mycobacterium
NCGSSWGRCWPPKVVAPSGTRNH

SEQ ID NO: 1066578 - protein, 28 aa, Mycobacterium
NDAYLAGLVGALRRYHEALGVSISTLPM

SEQ ID NO: 1066579 - protein, 17 aa, Mycobacterium
NDEKPFRLPANELEFFF

SEQ ID NO: 1066580 - protein, 28 aa, Mycobacterium
NDGLDRVKPFWPFQVNARLVGLADSEAI

SEQ ID NO: 1066581 - protein, 27 aa, Mycobacterium
NDGNTFHQLPFALTPGPPIATTALRDS

SEQ ID NO: 1066582 - protein, 24 aa, Mycobacterium
NDGVKGVWVLARYDDGRPSQLRLD

SEQ ID NO: 1066583 - protein, 25 aa, Mycobacterium
NDIKPLEMTKWFDTNYHYLVPEIEP

SEQ ID NO: 1066584 - protein, 34 aa, Mycobacterium
NDLDFDYVFIDCPPSLGLLTINALVAAPEVIIPI

SEQ ID NO: 1066585 - protein, 23 aa, Mycobacterium
NDPLLIIIIKNQSQWQNCLLRVS

SEQ ID NO: 1066586 - protein, 31 aa, Mycobacterium
NDSRRAIHFQEWWVRYRAQVPTHSFAYVGAE

SEQ ID NO: 1066587 - protein, 17 aa, Mycobacterium
NDTPELMPLPIALAHRL

SEQ ID NO: 1066588 - protein, 17 aa, Mycobacterium
NDVLDQMRWLEAETSRT

SEQ ID NO: 1066589 - protein, 17 aa, Mycobacterium
NELRRRGNNISLTTVYR

SEQ ID NO: 1066590 - protein, 24 aa, Mycobacterium
NEPARTWFTAMKPIATKFGEVRLP

SEQ ID NO: 1066591 - protein, 30 aa, Mycobacterium
NETRIVVTGNYRAWRHFIAMRASEHADVEI

SEQ ID NO: 1066592 - protein, 25 aa, Mycobacterium
NFAAGRLAYILGVRGPAVVIDTACS

SEQ ID NO: 1066593 - protein, 17 aa, Mycobacterium
NFHRGINVAMDSLKFAQ

SEQ ID NO: 1066594 - protein, 19 aa, Mycobacterium
NFPVFRKRLRQWMMRITAY

SEQ ID NO: 1066595 - protein, 39 aa, Mycobacterium
NFVKSLLDRAYAKKFRFSTFLGAFKYYTSYTLKTFDGKR

SEQ ID NO: 1066596 - protein, 23 aa, Mycobacterium
NGDRYLPIWIGQSEAAAIALEQQ

SEQ ID NO: 1066597 - protein, 22 aa, Mycobacterium
NGELDALLWRAARPGEPSWSSP

SEQ ID NO: 1066598 - protein, 20 aa, Mycobacterium
NGFEILLCKANHVKNVPFRK

SEQ ID NO: 1066599 - protein, 19 aa, Mycobacterium
NGGFFPSVREYSCLYGLTE

SEQ ID NO: 1066600 - protein, 23 aa, Mycobacterium
NGGNGSPAVYLLDGLRAQDDYNG

SEQ ID NO: 1066601 - protein, 19 aa, Mycobacterium
NGHTTFLELAPNAVALMQV

SEQ ID NO: 1066602 - protein, 29 aa, Mycobacterium
NGIDRRGKYLWFLLDTDIALVVHLGMSGQ

SEQ ID NO: 1066603 - protein, 17 aa, Mycobacterium
NGLVVLHYDQPFVTTIM

SEQ ID NO: 1066604 - protein, 25 aa, Mycobacterium
NGQDFIVDVILWIDLADAAANDNLA

SEQ ID NO: 1066605 - protein, 22 aa, Mycobacterium
NGQPFVFTDTVGFVRHLPTQLV

SEQ ID NO: 1066606 - protein, 28 aa, Mycobacterium
NGSTQMVLPTRALVPAPGLLTIVRSNGH

SEQ ID NO: 1066607 - protein, 22 aa, Mycobacterium
NGVDWPGTLTGLAGYASGDVDT

SEQ ID NO: 1066608 - protein, 19 aa, Mycobacterium
NHCGAWIAGVKLVNGTVGT

SEQ ID NO: 1066609 - protein, 24 aa, Mycobacterium
NHEGVYRFLLKRNRRLFCVSYTLD

SEQ ID NO: 1066610 - protein, 31 aa, Mycobacterium
NHFDGVLTVVLKLLQIVRPDRVFFGEKDYQQ

SEQ ID NO: 1066611 - protein, 17 aa, Mycobacterium
NHFSLQPSWIEADWLFH

SEQ ID NO: 1066612 - protein, 27 aa, Mycobacterium
NHLDADSLGWLRDFLRSHTGGLVVISH

SEQ ID NO: 1066613 - protein, 30 aa, Mycobacterium
NHLGHFAFTGLLLDRLLPIVGSRVITVSSL

SEQ ID NO: 1066614 - protein, 18 aa, Mycobacterium
NHNYIGTEHILLGLIHEG

SEQ ID NO: 1066615 - protein, 19 aa, Mycobacterium
NIAPDQFLLLVAEGTEDQA

SEQ ID NO: 1066616 - protein, 17 aa, Mycobacterium
NIIGSLAPLMTVLPASV

SEQ ID NO: 1066617 - protein, 20 aa, Mycobacterium
NIKRQWWRSVVTGREDVVGI

SEQ ID NO: 1066618 - protein, 21 aa, Mycobacterium
NINAVVLPSRSALQPLEPGGT

SEQ ID NO: 1066619 - protein, 22 aa, Mycobacterium
NIVGVFYLRDLVQHTFFFPDHG

SEQ ID NO: 1066620 - protein, 26 aa, Mycobacterium
NKLLGSFELTGIPPAPRGVPQIEVTF

SEQ ID NO: 1066621 - protein, 21 aa, Mycobacterium
NKLPGQPLMRITGFGYNQAAT

SEQ ID NO: 1066622 - protein, 28 aa, Mycobacterium
NKVKAAPVLWTQRVLSTGQLRAVILNSG

SEQ ID NO: 1066623 - protein, 18 aa, Mycobacterium
NLAELRRSLTGSASYAVA

SEQ ID NO: 1066624 - protein, 22 aa, Mycobacterium
NLALEAIWLMLGEANKYFSSQQ

SEQ ID NO: 1066625 - protein, 22 aa, Mycobacterium
NLEFRVLRDRLFEALAAAGERV

SEQ ID NO: 1066626 - protein, 19 aa, Mycobacterium
NLHMIFYRDVSEAGIELAP

SEQ ID NO: 1066627 - protein, 18 aa, Mycobacterium
NLNKLDLKPGMTLLDIGC

SEQ ID NO: 1066628 - protein, 31 aa, Mycobacterium
NLNKLMKAALPFGLWIPVLPGTRQVTIGGAI

SEQ ID NO: 1066629 - protein, 23 aa, Mycobacterium
NLQQAYRISISELAWMTPQTRER

SEQ ID NO: 1066630 - protein, 19 aa, Mycobacterium
NLRLVVSLAKRYTGRGMAF

SEQ ID NO: 1066631 - protein, 26 aa, Mycobacterium
NLSTQLASFHQQFLQALTGSANSYTA

SEQ ID NO: 1066632 - protein, 24 aa, Mycobacterium
NLTQFYHPLDMFGEWNRAYGAAGF

SEQ ID NO: 1066633 - protein, 24 aa, Mycobacterium
NNAWVEFPIFDAKARSLKKAVLGK

SEQ ID NO: 1066634 - protein, 23 aa, Mycobacterium
NNLVNMFISKSYVDNVKTKDLAQ

SEQ ID NO: 1066635 - protein, 23 aa, Mycobacterium
NNQFYGFLTHHIIDRELNARLAS

SEQ ID NO: 1066636 - protein, 28 aa, Mycobacterium
NPEIRPVHLLLAMLMQNDGIAAPLLETV

SEQ ID NO: 1066637 - protein, 23 aa, Mycobacterium
NPESWTHDSSTQQQKWLTMGHQS

SEQ ID NO: 1066638 - protein, 17 aa, Mycobacterium
NPIAIIVPCHRVIGASG

SEQ ID NO: 1066639 - protein, 28 aa, Mycobacterium
NPQRVLGLHFFNPVPVLPLVELVSTLVT

SEQ ID NO: 1066640 - protein, 24 aa, Mycobacterium
NPTAELVLPFSWQSFSLHATGASA

SEQ ID NO: 1066641 - protein, 23 aa, Mycobacterium
NPTDWHMLQPQWLADLSDAKRAQ

SEQ ID NO: 1066642 - protein, 21 aa, Mycobacterium
NPTTKMQVALTSALQAASSAG

SEQ ID NO: 1066643 - protein, 25 aa, Mycobacterium
NQAWLQGPLAALDRLIRTDIKVVAV

SEQ ID NO: 1066644 - protein, 24 aa, Mycobacterium
NQQFGLLFVDWLKANPGVRADYLD

SEQ ID NO: 1066645 - protein, 21 aa, Mycobacterium
NQYRRFQPASAHFSSATAVGF

SEQ ID NO: 1066646 - protein, 21 aa, Mycobacterium
NRELLIPSCPTNRLQHQRITE

SEQ ID NO: 1066647 - protein, 23 aa, Mycobacterium
NRELTPELVLALGAAAARCLANS

SEQ ID NO: 1066648 - protein, 21 aa, Mycobacterium
NRIRWTVVRYKAPEAMTLNGD

SEQ ID NO: 1066649 - protein, 18 aa, Mycobacterium
NRNRFCCLLVLAGSVYRR

SEQ ID NO: 1066650 - protein, 23 aa, Mycobacterium
NRPMVCINLDWLPQFRGDLIPSY

SEQ ID NO: 1066651 - protein, 24 aa, Mycobacterium
NRQKNPHILTLSPPILPQQQEVAD

SEQ ID NO: 1066652 - protein, 26 aa, Mycobacterium
NRRRCWGAGYRWHLWSLAEAAVLAAS

SEQ ID NO: 1066653 - protein, 17 aa, Mycobacterium
NRRYTFETFVIGASNRF

SEQ ID NO: 1066654 - protein, 29 aa, Mycobacterium
NRSLRRFMRPPLTIEVVVRVVLIRVSLRS

SEQ ID NO: 1066655 - protein, 35 aa, Mycobacterium
NRTANIALLHFLDGKKRYILAPQGLSQGDVVESGA

SEQ ID NO: 1066656 - protein, 19 aa, Mycobacterium
NRTPAVERLFRSCYQASSG

SEQ ID NO: 1066657 - protein, 20 aa, Mycobacterium
NRVGTLPYAALTAAGDMVSI

SEQ ID NO: 1066658 - protein, 21 aa, Mycobacterium
NSCLICRRLTIGWSSLHSTRT

SEQ ID NO: 1066659 - protein, 32 aa, Mycobacterium
NSEQLIAADLTWLLSRWTCVFGTPACRGTVAG

SEQ ID NO: 1066660 - protein, 17 aa, Mycobacterium
NSIRLQVLRDRLIEGVL

SEQ ID NO: 1066661 - protein, 25 aa, Mycobacterium
NSPLVRQIYIYGNSAHPYLLAVVVP

SEQ ID NO: 1066662 - protein, 18 aa, Mycobacterium
NSVIARNFGRRDKRLWTD

SEQ ID NO: 1066663 - protein, 24 aa, Mycobacterium
NTANMFGFWEWVGGRYSVDSAIGL

SEQ ID NO: 1066664 - protein, 26 aa, Mycobacterium
NTELDDWIYQLDWPTRPLTSEPGATW

SEQ ID NO: 1066665 - protein, 24 aa, Mycobacterium
NTGKLIVVVLPDFGERYLSTMLFA

SEQ ID NO: 1066666 - protein, 23 aa, Mycobacterium
NTLGLRPLAWIQAITVIESAPLY

SEQ ID NO: 1066667 - protein, 33 aa, Mycobacterium
NTLKSIPHYGIGYGLLRYMYAPTGRVFSAQRTP

SEQ ID NO: 1066668 - protein, 18 aa, Mycobacterium
NTLRVYEAAACSGQTPMP

SEQ ID NO: 1066669 - protein, 17 aa, Mycobacterium
NTLWEHWTSGVLNGAVR

SEQ ID NO: 1066670 - protein, 25 aa, Mycobacterium
NVADPAAALTLLRAEVRPGDVVLIK

SEQ ID NO: 1066671 - protein, 17 aa, Mycobacterium
NVALRDLAEDLGDATVL

SEQ ID NO: 1066672 - protein, 25 aa, Mycobacterium
NVAPSIVQYVIIGQVLTAGAGQMPA

SEQ ID NO: 1066673 - protein, 24 aa, Mycobacterium
NVDAFLAVCRKWEVLATVIGEVTD

SEQ ID NO: 1066674 - protein, 26 aa, Mycobacterium
NVDDPPVLLIMGLGAQLVLWRTAFCE

SEQ ID NO: 1066675 - protein, 17 aa, Mycobacterium
NVDFADVKGIMSGAGTA

SEQ ID NO: 1066676 - protein, 23 aa, Mycobacterium
NVETVPRIFKRIRPAFTYQRSLD

SEQ ID NO: 1066677 - protein, 19 aa, Mycobacterium
NVGSWRSLAPLLDSDRNQI

SEQ ID NO: 1066678 - protein, 19 aa, Mycobacterium
NVKKLMMLQDYLATVLPLV

SEQ ID NO: 1066679 - protein, 23 aa, Mycobacterium
NVKLPRELVLIGKQFLYVERYMK

SEQ ID NO: 1066680 - protein, 17 aa, Mycobacterium
NVLRAQSPTKPIWELSL

SEQ ID NO: 1066681 - protein, 28 aa, Mycobacterium
NVMAVWQRLHFGFGLPKPPMEPLAVERV

SEQ ID NO: 1066682 - protein, 17 aa, Mycobacterium
NVMTFRYVIKEVAIENG

SEQ ID NO: 1066683 - protein, 26 aa, Mycobacterium
NVNFFVHDPFTLEPYSRDPRNIARKA

SEQ ID NO: 1066684 - protein, 24 aa, Mycobacterium
NVPDMFTRMMLSLAATGIAPGSFY

SEQ ID NO: 1066685 - protein, 23 aa, Mycobacterium
NVPEARLVVIKPYDAIQLHAIET

SEQ ID NO: 1066686 - protein, 18 aa, Mycobacterium
NVRVLGDVAFWRGSDGTL

SEQ ID NO: 1066687 - protein, 24 aa, Mycobacterium
NVSELLPELTLAQKWDLTATELVR

SEQ ID NO: 1066688 - protein, 27 aa, Mycobacterium
NVVDVFIGYLRRKLEANSGPRLLHTVR

SEQ ID NO: 1066689 - protein, 26 aa, Mycobacterium
NWSDWLRNFRCTPAIYAVHRYVGNQA

SEQ ID NO: 1066690 - protein, 19 aa, Mycobacterium
NWTGIPVFKLTEAETTRLL

SEQ ID NO: 1066691 - protein, 22 aa, Mycobacterium
NYCNVEGFFRLPIQSTAHRNLI

SEQ ID NO: 1066692 - protein, 18 aa, Mycobacterium
NYSSHTWKLWARRGRVWC

SEQ ID NO: 1066693 - protein, 25 aa, Mycobacterium
PAAVRRFSVLSLPTTLIFDTDGQQR

SEQ ID NO: 1066694 - protein, 24 aa, Mycobacterium
PADAPFFVMLCQMLGKPVNFVPVI

SEQ ID NO: 1066695 - protein, 25 aa, Mycobacterium
PADGVYAAWFTVLGHGPVTGTVVPG

SEQ ID NO: 1066696 - protein, 24 aa, Mycobacterium
PADNSLVLVLRLTVAGPASVRSRR

SEQ ID NO: 1066697 - protein, 19 aa, Mycobacterium
PAEIRMLRMLGADLVGMST

SEQ ID NO: 1066698 - protein, 32 aa, Mycobacterium
PAELKGLHNFFTPLLRNLGRCARVVVIGTTPD

SEQ ID NO: 1066699 - protein, 23 aa, Mycobacterium
PAGVLIDRWLAGSGAPLAELLLP

SEQ ID NO: 1066700 - protein, 17 aa, Mycobacterium
PAIYVPFPIGNGEQRLN

SEQ ID NO: 1066701 - protein, 25 aa, Mycobacterium
PALDYVVVKAPRFAFEKFPGADPTL

SEQ ID NO: 1066702 - protein, 23 aa, Mycobacterium
PALQRRWWAARGQGAFVAVDGVP

SEQ ID NO: 1066703 - protein, 20 aa, Mycobacterium
PAMGGKFVPLLTDGALARPR

SEQ ID NO: 1066704 - protein, 25 aa, Mycobacterium
PAMSAFNAWILLKGLETLAIRVDHC

SEQ ID NO: 1066705 - protein, 19 aa, Mycobacterium
PAPALIRRSSVSMPNAAQW

SEQ ID NO: 1066706 - protein, 25 aa, Mycobacterium
PAPDHLRLVTLPWSRDLAAAIDRLG

SEQ ID NO: 1066707 - protein, 21 aa, Mycobacterium
PAPGPALRLVPAVSTLVVSGK

SEQ ID NO: 1066708 - protein, 17 aa, Mycobacterium
PAPIPRISYADAMRRFG

SEQ ID NO: 1066709 - protein, 24 aa, Mycobacterium
PAPLDAMAALREPGIGVIAEVKRA

SEQ ID NO: 1066710 - protein, 22 aa, Mycobacterium
PAPLPAWLRHPGHRTVFTAPPP

SEQ ID NO: 1066711 - protein, 24 aa, Mycobacterium
PAPQLLALPVGESMWRLAADGGGT

SEQ ID NO: 1066712 - protein, 23 aa, Mycobacterium
PAPVLQWLLYPRTDFIRSHTHIT

SEQ ID NO: 1066713 - protein, 20 aa, Mycobacterium
PAQRMRANLERWGGLVADGA

SEQ ID NO: 1066714 - protein, 24 aa, Mycobacterium
PARRLLRVAEPRQPTWFSESTLVG

SEQ ID NO: 1066715 - protein, 25 aa, Mycobacterium
PASMRKFFEAFAPYGLKQTAVKPSY

SEQ ID NO: 1066716 - protein, 23 aa, Mycobacterium
PATGMTWFDAASVQTARDVLTEH

SEQ ID NO: 1066717 - protein, 23 aa, Mycobacterium
PATLLGMTAPTFRRARSASGTIV

SEQ ID NO: 1066718 - protein, 28 aa, Mycobacterium
PATPSSITLSGIWLLIVPSELAKTDPVI

SEQ ID NO: 1066719 - protein, 24 aa, Mycobacterium
PAVAVVIYDPMNWLRTSTVSLRSA

SEQ ID NO: 1066720 - protein, 23 aa, Mycobacterium
PAVIARYPAPLGTPTVLLYAHHD

SEQ ID NO: 1066721 - protein, 26 aa, Mycobacterium
PAVNKLGTMGLILRGSEELKKQVLPS

SEQ ID NO: 1066722 - protein, 20 aa, Mycobacterium
PAYQVIFRDLTTQKAAEETL

SEQ ID NO: 1066723 - protein, 20 aa, Mycobacterium
PCHAFFQFYVAQGRLSCQLY

SEQ ID NO: 1066724 - protein, 28 aa, Mycobacterium
PDAEQRYRFTFPRQQRGRFLCIADFIRS

SEQ ID NO: 1066725 - protein, 20 aa, Mycobacterium
PDAYIYLAESIRAWPDQVTL

SEQ ID NO: 1066726 - protein, 18 aa, Mycobacterium
PDEASRWLARLRAGKPDQ

SEQ ID NO: 1066727 - protein, 24 aa, Mycobacterium
PDEAVTELWIVDVCISTAPVVHAD

SEQ ID NO: 1066728 - protein, 30 aa, Mycobacterium
PDENSCHQIWLPQPILRNYELAKLVNLDPA

SEQ ID NO: 1066729 - protein, 24 aa, Mycobacterium
PDEVPLNFLNPRPGTPFGALEVMP

SEQ ID NO: 1066730 - protein, 18 aa, Mycobacterium
PDFAYLPVDLSHERVVVI

SEQ ID NO: 1066731 - protein, 26 aa, Mycobacterium
PDGARELIRAFWPGALSLVVVHAPSL

SEQ ID NO: 1066732 - protein, 22 aa, Mycobacterium
PDGGLLAYRRLSEALSAETWYL

SEQ ID NO: 1066733 - protein, 26 aa, Mycobacterium
PDGKDLSWLWDVRFEHFEKIPVVAAG

SEQ ID NO: 1066734 - protein, 20 aa, Mycobacterium
PDGLLRLVVELPGERRLKTN

SEQ ID NO: 1066735 - protein, 23 aa, Mycobacterium
PDHAYPLLVSVFLDKDFAFVVSS

SEQ ID NO: 1066736 - protein, 27 aa, Mycobacterium
PDKSTWPVVFPMLPPSPDGGPRRPPQH

SEQ ID NO: 1066737 - protein, 26 aa, Mycobacterium
PDLASLIVAPYFRSAVESAIDSWRRV

SEQ ID NO: 1066738 - protein, 22 aa, Mycobacterium
PDLFTGILAQVPFVDPLTTMLD

SEQ ID NO: 1066739 - protein, 17 aa, Mycobacterium
PDLVLRWAALLHDIGKP

SEQ ID NO: 1066740 - protein, 17 aa, Mycobacterium
PDNKLIKGLDSDAIYNS

SEQ ID NO: 1066741 - protein, 17 aa, Mycobacterium
PDTHYHKIHLYDAFGFT

SEQ ID NO: 1066742 - protein, 20 aa, Mycobacterium
PEASQLPLALLTPDMRDRQL

SEQ ID NO: 1066743 - protein, 17 aa, Mycobacterium
PEDPGVMWQFAQAVRGL

SEQ ID NO: 1066744 - protein, 26 aa, Mycobacterium
PEEIVARQPFPGPGLGIRIVGEVTAE

SEQ ID NO: 1066745 - protein, 22 aa, Mycobacterium
PEFLNRIDDIIVFHQLSRDEII

SEQ ID NO: 1066746 - protein, 20 aa, Mycobacterium
PEGIEGRVPFRGPLSSVIHQ

SEQ ID NO: 1066747 - protein, 26 aa, Mycobacterium
PEIAEQLLRVLARRLRRTNNNLADLI

SEQ ID NO: 1066748 - protein, 26 aa, Mycobacterium
PELGYRLLQRLGADVADYGFVETSAK

SEQ ID NO: 1066749 - protein, 18 aa, Mycobacterium
PELLPMLEKVTESGKPLL

SEQ ID NO: 1066750 - protein, 34 aa, Mycobacterium; identical to SEQ ID NO: 843832

SEQ ID NO: 1066751 - protein, 25 aa, Mycobacterium
PESGYRLFHAVRRLAAAMVAGTSKP

SEQ ID NO: 1066752 - protein, 23 aa, Mycobacterium
PESKRFCWNCGRPVGRSELEGQE

SEQ ID NO: 1066753 - protein, 18 aa, Mycobacterium
PEVRSQLAMTWGTETFLV

SEQ ID NO: 1066754 - protein, 20 aa, Mycobacterium
PFAIQELTLPLALAGDDVIG

SEQ ID NO: 1066755 - protein, 27 aa, Mycobacterium
PFALQDFSLFQVLRYGFRPSKIAFLTW

SEQ ID NO: 1066756 - protein, 19 aa, Mycobacterium
PFLLACIDLRGAELTATQL

SEQ ID NO: 1066757 - protein, 33 aa, Mycobacterium
PFSLENGLLTGIRKLAWPKLKQHYGARLEQLYA

SEQ ID NO: 1066758 - protein, 19 aa, Mycobacterium
PFTDRLVSKFRLPVTGWRG

SEQ ID NO: 1066759 - protein, 34 aa, Mycobacterium
PFTVARTDGLPVWIYQFKISPHPTIPLASTANER

SEQ ID NO: 1066760 - protein, 18 aa, Mycobacterium
PFVLHPGGFVLGSTLELF

SEQ ID NO: 1066761 - protein, 24 aa, Mycobacterium
PFVTTIMQPGMTFTIEPMINLGTL

SEQ ID NO: 1066762 - protein, 17 aa, Mycobacterium
PGDAGVLASLLLNRISL

SEQ ID NO: 1066763 - protein, 25 aa, Mycobacterium
PGEALFTYLRSLVLHWGATDRGLVD

SEQ ID NO: 1066764 - protein, 19 aa, Mycobacterium
PGEFFDPLGGLAALRVRVL

SEQ ID NO: 1066765 - protein, 24 aa, Mycobacterium
PGELRPALERAFVTGLPSVVNVLT

SEQ ID NO: 1066766 - protein, 18 aa, Mycobacterium
PGEVLMQESEFRKALRTC

SEQ ID NO: 1066767 - protein, 23 aa, Mycobacterium
PGFGDRRKAMLQDMAILTGAQVI

SEQ ID NO: 1066768 - protein, 23 aa, Mycobacterium
PGFTMTSMYPKLWAVSSVDYPTL

SEQ ID NO: 1066769 - protein, 19 aa, Mycobacterium
PGFVISLTALLRDSYERDD

SEQ ID NO: 1066770 - protein, 21 aa, Mycobacterium
PGGKTVFVFPGQGAQWLGMGV

SEQ ID NO: 1066771 - protein, 20 aa, Mycobacterium
PGGLTSGPWGLLEPPELRLP

SEQ ID NO: 1066772 - protein, 22 aa, Mycobacterium
PGHRRIVFRFLTSPIEIKGKGK

SEQ ID NO: 1066773 - protein, 20 aa, Mycobacterium
PGKTLVRLTLHEGRKRIVRR

SEQ ID NO: 1066774 - protein, 20 aa, Mycobacterium
PGMFSRLVIDYYGSATPITQ

SEQ ID NO: 1066775 - protein, 25 aa, Mycobacterium
PGMNEIVFPAAILQPPFFDVEADDA

SEQ ID NO: 1066776 - protein, 19 aa, Mycobacterium
PGNAHFIFRGCEGDVLLML

SEQ ID NO: 1066777 - protein, 21 aa, Mycobacterium
PGPAISVFAPSFDPLAGNHAH

SEQ ID NO: 1066778 - protein, 24 aa, Mycobacterium
PGPPSELQPMWRRAVMTAATREAI

SEQ ID NO: 1066779 - protein, 18 aa, Mycobacterium
PGREAYPGDVFYLHSRLL

SEQ ID NO: 1066780 - protein, 17 aa, Mycobacterium
PGRPIDAFVVRKYAKTH

SEQ ID NO: 1066781 - protein, 31 aa, Mycobacterium; identical to SEQ ID NO: 221239

SEQ ID NO: 1066782 - protein, 22 aa, Mycobacterium
PGSQCFLLDGLLVAGDTLFLEG

SEQ ID NO: 1066783 - protein, 27 aa, Mycobacterium
PGTPPATLLDYFPEDFLLVIDESHVTV

SEQ ID NO: 1066784 - protein, 24 aa, Mycobacterium
PGVCWGRSWRIIVTLVCIGDLEGL

SEQ ID NO: 1066785 - protein, 24 aa, Mycobacterium
PGVGKALALDTPLPTPTGWTAMGD

SEQ ID NO: 1066786 - protein, 20 aa, Mycobacterium
PGVGLRYEFTSRKGDRIGII

SEQ ID NO: 1066787 - protein, 20 aa, Mycobacterium
PGVWIVIPAFNEAAIIGEVV

SEQ ID NO: 1066788 - protein, 19 aa, Mycobacterium
PGYLVRRQFVDGKGVPCLI

SEQ ID NO: 1066789 - protein, 31 aa, Mycobacterium
PGYPFARQRHWVEPRYTIWAQIPGASSGSPV

SEQ ID NO: 1066790 - protein, 19 aa, Mycobacterium
PHELLVVNKIDAASALMLA

SEQ ID NO: 1066791 - protein, 30 aa, Mycobacterium
PHFNNAIIRPFLRFFFKSWFRVEVSGIENL

SEQ ID NO: 1066792 - protein, 18 aa, Mycobacterium
PHLHIHVFPTHSLSNFSF

SEQ ID NO: 1066793 - protein, 25 aa, Mycobacterium
PIAADDFWYLWRQMVSQPGVVDPAG

SEQ ID NO: 1066794 - protein, 22 aa, Mycobacterium
PIDLRQDWPPALRSAGFDPSAR

SEQ ID NO: 1066795 - protein, 25 aa, Mycobacterium
PIGAPSFVEALRWGAEVYHALKSVL

SEQ ID NO: 1066796 - protein, 30 aa, Mycobacterium
PIGGLYGDITYPVTSPLAITMGFAACEAAQ

SEQ ID NO: 1066797 - protein, 20 aa, Mycobacterium
PIHPLQVGVDWVTAAPHAAL

SEQ ID NO: 1066798 - protein, 18 aa, Mycobacterium
PIIDGKPLRGMADKCLTV

SEQ ID NO: 1066799 - protein, 17 aa, Mycobacterium
PIMLDSTEIPVLQAGLE

SEQ ID NO: 1066800 - protein, 18 aa, Mycobacterium
PISRRPFAIRLPTLCSRH

SEQ ID NO: 1066801 - protein, 19 aa, Mycobacterium
PITLVISTTVLSGVKISRC

SEQ ID NO: 1066802 - protein, 19 aa, Mycobacterium
PIWGDVELAWRLDAAGYYG

SEQ ID NO: 1066803 - protein, 24 aa, Mycobacterium
PKAEFFAAPISWQQRLWPTEEFEL

SEQ ID NO: 1066804 - protein, 25 aa, Mycobacterium
PKDELTAFGRKWLFSSKFSKKDGMD

SEQ ID NO: 1066805 - protein, 24 aa, Mycobacterium
PKGCVFEYVYLARPDSTLAGRSVH

SEQ ID NO: 1066806 - protein, 24 aa, Mycobacterium
PKGVAAWLVLCCRALHAGAQEALS

SEQ ID NO: 1066807 - protein, 18 aa, Mycobacterium
PKHANFDEGLRATIDWYR

SEQ ID NO: 1066808 - protein, 17 aa, Mycobacterium
PKRGIVVVVPQVTERRP

SEQ ID NO: 1066809 - protein, 22 aa, Mycobacterium
PKTLVQHLIRWVIASSQFEEQV

SEQ ID NO: 1066810 - protein, 20 aa, Mycobacterium
PKTSALPHDTAVASTPNAAP

SEQ ID NO: 1066811 - protein, 17 aa, Mycobacterium
PLAPSLATVPDALVGAC

SEQ ID NO: 1066812 - protein, 18 aa, Mycobacterium
PLASILRDKRIPLELCPS

SEQ ID NO: 1066813 - protein, 21 aa, Mycobacterium
PLAYTLFQRTLRHDPNDTAWL

SEQ ID NO: 1066814 - protein, 18 aa, Mycobacterium
PLFDPTRLKTIAVRTPSG

SEQ ID NO: 1066815 - protein, 18 aa, Mycobacterium
PLGFWNAMREVLPATREQ

SEQ ID NO: 1066816 - protein, 17 aa, Mycobacterium
PLGPVYQAGTLSGNPVA

SEQ ID NO: 1066817 - protein, 20 aa, Mycobacterium
PLIATAFHLLTGTTPFQHPN

SEQ ID NO: 1066818 - protein, 18 aa, Mycobacterium
PLILVAQREVGAVTPKPS

SEQ ID NO: 1066819 - protein, 19 aa, Mycobacterium
PLLERAKFLAIFASNLDEF

SEQ ID NO: 1066820 - protein, 17 aa, Mycobacterium
PLNFHRGINVAMDSLKF

SEQ ID NO: 1066821 - protein, 18 aa, Mycobacterium
PLSSGMVGFFAYDMVRRL

SEQ ID NO: 1066822 - protein, 34 aa, Mycobacterium
PLTLSAPKPMLPTAGLPFLTHLLSRIAAAGIEHV

SEQ ID NO: 1066823 - protein, 34 aa, Mycobacterium
PLYVMPTKGIFTSNFGYRWGVLHAGIDLANAIGT

SEQ ID NO: 1066824 - protein, 17 aa, Mycobacterium
PMGWESLLTEPLQAYSV

SEQ ID NO: 1066825 - protein, 18 aa, Mycobacterium
PMKPKLDVLDFWSIVRPE

SEQ ID NO: 1066826 - protein, 24 aa, Mycobacterium
PMSVDHGMLPRLLAHLVHPSTTGV

SEQ ID NO: 1066827 - protein, 24 aa, Mycobacterium
PNEGSFPDFPLPLGDPLEPTQADI

SEQ ID NO: 1066828 - protein, 20 aa, Mycobacterium
PNFRIAAWGTLILADRESHR

SEQ ID NO: 1066829 - protein, 19 aa, Mycobacterium
PNHLIRTPGGWTEAGNLIA

SEQ ID NO: 1066830 - protein, 23 aa, Mycobacterium
PNLDKRIVRLPKTHIKAVGTHPV

SEQ ID NO: 1066831 - protein, 20 aa, Mycobacterium
PNPAEMVISWVANILSEHGN

SEQ ID NO: 1066832 - protein, 17 aa, Mycobacterium
PNPGFSSALSYYDALRT

SEQ ID NO: 1066833 - protein, 22 aa, Mycobacterium
PNYRNQPCRFSRPKFHRSSLHD

SEQ ID NO: 1066834 - protein, 27 aa, Mycobacterium
PPADIEARWFGANGWRPGDPWIADTTL

SEQ ID NO: 1066835 - protein, 24 aa, Mycobacterium
PPARRQWWIDRVKTCYSLLVPCAG

SEQ ID NO: 1066836 - protein, 26 aa, Mycobacterium
PPEPHPVLPITPWQHTRHWISAMSAA

SEQ ID NO: 1066837 - protein, 19 aa, Mycobacterium
PPGAGTPPFSLTPLSTTSG

SEQ ID NO: 1066838 - protein, 29 aa, Mycobacterium
PPHVATEITRLALFLTTPASRHITGQTLH

SEQ ID NO: 1066839 - protein, 22 aa, Mycobacterium
PPLIHVVVYALNQWLDEVWSFS

SEQ ID NO: 1066840 - protein, 17 aa, Mycobacterium
PPMVTSGLRIGTPALAT

SEQ ID NO: 1066841 - protein, 17 aa, Mycobacterium
PPPPGRWARRKPDAAAR

SEQ ID NO: 1066842 - protein, 24 aa, Mycobacterium
PPTDTRAYFRGECLRRFSADIAAA

SEQ ID NO: 1066843 - protein, 20 aa, Mycobacterium
PPTVPGWRSRAERFDMAVLE

SEQ ID NO: 1066844 - protein, 17 aa, Mycobacterium
PPTVVMLAGLQGSGKTT

SEQ ID NO: 1066845 - protein, 17 aa, Mycobacterium
PPYSWVATIFRSALEID

SEQ ID NO: 1066846 - protein, 25 aa, Mycobacterium
PQAAPQPLALTPFQTFTAGNIVPTR

SEQ ID NO: 1066847 - protein, 23 aa, Mycobacterium
PQAFDGLRLAGRWVRRPDLTVAT

SEQ ID NO: 1066848 - protein, 19 aa, Mycobacterium
PQARYILPSFIEHSSFGVK

SEQ ID NO: 1066849 - protein, 34 aa, Mycobacterium
PQDQDPDWIIGRYIPNLVPRPFTLARDFIQEIRD

SEQ ID NO: 1066850 - protein, 23 aa, Mycobacterium
PQGTVKWFNAEKGFGFIAPEDGS

SEQ ID NO: 1066851 - protein, 23 aa, Mycobacterium
PQITAMLRRLGIADDFKGGFRVT

SEQ ID NO: 1066852 - protein, 25 aa, Mycobacterium
PQLFKQLLMVAGMERYYQIAHCYRD

SEQ ID NO: 1066853 - protein, 18 aa, Mycobacterium
PQLNYQRHLFQERQIRSV

SEQ ID NO: 1066854 - protein, 30 aa, Mycobacterium; identical to SEQ ID NO: 1037167

SEQ ID NO: 1066855 - protein, 24 aa, Mycobacterium
PQNAQVLTPVLLAAGIDLLVVQGS

SEQ ID NO: 1066856 - protein, 20 aa, Mycobacterium
PQQRMALELTWEALEHARIP

SEQ ID NO: 1066857 - protein, 17 aa, Mycobacterium
PQRPLIEVLRDLTTRIY

SEQ ID NO: 1066858 - protein, 21 aa, Mycobacterium
PQRRKPICMPGLQDVAERLSN

SEQ ID NO: 1066859 - protein, 17 aa, Mycobacterium
PQRRVRLRGRLARGNLG

SEQ ID NO: 1066860 - protein, 17 aa, Mycobacterium
PQTLINIRPVVAAIKEF

SEQ ID NO: 1066861 - protein, 24 aa, Mycobacterium
PQVQNWLQWLQKIGYTDFYNTLVQ

SEQ ID NO: 1066862 - protein, 20 aa, Mycobacterium
PQVSPFPAVLQDVSLVVSTQ

SEQ ID NO: 1066863 - protein, 23 aa, Mycobacterium
PRELHIVDTLPRRGIGKVDRTAL

SEQ ID NO: 1066864 - protein, 18 aa, Mycobacterium
PREWRRRKPYSWLRQVLP

SEQ ID NO: 1066865 - protein, 20 aa, Mycobacterium
PRFDLTYKDVFIVPHRSDVA

SEQ ID NO: 1066866 - protein, 17 aa, Mycobacterium
PRIDLLINNAGVMMATK

SEQ ID NO: 1066867 - protein, 33 aa, Mycobacterium
PRINVELPLWLQRVLTNVPGLRALLRAGIYWAH

SEQ ID NO: 1066868 - protein, 24 aa, Mycobacterium
PRIVRLYRRRIAPGGFRFGSRFGV

SEQ ID NO: 1066869 - protein, 23 aa, Mycobacterium
PRKGMSVLLDALPGVMECFDDVQ

SEQ ID NO: 1066870 - protein, 24 aa, Mycobacterium
PRLGKTVLFLGRYDEPRKGMSVLL

SEQ ID NO: 1066871 - protein, 17 aa, Mycobacterium
PRLPQRELRKIHTRRRI

SEQ ID NO: 1066872 - protein, 29 aa, Mycobacterium
PRLRMRHAPFRITAIERDAWLRCMHTAVA

SEQ ID NO: 1066873 - protein, 23 aa, Mycobacterium
PRNFARRGIRSYVLPASATFNQI

SEQ ID NO: 1066874 - protein, 18 aa, Mycobacterium
PRPFYASSFMFLDPPDHT

SEQ ID NO: 1066875 - protein, 19 aa, Mycobacterium
PRQYRALSRSTDDTDRAWF

SEQ ID NO: 1066876 - protein, 17 aa, Mycobacterium
PRRHRQDIWGVDLSGAG

SEQ ID NO: 1066877 - protein, 27 aa, Mycobacterium
PRVMISKMFRLLFYTPRIPPNTGNAIR

SEQ ID NO: 1066878 - protein, 26 aa, Mycobacterium
PSDFRLWMCLHEVTHWIQFTANRWLF

SEQ ID NO: 1066879 - protein, 31 aa, Mycobacterium
PSEMARRVLIELLAWQFASPVRWIETQDLLF

SEQ ID NO: 1066880 - protein, 30 aa, Mycobacterium
PSFSVVAPLLSRSLILQLRPLNADDIRAVV

SEQ ID NO: 1066881 - protein, 20 aa, Mycobacterium
PSLATVPDALVGACWPAVFS

SEQ ID NO: 1066882 - protein, 24 aa, Mycobacterium
PSLAWAETYPGTLSYYLASAFGEV

SEQ ID NO: 1066883 - protein, 20 aa, Mycobacterium
PSLLPRPMSSPPEAPRPSAN

SEQ ID NO: 1066884 - protein, 19 aa, Mycobacterium
PSPCWFVNPDNATLAVVDV

SEQ ID NO: 1066885 - protein, 35 aa, Mycobacterium
PSQIVESVPMYKLRRYFPPGNRPGQPLLGAPVLMV

SEQ ID NO: 1066886 - protein, 21 aa, Mycobacterium
PSQPLTARLIRFWLGQRNACA

SEQ ID NO: 1066887 - protein, 21 aa, Mycobacterium
PSREVLFCPDQFLGAHVRRVT

SEQ ID NO: 1066888 - protein, 22 aa, Mycobacterium
PSRGNFLLTLRAAILERDSTVN

SEQ ID NO: 1066889 - protein, 17 aa, Mycobacterium
PSRLLPHQAVRVQTGAP

SEQ ID NO: 1066890 - protein, 23 aa, Mycobacterium
PSSRRIFLQWDSNSILLRWPASM

SEQ ID NO: 1066891 - protein, 17 aa, Mycobacterium
PSTIWQQTSRRPPLSVV

SEQ ID NO: 1066892 - protein, 18 aa, Mycobacterium
PSVLLGRRDGLTRVDEFE

SEQ ID NO: 1066893 - protein, 24 aa, Mycobacterium
PSVNSAVFGARVIARTVQFDVIVH

SEQ ID NO: 1066894 - protein, 19 aa, Mycobacterium
PTAGTLKAAMLSNRASWAT

SEQ ID NO: 1066895 - protein, 17 aa, Mycobacterium
PTALGLVCRVDEQRLFG

SEQ ID NO: 1066896 - protein, 23 aa, Mycobacterium
PTALLAPEWVPWEQRVRPGDLGP

SEQ ID NO: 1066897 - protein, 26 aa, Mycobacterium
PTEPRRFVEIPVVPWVVSAKSQAALT

SEQ ID NO: 1066898 - protein, 26 aa, Mycobacterium
PTGKQWDAAVAYWQQLRTDDDAVFDT

SEQ ID NO: 1066899 - protein, 23 aa, Mycobacterium
PTHRVRGKPLPWKDLRAAFTERG

SEQ ID NO: 1066900 - protein, 19 aa, Mycobacterium
PTLYIFPHAGGDATYYVPF

SEQ ID NO: 1066901 - protein, 25 aa, Mycobacterium
PTMYVNQPWTIRQYAGFSTAADSNA

SEQ ID NO: 1066902 - protein, 21 aa, Mycobacterium
PTNLFLWPFGGSISDGADHLV

SEQ ID NO: 1066903 - protein, 18 aa, Mycobacterium
PTNLGRLVLSTPAPLPCT

SEQ ID NO: 1066904 - protein, 24 aa, Mycobacterium
PTNSGWRMLSGDETGWLLGDYILS

SEQ ID NO: 1066905 - protein, 25 aa, Mycobacterium
PTRQANWWYYSRTFEGKQYRVQCRC

SEQ ID NO: 1066906 - protein, 25 aa, Mycobacterium
PTRRVRLMRWGLIPPWIKASSDGGP

SEQ ID NO: 1066907 - protein, 20 aa, Mycobacterium
PTRWFRTAVKALWVTYRIDL

SEQ ID NO: 1066908 - protein, 32 aa, Mycobacterium
PTSPGLAAILPSFPSLLRKQLKGAPMPAPRAI

SEQ ID NO: 1066909 - protein, 18 aa, Mycobacterium
PTSRRRIRLAYQLTPKRV

SEQ ID NO: 1066910 - protein, 30 aa, Mycobacterium
PTYIHPEDRFMLTDPLFGFGPRVAQVVTGA

SEQ ID NO: 1066911 - protein, 24 aa, Mycobacterium
PVDGDIGLWLDLCAGPGGKTALGD

SEQ ID NO: 1066912 - protein, 19 aa, Mycobacterium
PVDGFLPVGPVTPDPARLQ

SEQ ID NO: 1066913 - protein, 17 aa, Mycobacterium
PVDLIAEYGPQVALLPT

SEQ ID NO: 1066914 - protein, 17 aa, Mycobacterium
PVDSIYSPVLKVTYKVD

SEQ ID NO: 1066915 - protein, 21 aa, Mycobacterium
PVDVCVQRWIDAMPQYGPGHA

SEQ ID NO: 1066916 - protein, 17 aa, Mycobacterium
PVFQGTVKSAVAFGALL

SEQ ID NO: 1066917 - protein, 17 aa, Mycobacterium
PVGRIHGWGYRPVGLGL

SEQ ID NO: 1066918 - protein, 24 aa, Mycobacterium
PVHVETVLLPVLQPENHLSATLLA

SEQ ID NO: 1066919 - protein, 17 aa, Mycobacterium
PVLGARPLRRTIQREIE

SEQ ID NO: 1066920 - protein, 27 aa, Mycobacterium
PVLLDAIYDPWPTPLVAAVSAAGGRVI

SEQ ID NO: 1066921 - protein, 17 aa, Mycobacterium
PVLLEKPNQAIAALLKY

SEQ ID NO: 1066922 - protein, 20 aa, Mycobacterium
PVLLESYLDGPEVSLFCVVD

SEQ ID NO: 1066923 - protein, 33 aa, Mycobacterium
PVNDGRGYVLRRLLRRIIRSAKLLGIDSPIVGD

SEQ ID NO: 1066924 - protein, 28 aa, Mycobacterium
PVNFVPVIDKDVRRWWRSDSLWQAHDAR

SEQ ID NO: 1066925 - protein, 27 aa, Mycobacterium
PVPLPSMLITTLRRLNLTLLAQKWELL

SEQ ID NO: 1066926 - protein, 30 aa, Mycobacterium
PVPPNFPDDFLLYWGLLAAMQVRTGRLAFG

SEQ ID NO: 1066927 - protein, 17 aa, Mycobacterium
PVPQRLTYLINDVARRH

SEQ ID NO: 1066928 - protein, 34 aa, Mycobacterium
PVTGIDFAAVSPWWLQRRLLLSGIRAISPAVDVT

SEQ ID NO: 1066929 - protein, 20 aa, Mycobacterium
PVTITVGFLPPYLQTETTAD

SEQ ID NO: 1066930 - protein, 25 aa, Mycobacterium
PVTNGPVWVFAGFGAQHREMGKSLY

SEQ ID NO: 1066931 - protein, 17 aa, Mycobacterium
PVVHYLHRPIPRDELIA

SEQ ID NO: 1066932 - protein, 19 aa, Mycobacterium
PVVRAVNRYGLDTKILPIW

SEQ ID NO: 1066933 - protein, 18 aa, Mycobacterium
PVWASLIALLEDGVPSIG

SEQ ID NO: 1066934 - protein, 18 aa, Mycobacterium
PVYSHLRYDTIPGAKHVV

SEQ ID NO: 1066935 - protein, 27 aa, Mycobacterium
PWGGSYYVEWLTHQLAARARTHIAEVA

SEQ ID NO: 1066936 - protein, 19 aa, Mycobacterium
PWLVDWLLHLSWASITSPT

SEQ ID NO: 1066937 - protein, 27 aa, Mycobacterium
PWYLVRYWRLLKFKLANPHIITRGMVF

SEQ ID NO: 1066938 - protein, 18 aa, Mycobacterium
PYAPRVITIKVPVDKIGE

SEQ ID NO: 1066939 - protein, 24 aa, Mycobacterium
PYCLDGMHHWLANWRLRATEAASV

SEQ ID NO: 1066940 - protein, 18 aa, Mycobacterium
PYGVRPLSLGRLDRGWVV

SEQ ID NO: 1066941 - protein, 20 aa, Mycobacterium
PYNNIARWRWTDIPGALGVA

SEQ ID NO: 1066942 - protein, 31 aa, Mycobacterium
PYSCYAPIMETPWLKSFAQHSRFAEAFRSIS

SEQ ID NO: 1066943 - protein, 23 aa, Mycobacterium
PYSYKGCRYLIDAQYRASPDSVF

SEQ ID NO: 1066944 - protein, 25 aa, Mycobacterium
QAEAGWLWSVRPGVIAGLAAAALHD

SEQ ID NO: 1066945 - protein, 19 aa, Mycobacterium
QAGFNFVRIVSEGGAPAVI

SEQ ID NO: 1066946 - protein, 19 aa, Mycobacterium
QAGGVIALAAARRGIDVHF

SEQ ID NO: 1066947 - protein, 21 aa, Mycobacterium
QAHSAVLKWPQPAATSIATVI

SEQ ID NO: 1066948 - protein, 18 aa, Mycobacterium
QALLPGHAVVLHPGPMLR

SEQ ID NO: 1066949 - protein, 19 aa, Mycobacterium
QANYAGRPSPLYEATRLSE

SEQ ID NO: 1066950 - protein, 24 aa, Mycobacterium
QAPLSFPIPGWNICVDFPIKSGLN

SEQ ID NO: 1066951 - protein, 25 aa, Mycobacterium
QAQAGALPPLFSRLVRRSRRRQIED

SEQ ID NO: 1066952 - protein, 22 aa, Mycobacterium
QARELLPERALMGDASAIVALH

SEQ ID NO: 1066953 - protein, 24 aa, Mycobacterium
QARRLLVRGFFGEIISKIAVPQVR

SEQ ID NO: 1066954 - protein, 25 aa, Mycobacterium
QASPPDMKLPISLALGWPQRVGGAA

SEQ ID NO: 1066955 - protein, 28 aa, Mycobacterium
QATAAFEVDWWLTFSSASSLLGTPGQGA

SEQ ID NO: 1066956 - protein, 21 aa, Mycobacterium
QATRNVFGFAPYPSVSRSEPA

SEQ ID NO: 1066957 - protein, 24 aa, Mycobacterium
QCDVLIAELAPALSAPYERLCAGG

SEQ ID NO: 1066958 - protein, 19 aa, Mycobacterium
QCLRSLDALGLLETRILAP

SEQ ID NO: 1066959 - protein, 18 aa, Mycobacterium
QCPLLYRFRAIDRLPEAP

SEQ ID NO: 1066960 - protein, 17 aa, Mycobacterium
QCSTCDYLAAFGFFREL

SEQ ID NO: 1066961 - protein, 20 aa, Mycobacterium
QDAGLAILLLSRPPTNAMTR

SEQ ID NO: 1066962 - protein, 21 aa, Mycobacterium
QDEWSGRLRRLLVEQASVILR

SEQ ID NO: 1066963 - protein, 21 aa, Mycobacterium
QDEYLCWAVKAFRLATSGVAD

SEQ ID NO: 1066964 - protein, 29 aa, Mycobacterium
QDKLVMRRRLAALGAAMPRFMALDSVDDL

SEQ ID NO: 1066965 - protein, 24 aa, Mycobacterium
QDLRGLLGAFMFSGPQLDQLAGTL

SEQ ID NO: 1066966 - protein, 24 aa, Mycobacterium
QDMVSPLRAVVGKGLGLVAPGLPV

SEQ ID NO: 1066967 - protein, 17 aa, Mycobacterium
QDWIRALRTAETATRDL

SEQ ID NO: 1066968 - protein, 20 aa, Mycobacterium
QDYRTFWTQFGKVLKEGLMS

SEQ ID NO: 1066969 - protein, 24 aa, Mycobacterium
QEAKPLQLVEITIALKATQLLQTR

SEQ ID NO: 1066970 - protein, 27 aa, Mycobacterium
QEALAAKMPARRLPCGTSVKTIGGNGR

SEQ ID NO: 1066971 - protein, 21 aa, Mycobacterium
QEAQVLLPSYTKFYLDETYSE

SEQ ID NO: 1066972 - protein, 17 aa, Mycobacterium
QECERLSLPVFVKPARG

SEQ ID NO: 1066973 - protein, 32 aa, Mycobacterium
QEGDRGVSWLPFFHDMGLITVLLPSVLGHSFT

SEQ ID NO: 1066974 - protein, 19 aa, Mycobacterium
QEGLDQVFQVLRAPHTEEP

SEQ ID NO: 1066975 - protein, 25 aa, Mycobacterium
QEIDHVPFVAPLARFAATAQSADAA

SEQ ID NO: 1066976 - protein, 17 aa, Mycobacterium
QEILRDGVIPRRLITSC

SEQ ID NO: 1066977 - protein, 17 aa, Mycobacterium
QELLEQFDLLHAGKRRV

SEQ ID NO: 1066978 - protein, 25 aa, Mycobacterium
QELTPQLYPQLTAIAPTVFTAAAPG

SEQ ID NO: 1066979 - protein, 17 aa, Mycobacterium
QEMLRLRRWCSGTSNRW

SEQ ID NO: 1066980 - protein, 27 aa, Mycobacterium
QFAIRPSGVFLRRLIHAPATTTSKSST

SEQ ID NO: 1066981 - protein, 18 aa, Mycobacterium
QFAKVIIKLEPFSGENGA

SEQ ID NO: 1066982 - protein, 20 aa, Mycobacterium
QFDFFPLTVDVEERMYAAGR

SEQ ID NO: 1066983 - protein, 19 aa, Mycobacterium
QFDIPLREPLIPDPEPHGA

SEQ ID NO: 1066984 - protein, 20 aa, Mycobacterium
QFERTVVAGVRVLESSTDHV

SEQ ID NO: 1066985 - protein, 20 aa, Mycobacterium
QFRHRITDTRLLLNDALEAG

SEQ ID NO: 1066986 - protein, 25 aa, Mycobacterium
QFTANRWLFDYMSKALDLLTQKTSE

SEQ ID NO: 1066987 - protein, 25 aa, Mycobacterium
QFTEPLTNWYLRRSRARFWDEDVDA

SEQ ID NO: 1066988 - protein, 27 aa, Mycobacterium
QGALFDTPILVPPQAAMLGIGAIVKRP

SEQ ID NO: 1066989 - protein, 25 aa, Mycobacterium
QGAWPRFGLELPELLPRLTGIKRIS

SEQ ID NO: 1066990 - protein, 20 aa, Mycobacterium
QGCLNLSQWIKTFTQAGKPG

SEQ ID NO: 1066991 - protein, 22 aa, Mycobacterium
QGEGLVVWFNTLLASAGGQVLS

SEQ ID NO: 1066992 - protein, 25 aa, Mycobacterium
QGGLNLDMSLKLWERGEQLAKRCEE

SEQ ID NO: 1066993 - protein, 32 aa, Mycobacterium
QGILDIFQMWIPKLKFVLMPTPIWDQLLKPLA

SEQ ID NO: 1066994 - protein, 21 aa, Mycobacterium
QGITDLITTPGLINVDFADVK

SEQ ID NO: 1066995 - protein, 19 aa, Mycobacterium
QGPAGWLRAKTGSLTAINS

SEQ ID NO: 1066996 - protein, 24 aa, Mycobacterium
QGQCKFSWPPKMDLPGYKPNTKPH

SEQ ID NO: 1066997 - protein, 24 aa, Mycobacterium
QGSAQLIRPLTAAALLAAVNKVLS

SEQ ID NO: 1066998 - protein, 28 aa, Mycobacterium
QGYALLPTLLRYQLPIWPERLLTRNNAA

SEQ ID NO: 1066999 - protein, 20 aa, Mycobacterium
QGYLDYLIIERSIAANTLSS

SEQ ID NO: 1067000 - protein, 18 aa, Mycobacterium
QHGMLDELCLTIAPLIVG

SEQ ID NO: 1067001 - protein, 19 aa, Mycobacterium
QHLELARDLAQRFNSRFPD

SEQ ID NO: 1067002 - protein, 17 aa, Mycobacterium
QHPSRYRLGTFSALPHL

SEQ ID NO: 1067003 - protein, 24 aa, Mycobacterium
QHQMWAAQFISYEKPRTWLNSGGL

SEQ ID NO: 1067004 - protein, 17 aa, Mycobacterium
QHRHWHARRLDAVKDTA

SEQ ID NO: 1067005 - protein, 19 aa, Mycobacterium
QHVKKVYYWAARSIEGQFV

SEQ ID NO: 1067006 - protein, 21 aa, Mycobacterium
QIAISAWGLLSPHGRCAAFDA

SEQ ID NO: 1067007 - protein, 23 aa, Mycobacterium
QIGSPTYVVDLAAALLQVADGSV

SEQ ID NO: 1067008 - protein, 25 aa, Mycobacterium
QIPSITRRLLLTVRQRLAAFITPIP

SEQ ID NO: 1067009 - protein, 21 aa, Mycobacterium
QIQLGLMGMQLALTELWRSYG

SEQ ID NO: 1067010 - protein, 24 aa, Mycobacterium
QIQPGRVVVLPWDKHIAAGTEIRL

SEQ ID NO: 1067011 - protein, 17 aa, Mycobacterium
QITLDEIHLLRHNTRQP

SEQ ID NO: 1067012 - protein, 23 aa, Mycobacterium
QIVTGIIDRRPGWRDARWVAAVI

SEQ ID NO: 1067013 - protein, 25 aa, Mycobacterium
QKAKPQLSVLLWERSQDPQRGAWSL

SEQ ID NO: 1067014 - protein, 24 aa, Mycobacterium
QKISELYDRVGFAAAGKFNEFDNL

SEQ ID NO: 1067015 - protein, 25 aa, Mycobacterium
QKQRIGIARALALQPKILAFDEPVS

SEQ ID NO: 1067016 - protein, 23 aa, Mycobacterium
QKRWTMRWKPALNAFAITFADRM

SEQ ID NO: 1067017 - protein, 24 aa, Mycobacterium
QKRWTMRWKPALNAFAITFADRMP

SEQ ID NO: 1067018 - protein, 22 aa, Mycobacterium
QLAKAMDRKVWLPSGGTLVIDR

SEQ ID NO: 1067019 - protein, 19 aa, Mycobacterium
QLCGVASVWYFLDESHPAC

SEQ ID NO: 1067020 - protein, 18 aa, Mycobacterium
QLCLPFYGALVTNCGLDR

SEQ ID NO: 1067021 - protein, 21 aa, Mycobacterium
QLDALCALGLQYRVAAAALPN

SEQ ID NO: 1067022 - protein, 25 aa, Mycobacterium
QLDDRRLLSLIFLARDHVMHGWVLA

SEQ ID NO: 1067023 - protein, 22 aa, Mycobacterium
QLDEYLAWTIGVPNLLNPSIAA

SEQ ID NO: 1067024 - protein, 25 aa, Mycobacterium
QLEMRLNRQLADIEKLQLNLRQALT

SEQ ID NO: 1067025 - protein, 23 aa, Mycobacterium
QLGKDGCIPLAIHPAMMFSGSDE

SEQ ID NO: 1067026 - protein, 25 aa, Mycobacterium
QLGRAEIRALFRSSKVGIIAGCIIS

SEQ ID NO: 1067027 - protein, 18 aa, Mycobacterium
QLLGEGYTLVRCEYMTAI

SEQ ID NO: 1067028 - protein, 17 aa, Mycobacterium
QLLRLSAGPQARAISRA

SEQ ID NO: 1067029 - protein, 20 aa, Mycobacterium
QLMLDLYQRVIDGVAELGFP

SEQ ID NO: 1067030 - protein, 18 aa, Mycobacterium
QLPPNGLPVILGPDHPVT

SEQ ID NO: 1067031 - protein, 22 aa, Mycobacterium
QLRSVMHRLIYNDGITYTGIDP

SEQ ID NO: 1067032 - protein, 17 aa, Mycobacterium
QLSTVVLLLPHGHEGQG

SEQ ID NO: 1067033 - protein, 20 aa, Mycobacterium
QLTMRVFTGLTLLDTIQGTV

SEQ ID NO: 1067034 - protein, 23 aa, Mycobacterium
QLVDSTLPVLGLAGSTFFDEAAR

SEQ ID NO: 1067035 - protein, 26 aa, Mycobacterium
QLVDTRIQYPKYVRSRWLAAVDPHAN

SEQ ID NO: 1067036 - protein, 18 aa, Mycobacterium
QLVPKMLRIMRPDLTIGF

SEQ ID NO: 1067037 - protein, 20 aa, Mycobacterium
QLWTIIGFQHVKPGKGPAFV

SEQ ID NO: 1067038 - protein, 17 aa, Mycobacterium
QLYAALHRAGLVNLPIS

SEQ ID NO: 1067039 - protein, 17 aa, Mycobacterium
QMAPIPSLLSVAAVHHH

SEQ ID NO: 1067040 - protein, 17 aa, Mycobacterium
QMVSVATAMIPFLEHDD

SEQ ID NO: 1067041 - protein, 23 aa, Mycobacterium
QNNLQLHHILATKVDVWGDNSLP

SEQ ID NO: 1067042 - protein, 24 aa, Mycobacterium
QNQRNYRWLWRSASLLRHVLGCHH

SEQ ID NO: 1067043 - protein, 26 aa, Mycobacterium
QPGDALFFGHGLNIHFELVKPSGDVT

SEQ ID NO: 1067044 - protein, 17 aa, Mycobacterium
QPGRWPLPTATTPHQLW

SEQ ID NO: 1067045 - protein, 22 aa, Mycobacterium
QPLITSLTNHPFFQGMFSGFDP

SEQ ID NO: 1067046 - protein, 18 aa, Mycobacterium
QPLKAPDIVLRAAAKLPQ

SEQ ID NO: 1067047 - protein, 18 aa, Mycobacterium
QPLRIVSSDLRRAYDTAI

SEQ ID NO: 1067048 - protein, 23 aa, Mycobacterium
QPMRCWPIPPFRDHIPLMVGGSG

SEQ ID NO: 1067049 - protein, 21 aa, Mycobacterium
QPRCEILTFLATREAAHHRLF

SEQ ID NO: 1067050 - protein, 19 aa, Mycobacterium
QPRRVCIEALWGPASDADY

SEQ ID NO: 1067051 - protein, 34 aa, Mycobacterium; identical to SEQ ID NO: 979265

SEQ ID NO: 1067052 - protein, 25 aa, Mycobacterium
QPTFAVHDTLFYCVANMPSAVPKTS

SEQ ID NO: 1067053 - protein, 27 aa, Mycobacterium
QPWDRDRIHRLFDNLEFRVLRDRLFEA

SEQ ID NO: 1067054 - protein, 24 aa, Mycobacterium
QQAAVNRIHWFYSLSPTDRRQYSE

SEQ ID NO: 1067055 - protein, 23 aa, Mycobacterium
QQAVRFGLFHLLQASARAERRAI

SEQ ID NO: 1067056 - protein, 31 aa, Mycobacterium
QQDPDVLDTWFSSALWPFSTLGWPQMTPELE

SEQ ID NO: 1067057 - protein, 18 aa, Mycobacterium
QQDRLMYAYISTPTDNRV

SEQ ID NO: 1067058 - protein, 20 aa, Mycobacterium
QQHGPAFQGIVGLAVEESGA

SEQ ID NO: 1067059 - protein, 24 aa, Mycobacterium
QQIDWSRVHLFWGDERYVPKDDDE

SEQ ID NO: 1067060 - protein, 21 aa, Mycobacterium
QQPPNQLGLGLPPYSTPAELC

SEQ ID NO: 1067061 - protein, 24 aa, Mycobacterium
QQRGRFLCIADFIRSRDLATERSE

SEQ ID NO: 1067062 - protein, 24 aa, Mycobacterium
QQRVWQALLTIPYGETRSYGEIAE

SEQ ID NO: 1067063 - protein, 21 aa, Mycobacterium
QQSMILVYRDAGAGYLSGGRA

SEQ ID NO: 1067064 - protein, 17 aa, Mycobacterium
QQTLRMFGLSESGLAET

SEQ ID NO: 1067065 - protein, 23 aa, Mycobacterium
QQVTRLARDFPLYGGLEDWSLAG

SEQ ID NO: 1067066 - protein, 36 aa, Mycobacterium
QRALDLIEAPPWLQGALIAMLYGVVVVNYLAEALGV

SEQ ID NO: 1067067 - protein, 33 aa, Mycobacterium
QRCGSQAWNLPVVFGPIAITYNVNGLSSLNLDG

SEQ ID NO: 1067068 - protein, 22 aa, Mycobacterium
QREARLSQPLYVMPTKGIFTSN

SEQ ID NO: 1067069 - protein, 21 aa, Mycobacterium
QRFGRYIFMGSVVGLSGVPGQ

SEQ ID NO: 1067070 - protein, 18 aa, Mycobacterium
QRLATRHLLRYPGLQHAA

SEQ ID NO: 1067071 - protein, 18 aa, Mycobacterium
QRLDGMPLAIELAAARIR

SEQ ID NO: 1067072 - protein, 18 aa, Mycobacterium
QRLLPMPSYRTVSNFTKR

SEQ ID NO: 1067073 - protein, 22 aa, Mycobacterium
QRLSSWAVRIRQIYATASVVIV

SEQ ID NO: 1067074 - protein, 29 aa, Mycobacterium
QRLYSFKDILVLKIVKRLLDTGISLHNIR

SEQ ID NO: 1067075 - protein, 25 aa, Mycobacterium
QRNGERYQFLRWGQGAFNDFKVVPP

SEQ ID NO: 1067076 - protein, 26 aa, Mycobacterium
QRVSARVYPALVPMSHPLATVSGAFN

SEQ ID NO: 1067077 - protein, 30 aa, Mycobacterium
QRYCGAPDQLLTAVLFIDLDNFKGINDSLG

SEQ ID NO: 1067078 - protein, 25 aa, Mycobacterium
QSAQPILLAHHLLAHAHPLLRDVGR

SEQ ID NO: 1067079 - protein, 20 aa, Mycobacterium
QSERLLAKFAESSSVLATGS

SEQ ID NO: 1067080 - protein, 21 aa, Mycobacterium
QSGLILFGRLGGVEEALNNVG

SEQ ID NO: 1067081 - protein, 26 aa, Mycobacterium
QSGLSWLLILRKRENFRRAFSGFDIE

SEQ ID NO: 1067082 - protein, 17 aa, Mycobacterium
QSLLAASDIPMDCHLMI

SEQ ID NO: 1067083 - protein, 18 aa, Mycobacterium
QSLQVCTLLRKPDALRAN

SEQ ID NO: 1067084 - protein, 24 aa, Mycobacterium
QSPLDEFHRLAVNAFALLAADAIE

SEQ ID NO: 1067085 - protein, 22 aa, Mycobacterium
QSTTVLFLGRHVGYPVALEGAL

SEQ ID NO: 1067086 - protein, 23 aa, Mycobacterium
QTEKPKVLILGSGPNRIGQGIEF

SEQ ID NO: 1067087 - protein, 18 aa, Mycobacterium
QTGLATELSRHHMQASPK

SEQ ID NO: 1067088 - protein, 33 aa, Mycobacterium
QTLANLYLALERDLTIIPVLNKIDLPAADPDRY

SEQ ID NO: 1067089 - protein, 17 aa, Mycobacterium
QTLIGFLASRNADNWIG

SEQ ID NO: 1067090 - protein, 29 aa, Mycobacterium
QTVNLPTYAFQRQRFWLDANRIGQGDPAS

SEQ ID NO: 1067091 - protein, 19 aa, Mycobacterium
QTYLGHRRYARRQRSWFHR

SEQ ID NO: 1067092 - protein, 17 aa, Mycobacterium
QVALLNGKPRIGMYNLG

SEQ ID NO: 1067093 - protein, 19 aa, Mycobacterium
QVAVMRLRLGLYVFGCGGQ

SEQ ID NO: 1067094 - protein, 17 aa, Mycobacterium
QVDLWTFGDSGKSIIVL

SEQ ID NO: 1067095 - protein, 17 aa, Mycobacterium
QVDQQEFRLVRSSQRKP

SEQ ID NO: 1067096 - protein, 18 aa, Mycobacterium
QVGLLAKLYSVTPADIII

SEQ ID NO: 1067097 - protein, 30 aa, Mycobacterium
QVGLTICYDIRFPALYTELARRGAQLIVVC

SEQ ID NO: 1067098 - protein, 23 aa, Mycobacterium
QVPAAMGVLLAQSAHAGARVVRQ

SEQ ID NO: 1067099 - protein, 25 aa, Mycobacterium
QVRGRGLLLGIVLTAPRAKDIEKAA

SEQ ID NO: 1067100 - protein, 29 aa, Mycobacterium
QVRHDLGRENVFFLHVSLVPHLAPSGELK

SEQ ID NO: 1067101 - protein, 23 aa, Mycobacterium
QVRQWLAAHLAGAELRPAYSNAD

SEQ ID NO: 1067102 - protein, 22 aa, Mycobacterium
QVRSMRYTCERLIRGLDTIAAT

SEQ ID NO: 1067103 - protein, 21 aa, Mycobacterium
QVSYRDLVGFGRRFIDVTADD

SEQ ID NO: 1067104 - protein, 22 aa, Mycobacterium
QVVRFIVPRYIQDDPSLAGVLN

SEQ ID NO: 1067105 - protein, 24 aa, Mycobacterium
QVVTGRDLRWLRRVGLLAASACAV

SEQ ID NO: 1067106 - protein, 17 aa, Mycobacterium
QVWALRLAAELPVANQT

SEQ ID NO: 1067107 - protein, 17 aa, Mycobacterium
QVWTEVDLLLKVKEPMP

SEQ ID NO: 1067108 - protein, 18 aa, Mycobacterium
QWFLWAGIESTYLLNWGW

SEQ ID NO: 1067109 - protein, 21 aa, Mycobacterium
QWIAHVTLARRVCGAQLGRTL

SEQ ID NO: 1067110 - protein, 17 aa, Mycobacterium
QWLSAFDAAWLRLDVRV

SEQ ID NO: 1067111 - protein, 19 aa, Mycobacterium
QWMMRITAYADRLLDDLDL

SEQ ID NO: 1067112 - protein, 25 aa, Mycobacterium
RAAEEALWRWMTAAALVRARGDGGV

SEQ ID NO: 1067113 - protein, 22 aa, Mycobacterium
RAAKLVGIELPKKAAAPARKAP

SEQ ID NO: 1067114 - protein, 19 aa, Mycobacterium
RAAPLLPTVLLGRAGRYLT

SEQ ID NO: 1067115 - protein, 26 aa, Mycobacterium
RAASTPWPTYPLMYRVSPAHEEGGER

SEQ ID NO: 1067116 - protein, 17 aa, Mycobacterium
RACEALYHFAWDEFCDW

SEQ ID NO: 1067117 - protein, 23 aa, Mycobacterium
RADDLVFSVEALNSYIAAQQAAG

SEQ ID NO: 1067118 - protein, 18 aa, Mycobacterium
RADRFWSSQLLDDAIARL

SEQ ID NO: 1067119 - protein, 25 aa, Mycobacterium
RADRGYFCFPEVDIRIPFTPGMAAL

SEQ ID NO: 1067120 - protein, 25 aa, Mycobacterium
RAEESAFVLLALQAPVAGDLRAIVS

SEQ ID NO: 1067121 - protein, 27 aa, Mycobacterium
RAEVAVLKILALQFIMSDPRHLEGQAR

SEQ ID NO: 1067122 - protein, 17 aa, Mycobacterium
RAEVTSLLRFAGGLHIV

SEQ ID NO: 1067123 - protein, 25 aa, Mycobacterium
RAGGQVWLIPHNPAFDPIPGNDATV

SEQ ID NO: 1067124 - protein, 26 aa, Mycobacterium
RAGITCAVLIPQGKIAMGKLAQAVMH

SEQ ID NO: 1067125 - protein, 17 aa, Mycobacterium
RAGLLLPLGVRSLRVYR

SEQ ID NO: 1067126 - protein, 21 aa, Mycobacterium
RAGRLLWSELVAKFGPQSPKS

SEQ ID NO: 1067127 - protein, 17 aa, Mycobacterium
RAGVWLRDYLEQLVKCR

SEQ ID NO: 1067128 - protein, 27 aa, Mycobacterium
RAHGADMLLLIVAALDQSALMSMLDRT

SEQ ID NO: 1067129 - protein, 27 aa, Mycobacterium
RAHLINTARPFIFDTGLAPAAVGAARA

SEQ ID NO: 1067130 - protein, 19 aa, Mycobacterium
RAILLTHAHIDHMGSAIWF

SEQ ID NO: 1067131 - protein, 28 aa, Mycobacterium
RAINRPTPLMLPSFAVRAALGEFADEGL

SEQ ID NO: 1067132 - protein, 18 aa, Mycobacterium
RALFIPEVPHTYNGRSGL

SEQ ID NO: 1067133 - protein, 18 aa, Mycobacterium
RALQQFLSDVYWGDLDVL

SEQ ID NO: 1067134 - protein, 19 aa, Mycobacterium
RALRPARLLVSGSASLPVP

SEQ ID NO: 1067135 - protein, 23 aa, Mycobacterium
RANPAHAVLWGFGRTLALEHPEI

SEQ ID NO: 1067136 - protein, 25 aa, Mycobacterium
RANVRLLAGQRRLASAIAGGAPMYE

SEQ ID NO: 1067137 - protein, 24 aa, Mycobacterium
RAPDTPPLVLDFGGGVLGALQRHA

SEQ ID NO: 1067138 - protein, 17 aa, Mycobacterium
RAPFQTLLANRITSTTA

SEQ ID NO: 1067139 - protein, 17 aa, Mycobacterium
RAQLRRHGPVTIYGVDK

SEQ ID NO: 1067140 - protein, 21 aa, Mycobacterium
RAQLTPLVFEGTSFGGALMTT

SEQ ID NO: 1067141 - protein, 19 aa, Mycobacterium
RARFRVHQVRSVSGGTLNG

SEQ ID NO: 1067142 - protein, 18 aa, Mycobacterium
RARYLADTYSVLVTSVTD

SEQ ID NO: 1067143 - protein, 26 aa, Mycobacterium
RASCKYMKMITPGALLRCLVEGTDEV

SEQ ID NO: 1067144 - protein, 26 aa, Mycobacterium
RASQQTFLSDMFLFGALPLDPMRPYG

SEQ ID NO: 1067145 - protein, 24 aa, Mycobacterium
RATASADPPIVWVAPGVLVRNVVA

SEQ ID NO: 1067146 - protein, 23 aa, Mycobacterium
RATYTELLVKLNAKLMAGELGGN

SEQ ID NO: 1067147 - protein, 18 aa, Mycobacterium
RAWPRHRRLSIAAGDAPS

SEQ ID NO: 1067148 - protein, 21 aa, Mycobacterium
RAYQDMLLSVKLQHLVRWTEA

SEQ ID NO: 1067149 - protein, 30 aa, Mycobacterium
RCGDTDRVTLFRAWYSRRNFGQLSGSVQIP

SEQ ID NO: 1067150 - protein, 19 aa, Mycobacterium
RCHATRWASLISRSGLTVE

SEQ ID NO: 1067151 - protein, 28 aa, Mycobacterium
RCKTVVMRLYRDWALVLRQHNLGEADRI

SEQ ID NO: 1067152 - protein, 26 aa, Mycobacterium
RCSPYNERLFCLPAAIDLAGAEIELV

SEQ ID NO: 1067153 - protein, 26 aa, Mycobacterium
RDAEWMGPLLEAIGLTVGWITAESTR

SEQ ID NO: 1067154 - protein, 25 aa, Mycobacterium
RDALHSLPLIGQIAYRFMHSVKAGI

SEQ ID NO: 1067155 - protein, 30 aa, Mycobacterium
RDALPYVMALEWIGRICARIARRRGGIDVG

SEQ ID NO: 1067156 - protein, 23 aa, Mycobacterium
RDAMPTFRQVFMAGATGLTLERR

SEQ ID NO: 1067157 - protein, 18 aa, Mycobacterium
RDCGFFLSLVGSLGAMFG

SEQ ID NO: 1067158 - protein, 17 aa, Mycobacterium
RDDIHDVLWPTPTPPAW

SEQ ID NO: 1067159 - protein, 22 aa, Mycobacterium
RDDIIVMLTARRVSPPVAASGY

SEQ ID NO: 1067160 - protein, 22 aa, Mycobacterium
RDDMASLRILPPHDYVAATETI

SEQ ID NO: 1067161 - protein, 26 aa, Mycobacterium
RDDVAALLHWLGNGNFLLLGYQRCRV

SEQ ID NO: 1067162 - protein, 29 aa, Mycobacterium
RDEASQDVLLFIDNIFRFTQAGSEVSTLL

SEQ ID NO: 1067163 - protein, 25 aa, Mycobacterium
RDEAVHGYYIGYKFQRGLVLVDDAR

SEQ ID NO: 1067164 - protein, 26 aa, Mycobacterium
RDEHGEIPLGIYCRASLAQFMDAERL

SEQ ID NO: 1067165 - protein, 17 aa, Mycobacterium
RDELVLAELPAGSLVGT

SEQ ID NO: 1067166 - protein, 25 aa, Mycobacterium
RDETTRPLVICDLGMPRDVDPAVAK

SEQ ID NO: 1067167 - protein, 17 aa, Mycobacterium
RDEWPSMIRRLVSEQIS

SEQ ID NO: 1067168 - protein, 23 aa, Mycobacterium
RDFYALDRLWGDCLVVPVDISQH

SEQ ID NO: 1067169 - protein, 23 aa, Mycobacterium
RDGKPWGSRFPLISIRDQVEADI

SEQ ID NO: 1067170 - protein, 27 aa, Mycobacterium
RDGLYARVLGHWTVAPGLPPATVVQAL

SEQ ID NO: 1067171 - protein, 22 aa, Mycobacterium
RDGRRRLQRRRRYRCCEAAMPT

SEQ ID NO: 1067172 - protein, 23 aa, Mycobacterium
RDGYLVDRAFAEDLALMPVTSIP

SEQ ID NO: 1067173 - protein, 27 aa, Mycobacterium
RDHLQRLWTPYRMTYLAEAPVNHDNST

SEQ ID NO: 1067174 - protein, 20 aa, Mycobacterium
RDIAMVFQSYALYPHMTVRQ

SEQ ID NO: 1067175 - protein, 27 aa, Mycobacterium
RDIFATPDQFDWLVTRLEIARKPRTDP

SEQ ID NO: 1067176 - protein, 18 aa, Mycobacterium
RDIMITLGMFTHDALLGS

SEQ ID NO: 1067177 - protein, 25 aa, Mycobacterium
RDKRMEVALTYIYGIGRTRANEILE

SEQ ID NO: 1067178 - protein, 20 aa, Mycobacterium
RDLSYVWPSLLQQHYGRGFS

SEQ ID NO: 1067179 - protein, 20 aa, Mycobacterium
RDMLPDDLMLIYPEEGIIGT

SEQ ID NO: 1067180 - protein, 29 aa, Mycobacterium
RDPASLAVRLPLRAAPSRPPGRPLSPRRI

SEQ ID NO: 1067181 - protein, 21 aa, Mycobacterium
RDPCIDFAILSATAELLVESG

SEQ ID NO: 1067182 - protein, 20 aa, Mycobacterium
RDPLLRLSNFFDDGRVEPLH

SEQ ID NO: 1067183 - protein, 25 aa, Mycobacterium
RDQKFRFYRTILAQDKLYFDTYLDS

SEQ ID NO: 1067184 - protein, 20 aa, Mycobacterium
RDRFGFTAHMDFYEPTELEG

SEQ ID NO: 1067185 - protein, 18 aa, Mycobacterium
RDSILNVFAQLRSILPPP

SEQ ID NO: 1067186 - protein, 29 aa, Mycobacterium
RDTRLRFIRTYRRIVDPLNPPPANTYDQL

SEQ ID NO: 1067187 - protein, 31 aa, Mycobacterium
RDTTRLRYVEPYRTELQRLGRPVFGPTFEVD

SEQ ID NO: 1067188 - protein, 24 aa, Mycobacterium
RDVLADYGVFLRSLVNTAGLRPLR

SEQ ID NO: 1067189 - protein, 18 aa, Mycobacterium
RDVQFYCIDLGGGGLIYL

SEQ ID NO: 1067190 - protein, 17 aa, Mycobacterium
RDWAAKGTLLLGVRAVI

SEQ ID NO: 1067191 - protein, 22 aa, Mycobacterium
RDYWEHWLAVRSPVLLIEAGTS

SEQ ID NO: 1067192 - protein, 30 aa, Mycobacterium
REAAHHRLFSHVPWLASQLLGAVEAYAAGM

SEQ ID NO: 1067193 - protein, 31 aa, Mycobacterium
REAIDPLLPEVAWSWLIEALESRIDHVTALG

SEQ ID NO: 1067194 - protein, 18 aa, Mycobacterium
REALSLLLEVLPKWERYG

SEQ ID NO: 1067195 - protein, 17 aa, Mycobacterium
REANGDRYLPIWIGQSE

SEQ ID NO: 1067196 - protein, 21 aa, Mycobacterium
REASFFVDRLSQENMPLAGLM

SEQ ID NO: 1067197 - protein, 18 aa, Mycobacterium
REDGFFYIKGRSSEMIVS

SEQ ID NO: 1067198 - protein, 18 aa, Mycobacterium
REECGVFGVWAPGELVAK

SEQ ID NO: 1067199 - protein, 18 aa, Mycobacterium
REEFRRHSYLSPLATGVI

SEQ ID NO: 1067200 - protein, 32 aa, Mycobacterium; identical to SEQ ID NO: 852751

SEQ ID NO: 1067201 - protein, 33 aa, Mycobacterium
REGMRQVLLPLWNAYSFLALYAPKIGTWHTDVS

SEQ ID NO: 1067202 - protein, 24 aa, Mycobacterium
REGNFQIVLVDTPGLHRPRTLLGK

SEQ ID NO: 1067203 - protein, 27 aa, Mycobacterium
REGVEIRYYLVIYQAIDDIEKALRGML

SEQ ID NO: 1067204 - protein, 24 aa, Mycobacterium
REGVPTFLLPANPVSALVVFEVMV

SEQ ID NO: 1067205 - protein, 26 aa, Mycobacterium
REGVRTLPILYALRETGPDSERLRAL

SEQ ID NO: 1067206 - protein, 27 aa, Mycobacterium
REGYDPLQKLMWLFKGVSSPSSKETRE

SEQ ID NO: 1067207 - protein, 17 aa, Mycobacterium
REIGEAVGMLMLPQQHL

SEQ ID NO: 1067208 - protein, 19 aa, Mycobacterium
REIGVDLMFTHIKKSLHEF

SEQ ID NO: 1067209 - protein, 17 aa, Mycobacterium
REIVGPDNYFLELMDHG

SEQ ID NO: 1067210 - protein, 33 aa, Mycobacterium
RELIRYVRPPWLRRWIRGGYGWVQPRLSPVAKA

SEQ ID NO: 1067211 - protein, 30 aa, Mycobacterium
RELNLLTNKPFLYVFNADEAVLTAAAWVAE

SEQ ID NO: 1067212 - protein, 18 aa, Mycobacterium
RELREKRFMKIISLAPEV

SEQ ID NO: 1067213 - protein, 23 aa, Mycobacterium
RELRNWLLLQAYEAGVVPVGAQP

SEQ ID NO: 1067214 - protein, 26 aa, Mycobacterium
RELVKKYSDFIAWPIRMEVERRAPAT

SEQ ID NO: 1067215 - protein, 31 aa, Mycobacterium
REQLHCELASLLRFVLDLLGDYGLEDFYLEL

SEQ ID NO: 1067216 - protein, 32 aa, Mycobacterium
REQLLELIAGLDRPGRLILVEGAGGLLVELAD

SEQ ID NO: 1067217 - protein, 19 aa, Mycobacterium
REQSRPELGYRLLQRLGAD

SEQ ID NO: 1067218 - protein, 26 aa, Mycobacterium
RETLAIPVSPLPLIPGPVDPSGWEVY

SEQ ID NO: 1067219 - protein, 18 aa, Mycobacterium
RETLDLLTRVFPARTCSP

SEQ ID NO: 1067220 - protein, 17 aa, Mycobacterium
RETLFALDIYTTLARDM

SEQ ID NO: 1067221 - protein, 34 aa, Mycobacterium
RETPHVPIPYVYPVDLRYVLAPPVAPTESTNLLG

SEQ ID NO: 1067222 - protein, 18 aa, Mycobacterium
REVAMLRAYQARCAALIG

SEQ ID NO: 1067223 - protein, 19 aa, Mycobacterium
REVLGYDLRCYSDLTYSAA

SEQ ID NO: 1067224 - protein, 20 aa, Mycobacterium
RFAMYLRHRSGLSHLRGLTK

SEQ ID NO: 1067225 - protein, 25 aa, Mycobacterium
RFGVELQFWSFEETLIRCPVENSLT

SEQ ID NO: 1067226 - protein, 17 aa, Mycobacterium
RFLFKINVGYPSPEEER

SEQ ID NO: 1067227 - protein, 20 aa, Mycobacterium
RFRLAVRELKWSVLSSDFEA

SEQ ID NO: 1067228 - protein, 17 aa, Mycobacterium
RFRLLGYGCKQVEYLQW

SEQ ID NO: 1067229 - protein, 28 aa, Mycobacterium
RFRSHPDLDLLTHGLTLWDLDRVFKVNG

SEQ ID NO: 1067230 - protein, 24 aa, Mycobacterium
RFSKADVIELSYHTGIESMLAHIN

SEQ ID NO: 1067231 - protein, 21 aa, Mycobacterium
RFSRQMLRRLAFTRAVRNVDF

SEQ ID NO: 1067232 - protein, 18 aa, Mycobacterium
RFTASRLFGAPPGYVGYE

SEQ ID NO: 1067233 - protein, 18 aa, Mycobacterium
RFVANALSPAKVVSVSVI

SEQ ID NO: 1067234 - protein, 22 aa, Mycobacterium
RFVFHKPVLVGDKLWARMDIHS

SEQ ID NO: 1067235 - protein, 17 aa, Mycobacterium
RFVLEARNVGFDWAKLS

SEQ ID NO: 1067236 - protein, 22 aa, Mycobacterium
RGAEYSVDFVPKVRIEVVIDDS

SEQ ID NO: 1067237 - protein, 18 aa, Mycobacterium
RGAGWNVIKVVWGREWDA

SEQ ID NO: 1067238 - protein, 38 aa, Mycobacterium
RGAKECLPTLLQPGQRLLVFLPLAHVLARALTLSAFTY

SEQ ID NO: 1067239 - protein, 22 aa, Mycobacterium
RGCMRGRTMWVVPFCMGPPGAE

SEQ ID NO: 1067240 - protein, 26 aa, Mycobacterium
RGCSTGPWEPWLRGIPVEFDSVEKVF

SEQ ID NO: 1067241 - protein, 20 aa, Mycobacterium
RGCYPPKPGSYPQQAGHPPL

SEQ ID NO: 1067242 - protein, 23 aa, Mycobacterium
RGDAREPMIPFAQPNSLTRVYTV

SEQ ID NO: 1067243 - protein, 19 aa, Mycobacterium
RGEFEQRLKVVLDDIKFSA

SEQ ID NO: 1067244 - protein, 20 aa, Mycobacterium
RGFFGSRPFSRTNEILVGMG

SEQ ID NO: 1067245 - protein, 19 aa, Mycobacterium
RGFFTSRVIGTFVNEALAM

SEQ ID NO: 1067246 - protein, 28 aa, Mycobacterium
RGITVADMPNLFFLLGPNTGLGHNSVVF

SEQ ID NO: 1067247 - protein, 21 aa, Mycobacterium
RGKPLILVHGLMGRGNTWSRQ

SEQ ID NO: 1067248 - protein, 33 aa, Mycobacterium
RGMAVIISDFLGPINWMRPLRAIAARHEVLGIE

SEQ ID NO: 1067249 - protein, 23 aa, Mycobacterium
RGNTWSRQLPWLSQLGTVYTYDA

SEQ ID NO: 1067250 - protein, 17 aa, Mycobacterium
RGPRLVYYTVGGGDMDV

SEQ ID NO: 1067251 - protein, 18 aa, Mycobacterium
RGQECSAYWPAGTAAWHI

SEQ ID NO: 1067252 - protein, 39 aa, Mycobacterium
RGRDVLALDIYRVGQYTAWRRWMEIAFTLTSDPQELREI

SEQ ID NO: 1067253 - protein, 17 aa, Mycobacterium
RGRLPLDSELRRLPVGI

SEQ ID NO: 1067254 - protein, 27 aa, Mycobacterium
RGRVQSVLLPRLLNWMSYAPDPDGGLL

SEQ ID NO: 1067255 - protein, 17 aa, Mycobacterium
RGSAVKAGLIAVGEDRT

SEQ ID NO: 1067256 - protein, 18 aa, Mycobacterium
RGSRLRAGQVGVALPRRV

SEQ ID NO: 1067257 - protein, 23 aa, Mycobacterium
RGTPTRLLLLRHGQTELSVQRRY

SEQ ID NO: 1067258 - protein, 17 aa, Mycobacterium
RGWVVITNYKRIRISSI

SEQ ID NO: 1067259 - protein, 29 aa, Mycobacterium
RGYHRREDKPFWWGHFDRLNFPVGEWADN

SEQ ID NO: 1067260 - protein, 17 aa, Mycobacterium
RGYIATALHLLERKIAH

SEQ ID NO: 1067261 - protein, 19 aa, Mycobacterium
RGYIVARALKRFSFCLGNP

SEQ ID NO: 1067262 - protein, 20 aa, Mycobacterium
RGYPLFVENLANLGAEIERV

SEQ ID NO: 1067263 - protein, 19 aa, Mycobacterium
RHAVFDRLVYRKLRAALGG

SEQ ID NO: 1067264 - protein, 23 aa, Mycobacterium
RHDALPYDLTGRKLLVTSGGTRE

SEQ ID NO: 1067265 - protein, 27 aa, Mycobacterium
RHECLEYALAHDERFGIWGGLSERERR

SEQ ID NO: 1067266 - protein, 19 aa, Mycobacterium
RHHTILTSLGLPVSYDADA

SEQ ID NO: 1067267 - protein, 18 aa, Mycobacterium
RHKQIDRPCLLGYIDKCA

SEQ ID NO: 1067268 - protein, 20 aa, Mycobacterium
RHMRLPLRDVVWGADAGLLD

SEQ ID NO: 1067269 - protein, 18 aa, Mycobacterium
RHSYLSPLATGVITGLGV

SEQ ID NO: 1067270 - protein, 18 aa, Mycobacterium
RHTILIDIDKAYVEYIRY

SEQ ID NO: 1067271 - protein, 24 aa, Mycobacterium
RHVRFTVVLGYLRSTESPLATKTI

SEQ ID NO: 1067272 - protein, 29 aa, Mycobacterium
RHYHNADRVVYLYNYLLAETSHVLHQTDE

SEQ ID NO: 1067273 - protein, 21 aa, Mycobacterium
RIAAKPWQWVGQELPQFSTAP

SEQ ID NO: 1067274 - protein, 28 aa, Mycobacterium
RIASPPVKWPCFYGIDFPSPAELIANVV

SEQ ID NO: 1067275 - protein, 20 aa, Mycobacterium
RIGLRPRYYPASGADAYLMR

SEQ ID NO: 1067276 - protein, 34 aa, Mycobacterium; identical to SEQ ID NO: 215366

SEQ ID NO: 1067277 - protein, 18 aa, Mycobacterium
RIKMMELLQPERIGVTIS

SEQ ID NO: 1067278 - protein, 20 aa, Mycobacterium
RILKLNIGNPALFGFDAPDV

SEQ ID NO: 1067279 - protein, 24 aa, Mycobacterium
RIRTEPPHPGARYTQIAVLEDGIV

SEQ ID NO: 1067280 - protein, 18 aa, Mycobacterium
RIVPLHLANSALIDLVRV

SEQ ID NO: 1067281 - protein, 18 aa, Mycobacterium
RIVPWRPQTIEWDANDLN

SEQ ID NO: 1067282 - protein, 29 aa, Mycobacterium
RIYLDKNCGSIFIIWDRLFGSFQPRRFHP

SEQ ID NO: 1067283 - protein, 23 aa, Mycobacterium
RKARHDYAIIELFEAGVALLGTE

SEQ ID NO: 1067284 - protein, 19 aa, Mycobacterium
RKHPKWWDMAIIIAYDDSD

SEQ ID NO: 1067285 - protein, 22 aa, Mycobacterium
RKHQLLLLADEIYDKILYDDTK

SEQ ID NO: 1067286 - protein, 20 aa, Mycobacterium
RKLLDIVCDLYALSVKARHG

SEQ ID NO: 1067287 - protein, 20 aa, Mycobacterium
RKLWSTFMQKWISYTAAVID

SEQ ID NO: 1067288 - protein, 26 aa, Mycobacterium
RKPCRVPVWFMRQAGRSLPEYRALRE

SEQ ID NO: 1067289 - protein, 19 aa, Mycobacterium
RKTLTWAQLYQRTLNVAHE

SEQ ID NO: 1067290 - protein, 19 aa, Mycobacterium
RKVFGPIRVAATGALVSPP

SEQ ID NO: 1067291 - protein, 23 aa, Mycobacterium
RKVRVPDGFWLPHPPCDACEFYI

SEQ ID NO: 1067292 - protein, 23 aa, Mycobacterium
RKVVVFRPLYAVGGQELGYLPGS

SEQ ID NO: 1067293 - protein, 19 aa, Mycobacterium
RKVYPWIAQVRNSTPGVGL

SEQ ID NO: 1067294 - protein, 25 aa, Mycobacterium
RLAAKQSWPTLAKLTTLVTTMSSPS

SEQ ID NO: 1067295 - protein, 17 aa, Mycobacterium
RLAERLLVDVIGLPWEE

SEQ ID NO: 1067296 - protein, 28 aa, Mycobacterium
RLAPIKAAVLPLFRHVDLSPKARDLAAE

SEQ ID NO: 1067297 - protein, 30 aa, Mycobacterium
RLAVENDFIPMIPPVLVRPEVMSGTGFLGA

SEQ ID NO: 1067298 - protein, 22 aa, Mycobacterium
RLCRELSLLDLVLANGGRSKRR

SEQ ID NO: 1067299 - protein, 25 aa, Mycobacterium
RLDQLSLPVLRSWLATAAGAGAART

SEQ ID NO: 1067300 - protein, 22 aa, Mycobacterium
RLEALLNFQTLVSDLTGLEIAN

SEQ ID NO: 1067301 - protein, 23 aa, Mycobacterium
RLEELVGIYCTLLSLLAENGARW

SEQ ID NO: 1067302 - protein, 19 aa, Mycobacterium
RLEVLPLLEDVLGGGVVEA

SEQ ID NO: 1067303 - protein, 18 aa, Mycobacterium
RLFTHRNTLLRRIESAEK

SEQ ID NO: 1067304 - protein, 18 aa, Mycobacterium
RLFVEDEPFDVRYGEVIF

SEQ ID NO: 1067305 - protein, 27 aa, Mycobacterium
RLGMDYVDLYLIHWPAPPVGQYVDAWG

SEQ ID NO: 1067306 - protein, 19 aa, Mycobacterium
RLGYLIATPALVEAMLLVR

SEQ ID NO: 1067307 - protein, 20 aa, Mycobacterium
RLIAGLEWVFAAAGGPPKVL

SEQ ID NO: 1067308 - protein, 20 aa, Mycobacterium
RLIQLLELRPDLAQPPPGSI

SEQ ID NO: 1067309 - protein, 19 aa, Mycobacterium
RLKLNPLKEVIRGKRLIVV

SEQ ID NO: 1067310 - protein, 17 aa, Mycobacterium
RLLILDVAHTRQLLGTI

SEQ ID NO: 1067311 - protein, 17 aa, Mycobacterium
RLLPHQAVRVQTGAPLP

SEQ ID NO: 1067312 - protein, 18 aa, Mycobacterium
RLLTGIVVCDELDPWRIR

SEQ ID NO: 1067313 - protein, 18 aa, Mycobacterium
RLPAYRSIAAPVLVIGFA

SEQ ID NO: 1067314 - protein, 25 aa, Mycobacterium
RLPELALNDLQLPDMLLLLATDVAA

SEQ ID NO: 1067315 - protein, 17 aa, Mycobacterium
RLRAGVWLRDYLEQLVK

SEQ ID NO: 1067316 - protein, 24 aa, Mycobacterium
RLREHMVGMLWMPEALRAGRADQS

SEQ ID NO: 1067317 - protein, 21 aa, Mycobacterium
RLRFELDHHINLRPARLYPGV

SEQ ID NO: 1067318 - protein, 17 aa, Mycobacterium
RLRLVLDHLDSLSIGSI

SEQ ID NO: 1067319 - protein, 18 aa, Mycobacterium
RLRMFLEQYWGGPRTYSS

SEQ ID NO: 1067320 - protein, 25 aa, Mycobacterium
RLRQKVVVPTLPTAAPRWVVDPDFE

SEQ ID NO: 1067321 - protein, 21 aa, Mycobacterium
RLRQRFPKLQDPPSDDICYAT

SEQ ID NO: 1067322 - protein, 23 aa, Mycobacterium
RLRTLYCDQLLVLAALDLAATVE

SEQ ID NO: 1067323 - protein, 18 aa, Mycobacterium
RLSLPVFVKPARGGSSIG

SEQ ID NO: 1067324 - protein, 19 aa, Mycobacterium
RLSRLLSELLVSADSSANL

SEQ ID NO: 1067325 - protein, 23 aa, Mycobacterium
RLTAHLPSARRLLLFKADGSVSV

SEQ ID NO: 1067326 - protein, 18 aa, Mycobacterium
RLTIIRWKMLLVEVGPDY

SEQ ID NO: 1067327 - protein, 17 aa, Mycobacterium
RLTLTHRHIAARPIGYR

SEQ ID NO: 1067328 - protein, 17 aa, Mycobacterium
RLVEFFGGIPILDGIGS

SEQ ID NO: 1067329 - protein, 17 aa, Mycobacterium
RLVGPDPGLLVTAYAGL

SEQ ID NO: 1067330 - protein, 19 aa, Mycobacterium
RLVGRSSGLSRWQSRNCSV

SEQ ID NO: 1067331 - protein, 20 aa, Mycobacterium
RLVHVIWNAMYSIRPGSGTV

SEQ ID NO: 1067332 - protein, 17 aa, Mycobacterium
RLVLDHLDSLSIGSIHT

SEQ ID NO: 1067333 - protein, 18 aa, Mycobacterium
RLVLGLYVTYADGGLGLL

SEQ ID NO: 1067334 - protein, 17 aa, Mycobacterium
RLVLPDPVGLLRCCGGA

SEQ ID NO: 1067335 - protein, 20 aa, Mycobacterium
RLVRLLQQIAPRTVAAASRI

SEQ ID NO: 1067336 - protein, 18 aa, Mycobacterium
RLVVELPGERRLKTNAIL

SEQ ID NO: 1067337 - protein, 18 aa, Mycobacterium
RLVVELTPDEAAALSDEL

SEQ ID NO: 1067338 - protein, 18 aa, Mycobacterium
RLYDVELALRLGASTEKV

SEQ ID NO: 1067339 - protein, 17 aa, Mycobacterium
RMAYLRVTRPQIAVSEA

SEQ ID NO: 1067340 - protein, 20 aa, Mycobacterium
RMIEAYHRLSKLNEYSAIDF

SEQ ID NO: 1067341 - protein, 28 aa, Mycobacterium
RMIHGNALYVLQYLIAPRSLTGVRVFFP

SEQ ID NO: 1067342 - protein, 18 aa, Mycobacterium
RMLIVPGSMRVRAQAEAE

SEQ ID NO: 1067343 - protein, 19 aa, Mycobacterium
RMPDRARYLADTYSVLVTS

SEQ ID NO: 1067344 - protein, 19 aa, Mycobacterium
RMRHPLYGKIIRTTKKVKA

SEQ ID NO: 1067345 - protein, 23 aa, Mycobacterium
RNELPLIEEWFEFVGDKLPSGMQ

SEQ ID NO: 1067346 - protein, 17 aa, Mycobacterium
RNFCIIAHIDHGKSTLA

SEQ ID NO: 1067347 - protein, 22 aa, Mycobacterium
RNGPWLADRLLELGVKLAHITI

SEQ ID NO: 1067348 - protein, 26 aa, Mycobacterium
RNHVVMLRQPGIENSRIRMLRSFDPS

SEQ ID NO: 1067349 - protein, 18 aa, Mycobacterium
RNLLKLRRSKSNVQRLKL

SEQ ID NO: 1067350 - protein, 18 aa, Mycobacterium
RNNPMLVELLLDAPHDDH

SEQ ID NO: 1067351 - protein, 18 aa, Mycobacterium
RNPAPFGFHVVAVARHGD

SEQ ID NO: 1067352 - protein, 17 aa, Mycobacterium
RNRVLVEGVNRIKKHTA

SEQ ID NO: 1067353 - protein, 27 aa, Mycobacterium
RNVGEIELLPISKFFPATDVAILSRLG

SEQ ID NO: 1067354 - protein, 23 aa, Mycobacterium
RPAKHYRLTAVGRAKLGHAYDTL

SEQ ID NO: 1067355 - protein, 20 aa, Mycobacterium
RPDFVVGLMPARWGTGFILG

SEQ ID NO: 1067356 - protein, 24 aa, Mycobacterium
RPEDPTLRRLLPDFYTPDDKDQLD

SEQ ID NO: 1067357 - protein, 27 aa, Mycobacterium
RPGQKLRIVKYLAYGWSSLRSRPALHD

SEQ ID NO: 1067358 - protein, 26 aa, Mycobacterium
RPHDPPWCRPLLGVRRSVPRAACHEL

SEQ ID NO: 1067359 - protein, 28 aa, Mycobacterium
RPILAVGSYVPQLPWPFGLIDHAARVLL

SEQ ID NO: 1067360 - protein, 17 aa, Mycobacterium
RPLDVSDILVLAPYNAQ

SEQ ID NO: 1067361 - protein, 22 aa, Mycobacterium
RPLQLTSPEAIGLLVALRALAN

SEQ ID NO: 1067362 - protein, 31 aa, Mycobacterium
RPLVMLLHGFGSFWWSWRHQLRGLTEARLVA

SEQ ID NO: 1067363 - protein, 20 aa, Mycobacterium
RPMPSAAALCRDVGRRFSES

SEQ ID NO: 1067364 - protein, 18 aa, Mycobacterium
RPPLPLNPAAMVAPQVVN

SEQ ID NO: 1067365 - protein, 21 aa, Mycobacterium
RPRWQLYMINVLDWLAREFPL

SEQ ID NO: 1067366 - protein, 26 aa, Mycobacterium
RPSFISLRTIIGYPAPTLINTGKAHG

SEQ ID NO: 1067367 - protein, 21 aa, Mycobacterium
RPTGSFLFLGPTGVGKTELAK

SEQ ID NO: 1067368 - protein, 20 aa, Mycobacterium
RPVAAGLYGDLPAILSALAG

SEQ ID NO: 1067369 - protein, 18 aa, Mycobacterium
RPVLAELQHKFSVSAAET

SEQ ID NO: 1067370 - protein, 19 aa, Mycobacterium
RPVLAINIKLRPAVERALV

SEQ ID NO: 1067371 - protein, 24 aa, Mycobacterium
RPVVWLNPWHWYSVPQVAANALTL

SEQ ID NO: 1067372 - protein, 21 aa, Mycobacterium
RQAAIALDWLRHNGYQDLLSR

SEQ ID NO: 1067373 - protein, 19 aa, Mycobacterium
RQAIWDLVASFKQIGIATL

SEQ ID NO: 1067374 - protein, 35 aa, Mycobacterium
RQCLYFPCQNSVDLLWLLGLWLGDGHTAAPHKHMR

SEQ ID NO: 1067375 - protein, 26 aa, Mycobacterium
RQEDFIGIHFFSPVDKMPLVEIIKGE

SEQ ID NO: 1067376 - protein, 20 aa, Mycobacterium
RQFRASVCVLGPLVGRCKQA

SEQ ID NO: 1067377 - protein, 27 aa, Mycobacterium
RQGIAQLFDVPPLPYQELKIATAAGGG

SEQ ID NO: 1067378 - protein, 25 aa, Mycobacterium
RQHAARVYWLAYRLSGNQHDAEDLT

SEQ ID NO: 1067379 - protein, 22 aa, Mycobacterium
RQLHQLFRPMSTTGLLAPARSQ

SEQ ID NO: 1067380 - protein, 23 aa, Mycobacterium
RQLPAPMSVVAERATVASPGNRS

SEQ ID NO: 1067381 - protein, 18 aa, Mycobacterium
RQMLRRVTIIDSGSTEFL

SEQ ID NO: 1067382 - protein, 27 aa, Mycobacterium
RQRDRAKMFLLLFSSLHRQLQLARRFD

SEQ ID NO: 1067383 - protein, 23 aa, Mycobacterium
RQVILRLFGTLLDAAPTLGAGLD

SEQ ID NO: 1067384 - protein, 24 aa, Mycobacterium
RQVLSVNGWEITYLGTMIGQVDLG

SEQ ID NO: 1067385 - protein, 24 aa, Mycobacterium
RQVRFTAAFTFQYSKRPGTPAAEL

SEQ ID NO: 1067386 - protein, 21 aa, Mycobacterium
RQYMSWISLEDEVRALLFAIS

SEQ ID NO: 1067387 - protein, 24 aa, Mycobacterium
RRARDSAPSLMFLDEIDALAPQYR

SEQ ID NO: 1067388 - protein, 31 aa, Mycobacterium
RRARLPTPQHRRPYRPLQRPNLETLNAVIAV

SEQ ID NO: 1067389 - protein, 23 aa, Mycobacterium
RRDIAPRRILPDTAIIDAAIADP

SEQ ID NO: 1067390 - protein, 25 aa, Mycobacterium
RRDRVVRVIWVLRGLLREYGRRLTD

SEQ ID NO: 1067391 - protein, 22 aa, Mycobacterium
RRDTTYLYRDGANFVFMDSQDY

SEQ ID NO: 1067392 - protein, 25 aa, Mycobacterium
RRELDRYLPFLATTKVLIAAVRAGM

SEQ ID NO: 1067393 - protein, 18 aa, Mycobacterium
RRFALWEGDGQWIAHAGH

SEQ ID NO: 1067394 - protein, 24 aa, Mycobacterium
RRFRRSIQAIVLAALGRTIAQTVG

SEQ ID NO: 1067395 - protein, 17 aa, Mycobacterium
RRGFNIESLAVGATECK

SEQ ID NO: 1067396 - protein, 22 aa, Mycobacterium
RRGIPVLLRSAVLARLMDGCTT

SEQ ID NO: 1067397 - protein, 20 aa, Mycobacterium
RRGNNISLTTVYRTLQSMAE

SEQ ID NO: 1067398 - protein, 26 aa, Mycobacterium
RRIEELRRRLDDLPVLYELAAEERAA

SEQ ID NO: 1067399 - protein, 26 aa, Mycobacterium
RRILDRLYGYEVSPVLWKKVAPKLSA

SEQ ID NO: 1067400 - protein, 17 aa, Mycobacterium
RRKLPSVLYWDRILFCA

SEQ ID NO: 1067401 - protein, 20 aa, Mycobacterium
RRLGLLAELDFLQSAPWIDT

SEQ ID NO: 1067402 - protein, 20 aa, Mycobacterium
RRLIETLTRLRALGNTLIVV

SEQ ID NO: 1067403 - protein, 20 aa, Mycobacterium
RRLVRIPWDLDAYGINPDDF

SEQ ID NO: 1067404 - protein, 23 aa, Mycobacterium
RRNFQFEFLPSTSGNRRHFVVSN

SEQ ID NO: 1067405 - protein, 31 aa, Mycobacterium
RRNLAYFTTTRWLTGFVPIKIPATGSSFRKI

SEQ ID NO: 1067406 - protein, 23 aa, Mycobacterium
RRNRIRELVQEADRLKFALSEID

SEQ ID NO: 1067407 - protein, 20 aa, Mycobacterium
RRNTLRCLASLFGDNPLNSL

SEQ ID NO: 1067408 - protein, 18 aa, Mycobacterium
RRPRVMFDTPTSGLGKTV

SEQ ID NO: 1067409 - protein, 20 aa, Mycobacterium
RRQREGILLCWELLRQKESA

SEQ ID NO: 1067410 - protein, 20 aa, Mycobacterium
RRRFVGWRGPLCRWLTYVPR

SEQ ID NO: 1067411 - protein, 19 aa, Mycobacterium
RRRRRRRKSGVGEDEGCAP

SEQ ID NO: 1067412 - protein, 17 aa, Mycobacterium
RRSGAIELTGPWPGLRC

SEQ ID NO: 1067413 - protein, 25 aa, Mycobacterium
RRTDEVQTVLRWASANRVPVVARGA

SEQ ID NO: 1067414 - protein, 25 aa, Mycobacterium
RRTIARVFPNLFATHRVRAVDDYAS

SEQ ID NO: 1067415 - protein, 20 aa, Mycobacterium
RRVAIIVCKFSFLGGRIGVA

SEQ ID NO: 1067416 - protein, 26 aa, Mycobacterium
RRWAELVYDGLWYSPLKTALESFVAA

SEQ ID NO: 1067417 - protein, 30 aa, Mycobacterium
RSAATCVAAHAPYLAWLTQTNADCVGMAAQ

SEQ ID NO: 1067418 - protein, 29 aa, Mycobacterium
RSADKLVPDWLWHSPSTVKRAFLQALFEG

SEQ ID NO: 1067419 - protein, 22 aa, Mycobacterium
RSADMFLGVPFNIASYALLTHM

SEQ ID NO: 1067420 - protein, 23 aa, Mycobacterium
RSALDIQGLGYEAGVALLAAQVI

SEQ ID NO: 1067421 - protein, 29 aa, Mycobacterium
RSAWTKYSLNYWYRIFDPAFETLLDLERI

SEQ ID NO: 1067422 - protein, 19 aa, Mycobacterium
RSDILAFTLPGFVTGDRTK

SEQ ID NO: 1067423 - protein, 17 aa, Mycobacterium
RSDLIDRRNRIRELVQE

SEQ ID NO: 1067424 - protein, 24 aa, Mycobacterium
RSEMAYCFPAVPMVARAPAADLHS

SEQ ID NO: 1067425 - protein, 23 aa, Mycobacterium
RSEVDVLPFQLVTMGQPIADFVG

SEQ ID NO: 1067426 - protein, 17 aa, Mycobacterium
RSGALVVMESRARYFPK

SEQ ID NO: 1067427 - protein, 25 aa, Mycobacterium
RSIVSERFLLIRTVNRRTVCRHRPA

SEQ ID NO: 1067428 - protein, 19 aa, Mycobacterium
RSLELVFCHGVAVVARLAE

SEQ ID NO: 1067429 - protein, 17 aa, Mycobacterium
RSLLGQMVTARPCPTCR

SEQ ID NO: 1067430 - protein, 34 aa, Mycobacterium
RSLQGNRLLAPNEYIITLGVHDLEKMKADPDLTS

SEQ ID NO: 1067431 - protein, 24 aa, Mycobacterium
RSLVALFEALFDPSPLSSSTNCDA

SEQ ID NO: 1067432 - protein, 17 aa, Mycobacterium
RSLVYQLDRLRVDLADL

SEQ ID NO: 1067433 - protein, 19 aa, Mycobacterium
RSMSVAYELRIYASDGDRV

SEQ ID NO: 1067434 - protein, 30 aa, Mycobacterium
RSNLTAAMQGLLALPLLAGYDIHAPDPQSA

SEQ ID NO: 1067435 - protein, 27 aa, Mycobacterium
RSRLPDAATLIAPWPIALWPVRSNDIC

SEQ ID NO: 1067436 - protein, 22 aa, Mycobacterium
RSRRLHMHTPRSLTPGQGVGMI

SEQ ID NO: 1067437 - protein, 24 aa, Mycobacterium
RSSHTWFVLTHLLGKPGVRNYDGS

SEQ ID NO: 1067438 - protein, 19 aa, Mycobacterium
RSSLEMRATPPVGPDLSRV

SEQ ID NO: 1067439 - protein, 26 aa, Mycobacterium
RSSSGYNWSCGFAGYLVGRIDMSAQV

SEQ ID NO: 1067440 - protein, 20 aa, Mycobacterium
RSTSRLSGIAIERSKQIFEI

SEQ ID NO: 1067441 - protein, 20 aa, Mycobacterium
RSYRVERYLGIIGQVRAAMP

SEQ ID NO: 1067442 - protein, 23 aa, Mycobacterium
RTAGYLAIGLAVAAGAPVCVAMT

SEQ ID NO: 1067443 - protein, 17 aa, Mycobacterium
RTATALRKLVAGIGGRG

SEQ ID NO: 1067444 - protein, 20 aa, Mycobacterium
RTCLDITRYQQAGWRVFRRV

SEQ ID NO: 1067445 - protein, 19 aa, Mycobacterium
RTDFLTLTRGTGIANAVFD

SEQ ID NO: 1067446 - protein, 26 aa, Mycobacterium
RTDTLPNWQTGPLPTLRITAAVPTRA

SEQ ID NO: 1067447 - protein, 18 aa, Mycobacterium
RTDYLFRLANQHGGIVLG

SEQ ID NO: 1067448 - protein, 19 aa, Mycobacterium
RTFLSWQRTSPGLLAAAVA

SEQ ID NO: 1067449 - protein, 17 aa, Mycobacterium
RTGLKIWVDDRLREAHL

SEQ ID NO: 1067450 - protein, 21 aa, Mycobacterium
RTIVMLSGFAPPNLARHGYPG

SEQ ID NO: 1067451 - protein, 19 aa, Mycobacterium
RTLLQMAVVLTYGASLPVV

SEQ ID NO: 1067452 - protein, 24 aa, Mycobacterium
RTPGRSWEHRWALSVLHTALGGGL

SEQ ID NO: 1067453 - protein, 18 aa, Mycobacterium
RTRLRLEVLPLLEDVLGG

SEQ ID NO: 1067454 - protein, 21 aa, Mycobacterium
RTRNFDIFALLHGGGPSGQAG

SEQ ID NO: 1067455 - protein, 23 aa, Mycobacterium
RTRVRRPPRGSYQIGILGLKGGA

SEQ ID NO: 1067456 - protein, 23 aa, Mycobacterium
RTSEIRYRLTFGIVQGYGGHGIG

SEQ ID NO: 1067457 - protein, 25 aa, Mycobacterium
RTTLGALAFRAFARALACVVFLGRA

SEQ ID NO: 1067458 - protein, 26 aa, Mycobacterium
RTVRQFNDLLRVLPPLPADTSQEAGA

SEQ ID NO: 1067459 - protein, 26 aa, Mycobacterium
RTVVGVQLLLTPAIRLTNWAANCIVH

SEQ ID NO: 1067460 - protein, 18 aa, Mycobacterium
RTYRRLLSLVVDGYRREG

SEQ ID NO: 1067461 - protein, 22 aa, Mycobacterium
RVAGVHFLMKKNKITEIHGYGR

SEQ ID NO: 1067462 - protein, 20 aa, Mycobacterium
RVALIDGTWVAFPTVEQLER

SEQ ID NO: 1067463 - protein, 19 aa, Mycobacterium
RVAVEPLVLMLAPLAPHLA

SEQ ID NO: 1067464 - protein, 25 aa, Mycobacterium
RVEEIILSMVYARVPELPVAADTVS

SEQ ID NO: 1067465 - protein, 26 aa, Mycobacterium
RVGGSNYIIIIIALGFENMQSGSLNS

SEQ ID NO: 1067466 - protein, 22 aa, Mycobacterium
RVGIAWLRYTCGVCNYCRSGTE

SEQ ID NO: 1067467 - protein, 27 aa, Mycobacterium
RVGMRLLGSPLLYRYPDRQLPSEGTTC

SEQ ID NO: 1067468 - protein, 23 aa, Mycobacterium
RVGQYVTWGLNHLVFHAPGHNQR

SEQ ID NO: 1067469 - protein, 18 aa, Mycobacterium
RVHWLDVGTVDRVGVVDD

SEQ ID NO: 1067470 - protein, 18 aa, Mycobacterium
RVIDHPLATARLAVLRDE

SEQ ID NO: 1067471 - protein, 25 aa, Mycobacterium
RVIDSYLPGCWLDSGPFGCLGSGPG

SEQ ID NO: 1067472 - protein, 24 aa, Mycobacterium
RVKPGDVIIALRSSGLHSNGYSLA

SEQ ID NO: 1067473 - protein, 17 aa, Mycobacterium
RVLVAVPRPEESRFRSM

SEQ ID NO: 1067474 - protein, 19 aa, Mycobacterium
RVLYLCHKLSQVTLYAPAE

SEQ ID NO: 1067475 - protein, 23 aa, Mycobacterium
RVPDFYPMPYDPHLATGLAVEYT

SEQ ID NO: 1067476 - protein, 18 aa, Mycobacterium
RVPLGVVGMIYEGRPNIT

SEQ ID NO: 1067477 - protein, 27 aa, Mycobacterium
RVPTTALAQLPLLLLDEGHCLRDQTLD

SEQ ID NO: 1067478 - protein, 20 aa, Mycobacterium
RVREILGRRPTDTELAMYSV

SEQ ID NO: 1067479 - protein, 25 aa, Mycobacterium
RVSCQWRLVWYRAVADLLTGDYASA

SEQ ID NO: 1067480 - protein, 24 aa, Mycobacterium
RVSRRLMAMLARRGYSQTTICEVV

SEQ ID NO: 1067481 - protein, 29 aa, Mycobacterium
RVTQWGFVNTWLSYYTAGLFALNNGVPWS

SEQ ID NO: 1067482 - protein, 23 aa, Mycobacterium
RVVDKLLHAPTVRIKQLASAPGG

SEQ ID NO: 1067483 - protein, 18 aa, Mycobacterium
RVVLRFGAAYGASVLVDH

SEQ ID NO: 1067484 - protein, 26 aa, Mycobacterium
RVVSFLERYFPIPAPWEKVATDFNRQ

SEQ ID NO: 1067485 - protein, 17 aa, Mycobacterium
RVVVVAPYEGPLRDATA

SEQ ID NO: 1067486 - protein, 30 aa, Mycobacterium
RVWESQLGPDLLWLGDHVIDDLCVLPGAAY

SEQ ID NO: 1067487 - protein, 17 aa, Mycobacterium
RWALSLAAPESPAFMRH

SEQ ID NO: 1067488 - protein, 32 aa, Mycobacterium
RWIVNQIRSVAPKTILVVIVTKIDKVPKDRLS

SEQ ID NO: 1067489 - protein, 21 aa, Mycobacterium
RWWERPYIAAGIFLYDRLGGA

SEQ ID NO: 1067490 - protein, 18 aa, Mycobacterium
RWYHRTPVICWSTFDGFD

SEQ ID NO: 1067491 - protein, 19 aa, Mycobacterium
RYCYNFYNFLNINHYMVDI

SEQ ID NO: 1067492 - protein, 18 aa, Mycobacterium
RYFLDNVAEWILELDRGR

SEQ ID NO: 1067493 - protein, 20 aa, Mycobacterium
RYFVKVMPKDYKRVLQAIAL

SEQ ID NO: 1067494 - protein, 20 aa, Mycobacterium
RYINDRFLPDKAIDLIDEAG

SEQ ID NO: 1067495 - protein, 23 aa, Mycobacterium
RYITARFLPDKAIDLVDEAASRL

SEQ ID NO: 1067496 - protein, 19 aa, Mycobacterium
RYLEQLEFGLVREALYERE

SEQ ID NO: 1067497 - protein, 25 aa, Mycobacterium
RYQRPQGTYLTWLDCRHLGFDEQIN

SEQ ID NO: 1067498 - protein, 22 aa, Mycobacterium
RYQRWLKVLRGSARLVIGTRSA

SEQ ID NO: 1067499 - protein, 26 aa, Mycobacterium
RYRNTYDSWLWELPAGLLDAAGEPPY

SEQ ID NO: 1067500 - protein, 25 aa, Mycobacterium
RYSNRAYLIQIRRANAGTVLIDPVS

SEQ ID NO: 1067501 - protein, 19 aa, Mycobacterium
RYVDVFATVPVLLDAIYDP

SEQ ID NO: 1067502 - protein, 18 aa, Mycobacterium
RYVLMPGIINTLVGVRHA

SEQ ID NO: 1067503 - protein, 20 aa, Mycobacterium
RYVLTLPVMGTIEAGARTPS

SEQ ID NO: 1067504 - protein, 20 aa, Mycobacterium
RYVMMVLRHIPRSIFRKLPI

SEQ ID NO: 1067505 - protein, 31 aa, Mycobacterium
SAAEAYVIAYLPYLGWLRQASVDSAVMAAHY

SEQ ID NO: 1067506 - protein, 28 aa, Mycobacterium
SAAGVLELVWTTGLIRWEDDPQPGWYDT

SEQ ID NO: 1067507 - protein, 22 aa, Mycobacterium
SACIYGKFLRNPSNWLAIIVTQ

SEQ ID NO: 1067508 - protein, 30 aa, Mycobacterium
SADFSDQFPAPVKLWTIADLGGWSTVDPQL

SEQ ID NO: 1067509 - protein, 22 aa, Mycobacterium
SADPVIFLKPNTAIIGPNVPIR

SEQ ID NO: 1067510 - protein, 26 aa, Mycobacterium
SAEALGGGWFWPAAAAHPSLPRGALL

SEQ ID NO: 1067511 - protein, 25 aa, Mycobacterium
SAEEKLYTRRPYPPFMTSTLQQEAG

SEQ ID NO: 1067512 - protein, 18 aa, Mycobacterium
SAGDFVRWCRQVLDLLDQ

SEQ ID NO: 1067513 - protein, 24 aa, Mycobacterium
SAGVNPRRYLAELRLDHPDAAAEY

SEQ ID NO: 1067514 - protein, 29 aa, Mycobacterium
SAGYADVAILAYAAKFSSAFYGPFREAVS

SEQ ID NO: 1067515 - protein, 21 aa, Mycobacterium
SAGYRLIALFVSACSAPGYIR

SEQ ID NO: 1067516 - protein, 22 aa, Mycobacterium
SAIGPKLPELWGGSADLAGSNN

SEQ ID NO: 1067517 - protein, 28 aa, Mycobacterium
SAKGREMLFPLICRYALAYHVVFIPSVE

SEQ ID NO: 1067518 - protein, 26 aa, Mycobacterium
SAKRITAVIPFYPYARQDKKHRGREP

SEQ ID NO: 1067519 - protein, 17 aa, Mycobacterium
SALMSMLDRTESLGMIA

SEQ ID NO: 1067520 - protein, 18 aa, Mycobacterium
SALRRHYRYRLSTAPYGV

SEQ ID NO: 1067521 - protein, 21 aa, Mycobacterium
SALVPSWVAFAVTGLLEQHFG

SEQ ID NO: 1067522 - protein, 25 aa, Mycobacterium
SAMEEALFLTRFARSVTLVHRRDEF

SEQ ID NO: 1067523 - protein, 22 aa, Mycobacterium
SANELLFYEALGLCGPGEEPKL

SEQ ID NO: 1067524 - protein, 23 aa, Mycobacterium
SATCFEWAILDLAILSVGAVTVP

SEQ ID NO: 1067525 - protein, 18 aa, Mycobacterium
SATFNQIADIKPHGLFLS

SEQ ID NO: 1067526 - protein, 25 aa, Mycobacterium
SATSIPVVLVPKTTVIWSCIRDTGD

SEQ ID NO: 1067527 - protein, 18 aa, Mycobacterium
SAVDDLSMALLGTGFAYS

SEQ ID NO: 1067528 - protein, 19 aa, Mycobacterium
SCPQWVLSVTVLGDLDGRA

SEQ ID NO: 1067529 - protein, 26 aa, Mycobacterium
SCYVHPEIEFFLLKAGPEDGSMPIPV

SEQ ID NO: 1067530 - protein, 18 aa, Mycobacterium
SDATTLIHKRAHGVAVVA

SEQ ID NO: 1067531 - protein, 23 aa, Mycobacterium
SDEALARVFDYALAIGKTPIVVN

SEQ ID NO: 1067532 - protein, 17 aa, Mycobacterium
SDEWLHRRFGSFVRLSL

SEQ ID NO: 1067533 - protein, 23 aa, Mycobacterium
SDFGLIKTIFTDPVLLEKPNQAI

SEQ ID NO: 1067534 - protein, 19 aa, Mycobacterium
SDHAAASIWPKLWRPRANG

SEQ ID NO: 1067535 - protein, 20 aa, Mycobacterium
SDIQWRVVSVRRSHDLITVV

SEQ ID NO: 1067536 - protein, 25 aa, Mycobacterium
SDKNPLFLDEQLIRAEFQRITQDLL

SEQ ID NO: 1067537 - protein, 26 aa, Mycobacterium
SDLARFGEWLTIHRAWRSKLPEVVEK

SEQ ID NO: 1067538 - protein, 24 aa, Mycobacterium
SDQDLLLVTVLKGAVIFVTDLARA

SEQ ID NO: 1067539 - protein, 29 aa, Mycobacterium
SDSDMYTLGFRFRPWTKCQAIADGKPILE

SEQ ID NO: 1067540 - protein, 17 aa, Mycobacterium
SDTLFNLNKLNNLVNMF

SEQ ID NO: 1067541 - protein, 23 aa, Mycobacterium
SDTPGLRRLISDLESWLVQITGY

SEQ ID NO: 1067542 - protein, 27 aa, Mycobacterium
SDTTIDPVLAWLYVLDSWEGGLPSARY

SEQ ID NO: 1067543 - protein, 26 aa, Mycobacterium
SDVDDILWQVPYLPIDPRDVGRTYEA

SEQ ID NO: 1067544 - protein, 17 aa, Mycobacterium
SDVLRLAGASMPSSIVV

SEQ ID NO: 1067545 - protein, 19 aa, Mycobacterium
SDWLNYAALDVELLIELRT

SEQ ID NO: 1067546 - protein, 33 aa, Mycobacterium
SEALKSVAAFRLALPRTILRFAGGREITLGDLG

SEQ ID NO: 1067547 - protein, 20 aa, Mycobacterium
SEALRWWPAEALRPKLTVAR

SEQ ID NO: 1067548 - protein, 25 aa, Mycobacterium
SEDVEILRLSALRGLFSTVIEDAVT

SEQ ID NO: 1067549 - protein, 26 aa, Mycobacterium
SEESYLALLDALRWLGLNWDEGPEVG

SEQ ID NO: 1067550 - protein, 23 aa, Mycobacterium
SEFSRHLKLLAKELELPVVAISQ

SEQ ID NO: 1067551 - protein, 24 aa, Mycobacterium
SEGLIGQFGIGFYSSFMVANKVEL

SEQ ID NO: 1067552 - protein, 31 aa, Mycobacterium
SEHGGILLITHYTRILRYIRPEFVHVFVGGR

SEQ ID NO: 1067553 - protein, 23 aa, Mycobacterium
SELGLSYLLPRAVGSSRAFEIML

SEQ ID NO: 1067554 - protein, 20 aa, Mycobacterium
SELRPFYRPGLVHIYHALTW

SEQ ID NO: 1067555 - protein, 25 aa, Mycobacterium
SELTSPISFLQRPARWIQAMATSSH

SEQ ID NO: 1067556 - protein, 18 aa, Mycobacterium
SERNTLWEHWTSGVLNGA

SEQ ID NO: 1067557 - protein, 21 aa, Mycobacterium
SESQLLDWIHLAADAGEPVIL

SEQ ID NO: 1067558 - protein, 30 aa, Mycobacterium
SEVDCPHFDYALAAYYLILPSEVSSNLARF

SEQ ID NO: 1067559 - protein, 18 aa, Mycobacterium
SFATYFNAFPASYWRRWT

SEQ ID NO: 1067560 - protein, 28 aa, Mycobacterium
SFETARFIKFIITEIFPGGRLPSTKMMV

SEQ ID NO: 1067561 - protein, 21 aa, Mycobacterium
SFIDFTPLPELVELQRAVYLG

SEQ ID NO: 1067562 - protein, 18 aa, Mycobacterium
SFLDGLAVHRRAQGLPAM

SEQ ID NO: 1067563 - protein, 21 aa, Mycobacterium
SFTHLLGYALVQAVKKFPNIN

SEQ ID NO: 1067564 - protein, 19 aa, Mycobacterium
SFWSFAFGSGDFTPDTVDE

SEQ ID NO: 1067565 - protein, 28 aa, Mycobacterium
SGAGKLEQWTLLARARALDSMSYVAAVG

SEQ ID NO: 1067566 - protein, 25 aa, Mycobacterium
SGALKHFFDTVYYPILDHVSGRPYG

SEQ ID NO: 1067567 - protein, 19 aa, Mycobacterium
SGDAWLADRSWSRPAWTID

SEQ ID NO: 1067568 - protein, 24 aa, Mycobacterium
SGDNLAFDVWGRCLVWCPSGYQGV

SEQ ID NO: 1067569 - protein, 21 aa, Mycobacterium
SGDVLMVAWMDDQALARTLET

SEQ ID NO: 1067570 - protein, 24 aa, Mycobacterium
SGDYVVLQRIPPVEFGPADWYSTM

SEQ ID NO: 1067571 - protein, 25 aa, Mycobacterium
SGEPSWPTPWGRGRPGWHLECSAMA

SEQ ID NO: 1067572 - protein, 17 aa, Mycobacterium
SGEQNLILFGRLYGLSK

SEQ ID NO: 1067573 - protein, 29 aa, Mycobacterium
SGEQRLSGFLLWQSAYSEMWFTETHWPAF

SEQ ID NO: 1067574 - protein, 19 aa, Mycobacterium
SGFDVVITTALVPGKPAPR

SEQ ID NO: 1067575 - protein, 28 aa, Mycobacterium
SGFVVNALLVPYLLSAIRIVEAGFATVE

SEQ ID NO: 1067576 - protein, 32 aa, Mycobacterium
SGGEKSLIAVAMLVAIFKARPSPFYIMDEVEA

SEQ ID NO: 1067577 - protein, 19 aa, Mycobacterium
SGGHLFSIYDGCRSESIRL

SEQ ID NO: 1067578 - protein, 19 aa, Mycobacterium
SGHFGFVVGINRTGRVDQA

SEQ ID NO: 1067579 - protein, 24 aa, Mycobacterium
SGHYSFLNVFKLFGPGNQAPLSFP

SEQ ID NO: 1067580 - protein, 17 aa, Mycobacterium
SGIAIERSKQIFEINIE

SEQ ID NO: 1067581 - protein, 18 aa, Mycobacterium
SGLIQVDAPIKPGDSGGP

SEQ ID NO: 1067582 - protein, 19 aa, Mycobacterium
SGLRLRLPITTTLGTYRTA

SEQ ID NO: 1067583 - protein, 17 aa, Mycobacterium
SGLVPPVNRFRGDLTVR

SEQ ID NO: 1067584 - protein, 24 aa, Mycobacterium
SGMAAVHQAILGDRMRLALDAELS

SEQ ID NO: 1067585 - protein, 20 aa, Mycobacterium
SGMLAALYVLAALGEQQRPL

SEQ ID NO: 1067586 - protein, 26 aa, Mycobacterium
SGNVPVTWILHLYVVPPGAGRVGVRH

SEQ ID NO: 1067587 - protein, 24 aa, Mycobacterium
SGPGPLLVALMALGVLSLLTGNYT

SEQ ID NO: 1067588 - protein, 25 aa, Mycobacterium
SGQAGALRLGIARALILASPEDRPA

SEQ ID NO: 1067589 - protein, 25 aa, Mycobacterium
SGQRFAGMLVAGAFLREFVADGVDW

SEQ ID NO: 1067590 - protein, 28 aa, Mycobacterium
SGRAESVQQIWFGLSTLVERVSATIRIA

SEQ ID NO: 1067591 - protein, 18 aa, Mycobacterium
SGSLLYAHWLPNRRFYSS

SEQ ID NO: 1067592 - protein, 23 aa, Mycobacterium
SGTLTYQMMFELSDFGFSTAIGI

SEQ ID NO: 1067593 - protein, 22 aa, Mycobacterium
SGTRLYPITLGISKQLLPVYDK

SEQ ID NO: 1067594 - protein, 27 aa, Mycobacterium
SGVAFDILRRWLMARGYDVAFIRNVTD

SEQ ID NO: 1067595 - protein, 22 aa, Mycobacterium
SGVAVIYLDDTVFSKLRGAMGR

SEQ ID NO: 1067596 - protein, 26 aa, Mycobacterium
SGYENIIIRGLFLGQTRKQMLGKVDE

SEQ ID NO: 1067597 - protein, 23 aa, Mycobacterium
SGYRRFTAYDCARLRFILTAQRD

SEQ ID NO: 1067598 - protein, 29 aa, Mycobacterium
SGYVEILPTPFLPADVFDLWGLPADDPRR

SEQ ID NO: 1067599 - protein, 17 aa, Mycobacterium
SHANEFVMLIADNHWRV

SEQ ID NO: 1067600 - protein, 27 aa, Mycobacterium
SIEDLLSVPAIKLLIRKSGARSADMAA

SEQ ID NO: 1067601 - protein, 21 aa, Mycobacterium
SIFGFGFFALAQRIGVFMNLL

SEQ ID NO: 1067602 - protein, 22 aa, Mycobacterium
SIGAILAIPGIRGALRTTTAPV

SEQ ID NO: 1067603 - protein, 25 aa, Mycobacterium
SIIANRVSYFYDFRGPSVTIDTACS

SEQ ID NO: 1067604 - protein, 22 aa, Mycobacterium
SIMGIGFPPWTGGSAQFIAGYS

SEQ ID NO: 1067605 - protein, 21 aa, Mycobacterium
SIPMVYRYRNTYDSWLWELPA

SEQ ID NO: 1067606 - protein, 24 aa, Mycobacterium
SISRKYVEYLSGKVSRFEQTKDIG

SEQ ID NO: 1067607 - protein, 24 aa, Mycobacterium
SKEIRDLIAYLRVLDNPGDAVSMR

SEQ ID NO: 1067608 - protein, 17 aa, Mycobacterium
SKLFSILRRRTPNGAVS

SEQ ID NO: 1067609 - protein, 25 aa, Mycobacterium
SKLGWGWARFAFTSWKTLSWVDANV

SEQ ID NO: 1067610 - protein, 18 aa, Mycobacterium
SKRLLGKHLPRSNCLPLN

SEQ ID NO: 1067611 - protein, 23 aa, Mycobacterium
SLADLRRLLDVVPGILIVDEAYG

SEQ ID NO: 1067612 - protein, 17 aa, Mycobacterium
SLARCTRLPSGLRTVAR

SEQ ID NO: 1067613 - protein, 22 aa, Mycobacterium
SLARLPLILSDGHLRELALTGK

SEQ ID NO: 1067614 - protein, 24 aa, Mycobacterium
SLARPEVIAILDAEGLLPAITFVF

SEQ ID NO: 1067615 - protein, 18 aa, Mycobacterium
SLATMLCVLTTDAVVEPA

SEQ ID NO: 1067616 - protein, 25 aa, Mycobacterium
SLDEAKPLLGKPTAWLFGSEPHGLS

SEQ ID NO: 1067617 - protein, 27 aa, Mycobacterium
SLELMHDLVVFLVLYGGLDSSRPWKDE

SEQ ID NO: 1067618 - protein, 25 aa, Mycobacterium
SLFGQQLRYDLSVGFPLVTTKKVHF

SEQ ID NO: 1067619 - protein, 20 aa, Mycobacterium
SLGLVQLTRKRLGTGLVEAF

SEQ ID NO: 1067620 - protein, 32 aa, Mycobacterium
SLKEIRHWLQIFVQRFYSFSQFKRSALPNGPK

SEQ ID NO: 1067621 - protein, 18 aa, Mycobacterium
SLKFAQLMSQITRYAPEF

SEQ ID NO: 1067622 - protein, 17 aa, Mycobacterium
SLLDINVFGRRSGIAAA

SEQ ID NO: 1067623 - protein, 28 aa, Mycobacterium
SLLGLDRPIELRLLEIEPALKALEGVVM

SEQ ID NO: 1067624 - protein, 17 aa, Mycobacterium
SLPFEHARPTAIMTLMR

SEQ ID NO: 1067625 - protein, 29 aa, Mycobacterium
SLPQLPRTALIDILLRRIPRTHSGATLPR

SEQ ID NO: 1067626 - protein, 25 aa, Mycobacterium
SLQPIWFGRGHMYEGLAWFDSIFEH

SEQ ID NO: 1067627 - protein, 20 aa, Mycobacterium
SLRKRLGIHPVYKTVDTCAA

SEQ ID NO: 1067628 - protein, 20 aa, Mycobacterium
SLSAALPPAALWGREAYIRG

SEQ ID NO: 1067629 - protein, 18 aa, Mycobacterium
SLSRNHVVMLRQPGIENS

SEQ ID NO: 1067630 - protein, 25 aa, Mycobacterium
SLTDWIGVISMPFGVPATPTTMRCY

SEQ ID NO: 1067631 - protein, 21 aa, Mycobacterium
SLTLAAYPHFFELKRTRTEPP

SEQ ID NO: 1067632 - protein, 20 aa, Mycobacterium
SLTVHLLVDGVVRRQNWSDW

SEQ ID NO: 1067633 - protein, 19 aa, Mycobacterium
SLVAVWWQRVRRGQFGQVV

SEQ ID NO: 1067634 - protein, 21 aa, Mycobacterium
SLVENFLRMTFGLPAEPYEPD

SEQ ID NO: 1067635 - protein, 19 aa, Mycobacterium
SLVGPHYLGLVRQSSQRCA

SEQ ID NO: 1067636 - protein, 21 aa, Mycobacterium
SLVRRSLQFSTLTAAELMTPR

SEQ ID NO: 1067637 - protein, 17 aa, Mycobacterium
SLYKVLTLKYKVFTRSS

SEQ ID NO: 1067638 - protein, 19 aa, Mycobacterium
SMLMLIDGITYDTPFNLLK

SEQ ID NO: 1067639 - protein, 19 aa, Mycobacterium
SMRAGLQALAWIAHGGTHD

SEQ ID NO: 1067640 - protein, 18 aa, Mycobacterium
SNAGNVEFYAVFDGVVQH

SEQ ID NO: 1067641 - protein, 23 aa, Mycobacterium
SNALSLYRAWDDATLRIVSKAKA

SEQ ID NO: 1067642 - protein, 18 aa, Mycobacterium
SNDDMFFGRPLKASMFFS

SEQ ID NO: 1067643 - protein, 22 aa, Mycobacterium
SNEFFKLWLDPSMTYSCAYFER

SEQ ID NO: 1067644 - protein, 38 aa, Mycobacterium
SNLPKVFFVNWFRRGEGGKFLWPGFGENSRVLKWIVDR

SEQ ID NO: 1067645 - protein, 26 aa, Mycobacterium
SNREKIPYILRFLEAERLSPRTATTL

SEQ ID NO: 1067646 - protein, 24 aa, Mycobacterium
SNVVFQLLRYPPTTADLSLPVFHP

SEQ ID NO: 1067647 - protein, 26 aa, Mycobacterium
SPAEVLTLDILLRRGKTVRPKTLNQK

SEQ ID NO: 1067648 - protein, 27 aa, Mycobacterium
SPDLDTDWLYDGWLTLFCKWIDDAERA

SEQ ID NO: 1067649 - protein, 23 aa, Mycobacterium
SPDLVQLLLACLARGIMAFLANP

SEQ ID NO: 1067650 - protein, 24 aa, Mycobacterium
SPEGKSHRFAYPPNLYVVDGGAPQ

SEQ ID NO: 1067651 - protein, 25 aa, Mycobacterium
SPFDAYLTMRGLKTLVLRMQRHNEN

SEQ ID NO: 1067652 - protein, 24 aa, Mycobacterium
SPFGNPIPGLLDLGAGPDASAANA

SEQ ID NO: 1067653 - protein, 24 aa, Mycobacterium
SPKETWLRLWLIDVNLPVSTGQPV

SEQ ID NO: 1067654 - protein, 29 aa, Mycobacterium
SPLSATHIGGLWWILNCLMHGGLCITGGE

SEQ ID NO: 1067655 - protein, 17 aa, Mycobacterium
SPLSMISALALTPVFHG

SEQ ID NO: 1067656 - protein, 23 aa, Mycobacterium
SPPVYPPFYAFVTHDGRRVLEAP

SEQ ID NO: 1067657 - protein, 19 aa, Mycobacterium
SPRRVWPHEAVPAVQPVIA

SEQ ID NO: 1067658 - protein, 17 aa, Mycobacterium
SPVLKIFPSQKLALHLA

SEQ ID NO: 1067659 - protein, 25 aa, Mycobacterium
SPVPQRSFRWIPEDQLRIYYDNPRV

SEQ ID NO: 1067660 - protein, 20 aa, Mycobacterium
SQHAWTFRPGAALDAELCTE

SEQ ID NO: 1067661 - protein, 25 aa, Mycobacterium
SQIVYAAGAVLWRPGNSDPAVEIAV

SEQ ID NO: 1067662 - protein, 31 aa, Mycobacterium
SQLGWDLELVGRIGWTCRDVWWAATQDPRSW

SEQ ID NO: 1067663 - protein, 25 aa, Mycobacterium
SQLHAKLFYQPLLESIGPASLEIRH

SEQ ID NO: 1067664 - protein, 17 aa, Mycobacterium
SQRLATRLQRYRRIGLP

SEQ ID NO: 1067665 - protein, 23 aa, Mycobacterium
SQSRVMLPGWYGTGSAFQQWVAA

SEQ ID NO: 1067666 - protein, 21 aa, Mycobacterium
SQVLRVLDTWGQDPGDLAKLS

SEQ ID NO: 1067667 - protein, 19 aa, Mycobacterium
SQVLVFKDLGLVSQVFDEQ

SEQ ID NO: 1067668 - protein, 20 aa, Mycobacterium
SQYYNFLWLGRNGYWKVMQA

SEQ ID NO: 1067669 - protein, 20 aa, Mycobacterium
SRAPRWAIAYKYLPEEAQTK

SEQ ID NO: 1067670 - protein, 26 aa, Mycobacterium
SRAVGDGFARYWLHNGWVTMGGEKMS

SEQ ID NO: 1067671 - protein, 30 aa, Mycobacterium
SRDALDRVLIDLATYFRDALLVSANAGSVQ

SEQ ID NO: 1067672 - protein, 17 aa, Mycobacterium
SRFDVIVTDNLFGDIIT

SEQ ID NO: 1067673 - protein, 20 aa, Mycobacterium
SRGIAQIEELLLAAAADPTT

SEQ ID NO: 1067674 - protein, 18 aa, Mycobacterium
SRGLRVALAENMLWRFGT

SEQ ID NO: 1067675 - protein, 22 aa, Mycobacterium
SRLALWGRRLFGETVTQAQYPL

SEQ ID NO: 1067676 - protein, 19 aa, Mycobacterium
SRLISKAAWEFWRKPPPRP

SEQ ID NO: 1067677 - protein, 30 aa, Mycobacterium
SRMRNSGMPVLFWLDPYRPHENELIKKVRA

SEQ ID NO: 1067678 - protein, 24 aa, Mycobacterium
SRNEYVVGWIKRGPTGVIGTNKKD

SEQ ID NO: 1067679 - protein, 21 aa, Mycobacterium
SRTHPNLVRKLFSLEVPEIAD

SEQ ID NO: 1067680 - protein, 22 aa, Mycobacterium
SRTWLLVATGLMQLVEAVATGA

SEQ ID NO: 1067681 - protein, 28 aa, Mycobacterium
SSALRLIYTHEKIWRPKVFTISATEGTG

SEQ ID NO: 1067682 - protein, 21 aa, Mycobacterium
SSANLAVLRTPPGAADYLASA

SEQ ID NO: 1067683 - protein, 29 aa, Mycobacterium
SSARMGFRDFLLHPVMMDIALQTLGATRM

SEQ ID NO: 1067684 - protein, 33 aa, Mycobacterium
SSASFGTLWIKSPANMLGYWNNPERTREILVDG

SEQ ID NO: 1067685 - protein, 25 aa, Mycobacterium
SSEPLTEAIPLWKRPQDGAIITGWD

SEQ ID NO: 1067686 - protein, 21 aa, Mycobacterium
SSFVDLLRRQAPELLPVSLGG

SEQ ID NO: 1067687 - protein, 23 aa, Mycobacterium
SSGGAVPVVPWVVSAKSGSALGA

SEQ ID NO: 1067688 - protein, 23 aa, Mycobacterium
SSKQKWEMALLPLPDSPTRFPAE

SEQ ID NO: 1067689 - protein, 22 aa, Mycobacterium
SSLAFDTIFAEGQRRYVESLSA

SEQ ID NO: 1067690 - protein, 22 aa, Mycobacterium
SSLYTAIPFAQKPSVLMIGERT

SEQ ID NO: 1067691 - protein, 24 aa, Mycobacterium
SSNEYVVGWIKRGPTGVIGTNKKD

SEQ ID NO: 1067692 - protein, 22 aa, Mycobacterium
SSNFMLWQAAYTEYIFQDKLWP

SEQ ID NO: 1067693 - protein, 23 aa, Mycobacterium
SSNLARFDAMRYGLRVGDDGSRS

SEQ ID NO: 1067694 - protein, 24 aa, Mycobacterium
SSPVRLALGLLIGDAFAVGRATLP

SEQ ID NO: 1067695 - protein, 17 aa, Mycobacterium
SSRAYVSAFGFKGPDQQ

SEQ ID NO: 1067696 - protein, 23 aa, Mycobacterium
SSRRGKPTIPAWEDVLLGVRSAG

SEQ ID NO: 1067697 - protein, 17 aa, Mycobacterium
SSTIVFANSLRTAERLT

SEQ ID NO: 1067698 - protein, 28 aa, Mycobacterium
SSVKDKYKWSYRTWAKQVTRVLVAIENA

SEQ ID NO: 1067699 - protein, 28 aa, Mycobacterium
SSVLLSPMSFLRRPACWMQLLATTQACF

SEQ ID NO: 1067700 - protein, 18 aa, Mycobacterium
SSYATGIAFLPQSSKDAA

SEQ ID NO: 1067701 - protein, 26 aa, Mycobacterium
STAIADQLARRRLGYGRGARMAFERD

SEQ ID NO: 1067702 - protein, 34 aa, Mycobacterium
STDEPLSALAFKVATHPFFGKLTYVRVYSGKVDS

SEQ ID NO: 1067703 - protein, 19 aa, Mycobacterium
STETLLGHPLIGNGGMKGN

SEQ ID NO: 1067704 - protein, 29 aa, Mycobacterium
STHNEPMIPIYIFYSMFGFQRTGDGLWAA

SEQ ID NO: 1067705 - protein, 25 aa, Mycobacterium
STIYGYGIVLALSPPNANSLVVDAL

SEQ ID NO: 1067706 - protein, 17 aa, Mycobacterium
STLGYKGYPKSCCTSLN

SEQ ID NO: 1067707 - protein, 18 aa, Mycobacterium
STLILPADVSWSDGAIPA

SEQ ID NO: 1067708 - protein, 23 aa, Mycobacterium
STNNGLVEILPLGISKATGVEEV

SEQ ID NO: 1067709 - protein, 22 aa, Mycobacterium
STRSSVRWYFFGRVSVIADYAE

SEQ ID NO: 1067710 - protein, 23 aa, Mycobacterium
STSIFFLHAVLDDPNFQAGRLTT

SEQ ID NO: 1067711 - protein, 28 aa, Mycobacterium
STSSHCRPRWPWSVPVRSAPSTFRCLPR

SEQ ID NO: 1067712 - protein, 28 aa, Mycobacterium
STTISHLLLDCELLEPLRARLADGLPAY

SEQ ID NO: 1067713 - protein, 21 aa, Mycobacterium
STTWLKLKAVPMLGISVLGEV

SEQ ID NO: 1067714 - protein, 25 aa, Mycobacterium
STVKALQLVWTYRRSRWPWEPGFND

SEQ ID NO: 1067715 - protein, 17 aa, Mycobacterium
STVVGIGLPLTRSLLSR

SEQ ID NO: 1067716 - protein, 22 aa, Mycobacterium
SVAAFSVRLLESGRLELTPSLS

SEQ ID NO: 1067717 - protein, 29 aa, Mycobacterium
SVAAGLTPLRPWRSALVEALAVSRSLPVD

SEQ ID NO: 1067718 - protein, 24 aa, Mycobacterium
SVADKLMSALTGLGLVAFGVEGED

SEQ ID NO: 1067719 - protein, 20 aa, Mycobacterium
SVAQLELLLPAMAGLVASLT

SEQ ID NO: 1067720 - protein, 23 aa, Mycobacterium
SVAVLVTRLGRPPRRNAQCAQST

SEQ ID NO: 1067721 - protein, 21 aa, Mycobacterium
SVDHCIIAADFLKAVGFVVVA

SEQ ID NO: 1067722 - protein, 21 aa, Mycobacterium
SVDRLRWRGYLQPGSRDDASE

SEQ ID NO: 1067723 - protein, 19 aa, Mycobacterium
SVEDTYRASRNQLPHGFLD

SEQ ID NO: 1067724 - protein, 27 aa, Mycobacterium
SVHAIKALWDIILPFADYAFNKSHAAG

SEQ ID NO: 1067725 - protein, 24 aa, Mycobacterium
SVHCVYKPVSGEQPLWDFPEGTLA

SEQ ID NO: 1067726 - protein, 26 aa, Mycobacterium
SVIREAGATPSFLRYHGYPATICTSV

SEQ ID NO: 1067727 - protein, 25 aa, Mycobacterium
SVLFGRAHVVFARLVVPTSDLLALH

SEQ ID NO: 1067728 - protein, 18 aa, Mycobacterium
SVLICAASFPYRPVQQRA

SEQ ID NO: 1067729 - protein, 17 aa, Mycobacterium
SVLPTCEGLTIVVTGSL

SEQ ID NO: 1067730 - protein, 21 aa, Mycobacterium
SVLTPTFRYNPAVIGQAFATM

SEQ ID NO: 1067731 - protein, 22 aa, Mycobacterium
SVMPHLVSLPGYPFARQRHWVE

SEQ ID NO: 1067732 - protein, 23 aa, Mycobacterium
SVNGYAITLPLKEFDLLEYLMRN

SEQ ID NO: 1067733 - protein, 18 aa, Mycobacterium
SVPARRLAPSLTGIDGSG

SEQ ID NO: 1067734 - protein, 18 aa, Mycobacterium
SVPILIRHRVGSTCIPVG

SEQ ID NO: 1067735 - protein, 22 aa, Mycobacterium
SVPQRLWAKPAITVIGIDTTSV

SEQ ID NO: 1067736 - protein, 21 aa, Mycobacterium
SVQWLEQHLAGYAGAVLAVTH

SEQ ID NO: 1067737 - protein, 20 aa, Mycobacterium
SVRAYLKQIGKVALLNAEEE

SEQ ID NO: 1067738 - protein, 21 aa, Mycobacterium
SVREVTGVPILFATTGEKLDD

SEQ ID NO: 1067739 - protein, 17 aa, Mycobacterium
SVRGLAREIACAYDLAF

SEQ ID NO: 1067740 - protein, 24 aa, Mycobacterium
SVRNLPGVHLLSPDQLNTYDVLRA

SEQ ID NO: 1067741 - protein, 23 aa, Mycobacterium
SVRTRLIELFELFDPDDPNVIVG

SEQ ID NO: 1067742 - protein, 18 aa, Mycobacterium
SVRWWSNFVHAKDKMMER

SEQ ID NO: 1067743 - protein, 28 aa, Mycobacterium
SVSRARFGDVLPFLVKVLAADEPLSLQA

SEQ ID NO: 1067744 - protein, 20 aa, Mycobacterium
SVSVIRYTQLRPFVLHVNHT

SEQ ID NO: 1067745 - protein, 24 aa, Mycobacterium
SVVTTLLRSLLLMSEALAGDNVRV

SEQ ID NO: 1067746 - protein, 17 aa, Mycobacterium
SVYAWAYNLNKGTKTRI

SEQ ID NO: 1067747 - protein, 17 aa, Mycobacterium
SWKLLRGRVSLPSRTQL

SEQ ID NO: 1067748 - protein, 17 aa, Mycobacterium
SYAIMGHPKYRVISGAI

SEQ ID NO: 1067749 - protein, 23 aa, Mycobacterium
SYALLTHMMAAQSGLLVGEFVWT

SEQ ID NO: 1067750 - protein, 19 aa, Mycobacterium
SYALYPHMTVRQNIAFPLM

SEQ ID NO: 1067751 - protein, 26 aa, Mycobacterium
SYASLAKALLLIMNSGGSIVGMDFDP

SEQ ID NO: 1067752 - protein, 25 aa, Mycobacterium
SYCAQFNDTLKMYEDAHRTLGESLH

SEQ ID NO: 1067753 - protein, 17 aa, Mycobacterium
SYQLLTNVSRLFAERCI

SEQ ID NO: 1067754 - protein, 22 aa, Mycobacterium
SYYDQMLDTAFMLGALPARVAQ

SEQ ID NO: 1067755 - protein, 20 aa, Mycobacterium
TAAGFGIRYFGKVPAMIFDS

SEQ ID NO: 1067756 - protein, 21 aa, Mycobacterium
TAALLVLRAAVAALTSMTTFA

SEQ ID NO: 1067757 - protein, 22 aa, Mycobacterium
TAAPLDRRLLLGMLAELPAGVG

SEQ ID NO: 1067758 - protein, 19 aa, Mycobacterium
TADMRVLFDAIINDDPLPL

SEQ ID NO: 1067759 - protein, 25 aa, Mycobacterium
TADQLDMPVIFREVSLRQTLEADRV

SEQ ID NO: 1067760 - protein, 23 aa, Mycobacterium
TADVGLIIAVKRLAAAKTRLGPV

SEQ ID NO: 1067761 - protein, 21 aa, Mycobacterium
TAFCGCDVLVWLTAIAFKHSD

SEQ ID NO: 1067762 - protein, 17 aa, Mycobacterium
TAGDLLERLAVSGATLL

SEQ ID NO: 1067763 - protein, 27 aa, Mycobacterium
TAGYLARRAGRIPKRFWAQASSPELMR

SEQ ID NO: 1067764 - protein, 26 aa, Mycobacterium
TAHTGTPWRVGFNGFAPGFAYLVDGD

SEQ ID NO: 1067765 - protein, 22 aa, Mycobacterium
TAILVEMLVELSAGAWEEPHAV

SEQ ID NO: 1067766 - protein, 23 aa, Mycobacterium
TAKDIILALIAKIGTGGGQGYVL

SEQ ID NO: 1067767 - protein, 34 aa, Mycobacterium
TALFDRFGVDLPPLEGIYLAAFAGRPVLLSDMTD

SEQ ID NO: 1067768 - protein, 22 aa, Mycobacterium
TALLRVERRFQTVVALLEEGVI

SEQ ID NO: 1067769 - protein, 17 aa, Mycobacterium
TALSAALLRLPVANWSI

SEQ ID NO: 1067770 - protein, 35 aa, Mycobacterium
TALVANLPYNVAVPALLHLLAEFPSIRTVTVMVQA

SEQ ID NO: 1067771 - protein, 19 aa, Mycobacterium
TAMMTPVFMVLRSPTGELL

SEQ ID NO: 1067772 - protein, 20 aa, Mycobacterium
TAPLIPLVVSSFLTSRKKAA

SEQ ID NO: 1067773 - protein, 19 aa, Mycobacterium
TAQEISARVLMKLKRDAEA

SEQ ID NO: 1067774 - protein, 20 aa, Mycobacterium
TARCELVGLTLNLPTSEQAA

SEQ ID NO: 1067775 - protein, 28 aa, Mycobacterium
TARLAAPLLPLITEIIWRSVTGGRSVHL

SEQ ID NO: 1067776 - protein, 18 aa, Mycobacterium
TARTSFALLGNGAMMIGK

SEQ ID NO: 1067777 - protein, 21 aa, Mycobacterium
TASPWLVSPIRNPGQYEVIYD

SEQ ID NO: 1067778 - protein, 24 aa, Mycobacterium
TATLLTARCPIMFAPAMHTEMWLH

SEQ ID NO: 1067779 - protein, 25 aa, Mycobacterium
TATRYHSLTILPESLPPVLEVVART

SEQ ID NO: 1067780 - protein, 20 aa, Mycobacterium
TATYDGFAIRPLYTVFDELP

SEQ ID NO: 1067781 - protein, 20 aa, Mycobacterium
TATYLVRMLRDMPGLTVTRI

SEQ ID NO: 1067782 - protein, 18 aa, Mycobacterium
TAVEIDLPMAQRLQDLYG

SEQ ID NO: 1067783 - protein, 34 aa, Mycobacterium
TAVLLSPMAFLQRPARWMQLLGKYRGQISCAPNF

SEQ ID NO: 1067784 - protein, 22 aa, Mycobacterium
TAYAWRTILARGANSGPVGLIL

SEQ ID NO: 1067785 - protein, 22 aa, Mycobacterium
TCHFVRPNWKLPRRAPADAKAD

SEQ ID NO: 1067786 - protein, 19 aa, Mycobacterium
TCRLIDRPLRPSFVDGLRN

SEQ ID NO: 1067787 - protein, 18 aa, Mycobacterium
TCVRILRNQASLIGGLNS

SEQ ID NO: 1067788 - protein, 18 aa, Mycobacterium
TDAAIPVPSLFIAGAANP

SEQ ID NO: 1067789 - protein, 19 aa, Mycobacterium
TDAGTGLSFVPWVISAKSA

SEQ ID NO: 1067790 - protein, 23 aa, Mycobacterium
TDDFIAYIRRLGPQLGLEETTAF

SEQ ID NO: 1067791 - protein, 22 aa, Mycobacterium
TDDPPHPLLTRLRRRLNDIYAG

SEQ ID NO: 1067792 - protein, 23 aa, Mycobacterium
TDEYTAHWYGRTLHFGVREHAMG

SEQ ID NO: 1067793 - protein, 28 aa, Mycobacterium
TDFESYPQWHEWIKGVWVLAHYDDGRPS

SEQ ID NO: 1067794 - protein, 21 aa, Mycobacterium
TDFQRLQRELSSTGAADPGQL

SEQ ID NO: 1067795 - protein, 31 aa, Mycobacterium
TDGRWSCVRWGALTPPFYPHLHRPDSTLVTD

SEQ ID NO: 1067796 - protein, 22 aa, Mycobacterium
TDGVLPPELLFGHPGYVRTDHG

SEQ ID NO: 1067797 - protein, 22 aa, Mycobacterium
TDHDIFPITVLDNLRRCIGDRR

SEQ ID NO: 1067798 - protein, 21 aa, Mycobacterium
TDITPYWRPASWAAGVVVVDA

SEQ ID NO: 1067799 - protein, 21 aa, Mycobacterium
TDPIRRIAVFLVKTVLASPMS

SEQ ID NO: 1067800 - protein, 24 aa, Mycobacterium
TDPRKIFDLLEHAPIDVAVLTNAD

SEQ ID NO: 1067801 - protein, 22 aa, Mycobacterium
TDPYTVAPLLPYSGVTGRSRCT

SEQ ID NO: 1067802 - protein, 29 aa, Mycobacterium
TDQLLVDASLRLVATRLCWADQPKADLAA

SEQ ID NO: 1067803 - protein, 25 aa, Mycobacterium
TDRQSMLFSATMPDPIITLARTFMD

SEQ ID NO: 1067804 - protein, 18 aa, Mycobacterium
TDWPRLVAPVFDVKKAVV

SEQ ID NO: 1067805 - protein, 19 aa, Mycobacterium
TDWPRYGGYALAGVSSFGF

SEQ ID NO: 1067806 - protein, 19 aa, Mycobacterium
TDYLRLFGSWIGGSVCCFL

SEQ ID NO: 1067807 - protein, 23 aa, Mycobacterium
TEALAYLVVVGIGSRLATEWLDG

SEQ ID NO: 1067808 - protein, 18 aa, Mycobacterium
TEERLRAGVWLRDYLEQL

SEQ ID NO: 1067809 - protein, 20 aa, Mycobacterium
TEFYADLLGSYPLVSIEDPL

SEQ ID NO: 1067810 - protein, 21 aa, Mycobacterium
TEHQPSRATMLALRDPLRRRG

SEQ ID NO: 1067811 - protein, 17 aa, Mycobacterium
TELGPGSYLQDIKIRAV

SEQ ID NO: 1067812 - protein, 25 aa, Mycobacterium
TELTDRLFTLEWEPTPLYKEVSRSS

SEQ ID NO: 1067813 - protein, 31 aa, Mycobacterium
TELVNYVRGMLYFRTKRWPDVLTQFPEGKQW

SEQ ID NO: 1067814 - protein, 22 aa, Mycobacterium
TEPKARALRPYAEKLITHAKKG

SEQ ID NO: 1067815 - protein, 34 aa, Mycobacterium
TESFRFNRSPLLTVYWLLGGFLRKRRNIRDMTKT

SEQ ID NO: 1067816 - protein, 25 aa, Mycobacterium
TETERLLRDRLAQLRPGDSILGEEG

SEQ ID NO: 1067817 - protein, 18 aa, Mycobacterium
TFANIRLRNMLLNGVAGG

SEQ ID NO: 1067818 - protein, 24 aa, Mycobacterium
TFDRIVGLLIERDFIRGPADDPQV

SEQ ID NO: 1067819 - protein, 19 aa, Mycobacterium
TFQAPLILSARNFGLVSFA

SEQ ID NO: 1067820 - protein, 34 aa, Mycobacterium
TFSTTDVEFYKWTQWIFLQIYNAWFDVAANKARP

SEQ ID NO: 1067821 - protein, 26 aa, Mycobacterium
TFTGRSWPLADVRLLAPMLASKVVCI

SEQ ID NO: 1067822 - protein, 33 aa, Mycobacterium
TGAGTFYTLRCYLDDHPIFLGRNGRISVFSSER

SEQ ID NO: 1067823 - protein, 23 aa, Mycobacterium
TGAPLDFFIAVVARTAPARAAYI

SEQ ID NO: 1067824 - protein, 17 aa, Mycobacterium
TGAPLLSYGTPKSPIVR

SEQ ID NO: 1067825 - protein, 22 aa, Mycobacterium
TGDLRIRGRIKELINRSGEKIS

SEQ ID NO: 1067826 - protein, 17 aa, Mycobacterium
TGENFTLHLIPSGVLTP

SEQ ID NO: 1067827 - protein, 34 aa, Mycobacterium
TGEPKAVLLPNRTFFAIPDILREKGLAWIDWVVN

SEQ ID NO: 1067828 - protein, 23 aa, Mycobacterium
TGFEDIVAVLALYRPGPMGMNAH

SEQ ID NO: 1067829 - protein, 31 aa, Mycobacterium
TGFLGRYLALKWLERMDLVEGKVIALVRAKS

SEQ ID NO: 1067830 - protein, 23 aa, Mycobacterium
TGILTMLRMFYVESATTLVNKSK

SEQ ID NO: 1067831 - protein, 23 aa, Mycobacterium
TGKDFVAVMRRLAAGDGPVYVVD

SEQ ID NO: 1067832 - protein, 18 aa, Mycobacterium
TGLIYRALGFPTRMFTVL

SEQ ID NO: 1067833 - protein, 21 aa, Mycobacterium
TGLSFVPWVISAKSAEALSAQ

SEQ ID NO: 1067834 - protein, 29 aa, Mycobacterium
TGMGKTFAFGVPLLQRISVTTTARPLSGA

SEQ ID NO: 1067835 - protein, 23 aa, Mycobacterium
TGMGVERIALVLQGVHNVYEIDL

SEQ ID NO: 1067836 - protein, 30 aa, Mycobacterium
TGNILRDYLTDLFPILELGTSAKMLSIVPL

SEQ ID NO: 1067837 - protein, 27 aa, Mycobacterium
TGNKMLAVLFGAWWIGAETLLGPADPT

SEQ ID NO: 1067838 - protein, 26 aa, Mycobacterium
TGQHNWALLNALPELVATGVPILLGA

SEQ ID NO: 1067839 - protein, 26 aa, Mycobacterium
TGRPLPPIIAAIFRKAIGGTVHEVIP

SEQ ID NO: 1067840 - protein, 23 aa, Mycobacterium
TGRPYLVEGVGEDFWPAAYDPMV

SEQ ID NO: 1067841 - protein, 23 aa, Mycobacterium
TGRVTPFAFMTPVKVAGSTVGQA

SEQ ID NO: 1067842 - protein, 17 aa, Mycobacterium
TGTLKQGIDNRNAKKIT

SEQ ID NO: 1067843 - protein, 28 aa, Mycobacterium
TGTLVAADVWLLLSIPADWSNAEAAGMS

SEQ ID NO: 1067844 - protein, 25 aa, Mycobacterium
TGTPQFEIVDPQPLALLPDPDPGDL

SEQ ID NO: 1067845 - protein, 28 aa, Mycobacterium
TGVVRFIGVDGYRWMIRCVVNGPLETID

SEQ ID NO: 1067846 - protein, 20 aa, Mycobacterium
TGWASPRWRNLTGGIVALHA

SEQ ID NO: 1067847 - protein, 17 aa, Mycobacterium
THDRLGGPGSWLLALPP

SEQ ID NO: 1067848 - protein, 20 aa, Mycobacterium
THGLSWGFDRIFAVSANHSV

SEQ ID NO: 1067849 - protein, 24 aa, Mycobacterium
THGRTWDLLRLTRMPTVQIDIGYI

SEQ ID NO: 1067850 - protein, 17 aa, Mycobacterium
THHPLLHPHNESALTLT

SEQ ID NO: 1067851 - protein, 19 aa, Mycobacterium
THLLRIIVIAGPGIRSRWV

SEQ ID NO: 1067852 - protein, 18 aa, Mycobacterium
THNPNLVQPMRLSGPGQQ

SEQ ID NO: 1067853 - protein, 18 aa, Mycobacterium
THQGAAELMRPIARKYDL

SEQ ID NO: 1067854 - protein, 22 aa, Mycobacterium
THSHRIPDFVKLAEALGCVGLR

SEQ ID NO: 1067855 - protein, 27 aa, Mycobacterium
THSNALDIDLYLRIAPELFLKRCIVGG

SEQ ID NO: 1067856 - protein, 24 aa, Mycobacterium
THTIFVLGRPITARAFGAVAREVA

SEQ ID NO: 1067857 - protein, 21 aa, Mycobacterium
THYHKIHLYDAFGFTESRTVT

SEQ ID NO: 1067858 - protein, 30 aa, Mycobacterium
TIAEVVNAFGWTAPLGVTYPGVVTQGVVRT

SEQ ID NO: 1067859 - protein, 23 aa, Mycobacterium
TIARRFAHLTYRSEVELDTRFAN

SEQ ID NO: 1067860 - protein, 18 aa, Mycobacterium
TIDTGAPLRDALRVGHCS

SEQ ID NO: 1067861 - protein, 21 aa, Mycobacterium
TIGDVALVVIPYLSGEPIGPK

SEQ ID NO: 1067862 - protein, 20 aa, Mycobacterium
TIGLPVVQSLLAASDIPMDC

SEQ ID NO: 1067863 - protein, 20 aa, Mycobacterium
TIHEMVLSDSFWDEIFRELS

SEQ ID NO: 1067864 - protein, 21 aa, Mycobacterium
TIIDMWLPLSWLLNMVNRSMG

SEQ ID NO: 1067865 - protein, 20 aa, Mycobacterium
TILFGNASLMVAPLAEVDPD

SEQ ID NO: 1067866 - protein, 19 aa, Mycobacterium
TILHRIRQKLAIEPVAIGS

SEQ ID NO: 1067867 - protein, 18 aa, Mycobacterium
TIVFANSLRTAERLTIQI

SEQ ID NO: 1067868 - protein, 17 aa, Mycobacterium
TIYAVITTTMRQPNEMI

SEQ ID NO: 1067869 - protein, 18 aa, Mycobacterium
TIYGVDKFPRMVDYVVPT

SEQ ID NO: 1067870 - protein, 17 aa, Mycobacterium
TKRLFMGSLAALKLRSL

SEQ ID NO: 1067871 - protein, 28 aa, Mycobacterium
TKSYTAELLTLYLLFGQLSGSDGAHPTQ

SEQ ID NO: 1067872 - protein, 29 aa, Mycobacterium
TLAADGSILDTWFPAPKLTESGTSVTSQL

SEQ ID NO: 1067873 - protein, 23 aa, Mycobacterium
TLAKPITNGLTYNFTFNFEKAGQ

SEQ ID NO: 1067874 - protein, 28 aa, Mycobacterium
TLATITLQNYFRLYDKLAGMTGTAQTEA

SEQ ID NO: 1067875 - protein, 23 aa, Mycobacterium
TLDLSYMESVIWAFKQLWDKGLA

SEQ ID NO: 1067876 - protein, 22 aa, Mycobacterium
TLELIARCVFALVGLDPSTGII

SEQ ID NO: 1067877 - protein, 27 aa, Mycobacterium
TLELLATAAMPGLPPLSSGMVGFFAYD

SEQ ID NO: 1067878 - protein, 19 aa, Mycobacterium
TLGLPATSVAWGLWAGGGM

SEQ ID NO: 1067879 - protein, 20 aa, Mycobacterium
TLGSDRVVFLFPGQGAQHVG

SEQ ID NO: 1067880 - protein, 18 aa, Mycobacterium
TLIARDLDKAYRSVDVLV

SEQ ID NO: 1067881 - protein, 19 aa, Mycobacterium
TLILVPLFHVTGCNSQLLV

SEQ ID NO: 1067882 - protein, 18 aa, Mycobacterium
TLKAVAVKSPFFGDRRKA

SEQ ID NO: 1067883 - protein, 29 aa, Mycobacterium
TLPHPRAHLRAFVLVPWLAVDSDAELTVA

SEQ ID NO: 1067884 - protein, 17 aa, Mycobacterium
TLRMFGLSESGLAETLR

SEQ ID NO: 1067885 - protein, 25 aa, Mycobacterium
TLRRYRPSDAPLCGSLLIGGDGRLV

SEQ ID NO: 1067886 - protein, 30 aa, Mycobacterium; identical to SEQ ID NO: 223542

SEQ ID NO: 1067887 - protein, 23 aa, Mycobacterium
TLVEILHDCPIFNDGSFDALRKE

SEQ ID NO: 1067888 - protein, 24 aa, Mycobacterium
TLVLGCTHYPLLAGLIQLAMGENV

SEQ ID NO: 1067889 - protein, 28 aa, Mycobacterium
TLVRMAQPWSLRYPLVDGQGNFGSPGND

SEQ ID NO: 1067890 - protein, 17 aa, Mycobacterium
TLWLAGPSIPLTHSLRS

SEQ ID NO: 1067891 - protein, 29 aa, Mycobacterium
TLYGPDELALPMRLALPGSVNRGNAAQAV

SEQ ID NO: 1067892 - protein, 26 aa, Mycobacterium
TMEETALWLDLTYAGNVPVVLTGAMR

SEQ ID NO: 1067893 - protein, 27 aa, Mycobacterium
TMGEVRVPAIALWRAQTQRAVENFPIS

SEQ ID NO: 1067894 - protein, 30 aa, Mycobacterium
TMIEQSFVLLPMILPLLTAPLAVATAGAAG

SEQ ID NO: 1067895 - protein, 17 aa, Mycobacterium
TMLALRDPLRRRGKTNT

SEQ ID NO: 1067896 - protein, 18 aa, Mycobacterium
TMPRFWRASMQCTSGCFR

SEQ ID NO: 1067897 - protein, 22 aa, Mycobacterium
TMTVPPLMVFVNRAQACLLIMS

SEQ ID NO: 1067898 - protein, 23 aa, Mycobacterium
TNAAPLVMAAVNLTLNFAAKTVL

SEQ ID NO: 1067899 - protein, 18 aa, Mycobacterium
TNEFLTVMLLPNAIAEIG

SEQ ID NO: 1067900 - protein, 25 aa, Mycobacterium
TNFEGPFDLLLHLICAHRLDVTEVA

SEQ ID NO: 1067901 - protein, 24 aa, Mycobacterium
TNIEALLEAVLLTADAALDLRANS

SEQ ID NO: 1067902 - protein, 18 aa, Mycobacterium
TNLTRALKVWADQGLRVI

SEQ ID NO: 1067903 - protein, 22 aa, Mycobacterium
TNTQLLWYRTDLVDQPPGDWNG

SEQ ID NO: 1067904 - protein, 33 aa, Mycobacterium
TPADAADALALAICHCWRAPMIARMAEAEALGA

SEQ ID NO: 1067905 - protein, 25 aa, Mycobacterium
TPALVEAMLLVRLPYHLSSVTQAAA

SEQ ID NO: 1067906 - protein, 19 aa, Mycobacterium
TPAMIHVDVYRLLDHRDAD

SEQ ID NO: 1067907 - protein, 27 aa, Mycobacterium
TPELMPLPIALAHRLARRLTEVRKNGV

SEQ ID NO: 1067908 - protein, 21 aa, Mycobacterium
TPGLIPDWECLRTKNTAFVER

SEQ ID NO: 1067909 - protein, 18 aa, Mycobacterium
TPGVRYDSTCIFSLDTRD

SEQ ID NO: 1067910 - protein, 25 aa, Mycobacterium
TPIDPRFPTFLATNLSEALPGPFSP

SEQ ID NO: 1067911 - protein, 18 aa, Mycobacterium
TPKVPYYSATLFDPRELP

SEQ ID NO: 1067912 - protein, 17 aa, Mycobacterium
TPLHYPAGGIPNLSVTP

SEQ ID NO: 1067913 - protein, 19 aa, Mycobacterium
TPLIVMMTTLRLQDSKDSS

SEQ ID NO: 1067914 - protein, 19 aa, Mycobacterium
TPLPVIGVPVPLARLDGLD

SEQ ID NO: 1067915 - protein, 26 aa, Mycobacterium
TPLTSMRTNLGVLAVLELVSEQREEV

SEQ ID NO: 1067916 - protein, 19 aa, Mycobacterium
TPMIAAVAGYALGGGCELA

SEQ ID NO: 1067917 - protein, 21 aa, Mycobacterium
TPQLVQLGLKTVLDTLPYGDW

SEQ ID NO: 1067918 - protein, 23 aa, Mycobacterium
TPSNYFHLLRRHALDGIKRPLIV

SEQ ID NO: 1067919 - protein, 26 aa, Mycobacterium
TPTEMWDVFFEEYLSPVQPLERIKQR

SEQ ID NO: 1067920 - protein, 22 aa, Mycobacterium
TPTTKMAWLRWLDENGVRNIEM

SEQ ID NO: 1067921 - protein, 17 aa, Mycobacterium
TPTWLGGWVLLGPGGLN

SEQ ID NO: 1067922 - protein, 17 aa, Mycobacterium
TPVFMVLRSPTGELLGV

SEQ ID NO: 1067923 - protein, 24 aa, Mycobacterium
TQAEWVTCSPWLEAEWRLVSEYVR

SEQ ID NO: 1067924 - protein, 23 aa, Mycobacterium
TQAILATINFFGINMAPIAFTEA

SEQ ID NO: 1067925 - protein, 19 aa, Mycobacterium
TQEALLHYPPPELTATVIT

SEQ ID NO: 1067926 - protein, 29 aa, Mycobacterium
TQETLIALTRLRELIDRYPLRGIKGPMGT

SEQ ID NO: 1067927 - protein, 21 aa, Mycobacterium
TQIGSPYAWGGAAPGGFDCSG

SEQ ID NO: 1067928 - protein, 19 aa, Mycobacterium
TQIRALGLLKGACAQVNKD

SEQ ID NO: 1067929 - protein, 25 aa, Mycobacterium
TQKAVRSLLTGYLLYALGGDKEYRD

SEQ ID NO: 1067930 - protein, 18 aa, Mycobacterium
TQLLGRTQIGECCVIGPD

SEQ ID NO: 1067931 - protein, 29 aa, Mycobacterium
TQLPPGPWTKWAVSLVGIMPCLRAVSASA

SEQ ID NO: 1067932 - protein, 17 aa, Mycobacterium
TQQLIVVASAATRWVWL

SEQ ID NO: 1067933 - protein, 25 aa, Mycobacterium
TQRLTQQILWDRLCAALTPGNVVLA

SEQ ID NO: 1067934 - protein, 33 aa, Mycobacterium
TQRVKANLFYRGLTFHRFPVIGDTLYTSTEVVG

SEQ ID NO: 1067935 - protein, 30 aa, Mycobacterium
TQVVLALLDSPLGQLLYAAGTGSLADFGEL

SEQ ID NO: 1067936 - protein, 23 aa, Mycobacterium
TRADLLRPYPPRAVLLAANRDPL

SEQ ID NO: 1067937 - protein, 24 aa, Mycobacterium
TRAGVLRFVILDGLAKPGRLVGPD

SEQ ID NO: 1067938 - protein, 25 aa, Mycobacterium
TRCSNLILLAGVKSLPRSAGGQVAR

SEQ ID NO: 1067939 - protein, 26 aa, Mycobacterium
TRDSWEFALFEAALQRGLPVLGICRG

SEQ ID NO: 1067940 - protein, 17 aa, Mycobacterium
TREAVLPTVKFTDRTLA

SEQ ID NO: 1067941 - protein, 21 aa, Mycobacterium
TRGGYLKDIKGFDSDFFAVAK

SEQ ID NO: 1067942 - protein, 24 aa, Mycobacterium
TRHNVGFMVANLLAVRLGSKFEVH

SEQ ID NO: 1067943 - protein, 18 aa, Mycobacterium
TRIHTVLGILKAYTTRVG

SEQ ID NO: 1067944 - protein, 21 aa, Mycobacterium
TRIVCFELAADLRKRRLEQSR

SEQ ID NO: 1067945 - protein, 26 aa, Mycobacterium
TRKHKNACIFLNRPGFPIGAGCALHS

SEQ ID NO: 1067946 - protein, 17 aa, Mycobacterium
TRKRPSTPRGAVSAARR

SEQ ID NO: 1067947 - protein, 24 aa, Mycobacterium
TRLGKMWRCLGCTEFTLDEPHGLD

SEQ ID NO: 1067948 - protein, 19 aa, Mycobacterium
TRLRELFSWVVPMLGPMVQ

SEQ ID NO: 1067949 - protein, 18 aa, Mycobacterium
TRMRVALSALTMAEWFRD

SEQ ID NO: 1067950 - protein, 23 aa, Mycobacterium
TRRQTCVGLRFSDTLFLALSAGM

SEQ ID NO: 1067951 - protein, 24 aa, Mycobacterium
TRRYDTYFFFVGVLPEGQRPHGEN

SEQ ID NO: 1067952 - protein, 20 aa, Mycobacterium
TRSMALVTYRPEYHGALRHV

SEQ ID NO: 1067953 - protein, 18 aa, Mycobacterium
TRTEFALLEMLIANPRRV

SEQ ID NO: 1067954 - protein, 18 aa, Mycobacterium
TRTFGLYVQTRALVHRDV

SEQ ID NO: 1067955 - protein, 24 aa, Mycobacterium
TRTLPALIAPIFSVAELFLTQDAA

SEQ ID NO: 1067956 - protein, 22 aa, Mycobacterium
TRTLYRTVLQRRQLWHFGLQLD

SEQ ID NO: 1067957 - protein, 20 aa, Mycobacterium
TRVHYVEPAKWIAALRHTKS

SEQ ID NO: 1067958 - protein, 18 aa, Mycobacterium
TRWGAFLDDAAGFDAGFF

SEQ ID NO: 1067959 - protein, 30 aa, Mycobacterium
TRYQIVMGERRWRAAQQAGLSFIPAIVRAT

SEQ ID NO: 1067960 - protein, 23 aa, Mycobacterium
TSAAYMLGLLLQSKSIALADLGA

SEQ ID NO: 1067961 - protein, 24 aa, Mycobacterium
TSAEHPLFTIRIRTGHWANVLNQP

SEQ ID NO: 1067962 - protein, 26 aa, Mycobacterium
TSAFLDILGYARRLVGLPATVVAWGL

SEQ ID NO: 1067963 - protein, 26 aa, Mycobacterium
TSATGDFRFFAAPGSWTLRALSSVGN

SEQ ID NO: 1067964 - protein, 18 aa, Mycobacterium
TSDKLADRYLLVTGLPLA

SEQ ID NO: 1067965 - protein, 22 aa, Mycobacterium
TSDRLYPLRLQQELAEMLPGCT

SEQ ID NO: 1067966 - protein, 17 aa, Mycobacterium
TSFDPFTIITRGGRPMA

SEQ ID NO: 1067967 - protein, 20 aa, Mycobacterium
TSFLKVLQRFRSIRSVDVAV

SEQ ID NO: 1067968 - protein, 17 aa, Mycobacterium
TSIDPQQRLLLETSWEA

SEQ ID NO: 1067969 - protein, 25 aa, Mycobacterium
TSLHRPARVLLAGHLDTVPVAGNLP

SEQ ID NO: 1067970 - protein, 19 aa, Mycobacterium
TSMITWSGTEPSTLFRMNK

SEQ ID NO: 1067971 - protein, 34 aa, Mycobacterium
TSNHPLLCLVNVGGIPTLLWKLIGEIRSGDYVVL

SEQ ID NO: 1067972 - protein, 24 aa, Mycobacterium
TSPLAATRWGLIALAAGIVDEPNA

SEQ ID NO: 1067973 - protein, 18 aa, Mycobacterium
TSRLYRRARRDIAVSLPQ

SEQ ID NO: 1067974 - protein, 25 aa, Mycobacterium
TSSLSLFNGLGHGAAHIAVCPEIQK

SEQ ID NO: 1067975 - protein, 22 aa, Mycobacterium
TSSRAIRMLSIELGKLSADHDQ

SEQ ID NO: 1067976 - protein, 27 aa, Mycobacterium
TSVPTPLLCGALRIVFPVHADVIKHAV

SEQ ID NO: 1067977 - protein, 26 aa, Mycobacterium
TTADIWPNPWSMYRTLRDHEAVHHVV

SEQ ID NO: 1067978 - protein, 17 aa, Mycobacterium
TTASLVRRSLQFSTLTA

SEQ ID NO: 1067979 - protein, 25 aa, Mycobacterium
TTDARPLIYSQQRLHSLPPDTVAGI

SEQ ID NO: 1067980 - protein, 22 aa, Mycobacterium
TTDLIPLTDYKRSAAVTLPSGG

SEQ ID NO: 1067981 - protein, 25 aa, Mycobacterium
TTEMRLPFCWRGVSLHAGGAGRVRA

SEQ ID NO: 1067982 - protein, 17 aa, Mycobacterium
TTGLDAMLVTCLINVRY

SEQ ID NO: 1067983 - protein, 20 aa, Mycobacterium
TTGSYIFSFTTTDQHIVSQL

SEQ ID NO: 1067984 - protein, 22 aa, Mycobacterium
TTGVLRLYQFAAAGDLAFPAIN

SEQ ID NO: 1067985 - protein, 30 aa, Mycobacterium; identical to SEQ ID NO: 223691

SEQ ID NO: 1067986 - protein, 19 aa, Mycobacterium
TTLLPALLEALVSNVSRGI

SEQ ID NO: 1067987 - protein, 18 aa, Mycobacterium
TTPFVVDPALRSQVVGTI

SEQ ID NO: 1067988 - protein, 17 aa, Mycobacterium
TTPHQLWLRAVAAGGQG

SEQ ID NO: 1067989 - protein, 20 aa, Mycobacterium
TTRCPRHRLAQFRPSHQSTP

SEQ ID NO: 1067990 - protein, 25 aa, Mycobacterium
TTSRRVLDVLSALDGRIRSAHSSVD

SEQ ID NO: 1067991 - protein, 22 aa, Mycobacterium
TTTERILYYTGISYKIGEVHDG

SEQ ID NO: 1067992 - protein, 23 aa, Mycobacterium
TTTPLAMLVVPNPELLYTPASGE

SEQ ID NO: 1067993 - protein, 26 aa, Mycobacterium
TTVERPHYMPLFVAPQPIEVDDDSCA

SEQ ID NO: 1067994 - protein, 25 aa, Mycobacterium
TTYPLFLHEAYVRLYPAQVIKQADL

SEQ ID NO: 1067995 - protein, 31 aa, Mycobacterium
TVADWIRVVCFPDRWLDLRYLRSTSAVGDSE

SEQ ID NO: 1067996 - protein, 25 aa, Mycobacterium
TVAKRSYLLAVKSRRIIMKANVSFH

SEQ ID NO: 1067997 - protein, 21 aa, Mycobacterium
TVALLVTPIGRNSPQGLAASK

SEQ ID NO: 1067998 - protein, 25 aa, Mycobacterium
TVARRGGLVILPQDLPIATVQQAVE

SEQ ID NO: 1067999 - protein, 34 aa, Mycobacterium
TVATDRFTAMPPAERWHLLASTWLDLQCRPALIG

SEQ ID NO: 1068000 - protein, 18 aa, Mycobacterium
TVATVYGEYQRRLRTANA

SEQ ID NO: 1068001 - protein, 22 aa, Mycobacterium
TVFEAVFMIFGPRLNIAQRYVD

SEQ ID NO: 1068002 - protein, 20 aa, Mycobacterium
TVFMTIFTPGERRDASVKSS

SEQ ID NO: 1068003 - protein, 30 aa, Mycobacterium
TVGLIKAILSLRNGLVPPLLHFDRLSDDLT

SEQ ID NO: 1068004 - protein, 17 aa, Mycobacterium
TVHLLVVDAYRGGHPTP

SEQ ID NO: 1068005 - protein, 22 aa, Mycobacterium
TVHRGIALTSFYHCSDLYHIEP

SEQ ID NO: 1068006 - protein, 27 aa, Mycobacterium
TVIPARRGWVLWGAGVGALTYAPNIGI

SEQ ID NO: 1068007 - protein, 26 aa, Mycobacterium
TVKDLLPLLEKVIQAGKSLLIIAEDV

SEQ ID NO: 1068008 - protein, 26 aa, Mycobacterium
TVLSRAQLLELVWGYDFAADTNVVDV

SEQ ID NO: 1068009 - protein, 17 aa, Mycobacterium
TVLYPRKGVSELTRFTP

SEQ ID NO: 1068010 - protein, 29 aa, Mycobacterium
TVQNILALRFANQLWIPIWNAHVQITVAE

SEQ ID NO: 1068011 - protein, 17 aa, Mycobacterium
TVRAQLRRHGPVTIYGV

SEQ ID NO: 1068012 - protein, 19 aa, Mycobacterium
TVRDGPLGFWNAMREVLPA

SEQ ID NO: 1068013 - protein, 28 aa, Mycobacterium
TVRHLEVIALSPARLLMVVITESGRVDQ

SEQ ID NO: 1068014 - protein, 24 aa, Mycobacterium
TVRRDPMAMLPFMGYHVGDYFQHW

SEQ ID NO: 1068015 - protein, 17 aa, Mycobacterium
TVRVPDAALDAALAGLD

SEQ ID NO: 1068016 - protein, 17 aa, Mycobacterium
TVTKMFCGCATTFGAEP

SEQ ID NO: 1068017 - protein, 24 aa, Mycobacterium
TVTLPVLAYMPLLSVLQLTGHQRA

SEQ ID NO: 1068018 - protein, 29 aa, Mycobacterium
TVVDTLAAPFLFFLQNVRYRSIGVNYRDL

SEQ ID NO: 1068019 - protein, 17 aa, Mycobacterium
TVVLPFKIDDYTAWRLL

SEQ ID NO: 1068020 - protein, 26 aa, Mycobacterium
TVVYEPLLKRLPADTPMYGFERVEGS

SEQ ID NO: 1068021 - protein, 18 aa, Mycobacterium
TWLVAIISGQLAPTDKFF

SEQ ID NO: 1068022 - protein, 19 aa, Mycobacterium
TWTTLSLVRGLDLLHDAYR

SEQ ID NO: 1068023 - protein, 18 aa, Mycobacterium
TWVVRTASNALAAWCRCN

SEQ ID NO: 1068024 - protein, 17 aa, Mycobacterium
TYAAPLFVTAEFINNNT

SEQ ID NO: 1068025 - protein, 24 aa, Mycobacterium
TYCARHLIDALLPKIPKSIDDSDW

SEQ ID NO: 1068026 - protein, 17 aa, Mycobacterium
TYGNLLAQINHPHPTSP

SEQ ID NO: 1068027 - protein, 18 aa, Mycobacterium
TYHLTPAYIKRRLPSMHN

SEQ ID NO: 1068028 - protein, 27 aa, Mycobacterium
TYLAFDLIHRLWLDLGHEVHYVQNVTD

SEQ ID NO: 1068029 - protein, 20 aa, Mycobacterium
TYNEWSFASARKLNTAKIAT

SEQ ID NO: 1068030 - protein, 18 aa, Mycobacterium
VAAADWPLLAAAYQTRGV

SEQ ID NO: 1068031 - protein, 24 aa, Mycobacterium
VAADLFIFGKVMSGGMPAAAFGGR

SEQ ID NO: 1068032 - protein, 24 aa, Mycobacterium
VAAESLIVIDLLPTAITTYLTKTH

SEQ ID NO: 1068033 - protein, 23 aa, Mycobacterium
VAAGDPLLLALQSSLRARLSENG

SEQ ID NO: 1068034 - protein, 23 aa, Mycobacterium
VAALRSIGITPDALILRCDRDVP

SEQ ID NO: 1068035 - protein, 25 aa, Mycobacterium
VAAVTASIWPMIADGSVRPIIGARM

SEQ ID NO: 1068036 - protein, 17 aa, Mycobacterium
VAAYWPVPGVHDDKYTQ

SEQ ID NO: 1068037 - protein, 27 aa, Mycobacterium
VACSTPNLLFGKMSFLINSGAVAEDDS

SEQ ID NO: 1068038 - protein, 20 aa, Mycobacterium
VADAYRFFPLSEVGLHLFAE

SEQ ID NO: 1068039 - protein, 19 aa, Mycobacterium
VADIFFLVCDGLKGLPDSV

SEQ ID NO: 1068040 - protein, 23 aa, Mycobacterium
VAEAFSCYGAHLPQINNVLPDTT

SEQ ID NO: 1068041 - protein, 36 aa, Mycobacterium
VAEAIAYLLEILPALSYLHSIGLVYNDLKPENIMLT

SEQ ID NO: 1068042 - protein, 23 aa, Mycobacterium
VAEGLHVLGWRNVPTDASSLGAL

SEQ ID NO: 1068043 - protein, 34 aa, Mycobacterium
VAELVLFEVENPRLLVYPLERLRTDLWQLPGASG

SEQ ID NO: 1068044 - protein, 41 aa, Mycobacterium
VAEPTAPFGPYRPYPLHPLALPLLHPKQVIMLGRPTLHRPV

SEQ ID NO: 1068045 - protein, 20 aa, Mycobacterium
VAETVRVLYGGSLNAKNIGD

SEQ ID NO: 1068046 - protein, 22 aa, Mycobacterium
VAGFGIHPALLDAALHAMLIAN

SEQ ID NO: 1068047 - protein, 26 aa, Mycobacterium
VAGGAYFVLATGRPPRWVRPVVDALG

SEQ ID NO: 1068048 - protein, 27 aa, Mycobacterium
VAGGSADDIFWLSSAYLAAYADNGRLI

SEQ ID NO: 1068049 - protein, 17 aa, Mycobacterium
VAGPNWMLIGDAAACVN

SEQ ID NO: 1068050 - protein, 27 aa, Mycobacterium
VAHNSFIYVPPGVHVDIPLQAYFRINT

SEQ ID NO: 1068051 - protein, 17 aa, Mycobacterium
VAIHWAMSSLRSGECDL

SEQ ID NO: 1068052 - protein, 22 aa, Mycobacterium
VAILAGDYLFATASRLVSQLGL

SEQ ID NO: 1068053 - protein, 17 aa, Mycobacterium
VAKNRYLIYTSHDIRVL

SEQ ID NO: 1068054 - protein, 19 aa, Mycobacterium
VALIEGLGLKPRKVFGPIR

SEQ ID NO: 1068055 - protein, 20 aa, Mycobacterium
VALRFQSAGYRLIALFVSAC

SEQ ID NO: 1068056 - protein, 21 aa, Mycobacterium
VALTREVLNAGIPLFGICFGN

SEQ ID NO: 1068057 - protein, 45 aa, Mycobacterium
VAMFRPKLDVASLLHRLSLKQPVKYFLLFSSISGLIGSRWLAHYT

SEQ ID NO: 1068058 - protein, 24 aa, Mycobacterium
VANQFVAFLVWSPNRQSAISQVHR

SEQ ID NO: 1068059 - protein, 28 aa, Mycobacterium
VANRDKRLLVFPVKRLADLGFHVIATEG

SEQ ID NO: 1068060 - protein, 18 aa, Mycobacterium
VAPIAFNVVPLAGSLVDD

SEQ ID NO: 1068061 - protein, 18 aa, Mycobacterium
VARAVRPPTPGRRLPKSL

SEQ ID NO: 1068062 - protein, 26 aa, Mycobacterium
VAREALDRGIPLLRPARPNSPVFVSE

SEQ ID NO: 1068063 - protein, 19 aa, Mycobacterium
VARELKYSSPQTDFQRLQR

SEQ ID NO: 1068064 - protein, 17 aa, Mycobacterium
VARIVPLHLANSALIDL

SEQ ID NO: 1068065 - protein, 23 aa, Mycobacterium
VARRRVRRFLAEGPNLVEAAIVS

SEQ ID NO: 1068066 - protein, 26 aa, Mycobacterium
VASLDKWVIYVPLEHVAAVQAAVFEA

SEQ ID NO: 1068067 - protein, 29 aa, Mycobacterium
VASRIRCAGAIFVGPWAPVSLGDYCAGSN

SEQ ID NO: 1068068 - protein, 19 aa, Mycobacterium
VATAMIPFLEHDDANRALM

SEQ ID NO: 1068069 - protein, 27 aa, Mycobacterium
VATAQAWTYLCMTPPVGVTGLSQPGLF

SEQ ID NO: 1068070 - protein, 32 aa, Mycobacterium
VATGNWACIVPHTWLWTTPIGAEIRAVEMVDP

SEQ ID NO: 1068071 - protein, 20 aa, Mycobacterium
VAVDRKIWSGKGTFLFTRTT

SEQ ID NO: 1068072 - protein, 25 aa, Mycobacterium
VAVLARLDLGSVLIPLPEGSQLQVE

SEQ ID NO: 1068073 - protein, 19 aa, Mycobacterium
VAVPRPEESRFRSMCEARG

SEQ ID NO: 1068074 - protein, 26 aa, Mycobacterium
VAVRSHLVSFLPGHPFAPELPQGQPV

SEQ ID NO: 1068075 - protein, 18 aa, Mycobacterium
VAVTVLTAIFYANNKIRK

SEQ ID NO: 1068076 - protein, 18 aa, Mycobacterium
VAVVFVSVAVSCSVGFIG

SEQ ID NO: 1068077 - protein, 20 aa, Mycobacterium
VAYLAYFRSSSKAFATVCWG

SEQ ID NO: 1068078 - protein, 20 aa, Mycobacterium
VCALLSEWLPATTGSIIYAD

SEQ ID NO: 1068079 - protein, 28 aa, Mycobacterium
VCPVCLGLPGSLPVLNRAAVQSAIRIGL

SEQ ID NO: 1068080 - protein, 24 aa, Mycobacterium
VCQDFAHLTLIVLRSMGIPGRYVS

SEQ ID NO: 1068081 - protein, 18 aa, Mycobacterium
VCTVNVVAVLFDVPNRLR

SEQ ID NO: 1068082 - protein, 17 aa, Mycobacterium
VCVKIGHYLATTVQRHI

SEQ ID NO: 1068083 - protein, 29 aa, Mycobacterium
VDAADWAEMLMRMYIRWAEQHKYGVEVLD

SEQ ID NO: 1068084 - protein, 24 aa, Mycobacterium
VDAKGNTIAWLYSQRRFEVPTDKI

SEQ ID NO: 1068085 - protein, 25 aa, Mycobacterium
VDAKRKVFLSLPQRSQMSYHQTDFL

SEQ ID NO: 1068086 - protein, 33 aa, Mycobacterium
VDDALYEMELVGHDFFLFLDKQSERPSVVYRRH

SEQ ID NO: 1068087 - protein, 25 aa, Mycobacterium
VDDLRAPLLAALGAADLALTTVNEL

SEQ ID NO: 1068088 - protein, 34 aa, Mycobacterium
VDDMRDWCISRQLWWGHRIPIWYGPNGEQVCVGP

SEQ ID NO: 1068089 - protein, 18 aa, Mycobacterium
VDELVATVWPDRTDPRWT

SEQ ID NO: 1068090 - protein, 24 aa, Mycobacterium
VDFAIPMIGMLKRKAEHRLIDGAL

SEQ ID NO: 1068091 - protein, 18 aa, Mycobacterium
VDFVLSNLVNARYLRICV

SEQ ID NO: 1068092 - protein, 23 aa, Mycobacterium
VDGPRHWVAHLQVLRDIQDRTGG

SEQ ID NO: 1068093 - protein, 52 aa, Mycobacterium
VDGQHISTLLLTLLFRFMRPLIEHGYVFLAQPPLYKLKWQRMDPEFAYSDSE

SEQ ID NO: 1068094 - protein, 20 aa, Mycobacterium
VDIAAFIGAAADELVFTKNA

SEQ ID NO: 1068095 - protein, 24 aa, Mycobacterium
VDICPWALREGLILRKLDSEADGT

SEQ ID NO: 1068096 - protein, 19 aa, Mycobacterium
VDKGTVIVIEWAALGFHRR

SEQ ID NO: 1068097 - protein, 24 aa, Mycobacterium
VDKQANLHFVIGKASFDEKRLAEN

SEQ ID NO: 1068098 - protein, 17 aa, Mycobacterium
VDLGYTVPTLWSGSLSD

SEQ ID NO: 1068099 - protein, 22 aa, Mycobacterium
VDLIQRLRAAPPSQLAGFTATT

SEQ ID NO: 1068100 - protein, 24 aa, Mycobacterium
VDLQIPVLLIRGKTLLRDHLRGRS

SEQ ID NO: 1068101 - protein, 17 aa, Mycobacterium
VDLYPLVSKSIRVGAES

SEQ ID NO: 1068102 - protein, 24 aa, Mycobacterium
VDNKFQRALAHWCHRGGVAGGPVL

SEQ ID NO: 1068103 - protein, 29 aa, Mycobacterium
VDNKLAEFEEFLNGTLRSVGRGRHQLRTA

SEQ ID NO: 1068104 - protein, 26 aa, Mycobacterium
VDNWVCRALALLVLPDISADRALQVI

SEQ ID NO: 1068105 - protein, 24 aa, Mycobacterium
VDPKRKVRFLPYGIAVSVLDSHQE

SEQ ID NO: 1068106 - protein, 27 aa, Mycobacterium
VDPVNRVEFFFLRPKDIAIYVGSGDLD

SEQ ID NO: 1068107 - protein, 25 aa, Mycobacterium
VDQFYFDPRWIAIDPRWIAIKDPRA

SEQ ID NO: 1068108 - protein, 24 aa, Mycobacterium
VDQVLLRLKTPTEGRLYDVELALR

SEQ ID NO: 1068109 - protein, 31 aa, Mycobacterium
VDQVRFTAPVEYAFRHPLIRTVAYESQLKSD

SEQ ID NO: 1068110 - protein, 20 aa, Mycobacterium
VDRLRAIADRLGRGIGPEIL

SEQ ID NO: 1068111 - protein, 23 aa, Mycobacterium
VDRSAAYAMRWVAKNIVAAGLAE

SEQ ID NO: 1068112 - protein, 17 aa, Mycobacterium
VDRVLYLVDGRFLIGTV

SEQ ID NO: 1068113 - protein, 25 aa, Mycobacterium
VDSGLTLSWLLRNLATRRPQSLQVC

SEQ ID NO: 1068114 - protein, 24 aa, Mycobacterium
VDSSVLLGDWPIRIPREIASAASE

SEQ ID NO: 1068115 - protein, 23 aa, Mycobacterium
VDTIDLFQLHRIDPNFPLADQVG

SEQ ID NO: 1068116 - protein, 18 aa, Mycobacterium
VDTLMCVAMHRASPTAKT

SEQ ID NO: 1068117 - protein, 20 aa, Mycobacterium
VDVDLVFSQLWIAVRALLDE

SEQ ID NO: 1068118 - protein, 17 aa, Mycobacterium
VDVIGLPWEEVHAEACR

SEQ ID NO: 1068119 - protein, 19 aa, Mycobacterium
VDVPGLRSLGSNGTASPTV

SEQ ID NO: 1068120 - protein, 29 aa, Mycobacterium
VDVRRTIGWFTNYYPIPLVCVKGQGALAQ

SEQ ID NO: 1068121 - protein, 19 aa, Mycobacterium
VDVSVGYPIYPPVPTIRKP

SEQ ID NO: 1068122 - protein, 18 aa, Mycobacterium
VDVTIVEFLPRAMPNEDA

SEQ ID NO: 1068123 - protein, 32 aa, Mycobacterium
VDWLPAALAISRWRFRFMIKAEMRRVKVVNFL

SEQ ID NO: 1068124 - protein, 23 aa, Mycobacterium
VEAALPRLPFSTHAFDLVLSSHL

SEQ ID NO: 1068125 - protein, 21 aa, Mycobacterium
VEAARLIVYAAAARAERGEPD

SEQ ID NO: 1068126 - protein, 30 aa, Mycobacterium
VEAGAVLVPWLRPSQVRVLLMAALAANLPI

SEQ ID NO: 1068127 - protein, 22 aa, Mycobacterium
VEALDRHRLLLDITRALADERV

SEQ ID NO: 1068128 - protein, 17 aa, Mycobacterium
VEASLRSLARVAPTQRH

SEQ ID NO: 1068129 - protein, 25 aa, Mycobacterium
VEDIFPLPRELVGEGTLFLLKVTGD

SEQ ID NO: 1068130 - protein, 17 aa, Mycobacterium
VEDKLRTVLWGWAGKPI

SEQ ID NO: 1068131 - protein, 17 aa, Mycobacterium
VEFFGGIPILDGIGSSE

SEQ ID NO: 1068132 - protein, 34 aa, Mycobacterium
VEFGPADWYSTMEALLFGAFISGGFVFQDHAGFN

SEQ ID NO: 1068133 - protein, 21 aa, Mycobacterium
VEFSVLPRSYWATKISELPAV

SEQ ID NO: 1068134 - protein, 22 aa, Mycobacterium
VEGDQPWMIYELDLHQVLHVTE

SEQ ID NO: 1068135 - protein, 18 aa, Mycobacterium
VEGDTVVAVVDPGWRRGA

SEQ ID NO: 1068136 - protein, 18 aa, Mycobacterium
VEGLYTRWPERDSLVNEI

SEQ ID NO: 1068137 - protein, 21 aa, Mycobacterium
VEIDRSLSTWPQLAGDVALGA

SEQ ID NO: 1068138 - protein, 18 aa, Mycobacterium
VELPQQGGLIAHLAHTWK

SEQ ID NO: 1068139 - protein, 17 aa, Mycobacterium
VELYFVCMFCCGGGVKG

SEQ ID NO: 1068140 - protein, 17 aa, Mycobacterium
VENMFPFRADRFFGADQ

SEQ ID NO: 1068141 - protein, 28 aa, Mycobacterium
VEPFRRIEFRLEPPVGNIGLLREVERFP

SEQ ID NO: 1068142 - protein, 24 aa, Mycobacterium
VEPNMRWRTFCTELLTIADRLNVD

SEQ ID NO: 1068143 - protein, 17 aa, Mycobacterium
VEQFLAQFYGEQAELDF

SEQ ID NO: 1068144 - protein, 18 aa, Mycobacterium
VEQLERAVFDMVIAGRIV

SEQ ID NO: 1068145 - protein, 19 aa, Mycobacterium
VETGFLEHLWHAPTKEVYS

SEQ ID NO: 1068146 - protein, 23 aa, Mycobacterium
VEVRPKIALPDFSTLKVVVDPVE

SEQ ID NO: 1068147 - protein, 20 aa, Mycobacterium
VEWAWQMVRDAVLDRVLSNP

SEQ ID NO: 1068148 - protein, 23 aa, Mycobacterium
VEYRQLRLERVVLVGVWTEGSAA

SEQ ID NO: 1068149 - protein, 19 aa, Mycobacterium
VFCSVVRRVALPDSFFAID

SEQ ID NO: 1068150 - protein, 33 aa, Mycobacterium
VFDLRPGAIIRDLHLLRPIYAQTAAYGHFGRTD

SEQ ID NO: 1068151 - protein, 22 aa, Mycobacterium
VFDYPTVYSLTDYLATILPEFL

SEQ ID NO: 1068152 - protein, 17 aa, Mycobacterium
VFGVDATFRGPHNDTRL

SEQ ID NO: 1068153 - protein, 17 aa, Mycobacterium
VFMVLRSPTGELLGVEP

SEQ ID NO: 1068154 - protein, 23 aa, Mycobacterium
VFPEATMCRFGVPLGPVAEPIDG

SEQ ID NO: 1068155 - protein, 18 aa, Mycobacterium
VFPQAELPGFITPNAAGH

SEQ ID NO: 1068156 - protein, 20 aa, Mycobacterium
VFQTLLRYNRPYSCYAPIME

SEQ ID NO: 1068157 - protein, 33 aa, Mycobacterium
VGADVLLHSCAAELPWNFLQRSAIRAVSVDVNV

SEQ ID NO: 1068158 - protein, 28 aa, Mycobacterium
VGAKLWVDMAHFAGLVAVGLHPSPVPHA

SEQ ID NO: 1068159 - protein, 26 aa, Mycobacterium
VGDQAWIEDYFIPTVAKRGAAIIDAR

SEQ ID NO: 1068160 - protein, 20 aa, Mycobacterium
VGDVLRRKSGALPDLVHTHP

SEQ ID NO: 1068161 - protein, 29 aa, Mycobacterium
VGEEWLYQSWAAAYLPLLQVLHTLADENR

SEQ ID NO: 1068162 - protein, 18 aa, Mycobacterium
VGERGWVVITNYKRIRIS

SEQ ID NO: 1068163 - protein, 23 aa, Mycobacterium
VGGAAHWTIDPIVGFASSSAPQD

SEQ ID NO: 1068164 - protein, 29 aa, Mycobacterium
VGGADTVLVFPFDVAIPGGFLGMAASFAR

SEQ ID NO: 1068165 - protein, 24 aa, Mycobacterium
VGGQIDVMLITRLPPDAAVMLVCA

SEQ ID NO: 1068166 - protein, 28 aa, Mycobacterium
VGHHCALPLHRRFALAATARASFAVYNT

SEQ ID NO: 1068167 - protein, 17 aa, Mycobacterium
VGKALLYGPDDTWLRLG

SEQ ID NO: 1068168 - protein, 18 aa, Mycobacterium
VGKPERIVLVWPPTGNSC

SEQ ID NO: 1068169 - protein, 28 aa, Mycobacterium
VGKVQGLLARLLTLPIPTAAAVVGHAFG

SEQ ID NO: 1068170 - protein, 18 aa, Mycobacterium
VGLGGSTWRDPRLWWQLR

SEQ ID NO: 1068171 - protein, 24 aa, Mycobacterium
VGNQILESLNLRPRSHEIVSCPSC

SEQ ID NO: 1068172 - protein, 19 aa, Mycobacterium
VGRIHVLNRSLSRARRLAG

SEQ ID NO: 1068173 - protein, 19 aa, Mycobacterium
VGVTLMEFHMMYSALVSGA

SEQ ID NO: 1068174 - protein, 22 aa, Mycobacterium
VGVVHSLWQPMAGRFKDYIAQP

SEQ ID NO: 1068175 - protein, 27 aa, Mycobacterium
VHFKSVVYELLWFLRGDSNVAWLHEHG

SEQ ID NO: 1068176 - protein, 20 aa, Mycobacterium
VHGDLYGTMLFVGTAAPGIT

SEQ ID NO: 1068177 - protein, 26 aa, Mycobacterium
VHKPRPNFPVINFLDAGTAPLSVLLT

SEQ ID NO: 1068178 - protein, 25 aa, Mycobacterium
VHLDALTAHLQRYAPWGAQVSVIRG

SEQ ID NO: 1068179 - protein, 17 aa, Mycobacterium
VHQITIYAVITTTMRQP

SEQ ID NO: 1068180 - protein, 17 aa, Mycobacterium
VHRFYGAERLFDLAYLP

SEQ ID NO: 1068181 - protein, 22 aa, Mycobacterium
VHRKALVAFRKAGGRIVENVSA

SEQ ID NO: 1068182 - protein, 24 aa, Mycobacterium
VHSIREFGLLQPIVVRPASGSCGD

SEQ ID NO: 1068183 - protein, 24 aa, Mycobacterium
VHTTLQRLYGLPALRRCSDTARSL

SEQ ID NO: 1068184 - protein, 25 aa, Mycobacterium
VHVETLTGFKWLARADANLPGTLVY

SEQ ID NO: 1068185 - protein, 17 aa, Mycobacterium
VHYPFENDDWFDGFDSA

SEQ ID NO: 1068186 - protein, 23 aa, Mycobacterium
VIAVSDWMRAVPEQIRPWVPGTY

SEQ ID NO: 1068187 - protein, 18 aa, Mycobacterium
VIDFGAIAPLPGGFPVEL

SEQ ID NO: 1068188 - protein, 25 aa, Mycobacterium
VIDPTNLWLTIHQATIHTIKYKRAV

SEQ ID NO: 1068189 - protein, 17 aa, Mycobacterium
VIFVKPVLVGEVRYSEW

SEQ ID NO: 1068190 - protein, 20 aa, Mycobacterium
VIHYLAYCGWQVTTRPRRDL

SEQ ID NO: 1068191 - protein, 18 aa, Mycobacterium
VILDDVTLNFFPGAKIGV

SEQ ID NO: 1068192 - protein, 19 aa, Mycobacterium
VIRQHDGARPTWWSEPTGR

SEQ ID NO: 1068193 - protein, 17 aa, Mycobacterium
VISFYTPASEDATFTEV

SEQ ID NO: 1068194 - protein, 23 aa, Mycobacterium
VIVGPLWMQFWVCGTFEVQNKRI

SEQ ID NO: 1068195 - protein, 21 aa, Mycobacterium
VIVPKLDLPSLLTALTRPAQD

SEQ ID NO: 1068196 - protein, 22 aa, Mycobacterium
VIWAFKQLWDKGLAYESYRVLP

SEQ ID NO: 1068197 - protein, 28 aa, Mycobacterium
VKAEVLAEALPWLKQLHGKVVVVKYSGN

SEQ ID NO: 1068198 - protein, 29 aa, Mycobacterium
VKDGYGRNFLLPHGLAIVASRGAQRQADE

SEQ ID NO: 1068199 - protein, 18 aa, Mycobacterium
VKIEKLDFEPGAKVSLPV

SEQ ID NO: 1068200 - protein, 21 aa, Mycobacterium
VKITLTWSQLYRRTLNVAQEL

SEQ ID NO: 1068201 - protein, 26 aa, Mycobacterium
VKNNLQTVAALLRLQARRMANAEGRE

SEQ ID NO: 1068202 - protein, 20 aa, Mycobacterium
VKRRAFADQPYWGRPVPGWG

SEQ ID NO: 1068203 - protein, 23 aa, Mycobacterium
VKRRIMIGAYALSAGYYDSYYSQ

SEQ ID NO: 1068204 - protein, 26 aa, Mycobacterium
VKSATFAVHAPFAYGTLASEQGTHRL

SEQ ID NO: 1068205 - protein, 18 aa, Mycobacterium
VKTLRIWGDTLESNRAKA

SEQ ID NO: 1068206 - protein, 20 aa, Mycobacterium
VKVKMLLLNNIDVSQYWLEY

SEQ ID NO: 1068207 - protein, 34 aa, Mycobacterium
VKVKPTSVPAFRPGAQFKAVVAGAQRLPLEGPAV

SEQ ID NO: 1068208 - protein, 37 aa, Mycobacterium
VLAAALDTLLRLLHPVMPFITETLWQALTQLESLVIA

SEQ ID NO: 1068209 - protein, 21 aa, Mycobacterium
VLAAMPEATVVRTAWVYTGGT

SEQ ID NO: 1068210 - protein, 21 aa, Mycobacterium
VLAEMKLLQPLLTAGDYLVVE

SEQ ID NO: 1068211 - protein, 26 aa, Mycobacterium
VLARALTLSAFTYKMTVGFTSDIKNL

SEQ ID NO: 1068212 - protein, 20 aa, Mycobacterium
VLASLLLNRISLTPGEAIFL

SEQ ID NO: 1068213 - protein, 19 aa, Mycobacterium
VLDAQRWARERALCAVATA

SEQ ID NO: 1068214 - protein, 20 aa, Mycobacterium
VLDFYRCAMLPASAAWHPHD

SEQ ID NO: 1068215 - protein, 19 aa, Mycobacterium
VLDLCAGTLTRRANWRSPA

SEQ ID NO: 1068216 - protein, 24 aa, Mycobacterium
VLDLISAHRIPVVSTLAPDRDGVV

SEQ ID NO: 1068217 - protein, 25 aa, Mycobacterium
VLDRYLPVLVDLRMRYLDDGDWTGD

SEQ ID NO: 1068218 - protein, 21 aa, Mycobacterium
VLDYERAMLRLAGAPEGPDDG

SEQ ID NO: 1068219 - protein, 17 aa, Mycobacterium
VLECASAARKLNRHVWA

SEQ ID NO: 1068220 - protein, 17 aa, Mycobacterium
VLEGRLEQLRTFEREYR

SEQ ID NO: 1068221 - protein, 33 aa, Mycobacterium
VLEPRLRIPNEFGLCRYLAAGLAALQTVDPRLR

SEQ ID NO: 1068222 - protein, 17 aa, Mycobacterium
VLERLSLGQWVAFVLHD

SEQ ID NO: 1068223 - protein, 22 aa, Mycobacterium
VLESLTSIRRAGADIVFTYWAA

SEQ ID NO: 1068224 - protein, 23 aa, Mycobacterium
VLFHARAKLRRKGCDLLVVNAVG

SEQ ID NO: 1068225 - protein, 27 aa, Mycobacterium
VLGAIDSITLLPLYFELDGSFPNHEAN

SEQ ID NO: 1068226 - protein, 18 aa, Mycobacterium
VLGLLRDAYCRHIGVEYT

SEQ ID NO: 1068227 - protein, 21 aa, Mycobacterium
VLGVLQSWLIKSDSGVLVVVT

SEQ ID NO: 1068228 - protein, 20 aa, Mycobacterium
VLIDLVQRYAPKLSLIVTSH

SEQ ID NO: 1068229 - protein, 27 aa, Mycobacterium
VLIGKQFLYVERYMKLLAPEWQIMLDP

SEQ ID NO: 1068230 - protein, 19 aa, Mycobacterium
VLIPSPDYPLWTASTSLAG

SEQ ID NO: 1068231 - protein, 19 aa, Mycobacterium
VLLDEAGVTVTRFVRFEVG

SEQ ID NO: 1068232 - protein, 23 aa, Mycobacterium
VLLDHELWFIQPFRADEWRLYNQ

SEQ ID NO: 1068233 - protein, 17 aa, Mycobacterium
VLMPPRSYLGTHMRVHE

SEQ ID NO: 1068234 - protein, 17 aa, Mycobacterium
VLMQESEFRKALRTCQA

SEQ ID NO: 1068235 - protein, 30 aa, Mycobacterium; identical to SEQ ID NO: 224129

SEQ ID NO: 1068236 - protein, 23 aa, Mycobacterium
VLPEPTFVPILGRIAAGSPIFAE

SEQ ID NO: 1068237 - protein, 21 aa, Mycobacterium
VLPLVFDHLFGMISYTAGRSI

SEQ ID NO: 1068238 - protein, 21 aa, Mycobacterium
VLRRQPLLLSLLATHPIDVSR

SEQ ID NO: 1068239 - protein, 19 aa, Mycobacterium
VLSGLVTAELHGGLLGGFE

SEQ ID NO: 1068240 - protein, 25 aa, Mycobacterium
VLSRATFHWVLAFADSSLLTPAVYT

SEQ ID NO: 1068241 - protein, 18 aa, Mycobacterium
VLSRFLHDFAGLDADWTA

SEQ ID NO: 1068242 - protein, 21 aa, Mycobacterium
VLSRYLLARKVVGAATPHPAP

SEQ ID NO: 1068243 - protein, 19 aa, Mycobacterium
VLTQVLGLYLYRSRSRSVG

SEQ ID NO: 1068244 - protein, 17 aa, Mycobacterium
VLVGSWHTIEGLVYTMP

SEQ ID NO: 1068245 - protein, 24 aa, Mycobacterium
VLVRAFPASWFIGIDFSNEAVAIH

SEQ ID NO: 1068246 - protein, 32 aa, Mycobacterium
VLVTSLFEQALFIRKYYELRFFAMDFSAPLGC

SEQ ID NO: 1068247 - protein, 17 aa, Mycobacterium
VLYRYFIDKNDLTTAVM

SEQ ID NO: 1068248 - protein, 18 aa, Mycobacterium
VMAWTKAGHLADPGYYHN

SEQ ID NO: 1068249 - protein, 25 aa, Mycobacterium
VMDSITVLLHRLGVTYTAMMTPVFM

SEQ ID NO: 1068250 - protein, 24 aa, Mycobacterium
VMGLPSIFVGFSRQRGLAADGRCK

SEQ ID NO: 1068251 - protein, 26 aa, Mycobacterium
VMSDGELFIMGRIKDLLIVDGRNHYP

SEQ ID NO: 1068252 - protein, 24 aa, Mycobacterium
VMTQELLEFPGGILGVALNLDEHN

SEQ ID NO: 1068253 - protein, 24 aa, Mycobacterium
VNAMAVRIASYGPGEFFDPLGGLA

SEQ ID NO: 1068254 - protein, 18 aa, Mycobacterium
VNFGAFVDLGGVDGLVHV

SEQ ID NO: 1068255 - protein, 17 aa, Mycobacterium
VNFRHQLGRLGLGHDSR

SEQ ID NO: 1068256 - protein, 29 aa, Mycobacterium
VNGLLTHLTEVLPRNAVLLVTANHGVLNV

SEQ ID NO: 1068257 - protein, 24 aa, Mycobacterium
VNHRVVRGLVAYSGFCCASFFGLP

SEQ ID NO: 1068258 - protein, 24 aa, Mycobacterium
VNLDYELCYLRRFAGADVRVVHRV

SEQ ID NO: 1068259 - protein, 20 aa, Mycobacterium
VNNLLSFLRYAHDSSVLACV

SEQ ID NO: 1068260 - protein, 27 aa, Mycobacterium
VNSDPYGAGWLLDVHVSDVGALESAIA

SEQ ID NO: 1068261 - protein, 18 aa, Mycobacterium
VNTLRARFRVHQVRSVSG

SEQ ID NO: 1068262 - protein, 26 aa, Mycobacterium
VNVATLPFPGFPTDLQPMAIALTSIA

SEQ ID NO: 1068263 - protein, 17 aa, Mycobacterium
VNYRFAPDRSVAAALRH

SEQ ID NO: 1068264 - protein, 26 aa, Mycobacterium
VPAIIAEYLGLPQLTHLRTISVEGGK

SEQ ID NO: 1068265 - protein, 21 aa, Mycobacterium
VPEQAFFLIGGLDDLTKKAES

SEQ ID NO: 1068266 - protein, 26 aa, Mycobacterium
VPGTWRFTLALFLAQQLLRPIRGDAV

SEQ ID NO: 1068267 - protein, 17 aa, Mycobacterium
VPLFINTGDKLKVDSRD

SEQ ID NO: 1068268 - protein, 23 aa, Mycobacterium
VPLPSKWRIAFGEPIYTTDYAAT

SEQ ID NO: 1068269 - protein, 20 aa, Mycobacterium
VPMRPNLLEPFEILGIGEVL

SEQ ID NO: 1068270 - protein, 21 aa, Mycobacterium
VPRLYLVYILVLNLGSACSDR

SEQ ID NO: 1068271 - protein, 36 aa, Mycobacterium
VPSTAVSWLPFYHDMGLILGVILPMVNQDTAVLLSP

SEQ ID NO: 1068272 - protein, 27 aa, Mycobacterium
VPSVLRFSGYELIKRLGIRRTIAIPVF

SEQ ID NO: 1068273 - protein, 25 aa, Mycobacterium
VPTLNVHAFFRFLVEMFGMVPSDVV

SEQ ID NO: 1068274 - protein, 28 aa, Mycobacterium
VPVELPMAALLDATFPPASITGTPKLRA

SEQ ID NO: 1068275 - protein, 17 aa, Mycobacterium
VPVLPSVEEFPYAIRQV

SEQ ID NO: 1068276 - protein, 25 aa, Mycobacterium
VPVSNGWIDIPFTLPTNTVDGGALL

SEQ ID NO: 1068277 - protein, 20 aa, Mycobacterium
VQDDKLLLATRSASRHPAIP

SEQ ID NO: 1068278 - protein, 25 aa, Mycobacterium
VQEDRPLAVSLLTRQCTFDKVNALK

SEQ ID NO: 1068279 - protein, 22 aa, Mycobacterium
VQLRSRPVLAEPLRTLTTRSEE

SEQ ID NO: 1068280 - protein, 25 aa, Mycobacterium
VQNLGKPPRMLVLLHLDGSVERTST

SEQ ID NO: 1068281 - protein, 21 aa, Mycobacterium
VQPGRYWRFVCLSAVALLGHR

SEQ ID NO: 1068282 - protein, 17 aa, Mycobacterium
VQPLPPQQLTGKTVAVV

SEQ ID NO: 1068283 - protein, 22 aa, Mycobacterium
VQRDGICVLVVAPALALADDLA

SEQ ID NO: 1068284 - protein, 27 aa, Mycobacterium
VQRIEYQRLRLPSPDWQVLLAVSVELA

SEQ ID NO: 1068285 - protein, 26 aa, Mycobacterium
VRAAIGLLDLLLASGGELVTVLLGAG

SEQ ID NO: 1068286 - protein, 19 aa, Mycobacterium
VRAIAFEQMLLLAAETPID

SEQ ID NO: 1068287 - protein, 20 aa, Mycobacterium
VRAKYGWTDVSRFAALGVPA

SEQ ID NO: 1068288 - protein, 20 aa, Mycobacterium
VRAVLKIARSALLSGKRTVL

SEQ ID NO: 1068289 - protein, 18 aa, Mycobacterium
VRAYANASAAMNLVRALT

SEQ ID NO: 1068290 - protein, 24 aa, Mycobacterium
VRDRKPLLPPPSQPPGREPVSRRH

SEQ ID NO: 1068291 - protein, 19 aa, Mycobacterium
VRFPNLLARIVAVRHVTVT

SEQ ID NO: 1068292 - protein, 25 aa, Mycobacterium
VRGGKQPRILFATQATARPPTFVLF

SEQ ID NO: 1068293 - protein, 29 aa, Mycobacterium
VRGRSVADALDILRWAPQAASEPVARVIA

SEQ ID NO: 1068294 - protein, 19 aa, Mycobacterium
VRGVPVWASLIALLEDGVP

SEQ ID NO: 1068295 - protein, 24 aa, Mycobacterium
VRIERELPEWLAADVAILGEPTGG

SEQ ID NO: 1068296 - protein, 17 aa, Mycobacterium
VRKQRGLMVAQRAHHLV

SEQ ID NO: 1068297 - protein, 17 aa, Mycobacterium
VRLRGLMSHLVYADQPD

SEQ ID NO: 1068298 - protein, 23 aa, Mycobacterium
VRLYERLFYAGLTRDWQLFALED

SEQ ID NO: 1068299 - protein, 27 aa, Mycobacterium
VRPAKQYRYLLIASPVGAYFKGGINPV

SEQ ID NO: 1068300 - protein, 22 aa, Mycobacterium
VRPDRSTTLALRWLVGFSRQRR

SEQ ID NO: 1068301 - protein, 29 aa, Mycobacterium
VRRCGMVSPTVFWPIPRVYSGLVRVDRYA

SEQ ID NO: 1068302 - protein, 20 aa, Mycobacterium
VRRSNFVYGSTKAGLDGFYL

SEQ ID NO: 1068303 - protein, 26 aa, Mycobacterium
VRSHEVPILVLVWSPRSDACVKLLET

SEQ ID NO: 1068304 - protein, 21 aa, Mycobacterium
VRTPLPVQLPEQMAEQLREAA

SEQ ID NO: 1068305 - protein, 19 aa, Mycobacterium
VRVLLMAALAANLPIADVI

SEQ ID NO: 1068306 - protein, 25 aa, Mycobacterium
VSADAALGLLRRNKIEKLPVVDGHG

SEQ ID NO: 1068307 - protein, 31 aa, Mycobacterium
VSALVVFEVMVRPLIRLSLGKRQPMRRIVQA

SEQ ID NO: 1068308 - protein, 21 aa, Mycobacterium
VSAMRVLQAKLLERKRLEERA

SEQ ID NO: 1068309 - protein, 18 aa, Mycobacterium
VSCAVANFRLLRPQYSLD

SEQ ID NO: 1068310 - protein, 19 aa, Mycobacterium
VSDLAGLWYLTQFVDHWHS

SEQ ID NO: 1068311 - protein, 24 aa, Mycobacterium
VSEMTYLQWLQRYVELTIGEGNST

SEQ ID NO: 1068312 - protein, 27 aa, Mycobacterium
VSGSGPAYFFLLVEALVDAGVAVGLTR

SEQ ID NO: 1068313 - protein, 24 aa, Mycobacterium
VSHVLDRYILAKLAVLRDDLSQAM

SEQ ID NO: 1068314 - protein, 19 aa, Mycobacterium
VSIGFMEYFQSDHAPEAGR

SEQ ID NO: 1068315 - protein, 35 aa, Mycobacterium
VSIQAGIINLLLDLQDRLGLSYLFVSHDLSVIKHL

SEQ ID NO: 1068316 - protein, 23 aa, Mycobacterium
VSKVNGPLLFPLSATSVEQLRAT

SEQ ID NO: 1068317 - protein, 24 aa, Mycobacterium
VSKYYNVMLADCGVGLFDPVTRGV

SEQ ID NO: 1068318 - protein, 22 aa, Mycobacterium
VSLAGRYLVYVPGASSTGISRK

SEQ ID NO: 1068319 - protein, 28 aa, Mycobacterium
VSLLNIAMRVWQPRWAIWSGHVLRSGGL

SEQ ID NO: 1068320 - protein, 17 aa, Mycobacterium
VSLRPRSLREFIGQPRV

SEQ ID NO: 1068321 - protein, 27 aa, Mycobacterium
VSMTMNGAVLPILALYVVAAEEQGVPP

SEQ ID NO: 1068322 - protein, 19 aa, Mycobacterium
VSPPPPDEASRWLARLRAG

SEQ ID NO: 1068323 - protein, 20 aa, Mycobacterium
VSSAWLAQQLRNGLRCALDL

SEQ ID NO: 1068324 - protein, 23 aa, Mycobacterium
VSSDRAGLQALLNVLDEPDPTST

SEQ ID NO: 1068325 - protein, 24 aa, Mycobacterium
VSSKYALVIYAAKRARQINDHYNQ

SEQ ID NO: 1068326 - protein, 18 aa, Mycobacterium
VSSREPYRRLINQGYIQA

SEQ ID NO: 1068327 - protein, 23 aa, Mycobacterium
VSTMALKRFAFRLGDIWVQQVKT

SEQ ID NO: 1068328 - protein, 24 aa, Mycobacterium
VSTRLDRIISWLICADVDVMAMQE

SEQ ID NO: 1068329 - protein, 25 aa, Mycobacterium
VSVLAYPRVVWVAGGLLKGASVDAE

SEQ ID NO: 1068330 - protein, 22 aa, Mycobacterium
VTAANILRYIAGHPTKSPGGTR

SEQ ID NO: 1068331 - protein, 21 aa, Mycobacterium
VTIPVSFTELALGSTLSVPTL

SEQ ID NO: 1068332 - protein, 19 aa, Mycobacterium
VTITYLESKLPAGTPVVRA

SEQ ID NO: 1068333 - protein, 18 aa, Mycobacterium
VTLAIEAAGFKPGADVAL

SEQ ID NO: 1068334 - protein, 17 aa, Mycobacterium
VTNATEIMHIEQALMGC

SEQ ID NO: 1068335 - protein, 19 aa, Mycobacterium
VTRIILTRPAVEAGERLGF

SEQ ID NO: 1068336 - protein, 19 aa, Mycobacterium
VTRSRWFFYDVWATRSTSH

SEQ ID NO: 1068337 - protein, 23 aa, Mycobacterium
VTSIMTRRLLMEKVFVDWSQNRG

SEQ ID NO: 1068338 - protein, 19 aa, Mycobacterium
VTSLLRFAGGLHIVGGRVV

SEQ ID NO: 1068339 - protein, 28 aa, Mycobacterium
VTSSPIKGTLPLAAWPSALQASAKEVAE

SEQ ID NO: 1068340 - protein, 25 aa, Mycobacterium
VTTAPTICIMPFGVDNHVDAEWLKL

SEQ ID NO: 1068341 - protein, 19 aa, Mycobacterium
VTTGWREWSLRCAALATHP

SEQ ID NO: 1068342 - protein, 17 aa, Mycobacterium
VTVVSYTWAMLRELVDD

SEQ ID NO: 1068343 - protein, 17 aa, Mycobacterium
VVAAARWARSKLDYIPG

SEQ ID NO: 1068344 - protein, 22 aa, Mycobacterium
VVADLPFGSYEPGPTAALAVAT

SEQ ID NO: 1068345 - protein, 18 aa, Mycobacterium
VVADWLNRHGWRATAQSA

SEQ ID NO: 1068346 - protein, 26 aa, Mycobacterium
VVAKRGWRHWVHTVTRINLGLSPDER

SEQ ID NO: 1068347 - protein, 25 aa, Mycobacterium
VVASDAFFPFADGLQTLAAAGVTAI

SEQ ID NO: 1068348 - protein, 27 aa, Mycobacterium
VVASEAPPWVGPLDVLIVAGDDPGDPA

SEQ ID NO: 1068349 - protein, 25 aa, Mycobacterium
VVCDGGDLLLLPSCIRHWCDMGVHP

SEQ ID NO: 1068350 - protein, 27 aa, Mycobacterium
VVDALDQYLRLPLRQVMWGDDEGLLNS

SEQ ID NO: 1068351 - protein, 30 aa, Mycobacterium
VVDLDLNLKLHPARYRQLLQHILAHVADGR

SEQ ID NO: 1068352 - protein, 20 aa, Mycobacterium
VVEETLRYDPAIHLIGRVAA

SEQ ID NO: 1068353 - protein, 17 aa, Mycobacterium
VVELANLAKARGVDQPP

SEQ ID NO: 1068354 - protein, 17 aa, Mycobacterium
VVELSLGRLVRDEWCGI

SEQ ID NO: 1068355 - protein, 24 aa, Mycobacterium
VVETMVALVLARAALRKFGGDSLG

SEQ ID NO: 1068356 - protein, 18 aa, Mycobacterium
VVEYIKAYVIQMFLPGSP

SEQ ID NO: 1068357 - protein, 28 aa, Mycobacterium
VVGGMGGLGFVFARWLAEQGAGLIVLNG

SEQ ID NO: 1068358 - protein, 26 aa, Mycobacterium
VVGGVRLPHGNGETIRLARGASLSDF

SEQ ID NO: 1068359 - protein, 27 aa, Mycobacterium
VVGIGLPLTRSLLSRAGLSIAAMWAAN

SEQ ID NO: 1068360 - protein, 17 aa, Mycobacterium
VVGLGNPGKNYGRTRHN

SEQ ID NO: 1068361 - protein, 19 aa, Mycobacterium
VVGVFAVELFETADGALLV

SEQ ID NO: 1068362 - protein, 22 aa, Mycobacterium
VVHPPFRWQRRYAEGFSDQVAE

SEQ ID NO: 1068363 - protein, 18 aa, Mycobacterium
VVIDVCGDGLHLIETATQ

SEQ ID NO: 1068364 - protein, 18 aa, Mycobacterium
VVIDYFYTHRPSLPTGIA

SEQ ID NO: 1068365 - protein, 23 aa, Mycobacterium
VVIIGRGVTVGRPLGLLLTRRSE

SEQ ID NO: 1068366 - protein, 25 aa, Mycobacterium
VVITMPRTWPLRPVRGLWSETRIYM

SEQ ID NO: 1068367 - protein, 36 aa, Mycobacterium
VVIYGDKSNWWAAYALWVFTLFGHPDVRLLNGGRDL

SEQ ID NO: 1068368 - protein, 18 aa, Mycobacterium
VVKMPRWSSMTQGSAGRP

SEQ ID NO: 1068369 - protein, 34 aa, Mycobacterium
VVNDYYDRSGLWPYLEKLGFYLVGYGCTTCIGNS

SEQ ID NO: 1068370 - protein, 21 aa, Mycobacterium
VVNSIRKTLKAVAVKSPFFGD

SEQ ID NO: 1068371 - protein, 18 aa, Mycobacterium
VVNVGDISRLFPEGGTIS

SEQ ID NO: 1068372 - protein, 23 aa, Mycobacterium
VVPYPKVVLVTGACRFLGGYLTA

SEQ ID NO: 1068373 - protein, 20 aa, Mycobacterium
VVQSNYGPWKWDGVRRAGVS

SEQ ID NO: 1068374 - protein, 17 aa, Mycobacterium
VVQSQRVVPPWSTEQDH

SEQ ID NO: 1068375 - protein, 17 aa, Mycobacterium
VVRLFSDPAQLAAMTAA

SEQ ID NO: 1068376 - protein, 25 aa, Mycobacterium
VVRRGDTPLPVRTPLPVQLPEQMAE

SEQ ID NO: 1068377 - protein, 17 aa, Mycobacterium
VVRWIPPTTQDEELAVN

SEQ ID NO: 1068378 - protein, 26 aa, Mycobacterium
VVSHVTPIKMLLRLALDAGAGILYRL

SEQ ID NO: 1068379 - protein, 18 aa, Mycobacterium
VVTINDYLARRDAEWMGP

SEQ ID NO: 1068380 - protein, 29 aa, Mycobacterium
VVTNFPRLTRFHTATLFSLTLQELLTNRN

SEQ ID NO: 1068381 - protein, 25 aa, Mycobacterium
VVVDDSLVYLALNKPRGMYSTMSDD

SEQ ID NO: 1068382 - protein, 18 aa, Mycobacterium
VVVGENFTFGKKAAGNVI

SEQ ID NO: 1068383 - protein, 24 aa, Mycobacterium
VVVHAGDWVSPKLLDELESRAAQL

SEQ ID NO: 1068384 - protein, 26 aa, Mycobacterium
VVVMPLYHGHGLIAALLSTLASGGVV

SEQ ID NO: 1068385 - protein, 20 aa, Mycobacterium
VVVSIFVNPLQFGAAEDLDT

SEQ ID NO: 1068386 - protein, 17 aa, Mycobacterium
VWEPRNRMPVFPVPVGH

SEQ ID NO: 1068387 - protein, 18 aa, Mycobacterium
VWIIGFLPESIISSNKRW

SEQ ID NO: 1068388 - protein, 25 aa, Mycobacterium
VYARVNPFGFIETPYRKVVDGVVSD

SEQ ID NO: 1068389 - protein, 20 aa, Mycobacterium
VYDIAAAWARRFLDGLPHAL

SEQ ID NO: 1068390 - protein, 27 aa, Mycobacterium
VYEIDLLRPVIDLVATRAPRPYDPENE

SEQ ID NO: 1068391 - protein, 20 aa, Mycobacterium
VYEPVVKITIIAPSEFIGTI

SEQ ID NO: 1068392 - protein, 17 aa, Mycobacterium
VYFTTACRWCDQALPQR

SEQ ID NO: 1068393 - protein, 20 aa, Mycobacterium
VYGGTFRLIDKVFTQWNVDY

SEQ ID NO: 1068394 - protein, 17 aa, Mycobacterium
VYMYMVGGELLRAEIRY

SEQ ID NO: 1068395 - protein, 22 aa, Mycobacterium
VYQGIGYAAMVFAALAMGDVAA

SEQ ID NO: 1068396 - protein, 23 aa, Mycobacterium
WAARVSLAHALIGWTRGTGLMGH

SEQ ID NO: 1068397 - protein, 26 aa, Mycobacterium
WAGYCRPGYRLGIVGDVVLVVAADAV

SEQ ID NO: 1068398 - protein, 19 aa, Mycobacterium
WAIAYKYLPEEAQTKLLDI

SEQ ID NO: 1068399 - protein, 29 aa, Mycobacterium
WAPGELVAKLTYFGLYALQHRGQEAAGIA

SEQ ID NO: 1068400 - protein, 25 aa, Mycobacterium
WATALLHPRLVRAIALINSPHPAAL

SEQ ID NO: 1068401 - protein, 21 aa, Mycobacterium
WATQLRIMQAQLLAKIAAAVG

SEQ ID NO: 1068402 - protein, 26 aa, Mycobacterium
WATSRSIFILILRVAAMIPTFPHAVV

SEQ ID NO: 1068403 - protein, 21 aa, Mycobacterium
WDLVASFKQIGIATLLTTQYL

SEQ ID NO: 1068404 - protein, 26 aa, Mycobacterium
WDTRIATGPLNIWIKAVVAATPPPVR

SEQ ID NO: 1068405 - protein, 18 aa, Mycobacterium
WDVIGETGIGFCLDTCHA

SEQ ID NO: 1068406 - protein, 19 aa, Mycobacterium
WEAWIDSTVTSIPLLNRTI

SEQ ID NO: 1068407 - protein, 18 aa, Mycobacterium
WEAWSPYISATAVADGLP

SEQ ID NO: 1068408 - protein, 27 aa, Mycobacterium
WEGDDEGKWFWFEGNFGAYEENKVERL

SEQ ID NO: 1068409 - protein, 17 aa, Mycobacterium
WFDPAGLFLAFGDSSSN

SEQ ID NO: 1068410 - protein, 20 aa, Mycobacterium
WFDTLDRLLPAPLPAWLRHP

SEQ ID NO: 1068411 - protein, 17 aa, Mycobacterium
WFIGIDFSNEAVAIHTA

SEQ ID NO: 1068412 - protein, 18 aa, Mycobacterium
WFQLYMWRDRDRSMALVE

SEQ ID NO: 1068413 - protein, 19 aa, Mycobacterium
WGPMPDLPEALPRFTREIR

SEQ ID NO: 1068414 - protein, 17 aa, Mycobacterium
WGQLSTVVLLLPHGHEG

SEQ ID NO: 1068415 - protein, 23 aa, Mycobacterium
WGSDAYTPLAWWGSSTQRVRLGT

SEQ ID NO: 1068416 - protein, 17 aa, Mycobacterium
WGVITENSCWYLVGHDC

SEQ ID NO: 1068417 - protein, 21 aa, Mycobacterium
WHAESSWAARVSLAHALIGWT

SEQ ID NO: 1068418 - protein, 19 aa, Mycobacterium
WHQYWIDTRMQWYVELGID

SEQ ID NO: 1068419 - protein, 19 aa, Mycobacterium
WIAQHDTNLALLPVGYADG

SEQ ID NO: 1068420 - protein, 19 aa, Mycobacterium
WIKDLPPYETAFDGDLVDA

SEQ ID NO: 1068421 - protein, 20 aa, Mycobacterium
WILNGFKCWITNGGKSTWYT

SEQ ID NO: 1068422 - protein, 17 aa, Mycobacterium
WITVLADGDTVLARDII

SEQ ID NO: 1068423 - protein, 19 aa, Mycobacterium
WKYIVALFNAKLDENADPK

SEQ ID NO: 1068424 - protein, 17 aa, Mycobacterium
WLAVLTELKNRGVADIF

SEQ ID NO: 1068425 - protein, 17 aa, Mycobacterium
WLMLGEANKYFSSQQPW

SEQ ID NO: 1068426 - protein, 18 aa, Mycobacterium
WLNIPTSLPSQLVDTRIQ

SEQ ID NO: 1068427 - protein, 19 aa, Mycobacterium
WLVGLLFPDNDGCAGHSDG

SEQ ID NO: 1068428 - protein, 18 aa, Mycobacterium
WMIRCVVNGPLETIDVLS

SEQ ID NO: 1068429 - protein, 23 aa, Mycobacterium
WNAPLFLTVNNLGPTLLTGCTRV

SEQ ID NO: 1068430 - protein, 20 aa, Mycobacterium
WNEITPCNLSLDRLAKAVKE

SEQ ID NO: 1068431 - protein, 20 aa, Mycobacterium
WNRFAIASRIILDDVQIGFD

SEQ ID NO: 1068432 - protein, 17 aa, Mycobacterium
WPPALRSAGFDPSARTA

SEQ ID NO: 1068433 - protein, 19 aa, Mycobacterium
WQAGQPPRLGVHRLIFVLL

SEQ ID NO: 1068434 - protein, 37 aa, Mycobacterium
WQEIAGLPPERIQRRGMADNYWSMGIPGPCGPSSEIY

SEQ ID NO: 1068435 - protein, 20 aa, Mycobacterium
WQHTRHWISAMSAAYHRADT

SEQ ID NO: 1068436 - protein, 19 aa, Mycobacterium
WQVITYEGYAPNGVAVLIE

SEQ ID NO: 1068437 - protein, 18 aa, Mycobacterium
WQWVGQELPQFSTAPTDH

SEQ ID NO: 1068438 - protein, 24 aa, Mycobacterium
WRDGEWYTARLRPGPLRQAERRTV

SEQ ID NO: 1068439 - protein, 28 aa, Mycobacterium
WRGEPLLEYLRKMVFWSEVTPGSADMAM

SEQ ID NO: 1068440 - protein, 19 aa, Mycobacterium
WRNGCMSLLKRLIRAHVHG

SEQ ID NO: 1068441 - protein, 22 aa, Mycobacterium
WSAYPRILDFAAFRSIADEVGA

SEQ ID NO: 1068442 - protein, 22 aa, Mycobacterium
WSGTEPSTLFRMNKVFGVGSSE

SEQ ID NO: 1068443 - protein, 17 aa, Mycobacterium
WSRWLTGRAVQLGSTGV

SEQ ID NO: 1068444 - protein, 22 aa, Mycobacterium
WSTDVPALTVSLRGLVDCVVEV

SEQ ID NO: 1068445 - protein, 17 aa, Mycobacterium
WTTFVICDARHAVTLSP

SEQ ID NO: 1068446 - protein, 18 aa, Mycobacterium
WVGLFHRIARSRINYARL

SEQ ID NO: 1068447 - protein, 17 aa, Mycobacterium
WVVITNYKRIRISSIEV

SEQ ID NO: 1068448 - protein, 17 aa, Mycobacterium
WYLELAKAQLADGLTHT

SEQ ID NO: 1068449 - protein, 17 aa, Mycobacterium
YAALHRAGLVNLPISMD

SEQ ID NO: 1068450 - protein, 18 aa, Mycobacterium
YAARAQLTPLVFEGTSFG

SEQ ID NO: 1068451 - protein, 25 aa, Mycobacterium
YAASMSAFLPPFPGIDDVRALANRV

SEQ ID NO: 1068452 - protein, 25 aa, Mycobacterium
YAAWRSTYRWRPGVAVLLINKTDQR

SEQ ID NO: 1068453 - protein, 25 aa, Mycobacterium
YADFRAHNHWWNGPWSGDVWKSIVH

SEQ ID NO: 1068454 - protein, 30 aa, Mycobacterium
YAHPERLVTGDWLYFHLGKPGLAIVESDEN

SEQ ID NO: 1068455 - protein, 20 aa, Mycobacterium
YAIRLYFCDIDPAELIDLFN

SEQ ID NO: 1068456 - protein, 18 aa, Mycobacterium
YARLLQHTVVVLNAIQKT

SEQ ID NO: 1068457 - protein, 20 aa, Mycobacterium
YARVPLIVLSANRPYELLGT

SEQ ID NO: 1068458 - protein, 24 aa, Mycobacterium
YARYWREAFRLPTMNPHTVAKQVE

SEQ ID NO: 1068459 - protein, 25 aa, Mycobacterium
YCHLIKSPFTVVPIWRVADVVGQSS

SEQ ID NO: 1068460 - protein, 26 aa, Mycobacterium
YCVSGNSLVRLLFGKSIRIGDIVTGA

SEQ ID NO: 1068461 - protein, 26 aa, Mycobacterium
YDCARLRFILTAQRDHYLPLKVIRAQ

SEQ ID NO: 1068462 - protein, 19 aa, Mycobacterium
YDDFFKRCFNIMPSDGRMT

SEQ ID NO: 1068463 - protein, 25 aa, Mycobacterium
YDDRFLVFYQPVIYIGLAVPEDALD

SEQ ID NO: 1068464 - protein, 26 aa, Mycobacterium
YDETRRLFAGGWLGGRRFDSSFGDFG

SEQ ID NO: 1068465 - protein, 27 aa, Mycobacterium
YDGRVQEPMVLPSRFPNLLANGSGGIA

SEQ ID NO: 1068466 - protein, 28 aa, Mycobacterium
YDISDDFFALFLDPTWVYTCAYFERDDM

SEQ ID NO: 1068467 - protein, 17 aa, Mycobacterium
YDMLRWCGHSRLSNTQW

SEQ ID NO: 1068468 - protein, 27 aa, Mycobacterium
YDRYMKYLTGWVFLPQRHPQRGEFHLD

SEQ ID NO: 1068469 - protein, 20 aa, Mycobacterium
YDSFFKMCYDVLPDDGRMLL

SEQ ID NO: 1068470 - protein, 21 aa, Mycobacterium
YDWDVWLNPYIPLDPQLLARS

SEQ ID NO: 1068471 - protein, 27 aa, Mycobacterium
YEDRSFTFALKTPPAAKLLLDAAGVGK

SEQ ID NO: 1068472 - protein, 35 aa, Mycobacterium
YEPYGTVLIIGAWNYPFYLTLVPAVGAIAAGNTMV

SEQ ID NO: 1068473 - protein, 22 aa, Mycobacterium
YEVHATFAPLVEDASPKRCTIA

SEQ ID NO: 1068474 - protein, 17 aa, Mycobacterium
YEWVLGPSMTYTCAVYP

SEQ ID NO: 1068475 - protein, 17 aa, Mycobacterium
YFCVGPCWPTPTKPDRP

SEQ ID NO: 1068476 - protein, 22 aa, Mycobacterium
YFEVLHELKLIVDLMYEGGIAR

SEQ ID NO: 1068477 - protein, 19 aa, Mycobacterium
YGAMQLLVPVLLNTNENPH

SEQ ID NO: 1068478 - protein, 27 aa, Mycobacterium
YGDTRLGLFPFRRNLSLYAVDLALLTY

SEQ ID NO: 1068479 - protein, 22 aa, Mycobacterium
YGGRTLIKDLSFTLPRNGIVGI

SEQ ID NO: 1068480 - protein, 21 aa, Mycobacterium
YGLPMDADIVMDVRFLPNPHW

SEQ ID NO: 1068481 - protein, 23 aa, Mycobacterium
YGLSNEFFALFQAPTRTYSCACF

SEQ ID NO: 1068482 - protein, 34 aa, Mycobacterium
YGNTRLGLFPFRRGLTFYYLDLALMSVTQPDRVR

SEQ ID NO: 1068483 - protein, 20 aa, Mycobacterium
YGPWKWDGVRRAGVSSFGVG

SEQ ID NO: 1068484 - protein, 17 aa, Mycobacterium
YGQANSISRIVPGWLGQ

SEQ ID NO: 1068485 - protein, 19 aa, Mycobacterium
YGQLAWSVRCDPRVIVVER

SEQ ID NO: 1068486 - protein, 27 aa, Mycobacterium
YGSASLLPITWAYIRMMGADGLRTASL

SEQ ID NO: 1068487 - protein, 17 aa, Mycobacterium
YGTMLFVGTAAPGITDI

SEQ ID NO: 1068488 - protein, 25 aa, Mycobacterium
YGVDAQQLFGFLRENNRLSSLVTDA

SEQ ID NO: 1068489 - protein, 24 aa, Mycobacterium
YHQDRGPDLIYIDLHLVHEVTSPQ

SEQ ID NO: 1068490 - protein, 19 aa, Mycobacterium
YHSALKDGVEARRFWRSEY

SEQ ID NO: 1068491 - protein, 18 aa, Mycobacterium
YIDTVEESLEFLNRLGGP

SEQ ID NO: 1068492 - protein, 17 aa, Mycobacterium
YIPYDLSENRALRPGGG

SEQ ID NO: 1068493 - protein, 18 aa, Mycobacterium
YIRATLGSYRWLRPSGRC

SEQ ID NO: 1068494 - protein, 21 aa, Mycobacterium
YITWRATFLLPADAAIELFAD

SEQ ID NO: 1068495 - protein, 21 aa, Mycobacterium
YIVTGGLTGLGLFLGTEMAAA

SEQ ID NO: 1068496 - protein, 19 aa, Mycobacterium
YLEFVVVDLKRRLDLVTKG

SEQ ID NO: 1068497 - protein, 19 aa, Mycobacterium
YLESKLPAGTPVVRAMPNA

SEQ ID NO: 1068498 - protein, 26 aa, Mycobacterium
YLNHWGFPKFAMICCTLLNRLEGDQV

SEQ ID NO: 1068499 - protein, 19 aa, Mycobacterium
YLNWEARSWRLNDAGEYQE

SEQ ID NO: 1068500 - protein, 17 aa, Mycobacterium
YLRTLVDVGLGYVRLGQ

SEQ ID NO: 1068501 - protein, 21 aa, Mycobacterium
YLTLYPVAEYPATAPPGVLTE

SEQ ID NO: 1068502 - protein, 19 aa, Mycobacterium
YMDERLVGMIPRIWRRKAN

SEQ ID NO: 1068503 - protein, 20 aa, Mycobacterium
YNELCWAPKHANFDEGLRAT

SEQ ID NO: 1068504 - protein, 17 aa, Mycobacterium
YNMTINLVHWMSPERAH

SEQ ID NO: 1068505 - protein, 18 aa, Mycobacterium
YNPRLRRAYRIDDGIPVL

SEQ ID NO: 1068506 - protein, 23 aa, Mycobacterium
YNSKWPMVFLIAASEFVVVATDV

SEQ ID NO: 1068507 - protein, 19 aa, Mycobacterium
YNTPAICTLALLAEQLDWL

SEQ ID NO: 1068508 - protein, 30 aa, Mycobacterium
YPGKPWKVPKFYWSVFALSAFEAGMNALQG

SEQ ID NO: 1068509 - protein, 21 aa, Mycobacterium
YPGTIASVAAVALYIGEVLGA

SEQ ID NO: 1068510 - protein, 17 aa, Mycobacterium
YPHFFELKRTRTEPPQF

SEQ ID NO: 1068511 - protein, 25 aa, Mycobacterium
YPKTEFNVVLPWTKAVVLNLGVKTQ

SEQ ID NO: 1068512 - protein, 19 aa, Mycobacterium
YPVELDTLFNLFAGAAESF

SEQ ID NO: 1068513 - protein, 30 aa, Mycobacterium
YQADLWFDPLCPWCWITSRWILEVEKVRDV

SEQ ID NO: 1068514 - protein, 24 aa, Mycobacterium
YQEGVLKLSIPVAERAKPRKISVD

SEQ ID NO: 1068515 - protein, 26 aa, Mycobacterium
YQETSLRETGFWRFVSDPYDPTESQA

SEQ ID NO: 1068516 - protein, 18 aa, Mycobacterium
YQHQVRCGLLGSSWTRKE

SEQ ID NO: 1068517 - protein, 18 aa, Mycobacterium
YQRLLPADVLAIVTAARA

SEQ ID NO: 1068518 - protein, 19 aa, Mycobacterium
YRAFSGPLHRVGAAVLTPP

SEQ ID NO: 1068519 - protein, 19 aa, Mycobacterium
YRCGFLGLLHIDITRERLE

SEQ ID NO: 1068520 - protein, 34 aa, Mycobacterium; identical to SEQ ID NO: 224665

SEQ ID NO: 1068521 - protein, 25 aa, Mycobacterium
YRGRYGLSVAALARWHRPRLEVLAD

SEQ ID NO: 1068522 - protein, 22 aa, Mycobacterium
YRIGVDFVPYLYLSDLQDQRID

SEQ ID NO: 1068523 - protein, 17 aa, Mycobacterium
YRLGTFSALPHLSAHSC

SEQ ID NO: 1068524 - protein, 17 aa, Mycobacterium
YRLLRPVSVLTEFRSWP

SEQ ID NO: 1068525 - protein, 18 aa, Mycobacterium
YRTVTFILVTHYADGITK

SEQ ID NO: 1068526 - protein, 17 aa, Mycobacterium
YSARELIARIRAVLRRG

SEQ ID NO: 1068527 - protein, 24 aa, Mycobacterium
YSEAIALARLGWAALAVGTSHAVL

SEQ ID NO: 1068528 - protein, 28 aa, Mycobacterium
YSEKPGIHYIFWDQWPSIQVLTHCGRPV

SEQ ID NO: 1068529 - protein, 28 aa, Mycobacterium
YSGDDALNLPWLAVGAIGFISVISHLAA

SEQ ID NO: 1068530 - protein, 20 aa, Mycobacterium
YSIEDILLQDLLLEAVEDTV

SEQ ID NO: 1068531 - protein, 24 aa, Mycobacterium
YTAAPAIHRILLELASTQSFRSKR

SEQ ID NO: 1068532 - protein, 17 aa, Mycobacterium
YTALLSAHRVERVRMVA

SEQ ID NO: 1068533 - protein, 18 aa, Mycobacterium
YTQLPTNGMLFIGTSEGQ

SEQ ID NO: 1068534 - protein, 22 aa, Mycobacterium
YTQVLAHWPEVIASATPTAAGR

SEQ ID NO: 1068535 - protein, 31 aa, Mycobacterium
YTSHDIRVLYGFKRLAWWPYGVVMKQVNVVF

SEQ ID NO: 1068536 - protein, 19 aa, Mycobacterium
YTTLWKSDTAPLLAVFSIV

SEQ ID NO: 1068537 - protein, 18 aa, Mycobacterium
YTYLVPTTRPRYQVTETP

SEQ ID NO: 1068538 - protein, 26 aa, Mycobacterium
YTYVPTMMEYYLREKPLLANVDTLRC

SEQ ID NO: 1068539 - protein, 21 aa, Mycobacterium
YVDATYWRDMGTPEDFVRGSA

SEQ ID NO: 1068540 - protein, 29 aa, Mycobacterium
YVEDWDLDALWSALGTLYPVGIKHESLTH

SEQ ID NO: 1068541 - protein, 18 aa, Mycobacterium
YVEYIRYSLPQDSPELVR

SEQ ID NO: 1068542 - protein, 24 aa, Mycobacterium
YVHNLVHGLILAAEHLVPGGTAPG

SEQ ID NO: 1068543 - protein, 19 aa, Mycobacterium
YVQLWPHRHGTDAMFAAVL

SEQ ID NO: 1068544 - protein, 17 aa, Mycobacterium
YVQYAHARLSALARNAA

SEQ ID NO: 1068545 - protein, 20 aa, Mycobacterium
YVRVPYRARVPMTRAALMHR

SEQ ID NO: 1068546 - protein, 17 aa, Mycobacterium
YVVLAERTAAIIAGPPR

SEQ ID NO: 1068547 - protein, 18 aa, Mycobacterium
YWGTPIPVWKSDDPDYPR

SEQ ID NO: 1068548 - protein, 17 aa, Mycobacterium
YWPRWLVDGFGGLPAGT

SEQ ID NO: 1068549 - protein, 23 aa, Mycobacterium
YWVDHIRRPVRFADSVASLEAMG

SEQ ID NO: 1068550 - protein, 20 aa, Mycobacterium
YYDIVHSHYWLSGQVGWLAR

SEQ ID NO: 1068551 - protein, 26 aa, Mycobacterium
YYPARPIDLKLPPTSKLAPVIPAAQV

SEQ ID NO: 1068552 - protein, 23 aa, Mycobacterium
AAAAALYVTWLSATGLQAAQTAG

SEQ ID NO: 1068553 - protein, 21 aa, Mycobacterium
AAAALAKKWLGLRYTMNVIAL

SEQ ID NO: 1068554 - protein, 23 aa, Mycobacterium
AAAAMLVSAVPALLRLEEPTGIY

SEQ ID NO: 1068555 - protein, 29 aa, Mycobacterium
AAAANPPMIRYPIPPMIHGATQSATWMSI

SEQ ID NO: 1068556 - protein, 17 aa, Mycobacterium
AAAAPAAALFNLPTVNT

SEQ ID NO: 1068557 - protein, 19 aa, Mycobacterium
AAAAPITGVLAAGADEISA

SEQ ID NO: 1068558 - protein, 27 aa, Mycobacterium
AAAAVGPFTYLRPGTVLGTGGKLGAFV

SEQ ID NO: 1068559 - protein, 24 aa, Mycobacterium
AAAAVTFVGSLSLAIGLQLTPERH

SEQ ID NO: 1068560 - protein, 30 aa, Mycobacterium; identical to SEQ ID NO: 786578

SEQ ID NO: 1068561 - protein, 23 aa, Mycobacterium
AAAETLFDITLMPPSAPGHDAIS

SEQ ID NO: 1068562 - protein, 21 aa, Mycobacterium
AAAFGFWADKAPRYLADERIH

SEQ ID NO: 1068563 - protein, 17 aa, Mycobacterium
AAAGDIPDWAVFYLLPV

SEQ ID NO: 1068564 - protein, 25 aa, Mycobacterium
AAAGTPPVRPMRRSRRPPAEMAATG

SEQ ID NO: 1068565 - protein, 17 aa, Mycobacterium
AAAIPTSAIAAAAADEI

SEQ ID NO: 1068566 - protein, 18 aa, Mycobacterium
AAALRERLDPTRPPHVGV

SEQ ID NO: 1068567 - protein, 17 aa, Mycobacterium
AAALRRELLRDGQAFYV

SEQ ID NO: 1068568 - protein, 25 aa, Mycobacterium
AAAMALHALGPQWALVKGGHLRSSD

SEQ ID NO: 1068569 - protein, 23 aa, Mycobacterium
AAAMNALVSLTLAVAYAGPDPQT

SEQ ID NO: 1068570 - protein, 27 aa, Mycobacterium
AAAPGASYFVLVFAKGAFPAALETKPN

SEQ ID NO: 1068571 - protein, 18 aa, Mycobacterium
AAAPIPTSSWPQLLGRLT

SEQ ID NO: 1068572 - protein, 24 aa, Mycobacterium
AAAPQLWGGFAQHLSPINDTLSMI

SEQ ID NO: 1068573 - protein, 24 aa, Mycobacterium
AAAQAILGLLPQFSGAAGLGHGIT

SEQ ID NO: 1068574 - protein, 31 aa, Mycobacterium; identical to SEQ ID NO: 786715

SEQ ID NO: 1068575 - protein, 27 aa, Mycobacterium
AAAQVQLPPPGAPISAPISPGRLQFGD

SEQ ID NO: 1068576 - protein, 23 aa, Mycobacterium
AAARFRRPGAPPSATPSSSRRYD

SEQ ID NO: 1068577 - protein, 23 aa, Mycobacterium
AAARLVVREELEPALRAVPVEEA

SEQ ID NO: 1068578 - protein, 21 aa, Mycobacterium
AAARPLGIPVIVLAGQVDLDK

SEQ ID NO: 1068579 - protein, 17 aa, Mycobacterium
AAARRADIPFGATVAVI

SEQ ID NO: 1068580 - protein, 25 aa, Mycobacterium
AAASLLAPFSLPPQTSDPSGLARQA

SEQ ID NO: 1068581 - protein, 27 aa, Mycobacterium
AAATEPFLDPLVFTGGRLKAGGADAAQ

SEQ ID NO: 1068582 - protein, 23 aa, Mycobacterium
AAAVAILQAWLDQRRTLAGGRAD

SEQ ID NO: 1068583 - protein, 17 aa, Mycobacterium
AAAVDVTLLGRFYERFA

SEQ ID NO: 1068584 - protein, 19 aa, Mycobacterium
AAAVLPYRQFHDVAENFRY

SEQ ID NO: 1068585 - protein, 23 aa, Mycobacterium
AAAVWLQALADLVETLLPTIQAQ

SEQ ID NO: 1068586 - protein, 20 aa, Mycobacterium
AAAVWTAIRERRARRPAWRP

SEQ ID NO: 1068587 - protein, 17 aa, Mycobacterium
AACEPVAGYLTLRYVQG

SEQ ID NO: 1068588 - protein, 43 aa, Mycobacterium
AACFEAQAEAYRTFGAHTAALHDQIVRALTAGAGGYSAVEAAN

SEQ ID NO: 1068589 - protein, 21 aa, Mycobacterium
AACGLRRLLPMYSSVEAALSP

SEQ ID NO: 1068590 - protein, 25 aa, Mycobacterium
AACTFTFAFTVAEPGWTMFMVSHFH

SEQ ID NO: 1068591 - protein, 17 aa, Mycobacterium
AACWEARRWLGRPTVEH

SEQ ID NO: 1068592 - protein, 23 aa, Mycobacterium
AADDWLALLEAFDQPHRPGIVRA

SEQ ID NO: 1068593 - protein, 24 aa, Mycobacterium
AADEVSLAIAGLFSAHAKQYQAFS

SEQ ID NO: 1068594 - protein, 26 aa, Mycobacterium
AADGSLPPVIFQLLHQPVLDDRPTAS

SEQ ID NO: 1068595 - protein, 20 aa, Mycobacterium
AADIALLRRAAAGGVDIIDV

SEQ ID NO: 1068596 - protein, 19 aa, Mycobacterium
AADIHFQPKYIFAAIDAGC

SEQ ID NO: 1068597 - protein, 36 aa, Mycobacterium; identical to SEQ ID NO: 112941

SEQ ID NO: 1068598 - protein, 33 aa, Mycobacterium; identical to SEQ ID NO: 786857

SEQ ID NO: 1068599 - protein, 31 aa, Mycobacterium
AADLHNQISRTMELPVKMASKAATADTAATS

SEQ ID NO: 1068600 - protein, 18 aa, Mycobacterium
AADLVRAQLQLPADWEPL

SEQ ID NO: 1068601 - protein, 17 aa, Mycobacterium
AADPAVAAIAAHREQSA

SEQ ID NO: 1068602 - protein, 27 aa, Mycobacterium
AADPGIATYLDLPLFAGRPARASRGLE

SEQ ID NO: 1068603 - protein, 28 aa, Mycobacterium
AADPLDPRWLLDTLGLTDAARTTYRRLS

SEQ ID NO: 1068604 - protein, 26 aa, Mycobacterium
AADPLGAVAPVTRGAARPAVAPGPTR

SEQ ID NO: 1068605 - protein, 18 aa, Mycobacterium
AADPPILLMDEAFSAVDL

SEQ ID NO: 1068606 - protein, 27 aa, Mycobacterium
AADPSCGWGWLPYRAAPERAVAAVADF

SEQ ID NO: 1068607 - protein, 29 aa, Mycobacterium
AADTHALIVLAVPMPALPAMLAHIRELAP

SEQ ID NO: 1068608 - protein, 18 aa, Mycobacterium
AADVLGSWPWPALGSVTA

SEQ ID NO: 1068609 - protein, 19 aa, Mycobacterium
AAEAAFVFAMIAVDLSRLA

SEQ ID NO: 1068610 - protein, 27 aa, Mycobacterium
AAEAANASPLLGISQDMLNAVNGPTEA

SEQ ID NO: 1068611 - protein, 39 aa, Mycobacterium
AAEAANTGPLQQLLEAINSPVQALTGRPLIGNGANGAPG

SEQ ID NO: 1068612 - protein, 25 aa, Mycobacterium
AAEGRLKGILKYYDAPIVSSDIVTD

SEQ ID NO: 1068613 - protein, 25 aa, Mycobacterium
AAEGWQPIFYLPEKAHDVWGQALAA

SEQ ID NO: 1068614 - protein, 20 aa, Mycobacterium
AAELGVVGVLAVELFETTDG

SEQ ID NO: 1068615 - protein, 24 aa, Mycobacterium
AAELMGIQIPRFCDHPLLEPVGAC

SEQ ID NO: 1068616 - protein, 42 aa, Mycobacterium
AAELPYIAELLDLRPGQTRWRLAVEKVLRGVGLRLLVPDQHW

SEQ ID NO: 1068617 - protein, 24 aa, Mycobacterium
AAEQLTPFHRMLAGLSGRSVSSAV

SEQ ID NO: 1068618 - protein, 24 aa, Mycobacterium
AAERIAPVITPTPLQLCERLSDIT

SEQ ID NO: 1068619 - protein, 27 aa, Mycobacterium
AAESMVAAVLPFASWLSATASVAEQAG

SEQ ID NO: 1068620 - protein, 18 aa, Mycobacterium
AAEVAGIGSAVSTASRAA

SEQ ID NO: 1068621 - protein, 24 aa, Mycobacterium
AAFDRLFGALDWLSDRLASRRYLV

SEQ ID NO: 1068622 - protein, 27 aa, Mycobacterium
AAFDTELFGHWWYEGPTWLQRVLRALP

SEQ ID NO: 1068623 - protein, 18 aa, Mycobacterium
AAFFERSYDILPDDGRML

SEQ ID NO: 1068624 - protein, 18 aa, Mycobacterium
AAFFWAPGGDAKVVVCER

SEQ ID NO: 1068625 - protein, 19 aa, Mycobacterium
AAFHDDFVRILASGSNLYA

SEQ ID NO: 1068626 - protein, 20 aa, Mycobacterium
AAFHEQFLQALSGGGASYAA

SEQ ID NO: 1068627 - protein, 25 aa, Mycobacterium
AAFHERFLQTLSGGAGAYAAAEAAN

SEQ ID NO: 1068628 - protein, 23 aa, Mycobacterium
AAFQYVRDFLSFLPSDCFGDPPV

SEQ ID NO: 1068629 - protein, 20 aa, Mycobacterium
AAFVEFSRQRALAADGLCKA

SEQ ID NO: 1068630 - protein, 17 aa, Mycobacterium
AAFVRRPGRWIRELARK

SEQ ID NO: 1068631 - protein, 23 aa, Mycobacterium
AAGACAGFFRHPPRVPPSRAGAI

SEQ ID NO: 1068632 - protein, 29 aa, Mycobacterium
AAGDVPTLFAWRILDYWNWTNRPDRNHYE

SEQ ID NO: 1068633 - protein, 20 aa, Mycobacterium
AAGFQWPVAVVASLTGMRVA

SEQ ID NO: 1068634 - protein, 24 aa, Mycobacterium
AAGGDWFDAVALGDRLVLIVGDVV

SEQ ID NO: 1068635 - protein, 18 aa, Mycobacterium
AAGGLHLVFDFSVALWNT

SEQ ID NO: 1068636 - protein, 35 aa, Mycobacterium; identical to SEQ ID NO: 787099

SEQ ID NO: 1068637 - protein, 17 aa, Mycobacterium
AAGGLQLNRFHTTALCS

SEQ ID NO: 1068638 - protein, 17 aa, Mycobacterium
AAGHSFVIFLREGFPVN

SEQ ID NO: 1068639 - protein, 25 aa, Mycobacterium
AAGKTMGIPILYPWANRLGENTYDA

SEQ ID NO: 1068640 - protein, 22 aa, Mycobacterium
AAGKTVFVFPGQGSQLLGMGMG

SEQ ID NO: 1068641 - protein, 17 aa, Mycobacterium
AAGKYHWPGVLSNACCG

SEQ ID NO: 1068642 - protein, 27 aa, Mycobacterium
AAGLDSRAWRLPWPAGTTVFELDQPRV

SEQ ID NO: 1068643 - protein, 17 aa, Mycobacterium
AAGLPEVPSHEVGLAIL

SEQ ID NO: 1068644 - protein, 17 aa, Mycobacterium
AAGLRQVAGLPGPVGEV

SEQ ID NO: 1068645 - protein, 19 aa, Mycobacterium
AAGLRRIQWWTDEAGDFGL

SEQ ID NO: 1068646 - protein, 33 aa, Mycobacterium
AAGLSRLLEAKPVLWRLIATITRQWIDTTRELI

SEQ ID NO: 1068647 - protein, 27 aa, Mycobacterium
AAGLTVYATLFEGALGQALAAAGHREQ

SEQ ID NO: 1068648 - protein, 23 aa, Mycobacterium
AAGPLREWLHKQRTGLPHVTWKY

SEQ ID NO: 1068649 - protein, 20 aa, Mycobacterium
AAGPPRNPWLHRVAGQPRAT

SEQ ID NO: 1068650 - protein, 19 aa, Mycobacterium
AAGPVRFYFRVQIAGPGDS

SEQ ID NO: 1068651 - protein, 24 aa, Mycobacterium
AAGRAWVLRHPPLGHLLASAHDVV

SEQ ID NO: 1068652 - protein, 18 aa, Mycobacterium
AAGRPRTYVYRRAGDPCR

SEQ ID NO: 1068653 - protein, 25 aa, Mycobacterium
AAGRYVLDRAIFDALRRIERGAGGE

SEQ ID NO: 1068654 - protein, 43 aa, Mycobacterium
AAGSLGFLYDTGLYLRFRATDPDGFHLAYAAALALAGESAQFA

SEQ ID NO: 1068655 - protein, 18 aa, Mycobacterium
AAGSTLAAIAAGAGIVGT

SEQ ID NO: 1068656 - protein, 31 aa, Mycobacterium
AAGSVYLTRPSLFHFIRTAEEFSWRASELFD

SEQ ID NO: 1068657 - protein, 30 aa, Mycobacterium
AAGTASHPDGYDGGFLYGSGGSGYNSATSG

SEQ ID NO: 1068658 - protein, 24 aa, Mycobacterium
AAGTFVCNHLMYGVLHHIASRNLP

SEQ ID NO: 1068659 - protein, 32 aa, Mycobacterium; identical to SEQ ID NO: 787192

SEQ ID NO: 1068660 - protein, 41 aa, Mycobacterium
AAGVHLGYKCSIRKPWWSTPSLWVPDLFMLRQIHRTPRLSV

SEQ ID NO: 1068661 - protein, 28 aa, Mycobacterium
AAGVLELAWTTGLVRWEDDPQPGWYDTG

SEQ ID NO: 1068662 - protein, 26 aa, Mycobacterium
AAGVPVAFLTAWYGLSDLAGVRSGES

SEQ ID NO: 1068663 - protein, 26 aa, Mycobacterium
AAGVTMFVPAFLRYDLRKASDEWKIA

SEQ ID NO: 1068664 - protein, 32 aa, Mycobacterium; identical to SEQ ID NO: 787208

SEQ ID NO: 1068665 - protein, 25 aa, Mycobacterium
AAHAFRPLHYPMTSAIGLGIITAGH

SEQ ID NO: 1068666 - protein, 18 aa, Mycobacterium
AAHHFGCGFAPSGWDSLT

SEQ ID NO: 1068667 - protein, 22 aa, Mycobacterium
AAHLPYAAWLTKASADYAVMAA

SEQ ID NO: 1068668 - protein, 24 aa, Mycobacterium
AAHPDLVAALILLDPAIGLDGSRV

SEQ ID NO: 1068669 - protein, 26 aa, Mycobacterium
AAHRRAHGLPAISLGWGLWDQASDMT

SEQ ID NO: 1068670 - protein, 28 aa, Mycobacterium
AAHWIADRQIVPSLLKYGTELQKSHFLP

SEQ ID NO: 1068671 - protein, 23 aa, Mycobacterium
AAIATYLVTLYTSLAVLTDDALA

SEQ ID NO: 1068672 - protein, 25 aa, Mycobacterium
AAIDELIDAVKFTPALTGPQAQLGG

SEQ ID NO: 1068673 - protein, 25 aa, Mycobacterium
AAIKTALWELIWAGRVCGDTFVPVR

SEQ ID NO: 1068674 - protein, 20 aa, Mycobacterium
AAILKVFRRVSSGINPDIEL

SEQ ID NO: 1068675 - protein, 19 aa, Mycobacterium
AAIMSVSLLLAHLGLDDTA

SEQ ID NO: 1068676 - protein, 28 aa, Mycobacterium
AAIRPTTRLIWVETPTNPLLSIADIAGI

SEQ ID NO: 1068677 - protein, 20 aa, Mycobacterium
AAIRRRIGYVFPGQGGQRPG

SEQ ID NO: 1068678 - protein, 37 aa, Mycobacterium; identical to SEQ ID NO: 787311

SEQ ID NO: 1068679 - protein, 23 aa, Mycobacterium
AAKGKELVWAPAAFRYVMMVLRH

SEQ ID NO: 1068680 - protein, 29 aa, Mycobacterium
AAKSLARYKLPKAIVFRAGIQRSPSGKAD

SEQ ID NO: 1068681 - protein, 25 aa, Mycobacterium
AALALGCQGAWTGSQWLMVEEASNT

SEQ ID NO: 1068682 - protein, 20 aa, Mycobacterium
AALALRRYHFPSGTAKIIAL

SEQ ID NO: 1068683 - protein, 17 aa, Mycobacterium
AALAMNRRHRRMRFMIK

SEQ ID NO: 1068684 - protein, 17 aa, Mycobacterium
AALASRMQTLPQVLINV

SEQ ID NO: 1068685 - protein, 21 aa, Mycobacterium
AALDAPVLLHPGDEMLWRMTH

SEQ ID NO: 1068686 - protein, 39 aa, Mycobacterium; identical to SEQ ID NO: 787393

SEQ ID NO: 1068687 - protein, 24 aa, Mycobacterium
AALECGLLSEWRATLIVRESACLD

SEQ ID NO: 1068688 - protein, 21 aa, Mycobacterium
AALEQALRRATARTFDRLDID

SEQ ID NO: 1068689 - protein, 20 aa, Mycobacterium
AALESLTSIRRAGADIVLTY

SEQ ID NO: 1068690 - protein, 20 aa, Mycobacterium
AALFDGHAQAYQLIGAQAAE

SEQ ID NO: 1068691 - protein, 44 aa, Mycobacterium
AALFSGHGQAYQAISAQAAAFHDQFLRALTGAGGAYAAAEAANA

SEQ ID NO: 1068692 - protein, 29 aa, Mycobacterium
AALFTGHAQAYQWLGAQAGAFHSQFIQAL

SEQ ID NO: 1068693 - protein, 21 aa, Mycobacterium
AALGLVPDILINNAGLSTLGP

SEQ ID NO: 1068694 - protein, 26 aa, Mycobacterium
AALGNLPLIYPFLVNDPGEGIQAKRR

SEQ ID NO: 1068695 - protein, 20 aa, Mycobacterium
AALHAGLYGALDFGGSRAGN

SEQ ID NO: 1068696 - protein, 21 aa, Mycobacterium
AALHALVGRLNRAAPPLALRA

SEQ ID NO: 1068697 - protein, 24 aa, Mycobacterium
AALHERRPWRRWIGGRAAQLGTSG

SEQ ID NO: 1068698 - protein, 23 aa, Mycobacterium
AALHTQLERVLSAGAVAYAAAET

SEQ ID NO: 1068699 - protein, 27 aa, Mycobacterium
AALHTTAMPFILRGIALLGMDSVLMPI

SEQ ID NO: 1068700 - protein, 27 aa, Mycobacterium
AALLAEKDIWWCLQPFLDDEDAVAVPP

SEQ ID NO: 1068701 - protein, 25 aa, Mycobacterium
AALLPTHCWFEPKGWGFQVYPALDC

SEQ ID NO: 1068702 - protein, 25 aa, Mycobacterium
AALMDLIAAHRIPVISTLAPDAEGV

SEQ ID NO: 1068703 - protein, 20 aa, Mycobacterium
AALREAGLEWRQIQLVAGAD

SEQ ID NO: 1068704 - protein, 28 aa, Mycobacterium
AALSAALLRLPVSNWPALGGMGNASWVQ

SEQ ID NO: 1068705 - protein, 18 aa, Mycobacterium
AALSRRGPHRVLRGDLAF

SEQ ID NO: 1068706 - protein, 23 aa, Mycobacterium
AALTQPRLWLLGSSMYSARLAAA

SEQ ID NO: 1068707 - protein, 21 aa, Mycobacterium
AALVHHYFGTKQQLFAAAIHL

SEQ ID NO: 1068708 - protein, 26 aa, Mycobacterium
AAMAKRLLDWPGGLVVYDVRAEAMTP

SEQ ID NO: 1068709 - protein, 23 aa, Mycobacterium
AAMALHALGPQWALVKGGHLRSS

SEQ ID NO: 1068710 - protein, 22 aa, Mycobacterium
AAMCAIIARYRRHQPILIALNE

SEQ ID NO: 1068711 - protein, 31 aa, Mycobacterium
AAMGLRPLRHSPLGFGLLLNKPDAALTASWL

SEQ ID NO: 1068712 - protein, 23 aa, Mycobacterium
AAMLTAVTPYVSWLTTMATRAEQ

SEQ ID NO: 1068713 - protein, 27 aa, Mycobacterium
AAMTTADLFIRYLRPIRQGAARAVPRM

SEQ ID NO: 1068714 - protein, 23 aa, Mycobacterium
AANALRQFGLQTHVIEMMPRLMA

SEQ ID NO: 1068715 - protein, 26 aa, Mycobacterium
AANFRDVMIALGLYPDPDAAMGVEGA

SEQ ID NO: 1068716 - protein, 30 aa, Mycobacterium
AANLQVTRYALPNLRALNFVIEGILGQGVA

SEQ ID NO: 1068717 - protein, 18 aa, Mycobacterium
AANPDGDVLWRPGGKRPS

SEQ ID NO: 1068718 - protein, 36 aa, Mycobacterium; identical to SEQ ID NO: 787590

SEQ ID NO: 1068719 - protein, 19 aa, Mycobacterium
AANTPMLLKAGLVDGNPEA

SEQ ID NO: 1068720 - protein, 44 aa, Mycobacterium
AANVSPLQVLERDVLGLVNAPAQALLGRPIIGNGADGAPGSGAN

SEQ ID NO: 1068721 - protein, 17 aa, Mycobacterium
AANYLSVGQIYLLDNPL

SEQ ID NO: 1068722 - protein, 23 aa, Mycobacterium
AAPAGWSHFDADRWELSTSPKTA

SEQ ID NO: 1068723 - protein, 25 aa, Mycobacterium
AAPALPVFGMLWKGYARRALRNLSA

SEQ ID NO: 1068724 - protein, 26 aa, Mycobacterium
AAPERLRSGWLNGIKHWQVDYTGKCP

SEQ ID NO: 1068725 - protein, 26 aa, Mycobacterium
AAPGASYFVLVFDKAALSGDGPINGV

SEQ ID NO: 1068726 - protein, 31 aa, Mycobacterium; identical to SEQ ID NO: 787622

SEQ ID NO: 1068727 - protein, 19 aa, Mycobacterium
AAPPYTVPGGLLLERRTNG

SEQ ID NO: 1068728 - protein, 23 aa, Mycobacterium
AAPQLWGGFAQHLSPINDTLSMI

SEQ ID NO: 1068729 - protein, 22 aa, Mycobacterium
AAPRLKLFVGLGSRFCGAAAGI

SEQ ID NO: 1068730 - protein, 30 aa, Mycobacterium; identical to SEQ ID NO: 787684

SEQ ID NO: 1068731 - protein, 27 aa, Mycobacterium
AAQISKPMLYLYYGSKEDLFGACLNRE

SEQ ID NO: 1068732 - protein, 22 aa, Mycobacterium
AAQQRLWRIRESLAEVLGVYGP

SEQ ID NO: 1068733 - protein, 24 aa, Mycobacterium
AAQRQYGYYVRPLLLDGQLVGRVD

SEQ ID NO: 1068734 - protein, 27 aa, Mycobacterium
AAQSAMVQPFLLAANRSSLVSLVLSNL

SEQ ID NO: 1068735 - protein, 25 aa, Mycobacterium
AAQTGPFFLMDIDSFWTPLGSIPEF

SEQ ID NO: 1068736 - protein, 18 aa, Mycobacterium
AARAARLKWWTTELQVRT

SEQ ID NO: 1068737 - protein, 20 aa, Mycobacterium
AARAATAPMAAWAATAAAGT

SEQ ID NO: 1068738 - protein, 22 aa, Mycobacterium
AARAPERALAWLFESRRKDQAS

SEQ ID NO: 1068739 - protein, 23 aa, Mycobacterium
AARAVWQALPGEPWADRFAEAAA

SEQ ID NO: 1068740 - protein, 34 aa, Mycobacterium
AARDADYAGFIWYPQLPALDHWLQLYQRAARANG

SEQ ID NO: 1068741 - protein, 21 aa, Mycobacterium
AARECGFAFVIGFDRDGRAEE

SEQ ID NO: 1068742 - protein, 33 aa, Mycobacterium; identical to SEQ ID NO: 787768

SEQ ID NO: 1068743 - protein, 18 aa, Mycobacterium
AARGLFSRAIDQSSPATS

SEQ ID NO: 1068744 - protein, 27 aa, Mycobacterium
AARKLGELRPLYPPGLVHIYHALTWGP

SEQ ID NO: 1068745 - protein, 17 aa, Mycobacterium
AARLQVPRAYRTLPAVL

SEQ ID NO: 1068746 - protein, 18 aa, Mycobacterium
AARLTVVWIADWADDMVH

SEQ ID NO: 1068747 - protein, 23 aa, Mycobacterium
AARLTVVWIADWADDMVHLSAHH

SEQ ID NO: 1068748 - protein, 17 aa, Mycobacterium
AARLWSPVLACVLSQGV

SEQ ID NO: 1068749 - protein, 21 aa, Mycobacterium
AARMLIRLRSPQQVAFFGDVE

SEQ ID NO: 1068750 - protein, 26 aa, Mycobacterium
AARNPDAWFYQRPITLADHQNSRWII

SEQ ID NO: 1068751 - protein, 32 aa, Mycobacterium
AARNSQTWRFAPFFHALLDAGVYPPCSAFEAW

SEQ ID NO: 1068752 - protein, 25 aa, Mycobacterium
AARRALSESLLVHPYIRAAREAANN

SEQ ID NO: 1068753 - protein, 21 aa, Mycobacterium
AARRHGLRVSLSPTPFADNVG

SEQ ID NO: 1068754 - protein, 18 aa, Mycobacterium
AARRRLAAILAHHGLAVV

SEQ ID NO: 1068755 - protein, 18 aa, Mycobacterium
AARRTAGPCPLRGMRRAD

SEQ ID NO: 1068756 - protein, 20 aa, Mycobacterium
AARRVVLVHWDDFFRPLSKP

SEQ ID NO: 1068757 - protein, 20 aa, Mycobacterium
AARSFDLFRDSPVRVLLVTL

SEQ ID NO: 1068758 - protein, 35 aa, Mycobacterium
AASAAALGQVWDATAGPTAVLSDAYEAAAAAAKAG

SEQ ID NO: 1068759 - protein, 17 aa, Mycobacterium
AASAAIPGIFPPVSING

SEQ ID NO: 1068760 - protein, 24 aa, Mycobacterium
AASALLKGLTAHYLLKSVCPVADG

SEQ ID NO: 1068761 - protein, 34 aa, Mycobacterium
AASASDLAFARVPAALLCWGVSQFDADMRPDQVA

SEQ ID NO: 1068762 - protein, 24 aa, Mycobacterium
AASDAFFPFPDGLETLTAAGVKAI

SEQ ID NO: 1068763 - protein, 19 aa, Mycobacterium
AASFTRSFARYEPMPESAA

SEQ ID NO: 1068764 - protein, 26 aa, Mycobacterium
AASGCVLLPGLPYLGLEHRAAWVEAE

SEQ ID NO: 1068765 - protein, 25 aa, Mycobacterium
AASGTSIYWTGLNKGKRSATIDLRS

SEQ ID NO: 1068766 - protein, 19 aa, Mycobacterium
AASICRPRCLKPALSFEFG

SEQ ID NO: 1068767 - protein, 18 aa, Mycobacterium
AASQHARIGRRARAAQLL

SEQ ID NO: 1068768 - protein, 17 aa, Mycobacterium
AASQPRARRGIGTTAAI

SEQ ID NO: 1068769 - protein, 30 aa, Mycobacterium
AASSCQSVIWGLAFGQWVGASASLMGAAAA

SEQ ID NO: 1068770 - protein, 35 aa, Mycobacterium
AASSFSSVTAGLASGAWQGPASAAMSAVAAPYASW

SEQ ID NO: 1068771 - protein, 32 aa, Mycobacterium; identical to SEQ ID NO: 113016

SEQ ID NO: 1068772 - protein, 18 aa, Mycobacterium
AATHRAMWALGDYALMAE

SEQ ID NO: 1068773 - protein, 24 aa, Mycobacterium
AATIKRMFLELGGKSAFIVLDDAD

SEQ ID NO: 1068774 - protein, 30 aa, Mycobacterium
AATIPVPPLPPLPPIINELINWAFDVVNWA

SEQ ID NO: 1068775 - protein, 25 aa, Mycobacterium
AATVALFRLPRTLKYKAKPGRSVDR

SEQ ID NO: 1068776 - protein, 18 aa, Mycobacterium
AATVLDTDCRVYRVAGLR

SEQ ID NO: 1068777 - protein, 26 aa, Mycobacterium
AATVPLGRLAQPADIGWAAAFLASDL

SEQ ID NO: 1068778 - protein, 30 aa, Mycobacterium; identical to SEQ ID NO: 788037

SEQ ID NO: 1068779 - protein, 20 aa, Mycobacterium
AAVAETWLRLELTTPLVVDP

SEQ ID NO: 1068780 - protein, 21 aa, Mycobacterium
AAVAQLLRLPGGLPVSGIDVA

SEQ ID NO: 1068781 - protein, 42 aa, Mycobacterium
AAVATLFACYGQTYQTLGIAAARFHDEFVGNLRAAATSYASA

SEQ ID NO: 1068782 - protein, 21 aa, Mycobacterium
AAVDTEPIWIPARSSATPPHR

SEQ ID NO: 1068783 - protein, 25 aa, Mycobacterium
AAVEAILLFTQLMHTAPSELDLQLS

SEQ ID NO: 1068784 - protein, 20 aa, Mycobacterium
AAVFPSHYEPFGLVALEAAA

SEQ ID NO: 1068785 - protein, 27 aa, Mycobacterium
AAVGASGFYAKWLPQLVFGEGQRPKAY

SEQ ID NO: 1068786 - protein, 27 aa, Mycobacterium
AAVGDWLAMFSMWPIKQTPGLRCQLDA

SEQ ID NO: 1068787 - protein, 24 aa, Mycobacterium
AAVGPDFIICYRMSMADYVEGGQS

SEQ ID NO: 1068788 - protein, 24 aa, Mycobacterium
AAVGRISYLLGLRGPAVAVDTACS

SEQ ID NO: 1068789 - protein, 23 aa, Mycobacterium
AAVHRATRPGATLLMSCFCDANP

SEQ ID NO: 1068790 - protein, 18 aa, Mycobacterium
AAVHSCVFPAFRAAGRTV

SEQ ID NO: 1068791 - protein, 22 aa, Mycobacterium
AAVLDVTWRFYSLPRLRHQTGG

SEQ ID NO: 1068792 - protein, 25 aa, Mycobacterium
AAVNWLMGQADMHPDWSFGERGERF

SEQ ID NO: 1068793 - protein, 24 aa, Mycobacterium
AAVPIVAAVRRHGVVRYAEVVSAI

SEQ ID NO: 1068794 - protein, 23 aa, Mycobacterium
AAVPKGVVLTKVDDRLISSADAL

SEQ ID NO: 1068795 - protein, 39 aa, Mycobacterium
AAVPRQVALADLLRFYRLAQELVWQWMFGRITADSRDAA

SEQ ID NO: 1068796 - protein, 27 aa, Mycobacterium
AAVPVMRVIAPHWALLTALARHANQTA

SEQ ID NO: 1068797 - protein, 28 aa, Mycobacterium
AAVSHLIPALEILQDALATKALEWQSVV

SEQ ID NO: 1068798 - protein, 20 aa, Mycobacterium
AAVSMFGRLGRHAEVADAVA

SEQ ID NO: 1068799 - protein, 22 aa, Mycobacterium
AAVTISKLWDLFVGEDATLVEV

SEQ ID NO: 1068800 - protein, 20 aa, Mycobacterium
AAWGSLADELQVAASSFSSV

SEQ ID NO: 1068801 - protein, 21 aa, Mycobacterium
AAWRGTWHGGLEFTKKCCVPI

SEQ ID NO: 1068802 - protein, 17 aa, Mycobacterium
AAWRPDTVWRYRLGSPG

SEQ ID NO: 1068803 - protein, 23 aa, Mycobacterium
AAWSLIHGFSMLWLNGVLPSDPG

SEQ ID NO: 1068804 - protein, 26 aa, Mycobacterium
AAYAQPYLSRLWARLHGRDVWQEPCA

SEQ ID NO: 1068805 - protein, 35 aa, Mycobacterium
AAYEPDIWWDTFRLPPYRRYTLRTYFRPDVTGKTV

SEQ ID NO: 1068806 - protein, 26 aa, Mycobacterium
AAYNATKWGIIGLIKSVALEVAKEGI

SEQ ID NO: 1068807 - protein, 20 aa, Mycobacterium
AAYPFVVLDRDHTLRRIVDA

SEQ ID NO: 1068808 - protein, 21 aa, Mycobacterium
AAYTQRFIELGLNPDQIVLVV

SEQ ID NO: 1068809 - protein, 29 aa, Mycobacterium
ACASAWLDGLVAWRRAAGLPAATINWGPW

SEQ ID NO: 1068810 - protein, 27 aa, Mycobacterium
ACDVESYVYMPLLEELGYIPTEKYAKG

SEQ ID NO: 1068811 - protein, 19 aa, Mycobacterium
ACDYAKIREQYGKAIGSHQ

SEQ ID NO: 1068812 - protein, 18 aa, Mycobacterium
ACERVRAERINRWRVATA

SEQ ID NO: 1068813 - protein, 31 aa, Mycobacterium; identical to SEQ ID NO: 788260

SEQ ID NO: 1068814 - protein, 18 aa, Mycobacterium
ACLAIGPAAELLTPGLHG

SEQ ID NO: 1068815 - protein, 20 aa, Mycobacterium
ACLHWGAMWGPASDAHHVDP

SEQ ID NO: 1068816 - protein, 18 aa, Mycobacterium
ACMDARLDVYRLLGINEG

SEQ ID NO: 1068817 - protein, 17 aa, Mycobacterium
ACPGLLTRQEYVGALTA

SEQ ID NO: 1068818 - protein, 28 aa, Mycobacterium
ACSAALRPRYLMMLAEILRFHRAASRLL

SEQ ID NO: 1068819 - protein, 27 aa, Mycobacterium
ACTLRNWLGMWSLRVAQARAAPHLARI

SEQ ID NO: 1068820 - protein, 24 aa, Mycobacterium
ACTNLLLAMGVFDITVLDSRGTLH

SEQ ID NO: 1068821 - protein, 20 aa, Mycobacterium
ACVDGKWRFSYRDLTLIDMV

SEQ ID NO: 1068822 - protein, 25 aa, Mycobacterium
ACVLYACAQLPDLAGRHVAVIGQGS

SEQ ID NO: 1068823 - protein, 18 aa, Mycobacterium
ADAAAFSGAAGGNGGHGG

SEQ ID NO: 1068824 - protein, 21 aa, Mycobacterium
ADAEWYFNTVNVGDPVIVKEG

SEQ ID NO: 1068825 - protein, 25 aa, Mycobacterium
ADAGLVFQGWFQKTPYYPHDFFVPN

SEQ ID NO: 1068826 - protein, 22 aa, Mycobacterium
ADAKLIIASAYLPQHEDARAAD

SEQ ID NO: 1068827 - protein, 23 aa, Mycobacterium
ADALLVDLDPWGGGIDLLMGCEN

SEQ ID NO: 1068828 - protein, 23 aa, Mycobacterium
ADALMALPRLVPPAGALDSPRAD

SEQ ID NO: 1068829 - protein, 23 aa, Mycobacterium
ADAPVLVTVCRAAAALLGGSASD

SEQ ID NO: 1068830 - protein, 31 aa, Mycobacterium
ADARGPAHISYFVPAPLLTAIDPGRAEVGQQ

SEQ ID NO: 1068831 - protein, 22 aa, Mycobacterium
ADAVMILPVSYWKLNEHEIFQH

SEQ ID NO: 1068832 - protein, 26 aa, Mycobacterium
ADDDQFMTLAKMRAARRLWARVAEVA

SEQ ID NO: 1068833 - protein, 25 aa, Mycobacterium
ADDEQLVLDLLLSEKILVTQGTGFN

SEQ ID NO: 1068834 - protein, 23 aa, Mycobacterium
ADDEVSVAIAALFSGHGQAYQAI

SEQ ID NO: 1068835 - protein, 21 aa, Mycobacterium
ADDIAHRRIAITGVNEFPNLD

SEQ ID NO: 1068836 - protein, 22 aa, Mycobacterium
ADDQFRQRWFGAADPAEVMDEY

SEQ ID NO: 1068837 - protein, 24 aa, Mycobacterium
ADDVRLRRMAVFDVLINNADRKGG

SEQ ID NO: 1068838 - protein, 33 aa, Mycobacterium
ADDYTRTLDILERFYGLVLTDCGTGLLHSAMSA

SEQ ID NO: 1068839 - protein, 24 aa, Mycobacterium
ADEDSLQLLGWTEATATPQVEVAL

SEQ ID NO: 1068840 - protein, 32 aa, Mycobacterium; identical to SEQ ID NO: 788463

SEQ ID NO: 1068841 - protein, 24 aa, Mycobacterium
ADEERIVWLAEPLVAEDLPDGFPD

SEQ ID NO: 1068842 - protein, 24 aa, Mycobacterium
ADEFHPELQFDKPYLLAMANAGPG

SEQ ID NO: 1068843 - protein, 27 aa, Mycobacterium
ADEFPDGVWLFELAAVSDPAAVPDAVA

SEQ ID NO: 1068844 - protein, 22 aa, Mycobacterium
ADEHGLPLWQKLMIYTSESARH

SEQ ID NO: 1068845 - protein, 19 aa, Mycobacterium
ADEHVFYDLNIAKSVASLI

SEQ ID NO: 1068846 - protein, 18 aa, Mycobacterium
ADEISAAVAALFSGHALD

SEQ ID NO: 1068847 - protein, 23 aa, Mycobacterium
ADESHVLLFRFSHAPKTSVRSLR

SEQ ID NO: 1068848 - protein, 26 aa, Mycobacterium
ADEVSAAVAALFSSHARAYQALSVQA

SEQ ID NO: 1068849 - protein, 22 aa, Mycobacterium
ADEVWALLRDVTQARIGLGRAG

SEQ ID NO: 1068850 - protein, 27 aa, Mycobacterium
ADFARPLTVIAGAATRWVWVANAANAS

SEQ ID NO: 1068851 - protein, 17 aa, Mycobacterium
ADFMGGFALWVDEQRRL

SEQ ID NO: 1068852 - protein, 28 aa, Mycobacterium
ADFNSVMQVLPPWGIKIIRKAIHRSRGR

SEQ ID NO: 1068853 - protein, 26 aa, Mycobacterium
ADGATFQQLPFALTPGPPVPTRALRD

SEQ ID NO: 1068854 - protein, 17 aa, Mycobacterium
ADGFATVTIVTTGTGYL

SEQ ID NO: 1068855 - protein, 22 aa, Mycobacterium
ADGIGMLRFDALGLGDSEGGWG

SEQ ID NO: 1068856 - protein, 24 aa, Mycobacterium
ADGLAAFCDICVAAFAGFAVVKPQ

SEQ ID NO: 1068857 - protein, 31 aa, Mycobacterium
ADGNTVCMAGLWPVWKPNNAAAPLLSATIIT

SEQ ID NO: 1068858 - protein, 29 aa, Mycobacterium
ADGPIPPIAFQLLWYPSTMWDQTLPSFTE

SEQ ID NO: 1068859 - protein, 20 aa, Mycobacterium
ADGRCWPEFVLGAAYEGPPG

SEQ ID NO: 1068860 - protein, 22 aa, Mycobacterium
ADGRVIALLRDEGPRTKSVVVL

SEQ ID NO: 1068861 - protein, 28 aa, Mycobacterium
ADGRWLVNPMFIDPLPAHPPYPCATQGF

SEQ ID NO: 1068862 - protein, 25 aa, Mycobacterium
ADGVYAAWFTVLGHGPVTGAVIPGE

SEQ ID NO: 1068863 - protein, 29 aa, Mycobacterium
ADHCLDMPGLFVWRRYHPSRPKGKALLYG

SEQ ID NO: 1068864 - protein, 23 aa, Mycobacterium
ADHLIAHILTHYPQMEYGSISGN

SEQ ID NO: 1068865 - protein, 33 aa, Mycobacterium; identical to SEQ ID NO: 783620

SEQ ID NO: 1068866 - protein, 25 aa, Mycobacterium
ADIDTVVFDRGGYTYGGRIAALADA

SEQ ID NO: 1068867 - protein, 25 aa, Mycobacterium
ADIEDLRVLLARRNELWSREPANDK

SEQ ID NO: 1068868 - protein, 23 aa, Mycobacterium
ADIYRIAHNVAWERWTDIAFGLT

SEQ ID NO: 1068869 - protein, 25 aa, Mycobacterium
ADKHPGWHALRKIASRITTPLLPDD

SEQ ID NO: 1068870 - protein, 19 aa, Mycobacterium
ADLAKLLAPPLPAGPAASQ

SEQ ID NO: 1068871 - protein, 21 aa, Mycobacterium
ADLARRLARQVPGCRFSGLGG

SEQ ID NO: 1068872 - protein, 27 aa, Mycobacterium
ADLDYHLTTLFPPVRPRQWLEIRYLDS

SEQ ID NO: 1068873 - protein, 26 aa, Mycobacterium
ADLEHWRWMWETNVLGTLRVTRALLP

SEQ ID NO: 1068874 - protein, 21 aa, Mycobacterium
ADLGSMRFYRETALAVGFEVV

SEQ ID NO: 1068875 - protein, 24 aa, Mycobacterium
ADLISPLRLRGMSAMFARIKRRLR

SEQ ID NO: 1068876 - protein, 20 aa, Mycobacterium
ADLKVRALTIEWADNGNSFE

SEQ ID NO: 1068877 - protein, 28 aa, Mycobacterium
ADLLAVELSSFQLRWAPSLRPEAGVVLN

SEQ ID NO: 1068878 - protein, 20 aa, Mycobacterium
ADLRAPRALPVLVIDGRDDT

SEQ ID NO: 1068879 - protein, 22 aa, Mycobacterium
ADLRHWLVDYLVTNIGCPPDEV

SEQ ID NO: 1068880 - protein, 18 aa, Mycobacterium
ADLRYRVAALAGSLSRRG

SEQ ID NO: 1068881 - protein, 17 aa, Mycobacterium
ADLVSCMVALPTQLFRS

SEQ ID NO: 1068882 - protein, 24 aa, Mycobacterium
ADMTVRWFPLTEAVSKVFTGEIVN

SEQ ID NO: 1068883 - protein, 18 aa, Mycobacterium
ADPAIWDHPVDHPHVTEP

SEQ ID NO: 1068884 - protein, 23 aa, Mycobacterium
ADPALVRLGLAVIRGLLLDLVAT

SEQ ID NO: 1068885 - protein, 22 aa, Mycobacterium
ADPDLLIDFRDVSLRRGGRTLV

SEQ ID NO: 1068886 - protein, 25 aa, Mycobacterium
ADPELRGPLAGVPFLIKDLDQEYRG

SEQ ID NO: 1068887 - protein, 26 aa, Mycobacterium
ADPNGGRPAIWTRCSWTRTSGSSAGC

SEQ ID NO: 1068888 - protein, 22 aa, Mycobacterium
ADPPPVPLDAAILFAPVGELVL

SEQ ID NO: 1068889 - protein, 23 aa, Mycobacterium
ADPRLLACYDGAAGCWRIEAGTY

SEQ ID NO: 1068890 - protein, 24 aa, Mycobacterium
ADPSGLRELAPTLPRSSTATIDAV

SEQ ID NO: 1068891 - protein, 26 aa, Mycobacterium
ADPTLDAVYIPLPNGLHGRWTQATLT

SEQ ID NO: 1068892 - protein, 19 aa, Mycobacterium
ADPVIMLTGPTPAARKVLD

SEQ ID NO: 1068893 - protein, 25 aa, Mycobacterium
ADQAMALLRMLAGRGFLDGPGGQPA

SEQ ID NO: 1068894 - protein, 27 aa, Mycobacterium
ADQHTIEAMWFAPTDPLTMAHGVLALD

SEQ ID NO: 1068895 - protein, 25 aa, Mycobacterium
ADQLSPFELPLSISPHPAPILTEAE

SEQ ID NO: 1068896 - protein, 24 aa, Mycobacterium
ADQPYWGRPVPGWGSERPWLLIVG

SEQ ID NO: 1068897 - protein, 32 aa, Mycobacterium
ADQVSAAVAALFPGHALDYQALSTQVAAFHTQ

SEQ ID NO: 1068898 - protein, 20 aa, Mycobacterium
ADRAAIVLRAHRAMQAVIGS

SEQ ID NO: 1068899 - protein, 24 aa, Mycobacterium
ADRADWQPPWYAPESAALLQYTSG

SEQ ID NO: 1068900 - protein, 24 aa, Mycobacterium
ADRDELIQRLWQRAVIALPAGKVS

SEQ ID NO: 1068901 - protein, 17 aa, Mycobacterium
ADRERLLNLKPPTYFDD

SEQ ID NO: 1068902 - protein, 19 aa, Mycobacterium
ADRGEAIGYAVDWARTGDV

SEQ ID NO: 1068903 - protein, 31 aa, Mycobacterium; identical to SEQ ID NO: 788924

SEQ ID NO: 1068904 - protein, 24 aa, Mycobacterium
ADRLSDRFGLLTRGQRGAPTRQQT

SEQ ID NO: 1068905 - protein, 17 aa, Mycobacterium
ADRQLIMAIVNRTPDSF

SEQ ID NO: 1068906 - protein, 25 aa, Mycobacterium
ADRQSMLFSATMPDPIITLARTFMI

SEQ ID NO: 1068907 - protein, 23 aa, Mycobacterium
ADRRLSEDFVPLEDLLQPTMDEI

SEQ ID NO: 1068908 - protein, 22 aa, Mycobacterium
ADRSNGLWRPSPGSVYPTLQLL

SEQ ID NO: 1068909 - protein, 25 aa, Mycobacterium
ADRVLARVTAWLLAVSDTTDVASDR

SEQ ID NO: 1068910 - protein, 17 aa, Mycobacterium
ADRVYRLAYRLSGNQQD

SEQ ID NO: 1068911 - protein, 19 aa, Mycobacterium
ADRWTMFHSIAFDFSVWEL

SEQ ID NO: 1068912 - protein, 23 aa, Mycobacterium
ADRYRRLHVIIGDANLSETSTYL

SEQ ID NO: 1068913 - protein, 24 aa, Mycobacterium
ADRYSLAVLAPPIPRTVRFAEATA

SEQ ID NO: 1068914 - protein, 26 aa, Mycobacterium
ADSSSGWLFVSSWKADADSLRMRPGD

SEQ ID NO: 1068915 - protein, 19 aa, Mycobacterium
ADSVMAVGLIPSYRSFGVN

SEQ ID NO: 1068916 - protein, 24 aa, Mycobacterium
ADSYCRRYRPAARRPQPIDTGVSH

SEQ ID NO: 1068917 - protein, 21 aa, Mycobacterium
ADVAAFFVLLAVAGNDTTRQT

SEQ ID NO: 1068918 - protein, 27 aa, Mycobacterium
ADVAGAKPWFAIGGIDGLRLPEVLAAG

SEQ ID NO: 1068919 - protein, 22 aa, Mycobacterium
ADVFVHYTEIQGSGFRTLEENQ

SEQ ID NO: 1068920 - protein, 25 aa, Mycobacterium
ADVIRTRIYVTDISRWREVGDVHAQ

SEQ ID NO: 1068921 - protein, 22 aa, Mycobacterium
ADVLRAWGKLGYPRRAKRLHEC

SEQ ID NO: 1068922 - protein, 25 aa, Mycobacterium
ADVPFRVMMRLLRAVGQASGLDDEA

SEQ ID NO: 1068923 - protein, 26 aa, Mycobacterium
ADVPGVLFFAYAISAAVDWLYSGLPS

SEQ ID NO: 1068924 - protein, 25 aa, Mycobacterium
ADVQFLDGYPVLSHAVPCRPAWCIP

SEQ ID NO: 1068925 - protein, 26 aa, Mycobacterium
ADVSQRVGLPGIWYAGSHGFELTAPD

SEQ ID NO: 1068926 - protein, 22 aa, Mycobacterium
ADWTRRTFLELVPAVRVPVHFS

SEQ ID NO: 1068927 - protein, 18 aa, Mycobacterium
ADWYGTEAALVYNSGYLT

SEQ ID NO: 1068928 - protein, 29 aa, Mycobacterium
ADYLRRMGELFAPFTKIAAGNPFAAAPIE

SEQ ID NO: 1068929 - protein, 26 aa, Mycobacterium
ADYPPLRMMFDRCVEFLPALRSAAPD

SEQ ID NO: 1068930 - protein, 19 aa, Mycobacterium
ADYYPTGGRWNNWAEFFHS

SEQ ID NO: 1068931 - protein, 25 aa, Mycobacterium
AEAAALLCVALWCAVELGIGVLHVP

SEQ ID NO: 1068932 - protein, 31 aa, Mycobacterium
AEAAERLGVLGLPFLFFIDAAQGRAGVLYHR

SEQ ID NO: 1068933 - protein, 46 aa, Mycobacterium
AEAANVTPLQTIEQDLLGAVNAPTQVLFGRGLIGDGANGTAPGQAG

SEQ ID NO: 1068934 - protein, 35 aa, Mycobacterium
AEAASASPLAGLLAAINAPVQSLTGRPLIGNGANG

SEQ ID NO: 1068935 - protein, 19 aa, Mycobacterium
AEAAVRELLLAIGEDPDRG

SEQ ID NO: 1068936 - protein, 21 aa, Mycobacterium
AEAEFYALLAARQAERASLPS

SEQ ID NO: 1068937 - protein, 22 aa, Mycobacterium
AEAGHLVRFWALPAGPDGPRML

SEQ ID NO: 1068938 - protein, 27 aa, Mycobacterium
AEAHVMYVLSRIMPPLARWVSAQMAKA

SEQ ID NO: 1068939 - protein, 26 aa, Mycobacterium
AEAITDRILLLDGLPNYQRIGPLRVG

SEQ ID NO: 1068940 - protein, 27 aa, Mycobacterium
AEALGEGWFWPAAAAHPSLPRGALLQI

SEQ ID NO: 1068941 - protein, 22 aa, Mycobacterium
AEALRPARLLVSGSAALPVPVF

SEQ ID NO: 1068942 - protein, 23 aa, Mycobacterium
AEALSLLQRCSAALAAPVEVVPA

SEQ ID NO: 1068943 - protein, 24 aa, Mycobacterium
AEANPIIDGPFAAPLVRAVSLDFF

SEQ ID NO: 1068944 - protein, 25 aa, Mycobacterium
AEAPARAYNPLFIWGESGLGKTHLL

SEQ ID NO: 1068945 - protein, 27 aa, Mycobacterium
AEARIEIEMIRLLTLKAAYLMDTVGNK

SEQ ID NO: 1068946 - protein, 22 aa, Mycobacterium
AEAYPFMTPIFGKGVVFDASPE

SEQ ID NO: 1068947 - protein, 18 aa, Mycobacterium
AEDRGAFGDVLTAAGLPA

SEQ ID NO: 1068948 - protein, 20 aa, Mycobacterium
AEDRGAFGDVLTAAGLPAPR

SEQ ID NO: 1068949 - protein, 29 aa, Mycobacterium
AEDWDLDALWTALKTLYPVGIKTDTLMRR

SEQ ID NO: 1068950 - protein, 22 aa, Mycobacterium
AEEALCRWMAAAALVRSRADGG

SEQ ID NO: 1068951 - protein, 24 aa, Mycobacterium
AEEVDKMVWATRWGADTIMDLSTG

SEQ ID NO: 1068952 - protein, 17 aa, Mycobacterium
AEFALGGATTALRQIGR

SEQ ID NO: 1068953 - protein, 22 aa, Mycobacterium
AEFERPVLLFSGGKDSIVMLHL

SEQ ID NO: 1068954 - protein, 22 aa, Mycobacterium
AEFGGWLMPVSYTGTVSEHNAT

SEQ ID NO: 1068955 - protein, 19 aa, Mycobacterium
AEFINLKRQGELALFASCR

SEQ ID NO: 1068956 - protein, 24 aa, Mycobacterium
AEFLDLPRLALADAALSAATAAGA

SEQ ID NO: 1068957 - protein, 19 aa, Mycobacterium
AEFQVEGLATVIPFHRAVV

SEQ ID NO: 1068958 - protein, 23 aa, Mycobacterium
AEGHAAKVLNLRSTLLTLSGGDA

SEQ ID NO: 1068959 - protein, 24 aa, Mycobacterium
AEGHKWAMLTVYDYSTARAFDDAG

SEQ ID NO: 1068960 - protein, 31 aa, Mycobacterium; identical to SEQ ID NO: 789329

SEQ ID NO: 1068961 - protein, 17 aa, Mycobacterium
AEGLLNFTRLEDPPDLL

SEQ ID NO: 1068962 - protein, 27 aa, Mycobacterium
AEGTFEYQALLFIPSHAPFDLFNSDAK

SEQ ID NO: 1068963 - protein, 28 aa, Mycobacterium
AEGTFEYQALLFIPSHAPFDLFNSDAKI

SEQ ID NO: 1068964 - protein, 27 aa, Mycobacterium
AEGTTLMKILIVSWEYPPVVIGGLGRH

SEQ ID NO: 1068965 - protein, 26 aa, Mycobacterium
AEGTVLLMLAALRRLPELDAATRQGR

SEQ ID NO: 1068966 - protein, 31 aa, Mycobacterium; identical to SEQ ID NO: 789372

SEQ ID NO: 1068967 - protein, 18 aa, Mycobacterium
AEHLLGAARRRAFRVWLD

SEQ ID NO: 1068968 - protein, 19 aa, Mycobacterium
AEHPAFPAPPPREILEGAG

SEQ ID NO: 1068969 - protein, 30 aa, Mycobacterium
AEHQAIVRDVLVAGDFWGGAGSVACQEFIT

SEQ ID NO: 1068970 - protein, 17 aa, Mycobacterium
AEHVRDLLVGGRSMRME

SEQ ID NO: 1068971 - protein, 20 aa, Mycobacterium
AEICDGWLPIFYTPRMADMY

SEQ ID NO: 1068972 - protein, 22 aa, Mycobacterium
AEIHLMYLALVSGGAPLRLAEP

SEQ ID NO: 1068973 - protein, 19 aa, Mycobacterium
AEILARITALPWAEVPAAA

SEQ ID NO: 1068974 - protein, 17 aa, Mycobacterium
AEIRTTNPPLLLATRHV

SEQ ID NO: 1068975 - protein, 26 aa, Mycobacterium
AEKDLRAPFAPRGWFEGLTIEQLDVF

SEQ ID NO: 1068976 - protein, 20 aa, Mycobacterium
AEKLRLNHWAVEDAVAAAER

SEQ ID NO: 1068977 - protein, 28 aa, Mycobacterium
AELAHIPVRRFGSVGDIAPTVAFLCTEH

SEQ ID NO: 1068978 - protein, 22 aa, Mycobacterium
AELAIRFRDKGVVGFDIAGAEA

SEQ ID NO: 1068979 - protein, 27 aa, Mycobacterium
AELDLMADWIGWLFAFDDVFDESIDGC

SEQ ID NO: 1068980 - protein, 25 aa, Mycobacterium
AELDWWTSPFVLTDGVPPLALASDT

SEQ ID NO: 1068981 - protein, 22 aa, Mycobacterium
AELENLIRPTGFYRNKANSLIG

SEQ ID NO: 1068982 - protein, 48 aa, Mycobacterium; identical to SEQ ID NO: 789473

SEQ ID NO: 1068983 - protein, 19 aa, Mycobacterium
AELHTSLHRVAMSAGLAPY

SEQ ID NO: 1068984 - protein, 21 aa, Mycobacterium
AELIYGAAAFGFWADKAPRYL

SEQ ID NO: 1068985 - protein, 18 aa, Mycobacterium
AELLAGYYHAVHALTLQY

SEQ ID NO: 1068986 - protein, 19 aa, Mycobacterium
AELLAKWKSTPERPVPLPL

SEQ ID NO: 1068987 - protein, 18 aa, Mycobacterium
AELMSAPWYDERLAKLAA

SEQ ID NO: 1068988 - protein, 18 aa, Mycobacterium
AELRDRYHVARLDSPLVG

SEQ ID NO: 1068989 - protein, 32 aa, Mycobacterium; identical to SEQ ID NO: 789554

SEQ ID NO: 1068990 - protein, 27 aa, Mycobacterium
AELSSWQRSWALACQKAFAGLEVDPNR

SEQ ID NO: 1068991 - protein, 23 aa, Mycobacterium
AELVALHAWTDMGPLDFPSINWA

SEQ ID NO: 1068992 - protein, 25 aa, Mycobacterium
AELVRDPRWIALAGPAPRIQLVHDD

SEQ ID NO: 1068993 - protein, 34 aa, Mycobacterium; identical to SEQ ID NO: 789569

SEQ ID NO: 1068994 - protein, 19 aa, Mycobacterium
AELVWLGAAMIIGAGSTLF

SEQ ID NO: 1068995 - protein, 17 aa, Mycobacterium
AEMLKPCTLELGGKSAA

SEQ ID NO: 1068996 - protein, 23 aa, Mycobacterium
AENMARLLMVARERYYLFRHHQD

SEQ ID NO: 1068997 - protein, 17 aa, Mycobacterium
AEPACLGYVFYAPPRAV

SEQ ID NO: 1068998 - protein, 24 aa, Mycobacterium
AEPALCRTQYYINRAFAAVGRLLH

SEQ ID NO: 1068999 - protein, 23 aa, Mycobacterium
AEPHMYVGPALWPAAKDIAAAID

SEQ ID NO: 1069000 - protein, 24 aa, Mycobacterium
AEPHPVLPTTPWQHGQHWISSTTA

SEQ ID NO: 1069001 - protein, 24 aa, Mycobacterium
AEPLWEHWDRCALHWFPGSHVLHV

SEQ ID NO: 1069002 - protein, 19 aa, Mycobacterium
AEPMPFLLTNTRLARTTWR

SEQ ID NO: 1069003 - protein, 25 aa, Mycobacterium
AEPQAIWNVLADFGALSTWADGIDH

SEQ ID NO: 1069004 - protein, 19 aa, Mycobacterium
AEPSPLLRRRSLTTRTEAI

SEQ ID NO: 1069005 - protein, 24 aa, Mycobacterium
AEQAGISPLQLVERDLLGVINVPS

SEQ ID NO: 1069006 - protein, 26 aa, Mycobacterium
AEQFHDQFVHTLRAAGYTYEDAEYTN

SEQ ID NO: 1069007 - protein, 24 aa, Mycobacterium
AEQISKVVIAYEPVWAIGTGRVAG

SEQ ID NO: 1069008 - protein, 18 aa, Mycobacterium
AEQLSNRVAFRRAMRKAI

SEQ ID NO: 1069009 - protein, 22 aa, Mycobacterium
AEQMKMFLTRLGFGSKVVVTGD

SEQ ID NO: 1069010 - protein, 23 aa, Mycobacterium
AEQRAGWDLSPLQVIVSAAEPVR

SEQ ID NO: 1069011 - protein, 27 aa, Mycobacterium
AEQTPASVLYLMSLIGDLLPPGVVNVV

SEQ ID NO: 1069012 - protein, 24 aa, Mycobacterium
AEQYLWMVPQNIAGLVTALGGRAA

SEQ ID NO: 1069013 - protein, 28 aa, Mycobacterium
AERAKLSPWIPTLKLHYVRVIPTGITGR

SEQ ID NO: 1069014 - protein, 24 aa, Mycobacterium
AERDKLWRKVWQQVGRVEDLPKVG

SEQ ID NO: 1069015 - protein, 20 aa, Mycobacterium
AERFSPFSGFGFFASGLSGF

SEQ ID NO: 1069016 - protein, 24 aa, Mycobacterium
AERGYGYGPAFRGLNAMWRRGDEV

SEQ ID NO: 1069017 - protein, 24 aa, Mycobacterium
AERIGLVDLVFPRASFDSTDGGWR

SEQ ID NO: 1069018 - protein, 22 aa, Mycobacterium
AERLLRSRLAQLRPGDPIVGEE

SEQ ID NO: 1069019 - protein, 26 aa, Mycobacterium
AERRGEPWFDPAGLFLALEGSEGAED

SEQ ID NO: 1069020 - protein, 21 aa, Mycobacterium
AERRRIVELLLNGAPISRDSA

SEQ ID NO: 1069021 - protein, 22 aa, Mycobacterium
AESAPVPSLRDLLRRVEMGIGS

SEQ ID NO: 1069022 - protein, 17 aa, Mycobacterium
AESFIAIDLLPPEIVAS

SEQ ID NO: 1069023 - protein, 24 aa, Mycobacterium
AESYAYQRPAPIETFPVLSQSVVH

SEQ ID NO: 1069024 - protein, 23 aa, Mycobacterium
AETLTWSQLYRRTLNVARELSSC

SEQ ID NO: 1069025 - protein, 23 aa, Mycobacterium
AETTWKLLLDNQSGIRMLDDPFI

SEQ ID NO: 1069026 - protein, 18 aa, Mycobacterium
AEVDGHHVFWTVHARNKR

SEQ ID NO: 1069027 - protein, 25 aa, Mycobacterium
AEVENPKCHIAWTTLAGIGQVESHN

SEQ ID NO: 1069028 - protein, 18 aa, Mycobacterium
AEVLRGRKVAPGVRMLIV

SEQ ID NO: 1069029 - protein, 26 aa, Mycobacterium
AEVLRPGLLVLPVRGAARFFGSEQQA

SEQ ID NO: 1069030 - protein, 30 aa, Mycobacterium; identical to SEQ ID NO: 113110

SEQ ID NO: 1069031 - protein, 18 aa, Mycobacterium
AEVRFLPAGAIPRTTSGK

SEQ ID NO: 1069032 - protein, 23 aa, Mycobacterium
AEVRQLYLDTLKDWPVDELPEVN

SEQ ID NO: 1069033 - protein, 33 aa, Mycobacterium
AEVSPLEMTKWFDTNYHYLVPEIGPDTRFGLHP

SEQ ID NO: 1069034 - protein, 25 aa, Mycobacterium
AEWGLRCFAPTWPLGTHPRALGPDA

SEQ ID NO: 1069035 - protein, 25 aa, Mycobacterium
AEWMAPLLEAMDLTVGWITAESTGA

SEQ ID NO: 1069036 - protein, 29 aa, Mycobacterium
AEWRDHGLRYLLVINGSLVNPSLRKTVTA

SEQ ID NO: 1069037 - protein, 23 aa, Mycobacterium
AEYGQLVSLFPLQKALPVGDGHP

SEQ ID NO: 1069038 - protein, 26 aa, Mycobacterium
AEYKKLLVAMLQRREAWQIIDHVNSL

SEQ ID NO: 1069039 - protein, 24 aa, Mycobacterium
AFAALYRFQFDQVRRLLAWATPYR

SEQ ID NO: 1069040 - protein, 19 aa, Mycobacterium
AFAGADLELVFLGANSLQP

SEQ ID NO: 1069041 - protein, 17 aa, Mycobacterium
AFAGPRFLMRVAELEMH

SEQ ID NO: 1069042 - protein, 17 aa, Mycobacterium
AFALEHQPRERDYRNAI

SEQ ID NO: 1069043 - protein, 20 aa, Mycobacterium
AFDEDWPNALPWHVTSRGAS

SEQ ID NO: 1069044 - protein, 18 aa, Mycobacterium
AFDEGWVKPLPPQTLTGK

SEQ ID NO: 1069045 - protein, 27 aa, Mycobacterium
AFDTLSFYRPNQPGAYPIVLATYEIVC

SEQ ID NO: 1069046 - protein, 19 aa, Mycobacterium
AFEFVPDTAVFNDERWRSH

SEQ ID NO: 1069047 - protein, 18 aa, Mycobacterium
AFFGEKDYQQLVLIRQMV

SEQ ID NO: 1069048 - protein, 21 aa, Mycobacterium
AFGCEPPLRELLNGATVERLS

SEQ ID NO: 1069049 - protein, 17 aa, Mycobacterium
AFGDVLTAAGLPAPRYG

SEQ ID NO: 1069050 - protein, 18 aa, Mycobacterium
AFGSFHMVDGFLLNNQLS

SEQ ID NO: 1069051 - protein, 19 aa, Mycobacterium
AFHAELVRLLNGGAASYLS

SEQ ID NO: 1069052 - protein, 26 aa, Mycobacterium
AFHDGAPLYIELPVTVEFVVTHTEPG

SEQ ID NO: 1069053 - protein, 17 aa, Mycobacterium
AFHDRFVQTVNAAAASY

SEQ ID NO: 1069054 - protein, 19 aa, Mycobacterium
AFHERFLQTLAASAASYEH

SEQ ID NO: 1069055 - protein, 18 aa, Mycobacterium
AFHQQFLEGLRGASGAYV

SEQ ID NO: 1069056 - protein, 18 aa, Mycobacterium
AFHSPLMEPMLEEFVRVA

SEQ ID NO: 1069057 - protein, 18 aa, Mycobacterium
AFHYRYHPLTLRIEQIIA

SEQ ID NO: 1069058 - protein, 25 aa, Mycobacterium
AFIDTDSFNISWSDGLKSRLARGTR

SEQ ID NO: 1069059 - protein, 36 aa, Mycobacterium
AFISGNYSNGLLWRGDYQGLWGIDYAITIPDTAIPL

SEQ ID NO: 1069060 - protein, 26 aa, Mycobacterium
AFIYDHFTPFVFTQLEELGFCGRGEA

SEQ ID NO: 1069061 - protein, 22 aa, Mycobacterium
AFLGRLALVRIYNGKLRKGQQV

SEQ ID NO: 1069062 - protein, 23 aa, Mycobacterium
AFMAGLLDTLWEQGLLDADRRTE

SEQ ID NO: 1069063 - protein, 19 aa, Mycobacterium
AFNESDYMRMWVQAAITMT

SEQ ID NO: 1069064 - protein, 19 aa, Mycobacterium
AFNPTYLIDGLASLHSERV

SEQ ID NO: 1069065 - protein, 18 aa, Mycobacterium
AFPASRWRRYDKLSRFPA

SEQ ID NO: 1069066 - protein, 19 aa, Mycobacterium
AFQVLAKWSQKSNTKLRLL

SEQ ID NO: 1069067 - protein, 21 aa, Mycobacterium
AFRAFYALPTENFKTRGGLTT

SEQ ID NO: 1069068 - protein, 29 aa, Mycobacterium
AFRQRFGEHFFYILYFQQPGVADAELNGD

SEQ ID NO: 1069069 - protein, 24 aa, Mycobacterium
AFRSALFEMTLRHPILRTTFDLSA

SEQ ID NO: 1069070 - protein, 17 aa, Mycobacterium
AFRTTIGLPGRLATRLQ

SEQ ID NO: 1069071 - protein, 22 aa, Mycobacterium
AFRYVMMVLRHIPRSIFRRLPI

SEQ ID NO: 1069072 - protein, 31 aa, Mycobacterium
AFSEGELFIIGRIKDLLIIYGRNHSPDDIEA

SEQ ID NO: 1069073 - protein, 20 aa, Mycobacterium
AFSLPDKYYDKVDVTVLPPF

SEQ ID NO: 1069074 - protein, 17 aa, Mycobacterium
AFTDYPFAYLITVDDDH

SEQ ID NO: 1069075 - protein, 25 aa, Mycobacterium
AFTEKYGIPVLTSYAATEFGGGVAG

SEQ ID NO: 1069076 - protein, 19 aa, Mycobacterium
AFTGRRPVHPTGLTSPIRA

SEQ ID NO: 1069077 - protein, 18 aa, Mycobacterium
AFTSWKTLSWVDANVWRR

SEQ ID NO: 1069078 - protein, 18 aa, Mycobacterium
AFYAKRIVAGEGAVVHGA

SEQ ID NO: 1069079 - protein, 18 aa, Mycobacterium
AGAAGAMLLGNGGDGADG

SEQ ID NO: 1069080 - protein, 25 aa, Mycobacterium
AGADEVSVGIAALFADHAQEYEVVL

SEQ ID NO: 1069081 - protein, 24 aa, Mycobacterium
AGAGIVGTGVERANTALAAAAALA

SEQ ID NO: 1069082 - protein, 24 aa, Mycobacterium
AGAKLLEAYAVPPLLHNQALAISV

SEQ ID NO: 1069083 - protein, 19 aa, Mycobacterium
AGALGLPFPPAMVFEHMTI

SEQ ID NO: 1069084 - protein, 24 aa, Mycobacterium
AGALLMRRDVSCVPLLHGGGQERD

SEQ ID NO: 1069085 - protein, 19 aa, Mycobacterium
AGALRRWLLAHSELADHSL

SEQ ID NO: 1069086 - protein, 23 aa, Mycobacterium
AGAMVLALHESATDRLVETAVAQ

SEQ ID NO: 1069087 - protein, 25 aa, Mycobacterium
AGAPSGIIPTPWPASTGATRRSSAA

SEQ ID NO: 1069088 - protein, 20 aa, Mycobacterium
AGAPVLVQVPRRGYVPSLAC

SEQ ID NO: 1069089 - protein, 23 aa, Mycobacterium
AGASVWFNAVFRGDYAPVVIREG

SEQ ID NO: 1069090 - protein, 27 aa, Mycobacterium
AGATEALRWAMMRGEPLLVLADALAEA

SEQ ID NO: 1069091 - protein, 33 aa, Mycobacterium; identical to SEQ ID NO: 790303

SEQ ID NO: 1069092 - protein, 34 aa, Mycobacterium
AGCRVDCDLDFTTVIWRKLVLNALAGLMALSGRR

SEQ ID NO: 1069093 - protein, 27 aa, Mycobacterium
AGDAVALAAFRRGTRGLAAMIASVGAV

SEQ ID NO: 1069094 - protein, 30 aa, Mycobacterium
AGDFELQVLGMWLMPLRHLAVGDPEPALRW

SEQ ID NO: 1069095 - protein, 30 aa, Mycobacterium
AGDHAAICWPLLVGMAKAKYYLLTCETLSG

SEQ ID NO: 1069096 - protein, 26 aa, Mycobacterium
AGDLALAELRHALPGALFVSAHTGDG

SEQ ID NO: 1069097 - protein, 23 aa, Mycobacterium
AGDLARWLPLDPPAADSTGIVFC

SEQ ID NO: 1069098 - protein, 26 aa, Mycobacterium
AGDLLRPVLGVPRHPLRPAAFGPRAA

SEQ ID NO: 1069099 - protein, 18 aa, Mycobacterium
AGDLTFAGAGGFGGFGGT

SEQ ID NO: 1069100 - protein, 24 aa, Mycobacterium
AGDPFRALNPLSWASAAKAEATSS

SEQ ID NO: 1069101 - protein, 25 aa, Mycobacterium
AGDQAGFPLGWVHDVVWAPRPAAEP

SEQ ID NO: 1069102 - protein, 29 aa, Mycobacterium
AGDRVAIYLPLIPEAVIAMLACARLGIMH

SEQ ID NO: 1069103 - protein, 25 aa, Mycobacterium
AGDVNEELLLQLKSWRLNTAKEQNV

SEQ ID NO: 1069104 - protein, 29 aa, Mycobacterium
AGEAAAVSPLLDAINAPVLADTGRPLIGN

SEQ ID NO: 1069105 - protein, 31 aa, Mycobacterium
AGEIDTAIAALRPPRHPILDADLHLGDRRVR

SEQ ID NO: 1069106 - protein, 22 aa, Mycobacterium
AGEISVMFHPRRGGADIQSDPL

SEQ ID NO: 1069107 - protein, 23 aa, Mycobacterium
AGELALLRLACEAADAALSDLIK

SEQ ID NO: 1069108 - protein, 18 aa, Mycobacterium
AGELLSVPVGDHRVLVLA

SEQ ID NO: 1069109 - protein, 29 aa, Mycobacterium
AGEPWTVSKLYYIHGFLRERMRILQDEFI

SEQ ID NO: 1069110 - protein, 40 aa, Mycobacterium
AGETAWLTRPLIDSYHTVWFELHEELILAVGLTREQAARS

SEQ ID NO: 1069111 - protein, 24 aa, Mycobacterium
AGETRVPFLLHVLDMVEGRVSHVT

SEQ ID NO: 1069112 - protein, 20 aa, Mycobacterium
AGEVFGAWQTVLAGRFRAQG

SEQ ID NO: 1069113 - protein, 25 aa, Mycobacterium
AGFDAGRPTAWIAEGLFGYLPPEAQ

SEQ ID NO: 1069114 - protein, 20 aa, Mycobacterium
AGFHTLNLQTYLTVGPKEAR

SEQ ID NO: 1069115 - protein, 17 aa, Mycobacterium
AGFLTARPGVCLTTSGP

SEQ ID NO: 1069116 - protein, 22 aa, Mycobacterium
AGGAAGWWGAGGAGGQGGTGGM

SEQ ID NO: 1069117 - protein, 24 aa, Mycobacterium
AGGAGGLFFGNGGAGGPGGSGGLN

SEQ ID NO: 1069118 - protein, 27 aa, Mycobacterium
AGGAGGNGGWLFGQGGAGGIGGSGAAG

SEQ ID NO: 1069119 - protein, 27 aa, Mycobacterium
AGGAGGTGGWWFGNGGVGGAGGAGTAG

SEQ ID NO: 1069120 - protein, 24 aa, Mycobacterium
AGGAGGWLMGTGGAGGFSGAGDGG

SEQ ID NO: 1069121 - protein, 26 aa, Mycobacterium
AGGAVTGSINPLGNAGAHGANGTGGV

SEQ ID NO: 1069122 - protein, 24 aa, Mycobacterium
AGGDAGLLGLNGAGGHGGGGGMGG

SEQ ID NO: 1069123 - protein, 25 aa, Mycobacterium
AGGEEALYLRPFIIATEPGLGVRPA

SEQ ID NO: 1069124 - protein, 23 aa, Mycobacterium
AGGGTGWFGSTGITGAGGNGGTG

SEQ ID NO: 1069125 - protein, 19 aa, Mycobacterium
AGGHGGWLAGTGGAGGAGG

SEQ ID NO: 1069126 - protein, 26 aa, Mycobacterium
AGGIDFRLFRTIVFRTDLITESDALA

SEQ ID NO: 1069127 - protein, 24 aa, Mycobacterium
AGGKGGLLFGAGGEGGAGGTGGAG

SEQ ID NO: 1069128 - protein, 18 aa, Mycobacterium
AGGLLPSTGVGAGACCAP

SEQ ID NO: 1069129 - protein, 28 aa, Mycobacterium
AGGMGGSGGWLLGNGGAGGAGGVGCAGV

SEQ ID NO: 1069130 - protein, 23 aa, Mycobacterium
AGGMGGVGGMGGALGGHGGAGGV

SEQ ID NO: 1069131 - protein, 25 aa, Mycobacterium
AGGMVPITVINWFGDQPFAVCQWTQ

SEQ ID NO: 1069132 - protein, 23 aa, Mycobacterium
AGGNAGLLFSAGGVGGAGGYGSS

SEQ ID NO: 1069133 - protein, 23 aa, Mycobacterium
AGGNGGWLLSNGGVGGAGGAGAD

SEQ ID NO: 1069134 - protein, 23 aa, Mycobacterium
AGGNGGWLYGNGGAGGLGGAAAG

SEQ ID NO: 1069135 - protein, 24 aa, Mycobacterium
AGGPDTLLLLQHPAVYTAGRRTEP

SEQ ID NO: 1069136 - protein, 25 aa, Mycobacterium
AGGQGAALWGAGFGGDGAVGGNSFV

SEQ ID NO: 1069137 - protein, 28 aa, Mycobacterium
AGGQGGQGAVLIGAGFGGAGGDGGSATV

SEQ ID NO: 1069138 - protein, 36 aa, Mycobacterium; identical to SEQ ID NO: 790599

SEQ ID NO: 1069139 - protein, 22 aa, Mycobacterium
AGGSAGLWGAGGAGGAGGSATT

SEQ ID NO: 1069140 - protein, 24 aa, Mycobacterium
AGGSAVGWFGDGGAGGAGGPVVPT

SEQ ID NO: 1069141 - protein, 30 aa, Mycobacterium
AGGSGGQGGFLRFLGGQGDGGAGGAGGVAG

SEQ ID NO: 1069142 - protein, 25 aa, Mycobacterium
AGGSLLLHSLFTYDRRWLHEQGIAL

SEQ ID NO: 1069143 - protein, 18 aa, Mycobacterium
AGGTNYASGGRGGDATIR

SEQ ID NO: 1069144 - protein, 22 aa, Mycobacterium
AGHETLLTMSPTQRARTVAVVG

SEQ ID NO: 1069145 - protein, 17 aa, Mycobacterium
AGHLWKLVRTFDDPATW

SEQ ID NO: 1069146 - protein, 18 aa, Mycobacterium
AGHRLDLLAGIRFLDQSP

SEQ ID NO: 1069147 - protein, 23 aa, Mycobacterium
AGIARCLLFCQYAAKSYPPETAS

SEQ ID NO: 1069148 - protein, 25 aa, Mycobacterium
AGIGSLDLIRILPDTRRYLGRHLSV

SEQ ID NO: 1069149 - protein, 23 aa, Mycobacterium
AGIGSSFPQIPAPAAPPMGNPVR

SEQ ID NO: 1069150 - protein, 19 aa, Mycobacterium
AGILAAVLHYRLASGDAAA

SEQ ID NO: 1069151 - protein, 21 aa, Mycobacterium
AGILPITWAYIALMGPDGLAT

SEQ ID NO: 1069152 - protein, 23 aa, Mycobacterium
AGINTVVFDRGGYTYGGRIAALA

SEQ ID NO: 1069153 - protein, 24 aa, Mycobacterium
AGIRHLAPYVGYPTAAVALQQLRQ

SEQ ID NO: 1069154 - protein, 27 aa, Mycobacterium
AGISRPTFYFYFPSKEAVLLTLLDRVV

SEQ ID NO: 1069155 - protein, 25 aa, Mycobacterium
AGITCAVLIPQGKIAMGKLAQAVMH

SEQ ID NO: 1069156 - protein, 20 aa, Mycobacterium
AGIVPPRDLVFAFLADEEHG

SEQ ID NO: 1069157 - protein, 26 aa, Mycobacterium
AGKELPVVVFIWEVLGRIGIGRKDAL

SEQ ID NO: 1069158 - protein, 23 aa, Mycobacterium
AGKRRADMPLSIRSDYHPFLVAG

SEQ ID NO: 1069159 - protein, 27 aa, Mycobacterium
AGLAAAHQAILGDRLRLALDSSLCGAV

SEQ ID NO: 1069160 - protein, 27 aa, Mycobacterium
AGLCGALRRYHEALGMPISTLPMAVPV

SEQ ID NO: 1069161 - protein, 26 aa, Mycobacterium
AGLDADYWYRSIRQTVQFERAIRTAF

SEQ ID NO: 1069162 - protein, 18 aa, Mycobacterium
AGLDGPPRRHRPRRRGRG

SEQ ID NO: 1069163 - protein, 24 aa, Mycobacterium
AGLDPLAVIPPLAEPFVAAALDRA

SEQ ID NO: 1069164 - protein, 24 aa, Mycobacterium
AGLDSRAYRLSWPDGTTIFELDRP

SEQ ID NO: 1069165 - protein, 18 aa, Mycobacterium
AGLFASYARQRPRVLSDW

SEQ ID NO: 1069166 - protein, 22 aa, Mycobacterium
AGLGRFLAALPSPMALTAIELE

SEQ ID NO: 1069167 - protein, 25 aa, Mycobacterium
AGLGRSWLHAGIRPLDVDVAPPTVN

SEQ ID NO: 1069168 - protein, 19 aa, Mycobacterium
AGLIAVPLPVPQFGIHDER

SEQ ID NO: 1069169 - protein, 19 aa, Mycobacterium
AGLIKTILCLKNRAIPATL

SEQ ID NO: 1069170 - protein, 21 aa, Mycobacterium
AGLIVTRYILCLEPACSMTHD

SEQ ID NO: 1069171 - protein, 24 aa, Mycobacterium
AGLLAGIKLKQAGLPFVIIEKQAG

SEQ ID NO: 1069172 - protein, 17 aa, Mycobacterium
AGLLFNDLTVYFALAVR

SEQ ID NO: 1069173 - protein, 17 aa, Mycobacterium
AGLLLRTERLKARSVSA

SEQ ID NO: 1069174 - protein, 19 aa, Mycobacterium
AGLPALPLAIARHDLQVVL

SEQ ID NO: 1069175 - protein, 19 aa, Mycobacterium
AGLPFTSINYRLSADGIAA

SEQ ID NO: 1069176 - protein, 19 aa, Mycobacterium
AGLPGSPWHERAKKLSPKG

SEQ ID NO: 1069177 - protein, 20 aa, Mycobacterium
AGLRTLCLDAKLYAGGMAST

SEQ ID NO: 1069178 - protein, 28 aa, Mycobacterium
AGLTPGVRNLYLLGSSPLDELRTQFGNA

SEQ ID NO: 1069179 - protein, 25 aa, Mycobacterium
AGLTVNFPYLLDVQASHVAWILAWA

SEQ ID NO: 1069180 - protein, 19 aa, Mycobacterium
AGLWREVAGLPADRIQRRG

SEQ ID NO: 1069181 - protein, 22 aa, Mycobacterium
AGMEFAVLLFAVRKGFTYPRGY

SEQ ID NO: 1069182 - protein, 17 aa, Mycobacterium
AGNADFAIAIRTALMRN

SEQ ID NO: 1069183 - protein, 20 aa, Mycobacterium
AGNGGLLLGSGSRGGDGGDA

SEQ ID NO: 1069184 - protein, 23 aa, Mycobacterium
AGNVWEWTVDWYIDTPSARPAAE

SEQ ID NO: 1069185 - protein, 31 aa, Mycobacterium; identical to SEQ ID NO: 215182

SEQ ID NO: 1069186 - protein, 20 aa, Mycobacterium
AGPGLYRSFSSKQAILDALI

SEQ ID NO: 1069187 - protein, 19 aa, Mycobacterium
AGPLRLFGHRRVSNAHLRA

SEQ ID NO: 1069188 - protein, 30 aa, Mycobacterium; identical to SEQ ID NO: 790964

SEQ ID NO: 1069189 - protein, 18 aa, Mycobacterium
AGPSTLVRAGGQVFLVDC

SEQ ID NO: 1069190 - protein, 23 aa, Mycobacterium
AGPVHFDIPLREPLVPDPDPHGA

SEQ ID NO: 1069191 - protein, 29 aa, Mycobacterium
AGQDPRYILWAAWHRSGLQNRWLAAIDRG

SEQ ID NO: 1069192 - protein, 27 aa, Mycobacterium
AGQIGYSLLFRLASGSLLGPDRPIELR

SEQ ID NO: 1069193 - protein, 22 aa, Mycobacterium
AGQQYSWLPFGRNVAASPVRYG

SEQ ID NO: 1069194 - protein, 24 aa, Mycobacterium
AGQRFVVDITMWIDLADGARSDDL

SEQ ID NO: 1069195 - protein, 21 aa, Mycobacterium
AGRAWVSMAVPVAAAGRAGWS

SEQ ID NO: 1069196 - protein, 24 aa, Mycobacterium
AGRDAFWRLIAELDAQRLELSRPM

SEQ ID NO: 1069197 - protein, 19 aa, Mycobacterium
AGRHLAFSTGRHFCLGAAL

SEQ ID NO: 1069198 - protein, 26 aa, Mycobacterium
AGRLGLRPDVRRMPLFGLGCVAGAAG

SEQ ID NO: 1069199 - protein, 17 aa, Mycobacterium
AGRLTVFQRTPPWMVPK

SEQ ID NO: 1069200 - protein, 34 aa, Mycobacterium
AGRMWPHQLLTVFAARRMQLPVKLVLTRKQMYSS

SEQ ID NO: 1069201 - protein, 18 aa, Mycobacterium
AGRQLWVYGRAGQPCRRC

SEQ ID NO: 1069202 - protein, 25 aa, Mycobacterium
AGRREPIPLPIKTSYAWAAARHCGD

SEQ ID NO: 1069203 - protein, 26 aa, Mycobacterium
AGRSAPVVRAAPVGRPCSLGAPAAPA

SEQ ID NO: 1069204 - protein, 22 aa, Mycobacterium
AGRTWQPHQVPAFLAAGYRCIT

SEQ ID NO: 1069205 - protein, 20 aa, Mycobacterium
AGRVLLVWDAPNLDMRLGSI

SEQ ID NO: 1069206 - protein, 31 aa, Mycobacterium
AGRWGKYLGVQAGPLWLIAHLSRAGWLRWSD

SEQ ID NO: 1069207 - protein, 18 aa, Mycobacterium
AGSALARHVVAHHGVRQL

SEQ ID NO: 1069208 - protein, 27 aa, Mycobacterium
AGSAPATLLDYFPEDFLLVIDESHVTV

SEQ ID NO: 1069209 - protein, 21 aa, Mycobacterium
AGSCVFFVGTLWHGGGANTST

SEQ ID NO: 1069210 - protein, 27 aa, Mycobacterium
AGSDRIRFTPYQKLVILDIPDDKLDET

SEQ ID NO: 1069211 - protein, 27 aa, Mycobacterium
AGSLNRPGYLRFDFNWQGPLTEEQRGQ

SEQ ID NO: 1069212 - protein, 28 aa, Mycobacterium
AGSTATMDRLFRAAFRAGAGAALDAGAL

SEQ ID NO: 1069213 - protein, 17 aa, Mycobacterium
AGSTLFEMLRYVGDRFP

SEQ ID NO: 1069214 - protein, 26 aa, Mycobacterium
AGSTTPVELPFTGLADPHGLAFDSVD

SEQ ID NO: 1069215 - protein, 23 aa, Mycobacterium
AGSVVQQFPRDLRIIDTIEIGSS

SEQ ID NO: 1069216 - protein, 25 aa, Mycobacterium
AGTERILFTHIAVPVMTRLKQPERQ

SEQ ID NO: 1069217 - protein, 19 aa, Mycobacterium
AGTFGYVFDSALRMVPDGV

SEQ ID NO: 1069218 - protein, 22 aa, Mycobacterium
AGTFTPGLLETFNSGFGNLGNQ

SEQ ID NO: 1069219 - protein, 17 aa, Mycobacterium
AGTGGLGGLAGLAGRIV

SEQ ID NO: 1069220 - protein, 23 aa, Mycobacterium
AGTGGTFSSPIGGAGGTGGTGGN

SEQ ID NO: 1069221 - protein, 42 aa, Mycobacterium
AGTSKFDLVGWLPSYLHWYRLAMRGPVLRGTTGSLAALGAMW

SEQ ID NO: 1069222 - protein, 36 aa, Mycobacterium; identical to SEQ ID NO: 791212

SEQ ID NO: 1069223 - protein, 34 aa, Mycobacterium; identical to SEQ ID NO: 791223

SEQ ID NO: 1069224 - protein, 25 aa, Mycobacterium
AGVARSGFYFYFDSKYSVLAQLMAE

SEQ ID NO: 1069225 - protein, 24 aa, Mycobacterium
AGVDLALINYYFGSKRGLVGEALA

SEQ ID NO: 1069226 - protein, 25 aa, Mycobacterium
AGVETLGVGLWLPARTMAGLADDPA

SEQ ID NO: 1069227 - protein, 24 aa, Mycobacterium
AGVHQRFVQALTASGSSYAAAEAA

SEQ ID NO: 1069228 - protein, 18 aa, Mycobacterium
AGVLFGPGGIGGSGGQGM

SEQ ID NO: 1069229 - protein, 23 aa, Mycobacterium
AGVLRRFLLERGELPDTPLVATV

SEQ ID NO: 1069230 - protein, 25 aa, Mycobacterium
AGVNPTTMPAGNGTPGFTGRDTGGP

SEQ ID NO: 1069231 - protein, 23 aa, Mycobacterium
AGVRLVFMDAARREWNPSTIVEH

SEQ ID NO: 1069232 - protein, 27 aa, Mycobacterium
AGVVNFYGQLLQLLKNRLLLSDLRHRH

SEQ ID NO: 1069233 - protein, 21 aa, Mycobacterium
AGWHVYAGVRRAADGEALQAA

SEQ ID NO: 1069234 - protein, 17 aa, Mycobacterium
AGWIKRGPSGFIGTNKS

SEQ ID NO: 1069235 - protein, 20 aa, Mycobacterium
AGWLWSRRRGIVTGLSASAL

SEQ ID NO: 1069236 - protein, 20 aa, Mycobacterium
AGWRVGEGMALAMIATLPPG

SEQ ID NO: 1069237 - protein, 32 aa, Mycobacterium
AGYKARNPFAPLLLVLLQFQAGIKIDFRSEVT

SEQ ID NO: 1069238 - protein, 28 aa, Mycobacterium
AGYNHGSYIFLGPGFYPGSPSGGSGGNP

SEQ ID NO: 1069239 - protein, 24 aa, Mycobacterium
AGYVRKNSLWPATFGLACCAIEMM

SEQ ID NO: 1069240 - protein, 23 aa, Mycobacterium
AHAALVSLRRFVQAHPVMATPYV

SEQ ID NO: 1069241 - protein, 18 aa, Mycobacterium
AHALRFRPFASVREVVRD

SEQ ID NO: 1069242 - protein, 19 aa, Mycobacterium
AHAVLVDHLIPPMARAETY

SEQ ID NO: 1069243 - protein, 18 aa, Mycobacterium
AHAVVLFRAGLLTEEQRD

SEQ ID NO: 1069244 - protein, 39 aa, Mycobacterium
AHCQEFQVVSAQLRGFHDQLVRLMRAGAAAYASVEATAQ

SEQ ID NO: 1069245 - protein, 24 aa, Mycobacterium
AHDDAFRHWWDLAGNRAASPSTAR

SEQ ID NO: 1069246 - protein, 24 aa, Mycobacterium
AHDPLVEGLRALGHQVNLADQSSG

SEQ ID NO: 1069247 - protein, 27 aa, Mycobacterium
AHDVARCWLYLGLTRLASGALEVADQC

SEQ ID NO: 1069248 - protein, 24 aa, Mycobacterium
AHDVDVAALPRPLTLDCFSSLPPE

SEQ ID NO: 1069249 - protein, 34 aa, Mycobacterium
AHERSLNIDFLLGYLRELLPRRPDLKLIVTSATI

SEQ ID NO: 1069250 - protein, 29 aa, Mycobacterium
AHEVTHYLFKHPKVDFIWVTGGPKIVALA

SEQ ID NO: 1069251 - protein, 21 aa, Mycobacterium
AHGDWPVKPAPPFVPGHEGCG

SEQ ID NO: 1069252 - protein, 18 aa, Mycobacterium
AHGIGVVGLLNVQYALKD

SEQ ID NO: 1069253 - protein, 29 aa, Mycobacterium
AHGQDVVLRTYLLAGLAASRLALGQLDLA

SEQ ID NO: 1069254 - protein, 25 aa, Mycobacterium
AHHVAAWRAARLLVLDAFTTAEAAV

SEQ ID NO: 1069255 - protein, 23 aa, Mycobacterium
AHIRIDRLVAMPSLPTTPVGKID

SEQ ID NO: 1069256 - protein, 26 aa, Mycobacterium
AHLIDAARPFIFDTGLAPGAVGAARA

SEQ ID NO: 1069257 - protein, 18 aa, Mycobacterium
AHLLPYHHPVELAHRVAY

SEQ ID NO: 1069258 - protein, 18 aa, Mycobacterium
AHLVLTVNGKIPGLSMKT

SEQ ID NO: 1069259 - protein, 22 aa, Mycobacterium
AHMAAFHDQFVQTLKTGALAYT

SEQ ID NO: 1069260 - protein, 19 aa, Mycobacterium
AHNVAFDYSFLAAEAELTD

SEQ ID NO: 1069261 - protein, 24 aa, Mycobacterium
AHPALDRQSLLALTLRLVSGVGLR

SEQ ID NO: 1069262 - protein, 24 aa, Mycobacterium
AHPDWSVPFVAWGYHPLWHGPIGR

SEQ ID NO: 1069263 - protein, 18 aa, Mycobacterium
AHPFVDRQLIIVADGHVD

SEQ ID NO: 1069264 - protein, 18 aa, Mycobacterium
AHRIAWSHLWERLSIEFS

SEQ ID NO: 1069265 - protein, 31 aa, Mycobacterium; identical to SEQ ID NO: 791569

SEQ ID NO: 1069266 - protein, 33 aa, Mycobacterium; identical to SEQ ID NO: 791574

SEQ ID NO: 1069267 - protein, 17 aa, Mycobacterium
AHRVIELLHTIHLPVVC

SEQ ID NO: 1069268 - protein, 17 aa, Mycobacterium
AHTLGLHGPAMTVDTAC

SEQ ID NO: 1069269 - protein, 28 aa, Mycobacterium
AHTNSLARWYAVPLQGPYSAAKAALGVL

SEQ ID NO: 1069270 - protein, 18 aa, Mycobacterium
AHVGVRVNAIAPGLIRSA

SEQ ID NO: 1069271 - protein, 20 aa, Mycobacterium
AHVPRHMFILFGMGKHKCIG

SEQ ID NO: 1069272 - protein, 18 aa, Mycobacterium
AHVRTWGRNARLTDLMQP

SEQ ID NO: 1069273 - protein, 22 aa, Mycobacterium
AHYGVFITPFRASLGRLGVIHA

SEQ ID NO: 1069274 - protein, 22 aa, Mycobacterium
AHYTRLAALDLCPRIRVNAIAP

SEQ ID NO: 1069275 - protein, 17 aa, Mycobacterium
AIAAFLGLSPRDPSASP

SEQ ID NO: 1069276 - protein, 27 aa, Mycobacterium
AIAAGVNLLLSPAVFRGFDQVGALSPT

SEQ ID NO: 1069277 - protein, 20 aa, Mycobacterium
AIADHWARLTFDGAAAGRDY

SEQ ID NO: 1069278 - protein, 27 aa, Mycobacterium
AIAEGGWVLPYLPKPWGRASSPVEQVI

SEQ ID NO: 1069279 - protein, 24 aa, Mycobacterium
AIAHALERPLDLDRPLWECWVIEG

SEQ ID NO: 1069280 - protein, 18 aa, Mycobacterium
AIAHRLLRRAVARLPLRL

SEQ ID NO: 1069281 - protein, 32 aa, Mycobacterium
AIAIPAAPLPDARPFGVMLIAAAFGDQVAIDI

SEQ ID NO: 1069282 - protein, 20 aa, Mycobacterium
AIALDWLRKHGCQDLASRAC

SEQ ID NO: 1069283 - protein, 20 aa, Mycobacterium
AIALGHPLGATGAKLFTTML

SEQ ID NO: 1069284 - protein, 18 aa, Mycobacterium
AIALYRSVGFEQVGLRRR

SEQ ID NO: 1069285 - protein, 20 aa, Mycobacterium
AIARLTGLEILRKTRDDEDS

SEQ ID NO: 1069286 - protein, 22 aa, Mycobacterium
AIATYLVTLYTSLAVLTDDALA

SEQ ID NO: 1069287 - protein, 23 aa, Mycobacterium
AICDALQVPLSEVLIGAGERMAR

SEQ ID NO: 1069288 - protein, 23 aa, Mycobacterium
AICTQFLETFKEFPPRHPPARFT

SEQ ID NO: 1069289 - protein, 18 aa, Mycobacterium
AIDATMGLPLALGVEALG

SEQ ID NO: 1069290 - protein, 33 aa, Mycobacterium; identical to SEQ ID NO: 791716

SEQ ID NO: 1069291 - protein, 19 aa, Mycobacterium
AIDRLLLETDQVFGWVAFE

SEQ ID NO: 1069292 - protein, 27 aa, Mycobacterium
AIEAIYALIYGLTELAATLPLDQFHAA

SEQ ID NO: 1069293 - protein, 25 aa, Mycobacterium
AIEAPIAITPWRSVLVFDLDEAIAD

SEQ ID NO: 1069294 - protein, 22 aa, Mycobacterium
AIEATYVFPLPARAGVTDFVAD

SEQ ID NO: 1069295 - protein, 29 aa, Mycobacterium
AIEDHLRYSLGRPAALLEPKHYYRALALA

SEQ ID NO: 1069296 - protein, 25 aa, Mycobacterium
AIERDALSLFLAKTFLAEEPDAPVA

SEQ ID NO: 1069297 - protein, 26 aa, Mycobacterium
AIERIWQATRYWYQAGMHPAIQLCIR

SEQ ID NO: 1069298 - protein, 21 aa, Mycobacterium
AIERLLAHQLRPRPADRLEQP

SEQ ID NO: 1069299 - protein, 31 aa, Mycobacterium; identical to SEQ ID NO: 791763

SEQ ID NO: 1069300 - protein, 21 aa, Mycobacterium
AIFAGYQQLRPLRPGWRGRSG

SEQ ID NO: 1069301 - protein, 20 aa, Mycobacterium
AIFGVSHIWRRIRAEELPVA

SEQ ID NO: 1069302 - protein, 25 aa, Mycobacterium
AIGATLLQDWSQFAAPAVFGAAMRV

SEQ ID NO: 1069303 - protein, 20 aa, Mycobacterium
AIGAVLSMHFAKQAAPFFDS

SEQ ID NO: 1069304 - protein, 17 aa, Mycobacterium
AIGFTKLAHRGSPVACG

SEQ ID NO: 1069305 - protein, 17 aa, Mycobacterium
AIGFVNSRPKPLSAYLF

SEQ ID NO: 1069306 - protein, 22 aa, Mycobacterium
AIGMEFGYVLKNYGVDVTIVEF

SEQ ID NO: 1069307 - protein, 29 aa, Mycobacterium
AIGNAPTALFRLLELLDEGAPAPAAVLGG

SEQ ID NO: 1069308 - protein, 25 aa, Mycobacterium
AIGRIQEMLALPFDLSDAPPVRVLL

SEQ ID NO: 1069309 - protein, 19 aa, Mycobacterium
AIGVIPMPPAEAIALGMQR

SEQ ID NO: 1069310 - protein, 27 aa, Mycobacterium
AIGVNFIDTYFRSGSYPRELPFVIGSE

SEQ ID NO: 1069311 - protein, 20 aa, Mycobacterium
AIHDRFVAALAAGAQSYEAA

SEQ ID NO: 1069312 - protein, 19 aa, Mycobacterium
AIHLVTLLEALPVQETLEA

SEQ ID NO: 1069313 - protein, 24 aa, Mycobacterium
AIITGWDYPSCEAIGLLKMDFLGL

SEQ ID NO: 1069314 - protein, 25 aa, Mycobacterium
AIKDAEWWRLGLAEEIGGMPAPPPL

SEQ ID NO: 1069315 - protein, 32 aa, Mycobacterium
AIKRPDYSITGWVILTLIQHGTAWQIERFVEK

SEQ ID NO: 1069316 - protein, 17 aa, Mycobacterium
AIKWPPPVTFSQLRELV

SEQ ID NO: 1069317 - protein, 18 aa, Mycobacterium
AILDEWKTISGLDRKVDD

SEQ ID NO: 1069318 - protein, 18 aa, Mycobacterium
AILLAHHGQLIVGVSIEE

SEQ ID NO: 1069319 - protein, 19 aa, Mycobacterium
AILPIIESPVADSLPVVNS

SEQ ID NO: 1069320 - protein, 17 aa, Mycobacterium
AIPAAMGAKIALPDTEV

SEQ ID NO: 1069321 - protein, 18 aa, Mycobacterium
AIPGIFPPVSINGRELID

SEQ ID NO: 1069322 - protein, 27 aa, Mycobacterium
AIQESLNSLGPIFSELRDAGRDLLELR

SEQ ID NO: 1069323 - protein, 18 aa, Mycobacterium
AIRDGVDPALRAAAAMAS

SEQ ID NO: 1069324 - protein, 19 aa, Mycobacterium
AIREKFWSDASLQTAPWSA

SEQ ID NO: 1069325 - protein, 24 aa, Mycobacterium
AIRERRARRPAWRPAASIRSHSVH

SEQ ID NO: 1069326 - protein, 25 aa, Mycobacterium
AIRLLQELHAAPLDPGLLGAAVARI

SEQ ID NO: 1069327 - protein, 25 aa, Mycobacterium
AIRPFPHHCAYGAAKWALRGLTQTA

SEQ ID NO: 1069328 - protein, 18 aa, Mycobacterium
AIRQVFVKLLDDLPGATW

SEQ ID NO: 1069329 - protein, 17 aa, Mycobacterium
AIRRTRWQIWKFQHDNT

SEQ ID NO: 1069330 - protein, 20 aa, Mycobacterium
AIRYLGHTVTWADLRYRVAA

SEQ ID NO: 1069331 - protein, 25 aa, Mycobacterium
AISAALMLIWACDLIVAADNAKFSD

SEQ ID NO: 1069332 - protein, 25 aa, Mycobacterium
AISELTGIWWFGPAAESMVAAVLPF

SEQ ID NO: 1069333 - protein, 17 aa, Mycobacterium
AISKRRKARRGRGPLSL

SEQ ID NO: 1069334 - protein, 34 aa, Mycobacterium; identical to SEQ ID NO: 792005

SEQ ID NO: 1069335 - protein, 21 aa, Mycobacterium
AISSVYRRYLTERPLIFSEYL

SEQ ID NO: 1069336 - protein, 31 aa, Mycobacterium; identical to SEQ ID NO: 792009

SEQ ID NO: 1069337 - protein, 32 aa, Mycobacterium; identical to SEQ ID NO: 792012

SEQ ID NO: 1069338 - protein, 26 aa, Mycobacterium
AITLYRDQLGLRLALDRSFADWGMRL

SEQ ID NO: 1069339 - protein, 18 aa, Mycobacterium
AITMIEMLAMSDLSLMVK

SEQ ID NO: 1069340 - protein, 32 aa, Mycobacterium; identical to SEQ ID NO: 792023

SEQ ID NO: 1069341 - protein, 19 aa, Mycobacterium
AITTRLVVPRARYDEAVAI

SEQ ID NO: 1069342 - protein, 20 aa, Mycobacterium
AITWHKYVAGLVVQAKLAID

SEQ ID NO: 1069343 - protein, 21 aa, Mycobacterium
AIVAFNPKYVRYEVFGPPGTV

SEQ ID NO: 1069344 - protein, 18 aa, Mycobacterium
AIVAPKPLQNNGIPLWVA

SEQ ID NO: 1069345 - protein, 24 aa, Mycobacterium
AIVEELFPMAAITDLKAFFGASDD

SEQ ID NO: 1069346 - protein, 20 aa, Mycobacterium
AIYRPFHHQTVYFDSSVIER

SEQ ID NO: 1069347 - protein, 19 aa, Mycobacterium
AKAAAFIHHLPVDQSFTLE

SEQ ID NO: 1069348 - protein, 32 aa, Mycobacterium
AKAFARLGIRCFGFSPLRLPPELDFATLFHGV

SEQ ID NO: 1069349 - protein, 33 aa, Mycobacterium
AKAFESWRWFTPSERQRALLRLADLIEDNAEEL

SEQ ID NO: 1069350 - protein, 18 aa, Mycobacterium
AKAFLCSEIARWVNEEGL

SEQ ID NO: 1069351 - protein, 25 aa, Mycobacterium
AKAFSRLFAESLWLELREAGVDVLE

SEQ ID NO: 1069352 - protein, 27 aa, Mycobacterium
AKALHAPLDVLLVRKLGVPLHSELAFG

SEQ ID NO: 1069353 - protein, 24 aa, Mycobacterium
AKARGLWNLFLPAESGLTNLEYAP

SEQ ID NO: 1069354 - protein, 29 aa, Mycobacterium
AKAYAAAWGVPFYAVNHLGGHLAADVYEH

SEQ ID NO: 1069355 - protein, 29 aa, Mycobacterium
AKAYSAAWGVPFYAVNHLGGHLAADVYEH

SEQ ID NO: 1069356 - protein, 22 aa, Mycobacterium
AKEVFEAVTGRDDVKREGQAQQ

SEQ ID NO: 1069357 - protein, 18 aa, Mycobacterium
AKGALIHRLIRTGRSLFT

SEQ ID NO: 1069358 - protein, 43 aa, Mycobacterium; identical to SEQ ID NO: 792153

SEQ ID NO: 1069359 - protein, 26 aa, Mycobacterium
AKKRPEFGKLTPLYPNQRLRLETTTE

SEQ ID NO: 1069360 - protein, 22 aa, Mycobacterium
AKLASRMLLQVHDELLFEVAIG

SEQ ID NO: 1069361 - protein, 20 aa, Mycobacterium
AKLEGDAAFFWAPGGDAKVV

SEQ ID NO: 1069362 - protein, 17 aa, Mycobacterium
AKLFHTIAISLSTLPAD

SEQ ID NO: 1069363 - protein, 17 aa, Mycobacterium
AKLLLLEDRFRVDFEKL

SEQ ID NO: 1069364 - protein, 22 aa, Mycobacterium
AKLRQAAILALGGRPEELTDAA

SEQ ID NO: 1069365 - protein, 19 aa, Mycobacterium
AKLSSTWLRANFITSLDGG

SEQ ID NO: 1069366 - protein, 23 aa, Mycobacterium
AKNAGLRRFVFTSSYATVDRRHG

SEQ ID NO: 1069367 - protein, 27 aa, Mycobacterium
AKPGHITFGSDWPFAPTAAGKLFAAGL

SEQ ID NO: 1069368 - protein, 30 aa, Mycobacterium
AKPTLAARWKPLLEPLLAELAAQDLIVDLR

SEQ ID NO: 1069369 - protein, 29 aa, Mycobacterium
AKQAETLAFFPLWSYATPTAIELAERVAH

SEQ ID NO: 1069370 - protein, 24 aa, Mycobacterium
AKQALTEAVLWPLQHPDTFARLGV

SEQ ID NO: 1069371 - protein, 23 aa, Mycobacterium
AKQPLSVFFSDILHRDGRDLLDA

SEQ ID NO: 1069372 - protein, 23 aa, Mycobacterium
AKRDSEWMGRVHRFLGLDVGVIL

SEQ ID NO: 1069373 - protein, 19 aa, Mycobacterium
AKRGFDPVLGARPLRRTIQ

SEQ ID NO: 1069374 - protein, 22 aa, Mycobacterium
AKRLVDFAAGLAFALRGSFDKV

SEQ ID NO: 1069375 - protein, 18 aa, Mycobacterium
AKRRAVLNAHIKLTETIA

SEQ ID NO: 1069376 - protein, 27 aa, Mycobacterium
AKSALGSWLPHGPAPVADYPAVLLNGS

SEQ ID NO: 1069377 - protein, 26 aa, Mycobacterium
AKSLAAAPFADILWMETKTADLADAR

SEQ ID NO: 1069378 - protein, 22 aa, Mycobacterium
AKSPLPPMPIGGPAPIPPEPPP

SEQ ID NO: 1069379 - protein, 25 aa, Mycobacterium
AKSPVSFFAYPGMASDLVPAGCTVH

SEQ ID NO: 1069380 - protein, 19 aa, Mycobacterium
AKTDRVFGLAARKRIPVVL

SEQ ID NO: 1069381 - protein, 26 aa, Mycobacterium
AKTSWDLRKFLWAPKLGCYGIQRIHP

SEQ ID NO: 1069382 - protein, 26 aa, Mycobacterium
AKTVCEAGFRNMTYVRDLAPVLVGEP

SEQ ID NO: 1069383 - protein, 40 aa, Mycobacterium; identical to SEQ ID NO: 792282

SEQ ID NO: 1069384 - protein, 19 aa, Mycobacterium
AKVATLRPLMRPSGRPESG

SEQ ID NO: 1069385 - protein, 25 aa, Mycobacterium
AKVGRIARVLGPRGLMPNPKTGTVT

SEQ ID NO: 1069386 - protein, 22 aa, Mycobacterium
AKVSTLRLLRSILDVAHQDGRI

SEQ ID NO: 1069387 - protein, 21 aa, Mycobacterium
AKWASSISGYWRRGRTEETFR

SEQ ID NO: 1069388 - protein, 18 aa, Mycobacterium
ALAAFTKAGGRVVQNVSA

SEQ ID NO: 1069389 - protein, 20 aa, Mycobacterium
ALAAGARRIVVGLGGSACTD

SEQ ID NO: 1069390 - protein, 18 aa, Mycobacterium
ALAAVPTTDLLAAAADEV

SEQ ID NO: 1069391 - protein, 23 aa, Mycobacterium
ALADLVAFFKDPVKGFFRALDYT

SEQ ID NO: 1069392 - protein, 28 aa, Mycobacterium
ALAEEISQLLYWTQVLMISRGVSLDEVY

SEQ ID NO: 1069393 - protein, 28 aa, Mycobacterium
ALAFKVATHPFFGKLTYVRVYSGKVDSG

SEQ ID NO: 1069394 - protein, 23 aa, Mycobacterium
ALAGRVAAQPPPTRTAPWAERAA

SEQ ID NO: 1069395 - protein, 29 aa, Mycobacterium
ALAGVHPVDLGALGWRGLLDRVDVDPAAV

SEQ ID NO: 1069396 - protein, 18 aa, Mycobacterium
ALAGWMDYLRGVSEPLMV

SEQ ID NO: 1069397 - protein, 24 aa, Mycobacterium
ALAHGRYLGLGLSAYIEPTGAATG

SEQ ID NO: 1069398 - protein, 21 aa, Mycobacterium
ALAHITLAAVGLGVGICTAGS

SEQ ID NO: 1069399 - protein, 25 aa, Mycobacterium
ALAHPDRCVAVLAALPAWTGEPGPA

SEQ ID NO: 1069400 - protein, 18 aa, Mycobacterium
ALAILTARHLDCWVLGTV

SEQ ID NO: 1069401 - protein, 21 aa, Mycobacterium
ALAIVDAFLSTPWSKAERHQR

SEQ ID NO: 1069402 - protein, 22 aa, Mycobacterium
ALALPYPGVLPEGPPPSKAFGS

SEQ ID NO: 1069403 - protein, 18 aa, Mycobacterium
ALALPYQGMSPEGPPPPK

SEQ ID NO: 1069404 - protein, 20 aa, Mycobacterium
ALALPYQGMSPEGPPPPKAF

SEQ ID NO: 1069405 - protein, 26 aa, Mycobacterium
ALAMDPQHRMLLELSWEALERSGIDP

SEQ ID NO: 1069406 - protein, 27 aa, Mycobacterium
ALAQIAEFAFPVAPWMFGAAGREHMQQ

SEQ ID NO: 1069407 - protein, 22 aa, Mycobacterium
ALARAWTREAPLTGASRAWSVL

SEQ ID NO: 1069408 - protein, 23 aa, Mycobacterium
ALARLPERVLGRPAFQVLAGLCG

SEQ ID NO: 1069409 - protein, 20 aa, Mycobacterium
ALASIMSWQGWEQMFESARF

SEQ ID NO: 1069410 - protein, 30 aa, Mycobacterium; identical to SEQ ID NO: 792431

SEQ ID NO: 1069411 - protein, 20 aa, Mycobacterium
ALATLVVNSIRKTLKAIAVK

SEQ ID NO: 1069412 - protein, 26 aa, Mycobacterium
ALATQLPHYMVPTALIPIAELPLTVN

SEQ ID NO: 1069413 - protein, 24 aa, Mycobacterium
ALAVDPEVLLLDEPFGALDAKVRE

SEQ ID NO: 1069414 - protein, 38 aa, Mycobacterium
ALAVMPSRRDITTAPPVLAAWVATAAPGAMAGAVATEL

SEQ ID NO: 1069415 - protein, 18 aa, Mycobacterium
ALAVRGLGSCWIGSTIFA

SEQ ID NO: 1069416 - protein, 22 aa, Mycobacterium
ALCADMNALPLAERTRAPYALT

SEQ ID NO: 1069417 - protein, 32 aa, Mycobacterium; identical to SEQ ID NO: 792464

SEQ ID NO: 1069418 - protein, 35 aa, Mycobacterium
ALDELLAPLTEPRYLIGRKILTPPSGRFARGIFAA

SEQ ID NO: 1069419 - protein, 19 aa, Mycobacterium
ALDFKPVPEKLARWAELGV

SEQ ID NO: 1069420 - protein, 22 aa, Mycobacterium
ALDITLYRDDLMSKPPRPLEET

SEQ ID NO: 1069421 - protein, 26 aa, Mycobacterium
ALDNVRLHAGPSARAFVLLEDLGDSV

SEQ ID NO: 1069422 - protein, 19 aa, Mycobacterium
ALDPQRVVLLPDATEDYWS

SEQ ID NO: 1069423 - protein, 18 aa, Mycobacterium
ALDPVVDLRMRLGEGTGA

SEQ ID NO: 1069424 - protein, 17 aa, Mycobacterium
ALDRAGFKIVATGLREC

SEQ ID NO: 1069425 - protein, 27 aa, Mycobacterium
ALDRQSQLALTLRLVSGLTVTEIARAL

SEQ ID NO: 1069426 - protein, 19 aa, Mycobacterium
ALDRVQVPVLLVGGWQDVF

SEQ ID NO: 1069427 - protein, 31 aa, Mycobacterium
ALDVLNAPAQALFGRPLIGDGAGGAPGQSGG

SEQ ID NO: 1069428 - protein, 29 aa, Mycobacterium
ALEDCYDIYRWLWLRGYNPGRLCLAGDST

SEQ ID NO: 1069429 - protein, 18 aa, Mycobacterium
ALEGYWRDQLCGAPPEID

SEQ ID NO: 1069430 - protein, 17 aa, Mycobacterium
ALEGYWSEHLRDAPLAI

SEQ ID NO: 1069431 - protein, 26 aa, Mycobacterium
ALEPIGLMRRIGLGETLRIALMGNDE

SEQ ID NO: 1069432 - protein, 26 aa, Mycobacterium
ALESALTVLSLRDGVIPPTLNYETPD

SEQ ID NO: 1069433 - protein, 22 aa, Mycobacterium
ALESLLTRLNLPDDVPIEAKMV

SEQ ID NO: 1069434 - protein, 27 aa, Mycobacterium
ALEVDVSLLSTAWWAAGASMTQGMDTG

SEQ ID NO: 1069435 - protein, 20 aa, Mycobacterium
ALEVLQRWLARDRSATLVIA

SEQ ID NO: 1069436 - protein, 33 aa, Mycobacterium
ALFDRFGADLPPLDGIYLAAFAGGPVLLNEMTD

SEQ ID NO: 1069437 - protein, 33 aa, Mycobacterium; identical to SEQ ID NO: 792623

SEQ ID NO: 1069438 - protein, 18 aa, Mycobacterium
ALFELLQRRITSPENTIR

SEQ ID NO: 1069439 - protein, 24 aa, Mycobacterium
ALGDYEWILAFEAPELDRIVDLMR

SEQ ID NO: 1069440 - protein, 25 aa, Mycobacterium
ALGENPDFPYFRRAIQPLDKATIDN

SEQ ID NO: 1069441 - protein, 19 aa, Mycobacterium
ALGGERFDLVYTGLGALCW

SEQ ID NO: 1069442 - protein, 17 aa, Mycobacterium
ALGIFPPTDEQAAVIAA

SEQ ID NO: 1069443 - protein, 17 aa, Mycobacterium
ALGLAGATLRRGAVAAV

SEQ ID NO: 1069444 - protein, 20 aa, Mycobacterium
ALGLATFYNALAQEKLLSRE

SEQ ID NO: 1069445 - protein, 26 aa, Mycobacterium
ALGLSTYKMVFGHRGINIPVIDHATG

SEQ ID NO: 1069446 - protein, 30 aa, Mycobacterium
ALGLTLTEFRLFHFLVRHAGQAFTHTRLMH

SEQ ID NO: 1069447 - protein, 17 aa, Mycobacterium
ALGPLVHVNLIPLNPTP

SEQ ID NO: 1069448 - protein, 21 aa, Mycobacterium
ALGPYLRGACRVAFDAPLVVA

SEQ ID NO: 1069449 - protein, 26 aa, Mycobacterium
ALGRDFPPGFLFLDPPDHTRLRKLVS

SEQ ID NO: 1069450 - protein, 26 aa, Mycobacterium
ALGSLHMFFHRLGPVLARRVLLTGDI

SEQ ID NO: 1069451 - protein, 24 aa, Mycobacterium
ALGTAELLRLALTSKIKPYSYTST

SEQ ID NO: 1069452 - protein, 23 aa, Mycobacterium
ALGVRTLLVIIGERPGLSVADSL

SEQ ID NO: 1069453 - protein, 25 aa, Mycobacterium
ALGVSLGVFRLLMGADYTPLAVHLP

SEQ ID NO: 1069454 - protein, 27 aa, Mycobacterium
ALGWMDANVWRHVAPKGWFYNVMVTGV

SEQ ID NO: 1069455 - protein, 23 aa, Mycobacterium
ALGYFGNTLLLRITTRSQDTFTS

SEQ ID NO: 1069456 - protein, 24 aa, Mycobacterium
ALHDQLPDWPTIPQGPLTLKGFDD

SEQ ID NO: 1069457 - protein, 25 aa, Mycobacterium
ALHGLGPRWVLVKGGHLRSSTRSCD

SEQ ID NO: 1069458 - protein, 17 aa, Mycobacterium
ALHHCVVALASMGWQAT

SEQ ID NO: 1069459 - protein, 19 aa, Mycobacterium
ALHHFLDCDLQQLGLDRDQ

SEQ ID NO: 1069460 - protein, 36 aa, Mycobacterium
ALHHGLPQRWIDFLHRWDPVHWLQPVSAAASGAGPQ

SEQ ID NO: 1069461 - protein, 18 aa, Mycobacterium
ALHHPCCGDLVYGADPKL

SEQ ID NO: 1069462 - protein, 20 aa, Mycobacterium
ALIAARVIARDSLVKTALFG

SEQ ID NO: 1069463 - protein, 23 aa, Mycobacterium
ALIDVAHWASEFPWCGQAAEVLR

SEQ ID NO: 1069464 - protein, 20 aa, Mycobacterium
ALIGGMALKPRKAFGPIRVA

SEQ ID NO: 1069465 - protein, 17 aa, Mycobacterium
ALIGLPEAQLTLAHATI

SEQ ID NO: 1069466 - protein, 27 aa, Mycobacterium
ALIKSIGLRLGLPWYAYDTVTFSGEVT

SEQ ID NO: 1069467 - protein, 27 aa, Mycobacterium
ALILENRLQLVTLIATNIFGQNTPAIA

SEQ ID NO: 1069468 - protein, 29 aa, Mycobacterium
ALISGDYNNGLLWRGDYQGNLGAFNYTVT

SEQ ID NO: 1069469 - protein, 17 aa, Mycobacterium
ALIWAMSVAAKRAEAML

SEQ ID NO: 1069470 - protein, 23 aa, Mycobacterium
ALKELFDQLGLGRVLLVGNSLGG

SEQ ID NO: 1069471 - protein, 17 aa, Mycobacterium
ALKQCDAMIRLGAVADV

SEQ ID NO: 1069472 - protein, 27 aa, Mycobacterium
ALLAADAGVPVLLAPAADAAAALTDAS

SEQ ID NO: 1069473 - protein, 21 aa, Mycobacterium
ALLAALIATNWFGQNSAAIAA

SEQ ID NO: 1069474 - protein, 25 aa, Mycobacterium
ALLANTNFFGLNFPAIAAAEGLYEE

SEQ ID NO: 1069475 - protein, 19 aa, Mycobacterium
ALLDDAGVTVTQFVRFEVG

SEQ ID NO: 1069476 - protein, 19 aa, Mycobacterium
ALLDMFGYFNAVTTARRAH

SEQ ID NO: 1069477 - protein, 27 aa, Mycobacterium
ALLEVRDLLFARLLQYRAFKHVAEMFA

SEQ ID NO: 1069478 - protein, 17 aa, Mycobacterium
ALLFPNLCVPTGELPPI

SEQ ID NO: 1069479 - protein, 21 aa, Mycobacterium
ALLGDPLLGVPFSAPYSFDTP

SEQ ID NO: 1069480 - protein, 18 aa, Mycobacterium
ALLGGLVSVVLDNSTQAC

SEQ ID NO: 1069481 - protein, 19 aa, Mycobacterium
ALLGVPVPADFTGSLLASG

SEQ ID NO: 1069482 - protein, 19 aa, Mycobacterium
ALLHIMVAETGRRPLTSGQ

SEQ ID NO: 1069483 - protein, 19 aa, Mycobacterium
ALLISRLVSWVDDLWCRAI

SEQ ID NO: 1069484 - protein, 20 aa, Mycobacterium
ALLPGYRLKHRVQFERLGSG

SEQ ID NO: 1069485 - protein, 21 aa, Mycobacterium
ALLPSLFRGAALSDLPTSEAL

SEQ ID NO: 1069486 - protein, 18 aa, Mycobacterium
ALLPTVRIRRIYACYDAG

SEQ ID NO: 1069487 - protein, 32 aa, Mycobacterium
ALLQVGETMPRRAPALTAPLLVIHGTDDRLIP

SEQ ID NO: 1069488 - protein, 19 aa, Mycobacterium
ALLRRLVEAGTRVVQYGYA

SEQ ID NO: 1069489 - protein, 18 aa, Mycobacterium
ALLVVKRGPNAGSRFLLD

SEQ ID NO: 1069490 - protein, 25 aa, Mycobacterium
ALNAAMDDWLEMSRALLSRIGDHAR

SEQ ID NO: 1069491 - protein, 33 aa, Mycobacterium; identical to SEQ ID NO: 783753

SEQ ID NO: 1069492 - protein, 18 aa, Mycobacterium
ALNGALNRGFNAGNLLLG

SEQ ID NO: 1069493 - protein, 17 aa, Mycobacterium
ALNLVKCVHWPSGSTTD

SEQ ID NO: 1069494 - protein, 20 aa, Mycobacterium
ALNNTRFWAPLSLSAEQKRS

SEQ ID NO: 1069495 - protein, 25 aa, Mycobacterium
ALNPETFYWAHATFFMLVVKVAEYF

SEQ ID NO: 1069496 - protein, 21 aa, Mycobacterium
ALNQWMYETWSFNYKDRIFAT

SEQ ID NO: 1069497 - protein, 26 aa, Mycobacterium
ALNRPTPLMLPGFAARAVLGEFADEG

SEQ ID NO: 1069498 - protein, 24 aa, Mycobacterium
ALPADPRWGGQLVSLPPGAGEVLA

SEQ ID NO: 1069499 - protein, 18 aa, Mycobacterium
ALPDGSVLRRHSLVRSDN

SEQ ID NO: 1069500 - protein, 25 aa, Mycobacterium
ALPGEELWRFVDKLAGRIASYPEEA

SEQ ID NO: 1069501 - protein, 28 aa, Mycobacterium
ALPIDPEPDLPLRFALNLSVFVGVTAEG

SEQ ID NO: 1069502 - protein, 25 aa, Mycobacterium
ALPPRQRRLVILRDLLGISAEEAAH

SEQ ID NO: 1069503 - protein, 21 aa, Mycobacterium
ALPSEFFFEIAQWANGDSQAV

SEQ ID NO: 1069504 - protein, 25 aa, Mycobacterium
ALPSMLLPMWDSELGTGLIASLRSL

SEQ ID NO: 1069505 - protein, 26 aa, Mycobacterium
ALPTYGFQHRRFWLGQLDAGRTDVGG

SEQ ID NO: 1069506 - protein, 27 aa, Mycobacterium
ALPVKLCYAGPFFRYERPQAGRYRQLQ

SEQ ID NO: 1069507 - protein, 25 aa, Mycobacterium
ALQLRSLPFQPIGIGPLVAARMWQV

SEQ ID NO: 1069508 - protein, 17 aa, Mycobacterium
ALQPALAWSEADDQSRA

SEQ ID NO: 1069509 - protein, 19 aa, Mycobacterium
ALQRLGVDAPIYLGGAGRW

SEQ ID NO: 1069510 - protein, 20 aa, Mycobacterium
ALQYEAYLAKILEAANRLGT

SEQ ID NO: 1069511 - protein, 20 aa, Mycobacterium
ALRAWPRDGLPDSPGGWLVT

SEQ ID NO: 1069512 - protein, 18 aa, Mycobacterium
ALRDVLARREIENVAGLG

SEQ ID NO: 1069513 - protein, 25 aa, Mycobacterium
ALREIAPLIFGVPVLVPDPAEYVAL

SEQ ID NO: 1069514 - protein, 18 aa, Mycobacterium
ALRMRRSHPECFLRGAYI

SEQ ID NO: 1069515 - protein, 22 aa, Mycobacterium
ALRNLLLRYDGRAEPLLASVPV

SEQ ID NO: 1069516 - protein, 21 aa, Mycobacterium
ALRPAFYSDAIKERFPQINWS

SEQ ID NO: 1069517 - protein, 20 aa, Mycobacterium
ALRPFLLVASFINPHDVVLF

SEQ ID NO: 1069518 - protein, 26 aa, Mycobacterium
ALRPRPWTKPVAPPSWPRFRTGIAGA

SEQ ID NO: 1069519 - protein, 17 aa, Mycobacterium
ALRPYDLSFSRYELLRL

SEQ ID NO: 1069520 - protein, 17 aa, Mycobacterium
ALRVKFDGGTLPPMFVD

SEQ ID NO: 1069521 - protein, 19 aa, Mycobacterium
ALRVTHPAAIVWAAQMGTV

SEQ ID NO: 1069522 - protein, 17 aa, Mycobacterium
ALRYRVIAEPTQQLPRY

SEQ ID NO: 1069523 - protein, 29 aa, Mycobacterium
ALSPNALQHYSVFGLLPIAVGQKSGALGI

SEQ ID NO: 1069524 - protein, 21 aa, Mycobacterium
ALSPWEQLLQNAPALSPLAAI

SEQ ID NO: 1069525 - protein, 26 aa, Mycobacterium
ALSQARFEFRWNDQFALSLDPDTARE

SEQ ID NO: 1069526 - protein, 26 aa, Mycobacterium
ALSRRAAGSLWAAPSGWRVGGVTAPV

SEQ ID NO: 1069527 - protein, 25 aa, Mycobacterium
ALSTQMAGFHQQFVTALNSAGASYA

SEQ ID NO: 1069528 - protein, 32 aa, Mycobacterium
ALSVPPAPPLPPWPPLPPFATTLPVAPCAPTV

SEQ ID NO: 1069529 - protein, 22 aa, Mycobacterium
ALTAVIVVALTLYDMIKAVDPA

SEQ ID NO: 1069530 - protein, 21 aa, Mycobacterium
ALTDFPGEKAWLLADFDTRIG

SEQ ID NO: 1069531 - protein, 20 aa, Mycobacterium
ALTDLAYFLGCALQPNERRA

SEQ ID NO: 1069532 - protein, 24 aa, Mycobacterium
ALTDRFEIAHLSPDLLRFVAQRTL

SEQ ID NO: 1069533 - protein, 23 aa, Mycobacterium
ALTDYAALLKVHGVERVRMVATS

SEQ ID NO: 1069534 - protein, 25 aa, Mycobacterium
ALTKALDIHPIRRTIQHADLVVVRR

SEQ ID NO: 1069535 - protein, 21 aa, Mycobacterium
ALTKLAKFTAKVGYPVRWRDY

SEQ ID NO: 1069536 - protein, 27 aa, Mycobacterium
ALTLDDVVKFLLPRGAAKKTAKAASTA

SEQ ID NO: 1069537 - protein, 26 aa, Mycobacterium
ALTMSDLRFLKFLRESIFPGGEVPSE

SEQ ID NO: 1069538 - protein, 19 aa, Mycobacterium
ALTRLLPAARPVRAGSHAT

SEQ ID NO: 1069539 - protein, 19 aa, Mycobacterium
ALTVLTIEPTPRSSVAAAA

SEQ ID NO: 1069540 - protein, 20 aa, Mycobacterium
ALTVPPPVIASNRALLAALI

SEQ ID NO: 1069541 - protein, 24 aa, Mycobacterium
ALVANVYTEYLMRALPQVARLVSS

SEQ ID NO: 1069542 - protein, 19 aa, Mycobacterium
ALVDLMDDPPWCDAGLSIA

SEQ ID NO: 1069543 - protein, 17 aa, Mycobacterium
ALVGALGLRPTLAALAS

SEQ ID NO: 1069544 - protein, 28 aa, Mycobacterium
ALVLARVARLVFGAWEPKTGAVGSLWDV

SEQ ID NO: 1069545 - protein, 30 aa, Mycobacterium; identical to SEQ ID NO: 793284

SEQ ID NO: 1069546 - protein, 28 aa, Mycobacterium
ALVLSDVRKLYKALMLRAAGAPGATLGQ

SEQ ID NO: 1069547 - protein, 30 aa, Mycobacterium; identical to SEQ ID NO: 793308

SEQ ID NO: 1069548 - protein, 25 aa, Mycobacterium
ALVVNLRPSSIRRLGLTYEALRRFN

SEQ ID NO: 1069549 - protein, 17 aa, Mycobacterium
ALWVGPVWRSATAIAER

SEQ ID NO: 1069550 - protein, 23 aa, Mycobacterium
AMAAAVAPYTSWLSAAAAQAVGV

SEQ ID NO: 1069551 - protein, 25 aa, Mycobacterium
AMAEGTRFLVLAPVVRTRKGEFADL

SEQ ID NO: 1069552 - protein, 26 aa, Mycobacterium
AMAGAELLLGTRRLAGGSSTSLYVYA

SEQ ID NO: 1069553 - protein, 28 aa, Mycobacterium
AMAIRTRFFDDFFLDATASGIVRPSSWL

SEQ ID NO: 1069554 - protein, 27 aa, Mycobacterium
AMAPENVSPLVVWLASAEAGAVTGKVF

SEQ ID NO: 1069555 - protein, 33 aa, Mycobacterium
AMAPLVAEASVPWVLMHWRPVSDDNPHQVPNYR

SEQ ID NO: 1069556 - protein, 24 aa, Mycobacterium
AMCELEAPDYFRVPKRGKVEIIDP

SEQ ID NO: 1069557 - protein, 19 aa, Mycobacterium
AMDIDDPLRLVPILGAGLA

SEQ ID NO: 1069558 - protein, 17 aa, Mycobacterium
AMFGTRPVILWHRSFHE

SEQ ID NO: 1069559 - protein, 23 aa, Mycobacterium
AMFNQFCYVQLSGSRTKEPDDLA

SEQ ID NO: 1069560 - protein, 22 aa, Mycobacterium
AMGPMQFISETWRLYGVDANND

SEQ ID NO: 1069561 - protein, 25 aa, Mycobacterium
AMGSLTHGFLNLFPLGGGCAAATSE

SEQ ID NO: 1069562 - protein, 29 aa, Mycobacterium
AMHDDMMRLWVDAEVLRLAGERLRQQAAS

SEQ ID NO: 1069563 - protein, 17 aa, Mycobacterium
AMHDSDLARPVLDRNGL

SEQ ID NO: 1069564 - protein, 28 aa, Mycobacterium
AMIASQKYLPRWLSEGLNRLLGGEHVFT

SEQ ID NO: 1069565 - protein, 20 aa, Mycobacterium
AMKAARVLSLAQDTADRLTS

SEQ ID NO: 1069566 - protein, 26 aa, Mycobacterium
AMLGQPVSMLIPRVVGFKLTGEIQPG

SEQ ID NO: 1069567 - protein, 17 aa, Mycobacterium
AMLRDWLDAELPDASVT

SEQ ID NO: 1069568 - protein, 19 aa, Mycobacterium
AMNPVLLKPGSDHRSHVVL

SEQ ID NO: 1069569 - protein, 21 aa, Mycobacterium
AMPLMDYLDPIPEDIAWCGLS

SEQ ID NO: 1069570 - protein, 25 aa, Mycobacterium
AMQPRYISNPLLIAEAGGGPWAINQ

SEQ ID NO: 1069571 - protein, 18 aa, Mycobacterium
AMRDRVVQALRHLALVVA

SEQ ID NO: 1069572 - protein, 18 aa, Mycobacterium
AMRHGLLPETLHVDEPSG

SEQ ID NO: 1069573 - protein, 19 aa, Mycobacterium
AMRVLTGPRWRLGGSDVAA

SEQ ID NO: 1069574 - protein, 25 aa, Mycobacterium
AMSARLPIRALWKAIELAAMAEHAL

SEQ ID NO: 1069575 - protein, 23 aa, Mycobacterium
AMSKFEVLTAMAFAAFADAPVDV

SEQ ID NO: 1069576 - protein, 24 aa, Mycobacterium
AMSTLVGLGRLFPTTLRRKVIKKV

SEQ ID NO: 1069577 - protein, 23 aa, Mycobacterium
AMTGLAVLDLYAGSGALGLEALS

SEQ ID NO: 1069578 - protein, 21 aa, Mycobacterium
AMTSGPWRGLASTSMASAAAP

SEQ ID NO: 1069579 - protein, 21 aa, Mycobacterium
AMTVPPPVVAANRSLLAALVA

SEQ ID NO: 1069580 - protein, 25 aa, Mycobacterium
AMVGAISPYLTWLRATAQQCQQLAA

SEQ ID NO: 1069581 - protein, 25 aa, Mycobacterium
AMVLRRLLRLCARYSAHPTVIFASA

SEQ ID NO: 1069582 - protein, 24 aa, Mycobacterium
AMVRAALSYLALPPSDADEAAKGM

SEQ ID NO: 1069583 - protein, 17 aa, Mycobacterium
AMVSAARGYKCVLTMPD

SEQ ID NO: 1069584 - protein, 23 aa, Mycobacterium
ANAAAVLPTTVLQAAGADEVSAA

SEQ ID NO: 1069585 - protein, 23 aa, Mycobacterium
ANAAIPWSLTIVTTLTSVVAHLV

SEQ ID NO: 1069586 - protein, 24 aa, Mycobacterium
ANAAVLHALMSPGERLLGLDLANG

SEQ ID NO: 1069587 - protein, 26 aa, Mycobacterium
ANAHYANMLLAFYLATGQDAANIIAG

SEQ ID NO: 1069588 - protein, 31 aa, Mycobacterium; identical to SEQ ID NO: 793583

SEQ ID NO: 1069589 - protein, 23 aa, Mycobacterium
ANDAPIQRFWRDAHAGRVHAAND

SEQ ID NO: 1069590 - protein, 27 aa, Mycobacterium
ANDPAETRYWYYALQTCRLNEHRAGSG

SEQ ID NO: 1069591 - protein, 18 aa, Mycobacterium
ANDRGVFVLAATSNPEGA

SEQ ID NO: 1069592 - protein, 23 aa, Mycobacterium
ANEGLCAIGLRFSEDKTAPRERF

SEQ ID NO: 1069593 - protein, 20 aa, Mycobacterium
ANFLSILDEGRIAIAALATG

SEQ ID NO: 1069594 - protein, 23 aa, Mycobacterium
ANGGYGGYGGFGGVGGAGGTGGV

SEQ ID NO: 1069595 - protein, 25 aa, Mycobacterium
ANGIDAPALWPGLPVRPVKGEVLRL

SEQ ID NO: 1069596 - protein, 20 aa, Mycobacterium
ANGPLAVQAILRTIRETEGM

SEQ ID NO: 1069597 - protein, 19 aa, Mycobacterium
ANHPLFRRRRFFNGKPVGR

SEQ ID NO: 1069598 - protein, 24 aa, Mycobacterium
ANHSVWFHRQVDFNDWVLYSTSSP

SEQ ID NO: 1069599 - protein, 25 aa, Mycobacterium
ANIAPWLRAAHRYGAKVKWAEVDIE

SEQ ID NO: 1069600 - protein, 32 aa, Mycobacterium; identical to SEQ ID NO: 793667

SEQ ID NO: 1069601 - protein, 21 aa, Mycobacterium
ANLPLSPLNPPVPPTAYSPPP

SEQ ID NO: 1069602 - protein, 20 aa, Mycobacterium
ANLTAAVPTAGVLAAGADEV

SEQ ID NO: 1069603 - protein, 26 aa, Mycobacterium
ANLVGAFNAPALLAGLNSGLNGLVQT

SEQ ID NO: 1069604 - protein, 19 aa, Mycobacterium
ANLVWTPQPAMPGQLRAVT

SEQ ID NO: 1069605 - protein, 19 aa, Mycobacterium
ANMLLLTAHHLAVDVVSWH

SEQ ID NO: 1069606 - protein, 25 aa, Mycobacterium
ANMVDTFVLLTLARTGDQLQGIKKG

SEQ ID NO: 1069607 - protein, 24 aa, Mycobacterium
ANNFTRLLDRVAPLGYPEVNQMTK

SEQ ID NO: 1069608 - protein, 22 aa, Mycobacterium
ANPLDARLPFGAAQPKASTPAS

SEQ ID NO: 1069609 - protein, 28 aa, Mycobacterium
ANPLDPANLLDLQKFVVATGADIGLAFD

SEQ ID NO: 1069610 - protein, 17 aa, Mycobacterium
ANQLERIGSALSAANLT

SEQ ID NO: 1069611 - protein, 26 aa, Mycobacterium
ANQYKDVILGLVFLKFVSDARDGRKP

SEQ ID NO: 1069612 - protein, 25 aa, Mycobacterium
ANRALPWPEDPVAALWHATTLLREH

SEQ ID NO: 1069613 - protein, 18 aa, Mycobacterium
ANRALTERLVYATQLPDV

SEQ ID NO: 1069614 - protein, 22 aa, Mycobacterium
ANRFHSWIYRERPDVQCIVHTH

SEQ ID NO: 1069615 - protein, 42 aa, Mycobacterium; identical to SEQ ID NO: 793752

SEQ ID NO: 1069616 - protein, 23 aa, Mycobacterium
ANSWVDAFAHWRRAQGLPVCAIG

SEQ ID NO: 1069617 - protein, 24 aa, Mycobacterium
ANVPTPFGLFPDVAPATVFDALVA

SEQ ID NO: 1069618 - protein, 19 aa, Mycobacterium
ANWTSVIPTLNGGAISGLP

SEQ ID NO: 1069619 - protein, 17 aa, Mycobacterium
ANYFAAAAVLPYRQFHD

SEQ ID NO: 1069620 - protein, 17 aa, Mycobacterium
ANYLYPRVEVEVGFILA

SEQ ID NO: 1069621 - protein, 20 aa, Mycobacterium
APAAALFNLPTVNTGLGNSG

SEQ ID NO: 1069622 - protein, 18 aa, Mycobacterium
APAALEEHALRACLAALD

SEQ ID NO: 1069623 - protein, 20 aa, Mycobacterium
APAEGEPLLEPLRALFEPIM

SEQ ID NO: 1069624 - protein, 19 aa, Mycobacterium
APAERLAFVLHDVFAVPFD

SEQ ID NO: 1069625 - protein, 24 aa, Mycobacterium
APAFEAIIPRLLRDLRGRVFVAHN

SEQ ID NO: 1069626 - protein, 20 aa, Mycobacterium
APAHDWLTLTGGAIGYGIPA

SEQ ID NO: 1069627 - protein, 28 aa, Mycobacterium
APALLDTRWVVIGEPFLAAAETLRAAGY

SEQ ID NO: 1069628 - protein, 22 aa, Mycobacterium
APALLISRLVSWVDDLWCRAIG

SEQ ID NO: 1069629 - protein, 29 aa, Mycobacterium
APAPHHTRPVRFVWLQSHATRIALLDAMK

SEQ ID NO: 1069630 - protein, 26 aa, Mycobacterium
APAYTGRLFTAPVPALRLPEESMDPE

SEQ ID NO: 1069631 - protein, 28 aa, Mycobacterium
APCELVDFWRFNVAFTRQILDQQPVSAK

SEQ ID NO: 1069632 - protein, 17 aa, Mycobacterium
APCVLFFDEVDALGHRR

SEQ ID NO: 1069633 - protein, 23 aa, Mycobacterium
APDEGMYAFEQMLRHARTYTGYI

SEQ ID NO: 1069634 - protein, 27 aa, Mycobacterium
APDLTLDALLMFGAIGYTWEHDMHLYW

SEQ ID NO: 1069635 - protein, 17 aa, Mycobacterium
APDQRPPVHALYGFARY

SEQ ID NO: 1069636 - protein, 23 aa, Mycobacterium
APDRPPWDIATQRLTLVRGVVEA

SEQ ID NO: 1069637 - protein, 25 aa, Mycobacterium
APDTMTYLTALLPVAQGISVYAALR

SEQ ID NO: 1069638 - protein, 17 aa, Mycobacterium
APDVLRYVMGFGGTPDS

SEQ ID NO: 1069639 - protein, 17 aa, Mycobacterium
APEAFSTRVTEFLDLLR

SEQ ID NO: 1069640 - protein, 17 aa, Mycobacterium
APEILFADQTRTLADIV

SEQ ID NO: 1069641 - protein, 19 aa, Mycobacterium
APELSAILIPLGELINMIP

SEQ ID NO: 1069642 - protein, 32 aa, Mycobacterium
APELVKLRSYFDHPLFVEMFADAIAAAAATVP

SEQ ID NO: 1069643 - protein, 20 aa, Mycobacterium
APEMTVLVGGLRALGANHGG

SEQ ID NO: 1069644 - protein, 26 aa, Mycobacterium
APESVLLMAAKLRNLFVVSGKLQVGR

SEQ ID NO: 1069645 - protein, 18 aa, Mycobacterium
APFSLAWMTAVGERTKRM

SEQ ID NO: 1069646 - protein, 25 aa, Mycobacterium
APGAGLFILAFAQRPFGDGMPGPNG

SEQ ID NO: 1069647 - protein, 24 aa, Mycobacterium
APGDPLFDPFWQLANDSGITVCYH

SEQ ID NO: 1069648 - protein, 24 aa, Mycobacterium
APGFGDRRKAMLQDMAILTGGQVI

SEQ ID NO: 1069649 - protein, 23 aa, Mycobacterium
APGGGPPRKAWPAGGTGIGGGPP

SEQ ID NO: 1069650 - protein, 21 aa, Mycobacterium
APGGWLIGNDGAGGSGAAGSA

SEQ ID NO: 1069651 - protein, 18 aa, Mycobacterium
APGMPPRPGAPGMPGMPG

SEQ ID NO: 1069652 - protein, 25 aa, Mycobacterium
APGPRPRLARPLSWGRAAPADTGSF

SEQ ID NO: 1069653 - protein, 17 aa, Mycobacterium
APGRLPPLTPGEMATPR

SEQ ID NO: 1069654 - protein, 24 aa, Mycobacterium
APGSYATGIAFLPQSSKDAAAACA

SEQ ID NO: 1069655 - protein, 19 aa, Mycobacterium
APHALSMLRGFNLMKQLEE

SEQ ID NO: 1069656 - protein, 26 aa, Mycobacterium
APHHTRLRKIISRGFTPRAIGRLHDE

SEQ ID NO: 1069657 - protein, 28 aa, Mycobacterium
APIRDSWEFALLRGALQRGLPVLGICRG

SEQ ID NO: 1069658 - protein, 22 aa, Mycobacterium
APISWPEFAAIHPHAPIAQTTG

SEQ ID NO: 1069659 - protein, 19 aa, Mycobacterium
APKHHQRLGRRQADPLVSI

SEQ ID NO: 1069660 - protein, 25 aa, Mycobacterium
APKHKGITYFLLDMTAPGIEIRPLR

SEQ ID NO: 1069661 - protein, 35 aa, Mycobacterium; identical to SEQ ID NO: 794084

SEQ ID NO: 1069662 - protein, 21 aa, Mycobacterium
APKSLKVNVLLLGVQNDPIVG

SEQ ID NO: 1069663 - protein, 19 aa, Mycobacterium
APLAALSRPQLPTGALTSM

SEQ ID NO: 1069664 - protein, 21 aa, Mycobacterium
APLHAECAGLIYLASELDGYP

SEQ ID NO: 1069665 - protein, 21 aa, Mycobacterium
APLIDLFRPHVTGLETLPANG

SEQ ID NO: 1069666 - protein, 22 aa, Mycobacterium
APLLPRCIGADRLRLVSAAAHG

SEQ ID NO: 1069667 - protein, 19 aa, Mycobacterium
APLLVFYHGGGWALGDLDT

SEQ ID NO: 1069668 - protein, 17 aa, Mycobacterium
APLMHGAAQWAAFISLC

SEQ ID NO: 1069669 - protein, 22 aa, Mycobacterium
APLPEFWVNRARRKILHSALEG

SEQ ID NO: 1069670 - protein, 23 aa, Mycobacterium
APLPSKWRIAFGEPIYTADYGSG

SEQ ID NO: 1069671 - protein, 28 aa, Mycobacterium
APLTLAQQRIWLLDRLNLGGPELCSQRY

SEQ ID NO: 1069672 - protein, 29 aa, Mycobacterium
APLYQRWAKLWDGLLLACQPGAGAGELLN

SEQ ID NO: 1069673 - protein, 29 aa, Mycobacterium
APMSWDRNYVHSLDWRWLTEPMTPGPGEC

SEQ ID NO: 1069674 - protein, 23 aa, Mycobacterium
APMTLRWLTDRFAGLPLTEHVIR

SEQ ID NO: 1069675 - protein, 18 aa, Mycobacterium
APNFAYEWAAQRGLLTPG

SEQ ID NO: 1069676 - protein, 26 aa, Mycobacterium
APNFKDIVIRYITFAPYHMQTMFGAP

SEQ ID NO: 1069677 - protein, 17 aa, Mycobacterium
APNIKMLAPIPAGDPDK

SEQ ID NO: 1069678 - protein, 23 aa, Mycobacterium
APNQRRPYRPPARPSGETLNGII

SEQ ID NO: 1069679 - protein, 25 aa, Mycobacterium
APPADFVAPLYAYLASDLASGITGQ

SEQ ID NO: 1069680 - protein, 30 aa, Mycobacterium; identical to SEQ ID NO: 794170

SEQ ID NO: 1069681 - protein, 39 aa, Mycobacterium
APPDTTVVSWLPFFHDMGLMFGIIMPLLEGFHSVLTSPI

SEQ ID NO: 1069682 - protein, 20 aa, Mycobacterium
APPEIELPRDFPGPALGSFR

SEQ ID NO: 1069683 - protein, 17 aa, Mycobacterium
APPKISLQRDLADSVVV

SEQ ID NO: 1069684 - protein, 19 aa, Mycobacterium
APPLLVRQFVKMSVFLPDR

SEQ ID NO: 1069685 - protein, 21 aa, Mycobacterium
APPMPPVALLALSVPPAPPLP

SEQ ID NO: 1069686 - protein, 24 aa, Mycobacterium
APPPERLLVGWTGGPAAITAQIGR

SEQ ID NO: 1069687 - protein, 26 aa, Mycobacterium
APPPLDVMAALRQPGIGVIAEVKRAS

SEQ ID NO: 1069688 - protein, 22 aa, Mycobacterium
APPQLPQLPALPAPAPPKISPP

SEQ ID NO: 1069689 - protein, 24 aa, Mycobacterium
APPRRSVGYLVFGIGRHGSDALRQ

SEQ ID NO: 1069690 - protein, 22 aa, Mycobacterium
APRGSVYYHFPDGRNQILIEAL

SEQ ID NO: 1069691 - protein, 18 aa, Mycobacterium
APRLFRLPEDRALLNRMG

SEQ ID NO: 1069692 - protein, 18 aa, Mycobacterium
APRPRMLVFVPSTSPRRW

SEQ ID NO: 1069693 - protein, 29 aa, Mycobacterium
APRQRRDLFVGLLVDRRRLVDGQGAVGDR

SEQ ID NO: 1069694 - protein, 17 aa, Mycobacterium
APRRAAFAVIPVVEYEP

SEQ ID NO: 1069695 - protein, 17 aa, Mycobacterium
APRRPVIRPVPVDDSGF

SEQ ID NO: 1069696 - protein, 23 aa, Mycobacterium
APRRQWLQRGLTGIAKLPSDLAG

SEQ ID NO: 1069697 - protein, 24 aa, Mycobacterium
APSAVARFCRICGALAAELINCCG

SEQ ID NO: 1069698 - protein, 27 aa, Mycobacterium
APSFRERVRYRSVQWAHGPKLVEHGHD

SEQ ID NO: 1069699 - protein, 20 aa, Mycobacterium
APTAILLDGSKFGGLITGLL

SEQ ID NO: 1069700 - protein, 50 aa, Mycobacterium
APTGAAYLGLLRFLFGLDLIDRVVFWMLPLDDSLPWLLVDRRAMKVTAVH

SEQ ID NO: 1069701 - protein, 23 aa, Mycobacterium
APTGAVLLQVRWLCLEGRDDPVD

SEQ ID NO: 1069702 - protein, 26 aa, Mycobacterium
APTHRPLPVMVFIHGGGYILGSSATP

SEQ ID NO: 1069703 - protein, 25 aa, Mycobacterium
APTIDTDWYLAWLAREAKNAGVCVD

SEQ ID NO: 1069704 - protein, 18 aa, Mycobacterium
APTIGFRVEFDGASAVLA

SEQ ID NO: 1069705 - protein, 25 aa, Mycobacterium
APTRPEPPLPPGPPRRRAQPPTAPP

SEQ ID NO: 1069706 - protein, 19 aa, Mycobacterium
APTVFTAAPGAAWEDNLRG

SEQ ID NO: 1069707 - protein, 23 aa, Mycobacterium
APVADYPAVLLNGSWLTQEQAAA

SEQ ID NO: 1069708 - protein, 21 aa, Mycobacterium
APVAGTLLTDCAHTRPTSVLQ

SEQ ID NO: 1069709 - protein, 21 aa, Mycobacterium
APVHYSQRLYGAVPGTLIGEI

SEQ ID NO: 1069710 - protein, 19 aa, Mycobacterium
APVLDRLIAFTGRRPVHPT

SEQ ID NO: 1069711 - protein, 19 aa, Mycobacterium
APVLVLRRTSYTDGDKPLE

SEQ ID NO: 1069712 - protein, 21 aa, Mycobacterium
APVPQFEVMYLLAGCDAAAAD

SEQ ID NO: 1069713 - protein, 26 aa, Mycobacterium
APVQRTWSELIPLLESGRLDVDGIFT

SEQ ID NO: 1069714 - protein, 20 aa, Mycobacterium
APVQTLLGRPLIGNGANATT

SEQ ID NO: 1069715 - protein, 19 aa, Mycobacterium
APVTFPRAAPPRCASKSSD

SEQ ID NO: 1069716 - protein, 27 aa, Mycobacterium
APVVRTVAPGLFWQRKYRVLQRLGESR

SEQ ID NO: 1069717 - protein, 28 aa, Mycobacterium
APVWGGIHLSYVMAVPEIIEAAASTAAA

SEQ ID NO: 1069718 - protein, 19 aa, Mycobacterium
APWFESWLEHTDHSDPFWD

SEQ ID NO: 1069719 - protein, 26 aa, Mycobacterium
APYAHGWATWFPPDGPPRTGRFGPAP

SEQ ID NO: 1069720 - protein, 21 aa, Mycobacterium
APYQIVMGERRWRAAQEAGLA

SEQ ID NO: 1069721 - protein, 28 aa, Mycobacterium
AQAAEFHERFVRAMAAGAASYATAEAAN

SEQ ID NO: 1069722 - protein, 19 aa, Mycobacterium
AQAGLKWPNDVLAGLPGSL

SEQ ID NO: 1069723 - protein, 26 aa, Mycobacterium
AQAGRFGIHPALLNAALHAGLYGALD

SEQ ID NO: 1069724 - protein, 24 aa, Mycobacterium
AQALLGRPLIGNGDDGVAGTGQSG

SEQ ID NO: 1069725 - protein, 23 aa, Mycobacterium
AQAQVWFDRAMVWAYAFNHEESI

SEQ ID NO: 1069726 - protein, 30 aa, Mycobacterium
AQASPPDMKLPISLALGWPRRVPGAARYCD

SEQ ID NO: 1069727 - protein, 24 aa, Mycobacterium
AQASSVPILIHPEPRSVLGGLAAA

SEQ ID NO: 1069728 - protein, 17 aa, Mycobacterium
AQCAIDAGVAFVNALPV

SEQ ID NO: 1069729 - protein, 19 aa, Mycobacterium
AQEVLSGDLFAALAGASTH

SEQ ID NO: 1069730 - protein, 24 aa, Mycobacterium
AQFGNMLSVSLIFVLEMMVAQAES

SEQ ID NO: 1069731 - protein, 30 aa, Mycobacterium
AQFKTSLYDSYLRAFRWATDRVGDHGIVAY

SEQ ID NO: 1069732 - protein, 23 aa, Mycobacterium
AQFLGPDTVAYLRDFRFSGDIDG

SEQ ID NO: 1069733 - protein, 22 aa, Mycobacterium
AQFTIVLPRREGVEYSVEHAVI

SEQ ID NO: 1069734 - protein, 21 aa, Mycobacterium
AQGHEALRRWASSLQTTAEMG

SEQ ID NO: 1069735 - protein, 24 aa, Mycobacterium
AQGINVRWWLPQKVKQRKDFLAQT

SEQ ID NO: 1069736 - protein, 25 aa, Mycobacterium
AQGIPPQFLVDILTNLRTDRLVRSH

SEQ ID NO: 1069737 - protein, 17 aa, Mycobacterium
AQGPRRTLIGLQGLGKR

SEQ ID NO: 1069738 - protein, 25 aa, Mycobacterium
AQHGPRLFHALFAPLGWCAKYAPGL

SEQ ID NO: 1069739 - protein, 24 aa, Mycobacterium
AQIDAILWQSEAFGDPLRAAYHEG

SEQ ID NO: 1069740 - protein, 17 aa, Mycobacterium
AQISDLATAFHAAGRST

SEQ ID NO: 1069741 - protein, 24 aa, Mycobacterium
AQKKKFLPAILAGEVHFAIGYTEP

SEQ ID NO: 1069742 - protein, 19 aa, Mycobacterium
AQLAFFDRYLKHLDVPKPP

SEQ ID NO: 1069743 - protein, 21 aa, Mycobacterium
AQLAPGRFAPYGPGSARADAD

SEQ ID NO: 1069744 - protein, 29 aa, Mycobacterium
AQLAVTPVMLLLWIRGVRFMYTVDPLLAP

SEQ ID NO: 1069745 - protein, 23 aa, Mycobacterium
AQLDLPAADAIMLLAAHISRHGT

SEQ ID NO: 1069746 - protein, 20 aa, Mycobacterium
AQLLHEVWGYDFFGGTRTVD

SEQ ID NO: 1069747 - protein, 17 aa, Mycobacterium
AQLQRWPDGLQAAVEAK

SEQ ID NO: 1069748 - protein, 20 aa, Mycobacterium
AQLRHRLLTLAHDADLVLDL

SEQ ID NO: 1069749 - protein, 26 aa, Mycobacterium
AQMGKNGWLTLNWPKEYGGQDRSPMD

SEQ ID NO: 1069750 - protein, 26 aa, Mycobacterium
AQNATKPWLLYYSTGATHAPHHVFKE

SEQ ID NO: 1069751 - protein, 26 aa, Mycobacterium
AQNPTLRRWWPRRYRRSSAYWKLVEL

SEQ ID NO: 1069752 - protein, 34 aa, Mycobacterium; identical to SEQ ID NO: 794606

SEQ ID NO: 1069753 - protein, 22 aa, Mycobacterium
AQQGPLLVVTATGREADDVTAE

SEQ ID NO: 1069754 - protein, 25 aa, Mycobacterium
AQQVLPTYAVICCPAFGAAGKIGTL

SEQ ID NO: 1069755 - protein, 20 aa, Mycobacterium
AQRAGLELLAFGGRFVEIGK

SEQ ID NO: 1069756 - protein, 22 aa, Mycobacterium
AQRAHVLWAHRRARRRLAALRL

SEQ ID NO: 1069757 - protein, 23 aa, Mycobacterium
AQRIYDPGIILDKDRGLGAVIAQ

SEQ ID NO: 1069758 - protein, 24 aa, Mycobacterium
AQRLRRYPFDLGAPQWVDDPDFDI

SEQ ID NO: 1069759 - protein, 22 aa, Mycobacterium
AQRMLKYAFNLLDDGLVGQQLF

SEQ ID NO: 1069760 - protein, 24 aa, Mycobacterium
AQRRDMMWICRDGDRAKNHLLEAN

SEQ ID NO: 1069761 - protein, 19 aa, Mycobacterium
AQRTVLCKDPFRAVDERVK

SEQ ID NO: 1069762 - protein, 27 aa, Mycobacterium
AQSYVDAHAPYLAWLTTTSADYAATAA

SEQ ID NO: 1069763 - protein, 23 aa, Mycobacterium
AQTALDLINQPVLTLTGRPQIGN

SEQ ID NO: 1069764 - protein, 22 aa, Mycobacterium
AQTGAFDLLLGDAGPALVGDDI

SEQ ID NO: 1069765 - protein, 21 aa, Mycobacterium
AQTKRRVAVLGGNRIPFARSD

SEQ ID NO: 1069766 - protein, 28 aa, Mycobacterium
AQTVARWLVLYLRRPCGQTQFAAPVWMP

SEQ ID NO: 1069767 - protein, 28 aa, Mycobacterium
AQVCESFAISWLVIRAPSDLAGAGSGLD

SEQ ID NO: 1069768 - protein, 18 aa, Mycobacterium
AQVGPRRFWPDEDGQGQF

SEQ ID NO: 1069769 - protein, 25 aa, Mycobacterium
AQVLDPQHRLFLQCAWHALEDANCD

SEQ ID NO: 1069770 - protein, 18 aa, Mycobacterium
AQVMLAWQNNKPAELALG

SEQ ID NO: 1069771 - protein, 21 aa, Mycobacterium
AQVNMDLGLLAPEKAQAIIAA

SEQ ID NO: 1069772 - protein, 24 aa, Mycobacterium
AQVQTYVPGYRLLNEPQFDEPSIN

SEQ ID NO: 1069773 - protein, 20 aa, Mycobacterium
AQWLAAHGWAVEPVRNTLEL

SEQ ID NO: 1069774 - protein, 18 aa, Mycobacterium
ARAAEPLLLIVDVSKPRP

SEQ ID NO: 1069775 - protein, 24 aa, Mycobacterium
ARAAIVHPLQVAANRTQLVSLVVS

SEQ ID NO: 1069776 - protein, 20 aa, Mycobacterium
ARAALWRTLLGLDSMERVSI

SEQ ID NO: 1069777 - protein, 28 aa, Mycobacterium
ARAAQLGIELLPLDDLLARADFISVHLP

SEQ ID NO: 1069778 - protein, 23 aa, Mycobacterium
ARAASTPWPTYPLMYRVSAAHEE

SEQ ID NO: 1069779 - protein, 24 aa, Mycobacterium
ARAEALIGLAHPDYRPWLAECAQH

SEQ ID NO: 1069780 - protein, 23 aa, Mycobacterium
ARAGDLNWLFRPGGPGIGSESLH

SEQ ID NO: 1069781 - protein, 20 aa, Mycobacterium
ARAGFATRVLLDLTAGISAE

SEQ ID NO: 1069782 - protein, 22 aa, Mycobacterium
ARALAADPPVLLMDEPFGAVDP

SEQ ID NO: 1069783 - protein, 24 aa, Mycobacterium
ARALIAVRGLHRFAAAEGLAALDV

SEQ ID NO: 1069784 - protein, 22 aa, Mycobacterium
ARALTLSAFASKVTVGFTSDIK

SEQ ID NO: 1069785 - protein, 25 aa, Mycobacterium
ARALTPPALVVRLVDMLRAGHAAVV

SEQ ID NO: 1069786 - protein, 22 aa, Mycobacterium
ARARLAIGSALFGLLRADDQVP

SEQ ID NO: 1069787 - protein, 24 aa, Mycobacterium
ARARYLMLRLLERAGEQRVAIPSL

SEQ ID NO: 1069788 - protein, 38 aa, Mycobacterium
ARAYQALSVQAGQFHQWFTQTLSGAGLAYASAEAANVS

SEQ ID NO: 1069789 - protein, 21 aa, Mycobacterium
ARCVTYPLLAVQAWATHHDTT

SEQ ID NO: 1069790 - protein, 30 aa, Mycobacterium; identical to SEQ ID NO: 794907

SEQ ID NO: 1069791 - protein, 25 aa, Mycobacterium
ARDEGWLAEHMLILKLISPENKAYY

SEQ ID NO: 1069792 - protein, 23 aa, Mycobacterium
ARDNLAAELARLRQRHDRLEIEV

SEQ ID NO: 1069793 - protein, 29 aa, Mycobacterium
ARDSLPHITAPTLILHRVGTKFVPVEHGR

SEQ ID NO: 1069794 - protein, 22 aa, Mycobacterium
AREFQNFLLAKQREIATIVATA

SEQ ID NO: 1069795 - protein, 18 aa, Mycobacterium
AREIILSLFESITGLRMN

SEQ ID NO: 1069796 - protein, 20 aa, Mycobacterium
ARELALIRGGATPGSFTVTR

SEQ ID NO: 1069797 - protein, 30 aa, Mycobacterium
AREQLDIRLMSWRAHVFAPVSGIPGVQAPG

SEQ ID NO: 1069798 - protein, 28 aa, Mycobacterium
AREQTYFGTRRYVRRQRSWFRRDHRVHW

SEQ ID NO: 1069799 - protein, 27 aa, Mycobacterium
ARERDVWLPIHPVTRRRWPNGRVTHDE

SEQ ID NO: 1069800 - protein, 18 aa, Mycobacterium
AREREVLHRIAKGQSIPA

SEQ ID NO: 1069801 - protein, 30 aa, Mycobacterium
ARESGPGLGTWWGSWRRFLPAGQGQPERRV

SEQ ID NO: 1069802 - protein, 19 aa, Mycobacterium
ARFKSPNPIHWANATHACT

SEQ ID NO: 1069803 - protein, 20 aa, Mycobacterium
ARFVRTCDCFNIPIVMLVDV

SEQ ID NO: 1069804 - protein, 31 aa, Mycobacterium
ARGGAMQLRYISVPALVAYAGGDPWAINQSL

SEQ ID NO: 1069805 - protein, 28 aa, Mycobacterium
ARGGFGPFTPGFRSVPFGDSTALARAID

SEQ ID NO: 1069806 - protein, 24 aa, Mycobacterium
ARGGPMMLLTSPTLPGRGLSPSCA

SEQ ID NO: 1069807 - protein, 22 aa, Mycobacterium
ARGHQAGNLGIVSTAIGFGNTD

SEQ ID NO: 1069808 - protein, 25 aa, Mycobacterium
ARGPSTWYFGAGELDAWEVWARVAE

SEQ ID NO: 1069809 - protein, 23 aa, Mycobacterium
ARGTPVFGLFLTAGTTDYGAIDP

SEQ ID NO: 1069810 - protein, 25 aa, Mycobacterium
ARGYHLELITPVPLPRKPSGDLARL

SEQ ID NO: 1069811 - protein, 20 aa, Mycobacterium
ARHPVLRFASSIRQVFILGR

SEQ ID NO: 1069812 - protein, 24 aa, Mycobacterium
ARHVRSTILLAASAFGRLALDAVH

SEQ ID NO: 1069813 - protein, 18 aa, Mycobacterium
ARHVVAHHGVRQLVLVSR

SEQ ID NO: 1069814 - protein, 18 aa, Mycobacterium
ARIAGRLGLRPDVRRMPL

SEQ ID NO: 1069815 - protein, 25 aa, Mycobacterium
ARIALSRLAFIGALGPWGPLATPEI

SEQ ID NO: 1069816 - protein, 18 aa, Mycobacterium
ARIDGLLREIRLVRALSG

SEQ ID NO: 1069817 - protein, 31 aa, Mycobacterium; identical to SEQ ID NO: 795106

SEQ ID NO: 1069818 - protein, 33 aa, Mycobacterium; identical to SEQ ID NO: 795111

SEQ ID NO: 1069819 - protein, 31 aa, Mycobacterium; identical to SEQ ID NO: 795118

SEQ ID NO: 1069820 - protein, 26 aa, Mycobacterium
ARIRDWLDIDHVVVADLFAARTVGAL

SEQ ID NO: 1069821 - protein, 25 aa, Mycobacterium
ARKGFFRVPLIGGTITHPVQGEAAA

SEQ ID NO: 1069822 - protein, 26 aa, Mycobacterium
ARLAAPLLPLVTEVIWRGLTGERSVH

SEQ ID NO: 1069823 - protein, 19 aa, Mycobacterium
ARLAGWWAEHFGGTAHELL

SEQ ID NO: 1069824 - protein, 21 aa, Mycobacterium
ARLAHRVGLREDVKRIPLFGL

SEQ ID NO: 1069825 - protein, 27 aa, Mycobacterium
ARLAPGTPLARVFWPRTRIVVTRDDVS

SEQ ID NO: 1069826 - protein, 19 aa, Mycobacterium
ARLDEMLLITFGRAASQEL

SEQ ID NO: 1069827 - protein, 27 aa, Mycobacterium
ARLDGLDSLLSIVQMPAGVPVATVSIG

SEQ ID NO: 1069828 - protein, 23 aa, Mycobacterium
ARLGRPLRIAHAWSLSFDASWQP

SEQ ID NO: 1069829 - protein, 17 aa, Mycobacterium
ARLLGQIDVVFSNAGIV

SEQ ID NO: 1069830 - protein, 32 aa, Mycobacterium
ARLMRSRTLMRAPIWIYRARAGAVFGSRMLML

SEQ ID NO: 1069831 - protein, 17 aa, Mycobacterium
ARLPPAPEPPVPPAPPA

SEQ ID NO: 1069832 - protein, 24 aa, Mycobacterium
ARLQDLGFYTGLVDGYFGLQTHNA

SEQ ID NO: 1069833 - protein, 25 aa, Mycobacterium
ARLRARIWVAQVGRVPLLLLDSDVP

SEQ ID NO: 1069834 - protein, 17 aa, Mycobacterium
ARLSESFALLSRGYRGS

SEQ ID NO: 1069835 - protein, 20 aa, Mycobacterium
ARLTIGAGLGPMLEAANARQ

SEQ ID NO: 1069836 - protein, 18 aa, Mycobacterium
ARLVDLYAKRPQVQERLT

SEQ ID NO: 1069837 - protein, 22 aa, Mycobacterium
ARMELPFFRTVESAPGPTTVVE

SEQ ID NO: 1069838 - protein, 20 aa, Mycobacterium
ARMMMLGSAPLDRGSPLLAE

SEQ ID NO: 1069839 - protein, 30 aa, Mycobacterium; identical to SEQ ID NO: 795244

SEQ ID NO: 1069840 - protein, 18 aa, Mycobacterium
ARNPLRFAAPVPGRHGWH

SEQ ID NO: 1069841 - protein, 26 aa, Mycobacterium
ARNRGLWKLFHPHPEWGPGLTNLEYA

SEQ ID NO: 1069842 - protein, 32 aa, Mycobacterium
ARNVIPKPMQKPHPPVWVACTRPATVQMAAQK

SEQ ID NO: 1069843 - protein, 18 aa, Mycobacterium
ARPGPAPAAPVVGTMQSL

SEQ ID NO: 1069844 - protein, 17 aa, Mycobacterium
ARPIAVVDQLRFGAADA

SEQ ID NO: 1069845 - protein, 31 aa, Mycobacterium; identical to SEQ ID NO: 795280

SEQ ID NO: 1069846 - protein, 24 aa, Mycobacterium
ARPTGKIVLIAPAALDPAGTVLIT

SEQ ID NO: 1069847 - protein, 22 aa, Mycobacterium
ARPVRAPHWLPTPARPRARGAY

SEQ ID NO: 1069848 - protein, 20 aa, Mycobacterium
ARPYRDYIVWLANQDRSAAL

SEQ ID NO: 1069849 - protein, 26 aa, Mycobacterium
ARQDRAELIAWLLERGFSFEHIQASA

SEQ ID NO: 1069850 - protein, 26 aa, Mycobacterium
ARQEPGLSWAAGLRDDGRTTLLVTDL

SEQ ID NO: 1069851 - protein, 23 aa, Mycobacterium
ARQRRLYDIPSRFVKTIGPDPVH

SEQ ID NO: 1069852 - protein, 33 aa, Mycobacterium
ARRAIVPACALLPPVFPVWGKYPGKLTAQSGGH

SEQ ID NO: 1069853 - protein, 23 aa, Mycobacterium
ARRAYDVHPIVTAILDADTPFDE

SEQ ID NO: 1069854 - protein, 25 aa, Mycobacterium
ARRFDPRLGRTPLSRIWTQFSDSKK

SEQ ID NO: 1069855 - protein, 34 aa, Mycobacterium
ARRGAHLRGRRKPVLVRHRLLQSPNRVPSTKVKK

SEQ ID NO: 1069856 - protein, 26 aa, Mycobacterium
ARRGDGWIKLVGDWIDRQIGDLAPLW

SEQ ID NO: 1069857 - protein, 22 aa, Mycobacterium
ARRGKMFARLIKNIEVAARVGG

SEQ ID NO: 1069858 - protein, 18 aa, Mycobacterium
ARRIARNTQLLLLEESHV

SEQ ID NO: 1069859 - protein, 18 aa, Mycobacterium
ARRISAVKAFTAWAKWRG

SEQ ID NO: 1069860 - protein, 26 aa, Mycobacterium
ARRLAEKLWYLRILTDEKSASDLGAP

SEQ ID NO: 1069861 - protein, 25 aa, Mycobacterium
ARRLRKDIFDLYGYSAVVHVLSASG

SEQ ID NO: 1069862 - protein, 17 aa, Mycobacterium
ARRLRVAGAGLIRAWRA

SEQ ID NO: 1069863 - protein, 17 aa, Mycobacterium
ARRMATEEGLLFGISSG

SEQ ID NO: 1069864 - protein, 27 aa, Mycobacterium
ARRRFRRSIQTILLAALGRTIAQTVGD

SEQ ID NO: 1069865 - protein, 24 aa, Mycobacterium
ARRSGMIEQIWRAFFSSLAADGVD

SEQ ID NO: 1069866 - protein, 29 aa, Mycobacterium
ARRVADVLGIPFYVWDFAERFKEDVIDDF

SEQ ID NO: 1069867 - protein, 18 aa, Mycobacterium
ARRVVVVSYLLAEGLFQE

SEQ ID NO: 1069868 - protein, 27 aa, Mycobacterium
ARRWCDIWLHEGFACYAEWLWSEHSGG

SEQ ID NO: 1069869 - protein, 24 aa, Mycobacterium
ARSGRGVLWRSSTLHQLCCGETGN

SEQ ID NO: 1069870 - protein, 20 aa, Mycobacterium
ARSLMRPLLEHPAALHASIR

SEQ ID NO: 1069871 - protein, 26 aa, Mycobacterium
ARSPRPATVWIAQDGSHRLVRANVDL

SEQ ID NO: 1069872 - protein, 23 aa, Mycobacterium
ARTEPVVFVLEDVHWIDEASESM

SEQ ID NO: 1069873 - protein, 19 aa, Mycobacterium
ARTFCFNPMVFAGEKPTTM

SEQ ID NO: 1069874 - protein, 26 aa, Mycobacterium
ARTFGMDSWFPSLKIYNRNGQLYTAV

SEQ ID NO: 1069875 - protein, 25 aa, Mycobacterium
ARTGLVLAPAGGTLRPLRPAFSVGL

SEQ ID NO: 1069876 - protein, 26 aa, Mycobacterium
ARTGRRYLDMFTFFASSALGMNHPGL

SEQ ID NO: 1069877 - protein, 26 aa, Mycobacterium
ARTYEKMSLFIVPAETPGIEIVRNVG

SEQ ID NO: 1069878 - protein, 26 aa, Mycobacterium
ARVGSYLRYGAYPYAIAIRESLGDGN

SEQ ID NO: 1069879 - protein, 25 aa, Mycobacterium
ARVHYHVPLHLDPPAPLRTTSHILA

SEQ ID NO: 1069880 - protein, 23 aa, Mycobacterium
ARVLHCAALRRLADKTQVVGPRE

SEQ ID NO: 1069881 - protein, 20 aa, Mycobacterium
ARVQLLRDLGSAASPFNAFL

SEQ ID NO: 1069882 - protein, 26 aa, Mycobacterium
ARVTRRLVAMLARRGYSQTVACEVVI

SEQ ID NO: 1069883 - protein, 26 aa, Mycobacterium
ARWTVRVIVSLLMFPGQDEADERAML

SEQ ID NO: 1069884 - protein, 19 aa, Mycobacterium
ARYFRVLTSWVGGGFTIAD

SEQ ID NO: 1069885 - protein, 18 aa, Mycobacterium
ARYILPSFIEHSSFGVKE

SEQ ID NO: 1069886 - protein, 33 aa, Mycobacterium; identical to SEQ ID NO: 795613

SEQ ID NO: 1069887 - protein, 30 aa, Mycobacterium
ASAAMASAAAPYLKWLTTAAAQAGQAATQV

SEQ ID NO: 1069888 - protein, 31 aa, Mycobacterium
ASAAMSAVAAPYASWLSAAAAQAAGTAGRAS

SEQ ID NO: 1069889 - protein, 31 aa, Mycobacterium
ASADEFRVQIYALIVMIWTSAAANDAQTAVA

SEQ ID NO: 1069890 - protein, 25 aa, Mycobacterium
ASAGAGNFNLALARAYKAVADATGG

SEQ ID NO: 1069891 - protein, 23 aa, Mycobacterium
ASAKPFDFVFHGGSGSLKSEIEE

SEQ ID NO: 1069892 - protein, 17 aa, Mycobacterium
ASALLISRLVSWVDDLW

SEQ ID NO: 1069893 - protein, 24 aa, Mycobacterium
ASANHILGFPFTKHGLRLGVEASL

SEQ ID NO: 1069894 - protein, 25 aa, Mycobacterium
ASANHILGFPFTKHGLRLGVEASLR

SEQ ID NO: 1069895 - protein, 23 aa, Mycobacterium
ASAPYVAWLRASAIRAERTASQA

SEQ ID NO: 1069896 - protein, 22 aa, Mycobacterium
ASAQAALLLEALTDAGFDNVVP

SEQ ID NO: 1069897 - protein, 29 aa, Mycobacterium
ASAQAQSLGQRFAQALAAGAGSYSSAEAA

SEQ ID NO: 1069898 - protein, 23 aa, Mycobacterium
ASARLAGLLIQRGLRPGDRVGVM

SEQ ID NO: 1069899 - protein, 22 aa, Mycobacterium
ASARRLQLDRIPLYQIHQPNPV

SEQ ID NO: 1069900 - protein, 28 aa, Mycobacterium
ASASPLFIPVDRLTGWAWVPLTTDTARN

SEQ ID NO: 1069901 - protein, 26 aa, Mycobacterium
ASAWDSLWVYDHFHTVPLPSDEATHE

SEQ ID NO: 1069902 - protein, 19 aa, Mycobacterium
ASCEFAVLIPLGVDTSVLW

SEQ ID NO: 1069903 - protein, 24 aa, Mycobacterium
ASDIRRWPLAASGTSIYWTGLNKG

SEQ ID NO: 1069904 - protein, 24 aa, Mycobacterium
ASDSAGFKWLAPYTGSAVAQHWMY

SEQ ID NO: 1069905 - protein, 26 aa, Mycobacterium
ASDTADWFAGRLPEDWFEGAPAVVVD

SEQ ID NO: 1069906 - protein, 24 aa, Mycobacterium
ASEANVIWKLRYTMRSQIFSRGLP

SEQ ID NO: 1069907 - protein, 18 aa, Mycobacterium
ASELILPIAVAVQNRITV

SEQ ID NO: 1069908 - protein, 25 aa, Mycobacterium
ASELVFTLPSYNLNLFLDGVIQAIN

SEQ ID NO: 1069909 - protein, 27 aa, Mycobacterium
ASEPRRLARRYLLQGPIALLRAARAQL

SEQ ID NO: 1069910 - protein, 28 aa, Mycobacterium
ASESAELPLFRYIGGPNAHILPVPMMNI

SEQ ID NO: 1069911 - protein, 17 aa, Mycobacterium
ASGAPTAILLDGSKFGG

SEQ ID NO: 1069912 - protein, 26 aa, Mycobacterium
ASGAQWAGFARAALFPTLAAALDCGT

SEQ ID NO: 1069913 - protein, 25 aa, Mycobacterium
ASGLDARAYRLGWPAGTVVHEVDMP

SEQ ID NO: 1069914 - protein, 26 aa, Mycobacterium
ASGLDARAYRLPWPADTVVYELDQPQ

SEQ ID NO: 1069915 - protein, 26 aa, Mycobacterium
ASGLDSRAWRLPWPDGTVVYELDQPR

SEQ ID NO: 1069916 - protein, 26 aa, Mycobacterium
ASGLDTRAYRLNWPSGMTVYEIDQPQ

SEQ ID NO: 1069917 - protein, 24 aa, Mycobacterium
ASGLPSWQQALSALPGIGQAAAAP

SEQ ID NO: 1069918 - protein, 22 aa, Mycobacterium
ASGPRIRLAYQLTPRSVRGEQR

SEQ ID NO: 1069919 - protein, 24 aa, Mycobacterium
ASGRWVPDFLSLPIAIENSLKNQT

SEQ ID NO: 1069920 - protein, 21 aa, Mycobacterium
ASGTPPIYFGFGSMPVESPAA

SEQ ID NO: 1069921 - protein, 25 aa, Mycobacterium
ASHCYPHFSRFLAEVVRVLRPGGYL

SEQ ID NO: 1069922 - protein, 23 aa, Mycobacterium
ASHHPIIDPILPDLRSALADLTP

SEQ ID NO: 1069923 - protein, 31 aa, Mycobacterium
ASHNETYLQFYDLLLPTIHRAVEAGPVGTCT

SEQ ID NO: 1069924 - protein, 30 aa, Mycobacterium
ASHRIRVMTIAPGLFDTPLLASLPEEARAS

SEQ ID NO: 1069925 - protein, 31 aa, Mycobacterium; identical to SEQ ID NO: 795837

SEQ ID NO: 1069926 - protein, 28 aa, Mycobacterium
ASILPEVSLPPWLATNLANWNTIMATLT

SEQ ID NO: 1069927 - protein, 27 aa, Mycobacterium
ASIPVKRLRQAGVLELLLALANETGGN

SEQ ID NO: 1069928 - protein, 29 aa, Mycobacterium
ASIYSSCAVPPLIGYLNDGKLPGTYTYCP

SEQ ID NO: 1069929 - protein, 25 aa, Mycobacterium
ASKGYCFQIDLTWRTVNNGFVIIEV

SEQ ID NO: 1069930 - protein, 25 aa, Mycobacterium
ASKHALVGLMRVYANLLAPHSIRVN

SEQ ID NO: 1069931 - protein, 18 aa, Mycobacterium
ASKRFRRTGTGKIVRQKA

SEQ ID NO: 1069932 - protein, 24 aa, Mycobacterium
ASLADIFVTLFLGAQLIVPKPDAF

SEQ ID NO: 1069933 - protein, 24 aa, Mycobacterium
ASLAKALLPIMNPGGSIVGMDFDP

SEQ ID NO: 1069934 - protein, 24 aa, Mycobacterium
ASLGLPIFGDPLYPNVIPESPHDL

SEQ ID NO: 1069935 - protein, 22 aa, Mycobacterium
ASLREHTWKRSSFSGAEIFGKT

SEQ ID NO: 1069936 - protein, 24 aa, Mycobacterium
ASLRGLLKFRAGVRPPIPLDEVEP

SEQ ID NO: 1069937 - protein, 18 aa, Mycobacterium
ASLRLLARGGRFIEMGKT

SEQ ID NO: 1069938 - protein, 30 aa, Mycobacterium; identical to SEQ ID NO: 943091

SEQ ID NO: 1069939 - protein, 26 aa, Mycobacterium
ASMISLTYFPPLWRKVMDHRVLEHYG

SEQ ID NO: 1069940 - protein, 19 aa, Mycobacterium
ASMTPFPTMYELFSVGWGQ

SEQ ID NO: 1069941 - protein, 30 aa, Mycobacterium; identical to SEQ ID NO: 795923

SEQ ID NO: 1069942 - protein, 18 aa, Mycobacterium
ASNLDWTVLGPSRLTMEP

SEQ ID NO: 1069943 - protein, 25 aa, Mycobacterium
ASNRVRPIIGSRLPIGQAAQAHQLL

SEQ ID NO: 1069944 - protein, 20 aa, Mycobacterium
ASPCWSIRALLRVGGRKMGV

SEQ ID NO: 1069945 - protein, 24 aa, Mycobacterium
ASPLIALLEVSGAVLSWVIDDPRG

SEQ ID NO: 1069946 - protein, 27 aa, Mycobacterium
ASPSRAFWLDRLQGFQTLRFAGDRLQH

SEQ ID NO: 1069947 - protein, 23 aa, Mycobacterium
ASQADVIWKLRYTMRSQIFSRGL

SEQ ID NO: 1069948 - protein, 24 aa, Mycobacterium
ASQRAEARTWWRIGEPYEGIDVAT

SEQ ID NO: 1069949 - protein, 25 aa, Mycobacterium
ASRANLIVVPLDPALPVAYQRARAG

SEQ ID NO: 1069950 - protein, 23 aa, Mycobacterium
ASRATYIELLTKLEARFADQPNA

SEQ ID NO: 1069951 - protein, 22 aa, Mycobacterium
ASRHHAFLTLTPLGTEIRDAHS

SEQ ID NO: 1069952 - protein, 18 aa, Mycobacterium
ASRTAFFDEFFLDATRAG

SEQ ID NO: 1069953 - protein, 28 aa, Mycobacterium
ASSTKWEKLFRFLALDRLQTRLHRWRLN

SEQ ID NO: 1069954 - protein, 18 aa, Mycobacterium
ASTGYYNTGLFNSGDHNT

SEQ ID NO: 1069955 - protein, 28 aa, Mycobacterium
ASTPLDRRYPLWEMYFVEGLANHRVAVV

SEQ ID NO: 1069956 - protein, 17 aa, Mycobacterium
ASTTYYFSSLDDLVARA

SEQ ID NO: 1069957 - protein, 24 aa, Mycobacterium
ASTVFGVRFPGPLGLAAGFDKDGT

SEQ ID NO: 1069958 - protein, 21 aa, Mycobacterium
ASVGGYPLERLRILDLGIIVA

SEQ ID NO: 1069959 - protein, 22 aa, Mycobacterium
ASVIPRAIGVNPFLTISMFAER

SEQ ID NO: 1069960 - protein, 19 aa, Mycobacterium
ASVIRYTQLRPFVLHVNHT

SEQ ID NO: 1069961 - protein, 26 aa, Mycobacterium
ASVLAYPRVVWVAGGLLKGASVDAEV

SEQ ID NO: 1069962 - protein, 19 aa, Mycobacterium
ASVYDIFGMFAVGGSLVAV

SEQ ID NO: 1069963 - protein, 17 aa, Mycobacterium
ASWAPAEGEPLLEPLRA

SEQ ID NO: 1069964 - protein, 31 aa, Mycobacterium; identical to SEQ ID NO: 796115

SEQ ID NO: 1069965 - protein, 22 aa, Mycobacterium
ASYHRWRYQFGGLKAKDADKLE

SEQ ID NO: 1069966 - protein, 17 aa, Mycobacterium
ASYPGFTSTAPPGDGQV

SEQ ID NO: 1069967 - protein, 23 aa, Mycobacterium
ATAAGRAVFTPSLAGLVLGEYRR

SEQ ID NO: 1069968 - protein, 33 aa, Mycobacterium; identical to SEQ ID NO: 796135

SEQ ID NO: 1069969 - protein, 17 aa, Mycobacterium
ATAIRIAISHYIVRSDD

SEQ ID NO: 1069970 - protein, 20 aa, Mycobacterium
ATAKFDFADGFATVTIVTTG

SEQ ID NO: 1069971 - protein, 18 aa, Mycobacterium
ATALLRMQAIDTEALRAS

SEQ ID NO: 1069972 - protein, 29 aa, Mycobacterium
ATARPVIPIFINAIAAPLGPLRRCRALGT

SEQ ID NO: 1069973 - protein, 18 aa, Mycobacterium
ATARRWFEEFEGAGLDGV

SEQ ID NO: 1069974 - protein, 27 aa, Mycobacterium
ATATRELDWWLGFSSTASLLGSPGQTA

SEQ ID NO: 1069975 - protein, 22 aa, Mycobacterium
ATATYLVRMLRDIPGLTVTRIA

SEQ ID NO: 1069976 - protein, 23 aa, Mycobacterium
ATAVQIVPFLGRYAKHLYVFQRT

SEQ ID NO: 1069977 - protein, 19 aa, Mycobacterium
ATDHLMRFPGHFSEQLLPE

SEQ ID NO: 1069978 - protein, 28 aa, Mycobacterium
ATDLAGLGSTLQIANRAAAATITGVPAA

SEQ ID NO: 1069979 - protein, 25 aa, Mycobacterium
ATDLELILTTRRITHLIFTGIATDV

SEQ ID NO: 1069980 - protein, 27 aa, Mycobacterium
ATDPAGAFFGLWQPLGHRGFEIIGEAG

SEQ ID NO: 1069981 - protein, 25 aa, Mycobacterium
ATDPELAIDWPLVDGAPPSLSERDA

SEQ ID NO: 1069982 - protein, 24 aa, Mycobacterium
ATDPLPVVLFFHGGGFVMGDLDTH

SEQ ID NO: 1069983 - protein, 26 aa, Mycobacterium
ATDYRTLLEFFFQIHDPTTPNRQGND

SEQ ID NO: 1069984 - protein, 22 aa, Mycobacterium
ATEAVYEQLWAQDVAVMAGYHA

SEQ ID NO: 1069985 - protein, 24 aa, Mycobacterium
ATEEFLRYFTPAPGDGRTFSDDLE

SEQ ID NO: 1069986 - protein, 20 aa, Mycobacterium
ATELYRGAPFGVGCFVGVWQ

SEQ ID NO: 1069987 - protein, 28 aa, Mycobacterium
ATFPISAHYFTVFPLARWSAVLGRRYLR

SEQ ID NO: 1069988 - protein, 41 aa, Mycobacterium
ATGAAPLQPVLDLINGPTQALLGRPLIGNGTSGALGTGQAG

SEQ ID NO: 1069989 - protein, 25 aa, Mycobacterium
ATGARWLCETFPTRLERGAGVPAVE

SEQ ID NO: 1069990 - protein, 24 aa, Mycobacterium
ATGDPVRILSPRTAQPGGLSTCLD

SEQ ID NO: 1069991 - protein, 18 aa, Mycobacterium
ATGLLKRALRIGQEKDDA

SEQ ID NO: 1069992 - protein, 25 aa, Mycobacterium
ATGLRPFDVQLLGALRMLAGDVIEM

SEQ ID NO: 1069993 - protein, 32 aa, Mycobacterium; identical to SEQ ID NO: 124558

SEQ ID NO: 1069994 - protein, 30 aa, Mycobacterium
ATGSPMPTPALGTPFPPGATQLPAGGGSGV

SEQ ID NO: 1069995 - protein, 25 aa, Mycobacterium
ATHGQLMTLYPSLSSDQAWAMLGVT

SEQ ID NO: 1069996 - protein, 27 aa, Mycobacterium
ATHHELHLWLPHPSAALWRSLADLHGV

SEQ ID NO: 1069997 - protein, 22 aa, Mycobacterium
ATHRALPPQPPAPPSRPAAALG

SEQ ID NO: 1069998 - protein, 30 aa, Mycobacterium
ATIGVSYLGFTQWALLQDPPPELAAAVITA

SEQ ID NO: 1069999 - protein, 32 aa, Mycobacterium; identical to SEQ ID NO: 796378

SEQ ID NO: 1070000 - protein, 18 aa, Mycobacterium
ATIPIIAGFPFPLAVEIL

SEQ ID NO: 1070001 - protein, 18 aa, Mycobacterium
ATKRIAPIVVLTAFSQRD

SEQ ID NO: 1070002 - protein, 30 aa, Mycobacterium
ATLARFAQRFARFHLHPRALRPSYGLAEAT

SEQ ID NO: 1070003 - protein, 22 aa, Mycobacterium
ATLHHRAAALVGSLMRELTQDW

SEQ ID NO: 1070004 - protein, 18 aa, Mycobacterium
ATLLMSCFCDANPPNEQQ

SEQ ID NO: 1070005 - protein, 24 aa, Mycobacterium
ATMKRLFLELGGKSATIVLEDAEF

SEQ ID NO: 1070006 - protein, 20 aa, Mycobacterium
ATPRHHGISIVLVEPGPGLN

SEQ ID NO: 1070007 - protein, 28 aa, Mycobacterium
ATPYSVLVAAFMVWIASYGRQRDMVVGA

SEQ ID NO: 1070008 - protein, 30 aa, Mycobacterium
ATQFYSMLGMRALYHQGWLATTLHPPLSGW

SEQ ID NO: 1070009 - protein, 17 aa, Mycobacterium
ATQPMPATVWIQETGDH

SEQ ID NO: 1070010 - protein, 20 aa, Mycobacterium
ATQQAVLPTAKFTDRVLAEV

SEQ ID NO: 1070011 - protein, 34 aa, Mycobacterium
ATRIPMTWFEVDQVPLWAKVPIVLVVHAPAGGDY

SEQ ID NO: 1070012 - protein, 24 aa, Mycobacterium
ATRKALLEALLRHVPTGDLDIDEI

SEQ ID NO: 1070013 - protein, 22 aa, Mycobacterium
ATRWPAVRFAVRNTAVQGPNAV

SEQ ID NO: 1070014 - protein, 23 aa, Mycobacterium
ATRWRVGFSGFAPGFAYLIGGDP

SEQ ID NO: 1070015 - protein, 28 aa, Mycobacterium
ATSASTPLFFAQAIGRFVRSRHPGETAS

SEQ ID NO: 1070016 - protein, 23 aa, Mycobacterium
ATSLPGFRAVIGPLLRTAEQGAD

SEQ ID NO: 1070017 - protein, 29 aa, Mycobacterium
ATSSGRGLWELAWPPLSSAGAPGAAAVAE

SEQ ID NO: 1070018 - protein, 23 aa, Mycobacterium
ATSTHFLQTPACAPIVAAALGCQ

SEQ ID NO: 1070019 - protein, 25 aa, Mycobacterium
ATSTYLFTHPDVNEFFTGLRGQERD

SEQ ID NO: 1070020 - protein, 21 aa, Mycobacterium
ATTAWLIERLQRPTLVMAPNK

SEQ ID NO: 1070021 - protein, 34 aa, Mycobacterium
ATTDVGALLALARRLLLDPAQIGPIRLLGVGFSG

SEQ ID NO: 1070022 - protein, 25 aa, Mycobacterium
ATTIELLCMLLPSLGMTNDTVGRAG

SEQ ID NO: 1070023 - protein, 22 aa, Mycobacterium
ATTVPSLRLLGYGGSRAIAADV

SEQ ID NO: 1070024 - protein, 26 aa, Mycobacterium
ATVAVMPLYHGHGLMAALLSTLVSGG

SEQ ID NO: 1070025 - protein, 19 aa, Mycobacterium
ATVENLSLGGLLPINTNGG

SEQ ID NO: 1070026 - protein, 21 aa, Mycobacterium
ATVLLRTLPLVVHGSSVGAAV

SEQ ID NO: 1070027 - protein, 20 aa, Mycobacterium
ATVPELPVGVRLIFEAAEEL

SEQ ID NO: 1070028 - protein, 18 aa, Mycobacterium
ATVPPALILENRLQLVTL

SEQ ID NO: 1070029 - protein, 17 aa, Mycobacterium
ATVPPPVIAANRAHLAA

SEQ ID NO: 1070030 - protein, 25 aa, Mycobacterium
ATVPPPVIAANRALLMALIATNIFG

SEQ ID NO: 1070031 - protein, 34 aa, Mycobacterium
ATVQEDLLAVINAPTQALLGRPLIGNGADGTAAN

SEQ ID NO: 1070032 - protein, 18 aa, Mycobacterium
ATVRPFVFEFPTLPGTDE

SEQ ID NO: 1070033 - protein, 23 aa, Mycobacterium
ATVSIWMGILLTEKLRGAFGQHP

SEQ ID NO: 1070034 - protein, 23 aa, Mycobacterium
ATVVQLFICFRQGATPVSVGPDR

SEQ ID NO: 1070035 - protein, 18 aa, Mycobacterium
ATWDYFPGHFDPGYARDQ

SEQ ID NO: 1070036 - protein, 19 aa, Mycobacterium
ATWSTDLMLLLMTAGVPQE

SEQ ID NO: 1070037 - protein, 30 aa, Mycobacterium; identical to SEQ ID NO: 796674

SEQ ID NO: 1070038 - protein, 24 aa, Mycobacterium
ATYEALAKAPWRSATVTATAWGLR

SEQ ID NO: 1070039 - protein, 28 aa, Mycobacterium
ATYLFTNDYEWDLLLSKTGWSEADVMAQ

SEQ ID NO: 1070040 - protein, 22 aa, Mycobacterium
AVAALQQLAAQCPVAILSGRDL

SEQ ID NO: 1070041 - protein, 33 aa, Mycobacterium
AVAANRSAFLKLVQSNWLGLNAPAIMATEGHYE

SEQ ID NO: 1070042 - protein, 36 aa, Mycobacterium; identical to SEQ ID NO: 796700

SEQ ID NO: 1070043 - protein, 17 aa, Mycobacterium
AVAAWLARPDTAETVLV

SEQ ID NO: 1070044 - protein, 30 aa, Mycobacterium
AVADLFAAFGMFAVGFYDLRSARSPIPVVS

SEQ ID NO: 1070045 - protein, 31 aa, Mycobacterium; identical to SEQ ID NO: 943202

SEQ ID NO: 1070046 - protein, 24 aa, Mycobacterium
AVAEFVPRIGTLIDIVHRRHLTSA

SEQ ID NO: 1070047 - protein, 17 aa, Mycobacterium
AVAEMTVALLLASTRHL

SEQ ID NO: 1070048 - protein, 23 aa, Mycobacterium
AVAGRDPSLPRPPRGEAPDRNLA

SEQ ID NO: 1070049 - protein, 17 aa, Mycobacterium
AVAIQPATGTTGTARAA

SEQ ID NO: 1070050 - protein, 26 aa, Mycobacterium
AVAIVNLLRILLSNPAVWEKTALIVG

SEQ ID NO: 1070051 - protein, 17 aa, Mycobacterium
AVALAAALGADVCEIYT

SEQ ID NO: 1070052 - protein, 21 aa, Mycobacterium
AVAQLTPWELTSEGIVIPLPD

SEQ ID NO: 1070053 - protein, 22 aa, Mycobacterium
AVARAAGIGELKFFSKIHYGGG

SEQ ID NO: 1070054 - protein, 19 aa, Mycobacterium
AVARLVLGPGMRIQAPPNL

SEQ ID NO: 1070055 - protein, 26 aa, Mycobacterium
AVARRLARFGAGWIPWGPDARDVAAG

SEQ ID NO: 1070056 - protein, 25 aa, Mycobacterium
AVARYVAELLVWDRAVRTDVDDSVH

SEQ ID NO: 1070057 - protein, 35 aa, Mycobacterium
AVASHFPHLPWPWSLVDFALLPITWASGIIGERVS

SEQ ID NO: 1070058 - protein, 18 aa, Mycobacterium
AVASLDLGLPLAAGNVVS

SEQ ID NO: 1070059 - protein, 25 aa, Mycobacterium
AVASYVTVTAALAGVRRGKADSISI

SEQ ID NO: 1070060 - protein, 31 aa, Mycobacterium
AVATLAALAALAARSIPAVTTVTAVAAYPAV

SEQ ID NO: 1070061 - protein, 18 aa, Mycobacterium
AVAWLGPAPAQDAEPDGL

SEQ ID NO: 1070062 - protein, 19 aa, Mycobacterium
AVCERLHTASLRTVVVGAD

SEQ ID NO: 1070063 - protein, 26 aa, Mycobacterium
AVDAGDRWILHCGDAFYHVGTLDGQS

SEQ ID NO: 1070064 - protein, 26 aa, Mycobacterium
AVDDLHLPEMLLLLATDLAAVDHHEG

SEQ ID NO: 1070065 - protein, 19 aa, Mycobacterium
AVDGIMRRLNPSGAMCIIT

SEQ ID NO: 1070066 - protein, 35 aa, Mycobacterium
AVDHTRRYLRACQQLGYQDPFLAKGFDPIGDRYDS

SEQ ID NO: 1070067 - protein, 24 aa, Mycobacterium
AVDPAHPFPFVSGLSLNLAVTVKQ

SEQ ID NO: 1070068 - protein, 17 aa, Mycobacterium
AVDPNREMLASERPRGV

SEQ ID NO: 1070069 - protein, 34 aa, Mycobacterium; identical to SEQ ID NO: 796881

SEQ ID NO: 1070070 - protein, 28 aa, Mycobacterium
AVDRKFIDFYLGLSNYVNNWLKLGFTED

SEQ ID NO: 1070071 - protein, 26 aa, Mycobacterium
AVDSQGHPFLFDLQNLRGHGTGVGCS

SEQ ID NO: 1070072 - protein, 21 aa, Mycobacterium
AVDVTLLGRFYERFADHAVEV

SEQ ID NO: 1070073 - protein, 18 aa, Mycobacterium
AVDWLYSGLPSRFPDLKI

SEQ ID NO: 1070074 - protein, 24 aa, Mycobacterium
AVDYFCVGPCWPTPTKPGRTAPGL

SEQ ID NO: 1070075 - protein, 17 aa, Mycobacterium
AVDYFSHPTFYLTDHCR

SEQ ID NO: 1070076 - protein, 19 aa, Mycobacterium
AVEGAVILCLAARSTDPLD

SEQ ID NO: 1070077 - protein, 26 aa, Mycobacterium
AVELGIKWLSLYAFSTENWKRSAEEV

SEQ ID NO: 1070078 - protein, 21 aa, Mycobacterium
AVELILCFNQLAYSAFAPAVA

SEQ ID NO: 1070079 - protein, 29 aa, Mycobacterium
AVESILTVLALRDQVIPPTLNLVNLDPDI

SEQ ID NO: 1070080 - protein, 28 aa, Mycobacterium
AVESILTVLALRDQVVPPTLNLVNLDPE

SEQ ID NO: 1070081 - protein, 17 aa, Mycobacterium
AVEVGRRVIFMVTGVLP

SEQ ID NO: 1070082 - protein, 20 aa, Mycobacterium
AVFFDYPPHPRTIAHTVRGF

SEQ ID NO: 1070083 - protein, 22 aa, Mycobacterium
AVFLTHYLGFPLGSGLNGAVDT

SEQ ID NO: 1070084 - protein, 17 aa, Mycobacterium
AVFSTRGCPYRCTFCGT

SEQ ID NO: 1070085 - protein, 24 aa, Mycobacterium
AVGADAMPWLLAGAKTLSYAVNMA

SEQ ID NO: 1070086 - protein, 23 aa, Mycobacterium
AVGALLSMLAKLSGGKAVAEVGT

SEQ ID NO: 1070087 - protein, 25 aa, Mycobacterium
AVGGFPNFFMLYGPNTNQGGNSIVY

SEQ ID NO: 1070088 - protein, 25 aa, Mycobacterium
AVGGLLPDQPLTAHRARGLARALIA

SEQ ID NO: 1070089 - protein, 17 aa, Mycobacterium
AVGIWVATSFPSFSKRT

SEQ ID NO: 1070090 - protein, 17 aa, Mycobacterium
AVGLPAPRLVVEPGRAI

SEQ ID NO: 1070091 - protein, 20 aa, Mycobacterium
AVGLPMRCVFALTAMGFLPQ

SEQ ID NO: 1070092 - protein, 18 aa, Mycobacterium
AVGMLSVPPTWAGSATLV

SEQ ID NO: 1070093 - protein, 21 aa, Mycobacterium
AVGVHRLLCWGIVGTPLTLVP

SEQ ID NO: 1070094 - protein, 24 aa, Mycobacterium
AVGVVHSLWQPMAGRFKDYIAQPR

SEQ ID NO: 1070095 - protein, 22 aa, Mycobacterium
AVHLRHPLLDPLPGTLPEPEIW

SEQ ID NO: 1070096 - protein, 27 aa, Mycobacterium
AVHLRRALVLYCFTLPFAMVETFGWTT

SEQ ID NO: 1070097 - protein, 27 aa, Mycobacterium
AVHPLALASPFFSSSIWPPGACGWPCR

SEQ ID NO: 1070098 - protein, 20 aa, Mycobacterium
AVHPWGLYLARPTPGRAQFH

SEQ ID NO: 1070099 - protein, 20 aa, Mycobacterium
AVIEPLVLMVAPLAPHLAEE

SEQ ID NO: 1070100 - protein, 21 aa, Mycobacterium
AVIHEMFVNTLATSSGSYAAT

SEQ ID NO: 1070101 - protein, 27 aa, Mycobacterium
AVILAPQGLEYVVAFLGALQAGRIAVP

SEQ ID NO: 1070102 - protein, 26 aa, Mycobacterium
AVIPPSYTRGYIGTALRLLERKIAQQ

SEQ ID NO: 1070103 - protein, 26 aa, Mycobacterium
AVIRATPVLAPLPALALEQLARTATR

SEQ ID NO: 1070104 - protein, 25 aa, Mycobacterium
AVIWSYLELFGTDRLASLLLVDQMP

SEQ ID NO: 1070105 - protein, 25 aa, Mycobacterium
AVKRPEDLRFLVRLARQQGERLGRA

SEQ ID NO: 1070106 - protein, 26 aa, Mycobacterium
AVLADLYGPRRLLTEGLLPSELVFGH

SEQ ID NO: 1070107 - protein, 27 aa, Mycobacterium
AVLANPAQVVSGDLLAAINAPVLSLTG

SEQ ID NO: 1070108 - protein, 24 aa, Mycobacterium
AVLDRILMPNYLLSALQAINILPG

SEQ ID NO: 1070109 - protein, 27 aa, Mycobacterium
AVLGDIIIGDLLSGGMRGGFGGWSPTS

SEQ ID NO: 1070110 - protein, 20 aa, Mycobacterium
AVLGPYFAMPSELIGGGTAE

SEQ ID NO: 1070111 - protein, 19 aa, Mycobacterium
AVLKVIVESAALLGLADES

SEQ ID NO: 1070112 - protein, 18 aa, Mycobacterium
AVLLAPGAGRRYGKPKVL

SEQ ID NO: 1070113 - protein, 20 aa, Mycobacterium
AVLLGTNFFGINTIPIALNE

SEQ ID NO: 1070114 - protein, 17 aa, Mycobacterium
AVLLLVAEYGIPKAWRA

SEQ ID NO: 1070115 - protein, 21 aa, Mycobacterium
AVLLRECIDFFAPYLAAAKLT

SEQ ID NO: 1070116 - protein, 17 aa, Mycobacterium
AVLLTCASALEASVAAQ

SEQ ID NO: 1070117 - protein, 20 aa, Mycobacterium
AVLLVDILDQALAATTAELD

SEQ ID NO: 1070118 - protein, 17 aa, Mycobacterium
AVLPGMLERQRGDLIFV

SEQ ID NO: 1070119 - protein, 19 aa, Mycobacterium
AVLPILHLNGYKIANPTVL

SEQ ID NO: 1070120 - protein, 18 aa, Mycobacterium
AVLPSHYEPFGLVALEAA

SEQ ID NO: 1070121 - protein, 20 aa, Mycobacterium
AVLPSHYEPFGLVALEAAAA

SEQ ID NO: 1070122 - protein, 25 aa, Mycobacterium
AVLPVYDPLFDSQKLRHVLVRHEQG

SEQ ID NO: 1070123 - protein, 26 aa, Mycobacterium
AVLQAERFAVFAGVLCGAPYPQAALA

SEQ ID NO: 1070124 - protein, 24 aa, Mycobacterium
AVLRPGGRLVTLSAPPPAGKADEH

SEQ ID NO: 1070125 - protein, 26 aa, Mycobacterium
AVLSRAQLLELVWGYDFAADTNVVDV

SEQ ID NO: 1070126 - protein, 24 aa, Mycobacterium
AVLTTRIYCRPSCPVRPPFARNVR

SEQ ID NO: 1070127 - protein, 25 aa, Mycobacterium
AVMLEQALRTAPALAPDERDAAFAL

SEQ ID NO: 1070128 - protein, 23 aa, Mycobacterium
AVMLGGLAMKWRWRQKVGKDWKG

SEQ ID NO: 1070129 - protein, 21 aa, Mycobacterium
AVMPMDAWREGDKFVVEFDLP

SEQ ID NO: 1070130 - protein, 20 aa, Mycobacterium
AVMRGILAFLAVNSTYRGPF

SEQ ID NO: 1070131 - protein, 17 aa, Mycobacterium
AVMRRRRARKGTLEFGD

SEQ ID NO: 1070132 - protein, 25 aa, Mycobacterium
AVNADLLIGAVLVPGAKAPKLIPNS

SEQ ID NO: 1070133 - protein, 18 aa, Mycobacterium
AVNPWMLRMAGEVADGVH

SEQ ID NO: 1070134 - protein, 28 aa, Mycobacterium
AVNVDTWGGWIWINMDPAAQPLRQYLEP

SEQ ID NO: 1070135 - protein, 26 aa, Mycobacterium
AVNYPLYVIMSLLGLPEADFPRMLKL

SEQ ID NO: 1070136 - protein, 18 aa, Mycobacterium
AVPAPRLVRLLQQIAPRT

SEQ ID NO: 1070137 - protein, 19 aa, Mycobacterium
AVPMMVFSGIMNTGQACVG

SEQ ID NO: 1070138 - protein, 23 aa, Mycobacterium
AVPNIRFLPALSKVLFRKDFPQE

SEQ ID NO: 1070139 - protein, 28 aa, Mycobacterium
AVPYLSDRGWLLTSTPLPELRAANGLAP

SEQ ID NO: 1070140 - protein, 24 aa, Mycobacterium
AVQAALLARWMLIGFVHGVMNTDN

SEQ ID NO: 1070141 - protein, 25 aa, Mycobacterium
AVQDRLLMAAAAIPAYALLRSPDDL

SEQ ID NO: 1070142 - protein, 19 aa, Mycobacterium
AVQEDVAVVGLSILSGAHL

SEQ ID NO: 1070143 - protein, 38 aa, Mycobacterium; identical to SEQ ID NO: 797299

SEQ ID NO: 1070144 - protein, 18 aa, Mycobacterium
AVQPDVLLMDEPCSALDP

SEQ ID NO: 1070145 - protein, 27 aa, Mycobacterium
AVQRAAAVLLILNPAHPISRVAGMLAD

SEQ ID NO: 1070146 - protein, 20 aa, Mycobacterium
AVQTIWARSVVRDLEDAYAC

SEQ ID NO: 1070147 - protein, 26 aa, Mycobacterium
AVRDKIPLVMLLEGAGFRPTGVHYGR

SEQ ID NO: 1070148 - protein, 18 aa, Mycobacterium
AVRGCRLARRARLAAGEP

SEQ ID NO: 1070149 - protein, 19 aa, Mycobacterium
AVRGGILDLFAPTAEHPVR

SEQ ID NO: 1070150 - protein, 24 aa, Mycobacterium
AVRLGLLAGHYRADRFWSQQVLDE

SEQ ID NO: 1070151 - protein, 18 aa, Mycobacterium
AVRMILYTSGTTGRPKGV

SEQ ID NO: 1070152 - protein, 22 aa, Mycobacterium
AVRPCPPVVIWSLSPPDLRGDD

SEQ ID NO: 1070153 - protein, 21 aa, Mycobacterium
AVRRNVNITILLFNNRIYGLT

SEQ ID NO: 1070154 - protein, 19 aa, Mycobacterium
AVRTFGLGARLLNKLLAAS

SEQ ID NO: 1070155 - protein, 21 aa, Mycobacterium
AVRTHFFDSYFIDAVAAGIRQ

SEQ ID NO: 1070156 - protein, 24 aa, Mycobacterium
AVRTRFFDDFFLAATRAGLEQVVI

SEQ ID NO: 1070157 - protein, 27 aa, Mycobacterium
AVSAPAQSLLARPIIGNGANATTLGGN

SEQ ID NO: 1070158 - protein, 20 aa, Mycobacterium
AVSAQAAVIHEMFVNTLATS

SEQ ID NO: 1070159 - protein, 30 aa, Mycobacterium; identical to SEQ ID NO: 797400

SEQ ID NO: 1070160 - protein, 27 aa, Mycobacterium
AVSEAYFAALLDLPFVAVMPAATSASK

SEQ ID NO: 1070161 - protein, 24 aa, Mycobacterium
AVSIPLLRKDFVVQPYQIHEARAH

SEQ ID NO: 1070162 - protein, 20 aa, Mycobacterium
AVSLAKRYLGYFQGKVEGWQ

SEQ ID NO: 1070163 - protein, 25 aa, Mycobacterium
AVSQHMSPPLKLIGAGELVGVAGKA

SEQ ID NO: 1070164 - protein, 27 aa, Mycobacterium
AVSSQAALFHDQFVQALTTGASSYASA

SEQ ID NO: 1070165 - protein, 25 aa, Mycobacterium
AVSVFAKNLKDLLLAAPAGARTTLG

SEQ ID NO: 1070166 - protein, 24 aa, Mycobacterium
AVSVFSIEFLVHAWDYATAVGHDI

SEQ ID NO: 1070167 - protein, 17 aa, Mycobacterium
AVTALSGSGPAYFLLMV

SEQ ID NO: 1070168 - protein, 23 aa, Mycobacterium
AVTCSFLFLCSGYYNYDQGYTPN

SEQ ID NO: 1070169 - protein, 24 aa, Mycobacterium
AVTDPIQLGFARQALIGIRATGDT

SEQ ID NO: 1070170 - protein, 17 aa, Mycobacterium
AVTILRLANMIGPAMDT

SEQ ID NO: 1070171 - protein, 32 aa, Mycobacterium
AVTPWLAATVSFAWRIRLISSATIDARVRLRQ

SEQ ID NO: 1070172 - protein, 18 aa, Mycobacterium
AVTSWLHRIVVNACLERL

SEQ ID NO: 1070173 - protein, 18 aa, Mycobacterium
AVTTSWWKEERGQRIFID

SEQ ID NO: 1070174 - protein, 19 aa, Mycobacterium
AVTTTSWLTSRHSFSFGDH

SEQ ID NO: 1070175 - protein, 34 aa, Mycobacterium; identical to SEQ ID NO: 783043

SEQ ID NO: 1070176 - protein, 17 aa, Mycobacterium
AVVAPRPGSRPSLAELD

SEQ ID NO: 1070177 - protein, 24 aa, Mycobacterium
AVVEALVRKLGPDFLVEVLEIRAA

SEQ ID NO: 1070178 - protein, 28 aa, Mycobacterium
AVVGIGLPLTRDLISRAGISIAALWASN

SEQ ID NO: 1070179 - protein, 18 aa, Mycobacterium
AVVTGFGEPLQIKELALP

SEQ ID NO: 1070180 - protein, 24 aa, Mycobacterium
AVVTGYWNIFKQNIGIMIAVDQLA

SEQ ID NO: 1070181 - protein, 28 aa, Mycobacterium
AVWGHRISQWLWRRNARLVARALGEINR

SEQ ID NO: 1070182 - protein, 17 aa, Mycobacterium
AVYECAVPVIAAVNGFC

SEQ ID NO: 1070183 - protein, 17 aa, Mycobacterium
AVYFDSEELPQLAKHFY

SEQ ID NO: 1070184 - protein, 24 aa, Mycobacterium
AVYGFTAMLINLLREEAPTHIAAA

SEQ ID NO: 1070185 - protein, 21 aa, Mycobacterium
AVYPFVPAMIEYYLGEKPALA

SEQ ID NO: 1070186 - protein, 28 aa, Mycobacterium
AVYQRYMGWFDGNPARLWQHPPEAIGPR

SEQ ID NO: 1070187 - protein, 30 aa, Mycobacterium
AVYQRYMGWFDGNPGRLWPHPPEELAPRYV

SEQ ID NO: 1070188 - protein, 18 aa, Mycobacterium
AVYRKPYPTPQSRIPTLL

SEQ ID NO: 1070189 - protein, 21 aa, Mycobacterium
AWANILLQRKVPADAALNLFT

SEQ ID NO: 1070190 - protein, 34 aa, Mycobacterium; identical to SEQ ID NO: 797604

SEQ ID NO: 1070191 - protein, 25 aa, Mycobacterium
AWGADPIDMGMGGSIPFIAEFAEAF

SEQ ID NO: 1070192 - protein, 22 aa, Mycobacterium
AWGRFYESPYAGSWPYGLPELP

SEQ ID NO: 1070193 - protein, 18 aa, Mycobacterium
AWHIDLAKRTGKPLMIHN

SEQ ID NO: 1070194 - protein, 25 aa, Mycobacterium
AWIAEGLLVYLPPEAQDRLFDNIAE

SEQ ID NO: 1070195 - protein, 20 aa, Mycobacterium
AWIGPTQHRIYALMKEFGVA

SEQ ID NO: 1070196 - protein, 17 aa, Mycobacterium
AWIQHILSKLAPTGQAG

SEQ ID NO: 1070197 - protein, 30 aa, Mycobacterium; identical to SEQ ID NO: 797621

SEQ ID NO: 1070198 - protein, 19 aa, Mycobacterium
AWLEQQLRSGLRRAFESAG

SEQ ID NO: 1070199 - protein, 20 aa, Mycobacterium
AWLFCPADRPERFAKAAAAA

SEQ ID NO: 1070200 - protein, 18 aa, Mycobacterium
AWLNSWLDRDLGVSGRLS

SEQ ID NO: 1070201 - protein, 21 aa, Mycobacterium
AWLSMVMLEWGSCGQIATAIP

SEQ ID NO: 1070202 - protein, 17 aa, Mycobacterium
AWQTDDAALPLTYRFEP

SEQ ID NO: 1070203 - protein, 18 aa, Mycobacterium
AWSDVGVFPILGMDWRER

SEQ ID NO: 1070204 - protein, 23 aa, Mycobacterium
AWTPTAFPVEFLSLGAGGVGVPV

SEQ ID NO: 1070205 - protein, 19 aa, Mycobacterium
AWTSRFEPAADLLVPLKSG

SEQ ID NO: 1070206 - protein, 17 aa, Mycobacterium
AWYLQYAGKKSIGPDKV

SEQ ID NO: 1070207 - protein, 17 aa, Mycobacterium
AYAAAQVQLPPPGAPIS

SEQ ID NO: 1070208 - protein, 25 aa, Mycobacterium
AYAASNMLATARALPAAPADCAAAA

SEQ ID NO: 1070209 - protein, 29 aa, Mycobacterium
AYAATGKPGWFLFDGLVKHDLLTGNQEGI

SEQ ID NO: 1070210 - protein, 19 aa, Mycobacterium
AYACFTPSPSLGIPALRQL

SEQ ID NO: 1070211 - protein, 24 aa, Mycobacterium
AYAHRWWVRRTLADALREAAQSTP

SEQ ID NO: 1070212 - protein, 26 aa, Mycobacterium
AYAVCELLWQHGFAGATVLLGVDGTA

SEQ ID NO: 1070213 - protein, 22 aa, Mycobacterium
AYEAEPFIYLMPEGQLPRTGAV

SEQ ID NO: 1070214 - protein, 25 aa, Mycobacterium
AYEQYGLPYTIIRPFNCVGTGEQRA

SEQ ID NO: 1070215 - protein, 18 aa, Mycobacterium
AYESAFAATVPPALILEN

SEQ ID NO: 1070216 - protein, 30 aa, Mycobacterium
AYEVNEAFAPVPLAWLCDIGADENRLNPNG

SEQ ID NO: 1070217 - protein, 20 aa, Mycobacterium
AYFKGGINPVSVWVSTDYVR

SEQ ID NO: 1070218 - protein, 18 aa, Mycobacterium
AYGAAWIGASPDADLAWV

SEQ ID NO: 1070219 - protein, 20 aa, Mycobacterium
AYGALPYLRKAPGSLMFSTS

SEQ ID NO: 1070220 - protein, 26 aa, Mycobacterium
AYGGTFRLIDKVFTGWNVEYTPVALA

SEQ ID NO: 1070221 - protein, 17 aa, Mycobacterium
AYGTAKVALAHYTRLAA

SEQ ID NO: 1070222 - protein, 18 aa, Mycobacterium
AYHAVTYGWLLSGLARAV

SEQ ID NO: 1070223 - protein, 24 aa, Mycobacterium
AYKYPRRIWFVDELPKGPTGKILK

SEQ ID NO: 1070224 - protein, 39 aa, Mycobacterium; identical to SEQ ID NO: 797794

SEQ ID NO: 1070225 - protein, 19 aa, Mycobacterium
AYNLLVQLTAEELAAGVVC

SEQ ID NO: 1070226 - protein, 18 aa, Mycobacterium
AYQAQFTHHMYLPMDEDM

SEQ ID NO: 1070227 - protein, 26 aa, Mycobacterium
AYRDSQGWIYLAPAAPPTGCGYTAKT

SEQ ID NO: 1070228 - protein, 17 aa, Mycobacterium
AYRVRLLRGHPCARDHR

SEQ ID NO: 1070229 - protein, 18 aa, Mycobacterium
AYSWRHQIPVLAEAGYHV

SEQ ID NO: 1070230 - protein, 18 aa, Mycobacterium
AYTTVMTVLQRLAKKKLV

SEQ ID NO: 1070231 - protein, 42 aa, Mycobacterium
AYVAAEAANVWPLQDLLGLINAPTQALLGRPLIGNGTNGTAA

SEQ ID NO: 1070232 - protein, 20 aa, Mycobacterium
AYVCFRRQGFQKTTIVDIAR

SEQ ID NO: 1070233 - protein, 21 aa, Mycobacterium
AYVYPMFEQALRIANGESIED

SEQ ID NO: 1070234 - protein, 24 aa, Mycobacterium
AYYVHTDYLFLTPAQIDAAVHLTN

SEQ ID NO: 1070235 - protein, 32 aa, Mycobacterium
CAAAVEGLILGSYRFSAFRSAKTAPKDAGLHK

SEQ ID NO: 1070236 - protein, 28 aa, Mycobacterium
CAAIGLVKFDLLGLGMLSALHYARDLVA

SEQ ID NO: 1070237 - protein, 20 aa, Mycobacterium
CAALPERVGVAAIPMSAFCD

SEQ ID NO: 1070238 - protein, 26 aa, Mycobacterium
CAAQDLMPLAARLAPLRAAAGQILMR

SEQ ID NO: 1070239 - protein, 26 aa, Mycobacterium
CAELALPHIVLARPPWDPGAALVVRS

SEQ ID NO: 1070240 - protein, 37 aa, Mycobacterium; identical to SEQ ID NO: 797895

SEQ ID NO: 1070241 - protein, 22 aa, Mycobacterium
CAFGLALIAPRLPPFDVPDGHT

SEQ ID NO: 1070242 - protein, 21 aa, Mycobacterium
CAGAISLGVLKRGAQLMYRFA

SEQ ID NO: 1070243 - protein, 19 aa, Mycobacterium
CAGITLFSPLRHWNAGPGK

SEQ ID NO: 1070244 - protein, 17 aa, Mycobacterium
CALTVSGKLRFVDNAGG

SEQ ID NO: 1070245 - protein, 21 aa, Mycobacterium
CANYLATLRFELLSLARACGY

SEQ ID NO: 1070246 - protein, 23 aa, Mycobacterium
CARLTVVWIADWADDTVHLSAHH

SEQ ID NO: 1070247 - protein, 18 aa, Mycobacterium
CARQRGPVAESLLALGLP

SEQ ID NO: 1070248 - protein, 17 aa, Mycobacterium
CARSSGRAYRWANPARL

SEQ ID NO: 1070249 - protein, 23 aa, Mycobacterium
CASATRLTPFTSPPPITDPVGLA

SEQ ID NO: 1070250 - protein, 24 aa, Mycobacterium
CATRSFVPLWDYNSVVRWSSAVSN

SEQ ID NO: 1070251 - protein, 25 aa, Mycobacterium
CATRSFVPLWDYNSVVRWSSAVSNV

SEQ ID NO: 1070252 - protein, 20 aa, Mycobacterium
CAVLSEWLPATTGDIIFADG

SEQ ID NO: 1070253 - protein, 20 aa, Mycobacterium
CAVVPLGWPIGKYGPTTRRP

SEQ ID NO: 1070254 - protein, 17 aa, Mycobacterium
CCRATWTCPMPARPPCR

SEQ ID NO: 1070255 - protein, 36 aa, Mycobacterium
CCRPVFVTHRRLTLPKRWLGYPFGAPTLALPEYNNG

SEQ ID NO: 1070256 - protein, 23 aa, Mycobacterium
CDEDIYYYYDCIYCAADVASPTG

SEQ ID NO: 1070257 - protein, 17 aa, Mycobacterium
CDERPRRVFAAKQAQDV

SEQ ID NO: 1070258 - protein, 20 aa, Mycobacterium
CDIITITQYLRPSPRHHPVE

SEQ ID NO: 1070259 - protein, 24 aa, Mycobacterium
CDILARYDVTFSLGDGLRPGSIAD

SEQ ID NO: 1070260 - protein, 22 aa, Mycobacterium
CDLAAFTAIVPCGISDAGVTSL

SEQ ID NO: 1070261 - protein, 29 aa, Mycobacterium
CDLHKTNPLYLLDFLRQSGETPIVLLHCY

SEQ ID NO: 1070262 - protein, 17 aa, Mycobacterium
CDLLYDGTDFFEFDAPR

SEQ ID NO: 1070263 - protein, 24 aa, Mycobacterium
CDPLWLRRRVGMCFQRPTPFAGTV

SEQ ID NO: 1070264 - protein, 20 aa, Mycobacterium
CDPVLRTAVGWLSEPLAKMA

SEQ ID NO: 1070265 - protein, 22 aa, Mycobacterium
CDRELGLPLPDAATRKALLEAL

SEQ ID NO: 1070266 - protein, 23 aa, Mycobacterium
CEAGLLPGALTRNVGLHFVCRDA

SEQ ID NO: 1070267 - protein, 18 aa, Mycobacterium
CEDWFFCTKELSAETVES

SEQ ID NO: 1070268 - protein, 25 aa, Mycobacterium
CEEYLYRPAPPLSCPITALGGVGDV

SEQ ID NO: 1070269 - protein, 22 aa, Mycobacterium
CEFAMAFDMRYAALGTTVLGHP

SEQ ID NO: 1070270 - protein, 19 aa, Mycobacterium
CEPVAGYLTLRYVQGQSFE

SEQ ID NO: 1070271 - protein, 19 aa, Mycobacterium
CERIYFDTLTMIKQLLGGL

SEQ ID NO: 1070272 - protein, 17 aa, Mycobacterium
CETQLTVLAPRREQLTG

SEQ ID NO: 1070273 - protein, 23 aa, Mycobacterium
CETSYVRLGLAQQLARHLGAPAV

SEQ ID NO: 1070274 - protein, 28 aa, Mycobacterium
CFGEGPRWFEGLLWFSDMLGEAVHTSDM

SEQ ID NO: 1070275 - protein, 19 aa, Mycobacterium
CFLVQHRSRLASEKNGLMI

SEQ ID NO: 1070276 - protein, 20 aa, Mycobacterium
CGAEPLFLQDYIAVGRTVPE

SEQ ID NO: 1070277 - protein, 30 aa, Mycobacterium; identical to SEQ ID NO: 798092

SEQ ID NO: 1070278 - protein, 24 aa, Mycobacterium
CGDCALNRGVFADAYGVVGAVSEV

SEQ ID NO: 1070279 - protein, 24 aa, Mycobacterium
CGDVGWFQLANKHVVLLSGAKANE

SEQ ID NO: 1070280 - protein, 21 aa, Mycobacterium
CGGMLKPDIVYFGESVPKEPV

SEQ ID NO: 1070281 - protein, 25 aa, Mycobacterium
CGGQATIPIVYAVSRAVADLGGVPY

SEQ ID NO: 1070282 - protein, 19 aa, Mycobacterium
CGGRAPRQRRDLFVGLLVD

SEQ ID NO: 1070283 - protein, 23 aa, Mycobacterium
CGGRPFVMPQMATRFDPAAAWAM

SEQ ID NO: 1070284 - protein, 29 aa, Mycobacterium
CGGSPAWNLPVVFGPIAVTYNISGVSSLN

SEQ ID NO: 1070285 - protein, 19 aa, Mycobacterium
CGGYQFAVIRHGQLAAAGN

SEQ ID NO: 1070286 - protein, 26 aa, Mycobacterium
CGKTYLAQTLAKMLNVPFAIADATAL

SEQ ID NO: 1070287 - protein, 23 aa, Mycobacterium
CGLIEVRFPDGWSVAPRRLPFDL

SEQ ID NO: 1070288 - protein, 20 aa, Mycobacterium
CGRDYRVLSVALLEVTFCGF

SEQ ID NO: 1070289 - protein, 27 aa, Mycobacterium
CGTTWTQRLISLLIFDGPQLPAPMHLV

SEQ ID NO: 1070290 - protein, 19 aa, Mycobacterium
CHAFFQFYVADGRLSCQLY

SEQ ID NO: 1070291 - protein, 18 aa, Mycobacterium
CHIGTDTVWLSRLGPRST

SEQ ID NO: 1070292 - protein, 18 aa, Mycobacterium
CIDILTQISAVSNALRSV

SEQ ID NO: 1070293 - protein, 18 aa, Mycobacterium
CIDVLTQISAVNSALRSV

SEQ ID NO: 1070294 - protein, 17 aa, Mycobacterium
CIFFSAGPVRASRALLG

SEQ ID NO: 1070295 - protein, 27 aa, Mycobacterium
CIYHDVFSYLVDAPWDEIAFRAAVDVV

SEQ ID NO: 1070296 - protein, 27 aa, Mycobacterium
CKIVDPSWFNWPALPVAMADTIVPDFP

SEQ ID NO: 1070297 - protein, 17 aa, Mycobacterium
CKRVLLGDDFYRALQHA

SEQ ID NO: 1070298 - protein, 25 aa, Mycobacterium
CLAVEPWVQYGFNLASWAVGWVPWI

SEQ ID NO: 1070299 - protein, 28 aa, Mycobacterium
CLCRKHHLLKTFWGWHDEQLPDATVIWS

SEQ ID NO: 1070300 - protein, 42 aa, Mycobacterium
CLCRKHHLLKTFWGWRDLQLPDGTVIWLLPDGHTYVTTPGSA

SEQ ID NO: 1070301 - protein, 21 aa, Mycobacterium
CLDLLFRGEIPDGVDPASLMK

SEQ ID NO: 1070302 - protein, 25 aa, Mycobacterium
CLEGDLAYWCVAAADRYAYTVQGHE

SEQ ID NO: 1070303 - protein, 23 aa, Mycobacterium
CLGAGLELPLGCTFRLAAEEGAS

SEQ ID NO: 1070304 - protein, 17 aa, Mycobacterium
CLHQNRITFAAVQRARS

SEQ ID NO: 1070305 - protein, 17 aa, Mycobacterium
CLLMFPRRDLTVSEVEA

SEQ ID NO: 1070306 - protein, 22 aa, Mycobacterium
CLRERIPNLHFSVSATTRAPRP

SEQ ID NO: 1070307 - protein, 23 aa, Mycobacterium
CMREETFGPTLPVMKVRDVAEAI

SEQ ID NO: 1070308 - protein, 26 aa, Mycobacterium
CNIPMCRLNWPWSAKSVLIPGPMDTV

SEQ ID NO: 1070309 - protein, 26 aa, Mycobacterium
CNPAPSTLLLALLSGFERRGRWNVPK

SEQ ID NO: 1070310 - protein, 27 aa, Mycobacterium
CNPRHHSLAFLPLPTPSGIVHLMVEVQ

SEQ ID NO: 1070311 - protein, 25 aa, Mycobacterium
CNRIMTQFAAFLRGVNVGGVNLKMA

SEQ ID NO: 1070312 - protein, 17 aa, Mycobacterium
CPDQFLGAHVRRSTGRE

SEQ ID NO: 1070313 - protein, 20 aa, Mycobacterium
CPHHLLPFTGTATIAYRPHP

SEQ ID NO: 1070314 - protein, 21 aa, Mycobacterium
CPLWNVYETFANPGKILVQIA

SEQ ID NO: 1070315 - protein, 18 aa, Mycobacterium
CPPDRFPGVISEPVVPPV

SEQ ID NO: 1070316 - protein, 22 aa, Mycobacterium
CPQVEFLHLSGSAELIGRRLAA

SEQ ID NO: 1070317 - protein, 21 aa, Mycobacterium
CQIPRRIAPRPGPSRSSRGCT

SEQ ID NO: 1070318 - protein, 25 aa, Mycobacterium
CQRYPGAARRVIRHLNARLLPTGYP

SEQ ID NO: 1070319 - protein, 29 aa, Mycobacterium
CQSLVFLHGLQLFGAMGFTWGNDLQFALK

SEQ ID NO: 1070320 - protein, 17 aa, Mycobacterium
CQYAMQFIAVLRGYALP

SEQ ID NO: 1070321 - protein, 24 aa, Mycobacterium
CRNRIEIVIAMLGIIKAGAILINV

SEQ ID NO: 1070322 - protein, 28 aa, Mycobacterium
CRQEDIYNPLRFLRAGLKWCRKAAELGT

SEQ ID NO: 1070323 - protein, 19 aa, Mycobacterium
CRRLDGIPLAIELAASRMA

SEQ ID NO: 1070324 - protein, 22 aa, Mycobacterium
CRTRDLPLIGAPATPGPAAGPG

SEQ ID NO: 1070325 - protein, 29 aa, Mycobacterium
CRYNDGIGHPFWFSRRLFGELTQLHGDKG

SEQ ID NO: 1070326 - protein, 19 aa, Mycobacterium
CSDPARLAGWWAEHFGGTA

SEQ ID NO: 1070327 - protein, 19 aa, Mycobacterium
CSELNLLALLASHGMLLAL

SEQ ID NO: 1070328 - protein, 25 aa, Mycobacterium
CSGAWARPMPAWYSTRSPTDTASPS

SEQ ID NO: 1070329 - protein, 32 aa, Mycobacterium; identical to SEQ ID NO: 798453

SEQ ID NO: 1070330 - protein, 24 aa, Mycobacterium
CSRAKARDLPSARPGWAPAAFITA

SEQ ID NO: 1070331 - protein, 22 aa, Mycobacterium
CSRATIYRYAGGKAKIRDVVIA

SEQ ID NO: 1070332 - protein, 18 aa, Mycobacterium
CSSSLQITRVAFHAIKAG

SEQ ID NO: 1070333 - protein, 19 aa, Mycobacterium
CSWSSRPAAIRSWTAVICS

SEQ ID NO: 1070334 - protein, 20 aa, Mycobacterium
CTALGCRAPLIVVTNSATRW

SEQ ID NO: 1070335 - protein, 17 aa, Mycobacterium
CTFVTVPGKLRAQGAGM

SEQ ID NO: 1070336 - protein, 19 aa, Mycobacterium
CTGFIFNRVWAAIKRESLA

SEQ ID NO: 1070337 - protein, 20 aa, Mycobacterium
CTGHAIAMGAFLLCSGDHRV

SEQ ID NO: 1070338 - protein, 28 aa, Mycobacterium
CTGTGMGIDRLLMCLTGLSIRETVLFPI

SEQ ID NO: 1070339 - protein, 20 aa, Mycobacterium
CTLIGRAYLYGLMAGGEAGV

SEQ ID NO: 1070340 - protein, 20 aa, Mycobacterium
CTPIQQQLWARLSVFAGSFD

SEQ ID NO: 1070341 - protein, 19 aa, Mycobacterium
CTREQIPAIPYGGGSSVVG

SEQ ID NO: 1070342 - protein, 22 aa, Mycobacterium
CTVLVDGRRINSCLALAVMHDG

SEQ ID NO: 1070343 - protein, 22 aa, Mycobacterium
CTYKWETFLAEELPAWLENNKG

SEQ ID NO: 1070344 - protein, 22 aa, Mycobacterium
CVDPLVPVVVLGRYVGARRQAI

SEQ ID NO: 1070345 - protein, 23 aa, Mycobacterium
CVGCRKRELAVELLRVVAESTGN

SEQ ID NO: 1070346 - protein, 18 aa, Mycobacterium
CVGYCNAYIHYLTTPEEY

SEQ ID NO: 1070347 - protein, 18 aa, Mycobacterium
CVLACACDRRLIGAEAAI

SEQ ID NO: 1070348 - protein, 28 aa, Mycobacterium
CVMAPRQWRGLRRWLGESPDFQDPKYDV

SEQ ID NO: 1070349 - protein, 21 aa, Mycobacterium
CVRELMELTLFGPTPAQADAA

SEQ ID NO: 1070350 - protein, 17 aa, Mycobacterium
CVRPWMQAIADVTGRPV

SEQ ID NO: 1070351 - protein, 24 aa, Mycobacterium
CVVDARAWLRDPAPLFHTNVEGLR

SEQ ID NO: 1070352 - protein, 19 aa, Mycobacterium
CVVVVPYLLTRNPAEFREL

SEQ ID NO: 1070353 - protein, 29 aa, Mycobacterium
CWERTADKLSPPWCTIWPVTANHGSKGLA

SEQ ID NO: 1070354 - protein, 29 aa, Mycobacterium
CWQTITRDLWPAPYLVMNVGANMAPYNHL

SEQ ID NO: 1070355 - protein, 18 aa, Mycobacterium
CWRCRNPLIYRAVSSWFV

SEQ ID NO: 1070356 - protein, 18 aa, Mycobacterium
CWVFPRGMRRDGGVGAGS

SEQ ID NO: 1070357 - protein, 20 aa, Mycobacterium
CYAALLWLRQQQWVDPSRIA

SEQ ID NO: 1070358 - protein, 18 aa, Mycobacterium
CYGIQRIHPLKNVMILAG

SEQ ID NO: 1070359 - protein, 19 aa, Mycobacterium
CYIPLLEELNYMPSKKFAD

SEQ ID NO: 1070360 - protein, 23 aa, Mycobacterium
CYPTAALLALLPAVAEGLIDPAV

SEQ ID NO: 1070361 - protein, 26 aa, Mycobacterium
CYVHPEIEFFLLNPGPEDGTEPVPID

SEQ ID NO: 1070362 - protein, 27 aa, Mycobacterium
DAAGIRALAGLWRSLTRKEVFPTQPVT

SEQ ID NO: 1070363 - protein, 20 aa, Mycobacterium
DAAHPDLILGSEALTPNLYA

SEQ ID NO: 1070364 - protein, 26 aa, Mycobacterium
DAALARDFLTIWFAQLHSQVAEIRKR

SEQ ID NO: 1070365 - protein, 20 aa, Mycobacterium
DAALDRFGPPAGDPAWVVKD

SEQ ID NO: 1070366 - protein, 17 aa, Mycobacterium
DAANLTAAVPTAGVLAA

SEQ ID NO: 1070367 - protein, 23 aa, Mycobacterium
DAARFLLEGMPVQVAFHDGAPLY

SEQ ID NO: 1070368 - protein, 30 aa, Mycobacterium
DAASIATWVGFLGFLVNRFEPLTWVEEAIE

SEQ ID NO: 1070369 - protein, 21 aa, Mycobacterium
DAASITLFPQANSWYVGANIP

SEQ ID NO: 1070370 - protein, 24 aa, Mycobacterium
DAASVTVNYRFAPDRSVPAALQHV

SEQ ID NO: 1070371 - protein, 20 aa, Mycobacterium
DADECRVFLSMLGIGPAKPE

SEQ ID NO: 1070372 - protein, 24 aa, Mycobacterium
DADGFWAAVLHRTAERRAGSMLAL

SEQ ID NO: 1070373 - protein, 23 aa, Mycobacterium
DADGRVIALLRDEGPRTKSVVVL

SEQ ID NO: 1070374 - protein, 23 aa, Mycobacterium
DADGRVIALLRDEGRRTKSVVVI

SEQ ID NO: 1070375 - protein, 32 aa, Mycobacterium
DADPDLIIGRYIPNLVPRLFNLDRDFIQEIRD

SEQ ID NO: 1070376 - protein, 23 aa, Mycobacterium
DADPLGPYGFSGWVGPEPHGAGN

SEQ ID NO: 1070377 - protein, 26 aa, Mycobacterium
DADSEAKWFWFEGNFGAYEENKVERL

SEQ ID NO: 1070378 - protein, 24 aa, Mycobacterium
DADSHLLGVVAFRALVLADPERLV

SEQ ID NO: 1070379 - protein, 25 aa, Mycobacterium
DADVPIVPVIVWGAQRIWTKGQPRH

SEQ ID NO: 1070380 - protein, 29 aa, Mycobacterium
DADYGAVLPLPMVSWLYEYGNYRRFTHTV

SEQ ID NO: 1070381 - protein, 20 aa, Mycobacterium
DAEFPKFRQLLPAEHTAVAS

SEQ ID NO: 1070382 - protein, 23 aa, Mycobacterium
DAELANRIVKLNTLAHLRSQAAL

SEQ ID NO: 1070383 - protein, 29 aa, Mycobacterium
DAEPALASLLVAPYFRSAIESAVDSWRRV

SEQ ID NO: 1070384 - protein, 19 aa, Mycobacterium
DAEWLAAHLTGTDRGLLYL

SEQ ID NO: 1070385 - protein, 24 aa, Mycobacterium
DAEYPLLGPWGSARVFSPQKGADA

SEQ ID NO: 1070386 - protein, 21 aa, Mycobacterium
DAFEHFPPPILKPVILAAKSK

SEQ ID NO: 1070387 - protein, 25 aa, Mycobacterium
DAFGIPLVVVVDVPGYLPGVDQEWG

SEQ ID NO: 1070388 - protein, 17 aa, Mycobacterium
DAFLRDVYSEQAILADG

SEQ ID NO: 1070389 - protein, 20 aa, Mycobacterium
DAFMAVCRKWDVLATVIGEV

SEQ ID NO: 1070390 - protein, 21 aa, Mycobacterium
DAFTFNVATAHALTVAAVPLM

SEQ ID NO: 1070391 - protein, 33 aa, Mycobacterium; identical to SEQ ID NO: 798902

SEQ ID NO: 1070392 - protein, 38 aa, Mycobacterium; identical to SEQ ID NO: 798909

SEQ ID NO: 1070393 - protein, 27 aa, Mycobacterium
DAGELGVIFLTGLFALLATGATTPDAR

SEQ ID NO: 1070394 - protein, 22 aa, Mycobacterium
DAGIAISIMGTGLAAAALAANG

SEQ ID NO: 1070395 - protein, 24 aa, Mycobacterium
DAGLAWVHFPVGFGGLDLPHTYQA

SEQ ID NO: 1070396 - protein, 17 aa, Mycobacterium
DAGLLLGTGGNGGSGGA

SEQ ID NO: 1070397 - protein, 19 aa, Mycobacterium
DAGLNPKILPGGTGLTCDF

SEQ ID NO: 1070398 - protein, 17 aa, Mycobacterium
DAGPLLARLHKLVRADC

SEQ ID NO: 1070399 - protein, 25 aa, Mycobacterium
DAGRQWVTSQWRWDTLAARLAELLR

SEQ ID NO: 1070400 - protein, 43 aa, Mycobacterium; identical to SEQ ID NO: 798967

SEQ ID NO: 1070401 - protein, 25 aa, Mycobacterium
DAHAPGQLDFLGYGAQRALDAGVAA

SEQ ID NO: 1070402 - protein, 24 aa, Mycobacterium
DAIDGRPRGHLRKFGLSRVRVREL

SEQ ID NO: 1070403 - protein, 18 aa, Mycobacterium
DAILANGLYVLPHEGART

SEQ ID NO: 1070404 - protein, 30 aa, Mycobacterium; identical to SEQ ID NO: 799011

SEQ ID NO: 1070405 - protein, 20 aa, Mycobacterium
DAILLRMPGFGLDGPWRDNP

SEQ ID NO: 1070406 - protein, 19 aa, Mycobacterium
DAIMLLAAHISRHGTLTEW

SEQ ID NO: 1070407 - protein, 19 aa, Mycobacterium
DAIMVVLALAMQEAGELAS

SEQ ID NO: 1070408 - protein, 27 aa, Mycobacterium
DAKPAQVALAWLISLPGVVAIPGASSV

SEQ ID NO: 1070409 - protein, 18 aa, Mycobacterium
DALELARRMATEEGLLFG

SEQ ID NO: 1070410 - protein, 18 aa, Mycobacterium
DALFTGLIAIHGLRSTDA

SEQ ID NO: 1070411 - protein, 19 aa, Mycobacterium
DALGIGYEIVPGVPAFAAA

SEQ ID NO: 1070412 - protein, 18 aa, Mycobacterium
DALLLPTTTEHPSLAAVA

SEQ ID NO: 1070413 - protein, 27 aa, Mycobacterium
DALLPNFLRVWGPRGAFLPLLRAAATN

SEQ ID NO: 1070414 - protein, 24 aa, Mycobacterium
DALMIFHTFMAAYSPAIHIEITPL

SEQ ID NO: 1070415 - protein, 19 aa, Mycobacterium
DALPYDLAGRKVLVTAGGT

SEQ ID NO: 1070416 - protein, 22 aa, Mycobacterium
DALRMLTLPATFSLYVERAWPR

SEQ ID NO: 1070417 - protein, 25 aa, Mycobacterium
DALRRLHSIRNCYSDILQKGQTNLA

SEQ ID NO: 1070418 - protein, 17 aa, Mycobacterium
DAMFGYPGPTVAAINGA

SEQ ID NO: 1070419 - protein, 23 aa, Mycobacterium
DAMHGLLLVKKWSSITMADVASA

SEQ ID NO: 1070420 - protein, 30 aa, Mycobacterium
DAMLVTDLINVRYLSGFSGSNGALLVFADE

SEQ ID NO: 1070421 - protein, 18 aa, Mycobacterium
DAMSYRVLVSDLAQLYRG

SEQ ID NO: 1070422 - protein, 30 aa, Mycobacterium
DANFDRSYRLAWWPTRLPTLIVSGAADRIV

SEQ ID NO: 1070423 - protein, 24 aa, Mycobacterium
DANLWPAFDPIWRDDPIAPGMKIN

SEQ ID NO: 1070424 - protein, 26 aa, Mycobacterium
DAPARGLQIPLFAIAANPSTVYVAGP

SEQ ID NO: 1070425 - protein, 23 aa, Mycobacterium
DAPIPGRLFAGPGLAQPSGVSPA

SEQ ID NO: 1070426 - protein, 27 aa, Mycobacterium
DAPQLLTFPDVFPNGLANKYTFGPIGE

SEQ ID NO: 1070427 - protein, 26 aa, Mycobacterium
DAPTNAFVMSFLGAVSALNGALVRPH

SEQ ID NO: 1070428 - protein, 25 aa, Mycobacterium
DAPYLGFQLGSMWYISLDYINHQTS

SEQ ID NO: 1070429 - protein, 26 aa, Mycobacterium
DAQGQAYQLLSARAAAFHEQFLQALS

SEQ ID NO: 1070430 - protein, 17 aa, Mycobacterium
DAQIAELIYGAAAFGFW

SEQ ID NO: 1070431 - protein, 24 aa, Mycobacterium
DAQMLILGSFPNGRRARVLIGSTA

SEQ ID NO: 1070432 - protein, 24 aa, Mycobacterium
DARALLSGYYRLEDPRRFDPQSCE

SEQ ID NO: 1070433 - protein, 26 aa, Mycobacterium
DARGYGYGPAFRGLTAMWARGEELFA

SEQ ID NO: 1070434 - protein, 22 aa, Mycobacterium
DARIGRLLFSTHLANPVVVRKR

SEQ ID NO: 1070435 - protein, 29 aa, Mycobacterium
DARKPKRLTLFLLPMDRPGFTVRPIPSML

SEQ ID NO: 1070436 - protein, 26 aa, Mycobacterium
DARLAIKAPRWPSMTSWKLATEVDRV

SEQ ID NO: 1070437 - protein, 21 aa, Mycobacterium
DASLRSWLAFGAEKVAEVAVL

SEQ ID NO: 1070438 - protein, 17 aa, Mycobacterium
DASMANFWMATPQQLYR

SEQ ID NO: 1070439 - protein, 25 aa, Mycobacterium
DATGSFNRAWAFDQYSDAEVNQAIA

SEQ ID NO: 1070440 - protein, 27 aa, Mycobacterium
DATKGSPLAWLLTMAHRRAVDRVRAEQ

SEQ ID NO: 1070441 - protein, 21 aa, Mycobacterium
DATLVQIIRWLRPGAVIAIAK

SEQ ID NO: 1070442 - protein, 25 aa, Mycobacterium
DATQGTRLVPIPGAPPSPAGLDRGC

SEQ ID NO: 1070443 - protein, 18 aa, Mycobacterium
DATYFDTMLVYNGMADGM

SEQ ID NO: 1070444 - protein, 19 aa, Mycobacterium
DAVAGMPIGLGPDLVHVVP

SEQ ID NO: 1070445 - protein, 27 aa, Mycobacterium
DAVAHMCAIIVILMRGPALHTTSPLCN

SEQ ID NO: 1070446 - protein, 18 aa, Mycobacterium
DAVDMWLEEGRRLVHYPP

SEQ ID NO: 1070447 - protein, 22 aa, Mycobacterium
DAVELPAWYQQNPGLARDLAFI

SEQ ID NO: 1070448 - protein, 24 aa, Mycobacterium
DAVGGTWFWNTYPGIAVDIPSFSY

SEQ ID NO: 1070449 - protein, 17 aa, Mycobacterium
DAVGLIGSGGAGGIGGA

SEQ ID NO: 1070450 - protein, 26 aa, Mycobacterium
DAVGRPETWKQAFYARDLAGTVVLVG

SEQ ID NO: 1070451 - protein, 22 aa, Mycobacterium
DAVIVEFWLMGTHRGYLGKIPP

SEQ ID NO: 1070452 - protein, 23 aa, Mycobacterium
DAVLWAIGKVRPNTGWLPEQLLD

SEQ ID NO: 1070453 - protein, 17 aa, Mycobacterium
DAVRAAVSIPLLRKDFV

SEQ ID NO: 1070454 - protein, 24 aa, Mycobacterium
DAVREFVVELLQWAAAKLERYERA

SEQ ID NO: 1070455 - protein, 23 aa, Mycobacterium
DAVRPTFLVLQSGMCIGLARTAL

SEQ ID NO: 1070456 - protein, 21 aa, Mycobacterium
DAVSFTLLQDQLQSVLDTLSE

SEQ ID NO: 1070457 - protein, 34 aa, Mycobacterium
DAVTKYPWPRGRARRKFGFYDQDLQPALWVRQGA

SEQ ID NO: 1070458 - protein, 28 aa, Mycobacterium
DAVTTFNKVFAPYGLPRAAFKPSYGIAE

SEQ ID NO: 1070459 - protein, 17 aa, Mycobacterium
DAVYYPLYVKCAELELA

SEQ ID NO: 1070460 - protein, 20 aa, Mycobacterium
DAWLLALRSELELAAARLNA

SEQ ID NO: 1070461 - protein, 21 aa, Mycobacterium
DAYNHYAVGWAHALCAPYQWT

SEQ ID NO: 1070462 - protein, 17 aa, Mycobacterium
DCFDLPLDEVKFSYELG

SEQ ID NO: 1070463 - protein, 26 aa, Mycobacterium
DCFNIPIVMLVDVPGFLPGTGQEYNG

SEQ ID NO: 1070464 - protein, 26 aa, Mycobacterium
DCHDGYRWLRLLGYDPEQIVLAGDSA

SEQ ID NO: 1070465 - protein, 26 aa, Mycobacterium
DCPHFDHALAAYYLILPSEVSSNLAR

SEQ ID NO: 1070466 - protein, 25 aa, Mycobacterium
DCPMAPLAPLTLAWVAARRIATSTA

SEQ ID NO: 1070467 - protein, 24 aa, Mycobacterium
DCTGYIVQLPLPKHLDENAALERI

SEQ ID NO: 1070468 - protein, 24 aa, Mycobacterium
DDAELIPHTFVVDCAAIGCTCGES

SEQ ID NO: 1070469 - protein, 22 aa, Mycobacterium
DDAEVRFRLLATPREYGASCLT

SEQ ID NO: 1070470 - protein, 24 aa, Mycobacterium
DDAIYPALALLPANDIRIIDVWHT

SEQ ID NO: 1070471 - protein, 26 aa, Mycobacterium
DDAMALRHRTILSALGLPVSYDADAL

SEQ ID NO: 1070472 - protein, 23 aa, Mycobacterium
DDAPRYYYLLDLDENWPGHALRQ

SEQ ID NO: 1070473 - protein, 18 aa, Mycobacterium
DDATIACDVGSHYIYMAR

SEQ ID NO: 1070474 - protein, 26 aa, Mycobacterium
DDATSWLVRRPPLHGLTPSAHDMARE

SEQ ID NO: 1070475 - protein, 23 aa, Mycobacterium
DDAVREYLYPIAASRVRGVALPG

SEQ ID NO: 1070476 - protein, 26 aa, Mycobacterium
DDDDFGKYPFLVKGYIGPKALRSNDV

SEQ ID NO: 1070477 - protein, 24 aa, Mycobacterium
DDDLALIDAYWRAANYLSVGQIYL

SEQ ID NO: 1070478 - protein, 24 aa, Mycobacterium
DDDPLPPIIKLFDDAGYIGVVATN

SEQ ID NO: 1070479 - protein, 17 aa, Mycobacterium
DDDSLAAFGANPLDPCC

SEQ ID NO: 1070480 - protein, 18 aa, Mycobacterium
DDEFGFFVVMLAVAGNET

SEQ ID NO: 1070481 - protein, 26 aa, Mycobacterium
DDEHIARIAALGRIALVLISHRHGDH

SEQ ID NO: 1070482 - protein, 17 aa, Mycobacterium
DDELDVWLISWVPGHAT

SEQ ID NO: 1070483 - protein, 18 aa, Mycobacterium
DDEPLLMGFELPDAATTA

SEQ ID NO: 1070484 - protein, 24 aa, Mycobacterium
DDERGRRFLVAAAKIAYVEIGVAD

SEQ ID NO: 1070485 - protein, 25 aa, Mycobacterium
DDEVNIAPWLRAAHRHGAKVKWAEV

SEQ ID NO: 1070486 - protein, 25 aa, Mycobacterium
DDFAAAWRHGASPLLRALIDAGTVE

SEQ ID NO: 1070487 - protein, 18 aa, Mycobacterium
DDFSAWYNEVVAKAGLID

SEQ ID NO: 1070488 - protein, 24 aa, Mycobacterium
DDGFVNVVYRWARTGDLSAALAAA

SEQ ID NO: 1070489 - protein, 18 aa, Mycobacterium
DDGIPHLPMLRPAHGPAA

SEQ ID NO: 1070490 - protein, 27 aa, Mycobacterium
DDGLAVREILLLRLRALLARAHGDDTT

SEQ ID NO: 1070491 - protein, 20 aa, Mycobacterium
DDGPIRLLAQEPTKLFRATV

SEQ ID NO: 1070492 - protein, 24 aa, Mycobacterium
DDGPMKPVRLWSRIRRRPIFAAGN

SEQ ID NO: 1070493 - protein, 25 aa, Mycobacterium
DDGRPGWRPLPELLATSDIVSLHLP

SEQ ID NO: 1070494 - protein, 18 aa, Mycobacterium
DDGSIIDGLYAAGNVSAP

SEQ ID NO: 1070495 - protein, 28 aa, Mycobacterium
DDHAGKWRVVFFWPKDFTFVCPTEIAAF

SEQ ID NO: 1070496 - protein, 25 aa, Mycobacterium
DDHGNYLRWHLLDHMPEQYQLPGIV

SEQ ID NO: 1070497 - protein, 23 aa, Mycobacterium
DDHYLAWVLHHIVADGWSAAGLL

SEQ ID NO: 1070498 - protein, 25 aa, Mycobacterium
DDIAGALAWLVSDEARYITGVALPV

SEQ ID NO: 1070499 - protein, 31 aa, Mycobacterium; identical to SEQ ID NO: 799741

SEQ ID NO: 1070500 - protein, 17 aa, Mycobacterium
DDIIVFHQLTRDEIIRM

SEQ ID NO: 1070501 - protein, 25 aa, Mycobacterium
DDLHRHLFTVLMDREWKYGVAAAVD

SEQ ID NO: 1070502 - protein, 23 aa, Mycobacterium
DDLKPLLEFIVAGRLATTVKAGL

SEQ ID NO: 1070503 - protein, 25 aa, Mycobacterium
DDLLTATLLTARCPVMFAPAMHTEM

SEQ ID NO: 1070504 - protein, 30 aa, Mycobacterium; identical to SEQ ID NO: 352120

SEQ ID NO: 1070505 - protein, 25 aa, Mycobacterium
DDMAPICQLFHTLPIPWVEAEDISN

SEQ ID NO: 1070506 - protein, 18 aa, Mycobacterium
DDMLGLPYQRPAAYTRDY

SEQ ID NO: 1070507 - protein, 18 aa, Mycobacterium
DDMLLHVDGWLCEIKDVQ

SEQ ID NO: 1070508 - protein, 25 aa, Mycobacterium
DDNCLAILDIRPFTRGHTLVLPKKH

SEQ ID NO: 1070509 - protein, 26 aa, Mycobacterium
DDNNPVWFLAHLLESIRRVHPGVAES

SEQ ID NO: 1070510 - protein, 24 aa, Mycobacterium
DDNNRGWIINWRSTGDPVGFCTRI

SEQ ID NO: 1070511 - protein, 29 aa, Mycobacterium
DDPEHRIYRTVLNPYLSPAAVKRWEPFID

SEQ ID NO: 1070512 - protein, 26 aa, Mycobacterium
DDPEQVVLALYRYLGRTPSRLLGVAL

SEQ ID NO: 1070513 - protein, 27 aa, Mycobacterium
DDPHKVAMLGLTFDDVLLLPAASDVVP

SEQ ID NO: 1070514 - protein, 19 aa, Mycobacterium
DDPLLIHIVVHALNEWLHE

SEQ ID NO: 1070515 - protein, 17 aa, Mycobacterium
DDPLRLVPILGAGLAQR

SEQ ID NO: 1070516 - protein, 25 aa, Mycobacterium
DDPLRLVPILGAGLAQRPPARFDEF

SEQ ID NO: 1070517 - protein, 21 aa, Mycobacterium
DDPVLHICALAYMSDLTLLGS

SEQ ID NO: 1070518 - protein, 23 aa, Mycobacterium
DDPYLQVVLQRRLPVVVVDQPKE

SEQ ID NO: 1070519 - protein, 29 aa, Mycobacterium
DDQRLRRLLMFVARQEPRLNWAIGRQSEG

SEQ ID NO: 1070520 - protein, 27 aa, Mycobacterium
DDRAYKPLNWMSPPCWLTEEPGGDSPV

SEQ ID NO: 1070521 - protein, 17 aa, Mycobacterium
DDREDLPRIIRAGRHLA

SEQ ID NO: 1070522 - protein, 23 aa, Mycobacterium
DDRGHVLLTLHPRLGRWVQLGGH

SEQ ID NO: 1070523 - protein, 29 aa, Mycobacterium
DDRHLCINPFFHNFGYKAGILACLQTGAT

SEQ ID NO: 1070524 - protein, 23 aa, Mycobacterium
DDRLAYLDQAAFLGLRAGYGSLI

SEQ ID NO: 1070525 - protein, 22 aa, Mycobacterium
DDSLALLIYTSGSTGAPKGAMY

SEQ ID NO: 1070526 - protein, 23 aa, Mycobacterium
DDSLRAILIRGAAADFCAGADWV

SEQ ID NO: 1070527 - protein, 28 aa, Mycobacterium
DDTNLRRLIGLFEMLRDRSQLIIITHQK

SEQ ID NO: 1070528 - protein, 25 aa, Mycobacterium
DDTSKATLMAAWTSLYNASKQEASS

SEQ ID NO: 1070529 - protein, 20 aa, Mycobacterium
DDVFVALSWTKHPAPQTYQE

SEQ ID NO: 1070530 - protein, 18 aa, Mycobacterium
DDVLPMNFAPPIGPELVS

SEQ ID NO: 1070531 - protein, 25 aa, Mycobacterium
DDVSQLVYLHLRFHGYGDGKWTDSA

SEQ ID NO: 1070532 - protein, 17 aa, Mycobacterium
DDWAVHVALWQRRANGR

SEQ ID NO: 1070533 - protein, 19 aa, Mycobacterium
DDYLVKPFVLAELVARVKA

SEQ ID NO: 1070534 - protein, 20 aa, Mycobacterium
DEAFKLVKINPLVAWTDQDV

SEQ ID NO: 1070535 - protein, 21 aa, Mycobacterium
DEALLDIYRKLRPGEPPTKES

SEQ ID NO: 1070536 - protein, 22 aa, Mycobacterium
DEALLDIYRKLRPGEPPTKESA

SEQ ID NO: 1070537 - protein, 20 aa, Mycobacterium
DEALPFTAIAADASLVRADG

SEQ ID NO: 1070538 - protein, 23 aa, Mycobacterium
DEAMLVATVRAFIDRDVRPSVRE

SEQ ID NO: 1070539 - protein, 28 aa, Mycobacterium
DEAQRPRPWYPIPLLLGGSGPRMMRLVA

SEQ ID NO: 1070540 - protein, 33 aa, Mycobacterium
DEARKAGRRFARLARIVATYRKLVAAREDLETA

SEQ ID NO: 1070541 - protein, 31 aa, Mycobacterium; identical to SEQ ID NO: 800061

SEQ ID NO: 1070542 - protein, 23 aa, Mycobacterium
DEDSRLPFLLRIPRPDGQGSGVV

SEQ ID NO: 1070543 - protein, 23 aa, Mycobacterium
DEELRKLRYILNFARLADFEPGA

SEQ ID NO: 1070544 - protein, 24 aa, Mycobacterium
DEFDLSKLRYHKIVLMADADVDGQ

SEQ ID NO: 1070545 - protein, 23 aa, Mycobacterium
DEFEALLLEFLGEAAVTVPELGT

SEQ ID NO: 1070546 - protein, 42 aa, Mycobacterium
DEFGQQPLFAQSPLLLGERAAPWWVILYRTGQTLAPQPSRGE

SEQ ID NO: 1070547 - protein, 20 aa, Mycobacterium
DEGATVPFIARYRKEATGSL

SEQ ID NO: 1070548 - protein, 24 aa, Mycobacterium
DEGGRLKFLVRLASWPSGEARVLG

SEQ ID NO: 1070549 - protein, 24 aa, Mycobacterium
DEGRLFTRFLKMLPTNKAMIDELL

SEQ ID NO: 1070550 - protein, 20 aa, Mycobacterium
DEGWLVRRQGLGTFVAEPVE

SEQ ID NO: 1070551 - protein, 24 aa, Mycobacterium
DEHGVTAVFFIVTPNRDQLNRLGE

SEQ ID NO: 1070552 - protein, 24 aa, Mycobacterium
DEHLRLPLREVIWGADASLLEGTE

SEQ ID NO: 1070553 - protein, 25 aa, Mycobacterium
DEHQQRYLKPLLEGKIRSAFAITEP

SEQ ID NO: 1070554 - protein, 31 aa, Mycobacterium
DEHTCLYHYAWVRDRLLMVSLADVASQVEIV

SEQ ID NO: 1070555 - protein, 27 aa, Mycobacterium
DEIDNLIPAWLATPSPVLVGATSEALP

SEQ ID NO: 1070556 - protein, 25 aa, Mycobacterium
DEIEALWPMVIARATVLLVSDLQQI

SEQ ID NO: 1070557 - protein, 18 aa, Mycobacterium
DEIFTPDSSRYWPADEYR

SEQ ID NO: 1070558 - protein, 24 aa, Mycobacterium
DEIIRQYAPLLHLALRSTTANARR

SEQ ID NO: 1070559 - protein, 34 aa, Mycobacterium
DELAERPALSLTLDQACLLMFPRRDLTVDESQSV

SEQ ID NO: 1070560 - protein, 24 aa, Mycobacterium
DELAGFTAIRRWAKQFYPDGISGS

SEQ ID NO: 1070561 - protein, 32 aa, Mycobacterium
DELAGQFTALAWSLMKLTTLHRTIKPELLDHP

SEQ ID NO: 1070562 - protein, 19 aa, Mycobacterium
DELAKRLIVLVEPVEAIVD

SEQ ID NO: 1070563 - protein, 19 aa, Mycobacterium
DELGWRGLIAQSTDLDALA

SEQ ID NO: 1070564 - protein, 17 aa, Mycobacterium
DELIEVVRLLEQGGLDL

SEQ ID NO: 1070565 - protein, 21 aa, Mycobacterium
DELLLALFDRTMSQTAQLWRA

SEQ ID NO: 1070566 - protein, 18 aa, Mycobacterium
DELPVLTERIHELDRRLK

SEQ ID NO: 1070567 - protein, 21 aa, Mycobacterium
DELRERFAPMRILTGIEVDIL

SEQ ID NO: 1070568 - protein, 18 aa, Mycobacterium
DELRMMFTCAHPALDRQS

SEQ ID NO: 1070569 - protein, 30 aa, Mycobacterium; identical to SEQ ID NO: 800275

SEQ ID NO: 1070570 - protein, 19 aa, Mycobacterium
DEMRMFGGLAFLIGGHMAV

SEQ ID NO: 1070571 - protein, 23 aa, Mycobacterium
DENLVIAQELLKAAVAAKIILEI

SEQ ID NO: 1070572 - protein, 25 aa, Mycobacterium
DEPGAAALWFALETSLPVIVDADGL

SEQ ID NO: 1070573 - protein, 35 aa, Mycobacterium; identical to SEQ ID NO: 800321

SEQ ID NO: 1070574 - protein, 32 aa, Mycobacterium
DEPHRPLSRRRLFGIAMPVTGAIALSACTGSP

SEQ ID NO: 1070575 - protein, 33 aa, Mycobacterium
DEPPDGPQPLRDIWLLRMRTALAGARGGGGDYQ

SEQ ID NO: 1070576 - protein, 30 aa, Mycobacterium
DEPRKGMSVLLEALPKLVERFIDVQLLIVG

SEQ ID NO: 1070577 - protein, 25 aa, Mycobacterium
DEQKKFFLPKIAAGDLHFSIGYSEP

SEQ ID NO: 1070578 - protein, 23 aa, Mycobacterium
DEQKLRWAVPILRAQITASLGMS

SEQ ID NO: 1070579 - protein, 17 aa, Mycobacterium
DEQLHPLRPPSLLAVEP

SEQ ID NO: 1070580 - protein, 24 aa, Mycobacterium
DEQRQQWLDPLLHGEIRSAFSMTE

SEQ ID NO: 1070581 - protein, 25 aa, Mycobacterium
DERARLMFMLGTLTPDRVTRDAGAY

SEQ ID NO: 1070582 - protein, 26 aa, Mycobacterium
DERARLPIDPEWGPGWHLGVVGLDDG

SEQ ID NO: 1070583 - protein, 25 aa, Mycobacterium
DERDFPATSVRFFASARSQGRKLPF

SEQ ID NO: 1070584 - protein, 17 aa, Mycobacterium
DERPQVHLAARPGVLTA

SEQ ID NO: 1070585 - protein, 25 aa, Mycobacterium
DERTAGFLAIGLAVGAGAPACVAMT

SEQ ID NO: 1070586 - protein, 24 aa, Mycobacterium
DERTPFAAVTWFRPDHTIDVSAPC

SEQ ID NO: 1070587 - protein, 29 aa, Mycobacterium
DESKRLMRDYPYLAGFLRAVRAENADQTG

SEQ ID NO: 1070588 - protein, 27 aa, Mycobacterium
DESVNAFYHLGWLCVWAVLEAVAEPGS

SEQ ID NO: 1070589 - protein, 25 aa, Mycobacterium
DETGMVNVLCTPGVWMRHRKLANTA

SEQ ID NO: 1070590 - protein, 23 aa, Mycobacterium
DETGWLLGDYILSKQPSGDWIVA

SEQ ID NO: 1070591 - protein, 24 aa, Mycobacterium
DEVGFTQLLYDDHIGKLSLIGAGM

SEQ ID NO: 1070592 - protein, 26 aa, Mycobacterium
DEVIFGWRSFELYPPQVQVAGATAIQ

SEQ ID NO: 1070593 - protein, 22 aa, Mycobacterium
DEVLLRLFGKAVELAFLAVPDE

SEQ ID NO: 1070594 - protein, 25 aa, Mycobacterium
DEVMGLYFVPLTRDGRYVNSMVSDA

SEQ ID NO: 1070595 - protein, 26 aa, Mycobacterium
DEVNLLHDHLVDILLDAAAMGRVHVE

SEQ ID NO: 1070596 - protein, 23 aa, Mycobacterium
DEVPLNFLNPRPGTPFGDLEVLP

SEQ ID NO: 1070597 - protein, 27 aa, Mycobacterium
DEVRRYIIDVALRWMREFHADGLRLDA

SEQ ID NO: 1070598 - protein, 27 aa, Mycobacterium
DEVSAAISFLFGAHAQAYQALSAQAAS

SEQ ID NO: 1070599 - protein, 24 aa, Mycobacterium
DEVSALQAALFTAYGTYYQQVSAD

SEQ ID NO: 1070600 - protein, 22 aa, Mycobacterium
DEVSLAIPRVFGAYGRDYQAFG

SEQ ID NO: 1070601 - protein, 21 aa, Mycobacterium
DEYEWAPLRLPPEVTRLSAST

SEQ ID NO: 1070602 - protein, 18 aa, Mycobacterium
DFDAVIATPDQMAKVGRI

SEQ ID NO: 1070603 - protein, 20 aa, Mycobacterium
DFDKPVPRDVLMECLQLALQ

SEQ ID NO: 1070604 - protein, 18 aa, Mycobacterium
DFDLAISAYLLVYARDRD

SEQ ID NO: 1070605 - protein, 22 aa, Mycobacterium
DFEKTLRFWLERGVDGFRIDVA

SEQ ID NO: 1070606 - protein, 20 aa, Mycobacterium
DFFALFQDPTRIYSCAYFEP

SEQ ID NO: 1070607 - protein, 24 aa, Mycobacterium
DFFEGVMMPELFMADAMGASGKPL

SEQ ID NO: 1070608 - protein, 18 aa, Mycobacterium
DFHKQPEFLAPQDKGPWG

SEQ ID NO: 1070609 - protein, 18 aa, Mycobacterium
DFHVRRIGVPAPGGRREL

SEQ ID NO: 1070610 - protein, 26 aa, Mycobacterium
DFIEGYNLNMAIPWIAAERGYIDAVV

SEQ ID NO: 1070611 - protein, 28 aa, Mycobacterium
DFIETTGIPFLPMSMAKGLLPDSHPCSA

SEQ ID NO: 1070612 - protein, 44 aa, Mycobacterium
DFIMDIGAYPTPYPVLTTAAIGMFFPGPYRIPKASFSYKTVFSN

SEQ ID NO: 1070613 - protein, 19 aa, Mycobacterium
DFMTTGWFTGFVPITVPTV

SEQ ID NO: 1070614 - protein, 17 aa, Mycobacterium
DFNFAWPTARIAVIGAD

SEQ ID NO: 1070615 - protein, 18 aa, Mycobacterium
DFPILQRVMRSGNQLAYL

SEQ ID NO: 1070616 - protein, 19 aa, Mycobacterium
DFPLTLYQIQIKYRDEARP

SEQ ID NO: 1070617 - protein, 23 aa, Mycobacterium
DFPRYPINFLADLNAFLGIQSLH

SEQ ID NO: 1070618 - protein, 17 aa, Mycobacterium
DFRVFFICEDVTQYLTE

SEQ ID NO: 1070619 - protein, 20 aa, Mycobacterium
DFSRPLARVVLAAAPALSLG

SEQ ID NO: 1070620 - protein, 19 aa, Mycobacterium
DFTGRLCPAPCEPACVLGI

SEQ ID NO: 1070621 - protein, 20 aa, Mycobacterium
DFVASSYVRLGGLMDDPAAT

SEQ ID NO: 1070622 - protein, 22 aa, Mycobacterium
DFVRDLAAPLPMAVIGDMLGVL

SEQ ID NO: 1070623 - protein, 21 aa, Mycobacterium
DGAAQLLMKRFPDPTTPEAQK

SEQ ID NO: 1070624 - protein, 17 aa, Mycobacterium
DGALLWGNGGAGGQGGT

SEQ ID NO: 1070625 - protein, 19 aa, Mycobacterium
DGALPLLAPMSEVAGRLSA

SEQ ID NO: 1070626 - protein, 29 aa, Mycobacterium
DGAMGGAVTVPVNFLAHAGSDGGIGTGGN

SEQ ID NO: 1070627 - protein, 25 aa, Mycobacterium
DGAPAWLRFFGCNPRHHSLAFLPLP

SEQ ID NO: 1070628 - protein, 17 aa, Mycobacterium
DGASLAVGGFGLCGIPE

SEQ ID NO: 1070629 - protein, 25 aa, Mycobacterium
DGASMWFRSYFGVPSSITAPDGRPI

SEQ ID NO: 1070630 - protein, 20 aa, Mycobacterium
DGATYVLERGIRTDFALVHA

SEQ ID NO: 1070631 - protein, 24 aa, Mycobacterium
DGCPKSFWRIDVAPLSRIALHYRD

SEQ ID NO: 1070632 - protein, 24 aa, Mycobacterium
DGDFPVAIPLPIVPAGPIRARVNQ

SEQ ID NO: 1070633 - protein, 21 aa, Mycobacterium
DGDLYFSCTIPNLIVGTVGNG

SEQ ID NO: 1070634 - protein, 28 aa, Mycobacterium
DGDPLDALVLLPEPLFPGVLVEARPVGM

SEQ ID NO: 1070635 - protein, 21 aa, Mycobacterium
DGDPPTGQTGGGGTGGGGGAP

SEQ ID NO: 1070636 - protein, 19 aa, Mycobacterium
DGDRLRPLRPGHLAYVIYT

SEQ ID NO: 1070637 - protein, 23 aa, Mycobacterium
DGDRYLPIWIGQSEAAAIALEQQ

SEQ ID NO: 1070638 - protein, 26 aa, Mycobacterium
DGEATYRFPLVIAPRYTTGHPVGGDQ

SEQ ID NO: 1070639 - protein, 17 aa, Mycobacterium
DGEDVTIYPTHFSDWLA

SEQ ID NO: 1070640 - protein, 20 aa, Mycobacterium
DGEILLRGPGLMTSYHDLPE

SEQ ID NO: 1070641 - protein, 22 aa, Mycobacterium
DGELWRVDFAWPDLRLAAEYDS

SEQ ID NO: 1070642 - protein, 19 aa, Mycobacterium
DGEPGWFHYHQMFAEFLRR

SEQ ID NO: 1070643 - protein, 25 aa, Mycobacterium
DGERFRARFFGRNVNVPLMIIGIGT

SEQ ID NO: 1070644 - protein, 27 aa, Mycobacterium
DGETRDLFLTLLSVSGVGPRLAMATLS

SEQ ID NO: 1070645 - protein, 17 aa, Mycobacterium
DGFADFPRYPINLLADI

SEQ ID NO: 1070646 - protein, 17 aa, Mycobacterium
DGFELAAHRVIGLLREV

SEQ ID NO: 1070647 - protein, 17 aa, Mycobacterium
DGFSPITGGNGGGGGNG

SEQ ID NO: 1070648 - protein, 23 aa, Mycobacterium
DGGDPSGQFGGTGGAGGSGGAGA

SEQ ID NO: 1070649 - protein, 22 aa, Mycobacterium
DGGGPGSGSRRGMSGSHGSYGQ

SEQ ID NO: 1070650 - protein, 17 aa, Mycobacterium
DGGHFYLRSHIDAVAAL

SEQ ID NO: 1070651 - protein, 24 aa, Mycobacterium
DGGHGAKLLGNGGAGGAGGAAGGG

SEQ ID NO: 1070652 - protein, 23 aa, Mycobacterium
DGGLGRFWMSAGQAHVAGVGMDW

SEQ ID NO: 1070653 - protein, 21 aa, Mycobacterium
DGGLHVGWLSSGDHVVGLAST

SEQ ID NO: 1070654 - protein, 17 aa, Mycobacterium
DGGLLYGNGGAGGWLFG

SEQ ID NO: 1070655 - protein, 21 aa, Mycobacterium
DGGLQRFWLSVAQAHVAGVRV

SEQ ID NO: 1070656 - protein, 22 aa, Mycobacterium
DGGNAGLLFSSAGSGGFGGSST

SEQ ID NO: 1070657 - protein, 28 aa, Mycobacterium
DGGNGGAGGFGGIGLNGSGGDGGHGGAG

SEQ ID NO: 1070658 - protein, 22 aa, Mycobacterium
DGGNGGGLFNIGRGGDGGNGGN

SEQ ID NO: 1070659 - protein, 34 aa, Mycobacterium
DGGRGYMSKIFNDAWMSSYGFLRSRLDGRTDTST

SEQ ID NO: 1070660 - protein, 25 aa, Mycobacterium
DGGTGGLGGWLWGQAGAAGTGTPLP

SEQ ID NO: 1070661 - protein, 28 aa, Mycobacterium
DGGTGQGGISFLAPGGQTGGDGSTGGTG

SEQ ID NO: 1070662 - protein, 24 aa, Mycobacterium
DGGVGGWGVLAAAGGKGGDAIGLF

SEQ ID NO: 1070663 - protein, 29 aa, Mycobacterium
DGGYHDTEIIRWLFTPDPSLTVTRDGSRD

SEQ ID NO: 1070664 - protein, 25 aa, Mycobacterium
DGHGRLELFEYIHPPVIESKPMLPN

SEQ ID NO: 1070665 - protein, 24 aa, Mycobacterium
DGIDVLWRKLAELAAPTDTAVDVV

SEQ ID NO: 1070666 - protein, 32 aa, Mycobacterium
DGIGVAAVDWCRWRLRCRGACGCRIRGNAADV

SEQ ID NO: 1070667 - protein, 25 aa, Mycobacterium
DGIIEKLPRMLGTQAAGAAPLVLGE

SEQ ID NO: 1070668 - protein, 29 aa, Mycobacterium
DGIQRIPRALARLEVPLIGAINGAAIGAG

SEQ ID NO: 1070669 - protein, 20 aa, Mycobacterium
DGIQRPLIVFTPKSMLRNKA

SEQ ID NO: 1070670 - protein, 22 aa, Mycobacterium
DGIVTGLRLMTRMVATGASLAA

SEQ ID NO: 1070671 - protein, 24 aa, Mycobacterium
DGKHELLLALFEDALSRSADQIRA

SEQ ID NO: 1070672 - protein, 20 aa, Mycobacterium
DGKPALFIVESSAAGLIVKA

SEQ ID NO: 1070673 - protein, 29 aa, Mycobacterium
DGKPPVVTRSTRPILLPDRNEIGRNISDE

SEQ ID NO: 1070674 - protein, 17 aa, Mycobacterium
DGKPWGSRFPLISVRDQ

SEQ ID NO: 1070675 - protein, 17 aa, Mycobacterium
DGKTLSGALPVAKGVFS

SEQ ID NO: 1070676 - protein, 17 aa, Mycobacterium
DGKVWVSPVDTIVRVRT

SEQ ID NO: 1070677 - protein, 17 aa, Mycobacterium
DGLLLTMDQPYPVAMAK

SEQ ID NO: 1070678 - protein, 18 aa, Mycobacterium
DGLQGGSGRTLDAAAKAY

SEQ ID NO: 1070679 - protein, 25 aa, Mycobacterium
DGLQIEKPVPLSAKLELLAAVAATG

SEQ ID NO: 1070680 - protein, 33 aa, Mycobacterium; identical to SEQ ID NO: 801029

SEQ ID NO: 1070681 - protein, 31 aa, Mycobacterium
DGLSDPCGYLQWLRELVGQQAWIVIEKILAA

SEQ ID NO: 1070682 - protein, 22 aa, Mycobacterium
DGLTMFLVPINHPGITLRRITQ

SEQ ID NO: 1070683 - protein, 24 aa, Mycobacterium
DGMESLLGAIYLHHGMEVAREAIL

SEQ ID NO: 1070684 - protein, 22 aa, Mycobacterium
DGMFKVNWRVPAGPFQLMDQVG

SEQ ID NO: 1070685 - protein, 18 aa, Mycobacterium
DGMPHRVLRTGLVEKLEG

SEQ ID NO: 1070686 - protein, 18 aa, Mycobacterium
DGNLGFGLTGDNLVGFGN

SEQ ID NO: 1070687 - protein, 23 aa, Mycobacterium
DGPDLRSRLPERADVVLAGLRFA

SEQ ID NO: 1070688 - protein, 17 aa, Mycobacterium
DGPTVVRVLGAIEIPVV

SEQ ID NO: 1070689 - protein, 25 aa, Mycobacterium
DGQRVLVDRIWPRGIRKDDPRVGIW

SEQ ID NO: 1070690 - protein, 21 aa, Mycobacterium
DGQWRLSPKAMRRLGETALRD

SEQ ID NO: 1070691 - protein, 23 aa, Mycobacterium
DGRAPTLRRWYPSTDGSWDAKSA

SEQ ID NO: 1070692 - protein, 25 aa, Mycobacterium
DGRASWYRNRWVRSMPVCAALGESP

SEQ ID NO: 1070693 - protein, 27 aa, Mycobacterium
DGRDPWRLDGPWRTPLIAVAHGWCMTL

SEQ ID NO: 1070694 - protein, 26 aa, Mycobacterium
DGRDWQRLCQKWDLASAPLDRQIEIT

SEQ ID NO: 1070695 - protein, 24 aa, Mycobacterium
DGREVLFFALPGNVPAPVADRRPL

SEQ ID NO: 1070696 - protein, 22 aa, Mycobacterium
DGRFEILLGPRRPGEHTGNFIA

SEQ ID NO: 1070697 - protein, 23 aa, Mycobacterium
DGRGAPLMPCGRCRQLLFEHGGP

SEQ ID NO: 1070698 - protein, 22 aa, Mycobacterium
DGRIQASLWSWAPDEPRAGAGE

SEQ ID NO: 1070699 - protein, 17 aa, Mycobacterium
DGRLHYVYNFLGERQQL

SEQ ID NO: 1070700 - protein, 22 aa, Mycobacterium
DGRLHYVYNWLGERIQTISAPE

SEQ ID NO: 1070701 - protein, 18 aa, Mycobacterium
DGRPIAPGPRPRLARPLS

SEQ ID NO: 1070702 - protein, 24 aa, Mycobacterium
DGRRWRALFDWTSQRFDMLAEDIM

SEQ ID NO: 1070703 - protein, 23 aa, Mycobacterium
DGRVRARREISVKIPAGVGDGMR

SEQ ID NO: 1070704 - protein, 19 aa, Mycobacterium
DGRYLGQFTLRPNLAVSAQ

SEQ ID NO: 1070705 - protein, 27 aa, Mycobacterium
DGSDTLAIPQFLSNPWWAEAATAERRA

SEQ ID NO: 1070706 - protein, 26 aa, Mycobacterium
DGSDTVTLVWLGQRRIPGIDSGRTLR

SEQ ID NO: 1070707 - protein, 23 aa, Mycobacterium
DGSFHETEIVRWLFTPDPSLTLT

SEQ ID NO: 1070708 - protein, 20 aa, Mycobacterium
DGSFNNAWAFDGSAAEVNTA

SEQ ID NO: 1070709 - protein, 21 aa, Mycobacterium
DGSGDAYGGFGGTGGNGGAPG

SEQ ID NO: 1070710 - protein, 17 aa, Mycobacterium
DGSLLYGNGGAGGPGGA

SEQ ID NO: 1070711 - protein, 18 aa, Mycobacterium
DGSLQHPPLPAVWQDKAE

SEQ ID NO: 1070712 - protein, 24 aa, Mycobacterium
DGSPAVKALLARTTRWGSYLTDID

SEQ ID NO: 1070713 - protein, 23 aa, Mycobacterium
DGSPKILDRCTLPLTGVGCVNRI

SEQ ID NO: 1070714 - protein, 29 aa, Mycobacterium
DGSPYQVFTPFFRKWQDARWRAPADTGPG

SEQ ID NO: 1070715 - protein, 25 aa, Mycobacterium
DGSRGDTPLGPFNVDGHSGGDGGRG

SEQ ID NO: 1070716 - protein, 38 aa, Mycobacterium; identical to SEQ ID NO: 1042817

SEQ ID NO: 1070717 - protein, 30 aa, Mycobacterium
DGSRPRDLLLDAYLLRAMGIAGWVPALTEC

SEQ ID NO: 1070718 - protein, 27 aa, Mycobacterium
DGSSHLVQIKILPTPATSVTLTMSDWG

SEQ ID NO: 1070719 - protein, 24 aa, Mycobacterium
DGSSNWYTEFARLAPLMEKDTHYE

SEQ ID NO: 1070720 - protein, 26 aa, Mycobacterium
DGSTLGLRLELGGGALFGPLGSAAAR

SEQ ID NO: 1070721 - protein, 26 aa, Mycobacterium
DGSTWTLRWLLGRLGYRAYGWRLGLN

SEQ ID NO: 1070722 - protein, 18 aa, Mycobacterium
DGSYIITGGLGGLGLFFA

SEQ ID NO: 1070723 - protein, 21 aa, Mycobacterium
DGTAAIWQRLPDLDLDGDGRL

SEQ ID NO: 1070724 - protein, 25 aa, Mycobacterium
DGTIKIEMNFLPDVYVPCEVCQGAR

SEQ ID NO: 1070725 - protein, 21 aa, Mycobacterium
DGTLLIASAHDRLVLRYDGDT

SEQ ID NO: 1070726 - protein, 19 aa, Mycobacterium
DGTLLWVDGDRRACRKAES

SEQ ID NO: 1070727 - protein, 20 aa, Mycobacterium
DGTPYVTPLVRKLAEENNID

SEQ ID NO: 1070728 - protein, 24 aa, Mycobacterium
DGTRIPISIVYRGGIQLPAPAMIY

SEQ ID NO: 1070729 - protein, 18 aa, Mycobacterium
DGTTMFPFRRLFIVAEVG

SEQ ID NO: 1070730 - protein, 27 aa, Mycobacterium
DGTWNTLYRKWLSVLGPAPAPPRPRYV

SEQ ID NO: 1070731 - protein, 28 aa, Mycobacterium
DGVDRIVVHLAPWLEPEPICWAINHVRV

SEQ ID NO: 1070732 - protein, 19 aa, Mycobacterium
DGVGNYTFGLAEQPVFHEI

SEQ ID NO: 1070733 - protein, 19 aa, Mycobacterium
DGVILAVPAPRLVRLLQQI

SEQ ID NO: 1070734 - protein, 23 aa, Mycobacterium
DGVILAVPAPRLVRLLQQIAPRT

SEQ ID NO: 1070735 - protein, 22 aa, Mycobacterium
DGVLVCVAQCRPHTAPTVLQTD

SEQ ID NO: 1070736 - protein, 28 aa, Mycobacterium
DGVPGPDRVPLLALLRSTPLTEDQIRQV

SEQ ID NO: 1070737 - protein, 23 aa, Mycobacterium
DGVPIHRAIVRRLYRRRRPDGAT

SEQ ID NO: 1070738 - protein, 20 aa, Mycobacterium
DGVSIAVTAAFWSAAEEFQE

SEQ ID NO: 1070739 - protein, 26 aa, Mycobacterium
DGVYEFQLVAPPLRFVGAVGSPVNPI

SEQ ID NO: 1070740 - protein, 17 aa, Mycobacterium
DGWLGAAKPRKIIEDKD

SEQ ID NO: 1070741 - protein, 19 aa, Mycobacterium
DGYGLPPLESIPGLAEEIF

SEQ ID NO: 1070742 - protein, 25 aa, Mycobacterium
DHAPAGLLHLAVLGSPLAHARITSI

SEQ ID NO: 1070743 - protein, 27 aa, Mycobacterium
DHAQEYEVVLEEFLDGLQGGSGRTLDA

SEQ ID NO: 1070744 - protein, 17 aa, Mycobacterium
DHCLSVLLQAWGDDPFE

SEQ ID NO: 1070745 - protein, 17 aa, Mycobacterium
DHDVTIGLVFRARMAEP

SEQ ID NO: 1070746 - protein, 23 aa, Mycobacterium
DHELLLVVPRFCPNCSRRLAPTE

SEQ ID NO: 1070747 - protein, 21 aa, Mycobacterium
DHGRGIMFAELPWRGNEIHRV

SEQ ID NO: 1070748 - protein, 32 aa, Mycobacterium
DHGRTGLKVPWTHAILPKRLVFAVAARKYGHP

SEQ ID NO: 1070749 - protein, 27 aa, Mycobacterium
DHHSRRGLLLLVGRRRRLIKYISQIDV

SEQ ID NO: 1070750 - protein, 32 aa, Mycobacterium
DHIADFDDFWRPIRSYFYWEKHCYDVPICWSL

SEQ ID NO: 1070751 - protein, 19 aa, Mycobacterium
DHINAVLGANFYRVAQRVW

SEQ ID NO: 1070752 - protein, 18 aa, Mycobacterium
DHIVDYYSFFLSGGFQGP

SEQ ID NO: 1070753 - protein, 27 aa, Mycobacterium
DHLERLWTPYRMNYLAEAPLKREDSAR

SEQ ID NO: 1070754 - protein, 36 aa, Mycobacterium
DHLHAVVGEWQLLADLSFADYLMWVARDDGALVCVA

SEQ ID NO: 1070755 - protein, 23 aa, Mycobacterium
DHPAQLHRILGFGRSRPVKVGTI

SEQ ID NO: 1070756 - protein, 25 aa, Mycobacterium
DHPEDWHMFQPQWLADLSDARRARL

SEQ ID NO: 1070757 - protein, 34 aa, Mycobacterium; identical to SEQ ID NO: 801470

SEQ ID NO: 1070758 - protein, 24 aa, Mycobacterium
DHPFFARIWPFIVAHEAEPVRALR

SEQ ID NO: 1070759 - protein, 22 aa, Mycobacterium
DHPMGCKRLVFSSEFLTALTRP

SEQ ID NO: 1070760 - protein, 18 aa, Mycobacterium
DHPVARMTELIAALRAIF

SEQ ID NO: 1070761 - protein, 26 aa, Mycobacterium
DHPVRAVFIRAPWVERVGAGVTVLAR

SEQ ID NO: 1070762 - protein, 32 aa, Mycobacterium; identical to SEQ ID NO: 801485

SEQ ID NO: 1070763 - protein, 22 aa, Mycobacterium
DHRPELLLSFGFVPKAERRVGL

SEQ ID NO: 1070764 - protein, 23 aa, Mycobacterium
DHSGPLVTELLTEAGFVVDGVVA

SEQ ID NO: 1070765 - protein, 30 aa, Mycobacterium
DHVAFGVWTLWPVLVLFMPYDVYGFSAADK

SEQ ID NO: 1070766 - protein, 29 aa, Mycobacterium
DHVALCQLWGPMPGLPKAIPRFTRELRQL

SEQ ID NO: 1070767 - protein, 21 aa, Mycobacterium
DHVMYVWIDALTNYLTGAGFP

SEQ ID NO: 1070768 - protein, 20 aa, Mycobacterium
DHVMYVWVDALTNYLTGAGY

SEQ ID NO: 1070769 - protein, 25 aa, Mycobacterium
DHVPEQAFFLIGGLDDLAKKAESLG

SEQ ID NO: 1070770 - protein, 23 aa, Mycobacterium
DHVRIPWVNLLNRYGDVATDGTY

SEQ ID NO: 1070771 - protein, 17 aa, Mycobacterium
DHVTSVFRHDDLASALA

SEQ ID NO: 1070772 - protein, 28 aa, Mycobacterium
DHVVSLTREVLGAGIPLFGICFGNQILG

SEQ ID NO: 1070773 - protein, 24 aa, Mycobacterium
DHYDDDWTQLWWVRADGVAQIHPA

SEQ ID NO: 1070774 - protein, 23 aa, Mycobacterium
DHYGVIFIDSPPENQLLLQAALC

SEQ ID NO: 1070775 - protein, 26 aa, Mycobacterium
DIAEEYYISFLLDRANRTYLAMCSVE

SEQ ID NO: 1070776 - protein, 24 aa, Mycobacterium
DIAEPLPRSLVWSAAWEMTREAEL

SEQ ID NO: 1070777 - protein, 24 aa, Mycobacterium
DIAFNWDHFFPLFGDPDGAHFECW

SEQ ID NO: 1070778 - protein, 19 aa, Mycobacterium
DIAGHYRRRFRHVLVDEYQ

SEQ ID NO: 1070779 - protein, 23 aa, Mycobacterium
DIAGTLSILAFTFTMITGGNDTV

SEQ ID NO: 1070780 - protein, 23 aa, Mycobacterium
DIALAAAIPRRRTDWRAYSSWPV

SEQ ID NO: 1070781 - protein, 18 aa, Mycobacterium
DICFIPSGNTQTFLGERI

SEQ ID NO: 1070782 - protein, 21 aa, Mycobacterium
DICPWALREGVILRRLDSEGD

SEQ ID NO: 1070783 - protein, 21 aa, Mycobacterium
DIDDFLSKDLTLSPDRLIRDD

SEQ ID NO: 1070784 - protein, 28 aa, Mycobacterium
DIDDIQAQAILDMQLRRLAALERQRIID

SEQ ID NO: 1070785 - protein, 23 aa, Mycobacterium
DIDDLTFALNLGVDMVALSFVRS

SEQ ID NO: 1070786 - protein, 24 aa, Mycobacterium
DIDLHLVLGSWRILGAVQQTLDIV

SEQ ID NO: 1070787 - protein, 25 aa, Mycobacterium
DIDPPPPRPTPPPPPTRSPPHPTTS

SEQ ID NO: 1070788 - protein, 23 aa, Mycobacterium
DIDTVWFGAAAPLALLAPRARQA

SEQ ID NO: 1070789 - protein, 23 aa, Mycobacterium
DIDYRAFQTIVFRTDLITDAEVL

SEQ ID NO: 1070790 - protein, 26 aa, Mycobacterium
DIERLRNLWDVPALALVGIGNGAQVA

SEQ ID NO: 1070791 - protein, 19 aa, Mycobacterium
DIEYKFGFVGNPWGELEGV

SEQ ID NO: 1070792 - protein, 24 aa, Mycobacterium
DIGAPPQFMDFRYGLHDRWHGEFH

SEQ ID NO: 1070793 - protein, 22 aa, Mycobacterium
DIGLTSRLRPVPLRHPRFVVDV

SEQ ID NO: 1070794 - protein, 19 aa, Mycobacterium
DIGPELRKLAQMTLDGIGP

SEQ ID NO: 1070795 - protein, 18 aa, Mycobacterium
DIGPLTHSARRLSSTQAP

SEQ ID NO: 1070796 - protein, 25 aa, Mycobacterium
DIGYATNYYMLTHDLVLQPANQDWH

SEQ ID NO: 1070797 - protein, 18 aa, Mycobacterium
DIHALLPESARRAYDVHP

SEQ ID NO: 1070798 - protein, 30 aa, Mycobacterium; identical to SEQ ID NO: 801682

SEQ ID NO: 1070799 - protein, 17 aa, Mycobacterium
DIILYGATGFVGKLTAQ

SEQ ID NO: 1070800 - protein, 25 aa, Mycobacterium
DIKPEHLILIGQIAQEFGLYTKITG

SEQ ID NO: 1070801 - protein, 26 aa, Mycobacterium
DIKRPVWPMIVLRTPKGWTGPKVVDG

SEQ ID NO: 1070802 - protein, 19 aa, Mycobacterium
DILAFERQWWKFAGVKEDA

SEQ ID NO: 1070803 - protein, 17 aa, Mycobacterium
DILALLAGTYRAEGFDV

SEQ ID NO: 1070804 - protein, 17 aa, Mycobacterium
DILATEILDPLGFRWTN

SEQ ID NO: 1070805 - protein, 18 aa, Mycobacterium
DILKRFPEWDVDLGNAKL

SEQ ID NO: 1070806 - protein, 30 aa, Mycobacterium
DILTDKLGMFPLFQYWGPTANITSSRWLVD

SEQ ID NO: 1070807 - protein, 18 aa, Mycobacterium
DILVAHTGIGFRGWVAAA

SEQ ID NO: 1070808 - protein, 26 aa, Mycobacterium
DINLVGSFNVLRLAAERIAKTEPVGP

SEQ ID NO: 1070809 - protein, 23 aa, Mycobacterium
DINSLYKVGLGSVRFLMSVGDLV

SEQ ID NO: 1070810 - protein, 24 aa, Mycobacterium
DINTPAFEWYYQSGLSVIMPVGGQ

SEQ ID NO: 1070811 - protein, 17 aa, Mycobacterium
DIPDWISQAYLDSYQRR

SEQ ID NO: 1070812 - protein, 17 aa, Mycobacterium
DIPGACDSTLLIAERVQ

SEQ ID NO: 1070813 - protein, 21 aa, Mycobacterium
DIPLAIDHFRYFAGAIRAQEG

SEQ ID NO: 1070814 - protein, 31 aa, Mycobacterium
DIQSHLYSFSFAANKFWSRTYARQPEILAYL

SEQ ID NO: 1070815 - protein, 22 aa, Mycobacterium
DIRESIHLRALGRQNPLDEFHR

SEQ ID NO: 1070816 - protein, 27 aa, Mycobacterium
DIRFVRLWFTDVLGYLKSVAIAPAELE

SEQ ID NO: 1070817 - protein, 35 aa, Mycobacterium
DIRRPLGLPRQIPAERLRCVLGDSLRSPELPGWHL

SEQ ID NO: 1070818 - protein, 26 aa, Mycobacterium
DITSNTYYDWFLDHDFIAFYGTAICT

SEQ ID NO: 1070819 - protein, 29 aa, Mycobacterium
DITVNVDGFWMLQALLDIRHVAPELRCRP

SEQ ID NO: 1070820 - protein, 20 aa, Mycobacterium
DIVGIGFKAVHVSAIKFPNL

SEQ ID NO: 1070821 - protein, 19 aa, Mycobacterium
DIVSGVGYTALLVAGWRAL

SEQ ID NO: 1070822 - protein, 19 aa, Mycobacterium
DIVVPLDTKLLPVTPPVLE

SEQ ID NO: 1070823 - protein, 19 aa, Mycobacterium
DIYVLDFPGYGLSDKPRQP

SEQ ID NO: 1070824 - protein, 32 aa, Mycobacterium
DKATDFLMLCESFRLPVISLCDTPGFMVGPDA

SEQ ID NO: 1070825 - protein, 20 aa, Mycobacterium
DKATLLNLGTYTAGGLPLQF

SEQ ID NO: 1070826 - protein, 20 aa, Mycobacterium
DKAWYIEHRYLSTERAKAVT

SEQ ID NO: 1070827 - protein, 19 aa, Mycobacterium
DKDDCAAIGLVKFDLLGLG

SEQ ID NO: 1070828 - protein, 24 aa, Mycobacterium
DKEFTKKLWSAAGLPIGPHAVLRP

SEQ ID NO: 1070829 - protein, 22 aa, Mycobacterium
DKGEMVMFLMTRMPPDAPHNKP

SEQ ID NO: 1070830 - protein, 25 aa, Mycobacterium
DKGFGGRTLIKDLSFTLPRNGTVGV

SEQ ID NO: 1070831 - protein, 25 aa, Mycobacterium
DKGPWGAFDMSLGKAMYAGFTLGGL

SEQ ID NO: 1070832 - protein, 20 aa, Mycobacterium
DKIDQRLTVLGIDNTITYKA

SEQ ID NO: 1070833 - protein, 24 aa, Mycobacterium
DKKNPEMMAVLRPLQQVKNQGLWA

SEQ ID NO: 1070834 - protein, 20 aa, Mycobacterium
DKLALLLEFANELPPLPSDL

SEQ ID NO: 1070835 - protein, 19 aa, Mycobacterium
DKPPYRQIASMLRGAIISG

SEQ ID NO: 1070836 - protein, 20 aa, Mycobacterium
DKRLAARFLALEGLPKGTFG

SEQ ID NO: 1070837 - protein, 24 aa, Mycobacterium
DKRLRRRLLTWRKFSVKPLGCKRR

SEQ ID NO: 1070838 - protein, 24 aa, Mycobacterium
DKSRPLWEMYLIEGLEKGRVALYT

SEQ ID NO: 1070839 - protein, 30 aa, Mycobacterium
DKVALLLERTHLIPIAVLAIVKTGAAYVPI

SEQ ID NO: 1070840 - protein, 25 aa, Mycobacterium
DKVARFMLGLARRYGPAFYTANQLA

SEQ ID NO: 1070841 - protein, 23 aa, Mycobacterium
DKVARIRVGLRRSAMGEAPDSRV

SEQ ID NO: 1070842 - protein, 21 aa, Mycobacterium
DKVILDDVTLSFYPGAKIGVV

SEQ ID NO: 1070843 - protein, 23 aa, Mycobacterium
DKVPALNPHQIDDLIMGCGLPGG

SEQ ID NO: 1070844 - protein, 19 aa, Mycobacterium
DKVTLWYCSANRDEEKFAD

SEQ ID NO: 1070845 - protein, 23 aa, Mycobacterium
DLAARLKARWAPEGLVQRSQRHC

SEQ ID NO: 1070846 - protein, 20 aa, Mycobacterium
DLACSGLRFAYDGLIPLPDG

SEQ ID NO: 1070847 - protein, 23 aa, Mycobacterium
DLALFTGDLLRPSTVSPPMHAEA

SEQ ID NO: 1070848 - protein, 33 aa, Mycobacterium
DLALQVCPVPPPRELDMLLTAGERISNALVAMA

SEQ ID NO: 1070849 - protein, 32 aa, Mycobacterium; identical to SEQ ID NO: 802009

SEQ ID NO: 1070850 - protein, 24 aa, Mycobacterium
DLAPELGYLITDPTLVRIGAMARH

SEQ ID NO: 1070851 - protein, 24 aa, Mycobacterium
DLATNWLFGYVDVVLIRAERLYEV

SEQ ID NO: 1070852 - protein, 28 aa, Mycobacterium
DLAVLTLRPRLIEVLGVDPLTDAGMRRW

SEQ ID NO: 1070853 - protein, 28 aa, Mycobacterium
DLAYRVAVGLYRYSLLDIIDIADIADID

SEQ ID NO: 1070854 - protein, 20 aa, Mycobacterium
DLCAPALYALFDSVRELAAP

SEQ ID NO: 1070855 - protein, 25 aa, Mycobacterium
DLDAAIKWYHDHLGLILVHEEVNDD

SEQ ID NO: 1070856 - protein, 19 aa, Mycobacterium
DLDAFRRVLRDGEIGRLVP

SEQ ID NO: 1070857 - protein, 28 aa, Mycobacterium
DLDALITKVWKMPSFFLTHPQGIAAFGR

SEQ ID NO: 1070858 - protein, 29 aa, Mycobacterium
DLDALITKVWKMPSFFLTHPQGIAAFGRE

SEQ ID NO: 1070859 - protein, 23 aa, Mycobacterium
DLDGRPMLRHRMELGAGSLADDV

SEQ ID NO: 1070860 - protein, 27 aa, Mycobacterium
DLDILSATLVYQLALAGAARMIVTARA

SEQ ID NO: 1070861 - protein, 25 aa, Mycobacterium
DLDKPKLVFFFDEAHLLFSDASKAF

SEQ ID NO: 1070862 - protein, 24 aa, Mycobacterium
DLDRGYVKAVRRRWIREEHYRRMY

SEQ ID NO: 1070863 - protein, 25 aa, Mycobacterium
DLDTPVVMINLLQFKPDGVANYQRY

SEQ ID NO: 1070864 - protein, 25 aa, Mycobacterium
DLDVAERILLNSKTRRPSVCNAAET

SEQ ID NO: 1070865 - protein, 20 aa, Mycobacterium
DLDVLGYWVTSQAPPVMQIC

SEQ ID NO: 1070866 - protein, 23 aa, Mycobacterium
DLEGYLPLGVERVLLGLPTEPRD

SEQ ID NO: 1070867 - protein, 26 aa, Mycobacterium
DLEHTWSSGILDRPLLRYTVSTDEGG

SEQ ID NO: 1070868 - protein, 25 aa, Mycobacterium
DLELFKHLHKAGLRRVFVGLETGSY

SEQ ID NO: 1070869 - protein, 21 aa, Mycobacterium
DLEPTRPILHGLLGDIDVAAL

SEQ ID NO: 1070870 - protein, 25 aa, Mycobacterium
DLETLMTALTPLERLACGEPANAPE

SEQ ID NO: 1070871 - protein, 31 aa, Mycobacterium
DLFDESYTRWGPIQWMAPETLLTLGAHLADR

SEQ ID NO: 1070872 - protein, 21 aa, Mycobacterium
DLFNRFTHDAFWRDPERIPAG

SEQ ID NO: 1070873 - protein, 30 aa, Mycobacterium
DLGALSSWYVWAALGLYPITAGTPILTVNT

SEQ ID NO: 1070874 - protein, 17 aa, Mycobacterium
DLGCEYAICYFPEAAYD

SEQ ID NO: 1070875 - protein, 22 aa, Mycobacterium
DLGKWQKVIDVNLTGTFLGMRA

SEQ ID NO: 1070876 - protein, 23 aa, Mycobacterium
DLGLPLIAVGLYYRSGYFRQSLT

SEQ ID NO: 1070877 - protein, 30 aa, Mycobacterium; identical to SEQ ID NO: 784034

SEQ ID NO: 1070878 - protein, 19 aa, Mycobacterium
DLGYSWAPIILSDGAHHTN

SEQ ID NO: 1070879 - protein, 23 aa, Mycobacterium
DLHDATVYYTVMGPTLDGEPDYA

SEQ ID NO: 1070880 - protein, 19 aa, Mycobacterium
DLHFIVYSAMFEGQSQIAL

SEQ ID NO: 1070881 - protein, 24 aa, Mycobacterium
DLHRRLLGVLIDQEWKYGVATGVE

SEQ ID NO: 1070882 - protein, 22 aa, Mycobacterium
DLITSHLQGWTLDRLPAVDRAI

SEQ ID NO: 1070883 - protein, 17 aa, Mycobacterium
DLIVGHGRFVDPHSIVV

SEQ ID NO: 1070884 - protein, 25 aa, Mycobacterium
DLKLDTLRRAIATAPYLLSKSALVS

SEQ ID NO: 1070885 - protein, 29 aa, Mycobacterium
DLLAAINAPVLSLTGRPLIGNGASGAPGT

SEQ ID NO: 1070886 - protein, 18 aa, Mycobacterium
DLLFLEWAADSAHHRVDD

SEQ ID NO: 1070887 - protein, 17 aa, Mycobacterium
DLLKPLLPTGRISGSTD

SEQ ID NO: 1070888 - protein, 18 aa, Mycobacterium
DLLLACHLAGCGYSMCES

SEQ ID NO: 1070889 - protein, 21 aa, Mycobacterium
DLLLQVLFHARIAEDAALLPF

SEQ ID NO: 1070890 - protein, 23 aa, Mycobacterium
DLLPHRRVPLRAIQRDIGIGGLF

SEQ ID NO: 1070891 - protein, 25 aa, Mycobacterium
DLLRNAIVSFLRYIDQNQASWIVMY

SEQ ID NO: 1070892 - protein, 24 aa, Mycobacterium
DLLSKLVRHHLLLPVVATRSDLND

SEQ ID NO: 1070893 - protein, 31 aa, Mycobacterium; identical to SEQ ID NO: 802340

SEQ ID NO: 1070894 - protein, 23 aa, Mycobacterium
DLNDYLNRPLWYQQQEADGVAMP

SEQ ID NO: 1070895 - protein, 24 aa, Mycobacterium
DLPAERLTLLRDWLGPGYGHPTSQ

SEQ ID NO: 1070896 - protein, 21 aa, Mycobacterium
DLPDRRVALYVLPRTLDDVPG

SEQ ID NO: 1070897 - protein, 21 aa, Mycobacterium
DLPEFYGYPAKLSSTWLRANF

SEQ ID NO: 1070898 - protein, 25 aa, Mycobacterium
DLPLSAVQLLPRADLAKLLAPPLPA

SEQ ID NO: 1070899 - protein, 22 aa, Mycobacterium
DLPPAPEDLAPPAPADLPPAPE

SEQ ID NO: 1070900 - protein, 19 aa, Mycobacterium
DLPPIIDIRKRLLPNSPRV

SEQ ID NO: 1070901 - protein, 17 aa, Mycobacterium
DLQIVRSYKLRGAYNLL

SEQ ID NO: 1070902 - protein, 23 aa, Mycobacterium
DLRITRSLALPDPPRHRLRLADL

SEQ ID NO: 1070903 - protein, 18 aa, Mycobacterium
DLRTFGRYGWGVDLDLAL

SEQ ID NO: 1070904 - protein, 31 aa, Mycobacterium
DLRTGDRYLIVNPFFHIFGYKAGCIASLIRA

SEQ ID NO: 1070905 - protein, 20 aa, Mycobacterium
DLSAEFFGAPLRAPVLIGAM

SEQ ID NO: 1070906 - protein, 19 aa, Mycobacterium
DLSAKAWPRYVRIAADLPS

SEQ ID NO: 1070907 - protein, 17 aa, Mycobacterium
DLSGLPVMVLDPMLATG

SEQ ID NO: 1070908 - protein, 32 aa, Mycobacterium; identical to SEQ ID NO: 802490

SEQ ID NO: 1070909 - protein, 26 aa, Mycobacterium
DLSNPNLFTFHVTPGENNIGIGNTGN

SEQ ID NO: 1070910 - protein, 22 aa, Mycobacterium
DLTARLLGARISGTDRRGKYLW

SEQ ID NO: 1070911 - protein, 18 aa, Mycobacterium
DLTMLGGLQRHFADQIRD

SEQ ID NO: 1070912 - protein, 18 aa, Mycobacterium
DLTYNDVFIMPNRSLVAS

SEQ ID NO: 1070913 - protein, 18 aa, Mycobacterium
DLVATLPHRAAQRVWQLH

SEQ ID NO: 1070914 - protein, 19 aa, Mycobacterium
DLVDGAPKPLLEKVAKEAA

SEQ ID NO: 1070915 - protein, 21 aa, Mycobacterium
DLVLAIYNPASKTRAWQVGAM

SEQ ID NO: 1070916 - protein, 24 aa, Mycobacterium
DLVLYFCEAITRCWKQIIHFTPKF

SEQ ID NO: 1070917 - protein, 18 aa, Mycobacterium
DLVLYTVLRLRLAPVLVH

SEQ ID NO: 1070918 - protein, 29 aa, Mycobacterium
DLVNPNPMFVPWLVGPLLTGEGIHLVKSF

SEQ ID NO: 1070919 - protein, 17 aa, Mycobacterium
DLVQIVADFRPGPDCRL

SEQ ID NO: 1070920 - protein, 17 aa, Mycobacterium
DLVRHLQWIHPRIGHRT

SEQ ID NO: 1070921 - protein, 28 aa, Mycobacterium
DLVSLTQILAWDLPLTKKISDLLANQAR

SEQ ID NO: 1070922 - protein, 30 aa, Mycobacterium; identical to SEQ ID NO: 802610

SEQ ID NO: 1070923 - protein, 21 aa, Mycobacterium
DLVVALERLGRWCVPGPVAES

SEQ ID NO: 1070924 - protein, 21 aa, Mycobacterium
DLVVGDLRWSLSVSARLASIP

SEQ ID NO: 1070925 - protein, 17 aa, Mycobacterium
DLVWQIGTGYFGCRNDD

SEQ ID NO: 1070926 - protein, 20 aa, Mycobacterium
DLYPFVLPVAVLEKMRFVHT

SEQ ID NO: 1070927 - protein, 24 aa, Mycobacterium
DMARPRFGSWLRNPTRGSLAMDPR

SEQ ID NO: 1070928 - protein, 23 aa, Mycobacterium
DMEDYLILGACNPPLAHRAIGVN

SEQ ID NO: 1070929 - protein, 22 aa, Mycobacterium
DMGLMLGEYWDLTALAADCAAD

SEQ ID NO: 1070930 - protein, 20 aa, Mycobacterium
DMMAKWITSHRDLPLRLNQW

SEQ ID NO: 1070931 - protein, 25 aa, Mycobacterium
DMRCKWRKWLTFQCNWKVAMEAFNE

SEQ ID NO: 1070932 - protein, 23 aa, Mycobacterium
DMTEGMLELLLRELDVHPGDVIE

SEQ ID NO: 1070933 - protein, 17 aa, Mycobacterium
DMTIGQQTRAALGDLAA

SEQ ID NO: 1070934 - protein, 17 aa, Mycobacterium
DMTVCILDRPRHAQLIE

SEQ ID NO: 1070935 - protein, 25 aa, Mycobacterium
DNDYDLSSLFLLASTAALFSPSIKE

SEQ ID NO: 1070936 - protein, 26 aa, Mycobacterium
DNEAATFGIAYLTAWHSLCEVGRLSP

SEQ ID NO: 1070937 - protein, 18 aa, Mycobacterium
DNERLIPYRASRSAFAFK

SEQ ID NO: 1070938 - protein, 32 aa, Mycobacterium; identical to SEQ ID NO: 113890

SEQ ID NO: 1070939 - protein, 22 aa, Mycobacterium
DNHQYLGLVLWSPSGETPDWWD

SEQ ID NO: 1070940 - protein, 20 aa, Mycobacterium
DNIRFFAGAARRLPGQATAE

SEQ ID NO: 1070941 - protein, 25 aa, Mycobacterium
DNIVIPWVFDGLGFDAPLGKKQDSM

SEQ ID NO: 1070942 - protein, 21 aa, Mycobacterium
DNIWMTLLTMNTQPVHFDARC

SEQ ID NO: 1070943 - protein, 24 aa, Mycobacterium
DNKRKFREALERKMAKSSGATDHK

SEQ ID NO: 1070944 - protein, 25 aa, Mycobacterium
DNLHVGLAGLWRRLSEDRSARAAVL

SEQ ID NO: 1070945 - protein, 25 aa, Mycobacterium
DNMAQGRLFLYGPRTLRKYVEEDSK

SEQ ID NO: 1070946 - protein, 19 aa, Mycobacterium
DNMHELMLPFLEHFVMKSR

SEQ ID NO: 1070947 - protein, 27 aa, Mycobacterium
DNNDHFEFFVFPYAETALTRTTRRSEE

SEQ ID NO: 1070948 - protein, 24 aa, Mycobacterium
DNPAYGWFGLFSAVRVRAGSDAVR

SEQ ID NO: 1070949 - protein, 17 aa, Mycobacterium
DNPDPLLLLTHPLPNTG

SEQ ID NO: 1070950 - protein, 32 aa, Mycobacterium
DNPEHLIAADLTWLLSHWSCVFGTPACQGTVA

SEQ ID NO: 1070951 - protein, 18 aa, Mycobacterium
DNPHYLRWPGAVPATDDH

SEQ ID NO: 1070952 - protein, 25 aa, Mycobacterium
DNPTTRAVLFHQGKFIPQGVPDTYG

SEQ ID NO: 1070953 - protein, 20 aa, Mycobacterium
DNPWLTGLCTMRWAGRLLPA

SEQ ID NO: 1070954 - protein, 21 aa, Mycobacterium
DNQIWQCPVVLLADVRSVGVQ

SEQ ID NO: 1070955 - protein, 17 aa, Mycobacterium
DNRCYLVLPPGAGKTMI

SEQ ID NO: 1070956 - protein, 26 aa, Mycobacterium
DNRGSQFYLALYWAQELAEQTDDAEL

SEQ ID NO: 1070957 - protein, 24 aa, Mycobacterium
DNRTYGHPIVLRPVSSEDAMTADW

SEQ ID NO: 1070958 - protein, 24 aa, Mycobacterium
DNSLVLVDFWASYCRPCHAFAPTY

SEQ ID NO: 1070959 - protein, 24 aa, Mycobacterium
DNSLYTMLMPQPRLVRLLEQRASA

SEQ ID NO: 1070960 - protein, 24 aa, Mycobacterium
DNSPGFLGFQLLRPVKGEDRYFVV

SEQ ID NO: 1070961 - protein, 18 aa, Mycobacterium
DNTGFLNSGSVNTGFLNS

SEQ ID NO: 1070962 - protein, 22 aa, Mycobacterium
DNTLVFYIWGDNGASMEGTNTG

SEQ ID NO: 1070963 - protein, 25 aa, Mycobacterium
DNVSKLLWANWHRSLGELAMDVIGK

SEQ ID NO: 1070964 - protein, 26 aa, Mycobacterium
DNVSLDKARRLLWPVKQKYGSEISWA

SEQ ID NO: 1070965 - protein, 24 aa, Mycobacterium
DNWYNWRVTWNVTGMYFWLDYADG

SEQ ID NO: 1070966 - protein, 20 aa, Mycobacterium
DPAEAVVAAARWARSELDYL

SEQ ID NO: 1070967 - protein, 20 aa, Mycobacterium
DPAHLWRRKLVNAGFTRKRV

SEQ ID NO: 1070968 - protein, 36 aa, Mycobacterium
DPAKWAVRHLPYYGRWLRFVTWWPIADGAAHLTVID

SEQ ID NO: 1070969 - protein, 24 aa, Mycobacterium
DPALAARYTWANRLIAVVSDGSAV

SEQ ID NO: 1070970 - protein, 23 aa, Mycobacterium
DPALPRNRGAFAELLRACGDIDG

SEQ ID NO: 1070971 - protein, 20 aa, Mycobacterium
DPAQYRDRFPRELSGGQQQR

SEQ ID NO: 1070972 - protein, 21 aa, Mycobacterium
DPATLIGPLIHETAYRDMLGA

SEQ ID NO: 1070973 - protein, 27 aa, Mycobacterium
DPDEFARRLPLMAAKRVFSEPIALNWA

SEQ ID NO: 1070974 - protein, 25 aa, Mycobacterium
DPDHASRLLLRVLGIDPPDHELDVW

SEQ ID NO: 1070975 - protein, 20 aa, Mycobacterium
DPDLFPIDESGYSILEEHEV

SEQ ID NO: 1070976 - protein, 17 aa, Mycobacterium
DPDLHHRWLNDTSITPP

SEQ ID NO: 1070977 - protein, 23 aa, Mycobacterium
DPDQLKVFPAATFVIGDTPDQAG

SEQ ID NO: 1070978 - protein, 23 aa, Mycobacterium
DPELAWAAVRAWNDWHLEAWAGP

SEQ ID NO: 1070979 - protein, 35 aa, Mycobacterium
DPELSLYALRDSVGTPFLLLAGMEPDLKWERFITA

SEQ ID NO: 1070980 - protein, 20 aa, Mycobacterium
DPEMTSPYAWYQYFINTSDA

SEQ ID NO: 1070981 - protein, 28 aa, Mycobacterium
DPEVARFWRKPWPRPQIASYLFDQHCSA

SEQ ID NO: 1070982 - protein, 25 aa, Mycobacterium
DPEVRQLILLDAPAVLGWAGFCDVA

SEQ ID NO: 1070983 - protein, 17 aa, Mycobacterium
DPEYKAPLRPLAPVSHL

SEQ ID NO: 1070984 - protein, 18 aa, Mycobacterium
DPFPEFVGGLRAAGAEVV

SEQ ID NO: 1070985 - protein, 22 aa, Mycobacterium
DPGFQVFLPHRLLVVVVDESKG

SEQ ID NO: 1070986 - protein, 21 aa, Mycobacterium
DPGQPWPGQLPAPSPAVLLDD

SEQ ID NO: 1070987 - protein, 20 aa, Mycobacterium
DPGSVSYLFSRKGVVTLEKN

SEQ ID NO: 1070988 - protein, 17 aa, Mycobacterium
DPHWPLLQAERSALLSL

SEQ ID NO: 1070989 - protein, 25 aa, Mycobacterium
DPICPFAWVTSRWLLEAAQSTHTPV

SEQ ID NO: 1070990 - protein, 28 aa, Mycobacterium
DPLALRDRLIVELLYATGIRVSELRGLD

SEQ ID NO: 1070991 - protein, 21 aa, Mycobacterium
DPLPISPVQLINPGLSVTGHP

SEQ ID NO: 1070992 - protein, 22 aa, Mycobacterium
DPLYHGHFKCNWYKLSEMPVLW

SEQ ID NO: 1070993 - protein, 19 aa, Mycobacterium
DPNARYFGAVLDGHSIVPT

SEQ ID NO: 1070994 - protein, 35 aa, Mycobacterium
DPNLLFVNAGMVQFVPFFLGQRTPPYATATSIQKC

SEQ ID NO: 1070995 - protein, 19 aa, Mycobacterium
DPNPMFVERALGLLEKVDS

SEQ ID NO: 1070996 - protein, 25 aa, Mycobacterium
DPPALPIDLIITNANIYLPLSNLTA

SEQ ID NO: 1070997 - protein, 23 aa, Mycobacterium
DPQGNVIAWASSGHVGFKGSRKS

SEQ ID NO: 1070998 - protein, 17 aa, Mycobacterium
DPQHRQLLETAWEAIEH

SEQ ID NO: 1070999 - protein, 23 aa, Mycobacterium
DPQILRLYRRRIAPGGFRYGAMF

SEQ ID NO: 1071000 - protein, 27 aa, Mycobacterium
DPQRPTILAIHGWPDNHHLWDPVAELL

SEQ ID NO: 1071001 - protein, 22 aa, Mycobacterium
DPRDPLLRLSNFFDDGTVVLLH

SEQ ID NO: 1071002 - protein, 22 aa, Mycobacterium
DPRIFRLIRGQVAIASTPGKVR

SEQ ID NO: 1071003 - protein, 24 aa, Mycobacterium
DPRPPMVTSGLRIGTPALASRGFS

SEQ ID NO: 1071004 - protein, 23 aa, Mycobacterium
DPRTPMIMIGPGTGIAPFRGFLQ

SEQ ID NO: 1071005 - protein, 23 aa, Mycobacterium
DPRVGAIFLDDGPVHICTGAVLH

SEQ ID NO: 1071006 - protein, 26 aa, Mycobacterium
DPSTWMPSTRVRRSAWHELFAKNLEA

SEQ ID NO: 1071007 - protein, 25 aa, Mycobacterium
DPSVPLVPTMLRASWRRLGGHAAAL

SEQ ID NO: 1071008 - protein, 24 aa, Mycobacterium
DPTIKGMWTVPVFGNPTGVTYSWE

SEQ ID NO: 1071009 - protein, 17 aa, Mycobacterium
DPTLVHYAQFDSGVVKG

SEQ ID NO: 1071010 - protein, 22 aa, Mycobacterium
DPTLWPQREALKSALQYPALTG

SEQ ID NO: 1071011 - protein, 25 aa, Mycobacterium
DPTPQLRNVLLPHALELRRAGALGD

SEQ ID NO: 1071012 - protein, 30 aa, Mycobacterium
DPTRPPHVGVLLRNTPFFSAMLTAAGMSGI

SEQ ID NO: 1071013 - protein, 29 aa, Mycobacterium
DPVKIILQALQGFLNFLRNLAAETLSGPL

SEQ ID NO: 1071014 - protein, 18 aa, Mycobacterium
DPVLGARPLRRTIQREIE

SEQ ID NO: 1071015 - protein, 19 aa, Mycobacterium
DPWFVAQIDELVGLRAELV

SEQ ID NO: 1071016 - protein, 24 aa, Mycobacterium
DPYPYYRRLRNEAPLYHNQELGFW

SEQ ID NO: 1071017 - protein, 22 aa, Mycobacterium
DPYRLWPRVVAEAARQVPHPVF

SEQ ID NO: 1071018 - protein, 34 aa, Mycobacterium; identical to SEQ ID NO: 352705

SEQ ID NO: 1071019 - protein, 17 aa, Mycobacterium
DQAWRRGPLTALERLAG

SEQ ID NO: 1071020 - protein, 29 aa, Mycobacterium
DQEPDWVNTIFLSTRFQAWRVGGYNEYLY

SEQ ID NO: 1071021 - protein, 24 aa, Mycobacterium
DQERYPLLEETLELDLSGLSEEEK

SEQ ID NO: 1071022 - protein, 26 aa, Mycobacterium
DQGDPPYRGLVSMSFAWPTDDTGGYP

SEQ ID NO: 1071023 - protein, 24 aa, Mycobacterium
DQGDVVTILAYTGLRWSEPVGLRV

SEQ ID NO: 1071024 - protein, 24 aa, Mycobacterium
DQGLATLVVFRPPTNAMTRQVYRE

SEQ ID NO: 1071025 - protein, 25 aa, Mycobacterium
DQGRALLPTLLRYQVPLWPERLLTR

SEQ ID NO: 1071026 - protein, 25 aa, Mycobacterium
DQGSVLTFEYLPQGAPAANAFTIDV

SEQ ID NO: 1071027 - protein, 17 aa, Mycobacterium
DQGVLIRDVGIPGYLRA

SEQ ID NO: 1071028 - protein, 19 aa, Mycobacterium
DQIWANISAVARQLKGFIA

SEQ ID NO: 1071029 - protein, 20 aa, Mycobacterium
DQLFRPLVAGQRWIAAGLFE

SEQ ID NO: 1071030 - protein, 18 aa, Mycobacterium
DQLLALGTLLEGHAEHVM

SEQ ID NO: 1071031 - protein, 20 aa, Mycobacterium
DQLRFLELFEKDLAPRLRRL

SEQ ID NO: 1071032 - protein, 17 aa, Mycobacterium
DQLRMDVALHQLPVTMV

SEQ ID NO: 1071033 - protein, 19 aa, Mycobacterium
DQMLDTAVLLGALPTRVAG

SEQ ID NO: 1071034 - protein, 24 aa, Mycobacterium
DQPLAIVTCYLPTDLPHDAVEPLL

SEQ ID NO: 1071035 - protein, 23 aa, Mycobacterium
DQPRAPIPLSLNGTGRVGRPGTE

SEQ ID NO: 1071036 - protein, 25 aa, Mycobacterium
DQPRLLTPLALAPRGIWLGPKELRS

SEQ ID NO: 1071037 - protein, 20 aa, Mycobacterium
DQPRWLADPAPELASTASVG

SEQ ID NO: 1071038 - protein, 22 aa, Mycobacterium
DQPYLRVTPKISWSLNLRGEPV

SEQ ID NO: 1071039 - protein, 17 aa, Mycobacterium
DQRAAPLVPIYLGDDIT

SEQ ID NO: 1071040 - protein, 18 aa, Mycobacterium
DQRFLLAELRRAGVPLDN

SEQ ID NO: 1071041 - protein, 26 aa, Mycobacterium
DQVATLFRMWLRDAVRRVATGVLEVV

SEQ ID NO: 1071042 - protein, 30 aa, Mycobacterium; identical to SEQ ID NO: 803527

SEQ ID NO: 1071043 - protein, 18 aa, Mycobacterium
DQVRRLLAWATPYREMMG

SEQ ID NO: 1071044 - protein, 23 aa, Mycobacterium
DQYLRTVILKRMGLERPGQDRAL

SEQ ID NO: 1071045 - protein, 25 aa, Mycobacterium
DRADVVFASHHWPTWGRERIVEFLA

SEQ ID NO: 1071046 - protein, 18 aa, Mycobacterium
DRAKILARTLDDAIGKLL

SEQ ID NO: 1071047 - protein, 18 aa, Mycobacterium
DRALFTEAARLGLLGFSV

SEQ ID NO: 1071048 - protein, 19 aa, Mycobacterium
DRARRPLVVVLTDGRATAG

SEQ ID NO: 1071049 - protein, 33 aa, Mycobacterium; identical to SEQ ID NO: 803572

SEQ ID NO: 1071050 - protein, 30 aa, Mycobacterium; identical to SEQ ID NO: 803577

SEQ ID NO: 1071051 - protein, 26 aa, Mycobacterium
DRATGQFLWQNIFGVWPVTGEVSEQL

SEQ ID NO: 1071052 - protein, 24 aa, Mycobacterium
DRATLRISSQLLANWLRHGVITSE

SEQ ID NO: 1071053 - protein, 19 aa, Mycobacterium
DRAWLSLGQLGAATRRVAA

SEQ ID NO: 1071054 - protein, 25 aa, Mycobacterium
DRDELLRFEKTLMAIWRAIQSAGQS

SEQ ID NO: 1071055 - protein, 25 aa, Mycobacterium
DRDEPAVRWWPIAVSVARDTGILSV

SEQ ID NO: 1071056 - protein, 27 aa, Mycobacterium
DREAAHLRAFLTFAEHAPRFALDQAHS

SEQ ID NO: 1071057 - protein, 30 aa, Mycobacterium; identical to SEQ ID NO: 803634

SEQ ID NO: 1071058 - protein, 19 aa, Mycobacterium
DREILGIAEAIRASGLSAG

SEQ ID NO: 1071059 - protein, 20 aa, Mycobacterium
DREIRRPTYVFAAVDHAGAD

SEQ ID NO: 1071060 - protein, 19 aa, Mycobacterium
DREVLFCPDQFLGAHVRRS

SEQ ID NO: 1071061 - protein, 38 aa, Mycobacterium; identical to SEQ ID NO: 803667

SEQ ID NO: 1071062 - protein, 17 aa, Mycobacterium
DRFDLRGQRLGAVVGGA

SEQ ID NO: 1071063 - protein, 18 aa, Mycobacterium
DRFHLVIDVIDRVVGLSS

SEQ ID NO: 1071064 - protein, 20 aa, Mycobacterium
DRFTASRLFGAPPGYVGYEE

SEQ ID NO: 1071065 - protein, 27 aa, Mycobacterium
DRGKLEALLRVLEPFGIREIAQSGMVA

SEQ ID NO: 1071066 - protein, 25 aa, Mycobacterium
DRGMPLTFEIARFIKFIVTEIFPGG

SEQ ID NO: 1071067 - protein, 23 aa, Mycobacterium
DRGNFPVFRKRLRQWMMRITAYS

SEQ ID NO: 1071068 - protein, 24 aa, Mycobacterium
DRGRWGCVLGGDPLRRVTAMRTRE

SEQ ID NO: 1071069 - protein, 17 aa, Mycobacterium
DRGWDLADLFDPDPDTP

SEQ ID NO: 1071070 - protein, 24 aa, Mycobacterium
DRHDHSHYYVMGSESLRSITDISS

SEQ ID NO: 1071071 - protein, 17 aa, Mycobacterium
DRHRIQLVAVPTTSGTG

SEQ ID NO: 1071072 - protein, 21 aa, Mycobacterium
DRIDPRFPVFSAASLAEALPG

SEQ ID NO: 1071073 - protein, 18 aa, Mycobacterium
DRIDVVQPVLFAVMVSLA

SEQ ID NO: 1071074 - protein, 17 aa, Mycobacterium
DRILVELTDHARATFAE

SEQ ID NO: 1071075 - protein, 25 aa, Mycobacterium
DRIPLHPMRVYAELAPLLDRDAIVV

SEQ ID NO: 1071076 - protein, 31 aa, Mycobacterium; identical to SEQ ID NO: 803760

SEQ ID NO: 1071077 - protein, 17 aa, Mycobacterium
DRIRLSPPPASNVSLVG

SEQ ID NO: 1071078 - protein, 26 aa, Mycobacterium
DRIVLSPHWPEYLGALGFPIHYRGNH

SEQ ID NO: 1071079 - protein, 25 aa, Mycobacterium
DRKRRHSLLPLLQNYREPAEPIRGG

SEQ ID NO: 1071080 - protein, 24 aa, Mycobacterium
DRKRRQPVTVLLKALGWSNEQIHE

SEQ ID NO: 1071081 - protein, 19 aa, Mycobacterium
DRLAADPRLPLDRAALDAA

SEQ ID NO: 1071082 - protein, 17 aa, Mycobacterium
DRLADVAVLILVGAGQA

SEQ ID NO: 1071083 - protein, 20 aa, Mycobacterium
DRLALNPQRVDGIAAGLRQV

SEQ ID NO: 1071084 - protein, 31 aa, Mycobacterium
DRLGLDYVDLYLIHWPAPAVGKYVDAFGGLI

SEQ ID NO: 1071085 - protein, 18 aa, Mycobacterium
DRLIAFTGRRPVHPTGLT

SEQ ID NO: 1071086 - protein, 21 aa, Mycobacterium
DRLKELVLKPVEGSGGYGIVF

SEQ ID NO: 1071087 - protein, 17 aa, Mycobacterium
DRLMLLDHLTHGRVIGG

SEQ ID NO: 1071088 - protein, 19 aa, Mycobacterium
DRLPQLLYVADARGLLRSR

SEQ ID NO: 1071089 - protein, 28 aa, Mycobacterium
DRLTRIRAHWPVGTLPLTAIAACCTPEA

SEQ ID NO: 1071090 - protein, 29 aa, Mycobacterium
DRLTTHDYFWRWDTDWFWCSRAFGAQNPT

SEQ ID NO: 1071091 - protein, 20 aa, Mycobacterium
DRLTYRQLWCRASRVAGGLR

SEQ ID NO: 1071092 - protein, 17 aa, Mycobacterium
DRLYFEPLTFEDVLEVF

SEQ ID NO: 1071093 - protein, 27 aa, Mycobacterium
DRMFGTWHYWWQAHLLDCLIDAELRDP

SEQ ID NO: 1071094 - protein, 23 aa, Mycobacterium
DRMNLFYQHAVPLAVDVAARALD

SEQ ID NO: 1071095 - protein, 22 aa, Mycobacterium
DRPPPRPKPQPNPARPAWTAYD

SEQ ID NO: 1071096 - protein, 17 aa, Mycobacterium
DRPWRLWSADRPEVSAY

SEQ ID NO: 1071097 - protein, 23 aa, Mycobacterium
DRQQLLMTVFKTLAKKHGMECLF

SEQ ID NO: 1071098 - protein, 24 aa, Mycobacterium
DRRGKYLWLTLDAGAPTTGRDDPD

SEQ ID NO: 1071099 - protein, 24 aa, Mycobacterium
DRRGLPMHYFPPRAHPAKVLLERA

SEQ ID NO: 1071100 - protein, 24 aa, Mycobacterium
DRRLDAAIIERLAPGGLVALVALS

SEQ ID NO: 1071101 - protein, 20 aa, Mycobacterium
DRSPLALARQALASLPKIDR

SEQ ID NO: 1071102 - protein, 35 aa, Mycobacterium; identical to SEQ ID NO: 352824

SEQ ID NO: 1071103 - protein, 18 aa, Mycobacterium
DRSTVVLGMWQHLLHRYS

SEQ ID NO: 1071104 - protein, 19 aa, Mycobacterium
DRTGPGKEPLWLGSIKSNM

SEQ ID NO: 1071105 - protein, 18 aa, Mycobacterium
DRTKPLPLSPVQANLWYL

SEQ ID NO: 1071106 - protein, 23 aa, Mycobacterium
DRTSFVPGVLLAVRRITERPGLT

SEQ ID NO: 1071107 - protein, 21 aa, Mycobacterium
DRTSFVPGVLLAVRRVRERPG

SEQ ID NO: 1071108 - protein, 22 aa, Mycobacterium
DRVFRLPDNVSFEAGAGLLFND

SEQ ID NO: 1071109 - protein, 30 aa, Mycobacterium
DRVGIWAPNRWEWVLVQYATAEIGAIVVTI

SEQ ID NO: 1071110 - protein, 24 aa, Mycobacterium
DRVLAAQHGWLAPLPPEGASAIVF

SEQ ID NO: 1071111 - protein, 25 aa, Mycobacterium
DRVNRFIPNPTFDPIIVPGCLDLLF

SEQ ID NO: 1071112 - protein, 25 aa, Mycobacterium
DRVRRWVRDRLDRPPPDAFLAEILA

SEQ ID NO: 1071113 - protein, 18 aa, Mycobacterium
DRVVQALRHLALVVADEP

SEQ ID NO: 1071114 - protein, 25 aa, Mycobacterium
DRYGRLDILVNNVGHWLRHPGNFVD

SEQ ID NO: 1071115 - protein, 20 aa, Mycobacterium
DRYHAFLHIGAHEALSAAAA

SEQ ID NO: 1071116 - protein, 23 aa, Mycobacterium
DRYINDRFLPDKAIDLIDEAGAR

SEQ ID NO: 1071117 - protein, 24 aa, Mycobacterium
DRYLNRELSWLEFNARVLALAADD

SEQ ID NO: 1071118 - protein, 17 aa, Mycobacterium
DRYPNAKEFFWVQEEPA

SEQ ID NO: 1071119 - protein, 27 aa, Mycobacterium
DRYPTYGVLAKILQVGRIAGGGAAAVV

SEQ ID NO: 1071120 - protein, 22 aa, Mycobacterium
DSAAELPTPWPREVLDDLLAVL

SEQ ID NO: 1071121 - protein, 20 aa, Mycobacterium
DSAAHRLGVKRFGGQVVKAG

SEQ ID NO: 1071122 - protein, 27 aa, Mycobacterium
DSAEWKVFLGLLRSRFETDKGKWTKIA

SEQ ID NO: 1071123 - protein, 17 aa, Mycobacterium
DSAFLVVNYRLLPKHSI

SEQ ID NO: 1071124 - protein, 18 aa, Mycobacterium
DSAQVRLKRMYPGGHYRA

SEQ ID NO: 1071125 - protein, 21 aa, Mycobacterium
DSAVAWARRYLECPPRALAAA

SEQ ID NO: 1071126 - protein, 20 aa, Mycobacterium
DSAVRLTHVPTGLVVTCQNE

SEQ ID NO: 1071127 - protein, 23 aa, Mycobacterium
DSAWLLVSILRQFGLAARFVSGY

SEQ ID NO: 1071128 - protein, 25 aa, Mycobacterium
DSDDATVRFLLTAGAIGSLFKERAS

SEQ ID NO: 1071129 - protein, 26 aa, Mycobacterium
DSDFMSYLNLWRYLGEQRRALSRSAF

SEQ ID NO: 1071130 - protein, 17 aa, Mycobacterium
DSDLLLDLFTDDPWWCD

SEQ ID NO: 1071131 - protein, 28 aa, Mycobacterium
DSDMDDMLWQVPYLPIDPKDVGRTYEAV

SEQ ID NO: 1071132 - protein, 22 aa, Mycobacterium
DSDPLWKVYVDLGWTELNDPAS

SEQ ID NO: 1071133 - protein, 27 aa, Mycobacterium
DSGGPAPIFQWLIYPRTDFAGRTRSAS

SEQ ID NO: 1071134 - protein, 25 aa, Mycobacterium
DSGHTLVLPIRFAGIHVYGDIAEGV

SEQ ID NO: 1071135 - protein, 21 aa, Mycobacterium
DSGMLAALYVLAALGEQSRPL

SEQ ID NO: 1071136 - protein, 24 aa, Mycobacterium
DSGPNQWLLRMLVTQTERAELVPL

SEQ ID NO: 1071137 - protein, 24 aa, Mycobacterium
DSGREPVWYIAPEDELAAAFYRNS

SEQ ID NO: 1071138 - protein, 20 aa, Mycobacterium
DSGVQLLRLLEGDTTPGRVD

SEQ ID NO: 1071139 - protein, 25 aa, Mycobacterium
DSHGTYFLCADPRPLGYDDSTAFCA

SEQ ID NO: 1071140 - protein, 30 aa, Mycobacterium
DSHSRQLLAAQIIWTLARADIRGPYVINAD

SEQ ID NO: 1071141 - protein, 33 aa, Mycobacterium
DSILTLPHPLAHQRAFVMVPWLDVDPAAELTGP

SEQ ID NO: 1071142 - protein, 25 aa, Mycobacterium
DSIPSDLTVYALYRAVRDDGAGELG

SEQ ID NO: 1071143 - protein, 21 aa, Mycobacterium
DSLAAFGANPLDPCCRKASAL

SEQ ID NO: 1071144 - protein, 22 aa, Mycobacterium
DSLAPFRWRLAPVPLNLDHPYW

SEQ ID NO: 1071145 - protein, 24 aa, Mycobacterium
DSLITALWEEWPPAGARASIHSYV

SEQ ID NO: 1071146 - protein, 17 aa, Mycobacterium
DSLLPEWTTSQRLFAMQ

SEQ ID NO: 1071147 - protein, 17 aa, Mycobacterium
DSLPRAGLAAGPCLLKD

SEQ ID NO: 1071148 - protein, 22 aa, Mycobacterium
DSLSFKLRHLLMLEAKEVILHD

SEQ ID NO: 1071149 - protein, 23 aa, Mycobacterium
DSMADRTYMVAPVSWIDGNVEAS

SEQ ID NO: 1071150 - protein, 22 aa, Mycobacterium
DSMPLLERAKFLAVFASNLDEF

SEQ ID NO: 1071151 - protein, 17 aa, Mycobacterium
DSMRIYGSRNFAASVLA

SEQ ID NO: 1071152 - protein, 27 aa, Mycobacterium
DSNGAPLFTVVNPPWDGVGVGADGRPD

SEQ ID NO: 1071153 - protein, 21 aa, Mycobacterium
DSPLQVTMWTKRLRAVDFTLG

SEQ ID NO: 1071154 - protein, 21 aa, Mycobacterium
DSPRHWIAHLNVLRDIQDRTG

SEQ ID NO: 1071155 - protein, 19 aa, Mycobacterium
DSQLRVLTRREFAGMISVA

SEQ ID NO: 1071156 - protein, 24 aa, Mycobacterium
DSQRAVVTPLLLASAYHARTDIPE

SEQ ID NO: 1071157 - protein, 39 aa, Mycobacterium; identical to SEQ ID NO: 804281

SEQ ID NO: 1071158 - protein, 24 aa, Mycobacterium
DSRVQRWIEAMPRYGPGHGVLVAQ

SEQ ID NO: 1071159 - protein, 27 aa, Mycobacterium
DSRYNPDYLPGTLLPPGIRATADAAEA

SEQ ID NO: 1071160 - protein, 22 aa, Mycobacterium
DSSVKITYRIKLEISFKMRPSQ

SEQ ID NO: 1071161 - protein, 31 aa, Mycobacterium
DSSYERGAPVVFPLIGVVPGFQKAIAGQKVG

SEQ ID NO: 1071162 - protein, 24 aa, Mycobacterium
DSVDLPWHRVITASGRPARHLTSR

SEQ ID NO: 1071163 - protein, 23 aa, Mycobacterium
DSVGLKLHYVSPAGEMGFPGALS

SEQ ID NO: 1071164 - protein, 19 aa, Mycobacterium
DSVITTHGLSWGFDRIFAA

SEQ ID NO: 1071165 - protein, 22 aa, Mycobacterium
DSVLMMADCFDLPLDEVKFSYE

SEQ ID NO: 1071166 - protein, 17 aa, Mycobacterium
DSVLTWIDWSDVDTGLL

SEQ ID NO: 1071167 - protein, 23 aa, Mycobacterium
DSVVQLELLLPAMAGLVGSLTFD

SEQ ID NO: 1071168 - protein, 17 aa, Mycobacterium
DSWAKGRVALVGDAAYC

SEQ ID NO: 1071169 - protein, 26 aa, Mycobacterium
DSYGPHHRLIFPLNTILELENVPEGQ

SEQ ID NO: 1071170 - protein, 23 aa, Mycobacterium
DTAAGFILDGYPRSVEQAKALHE

SEQ ID NO: 1071171 - protein, 24 aa, Mycobacterium
DTAGAVRWLIPRLDLPATQLEQIT

SEQ ID NO: 1071172 - protein, 27 aa, Mycobacterium
DTAGRLGGFLTLRWTYCDPPSELPKAS

SEQ ID NO: 1071173 - protein, 17 aa, Mycobacterium
DTAKATLAALIARHRVN

SEQ ID NO: 1071174 - protein, 23 aa, Mycobacterium
DTAQHLWTLDNPAYGWFGLFSAV

SEQ ID NO: 1071175 - protein, 17 aa, Mycobacterium
DTATLRPGLVVLVAFDP

SEQ ID NO: 1071176 - protein, 22 aa, Mycobacterium
DTATWAPIGRPIANVRLYIVDE

SEQ ID NO: 1071177 - protein, 19 aa, Mycobacterium
DTAWLRDRLSEVLPAYMVP

SEQ ID NO: 1071178 - protein, 21 aa, Mycobacterium
DTAYAWAYNLGKGGKTRIIGP

SEQ ID NO: 1071179 - protein, 36 aa, Mycobacterium
DTDAMTKSIRYPLRKVHLALVLWFPDDATDGNEFER

SEQ ID NO: 1071180 - protein, 17 aa, Mycobacterium
DTDCRVYRVAGLRVADA

SEQ ID NO: 1071181 - protein, 29 aa, Mycobacterium
DTDGTIGPLTIPLIDIPAGPGFGNSSTSP

SEQ ID NO: 1071182 - protein, 25 aa, Mycobacterium
DTDLAWSRITYWRALLTSAVDQPPH

SEQ ID NO: 1071183 - protein, 24 aa, Mycobacterium
DTDQIIPAVFLKRVTRTGFEDGLF

SEQ ID NO: 1071184 - protein, 24 aa, Mycobacterium
DTEAFLHRLAYLESAGPISGETRK

SEQ ID NO: 1071185 - protein, 17 aa, Mycobacterium
DTELLGYYLPKGTNVIA

SEQ ID NO: 1071186 - protein, 30 aa, Mycobacterium
DTESRGLVIPFWAVGFQNLGWPTGIGIASY

SEQ ID NO: 1071187 - protein, 31 aa, Mycobacterium; identical to SEQ ID NO: 804422

SEQ ID NO: 1071188 - protein, 23 aa, Mycobacterium
DTEVRAMWNLPRPPRPKSNGGGS

SEQ ID NO: 1071189 - protein, 24 aa, Mycobacterium
DTGNPPQFPVLHSGWEQVGDGAIQ

SEQ ID NO: 1071190 - protein, 25 aa, Mycobacterium
DTHGSTLRFAPPLVITAQEIDWAVR

SEQ ID NO: 1071191 - protein, 18 aa, Mycobacterium
DTIVLVAGLYRAAVAREA

SEQ ID NO: 1071192 - protein, 27 aa, Mycobacterium
DTKARVEDIYLPYKPKRRTKAQIAREA

SEQ ID NO: 1071193 - protein, 24 aa, Mycobacterium
DTKDPNLIKLLPPAPVAADVPADQ

SEQ ID NO: 1071194 - protein, 27 aa, Mycobacterium
DTKGDLPAFAELLSRLPWPLNKTTSVN

SEQ ID NO: 1071195 - protein, 17 aa, Mycobacterium
DTKLARQAQLRTLTRKY

SEQ ID NO: 1071196 - protein, 18 aa, Mycobacterium
DTLALLEDRWRDVVDALN

SEQ ID NO: 1071197 - protein, 24 aa, Mycobacterium
DTLAPGHGSLWRGPIRLATEEARA

SEQ ID NO: 1071198 - protein, 27 aa, Mycobacterium
DTLEETALWLDLTYSGSTPVVLTGAMR

SEQ ID NO: 1071199 - protein, 19 aa, Mycobacterium
DTLLPPDLFNRFTHDAFWR

SEQ ID NO: 1071200 - protein, 22 aa, Mycobacterium
DTLYSCLPLYHNNALTVAVSSV

SEQ ID NO: 1071201 - protein, 20 aa, Mycobacterium
DTMVLLLAAANRDPAVYSRP

SEQ ID NO: 1071202 - protein, 26 aa, Mycobacterium
DTNAVCSGFLFAINTPHALAQRDSIH

SEQ ID NO: 1071203 - protein, 19 aa, Mycobacterium
DTNFRATWSPAPERPRGVQ

SEQ ID NO: 1071204 - protein, 24 aa, Mycobacterium
DTNRGWCAWMPAIARLFPDAKVIA

SEQ ID NO: 1071205 - protein, 26 aa, Mycobacterium
DTNVYYRRALMLAACFGRSVEYPQRV

SEQ ID NO: 1071206 - protein, 19 aa, Mycobacterium
DTPKFFHYVKKDKIAESAV

SEQ ID NO: 1071207 - protein, 31 aa, Mycobacterium; identical to SEQ ID NO: 804553

SEQ ID NO: 1071208 - protein, 18 aa, Mycobacterium
DTPQISAALLAECARRLL

SEQ ID NO: 1071209 - protein, 17 aa, Mycobacterium
DTPVALFGHSMGGMLAF

SEQ ID NO: 1071210 - protein, 23 aa, Mycobacterium
DTQRQCIELAYYGGLTYAEVSQR

SEQ ID NO: 1071211 - protein, 17 aa, Mycobacterium
DTRFAQQMKILFPIFTS

SEQ ID NO: 1071212 - protein, 23 aa, Mycobacterium
DTRQPRLVAYYTTTIGGGGIDTA

SEQ ID NO: 1071213 - protein, 22 aa, Mycobacterium
DTRVLRGWSTLPVTLGPARALA

SEQ ID NO: 1071214 - protein, 19 aa, Mycobacterium
DTTWLGRDRFVLSCGHSSL

SEQ ID NO: 1071215 - protein, 23 aa, Mycobacterium
DTTYGGRWVVNPSGGLISKGHPL

SEQ ID NO: 1071216 - protein, 20 aa, Mycobacterium
DTVIGVNLSGTWRTLRAAVP

SEQ ID NO: 1071217 - protein, 20 aa, Mycobacterium
DTVMPPLTRAADHSKLWFAM

SEQ ID NO: 1071218 - protein, 23 aa, Mycobacterium
DTVVDAFRTCPLDAGPYTHGLTD

SEQ ID NO: 1071219 - protein, 26 aa, Mycobacterium
DTVVQTCIIHLIRGTFRYPGRQHHTA

SEQ ID NO: 1071220 - protein, 23 aa, Mycobacterium
DTWDGFYCFAAELTSPMLEVPFS

SEQ ID NO: 1071221 - protein, 28 aa, Mycobacterium
DVAAAAIGLVDLLLAPGGNLVTVLIGAG

SEQ ID NO: 1071222 - protein, 19 aa, Mycobacterium
DVAAFLPHSPLRVYVMGQR

SEQ ID NO: 1071223 - protein, 25 aa, Mycobacterium
DVAAKRIAWIKLLNGGQTCVAPDYV

SEQ ID NO: 1071224 - protein, 31 aa, Mycobacterium
DVAARPPASLVLFSPLIDLTFGLSAARERTK

SEQ ID NO: 1071225 - protein, 28 aa, Mycobacterium
DVAEGLYAIRDLAAPLVFPVVPSGHSDH

SEQ ID NO: 1071226 - protein, 28 aa, Mycobacterium
DVAGLLRRLEGVPIATVVRLPNADPGPI

SEQ ID NO: 1071227 - protein, 18 aa, Mycobacterium
DVAHLRNCTAVCVGTYIA

SEQ ID NO: 1071228 - protein, 17 aa, Mycobacterium
DVALGIGGLPRGRVIEI

SEQ ID NO: 1071229 - protein, 25 aa, Mycobacterium
DVALIVGVPMDFRLGFGGVFGPQTQ

SEQ ID NO: 1071230 - protein, 26 aa, Mycobacterium
DVAVGTLYRYFPSKVHLLVSALGREF

SEQ ID NO: 1071231 - protein, 25 aa, Mycobacterium
DVDDLNVIAIRYLPEARVLAPPDDA

SEQ ID NO: 1071232 - protein, 23 aa, Mycobacterium
DVDDPLYVLAGRSEGYVPYYDAY

SEQ ID NO: 1071233 - protein, 23 aa, Mycobacterium
DVDGDIPLLLEMPMAYTARALED

SEQ ID NO: 1071234 - protein, 31 aa, Mycobacterium
DVDKKRPFYFGALTWYMDRLLELVHDDLDAY

SEQ ID NO: 1071235 - protein, 18 aa, Mycobacterium
DVDMRCLLIIGSSQTQWY

SEQ ID NO: 1071236 - protein, 25 aa, Mycobacterium
DVDQLARSMLLLLGDHHDHQESSEQ

SEQ ID NO: 1071237 - protein, 18 aa, Mycobacterium
DVDRLSAFFDLVQQDPVV

SEQ ID NO: 1071238 - protein, 24 aa, Mycobacterium
DVDSPWVWVLDPVDGTFNYAAGSP

SEQ ID NO: 1071239 - protein, 25 aa, Mycobacterium
DVEEFSWQLEKALPVPVFAQTMAQV

SEQ ID NO: 1071240 - protein, 18 aa, Mycobacterium
DVERWPEWTASVTSLAAL

SEQ ID NO: 1071241 - protein, 20 aa, Mycobacterium
DVEVETYIWEVLPASLRKAS

SEQ ID NO: 1071242 - protein, 24 aa, Mycobacterium
DVFASRLPSYFPKPLRERFAPEIR

SEQ ID NO: 1071243 - protein, 24 aa, Mycobacterium
DVFCSVVRRVVLPDSFIAIDGQTE

SEQ ID NO: 1071244 - protein, 17 aa, Mycobacterium
DVFLQMRNQSHTLVWEG

SEQ ID NO: 1071245 - protein, 18 aa, Mycobacterium
DVFPFLRDWFSARLDECP

SEQ ID NO: 1071246 - protein, 17 aa, Mycobacterium
DVFYWAHATFFVGTIHV

SEQ ID NO: 1071247 - protein, 21 aa, Mycobacterium
DVIAQFLPQSPFVTKLGIVAD

SEQ ID NO: 1071248 - protein, 17 aa, Mycobacterium
DVILKQYTDYQNKSESV

SEQ ID NO: 1071249 - protein, 22 aa, Mycobacterium
DVIVGFRMPYIKGPDTEPLQTK

SEQ ID NO: 1071250 - protein, 24 aa, Mycobacterium
DVKLGRLAAILRDKRIPLELCPSS

SEQ ID NO: 1071251 - protein, 22 aa, Mycobacterium
DVKLPRELVLIGKQFLYVERYM

SEQ ID NO: 1071252 - protein, 27 aa, Mycobacterium
DVKRIRAIYLYVRDLPYAIAESFRYLA

SEQ ID NO: 1071253 - protein, 22 aa, Mycobacterium
DVLAHLVIGYRASLRMLAADLV

SEQ ID NO: 1071254 - protein, 25 aa, Mycobacterium
DVLARYVPVLNDLRMRYLDDEDRTG

SEQ ID NO: 1071255 - protein, 19 aa, Mycobacterium
DVLKALRPSLTTPARIAKY

SEQ ID NO: 1071256 - protein, 20 aa, Mycobacterium
DVLLAFTDLAEAIGDCPRGC

SEQ ID NO: 1071257 - protein, 17 aa, Mycobacterium
DVLLVGVGVFASMALAV

SEQ ID NO: 1071258 - protein, 27 aa, Mycobacterium
DVLQAQCTFSWPPQMDLPGYKPNTKPH

SEQ ID NO: 1071259 - protein, 17 aa, Mycobacterium
DVLSSPAPVRSLLVEND

SEQ ID NO: 1071260 - protein, 23 aa, Mycobacterium
DVLVPPRADLWGRTLRRQPWPLS

SEQ ID NO: 1071261 - protein, 19 aa, Mycobacterium
DVMGFGKPLDEIPMLLQPG

SEQ ID NO: 1071262 - protein, 25 aa, Mycobacterium
DVMLRATQHLPWHPGRCAEVLVGEA

SEQ ID NO: 1071263 - protein, 21 aa, Mycobacterium
DVMMGIVEMLRLVTDRGDTVI

SEQ ID NO: 1071264 - protein, 18 aa, Mycobacterium
DVMMPGMDGFGVLRRLQA

SEQ ID NO: 1071265 - protein, 18 aa, Mycobacterium
DVMVANAGVFGWGRLWEL

SEQ ID NO: 1071266 - protein, 18 aa, Mycobacterium
DVPAFDASGVRLAIVAST

SEQ ID NO: 1071267 - protein, 29 aa, Mycobacterium
DVPHIAVFDTAFFHQLPPAAATYAIDREL

SEQ ID NO: 1071268 - protein, 19 aa, Mycobacterium
DVPKHAGLTYLLCDMTQPG

SEQ ID NO: 1071269 - protein, 18 aa, Mycobacterium
DVPKHDGLTMFLVPINHP

SEQ ID NO: 1071270 - protein, 23 aa, Mycobacterium
DVPNEVLQCYLDLVLDGLVARLA

SEQ ID NO: 1071271 - protein, 24 aa, Mycobacterium
DVPNYRRFWAITRHADVMDIERDN

SEQ ID NO: 1071272 - protein, 20 aa, Mycobacterium
DVPPVVWTVLMASLSRFLVL

SEQ ID NO: 1071273 - protein, 17 aa, Mycobacterium
DVQASHVAWILAWALEH

SEQ ID NO: 1071274 - protein, 17 aa, Mycobacterium
DVRAMFAPKLDAAALLH

SEQ ID NO: 1071275 - protein, 24 aa, Mycobacterium
DVRPTVWGAVPRVWEKLKAGIEFT

SEQ ID NO: 1071276 - protein, 17 aa, Mycobacterium
DVRTMKYFDQELIAWRA

SEQ ID NO: 1071277 - protein, 23 aa, Mycobacterium
DVRTVLPPVLSIRNGWRSVVITG

SEQ ID NO: 1071278 - protein, 24 aa, Mycobacterium
DVRTVLPPVLSIRNGWRSVVITGT

SEQ ID NO: 1071279 - protein, 19 aa, Mycobacterium
DVRTVLPPVLSIRSGRRSV

SEQ ID NO: 1071280 - protein, 17 aa, Mycobacterium
DVRVAAELALPHRRRRD

SEQ ID NO: 1071281 - protein, 24 aa, Mycobacterium
DVSELLPELTLAQKWDLTATELAR

SEQ ID NO: 1071282 - protein, 27 aa, Mycobacterium
DVSGGAAFFLCRRASRLRAHAAQWALP

SEQ ID NO: 1071283 - protein, 19 aa, Mycobacterium
DVSIFIDKSIPVAGGMAGG

SEQ ID NO: 1071284 - protein, 24 aa, Mycobacterium
DVTALCQALDLLVQRHPALRTVFP

SEQ ID NO: 1071285 - protein, 21 aa, Mycobacterium
DVTDIILNLKALVVSSEEDEP

SEQ ID NO: 1071286 - protein, 40 aa, Mycobacterium; identical to SEQ ID NO: 805205

SEQ ID NO: 1071287 - protein, 42 aa, Mycobacterium
DVTKVPLPRKLAKASLARLPGLYRLMRIPPEAVDYFSHPTFY

SEQ ID NO: 1071288 - protein, 24 aa, Mycobacterium
DVTPTGTYVLACGKTLVIENGRLV

SEQ ID NO: 1071289 - protein, 23 aa, Mycobacterium
DVTPYDPVYFPFDPALRDRQDLG

SEQ ID NO: 1071290 - protein, 21 aa, Mycobacterium
DVVFASHHRPTWGREGIVEFL

SEQ ID NO: 1071291 - protein, 32 aa, Mycobacterium
DVVHAHDWLVAHPAITLAQFYDVPMVSTIHAT

SEQ ID NO: 1071292 - protein, 18 aa, Mycobacterium
DVVLHFEGDRNGGLRMVR

SEQ ID NO: 1071293 - protein, 18 aa, Mycobacterium
DVVLLLPGSAHRDERAFR

SEQ ID NO: 1071294 - protein, 17 aa, Mycobacterium
DVVMGNLEFLIFNGIHA

SEQ ID NO: 1071295 - protein, 32 aa, Mycobacterium
DVVNAMVTTLPAYNLKLFLDGILQVLDGDPAG

SEQ ID NO: 1071296 - protein, 19 aa, Mycobacterium
DVVPGGPFVRRIAPVMAAE

SEQ ID NO: 1071297 - protein, 24 aa, Mycobacterium
DVVQNHLLQVLALVAMEPPVGPGA

SEQ ID NO: 1071298 - protein, 23 aa, Mycobacterium
DVVYVHGTVISSRRGELSVLADS

SEQ ID NO: 1071299 - protein, 19 aa, Mycobacterium
DVWELYYLPDDFSQARNVA

SEQ ID NO: 1071300 - protein, 20 aa, Mycobacterium
DVWTPRDRMPIFPVPEGHDP

SEQ ID NO: 1071301 - protein, 24 aa, Mycobacterium
DVYACPFAIHDRFLAGNVLTDGGF

SEQ ID NO: 1071302 - protein, 23 aa, Mycobacterium
DVYGVGATLFCALTGHPPFERRK

SEQ ID NO: 1071303 - protein, 28 aa, Mycobacterium
DWAARYTWPRFVCGLPREFFAAVRAELA

SEQ ID NO: 1071304 - protein, 18 aa, Mycobacterium
DWAVNLPEELLHAAPNQI

SEQ ID NO: 1071305 - protein, 21 aa, Mycobacterium
DWCRYYRRNGWSYGPTRDDAR

SEQ ID NO: 1071306 - protein, 17 aa, Mycobacterium
DWEGMTFAEAANRDPDL

SEQ ID NO: 1071307 - protein, 19 aa, Mycobacterium
DWEPVIPKSLRLLQVGGSR

SEQ ID NO: 1071308 - protein, 20 aa, Mycobacterium
DWGHCTVGLGLQQKLDRPAQ

SEQ ID NO: 1071309 - protein, 24 aa, Mycobacterium
DWMPNFIDLLQRKLSQIADPVLQK

SEQ ID NO: 1071310 - protein, 21 aa, Mycobacterium
DWMVATTLLSGRRTFVPWLST

SEQ ID NO: 1071311 - protein, 17 aa, Mycobacterium
DWRDELMPHYQQAQRML

SEQ ID NO: 1071312 - protein, 19 aa, Mycobacterium
DWTIRHSVAAWPAVCSGLR

SEQ ID NO: 1071313 - protein, 24 aa, Mycobacterium
DWTRLARRMSEISEAPLYIDDSPN

SEQ ID NO: 1071314 - protein, 20 aa, Mycobacterium
DWVIKRKLFQRYQDRYNMEL

SEQ ID NO: 1071315 - protein, 19 aa, Mycobacterium
DYALVCADGDWRRADIPAR

SEQ ID NO: 1071316 - protein, 23 aa, Mycobacterium
DYAQRRFGVGIAVRAGVHRGLVY

SEQ ID NO: 1071317 - protein, 38 aa, Mycobacterium
DYARAHWGGLLAPPALLMGWLTTPPWQPAERDSAGSLA

SEQ ID NO: 1071318 - protein, 27 aa, Mycobacterium
DYEVLDLLDALVGKSLLIVDRLSGRSR

SEQ ID NO: 1071319 - protein, 21 aa, Mycobacterium
DYFSHPTFYLTDHCRADLAGG

SEQ ID NO: 1071320 - protein, 18 aa, Mycobacterium
DYGLAVERAIDAYLEAWP

SEQ ID NO: 1071321 - protein, 20 aa, Mycobacterium
DYHFRRSALPRPGRVRELLE

SEQ ID NO: 1071322 - protein, 25 aa, Mycobacterium
DYKGRQVVVYFYPAASTPGCTKQAC

SEQ ID NO: 1071323 - protein, 18 aa, Mycobacterium
DYLEELLDLLDFDGDIDL

SEQ ID NO: 1071324 - protein, 20 aa, Mycobacterium
DYLEELLDLLDFDGDIDLDV

SEQ ID NO: 1071325 - protein, 18 aa, Mycobacterium
DYLKRLTAGLRRTRRRVA

SEQ ID NO: 1071326 - protein, 21 aa, Mycobacterium
DYNNGFLWRGDNQGLIFGEPG

SEQ ID NO: 1071327 - protein, 31 aa, Mycobacterium
DYPGDPWVVPKFYWTVLGVSAFLAGRQALTP

SEQ ID NO: 1071328 - protein, 24 aa, Mycobacterium
DYRDRGCPAPFLPNRVQLQTMLDV

SEQ ID NO: 1071329 - protein, 28 aa, Mycobacterium
DYRGAKNVLLVFFPLAFTGICQGELDQI

SEQ ID NO: 1071330 - protein, 26 aa, Mycobacterium
DYSEAIALARLGWAALAVGTSHAVLD

SEQ ID NO: 1071331 - protein, 23 aa, Mycobacterium
DYTITIPQIPLTIGGGGILNIPI

SEQ ID NO: 1071332 - protein, 23 aa, Mycobacterium
DYTPLALCTKAIQTLVRLPQRSV

SEQ ID NO: 1071333 - protein, 22 aa, Mycobacterium
DYTTRMVVLTPADPARFNGTVL

SEQ ID NO: 1071334 - protein, 23 aa, Mycobacterium
DYVDLYSCFPSAVQVAAHELGLP

SEQ ID NO: 1071335 - protein, 17 aa, Mycobacterium
DYVELHRRHGCTLQIGG

SEQ ID NO: 1071336 - protein, 22 aa, Mycobacterium
DYVGTIMGDLSGRLGRVLGTDT

SEQ ID NO: 1071337 - protein, 19 aa, Mycobacterium
DYYRNGGILQYVLRNMLKS

SEQ ID NO: 1071338 - protein, 33 aa, Mycobacterium; identical to SEQ ID NO: 944208

SEQ ID NO: 1071339 - protein, 25 aa, Mycobacterium
EAAAAALLPGPLLSTATASAVAGLA

SEQ ID NO: 1071340 - protein, 17 aa, Mycobacterium
EAAAKMLAGKPFKKEAA

SEQ ID NO: 1071341 - protein, 19 aa, Mycobacterium
EAAELLAAAVRNAVRIPLA

SEQ ID NO: 1071342 - protein, 17 aa, Mycobacterium
EAAFVDIGRGRNGVLYA

SEQ ID NO: 1071343 - protein, 18 aa, Mycobacterium
EAAFVMTVPPPVVAANRV

SEQ ID NO: 1071344 - protein, 25 aa, Mycobacterium
EAAKLIGAARKPVLYVGGGVIRGEA

SEQ ID NO: 1071345 - protein, 20 aa, Mycobacterium
EAALALMLDGLKPGGLLLLR

SEQ ID NO: 1071346 - protein, 18 aa, Mycobacterium
EAALPGLHDWVDEQLAQD

SEQ ID NO: 1071347 - protein, 37 aa, Mycobacterium
EAANASPLEFLLDAVNAPTQTLFGRDLIGNGTDGAAG

SEQ ID NO: 1071348 - protein, 43 aa, Mycobacterium
EAANASPLQTLEQDLLAGINAPSQMLTGRPLIGNGANGVDGTG

SEQ ID NO: 1071349 - protein, 21 aa, Mycobacterium
EAANVSPLQTLESNVVGALNT

SEQ ID NO: 1071350 - protein, 22 aa, Mycobacterium
EAAQRISQSVPWPLIREQTPSD

SEQ ID NO: 1071351 - protein, 24 aa, Mycobacterium
EAAQRLLPRPLAHTSVHVAVALEA

SEQ ID NO: 1071352 - protein, 37 aa, Mycobacterium
EAASQNLLNLVNAPTQALLNRPLIGNGANGAAGTGAS

SEQ ID NO: 1071353 - protein, 25 aa, Mycobacterium
EAATPLYLRYVIFGGERLTSSDLIP

SEQ ID NO: 1071354 - protein, 30 aa, Mycobacterium
EAATSQGIAFIPWFPLASGPLAAPDGPLRK

SEQ ID NO: 1071355 - protein, 35 aa, Mycobacterium
EAAWHAYQHPTRLHWYVPPSIRWIDRLKGVSPEFV

SEQ ID NO: 1071356 - protein, 23 aa, Mycobacterium
EAAYENWIDTRKPPLFGTEPDAR

SEQ ID NO: 1071357 - protein, 34 aa, Mycobacterium; identical to SEQ ID NO: 805654

SEQ ID NO: 1071358 - protein, 32 aa, Mycobacterium; identical to SEQ ID NO: 217368

SEQ ID NO: 1071359 - protein, 17 aa, Mycobacterium
EADGLVFPTRRWVHPIG

SEQ ID NO: 1071360 - protein, 22 aa, Mycobacterium
EADHIASFALPIDDLDLTVRSY

SEQ ID NO: 1071361 - protein, 28 aa, Mycobacterium
EADHMADLGFLPGVTRILAATPSGGQRL

SEQ ID NO: 1071362 - protein, 20 aa, Mycobacterium
EADLAARYLGAARDLGMDAV

SEQ ID NO: 1071363 - protein, 17 aa, Mycobacterium
EAEAILAQIQRLLGSPW

SEQ ID NO: 1071364 - protein, 17 aa, Mycobacterium
EAEIRGHRRTYVGALPG

SEQ ID NO: 1071365 - protein, 20 aa, Mycobacterium
EAELIEYFGVARMTVRQAVQ

SEQ ID NO: 1071366 - protein, 18 aa, Mycobacterium
EAELLPIPPPTRAGAELA

SEQ ID NO: 1071367 - protein, 18 aa, Mycobacterium
EAEMFVGIELSATMLFNH

SEQ ID NO: 1071368 - protein, 17 aa, Mycobacterium
EAEMLYALAILEASEGE

SEQ ID NO: 1071369 - protein, 26 aa, Mycobacterium
EAFDADFFAAWGKLAAVRTPTIAAVA

SEQ ID NO: 1071370 - protein, 23 aa, Mycobacterium
EAFELVVVNLYPFSQTVESGASV

SEQ ID NO: 1071371 - protein, 25 aa, Mycobacterium
EAFHQQFVQLMTTGAGSYAAAEAAN

SEQ ID NO: 1071372 - protein, 19 aa, Mycobacterium
EAFKWIQRAAMDRRTTMKR

SEQ ID NO: 1071373 - protein, 18 aa, Mycobacterium
EAFLPKLLEHGGHIAFTA

SEQ ID NO: 1071374 - protein, 17 aa, Mycobacterium
EAFLQGFRSFFGESAAD

SEQ ID NO: 1071375 - protein, 37 aa, Mycobacterium; identical to SEQ ID NO: 805777

SEQ ID NO: 1071376 - protein, 20 aa, Mycobacterium
EAGARWILDLGPGDILTRLT

SEQ ID NO: 1071377 - protein, 17 aa, Mycobacterium
EAGFVGALGVWQGGPTR

SEQ ID NO: 1071378 - protein, 21 aa, Mycobacterium
EAGLLAPHWPAPYGRGASPAE

SEQ ID NO: 1071379 - protein, 20 aa, Mycobacterium
EAGMRFLLDTYINAHASEVV

SEQ ID NO: 1071380 - protein, 23 aa, Mycobacterium
EAGRINHAYLFSGPRGCGKTSSA

SEQ ID NO: 1071381 - protein, 26 aa, Mycobacterium
EAGRPVPVRIYRAAPTPAPVVVYCHA

SEQ ID NO: 1071382 - protein, 25 aa, Mycobacterium
EAGSKWLFPLLDQLADVYKKTPESF

SEQ ID NO: 1071383 - protein, 17 aa, Mycobacterium
EAGYADVVILAYAAKFA

SEQ ID NO: 1071384 - protein, 24 aa, Mycobacterium
EAHLRKHAPWGARVSVERGDIGQP

SEQ ID NO: 1071385 - protein, 24 aa, Mycobacterium
EAHPVGFQWVIEAKTRGAQVIHID

SEQ ID NO: 1071386 - protein, 18 aa, Mycobacterium
EAHRAILDTLAGGGAYFF

SEQ ID NO: 1071387 - protein, 19 aa, Mycobacterium
EAIAERVLWLSTSMVHHAN

SEQ ID NO: 1071388 - protein, 29 aa, Mycobacterium
EAIAIANRLLPCLPTLLALSASSPFWADG

SEQ ID NO: 1071389 - protein, 24 aa, Mycobacterium
EAIALVQKIAFSLPDKYYDKVDVT

SEQ ID NO: 1071390 - protein, 37 aa, Mycobacterium
EAICKGTLWALRREAAKPGSYFWLKGGSRPVQPSAEQ

SEQ ID NO: 1071391 - protein, 26 aa, Mycobacterium
EAIDPLLPEVAWSWLVEALESRTEHV

SEQ ID NO: 1071392 - protein, 17 aa, Mycobacterium
EAIGYAVDWARTGDVVL

SEQ ID NO: 1071393 - protein, 21 aa, Mycobacterium
EAILAQIQRLLGSPWTDEHGT

SEQ ID NO: 1071394 - protein, 23 aa, Mycobacterium
EAIRRRVGRLRAQRAHVLWAHRR

SEQ ID NO: 1071395 - protein, 21 aa, Mycobacterium
EAKAELLGVDPALIEMHGAVS

SEQ ID NO: 1071396 - protein, 17 aa, Mycobacterium
EAKARVLTGRVAVVGLD

SEQ ID NO: 1071397 - protein, 18 aa, Mycobacterium
EAKRAAKWDRMTLAQWLR

SEQ ID NO: 1071398 - protein, 25 aa, Mycobacterium
EAKRFPQLTVLSIAPLLASTIRAVF

SEQ ID NO: 1071399 - protein, 17 aa, Mycobacterium
EAKYFMLRVRCDGGALS

SEQ ID NO: 1071400 - protein, 21 aa, Mycobacterium
EALAHLSTQCPVAILSGRDLT

SEQ ID NO: 1071401 - protein, 18 aa, Mycobacterium
EALAWFDHWLKSRDTGIL

SEQ ID NO: 1071402 - protein, 27 aa, Mycobacterium
EALAYGDMGLALSILAPGGVASALTHW

SEQ ID NO: 1071403 - protein, 23 aa, Mycobacterium
EALDFYARGLIHPTVEGAALEDI

SEQ ID NO: 1071404 - protein, 32 aa, Mycobacterium; identical to SEQ ID NO: 784136

SEQ ID NO: 1071405 - protein, 21 aa, Mycobacterium
EALKSALQYPALTGPVFDTLT

SEQ ID NO: 1071406 - protein, 20 aa, Mycobacterium
EALLDIYRKLRPGEPPTKES

SEQ ID NO: 1071407 - protein, 17 aa, Mycobacterium
EALPERERTVLVLRFFD

SEQ ID NO: 1071408 - protein, 20 aa, Mycobacterium
EALPFDERRLRQALNALDCG

SEQ ID NO: 1071409 - protein, 23 aa, Mycobacterium
EALRGPFWRWSPGLRAGIKLMHN

SEQ ID NO: 1071410 - protein, 17 aa, Mycobacterium
EALRIELEPHRIGVTAI

SEQ ID NO: 1071411 - protein, 23 aa, Mycobacterium
EALSGITELPWTLSIFGDGPDRE

SEQ ID NO: 1071412 - protein, 19 aa, Mycobacterium
EALVESALWEASLFEEHGF

SEQ ID NO: 1071413 - protein, 19 aa, Mycobacterium
EAMLLMRAGREYALKRALA

SEQ ID NO: 1071414 - protein, 17 aa, Mycobacterium
EAMLVATVRAFIDRDVR

SEQ ID NO: 1071415 - protein, 26 aa, Mycobacterium
EAMRAIGVPVYLLPGNHDPLDASSVY

SEQ ID NO: 1071416 - protein, 20 aa, Mycobacterium
EAMTWPLLEVIDGSLEEPWC

SEQ ID NO: 1071417 - protein, 26 aa, Mycobacterium
EANFMLIGAAFYRDQYRRTAAGWRIS

SEQ ID NO: 1071418 - protein, 23 aa, Mycobacterium
EAPLGFLLYRAAAVLRPEVSTAL

SEQ ID NO: 1071419 - protein, 19 aa, Mycobacterium
EAPMFPLEATMLPGQDLPL

SEQ ID NO: 1071420 - protein, 24 aa, Mycobacterium
EAPQAPFPLATMQHAYWIGRADEQ

SEQ ID NO: 1071421 - protein, 29 aa, Mycobacterium
EAPSPLVQRIPGMRAKLFDAARLAAEAIG

SEQ ID NO: 1071422 - protein, 17 aa, Mycobacterium
EAPVLFAMGHFLGSDRV

SEQ ID NO: 1071423 - protein, 26 aa, Mycobacterium
EAPVPQMAVLPTADPGIAAAAAPGSK

SEQ ID NO: 1071424 - protein, 17 aa, Mycobacterium
EAQGILCGSIVSGLRMR

SEQ ID NO: 1071425 - protein, 20 aa, Mycobacterium
EAQIVLRLLLERTTVIEAAD

SEQ ID NO: 1071426 - protein, 22 aa, Mycobacterium
EAQKRHFLPRILTGDDRWCQGF

SEQ ID NO: 1071427 - protein, 23 aa, Mycobacterium
EAQRDRFLFKINVGYPTPEEERE

SEQ ID NO: 1071428 - protein, 27 aa, Mycobacterium
EAQVPIVPMIVWGAQRIWPKGHPKNLF

SEQ ID NO: 1071429 - protein, 22 aa, Mycobacterium
EARGRWAAAPLATTSCTWRRDR

SEQ ID NO: 1071430 - protein, 23 aa, Mycobacterium
EARHTALPLERYAELSGFTEAND

SEQ ID NO: 1071431 - protein, 31 aa, Mycobacterium; identical to SEQ ID NO: 237197

SEQ ID NO: 1071432 - protein, 25 aa, Mycobacterium
EARKSFFRVPLIDGTITHPVQGEAA

SEQ ID NO: 1071433 - protein, 26 aa, Mycobacterium
EARKSFFRVPLIDGTITHPVQGEAAA

SEQ ID NO: 1071434 - protein, 18 aa, Mycobacterium
EARMLALDQLDRVGLKHK

SEQ ID NO: 1071435 - protein, 33 aa, Mycobacterium; identical to SEQ ID NO: 784139

SEQ ID NO: 1071436 - protein, 25 aa, Mycobacterium
EARRHGWTFPYLYDESQDVARAFSA

SEQ ID NO: 1071437 - protein, 24 aa, Mycobacterium
EARVPFLREPFGADITTIGLLIAD

SEQ ID NO: 1071438 - protein, 22 aa, Mycobacterium
EARYGIVWGAMGAARSAWQCAL

SEQ ID NO: 1071439 - protein, 23 aa, Mycobacterium
EASCVGVDRFARVRDIAALDFVS

SEQ ID NO: 1071440 - protein, 19 aa, Mycobacterium
EASFFVDRLSEESMPLAGL

SEQ ID NO: 1071441 - protein, 25 aa, Mycobacterium
EASVPYFSLAMLPGGRRSTVVAGTV

SEQ ID NO: 1071442 - protein, 29 aa, Mycobacterium
EASWADVAMMLSIPYQGLGNAAISAVATD

SEQ ID NO: 1071443 - protein, 20 aa, Mycobacterium
EATRDLGLSAFVLCSSIAAT

SEQ ID NO: 1071444 - protein, 23 aa, Mycobacterium
EATWRDIRRHLDGLKADDQLIGR

SEQ ID NO: 1071445 - protein, 27 aa, Mycobacterium
EAVAKVPTYAPGEHPMFKAMAASSSSE

SEQ ID NO: 1071446 - protein, 20 aa, Mycobacterium
EAVALFPSWETLPHERLSPG

SEQ ID NO: 1071447 - protein, 17 aa, Mycobacterium
EAVARFLSWVYVTNGPG

SEQ ID NO: 1071448 - protein, 22 aa, Mycobacterium
EAVGHFLSAFVAITPLDPSQPD

SEQ ID NO: 1071449 - protein, 23 aa, Mycobacterium
EAVPAGLRTLCAPTIVAALEHMI

SEQ ID NO: 1071450 - protein, 18 aa, Mycobacterium
EAVSLWHADADLKGVDAV

SEQ ID NO: 1071451 - protein, 18 aa, Mycobacterium
EAWRWYRDVVGAGHTPIV

SEQ ID NO: 1071452 - protein, 25 aa, Mycobacterium
EAYERLILDVLLGEPSLFPVNAEVE

SEQ ID NO: 1071453 - protein, 18 aa, Mycobacterium
EAYQLLRDGLGMSAPQIA

SEQ ID NO: 1071454 - protein, 17 aa, Mycobacterium
EAYRLLMEVLGTAATLR

SEQ ID NO: 1071455 - protein, 28 aa, Mycobacterium
EAYTWLTAELANLRLAFRWTADNNDLDD

SEQ ID NO: 1071456 - protein, 20 aa, Mycobacterium
ECAQACGLSLLGGPPSPETA

SEQ ID NO: 1071457 - protein, 19 aa, Mycobacterium
ECAQAYRVLSIHAAEFHGS

SEQ ID NO: 1071458 - protein, 38 aa, Mycobacterium; identical to SEQ ID NO: 806269

SEQ ID NO: 1071459 - protein, 23 aa, Mycobacterium
ECELLDKIFYRSGTGVTLQATAY

SEQ ID NO: 1071460 - protein, 18 aa, Mycobacterium
ECGRRMIVQIRPDGWWAR

SEQ ID NO: 1071461 - protein, 20 aa, Mycobacterium
ECHHLLATWGALVAALGSVL

SEQ ID NO: 1071462 - protein, 17 aa, Mycobacterium
ECIRALRANRQAAQRLR

SEQ ID NO: 1071463 - protein, 18 aa, Mycobacterium
ECLRDAYPLGRGHGPVSP

SEQ ID NO: 1071464 - protein, 19 aa, Mycobacterium
ECWAMQAYGAAYTLQELLT

SEQ ID NO: 1071465 - protein, 17 aa, Mycobacterium
EDADFLRKHAVLPDSRI

SEQ ID NO: 1071466 - protein, 25 aa, Mycobacterium
EDADMLGPVDLPPGVRRPAGTPDGV

SEQ ID NO: 1071467 - protein, 20 aa, Mycobacterium
EDAFDALRFSGVGIVVRHDE

SEQ ID NO: 1071468 - protein, 20 aa, Mycobacterium
EDAIRLRGLMTHMVHADAPE

SEQ ID NO: 1071469 - protein, 25 aa, Mycobacterium
EDESPIVFLRLRKAARKNGLPVYAL

SEQ ID NO: 1071470 - protein, 30 aa, Mycobacterium
EDETAWRGGEWYVARLFPGPLSADERQTTV

SEQ ID NO: 1071471 - protein, 22 aa, Mycobacterium
EDEVKLLRQAWLTATRARNALV

SEQ ID NO: 1071472 - protein, 24 aa, Mycobacterium
EDFWLKVGIDPIRIMTGAGNLYTL

SEQ ID NO: 1071473 - protein, 22 aa, Mycobacterium
EDGAFGLLRVLGAAMARLAEAE

SEQ ID NO: 1071474 - protein, 25 aa, Mycobacterium
EDGAQLWFVLDPRSPGSGLSVQPQR

SEQ ID NO: 1071475 - protein, 18 aa, Mycobacterium
EDGYLFIGGRSDDTIIRG

SEQ ID NO: 1071476 - protein, 17 aa, Mycobacterium
EDGYLYIVDRRVDMIIT

SEQ ID NO: 1071477 - protein, 28 aa, Mycobacterium
EDHAMLATGLLALYQLTSEPGWLTSACD

SEQ ID NO: 1071478 - protein, 24 aa, Mycobacterium
EDHLLRSLAPAVGRTRIYCVGVDR

SEQ ID NO: 1071479 - protein, 25 aa, Mycobacterium
EDIEQWYVSRFLAMRSTAFANPESH

SEQ ID NO: 1071480 - protein, 26 aa, Mycobacterium
EDIRLALVALGPKSLALGGRVFDDVI

SEQ ID NO: 1071481 - protein, 18 aa, Mycobacterium
EDIWIPERDPGNARLVMG

SEQ ID NO: 1071482 - protein, 24 aa, Mycobacterium
EDLLGALTVIRPLSRSASSEVAVG

SEQ ID NO: 1071483 - protein, 25 aa, Mycobacterium
EDLNQLWMCGLPGYFPGDLIDFEFS

SEQ ID NO: 1071484 - protein, 23 aa, Mycobacterium
EDLPSAIYHRFARVHSYAAVHRS

SEQ ID NO: 1071485 - protein, 40 aa, Mycobacterium
EDLTERLVLTSRQYGIEPQQLFVYLQENNQLPSMFADVRR

SEQ ID NO: 1071486 - protein, 32 aa, Mycobacterium; identical to SEQ ID NO: 806444

SEQ ID NO: 1071487 - protein, 29 aa, Mycobacterium
EDMPAYLSTSLFAFWIVDSAYSLDGRRNL

SEQ ID NO: 1071488 - protein, 28 aa, Mycobacterium
EDNRAWRLYRRLGFTDILRGYYFAGDPR

SEQ ID NO: 1071489 - protein, 28 aa, Mycobacterium
EDPDPDLLLLFSALELLHAWALIHDDVI

SEQ ID NO: 1071490 - protein, 26 aa, Mycobacterium
EDPGWANLLDLLAALGLPVEPMGVDD

SEQ ID NO: 1071491 - protein, 24 aa, Mycobacterium
EDPHPMRFYNALGAIRTVLHDNPD

SEQ ID NO: 1071492 - protein, 24 aa, Mycobacterium
EDPHYTYKLDWLAALRDTAQCWLK

SEQ ID NO: 1071493 - protein, 23 aa, Mycobacterium
EDPIKFGTLYISGPYVPPATAET

SEQ ID NO: 1071494 - protein, 20 aa, Mycobacterium
EDPRFSIARLSLLDRGMVFV

SEQ ID NO: 1071495 - protein, 25 aa, Mycobacterium
EDQARVILFLACELSAFVTGHTIPT

SEQ ID NO: 1071496 - protein, 18 aa, Mycobacterium
EDRAVLHTALRLPRDAEL

SEQ ID NO: 1071497 - protein, 17 aa, Mycobacterium
EDRGAFGDVLTAAGLPA

SEQ ID NO: 1071498 - protein, 17 aa, Mycobacterium
EDRYLMTVIATASNPRF

SEQ ID NO: 1071499 - protein, 24 aa, Mycobacterium
EDSLLQVFVLRPCIVAGPHAYSLA

SEQ ID NO: 1071500 - protein, 24 aa, Mycobacterium
EDTGLVDLIVKLGAQNALAKLPKG

SEQ ID NO: 1071501 - protein, 25 aa, Mycobacterium
EDVAPVVQGIWRLGAAMTMLQQPTS

SEQ ID NO: 1071502 - protein, 23 aa, Mycobacterium
EDVFVPTYRLIKVTDIYAGTTPG

SEQ ID NO: 1071503 - protein, 33 aa, Mycobacterium; identical to SEQ ID NO: 806545

SEQ ID NO: 1071504 - protein, 21 aa, Mycobacterium
EDYGLTPWPKTSGSRGFHVYA

SEQ ID NO: 1071505 - protein, 24 aa, Mycobacterium
EDYTNRGRIITPLKDRFGAEIRTH

SEQ ID NO: 1071506 - protein, 29 aa, Mycobacterium
EEAKSYRFNPFDLTKVWPHSDYPLIDVGK

SEQ ID NO: 1071507 - protein, 26 aa, Mycobacterium
EEALPSRPVQVIGFTSVPGAGDNFLV

SEQ ID NO: 1071508 - protein, 21 aa, Mycobacterium
EEGLLRRYLEVDRAWRDHLLV

SEQ ID NO: 1071509 - protein, 27 aa, Mycobacterium
EEHHLAATGWLPSPLILAAAVAGRTRN

SEQ ID NO: 1071510 - protein, 27 aa, Mycobacterium
EEIGRALAPVPWIDHVCAARLLARLGT

SEQ ID NO: 1071511 - protein, 22 aa, Mycobacterium
EEIYDWLRSHPSDEIREIATAF

SEQ ID NO: 1071512 - protein, 25 aa, Mycobacterium
EEKFGFLLEALTFGAPPHGGIAFGW

SEQ ID NO: 1071513 - protein, 25 aa, Mycobacterium
EELELLHPGRKFPLDGHLVGSLAEA

SEQ ID NO: 1071514 - protein, 27 aa, Mycobacterium
EELGIDVFLVMPFTTDFMKLTPDRFIH

SEQ ID NO: 1071515 - protein, 23 aa, Mycobacterium
EELIGQFGIGFYSSFMVADKVEL

SEQ ID NO: 1071516 - protein, 17 aa, Mycobacterium
EELLADWYGTEAALVYN

SEQ ID NO: 1071517 - protein, 17 aa, Mycobacterium
EELLDLLDFDGDIDLDV

SEQ ID NO: 1071518 - protein, 25 aa, Mycobacterium
EELREELVLEAGRLARLPSDLSWMR

SEQ ID NO: 1071519 - protein, 22 aa, Mycobacterium
EELRLKYRYLDLRRDGPASAIR

SEQ ID NO: 1071520 - protein, 22 aa, Mycobacterium
EELVGILGGQTRELVFAKTPPT

SEQ ID NO: 1071521 - protein, 30 aa, Mycobacterium; identical to SEQ ID NO: 806749

SEQ ID NO: 1071522 - protein, 17 aa, Mycobacterium
EENKKAFAGPRFLMRVA

SEQ ID NO: 1071523 - protein, 24 aa, Mycobacterium
EEPAFDILALVPPPADVGLGRIGT

SEQ ID NO: 1071524 - protein, 17 aa, Mycobacterium
EEQLLSHPAIRSAAAVP

SEQ ID NO: 1071525 - protein, 19 aa, Mycobacterium
EEQLWGTLLASAAATRNAQ

SEQ ID NO: 1071526 - protein, 28 aa, Mycobacterium
EESLHYEMPLILNVPTFTICCATLLDTG

SEQ ID NO: 1071527 - protein, 18 aa, Mycobacterium
EETALIARWLATPGVRVV

SEQ ID NO: 1071528 - protein, 20 aa, Mycobacterium
EETGLLPHLNPGVMSWSELS

SEQ ID NO: 1071529 - protein, 19 aa, Mycobacterium
EETGLLPHLNPGVMSWSEM

SEQ ID NO: 1071530 - protein, 25 aa, Mycobacterium
EEVASYLFHAFGANLQFAPGEFNSV

SEQ ID NO: 1071531 - protein, 25 aa, Mycobacterium
EEVKKWWDSLSPQQRGRLIDEHPPE

SEQ ID NO: 1071532 - protein, 31 aa, Mycobacterium
EEYGVTIYYTAPTLIRTFMKWGRAIPDAHDL

SEQ ID NO: 1071533 - protein, 17 aa, Mycobacterium
EFAVLQRPYQGPPVLDG

SEQ ID NO: 1071534 - protein, 25 aa, Mycobacterium
EFDEWQRLFLFTRADTIYGGSNEIQ

SEQ ID NO: 1071535 - protein, 26 aa, Mycobacterium
EFFGDGIEALYYLHPLTGDVVRQVDS

SEQ ID NO: 1071536 - protein, 18 aa, Mycobacterium
EFFTSGEFNSGVGSSGTL

SEQ ID NO: 1071537 - protein, 25 aa, Mycobacterium
EFGHVDVHLLQYSGAIWYPMVYDMP

SEQ ID NO: 1071538 - protein, 25 aa, Mycobacterium
EFIGRLLELASLRKIVHSSDGFGPA

SEQ ID NO: 1071539 - protein, 21 aa, Mycobacterium
EFLNQLQKGTIRKGVVSSIVN

SEQ ID NO: 1071540 - protein, 19 aa, Mycobacterium
EFLRTMILSLVAMTHPDQL

SEQ ID NO: 1071541 - protein, 19 aa, Mycobacterium
EFLVAGDKFVFLEINPRIQ

SEQ ID NO: 1071542 - protein, 19 aa, Mycobacterium
EFNVPTQDARWFRLCTVDG

SEQ ID NO: 1071543 - protein, 23 aa, Mycobacterium
EFSKDPVFRERMKREARIAGRLQ

SEQ ID NO: 1071544 - protein, 19 aa, Mycobacterium
EFSSFYFDTALSSSAAALP

SEQ ID NO: 1071545 - protein, 22 aa, Mycobacterium
EFVDWSLLDVLRGAAGAPGLDR

SEQ ID NO: 1071546 - protein, 18 aa, Mycobacterium
EFVENFFMFIAEEVREYM

SEQ ID NO: 1071547 - protein, 24 aa, Mycobacterium
EGADIVMIKPALGYLDVVAAAADI

SEQ ID NO: 1071548 - protein, 26 aa, Mycobacterium
EGAHGAPLPGMPFGQLAGNGGNGVSG

SEQ ID NO: 1071549 - protein, 20 aa, Mycobacterium
EGALLLARVRRDLTPLYVVH

SEQ ID NO: 1071550 - protein, 27 aa, Mycobacterium
EGAPSRLFLRYVIFGGEMLTFADLIPW

SEQ ID NO: 1071551 - protein, 32 aa, Mycobacterium
EGARSITIFAAASLKTAFTQIGERFKTANPGV

SEQ ID NO: 1071552 - protein, 17 aa, Mycobacterium
EGDDVFVALSWTKHPAP

SEQ ID NO: 1071553 - protein, 31 aa, Mycobacterium
EGDSWELLGNARWLPLVIAHGLLDELVPFPS

SEQ ID NO: 1071554 - protein, 21 aa, Mycobacterium
EGEIDLLEFFAELTSYTSTSC

SEQ ID NO: 1071555 - protein, 23 aa, Mycobacterium
EGELPRLFVVTRQAQRVRPEDEI

SEQ ID NO: 1071556 - protein, 28 aa, Mycobacterium
EGGLMACLAYTWKQVVTTPLFAENELAL

SEQ ID NO: 1071557 - protein, 27 aa, Mycobacterium
EGGQMPIHMRLPKLKGFRNRFRTEYEI

SEQ ID NO: 1071558 - protein, 20 aa, Mycobacterium
EGIFYARYNDDFLIAHPDLA

SEQ ID NO: 1071559 - protein, 18 aa, Mycobacterium
EGIKLWTTNGVVAELLVV

SEQ ID NO: 1071560 - protein, 26 aa, Mycobacterium
EGIRADRFWMMGPPTPADEVDTRKAA

SEQ ID NO: 1071561 - protein, 18 aa, Mycobacterium
EGITWLASHLQQRWARNT

SEQ ID NO: 1071562 - protein, 30 aa, Mycobacterium
EGIVIPLPDNIGVLNFTPGNIGSLNLGIGN

SEQ ID NO: 1071563 - protein, 17 aa, Mycobacterium
EGKMAAVAKRRGWPILK

SEQ ID NO: 1071564 - protein, 38 aa, Mycobacterium
EGKQPVLYVVGRKALAYYTFRNWYIAQSWTGFSEQPKY

SEQ ID NO: 1071565 - protein, 17 aa, Mycobacterium
EGLITPQIREFEPNWLV

SEQ ID NO: 1071566 - protein, 20 aa, Mycobacterium
EGLLAGVYLNLAPVIVDAGA

SEQ ID NO: 1071567 - protein, 24 aa, Mycobacterium
EGLMRRHIKPYQKPHPPIGVTGFS

SEQ ID NO: 1071568 - protein, 18 aa, Mycobacterium
EGLWAPHLGPELGGQGFG

SEQ ID NO: 1071569 - protein, 17 aa, Mycobacterium
EGMTFAEAANRDPDLHH

SEQ ID NO: 1071570 - protein, 20 aa, Mycobacterium
EGNPSWIPAASPASPESLPV

SEQ ID NO: 1071571 - protein, 23 aa, Mycobacterium
EGPIEALPIAAFSMMRAMSTRND

SEQ ID NO: 1071572 - protein, 21 aa, Mycobacterium
EGPQRFTVVALDLGIKTNTPR

SEQ ID NO: 1071573 - protein, 38 aa, Mycobacterium; identical to SEQ ID NO: 807320

SEQ ID NO: 1071574 - protein, 18 aa, Mycobacterium
EGQRRYVESLSAYARQFL

SEQ ID NO: 1071575 - protein, 20 aa, Mycobacterium
EGRGIVMRVPLEGGGRLVVE

SEQ ID NO: 1071576 - protein, 32 aa, Mycobacterium; identical to SEQ ID NO: 114182

SEQ ID NO: 1071577 - protein, 22 aa, Mycobacterium
EGRLKYCYNFLGIDHYMVAATK

SEQ ID NO: 1071578 - protein, 23 aa, Mycobacterium
EGRPKHYWSIYQKMIVKGRDFDD

SEQ ID NO: 1071579 - protein, 26 aa, Mycobacterium
EGTFEYQALLFIPSHAQHDLFNRDAV

SEQ ID NO: 1071580 - protein, 29 aa, Mycobacterium
EGTRPLRSWQRRALVKYLGTQPRDFLAVA

SEQ ID NO: 1071581 - protein, 29 aa, Mycobacterium
EGTWPHTREWLRRSFWDIPIDETRQILGL

SEQ ID NO: 1071582 - protein, 17 aa, Mycobacterium
EGVDWLVAQSDKPDLVF

SEQ ID NO: 1071583 - protein, 28 aa, Mycobacterium
EGVKVASFALAPKPELIARLKEAGAVVI

SEQ ID NO: 1071584 - protein, 19 aa, Mycobacterium
EGVLKLQIPVAEKAKPRKI

SEQ ID NO: 1071585 - protein, 27 aa, Mycobacterium
EGVNNWDPIWPKHAIRIIPGPSSMWFD

SEQ ID NO: 1071586 - protein, 22 aa, Mycobacterium
EGVRFLVGSLLPSGAVPVAQAY

SEQ ID NO: 1071587 - protein, 20 aa, Mycobacterium
EGYDMFMAMLDGVKEESVGF

SEQ ID NO: 1071588 - protein, 17 aa, Mycobacterium
EGYDPPNEKLREALCTV

SEQ ID NO: 1071589 - protein, 17 aa, Mycobacterium
EGYGWVFEGYRDGLLEA

SEQ ID NO: 1071590 - protein, 26 aa, Mycobacterium
EHAERFTLLRPLLFTIAYEILGSATE

SEQ ID NO: 1071591 - protein, 23 aa, Mycobacterium
EHALFLRQTPIFEQMLIDDGILL

SEQ ID NO: 1071592 - protein, 24 aa, Mycobacterium
EHANMFGLWLCPLGTDLPDPHRRL

SEQ ID NO: 1071593 - protein, 17 aa, Mycobacterium
EHAPVVTPQPHVPAEQP

SEQ ID NO: 1071594 - protein, 22 aa, Mycobacterium
EHAQLLRFYRDLIALRHHETDL

SEQ ID NO: 1071595 - protein, 31 aa, Mycobacterium; identical to SEQ ID NO: 807463

SEQ ID NO: 1071596 - protein, 26 aa, Mycobacterium
EHAVWALMDYGFRVVISSRFGDIFRG

SEQ ID NO: 1071597 - protein, 25 aa, Mycobacterium
EHDAHLHLRRALVDAALLGADVPAR

SEQ ID NO: 1071598 - protein, 26 aa, Mycobacterium
EHDPGPLRRLIATLPALEVPRPDWPA

SEQ ID NO: 1071599 - protein, 28 aa, Mycobacterium
EHEGKPFFGSLLEFITSAPVVAAIVEGP

SEQ ID NO: 1071600 - protein, 25 aa, Mycobacterium
EHFGRLRYAHFFKMAYQALPADGIM

SEQ ID NO: 1071601 - protein, 24 aa, Mycobacterium
EHGTTPWRDLFSPAVALADNGFDI

SEQ ID NO: 1071602 - protein, 23 aa, Mycobacterium
EHGYELLPPWESAGVVFDALAAA

SEQ ID NO: 1071603 - protein, 19 aa, Mycobacterium
EHHIHLYVRHAWQGAAQLG

SEQ ID NO: 1071604 - protein, 36 aa, Mycobacterium; identical to SEQ ID NO: 807533

SEQ ID NO: 1071605 - protein, 18 aa, Mycobacterium
EHLALQLVYTTMTGSATA

SEQ ID NO: 1071606 - protein, 30 aa, Mycobacterium; identical to SEQ ID NO: 807540

SEQ ID NO: 1071607 - protein, 26 aa, Mycobacterium
EHMDQIFVTAPPYPPSILLTGVIVNK

SEQ ID NO: 1071608 - protein, 20 aa, Mycobacterium
EHNGLIGYVLAELGYRVRRL

SEQ ID NO: 1071609 - protein, 17 aa, Mycobacterium
EHNRWAILLKLHHSMAD

SEQ ID NO: 1071610 - protein, 19 aa, Mycobacterium
EHNVTAIVELPPAGALTGI

SEQ ID NO: 1071611 - protein, 25 aa, Mycobacterium
EHNVTAIVELPPAGALTGIAKRELR

SEQ ID NO: 1071612 - protein, 17 aa, Mycobacterium
EHPALIRTDPAAIRRRI

SEQ ID NO: 1071613 - protein, 24 aa, Mycobacterium
EHPGLLRFTVGLAQITTLLMAGEV

SEQ ID NO: 1071614 - protein, 23 aa, Mycobacterium
EHPSLCLLASWVSPGSPAGRRLR

SEQ ID NO: 1071615 - protein, 28 aa, Mycobacterium
EHPYREPLWTQLITAYYLTDRQSDALGA

SEQ ID NO: 1071616 - protein, 22 aa, Mycobacterium
EHRFVAANAAYRRFSPTFTAVG

SEQ ID NO: 1071617 - protein, 18 aa, Mycobacterium
EHRLRRLVGWFDHAVELG

SEQ ID NO: 1071618 - protein, 22 aa, Mycobacterium
EHRVLIMDELTRRNPDLLAELR

SEQ ID NO: 1071619 - protein, 28 aa, Mycobacterium
EHRWVGLYDLLWHPQRLYPPEVLNAAII

SEQ ID NO: 1071620 - protein, 24 aa, Mycobacterium
EHSDYRLGLPIAGRWREVLNTDAT

SEQ ID NO: 1071621 - protein, 18 aa, Mycobacterium
EHSVALLNVIRAIVDDID

SEQ ID NO: 1071622 - protein, 28 aa, Mycobacterium
EHTDYNLGWALPIALPQRAVATLVPDHG

SEQ ID NO: 1071623 - protein, 17 aa, Mycobacterium
EHYLIHRESFTPFNIEL

SEQ ID NO: 1071624 - protein, 24 aa, Mycobacterium
EHYTAPPMPFWFTADHYDELRAIP

SEQ ID NO: 1071625 - protein, 17 aa, Mycobacterium
EIAENFRMPPALEKAWH

SEQ ID NO: 1071626 - protein, 19 aa, Mycobacterium
EIAFLVEDCAPRLVITEEV

SEQ ID NO: 1071627 - protein, 21 aa, Mycobacterium
EIAGRLAARIGSGLLVDVVGI

SEQ ID NO: 1071628 - protein, 18 aa, Mycobacterium
EIAVLLQEWFRRVPEFQI

SEQ ID NO: 1071629 - protein, 18 aa, Mycobacterium
EICYCPNTPPPPMSVKAC

SEQ ID NO: 1071630 - protein, 23 aa, Mycobacterium
EIDGQLFIDMRFIEGTDLGSVLK

SEQ ID NO: 1071631 - protein, 24 aa, Mycobacterium
EIGHYYFYRLIAPSDDHLARFREL

SEQ ID NO: 1071632 - protein, 33 aa, Mycobacterium
EIGILLRNRPAQMAAFLGVLLAGATVVTINPSR

SEQ ID NO: 1071633 - protein, 17 aa, Mycobacterium
EIGVWDNTLFIYIIGDN

SEQ ID NO: 1071634 - protein, 17 aa, Mycobacterium
EIILNLKGLVVSSEEDE

SEQ ID NO: 1071635 - protein, 17 aa, Mycobacterium
EIKRAYRKLARELHPDV

SEQ ID NO: 1071636 - protein, 25 aa, Mycobacterium
EILADYDTWIRERPRELARTVFIEL

SEQ ID NO: 1071637 - protein, 18 aa, Mycobacterium
EILDPLGFRWTNFGVAEE

SEQ ID NO: 1071638 - protein, 17 aa, Mycobacterium
EILLKRCLPMVCAISAE

SEQ ID NO: 1071639 - protein, 22 aa, Mycobacterium
EILRLLLGHPAYTSGRLTIGAV

SEQ ID NO: 1071640 - protein, 23 aa, Mycobacterium
EINEAFAPVVLAWLKEIKADPEK

SEQ ID NO: 1071641 - protein, 22 aa, Mycobacterium
EINGKPRLMCMTRMSTFAEDEI

SEQ ID NO: 1071642 - protein, 23 aa, Mycobacterium
EINPIRMYSGPGSAPMLAAVTAW

SEQ ID NO: 1071643 - protein, 23 aa, Mycobacterium
EINSARMFAGAGSGPMLSAAMAW

SEQ ID NO: 1071644 - protein, 22 aa, Mycobacterium
EINSLRIFAGTGSGPMLAAAAA

SEQ ID NO: 1071645 - protein, 20 aa, Mycobacterium
EINSLRMFTGAGSAPMLQAA

SEQ ID NO: 1071646 - protein, 18 aa, Mycobacterium
EINSLRMLIGAGTAPMLE

SEQ ID NO: 1071647 - protein, 21 aa, Mycobacterium
EIPCVCALLTLLPDNLRWLVT

SEQ ID NO: 1071648 - protein, 27 aa, Mycobacterium
EIPCVRALLTLLPGSLRWLVTVDAMHT

SEQ ID NO: 1071649 - protein, 28 aa, Mycobacterium
EIPCVRALLTLLPGSLRWLVTVDAMHTQ

SEQ ID NO: 1071650 - protein, 18 aa, Mycobacterium
EIPFADLLERFGTRLQKS

SEQ ID NO: 1071651 - protein, 20 aa, Mycobacterium
EIPGTWLCKNGMEGTLIEGD

SEQ ID NO: 1071652 - protein, 24 aa, Mycobacterium
EIPTRAMVRLLGLPDGDHVRFRRW

SEQ ID NO: 1071653 - protein, 24 aa, Mycobacterium
EIQAYDELCFPGLAAEWAEWGDRR

SEQ ID NO: 1071654 - protein, 20 aa, Mycobacterium
EIQPYLADVPVAIGGVTVVP

SEQ ID NO: 1071655 - protein, 21 aa, Mycobacterium
EIRGHRRTYVGALPGRIVRAI

SEQ ID NO: 1071656 - protein, 17 aa, Mycobacterium
EIRYMLDRRRTLGGFLP

SEQ ID NO: 1071657 - protein, 17 aa, Mycobacterium
EISAKMCGWIDGAIRSG

SEQ ID NO: 1071658 - protein, 26 aa, Mycobacterium
EISSGPYRFVYRKRFHKKCETQLTVL

SEQ ID NO: 1071659 - protein, 18 aa, Mycobacterium
EISVMFHPRRGGADIQSD

SEQ ID NO: 1071660 - protein, 23 aa, Mycobacterium
EITLTMKLKRRPIVTKYAAEIEE

SEQ ID NO: 1071661 - protein, 32 aa, Mycobacterium; identical to SEQ ID NO: 807910

SEQ ID NO: 1071662 - protein, 38 aa, Mycobacterium; identical to SEQ ID NO: 119821

SEQ ID NO: 1071663 - protein, 21 aa, Mycobacterium
EIVTWMSVAPALRDGWEDSIL

SEQ ID NO: 1071664 - protein, 29 aa, Mycobacterium
EIWSQLSQWPPLQQLLRLLPGCKAPSSSG

SEQ ID NO: 1071665 - protein, 18 aa, Mycobacterium
EIYHRPLVDSLLADQTAF

SEQ ID NO: 1071666 - protein, 30 aa, Mycobacterium
EKADQYGLRPLVRLVSWGLAGVAPDVMGIG

SEQ ID NO: 1071667 - protein, 25 aa, Mycobacterium
EKAQELGLTWLVEIGAHGVAAGPDS

SEQ ID NO: 1071668 - protein, 26 aa, Mycobacterium
EKAVKALWDTILPFAGYAFNKSHAAG

SEQ ID NO: 1071669 - protein, 24 aa, Mycobacterium
EKDVKRQLLLDALADDLKVQVGQE

SEQ ID NO: 1071670 - protein, 35 aa, Mycobacterium; identical to SEQ ID NO: 784213

SEQ ID NO: 1071671 - protein, 25 aa, Mycobacterium
EKHCYDVPICWSLRSIFDALDGVDK

SEQ ID NO: 1071672 - protein, 26 aa, Mycobacterium
EKHRAKLREFLGTMLNLPTPEQAAAA

SEQ ID NO: 1071673 - protein, 30 aa, Mycobacterium; identical to SEQ ID NO: 807979

SEQ ID NO: 1071674 - protein, 23 aa, Mycobacterium
EKLTPMTPFERKIVHDAIAAVPG

SEQ ID NO: 1071675 - protein, 17 aa, Mycobacterium
EKQLRRKIPQLTEALYG

SEQ ID NO: 1071676 - protein, 24 aa, Mycobacterium
EKRFPQLTVLSIAPLLASTIRAIF

SEQ ID NO: 1071677 - protein, 17 aa, Mycobacterium
EKSLAVDGFDPARIWGA

SEQ ID NO: 1071678 - protein, 23 aa, Mycobacterium
EKSTFIEVCYLLIYGELPNTDQL

SEQ ID NO: 1071679 - protein, 29 aa, Mycobacterium
EKTREKLFPLICRYALAYHVVFIPSVEVD

SEQ ID NO: 1071680 - protein, 19 aa, Mycobacterium
EKTRLALAGLVASTANVLL

SEQ ID NO: 1071681 - protein, 32 aa, Mycobacterium; identical to SEQ ID NO: 119826

SEQ ID NO: 1071682 - protein, 23 aa, Mycobacterium
EKVMSLFDDNIEWVQPGESEISG

SEQ ID NO: 1071683 - protein, 21 aa, Mycobacterium
EKVRRKPFSVALFDEIEKAHQ

SEQ ID NO: 1071684 - protein, 20 aa, Mycobacterium
EKVVMFYASGNWDEDAFCHP

SEQ ID NO: 1071685 - protein, 17 aa, Mycobacterium
EKWAKVRGDKLAYRFLD

SEQ ID NO: 1071686 - protein, 23 aa, Mycobacterium
EKYELDLRTRIGRKPRGSYQIAI

SEQ ID NO: 1071687 - protein, 24 aa, Mycobacterium
ELADIALRRPSLDDVFLSMTTDPS

SEQ ID NO: 1071688 - protein, 30 aa, Mycobacterium; identical to SEQ ID NO: 808064

SEQ ID NO: 1071689 - protein, 36 aa, Mycobacterium; identical to SEQ ID NO: 808071

SEQ ID NO: 1071690 - protein, 25 aa, Mycobacterium
ELAGQFRRISYAWIPRARNAHADQL

SEQ ID NO: 1071691 - protein, 21 aa, Mycobacterium
ELAGWIVEALTKADGIASAEV

SEQ ID NO: 1071692 - protein, 29 aa, Mycobacterium
ELAILVPELLLIGQLIDRSGMAWCIQAFG

SEQ ID NO: 1071693 - protein, 19 aa, Mycobacterium
ELALASYPGFTSTAPPGDG

SEQ ID NO: 1071694 - protein, 26 aa, Mycobacterium
ELAQRGWPVFLVSTVTRENLQPLIFG

SEQ ID NO: 1071695 - protein, 18 aa, Mycobacterium
ELARAVRLRSAAVAAAVA

SEQ ID NO: 1071696 - protein, 21 aa, Mycobacterium
ELARSWRVQWPQLPDAMEQAA

SEQ ID NO: 1071697 - protein, 23 aa, Mycobacterium
ELCSLTFPGYKPSAAGLVGSALF

SEQ ID NO: 1071698 - protein, 24 aa, Mycobacterium
ELDGQTHTVSWPRSAKLLDVLLAA

SEQ ID NO: 1071699 - protein, 19 aa, Mycobacterium
ELDHLIANRPIIAAEINDR

SEQ ID NO: 1071700 - protein, 18 aa, Mycobacterium
ELDIGHRTIPNYGGFDLG

SEQ ID NO: 1071701 - protein, 19 aa, Mycobacterium
ELDKAMLDWGTRELHDEMP

SEQ ID NO: 1071702 - protein, 39 aa, Mycobacterium; identical to SEQ ID NO: 808165

SEQ ID NO: 1071703 - protein, 27 aa, Mycobacterium
ELDRRGLLRRIGGAPYLHTLISTVPTA

SEQ ID NO: 1071704 - protein, 21 aa, Mycobacterium
ELDVWLISWVPGHATELHDHG

SEQ ID NO: 1071705 - protein, 18 aa, Mycobacterium
ELDWYEHLGLCPKGEAEA

SEQ ID NO: 1071706 - protein, 19 aa, Mycobacterium
ELEDFWRDHLDGAPPEIEL

SEQ ID NO: 1071707 - protein, 29 aa, Mycobacterium
ELEHHANLIPWQELARRTGATLRWYSVTD

SEQ ID NO: 1071708 - protein, 25 aa, Mycobacterium
ELEKRRAHVPWVTWGTTAMVARSVA

SEQ ID NO: 1071709 - protein, 17 aa, Mycobacterium
ELERTGYSWGPLSLMLL

SEQ ID NO: 1071710 - protein, 23 aa, Mycobacterium
ELFAAIVVLMQWGDKHLPNPDGP

SEQ ID NO: 1071711 - protein, 21 aa, Mycobacterium
ELFEQWFPASKLVRLGLCLSS

SEQ ID NO: 1071712 - protein, 18 aa, Mycobacterium
ELFGRYWPANLHMIGKDI

SEQ ID NO: 1071713 - protein, 22 aa, Mycobacterium
ELFNLRFQMATGQLNNNRRLRT

SEQ ID NO: 1071714 - protein, 17 aa, Mycobacterium
ELFRRHHRQLYHLARLT

SEQ ID NO: 1071715 - protein, 27 aa, Mycobacterium
ELGAMGFKFQFITLAGFHALNYSMFDL

SEQ ID NO: 1071716 - protein, 27 aa, Mycobacterium
ELGDVADALWYPLWDASIRLDHSVRTV

SEQ ID NO: 1071717 - protein, 19 aa, Mycobacterium
ELGELLHEILVAQVAIHLD

SEQ ID NO: 1071718 - protein, 20 aa, Mycobacterium
ELGEWLHPFEKLWREKLSAL

SEQ ID NO: 1071719 - protein, 24 aa, Mycobacterium
ELGGDFGGVWYWNRYPGLQCDNES

SEQ ID NO: 1071720 - protein, 23 aa, Mycobacterium
ELGKMGFVFNFITYGGHQIDGVA

SEQ ID NO: 1071721 - protein, 32 aa, Mycobacterium; identical to SEQ ID NO: 808292

SEQ ID NO: 1071722 - protein, 34 aa, Mycobacterium; identical to SEQ ID NO: 808296

SEQ ID NO: 1071723 - protein, 25 aa, Mycobacterium
ELGPIRPPQRLAPYSYALGAEVKHP

SEQ ID NO: 1071724 - protein, 19 aa, Mycobacterium
ELGPPLQLVAMALAHGGEP

SEQ ID NO: 1071725 - protein, 29 aa, Mycobacterium
ELGQHAWSLPQLTMRVKSFVFLAADLCTA

SEQ ID NO: 1071726 - protein, 25 aa, Mycobacterium
ELGQPLPLFIKWDDADYGLRAAEHG

SEQ ID NO: 1071727 - protein, 25 aa, Mycobacterium
ELGRAEIRALFRSSKVGLIAGCMIS

SEQ ID NO: 1071728 - protein, 25 aa, Mycobacterium
ELGRALTPVPFAATILAIEAILRMG

SEQ ID NO: 1071729 - protein, 32 aa, Mycobacterium; identical to SEQ ID NO: 808312

SEQ ID NO: 1071730 - protein, 22 aa, Mycobacterium
ELGRIRQVPSADRRVLVLGASG

SEQ ID NO: 1071731 - protein, 29 aa, Mycobacterium
ELGVKGIWVNSVAPGYIWGDTLQGYFEHQ

SEQ ID NO: 1071732 - protein, 21 aa, Mycobacterium
ELHKTIVFVTHDFGEAVKLGD

SEQ ID NO: 1071733 - protein, 18 aa, Mycobacterium
ELHRQAMALAQHLRSRMP

SEQ ID NO: 1071734 - protein, 24 aa, Mycobacterium
ELHRRANRLARWFIGQGFGPEDII

SEQ ID NO: 1071735 - protein, 28 aa, Mycobacterium
ELIALLLPRTHRGIIAILAVLKTGAGYL

SEQ ID NO: 1071736 - protein, 18 aa, Mycobacterium
ELIARIRAVLRRGGDDDS

SEQ ID NO: 1071737 - protein, 22 aa, Mycobacterium
ELILAALEFWMDEHHYAGLAEQ

SEQ ID NO: 1071738 - protein, 20 aa, Mycobacterium
ELIREYPQLAAFEFAIRAED

SEQ ID NO: 1071739 - protein, 20 aa, Mycobacterium
ELITMLIRFRTQAVASITAT

SEQ ID NO: 1071740 - protein, 29 aa, Mycobacterium
ELKKHFRPEFLNRIDDIIVFHQLTRDEII

SEQ ID NO: 1071741 - protein, 19 aa, Mycobacterium
ELKLLPQEEWAGRLRRLIA

SEQ ID NO: 1071742 - protein, 22 aa, Mycobacterium
ELKQGWLEIDSEIKELFLRGQR

SEQ ID NO: 1071743 - protein, 28 aa, Mycobacterium
ELLAAERARLRFLLVDDAQQLDPQAARL

SEQ ID NO: 1071744 - protein, 20 aa, Mycobacterium
ELLADVVNRVWFLDAVRGEV

SEQ ID NO: 1071745 - protein, 18 aa, Mycobacterium
ELLAHYRALAGDHLEVLA

SEQ ID NO: 1071746 - protein, 18 aa, Mycobacterium
ELLARMRALLRRTKLEDD

SEQ ID NO: 1071747 - protein, 20 aa, Mycobacterium
ELLDARLVFEPLAASLAAEH

SEQ ID NO: 1071748 - protein, 17 aa, Mycobacterium
ELLDKLVAEGVVLAPPP

SEQ ID NO: 1071749 - protein, 17 aa, Mycobacterium
ELLGAARALMLDVIVKV

SEQ ID NO: 1071750 - protein, 17 aa, Mycobacterium
ELLKILESRLDNVVYRA

SEQ ID NO: 1071751 - protein, 17 aa, Mycobacterium
ELLLDVLGPAALDSGAT

SEQ ID NO: 1071752 - protein, 22 aa, Mycobacterium
ELLNRWPQWDIGYDSLQLAPTS

SEQ ID NO: 1071753 - protein, 18 aa, Mycobacterium
ELLPEAFAVAREAAWRVL

SEQ ID NO: 1071754 - protein, 25 aa, Mycobacterium
ELLRSRVFFDWFDAVGVDDIPAVFA

SEQ ID NO: 1071755 - protein, 24 aa, Mycobacterium
ELNRFVFAMPEQLGRVYLGLTDED

SEQ ID NO: 1071756 - protein, 24 aa, Mycobacterium
ELPATAQVWRRGLLDGQHVKVIAA

SEQ ID NO: 1071757 - protein, 28 aa, Mycobacterium
ELPATEFAGFLWVSLHPAARLDVPAHLG

SEQ ID NO: 1071758 - protein, 23 aa, Mycobacterium
ELPMQMICILLGVPESERHWLFE

SEQ ID NO: 1071759 - protein, 25 aa, Mycobacterium
ELPPLPTITRFAFQGGVQNIQRGMV

SEQ ID NO: 1071760 - protein, 18 aa, Mycobacterium
ELPRHSWLDGYRDSWRYG

SEQ ID NO: 1071761 - protein, 27 aa, Mycobacterium
ELPRLPRTALIDVLLRCPPRTRSAAPL

SEQ ID NO: 1071762 - protein, 19 aa, Mycobacterium
ELPSLRKILHLDSDGPAAL

SEQ ID NO: 1071763 - protein, 25 aa, Mycobacterium
ELPTRYLGLVTAVEYGRRARLAVEA

SEQ ID NO: 1071764 - protein, 18 aa, Mycobacterium
ELPTWQWESLIGESTRLV

SEQ ID NO: 1071765 - protein, 22 aa, Mycobacterium
ELPTYAFEKRRFWLSGEGVSVD

SEQ ID NO: 1071766 - protein, 24 aa, Mycobacterium
ELQLERLFVLTFETEFFTAHGFTE

SEQ ID NO: 1071767 - protein, 22 aa, Mycobacterium
ELQNAIQLNSSFPSPGSAAAVS

SEQ ID NO: 1071768 - protein, 18 aa, Mycobacterium
ELQRSYVQALWRATKPGA

SEQ ID NO: 1071769 - protein, 17 aa, Mycobacterium
ELQRVVASIPVKRLRQA

SEQ ID NO: 1071770 - protein, 17 aa, Mycobacterium
ELRAFCREPGRRTWRAR

SEQ ID NO: 1071771 - protein, 22 aa, Mycobacterium
ELRAPMEQATPLRRLGDPVDIA

SEQ ID NO: 1071772 - protein, 22 aa, Mycobacterium
ELRDRAFYAPAQSRYRVFIIDE

SEQ ID NO: 1071773 - protein, 24 aa, Mycobacterium
ELREAVPLIPLDQLLVETDAPFLT

SEQ ID NO: 1071774 - protein, 17 aa, Mycobacterium
ELRELWWQEAERNRVLP

SEQ ID NO: 1071775 - protein, 18 aa, Mycobacterium
ELRIKPRFGHVPVDEITR

SEQ ID NO: 1071776 - protein, 23 aa, Mycobacterium
ELRPAFDDIRPLRHGSIDDALTD

SEQ ID NO: 1071777 - protein, 24 aa, Mycobacterium
ELRPQHRALRQQIPEVYKGFAALS

SEQ ID NO: 1071778 - protein, 25 aa, Mycobacterium
ELRQRQIGVGWATLRSPPAAAGSPA

SEQ ID NO: 1071779 - protein, 26 aa, Mycobacterium
ELRRRYLDQLLAGKTLAALAITEPEV

SEQ ID NO: 1071780 - protein, 25 aa, Mycobacterium
ELRSLRARFGTLIGVDRPVALGDFV

SEQ ID NO: 1071781 - protein, 26 aa, Mycobacterium
ELRSLRARFGTLIGVDRPVALGDFVS

SEQ ID NO: 1071782 - protein, 22 aa, Mycobacterium
ELRVLGLHLLHLLQTVSYNSAD

SEQ ID NO: 1071783 - protein, 20 aa, Mycobacterium
ELRYTMPLGEIIFDFFDSLI

SEQ ID NO: 1071784 - protein, 22 aa, Mycobacterium
ELSAKLAVLWFPNQGSEDVHRP

SEQ ID NO: 1071785 - protein, 24 aa, Mycobacterium
ELSKELRPWVPVVSLVKGLEQGTN

SEQ ID NO: 1071786 - protein, 22 aa, Mycobacterium
ELSKLYLLPDQHGTGTAKALMD

SEQ ID NO: 1071787 - protein, 34 aa, Mycobacterium; identical to SEQ ID NO: 808647

SEQ ID NO: 1071788 - protein, 22 aa, Mycobacterium
ELTDLLWRMGIRTVGQFAALSR

SEQ ID NO: 1071789 - protein, 20 aa, Mycobacterium
ELTPEERLLRAIFGEKAREV

SEQ ID NO: 1071790 - protein, 17 aa, Mycobacterium
ELTSEGIVIPLPDNIGV

SEQ ID NO: 1071791 - protein, 19 aa, Mycobacterium
ELTSPMLEVPFSGSGLHHD

SEQ ID NO: 1071792 - protein, 25 aa, Mycobacterium
ELTYRKVFPFLLRLYHRILQTSDPN

SEQ ID NO: 1071793 - protein, 18 aa, Mycobacterium
ELVALKERGFRLLALTPK

SEQ ID NO: 1071794 - protein, 31 aa, Mycobacterium; identical to SEQ ID NO: 808726

SEQ ID NO: 1071795 - protein, 20 aa, Mycobacterium
ELVLDRRGNRHFSFGIGVHR

SEQ ID NO: 1071796 - protein, 24 aa, Mycobacterium
ELVLLLVVHHICWDDDSWEVFFGE

SEQ ID NO: 1071797 - protein, 19 aa, Mycobacterium
ELVPVYPTCHYVMGGIPTT

SEQ ID NO: 1071798 - protein, 23 aa, Mycobacterium
ELVRRGCPFSGLLYAGLAITAKG

SEQ ID NO: 1071799 - protein, 21 aa, Mycobacterium
ELVRSFYTNWFSLDSSVRDLF

SEQ ID NO: 1071800 - protein, 17 aa, Mycobacterium
ELWLVDAGPDTPAGKFG

SEQ ID NO: 1071801 - protein, 23 aa, Mycobacterium
ELWSTFMQKWIAYTAKIIEAERE

SEQ ID NO: 1071802 - protein, 25 aa, Mycobacterium
ELYRVNLHHVLLATHAFLPAMIEQH

SEQ ID NO: 1071803 - protein, 19 aa, Mycobacterium
EMAATLAGFGYAVLLPDMY

SEQ ID NO: 1071804 - protein, 32 aa, Mycobacterium
EMCTIGDPLLDLGWLLATWRQSDGASVFGHAL

SEQ ID NO: 1071805 - protein, 22 aa, Mycobacterium
EMDAAWALFEAYIKILTGEVDT

SEQ ID NO: 1071806 - protein, 19 aa, Mycobacterium
EMEGWFWRLTDRASGRVVV

SEQ ID NO: 1071807 - protein, 34 aa, Mycobacterium; identical to SEQ ID NO: 808828

SEQ ID NO: 1071808 - protein, 19 aa, Mycobacterium
EMIAVAPSMLWSMTVDLEW

SEQ ID NO: 1071809 - protein, 25 aa, Mycobacterium
EMLDTLIREKWLTANGVIGFFPANA

SEQ ID NO: 1071810 - protein, 18 aa, Mycobacterium
EMPDGDYPFLLNTGRLAH

SEQ ID NO: 1071811 - protein, 18 aa, Mycobacterium
EMQFGTNHLGHFALTGLL

SEQ ID NO: 1071812 - protein, 26 aa, Mycobacterium
EMRELAYRLLPSRFVAALAAAGPIGE

SEQ ID NO: 1071813 - protein, 18 aa, Mycobacterium
EMRPYIAEMARIADTFVS

SEQ ID NO: 1071814 - protein, 25 aa, Mycobacterium
EMSARHPGNIAALARVAPPAIGVVL

SEQ ID NO: 1071815 - protein, 22 aa, Mycobacterium
EMTWNWDCLLPDGTIEYNPAKS

SEQ ID NO: 1071816 - protein, 23 aa, Mycobacterium
EMVVYGFLLLSFTQFVDWIRCAA

SEQ ID NO: 1071817 - protein, 24 aa, Mycobacterium
ENANGLLRQYFPKGTSLSTHTPDH

SEQ ID NO: 1071818 - protein, 22 aa, Mycobacterium
ENASRVIVHFYNSTSILQRRVV

SEQ ID NO: 1071819 - protein, 23 aa, Mycobacterium
ENASRVIVHFYNSTSILQRRVVF

SEQ ID NO: 1071820 - protein, 23 aa, Mycobacterium
ENAVAPWNAGTTDNVWQGGWRHR

SEQ ID NO: 1071821 - protein, 20 aa, Mycobacterium
ENFREMLPLGGWEITYLGPT

SEQ ID NO: 1071822 - protein, 35 aa, Mycobacterium
ENGNWAWRYDGIRAFPDFAVLWDVDALAAPVTLVR

SEQ ID NO: 1071823 - protein, 25 aa, Mycobacterium
ENGRSWSRWSFIGAGAPTALTVRDG

SEQ ID NO: 1071824 - protein, 25 aa, Mycobacterium
ENGWGIMRRVTLAQWRFRQTRWPSS

SEQ ID NO: 1071825 - protein, 21 aa, Mycobacterium
ENIKRQWWRSVVTGREDVVGL

SEQ ID NO: 1071826 - protein, 22 aa, Mycobacterium
ENKAYYIAAAFPSACGKTNLAM

SEQ ID NO: 1071827 - protein, 17 aa, Mycobacterium
ENKLSCPIYTFIGSKDW

SEQ ID NO: 1071828 - protein, 23 aa, Mycobacterium
ENLEAFLRVMVYDQKLITPELVD

SEQ ID NO: 1071829 - protein, 22 aa, Mycobacterium
ENLHGQFVTTLNSSAFSYASAE

SEQ ID NO: 1071830 - protein, 18 aa, Mycobacterium
ENLPSYIYRSVDPVVAEM

SEQ ID NO: 1071831 - protein, 21 aa, Mycobacterium
ENLRLAWPFENAPVDLLAAAR

SEQ ID NO: 1071832 - protein, 25 aa, Mycobacterium
ENLVNAPVLGLTGRPLIGNGANGAA

SEQ ID NO: 1071833 - protein, 30 aa, Mycobacterium
ENPSFSVVAPLLSRSLILQLHPLGAEDIRA

SEQ ID NO: 1071834 - protein, 18 aa, Mycobacterium
ENRFVGRVGLFRNQPGDI

SEQ ID NO: 1071835 - protein, 24 aa, Mycobacterium
ENTNGLLRDYFPKGVTPISHPPAH

SEQ ID NO: 1071836 - protein, 19 aa, Mycobacterium
ENYHRLTTPSTWLEALVKT

SEQ ID NO: 1071837 - protein, 17 aa, Mycobacterium
ENYSGWFHHRSTTELYP

SEQ ID NO: 1071838 - protein, 24 aa, Mycobacterium
EPAARLRALQRLENARRRQAVVSH

SEQ ID NO: 1071839 - protein, 32 aa, Mycobacterium
EPADSRAAIADWLYWKHLSGLLHAALNPKLAA

SEQ ID NO: 1071840 - protein, 23 aa, Mycobacterium
EPAFAIDVEWTLLASLARLGRPD

SEQ ID NO: 1071841 - protein, 30 aa, Mycobacterium; identical to SEQ ID NO: 809062

SEQ ID NO: 1071842 - protein, 24 aa, Mycobacterium
EPDHLRLVTLPWSRDLAAAIERLG

SEQ ID NO: 1071843 - protein, 34 aa, Mycobacterium; identical to SEQ ID NO: 809094

SEQ ID NO: 1071844 - protein, 20 aa, Mycobacterium
EPDTRLLSETELWQLAFEVV

SEQ ID NO: 1071845 - protein, 22 aa, Mycobacterium
EPDWGPFLAPAAPAGAPNVLMI

SEQ ID NO: 1071846 - protein, 25 aa, Mycobacterium
EPFEPRLSLQWWVRVESLAKAAGDA

SEQ ID NO: 1071847 - protein, 17 aa, Mycobacterium
EPFLRWLLGLILQIAET

SEQ ID NO: 1071848 - protein, 20 aa, Mycobacterium
EPFWVQTPQRPDGSGVVLVV

SEQ ID NO: 1071849 - protein, 26 aa, Mycobacterium
EPGAYICVYPFVRSYEWYLLPDEERR

SEQ ID NO: 1071850 - protein, 24 aa, Mycobacterium
EPGDFVILNWRAVCGQCRACKRGR

SEQ ID NO: 1071851 - protein, 31 aa, Mycobacterium
EPGHWYSAGADFKRPRPQWWFDDEAVYGPDG

SEQ ID NO: 1071852 - protein, 26 aa, Mycobacterium
EPGNSLFITVNCWGRLVTGVGAALGK

SEQ ID NO: 1071853 - protein, 27 aa, Mycobacterium
EPGVGKSTLLLEVAHRWAQSGQRVLYI

SEQ ID NO: 1071854 - protein, 22 aa, Mycobacterium
EPHPQIPTTPWHHTHHWIDNAA

SEQ ID NO: 1071855 - protein, 24 aa, Mycobacterium
EPIRPYERLLYAGLIGDRQLFARE

SEQ ID NO: 1071856 - protein, 21 aa, Mycobacterium
EPKARFYFVHSYAAQRWEGSS

SEQ ID NO: 1071857 - protein, 26 aa, Mycobacterium
EPLDTGRLLPLRRLVTRGAIVIDEPH

SEQ ID NO: 1071858 - protein, 18 aa, Mycobacterium
EPLFSLLNPRDADNLTKG

SEQ ID NO: 1071859 - protein, 21 aa, Mycobacterium
EPLGRFDALLLPTTTEHPSLA

SEQ ID NO: 1071860 - protein, 18 aa, Mycobacterium
EPLLAQLGGRFWFSIDDG

SEQ ID NO: 1071861 - protein, 31 aa, Mycobacterium
EPLPGQPLDRPFAWALIKLDGADTPLLHAVD

SEQ ID NO: 1071862 - protein, 17 aa, Mycobacterium
EPPAGDPGRLFGRMLGC

SEQ ID NO: 1071863 - protein, 22 aa, Mycobacterium
EPPASTVFLLCAPSVDPEDIAV

SEQ ID NO: 1071864 - protein, 17 aa, Mycobacterium
EPPGTRMRVALSALTMA

SEQ ID NO: 1071865 - protein, 24 aa, Mycobacterium
EPRVLQIRALVLGGAMDWLQDNEA

SEQ ID NO: 1071866 - protein, 23 aa, Mycobacterium
EPRYQVRYLIRDPDAPSGWVETS

SEQ ID NO: 1071867 - protein, 18 aa, Mycobacterium
EPSLDGVVLHYFLHAEPT

SEQ ID NO: 1071868 - protein, 29 aa, Mycobacterium
EPSMYRFHRRLASFSRLIRFDHRGVGLSS

SEQ ID NO: 1071869 - protein, 27 aa, Mycobacterium
EPTELNSVVWPRHRYLTFGSDLGEVAE

SEQ ID NO: 1071870 - protein, 23 aa, Mycobacterium
EPTLLPREYFERVFALQREVFPS

SEQ ID NO: 1071871 - protein, 26 aa, Mycobacterium
EPTQALTGRPLIGNGTPGAAGSGTDG

SEQ ID NO: 1071872 - protein, 19 aa, Mycobacterium
EPTYILRGLTELHITFTPA

SEQ ID NO: 1071873 - protein, 24 aa, Mycobacterium
EPVAGLTWLPFIGERYTAVAGGPL

SEQ ID NO: 1071874 - protein, 29 aa, Mycobacterium
EPVGVVGAIVPWNFPFEVTINKLGQALGT

SEQ ID NO: 1071875 - protein, 18 aa, Mycobacterium
EPVPPPAPGRLPPLTPGE

SEQ ID NO: 1071876 - protein, 24 aa, Mycobacterium
EPWGVVTEKGRWYLVGHDRDRGAT

SEQ ID NO: 1071877 - protein, 27 aa, Mycobacterium
EQAFPALRPLRFLQQSALLESLFTTML

SEQ ID NO: 1071878 - protein, 26 aa, Mycobacterium
EQAGPDALVVVLLPDGGRGYMSKIFN

SEQ ID NO: 1071879 - protein, 23 aa, Mycobacterium
EQAQWLDVLHWSQLVIQLADGDP

SEQ ID NO: 1071880 - protein, 23 aa, Mycobacterium
EQARKHRVLKATKFLGHLEHAEL

SEQ ID NO: 1071881 - protein, 25 aa, Mycobacterium
EQARRLVIRGFFGEIISKIAVPEVR

SEQ ID NO: 1071882 - protein, 28 aa, Mycobacterium
EQAVLDLINSPAVALTGRPLIGNGADGA

SEQ ID NO: 1071883 - protein, 19 aa, Mycobacterium
EQDLRREYLAMEIAVAVVD

SEQ ID NO: 1071884 - protein, 37 aa, Mycobacterium
EQDQNELLVSWLPQYHDFGLIFMALQALYLGATLVSM

SEQ ID NO: 1071885 - protein, 25 aa, Mycobacterium
EQELRGLLGAFMFTGPQLDQPAGTL

SEQ ID NO: 1071886 - protein, 21 aa, Mycobacterium
EQERALRRWIISTDTDRDGNT

SEQ ID NO: 1071887 - protein, 26 aa, Mycobacterium
EQEYFLVDRHFFVARPELVNAGRTVF

SEQ ID NO: 1071888 - protein, 18 aa, Mycobacterium
EQFLARQAVQLRPDQLEK

SEQ ID NO: 1071889 - protein, 22 aa, Mycobacterium
EQHPIPEWIVVGAGTGGTSATI

SEQ ID NO: 1071890 - protein, 19 aa, Mycobacterium
EQIAALRTIILTGGNQIRL

SEQ ID NO: 1071891 - protein, 23 aa, Mycobacterium
EQIKRFRILPTLWEPGGDEITLT

SEQ ID NO: 1071892 - protein, 34 aa, Mycobacterium; identical to SEQ ID NO: 126034

SEQ ID NO: 1071893 - protein, 23 aa, Mycobacterium
EQKQRWLPGIADGTLTMAFAITE

SEQ ID NO: 1071894 - protein, 18 aa, Mycobacterium
EQKRPGYLLLSTDVARFP

SEQ ID NO: 1071895 - protein, 20 aa, Mycobacterium
EQLEIELNWIDEHIGDHPYG

SEQ ID NO: 1071896 - protein, 25 aa, Mycobacterium
EQLGRWLPEMFGTPGDPKLGAFCSS

SEQ ID NO: 1071897 - protein, 28 aa, Mycobacterium
EQLLAELARVWKLLPFEADWFSSNELAR

SEQ ID NO: 1071898 - protein, 23 aa, Mycobacterium
EQLLKQLLNRVQWIYAGIASDTG

SEQ ID NO: 1071899 - protein, 17 aa, Mycobacterium
EQLQRLGGFSWSGAAEP

SEQ ID NO: 1071900 - protein, 26 aa, Mycobacterium
EQLRHTIPELPWLSRKRIQQEWGISD

SEQ ID NO: 1071901 - protein, 18 aa, Mycobacterium
EQLTRPTLMGRPVLVGGM

SEQ ID NO: 1071902 - protein, 34 aa, Mycobacterium
EQNALGLINAPTQTLLGRPLIGDGAAGTATNPNG

SEQ ID NO: 1071903 - protein, 30 aa, Mycobacterium
EQNLLGLINAPTQALFGRPLIGNGADGAPG

SEQ ID NO: 1071904 - protein, 25 aa, Mycobacterium
EQNQTVLPFAWQGVSLHAAGASRCR

SEQ ID NO: 1071905 - protein, 19 aa, Mycobacterium
EQPGFGGIGIGCDVGGWFD

SEQ ID NO: 1071906 - protein, 25 aa, Mycobacterium
EQQKEFADLLGWLKETLGEQVKEVR

SEQ ID NO: 1071907 - protein, 21 aa, Mycobacterium
EQQPTVAAVLAGPRGPVGAVA

SEQ ID NO: 1071908 - protein, 23 aa, Mycobacterium
EQRHHLADNAAFFREILPGRDAP

SEQ ID NO: 1071909 - protein, 20 aa, Mycobacterium
EQRIYALSPQALSRPRDMRR

SEQ ID NO: 1071910 - protein, 22 aa, Mycobacterium
EQRSRLFKQLGDSTLGAVASIF

SEQ ID NO: 1071911 - protein, 22 aa, Mycobacterium
EQRTNWLNNFYFGGNHGVSDSI

SEQ ID NO: 1071912 - protein, 23 aa, Mycobacterium
EQRTNWLNNFYFGGNHGVSDSIA

SEQ ID NO: 1071913 - protein, 29 aa, Mycobacterium
EQSIWEPTVALARKLWQVGVGTAVYSPAD

SEQ ID NO: 1071914 - protein, 27 aa, Mycobacterium
EQSNNISRVAWLTAGLPGHVGATTVDC

SEQ ID NO: 1071915 - protein, 19 aa, Mycobacterium
EQSRPCEVSYRGDARPIPL

SEQ ID NO: 1071916 - protein, 22 aa, Mycobacterium
EQTQWPGWVPVGRMGVPEDQAR

SEQ ID NO: 1071917 - protein, 31 aa, Mycobacterium; identical to SEQ ID NO: 809618

SEQ ID NO: 1071918 - protein, 17 aa, Mycobacterium
EQVSCELPLQAIAGLMG

SEQ ID NO: 1071919 - protein, 17 aa, Mycobacterium
EQWAALESLLSSGALPP

SEQ ID NO: 1071920 - protein, 20 aa, Mycobacterium
ERADVVLAGLRFAVVHETGA

SEQ ID NO: 1071921 - protein, 20 aa, Mycobacterium
ERALLLCYRQRRWYLEGSYE

SEQ ID NO: 1071922 - protein, 18 aa, Mycobacterium
ERARWVTPRLVSKSGWRS

SEQ ID NO: 1071923 - protein, 25 aa, Mycobacterium
ERASLRLIQKVLRGPLGPIAARLVN

SEQ ID NO: 1071924 - protein, 26 aa, Mycobacterium
ERASQQAFLFGPPPLGPEAAPLDRLI

SEQ ID NO: 1071925 - protein, 28 aa, Mycobacterium
ERAVQAWRGFSRWLMRAYDVLVDEDQIA

SEQ ID NO: 1071926 - protein, 24 aa, Mycobacterium
ERDAIPLLDQLYGGALRMTRNPAD

SEQ ID NO: 1071927 - protein, 25 aa, Mycobacterium
ERDGQWWYENLSGAPMPDWLGNALS

SEQ ID NO: 1071928 - protein, 22 aa, Mycobacterium
ERDRPLLQLAWDYATEGDEPSG

SEQ ID NO: 1071929 - protein, 24 aa, Mycobacterium
ERDRYRVRWIPQRAVKGVYYGTPI

SEQ ID NO: 1071930 - protein, 19 aa, Mycobacterium
EREFTAYGIPFLPVGDRVT

SEQ ID NO: 1071931 - protein, 17 aa, Mycobacterium
EREGMQIPLLIGGATTS

SEQ ID NO: 1071932 - protein, 21 aa, Mycobacterium
ERFLTEFPGLRLIGLDRDPSA

SEQ ID NO: 1071933 - protein, 17 aa, Mycobacterium
ERFVAAHQPFLDWRPRP

SEQ ID NO: 1071934 - protein, 17 aa, Mycobacterium
ERGFLAVRLEDIGAAAG

SEQ ID NO: 1071935 - protein, 23 aa, Mycobacterium
ERGFSLGHFPQSFEYATIGGFAA

SEQ ID NO: 1071936 - protein, 25 aa, Mycobacterium
ERGIRTDFALVHAWKGDRHGNLLYR

SEQ ID NO: 1071937 - protein, 26 aa, Mycobacterium
ERGRSARAWLFTVARNMIIDDRRSAR

SEQ ID NO: 1071938 - protein, 28 aa, Mycobacterium
ERGYDETLWRLLCEQVGAAALVIPEELG

SEQ ID NO: 1071939 - protein, 25 aa, Mycobacterium
ERHKNRPVLFLGDTTLTGGQLAERI

SEQ ID NO: 1071940 - protein, 17 aa, Mycobacterium
ERHLDVDALLALARHGC

SEQ ID NO: 1071941 - protein, 30 aa, Mycobacterium
ERIAALPVNQLIMIKLALNSALLQQGGVNS

SEQ ID NO: 1071942 - protein, 19 aa, Mycobacterium
ERIDTDVLAALRSAERDPA

SEQ ID NO: 1071943 - protein, 27 aa, Mycobacterium
ERIDTSLPNWWPSILAPIVAGVGAWRG

SEQ ID NO: 1071944 - protein, 17 aa, Mycobacterium
ERIFAAPYITLCIPDNA

SEQ ID NO: 1071945 - protein, 17 aa, Mycobacterium
ERIYVEALVFDTFVSKL

SEQ ID NO: 1071946 - protein, 22 aa, Mycobacterium
ERKKLVWWDAELGEWTGHDVPD

SEQ ID NO: 1071947 - protein, 18 aa, Mycobacterium
ERLDGLPLAIELAAARLR

SEQ ID NO: 1071948 - protein, 21 aa, Mycobacterium
ERLEDRVCMVALTLAAGDTGL

SEQ ID NO: 1071949 - protein, 22 aa, Mycobacterium
ERLEDRVCMVALTLAAGDTGLA

SEQ ID NO: 1071950 - protein, 21 aa, Mycobacterium
ERLGFTRYWVAEHHNMASVGA

SEQ ID NO: 1071951 - protein, 19 aa, Mycobacterium
ERLQLAIAWANILLQRKVP

SEQ ID NO: 1071952 - protein, 28 aa, Mycobacterium
ERLQQVQSWLFNQPNTSVLIAPSFAISA

SEQ ID NO: 1071953 - protein, 23 aa, Mycobacterium
ERLVMDRLLRLQAADDRLGDVRG

SEQ ID NO: 1071954 - protein, 18 aa, Mycobacterium
ERMLALQRIAGADELVVT

SEQ ID NO: 1071955 - protein, 24 aa, Mycobacterium
ERMRHGMYWSGDLAYRDSQGWIYL

SEQ ID NO: 1071956 - protein, 21 aa, Mycobacterium
ERMTTPVPKREWKEVVLLAGG

SEQ ID NO: 1071957 - protein, 30 aa, Mycobacterium; identical to SEQ ID NO: 809931

SEQ ID NO: 1071958 - protein, 24 aa, Mycobacterium
ERPTPGPLKWNLTLGVATDTRESL

SEQ ID NO: 1071959 - protein, 21 aa, Mycobacterium
ERPVLFVGLRVGDPAPCAALR

SEQ ID NO: 1071960 - protein, 17 aa, Mycobacterium
ERPVPGVRVLLVSLGAE

SEQ ID NO: 1071961 - protein, 17 aa, Mycobacterium
ERQKQILLDIYASFTQQ

SEQ ID NO: 1071962 - protein, 24 aa, Mycobacterium
ERRDIAPRRILPDSAIIDAALSDP

SEQ ID NO: 1071963 - protein, 23 aa, Mycobacterium
ERRDYILELLLEQTTAGLSYEQC

SEQ ID NO: 1071964 - protein, 19 aa, Mycobacterium
ERRGPICYLVHAGVGMDFG

SEQ ID NO: 1071965 - protein, 23 aa, Mycobacterium
ERRLYLVETAEKGILWMRLTAQG

SEQ ID NO: 1071966 - protein, 29 aa, Mycobacterium
ERRRFSMNYVFALYALPGPMTISQMGRQF

SEQ ID NO: 1071967 - protein, 22 aa, Mycobacterium
ERSLDFYGMYVLPELEGLDGFC

SEQ ID NO: 1071968 - protein, 26 aa, Mycobacterium
ERSSHTWFVLTHLLGKPGVRNYDGSW

SEQ ID NO: 1071969 - protein, 26 aa, Mycobacterium
ERSVALRAVLRERGWDRDAVEAALLG

SEQ ID NO: 1071970 - protein, 25 aa, Mycobacterium
ERTAQIVWGARALGGPVPIPEDVNR

SEQ ID NO: 1071971 - protein, 23 aa, Mycobacterium
ERTDIPWIAVGDPLPHVAGFRRS

SEQ ID NO: 1071972 - protein, 24 aa, Mycobacterium
ERTFIAPSRFHVVPVLAYSADIPV

SEQ ID NO: 1071973 - protein, 28 aa, Mycobacterium
ERTGYSWGPLSLMLLATAIAQQGNIAET

SEQ ID NO: 1071974 - protein, 28 aa, Mycobacterium
ERTPHVLGCIYSVFTEGYWATGGPSAIR

SEQ ID NO: 1071975 - protein, 18 aa, Mycobacterium
ERTPWYHRNVDYDEIAFF

SEQ ID NO: 1071976 - protein, 32 aa, Mycobacterium
ERTQDFMTWFLETVPIAPIWLCPLRLRDSDGW

SEQ ID NO: 1071977 - protein, 24 aa, Mycobacterium
ERTRRNFLYPRWSDFFDGIDPRRI

SEQ ID NO: 1071978 - protein, 24 aa, Mycobacterium
ERTTLWHSTFAQCSMLGSVFVSCR

SEQ ID NO: 1071979 - protein, 19 aa, Mycobacterium
ERVDVVQPVLFAVMVSLAR

SEQ ID NO: 1071980 - protein, 24 aa, Mycobacterium
ERVEGPLLSLLLAMTGRAAGCVDL

SEQ ID NO: 1071981 - protein, 22 aa, Mycobacterium
ERVHGRLRLGPGWVSHILQDLA

SEQ ID NO: 1071982 - protein, 23 aa, Mycobacterium
ERWDVIQFVRYPSLEAFIAVMSS

SEQ ID NO: 1071983 - protein, 18 aa, Mycobacterium
ERWIPVERVGLYVPGGNA

SEQ ID NO: 1071984 - protein, 18 aa, Mycobacterium
ERWTLLILRELVGGPRRY

SEQ ID NO: 1071985 - protein, 24 aa, Mycobacterium
ERYGVPAHQLLHRAGQRKLIGGQE

SEQ ID NO: 1071986 - protein, 22 aa, Mycobacterium
ERYHQRCWLRQLTPYASREQEN

SEQ ID NO: 1071987 - protein, 18 aa, Mycobacterium
ERYLTAGLQPVDCRFCHV

SEQ ID NO: 1071988 - protein, 17 aa, Mycobacterium
ERYMRYLTGCSKLFQEG

SEQ ID NO: 1071989 - protein, 26 aa, Mycobacterium
ESAARALLLPRRHPGRRSPLWHQRQR

SEQ ID NO: 1071990 - protein, 18 aa, Mycobacterium
ESAIELLRRNGVAGTGLA

SEQ ID NO: 1071991 - protein, 21 aa, Mycobacterium
ESALRFIGAATFEALSGQPVH

SEQ ID NO: 1071992 - protein, 27 aa, Mycobacterium
ESCDTLIVIPNDRLLQMGDAAVSLMDA

SEQ ID NO: 1071993 - protein, 25 aa, Mycobacterium
ESDDLQWWPPDALPPGTDHALRYLV

SEQ ID NO: 1071994 - protein, 21 aa, Mycobacterium
ESDGWLWITGQMPNYPDDHAK

SEQ ID NO: 1071995 - protein, 27 aa, Mycobacterium
ESDNLAVKGMYWARRDAQPARRRIVTT

SEQ ID NO: 1071996 - protein, 27 aa, Mycobacterium
ESDQPASILILFAPGAPREDYFEGFPG

SEQ ID NO: 1071997 - protein, 24 aa, Mycobacterium
ESEDLHERLLRRDIPAVVLNAKND

SEQ ID NO: 1071998 - protein, 23 aa, Mycobacterium
ESERLLRGFLSSALLEAGLYCRA

SEQ ID NO: 1071999 - protein, 17 aa, Mycobacterium
ESFKVLLKELQSLCLNV

SEQ ID NO: 1072000 - protein, 19 aa, Mycobacterium
ESFKVLLKELQSLCLNVEV

SEQ ID NO: 1072001 - protein, 18 aa, Mycobacterium
ESFRYIDCRCCGGMLKPD

SEQ ID NO: 1072002 - protein, 23 aa, Mycobacterium
ESFTPFNIELLPCGQIAHSALSG

SEQ ID NO: 1072003 - protein, 22 aa, Mycobacterium
ESGSAWVFHLFEKLAKSYGQIP

SEQ ID NO: 1072004 - protein, 24 aa, Mycobacterium
ESIAAALTPFPLQAAGSVVTANLG

SEQ ID NO: 1072005 - protein, 26 aa, Mycobacterium
ESLADPLAFLLRKEGFEATVVTDGPA

SEQ ID NO: 1072006 - protein, 29 aa, Mycobacterium
ESLAGKATVLWFSTPWCPKCQQEAPIVAK

SEQ ID NO: 1072007 - protein, 18 aa, Mycobacterium
ESLLKGGTFGVGTLPIPG

SEQ ID NO: 1072008 - protein, 22 aa, Mycobacterium
ESMAMWPGAAVSGWYFSHPQSQ

SEQ ID NO: 1072009 - protein, 17 aa, Mycobacterium
ESMTFPDPVIEVAIEPK

SEQ ID NO: 1072010 - protein, 27 aa, Mycobacterium
ESNAPALLGLIGLWYSNFLGAQSRAVL

SEQ ID NO: 1072011 - protein, 24 aa, Mycobacterium
ESPWALMHFMVRLPEDVATGSIDV

SEQ ID NO: 1072012 - protein, 24 aa, Mycobacterium
ESRAQMATLPRLKPRVFYDLVVEV

SEQ ID NO: 1072013 - protein, 24 aa, Mycobacterium
ESRELLSPFPRDRGWPVDDLLSVS

SEQ ID NO: 1072014 - protein, 22 aa, Mycobacterium
ESRHRPGWLPIPLRSIARLTAT

SEQ ID NO: 1072015 - protein, 19 aa, Mycobacterium
ESRLRMLRSFDPRSGAYVL

SEQ ID NO: 1072016 - protein, 29 aa, Mycobacterium
ESRPPFWQDMVELGWLGLHIDERHGGSGY

SEQ ID NO: 1072017 - protein, 21 aa, Mycobacterium
ESRTLACLPGEYGPNLAVMAA

SEQ ID NO: 1072018 - protein, 24 aa, Mycobacterium
ESTATFEWAFRWLDAHRPAESAPV

SEQ ID NO: 1072019 - protein, 22 aa, Mycobacterium
ESTIVFRVLPHTPPVTQHITLG

SEQ ID NO: 1072020 - protein, 25 aa, Mycobacterium
ESTRREWTLPTWAPVPVAELVLGRA

SEQ ID NO: 1072021 - protein, 25 aa, Mycobacterium
ESTWDRRPGWFRKVAGLATGVKDRA

SEQ ID NO: 1072022 - protein, 23 aa, Mycobacterium
ESVQWLEQHLASYAGAVLAVTHD

SEQ ID NO: 1072023 - protein, 21 aa, Mycobacterium
ESVSGYLTLLYAYSQDSDTNE

SEQ ID NO: 1072024 - protein, 30 aa, Mycobacterium
ESVVTPFLLPDIPVVAWWPDIAPAVPTQDP

SEQ ID NO: 1072025 - protein, 18 aa, Mycobacterium
ESVYGPLTASIRRLIDVS

SEQ ID NO: 1072026 - protein, 19 aa, Mycobacterium
ESWGPLFAEARRATVDAVN

SEQ ID NO: 1072027 - protein, 17 aa, Mycobacterium
ESYSWKQDLGAAAPMGI

SEQ ID NO: 1072028 - protein, 28 aa, Mycobacterium
ETAATIDASLWSHAWCIPCSLGCVMAEA

SEQ ID NO: 1072029 - protein, 20 aa, Mycobacterium
ETAFQSAWLLAAAGCDDSGG

SEQ ID NO: 1072030 - protein, 31 aa, Mycobacterium
ETAFTMTVPPLMVFVNRAQACLLIMSNIFGQ

SEQ ID NO: 1072031 - protein, 36 aa, Mycobacterium
ETAFTMTVPPLMVFVNRAQACLLIMSNIFGQNSTAI

SEQ ID NO: 1072032 - protein, 26 aa, Mycobacterium
ETARDGIVRLRPGLQLLRCRRGAERR

SEQ ID NO: 1072033 - protein, 27 aa, Mycobacterium
ETDPRTWLLVATGLLRLSEATATGALT

SEQ ID NO: 1072034 - protein, 38 aa, Mycobacterium; identical to SEQ ID NO: 810463

SEQ ID NO: 1072035 - protein, 24 aa, Mycobacterium
ETERMAIVHFTLRSKTRLAALRAK

SEQ ID NO: 1072036 - protein, 23 aa, Mycobacterium
ETFLRAIGAIRRFGGRSSARTWL

SEQ ID NO: 1072037 - protein, 20 aa, Mycobacterium
ETFPGLAGLGDLIVTCTSQR

SEQ ID NO: 1072038 - protein, 19 aa, Mycobacterium
ETGAEDLLKPLLPTGRISG

SEQ ID NO: 1072039 - protein, 17 aa, Mycobacterium
ETGDPKKQVRCVYVAVG

SEQ ID NO: 1072040 - protein, 23 aa, Mycobacterium
ETKRRMIFTAHHILVDGWSLAVF

SEQ ID NO: 1072041 - protein, 30 aa, Mycobacterium
ETLGMSFVNLIWRNIASIPGGLRWTWETMK

SEQ ID NO: 1072042 - protein, 18 aa, Mycobacterium
ETLPALNSFVLPGGSPLS

SEQ ID NO: 1072043 - protein, 19 aa, Mycobacterium
ETLVRLRPTFGAVNLEDIS

SEQ ID NO: 1072044 - protein, 24 aa, Mycobacterium
ETMNLVTPWLLAERDRFALLHGDY

SEQ ID NO: 1072045 - protein, 22 aa, Mycobacterium
ETNSTRMYLGPGSSPILTAAAA

SEQ ID NO: 1072046 - protein, 26 aa, Mycobacterium
ETNVDFWAAVILDFAGVPANRMPAMF

SEQ ID NO: 1072047 - protein, 20 aa, Mycobacterium
ETPDWWDSLPADRLIVYATL

SEQ ID NO: 1072048 - protein, 24 aa, Mycobacterium
ETPYASVTFPWYQLGRQVHVRGPV

SEQ ID NO: 1072049 - protein, 24 aa, Mycobacterium
ETQAVLALLDSPLGQLLHAAGSGK

SEQ ID NO: 1072050 - protein, 30 aa, Mycobacterium
ETQKFDGPYFVMQWLLRQPHRAILPVAGDP

SEQ ID NO: 1072051 - protein, 24 aa, Mycobacterium
ETRDFLQASLLLLASHRYRILARQ

SEQ ID NO: 1072052 - protein, 18 aa, Mycobacterium
ETRLVPARGYHLELITPV

SEQ ID NO: 1072053 - protein, 29 aa, Mycobacterium
ETRRILDRLYGYEVSPVLWKKVAPKLSAG

SEQ ID NO: 1072054 - protein, 18 aa, Mycobacterium
ETRRLFAGGGFGGRRFDT

SEQ ID NO: 1072055 - protein, 26 aa, Mycobacterium
ETRTTLPGGLTWPLGLAVAADGDLYI

SEQ ID NO: 1072056 - protein, 19 aa, Mycobacterium
ETSMRFPLPKFSDIRYNYA

SEQ ID NO: 1072057 - protein, 28 aa, Mycobacterium
ETTKRYMHHYNFPPFSTGETGRVGSPKR

SEQ ID NO: 1072058 - protein, 25 aa, Mycobacterium
ETTLLTLYVTLMHFGGIIVAPGYTD

SEQ ID NO: 1072059 - protein, 18 aa, Mycobacterium
ETTWKLLLDSQSGIRTLD

SEQ ID NO: 1072060 - protein, 17 aa, Mycobacterium
ETVVPLLPAQDFKRVGE

SEQ ID NO: 1072061 - protein, 23 aa, Mycobacterium
EVAAAINRPLSFAGAVDAVTNRL

SEQ ID NO: 1072062 - protein, 34 aa, Mycobacterium
EVAGLHRRYLIVLPFLTPTIASLWVGTVTPIPPG

SEQ ID NO: 1072063 - protein, 18 aa, Mycobacterium
EVAIDALLPTVRIRRIYA

SEQ ID NO: 1072064 - protein, 20 aa, Mycobacterium
EVALMASLVRIADRAGANLF

SEQ ID NO: 1072065 - protein, 24 aa, Mycobacterium
EVAPWLDLACKLGVLAAALSDEPP

SEQ ID NO: 1072066 - protein, 24 aa, Mycobacterium
EVARAFLTSQKARWAARSLLDSPD

SEQ ID NO: 1072067 - protein, 18 aa, Mycobacterium
EVDAYYFAPQKNFASDGG

SEQ ID NO: 1072068 - protein, 24 aa, Mycobacterium
EVDEPYVLILPTYGGGRANPDLDL

SEQ ID NO: 1072069 - protein, 19 aa, Mycobacterium
EVDVYNMGWHKYLDARATD

SEQ ID NO: 1072070 - protein, 23 aa, Mycobacterium
EVEALQLEYNWIKEFDPRFNVRY

SEQ ID NO: 1072071 - protein, 26 aa, Mycobacterium
EVEEVFLPLARLLHLQVAARQRLFAA

SEQ ID NO: 1072072 - protein, 23 aa, Mycobacterium
EVELAFLGLIPQSITATQLLYRT

SEQ ID NO: 1072073 - protein, 31 aa, Mycobacterium; identical to SEQ ID NO: 810804

SEQ ID NO: 1072074 - protein, 26 aa, Mycobacterium
EVEPRMLLVHFLRDQLRLTGTHWGCD

SEQ ID NO: 1072075 - protein, 25 aa, Mycobacterium
EVEYRQLRLERVVLVGVWTEGTAAD

SEQ ID NO: 1072076 - protein, 28 aa, Mycobacterium
EVFDHERSIWWERAVGVWPDYAEYQKKT

SEQ ID NO: 1072077 - protein, 26 aa, Mycobacterium
EVFETLLALAGYYFAVGDLARSTGVF

SEQ ID NO: 1072078 - protein, 17 aa, Mycobacterium
EVFGPVASVYRAADIDE

SEQ ID NO: 1072079 - protein, 40 aa, Mycobacterium
EVGDDVRWAMRHLPFYGRWYRFLLLWPGADKGLDAARTDP

SEQ ID NO: 1072080 - protein, 35 aa, Mycobacterium
EVGKQLRLAQQYFFVSCSLQDILHLLDDFAGLPVQ

SEQ ID NO: 1072081 - protein, 23 aa, Mycobacterium
EVGLAILGPLRELDEVAYLRFAS

SEQ ID NO: 1072082 - protein, 31 aa, Mycobacterium; identical to SEQ ID NO: 810852

SEQ ID NO: 1072083 - protein, 17 aa, Mycobacterium
EVGRAQFFADLGVSMIT

SEQ ID NO: 1072084 - protein, 19 aa, Mycobacterium
EVGRGGFGIVYRAFQPSLD

SEQ ID NO: 1072085 - protein, 17 aa, Mycobacterium
EVGWRQAGLAARYIAHR

SEQ ID NO: 1072086 - protein, 27 aa, Mycobacterium
EVGYFKGVMQLTHPAFLILDSPDGQHH

SEQ ID NO: 1072087 - protein, 18 aa, Mycobacterium
EVIRILQRYKDLQDIIAI

SEQ ID NO: 1072088 - protein, 25 aa, Mycobacterium
EVIRRKAGLPPATYFSGGKLQWILE

SEQ ID NO: 1072089 - protein, 24 aa, Mycobacterium
EVISISYGFFTPLSGFMGRREVDE

SEQ ID NO: 1072090 - protein, 25 aa, Mycobacterium
EVKAMYPLGPIFHGSGLNVTVMSLN

SEQ ID NO: 1072091 - protein, 30 aa, Mycobacterium; identical to SEQ ID NO: 810903

SEQ ID NO: 1072092 - protein, 17 aa, Mycobacterium
EVKGQVFPWVLADVDLG

SEQ ID NO: 1072093 - protein, 17 aa, Mycobacterium
EVKGYCYGWHFYKAADA

SEQ ID NO: 1072094 - protein, 17 aa, Mycobacterium
EVKSVCFTVDGGKQLLD

SEQ ID NO: 1072095 - protein, 26 aa, Mycobacterium
EVLPEKPELILLDNFPVWQTQTALQR

SEQ ID NO: 1072096 - protein, 27 aa, Mycobacterium
EVLRLRWRKGCMPLLQRVVRARVHGRQ

SEQ ID NO: 1072097 - protein, 21 aa, Mycobacterium
EVLRNMLYADSPALPGLSYVV

SEQ ID NO: 1072098 - protein, 17 aa, Mycobacterium
EVLTLDILSRRGKTIRP

SEQ ID NO: 1072099 - protein, 19 aa, Mycobacterium
EVLVIAALARQNGLAAQHS

SEQ ID NO: 1072100 - protein, 19 aa, Mycobacterium
EVLYLAAVLGTRRYDDIDV

SEQ ID NO: 1072101 - protein, 19 aa, Mycobacterium
EVMAPLGPILVTATGIRPG

SEQ ID NO: 1072102 - protein, 38 aa, Mycobacterium; identical to SEQ ID NO: 810969

SEQ ID NO: 1072103 - protein, 26 aa, Mycobacterium
EVNALARRLLVKRYGAAVLGPYTSKR

SEQ ID NO: 1072104 - protein, 28 aa, Mycobacterium
EVNSRRWAGVPFYLRTGKRLGRRVTEIA

SEQ ID NO: 1072105 - protein, 17 aa, Mycobacterium
EVNVAYGLYPAWRGRGL

SEQ ID NO: 1072106 - protein, 27 aa, Mycobacterium
EVPHGRDELWRFTPLKRLRGLHDGSAA

SEQ ID NO: 1072107 - protein, 22 aa, Mycobacterium
EVPIQRPIFVTGLVRTGTTALH

SEQ ID NO: 1072108 - protein, 17 aa, Mycobacterium
EVPSHEVGLAILGPLRE

SEQ ID NO: 1072109 - protein, 43 aa, Mycobacterium; identical to SEQ ID NO: 811012

SEQ ID NO: 1072110 - protein, 23 aa, Mycobacterium
EVQADIRRKIEIGCYQGLRHRRG

SEQ ID NO: 1072111 - protein, 24 aa, Mycobacterium
EVQIGKFRLVFLTGPKQGDDDGGT

SEQ ID NO: 1072112 - protein, 17 aa, Mycobacterium
EVQRDIIGMISLGLLRA

SEQ ID NO: 1072113 - protein, 21 aa, Mycobacterium
EVRDKIERRYATALGQAELAQ

SEQ ID NO: 1072114 - protein, 25 aa, Mycobacterium
EVRGEVFFRVADFQALNASLVEEGK

SEQ ID NO: 1072115 - protein, 17 aa, Mycobacterium
EVRGLFPHHLDTIVNVP

SEQ ID NO: 1072116 - protein, 19 aa, Mycobacterium
EVRGPWITGAYYLGYDQSE

SEQ ID NO: 1072117 - protein, 30 aa, Mycobacterium; identical to SEQ ID NO: 811043

SEQ ID NO: 1072118 - protein, 23 aa, Mycobacterium
EVRPDRSTTLALRWLVGYSRQRR

SEQ ID NO: 1072119 - protein, 27 aa, Mycobacterium
EVSAAIAALFSFHGQSYQTLGAQAEAF

SEQ ID NO: 1072120 - protein, 27 aa, Mycobacterium
EVSAAVAAVFCAHAQDYQALSAEATQF

SEQ ID NO: 1072121 - protein, 24 aa, Mycobacterium
EVSAQLAAVFGDYARQFQALSARA

SEQ ID NO: 1072122 - protein, 18 aa, Mycobacterium
EVSITRRMFRDGASEYEI

SEQ ID NO: 1072123 - protein, 17 aa, Mycobacterium
EVSTAKRRSPGSLPGVK

SEQ ID NO: 1072124 - protein, 25 aa, Mycobacterium
EVTEHLSRVLAGCLQYTYDALDNLI

SEQ ID NO: 1072125 - protein, 25 aa, Mycobacterium
EVTLNGRVLPIGGVKQKLLAAQRAG

SEQ ID NO: 1072126 - protein, 17 aa, Mycobacterium
EVTLTTHPAGFNRTFRL

SEQ ID NO: 1072127 - protein, 19 aa, Mycobacterium
EVTVRYFAAARAAAGIECE

SEQ ID NO: 1072128 - protein, 19 aa, Mycobacterium
EVVALLSRGKLLYGVVDNE

SEQ ID NO: 1072129 - protein, 20 aa, Mycobacterium
EVVALRKAGGLAAGAIAVVT

SEQ ID NO: 1072130 - protein, 18 aa, Mycobacterium
EVVARLRVILRRAGKGSA

SEQ ID NO: 1072131 - protein, 29 aa, Mycobacterium
EVVASATGDFRFFAAPGSWTVRALSKAGN

SEQ ID NO: 1072132 - protein, 19 aa, Mycobacterium
EVVFVPSGQPWQKGRRVSP

SEQ ID NO: 1072133 - protein, 27 aa, Mycobacterium
EVVGQGHLLAPGAPLRRLVEGSGVASV

SEQ ID NO: 1072134 - protein, 26 aa, Mycobacterium
EVVKGGLILDIGLRGFLPASLVEMRR

SEQ ID NO: 1072135 - protein, 23 aa, Mycobacterium
EVVLDPRLRAAASWPAGVAAGRR

SEQ ID NO: 1072136 - protein, 24 aa, Mycobacterium
EVVPIRVSRWKPTPLGGAFDQLVT

SEQ ID NO: 1072137 - protein, 17 aa, Mycobacterium
EVVRKLWDSWEDDAVIR

SEQ ID NO: 1072138 - protein, 22 aa, Mycobacterium
EWAKASLITPEQYPAAVVAASR

SEQ ID NO: 1072139 - protein, 25 aa, Mycobacterium
EWATNDARFLLYPAMKKLTLDIASM

SEQ ID NO: 1072140 - protein, 38 aa, Mycobacterium
EWGHRYPAAIRLWRTAWNEFIPFLDYDTEIRKVICSTN

SEQ ID NO: 1072141 - protein, 37 aa, Mycobacterium
EWGHRYPAAIRLWRTAWNEFIPFLDYDTEIRKVTCST

SEQ ID NO: 1072142 - protein, 18 aa, Mycobacterium
EWGPGLTNLEYAPLAEIL

SEQ ID NO: 1072143 - protein, 23 aa, Mycobacterium
EWGRPLYGQVALFERMSLEAFQS

SEQ ID NO: 1072144 - protein, 19 aa, Mycobacterium
EWQRDFFDFGHVQALYLDL

SEQ ID NO: 1072145 - protein, 19 aa, Mycobacterium
EYAICYFPEAAYDRSGIEL

SEQ ID NO: 1072146 - protein, 18 aa, Mycobacterium
EYDVLVGINLLREGLDLP

SEQ ID NO: 1072147 - protein, 18 aa, Mycobacterium
EYEIVNVGDIARLFPEGG

SEQ ID NO: 1072148 - protein, 31 aa, Mycobacterium; identical to SEQ ID NO: 811276

SEQ ID NO: 1072149 - protein, 17 aa, Mycobacterium
EYFSLRGLALLTDTVEK

SEQ ID NO: 1072150 - protein, 29 aa, Mycobacterium
EYGKTPTQVLLRWNLQLGNAVIFGSSNAE

SEQ ID NO: 1072151 - protein, 19 aa, Mycobacterium
EYHSVARMRRGPGGGLVVT

SEQ ID NO: 1072152 - protein, 20 aa, Mycobacterium
EYKAPLRPLAPVSHLAFDEP

SEQ ID NO: 1072153 - protein, 25 aa, Mycobacterium
EYPEGKRAGLWPGLRETFKSGTSEP

SEQ ID NO: 1072154 - protein, 17 aa, Mycobacterium
EYPVFPEYGDDVYYAVS

SEQ ID NO: 1072155 - protein, 24 aa, Mycobacterium
EYQITHHTYLNTPPLIEVYEYTKG

SEQ ID NO: 1072156 - protein, 23 aa, Mycobacterium
EYRDPQLLRLALGEKNRALLPAS

SEQ ID NO: 1072157 - protein, 25 aa, Mycobacterium
EYRSLPDHPAFYWYAERISEQRAVL

SEQ ID NO: 1072158 - protein, 22 aa, Mycobacterium
EYSLAVVGPLLAGAALGISGMA

SEQ ID NO: 1072159 - protein, 19 aa, Mycobacterium
EYWRRFGVVPDWAGKRVLD

SEQ ID NO: 1072160 - protein, 17 aa, Mycobacterium
FAADVAGAKPWFAIGGI

SEQ ID NO: 1072161 - protein, 24 aa, Mycobacterium
FAAELRLLRGMPSVFVPSAAIPNN

SEQ ID NO: 1072162 - protein, 17 aa, Mycobacterium
FAAFRAVYECAVPVIAA

SEQ ID NO: 1072163 - protein, 35 aa, Mycobacterium
FAAFYRRCRLVTERLWPTLLEPLRTRDQARRTVVD

SEQ ID NO: 1072164 - protein, 26 aa, Mycobacterium
FAAGRIGATGPRRCRWSVVHHSWTTR

SEQ ID NO: 1072165 - protein, 18 aa, Mycobacterium
FAALSLDPPLVLFCPTKV

SEQ ID NO: 1072166 - protein, 17 aa, Mycobacterium
FAAPTTLRFEPGITAVV

SEQ ID NO: 1072167 - protein, 20 aa, Mycobacterium
FAATILAIEAILRMGDSEQR

SEQ ID NO: 1072168 - protein, 18 aa, Mycobacterium
FAAVFARRGLIAEFGISW

SEQ ID NO: 1072169 - protein, 19 aa, Mycobacterium
FAAVGRLLHRHDGPIFPLI

SEQ ID NO: 1072170 - protein, 19 aa, Mycobacterium
FACDPPLVQLLQGATMEQL

SEQ ID NO: 1072171 - protein, 23 aa, Mycobacterium
FADDTAHYLWTWTDDAAGDLRSR

SEQ ID NO: 1072172 - protein, 18 aa, Mycobacterium
FADFPRYPINLLADINAV

SEQ ID NO: 1072173 - protein, 24 aa, Mycobacterium
FADWGMRLVFLRVGGVTIEIAQPL

SEQ ID NO: 1072174 - protein, 18 aa, Mycobacterium
FAECVLLETLVLSVLNHD

SEQ ID NO: 1072175 - protein, 23 aa, Mycobacterium
FAEELVMWWNFVGRNHDEIVSYR

SEQ ID NO: 1072176 - protein, 26 aa, Mycobacterium
FAEGTPAGLAAWLVLCCRAMEAGAQE

SEQ ID NO: 1072177 - protein, 34 aa, Mycobacterium; identical to SEQ ID NO: 811457

SEQ ID NO: 1072178 - protein, 20 aa, Mycobacterium
FAEYDRDLPHYIPVEQIRTE

SEQ ID NO: 1072179 - protein, 23 aa, Mycobacterium
FAGATRGGWWAGVARDGKIGALV

SEQ ID NO: 1072180 - protein, 17 aa, Mycobacterium
FAGGRRGAAGTLASNYQ

SEQ ID NO: 1072181 - protein, 19 aa, Mycobacterium
FAGILAQVPFVDPLTTILD

SEQ ID NO: 1072182 - protein, 32 aa, Mycobacterium; identical to SEQ ID NO: 811501

SEQ ID NO: 1072183 - protein, 18 aa, Mycobacterium
FAHFGRRFDDLNTEITLM

SEQ ID NO: 1072184 - protein, 18 aa, Mycobacterium
FAHNLSVGQIARFPARVV

SEQ ID NO: 1072185 - protein, 26 aa, Mycobacterium
FAIRVAPACFFPAGDRALLARFADRW

SEQ ID NO: 1072186 - protein, 24 aa, Mycobacterium
FALDHALVDIGVGVRWLREVAGAE

SEQ ID NO: 1072187 - protein, 21 aa, Mycobacterium
FAMFYDHTCTRVYGLVARVLR

SEQ ID NO: 1072188 - protein, 29 aa, Mycobacterium
FAMRNMKTIPTLRLLRQMLAKRPKFDSKR

SEQ ID NO: 1072189 - protein, 20 aa, Mycobacterium
FAPAMHTEMWLHPATVDNVA

SEQ ID NO: 1072190 - protein, 22 aa, Mycobacterium
FAPQFHPSYRQASVVRREIGVP

SEQ ID NO: 1072191 - protein, 17 aa, Mycobacterium
FAPVFDPVKVEVGFHTP

SEQ ID NO: 1072192 - protein, 23 aa, Mycobacterium
FAQPALFALEVALAALLQACGVV

SEQ ID NO: 1072193 - protein, 25 aa, Mycobacterium
FAQQMKILFPIFTSNDAKEGAIAFA

SEQ ID NO: 1072194 - protein, 17 aa, Mycobacterium
FARTAAALLSWLAEDFR

SEQ ID NO: 1072195 - protein, 18 aa, Mycobacterium
FARVRDIAALDFVSAPVG

SEQ ID NO: 1072196 - protein, 22 aa, Mycobacterium
FASAFYGPFREAVSCSLSGDRR

SEQ ID NO: 1072197 - protein, 25 aa, Mycobacterium
FASDGGLWLAIMSPAALARVEAVAA

SEQ ID NO: 1072198 - protein, 19 aa, Mycobacterium
FASVVLSWARVHEPEMAKV

SEQ ID NO: 1072199 - protein, 17 aa, Mycobacterium
FATAITSLPLFDGTGWN

SEQ ID NO: 1072200 - protein, 21 aa, Mycobacterium
FATAVQTWWRPHAHYGALRPL

SEQ ID NO: 1072201 - protein, 25 aa, Mycobacterium
FATTELFLERLGLTSLTELPDIAPL

SEQ ID NO: 1072202 - protein, 19 aa, Mycobacterium
FAVALPFVDLIDYRLQVSY

SEQ ID NO: 1072203 - protein, 23 aa, Mycobacterium
FAVMVSLAELWKSVGVRPDAVIG

SEQ ID NO: 1072204 - protein, 18 aa, Mycobacterium
FAWGLLIATVHNLAEEHR

SEQ ID NO: 1072205 - protein, 20 aa, Mycobacterium
FAYEWAAQRGLLTPGDDVDL

SEQ ID NO: 1072206 - protein, 19 aa, Mycobacterium
FCATGVTDGDLLKGVRYYP

SEQ ID NO: 1072207 - protein, 26 aa, Mycobacterium
FCEGDALLVWIPLNAANIFGGLYRQV

SEQ ID NO: 1072208 - protein, 24 aa, Mycobacterium
FCERLTQLLPDPLDTVFLVYSGSE

SEQ ID NO: 1072209 - protein, 18 aa, Mycobacterium
FCGLDDPELGERAASAAA

SEQ ID NO: 1072210 - protein, 18 aa, Mycobacterium
FCKTEHPFLQHLLTHRDV

SEQ ID NO: 1072211 - protein, 19 aa, Mycobacterium
FCKTEHPFLQHLLTHRDVT

SEQ ID NO: 1072212 - protein, 25 aa, Mycobacterium
FCNSYRYIQFAVANQFYLLSREAGQ

SEQ ID NO: 1072213 - protein, 40 aa, Mycobacterium
FDAHAQAYQALSAQALVFHDQFVQMLNAGAGSYAAAEAAN

SEQ ID NO: 1072214 - protein, 28 aa, Mycobacterium
FDAVCCFGALYLMPEPFRIAREMVRVLG

SEQ ID NO: 1072215 - protein, 21 aa, Mycobacterium
FDCSGLVQWAYAQAGVHVDRT

SEQ ID NO: 1072216 - protein, 19 aa, Mycobacterium
FDDALVLSGILAPALQRAR

SEQ ID NO: 1072217 - protein, 23 aa, Mycobacterium
FDDEQLFYLRSRGIGEEQARRLL

SEQ ID NO: 1072218 - protein, 23 aa, Mycobacterium
FDDPYTFNILRDPNPHVGFGGTG

SEQ ID NO: 1072219 - protein, 25 aa, Mycobacterium
FDDVFKRMWELYLAYSEAGFRSGYL

SEQ ID NO: 1072220 - protein, 24 aa, Mycobacterium
FDDVILHTYFTPETLQRCVSIVKT

SEQ ID NO: 1072221 - protein, 17 aa, Mycobacterium
FDEGNAEQYLWMVPQNI

SEQ ID NO: 1072222 - protein, 18 aa, Mycobacterium
FDELAGDLLRPVLGVPRH

SEQ ID NO: 1072223 - protein, 26 aa, Mycobacterium
FDGLNSWLTGMFDRGAWRPAAVVVVG

SEQ ID NO: 1072224 - protein, 18 aa, Mycobacterium
FDGLRLAGRPVRRPDLTI

SEQ ID NO: 1072225 - protein, 20 aa, Mycobacterium
FDGSSGLMGAWCGRFRIVSV

SEQ ID NO: 1072226 - protein, 17 aa, Mycobacterium
FDLALTREMLDAMRPIT

SEQ ID NO: 1072227 - protein, 17 aa, Mycobacterium
FDLSRDQGFLWDGARRT

SEQ ID NO: 1072228 - protein, 30 aa, Mycobacterium
FDLTMMSPMSFIQRPALWFEVMDRVRATVT

SEQ ID NO: 1072229 - protein, 19 aa, Mycobacterium
FDMSLSFHHALLDGWSVVE

SEQ ID NO: 1072230 - protein, 17 aa, Mycobacterium
FDNFCDILLRVADARAQ

SEQ ID NO: 1072231 - protein, 17 aa, Mycobacterium
FDPVYSHRILWPDRAYQ

SEQ ID NO: 1072232 - protein, 19 aa, Mycobacterium
FDQSYYQLLDSTRGRPFGA

SEQ ID NO: 1072233 - protein, 17 aa, Mycobacterium
FDRFYAEAARRIHLLPM

SEQ ID NO: 1072234 - protein, 26 aa, Mycobacterium
FDRSPVCTHALAVYLGLPVCAALTAE

SEQ ID NO: 1072235 - protein, 24 aa, Mycobacterium
FDSLFLMDHFYQLPMLGTPDQPML

SEQ ID NO: 1072236 - protein, 31 aa, Mycobacterium
FDVGAVIYFPRKVIWFLPDFTVECYHDQLRA

SEQ ID NO: 1072237 - protein, 18 aa, Mycobacterium
FDVIHLRGHTPGSIALAL

SEQ ID NO: 1072238 - protein, 26 aa, Mycobacterium
FEAARAAMIHPLAVAANRNALVQLVL

SEQ ID NO: 1072239 - protein, 27 aa, Mycobacterium
FEATLAEGLLYERRLIHSAFATADQSE

SEQ ID NO: 1072240 - protein, 25 aa, Mycobacterium
FEDGGWIWFDITTDTAVTLLNAGWY

SEQ ID NO: 1072241 - protein, 23 aa, Mycobacterium
FEDPFSFNILRNPNPHVGFGGTG

SEQ ID NO: 1072242 - protein, 17 aa, Mycobacterium
FEELRVLSLLPSQATTL

SEQ ID NO: 1072243 - protein, 22 aa, Mycobacterium
FEGELFITGRIKDLLIVDGSNH

SEQ ID NO: 1072244 - protein, 17 aa, Mycobacterium
FEGIMDALFTGLIAIHG

SEQ ID NO: 1072245 - protein, 17 aa, Mycobacterium
FEHARPTAIMTWMRQHC

SEQ ID NO: 1072246 - protein, 21 aa, Mycobacterium
FEHPGLDRVLQWDPRFASESV

SEQ ID NO: 1072247 - protein, 21 aa, Mycobacterium
FEHWSIHRKPPAFEDLEPRTE

SEQ ID NO: 1072248 - protein, 25 aa, Mycobacterium
FEIADYGVIGDLFKVAPQLTEGVKA

SEQ ID NO: 1072249 - protein, 19 aa, Mycobacterium
FEISGPVPKAPLGRSNNYP

SEQ ID NO: 1072250 - protein, 18 aa, Mycobacterium
FELGLTFHHALLDGWSVA

SEQ ID NO: 1072251 - protein, 24 aa, Mycobacterium
FELNVYIPMMARNILESFTLLTNV

SEQ ID NO: 1072252 - protein, 17 aa, Mycobacterium
FEPIHAVTYFAPEARAA

SEQ ID NO: 1072253 - protein, 20 aa, Mycobacterium
FEPKQTTFLRAHSGFDVKHI

SEQ ID NO: 1072254 - protein, 22 aa, Mycobacterium
FEQQLAINTYWDLIGGHNMLPG

SEQ ID NO: 1072255 - protein, 25 aa, Mycobacterium
FESRAPALLISRLVSWVDDLWCRAI

SEQ ID NO: 1072256 - protein, 19 aa, Mycobacterium
FEVILGVWERRSSEVAQSV

SEQ ID NO: 1072257 - protein, 19 aa, Mycobacterium
FEWLIGSQRWRESAAQRGD

SEQ ID NO: 1072258 - protein, 23 aa, Mycobacterium
FEYVRELLSYLPPNNATDAPRYP

SEQ ID NO: 1072259 - protein, 18 aa, Mycobacterium
FFAKNMLPKLTGVRAVIE

SEQ ID NO: 1072260 - protein, 18 aa, Mycobacterium
FFCTQLPTDLPKDVLSQL

SEQ ID NO: 1072261 - protein, 17 aa, Mycobacterium
FFDEFFLGAADAGVRQV

SEQ ID NO: 1072262 - protein, 29 aa, Mycobacterium
FFDIGAVVYFLRKLIWTVPDFTAEPYFQR

SEQ ID NO: 1072263 - protein, 18 aa, Mycobacterium
FFDLLLSERGSGFDWGKT

SEQ ID NO: 1072264 - protein, 19 aa, Mycobacterium
FFGLFLDPTWVYTCAYFGR

SEQ ID NO: 1072265 - protein, 20 aa, Mycobacterium
FFGPPPFRPPSFNPVDGAMV

SEQ ID NO: 1072266 - protein, 17 aa, Mycobacterium
FFRAGGRGQWHDIFTAA

SEQ ID NO: 1072267 - protein, 20 aa, Mycobacterium
FFSFGIMHYYMTGIHTPGRT

SEQ ID NO: 1072268 - protein, 17 aa, Mycobacterium
FFTARNAATAERDAEFR

SEQ ID NO: 1072269 - protein, 26 aa, Mycobacterium
FGADPVLLASFPYPHVLSLTARLAER

SEQ ID NO: 1072270 - protein, 23 aa, Mycobacterium
FGAFLEYQPPEAAAWLASAIDAA

SEQ ID NO: 1072271 - protein, 18 aa, Mycobacterium
FGAGLRWARSRTGPPSSA

SEQ ID NO: 1072272 - protein, 24 aa, Mycobacterium
FGAPPPDVVRQLSALGLLVSVTVT

SEQ ID NO: 1072273 - protein, 17 aa, Mycobacterium
FGAVLDGHSIVPTDGED

SEQ ID NO: 1072274 - protein, 20 aa, Mycobacterium
FGDLVAMEAYRRSLLEQASG

SEQ ID NO: 1072275 - protein, 23 aa, Mycobacterium
FGDMPNDVPMLLRAGLGVAMGNA

SEQ ID NO: 1072276 - protein, 20 aa, Mycobacterium
FGDRVTSFLPTAHIADRMTG

SEQ ID NO: 1072277 - protein, 17 aa, Mycobacterium
FGDWEGMTFAEAANRDP

SEQ ID NO: 1072278 - protein, 23 aa, Mycobacterium
FGEALPVRVCPLRTDPWNVATSR

SEQ ID NO: 1072279 - protein, 24 aa, Mycobacterium
FGEIALLSGWRRAATVRASQPSVL

SEQ ID NO: 1072280 - protein, 25 aa, Mycobacterium
FGEQKARIFLALLGKQYGVRPEGWQ

SEQ ID NO: 1072281 - protein, 17 aa, Mycobacterium
FGFATAPLVVAGCIMMR

SEQ ID NO: 1072282 - protein, 29 aa, Mycobacterium
FGFYHKHFGIPYAFGKYDQLFVPEFNAGA

SEQ ID NO: 1072283 - protein, 18 aa, Mycobacterium
FGGLVFDATGITAPAELK

SEQ ID NO: 1072284 - protein, 26 aa, Mycobacterium
FGGPTMFSILPRIPISRSPAYNLILS

SEQ ID NO: 1072285 - protein, 20 aa, Mycobacterium
FGGYAQQFQALGAQASLFHD

SEQ ID NO: 1072286 - protein, 17 aa, Mycobacterium
FGHALGYGLRPGDALLI

SEQ ID NO: 1072287 - protein, 17 aa, Mycobacterium
FGHGLTYTSFGYRDLAV

SEQ ID NO: 1072288 - protein, 17 aa, Mycobacterium
FGHIPNLVTMRGDRYRD

SEQ ID NO: 1072289 - protein, 17 aa, Mycobacterium
FGISSGAAVWAARELAH

SEQ ID NO: 1072290 - protein, 19 aa, Mycobacterium
FGITPALARIYRATGQDVP

SEQ ID NO: 1072291 - protein, 20 aa, Mycobacterium
FGIVHKLRRVLSGLDSHQAI

SEQ ID NO: 1072292 - protein, 24 aa, Mycobacterium
FGLADKAWVLDELRELAAVLGVAR

SEQ ID NO: 1072293 - protein, 17 aa, Mycobacterium
FGLVYQLADGHQARELG

SEQ ID NO: 1072294 - protein, 18 aa, Mycobacterium
FGNAYYDSTTGQFTFNGL

SEQ ID NO: 1072295 - protein, 28 aa, Mycobacterium
FGNPLTWSDLAWLRELTDLPLIVKGICH

SEQ ID NO: 1072296 - protein, 17 aa, Mycobacterium
FGNTATVATAFIGGGNT

SEQ ID NO: 1072297 - protein, 19 aa, Mycobacterium
FGQLAYYSSGVLNAKDYIS

SEQ ID NO: 1072298 - protein, 27 aa, Mycobacterium
FGQLEIKTILHRLLRRYRLELARPDYR

SEQ ID NO: 1072299 - protein, 30 aa, Mycobacterium; identical to SEQ ID NO: 812442

SEQ ID NO: 1072300 - protein, 22 aa, Mycobacterium
FGSALPEFAAQLSGAISATVGS

SEQ ID NO: 1072301 - protein, 22 aa, Mycobacterium
FGTSLPELVAAFTGGLNGLVQA

SEQ ID NO: 1072302 - protein, 17 aa, Mycobacterium
FGVAYDRSLLFGYALDQ

SEQ ID NO: 1072303 - protein, 20 aa, Mycobacterium
FGVGGVGGNGAWGAGGIGGD

SEQ ID NO: 1072304 - protein, 18 aa, Mycobacterium
FGVLPPLQATTSLPGYLA

SEQ ID NO: 1072305 - protein, 19 aa, Mycobacterium
FGYQLVDIPFKFHHPMWRE

SEQ ID NO: 1072306 - protein, 26 aa, Mycobacterium
FHAALEFWSALHGFVLLEMTGLMEEI

SEQ ID NO: 1072307 - protein, 17 aa, Mycobacterium
FHEDGAASGLRAARRLG

SEQ ID NO: 1072308 - protein, 25 aa, Mycobacterium
FHESYDYFLTPSLATPPLTVGDTTT

SEQ ID NO: 1072309 - protein, 24 aa, Mycobacterium
FHFDPMCPFAYQTSVWIRDVRAQL

SEQ ID NO: 1072310 - protein, 20 aa, Mycobacterium
FHGGSLYGIPMPPGLISHAP

SEQ ID NO: 1072311 - protein, 21 aa, Mycobacterium
FHGLLLLRHVDELVKTGWPVL

SEQ ID NO: 1072312 - protein, 38 aa, Mycobacterium
FHLSEPCVLFAKLNPRVPRIWNVVRLPPQMALASCEFA

SEQ ID NO: 1072313 - protein, 27 aa, Mycobacterium
FHQGQNLFWDKLSGAMFRLAGALGATQ

SEQ ID NO: 1072314 - protein, 23 aa, Mycobacterium
FHQRHLLLSGWIKMQEGQLPSAS

SEQ ID NO: 1072315 - protein, 27 aa, Mycobacterium
FHRGQDFVYHWALGDRLPADAGLAARH

SEQ ID NO: 1072316 - protein, 25 aa, Mycobacterium
FHSDRLGPFCAALSELCGKDMVLPM

SEQ ID NO: 1072317 - protein, 33 aa, Mycobacterium; identical to SEQ ID NO: 812565

SEQ ID NO: 1072318 - protein, 18 aa, Mycobacterium
FHSQFIQALTGSGSAYAA

SEQ ID NO: 1072319 - protein, 25 aa, Mycobacterium
FHSYDLFARKVIPYFKGQLEAPRAS

SEQ ID NO: 1072320 - protein, 18 aa, Mycobacterium
FHVYARIAPQWSFSQVRL

SEQ ID NO: 1072321 - protein, 24 aa, Mycobacterium
FHYTRRWLQRMTVSQIDRSVAQIK

SEQ ID NO: 1072322 - protein, 18 aa, Mycobacterium
FIAPFHRAGTNPTLALQR

SEQ ID NO: 1072323 - protein, 35 aa, Mycobacterium
FIDGPLWPRLILRVRGMLRATWLVLRKHTDVLHVH

SEQ ID NO: 1072324 - protein, 18 aa, Mycobacterium
FIEDVARTWHLTRYAAVA

SEQ ID NO: 1072325 - protein, 20 aa, Mycobacterium
FIEHDSQGYRLIFENDYVTE

SEQ ID NO: 1072326 - protein, 17 aa, Mycobacterium
FIELGLNPDQIVLVVRV

SEQ ID NO: 1072327 - protein, 17 aa, Mycobacterium
FIGAGIAGGLALAGCGH

SEQ ID NO: 1072328 - protein, 30 aa, Mycobacterium; identical to SEQ ID NO: 812608

SEQ ID NO: 1072329 - protein, 25 aa, Mycobacterium
FIKGIIGLPPNLFYGTGIPTCIVIL

SEQ ID NO: 1072330 - protein, 19 aa, Mycobacterium
FIMFASDYPHWDGEWPEST

SEQ ID NO: 1072331 - protein, 31 aa, Mycobacterium
FIPDVGGAYLLSRAPGALGLHTALTGAPFSG

SEQ ID NO: 1072332 - protein, 18 aa, Mycobacterium
FIPVTHLCRDNCHYCTFV

SEQ ID NO: 1072333 - protein, 17 aa, Mycobacterium
FIQPFFPGATSVGLSYP

SEQ ID NO: 1072334 - protein, 33 aa, Mycobacterium
FIRDLYEAVSQLAFLPFPFDSVIVGGPSMAYWK

SEQ ID NO: 1072335 - protein, 25 aa, Mycobacterium
FIRDTTWVSVRWYKPGGALTAQQVG

SEQ ID NO: 1072336 - protein, 20 aa, Mycobacterium
FIREHLTRAWTGLRAMRSYA

SEQ ID NO: 1072337 - protein, 26 aa, Mycobacterium
FITDGKMFIIGRIKDLLIVYGRNHSP

SEQ ID NO: 1072338 - protein, 18 aa, Mycobacterium
FIVLAQLHWDMLTPYHRL

SEQ ID NO: 1072339 - protein, 24 aa, Mycobacterium
FKDTLIMAYEWPADRQSLSWTLQS

SEQ ID NO: 1072340 - protein, 24 aa, Mycobacterium
FKEGERLWISWAMANREPQVFPDP

SEQ ID NO: 1072341 - protein, 27 aa, Mycobacterium
FKGANPWIMISAFYLKIDGCVGQSFVR

SEQ ID NO: 1072342 - protein, 22 aa, Mycobacterium
FKRHKQIDRPCLLGYIDKCSAP

SEQ ID NO: 1072343 - protein, 18 aa, Mycobacterium
FKVDMAAQYRIRLGGTWK

SEQ ID NO: 1072344 - protein, 17 aa, Mycobacterium
FKWIARSADGWITTPRD

SEQ ID NO: 1072345 - protein, 17 aa, Mycobacterium
FLALVDYAHKPGALREV

SEQ ID NO: 1072346 - protein, 18 aa, Mycobacterium
FLARLCKTAMWIDHGEIK

SEQ ID NO: 1072347 - protein, 19 aa, Mycobacterium
FLASSRILNRRKGVRMSLL

SEQ ID NO: 1072348 - protein, 17 aa, Mycobacterium
FLELSPLAAWGSAFKVG

SEQ ID NO: 1072349 - protein, 31 aa, Mycobacterium
FLEPLESTGIFLIYAALYQLAKHFPDRRFDP

SEQ ID NO: 1072350 - protein, 21 aa, Mycobacterium
FLETDLFNQGVRPAINVGVSV

SEQ ID NO: 1072351 - protein, 24 aa, Mycobacterium
FLGEQFMQWFLQEQIEEVALMASL

SEQ ID NO: 1072352 - protein, 17 aa, Mycobacterium
FLGLRAGYGSLIQMIWI

SEQ ID NO: 1072353 - protein, 17 aa, Mycobacterium
FLHGCDISRIPDGSYQV

SEQ ID NO: 1072354 - protein, 17 aa, Mycobacterium
FLMPLNPGKDDDGNPID

SEQ ID NO: 1072355 - protein, 18 aa, Mycobacterium
FLNTVPLRMRLTSTDYIG

SEQ ID NO: 1072356 - protein, 17 aa, Mycobacterium
FLPASLVEMRRVRDLQP

SEQ ID NO: 1072357 - protein, 17 aa, Mycobacterium
FLQHLLTHRDVTRLKVT

SEQ ID NO: 1072358 - protein, 19 aa, Mycobacterium
FLRAQPDLSAKAWPRYVRI

SEQ ID NO: 1072359 - protein, 17 aa, Mycobacterium
FLRDVYSEQAILADGVL

SEQ ID NO: 1072360 - protein, 25 aa, Mycobacterium
FLRMEADWEASYLLSLRAAWQADNK

SEQ ID NO: 1072361 - protein, 17 aa, Mycobacterium
FLRTIIPSSNTVSTANE

SEQ ID NO: 1072362 - protein, 19 aa, Mycobacterium
FLSLQQAVYRLTGELAEWF

SEQ ID NO: 1072363 - protein, 26 aa, Mycobacterium
FLSLQRDLYAYLHDQTLRLLNQGYTG

SEQ ID NO: 1072364 - protein, 18 aa, Mycobacterium
FMAIRRAVLAIAAIGGYT

SEQ ID NO: 1072365 - protein, 20 aa, Mycobacterium
FMGLGMIYTAMPVTNAVPAV

SEQ ID NO: 1072366 - protein, 37 aa, Mycobacterium; identical to SEQ ID NO: 812912

SEQ ID NO: 1072367 - protein, 29 aa, Mycobacterium
FMLQQTPVSRVLSIWPDWVRRWPTASATA

SEQ ID NO: 1072368 - protein, 20 aa, Mycobacterium
FMNHMLTPQRRFATAPLALA

SEQ ID NO: 1072369 - protein, 18 aa, Mycobacterium
FMPAPGYSAYIAPDKYAQ

SEQ ID NO: 1072370 - protein, 18 aa, Mycobacterium
FMPAWGEADYMMSFQALL

SEQ ID NO: 1072371 - protein, 23 aa, Mycobacterium
FMQKVFFEIMKQFQGEYMGSLLS

SEQ ID NO: 1072372 - protein, 18 aa, Mycobacterium
FMSGFVNSSGTFISGFFN

SEQ ID NO: 1072373 - protein, 18 aa, Mycobacterium
FMTAVRQIDEFFLQVVRL

SEQ ID NO: 1072374 - protein, 20 aa, Mycobacterium
FNAIYKRWHCGELDVPLPGG

SEQ ID NO: 1072375 - protein, 17 aa, Mycobacterium
FNASPVAQGWLHSFLAS

SEQ ID NO: 1072376 - protein, 19 aa, Mycobacterium
FNATRYALLNGAALAPLPP

SEQ ID NO: 1072377 - protein, 28 aa, Mycobacterium
FNDAIVRPLLRFFFKSWFRVEVSGVENI

SEQ ID NO: 1072378 - protein, 23 aa, Mycobacterium
FNDMIIGLRMITPAGVLDLGRVA

SEQ ID NO: 1072379 - protein, 46 aa, Mycobacterium; identical to SEQ ID NO: 812977

SEQ ID NO: 1072380 - protein, 21 aa, Mycobacterium
FNLGFANLGDENLGLGNSGFN

SEQ ID NO: 1072381 - protein, 24 aa, Mycobacterium
FNNELGHPWTVLRATRSTDYLILE

SEQ ID NO: 1072382 - protein, 19 aa, Mycobacterium
FNRRFIGLGPGHRAVFWVP

SEQ ID NO: 1072383 - protein, 21 aa, Mycobacterium
FNSGYVNTGFFNSGSTNTGLF

SEQ ID NO: 1072384 - protein, 17 aa, Mycobacterium
FNTGIAVSGLFNLSQLA

SEQ ID NO: 1072385 - protein, 17 aa, Mycobacterium
FNTVNVGDPVIVKEGVP

SEQ ID NO: 1072386 - protein, 27 aa, Mycobacterium
FNVTPLDQMFVLWTAVNRVSRSGEVIG

SEQ ID NO: 1072387 - protein, 17 aa, Mycobacterium
FPAYLDPLRQSLPGRAI

SEQ ID NO: 1072388 - protein, 17 aa, Mycobacterium
FPDIAGHYRRRFRHVLV

SEQ ID NO: 1072389 - protein, 26 aa, Mycobacterium
FPDNGLHTWQYWGAQLQAMLPDLRRV

SEQ ID NO: 1072390 - protein, 23 aa, Mycobacterium
FPEATMCRFGVPLGPVAQPLDGP

SEQ ID NO: 1072391 - protein, 18 aa, Mycobacterium
FPFPVFFQEFEVTLNDLP

SEQ ID NO: 1072392 - protein, 18 aa, Mycobacterium
FPGERPLTAYHPRAWQRI

SEQ ID NO: 1072393 - protein, 23 aa, Mycobacterium
FPGMGMVERWLLKTQFPETTLAD

SEQ ID NO: 1072394 - protein, 25 aa, Mycobacterium
FPKGVMWRHEDIYRVLFGGTDFATG

SEQ ID NO: 1072395 - protein, 23 aa, Mycobacterium
FPKKQGMRIDFILGSPALAGRVV

SEQ ID NO: 1072396 - protein, 17 aa, Mycobacterium
FPPAMVFEHMTIAELAA

SEQ ID NO: 1072397 - protein, 17 aa, Mycobacterium
FPPGWRLSMKSRAKDGT

SEQ ID NO: 1072398 - protein, 24 aa, Mycobacterium
FPRGSVPELFNALHAKIDFGSLAK

SEQ ID NO: 1072399 - protein, 23 aa, Mycobacterium
FPSSHTADLADWLSSRQPELVTA

SEQ ID NO: 1072400 - protein, 39 aa, Mycobacterium
FPSSSFNFRSVIPYLAGQAWLTMDFLGFGLSDKPRPHRY

SEQ ID NO: 1072401 - protein, 17 aa, Mycobacterium
FPVFAHALDEVAAALNP

SEQ ID NO: 1072402 - protein, 26 aa, Mycobacterium
FPVTEFNVALPWTKMVVLNPGVQTES

SEQ ID NO: 1072403 - protein, 30 aa, Mycobacterium; identical to SEQ ID NO: 944832

SEQ ID NO: 1072404 - protein, 32 aa, Mycobacterium; identical to SEQ ID NO: 813133

SEQ ID NO: 1072405 - protein, 23 aa, Mycobacterium
FQADLAAMLHRLSQRLVPGGIVA

SEQ ID NO: 1072406 - protein, 27 aa, Mycobacterium
FQEFAGLPVRRVWRPTTFYTMVLQQLT

SEQ ID NO: 1072407 - protein, 18 aa, Mycobacterium
FQHLPVPFELYSDGIDLP

SEQ ID NO: 1072408 - protein, 22 aa, Mycobacterium
FQLIAAVAALLAFPAYARNAEL

SEQ ID NO: 1072409 - protein, 18 aa, Mycobacterium
FQMAGSLALREAAAATRV

SEQ ID NO: 1072410 - protein, 18 aa, Mycobacterium
FQPKYIFAAIDAGCAAVR

SEQ ID NO: 1072411 - protein, 25 aa, Mycobacterium
FQRRVWQALLTIPYGETRSYGEIAE

SEQ ID NO: 1072412 - protein, 18 aa, Mycobacterium
FQRVTLTNPVGKVVAGVF

SEQ ID NO: 1072413 - protein, 27 aa, Mycobacterium
FQSGLSWLIILRKRENFRRAFCGFDIE

SEQ ID NO: 1072414 - protein, 33 aa, Mycobacterium
FQTSLPTAWLAEGLLPFLPAAAQHALFTAIDAN

SEQ ID NO: 1072415 - protein, 17 aa, Mycobacterium
FQVLCEAGLLPGALIRN

SEQ ID NO: 1072416 - protein, 18 aa, Mycobacterium
FQVLCEAGLLPGALIRNV

SEQ ID NO: 1072417 - protein, 30 aa, Mycobacterium
FRAALESGRLLRFPGAYSPLVARLVAEIGF

SEQ ID NO: 1072418 - protein, 27 aa, Mycobacterium
FRAENRWWQMLWSGDVWKAIVHLRSTR

SEQ ID NO: 1072419 - protein, 22 aa, Mycobacterium
FRALDYTLPWDVDGVEDAMPVD

SEQ ID NO: 1072420 - protein, 20 aa, Mycobacterium
FRGCEGDALLMLLDANGIEC

SEQ ID NO: 1072421 - protein, 20 aa, Mycobacterium
FRLWVCLHEVAHRVQFTANP

SEQ ID NO: 1072422 - protein, 20 aa, Mycobacterium
FRPGTLEKWDLGYDVLRERN

SEQ ID NO: 1072423 - protein, 18 aa, Mycobacterium
FRPKVPIVVVVGEPIEPT

SEQ ID NO: 1072424 - protein, 18 aa, Mycobacterium
FRQLLSGRDFAVNDMIAA

SEQ ID NO: 1072425 - protein, 27 aa, Mycobacterium
FRRHGAAPFRAPLRTSFRDFVALERQA

SEQ ID NO: 1072426 - protein, 21 aa, Mycobacterium
FRRNSCCLYYRLPGAGKRGDC

SEQ ID NO: 1072427 - protein, 21 aa, Mycobacterium
FRTDFLTLTRGTGIANAVFDG

SEQ ID NO: 1072428 - protein, 21 aa, Mycobacterium
FRTVLYTTCEVVRIAALLVQP

SEQ ID NO: 1072429 - protein, 22 aa, Mycobacterium
FRTVLYTTCEVVRIAALLVQPV

SEQ ID NO: 1072430 - protein, 17 aa, Mycobacterium
FSEALRWGAEVYHALKA

SEQ ID NO: 1072431 - protein, 19 aa, Mycobacterium
FSEDLLADLALSCALWVGM

SEQ ID NO: 1072432 - protein, 40 aa, Mycobacterium
FSEHAQSYQALSAQMAAFHDRFMNALAGASGSYASAEAAN

SEQ ID NO: 1072433 - protein, 17 aa, Mycobacterium
FSELRDAGRDLLELRRQ

SEQ ID NO: 1072434 - protein, 24 aa, Mycobacterium
FSEQLLPEHLHKVSLSFLVDDLVV

SEQ ID NO: 1072435 - protein, 17 aa, Mycobacterium
FSFGDYFKRGAIELAWA

SEQ ID NO: 1072436 - protein, 24 aa, Mycobacterium
FSGDLIDQSLLTYVMSEMPATGSF

SEQ ID NO: 1072437 - protein, 23 aa, Mycobacterium
FSHLDRPFLTYTQKTRAITDGKP

SEQ ID NO: 1072438 - protein, 24 aa, Mycobacterium
FSHLDRPFLTYTQKTRAITDGKPL

SEQ ID NO: 1072439 - protein, 17 aa, Mycobacterium
FSLTVPRRDGGERRLYL

SEQ ID NO: 1072440 - protein, 17 aa, Mycobacterium
FSLVELPVKLPRETLKK

SEQ ID NO: 1072441 - protein, 19 aa, Mycobacterium
FSMLYAFSENYVLPLSHDE

SEQ ID NO: 1072442 - protein, 36 aa, Mycobacterium; identical to SEQ ID NO: 813430

SEQ ID NO: 1072443 - protein, 17 aa, Mycobacterium
FSPLRHWNAGPGKRIAV

SEQ ID NO: 1072444 - protein, 21 aa, Mycobacterium
FSRLSPPWQPMRLVTEARSLE

SEQ ID NO: 1072445 - protein, 17 aa, Mycobacterium
FSRPIVGHIFTNYDGVL

SEQ ID NO: 1072446 - protein, 17 aa, Mycobacterium
FSRTPGRVLGPAPQLGA

SEQ ID NO: 1072447 - protein, 27 aa, Mycobacterium
FSSKQAILDALIRRLDEWRSLECIRAL

SEQ ID NO: 1072448 - protein, 26 aa, Mycobacterium
FSSNNRPFLPPPAPRALLAVLNGPPP

SEQ ID NO: 1072449 - protein, 17 aa, Mycobacterium
FSTALWAPRTIKRMAQH

SEQ ID NO: 1072450 - protein, 30 aa, Mycobacterium
FSVQAATFHEQLVRSLAAGGFSYATAEAAN

SEQ ID NO: 1072451 - protein, 17 aa, Mycobacterium
FSWSINLTYQFWVHTER

SEQ ID NO: 1072452 - protein, 19 aa, Mycobacterium
FTAFVPFAARWPVEVHIYP

SEQ ID NO: 1072453 - protein, 40 aa, Mycobacterium
FTASSLQTLPLDVLNAVNAPFQALTDRPLIGNGVAGAPGT

SEQ ID NO: 1072454 - protein, 25 aa, Mycobacterium
FTDILRGYYFAGDPRAFAILGRALP

SEQ ID NO: 1072455 - protein, 19 aa, Mycobacterium
FTEAARLGLLGFSVAERFG

SEQ ID NO: 1072456 - protein, 18 aa, Mycobacterium
FTEGLQLMKAAWSDEPRV

SEQ ID NO: 1072457 - protein, 17 aa, Mycobacterium
FTGAIPGGGRVVPIEGG

SEQ ID NO: 1072458 - protein, 18 aa, Mycobacterium
FTGDGVMAVFGAPAALEE

SEQ ID NO: 1072459 - protein, 17 aa, Mycobacterium
FTGLLQTGQSLAGNLVD

SEQ ID NO: 1072460 - protein, 24 aa, Mycobacterium
FTGNEKVWPFFEKAVPAPRGHKVP

SEQ ID NO: 1072461 - protein, 17 aa, Mycobacterium
FTIVRLPRVLGEDYQLR

SEQ ID NO: 1072462 - protein, 18 aa, Mycobacterium
FTLGVRLIRDSPLYSRIA

SEQ ID NO: 1072463 - protein, 22 aa, Mycobacterium
FTMWPSRHPYPHKDSWHAGRDL

SEQ ID NO: 1072464 - protein, 30 aa, Mycobacterium
FTPGPGVYTYWYYTQLRFPKKQGMRIDFIL

SEQ ID NO: 1072465 - protein, 20 aa, Mycobacterium
FTPPAQIRNFCIIAHIDHGK

SEQ ID NO: 1072466 - protein, 29 aa, Mycobacterium
FTQEHDLSLWLLRVQALRSAWGTPEVHRR

SEQ ID NO: 1072467 - protein, 17 aa, Mycobacterium
FTRMYRRIVAGSDPPDD

SEQ ID NO: 1072468 - protein, 19 aa, Mycobacterium
FTRNFWFCAVEDKSSFVQH

SEQ ID NO: 1072469 - protein, 17 aa, Mycobacterium
FTSWKTLSWVDANVWRR

SEQ ID NO: 1072470 - protein, 26 aa, Mycobacterium
FTTGEFQYCTAGHPPPLVVTAEAKAR

SEQ ID NO: 1072471 - protein, 20 aa, Mycobacterium
FTTTPFLAPAPLAPTGRGLP

SEQ ID NO: 1072472 - protein, 25 aa, Mycobacterium
FTVESGKLWLLQTRSAERSAQAAVR

SEQ ID NO: 1072473 - protein, 19 aa, Mycobacterium
FTVPPSQANFVWLPLEDRT

SEQ ID NO: 1072474 - protein, 20 aa, Mycobacterium
FVCRDAWLRVASTSTAWTSR

SEQ ID NO: 1072475 - protein, 17 aa, Mycobacterium
FVDTGLLHLGGNESHRA

SEQ ID NO: 1072476 - protein, 19 aa, Mycobacterium
FVEFAQYAEGLGFAGVLAG

SEQ ID NO: 1072477 - protein, 17 aa, Mycobacterium
FVEFVRDGQFDQVAQHR

SEQ ID NO: 1072478 - protein, 29 aa, Mycobacterium
FVELPTYAFERRRFWLSGDAVPADAAGLG

SEQ ID NO: 1072479 - protein, 23 aa, Mycobacterium
FVGMNTPLLLKGLARVFGQGTYM

SEQ ID NO: 1072480 - protein, 25 aa, Mycobacterium
FVGYQLDRVFAPRLGQPRSNGCSYA

SEQ ID NO: 1072481 - protein, 19 aa, Mycobacterium
FVHVRWDAVDMWLEEGRRL

SEQ ID NO: 1072482 - protein, 19 aa, Mycobacterium
FVIAVRTPPERHQGLSLLV

SEQ ID NO: 1072483 - protein, 37 aa, Mycobacterium; identical to SEQ ID NO: 813746

SEQ ID NO: 1072484 - protein, 24 aa, Mycobacterium
FVKRPDLWLRAISDYRITFTGGPN

SEQ ID NO: 1072485 - protein, 17 aa, Mycobacterium
FVLFGEFADAPAAWQRY

SEQ ID NO: 1072486 - protein, 17 aa, Mycobacterium
FVLLEMTGLMEEIDTDA

SEQ ID NO: 1072487 - protein, 19 aa, Mycobacterium
FVLPQRRPRRILFVSGGSG

SEQ ID NO: 1072488 - protein, 27 aa, Mycobacterium
FVMPHQPRFPFFDYPYIVVLVELDEGV

SEQ ID NO: 1072489 - protein, 18 aa, Mycobacterium
FVNELFALYRAGGAIDVL

SEQ ID NO: 1072490 - protein, 17 aa, Mycobacterium
FVPAFDIPGAEELLNPR

SEQ ID NO: 1072491 - protein, 22 aa, Mycobacterium
FVRGEFRALRVKVGEDTVTALL

SEQ ID NO: 1072492 - protein, 17 aa, Mycobacterium
FVRGFVGAGATLMQLSL

SEQ ID NO: 1072493 - protein, 18 aa, Mycobacterium
FVSRILIDPSALWGPPLT

SEQ ID NO: 1072494 - protein, 17 aa, Mycobacterium
FVSWSLLDVVAGVAGAP

SEQ ID NO: 1072495 - protein, 25 aa, Mycobacterium
FVTRMDYLSPFFNETAYCLGVEKLL

SEQ ID NO: 1072496 - protein, 26 aa, Mycobacterium
FVTYDALPGIPTLPPPAAKKRSRRST

SEQ ID NO: 1072497 - protein, 17 aa, Mycobacterium
FVVSRKLDKMGWRSSDT

SEQ ID NO: 1072498 - protein, 18 aa, Mycobacterium
FVVTQPERLAAAAGSLQE

SEQ ID NO: 1072499 - protein, 17 aa, Mycobacterium
FVVVDGELYATLTPSKW

SEQ ID NO: 1072500 - protein, 17 aa, Mycobacterium
FVYKGMLTTPQLKAFYL

SEQ ID NO: 1072501 - protein, 26 aa, Mycobacterium
FWDSEGFVLPVLTYTAPHAVADALRW

SEQ ID NO: 1072502 - protein, 17 aa, Mycobacterium
FWTQFGKVLKEGLMSDS

SEQ ID NO: 1072503 - protein, 18 aa, Mycobacterium
FYAALRHDGILILDQRNY

SEQ ID NO: 1072504 - protein, 25 aa, Mycobacterium
FYDDPAMTWLFPGDRARTTQLCRLF

SEQ ID NO: 1072505 - protein, 23 aa, Mycobacterium
FYDLDLITPQWSAGPIDAPDPKV

SEQ ID NO: 1072506 - protein, 19 aa, Mycobacterium
FYRELVGLPLFETFGDSFG

SEQ ID NO: 1072507 - protein, 21 aa, Mycobacterium
FYRGRGFLEGQYDDLRAGLRM

SEQ ID NO: 1072508 - protein, 26 aa, Mycobacterium
GAAAAFGFPGFGGNGGLLFGKAGADG

SEQ ID NO: 1072509 - protein, 24 aa, Mycobacterium
GAAAGSLFSWTQNATGPGAGIAGQ

SEQ ID NO: 1072510 - protein, 26 aa, Mycobacterium
GAAAQGFAWPWSICRWVTGENPKVGQ

SEQ ID NO: 1072511 - protein, 18 aa, Mycobacterium
GAADGWDPFPEFVGGLRA

SEQ ID NO: 1072512 - protein, 25 aa, Mycobacterium
GAADLTAPPDWMGVDLFGTPGANVP

SEQ ID NO: 1072513 - protein, 22 aa, Mycobacterium
GAAEFIAALPRSAWAVVTSASR

SEQ ID NO: 1072514 - protein, 25 aa, Mycobacterium
GAAGGAGAMRGNGGNGGSAGTGTTA

SEQ ID NO: 1072515 - protein, 28 aa, Mycobacterium
GAAGGAGGQGGFLGSAGSAGGSGVGGAG

SEQ ID NO: 1072516 - protein, 33 aa, Mycobacterium
GAAGLIGNGGAGGTGGWLFGDGGAGGTGGAGGW

SEQ ID NO: 1072517 - protein, 19 aa, Mycobacterium
GAAGLIGNGGMGGAGGAGA

SEQ ID NO: 1072518 - protein, 22 aa, Mycobacterium
GAAGLLGTAGHAGAGGGGGVGG

SEQ ID NO: 1072519 - protein, 18 aa, Mycobacterium
GAAGNGGWLIGNGGTGGQ

SEQ ID NO: 1072520 - protein, 24 aa, Mycobacterium
GAAGPLAYRLYRPASPGPHPVVVY

SEQ ID NO: 1072521 - protein, 19 aa, Mycobacterium
GAAGWLLGDGGAGGSGGLE

SEQ ID NO: 1072522 - protein, 23 aa, Mycobacterium
GAAKWALRGLTQTAAAELAPAGF

SEQ ID NO: 1072523 - protein, 37 aa, Mycobacterium
GAALGRVPEWSPAGQPLLLIPDAAAALFAARANPGIP

SEQ ID NO: 1072524 - protein, 25 aa, Mycobacterium
GAALLLDTWALLGRQDLRAAEEALC

SEQ ID NO: 1072525 - protein, 31 aa, Mycobacterium
GAALQFPAPVKYVAPIAFNVVPLAGWLVDDG

SEQ ID NO: 1072526 - protein, 17 aa, Mycobacterium
GAALRIAFRALTLAGVH

SEQ ID NO: 1072527 - protein, 18 aa, Mycobacterium
GAAPNVVRLAPPLVITEP

SEQ ID NO: 1072528 - protein, 26 aa, Mycobacterium
GAARRRAFRVWLDGRRAALVQLAPGY

SEQ ID NO: 1072529 - protein, 28 aa, Mycobacterium
GAASPRESWLRMVLIDAGLPVPVTQIPV

SEQ ID NO: 1072530 - protein, 38 aa, Mycobacterium
GAAVDFSVLYPAGRLVNAPPPAWTHRRFFVDGEGQDSK

SEQ ID NO: 1072531 - protein, 32 aa, Mycobacterium
GAAVHRFLPLEELIAAFLPVLFPGMEIVEHHA

SEQ ID NO: 1072532 - protein, 19 aa, Mycobacterium
GAAVLWRASFRFIGRDTEV

SEQ ID NO: 1072533 - protein, 24 aa, Mycobacterium
GAAVPLGILPARVAEFLAAIEAPI

SEQ ID NO: 1072534 - protein, 18 aa, Mycobacterium
GAAYVPLDPSWPPQQAEL

SEQ ID NO: 1072535 - protein, 20 aa, Mycobacterium
GACRFLGGYLTARLAQNPLI

SEQ ID NO: 1072536 - protein, 20 aa, Mycobacterium
GACTPRDAAAQPGGHSAART

SEQ ID NO: 1072537 - protein, 22 aa, Mycobacterium
GADAWDRLFSGPKPAELHPFVP

SEQ ID NO: 1072538 - protein, 23 aa, Mycobacterium
GADDRLLPALQTSLTGSAAELDV

SEQ ID NO: 1072539 - protein, 38 aa, Mycobacterium
GADEVSVAIAGLLRLHGQQYQQFGAHLSEFHARFTQML

SEQ ID NO: 1072540 - protein, 20 aa, Mycobacterium
GADGAPGGWLLGDGGAGGSG

SEQ ID NO: 1072541 - protein, 23 aa, Mycobacterium
GADGGAGGFLWGNGGNGGSGAAG

SEQ ID NO: 1072542 - protein, 25 aa, Mycobacterium
GADGSGGWLFGAGGVGGAGGVGGAG

SEQ ID NO: 1072543 - protein, 23 aa, Mycobacterium
GADLLALTLLTPPGEIGADIAFG

SEQ ID NO: 1072544 - protein, 22 aa, Mycobacterium
GADPVIMLTAPIPATQKVLKRS

SEQ ID NO: 1072545 - protein, 25 aa, Mycobacterium
GADRLALGPLMSGMFGDFAAADAFR

SEQ ID NO: 1072546 - protein, 29 aa, Mycobacterium
GADTVEWLRRQPWFTGRFATIGVSYLGFT

SEQ ID NO: 1072547 - protein, 23 aa, Mycobacterium
GADTVLVHPFDVAIAGGFPGTAT

SEQ ID NO: 1072548 - protein, 25 aa, Mycobacterium
GADVNTLVILLPETPKLDGRAAAAE

SEQ ID NO: 1072549 - protein, 23 aa, Mycobacterium
GADVVAIARPLLAPAIESATAVQ

SEQ ID NO: 1072550 - protein, 25 aa, Mycobacterium
GAEALALLRLPMVLPTVQLAGKVLG

SEQ ID NO: 1072551 - protein, 28 aa, Mycobacterium
GAEHITLPSIYFAHRRKVFKRDGMLLAV

SEQ ID NO: 1072552 - protein, 22 aa, Mycobacterium
GAELSMVLLDTAAMADLHMRWM

SEQ ID NO: 1072553 - protein, 23 aa, Mycobacterium
GAFEGPPPWNIGEPQPELAALIA

SEQ ID NO: 1072554 - protein, 23 aa, Mycobacterium
GAFGYWRESGRFILFEAPAVVMA

SEQ ID NO: 1072555 - protein, 20 aa, Mycobacterium
GAFLAWGDPSLYDSTLRILD

SEQ ID NO: 1072556 - protein, 19 aa, Mycobacterium
GAFVNWEGRYREFEPSLRG

SEQ ID NO: 1072557 - protein, 30 aa, Mycobacterium; identical to SEQ ID NO: 814208

SEQ ID NO: 1072558 - protein, 30 aa, Mycobacterium
GAGANPCLLTPPPWYPIVRGTTQQALFEVA

SEQ ID NO: 1072559 - protein, 25 aa, Mycobacterium
GAGCPIKVRLLVTAMRHAAMSREIA

SEQ ID NO: 1072560 - protein, 18 aa, Mycobacterium
GAGFVYIGGIQRLLEAGQ

SEQ ID NO: 1072561 - protein, 23 aa, Mycobacterium
GAGGAAIGLFGNGGTGGTGGYNQ

SEQ ID NO: 1072562 - protein, 23 aa, Mycobacterium
GAGGAGGLWGGGGIGGTGGFGAL

SEQ ID NO: 1072563 - protein, 26 aa, Mycobacterium
GAGGAGGVGGLLFGAGGAGGAGGSGT

SEQ ID NO: 1072564 - protein, 20 aa, Mycobacterium
GAGGAGGWLLGDGGGGGGGA

SEQ ID NO: 1072565 - protein, 27 aa, Mycobacterium
GAGGASAIPLGPDLIGKGGAGGPGGLF

SEQ ID NO: 1072566 - protein, 23 aa, Mycobacterium
GAGGDAWLFGSGGSGGSGGAGAI

SEQ ID NO: 1072567 - protein, 25 aa, Mycobacterium
GAGGDGGNAPLLGRGGAGGVGGASD

SEQ ID NO: 1072568 - protein, 18 aa, Mycobacterium
GAGGFLYGNGGNGYSFTS

SEQ ID NO: 1072569 - protein, 25 aa, Mycobacterium
GAGGGVGLIGFGGAGGFGGASGFGT

SEQ ID NO: 1072570 - protein, 22 aa, Mycobacterium
GAGGLGLFGAGGVATSAGGAGG

SEQ ID NO: 1072571 - protein, 19 aa, Mycobacterium
GAGGLLFGTGGSGGAGGGS

SEQ ID NO: 1072572 - protein, 18 aa, Mycobacterium
GAGGLLGGGGLGGAGGAS

SEQ ID NO: 1072573 - protein, 18 aa, Mycobacterium
GAGGLLRGMGGAGGTGGT

SEQ ID NO: 1072574 - protein, 24 aa, Mycobacterium
GAGGNALGLFGHGGAGGAGGYDVT

SEQ ID NO: 1072575 - protein, 24 aa, Mycobacterium
GAGGSGGWLVGNGGAGGIGGIGAS

SEQ ID NO: 1072576 - protein, 26 aa, Mycobacterium
GAGGTGAPAPFGSGGAYGGTGGHGGT

SEQ ID NO: 1072577 - protein, 32 aa, Mycobacterium
GAGGTGGHGGLLIGNGGAGGIGGTRGSGGAGA

SEQ ID NO: 1072578 - protein, 25 aa, Mycobacterium
GAGGTGGILLGPGGGGGGGGNGTGT

SEQ ID NO: 1072579 - protein, 23 aa, Mycobacterium
GAGGTGGWLYGSGGSGGIGGVGG

SEQ ID NO: 1072580 - protein, 24 aa, Mycobacterium
GAGGTGSYATGFGTGGTGGTGGTA

SEQ ID NO: 1072581 - protein, 20 aa, Mycobacterium
GAGGWLLGNGGAGGAGGASA

SEQ ID NO: 1072582 - protein, 23 aa, Mycobacterium
GAGIRPPWSLGEPQPELATLIEQ

SEQ ID NO: 1072583 - protein, 17 aa, Mycobacterium
GAGLALALVLDGCGKQV

SEQ ID NO: 1072584 - protein, 23 aa, Mycobacterium
GAGLITVPLWSTVLARRALGLPR

SEQ ID NO: 1072585 - protein, 17 aa, Mycobacterium
GAGLPELATQLSAALSA

SEQ ID NO: 1072586 - protein, 19 aa, Mycobacterium
GAGLTLALAADWRVSGDNV

SEQ ID NO: 1072587 - protein, 34 aa, Mycobacterium
GAGNRDLLKQLLPIVLPIVLAYIGNQLGSGEGSQ

SEQ ID NO: 1072588 - protein, 27 aa, Mycobacterium
GAGNWLLAVPAIHIAGLQVLVRSALAG

SEQ ID NO: 1072589 - protein, 20 aa, Mycobacterium
GAGRYQLLCRTGERIRVCDW

SEQ ID NO: 1072590 - protein, 28 aa, Mycobacterium
GAGYEDLAWFCVRAWRFGAPASYGAGGL

SEQ ID NO: 1072591 - protein, 17 aa, Mycobacterium
GAHGADGFSPITGGNGG

SEQ ID NO: 1072592 - protein, 22 aa, Mycobacterium
GAHGADGFSPITGGNGGDGGSG

SEQ ID NO: 1072593 - protein, 26 aa, Mycobacterium
GAHLSEFHARFTQMLSAGANEYSQAE

SEQ ID NO: 1072594 - protein, 17 aa, Mycobacterium
GAHQSNWARLADTGVRM

SEQ ID NO: 1072595 - protein, 18 aa, Mycobacterium
GAHRFLQRVWRLVIDENT

SEQ ID NO: 1072596 - protein, 23 aa, Mycobacterium
GAIELAWALLTNSVADGGYGLDP

SEQ ID NO: 1072597 - protein, 25 aa, Mycobacterium
GAINAPTEFLLGRPLIGNGADGTAA

SEQ ID NO: 1072598 - protein, 24 aa, Mycobacterium
GAINAPTRALLGRPLIGNGTNGTA

SEQ ID NO: 1072599 - protein, 36 aa, Mycobacterium
GAIVPWNVPQFLIMPKLIPALIAGCTVSIKPAPETP

SEQ ID NO: 1072600 - protein, 26 aa, Mycobacterium
GAKDQLRFTAPPRLDLSLLVSALPED

SEQ ID NO: 1072601 - protein, 20 aa, Mycobacterium
GAKEILCIRVLGGSSRRYAG

SEQ ID NO: 1072602 - protein, 25 aa, Mycobacterium
GAKEQLGILARFAGAALVAKEDTVP

SEQ ID NO: 1072603 - protein, 19 aa, Mycobacterium
GAKLRPLFSQLAEHGLALE

SEQ ID NO: 1072604 - protein, 17 aa, Mycobacterium
GALCERLGYAQLADVEQ

SEQ ID NO: 1072605 - protein, 20 aa, Mycobacterium
GALDSFTLRVGRPIGPMLAQ

SEQ ID NO: 1072606 - protein, 25 aa, Mycobacterium
GALEAIGVAARLRMTCVATGAAGTT

SEQ ID NO: 1072607 - protein, 21 aa, Mycobacterium
GALGGLLNGAGGNGGAGGAGG

SEQ ID NO: 1072608 - protein, 22 aa, Mycobacterium
GALGLRPTLAALASGARLALAN

SEQ ID NO: 1072609 - protein, 22 aa, Mycobacterium
GALGMLFDTLLGLTASVLTGSR

SEQ ID NO: 1072610 - protein, 24 aa, Mycobacterium
GALHQVLPADLLAHSLRELAARTG

SEQ ID NO: 1072611 - protein, 25 aa, Mycobacterium
GALHRTLRGELLGLPVRLTEIAPGA

SEQ ID NO: 1072612 - protein, 20 aa, Mycobacterium
GALLLGARLGPARTAGICAI

SEQ ID NO: 1072613 - protein, 18 aa, Mycobacterium
GALLLGGRLGPARTAAIC

SEQ ID NO: 1072614 - protein, 19 aa, Mycobacterium
GALPVEVPTIAVAPPRSPA

SEQ ID NO: 1072615 - protein, 20 aa, Mycobacterium
GALRIPEMIRWPGKISAGVV

SEQ ID NO: 1072616 - protein, 25 aa, Mycobacterium
GALRRSIKFATFLDAIDAVRRVAEH

SEQ ID NO: 1072617 - protein, 29 aa, Mycobacterium
GALVVLVDGALAWFLERGGRTLLTFTNDP

SEQ ID NO: 1072618 - protein, 24 aa, Mycobacterium
GAMFDPSAVFYMSKIAVGPEAAHV

SEQ ID NO: 1072619 - protein, 27 aa, Mycobacterium
GAMFGVEVQFWVFEETLIRCPIENSLT

SEQ ID NO: 1072620 - protein, 22 aa, Mycobacterium
GANFAGLFRDSAGGTTLNVGFA

SEQ ID NO: 1072621 - protein, 23 aa, Mycobacterium
GANGAPGLAGGTGGAGGFGGTGG

SEQ ID NO: 1072622 - protein, 25 aa, Mycobacterium
GANLALLVGARPRGPGMERSDLLEA

SEQ ID NO: 1072623 - protein, 18 aa, Mycobacterium
GAPATALLIDFRDLSVQA

SEQ ID NO: 1072624 - protein, 20 aa, Mycobacterium
GAPFGLRPQAILPAYGMAEI

SEQ ID NO: 1072625 - protein, 20 aa, Mycobacterium
GAPMALWVQGPARLDQVVQR

SEQ ID NO: 1072626 - protein, 25 aa, Mycobacterium
GAPNPLYWRGARLVGNYPLSIALDG

SEQ ID NO: 1072627 - protein, 28 aa, Mycobacterium
GAPNPRFLQRMILVLNQIQRRGFVVERL

SEQ ID NO: 1072628 - protein, 24 aa, Mycobacterium
GAPNPYIYPENLPRVNARGGPGGR

SEQ ID NO: 1072629 - protein, 26 aa, Mycobacterium
GAPVEDRGRRYIAMVLVDSSGAEVVY

SEQ ID NO: 1072630 - protein, 30 aa, Mycobacterium
GAQASLFHDQFVQALNGGGFLYAATEATSA

SEQ ID NO: 1072631 - protein, 25 aa, Mycobacterium
GAQGRLLRLWRPPCGPGQWCTLGLF

SEQ ID NO: 1072632 - protein, 24 aa, Mycobacterium
GAQLVTATLWSLPTTAAYRQFVAE

SEQ ID NO: 1072633 - protein, 29 aa, Mycobacterium
GAQSPRESYLRLFLIDAGLPRPQTQLPVL

SEQ ID NO: 1072634 - protein, 30 aa, Mycobacterium; identical to SEQ ID NO: 814669

SEQ ID NO: 1072635 - protein, 25 aa, Mycobacterium
GARARFGDVLPFLVKVLAADEPLSL

SEQ ID NO: 1072636 - protein, 21 aa, Mycobacterium
GARDPLRLPGNAHFTFRGCEG

SEQ ID NO: 1072637 - protein, 25 aa, Mycobacterium
GAREHALLLALARDPQVSGLVVAPG

SEQ ID NO: 1072638 - protein, 17 aa, Mycobacterium
GARFLAQHRWRDGVMKL

SEQ ID NO: 1072639 - protein, 21 aa, Mycobacterium
GARGLHLFATLLSAAENATGS

SEQ ID NO: 1072640 - protein, 20 aa, Mycobacterium
GARHQALVSIFLDAVVRGDS

SEQ ID NO: 1072641 - protein, 23 aa, Mycobacterium
GARLDSLVPLGPPVMDVALNITC

SEQ ID NO: 1072642 - protein, 25 aa, Mycobacterium
GARNAGLLAVRMLGSSDPALRARIA

SEQ ID NO: 1072643 - protein, 24 aa, Mycobacterium
GARNSPRLWIVTRGAQQLSPADEV

SEQ ID NO: 1072644 - protein, 25 aa, Mycobacterium
GARQRLVHRLPTRPDPHAQLGNIFH

SEQ ID NO: 1072645 - protein, 30 aa, Mycobacterium; identical to SEQ ID NO: 814736

SEQ ID NO: 1072646 - protein, 20 aa, Mycobacterium
GARSLLLNMVAAVTAAGGNA

SEQ ID NO: 1072647 - protein, 17 aa, Mycobacterium
GASFYQVGIADVLHRWF

SEQ ID NO: 1072648 - protein, 23 aa, Mycobacterium
GASIYNVSVLLDPNQGLANLLAN

SEQ ID NO: 1072649 - protein, 17 aa, Mycobacterium
GASLPEVVAAFTGGLNG

SEQ ID NO: 1072650 - protein, 23 aa, Mycobacterium
GASPRFLLDFSRRFPDATLVRLE

SEQ ID NO: 1072651 - protein, 18 aa, Mycobacterium
GASPRKVIVVAGRLVNLV

SEQ ID NO: 1072652 - protein, 30 aa, Mycobacterium
GATGGTGGSGGYGGDSYFGANGGAGGTGGT

SEQ ID NO: 1072653 - protein, 22 aa, Mycobacterium
GATHRLPVWPTTPAPTTTEFDR

SEQ ID NO: 1072654 - protein, 17 aa, Mycobacterium
GATPFLEQLLAAAQRAG

SEQ ID NO: 1072655 - protein, 24 aa, Mycobacterium
GATPYRVLVAAFTTWVAGRGQQRD

SEQ ID NO: 1072656 - protein, 24 aa, Mycobacterium
GATRGWFMSWLARAHPDLVGTYRE

SEQ ID NO: 1072657 - protein, 23 aa, Mycobacterium
GATSGRRVLATSGLAPAADHRKK

SEQ ID NO: 1072658 - protein, 31 aa, Mycobacterium; identical to SEQ ID NO: 814841

SEQ ID NO: 1072659 - protein, 17 aa, Mycobacterium
GAVDYLEIWDAQAWHEY

SEQ ID NO: 1072660 - protein, 33 aa, Mycobacterium
GAVEQKFLMDGAFLSVFGVPIQVTLDGRLPELI

SEQ ID NO: 1072661 - protein, 30 aa, Mycobacterium
GAVESILTVLALRDQVIPPTLNLVNLDPDI

SEQ ID NO: 1072662 - protein, 19 aa, Mycobacterium
GAVGGASGWLLGNGGAGGD

SEQ ID NO: 1072663 - protein, 19 aa, Mycobacterium
GAVGGTGGWLLGDGGAGGD

SEQ ID NO: 1072664 - protein, 30 aa, Mycobacterium
GAVNAPVQTLTGRPLIGNGTPGAAGSGAAG

SEQ ID NO: 1072665 - protein, 23 aa, Mycobacterium
GAVQKALVHKAGLSSGLQPGDVE

SEQ ID NO: 1072666 - protein, 22 aa, Mycobacterium
GAVSRVRPMWVLRARGEPGYGS

SEQ ID NO: 1072667 - protein, 19 aa, Mycobacterium
GAVVRYIMSRLDDPTPNTS

SEQ ID NO: 1072668 - protein, 23 aa, Mycobacterium
GAWGRFYESPYAGSWPYGLPELP

SEQ ID NO: 1072669 - protein, 26 aa, Mycobacterium
GAWRNHVMYIRYLDRYLLGGDGAWRI

SEQ ID NO: 1072670 - protein, 22 aa, Mycobacterium
GAYLIDQPLMRNVLADLAVEAE

SEQ ID NO: 1072671 - protein, 17 aa, Mycobacterium
GAYTGTGPGSSAAGGLG

SEQ ID NO: 1072672 - protein, 25 aa, Mycobacterium
GCAGLRYNLFFDDRALDGDLTAEFG

SEQ ID NO: 1072673 - protein, 27 aa, Mycobacterium
GCASTAWPAAFYALHNWMLALFDERAQ

SEQ ID NO: 1072674 - protein, 38 aa, Mycobacterium
GCATASARRFRWAYRPPLPRRWPTRWPSCWAAMHAPTR

SEQ ID NO: 1072675 - protein, 20 aa, Mycobacterium
GCATPARVFKGTRMAGRMGN

SEQ ID NO: 1072676 - protein, 18 aa, Mycobacterium
GCCDLAFAAPDAARAIKS

SEQ ID NO: 1072677 - protein, 17 aa, Mycobacterium
GCDLAHADKLIYSVGVD

SEQ ID NO: 1072678 - protein, 17 aa, Mycobacterium
GCDPFVIDAFDLASRPG

SEQ ID NO: 1072679 - protein, 25 aa, Mycobacterium
GCDYYIFSIFSFLDSRMWSHHCAVI

SEQ ID NO: 1072680 - protein, 18 aa, Mycobacterium
GCGAAAVNPYLAFASIED

SEQ ID NO: 1072681 - protein, 31 aa, Mycobacterium
GCHHLQIIVTSWSRTGLPLSRLRLADELVEI

SEQ ID NO: 1072682 - protein, 25 aa, Mycobacterium
GCIRHTCWLPVLWRLPCGKSRTPRA

SEQ ID NO: 1072683 - protein, 18 aa, Mycobacterium
GCISYEPAFAIDVEWTLL

SEQ ID NO: 1072684 - protein, 23 aa, Mycobacterium
GCQAQRPGSWWKNFGAKMHYRAS

SEQ ID NO: 1072685 - protein, 23 aa, Mycobacterium
GCSKVGLPLVRRALELLPDVGFV

SEQ ID NO: 1072686 - protein, 17 aa, Mycobacterium
GCSLRNGLFAYKIELRD

SEQ ID NO: 1072687 - protein, 26 aa, Mycobacterium
GCSTYKWETFLTSELPEWLSANRSVK

SEQ ID NO: 1072688 - protein, 23 aa, Mycobacterium
GCTGVFVTLVPFAVDGGIALTAV

SEQ ID NO: 1072689 - protein, 23 aa, Mycobacterium
GCVFQDFRLLQQKTVYENVAFAL

SEQ ID NO: 1072690 - protein, 18 aa, Mycobacterium
GCVMRPHLFLQKNQAWNL

SEQ ID NO: 1072691 - protein, 22 aa, Mycobacterium
GCWRSYLTCDANLAVTLPAGLS

SEQ ID NO: 1072692 - protein, 19 aa, Mycobacterium
GDAAAPLLVFYHGGGWALG

SEQ ID NO: 1072693 - protein, 25 aa, Mycobacterium
GDAALAVFGAPLRTGDPASAALATA

SEQ ID NO: 1072694 - protein, 19 aa, Mycobacterium
GDAGAALALPADAVVLSAD

SEQ ID NO: 1072695 - protein, 26 aa, Mycobacterium
GDAGDIAYPYYLVNGRIPAAPTSFKA

SEQ ID NO: 1072696 - protein, 27 aa, Mycobacterium
GDDTLFLERFVLRPRHIEVQVLADTHG

SEQ ID NO: 1072697 - protein, 19 aa, Mycobacterium
GDEAALRPFLLVASFINPH

SEQ ID NO: 1072698 - protein, 27 aa, Mycobacterium
GDECHMAFHFPLMPRIFMAVRRESRFP

SEQ ID NO: 1072699 - protein, 21 aa, Mycobacterium
GDEHLAMLRRLMMDDSFFRGE

SEQ ID NO: 1072700 - protein, 29 aa, Mycobacterium
GDESMSLTMALLAAAVLYAASAEAADIDC

SEQ ID NO: 1072701 - protein, 17 aa, Mycobacterium
GDFLSAGGHLQVSGRPV

SEQ ID NO: 1072702 - protein, 20 aa, Mycobacterium
GDFWLVGRRGSVARTARGMI

SEQ ID NO: 1072703 - protein, 17 aa, Mycobacterium
GDGEPAEPASDDLDAVA

SEQ ID NO: 1072704 - protein, 24 aa, Mycobacterium
GDGGDAGLLGKGGYGGSAGLLIGN

SEQ ID NO: 1072705 - protein, 18 aa, Mycobacterium
GDGGLFFSSGGAGGEGGA

SEQ ID NO: 1072706 - protein, 24 aa, Mycobacterium
GDGGLGGTGFFGAGGAGGAAGNAG

SEQ ID NO: 1072707 - protein, 24 aa, Mycobacterium
GDGGNATDLMIGNGGNGGTGGSGA

SEQ ID NO: 1072708 - protein, 19 aa, Mycobacterium
GDGGVAAGAFGVNGSDGAD

SEQ ID NO: 1072709 - protein, 20 aa, Mycobacterium
GDGGWLFGSGGNGAAGAAGQ

SEQ ID NO: 1072710 - protein, 20 aa, Mycobacterium
GDGPLPLMWGEYRPGELVRG

SEQ ID NO: 1072711 - protein, 24 aa, Mycobacterium
GDGQPWFRDDLSFADPSIPRSGSA

SEQ ID NO: 1072712 - protein, 25 aa, Mycobacterium
GDGRRFWIVGLEIDRHWPALCRVVE

SEQ ID NO: 1072713 - protein, 23 aa, Mycobacterium
GDGVAPIAGLAAGAALTAGGAVS

SEQ ID NO: 1072714 - protein, 18 aa, Mycobacterium
GDHARIATWRREVSLRRT

SEQ ID NO: 1072715 - protein, 25 aa, Mycobacterium
GDIDGFWAAVLHRTAERRGELPSNA

SEQ ID NO: 1072716 - protein, 26 aa, Mycobacterium
GDIDRGGVFAAFFGTIALLSVEDQAL

SEQ ID NO: 1072717 - protein, 24 aa, Mycobacterium
GDIDYRSFQTIVFRTDLIADADVL

SEQ ID NO: 1072718 - protein, 28 aa, Mycobacterium
GDINAPPVLLIMGLGAQLLLWRTGFCQK

SEQ ID NO: 1072719 - protein, 24 aa, Mycobacterium
GDIPTLLTGVEWLDTARAAGVDAI

SEQ ID NO: 1072720 - protein, 23 aa, Mycobacterium
GDITGPLGMLRYADPKDAGEFDR

SEQ ID NO: 1072721 - protein, 28 aa, Mycobacterium
GDIWDWAVDWDTWVGMSALLSFPTVHQP

SEQ ID NO: 1072722 - protein, 17 aa, Mycobacterium
GDKIWVAGYAVRDPSPR

SEQ ID NO: 1072723 - protein, 25 aa, Mycobacterium
GDKPLEVVLFHHRPERYEFCVTLPR

SEQ ID NO: 1072724 - protein, 33 aa, Mycobacterium; identical to SEQ ID NO: 815248

SEQ ID NO: 1072725 - protein, 21 aa, Mycobacterium
GDLAGLILNAPSFPGRDSFGA

SEQ ID NO: 1072726 - protein, 25 aa, Mycobacterium
GDLDPGVIGYLWRTAKLGVDEIESM

SEQ ID NO: 1072727 - protein, 24 aa, Mycobacterium
GDLKTSVFALYQPPAPPSMTADPD

SEQ ID NO: 1072728 - protein, 19 aa, Mycobacterium
GDLLDLLNLEIRALPGVLS

SEQ ID NO: 1072729 - protein, 19 aa, Mycobacterium
GDLLGPDPILLPPDSEAEQ

SEQ ID NO: 1072730 - protein, 23 aa, Mycobacterium
GDLLITHWVTTFALDPPPLPIIG

SEQ ID NO: 1072731 - protein, 20 aa, Mycobacterium
GDLPSNLIRSITWDQGIEMA

SEQ ID NO: 1072732 - protein, 24 aa, Mycobacterium
GDMEALMAMLAPDATWLADSGGKV

SEQ ID NO: 1072733 - protein, 25 aa, Mycobacterium
GDMGPALVLPLRATDAVAGVVVLLH

SEQ ID NO: 1072734 - protein, 20 aa, Mycobacterium
GDNRPFVVALIAIDPEGFEV

SEQ ID NO: 1072735 - protein, 23 aa, Mycobacterium
GDNVGLLFKKLTKSDLAAGDVIT

SEQ ID NO: 1072736 - protein, 24 aa, Mycobacterium
GDPGRLFGRMLGCDLGMNPPFEMD

SEQ ID NO: 1072737 - protein, 17 aa, Mycobacterium
GDPGVGTTYNGISGHNG

SEQ ID NO: 1072738 - protein, 24 aa, Mycobacterium
GDPTVFPGHWYSAEPSASLSEVKR

SEQ ID NO: 1072739 - protein, 24 aa, Mycobacterium
GDPVELIALFKTYGAAGSEALLGS

SEQ ID NO: 1072740 - protein, 22 aa, Mycobacterium
GDPVGGWPEPLRSAALAGRAPA

SEQ ID NO: 1072741 - protein, 23 aa, Mycobacterium
GDPWKINATLQSGRPAQISDLAQ

SEQ ID NO: 1072742 - protein, 23 aa, Mycobacterium
GDQPLTGQWPHRANTHGPKGLGY

SEQ ID NO: 1072743 - protein, 31 aa, Mycobacterium; identical to SEQ ID NO: 815373

SEQ ID NO: 1072744 - protein, 22 aa, Mycobacterium
GDRGPVWVFSGQGSQWAAMGAD

SEQ ID NO: 1072745 - protein, 20 aa, Mycobacterium
GDRRAGWVGLPLAGVQTRLV

SEQ ID NO: 1072746 - protein, 26 aa, Mycobacterium
GDRTYDLAYLRAIHRQLFQDVYVWAG

SEQ ID NO: 1072747 - protein, 22 aa, Mycobacterium
GDSAIFEYLDAKLVIHHSRDHT

SEQ ID NO: 1072748 - protein, 25 aa, Mycobacterium
GDTAVPLCFGFHPYLQLPGVPRTEW

SEQ ID NO: 1072749 - protein, 22 aa, Mycobacterium
GDTGRILLRPSGTEPLIRVMVE

SEQ ID NO: 1072750 - protein, 17 aa, Mycobacterium
GDTLFLEGCGRTDFPGG

SEQ ID NO: 1072751 - protein, 24 aa, Mycobacterium
GDTPLIGFAGAPFTLASYLVEGGP

SEQ ID NO: 1072752 - protein, 29 aa, Mycobacterium
GDVIRRKAGLPPATYFSGGKLQWILEDVD

SEQ ID NO: 1072753 - protein, 21 aa, Mycobacterium
GDVLITSWVTNFAADPAPLQV

SEQ ID NO: 1072754 - protein, 22 aa, Mycobacterium
GDYLEELLDLLDFDGDIDLDVE

SEQ ID NO: 1072755 - protein, 26 aa, Mycobacterium
GDYQGLVGVPLFDIAAAPGFGNTTTS

SEQ ID NO: 1072756 - protein, 20 aa, Mycobacterium
GEAREEAIRIAAAAKREYEA

SEQ ID NO: 1072757 - protein, 27 aa, Mycobacterium
GECRHNLGYWNGGQWWGAGPGAHGYVG

SEQ ID NO: 1072758 - protein, 20 aa, Mycobacterium
GEDFSWYLEEVPGAMGRLGV

SEQ ID NO: 1072759 - protein, 24 aa, Mycobacterium
GEDGVIAWLLSGPEHTYHVALPGR

SEQ ID NO: 1072760 - protein, 26 aa, Mycobacterium
GEDTLYLWSALPSWRPTWPTVAVNNS

SEQ ID NO: 1072761 - protein, 23 aa, Mycobacterium
GEEQFMAWRRSYDTPPPLIEKGS

SEQ ID NO: 1072762 - protein, 20 aa, Mycobacterium
GEERLGRFPASPASVATLSG

SEQ ID NO: 1072763 - protein, 30 aa, Mycobacterium; identical to SEQ ID NO: 815605

SEQ ID NO: 1072764 - protein, 29 aa, Mycobacterium
GEETGFPLFTPRFDGAFTAGLYSVAPTKQ

SEQ ID NO: 1072765 - protein, 18 aa, Mycobacterium
GEFAVHLALASGGKCFYT

SEQ ID NO: 1072766 - protein, 27 aa, Mycobacterium
GEFGLDRWYQQLTRLWASLASDPHPSR

SEQ ID NO: 1072767 - protein, 19 aa, Mycobacterium
GEFIPRPIKSSFREGLTVL

SEQ ID NO: 1072768 - protein, 17 aa, Mycobacterium
GEFLPPSVVFDYPTVYS

SEQ ID NO: 1072769 - protein, 18 aa, Mycobacterium
GEFRKLWISRINAAARAN

SEQ ID NO: 1072770 - protein, 24 aa, Mycobacterium
GEFSEPFIQLWDPAYTYVGSNIAT

SEQ ID NO: 1072771 - protein, 32 aa, Mycobacterium; identical to SEQ ID NO: 114674

SEQ ID NO: 1072772 - protein, 18 aa, Mycobacterium
GEFVAHSAAFHAMMQALT

SEQ ID NO: 1072773 - protein, 19 aa, Mycobacterium
GEGFGIWQLGDDDAMLGIV

SEQ ID NO: 1072774 - protein, 23 aa, Mycobacterium
GEGLQTGLRYLARQSVAIGGGPT

SEQ ID NO: 1072775 - protein, 27 aa, Mycobacterium
GEGLYEMTLALWDWGFELEDVRAHFDV

SEQ ID NO: 1072776 - protein, 26 aa, Mycobacterium
GEGMALAMIATLPPGGHFASADISVD

SEQ ID NO: 1072777 - protein, 25 aa, Mycobacterium
GEGPYVQLWPHRHGTDAMFAAALRR

SEQ ID NO: 1072778 - protein, 26 aa, Mycobacterium
GEGTCIRLWVLEVLYRCALWSQRCYE

SEQ ID NO: 1072779 - protein, 30 aa, Mycobacterium; identical to SEQ ID NO: 815659

SEQ ID NO: 1072780 - protein, 26 aa, Mycobacterium
GEIAVRVIRTLRRLGIRSVAVYSDAD

SEQ ID NO: 1072781 - protein, 18 aa, Mycobacterium
GEIKACWIICSNPVATVA

SEQ ID NO: 1072782 - protein, 17 aa, Mycobacterium
GEILAARLAFLVCGGTG

SEQ ID NO: 1072783 - protein, 25 aa, Mycobacterium
GEKDQTILVFDLGGGTFDVSLLEIG

SEQ ID NO: 1072784 - protein, 19 aa, Mycobacterium
GELAEVRKLLMNPQIREAA

SEQ ID NO: 1072785 - protein, 19 aa, Mycobacterium
GELPTWQWESLISKSTRLV

SEQ ID NO: 1072786 - protein, 22 aa, Mycobacterium
GELRPQLLDRFGLTVDVHASRD

SEQ ID NO: 1072787 - protein, 23 aa, Mycobacterium
GELSRVMLALEVVLAASAAGTTM

SEQ ID NO: 1072788 - protein, 25 aa, Mycobacterium
GELVRGRWGLLEPPAPWLPESAVGQ

SEQ ID NO: 1072789 - protein, 30 aa, Mycobacterium
GELYGRRELLAAMPPFLTGGSMIETVTMEA

SEQ ID NO: 1072790 - protein, 25 aa, Mycobacterium
GEMATPRLPAPPPQPPIRGGADLAP

SEQ ID NO: 1072791 - protein, 24 aa, Mycobacterium
GENLSFADLLPWIDAHDDARPELI

SEQ ID NO: 1072792 - protein, 18 aa, Mycobacterium
GEPRLRLLGFERVELEPG

SEQ ID NO: 1072793 - protein, 20 aa, Mycobacterium
GEPVSCFLLRIEDNMESIGR

SEQ ID NO: 1072794 - protein, 19 aa, Mycobacterium
GEQFGMVFTKDGGRLFLHT

SEQ ID NO: 1072795 - protein, 24 aa, Mycobacterium
GEQLDWGTYVFDFGRPEVRNFLVA

SEQ ID NO: 1072796 - protein, 22 aa, Mycobacterium
GEQLRQFYKLGVSPIPPNTPNI

SEQ ID NO: 1072797 - protein, 27 aa, Mycobacterium
GEQNLVLFGRLYGLRKSRARQRAQELL

SEQ ID NO: 1072798 - protein, 21 aa, Mycobacterium
GEQWLSVCGFRRAENAEPAEP

SEQ ID NO: 1072799 - protein, 25 aa, Mycobacterium
GERFSVVAFTAHGPFVLAQWADAAE

SEQ ID NO: 1072800 - protein, 31 aa, Mycobacterium; identical to SEQ ID NO: 815857

SEQ ID NO: 1072801 - protein, 24 aa, Mycobacterium
GERPPHFVTMLRKPVIAAINGPCV

SEQ ID NO: 1072802 - protein, 17 aa, Mycobacterium
GERQPLPRLPIVEHALP

SEQ ID NO: 1072803 - protein, 27 aa, Mycobacterium
GESDPVVLLAIAFVVRALRGGSVCVDL

SEQ ID NO: 1072804 - protein, 25 aa, Mycobacterium
GESVAKLRPMPVGRHTFFTREEGVT

SEQ ID NO: 1072805 - protein, 24 aa, Mycobacterium
GETASIFLPSVPNLLQLASELEAQ

SEQ ID NO: 1072806 - protein, 26 aa, Mycobacterium
GETELDLVLAILRARQLFAGAQALPG

SEQ ID NO: 1072807 - protein, 17 aa, Mycobacterium
GETERHIRLIFQRAREK

SEQ ID NO: 1072808 - protein, 23 aa, Mycobacterium
GEVDVRIWIHPEHRKKGYGTAAL

SEQ ID NO: 1072809 - protein, 26 aa, Mycobacterium
GEVVEMSFVITAPEALTAAATDLASL

SEQ ID NO: 1072810 - protein, 22 aa, Mycobacterium
GEVVFPLAADDLPYLHPVTVVN

SEQ ID NO: 1072811 - protein, 18 aa, Mycobacterium
GEWLVSRSGLRYRMHSYR

SEQ ID NO: 1072812 - protein, 20 aa, Mycobacterium
GFAAGPAPRRVAGRRRSWSG

SEQ ID NO: 1072813 - protein, 18 aa, Mycobacterium
GFALILVGHVTKDGAIAG

SEQ ID NO: 1072814 - protein, 27 aa, Mycobacterium
GFALLSDDFTYWSIITRSAFEKDALRR

SEQ ID NO: 1072815 - protein, 32 aa, Mycobacterium; identical to SEQ ID NO: 816000

SEQ ID NO: 1072816 - protein, 20 aa, Mycobacterium
GFDAGFFGIAPREALAMDPQ

SEQ ID NO: 1072817 - protein, 25 aa, Mycobacterium
GFDELRRRHLVPDPPYGQGVAAAVA

SEQ ID NO: 1072818 - protein, 24 aa, Mycobacterium
GFDLTLEHWAAHDGLSALSPSRNP

SEQ ID NO: 1072819 - protein, 33 aa, Mycobacterium; identical to SEQ ID NO: 816021

SEQ ID NO: 1072820 - protein, 17 aa, Mycobacterium
GFDQLLPEDGRIQASLW

SEQ ID NO: 1072821 - protein, 17 aa, Mycobacterium
GFEFVAMARALLAEPDL

SEQ ID NO: 1072822 - protein, 23 aa, Mycobacterium
GFERFYGFLGGETNQWYPDLVYD

SEQ ID NO: 1072823 - protein, 25 aa, Mycobacterium
GFESAWRVNCLGAFLGMRAALGALS

SEQ ID NO: 1072824 - protein, 21 aa, Mycobacterium
GFGEQAILRDVPRTATVRAVG

SEQ ID NO: 1072825 - protein, 19 aa, Mycobacterium
GFLAWHAWSDSQRGNWPLG

SEQ ID NO: 1072826 - protein, 20 aa, Mycobacterium
GFLDDLHYIARGREFIGGIR

SEQ ID NO: 1072827 - protein, 24 aa, Mycobacterium
GFLGPRVYELLYDEPFPAGVQTAE

SEQ ID NO: 1072828 - protein, 17 aa, Mycobacterium
GFLGRRQHLVPNTGLRR

SEQ ID NO: 1072829 - protein, 20 aa, Mycobacterium
GFLMMAHTIAPEKLAAQARI

SEQ ID NO: 1072830 - protein, 24 aa, Mycobacterium
GFLSEPWWCRMVVLSADRVARRGG

SEQ ID NO: 1072831 - protein, 19 aa, Mycobacterium
GFMAPSLNGIGGDGGDAFL

SEQ ID NO: 1072832 - protein, 25 aa, Mycobacterium
GFNANGAGWNLGFGNDGSFNIGLGN

SEQ ID NO: 1072833 - protein, 31 aa, Mycobacterium; identical to SEQ ID NO: 977766

SEQ ID NO: 1072834 - protein, 17 aa, Mycobacterium
GFNGYQGVGGAGGAGGK

SEQ ID NO: 1072835 - protein, 27 aa, Mycobacterium
GFNIGRVVAVALGYDFLPGTTVNRYCS

SEQ ID NO: 1072836 - protein, 26 aa, Mycobacterium
GFPIAKIAAKLAIGYTLDEIVNDITK

SEQ ID NO: 1072837 - protein, 33 aa, Mycobacterium; identical to SEQ ID NO: 816138

SEQ ID NO: 1072838 - protein, 17 aa, Mycobacterium
GFQLVIVATVQNATTIE

SEQ ID NO: 1072839 - protein, 18 aa, Mycobacterium
GFRFDLAATLAREFYEVD

SEQ ID NO: 1072840 - protein, 26 aa, Mycobacterium
GFRLGITTDWKSRWYADKQYADYVKE

SEQ ID NO: 1072841 - protein, 23 aa, Mycobacterium
GFRLGITTGWKSRWYADKQYAEY

SEQ ID NO: 1072842 - protein, 17 aa, Mycobacterium
GFRNAMTFVLTGLNIEA

SEQ ID NO: 1072843 - protein, 34 aa, Mycobacterium; identical to SEQ ID NO: 816175

SEQ ID NO: 1072844 - protein, 26 aa, Mycobacterium
GFSAVRYGFVPRRFRLLLVAVGARKL

SEQ ID NO: 1072845 - protein, 19 aa, Mycobacterium
GFSTELLLRAYRHAGVSAF

SEQ ID NO: 1072846 - protein, 26 aa, Mycobacterium
GFTAFGQTPWRLDRQALFAAGLPGVA

SEQ ID NO: 1072847 - protein, 26 aa, Mycobacterium
GFTEFVPLPFVHQNSPLYLAGAARPG

SEQ ID NO: 1072848 - protein, 17 aa, Mycobacterium
GFTRLSEILSPERALQV

SEQ ID NO: 1072849 - protein, 23 aa, Mycobacterium
GFTTHLVHRFQFLTKTIAAQCEA

SEQ ID NO: 1072850 - protein, 24 aa, Mycobacterium
GFVCSIRAWAYQIADLATDYRVIA

SEQ ID NO: 1072851 - protein, 22 aa, Mycobacterium
GFVNSRPKPLSAYLFTKSREIR

SEQ ID NO: 1072852 - protein, 20 aa, Mycobacterium
GFVPILSMSLFKHVTGSRCV

SEQ ID NO: 1072853 - protein, 29 aa, Mycobacterium
GFVVPEPLSLRPYYIKTLRIWGDNLEANK

SEQ ID NO: 1072854 - protein, 21 aa, Mycobacterium
GGAAGLLGNGGTGGAGGAGAN

SEQ ID NO: 1072855 - protein, 25 aa, Mycobacterium
GGAAGPPMVLPAAAPMPTAESAPVP

SEQ ID NO: 1072856 - protein, 17 aa, Mycobacterium
GGAAWLVGAGGAGGVGG

SEQ ID NO: 1072857 - protein, 22 aa, Mycobacterium
GGAAYTSNILMNATGGNGGQGG

SEQ ID NO: 1072858 - protein, 20 aa, Mycobacterium
GGADIIIIETIFDSLNAKAA

SEQ ID NO: 1072859 - protein, 31 aa, Mycobacterium; identical to SEQ ID NO: 114715

SEQ ID NO: 1072860 - protein, 21 aa, Mycobacterium
GGAEYVYRFAPLVGIYGGTHE

SEQ ID NO: 1072861 - protein, 20 aa, Mycobacterium
GGAGGAAGWFGHAGVGGDGG

SEQ ID NO: 1072862 - protein, 25 aa, Mycobacterium
GGAGGAGEWLFGPGGVGGAGGSSSS

SEQ ID NO: 1072863 - protein, 22 aa, Mycobacterium
GGAGGALAGFLGAGGSDGGAGG

SEQ ID NO: 1072864 - protein, 25 aa, Mycobacterium
GGAGGGGLWFGNGGAGGIGGFDAHG

SEQ ID NO: 1072865 - protein, 17 aa, Mycobacterium
GGAGGHAGLFGIGGAGG

SEQ ID NO: 1072866 - protein, 20 aa, Mycobacterium
GGAGGHGGMLFGDGGAGGGG

SEQ ID NO: 1072867 - protein, 18 aa, Mycobacterium
GGAGGIGGAALAGGTGGT

SEQ ID NO: 1072868 - protein, 23 aa, Mycobacterium
GGAGGLGGMLFGTGGSGGAGGVA

SEQ ID NO: 1072869 - protein, 22 aa, Mycobacterium
GGAGGLSQAAGFSDGIQGGRWS

SEQ ID NO: 1072870 - protein, 24 aa, Mycobacterium
GGAGGNGGWLYGDGGAGGQGGAAA

SEQ ID NO: 1072871 - protein, 25 aa, Mycobacterium
GGAGGPGLFGFNGGAGGAGGLLGAG

SEQ ID NO: 1072872 - protein, 25 aa, Mycobacterium
GGAGGRGGLLFGVGGAGGAGGDGLD

SEQ ID NO: 1072873 - protein, 26 aa, Mycobacterium
GGAGGRGGLLIGLGGNGGTGGFSGPL

SEQ ID NO: 1072874 - protein, 27 aa, Mycobacterium
GGAGGSAGLLFGSGRIGGDGGFGSNTG

SEQ ID NO: 1072875 - protein, 26 aa, Mycobacterium
GGAGGSAGLWGAGGAGGAGGAGATPG

SEQ ID NO: 1072876 - protein, 26 aa, Mycobacterium
GGAGGSAPLLGWGGNGGAGGDSTQGT

SEQ ID NO: 1072877 - protein, 19 aa, Mycobacterium
GGAGGWIYGHGGDGGIGGA

SEQ ID NO: 1072878 - protein, 21 aa, Mycobacterium
GGAGGWLFGAGGTGGAGGLTV

SEQ ID NO: 1072879 - protein, 21 aa, Mycobacterium
GGAGGWLIGNGGHGGIGGLGI

SEQ ID NO: 1072880 - protein, 24 aa, Mycobacterium
GGAGPLVGVWQKAPLQALARLHML

SEQ ID NO: 1072881 - protein, 28 aa, Mycobacterium
GGAGTYISPSGRLTVVEFGGGVGGGGGA

SEQ ID NO: 1072882 - protein, 20 aa, Mycobacterium
GGAGVFGGLGGDGGTGGQLF

SEQ ID NO: 1072883 - protein, 23 aa, Mycobacterium
GGANIVSSGFILGAGGGGNGGNA

SEQ ID NO: 1072884 - protein, 24 aa, Mycobacterium
GGANRQLVSLFGAGGAGGADGAGG

SEQ ID NO: 1072885 - protein, 25 aa, Mycobacterium
GGARPIGISKALWEVLDRARAHLEA

SEQ ID NO: 1072886 - protein, 23 aa, Mycobacterium
GGASLIGLHFVKGAERQISCGGR

SEQ ID NO: 1072887 - protein, 20 aa, Mycobacterium
GGASYLTRTLGPASYTALDL

SEQ ID NO: 1072888 - protein, 23 aa, Mycobacterium
GGAYAMYAHLIKGSLLVKPGDKV

SEQ ID NO: 1072889 - protein, 19 aa, Mycobacterium
GGAYRLIDFVLSNLVNARY

SEQ ID NO: 1072890 - protein, 20 aa, Mycobacterium
GGCEVAMMCDLIIAADTAKF

SEQ ID NO: 1072891 - protein, 19 aa, Mycobacterium
GGCFPPPPGYFERVREICD

SEQ ID NO: 1072892 - protein, 26 aa, Mycobacterium
GGDAGGMFGVRGLFGTGGAGGTGGFG

SEQ ID NO: 1072893 - protein, 22 aa, Mycobacterium
GGDAGLFGLGGAGGSGGGGGDS

SEQ ID NO: 1072894 - protein, 22 aa, Mycobacterium
GGDAYLLGTGGAGGHGGLGSVG

SEQ ID NO: 1072895 - protein, 24 aa, Mycobacterium
GGDGGFGVIGGQGGGGGFGGLGGT

SEQ ID NO: 1072896 - protein, 19 aa, Mycobacterium
GGDGGLLIGNGTSGALGTG

SEQ ID NO: 1072897 - protein, 18 aa, Mycobacterium
GGDGGLYGNGGKGGDGGD

SEQ ID NO: 1072898 - protein, 25 aa, Mycobacterium
GGDGGNAGALFGIGAGGHGGNAGSG

SEQ ID NO: 1072899 - protein, 25 aa, Mycobacterium
GGDGGVGGRLFGSGGVGGSGGAGGV

SEQ ID NO: 1072900 - protein, 24 aa, Mycobacterium
GGDGLHTALGRQGNGGAGGHGGSG

SEQ ID NO: 1072901 - protein, 23 aa, Mycobacterium
GGDLEFIIRLLPDGAMSNYLRDH

SEQ ID NO: 1072902 - protein, 25 aa, Mycobacterium
GGDSGLLSGLFGTGGGHGGLGGAGV

SEQ ID NO: 1072903 - protein, 29 aa, Mycobacterium
GGEGGFGGIGGNSYYAGNAGPGGQGGQGG

SEQ ID NO: 1072904 - protein, 23 aa, Mycobacterium
GGEGSGRLFGLGGAGGAGGTGTT

SEQ ID NO: 1072905 - protein, 34 aa, Mycobacterium
GGEKALTAVAILVAIFRARPSPFYIMDEVEAALD

SEQ ID NO: 1072906 - protein, 20 aa, Mycobacterium
GGEMIVLAKFDPGEVLRVIE

SEQ ID NO: 1072907 - protein, 25 aa, Mycobacterium
GGEMLTFADLIPWVKAHGDEHPELV

SEQ ID NO: 1072908 - protein, 18 aa, Mycobacterium
GGFALWVDEQRRLHHTYS

SEQ ID NO: 1072909 - protein, 20 aa, Mycobacterium
GGFGLVSACDIVVAGPACTF

SEQ ID NO: 1072910 - protein, 31 aa, Mycobacterium
GGFGTGGAGGTGGWLIGHSGTNGIGGTGGAG

SEQ ID NO: 1072911 - protein, 17 aa, Mycobacterium
GGFTLIALSIFGSLAWK

SEQ ID NO: 1072912 - protein, 23 aa, Mycobacterium
GGFTQVFTFGLTGLRLRADGIVV

SEQ ID NO: 1072913 - protein, 26 aa, Mycobacterium
GGGADYDFGFFWITAVTVDGQIAVAN

SEQ ID NO: 1072914 - protein, 21 aa, Mycobacterium
GGGAYFFRQLIGDIPDEAAIK

SEQ ID NO: 1072915 - protein, 23 aa, Mycobacterium
GGGGGFGGLGGTGAGGAPSDKGI

SEQ ID NO: 1072916 - protein, 27 aa, Mycobacterium
GGGGTGGFGLPPATGGFGGRGGRLFGS

SEQ ID NO: 1072917 - protein, 23 aa, Mycobacterium
GGGHGGLLVGNGGGGGAGGIGGG

SEQ ID NO: 1072918 - protein, 28 aa, Mycobacterium
GGGLFSSIPFLNQYWHPYRLGGNASGTV

SEQ ID NO: 1072919 - protein, 26 aa, Mycobacterium
GGGLLLATGRLPRLASAALALTVVPG

SEQ ID NO: 1072920 - protein, 24 aa, Mycobacterium
GGGLLRLPERIPYAIAMELALTGD

SEQ ID NO: 1072921 - protein, 24 aa, Mycobacterium
GGGLNLVLIARIRAAGRYGATLPG

SEQ ID NO: 1072922 - protein, 18 aa, Mycobacterium
GGGPAPRPVLDAGAAAGI

SEQ ID NO: 1072923 - protein, 19 aa, Mycobacterium
GGGRRALRFGWSKINLHQR

SEQ ID NO: 1072924 - protein, 24 aa, Mycobacterium
GGHAVVLHPGPMLRGMEIASSVAD

SEQ ID NO: 1072925 - protein, 21 aa, Mycobacterium
GGHVLFIADGRLHYVYNFLGE

SEQ ID NO: 1072926 - protein, 23 aa, Mycobacterium
GGHWAMLPRITAMTVRDGKVCAL

SEQ ID NO: 1072927 - protein, 19 aa, Mycobacterium
GGIDIPYPTGHSALLHWIG

SEQ ID NO: 1072928 - protein, 25 aa, Mycobacterium
GGIGGHGGWLFGNAGAGGPGGSGGA

SEQ ID NO: 1072929 - protein, 26 aa, Mycobacterium
GGIGSQGGILFSHAGADGSTGAPGAG

SEQ ID NO: 1072930 - protein, 18 aa, Mycobacterium
GGIKTNWVIALPPGQTGL

SEQ ID NO: 1072931 - protein, 23 aa, Mycobacterium
GGIPWRLPEDLAHFKRLTMGHTV

SEQ ID NO: 1072932 - protein, 23 aa, Mycobacterium
GGIRAIRAFTAIQGLPAPEVFHM

SEQ ID NO: 1072933 - protein, 19 aa, Mycobacterium
GGISHRLVRIDEPILRVPQ

SEQ ID NO: 1072934 - protein, 21 aa, Mycobacterium
GGKALKFYASVRMDVRRIETL

SEQ ID NO: 1072935 - protein, 24 aa, Mycobacterium
GGKLMWNQTPLLLNRARQLPNRSG

SEQ ID NO: 1072936 - protein, 19 aa, Mycobacterium
GGKSFVFFRTPQPDATDPD

SEQ ID NO: 1072937 - protein, 25 aa, Mycobacterium
GGLEKLAMLGVTWVHVGLPGDGLAH

SEQ ID NO: 1072938 - protein, 31 aa, Mycobacterium; identical to SEQ ID NO: 816636

SEQ ID NO: 1072939 - protein, 26 aa, Mycobacterium
GGLGTDTGVPPFSVTEPGGAGGNGGA

SEQ ID NO: 1072940 - protein, 21 aa, Mycobacterium
GGLGTFSWPGAYGTWWQADPG

SEQ ID NO: 1072941 - protein, 27 aa, Mycobacterium
GGLKRTYILHVPPGPPTGLVLNLHGGG

SEQ ID NO: 1072942 - protein, 23 aa, Mycobacterium
GGLLKIWDQRNYRFWADLTDALQ

SEQ ID NO: 1072943 - protein, 17 aa, Mycobacterium
GGLPPVVRERFGIGWSG

SEQ ID NO: 1072944 - protein, 19 aa, Mycobacterium
GGLQQLLKTLPNLGIGNIG

SEQ ID NO: 1072945 - protein, 25 aa, Mycobacterium
GGLSCFMLPHILPDGTRNRMFLQRL

SEQ ID NO: 1072946 - protein, 20 aa, Mycobacterium
GGMAALFGNGGAGGAAGVSL

SEQ ID NO: 1072947 - protein, 28 aa, Mycobacterium
GGMELGAMTPMFVGFRAREIILSLFESI

SEQ ID NO: 1072948 - protein, 21 aa, Mycobacterium
GGMFDKGFWVAPTILTGVHND

SEQ ID NO: 1072949 - protein, 26 aa, Mycobacterium
GGMGAYAPLPWLPDDSYRQVVTEIIE

SEQ ID NO: 1072950 - protein, 23 aa, Mycobacterium
GGMHALIWHRGAIIAHGAVVQRR

SEQ ID NO: 1072951 - protein, 27 aa, Mycobacterium
GGMVKGAGMLAPSLATMLCVLTTDAVA

SEQ ID NO: 1072952 - protein, 22 aa, Mycobacterium
GGNAALLIGTGGNGGAGVPPAS

SEQ ID NO: 1072953 - protein, 24 aa, Mycobacterium
GGNAGLIGTGGLGGAGGVGGQDGG

SEQ ID NO: 1072954 - protein, 21 aa, Mycobacterium
GGNAGLLFGSGGAGGAGGAAV

SEQ ID NO: 1072955 - protein, 24 aa, Mycobacterium
GGNASSVFGFGGNGGAAGTGGAGG

SEQ ID NO: 1072956 - protein, 25 aa, Mycobacterium
GGNGGAAGLLWGTAGAGGAGGSANS

SEQ ID NO: 1072957 - protein, 24 aa, Mycobacterium
GGNGGAGGWLFGNGGTGGTGGDAV

SEQ ID NO: 1072958 - protein, 28 aa, Mycobacterium
GGNGGSGGFAFTFGTGNIIAGVGGGGGT

SEQ ID NO: 1072959 - protein, 24 aa, Mycobacterium
GGNGGWAIYNSFAGDDGSGGTAIG

SEQ ID NO: 1072960 - protein, 30 aa, Mycobacterium
GGNQIRLVESLLYRGDVTPLLTAIARARAA

SEQ ID NO: 1072961 - protein, 24 aa, Mycobacterium
GGNVFNNFYNHVTNTGYSGGNGGN

SEQ ID NO: 1072962 - protein, 17 aa, Mycobacterium
GGPANLSRLNPFALQPA

SEQ ID NO: 1072963 - protein, 28 aa, Mycobacterium
GGPATIVPMFLLYDYSFLPSGATTKAEG

SEQ ID NO: 1072964 - protein, 22 aa, Mycobacterium
GGPLAHPFQPLLNPRLREFALR

SEQ ID NO: 1072965 - protein, 23 aa, Mycobacterium
GGPLPERVAAIIDTLYEGLTSTH

SEQ ID NO: 1072966 - protein, 26 aa, Mycobacterium
GGPLTWPLHISLMLAKEYALTGQRIA

SEQ ID NO: 1072967 - protein, 25 aa, Mycobacterium
GGPVAFIMMLRYPAKVTGFFGMNTA

SEQ ID NO: 1072968 - protein, 24 aa, Mycobacterium
GGQGGAAAWLFGSGGTGGAGGFGN

SEQ ID NO: 1072969 - protein, 23 aa, Mycobacterium
GGQGGYGGWLAGSGGAGGTGGTA

SEQ ID NO: 1072970 - protein, 17 aa, Mycobacterium
GGQLWRQVSERLAEWGL

SEQ ID NO: 1072971 - protein, 20 aa, Mycobacterium
GGQRLLFSATLDNGVDKLVN

SEQ ID NO: 1072972 - protein, 29 aa, Mycobacterium
GGRDDRLHWWAGPWPVDERWWDPDLGKGR

SEQ ID NO: 1072973 - protein, 18 aa, Mycobacterium
GGRLFGSPGAQGRRALMC

SEQ ID NO: 1072974 - protein, 17 aa, Mycobacterium
GGRLVVELTPDEAAALG

SEQ ID NO: 1072975 - protein, 18 aa, Mycobacterium
GGRNQFWAHGTLAPARAT

SEQ ID NO: 1072976 - protein, 23 aa, Mycobacterium
GGRPGLPVLAVSVGPAAPADGCT

SEQ ID NO: 1072977 - protein, 25 aa, Mycobacterium
GGRPYSQTFLERYDGRIPNQGLGAE

SEQ ID NO: 1072978 - protein, 25 aa, Mycobacterium
GGRRAVWSIWGIDNAILLGDALQTA

SEQ ID NO: 1072979 - protein, 19 aa, Mycobacterium
GGRRQLHIPAHLAYGDRCA

SEQ ID NO: 1072980 - protein, 17 aa, Mycobacterium
GGRVKDLPGVRYKIIRG

SEQ ID NO: 1072981 - protein, 21 aa, Mycobacterium
GGRVLVTETYFSVGGGFIVTA

SEQ ID NO: 1072982 - protein, 27 aa, Mycobacterium
GGSAVRLVRQIPYTVACDLLLTGRHIT

SEQ ID NO: 1072983 - protein, 26 aa, Mycobacterium
GGSFIYVPPGVHVDIPLQAYFRINTE

SEQ ID NO: 1072984 - protein, 27 aa, Mycobacterium
GGSGAALGLFGGSGAALGLFGGTGGNG

SEQ ID NO: 1072985 - protein, 24 aa, Mycobacterium
GGSGGLLDPILFGGTGGLLGPLVG

SEQ ID NO: 1072986 - protein, 24 aa, Mycobacterium
GGSGGLLFGAGGIGGTGAAGAGMG

SEQ ID NO: 1072987 - protein, 24 aa, Mycobacterium
GGSPPAELAWVEPILAATTTLQVA

SEQ ID NO: 1072988 - protein, 32 aa, Mycobacterium; identical to SEQ ID NO: 816941

SEQ ID NO: 1072989 - protein, 20 aa, Mycobacterium
GGSVGLWGHGGNGGIGGAGG

SEQ ID NO: 1072990 - protein, 25 aa, Mycobacterium
GGSVTRIWLGPKRLVPPMVMVTSPQ

SEQ ID NO: 1072991 - protein, 18 aa, Mycobacterium
GGTDHEKLFTRDGWMRMG

SEQ ID NO: 1072992 - protein, 21 aa, Mycobacterium
GGTEFGGLIPGLQSASAQLAD

SEQ ID NO: 1072993 - protein, 24 aa, Mycobacterium
GGTGGAGGWLYGNGGAGGSGGNGG

SEQ ID NO: 1072994 - protein, 25 aa, Mycobacterium
GGTGGTAGWLYGSGGSGGAGGAGTA

SEQ ID NO: 1072995 - protein, 25 aa, Mycobacterium
GGTGGTGGLLWGNGGIGGQGGTAMA

SEQ ID NO: 1072996 - protein, 25 aa, Mycobacterium
GGTGLLDLLNRLGITPLPNTAGCRS

SEQ ID NO: 1072997 - protein, 28 aa, Mycobacterium
GGTVETYLHRRAADLPPAVGVLVEYTGA

SEQ ID NO: 1072998 - protein, 25 aa, Mycobacterium
GGTVRNWPWQRLALSKTANTYSRLA

SEQ ID NO: 1072999 - protein, 20 aa, Mycobacterium
GGVFASLFTCGIAVPHMIAS

SEQ ID NO: 1073000 - protein, 24 aa, Mycobacterium
GGVGGAGWDATAAGVLAATGGDGG

SEQ ID NO: 1073001 - protein, 20 aa, Mycobacterium
GGVGPLTRAFLLTNVVELAE

SEQ ID NO: 1073002 - protein, 25 aa, Mycobacterium
GGVLASPEHRSGRRRGHLRVLPDPS

SEQ ID NO: 1073003 - protein, 19 aa, Mycobacterium
GGVLYLFVRGMCGPDTPML

SEQ ID NO: 1073004 - protein, 25 aa, Mycobacterium
GGVLYRYWVDTDRAARFLLVVLTQT

SEQ ID NO: 1073005 - protein, 23 aa, Mycobacterium
GGVMPRFPLPLGESGPHPERVEV

SEQ ID NO: 1073006 - protein, 24 aa, Mycobacterium
GGVPTNPLLLDPRPQRPDLPGQAR

SEQ ID NO: 1073007 - protein, 24 aa, Mycobacterium
GGVPVVMKTLLDAGLLHGDCLTVT

SEQ ID NO: 1073008 - protein, 19 aa, Mycobacterium
GGVQALRIWGAGATGSRLV

SEQ ID NO: 1073009 - protein, 20 aa, Mycobacterium
GGVRPFGWRYAASRDPSVPL

SEQ ID NO: 1073010 - protein, 20 aa, Mycobacterium
GGVVKPILWGPGKAAAVQRF

SEQ ID NO: 1073011 - protein, 24 aa, Mycobacterium
GGWGLEQIIGSSPLLAPLQLLAYC

SEQ ID NO: 1073012 - protein, 17 aa, Mycobacterium
GGWLLGDGGAGGSGAPG

SEQ ID NO: 1073013 - protein, 26 aa, Mycobacterium
GGYAPNRTGWLYPFASELVTPAEARR

SEQ ID NO: 1073014 - protein, 19 aa, Mycobacterium
GGYDPWVDKVLAGRPDIKS

SEQ ID NO: 1073015 - protein, 20 aa, Mycobacterium
GGYGYMREYPVARAYLDSRV

SEQ ID NO: 1073016 - protein, 17 aa, Mycobacterium
GGYKAWALTPSELILYL

SEQ ID NO: 1073017 - protein, 21 aa, Mycobacterium
GGYTYGGRIAALADAARENGL

SEQ ID NO: 1073018 - protein, 18 aa, Mycobacterium
GHARGKAFRDVTRNLLGH

SEQ ID NO: 1073019 - protein, 25 aa, Mycobacterium
GHAVKTFYRDAFAKHQKLFDELGVN

SEQ ID NO: 1073020 - protein, 18 aa, Mycobacterium
GHEIACHGLRWKSYQEID

SEQ ID NO: 1073021 - protein, 26 aa, Mycobacterium
GHERTMLWLGYANLLGELATDFTPAG

SEQ ID NO: 1073022 - protein, 19 aa, Mycobacterium
GHEWDLVVIAGLQDGSWPN

SEQ ID NO: 1073023 - protein, 24 aa, Mycobacterium
GHFALTAHVLPLLRAAQGARVVSL

SEQ ID NO: 1073024 - protein, 19 aa, Mycobacterium
GHFNAVELILCFNQLAYSA

SEQ ID NO: 1073025 - protein, 26 aa, Mycobacterium
GHFVPNLTLGLPVVESLLAASDIPMD

SEQ ID NO: 1073026 - protein, 19 aa, Mycobacterium
GHFYGAGLINWWDPTEPAA

SEQ ID NO: 1073027 - protein, 18 aa, Mycobacterium
GHGAAIAAALRERLDPTR

SEQ ID NO: 1073028 - protein, 23 aa, Mycobacterium
GHGGAGGFYGNGGAGGAGGNSAP

SEQ ID NO: 1073029 - protein, 33 aa, Mycobacterium
GHGQAYQRLANQLMAFHDQFAQALTAGASAYTG

SEQ ID NO: 1073030 - protein, 24 aa, Mycobacterium
GHGRTFLERFVVTEELLAVGAPVA

SEQ ID NO: 1073031 - protein, 20 aa, Mycobacterium
GHHQLFLHGCDISRIPDGSY

SEQ ID NO: 1073032 - protein, 29 aa, Mycobacterium
GHICPISMTYAVVPALRYNPELAAVYEPL

SEQ ID NO: 1073033 - protein, 17 aa, Mycobacterium
GHIGTVASALFGDNNGV

SEQ ID NO: 1073034 - protein, 23 aa, Mycobacterium
GHLTHGMRINFSGKLYNVAAYEV

SEQ ID NO: 1073035 - protein, 17 aa, Mycobacterium
GHNYLASSFLSPLINRR

SEQ ID NO: 1073036 - protein, 19 aa, Mycobacterium
GHPAGVFSWSPPAALVTAL

SEQ ID NO: 1073037 - protein, 22 aa, Mycobacterium
GHPRFLVPHIVASAPKVVIQEW

SEQ ID NO: 1073038 - protein, 24 aa, Mycobacterium
GHRHRPHPRSAVTFRPGSRSSKNR

SEQ ID NO: 1073039 - protein, 18 aa, Mycobacterium
GHRLMETWHPLGVVGVIT

SEQ ID NO: 1073040 - protein, 22 aa, Mycobacterium
GHRLRMIGVTWSDEASAQAALL

SEQ ID NO: 1073041 - protein, 23 aa, Mycobacterium
GHRMLANWLAYCGWARDDTLVRR

SEQ ID NO: 1073042 - protein, 17 aa, Mycobacterium
GHRRRSLILRTGPPDDV

SEQ ID NO: 1073043 - protein, 28 aa, Mycobacterium
GHRSRFCARLWFRPNGPRSPIPNDSVFS

SEQ ID NO: 1073044 - protein, 28 aa, Mycobacterium
GHRYPAAIRLWRNAWNESIPFLDYDTEI

SEQ ID NO: 1073045 - protein, 35 aa, Mycobacterium
GHRYPAAIRLWRTAWNEFIPFLDYDTEIRKVICST

SEQ ID NO: 1073046 - protein, 23 aa, Mycobacterium
GHSFVIFLREGFPVNILNPVKAV

SEQ ID NO: 1073047 - protein, 22 aa, Mycobacterium
GHTDAVLWDIDRPNPALLTQGM

SEQ ID NO: 1073048 - protein, 31 aa, Mycobacterium
GHVDPHWHPMDLLVLLFGVDLAWAQSPHPDA

SEQ ID NO: 1073049 - protein, 18 aa, Mycobacterium
GHVVRRNIITFRRGELST

SEQ ID NO: 1073050 - protein, 20 aa, Mycobacterium
GHWLEPLTTLTYLVARTERI

SEQ ID NO: 1073051 - protein, 33 aa, Mycobacterium; identical to SEQ ID NO: 817305

SEQ ID NO: 1073052 - protein, 32 aa, Mycobacterium; identical to SEQ ID NO: 817307

SEQ ID NO: 1073053 - protein, 22 aa, Mycobacterium
GIAEGLIHVDGDAGLNGVAGTS

SEQ ID NO: 1073054 - protein, 23 aa, Mycobacterium
GIAEWIFPTILDRGSDLQRDRFG

SEQ ID NO: 1073055 - protein, 18 aa, Mycobacterium
GIANAVFDGYRPWAGEIR

SEQ ID NO: 1073056 - protein, 28 aa, Mycobacterium
GIASQPFILRMPGLVNADIDDILRLVTP

SEQ ID NO: 1073057 - protein, 18 aa, Mycobacterium
GIATGYEIQMALVRGICL

SEQ ID NO: 1073058 - protein, 17 aa, Mycobacterium
GICFGNQILGRALGLST

SEQ ID NO: 1073059 - protein, 20 aa, Mycobacterium
GICRQAGLSARYFYESFPDK

SEQ ID NO: 1073060 - protein, 27 aa, Mycobacterium
GIDEFDADFFGFPPLAAQVLDPQHRLF

SEQ ID NO: 1073061 - protein, 28 aa, Mycobacterium
GIDEIQAQAILDMQLRRLAALERERIVD

SEQ ID NO: 1073062 - protein, 20 aa, Mycobacterium
GIDERYFDFLVTPRRREDGS

SEQ ID NO: 1073063 - protein, 18 aa, Mycobacterium
GIDLILPFEDRVNIVATM

SEQ ID NO: 1073064 - protein, 18 aa, Mycobacterium
GIDLYFSTFAKAAADTGA

SEQ ID NO: 1073065 - protein, 17 aa, Mycobacterium
GIDPEIVDDVIWGCVMQ

SEQ ID NO: 1073066 - protein, 38 aa, Mycobacterium
GIDYAITIPDTAIPLNLDVPVYLDIPITGTLGVFTVGG

SEQ ID NO: 1073067 - protein, 25 aa, Mycobacterium
GIEKNLEYRYWTQGVTFVTRMDYLS

SEQ ID NO: 1073068 - protein, 18 aa, Mycobacterium
GIELPRRVFAHGFLHNRG

SEQ ID NO: 1073069 - protein, 25 aa, Mycobacterium
GIERATKILGLLIATSKSYAATIRL

SEQ ID NO: 1073070 - protein, 23 aa, Mycobacterium
GIERVRATLPRLGELAIGGTAVG

SEQ ID NO: 1073071 - protein, 22 aa, Mycobacterium
GIESLSHPLIDQVRGRGLLLGI

SEQ ID NO: 1073072 - protein, 21 aa, Mycobacterium
GIFDSMRTLAPPTARGWEVVA

SEQ ID NO: 1073073 - protein, 44 aa, Mycobacterium
GIFYRGVGQGNFYFSITTPDLTLPPLEIPGITIPNLSLPPITMR

SEQ ID NO: 1073074 - protein, 27 aa, Mycobacterium
GIGCSSRFPYYLETYGFHSIHGRAPAI

SEQ ID NO: 1073075 - protein, 40 aa, Mycobacterium
GIGDPLLVVTINFLGLRHLTEALLPMMGPGSAIVSVSSLA

SEQ ID NO: 1073076 - protein, 25 aa, Mycobacterium
GIGFVFQHYAAFKHLTVRDNVAYGL

SEQ ID NO: 1073077 - protein, 18 aa, Mycobacterium
GIGGAYTGTGPGSSAAGG

SEQ ID NO: 1073078 - protein, 23 aa, Mycobacterium
GIGGGLLGLIGTGETLASSLAGG

SEQ ID NO: 1073079 - protein, 18 aa, Mycobacterium
GIGGIGASGSFGAPSGQG

SEQ ID NO: 1073080 - protein, 18 aa, Mycobacterium
GIGGTRGSGGAGAPGGIG

SEQ ID NO: 1073081 - protein, 27 aa, Mycobacterium
GIGGTSGLLLGLDGFNAPTSTSPIHTL

SEQ ID NO: 1073082 - protein, 17 aa, Mycobacterium
GIGIGCDVGGWFDGIGA

SEQ ID NO: 1073083 - protein, 19 aa, Mycobacterium
GIGLLRYLGSQGPQIDWSK

SEQ ID NO: 1073084 - protein, 27 aa, Mycobacterium
GIGMTWEYPAHLYLKRAKSDQLALGTA

SEQ ID NO: 1073085 - protein, 24 aa, Mycobacterium
GIGPISSPFRFSICRRRLASATRP

SEQ ID NO: 1073086 - protein, 23 aa, Mycobacterium
GIGREMHVIVGQGKLDEILQSRP

SEQ ID NO: 1073087 - protein, 23 aa, Mycobacterium
GIGRRLLDELLAFADGGVVFLEV

SEQ ID NO: 1073088 - protein, 18 aa, Mycobacterium
GIGRYARAILGRRPPSSP

SEQ ID NO: 1073089 - protein, 18 aa, Mycobacterium
GIGSRAPALLISRLVSWG

SEQ ID NO: 1073090 - protein, 24 aa, Mycobacterium
GIGVLHVPGFRRSAPDSPQRVAGT

SEQ ID NO: 1073091 - protein, 17 aa, Mycobacterium
GIGYTALRRINRPLPNV

SEQ ID NO: 1073092 - protein, 18 aa, Mycobacterium
GIKIIRKAIHRSRGRFGF

SEQ ID NO: 1073093 - protein, 23 aa, Mycobacterium
GILPGSLYHHFESKEAILIELIR

SEQ ID NO: 1073094 - protein, 21 aa, Mycobacterium
GINLLRPVRPLRELTAIVGEL

SEQ ID NO: 1073095 - protein, 19 aa, Mycobacterium
GINPGFMSGFVNSSGTFIS

SEQ ID NO: 1073096 - protein, 20 aa, Mycobacterium
GINWGPWAEVGRAQFFADLG

SEQ ID NO: 1073097 - protein, 27 aa, Mycobacterium
GIPAVTFWAAVPHYVSHPPNPKATVAL

SEQ ID NO: 1073098 - protein, 19 aa, Mycobacterium
GIPILRLHDTIYRKTNGRI

SEQ ID NO: 1073099 - protein, 30 aa, Mycobacterium
GIPRLQFSHTDLLVRAFGSLHGLLAASASD

SEQ ID NO: 1073100 - protein, 24 aa, Mycobacterium
GIPTPSLLRQQQWMLGPPAGSVAG

SEQ ID NO: 1073101 - protein, 31 aa, Mycobacterium
GIRARPVVIGPVTFLLLSKAVDGASAPIGRL

SEQ ID NO: 1073102 - protein, 17 aa, Mycobacterium
GIRGELYRISEAGLGRF

SEQ ID NO: 1073103 - protein, 17 aa, Mycobacterium
GIRLVYETPRRGTADSR

SEQ ID NO: 1073104 - protein, 19 aa, Mycobacterium
GISLPAAIAAKLVHPDRKV

SEQ ID NO: 1073105 - protein, 22 aa, Mycobacterium
GISMPSRRYVQLANSLYIGRSV

SEQ ID NO: 1073106 - protein, 25 aa, Mycobacterium
GITGIITMPWMFYTGPDAGLDAKID

SEQ ID NO: 1073107 - protein, 19 aa, Mycobacterium
GITMSAPYLSQLRSGNRTN

SEQ ID NO: 1073108 - protein, 23 aa, Mycobacterium
GITPLIEEIPAPTPRRGLDSIFE

SEQ ID NO: 1073109 - protein, 22 aa, Mycobacterium
GITPVLAMLRTLVAQHHLHIHG

SEQ ID NO: 1073110 - protein, 19 aa, Mycobacterium
GIVPAVLHYAAHYTRAGTA

SEQ ID NO: 1073111 - protein, 23 aa, Mycobacterium
GIYTADIMDFWRPNYRSTALVDG

SEQ ID NO: 1073112 - protein, 29 aa, Mycobacterium
GKAELWPDLNLGLPFTYHQGYQSPPVPGL

SEQ ID NO: 1073113 - protein, 24 aa, Mycobacterium
GKAITLRLLSLAEHRVFIEAARDF

SEQ ID NO: 1073114 - protein, 22 aa, Mycobacterium
GKARLRIALAAPTGKAAARLHE

SEQ ID NO: 1073115 - protein, 24 aa, Mycobacterium
GKCQQVWCPLCALAALVNGEQHPL

SEQ ID NO: 1073116 - protein, 27 aa, Mycobacterium
GKDGGTMPITLWIVDTSAQAPASSTAE

SEQ ID NO: 1073117 - protein, 31 aa, Mycobacterium
GKDIIRFHAVYWPAFLMSAGIELPRRVFAHG

SEQ ID NO: 1073118 - protein, 27 aa, Mycobacterium
GKGGNAAIGTIVINGGVGGAGGSGGLG

SEQ ID NO: 1073119 - protein, 19 aa, Mycobacterium
GKIDVLVNNAFRVPSMKPL

SEQ ID NO: 1073120 - protein, 19 aa, Mycobacterium
GKILLIGRWSWSGPPVAGA

SEQ ID NO: 1073121 - protein, 20 aa, Mycobacterium
GKLAARLRGQGHTPLLVACD

SEQ ID NO: 1073122 - protein, 24 aa, Mycobacterium
GKLIGDGGLGGDGGIGLAGTGGNG

SEQ ID NO: 1073123 - protein, 25 aa, Mycobacterium
GKLRPALFVVPTDTPGFTYTAIDME

SEQ ID NO: 1073124 - protein, 21 aa, Mycobacterium
GKLRPPVFGILRYIADAVDEI

SEQ ID NO: 1073125 - protein, 18 aa, Mycobacterium
GKLTAHLLGCGGVRDGED

SEQ ID NO: 1073126 - protein, 31 aa, Mycobacterium
GKMHTAMKQLLPAAMFIGFTGTPLLKADKAT

SEQ ID NO: 1073127 - protein, 29 aa, Mycobacterium
GKNTWHGLLLLRHVADLVKTGWPVLMALS

SEQ ID NO: 1073128 - protein, 27 aa, Mycobacterium
GKPKPHLATSFWFAFGPQADARAQVHR

SEQ ID NO: 1073129 - protein, 23 aa, Mycobacterium
GKQEVWNAIRLLRSEGRTVVLTT

SEQ ID NO: 1073130 - protein, 31 aa, Mycobacterium
GKREVMVVHTLLWLDEIRDPDFPVLDKEVEI

SEQ ID NO: 1073131 - protein, 20 aa, Mycobacterium
GKRYGIVGKVFNLFSKLRGG

SEQ ID NO: 1073132 - protein, 19 aa, Mycobacterium
GKSGLLFGAGGAGGQGGGG

SEQ ID NO: 1073133 - protein, 27 aa, Mycobacterium
GKSLPDFLSIEIFRPLDLAMVVDPISA

SEQ ID NO: 1073134 - protein, 23 aa, Mycobacterium
GKSLTMVWLAKWIREHQDDARVL

SEQ ID NO: 1073135 - protein, 24 aa, Mycobacterium
GKSTIAAALALTLAAGGRKVLLVE

SEQ ID NO: 1073136 - protein, 22 aa, Mycobacterium
GKSTLFNALTRNDVLAANYPFA

SEQ ID NO: 1073137 - protein, 22 aa, Mycobacterium
GKTILAQRLPGLLPPLSRGESL

SEQ ID NO: 1073138 - protein, 19 aa, Mycobacterium
GKTMVVTGLHLLGGARADA

SEQ ID NO: 1073139 - protein, 23 aa, Mycobacterium
GKTNIIEALWYSATLGSHRVGTD

SEQ ID NO: 1073140 - protein, 26 aa, Mycobacterium
GKTPAQVLLRWNLQLGNAVVFRSAKA

SEQ ID NO: 1073141 - protein, 25 aa, Mycobacterium
GKTRGFPLGPGYLIDGRPVILTAPK

SEQ ID NO: 1073142 - protein, 23 aa, Mycobacterium
GKTRQRLPPWRRHMRRSGLSMCP

SEQ ID NO: 1073143 - protein, 25 aa, Mycobacterium
GKTRSLALTFRRPTPILTHLRFDIT

SEQ ID NO: 1073144 - protein, 20 aa, Mycobacterium
GKTVFALRIAAEALGQRAAE

SEQ ID NO: 1073145 - protein, 25 aa, Mycobacterium
GKVAGGWFWIHALNSATQAATNDRD

SEQ ID NO: 1073146 - protein, 24 aa, Mycobacterium
GKVIGIPGVQYKALVGAGRMIPRG

SEQ ID NO: 1073147 - protein, 26 aa, Mycobacterium
GKVKWSVPLGFLAQTPPTVTPEGLIV

SEQ ID NO: 1073148 - protein, 23 aa, Mycobacterium
GKVPARLLEARFGRETLLDQVVN

SEQ ID NO: 1073149 - protein, 30 aa, Mycobacterium
GKWAVNPMFMDPLPQHPPYPRGQAFVNSDG

SEQ ID NO: 1073150 - protein, 18 aa, Mycobacterium
GKWPWQMTHQMDGAAQID

SEQ ID NO: 1073151 - protein, 38 aa, Mycobacterium
GKYGYSYKVLGIKFNYPFNYSFDIPAITIPSIQIGGSS

SEQ ID NO: 1073152 - protein, 28 aa, Mycobacterium
GLAAYRGPWQYETLAREILLDIAARKMG

SEQ ID NO: 1073153 - protein, 20 aa, Mycobacterium
GLAEYFVHRTGHGIGLCVHE

SEQ ID NO: 1073154 - protein, 20 aa, Mycobacterium
GLAIARWGIAYAVGPNYNKP

SEQ ID NO: 1073155 - protein, 25 aa, Mycobacterium
GLALSPTLIFDYPNSAALAGYMHRE

SEQ ID NO: 1073156 - protein, 25 aa, Mycobacterium
GLALSRTIIFDYTTPMALARHLDEQ

SEQ ID NO: 1073157 - protein, 23 aa, Mycobacterium
GLANLGDYNVGFGNAGSLNQGFA

SEQ ID NO: 1073158 - protein, 20 aa, Mycobacterium
GLAPLRALILDMGRFVENPR

SEQ ID NO: 1073159 - protein, 17 aa, Mycobacterium
GLAPRRQPPKTVPPLRR

SEQ ID NO: 1073160 - protein, 24 aa, Mycobacterium
GLATVIPFHRAVVSDPAFIGDEHG

SEQ ID NO: 1073161 - protein, 23 aa, Mycobacterium
GLAWRTKRLIVFDVDSTLVQGEV

SEQ ID NO: 1073162 - protein, 24 aa, Mycobacterium
GLCTMRWAGRLLPAASRKLPDCCD

SEQ ID NO: 1073163 - protein, 25 aa, Mycobacterium
GLDFMPVVFSLFQWGKRHLPGGDRL

SEQ ID NO: 1073164 - protein, 17 aa, Mycobacterium
GLDLDDETRRRAALNPL

SEQ ID NO: 1073165 - protein, 18 aa, Mycobacterium
GLDLIAIDKGAPVELDLR

SEQ ID NO: 1073166 - protein, 25 aa, Mycobacterium
GLDRVKPFRPFQVNEQLLAAADSEV

SEQ ID NO: 1073167 - protein, 30 aa, Mycobacterium; identical to SEQ ID NO: 818025

SEQ ID NO: 1073168 - protein, 24 aa, Mycobacterium
GLDSRAYRLKWPNGATVFEIDLPK

SEQ ID NO: 1073169 - protein, 24 aa, Mycobacterium
GLDSVRFVLLMKRLGVDRESELPS

SEQ ID NO: 1073170 - protein, 18 aa, Mycobacterium
GLDVGSPFHHAKSGILYV

SEQ ID NO: 1073171 - protein, 26 aa, Mycobacterium
GLELRPRKLREAAALWDRLTQGAGID

SEQ ID NO: 1073172 - protein, 27 aa, Mycobacterium
GLEQRFDRELWRKLIDSDILSSAAATQ

SEQ ID NO: 1073173 - protein, 24 aa, Mycobacterium
GLEVDTDLRWRIVTALATAGVIDS

SEQ ID NO: 1073174 - protein, 21 aa, Mycobacterium
GLFRGIAGIGYTALRRINRPL

SEQ ID NO: 1073175 - protein, 20 aa, Mycobacterium
GLGAIAAHLPLSLTIALDPD

SEQ ID NO: 1073176 - protein, 18 aa, Mycobacterium
GLGAQLRAALSGSLGTAV

SEQ ID NO: 1073177 - protein, 21 aa, Mycobacterium
GLGGGLPIGAFLATGPAAELL

SEQ ID NO: 1073178 - protein, 18 aa, Mycobacterium
GLGGLAGLAGRIVDALAE

SEQ ID NO: 1073179 - protein, 25 aa, Mycobacterium
GLGGLGLVVARWLVDSGAGRVVLNG

SEQ ID NO: 1073180 - protein, 24 aa, Mycobacterium
GLGGQAQAGGFQDGVDGAGGAGGQ

SEQ ID NO: 1073181 - protein, 23 aa, Mycobacterium
GLGGRVGFLFGDGGLGGQGGDGG

SEQ ID NO: 1073182 - protein, 26 aa, Mycobacterium
GLGLDFLRHIERCAVLVHVVNCATAE

SEQ ID NO: 1073183 - protein, 23 aa, Mycobacterium
GLGNAGSFNMGFGNAGSGNVGYE

SEQ ID NO: 1073184 - protein, 24 aa, Mycobacterium
GLGRSGFLLAPWTAEQIVSELVPI

SEQ ID NO: 1073185 - protein, 20 aa, Mycobacterium
GLGRSLPRPVRRRLPGDSGG

SEQ ID NO: 1073186 - protein, 25 aa, Mycobacterium
GLGRTLTMIGLRSLTQRLGDRDLGH

SEQ ID NO: 1073187 - protein, 25 aa, Mycobacterium
GLGSVYRLRLALPQLDPGSLTLGRA

SEQ ID NO: 1073188 - protein, 17 aa, Mycobacterium
GLHAAALFSADGTMHVI

SEQ ID NO: 1073189 - protein, 18 aa, Mycobacterium
GLHCRLVGRPARTAALQR

SEQ ID NO: 1073190 - protein, 24 aa, Mycobacterium
GLHNEIVAPYLLALATEEQKQRRL

SEQ ID NO: 1073191 - protein, 21 aa, Mycobacterium
GLHQHFENALAAAGSSYAGAE

SEQ ID NO: 1073192 - protein, 17 aa, Mycobacterium
GLHTCWVAEAWGSDAPS

SEQ ID NO: 1073193 - protein, 38 aa, Mycobacterium; identical to SEQ ID NO: 818181

SEQ ID NO: 1073194 - protein, 17 aa, Mycobacterium
GLIEALAGFPKPLICAV

SEQ ID NO: 1073195 - protein, 30 aa, Mycobacterium; identical to SEQ ID NO: 818199

SEQ ID NO: 1073196 - protein, 31 aa, Mycobacterium; identical to SEQ ID NO: 818200

SEQ ID NO: 1073197 - protein, 25 aa, Mycobacterium
GLKPSRGRLPLNSQLRRLPLVIVAN

SEQ ID NO: 1073198 - protein, 24 aa, Mycobacterium
GLKRIRIEILPITIGLPFGLTMFF

SEQ ID NO: 1073199 - protein, 20 aa, Mycobacterium
GLLAHLPGLPQIRASVAELQ

SEQ ID NO: 1073200 - protein, 18 aa, Mycobacterium
GLLCTFPLERESGEVTLN

SEQ ID NO: 1073201 - protein, 20 aa, Mycobacterium
GLLDAMGWLAANVPIYAVNV

SEQ ID NO: 1073202 - protein, 23 aa, Mycobacterium
GLLDPSCIFYWLVELIRGLARQR

SEQ ID NO: 1073203 - protein, 19 aa, Mycobacterium
GLLDPVAKMLRLPFGTPEF

SEQ ID NO: 1073204 - protein, 28 aa, Mycobacterium
GLLDTAMVLGEPFMLPAHIDFAALRVKF

SEQ ID NO: 1073205 - protein, 37 aa, Mycobacterium; identical to SEQ ID NO: 818251

SEQ ID NO: 1073206 - protein, 17 aa, Mycobacterium
GLLGPLEMTIDGELVPL

SEQ ID NO: 1073207 - protein, 26 aa, Mycobacterium
GLLGRRIERSPLPFGRPRWVAYHEAP

SEQ ID NO: 1073208 - protein, 19 aa, Mycobacterium
GLLHRAFSVFLFDDSRRMA

SEQ ID NO: 1073209 - protein, 17 aa, Mycobacterium
GLLIAEWVRRKAAGPVL

SEQ ID NO: 1073210 - protein, 17 aa, Mycobacterium
GLLIYNAGANTCREQFL

SEQ ID NO: 1073211 - protein, 27 aa, Mycobacterium
GLLLVTHDRWFLDEIATTTWEVHDGIV

SEQ ID NO: 1073212 - protein, 26 aa, Mycobacterium
GLLMAPTYAVPRLLARNGLTLQDFDF

SEQ ID NO: 1073213 - protein, 25 aa, Mycobacterium
GLLSMPEFANIRLVFDTTNPGAHQS

SEQ ID NO: 1073214 - protein, 20 aa, Mycobacterium
GLLTARENINMIGSLRGIRR

SEQ ID NO: 1073215 - protein, 20 aa, Mycobacterium
GLLVRSPPPRRLGRRGPDRR

SEQ ID NO: 1073216 - protein, 17 aa, Mycobacterium
GLLYLPDDPLDSDALGQ

SEQ ID NO: 1073217 - protein, 20 aa, Mycobacterium
GLMLATLAHRVGWPIPIGGS

SEQ ID NO: 1073218 - protein, 23 aa, Mycobacterium
GLNDGNFFELDWALQRHNEFVAS

SEQ ID NO: 1073219 - protein, 24 aa, Mycobacterium
GLNHDVLLIAVGALASMALAVAKR

SEQ ID NO: 1073220 - protein, 27 aa, Mycobacterium
GLNLGLQDTFNLGWKLAAELNGWAPDG

SEQ ID NO: 1073221 - protein, 23 aa, Mycobacterium
GLNLSIRDGWWDEWYDGENGWEI

SEQ ID NO: 1073222 - protein, 22 aa, Mycobacterium
GLNMLRLWDDRGTLEPWIAPLS

SEQ ID NO: 1073223 - protein, 17 aa, Mycobacterium
GLPAPRLVVEPGRAIAG

SEQ ID NO: 1073224 - protein, 25 aa, Mycobacterium
GLPEMGLVGQQLWQQSGLKPTDIQT

SEQ ID NO: 1073225 - protein, 22 aa, Mycobacterium
GLPGVRAFLEGAGVARFKIPEQ

SEQ ID NO: 1073226 - protein, 25 aa, Mycobacterium
GLPHALKFLLMLRGGARQTKSQGTA

SEQ ID NO: 1073227 - protein, 25 aa, Mycobacterium
GLPVPVTSRHTLLLGPPGTGKTSVA

SEQ ID NO: 1073228 - protein, 24 aa, Mycobacterium
GLQARLMSQALRKMTGALNNSGTT

SEQ ID NO: 1073229 - protein, 17 aa, Mycobacterium
GLQFTRLAGGRPKSPAR

SEQ ID NO: 1073230 - protein, 19 aa, Mycobacterium
GLQIMAPALADDRLYRVGA

SEQ ID NO: 1073231 - protein, 20 aa, Mycobacterium
GLQVWAPSVIPPIGVELSDA

SEQ ID NO: 1073232 - protein, 23 aa, Mycobacterium
GLQYLAGCIAGCLHLAFDYERDH

SEQ ID NO: 1073233 - protein, 17 aa, Mycobacterium
GLRALYLYAAAHQDDAV

SEQ ID NO: 1073234 - protein, 17 aa, Mycobacterium
GLRLGVEASLRSLARVA

SEQ ID NO: 1073235 - protein, 19 aa, Mycobacterium
GLRPAVYYFGRRIEDDPIE

SEQ ID NO: 1073236 - protein, 17 aa, Mycobacterium
GLRRFAALSGRSVGAEK

SEQ ID NO: 1073237 - protein, 18 aa, Mycobacterium
GLRRLAPMAFVRFRIDGK

SEQ ID NO: 1073238 - protein, 26 aa, Mycobacterium
GLRSLLAYQWAHPGKQLLFMGQEFGQ

SEQ ID NO: 1073239 - protein, 29 aa, Mycobacterium
GLRSSYVASWYAAPLLVAGGRGLIAFTSS

SEQ ID NO: 1073240 - protein, 20 aa, Mycobacterium
GLRTWLPTRRSPRTKARHRL

SEQ ID NO: 1073241 - protein, 20 aa, Mycobacterium
GLRTYLSVRGGISVTPVLGS

SEQ ID NO: 1073242 - protein, 17 aa, Mycobacterium
GLRYTMNVIALNGAAVG

SEQ ID NO: 1073243 - protein, 24 aa, Mycobacterium
GLSARYFYESFPDKDEFIGGVFDW

SEQ ID NO: 1073244 - protein, 21 aa, Mycobacterium
GLSFSPWVVIYLVVDSMDPTE

SEQ ID NO: 1073245 - protein, 22 aa, Mycobacterium
GLSINRFIAIDFVGFAKMVQAL

SEQ ID NO: 1073246 - protein, 26 aa, Mycobacterium
GLSPAPLHRTGWIDDWLPAELNRRGR

SEQ ID NO: 1073247 - protein, 22 aa, Mycobacterium
GLSSRLFQEIRESRGLAYSVYS

SEQ ID NO: 1073248 - protein, 26 aa, Mycobacterium
GLTARVLQRWSVAPVRPAVTVVQALP

SEQ ID NO: 1073249 - protein, 21 aa, Mycobacterium
GLTGQFWQGAAAQAMTGVAQA

SEQ ID NO: 1073250 - protein, 24 aa, Mycobacterium
GLTNLELHLLPIEDLHTLGRDFDL

SEQ ID NO: 1073251 - protein, 26 aa, Mycobacterium
GLTTEGFPNLFLIAGPNSPSVLSNMA

SEQ ID NO: 1073252 - protein, 28 aa, Mycobacterium
GLVDRALIAAYTGGLTPILCLTKTDLAP

SEQ ID NO: 1073253 - protein, 26 aa, Mycobacterium
GLVHIYHALTWGPLMREIIWATTRKE

SEQ ID NO: 1073254 - protein, 23 aa, Mycobacterium
GLVVPGKPTVMVLPGPPSELQPM

SEQ ID NO: 1073255 - protein, 25 aa, Mycobacterium
GLVVPGKPTVMVLPGPPSELQPMWR

SEQ ID NO: 1073256 - protein, 20 aa, Mycobacterium
GLWRKFLFDRKRKSAGLPPH

SEQ ID NO: 1073257 - protein, 25 aa, Mycobacterium
GLWSTADDYLRFVRLLLGDGTIDGV

SEQ ID NO: 1073258 - protein, 21 aa, Mycobacterium
GMATAAYFTYRSKCAAIARIS

SEQ ID NO: 1073259 - protein, 21 aa, Mycobacterium
GMDDFVRMGLAAHGDSRQVRT

SEQ ID NO: 1073260 - protein, 17 aa, Mycobacterium
GMDFTVPDGIPAIDLRS

SEQ ID NO: 1073261 - protein, 17 aa, Mycobacterium
GMFALRFDQFALSLLSR

SEQ ID NO: 1073262 - protein, 17 aa, Mycobacterium
GMFISLMFAGHHTSSGT

SEQ ID NO: 1073263 - protein, 25 aa, Mycobacterium
GMGHDLPQPVWRPILETLTENFSRA

SEQ ID NO: 1073264 - protein, 19 aa, Mycobacterium
GMGINPFFDAPYEDVSKGI

SEQ ID NO: 1073265 - protein, 24 aa, Mycobacterium
GMGKTFAFGVPLLQRVSSGTGVRP

SEQ ID NO: 1073266 - protein, 18 aa, Mycobacterium
GMGQLFYESVPAFRAEVD

SEQ ID NO: 1073267 - protein, 25 aa, Mycobacterium
GMGRDLYGRFPAFAKAFDTVADALD

SEQ ID NO: 1073268 - protein, 26 aa, Mycobacterium
GMILIDGAIRRPAVLDYKLVDVPDLG

SEQ ID NO: 1073269 - protein, 19 aa, Mycobacterium
GMIYEGRPNITVDAFGLAF

SEQ ID NO: 1073270 - protein, 20 aa, Mycobacterium
GMIYEGRPNITVDAFGLAFK

SEQ ID NO: 1073271 - protein, 27 aa, Mycobacterium
GMKLDLQLTVPLDYYKKFMSVNHDGVL

SEQ ID NO: 1073272 - protein, 24 aa, Mycobacterium
GMKRFNTIWTSPQTLPLPAELENP

SEQ ID NO: 1073273 - protein, 19 aa, Mycobacterium
GMLPAFRHTVEELFTAGLV

SEQ ID NO: 1073274 - protein, 26 aa, Mycobacterium
GMLTTPQLKAFYLDLQDDRLTSALGI

SEQ ID NO: 1073275 - protein, 19 aa, Mycobacterium
GMMLSGLPNMAYTVGYTNA

SEQ ID NO: 1073276 - protein, 18 aa, Mycobacterium
GMPALARVLSWASVGVDP

SEQ ID NO: 1073277 - protein, 20 aa, Mycobacterium
GMPATRFLGPALGSLHMFFH

SEQ ID NO: 1073278 - protein, 18 aa, Mycobacterium
GMPFGNMAGQPFGRALPQ

SEQ ID NO: 1073279 - protein, 23 aa, Mycobacterium
GMPKAVLWRQHDIFMNSMGGRTF

SEQ ID NO: 1073280 - protein, 27 aa, Mycobacterium
GMPMAPGMFAISWLDQLRLPVRIDSVG

SEQ ID NO: 1073281 - protein, 25 aa, Mycobacterium
GMPPMAPLAPLLPAATDIGLHIVVP

SEQ ID NO: 1073282 - protein, 19 aa, Mycobacterium
GMQGTYIQAVYYPGVNQIQ

SEQ ID NO: 1073283 - protein, 20 aa, Mycobacterium
GMQGTYIQAVYYPGVNQIQT

SEQ ID NO: 1073284 - protein, 24 aa, Mycobacterium
GMRGGFGGWSPTSFGGSSGSSGDS

SEQ ID NO: 1073285 - protein, 23 aa, Mycobacterium
GMRHQLPMPSILDTKGRIVDTGT

SEQ ID NO: 1073286 - protein, 18 aa, Mycobacterium
GMTAWDLYGGAGVFAAVL

SEQ ID NO: 1073287 - protein, 27 aa, Mycobacterium
GMTETSPLATMAWPPPGTPPDRHWAIR

SEQ ID NO: 1073288 - protein, 23 aa, Mycobacterium
GMTLSGKTLGLLGLGRVGKRMTE

SEQ ID NO: 1073289 - protein, 25 aa, Mycobacterium
GMVFQHFNLFPHRNVVDNVTLAPRK

SEQ ID NO: 1073290 - protein, 18 aa, Mycobacterium
GMVFTKDGGRLFLHTVGS

SEQ ID NO: 1073291 - protein, 33 aa, Mycobacterium; identical to SEQ ID NO: 818839

SEQ ID NO: 1073292 - protein, 20 aa, Mycobacterium
GNAGLFSGIAGNGGDGGQGG

SEQ ID NO: 1073293 - protein, 27 aa, Mycobacterium
GNAPDSTFNLGFADIGIFNAGAANTGN

SEQ ID NO: 1073294 - protein, 26 aa, Mycobacterium
GNAQLRAEFGDRLPVILLDGREHSYW

SEQ ID NO: 1073295 - protein, 18 aa, Mycobacterium
GNAWLWSACGSCEQCRTG

SEQ ID NO: 1073296 - protein, 25 aa, Mycobacterium
GNDSVLVYVWAPLCAPCDVFAPTYE

SEQ ID NO: 1073297 - protein, 29 aa, Mycobacterium
GNGAPNLVFQLLWYPSCVGDLALPSFSEN

SEQ ID NO: 1073298 - protein, 22 aa, Mycobacterium
GNGGAGGARRAGGTGGAGGVAG

SEQ ID NO: 1073299 - protein, 25 aa, Mycobacterium
GNGGFGGGGTIRGNGGNGGNGDNGD

SEQ ID NO: 1073300 - protein, 27 aa, Mycobacterium
GNGGFGGTGGLFEAAGSGGAGGVDGDG

SEQ ID NO: 1073301 - protein, 18 aa, Mycobacterium
GNGGIGELIGNGGAGGAG

SEQ ID NO: 1073302 - protein, 28 aa, Mycobacterium
GNGGNGSQPPFGSIPAGSGGDGGNGGDG

SEQ ID NO: 1073303 - protein, 26 aa, Mycobacterium
GNGGRAALLIGFGGNGGNGGVGTATT

SEQ ID NO: 1073304 - protein, 26 aa, Mycobacterium
GNGGRAGLFFGVGGTGGNGGATSTNG

SEQ ID NO: 1073305 - protein, 23 aa, Mycobacterium
GNGGRGDMLFTVGGSGGTGGDGG

SEQ ID NO: 1073306 - protein, 28 aa, Mycobacterium
GNGGSGGLGGNAWLLGSGGTGGTGGAGV

SEQ ID NO: 1073307 - protein, 22 aa, Mycobacterium
GNGGTGAWLLGNGGAGGSGGST

SEQ ID NO: 1073308 - protein, 21 aa, Mycobacterium
GNGNALALRAGASLINMECVQ

SEQ ID NO: 1073309 - protein, 18 aa, Mycobacterium
GNGPAGGAAGCWGRGGIG

SEQ ID NO: 1073310 - protein, 17 aa, Mycobacterium
GNGQSWLATLWSEFGPN

SEQ ID NO: 1073311 - protein, 25 aa, Mycobacterium
GNHNVGMFNAGFANVGWANAGIGNT

SEQ ID NO: 1073312 - protein, 28 aa, Mycobacterium
GNIFHTWVQQFYGAELLFDLGDLPGAAD

SEQ ID NO: 1073313 - protein, 24 aa, Mycobacterium
GNIPIRAHLLDEGLVRRGTGRWPG

SEQ ID NO: 1073314 - protein, 21 aa, Mycobacterium
GNKIILFGARTGLDGIGGVSV

SEQ ID NO: 1073315 - protein, 19 aa, Mycobacterium
GNKLLIFQVYDHQTNFPLG

SEQ ID NO: 1073316 - protein, 18 aa, Mycobacterium
GNLAPPPETLRSFGLPTM

SEQ ID NO: 1073317 - protein, 25 aa, Mycobacterium
GNNQPGLVVLLTFGTGIGSAVINDG

SEQ ID NO: 1073318 - protein, 20 aa, Mycobacterium
GNPALFAEALLHNARHIEVQ

SEQ ID NO: 1073319 - protein, 18 aa, Mycobacterium
GNPGPGGKPGPNGADGIV

SEQ ID NO: 1073320 - protein, 26 aa, Mycobacterium
GNPSWGTFYSLDDPWITSAMAEMQQN

SEQ ID NO: 1073321 - protein, 23 aa, Mycobacterium
GNPTSSYLWRNVIPHLSDVGRCL

SEQ ID NO: 1073322 - protein, 22 aa, Mycobacterium
GNQILGRALGLSTYKMVFGHRG

SEQ ID NO: 1073323 - protein, 25 aa, Mycobacterium
GNQKPEFIRPYFSTVQLMLAGNDVE

SEQ ID NO: 1073324 - protein, 27 aa, Mycobacterium
GNRPKIGWRRYEAQAVLSRLLNAPVSV

SEQ ID NO: 1073325 - protein, 18 aa, Mycobacterium
GNRTFYIQAVHDKRVVSV

SEQ ID NO: 1073326 - protein, 24 aa, Mycobacterium
GNSANLNIGFWNSTGAGNVGVMNT

SEQ ID NO: 1073327 - protein, 19 aa, Mycobacterium
GNSGFFNSGSYNSGLINSS

SEQ ID NO: 1073328 - protein, 25 aa, Mycobacterium
GNSTRARIVLFRKPIERRAKDTIEL

SEQ ID NO: 1073329 - protein, 24 aa, Mycobacterium
GNTALLLAQLRDVPEQRRGAAFVS

SEQ ID NO: 1073330 - protein, 25 aa, Mycobacterium
GNTQVTGLLPFGRPQLTGGPLRSAA

SEQ ID NO: 1073331 - protein, 22 aa, Mycobacterium
GNVIRFLPPLTIEEADISAALT

SEQ ID NO: 1073332 - protein, 19 aa, Mycobacterium
GNVPAGFMAPSLNGIGGDG

SEQ ID NO: 1073333 - protein, 18 aa, Mycobacterium
GNVYCNELCFVSGHLPTA

SEQ ID NO: 1073334 - protein, 30 aa, Mycobacterium; identical to SEQ ID NO: 819042

SEQ ID NO: 1073335 - protein, 20 aa, Mycobacterium
GNYLPRFGPYLSSASNPWGE

SEQ ID NO: 1073336 - protein, 18 aa, Mycobacterium
GPAAARFFAALAVGDTAT

SEQ ID NO: 1073337 - protein, 20 aa, Mycobacterium
GPAAAVDRAAPPRAVAAAAA

SEQ ID NO: 1073338 - protein, 25 aa, Mycobacterium
GPAARYRRWLAALRGGARLVIGTRS

SEQ ID NO: 1073339 - protein, 26 aa, Mycobacterium
GPAELRLRNLLKPEQFPYTTKTGWVY

SEQ ID NO: 1073340 - protein, 23 aa, Mycobacterium
GPAFQGTIKSAVAFGALLSRGIG

SEQ ID NO: 1073341 - protein, 19 aa, Mycobacterium
GPAIYRAVARHDPAGAVLV

SEQ ID NO: 1073342 - protein, 23 aa, Mycobacterium
GPALALLPGWSLTAQIFRHQLAG

SEQ ID NO: 1073343 - protein, 20 aa, Mycobacterium
GPALLLGARGRRLDVRQART

SEQ ID NO: 1073344 - protein, 29 aa, Mycobacterium
GPAVGRYLHLHPVVTMLALHDEPQQPWWG

SEQ ID NO: 1073345 - protein, 41 aa, Mycobacterium
GPAVPPAPPPIKTPPRPPAPPWPTTPPVAPTVVAAPPAPPS

SEQ ID NO: 1073346 - protein, 21 aa, Mycobacterium
GPEGKDLAILLLRLGRGRLGH

SEQ ID NO: 1073347 - protein, 33 aa, Mycobacterium
GPEMLSFVLEHTPLKMCWVPGYSDYYSEAPGGR

SEQ ID NO: 1073348 - protein, 22 aa, Mycobacterium
GPETLIIDCGADFRLTDAAAWE

SEQ ID NO: 1073349 - protein, 36 aa, Mycobacterium
GPFALQDFSLFHVLRYGFRPSKIGFLAWHAWSDSQR

SEQ ID NO: 1073350 - protein, 21 aa, Mycobacterium
GPFRGVPFLIKDLYALYAGQP

SEQ ID NO: 1073351 - protein, 26 aa, Mycobacterium
GPGDRPAWSMIFEDLGHRRRPAPETA

SEQ ID NO: 1073352 - protein, 23 aa, Mycobacterium
GPGDRWIIEQIAATAPKVKLVVI

SEQ ID NO: 1073353 - protein, 40 aa, Mycobacterium
GPGEAMVVKELTGASLVRHRMAARAVTAEVGARAGLAVKA

SEQ ID NO: 1073354 - protein, 27 aa, Mycobacterium
GPGENIPAWLVFDQRYRDRYIFAGLQP

SEQ ID NO: 1073355 - protein, 22 aa, Mycobacterium
GPGGLPEFLVARFGAEAANVVV

SEQ ID NO: 1073356 - protein, 25 aa, Mycobacterium
GPGGPLVRWPTLTKSGRWRAEKATA

SEQ ID NO: 1073357 - protein, 26 aa, Mycobacterium
GPGGSIPIRIYWPPISPDATDPLPVV

SEQ ID NO: 1073358 - protein, 20 aa, Mycobacterium
GPGGWIFGTGGAGGNGGLGG

SEQ ID NO: 1073359 - protein, 28 aa, Mycobacterium
GPGIAVTVRYRSQWPVGPASRRQSAVSG

SEQ ID NO: 1073360 - protein, 20 aa, Mycobacterium
GPGNFNVSIHPFFDVQPLFG

SEQ ID NO: 1073361 - protein, 21 aa, Mycobacterium
GPIFPLIEDLFGLGIVEVQQE

SEQ ID NO: 1073362 - protein, 22 aa, Mycobacterium
GPIGRVRPGSDSLLPMWLDLEE

SEQ ID NO: 1073363 - protein, 24 aa, Mycobacterium
GPIGRVRPGSDSLLPMWLDLEECA

SEQ ID NO: 1073364 - protein, 22 aa, Mycobacterium
GPIPFPHHPIYTIPSERFLGNL

SEQ ID NO: 1073365 - protein, 23 aa, Mycobacterium
GPLAAFVHALGTVGFDVAVLDYS

SEQ ID NO: 1073366 - protein, 20 aa, Mycobacterium
GPLLDRQAVIRARLGQLGIP

SEQ ID NO: 1073367 - protein, 18 aa, Mycobacterium
GPLPLQIICDMMGIPEED

SEQ ID NO: 1073368 - protein, 35 aa, Mycobacterium
GPLPQTGFVLRKALSAHLPVILVVNKTDRPDARIK

SEQ ID NO: 1073369 - protein, 18 aa, Mycobacterium
GPLVERFKTIQPWLTDGI

SEQ ID NO: 1073370 - protein, 34 aa, Mycobacterium
GPLVILLHGFPESWYSWRHQIPALAAADYRVVAV

SEQ ID NO: 1073371 - protein, 25 aa, Mycobacterium
GPNVLRAFTFPFDQVRILIVGQDPY

SEQ ID NO: 1073372 - protein, 24 aa, Mycobacterium
GPPAMAAHRIGRVRRLGGGGHRDP

SEQ ID NO: 1073373 - protein, 18 aa, Mycobacterium
GPPPTHKIWATQSGFTFP

SEQ ID NO: 1073374 - protein, 25 aa, Mycobacterium
GPPSDLPLCALLAGWVRGQVRPAAT

SEQ ID NO: 1073375 - protein, 23 aa, Mycobacterium
GPQDMFFLYSESPSTMMHVGALM

SEQ ID NO: 1073376 - protein, 26 aa, Mycobacterium
GPQFGPLRRVRAVLAAATRCHRAGQD

SEQ ID NO: 1073377 - protein, 24 aa, Mycobacterium
GPQTRRFLMDLTGIGGDRPPFSCD

SEQ ID NO: 1073378 - protein, 25 aa, Mycobacterium
GPRATFLLMQAVYPVMVEAGGGSIV

SEQ ID NO: 1073379 - protein, 23 aa, Mycobacterium
GPRSSFLRLFPTVVKGTHVELDE

SEQ ID NO: 1073380 - protein, 29 aa, Mycobacterium
GPSAFPTIIDMWLPLSWSLNMVNRSMGHD

SEQ ID NO: 1073381 - protein, 20 aa, Mycobacterium
GPSASILAAGRWLANELCSH

SEQ ID NO: 1073382 - protein, 29 aa, Mycobacterium
GPSGIALSPYRFPTGWFIVAFSSELGAGE

SEQ ID NO: 1073383 - protein, 17 aa, Mycobacterium
GPSKFLAELKLLPQEEW

SEQ ID NO: 1073384 - protein, 28 aa, Mycobacterium
GPSLSLVLIDRIPFPRPDDPLLSARQRA

SEQ ID NO: 1073385 - protein, 20 aa, Mycobacterium
GPTEASLGRPLIGNGADGTA

SEQ ID NO: 1073386 - protein, 22 aa, Mycobacterium
GPTRIRTVLGILKAYTTRVGSG

SEQ ID NO: 1073387 - protein, 31 aa, Mycobacterium
GPTSTNYYMIPSPHLPLLDPVRAIPVIGTPI

SEQ ID NO: 1073388 - protein, 17 aa, Mycobacterium
GPVAESLLALGLPGLSV

SEQ ID NO: 1073389 - protein, 18 aa, Mycobacterium
GPVATRFMRDRFGHFDFS

SEQ ID NO: 1073390 - protein, 20 aa, Mycobacterium
GPVATTLLLPSVLDAVKGTG

SEQ ID NO: 1073391 - protein, 29 aa, Mycobacterium
GPVDLRHLSLWWTWTPGASWRHPAGPHSS

SEQ ID NO: 1073392 - protein, 30 aa, Mycobacterium
GPVDRRDWRQWWYWAPGASWRHPWGPDSDV

SEQ ID NO: 1073393 - protein, 18 aa, Mycobacterium
GPVLARRVLLTGDIIEAG

SEQ ID NO: 1073394 - protein, 26 aa, Mycobacterium
GPVVHVHLGLYGAFTEWVRSAGELLP

SEQ ID NO: 1073395 - protein, 25 aa, Mycobacterium
GQACILHSRLLLPEAMHDEIVDRLV

SEQ ID NO: 1073396 - protein, 25 aa, Mycobacterium
GQAGGAGGLLIGNGGNGAPSAVGQA

SEQ ID NO: 1073397 - protein, 23 aa, Mycobacterium
GQAGSRHRWRVSQASLDDSGHAG

SEQ ID NO: 1073398 - protein, 20 aa, Mycobacterium
GQDLIGEFVAHSAAFHAMMQ

SEQ ID NO: 1073399 - protein, 22 aa, Mycobacterium
GQERPFPLDLVPRVISAAEWSR

SEQ ID NO: 1073400 - protein, 22 aa, Mycobacterium
GQERPFPLDLVPRVISASEWSR

SEQ ID NO: 1073401 - protein, 19 aa, Mycobacterium
GQFDLSSLRFALSGAEPVE

SEQ ID NO: 1073402 - protein, 22 aa, Mycobacterium
GQGALVVLIARDDPLDTYLVHH

SEQ ID NO: 1073403 - protein, 22 aa, Mycobacterium
GQGDLGFFWVTAVTADATIVVA

SEQ ID NO: 1073404 - protein, 26 aa, Mycobacterium
GQHQMWAAQFIKYEKPRTWLNSGGLG

SEQ ID NO: 1073405 - protein, 21 aa, Mycobacterium
GQIDPALKLRPSRGTHLVFDA

SEQ ID NO: 1073406 - protein, 23 aa, Mycobacterium
GQIHDWVLLTLDGPRYLAQINQE

SEQ ID NO: 1073407 - protein, 25 aa, Mycobacterium
GQLDKAGLPYLGHVRRVAAYVDPAN

SEQ ID NO: 1073408 - protein, 23 aa, Mycobacterium
GQLEGSKRFIGCGQILFEDVVIG

SEQ ID NO: 1073409 - protein, 20 aa, Mycobacterium
GQLGLQYLPPGAAMTTADLF

SEQ ID NO: 1073410 - protein, 18 aa, Mycobacterium
GQLLLALREVVIQRTGFN

SEQ ID NO: 1073411 - protein, 24 aa, Mycobacterium
GQLPGHKVYPWVAKVRHSTPGVGL

SEQ ID NO: 1073412 - protein, 19 aa, Mycobacterium
GQLPKMRAIVGFAAETGDA

SEQ ID NO: 1073413 - protein, 20 aa, Mycobacterium
GQMVTARPCPTCRGVGVVIP

SEQ ID NO: 1073414 - protein, 28 aa, Mycobacterium
GQNARLAARLTGWWIDIRGDSPEQSAEH

SEQ ID NO: 1073415 - protein, 24 aa, Mycobacterium
GQNGADGGLLWGTGGTGDATHPAG

SEQ ID NO: 1073416 - protein, 22 aa, Mycobacterium
GQPLRVRAAMKPISTVPKALAT

SEQ ID NO: 1073417 - protein, 34 aa, Mycobacterium
GQPVVPYLHFEGLRTLALPLRIHLESAGFGIDCY

SEQ ID NO: 1073418 - protein, 18 aa, Mycobacterium
GQQFFFNGGAGGDGGSVG

SEQ ID NO: 1073419 - protein, 18 aa, Mycobacterium
GQQWLKTTGLNTLRPDFD

SEQ ID NO: 1073420 - protein, 17 aa, Mycobacterium
GQRGAPIGRMWVRPFAS

SEQ ID NO: 1073421 - protein, 22 aa, Mycobacterium
GQRPACEVVLDALRRMEYRGYD

SEQ ID NO: 1073422 - protein, 25 aa, Mycobacterium
GQRRRVELARILFAASDTGAGSSTV

SEQ ID NO: 1073423 - protein, 25 aa, Mycobacterium
GQSGEVWISFLIVAPKYVASVATDL

SEQ ID NO: 1073424 - protein, 29 aa, Mycobacterium
GQSKLANLLFTYELQRRLAADSQAATIAV

SEQ ID NO: 1073425 - protein, 23 aa, Mycobacterium
GQTELDYWRDALAGLPDEISVAT

SEQ ID NO: 1073426 - protein, 22 aa, Mycobacterium
GQTPTYCIDLATAEVRPVVPER

SEQ ID NO: 1073427 - protein, 24 aa, Mycobacterium
GQTRGWFYTLHVLATALFDRPAFK

SEQ ID NO: 1073428 - protein, 24 aa, Mycobacterium
GQVFDWAPALTLSAGLAAAHQAIL

SEQ ID NO: 1073429 - protein, 25 aa, Mycobacterium
GQVIDFTLTLWDGDRSRLHLDVDML

SEQ ID NO: 1073430 - protein, 19 aa, Mycobacterium
GQVMPYFGQEFLEQSQAKG

SEQ ID NO: 1073431 - protein, 23 aa, Mycobacterium
GQVTEAFWNAIRHAKPIAVGLNC

SEQ ID NO: 1073432 - protein, 30 aa, Mycobacterium; identical to SEQ ID NO: 819699

SEQ ID NO: 1073433 - protein, 23 aa, Mycobacterium
GQYEAPLGITLRELLDYAGGIRA

SEQ ID NO: 1073434 - protein, 19 aa, Mycobacterium
GQYIGIGLLVDGRWRWRSY

SEQ ID NO: 1073435 - protein, 38 aa, Mycobacterium
GRAAVLAPRLSVPDEFGLCRYLAAGLAVLRTVAPKLRI

SEQ ID NO: 1073436 - protein, 18 aa, Mycobacterium
GRAFSFISAIDSIGAVPP

SEQ ID NO: 1073437 - protein, 29 aa, Mycobacterium
GRASFELTQKALMAGIPVLAAVSAPSSLA

SEQ ID NO: 1073438 - protein, 18 aa, Mycobacterium
GRCPTCQAGLRNLCDLGA

SEQ ID NO: 1073439 - protein, 18 aa, Mycobacterium
GRDAGRRRPPVLSEAEFL

SEQ ID NO: 1073440 - protein, 25 aa, Mycobacterium
GRDIGTVVFPDARVKIFLTASAETR

SEQ ID NO: 1073441 - protein, 34 aa, Mycobacterium; identical to SEQ ID NO: 819786

SEQ ID NO: 1073442 - protein, 23 aa, Mycobacterium
GRDRCRVPMPWSGTTPPFGFSSC

SEQ ID NO: 1073443 - protein, 18 aa, Mycobacterium
GRDRWQYLPFGGGGRSCL

SEQ ID NO: 1073444 - protein, 27 aa, Mycobacterium
GRDSFGAMVNHFRFIRDHQKHVKKIAV

SEQ ID NO: 1073445 - protein, 25 aa, Mycobacterium
GREDGGLQRFLASAAAAFVAGVNVD

SEQ ID NO: 1073446 - protein, 26 aa, Mycobacterium
GREHLLDVWRRPDLAPGGRAPVLIQV

SEQ ID NO: 1073447 - protein, 23 aa, Mycobacterium
GRENPHILTLSPPVQLDKKWLKP

SEQ ID NO: 1073448 - protein, 28 aa, Mycobacterium
GREPGLYFRPMLIPISIHLCEDPERGWA

SEQ ID NO: 1073449 - protein, 25 aa, Mycobacterium
GREQVRAWIWQTMTTFPGSHMVAFP

SEQ ID NO: 1073450 - protein, 27 aa, Mycobacterium
GREVSSNVVVPYFWSDQYDVKIQCLGE

SEQ ID NO: 1073451 - protein, 20 aa, Mycobacterium
GREYVAQFLISGAGALHIPS

SEQ ID NO: 1073452 - protein, 18 aa, Mycobacterium
GRFELALKQPGMLRPLGA

SEQ ID NO: 1073453 - protein, 19 aa, Mycobacterium
GRFVANALSPAKVVSVSVI

SEQ ID NO: 1073454 - protein, 26 aa, Mycobacterium
GRFVGPKPPQYLIFEAHIDYAGDTGG

SEQ ID NO: 1073455 - protein, 29 aa, Mycobacterium
GRGADLRALSLPVLRSWLATAAGAGAART

SEQ ID NO: 1073456 - protein, 20 aa, Mycobacterium
GRGFALLHPVGESGARSVDT

SEQ ID NO: 1073457 - protein, 18 aa, Mycobacterium
GRGGLLIGSGGNGGTGGT

SEQ ID NO: 1073458 - protein, 18 aa, Mycobacterium
GRGILLHADPVDSAPTTG

SEQ ID NO: 1073459 - protein, 20 aa, Mycobacterium
GRGLLVLLDALRSTITGQTP

SEQ ID NO: 1073460 - protein, 29 aa, Mycobacterium
GRGLVRLARAIWPEADWDALGAKPHLAVA

SEQ ID NO: 1073461 - protein, 27 aa, Mycobacterium
GRGSTWSRQLPWLTRLGAVYTYDAPWH

SEQ ID NO: 1073462 - protein, 24 aa, Mycobacterium
GRGTRLPVWLTQWGYQRPPEETVD

SEQ ID NO: 1073463 - protein, 20 aa, Mycobacterium
GRHQLNRYPDGLEKCIGCEL

SEQ ID NO: 1073464 - protein, 26 aa, Mycobacterium
GRIDPRTRWLLRELVYALLVKKDHAA

SEQ ID NO: 1073465 - protein, 24 aa, Mycobacterium
GRIERELPEWLSADVAILGEPTSG

SEQ ID NO: 1073466 - protein, 17 aa, Mycobacterium
GRIPKRFWAQASSPTLV

SEQ ID NO: 1073467 - protein, 23 aa, Mycobacterium
GRIQMGIGGGWYEHEWRAYGYGF

SEQ ID NO: 1073468 - protein, 18 aa, Mycobacterium
GRKIGEFQAVAFKLADMK

SEQ ID NO: 1073469 - protein, 24 aa, Mycobacterium
GRKRGLILRTVQADWWELNRDIQG

SEQ ID NO: 1073470 - protein, 19 aa, Mycobacterium
GRKSGRHFSLPLSAHVIDN

SEQ ID NO: 1073471 - protein, 26 aa, Mycobacterium
GRKVAPGVRMLIVPGSMRVRAQAEKE

SEQ ID NO: 1073472 - protein, 29 aa, Mycobacterium
GRKVSEIELLPITKFFPATDVAILARLGC

SEQ ID NO: 1073473 - protein, 20 aa, Mycobacterium
GRKVVQFIPNSFSNAVRLFT

SEQ ID NO: 1073474 - protein, 27 aa, Mycobacterium
GRLGWNWARFAFNGWKALGWMDANVWR

SEQ ID NO: 1073475 - protein, 17 aa, Mycobacterium
GRLSNLLAAAIGAERAE

SEQ ID NO: 1073476 - protein, 18 aa, Mycobacterium
GRLTALDVFMGRPVVACM

SEQ ID NO: 1073477 - protein, 23 aa, Mycobacterium
GRLTGIVIGRLAADGRRFLASTE

SEQ ID NO: 1073478 - protein, 18 aa, Mycobacterium
GRLTLVEGAGGLLVELAD

SEQ ID NO: 1073479 - protein, 27 aa, Mycobacterium
GRLVPPIIETALPKTEPFWVQTPQRPD

SEQ ID NO: 1073480 - protein, 23 aa, Mycobacterium
GRLWATILQHRFGGSGALAGHPI

SEQ ID NO: 1073481 - protein, 24 aa, Mycobacterium
GRLWATILQHRFGGSGALAGHPIG

SEQ ID NO: 1073482 - protein, 24 aa, Mycobacterium
GRMEGLLVDLWDALRGLPEVFRAL

SEQ ID NO: 1073483 - protein, 23 aa, Mycobacterium
GRNAIVAAFNFDRARPVLETFGY

SEQ ID NO: 1073484 - protein, 23 aa, Mycobacterium
GRNMTMVLAPHRGAKTRARARHP

SEQ ID NO: 1073485 - protein, 18 aa, Mycobacterium
GRNVPKLRQVIGCVFQDF

SEQ ID NO: 1073486 - protein, 33 aa, Mycobacterium; identical to SEQ ID NO: 783188

SEQ ID NO: 1073487 - protein, 22 aa, Mycobacterium
GRPAFWVAHSFGGVALARAAAQ

SEQ ID NO: 1073488 - protein, 24 aa, Mycobacterium
GRPAGMPMMPMPMGAGAGAGGGMP

SEQ ID NO: 1073489 - protein, 19 aa, Mycobacterium
GRPEGRPWTYTPPVTFDQP

SEQ ID NO: 1073490 - protein, 31 aa, Mycobacterium; identical to SEQ ID NO: 820067

SEQ ID NO: 1073491 - protein, 26 aa, Mycobacterium
GRPKCLVKVIQKLSGLSINRFIAIDF

SEQ ID NO: 1073492 - protein, 21 aa, Mycobacterium
GRPLGLLLTRRSENATVTLCH

SEQ ID NO: 1073493 - protein, 24 aa, Mycobacterium
GRPSTFGWIPFGGGTRRCVGAAFA

SEQ ID NO: 1073494 - protein, 22 aa, Mycobacterium
GRPVIIITEYFLRSVFEDNSRE

SEQ ID NO: 1073495 - protein, 17 aa, Mycobacterium
GRRFSFTALVIVGDGHG

SEQ ID NO: 1073496 - protein, 26 aa, Mycobacterium
GRRGQPRLRPPFPAVAGLYGCPTVIN

SEQ ID NO: 1073497 - protein, 21 aa, Mycobacterium
GRRGRCLRAVWVSRWPSVVHW

SEQ ID NO: 1073498 - protein, 18 aa, Mycobacterium
GRRRGKLSNIPLGARDAA

SEQ ID NO: 1073499 - protein, 22 aa, Mycobacterium
GRRSFILVPGIDVPFHSRVLRV

SEQ ID NO: 1073500 - protein, 18 aa, Mycobacterium
GRRVIFMVTGVLPSEDEI

SEQ ID NO: 1073501 - protein, 18 aa, Mycobacterium
GRRWWGQHVTSEALDLLI

SEQ ID NO: 1073502 - protein, 26 aa, Mycobacterium
GRSAIKYKMDLVPLALMVSTYYYDTQ

SEQ ID NO: 1073503 - protein, 24 aa, Mycobacterium
GRSFSDFPTILQSISERLGTLPGD

SEQ ID NO: 1073504 - protein, 24 aa, Mycobacterium
GRSGFLLAPWTAEQIMFELAAVGA

SEQ ID NO: 1073505 - protein, 27 aa, Mycobacterium
GRSHAWIQAWTGGWWHYDPTNDTEISE

SEQ ID NO: 1073506 - protein, 19 aa, Mycobacterium
GRSIIVLSEGRLLNLGNAT

SEQ ID NO: 1073507 - protein, 44 aa, Mycobacterium
GRSPAWPVVYPHARPVPLPTYPFQHHRYWLTTGPGNDAAGLGLD

SEQ ID NO: 1073508 - protein, 20 aa, Mycobacterium
GRSQMAAGWLRHLAGDRIEV

SEQ ID NO: 1073509 - protein, 18 aa, Mycobacterium
GRSVARMEAALSAPSIFG

SEQ ID NO: 1073510 - protein, 28 aa, Mycobacterium
GRSVSDALDILRWAPQAASEPVAKVIAS

SEQ ID NO: 1073511 - protein, 20 aa, Mycobacterium
GRSWWEQELLTMRQANAAAA

SEQ ID NO: 1073512 - protein, 18 aa, Mycobacterium
GRTLITESRLGLVQAAAG

SEQ ID NO: 1073513 - protein, 21 aa, Mycobacterium
GRTLTYLTYGDPGGLPVIFSH

SEQ ID NO: 1073514 - protein, 21 aa, Mycobacterium
GRVAAPHRILDPKAGPLIATK

SEQ ID NO: 1073515 - protein, 25 aa, Mycobacterium
GRVDWAVHVALWQAGQLVAGAVALP

SEQ ID NO: 1073516 - protein, 22 aa, Mycobacterium
GRWACWPAPAEGRPARKRWHRR

SEQ ID NO: 1073517 - protein, 19 aa, Mycobacterium
GRWVSAPCTDAHPAACVTA

SEQ ID NO: 1073518 - protein, 18 aa, Mycobacterium
GRYAIHELALTPDDVPEE

SEQ ID NO: 1073519 - protein, 19 aa, Mycobacterium
GRYLKKITVSTTTGPGIPV

SEQ ID NO: 1073520 - protein, 19 aa, Mycobacterium
GSAGLFGNGGAGGAGGINA

SEQ ID NO: 1073521 - protein, 28 aa, Mycobacterium
GSAGLVVPIWDIGLQDLGLPTGFDVIRY

SEQ ID NO: 1073522 - protein, 24 aa, Mycobacterium
GSAKNPMWYLNLKANPNVGVQIKK

SEQ ID NO: 1073523 - protein, 21 aa, Mycobacterium
GSALCPVAVIQSPAGAAGAPK

SEQ ID NO: 1073524 - protein, 23 aa, Mycobacterium
GSALVPSWVAFAVTGLLEQHFGH

SEQ ID NO: 1073525 - protein, 18 aa, Mycobacterium
GSAQLLPEAVAGRGLVYA

SEQ ID NO: 1073526 - protein, 29 aa, Mycobacterium
GSATGSTIWPSASGWCWCSCRAAATARPA

SEQ ID NO: 1073527 - protein, 21 aa, Mycobacterium
GSDFVAIMRRLAAGEGPVDVV

SEQ ID NO: 1073528 - protein, 21 aa, Mycobacterium
GSDGIIPSNGGLGGNGGNGGN

SEQ ID NO: 1073529 - protein, 25 aa, Mycobacterium
GSDGRRWRLDFAWPGLRVAAEYDGV

SEQ ID NO: 1073530 - protein, 26 aa, Mycobacterium
GSDGSNAGFFTLGGYNSGVLNIGSLN

SEQ ID NO: 1073531 - protein, 22 aa, Mycobacterium
GSEAFLRYWPADQHMIGKDIIR

SEQ ID NO: 1073532 - protein, 23 aa, Mycobacterium
GSELGYDYLIYAVGSTAAMPAVA

SEQ ID NO: 1073533 - protein, 23 aa, Mycobacterium
GSERPWLLIVGLAPAAHGANRTG

SEQ ID NO: 1073534 - protein, 21 aa, Mycobacterium
GSFHETEIVRWLFTPDPSLTL

SEQ ID NO: 1073535 - protein, 18 aa, Mycobacterium
GSFPLQYAKTWRTLAKLS

SEQ ID NO: 1073536 - protein, 22 aa, Mycobacterium
GSFYAAVKLALDKNVVLPANAT

SEQ ID NO: 1073537 - protein, 20 aa, Mycobacterium
GSGALFFGNGGAGGNGAPGG

SEQ ID NO: 1073538 - protein, 30 aa, Mycobacterium; identical to SEQ ID NO: 820409

SEQ ID NO: 1073539 - protein, 25 aa, Mycobacterium
GSGDLLVTVKVAVPPNLEGAAKEAL

SEQ ID NO: 1073540 - protein, 24 aa, Mycobacterium
GSGDVLMVAWMDDDALDRTLKTRE

SEQ ID NO: 1073541 - protein, 18 aa, Mycobacterium
GSGFYRTDSREATKKSKS

SEQ ID NO: 1073542 - protein, 23 aa, Mycobacterium
GSGGPRLPTLTDLLYQLASGSVT

SEQ ID NO: 1073543 - protein, 25 aa, Mycobacterium
GSGGQGGWLYGNGGVGGAGGAASTA

SEQ ID NO: 1073544 - protein, 23 aa, Mycobacterium
GSGKTLAFSLPMVSRLAGRPRRP

SEQ ID NO: 1073545 - protein, 19 aa, Mycobacterium
GSGRIVGLCLGVPAFLGEQ

SEQ ID NO: 1073546 - protein, 23 aa, Mycobacterium
GSGRWPDRPLGSVSSGLLRYAHC

SEQ ID NO: 1073547 - protein, 21 aa, Mycobacterium
GSGSFIHRFVDLRRIVGLLTD

SEQ ID NO: 1073548 - protein, 18 aa, Mycobacterium
GSGSSRDWAAKGTLLLGV

SEQ ID NO: 1073549 - protein, 22 aa, Mycobacterium
GSHAPPWPGLGAYGVSKAALER

SEQ ID NO: 1073550 - protein, 20 aa, Mycobacterium
GSHNWGIGNIGINNIGLGNV

SEQ ID NO: 1073551 - protein, 20 aa, Mycobacterium
GSHVYLYRDLPEEVPVPFEM

SEQ ID NO: 1073552 - protein, 26 aa, Mycobacterium
GSIERFFGILTEHYAGAFPAWLAPVQ

SEQ ID NO: 1073553 - protein, 23 aa, Mycobacterium
GSIYAFKCPLLLGTTAVLLDRWD

SEQ ID NO: 1073554 - protein, 23 aa, Mycobacterium
GSKATWVLAPRSLATGRELGGAQ

SEQ ID NO: 1073555 - protein, 23 aa, Mycobacterium
GSKRLCLDSNYYATLNLPQVRLV

SEQ ID NO: 1073556 - protein, 29 aa, Mycobacterium
GSKVHEAPAYRWPLVPALALVAAMPALGA

SEQ ID NO: 1073557 - protein, 24 aa, Mycobacterium
GSLEHSLAVARRLRAGFIGVNGGA

SEQ ID NO: 1073558 - protein, 18 aa, Mycobacterium
GSLGNIAWYLQYAGKKSI

SEQ ID NO: 1073559 - protein, 19 aa, Mycobacterium
GSLIIFYTDGLMERAGETL

SEQ ID NO: 1073560 - protein, 17 aa, Mycobacterium
GSLQRWATTRPKSAIIK

SEQ ID NO: 1073561 - protein, 23 aa, Mycobacterium
GSLSWALSWKDAAAPLWTFPRVA

SEQ ID NO: 1073562 - protein, 27 aa, Mycobacterium
GSLTQAWDALLPARVFAFTAGASVTFS

SEQ ID NO: 1073563 - protein, 21 aa, Mycobacterium
GSMFGPYHLKRLLGRGGMGEV

SEQ ID NO: 1073564 - protein, 22 aa, Mycobacterium
GSNWIALLLEPPERAVAPGTPE

SEQ ID NO: 1073565 - protein, 24 aa, Mycobacterium
GSPAGITAVLWATAEAVSAGVPLR

SEQ ID NO: 1073566 - protein, 25 aa, Mycobacterium
GSPAMNMFILPIVDSSVLLGDWLIQ

SEQ ID NO: 1073567 - protein, 20 aa, Mycobacterium
GSPYSFLPQLSPGDTIAGQY

SEQ ID NO: 1073568 - protein, 30 aa, Mycobacterium; identical to SEQ ID NO: 783196

SEQ ID NO: 1073569 - protein, 24 aa, Mycobacterium
GSQGIRLHAPLPAAGKLSVVSEVA

SEQ ID NO: 1073570 - protein, 28 aa, Mycobacterium
GSQTQGMLSPWLELPGAADQIASWSQAS

SEQ ID NO: 1073571 - protein, 20 aa, Mycobacterium
GSQVLVFKDLGLVSQVFDEQ

SEQ ID NO: 1073572 - protein, 24 aa, Mycobacterium
GSRIDPVLARSWLLVNGTHADRFQ

SEQ ID NO: 1073573 - protein, 27 aa, Mycobacterium
GSRIRVLVAGSWFPRYARHLGTDEPTL

SEQ ID NO: 1073574 - protein, 17 aa, Mycobacterium
GSRLVELPGSDSLYWVG

SEQ ID NO: 1073575 - protein, 24 aa, Mycobacterium
GSSGLLNVGALQSGILNLGSTISG

SEQ ID NO: 1073576 - protein, 22 aa, Mycobacterium
GSSPLLAPLQLLAYCAACTNRL

SEQ ID NO: 1073577 - protein, 17 aa, Mycobacterium
GSSQWLLRMLVTQTGRA

SEQ ID NO: 1073578 - protein, 24 aa, Mycobacterium
GSTAARLFYAYADTLLALGRRDEA

SEQ ID NO: 1073579 - protein, 23 aa, Mycobacterium
GSTANWIFVLARTDPVAPKHQGL

SEQ ID NO: 1073580 - protein, 26 aa, Mycobacterium
GSTLFGRWELPAFMQIVAGLAEAMRD

SEQ ID NO: 1073581 - protein, 24 aa, Mycobacterium
GSTNTGWWNAGSVNDGLFNAGNAN

SEQ ID NO: 1073582 - protein, 25 aa, Mycobacterium
GSTPEIIDVVRWATFLFAAGQETTA

SEQ ID NO: 1073583 - protein, 21 aa, Mycobacterium
GSVGVISDGSFTPTPVGYGGN

SEQ ID NO: 1073584 - protein, 21 aa, Mycobacterium
GSVLPLLYGAPAMSAELVDYA

SEQ ID NO: 1073585 - protein, 32 aa, Mycobacterium
GSVRFLMSVGDLVIAWLLQRQAAVAVAALDAG

SEQ ID NO: 1073586 - protein, 34 aa, Mycobacterium; identical to SEQ ID NO: 820688

SEQ ID NO: 1073587 - protein, 20 aa, Mycobacterium
GSVSSGLLRYAHCPVAIVHD

SEQ ID NO: 1073588 - protein, 19 aa, Mycobacterium
GSVVKFRWNGNGVELISNK

SEQ ID NO: 1073589 - protein, 23 aa, Mycobacterium
GSVYPTLQLLDDEGLIAASASDA

SEQ ID NO: 1073590 - protein, 33 aa, Mycobacterium
GSYRGADLLGIRYLPPFAYFMDSPNAFAVLAGE

SEQ ID NO: 1073591 - protein, 19 aa, Mycobacterium
GTAAILLAFYAAAAERKGV

SEQ ID NO: 1073592 - protein, 23 aa, Mycobacterium
GTAEIGWAARMGRIPLGYFNDPE

SEQ ID NO: 1073593 - protein, 29 aa, Mycobacterium
GTALLCPFDPLIFFRPRVQRLFDFHYRIE

SEQ ID NO: 1073594 - protein, 24 aa, Mycobacterium
GTAQRPIVTAPIGKATLGALSARL

SEQ ID NO: 1073595 - protein, 24 aa, Mycobacterium
GTASPFDLILADPPYDVSCAEIEA

SEQ ID NO: 1073596 - protein, 23 aa, Mycobacterium
GTDAAPYFRIFNPSAQAEKFDPA

SEQ ID NO: 1073597 - protein, 27 aa, Mycobacterium
GTDGTPGGWLLGDGGAAGLLGTGGTGG

SEQ ID NO: 1073598 - protein, 25 aa, Mycobacterium
GTDTGFFNYGDGGLHVGWLSSGDHV

SEQ ID NO: 1073599 - protein, 36 aa, Mycobacterium; identical to SEQ ID NO: 820787

SEQ ID NO: 1073600 - protein, 28 aa, Mycobacterium
GTEAPAEMHFYFPKFRALCMAENATHNL

SEQ ID NO: 1073601 - protein, 18 aa, Mycobacterium
GTEKNFKWIARSADGWIT

SEQ ID NO: 1073602 - protein, 24 aa, Mycobacterium
GTENLRRIEPLLQTLRAVAIDVDA

SEQ ID NO: 1073603 - protein, 20 aa, Mycobacterium
GTEVTLRFDDGEVVTMHVIA

SEQ ID NO: 1073604 - protein, 18 aa, Mycobacterium
GTFLGMRAAVEPMTAAGS

SEQ ID NO: 1073605 - protein, 24 aa, Mycobacterium
GTFTPRTWVALATEYFLAGHSRVM

SEQ ID NO: 1073606 - protein, 29 aa, Mycobacterium
GTGAAGGAGGLLWGNGGNGGSGAAGQAGG

SEQ ID NO: 1073607 - protein, 23 aa, Mycobacterium
GTGDQLMFRKLFESVIKGHVKVL

SEQ ID NO: 1073608 - protein, 25 aa, Mycobacterium
GTGDVGLIIAVKRLSAAKTRLAPVF

SEQ ID NO: 1073609 - protein, 23 aa, Mycobacterium
GTGGAGGWFYGTGGGGGAGGVSA

SEQ ID NO: 1073610 - protein, 24 aa, Mycobacterium
GTGGHGGWLYGNGGAGGIGGAGGV

SEQ ID NO: 1073611 - protein, 28 aa, Mycobacterium
GTGGNGGILGLGLPPGTAGTGGTGGTLI

SEQ ID NO: 1073612 - protein, 23 aa, Mycobacterium
GTGSNITVPVSLSATVDGGAGGA

SEQ ID NO: 1073613 - protein, 32 aa, Mycobacterium
GTGTLIAAFPRYHPRSAWWMTSVPMLREFLVS

SEQ ID NO: 1073614 - protein, 21 aa, Mycobacterium
GTHGWGYDGVLWYSVHEPYGG

SEQ ID NO: 1073615 - protein, 24 aa, Mycobacterium
GTIAALEMAFFGALVHAGSGKFTY

SEQ ID NO: 1073616 - protein, 17 aa, Mycobacterium
GTIALLSVEDQALVAGF

SEQ ID NO: 1073617 - protein, 45 aa, Mycobacterium
GTIGVISWTPEGFFGRMLATIRPYRPSLSAALPPSALWGREAYAR

SEQ ID NO: 1073618 - protein, 19 aa, Mycobacterium
GTIMFHPTVQPKAPALLIS

SEQ ID NO: 1073619 - protein, 25 aa, Mycobacterium
GTKGRLIDYYLAVGGGPMLTALRDR

SEQ ID NO: 1073620 - protein, 24 aa, Mycobacterium
GTLPPAAGTLIRLFHAETVMCEMD

SEQ ID NO: 1073621 - protein, 31 aa, Mycobacterium
GTLQVWAEPFIPLRVPKIFNLRTDPYERADI

SEQ ID NO: 1073622 - protein, 31 aa, Mycobacterium; identical to SEQ ID NO: 820945

SEQ ID NO: 1073623 - protein, 25 aa, Mycobacterium
GTLTYQMMFELRDFGFTTSIGIGGD

SEQ ID NO: 1073624 - protein, 24 aa, Mycobacterium
GTLYATLTPNKWSDFGPAADIYDP

SEQ ID NO: 1073625 - protein, 18 aa, Mycobacterium
GTMGFAIPAAMGAKIALP

SEQ ID NO: 1073626 - protein, 18 aa, Mycobacterium
GTMRLGAYPAVLESGSIV

SEQ ID NO: 1073627 - protein, 24 aa, Mycobacterium
GTNNIGFFNSGNGNFGVFNAGLSS

SEQ ID NO: 1073628 - protein, 24 aa, Mycobacterium
GTPGQWYLHLFDTEQPDLNWDNPD

SEQ ID NO: 1073629 - protein, 31 aa, Mycobacterium
GTPNFTGRSWPLADVRLLAPILASKVVCVGK

SEQ ID NO: 1073630 - protein, 25 aa, Mycobacterium
GTRDPMVACWPSRIPREGGIRSQFT

SEQ ID NO: 1073631 - protein, 24 aa, Mycobacterium
GTRIRARVPGALAATLREFAASSA

SEQ ID NO: 1073632 - protein, 21 aa, Mycobacterium
GTRLYPITMGISKQLLPVYDK

SEQ ID NO: 1073633 - protein, 27 aa, Mycobacterium
GTRPLATRDLLVLAPYNAQVALIRQRL

SEQ ID NO: 1073634 - protein, 20 aa, Mycobacterium
GTSVPRPFWREAATGQIDAI

SEQ ID NO: 1073635 - protein, 21 aa, Mycobacterium
GTSVRMPLTLNIPAGIPLEPG

SEQ ID NO: 1073636 - protein, 23 aa, Mycobacterium
GTSWAWRPGMARSARIRPGASAR

SEQ ID NO: 1073637 - protein, 23 aa, Mycobacterium
GTTILYDLLAQDPYLRAPLTWEV

SEQ ID NO: 1073638 - protein, 28 aa, Mycobacterium
GTTPIYALPSYFMAAGTPLYAMSSILGM

SEQ ID NO: 1073639 - protein, 23 aa, Mycobacterium
GTVARAFLRQALGVEVLSHVVSI

SEQ ID NO: 1073640 - protein, 23 aa, Mycobacterium
GTVDIAVFPPIPVDDWTLDTLPD

SEQ ID NO: 1073641 - protein, 19 aa, Mycobacterium
GTVEILKWAKSQGISITAE

SEQ ID NO: 1073642 - protein, 20 aa, Mycobacterium
GTVHWLEPPAGPALGLNLGN

SEQ ID NO: 1073643 - protein, 20 aa, Mycobacterium
GTVWLITTAGERIVGSWQAG

SEQ ID NO: 1073644 - protein, 27 aa, Mycobacterium
GTWHGRAPRLWLVTEGGLVVHDKPGRP

SEQ ID NO: 1073645 - protein, 20 aa, Mycobacterium
GTYAINWYAFDPCCPFGGYK

SEQ ID NO: 1073646 - protein, 18 aa, Mycobacterium
GVAARLPEFSKPALIAWS

SEQ ID NO: 1073647 - protein, 23 aa, Mycobacterium
GVAITQFVVSPLFGTPAAADLLR

SEQ ID NO: 1073648 - protein, 20 aa, Mycobacterium
GVALLPIAPELSAILIPLGE

SEQ ID NO: 1073649 - protein, 22 aa, Mycobacterium
GVAPGLLTLLPEQLAEAIGASP

SEQ ID NO: 1073650 - protein, 25 aa, Mycobacterium
GVARGTFYFHFPTKEHVLVELERAE

SEQ ID NO: 1073651 - protein, 27 aa, Mycobacterium
GVAVWISGPQYQAWKHTQLVIDVVPGR

SEQ ID NO: 1073652 - protein, 27 aa, Mycobacterium
GVDFTNIYFYAVLYHALRASNRIAVER

SEQ ID NO: 1073653 - protein, 18 aa, Mycobacterium
GVDGAGCCDLAFAAPDAA

SEQ ID NO: 1073654 - protein, 24 aa, Mycobacterium
GVDGYLAALGRYLQFHEDRRIPIP

SEQ ID NO: 1073655 - protein, 22 aa, Mycobacterium
GVDKLDAALRFIVDYQYSYSGV

SEQ ID NO: 1073656 - protein, 26 aa, Mycobacterium
GVDLDLPRDALIVFTGLSGSGKSSLA

SEQ ID NO: 1073657 - protein, 27 aa, Mycobacterium
GVDRPQQNMWWWDVLRHGRNSEYAGYF

SEQ ID NO: 1073658 - protein, 36 aa, Mycobacterium
GVDTSLLRELNLLTTKPFLYVFNADESVLTGAARVA

SEQ ID NO: 1073659 - protein, 28 aa, Mycobacterium
GVDTVGARLLLLRRLAHPDDTRLGPPLR

SEQ ID NO: 1073660 - protein, 28 aa, Mycobacterium
GVDYMTVHAGVLLRYVPLTAKRVTGIVS

SEQ ID NO: 1073661 - protein, 36 aa, Mycobacterium
GVEEHLLGVLNSPTQALLGRPLIRDGAAGAPGQDGG

SEQ ID NO: 1073662 - protein, 23 aa, Mycobacterium
GVEHTWLGFVDSGLPKGDPPPPL

SEQ ID NO: 1073663 - protein, 21 aa, Mycobacterium
GVEIAEMFQMPPALEQAWHTR

SEQ ID NO: 1073664 - protein, 24 aa, Mycobacterium
GVEIRYYSVIYQAIDEIEKALRGM

SEQ ID NO: 1073665 - protein, 18 aa, Mycobacterium
GVEPPVTLILQGASLHDL

SEQ ID NO: 1073666 - protein, 24 aa, Mycobacterium
GVFHTLRAAIPVMRQQRFGRIVAT

SEQ ID NO: 1073667 - protein, 18 aa, Mycobacterium
GVFITPFHPTGQSPTVAL

SEQ ID NO: 1073668 - protein, 20 aa, Mycobacterium
GVFRPLYAVGGQELGYLPGS

SEQ ID NO: 1073669 - protein, 23 aa, Mycobacterium
GVGGLMLFGVPRDTSKDPVGSAG

SEQ ID NO: 1073670 - protein, 18 aa, Mycobacterium
GVGGTGGWLSGSGGVGGA

SEQ ID NO: 1073671 - protein, 27 aa, Mycobacterium
GVGGTSGLLLGLDGFNAPASTSPLHTF

SEQ ID NO: 1073672 - protein, 19 aa, Mycobacterium
GVGGYFDALSWRPQDTEGQ

SEQ ID NO: 1073673 - protein, 26 aa, Mycobacterium
GVGILAAFEEMFWGDAGIAISIMGTG

SEQ ID NO: 1073674 - protein, 21 aa, Mycobacterium
GVGLGYWRRADLTGTRFVACP

SEQ ID NO: 1073675 - protein, 27 aa, Mycobacterium
GVGMFLQNLMLALTARGLGTCVQVSIA

SEQ ID NO: 1073676 - protein, 26 aa, Mycobacterium
GVGQGRLYFGIGLPELTLPPLDVPGI

SEQ ID NO: 1073677 - protein, 21 aa, Mycobacterium
GVGSWPGILARPAAEVVVGEL

SEQ ID NO: 1073678 - protein, 20 aa, Mycobacterium
GVGTTYNGISGHNGVQGGTG

SEQ ID NO: 1073679 - protein, 23 aa, Mycobacterium
GVGTVPWRLPAVEAALRGRPPDA

SEQ ID NO: 1073680 - protein, 26 aa, Mycobacterium
GVHGLEPGPWRLDTLPLVVSARDWEV

SEQ ID NO: 1073681 - protein, 20 aa, Mycobacterium
GVHIVYDVWTPDAAPKAVVV

SEQ ID NO: 1073682 - protein, 18 aa, Mycobacterium
GVHQAMEYLPWANRLQEG

SEQ ID NO: 1073683 - protein, 27 aa, Mycobacterium
GVIDPYHRVYGYPTMFVVDGAAISANL

SEQ ID NO: 1073684 - protein, 26 aa, Mycobacterium
GVIGKILPAEDMPFLPDGTPVDIILN

SEQ ID NO: 1073685 - protein, 25 aa, Mycobacterium
GVIRTRGRLWLANRPDQVMWLESAG

SEQ ID NO: 1073686 - protein, 17 aa, Mycobacterium
GVKDAFLLIRRGDTQTA

SEQ ID NO: 1073687 - protein, 34 aa, Mycobacterium; identical to SEQ ID NO: 821475

SEQ ID NO: 1073688 - protein, 25 aa, Mycobacterium
GVKQRFVDLLPQLTILDAGGSSESG

SEQ ID NO: 1073689 - protein, 23 aa, Mycobacterium
GVLAALGRIDYWFVTDGRRVHKT

SEQ ID NO: 1073690 - protein, 25 aa, Mycobacterium
GVLARFPDLTLPSLGFTFYGATPDN

SEQ ID NO: 1073691 - protein, 30 aa, Mycobacterium
GVLERGLLLRLRFELDYHINLRPGRLYPGV

SEQ ID NO: 1073692 - protein, 21 aa, Mycobacterium
GVLHGDYLGLLPGPGSEPGES

SEQ ID NO: 1073693 - protein, 18 aa, Mycobacterium
GVLPAADPAIWDHPVDHP

SEQ ID NO: 1073694 - protein, 20 aa, Mycobacterium
GVLRLYQFAEAGDLAFPAIN

SEQ ID NO: 1073695 - protein, 17 aa, Mycobacterium
GVMFSLHVKATMMKVSH

SEQ ID NO: 1073696 - protein, 20 aa, Mycobacterium
GVMNEYWVRHLCGESGASLL

SEQ ID NO: 1073697 - protein, 27 aa, Mycobacterium
GVNFRDVLVVLGMYPGQAPPLGGEGAG

SEQ ID NO: 1073698 - protein, 19 aa, Mycobacterium
GVNLFGFDQLLPEDGRIQA

SEQ ID NO: 1073699 - protein, 25 aa, Mycobacterium
GVNPVDWKMRSSGPLRLAARLIGPK

SEQ ID NO: 1073700 - protein, 27 aa, Mycobacterium
GVPEGSVLVPFAWQGVTLHAAGASAVR

SEQ ID NO: 1073701 - protein, 19 aa, Mycobacterium
GVPIGGFQGIKHALADNYG

SEQ ID NO: 1073702 - protein, 25 aa, Mycobacterium
GVPIHRALVHRLMQSGAPRGATALR

SEQ ID NO: 1073703 - protein, 21 aa, Mycobacterium
GVPISAILFGGRRKTTVPLVT

SEQ ID NO: 1073704 - protein, 24 aa, Mycobacterium
GVPKTLIQHLMRWVISSGQFDEHV

SEQ ID NO: 1073705 - protein, 18 aa, Mycobacterium
GVPLLPSAPAAPLPNWPY

SEQ ID NO: 1073706 - protein, 18 aa, Mycobacterium
GVPRAQRWPLMEAAAALQ

SEQ ID NO: 1073707 - protein, 25 aa, Mycobacterium
GVPRRYFTVMVPVNRGWVRPWLAAS

SEQ ID NO: 1073708 - protein, 23 aa, Mycobacterium
GVQGITDLITTPGLINVDFADVK

SEQ ID NO: 1073709 - protein, 18 aa, Mycobacterium
GVQGWLGAHRVGDVVVLP

SEQ ID NO: 1073710 - protein, 27 aa, Mycobacterium
GVRAVVEPAFWLGQPRTGPSSFIDYFD

SEQ ID NO: 1073711 - protein, 18 aa, Mycobacterium
GVRELLLTHIPPWTSRED

SEQ ID NO: 1073712 - protein, 29 aa, Mycobacterium
GVRIDHIIGLFRLWWIPEGAAPTEGTYVR

SEQ ID NO: 1073713 - protein, 18 aa, Mycobacterium
GVRKFIRGRFAKERTRVI

SEQ ID NO: 1073714 - protein, 23 aa, Mycobacterium
GVRKFIRGRFAKERTRVIAVDAV

SEQ ID NO: 1073715 - protein, 18 aa, Mycobacterium
GVRLVPNVDIPADFNLDS

SEQ ID NO: 1073716 - protein, 27 aa, Mycobacterium
GVRNYPAYFGLLKSKLRTGGLLLNHCI

SEQ ID NO: 1073717 - protein, 27 aa, Mycobacterium
GVRPAKQYRYLLIASPAGAYFKGGINP

SEQ ID NO: 1073718 - protein, 26 aa, Mycobacterium
GVRPARHRFLTRNRLVAALGGAAVVV

SEQ ID NO: 1073719 - protein, 17 aa, Mycobacterium
GVRSDPLGRHLVGSFPK

SEQ ID NO: 1073720 - protein, 22 aa, Mycobacterium
GVRTLPMLYALRQTGSDGARLR

SEQ ID NO: 1073721 - protein, 28 aa, Mycobacterium
GVRVILDDSLVYLALNKPRGMHSTMSDD

SEQ ID NO: 1073722 - protein, 17 aa, Mycobacterium
GVRWLREVAGAETVVLL

SEQ ID NO: 1073723 - protein, 31 aa, Mycobacterium
GVSAIAQQLAPWQQALALPAADADFSLSIFG

SEQ ID NO: 1073724 - protein, 35 aa, Mycobacterium
GVSAVAAQVVPWQSVLKGLPGLASGLAGGAGAGSG

SEQ ID NO: 1073725 - protein, 17 aa, Mycobacterium
GVSGLWLLSGMSDDGVL

SEQ ID NO: 1073726 - protein, 23 aa, Mycobacterium
GVSNYSLARWKKADAALGRPVVS

SEQ ID NO: 1073727 - protein, 26 aa, Mycobacterium
GVSRPTLYRWFASKEELLATFSRYER

SEQ ID NO: 1073728 - protein, 26 aa, Mycobacterium
GVSRRHLEIRWDGQVALLADLNSTNG

SEQ ID NO: 1073729 - protein, 17 aa, Mycobacterium
GVSTELHIFPRACHGFD

SEQ ID NO: 1073730 - protein, 20 aa, Mycobacterium
GVTDLLVHIVARNAEDLYRI

SEQ ID NO: 1073731 - protein, 23 aa, Mycobacterium
GVTRELEWPAMRISHCRPPDSDR

SEQ ID NO: 1073732 - protein, 22 aa, Mycobacterium
GVTVIDPRWVLPVADGIGDLAV

SEQ ID NO: 1073733 - protein, 20 aa, Mycobacterium
GVTVTRLPASPASVASLLAG

SEQ ID NO: 1073734 - protein, 24 aa, Mycobacterium
GVTVVDPRWVLPVPDAVLELAVAH

SEQ ID NO: 1073735 - protein, 27 aa, Mycobacterium
GVTVVSYTWAMLRDVVDNPEFAFHGNH

SEQ ID NO: 1073736 - protein, 25 aa, Mycobacterium
GVTWTQRLISLLVFNGPQLPAPMSR

SEQ ID NO: 1073737 - protein, 21 aa, Mycobacterium
GVVELTYQIGLENMRARMNAA

SEQ ID NO: 1073738 - protein, 32 aa, Mycobacterium; identical to SEQ ID NO: 821829

SEQ ID NO: 1073739 - protein, 24 aa, Mycobacterium
GVVGSRRFFYDVWGDAVNVASRME

SEQ ID NO: 1073740 - protein, 18 aa, Mycobacterium
GVVGVLKGPLRDGVIVPG

SEQ ID NO: 1073741 - protein, 25 aa, Mycobacterium
GVVLIPEMPGIHPGVLALGNHLVDN

SEQ ID NO: 1073742 - protein, 17 aa, Mycobacterium
GVVLLRPASPGTGVLAG

SEQ ID NO: 1073743 - protein, 20 aa, Mycobacterium
GVVPDALSVLVRLLASLHDD

SEQ ID NO: 1073744 - protein, 24 aa, Mycobacterium
GVVRFIGVDGYRWMVRCVVNGPHE

SEQ ID NO: 1073745 - protein, 28 aa, Mycobacterium
GWAPTVQLTAILRALPTDGWLRIVATCV

SEQ ID NO: 1073746 - protein, 25 aa, Mycobacterium
GWDGPGFFGPLSQPLPMSLARHQHW

SEQ ID NO: 1073747 - protein, 21 aa, Mycobacterium
GWDINTPVFNWFDQSGLSVVM

SEQ ID NO: 1073748 - protein, 34 aa, Mycobacterium; identical to SEQ ID NO: 821908

SEQ ID NO: 1073749 - protein, 19 aa, Mycobacterium
GWEIQRVCGEVFGLTVRSR

SEQ ID NO: 1073750 - protein, 18 aa, Mycobacterium
GWELTRVRLYTDGSRRVL

SEQ ID NO: 1073751 - protein, 24 aa, Mycobacterium
GWERPYIAAGIFLYDRLGGAKSVP

SEQ ID NO: 1073752 - protein, 17 aa, Mycobacterium
GWGLWDQASDMTGGMDA

SEQ ID NO: 1073753 - protein, 17 aa, Mycobacterium
GWGLWDQASNMTGGLAA

SEQ ID NO: 1073754 - protein, 17 aa, Mycobacterium
GWITSWIVGPFKGIPGS

SEQ ID NO: 1073755 - protein, 17 aa, Mycobacterium
GWLAANVPIYAVNVLLS

SEQ ID NO: 1073756 - protein, 18 aa, Mycobacterium
GWLEGYLLTGRHGMFDCY

SEQ ID NO: 1073757 - protein, 27 aa, Mycobacterium
GWLSEPLAKMAGYHLGWWDVNGVPVDG

SEQ ID NO: 1073758 - protein, 33 aa, Mycobacterium; identical to SEQ ID NO: 821948

SEQ ID NO: 1073759 - protein, 35 aa, Mycobacterium
GWQSFRVPCLPSDRLLNLLIYIKGYLDGTLTFRRS

SEQ ID NO: 1073760 - protein, 20 aa, Mycobacterium
GWQSFRVPCLPTDRLLNLLI

SEQ ID NO: 1073761 - protein, 18 aa, Mycobacterium
GWSAAIAALGSPTAVLAQ

SEQ ID NO: 1073762 - protein, 19 aa, Mycobacterium
GWSAPTYLRAGRSLPRRDR

SEQ ID NO: 1073763 - protein, 19 aa, Mycobacterium
GWSAVRWRNLTGGIVALHA

SEQ ID NO: 1073764 - protein, 28 aa, Mycobacterium
GWTPTVQLTTYLRRRPAPGWMRVMASST

SEQ ID NO: 1073765 - protein, 20 aa, Mycobacterium
GWVAGLLDRLDHMLSYHEMY

SEQ ID NO: 1073766 - protein, 19 aa, Mycobacterium
GWWAMLGRPAVNPVDFPVA

SEQ ID NO: 1073767 - protein, 27 aa, Mycobacterium
GYADVVILAYAAKFASAFYGPFREAVS

SEQ ID NO: 1073768 - protein, 27 aa, Mycobacterium
GYASMRTLVWRRWPTTGLAAPVQSATE

SEQ ID NO: 1073769 - protein, 25 aa, Mycobacterium
GYDRPVYTLSHDILFMGATGSFFRR

SEQ ID NO: 1073770 - protein, 24 aa, Mycobacterium
GYFHVELMSIRRSATALKYLAASE

SEQ ID NO: 1073771 - protein, 24 aa, Mycobacterium
GYFVNLLPVRADFSPALTLRSLTT

SEQ ID NO: 1073772 - protein, 21 aa, Mycobacterium
GYGARFAGVAFPGETLTVNVW

SEQ ID NO: 1073773 - protein, 36 aa, Mycobacterium
GYGARGWAMNTLFDGIAPLLADLRAAGVRLAVATCK

SEQ ID NO: 1073774 - protein, 23 aa, Mycobacterium
GYGEIAWQTLFTQQLYAVVSTDH

SEQ ID NO: 1073775 - protein, 22 aa, Mycobacterium
GYGGHGGWLYGSGGAGGDGGSG

SEQ ID NO: 1073776 - protein, 21 aa, Mycobacterium
GYGLRLFVYDCADDRRKAAHR

SEQ ID NO: 1073777 - protein, 21 aa, Mycobacterium
GYGRLGGGYFALAVTLEELGK

SEQ ID NO: 1073778 - protein, 26 aa, Mycobacterium
GYGRLGKWFWGFEQQGVVPDIVAIAK

SEQ ID NO: 1073779 - protein, 25 aa, Mycobacterium
GYIDVKGLRLTLTQAAWRVSEDLPA

SEQ ID NO: 1073780 - protein, 26 aa, Mycobacterium
GYIPLLIVASLPNFARRLPMLRGWVA

SEQ ID NO: 1073781 - protein, 25 aa, Mycobacterium
GYIPPNLHFSRWNPAIDASSTRLFV

SEQ ID NO: 1073782 - protein, 20 aa, Mycobacterium
GYLADFYARRRLSGSERALL

SEQ ID NO: 1073783 - protein, 22 aa, Mycobacterium
GYLGLFVTHDGFWKAFAAEAGI

SEQ ID NO: 1073784 - protein, 34 aa, Mycobacterium
GYNGALDIDLVFSSFFNALPIRRLGIHERAEMIT

SEQ ID NO: 1073785 - protein, 19 aa, Mycobacterium
GYNTGFWNAGDINTGMWNS

SEQ ID NO: 1073786 - protein, 17 aa, Mycobacterium
GYNVVIYPVTTLRLAMY

SEQ ID NO: 1073787 - protein, 28 aa, Mycobacterium
GYPHICVPAGYFCGLPVGLSLFAGAFQE

SEQ ID NO: 1073788 - protein, 18 aa, Mycobacterium
GYPYLVMPFCSRGSVQEV

SEQ ID NO: 1073789 - protein, 17 aa, Mycobacterium
GYRNPIVPDPFAESGWF

SEQ ID NO: 1073790 - protein, 20 aa, Mycobacterium
GYRVPCFVISPYSRGPLMVH

SEQ ID NO: 1073791 - protein, 22 aa, Mycobacterium
GYSEQLLLEKWGRDSKILDIFE

SEQ ID NO: 1073792 - protein, 21 aa, Mycobacterium
GYSPMIGGLGYVLAPGPAAYT

SEQ ID NO: 1073793 - protein, 24 aa, Mycobacterium
GYSTRLKILLEPVKPFVALQHIRF

SEQ ID NO: 1073794 - protein, 19 aa, Mycobacterium
GYTALLVAGWRALDTVGPQ

SEQ ID NO: 1073795 - protein, 25 aa, Mycobacterium
GYVDATYWRDMGTPEDFVRGSADLV

SEQ ID NO: 1073796 - protein, 22 aa, Mycobacterium
GYVENWPVARLLRDAQVNTIWE

SEQ ID NO: 1073797 - protein, 20 aa, Mycobacterium
GYVHPALVPLQAIELLDVDL

SEQ ID NO: 1073798 - protein, 30 aa, Mycobacterium; identical to SEQ ID NO: 822171

SEQ ID NO: 1073799 - protein, 18 aa, Mycobacterium
GYVVRWVDQGIGCSKVPD

SEQ ID NO: 1073800 - protein, 18 aa, Mycobacterium
GYVWHAYLPNISPGQRYG

SEQ ID NO: 1073801 - protein, 24 aa, Mycobacterium
GYVYVAPFITISFTSGVFSSGAFT

SEQ ID NO: 1073802 - protein, 20 aa, Mycobacterium
GYWSEHLRDAPLAIDLPRDF

SEQ ID NO: 1073803 - protein, 22 aa, Mycobacterium
GYYFESPSGRWRCAILPHVQAG

SEQ ID NO: 1073804 - protein, 24 aa, Mycobacterium
GYYQIRGGIPYAIAKSLAAAPFAD

SEQ ID NO: 1073805 - protein, 24 aa, Mycobacterium
HAADGRWYGRRWRGRDPQRQRARQ

SEQ ID NO: 1073806 - protein, 18 aa, Mycobacterium
HAAGFTDGATGAGGDGGQ

SEQ ID NO: 1073807 - protein, 18 aa, Mycobacterium
HAAGLWTAFSGFLSGFPV

SEQ ID NO: 1073808 - protein, 36 aa, Mycobacterium; identical to SEQ ID NO: 822207

SEQ ID NO: 1073809 - protein, 25 aa, Mycobacterium
HAAKGLEWHAVFLVGLADGTLPISH

SEQ ID NO: 1073810 - protein, 25 aa, Mycobacterium
HAALRLHKPVIRYDLPAGGRRLDQT

SEQ ID NO: 1073811 - protein, 24 aa, Mycobacterium
HAAPRLKLFVGLGSRFCGAAAGIN

SEQ ID NO: 1073812 - protein, 28 aa, Mycobacterium
HAARWVVRVVLSLMYWPAESEDVERLMV

SEQ ID NO: 1073813 - protein, 22 aa, Mycobacterium
HAAYIDYPASLLTWSEFDCAAT

SEQ ID NO: 1073814 - protein, 23 aa, Mycobacterium
HADAIDFHRWLQWQLDEQLAAAQ

SEQ ID NO: 1073815 - protein, 24 aa, Mycobacterium
HAEARIIDEYLPTPLTEAELADVV

SEQ ID NO: 1073816 - protein, 23 aa, Mycobacterium
HAEGWSHYLDRLVAAALQGDAGP

SEQ ID NO: 1073817 - protein, 18 aa, Mycobacterium
HAELADRLNVALAALREE

SEQ ID NO: 1073818 - protein, 23 aa, Mycobacterium
HAERFLTELPGLRLIGLDRDPSA

SEQ ID NO: 1073819 - protein, 17 aa, Mycobacterium
HAFALLQDDVMDQSPQR

SEQ ID NO: 1073820 - protein, 19 aa, Mycobacterium
HAFHSPLMEPMLEEFVRVA

SEQ ID NO: 1073821 - protein, 25 aa, Mycobacterium
HAGAQTILPAPAPLGGALVEETALI

SEQ ID NO: 1073822 - protein, 20 aa, Mycobacterium
HAHDWLVAHPAITLAQFYDV

SEQ ID NO: 1073823 - protein, 29 aa, Mycobacterium
HAHEDHIGAIPFLLKLRSDIPVVGSKFTL

SEQ ID NO: 1073824 - protein, 30 aa, Mycobacterium
HAHEDHIGAIPFLLKLRSDIPVVGSKFTLA

SEQ ID NO: 1073825 - protein, 18 aa, Mycobacterium
HAHELRQTVLALLADHNL

SEQ ID NO: 1073826 - protein, 21 aa, Mycobacterium
HAHLRYLNPFPANLGEVLRRY

SEQ ID NO: 1073827 - protein, 25 aa, Mycobacterium
HAHSTLNPLAAYQKRFTLEQIMNDV

SEQ ID NO: 1073828 - protein, 19 aa, Mycobacterium
HAIATAESWGPLFAEARRA

SEQ ID NO: 1073829 - protein, 17 aa, Mycobacterium
HAIGLLDRLGEGARFVA

SEQ ID NO: 1073830 - protein, 17 aa, Mycobacterium
HALAYQAIGAQAATFHD

SEQ ID NO: 1073831 - protein, 19 aa, Mycobacterium
HALNPAAELYFITGADALA

SEQ ID NO: 1073832 - protein, 17 aa, Mycobacterium
HALNPHIVLAGSSAFGN

SEQ ID NO: 1073833 - protein, 24 aa, Mycobacterium
HALVACFSGAVPDGWRVIGRVLDG

SEQ ID NO: 1073834 - protein, 23 aa, Mycobacterium
HAMALLLAAARQIPAADASLREH

SEQ ID NO: 1073835 - protein, 18 aa, Mycobacterium
HANLLFEGFAIEEVFGIQ

SEQ ID NO: 1073836 - protein, 22 aa, Mycobacterium
HAQLATYKLAVAESMFPADPSA

SEQ ID NO: 1073837 - protein, 18 aa, Mycobacterium
HAQMYQAVSAQAAVIHEM

SEQ ID NO: 1073838 - protein, 25 aa, Mycobacterium
HAQRPGDPTLRRLLPDFYKPGETDP

SEQ ID NO: 1073839 - protein, 34 aa, Mycobacterium; identical to SEQ ID NO: 822437

SEQ ID NO: 1073840 - protein, 34 aa, Mycobacterium
HARLMRKTFMSNPILCDLILIRSALSPKTARLGA

SEQ ID NO: 1073841 - protein, 24 aa, Mycobacterium
HARRDVHMYPYSARRTRILGRLVG

SEQ ID NO: 1073842 - protein, 17 aa, Mycobacterium
HASALIMLRLSRKSDEH

SEQ ID NO: 1073843 - protein, 21 aa, Mycobacterium
HASHGYVRYHDVRVPADHVLG

SEQ ID NO: 1073844 - protein, 25 aa, Mycobacterium
HATGRPLPPVIAAAFRKAIGGTVHE

SEQ ID NO: 1073845 - protein, 26 aa, Mycobacterium
HAVGDHPHLVLAGYSSGGVLAHALGS

SEQ ID NO: 1073846 - protein, 24 aa, Mycobacterium
HAVHRKLLVRHLAARRIRSLERFV

SEQ ID NO: 1073847 - protein, 31 aa, Mycobacterium
HAYAGELLFLYNGVRPRQVMPVHGTWRMLRA

SEQ ID NO: 1073848 - protein, 43 aa, Mycobacterium
HAYAGELLFLYNGVRPRQVMPVHGTWRMLRANAKLAASTGVPE

SEQ ID NO: 1073849 - protein, 19 aa, Mycobacterium
HCSAFHPLGVGSPFWNEID

SEQ ID NO: 1073850 - protein, 23 aa, Mycobacterium
HCYPRFPVFLEEVKRVLRPGGYF

SEQ ID NO: 1073851 - protein, 44 aa, Mycobacterium
HDADFVIEPLPNLLFTRDSSIWIGPRFVIPSLAMRARVREASLT

SEQ ID NO: 1073852 - protein, 23 aa, Mycobacterium
HDDVFMIMNDGWLGAAKPRKIIE

SEQ ID NO: 1073853 - protein, 31 aa, Mycobacterium
HDELRPLKALASRMPCPYLNPGRYVCDRPLV

SEQ ID NO: 1073854 - protein, 29 aa, Mycobacterium
HDELRRRGENIGLTTVYRTLQSMASAGTV

SEQ ID NO: 1073855 - protein, 25 aa, Mycobacterium
HDELVLIKEIPLYSTCEHHLVSFHG

SEQ ID NO: 1073856 - protein, 18 aa, Mycobacterium
HDFDYALVCADGDWRRAD

SEQ ID NO: 1073857 - protein, 35 aa, Mycobacterium; identical to SEQ ID NO: 822586

SEQ ID NO: 1073858 - protein, 18 aa, Mycobacterium
HDGPMGRYPVLFLDPDFN

SEQ ID NO: 1073859 - protein, 18 aa, Mycobacterium
HDKKLWHRLCAELELPAL

SEQ ID NO: 1073860 - protein, 21 aa, Mycobacterium
HDLLDVCTLADRVLILEAGRI

SEQ ID NO: 1073861 - protein, 18 aa, Mycobacterium
HDLRHVVHPVRTACAAGA

SEQ ID NO: 1073862 - protein, 26 aa, Mycobacterium
HDLVEFLLRVLLSFFVAPNVPSRSDD

SEQ ID NO: 1073863 - protein, 17 aa, Mycobacterium
HDPDLPPSHHYLAAYHW

SEQ ID NO: 1073864 - protein, 19 aa, Mycobacterium
HDPKHEPVFSEYLELNLSD

SEQ ID NO: 1073865 - protein, 29 aa, Mycobacterium
HDQASVWALHQYLVGLRRRYPWLHTASTS

SEQ ID NO: 1073866 - protein, 18 aa, Mycobacterium
HDQTLRLLNQGYTGIEIA

SEQ ID NO: 1073867 - protein, 18 aa, Mycobacterium
HDRFACVDGKWRFSYRDL

SEQ ID NO: 1073868 - protein, 30 aa, Mycobacterium; identical to SEQ ID NO: 822675

SEQ ID NO: 1073869 - protein, 25 aa, Mycobacterium
HDTTHPLFFNIPTPGPAPADTEESA

SEQ ID NO: 1073870 - protein, 26 aa, Mycobacterium
HDVEFFNEFYALDLALTETPSGPVAT

SEQ ID NO: 1073871 - protein, 20 aa, Mycobacterium
HDYVALCRLIDERELPEAYE

SEQ ID NO: 1073872 - protein, 26 aa, Mycobacterium
HEAAQPLYARYWLHNRGPAPLGGLPA

SEQ ID NO: 1073873 - protein, 29 aa, Mycobacterium
HEATADLDLDWWLTFSSVASLLGAPGQGS

SEQ ID NO: 1073874 - protein, 27 aa, Mycobacterium
HEDPGEFLSPKWQKIWKPVVCAVQGMC

SEQ ID NO: 1073875 - protein, 24 aa, Mycobacterium
HEGIGWLAQRGYVPLGYKGDAAKT

SEQ ID NO: 1073876 - protein, 26 aa, Mycobacterium
HELRAFCARLLGIAAQRVRVIMRDTG

SEQ ID NO: 1073877 - protein, 20 aa, Mycobacterium
HELRRIAALCAAFDVDGMRA

SEQ ID NO: 1073878 - protein, 18 aa, Mycobacterium
HEMTFSMLYAFSENYVLP

SEQ ID NO: 1073879 - protein, 28 aa, Mycobacterium
HEPDAPESLPLLVFPHAGAGASAYREFS

SEQ ID NO: 1073880 - protein, 18 aa, Mycobacterium
HEPFVTLGLHIGARTTSI

SEQ ID NO: 1073881 - protein, 20 aa, Mycobacterium
HEQIFHWTNVILGFGDPDLT

SEQ ID NO: 1073882 - protein, 17 aa, Mycobacterium
HEREAVLRLLRDGLPTV

SEQ ID NO: 1073883 - protein, 17 aa, Mycobacterium
HERHPYGGDLVYTAFSG

SEQ ID NO: 1073884 - protein, 19 aa, Mycobacterium
HERHPYGGDLVYTAFSGSH

SEQ ID NO: 1073885 - protein, 23 aa, Mycobacterium
HERLRLIEIELDQCWDLLRQRRA

SEQ ID NO: 1073886 - protein, 25 aa, Mycobacterium
HERQHYRLVGWRRGLCGYRRFFSIT

SEQ ID NO: 1073887 - protein, 26 aa, Mycobacterium
HERQVDRWLHFLAAYQVRELPGLDAA

SEQ ID NO: 1073888 - protein, 17 aa, Mycobacterium
HESIRELQYYRRTAFVP

SEQ ID NO: 1073889 - protein, 17 aa, Mycobacterium
HETAYRDMLGALDQARA

SEQ ID NO: 1073890 - protein, 28 aa, Mycobacterium
HETGHLDGYLYLDCLIGRHARSAKRAVK

SEQ ID NO: 1073891 - protein, 24 aa, Mycobacterium
HEVGLAILGPLRELDEVAYLRFAS

SEQ ID NO: 1073892 - protein, 25 aa, Mycobacterium
HEVGWSMLPVAGSVLRRIGDTTDIV

SEQ ID NO: 1073893 - protein, 26 aa, Mycobacterium
HEVIPYTNKPLFLRTIIPSSNTVSTA

SEQ ID NO: 1073894 - protein, 17 aa, Mycobacterium
HEWFQSRDGYEGCSFIN

SEQ ID NO: 1073895 - protein, 18 aa, Mycobacterium
HEWGLEYLFGVLEAGKKG

SEQ ID NO: 1073896 - protein, 17 aa, Mycobacterium
HFAGLVAAGLHPSPVPH

SEQ ID NO: 1073897 - protein, 17 aa, Mycobacterium
HFAVAILRDPGGPVPAN

SEQ ID NO: 1073898 - protein, 26 aa, Mycobacterium
HFDEHLTLNGLRLVFERNREAQRGRL

SEQ ID NO: 1073899 - protein, 26 aa, Mycobacterium
HFDNQSMHLALEAIWLMLGHANKYFS

SEQ ID NO: 1073900 - protein, 22 aa, Mycobacterium
HFDRQIAWLRQMADLCSTMASQ

SEQ ID NO: 1073901 - protein, 26 aa, Mycobacterium
HFDTAIYAYRKGWLKKINVISSSMVF

SEQ ID NO: 1073902 - protein, 30 aa, Mycobacterium
HFEKMLYDNALLLRAYAHWARRTGDELACR

SEQ ID NO: 1073903 - protein, 28 aa, Mycobacterium
HFFVCSTHDWILFFTTQGRVYRAKAYEL

SEQ ID NO: 1073904 - protein, 19 aa, Mycobacterium
HFGPHYNPWDQRLCLVPNG

SEQ ID NO: 1073905 - protein, 27 aa, Mycobacterium
HFPQSFGFSSLGGWLATRAAGGHFATL

SEQ ID NO: 1073906 - protein, 21 aa, Mycobacterium
HFSRHFGVFREAQAGAGVVFD

SEQ ID NO: 1073907 - protein, 22 aa, Mycobacterium
HGAAQWAAFISLCGGRPFVMPQ

SEQ ID NO: 1073908 - protein, 30 aa, Mycobacterium
HGAFIVGAVFGKLPFLMNGIKLEVVGVDDA

SEQ ID NO: 1073909 - protein, 27 aa, Mycobacterium
HGALAERALMPVLPSVEEFPYAIRQVS

SEQ ID NO: 1073910 - protein, 27 aa, Mycobacterium
HGANLHDALLALLPLVGVWRGEGEGRG

SEQ ID NO: 1073911 - protein, 24 aa, Mycobacterium
HGCEPWEELAVKLMLKWPNLYYST

SEQ ID NO: 1073912 - protein, 24 aa, Mycobacterium
HGDATLLWPPPEPGGYSLIVDGRA

SEQ ID NO: 1073913 - protein, 24 aa, Mycobacterium
HGDIPLGIYCRASLAQYMDAERLF

SEQ ID NO: 1073914 - protein, 26 aa, Mycobacterium
HGDSRGMFFEWLTDSGFTAFCGHRFD

SEQ ID NO: 1073915 - protein, 50 aa, Mycobacterium
HGEAYRGHIFWDELFIFPVLNLRLPAVTRSLLLYRYRRLLEAQRAAKLAG

SEQ ID NO: 1073916 - protein, 30 aa, Mycobacterium
HGEFDFNLQWKPLGGFPVTAGWFSAIRRGQ

SEQ ID NO: 1073917 - protein, 17 aa, Mycobacterium
HGELLTLRPFGTADGVV

SEQ ID NO: 1073918 - protein, 22 aa, Mycobacterium
HGEPFLSAWTPVAQPQTIMVPA

SEQ ID NO: 1073919 - protein, 19 aa, Mycobacterium
HGFEVRLLPTLDDGRLALD

SEQ ID NO: 1073920 - protein, 17 aa, Mycobacterium
HGGLLYGNGGAGGIGGD

SEQ ID NO: 1073921 - protein, 22 aa, Mycobacterium
HGGMGWIYLALDRNVNDRPVVL

SEQ ID NO: 1073922 - protein, 17 aa, Mycobacterium
HGGTYFGSGGAGGHGGY

SEQ ID NO: 1073923 - protein, 20 aa, Mycobacterium
HGLDRIFLVAPSSTPERLAN

SEQ ID NO: 1073924 - protein, 25 aa, Mycobacterium
HGLGADLLAVVARLNRLATQRIQMP

SEQ ID NO: 1073925 - protein, 18 aa, Mycobacterium
HGLPGRCDERPRRVFAAK

SEQ ID NO: 1073926 - protein, 25 aa, Mycobacterium
HGLVDAPIQYGLLENARRAATGLGP

SEQ ID NO: 1073927 - protein, 17 aa, Mycobacterium
HGNAYQTLGAQTLALHE

SEQ ID NO: 1073928 - protein, 25 aa, Mycobacterium
HGNSVPRFHIAWGTGTGVVEPFVDS

SEQ ID NO: 1073929 - protein, 26 aa, Mycobacterium
HGPARLPLSGGFRRALQPAPISGAHP

SEQ ID NO: 1073930 - protein, 17 aa, Mycobacterium
HGPQLRAIDERHGGSII

SEQ ID NO: 1073931 - protein, 27 aa, Mycobacterium
HGQIPPNLHFSQWNPAIDAASTRLFVP

SEQ ID NO: 1073932 - protein, 21 aa, Mycobacterium
HGQLMTLYPSMSSEDAWAMIK

SEQ ID NO: 1073933 - protein, 23 aa, Mycobacterium
HGQLVGRAVDLVQLFPAASYGKN

SEQ ID NO: 1073934 - protein, 28 aa, Mycobacterium
HGQQILGRFLHDFAGIGARWTPANIANA

SEQ ID NO: 1073935 - protein, 18 aa, Mycobacterium
HGRGPLSDLLVQALRCSG

SEQ ID NO: 1073936 - protein, 26 aa, Mycobacterium
HGRNTVLWCGYTWQYWLATRSVKPEE

SEQ ID NO: 1073937 - protein, 25 aa, Mycobacterium
HGRSGFLLAPWTAEQIMFELAAVGA

SEQ ID NO: 1073938 - protein, 25 aa, Mycobacterium
HGTILALHHPPIPSVLDLAVTVELR

SEQ ID NO: 1073939 - protein, 23 aa, Mycobacterium
HGTNLWAGTAYRAAQAGPAADIV

SEQ ID NO: 1073940 - protein, 26 aa, Mycobacterium
HGTRNRALGLLYRWVEQAFGGREHDL

SEQ ID NO: 1073941 - protein, 25 aa, Mycobacterium
HGTVMLRMPLHPVAIELLRQVGPMA

SEQ ID NO: 1073942 - protein, 19 aa, Mycobacterium
HGVIGPERLLSGFGTIGIL

SEQ ID NO: 1073943 - protein, 18 aa, Mycobacterium
HGVRVLVIRPGQVRTRMS

SEQ ID NO: 1073944 - protein, 17 aa, Mycobacterium
HGWGFHEDGAASGLRAA

SEQ ID NO: 1073945 - protein, 20 aa, Mycobacterium
HGWHVPPVAAPPLERVRDAI

SEQ ID NO: 1073946 - protein, 18 aa, Mycobacterium
HHCELLAIPNNQSHVRAG

SEQ ID NO: 1073947 - protein, 27 aa, Mycobacterium
HHDLAEATDWMLLAAIDALIDGNRTAA

SEQ ID NO: 1073948 - protein, 24 aa, Mycobacterium
HHDRPRRVRKPGEPLRIGVGGPVG

SEQ ID NO: 1073949 - protein, 29 aa, Mycobacterium
HHDSAICQIAIILFIRIATCWRTDQHNIF

SEQ ID NO: 1073950 - protein, 30 aa, Mycobacterium
HHDSAICQIAIILFIRIATCWRTDQHNIFR

SEQ ID NO: 1073951 - protein, 24 aa, Mycobacterium
HHEQYVPKIIDLQLRGCFAMTETG

SEQ ID NO: 1073952 - protein, 20 aa, Mycobacterium
HHFAMFWDRRRQPNVAMFHY

SEQ ID NO: 1073953 - protein, 19 aa, Mycobacterium
HHGDLRSELTRRLTEVHGV

SEQ ID NO: 1073954 - protein, 23 aa, Mycobacterium
HHGVAHLVLISRRGPAAPGATEL

SEQ ID NO: 1073955 - protein, 31 aa, Mycobacterium; identical to SEQ ID NO: 823255

SEQ ID NO: 1073956 - protein, 24 aa, Mycobacterium
HHRPSGRRLLIQGSAGFVAGALDG

SEQ ID NO: 1073957 - protein, 17 aa, Mycobacterium
HHRWLNDTSITPPGGES

SEQ ID NO: 1073958 - protein, 22 aa, Mycobacterium
HHRYHPDIPTPYIIALVELSEQ

SEQ ID NO: 1073959 - protein, 17 aa, Mycobacterium
HHRYRIAPPVIATQARV

SEQ ID NO: 1073960 - protein, 19 aa, Mycobacterium
HHVEWTNYLTPQALIDLVA

SEQ ID NO: 1073961 - protein, 18 aa, Mycobacterium
HHVFWTVHARNKRAITLD

SEQ ID NO: 1073962 - protein, 18 aa, Mycobacterium
HHVKATIKILGLVDKEIL

SEQ ID NO: 1073963 - protein, 24 aa, Mycobacterium
HIASRNLPIRAGWVHLPCLPMVAA

SEQ ID NO: 1073964 - protein, 19 aa, Mycobacterium
HIELPIFEDTALFARGVGE

SEQ ID NO: 1073965 - protein, 27 aa, Mycobacterium
HIGKVILTMLTLFPDALATGTVLITGG

SEQ ID NO: 1073966 - protein, 17 aa, Mycobacterium
HIGLSPFDQSRCAERVN

SEQ ID NO: 1073967 - protein, 25 aa, Mycobacterium
HIGPSDHVAWLDDRKWAYVRLEGRA

SEQ ID NO: 1073968 - protein, 27 aa, Mycobacterium
HIKDAQTPTLLFPFAAPRVVGDLSEAG

SEQ ID NO: 1073969 - protein, 27 aa, Mycobacterium
HILEVQRLIRFMPKVVICLVNGWAAGG

SEQ ID NO: 1073970 - protein, 18 aa, Mycobacterium
HINISDTAFKWCLPLGIL

SEQ ID NO: 1073971 - protein, 19 aa, Mycobacterium
HIRPYTWPYPEISTAAMIS

SEQ ID NO: 1073972 - protein, 19 aa, Mycobacterium
HISRTLTNAVLRQAGTAPP

SEQ ID NO: 1073973 - protein, 23 aa, Mycobacterium
HITPADFLNDPLLWAELITKHRG

SEQ ID NO: 1073974 - protein, 20 aa, Mycobacterium
HIVAAKYPINVALHTDHCPK

SEQ ID NO: 1073975 - protein, 19 aa, Mycobacterium
HKIWATQSGFTFPVLSDFW

SEQ ID NO: 1073976 - protein, 24 aa, Mycobacterium
HKTVHHYLMRFLGGELSDNDLEVT

SEQ ID NO: 1073977 - protein, 26 aa, Mycobacterium
HKVKSRTFHYPGGLVDFVKHINRTKS

SEQ ID NO: 1073978 - protein, 20 aa, Mycobacterium
HKVPRRLLKAARLGLIDLDR

SEQ ID NO: 1073979 - protein, 17 aa, Mycobacterium
HLAALIATNLLGQNSPA

SEQ ID NO: 1073980 - protein, 24 aa, Mycobacterium
HLAALLYGIPHVLTAHSLEPMRPW

SEQ ID NO: 1073981 - protein, 23 aa, Mycobacterium
HLAELREGVWIRPDNLDPQRLPI

SEQ ID NO: 1073982 - protein, 17 aa, Mycobacterium
HLAFIKLGSRAESAQVN

SEQ ID NO: 1073983 - protein, 25 aa, Mycobacterium
HLAKAMDRKVWLPSGGTLVIDRTEA

SEQ ID NO: 1073984 - protein, 18 aa, Mycobacterium
HLAKLRLQPAYEQVLEKG

SEQ ID NO: 1073985 - protein, 17 aa, Mycobacterium
HLARDPLDPLFDVDSVI

SEQ ID NO: 1073986 - protein, 28 aa, Mycobacterium
HLATMHPSRYLTLIDGVSAVFLTGVHPI

SEQ ID NO: 1073987 - protein, 17 aa, Mycobacterium
HLDWYADGMFPPMQIDA

SEQ ID NO: 1073988 - protein, 24 aa, Mycobacterium
HLEALGPAMRRALTTAGIVRPDVV

SEQ ID NO: 1073989 - protein, 18 aa, Mycobacterium
HLELGESLGLIDMARGAK

SEQ ID NO: 1073990 - protein, 20 aa, Mycobacterium
HLFHHYAGGPVVHVHLGLYG

SEQ ID NO: 1073991 - protein, 26 aa, Mycobacterium
HLGDLARYLIAIRRRLDRLPHAVAAD

SEQ ID NO: 1073992 - protein, 17 aa, Mycobacterium
HLGMFIKPLVKSGHRVI

SEQ ID NO: 1073993 - protein, 17 aa, Mycobacterium
HLGPSGNYLPRFGPYLS

SEQ ID NO: 1073994 - protein, 27 aa, Mycobacterium
HLGVGVTSIYWYFRKKDDLLNAMTDRA

SEQ ID NO: 1073995 - protein, 28 aa, Mycobacterium
HLHQGIALQVPPYNYAHPDDLLAAALDT

SEQ ID NO: 1073996 - protein, 17 aa, Mycobacterium
HLIAMGPNIRFLSGDYW

SEQ ID NO: 1073997 - protein, 25 aa, Mycobacterium
HLKGTWNGIRLAAAIMRENKRGAIV

SEQ ID NO: 1073998 - protein, 19 aa, Mycobacterium
HLLAAAHQFSPDVQLVLCA

SEQ ID NO: 1073999 - protein, 37 aa, Mycobacterium
HLLGVRLVKLLYRLERPLFFAFQCLPLNWVRRKHGLP

SEQ ID NO: 1074000 - protein, 22 aa, Mycobacterium
HLPCLPMVAALDRNLGVPSMSV

SEQ ID NO: 1074001 - protein, 25 aa, Mycobacterium
HLPEGLGIIGLLIDEPKPLRLEDIS

SEQ ID NO: 1074002 - protein, 33 aa, Mycobacterium
HLPQWARRWQRLLFDNGWLLPGQSPEFGGRNAT

SEQ ID NO: 1074003 - protein, 32 aa, Mycobacterium
HLQVASLDHAMWFMRGFRADEWLLYDQSSPSA

SEQ ID NO: 1074004 - protein, 17 aa, Mycobacterium
HLRFLLEAVGPELRQYI

SEQ ID NO: 1074005 - protein, 19 aa, Mycobacterium
HLRLAGADYWFCCPACRTA

SEQ ID NO: 1074006 - protein, 22 aa, Mycobacterium
HLRRRKLLTPPLHGTALGRYVP

SEQ ID NO: 1074007 - protein, 17 aa, Mycobacterium
HLRVHPGADAWCVAALA

SEQ ID NO: 1074008 - protein, 19 aa, Mycobacterium
HLSAALRRDDLSYHAELDW

SEQ ID NO: 1074009 - protein, 26 aa, Mycobacterium
HLSRLQVINWGVFDGYHSIPFSVGGA

SEQ ID NO: 1074010 - protein, 26 aa, Mycobacterium
HLTDWAQLLEGCGFDRVLVSEHIAFG

SEQ ID NO: 1074011 - protein, 19 aa, Mycobacterium
HLTGTDRGLLYLPDDPLDS

SEQ ID NO: 1074012 - protein, 20 aa, Mycobacterium
HLVKSFYRRPLSVGDASGAA

SEQ ID NO: 1074013 - protein, 22 aa, Mycobacterium
HLVPNTGLRRILSRELEFTNLE

SEQ ID NO: 1074014 - protein, 27 aa, Mycobacterium
HLVPSMLSTLLLLPQVQQWRQLRHVPV

SEQ ID NO: 1074015 - protein, 23 aa, Mycobacterium
HLVRGRFVLAGVTPAVLAKLLGD

SEQ ID NO: 1074016 - protein, 30 aa, Mycobacterium
HLVVSYRIEALPRIQLWPLTADGDYGEVED

SEQ ID NO: 1074017 - protein, 26 aa, Mycobacterium
HMLSRLFRLPLNWRTLCTRSVRQCTP

SEQ ID NO: 1074018 - protein, 18 aa, Mycobacterium
HMNEGHAGFLGAERIREL

SEQ ID NO: 1074019 - protein, 23 aa, Mycobacterium
HNAGRTLVRTLDSLAAFSDDIYV

SEQ ID NO: 1074020 - protein, 18 aa, Mycobacterium
HNDRMTLFVALNYGGRQE

SEQ ID NO: 1074021 - protein, 26 aa, Mycobacterium
HNGQPTQVILPPGPIPLQQVDLRDLP

SEQ ID NO: 1074022 - protein, 18 aa, Mycobacterium
HNLIVTARRESLLNELAA

SEQ ID NO: 1074023 - protein, 22 aa, Mycobacterium
HNLRGLDVAFPLGVLTSVTGVS

SEQ ID NO: 1074024 - protein, 18 aa, Mycobacterium
HNMLPQNLADLSRPGRGA

SEQ ID NO: 1074025 - protein, 26 aa, Mycobacterium
HNRGLPIITFGHSMGALVAFEFVRLA

SEQ ID NO: 1074026 - protein, 25 aa, Mycobacterium
HNRRMPYTIGLLGSVPRLDATQGTR

SEQ ID NO: 1074027 - protein, 18 aa, Mycobacterium
HNVNFDQRFLLAELRRAG

SEQ ID NO: 1074028 - protein, 20 aa, Mycobacterium
HNWHQMRRLPRPHAVDAATP

SEQ ID NO: 1074029 - protein, 30 aa, Mycobacterium
HNYGLTLWQNRIERILAEWVAELRVRIYRG

SEQ ID NO: 1074030 - protein, 18 aa, Mycobacterium
HNYPIIKHAAFPVSAPDG

SEQ ID NO: 1074031 - protein, 19 aa, Mycobacterium
HPAPDWTAAALAKAAAADA

SEQ ID NO: 1074032 - protein, 18 aa, Mycobacterium
HPAWTLEEAVVEGAQSGA

SEQ ID NO: 1074033 - protein, 26 aa, Mycobacterium
HPCTGLDPKPWFRLQSKSGGQQVGSG

SEQ ID NO: 1074034 - protein, 24 aa, Mycobacterium
HPCYVPAQLFPTADGYLGLFVTHD

SEQ ID NO: 1074035 - protein, 24 aa, Mycobacterium
HPDIDIRWRTVTFALVTHSAGGIT

SEQ ID NO: 1074036 - protein, 17 aa, Mycobacterium
HPDLPALTYVEVATGPM

SEQ ID NO: 1074037 - protein, 19 aa, Mycobacterium
HPFLQHLLAHRDVTRLKVT

SEQ ID NO: 1074038 - protein, 18 aa, Mycobacterium
HPGGSRPYLPLATLVVRG

SEQ ID NO: 1074039 - protein, 22 aa, Mycobacterium
HPGHRLIPAPPKPSLPARIQIG

SEQ ID NO: 1074040 - protein, 26 aa, Mycobacterium
HPGIVAPPAMIQVWTMMGLSGVRADD

SEQ ID NO: 1074041 - protein, 20 aa, Mycobacterium
HPGNWYFRSSGGPLAAGLLD

SEQ ID NO: 1074042 - protein, 23 aa, Mycobacterium
HPGQPLWGHGWDESAWPQHIAPS

SEQ ID NO: 1074043 - protein, 25 aa, Mycobacterium
HPHSLQLIMDSLRYWVTEMHVDGFR

SEQ ID NO: 1074044 - protein, 23 aa, Mycobacterium
HPITVWWSEIARVLRPGGTYLAQ

SEQ ID NO: 1074045 - protein, 20 aa, Mycobacterium
HPLPESLVGDAARFLLEGMP

SEQ ID NO: 1074046 - protein, 18 aa, Mycobacterium
HPPFRWQRRYAEGFSDEV

SEQ ID NO: 1074047 - protein, 20 aa, Mycobacterium
HPQIPTTPWHHTHHWIDTPA

SEQ ID NO: 1074048 - protein, 20 aa, Mycobacterium
HPQPGAEPLWRATPPNPATD

SEQ ID NO: 1074049 - protein, 18 aa, Mycobacterium
HPSGHILVRSCRGGYMHS

SEQ ID NO: 1074050 - protein, 19 aa, Mycobacterium
HPSNLKCLCRKHHLLKTFW

SEQ ID NO: 1074051 - protein, 19 aa, Mycobacterium
HPTDVTSPWLPAVLGERGT

SEQ ID NO: 1074052 - protein, 17 aa, Mycobacterium
HPTLGDRVIIGAGAKIL

SEQ ID NO: 1074053 - protein, 21 aa, Mycobacterium
HPTLRLTTNLRIGLEGREARA

SEQ ID NO: 1074054 - protein, 24 aa, Mycobacterium
HPVHRYFLAAKEAEFALGGATTAL

SEQ ID NO: 1074055 - protein, 22 aa, Mycobacterium
HPVLLESYLDGPEVSLFCVIDG

SEQ ID NO: 1074056 - protein, 19 aa, Mycobacterium
HPVVHYLHRPVPRNELIAF

SEQ ID NO: 1074057 - protein, 32 aa, Mycobacterium
HPWERDWSYGWSLMRIGALLRRSDMSLLDQWY

SEQ ID NO: 1074058 - protein, 23 aa, Mycobacterium
HQERGHCLAQLGAALQDYADAYF

SEQ ID NO: 1074059 - protein, 23 aa, Mycobacterium
HQGLHMWLAEFPQPRPPRETWET

SEQ ID NO: 1074060 - protein, 31 aa, Mycobacterium
HQKVRLGGSPWFAVSPLMHAAGLWTAFSGFL

SEQ ID NO: 1074061 - protein, 18 aa, Mycobacterium
HQLDWLHRLRREMPNLQE

SEQ ID NO: 1074062 - protein, 17 aa, Mycobacterium
HQNRITFAAVQRARSAA

SEQ ID NO: 1074063 - protein, 24 aa, Mycobacterium
HQNSRWIIEPVLRLLDCCQESDGG

SEQ ID NO: 1074064 - protein, 17 aa, Mycobacterium
HQPCDLGRAGLPEEVAS

SEQ ID NO: 1074065 - protein, 17 aa, Mycobacterium
HQPPDPAALALPAARVS

SEQ ID NO: 1074066 - protein, 22 aa, Mycobacterium
HQPWPGVIAAYRDRLPVGDDWT

SEQ ID NO: 1074067 - protein, 17 aa, Mycobacterium
HQRLGRRQADPLVSIEQ

SEQ ID NO: 1074068 - protein, 26 aa, Mycobacterium
HQRRAGLRRWRRWRRRGRQGATHQRR

SEQ ID NO: 1074069 - protein, 20 aa, Mycobacterium
HQSIPLLARATPYIGHFQIR

SEQ ID NO: 1074070 - protein, 17 aa, Mycobacterium
HQSWIRELRDTETEARE

SEQ ID NO: 1074071 - protein, 24 aa, Mycobacterium
HQVARLLRDARFLRIGEGPSEALL

SEQ ID NO: 1074072 - protein, 17 aa, Mycobacterium
HQVIVVTHLPQVAAYAD

SEQ ID NO: 1074073 - protein, 17 aa, Mycobacterium
HQVQRWLTEATGEPIWS

SEQ ID NO: 1074074 - protein, 18 aa, Mycobacterium
HRAHAFIVLARTAPVDPD

SEQ ID NO: 1074075 - protein, 41 aa, Mycobacterium; identical to SEQ ID NO: 824021

SEQ ID NO: 1074076 - protein, 27 aa, Mycobacterium
HRARAMAMLMLALPGAVFLYNGEELGL

SEQ ID NO: 1074077 - protein, 23 aa, Mycobacterium
HRASFVQIHFALDALPEFAPPYE

SEQ ID NO: 1074078 - protein, 17 aa, Mycobacterium
HRASRRGRRHFVGQWRQ

SEQ ID NO: 1074079 - protein, 33 aa, Mycobacterium; identical to SEQ ID NO: 219178

SEQ ID NO: 1074080 - protein, 17 aa, Mycobacterium
HRGRRQLRTLLADVAKE

SEQ ID NO: 1074081 - protein, 18 aa, Mycobacterium
HRGWLFKHTGDGVCAAFA

SEQ ID NO: 1074082 - protein, 22 aa, Mycobacterium
HRHLRRYMNWIPAEYVDAMAPT

SEQ ID NO: 1074083 - protein, 18 aa, Mycobacterium
HRLRIIHELSSQSPVPAL

SEQ ID NO: 1074084 - protein, 17 aa, Mycobacterium
HRMLLHHFGSRDNLLVA

SEQ ID NO: 1074085 - protein, 24 aa, Mycobacterium
HRPELLLSFGFIPKVESRVGLINW

SEQ ID NO: 1074086 - protein, 21 aa, Mycobacterium
HRPELLLSFGFVPKAERRVGL

SEQ ID NO: 1074087 - protein, 26 aa, Mycobacterium
HRPLEGFVYAITPFNFTAIAANLPTA

SEQ ID NO: 1074088 - protein, 17 aa, Mycobacterium
HRPPPPELPPAPPGPPP

SEQ ID NO: 1074089 - protein, 29 aa, Mycobacterium
HRPVPLWQHVLVGKRLFDLFDYQADKPAG

SEQ ID NO: 1074090 - protein, 19 aa, Mycobacterium
HRQQSMMVVPIDAPGLTVQ

SEQ ID NO: 1074091 - protein, 26 aa, Mycobacterium
HRQTPLRARHFVRWLTIWNDTVDAMY

SEQ ID NO: 1074092 - protein, 28 aa, Mycobacterium
HRRFGDLVRLIFALVPRRMRKHPRGRAG

SEQ ID NO: 1074093 - protein, 18 aa, Mycobacterium
HRRGFLQFRWQRVSRQLT

SEQ ID NO: 1074094 - protein, 22 aa, Mycobacterium
HRRRRGLLVPPFHGKSMKNYEI

SEQ ID NO: 1074095 - protein, 22 aa, Mycobacterium
HRRVVHPLLATLGRDLRELQRG

SEQ ID NO: 1074096 - protein, 38 aa, Mycobacterium
HRSALIYPESSHRFWRHQHRYWRPGPGPRFLDAPGQPA

SEQ ID NO: 1074097 - protein, 25 aa, Mycobacterium
HRSETAMMRFLRKLSDRDLALDRTM

SEQ ID NO: 1074098 - protein, 19 aa, Mycobacterium
HRSIPGVTEKWDLYVRGVE

SEQ ID NO: 1074099 - protein, 19 aa, Mycobacterium
HRSLADSFRPVVFRLDPPA

SEQ ID NO: 1074100 - protein, 25 aa, Mycobacterium
HRTGKPHGWIHNELRRRCGGPPIAA

SEQ ID NO: 1074101 - protein, 18 aa, Mycobacterium
HRVMAVNVLGVMAGTRDA

SEQ ID NO: 1074102 - protein, 17 aa, Mycobacterium
HRWPVPVDRIAHYWVDR

SEQ ID NO: 1074103 - protein, 39 aa, Mycobacterium
HRYHAGLRRSLVAMRSKRYFRLLDALDAIAAAYPADTAA

SEQ ID NO: 1074104 - protein, 34 aa, Mycobacterium
HRYPAAIRLWRTAWNEFIPFLDYDTEIRKVICST

SEQ ID NO: 1074105 - protein, 23 aa, Mycobacterium
HSAHYYFRDFWGADSGMLAALYV

SEQ ID NO: 1074106 - protein, 25 aa, Mycobacterium
HSDSRGMFFEWLTASRFSAFTGHRL

SEQ ID NO: 1074107 - protein, 28 aa, Mycobacterium
HSEVDTLRRVELLRQLRLGEYDVLVGIN

SEQ ID NO: 1074108 - protein, 24 aa, Mycobacterium
HSFSLARYAGVLLGMSGMPVTYSP

SEQ ID NO: 1074109 - protein, 19 aa, Mycobacterium
HSIGRFLGGAERWLRRVAA

SEQ ID NO: 1074110 - protein, 18 aa, Mycobacterium
HSLRYVFCGGEPLPIALC

SEQ ID NO: 1074111 - protein, 21 aa, Mycobacterium
HSRAIEPFNYRLSWLGRNVAR

SEQ ID NO: 1074112 - protein, 21 aa, Mycobacterium
HSSLLPLLHNYRQPERPVRGS

SEQ ID NO: 1074113 - protein, 27 aa, Mycobacterium
HSTFFRERWPRLLRSLYPIGGVVFDGD

SEQ ID NO: 1074114 - protein, 21 aa, Mycobacterium
HSVMYIFAVALQDGSWHHVRS

SEQ ID NO: 1074115 - protein, 25 aa, Mycobacterium
HSVVVAADWPLLAAAYRTRGSLRIV

SEQ ID NO: 1074116 - protein, 22 aa, Mycobacterium
HTAARLRQYLAGKTLTRCDIRV

SEQ ID NO: 1074117 - protein, 24 aa, Mycobacterium
HTAEQVFIPLTVGGGVRTVADVDL

SEQ ID NO: 1074118 - protein, 23 aa, Mycobacterium
HTATDYRRFLDPAALQGARLGVA

SEQ ID NO: 1074119 - protein, 26 aa, Mycobacterium
HTDGVMLWFIQDESGLHLRCRYPDTA

SEQ ID NO: 1074120 - protein, 24 aa, Mycobacterium
HTEEVMLGLRLRQGLPLAHLDAGE

SEQ ID NO: 1074121 - protein, 27 aa, Mycobacterium
HTGRDKEWWIMFACAHPALDRQSLLAL

SEQ ID NO: 1074122 - protein, 23 aa, Mycobacterium
HTGWLIVRDALVMGPWHDIERRS

SEQ ID NO: 1074123 - protein, 35 aa, Mycobacterium
HTKPMLMLLDGNSLAFRAFYALPTENFKTRGGLTT

SEQ ID NO: 1074124 - protein, 20 aa, Mycobacterium
HTLTLGCLVLALTIKGQCDE

SEQ ID NO: 1074125 - protein, 30 aa, Mycobacterium
HTQAIAGFLNPMPRWYIGSVLRHVDFLTSD

SEQ ID NO: 1074126 - protein, 19 aa, Mycobacterium
HTRLRVGLPMVPNTVFIAF

SEQ ID NO: 1074127 - protein, 24 aa, Mycobacterium
HTTNPIPMLATPPPTNNAPLTSSE

SEQ ID NO: 1074128 - protein, 17 aa, Mycobacterium
HTVTWADLRYRVAALAG

SEQ ID NO: 1074129 - protein, 17 aa, Mycobacterium
HTWFGLSALAERVGTTV

SEQ ID NO: 1074130 - protein, 21 aa, Mycobacterium
HTYAVAHQLWRDATSIDWSGH

SEQ ID NO: 1074131 - protein, 18 aa, Mycobacterium
HVALPGRGEPKRAILDSY

SEQ ID NO: 1074132 - protein, 35 aa, Mycobacterium; identical to SEQ ID NO: 824490

SEQ ID NO: 1074133 - protein, 23 aa, Mycobacterium
HVDHQRLGWRHAPVGPALADALG

SEQ ID NO: 1074134 - protein, 24 aa, Mycobacterium
HVDMWSMLVIARDLLSMLADARTG

SEQ ID NO: 1074135 - protein, 19 aa, Mycobacterium
HVELEWLVHALFTGFYQSD

SEQ ID NO: 1074136 - protein, 30 aa, Mycobacterium; identical to SEQ ID NO: 824516

SEQ ID NO: 1074137 - protein, 18 aa, Mycobacterium
HVGLPLALVLADEGYNVD

SEQ ID NO: 1074138 - protein, 17 aa, Mycobacterium
HVGPLRVPGVPAYIDPE

SEQ ID NO: 1074139 - protein, 17 aa, Mycobacterium
HVLGMFLNTVPLRMRLT

SEQ ID NO: 1074140 - protein, 18 aa, Mycobacterium
HVLLPGLVDLHTHLREPG

SEQ ID NO: 1074141 - protein, 17 aa, Mycobacterium
HVLPRRDGDKLSVAKGL

SEQ ID NO: 1074142 - protein, 20 aa, Mycobacterium
HVNKLRGRNVPKLRQVIGCV

SEQ ID NO: 1074143 - protein, 18 aa, Mycobacterium
HVPLKSTLLAAHLAVNGR

SEQ ID NO: 1074144 - protein, 17 aa, Mycobacterium
HVQATFRKLQLANRVEL

SEQ ID NO: 1074145 - protein, 19 aa, Mycobacterium
HVQDKLRTVLWGWAGKPID

SEQ ID NO: 1074146 - protein, 18 aa, Mycobacterium
HVQDLLDYALRSGESFSS

SEQ ID NO: 1074147 - protein, 18 aa, Mycobacterium
HVRGGFDGLNSWLTGMFD

SEQ ID NO: 1074148 - protein, 25 aa, Mycobacterium
HVRGRGLLLGIVLAGPHAKAAEVAA

SEQ ID NO: 1074149 - protein, 21 aa, Mycobacterium
HVRNLIRRFVEVGVPGYHIED

SEQ ID NO: 1074150 - protein, 19 aa, Mycobacterium
HVRRSVLPYPGRVRELLQL

SEQ ID NO: 1074151 - protein, 21 aa, Mycobacterium
HVTVVFERPPSPSIRSSVIVI

SEQ ID NO: 1074152 - protein, 20 aa, Mycobacterium
HVVTINDYLARRDAEWMAPL

SEQ ID NO: 1074153 - protein, 19 aa, Mycobacterium
HVYTRLDRPLTASLGLMIL

SEQ ID NO: 1074154 - protein, 18 aa, Mycobacterium
HWDGDTFTFPLSTENALP

SEQ ID NO: 1074155 - protein, 23 aa, Mycobacterium
HWRDVPVRWDLLPEQRLLSAEVR

SEQ ID NO: 1074156 - protein, 23 aa, Mycobacterium
HYAGAFPAWLAPVQAVGIPVADE

SEQ ID NO: 1074157 - protein, 20 aa, Mycobacterium
HYAPYEKKALLRLAGRYGVG

SEQ ID NO: 1074158 - protein, 18 aa, Mycobacterium
HYEPFGLVALEAAAAGTP

SEQ ID NO: 1074159 - protein, 25 aa, Mycobacterium
HYGAPPITIGPLYQPRTIELCASGD

SEQ ID NO: 1074160 - protein, 24 aa, Mycobacterium
HYGGLFIRMSWHAAGTYRIQDGRG

SEQ ID NO: 1074161 - protein, 26 aa, Mycobacterium
HYNVSNCLLALAILDAVGVSPEQAAP

SEQ ID NO: 1074162 - protein, 18 aa, Mycobacterium
HYVDIPLPGPRLPHDMAF

SEQ ID NO: 1074163 - protein, 18 aa, Mycobacterium
IAAAHWQLGVPAGRIRPL

SEQ ID NO: 1074164 - protein, 18 aa, Mycobacterium
IAAAVRLHKQAHLPYLVY

SEQ ID NO: 1074165 - protein, 28 aa, Mycobacterium
IAAEIGYPVLVRPSYVLGGRGMEIVYDE

SEQ ID NO: 1074166 - protein, 29 aa, Mycobacterium
IAAEIGYPVLVRPSYVLGGRGMEIVYDEE

SEQ ID NO: 1074167 - protein, 29 aa, Mycobacterium
IAAKIAFFFTKRKLARMAGLATADMLEPL

SEQ ID NO: 1074168 - protein, 18 aa, Mycobacterium
IAALPRIRRAHPGTTLTI

SEQ ID NO: 1074169 - protein, 18 aa, Mycobacterium
IAALSFLLEHGCHHLQII

SEQ ID NO: 1074170 - protein, 23 aa, Mycobacterium
IAAMALWFLNFSTWDGAAGIYLE

SEQ ID NO: 1074171 - protein, 27 aa, Mycobacterium
IAAMQWEKLICNVAYSAPCALTGMTVG

SEQ ID NO: 1074172 - protein, 26 aa, Mycobacterium
IAANPKIFFQIYWLGGRDAIAERVER

SEQ ID NO: 1074173 - protein, 18 aa, Mycobacterium
IAANRAHLAALIATNLLG

SEQ ID NO: 1074174 - protein, 23 aa, Mycobacterium
IAAPDWTAIFSDALIGYAMKRRD

SEQ ID NO: 1074175 - protein, 20 aa, Mycobacterium
IAARPGRIWLRISGYGEHSR

SEQ ID NO: 1074176 - protein, 24 aa, Mycobacterium
IAAVAETWLRLELTTPLVVDPVCA

SEQ ID NO: 1074177 - protein, 25 aa, Mycobacterium
IACDVGSHYIYMARHVRVYQPRRLL

SEQ ID NO: 1074178 - protein, 24 aa, Mycobacterium
IADAILDGVFPPGSALPPERELAE

SEQ ID NO: 1074179 - protein, 24 aa, Mycobacterium
IADLETREVLLAKLAGAMKGNLAK

SEQ ID NO: 1074180 - protein, 28 aa, Mycobacterium
IADLRAIPWVLAWSQSRVMLPGWYGTGS

SEQ ID NO: 1074181 - protein, 29 aa, Mycobacterium
IADMTHDVWRWVIDIDLWGSIHTVEAFLP

SEQ ID NO: 1074182 - protein, 24 aa, Mycobacterium
IADMTYLQWLQRYVELAIGEGNST

SEQ ID NO: 1074183 - protein, 18 aa, Mycobacterium
IADPKARYFRVLTSWVGG

SEQ ID NO: 1074184 - protein, 29 aa, Mycobacterium
IADSYTELMPFRLAVLHAAWMIDTAGEHA

SEQ ID NO: 1074185 - protein, 26 aa, Mycobacterium
IAEAAKLIRAAERPVLFVGLRVGDPA

SEQ ID NO: 1074186 - protein, 23 aa, Mycobacterium
IAEALVGLLRSNSRLSVRVLHRD

SEQ ID NO: 1074187 - protein, 21 aa, Mycobacterium
IAEELVRIIGVLRGMQLKKLP

SEQ ID NO: 1074188 - protein, 31 aa, Mycobacterium
IAELFGMYGRDYQRIAFGAAGFHARVAALLG

SEQ ID NO: 1074189 - protein, 23 aa, Mycobacterium
IAETIDWGRTVLALGLDTIDDAV

SEQ ID NO: 1074190 - protein, 28 aa, Mycobacterium
IAFGDKVLPLYLPTSDGLIGLLSQTQYA

SEQ ID NO: 1074191 - protein, 25 aa, Mycobacterium
IAFNQVLLEIMPAWGGAERLAAVVG

SEQ ID NO: 1074192 - protein, 25 aa, Mycobacterium
IAGAETLPLGDYRMLPRATFCQPQV

SEQ ID NO: 1074193 - protein, 27 aa, Mycobacterium
IAGGALPPPFNIVGKLSGPGVSMAGNA

SEQ ID NO: 1074194 - protein, 32 aa, Mycobacterium
IAGIDLAELTLPTPPPPILATGLDSASAAINA

SEQ ID NO: 1074195 - protein, 21 aa, Mycobacterium
IAGIVLIGLLTRPGELEPGVG

SEQ ID NO: 1074196 - protein, 18 aa, Mycobacterium
IAGVPLTELAREYGTPLF

SEQ ID NO: 1074197 - protein, 18 aa, Mycobacterium
IAGYPEVTLAIYASPRQT

SEQ ID NO: 1074198 - protein, 25 aa, Mycobacterium
IAHGFMTLSLLPRLQHEMYTVKGIK

SEQ ID NO: 1074199 - protein, 26 aa, Mycobacterium
IAIELDGLRLITWRGASRAEQGLSFA

SEQ ID NO: 1074200 - protein, 19 aa, Mycobacterium
IAILAVLKTGAGYLPIDPI

SEQ ID NO: 1074201 - protein, 17 aa, Mycobacterium
IAKVWGLYMAASRVAFE

SEQ ID NO: 1074202 - protein, 17 aa, Mycobacterium
IALGILDQFDMSCYPVD

SEQ ID NO: 1074203 - protein, 27 aa, Mycobacterium
IALVQKIAFSLPDKYYDKVDVTVLPPF

SEQ ID NO: 1074204 - protein, 17 aa, Mycobacterium
IAMLDEDGYLFIGGRSD

SEQ ID NO: 1074205 - protein, 22 aa, Mycobacterium
IAMNFSMDGPWGQWVNRWTAEE

SEQ ID NO: 1074206 - protein, 20 aa, Mycobacterium
IAMNMGMDGAWGQWVNRWTA

SEQ ID NO: 1074207 - protein, 19 aa, Mycobacterium
IAMPALRLDAAFAHLNLGD

SEQ ID NO: 1074208 - protein, 19 aa, Mycobacterium
IAMYLCRELTDLSLPKIGQ

SEQ ID NO: 1074209 - protein, 22 aa, Mycobacterium
IAPELTGLWTAGFMMAPTNTRI

SEQ ID NO: 1074210 - protein, 24 aa, Mycobacterium
IAPGPFVIDIRDLDFIGSCAYAVL

SEQ ID NO: 1074211 - protein, 27 aa, Mycobacterium
IAPGVVTTWMKLAVRDRILPDDDSDGD

SEQ ID NO: 1074212 - protein, 28 aa, Mycobacterium
IAPHDTNVALLPIGYADGVFRSLGGRLE

SEQ ID NO: 1074213 - protein, 20 aa, Mycobacterium
IAPTVLLLHGFPSSSFNFRS

SEQ ID NO: 1074214 - protein, 31 aa, Mycobacterium; identical to SEQ ID NO: 825098

SEQ ID NO: 1074215 - protein, 31 aa, Mycobacterium
IAQVARWGVKDRLRGLRTARISLAAQRFAAA

SEQ ID NO: 1074216 - protein, 26 aa, Mycobacterium
IARADAVLLIGARLNWLLGHGESPQW

SEQ ID NO: 1074217 - protein, 27 aa, Mycobacterium
IARELDRYLPFLATTKVLMAAVRAGMG

SEQ ID NO: 1074218 - protein, 20 aa, Mycobacterium
IARHDLQVVLLEPMLRRVEF

SEQ ID NO: 1074219 - protein, 17 aa, Mycobacterium
IARIQRFAHPVLLERSR

SEQ ID NO: 1074220 - protein, 20 aa, Mycobacterium
IARLAGLYQSGQLQLDEMIT

SEQ ID NO: 1074221 - protein, 20 aa, Mycobacterium
IARNALLGAGFPESVPGVTI

SEQ ID NO: 1074222 - protein, 28 aa, Mycobacterium
IARVISDVWLSNLLAWLTRRASATDVSK

SEQ ID NO: 1074223 - protein, 21 aa, Mycobacterium
IASITYRQLDYWARTSLVVPS

SEQ ID NO: 1074224 - protein, 35 aa, Mycobacterium; identical to SEQ ID NO: 825177

SEQ ID NO: 1074225 - protein, 22 aa, Mycobacterium
IASTGFLLPSNMVTPFLGMLDT

SEQ ID NO: 1074226 - protein, 21 aa, Mycobacterium
IATDHLMRFPGRFSEQLLVDN

SEQ ID NO: 1074227 - protein, 25 aa, Mycobacterium
IATEAPPWVGPLDVMVVAGDDPGDP

SEQ ID NO: 1074228 - protein, 20 aa, Mycobacterium
IATPQLRAHLDAWLARFAAP

SEQ ID NO: 1074229 - protein, 25 aa, Mycobacterium
IATRVPQEWLLPYVHQRYDEPHDAP

SEQ ID NO: 1074230 - protein, 20 aa, Mycobacterium
IATVLAWSDALNAADIDTLV

SEQ ID NO: 1074231 - protein, 17 aa, Mycobacterium
IATWRREVSLRRTRERR

SEQ ID NO: 1074232 - protein, 23 aa, Mycobacterium
IAVAYNVWQFYQVTGNLAFMIDY

SEQ ID NO: 1074233 - protein, 25 aa, Mycobacterium
IAVTVVFPLLPSTPKIRTGYNLPIS

SEQ ID NO: 1074234 - protein, 23 aa, Mycobacterium
IAWEHNIGVLGGRFRVLAPDLLG

SEQ ID NO: 1074235 - protein, 17 aa, Mycobacterium
IAYIIPKGSDAQLRAQG

SEQ ID NO: 1074236 - protein, 18 aa, Mycobacterium
IAYYVADDEIFLVPNAAN

SEQ ID NO: 1074237 - protein, 17 aa, Mycobacterium
ICARIAQAPALRGLLGP

SEQ ID NO: 1074238 - protein, 25 aa, Mycobacterium
ICDGGFPLDVRYAPTRLRELCKMDG

SEQ ID NO: 1074239 - protein, 23 aa, Mycobacterium
ICRIRLALRLDLSVRMAAHAHPG

SEQ ID NO: 1074240 - protein, 24 aa, Mycobacterium
ICVHDPLIMRRALEYATGLGVLIA

SEQ ID NO: 1074241 - protein, 34 aa, Mycobacterium; identical to SEQ ID NO: 825280

SEQ ID NO: 1074242 - protein, 25 aa, Mycobacterium
IDADGFVWIVGRADQAIIRGGFKVL

SEQ ID NO: 1074243 - protein, 25 aa, Mycobacterium
IDAMAVGLAAWRLGAGRSRPGARVQ

SEQ ID NO: 1074244 - protein, 29 aa, Mycobacterium
IDATLRPWAAMRAQLLLAETLRAAGLQPD

SEQ ID NO: 1074245 - protein, 22 aa, Mycobacterium
IDCPPSLGVLTLNGLTAADEVI

SEQ ID NO: 1074246 - protein, 27 aa, Mycobacterium
IDDIQAQAILDMQLRRLAALERQRIID

SEQ ID NO: 1074247 - protein, 19 aa, Mycobacterium
IDDLIAYYVADDEIFLVPN

SEQ ID NO: 1074248 - protein, 20 aa, Mycobacterium
IDDMAWMRQLLDWQREAADP

SEQ ID NO: 1074249 - protein, 23 aa, Mycobacterium
IDELIPLVRGVVRGAPHALVVAD

SEQ ID NO: 1074250 - protein, 25 aa, Mycobacterium
IDEQSPIVGIWHSGGARLAEGVRAL

SEQ ID NO: 1074251 - protein, 24 aa, Mycobacterium
IDERTVICVLTHDPKFDVPVLEVA

SEQ ID NO: 1074252 - protein, 26 aa, Mycobacterium
IDFIEACAWIKENLPGVHISGGISNV

SEQ ID NO: 1074253 - protein, 19 aa, Mycobacterium
IDFLDDPPPLPLAPAAVPT

SEQ ID NO: 1074254 - protein, 31 aa, Mycobacterium
IDGATYLFTNDYEWDLLLSKTGWSEADVMAQ

SEQ ID NO: 1074255 - protein, 18 aa, Mycobacterium
IDGETVVPLLPAQDFKRV

SEQ ID NO: 1074256 - protein, 27 aa, Mycobacterium
IDGNLYLRDLVMALQWIQDNIAEFGGD

SEQ ID NO: 1074257 - protein, 23 aa, Mycobacterium
IDGPTVVRVLGAIEIPVVVQELA

SEQ ID NO: 1074258 - protein, 24 aa, Mycobacterium
IDHFARRCRAVRLVPFDPQLEEGA

SEQ ID NO: 1074259 - protein, 18 aa, Mycobacterium
IDHFLVQADLTVVVPGPL

SEQ ID NO: 1074260 - protein, 18 aa, Mycobacterium
IDHLTGLWQRGIAALAAG

SEQ ID NO: 1074261 - protein, 25 aa, Mycobacterium
IDIAQNLPFLLSLYAQPASVGVPPA

SEQ ID NO: 1074262 - protein, 18 aa, Mycobacterium
IDKGEFVFLIGPSGSGKS

SEQ ID NO: 1074263 - protein, 27 aa, Mycobacterium
IDLELRYRGLRAPHKLKLGVSGCAREC

SEQ ID NO: 1074264 - protein, 17 aa, Mycobacterium
IDLPCRDVGLPQDFFDH

SEQ ID NO: 1074265 - protein, 25 aa, Mycobacterium
IDLPGLGHPLLPPWTVTGSGVDGVT

SEQ ID NO: 1074266 - protein, 30 aa, Mycobacterium; identical to SEQ ID NO: 946265

SEQ ID NO: 1074267 - protein, 29 aa, Mycobacterium
IDMFGARVDQLPLIWKRLVDAGMESGHAY

SEQ ID NO: 1074268 - protein, 21 aa, Mycobacterium
IDNGKLHRFVNIYVNDEDVRF

SEQ ID NO: 1074269 - protein, 27 aa, Mycobacterium
IDNPNRRFFTMIGTLIRGRVTVGGSAA

SEQ ID NO: 1074270 - protein, 24 aa, Mycobacterium
IDPAVPAWTWGRRQDVGFIRRRVA

SEQ ID NO: 1074271 - protein, 26 aa, Mycobacterium
IDPTGTIRAIIYYPLSLGRNFDELLR

SEQ ID NO: 1074272 - protein, 20 aa, Mycobacterium
IDQLLEAPTAWLFGPEAHGL

SEQ ID NO: 1074273 - protein, 17 aa, Mycobacterium
IDQPVYRVAAKLRLMAD

SEQ ID NO: 1074274 - protein, 25 aa, Mycobacterium
IDRAADVGGTWYWNRYPGIACDVES

SEQ ID NO: 1074275 - protein, 23 aa, Mycobacterium
IDRFAPFNLRDTAIRPSYGLAEA

SEQ ID NO: 1074276 - protein, 20 aa, Mycobacterium
IDRIGRRPGARWAADLLAAA

SEQ ID NO: 1074277 - protein, 24 aa, Mycobacterium
IDSSDEWIYSRTGIKTRRFAAPEE

SEQ ID NO: 1074278 - protein, 26 aa, Mycobacterium
IDTTEKYWLQWRLIKDIDEHQRKQLE

SEQ ID NO: 1074279 - protein, 32 aa, Mycobacterium
IDVGFVVVGPHPYFPRLRLELDKRLGWKAEVE

SEQ ID NO: 1074280 - protein, 19 aa, Mycobacterium
IDVLRSRLGGVRKLQVSGP

SEQ ID NO: 1074281 - protein, 23 aa, Mycobacterium
IDVVGWLDPMARDELLCRAQIFV

SEQ ID NO: 1074282 - protein, 17 aa, Mycobacterium
IDVVYYLVHGIGQPDFR

SEQ ID NO: 1074283 - protein, 23 aa, Mycobacterium
IDYATIDLALTLLGAVSVPLPTN

SEQ ID NO: 1074284 - protein, 45 aa, Mycobacterium
IEAMLHSDYPLQALLYTVVLHRFLRWRQPGYDPARHLGGVLYLFV

SEQ ID NO: 1074285 - protein, 19 aa, Mycobacterium
IEDILITHPGIADVAIVGL

SEQ ID NO: 1074286 - protein, 17 aa, Mycobacterium
IEDLLAKLAIPIPTVTT

SEQ ID NO: 1074287 - protein, 20 aa, Mycobacterium
IEDSLAPRYVDLRPFAVNDG

SEQ ID NO: 1074288 - protein, 26 aa, Mycobacterium
IEEIVLRLRALLRRTGVTTVDSGAQL

SEQ ID NO: 1074289 - protein, 18 aa, Mycobacterium
IEEMLRWTAPVKNMCRML

SEQ ID NO: 1074290 - protein, 17 aa, Mycobacterium
IEEVALMASLVRIADRA

SEQ ID NO: 1074291 - protein, 18 aa, Mycobacterium
IEFCLLATQYDALAATIT

SEQ ID NO: 1074292 - protein, 18 aa, Mycobacterium
IEGTFAWNQSLFGYTFGD

SEQ ID NO: 1074293 - protein, 28 aa, Mycobacterium
IEHELKVIAQLSFPGYFLVVHDITQFCR

SEQ ID NO: 1074294 - protein, 22 aa, Mycobacterium
IELMLQLLLDGHDTLRSILTET

SEQ ID NO: 1074295 - protein, 19 aa, Mycobacterium
IELTPAYRGGPTLRNHDTI

SEQ ID NO: 1074296 - protein, 25 aa, Mycobacterium
IEPPQFMPDQYGGTWRYIGKDATVS

SEQ ID NO: 1074297 - protein, 36 aa, Mycobacterium; identical to SEQ ID NO: 825744

SEQ ID NO: 1074298 - protein, 18 aa, Mycobacterium
IERAVRAGLPMDLVPATL

SEQ ID NO: 1074299 - protein, 25 aa, Mycobacterium
IERDNTLFTNWPRPVLATVAGDELQ

SEQ ID NO: 1074300 - protein, 18 aa, Mycobacterium
IERKPPWIRTRARMGPEY

SEQ ID NO: 1074301 - protein, 17 aa, Mycobacterium
IERMRTLMESTLARHTG

SEQ ID NO: 1074302 - protein, 23 aa, Mycobacterium
IERPHMYRLMFGSTSAHGINAPA

SEQ ID NO: 1074303 - protein, 22 aa, Mycobacterium
IERQLVHRFIGPAFGHESGFDA

SEQ ID NO: 1074304 - protein, 18 aa, Mycobacterium
IERRWGGSGPIRRFVRGQ

SEQ ID NO: 1074305 - protein, 18 aa, Mycobacterium
IESGLFAVALPFVDLIDY

SEQ ID NO: 1074306 - protein, 26 aa, Mycobacterium
IESGVANPNIYWVHNDSGDTARVFAI

SEQ ID NO: 1074307 - protein, 17 aa, Mycobacterium
IESIAQAGLTVNFPYLL

SEQ ID NO: 1074308 - protein, 21 aa, Mycobacterium
IESLSHPLIDQVRGRGLLLGI

SEQ ID NO: 1074309 - protein, 20 aa, Mycobacterium
IESLTQLIAVDNVWVPPAGG

SEQ ID NO: 1074310 - protein, 24 aa, Mycobacterium
IETGIQGFLAFNPGLYAQQFVAST

SEQ ID NO: 1074311 - protein, 26 aa, Mycobacterium
IETGYVMPHWPKPWGRAADAVEQLVI

SEQ ID NO: 1074312 - protein, 23 aa, Mycobacterium
IETIFMFPTFGCGVEEALKADIE

SEQ ID NO: 1074313 - protein, 31 aa, Mycobacterium
IETTPWTLQNGLLTGIRKLARPQLKKHYGEL

SEQ ID NO: 1074314 - protein, 40 aa, Mycobacterium
IEVAVLPFPTTLNSLLIIALSPVLQPVFGVGMFGLAHDTL

SEQ ID NO: 1074315 - protein, 24 aa, Mycobacterium
IEVVPDVLRHRLVLTYDALADEIS

SEQ ID NO: 1074316 - protein, 17 aa, Mycobacterium
IFAAPYITLCIPDNAVR

SEQ ID NO: 1074317 - protein, 17 aa, Mycobacterium
IFADALRELSAKYPDRL

SEQ ID NO: 1074318 - protein, 18 aa, Mycobacterium
IFAYTSVKMPKFNSISIS

SEQ ID NO: 1074319 - protein, 18 aa, Mycobacterium
IFEPAALQDLEGLFARLA

SEQ ID NO: 1074320 - protein, 17 aa, Mycobacterium
IFHGALSWPFAENDDTL

SEQ ID NO: 1074321 - protein, 19 aa, Mycobacterium
IFIADYVLAGYGTGAIMAV

SEQ ID NO: 1074322 - protein, 17 aa, Mycobacterium
IFNSIWGDFPAAVSWQR

SEQ ID NO: 1074323 - protein, 19 aa, Mycobacterium
IFRSLQQLAALPGDPTVFP

SEQ ID NO: 1074324 - protein, 29 aa, Mycobacterium
IFTVPNFLELDYWQKWHYGDNTMAGVYSA

SEQ ID NO: 1074325 - protein, 18 aa, Mycobacterium
IFVEFSRWRGLSADGRCK

SEQ ID NO: 1074326 - protein, 17 aa, Mycobacterium
IGAGYARRYAQDGYDLI

SEQ ID NO: 1074327 - protein, 24 aa, Mycobacterium
IGALSVGLDRKDGAAWLARNHSDA

SEQ ID NO: 1074328 - protein, 23 aa, Mycobacterium
IGAQLRFMADQDLDLIITSGGLG

SEQ ID NO: 1074329 - protein, 17 aa, Mycobacterium
IGCPLAVAFATRANARY

SEQ ID NO: 1074330 - protein, 24 aa, Mycobacterium
IGCPLINIHHSFLPAFTGASPYKR

SEQ ID NO: 1074331 - protein, 23 aa, Mycobacterium
IGELRDGALLPGLAAGALGIHDQ

SEQ ID NO: 1074332 - protein, 21 aa, Mycobacterium
IGERYVGIRPAPGYPACPEHT

SEQ ID NO: 1074333 - protein, 21 aa, Mycobacterium
IGESILRLKARLWFVHRASRS

SEQ ID NO: 1074334 - protein, 24 aa, Mycobacterium
IGEVLLAHVLIVKGEFGTAAAMVE

SEQ ID NO: 1074335 - protein, 21 aa, Mycobacterium
IGFGGYVALPAYLAARGIPGL

SEQ ID NO: 1074336 - protein, 18 aa, Mycobacterium
IGGAALAGGTGGTGGDGG

SEQ ID NO: 1074337 - protein, 22 aa, Mycobacterium
IGGAGNIARITAIGGGTVTSSA

SEQ ID NO: 1074338 - protein, 27 aa, Mycobacterium
IGGAKAWLGTALALKPLLRVEDGKLVL

SEQ ID NO: 1074339 - protein, 26 aa, Mycobacterium
IGGATMLRVLLYPDQMLDEAWVDQTT

SEQ ID NO: 1074340 - protein, 26 aa, Mycobacterium
IGGQEILFPALLPRAPYETTNRWTEY

SEQ ID NO: 1074341 - protein, 22 aa, Mycobacterium
IGGTPLVRLNAVVPAGIGTVAA

SEQ ID NO: 1074342 - protein, 25 aa, Mycobacterium
IGGVYRVLQCIAQARPFVLLDRFEL

SEQ ID NO: 1074343 - protein, 30 aa, Mycobacterium; identical to SEQ ID NO: 826015

SEQ ID NO: 1074344 - protein, 23 aa, Mycobacterium
IGHPCWADYLPVTRAVPQPPSVR

SEQ ID NO: 1074345 - protein, 22 aa, Mycobacterium
IGIAQMRRYFPSSLILYERFAG

SEQ ID NO: 1074346 - protein, 24 aa, Mycobacterium
IGIDLREDWPSALRQRGFDAGQPT

SEQ ID NO: 1074347 - protein, 19 aa, Mycobacterium
IGISPRRPLDALYRGFCQL

SEQ ID NO: 1074348 - protein, 25 aa, Mycobacterium
IGLEELLTEAWLTQAPKRLAKEFLT

SEQ ID NO: 1074349 - protein, 34 aa, Mycobacterium
IGLGPGHRAVFWVPPYHDFGLISGILSALAGNFD

SEQ ID NO: 1074350 - protein, 17 aa, Mycobacterium
IGLLTRPGELEPGVGDA

SEQ ID NO: 1074351 - protein, 20 aa, Mycobacterium
IGLLVDGRWRWRSYSLTSSP

SEQ ID NO: 1074352 - protein, 23 aa, Mycobacterium
IGLQWIPENILHFVGTRAALIHA

SEQ ID NO: 1074353 - protein, 18 aa, Mycobacterium
IGLTFRSPNKLPVTFTPA

SEQ ID NO: 1074354 - protein, 20 aa, Mycobacterium
IGLYHAKRLATPGQRIVLYA

SEQ ID NO: 1074355 - protein, 20 aa, Mycobacterium
IGMFRDWHALALGDGNAFLD

SEQ ID NO: 1074356 - protein, 27 aa, Mycobacterium
IGMHPQITANLLFIRFEFRTGDASGHN

SEQ ID NO: 1074357 - protein, 18 aa, Mycobacterium
IGNGGMGGAGLRGGDGGT

SEQ ID NO: 1074358 - protein, 25 aa, Mycobacterium
IGNTEWPKWEAVMAADPLDPAAAAE

SEQ ID NO: 1074359 - protein, 22 aa, Mycobacterium
IGNVVLGFPTLAGYLNNTGSAK

SEQ ID NO: 1074360 - protein, 25 aa, Mycobacterium
IGPDREWRAWRAIIDKTLVLVRQPA

SEQ ID NO: 1074361 - protein, 20 aa, Mycobacterium
IGPLHFNSADLAGLPGAASE

SEQ ID NO: 1074362 - protein, 28 aa, Mycobacterium
IGPNGQPHLTAMWYAVVDGEIWLETKAK

SEQ ID NO: 1074363 - protein, 17 aa, Mycobacterium
IGPSLRAILLTAAHEDA

SEQ ID NO: 1074364 - protein, 19 aa, Mycobacterium
IGPYLIRQLAQMGAKTVVA

SEQ ID NO: 1074365 - protein, 17 aa, Mycobacterium
IGQPLLNEYVWGRQFGE

SEQ ID NO: 1074366 - protein, 25 aa, Mycobacterium
IGRGCLGRPWLFAELSAAFTGNPGP

SEQ ID NO: 1074367 - protein, 24 aa, Mycobacterium
IGRGDVVALLLPRSGRAIIAILAV

SEQ ID NO: 1074368 - protein, 25 aa, Mycobacterium
IGRHDGGLVSTYLYDHARRGMVVGL

SEQ ID NO: 1074369 - protein, 27 aa, Mycobacterium
IGRLEELMPIYSELLSLLADSGAQWVQ

SEQ ID NO: 1074370 - protein, 19 aa, Mycobacterium
IGRRGPLQRAFTTLELREL

SEQ ID NO: 1074371 - protein, 29 aa, Mycobacterium
IGRYPDQRSALLPLLHLVQGEDSYLTPAG

SEQ ID NO: 1074372 - protein, 19 aa, Mycobacterium
IGSALYEDLQIGPDGRVLT

SEQ ID NO: 1074373 - protein, 25 aa, Mycobacterium
IGSDRLRLEAYRRLATATSDSGVAA

SEQ ID NO: 1074374 - protein, 31 aa, Mycobacterium; identical to SEQ ID NO: 826217

SEQ ID NO: 1074375 - protein, 24 aa, Mycobacterium
IGSFTPIFVMSRITGWTAHIMEQT

SEQ ID NO: 1074376 - protein, 19 aa, Mycobacterium
IGSGRTFRRSRCRRCGSMN

SEQ ID NO: 1074377 - protein, 27 aa, Mycobacterium
IGSPAMNFFPAVLTPTGLTLPFGEVTL

SEQ ID NO: 1074378 - protein, 21 aa, Mycobacterium
IGSRWLAHYTATSGYLDALAY

SEQ ID NO: 1074379 - protein, 22 aa, Mycobacterium
IGSRWLAHYTATSGYLDALAYA

SEQ ID NO: 1074380 - protein, 24 aa, Mycobacterium
IGSVMAALFERLARHPIATRAPWT

SEQ ID NO: 1074381 - protein, 21 aa, Mycobacterium
IGTHRLLQTGVRWKDLGLVVV

SEQ ID NO: 1074382 - protein, 30 aa, Mycobacterium; identical to SEQ ID NO: 826248

SEQ ID NO: 1074383 - protein, 37 aa, Mycobacterium; identical to SEQ ID NO: 826249

SEQ ID NO: 1074384 - protein, 24 aa, Mycobacterium
IGTRAIHGFYSAIAGLTRECELVS

SEQ ID NO: 1074385 - protein, 31 aa, Mycobacterium; identical to SEQ ID NO: 826256

SEQ ID NO: 1074386 - protein, 26 aa, Mycobacterium
IGVISWTQEGFFGRMLATIRPYRPSL

SEQ ID NO: 1074387 - protein, 25 aa, Mycobacterium
IGYRSLLRAELPPGGRLGLYGFGGS

SEQ ID NO: 1074388 - protein, 17 aa, Mycobacterium
IHDPISTQFLWPKTDEP

SEQ ID NO: 1074389 - protein, 18 aa, Mycobacterium
IHELSSQSPVPALVELSR

SEQ ID NO: 1074390 - protein, 18 aa, Mycobacterium
IHGIIAYPVTPFTAEGDV

SEQ ID NO: 1074391 - protein, 21 aa, Mycobacterium
IHGVLLATNFFGINTIPIALN

SEQ ID NO: 1074392 - protein, 18 aa, Mycobacterium
IHGYKRAFRIAGSGPAIL

SEQ ID NO: 1074393 - protein, 23 aa, Mycobacterium
IHHAIPIIRAFSHFALLANVAED

SEQ ID NO: 1074394 - protein, 21 aa, Mycobacterium
IHKNWNPHDYIPWSDGKNYYA

SEQ ID NO: 1074395 - protein, 23 aa, Mycobacterium
IHLGHIFILLLTEATDALVSIPE

SEQ ID NO: 1074396 - protein, 24 aa, Mycobacterium
IHNTQPWRWQVTSRSLELFPEPDM

SEQ ID NO: 1074397 - protein, 17 aa, Mycobacterium
IIAEWLEQRGFSPLESK

SEQ ID NO: 1074398 - protein, 24 aa, Mycobacterium
IIANRLSYFLDLRGPSVAVDTACS

SEQ ID NO: 1074399 - protein, 27 aa, Mycobacterium
IIDAAVPFIQTLLARCPRLKILATSRE

SEQ ID NO: 1074400 - protein, 17 aa, Mycobacterium
IIDAVGLELPLSPVCRP

SEQ ID NO: 1074401 - protein, 25 aa, Mycobacterium
IIDSALDGVLFLDEAYALVATGAKN

SEQ ID NO: 1074402 - protein, 19 aa, Mycobacterium
IIEKQAGVGGTWRANRYPG

SEQ ID NO: 1074403 - protein, 21 aa, Mycobacterium
IIFDQGLGDMFVVRTAGHVID

SEQ ID NO: 1074404 - protein, 18 aa, Mycobacterium
IINTTWSAEGWVAVAGRV

SEQ ID NO: 1074405 - protein, 18 aa, Mycobacterium
IIRAKFLNRIKEAFDAEP

SEQ ID NO: 1074406 - protein, 19 aa, Mycobacterium
IITGGLGGLGLFFASKMAA

SEQ ID NO: 1074407 - protein, 24 aa, Mycobacterium
IIVKPHAWVRYTTIQNWSNNVYNL

SEQ ID NO: 1074408 - protein, 20 aa, Mycobacterium
IIVRRLLGLEPVLSIGFCGP

SEQ ID NO: 1074409 - protein, 24 aa, Mycobacterium
IKDSLSPQLLFTDLGLKYVGPVDG

SEQ ID NO: 1074410 - protein, 18 aa, Mycobacterium
IKERSLIRHLGVLEVPRL

SEQ ID NO: 1074411 - protein, 21 aa, Mycobacterium
IKGAIRKLTITSEAYPVLCGS

SEQ ID NO: 1074412 - protein, 19 aa, Mycobacterium
IKNPRWDKRFLGKHLITAH

SEQ ID NO: 1074413 - protein, 23 aa, Mycobacterium
IKPGNNLPLRNIPAGTLVHAVEL

SEQ ID NO: 1074414 - protein, 17 aa, Mycobacterium
IKQGWRTVPASLKWHDT

SEQ ID NO: 1074415 - protein, 22 aa, Mycobacterium
IKQRFLPPTASLDIWWCQGFSE

SEQ ID NO: 1074416 - protein, 25 aa, Mycobacterium
IKSATFAVHAPFAYGTLSVEQGTHR

SEQ ID NO: 1074417 - protein, 27 aa, Mycobacterium
IKVRYYRSRFFGKPFFQLAQALLRGPS

SEQ ID NO: 1074418 - protein, 27 aa, Mycobacterium
ILAAKRTSDLIPLCHQLALTGVDVDFT

SEQ ID NO: 1074419 - protein, 20 aa, Mycobacterium
ILAAVKRLYLLGKNDRPTGT

SEQ ID NO: 1074420 - protein, 25 aa, Mycobacterium
ILAPQGIDYVAGFYAAIKAGTIAVP

SEQ ID NO: 1074421 - protein, 24 aa, Mycobacterium
ILDALMVFFDLWVSAGMTPRVDPL

SEQ ID NO: 1074422 - protein, 19 aa, Mycobacterium
ILDTLAGGGAYFFRQLIGD

SEQ ID NO: 1074423 - protein, 19 aa, Mycobacterium
ILDVLDNYAFVRTSGYLAG

SEQ ID NO: 1074424 - protein, 24 aa, Mycobacterium
ILDVLDNYAFVRTSGYLAGPHDVY

SEQ ID NO: 1074425 - protein, 22 aa, Mycobacterium
ILEALEEQIVVLRLLAAQQEAG

SEQ ID NO: 1074426 - protein, 25 aa, Mycobacterium
ILESPGLMRFLPGLAERLLGEEPML

SEQ ID NO: 1074427 - protein, 18 aa, Mycobacterium
ILFLRMMERVKSGAKLIV

SEQ ID NO: 1074428 - protein, 17 aa, Mycobacterium
ILGGYQSDFARNRTKEN

SEQ ID NO: 1074429 - protein, 19 aa, Mycobacterium
ILGIRMTKFGKHPDLDTVD

SEQ ID NO: 1074430 - protein, 20 aa, Mycobacterium
ILGLDIKGHIVKKLLVVEAS

SEQ ID NO: 1074431 - protein, 18 aa, Mycobacterium
ILGLDIKGHVVKKLLVAE

SEQ ID NO: 1074432 - protein, 17 aa, Mycobacterium
ILGLLDVDLLAAVGAGS

SEQ ID NO: 1074433 - protein, 31 aa, Mycobacterium
ILGTARLLSFPIDYASITRLLFSRTGQATVA

SEQ ID NO: 1074434 - protein, 35 aa, Mycobacterium; identical to SEQ ID NO: 978199

SEQ ID NO: 1074435 - protein, 35 aa, Mycobacterium; identical to SEQ ID NO: 946396

SEQ ID NO: 1074436 - protein, 31 aa, Mycobacterium
ILIPLGELINMIPFPSFLADDFTVLDGLLAF

SEQ ID NO: 1074437 - protein, 17 aa, Mycobacterium
ILLFNNRIYGLTKGQYS

SEQ ID NO: 1074438 - protein, 19 aa, Mycobacterium
ILLRVAVGIIMFPTERLDT

SEQ ID NO: 1074439 - protein, 19 aa, Mycobacterium
ILMVSWEYPPVVIGGLGRH

SEQ ID NO: 1074440 - protein, 30 aa, Mycobacterium; identical to SEQ ID NO: 826704

SEQ ID NO: 1074441 - protein, 17 aa, Mycobacterium
ILQIRRFDNDWALVHVT

SEQ ID NO: 1074442 - protein, 22 aa, Mycobacterium
ILQSPLDISRPLWTATLVEGLA

SEQ ID NO: 1074443 - protein, 32 aa, Mycobacterium; identical to SEQ ID NO: 826740

SEQ ID NO: 1074444 - protein, 18 aa, Mycobacterium
ILRPSFRNWDHPYRRQIF

SEQ ID NO: 1074445 - protein, 19 aa, Mycobacterium
ILRTAFELAAYSQPLQIVH

SEQ ID NO: 1074446 - protein, 20 aa, Mycobacterium
ILRTNLAAVILQMAALQLGE

SEQ ID NO: 1074447 - protein, 26 aa, Mycobacterium
ILSATRYEWVILDYAILSVGAVTVPI

SEQ ID NO: 1074448 - protein, 39 aa, Mycobacterium; identical to SEQ ID NO: 826792

SEQ ID NO: 1074449 - protein, 25 aa, Mycobacterium
IMGSEGYLLNQFLAPRTNQRTDSWG

SEQ ID NO: 1074450 - protein, 21 aa, Mycobacterium
IMPIGKGQRALIVSPPKAGKT

SEQ ID NO: 1074451 - protein, 18 aa, Mycobacterium
IMQTGMTFTIEPMINLGT

SEQ ID NO: 1074452 - protein, 23 aa, Mycobacterium
IMRGAVTGLLPRPKSKASIGTVF

SEQ ID NO: 1074453 - protein, 24 aa, Mycobacterium
IMRYRGYCSLTWALNGVLPGAEAA

SEQ ID NO: 1074454 - protein, 28 aa, Mycobacterium
IMVSYPVEQGLKKVYYWAARSLGGEFTA

SEQ ID NO: 1074455 - protein, 18 aa, Mycobacterium
IMVTTTPIRATVNGCPVA

SEQ ID NO: 1074456 - protein, 29 aa, Mycobacterium
INAASGRTFFLATRLLAPDQRPPVHALYG

SEQ ID NO: 1074457 - protein, 31 aa, Mycobacterium; identical to SEQ ID NO: 826849

SEQ ID NO: 1074458 - protein, 17 aa, Mycobacterium
INANRALTALLANTNFF

SEQ ID NO: 1074459 - protein, 17 aa, Mycobacterium
INDRWAQLQLPRVPGME

SEQ ID NO: 1074460 - protein, 18 aa, Mycobacterium
INEAFASVVLSWARVHEP

SEQ ID NO: 1074461 - protein, 31 aa, Mycobacterium; identical to SEQ ID NO: 826869

SEQ ID NO: 1074462 - protein, 25 aa, Mycobacterium
INGLVIALLCRGHVLLEGVPGVAKT

SEQ ID NO: 1074463 - protein, 20 aa, Mycobacterium
INGQKMWTSLIAYADWVCLA

SEQ ID NO: 1074464 - protein, 22 aa, Mycobacterium
INHVLPAWDVSCGLYAALVVVA

SEQ ID NO: 1074465 - protein, 31 aa, Mycobacterium
INIGLLAKFMPNFLFAPDAALPLIPRRDDAA

SEQ ID NO: 1074466 - protein, 20 aa, Mycobacterium
INNLAYGFPFDDVNSQSSVL

SEQ ID NO: 1074467 - protein, 20 aa, Mycobacterium
INQLAAPDLLAWAHGGRRGC

SEQ ID NO: 1074468 - protein, 23 aa, Mycobacterium
INRGAAVFTFALGDRKTYEFMDN

SEQ ID NO: 1074469 - protein, 17 aa, Mycobacterium
INRNKAELMCRAYDGLY

SEQ ID NO: 1074470 - protein, 18 aa, Mycobacterium
INSGFGWHEARIPTIVTS

SEQ ID NO: 1074471 - protein, 25 aa, Mycobacterium
INTDNIFGFWDWVGGRYSVDSAIGL

SEQ ID NO: 1074472 - protein, 21 aa, Mycobacterium
INTVVFDRGGYTYGGRIAALA

SEQ ID NO: 1074473 - protein, 18 aa, Mycobacterium
INVDFADVKGIMSGAGTA

SEQ ID NO: 1074474 - protein, 18 aa, Mycobacterium
IPAACNGLVGLKLSRGLS

SEQ ID NO: 1074475 - protein, 31 aa, Mycobacterium; identical to SEQ ID NO: 826944

SEQ ID NO: 1074476 - protein, 21 aa, Mycobacterium
IPADRPALEAALAILRDITAG

SEQ ID NO: 1074477 - protein, 19 aa, Mycobacterium
IPAFKLTRSSAAYWRGDQK

SEQ ID NO: 1074478 - protein, 20 aa, Mycobacterium
IPAGRRALLLYGSANRDERQ

SEQ ID NO: 1074479 - protein, 21 aa, Mycobacterium
IPALYAEHWEPLWAACAQAGL

SEQ ID NO: 1074480 - protein, 20 aa, Mycobacterium
IPASFIAFDLLALGDDDYTT

SEQ ID NO: 1074481 - protein, 27 aa, Mycobacterium
IPAVNKLGTMGLILRGSDELKKQVLPS

SEQ ID NO: 1074482 - protein, 26 aa, Mycobacterium
IPCVRALLTLLPDNLRWLVTVDAMHT

SEQ ID NO: 1074483 - protein, 23 aa, Mycobacterium
IPDLAGAFYLPTLLADVGEQSQA

SEQ ID NO: 1074484 - protein, 25 aa, Mycobacterium
IPDPHPYFDYLRRQSPVLRLPQYGV

SEQ ID NO: 1074485 - protein, 17 aa, Mycobacterium
IPEFNRDALVSTLQDLY

SEQ ID NO: 1074486 - protein, 17 aa, Mycobacterium
IPFGATVAVIGLGAVGL

SEQ ID NO: 1074487 - protein, 26 aa, Mycobacterium
IPGFHLDFKALIPNNIIALQTGIAGQ

SEQ ID NO: 1074488 - protein, 17 aa, Mycobacterium
IPGLLDLGVGPESDSYE

SEQ ID NO: 1074489 - protein, 27 aa, Mycobacterium
IPGPRKLPALIWRILSAPLNAYARLVI

SEQ ID NO: 1074490 - protein, 25 aa, Mycobacterium
IPGSGLLAALLNFLDGNDGNPYGVF

SEQ ID NO: 1074491 - protein, 19 aa, Mycobacterium
IPHGLLFERFLNPERPSAP

SEQ ID NO: 1074492 - protein, 19 aa, Mycobacterium
IPHGLLFERFLNPERTSMP

SEQ ID NO: 1074493 - protein, 20 aa, Mycobacterium
IPHGLLFERFLNPERTSMPD

SEQ ID NO: 1074494 - protein, 22 aa, Mycobacterium
IPHVVRLAGRWLRPGGRFAVEH

SEQ ID NO: 1074495 - protein, 17 aa, Mycobacterium
IPKFTYNYFGSTYTTVA

SEQ ID NO: 1074496 - protein, 20 aa, Mycobacterium
IPLEAPWEAKRAAKWDRMTL

SEQ ID NO: 1074497 - protein, 17 aa, Mycobacterium
IPQFRTLVILSNRGPVN

SEQ ID NO: 1074498 - protein, 19 aa, Mycobacterium
IPQLLAGGYRPETPAAVVA

SEQ ID NO: 1074499 - protein, 25 aa, Mycobacterium
IPQTYSIVLVTYRPDYRGALRGVRG

SEQ ID NO: 1074500 - protein, 19 aa, Mycobacterium
IPRDFIIETTPWTLQNGLL

SEQ ID NO: 1074501 - protein, 25 aa, Mycobacterium
IPRDLNKITLPWPITVRATAESVAP

SEQ ID NO: 1074502 - protein, 19 aa, Mycobacterium
IPRLENVLKETLRLHPPLI

SEQ ID NO: 1074503 - protein, 34 aa, Mycobacterium
IPRPSYRFMREVYDLFVAPHYFGDSLFGVQTPAQ

SEQ ID NO: 1074504 - protein, 26 aa, Mycobacterium
IPSYKSCFLAMLRRFYELGVKELNGH

SEQ ID NO: 1074505 - protein, 25 aa, Mycobacterium
IPTLPVDLDIYANFQTPISLDVGGT

SEQ ID NO: 1074506 - protein, 19 aa, Mycobacterium
IPTPGFSSALAYYDALRTE

SEQ ID NO: 1074507 - protein, 27 aa, Mycobacterium
IPTTLNLPMDGILVPAGPYTATIPDLG

SEQ ID NO: 1074508 - protein, 25 aa, Mycobacterium
IPYQRFRGWEIAGRTAGLVGLGAVG

SEQ ID NO: 1074509 - protein, 19 aa, Mycobacterium
IQAEGLPYRSVLGLADLGL

SEQ ID NO: 1074510 - protein, 22 aa, Mycobacterium
IQAQDFFFRKIVRDKGVALAHV

SEQ ID NO: 1074511 - protein, 22 aa, Mycobacterium
IQAYDQIVLPGPPGRWVQADGR

SEQ ID NO: 1074512 - protein, 26 aa, Mycobacterium
IQFADRITHIWTNTKMYLVAVHLEGP

SEQ ID NO: 1074513 - protein, 24 aa, Mycobacterium
IQGKYDAIIFLGNSFTHLHDEHDR

SEQ ID NO: 1074514 - protein, 26 aa, Mycobacterium
IQHGSPPLALLTKLIEELSAGSGLRI

SEQ ID NO: 1074515 - protein, 18 aa, Mycobacterium
IQIDTTNVLFIVAGAFAG

SEQ ID NO: 1074516 - protein, 23 aa, Mycobacterium
IQQWNQIIAVNLTGTFLVVREAL

SEQ ID NO: 1074517 - protein, 17 aa, Mycobacterium
IQRADELPVLTERIHEL

SEQ ID NO: 1074518 - protein, 27 aa, Mycobacterium
IQRQLCKQLLLIDQLPILGDRVSTATI

SEQ ID NO: 1074519 - protein, 22 aa, Mycobacterium
IQRVAGVLAAAGWPLAGIDLSE

SEQ ID NO: 1074520 - protein, 18 aa, Mycobacterium
IQTAFIYDHFTPFVFTQL

SEQ ID NO: 1074521 - protein, 33 aa, Mycobacterium; identical to SEQ ID NO: 120731

SEQ ID NO: 1074522 - protein, 17 aa, Mycobacterium
IQTGWALARALGAIEGT

SEQ ID NO: 1074523 - protein, 24 aa, Mycobacterium
IQTTPSQLVLWADNYRTGKVGGQK

SEQ ID NO: 1074524 - protein, 28 aa, Mycobacterium
IQVMRDMLAAPEQFDWLATRLEIARKLR

SEQ ID NO: 1074525 - protein, 27 aa, Mycobacterium
IRAAARPLLQLLADRGLLSGLLSQDEM

SEQ ID NO: 1074526 - protein, 21 aa, Mycobacterium
IRALTVAALAPRPGERLWDVG

SEQ ID NO: 1074527 - protein, 25 aa, Mycobacterium
IRDEAVHGYYIGYKFQRGLAAADEA

SEQ ID NO: 1074528 - protein, 23 aa, Mycobacterium
IRDRVGVPGIWYAGSHGFELIAP

SEQ ID NO: 1074529 - protein, 19 aa, Mycobacterium
IRDRVLQAAKLLDLEAYLD

SEQ ID NO: 1074530 - protein, 17 aa, Mycobacterium
IRDVGIPGYLRATTGLA

SEQ ID NO: 1074531 - protein, 19 aa, Mycobacterium
IRELRIIPQIISGFDAEGL

SEQ ID NO: 1074532 - protein, 25 aa, Mycobacterium
IREQARLQAAQLERRRALADETAAK

SEQ ID NO: 1074533 - protein, 20 aa, Mycobacterium
IRERFGGRIRFFVSAAAALD

SEQ ID NO: 1074534 - protein, 19 aa, Mycobacterium
IRFGIIPTVAPYVLPTVLA

SEQ ID NO: 1074535 - protein, 18 aa, Mycobacterium
IRGRLRPVPADMIGAALD

SEQ ID NO: 1074536 - protein, 39 aa, Mycobacterium; identical to SEQ ID NO: 827313

SEQ ID NO: 1074537 - protein, 17 aa, Mycobacterium
IRIAGARALELAGLGIN

SEQ ID NO: 1074538 - protein, 26 aa, Mycobacterium
IRKGEWVALFFGSANRDPAVFPDPGR

SEQ ID NO: 1074539 - protein, 31 aa, Mycobacterium
IRLLRDRIHQGWILTALWVIDTGVTAATLEH

SEQ ID NO: 1074540 - protein, 18 aa, Mycobacterium
IRLRLFHGRGGTVGRGGG

SEQ ID NO: 1074541 - protein, 19 aa, Mycobacterium
IRNALGFNGYSLGAAPSGA

SEQ ID NO: 1074542 - protein, 17 aa, Mycobacterium
IRQILDRQPGYTKHLLD

SEQ ID NO: 1074543 - protein, 17 aa, Mycobacterium
IRQVFILGRPAPLRQHI

SEQ ID NO: 1074544 - protein, 23 aa, Mycobacterium
IRRKAGLPPATYFSGGKLQWILE

SEQ ID NO: 1074545 - protein, 22 aa, Mycobacterium
IRRQFHRGRLLAMGPRCLMTSM

SEQ ID NO: 1074546 - protein, 18 aa, Mycobacterium
IRSSLIHWAAANVSNPGA

SEQ ID NO: 1074547 - protein, 18 aa, Mycobacterium
IRTDPAAIRRRIGYVFPG

SEQ ID NO: 1074548 - protein, 21 aa, Mycobacterium
IRWSLDLLRRRFAKVIWVPGN

SEQ ID NO: 1074549 - protein, 19 aa, Mycobacterium
IRYDLGGGHPLLGRRMPDL

SEQ ID NO: 1074550 - protein, 17 aa, Mycobacterium
IRYDLPAGGRRLDQTAE

SEQ ID NO: 1074551 - protein, 17 aa, Mycobacterium
ISALRRRAKRRPLDEGV

SEQ ID NO: 1074552 - protein, 17 aa, Mycobacterium
ISAVLSVHFARQAAPFF

SEQ ID NO: 1074553 - protein, 18 aa, Mycobacterium
ISAVLSVHFARQAAPFFD

SEQ ID NO: 1074554 - protein, 24 aa, Mycobacterium
ISAVYDEPFWRADGLCGQSAAPTS

SEQ ID NO: 1074555 - protein, 21 aa, Mycobacterium
ISDDLLARFKSIPLLDEYDVY

SEQ ID NO: 1074556 - protein, 24 aa, Mycobacterium
ISDDLVDPKPFWEKPLALADVLDV

SEQ ID NO: 1074557 - protein, 21 aa, Mycobacterium
ISEVPGVLQALTSPLASAASS

SEQ ID NO: 1074558 - protein, 18 aa, Mycobacterium
ISFDEAFKLVKINPLVAW

SEQ ID NO: 1074559 - protein, 24 aa, Mycobacterium
ISFTHLLGYALVQAVKKFPNMNRH

SEQ ID NO: 1074560 - protein, 22 aa, Mycobacterium
ISGPEALWQFLCDRKSSIGRVP

SEQ ID NO: 1074561 - protein, 20 aa, Mycobacterium
ISHHCYGSFDLAFRCVQLLQ

SEQ ID NO: 1074562 - protein, 20 aa, Mycobacterium
ISKSIVRRLAALGGTAELST

SEQ ID NO: 1074563 - protein, 17 aa, Mycobacterium
ISLGWGLWDQASDMTGG

SEQ ID NO: 1074564 - protein, 23 aa, Mycobacterium
ISMYPRMWVASGVDYPTLLATMV

SEQ ID NO: 1074565 - protein, 23 aa, Mycobacterium
ISNVPGPRTPLYCAGRRVCEHYP

SEQ ID NO: 1074566 - protein, 22 aa, Mycobacterium
ISPDLMDILGSAAALPFGTDGA

SEQ ID NO: 1074567 - protein, 17 aa, Mycobacterium
ISPTTIYDKFPTLTPEQ

SEQ ID NO: 1074568 - protein, 30 aa, Mycobacterium; identical to SEQ ID NO: 827575

SEQ ID NO: 1074569 - protein, 25 aa, Mycobacterium
ISQAWRDWAAAPDGWLGIPNGEILC

SEQ ID NO: 1074570 - protein, 17 aa, Mycobacterium
ISQQTTAFHDRFVQTVN

SEQ ID NO: 1074571 - protein, 32 aa, Mycobacterium
ISRASFYIYFDDKGHLLRRLAGQVFDDLATGA

SEQ ID NO: 1074572 - protein, 25 aa, Mycobacterium
ISRWADVFASLLRPGGRLFMREGHP

SEQ ID NO: 1074573 - protein, 31 aa, Mycobacterium
ISSAAKMFNCTGWKIGWACGLKELIAGVRAA

SEQ ID NO: 1074574 - protein, 24 aa, Mycobacterium
ISSISGILRSLMGGLGAQGDSAAQ

SEQ ID NO: 1074575 - protein, 19 aa, Mycobacterium
ISSVYRRYLTERPLIFSEY

SEQ ID NO: 1074576 - protein, 31 aa, Mycobacterium; identical to SEQ ID NO: 827610

SEQ ID NO: 1074577 - protein, 25 aa, Mycobacterium
ISTEYLFRRDEDGDFWLVGRRGSVA

SEQ ID NO: 1074578 - protein, 24 aa, Mycobacterium
ISTGYLGPPPVPTSSPPTTPAGAP

SEQ ID NO: 1074579 - protein, 22 aa, Mycobacterium
ISVGCNNTCTFCIVPSLRGKEI

SEQ ID NO: 1074580 - protein, 23 aa, Mycobacterium
ISVKLIQPVAMDDGLRFAIREGG

SEQ ID NO: 1074581 - protein, 18 aa, Mycobacterium
ISWAYRNLSPYLDCPIVG

SEQ ID NO: 1074582 - protein, 23 aa, Mycobacterium
ITAALLRGVLRVFEDFRYIREIA

SEQ ID NO: 1074583 - protein, 18 aa, Mycobacterium
ITALLSPLAIEHTLQYRR

SEQ ID NO: 1074584 - protein, 21 aa, Mycobacterium
ITANLDGKIKYKIPGVGKVNV

SEQ ID NO: 1074585 - protein, 17 aa, Mycobacterium
ITDGASLAVGGFGLCGI

SEQ ID NO: 1074586 - protein, 24 aa, Mycobacterium
ITDGPMAGLLARAIVVIGADGKVS

SEQ ID NO: 1074587 - protein, 22 aa, Mycobacterium
ITDITPYWRPASWAAGVVVIDA

SEQ ID NO: 1074588 - protein, 26 aa, Mycobacterium
ITDMPERVVWLPLNSPGSAVYRQLGA

SEQ ID NO: 1074589 - protein, 25 aa, Mycobacterium
ITDPRLRRVFTFQSLYAGVAPQDAP

SEQ ID NO: 1074590 - protein, 17 aa, Mycobacterium
ITESLNLPPEALELTWR

SEQ ID NO: 1074591 - protein, 17 aa, Mycobacterium
ITEVDAYYFAPQKNFAS

SEQ ID NO: 1074592 - protein, 27 aa, Mycobacterium
ITGAKTWISNARRSGLIALLCKTDPHA

SEQ ID NO: 1074593 - protein, 19 aa, Mycobacterium
ITGPILRSTGLPHDLRKSE

SEQ ID NO: 1074594 - protein, 32 aa, Mycobacterium
ITLINEPVFNAPFSNFWLTPRQHRDALRTKGW

SEQ ID NO: 1074595 - protein, 22 aa, Mycobacterium
ITPGYDLRYLIGSRADTFERLT

SEQ ID NO: 1074596 - protein, 18 aa, Mycobacterium
ITPRVVFMEASDDMLVRR

SEQ ID NO: 1074597 - protein, 18 aa, Mycobacterium
ITPSARQRTLLLSLDNAA

SEQ ID NO: 1074598 - protein, 17 aa, Mycobacterium
ITQDLLDRTRKPFQSVI

SEQ ID NO: 1074599 - protein, 23 aa, Mycobacterium
ITQGMMAFIDFPDQWELYKRERP

SEQ ID NO: 1074600 - protein, 18 aa, Mycobacterium
ITRLPFVAPHHSSSVVAL

SEQ ID NO: 1074601 - protein, 20 aa, Mycobacterium
ITRPPDVLITTPESLFLMLT

SEQ ID NO: 1074602 - protein, 24 aa, Mycobacterium
ITRSHLQIEILPGLAATSAVPTYA

SEQ ID NO: 1074603 - protein, 25 aa, Mycobacterium
ITSDRLYPLRLQQELADLLPGCAGL

SEQ ID NO: 1074604 - protein, 21 aa, Mycobacterium
ITTPDGWVLALGAKDEKHVPV

SEQ ID NO: 1074605 - protein, 25 aa, Mycobacterium
ITVGRISYLLGLRGPSLAVDTACSS

SEQ ID NO: 1074606 - protein, 20 aa, Mycobacterium
ITVGRISYLLGLRGPSVAVD

SEQ ID NO: 1074607 - protein, 33 aa, Mycobacterium
ITVLLPSVLGHSFTFMTPAAFVRRPGRWIRELA

SEQ ID NO: 1074608 - protein, 35 aa, Mycobacterium
ITVLLPSVLGHSFTFMTPAAFVRRPGRWIRELARK

SEQ ID NO: 1074609 - protein, 26 aa, Mycobacterium
ITWEHDMHLYFKRAHGSTHLLASPPE

SEQ ID NO: 1074610 - protein, 18 aa, Mycobacterium
IVADFRPGPDCRLGVLVD

SEQ ID NO: 1074611 - protein, 18 aa, Mycobacterium
IVADSWRRSLATGVDPDR

SEQ ID NO: 1074612 - protein, 19 aa, Mycobacterium
IVAFVGRITRQKGVPHLLA

SEQ ID NO: 1074613 - protein, 19 aa, Mycobacterium
IVAGWHDRPWAHHVPVMRE

SEQ ID NO: 1074614 - protein, 17 aa, Mycobacterium
IVAKLFGFPTTIAHGMF

SEQ ID NO: 1074615 - protein, 20 aa, Mycobacterium
IVALRYRQMRNFWATLMVSQ

SEQ ID NO: 1074616 - protein, 17 aa, Mycobacterium
IVARWHAHARALTTSAV

SEQ ID NO: 1074617 - protein, 17 aa, Mycobacterium
IVAVDRKIWSGAGTFLF

SEQ ID NO: 1074618 - protein, 20 aa, Mycobacterium
IVCPWHGWQWRGDGTNALIP

SEQ ID NO: 1074619 - protein, 38 aa, Mycobacterium
IVDDYDRFLPYTTRSPWPRAPILVRQYLRSRAAWPIFG

SEQ ID NO: 1074620 - protein, 17 aa, Mycobacterium
IVDINLVGSFNVLRLAA

SEQ ID NO: 1074621 - protein, 27 aa, Mycobacterium
IVDNTIATPYLIRPFTQGADIVVHSAT

SEQ ID NO: 1074622 - protein, 20 aa, Mycobacterium
IVDPQLPWPSGVAPAPELAR

SEQ ID NO: 1074623 - protein, 27 aa, Mycobacterium
IVEEPPEHLIFIFATTEPEKVLPTIRS

SEQ ID NO: 1074624 - protein, 23 aa, Mycobacterium
IVELGHLFRLPIAALGNGATIRN

SEQ ID NO: 1074625 - protein, 19 aa, Mycobacterium
IVEYIGQTRGWFYTLHVLA

SEQ ID NO: 1074626 - protein, 34 aa, Mycobacterium
IVFNGLPPGDFPAPIFVIVLKGLTIRGSIVGTRQ

SEQ ID NO: 1074627 - protein, 19 aa, Mycobacterium
IVGGGPYLETLRKLARDCE

SEQ ID NO: 1074628 - protein, 27 aa, Mycobacterium
IVGGMGGLGFVVARWLAEQGAGLIVLN

SEQ ID NO: 1074629 - protein, 18 aa, Mycobacterium
IVGKLSVPPSWTGAAPLA

SEQ ID NO: 1074630 - protein, 20 aa, Mycobacterium
IVHAALAPGAIIAELGNDAQ

SEQ ID NO: 1074631 - protein, 25 aa, Mycobacterium
IVHSAAWVNFVYPYQHLKATNVEST

SEQ ID NO: 1074632 - protein, 17 aa, Mycobacterium
IVKAYFRARAAPGGQRL

SEQ ID NO: 1074633 - protein, 26 aa, Mycobacterium
IVKTTLEELWWDRPFTLEGVDIGASV

SEQ ID NO: 1074634 - protein, 25 aa, Mycobacterium
IVLHPQQRVAMRVAWKALENSGINP

SEQ ID NO: 1074635 - protein, 19 aa, Mycobacterium
IVNDFFVSGRLPPAGLELP

SEQ ID NO: 1074636 - protein, 26 aa, Mycobacterium
IVPADGFLPALQRWSRDNDVVFIADE

SEQ ID NO: 1074637 - protein, 34 aa, Mycobacterium; identical to SEQ ID NO: 828036

SEQ ID NO: 1074638 - protein, 19 aa, Mycobacterium
IVPHIVWGAQRIWTKGHKK

SEQ ID NO: 1074639 - protein, 18 aa, Mycobacterium
IVPVFTRHDFDGPVSFVD

SEQ ID NO: 1074640 - protein, 19 aa, Mycobacterium
IVQLTRDSMRIYGSRNFAA

SEQ ID NO: 1074641 - protein, 34 aa, Mycobacterium
IVQSFLNIDVPLQALGRLPLLSVGGYRRIELRSG

SEQ ID NO: 1074642 - protein, 24 aa, Mycobacterium
IVQSMFIGPIFNPLLKMLGADKIA

SEQ ID NO: 1074643 - protein, 17 aa, Mycobacterium
IVRHFFVCSTHDWILFF

SEQ ID NO: 1074644 - protein, 17 aa, Mycobacterium
IVRKNRHWYSTGADFKR

SEQ ID NO: 1074645 - protein, 17 aa, Mycobacterium
IVRPTRVATLGAAPPES

SEQ ID NO: 1074646 - protein, 25 aa, Mycobacterium
IVRRSNALLDWAYGKRFQYTEHMSL

SEQ ID NO: 1074647 - protein, 23 aa, Mycobacterium
IVTPRVMQFTLRANVPKLADIRI

SEQ ID NO: 1074648 - protein, 27 aa, Mycobacterium
IVTQWPYTELEYARRTWRIRPRDWLHH

SEQ ID NO: 1074649 - protein, 22 aa, Mycobacterium
IVTWRFWAAKLGISVDDISATA

SEQ ID NO: 1074650 - protein, 17 aa, Mycobacterium
IVVPLDTKLLPVTPPVL

SEQ ID NO: 1074651 - protein, 26 aa, Mycobacterium
IVVSGNYRAWRHFIAMRASEHADVEI

SEQ ID NO: 1074652 - protein, 19 aa, Mycobacterium
IWHVLRPLSGADLQRAPRL

SEQ ID NO: 1074653 - protein, 18 aa, Mycobacterium
IYDKFPTLTPEQAAGVIT

SEQ ID NO: 1074654 - protein, 20 aa, Mycobacterium
IYELEALLEMVFHRGSKMHD

SEQ ID NO: 1074655 - protein, 18 aa, Mycobacterium
IYIIDLQQTLTFIDKAYE

SEQ ID NO: 1074656 - protein, 19 aa, Mycobacterium
IYLAAHRGPPRGSGLLRRT

SEQ ID NO: 1074657 - protein, 18 aa, Mycobacterium
IYLPLSNLTAFQTALLDP

SEQ ID NO: 1074658 - protein, 18 aa, Mycobacterium
IYLTFTLPVDAHADTYFR

SEQ ID NO: 1074659 - protein, 19 aa, Mycobacterium
IYMHYLTGCSDLFRDHYTD

SEQ ID NO: 1074660 - protein, 17 aa, Mycobacterium
IYQRTTAGWQPLKAGIT

SEQ ID NO: 1074661 - protein, 17 aa, Mycobacterium
IYQVGGKSFVFFRTPQP

SEQ ID NO: 1074662 - protein, 30 aa, Mycobacterium; identical to SEQ ID NO: 115465

SEQ ID NO: 1074663 - protein, 33 aa, Mycobacterium; identical to SEQ ID NO: 828191

SEQ ID NO: 1074664 - protein, 19 aa, Mycobacterium
IYYGSFHAVAEVSLSILPR

SEQ ID NO: 1074665 - protein, 28 aa, Mycobacterium
KAAAAERPWWEWAATYERAFTAAYDALD

SEQ ID NO: 1074666 - protein, 26 aa, Mycobacterium
KAAALPIYVHAPYLINLASANNKVRI

SEQ ID NO: 1074667 - protein, 20 aa, Mycobacterium
KAAIILPHGVLFRGHAEATI

SEQ ID NO: 1074668 - protein, 23 aa, Mycobacterium
KAAITAVRAWRRAKPGKAKKAGG

SEQ ID NO: 1074669 - protein, 21 aa, Mycobacterium
KAAPVLWTQQALTTGQLRAVI

SEQ ID NO: 1074670 - protein, 17 aa, Mycobacterium
KAARFVRTCDCFNIPIV

SEQ ID NO: 1074671 - protein, 24 aa, Mycobacterium
KACPWLGDHKVFGQAIMPAAGFAE

SEQ ID NO: 1074672 - protein, 30 aa, Mycobacterium
KAGGRAVVMTYWNPVLRYGGDAFARDLAAA

SEQ ID NO: 1074673 - protein, 31 aa, Mycobacterium; identical to SEQ ID NO: 828292

SEQ ID NO: 1074674 - protein, 28 aa, Mycobacterium
KAGRPTPEMLAYQYLQTLPEMARGDANK

SEQ ID NO: 1074675 - protein, 17 aa, Mycobacterium
KAGTIAVPLFAPELPGH

SEQ ID NO: 1074676 - protein, 17 aa, Mycobacterium
KAILGLLDVDLLAAVGA

SEQ ID NO: 1074677 - protein, 28 aa, Mycobacterium
KALHRRCADVRYLGSWPTGQTYAAQPPP

SEQ ID NO: 1074678 - protein, 17 aa, Mycobacterium
KALLAKRGFDPVLGARP

SEQ ID NO: 1074679 - protein, 30 aa, Mycobacterium; identical to SEQ ID NO: 828377

SEQ ID NO: 1074680 - protein, 20 aa, Mycobacterium
KAPFVVFDDADLDAAIQGAV

SEQ ID NO: 1074681 - protein, 20 aa, Mycobacterium
KAQLFHTSGHLDWYADGMFP

SEQ ID NO: 1074682 - protein, 21 aa, Mycobacterium
KARALRVIDWFLSATTERRYE

SEQ ID NO: 1074683 - protein, 20 aa, Mycobacterium
KARFIVWPPSRWGVVRSVNP

SEQ ID NO: 1074684 - protein, 25 aa, Mycobacterium
KARIDAARLLVWRAGWMARNNHNFD

SEQ ID NO: 1074685 - protein, 17 aa, Mycobacterium
KARVLTGRVAVVGLDDS

SEQ ID NO: 1074686 - protein, 24 aa, Mycobacterium
KASAAYMLGLLLQSESVAVSDLGA

SEQ ID NO: 1074687 - protein, 24 aa, Mycobacterium
KATLAFAFSHRSYLDGMLLPEVIQ

SEQ ID NO: 1074688 - protein, 21 aa, Mycobacterium
KATPTTPPFKATYDAQVRLAD

SEQ ID NO: 1074689 - protein, 24 aa, Mycobacterium
KAVADKMMSVLTGLGLKSFGAEGE

SEQ ID NO: 1074690 - protein, 28 aa, Mycobacterium
KAVHVSAIKFPNLELGLPAIDINIGTGP

SEQ ID NO: 1074691 - protein, 17 aa, Mycobacterium
KAVLLKLVTRMIRARVF

SEQ ID NO: 1074692 - protein, 17 aa, Mycobacterium
KAVPTPGSLPALFAAQV

SEQ ID NO: 1074693 - protein, 22 aa, Mycobacterium
KAVVLNIFPSIDTPVCATSVRT

SEQ ID NO: 1074694 - protein, 26 aa, Mycobacterium
KAWALTPSELILYLPDYPVAHDNPIN

SEQ ID NO: 1074695 - protein, 26 aa, Mycobacterium
KAYAEGLRALYLYTATFQDAAVAEAA

SEQ ID NO: 1074696 - protein, 30 aa, Mycobacterium
KCLCRKHHLLKTFWGWRDQQLPDGTVIWGL

SEQ ID NO: 1074697 - protein, 27 aa, Mycobacterium
KCLRSTFMYLGWLCGAGPNNAALSAAA

SEQ ID NO: 1074698 - protein, 26 aa, Mycobacterium
KCNWYKLSEMPVLWAYARDLFQTPGF

SEQ ID NO: 1074699 - protein, 23 aa, Mycobacterium
KCQQAWCPVCALTALVIGEQHPL

SEQ ID NO: 1074700 - protein, 18 aa, Mycobacterium
KDAAAPLWTFPRVAWERE

SEQ ID NO: 1074701 - protein, 26 aa, Mycobacterium
KDAEVWDRLTGNFWLPEKVPVSNDIP

SEQ ID NO: 1074702 - protein, 20 aa, Mycobacterium
KDAFLLIRRGDTQTAVHLSD

SEQ ID NO: 1074703 - protein, 22 aa, Mycobacterium
KDARFDGWFVTAVLTTRIYCRP

SEQ ID NO: 1074704 - protein, 26 aa, Mycobacterium
KDDIFFYVYGLLHDPAYRSTYAADLK

SEQ ID NO: 1074705 - protein, 32 aa, Mycobacterium; identical to SEQ ID NO: 828521

SEQ ID NO: 1074706 - protein, 33 aa, Mycobacterium
KDFVSSLQLLLTFPFPNFGIKQAVRGDYLNVFT

SEQ ID NO: 1074707 - protein, 17 aa, Mycobacterium
KDLLIVYGRNHSPDDIE

SEQ ID NO: 1074708 - protein, 26 aa, Mycobacterium
KDQVVAHLLNLILTGKLRSGDRVDRN

SEQ ID NO: 1074709 - protein, 20 aa, Mycobacterium
KDRIIEYLAVRARRAQRGLQ

SEQ ID NO: 1074710 - protein, 27 aa, Mycobacterium
KDRLPKRRWWGWGINPQFRILRQPARW

SEQ ID NO: 1074711 - protein, 24 aa, Mycobacterium
KDVLGDYGVFLRSLVNTADLRPLR

SEQ ID NO: 1074712 - protein, 21 aa, Mycobacterium
KEAKIAFLMLPGVGTKEDIKE

SEQ ID NO: 1074713 - protein, 22 aa, Mycobacterium
KEEFNETIRYFSTMLAKHGVDV

SEQ ID NO: 1074714 - protein, 26 aa, Mycobacterium
KEFMVRNTYIYPPKPSMRIISDIFAY

SEQ ID NO: 1074715 - protein, 23 aa, Mycobacterium
KEIRDIVAYLRVLDNPGDAVSMR

SEQ ID NO: 1074716 - protein, 20 aa, Mycobacterium
KELAEHLMLVDLGRNDLGRV

SEQ ID NO: 1074717 - protein, 20 aa, Mycobacterium
KELAWLRRGPPARTSKPKFR

SEQ ID NO: 1074718 - protein, 28 aa, Mycobacterium
KELCRRWYPRIYFGQPPKGLAHRALADI

SEQ ID NO: 1074719 - protein, 23 aa, Mycobacterium
KELLPERLVVVDELPRSSGGKIA

SEQ ID NO: 1074720 - protein, 20 aa, Mycobacterium
KEPHYGPPPLLLRMVEAGQL

SEQ ID NO: 1074721 - protein, 19 aa, Mycobacterium
KEPLYRLYELRLRQGLAAT

SEQ ID NO: 1074722 - protein, 20 aa, Mycobacterium
KETQLTVLFPNNPVARESVT

SEQ ID NO: 1074723 - protein, 26 aa, Mycobacterium
KEWAQLLMVAVRIASLPGLLSTTTVF

SEQ ID NO: 1074724 - protein, 24 aa, Mycobacterium
KFFEPGYQRFFVERFPGIVERIDT

SEQ ID NO: 1074725 - protein, 23 aa, Mycobacterium
KFGYNAWVLVYDIETVRTINEAY

SEQ ID NO: 1074726 - protein, 25 aa, Mycobacterium
KFGYQRPLYTLAHYGVFITPFRASL

SEQ ID NO: 1074727 - protein, 19 aa, Mycobacterium
KFHLRDLAVTFRFGEEVTA

SEQ ID NO: 1074728 - protein, 27 aa, Mycobacterium
KFHQRILNTHPALLPAFPGAHGVADAL

SEQ ID NO: 1074729 - protein, 17 aa, Mycobacterium
KFIGDAVMWVSSTPQRL

SEQ ID NO: 1074730 - protein, 20 aa, Mycobacterium
KFIRGRFAKERTRVIAVDAV

SEQ ID NO: 1074731 - protein, 21 aa, Mycobacterium
KFKIPRYLRLVDEFPMTVTGK

SEQ ID NO: 1074732 - protein, 26 aa, Mycobacterium
KFLREYPYRDAYLLRDARLFRSELSM

SEQ ID NO: 1074733 - protein, 39 aa, Mycobacterium; identical to SEQ ID NO: 828756

SEQ ID NO: 1074734 - protein, 18 aa, Mycobacterium
KFMAIWRASKPVIAQIHG

SEQ ID NO: 1074735 - protein, 29 aa, Mycobacterium
KFMQRLNSVLPLWLQYGGSPAQAAALCPD

SEQ ID NO: 1074736 - protein, 26 aa, Mycobacterium
KGAALAWIRSLIFEDSRVLPMYVGDD

SEQ ID NO: 1074737 - protein, 17 aa, Mycobacterium
KGADAAAFSGAAGGNGG

SEQ ID NO: 1074738 - protein, 23 aa, Mycobacterium
KGAFEMAATIDYLFGYDATAGVM

SEQ ID NO: 1074739 - protein, 26 aa, Mycobacterium
KGAGLGKDVLLLTDGRFSGGTTGFCV

SEQ ID NO: 1074740 - protein, 24 aa, Mycobacterium
KGAIEIALIHRPRYDDWSLPKGKV

SEQ ID NO: 1074741 - protein, 31 aa, Mycobacterium; identical to SEQ ID NO: 828803

SEQ ID NO: 1074742 - protein, 23 aa, Mycobacterium
KGEFGQFLARLAEKSTTATPHKF

SEQ ID NO: 1074743 - protein, 24 aa, Mycobacterium
KGEVKDVLLLDVTPLSLGIETKGG

SEQ ID NO: 1074744 - protein, 18 aa, Mycobacterium
KGFKSFAAPTTLRFEPGI

SEQ ID NO: 1074745 - protein, 27 aa, Mycobacterium
KGGAGGPGGLFGAGGLGGAGGFGGSGG

SEQ ID NO: 1074746 - protein, 18 aa, Mycobacterium
KGGHGGLLYGNGGAGGIG

SEQ ID NO: 1074747 - protein, 21 aa, Mycobacterium
KGGNAVLFGAGGNGGIGGTGA

SEQ ID NO: 1074748 - protein, 30 aa, Mycobacterium
KGILFLHVHVFARYYRYPFRPATIGSYRSA

SEQ ID NO: 1074749 - protein, 26 aa, Mycobacterium
KGKGVMRTWYLIGRKPIDEPTAVPAD

SEQ ID NO: 1074750 - protein, 22 aa, Mycobacterium
KGKNFYHMLATRYGYGAEADRI

SEQ ID NO: 1074751 - protein, 25 aa, Mycobacterium
KGKRYALPHARILMHQPLGGVTGSA

SEQ ID NO: 1074752 - protein, 22 aa, Mycobacterium
KGLGGGLPIGAFLATGPAAELL

SEQ ID NO: 1074753 - protein, 19 aa, Mycobacterium
KGLILISRLEMVNTLGVVA

SEQ ID NO: 1074754 - protein, 18 aa, Mycobacterium
KGLQLDIGAPPQFMDFRY

SEQ ID NO: 1074755 - protein, 17 aa, Mycobacterium
KGLRRRAAAAGLDVIMI

SEQ ID NO: 1074756 - protein, 17 aa, Mycobacterium
KGLRRWRSAVRSAARQS

SEQ ID NO: 1074757 - protein, 33 aa, Mycobacterium; identical to SEQ ID NO: 828879

SEQ ID NO: 1074758 - protein, 24 aa, Mycobacterium
KGNTRRLASLGPLLQGIEARIVDA

SEQ ID NO: 1074759 - protein, 27 aa, Mycobacterium
KGPIGKILRLIPLTKPLFGSYREKIAE

SEQ ID NO: 1074760 - protein, 23 aa, Mycobacterium
KGPKIRIHKFKNKTGYHKRQGHR

SEQ ID NO: 1074761 - protein, 26 aa, Mycobacterium
KGRLTLPAKFRDALAGGLMVTKSQDH

SEQ ID NO: 1074762 - protein, 32 aa, Mycobacterium
KGRRTVWIPWALRPMFFVLRPLPQFVWRKMPR

SEQ ID NO: 1074763 - protein, 20 aa, Mycobacterium
KGTMVIRPYGYRIWELLQDE

SEQ ID NO: 1074764 - protein, 20 aa, Mycobacterium
KGVLMAVYRVSAEEAFRVLQ

SEQ ID NO: 1074765 - protein, 20 aa, Mycobacterium
KGVLWRQHDIFMTSFGGRDL

SEQ ID NO: 1074766 - protein, 19 aa, Mycobacterium
KGVPGRWRLCALVREHLTG

SEQ ID NO: 1074767 - protein, 20 aa, Mycobacterium
KGYCFQIEMTWRSVNSGFVV

SEQ ID NO: 1074768 - protein, 18 aa, Mycobacterium
KGYRNPIVPDPFAESGWF

SEQ ID NO: 1074769 - protein, 18 aa, Mycobacterium
KHCADIPEFPADVTKMVA

SEQ ID NO: 1074770 - protein, 27 aa, Mycobacterium
KHEAALFRLMRSPLMPITPRAITSMFT

SEQ ID NO: 1074771 - protein, 28 aa, Mycobacterium
KHIAGVDTFFVATAPRYSFVSSSLAKEV

SEQ ID NO: 1074772 - protein, 24 aa, Mycobacterium
KHKSLTMFLVPLDSAGIEIQGIRT

SEQ ID NO: 1074773 - protein, 17 aa, Mycobacterium
KHWVIDEIRPARIHANL

SEQ ID NO: 1074774 - protein, 24 aa, Mycobacterium
KIAAPDWTAIFSDALIGYAMKRRD

SEQ ID NO: 1074775 - protein, 24 aa, Mycobacterium
KIADYPFTTLVPNLGVVAAGGHSF

SEQ ID NO: 1074776 - protein, 19 aa, Mycobacterium
KIAFLNWAYEEDPPIDLTL

SEQ ID NO: 1074777 - protein, 27 aa, Mycobacterium
KIETEILWGRPLTKLLEESRTAVMVCV

SEQ ID NO: 1074778 - protein, 20 aa, Mycobacterium
KIGADFYFSVRTMEERLGAN

SEQ ID NO: 1074779 - protein, 27 aa, Mycobacterium
KIGYPPTRVWGVPAAGLWAHRLGDQRA

SEQ ID NO: 1074780 - protein, 19 aa, Mycobacterium
KIHRLWCQEGLQVAARSPR

SEQ ID NO: 1074781 - protein, 21 aa, Mycobacterium
KIIGRQFIRAFEGAVRDVLDG

SEQ ID NO: 1074782 - protein, 21 aa, Mycobacterium
KILSAFFAHRHRRLRKSLAKT

SEQ ID NO: 1074783 - protein, 21 aa, Mycobacterium
KIPAAEFFTGLWETAMEPDEV

SEQ ID NO: 1074784 - protein, 32 aa, Mycobacterium
KIPGVGKVNVKLYWDLKISPITFSDSTISGPT

SEQ ID NO: 1074785 - protein, 17 aa, Mycobacterium
KIRILTNKIVLAVDGET

SEQ ID NO: 1074786 - protein, 26 aa, Mycobacterium
KISSLPDLLPLLEKVAESGKPLMIIA

SEQ ID NO: 1074787 - protein, 19 aa, Mycobacterium
KITFDKIDQRLTVLGIDNT

SEQ ID NO: 1074788 - protein, 19 aa, Mycobacterium
KITTRPRGHRPGEKSWGHR

SEQ ID NO: 1074789 - protein, 28 aa, Mycobacterium
KIVEGRLNGFFKDAVLLEQPSVSDSKKS

SEQ ID NO: 1074790 - protein, 19 aa, Mycobacterium
KIWEALIIVYPNGTPRTKH

SEQ ID NO: 1074791 - protein, 23 aa, Mycobacterium
KIWSGAGTFLFTRTTVGEIGILP

SEQ ID NO: 1074792 - protein, 24 aa, Mycobacterium
KKCGVVNWMRLADKLQPILDAVAK

SEQ ID NO: 1074793 - protein, 35 aa, Mycobacterium
KKNVRIRSYPSIQWYGFILVWQERHGRPPYWQPPV

SEQ ID NO: 1074794 - protein, 17 aa, Mycobacterium
KKQVRCVYVAVGQKGTT

SEQ ID NO: 1074795 - protein, 25 aa, Mycobacterium
KKRPEFGKLTPLYPNQRLRLETTPD

SEQ ID NO: 1074796 - protein, 25 aa, Mycobacterium
KLAELQRLWLIEATKYNVVPLDDRG

SEQ ID NO: 1074797 - protein, 26 aa, Mycobacterium
KLAEQDALFRNLLEIAPVPVRELANA

SEQ ID NO: 1074798 - protein, 21 aa, Mycobacterium
KLARPQLKKHYGELLEQIYTD

SEQ ID NO: 1074799 - protein, 21 aa, Mycobacterium
KLASRMLLQVHDELLFEVAIG

SEQ ID NO: 1074800 - protein, 35 aa, Mycobacterium; identical to SEQ ID NO: 829140

SEQ ID NO: 1074801 - protein, 35 aa, Mycobacterium; identical to SEQ ID NO: 829141

SEQ ID NO: 1074802 - protein, 21 aa, Mycobacterium
KLDITKWTFLNTDLAVHVFRI

SEQ ID NO: 1074803 - protein, 22 aa, Mycobacterium
KLDLVRYYLSVADGALRGVAGR

SEQ ID NO: 1074804 - protein, 22 aa, Mycobacterium
KLELRRVAIFGGTVETYLHRRA

SEQ ID NO: 1074805 - protein, 26 aa, Mycobacterium
KLERYDETLFLVLKTVNYVPHESVVL

SEQ ID NO: 1074806 - protein, 19 aa, Mycobacterium
KLGAQNALAKLPKGIQKDP

SEQ ID NO: 1074807 - protein, 29 aa, Mycobacterium
KLGTEQLFGTTFYVLAHPCPMCLGSQELN

SEQ ID NO: 1074808 - protein, 19 aa, Mycobacterium
KLLAYYQRDGVLVGVVGGG

SEQ ID NO: 1074809 - protein, 17 aa, Mycobacterium
KLLEHGGHIAFTASFAG

SEQ ID NO: 1074810 - protein, 17 aa, Mycobacterium
KLLLDPYGKAFDGDFTF

SEQ ID NO: 1074811 - protein, 20 aa, Mycobacterium
KLPAIRQQIWTLIRAAKMDH

SEQ ID NO: 1074812 - protein, 37 aa, Mycobacterium
KLPQVFFVNWFRRGEDHRFLWPGFGENSRVMKWIVDR

SEQ ID NO: 1074813 - protein, 34 aa, Mycobacterium; identical to SEQ ID NO: 783257

SEQ ID NO: 1074814 - protein, 25 aa, Mycobacterium
KLSAPRVIWVMVPAGTITTGVIEEL

SEQ ID NO: 1074815 - protein, 19 aa, Mycobacterium
KLSARAAARYYLTGAKFGA

SEQ ID NO: 1074816 - protein, 18 aa, Mycobacterium
KLSDYAQRRFGVGIAVRA

SEQ ID NO: 1074817 - protein, 27 aa, Mycobacterium
KLSVPPSWTGAAPLASPLGSALGGTPM

SEQ ID NO: 1074818 - protein, 21 aa, Mycobacterium
KLTARLPGYMLPSAIVTVESL

SEQ ID NO: 1074819 - protein, 25 aa, Mycobacterium
KLTGIPPDLAIYRLTTRKDLATIGD

SEQ ID NO: 1074820 - protein, 24 aa, Mycobacterium
KLTPDRFIHELLFEHLHVVEVVVG

SEQ ID NO: 1074821 - protein, 19 aa, Mycobacterium
KLVAEGVVLAPPPQALVHA

SEQ ID NO: 1074822 - protein, 20 aa, Mycobacterium
KLVDGPIEAIRMLRVARSDA

SEQ ID NO: 1074823 - protein, 27 aa, Mycobacterium
KLVDTIKARLPVWKHQFFGDGSEEWVG

SEQ ID NO: 1074824 - protein, 20 aa, Mycobacterium
KLWHRLCAELELPALHAPPE

SEQ ID NO: 1074825 - protein, 19 aa, Mycobacterium
KLYALRDITGTVESLPLIA

SEQ ID NO: 1074826 - protein, 18 aa, Mycobacterium
KMAADFPMISLVNSVNPV

SEQ ID NO: 1074827 - protein, 28 aa, Mycobacterium
KMAAVAKRRGWPILKFNSRGGVGIGAQL

SEQ ID NO: 1074828 - protein, 33 aa, Mycobacterium
KMADTAWFVIREQNLRLNWLKDVDKKRPFYFGA

SEQ ID NO: 1074829 - protein, 23 aa, Mycobacterium
KMDPQQRLLLEVAWEALEHAGIP

SEQ ID NO: 1074830 - protein, 19 aa, Mycobacterium
KMFQVVPNPAWVARPGQYA

SEQ ID NO: 1074831 - protein, 17 aa, Mycobacterium
KMGLPVLAVVAFAQSFG

SEQ ID NO: 1074832 - protein, 19 aa, Mycobacterium
KMLSLLWQSLRRQRELSKR

SEQ ID NO: 1074833 - protein, 24 aa, Mycobacterium
KMNGQLEKARWFGKTFTSPTDVQP

SEQ ID NO: 1074834 - protein, 35 aa, Mycobacterium; identical to SEQ ID NO: 829367

SEQ ID NO: 1074835 - protein, 40 aa, Mycobacterium
KNAYVGRTFIQPSQTIRQLGIRLKLNPLKDVIRAKRLIVV

SEQ ID NO: 1074836 - protein, 32 aa, Mycobacterium
KNEPEWMLQTRLKALRIFERKPMPNWGSNLAG

SEQ ID NO: 1074837 - protein, 24 aa, Mycobacterium
KNGADWVPTLFKGLKGVYKKMPNA

SEQ ID NO: 1074838 - protein, 21 aa, Mycobacterium
KNKLKYYERIGACKANAAGIE

SEQ ID NO: 1074839 - protein, 28 aa, Mycobacterium
KNNVLTFAGSLWWRTVQEIGEEYPDVEL

SEQ ID NO: 1074840 - protein, 26 aa, Mycobacterium
KNPKEHFNFFPLTVDVEERMYAAGRI

SEQ ID NO: 1074841 - protein, 22 aa, Mycobacterium
KNPLFLDEQLTRAEFQRITQDL

SEQ ID NO: 1074842 - protein, 30 aa, Mycobacterium
KNPRRVLGLHFFNPVPVLPLVELVNTLVTD

SEQ ID NO: 1074843 - protein, 17 aa, Mycobacterium
KNRGVADIFFLVCDGLK

SEQ ID NO: 1074844 - protein, 18 aa, Mycobacterium
KNVFAIAVGMGYSLGIGE

SEQ ID NO: 1074845 - protein, 18 aa, Mycobacterium
KPAELHPFVPLTGPRHNA

SEQ ID NO: 1074846 - protein, 17 aa, Mycobacterium
KPAPHEFIPFSGGLHRC

SEQ ID NO: 1074847 - protein, 18 aa, Mycobacterium
KPAVLVVSAIPLAEPVRV

SEQ ID NO: 1074848 - protein, 17 aa, Mycobacterium
KPDLVIMDVKMPRRDGI

SEQ ID NO: 1074849 - protein, 26 aa, Mycobacterium
KPEKLAKFRDAEGLTFPLLSDPDRKV

SEQ ID NO: 1074850 - protein, 30 aa, Mycobacterium; identical to SEQ ID NO: 829498

SEQ ID NO: 1074851 - protein, 19 aa, Mycobacterium
KPEWSERWPEFVASFTAAT

SEQ ID NO: 1074852 - protein, 32 aa, Mycobacterium; identical to SEQ ID NO: 829511

SEQ ID NO: 1074853 - protein, 20 aa, Mycobacterium
KPGDLALLIGYGAGLSYAAQ

SEQ ID NO: 1074854 - protein, 26 aa, Mycobacterium
KPGEPSWPTPWGRGRPGWHLECSAMA

SEQ ID NO: 1074855 - protein, 35 aa, Mycobacterium
KPGGGHPILYVAQAWDWIFPLTEDPNYEPAAADSI

SEQ ID NO: 1074856 - protein, 20 aa, Mycobacterium
KPGTYGAGLLQLIDSRNWRD

SEQ ID NO: 1074857 - protein, 19 aa, Mycobacterium
KPIIINFQVPIADQAMAES

SEQ ID NO: 1074858 - protein, 23 aa, Mycobacterium
KPITAAPEPPAPRAPLGAVCEAT

SEQ ID NO: 1074859 - protein, 32 aa, Mycobacterium; identical to SEQ ID NO: 829553

SEQ ID NO: 1074860 - protein, 19 aa, Mycobacterium
KPLTVIRASLRPAQRWMLS

SEQ ID NO: 1074861 - protein, 17 aa, Mycobacterium
KPNLGRFGSFGRGVTPA

SEQ ID NO: 1074862 - protein, 26 aa, Mycobacterium
KPQRGRISTWPWPETFNGITVNGVLA

SEQ ID NO: 1074863 - protein, 34 aa, Mycobacterium; identical to SEQ ID NO: 829589

SEQ ID NO: 1074864 - protein, 24 aa, Mycobacterium
KPSPFAASLLFGYVGAFMYEGDVP

SEQ ID NO: 1074865 - protein, 26 aa, Mycobacterium
KPSRVPVWFMRQAGRSLPEYRALRRQ

SEQ ID NO: 1074866 - protein, 26 aa, Mycobacterium
KPTISVGAWLQYLLDNFGTVAEAVQA

SEQ ID NO: 1074867 - protein, 23 aa, Mycobacterium
KPTTMLLGLWYDDEFVRTAEGWR

SEQ ID NO: 1074868 - protein, 24 aa, Mycobacterium
KPVAHLAYRFAQSSTVLFLGRHVG

SEQ ID NO: 1074869 - protein, 17 aa, Mycobacterium
KPVKGMLTGPVTILAWS

SEQ ID NO: 1074870 - protein, 28 aa, Mycobacterium
KPVNVARFPTFDWPRIDAPYIRPDADMD

SEQ ID NO: 1074871 - protein, 27 aa, Mycobacterium
KPVPQRGWRRWVHAVTRINFGLSPDEK

SEQ ID NO: 1074872 - protein, 17 aa, Mycobacterium
KPVPRDVLMECLQLALQ

SEQ ID NO: 1074873 - protein, 17 aa, Mycobacterium
KQAAFEPLPGHVTHVPY

SEQ ID NO: 1074874 - protein, 23 aa, Mycobacterium
KQADALMLLYLLSADELGESLNR

SEQ ID NO: 1074875 - protein, 27 aa, Mycobacterium
KQGSPNLFMNILTTNGLCVRFLTDWAG

SEQ ID NO: 1074876 - protein, 26 aa, Mycobacterium
KQKFLRPLFTGEHLYCQLFSEPGAGS

SEQ ID NO: 1074877 - protein, 22 aa, Mycobacterium
KQLYAPLAKAALSLGVQFYPHT

SEQ ID NO: 1074878 - protein, 23 aa, Mycobacterium
KQSLAYWDRTLTGMPARLELPTD

SEQ ID NO: 1074879 - protein, 17 aa, Mycobacterium
KQVLMSLALALAQISDH

SEQ ID NO: 1074880 - protein, 17 aa, Mycobacterium
KQYTAYLPSRPHLEWQL

SEQ ID NO: 1074881 - protein, 27 aa, Mycobacterium
KRAGGQIWLMPHNPAFDPIPGNDATVL

SEQ ID NO: 1074882 - protein, 18 aa, Mycobacterium
KRALLVLAPGDRVTHDKY

SEQ ID NO: 1074883 - protein, 20 aa, Mycobacterium
KRETTLLRPVSVFINLAMQA

SEQ ID NO: 1074884 - protein, 23 aa, Mycobacterium
KRETTLLRPVSVFINLAMQAHSA

SEQ ID NO: 1074885 - protein, 23 aa, Mycobacterium
KRFPQLTVLSIAPLLASTIRAIF

SEQ ID NO: 1074886 - protein, 18 aa, Mycobacterium
KRGLKMFLSPDGHAVRFI

SEQ ID NO: 1074887 - protein, 30 aa, Mycobacterium
KRHGEWMVPTRLALVRRLGSIELDLTKARF

SEQ ID NO: 1074888 - protein, 29 aa, Mycobacterium
KRHNHELGWFARQALRLFDDLRLEHGRLD

SEQ ID NO: 1074889 - protein, 28 aa, Mycobacterium
KRHRFSSFFVDYFITPLVAAVWSCTAGD

SEQ ID NO: 1074890 - protein, 25 aa, Mycobacterium
KRIERGLWLTALLADTLTTVRGVVA

SEQ ID NO: 1074891 - protein, 24 aa, Mycobacterium
KRPEFGKLTPLYPNQRLRLETTPD

SEQ ID NO: 1074892 - protein, 19 aa, Mycobacterium
KRPQISLGPLPVADQLRDS

SEQ ID NO: 1074893 - protein, 21 aa, Mycobacterium
KRQRRRDGRDAGRRRPPVLSE

SEQ ID NO: 1074894 - protein, 17 aa, Mycobacterium
KRQVMDVYFLAGAEDFL

SEQ ID NO: 1074895 - protein, 19 aa, Mycobacterium
KRRGFRFVGPTTAYALMQA

SEQ ID NO: 1074896 - protein, 26 aa, Mycobacterium
KRSLNHWYRMFGPTFETSLGLEFLGF

SEQ ID NO: 1074897 - protein, 17 aa, Mycobacterium
KRVALVFSAYPTKHARI

SEQ ID NO: 1074898 - protein, 17 aa, Mycobacterium
KRVLMMRSTFRKHRDRM

SEQ ID NO: 1074899 - protein, 28 aa, Mycobacterium
KRYTGRGMAFLDLIQEGNLGLIRAVEKF

SEQ ID NO: 1074900 - protein, 26 aa, Mycobacterium
KSAEFLAELLGLPSPVTFGPFLVVAL

SEQ ID NO: 1074901 - protein, 27 aa, Mycobacterium
KSALVAAVYLRLLRDLPLHTDVNDTTK

SEQ ID NO: 1074902 - protein, 21 aa, Mycobacterium
KSAYAAELIAARDAAARAVDN

SEQ ID NO: 1074903 - protein, 22 aa, Mycobacterium
KSDIPLLATMYQSGQLLLDAMI

SEQ ID NO: 1074904 - protein, 22 aa, Mycobacterium
KSLGLKTFLMPLNPGKDDDGNP

SEQ ID NO: 1074905 - protein, 24 aa, Mycobacterium
KSLIKIAAPLPKHWEFYLGNTKAI

SEQ ID NO: 1074906 - protein, 17 aa, Mycobacterium
KSLLIVDRLSGRSRFSM

SEQ ID NO: 1074907 - protein, 25 aa, Mycobacterium
KSLNQRTILRLLDPSITAAGVLRAE

SEQ ID NO: 1074908 - protein, 17 aa, Mycobacterium
KSNILMLGPTGCGKTYL

SEQ ID NO: 1074909 - protein, 29 aa, Mycobacterium
KSPPGATPIGRWCWRPRPTRPIPAASTTA

SEQ ID NO: 1074910 - protein, 23 aa, Mycobacterium
KSSLAFDTIFAEGQRRYVESLSA

SEQ ID NO: 1074911 - protein, 26 aa, Mycobacterium
KSSLLDAISLGFLPFNRRNFNASGDN

SEQ ID NO: 1074912 - protein, 20 aa, Mycobacterium
KSTLLRLLSGIYEPTRGLAK

SEQ ID NO: 1074913 - protein, 23 aa, Mycobacterium
KSVQVTLNGYQWLNGIRIENGLL

SEQ ID NO: 1074914 - protein, 23 aa, Mycobacterium
KSVWFQRGPLDEAIHASIAIPGI

SEQ ID NO: 1074915 - protein, 20 aa, Mycobacterium
KSYVLLAKTLAETERMAIVH

SEQ ID NO: 1074916 - protein, 23 aa, Mycobacterium
KTAAQWVELLHEGGLMACLAYTW

SEQ ID NO: 1074917 - protein, 33 aa, Mycobacterium
KTAKRDALLASLPLKRAVVLRGLLSWPEDSAAA

SEQ ID NO: 1074918 - protein, 32 aa, Mycobacterium
KTAPRLPDGTPFPTLYYLTHPELTAAASRLET

SEQ ID NO: 1074919 - protein, 19 aa, Mycobacterium
KTCAPWLDAEWRLVSHDVR

SEQ ID NO: 1074920 - protein, 20 aa, Mycobacterium
KTGVLAKYVKLVGSAAIGAV

SEQ ID NO: 1074921 - protein, 18 aa, Mycobacterium
KTHPLTVRLGERPTLMFD

SEQ ID NO: 1074922 - protein, 20 aa, Mycobacterium
KTHQGTAELIRPIARKYDLK

SEQ ID NO: 1074923 - protein, 21 aa, Mycobacterium
KTLGVPLFQEQLMQLAVDCAG

SEQ ID NO: 1074924 - protein, 29 aa, Mycobacterium
KTLNLNFFVHDPFTLEPYSRDPRNVARKA

SEQ ID NO: 1074925 - protein, 24 aa, Mycobacterium
KTLREAVLYLTGMNQRELYGASYR

SEQ ID NO: 1074926 - protein, 30 aa, Mycobacterium
KTLSWVDANVWRRVIPKSWFYNIIITGVKP

SEQ ID NO: 1074927 - protein, 23 aa, Mycobacterium
KTNLLNTHPLPNIGRVVISGNPA

SEQ ID NO: 1074928 - protein, 20 aa, Mycobacterium
KTNWVIALPPGQTGLLRPVI

SEQ ID NO: 1074929 - protein, 25 aa, Mycobacterium
KTPAQVLLRWNLQLGNAVVFRSAKA

SEQ ID NO: 1074930 - protein, 26 aa, Mycobacterium
KTPPGHLWRWELTPISGTRTLVTHTY

SEQ ID NO: 1074931 - protein, 24 aa, Mycobacterium
KTPYYPHDFFVPNSKFYAAVNALP

SEQ ID NO: 1074932 - protein, 22 aa, Mycobacterium
KTQKEFLLRQQLAAIRKELGEG

SEQ ID NO: 1074933 - protein, 20 aa, Mycobacterium
KTRAWQVGAMRELLLQHRDP

SEQ ID NO: 1074934 - protein, 18 aa, Mycobacterium
KTRGWMHTFFADHSKTPV

SEQ ID NO: 1074935 - protein, 32 aa, Mycobacterium
KTRIYCPDWVGLFRWLKPALSTPLGELPVRKA

SEQ ID NO: 1074936 - protein, 26 aa, Mycobacterium
KTTFGRIGVKVWIYKGDIVGGKREVT

SEQ ID NO: 1074937 - protein, 24 aa, Mycobacterium
KTVDVMLRYNFPGAGLTDNALRTL

SEQ ID NO: 1074938 - protein, 20 aa, Mycobacterium
KTVFMVLRDPAADMSLTVTC

SEQ ID NO: 1074939 - protein, 18 aa, Mycobacterium
KTVFVFPGQGGQYPGMAA

SEQ ID NO: 1074940 - protein, 24 aa, Mycobacterium
KTVPPRWLPGPRELRAWALAAGSP

SEQ ID NO: 1074941 - protein, 24 aa, Mycobacterium
KVAIARDYLLPRQRDRAALSDDEV

SEQ ID NO: 1074942 - protein, 24 aa, Mycobacterium
KVARIKFPTPAACGRVPLVVKGLS

SEQ ID NO: 1074943 - protein, 19 aa, Mycobacterium
KVARLMEWCSMVGCPIIGI

SEQ ID NO: 1074944 - protein, 19 aa, Mycobacterium
KVARRFAHLTYRGEIELDS

SEQ ID NO: 1074945 - protein, 18 aa, Mycobacterium
KVDIAAVNPWMLRMAGEV

SEQ ID NO: 1074946 - protein, 22 aa, Mycobacterium
KVDMAALPAVPFAGAADADADV

SEQ ID NO: 1074947 - protein, 25 aa, Mycobacterium
KVESQYLAQLYAAIGIRASDAAQQL

SEQ ID NO: 1074948 - protein, 17 aa, Mycobacterium
KVGAPLLPPVLGGGMPA

SEQ ID NO: 1074949 - protein, 18 aa, Mycobacterium
KVGVFRPITRRGERRDYI

SEQ ID NO: 1074950 - protein, 24 aa, Mycobacterium
KVGYAMRRISPSMIRMFARLDIRQ

SEQ ID NO: 1074951 - protein, 18 aa, Mycobacterium
KVHYIDFVGTYFSVKGPS

SEQ ID NO: 1074952 - protein, 18 aa, Mycobacterium
KVIELAPAPNLPGELRDK

SEQ ID NO: 1074953 - protein, 18 aa, Mycobacterium
KVIKATRFVGHLNHNELL

SEQ ID NO: 1074954 - protein, 17 aa, Mycobacterium
KVLMRDLLPKKAGKNLT

SEQ ID NO: 1074955 - protein, 25 aa, Mycobacterium
KVLSGWGAILLMFDVIQLSATSGII

SEQ ID NO: 1074956 - protein, 24 aa, Mycobacterium
KVNGMVVVGIWQPGAPAAGLVGLK

SEQ ID NO: 1074957 - protein, 25 aa, Mycobacterium
KVPNAAALPFRYTVNGYRGCMHACR

SEQ ID NO: 1074958 - protein, 24 aa, Mycobacterium
KVRPGVPVIFLDTGYHFAETIGTR

SEQ ID NO: 1074959 - protein, 19 aa, Mycobacterium
KVSALLEALPKVGKVKAQE

SEQ ID NO: 1074960 - protein, 23 aa, Mycobacterium
KVSCAGLVLGSWPAHPGLVESSN

SEQ ID NO: 1074961 - protein, 24 aa, Mycobacterium
KVSENQLFYLMSRGLTEDEAMAMV

SEQ ID NO: 1074962 - protein, 17 aa, Mycobacterium
KVSPATRVLVLSTSDER

SEQ ID NO: 1074963 - protein, 17 aa, Mycobacterium
KVSPLTVQMIMPNGAAA

SEQ ID NO: 1074964 - protein, 17 aa, Mycobacterium
KVSQLKPVFRPNGTVTA

SEQ ID NO: 1074965 - protein, 19 aa, Mycobacterium
KVTKLARTYKPYGPVLSDA

SEQ ID NO: 1074966 - protein, 30 aa, Mycobacterium; identical to SEQ ID NO: 830310

SEQ ID NO: 1074967 - protein, 21 aa, Mycobacterium
KVTPMDFMRDTLLWAKLIDKY

SEQ ID NO: 1074968 - protein, 19 aa, Mycobacterium
KVVAQFLRITSQPIPNLRG

SEQ ID NO: 1074969 - protein, 20 aa, Mycobacterium
KVVDLLTPYVRGGKIALFGG

SEQ ID NO: 1074970 - protein, 25 aa, Mycobacterium
KVVNAPTQMLLGRSLIADGANATAA

SEQ ID NO: 1074971 - protein, 25 aa, Mycobacterium
KVVSWYDNEWGYSNRLIDLVALVGK

SEQ ID NO: 1074972 - protein, 17 aa, Mycobacterium
KVVWLSQTTLSVDETME

SEQ ID NO: 1074973 - protein, 17 aa, Mycobacterium
KVWGLYMAASRVAFERN

SEQ ID NO: 1074974 - protein, 17 aa, Mycobacterium
KVYAPFESGLPGPTGRV

SEQ ID NO: 1074975 - protein, 21 aa, Mycobacterium
KWALNRDIAAARLSWERATRI

SEQ ID NO: 1074976 - protein, 21 aa, Mycobacterium
KWDHTAAIKWPPPVTFSQLRE

SEQ ID NO: 1074977 - protein, 19 aa, Mycobacterium
KWELEDLSFAILHPKKYDE

SEQ ID NO: 1074978 - protein, 26 aa, Mycobacterium
KWEQKLDLKVPRWSIRRMKTKWGSCN

SEQ ID NO: 1074979 - protein, 21 aa, Mycobacterium
KWGQLSNVVLLLPHGHEGQGP

SEQ ID NO: 1074980 - protein, 37 aa, Mycobacterium
KWHRHRVIEPFDVDAYRQFLIDIGYLLPEPDDFTIST

SEQ ID NO: 1074981 - protein, 38 aa, Mycobacterium
KWHRHRVIEPFDVDAYRQFLIDIGYLLPEPDDFTISTS

SEQ ID NO: 1074982 - protein, 19 aa, Mycobacterium
KWRAHPADVLPLWVAEMDV

SEQ ID NO: 1074983 - protein, 24 aa, Mycobacterium
KWREIFGADNYFLELMDHGLSIER

SEQ ID NO: 1074984 - protein, 18 aa, Mycobacterium
KWTAQFEHTLLVTDTGAE

SEQ ID NO: 1074985 - protein, 19 aa, Mycobacterium
KYFDQELIAWRAESGQLTV

SEQ ID NO: 1074986 - protein, 17 aa, Mycobacterium
KYFGDLRIGMMGVWIGA

SEQ ID NO: 1074987 - protein, 26 aa, Mycobacterium
KYGAVEVWPMAGPGLPTQPLQGSNWI

SEQ ID NO: 1074988 - protein, 22 aa, Mycobacterium
KYPDTQWRFEYSPESYTGTELE

SEQ ID NO: 1074989 - protein, 18 aa, Mycobacterium
KYRDTVRDFWRGEPATLD

SEQ ID NO: 1074990 - protein, 17 aa, Mycobacterium
KYRVQRAIKRRGRPLTA

SEQ ID NO: 1074991 - protein, 20 aa, Mycobacterium
KYVEYNLIPSLFTEHAFYFG

SEQ ID NO: 1074992 - protein, 25 aa, Mycobacterium
KYYDKVDVTVIPPFTDLRSVQTLVD

SEQ ID NO: 1074993 - protein, 18 aa, Mycobacterium
LAAAAAWDGLADELSTAA

SEQ ID NO: 1074994 - protein, 24 aa, Mycobacterium
LAAALVPMHDTPLGPLAGGLTLRQ

SEQ ID NO: 1074995 - protein, 18 aa, Mycobacterium
LAAANAALAPLITAVVPP

SEQ ID NO: 1074996 - protein, 26 aa, Mycobacterium
LAAAYLQGFVWGMQRNYSVLVEMDAD

SEQ ID NO: 1074997 - protein, 24 aa, Mycobacterium
LAADYGCMAGIYTAAAQYFTGVAG

SEQ ID NO: 1074998 - protein, 34 aa, Mycobacterium; identical to SEQ ID NO: 830462

SEQ ID NO: 1074999 - protein, 25 aa, Mycobacterium
LAAEHPEWVLLYQYGNPANSESHYR

SEQ ID NO: 1075000 - protein, 25 aa, Mycobacterium
LAAGHLTLVPALRDALAKVGRPDIM

SEQ ID NO: 1075001 - protein, 20 aa, Mycobacterium
LAAGLDAPFSCREGHCGACA

SEQ ID NO: 1075002 - protein, 30 aa, Mycobacterium; identical to SEQ ID NO: 830479

SEQ ID NO: 1075003 - protein, 19 aa, Mycobacterium
LAAGWLTEAFYSLVSGAGW

SEQ ID NO: 1075004 - protein, 24 aa, Mycobacterium
LAAIGPKLPELWGGSADLAGSNNT

SEQ ID NO: 1075005 - protein, 29 aa, Mycobacterium
LAAINGPTQAIFGRPLIGDGAAGTATDPN

SEQ ID NO: 1075006 - protein, 20 aa, Mycobacterium
LAALPILGAANRIPASYATC

SEQ ID NO: 1075007 - protein, 26 aa, Mycobacterium
LAAPPRPFRDYLGWLDGWDSQSGEQF

SEQ ID NO: 1075008 - protein, 26 aa, Mycobacterium
LAAPQGLLHKVVLARALQLTAETALD

SEQ ID NO: 1075009 - protein, 28 aa, Mycobacterium
LAAPSTVPPAPPYYPVRTAAAHIAEPDQ

SEQ ID NO: 1075010 - protein, 18 aa, Mycobacterium
LAAQLAVYLGPPGYGEMF

SEQ ID NO: 1075011 - protein, 20 aa, Mycobacterium
LAAQRFAAAVWTAIRERRAR

SEQ ID NO: 1075012 - protein, 21 aa, Mycobacterium
LAARFARPLAFGTAGLRGPVR

SEQ ID NO: 1075013 - protein, 27 aa, Mycobacterium
LAARIEAMPWQWVGQELPAFSSAPTDH

SEQ ID NO: 1075014 - protein, 17 aa, Mycobacterium
LAARRRPGNLEIAYLAC

SEQ ID NO: 1075015 - protein, 18 aa, Mycobacterium
LAASSRRSAWWAGALTLG

SEQ ID NO: 1075016 - protein, 25 aa, Mycobacterium
LAATDRFRLAVRELTWNALSPDIEA

SEQ ID NO: 1075017 - protein, 23 aa, Mycobacterium
LAAVCALEPYWEAVRKVYAPFES

SEQ ID NO: 1075018 - protein, 18 aa, Mycobacterium
LAAVEETLVLPTHQQWRL

SEQ ID NO: 1075019 - protein, 21 aa, Mycobacterium
LAAVFSGHALDYQALSAQMAG

SEQ ID NO: 1075020 - protein, 25 aa, Mycobacterium
LAAVRVFVGPQFRGPGKPFGQEQPC

SEQ ID NO: 1075021 - protein, 18 aa, Mycobacterium
LAAYPHHDLAEATDWMLL

SEQ ID NO: 1075022 - protein, 25 aa, Mycobacterium
LACIRNWLYWQYVVGLFGSAMSDTS

SEQ ID NO: 1075023 - protein, 22 aa, Mycobacterium
LADAWLGVIARHGTLRTAFTLG

SEQ ID NO: 1075024 - protein, 35 aa, Mycobacterium
LADEFWDEIFRELSIPYLPVRWRPDNPDSIVDKNA

SEQ ID NO: 1075025 - protein, 26 aa, Mycobacterium
LADFAHRGWIRLEGKSVLISDSERLA

SEQ ID NO: 1075026 - protein, 17 aa, Mycobacterium
LADFHRVMAVNVLGVMA

SEQ ID NO: 1075027 - protein, 18 aa, Mycobacterium
LADLRNPEHEAALAELGV

SEQ ID NO: 1075028 - protein, 23 aa, Mycobacterium
LADNGYIPIPDEFKSRLSTAVNA

SEQ ID NO: 1075029 - protein, 17 aa, Mycobacterium
LADPEVPVFALTTGPRW

SEQ ID NO: 1075030 - protein, 20 aa, Mycobacterium
LADRFDCHTVIFTGVAGGLD

SEQ ID NO: 1075031 - protein, 24 aa, Mycobacterium
LADRGALLVLDNCEHIIDAAVPFI

SEQ ID NO: 1075032 - protein, 18 aa, Mycobacterium
LADVLDVGLRSSYVASWY

SEQ ID NO: 1075033 - protein, 25 aa, Mycobacterium
LADVSIRWQLKQSAAPELFQQYKTF

SEQ ID NO: 1075034 - protein, 28 aa, Mycobacterium
LADVYWGDLDVLLLDLPPGTGDIAISVA

SEQ ID NO: 1075035 - protein, 29 aa, Mycobacterium
LADYMAARGIGFLGWNTRFRGFESNFALD

SEQ ID NO: 1075036 - protein, 27 aa, Mycobacterium
LAEAGWPVRVWIDLLPRQTTSAVAGAV

SEQ ID NO: 1075037 - protein, 19 aa, Mycobacterium
LAECSWLVPVGQRDGLCES

SEQ ID NO: 1075038 - protein, 24 aa, Mycobacterium
LAEDLLRLLDKWFPGEQVHGVGPS

SEQ ID NO: 1075039 - protein, 23 aa, Mycobacterium
LAEFEEMLNGTLRSVGRGRHQLR

SEQ ID NO: 1075040 - protein, 25 aa, Mycobacterium
LAEFKAMFQMKFYGVALFRSRGVLP

SEQ ID NO: 1075041 - protein, 20 aa, Mycobacterium
LAEGAFRGLQAGATAATSIT

SEQ ID NO: 1075042 - protein, 25 aa, Mycobacterium
LAEHHPHLLPLAQRILEPTELEVLR

SEQ ID NO: 1075043 - protein, 26 aa, Mycobacterium
LAELRAARRMGSKSALLALMADCERG

SEQ ID NO: 1075044 - protein, 29 aa, Mycobacterium
LAELREYIDWQPFFNAWEMKGRFPDILNN

SEQ ID NO: 1075045 - protein, 18 aa, Mycobacterium
LAELRIGVVGLSVGHTLP

SEQ ID NO: 1075046 - protein, 23 aa, Mycobacterium
LAELTGWSLEIAPEALDCAAPDT

SEQ ID NO: 1075047 - protein, 29 aa, Mycobacterium
LAEQDLLPDVLYTSLLRRAITTAHLALDS

SEQ ID NO: 1075048 - protein, 31 aa, Mycobacterium; identical to SEQ ID NO: 830816

SEQ ID NO: 1075049 - protein, 31 aa, Mycobacterium; identical to SEQ ID NO: 830827

SEQ ID NO: 1075050 - protein, 21 aa, Mycobacterium
LAEYVGAAAGLLFSSGYTANL

SEQ ID NO: 1075051 - protein, 18 aa, Mycobacterium
LAFDRRRYWDLFEGVLRN

SEQ ID NO: 1075052 - protein, 35 aa, Mycobacterium; identical to SEQ ID NO: 219859

SEQ ID NO: 1075053 - protein, 19 aa, Mycobacterium
LAGEAILFTRAHATAPLCS

SEQ ID NO: 1075054 - protein, 21 aa, Mycobacterium
LAGFNLYAYLYAFNKILPGVL

SEQ ID NO: 1075055 - protein, 25 aa, Mycobacterium
LAGHGYVVLLPDVYYREGDWTPFAM

SEQ ID NO: 1075056 - protein, 21 aa, Mycobacterium
LAGHPIGNLLLAGLSEVLADP

SEQ ID NO: 1075057 - protein, 18 aa, Mycobacterium
LAGLPFSGPVGGVRVALI

SEQ ID NO: 1075058 - protein, 18 aa, Mycobacterium
LAGLRDYFRAHAFGNATF

SEQ ID NO: 1075059 - protein, 23 aa, Mycobacterium
LAGPYATLLLADLGAKVVKIEPP

SEQ ID NO: 1075060 - protein, 26 aa, Mycobacterium
LAGQGFDNLLLAYPTTDRTGLRALGE

SEQ ID NO: 1075061 - protein, 24 aa, Mycobacterium
LAGQPFLLTAGFFETHRPYPHERY

SEQ ID NO: 1075062 - protein, 24 aa, Mycobacterium
LAGRHLRRHPNAQPVVLVVTDGEP

SEQ ID NO: 1075063 - protein, 26 aa, Mycobacterium
LAGTGGAGGFGIFPGGQTGQNGTDSK

SEQ ID NO: 1075064 - protein, 17 aa, Mycobacterium
LAHHAVEPPPSGLAAQR

SEQ ID NO: 1075065 - protein, 18 aa, Mycobacterium
LAHLDALRVPYVINPRMV

SEQ ID NO: 1075066 - protein, 19 aa, Mycobacterium
LAHRVGWPIPIGGSQVIAD

SEQ ID NO: 1075067 - protein, 27 aa, Mycobacterium
LAICQRYLRNAPARIVLACLPDDPGRD

SEQ ID NO: 1075068 - protein, 19 aa, Mycobacterium
LAIMSAATTRWVWVRDVDV

SEQ ID NO: 1075069 - protein, 17 aa, Mycobacterium
LAIQGLKTLVIDLDPQG

SEQ ID NO: 1075070 - protein, 19 aa, Mycobacterium
LAKLAIPIPTVTTPQMFMY

SEQ ID NO: 1075071 - protein, 17 aa, Mycobacterium
LAKPWGLAATPVQQVII

SEQ ID NO: 1075072 - protein, 27 aa, Mycobacterium
LAKRLGLQRQWLHARSLAFAHPADGRR

SEQ ID NO: 1075073 - protein, 17 aa, Mycobacterium
LAKWSMPLLKREGRMLA

SEQ ID NO: 1075074 - protein, 19 aa, Mycobacterium
LALAFSGKRFAYEGEIFTV

SEQ ID NO: 1075075 - protein, 18 aa, Mycobacterium
LALATVPELPVGVRLIFE

SEQ ID NO: 1075076 - protein, 24 aa, Mycobacterium
LALESLILMTLGLVDLLSGGSEAR

SEQ ID NO: 1075077 - protein, 17 aa, Mycobacterium
LALKPDCVVYNPMWIDV

SEQ ID NO: 1075078 - protein, 19 aa, Mycobacterium
LALLNAGVPLKAPVAGIAM

SEQ ID NO: 1075079 - protein, 18 aa, Mycobacterium
LALRVPLPGTAFINAAND

SEQ ID NO: 1075080 - protein, 20 aa, Mycobacterium
LALTAPTFQQLIARASDRPD

SEQ ID NO: 1075081 - protein, 25 aa, Mycobacterium
LAMDPQQRMFLELSWEALERAGIEP

SEQ ID NO: 1075082 - protein, 18 aa, Mycobacterium
LAMFAIAHFGSEEHKQRW

SEQ ID NO: 1075083 - protein, 21 aa, Mycobacterium
LAMLALFGCAHYEAIFAGYQQ

SEQ ID NO: 1075084 - protein, 21 aa, Mycobacterium
LANIALLRRPAALDEPTWLAR

SEQ ID NO: 1075085 - protein, 27 aa, Mycobacterium
LANLGYRGFWMGYFAARSAPLGQVAPE

SEQ ID NO: 1075086 - protein, 40 aa, Mycobacterium; identical to SEQ ID NO: 831147

SEQ ID NO: 1075087 - protein, 20 aa, Mycobacterium
LAPKDLEKIIYFAAYVITSV

SEQ ID NO: 1075088 - protein, 17 aa, Mycobacterium
LAPLLGTWAGQGAGEYP

SEQ ID NO: 1075089 - protein, 26 aa, Mycobacterium
LAPPGRDLLYLLAPAPNLTAGRVDWG

SEQ ID NO: 1075090 - protein, 33 aa, Mycobacterium
LAPPPGPLALPPMPDPLAPPPLVPVAAGPVAGQ

SEQ ID NO: 1075091 - protein, 24 aa, Mycobacterium
LAPQGLDYIVAFLGALQAGQIAVP

SEQ ID NO: 1075092 - protein, 20 aa, Mycobacterium
LAPRNPLPYWQQLKALKTLH

SEQ ID NO: 1075093 - protein, 19 aa, Mycobacterium
LAPSKPIPTPGLSYYAREF

SEQ ID NO: 1075094 - protein, 27 aa, Mycobacterium
LAQAAIPLLPPMMDDLMRLELRHSVET

SEQ ID NO: 1075095 - protein, 20 aa, Mycobacterium
LAQFGSRPVDYVESLGWLGS

SEQ ID NO: 1075096 - protein, 18 aa, Mycobacterium
LAQLLEAVGLVVGVRVTE

SEQ ID NO: 1075097 - protein, 25 aa, Mycobacterium
LAQLSILVTLLDRGPIRMTDLAAHE

SEQ ID NO: 1075098 - protein, 25 aa, Mycobacterium
LAQRGVPVNALVRAYRLGHKEMLER

SEQ ID NO: 1075099 - protein, 18 aa, Mycobacterium
LARAIRFGHKVIESAWST

SEQ ID NO: 1075100 - protein, 20 aa, Mycobacterium
LARALAADPPILLMDEAFSA

SEQ ID NO: 1075101 - protein, 21 aa, Mycobacterium
LARALASLPVQPARMVRGLPP

SEQ ID NO: 1075102 - protein, 18 aa, Mycobacterium
LARALAVGVHRLLCWGIV

SEQ ID NO: 1075103 - protein, 21 aa, Mycobacterium
LARDLAFIAFSGIGGVLVAKQ

SEQ ID NO: 1075104 - protein, 18 aa, Mycobacterium
LAREPRRGPRLPVQNIRS

SEQ ID NO: 1075105 - protein, 21 aa, Mycobacterium
LARFTADLPFALDDFQRRACA

SEQ ID NO: 1075106 - protein, 17 aa, Mycobacterium
LARKFVDMVTAETGRRI

SEQ ID NO: 1075107 - protein, 36 aa, Mycobacterium; identical to SEQ ID NO: 831267

SEQ ID NO: 1075108 - protein, 18 aa, Mycobacterium
LARLHMLAAADLAADGGL

SEQ ID NO: 1075109 - protein, 20 aa, Mycobacterium
LARLPLRSLAFDVPPEYVFR

SEQ ID NO: 1075110 - protein, 20 aa, Mycobacterium
LARLPRIAVTPLGITSVRFT

SEQ ID NO: 1075111 - protein, 24 aa, Mycobacterium
LARNAAELGLIPDTDHLELLSHEK

SEQ ID NO: 1075112 - protein, 31 aa, Mycobacterium; identical to SEQ ID NO: 831297

SEQ ID NO: 1075113 - protein, 22 aa, Mycobacterium
LARYAGWAMRSYLRFAQLASDP

SEQ ID NO: 1075114 - protein, 19 aa, Mycobacterium
LASLGVFEEAFRRAQEAIE

SEQ ID NO: 1075115 - protein, 20 aa, Mycobacterium
LASNRMRAAGIPLPDVLISA

SEQ ID NO: 1075116 - protein, 19 aa, Mycobacterium
LASRARKAPGFALLGEPGQ

SEQ ID NO: 1075117 - protein, 18 aa, Mycobacterium
LASSYYQLPGLGPDAPEQ

SEQ ID NO: 1075118 - protein, 29 aa, Mycobacterium
LASTRSGVFWIRDILPVQKLREILSAATV

SEQ ID NO: 1075119 - protein, 19 aa, Mycobacterium
LASVHPGLEYVRDAILFMA

SEQ ID NO: 1075120 - protein, 36 aa, Mycobacterium; identical to SEQ ID NO: 831391

SEQ ID NO: 1075121 - protein, 23 aa, Mycobacterium
LATHVLGPILLTSLLVPMLAESD

SEQ ID NO: 1075122 - protein, 20 aa, Mycobacterium
LATILHHFAMFWDRRRQPNV

SEQ ID NO: 1075123 - protein, 19 aa, Mycobacterium
LATLGLGVVPLLALASEAQ

SEQ ID NO: 1075124 - protein, 17 aa, Mycobacterium
LATQFRPDQLARLAGRL

SEQ ID NO: 1075125 - protein, 21 aa, Mycobacterium
LATQIALLTQADLITGIIAGD

SEQ ID NO: 1075126 - protein, 29 aa, Mycobacterium
LATQREMLRPLRFLLTAPVTALGSSDVDR

SEQ ID NO: 1075127 - protein, 27 aa, Mycobacterium
LATQSLSPITLRQALLGKVMTVGDAVS

SEQ ID NO: 1075128 - protein, 38 aa, Mycobacterium
LATSNQALLDLINAPTQALLDRPLIGNGANGAAGTGAN

SEQ ID NO: 1075129 - protein, 22 aa, Mycobacterium
LAVALANRWPTARILGVDDSAA

SEQ ID NO: 1075130 - protein, 20 aa, Mycobacterium
LAVDFRQRFNKDVIIDMLCY

SEQ ID NO: 1075131 - protein, 25 aa, Mycobacterium
LAVDPAHPFPFVSGLSLNLAVTVKQ

SEQ ID NO: 1075132 - protein, 25 aa, Mycobacterium
LAVDVVSWHIMLGDLAAAWRSLQAG

SEQ ID NO: 1075133 - protein, 26 aa, Mycobacterium
LAVGEDALITLLDPSDRLGGILRTER

SEQ ID NO: 1075134 - protein, 20 aa, Mycobacterium
LAVGPTTPLFLYAHNDQELH

SEQ ID NO: 1075135 - protein, 19 aa, Mycobacterium
LAVLDLKRVADDRFIGAHP

SEQ ID NO: 1075136 - protein, 31 aa, Mycobacterium
LAVLVYESHWWAHRALLHLIFSGVLDRYPDL

SEQ ID NO: 1075137 - protein, 20 aa, Mycobacterium
LAVMYGELPPLPTITRFAFQ

SEQ ID NO: 1075138 - protein, 24 aa, Mycobacterium
LAVNRLLRRNVGVLGVAWGEYLNR

SEQ ID NO: 1075139 - protein, 18 aa, Mycobacterium
LAVQLRTLAPSGGRVTEL

SEQ ID NO: 1075140 - protein, 24 aa, Mycobacterium
LAVQPLAPVFLYARNDDELRGLSP

SEQ ID NO: 1075141 - protein, 22 aa, Mycobacterium
LAVRGTRLAILKGIDLPLPEAE

SEQ ID NO: 1075142 - protein, 17 aa, Mycobacterium
LAVRLDVSRLVVVGTGR

SEQ ID NO: 1075143 - protein, 27 aa, Mycobacterium
LAWHSLGEALFNGRWIKLDATIDAPTA

SEQ ID NO: 1075144 - protein, 19 aa, Mycobacterium
LCERLLSYARPLHLYAEEI

SEQ ID NO: 1075145 - protein, 18 aa, Mycobacterium
LCGSIVSGLRMRPGNWAG

SEQ ID NO: 1075146 - protein, 21 aa, Mycobacterium
LCLTFNGLSKAYRVAGYRAGW

SEQ ID NO: 1075147 - protein, 28 aa, Mycobacterium
LCMIHGADPWWDVAIRLLLKYSNSRLMT

SEQ ID NO: 1075148 - protein, 19 aa, Mycobacterium
LCNTHFYMPPQFNALDLMS

SEQ ID NO: 1075149 - protein, 21 aa, Mycobacterium
LDAALGWQRDGAEWIHLVDLD

SEQ ID NO: 1075150 - protein, 28 aa, Mycobacterium
LDAANGETMAMLGRPLIGNGADGAPGQA

SEQ ID NO: 1075151 - protein, 17 aa, Mycobacterium
LDAHGVALLLIDSRARH

SEQ ID NO: 1075152 - protein, 18 aa, Mycobacterium
LDAIGRPVVLIGASMGGL

SEQ ID NO: 1075153 - protein, 20 aa, Mycobacterium
LDALALDTLALLEDRWRDVV

SEQ ID NO: 1075154 - protein, 17 aa, Mycobacterium
LDALMKDNDYDLSSLFL

SEQ ID NO: 1075155 - protein, 25 aa, Mycobacterium
LDANGYLFYHGRSDDMFKVSGATVY

SEQ ID NO: 1075156 - protein, 25 aa, Mycobacterium
LDAQLIDELPLPRPKYEIFVYSPRV

SEQ ID NO: 1075157 - protein, 26 aa, Mycobacterium
LDASLLLVVLTRFLPPDDPRVRNTVL

SEQ ID NO: 1075158 - protein, 22 aa, Mycobacterium
LDATDRWSIGLSGGPDSLALTA

SEQ ID NO: 1075159 - protein, 26 aa, Mycobacterium
LDAVELELYRRLPGDLSVLTPSPASD

SEQ ID NO: 1075160 - protein, 27 aa, Mycobacterium
LDAVNAPAQALLGRPLIGDGADGAPGQ

SEQ ID NO: 1075161 - protein, 24 aa, Mycobacterium
LDAVPVIPPELRPLVQLDGGRFAT

SEQ ID NO: 1075162 - protein, 25 aa, Mycobacterium
LDAYYEHGLQLWDRAAGALIAAEAG

SEQ ID NO: 1075163 - protein, 29 aa, Mycobacterium
LDDDDRRPWLRRVGRWLADHPGGGVISCS

SEQ ID NO: 1075164 - protein, 22 aa, Mycobacterium
LDDEYLTKWDLPVKIGGHLKDP

SEQ ID NO: 1075165 - protein, 23 aa, Mycobacterium
LDDHTIAYYPPAFSAAARDQLQA

SEQ ID NO: 1075166 - protein, 23 aa, Mycobacterium
LDDMTPLKHEHLEFGYGALDLGA

SEQ ID NO: 1075167 - protein, 29 aa, Mycobacterium
LDDQFWGERYGVVADPFGHHWSLGQPVRE

SEQ ID NO: 1075168 - protein, 29 aa, Mycobacterium
LDDVLRRAVRLLAQLTRQVAVVQYPTLST

SEQ ID NO: 1075169 - protein, 20 aa, Mycobacterium
LDDYRRRPQWRRIGLIDCGE

SEQ ID NO: 1075170 - protein, 22 aa, Mycobacterium
LDEDPYLPPYYHPGSDAPEIRY

SEQ ID NO: 1075171 - protein, 23 aa, Mycobacterium
LDELRRIIPPWTTLGSRLASMPK

SEQ ID NO: 1075172 - protein, 24 aa, Mycobacterium
LDELRVRYAIAPLLPADAAAGDEV

SEQ ID NO: 1075173 - protein, 20 aa, Mycobacterium
LDEPTLDALLIMSLTQEWGT

SEQ ID NO: 1075174 - protein, 19 aa, Mycobacterium
LDEVPMLLQPGVLGIAWGT

SEQ ID NO: 1075175 - protein, 17 aa, Mycobacterium
LDEVRDKIERRYATALG

SEQ ID NO: 1075176 - protein, 22 aa, Mycobacterium
LDFHAAIIGLLDSPRVDRFFAA

SEQ ID NO: 1075177 - protein, 18 aa, Mycobacterium
LDFLTIDDTLMPQPGRRE

SEQ ID NO: 1075178 - protein, 17 aa, Mycobacterium
LDFRPKHKPAVLVVSAI

SEQ ID NO: 1075179 - protein, 20 aa, Mycobacterium
LDGAALRYAFGCFPSGVIAV

SEQ ID NO: 1075180 - protein, 25 aa, Mycobacterium
LDGDEFRLYELIWQRTVASQMADAR

SEQ ID NO: 1075181 - protein, 23 aa, Mycobacterium
LDGEKRYIIAPNGLSQGDVVESG

SEQ ID NO: 1075182 - protein, 25 aa, Mycobacterium
LDGGPMRDLLRRMQPTEFNDIVAVL

SEQ ID NO: 1075183 - protein, 30 aa, Mycobacterium; identical to SEQ ID NO: 831873

SEQ ID NO: 1075184 - protein, 23 aa, Mycobacterium
LDGNQIMTLLDIPAGPQVGEAWR

SEQ ID NO: 1075185 - protein, 26 aa, Mycobacterium
LDGQRIRGLLAQRIDLMPPLRWRVRE

SEQ ID NO: 1075186 - protein, 23 aa, Mycobacterium
LDGSTWVVFLTDHGPAFPRAKST

SEQ ID NO: 1075187 - protein, 25 aa, Mycobacterium
LDGVRIFEQLAIADPVTAAFLSIHN

SEQ ID NO: 1075188 - protein, 22 aa, Mycobacterium
LDGYGLHIIERVPLPVRANAEN

SEQ ID NO: 1075189 - protein, 24 aa, Mycobacterium
LDHLRHLGRIPATMRYTAQGLARV

SEQ ID NO: 1075190 - protein, 20 aa, Mycobacterium
LDICDQFGISISEVALRNES

SEQ ID NO: 1075191 - protein, 38 aa, Mycobacterium; identical to SEQ ID NO: 783276

SEQ ID NO: 1075192 - protein, 21 aa, Mycobacterium
LDIEMLGYEAGAALLSARVIG

SEQ ID NO: 1075193 - protein, 22 aa, Mycobacterium
LDIENYWFRRHEVVYERLAPRC

SEQ ID NO: 1075194 - protein, 20 aa, Mycobacterium
LDILVDRMRREFKVEANVGK

SEQ ID NO: 1075195 - protein, 18 aa, Mycobacterium
LDISPLQARCGWAIGWKK

SEQ ID NO: 1075196 - protein, 23 aa, Mycobacterium
LDKLGLPSKPSGWRKNTMACTGI

SEQ ID NO: 1075197 - protein, 18 aa, Mycobacterium
LDKNFGGILIIWDRMLGT

SEQ ID NO: 1075198 - protein, 27 aa, Mycobacterium
LDLAAVAPLPVLVAALGPVMLTLAGER

SEQ ID NO: 1075199 - protein, 25 aa, Mycobacterium
LDLGLRNYWGYNTFGFFAPHNQYAA

SEQ ID NO: 1075200 - protein, 17 aa, Mycobacterium
LDLLLSGRIFLAEEAAQ

SEQ ID NO: 1075201 - protein, 22 aa, Mycobacterium
LDLPPTLIFDHPTPHALTQHLH

SEQ ID NO: 1075202 - protein, 17 aa, Mycobacterium
LDMIRRSLSYFPPSAWS

SEQ ID NO: 1075203 - protein, 17 aa, Mycobacterium
LDMVRRRSRIRMEALPE

SEQ ID NO: 1075204 - protein, 21 aa, Mycobacterium
LDPAAIIRLRARSAGLLTAWV

SEQ ID NO: 1075205 - protein, 23 aa, Mycobacterium
LDPDLLLGEMAFVPSPTAAAEDH

SEQ ID NO: 1075206 - protein, 21 aa, Mycobacterium
LDPHLLMWDIRRTVPIDAWPR

SEQ ID NO: 1075207 - protein, 26 aa, Mycobacterium
LDPLPGTLPEPEIWARLVRALGFVTD

SEQ ID NO: 1075208 - protein, 19 aa, Mycobacterium
LDPNRFLFMNTDTVVHLHR

SEQ ID NO: 1075209 - protein, 30 aa, Mycobacterium; identical to SEQ ID NO: 832068

SEQ ID NO: 1075210 - protein, 23 aa, Mycobacterium
LDPRLPISDLLAEPLQANGFNKT

SEQ ID NO: 1075211 - protein, 18 aa, Mycobacterium
LDPRLVDAVIFGSADMAA

SEQ ID NO: 1075212 - protein, 17 aa, Mycobacterium
LDPRRFEVIAIGITPQG

SEQ ID NO: 1075213 - protein, 18 aa, Mycobacterium
LDPVLRVDLWQQFAELAR

SEQ ID NO: 1075214 - protein, 26 aa, Mycobacterium
LDPVTNYDVMFVPQGIGADLIATIEG

SEQ ID NO: 1075215 - protein, 25 aa, Mycobacterium
LDPYLEILPHFDTLLVMSVEPGFGG

SEQ ID NO: 1075216 - protein, 25 aa, Mycobacterium
LDRAPAPFHLLPLVARELGKDTEIV

SEQ ID NO: 1075217 - protein, 17 aa, Mycobacterium
LDRDLVLYTVLRLRLAP

SEQ ID NO: 1075218 - protein, 17 aa, Mycobacterium
LDRFLLKLNVGLPSRES

SEQ ID NO: 1075219 - protein, 27 aa, Mycobacterium
LDRHTQPLIRLPLCAEALAIRLIPDAA

SEQ ID NO: 1075220 - protein, 21 aa, Mycobacterium
LDRQMRVWARTLLDGYPAEQL

SEQ ID NO: 1075221 - protein, 29 aa, Mycobacterium
LDRRLGEARLFPLTQFMGDVYAGALLIER

SEQ ID NO: 1075222 - protein, 21 aa, Mycobacterium
LDRSVLPYLRTPFAQLSETRD

SEQ ID NO: 1075223 - protein, 24 aa, Mycobacterium
LDSADRLWIPVRRSWRLNERHYGA

SEQ ID NO: 1075224 - protein, 21 aa, Mycobacterium
LDSLLSIVQMPAGVPVATVSI

SEQ ID NO: 1075225 - protein, 22 aa, Mycobacterium
LDSLLSIVQMPAGVPVATVSIG

SEQ ID NO: 1075226 - protein, 21 aa, Mycobacterium
LDSRRLLLRPPKLDDAGPIYK

SEQ ID NO: 1075227 - protein, 28 aa, Mycobacterium
LDTAELDAEYWYRNIRQTVQFDQAVRSA

SEQ ID NO: 1075228 - protein, 17 aa, Mycobacterium
LDTTEVGPFKKGPFRIA

SEQ ID NO: 1075229 - protein, 26 aa, Mycobacterium
LDTVPRGYRIVPRPGAVTRRAISMLN

SEQ ID NO: 1075230 - protein, 23 aa, Mycobacterium
LDVEGGVYPMRRTDDGWWHTAIE

SEQ ID NO: 1075231 - protein, 17 aa, Mycobacterium
LDVHANTWRYNQLIAQQ

SEQ ID NO: 1075232 - protein, 17 aa, Mycobacterium
LDVPFRSAVAFIDTTLA

SEQ ID NO: 1075233 - protein, 23 aa, Mycobacterium
LDVPTFRMLAGLSGRVPLVSIVP

SEQ ID NO: 1075234 - protein, 28 aa, Mycobacterium
LDVQTDSFEWLIGSPCWRAAAASRGDLK

SEQ ID NO: 1075235 - protein, 27 aa, Mycobacterium
LDVVNAPTEALLGRPLIGDGADGAPGE

SEQ ID NO: 1075236 - protein, 17 aa, Mycobacterium
LDVYRRALAAAGGPELD

SEQ ID NO: 1075237 - protein, 28 aa, Mycobacterium
LDWDDELLSFFSIPRAMLPAIEPSSPLQ

SEQ ID NO: 1075238 - protein, 30 aa, Mycobacterium
LDYRKFLDRNLIGHIPLIGGGLSLLVSDGV

SEQ ID NO: 1075239 - protein, 27 aa, Mycobacterium
LDYSISFDTPTWLPGRLLAAVLDVTWR

SEQ ID NO: 1075240 - protein, 19 aa, Mycobacterium
LEAAGYRRAAEGTDADVVV

SEQ ID NO: 1075241 - protein, 27 aa, Mycobacterium
LEADSFSGWFLTVLGAARVAFAQFTQE

SEQ ID NO: 1075242 - protein, 28 aa, Mycobacterium
LEAHLISPWGTWEWMAPAAAGAALPVSG

SEQ ID NO: 1075243 - protein, 25 aa, Mycobacterium
LECDSTAHVLAWTQTLRAAALPGVV

SEQ ID NO: 1075244 - protein, 27 aa, Mycobacterium
LEDCYDIYRWLWLRGYNPGRLCLAGDS

SEQ ID NO: 1075245 - protein, 24 aa, Mycobacterium
LEDDKHFFPLYNLTEVVDTSLIND

SEQ ID NO: 1075246 - protein, 20 aa, Mycobacterium
LEDLGWYVADNLPPQLITRM

SEQ ID NO: 1075247 - protein, 24 aa, Mycobacterium
LEDTEVFFFLVGELLFLDADNKIL

SEQ ID NO: 1075248 - protein, 30 aa, Mycobacterium; identical to SEQ ID NO: 832371

SEQ ID NO: 1075249 - protein, 31 aa, Mycobacterium
LEEFVLSGGKRLRPIFAYRGWPAVTTEDPDP

SEQ ID NO: 1075250 - protein, 18 aa, Mycobacterium
LEEGRRLVHYPPNPYHRV

SEQ ID NO: 1075251 - protein, 33 aa, Mycobacterium; identical to SEQ ID NO: 832382

SEQ ID NO: 1075252 - protein, 18 aa, Mycobacterium
LEELKSLGLKTFLMPLNP

SEQ ID NO: 1075253 - protein, 31 aa, Mycobacterium
LEERDIRFVRLWFTDVLGYLKSVAIAPAELE

SEQ ID NO: 1075254 - protein, 19 aa, Mycobacterium
LEERLALWSDHYQLGEKLR

SEQ ID NO: 1075255 - protein, 21 aa, Mycobacterium
LEETGLLPHLNPGVMSWSELS

SEQ ID NO: 1075256 - protein, 19 aa, Mycobacterium
LEFFGIHFKEGERLWISWA

SEQ ID NO: 1075257 - protein, 25 aa, Mycobacterium
LEFRPKVIIAGWSAYPRVLDFAAFR

SEQ ID NO: 1075258 - protein, 19 aa, Mycobacterium
LEGYFDFHYRHRQDLMLVV

SEQ ID NO: 1075259 - protein, 27 aa, Mycobacterium
LEHDVRYYWDKHMSASFMVDPLGLELI

SEQ ID NO: 1075260 - protein, 18 aa, Mycobacterium
LEIRALPGVLSTETLVYL

SEQ ID NO: 1075261 - protein, 19 aa, Mycobacterium
LEKIIYFAAYVITSVDNEM

SEQ ID NO: 1075262 - protein, 17 aa, Mycobacterium
LELIGLMGVPPRDWDQE

SEQ ID NO: 1075263 - protein, 19 aa, Mycobacterium
LELLHAFALLQDDVMDQSP

SEQ ID NO: 1075264 - protein, 17 aa, Mycobacterium
LELLLRELDVHPSDVIE

SEQ ID NO: 1075265 - protein, 18 aa, Mycobacterium
LELVDPRFYHLDTVLAVL

SEQ ID NO: 1075266 - protein, 19 aa, Mycobacterium
LELVECAEFFKDTTFRVFQ

SEQ ID NO: 1075267 - protein, 19 aa, Mycobacterium
LELYLAVLNRHVDKLVAGV

SEQ ID NO: 1075268 - protein, 26 aa, Mycobacterium
LEMVADLRMLFIVSGKLKEGRRWLDR

SEQ ID NO: 1075269 - protein, 23 aa, Mycobacterium
LENPPLGLGFSVLAALVGLSRVA

SEQ ID NO: 1075270 - protein, 22 aa, Mycobacterium
LEPGSYGLLVGRYRDLVLEIAN

SEQ ID NO: 1075271 - protein, 22 aa, Mycobacterium
LEPLTAQGCIPLAIHPAMTFTG

SEQ ID NO: 1075272 - protein, 17 aa, Mycobacterium
LEQAISAVPPDIALFLD

SEQ ID NO: 1075273 - protein, 27 aa, Mycobacterium
LEQVAQRGLFLQPVDGEPGWFHYHQMF

SEQ ID NO: 1075274 - protein, 25 aa, Mycobacterium
LERAARLMVEAVRRHHPGSLKRVVF

SEQ ID NO: 1075275 - protein, 25 aa, Mycobacterium
LERDRPLWLMWVVEGLAEGKVALVM

SEQ ID NO: 1075276 - protein, 26 aa, Mycobacterium
LERHEDGFFYIKGRSSEMIISGGVNI

SEQ ID NO: 1075277 - protein, 20 aa, Mycobacterium
LERLRILDLGIIVAGGELSR

SEQ ID NO: 1075278 - protein, 25 aa, Mycobacterium
LERPRFDALGRWLLARTTQVSATAP

SEQ ID NO: 1075279 - protein, 19 aa, Mycobacterium
LERRILLSRVPELSKRLAK

SEQ ID NO: 1075280 - protein, 40 aa, Mycobacterium; identical to SEQ ID NO: 115765

SEQ ID NO: 1075281 - protein, 20 aa, Mycobacterium
LERYRLPFNALTQTSLADID

SEQ ID NO: 1075282 - protein, 17 aa, Mycobacterium
LESAIKQLIPAGDHTIV

SEQ ID NO: 1075283 - protein, 18 aa, Mycobacterium
LESAIKQLIPAGDHTIVV

SEQ ID NO: 1075284 - protein, 18 aa, Mycobacterium
LESLAYKIWGRAFEQFTA

SEQ ID NO: 1075285 - protein, 17 aa, Mycobacterium
LESLRARFGTLTGVERP

SEQ ID NO: 1075286 - protein, 25 aa, Mycobacterium
LESLRYDLAVQEIFVFTPKGDVITL

SEQ ID NO: 1075287 - protein, 29 aa, Mycobacterium
LESQIRVQSAWWPVQVPAAQLAAALVPMH

SEQ ID NO: 1075288 - protein, 18 aa, Mycobacterium
LESTVRFILSAKSAYVDG

SEQ ID NO: 1075289 - protein, 17 aa, Mycobacterium
LESVVLAAGALARFGSE

SEQ ID NO: 1075290 - protein, 25 aa, Mycobacterium
LETGPNFLGWTRPSTTTSTLTSVTT

SEQ ID NO: 1075291 - protein, 26 aa, Mycobacterium
LETRSLLRTKWYCRLQPATQAYAICA

SEQ ID NO: 1075292 - protein, 23 aa, Mycobacterium
LETSPYDAGLGRKVRLEKYFVGR

SEQ ID NO: 1075293 - protein, 30 aa, Mycobacterium; identical to SEQ ID NO: 832657

SEQ ID NO: 1075294 - protein, 25 aa, Mycobacterium
LEVEGRGRIWVDDKFRTKVEHIYAV

SEQ ID NO: 1075295 - protein, 19 aa, Mycobacterium
LEVFLPTGHSLRLPSWSVH

SEQ ID NO: 1075296 - protein, 23 aa, Mycobacterium
LEVHVPQWRFVAEWTSKGEILTP

SEQ ID NO: 1075297 - protein, 17 aa, Mycobacterium
LEVIELTGQPFAASAPR

SEQ ID NO: 1075298 - protein, 18 aa, Mycobacterium
LEVVFPGCEFLPLNDERR

SEQ ID NO: 1075299 - protein, 18 aa, Mycobacterium
LEWIVGHPDRVRSALLLA

SEQ ID NO: 1075300 - protein, 18 aa, Mycobacterium
LEWRQIQLVAGADTIRNG

SEQ ID NO: 1075301 - protein, 19 aa, Mycobacterium
LEYHWGPDWVCWDADQTFQ

SEQ ID NO: 1075302 - protein, 23 aa, Mycobacterium
LFADYTGLHWFRAALDARPVDEA

SEQ ID NO: 1075303 - protein, 27 aa, Mycobacterium
LFAEHLLTHYGVRRLLLTSRRGPSGVG

SEQ ID NO: 1075304 - protein, 24 aa, Mycobacterium
LFAKNLEAMFFMSQAIAAELKSRQ

SEQ ID NO: 1075305 - protein, 18 aa, Mycobacterium
LFARPQQLPPTDDHGRHL

SEQ ID NO: 1075306 - protein, 27 aa, Mycobacterium
LFDAVLNLNLKGPFRLSALVGERMVAA

SEQ ID NO: 1075307 - protein, 20 aa, Mycobacterium
LFDPGDRLGGVLRTECVGGQ

SEQ ID NO: 1075308 - protein, 25 aa, Mycobacterium
LFEDRGRRWPVIISGTITDASGRTL

SEQ ID NO: 1075309 - protein, 18 aa, Mycobacterium
LFEICARLTTKHGICSTR

SEQ ID NO: 1075310 - protein, 18 aa, Mycobacterium
LFEMLRYVGDRFPVLPMP

SEQ ID NO: 1075311 - protein, 37 aa, Mycobacterium; identical to SEQ ID NO: 832765

SEQ ID NO: 1075312 - protein, 40 aa, Mycobacterium; identical to SEQ ID NO: 832767

SEQ ID NO: 1075313 - protein, 19 aa, Mycobacterium
LFEVVWTPMTVAATDAAPA

SEQ ID NO: 1075314 - protein, 17 aa, Mycobacterium
LFGAQFITWRGIPLIPS

SEQ ID NO: 1075315 - protein, 19 aa, Mycobacterium
LFGHDIGFFNAGNHNVGMF

SEQ ID NO: 1075316 - protein, 23 aa, Mycobacterium
LFGQQIRYDLGCGFPLLTTKKVH

SEQ ID NO: 1075317 - protein, 17 aa, Mycobacterium
LFGRYWPANLHMIGKDI

SEQ ID NO: 1075318 - protein, 23 aa, Mycobacterium
LFGTHALEYQAISTQLSVFHEQF

SEQ ID NO: 1075319 - protein, 20 aa, Mycobacterium
LFGTLSLWQGVDVPGPSLSL

SEQ ID NO: 1075320 - protein, 26 aa, Mycobacterium
LFGTPDTWVLWNLTGGPRGGVHVTDV

SEQ ID NO: 1075321 - protein, 25 aa, Mycobacterium
LFGVAIAIEALRRGAARTQVRALLR

SEQ ID NO: 1075322 - protein, 20 aa, Mycobacterium
LFHARQKLRRKGCDLLVVNA

SEQ ID NO: 1075323 - protein, 19 aa, Mycobacterium
LFHDEFVRVLSAGADAYAS

SEQ ID NO: 1075324 - protein, 18 aa, Mycobacterium
LFHEAVHWDIPVAELSTD

SEQ ID NO: 1075325 - protein, 19 aa, Mycobacterium
LFIGGRWCKPTIAEPITVI

SEQ ID NO: 1075326 - protein, 18 aa, Mycobacterium
LFIVESSAAGLIVKADPS

SEQ ID NO: 1075327 - protein, 21 aa, Mycobacterium
LFLFGMDSIVAISLVHKARRQ

SEQ ID NO: 1075328 - protein, 26 aa, Mycobacterium
LFMREGHPFLWSLSDPRPDGLVVVEY

SEQ ID NO: 1075329 - protein, 21 aa, Mycobacterium
LFNRDAVFGIQLYVKRVFIMG

SEQ ID NO: 1075330 - protein, 18 aa, Mycobacterium
LFPDAILVSSADAYAFGL

SEQ ID NO: 1075331 - protein, 17 aa, Mycobacterium
LFPPGTGASLPAGLKGC

SEQ ID NO: 1075332 - protein, 19 aa, Mycobacterium
LFPVDLRRVYEDWPVVRIW

SEQ ID NO: 1075333 - protein, 21 aa, Mycobacterium
LFRPSPYAVRCCEQSIEILRT

SEQ ID NO: 1075334 - protein, 25 aa, Mycobacterium
LFRSRGVLPSRLRLIYLADGQVLDY

SEQ ID NO: 1075335 - protein, 25 aa, Mycobacterium
LFRSTGIPVCLWFFAKDKKARSGQV

SEQ ID NO: 1075336 - protein, 21 aa, Mycobacterium
LFSGHALDYQALSTQMAGFHQ

SEQ ID NO: 1075337 - protein, 20 aa, Mycobacterium
LFSRMVEVFAGFLSCTDAQI

SEQ ID NO: 1075338 - protein, 17 aa, Mycobacterium
LFTPATKTQHYLTAAAV

SEQ ID NO: 1075339 - protein, 19 aa, Mycobacterium
LFTRTGAGLAFTPGGLRLA

SEQ ID NO: 1075340 - protein, 18 aa, Mycobacterium
LFVGPPDAPLQLVRVRIV

SEQ ID NO: 1075341 - protein, 24 aa, Mycobacterium
LGAAYLEGFAWGLSRGYSVLVEMD

SEQ ID NO: 1075342 - protein, 26 aa, Mycobacterium
LGAEAFLLRRPEVPALLAELGLSERQ

SEQ ID NO: 1075343 - protein, 23 aa, Mycobacterium
LGAGNIGNFNFGFGNNGTGNFGF

SEQ ID NO: 1075344 - protein, 30 aa, Mycobacterium
LGAIAVPLNFRLTPSEIAFLVEDCAPRLVI

SEQ ID NO: 1075345 - protein, 20 aa, Mycobacterium
LGALGFPIHYRGNHLHLRVS

SEQ ID NO: 1075346 - protein, 24 aa, Mycobacterium
LGALHLDLRYVNGKSWLMFGPFAG

SEQ ID NO: 1075347 - protein, 28 aa, Mycobacterium
LGALPPNTSLLQWFPRALAAGDAAAVSV

SEQ ID NO: 1075348 - protein, 18 aa, Mycobacterium
LGAPEMRPYIAEMARIAD

SEQ ID NO: 1075349 - protein, 28 aa, Mycobacterium
LGAQPRDWFEVSLIPTTRELTTLGQAPV

SEQ ID NO: 1075350 - protein, 24 aa, Mycobacterium
LGASWVRVNSIRPGLIRTDLVAAI

SEQ ID NO: 1075351 - protein, 25 aa, Mycobacterium
LGAVSYWASLFPAVWSFCLALRSRG

SEQ ID NO: 1075352 - protein, 19 aa, Mycobacterium
LGAWGIIASVQPNFDARWG

SEQ ID NO: 1075353 - protein, 23 aa, Mycobacterium
LGCELRHAHRLVYSEGLDLSGDP

SEQ ID NO: 1075354 - protein, 20 aa, Mycobacterium
LGCRSLALVAFGTGVGGFPL

SEQ ID NO: 1075355 - protein, 27 aa, Mycobacterium
LGCVPGTVPVLVHPAPRGVLGEAAALV

SEQ ID NO: 1075356 - protein, 30 aa, Mycobacterium; identical to SEQ ID NO: 832969

SEQ ID NO: 1075357 - protein, 17 aa, Mycobacterium
LGDHIGQALGVRTLLVI

SEQ ID NO: 1075358 - protein, 29 aa, Mycobacterium
LGDLAEPLGFDGIWLPEHCGTPYGMTPNP

SEQ ID NO: 1075359 - protein, 17 aa, Mycobacterium
LGDLGSALGSALHDGAA

SEQ ID NO: 1075360 - protein, 21 aa, Mycobacterium
LGDLTAPWLGLDGLAPFQVLA

SEQ ID NO: 1075361 - protein, 25 aa, Mycobacterium
LGEALSVDLPLARLALERLAPGLGV

SEQ ID NO: 1075362 - protein, 26 aa, Mycobacterium
LGEDLVLYLFGTPGQRRFWFMWDDLV

SEQ ID NO: 1075363 - protein, 27 aa, Mycobacterium
LGEIHATWRINELLNWQVAAAGENINV

SEQ ID NO: 1075364 - protein, 17 aa, Mycobacterium
LGELRPAFDDIRPLRHG

SEQ ID NO: 1075365 - protein, 17 aa, Mycobacterium
LGERWTLLILRELVGGP

SEQ ID NO: 1075366 - protein, 20 aa, Mycobacterium
LGEWLVIHEGWRSELPEQLS

SEQ ID NO: 1075367 - protein, 27 aa, Mycobacterium
LGEYSLDLFALLPLGELWVAAARNRQV

SEQ ID NO: 1075368 - protein, 20 aa, Mycobacterium
LGFDGFARLSSSSALALVYV

SEQ ID NO: 1075369 - protein, 24 aa, Mycobacterium
LGFDVDTPWRKLPAKARKAILEGA

SEQ ID NO: 1075370 - protein, 17 aa, Mycobacterium
LGFEIDFNDLVYHGQRS

SEQ ID NO: 1075371 - protein, 19 aa, Mycobacterium
LGFGLTGDNLVGFGNAYYD

SEQ ID NO: 1075372 - protein, 18 aa, Mycobacterium
LGFSHFLRWERFAVVTNI

SEQ ID NO: 1075373 - protein, 17 aa, Mycobacterium
LGFTERPPAKPLIAAVE

SEQ ID NO: 1075374 - protein, 25 aa, Mycobacterium
LGFTQSYSYFTWRTAKWELTEFGND

SEQ ID NO: 1075375 - protein, 19 aa, Mycobacterium
LGGFLPERPTKAKTLTLPG

SEQ ID NO: 1075376 - protein, 20 aa, Mycobacterium
LGGITEREWRMCWPSVGAHT

SEQ ID NO: 1075377 - protein, 33 aa, Mycobacterium
LGGLAASVPAAIRLLGALRYDVVLLKTVGVGQS

SEQ ID NO: 1075378 - protein, 24 aa, Mycobacterium
LGGLSIALLAYQLSLQGKRAPVID

SEQ ID NO: 1075379 - protein, 24 aa, Mycobacterium
LGGRFRVLAPDLLGFGQSAKVVDF

SEQ ID NO: 1075380 - protein, 21 aa, Mycobacterium
LGHFALTNLLLPKLTDRVVTV

SEQ ID NO: 1075381 - protein, 17 aa, Mycobacterium
LGHLIEMLRGGPDYLMF

SEQ ID NO: 1075382 - protein, 20 aa, Mycobacterium
LGHSMGCAVIWSYLELFGTD

SEQ ID NO: 1075383 - protein, 23 aa, Mycobacterium
LGIEFPIFAFTHCRDVVLAVSKA

SEQ ID NO: 1075384 - protein, 20 aa, Mycobacterium
LGIGPHQVWWLSELTADPAV

SEQ ID NO: 1075385 - protein, 24 aa, Mycobacterium
LGIGPPITDGFYYDFEVLEPFTPD

SEQ ID NO: 1075386 - protein, 17 aa, Mycobacterium
LGILEHFPMNEYRPDNL

SEQ ID NO: 1075387 - protein, 28 aa, Mycobacterium
LGIPTIATVPWTTDRLLNALLRETETAK

SEQ ID NO: 1075388 - protein, 17 aa, Mycobacterium
LGITEQGFNFGDACRVP

SEQ ID NO: 1075389 - protein, 28 aa, Mycobacterium
LGITVPGFPNLFLIYGPGTHLAHGGSLI

SEQ ID NO: 1075390 - protein, 17 aa, Mycobacterium
LGKGILFLHVHVFARYY

SEQ ID NO: 1075391 - protein, 24 aa, Mycobacterium
LGKLQPLLIVSSDLRRAYDTATRL

SEQ ID NO: 1075392 - protein, 20 aa, Mycobacterium
LGKPAALLRAARASLGRKVR

SEQ ID NO: 1075393 - protein, 23 aa, Mycobacterium
LGKVRFHDWRAPFGSYGHLPNVA

SEQ ID NO: 1075394 - protein, 19 aa, Mycobacterium
LGLITTLARSGLIAPMRPD

SEQ ID NO: 1075395 - protein, 25 aa, Mycobacterium
LGLKIPSVPLPLWDSELSTGLVATL

SEQ ID NO: 1075396 - protein, 29 aa, Mycobacterium
LGLPEEIVARQPFPGPGLGIRIVGEVTGQ

SEQ ID NO: 1075397 - protein, 18 aa, Mycobacterium
LGLPMWPVSARTPAGLAA

SEQ ID NO: 1075398 - protein, 20 aa, Mycobacterium
LGLPVVVRPSFTMGGLGSGM

SEQ ID NO: 1075399 - protein, 20 aa, Mycobacterium
LGLQLGYWAAQPPGNAAELV

SEQ ID NO: 1075400 - protein, 19 aa, Mycobacterium
LGLRPPPPQRFPLSEAQAA

SEQ ID NO: 1075401 - protein, 17 aa, Mycobacterium
LGLSLRPKDLATKQAAA

SEQ ID NO: 1075402 - protein, 21 aa, Mycobacterium
LGLSYLLPRAIGSSRAFEIML

SEQ ID NO: 1075403 - protein, 27 aa, Mycobacterium
LGMANLDWLVVRDLVMIESATFWKEAP

SEQ ID NO: 1075404 - protein, 24 aa, Mycobacterium
LGMAVPGFPNFFMLCGPNTNVGSN

SEQ ID NO: 1075405 - protein, 20 aa, Mycobacterium
LGMDRFGIDLILPFEDRVNI

SEQ ID NO: 1075406 - protein, 22 aa, Mycobacterium
LGMFLNTVPLRIRLNAASYAAL

SEQ ID NO: 1075407 - protein, 32 aa, Mycobacterium
LGMVRDIWRFWYQIPILLPVIGPRVIADPKAR

SEQ ID NO: 1075408 - protein, 21 aa, Mycobacterium
LGNSLRRTLLSSIPGAAVTSI

SEQ ID NO: 1075409 - protein, 22 aa, Mycobacterium
LGNWTGIPVFKLTEAETTRLLR

SEQ ID NO: 1075410 - protein, 23 aa, Mycobacterium
LGPDFLVEVLEIRAALGPLIGRL

SEQ ID NO: 1075411 - protein, 17 aa, Mycobacterium
LGPLRRCRALGTAVGTF

SEQ ID NO: 1075412 - protein, 28 aa, Mycobacterium
LGQEGMGFIYLMQNLPQERISIAIMAAA

SEQ ID NO: 1075413 - protein, 25 aa, Mycobacterium
LGQLGFNYTLNIPTLPVDLDIYANF

SEQ ID NO: 1075414 - protein, 21 aa, Mycobacterium
LGQMVTARPCPTCRGVGVVIP

SEQ ID NO: 1075415 - protein, 20 aa, Mycobacterium
LGRAYALLLAARGAKVAVND

SEQ ID NO: 1075416 - protein, 20 aa, Mycobacterium
LGRLPVRLIDLPWAAQARTR

SEQ ID NO: 1075417 - protein, 23 aa, Mycobacterium
LGRQWWDMGFMSEALSLLLAGLP

SEQ ID NO: 1075418 - protein, 22 aa, Mycobacterium
LGRRELLPYSDLDLVLLHDGKP

SEQ ID NO: 1075419 - protein, 24 aa, Mycobacterium
LGRRVTEIALVFKRAPHLPFDATM

SEQ ID NO: 1075420 - protein, 33 aa, Mycobacterium; identical to SEQ ID NO: 833393

SEQ ID NO: 1075421 - protein, 26 aa, Mycobacterium
LGSKMNRFFLRGALVARLLSEAAWKQ

SEQ ID NO: 1075422 - protein, 36 aa, Mycobacterium
LGSLADTLWSLRRLGYRSRPLWRPFIRVGTVSAQQR

SEQ ID NO: 1075423 - protein, 34 aa, Mycobacterium
LGSQSLRPVLFSTFLMWVLADLFTYLPEVGDLDK

SEQ ID NO: 1075424 - protein, 25 aa, Mycobacterium
LGSRYFRLLPQRLVERIAPKPGTGP

SEQ ID NO: 1075425 - protein, 19 aa, Mycobacterium
LGSSVTLLARSRLLSRMEP

SEQ ID NO: 1075426 - protein, 18 aa, Mycobacterium
LGSYHRPVQTPSAQAQVW

SEQ ID NO: 1075427 - protein, 20 aa, Mycobacterium
LGTLRVTRALLPKLIASGDG

SEQ ID NO: 1075428 - protein, 23 aa, Mycobacterium
LGTSFPELMAGFTGGFTGLLQTG

SEQ ID NO: 1075429 - protein, 26 aa, Mycobacterium
LGTTLPAALVWAYPTITDLAGALCER

SEQ ID NO: 1075430 - protein, 37 aa, Mycobacterium; identical to SEQ ID NO: 833468

SEQ ID NO: 1075431 - protein, 18 aa, Mycobacterium
LGVALWLDAPLVELLTDA

SEQ ID NO: 1075432 - protein, 23 aa, Mycobacterium
LGVARLVTFLPGGAMSQSGYLAP

SEQ ID NO: 1075433 - protein, 23 aa, Mycobacterium
LGVEPPRGVLLYGPPGCGKTFVV

SEQ ID NO: 1075434 - protein, 27 aa, Mycobacterium
LGVFNAPTNALLGRPLIGNGADGAPGA

SEQ ID NO: 1075435 - protein, 22 aa, Mycobacterium
LGVHGFTRLPDGGPLRVVVTER

SEQ ID NO: 1075436 - protein, 21 aa, Mycobacterium
LGVLKRGAQLMYRFASRRQVS

SEQ ID NO: 1075437 - protein, 26 aa, Mycobacterium
LGVLQHLRSLLRPGGELRYLEHIASA

SEQ ID NO: 1075438 - protein, 26 aa, Mycobacterium
LGVMTELPLIVIGVQRGGPSTGLPTK

SEQ ID NO: 1075439 - protein, 25 aa, Mycobacterium
LGVSAATLYNWRRAYGGMDLDAAKE

SEQ ID NO: 1075440 - protein, 25 aa, Mycobacterium
LGVSGRACWLGRWRDWMLDHRDDLL

SEQ ID NO: 1075441 - protein, 21 aa, Mycobacterium
LGVSHLYLSPILTAVAGSSHG

SEQ ID NO: 1075442 - protein, 21 aa, Mycobacterium
LGVVYGRWTSSVLGSLAFSAN

SEQ ID NO: 1075443 - protein, 24 aa, Mycobacterium
LGWSLRRTPLPPTGQHWRLLSTIK

SEQ ID NO: 1075444 - protein, 18 aa, Mycobacterium
LGYADLAFMSSTARLKCP

SEQ ID NO: 1075445 - protein, 19 aa, Mycobacterium
LGYVVRWIDQGVGCSKVPD

SEQ ID NO: 1075446 - protein, 18 aa, Mycobacterium
LHAPPGIPVDIGPGATVA

SEQ ID NO: 1075447 - protein, 31 aa, Mycobacterium; identical to SEQ ID NO: 833569

SEQ ID NO: 1075448 - protein, 33 aa, Mycobacterium; identical to SEQ ID NO: 833570

SEQ ID NO: 1075449 - protein, 25 aa, Mycobacterium
LHDHVIQRLFAIGLALQGSVPRTRE

SEQ ID NO: 1075450 - protein, 38 aa, Mycobacterium; identical to SEQ ID NO: 833599

SEQ ID NO: 1075451 - protein, 24 aa, Mycobacterium
LHENVLTVRLMRADYVRCLVQHQE

SEQ ID NO: 1075452 - protein, 27 aa, Mycobacterium
LHEVRIMLEQYWPSVPHVLIEPGVRTG

SEQ ID NO: 1075453 - protein, 24 aa, Mycobacterium
LHGSIPAPQLLLDAIRDILCSVPS

SEQ ID NO: 1075454 - protein, 19 aa, Mycobacterium
LHGVAFDRPLARLKETVEI

SEQ ID NO: 1075455 - protein, 18 aa, Mycobacterium
LHIFPRACHGFDSLLPEW

SEQ ID NO: 1075456 - protein, 22 aa, Mycobacterium
LHLAAYRALGLTDWTYQRIECD

SEQ ID NO: 1075457 - protein, 17 aa, Mycobacterium
LHPYRVRHLLDRYGSLI

SEQ ID NO: 1075458 - protein, 21 aa, Mycobacterium
LHQKWFNLYDEATRVPFVITR

SEQ ID NO: 1075459 - protein, 20 aa, Mycobacterium
LHRALADLMPWLADRVDALK

SEQ ID NO: 1075460 - protein, 25 aa, Mycobacterium
LHRDRNWLGPAQQFGISAAILIGDV

SEQ ID NO: 1075461 - protein, 18 aa, Mycobacterium
LHRLGIQAFEPMLVEGKA

SEQ ID NO: 1075462 - protein, 19 aa, Mycobacterium
LHRLRREMPNLQEALQVAL

SEQ ID NO: 1075463 - protein, 26 aa, Mycobacterium
LHSIRAGYAGLLHQAPTSLSADGFDP

SEQ ID NO: 1075464 - protein, 26 aa, Mycobacterium
LHVQSLLDNWSFPATDPAVRARWEEC

SEQ ID NO: 1075465 - protein, 24 aa, Mycobacterium
LHVSTTLTPWPRGAGPRRAGVSSF

SEQ ID NO: 1075466 - protein, 18 aa, Mycobacterium
LHVVEVVVGENFTFGKKA

SEQ ID NO: 1075467 - protein, 19 aa, Mycobacterium
LHYARTLEIWAAALEAKKE

SEQ ID NO: 1075468 - protein, 20 aa, Mycobacterium
LHYNRVWVKALGKLPDDPIL

SEQ ID NO: 1075469 - protein, 19 aa, Mycobacterium
LIAFPEIRNLGYFTLVVQE

SEQ ID NO: 1075470 - protein, 18 aa, Mycobacterium
LIALYRNIAGEHPDWDEY

SEQ ID NO: 1075471 - protein, 27 aa, Mycobacterium
LIANTTSRLTVVDPCGWFGPRRRRWTL

SEQ ID NO: 1075472 - protein, 23 aa, Mycobacterium
LIAQLDQIFATRSLAEWTEIFDA

SEQ ID NO: 1075473 - protein, 30 aa, Mycobacterium; identical to SEQ ID NO: 833820

SEQ ID NO: 1075474 - protein, 24 aa, Mycobacterium
LIDDMVAACLKWEGGYVWACKNYD

SEQ ID NO: 1075475 - protein, 20 aa, Mycobacterium
LIDFVLSNLVNARYLRICVL

SEQ ID NO: 1075476 - protein, 25 aa, Mycobacterium
LIEAVKTALWLPGQVHVFIHGEAQA

SEQ ID NO: 1075477 - protein, 21 aa, Mycobacterium
LIEPDLRYLVNWGYGDPAYGW

SEQ ID NO: 1075478 - protein, 20 aa, Mycobacterium
LIFQSKLQMRYINLCLERLV

SEQ ID NO: 1075479 - protein, 19 aa, Mycobacterium
LIGANRLATAVLPGMLERQ

SEQ ID NO: 1075480 - protein, 18 aa, Mycobacterium
LIGEISDDLLARFKSIPL

SEQ ID NO: 1075481 - protein, 24 aa, Mycobacterium
LIGHTTVLPFTAPYTRFNGRLGAQ

SEQ ID NO: 1075482 - protein, 18 aa, Mycobacterium
LIGSPCWRAAAASRGDLK

SEQ ID NO: 1075483 - protein, 17 aa, Mycobacterium
LIGWTRGTGLMGHNDAI

SEQ ID NO: 1075484 - protein, 17 aa, Mycobacterium
LIGYQTRTYKSSGYTGM

SEQ ID NO: 1075485 - protein, 17 aa, Mycobacterium
LIIYDEVHLLPAPVFRM

SEQ ID NO: 1075486 - protein, 17 aa, Mycobacterium
LILDHDEHMRPETTKEG

SEQ ID NO: 1075487 - protein, 27 aa, Mycobacterium
LIPGAFWASYQYRREDMLPFYEDEHSA

SEQ ID NO: 1075488 - protein, 18 aa, Mycobacterium
LIPRGATLVSLAKGIELG

SEQ ID NO: 1075489 - protein, 24 aa, Mycobacterium
LIQRANARLVVFPELSLTGYQLEV

SEQ ID NO: 1075490 - protein, 21 aa, Mycobacterium
LIQRIVDRLPQKAPLIELDVQ

SEQ ID NO: 1075491 - protein, 21 aa, Mycobacterium
LISAWLYRPAGADPARPVPML

SEQ ID NO: 1075492 - protein, 18 aa, Mycobacterium
LISGGRFVFGVGAGWNIE

SEQ ID NO: 1075493 - protein, 18 aa, Mycobacterium
LITAEDWLEHPGSVGKPM

SEQ ID NO: 1075494 - protein, 34 aa, Mycobacterium; identical to SEQ ID NO: 834039

SEQ ID NO: 1075495 - protein, 18 aa, Mycobacterium
LITRYTIIHGLVDAPIQY

SEQ ID NO: 1075496 - protein, 17 aa, Mycobacterium
LITSITATLRMVRQRPA

SEQ ID NO: 1075497 - protein, 20 aa, Mycobacterium
LIVHWHDLGRYLGAYGHRDV

SEQ ID NO: 1075498 - protein, 22 aa, Mycobacterium
LKAMGVYPGLDGAAPVIGGECV

SEQ ID NO: 1075499 - protein, 21 aa, Mycobacterium
LKDKQLYTLDLGSLVAGSRYR

SEQ ID NO: 1075500 - protein, 22 aa, Mycobacterium
LKERGFRLLALTPKGDARALPE

SEQ ID NO: 1075501 - protein, 29 aa, Mycobacterium
LKEYASRGTWIWPPEPSLRLIADTIEFCA

SEQ ID NO: 1075502 - protein, 29 aa, Mycobacterium
LKGHFATMRHAASYWRGLSKVGKAVDARI

SEQ ID NO: 1075503 - protein, 23 aa, Mycobacterium
LKGHPLFAHITLLRSERSPIAAL

SEQ ID NO: 1075504 - protein, 21 aa, Mycobacterium
LKIAREWSGERVQWGKPLGKD

SEQ ID NO: 1075505 - protein, 17 aa, Mycobacterium
LKIINQPVQKRIPILLA

SEQ ID NO: 1075506 - protein, 22 aa, Mycobacterium
LKLINHPLRERIPISIAALGPR

SEQ ID NO: 1075507 - protein, 17 aa, Mycobacterium
LKLTLHPGVMTGYSHAE

SEQ ID NO: 1075508 - protein, 17 aa, Mycobacterium
LKLVAPLATDIASGETT

SEQ ID NO: 1075509 - protein, 30 aa, Mycobacterium; identical to SEQ ID NO: 220201

SEQ ID NO: 1075510 - protein, 26 aa, Mycobacterium
LKPVHRRVLYAMYDSGFRPDHSHAKS

SEQ ID NO: 1075511 - protein, 33 aa, Mycobacterium
LKRDFGMAWGVGGWLLTTFLQSAGAEAFVRLRA

SEQ ID NO: 1075512 - protein, 17 aa, Mycobacterium
LKRLLADAELEKDALRE

SEQ ID NO: 1075513 - protein, 17 aa, Mycobacterium
LKSDFDIGFLCITDDLF

SEQ ID NO: 1075514 - protein, 17 aa, Mycobacterium
LKSVHRAAAPGASYFVL

SEQ ID NO: 1075515 - protein, 19 aa, Mycobacterium
LKTQWAQAGARLGLSLDPK

SEQ ID NO: 1075516 - protein, 19 aa, Mycobacterium
LKTYYLPSENRRIKLRVSA

SEQ ID NO: 1075517 - protein, 17 aa, Mycobacterium
LKVAVVCKSLFGKAHTV

SEQ ID NO: 1075518 - protein, 19 aa, Mycobacterium
LKYAARLKGLIDVGTYNAS

SEQ ID NO: 1075519 - protein, 30 aa, Mycobacterium
LLAAINAPTQTLLGRPLIGNGANGAPGQNG

SEQ ID NO: 1075520 - protein, 20 aa, Mycobacterium
LLAALRLADRLIPHRAWILI

SEQ ID NO: 1075521 - protein, 19 aa, Mycobacterium
LLAATRRPVALPRLAALAQ

SEQ ID NO: 1075522 - protein, 18 aa, Mycobacterium
LLAECARRLLETSAVLGF

SEQ ID NO: 1075523 - protein, 17 aa, Mycobacterium
LLAHQELIRRGLLNDQE

SEQ ID NO: 1075524 - protein, 18 aa, Mycobacterium
LLALHQPGNPVVLSTVWD

SEQ ID NO: 1075525 - protein, 25 aa, Mycobacterium
LLALLASHGMLLALDLDIPVTSLDL

SEQ ID NO: 1075526 - protein, 18 aa, Mycobacterium
LLALRRFQRAGHRPIVLA

SEQ ID NO: 1075527 - protein, 19 aa, Mycobacterium
LLALYRRRGAFIDAGVGRH

SEQ ID NO: 1075528 - protein, 17 aa, Mycobacterium
LLAPKWQMMSDPQLTGY

SEQ ID NO: 1075529 - protein, 18 aa, Mycobacterium
LLAPQRLTEGLVGNGSIS

SEQ ID NO: 1075530 - protein, 17 aa, Mycobacterium
LLARSRLLSRMEPFVGD

SEQ ID NO: 1075531 - protein, 27 aa, Mycobacterium
LLASLPDGVLMRRAAFGLATEIGRELT

SEQ ID NO: 1075532 - protein, 19 aa, Mycobacterium
LLASYRRAIGDFTAGRRRK

SEQ ID NO: 1075533 - protein, 18 aa, Mycobacterium
LLATDLAYWQHTLAGLPE

SEQ ID NO: 1075534 - protein, 20 aa, Mycobacterium
LLCAGIIGYRSLLRAELPPG

SEQ ID NO: 1075535 - protein, 18 aa, Mycobacterium
LLCDEPLLALDPANANLV

SEQ ID NO: 1075536 - protein, 20 aa, Mycobacterium
LLCWGIVGTPLTLVPAPTRR

SEQ ID NO: 1075537 - protein, 24 aa, Mycobacterium
LLDGLATHLPPDSAVPAYLSRMLI

SEQ ID NO: 1075538 - protein, 29 aa, Mycobacterium
LLDIDDEFFVILRPAPSGTRLLLSDATAA

SEQ ID NO: 1075539 - protein, 28 aa, Mycobacterium
LLDLSSLWQIYGLDRPALKDRAFIPDTH

SEQ ID NO: 1075540 - protein, 32 aa, Mycobacterium
LLDLSSLWQIYGLDRPALKDRAFIPDTHPAFA

SEQ ID NO: 1075541 - protein, 18 aa, Mycobacterium
LLDRLQVVALPMRVRFRG

SEQ ID NO: 1075542 - protein, 18 aa, Mycobacterium
LLEALLRHYERTGSLAAL

SEQ ID NO: 1075543 - protein, 27 aa, Mycobacterium
LLEDPQLIARKLFRDMTHPLIARPLPA

SEQ ID NO: 1075544 - protein, 29 aa, Mycobacterium
LLEILPAKQREILILRVVVGLSAEETAAA

SEQ ID NO: 1075545 - protein, 28 aa, Mycobacterium
LLETADVSQRLRLLIDWTGDHLAEVEVN

SEQ ID NO: 1075546 - protein, 19 aa, Mycobacterium
LLEWAEIHGGLHRSGTPAQ

SEQ ID NO: 1075547 - protein, 19 aa, Mycobacterium
LLFNDLTVYFALAVRGRLQ

SEQ ID NO: 1075548 - protein, 17 aa, Mycobacterium
LLFRALSACNRLVCLLS

SEQ ID NO: 1075549 - protein, 21 aa, Mycobacterium
LLGGLGYRGFFELGDERRPIA

SEQ ID NO: 1075550 - protein, 27 aa, Mycobacterium
LLGLVERVPWLSVIPAYFVGVGVRPEH

SEQ ID NO: 1075551 - protein, 34 aa, Mycobacterium; identical to SEQ ID NO: 834468

SEQ ID NO: 1075552 - protein, 17 aa, Mycobacterium
LLGQIDVVFSNAGIVVA

SEQ ID NO: 1075553 - protein, 23 aa, Mycobacterium
LLGRLMIYDALEMTYRTIRIRKD

SEQ ID NO: 1075554 - protein, 23 aa, Mycobacterium
LLGSSMYSARLAAAKGLPYVFAH

SEQ ID NO: 1075555 - protein, 18 aa, Mycobacterium
LLGTKIYLDLRVKVAKNW

SEQ ID NO: 1075556 - protein, 27 aa, Mycobacterium
LLGVINTPTQALLGRPLIGNGANGTTV

SEQ ID NO: 1075557 - protein, 18 aa, Mycobacterium
LLGVMGAGDLWPLRDERI

SEQ ID NO: 1075558 - protein, 19 aa, Mycobacterium
LLHEILVAQVAIHLDVEPS

SEQ ID NO: 1075559 - protein, 27 aa, Mycobacterium
LLHGDYRLDNLLFDPDLRRVAVVDWQT

SEQ ID NO: 1075560 - protein, 18 aa, Mycobacterium
LLHRADAAVFPSHYEPFG

SEQ ID NO: 1075561 - protein, 17 aa, Mycobacterium
LLHRRPDQRRLLTDNPE

SEQ ID NO: 1075562 - protein, 17 aa, Mycobacterium
LLHSVKVIPSRGAWLEF

SEQ ID NO: 1075563 - protein, 17 aa, Mycobacterium
LLIVDRLSGRSRFSMLE

SEQ ID NO: 1075564 - protein, 17 aa, Mycobacterium
LLLDLFTDDPWWCDCSE

SEQ ID NO: 1075565 - protein, 38 aa, Mycobacterium
LLLETDQVFGWVAFEFGLYRYGLQARLAPGTPLARVFW

SEQ ID NO: 1075566 - protein, 26 aa, Mycobacterium
LLLTKGEYQLKLPPPFVPGLETAGVV

SEQ ID NO: 1075567 - protein, 18 aa, Mycobacterium
LLLVAQRVPYLQVWNLTC

SEQ ID NO: 1075568 - protein, 24 aa, Mycobacterium
LLNGPRYWLMNSIEKEPQGLPESK

SEQ ID NO: 1075569 - protein, 20 aa, Mycobacterium
LLNGYEPLFSLLNPRDADNL

SEQ ID NO: 1075570 - protein, 28 aa, Mycobacterium
LLNLVNAPTQALFGRPLIGNGADGAAGT

SEQ ID NO: 1075571 - protein, 33 aa, Mycobacterium; identical to SEQ ID NO: 834588

SEQ ID NO: 1075572 - protein, 20 aa, Mycobacterium
LLPSTPRQIALYQALMCIGI

SEQ ID NO: 1075573 - protein, 28 aa, Mycobacterium
LLPVYDKPMIYYPLTTLMMAGIRDIQLI

SEQ ID NO: 1075574 - protein, 19 aa, Mycobacterium
LLQNAPALSPLAAIGNLGA

SEQ ID NO: 1075575 - protein, 25 aa, Mycobacterium
LLQNRGVLPLRPAPGTRIAVIGGYA

SEQ ID NO: 1075576 - protein, 27 aa, Mycobacterium
LLRAINPVLGFLLRTPLAGSLGNQLMV

SEQ ID NO: 1075577 - protein, 24 aa, Mycobacterium
LLRAWDAAWPASRWYRYLQAQLEG

SEQ ID NO: 1075578 - protein, 23 aa, Mycobacterium
LLREAHVLCGLPVAVFRCDMILA

SEQ ID NO: 1075579 - protein, 28 aa, Mycobacterium
LLREERAKLRARIGQLQGRYDQLAARAA

SEQ ID NO: 1075580 - protein, 18 aa, Mycobacterium
LLREGVPSQWSIFFGAED

SEQ ID NO: 1075581 - protein, 25 aa, Mycobacterium
LLRGRVERMHRACLILTFGGGTNEV

SEQ ID NO: 1075582 - protein, 18 aa, Mycobacterium
LLRQRRALRETGGDPREA

SEQ ID NO: 1075583 - protein, 18 aa, Mycobacterium
LLRREFRLGNSAMVPLRT

SEQ ID NO: 1075584 - protein, 20 aa, Mycobacterium
LLRSMRSPIPITELQRHATG

SEQ ID NO: 1075585 - protein, 19 aa, Mycobacterium
LLRTLPLVVGGVSAGAAIL

SEQ ID NO: 1075586 - protein, 19 aa, Mycobacterium
LLSDIRLDFKPVVQTRYEP

SEQ ID NO: 1075587 - protein, 19 aa, Mycobacterium
LLTALREGSLDTALIALPA

SEQ ID NO: 1075588 - protein, 24 aa, Mycobacterium
LLTGGVVKPILWGPGKAAAVQRFA

SEQ ID NO: 1075589 - protein, 18 aa, Mycobacterium
LLTHYMPAHYSAGWWMDS

SEQ ID NO: 1075590 - protein, 19 aa, Mycobacterium
LLTILHDGGYHDTEIIRWL

SEQ ID NO: 1075591 - protein, 17 aa, Mycobacterium
LLTRGQLGIWLDLQING

SEQ ID NO: 1075592 - protein, 18 aa, Mycobacterium
LLVAAGLIAVSWPKEYGG

SEQ ID NO: 1075593 - protein, 24 aa, Mycobacterium
LLVESGMAPLFPLVVVVHADMEVR

SEQ ID NO: 1075594 - protein, 22 aa, Mycobacterium
LLVEVVVPVPPAYMGFHLSNLW

SEQ ID NO: 1075595 - protein, 18 aa, Mycobacterium
LLVSVFLDKDFSFVVSSE

SEQ ID NO: 1075596 - protein, 20 aa, Mycobacterium
LLYGNGGAGGWLFGQGGVGG

SEQ ID NO: 1075597 - protein, 26 aa, Mycobacterium
LMAVEDWPLLRWRMRQYRHGRWGTEI

SEQ ID NO: 1075598 - protein, 24 aa, Mycobacterium
LMCDQLYGRIVLASSIGGLYGNQG

SEQ ID NO: 1075599 - protein, 17 aa, Mycobacterium
LMCRAYDGLYAKGGKWA

SEQ ID NO: 1075600 - protein, 18 aa, Mycobacterium
LMDIDPIYVWTHDSIGLG

SEQ ID NO: 1075601 - protein, 29 aa, Mycobacterium
LMFAGAGSEPMLLAARGWSELSAELQSAA

SEQ ID NO: 1075602 - protein, 17 aa, Mycobacterium
LMGFELPDAATTAEVGF

SEQ ID NO: 1075603 - protein, 20 aa, Mycobacterium
LMLGIILPMINQDTAVLLNP

SEQ ID NO: 1075604 - protein, 18 aa, Mycobacterium
LMLLDHLTHGRVIGGMGP

SEQ ID NO: 1075605 - protein, 18 aa, Mycobacterium
LMLSFYMKTPGGFDVEFG

SEQ ID NO: 1075606 - protein, 19 aa, Mycobacterium
LMMPNLHMMARLRTGQPLG

SEQ ID NO: 1075607 - protein, 18 aa, Mycobacterium
LMRDVRFLRIGEGPSEAL

SEQ ID NO: 1075608 - protein, 24 aa, Mycobacterium
LMREGIGHLPIALVGGVAGAIAGA

SEQ ID NO: 1075609 - protein, 30 aa, Mycobacterium; identical to SEQ ID NO: 834934

SEQ ID NO: 1075610 - protein, 18 aa, Mycobacterium
LMTNYLPMAAHHGAQMFC

SEQ ID NO: 1075611 - protein, 24 aa, Mycobacterium
LMVDMAHFAGLVATGLHPSPVPHA

SEQ ID NO: 1075612 - protein, 24 aa, Mycobacterium
LNAMNAPIQAATGRPLIGNGTPGD

SEQ ID NO: 1075613 - protein, 20 aa, Mycobacterium
LNCVPSMLDMILDLGGDRLG

SEQ ID NO: 1075614 - protein, 31 aa, Mycobacterium; identical to SEQ ID NO: 834985

SEQ ID NO: 1075615 - protein, 23 aa, Mycobacterium
LNDTRVYFVEPAKWVAALRHANG

SEQ ID NO: 1075616 - protein, 25 aa, Mycobacterium
LNDVRSFLNPLPHVSFVHGAERVHQ

SEQ ID NO: 1075617 - protein, 17 aa, Mycobacterium
LNFQTMVTDLTGLEIAN

SEQ ID NO: 1075618 - protein, 23 aa, Mycobacterium
LNGFLAGILLGFDPARAPGLAAT

SEQ ID NO: 1075619 - protein, 19 aa, Mycobacterium
LNGTKCWITNGGKSSWYTV

SEQ ID NO: 1075620 - protein, 24 aa, Mycobacterium
LNKSQQWLICSLVHKFRGGDDDKD

SEQ ID NO: 1075621 - protein, 19 aa, Mycobacterium
LNLEYKLEVWDSPNSAGII

SEQ ID NO: 1075622 - protein, 20 aa, Mycobacterium
LNLGTYTAGGLPLQFPPEIT

SEQ ID NO: 1075623 - protein, 27 aa, Mycobacterium
LNLTGPYRLTMGLYRSLKASTAVGGAS

SEQ ID NO: 1075624 - protein, 17 aa, Mycobacterium
LNNERVMLGPAGRFASI

SEQ ID NO: 1075625 - protein, 24 aa, Mycobacterium
LNPDLAALYERLRAGGGPGAGQLQ

SEQ ID NO: 1075626 - protein, 24 aa, Mycobacterium
LNPRLDITGILLTRYDPRTVNSRE

SEQ ID NO: 1075627 - protein, 19 aa, Mycobacterium
LNRESSWLDFNARVLALAA

SEQ ID NO: 1075628 - protein, 33 aa, Mycobacterium; identical to SEQ ID NO: 835094

SEQ ID NO: 1075629 - protein, 17 aa, Mycobacterium
LNSLMAMAIRREAEMFV

SEQ ID NO: 1075630 - protein, 29 aa, Mycobacterium
LNTVNAPAQTLLGRPLIGNGANGAPGTGA

SEQ ID NO: 1075631 - protein, 46 aa, Mycobacterium; identical to SEQ ID NO: 835124

SEQ ID NO: 1075632 - protein, 26 aa, Mycobacterium
LNVPDMFTRMILSLAATGIAPGSFYE

SEQ ID NO: 1075633 - protein, 26 aa, Mycobacterium
LNVVNAPTQALLGRALIGNGANGADG

SEQ ID NO: 1075634 - protein, 17 aa, Mycobacterium
LNWEARSWRLDEDGQYE

SEQ ID NO: 1075635 - protein, 30 aa, Mycobacterium
LPAADPLLDGLASDPLLSGLGIMAGPAMGA

SEQ ID NO: 1075636 - protein, 24 aa, Mycobacterium
LPADPDAKPRPLAKARWAAAVDCV

SEQ ID NO: 1075637 - protein, 21 aa, Mycobacterium
LPAGLALAASFNPALARSAGE

SEQ ID NO: 1075638 - protein, 17 aa, Mycobacterium
LPAGSALLVVKRGPNAG

SEQ ID NO: 1075639 - protein, 26 aa, Mycobacterium
LPARMPAYQVPLPPLPHGLLITHVNL

SEQ ID NO: 1075640 - protein, 18 aa, Mycobacterium
LPASYFDGVTMAGGIAVL

SEQ ID NO: 1075641 - protein, 19 aa, Mycobacterium
LPAVLTQFPFLAPEDWNLP

SEQ ID NO: 1075642 - protein, 18 aa, Mycobacterium
LPAYGACAGMIMLASEIL

SEQ ID NO: 1075643 - protein, 19 aa, Mycobacterium
LPDAARSLGKSMRIFKSEM

SEQ ID NO: 1075644 - protein, 20 aa, Mycobacterium
LPDLPGITEAWPWTNRQATE

SEQ ID NO: 1075645 - protein, 18 aa, Mycobacterium
LPDMYYRHRGYAPFSLPS

SEQ ID NO: 1075646 - protein, 33 aa, Mycobacterium
LPDSVLRITPTGSWIFRKCAAWGLGRPDTADRL

SEQ ID NO: 1075647 - protein, 21 aa, Mycobacterium
LPEALTSRFILAPAARSKLSA

SEQ ID NO: 1075648 - protein, 19 aa, Mycobacterium
LPELEQHAVVLDLVRSHIA

SEQ ID NO: 1075649 - protein, 19 aa, Mycobacterium
LPENMAYAMVRWKNVLRQA

SEQ ID NO: 1075650 - protein, 31 aa, Mycobacterium; identical to SEQ ID NO: 835286

SEQ ID NO: 1075651 - protein, 24 aa, Mycobacterium
LPERERTVLVLRFFDSMTQTQIAE

SEQ ID NO: 1075652 - protein, 17 aa, Mycobacterium
LPESGLAATLRSAETTI

SEQ ID NO: 1075653 - protein, 19 aa, Mycobacterium
LPFGTGQVFFFGQPIAVVV

SEQ ID NO: 1075654 - protein, 17 aa, Mycobacterium
LPGEWPYVRGGDALRDV

SEQ ID NO: 1075655 - protein, 17 aa, Mycobacterium
LPGFIDPHSHYINALTV

SEQ ID NO: 1075656 - protein, 27 aa, Mycobacterium
LPGIAGNLTGLFNTGSNMSGVFSLEEL

SEQ ID NO: 1075657 - protein, 17 aa, Mycobacterium
LPGITRDSLLQLALDAG

SEQ ID NO: 1075658 - protein, 26 aa, Mycobacterium
LPGLIDAHWHAMFTTIPAALAQVSEF

SEQ ID NO: 1075659 - protein, 20 aa, Mycobacterium
LPGNAHFTFRGCEGDALLML

SEQ ID NO: 1075660 - protein, 19 aa, Mycobacterium
LPGRDFVFEHYRAITGLID

SEQ ID NO: 1075661 - protein, 17 aa, Mycobacterium
LPGTGAGTAGSIGSAGN

SEQ ID NO: 1075662 - protein, 23 aa, Mycobacterium
LPGVAMMVVLISRGGWATITVRY

SEQ ID NO: 1075663 - protein, 18 aa, Mycobacterium
LPGVLLTQVAAVRALARQ

SEQ ID NO: 1075664 - protein, 19 aa, Mycobacterium
LPGVWLIDVERVQREPSAH

SEQ ID NO: 1075665 - protein, 18 aa, Mycobacterium
LPHGVEVIGYWGEAVTTA

SEQ ID NO: 1075666 - protein, 38 aa, Mycobacterium
LPHQLLRSWYILYFQLPWLPERWASWVPRLLWRRWSPT

SEQ ID NO: 1075667 - protein, 19 aa, Mycobacterium
LPIESFRRRDEARKGLVAL

SEQ ID NO: 1075668 - protein, 32 aa, Mycobacterium
LPIQPKRVQRPHPPIWFGGRAPKALARAVRHG

SEQ ID NO: 1075669 - protein, 20 aa, Mycobacterium
LPITLDLPLDSEVRPIVVPD

SEQ ID NO: 1075670 - protein, 29 aa, Mycobacterium
LPIVPMFHANAWGLPYAALMAGADLVLPD

SEQ ID NO: 1075671 - protein, 26 aa, Mycobacterium
LPLASIFKLYVLHALAYAVRNGTVSW

SEQ ID NO: 1075672 - protein, 17 aa, Mycobacterium
LPLFETFGDSFGSNGAI

SEQ ID NO: 1075673 - protein, 18 aa, Mycobacterium
LPLRSRDRLPLMNALLGA

SEQ ID NO: 1075674 - protein, 20 aa, Mycobacterium
LPLVTIFAREYGALGIGIEY

SEQ ID NO: 1075675 - protein, 19 aa, Mycobacterium
LPLYARLPTAEQQKVFAPH

SEQ ID NO: 1075676 - protein, 25 aa, Mycobacterium
LPNMRTVLHCLPPKDWTESGFMGLG

SEQ ID NO: 1075677 - protein, 21 aa, Mycobacterium
LPPPYPPLPPLPPSPAWPVNP

SEQ ID NO: 1075678 - protein, 27 aa, Mycobacterium
LPPSHHYLAAYHWLDAGFGAHAVVHLG

SEQ ID NO: 1075679 - protein, 24 aa, Mycobacterium
LPRIARATKILDLARAYGIEASDF

SEQ ID NO: 1075680 - protein, 24 aa, Mycobacterium
LPRKDRWHSLARLAIRDDIYGALR

SEQ ID NO: 1075681 - protein, 18 aa, Mycobacterium
LPRKVAMEMLLTGEPITA

SEQ ID NO: 1075682 - protein, 22 aa, Mycobacterium
LPRKYYRTIAKMADTAWFVIRE

SEQ ID NO: 1075683 - protein, 21 aa, Mycobacterium
LPRQPRFALLKGRRNYLCLNK

SEQ ID NO: 1075684 - protein, 20 aa, Mycobacterium
LPRRGISALRRRAKRRPLDE

SEQ ID NO: 1075685 - protein, 17 aa, Mycobacterium
LPSPIFLAPIGVIGLCA

SEQ ID NO: 1075686 - protein, 23 aa, Mycobacterium
LPSRFRRPELAALQLRSLPFQPI

SEQ ID NO: 1075687 - protein, 19 aa, Mycobacterium
LPSSTQLPVWLSHAGADVL

SEQ ID NO: 1075688 - protein, 20 aa, Mycobacterium
LPTERGLLPGNGSFVAALRT

SEQ ID NO: 1075689 - protein, 31 aa, Mycobacterium
LPTIRSRTHHYPFRLLPRRTMRGLIGRICEQ

SEQ ID NO: 1075690 - protein, 18 aa, Mycobacterium
LPTKFMPAPGYSAYIAPD

SEQ ID NO: 1075691 - protein, 18 aa, Mycobacterium
LPTLAAQISAALQASLGT

SEQ ID NO: 1075692 - protein, 24 aa, Mycobacterium
LPTLADAVLPLRWTDGGMNRVRVL

SEQ ID NO: 1075693 - protein, 17 aa, Mycobacterium
LPTMPPWHVQENKWRAA

SEQ ID NO: 1075694 - protein, 18 aa, Mycobacterium
LPTWTRRELMLSRESVDH

SEQ ID NO: 1075695 - protein, 26 aa, Mycobacterium
LPVGDYCFWNLRNIVRFDKAIAAAVQ

SEQ ID NO: 1075696 - protein, 27 aa, Mycobacterium
LPVIGTKEFIAWLPTLLGLGSADAVVV

SEQ ID NO: 1075697 - protein, 18 aa, Mycobacterium
LPVLGDPLADLVQPNLKV

SEQ ID NO: 1075698 - protein, 19 aa, Mycobacterium
LPVMVLDPMLATGGSMTFT

SEQ ID NO: 1075699 - protein, 17 aa, Mycobacterium
LPVRTPFAYQGVFGHLA

SEQ ID NO: 1075700 - protein, 38 aa, Mycobacterium; identical to SEQ ID NO: 362053

SEQ ID NO: 1075701 - protein, 17 aa, Mycobacterium
LPVWLSHAGADVLRTHP

SEQ ID NO: 1075702 - protein, 24 aa, Mycobacterium
LPVWTLRLHLTGRRLWHDPRRRDC

SEQ ID NO: 1075703 - protein, 18 aa, Mycobacterium
LPWLAVTGHIVHHGGDNL

SEQ ID NO: 1075704 - protein, 18 aa, Mycobacterium
LPYVLDTFSYQGQISPAT

SEQ ID NO: 1075705 - protein, 41 aa, Mycobacterium
LQAAEQEVLAVINAPTNALLGRPLIGNGTDGLAGTGAAGGA

SEQ ID NO: 1075706 - protein, 17 aa, Mycobacterium
LQAALDEGRIVLVAGFQ

SEQ ID NO: 1075707 - protein, 18 aa, Mycobacterium
LQAFPDIAGHYRRRFRHV

SEQ ID NO: 1075708 - protein, 17 aa, Mycobacterium
LQALEQQLLAAINAPTQ

SEQ ID NO: 1075709 - protein, 18 aa, Mycobacterium
LQALGWAGTIWAGWGRPS

SEQ ID NO: 1075710 - protein, 25 aa, Mycobacterium
LQARLVLGQALAWRGRGREAGQVLT

SEQ ID NO: 1075711 - protein, 17 aa, Mycobacterium
LQARRPALAAAERAKAV

SEQ ID NO: 1075712 - protein, 18 aa, Mycobacterium
LQCPFHGWQWNQLGRNVC

SEQ ID NO: 1075713 - protein, 26 aa, Mycobacterium
LQEIDHVPFVAPLTRFAATAQSAEDA

SEQ ID NO: 1075714 - protein, 19 aa, Mycobacterium
LQELTWLAVHQKTGVRSRL

SEQ ID NO: 1075715 - protein, 17 aa, Mycobacterium
LQFRQFGGHAEFAGPIS

SEQ ID NO: 1075716 - protein, 27 aa, Mycobacterium
LQGNRRIPRWQFLSNELLPGLDVIVPA

SEQ ID NO: 1075717 - protein, 21 aa, Mycobacterium
LQGRNLVKVTRPLLSDPFEAQ

SEQ ID NO: 1075718 - protein, 33 aa, Mycobacterium
LQGSRAIRLLATTNLSLYATLMERHLSDGALPE

SEQ ID NO: 1075719 - protein, 17 aa, Mycobacterium
LQGWERRPIATADMVYA

SEQ ID NO: 1075720 - protein, 23 aa, Mycobacterium
LQKPTRLLPLFSGPAARPMNGVT

SEQ ID NO: 1075721 - protein, 17 aa, Mycobacterium
LQLARRIAAALNAPGGG

SEQ ID NO: 1075722 - protein, 19 aa, Mycobacterium
LQLKPQRGALPFAASPTLL

SEQ ID NO: 1075723 - protein, 25 aa, Mycobacterium
LQPASPIYNFRYPNMLRLHYEKKRN

SEQ ID NO: 1075724 - protein, 23 aa, Mycobacterium
LQQRLNSPGWRRAMAARTRIDEL

SEQ ID NO: 1075725 - protein, 26 aa, Mycobacterium
LQQVQSWLFNQPNTSVLIAPSFAISA

SEQ ID NO: 1075726 - protein, 27 aa, Mycobacterium
LQRDRFGWPILRRTQRWCQLFSEPGAG

SEQ ID NO: 1075727 - protein, 19 aa, Mycobacterium
LQRRTDRLAFDRRRYWDLF

SEQ ID NO: 1075728 - protein, 32 aa, Mycobacterium; identical to SEQ ID NO: 835765

SEQ ID NO: 1075729 - protein, 25 aa, Mycobacterium
LQSTQAAFILNFSCPIEQAWDRLRA

SEQ ID NO: 1075730 - protein, 17 aa, Mycobacterium
LQTGVRWKDLGLVVVDE

SEQ ID NO: 1075731 - protein, 34 aa, Mycobacterium
LQTLEQDALGIINAPTQALVGRPLIGNGANGTAA

SEQ ID NO: 1075732 - protein, 24 aa, Mycobacterium
LQVIFRPRIALDPYAIGVPGVYLC

SEQ ID NO: 1075733 - protein, 17 aa, Mycobacterium
LQVPSVHDPDLAPPGKH

SEQ ID NO: 1075734 - protein, 18 aa, Mycobacterium
LQVVLLEPMLRRVEFLQE

SEQ ID NO: 1075735 - protein, 20 aa, Mycobacterium
LQYAGAFLRSGRTPARRPRL

SEQ ID NO: 1075736 - protein, 26 aa, Mycobacterium
LQYAKTWRTLAKLSLPNKYLRDNADD

SEQ ID NO: 1075737 - protein, 18 aa, Mycobacterium
LQYYRRTAFVPQPGPTTS

SEQ ID NO: 1075738 - protein, 27 aa, Mycobacterium
LRAGYGSLIQMIWIYDRAVDVEGLRRF

SEQ ID NO: 1075739 - protein, 19 aa, Mycobacterium
LRAHLDAWLARFAAPGMCN

SEQ ID NO: 1075740 - protein, 21 aa, Mycobacterium
LRAHWLRRLCANMLCKLGVFS

SEQ ID NO: 1075741 - protein, 18 aa, Mycobacterium
LRAIMRLRERMGVTLQMR

SEQ ID NO: 1075742 - protein, 18 aa, Mycobacterium
LRALFINTTLKRSPDLSH

SEQ ID NO: 1075743 - protein, 18 aa, Mycobacterium
LRALINPIHATGGITILR

SEQ ID NO: 1075744 - protein, 17 aa, Mycobacterium
LRALNYPKVVIGVSGGL

SEQ ID NO: 1075745 - protein, 45 aa, Mycobacterium; identical to SEQ ID NO: 835840

SEQ ID NO: 1075746 - protein, 17 aa, Mycobacterium
LRAPMSAGYRYLGGAPP

SEQ ID NO: 1075747 - protein, 17 aa, Mycobacterium
LRAQEVLSGDLFAALAG

SEQ ID NO: 1075748 - protein, 21 aa, Mycobacterium
LRAQEVLSGDLFAALAGASTH

SEQ ID NO: 1075749 - protein, 17 aa, Mycobacterium
LRARDFVSLVSGGIHAE

SEQ ID NO: 1075750 - protein, 27 aa, Mycobacterium
LRARPQLAVTFRNGWRWATVEGGAELA

SEQ ID NO: 1075751 - protein, 33 aa, Mycobacterium; identical to SEQ ID NO: 947527

SEQ ID NO: 1075752 - protein, 20 aa, Mycobacterium
LRAVTLVPGYGAAKAGIICV

SEQ ID NO: 1075753 - protein, 20 aa, Mycobacterium
LRAWLTTVVSRLGLDKLRSA

SEQ ID NO: 1075754 - protein, 18 aa, Mycobacterium
LRCIGCGLCIEACPTRAL

SEQ ID NO: 1075755 - protein, 30 aa, Mycobacterium
LRDAPLAIDLPRDFPRPLRGSFRGARVPIV

SEQ ID NO: 1075756 - protein, 18 aa, Mycobacterium
LRDGAGVARMPLARALRS

SEQ ID NO: 1075757 - protein, 22 aa, Mycobacterium
LRDGHWLHFRDFMNSALTLQAF

SEQ ID NO: 1075758 - protein, 23 aa, Mycobacterium
LRDHNMQWDFWSLSPESAHQVTW

SEQ ID NO: 1075759 - protein, 18 aa, Mycobacterium
LRDLGSAASPFNAFLVAQ

SEQ ID NO: 1075760 - protein, 26 aa, Mycobacterium
LRDRLPKIYLELLDAARGLERLAAEV

SEQ ID NO: 1075761 - protein, 17 aa, Mycobacterium
LRDRVHWRGWSPGPGPA

SEQ ID NO: 1075762 - protein, 26 aa, Mycobacterium
LRDSVLDAMRDLLFTRDWSAITLSDV

SEQ ID NO: 1075763 - protein, 23 aa, Mycobacterium
LREAVRVFGFHLSGLDMRQNSDV

SEQ ID NO: 1075764 - protein, 17 aa, Mycobacterium
LRECHSLRYVFCGGEPL

SEQ ID NO: 1075765 - protein, 19 aa, Mycobacterium
LREDALLTRLLHDSIRANI

SEQ ID NO: 1075766 - protein, 18 aa, Mycobacterium
LREGSLDTALIALPADYG

SEQ ID NO: 1075767 - protein, 17 aa, Mycobacterium
LREKPLLANVDTLRCWL

SEQ ID NO: 1075768 - protein, 21 aa, Mycobacterium
LRETPLQWPCPPDGASNRSPI

SEQ ID NO: 1075769 - protein, 23 aa, Mycobacterium
LRFAYDGLIPLPDGARLREQHRV

SEQ ID NO: 1075770 - protein, 33 aa, Mycobacterium; identical to SEQ ID NO: 121199

SEQ ID NO: 1075771 - protein, 29 aa, Mycobacterium
LRGGTFHGIQLWVNLPRKKKSTPPRYQAI

SEQ ID NO: 1075772 - protein, 25 aa, Mycobacterium
LRGHLGHWLPDLVAEVRRVLGLDCD

SEQ ID NO: 1075773 - protein, 24 aa, Mycobacterium
LRGLGPRMVLPGHGPDLADIRIVA

SEQ ID NO: 1075774 - protein, 37 aa, Mycobacterium; identical to SEQ ID NO: 836056

SEQ ID NO: 1075775 - protein, 29 aa, Mycobacterium
LRGLPEVFRALLALILIVLRRDTGAAGQT

SEQ ID NO: 1075776 - protein, 23 aa, Mycobacterium
LRGNNWVAFNGCCEPGWAHRDSI

SEQ ID NO: 1075777 - protein, 18 aa, Mycobacterium
LRGRAALIDLKQAKPASA

SEQ ID NO: 1075778 - protein, 28 aa, Mycobacterium
LRGVASMAFLPWPLRALAGPFNLFATTG

SEQ ID NO: 1075779 - protein, 19 aa, Mycobacterium
LRIFAGAGSAPMLEAAVAW

SEQ ID NO: 1075780 - protein, 18 aa, Mycobacterium
LRIGMMGVWIGAIQNMYP

SEQ ID NO: 1075781 - protein, 19 aa, Mycobacterium
LRIQRRPDGSLQHPPLPAV

SEQ ID NO: 1075782 - protein, 25 aa, Mycobacterium
LRKENPRLPVLLLTAKDAVEDRIAG

SEQ ID NO: 1075783 - protein, 17 aa, Mycobacterium
LRKILHLDSDGPAALDE

SEQ ID NO: 1075784 - protein, 31 aa, Mycobacterium
LRKNALFPFVDFIRALSEEQVFFPPTGRALF

SEQ ID NO: 1075785 - protein, 22 aa, Mycobacterium
LRKRYQLGERPTVVCVSRLVPR

SEQ ID NO: 1075786 - protein, 26 aa, Mycobacterium
LRKSRSEMAWAFPAVPMVVRIPAANP

SEQ ID NO: 1075787 - protein, 17 aa, Mycobacterium
LRKTLGVPLFQEQLMQL

SEQ ID NO: 1075788 - protein, 21 aa, Mycobacterium
LRLADVLAYREELHARRNRFI

SEQ ID NO: 1075789 - protein, 20 aa, Mycobacterium
LRLPFGRLWGYDVSVSDLGR

SEQ ID NO: 1075790 - protein, 26 aa, Mycobacterium
LRLVTRAREMLWANRLRWNRTTTGDT

SEQ ID NO: 1075791 - protein, 17 aa, Mycobacterium
LRMLAAQLGSDVPFALH

SEQ ID NO: 1075792 - protein, 18 aa, Mycobacterium
LRMTLRELASRRVTADLM

SEQ ID NO: 1075793 - protein, 19 aa, Mycobacterium
LRNAELAHIFTKDAKAFGI

SEQ ID NO: 1075794 - protein, 25 aa, Mycobacterium
LRNHARWAVLLRNLRYLIVDECHYY

SEQ ID NO: 1075795 - protein, 18 aa, Mycobacterium
LRNLFKLSSLASFEGQLG

SEQ ID NO: 1075796 - protein, 18 aa, Mycobacterium
LRNLHIPEYLHGTWTNHE

SEQ ID NO: 1075797 - protein, 23 aa, Mycobacterium
LRPHGLTLRHFPQSFGFSSLGGW

SEQ ID NO: 1075798 - protein, 19 aa, Mycobacterium
LRPPSLLAVEPPDHTRYRK

SEQ ID NO: 1075799 - protein, 27 aa, Mycobacterium
LRPQGQALVFWDCYRPHDVQVKMFQVV

SEQ ID NO: 1075800 - protein, 19 aa, Mycobacterium
LRQALSNFSAWVTGLRRVE

SEQ ID NO: 1075801 - protein, 17 aa, Mycobacterium
LRQQPVVMAPRTTFLPF

SEQ ID NO: 1075802 - protein, 21 aa, Mycobacterium
LRQVGIKIWVDGSPWIGNIDL

SEQ ID NO: 1075803 - protein, 18 aa, Mycobacterium
LRQYLLEQNALPDAPLVA

SEQ ID NO: 1075804 - protein, 26 aa, Mycobacterium
LRRHLMLSAMVRSIRWDEDTWGWVCQ

SEQ ID NO: 1075805 - protein, 18 aa, Mycobacterium
LRRLEGHFTLVFANADDP

SEQ ID NO: 1075806 - protein, 20 aa, Mycobacterium
LRRPVVRAKLWLQCAIAGTP

SEQ ID NO: 1075807 - protein, 17 aa, Mycobacterium
LRRQIAVLSGKPAGKAV

SEQ ID NO: 1075808 - protein, 26 aa, Mycobacterium
LRRQYDPLMSPLVWDLAHIGQQEELW

SEQ ID NO: 1075809 - protein, 18 aa, Mycobacterium
LRRRTGGSDAGWHLKLPA

SEQ ID NO: 1075810 - protein, 24 aa, Mycobacterium
LRRSLEQALFTAESRIRAVSDYID

SEQ ID NO: 1075811 - protein, 17 aa, Mycobacterium
LRRVAPHALSMLRGFNL

SEQ ID NO: 1075812 - protein, 17 aa, Mycobacterium
LRRWRSAVRSAARQSRR

SEQ ID NO: 1075813 - protein, 32 aa, Mycobacterium; identical to SEQ ID NO: 836337

SEQ ID NO: 1075814 - protein, 28 aa, Mycobacterium
LRSVATWLRTMFAIMPLPVGTRDQDLPD

SEQ ID NO: 1075815 - protein, 17 aa, Mycobacterium
LRTPLVLPASGSVAVQV

SEQ ID NO: 1075816 - protein, 18 aa, Mycobacterium
LRTRLFAAPGWVVSPGVV

SEQ ID NO: 1075817 - protein, 19 aa, Mycobacterium
LRVFELHPLFNPAGYVVAE

SEQ ID NO: 1075818 - protein, 29 aa, Mycobacterium
LRVGGMLFSAGYPGFLRGVAALGSGEFAV

SEQ ID NO: 1075819 - protein, 23 aa, Mycobacterium
LRVGHLVLCDAFRHPAVLAKEAV

SEQ ID NO: 1075820 - protein, 23 aa, Mycobacterium
LRVGQPVVAVGSPLGLAGTVTSG

SEQ ID NO: 1075821 - protein, 24 aa, Mycobacterium
LRVIMRVRERMGVVLQMRDFVSAG

SEQ ID NO: 1075822 - protein, 19 aa, Mycobacterium
LRVIRPLCPVSISGADFSQ

SEQ ID NO: 1075823 - protein, 33 aa, Mycobacterium; identical to SEQ ID NO: 836437

SEQ ID NO: 1075824 - protein, 22 aa, Mycobacterium
LRVYAKSTNLPRVLGGLGVAII

SEQ ID NO: 1075825 - protein, 20 aa, Mycobacterium
LRWAQLFGNPLTWSDLAWLR

SEQ ID NO: 1075826 - protein, 19 aa, Mycobacterium
LRWDSLGEFLALGASLEDM

SEQ ID NO: 1075827 - protein, 29 aa, Mycobacterium
LRYGNHVPLTYPFALTFPAMMSLVTGFDF

SEQ ID NO: 1075828 - protein, 21 aa, Mycobacterium
LRYLEQLEFGLVREALFEREL

SEQ ID NO: 1075829 - protein, 33 aa, Mycobacterium; identical to SEQ ID NO: 836452

SEQ ID NO: 1075830 - protein, 26 aa, Mycobacterium
LRYRTGDWVYIPKATTWRQLPDTETT

SEQ ID NO: 1075831 - protein, 20 aa, Mycobacterium
LRYVAAWNAAFLPSKDLTEG

SEQ ID NO: 1075832 - protein, 18 aa, Mycobacterium
LRYYLIEQDALPDAPLIA

SEQ ID NO: 1075833 - protein, 25 aa, Mycobacterium
LSADDIAHIWALLGLTVAGPDVPTL

SEQ ID NO: 1075834 - protein, 25 aa, Mycobacterium
LSAGDFVRWCRQVLDLLDQVRNAAP

SEQ ID NO: 1075835 - protein, 20 aa, Mycobacterium
LSAGLRAGLPPKAAPDKPDE

SEQ ID NO: 1075836 - protein, 20 aa, Mycobacterium
LSALLAWPTDHLTEAAAHWD

SEQ ID NO: 1075837 - protein, 21 aa, Mycobacterium
LSALPGIGQAAAAPAAALFNL

SEQ ID NO: 1075838 - protein, 18 aa, Mycobacterium
LSALTAEAGRAPGARCAG

SEQ ID NO: 1075839 - protein, 24 aa, Mycobacterium
LSANPFVLYPSYREIAHLPLAERV

SEQ ID NO: 1075840 - protein, 19 aa, Mycobacterium
LSAQAAAFHERFLQTLSGG

SEQ ID NO: 1075841 - protein, 30 aa, Mycobacterium
LSAQAAQFHQGLMQLLNSAGGAYAGAEAAN

SEQ ID NO: 1075842 - protein, 27 aa, Mycobacterium
LSAQAITFHEQFVRALSSAGGAYAAAE

SEQ ID NO: 1075843 - protein, 19 aa, Mycobacterium
LSARDMTVCILDRPRHAQL

SEQ ID NO: 1075844 - protein, 30 aa, Mycobacterium
LSATSGIIWRFSISATLWSCIPRSWCLRRY

SEQ ID NO: 1075845 - protein, 26 aa, Mycobacterium
LSDDEFGFFVILLAVAGNETTRNSIT

SEQ ID NO: 1075846 - protein, 20 aa, Mycobacterium
LSDRWMLIFTSNTGGKPKAV

SEQ ID NO: 1075847 - protein, 24 aa, Mycobacterium
LSEAEFLARREAVERVMVVRDRVR

SEQ ID NO: 1075848 - protein, 17 aa, Mycobacterium
LSEALRIELEPHRIGVT

SEQ ID NO: 1075849 - protein, 18 aa, Mycobacterium
LSEGAPVLVLRRTSYTDG

SEQ ID NO: 1075850 - protein, 19 aa, Mycobacterium
LSEHFLVLQRFMVAQAEAG

SEQ ID NO: 1075851 - protein, 20 aa, Mycobacterium
LSEILSPERALQVLNAYLER

SEQ ID NO: 1075852 - protein, 19 aa, Mycobacterium
LSELLAAQPRWRASATARC

SEQ ID NO: 1075853 - protein, 32 aa, Mycobacterium
LSEQFRAVVPPATPFALALRMLVIALKNNEIL

SEQ ID NO: 1075854 - protein, 23 aa, Mycobacterium
LSGAGTPGLPGNGGLLIDTIGNT

SEQ ID NO: 1075855 - protein, 27 aa, Mycobacterium
LSGSGPAYFLLMVEALVDAGVAAGLSR

SEQ ID NO: 1075856 - protein, 17 aa, Mycobacterium
LSILPRSVTAFIGPSGC

SEQ ID NO: 1075857 - protein, 17 aa, Mycobacterium
LSIMHLSDTPRPGDPRL

SEQ ID NO: 1075858 - protein, 20 aa, Mycobacterium
LSIRGGGYGGLGGNGGTGGA

SEQ ID NO: 1075859 - protein, 18 aa, Mycobacterium
LSLDNGIHMMWATRNFNA

SEQ ID NO: 1075860 - protein, 26 aa, Mycobacterium
LSLGHRQIGLLTMRLGRDRRQDLVDA

SEQ ID NO: 1075861 - protein, 24 aa, Mycobacterium
LSMALLGTGFGYSAGRRATQAALL

SEQ ID NO: 1075862 - protein, 28 aa, Mycobacterium
LSNREKLPYILRLFDIQGLSTRSAASLV

SEQ ID NO: 1075863 - protein, 26 aa, Mycobacterium
LSNYWGYNTISFFVPDPKYSSAMLPG

SEQ ID NO: 1075864 - protein, 17 aa, Mycobacterium
LSPDMRDAFNAYTDAVR

SEQ ID NO: 1075865 - protein, 21 aa, Mycobacterium
LSPRQRAVLLLRDVLQWKAAE

SEQ ID NO: 1075866 - protein, 21 aa, Mycobacterium
LSQLMSQITRYQPESVFPGIE

SEQ ID NO: 1075867 - protein, 27 aa, Mycobacterium
LSRAGWLRWSDKLAAAPLPPGKGPIAL

SEQ ID NO: 1075868 - protein, 27 aa, Mycobacterium
LSRAVFSKGIFPAVDPLASSSTILDPG

SEQ ID NO: 1075869 - protein, 27 aa, Mycobacterium
LSRGMLEVLPLTHIRGRLLHDSFVIVD

SEQ ID NO: 1075870 - protein, 28 aa, Mycobacterium
LSRGTWLAERLGLKRLLRSDILPLSFGF

SEQ ID NO: 1075871 - protein, 27 aa, Mycobacterium
LSRQRPEIDWFPWLAQQLRGASPGAAR

SEQ ID NO: 1075872 - protein, 23 aa, Mycobacterium
LSRRRLVRIPWDLDSYGLDPDEF

SEQ ID NO: 1075873 - protein, 23 aa, Mycobacterium
LSRRYRVPVLSVHAPCLLISQRV

SEQ ID NO: 1075874 - protein, 21 aa, Mycobacterium
LSRYLAGPGVPTMFGRDARLQ

SEQ ID NO: 1075875 - protein, 18 aa, Mycobacterium
LSSCFLEPLESTGIFLIY

SEQ ID NO: 1075876 - protein, 36 aa, Mycobacterium; identical to SEQ ID NO: 362407

SEQ ID NO: 1075877 - protein, 24 aa, Mycobacterium
LSSDQAWAMLGVTPMIGVNDDTSE

SEQ ID NO: 1075878 - protein, 23 aa, Mycobacterium
LSSEKIGPYLTLAASLAITRQSG

SEQ ID NO: 1075879 - protein, 24 aa, Mycobacterium
LSSRAEWLPAWQDGLQRAAVAIDS

SEQ ID NO: 1075880 - protein, 22 aa, Mycobacterium
LSTIDSWVRLLTSVRPSLSATR

SEQ ID NO: 1075881 - protein, 20 aa, Mycobacterium
LSTKFTRLTGRSPILLAGMT

SEQ ID NO: 1075882 - protein, 30 aa, Mycobacterium; identical to SEQ ID NO: 947638

SEQ ID NO: 1075883 - protein, 25 aa, Mycobacterium
LSTQVAAFHTQFVEAVTGAGNAYAA

SEQ ID NO: 1075884 - protein, 27 aa, Mycobacterium
LSTYFHEQVFPVLTPLAVDPAHPFPFV

SEQ ID NO: 1075885 - protein, 19 aa, Mycobacterium
LSVDLPDLIAAAVASRSLT

SEQ ID NO: 1075886 - protein, 24 aa, Mycobacterium
LSVDRLRYPVFSWQRITLQEMTHM

SEQ ID NO: 1075887 - protein, 18 aa, Mycobacterium
LSVITWPKQYGGRDAPLL

SEQ ID NO: 1075888 - protein, 21 aa, Mycobacterium
LSVNQAIQWPLVELQTEAQMV

SEQ ID NO: 1075889 - protein, 24 aa, Mycobacterium
LSVPLSTWRDAAPVPILGSAWGLV

SEQ ID NO: 1075890 - protein, 18 aa, Mycobacterium
LSVPQAWITAIAASPVVS

SEQ ID NO: 1075891 - protein, 18 aa, Mycobacterium
LSVPVGDHRVLVLAGRIH

SEQ ID NO: 1075892 - protein, 21 aa, Mycobacterium
LSVREVTGVPILFASTGEKLE

SEQ ID NO: 1075893 - protein, 28 aa, Mycobacterium
LSVVNPLVDATWRFMTLDHDGKIRMDCS

SEQ ID NO: 1075894 - protein, 18 aa, Mycobacterium
LSYHAELDWWTSPFVLTD

SEQ ID NO: 1075895 - protein, 23 aa, Mycobacterium
LTAAVLLQRAGLRTLCLDAKLYA

SEQ ID NO: 1075896 - protein, 19 aa, Mycobacterium
LTADRELLPDVWHLADELA

SEQ ID NO: 1075897 - protein, 22 aa, Mycobacterium
LTAFAALWETINLEDWKCWARW

SEQ ID NO: 1075898 - protein, 19 aa, Mycobacterium
LTAFIMVTVTQRKLGEIGN

SEQ ID NO: 1075899 - protein, 18 aa, Mycobacterium
LTAFLSTGGHRVVRLVRG

SEQ ID NO: 1075900 - protein, 20 aa, Mycobacterium
LTAHAHADLRHPPPGDLSAP

SEQ ID NO: 1075901 - protein, 24 aa, Mycobacterium
LTAPLMQWFFDHYADPDARTDPRI

SEQ ID NO: 1075902 - protein, 24 aa, Mycobacterium
LTATNLLFAAKLLRENPYSVNIAQ

SEQ ID NO: 1075903 - protein, 21 aa, Mycobacterium
LTAVATPNWHYLHIHNDVIPA

SEQ ID NO: 1075904 - protein, 30 aa, Mycobacterium; identical to SEQ ID NO: 836946

SEQ ID NO: 1075905 - protein, 25 aa, Mycobacterium
LTDEEVLGFMFLMVIAGNETTTKLL

SEQ ID NO: 1075906 - protein, 17 aa, Mycobacterium
LTDKYVVIYDLPVTFDS

SEQ ID NO: 1075907 - protein, 20 aa, Mycobacterium
LTDLPLTLFSDPMAAGLACA

SEQ ID NO: 1075908 - protein, 17 aa, Mycobacterium
LTDWQVEFDLPANESIT

SEQ ID NO: 1075909 - protein, 24 aa, Mycobacterium
LTEFAGPEFRRFALSSGVEARHTA

SEQ ID NO: 1075910 - protein, 19 aa, Mycobacterium
LTEGMRFDKGYISGYFVTD

SEQ ID NO: 1075911 - protein, 17 aa, Mycobacterium
LTELGWSLRRTPLPPTG

SEQ ID NO: 1075912 - protein, 19 aa, Mycobacterium
LTERIAIAAPRPLASYTTR

SEQ ID NO: 1075913 - protein, 18 aa, Mycobacterium
LTFIDKAYEFVKETVAHG

SEQ ID NO: 1075914 - protein, 17 aa, Mycobacterium
LTFVHWPVLPDSVAHMY

SEQ ID NO: 1075915 - protein, 23 aa, Mycobacterium
LTGAVRHFLAIDPVVRIEGSKTG

SEQ ID NO: 1075916 - protein, 22 aa, Mycobacterium
LTGDLPALRRVLVINGSGPKAL

SEQ ID NO: 1075917 - protein, 24 aa, Mycobacterium
LTGDSFFHLAPLGSSGALAGLNMC

SEQ ID NO: 1075918 - protein, 24 aa, Mycobacterium
LTGERTMLNLVCHLSGIATATAAW

SEQ ID NO: 1075919 - protein, 19 aa, Mycobacterium
LTGFDAPSATYLYIDKKMR

SEQ ID NO: 1075920 - protein, 17 aa, Mycobacterium
LTGVIQGLRGKGRLTDA

SEQ ID NO: 1075921 - protein, 27 aa, Mycobacterium
LTGVQRVFFGWAQVWRTKSRDAEAIRR

SEQ ID NO: 1075922 - protein, 21 aa, Mycobacterium
LTGVRVFFPDPWPKARHHKRR

SEQ ID NO: 1075923 - protein, 24 aa, Mycobacterium
LTHPHGQIYGYPLLTPRTSVMLEQ

SEQ ID NO: 1075924 - protein, 25 aa, Mycobacterium
LTHPQYLVMLALWDNQRTSSGQGSA

SEQ ID NO: 1075925 - protein, 18 aa, Mycobacterium
LTHRRFDRLIRTADPLAR

SEQ ID NO: 1075926 - protein, 17 aa, Mycobacterium
LTKGKLPTSLWIEIVST

SEQ ID NO: 1075927 - protein, 24 aa, Mycobacterium
LTKPKILCNYLSTDQDRQLAVRGL

SEQ ID NO: 1075928 - protein, 21 aa, Mycobacterium
LTLEALAAQKVSCAGLVLGSW

SEQ ID NO: 1075929 - protein, 22 aa, Mycobacterium
LTLEDFLEQMLAVRKMGPIGNL

SEQ ID NO: 1075930 - protein, 18 aa, Mycobacterium
LTLLDFDDLLLHTAAAIE

SEQ ID NO: 1075931 - protein, 20 aa, Mycobacterium
LTLPADSHLLLMWGAANRDP

SEQ ID NO: 1075932 - protein, 25 aa, Mycobacterium
LTLPPTLAFDYPTPVALATHLGQLL

SEQ ID NO: 1075933 - protein, 31 aa, Mycobacterium; identical to SEQ ID NO: 837181

SEQ ID NO: 1075934 - protein, 20 aa, Mycobacterium
LTLRIPRPRLCTDNGAMIAA

SEQ ID NO: 1075935 - protein, 25 aa, Mycobacterium
LTLRNRALLELLYSTGSRISEAVGL

SEQ ID NO: 1075936 - protein, 20 aa, Mycobacterium
LTLRNSVVYDRFAETAVLHS

SEQ ID NO: 1075937 - protein, 17 aa, Mycobacterium
LTLTPLGTEIRDAHSVN

SEQ ID NO: 1075938 - protein, 17 aa, Mycobacterium
LTMAEWFRDEAGQDVLL

SEQ ID NO: 1075939 - protein, 20 aa, Mycobacterium
LTMEMAKFIRFIVTDIFPGG

SEQ ID NO: 1075940 - protein, 20 aa, Mycobacterium
LTMLAAHPELVVNRSAPTVL

SEQ ID NO: 1075941 - protein, 26 aa, Mycobacterium
LTNATMPYVLKLADLGWQAACLSDSA

SEQ ID NO: 1075942 - protein, 21 aa, Mycobacterium
LTPMTPFERKIVHDAIAAVPG

SEQ ID NO: 1075943 - protein, 20 aa, Mycobacterium
LTPNLYAQLAAIAPTVFTAA

SEQ ID NO: 1075944 - protein, 17 aa, Mycobacterium
LTPQAHTFFRVIDEISP

SEQ ID NO: 1075945 - protein, 24 aa, Mycobacterium
LTPQALIDLVASRSYCITSPAEVR

SEQ ID NO: 1075946 - protein, 26 aa, Mycobacterium
LTPQQRAWLNLVQPLTIVEGFALLSV

SEQ ID NO: 1075947 - protein, 19 aa, Mycobacterium
LTQETFIRVFRSVQNYQPG

SEQ ID NO: 1075948 - protein, 24 aa, Mycobacterium
LTQLRSHPVLADPLKALITRSDEI

SEQ ID NO: 1075949 - protein, 22 aa, Mycobacterium
LTQNICFLYHLLGGGTGDWDVP

SEQ ID NO: 1075950 - protein, 21 aa, Mycobacterium
LTRDAGWGNAMRWLLTGDEFD

SEQ ID NO: 1075951 - protein, 19 aa, Mycobacterium
LTRHALAAVAAWLARPDTA

SEQ ID NO: 1075952 - protein, 25 aa, Mycobacterium
LTRPAINHYFASKQALYREVVVQTN

SEQ ID NO: 1075953 - protein, 22 aa, Mycobacterium
LTSGYILTPTLPAGLTPAPTAR

SEQ ID NO: 1075954 - protein, 18 aa, Mycobacterium
LTSKPWVKTTMAPGSQVV

SEQ ID NO: 1075955 - protein, 25 aa, Mycobacterium
LTSSEFARYLADYIHEQGWQTYADV

SEQ ID NO: 1075956 - protein, 23 aa, Mycobacterium
LTTKQAAYFVVDATKVYCPEYAS

SEQ ID NO: 1075957 - protein, 18 aa, Mycobacterium
LTTPAAVMLRRCETCAGD

SEQ ID NO: 1075958 - protein, 45 aa, Mycobacterium
LTTVPGPVQFVLLDGWKDLYLPVVRLLEPVLPAGALILADNTESA

SEQ ID NO: 1075959 - protein, 27 aa, Mycobacterium
LTVATILTKPWLTPPLAKGDYSEWAEQ

SEQ ID NO: 1075960 - protein, 26 aa, Mycobacterium
LTVCYDIRFPALYTELARRGAELIVV

SEQ ID NO: 1075961 - protein, 26 aa, Mycobacterium
LTVGNVVHGALRSAWIGYWVASSQTG

SEQ ID NO: 1075962 - protein, 17 aa, Mycobacterium
LTVNGLRQLIAFISRMT

SEQ ID NO: 1075963 - protein, 18 aa, Mycobacterium
LTVNGLRQLIAFISRMTA

SEQ ID NO: 1075964 - protein, 17 aa, Mycobacterium
LTVPRRDGGERRLYLVE

SEQ ID NO: 1075965 - protein, 21 aa, Mycobacterium
LTVRYALRRAGALRVWPQRAR

SEQ ID NO: 1075966 - protein, 20 aa, Mycobacterium
LTWEGLFDVVAEQPHLLRSG

SEQ ID NO: 1075967 - protein, 17 aa, Mycobacterium
LTWQRNTIDQLLTALQS

SEQ ID NO: 1075968 - protein, 18 aa, Mycobacterium
LVAAHRVFTALIAAMRVF

SEQ ID NO: 1075969 - protein, 19 aa, Mycobacterium
LVAEYGIPKAWRAYRALDA

SEQ ID NO: 1075970 - protein, 24 aa, Mycobacterium
LVAHPAITLAQFYDVPMVSTIHAT

SEQ ID NO: 1075971 - protein, 17 aa, Mycobacterium
LVAIGFTKLAHRGSPVA

SEQ ID NO: 1075972 - protein, 23 aa, Mycobacterium
LVAKLALPVPSLVISQLLGVPYE

SEQ ID NO: 1075973 - protein, 17 aa, Mycobacterium
LVALMPMSMRSQAGAGN

SEQ ID NO: 1075974 - protein, 23 aa, Mycobacterium
LVANVYTEYLMRALPQVARLVSS

SEQ ID NO: 1075975 - protein, 19 aa, Mycobacterium
LVAPLARALAVGVHRLLCW

SEQ ID NO: 1075976 - protein, 19 aa, Mycobacterium
LVAQAWHWVDPARAIPEVA

SEQ ID NO: 1075977 - protein, 23 aa, Mycobacterium
LVARPLLAALRPELGCVLQPLSG

SEQ ID NO: 1075978 - protein, 18 aa, Mycobacterium
LVARRRGISVLGDRPPMV

SEQ ID NO: 1075979 - protein, 19 aa, Mycobacterium
LVATNFFGINTIPIAFNES

SEQ ID NO: 1075980 - protein, 19 aa, Mycobacterium
LVCASIYQATKFYELFVAA

SEQ ID NO: 1075981 - protein, 24 aa, Mycobacterium
LVCDKPAHWLLEEAQHAQLVIVGN

SEQ ID NO: 1075982 - protein, 28 aa, Mycobacterium
LVCESGRVLFFELALPWLDRSKVARVDY

SEQ ID NO: 1075983 - protein, 26 aa, Mycobacterium
LVCGDTVLWKPSELAPLTALACQALL

SEQ ID NO: 1075984 - protein, 31 aa, Mycobacterium
LVCNVPLLDMKRYHLLLAGASWVAEYGDPDN

SEQ ID NO: 1075985 - protein, 31 aa, Mycobacterium; identical to SEQ ID NO: 837502

SEQ ID NO: 1075986 - protein, 20 aa, Mycobacterium
LVDGDIIWAPAIDGAFVLTT

SEQ ID NO: 1075987 - protein, 24 aa, Mycobacterium
LVDGDLLRLGSLAFPIAAGTGTGT

SEQ ID NO: 1075988 - protein, 18 aa, Mycobacterium
LVDLALTAPTFQQLIARA

SEQ ID NO: 1075989 - protein, 19 aa, Mycobacterium
LVDLSLTNLLAPVLPNLDT

SEQ ID NO: 1075990 - protein, 19 aa, Mycobacterium
LVDRFFEARKMMSSMLGGM

SEQ ID NO: 1075991 - protein, 17 aa, Mycobacterium
LVDSWMCAISGRAKQFG

SEQ ID NO: 1075992 - protein, 23 aa, Mycobacterium
LVDTLQTLLPRDDRYRHAHGSRG

SEQ ID NO: 1075993 - protein, 18 aa, Mycobacterium
LVDTYQLYIDGRWVEPEN

SEQ ID NO: 1075994 - protein, 19 aa, Mycobacterium
LVDVIGLPWEEVHAEACRW

SEQ ID NO: 1075995 - protein, 19 aa, Mycobacterium
LVEAVFNYPTFSEAYKVAA

SEQ ID NO: 1075996 - protein, 25 aa, Mycobacterium
LVEDHALRLLNLRRAARSVEGAGPG

SEQ ID NO: 1075997 - protein, 19 aa, Mycobacterium
LVEEWVRLSQRSLTPPRVV

SEQ ID NO: 1075998 - protein, 18 aa, Mycobacterium
LVEIIPPRLKEPLYRLYE

SEQ ID NO: 1075999 - protein, 18 aa, Mycobacterium
LVEPPRMPNLPVSRRRVL

SEQ ID NO: 1076000 - protein, 18 aa, Mycobacterium
LVFEYRDALWDAQSIARM

SEQ ID NO: 1076001 - protein, 20 aa, Mycobacterium
LVFPTRRWVHPIGPRNRSLP

SEQ ID NO: 1076002 - protein, 17 aa, Mycobacterium
LVFSMPAGARELIRAFW

SEQ ID NO: 1076003 - protein, 28 aa, Mycobacterium
LVGAHYEIFIPEFPVLNQGSGVCLINGV

SEQ ID NO: 1076004 - protein, 25 aa, Mycobacterium
LVGMSFRHRLTGKKATLFTHYLHPS

SEQ ID NO: 1076005 - protein, 26 aa, Mycobacterium
LVGRADLVLPMWQRLESAWGPARDVR

SEQ ID NO: 1076006 - protein, 19 aa, Mycobacterium
LVGRLMSYKLDRSRPLWEL

SEQ ID NO: 1076007 - protein, 19 aa, Mycobacterium
LVGSSWQGAAATAMSAAAA

SEQ ID NO: 1076008 - protein, 25 aa, Mycobacterium
LVGSVSMTAQWWLDAREPKKEVVAA

SEQ ID NO: 1076009 - protein, 18 aa, Mycobacterium
LVHDAARALTPPALVVRL

SEQ ID NO: 1076010 - protein, 32 aa, Mycobacterium
LVHIKGVEAAVPAWQLLGVVDQYWQSGPAPAT

SEQ ID NO: 1076011 - protein, 17 aa, Mycobacterium
LVHLTPVASHRGTVQPL

SEQ ID NO: 1076012 - protein, 24 aa, Mycobacterium
LVHPGDLVILIAYGTMQDAEARAY

SEQ ID NO: 1076013 - protein, 26 aa, Mycobacterium
LVIENYYLPIAAYEAALRQAGFHDFV

SEQ ID NO: 1076014 - protein, 21 aa, Mycobacterium
LVITHRLPSCRFWNLVVWNQF

SEQ ID NO: 1076015 - protein, 17 aa, Mycobacterium
LVIWGDDIGITNLSCYS

SEQ ID NO: 1076016 - protein, 22 aa, Mycobacterium
LVKALLFSVFEGGLRHGLFHGD

SEQ ID NO: 1076017 - protein, 25 aa, Mycobacterium
LVKIDQTFPLVPAALLACAIPTRYG

SEQ ID NO: 1076018 - protein, 19 aa, Mycobacterium
LVKLWLTDEGDIDADWARL

SEQ ID NO: 1076019 - protein, 17 aa, Mycobacterium
LVLASRGTPLWASATNG

SEQ ID NO: 1076020 - protein, 23 aa, Mycobacterium
LVLDYERAMLRLGEGENGEPQLY

SEQ ID NO: 1076021 - protein, 18 aa, Mycobacterium
LVLMPSRPVSLLMQEYRG

SEQ ID NO: 1076022 - protein, 20 aa, Mycobacterium
LVLRADLLRPWANWITPEAE

SEQ ID NO: 1076023 - protein, 18 aa, Mycobacterium
LVLRRFQRAGHRPIVLAG

SEQ ID NO: 1076024 - protein, 17 aa, Mycobacterium
LVLSKLRERLGFGELRW

SEQ ID NO: 1076025 - protein, 18 aa, Mycobacterium
LVMFGPREVLLASDEPVV

SEQ ID NO: 1076026 - protein, 17 aa, Mycobacterium
LVNEPLWRVVQAHPSAA

SEQ ID NO: 1076027 - protein, 19 aa, Mycobacterium
LVNVLPLQNVEQDLLNLVN

SEQ ID NO: 1076028 - protein, 25 aa, Mycobacterium
LVNYNTMYFALARRAAMRPGETVLV

SEQ ID NO: 1076029 - protein, 21 aa, Mycobacterium
LVPADFIGFSQPIDDLPTVEG

SEQ ID NO: 1076030 - protein, 19 aa, Mycobacterium
LVPALAKLWTQACDWEPVI

SEQ ID NO: 1076031 - protein, 25 aa, Mycobacterium
LVPGPTALLAPAWVPWEQRVRPGDL

SEQ ID NO: 1076032 - protein, 17 aa, Mycobacterium
LVQKRAIQIARENAKPV

SEQ ID NO: 1076033 - protein, 23 aa, Mycobacterium
LVQLRRHHGMLSFAAPPMRRTGD

SEQ ID NO: 1076034 - protein, 18 aa, Mycobacterium
LVQLSRARALLLGRDYVI

SEQ ID NO: 1076035 - protein, 18 aa, Mycobacterium
LVQVAWALVLGALTGRDD

SEQ ID NO: 1076036 - protein, 18 aa, Mycobacterium
LVRAYRLGHKEMLERIID

SEQ ID NO: 1076037 - protein, 19 aa, Mycobacterium
LVRELTMVAPLVLSRDVPV

SEQ ID NO: 1076038 - protein, 24 aa, Mycobacterium
LVRQRLNWIAAHGLLRGTARLAAR

SEQ ID NO: 1076039 - protein, 23 aa, Mycobacterium
LVRTAVDPRLRAIAAEWTRGAVK

SEQ ID NO: 1076040 - protein, 19 aa, Mycobacterium
LVRVPVNRILLASYGAVLS

SEQ ID NO: 1076041 - protein, 23 aa, Mycobacterium
LVSCMVALPTQLFRSTGIPVCLW

SEQ ID NO: 1076042 - protein, 19 aa, Mycobacterium
LVSEFVCRLLNYMDANDYE

SEQ ID NO: 1076043 - protein, 19 aa, Mycobacterium
LVSIVAYLLGSAALTDQEA

SEQ ID NO: 1076044 - protein, 24 aa, Mycobacterium
LVSPWTEGLLFALGGPIYAGTNEI

SEQ ID NO: 1076045 - protein, 28 aa, Mycobacterium
LVSQIAPLLGPMIQEMLFMQLRHMMETE

SEQ ID NO: 1076046 - protein, 18 aa, Mycobacterium
LVSTNRKLDKAASKGVIH

SEQ ID NO: 1076047 - protein, 24 aa, Mycobacterium
LVSVVVIVAWRQANGKFICVCLPA

SEQ ID NO: 1076048 - protein, 24 aa, Mycobacterium
LVSVVVIVAWRQANGKFICVCLQA

SEQ ID NO: 1076049 - protein, 26 aa, Mycobacterium
LVTPELVRRLCWDWAPVAAAEITSTI

SEQ ID NO: 1076050 - protein, 26 aa, Mycobacterium
LVVHDWGSALGFYRALRYPEQIAGIA

SEQ ID NO: 1076051 - protein, 21 aa, Mycobacterium
LVVIDLQPVTFFGSAGLNAVL

SEQ ID NO: 1076052 - protein, 18 aa, Mycobacterium
LVVNKTDLAPLVGADLKV

SEQ ID NO: 1076053 - protein, 18 aa, Mycobacterium
LVVNYRLLPKHSIGMALE

SEQ ID NO: 1076054 - protein, 18 aa, Mycobacterium
LVVNYRLVPKHTVGMALE

SEQ ID NO: 1076055 - protein, 19 aa, Mycobacterium
LVVPVLNARFALNAANARW

SEQ ID NO: 1076056 - protein, 28 aa, Mycobacterium
LVVSHVTPIKMLLRLALDVGSEVLYRLH

SEQ ID NO: 1076057 - protein, 17 aa, Mycobacterium
LVVWLPEERICLCGNTF

SEQ ID NO: 1076058 - protein, 17 aa, Mycobacterium
LVYGLGTLITGLPGVLS

SEQ ID NO: 1076059 - protein, 17 aa, Mycobacterium
LVYKGLRRRAAAAGLDV

SEQ ID NO: 1076060 - protein, 19 aa, Mycobacterium
LWAATSLRRRGAAADAVLL

SEQ ID NO: 1076061 - protein, 24 aa, Mycobacterium
LWAELITKHRGSITAAPNFAYSLL

SEQ ID NO: 1076062 - protein, 26 aa, Mycobacterium
LWCEKPMYIQLDFLVRRFAEQVAADP

SEQ ID NO: 1076063 - protein, 20 aa, Mycobacterium
LWDCAVTDMLVARMPADHVL

SEQ ID NO: 1076064 - protein, 18 aa, Mycobacterium
LWDRAPALLISRLVSWGI

SEQ ID NO: 1076065 - protein, 17 aa, Mycobacterium
LWEAQFGDFVNGAQSII

SEQ ID NO: 1076066 - protein, 19 aa, Mycobacterium
LWSIVEFQHVKPGKGPAFV

SEQ ID NO: 1076067 - protein, 29 aa, Mycobacterium
LYALCTAKLAHFKAPKAFIFVSHIQRLGN

SEQ ID NO: 1076068 - protein, 23 aa, Mycobacterium
LYDAPEVVIPMLVPDGAHTYPDG

SEQ ID NO: 1076069 - protein, 26 aa, Mycobacterium
LYEARGAASCFPTLLRKGERLLVFLP

SEQ ID NO: 1076070 - protein, 18 aa, Mycobacterium
LYELPIPVIAAVNGVAVG

SEQ ID NO: 1076071 - protein, 23 aa, Mycobacterium
LYEREVRFYAEVAPRLGGPIAPC

SEQ ID NO: 1076072 - protein, 17 aa, Mycobacterium
LYFQWASFEILPRRLQK

SEQ ID NO: 1076073 - protein, 33 aa, Mycobacterium; identical to SEQ ID NO: 838102

SEQ ID NO: 1076074 - protein, 25 aa, Mycobacterium
LYGGYNVVRAAWPHFREQSYGRVVV

SEQ ID NO: 1076075 - protein, 18 aa, Mycobacterium
LYHYYALMTGKAVQQEKA

SEQ ID NO: 1076076 - protein, 18 aa, Mycobacterium
LYNPRLRRAYRIDDDIPV

SEQ ID NO: 1076077 - protein, 26 aa, Mycobacterium
LYRHPKLRARFIYGDLPHPVQVVPSD

SEQ ID NO: 1076078 - protein, 17 aa, Mycobacterium
LYRLATMGEWRSGSNVD

SEQ ID NO: 1076079 - protein, 20 aa, Mycobacterium
LYRSVGFEQVGLRRRYYRVS

SEQ ID NO: 1076080 - protein, 25 aa, Mycobacterium
LYTARAQLAPLVFEGTSFGGALMTT

SEQ ID NO: 1076081 - protein, 17 aa, Mycobacterium
LYYLPDDFSQARNVAAE

SEQ ID NO: 1076082 - protein, 24 aa, Mycobacterium
MAAAAAPYAGWLGLAAARAGDVSA

SEQ ID NO: 1076083 - protein, 27 aa, Mycobacterium
MAAARLDLASVFLYAGSILPGVAKLSD

SEQ ID NO: 1076084 - protein, 19 aa, Mycobacterium
MAAGHITFVTVPTGITDEN

SEQ ID NO: 1076085 - protein, 18 aa, Mycobacterium
MAALRRAVPAAKGNTRRL

SEQ ID NO: 1076086 - protein, 22 aa, Mycobacterium
MAAQYRIRLGGTWKKPGTSDIE

SEQ ID NO: 1076087 - protein, 18 aa, Mycobacterium
MAASWRSLNLANWEPRVP

SEQ ID NO: 1076088 - protein, 18 aa, Mycobacterium
MAATAPPATYPAAMAARP

SEQ ID NO: 1076089 - protein, 24 aa, Mycobacterium
MADRAENLRRLAHVAVLLADCGHV

SEQ ID NO: 1076090 - protein, 26 aa, Mycobacterium
MAEEVMAPLGPILVAAAGIGPGVRVL

SEQ ID NO: 1076091 - protein, 17 aa, Mycobacterium
MAELVPRYLDPDAIAVI

SEQ ID NO: 1076092 - protein, 24 aa, Mycobacterium
MAEPDLLPKLLAVDALPAEIKADV

SEQ ID NO: 1076093 - protein, 23 aa, Mycobacterium
MAGWQVRVLVPGGDDIRPLQILG

SEQ ID NO: 1076094 - protein, 26 aa, Mycobacterium
MAHSVRNLLAPPLRLRGPVTRADGGK

SEQ ID NO: 1076095 - protein, 25 aa, Mycobacterium
MAIYDTMVLAPCDIATYAMGMAASM

SEQ ID NO: 1076096 - protein, 17 aa, Mycobacterium
MALGITGPILRSTGLPH

SEQ ID NO: 1076097 - protein, 26 aa, Mycobacterium
MALGKNLLVAIMPWEGHNYEDAIILS

SEQ ID NO: 1076098 - protein, 19 aa, Mycobacterium
MALLNWHDGSRFSPVDGSP

SEQ ID NO: 1076099 - protein, 19 aa, Mycobacterium
MALLQPRRIIADEGLLGAL

SEQ ID NO: 1076100 - protein, 18 aa, Mycobacterium
MALQYWRSRGRPGKHRLM

SEQ ID NO: 1076101 - protein, 19 aa, Mycobacterium
MALRRKFSASQFLSDVRRY

SEQ ID NO: 1076102 - protein, 31 aa, Mycobacterium
MANISLLNPSFTTGFPLTLALDALGAPIVTG

SEQ ID NO: 1076103 - protein, 17 aa, Mycobacterium
MANSIEFIVAMLAVLKA

SEQ ID NO: 1076104 - protein, 24 aa, Mycobacterium
MANSPALLHGYLGLAGSLDGGTLP

SEQ ID NO: 1076105 - protein, 17 aa, Mycobacterium
MAPALADDRLYRVGAAY

SEQ ID NO: 1076106 - protein, 20 aa, Mycobacterium
MAPGTRRLVRLGVAAPLKAV

SEQ ID NO: 1076107 - protein, 19 aa, Mycobacterium
MAQMIPQMASGIGGALSGA

SEQ ID NO: 1076108 - protein, 27 aa, Mycobacterium
MARDEGRWAVRWVSTGLHPKLGEHQTF

SEQ ID NO: 1076109 - protein, 25 aa, Mycobacterium
MARECVAAGWLLSLSGTVSFRNARE

SEQ ID NO: 1076110 - protein, 26 aa, Mycobacterium
MARHFDTIARLWDVIGDTGIGFCLDT

SEQ ID NO: 1076111 - protein, 26 aa, Mycobacterium
MARLDAQITIFRLGSDRGLARFIDQV

SEQ ID NO: 1076112 - protein, 26 aa, Mycobacterium
MARNILESFTLLTNVSKLFAQRCIAG

SEQ ID NO: 1076113 - protein, 20 aa, Mycobacterium
MASMAAFTWLSTRGGGGVVG

SEQ ID NO: 1076114 - protein, 19 aa, Mycobacterium
MASVKWELEDLSFAILHPK

SEQ ID NO: 1076115 - protein, 27 aa, Mycobacterium
MATARYGSYLRDSLPPFWQTTNGTQVR

SEQ ID NO: 1076116 - protein, 18 aa, Mycobacterium
MATDAIFGVSHIWRRIRA

SEQ ID NO: 1076117 - protein, 26 aa, Mycobacterium
MATVFKLPFGEIPGQVFIGMRTSDVL

SEQ ID NO: 1076118 - protein, 21 aa, Mycobacterium
MAVALRLAAFALLRADGSEPV

SEQ ID NO: 1076119 - protein, 18 aa, Mycobacterium
MAVTPPPPRWTARQPVLS

SEQ ID NO: 1076120 - protein, 17 aa, Mycobacterium
MAVWKVMPALAAGCTVV

SEQ ID NO: 1076121 - protein, 19 aa, Mycobacterium
MAWRWGIAAGELTSMDAPA

SEQ ID NO: 1076122 - protein, 25 aa, Mycobacterium
MAYEGKIDWAFAELLALGSLVAEGK

SEQ ID NO: 1076123 - protein, 17 aa, Mycobacterium
MCAALGLLAAIISGRGG

SEQ ID NO: 1076124 - protein, 27 aa, Mycobacterium
MCGLEPNMRWRTFCAELLAIIEKLNVD

SEQ ID NO: 1076125 - protein, 17 aa, Mycobacterium
MCRTILQALASHAPTDV

SEQ ID NO: 1076126 - protein, 24 aa, Mycobacterium
MCTGRLFAASLLPGAPERLVLTAS

SEQ ID NO: 1076127 - protein, 25 aa, Mycobacterium
MDAHARLLVWELIDALRRDGVTVVL

SEQ ID NO: 1076128 - protein, 25 aa, Mycobacterium
MDDEHLPFLVKLISEPQRSPQRWTF

SEQ ID NO: 1076129 - protein, 20 aa, Mycobacterium
MDGARLLREGVPSQWSIFFG

SEQ ID NO: 1076130 - protein, 18 aa, Mycobacterium
MDIDDPLRLVPILGAGLA

SEQ ID NO: 1076131 - protein, 19 aa, Mycobacterium
MDLALPRNRGQIPQPNEYP

SEQ ID NO: 1076132 - protein, 27 aa, Mycobacterium
MDLPPKLAIPMRVIASVAAILCQLDAH

SEQ ID NO: 1076133 - protein, 25 aa, Mycobacterium
MDNVSARRLITPPSAFISTVMVDQQ

SEQ ID NO: 1076134 - protein, 21 aa, Mycobacterium
MDPQQRLFLEVAWEALENAGI

SEQ ID NO: 1076135 - protein, 23 aa, Mycobacterium
MDPQQRVLLEVAWEALEHAGLPP

SEQ ID NO: 1076136 - protein, 18 aa, Mycobacterium
MDQFAEVFRMSLAEPGVT

SEQ ID NO: 1076137 - protein, 23 aa, Mycobacterium
MDQLIRLLNGYVFSHLTLPGDDD

SEQ ID NO: 1076138 - protein, 19 aa, Mycobacterium
MDRIGAYERYWLYPGAQNL

SEQ ID NO: 1076139 - protein, 23 aa, Mycobacterium
MDSVTVLLHRLGVGYTTIMTPVF

SEQ ID NO: 1076140 - protein, 31 aa, Mycobacterium
MEALRNDGRIKFILFRHLQAAGFAAAAYGRL

SEQ ID NO: 1076141 - protein, 37 aa, Mycobacterium; identical to SEQ ID NO: 838509

SEQ ID NO: 1076142 - protein, 24 aa, Mycobacterium
MEEATFLTRFARSVTLVHRRDEFR

SEQ ID NO: 1076143 - protein, 26 aa, Mycobacterium
MEEFERRFFPIYPASTKVQSWDIFKC

SEQ ID NO: 1076144 - protein, 30 aa, Mycobacterium
MEKLYLQEWHFYFQNTCRWRDLRKITIAQV

SEQ ID NO: 1076145 - protein, 22 aa, Mycobacterium
MELPFMCLMTDRIIDLGAGAAN

SEQ ID NO: 1076146 - protein, 35 aa, Mycobacterium
MELVLWLREGQWGAPLLFYLDAGIPPLSAMANSHV

SEQ ID NO: 1076147 - protein, 17 aa, Mycobacterium
MERATSQRLPLLASPSS

SEQ ID NO: 1076148 - protein, 20 aa, Mycobacterium
MERLAPLGPVYQAGTLSGNP

SEQ ID NO: 1076149 - protein, 25 aa, Mycobacterium
METAARLIRDARRPLIMVGGGTRAN

SEQ ID NO: 1076150 - protein, 38 aa, Mycobacterium; identical to SEQ ID NO: 838553

SEQ ID NO: 1076151 - protein, 27 aa, Mycobacterium
MEVGPDGLLYFPVMGANEIWRIDPDGG

SEQ ID NO: 1076152 - protein, 24 aa, Mycobacterium
MEVPAFALALMRRSLSGSNIGGIA

SEQ ID NO: 1076153 - protein, 17 aa, Mycobacterium
MEYLPWANRLQEGDDVL

SEQ ID NO: 1076154 - protein, 23 aa, Mycobacterium
MEYMLPRLRGWGESMSRQAGGRA

SEQ ID NO: 1076155 - protein, 17 aa, Mycobacterium
MFAFGGLKRTYILHVPP

SEQ ID NO: 1076156 - protein, 18 aa, Mycobacterium
MFAPKLDAAALLHRLSLK

SEQ ID NO: 1076157 - protein, 22 aa, Mycobacterium
MFDTLLVFENFPTGGLAVGKDV

SEQ ID NO: 1076158 - protein, 27 aa, Mycobacterium
MFHSVAFDFSVWELWGALLHGACVVVV

SEQ ID NO: 1076159 - protein, 26 aa, Mycobacterium
MFMVSHFHYDPVWWNTQGAYTSQWHE

SEQ ID NO: 1076160 - protein, 20 aa, Mycobacterium
MFQMPPALEQAWHTRGYYGS

SEQ ID NO: 1076161 - protein, 19 aa, Mycobacterium
MFRLINPRQWSERTVIALV

SEQ ID NO: 1076162 - protein, 21 aa, Mycobacterium
MFSLHVKATMMKVSHPIVFGH

SEQ ID NO: 1076163 - protein, 23 aa, Mycobacterium
MGALHSWCLAAERPGLVSALVVE

SEQ ID NO: 1076164 - protein, 24 aa, Mycobacterium
MGAMAMPIAGMAAARAVMAAGGGQ

SEQ ID NO: 1076165 - protein, 26 aa, Mycobacterium
MGCENLPGLRWPGLSLQGGRLAWSAV

SEQ ID NO: 1076166 - protein, 28 aa, Mycobacterium
MGCGDACPYFPGVSYRDWTLADPAGQPL

SEQ ID NO: 1076167 - protein, 25 aa, Mycobacterium
MGEVRVPAKALWRAQTQRAVENFPI

SEQ ID NO: 1076168 - protein, 37 aa, Mycobacterium
MGGLGLANALWRLLPDRVRVLDFPTNFHYDFRTPEYA

SEQ ID NO: 1076169 - protein, 17 aa, Mycobacterium
MGLYYSGGYDWTFNPTV

SEQ ID NO: 1076170 - protein, 32 aa, Mycobacterium; identical to SEQ ID NO: 838704

SEQ ID NO: 1076171 - protein, 24 aa, Mycobacterium
MGNVTQVLPGIRPVIGVDAGGATV

SEQ ID NO: 1076172 - protein, 22 aa, Mycobacterium
MGPGRRTCHALILGVLAGAAIS

SEQ ID NO: 1076173 - protein, 24 aa, Mycobacterium
MGPLLSIPGHPITLARFGAPTVLP

SEQ ID NO: 1076174 - protein, 23 aa, Mycobacterium
MGRHAGWIALNSGLASGAHMTLI

SEQ ID NO: 1076175 - protein, 27 aa, Mycobacterium
MGTPEDLVGMCLFLLGDQASRITGQIF

SEQ ID NO: 1076176 - protein, 24 aa, Mycobacterium
MGVDQGFIRKSGAWFTYEGEQLGQ

SEQ ID NO: 1076177 - protein, 26 aa, Mycobacterium
MGVVNAPAQALLGRPLIGNGANGADG

SEQ ID NO: 1076178 - protein, 18 aa, Mycobacterium
MHDMFVNTLGASAGTYGA

SEQ ID NO: 1076179 - protein, 20 aa, Mycobacterium
MHDQLVQTLSASSASYAGAE

SEQ ID NO: 1076180 - protein, 18 aa, Mycobacterium
MHIYHYAPYEKKALLRLA

SEQ ID NO: 1076181 - protein, 19 aa, Mycobacterium
MHLRTGVAMLSYSDDLYFG

SEQ ID NO: 1076182 - protein, 24 aa, Mycobacterium
MHNRIKWTIVCYQPPEGMTLNGDG

SEQ ID NO: 1076183 - protein, 31 aa, Mycobacterium; identical to SEQ ID NO: 838791

SEQ ID NO: 1076184 - protein, 32 aa, Mycobacterium
MHREPMPWNGPLFKFALFQVASEEFNLFVSIH

SEQ ID NO: 1076185 - protein, 18 aa, Mycobacterium
MHWMGSIGALNFFAGPAV

SEQ ID NO: 1076186 - protein, 19 aa, Mycobacterium
MIDMPQYLDYLTARLAAAG

SEQ ID NO: 1076187 - protein, 21 aa, Mycobacterium
MIDVLRFWLGLGIDGFRLDAV

SEQ ID NO: 1076188 - protein, 18 aa, Mycobacterium
MIEMLAMSDLSLMVKAGV

SEQ ID NO: 1076189 - protein, 19 aa, Mycobacterium
MIFDVAVATAIAWSKALDT

SEQ ID NO: 1076190 - protein, 19 aa, Mycobacterium
MINRRTVTVRPWAAVSPSV

SEQ ID NO: 1076191 - protein, 31 aa, Mycobacterium; identical to SEQ ID NO: 838847

SEQ ID NO: 1076192 - protein, 20 aa, Mycobacterium
MIRHAYHYLVVFDDHQSRPV

SEQ ID NO: 1076193 - protein, 17 aa, Mycobacterium
MISLLSALDARVTVWCA

SEQ ID NO: 1076194 - protein, 20 aa, Mycobacterium
MIWIMNWVEIKRGLQVHVTP

SEQ ID NO: 1076195 - protein, 17 aa, Mycobacterium
MIYAYGAYEICEDPRFS

SEQ ID NO: 1076196 - protein, 26 aa, Mycobacterium
MKKEGPLYALFLNCTLKKGPEVSNTE

SEQ ID NO: 1076197 - protein, 25 aa, Mycobacterium
MKSVHRILRNFKMPGFTVPEFRRKA

SEQ ID NO: 1076198 - protein, 24 aa, Mycobacterium
MKVVLADVLAEPLDRATRALTDEG

SEQ ID NO: 1076199 - protein, 18 aa, Mycobacterium
MKYLTGCAKLFRQGYTDI

SEQ ID NO: 1076200 - protein, 24 aa, Mycobacterium
MLAARPAVRYISAASLQVIDRVVA

SEQ ID NO: 1076201 - protein, 33 aa, Mycobacterium
MLADFLTVMLQTPSLVLFTYRPEYRGALQLVPG

SEQ ID NO: 1076202 - protein, 18 aa, Mycobacterium
MLASPRIIDAVAATWRQL

SEQ ID NO: 1076203 - protein, 24 aa, Mycobacterium
MLATIRPYRPSLSAALPPAALWGR

SEQ ID NO: 1076204 - protein, 25 aa, Mycobacterium
MLATIRPYRPSLSAALPPAALWGRE

SEQ ID NO: 1076205 - protein, 17 aa, Mycobacterium
MLCYVTPKEHLGLPDRK

SEQ ID NO: 1076206 - protein, 26 aa, Mycobacterium
MLDGLKPGGLLLLRIPDRDAVYGWTT

SEQ ID NO: 1076207 - protein, 24 aa, Mycobacterium
MLEVLRASLPRTLALLGTAEEIPL

SEQ ID NO: 1076208 - protein, 21 aa, Mycobacterium
MLFRKHLVMFGPREVLLASDE

SEQ ID NO: 1076209 - protein, 30 aa, Mycobacterium
MLGTGHTVTGLPPGYILYDDDHPNGRIATL

SEQ ID NO: 1076210 - protein, 17 aa, Mycobacterium
MLKPCTLELGGKSAAIL

SEQ ID NO: 1076211 - protein, 18 aa, Mycobacterium
MLLQPGVLGIAWGTAIRQ

SEQ ID NO: 1076212 - protein, 18 aa, Mycobacterium
MLMADIRGFTRLSEILSP

SEQ ID NO: 1076213 - protein, 21 aa, Mycobacterium
MLMCKYAIPRLISAGGGAIVN

SEQ ID NO: 1076214 - protein, 26 aa, Mycobacterium
MLQTLRAGRWSGYIRTEIDLPTFADR

SEQ ID NO: 1076215 - protein, 21 aa, Mycobacterium
MLREYLEAMRALWTQEEAAYD

SEQ ID NO: 1076216 - protein, 18 aa, Mycobacterium
MLRLHYEKKRNLPRALLA

SEQ ID NO: 1076217 - protein, 22 aa, Mycobacterium
MLSLADYRQYALPHSARVFATL

SEQ ID NO: 1076218 - protein, 39 aa, Mycobacterium
MLTDVKLLARLFGLPYFPVTPLFPLAGPAGLAPLPSKWR

SEQ ID NO: 1076219 - protein, 17 aa, Mycobacterium
MLTIVLRGEGFDTAVIG

SEQ ID NO: 1076220 - protein, 37 aa, Mycobacterium; identical to SEQ ID NO: 839058

SEQ ID NO: 1076221 - protein, 19 aa, Mycobacterium
MLVAANRAQLVSLVQSNLL

SEQ ID NO: 1076222 - protein, 25 aa, Mycobacterium
MLVAGEDPRFVARRLMILASEDIGL

SEQ ID NO: 1076223 - protein, 33 aa, Mycobacterium
MLVFVPSTSPRRWPGRVRFLATGLPSATPARCS

SEQ ID NO: 1076224 - protein, 17 aa, Mycobacterium
MLVKLCLKDGIPLINIV

SEQ ID NO: 1076225 - protein, 18 aa, Mycobacterium
MLWFEVMAPMASSAAGRE

SEQ ID NO: 1076226 - protein, 28 aa, Mycobacterium
MLYVQSLLDDWAFPAKDPAIRARWERRL

SEQ ID NO: 1076227 - protein, 26 aa, Mycobacterium
MLYWQFRGTFIPKTRLTMIAPRAGLV

SEQ ID NO: 1076228 - protein, 19 aa, Mycobacterium
MMAKWITSHRDLPLRLNQW

SEQ ID NO: 1076229 - protein, 17 aa, Mycobacterium
MMFTCAHPALDRQSQLA

SEQ ID NO: 1076230 - protein, 20 aa, Mycobacterium
MMQESLEAILALLRAAPGER

SEQ ID NO: 1076231 - protein, 24 aa, Mycobacterium
MMRGAFDFQLTPLDLEDLRVTISK

SEQ ID NO: 1076232 - protein, 22 aa, Mycobacterium
MMRVLRMIFQPWETHPDIVKAY

SEQ ID NO: 1076233 - protein, 17 aa, Mycobacterium
MMSHLTTPKLLAEQAKL

SEQ ID NO: 1076234 - protein, 19 aa, Mycobacterium
MNHLAFHVPAEKFDAYRQR

SEQ ID NO: 1076235 - protein, 17 aa, Mycobacterium
MNLNHFEAIALVQKIAF

SEQ ID NO: 1076236 - protein, 22 aa, Mycobacterium
MNNLFTPPGGPFGPRPGFGFGP

SEQ ID NO: 1076237 - protein, 19 aa, Mycobacterium
MNVLYNLQHLGYTIPPQAD

SEQ ID NO: 1076238 - protein, 26 aa, Mycobacterium
MNYGGLSVYSGEWWHFDGPGAGVDRP

SEQ ID NO: 1076239 - protein, 26 aa, Mycobacterium
MPAPPPPMFPWMQPTPQPLAPQPGCT

SEQ ID NO: 1076240 - protein, 34 aa, Mycobacterium
MPINLCRPIFRRAPALLISRLVSWVDDLWCRAIG

SEQ ID NO: 1076241 - protein, 18 aa, Mycobacterium
MPNVRAMNFLGEPAVEIG

SEQ ID NO: 1076242 - protein, 20 aa, Mycobacterium
MPQRIWDQKLAEVPMGRAGE

SEQ ID NO: 1076243 - protein, 26 aa, Mycobacterium
MPSTPSNYFHLLRRHALDGIQRPLIV

SEQ ID NO: 1076244 - protein, 29 aa, Mycobacterium
MPTAVNAPAQALFGRPLIGNGSNGTPGTG

SEQ ID NO: 1076245 - protein, 24 aa, Mycobacterium
MQFAYQFPQLVDRLILVGAGGVTK

SEQ ID NO: 1076246 - protein, 17 aa, Mycobacterium
MQGYYKRSREECFDADG

SEQ ID NO: 1076247 - protein, 23 aa, Mycobacterium
MQHFTIPISFFDEAVFEDGLAFD

SEQ ID NO: 1076248 - protein, 23 aa, Mycobacterium
MQIKAIFSVLLREYEFEMAQPAD

SEQ ID NO: 1076249 - protein, 23 aa, Mycobacterium
MQLINYLLRRRGMLTSNVGEAYG

SEQ ID NO: 1076250 - protein, 18 aa, Mycobacterium
MQPTPPPIPIYVGGLSDI

SEQ ID NO: 1076251 - protein, 24 aa, Mycobacterium
MQTLGWRGYVKRNRVAALMRDVRF

SEQ ID NO: 1076252 - protein, 18 aa, Mycobacterium
MQTVFSDFFHRVANDPLA

SEQ ID NO: 1076253 - protein, 24 aa, Mycobacterium
MQTVLGALRLRWLGTELNAMPIDA

SEQ ID NO: 1076254 - protein, 23 aa, Mycobacterium
MQTVPHLIRLHHSRFPQARFELH

SEQ ID NO: 1076255 - protein, 23 aa, Mycobacterium
MRDDVLRLYPGLDPGMVHVVRNG

SEQ ID NO: 1076256 - protein, 31 aa, Mycobacterium
MRERMAFPRSLLERLPRLKLITIVGMNLPNL

SEQ ID NO: 1076257 - protein, 26 aa, Mycobacterium
MRGHTAFLILARRLAPGAVAPAPWGR

SEQ ID NO: 1076258 - protein, 27 aa, Mycobacterium
MRIAPRTMLCGIAFRIHIDVAGARFEE

SEQ ID NO: 1076259 - protein, 30 aa, Mycobacterium
MRIPKPKFVLMPIGIWDQLFRPLVAGQRWI

SEQ ID NO: 1076260 - protein, 18 aa, Mycobacterium
MRRELGLPGYDPVTELDD

SEQ ID NO: 1076261 - protein, 23 aa, Mycobacterium
MRRLRGRFYDGMRALHGAPDEVI

SEQ ID NO: 1076262 - protein, 31 aa, Mycobacterium
MRRVHGRKWCKLFPPGTLPQAVPGSPIAYTT

SEQ ID NO: 1076263 - protein, 17 aa, Mycobacterium
MRTLWRDDLASFTGEFV

SEQ ID NO: 1076264 - protein, 18 aa, Mycobacterium
MRWKPALNAFAITFADRM

SEQ ID NO: 1076265 - protein, 27 aa, Mycobacterium
MSAAAAPYVSWLNAAAVRAGEAALQAK

SEQ ID NO: 1076266 - protein, 26 aa, Mycobacterium
MSAFSICVPRRVPALLISRLVSWGIV

SEQ ID NO: 1076267 - protein, 25 aa, Mycobacterium
MSAGAIMALRLGCQSDKFAAIAPVA

SEQ ID NO: 1076268 - protein, 17 aa, Mycobacterium
MSAPWYDERLAKLAAEL

SEQ ID NO: 1076269 - protein, 20 aa, Mycobacterium
MSCEWFFCASGYYRYDEGYT

SEQ ID NO: 1076270 - protein, 25 aa, Mycobacterium
MSDVRFMRFIGQEIFPGGQLPAQED

SEQ ID NO: 1076271 - protein, 17 aa, Mycobacterium
MSELGFEIDFNDLVYHG

SEQ ID NO: 1076272 - protein, 24 aa, Mycobacterium
MSEWLAYLEGVRAPYPLSYGPQSD

SEQ ID NO: 1076273 - protein, 24 aa, Mycobacterium
MSFKKGKLLFNQPGALPAAALEDL

SEQ ID NO: 1076274 - protein, 18 aa, Mycobacterium
MSGLDIRYDLGGGHPLLG

SEQ ID NO: 1076275 - protein, 25 aa, Mycobacterium
MSHATEFVMLIAENHWRVAEEPVEV

SEQ ID NO: 1076276 - protein, 24 aa, Mycobacterium
MSIERRMLLRAYGAELVLTPGAEG

SEQ ID NO: 1076277 - protein, 18 aa, Mycobacterium
MSIPARLSRPQTWRCCGT

SEQ ID NO: 1076278 - protein, 39 aa, Mycobacterium; identical to SEQ ID NO: 839454

SEQ ID NO: 1076279 - protein, 26 aa, Mycobacterium
MSRGAIFHHFRDKDALFFALAHEDAE

SEQ ID NO: 1076280 - protein, 17 aa, Mycobacterium
MSRLRGVVERPDPLSGL

SEQ ID NO: 1076281 - protein, 31 aa, Mycobacterium
MSVPQSWAWQQRWPITPVRQPRAAAGPVRPL

SEQ ID NO: 1076282 - protein, 27 aa, Mycobacterium
MSWPARWGILYHMYCYRLLYEMAAAPD

SEQ ID NO: 1076283 - protein, 20 aa, Mycobacterium
MTELIAALRAIFAAWNCGDR

SEQ ID NO: 1076284 - protein, 17 aa, Mycobacterium
MTESMLELLLRELDVHP

SEQ ID NO: 1076285 - protein, 18 aa, Mycobacterium
MTESMLELLLRELDVHPS

SEQ ID NO: 1076286 - protein, 18 aa, Mycobacterium
MTEVAEILLPLLAEDIRC

SEQ ID NO: 1076287 - protein, 18 aa, Mycobacterium
MTGSVFFQQATDLGLRTV

SEQ ID NO: 1076288 - protein, 24 aa, Mycobacterium
MTGTPWAYQQLGVKPDVVAFGKKT

SEQ ID NO: 1076289 - protein, 19 aa, Mycobacterium
MTHPLIARPLPAETGPAPF

SEQ ID NO: 1076290 - protein, 27 aa, Mycobacterium
MTIFEHLGRLLIIDCGVLFPGHDEPGV

SEQ ID NO: 1076291 - protein, 30 aa, Mycobacterium
MTIPYAAMEVLKLRLTPSAYQQAAGLAKTF

SEQ ID NO: 1076292 - protein, 18 aa, Mycobacterium
MTKAPHLLMDSRPGYKYG

SEQ ID NO: 1076293 - protein, 24 aa, Mycobacterium
MTKDLAILIGPQQAWLNSEEFLEA

SEQ ID NO: 1076294 - protein, 17 aa, Mycobacterium
MTMPILSLGDVAIVSDP

SEQ ID NO: 1076295 - protein, 17 aa, Mycobacterium
MTRQIMAAPSLARYCPE

SEQ ID NO: 1076296 - protein, 25 aa, Mycobacterium
MTSGSLYHYFPNKSELLNATATEIE

SEQ ID NO: 1076297 - protein, 18 aa, Mycobacterium
MTVLLNSVNLRRVQIEVS

SEQ ID NO: 1076298 - protein, 23 aa, Mycobacterium
MTWRDDEYIIWNLNNYLGLADHP

SEQ ID NO: 1076299 - protein, 19 aa, Mycobacterium
MTYAAPLFVTAEFINNNTG

SEQ ID NO: 1076300 - protein, 20 aa, Mycobacterium
MVAALNLFYSKLTQVIVRHG

SEQ ID NO: 1076301 - protein, 20 aa, Mycobacterium
MVAARDLQFELAARFRDEIA

SEQ ID NO: 1076302 - protein, 18 aa, Mycobacterium
MVADLLAARLGAKFKVHK

SEQ ID NO: 1076303 - protein, 19 aa, Mycobacterium
MVAKTLLAGVPLVVVPGGG

SEQ ID NO: 1076304 - protein, 24 aa, Mycobacterium
MVASVLPYVGWLEATAVQAGHSAM

SEQ ID NO: 1076305 - protein, 18 aa, Mycobacterium
MVDAPLLAAELWERGRVV

SEQ ID NO: 1076306 - protein, 25 aa, Mycobacterium
MVDPRTGRMLIIDKTSSGNPAIYSA

SEQ ID NO: 1076307 - protein, 17 aa, Mycobacterium
MVGFFAYDMVRRLERLP

SEQ ID NO: 1076308 - protein, 18 aa, Mycobacterium
MVGPPPSPIERYPLYCND

SEQ ID NO: 1076309 - protein, 25 aa, Mycobacterium
MVHPLMITLISYAVGGPIRMVDERA

SEQ ID NO: 1076310 - protein, 18 aa, Mycobacterium
MVLAMSTGALRNLLLRYD

SEQ ID NO: 1076311 - protein, 20 aa, Mycobacterium
MVLLSPWLDLGMTNPNIAFA

SEQ ID NO: 1076312 - protein, 22 aa, Mycobacterium
MVLNYYGPLRLIRGLAPGMLER

SEQ ID NO: 1076313 - protein, 26 aa, Mycobacterium
MVMPQMRPIRWWRAASGSANSAASRQ

SEQ ID NO: 1076314 - protein, 17 aa, Mycobacterium
MVNLHRRYRITTAQLAA

SEQ ID NO: 1076315 - protein, 28 aa, Mycobacterium
MVPTRTVFFERFPLTANGKLDRRAVTAL

SEQ ID NO: 1076316 - protein, 22 aa, Mycobacterium
MVQRPFVLIGQQYLADPSRSAG

SEQ ID NO: 1076317 - protein, 18 aa, Mycobacterium
MVRQRPALAAWFASTRPP

SEQ ID NO: 1076318 - protein, 26 aa, Mycobacterium
MVRRHRLLETFLVNELGYGWDEVHDE

SEQ ID NO: 1076319 - protein, 25 aa, Mycobacterium
MVRVRVMPTWLRLDARFGSVYRRRG

SEQ ID NO: 1076320 - protein, 23 aa, Mycobacterium
MVSFGGLPILPPGAGLNVTVASV

SEQ ID NO: 1076321 - protein, 26 aa, Mycobacterium
MVVLAGWVRLAVVLAVRRVERGCGVR

SEQ ID NO: 1076322 - protein, 19 aa, Mycobacterium
MVVPIDAPGLTVQRTCPSL

SEQ ID NO: 1076323 - protein, 25 aa, Mycobacterium
MVVSANPYYHYLLSDIYISEWLGSD

SEQ ID NO: 1076324 - protein, 19 aa, Mycobacterium
MWAADVAAMLGYHGGASAA

SEQ ID NO: 1076325 - protein, 25 aa, Mycobacterium
MWAARRSGLYYVPINTHLTAAEAAY

SEQ ID NO: 1076326 - protein, 17 aa, Mycobacterium
MWALGDYALMAEEVMAP

SEQ ID NO: 1076327 - protein, 26 aa, Mycobacterium
MWFTEAHWPAFRRVDFLRALRDYSMR

SEQ ID NO: 1076328 - protein, 18 aa, Mycobacterium
MWSMFANPALLAGAPEIE

SEQ ID NO: 1076329 - protein, 33 aa, Mycobacterium; identical to SEQ ID NO: 839813

SEQ ID NO: 1076330 - protein, 20 aa, Mycobacterium
MYRLVETFGYGWSDIQRFTI

SEQ ID NO: 1076331 - protein, 26 aa, Mycobacterium
MYYRHRGYAPFSLPSAFTDPGERARM

SEQ ID NO: 1076332 - protein, 20 aa, Mycobacterium
NAAALAPITTVLPAGADEVS

SEQ ID NO: 1076333 - protein, 25 aa, Mycobacterium
NAALAPLITAVVPPAADPVSLEAAI

SEQ ID NO: 1076334 - protein, 20 aa, Mycobacterium
NAAPVFDPPGADLSGEELSV

SEQ ID NO: 1076335 - protein, 23 aa, Mycobacterium
NAAPYGIPKALTAQFMDLVQYGE

SEQ ID NO: 1076336 - protein, 33 aa, Mycobacterium; identical to SEQ ID NO: 839862

SEQ ID NO: 1076337 - protein, 26 aa, Mycobacterium
NAAYTGIDPYFDDLFLMAAEQRFLSV

SEQ ID NO: 1076338 - protein, 26 aa, Mycobacterium
NADAWRPVFTGLAELGLFGVAVPEDH

SEQ ID NO: 1076339 - protein, 26 aa, Mycobacterium
NADFNKYVSYFCPSERSGLGDASQLR

SEQ ID NO: 1076340 - protein, 22 aa, Mycobacterium
NADQLLMVVALADPPPRSGLVD

SEQ ID NO: 1076341 - protein, 19 aa, Mycobacterium
NAFLIGNGGNGGAAAAFGF

SEQ ID NO: 1076342 - protein, 17 aa, Mycobacterium
NAFLVAQGLETLSLRIE

SEQ ID NO: 1076343 - protein, 21 aa, Mycobacterium
NAGEFQSLLGISKGGDGGTGG

SEQ ID NO: 1076344 - protein, 25 aa, Mycobacterium
NAGKLIVVVLPDFGERYLSTVLFAD

SEQ ID NO: 1076345 - protein, 32 aa, Mycobacterium
NAGKPTSVAAIAWMGYEPPPNPLDTATAGDLW

SEQ ID NO: 1076346 - protein, 25 aa, Mycobacterium
NAGLSADAFLIRMTEERFEKVIDAN

SEQ ID NO: 1076347 - protein, 18 aa, Mycobacterium
NAGPVLKVHPNLRYATEG

SEQ ID NO: 1076348 - protein, 23 aa, Mycobacterium
NAGSRFLLDQPITSAGRHPDSDI

SEQ ID NO: 1076349 - protein, 25 aa, Mycobacterium
NAGVYAFEITALQSALSRLSSDNAQ

SEQ ID NO: 1076350 - protein, 24 aa, Mycobacterium
NAHHKLRIFTPGGELAFAGHPTLG

SEQ ID NO: 1076351 - protein, 21 aa, Mycobacterium
NAHQPWVIRELSLHQLLHVTD

SEQ ID NO: 1076352 - protein, 23 aa, Mycobacterium
NAIALCLGWRLFEPMLRSATGLD

SEQ ID NO: 1076353 - protein, 21 aa, Mycobacterium
NAIAPGNIPTPLLASSAAGLD

SEQ ID NO: 1076354 - protein, 19 aa, Mycobacterium
NAISLFTPAESYWITGIKT

SEQ ID NO: 1076355 - protein, 26 aa, Mycobacterium
NAKFGIFIHWGLYSVPGWAPLEADTQ

SEQ ID NO: 1076356 - protein, 20 aa, Mycobacterium
NALPEIGHACGHNIIAASAV

SEQ ID NO: 1076357 - protein, 25 aa, Mycobacterium
NALVQLVLTNLFGQNAPAIAAAEGS

SEQ ID NO: 1076358 - protein, 17 aa, Mycobacterium
NANVSVYALMKLLGHES

SEQ ID NO: 1076359 - protein, 32 aa, Mycobacterium
NAPGVPMVFPPWFERFQIKYINPALKPIARCL

SEQ ID NO: 1076360 - protein, 17 aa, Mycobacterium
NAPHLHFQLMDGPSLLE

SEQ ID NO: 1076361 - protein, 21 aa, Mycobacterium
NAPLTLVHAISPDVATWLNKP

SEQ ID NO: 1076362 - protein, 26 aa, Mycobacterium
NAQELYFPVCFELAITKGPPAAGDRE

SEQ ID NO: 1076363 - protein, 19 aa, Mycobacterium
NAQGLNAFYSPKAITGTLA

SEQ ID NO: 1076364 - protein, 34 aa, Mycobacterium; identical to SEQ ID NO: 886505

SEQ ID NO: 1076365 - protein, 24 aa, Mycobacterium
NASVYLWHDVEGRAPFFDAPDVFA

SEQ ID NO: 1076366 - protein, 20 aa, Mycobacterium
NATAPEVIRLAPPLIITESQ

SEQ ID NO: 1076367 - protein, 22 aa, Mycobacterium
NATAPEVIRLAPPLIITESQID

SEQ ID NO: 1076368 - protein, 20 aa, Mycobacterium
NATIRYLMFSVFSVRPGELG

SEQ ID NO: 1076369 - protein, 19 aa, Mycobacterium
NATTTFGGLAIASGANSSA

SEQ ID NO: 1076370 - protein, 21 aa, Mycobacterium
NAVLGAPTPASFTGSLLVGGS

SEQ ID NO: 1076371 - protein, 28 aa, Mycobacterium
NAVNAPAQALLGHPIIGTGGSGSQSATT

SEQ ID NO: 1076372 - protein, 25 aa, Mycobacterium
NAVVLRQRLRLRAIPAEIVEITLSD

SEQ ID NO: 1076373 - protein, 32 aa, Mycobacterium; identical to SEQ ID NO: 840106

SEQ ID NO: 1076374 - protein, 17 aa, Mycobacterium
NAWFRVTPSYSQDWAQS

SEQ ID NO: 1076375 - protein, 23 aa, Mycobacterium
NAWNEFIPFLDYDTEIRKVICST

SEQ ID NO: 1076376 - protein, 34 aa, Mycobacterium
NCDAFETFPPFPFPAVFTLLRRPRSIKTLFAAMG

SEQ ID NO: 1076377 - protein, 25 aa, Mycobacterium
NCLGGSLMDYLIPTALEVPHLETGH

SEQ ID NO: 1076378 - protein, 23 aa, Mycobacterium
NDAEKRWVLKNPSHLFALDALMA

SEQ ID NO: 1076379 - protein, 27 aa, Mycobacterium
NDAEVLIDLIRRYAPKIALIVTSHQHF

SEQ ID NO: 1076380 - protein, 22 aa, Mycobacterium
NDAILIGCPGTDLARSAADFHF

SEQ ID NO: 1076381 - protein, 17 aa, Mycobacterium
NDELRAPMEQATPLRRL

SEQ ID NO: 1076382 - protein, 25 aa, Mycobacterium
NDKHWAAFVDAVRPPWASEQYATLE

SEQ ID NO: 1076383 - protein, 28 aa, Mycobacterium
NDMVLVDFWASWCGPCRALAPTFQASSE

SEQ ID NO: 1076384 - protein, 37 aa, Mycobacterium; identical to SEQ ID NO: 116265

SEQ ID NO: 1076385 - protein, 25 aa, Mycobacterium
NDPQPGLALIKSWAAQGWLHRIVDE

SEQ ID NO: 1076386 - protein, 18 aa, Mycobacterium
NDPYVFPDNLPLVAAKGG

SEQ ID NO: 1076387 - protein, 25 aa, Mycobacterium
NDTPLARLYSWHRAMRIFDGPDEVH

SEQ ID NO: 1076388 - protein, 26 aa, Mycobacterium
NDWSQTSLWLTFSYKGECIESNLIDA

SEQ ID NO: 1076389 - protein, 37 aa, Mycobacterium
NDYYDKAGLWPYLEKLGFFLVGYGCTTCIGNSGPLPE

SEQ ID NO: 1076390 - protein, 30 aa, Mycobacterium; identical to SEQ ID NO: 840272

SEQ ID NO: 1076391 - protein, 24 aa, Mycobacterium
NEENYLIKKLFTALGALQIENQAR

SEQ ID NO: 1076392 - protein, 32 aa, Mycobacterium; identical to SEQ ID NO: 840282

SEQ ID NO: 1076393 - protein, 19 aa, Mycobacterium
NEEWNCDKGRWAFTYATQP

SEQ ID NO: 1076394 - protein, 17 aa, Mycobacterium
NEFGSCQAIWRLEHGYL

SEQ ID NO: 1076395 - protein, 28 aa, Mycobacterium
NEGMGFYQLMRNLPQERLALAVGAVAAA

SEQ ID NO: 1076396 - protein, 21 aa, Mycobacterium
NEHIHAVMWAARRSGLYYVPI

SEQ ID NO: 1076397 - protein, 22 aa, Mycobacterium
NEHMMLHPLSAPMTLRWLTDRF

SEQ ID NO: 1076398 - protein, 23 aa, Mycobacterium
NEIAHILVLRSRFDGGFTSEVRG

SEQ ID NO: 1076399 - protein, 27 aa, Mycobacterium
NEIPCVCALLTLLPDNLRWLVTVDAMH

SEQ ID NO: 1076400 - protein, 24 aa, Mycobacterium
NEKEPAMAINPKDAVNAARDIATN

SEQ ID NO: 1076401 - protein, 19 aa, Mycobacterium
NEKWTKYFLDPRQIQTMRA

SEQ ID NO: 1076402 - protein, 17 aa, Mycobacterium
NELLALHGQNDQLRLMR

SEQ ID NO: 1076403 - protein, 20 aa, Mycobacterium
NENLGYGLLGRRIERSPLPF

SEQ ID NO: 1076404 - protein, 18 aa, Mycobacterium
NEPRFPSFKGIMAAKKKE

SEQ ID NO: 1076405 - protein, 19 aa, Mycobacterium
NEQVFPVLTPLAVDPAHPF

SEQ ID NO: 1076406 - protein, 21 aa, Mycobacterium
NETAFPRLYGVQTRFFDDFFS

SEQ ID NO: 1076407 - protein, 24 aa, Mycobacterium
NEVKPISLVVGLIEELRKRNPDLD

SEQ ID NO: 1076408 - protein, 28 aa, Mycobacterium
NEVVMPVLKKWRIFEREDFTGEAAWMRD

SEQ ID NO: 1076409 - protein, 19 aa, Mycobacterium
NFADVLIAFGRYPSLEGRL

SEQ ID NO: 1076410 - protein, 18 aa, Mycobacterium
NFAFGHGLTYTSFGYRDL

SEQ ID NO: 1076411 - protein, 21 aa, Mycobacterium
NFALVPLSMYFLDGKVKVELA

SEQ ID NO: 1076412 - protein, 18 aa, Mycobacterium
NFASPWRHPIISSSTISV

SEQ ID NO: 1076413 - protein, 25 aa, Mycobacterium
NFAVADPPLKLVLLENPGAGGTLNH

SEQ ID NO: 1076414 - protein, 20 aa, Mycobacterium
NFEYGLDCILDHAGRLIDER

SEQ ID NO: 1076415 - protein, 19 aa, Mycobacterium
NFFAVFGPYGYVGSSYFAL

SEQ ID NO: 1076416 - protein, 24 aa, Mycobacterium
NFHDLGRLGGWAILAAVAPQGSAT

SEQ ID NO: 1076417 - protein, 23 aa, Mycobacterium
NFLATLPQFVEFVRDGQFDQVAQ

SEQ ID NO: 1076418 - protein, 30 aa, Mycobacterium
NFMARLVFPKPMQHLTITVGLIADLKVINP

SEQ ID NO: 1076419 - protein, 28 aa, Mycobacterium
NFPLGIVPLLLLDMWEHAFYLQYKNVKV

SEQ ID NO: 1076420 - protein, 23 aa, Mycobacterium
NFPQAFTHLALINAVVHVIRAEE

SEQ ID NO: 1076421 - protein, 18 aa, Mycobacterium
NFTAIAANLPTAPALMGN

SEQ ID NO: 1076422 - protein, 25 aa, Mycobacterium
NFYGYFPGLNDMVPIIVAAATPGGK

SEQ ID NO: 1076423 - protein, 29 aa, Mycobacterium
NGAAILQAMLDLPLYRALVTARGGCQEVM

SEQ ID NO: 1076424 - protein, 22 aa, Mycobacterium
NGALNRGFNVANLLIGTGEQAA

SEQ ID NO: 1076425 - protein, 29 aa, Mycobacterium
NGAVVLLMWAGILAYLDRCDYDYVTGCVS

SEQ ID NO: 1076426 - protein, 25 aa, Mycobacterium
NGDCVAFFWFADAPDRVPGISSPGA

SEQ ID NO: 1076427 - protein, 24 aa, Mycobacterium
NGDLPLSFTVANIAPAAAGAATAD

SEQ ID NO: 1076428 - protein, 17 aa, Mycobacterium
NGGAAGWLLGDGGAGGS

SEQ ID NO: 1076429 - protein, 21 aa, Mycobacterium
NGGAASLLFGNGGSGGDGGDG

SEQ ID NO: 1076430 - protein, 29 aa, Mycobacterium
NGGSGGRAALLYGVGRDGGAGGAGGDGVG

SEQ ID NO: 1076431 - protein, 30 aa, Mycobacterium
NGGTGGAAGSGGMFGQMGDAGDGGDAGTGG

SEQ ID NO: 1076432 - protein, 27 aa, Mycobacterium
NGGVGGNAFAAGFSGTGGAAGVGAGAP

SEQ ID NO: 1076433 - protein, 22 aa, Mycobacterium
NGGWSGHGGAGGRGGWLIGNGG

SEQ ID NO: 1076434 - protein, 20 aa, Mycobacterium
NGIDFKIADLSLADFGRKEL

SEQ ID NO: 1076435 - protein, 19 aa, Mycobacterium
NGLRLPGAHSFFVGNPQIG

SEQ ID NO: 1076436 - protein, 31 aa, Mycobacterium; identical to SEQ ID NO: 840555

SEQ ID NO: 1076437 - protein, 22 aa, Mycobacterium
NGLTAAAVLQRAGLRTLCMEAN

SEQ ID NO: 1076438 - protein, 22 aa, Mycobacterium
NGPLAAFIDALGHVGLQVAVLD

SEQ ID NO: 1076439 - protein, 23 aa, Mycobacterium
NGPLAAFIDALGHVGLQVAVLDY

SEQ ID NO: 1076440 - protein, 21 aa, Mycobacterium
NGPPYSPEFLSRYRAAQAARN

SEQ ID NO: 1076441 - protein, 33 aa, Mycobacterium; identical to SEQ ID NO: 783327

SEQ ID NO: 1076442 - protein, 17 aa, Mycobacterium
NGQTLFEICARLTTKHG

SEQ ID NO: 1076443 - protein, 33 aa, Mycobacterium; identical to SEQ ID NO: 840598

SEQ ID NO: 1076444 - protein, 24 aa, Mycobacterium
NGRITIMFCSFTRNSRILRLYGTG

SEQ ID NO: 1076445 - protein, 23 aa, Mycobacterium
NGTATNLGIAAEGGLAGDGGDGG

SEQ ID NO: 1076446 - protein, 25 aa, Mycobacterium
NGTGRLLLVITGRPGDWLPRQWPVE

SEQ ID NO: 1076447 - protein, 23 aa, Mycobacterium
NGTKTFLPYLIASGDGHVINVSS

SEQ ID NO: 1076448 - protein, 20 aa, Mycobacterium
NGTPAQMWPVGANAAPESGE

SEQ ID NO: 1076449 - protein, 20 aa, Mycobacterium
NGVFHTIQAVLPDMVAAGWG

SEQ ID NO: 1076450 - protein, 21 aa, Mycobacterium
NHAALLLAQGAGRLLRRVTDR

SEQ ID NO: 1076451 - protein, 23 aa, Mycobacterium
NHALHIAAVVRLRYDPRSRAYAD

SEQ ID NO: 1076452 - protein, 35 aa, Mycobacterium
NHAQQYQALSAQMARFHDQFVRSLSGAAQTYARAE

SEQ ID NO: 1076453 - protein, 19 aa, Mycobacterium
NHDEDLKYAARLKGLIDVG

SEQ ID NO: 1076454 - protein, 25 aa, Mycobacterium
NHEGVYRFLLKRNRRFYGVAYTLDN

SEQ ID NO: 1076455 - protein, 23 aa, Mycobacterium
NHGNFGSGFLNAGSFSSGYRNTG

SEQ ID NO: 1076456 - protein, 29 aa, Mycobacterium
NHLDADSVGWLRDFLRAHTGGLIIISHNV

SEQ ID NO: 1076457 - protein, 30 aa, Mycobacterium; identical to SEQ ID NO: 840699

SEQ ID NO: 1076458 - protein, 28 aa, Mycobacterium
NHLSIGSFRFWFIGQRWEWSDEVAGMHG

SEQ ID NO: 1076459 - protein, 18 aa, Mycobacterium
NHLTPRVLDIDDLYARMT

SEQ ID NO: 1076460 - protein, 19 aa, Mycobacterium
NHNYIGTEHILLGLIHEGE

SEQ ID NO: 1076461 - protein, 17 aa, Mycobacterium
NHRGSTVLGPAASPLGA

SEQ ID NO: 1076462 - protein, 20 aa, Mycobacterium
NHSVRSYLFGELLAAHDGMR

SEQ ID NO: 1076463 - protein, 27 aa, Mycobacterium
NIASIAGFQPIPFMAVYSASKAFVLTF

SEQ ID NO: 1076464 - protein, 20 aa, Mycobacterium
NIASTLWRSVVDHDARRYYF

SEQ ID NO: 1076465 - protein, 26 aa, Mycobacterium
NIDLQEFILMNKTLAGTIFGSCNPRA

SEQ ID NO: 1076466 - protein, 26 aa, Mycobacterium
NIENTILAACPMVGVLIAIGDGRPYN

SEQ ID NO: 1076467 - protein, 24 aa, Mycobacterium
NIGHLGARLATLGPAATLARGYAV

SEQ ID NO: 1076468 - protein, 19 aa, Mycobacterium
NIGQILETHLGWVAKSGWN

SEQ ID NO: 1076469 - protein, 22 aa, Mycobacterium
NIGQLSMWQLPRDQTGDIGVSN

SEQ ID NO: 1076470 - protein, 19 aa, Mycobacterium
NIGSWRGFPLRDRVAAMVP

SEQ ID NO: 1076471 - protein, 21 aa, Mycobacterium
NILGLDIKGHIVKKLLVVEAS

SEQ ID NO: 1076472 - protein, 23 aa, Mycobacterium
NILITGNDFAYLVDFGIAAAATD

SEQ ID NO: 1076473 - protein, 20 aa, Mycobacterium
NILRAIVGALPLLPRTDQLP

SEQ ID NO: 1076474 - protein, 17 aa, Mycobacterium
NINLPNVKVNPGHVGLP

SEQ ID NO: 1076475 - protein, 17 aa, Mycobacterium
NINMTILLFNNRIYGLT

SEQ ID NO: 1076476 - protein, 19 aa, Mycobacterium
NIPMVYQYRHAFGRRLLEL

SEQ ID NO: 1076477 - protein, 18 aa, Mycobacterium
NIRWDPLDSVYFAGYAMW

SEQ ID NO: 1076478 - protein, 18 aa, Mycobacterium
NITVWSYVDQLNISVLTD

SEQ ID NO: 1076479 - protein, 24 aa, Mycobacterium
NIVGQRYLALAPGRTGRGIPIPPG

SEQ ID NO: 1076480 - protein, 26 aa, Mycobacterium
NIWRTDLQAALSRLATLLGSAASIAV

SEQ ID NO: 1076481 - protein, 25 aa, Mycobacterium
NKESLLVELLVGISSRLLAGARQVT

SEQ ID NO: 1076482 - protein, 21 aa, Mycobacterium
NKGLELIETHLLFGISYERIE

SEQ ID NO: 1076483 - protein, 18 aa, Mycobacterium
NKGWAALPGLQTNPNSLA

SEQ ID NO: 1076484 - protein, 35 aa, Mycobacterium
NKKVLAQLPRAQALALSLLLLSPAALNTLPGLSTV

SEQ ID NO: 1076485 - protein, 24 aa, Mycobacterium
NKLLGSFELTGIPPAPRGVSQIEV

SEQ ID NO: 1076486 - protein, 24 aa, Mycobacterium
NKVAAMRVLQAKLLERKRIEERAE

SEQ ID NO: 1076487 - protein, 33 aa, Mycobacterium; identical to SEQ ID NO: 840887

SEQ ID NO: 1076488 - protein, 18 aa, Mycobacterium
NKVWVVPSDFNAALQGFT

SEQ ID NO: 1076489 - protein, 28 aa, Mycobacterium
NLAAAMQGLVALPLLASYDIHASDPRSA

SEQ ID NO: 1076490 - protein, 18 aa, Mycobacterium
NLANIGVTINAANANAIL

SEQ ID NO: 1076491 - protein, 17 aa, Mycobacterium
NLANLPGYRVGGTIHII

SEQ ID NO: 1076492 - protein, 17 aa, Mycobacterium
NLAPSLWTPEHGEPFLS

SEQ ID NO: 1076493 - protein, 23 aa, Mycobacterium
NLAQYPSILVELGNMKNPADSAL

SEQ ID NO: 1076494 - protein, 17 aa, Mycobacterium
NLDFHVRRVRVSEPGTL

SEQ ID NO: 1076495 - protein, 22 aa, Mycobacterium
NLDPVLVGERLIGPLYAHGAQG

SEQ ID NO: 1076496 - protein, 27 aa, Mycobacterium
NLDQLMKAALPLGLWVPVLPGTRQVTI

SEQ ID NO: 1076497 - protein, 23 aa, Mycobacterium
NLERRKEICGRAYRILTEEVGFP

SEQ ID NO: 1076498 - protein, 17 aa, Mycobacterium
NLFYSKLTQVIVRHGIV

SEQ ID NO: 1076499 - protein, 18 aa, Mycobacterium
NLGLVGRVVLVTGGVRGV

SEQ ID NO: 1076500 - protein, 18 aa, Mycobacterium
NLHRASTGQPLDWFCLFS

SEQ ID NO: 1076501 - protein, 17 aa, Mycobacterium
NLHRPYIDELTRPNPDD

SEQ ID NO: 1076502 - protein, 29 aa, Mycobacterium
NLIDPSAWEFVWVVDPPLFEPAEDATASG

SEQ ID NO: 1076503 - protein, 25 aa, Mycobacterium
NLPAGPALSAIPRAIASRLDELDDP

SEQ ID NO: 1076504 - protein, 24 aa, Mycobacterium
NLPHDTWLPRRRTLQPIFTKQRVA

SEQ ID NO: 1076505 - protein, 21 aa, Mycobacterium
NLPRMLVPLANILGPALFQSA

SEQ ID NO: 1076506 - protein, 25 aa, Mycobacterium
NLRDPWTAIGMLQQGRRWIEKALDA

SEQ ID NO: 1076507 - protein, 27 aa, Mycobacterium
NLRLRDGRWYWHWDPAMMTAPGDDPEL

SEQ ID NO: 1076508 - protein, 18 aa, Mycobacterium
NLSGTWRTLRAAVPAMIE

SEQ ID NO: 1076509 - protein, 30 aa, Mycobacterium
NLTGRPAISLPLHWTPAGLPLGVQFVGGLG

SEQ ID NO: 1076510 - protein, 24 aa, Mycobacterium
NLTGTFLVVREALPALLDNQRSTV

SEQ ID NO: 1076511 - protein, 22 aa, Mycobacterium
NLTYPYGAYFCVVDVDPGTGVV

SEQ ID NO: 1076512 - protein, 18 aa, Mycobacterium
NLVDWFRDGVAETSDTFA

SEQ ID NO: 1076513 - protein, 17 aa, Mycobacterium
NLVGFGNAYYDSTTGQF

SEQ ID NO: 1076514 - protein, 23 aa, Mycobacterium
NLVNARYLRICVLTQYKSHSLDR

SEQ ID NO: 1076515 - protein, 19 aa, Mycobacterium
NLVNRILLTSGKIYYEMVA

SEQ ID NO: 1076516 - protein, 19 aa, Mycobacterium
NLVRPGEEDLFWLGTAEAI

SEQ ID NO: 1076517 - protein, 29 aa, Mycobacterium
NLVTSPVQTLTGRPLFGNGADATTPGANG

SEQ ID NO: 1076518 - protein, 30 aa, Mycobacterium; identical to SEQ ID NO: 841123

SEQ ID NO: 1076519 - protein, 34 aa, Mycobacterium; identical to SEQ ID NO: 841130

SEQ ID NO: 1076520 - protein, 17 aa, Mycobacterium
NMEFVQFHPTGMVWPPS

SEQ ID NO: 1076521 - protein, 18 aa, Mycobacterium
NMPLALRFEGPLDSVALA

SEQ ID NO: 1076522 - protein, 19 aa, Mycobacterium
NMQAIEAAGAGLLLRTERL

SEQ ID NO: 1076523 - protein, 22 aa, Mycobacterium
NMRNQILAIYAVLQQTSDEELA

SEQ ID NO: 1076524 - protein, 35 aa, Mycobacterium; identical to SEQ ID NO: 841162

SEQ ID NO: 1076525 - protein, 18 aa, Mycobacterium
NMTGYPEAVLARELELCY

SEQ ID NO: 1076526 - protein, 22 aa, Mycobacterium
NNLGGLSMWSANRDFPGAVGQL

SEQ ID NO: 1076527 - protein, 27 aa, Mycobacterium
NNRRRARVHGFRLRMRTRAGRSIVSDR

SEQ ID NO: 1076528 - protein, 22 aa, Mycobacterium
NNSGFFNVSFIDGNSGLRNYGN

SEQ ID NO: 1076529 - protein, 26 aa, Mycobacterium
NNTPVFFMRDPLKFQHFIRSQKRMQA

SEQ ID NO: 1076530 - protein, 24 aa, Mycobacterium
NNVGGVFWSPLLQTSEKGWDALYR

SEQ ID NO: 1076531 - protein, 26 aa, Mycobacterium
NNWAEFFHSDSINNLAYGFPFDDVNS

SEQ ID NO: 1076532 - protein, 20 aa, Mycobacterium
NPAIDGAVLPILHLNGYKIA

SEQ ID NO: 1076533 - protein, 23 aa, Mycobacterium
NPAPSTLLLALMSGFERRGRWNV

SEQ ID NO: 1076534 - protein, 25 aa, Mycobacterium
NPDADLVLPFSWQGVSLHAAGAASV

SEQ ID NO: 1076535 - protein, 25 aa, Mycobacterium
NPDGFTETLTWWQIYRRAKIVAEEL

SEQ ID NO: 1076536 - protein, 17 aa, Mycobacterium
NPDLFDESYTRWGPIQW

SEQ ID NO: 1076537 - protein, 24 aa, Mycobacterium
NPENIYFYITVYNEPYVQPAEPEN

SEQ ID NO: 1076538 - protein, 23 aa, Mycobacterium
NPFALLVGMLLDQQVPMETAFAG

SEQ ID NO: 1076539 - protein, 21 aa, Mycobacterium
NPFGHLALRRAGNPPEIVGAA

SEQ ID NO: 1076540 - protein, 21 aa, Mycobacterium
NPGTLYPTLHRLEADGLLLSE

SEQ ID NO: 1076541 - protein, 17 aa, Mycobacterium
NPIAALDRWSDPKMGVA

SEQ ID NO: 1076542 - protein, 23 aa, Mycobacterium
NPKPLGMPLQYMVSGMAVRATNK

SEQ ID NO: 1076543 - protein, 25 aa, Mycobacterium
NPLHSDPWFAKELAGFPKPILHGLC

SEQ ID NO: 1076544 - protein, 20 aa, Mycobacterium
NPMRTFGGLLMAQSFVANSR

SEQ ID NO: 1076545 - protein, 25 aa, Mycobacterium
NPNIRIRQGTRWPTGVAALRPDDDV

SEQ ID NO: 1076546 - protein, 26 aa, Mycobacterium
NPPPITQDLWPAPRPDSSSLPYPAVG

SEQ ID NO: 1076547 - protein, 20 aa, Mycobacterium
NPQSWKLLRGKVALPSHAAL

SEQ ID NO: 1076548 - protein, 22 aa, Mycobacterium
NPREIKRFLNAFQVRNRIAQAR

SEQ ID NO: 1076549 - protein, 29 aa, Mycobacterium
NPSNRRLVLLPFSWIIFIIHEKALGIDRS

SEQ ID NO: 1076550 - protein, 20 aa, Mycobacterium
NPSVSLVFKGLQPTSITEGL

SEQ ID NO: 1076551 - protein, 24 aa, Mycobacterium
NPSVVLLGCFVFASGTSSTRIREE

SEQ ID NO: 1076552 - protein, 23 aa, Mycobacterium
NPTFRWYSSSWRRWAFRPWNRCP

SEQ ID NO: 1076553 - protein, 21 aa, Mycobacterium
NPVCAAAALAVLRVVASEGLV

SEQ ID NO: 1076554 - protein, 20 aa, Mycobacterium
NPVCTAAALAVLRVLATQGL

SEQ ID NO: 1076555 - protein, 21 aa, Mycobacterium
NPVCTAAALAVLRVLATQGLV

SEQ ID NO: 1076556 - protein, 22 aa, Mycobacterium
NPVKLRLGIGYVIQNAGLMPHQ

SEQ ID NO: 1076557 - protein, 28 aa, Mycobacterium
NPVREAIHAVFLFHAIKAGLDMGIVNAG

SEQ ID NO: 1076558 - protein, 26 aa, Mycobacterium
NQAPLSFPIPGWNICVDFPIKAGLNE

SEQ ID NO: 1076559 - protein, 18 aa, Mycobacterium
NQDTPWVDPLIAAAAMGA

SEQ ID NO: 1076560 - protein, 20 aa, Mycobacterium
NQEMLWNRLCEALTPGNVVL

SEQ ID NO: 1076561 - protein, 23 aa, Mycobacterium
NQHLYDAATLRALVDVGAHNGFQ

SEQ ID NO: 1076562 - protein, 22 aa, Mycobacterium
NQLALAMLGAYADGLVAGALRL

SEQ ID NO: 1076563 - protein, 21 aa, Mycobacterium
NQMMEHCIRHVLVEHDGIPAG

SEQ ID NO: 1076564 - protein, 28 aa, Mycobacterium
NQPHPYVAMVPQWDLFNLLAEAAQAEPS

SEQ ID NO: 1076565 - protein, 22 aa, Mycobacterium
NQRIKFSALYAKALALGFDVVV

SEQ ID NO: 1076566 - protein, 21 aa, Mycobacterium
NQRQKFNPLVRLDSVNGGSVE

SEQ ID NO: 1076567 - protein, 25 aa, Mycobacterium
NQSPYPPGGPIPRKYYRTLDPFVAL

SEQ ID NO: 1076568 - protein, 28 aa, Mycobacterium
NQSSGRIKLAWFLLNAARYMPAQLYASD

SEQ ID NO: 1076569 - protein, 24 aa, Mycobacterium
NQSSGVIPIMKLLEDSFSYANQLG

SEQ ID NO: 1076570 - protein, 18 aa, Mycobacterium
NRAIIVRRLLGLEPVLSI

SEQ ID NO: 1076571 - protein, 32 aa, Mycobacterium
NRALGRDQPLSVPPPAAPPPRPTTPAATPPNP

SEQ ID NO: 1076572 - protein, 18 aa, Mycobacterium
NRAQLLLERDDVSPGWHA

SEQ ID NO: 1076573 - protein, 24 aa, Mycobacterium
NRDALARLAPMRAVLSAGAAQLSV

SEQ ID NO: 1076574 - protein, 26 aa, Mycobacterium
NRDKRSLVFPVKRLADLGFRVLATEG

SEQ ID NO: 1076575 - protein, 24 aa, Mycobacterium
NRELLVNVLRHPAFLDGATDTAFF

SEQ ID NO: 1076576 - protein, 19 aa, Mycobacterium
NRFAAPFFDALRAYAAAPV

SEQ ID NO: 1076577 - protein, 23 aa, Mycobacterium
NRFRPERFLGTRPQTYAWVPFGG

SEQ ID NO: 1076578 - protein, 19 aa, Mycobacterium
NRFRTEYEIVNVGDIARLF

SEQ ID NO: 1076579 - protein, 20 aa, Mycobacterium
NRIIIAYSPLAQGLLGGKYG

SEQ ID NO: 1076580 - protein, 24 aa, Mycobacterium
NRKRVVAVSFPRDLAITPVKCEAW

SEQ ID NO: 1076581 - protein, 19 aa, Mycobacterium
NRLARFLVGLGAGPGQRVA

SEQ ID NO: 1076582 - protein, 23 aa, Mycobacterium
NRLARVRWGWRVGLSAGLRRRTR

SEQ ID NO: 1076583 - protein, 23 aa, Mycobacterium
NRLATAQLTRRLTRWTRLYPDVR

SEQ ID NO: 1076584 - protein, 20 aa, Mycobacterium
NRLCAQILLLAAEDASKDIN

SEQ ID NO: 1076585 - protein, 25 aa, Mycobacterium
NRLPKVSWVLPGFLLSEHPAFPVNV

SEQ ID NO: 1076586 - protein, 20 aa, Mycobacterium
NRLVHRFRRAGLREGDAVAI

SEQ ID NO: 1076587 - protein, 34 aa, Mycobacterium; identical to SEQ ID NO: 841584

SEQ ID NO: 1076588 - protein, 27 aa, Mycobacterium
NRQEWHYYFENTKRWRNLRKITVAQVH

SEQ ID NO: 1076589 - protein, 25 aa, Mycobacterium
NRQVIALLDAGLLWERADLAVSGAI

SEQ ID NO: 1076590 - protein, 21 aa, Mycobacterium
NRQVWMPRSTDTGRRRVCGEV

SEQ ID NO: 1076591 - protein, 24 aa, Mycobacterium
NRRRARVHGFRLRMRTRAGRSIVS

SEQ ID NO: 1076592 - protein, 19 aa, Mycobacterium
NRRRLIEFCLLATQYDALA

SEQ ID NO: 1076593 - protein, 22 aa, Mycobacterium
NRRVTGHRLLRAAMAPGGVVLQ

SEQ ID NO: 1076594 - protein, 19 aa, Mycobacterium
NRSMLSLLAKLPDTCHPMD

SEQ ID NO: 1076595 - protein, 38 aa, Mycobacterium
NRSQFVIEPLEPGFGYTLGNSLRRTLLSSIPGAAVTSI

SEQ ID NO: 1076596 - protein, 23 aa, Mycobacterium
NRSTLLDGLRRIGIDRLAPTDGA

SEQ ID NO: 1076597 - protein, 21 aa, Mycobacterium
NRTAANYHLAWAMAAMSMRRR

SEQ ID NO: 1076598 - protein, 26 aa, Mycobacterium
NRTPIDWDGYTPPLPAQGLGVREFHD

SEQ ID NO: 1076599 - protein, 20 aa, Mycobacterium
NRVAALMRDVRFLRIGEGPS

SEQ ID NO: 1076600 - protein, 36 aa, Mycobacterium; identical to SEQ ID NO: 364247

SEQ ID NO: 1076601 - protein, 40 aa, Mycobacterium; identical to SEQ ID NO: 841645

SEQ ID NO: 1076602 - protein, 19 aa, Mycobacterium
NRYARGWHCLGVAKDFMDG

SEQ ID NO: 1076603 - protein, 23 aa, Mycobacterium
NRYWGTPIPVWKSDDPAYPRIDV

SEQ ID NO: 1076604 - protein, 21 aa, Mycobacterium
NSAALTFPFSAEPFPTEPFSI

SEQ ID NO: 1076605 - protein, 24 aa, Mycobacterium
NSALMYFGPGSRSMLAAAAAWDAV

SEQ ID NO: 1076606 - protein, 25 aa, Mycobacterium
NSDAALRRVAAWADGWYGFNLDGVG

SEQ ID NO: 1076607 - protein, 26 aa, Mycobacterium
NSDDDRFMFGYIPPVFKSQYAETAEE

SEQ ID NO: 1076608 - protein, 24 aa, Mycobacterium
NSDVGFIGVPFFHIAGIGNMLSGM

SEQ ID NO: 1076609 - protein, 25 aa, Mycobacterium
NSFLDGLAVHRQAHGLPAISLGWGL

SEQ ID NO: 1076610 - protein, 28 aa, Mycobacterium
NSFVDGLVAYRRSLGLPAVGINWGPWAE

SEQ ID NO: 1076611 - protein, 20 aa, Mycobacterium
NSGCQVFIESSPHPVLMAGI

SEQ ID NO: 1076612 - protein, 24 aa, Mycobacterium
NSGRLLIFSAYVTHRIPEVWPNPT

SEQ ID NO: 1076613 - protein, 23 aa, Mycobacterium
NSGSTNWGLWNPGTGNTGIANAG

SEQ ID NO: 1076614 - protein, 22 aa, Mycobacterium
NSIDIATHAVDKVKEVLIGKDD

SEQ ID NO: 1076615 - protein, 17 aa, Mycobacterium
NSLARAIRFGHKVIESA

SEQ ID NO: 1076616 - protein, 18 aa, Mycobacterium
NSLLDINVFGRRAGIAAA

SEQ ID NO: 1076617 - protein, 18 aa, Mycobacterium
NSRVLTMKWSLIRVAAVW

SEQ ID NO: 1076618 - protein, 19 aa, Mycobacterium
NSSFSFGRPKCLVKVIQKL

SEQ ID NO: 1076619 - protein, 23 aa, Mycobacterium
NSSRRIFRSTRPWFRGCSHPPSS

SEQ ID NO: 1076620 - protein, 21 aa, Mycobacterium
NSWPMARLTLALSPATLPKMG

SEQ ID NO: 1076621 - protein, 30 aa, Mycobacterium; identical to SEQ ID NO: 841782

SEQ ID NO: 1076622 - protein, 23 aa, Mycobacterium
NTADINVFGLENVATVATAIGDN

SEQ ID NO: 1076623 - protein, 21 aa, Mycobacterium
NTARCMRWWAPPAGQRSSSSL

SEQ ID NO: 1076624 - protein, 25 aa, Mycobacterium
NTDPYGAGWLLDVQVEGSDVAALES

SEQ ID NO: 1076625 - protein, 23 aa, Mycobacterium
NTECGALLMHRTRSSALMMAAAM

SEQ ID NO: 1076626 - protein, 20 aa, Mycobacterium
NTFDPTVEAVFWAAERDHGA

SEQ ID NO: 1076627 - protein, 21 aa, Mycobacterium
NTFRRLNGTLLAGLPAMVVAA

SEQ ID NO: 1076628 - protein, 19 aa, Mycobacterium
NTGLTDPIGPFASGVLSGF

SEQ ID NO: 1076629 - protein, 18 aa, Mycobacterium
NTGYLNRGDYNTGVANFG

SEQ ID NO: 1076630 - protein, 18 aa, Mycobacterium
NTHAAWLNGLTRDTPDPK

SEQ ID NO: 1076631 - protein, 23 aa, Mycobacterium
NTKRVTRLFDRVARHRRFRFYLN

SEQ ID NO: 1076632 - protein, 25 aa, Mycobacterium
NTLLGAPVPTNFTSSLLLGSSAQVF

SEQ ID NO: 1076633 - protein, 17 aa, Mycobacterium
NTLLPGFIDPHSHYINA

SEQ ID NO: 1076634 - protein, 30 aa, Mycobacterium
NTLVNTWGLAYFGAVIFQLGTLFAQQLLPD

SEQ ID NO: 1076635 - protein, 25 aa, Mycobacterium
NTPETLLYKKSSVLFGIDLAKRDIA

SEQ ID NO: 1076636 - protein, 29 aa, Mycobacterium
NTRMNEIRLWLPYDEVLPRRQPPSVSVAP

SEQ ID NO: 1076637 - protein, 38 aa, Mycobacterium; identical to SEQ ID NO: 841868

SEQ ID NO: 1076638 - protein, 26 aa, Mycobacterium
NTTVLFAWAVVLSRLTDRRDVVFGTV

SEQ ID NO: 1076639 - protein, 17 aa, Mycobacterium
NTVVLKPAPDTPWCAAV

SEQ ID NO: 1076640 - protein, 23 aa, Mycobacterium
NVATFWRKRTWFEGGYEPSITLN

SEQ ID NO: 1076641 - protein, 23 aa, Mycobacterium
NVAYGLYPAWRGRGLATRAVDLV

SEQ ID NO: 1076642 - protein, 22 aa, Mycobacterium
NVDFVCASLRNPVLLELASEAD

SEQ ID NO: 1076643 - protein, 26 aa, Mycobacterium
NVFDIGLLARRLVDVTGWLAAQPDTT

SEQ ID NO: 1076644 - protein, 17 aa, Mycobacterium
NVFYRGRGFLEGQYDDL

SEQ ID NO: 1076645 - protein, 24 aa, Mycobacterium
NVGAQPARLLLLGGTPFAEELVMW

SEQ ID NO: 1076646 - protein, 19 aa, Mycobacterium
NVGSWLDLLVARLQALAQS

SEQ ID NO: 1076647 - protein, 19 aa, Mycobacterium
NVIGTRPDCWWKDRRGAMV

SEQ ID NO: 1076648 - protein, 37 aa, Mycobacterium; identical to SEQ ID NO: 948235

SEQ ID NO: 1076649 - protein, 19 aa, Mycobacterium
NVITGIFQIGVPMAGWKES

SEQ ID NO: 1076650 - protein, 17 aa, Mycobacterium
NVLIVHWHDLGRYLGAY

SEQ ID NO: 1076651 - protein, 27 aa, Mycobacterium
NVLKETLRLHPPLIILMRVAKGEFQVE

SEQ ID NO: 1076652 - protein, 19 aa, Mycobacterium
NVLPSMEAAFVDIGRGRNG

SEQ ID NO: 1076653 - protein, 19 aa, Mycobacterium
NVLTSLRTLGYGPGDVRAI

SEQ ID NO: 1076654 - protein, 34 aa, Mycobacterium; identical to SEQ ID NO: 841997

SEQ ID NO: 1076655 - protein, 22 aa, Mycobacterium
NVMARIVLSSAWINAEIPTGRL

SEQ ID NO: 1076656 - protein, 18 aa, Mycobacterium
NVMTFRYVIKEVALEEGV

SEQ ID NO: 1076657 - protein, 18 aa, Mycobacterium
NVNVPLMIIGIGTAAQVS

SEQ ID NO: 1076658 - protein, 17 aa, Mycobacterium
NVPAPFGVLPPLQATTS

SEQ ID NO: 1076659 - protein, 24 aa, Mycobacterium
NVPASLVEYVIMGQVLTAGAGQMP

SEQ ID NO: 1076660 - protein, 24 aa, Mycobacterium
NVPEARMVVIKPYEANQLHAIETA

SEQ ID NO: 1076661 - protein, 18 aa, Mycobacterium
NVPLFINTGDKLKVDSRD

SEQ ID NO: 1076662 - protein, 25 aa, Mycobacterium
NVPTDLLLEQLSIRLGWAQRRVELP

SEQ ID NO: 1076663 - protein, 25 aa, Mycobacterium
NVRRDPMAMLPFMGYNVGDYVQHWI

SEQ ID NO: 1076664 - protein, 27 aa, Mycobacterium
NVSGQRFAGMLVAGVFLREFVADAVDW

SEQ ID NO: 1076665 - protein, 20 aa, Mycobacterium
NVSVYALMKLLGHESMVTSQ

SEQ ID NO: 1076666 - protein, 29 aa, Mycobacterium
NVTDMAHFFYIHFGLPTYFKNVFEGHIAS

SEQ ID NO: 1076667 - protein, 19 aa, Mycobacterium
NVTKLPGLGGWRRPQEELD

SEQ ID NO: 1076668 - protein, 19 aa, Mycobacterium
NVVDAYRYWTREAIVADID

SEQ ID NO: 1076669 - protein, 19 aa, Mycobacterium
NVVIYPVTTLRLAMYAVEA

SEQ ID NO: 1076670 - protein, 23 aa, Mycobacterium
NVVQWVPDRYWPTHTRVSVGVQE

SEQ ID NO: 1076671 - protein, 26 aa, Mycobacterium
NVVSRKCGVPYLYRFELMGTADDVAA

SEQ ID NO: 1076672 - protein, 18 aa, Mycobacterium
NVVWTNRGPCAIEGFEAV

SEQ ID NO: 1076673 - protein, 17 aa, Mycobacterium
NWHEAAVIYLDSTLAAM

SEQ ID NO: 1076674 - protein, 18 aa, Mycobacterium
NWLEWKSTLDLSVAAGKF

SEQ ID NO: 1076675 - protein, 21 aa, Mycobacterium
NWLGNLIDAIGVALLPIAPEL

SEQ ID NO: 1076676 - protein, 17 aa, Mycobacterium
NWTLWRDDNERLIPYRA

SEQ ID NO: 1076677 - protein, 18 aa, Mycobacterium
NYAFVRTSGYLAGPHDVY

SEQ ID NO: 1076678 - protein, 22 aa, Mycobacterium
NYARVPLIVLSANRPYELLGTG

SEQ ID NO: 1076679 - protein, 26 aa, Mycobacterium
NYGAAKLGLVGLINTLALEGAKYNIH

SEQ ID NO: 1076680 - protein, 26 aa, Mycobacterium
NYGVDVTIVEFLPRALPNEDAEVSKE

SEQ ID NO: 1076681 - protein, 22 aa, Mycobacterium
NYKDRIFATPVITLPIVDRALE

SEQ ID NO: 1076682 - protein, 27 aa, Mycobacterium
NYLGAVQLILKFIPGMRERGFGHIINV

SEQ ID NO: 1076683 - protein, 29 aa, Mycobacterium
NYQSRRYSPWLAYGQSKLANLLFTSELQK

SEQ ID NO: 1076684 - protein, 25 aa, Mycobacterium
NYRSLRQLVVPLHQLNVVTGANGSG

SEQ ID NO: 1076685 - protein, 20 aa, Mycobacterium
NYVNLLSKTALMQRFNALDQ

SEQ ID NO: 1076686 - protein, 28 aa, Mycobacterium
PAAAAGAPARYWAMAGPAAAVDRAAPPR

SEQ ID NO: 1076687 - protein, 30 aa, Mycobacterium
PAADADFSLSIFGLQLVKTGTANATTTFGG

SEQ ID NO: 1076688 - protein, 24 aa, Mycobacterium
PAADIVIRQIRSITWCRRRTIQVG

SEQ ID NO: 1076689 - protein, 17 aa, Mycobacterium
PAAFYRHFESMEALGLV

SEQ ID NO: 1076690 - protein, 28 aa, Mycobacterium
PAAGEAILTGWRMLLDAGRLQDGEPHLS

SEQ ID NO: 1076691 - protein, 32 aa, Mycobacterium
PAAGHDALLPAYDLLSRLLGMNKIHRTLITQA

SEQ ID NO: 1076692 - protein, 18 aa, Mycobacterium
PAALAHLPADIQLGTHSL

SEQ ID NO: 1076693 - protein, 20 aa, Mycobacterium
PAALQDLEGLFARLAAGSTP

SEQ ID NO: 1076694 - protein, 19 aa, Mycobacterium
PAALVQALFNLGEMVTATQ

SEQ ID NO: 1076695 - protein, 21 aa, Mycobacterium
PAARFALDVTPKYIGSIPANV

SEQ ID NO: 1076696 - protein, 20 aa, Mycobacterium
PAARLQVPRAYRTLPAVLRQ

SEQ ID NO: 1076697 - protein, 25 aa, Mycobacterium
PAAVFAPGFGPPRSWQGLLVSARKG

SEQ ID NO: 1076698 - protein, 22 aa, Mycobacterium
PAAVWRFRLVPRDGGTNLTYRT

SEQ ID NO: 1076699 - protein, 24 aa, Mycobacterium
PAAWTHLVGIKPQRGRISTWPWPE

SEQ ID NO: 1076700 - protein, 21 aa, Mycobacterium
PACLGYVFYAPPRAVPRAHRF

SEQ ID NO: 1076701 - protein, 26 aa, Mycobacterium
PADFAKLWRTLAAELGVAGLLVPESL

SEQ ID NO: 1076702 - protein, 19 aa, Mycobacterium
PADGVGALLRYPASDRLAS

SEQ ID NO: 1076703 - protein, 17 aa, Mycobacterium
PADIGWAAAFLASDLAS

SEQ ID NO: 1076704 - protein, 27 aa, Mycobacterium
PADLSFERPFDAIVGRYVLTFQADLAA

SEQ ID NO: 1076705 - protein, 22 aa, Mycobacterium
PADLYALLRQAGQNHGPAFAAL

SEQ ID NO: 1076706 - protein, 27 aa, Mycobacterium
PADPATLTDLVFAWRSCRAVKSNAIVI

SEQ ID NO: 1076707 - protein, 24 aa, Mycobacterium
PADSRLLTRELFYTAVTRAARKVR

SEQ ID NO: 1076708 - protein, 19 aa, Mycobacterium
PADVVALLNRFFAVVVDEV

SEQ ID NO: 1076709 - protein, 26 aa, Mycobacterium
PADYAGKWVIFFSHPADFTPVCTSEF

SEQ ID NO: 1076710 - protein, 20 aa, Mycobacterium
PAECPGDMRLIPLVANGQPA

SEQ ID NO: 1076711 - protein, 24 aa, Mycobacterium
PAEDDWAGMYLLAAASFTDFIGAE

SEQ ID NO: 1076712 - protein, 19 aa, Mycobacterium
PAEIRMLRVLGADLVGMST

SEQ ID NO: 1076713 - protein, 27 aa, Mycobacterium
PAELHYLGAALWRRGIHRVLHGFVQSG

SEQ ID NO: 1076714 - protein, 24 aa, Mycobacterium
PAELRPALERAFASGLPAVVNVLT

SEQ ID NO: 1076715 - protein, 26 aa, Mycobacterium
PAELRQAWLDLHESWLIVKAAQIGIA

SEQ ID NO: 1076716 - protein, 28 aa, Mycobacterium
PAEQTPASILYLMSLIGDLLPAGVVNVV

SEQ ID NO: 1076717 - protein, 20 aa, Mycobacterium
PAESWPPNQPLPANLPWRPC

SEQ ID NO: 1076718 - protein, 20 aa, Mycobacterium
PAFKAPFEPLTPGGVRIPNT

SEQ ID NO: 1076719 - protein, 27 aa, Mycobacterium
PAFSDDRWEFYDLFRDYSQAADLSAQF

SEQ ID NO: 1076720 - protein, 19 aa, Mycobacterium
PAGAMISLLSALDARVTVW

SEQ ID NO: 1076721 - protein, 26 aa, Mycobacterium
PAGARELIRAFWPGALSLVVVQAPSL

SEQ ID NO: 1076722 - protein, 20 aa, Mycobacterium
PAGFHQPRPPWLMSRCAPAP

SEQ ID NO: 1076723 - protein, 26 aa, Mycobacterium
PAGIRRLFIRWSEWSGSGLWVNLTCR

SEQ ID NO: 1076724 - protein, 29 aa, Mycobacterium
PAGLKGLHDFFKPVLRNLGASARVVVVGT

SEQ ID NO: 1076725 - protein, 17 aa, Mycobacterium
PAGLPPRLSLFGHTRMA

SEQ ID NO: 1076726 - protein, 34 aa, Mycobacterium
PAGPARLGMMLFGPLLNLGLRHFLRKLRSYTDAR

SEQ ID NO: 1076727 - protein, 28 aa, Mycobacterium
PAGRGRFLRWALPVAYRLPGLGRLRAPV

SEQ ID NO: 1076728 - protein, 18 aa, Mycobacterium
PAGRRELLSLRLSSAKIA

SEQ ID NO: 1076729 - protein, 21 aa, Mycobacterium
PAGVDVHLLPFPDLADDQAGT

SEQ ID NO: 1076730 - protein, 31 aa, Mycobacterium
PAHLVVRAVGYRGIPTPGLPFDTNSATIPHS

SEQ ID NO: 1076731 - protein, 29 aa, Mycobacterium
PAHPGNLGVTLGRRVALAAGAVRAESAAT

SEQ ID NO: 1076732 - protein, 19 aa, Mycobacterium
PAIALAVRDALDGTLVEMG

SEQ ID NO: 1076733 - protein, 26 aa, Mycobacterium
PAIATLVLLAEQLDWLLGNGGLDWAV

SEQ ID NO: 1076734 - protein, 31 aa, Mycobacterium; identical to SEQ ID NO: 842504

SEQ ID NO: 1076735 - protein, 28 aa, Mycobacterium
PAIYHDLRIIDNVRYFAALYGYNRQAAD

SEQ ID NO: 1076736 - protein, 25 aa, Mycobacterium
PAKPKALHEAKLAIHDLRGRGWTLN

SEQ ID NO: 1076737 - protein, 24 aa, Mycobacterium
PAKQAPFEPLPGYVTHVPYGDIDA

SEQ ID NO: 1076738 - protein, 20 aa, Mycobacterium
PAKVLPFNEVLDAAGFRCNF

SEQ ID NO: 1076739 - protein, 17 aa, Mycobacterium
PALACGNAFVLKPSERD

SEQ ID NO: 1076740 - protein, 27 aa, Mycobacterium
PALFTQMAALAAMWRSFDIPPNVTIGH

SEQ ID NO: 1076741 - protein, 17 aa, Mycobacterium
PALLRVFGFRTGVGRAV

SEQ ID NO: 1076742 - protein, 19 aa, Mycobacterium
PALPAMLAHIRELAPNCPL

SEQ ID NO: 1076743 - protein, 17 aa, Mycobacterium
PALPFPQTPGAAAQSDN

SEQ ID NO: 1076744 - protein, 17 aa, Mycobacterium
PAMRVLVAPVCYGESLS

SEQ ID NO: 1076745 - protein, 24 aa, Mycobacterium
PANHQYLGPVLWSPAGELPRWWDS

SEQ ID NO: 1076746 - protein, 20 aa, Mycobacterium
PANLSRLNPFALQPAPGNNN

SEQ ID NO: 1076747 - protein, 26 aa, Mycobacterium
PANVPTPFGLFPPVSPLTVAEHLAAG

SEQ ID NO: 1076748 - protein, 19 aa, Mycobacterium
PAPLPSWPTRLGWAVRDWP

SEQ ID NO: 1076749 - protein, 19 aa, Mycobacterium
PAPPAPPVPPMLPAPPSVP

SEQ ID NO: 1076750 - protein, 17 aa, Mycobacterium
PAPRRVAGRRRSWSGPG

SEQ ID NO: 1076751 - protein, 23 aa, Mycobacterium
PAPRRWRSPAPLWGDASFDSVAP

SEQ ID NO: 1076752 - protein, 22 aa, Mycobacterium
PAQAIAQVCELNWQLRGQATGR

SEQ ID NO: 1076753 - protein, 17 aa, Mycobacterium
PAQLLARLIASLIEVTL

SEQ ID NO: 1076754 - protein, 35 aa, Mycobacterium
PARIQAMLGALLELFQARALHPLPIKTWDVRCTPA

SEQ ID NO: 1076755 - protein, 17 aa, Mycobacterium
PARLKVGIISAGRVGTA

SEQ ID NO: 1076756 - protein, 23 aa, Mycobacterium
PARPRAGLIGCAFADLAEIMAGV

SEQ ID NO: 1076757 - protein, 24 aa, Mycobacterium
PARPVFFDMCPPNRMIGGPNPEGN

SEQ ID NO: 1076758 - protein, 24 aa, Mycobacterium
PARQAADLAYFRVLIHGTRNRALG

SEQ ID NO: 1076759 - protein, 17 aa, Mycobacterium
PARSFLARVPRSVVEPS

SEQ ID NO: 1076760 - protein, 25 aa, Mycobacterium
PARSLRNVFAAYTLYDLTARLVLGD

SEQ ID NO: 1076761 - protein, 19 aa, Mycobacterium
PASFQGVLTNLGWSVDDDI

SEQ ID NO: 1076762 - protein, 23 aa, Mycobacterium
PASLKWHDTARRSWLRELGRIPR

SEQ ID NO: 1076763 - protein, 17 aa, Mycobacterium
PASLVEMRRVRDLQPYI

SEQ ID NO: 1076764 - protein, 67 aa, Mycobacterium
PASPPSPPLPPAWPPRPEMLPSAPLAPLPPLPPAPPPPPLPPAPPPWLPVVLPAPPSPPAPPCPPVP

SEQ ID NO: 1076765 - protein, 19 aa, Mycobacterium
PASVLSVLRRLEGHFTLVF

SEQ ID NO: 1076766 - protein, 27 aa, Mycobacterium
PASVTSWWRLAACPRPRWPRTTPTTWA

SEQ ID NO: 1076767 - protein, 22 aa, Mycobacterium
PATGFPLMALFSGLHDECEQRS

SEQ ID NO: 1076768 - protein, 29 aa, Mycobacterium
PATIATDPYGAGWLYSVQPTAVGDLLTAS

SEQ ID NO: 1076769 - protein, 24 aa, Mycobacterium
PATILPVVAAFHAIRPLSGDEIEA

SEQ ID NO: 1076770 - protein, 24 aa, Mycobacterium
PATKVNPGLYHYNTRRWHEHPPVG

SEQ ID NO: 1076771 - protein, 17 aa, Mycobacterium
PATMMARWFRTEQARAL

SEQ ID NO: 1076772 - protein, 17 aa, Mycobacterium
PATTGLHRVLTTPLARS

SEQ ID NO: 1076773 - protein, 18 aa, Mycobacterium
PATYFSGGKLQWILENVD

SEQ ID NO: 1076774 - protein, 19 aa, Mycobacterium
PATYFSGGKLQWILENVDG

SEQ ID NO: 1076775 - protein, 19 aa, Mycobacterium
PAVFIFNHRNQVDPVIAGA

SEQ ID NO: 1076776 - protein, 28 aa, Mycobacterium
PAVIKNAIDWLSRPFGDGALKDKPLAVI

SEQ ID NO: 1076777 - protein, 17 aa, Mycobacterium
PAVLDFGVEQDWAWLRT

SEQ ID NO: 1076778 - protein, 41 aa, Mycobacterium; identical to SEQ ID NO: 842867

SEQ ID NO: 1076779 - protein, 18 aa, Mycobacterium
PAVRAAFLLVNDLAVLTL

SEQ ID NO: 1076780 - protein, 18 aa, Mycobacterium
PAVTARRRLRMICHGLGH

SEQ ID NO: 1076781 - protein, 19 aa, Mycobacterium
PAVVVLPGPPRELQPMWHS

SEQ ID NO: 1076782 - protein, 20 aa, Mycobacterium
PAYGLAFRLLSSAHENVITG

SEQ ID NO: 1076783 - protein, 19 aa, Mycobacterium
PAYLAVLDALRPFMSGLQI

SEQ ID NO: 1076784 - protein, 20 aa, Mycobacterium
PCGKPQPGYLPVLRAYDYSG

SEQ ID NO: 1076785 - protein, 25 aa, Mycobacterium
PCLVYLQQMLDLKILLNVAFDGEKL

SEQ ID NO: 1076786 - protein, 35 aa, Mycobacterium
PDAQLRAWLRSYATKHPCHGFRRAWSALRYDEHHQ

SEQ ID NO: 1076787 - protein, 26 aa, Mycobacterium
PDAQQDWLRAFGAPNPRFLQRMILVL

SEQ ID NO: 1076788 - protein, 29 aa, Mycobacterium
PDATTLFESFLPRYLTTRVYAAMLESAAS

SEQ ID NO: 1076789 - protein, 22 aa, Mycobacterium
PDAVRVFLTPESARQFATRSNR

SEQ ID NO: 1076790 - protein, 24 aa, Mycobacterium
PDAYPGYLGLMPQGTQVPNEVAAR

SEQ ID NO: 1076791 - protein, 25 aa, Mycobacterium
PDDGRMLLHTILTYTQKQFHEMGVK

SEQ ID NO: 1076792 - protein, 25 aa, Mycobacterium
PDDLKFTLVEPLRLLFKDEVRAVGR

SEQ ID NO: 1076793 - protein, 17 aa, Mycobacterium
PDDPLLSARQRAVAARG

SEQ ID NO: 1076794 - protein, 24 aa, Mycobacterium
PDDRYMRTLDPWVSLGAASAVTSR

SEQ ID NO: 1076795 - protein, 18 aa, Mycobacterium
PDDYWAGRGLATICLRPE

SEQ ID NO: 1076796 - protein, 31 aa, Mycobacterium; identical to SEQ ID NO: 843053

SEQ ID NO: 1076797 - protein, 24 aa, Mycobacterium
PDEFAIVHKLRRVLSGLDSHQAID

SEQ ID NO: 1076798 - protein, 24 aa, Mycobacterium
PDEFGIVHKLRRVLSGLDSHQAID

SEQ ID NO: 1076799 - protein, 26 aa, Mycobacterium
PDEFIWDRPIRRSLAFGRGQHFCIGY

SEQ ID NO: 1076800 - protein, 18 aa, Mycobacterium
PDEIGQLVFVTSTGFIAP

SEQ ID NO: 1076801 - protein, 25 aa, Mycobacterium
PDEVARYLFRRVVSWGRSSNVFLRN

SEQ ID NO: 1076802 - protein, 19 aa, Mycobacterium
PDFGALEITTCLRRGEIEM

SEQ ID NO: 1076803 - protein, 23 aa, Mycobacterium
PDGEDLSWLWDVRFEHFAEAFKT

SEQ ID NO: 1076804 - protein, 28 aa, Mycobacterium
PDGISRLRFRLRWRGYRLTVDANHSTVT

SEQ ID NO: 1076805 - protein, 27 aa, Mycobacterium
PDGQTDMLVNPWGLWWQELTASDICTV

SEQ ID NO: 1076806 - protein, 24 aa, Mycobacterium
PDGRDLIISCGVALHHCVVALASM

SEQ ID NO: 1076807 - protein, 22 aa, Mycobacterium
PDGRNYMWVARTVERRAARYGQ

SEQ ID NO: 1076808 - protein, 22 aa, Mycobacterium
PDGRPFYCGTYYPKAGFLQLLS

SEQ ID NO: 1076809 - protein, 23 aa, Mycobacterium
PDGRPHRFQVTASRFGRSVNVAA

SEQ ID NO: 1076810 - protein, 28 aa, Mycobacterium
PDGTATARFLIARILFHDWEHEMSPDLH

SEQ ID NO: 1076811 - protein, 25 aa, Mycobacterium
PDGTKGVTVLLFTQGRALAELEFDG

SEQ ID NO: 1076812 - protein, 18 aa, Mycobacterium
PDGWIRAVGYHEAVAGPL

SEQ ID NO: 1076813 - protein, 25 aa, Mycobacterium
PDGYRLTVDYAVRITGRGLYVHSAP

SEQ ID NO: 1076814 - protein, 27 aa, Mycobacterium
PDHTAVAIALLFENFTSVLVGTSGSSG

SEQ ID NO: 1076815 - protein, 22 aa, Mycobacterium
PDHVMYVWIDALTNYLTGAGFP

SEQ ID NO: 1076816 - protein, 20 aa, Mycobacterium
PDIEFSALVASPNGARRAIA

SEQ ID NO: 1076817 - protein, 17 aa, Mycobacterium
PDIKAVPAPPAPPAPPL

SEQ ID NO: 1076818 - protein, 17 aa, Mycobacterium
PDILINNAGLSTLGPVA

SEQ ID NO: 1076819 - protein, 25 aa, Mycobacterium
PDIVHAHDWLVAHPAIALADYYDVP

SEQ ID NO: 1076820 - protein, 17 aa, Mycobacterium
PDKLSRFVSFVNAPDAA

SEQ ID NO: 1076821 - protein, 28 aa, Mycobacterium
PDKNGDYAFLLHVLKSLKSTGKAAIILP

SEQ ID NO: 1076822 - protein, 25 aa, Mycobacterium
PDLARLYEPMLARQTNRHYGTPTPI

SEQ ID NO: 1076823 - protein, 32 aa, Mycobacterium; identical to SEQ ID NO: 843188

SEQ ID NO: 1076824 - protein, 26 aa, Mycobacterium
PDLIDPALLRPGRLERLVFVEPPDAE

SEQ ID NO: 1076825 - protein, 41 aa, Mycobacterium
PDLKALIDRLWPASDFSAPRRWWPPCARSLTSLRPPVVRRW

SEQ ID NO: 1076826 - protein, 27 aa, Mycobacterium
PDLKWERFITAVRLLAERLGVRQTISL

SEQ ID NO: 1076827 - protein, 28 aa, Mycobacterium
PDLKWERFITAVRLLAERLGVRQTISLG

SEQ ID NO: 1076828 - protein, 17 aa, Mycobacterium
PDLLLAQALLRTKQIKL

SEQ ID NO: 1076829 - protein, 20 aa, Mycobacterium
PDLRLLGALPTLYDPRTTHT

SEQ ID NO: 1076830 - protein, 18 aa, Mycobacterium
PDMKREIWLPTNPPQHGS

SEQ ID NO: 1076831 - protein, 30 aa, Mycobacterium
PDMPHTTPPRLVLDGFLASGQPLSGLEPEL

SEQ ID NO: 1076832 - protein, 23 aa, Mycobacterium
PDNEFRVVLARRGQHWVSAVRVG

SEQ ID NO: 1076833 - protein, 25 aa, Mycobacterium
PDPDGGLLAYRRLSEALAPQSWYLS

SEQ ID NO: 1076834 - protein, 20 aa, Mycobacterium
PDPLLLLTHPLPNTGVVEVQ

SEQ ID NO: 1076835 - protein, 21 aa, Mycobacterium
PDPQWRGGALIAVQFVLNYEE

SEQ ID NO: 1076836 - protein, 25 aa, Mycobacterium
PDQVNTEFYFKFLRSPDGNGITDPH

SEQ ID NO: 1076837 - protein, 26 aa, Mycobacterium
PDRGPALLISRLVSWVDDLWCRAIGA

SEQ ID NO: 1076838 - protein, 20 aa, Mycobacterium
PDRGPLRHLGFGRGAHYCLG

SEQ ID NO: 1076839 - protein, 17 aa, Mycobacterium
PDRLILSKYDPVIRKHV

SEQ ID NO: 1076840 - protein, 25 aa, Mycobacterium
PDRPIELRLLEIEPALKALEGVVME

SEQ ID NO: 1076841 - protein, 20 aa, Mycobacterium
PDRRVVNFRGLRLEAMAAKQ

SEQ ID NO: 1076842 - protein, 26 aa, Mycobacterium
PDRVPGLFTLVLHTHLPWLAHHGRWP

SEQ ID NO: 1076843 - protein, 31 aa, Mycobacterium
PDSGSTWLLPRLVGLARARRMLLLGEQVTAP

SEQ ID NO: 1076844 - protein, 17 aa, Mycobacterium
PDSHDICFIPSGNTQTF

SEQ ID NO: 1076845 - protein, 26 aa, Mycobacterium
PDSILRVLAMHRFAKSPMLVGGQMLN

SEQ ID NO: 1076846 - protein, 26 aa, Mycobacterium
PDSNGARPFLFTDTVGFVRHLPPQLV

SEQ ID NO: 1076847 - protein, 17 aa, Mycobacterium
PDSPFLELSPLAAWGSA

SEQ ID NO: 1076848 - protein, 26 aa, Mycobacterium
PDSPRVVLLGIPTRGVILASRLAANI

SEQ ID NO: 1076849 - protein, 18 aa, Mycobacterium
PDTPFNATRLGRLIAEKT

SEQ ID NO: 1076850 - protein, 25 aa, Mycobacterium
PDTQTVDFVKEDGRWMMLLFEDKCS

SEQ ID NO: 1076851 - protein, 25 aa, Mycobacterium
PDTTNVVTAWRLLGSIDPRLRPHRV

SEQ ID NO: 1076852 - protein, 26 aa, Mycobacterium
PDTWRDPRGFALKFYTSEGNFDMVGN

SEQ ID NO: 1076853 - protein, 25 aa, Mycobacterium
PDVFSRFRRAVTDTGLYKDSDRLAV

SEQ ID NO: 1076854 - protein, 34 aa, Mycobacterium; identical to SEQ ID NO: 843414

SEQ ID NO: 1076855 - protein, 35 aa, Mycobacterium
PDVVIGIGIPIRNPLPAPLRAAFQPGVHYNRFGKP

SEQ ID NO: 1076856 - protein, 21 aa, Mycobacterium
PDYRKYGFQIKLADAAFEGAP

SEQ ID NO: 1076857 - protein, 18 aa, Mycobacterium
PEAVLARELELCYAAVAL

SEQ ID NO: 1076858 - protein, 27 aa, Mycobacterium
PECQQAVRFGLFHLLQASARAERRAIP

SEQ ID NO: 1076859 - protein, 21 aa, Mycobacterium
PEDPGVMWQFAQAVRGLADGC

SEQ ID NO: 1076860 - protein, 18 aa, Mycobacterium
PEEFVEFAQYAEGLGFAG

SEQ ID NO: 1076861 - protein, 28 aa, Mycobacterium
PEELTEAFAKAWYKLLHRDMGPVSRYLG

SEQ ID NO: 1076862 - protein, 25 aa, Mycobacterium
PEEMARIVAFLLPDDSSMITGTTQI

SEQ ID NO: 1076863 - protein, 25 aa, Mycobacterium
PEERRALQLPPGAPVLTVVRTAYDT

SEQ ID NO: 1076864 - protein, 20 aa, Mycobacterium
PEEVALELLRNELGARRIDN

SEQ ID NO: 1076865 - protein, 17 aa, Mycobacterium
PEEVKYPPLGSFRHGAS

SEQ ID NO: 1076866 - protein, 21 aa, Mycobacterium
PEFKAMFLDDLLNGSRKQLAA

SEQ ID NO: 1076867 - protein, 22 aa, Mycobacterium
PEGDFFGIVLQAPGASGAVRHL

SEQ ID NO: 1076868 - protein, 31 aa, Mycobacterium
PEGFYGQLLSTLRPYRPTLPMGAPHEVWWGR

SEQ ID NO: 1076869 - protein, 25 aa, Mycobacterium
PEGGMHSLWTDILARQVFAPHVPHD

SEQ ID NO: 1076870 - protein, 20 aa, Mycobacterium
PEGIEGRVPFRGPLASVIHQ

SEQ ID NO: 1076871 - protein, 28 aa, Mycobacterium
PEGKGWRWHTWHLYPLHPGGSGGTVVHT

SEQ ID NO: 1076872 - protein, 30 aa, Mycobacterium; identical to SEQ ID NO: 785416

SEQ ID NO: 1076873 - protein, 20 aa, Mycobacterium
PEGLYEPLLARLRASANVVP

SEQ ID NO: 1076874 - protein, 26 aa, Mycobacterium
PEHGPGPFPGALWLQVRDIAATQAEL

SEQ ID NO: 1076875 - protein, 18 aa, Mycobacterium
PEHTYHVALPGRGEPKRA

SEQ ID NO: 1076876 - protein, 27 aa, Mycobacterium
PEIAEQLLRVLARRLRRTSNNLADLIF

SEQ ID NO: 1076877 - protein, 20 aa, Mycobacterium
PEIKAFYDYIKRAALNTEIP

SEQ ID NO: 1076878 - protein, 19 aa, Mycobacterium
PEILLLDEGIGAVDAGFLK

SEQ ID NO: 1076879 - protein, 18 aa, Mycobacterium
PEIWRGIIDLDESMPAEL

SEQ ID NO: 1076880 - protein, 17 aa, Mycobacterium
PEKPGPVAPRYHGRHQL

SEQ ID NO: 1076881 - protein, 24 aa, Mycobacterium
PEKSLDALTMPFLDPRKRVADYPT

SEQ ID NO: 1076882 - protein, 27 aa, Mycobacterium
PELAEAALAIRAGALWVAANVDKTLPT

SEQ ID NO: 1076883 - protein, 21 aa, Mycobacterium
PELARPLISLGTRGLLLGIKH

SEQ ID NO: 1076884 - protein, 18 aa, Mycobacterium
PELFYWAHATFVDQILYN

SEQ ID NO: 1076885 - protein, 22 aa, Mycobacterium
PELGRFGVWLGSRSITPELAGQ

SEQ ID NO: 1076886 - protein, 25 aa, Mycobacterium
PELPADTRWHPVNALPPMAFDHGPM

SEQ ID NO: 1076887 - protein, 19 aa, Mycobacterium
PELRQLERLFFECYSRAAQ

SEQ ID NO: 1076888 - protein, 31 aa, Mycobacterium
PELSLYALRDSVGTPFLLLAGMEPDLKWERF

SEQ ID NO: 1076889 - protein, 33 aa, Mycobacterium
PELSLYALRDSVGTPFLLLAGMEPDLKWERFIT

SEQ ID NO: 1076890 - protein, 22 aa, Mycobacterium
PELVRRWRAGYFSALDASSGGH

SEQ ID NO: 1076891 - protein, 17 aa, Mycobacterium
PEMIRWPGKISAGVVSN

SEQ ID NO: 1076892 - protein, 25 aa, Mycobacterium
PEMNLGQLALVLRGKYLVDVQSVTK

SEQ ID NO: 1076893 - protein, 29 aa, Mycobacterium
PEPLATMAGYYLGWWDIDRSALAGSSGTF

SEQ ID NO: 1076894 - protein, 23 aa, Mycobacterium
PEPTLPVPAGWPFGEEFPRTCGA

SEQ ID NO: 1076895 - protein, 25 aa, Mycobacterium
PEQTARAWLACGPAIVALTFGDQSA

SEQ ID NO: 1076896 - protein, 20 aa, Mycobacterium
PERAKYLASTYSVLVTSAKD

SEQ ID NO: 1076897 - protein, 24 aa, Mycobacterium
PERDRAIIFTALLTGLRADELIRA

SEQ ID NO: 1076898 - protein, 25 aa, Mycobacterium
PERGLLLAHHPLLLRGVDTVAANTA

SEQ ID NO: 1076899 - protein, 20 aa, Mycobacterium
PERIDTDVLAALRSAERDPA

SEQ ID NO: 1076900 - protein, 17 aa, Mycobacterium
PERLGTRNPIFQAAVSL

SEQ ID NO: 1076901 - protein, 19 aa, Mycobacterium
PERNRVLVEGVNRIKKHTA

SEQ ID NO: 1076902 - protein, 19 aa, Mycobacterium
PERVELRYTMPLGEIIFDF

SEQ ID NO: 1076903 - protein, 33 aa, Mycobacterium; identical to SEQ ID NO: 843851

SEQ ID NO: 1076904 - protein, 26 aa, Mycobacterium
PETDFPRWFGRNWRRQAMLRYGENPH

SEQ ID NO: 1076905 - protein, 21 aa, Mycobacterium
PETLRSLYFLSSRVSGGSPHA

SEQ ID NO: 1076906 - protein, 23 aa, Mycobacterium
PETNSTRMYLGPGSSPILTAAAA

SEQ ID NO: 1076907 - protein, 23 aa, Mycobacterium
PEVADLVAMLRLVGDPTAGAAAM

SEQ ID NO: 1076908 - protein, 31 aa, Mycobacterium; identical to SEQ ID NO: 843889

SEQ ID NO: 1076909 - protein, 24 aa, Mycobacterium
PEVNSLRMYSGPGSAPMLAAMAAW

SEQ ID NO: 1076910 - protein, 19 aa, Mycobacterium
PEVRSQLAMTWGTETFIVP

SEQ ID NO: 1076911 - protein, 30 aa, Mycobacterium
PEWARRWQRLLFDNGWLIPGNPPEFGGRNA

SEQ ID NO: 1076912 - protein, 23 aa, Mycobacterium
PFAQALRLALIDAAPDVAQDPVV

SEQ ID NO: 1076913 - protein, 24 aa, Mycobacterium
PFDAEQPLFLLYTSGTTGKPKGIV

SEQ ID NO: 1076914 - protein, 28 aa, Mycobacterium
PFDLQKDLPIRVLLIALGADDHYLAWSV

SEQ ID NO: 1076915 - protein, 22 aa, Mycobacterium
PFDTGTRLWLDGLLAGMFARAE

SEQ ID NO: 1076916 - protein, 21 aa, Mycobacterium
PFELPIHGVWRRILASQATPE

SEQ ID NO: 1076917 - protein, 21 aa, Mycobacterium
PFERKQYVAKFLGLSDGVIGE

SEQ ID NO: 1076918 - protein, 19 aa, Mycobacterium
PFFATITGSPRIGPRRELK

SEQ ID NO: 1076919 - protein, 33 aa, Mycobacterium
PFFKAYVVNLLPGQFVQLFIGAALSDLGLDPAT

SEQ ID NO: 1076920 - protein, 26 aa, Mycobacterium
PFGLTMFFPANFPLPAKIVYQVLEPI

SEQ ID NO: 1076921 - protein, 19 aa, Mycobacterium
PFLQHLLTHRDVTRLKVTV

SEQ ID NO: 1076922 - protein, 26 aa, Mycobacterium
PFLSYGQFTGLAPRDLCALWPVPATS

SEQ ID NO: 1076923 - protein, 20 aa, Mycobacterium
PFNATRLGRLIAEKTDIPPG

SEQ ID NO: 1076924 - protein, 17 aa, Mycobacterium
PFRAKQLAHQYYGRLIA

SEQ ID NO: 1076925 - protein, 17 aa, Mycobacterium
PFSALAFKVATHPFFGK

SEQ ID NO: 1076926 - protein, 25 aa, Mycobacterium
PFSAPYSFDTPFGPVALTLNGTASP

SEQ ID NO: 1076927 - protein, 17 aa, Mycobacterium
PFSIEEIVLRLRALLRR

SEQ ID NO: 1076928 - protein, 17 aa, Mycobacterium
PFTARYFEVILGVWERR

SEQ ID NO: 1076929 - protein, 25 aa, Mycobacterium
PFTTTAELVALLYEAIPAAARRTGG

SEQ ID NO: 1076930 - protein, 31 aa, Mycobacterium; identical to SEQ ID NO: 844078

SEQ ID NO: 1076931 - protein, 26 aa, Mycobacterium
PFVALTQRIIAKRYLRGVWAASAEPA

SEQ ID NO: 1076932 - protein, 21 aa, Mycobacterium
PFYDGAVFHRVIRGFMIQGGD

SEQ ID NO: 1076933 - protein, 28 aa, Mycobacterium
PGAEAFRSWRLLVTRYGTPAPGPAPDGM

SEQ ID NO: 1076934 - protein, 28 aa, Mycobacterium
PGAHQHIALVPQWDFLELLAAAAEAEPT

SEQ ID NO: 1076935 - protein, 28 aa, Mycobacterium
PGAPQLDPALFDLGLPVFGICYGFQVMA

SEQ ID NO: 1076936 - protein, 17 aa, Mycobacterium
PGATGVWVLVQRPSSFS

SEQ ID NO: 1076937 - protein, 19 aa, Mycobacterium
PGCHVYRTLDDLDAIHACA

SEQ ID NO: 1076938 - protein, 27 aa, Mycobacterium
PGDARSELWFFYHLGRKLREKLSGSTD

SEQ ID NO: 1076939 - protein, 20 aa, Mycobacterium
PGDAYWLLRHAIACPDPVMY

SEQ ID NO: 1076940 - protein, 24 aa, Mycobacterium
PGDELLFIADSFLERSVWAAVYST

SEQ ID NO: 1076941 - protein, 26 aa, Mycobacterium
PGDGEQRLHLVLADLGRVRQLGDATG

SEQ ID NO: 1076942 - protein, 23 aa, Mycobacterium
PGDGGTWFLQRAIGYERAAEMTL

SEQ ID NO: 1076943 - protein, 18 aa, Mycobacterium
PGDPPLAGSLLIGGEGRV

SEQ ID NO: 1076944 - protein, 83 aa, Mycobacterium
PGDRRGWRRGRHRRQLRCRRHVRRRHPGGLGPGRRWRRRWTGRLRRRRLVRATRRHWRRRRVRRHRLRNGGIRRRHRRHRRDR

SEQ ID NO: 1076945 - protein, 23 aa, Mycobacterium
PGDRRPMLWLEVMKPMASNAVDR

SEQ ID NO: 1076946 - protein, 23 aa, Mycobacterium
PGDTWLCDRSWNRPRWKIDEVVE

SEQ ID NO: 1076947 - protein, 24 aa, Mycobacterium
PGDVWAGPVSLDRLARPQFTMHAG

SEQ ID NO: 1076948 - protein, 24 aa, Mycobacterium
PGEPPYVRGPYPTMYVNQPWTIRQ

SEQ ID NO: 1076949 - protein, 18 aa, Mycobacterium
PGFFRATVRPSVRLLILD

SEQ ID NO: 1076950 - protein, 20 aa, Mycobacterium
PGFQVFLPHRLLVVVVDESK

SEQ ID NO: 1076951 - protein, 17 aa, Mycobacterium
PGFTVPEFRRKAVIIAV

SEQ ID NO: 1076952 - protein, 17 aa, Mycobacterium
PGFVLKRAVKGTVESGL

SEQ ID NO: 1076953 - protein, 21 aa, Mycobacterium
PGGAGGAGGWLLGDGGNGGIG

SEQ ID NO: 1076954 - protein, 24 aa, Mycobacterium
PGGKSPLPPMPIGGPTPASPEPPA

SEQ ID NO: 1076955 - protein, 22 aa, Mycobacterium
PGGLALGILLKNRGFENFNIFD

SEQ ID NO: 1076956 - protein, 26 aa, Mycobacterium
PGGTGFQRLFGPAITYGRNGFLVSPK

SEQ ID NO: 1076957 - protein, 20 aa, Mycobacterium
PGGTVFYFGVADDDAYPISM

SEQ ID NO: 1076958 - protein, 28 aa, Mycobacterium
PGHPVVIARRHWPEILARMTGDHGAAAY

SEQ ID NO: 1076959 - protein, 19 aa, Mycobacterium
PGHRLARPPMVLQHGRLRG

SEQ ID NO: 1076960 - protein, 25 aa, Mycobacterium
PGHSTPGWWDGMVGPGAPIDTNRWC

SEQ ID NO: 1076961 - protein, 19 aa, Mycobacterium
PGHVGAAWRGTWHGGLEFT

SEQ ID NO: 1076962 - protein, 22 aa, Mycobacterium
PGHYAVMFDWSLIDRTDSDLAA

SEQ ID NO: 1076963 - protein, 21 aa, Mycobacterium
PGIDPILKMLLDAVPMTFCAA

SEQ ID NO: 1076964 - protein, 17 aa, Mycobacterium
PGIYFPGRWGARIEDIV

SEQ ID NO: 1076965 - protein, 29 aa, Mycobacterium
PGKNDALDALLWRAARPGEPSWPSPFGPG

SEQ ID NO: 1076966 - protein, 23 aa, Mycobacterium
PGKPWTMQVMLANPDQWAVVTTS

SEQ ID NO: 1076967 - protein, 22 aa, Mycobacterium
PGLFTLVLHTHLPWLAHHGRWP

SEQ ID NO: 1076968 - protein, 18 aa, Mycobacterium
PGLGGWRRPQEELDESSR

SEQ ID NO: 1076969 - protein, 30 aa, Mycobacterium; identical to SEQ ID NO: 785435

SEQ ID NO: 1076970 - protein, 17 aa, Mycobacterium
PGLLIDAPSIMRGAVTG

SEQ ID NO: 1076971 - protein, 19 aa, Mycobacterium
PGLNLIYAHLNRIIRERDA

SEQ ID NO: 1076972 - protein, 19 aa, Mycobacterium
PGLRKLLRDNLAAGRLHFT

SEQ ID NO: 1076973 - protein, 25 aa, Mycobacterium
PGLRVGWFEGGIAWVPWALQDAEHL

SEQ ID NO: 1076974 - protein, 24 aa, Mycobacterium
PGLVHGGFLGVFFDCVIQHHNCVS

SEQ ID NO: 1076975 - protein, 29 aa, Mycobacterium
PGLVMTDGLPWTWETFPEFMDALEAGARD

SEQ ID NO: 1076976 - protein, 19 aa, Mycobacterium
PGMIVGEIALLRNVPRTAT

SEQ ID NO: 1076977 - protein, 25 aa, Mycobacterium
PGMNEIVFPAAILQPPFFDAQADDA

SEQ ID NO: 1076978 - protein, 31 aa, Mycobacterium; identical to SEQ ID NO: 844425

SEQ ID NO: 1076979 - protein, 17 aa, Mycobacterium
PGNPYLQGALGTAAMSI

SEQ ID NO: 1076980 - protein, 26 aa, Mycobacterium
PGPFDAYLTMRGLKTLVLRMQRHSEN

SEQ ID NO: 1076981 - protein, 26 aa, Mycobacterium
PGPGGFLDFPIPIDGLYLGGAGCHGG

SEQ ID NO: 1076982 - protein, 19 aa, Mycobacterium
PGPHLLVLARGPEGYRRLS

SEQ ID NO: 1076983 - protein, 31 aa, Mycobacterium
PGPQDLPAKPVWPVPPPAPVPRAPEAPAAMA

SEQ ID NO: 1076984 - protein, 23 aa, Mycobacterium
PGPQLPLYMLGCEVKAMYPLGPI

SEQ ID NO: 1076985 - protein, 24 aa, Mycobacterium
PGPQNRMISWPYTKLMNSNNMVDQ

SEQ ID NO: 1076986 - protein, 25 aa, Mycobacterium
PGPVPGQSYLYLGDIGDNGLSRSAI

SEQ ID NO: 1076987 - protein, 25 aa, Mycobacterium
PGQAGGAGGLLYGNGGNGAAGTNPG

SEQ ID NO: 1076988 - protein, 26 aa, Mycobacterium
PGQNGADGGLLWGTGGTGDATHPAGG

SEQ ID NO: 1076989 - protein, 23 aa, Mycobacterium
PGQPPILIPLITGQYNNVVSVGL

SEQ ID NO: 1076990 - protein, 31 aa, Mycobacterium; identical to SEQ ID NO: 844493

SEQ ID NO: 1076991 - protein, 41 aa, Mycobacterium; identical to SEQ ID NO: 844506

SEQ ID NO: 1076992 - protein, 25 aa, Mycobacterium
PGRPAMIHVDVYRLLDHGSADLLGE

SEQ ID NO: 1076993 - protein, 18 aa, Mycobacterium
PGRPIDAFVVRKAAKVHG

SEQ ID NO: 1076994 - protein, 17 aa, Mycobacterium
PGRSLLFVRNVGHLMTN

SEQ ID NO: 1076995 - protein, 32 aa, Mycobacterium; identical to SEQ ID NO: 844536

SEQ ID NO: 1076996 - protein, 21 aa, Mycobacterium
PGSFWSGDTLPLTPGYRLGSE

SEQ ID NO: 1076997 - protein, 28 aa, Mycobacterium
PGSNPTERTAWIAEGLLGYLPAEAQDRL

SEQ ID NO: 1076998 - protein, 26 aa, Mycobacterium
PGSPPFPPLPPVPNPAPGFTAMEPCA

SEQ ID NO: 1076999 - protein, 39 aa, Mycobacterium
PGSVKRFAALLSNAKTIFWNGPMGVFEFPAYATGTRGIA

SEQ ID NO: 1077000 - protein, 17 aa, Mycobacterium
PGTAFAATFTPGERRDA

SEQ ID NO: 1077001 - protein, 25 aa, Mycobacterium
PGTIDRPGVWWQFQRLRAETSPGPS

SEQ ID NO: 1077002 - protein, 26 aa, Mycobacterium
PGTKGLSLFYVPNYLFDPDTGELGPR

SEQ ID NO: 1077003 - protein, 23 aa, Mycobacterium
PGTLAGLVTAPIMTSLNSAFTSL

SEQ ID NO: 1077004 - protein, 18 aa, Mycobacterium
PGTPPDRHWAIRSTQGQP

SEQ ID NO: 1077005 - protein, 17 aa, Mycobacterium
PGVLLAVRRVRERPGLT

SEQ ID NO: 1077006 - protein, 24 aa, Mycobacterium
PGVRLRWPQGTYLAWLDCRDLGIS

SEQ ID NO: 1077007 - protein, 18 aa, Mycobacterium
PGVRQFERLLAKVLRKVT

SEQ ID NO: 1077008 - protein, 20 aa, Mycobacterium
PGYGAFLRVLVDKTPKLTAV

SEQ ID NO: 1077009 - protein, 19 aa, Mycobacterium
PGYLLLSTDVARFPTEPPG

SEQ ID NO: 1077010 - protein, 21 aa, Mycobacterium
PGYPFARQRHWVEPKHMAWAQ

SEQ ID NO: 1077011 - protein, 20 aa, Mycobacterium
PGYPFRCKRVLLGDDFYRAL

SEQ ID NO: 1077012 - protein, 22 aa, Mycobacterium
PGYRALHAKGTLYRGTFTATPE

SEQ ID NO: 1077013 - protein, 39 aa, Mycobacterium
PGYSALGGRQWAAAGLTPLRPWRSALVAALAAASDRALA

SEQ ID NO: 1077014 - protein, 18 aa, Mycobacterium
PHALFAIHRREAPVYWHE

SEQ ID NO: 1077015 - protein, 30 aa, Mycobacterium; identical to SEQ ID NO: 844699

SEQ ID NO: 1077016 - protein, 28 aa, Mycobacterium
PHARTLVDGFGILKPLRYAEMLHPENLP

SEQ ID NO: 1077017 - protein, 27 aa, Mycobacterium
PHENAQFLVFCAAVIRAVHKYAELLRV

SEQ ID NO: 1077018 - protein, 29 aa, Mycobacterium
PHGRANGIFLPHVLRYNASLPTKFMPAPG

SEQ ID NO: 1077019 - protein, 18 aa, Mycobacterium
PHGVRPLSLGRLDRGWVV

SEQ ID NO: 1077020 - protein, 25 aa, Mycobacterium
PHHDDGFYPIPRPRAPLAAATIWAI

SEQ ID NO: 1077021 - protein, 20 aa, Mycobacterium
PHHLIADGGILAHRRTRAGD

SEQ ID NO: 1077022 - protein, 20 aa, Mycobacterium
PHIGARFPLADTPAALRYVA

SEQ ID NO: 1077023 - protein, 17 aa, Mycobacterium
PHLHFQLMDGPSLLEAD

SEQ ID NO: 1077024 - protein, 18 aa, Mycobacterium
PHPGSRYTQIAVLEDGIV

SEQ ID NO: 1077025 - protein, 24 aa, Mycobacterium
PHPPHWLVELLAQRLTTLARYPSI

SEQ ID NO: 1077026 - protein, 42 aa, Mycobacterium
PHQLPDTVFGPRRTVPRLRAGPRPGARFHQAGRRRIRRQTGD

SEQ ID NO: 1077027 - protein, 19 aa, Mycobacterium
PHRDMEIVTWVLEGELTHR

SEQ ID NO: 1077028 - protein, 20 aa, Mycobacterium
PHRVCRYLEDLAGDYHRFYD

SEQ ID NO: 1077029 - protein, 27 aa, Mycobacterium
PHTKPPNFWAWLIGRIKAVDPDVLFLS

SEQ ID NO: 1077030 - protein, 21 aa, Mycobacterium
PHVLQLIMDSLRYWVIEMHVD

SEQ ID NO: 1077031 - protein, 22 aa, Mycobacterium
PHVVPVVFAVDNDLIFTAVDAK

SEQ ID NO: 1077032 - protein, 24 aa, Mycobacterium
PHYDVYPAFAFRFDVKNPAVSITF

SEQ ID NO: 1077033 - protein, 26 aa, Mycobacterium
PIASQRWMWQQIPGAQFARVPGRRGG

SEQ ID NO: 1077034 - protein, 24 aa, Mycobacterium
PIAVKEAVLPFHRFRRADGAAIDS

SEQ ID NO: 1077035 - protein, 20 aa, Mycobacterium
PIAVPWSLPDAYPVHVGEEA

SEQ ID NO: 1077036 - protein, 17 aa, Mycobacterium
PIAVVDQLRFGAADAPD

SEQ ID NO: 1077037 - protein, 17 aa, Mycobacterium
PIDPHHPPPTRIAFMLT

SEQ ID NO: 1077038 - protein, 26 aa, Mycobacterium
PIFEQMLIDDGILLRKYWFSVSDEEQ

SEQ ID NO: 1077039 - protein, 19 aa, Mycobacterium
PIGDKLTRLTTQLLAALDE

SEQ ID NO: 1077040 - protein, 20 aa, Mycobacterium
PIGKRNGWLSGLHATELLGA

SEQ ID NO: 1077041 - protein, 20 aa, Mycobacterium
PIGRLMGSLKDFSASDLGAI

SEQ ID NO: 1077042 - protein, 19 aa, Mycobacterium
PIHPLQVGLDWVSAAAHAA

SEQ ID NO: 1077043 - protein, 17 aa, Mycobacterium
PIHTLQQQALNAMNAPI

SEQ ID NO: 1077044 - protein, 18 aa, Mycobacterium
PIIADAPRMVWALDFQFD

SEQ ID NO: 1077045 - protein, 29 aa, Mycobacterium
PIIAGFPFPLAVEILPAHLPLPAKIRTEF

SEQ ID NO: 1077046 - protein, 19 aa, Mycobacterium
PILEVPRTDLDRMTANHLH

SEQ ID NO: 1077047 - protein, 23 aa, Mycobacterium
PILPYVDRVLYLVDGRFLIGTVE

SEQ ID NO: 1077048 - protein, 17 aa, Mycobacterium
PIPIYVGGLSDIALRRA

SEQ ID NO: 1077049 - protein, 43 aa, Mycobacterium
PIPPAPPAPPAPPLPALKPAPPAPPLPIRPASPPLPPAVCVAV

SEQ ID NO: 1077050 - protein, 18 aa, Mycobacterium
PIPSAEPRRRGFLPRVAA

SEQ ID NO: 1077051 - protein, 18 aa, Mycobacterium
PIPSWLQVVGGRQRILIH

SEQ ID NO: 1077052 - protein, 20 aa, Mycobacterium
PIPTSSWPQLLGRLTEGKHL

SEQ ID NO: 1077053 - protein, 19 aa, Mycobacterium
PIRAQLAGALRGFFAIGAA

SEQ ID NO: 1077054 - protein, 24 aa, Mycobacterium
PISPKMVDALRPMMRLVVTNGTAK

SEQ ID NO: 1077055 - protein, 30 aa, Mycobacterium
PISRNPYAAFFVFSLGWPTSEVPGLYLTAS

SEQ ID NO: 1077056 - protein, 18 aa, Mycobacterium
PIVVLWASQTGTAEELAA

SEQ ID NO: 1077057 - protein, 20 aa, Mycobacterium
PIYEEDFVLALPPGHPMADR

SEQ ID NO: 1077058 - protein, 19 aa, Mycobacterium
PKAFIFVSHIQRLGNGKPN

SEQ ID NO: 1077059 - protein, 32 aa, Mycobacterium; identical to SEQ ID NO: 845060

SEQ ID NO: 1077060 - protein, 30 aa, Mycobacterium; identical to SEQ ID NO: 845064

SEQ ID NO: 1077061 - protein, 20 aa, Mycobacterium
PKAVVINPYFDWANDRPPDH

SEQ ID NO: 1077062 - protein, 26 aa, Mycobacterium
PKDKLDTYVRPLLAISAERVSAGKDP

SEQ ID NO: 1077063 - protein, 26 aa, Mycobacterium
PKEMWDAFAEEYLAPVRPLERIKQRV

SEQ ID NO: 1077064 - protein, 27 aa, Mycobacterium
PKETLGFFCGIGIPITEIWGMSELSCV

SEQ ID NO: 1077065 - protein, 31 aa, Mycobacterium; identical to SEQ ID NO: 845083

SEQ ID NO: 1077066 - protein, 18 aa, Mycobacterium
PKGALLTAAALIASASAT

SEQ ID NO: 1077067 - protein, 22 aa, Mycobacterium
PKGDWLLAVFGYPQAHEDDARR

SEQ ID NO: 1077068 - protein, 23 aa, Mycobacterium
PKGKALLYGPSDTWSRLGAASSP

SEQ ID NO: 1077069 - protein, 22 aa, Mycobacterium
PKGVPYIFHVKHPSWIQRQHDD

SEQ ID NO: 1077070 - protein, 19 aa, Mycobacterium
PKHQGLSLLLVPMDQPAVV

SEQ ID NO: 1077071 - protein, 19 aa, Mycobacterium
PKIRLGRFADGPTYWADGD

SEQ ID NO: 1077072 - protein, 20 aa, Mycobacterium
PKPFALEELLARMRALLRRT

SEQ ID NO: 1077073 - protein, 29 aa, Mycobacterium
PKPISGHPPPPPRPAAFTPPARGATPNRH

SEQ ID NO: 1077074 - protein, 31 aa, Mycobacterium
PKPVLISHRSLANQLLWRRDELGLGVGDAVL

SEQ ID NO: 1077075 - protein, 22 aa, Mycobacterium
PKQLQVVLFDELRMPKTKRTKT

SEQ ID NO: 1077076 - protein, 21 aa, Mycobacterium
PKRSLHYAGAATTLAAAAVTF

SEQ ID NO: 1077077 - protein, 22 aa, Mycobacterium
PKRWLGYPFGAPTLALPEYNNG

SEQ ID NO: 1077078 - protein, 23 aa, Mycobacterium
PKSLPPKWFYDAVGSELFDRITR

SEQ ID NO: 1077079 - protein, 20 aa, Mycobacterium
PKVTRRGGGAALPYKRRLFG

SEQ ID NO: 1077080 - protein, 26 aa, Mycobacterium
PKVTRRGGGAALPYKRRLFGQIVAAA

SEQ ID NO: 1077081 - protein, 24 aa, Mycobacterium
PLAAGLLDWQAIRLGHPARDLAYT

SEQ ID NO: 1077082 - protein, 24 aa, Mycobacterium
PLAELLPSLRRGGVAAVSPIGVLG

SEQ ID NO: 1077083 - protein, 21 aa, Mycobacterium
PLAFERLVALRLIRIDGTQAI

SEQ ID NO: 1077084 - protein, 26 aa, Mycobacterium
PLAGRRLIRFPELAAYPFVVLDRDHT

SEQ ID NO: 1077085 - protein, 29 aa, Mycobacterium
PLARTRIRPHFFPFTEPSAEVDVWFANKK

SEQ ID NO: 1077086 - protein, 22 aa, Mycobacterium
PLASALMRVGIAPTLIGTRGGH

SEQ ID NO: 1077087 - protein, 23 aa, Mycobacterium
PLATTFVDYLLPTATEVPPIEYG

SEQ ID NO: 1077088 - protein, 32 aa, Mycobacterium; identical to SEQ ID NO: 845236

SEQ ID NO: 1077089 - protein, 17 aa, Mycobacterium
PLCYVDPYLPIESFRRR

SEQ ID NO: 1077090 - protein, 25 aa, Mycobacterium
PLDEIPMLLQPGVLSLAWGSVVRQL

SEQ ID NO: 1077091 - protein, 20 aa, Mycobacterium
PLDFFIDGVARTSPARAAYV

SEQ ID NO: 1077092 - protein, 19 aa, Mycobacterium
PLDLTYKEFELLKYLAQHA

SEQ ID NO: 1077093 - protein, 20 aa, Mycobacterium
PLDPLFDVDSVIKVLRGKHS

SEQ ID NO: 1077094 - protein, 26 aa, Mycobacterium
PLDRGRPLWELYLIQGLSGGRVAIMT

SEQ ID NO: 1077095 - protein, 20 aa, Mycobacterium
PLDTRLCHFYRGIGLTIYEG

SEQ ID NO: 1077096 - protein, 21 aa, Mycobacterium
PLDWLVSKFAREVPGVAHALL

SEQ ID NO: 1077097 - protein, 17 aa, Mycobacterium
PLEGIAISFSYTIAPPL

SEQ ID NO: 1077098 - protein, 18 aa, Mycobacterium
PLETVGEVIGWVNRHVGE

SEQ ID NO: 1077099 - protein, 26 aa, Mycobacterium
PLGAVSYWASLFPAVWSFCLALRSRG

SEQ ID NO: 1077100 - protein, 24 aa, Mycobacterium
PLGEIIFDFFDSLISRTRGYASLD

SEQ ID NO: 1077101 - protein, 28 aa, Mycobacterium
PLGGVSLWASLFPAVWSFCLALRSRGLG

SEQ ID NO: 1077102 - protein, 22 aa, Mycobacterium
PLGGWEITYLGPTTYRTTVSME

SEQ ID NO: 1077103 - protein, 20 aa, Mycobacterium
PLGPGTVFVYSGRGSQWAGM

SEQ ID NO: 1077104 - protein, 18 aa, Mycobacterium
PLGPVYQAGTLSGNPVAM

SEQ ID NO: 1077105 - protein, 24 aa, Mycobacterium
PLGQALRIAWWSYVHRVDTDMEAA

SEQ ID NO: 1077106 - protein, 19 aa, Mycobacterium
PLGVTMRLYAPRPEVVAGE

SEQ ID NO: 1077107 - protein, 34 aa, Mycobacterium
PLGVVGQIIPWNFPILMGAWKLAPALAAGNAVVL

SEQ ID NO: 1077108 - protein, 34 aa, Mycobacterium
PLGVVGQIIPWNFPLLMATWKLAPALAAGNAVVL

SEQ ID NO: 1077109 - protein, 25 aa, Mycobacterium
PLHPHTLNMISFQILSWADVKQLEP

SEQ ID NO: 1077110 - protein, 20 aa, Mycobacterium
PLIVNLYTFGAKDFDVHTAL

SEQ ID NO: 1077111 - protein, 17 aa, Mycobacterium
PLLEFYDTEVKTVDAIG

SEQ ID NO: 1077112 - protein, 19 aa, Mycobacterium
PLLVACDLQRPAAVNQLQV

SEQ ID NO: 1077113 - protein, 20 aa, Mycobacterium
PLLVACDLQRPAAVNQLQVV

SEQ ID NO: 1077114 - protein, 20 aa, Mycobacterium
PLMHGIGGTLIRLFGPEHVR

SEQ ID NO: 1077115 - protein, 18 aa, Mycobacterium
PLMPQVHRDIRGLAALGD

SEQ ID NO: 1077116 - protein, 19 aa, Mycobacterium
PLPGLGLLGLANHGTFNQG

SEQ ID NO: 1077117 - protein, 18 aa, Mycobacterium
PLPIEGFPSWLHPQLRAA

SEQ ID NO: 1077118 - protein, 20 aa, Mycobacterium
PLPSAVRIPTQYLIAMMAVG

SEQ ID NO: 1077119 - protein, 19 aa, Mycobacterium
PLPTWTRRELMLSRESVDH

SEQ ID NO: 1077120 - protein, 27 aa, Mycobacterium
PLQAKALWAFNMAPLTLTAVPGFVPWT

SEQ ID NO: 1077121 - protein, 20 aa, Mycobacterium
PLQALEQQLLAAINAPTQTL

SEQ ID NO: 1077122 - protein, 20 aa, Mycobacterium
PLRELLAACRRHRALLVIDE

SEQ ID NO: 1077123 - protein, 18 aa, Mycobacterium
PLRIRLNAASYAALLDGV

SEQ ID NO: 1077124 - protein, 23 aa, Mycobacterium
PLRLVPILGAGLAQRPPARFDEF

SEQ ID NO: 1077125 - protein, 36 aa, Mycobacterium
PLSGDPYRMASQLGMRPWRVQKAQKQARRWSRDKVA

SEQ ID NO: 1077126 - protein, 26 aa, Mycobacterium
PLSGGRVWTWKWPETLSARGWQWCRV

SEQ ID NO: 1077127 - protein, 26 aa, Mycobacterium
PLSGIALNLLPPTAIPHFGDAPASLV

SEQ ID NO: 1077128 - protein, 19 aa, Mycobacterium
PLSGIRVLDLTTFWAGPSC

SEQ ID NO: 1077129 - protein, 18 aa, Mycobacterium
PLTEVYFADTFDELGPLG

SEQ ID NO: 1077130 - protein, 25 aa, Mycobacterium
PLTHAQLRIWLLDRRNAGGPELCAQ

SEQ ID NO: 1077131 - protein, 18 aa, Mycobacterium
PLTSGQLGERMGLSAGLR

SEQ ID NO: 1077132 - protein, 22 aa, Mycobacterium
PLTTILDPSLPLTVTEWDEWGN

SEQ ID NO: 1077133 - protein, 17 aa, Mycobacterium
PLTVAVLLRITEVFGVD

SEQ ID NO: 1077134 - protein, 17 aa, Mycobacterium
PLVDLIWMETDTTVPQT

SEQ ID NO: 1077135 - protein, 21 aa, Mycobacterium
PLVHPPLATDAVSMSAAARLS

SEQ ID NO: 1077136 - protein, 17 aa, Mycobacterium
PLVHTAHTLAAVKNAAL

SEQ ID NO: 1077137 - protein, 26 aa, Mycobacterium
PLVVSPNASPVFLKSGRRPPVATRGT

SEQ ID NO: 1077138 - protein, 19 aa, Mycobacterium
PLWELHVIEGLEGKQFAIY

SEQ ID NO: 1077139 - protein, 17 aa, Mycobacterium
PLYCYLNAGKQSLTLAP

SEQ ID NO: 1077140 - protein, 46 aa, Mycobacterium
PLYEERYVLLAPPEMLPPGVSTLSWLDAAQLPLALLSSDMRDRQII

SEQ ID NO: 1077141 - protein, 17 aa, Mycobacterium
PLYVRQVLRLRPAPEFE

SEQ ID NO: 1077142 - protein, 27 aa, Mycobacterium
PMAFVRFRIDGKDWPASPLPSLRMRTT

SEQ ID NO: 1077143 - protein, 24 aa, Mycobacterium
PMARFVQTFVRVLGDPALPHLFFV

SEQ ID NO: 1077144 - protein, 17 aa, Mycobacterium
PMATGVLVIGIERATKI

SEQ ID NO: 1077145 - protein, 29 aa, Mycobacterium
PMDCAEVLDWPAKLRLLEGFRQRENLNWS

SEQ ID NO: 1077146 - protein, 21 aa, Mycobacterium
PMDDDPRWRLLDPGELVHVDV

SEQ ID NO: 1077147 - protein, 25 aa, Mycobacterium
PMDGGWPAPFDTDLPARRGLALQLV

SEQ ID NO: 1077148 - protein, 27 aa, Mycobacterium
PMEIVGRFLALLELYRSRAVAFDQSEP

SEQ ID NO: 1077149 - protein, 17 aa, Mycobacterium
PMGFISTRYYVSINVAD

SEQ ID NO: 1077150 - protein, 26 aa, Mycobacterium
PMGPSPYLPTSRRFFNPIYLRVEAIP

SEQ ID NO: 1077151 - protein, 23 aa, Mycobacterium
PMGRYPVLFLDPDFNEDIRLALV

SEQ ID NO: 1077152 - protein, 22 aa, Mycobacterium
PMHLVSPWLDLTARPVQEVAAA

SEQ ID NO: 1077153 - protein, 17 aa, Mycobacterium
PMHWDLPEWERDRVRAV

SEQ ID NO: 1077154 - protein, 24 aa, Mycobacterium
PMIDMPRYLDYLTTRLAAAGCEIE

SEQ ID NO: 1077155 - protein, 21 aa, Mycobacterium
PMIMRDTIFCAIPEDADRDAI

SEQ ID NO: 1077156 - protein, 26 aa, Mycobacterium
PMINNEFIRHWLADLVAETGSGPGAG

SEQ ID NO: 1077157 - protein, 18 aa, Mycobacterium
PMNVMGFAVKTADDYQLA

SEQ ID NO: 1077158 - protein, 18 aa, Mycobacterium
PMPDWLGNALSATPGLSA

SEQ ID NO: 1077159 - protein, 35 aa, Mycobacterium
PMPEGRGLFFRTLYPALWRFPPIKPFRGAYVLLEF

SEQ ID NO: 1077160 - protein, 20 aa, Mycobacterium
PMPGVEWRRILDVAQVVREV

SEQ ID NO: 1077161 - protein, 25 aa, Mycobacterium
PMQYAILHHNFFVERLIPAGTTHRP

SEQ ID NO: 1077162 - protein, 20 aa, Mycobacterium
PMREDMCIMLAARKVPGALK

SEQ ID NO: 1077163 - protein, 28 aa, Mycobacterium
PMSTYLYTISMMHCMTVSLALDGVGLGT

SEQ ID NO: 1077164 - protein, 19 aa, Mycobacterium
PMTPFERKIVHDAVAAVPG

SEQ ID NO: 1077165 - protein, 24 aa, Mycobacterium
PNAHILPVPMMNILNGGAHADTGV

SEQ ID NO: 1077166 - protein, 27 aa, Mycobacterium
PNAIPLVLTRRTVWASSYMVADRLIAA

SEQ ID NO: 1077167 - protein, 22 aa, Mycobacterium
PNAPKHNGITYFLLDMKTEGVQ

SEQ ID NO: 1077168 - protein, 20 aa, Mycobacterium
PNAYRFGTVGWPFPATEAKI

SEQ ID NO: 1077169 - protein, 22 aa, Mycobacterium
PNDIDPEWAFQDLGFDSVKATE

SEQ ID NO: 1077170 - protein, 22 aa, Mycobacterium
PNEVRDFVRRGAGWLAHAHETQ

SEQ ID NO: 1077171 - protein, 25 aa, Mycobacterium
PNFARRLPMLRGWVADLLDRDARDR

SEQ ID NO: 1077172 - protein, 21 aa, Mycobacterium
PNGSHLVDYPPMLLARDGRDD

SEQ ID NO: 1077173 - protein, 18 aa, Mycobacterium
PNHFSHMRAFPSADFRAV

SEQ ID NO: 1077174 - protein, 17 aa, Mycobacterium
PNIAFAQDPLLPFGPAQ

SEQ ID NO: 1077175 - protein, 19 aa, Mycobacterium
PNIKRDAMFPPKAFDALGE

SEQ ID NO: 1077176 - protein, 20 aa, Mycobacterium
PNKLLLDPYSKAIEGTFAWN

SEQ ID NO: 1077177 - protein, 25 aa, Mycobacterium
PNLARLYEPMWLRETNRHRGAAVAL

SEQ ID NO: 1077178 - protein, 25 aa, Mycobacterium
PNLYPLGDPPYYAFRIVLGDLGTSG

SEQ ID NO: 1077179 - protein, 22 aa, Mycobacterium
PNNDWTHFFAEQWELQDYFAKA

SEQ ID NO: 1077180 - protein, 25 aa, Mycobacterium
PNPAPSTLLLALMSGFERRGRWNVP

SEQ ID NO: 1077181 - protein, 18 aa, Mycobacterium
PNPPFPPLPHKIPPAPPA

SEQ ID NO: 1077182 - protein, 23 aa, Mycobacterium
PNPTDMPVVPFAGSPQLPGNTLA

SEQ ID NO: 1077183 - protein, 19 aa, Mycobacterium
PNRCTGCAPCWWNWSGFTT

SEQ ID NO: 1077184 - protein, 27 aa, Mycobacterium
PNRTARIALLHYLDGEKRYIIAPNGLS

SEQ ID NO: 1077185 - protein, 36 aa, Mycobacterium
PNSHPGLPPSPPAPPAPPAVPTPPAPPPPPCPKSSA

SEQ ID NO: 1077186 - protein, 18 aa, Mycobacterium
PNSKTVFMVLRDPAADMS

SEQ ID NO: 1077187 - protein, 31 aa, Mycobacterium
PNSLADLNLPAWGSLRLALPMNGNSDATFLA

SEQ ID NO: 1077188 - protein, 26 aa, Mycobacterium
PNVGLMQPWRFIRITDTGLRRRIHTL

SEQ ID NO: 1077189 - protein, 20 aa, Mycobacterium
PNVRDLPPLPKWPDPLDQMR

SEQ ID NO: 1077190 - protein, 20 aa, Mycobacterium
PNVVRLAPPLVITEPQLEGF

SEQ ID NO: 1077191 - protein, 26 aa, Mycobacterium
PPAEMAATGAMPRLPVVPAARAAGVA

SEQ ID NO: 1077192 - protein, 20 aa, Mycobacterium
PPALTTPAAMALLIASGFQI

SEQ ID NO: 1077193 - protein, 18 aa, Mycobacterium
PPAPWLPESAVGQASLVL

SEQ ID NO: 1077194 - protein, 20 aa, Mycobacterium
PPATYPAAMAARPAPVATAG

SEQ ID NO: 1077195 - protein, 27 aa, Mycobacterium
PPDAELTERPDLFPAWDSLSEAQQKLF

SEQ ID NO: 1077196 - protein, 24 aa, Mycobacterium
PPDCTPWVIGGLWPTELSRDAPET

SEQ ID NO: 1077197 - protein, 18 aa, Mycobacterium
PPDPLAPLGVPPVGGPPA

SEQ ID NO: 1077198 - protein, 20 aa, Mycobacterium
PPEAHGEVFPFVFTAARLTE

SEQ ID NO: 1077199 - protein, 28 aa, Mycobacterium
PPEDELAFLHPLPVRRLWEVGAKTAAKL

SEQ ID NO: 1077200 - protein, 21 aa, Mycobacterium
PPELLYVGRLEYEKGVHNAIA

SEQ ID NO: 1077201 - protein, 20 aa, Mycobacterium
PPENQLLLQAALCASRFVVV

SEQ ID NO: 1077202 - protein, 18 aa, Mycobacterium
PPFPPFTFETATQKVQAA

SEQ ID NO: 1077203 - protein, 21 aa, Mycobacterium
PPGPPWPPWAPAPPLMPLMTP

SEQ ID NO: 1077204 - protein, 17 aa, Mycobacterium
PPGRPEGRPWTYTPPVT

SEQ ID NO: 1077205 - protein, 24 aa, Mycobacterium
PPGSAGLVLVPYLEGERTPNRPKA

SEQ ID NO: 1077206 - protein, 17 aa, Mycobacterium
PPGVRRPAGTPDGVPVT

SEQ ID NO: 1077207 - protein, 21 aa, Mycobacterium
PPHNLRELAEAVFWCLENHDA

SEQ ID NO: 1077208 - protein, 20 aa, Mycobacterium
PPHRTPWHRPTHLSDVPWNS

SEQ ID NO: 1077209 - protein, 27 aa, Mycobacterium
PPIVATPFGLWPEVSPLTIADALAAGT

SEQ ID NO: 1077210 - protein, 21 aa, Mycobacterium
PPLPHGLLITHVNLGLDALQL

SEQ ID NO: 1077211 - protein, 19 aa, Mycobacterium
PPLPPLLISIAPPPSPPSP

SEQ ID NO: 1077212 - protein, 19 aa, Mycobacterium
PPLSGGMVGFFAYDMVRRL

SEQ ID NO: 1077213 - protein, 20 aa, Mycobacterium
PPPAALTGEWFGALAVIAPS

SEQ ID NO: 1077214 - protein, 26 aa, Mycobacterium
PPPAPMPFGLMPPPPAPAAPPPPDPL

SEQ ID NO: 1077215 - protein, 23 aa, Mycobacterium
PPPLPDTPPVSALPDTPPLGAPA

SEQ ID NO: 1077216 - protein, 30 aa, Mycobacterium
PPPTTAPPAAPLIPPLTVPATGAGFTHVPD

SEQ ID NO: 1077217 - protein, 27 aa, Mycobacterium
PPQPAQGWMFAAMPLSFLGLNDNSLYT

SEQ ID NO: 1077218 - protein, 17 aa, Mycobacterium
PPRAGEVLLQLSATGLC

SEQ ID NO: 1077219 - protein, 19 aa, Mycobacterium
PPRCTSYFPKFRALCMAEN

SEQ ID NO: 1077220 - protein, 20 aa, Mycobacterium
PPRMPNLPVSRRRVLVFSGD

SEQ ID NO: 1077221 - protein, 20 aa, Mycobacterium
PPRSVSHLPQWARRWQRLLF

SEQ ID NO: 1077222 - protein, 17 aa, Mycobacterium
PPRTSTWVLGPLRRDVS

SEQ ID NO: 1077223 - protein, 17 aa, Mycobacterium
PPSALWGREAYARGLFG

SEQ ID NO: 1077224 - protein, 18 aa, Mycobacterium
PPSILLTGVIVNKLGRRF

SEQ ID NO: 1077225 - protein, 29 aa, Mycobacterium
PPSPKWPVLPWLPIWEPVPKDPPVPPVPG

SEQ ID NO: 1077226 - protein, 25 aa, Mycobacterium
PPTDTRAYFRGECLRRFGADIAAAS

SEQ ID NO: 1077227 - protein, 24 aa, Mycobacterium
PPTEGWRRLVYVLSGQLVNLGESP

SEQ ID NO: 1077228 - protein, 37 aa, Mycobacterium
PPVPGKFYWMTPTQVRWRPFQFWPANTAVNIDAAGTK

SEQ ID NO: 1077229 - protein, 29 aa, Mycobacterium
PPVQLDKKWLKPTAYMMAKFGMTLCALGI

SEQ ID NO: 1077230 - protein, 27 aa, Mycobacterium
PPVVRTPMEPPARLGGPIAGGPVPPGS

SEQ ID NO: 1077231 - protein, 19 aa, Mycobacterium
PPYQGAIYLTFTLPVDAHA

SEQ ID NO: 1077232 - protein, 24 aa, Mycobacterium
PPYVAVPYLDRMDLAYAAADLVIC

SEQ ID NO: 1077233 - protein, 23 aa, Mycobacterium
PQAPMGLIPGWGKLMSKILSAFF

SEQ ID NO: 1077234 - protein, 19 aa, Mycobacterium
PQAWIEQMKRIGIYGLAIG

SEQ ID NO: 1077235 - protein, 21 aa, Mycobacterium
PQDMRLFWGAHAGSPPACWRP

SEQ ID NO: 1077236 - protein, 22 aa, Mycobacterium
PQEEWAGRLRRLIAEQASVILR

SEQ ID NO: 1077237 - protein, 18 aa, Mycobacterium
PQELARAVGRIVIWPNTP

SEQ ID NO: 1077238 - protein, 24 aa, Mycobacterium
PQESFNFRRSLIYVNPKGPNDNPD

SEQ ID NO: 1077239 - protein, 29 aa, Mycobacterium
PQFAQQALHAFRKFGFQLVIVATVQNATT

SEQ ID NO: 1077240 - protein, 22 aa, Mycobacterium
PQFEVRGFATLPAGPQGHPVLL

SEQ ID NO: 1077241 - protein, 17 aa, Mycobacterium
PQGFSTELLLRAYRHAG

SEQ ID NO: 1077242 - protein, 19 aa, Mycobacterium
PQGHGVPIAWSVDHDPRLS

SEQ ID NO: 1077243 - protein, 21 aa, Mycobacterium
PQGRAVFWFHGTPGARRQIPT

SEQ ID NO: 1077244 - protein, 27 aa, Mycobacterium
PQHGGPQFGLILALMTQGLAISDYPDM

SEQ ID NO: 1077245 - protein, 24 aa, Mycobacterium
PQIDKPKVLILGSGPNRIGQGIEF

SEQ ID NO: 1077246 - protein, 24 aa, Mycobacterium
PQIDWSKVHLFWGDDRYVPEDDDE

SEQ ID NO: 1077247 - protein, 23 aa, Mycobacterium
PQIERGWRHYLLSTAGRSYLDMV

SEQ ID NO: 1077248 - protein, 25 aa, Mycobacterium
PQIREFEPNWLVWTHGCPGGESVQQ

SEQ ID NO: 1077249 - protein, 24 aa, Mycobacterium
PQLFKQLLMVAGMERYYQIARCYR

SEQ ID NO: 1077250 - protein, 28 aa, Mycobacterium
PQLSTITPRWLLHLLNWVPVEAGVYRVN

SEQ ID NO: 1077251 - protein, 33 aa, Mycobacterium; identical to SEQ ID NO: 846251

SEQ ID NO: 1077252 - protein, 20 aa, Mycobacterium
PQPLALLPEPNPGDLFFDFE

SEQ ID NO: 1077253 - protein, 24 aa, Mycobacterium
PQRITLTLPAIQRSREVWLMVSGG

SEQ ID NO: 1077254 - protein, 29 aa, Mycobacterium
PQRRPGWYGNITVLQWLSPLPGGSVVKVE

SEQ ID NO: 1077255 - protein, 24 aa, Mycobacterium
PQRTISVPTLYALGALGSLRARLT

SEQ ID NO: 1077256 - protein, 22 aa, Mycobacterium
PQSRRSWAVLGEMAELGADAIT

SEQ ID NO: 1077257 - protein, 23 aa, Mycobacterium
PQVAAPLAAYVPAVRTGNLIYTA

SEQ ID NO: 1077258 - protein, 19 aa, Mycobacterium
PQVDLWTFGDTGRSIIVLS

SEQ ID NO: 1077259 - protein, 19 aa, Mycobacterium
PQVHLAARPGVLTAAALAD

SEQ ID NO: 1077260 - protein, 24 aa, Mycobacterium
PQVPVFALGRYAGARRYAILALKE

SEQ ID NO: 1077261 - protein, 19 aa, Mycobacterium
PRAAFKPSYGIAEATLLVA

SEQ ID NO: 1077262 - protein, 36 aa, Mycobacterium; identical to SEQ ID NO: 846353

SEQ ID NO: 1077263 - protein, 20 aa, Mycobacterium
PRAVHVVPAGWLPKTSSGKL

SEQ ID NO: 1077264 - protein, 27 aa, Mycobacterium
PRCTVADPTLFSHRRGAPTGRLASLVW

SEQ ID NO: 1077265 - protein, 23 aa, Mycobacterium
PRDARLGSVAKLLPGLEGKIADD

SEQ ID NO: 1077266 - protein, 25 aa, Mycobacterium
PRDLCALWPVPATSVPHAASPAAPG

SEQ ID NO: 1077267 - protein, 33 aa, Mycobacterium
PRDLGEPYAVKRFTQTLAIRTDAPGIGGDGGVG

SEQ ID NO: 1077268 - protein, 24 aa, Mycobacterium
PREDLDLFRRLSFDLISIPTDIVA

SEQ ID NO: 1077269 - protein, 17 aa, Mycobacterium
PRERFSTLKARLGDAFE

SEQ ID NO: 1077270 - protein, 24 aa, Mycobacterium
PREVVHLALRTLLAEAGEKGGGDD

SEQ ID NO: 1077271 - protein, 19 aa, Mycobacterium
PREWRRRKPYSWLRQVLPD

SEQ ID NO: 1077272 - protein, 19 aa, Mycobacterium
PRFSTRAESRWFAGAGFSL

SEQ ID NO: 1077273 - protein, 23 aa, Mycobacterium
PRFYRPPPRPDVIATLDSAGLLP

SEQ ID NO: 1077274 - protein, 25 aa, Mycobacterium
PRGGTLQLLRPLFSAGLGGRLGDGR

SEQ ID NO: 1077275 - protein, 33 aa, Mycobacterium
PRGRLEWLLLADGMPIAWRGKLLTGEPWPRITG

SEQ ID NO: 1077276 - protein, 20 aa, Mycobacterium
PRGVGASRPAIALAGDEHVA

SEQ ID NO: 1077277 - protein, 17 aa, Mycobacterium
PRHRGISLLSGTRRGQE

SEQ ID NO: 1077278 - protein, 24 aa, Mycobacterium
PRIAGMGFDVVYLPPIHPIGKVHR

SEQ ID NO: 1077279 - protein, 18 aa, Mycobacterium
PRIALMAKALNTLGPRWV

SEQ ID NO: 1077280 - protein, 20 aa, Mycobacterium
PRIFRLIRGQVAIASTPGKV

SEQ ID NO: 1077281 - protein, 23 aa, Mycobacterium
PRIKTRLAKLIPAPTRDIPVLIG

SEQ ID NO: 1077282 - protein, 21 aa, Mycobacterium
PRIVSLPGYPFARQRHWVEPK

SEQ ID NO: 1077283 - protein, 27 aa, Mycobacterium
PRLAPARALTPPPTPHWRLITSGSGDL

SEQ ID NO: 1077284 - protein, 28 aa, Mycobacterium
PRLITDACEILLILKDNLAGRHRELVEH

SEQ ID NO: 1077285 - protein, 25 aa, Mycobacterium
PRLNRSVISALWWVHWRVTKNPEEA

SEQ ID NO: 1077286 - protein, 17 aa, Mycobacterium
PRLNWAIGRQSEGTVLV

SEQ ID NO: 1077287 - protein, 20 aa, Mycobacterium
PRNPYLEGFLAPVRAEVTAT

SEQ ID NO: 1077288 - protein, 24 aa, Mycobacterium
PRPGKTVLFLGRYDEPRKGMSVLL

SEQ ID NO: 1077289 - protein, 26 aa, Mycobacterium
PRQEDLINRWTWIPFGAGRHRCVGAA

SEQ ID NO: 1077290 - protein, 21 aa, Mycobacterium
PRQRHRWLLEQVSFIAAIEHY

SEQ ID NO: 1077291 - protein, 24 aa, Mycobacterium
PRQRLALELAWELFEDARIVAESV

SEQ ID NO: 1077292 - protein, 20 aa, Mycobacterium
PRRFDMTVLLNSVNLRRVQI

SEQ ID NO: 1077293 - protein, 23 aa, Mycobacterium
PRRFDMTVLLNSVNLRRVQIEVS

SEQ ID NO: 1077294 - protein, 23 aa, Mycobacterium
PRRRRIRATWRRVCLINGVSGVF

SEQ ID NO: 1077295 - protein, 18 aa, Mycobacterium
PRRSGPVVWVKDASRSVP

SEQ ID NO: 1077296 - protein, 18 aa, Mycobacterium
PRRVAGRRRSWSGPGPDT

SEQ ID NO: 1077297 - protein, 20 aa, Mycobacterium
PRRVFTYLHAARPVLLNLAE

SEQ ID NO: 1077298 - protein, 27 aa, Mycobacterium
PRSNYAKSLRMFAVLPTIVAADMRRRR

SEQ ID NO: 1077299 - protein, 21 aa, Mycobacterium
PRVLQIRALVLGCAMDWLADN

SEQ ID NO: 1077300 - protein, 24 aa, Mycobacterium
PRVLQIRALVLGCAMDWLADNQAS

SEQ ID NO: 1077301 - protein, 24 aa, Mycobacterium
PRVNRPIVDFSLTHSYVAAPVMPT

SEQ ID NO: 1077302 - protein, 17 aa, Mycobacterium
PRWSKLADMFTPDGPEA

SEQ ID NO: 1077303 - protein, 31 aa, Mycobacterium; identical to SEQ ID NO: 846646

SEQ ID NO: 1077304 - protein, 26 aa, Mycobacterium
PRYLADLRNFCRRHEVLLIFDEIATG

SEQ ID NO: 1077305 - protein, 25 aa, Mycobacterium
PRYLHMLADYQLLAREQLICATHVH

SEQ ID NO: 1077306 - protein, 23 aa, Mycobacterium
PSAGFFILGPTMAQSLYAEGNEE

SEQ ID NO: 1077307 - protein, 17 aa, Mycobacterium
PSALIKSIGLRLGLPWY

SEQ ID NO: 1077308 - protein, 27 aa, Mycobacterium
PSAPAAPLPNWPYPPAPPEAAPPPAPP

SEQ ID NO: 1077309 - protein, 21 aa, Mycobacterium
PSAPVPPFPPTPPSPTRPPSP

SEQ ID NO: 1077310 - protein, 26 aa, Mycobacterium
PSARNRVMFGPPGRLYTYRSHGIHVC

SEQ ID NO: 1077311 - protein, 26 aa, Mycobacterium
PSASFGTLWIKSPANMLGYWSNPQRT

SEQ ID NO: 1077312 - protein, 22 aa, Mycobacterium
PSASLMIRMRRLSDRFVRVKNT

SEQ ID NO: 1077313 - protein, 31 aa, Mycobacterium; identical to SEQ ID NO: 846686

SEQ ID NO: 1077314 - protein, 23 aa, Mycobacterium
PSAVARFCRICGALAAELINCCG

SEQ ID NO: 1077315 - protein, 22 aa, Mycobacterium
PSAWSVEGLLPYLTADAQDALF

SEQ ID NO: 1077316 - protein, 20 aa, Mycobacterium
PSCRFWNLVVWNQFMATCGA

SEQ ID NO: 1077317 - protein, 24 aa, Mycobacterium
PSEVTPLTSLLLAQGLAESGLPDG

SEQ ID NO: 1077318 - protein, 36 aa, Mycobacterium; identical to SEQ ID NO: 846742

SEQ ID NO: 1077319 - protein, 24 aa, Mycobacterium
PSGLQQILQSLPNLGLGNKGNANL

SEQ ID NO: 1077320 - protein, 26 aa, Mycobacterium
PSGNVEYFLWLRAQTDRPLSDDTLSD

SEQ ID NO: 1077321 - protein, 24 aa, Mycobacterium
PSGPVHLVALPRFPEPGSAVEQGS

SEQ ID NO: 1077322 - protein, 22 aa, Mycobacterium
PSHLQLVLHKLYDAGATVTQTD

SEQ ID NO: 1077323 - protein, 27 aa, Mycobacterium
PSIDGEVLLNWMLLAATASSVNGDAVT

SEQ ID NO: 1077324 - protein, 22 aa, Mycobacterium
PSLHVGHLVPLLVLRRFQRAGH

SEQ ID NO: 1077325 - protein, 20 aa, Mycobacterium
PSLLFSILHFRDTCNPIPPT

SEQ ID NO: 1077326 - protein, 20 aa, Mycobacterium
PSLRKTVTAVLPHAKVLRGL

SEQ ID NO: 1077327 - protein, 19 aa, Mycobacterium
PSMAISTPSRELLTMSWIS

SEQ ID NO: 1077328 - protein, 17 aa, Mycobacterium
PSMLWSMTVDLEWPGSL

SEQ ID NO: 1077329 - protein, 24 aa, Mycobacterium
PSNRLPYAWNPAYPARIGVMPREG

SEQ ID NO: 1077330 - protein, 26 aa, Mycobacterium
PSPFHLCATVARRLLNAGYTELSEID

SEQ ID NO: 1077331 - protein, 17 aa, Mycobacterium
PSPVTFGPFLVVALEHD

SEQ ID NO: 1077332 - protein, 32 aa, Mycobacterium; identical to SEQ ID NO: 221440

SEQ ID NO: 1077333 - protein, 31 aa, Mycobacterium
PSQPCVWSPPPTPPCTPVCVLLMVFEAPTIT

SEQ ID NO: 1077334 - protein, 25 aa, Mycobacterium
PSQRPLLLVFADSLSYYGPTGGLPA

SEQ ID NO: 1077335 - protein, 26 aa, Mycobacterium
PSRDIPRFVSLWQSGRLPVESLVSAT

SEQ ID NO: 1077336 - protein, 17 aa, Mycobacterium
PSRIVLTPLISDFLARG

SEQ ID NO: 1077337 - protein, 21 aa, Mycobacterium
PSRLLALQNAFVARHRGRRVH

SEQ ID NO: 1077338 - protein, 19 aa, Mycobacterium
PSRQAYTLSLFASLAMSDV

SEQ ID NO: 1077339 - protein, 24 aa, Mycobacterium
PSSAPIHDLPLDDLGIPGVSVDID

SEQ ID NO: 1077340 - protein, 26 aa, Mycobacterium
PSSFIDYFDSLIGWERYRASQFGIAH

SEQ ID NO: 1077341 - protein, 32 aa, Mycobacterium; identical to SEQ ID NO: 785505

SEQ ID NO: 1077342 - protein, 25 aa, Mycobacterium
PSTARSLVLLFEALFDPRPAGSPVS

SEQ ID NO: 1077343 - protein, 23 aa, Mycobacterium
PSTHTIFVLGRPVTAGAFGAVAK

SEQ ID NO: 1077344 - protein, 25 aa, Mycobacterium
PSTVADMMLYLAWSMAGRGAQEGRT

SEQ ID NO: 1077345 - protein, 25 aa, Mycobacterium
PSVAKLLPYVLYETLGPTLPDGMAG

SEQ ID NO: 1077346 - protein, 18 aa, Mycobacterium
PSVLFTGAETPDPTFDHG

SEQ ID NO: 1077347 - protein, 19 aa, Mycobacterium
PSVPLRLAELFVEAGLPPG

SEQ ID NO: 1077348 - protein, 19 aa, Mycobacterium
PTAAPGAAAARRAPEVRPD

SEQ ID NO: 1077349 - protein, 18 aa, Mycobacterium
PTAARLLYELFAQTSAAG

SEQ ID NO: 1077350 - protein, 20 aa, Mycobacterium
PTADFNVTLLAGATLGGGPT

SEQ ID NO: 1077351 - protein, 24 aa, Mycobacterium
PTAQLMNIPIDLRQDWPAALLDSG

SEQ ID NO: 1077352 - protein, 33 aa, Mycobacterium
PTDEQFRIAYLFSQKVFGFAPYPAVLPGQPARV

SEQ ID NO: 1077353 - protein, 28 aa, Mycobacterium
PTDPNGEPFWFPNWTRLVYAGDGLFCSE

SEQ ID NO: 1077354 - protein, 23 aa, Mycobacterium
PTDQLLKVPAGSGPVLVIAPSTA

SEQ ID NO: 1077355 - protein, 31 aa, Mycobacterium
PTDTSYEPKTGWFRSRMLSRRRPGQVEQPQQ

SEQ ID NO: 1077356 - protein, 23 aa, Mycobacterium
PTELTSRLFTLEWEPKPLDQTAA

SEQ ID NO: 1077357 - protein, 18 aa, Mycobacterium
PTFADVPAGWRVAFGADT

SEQ ID NO: 1077358 - protein, 18 aa, Mycobacterium
PTGALKFELQIESPQAVI

SEQ ID NO: 1077359 - protein, 24 aa, Mycobacterium
PTGDAELLIIGWGSSYGPIGEACR

SEQ ID NO: 1077360 - protein, 26 aa, Mycobacterium
PTGGRRLFVFLGSTIGNLTPGPRAEF

SEQ ID NO: 1077361 - protein, 22 aa, Mycobacterium
PTGPTRAAVAIQPATGTTGTAR

SEQ ID NO: 1077362 - protein, 25 aa, Mycobacterium
PTGQPGIPPLPMPYPRTGQGGEPRL

SEQ ID NO: 1077363 - protein, 27 aa, Mycobacterium
PTGQRLRLLESLDLFGVAIAIEALRRG

SEQ ID NO: 1077364 - protein, 29 aa, Mycobacterium
PTGSGKTLAAFLWALDSLARCPDRTAGTR

SEQ ID NO: 1077365 - protein, 18 aa, Mycobacterium
PTGYIRDTFEHLGIPEAA

SEQ ID NO: 1077366 - protein, 22 aa, Mycobacterium
PTGYLPGGLFSLAKLLVIRGEK

SEQ ID NO: 1077367 - protein, 34 aa, Mycobacterium; identical to SEQ ID NO: 847074

SEQ ID NO: 1077368 - protein, 19 aa, Mycobacterium
PTIADLLKPLGYATGQFGK

SEQ ID NO: 1077369 - protein, 25 aa, Mycobacterium
PTLDYVVVKAPRFAFEKFPGADATL

SEQ ID NO: 1077370 - protein, 28 aa, Mycobacterium
PTLGEFFTALRERRILGVRGSDGRVHVP

SEQ ID NO: 1077371 - protein, 30 aa, Mycobacterium
PTLLRKGERLLVFLPLAHVLARSLSMSAFA

SEQ ID NO: 1077372 - protein, 28 aa, Mycobacterium
PTLPTLATVARRLPALFSAFRTVRKGPG

SEQ ID NO: 1077373 - protein, 17 aa, Mycobacterium
PTLSMLRAHVTRRLDAM

SEQ ID NO: 1077374 - protein, 26 aa, Mycobacterium
PTMYVNQPWTIRQYAGFSTAADSNAF

SEQ ID NO: 1077375 - protein, 25 aa, Mycobacterium
PTNLGRLVLNTPAPLPCTPRGIVHL

SEQ ID NO: 1077376 - protein, 25 aa, Mycobacterium
PTPAANSIAWLIWHSARVQDVQVAD

SEQ ID NO: 1077377 - protein, 29 aa, Mycobacterium
PTPDMRLDMPLVDFFSRGGALKSSWYGDC

SEQ ID NO: 1077378 - protein, 23 aa, Mycobacterium
PTPLLDFIAPKVAGLSFSGLLGA

SEQ ID NO: 1077379 - protein, 18 aa, Mycobacterium
PTPMCRRGLPSMPPRRCV

SEQ ID NO: 1077380 - protein, 24 aa, Mycobacterium
PTQLESFLLSPEQINTIVGTTGIV

SEQ ID NO: 1077381 - protein, 25 aa, Mycobacterium
PTQVESMILPPIAHEVRVISIAQFT

SEQ ID NO: 1077382 - protein, 22 aa, Mycobacterium
PTRPHPLFAAFVKAAIDYKEGE

SEQ ID NO: 1077383 - protein, 22 aa, Mycobacterium
PTRPHPLFVAFVGAAIDYKSAE

SEQ ID NO: 1077384 - protein, 28 aa, Mycobacterium
PTRRVRMMRWGFVPSWAKPGPQGAPEGK

SEQ ID NO: 1077385 - protein, 28 aa, Mycobacterium
PTSEQLSMWIWRELATLLPMMMSAVSVS

SEQ ID NO: 1077386 - protein, 24 aa, Mycobacterium
PTSSGWRMLSGDETGWLLGDYILS

SEQ ID NO: 1077387 - protein, 18 aa, Mycobacterium
PTSTYVFQKLACEYFAHG

SEQ ID NO: 1077388 - protein, 20 aa, Mycobacterium
PTSVMGLWTFDGHKGQTEVT

SEQ ID NO: 1077389 - protein, 21 aa, Mycobacterium
PTTFRTMPYWESVEPFPLPQE

SEQ ID NO: 1077390 - protein, 25 aa, Mycobacterium
PTTQGLFTLFDPFGKVIERLPIQTH

SEQ ID NO: 1077391 - protein, 29 aa, Mycobacterium
PTTTADLNLSFPISLPISIDIGKIVIESF

SEQ ID NO: 1077392 - protein, 27 aa, Mycobacterium
PTTVVAAPTPFVWIIGRTQTNGPADYP

SEQ ID NO: 1077393 - protein, 24 aa, Mycobacterium
PTVYFTTPHFDGYPAVLVVLSEIE

SEQ ID NO: 1077394 - protein, 22 aa, Mycobacterium
PTYLYRYDYAPRTLRWSGFGAT

SEQ ID NO: 1077395 - protein, 27 aa, Mycobacterium
PVAAEIARLALFLTTPAARHITGQTLH

SEQ ID NO: 1077396 - protein, 26 aa, Mycobacterium
PVAAGEPLFTLYTDTPERFGAAVAEL

SEQ ID NO: 1077397 - protein, 28 aa, Mycobacterium
PVAMESRARLFPRGLAAFIELRDQRCRT

SEQ ID NO: 1077398 - protein, 30 aa, Mycobacterium; identical to SEQ ID NO: 847323

SEQ ID NO: 1077399 - protein, 30 aa, Mycobacterium
PVAVRSHLAPFLPGHPFAPGLPQGDPVSAA

SEQ ID NO: 1077400 - protein, 20 aa, Mycobacterium
PVAWIHATALRTEPLAYSGR

SEQ ID NO: 1077401 - protein, 17 aa, Mycobacterium
PVAYHTFGGWKRSGFGD

SEQ ID NO: 1077402 - protein, 17 aa, Mycobacterium
PVCGSAVDRQRHRLVEQ

SEQ ID NO: 1077403 - protein, 26 aa, Mycobacterium
PVDDPPWHPLPFRAVFDAPLCGEIRR

SEQ ID NO: 1077404 - protein, 23 aa, Mycobacterium
PVDFGSFLIPRTEYRIDDVWHVV

SEQ ID NO: 1077405 - protein, 27 aa, Mycobacterium
PVDRTTLFRLALIATARLTTSGSGVDV

SEQ ID NO: 1077406 - protein, 17 aa, Mycobacterium
PVEDCYAALLWLRQQQW

SEQ ID NO: 1077407 - protein, 23 aa, Mycobacterium
PVELLRDLVAIYDAGRREPIPLP

SEQ ID NO: 1077408 - protein, 20 aa, Mycobacterium
PVFDQLVHLAGHRPIERYGS

SEQ ID NO: 1077409 - protein, 33 aa, Mycobacterium; identical to SEQ ID NO: 847424

SEQ ID NO: 1077410 - protein, 17 aa, Mycobacterium
PVGGLYDQFLGAAETDP

SEQ ID NO: 1077411 - protein, 26 aa, Mycobacterium
PVGILCLELLVHAWDFAFATDRRVVV

SEQ ID NO: 1077412 - protein, 21 aa, Mycobacterium
PVGPDAALWPTLRAIATLGSS

SEQ ID NO: 1077413 - protein, 26 aa, Mycobacterium
PVGSPVAWFYDPPWTIPCLRRNEIAV

SEQ ID NO: 1077414 - protein, 17 aa, Mycobacterium
PVHAAASAGFRSIGAEH

SEQ ID NO: 1077415 - protein, 19 aa, Mycobacterium
PVHHVVLAPPFRLDEAAVP

SEQ ID NO: 1077416 - protein, 19 aa, Mycobacterium
PVHQLPQPIAWPGSSDRNF

SEQ ID NO: 1077417 - protein, 17 aa, Mycobacterium
PVITAPRPQLTAATGGA

SEQ ID NO: 1077418 - protein, 19 aa, Mycobacterium
PVKLVLTRKQMYSSVGFRP

SEQ ID NO: 1077419 - protein, 18 aa, Mycobacterium
PVKQKYGSEISWADLIIF

SEQ ID NO: 1077420 - protein, 25 aa, Mycobacterium
PVLDRYDYVLVDCQPSLGLLTVNGL

SEQ ID NO: 1077421 - protein, 25 aa, Mycobacterium
PVLEVALRLPRIGYIGAMGSRQTHD

SEQ ID NO: 1077422 - protein, 21 aa, Mycobacterium
PVLIERPFVVTPKGTRLARPV

SEQ ID NO: 1077423 - protein, 17 aa, Mycobacterium
PVLPCHVGNPDLWFAET

SEQ ID NO: 1077424 - protein, 23 aa, Mycobacterium
PVLTRGSAMGARTTCPARTAVTA

SEQ ID NO: 1077425 - protein, 17 aa, Mycobacterium
PVLWKKVAPKLSAGRVQ

SEQ ID NO: 1077426 - protein, 18 aa, Mycobacterium
PVLYQHFSSKLELYLAVL

SEQ ID NO: 1077427 - protein, 24 aa, Mycobacterium
PVMCDFWETVLFRAGRYRGSALTA

SEQ ID NO: 1077428 - protein, 17 aa, Mycobacterium
PVMGVVAKRLWRDSGLK

SEQ ID NO: 1077429 - protein, 25 aa, Mycobacterium
PVMPTGKMIGFLHADRLYSGRIVDE

SEQ ID NO: 1077430 - protein, 29 aa, Mycobacterium
PVNFVPVIDKDVRRWWRSDSLWQAHDARY

SEQ ID NO: 1077431 - protein, 21 aa, Mycobacterium
PVNLAARLVAAAAPGQVLADA

SEQ ID NO: 1077432 - protein, 18 aa, Mycobacterium
PVPARWSRRKPEAAARLE

SEQ ID NO: 1077433 - protein, 26 aa, Mycobacterium
PVPGKPALLLGAFDLGGLGYLVEEFF

SEQ ID NO: 1077434 - protein, 29 aa, Mycobacterium
PVPHDPGRSLFWLSLSLQSDGTALRLVFE

SEQ ID NO: 1077435 - protein, 20 aa, Mycobacterium
PVPPALLRQGGCPLPTLAIT

SEQ ID NO: 1077436 - protein, 26 aa, Mycobacterium
PVPTPKVLTRLPLSGIRVLDLTTFWA

SEQ ID NO: 1077437 - protein, 17 aa, Mycobacterium
PVPVALRNRLRLAATHA

SEQ ID NO: 1077438 - protein, 23 aa, Mycobacterium
PVQKRIPILLAALGPKNVELAAE

SEQ ID NO: 1077439 - protein, 19 aa, Mycobacterium
PVQLGQQLRFPFARFSDQC

SEQ ID NO: 1077440 - protein, 17 aa, Mycobacterium
PVRAADPQFLRGDPVAL

SEQ ID NO: 1077441 - protein, 19 aa, Mycobacterium
PVRALSRVVPMLKPIVPDP

SEQ ID NO: 1077442 - protein, 26 aa, Mycobacterium
PVREPVRSLVWIRGRLRPVPADMIGA

SEQ ID NO: 1077443 - protein, 24 aa, Mycobacterium
PVRIDRFEVLAVRPGPEVGLADVI

SEQ ID NO: 1077444 - protein, 25 aa, Mycobacterium
PVRIDRFEVLAVRPGPEVGLADVID

SEQ ID NO: 1077445 - protein, 18 aa, Mycobacterium
PVRRRHWEWFGNGLGGGQ

SEQ ID NO: 1077446 - protein, 20 aa, Mycobacterium
PVRYIILTQGHVDHVGGLDS

SEQ ID NO: 1077447 - protein, 27 aa, Mycobacterium
PVSALLVRALQRCAWREDTRLSRVVVD

SEQ ID NO: 1077448 - protein, 36 aa, Mycobacterium
PVSALVVFEVMVRPLIRLSLGKRQPMRRIVQARTLS

SEQ ID NO: 1077449 - protein, 31 aa, Mycobacterium; identical to SEQ ID NO: 847709

SEQ ID NO: 1077450 - protein, 25 aa, Mycobacterium
PVTAAFLSIHNMCTWMIDSFGTDEQ

SEQ ID NO: 1077451 - protein, 19 aa, Mycobacterium
PVTFVDIAGLVKGASEGAG

SEQ ID NO: 1077452 - protein, 17 aa, Mycobacterium
PVVASIARKLGALTVGV

SEQ ID NO: 1077453 - protein, 24 aa, Mycobacterium
PVVLDAIYNSWPTPLAAAVAAAGG

SEQ ID NO: 1077454 - protein, 25 aa, Mycobacterium
PVVPPKPNTSALRRVLRRARDGFAL

SEQ ID NO: 1077455 - protein, 18 aa, Mycobacterium
PVYKMPWGTMHPTTITAP

SEQ ID NO: 1077456 - protein, 18 aa, Mycobacterium
PVYSHRILWPDRAYQPDL

SEQ ID NO: 1077457 - protein, 27 aa, Mycobacterium
PWAGSYYVEWLTHQLAQRARAHINEVA

SEQ ID NO: 1077458 - protein, 22 aa, Mycobacterium
PWIGNIDLSFPYLDTAATRTIG

SEQ ID NO: 1077459 - protein, 17 aa, Mycobacterium
PWLESLAYKIWGRAFEQ

SEQ ID NO: 1077460 - protein, 18 aa, Mycobacterium
PWNLQAWVNSLFGAAYYH

SEQ ID NO: 1077461 - protein, 20 aa, Mycobacterium
PWQIYRGDDAWRPTLRRVMR

SEQ ID NO: 1077462 - protein, 17 aa, Mycobacterium
PWQPMRLVTEARSLEDG

SEQ ID NO: 1077463 - protein, 23 aa, Mycobacterium
PWQRDLNSLVYVLAGRGAVGPAG

SEQ ID NO: 1077464 - protein, 18 aa, Mycobacterium
PWQRLEKTLLLGELSLDG

SEQ ID NO: 1077465 - protein, 20 aa, Mycobacterium
PYAWYQYFINTSDADVIRYL

SEQ ID NO: 1077466 - protein, 24 aa, Mycobacterium
PYCLDGMHHWLANWRLRAAEATSV

SEQ ID NO: 1077467 - protein, 18 aa, Mycobacterium
PYDATLTLRLRAAGIPIL

SEQ ID NO: 1077468 - protein, 25 aa, Mycobacterium
PYESMTLPARVTATLLRGKITARDG

SEQ ID NO: 1077469 - protein, 24 aa, Mycobacterium
PYETRIRLLIIRSGLPAPQTEIKV

SEQ ID NO: 1077470 - protein, 26 aa, Mycobacterium
PYGVDFVHNTWRFGIDRVLAGVAMSE

SEQ ID NO: 1077471 - protein, 17 aa, Mycobacterium
PYHRVAVPVWSTGPEMS

SEQ ID NO: 1077472 - protein, 17 aa, Mycobacterium
PYLLCNPHNPTGAAHSC

SEQ ID NO: 1077473 - protein, 18 aa, Mycobacterium
PYNHLEIGQPLLNEYVWG

SEQ ID NO: 1077474 - protein, 20 aa, Mycobacterium
PYPTPQSRIPTLLWAREIPV

SEQ ID NO: 1077475 - protein, 28 aa, Mycobacterium
PYREMMGPFVAVYARCYLGLAAKFALDI

SEQ ID NO: 1077476 - protein, 18 aa, Mycobacterium
PYRRQIFAGVRLAWSIED

SEQ ID NO: 1077477 - protein, 18 aa, Mycobacterium
PYSARELIARIRAVLRRG

SEQ ID NO: 1077478 - protein, 31 aa, Mycobacterium; identical to SEQ ID NO: 847939

SEQ ID NO: 1077479 - protein, 19 aa, Mycobacterium
PYVNQRWLGGMLTNFSTVH

SEQ ID NO: 1077480 - protein, 29 aa, Mycobacterium
QAAAEWFARILFSLFSTPSPIRDMDDAQA

SEQ ID NO: 1077481 - protein, 17 aa, Mycobacterium
QAALPRRAHVCLLTGAE

SEQ ID NO: 1077482 - protein, 17 aa, Mycobacterium
QAALQLINAPTQSWFGA

SEQ ID NO: 1077483 - protein, 22 aa, Mycobacterium
QAAQFHSQFVQAMQAGAGSYAT

SEQ ID NO: 1077484 - protein, 17 aa, Mycobacterium
QAARRVYQQSGLGPEDF

SEQ ID NO: 1077485 - protein, 24 aa, Mycobacterium
QAAVQLAVYRMAWAALRGCPESSV

SEQ ID NO: 1077486 - protein, 19 aa, Mycobacterium
QAAVWALLHSAQSEHPGRI

SEQ ID NO: 1077487 - protein, 27 aa, Mycobacterium
QADPGHITFAWYPQLVRADLGIGPHQV

SEQ ID NO: 1077488 - protein, 25 aa, Mycobacterium
QADRDTLWIDLIGELVPQTSSVEAR

SEQ ID NO: 1077489 - protein, 22 aa, Mycobacterium
QADRPLAVSLPTRQCTIDKVTA

SEQ ID NO: 1077490 - protein, 20 aa, Mycobacterium
QADVVVHLAFIKLGSRAESA

SEQ ID NO: 1077491 - protein, 26 aa, Mycobacterium
QAEAFHAQFAQLMANGAGTYASAEAA

SEQ ID NO: 1077492 - protein, 33 aa, Mycobacterium; identical to SEQ ID NO: 848042

SEQ ID NO: 1077493 - protein, 23 aa, Mycobacterium
QAEGFRHRIADARLLLNNALEAG

SEQ ID NO: 1077494 - protein, 24 aa, Mycobacterium
QAERIGPYLTLLRGISFEQANIQW

SEQ ID NO: 1077495 - protein, 24 aa, Mycobacterium
QAESIRKFCILPVDFTVLTGELTP

SEQ ID NO: 1077496 - protein, 25 aa, Mycobacterium
QAFAADMAFLRNCGIHPVVVHGGGP

SEQ ID NO: 1077497 - protein, 24 aa, Mycobacterium
QAFRGCTALWRRDQKLFAEVALPE

SEQ ID NO: 1077498 - protein, 18 aa, Mycobacterium
QAFTEAVSRRPANAEVTL

SEQ ID NO: 1077499 - protein, 29 aa, Mycobacterium
QAGAETPVWTFLGPRPAHWWVRRRLHEVV

SEQ ID NO: 1077500 - protein, 26 aa, Mycobacterium
QAGISFLLIDMATPGITLRPIKTIDG

SEQ ID NO: 1077501 - protein, 24 aa, Mycobacterium
QAGLRTDYLFRIANHRGGIVLGTG

SEQ ID NO: 1077502 - protein, 23 aa, Mycobacterium
QAGNIARLSWLAAGYPEEVPGVT

SEQ ID NO: 1077503 - protein, 32 aa, Mycobacterium
QAGQPWAKAPFGQRIHFALRPTDALTAPHTVR

SEQ ID NO: 1077504 - protein, 23 aa, Mycobacterium
QAGTPLAVYAANNSLTATQLAAQ

SEQ ID NO: 1077505 - protein, 32 aa, Mycobacterium; identical to SEQ ID NO: 848114

SEQ ID NO: 1077506 - protein, 23 aa, Mycobacterium
QAHFLSPMRAAIDMGLRPTNHTD

SEQ ID NO: 1077507 - protein, 22 aa, Mycobacterium
QAHGLPAISLGWGLWDQASNMT

SEQ ID NO: 1077508 - protein, 27 aa, Mycobacterium
QAHLEWFSRKQVDWIHRLRSELPNIEE

SEQ ID NO: 1077509 - protein, 33 aa, Mycobacterium
QAIAAWNRAFDDGVFCALALPPAVGENEALMRC

SEQ ID NO: 1077510 - protein, 29 aa, Mycobacterium
QAISAVPPDIALFLDLKQTPAQPVVSAVA

SEQ ID NO: 1077511 - protein, 23 aa, Mycobacterium
QAKPPEQIVVPPGPDPVPAPADD

SEQ ID NO: 1077512 - protein, 20 aa, Mycobacterium
QALEDVGFFTLLQPEQWGGL

SEQ ID NO: 1077513 - protein, 23 aa, Mycobacterium
QALERLDRALAHTAILGVQTNVE

SEQ ID NO: 1077514 - protein, 25 aa, Mycobacterium
QALERLETLLALIEGWVQTVVTDAL

SEQ ID NO: 1077515 - protein, 17 aa, Mycobacterium
QALLQRPDLGHAPSAVL

SEQ ID NO: 1077516 - protein, 22 aa, Mycobacterium
QALMCIGIAERVPEFAHLPTVL

SEQ ID NO: 1077517 - protein, 20 aa, Mycobacterium
QALPNIGLGNKGGTGNIGSG

SEQ ID NO: 1077518 - protein, 31 aa, Mycobacterium
QALSEQASAFHLQFVQAMTAGAGAYAGAEAV

SEQ ID NO: 1077519 - protein, 20 aa, Mycobacterium
QALVGTPLDPITPAEGLVAL

SEQ ID NO: 1077520 - protein, 17 aa, Mycobacterium
QAMEYLPWANRLQEGDD

SEQ ID NO: 1077521 - protein, 26 aa, Mycobacterium
QAMKSLHLILHNFKMPGFQVPEFRRK

SEQ ID NO: 1077522 - protein, 22 aa, Mycobacterium
QANAFQAQFIQAINGAGGAYVA

SEQ ID NO: 1077523 - protein, 19 aa, Mycobacterium
QANDKIRILTNKIVLAVDG

SEQ ID NO: 1077524 - protein, 24 aa, Mycobacterium
QANHLIAGLIAIGAIDIGIACGIE

SEQ ID NO: 1077525 - protein, 29 aa, Mycobacterium
QAPDGTNLDPLFDVLLEHVPPPQGDSEAP

SEQ ID NO: 1077526 - protein, 32 aa, Mycobacterium
QAPNSTLVSYLNKMLWILTGNFAKKGGQHLHS

SEQ ID NO: 1077527 - protein, 24 aa, Mycobacterium
QAQAFARGGLIRPAMLVHSIATRA

SEQ ID NO: 1077528 - protein, 21 aa, Mycobacterium
QAQAIYEMFVTTLQACGGSYA

SEQ ID NO: 1077529 - protein, 17 aa, Mycobacterium
QARGHGHSTRLLRAALA

SEQ ID NO: 1077530 - protein, 23 aa, Mycobacterium
QARGIRYIGFRHEASAANAAAAA

SEQ ID NO: 1077531 - protein, 17 aa, Mycobacterium
QARIAQDAPRRPFAIDD

SEQ ID NO: 1077532 - protein, 20 aa, Mycobacterium
QARLIALLGRPLPAQVAQLL

SEQ ID NO: 1077533 - protein, 25 aa, Mycobacterium
QARQPPEWLSVYPRELFVYELAESA

SEQ ID NO: 1077534 - protein, 30 aa, Mycobacterium
QASVVRREIGVPTVFNLLGPLTNPARPRAG

SEQ ID NO: 1077535 - protein, 37 aa, Mycobacterium; identical to SEQ ID NO: 785550

SEQ ID NO: 1077536 - protein, 26 aa, Mycobacterium
QATGARVAFLLRFGTGVLPEPKTVLQ

SEQ ID NO: 1077537 - protein, 20 aa, Mycobacterium
QAVAMPYRTLFMTLQQLLVG

SEQ ID NO: 1077538 - protein, 37 aa, Mycobacterium; identical to SEQ ID NO: 848324

SEQ ID NO: 1077539 - protein, 28 aa, Mycobacterium
QAVLEDPLILLHQDKISSLPDLLPLLEK

SEQ ID NO: 1077540 - protein, 25 aa, Mycobacterium
QAVLTSPVSFLQRPARWLQMLATSS

SEQ ID NO: 1077541 - protein, 24 aa, Mycobacterium
QAVQRLLHRRLLGPLLRGQDATPP

SEQ ID NO: 1077542 - protein, 19 aa, Mycobacterium
QAVRTNFFDTYFADAVAAG

SEQ ID NO: 1077543 - protein, 24 aa, Mycobacterium
QAVTAHLTLLLIELARLARDVVGD

SEQ ID NO: 1077544 - protein, 24 aa, Mycobacterium
QAVTASVWPMIASNRVRPIIGSRL

SEQ ID NO: 1077545 - protein, 17 aa, Mycobacterium
QAYQALSEQASAFHLQF

SEQ ID NO: 1077546 - protein, 17 aa, Mycobacterium
QAYRLQTFGTVTRLAAG

SEQ ID NO: 1077547 - protein, 21 aa, Mycobacterium
QAYSMTMYAGWRAVIAGFVAR

SEQ ID NO: 1077548 - protein, 21 aa, Mycobacterium
QCCAVVAYGALLGDALLGVPP

SEQ ID NO: 1077549 - protein, 25 aa, Mycobacterium
QCLAPGARLVFNAFLACGGYTPDQA

SEQ ID NO: 1077550 - protein, 31 aa, Mycobacterium
QCPNALDFYGQVIGMVAGRQLFVCMDYDGTL

SEQ ID NO: 1077551 - protein, 17 aa, Mycobacterium
QCRWTEVALWGQGWPLG

SEQ ID NO: 1077552 - protein, 25 aa, Mycobacterium
QDAKPVIGTVMRQGYQLGEHVLRNA

SEQ ID NO: 1077553 - protein, 25 aa, Mycobacterium
QDARRALDFLRGLRRQDTIATGGSI

SEQ ID NO: 1077554 - protein, 25 aa, Mycobacterium
QDETLTVLWHSITWQYLPAQERAAI

SEQ ID NO: 1077555 - protein, 21 aa, Mycobacterium
QDFARASFSYGLNAKWPVYLS

SEQ ID NO: 1077556 - protein, 26 aa, Mycobacterium
QDGCGLPLFCLPPGGGISWAYRNLSP

SEQ ID NO: 1077557 - protein, 22 aa, Mycobacterium
QDHAFDLSSLRFALNGAEGIDV

SEQ ID NO: 1077558 - protein, 31 aa, Mycobacterium
QDHYHDWDMLRANLLQLLIDGTVRPHEPAYD

SEQ ID NO: 1077559 - protein, 19 aa, Mycobacterium
QDHYLIEQMAMFNRERIPE

SEQ ID NO: 1077560 - protein, 25 aa, Mycobacterium
QDIVVLGLPRGGVPVAFEVAKALHA

SEQ ID NO: 1077561 - protein, 18 aa, Mycobacterium
QDLAFPLSGASRDGLYLA

SEQ ID NO: 1077562 - protein, 26 aa, Mycobacterium
QDLFIDPHFPGFTTQVLFTPEQLWPF

SEQ ID NO: 1077563 - protein, 27 aa, Mycobacterium
QDLLATGPISWLLQLGADLSTGYTAAV

SEQ ID NO: 1077564 - protein, 23 aa, Mycobacterium
QDLSELLWSFAPPARPRPATLAE

SEQ ID NO: 1077565 - protein, 22 aa, Mycobacterium
QDLTTLLRSGFAPVAFVMGNCV

SEQ ID NO: 1077566 - protein, 35 aa, Mycobacterium
QDNDPALYLIGKRYRFHPLALSNFLVALEASVLNN

SEQ ID NO: 1077567 - protein, 24 aa, Mycobacterium
QDPLPGILDYLRRALRAFHRNPEM

SEQ ID NO: 1077568 - protein, 21 aa, Mycobacterium
QDPSDPGFWAVTRRADIVAVS

SEQ ID NO: 1077569 - protein, 20 aa, Mycobacterium
QDRIFTVPVVSLPIVEKAIE

SEQ ID NO: 1077570 - protein, 27 aa, Mycobacterium
QDSQGALRLLIAQRALLCKGEALDLPA

SEQ ID NO: 1077571 - protein, 22 aa, Mycobacterium
QDTFTYGLLYQRESDLAEGCRQ

SEQ ID NO: 1077572 - protein, 20 aa, Mycobacterium
QDTFYIAPEDSRQLLRTHTS

SEQ ID NO: 1077573 - protein, 23 aa, Mycobacterium
QDYQLQLVPKMLRAMRPDLTIGF

SEQ ID NO: 1077574 - protein, 17 aa, Mycobacterium
QEAYRRALLSRNQPMAL

SEQ ID NO: 1077575 - protein, 24 aa, Mycobacterium
QEEVDHWLALDPISRYRSYLQGQG

SEQ ID NO: 1077576 - protein, 22 aa, Mycobacterium
QEGLDKVFQVLRAPHTEEPTNW

SEQ ID NO: 1077577 - protein, 24 aa, Mycobacterium
QEGTPLFRSMAKPVLTAVNGICCG

SEQ ID NO: 1077578 - protein, 28 aa, Mycobacterium
QEIMTELEIAPTRRLRGLGDRQRKALLE

SEQ ID NO: 1077579 - protein, 21 aa, Mycobacterium
QEISRLIGRSLRACIDLAALG

SEQ ID NO: 1077580 - protein, 23 aa, Mycobacterium
QEISRLIGRSLRACIDLAALGEN

SEQ ID NO: 1077581 - protein, 21 aa, Mycobacterium
QEISRLVGRSLRACIDLAALG

SEQ ID NO: 1077582 - protein, 34 aa, Mycobacterium; identical to SEQ ID NO: 848575

SEQ ID NO: 1077583 - protein, 17 aa, Mycobacterium
QEMAFLNKGLTINLTDE

SEQ ID NO: 1077584 - protein, 24 aa, Mycobacterium
QENKYRLVFEKLRLRPGDRLLDVG

SEQ ID NO: 1077585 - protein, 26 aa, Mycobacterium
QERELSIAGLWQITGFNQIPMSVHKA

SEQ ID NO: 1077586 - protein, 24 aa, Mycobacterium
QERFGRWLELIGPPPQSIYEIGSG

SEQ ID NO: 1077587 - protein, 28 aa, Mycobacterium
QERLGALAGAMRPPGAPGAPGAPGAPGM

SEQ ID NO: 1077588 - protein, 24 aa, Mycobacterium
QERRTDWLNNFYFGGDHGVSDSVA

SEQ ID NO: 1077589 - protein, 18 aa, Mycobacterium
QEVAWLADSPLLAGVASD

SEQ ID NO: 1077590 - protein, 23 aa, Mycobacterium
QFAAPVWMPRAKRPSIRDVQEAI

SEQ ID NO: 1077591 - protein, 20 aa, Mycobacterium
QFALILSPRGFGASAPFYGT

SEQ ID NO: 1077592 - protein, 24 aa, Mycobacterium
QFDSLEELFFTLYDQRATLISEQV

SEQ ID NO: 1077593 - protein, 26 aa, Mycobacterium
QFEEWDVRIVPRDLLAPLPGKASQQQ

SEQ ID NO: 1077594 - protein, 23 aa, Mycobacterium
QFEPDIQIWAHQRYCDPPTLTTD

SEQ ID NO: 1077595 - protein, 28 aa, Mycobacterium
QFMRYVQNPIWNFLCDKYFRVEIDGWHR

SEQ ID NO: 1077596 - protein, 17 aa, Mycobacterium
QFPALPLFELGYEVAHV

SEQ ID NO: 1077597 - protein, 23 aa, Mycobacterium
QFQAKYPMYRIIRQQLTEAAVRP

SEQ ID NO: 1077598 - protein, 21 aa, Mycobacterium
QFRQPHPARLPDRSIYLAAHR

SEQ ID NO: 1077599 - protein, 25 aa, Mycobacterium
QFRRFAGCPICNLHLRSISGRHDEI

SEQ ID NO: 1077600 - protein, 24 aa, Mycobacterium
QFTANPWLAGYMQQALGLLTTEPA

SEQ ID NO: 1077601 - protein, 21 aa, Mycobacterium
QGAGGMRFHDPRYLADLRNFC

SEQ ID NO: 1077602 - protein, 23 aa, Mycobacterium
QGALAALYRRSVTGTGQVVDVAL

SEQ ID NO: 1077603 - protein, 23 aa, Mycobacterium
QGAQWPAGLRRAAVSSFGLSGTN

SEQ ID NO: 1077604 - protein, 22 aa, Mycobacterium
QGEFRPDLAAGWLTEAFYSLVS

SEQ ID NO: 1077605 - protein, 30 aa, Mycobacterium; identical to SEQ ID NO: 848773

SEQ ID NO: 1077606 - protein, 25 aa, Mycobacterium
QGGAADFFESGAPWRHGSTPVNVSG

SEQ ID NO: 1077607 - protein, 23 aa, Mycobacterium
QGGNATLFGYGGHGSAGGSSLNL

SEQ ID NO: 1077608 - protein, 21 aa, Mycobacterium
QGGWPMTCFLTPDGRPFYCGT

SEQ ID NO: 1077609 - protein, 18 aa, Mycobacterium
QGGYPPSYEQCPPAPGGY

SEQ ID NO: 1077610 - protein, 22 aa, Mycobacterium
QGHLQLGGLYVLVLDEADEMLD

SEQ ID NO: 1077611 - protein, 20 aa, Mycobacterium
QGISAELIAARWGLSRTQLD

SEQ ID NO: 1077612 - protein, 24 aa, Mycobacterium
QGKAALELNWPYVFASMLENAVKG

SEQ ID NO: 1077613 - protein, 30 aa, Mycobacterium
QGKFELSTPIPITILLTQPPPVAGEDVPVA

SEQ ID NO: 1077614 - protein, 22 aa, Mycobacterium
QGKFLLNVPLFQRESVHPDIDR

SEQ ID NO: 1077615 - protein, 23 aa, Mycobacterium
QGKTRLLRALTGLLDEWTPVIAG

SEQ ID NO: 1077616 - protein, 23 aa, Mycobacterium
QGLDGMSRISGWLTPEARAGLEA

SEQ ID NO: 1077617 - protein, 27 aa, Mycobacterium
QGLEYIIAFLGVLEAGLIAVPLPVPQF

SEQ ID NO: 1077618 - protein, 18 aa, Mycobacterium
QGLLVPPHPITATVPLEI

SEQ ID NO: 1077619 - protein, 21 aa, Mycobacterium
QGLVRVLAYEHPELRATLVDL

SEQ ID NO: 1077620 - protein, 30 aa, Mycobacterium
QGNDLVLDTVSFYKPTKPGSYPIVLGTYEI

SEQ ID NO: 1077621 - protein, 20 aa, Mycobacterium
QGNYIFPEGFDPETNEWMEG

SEQ ID NO: 1077622 - protein, 21 aa, Mycobacterium
QGQGDIFYLGGALGFESLEHT

SEQ ID NO: 1077623 - protein, 17 aa, Mycobacterium
QGREQVRHLVRITRGLA

SEQ ID NO: 1077624 - protein, 20 aa, Mycobacterium
QGRNLVKVTRPLLSDPFEAQ

SEQ ID NO: 1077625 - protein, 27 aa, Mycobacterium
QGRQLKSLVPITKFLRRSPYLSAVRTA

SEQ ID NO: 1077626 - protein, 23 aa, Mycobacterium
QGRTAFFTTPYLADGPGGEKNWS

SEQ ID NO: 1077627 - protein, 27 aa, Mycobacterium
QGSRALLLDFTFDKLAQFPKAVMLRLH

SEQ ID NO: 1077628 - protein, 30 aa, Mycobacterium
QGWEHGRFSAPYLRDSLLAASALCETLETA

SEQ ID NO: 1077629 - protein, 25 aa, Mycobacterium
QGWVPVIGPFFRRGLMLLDFEEHMF

SEQ ID NO: 1077630 - protein, 26 aa, Mycobacterium
QGYHMTTFGFILGEVFRRITGRTVGQ

SEQ ID NO: 1077631 - protein, 18 aa, Mycobacterium
QHAERWGYRRFWVAEHHF

SEQ ID NO: 1077632 - protein, 17 aa, Mycobacterium
QHALVTQRFLDAGLVVF

SEQ ID NO: 1077633 - protein, 18 aa, Mycobacterium
QHETRLSCHSPRQVLQFR

SEQ ID NO: 1077634 - protein, 18 aa, Mycobacterium
QHLATQLSALFRTRRFRV

SEQ ID NO: 1077635 - protein, 18 aa, Mycobacterium
QHLELARDIAQRFNGRFP

SEQ ID NO: 1077636 - protein, 21 aa, Mycobacterium
QHNAPQWDILPIQFADYAVWQ

SEQ ID NO: 1077637 - protein, 24 aa, Mycobacterium
QHNWTLLHALPELVATGIPVLVGA

SEQ ID NO: 1077638 - protein, 24 aa, Mycobacterium
QHRSGALWILNSAALNRIGLAGHV

SEQ ID NO: 1077639 - protein, 26 aa, Mycobacterium
QHRTDLTPWILAARSAPALVNQARRL

SEQ ID NO: 1077640 - protein, 20 aa, Mycobacterium
QHSLWPTFADVPAGWRVAFG

SEQ ID NO: 1077641 - protein, 24 aa, Mycobacterium
QHSLWPTFADVPAGWRVVHGEGTR

SEQ ID NO: 1077642 - protein, 28 aa, Mycobacterium
QHSLWPVFAEVPAGWRVVFGEAARAACL

SEQ ID NO: 1077643 - protein, 26 aa, Mycobacterium
QHVLAAPHRLYTVRILVTPGQIVATG

SEQ ID NO: 1077644 - protein, 25 aa, Mycobacterium
QHVRPKFRWIELPERIEAGLVRMAR

SEQ ID NO: 1077645 - protein, 18 aa, Mycobacterium
QIAADALGLPLQRVRFSL

SEQ ID NO: 1077646 - protein, 19 aa, Mycobacterium
QIAISAWGLLSPEGRCATF

SEQ ID NO: 1077647 - protein, 22 aa, Mycobacterium
QIAQAFVSERIALAAQAYSSAQ

SEQ ID NO: 1077648 - protein, 26 aa, Mycobacterium
QIAVTQAFLPLLRRAAGRIVVIASIG

SEQ ID NO: 1077649 - protein, 18 aa, Mycobacterium
QIDAIIPQLLAGGYRPET

SEQ ID NO: 1077650 - protein, 24 aa, Mycobacterium
QIDGEWVDWFPPTHPDRPDAPNMD

SEQ ID NO: 1077651 - protein, 25 aa, Mycobacterium
QIDPNAEFFAAPLSWQRELWPTEEF

SEQ ID NO: 1077652 - protein, 24 aa, Mycobacterium
QIGGFGIHPALLDAALHALVLTAE

SEQ ID NO: 1077653 - protein, 26 aa, Mycobacterium
QIGKGDIVVLLESMKMEIPVLAEIGG

SEQ ID NO: 1077654 - protein, 26 aa, Mycobacterium
QIGQKFAREIFLLGRAYTAEQMHHMG

SEQ ID NO: 1077655 - protein, 24 aa, Mycobacterium
QIGTLLPCNVVVRADPERDGTIII

SEQ ID NO: 1077656 - protein, 18 aa, Mycobacterium
QIHLIGANRLATAVLPGM

SEQ ID NO: 1077657 - protein, 19 aa, Mycobacterium
QIHPSVMRAIADVGYESPT

SEQ ID NO: 1077658 - protein, 18 aa, Mycobacterium
QILAARPLLARLASEVPA

SEQ ID NO: 1077659 - protein, 25 aa, Mycobacterium
QILEQAVGLFIDRGFHSVKLEDIAE

SEQ ID NO: 1077660 - protein, 17 aa, Mycobacterium
QILRFGALLEFNIEDVD

SEQ ID NO: 1077661 - protein, 26 aa, Mycobacterium
QIPVRLHARSWHRYPEPPPDSVAMVI

SEQ ID NO: 1077662 - protein, 21 aa, Mycobacterium
QIRGPHTLRGLCRRSREEVFT

SEQ ID NO: 1077663 - protein, 19 aa, Mycobacterium
QIRWLFGKLLAEKPGRNPR

SEQ ID NO: 1077664 - protein, 18 aa, Mycobacterium
QITDPVAVLIAPGSKVGS

SEQ ID NO: 1077665 - protein, 17 aa, Mycobacterium
QITGFNQIPMSVHKASK

SEQ ID NO: 1077666 - protein, 17 aa, Mycobacterium
QIVPVHAALPWSERVAT

SEQ ID NO: 1077667 - protein, 25 aa, Mycobacterium
QKAGLEWLYRLASEPRRLARRYLLQ

SEQ ID NO: 1077668 - protein, 24 aa, Mycobacterium
QKANLKLVVVDYLQLMISGKKHES

SEQ ID NO: 1077669 - protein, 32 aa, Mycobacterium
QKDRDALLRKAPWVDVVFGTHNIGSLPALLDR

SEQ ID NO: 1077670 - protein, 20 aa, Mycobacterium
QKFHYLNTAPLGQIAKRWRI

SEQ ID NO: 1077671 - protein, 23 aa, Mycobacterium
QKFRFYRPIVTGDKLYFHTYLDS

SEQ ID NO: 1077672 - protein, 26 aa, Mycobacterium
QKLSRLERFDRTIYLFDVELDHERNR

SEQ ID NO: 1077673 - protein, 25 aa, Mycobacterium
QKQRIGIARALALQPKILALDEPVS

SEQ ID NO: 1077674 - protein, 20 aa, Mycobacterium
QKQRRLPKFCTGEFITAIAM

SEQ ID NO: 1077675 - protein, 18 aa, Mycobacterium
QKRLQEELAWVRSGAKAR

SEQ ID NO: 1077676 - protein, 26 aa, Mycobacterium
QKRREFLTDVSLLGGLIIASADTAGK

SEQ ID NO: 1077677 - protein, 20 aa, Mycobacterium
QKRWTMRWKPALNAFAITFA

SEQ ID NO: 1077678 - protein, 25 aa, Mycobacterium
QKRWTTRWKPALNAFAITFADRMPG

SEQ ID NO: 1077679 - protein, 20 aa, Mycobacterium
QKSHFLPRIVRGECFFGIGM

SEQ ID NO: 1077680 - protein, 25 aa, Mycobacterium
QKVAFKGFLLSDVPNFAYVFGYTNS

SEQ ID NO: 1077681 - protein, 22 aa, Mycobacterium
QKVIYSIQWLVVNSLGHQLPRT

SEQ ID NO: 1077682 - protein, 19 aa, Mycobacterium
QLAAIAPTVFTAAPGAAWE

SEQ ID NO: 1077683 - protein, 19 aa, Mycobacterium
QLAALRDALLPGLVTGEVA

SEQ ID NO: 1077684 - protein, 22 aa, Mycobacterium
QLADIPVTPWQHTQFWVEDRSG

SEQ ID NO: 1077685 - protein, 25 aa, Mycobacterium
QLAELLRTQILERALSPGSRLPTEQ

SEQ ID NO: 1077686 - protein, 31 aa, Mycobacterium
QLAGNALLDLFLRIIVELFQRHWSSTEHQQP

SEQ ID NO: 1077687 - protein, 19 aa, Mycobacterium
QLAQLGAELNRRIVAAHQM

SEQ ID NO: 1077688 - protein, 32 aa, Mycobacterium
QLARTELQIVYRTLLQRIPTLTLATALEDVPF

SEQ ID NO: 1077689 - protein, 31 aa, Mycobacterium; identical to SEQ ID NO: 1052930

SEQ ID NO: 1077690 - protein, 28 aa, Mycobacterium
QLDPYLPDFVMCRPELAPVLLDAIRQVW

SEQ ID NO: 1077691 - protein, 22 aa, Mycobacterium
QLEGSKRFIGCGQILFEDVVIG

SEQ ID NO: 1077692 - protein, 22 aa, Mycobacterium
QLEMRLNRQLADIEKLQVNARQ

SEQ ID NO: 1077693 - protein, 21 aa, Mycobacterium
QLFVDMAHFAGLVAAGLHPSP

SEQ ID NO: 1077694 - protein, 23 aa, Mycobacterium
QLGIWLDLQINGAGPRWNIANFV

SEQ ID NO: 1077695 - protein, 17 aa, Mycobacterium
QLGLIGMQLTLTELWRS

SEQ ID NO: 1077696 - protein, 28 aa, Mycobacterium
QLGRDRVPTFLLPANPVSALVVFEVMVR

SEQ ID NO: 1077697 - protein, 18 aa, Mycobacterium
QLGTLFAQQLLPDAAAAP

SEQ ID NO: 1077698 - protein, 18 aa, Mycobacterium
QLGWDLELIGRIGWTCRD

SEQ ID NO: 1077699 - protein, 24 aa, Mycobacterium
QLHRHLHRIGLPPPGGRAELSQIC

SEQ ID NO: 1077700 - protein, 20 aa, Mycobacterium
QLHWDMLTPYHRLGGPRFVA

SEQ ID NO: 1077701 - protein, 20 aa, Mycobacterium
QLIAPNRMMRKWLSANNFLG

SEQ ID NO: 1077702 - protein, 17 aa, Mycobacterium
QLIAVDNVWVPPAGGEE

SEQ ID NO: 1077703 - protein, 17 aa, Mycobacterium
QLISEHLRINRDVLIRI

SEQ ID NO: 1077704 - protein, 23 aa, Mycobacterium
QLKADTSFLLCFKAHDHDMEFVT

SEQ ID NO: 1077705 - protein, 27 aa, Mycobacterium
QLLAAELAAIPDRFTKTVLASANSYAS

SEQ ID NO: 1077706 - protein, 25 aa, Mycobacterium
QLLADLSFADYLMWVSRDDGVLVCV

SEQ ID NO: 1077707 - protein, 32 aa, Mycobacterium
QLLELDFVGSIVEPAFAYPFAKQANSIRVRAA

SEQ ID NO: 1077708 - protein, 24 aa, Mycobacterium
QLLERFGMFGIRISIAGLAAGIAD

SEQ ID NO: 1077709 - protein, 19 aa, Mycobacterium
QLNAIRRLHPALQQLRTIY

SEQ ID NO: 1077710 - protein, 17 aa, Mycobacterium
QLNLILKGDNAGTVEAL

SEQ ID NO: 1077711 - protein, 21 aa, Mycobacterium
QLNLLLTDFKGGSTFLGMEKL

SEQ ID NO: 1077712 - protein, 26 aa, Mycobacterium
QLNSIALYLNFDMLGSPNAGYFTDDG

SEQ ID NO: 1077713 - protein, 18 aa, Mycobacterium
QLPQPILRNHELAKLINL

SEQ ID NO: 1077714 - protein, 23 aa, Mycobacterium
QLPSMFADVRRELAVKAVAQAAT

SEQ ID NO: 1077715 - protein, 20 aa, Mycobacterium
QLQFAGLLGTPIGHPAAAAA

SEQ ID NO: 1077716 - protein, 28 aa, Mycobacterium
QLQNKIRAMQVLGARLQAIAEERAMADA

SEQ ID NO: 1077717 - protein, 24 aa, Mycobacterium
QLRDTHIELERLVHALPAGPNQRD

SEQ ID NO: 1077718 - protein, 18 aa, Mycobacterium
QLRLLLRDVFISAGGTHD

SEQ ID NO: 1077719 - protein, 17 aa, Mycobacterium
QLRLWVDSLLSATDGKL

SEQ ID NO: 1077720 - protein, 24 aa, Mycobacterium
QLRTYVRVPYRARVPMTRAALMHR

SEQ ID NO: 1077721 - protein, 20 aa, Mycobacterium
QLSALFRTRRFRVYTTDDVI

SEQ ID NO: 1077722 - protein, 19 aa, Mycobacterium
QLSALLASPITVSVLAPLD

SEQ ID NO: 1077723 - protein, 24 aa, Mycobacterium
QLSDVTIAGYLPQGQLYSADVTGR

SEQ ID NO: 1077724 - protein, 27 aa, Mycobacterium
QLSPNGLPVILGPDHPITGGYPVVGVV

SEQ ID NO: 1077725 - protein, 20 aa, Mycobacterium
QLSRAIHGIATFPKLGGAAG

SEQ ID NO: 1077726 - protein, 17 aa, Mycobacterium
QLTRLYELPIPVIAAVN

SEQ ID NO: 1077727 - protein, 19 aa, Mycobacterium
QLVAIYLGAVNRDPSVFAD

SEQ ID NO: 1077728 - protein, 33 aa, Mycobacterium
QLVDRVKTWLQFPQWFYLNIPVNTMVVPRLTPG

SEQ ID NO: 1077729 - protein, 21 aa, Mycobacterium
QLVQALDRTAGWYADAETGNA

SEQ ID NO: 1077730 - protein, 17 aa, Mycobacterium
QLVSLVQSNLLGLNAPA

SEQ ID NO: 1077731 - protein, 20 aa, Mycobacterium
QLVSYILPRSPIVRVVDPDT

SEQ ID NO: 1077732 - protein, 17 aa, Mycobacterium
QLYPLLAHVVLFGGGHV

SEQ ID NO: 1077733 - protein, 19 aa, Mycobacterium
QMALASCEFAVLIPLGVDT

SEQ ID NO: 1077734 - protein, 18 aa, Mycobacterium
QMDQYFSRFGGVRDYLMA

SEQ ID NO: 1077735 - protein, 26 aa, Mycobacterium
QMIDFMATRTAFFDEFFLGAADAGVR

SEQ ID NO: 1077736 - protein, 21 aa, Mycobacterium
QMLAYNCSPSFNWKKHLDDET

SEQ ID NO: 1077737 - protein, 17 aa, Mycobacterium
QMLGWRGYVENHQVARL

SEQ ID NO: 1077738 - protein, 23 aa, Mycobacterium
QMNPKLVQDFAKGLAPYVANIAG

SEQ ID NO: 1077739 - protein, 27 aa, Mycobacterium
QMQTAAPDFRLFWDNAYMVHTLTPDFI

SEQ ID NO: 1077740 - protein, 17 aa, Mycobacterium
QMRPIHRPPRSPADRHP

SEQ ID NO: 1077741 - protein, 17 aa, Mycobacterium
QMRTFTVSALVVGWLTR

SEQ ID NO: 1077742 - protein, 17 aa, Mycobacterium
QMSLLPELPTSPAESFT

SEQ ID NO: 1077743 - protein, 19 aa, Mycobacterium
QMSNFRQTLNVRCGLLRTS

SEQ ID NO: 1077744 - protein, 25 aa, Mycobacterium
QMSVLTGHIFAGHLRSIIGSMTVEE

SEQ ID NO: 1077745 - protein, 18 aa, Mycobacterium
QMVSVATAMIPFLEHDDA

SEQ ID NO: 1077746 - protein, 26 aa, Mycobacterium
QNAAPADLFMLIYTSGTSGDPKAVKC

SEQ ID NO: 1077747 - protein, 24 aa, Mycobacterium
QNDSLEALVRRNGPLDWGEVVRLG

SEQ ID NO: 1077748 - protein, 22 aa, Mycobacterium
QNGGDGGLLWGNGGAGGVGTAA

SEQ ID NO: 1077749 - protein, 23 aa, Mycobacterium
QNHGPAFAALTRILRRPDGSVET

SEQ ID NO: 1077750 - protein, 20 aa, Mycobacterium
QNIAFPLTLAKMKKAANAQK

SEQ ID NO: 1077751 - protein, 19 aa, Mycobacterium
QNILALRFANQLFDPIWNA

SEQ ID NO: 1077752 - protein, 23 aa, Mycobacterium
QNIVGQRYLGLSLGKKGSPDQLA

SEQ ID NO: 1077753 - protein, 25 aa, Mycobacterium
QNLTQFYHPLDMFGEWNRAYGPAGF

SEQ ID NO: 1077754 - protein, 18 aa, Mycobacterium
QNMTVIDAIYRAAGLPLR

SEQ ID NO: 1077755 - protein, 22 aa, Mycobacterium
QPAAMFALPICRRPGAKTVTAL

SEQ ID NO: 1077756 - protein, 19 aa, Mycobacterium
QPAVYVIEDAHWMDEASES

SEQ ID NO: 1077757 - protein, 18 aa, Mycobacterium
QPDYLTAFAALWETINLE

SEQ ID NO: 1077758 - protein, 17 aa, Mycobacterium
QPEAYTWLTAELANLRL

SEQ ID NO: 1077759 - protein, 33 aa, Mycobacterium; identical to SEQ ID NO: 849814

SEQ ID NO: 1077760 - protein, 24 aa, Mycobacterium
QPEQWGGLQCDPTLFYEATRRLAS

SEQ ID NO: 1077761 - protein, 21 aa, Mycobacterium
QPGDILVFEGPRNAFYLGAAE

SEQ ID NO: 1077762 - protein, 22 aa, Mycobacterium
QPGRVVVLPWDRHIAAGTEIHL

SEQ ID NO: 1077763 - protein, 28 aa, Mycobacterium
QPGTFEGWLHRITTNLFLDMVRRRSRIR

SEQ ID NO: 1077764 - protein, 18 aa, Mycobacterium
QPGYPPPRPQDQGGYPEQ

SEQ ID NO: 1077765 - protein, 24 aa, Mycobacterium
QPIASRAALLYKLAQVTARFADVE

SEQ ID NO: 1077766 - protein, 22 aa, Mycobacterium
QPIHAMYATAQFWDLDGAPATV

SEQ ID NO: 1077767 - protein, 23 aa, Mycobacterium
QPIHAMYATAQFWDLDGAPATVW

SEQ ID NO: 1077768 - protein, 20 aa, Mycobacterium
QPISLLPFLFRVETGLDGCE

SEQ ID NO: 1077769 - protein, 17 aa, Mycobacterium
QPLEKLFGTATARPVIP

SEQ ID NO: 1077770 - protein, 30 aa, Mycobacterium
QPLSWAIMVSLAELWRSVGVAPDAVIGHSQ

SEQ ID NO: 1077771 - protein, 17 aa, Mycobacterium
QPLVAFADSWKQTLRAS

SEQ ID NO: 1077772 - protein, 23 aa, Mycobacterium
QPPAPTLSPRRTTRQLMVRDVGV

SEQ ID NO: 1077773 - protein, 18 aa, Mycobacterium
QPPGPQFGPLRRVRAVLA

SEQ ID NO: 1077774 - protein, 35 aa, Mycobacterium
QPRAGNLFLSLADRIPFALTAWTVGVLMRLPQRGV

SEQ ID NO: 1077775 - protein, 18 aa, Mycobacterium
QPTFSRKAARRRAVELLE

SEQ ID NO: 1077776 - protein, 30 aa, Mycobacterium; identical to SEQ ID NO: 849930

SEQ ID NO: 1077777 - protein, 22 aa, Mycobacterium
QPTTRSFLAQPLRVAIAGDWHS

SEQ ID NO: 1077778 - protein, 18 aa, Mycobacterium
QPTTSVVGLPAGTGGTGG

SEQ ID NO: 1077779 - protein, 22 aa, Mycobacterium
QPVLFAVMVSLARTLISYGIEP

SEQ ID NO: 1077780 - protein, 17 aa, Mycobacterium
QPVRALISICAAGGQGV

SEQ ID NO: 1077781 - protein, 21 aa, Mycobacterium
QPVTGVMGFLGRRQHLVPNTG

SEQ ID NO: 1077782 - protein, 27 aa, Mycobacterium
QPVVMAPRTTFLPFPQNYRCPFGVGGE

SEQ ID NO: 1077783 - protein, 17 aa, Mycobacterium
QPVYRVAAKLRLMADEL

SEQ ID NO: 1077784 - protein, 26 aa, Mycobacterium
QPWDRDQIHRLFDDLEFRVLRDRLFD

SEQ ID NO: 1077785 - protein, 18 aa, Mycobacterium
QQAATLKALVDCGVNNAA

SEQ ID NO: 1077786 - protein, 18 aa, Mycobacterium
QQALNSPGALFTHQMNDI

SEQ ID NO: 1077787 - protein, 26 aa, Mycobacterium
QQARRPDLILLDLNLPKYDGRQLLEK

SEQ ID NO: 1077788 - protein, 27 aa, Mycobacterium
QQERDLMGTLLLELTFDAPRRLEMLHG

SEQ ID NO: 1077789 - protein, 21 aa, Mycobacterium
QQHGPAFRGIVGLAVTGSGAA

SEQ ID NO: 1077790 - protein, 23 aa, Mycobacterium
QQLELSLLGPLRNPELMKAYKVS

SEQ ID NO: 1077791 - protein, 32 aa, Mycobacterium
QQLLAAINAPTQTLLGRPLIGNGANGAPGQNG

SEQ ID NO: 1077792 - protein, 22 aa, Mycobacterium
QQLRAVLVADNPGYWVLHCHNS

SEQ ID NO: 1077793 - protein, 21 aa, Mycobacterium
QQLSDLLRRQLHQAAARLCAR

SEQ ID NO: 1077794 - protein, 26 aa, Mycobacterium
QQLSTQVGVFSDQFVAALSASASGYS

SEQ ID NO: 1077795 - protein, 23 aa, Mycobacterium
QQLVDIVAIARIPGVRAKVAVRS

SEQ ID NO: 1077796 - protein, 25 aa, Mycobacterium
QQNFTPPAPRYKTGVLAKYVKLVGS

SEQ ID NO: 1077797 - protein, 22 aa, Mycobacterium
QQQRFLPRILDVTELWCQGYSE

SEQ ID NO: 1077798 - protein, 22 aa, Mycobacterium
QQRDLAEILDLAPLVADNGYNA

SEQ ID NO: 1077799 - protein, 19 aa, Mycobacterium
QQRTVLEGRLEQLRTFERE

SEQ ID NO: 1077800 - protein, 25 aa, Mycobacterium
QQSTALLGRPLIGNGADGAAPGQSG

SEQ ID NO: 1077801 - protein, 23 aa, Mycobacterium
QQSWVVSFQLNWPRDHGPTVTSW

SEQ ID NO: 1077802 - protein, 27 aa, Mycobacterium
QQYVHLQELARRRLYRSFNPQGVGIIA

SEQ ID NO: 1077803 - protein, 18 aa, Mycobacterium
QRAALPPMHEGRVDVIGG

SEQ ID NO: 1077804 - protein, 30 aa, Mycobacterium
QRAEEFLTVARKFWDSWAPGAVLADIENGD

SEQ ID NO: 1077805 - protein, 27 aa, Mycobacterium
QRAKNMFALGLVSWMYGRPIQTSETFI

SEQ ID NO: 1077806 - protein, 18 aa, Mycobacterium
QRAVHRVFTLLAAGRPVL

SEQ ID NO: 1077807 - protein, 34 aa, Mycobacterium
QRCGSLVWNLPRVFGPIAIAYRVNGLTSLNLDGP

SEQ ID NO: 1077808 - protein, 22 aa, Mycobacterium
QRDALYRRGLQAGRKFLQSWNY

SEQ ID NO: 1077809 - protein, 20 aa, Mycobacterium
QRDFTLWKGAKPGEPSWPTP

SEQ ID NO: 1077810 - protein, 32 aa, Mycobacterium
QRDHSWGVRDWWSMDWMWSALHLDDGTHLHGV

SEQ ID NO: 1077811 - protein, 20 aa, Mycobacterium
QRDIIGMISLGLLRANHGPS

SEQ ID NO: 1077812 - protein, 24 aa, Mycobacterium
QRDLSSIVFILQGAAVMPPSLLHT

SEQ ID NO: 1077813 - protein, 17 aa, Mycobacterium
QRDRAVWSFPPEGNGLG

SEQ ID NO: 1077814 - protein, 20 aa, Mycobacterium
QRDRILIITINRPKAKNSVN

SEQ ID NO: 1077815 - protein, 20 aa, Mycobacterium
QRETPLPGALLVRVARSHLR

SEQ ID NO: 1077816 - protein, 26 aa, Mycobacterium
QREVTEFFDVLPLMADNLYNAVDRRN

SEQ ID NO: 1077817 - protein, 23 aa, Mycobacterium
QRFAPLNSWPDNVSLDKARRLLW

SEQ ID NO: 1077818 - protein, 17 aa, Mycobacterium
QRFLVPRRSAAPSACAG

SEQ ID NO: 1077819 - protein, 20 aa, Mycobacterium
QRGAQLWQWLQDGAQVYVCG

SEQ ID NO: 1077820 - protein, 32 aa, Mycobacterium
QRHQFYVLDEFTYPLKWGWVDVGEVVDVLLAR

SEQ ID NO: 1077821 - protein, 21 aa, Mycobacterium
QRKALLDRLTAQQLPDGWDAD

SEQ ID NO: 1077822 - protein, 32 aa, Mycobacterium; identical to SEQ ID NO: 850200

SEQ ID NO: 1077823 - protein, 18 aa, Mycobacterium
QRLALACALVGRPELVFL

SEQ ID NO: 1077824 - protein, 27 aa, Mycobacterium
QRLANFWHGDFPWRPEPGYGRTSPVGS

SEQ ID NO: 1077825 - protein, 19 aa, Mycobacterium
QRLFDFHYRIEIYTLAAQR

SEQ ID NO: 1077826 - protein, 24 aa, Mycobacterium
QRLTGLLMVLAADPARRLSSIDLL

SEQ ID NO: 1077827 - protein, 17 aa, Mycobacterium
QRLVAHSIRFGVLSRFT

SEQ ID NO: 1077828 - protein, 19 aa, Mycobacterium
QRNFVHSALLYHSQHEYLE

SEQ ID NO: 1077829 - protein, 25 aa, Mycobacterium
QRNGERYQFLRWGQGAFDDFKVVPP

SEQ ID NO: 1077830 - protein, 18 aa, Mycobacterium
QRPARWMQLLASNCQVFS

SEQ ID NO: 1077831 - protein, 19 aa, Mycobacterium
QRPMSFSPMLRRVEAGPDG

SEQ ID NO: 1077832 - protein, 24 aa, Mycobacterium
QRPVIMAGTNVWWGHGERALLRLA

SEQ ID NO: 1077833 - protein, 25 aa, Mycobacterium
QRRAFGGALIDKPLMRRKLAELIVD

SEQ ID NO: 1077834 - protein, 20 aa, Mycobacterium
QRRELLPRTVEVEPGVFVWC

SEQ ID NO: 1077835 - protein, 22 aa, Mycobacterium
QRRFWFMWDDLVRGAIGAIVLV

SEQ ID NO: 1077836 - protein, 25 aa, Mycobacterium
QRRGQLKILDLVRPDPYLQAGTPTG

SEQ ID NO: 1077837 - protein, 25 aa, Mycobacterium
QRRQLWHFGLLPDEVPEFLAEYGWR

SEQ ID NO: 1077838 - protein, 22 aa, Mycobacterium
QRRRVQLARLLIGDWDVIALDE

SEQ ID NO: 1077839 - protein, 24 aa, Mycobacterium
QRSLLGQMLTSRPCPTCRGVGVVI

SEQ ID NO: 1077840 - protein, 41 aa, Mycobacterium
QRSTVVLAMWQYLLHHYSQQDALLVGLPFPARPAGVSEAAI

SEQ ID NO: 1077841 - protein, 18 aa, Mycobacterium
QRTAYLKIDYRNIVPIEK

SEQ ID NO: 1077842 - protein, 19 aa, Mycobacterium
QRTGLPHVTWKYATSIDGR

SEQ ID NO: 1077843 - protein, 18 aa, Mycobacterium
QRVALFADIQLIALIAQN

SEQ ID NO: 1077844 - protein, 19 aa, Mycobacterium
QRVARRLVAAGLPGSIMAI

SEQ ID NO: 1077845 - protein, 33 aa, Mycobacterium; identical to SEQ ID NO: 850340

SEQ ID NO: 1077846 - protein, 29 aa, Mycobacterium
QRVSARVYPALVPLSHPLATVNGAFNAVV

SEQ ID NO: 1077847 - protein, 26 aa, Mycobacterium
QRWAELVYDGLWYSPLKTALESFVAK

SEQ ID NO: 1077848 - protein, 21 aa, Mycobacterium
QRWARNTGGLLLVTHDRWFLD

SEQ ID NO: 1077849 - protein, 31 aa, Mycobacterium; identical to SEQ ID NO: 850366

SEQ ID NO: 1077850 - protein, 17 aa, Mycobacterium
QRWLGRIAPQLPVASPV

SEQ ID NO: 1077851 - protein, 17 aa, Mycobacterium
QRYDVVLTPTLADPPPQ

SEQ ID NO: 1077852 - protein, 44 aa, Mycobacterium
QRYLDKIVQLPVSLPFLPAHEADAYLGLLLAKAGLDNDAFTALV

SEQ ID NO: 1077853 - protein, 25 aa, Mycobacterium
QRYRDRYIFAGLQPGQRIPRKWLDS

SEQ ID NO: 1077854 - protein, 25 aa, Mycobacterium
QSAAAGFASLTSGLTGQFWQGAAAQ

SEQ ID NO: 1077855 - protein, 22 aa, Mycobacterium
QSALKCLYLVTRSLDPTGTGQK

SEQ ID NO: 1077856 - protein, 29 aa, Mycobacterium
QSALTGFERFLPLLFAYDLPPIAEEMRKF

SEQ ID NO: 1077857 - protein, 32 aa, Mycobacterium
QSASPGFDIFLWELFGPLVAGVRLVFMDAARR

SEQ ID NO: 1077858 - protein, 18 aa, Mycobacterium
QSEGLRRFAALSGRSVGA

SEQ ID NO: 1077859 - protein, 34 aa, Mycobacterium; identical to SEQ ID NO: 850417

SEQ ID NO: 1077860 - protein, 26 aa, Mycobacterium
QSETTGLRFPLFVKAVAGGGGRGMRR

SEQ ID NO: 1077861 - protein, 24 aa, Mycobacterium
QSGEVWISFLIVAPKYVASVATDL

SEQ ID NO: 1077862 - protein, 26 aa, Mycobacterium
QSGSGRLLVVFQPHLYSRTKAFAAEF

SEQ ID NO: 1077863 - protein, 25 aa, Mycobacterium
QSGSIGLGFAIPVDQAKRIADELIS

SEQ ID NO: 1077864 - protein, 37 aa, Mycobacterium
QSGSILCDPWVNPAYFASWFPFPDNSALDWDAIGDCD

SEQ ID NO: 1077865 - protein, 18 aa, Mycobacterium
QSKLLPLIGNAKTRRSRS

SEQ ID NO: 1077866 - protein, 24 aa, Mycobacterium
QSKSAGIWVSSLLGLPSSARVLEV

SEQ ID NO: 1077867 - protein, 21 aa, Mycobacterium
QSLAQSWRRQIGPPRQLPADS

SEQ ID NO: 1077868 - protein, 19 aa, Mycobacterium
QSLAVAATLHECGVRPGDA

SEQ ID NO: 1077869 - protein, 17 aa, Mycobacterium
QSLRYVFCGGEPLSLAT

SEQ ID NO: 1077870 - protein, 26 aa, Mycobacterium
QSLVPMLSMRLAFFDHLIDISRLGEL

SEQ ID NO: 1077871 - protein, 18 aa, Mycobacterium
QSNWLPAPLGPLGVTMRL

SEQ ID NO: 1077872 - protein, 27 aa, Mycobacterium
QSPKETWLRLLLLDDGLPRPQTQIRVA

SEQ ID NO: 1077873 - protein, 24 aa, Mycobacterium
QSRKGLISSWKAFAPAWAGKVAIE

SEQ ID NO: 1077874 - protein, 22 aa, Mycobacterium
QSRYRVFIIDEAHMVTTAGFNA

SEQ ID NO: 1077875 - protein, 22 aa, Mycobacterium
QSSGLSAITRSKSGWTGGADPR

SEQ ID NO: 1077876 - protein, 26 aa, Mycobacterium
QSSLELAHRFFMPLGDHMREAMADLS

SEQ ID NO: 1077877 - protein, 21 aa, Mycobacterium
QSSVRGLLRVAGRTFRVQRAT

SEQ ID NO: 1077878 - protein, 24 aa, Mycobacterium
QSTYYWCDSIIIILTTLAQLNRDH

SEQ ID NO: 1077879 - protein, 19 aa, Mycobacterium
QSWGIGRWSPLGEKVLGSP

SEQ ID NO: 1077880 - protein, 28 aa, Mycobacterium
QSYVDAHVPYLTWLTKTSADYAVTAAEH

SEQ ID NO: 1077881 - protein, 36 aa, Mycobacterium
QTAAQELLAVINTPTQTLLGRPLIGNGADGALGQAG

SEQ ID NO: 1077882 - protein, 20 aa, Mycobacterium
QTAIFAFPYDVEAVAKIATL

SEQ ID NO: 1077883 - protein, 26 aa, Mycobacterium
QTALGEGWFINQHIIWQVGDEDVAEM

SEQ ID NO: 1077884 - protein, 31 aa, Mycobacterium
QTCLATRRYVRRQRSWFRRDRRVRWLDATVS

SEQ ID NO: 1077885 - protein, 17 aa, Mycobacterium
QTCRTEVFFFPAASHVE

SEQ ID NO: 1077886 - protein, 26 aa, Mycobacterium
QTDDAALPLTYRFEPAPPMTASRCTC

SEQ ID NO: 1077887 - protein, 24 aa, Mycobacterium
QTDSERVFALITAAIRTHDGGVSA

SEQ ID NO: 1077888 - protein, 24 aa, Mycobacterium
QTEALFRGIGLAASKYWVCKRSTP

SEQ ID NO: 1077889 - protein, 27 aa, Mycobacterium
QTEAQMVRLLVYYAAWHLDRNHHMEVS

SEQ ID NO: 1077890 - protein, 17 aa, Mycobacterium
QTEEVFAARLPGDPARY

SEQ ID NO: 1077891 - protein, 27 aa, Mycobacterium
QTEGMLSPWLGLPGAADQIATWSKASG

SEQ ID NO: 1077892 - protein, 22 aa, Mycobacterium
QTEVSFITLYRDQPRFGDVDLE

SEQ ID NO: 1077893 - protein, 18 aa, Mycobacterium
QTGAPLPTLADAVLPLRW

SEQ ID NO: 1077894 - protein, 25 aa, Mycobacterium
QTGATLFPHLTFDPLRTLQAIERHR

SEQ ID NO: 1077895 - protein, 23 aa, Mycobacterium
QTGETFVFIEQWADAEALTAHST

SEQ ID NO: 1077896 - protein, 25 aa, Mycobacterium
QTGRAVLVLLLDALVEWVRVAKMMD

SEQ ID NO: 1077897 - protein, 26 aa, Mycobacterium
QTKDIPVYRFVLRAYAAQLVQNHANL

SEQ ID NO: 1077898 - protein, 33 aa, Mycobacterium; identical to SEQ ID NO: 221843

SEQ ID NO: 1077899 - protein, 27 aa, Mycobacterium
QTLATITLQNYFRLYNKHAGMTGTAQT

SEQ ID NO: 1077900 - protein, 17 aa, Mycobacterium
QTLEQQLLGVFNAPTNA

SEQ ID NO: 1077901 - protein, 17 aa, Mycobacterium
QTLFEICARLTTKHGIC

SEQ ID NO: 1077902 - protein, 21 aa, Mycobacterium
QTLIGFLAPRNADYSIGALKQ

SEQ ID NO: 1077903 - protein, 17 aa, Mycobacterium
QTLLRTVLAPMFASRAM

SEQ ID NO: 1077904 - protein, 18 aa, Mycobacterium
QTLPVLPCHVGNPDLWFA

SEQ ID NO: 1077905 - protein, 17 aa, Mycobacterium
QTLVLYRPDPDGDEVLG

SEQ ID NO: 1077906 - protein, 25 aa, Mycobacterium
QTMVQPGLLSWRDVARVMSENPARI

SEQ ID NO: 1077907 - protein, 30 aa, Mycobacterium
QTNNSVFSFPMEFTPFPPPQQSWQLSKRTA

SEQ ID NO: 1077908 - protein, 17 aa, Mycobacterium
QTNPLLGVASQLLMLAG

SEQ ID NO: 1077909 - protein, 21 aa, Mycobacterium
QTPSQWGAAAAALLQRHVDLL

SEQ ID NO: 1077910 - protein, 21 aa, Mycobacterium
QTRIWWGAYLGTEDELLVAGT

SEQ ID NO: 1077911 - protein, 37 aa, Mycobacterium
QTSVPVQVLVPRKDMFVTPALQRFTGAIPGGGRVVPI

SEQ ID NO: 1077912 - protein, 22 aa, Mycobacterium
QTTQRMLTRLGAPQRTAHFADT

SEQ ID NO: 1077913 - protein, 27 aa, Mycobacterium
QTTRRFDALKIFLTLRALGERRIGAMI

SEQ ID NO: 1077914 - protein, 31 aa, Mycobacterium; identical to SEQ ID NO: 850672

SEQ ID NO: 1077915 - protein, 23 aa, Mycobacterium
QTVFHIHLHVLPRRDGDKLSVAK

SEQ ID NO: 1077916 - protein, 18 aa, Mycobacterium
QVAAFAVAMKMKVPTAGE

SEQ ID NO: 1077917 - protein, 19 aa, Mycobacterium
QVAALLGCAVLTGGGAVLN

SEQ ID NO: 1077918 - protein, 26 aa, Mycobacterium
QVAFFGDNIPLLLKGLTRVGNRGAYG

SEQ ID NO: 1077919 - protein, 22 aa, Mycobacterium
QVARAYVTALRDLLRALDVSDV

SEQ ID NO: 1077920 - protein, 25 aa, Mycobacterium
QVARLWEHWGKPDIVWYPGGHTGFF

SEQ ID NO: 1077921 - protein, 31 aa, Mycobacterium; identical to SEQ ID NO: 850716

SEQ ID NO: 1077922 - protein, 22 aa, Mycobacterium
QVCPVCLGLPGSLPVLNRVAVE

SEQ ID NO: 1077923 - protein, 19 aa, Mycobacterium
QVEIARFCSAPRVRLTQTP

SEQ ID NO: 1077924 - protein, 26 aa, Mycobacterium
QVEPQAFLFQLLDPAIRADPYPLCAR

SEQ ID NO: 1077925 - protein, 19 aa, Mycobacterium
QVFELGTAPDFPTSVEIAV

SEQ ID NO: 1077926 - protein, 20 aa, Mycobacterium
QVFGMAEGLLNFTRLEDPPD

SEQ ID NO: 1077927 - protein, 18 aa, Mycobacterium
QVFIGMRTSDVLTHAWDL

SEQ ID NO: 1077928 - protein, 24 aa, Mycobacterium
QVFPKLGLSHSFIRVPQAQMDDYA

SEQ ID NO: 1077929 - protein, 27 aa, Mycobacterium
QVFRDYGYRRLRAKARIKFLVKDWGVE

SEQ ID NO: 1077930 - protein, 27 aa, Mycobacterium
QVGIADLPWPAAGEWLAAVRASPLVGS

SEQ ID NO: 1077931 - protein, 20 aa, Mycobacterium
QVGYRDLAGFGRRFIDVDPE

SEQ ID NO: 1077932 - protein, 20 aa, Mycobacterium
QVHFSLAHPGPLDDLVPFAE

SEQ ID NO: 1077933 - protein, 18 aa, Mycobacterium
QVIELHDCFSANELLLYE

SEQ ID NO: 1077934 - protein, 26 aa, Mycobacterium
QVIERLRKWVTFTPLQNVTGDPAISL

SEQ ID NO: 1077935 - protein, 25 aa, Mycobacterium
QVIVYRRLELPLDEIARLLDEGNAV

SEQ ID NO: 1077936 - protein, 17 aa, Mycobacterium
QVLDGDLDALFDALAAA

SEQ ID NO: 1077937 - protein, 23 aa, Mycobacterium
QVLIPAPDYPLWTASTSLAGGTP

SEQ ID NO: 1077938 - protein, 19 aa, Mycobacterium
QVLRALDGHFIAVGPSGSP

SEQ ID NO: 1077939 - protein, 29 aa, Mycobacterium
QVLSAFKVPTVWLLLADDADIPRGPTGKV

SEQ ID NO: 1077940 - protein, 23 aa, Mycobacterium
QVMPVKMPSWLGVPARLVMASLI

SEQ ID NO: 1077941 - protein, 17 aa, Mycobacterium
QVMRRLWKGEMVFNHDG

SEQ ID NO: 1077942 - protein, 24 aa, Mycobacterium
QVNLNLAMLTLMQKNLQGTIFGGG

SEQ ID NO: 1077943 - protein, 23 aa, Mycobacterium
QVNRIILTRPAVEAGERLGFLPG

SEQ ID NO: 1077944 - protein, 27 aa, Mycobacterium
QVNRKVLPGYILVRMDLTDDSWAAVRN

SEQ ID NO: 1077945 - protein, 18 aa, Mycobacterium
QVRERLALGFGSSSFRYA

SEQ ID NO: 1077946 - protein, 31 aa, Mycobacterium; identical to SEQ ID NO: 116941

SEQ ID NO: 1077947 - protein, 19 aa, Mycobacterium
QVRLAVIQRLSWIKRQRGR

SEQ ID NO: 1077948 - protein, 20 aa, Mycobacterium
QVRLKRMYPGGHYRATTSTV

SEQ ID NO: 1077949 - protein, 28 aa, Mycobacterium
QVSGFNSGFFNWGTANSGLFSLSKLAIK

SEQ ID NO: 1077950 - protein, 17 aa, Mycobacterium
QVTANYLLGLALAQARG

SEQ ID NO: 1077951 - protein, 18 aa, Mycobacterium
QVVIGYDMRDSSPALAAA

SEQ ID NO: 1077952 - protein, 19 aa, Mycobacterium
QVVVPPFKSKAILGRPNGA

SEQ ID NO: 1077953 - protein, 19 aa, Mycobacterium
QWHAQRARIWARAISTELG

SEQ ID NO: 1077954 - protein, 17 aa, Mycobacterium
QWSAQNLDFLVAVARSC

SEQ ID NO: 1077955 - protein, 20 aa, Mycobacterium
QWWQQQVVLGLQRRGFPMHA

SEQ ID NO: 1077956 - protein, 19 aa, Mycobacterium
QYDFRLLVDDAHGIGVLGP

SEQ ID NO: 1077957 - protein, 21 aa, Mycobacterium
QYDIPHLLSMYKARNLNIDDM

SEQ ID NO: 1077958 - protein, 20 aa, Mycobacterium
QYFHVTPWVAWTDAGPRGQM

SEQ ID NO: 1077959 - protein, 31 aa, Mycobacterium
QYGALIGLVQGLLMMRHMMFVGYSLQDEDFH

SEQ ID NO: 1077960 - protein, 25 aa, Mycobacterium
QYGKTWRTLAKLSLPNKYLRDNADD

SEQ ID NO: 1077961 - protein, 18 aa, Mycobacterium
QYSWLPFGRNVAASPVRY

SEQ ID NO: 1077962 - protein, 17 aa, Mycobacterium
QYVEIWVGVLRQLDPGL

SEQ ID NO: 1077963 - protein, 18 aa, Mycobacterium
QYVGIPILRLHDTIYRKT

SEQ ID NO: 1077964 - protein, 31 aa, Mycobacterium
RAAALGCESLREDLWRLVDMKVESVIAIDDR

SEQ ID NO: 1077965 - protein, 24 aa, Mycobacterium
RAAATRWAARLAPYGLRWYEEPGD

SEQ ID NO: 1077966 - protein, 30 aa, Mycobacterium; identical to SEQ ID NO: 851067

SEQ ID NO: 1077967 - protein, 25 aa, Mycobacterium
RAADHSKLWFAMAAGLLASRSQSAQ

SEQ ID NO: 1077968 - protein, 25 aa, Mycobacterium
RAADPVFMLTGPIPATRHALEKTGL

SEQ ID NO: 1077969 - protein, 17 aa, Mycobacterium
RAAFAEVVACHEALRTV

SEQ ID NO: 1077970 - protein, 22 aa, Mycobacterium
RAAFLLVNDLAVLTLRPRLIEV

SEQ ID NO: 1077971 - protein, 26 aa, Mycobacterium
RAAGHQAIKLTFVNPLITADLATGVI

SEQ ID NO: 1077972 - protein, 20 aa, Mycobacterium
RAAHPFGVAAPRIAASALTP

SEQ ID NO: 1077973 - protein, 17 aa, Mycobacterium
RAAHRHGAKVKWAEVDI

SEQ ID NO: 1077974 - protein, 24 aa, Mycobacterium
RAAIEWFGRWTPDTWVCAWTPATW

SEQ ID NO: 1077975 - protein, 21 aa, Mycobacterium
RAAISAFWDKAIEPTTRIEFF

SEQ ID NO: 1077976 - protein, 20 aa, Mycobacterium
RAAIWAVLVRDFFQAWVRRS

SEQ ID NO: 1077977 - protein, 21 aa, Mycobacterium
RAALTKLTLPSDNPLVGKRVS

SEQ ID NO: 1077978 - protein, 41 aa, Mycobacterium; identical to SEQ ID NO: 851131

SEQ ID NO: 1077979 - protein, 27 aa, Mycobacterium
RAAMNLTIPILLIRGKLSDVVTSEGVQ

SEQ ID NO: 1077980 - protein, 17 aa, Mycobacterium
RAAPPRAVAAAAATPAR

SEQ ID NO: 1077981 - protein, 22 aa, Mycobacterium
RAATVHPMLVAANRAQLVSLVQ

SEQ ID NO: 1077982 - protein, 18 aa, Mycobacterium
RACGYVHPALVPLQAIEL

SEQ ID NO: 1077983 - protein, 20 aa, Mycobacterium
RACHGFDSLLPEWTTSQRLF

SEQ ID NO: 1077984 - protein, 25 aa, Mycobacterium
RADEWLPIVPGTDAALLLAVAHTLF

SEQ ID NO: 1077985 - protein, 19 aa, Mycobacterium
RADLRRFLAQGRVEVMGGT

SEQ ID NO: 1077986 - protein, 24 aa, Mycobacterium
RADPVLAATPVLMLSARAGAEAVS

SEQ ID NO: 1077987 - protein, 25 aa, Mycobacterium
RADQDGYMYFTGRLSSLIKTAGANV

SEQ ID NO: 1077988 - protein, 25 aa, Mycobacterium
RADRDFVLRFRLDQGRLSSSALLVA

SEQ ID NO: 1077989 - protein, 23 aa, Mycobacterium
RADTPLLFLHNTTGYMVGKDYEE

SEQ ID NO: 1077990 - protein, 30 aa, Mycobacterium; identical to SEQ ID NO: 851238

SEQ ID NO: 1077991 - protein, 26 aa, Mycobacterium
RADWDRHLRPMLARRYEIATGQRQAK

SEQ ID NO: 1077992 - protein, 18 aa, Mycobacterium
RAEARARHGWIMDTYLIR

SEQ ID NO: 1077993 - protein, 25 aa, Mycobacterium
RAEESAFVLLALQAPVAGDLRAIMS

SEQ ID NO: 1077994 - protein, 19 aa, Mycobacterium
RAEFQRITQDLLDRTRKPF

SEQ ID NO: 1077995 - protein, 24 aa, Mycobacterium
RAEGLPFVAELLATGGPFPQRLHL

SEQ ID NO: 1077996 - protein, 29 aa, Mycobacterium
RAEKFRALMSQRIPLYRRVSTIRVDTNRR

SEQ ID NO: 1077997 - protein, 26 aa, Mycobacterium
RAELPYNTLSFLWRELAGFSRDDWAL

SEQ ID NO: 1077998 - protein, 30 aa, Mycobacterium; identical to SEQ ID NO: 717200

SEQ ID NO: 1077999 - protein, 24 aa, Mycobacterium
RAERAELIDWLFGQGITAAEIRTT

SEQ ID NO: 1078000 - protein, 19 aa, Mycobacterium
RAESVQHTWFGLSALAERV

SEQ ID NO: 1078001 - protein, 31 aa, Mycobacterium; identical to SEQ ID NO: 851302

SEQ ID NO: 1078002 - protein, 18 aa, Mycobacterium
RAETPPALPFPQTPGAAA

SEQ ID NO: 1078003 - protein, 23 aa, Mycobacterium
RAEVLPLLEEVLGGGVAAALART

SEQ ID NO: 1078004 - protein, 27 aa, Mycobacterium
RAFSDDLVLLPASSIPVPGPVGVLDTL

SEQ ID NO: 1078005 - protein, 18 aa, Mycobacterium
RAGALPYAALSAAGDMVS

SEQ ID NO: 1078006 - protein, 32 aa, Mycobacterium; identical to SEQ ID NO: 851333

SEQ ID NO: 1078007 - protein, 18 aa, Mycobacterium
RAGEKVVMFYASGNWDED

SEQ ID NO: 1078008 - protein, 19 aa, Mycobacterium
RAGGFKHRAKVEISWVGSD

SEQ ID NO: 1078009 - protein, 24 aa, Mycobacterium
RAGHAAVVPVLPLTDTIKAVDANG

SEQ ID NO: 1078010 - protein, 23 aa, Mycobacterium
RAGHQLKFWTPGGSSTPLLTDEH

SEQ ID NO: 1078011 - protein, 26 aa, Mycobacterium
RAGIDMTKLPSFMWLDVDDVIQESLA

SEQ ID NO: 1078012 - protein, 23 aa, Mycobacterium
RAGIPPFYVMDVWLAAAERQRTH

SEQ ID NO: 1078013 - protein, 18 aa, Mycobacterium
RAGLAARPPLITAKPAKL

SEQ ID NO: 1078014 - protein, 22 aa, Mycobacterium
RAGLKAIYLSGWQVAGDANLSG

SEQ ID NO: 1078015 - protein, 17 aa, Mycobacterium
RAGLLIGNAGAGGAGGE

SEQ ID NO: 1078016 - protein, 17 aa, Mycobacterium
RAGLPMDLVPATLTSVV

SEQ ID NO: 1078017 - protein, 23 aa, Mycobacterium
RAGLTKSYLSKIERGQSTPSIAV

SEQ ID NO: 1078018 - protein, 23 aa, Mycobacterium
RAGLTTCLEMAFDPGFRPLVEQL

SEQ ID NO: 1078019 - protein, 25 aa, Mycobacterium
RAGMLALLDGLHAQGFVAASQSARE

SEQ ID NO: 1078020 - protein, 21 aa, Mycobacterium
RAGPYGMPILDDAAAWFVGKI

SEQ ID NO: 1078021 - protein, 26 aa, Mycobacterium
RAGRSGAALLFVSPRERHLLKLIEKA

SEQ ID NO: 1078022 - protein, 25 aa, Mycobacterium
RAGVFLRAADLLAGPWREKIAAATM

SEQ ID NO: 1078023 - protein, 26 aa, Mycobacterium
RAGVGTLVMTHYVPAIIAGQEDQWRA

SEQ ID NO: 1078024 - protein, 19 aa, Mycobacterium
RAGVLRFVVLDGLAKPGRM

SEQ ID NO: 1078025 - protein, 26 aa, Mycobacterium
RAGVQRFVMISYFGAGPNHGVSVDDS

SEQ ID NO: 1078026 - protein, 19 aa, Mycobacterium
RAGYWRQVRAQLAVTPVML

SEQ ID NO: 1078027 - protein, 33 aa, Mycobacterium
RAHAIVLDRQNRPLRWLPLEELAKPQALAQVTR

SEQ ID NO: 1078028 - protein, 21 aa, Mycobacterium
RAHFAGIFGVGLPRGLREQAA

SEQ ID NO: 1078029 - protein, 27 aa, Mycobacterium
RAHGADMLLLIVAALDQSALVSMLDRT

SEQ ID NO: 1078030 - protein, 19 aa, Mycobacterium
RAHLHRVLSPHWETVLVAD

SEQ ID NO: 1078031 - protein, 20 aa, Mycobacterium
RAHRPVRTAVVAASLPELVE

SEQ ID NO: 1078032 - protein, 18 aa, Mycobacterium
RAHWKAHRLDLTPVLHEP

SEQ ID NO: 1078033 - protein, 29 aa, Mycobacterium
RAIAANFRDIMITLGMFTHDALIGGEGAG

SEQ ID NO: 1078034 - protein, 23 aa, Mycobacterium
RAIIAILAVLKVGAAYLPIDPDH

SEQ ID NO: 1078035 - protein, 22 aa, Mycobacterium
RAIMEEVLLPVMYDIPSRDDVA

SEQ ID NO: 1078036 - protein, 19 aa, Mycobacterium
RAIMVETLKFHQVQSGPHT

SEQ ID NO: 1078037 - protein, 20 aa, Mycobacterium
RAISPLAVQKYMPNGAAAAV

SEQ ID NO: 1078038 - protein, 20 aa, Mycobacterium
RAIWFRGTEHRADPANMLLL

SEQ ID NO: 1078039 - protein, 24 aa, Mycobacterium
RAKHALFDRLVYHKLRAALGGDCH

SEQ ID NO: 1078040 - protein, 18 aa, Mycobacterium
RAKLTEALQCRWTEVALW

SEQ ID NO: 1078041 - protein, 18 aa, Mycobacterium
RAKPRPHRLKPVQNPLKG

SEQ ID NO: 1078042 - protein, 17 aa, Mycobacterium
RAKQLAHQYYGRLIADP

SEQ ID NO: 1078043 - protein, 17 aa, Mycobacterium
RAKSWYERLNAEDPNRK

SEQ ID NO: 1078044 - protein, 30 aa, Mycobacterium
RALAFPTRMFTVLFALGRLPGWIAHWREMH

SEQ ID NO: 1078045 - protein, 28 aa, Mycobacterium
RALELGCGTGFFLLNLIQAGVARRGSVT

SEQ ID NO: 1078046 - protein, 19 aa, Mycobacterium
RALEPWSFGIYAGGQSILI

SEQ ID NO: 1078047 - protein, 19 aa, Mycobacterium
RALGLRPRARIVSQALVGA

SEQ ID NO: 1078048 - protein, 19 aa, Mycobacterium
RALLAATDLPVVETFQAAG

SEQ ID NO: 1078049 - protein, 17 aa, Mycobacterium
RALLPKLIASGDGLIVT

SEQ ID NO: 1078050 - protein, 28 aa, Mycobacterium
RALVDLNNWSLLKWLDEPCSFYDWRRSE

SEQ ID NO: 1078051 - protein, 18 aa, Mycobacterium
RALVLGCAMDWLADNQAS

SEQ ID NO: 1078052 - protein, 27 aa, Mycobacterium
RAMAPDRPFFAYWAPGATHAPHHVAPE

SEQ ID NO: 1078053 - protein, 18 aa, Mycobacterium
RAMEQYLLELLNLSPEEL

SEQ ID NO: 1078054 - protein, 20 aa, Mycobacterium
RAMLFLLATAKLNQAERFGV

SEQ ID NO: 1078055 - protein, 24 aa, Mycobacterium
RAMQLFGPIYRRSIARRGDEKMLR

SEQ ID NO: 1078056 - protein, 22 aa, Mycobacterium
RANIIVPAMPIWMGVRSSVMQR

SEQ ID NO: 1078057 - protein, 23 aa, Mycobacterium
RANILVLCGPIWLGDNSSVMKLV

SEQ ID NO: 1078058 - protein, 17 aa, Mycobacterium
RANSWQSLPGIGPKTAK

SEQ ID NO: 1078059 - protein, 17 aa, Mycobacterium
RAPAELLAGYYHAVHAL

SEQ ID NO: 1078060 - protein, 19 aa, Mycobacterium
RAPAYIYFTSGSTGRPKPV

SEQ ID NO: 1078061 - protein, 19 aa, Mycobacterium
RAPESVQINWVYRGGRADL

SEQ ID NO: 1078062 - protein, 20 aa, Mycobacterium
RAPFAMNRIATRTAIRLPCA

SEQ ID NO: 1078063 - protein, 17 aa, Mycobacterium
RAPIPVYGPGPAGGLPP

SEQ ID NO: 1078064 - protein, 20 aa, Mycobacterium
RAQACLLIMSNIFGQNSTAI

SEQ ID NO: 1078065 - protein, 25 aa, Mycobacterium
RAQHGVMELLLINHPLDCPMCDKGG

SEQ ID NO: 1078066 - protein, 23 aa, Mycobacterium
RAQIETLLHRYPTRRWIRRARRA

SEQ ID NO: 1078067 - protein, 18 aa, Mycobacterium
RAQLQLPADWEPLGAIAI

SEQ ID NO: 1078068 - protein, 22 aa, Mycobacterium
RAQLRAIFGELLVQLPDIQAGD

SEQ ID NO: 1078069 - protein, 20 aa, Mycobacterium
RAQLVRLPWDYRRVYGVDPA

SEQ ID NO: 1078070 - protein, 17 aa, Mycobacterium
RAQPAVYVIEDAHWMDE

SEQ ID NO: 1078071 - protein, 25 aa, Mycobacterium
RAQPSHWRRNLMACSGIEFCKLSFA

SEQ ID NO: 1078072 - protein, 25 aa, Mycobacterium
RAQRRLPDTPVLPPLDVAASAELLV

SEQ ID NO: 1078073 - protein, 22 aa, Mycobacterium
RARAILAKVPTPNDAVLVAVSP

SEQ ID NO: 1078074 - protein, 20 aa, Mycobacterium
RARALAYFAALTFSADDPRR

SEQ ID NO: 1078075 - protein, 27 aa, Mycobacterium
RARENALLERGLLPSPLLLDSPGVDIV

SEQ ID NO: 1078076 - protein, 21 aa, Mycobacterium
RARFWHGWISSDLTRPAFESV

SEQ ID NO: 1078077 - protein, 22 aa, Mycobacterium
RARFWHGWISSDLTRPAFESVE

SEQ ID NO: 1078078 - protein, 24 aa, Mycobacterium
RARHALFDRLVYEKLRSALGGDCH

SEQ ID NO: 1078079 - protein, 22 aa, Mycobacterium
RARHELDLLPDVPGRQALAALV

SEQ ID NO: 1078080 - protein, 25 aa, Mycobacterium
RARHRGCTLLVTDGDWEGAPTRLEA

SEQ ID NO: 1078081 - protein, 20 aa, Mycobacterium
RARHVIVYRTIQMLGGTVAL

SEQ ID NO: 1078082 - protein, 20 aa, Mycobacterium
RARLARLLSYLDADINAVDM

SEQ ID NO: 1078083 - protein, 18 aa, Mycobacterium
RARMQQRWPVVMVDEFQD

SEQ ID NO: 1078084 - protein, 19 aa, Mycobacterium
RARNPKLIYARLSAFGGNG

SEQ ID NO: 1078085 - protein, 19 aa, Mycobacterium
RARRALAEFQVEGLATVIP

SEQ ID NO: 1078086 - protein, 20 aa, Mycobacterium
RARRLARALHQWGFGASRER

SEQ ID NO: 1078087 - protein, 17 aa, Mycobacterium
RARRMLGAVPYAENVPL

SEQ ID NO: 1078088 - protein, 19 aa, Mycobacterium
RARRPMFASKLTGIPPDLA

SEQ ID NO: 1078089 - protein, 25 aa, Mycobacterium
RARTWSRRWAGFYPTEKEAAPLEVA

SEQ ID NO: 1078090 - protein, 18 aa, Mycobacterium
RARVQRLLDPGTFRELGT

SEQ ID NO: 1078091 - protein, 28 aa, Mycobacterium
RARYWPKLVDMYPSWTCIPPMRTTSPGP

SEQ ID NO: 1078092 - protein, 25 aa, Mycobacterium
RASAGSIFAIPVIVAPDTSAALGAL

SEQ ID NO: 1078093 - protein, 27 aa, Mycobacterium
RASCKYMKMITPAALLRCLVEGADEVH

SEQ ID NO: 1078094 - protein, 24 aa, Mycobacterium
RASEELTLWASTQTPHELRAFCAR

SEQ ID NO: 1078095 - protein, 17 aa, Mycobacterium
RASGSRGPYLPQAVIAA

SEQ ID NO: 1078096 - protein, 25 aa, Mycobacterium
RASIRTWMFRVVLNQVHTLARKEAN

SEQ ID NO: 1078097 - protein, 31 aa, Mycobacterium
RASLESYARYWREAFRLPSMNLRKVAAQIDS

SEQ ID NO: 1078098 - protein, 25 aa, Mycobacterium
RASLRPAQRWMLSAGVLSVIGSIVD

SEQ ID NO: 1078099 - protein, 23 aa, Mycobacterium
RASVPLVPGETLLESARRAGLDP

SEQ ID NO: 1078100 - protein, 18 aa, Mycobacterium
RASYWDIVATLDASVSDP

SEQ ID NO: 1078101 - protein, 17 aa, Mycobacterium
RATALRRAGPSMGPRRL

SEQ ID NO: 1078102 - protein, 35 aa, Mycobacterium; identical to SEQ ID NO: 851888

SEQ ID NO: 1078103 - protein, 20 aa, Mycobacterium
RATLGRPIELAFDTTRLTVF

SEQ ID NO: 1078104 - protein, 24 aa, Mycobacterium
RATRRAIPIDLRGDWPVALRAAGL

SEQ ID NO: 1078105 - protein, 26 aa, Mycobacterium
RATVDQLLTIPLAKELAWAPEEIREE

SEQ ID NO: 1078106 - protein, 26 aa, Mycobacterium
RATVDQLLTIPLAKKLAWAPEEIREE

SEQ ID NO: 1078107 - protein, 19 aa, Mycobacterium
RATVLIFPDLNTGNNTYKA

SEQ ID NO: 1078108 - protein, 28 aa, Mycobacterium
RATVRPSVRLLILDVAYTTQLIGTLVGV

SEQ ID NO: 1078109 - protein, 20 aa, Mycobacterium
RAVAGLLVPPGDGPWRLGMS

SEQ ID NO: 1078110 - protein, 21 aa, Mycobacterium
RAVAPVPFLSSAVLATVALLH

SEQ ID NO: 1078111 - protein, 29 aa, Mycobacterium
RAVAVNFPDVLFIAGKYQIKIPPPFVPGN

SEQ ID NO: 1078112 - protein, 20 aa, Mycobacterium
RAVFVLLRELADVILVGAGT

SEQ ID NO: 1078113 - protein, 18 aa, Mycobacterium
RAVGPGGLFLALPGARAD

SEQ ID NO: 1078114 - protein, 26 aa, Mycobacterium
RAVLAALPDAVVVRSAWVYTGGTGSD

SEQ ID NO: 1078115 - protein, 21 aa, Mycobacterium
RAVLVYPPGLDFVCGLLGCMA

SEQ ID NO: 1078116 - protein, 26 aa, Mycobacterium
RAVQTAAPAALVRRAKTARQAPTPTA

SEQ ID NO: 1078117 - protein, 21 aa, Mycobacterium
RAVRDLLADIGLSTLPLTSGS

SEQ ID NO: 1078118 - protein, 17 aa, Mycobacterium
RAVRFNLYRGGSETIDE

SEQ ID NO: 1078119 - protein, 18 aa, Mycobacterium
RAVVGHRRSLLPAGITAV

SEQ ID NO: 1078120 - protein, 21 aa, Mycobacterium
RAVVIYLEYLGITLGELLDAR

SEQ ID NO: 1078121 - protein, 17 aa, Mycobacterium
RAWLNRQLRPIGARPRR

SEQ ID NO: 1078122 - protein, 25 aa, Mycobacterium
RAYLDFGEPLPLRKRLEELRTDESG

SEQ ID NO: 1078123 - protein, 19 aa, Mycobacterium
RAYLDGLWEHRRVARLLAS

SEQ ID NO: 1078124 - protein, 17 aa, Mycobacterium
RAYNKFRRGPGAFKVDF

SEQ ID NO: 1078125 - protein, 20 aa, Mycobacterium
RAYREIFAGLYTDPDAVLNT

SEQ ID NO: 1078126 - protein, 17 aa, Mycobacterium
RCFQDNALLKSVLSQPG

SEQ ID NO: 1078127 - protein, 26 aa, Mycobacterium
RCGGKPLAGPGWYYPPTVITDITKDM

SEQ ID NO: 1078128 - protein, 33 aa, Mycobacterium
RCHRRPIPVSLLGRYLGLIPKLKPVRTSRTSTR

SEQ ID NO: 1078129 - protein, 17 aa, Mycobacterium
RCIVGGFDRVFELNRVF

SEQ ID NO: 1078130 - protein, 25 aa, Mycobacterium
RCNLRCGYCMPAEGLNWLPGEQLLG

SEQ ID NO: 1078131 - protein, 17 aa, Mycobacterium
RCPPCPSAGLRRYPQSH

SEQ ID NO: 1078132 - protein, 20 aa, Mycobacterium
RCQGHTLCAMIAPDSFQLSD

SEQ ID NO: 1078133 - protein, 35 aa, Mycobacterium
RCRRWAIGTGHPRPRRIWLPTSAAVRCWCCLASWP

SEQ ID NO: 1078134 - protein, 17 aa, Mycobacterium
RCRWSVVHHSWTTRPAD

SEQ ID NO: 1078135 - protein, 32 aa, Mycobacterium
RCSELNLLALLASHGMLLALDLDIPVTSLDLS

SEQ ID NO: 1078136 - protein, 17 aa, Mycobacterium
RCVAVLFAALHGDTNLR

SEQ ID NO: 1078137 - protein, 18 aa, Mycobacterium
RCYGLPGVYSYLPGLTNV

SEQ ID NO: 1078138 - protein, 21 aa, Mycobacterium
RDADWFVWYEHGGLGYFWQAV

SEQ ID NO: 1078139 - protein, 18 aa, Mycobacterium
RDAFAMFYDHTCTRVYGL

SEQ ID NO: 1078140 - protein, 29 aa, Mycobacterium
RDAFNLAINALLAIGFEWGIALRHLEARD

SEQ ID NO: 1078141 - protein, 30 aa, Mycobacterium; identical to SEQ ID NO: 852137

SEQ ID NO: 1078142 - protein, 22 aa, Mycobacterium
RDALRLRHYVLTAAADAAAGSN

SEQ ID NO: 1078143 - protein, 24 aa, Mycobacterium
RDAMPTFRQVFLAGASDMALERRC

SEQ ID NO: 1078144 - protein, 26 aa, Mycobacterium
RDANDLVPPVLFGPAMRAMTAVAASD

SEQ ID NO: 1078145 - protein, 26 aa, Mycobacterium
RDARLFRSELSMPLILLDGITNRETM

SEQ ID NO: 1078146 - protein, 18 aa, Mycobacterium
RDDLLLVAGMRVSQREKL

SEQ ID NO: 1078147 - protein, 25 aa, Mycobacterium
RDDLQTVIAMLKQADLDVALQFVNY

SEQ ID NO: 1078148 - protein, 18 aa, Mycobacterium
RDDLSYHAELDWWTSPFV

SEQ ID NO: 1078149 - protein, 24 aa, Mycobacterium
RDDPQRVAQLHRTAALWLKEHDRL

SEQ ID NO: 1078150 - protein, 29 aa, Mycobacterium
RDEAGQDVLLFIDNIFRFTQAGSEVSTLL

SEQ ID NO: 1078151 - protein, 18 aa, Mycobacterium
RDEDGRWGLGPAITELAA

SEQ ID NO: 1078152 - protein, 19 aa, Mycobacterium
RDEDKVVWLSQTTLSVDET

SEQ ID NO: 1078153 - protein, 25 aa, Mycobacterium
RDEGIASNTLWPRTLVATAAVQNLL

SEQ ID NO: 1078154 - protein, 25 aa, Mycobacterium
RDELGDWRVILHSPYGLRVHGPLAL

SEQ ID NO: 1078155 - protein, 28 aa, Mycobacterium
RDELRSLLRFVLDLLSDYGLTDFYLELS

SEQ ID NO: 1078156 - protein, 27 aa, Mycobacterium
RDETTRPLVICDLGMPRDVDPAVAGLP

SEQ ID NO: 1078157 - protein, 20 aa, Mycobacterium
RDEWLHRRFGDLVRLIFALV

SEQ ID NO: 1078158 - protein, 21 aa, Mycobacterium
RDEWQALYEFSTLTRPQVDLR

SEQ ID NO: 1078159 - protein, 25 aa, Mycobacterium
RDGAEWIHLVDLDAAFGRGSNRELL

SEQ ID NO: 1078160 - protein, 33 aa, Mycobacterium; identical to SEQ ID NO: 852305

SEQ ID NO: 1078161 - protein, 26 aa, Mycobacterium
RDGDSWRLNGFKWFASNCAGQAFVVL

SEQ ID NO: 1078162 - protein, 27 aa, Mycobacterium
RDGSDAMRWFLMASPILRGGNLIVTEQ

SEQ ID NO: 1078163 - protein, 25 aa, Mycobacterium
RDHQPKMIIAGWSAYPRQLDFARFR

SEQ ID NO: 1078164 - protein, 28 aa, Mycobacterium
RDHTRYIYIYIYIYIYITTDPTEAIAYA

SEQ ID NO: 1078165 - protein, 22 aa, Mycobacterium
RDHTYFLNFDTIGSPELIMLEG

SEQ ID NO: 1078166 - protein, 19 aa, Mycobacterium
RDHYTINAFIPLPRGEGDP

SEQ ID NO: 1078167 - protein, 17 aa, Mycobacterium
RDIDVAAFLPHSPLRVY

SEQ ID NO: 1078168 - protein, 26 aa, Mycobacterium
RDIQVRGYTLRLPLDVLVVASANPED

SEQ ID NO: 1078169 - protein, 20 aa, Mycobacterium
RDLEGRMFACFAAGALAAGC

SEQ ID NO: 1078170 - protein, 20 aa, Mycobacterium
RDNCHYCTFVTVPGKLRAQG

SEQ ID NO: 1078171 - protein, 23 aa, Mycobacterium
RDNGYLPMTFTANNIAWSNKNPS

SEQ ID NO: 1078172 - protein, 24 aa, Mycobacterium
RDNVSLFDYWRNGYQTLHGMTSRG

SEQ ID NO: 1078173 - protein, 24 aa, Mycobacterium
RDPDYKFVLAEVDYLKPYWDTHPQ

SEQ ID NO: 1078174 - protein, 28 aa, Mycobacterium
RDPDYPAALYANYLPRYLRGISDDADAL

SEQ ID NO: 1078175 - protein, 50 aa, Mycobacterium; identical to SEQ ID NO: 852492

SEQ ID NO: 1078176 - protein, 26 aa, Mycobacterium
RDPVVLARLLSLLRELAWTARLPVHR

SEQ ID NO: 1078177 - protein, 21 aa, Mycobacterium
RDPYLMNLLANPGTSLNETAF

SEQ ID NO: 1078178 - protein, 18 aa, Mycobacterium
RDQKLFAEVALPEQVSAQ

SEQ ID NO: 1078179 - protein, 17 aa, Mycobacterium
RDRAKMLSLLWQSLRRQ

SEQ ID NO: 1078180 - protein, 20 aa, Mycobacterium
RDRCPADLFAALLASQNPPV

SEQ ID NO: 1078181 - protein, 21 aa, Mycobacterium
RDRMAFRRASYWDIVATLDAS

SEQ ID NO: 1078182 - protein, 29 aa, Mycobacterium
RDRPTAWLAEGLLPYLPGDAQDRLFEMIT

SEQ ID NO: 1078183 - protein, 22 aa, Mycobacterium
RDRQHLASRLAYSETVFVDLPA

SEQ ID NO: 1078184 - protein, 26 aa, Mycobacterium
RDRVRPCLPVRTWAPVASPSISRHWR

SEQ ID NO: 1078185 - protein, 18 aa, Mycobacterium
RDSLFSHPPMVLTPSVRP

SEQ ID NO: 1078186 - protein, 24 aa, Mycobacterium
RDSLGPITILVNNAAFTAPGRPPV

SEQ ID NO: 1078187 - protein, 19 aa, Mycobacterium
RDSPVRVLLVTLADDDHYL

SEQ ID NO: 1078188 - protein, 24 aa, Mycobacterium
RDSSELIRDLGFDSLAFASTVSEI

SEQ ID NO: 1078189 - protein, 20 aa, Mycobacterium
RDTTYLYRDGSDFVFMDSQD

SEQ ID NO: 1078190 - protein, 19 aa, Mycobacterium
RDVELLALAQLIGAAGTLV

SEQ ID NO: 1078191 - protein, 28 aa, Mycobacterium
RDVGGAIMDMLFPPGTQARVPIAALTGT

SEQ ID NO: 1078192 - protein, 30 aa, Mycobacterium
RDVNKAQIYAWRKGIKTLYYIRLRQMALEG

SEQ ID NO: 1078193 - protein, 36 aa, Mycobacterium; identical to SEQ ID NO: 852628

SEQ ID NO: 1078194 - protein, 35 aa, Mycobacterium; identical to SEQ ID NO: 117051

SEQ ID NO: 1078195 - protein, 18 aa, Mycobacterium
RDVRLLRLYEGTSEIQQL

SEQ ID NO: 1078196 - protein, 17 aa, Mycobacterium
RDWAAKGTLLLGVRVVI

SEQ ID NO: 1078197 - protein, 22 aa, Mycobacterium
RDWMLDHRDDLLTPLQLETGKS

SEQ ID NO: 1078198 - protein, 17 aa, Mycobacterium
RDWRVLSIMHLSDTPRP

SEQ ID NO: 1078199 - protein, 26 aa, Mycobacterium
RDYHIPQFVDVPLTEVYFADTFDELG

SEQ ID NO: 1078200 - protein, 21 aa, Mycobacterium
RDYVMALGYLQAPVVVAGDDH

SEQ ID NO: 1078201 - protein, 23 aa, Mycobacterium
RDYWAQWRAVRQPALLIEAGNSV

SEQ ID NO: 1078202 - protein, 29 aa, Mycobacterium
REAAHHRLFSHVPWLSSQLLGAVEAYAAG

SEQ ID NO: 1078203 - protein, 23 aa, Mycobacterium
REALEIMLRIWTEDQPWEHRGKY

SEQ ID NO: 1078204 - protein, 18 aa, Mycobacterium
REALFDAFRRGEIATLVV

SEQ ID NO: 1078205 - protein, 23 aa, Mycobacterium
REALLLTQLLGLSYTDAAAVCGC

SEQ ID NO: 1078206 - protein, 40 aa, Mycobacterium; identical to SEQ ID NO: 852702

SEQ ID NO: 1078207 - protein, 20 aa, Mycobacterium
REDPIYRRITQRWLEHPEEL

SEQ ID NO: 1078208 - protein, 27 aa, Mycobacterium
REELGALLLQVLFQARIAQDAPRRPFA

SEQ ID NO: 1078209 - protein, 19 aa, Mycobacterium
REELGDLLLQVLFHARIAE

SEQ ID NO: 1078210 - protein, 27 aa, Mycobacterium
REELPLIEEWLQFIGEKLPTGIKDEFD

SEQ ID NO: 1078211 - protein, 24 aa, Mycobacterium
REETPWPVIQEATKVGLYSPDFFA

SEQ ID NO: 1078212 - protein, 20 aa, Mycobacterium
REEVEPLEVVFPGCEFLPLN

SEQ ID NO: 1078213 - protein, 17 aa, Mycobacterium
REFASTIHQVSQILADE

SEQ ID NO: 1078214 - protein, 19 aa, Mycobacterium
REFDILVCTTIVETGLDIS

SEQ ID NO: 1078215 - protein, 20 aa, Mycobacterium
REFLGARFDAGLAWVHFPVG

SEQ ID NO: 1078216 - protein, 18 aa, Mycobacterium
REFNLKKMWLSPNGTIRN

SEQ ID NO: 1078217 - protein, 21 aa, Mycobacterium
REFQIVFSSLFPGGEGRLRLT

SEQ ID NO: 1078218 - protein, 18 aa, Mycobacterium
REGLQRLLPGPNAAVKAA

SEQ ID NO: 1078219 - protein, 20 aa, Mycobacterium
REGMMAFLEKRPPVFNRPKR

SEQ ID NO: 1078220 - protein, 29 aa, Mycobacterium
REGPLNFYSLYRAHDLHFIVYSAMFEGQS

SEQ ID NO: 1078221 - protein, 32 aa, Mycobacterium; identical to SEQ ID NO: 852826

SEQ ID NO: 1078222 - protein, 17 aa, Mycobacterium
REHGVRVLVIRPGQVRT

SEQ ID NO: 1078223 - protein, 17 aa, Mycobacterium
REIGVDLMFSHIKESLH

SEQ ID NO: 1078224 - protein, 19 aa, Mycobacterium
REIRLLSRFTGANPHVPII

SEQ ID NO: 1078225 - protein, 40 aa, Mycobacterium; identical to SEQ ID NO: 852878

SEQ ID NO: 1078226 - protein, 21 aa, Mycobacterium
RELAERRINLVRRLAAADRIQ

SEQ ID NO: 1078227 - protein, 18 aa, Mycobacterium
RELDEVAYLRFASVYRSF

SEQ ID NO: 1078228 - protein, 24 aa, Mycobacterium
RELDEVAYLRFASVYRSFSSADDF

SEQ ID NO: 1078229 - protein, 20 aa, Mycobacterium
RELHVVDELPRRGIGKIDRR

SEQ ID NO: 1078230 - protein, 19 aa, Mycobacterium
RELLIALLPQIEQADRDDL

SEQ ID NO: 1078231 - protein, 19 aa, Mycobacterium
RELLKTYARIRGRWHAALP

SEQ ID NO: 1078232 - protein, 25 aa, Mycobacterium
RELRDWLLIRAWEAGVTPIGVQPVP

SEQ ID NO: 1078233 - protein, 32 aa, Mycobacterium
RELSGAIRLIYPRETIWRPPVLTMSAVEGTGL

SEQ ID NO: 1078234 - protein, 24 aa, Mycobacterium
RELYRRGAYLPPYYRDMLRQRVAP

SEQ ID NO: 1078235 - protein, 33 aa, Mycobacterium
REMDGHFPKPWALGIHNVWLRIVPTTITERRLG

SEQ ID NO: 1078236 - protein, 23 aa, Mycobacterium
RENVQFHWLRIEDVPEIWRRLES

SEQ ID NO: 1078237 - protein, 24 aa, Mycobacterium
REPGRLRIALSTKIPTPLPVRVGQ

SEQ ID NO: 1078238 - protein, 26 aa, Mycobacterium
REQFVEDLLSILPPGLAADGRVHLCS

SEQ ID NO: 1078239 - protein, 29 aa, Mycobacterium
REQLAETVGAYFPLGWPIACHVQGDAGVD

SEQ ID NO: 1078240 - protein, 31 aa, Mycobacterium; identical to SEQ ID NO: 783400

SEQ ID NO: 1078241 - protein, 18 aa, Mycobacterium
REQVGAQNFFLFGLTVQD

SEQ ID NO: 1078242 - protein, 26 aa, Mycobacterium
RERDRQWWQRRLPEMAGAPQLPTVAV

SEQ ID NO: 1078243 - protein, 18 aa, Mycobacterium
RERGFDLCIYMLGADHHG

SEQ ID NO: 1078244 - protein, 21 aa, Mycobacterium
RERGITIKAQNVRLPWQLDGT

SEQ ID NO: 1078245 - protein, 23 aa, Mycobacterium
RERGQWYYQRYIAHLPAKGEIVF

SEQ ID NO: 1078246 - protein, 25 aa, Mycobacterium
RERLALMMALLARPRLWKLERAMRE

SEQ ID NO: 1078247 - protein, 17 aa, Mycobacterium
RERLLNLKPPTYFDDFL

SEQ ID NO: 1078248 - protein, 17 aa, Mycobacterium
RERLWRVGVTAAVLWVL

SEQ ID NO: 1078249 - protein, 42 aa, Mycobacterium; identical to SEQ ID NO: 853029

SEQ ID NO: 1078250 - protein, 19 aa, Mycobacterium
RERRRLIKVLRKRGRILQS

SEQ ID NO: 1078251 - protein, 25 aa, Mycobacterium
RERVILDQALLVPAPVMTGLIRDRL

SEQ ID NO: 1078252 - protein, 25 aa, Mycobacterium
RERVKRHLPIFLRAAGRNYIGATGT

SEQ ID NO: 1078253 - protein, 24 aa, Mycobacterium
RESDERMAPIPALLAVAGVHHHLV

SEQ ID NO: 1078254 - protein, 18 aa, Mycobacterium
RESRAAIWAVLVRDFFQA

SEQ ID NO: 1078255 - protein, 24 aa, Mycobacterium
RESVFDPVLHVADLSFREVRVPEN

SEQ ID NO: 1078256 - protein, 19 aa, Mycobacterium
RETLQRWECGQDRLALIMH

SEQ ID NO: 1078257 - protein, 25 aa, Mycobacterium
RETMRALLVTIPDDALRLPRQDAVD

SEQ ID NO: 1078258 - protein, 24 aa, Mycobacterium
REVAAAINRPLSFAGAVDAVTNRL

SEQ ID NO: 1078259 - protein, 37 aa, Mycobacterium
REVIELHPDIDWDKGKTLRWVIDHLPDQRAAPLVPIY

SEQ ID NO: 1078260 - protein, 23 aa, Mycobacterium
REVKALRRGVFHNSLRLENGNWA

SEQ ID NO: 1078261 - protein, 19 aa, Mycobacterium
REVLRLEYSAHPSAGQVLA

SEQ ID NO: 1078262 - protein, 17 aa, Mycobacterium
REVYLLQRTKGPQGKRL

SEQ ID NO: 1078263 - protein, 18 aa, Mycobacterium
REVYWARYRDGVRTHGPA

SEQ ID NO: 1078264 - protein, 18 aa, Mycobacterium
REWILRNSPVPVGTVPIY

SEQ ID NO: 1078265 - protein, 22 aa, Mycobacterium
REYALLLRHREPRPWLVCVHGT

SEQ ID NO: 1078266 - protein, 19 aa, Mycobacterium
REYVLPTFRMFGMTKFYKH

SEQ ID NO: 1078267 - protein, 19 aa, Mycobacterium
RFAASSWLGSLRSRGGTVM

SEQ ID NO: 1078268 - protein, 18 aa, Mycobacterium
RFAGYEGGVADPLIVSWP

SEQ ID NO: 1078269 - protein, 19 aa, Mycobacterium
RFATALWGVRTMFGGFARF

SEQ ID NO: 1078270 - protein, 25 aa, Mycobacterium
RFDDEQLFYLRSRGIGEEQARRLLV

SEQ ID NO: 1078271 - protein, 19 aa, Mycobacterium
RFDIPDAVLGFLRGDLGDP

SEQ ID NO: 1078272 - protein, 23 aa, Mycobacterium
RFDLPTHYFAPDSDARLVSDLRE

SEQ ID NO: 1078273 - protein, 20 aa, Mycobacterium
RFDPQRFIGGRPSTFGWIPF

SEQ ID NO: 1078274 - protein, 21 aa, Mycobacterium
RFDRMYSGPLPYISALHQYRD

SEQ ID NO: 1078275 - protein, 22 aa, Mycobacterium
RFEFRWNDQFALSLDPPTAREF

SEQ ID NO: 1078276 - protein, 23 aa, Mycobacterium
RFEFRWNDQFALSLDPPTAREFH

SEQ ID NO: 1078277 - protein, 20 aa, Mycobacterium
RFELFMEGTRRPELQPFLVE

SEQ ID NO: 1078278 - protein, 19 aa, Mycobacterium
RFFEAFAASGIRREAFCPC

SEQ ID NO: 1078279 - protein, 17 aa, Mycobacterium
RFFEVAVTPDRVAAAFA

SEQ ID NO: 1078280 - protein, 17 aa, Mycobacterium
RFGFTAHMDFYEPAELE

SEQ ID NO: 1078281 - protein, 20 aa, Mycobacterium
RFGLGFLPMVPDLVDVYLEE

SEQ ID NO: 1078282 - protein, 23 aa, Mycobacterium
RFGQALPVLGWNMRVSNLRWSGD

SEQ ID NO: 1078283 - protein, 17 aa, Mycobacterium
RFHDPRYLADLRNFCRR

SEQ ID NO: 1078284 - protein, 25 aa, Mycobacterium
RFHRNLGCGLLGRRIERSPLPFARD

SEQ ID NO: 1078285 - protein, 21 aa, Mycobacterium
RFHSKIVELNLLAPLLVSQHA

SEQ ID NO: 1078286 - protein, 33 aa, Mycobacterium
RFLAQHRWRDGVMKLVFMGVPLRGVSSLCSRAD

SEQ ID NO: 1078287 - protein, 26 aa, Mycobacterium
RFLEHSRILHFRAIDEFWIGSADMMH

SEQ ID NO: 1078288 - protein, 25 aa, Mycobacterium
RFLERRLRETFGFEGSPIRINVRVR

SEQ ID NO: 1078289 - protein, 24 aa, Mycobacterium
RFNAALAPLGWAPTCMQPSYGLAE

SEQ ID NO: 1078290 - protein, 18 aa, Mycobacterium
RFNDDMIIMPLQAATQWD

SEQ ID NO: 1078291 - protein, 25 aa, Mycobacterium
RFNGTVLLEWLNVSGGIDAPAVWMM

SEQ ID NO: 1078292 - protein, 19 aa, Mycobacterium
RFPRPFTRDKIEAVLGWPR

SEQ ID NO: 1078293 - protein, 22 aa, Mycobacterium
RFPTEPPGAPLPPLAGGTSPRA

SEQ ID NO: 1078294 - protein, 19 aa, Mycobacterium
RFQWVVFTSTNAVRAVWEK

SEQ ID NO: 1078295 - protein, 25 aa, Mycobacterium
RFRRMLSKPFTFKRVEALRPTIQQI

SEQ ID NO: 1078296 - protein, 17 aa, Mycobacterium
RFRRWANAFMLSSSLTP

SEQ ID NO: 1078297 - protein, 27 aa, Mycobacterium
RFRSDALQIIAFGRYARTVTAAELTGL

SEQ ID NO: 1078298 - protein, 29 aa, Mycobacterium
RFSTNTFPSWPLAHPFRRIAHNGEINTVT

SEQ ID NO: 1078299 - protein, 18 aa, Mycobacterium
RFTHDLRMTLRELASRRV

SEQ ID NO: 1078300 - protein, 22 aa, Mycobacterium
RFTTVHMALVRTPMISPTTIYD

SEQ ID NO: 1078301 - protein, 22 aa, Mycobacterium
RFVEHQGIRWYKTGDMARYWPD

SEQ ID NO: 1078302 - protein, 18 aa, Mycobacterium
RFVSGPGDRPAWSMIFED

SEQ ID NO: 1078303 - protein, 17 aa, Mycobacterium
RGAARPAVAPGPTRTVA

SEQ ID NO: 1078304 - protein, 18 aa, Mycobacterium
RGAAVLLVDILDQALAAT

SEQ ID NO: 1078305 - protein, 19 aa, Mycobacterium
RGADLPPLPTLFVVVDEFA

SEQ ID NO: 1078306 - protein, 18 aa, Mycobacterium
RGAELIVVSASWGSGPGK

SEQ ID NO: 1078307 - protein, 20 aa, Mycobacterium
RGAGWLKVKPVHTLDLVVLA

SEQ ID NO: 1078308 - protein, 19 aa, Mycobacterium
RGAGWNVIKVVWGREWDAL

SEQ ID NO: 1078309 - protein, 20 aa, Mycobacterium
RGAMAPIRPGANRCGKRVTQ

SEQ ID NO: 1078310 - protein, 21 aa, Mycobacterium
RGAPIGRMWVRPFASDEADPA

SEQ ID NO: 1078311 - protein, 26 aa, Mycobacterium
RGAVNAVVAFWGTDWAREISVVAAGS

SEQ ID NO: 1078312 - protein, 24 aa, Mycobacterium
RGAVVVRLIALDPILIRDASTATV

SEQ ID NO: 1078313 - protein, 22 aa, Mycobacterium
RGCMRGRTMYVVPFCMGPLGAE

SEQ ID NO: 1078314 - protein, 22 aa, Mycobacterium
RGDGVIYWQVPKGATLDSTIGR

SEQ ID NO: 1078315 - protein, 22 aa, Mycobacterium
RGDLAVAIDALRRPERRRGMAV

SEQ ID NO: 1078316 - protein, 23 aa, Mycobacterium
RGDLRFVVRVKADPARMLLSVRP

SEQ ID NO: 1078317 - protein, 18 aa, Mycobacterium
RGDRLFMTMLHRHCEHVL

SEQ ID NO: 1078318 - protein, 20 aa, Mycobacterium
RGDVLELLDDIKDAIPGELD

SEQ ID NO: 1078319 - protein, 17 aa, Mycobacterium
RGEECSAYWPAGTAAWQ

SEQ ID NO: 1078320 - protein, 25 aa, Mycobacterium
RGEFRPRVRFLSPGKKILRDDHLDL

SEQ ID NO: 1078321 - protein, 25 aa, Mycobacterium
RGEIARRVFATCRRLGLGTVAVYTD

SEQ ID NO: 1078322 - protein, 19 aa, Mycobacterium
RGELPPALALQIVERHGYD

SEQ ID NO: 1078323 - protein, 23 aa, Mycobacterium
RGERLVNSMFTLSTLVGLSVAQL

SEQ ID NO: 1078324 - protein, 26 aa, Mycobacterium
RGESYQDLLRRRGWPALESEHTWTPD

SEQ ID NO: 1078325 - protein, 19 aa, Mycobacterium
RGFAAYGTAKVALAHYTRL

SEQ ID NO: 1078326 - protein, 21 aa, Mycobacterium
RGGGAALPYKRRLFGQIVAAA

SEQ ID NO: 1078327 - protein, 27 aa, Mycobacterium
RGGLGGFAGLFALRNDYREPVLAASTD

SEQ ID NO: 1078328 - protein, 17 aa, Mycobacterium
RGGLLLGDGGAGAPGAA

SEQ ID NO: 1078329 - protein, 20 aa, Mycobacterium
RGGLSGGHQRRAGLRRWRRW

SEQ ID NO: 1078330 - protein, 25 aa, Mycobacterium
RGGPDYLMFLYRTKGPVVFGDSPVL

SEQ ID NO: 1078331 - protein, 19 aa, Mycobacterium
RGGYLIGSGGNGGAGAGGG

SEQ ID NO: 1078332 - protein, 23 aa, Mycobacterium
RGHAVAFVRRVLGPLAANDEGTY

SEQ ID NO: 1078333 - protein, 25 aa, Mycobacterium
RGHTAFLILARRLAPGAVAPAPWGR

SEQ ID NO: 1078334 - protein, 29 aa, Mycobacterium
RGHTQKGTLFQWLTEMYPVWGRLDAELEF

SEQ ID NO: 1078335 - protein, 27 aa, Mycobacterium
RGIAVADVPNLFFLLGPNTGLGHNSVV

SEQ ID NO: 1078336 - protein, 18 aa, Mycobacterium
RGIDGFASRFPTVTAACR

SEQ ID NO: 1078337 - protein, 20 aa, Mycobacterium
RGIGLLHKLQTYQLQDAGDD

SEQ ID NO: 1078338 - protein, 18 aa, Mycobacterium
RGIPLTMEMAKFIRFIVT

SEQ ID NO: 1078339 - protein, 20 aa, Mycobacterium
RGKAFRDVTRNLLGHLDHVP

SEQ ID NO: 1078340 - protein, 18 aa, Mycobacterium
RGKRQFRRAILDIGTGQV

SEQ ID NO: 1078341 - protein, 25 aa, Mycobacterium
RGLCGYRRFFSITSLAGLRQEDRAV

SEQ ID NO: 1078342 - protein, 29 aa, Mycobacterium
RGLDPLTTVPLLAPVLSIAPEYGYQPAPA

SEQ ID NO: 1078343 - protein, 18 aa, Mycobacterium
RGLDPVRLSHVLTAGMTF

SEQ ID NO: 1078344 - protein, 32 aa, Mycobacterium
RGLGSRFLDTGAMYRMVTLSVLRAGIDPADEQ

SEQ ID NO: 1078345 - protein, 35 aa, Mycobacterium
RGLIAEFGISWILPRLTSWAVALDLLLSGRIFLAE

SEQ ID NO: 1078346 - protein, 18 aa, Mycobacterium
RGLPAVDFGVGVSAGRVF

SEQ ID NO: 1078347 - protein, 22 aa, Mycobacterium
RGLPVLGICRGAQVLNVAFGGT

SEQ ID NO: 1078348 - protein, 23 aa, Mycobacterium
RGLSFMARYVLHNGFLESDKLAE

SEQ ID NO: 1078349 - protein, 17 aa, Mycobacterium
RGLTLEQLAQRAGLTKS

SEQ ID NO: 1078350 - protein, 27 aa, Mycobacterium
RGLTMRFLLVELPNERWRFVITAHHIV

SEQ ID NO: 1078351 - protein, 30 aa, Mycobacterium; identical to SEQ ID NO: 853680

SEQ ID NO: 1078352 - protein, 33 aa, Mycobacterium; identical to SEQ ID NO: 853691

SEQ ID NO: 1078353 - protein, 32 aa, Mycobacterium
RGMIADSWQLMSNPNMSFPKTPLTVGAKQGSD

SEQ ID NO: 1078354 - protein, 18 aa, Mycobacterium
RGMLKPIYEEVELGRAEI

SEQ ID NO: 1078355 - protein, 29 aa, Mycobacterium
RGNPDYGLRLSWDFLARSTAGLWEWAECL

SEQ ID NO: 1078356 - protein, 18 aa, Mycobacterium
RGNRHFSFGIGVHRCVGS

SEQ ID NO: 1078357 - protein, 17 aa, Mycobacterium
RGPFVMQGYYKRSREEC

SEQ ID NO: 1078358 - protein, 22 aa, Mycobacterium
RGPHRVLRGDLAFAGLPGVVYT

SEQ ID NO: 1078359 - protein, 33 aa, Mycobacterium
RGPLRRRARLHPPRLRRPGLLVRSPPPRRLGRR

SEQ ID NO: 1078360 - protein, 25 aa, Mycobacterium
RGPQALSLKLLDPPPSLTRTRHEAV

SEQ ID NO: 1078361 - protein, 29 aa, Mycobacterium
RGPTPPKVKSPFGMPGMPGMLAGFPDLSQ

SEQ ID NO: 1078362 - protein, 27 aa, Mycobacterium
RGQGLVKRMLLGWVSTGLVHHAHCPVA

SEQ ID NO: 1078363 - protein, 25 aa, Mycobacterium
RGQNVYPMTLLGTFSPYMVVHRSSV

SEQ ID NO: 1078364 - protein, 20 aa, Mycobacterium
RGRALTLLLPALRALVTTQP

SEQ ID NO: 1078365 - protein, 18 aa, Mycobacterium
RGRDRAELRRTAGDSLAR

SEQ ID NO: 1078366 - protein, 22 aa, Mycobacterium
RGRLQLHHVRAKFLGAEPAEPE

SEQ ID NO: 1078367 - protein, 30 aa, Mycobacterium; identical to SEQ ID NO: 131183

SEQ ID NO: 1078368 - protein, 20 aa, Mycobacterium
RGRPAKRYRLTPGGRAKLEH

SEQ ID NO: 1078369 - protein, 28 aa, Mycobacterium
RGRPDHFYHPFGLLPSPQHIPLSHFWAR

SEQ ID NO: 1078370 - protein, 20 aa, Mycobacterium
RGRPPDADLFRRAAALSAIG

SEQ ID NO: 1078371 - protein, 23 aa, Mycobacterium
RGRRAAVVAAGRPPRCRPTGAGR

SEQ ID NO: 1078372 - protein, 30 aa, Mycobacterium
RGRRHFVGQWRQWRLGRHRPDRRRWWGGGI

SEQ ID NO: 1078373 - protein, 18 aa, Mycobacterium
RGRRPRFYRPPPRPDVIA

SEQ ID NO: 1078374 - protein, 26 aa, Mycobacterium
RGRVKQLLLKIGWPAEDLAGYVNGEA

SEQ ID NO: 1078375 - protein, 29 aa, Mycobacterium
RGRWNVPKKLTTLTLWGSGVLDLRYADFT

SEQ ID NO: 1078376 - protein, 41 aa, Mycobacterium; identical to SEQ ID NO: 853853

SEQ ID NO: 1078377 - protein, 25 aa, Mycobacterium
RGSALSLFPRFGVAAPPPQPSAAQR

SEQ ID NO: 1078378 - protein, 20 aa, Mycobacterium
RGSAYHYFPGGRTQLLCEAV

SEQ ID NO: 1078379 - protein, 18 aa, Mycobacterium
RGSDGQWRLSPKAMRRLG

SEQ ID NO: 1078380 - protein, 24 aa, Mycobacterium
RGTAGFMTVFRRSGARHQALVSIF

SEQ ID NO: 1078381 - protein, 20 aa, Mycobacterium
RGVASINWGGVPPAIFDAAE

SEQ ID NO: 1078382 - protein, 17 aa, Mycobacterium
RGVDLSGCRLREASLVE

SEQ ID NO: 1078383 - protein, 18 aa, Mycobacterium
RGVIAPWPRISTSSAYGS

SEQ ID NO: 1078384 - protein, 28 aa, Mycobacterium
RGVPVMLRPVVLAKLMDGRITVMVTGTH

SEQ ID NO: 1078385 - protein, 17 aa, Mycobacterium
RGVRPIRKPAPGRRSRG

SEQ ID NO: 1078386 - protein, 17 aa, Mycobacterium
RGWGVFAHGFTLNKDSP

SEQ ID NO: 1078387 - protein, 17 aa, Mycobacterium
RGWHCLGVAKDFMDGKP

SEQ ID NO: 1078388 - protein, 17 aa, Mycobacterium
RGWPGQRLAGAETRHRR

SEQ ID NO: 1078389 - protein, 22 aa, Mycobacterium
RGWTFTFEGYDPPNEKLREALC

SEQ ID NO: 1078390 - protein, 29 aa, Mycobacterium
RGYHRREDKPFWWSHFDRLNYPIDEWSDS

SEQ ID NO: 1078391 - protein, 18 aa, Mycobacterium
RHAGLSYLLVPLDQPSVQ

SEQ ID NO: 1078392 - protein, 19 aa, Mycobacterium
RHAMFPIGDTPKPQIREEA

SEQ ID NO: 1078393 - protein, 23 aa, Mycobacterium
RHANIPLRVPPAELLPERTPHVL

SEQ ID NO: 1078394 - protein, 34 aa, Mycobacterium; identical to SEQ ID NO: 853992

SEQ ID NO: 1078395 - protein, 25 aa, Mycobacterium
RHDPDTLRRLAAQLPLPINAIALPD

SEQ ID NO: 1078396 - protein, 23 aa, Mycobacterium
RHEALRTIFPYQQGQPVQVVLAP

SEQ ID NO: 1078397 - protein, 26 aa, Mycobacterium
RHECLEYALAHDERFGIWGGLSERER

SEQ ID NO: 1078398 - protein, 18 aa, Mycobacterium
RHGFVYLLGPEANRFVFA

SEQ ID NO: 1078399 - protein, 17 aa, Mycobacterium
RHHDSIAELLEFAVGAG

SEQ ID NO: 1078400 - protein, 26 aa, Mycobacterium
RHIRYNSYLRYGGLGWLRQHQPHVRT

SEQ ID NO: 1078401 - protein, 30 aa, Mycobacterium; identical to SEQ ID NO: 854060

SEQ ID NO: 1078402 - protein, 17 aa, Mycobacterium
RHLARPKRYIPGFAPEL

SEQ ID NO: 1078403 - protein, 18 aa, Mycobacterium
RHLPPQLVEAFRSTLEEV

SEQ ID NO: 1078404 - protein, 21 aa, Mycobacterium
RHMSELPDALQALGRPDGLTV

SEQ ID NO: 1078405 - protein, 25 aa, Mycobacterium
RHNFLGAPFWVGRGFGLNLSVVTDP

SEQ ID NO: 1078406 - protein, 28 aa, Mycobacterium
RHPAGHRWRWEFESLSPTLTRVTETFDY

SEQ ID NO: 1078407 - protein, 26 aa, Mycobacterium
RHPLRPAAFGPRAALPATMMARWFRT

SEQ ID NO: 1078408 - protein, 29 aa, Mycobacterium
RHPMIRIDGQWHEVSWDAAFRRCTELLAP

SEQ ID NO: 1078409 - protein, 23 aa, Mycobacterium
RHQRTLLGVALIDTYLPSQIVNA

SEQ ID NO: 1078410 - protein, 26 aa, Mycobacterium
RHRFTVYPFEDHIAWILQDKFNDPIA

SEQ ID NO: 1078411 - protein, 25 aa, Mycobacterium
RHRGLTYFMFDLKAKGITVRPIVQL

SEQ ID NO: 1078412 - protein, 21 aa, Mycobacterium
RHRLWQLDPNIAYLSGDTLPE

SEQ ID NO: 1078413 - protein, 20 aa, Mycobacterium
RHVFESLAMNARIALHVRVL

SEQ ID NO: 1078414 - protein, 36 aa, Mycobacterium
RHVGRGKLLPRERVYRLLDPGSPFLELAALAANGMY

SEQ ID NO: 1078415 - protein, 20 aa, Mycobacterium
RHVLRRQLIKANELGFSCYV

SEQ ID NO: 1078416 - protein, 33 aa, Mycobacterium
RHVQLPGFRPGKVPARLLEARFGRETLLDQVVN

SEQ ID NO: 1078417 - protein, 25 aa, Mycobacterium
RHVRVYQPRRLLFSDGQQTLGVALP

SEQ ID NO: 1078418 - protein, 21 aa, Mycobacterium
RHVVHPVRTACAAGARTVVLT

SEQ ID NO: 1078419 - protein, 18 aa, Mycobacterium
RHWLTRPKIWPPYSTHWK

SEQ ID NO: 1078420 - protein, 37 aa, Mycobacterium
RHWVQTPYRYFPIEPHWLFPGVQWLPYEARVQISMRW

SEQ ID NO: 1078421 - protein, 26 aa, Mycobacterium
RIADACGFAVPYYDLVDERPVLDAHF

SEQ ID NO: 1078422 - protein, 30 aa, Mycobacterium; identical to SEQ ID NO: 122127

SEQ ID NO: 1078423 - protein, 37 aa, Mycobacterium; identical to SEQ ID NO: 854218

SEQ ID NO: 1078424 - protein, 19 aa, Mycobacterium
RIALHVRVLYGRDPHHITE

SEQ ID NO: 1078425 - protein, 22 aa, Mycobacterium
RIAPLRAPDLSALPPAIVVAAE

SEQ ID NO: 1078426 - protein, 28 aa, Mycobacterium
RIASPPVKWPCFYGIDFPSPAELIANAV

SEQ ID NO: 1078427 - protein, 23 aa, Mycobacterium
RIATGPTVLTIRARPPGTTITEQ

SEQ ID NO: 1078428 - protein, 17 aa, Mycobacterium
RICGALAAELINCCGMF

SEQ ID NO: 1078429 - protein, 17 aa, Mycobacterium
RICIPVPFYHCFGMVMG

SEQ ID NO: 1078430 - protein, 20 aa, Mycobacterium
RIDLDPMPGVEWRRILDVAQ

SEQ ID NO: 1078431 - protein, 18 aa, Mycobacterium
RIDLYFPGERPLTAYHPR

SEQ ID NO: 1078432 - protein, 18 aa, Mycobacterium
RIDRFELMDLRRGADVID

SEQ ID NO: 1078433 - protein, 22 aa, Mycobacterium
RIDRRGRMLWSLPKGHIEMGET

SEQ ID NO: 1078434 - protein, 17 aa, Mycobacterium
RIDTDVLAALRSAERSP

SEQ ID NO: 1078435 - protein, 26 aa, Mycobacterium
RIDVTVRISGFFRDAFPHVVTMLDDA

SEQ ID NO: 1078436 - protein, 20 aa, Mycobacterium
RIEAAYPGRFLLGIGVGHPE

SEQ ID NO: 1078437 - protein, 20 aa, Mycobacterium
RIEFSMWSSHLLNMSARVVG

SEQ ID NO: 1078438 - protein, 24 aa, Mycobacterium
RIEHRSLVVEIYRPRLTGPVPQAE

SEQ ID NO: 1078439 - protein, 21 aa, Mycobacterium
RIEPLWLGSIKSNIGHTSAAA

SEQ ID NO: 1078440 - protein, 18 aa, Mycobacterium
RIEPWQILGEIGGGLDVV

SEQ ID NO: 1078441 - protein, 29 aa, Mycobacterium
RIFAFDVHSIFIPVSRWQYDIVGADGGCR

SEQ ID NO: 1078442 - protein, 23 aa, Mycobacterium
RIGAALGPGWPRSVKSTLQMTFS

SEQ ID NO: 1078443 - protein, 24 aa, Mycobacterium
RIGADILLLNTAFAGPALADVVAR

SEQ ID NO: 1078444 - protein, 22 aa, Mycobacterium
RIGETFFTTAYFDPNMAHMDEI

SEQ ID NO: 1078445 - protein, 26 aa, Mycobacterium
RIGFGWVPLLVFVRPATKMGLVLRTM

SEQ ID NO: 1078446 - protein, 17 aa, Mycobacterium
RIGILGAARIAPQALVK

SEQ ID NO: 1078447 - protein, 26 aa, Mycobacterium
RIGKSFLLLFGFLPFGFDDITITRIE

SEQ ID NO: 1078448 - protein, 31 aa, Mycobacterium
RIGLALASLGVPAFFVVAVPSIPRKPNGKVD

SEQ ID NO: 1078449 - protein, 35 aa, Mycobacterium
RIGRSRPLITNMIRLLKLPIPVQRRVAAGVLSAGH

SEQ ID NO: 1078450 - protein, 25 aa, Mycobacterium
RIGTPGGAGGLLYGNGGRGGDSTLA

SEQ ID NO: 1078451 - protein, 17 aa, Mycobacterium
RIGWVAGLLDRLDHMLS

SEQ ID NO: 1078452 - protein, 20 aa, Mycobacterium
RIHANLPPEVPGCPPSTLAT

SEQ ID NO: 1078453 - protein, 38 aa, Mycobacterium
RIIPGPSSMWFDALGRRLPAPLPARLRHLRHPAPPAHH

SEQ ID NO: 1078454 - protein, 17 aa, Mycobacterium
RIIPQIISGFDAEGLRV

SEQ ID NO: 1078455 - protein, 21 aa, Mycobacterium
RIIRAGRHLARPKRYIPGFAP

SEQ ID NO: 1078456 - protein, 20 aa, Mycobacterium
RIKPPYVAAYVLLDGADIPF

SEQ ID NO: 1078457 - protein, 17 aa, Mycobacterium
RILIDPSALWGPPLTTL

SEQ ID NO: 1078458 - protein, 17 aa, Mycobacterium
RILLSNPAVWEKTALIV

SEQ ID NO: 1078459 - protein, 24 aa, Mycobacterium
RILNNLCRYGLWDVTLESRVDVVL

SEQ ID NO: 1078460 - protein, 21 aa, Mycobacterium
RINVTFPDRLDVWPAYALKIT

SEQ ID NO: 1078461 - protein, 18 aa, Mycobacterium
RIPGWREALMRMGVVEGT

SEQ ID NO: 1078462 - protein, 25 aa, Mycobacterium
RIPLAEHDLLACWLLDSHDMGADAA

SEQ ID NO: 1078463 - protein, 18 aa, Mycobacterium
RIPTQYLIAMMAVGADAH

SEQ ID NO: 1078464 - protein, 20 aa, Mycobacterium
RIQPLKAPDIVLRAVAKLPG

SEQ ID NO: 1078465 - protein, 27 aa, Mycobacterium
RIQRRGMADNYWSMGIPGPCGPSSEIY

SEQ ID NO: 1078466 - protein, 17 aa, Mycobacterium
RIRIQGIKLWLRRVPVV

SEQ ID NO: 1078467 - protein, 17 aa, Mycobacterium
RIRLVHEVVVADELLTA

SEQ ID NO: 1078468 - protein, 37 aa, Mycobacterium
RIRLVIAGRKLAPRNPLYGSFPALYAPSPPARCTLHW

SEQ ID NO: 1078469 - protein, 24 aa, Mycobacterium
RIRRVLPELGGLLRRPLITLERVR

SEQ ID NO: 1078470 - protein, 23 aa, Mycobacterium
RISAELIRVTPPDWMGSIMARIH

SEQ ID NO: 1078471 - protein, 27 aa, Mycobacterium
RISAQRRFAFGSLPLDQIKAAKFAVPG

SEQ ID NO: 1078472 - protein, 18 aa, Mycobacterium
RISEFAEIIGFYGLSYWY

SEQ ID NO: 1078473 - protein, 25 aa, Mycobacterium
RISLRTQVPLLLDEYTRNSSTGSFI

SEQ ID NO: 1078474 - protein, 27 aa, Mycobacterium
RISRGMRTPFVAPIGRDYVAWWSPDAQ

SEQ ID NO: 1078475 - protein, 26 aa, Mycobacterium
RITEAVYFVERLVDCLAFELKMGPAE

SEQ ID NO: 1078476 - protein, 23 aa, Mycobacterium
RITLWRDYFDFYDMTKALLRGVA

SEQ ID NO: 1078477 - protein, 28 aa, Mycobacterium
RITRLHQYNLFPNMTFLANADHLTMMCS

SEQ ID NO: 1078478 - protein, 19 aa, Mycobacterium
RIVTWLFVNAAGAETLSAP

SEQ ID NO: 1078479 - protein, 19 aa, Mycobacterium
RIVWSGGSYVRRPLSLPFE

SEQ ID NO: 1078480 - protein, 18 aa, Mycobacterium
RIWLRISGYGEHSRRPAF

SEQ ID NO: 1078481 - protein, 19 aa, Mycobacterium
RIYADHWLSRQLNETDDIL

SEQ ID NO: 1078482 - protein, 22 aa, Mycobacterium
RIYAGFSPLYYSPFGDHGRTGL

SEQ ID NO: 1078483 - protein, 23 aa, Mycobacterium
RKAFAARWRQLLVAAGLIAVSWP

SEQ ID NO: 1078484 - protein, 24 aa, Mycobacterium
RKAKKLRVRLPLPKLTVAVENPQA

SEQ ID NO: 1078485 - protein, 20 aa, Mycobacterium
RKDFRVVLGADRMGRVGALD

SEQ ID NO: 1078486 - protein, 26 aa, Mycobacterium
RKEEQLLLGGLPVRRLWGIGPVAEEK

SEQ ID NO: 1078487 - protein, 17 aa, Mycobacterium
RKGYLRRDPNRPRAVDV

SEQ ID NO: 1078488 - protein, 21 aa, Mycobacterium
RKHELLLLADEIYDKILYDDA

SEQ ID NO: 1078489 - protein, 25 aa, Mycobacterium
RKHKDACIFLNRPGFAGGTGCALHS

SEQ ID NO: 1078490 - protein, 21 aa, Mycobacterium
RKIEEIGGLITRLSIGGNGER

SEQ ID NO: 1078491 - protein, 27 aa, Mycobacterium
RKIGHLPYLLTLPGHGFYWFQLSASEE

SEQ ID NO: 1078492 - protein, 23 aa, Mycobacterium
RKLAYRNLLVAPYGIRRGIIERV

SEQ ID NO: 1078493 - protein, 24 aa, Mycobacterium
RKLAYRNLLVAPYGIRRGIIERVE

SEQ ID NO: 1078494 - protein, 37 aa, Mycobacterium
RKLGDLITFVIHIPLSIDLLLDLRLDKQRFSVTGDIA

SEQ ID NO: 1078495 - protein, 26 aa, Mycobacterium
RKNERYKLVWKNRLGFARLAIQHACP

SEQ ID NO: 1078496 - protein, 23 aa, Mycobacterium
RKNGLPVYALAPFATRGLQKMSG

SEQ ID NO: 1078497 - protein, 22 aa, Mycobacterium
RKPEFAEDWVNLVALAVNEENA

SEQ ID NO: 1078498 - protein, 17 aa, Mycobacterium
RKRIPVVLFAEGGGGRP

SEQ ID NO: 1078499 - protein, 17 aa, Mycobacterium
RKRIYEGNYAAGKYIRL

SEQ ID NO: 1078500 - protein, 25 aa, Mycobacterium
RKRLRQWMMRITAYSDRLLDDLDVL

SEQ ID NO: 1078501 - protein, 19 aa, Mycobacterium
RKRRMFDLLVRMGYKEIEV

SEQ ID NO: 1078502 - protein, 24 aa, Mycobacterium
RKRRQPVTVLLKALGWTSEQITER

SEQ ID NO: 1078503 - protein, 25 aa, Mycobacterium
RKRRQPVTVLLKALGWTSEQITERF

SEQ ID NO: 1078504 - protein, 24 aa, Mycobacterium
RKRRRGILGYDDLLLRLADALASE

SEQ ID NO: 1078505 - protein, 21 aa, Mycobacterium
RKVDDALWKRYSAARDTFNRR

SEQ ID NO: 1078506 - protein, 24 aa, Mycobacterium
RKVGHINFLGFDPAAVAGLRERAE

SEQ ID NO: 1078507 - protein, 21 aa, Mycobacterium
RKVNLLFFTGDAMARPLLDAL

SEQ ID NO: 1078508 - protein, 18 aa, Mycobacterium
RKVVPLRQALSNFSAWVT

SEQ ID NO: 1078509 - protein, 21 aa, Mycobacterium
RKYCRQQALLISRFHARRDVH

SEQ ID NO: 1078510 - protein, 18 aa, Mycobacterium
RLAAGLPAYGACAGMIML

SEQ ID NO: 1078511 - protein, 19 aa, Mycobacterium
RLAERLLVDVIGLPWEEVH

SEQ ID NO: 1078512 - protein, 17 aa, Mycobacterium
RLAFVLHDVFAVPFDQI

SEQ ID NO: 1078513 - protein, 17 aa, Mycobacterium
RLAGIMSALSIADYAGS

SEQ ID NO: 1078514 - protein, 25 aa, Mycobacterium
RLAIVASTWHTKICDALLAGARNTA

SEQ ID NO: 1078515 - protein, 19 aa, Mycobacterium
RLALDRSFADWGMRLVFLR

SEQ ID NO: 1078516 - protein, 21 aa, Mycobacterium
RLANQIWRTNVLGAYHVAQSA

SEQ ID NO: 1078517 - protein, 19 aa, Mycobacterium
RLARKLAGWSITGTILDKT

SEQ ID NO: 1078518 - protein, 19 aa, Mycobacterium
RLARLLGELLVSSDASANL

SEQ ID NO: 1078519 - protein, 24 aa, Mycobacterium
RLARLRGATLLAHNYQLPAIQDVA

SEQ ID NO: 1078520 - protein, 17 aa, Mycobacterium
RLARPRRRAPRPVPWRP

SEQ ID NO: 1078521 - protein, 21 aa, Mycobacterium
RLARYVVPLPGRPAPLHPNEA

SEQ ID NO: 1078522 - protein, 25 aa, Mycobacterium
RLATQRIQMPLPSAQARLLATIEAQ

SEQ ID NO: 1078523 - protein, 31 aa, Mycobacterium; identical to SEQ ID NO: 854864

SEQ ID NO: 1078524 - protein, 17 aa, Mycobacterium
RLCDAFGIPLVVVVDVP

SEQ ID NO: 1078525 - protein, 21 aa, Mycobacterium
RLCPAPCEPACVLGINQDPVT

SEQ ID NO: 1078526 - protein, 26 aa, Mycobacterium
RLCSETLELLLRSTGYNDDITLLAVQ

SEQ ID NO: 1078527 - protein, 19 aa, Mycobacterium
RLCTACFDGKYPIELPGET

SEQ ID NO: 1078528 - protein, 20 aa, Mycobacterium
RLDAAYAVPQQFWAKVLPRV

SEQ ID NO: 1078529 - protein, 20 aa, Mycobacterium
RLDAESAFQVLAKWSQKSNT

SEQ ID NO: 1078530 - protein, 18 aa, Mycobacterium
RLDGLDSLLSIVQMPAGV

SEQ ID NO: 1078531 - protein, 19 aa, Mycobacterium
RLDGLDSLLSIVQMPAGVP

SEQ ID NO: 1078532 - protein, 25 aa, Mycobacterium
RLDRLTAGVLLFTTRRELRGRYQTL

SEQ ID NO: 1078533 - protein, 17 aa, Mycobacterium
RLEAQIVLRLLLERTTV

SEQ ID NO: 1078534 - protein, 18 aa, Mycobacterium
RLECACPIPWDIDLNETA

SEQ ID NO: 1078535 - protein, 20 aa, Mycobacterium
RLEFGPVTVGLVPVTVTHQV

SEQ ID NO: 1078536 - protein, 17 aa, Mycobacterium
RLELLPVDPAYTAMFAD

SEQ ID NO: 1078537 - protein, 22 aa, Mycobacterium
RLELRVLFEELLGRFGVVLVGQ

SEQ ID NO: 1078538 - protein, 23 aa, Mycobacterium
RLEYGKGFHIGLFLRRIRAAQPE

SEQ ID NO: 1078539 - protein, 18 aa, Mycobacterium
RLFARHSQPYAWPGRVIG

SEQ ID NO: 1078540 - protein, 20 aa, Mycobacterium
RLFDLFDYQADKPAGSSRQA

SEQ ID NO: 1078541 - protein, 20 aa, Mycobacterium
RLFVPLDNIAWPSDSGPRRA

SEQ ID NO: 1078542 - protein, 19 aa, Mycobacterium
RLGAFRHFLRPALLQNETA

SEQ ID NO: 1078543 - protein, 24 aa, Mycobacterium
RLGASQHFLLEGLAARLQVAQGTG

SEQ ID NO: 1078544 - protein, 25 aa, Mycobacterium
RLGDAKFFALLRDWTTRYRHGTVIT

SEQ ID NO: 1078545 - protein, 20 aa, Mycobacterium
RLGHPVLAVVRRSAVNQDGA

SEQ ID NO: 1078546 - protein, 27 aa, Mycobacterium
RLGIPWIELNPHPLYRPSKGLPPIGSG

SEQ ID NO: 1078547 - protein, 19 aa, Mycobacterium
RLGPIVMVSYHRNGWDQTP

SEQ ID NO: 1078548 - protein, 22 aa, Mycobacterium
RLGQRLMNELIFDELRATDIPE

SEQ ID NO: 1078549 - protein, 20 aa, Mycobacterium
RLGRFAGLVAIDRGHPAIAD

SEQ ID NO: 1078550 - protein, 31 aa, Mycobacterium
RLGRGTPLWGGWITGPTWLGPEEFARAGYDY

SEQ ID NO: 1078551 - protein, 21 aa, Mycobacterium
RLHAHLLDRHRPLWETHVIEG

SEQ ID NO: 1078552 - protein, 17 aa, Mycobacterium
RLHGPLLGDAALAEAPW

SEQ ID NO: 1078553 - protein, 24 aa, Mycobacterium
RLHGSLLDRHRPLWEAHLVEGLND

SEQ ID NO: 1078554 - protein, 20 aa, Mycobacterium
RLIAMVGALNRMMPRIVREF

SEQ ID NO: 1078555 - protein, 18 aa, Mycobacterium
RLIETLTRLRDLGNTLIV

SEQ ID NO: 1078556 - protein, 20 aa, Mycobacterium
RLILSKYDPVIRKHVPFREE

SEQ ID NO: 1078557 - protein, 26 aa, Mycobacterium
RLIPNIVVLPYRNPFVVAKSAATLDL

SEQ ID NO: 1078558 - protein, 17 aa, Mycobacterium
RLIQPSTVVLIADRLLP

SEQ ID NO: 1078559 - protein, 18 aa, Mycobacterium
RLISPFVGGAFGSAGRMW

SEQ ID NO: 1078560 - protein, 20 aa, Mycobacterium
RLITLLELRPDLAQPPPGSI

SEQ ID NO: 1078561 - protein, 27 aa, Mycobacterium
RLKPRVFYDLVVEVALIRPGPIQGGSV

SEQ ID NO: 1078562 - protein, 26 aa, Mycobacterium
RLLADGGILDPLPMAPIAGVNADLTI

SEQ ID NO: 1078563 - protein, 18 aa, Mycobacterium
RLLARIYSESDLLVAECL

SEQ ID NO: 1078564 - protein, 37 aa, Mycobacterium; identical to SEQ ID NO: 855182

SEQ ID NO: 1078565 - protein, 20 aa, Mycobacterium
RLLHRHDGPIFPLIEDLFGL

SEQ ID NO: 1078566 - protein, 19 aa, Mycobacterium
RLLLASVPFFGWQFSAKHQ

SEQ ID NO: 1078567 - protein, 26 aa, Mycobacterium
RLLLNALRDRGLLQRFVPFDVDESVL

SEQ ID NO: 1078568 - protein, 21 aa, Mycobacterium
RLLNLKPPTYFDDFLASDGIS

SEQ ID NO: 1078569 - protein, 20 aa, Mycobacterium
RLLRDNIVVVENLSIRSLRR

SEQ ID NO: 1078570 - protein, 20 aa, Mycobacterium
RLLSEFRYEQPDPARFYGAL

SEQ ID NO: 1078571 - protein, 18 aa, Mycobacterium
RLLTRARIALRHPGEIFA

SEQ ID NO: 1078572 - protein, 21 aa, Mycobacterium
RLMNQLPEQCPPLSAVIYAAG

SEQ ID NO: 1078573 - protein, 25 aa, Mycobacterium
RLNPVLHPYMTVLADSALDEARQAE

SEQ ID NO: 1078574 - protein, 23 aa, Mycobacterium
RLNRPSRVLLAGHLDTVPVADNL

SEQ ID NO: 1078575 - protein, 28 aa, Mycobacterium
RLPAVDRAILRVAVWELLYADDVPEPVA

SEQ ID NO: 1078576 - protein, 23 aa, Mycobacterium
RLPEALSRFPITRVISSPQRRAV

SEQ ID NO: 1078577 - protein, 25 aa, Mycobacterium
RLPEIPQLRWRVTGAPLGLDRPWFV

SEQ ID NO: 1078578 - protein, 17 aa, Mycobacterium
RLPGDILRRLDDFAMES

SEQ ID NO: 1078579 - protein, 24 aa, Mycobacterium
RLPSPLPVLGIGVGGLQGLQVDHV

SEQ ID NO: 1078580 - protein, 18 aa, Mycobacterium
RLPTQRRLATNTQTGLAS

SEQ ID NO: 1078581 - protein, 26 aa, Mycobacterium
RLQCRPYWWFLWRLADQARQTIKTAS

SEQ ID NO: 1078582 - protein, 22 aa, Mycobacterium
RLQTHYAGRPSPLYEATRLSAH

SEQ ID NO: 1078583 - protein, 30 aa, Mycobacterium; identical to SEQ ID NO: 855306

SEQ ID NO: 1078584 - protein, 17 aa, Mycobacterium
RLRAKLVERINNLRVGH

SEQ ID NO: 1078585 - protein, 19 aa, Mycobacterium
RLRCSVAMGASYLRYAMAM

SEQ ID NO: 1078586 - protein, 25 aa, Mycobacterium
RLRELLKFEFLFSARVQFEKDLADE

SEQ ID NO: 1078587 - protein, 32 aa, Mycobacterium
RLREQAPLYYNQRYDFWAISRHADVEKALADW

SEQ ID NO: 1078588 - protein, 18 aa, Mycobacterium
RLRETLDRYPNAKEFFWV

SEQ ID NO: 1078589 - protein, 19 aa, Mycobacterium
RLRGQGHTPLLVACDLQRP

SEQ ID NO: 1078590 - protein, 22 aa, Mycobacterium
RLRHAVLWAPAVTDAALRRAVY

SEQ ID NO: 1078591 - protein, 23 aa, Mycobacterium
RLRLEHVGAIRPEQLRRAADLGV

SEQ ID NO: 1078592 - protein, 20 aa, Mycobacterium
RLRLLGFERVELEPGQSCAV

SEQ ID NO: 1078593 - protein, 18 aa, Mycobacterium
RLRMGAVGLPLQHHLGAR

SEQ ID NO: 1078594 - protein, 17 aa, Mycobacterium
RLRMICHGLGHTEGFRP

SEQ ID NO: 1078595 - protein, 20 aa, Mycobacterium
RLRMLVNAGLLDRVPYSQDP

SEQ ID NO: 1078596 - protein, 17 aa, Mycobacterium
RLRQALIQTSRLSVALR

SEQ ID NO: 1078597 - protein, 25 aa, Mycobacterium
RLRQKVVVPTLPTAAPRWVVDPDFN

SEQ ID NO: 1078598 - protein, 17 aa, Mycobacterium
RLRQRFAKLQDPPSDDI

SEQ ID NO: 1078599 - protein, 38 aa, Mycobacterium
RLRRTSIDAGWLLDYWSDRVYPLLWACVRDRDIVPPDR

SEQ ID NO: 1078600 - protein, 21 aa, Mycobacterium
RLRVAGAGLIRAWRARTSDAI

SEQ ID NO: 1078601 - protein, 20 aa, Mycobacterium
RLRVPTERWVYPQTGTEAHD

SEQ ID NO: 1078602 - protein, 26 aa, Mycobacterium
RLRVRLADRSLLQTNPLLGVASQLLM

SEQ ID NO: 1078603 - protein, 34 aa, Mycobacterium
RLSADGIAALIRRLPRPLVVVDERYRETIAADQS

SEQ ID NO: 1078604 - protein, 28 aa, Mycobacterium
RLSDRVLLRFGLHQALRLGKPLQLHIGF

SEQ ID NO: 1078605 - protein, 20 aa, Mycobacterium
RLSELDLLLRIVDAADVAFV

SEQ ID NO: 1078606 - protein, 27 aa, Mycobacterium
RLSEYPYMVPLIDREIRRPTYVFAAVD

SEQ ID NO: 1078607 - protein, 23 aa, Mycobacterium
RLSLADILQLGVALAAGLESAHR

SEQ ID NO: 1078608 - protein, 35 aa, Mycobacterium; identical to SEQ ID NO: 855442

SEQ ID NO: 1078609 - protein, 40 aa, Mycobacterium; identical to SEQ ID NO: 855454

SEQ ID NO: 1078610 - protein, 17 aa, Mycobacterium
RLSWAVLNWNSNAIAVY

SEQ ID NO: 1078611 - protein, 17 aa, Mycobacterium
RLTADAILANGLYVLPH

SEQ ID NO: 1078612 - protein, 17 aa, Mycobacterium
RLTAWLSSLTGLPVFSV

SEQ ID NO: 1078613 - protein, 20 aa, Mycobacterium
RLTIAMTRWQATVNWVADEP

SEQ ID NO: 1078614 - protein, 33 aa, Mycobacterium
RLTLDTRRLIDRASRWLLNYRPQPLAVGAEINR

SEQ ID NO: 1078615 - protein, 25 aa, Mycobacterium
RLTRRRHKLAPDPGIRRAILVAASM

SEQ ID NO: 1078616 - protein, 30 aa, Mycobacterium; identical to SEQ ID NO: 131395

SEQ ID NO: 1078617 - protein, 21 aa, Mycobacterium
RLTVFQRTPPWMVPKDDRRYT

SEQ ID NO: 1078618 - protein, 25 aa, Mycobacterium
RLTVPLGMIILRKGYGLGAMAMAGG

SEQ ID NO: 1078619 - protein, 32 aa, Mycobacterium; identical to SEQ ID NO: 855523

SEQ ID NO: 1078620 - protein, 20 aa, Mycobacterium
RLVELPGSDSLYWVGDTAAL

SEQ ID NO: 1078621 - protein, 33 aa, Mycobacterium
RLVELPTYAFQRQRFWLPRAPTGSVDPAGLGLG

SEQ ID NO: 1078622 - protein, 20 aa, Mycobacterium
RLVQGGGFAGPLFDGFDNLY

SEQ ID NO: 1078623 - protein, 18 aa, Mycobacterium
RLVRIDEPILRVPQLAIH

SEQ ID NO: 1078624 - protein, 18 aa, Mycobacterium
RLVVELTPDEAAALGDEL

SEQ ID NO: 1078625 - protein, 20 aa, Mycobacterium
RLWPHPPEELAPRYVEAMGG

SEQ ID NO: 1078626 - protein, 20 aa, Mycobacterium
RLWRVGVTAAVLWVLDGNAR

SEQ ID NO: 1078627 - protein, 23 aa, Mycobacterium
RLYAPSCIAPRGAIYAARVALPH

SEQ ID NO: 1078628 - protein, 18 aa, Mycobacterium
RLYDLELALRLGASVDRV

SEQ ID NO: 1078629 - protein, 17 aa, Mycobacterium
RLYDRFEPIHAVTYFAP

SEQ ID NO: 1078630 - protein, 19 aa, Mycobacterium
RLYGFARPMGPRMMCGETD

SEQ ID NO: 1078631 - protein, 17 aa, Mycobacterium
RLYPAVVAAVQQSCRTL

SEQ ID NO: 1078632 - protein, 25 aa, Mycobacterium
RLYPRTAAELFSWGRSWLETCQNAF

SEQ ID NO: 1078633 - protein, 24 aa, Mycobacterium
RLYSFKDILVLKIVKRLLDTGISL

SEQ ID NO: 1078634 - protein, 22 aa, Mycobacterium
RMAHERVVLRQLVFGYTYEELN

SEQ ID NO: 1078635 - protein, 18 aa, Mycobacterium
RMAKFLSGQLWESAGSPE

SEQ ID NO: 1078636 - protein, 24 aa, Mycobacterium
RMCLARTLLAQPQVLLLDAPNSAV

SEQ ID NO: 1078637 - protein, 19 aa, Mycobacterium
RMFDALITALHQRTGRTTS

SEQ ID NO: 1078638 - protein, 17 aa, Mycobacterium
RMFTGAGSAPMLQAAAA

SEQ ID NO: 1078639 - protein, 18 aa, Mycobacterium
RMGALALHVAKIARRRHP

SEQ ID NO: 1078640 - protein, 30 aa, Mycobacterium
RMHGRLTQCQPGWLLAPPIAYGASGEHQSF

SEQ ID NO: 1078641 - protein, 29 aa, Mycobacterium
RMIEDGWVRAQLLHYMRSAPDFYFDEMAQ

SEQ ID NO: 1078642 - protein, 17 aa, Mycobacterium
RMLGVFKQLSPGADVQG

SEQ ID NO: 1078643 - protein, 18 aa, Mycobacterium
RMMRLVTEQAPDAILTLH

SEQ ID NO: 1078644 - protein, 22 aa, Mycobacterium
RMPDTDLAWHDLVRGPTTFAAG

SEQ ID NO: 1078645 - protein, 22 aa, Mycobacterium
RMPRWYRPVGGLYDQFLGAAET

SEQ ID NO: 1078646 - protein, 25 aa, Mycobacterium
RMRHMPFRITPIERDAWLRCMHTAV

SEQ ID NO: 1078647 - protein, 20 aa, Mycobacterium
RMRTRWINFATQDNPAGPAG

SEQ ID NO: 1078648 - protein, 17 aa, Mycobacterium
RMSLAMAGWPKSDRKRR

SEQ ID NO: 1078649 - protein, 17 aa, Mycobacterium
RMSTYLVALIAGPYAVW

SEQ ID NO: 1078650 - protein, 22 aa, Mycobacterium
RMVVLMQRFGLDRMIVNSAADW

SEQ ID NO: 1078651 - protein, 31 aa, Mycobacterium
RNADGRVIGVLTLLWPTPRQFDASELEMFTR

SEQ ID NO: 1078652 - protein, 17 aa, Mycobacterium
RNAILFRPSPYAVRCCE

SEQ ID NO: 1078653 - protein, 17 aa, Mycobacterium
RNAPQGEFLLFDDRVHT

SEQ ID NO: 1078654 - protein, 24 aa, Mycobacterium
RNAWNEFIPFLDYDTEIRKVICST

SEQ ID NO: 1078655 - protein, 18 aa, Mycobacterium
RNCTAVCVGTYIASATRT

SEQ ID NO: 1078656 - protein, 20 aa, Mycobacterium
RNFLLPPTWTQLDALAGHTV

SEQ ID NO: 1078657 - protein, 40 aa, Mycobacterium; identical to SEQ ID NO: 122201

SEQ ID NO: 1078658 - protein, 20 aa, Mycobacterium
RNGPWIADQLLELGVELAHI

SEQ ID NO: 1078659 - protein, 19 aa, Mycobacterium
RNIIDYRVTTLPAARRNAQ

SEQ ID NO: 1078660 - protein, 24 aa, Mycobacterium
RNKRAYSHSGYPGGLRKRSIGELM

SEQ ID NO: 1078661 - protein, 17 aa, Mycobacterium
RNLFVVSGKLQVGRLWV

SEQ ID NO: 1078662 - protein, 19 aa, Mycobacterium
RNLPHAEVRFVWHDPGPIT

SEQ ID NO: 1078663 - protein, 28 aa, Mycobacterium
RNPAALCYALLAYGFTFRDTNPASALAA

SEQ ID NO: 1078664 - protein, 18 aa, Mycobacterium
RNPWLHRVAGQPRATGDP

SEQ ID NO: 1078665 - protein, 23 aa, Mycobacterium
RNQIQLFNALLLSLPGSPVLYYG

SEQ ID NO: 1078666 - protein, 25 aa, Mycobacterium
RNRLKIISGLALPPTLIVDYPTPQL

SEQ ID NO: 1078667 - protein, 20 aa, Mycobacterium
RNRMFLQRLKDKLGNHANAS

SEQ ID NO: 1078668 - protein, 17 aa, Mycobacterium
RNRSLPFPTLVSIQLAD

SEQ ID NO: 1078669 - protein, 25 aa, Mycobacterium
RNTLTWVQKYIFPGGLLPSTQAIAD

SEQ ID NO: 1078670 - protein, 17 aa, Mycobacterium
RNTLVERITAFDPPTSL

SEQ ID NO: 1078671 - protein, 18 aa, Mycobacterium
RNTVYPSGTHVGNTSGFV

SEQ ID NO: 1078672 - protein, 25 aa, Mycobacterium
RNVNPIYNWPLPRLAVNIVGSDHGG

SEQ ID NO: 1078673 - protein, 17 aa, Mycobacterium
RNVVLEKKWGAPTITND

SEQ ID NO: 1078674 - protein, 21 aa, Mycobacterium
RNWMDSAREGHLAWGIQHFRK

SEQ ID NO: 1078675 - protein, 17 aa, Mycobacterium
RNWVVDPRELGLTTSVY

SEQ ID NO: 1078676 - protein, 18 aa, Mycobacterium
RPALKDRAFIPDTHPAFA

SEQ ID NO: 1078677 - protein, 28 aa, Mycobacterium
RPAMPAECLLDRNALIMGYSGVYSSFLK

SEQ ID NO: 1078678 - protein, 20 aa, Mycobacterium
RPARTAWHWCPALPKIRRAG

SEQ ID NO: 1078679 - protein, 17 aa, Mycobacterium
RPATRPPAQRWRGPPTP

SEQ ID NO: 1078680 - protein, 18 aa, Mycobacterium
RPCLSIHAAIVFTSPNPR

SEQ ID NO: 1078681 - protein, 26 aa, Mycobacterium
RPDGLTVPRPAVFFDFDGTLSEIVDD

SEQ ID NO: 1078682 - protein, 19 aa, Mycobacterium
RPDLRVPLITIITETDLFG

SEQ ID NO: 1078683 - protein, 19 aa, Mycobacterium
RPDLVILRGRTYRPNQLGH

SEQ ID NO: 1078684 - protein, 32 aa, Mycobacterium
RPDSATGLAPLRWGTGFMLGSNRFGPFGRNAP

SEQ ID NO: 1078685 - protein, 19 aa, Mycobacterium
RPDTLFGATYLVLAPEHDL

SEQ ID NO: 1078686 - protein, 17 aa, Mycobacterium
RPDTPFRYESDPPFEHD

SEQ ID NO: 1078687 - protein, 22 aa, Mycobacterium
RPDTWLQWLHAEHYPALLASPG

SEQ ID NO: 1078688 - protein, 23 aa, Mycobacterium
RPEFEQALANKGWAALPGLQTNP

SEQ ID NO: 1078689 - protein, 17 aa, Mycobacterium
RPELLLEPEAPQAPFPL

SEQ ID NO: 1078690 - protein, 25 aa, Mycobacterium
RPEMLLHAILKLHEKIQEMPLGVNR

SEQ ID NO: 1078691 - protein, 24 aa, Mycobacterium
RPERLRSGWLNGIKHWQVDYHSDS

SEQ ID NO: 1078692 - protein, 22 aa, Mycobacterium
RPEYAPGWLAVTEDPAALLGLE

SEQ ID NO: 1078693 - protein, 21 aa, Mycobacterium
RPFCAPLPEALTSRFILAPAA

SEQ ID NO: 1078694 - protein, 20 aa, Mycobacterium
RPGALPAFSDDRWEFYDLFR

SEQ ID NO: 1078695 - protein, 21 aa, Mycobacterium
RPGFGFGPGPAQRRALHSARR

SEQ ID NO: 1078696 - protein, 23 aa, Mycobacterium
RPGGLAVLSYTVWLGPFGGHEMG

SEQ ID NO: 1078697 - protein, 20 aa, Mycobacterium
RPGHRRIVLRFLTSPIEIKG

SEQ ID NO: 1078698 - protein, 28 aa, Mycobacterium
RPGLDLPDLELIFAPAPFYDEGLPAHPP

SEQ ID NO: 1078699 - protein, 19 aa, Mycobacterium
RPGLVVLVAFDPADRQQLS

SEQ ID NO: 1078700 - protein, 26 aa, Mycobacterium
RPGPRGFIGQPIPIAGLYLGSAGCHG

SEQ ID NO: 1078701 - protein, 27 aa, Mycobacterium
RPGQKLRIVKYLAYGWSSLRSRPALRD

SEQ ID NO: 1078702 - protein, 26 aa, Mycobacterium
RPGQRQLLPLRPLLRNGWSQRGKSKL

SEQ ID NO: 1078703 - protein, 23 aa, Mycobacterium
RPGRPRAAPPVRKLAKELMVDLA

SEQ ID NO: 1078704 - protein, 24 aa, Mycobacterium
RPHDPPWCRPLLGVRRGVTHDACR

SEQ ID NO: 1078705 - protein, 24 aa, Mycobacterium
RPHPGQRIVGLSKLARLVDGYAAR

SEQ ID NO: 1078706 - protein, 19 aa, Mycobacterium
RPKRRFRLGGFASWHAVGE

SEQ ID NO: 1078707 - protein, 17 aa, Mycobacterium
RPLLEHPAALHASIREE

SEQ ID NO: 1078708 - protein, 19 aa, Mycobacterium
RPLRPSFVNGLRNEIQVVV

SEQ ID NO: 1078709 - protein, 27 aa, Mycobacterium
RPLTASLGLMILASGHRYGWPVAQGGS

SEQ ID NO: 1078710 - protein, 36 aa, Mycobacterium; identical to SEQ ID NO: 783425

SEQ ID NO: 1078711 - protein, 31 aa, Mycobacterium
RPMADTVLRYELMGRFLPNSMFLQAAERDLI

SEQ ID NO: 1078712 - protein, 17 aa, Mycobacterium
RPMAHIHFAALHRDRNW

SEQ ID NO: 1078713 - protein, 19 aa, Mycobacterium
RPMRGCYRIALVSLKGGVG

SEQ ID NO: 1078714 - protein, 20 aa, Mycobacterium
RPPMVTSGLRIGTPALATRG

SEQ ID NO: 1078715 - protein, 24 aa, Mycobacterium
RPQFRRRGLARRLLATLAAECLDN

SEQ ID NO: 1078716 - protein, 25 aa, Mycobacterium
RPQLATTLLPALLEALGRNVSRGLA

SEQ ID NO: 1078717 - protein, 17 aa, Mycobacterium
RPQLSDDVARYVRKRIY

SEQ ID NO: 1078718 - protein, 27 aa, Mycobacterium
RPQYRELLQEFLFGLDLDDETRRRAAL

SEQ ID NO: 1078719 - protein, 18 aa, Mycobacterium
RPRDWLHHKGVSPAAQRG

SEQ ID NO: 1078720 - protein, 18 aa, Mycobacterium
RPRHLHWPVLRHSHGHSP

SEQ ID NO: 1078721 - protein, 21 aa, Mycobacterium
RPRIEELLTADRVALRQLITK

SEQ ID NO: 1078722 - protein, 21 aa, Mycobacterium
RPRLRLVALMSYEGHIAGFGD

SEQ ID NO: 1078723 - protein, 18 aa, Mycobacterium
RPRRILFVSGGSGITPVL

SEQ ID NO: 1078724 - protein, 49 aa, Mycobacterium
RPRRRAPRPVPWRPNLSPRGLRWCRRRWWRLTVRTWCRWCFRIFSGKTR

SEQ ID NO: 1078725 - protein, 18 aa, Mycobacterium
RPSQCVLVIIPTFNELEN

SEQ ID NO: 1078726 - protein, 20 aa, Mycobacterium
RPTLRHRIMLRLEAELEGAT

SEQ ID NO: 1078727 - protein, 17 aa, Mycobacterium
RPTPLLLATTLSGGNRL

SEQ ID NO: 1078728 - protein, 20 aa, Mycobacterium
RPTPRVLGWRDHRADPPWPV

SEQ ID NO: 1078729 - protein, 23 aa, Mycobacterium
RPTRPHPLFVAFVGAAIDYKSAE

SEQ ID NO: 1078730 - protein, 19 aa, Mycobacterium
RPTTLEVIFCYPGVHAVWG

SEQ ID NO: 1078731 - protein, 27 aa, Mycobacterium
RPVALPRLAALAQWLEAHLPGITPAER

SEQ ID NO: 1078732 - protein, 21 aa, Mycobacterium
RPVPPPRVRGNLPAPLSEFVG

SEQ ID NO: 1078733 - protein, 25 aa, Mycobacterium
RPVPQLLTMGLLRRIDADTVILPRH

SEQ ID NO: 1078734 - protein, 17 aa, Mycobacterium
RPVVLIGASMGGLTGIL

SEQ ID NO: 1078735 - protein, 31 aa, Mycobacterium; identical to SEQ ID NO: 785811

SEQ ID NO: 1078736 - protein, 19 aa, Mycobacterium
RPYHTIIPGFVTKDGAPVL

SEQ ID NO: 1078737 - protein, 23 aa, Mycobacterium
RPYLALFEEVVAVQAALLARWML

SEQ ID NO: 1078738 - protein, 27 aa, Mycobacterium
RPYRECGYLPMVELLQYLTGNGFTNYI

SEQ ID NO: 1078739 - protein, 37 aa, Mycobacterium; identical to SEQ ID NO: 856354

SEQ ID NO: 1078740 - protein, 17 aa, Mycobacterium
RQALRILGLGADAVIEV

SEQ ID NO: 1078741 - protein, 24 aa, Mycobacterium
RQARFSAAFTFQYSKRPGTPAAEL

SEQ ID NO: 1078742 - protein, 22 aa, Mycobacterium
RQDIDDIFWLQATIARELAVTA

SEQ ID NO: 1078743 - protein, 22 aa, Mycobacterium
RQDLEKLVRIESVWADPGRRAE

SEQ ID NO: 1078744 - protein, 22 aa, Mycobacterium
RQDPGLLIICAHDPSLYAVAKD

SEQ ID NO: 1078745 - protein, 28 aa, Mycobacterium
RQEAVLEDPYILLVSSKVSTVKDLLPLL

SEQ ID NO: 1078746 - protein, 26 aa, Mycobacterium
RQEDFIGVHFFSPVDKMPLVEIIKGE

SEQ ID NO: 1078747 - protein, 20 aa, Mycobacterium
RQFERLLAKVLRKVTTKLAA

SEQ ID NO: 1078748 - protein, 23 aa, Mycobacterium
RQFQVFLDDVRLPADALVGAQDA

SEQ ID NO: 1078749 - protein, 20 aa, Mycobacterium
RQFRASVCVLGPLVGRCKRA

SEQ ID NO: 1078750 - protein, 26 aa, Mycobacterium
RQFRQRLWQGLDRLGGFLARVRGSRE

SEQ ID NO: 1078751 - protein, 21 aa, Mycobacterium
RQGAQLAKLTRWFTPAEVLQQ

SEQ ID NO: 1078752 - protein, 23 aa, Mycobacterium
RQGDSWLLIGTKNPVLAGDCADT

SEQ ID NO: 1078753 - protein, 24 aa, Mycobacterium
RQGIAQLFDVPPLPYQEVKIATAE

SEQ ID NO: 1078754 - protein, 19 aa, Mycobacterium
RQGWRMLYDRSPAGSPRRA

SEQ ID NO: 1078755 - protein, 21 aa, Mycobacterium
RQGYQLGEHVLRNALVAVVET

SEQ ID NO: 1078756 - protein, 19 aa, Mycobacterium
RQHGVWAHVDACVGGCLAF

SEQ ID NO: 1078757 - protein, 17 aa, Mycobacterium
RQHYIRILPEDRVVVEL

SEQ ID NO: 1078758 - protein, 21 aa, Mycobacterium
RQIAELLVRAVGRSHQVRVAP

SEQ ID NO: 1078759 - protein, 20 aa, Mycobacterium
RQIMAAPSLARYCPEELLPG

SEQ ID NO: 1078760 - protein, 18 aa, Mycobacterium
RQKLRKHLEACPGCLKHY

SEQ ID NO: 1078761 - protein, 23 aa, Mycobacterium
RQLDPRTRLLLGTNPDGSLTALL

SEQ ID NO: 1078762 - protein, 19 aa, Mycobacterium
RQLPGQILVLGGGEARDLD

SEQ ID NO: 1078763 - protein, 26 aa, Mycobacterium
RQLRSELKMLPALPVAELRAQADELA

SEQ ID NO: 1078764 - protein, 18 aa, Mycobacterium
RQLWDDDIPGACDSTLLI

SEQ ID NO: 1078765 - protein, 18 aa, Mycobacterium
RQLWEDRGSPRLPPRSRD

SEQ ID NO: 1078766 - protein, 19 aa, Mycobacterium
RQMLRRVTIIDSGATEFLP

SEQ ID NO: 1078767 - protein, 31 aa, Mycobacterium
RQPDLLDRSARWRPWRSYATQHLWTTLEHSV

SEQ ID NO: 1078768 - protein, 19 aa, Mycobacterium
RQPDYLTAFAALWETINLE

SEQ ID NO: 1078769 - protein, 21 aa, Mycobacterium
RQPMRRIVQARTLSPITSVAG

SEQ ID NO: 1078770 - protein, 18 aa, Mycobacterium
RQPWWAPIVDVGPGPAVL

SEQ ID NO: 1078771 - protein, 31 aa, Mycobacterium
RQQKALMPDKPFFMYFAPGATHAPHHVPKVW

SEQ ID NO: 1078772 - protein, 18 aa, Mycobacterium
RQQRVPLGVVGMIYEGRP

SEQ ID NO: 1078773 - protein, 19 aa, Mycobacterium
RQRDTYFPYFPRPPEEREV

SEQ ID NO: 1078774 - protein, 18 aa, Mycobacterium
RQRFAKLQDPPSDDICYA

SEQ ID NO: 1078775 - protein, 17 aa, Mycobacterium
RQRFNKDVIIDMLCYRR

SEQ ID NO: 1078776 - protein, 17 aa, Mycobacterium
RQRHSSLLPLLHNYRQP

SEQ ID NO: 1078777 - protein, 20 aa, Mycobacterium
RQRHWVEPKHMAWAQIPTAS

SEQ ID NO: 1078778 - protein, 29 aa, Mycobacterium
RQRKQPPLQRLLRALLGFDAKLNQYTRGK

SEQ ID NO: 1078779 - protein, 19 aa, Mycobacterium
RQRLATAPVIIEWCQLPAG

SEQ ID NO: 1078780 - protein, 20 aa, Mycobacterium
RQRLLNLQRAMAEGTGSIVV

SEQ ID NO: 1078781 - protein, 29 aa, Mycobacterium
RQRMHLLFGVCSTTIWARRVLAGAPFDDV

SEQ ID NO: 1078782 - protein, 17 aa, Mycobacterium
RQRWSPPTPVALDATES

SEQ ID NO: 1078783 - protein, 27 aa, Mycobacterium
RQRYVEPYRMELQRLGRPVFGPTFEVD

SEQ ID NO: 1078784 - protein, 29 aa, Mycobacterium
RQSDYGVKPYLLLMGSLQVADEVTISFSA

SEQ ID NO: 1078785 - protein, 22 aa, Mycobacterium
RQTAVLRNWEFFRAPLGGIVSM

SEQ ID NO: 1078786 - protein, 20 aa, Mycobacterium
RQTVIDRGLIGNKLSLEELD

SEQ ID NO: 1078787 - protein, 24 aa, Mycobacterium
RQVAPLAKFYSVPPADLIVIHDEL

SEQ ID NO: 1078788 - protein, 27 aa, Mycobacterium
RQVGQKFAREIFFLGRPYTAEQMHHMG

SEQ ID NO: 1078789 - protein, 27 aa, Mycobacterium
RQVMPVHGTWRMLRANAKLAASTGVPE

SEQ ID NO: 1078790 - protein, 23 aa, Mycobacterium
RQVPGLWTIPHTAPGKSQIGGAS

SEQ ID NO: 1078791 - protein, 25 aa, Mycobacterium
RQVQELLLALLPDSGKAHRVGITGV

SEQ ID NO: 1078792 - protein, 36 aa, Mycobacterium
RQWLEIRYLDSLSNVFWPAVVFTLVTLLDDPGAAEL

SEQ ID NO: 1078793 - protein, 23 aa, Mycobacterium
RQYRDMRILGIGGGTTEILTALA

SEQ ID NO: 1078794 - protein, 18 aa, Mycobacterium
RQYRYAYAATGKPGWFLF

SEQ ID NO: 1078795 - protein, 18 aa, Mycobacterium
RRAAEMLKPCTLELGGKS

SEQ ID NO: 1078796 - protein, 26 aa, Mycobacterium
RRAASRQASWLPARTASAVLAVTPGL

SEQ ID NO: 1078797 - protein, 24 aa, Mycobacterium
RRADQASWLRYGLPARFGGRDGTN

SEQ ID NO: 1078798 - protein, 23 aa, Mycobacterium
RRAEVTSLLRFAGGLHIVAGRVV

SEQ ID NO: 1078799 - protein, 18 aa, Mycobacterium
RRAHARLSADYRARSLTI

SEQ ID NO: 1078800 - protein, 21 aa, Mycobacterium
RRAIVRLLLESGSITAGEIGD

SEQ ID NO: 1078801 - protein, 18 aa, Mycobacterium
RRAKTARQAPTPTAAPGA

SEQ ID NO: 1078802 - protein, 22 aa, Mycobacterium
RRARFRLIAVDRPGYGRSTFQE

SEQ ID NO: 1078803 - protein, 31 aa, Mycobacterium; identical to SEQ ID NO: 856665

SEQ ID NO: 1078804 - protein, 23 aa, Mycobacterium
RRASWVYYAVVPEALNALSRLLS

SEQ ID NO: 1078805 - protein, 23 aa, Mycobacterium
RRAVLRVLRALGHPLSIVAIAEH

SEQ ID NO: 1078806 - protein, 19 aa, Mycobacterium
RRCSTCCRATWTCPMPARP

SEQ ID NO: 1078807 - protein, 24 aa, Mycobacterium
RRDALRAHILPVIFEWYVGHEVNG

SEQ ID NO: 1078808 - protein, 22 aa, Mycobacterium
RRDEALHWFLRSAAADSEGVTD

SEQ ID NO: 1078809 - protein, 25 aa, Mycobacterium
RRDGEVLMAQLLRIATKSAPDLRAY

SEQ ID NO: 1078810 - protein, 24 aa, Mycobacterium
RRDPALWQRLEQLGLARLTGAEDS

SEQ ID NO: 1078811 - protein, 29 aa, Mycobacterium
RRDRRTFTASYLILAAGTWGTQHLLFKMR

SEQ ID NO: 1078812 - protein, 24 aa, Mycobacterium
RRDTATRLLLLRHGQTELSVQRRY

SEQ ID NO: 1078813 - protein, 22 aa, Mycobacterium
RREEPWTFGLIEQKSRARGNTP

SEQ ID NO: 1078814 - protein, 24 aa, Mycobacterium
RREIDRVRLFYYHAERPMADTVLR

SEQ ID NO: 1078815 - protein, 21 aa, Mycobacterium
RRELLGRRDQLNATLAGLCGD

SEQ ID NO: 1078816 - protein, 24 aa, Mycobacterium
RREVLPGVGLYLDGGFGVGNTHLL

SEQ ID NO: 1078817 - protein, 18 aa, Mycobacterium
RRFGDAFIPMDETLAHAA

SEQ ID NO: 1078818 - protein, 22 aa, Mycobacterium
RRFWRDEYLMNGQIGRFSKPYV

SEQ ID NO: 1078819 - protein, 25 aa, Mycobacterium
RRGANFFTSVFPPLVLAAAGVHLNV

SEQ ID NO: 1078820 - protein, 17 aa, Mycobacterium
RRGATVALVYLSPDAKP

SEQ ID NO: 1078821 - protein, 19 aa, Mycobacterium
RRGFFRSEPERILIGDWRY

SEQ ID NO: 1078822 - protein, 25 aa, Mycobacterium
RRGKAIIILNPADPPMIMRDTIFCA

SEQ ID NO: 1078823 - protein, 35 aa, Mycobacterium; identical to SEQ ID NO: 856796

SEQ ID NO: 1078824 - protein, 41 aa, Mycobacterium
RRGLEALTLDIYRIGQYIAWRLWINIAFDLTSDPQELHELL

SEQ ID NO: 1078825 - protein, 18 aa, Mycobacterium
RRGLKAAITAVRAWRRAK

SEQ ID NO: 1078826 - protein, 23 aa, Mycobacterium
RRGPFDFLCAFKDIIDRSAAAGD

SEQ ID NO: 1078827 - protein, 29 aa, Mycobacterium
RRGPIDRFHRRLLWPIRSSAGEVIGFGAR

SEQ ID NO: 1078828 - protein, 20 aa, Mycobacterium
RRHHRQLYHLARLTSQTPED

SEQ ID NO: 1078829 - protein, 19 aa, Mycobacterium
RRHQPILIALNEMAGYEPQ

SEQ ID NO: 1078830 - protein, 25 aa, Mycobacterium
RRHVNRWFYDCPPAFHRNLGDMYVS

SEQ ID NO: 1078831 - protein, 31 aa, Mycobacterium
RRHYAYLKKVLQALTFLRGPQTWVLKRPQHC

SEQ ID NO: 1078832 - protein, 21 aa, Mycobacterium
RRIFELGVRAYLDGLWEHRRV

SEQ ID NO: 1078833 - protein, 29 aa, Mycobacterium
RRIIADEGLLGALRFAKNLLTQPAARKRV

SEQ ID NO: 1078834 - protein, 21 aa, Mycobacterium
RRIVDAVARQEPGLSWAAGLR

SEQ ID NO: 1078835 - protein, 17 aa, Mycobacterium
RRLKKPLIAAVEGPAIA

SEQ ID NO: 1078836 - protein, 23 aa, Mycobacterium
RRLLAWATPYREMMGPFVAVYAR

SEQ ID NO: 1078837 - protein, 22 aa, Mycobacterium
RRLLEHGFIKGIIGLPPNLFYG

SEQ ID NO: 1078838 - protein, 17 aa, Mycobacterium
RRLLELPAGLRDAAGEP

SEQ ID NO: 1078839 - protein, 17 aa, Mycobacterium
RRLLRYDTLILDEAHER

SEQ ID NO: 1078840 - protein, 25 aa, Mycobacterium
RRLQALDVPVPRYLGIHQLEELGEL

SEQ ID NO: 1078841 - protein, 18 aa, Mycobacterium
RRLQPEPISDLLAESEAL

SEQ ID NO: 1078842 - protein, 17 aa, Mycobacterium
RRLRRTSNNLADLIFTD

SEQ ID NO: 1078843 - protein, 19 aa, Mycobacterium
RRLTRWTRLYPDVRVESAI

SEQ ID NO: 1078844 - protein, 17 aa, Mycobacterium
RRLWGSRPPVRPMANSN

SEQ ID NO: 1078845 - protein, 22 aa, Mycobacterium
RRNINMTILLFNNRIYGLTKGQ

SEQ ID NO: 1078846 - protein, 19 aa, Mycobacterium
RRNTLARFELFMEGTRRPE

SEQ ID NO: 1078847 - protein, 21 aa, Mycobacterium
RRPELQPFLVELQRAAVKSAT

SEQ ID NO: 1078848 - protein, 18 aa, Mycobacterium
RRPEVPALLAELGLSERQ

SEQ ID NO: 1078849 - protein, 24 aa, Mycobacterium
RRPRGPALLDYIAEYRRRAGITTE

SEQ ID NO: 1078850 - protein, 17 aa, Mycobacterium
RRPSLVPVEAIELLGGT

SEQ ID NO: 1078851 - protein, 22 aa, Mycobacterium
RRPTAGLWCRPGLPGDGSDWNH

SEQ ID NO: 1078852 - protein, 25 aa, Mycobacterium
RRQLAFLYGGVIYDLGGALLGLRPV

SEQ ID NO: 1078853 - protein, 18 aa, Mycobacterium
RRQPWPLSLLATHPIDVS

SEQ ID NO: 1078854 - protein, 24 aa, Mycobacterium
RRQRLTVTYQRRGYTPARAARNIL

SEQ ID NO: 1078855 - protein, 24 aa, Mycobacterium
RRQRRRWWHRWLVIRRRRCGRGRR

SEQ ID NO: 1078856 - protein, 18 aa, Mycobacterium
RRQSSLTMVLLVVASAPS

SEQ ID NO: 1078857 - protein, 28 aa, Mycobacterium
RRRAAHGRPLWYLMPDGVVQYVSKRRLY

SEQ ID NO: 1078858 - protein, 25 aa, Mycobacterium
RRRERGRGKLRRRKLRPAEHRGRER

SEQ ID NO: 1078859 - protein, 26 aa, Mycobacterium
RRRGDYLYDFWRDANNPRGLWRRTTL

SEQ ID NO: 1078860 - protein, 19 aa, Mycobacterium
RRRGSAPPGPLRPIVDLES

SEQ ID NO: 1078861 - protein, 19 aa, Mycobacterium
RRRIWELEKRRAHVPWVTW

SEQ ID NO: 1078862 - protein, 18 aa, Mycobacterium
RRRLDVAISLLARPQVLF

SEQ ID NO: 1078863 - protein, 22 aa, Mycobacterium
RRRLLMPLFHGNLMKSYESIIE

SEQ ID NO: 1078864 - protein, 22 aa, Mycobacterium
RRRLPSRGAILLRRGPDGALAH

SEQ ID NO: 1078865 - protein, 24 aa, Mycobacterium
RRRQARGLRLNHPEAVALITDHVL

SEQ ID NO: 1078866 - protein, 24 aa, Mycobacterium
RRRQVYPWVGWLVCHGVAPGDVLV

SEQ ID NO: 1078867 - protein, 23 aa, Mycobacterium
RRRRRHRWGRRCHPSQWQQGQQR

SEQ ID NO: 1078868 - protein, 25 aa, Mycobacterium
RRRTPPQWFRVPSNTYFNEGALDNL

SEQ ID NO: 1078869 - protein, 25 aa, Mycobacterium
RRSADTHLLRYPLPSAWSNDANVEL

SEQ ID NO: 1078870 - protein, 18 aa, Mycobacterium
RRSAWWAGALTLGVAKIV

SEQ ID NO: 1078871 - protein, 23 aa, Mycobacterium
RRSQLPRACPLPMPGHGRCYSPA

SEQ ID NO: 1078872 - protein, 18 aa, Mycobacterium
RRTLTMLMADIRGFTRLS

SEQ ID NO: 1078873 - protein, 25 aa, Mycobacterium
RRTMARVFPNLFATHRVRAVDDYPS

SEQ ID NO: 1078874 - protein, 20 aa, Mycobacterium
RRTRLLELQERLSPAFVSEP

SEQ ID NO: 1078875 - protein, 25 aa, Mycobacterium
RRTSWKVFARRLPAGRRYGVVAGTG

SEQ ID NO: 1078876 - protein, 51 aa, Mycobacterium
RRTWDADNAFYQFLGPPGSMWSQWLTLPAAAGPIVLALNAGHRGRHVESCS

SEQ ID NO: 1078877 - protein, 32 aa, Mycobacterium
RRVARAPFTLLNIAVRPSLLNPTPMLTLGGIK

SEQ ID NO: 1078878 - protein, 24 aa, Mycobacterium
RRVHPLRDQWWQSLVPDLGRIEVP

SEQ ID NO: 1078879 - protein, 18 aa, Mycobacterium
RRVKAMSYGLAYGLSAYG

SEQ ID NO: 1078880 - protein, 20 aa, Mycobacterium
RRVRDYLVLMPSRPVSLLMQ

SEQ ID NO: 1078881 - protein, 21 aa, Mycobacterium
RRVRDYLVLMPSRPVSLLMQE

SEQ ID NO: 1078882 - protein, 23 aa, Mycobacterium
RRVRPLPAGLFSRVEEFARKCSA

SEQ ID NO: 1078883 - protein, 25 aa, Mycobacterium
RRWNPKMKRFIFTDRNGIYIIDLQQ

SEQ ID NO: 1078884 - protein, 25 aa, Mycobacterium
RRYQATYMNYVGKPLAYILATPERD

SEQ ID NO: 1078885 - protein, 18 aa, Mycobacterium
RRYRPGDPPLAGSLLIGG

SEQ ID NO: 1078886 - protein, 24 aa, Mycobacterium
RSAAGRHIGAFAAGRIGATGPRRC

SEQ ID NO: 1078887 - protein, 17 aa, Mycobacterium
RSAALAGWMDYLRGVSE

SEQ ID NO: 1078888 - protein, 23 aa, Mycobacterium
RSADLFLGVPFNIASYALLTHMM

SEQ ID NO: 1078889 - protein, 23 aa, Mycobacterium
RSADTWILDQLFPADRATPMVTV

SEQ ID NO: 1078890 - protein, 18 aa, Mycobacterium
RSAKAFPFPVFFQEFEVT

SEQ ID NO: 1078891 - protein, 17 aa, Mycobacterium
RSALPRPGRVRELLELT

SEQ ID NO: 1078892 - protein, 20 aa, Mycobacterium
RSAPVRLRALQRLELEALPR

SEQ ID NO: 1078893 - protein, 30 aa, Mycobacterium; identical to SEQ ID NO: 857354

SEQ ID NO: 1078894 - protein, 18 aa, Mycobacterium
RSAVWPNTRRPPRTSTWV

SEQ ID NO: 1078895 - protein, 19 aa, Mycobacterium
RSAWHELFAKNLEAMFFMS

SEQ ID NO: 1078896 - protein, 24 aa, Mycobacterium
RSAYPRIDLLINNAGVMWTPKQVT

SEQ ID NO: 1078897 - protein, 29 aa, Mycobacterium
RSDDHLQGHWLLARLGKRVLRPGGVELTR

SEQ ID NO: 1078898 - protein, 26 aa, Mycobacterium
RSDDKPIPFVTYALDADGLMHSQADH

SEQ ID NO: 1078899 - protein, 27 aa, Mycobacterium
RSDDKPIPFVTYALDADGLMHSQADHT

SEQ ID NO: 1078900 - protein, 27 aa, Mycobacterium
RSDRGPGRFFTMRLALSDIGVSDITVT

SEQ ID NO: 1078901 - protein, 22 aa, Mycobacterium
RSDTVMLVNIPANRKRVVAVSF

SEQ ID NO: 1078902 - protein, 26 aa, Mycobacterium
RSEGGGLVLLKPLRAALEDGNSIRAV

SEQ ID NO: 1078903 - protein, 28 aa, Mycobacterium
RSEMEMKVLLWAVQRLIGGLSTIGAERD

SEQ ID NO: 1078904 - protein, 17 aa, Mycobacterium
RSETISEFLAALETPRR

SEQ ID NO: 1078905 - protein, 18 aa, Mycobacterium
RSFVLRVPIINAPMGEIT

SEQ ID NO: 1078906 - protein, 21 aa, Mycobacterium
RSFYALDRLWADCPVVAVDLA

SEQ ID NO: 1078907 - protein, 29 aa, Mycobacterium
RSGFVVNALLVPYLLSAIRMVEAGFATVE

SEQ ID NO: 1078908 - protein, 23 aa, Mycobacterium
RSGKIMRRLLRDIAEKRELGDTS

SEQ ID NO: 1078909 - protein, 18 aa, Mycobacterium
RSGNLGNENIGFGNTGNP

SEQ ID NO: 1078910 - protein, 22 aa, Mycobacterium
RSGPERFLSTFVLLAATAESMA

SEQ ID NO: 1078911 - protein, 21 aa, Mycobacterium
RSGREMLYRLADYHLTHIVVD

SEQ ID NO: 1078912 - protein, 25 aa, Mycobacterium
RSGTRTFDFLIGADGLHSNVRRKVF

SEQ ID NO: 1078913 - protein, 23 aa, Mycobacterium
RSGYVITPVVIWGGGRLDPHLVP

SEQ ID NO: 1078914 - protein, 19 aa, Mycobacterium
RSHLDWYRQLAEKACEEWF

SEQ ID NO: 1078915 - protein, 17 aa, Mycobacterium
RSHPECFLRGAYIPVLA

SEQ ID NO: 1078916 - protein, 19 aa, Mycobacterium
RSHPMTVDWISYAQSLTAK

SEQ ID NO: 1078917 - protein, 20 aa, Mycobacterium
RSIIAGYRLSPQDATVAVMP

SEQ ID NO: 1078918 - protein, 19 aa, Mycobacterium
RSIYQDGWWACARLDKAPW

SEQ ID NO: 1078919 - protein, 17 aa, Mycobacterium
RSLDVYPVNYPASDNWD

SEQ ID NO: 1078920 - protein, 20 aa, Mycobacterium
RSLIRHLGVLEVPRLQLREA

SEQ ID NO: 1078921 - protein, 23 aa, Mycobacterium
RSLLELAKLDAELSRIAHRSTHL

SEQ ID NO: 1078922 - protein, 17 aa, Mycobacterium
RSLPLAPRNPLPYWQQL

SEQ ID NO: 1078923 - protein, 20 aa, Mycobacterium
RSLRQLPEPVIPNGLQIRTY

SEQ ID NO: 1078924 - protein, 26 aa, Mycobacterium
RSLSYFPPSAWSYPPSLPASGTTARR

SEQ ID NO: 1078925 - protein, 21 aa, Mycobacterium
RSLVRRAVGIDFPGWDPTTSA

SEQ ID NO: 1078926 - protein, 26 aa, Mycobacterium
RSMDRPGLLALLTRALERAGADIVWA

SEQ ID NO: 1078927 - protein, 17 aa, Mycobacterium
RSMELFKTALRLGRHRE

SEQ ID NO: 1078928 - protein, 28 aa, Mycobacterium
RSMELLDEVILMLRRLHQPVIAAVNGPA

SEQ ID NO: 1078929 - protein, 17 aa, Mycobacterium
RSMILDSPLLSRDDIAL

SEQ ID NO: 1078930 - protein, 28 aa, Mycobacterium
RSMQRKKFGRLIFIGSVSGSWGIGNQAN

SEQ ID NO: 1078931 - protein, 26 aa, Mycobacterium
RSNLIGMGVIPLQFPTGQSASSLGLD

SEQ ID NO: 1078932 - protein, 21 aa, Mycobacterium
RSNPYTPLQAAKLAKETSSTK

SEQ ID NO: 1078933 - protein, 27 aa, Mycobacterium
RSPDLRSWVPRFPWLGSTDAVPRCCQT

SEQ ID NO: 1078934 - protein, 19 aa, Mycobacterium
RSPIPITELQRHATGRGWV

SEQ ID NO: 1078935 - protein, 19 aa, Mycobacterium
RSPRSDRLFCVPATIDLAG

SEQ ID NO: 1078936 - protein, 18 aa, Mycobacterium
RSPWAPIVFGTQAPDTGN

SEQ ID NO: 1078937 - protein, 22 aa, Mycobacterium
RSQWAMGWSQDPTQSALRALIA

SEQ ID NO: 1078938 - protein, 21 aa, Mycobacterium
RSRALPSTFATWRERRRLIKV

SEQ ID NO: 1078939 - protein, 23 aa, Mycobacterium
RSRAYDRAWLFTRFVADTYGTTK

SEQ ID NO: 1078940 - protein, 23 aa, Mycobacterium
RSRDLYDALRRRCLYHWIDYPEP

SEQ ID NO: 1078941 - protein, 27 aa, Mycobacterium
RSRERGYAYFLYPPQAPLTETAYDRLA

SEQ ID NO: 1078942 - protein, 19 aa, Mycobacterium
RSRFGFLAIHGGGARVDYL

SEQ ID NO: 1078943 - protein, 19 aa, Mycobacterium
RSRLLDAVLADLYGPRRLL

SEQ ID NO: 1078944 - protein, 26 aa, Mycobacterium
RSRRPPTSAMLFPNSSRRIFRSTRPW

SEQ ID NO: 1078945 - protein, 21 aa, Mycobacterium
RSRVGLTHFAAPTPGRRIGLV

SEQ ID NO: 1078946 - protein, 21 aa, Mycobacterium
RSSDQLLFDGLPWVSRAQEEH

SEQ ID NO: 1078947 - protein, 21 aa, Mycobacterium
RSSGNLLYLLLTHPEQLTMVQ

SEQ ID NO: 1078948 - protein, 21 aa, Mycobacterium
RSSGRAYRWANPARLSDLELA

SEQ ID NO: 1078949 - protein, 22 aa, Mycobacterium
RSSHTWFVLHELLGHKNVKNYD

SEQ ID NO: 1078950 - protein, 17 aa, Mycobacterium
RSSLIGGIRYYDTVVDD

SEQ ID NO: 1078951 - protein, 23 aa, Mycobacterium
RSSNFMLWQSAYAEYIFQDKLWP

SEQ ID NO: 1078952 - protein, 21 aa, Mycobacterium
RSTRQFVQALTGAASAYASAE

SEQ ID NO: 1078953 - protein, 19 aa, Mycobacterium
RSTVAVYIGVRNPEHVGSC

SEQ ID NO: 1078954 - protein, 22 aa, Mycobacterium
RSVDLCALLRRRASDRVSMSLP

SEQ ID NO: 1078955 - protein, 19 aa, Mycobacterium
RSVGAQWLNIGIDAAGEGG

SEQ ID NO: 1078956 - protein, 24 aa, Mycobacterium
RSVHSYAYAVLRRAAERTGDAPPR

SEQ ID NO: 1078957 - protein, 18 aa, Mycobacterium
RSVLQWDKDDCAAIGLVK

SEQ ID NO: 1078958 - protein, 23 aa, Mycobacterium
RSVPTALRPAMHLGLRVLAQGTP

SEQ ID NO: 1078959 - protein, 23 aa, Mycobacterium
RSVVDLNLIATFNISRLAAAHMA

SEQ ID NO: 1078960 - protein, 18 aa, Mycobacterium
RSWMAVLELDSSLHGQFL

SEQ ID NO: 1078961 - protein, 21 aa, Mycobacterium
RSWTTDVRGGLFFVWHDHEGN

SEQ ID NO: 1078962 - protein, 21 aa, Mycobacterium
RSWWGNFLVQKANEAGIGLDE

SEQ ID NO: 1078963 - protein, 18 aa, Mycobacterium
RSYARAFGMSEERVRLIS

SEQ ID NO: 1078964 - protein, 19 aa, Mycobacterium
RSYRLTELLARFLEQLKDD

SEQ ID NO: 1078965 - protein, 21 aa, Mycobacterium
RSYVQALWRATKPGARLYMYE

SEQ ID NO: 1078966 - protein, 25 aa, Mycobacterium
RTAPTLPALRRYTGVLYDALDVDSL

SEQ ID NO: 1078967 - protein, 19 aa, Mycobacterium
RTAVGWLSEPLAKMAGYHL

SEQ ID NO: 1078968 - protein, 17 aa, Mycobacterium
RTAVVAASLPELVEGLQ

SEQ ID NO: 1078969 - protein, 23 aa, Mycobacterium
RTDEPDRRFTPGASLRAKRSRDG

SEQ ID NO: 1078970 - protein, 22 aa, Mycobacterium
RTDLVEHYIARAAGIRRCAGSV

SEQ ID NO: 1078971 - protein, 23 aa, Mycobacterium
RTDRGDEITCRYLIMATGCLSVP

SEQ ID NO: 1078972 - protein, 26 aa, Mycobacterium
RTDRLPVAILAILKTGAAYVPIDPSW

SEQ ID NO: 1078973 - protein, 17 aa, Mycobacterium
RTEFALLEMLIANPRRV

SEQ ID NO: 1078974 - protein, 21 aa, Mycobacterium
RTELRKLLRGDAREPVIPFAQ

SEQ ID NO: 1078975 - protein, 25 aa, Mycobacterium
RTELVEHLLALGYSKELLPERLVVV

SEQ ID NO: 1078976 - protein, 31 aa, Mycobacterium
RTERIRLGTNILLAALRPAAMLAKTLATMDV

SEQ ID NO: 1078977 - protein, 18 aa, Mycobacterium
RTFLREHGHFEVKMGCDA

SEQ ID NO: 1078978 - protein, 25 aa, Mycobacterium
RTFTVSALVVGWLTRGGVEHADSAL

SEQ ID NO: 1078979 - protein, 18 aa, Mycobacterium
RTFVLDKAADWQLEIYEL

SEQ ID NO: 1078980 - protein, 27 aa, Mycobacterium
RTFYRHFRSKHDLLFADYTGLHWFRAA

SEQ ID NO: 1078981 - protein, 19 aa, Mycobacterium
RTGDLVCWGPDGQLQYLGR

SEQ ID NO: 1078982 - protein, 20 aa, Mycobacterium
RTGDLWLFRGRSRPDRAIQT

SEQ ID NO: 1078983 - protein, 24 aa, Mycobacterium
RTGLGTYMFFIDCVGHIADDAVAE

SEQ ID NO: 1078984 - protein, 20 aa, Mycobacterium
RTIGELISKPLLPGLTQRLT

SEQ ID NO: 1078985 - protein, 32 aa, Mycobacterium; identical to SEQ ID NO: 857992

SEQ ID NO: 1078986 - protein, 20 aa, Mycobacterium
RTIWGFPKIMADFNVREGKK

SEQ ID NO: 1078987 - protein, 29 aa, Mycobacterium
RTKRMQVAFTPLLARRWSGERIRVYSMHP

SEQ ID NO: 1078988 - protein, 24 aa, Mycobacterium
RTLARRPAWLAACAEVGGGAAPGS

SEQ ID NO: 1078989 - protein, 18 aa, Mycobacterium
RTLDETCLLMFPRRDLTV

SEQ ID NO: 1078990 - protein, 23 aa, Mycobacterium
RTLDPIFAAAFNAAGDDGARMRV

SEQ ID NO: 1078991 - protein, 23 aa, Mycobacterium
RTLEERLRYLRELDERRAAVLAS

SEQ ID NO: 1078992 - protein, 20 aa, Mycobacterium
RTLELNPTHPLVIGLRQAQA

SEQ ID NO: 1078993 - protein, 18 aa, Mycobacterium
RTLGDFPRMLKAAASLRE

SEQ ID NO: 1078994 - protein, 20 aa, Mycobacterium
RTLLADMTIGQQTRAALGDL

SEQ ID NO: 1078995 - protein, 18 aa, Mycobacterium
RTLMESTLARHTGKDPSV

SEQ ID NO: 1078996 - protein, 29 aa, Mycobacterium
RTLSYEAFIYFYPLVMMDVTRLQALNAAP

SEQ ID NO: 1078997 - protein, 17 aa, Mycobacterium
RTMLREYLEAMRALWTQ

SEQ ID NO: 1078998 - protein, 20 aa, Mycobacterium
RTMQLNYLGAVQLILKFIPG

SEQ ID NO: 1078999 - protein, 21 aa, Mycobacterium
RTNARAAFFGRSGLRRNIRWD

SEQ ID NO: 1079000 - protein, 26 aa, Mycobacterium
RTNEPPWLWPAELASVLLAGPAEQAA

SEQ ID NO: 1079001 - protein, 29 aa, Mycobacterium
RTPDLPGMGSLLLPPWTLTRYVPDGVEMR

SEQ ID NO: 1079002 - protein, 25 aa, Mycobacterium
RTPGRGWEHRWALSVLHTALGGGLS

SEQ ID NO: 1079003 - protein, 18 aa, Mycobacterium
RTPITAALSRRLGQQIQL

SEQ ID NO: 1079004 - protein, 24 aa, Mycobacterium
RTPITLMHGVAPVVVGWPVGQLYA

SEQ ID NO: 1079005 - protein, 26 aa, Mycobacterium
RTRAKARLVWGDQTLVGIGLARLDRA

SEQ ID NO: 1079006 - protein, 29 aa, Mycobacterium
RTRSWDHRKLGLPPMPVGGSTAPAVLGTG

SEQ ID NO: 1079007 - protein, 32 aa, Mycobacterium
RTRVRLVGILGFPLLRMAVRSPLPISPCATRP

SEQ ID NO: 1079008 - protein, 27 aa, Mycobacterium
RTRVRTRLIELFELFDPADPEVIAGRR

SEQ ID NO: 1079009 - protein, 18 aa, Mycobacterium
RTSDGYLAALIYNDKHWA

SEQ ID NO: 1079010 - protein, 25 aa, Mycobacterium
RTSLLDMLRERAGLPGTKKGCDQGA

SEQ ID NO: 1079011 - protein, 19 aa, Mycobacterium
RTSLLTAGWPETVPGVTVD

SEQ ID NO: 1079012 - protein, 20 aa, Mycobacterium
RTSPFAFTGNRFEFRAPGSG

SEQ ID NO: 1079013 - protein, 24 aa, Mycobacterium
RTTDLLWTSIFLGGDRGRGFEEDL

SEQ ID NO: 1079014 - protein, 25 aa, Mycobacterium
RTTGPWEPWLHALPVEFDSADQVFA

SEQ ID NO: 1079015 - protein, 19 aa, Mycobacterium
RTTLGLDPGFRTGVKVAVV

SEQ ID NO: 1079016 - protein, 33 aa, Mycobacterium
RTTLLVTDLAGGWIPPHVRLPLARDPAGTGHAA

SEQ ID NO: 1079017 - protein, 17 aa, Mycobacterium
RTVIVRSRSRQVDPDNN

SEQ ID NO: 1079018 - protein, 31 aa, Mycobacterium; identical to SEQ ID NO: 858223

SEQ ID NO: 1079019 - protein, 17 aa, Mycobacterium
RTVTLPTYSFARQRFWL

SEQ ID NO: 1079020 - protein, 23 aa, Mycobacterium
RTYIRFFTRRSLVRLFKTSGFGV

SEQ ID NO: 1079021 - protein, 20 aa, Mycobacterium
RVAFLGWSMGGYGALLLGGR

SEQ ID NO: 1079022 - protein, 21 aa, Mycobacterium
RVAGVHFLMKKNKITEIHGYG

SEQ ID NO: 1079023 - protein, 17 aa, Mycobacterium
RVAIARALITNPDLLLA

SEQ ID NO: 1079024 - protein, 18 aa, Mycobacterium
RVALTRNVLLPVGTDYTP

SEQ ID NO: 1079025 - protein, 24 aa, Mycobacterium
RVAMKKELLWYPYSRKNGSFAEKV

SEQ ID NO: 1079026 - protein, 17 aa, Mycobacterium
RVAPHALSMLRGFNLMK

SEQ ID NO: 1079027 - protein, 26 aa, Mycobacterium
RVATGRLRLVLLLSPPRTGSTALANA

SEQ ID NO: 1079028 - protein, 19 aa, Mycobacterium
RVCDWLPDDPYPRATVQIW

SEQ ID NO: 1079029 - protein, 26 aa, Mycobacterium
RVCRDCGFFLPLAGSLGVMFGVCGNE

SEQ ID NO: 1079030 - protein, 20 aa, Mycobacterium
RVCRRHRLLLGRAGGQLTTH

SEQ ID NO: 1079031 - protein, 19 aa, Mycobacterium
RVDAMCPLGPILGGAGLNI

SEQ ID NO: 1079032 - protein, 18 aa, Mycobacterium
RVDAQAKYPAAPRQRKGA

SEQ ID NO: 1079033 - protein, 25 aa, Mycobacterium
RVDAVVFLLRTLNAADIALLKQIGG

SEQ ID NO: 1079034 - protein, 19 aa, Mycobacterium
RVDDDGTVWLITTAGERIV

SEQ ID NO: 1079035 - protein, 17 aa, Mycobacterium
RVDGIAAGLRQVAGLPG

SEQ ID NO: 1079036 - protein, 18 aa, Mycobacterium
RVDGVRVILDDSLVYLAL

SEQ ID NO: 1079037 - protein, 30 aa, Mycobacterium; identical to SEQ ID NO: 858362

SEQ ID NO: 1079038 - protein, 26 aa, Mycobacterium
RVDKQANLHFVIGKASFEENKLAENY

SEQ ID NO: 1079039 - protein, 17 aa, Mycobacterium
RVDLIVGHGRFVDPHSI

SEQ ID NO: 1079040 - protein, 28 aa, Mycobacterium
RVDPRRVPIWLPYIRGERTPFHDPDRRA

SEQ ID NO: 1079041 - protein, 25 aa, Mycobacterium
RVEELRRRLEDLPVLYELAAEEEGA

SEQ ID NO: 1079042 - protein, 21 aa, Mycobacterium
RVFGLAARKRIPVVLFAEGGG

SEQ ID NO: 1079043 - protein, 19 aa, Mycobacterium
RVFPLSNWTEFDIWSYIGA

SEQ ID NO: 1079044 - protein, 17 aa, Mycobacterium
RVFTLLAAGRPVLTHCF

SEQ ID NO: 1079045 - protein, 19 aa, Mycobacterium
RVGFLGWSMGGYGALLLGA

SEQ ID NO: 1079046 - protein, 24 aa, Mycobacterium
RVGISQMHVSRLLAKSLARLRDQL

SEQ ID NO: 1079047 - protein, 26 aa, Mycobacterium
RVGVLFLRMVLFVEKVLCGLRAHWLR

SEQ ID NO: 1079048 - protein, 33 aa, Mycobacterium; identical to SEQ ID NO: 858470

SEQ ID NO: 1079049 - protein, 17 aa, Mycobacterium
RVHARVPAFLVPGRTEA

SEQ ID NO: 1079050 - protein, 17 aa, Mycobacterium
RVHDYVALCRLIDEREL

SEQ ID NO: 1079051 - protein, 19 aa, Mycobacterium
RVHGPLALAVGRRLRDRYG

SEQ ID NO: 1079052 - protein, 19 aa, Mycobacterium
RVHNPLDLAAVAPLPVLVA

SEQ ID NO: 1079053 - protein, 17 aa, Mycobacterium
RVHPTGKAVVRLSVQTQ

SEQ ID NO: 1079054 - protein, 24 aa, Mycobacterium
RVIDLTAFWAGRAATHLLAAFGAD

SEQ ID NO: 1079055 - protein, 17 aa, Mycobacterium
RVIRDFFRQLPAGVDVG

SEQ ID NO: 1079056 - protein, 21 aa, Mycobacterium
RVISGLHMLLHQAFAQVEQFT

SEQ ID NO: 1079057 - protein, 18 aa, Mycobacterium
RVKIMSLLFGSPAGEEIS

SEQ ID NO: 1079058 - protein, 26 aa, Mycobacterium
RVKLELAVDAVVPLPGFVLKRAVKGT

SEQ ID NO: 1079059 - protein, 23 aa, Mycobacterium
RVKPLLFPMTMGEEPFVFHGQFT

SEQ ID NO: 1079060 - protein, 27 aa, Mycobacterium
RVKRPQVGIAAWILPSIVAFGTEEQKQ

SEQ ID NO: 1079061 - protein, 19 aa, Mycobacterium
RVKSFVFLAADLCTANLGF

SEQ ID NO: 1079062 - protein, 17 aa, Mycobacterium
RVLATAKRMGYPGPDPV

SEQ ID NO: 1079063 - protein, 24 aa, Mycobacterium
RVLENIYRALRPGGVLLMVDVKAS

SEQ ID NO: 1079064 - protein, 22 aa, Mycobacterium
RVLGTFLRDVIRRNPDRFRLMG

SEQ ID NO: 1079065 - protein, 19 aa, Mycobacterium
RVLHLDDLVRFLVLALDTD

SEQ ID NO: 1079066 - protein, 19 aa, Mycobacterium
RVLKFGQLAGPCLDFGLTW

SEQ ID NO: 1079067 - protein, 19 aa, Mycobacterium
RVLLLEYGRSAACWADRLV

SEQ ID NO: 1079068 - protein, 17 aa, Mycobacterium
RVLLVTLADDDHYLAWV

SEQ ID NO: 1079069 - protein, 31 aa, Mycobacterium
RVLMDTWYRIPAFYFACSATVLGPYDDAPMA

SEQ ID NO: 1079070 - protein, 17 aa, Mycobacterium
RVLRLAARRSAGAHPYL

SEQ ID NO: 1079071 - protein, 18 aa, Mycobacterium
RVLRVGVAEFRRSLDRVM

SEQ ID NO: 1079072 - protein, 20 aa, Mycobacterium
RVLTFFYPSARICEELFEIP

SEQ ID NO: 1079073 - protein, 30 aa, Mycobacterium
RVLTFLGRRQLFDPALLAQARVIAAEGGCD

SEQ ID NO: 1079074 - protein, 31 aa, Mycobacterium; identical to SEQ ID NO: 858613

SEQ ID NO: 1079075 - protein, 18 aa, Mycobacterium
RVLVDRNLPAFLRFADRA

SEQ ID NO: 1079076 - protein, 20 aa, Mycobacterium
RVLVGPAVTISFLPVRKDLM

SEQ ID NO: 1079077 - protein, 26 aa, Mycobacterium
RVMKKAVAYLLPFIEAEKAQSGSTEQ

SEQ ID NO: 1079078 - protein, 37 aa, Mycobacterium; identical to SEQ ID NO: 858644

SEQ ID NO: 1079079 - protein, 25 aa, Mycobacterium
RVNPAPPLVPYTRGLHQVADRVWAW

SEQ ID NO: 1079080 - protein, 28 aa, Mycobacterium
RVPCRTFAAFLNLKQWIKTFTQAGKPGA

SEQ ID NO: 1079081 - protein, 34 aa, Mycobacterium
RVPDRLWALQRKLLVPFFVWVTVGLYDPPVRTLM

SEQ ID NO: 1079082 - protein, 17 aa, Mycobacterium
RVPLGVVGMIYEGRPNV

SEQ ID NO: 1079083 - protein, 18 aa, Mycobacterium
RVPLRGDPWTKIVPGVRP

SEQ ID NO: 1079084 - protein, 17 aa, Mycobacterium
RVPNPFVPAAQRARGLS

SEQ ID NO: 1079085 - protein, 17 aa, Mycobacterium
RVQEVGALAYPAARFRK

SEQ ID NO: 1079086 - protein, 20 aa, Mycobacterium
RVQEVGALAYPAARFRKHID

SEQ ID NO: 1079087 - protein, 18 aa, Mycobacterium
RVQGLGRSLPRPVRRRLP

SEQ ID NO: 1079088 - protein, 18 aa, Mycobacterium
RVQRAIKRRGRPLTADRL

SEQ ID NO: 1079089 - protein, 22 aa, Mycobacterium
RVRAERINRWRVATAEASYSVV

SEQ ID NO: 1079090 - protein, 30 aa, Mycobacterium; identical to SEQ ID NO: 858720

SEQ ID NO: 1079091 - protein, 26 aa, Mycobacterium
RVRGIVLGNTWFWPADTLTMKAFSTV

SEQ ID NO: 1079092 - protein, 25 aa, Mycobacterium
RVRLSEWVVRCSIGFRIGQNVTPSD

SEQ ID NO: 1079093 - protein, 32 aa, Mycobacterium; identical to SEQ ID NO: 858734

SEQ ID NO: 1079094 - protein, 18 aa, Mycobacterium
RVRLYTDGSRRVLLRRKK

SEQ ID NO: 1079095 - protein, 24 aa, Mycobacterium
RVRPVSTAQFPRPVVRPGYSALGG

SEQ ID NO: 1079096 - protein, 17 aa, Mycobacterium
RVRQPGFFLGHTLTPST

SEQ ID NO: 1079097 - protein, 17 aa, Mycobacterium
RVRQQVIQLLSGYQGKE

SEQ ID NO: 1079098 - protein, 17 aa, Mycobacterium
RVRRLVDLGVIRGFYTD

SEQ ID NO: 1079099 - protein, 17 aa, Mycobacterium
RVRSMILDSPLLSRDDI

SEQ ID NO: 1079100 - protein, 20 aa, Mycobacterium
RVRWELPVPIIERRIRAVTP

SEQ ID NO: 1079101 - protein, 18 aa, Mycobacterium
RVRYPAHTSLIHDGADKL

SEQ ID NO: 1079102 - protein, 24 aa, Mycobacterium
RVSALIAQLGPVLGDMPLGAHFHN

SEQ ID NO: 1079103 - protein, 21 aa, Mycobacterium
RVSFGFTTPGKPALLRPASAE

SEQ ID NO: 1079104 - protein, 21 aa, Mycobacterium
RVSKMTVYRLVHNGELPAVRV

SEQ ID NO: 1079105 - protein, 17 aa, Mycobacterium
RVSPFPAVFQDLSLVVA

SEQ ID NO: 1079106 - protein, 28 aa, Mycobacterium
RVSRLHAKLFYQPLLESIAPAGLEIAGR

SEQ ID NO: 1079107 - protein, 26 aa, Mycobacterium
RVSSKYALVIYAAKRARQINDYYNQL

SEQ ID NO: 1079108 - protein, 30 aa, Mycobacterium
RVTGRQVFGTLPWHADLWLDSEDALDLTGR

SEQ ID NO: 1079109 - protein, 22 aa, Mycobacterium
RVTLPTYAFQRRRFWETPGTDG

SEQ ID NO: 1079110 - protein, 23 aa, Mycobacterium
RVTLPTYAFQRRRFWETPGTDGT

SEQ ID NO: 1079111 - protein, 26 aa, Mycobacterium
RVTNPSPYMYLIQVPNDHGSVEFSIV

SEQ ID NO: 1079112 - protein, 17 aa, Mycobacterium
RVTVNCGIFGWTPTVQL

SEQ ID NO: 1079113 - protein, 24 aa, Mycobacterium
RVVDKLLHAPTVRIKQLASAPGGD

SEQ ID NO: 1079114 - protein, 22 aa, Mycobacterium
RVVEWLVDKFKGTSGIDLTKDK

SEQ ID NO: 1079115 - protein, 28 aa, Mycobacterium
RVVIDPGNPYLLGPQLLCAATELPLDAV

SEQ ID NO: 1079116 - protein, 31 aa, Mycobacterium; identical to SEQ ID NO: 858845

SEQ ID NO: 1079117 - protein, 25 aa, Mycobacterium
RVVNFLERYFPIPAPWEKVAADINP

SEQ ID NO: 1079118 - protein, 22 aa, Mycobacterium
RVVTHILNLALTDQLRGGDRVN

SEQ ID NO: 1079119 - protein, 20 aa, Mycobacterium
RVWGRRPYAYLGITVPGFPN

SEQ ID NO: 1079120 - protein, 19 aa, Mycobacterium
RVWLADMTLLDPHAAQVAC

SEQ ID NO: 1079121 - protein, 18 aa, Mycobacterium
RVYLACGSSYKLAAQRLN

SEQ ID NO: 1079122 - protein, 19 aa, Mycobacterium
RVYQINYLRCIGCGLCIEA

SEQ ID NO: 1079123 - protein, 30 aa, Mycobacterium
RWAAPLAGHKWYAFVAEYFFDEYTVTSFAN

SEQ ID NO: 1079124 - protein, 25 aa, Mycobacterium
RWAYLPALEQVAAWHWSLNHPDASG

SEQ ID NO: 1079125 - protein, 27 aa, Mycobacterium
RWDAVLEVNLLAPQRLTEGLVGNGSIS

SEQ ID NO: 1079126 - protein, 19 aa, Mycobacterium
RWERLAEDLLRLLDKWFPG

SEQ ID NO: 1079127 - protein, 18 aa, Mycobacterium
RWGLGPAITELAAHVDDP

SEQ ID NO: 1079128 - protein, 21 aa, Mycobacterium
RWGYRRFWVAEHHFVAVASAS

SEQ ID NO: 1079129 - protein, 32 aa, Mycobacterium; identical to SEQ ID NO: 122352

SEQ ID NO: 1079130 - protein, 26 aa, Mycobacterium
RWKIDQVYFDPRWIANQDPRADYAIA

SEQ ID NO: 1079131 - protein, 18 aa, Mycobacterium
RWLAPVVRTVAPGLFWQR

SEQ ID NO: 1079132 - protein, 18 aa, Mycobacterium
RWLGRPTVEHGASADLVC

SEQ ID NO: 1079133 - protein, 20 aa, Mycobacterium
RWLQEVLDGLRRTAPPVITA

SEQ ID NO: 1079134 - protein, 17 aa, Mycobacterium
RWPLGRGFERFYGFLGG

SEQ ID NO: 1079135 - protein, 18 aa, Mycobacterium
RWQFDGVERCGPDLLLSL

SEQ ID NO: 1079136 - protein, 17 aa, Mycobacterium
RWRAHGFDVDMVGLVYF

SEQ ID NO: 1079137 - protein, 19 aa, Mycobacterium
RWRCAILPHVQAGCQAASG

SEQ ID NO: 1079138 - protein, 17 aa, Mycobacterium
RWRQRWSPPTPVALDAT

SEQ ID NO: 1079139 - protein, 18 aa, Mycobacterium
RWRSAVRSAARQSRRAHI

SEQ ID NO: 1079140 - protein, 17 aa, Mycobacterium
RWSLLAASLHVNIGVTQ

SEQ ID NO: 1079141 - protein, 17 aa, Mycobacterium
RYAIAMVGGLKLADHGN

SEQ ID NO: 1079142 - protein, 19 aa, Mycobacterium
RYAPGQFLTLRVPSERTGS

SEQ ID NO: 1079143 - protein, 18 aa, Mycobacterium
RYAQRYRTPRPNPRRVVI

SEQ ID NO: 1079144 - protein, 18 aa, Mycobacterium
RYCRYLDTKRWDDWRTLF

SEQ ID NO: 1079145 - protein, 23 aa, Mycobacterium
RYDAEWIVVLDDWTDGVGKSPQQ

SEQ ID NO: 1079146 - protein, 19 aa, Mycobacterium
RYDLAQLPPAPPTTVAVIE

SEQ ID NO: 1079147 - protein, 23 aa, Mycobacterium
RYEAWSFPDFSTGVAALRAITQT

SEQ ID NO: 1079148 - protein, 27 aa, Mycobacterium
RYESARGIKLLRREPLGTYDSILALHL

SEQ ID NO: 1079149 - protein, 20 aa, Mycobacterium
RYFLDNVAEWILELDRGRTY

SEQ ID NO: 1079150 - protein, 26 aa, Mycobacterium
RYFPSSLILYERFAGLIKSLVAIKTD

SEQ ID NO: 1079151 - protein, 22 aa, Mycobacterium
RYGEERFARRIAARIIRRRADR

SEQ ID NO: 1079152 - protein, 27 aa, Mycobacterium
RYGNHVPLTYPFALTFPAMMSLVTGFD

SEQ ID NO: 1079153 - protein, 21 aa, Mycobacterium
RYGRLQLVKHPAHGLTLISLD

SEQ ID NO: 1079154 - protein, 17 aa, Mycobacterium
RYGVVAGTGRLLELLPR

SEQ ID NO: 1079155 - protein, 21 aa, Mycobacterium
RYIDCRCCGGMLKPDIVYFGE

SEQ ID NO: 1079156 - protein, 17 aa, Mycobacterium
RYIFNTPSKYTGPHDVS

SEQ ID NO: 1079157 - protein, 18 aa, Mycobacterium
RYIRPEFVHVFVGGRIAE

SEQ ID NO: 1079158 - protein, 19 aa, Mycobacterium
RYLDIYRRAVRHKSALWRA

SEQ ID NO: 1079159 - protein, 28 aa, Mycobacterium
RYLDTGAMYRMMTLAVLRAGIDPADAAA

SEQ ID NO: 1079160 - protein, 19 aa, Mycobacterium
RYLRTLVDVGLGYVRLGQP

SEQ ID NO: 1079161 - protein, 22 aa, Mycobacterium
RYNLRLPSIDRKVIPLVVPRPT

SEQ ID NO: 1079162 - protein, 27 aa, Mycobacterium
RYPARYLFVFLEHHGMLSVFGSPTWRT

SEQ ID NO: 1079163 - protein, 21 aa, Mycobacterium
RYPYREPPPAPPPGGPPTGPP

SEQ ID NO: 1079164 - protein, 17 aa, Mycobacterium
RYRVIAEPTQQLPRYLH

SEQ ID NO: 1079165 - protein, 22 aa, Mycobacterium
RYTQTLTLWRGVARVDCRTTID

SEQ ID NO: 1079166 - protein, 26 aa, Mycobacterium
RYVRPPWLRRWVRDGYAWVQPRLSPV

SEQ ID NO: 1079167 - protein, 30 aa, Mycobacterium
RYVVRLRRPRRLLKWIYHIESRKAQRDIGG

SEQ ID NO: 1079168 - protein, 34 aa, Mycobacterium
SAAAAQLAPWQQWLQSLPGLPGQLAGSATAAAAA

SEQ ID NO: 1079169 - protein, 24 aa, Mycobacterium
SAAAPVMLPAYRVLGDDGTLVSAR

SEQ ID NO: 1079170 - protein, 23 aa, Mycobacterium
SAAARYGFRYWVESRRHQRVPVV

SEQ ID NO: 1079171 - protein, 21 aa, Mycobacterium
SAAAVTAFLARRLRPIDRVGP

SEQ ID NO: 1079172 - protein, 24 aa, Mycobacterium
SAADPDFLMLPKVQSAAEIGLVKR

SEQ ID NO: 1079173 - protein, 22 aa, Mycobacterium
SAAEIGLVKRLLRQSQKTTRLI

SEQ ID NO: 1079174 - protein, 36 aa, Mycobacterium; identical to SEQ ID NO: 859251

SEQ ID NO: 1079175 - protein, 22 aa, Mycobacterium
SAAFTALAHYLAELTALAQELS

SEQ ID NO: 1079176 - protein, 34 aa, Mycobacterium; identical to SEQ ID NO: 859260

SEQ ID NO: 1079177 - protein, 19 aa, Mycobacterium
SAAIASFFAAHGQAYQTMA

SEQ ID NO: 1079178 - protein, 25 aa, Mycobacterium
SAARIGGITYFHEYAYDLLAENERI

SEQ ID NO: 1079179 - protein, 26 aa, Mycobacterium
SAASALAGLAAQPLVHPPLATDAVSM

SEQ ID NO: 1079180 - protein, 18 aa, Mycobacterium
SAAVAALFDGHAQAYQLI

SEQ ID NO: 1079181 - protein, 25 aa, Mycobacterium
SAAVSSFFGAYARDYQAFSVQVEAL

SEQ ID NO: 1079182 - protein, 46 aa, Mycobacterium
SAAVTRMFGAYAQEFQTLSARMEQFYTDCVRALLTGAGAYSGAEAA

SEQ ID NO: 1079183 - protein, 20 aa, Mycobacterium
SAAYAMRWVAKNVVAAGLAE

SEQ ID NO: 1079184 - protein, 24 aa, Mycobacterium
SACATRGGLLPSGPRRRYAAQTSD

SEQ ID NO: 1079185 - protein, 25 aa, Mycobacterium
SADAGVADIAFAFGSGSSASATGGV

SEQ ID NO: 1079186 - protein, 24 aa, Mycobacterium
SADENLHMIFYRDVSEAAFDLAPN

SEQ ID NO: 1079187 - protein, 18 aa, Mycobacterium
SADVFLTNYLPSARQKNK

SEQ ID NO: 1079188 - protein, 38 aa, Mycobacterium
SAEAANAAPFQGLLGAVNAPVQTLTGRPLIGNGANGAP

SEQ ID NO: 1079189 - protein, 20 aa, Mycobacterium
SAEDLLGWCRERMAGFKVPR

SEQ ID NO: 1079190 - protein, 24 aa, Mycobacterium
SAEDRRYLLYSPLTKAKVTSEGER

SEQ ID NO: 1079191 - protein, 22 aa, Mycobacterium
SAENPFPVRAVAIRVAGWIDRL

SEQ ID NO: 1079192 - protein, 23 aa, Mycobacterium
SAEPGMASPLLFALSSTSADGLR

SEQ ID NO: 1079193 - protein, 22 aa, Mycobacterium
SAEPRRRSVAVHALRSRPDAPA

SEQ ID NO: 1079194 - protein, 24 aa, Mycobacterium
SAERFGVPLFFGGPHAGYMAVRSG

SEQ ID NO: 1079195 - protein, 23 aa, Mycobacterium
SAESYLDFEKLLDAATKSGANAI

SEQ ID NO: 1079196 - protein, 25 aa, Mycobacterium
SAGIDDAWIFARTAIRTRRWADPEQ

SEQ ID NO: 1079197 - protein, 23 aa, Mycobacterium
SAGLLAAVNEPIAALTGRPLIGN

SEQ ID NO: 1079198 - protein, 19 aa, Mycobacterium
SAGLLLRAPRPDGAAAVLL

SEQ ID NO: 1079199 - protein, 38 aa, Mycobacterium
SAGLYLNRIFDYLMMSLRSLSLVMVIGRPEVRIPVVSF

SEQ ID NO: 1079200 - protein, 25 aa, Mycobacterium
SAGSAWPRHLLPALTTAGFATELRN

SEQ ID NO: 1079201 - protein, 18 aa, Mycobacterium
SAGSLAVRPVGTAELRAA

SEQ ID NO: 1079202 - protein, 27 aa, Mycobacterium
SAGSPQQLWRRELRHRQLRRRERGRGK

SEQ ID NO: 1079203 - protein, 24 aa, Mycobacterium
SAGVIEVAPLAYMRGRTLNDAFIV

SEQ ID NO: 1079204 - protein, 23 aa, Mycobacterium
SAGVPLRLISVLKTAHSAPEEYE

SEQ ID NO: 1079205 - protein, 23 aa, Mycobacterium
SAIEFARRIAKLPTMAALLIKES

SEQ ID NO: 1079206 - protein, 25 aa, Mycobacterium
SAIHEMFVNTLGISSGSYAATEAAN

SEQ ID NO: 1079207 - protein, 18 aa, Mycobacterium
SAINAMDLALPRNRGQIP

SEQ ID NO: 1079208 - protein, 21 aa, Mycobacterium
SAIPVVAFRLAGDRGYTEFDL

SEQ ID NO: 1079209 - protein, 23 aa, Mycobacterium
SAIQPEAMTPHWGRGTLVGKLTV

SEQ ID NO: 1079210 - protein, 24 aa, Mycobacterium
SAITREWFTNTFAAPTPAQASAWA

SEQ ID NO: 1079211 - protein, 25 aa, Mycobacterium
SAKDYRRWFATLPSELTDAVTQHWG

SEQ ID NO: 1079212 - protein, 20 aa, Mycobacterium
SAKMCGWIDGAIRSGERAAS

SEQ ID NO: 1079213 - protein, 25 aa, Mycobacterium
SAKRITAVMPFYPYARQDKKHRGRE

SEQ ID NO: 1079214 - protein, 21 aa, Mycobacterium
SAKTYFGAIIGRYGNRIAGGV

SEQ ID NO: 1079215 - protein, 24 aa, Mycobacterium
SALDEIAVLFSGAPRFILHEQPEA

SEQ ID NO: 1079216 - protein, 18 aa, Mycobacterium
SALIMLRLSRKSDEHPEV

SEQ ID NO: 1079217 - protein, 17 aa, Mycobacterium
SALLLGRAPARGAPVTV

SEQ ID NO: 1079218 - protein, 22 aa, Mycobacterium
SALLSLNVPYFFMASDGVEAHD

SEQ ID NO: 1079219 - protein, 19 aa, Mycobacterium
SALNEALSPDMRDAFNAYT

SEQ ID NO: 1079220 - protein, 31 aa, Mycobacterium
SALPAKYLNRLSDLLFILARAANPDGDVLWR

SEQ ID NO: 1079221 - protein, 31 aa, Mycobacterium; identical to SEQ ID NO: 859553

SEQ ID NO: 1079222 - protein, 20 aa, Mycobacterium
SALWEASLFEEHGFGNIKIS

SEQ ID NO: 1079223 - protein, 20 aa, Mycobacterium
SAMVHPLAVAANRNVFVQLV

SEQ ID NO: 1079224 - protein, 17 aa, Mycobacterium
SAMVPLRTALDRGLLSI

SEQ ID NO: 1079225 - protein, 18 aa, Mycobacterium
SANLAVLRTPPGGAHYLA

SEQ ID NO: 1079226 - protein, 23 aa, Mycobacterium
SANLFGPGYYNQLKVPVAVVGAS

SEQ ID NO: 1079227 - protein, 17 aa, Mycobacterium
SANTLVRTPRGWRADNT

SEQ ID NO: 1079228 - protein, 25 aa, Mycobacterium
SAPALYRHYAGKYELFRGAVLALSQ

SEQ ID NO: 1079229 - protein, 29 aa, Mycobacterium
SAPAPPAPPLPPLLGVDPVAPVAARLPPA

SEQ ID NO: 1079230 - protein, 25 aa, Mycobacterium
SAPMCDIFLVLAQAPGGLSCFMLPH

SEQ ID NO: 1079231 - protein, 33 aa, Mycobacterium; identical to SEQ ID NO: 859626

SEQ ID NO: 1079232 - protein, 29 aa, Mycobacterium
SAQANAFHAQFLQALTNAGGAYAAAEVAN

SEQ ID NO: 1079233 - protein, 23 aa, Mycobacterium
SAQLGWNIVPYTVIRDGPAGPGM

SEQ ID NO: 1079234 - protein, 24 aa, Mycobacterium
SAQPAADLSAWPPAGAIAVDVADG

SEQ ID NO: 1079235 - protein, 26 aa, Mycobacterium
SAQVPDYLLQVIARFARYLRESSSVD

SEQ ID NO: 1079236 - protein, 27 aa, Mycobacterium
SAQYWGAVALARWKAEHLADDLPRQWA

SEQ ID NO: 1079237 - protein, 21 aa, Mycobacterium
SARAPLLAEERRLLLAAMGRA

SEQ ID NO: 1079238 - protein, 23 aa, Mycobacterium
SARRTRILGRLVGRLYRGVRGTD

SEQ ID NO: 1079239 - protein, 24 aa, Mycobacterium
SASAALGLLRRHKIEKLPVVDGSG

SEQ ID NO: 1079240 - protein, 25 aa, Mycobacterium
SASGRTLTFPGFLKAYVETVDELVG

SEQ ID NO: 1079241 - protein, 25 aa, Mycobacterium
SASMVTIMTSLWFQQLQAGDRVSVK

SEQ ID NO: 1079242 - protein, 24 aa, Mycobacterium
SATAKARFVRVSPRKARRVIDLVR

SEQ ID NO: 1079243 - protein, 26 aa, Mycobacterium
SATASDLVLLLWGRRRPDRVDVDGSA

SEQ ID NO: 1079244 - protein, 34 aa, Mycobacterium
SATAVQDWLQLFLDELRVCLHCCGAPDLTSLRDI

SEQ ID NO: 1079245 - protein, 18 aa, Mycobacterium
SATFDRPALGPSAFPTII

SEQ ID NO: 1079246 - protein, 19 aa, Mycobacterium
SATPIPRTLEMSLAGIREM

SEQ ID NO: 1079247 - protein, 25 aa, Mycobacterium
SATVGLFTYPVLQAADVLAYDAELV

SEQ ID NO: 1079248 - protein, 20 aa, Mycobacterium
SAVFYRYFTDKEDLLAALAQ

SEQ ID NO: 1079249 - protein, 24 aa, Mycobacterium
SAVKAFTAWAVRRGLLATDPAARL

SEQ ID NO: 1079250 - protein, 23 aa, Mycobacterium
SAVLDRLARYPARSVDIDGCTYR

SEQ ID NO: 1079251 - protein, 20 aa, Mycobacterium
SAVPAYLSRMLISGGTAGPG

SEQ ID NO: 1079252 - protein, 28 aa, Mycobacterium
SAVRASMAIPFIYPPVTLTSSDGLRSTL

SEQ ID NO: 1079253 - protein, 18 aa, Mycobacterium
SAYLRGLDPVRLSHVLTA

SEQ ID NO: 1079254 - protein, 17 aa, Mycobacterium
SAYPGQNGSGGATGGAP

SEQ ID NO: 1079255 - protein, 18 aa, Mycobacterium
SAYPRVLDFAAFRSIADE

SEQ ID NO: 1079256 - protein, 25 aa, Mycobacterium
SAYYRLVDSDLRWYKDYTGTGNSLN

SEQ ID NO: 1079257 - protein, 18 aa, Mycobacterium
SCHSPRQVLQFRSMGGGN

SEQ ID NO: 1079258 - protein, 19 aa, Mycobacterium
SCIDTLPEVLWLAQRVRET

SEQ ID NO: 1079259 - protein, 22 aa, Mycobacterium
SCNWSCDWLESGSVLTAVLLVA

SEQ ID NO: 1079260 - protein, 18 aa, Mycobacterium
SCPGPEAALALVGAARRL

SEQ ID NO: 1079261 - protein, 23 aa, Mycobacterium
SCQGQCPPRQFQRARIVVFAGDH

SEQ ID NO: 1079262 - protein, 24 aa, Mycobacterium
SCQGQCPPRQFQRARVVVFAGDHG

SEQ ID NO: 1079263 - protein, 27 aa, Mycobacterium
SCTIRNDLLILLRRLHRRDGVDRIVVH

SEQ ID NO: 1079264 - protein, 24 aa, Mycobacterium
SDAALICVPPYHIAGVSAVLSNLY

SEQ ID NO: 1079265 - protein, 24 aa, Mycobacterium
SDAIKLSVPFLTLEGNPPADNSEL

SEQ ID NO: 1079266 - protein, 25 aa, Mycobacterium
SDALPEPTFVPVLGRIAAGGPILAE

SEQ ID NO: 1079267 - protein, 24 aa, Mycobacterium
SDDDKIWSVLRTIPVRELRRSGML

SEQ ID NO: 1079268 - protein, 21 aa, Mycobacterium
SDDFFRLFLDPTQTYSCAYFE

SEQ ID NO: 1079269 - protein, 26 aa, Mycobacterium
SDDKDLYLTFDFSTALWAPRTIKRMA

SEQ ID NO: 1079270 - protein, 19 aa, Mycobacterium
SDDVARYVRKRIYEGNYAA

SEQ ID NO: 1079271 - protein, 25 aa, Mycobacterium
SDEEAMIFYRDPLQLISHLGEKHGS

SEQ ID NO: 1079272 - protein, 26 aa, Mycobacterium
SDELIDYLTMLSWSALCGIVEAGGSL

SEQ ID NO: 1079273 - protein, 21 aa, Mycobacterium
SDELLARMLFESCLLHAGQAC

SEQ ID NO: 1079274 - protein, 19 aa, Mycobacterium
SDFLHGRWLVLRRGKRNIA

SEQ ID NO: 1079275 - protein, 31 aa, Mycobacterium; identical to SEQ ID NO: 859978

SEQ ID NO: 1079276 - protein, 19 aa, Mycobacterium
SDGPPPDWHSFGRVLNKNG

SEQ ID NO: 1079277 - protein, 18 aa, Mycobacterium
SDGQPIELAFWYVRARRQ

SEQ ID NO: 1079278 - protein, 23 aa, Mycobacterium
SDGQRRMWFLQTMDPDDVTLNIC

SEQ ID NO: 1079279 - protein, 18 aa, Mycobacterium
SDGRLLKLTLHPGVMTGY

SEQ ID NO: 1079280 - protein, 26 aa, Mycobacterium
SDHAILAILAVLKTGAAYLPIDPHHP

SEQ ID NO: 1079281 - protein, 18 aa, Mycobacterium
SDHQLAFINALCTSVLSP

SEQ ID NO: 1079282 - protein, 24 aa, Mycobacterium
SDHVLDRYILAKLAVLRDDLTQAM

SEQ ID NO: 1079283 - protein, 18 aa, Mycobacterium
SDILAFTLPGFATGDRTK

SEQ ID NO: 1079284 - protein, 26 aa, Mycobacterium
SDILPLSFGFPFGISAAIPPNLPLPT

SEQ ID NO: 1079285 - protein, 18 aa, Mycobacterium
SDIYLPLHGEHQAHNAVV

SEQ ID NO: 1079286 - protein, 25 aa, Mycobacterium
SDKNRFIGIPAAFPKLFRSEVDWDY

SEQ ID NO: 1079287 - protein, 29 aa, Mycobacterium
SDKSEPLVLKPWTMPEPLLPMATEAHAKT

SEQ ID NO: 1079288 - protein, 23 aa, Mycobacterium
SDLDIMIIALRAPADGPIGDSAL

SEQ ID NO: 1079289 - protein, 17 aa, Mycobacterium
SDLKRLPRSALTFCIES

SEQ ID NO: 1079290 - protein, 27 aa, Mycobacterium
SDLPYSIVRATQFFEFVLGIADSATDG

SEQ ID NO: 1079291 - protein, 20 aa, Mycobacterium
SDLSELGEWLVIHEGWRSEL

SEQ ID NO: 1079292 - protein, 21 aa, Mycobacterium
SDLTFASGWLEFRSAGYSGVT

SEQ ID NO: 1079293 - protein, 24 aa, Mycobacterium
SDMAMPLMRGMGPTLIPRPQRMYL

SEQ ID NO: 1079294 - protein, 35 aa, Mycobacterium
SDMFQRRVYFLADLPFVEVYLAREWARGGDLDGAI

SEQ ID NO: 1079295 - protein, 30 aa, Mycobacterium
SDNAQQELYLPDVIAILRRDGQTVSARHID

SEQ ID NO: 1079296 - protein, 25 aa, Mycobacterium
SDNKKVFAQLPRIQQLALSGLLTGG

SEQ ID NO: 1079297 - protein, 27 aa, Mycobacterium
SDPAEQLYTLDYYLRLAEQIVEAGAHV

SEQ ID NO: 1079298 - protein, 23 aa, Mycobacterium
SDPVFRQRYWARNHVGWRHMDDT

SEQ ID NO: 1079299 - protein, 21 aa, Mycobacterium
SDPVIWAFNCALNVVSATPNA

SEQ ID NO: 1079300 - protein, 23 aa, Mycobacterium
SDQVYLDLLTGWRDAWEIGRTVR

SEQ ID NO: 1079301 - protein, 25 aa, Mycobacterium
SDRLKPWEVIAARLGAAAAADLVLA

SEQ ID NO: 1079302 - protein, 24 aa, Mycobacterium
SDRVRWLRGPAEQLPFDDGALDAV

SEQ ID NO: 1079303 - protein, 27 aa, Mycobacterium
SDSLTCGTSVFLFAGGRRGAAGTLASN

SEQ ID NO: 1079304 - protein, 25 aa, Mycobacterium
SDSQRGNWPLGFPDDKRPSYSLSEI

SEQ ID NO: 1079305 - protein, 33 aa, Mycobacterium; identical to SEQ ID NO: 860149

SEQ ID NO: 1079306 - protein, 28 aa, Mycobacterium
SDTGARQRVLLLPLGPLAEHNMRATFAS

SEQ ID NO: 1079307 - protein, 26 aa, Mycobacterium
SDTPGLRRLITELQGWLAAITGYDEV

SEQ ID NO: 1079308 - protein, 29 aa, Mycobacterium
SDTTTDPVLAWLYVLDAWEGGLPSARYLG

SEQ ID NO: 1079309 - protein, 22 aa, Mycobacterium
SDVAALWRRAVALVGGPQVGAS

SEQ ID NO: 1079310 - protein, 27 aa, Mycobacterium
SDVAAWPATLERLLAIGGPDAIYVPGH

SEQ ID NO: 1079311 - protein, 34 aa, Mycobacterium; identical to SEQ ID NO: 860172

SEQ ID NO: 1079312 - protein, 28 aa, Mycobacterium
SDVGFAMWQYYLATGDRQWLRHDGWPVL

SEQ ID NO: 1079313 - protein, 24 aa, Mycobacterium
SDVPDQLELLARYTRHFVACDYYD

SEQ ID NO: 1079314 - protein, 26 aa, Mycobacterium
SDVVDQYLITPFVDVLAGLAESSAPA

SEQ ID NO: 1079315 - protein, 23 aa, Mycobacterium
SDVWDLHPFFDTSDKQRLKRTCN

SEQ ID NO: 1079316 - protein, 19 aa, Mycobacterium
SDWLNYAALDVELLIELRS

SEQ ID NO: 1079317 - protein, 18 aa, Mycobacterium
SDWYKPLATGFNPAAEIV

SEQ ID NO: 1079318 - protein, 17 aa, Mycobacterium
SDYLAGRAFSFISAIDS

SEQ ID NO: 1079319 - protein, 20 aa, Mycobacterium
SDYMRPAVRLAALMDIDPIY

SEQ ID NO: 1079320 - protein, 23 aa, Mycobacterium
SEAAFARLCGVAPIPASSGKTHR

SEQ ID NO: 1079321 - protein, 23 aa, Mycobacterium
SEAAVEHLFAVASGLDSAVVGEQ

SEQ ID NO: 1079322 - protein, 25 aa, Mycobacterium
SEAELMAWAVPQAANQFWMLGEPER

SEQ ID NO: 1079323 - protein, 22 aa, Mycobacterium
SEALPQVLAIELPQPECFESFL

SEQ ID NO: 1079324 - protein, 22 aa, Mycobacterium
SEAPIQVYFVSTLGVLMSTGYG

SEQ ID NO: 1079325 - protein, 17 aa, Mycobacterium
SEARILGIFVDGKRVPV

SEQ ID NO: 1079326 - protein, 29 aa, Mycobacterium
SEASLVERLVPDFLWISTEHTAQVSLDAL

SEQ ID NO: 1079327 - protein, 24 aa, Mycobacterium
SEDLPTLIRTLTATTALMLTGDAL

SEQ ID NO: 1079328 - protein, 26 aa, Mycobacterium
SEESYLALLDALRWLGLDWDEGPEVD

SEQ ID NO: 1079329 - protein, 23 aa, Mycobacterium
SEFGGIDYLVNNAAIYGGMKLDL

SEQ ID NO: 1079330 - protein, 17 aa, Mycobacterium
SEFLAPQHNTNPAGLLA

SEQ ID NO: 1079331 - protein, 17 aa, Mycobacterium
SEFLGRLVLLPTTPAAA

SEQ ID NO: 1079332 - protein, 19 aa, Mycobacterium
SEFLVALRRGDPESGVLGL

SEQ ID NO: 1079333 - protein, 33 aa, Mycobacterium; identical to SEQ ID NO: 860250

SEQ ID NO: 1079334 - protein, 19 aa, Mycobacterium
SEGDAFGRLILLYDPDGSD

SEQ ID NO: 1079335 - protein, 23 aa, Mycobacterium
SEGDWDAWLNPDAPLDPALLSHP

SEQ ID NO: 1079336 - protein, 30 aa, Mycobacterium; identical to SEQ ID NO: 785942

SEQ ID NO: 1079337 - protein, 31 aa, Mycobacterium
SEHGRGVFVRPAPPIRWLASDRFARQHRANG

SEQ ID NO: 1079338 - protein, 30 aa, Mycobacterium
SEHRLEKICRMIMLYHLDRGWADHLAYLAD

SEQ ID NO: 1079339 - protein, 24 aa, Mycobacterium
SEKGWDALYRSNLGHVLLCTQRVA

SEQ ID NO: 1079340 - protein, 17 aa, Mycobacterium
SEKPAIHRFPGSMAKRV

SEQ ID NO: 1079341 - protein, 22 aa, Mycobacterium
SELDVIPPGDLRMALAALASDS

SEQ ID NO: 1079342 - protein, 25 aa, Mycobacterium
SELPDRACWALQHRLTRRYISAEAD

SEQ ID NO: 1079343 - protein, 23 aa, Mycobacterium
SELTPLTTLTLARLAAEAGLPDG

SEQ ID NO: 1079344 - protein, 19 aa, Mycobacterium
SELVRLRGAAQHNCRLCKS

SEQ ID NO: 1079345 - protein, 24 aa, Mycobacterium
SENRFKVELLKRVVEKQLTVVAAM

SEQ ID NO: 1079346 - protein, 18 aa, Mycobacterium
SEPGWLTSACDLLDTALA

SEQ ID NO: 1079347 - protein, 22 aa, Mycobacterium
SEPIWWDEQFPGQGGGFHDGGF

SEQ ID NO: 1079348 - protein, 24 aa, Mycobacterium
SEPLTEAIPLWKRPQDGAIITGWD

SEQ ID NO: 1079349 - protein, 24 aa, Mycobacterium
SEPYDLVAEMPRFGWPTVVVSGGH

SEQ ID NO: 1079350 - protein, 26 aa, Mycobacterium
SEQDVYLRWAVAAFRLATSGVADSTQ

SEQ ID NO: 1079351 - protein, 23 aa, Mycobacterium
SERRRPFDLSRGPALRVVVLSVP

SEQ ID NO: 1079352 - protein, 25 aa, Mycobacterium
SESAAVRLPFVLSGVTLHATAATRL

SEQ ID NO: 1079353 - protein, 27 aa, Mycobacterium
SESMEAAVFPYLAWMNITGMQAEQTAR

SEQ ID NO: 1079354 - protein, 25 aa, Mycobacterium
SESQPFNFVAPVAGLAALLAAKGVV

SEQ ID NO: 1079355 - protein, 25 aa, Mycobacterium
SEVASVALFLACDLSSYMTGTVLDV

SEQ ID NO: 1079356 - protein, 19 aa, Mycobacterium
SEVIAWIEAGHAADPARYH

SEQ ID NO: 1079357 - protein, 22 aa, Mycobacterium
SEVLLIEPFYDSYAPVIAMAGA

SEQ ID NO: 1079358 - protein, 18 aa, Mycobacterium
SEVSFPKPVFHGDTLYAE

SEQ ID NO: 1079359 - protein, 24 aa, Mycobacterium
SEVSMLFVLYQMASGGGPGFVLGS

SEQ ID NO: 1079360 - protein, 28 aa, Mycobacterium
SEYGRLRRGQTLFTYLHLAASRPCTDAL

SEQ ID NO: 1079361 - protein, 21 aa, Mycobacterium
SEYTLNMFPLRKSYVRRLMRE

SEQ ID NO: 1079362 - protein, 23 aa, Mycobacterium
SFADFLRRENLVLRADLLRPWAN

SEQ ID NO: 1079363 - protein, 32 aa, Mycobacterium; identical to SEQ ID NO: 860459

SEQ ID NO: 1079364 - protein, 24 aa, Mycobacterium
SFDAQGYFRTGDLGHWVDDEYLVV

SEQ ID NO: 1079365 - protein, 19 aa, Mycobacterium
SFDELFIGGRWCKPTIAEP

SEQ ID NO: 1079366 - protein, 29 aa, Mycobacterium
SFDVHLGGPALFGPIGMVVAAALRSDINA

SEQ ID NO: 1079367 - protein, 28 aa, Mycobacterium
SFENFARTWLDYRLKLLEATDRFGPFQR

SEQ ID NO: 1079368 - protein, 19 aa, Mycobacterium
SFFAMTAEVLGAVLPGAIA

SEQ ID NO: 1079369 - protein, 19 aa, Mycobacterium
SFGGLVFDATGITAPAELK

SEQ ID NO: 1079370 - protein, 19 aa, Mycobacterium
SFGLPGLAAYCREAIHANA

SEQ ID NO: 1079371 - protein, 19 aa, Mycobacterium
SFHQQFVQLMSGGATEYAA

SEQ ID NO: 1079372 - protein, 18 aa, Mycobacterium
SFIHTYKFDEAVADGVVL

SEQ ID NO: 1079373 - protein, 30 aa, Mycobacterium
SFINPHDVVLFPAWVRFGPLKPSHLDPPHV

SEQ ID NO: 1079374 - protein, 19 aa, Mycobacterium
SFIPSCGRCPTCQAGLRNL

SEQ ID NO: 1079375 - protein, 24 aa, Mycobacterium
SFLNTGLLDRGHPLWECYIIDGIE

SEQ ID NO: 1079376 - protein, 30 aa, Mycobacterium; identical to SEQ ID NO: 860539

SEQ ID NO: 1079377 - protein, 25 aa, Mycobacterium
SFPAIALCRRFLAAGDIPTLLTGVE

SEQ ID NO: 1079378 - protein, 37 aa, Mycobacterium; identical to SEQ ID NO: 860563

SEQ ID NO: 1079379 - protein, 28 aa, Mycobacterium
SFSMVMENRWLPMKRTALALNHLVCTRF

SEQ ID NO: 1079380 - protein, 25 aa, Mycobacterium
SFSRPATWWSKAGGPFVALTQRIIA

SEQ ID NO: 1079381 - protein, 34 aa, Mycobacterium; identical to SEQ ID NO: 860576

SEQ ID NO: 1079382 - protein, 17 aa, Mycobacterium
SFSYGLNAKWPVYLSTK

SEQ ID NO: 1079383 - protein, 25 aa, Mycobacterium
SFVGAYGPYLAWLTAASADCMARAA

SEQ ID NO: 1079384 - protein, 20 aa, Mycobacterium
SFVIVDLWSLNGVSVSGRRV

SEQ ID NO: 1079385 - protein, 17 aa, Mycobacterium
SFYRIRQSWAGKAVLLK

SEQ ID NO: 1079386 - protein, 24 aa, Mycobacterium
SGAALGLFGGTGGNGGLLFGDGGT

SEQ ID NO: 1079387 - protein, 23 aa, Mycobacterium
SGAGFRVGWIRRTPCGTWWCRPG

SEQ ID NO: 1079388 - protein, 26 aa, Mycobacterium
SGAGVPVLPATWPLQVVGSTSGSGVS

SEQ ID NO: 1079389 - protein, 26 aa, Mycobacterium
SGASGSPGGWLLGDGGAGGSGAAGSG

SEQ ID NO: 1079390 - protein, 20 aa, Mycobacterium
SGASYRLTWRHRRQNVSLPA

SEQ ID NO: 1079391 - protein, 25 aa, Mycobacterium
SGDIVLIRTGWWTRFLMTANKTEPY

SEQ ID NO: 1079392 - protein, 19 aa, Mycobacterium
SGDLFVIAVRTPPERHQGL

SEQ ID NO: 1079393 - protein, 24 aa, Mycobacterium
SGDPLLDSLLFDDPGLVDEATLPQ

SEQ ID NO: 1079394 - protein, 18 aa, Mycobacterium
SGDTPLITRLPFVAPHHS

SEQ ID NO: 1079395 - protein, 36 aa, Mycobacterium; identical to SEQ ID NO: 225605

SEQ ID NO: 1079396 - protein, 20 aa, Mycobacterium
SGEFWVPRRLGGSAPSLAEA

SEQ ID NO: 1079397 - protein, 31 aa, Mycobacterium; identical to SEQ ID NO: 132037

SEQ ID NO: 1079398 - protein, 20 aa, Mycobacterium
SGEVILTGRLSLSAQPWLAD

SEQ ID NO: 1079399 - protein, 28 aa, Mycobacterium
SGFTEILPTPFLPAGVFDLWGLAADDPR

SEQ ID NO: 1079400 - protein, 27 aa, Mycobacterium
SGFVGLRVVPWLWEAPPTDRRYYPLFA

SEQ ID NO: 1079401 - protein, 30 aa, Mycobacterium
SGGAGGAGGGAWLWGAGGAGGSGSGGLASA

SEQ ID NO: 1079402 - protein, 23 aa, Mycobacterium
SGGAGGLLFSPGGAGGDGGAGFS

SEQ ID NO: 1079403 - protein, 27 aa, Mycobacterium
SGGFVVPFLHPDLKWDFRLPRVVSINV

SEQ ID NO: 1079404 - protein, 22 aa, Mycobacterium
SGGHAGLLFGNGGSGGLGGVGG

SEQ ID NO: 1079405 - protein, 19 aa, Mycobacterium
SGGHLFSLYDGCRDEGVRL

SEQ ID NO: 1079406 - protein, 18 aa, Mycobacterium
SGGLYRWQSRYLRAEDQA

SEQ ID NO: 1079407 - protein, 22 aa, Mycobacterium
SGGNAAWLFGDGGAGGSGGSSD

SEQ ID NO: 1079408 - protein, 26 aa, Mycobacterium
SGGQRRRLQLMLTLLSEPNVLLLDEP

SEQ ID NO: 1079409 - protein, 22 aa, Mycobacterium
SGGRGGFFFGSGGAGGDGGASA

SEQ ID NO: 1079410 - protein, 31 aa, Mycobacterium
SGGRGIHVFLRIASDWDFIEVRRAGIALARE

SEQ ID NO: 1079411 - protein, 22 aa, Mycobacterium
SGGSGFQGVKGGAGGVGGDGGL

SEQ ID NO: 1079412 - protein, 20 aa, Mycobacterium
SGGTIFAYWVANPTAYGVVE

SEQ ID NO: 1079413 - protein, 28 aa, Mycobacterium
SGGVDSTALYPPKRFLGAARNIEEGGSL

SEQ ID NO: 1079414 - protein, 18 aa, Mycobacterium
SGGWFHRADYPKMAMSDA

SEQ ID NO: 1079415 - protein, 18 aa, Mycobacterium
SGHDGRLPRAAFALEHQP

SEQ ID NO: 1079416 - protein, 23 aa, Mycobacterium
SGHDQFLFDVTHNRWDHGGKGIG

SEQ ID NO: 1079417 - protein, 20 aa, Mycobacterium
SGHEVFLIVPGAHTGQRRLD

SEQ ID NO: 1079418 - protein, 35 aa, Mycobacterium
SGHGQAYQVLSAQVAAFHQRFVEALNAGAQSYVGA

SEQ ID NO: 1079419 - protein, 21 aa, Mycobacterium
SGHLFYNRRLRTATTRFSVRM

SEQ ID NO: 1079420 - protein, 24 aa, Mycobacterium
SGHNGGAGGLLWGNGGNGGAGAAG

SEQ ID NO: 1079421 - protein, 25 aa, Mycobacterium
SGHYSFLNVFKLFGAGNQAPLSFPI

SEQ ID NO: 1079422 - protein, 34 aa, Mycobacterium; identical to SEQ ID NO: 860811

SEQ ID NO: 1079423 - protein, 19 aa, Mycobacterium
SGIGFGLHNEIVAPYLLAL

SEQ ID NO: 1079424 - protein, 23 aa, Mycobacterium
SGIGSLLMGIPGPSGLHFAGRVG

SEQ ID NO: 1079425 - protein, 21 aa, Mycobacterium
SGILALIKLLLAGQHGQIPPT

SEQ ID NO: 1079426 - protein, 27 aa, Mycobacterium
SGKQRSRLALWSRRLLGEAITQAQFLL

SEQ ID NO: 1079427 - protein, 19 aa, Mycobacterium
SGKSTFMRLLLAAETPTSG

SEQ ID NO: 1079428 - protein, 17 aa, Mycobacterium
SGKTTTTYLVEAGLRAA

SEQ ID NO: 1079429 - protein, 22 aa, Mycobacterium
SGLANTGLFNSGSFNTGIGNVG

SEQ ID NO: 1079430 - protein, 23 aa, Mycobacterium
SGLASWQQALQGLAGPAASVILG

SEQ ID NO: 1079431 - protein, 24 aa, Mycobacterium
SGLDARAYRLDWPAGMTVFEIDQP

SEQ ID NO: 1079432 - protein, 26 aa, Mycobacterium
SGLELPAFQQMFWRGGPTPTADFNVT

SEQ ID NO: 1079433 - protein, 21 aa, Mycobacterium
SGLHGVLMFFATCSVARRTGH

SEQ ID NO: 1079434 - protein, 20 aa, Mycobacterium
SGLHLRCRYPDTAEARTNVG

SEQ ID NO: 1079435 - protein, 20 aa, Mycobacterium
SGLIAPMRPDRYLKIAAAMR

SEQ ID NO: 1079436 - protein, 20 aa, Mycobacterium
SGLLDPWIRIADLDGRYLGQ

SEQ ID NO: 1079437 - protein, 24 aa, Mycobacterium
SGLQTLLPGLFPSSGDTTTTPAPG

SEQ ID NO: 1079438 - protein, 25 aa, Mycobacterium
SGLRHLNGFPGGPPPRLALSLGDSL

SEQ ID NO: 1079439 - protein, 20 aa, Mycobacterium
SGLRSLPWEGLKLAPGEPAI

SEQ ID NO: 1079440 - protein, 24 aa, Mycobacterium
SGLTRLAGRLLGWLLVCDPERQSS

SEQ ID NO: 1079441 - protein, 26 aa, Mycobacterium
SGLVEPSHPPAFLRLVHEAVVHIVGN

SEQ ID NO: 1079442 - protein, 22 aa, Mycobacterium
SGLYAVFLDRYGEQIDPRSRMV

SEQ ID NO: 1079443 - protein, 28 aa, Mycobacterium
SGMLLGVPTVIYPLGAFNPGQLLDVLEA

SEQ ID NO: 1079444 - protein, 25 aa, Mycobacterium
SGNDQLVRLRWPCPVPGAMAVSEVG

SEQ ID NO: 1079445 - protein, 28 aa, Mycobacterium
SGNFNLALPELIAGFNNGLTGLIQTGQT

SEQ ID NO: 1079446 - protein, 34 aa, Mycobacterium
SGNTGILNVGWAPALLISRLVSWVDDLWCRAIGA

SEQ ID NO: 1079447 - protein, 28 aa, Mycobacterium
SGNYSNGMFWRGDYQGLVGAHYEIFIPE

SEQ ID NO: 1079448 - protein, 20 aa, Mycobacterium
SGPDRLFEVVWTPMTVAATD

SEQ ID NO: 1079449 - protein, 25 aa, Mycobacterium
SGPGKLDQWTLLARARALDSASYVA

SEQ ID NO: 1079450 - protein, 28 aa, Mycobacterium
SGPLRLAARLIGPKPPVVVGVDFAGVVE

SEQ ID NO: 1079451 - protein, 20 aa, Mycobacterium
SGPVVWVKDASRSVPVAAAL

SEQ ID NO: 1079452 - protein, 24 aa, Mycobacterium
SGQAGALRLGIARALIVANPEDRP

SEQ ID NO: 1079453 - protein, 23 aa, Mycobacterium
SGQERPFPLDLVPRVISASEWSR

SEQ ID NO: 1079454 - protein, 24 aa, Mycobacterium
SGQLAIKAALVLGSPYTAMLFMGE

SEQ ID NO: 1079455 - protein, 26 aa, Mycobacterium
SGQPVPRLIWFYFDGADLTVYSMPKA

SEQ ID NO: 1079456 - protein, 26 aa, Mycobacterium
SGRARLSSVLWTFTVTKQDGVVCPGG

SEQ ID NO: 1079457 - protein, 26 aa, Mycobacterium
SGRDARAYRLPWPPQTVVYEIDLPQV

SEQ ID NO: 1079458 - protein, 18 aa, Mycobacterium
SGRFEFRAGPIFTNLLMA

SEQ ID NO: 1079459 - protein, 21 aa, Mycobacterium
SGRGMRVRILTYGGIIQSIEV

SEQ ID NO: 1079460 - protein, 32 aa, Mycobacterium
SGRILEGTPPGLPPFILCTNVSTLPPIRTPED

SEQ ID NO: 1079461 - protein, 26 aa, Mycobacterium
SGRPLAMPRLDMVTGLYYLTTEVEGD

SEQ ID NO: 1079462 - protein, 27 aa, Mycobacterium
SGRPRLAPLVYLRIDGKMFIVGSFRRC

SEQ ID NO: 1079463 - protein, 24 aa, Mycobacterium
SGRQYMAWISLEDEVRALLFAISN

SEQ ID NO: 1079464 - protein, 28 aa, Mycobacterium
SGRWAQAYGFPLMPIDGILVGTAAMAAL

SEQ ID NO: 1079465 - protein, 17 aa, Mycobacterium
SGSAKWNLLAPYAAKSE

SEQ ID NO: 1079466 - protein, 20 aa, Mycobacterium
SGSGRLLVAVRFGTTRLLDN

SEQ ID NO: 1079467 - protein, 26 aa, Mycobacterium
SGSLNVPLPLRLGVNALGPAITTAAA

SEQ ID NO: 1079468 - protein, 27 aa, Mycobacterium
SGSNIREALFKVTRWGVKGRFAGSEGG

SEQ ID NO: 1079469 - protein, 24 aa, Mycobacterium
SGSNLEFVVALLAASRANLIVVPL

SEQ ID NO: 1079470 - protein, 25 aa, Mycobacterium
SGSVPQRLWAKPAITVIGIDTTSIA

SEQ ID NO: 1079471 - protein, 23 aa, Mycobacterium
SGTANSGVPLILLLSLLSFVPLL

SEQ ID NO: 1079472 - protein, 25 aa, Mycobacterium
SGTIAGIHLEGPWLSPARCGAHDHT

SEQ ID NO: 1079473 - protein, 27 aa, Mycobacterium
SGVAFDILRRWLMARGFDVAFIRNVTD

SEQ ID NO: 1079474 - protein, 19 aa, Mycobacterium
SGVMYPVVPPGVVQLRLVS

SEQ ID NO: 1079475 - protein, 26 aa, Mycobacterium
SGVTPPPLPTVWPGSAYPLGATYDGA

SEQ ID NO: 1079476 - protein, 18 aa, Mycobacterium
SGWIRPPFNVTISNIPGS

SEQ ID NO: 1079477 - protein, 25 aa, Mycobacterium
SGYDALPRRLADGLPIVFGTKVDSI

SEQ ID NO: 1079478 - protein, 26 aa, Mycobacterium
SGYENIIIRGLFLGQTRKQMLAKVDE

SEQ ID NO: 1079479 - protein, 24 aa, Mycobacterium
SGYLDALAYARHALGLPATTVNWG

SEQ ID NO: 1079480 - protein, 31 aa, Mycobacterium; identical to SEQ ID NO: 861154

SEQ ID NO: 1079481 - protein, 22 aa, Mycobacterium
SGYPLELLVRAAAAGWRVAEFD

SEQ ID NO: 1079482 - protein, 24 aa, Mycobacterium
SGYRGKLWTFRQYSGFGTAEESNR

SEQ ID NO: 1079483 - protein, 35 aa, Mycobacterium; identical to SEQ ID NO: 861166

SEQ ID NO: 1079484 - protein, 23 aa, Mycobacterium
SGYTGMLAQLMQKPRSTPGYVVV

SEQ ID NO: 1079485 - protein, 38 aa, Mycobacterium; identical to SEQ ID NO: 117585

SEQ ID NO: 1079486 - protein, 19 aa, Mycobacterium
SHAWAIRETVDLLTRVFPA

SEQ ID NO: 1079487 - protein, 24 aa, Mycobacterium
SHDENLHMIFYRDVSAAGLDIAPN

SEQ ID NO: 1079488 - protein, 26 aa, Mycobacterium
SHGGLPHPTILAAARLLGVDEVWAVG

SEQ ID NO: 1079489 - protein, 36 aa, Mycobacterium; identical to SEQ ID NO: 1055362

SEQ ID NO: 1079490 - protein, 20 aa, Mycobacterium
SHGRFMRIRVFDCWMHEQDI

SEQ ID NO: 1079491 - protein, 25 aa, Mycobacterium
SHITWYTVLACFKLGIIVEGTLARA

SEQ ID NO: 1079492 - protein, 18 aa, Mycobacterium
SHLKMDGSWRVGDRPPRV

SEQ ID NO: 1079493 - protein, 19 aa, Mycobacterium
SHLLLMWGAANRDPVQFDA

SEQ ID NO: 1079494 - protein, 26 aa, Mycobacterium
SHNGMWDLSMLGIIPGIRVAAPRDAT

SEQ ID NO: 1079495 - protein, 30 aa, Mycobacterium
SHNRVALDRMLIDQLPDIVEKAALGLSGAN

SEQ ID NO: 1079496 - protein, 18 aa, Mycobacterium
SHQLLGALGFCDESDISV

SEQ ID NO: 1079497 - protein, 24 aa, Mycobacterium
SHRAFCNQLLWRRDEFGLGGDDAL

SEQ ID NO: 1079498 - protein, 25 aa, Mycobacterium
SHRDLPLRLNQWSNVVRWELRPRML

SEQ ID NO: 1079499 - protein, 28 aa, Mycobacterium
SHRDRGFGYLAYLHDPLAAAIALDPQLV

SEQ ID NO: 1079500 - protein, 22 aa, Mycobacterium
SHRERYTLPALRDWLRGQREDR

SEQ ID NO: 1079501 - protein, 20 aa, Mycobacterium
SHRILWPDRAYQPDLDILIA

SEQ ID NO: 1079502 - protein, 22 aa, Mycobacterium
SHSTLYRHFDGRTALLEALDHA

SEQ ID NO: 1079503 - protein, 24 aa, Mycobacterium
SHVINDTIWVLPDPAAATSELDQR

SEQ ID NO: 1079504 - protein, 19 aa, Mycobacterium
SHVSAPILAGAFAVAWEWE

SEQ ID NO: 1079505 - protein, 30 aa, Mycobacterium; identical to SEQ ID NO: 861274

SEQ ID NO: 1079506 - protein, 30 aa, Mycobacterium; identical to SEQ ID NO: 861276

SEQ ID NO: 1079507 - protein, 24 aa, Mycobacterium
SIDDYTAHWYGRTLHFGVREHAMG

SEQ ID NO: 1079508 - protein, 30 aa, Mycobacterium; identical to SEQ ID NO: 861300

SEQ ID NO: 1079509 - protein, 25 aa, Mycobacterium
SIDRKVIPLVVPRPTGIAVIENKII

SEQ ID NO: 1079510 - protein, 29 aa, Mycobacterium
SIEDLLSAPAIKLLIRKAGAASADMAAEL

SEQ ID NO: 1079511 - protein, 20 aa, Mycobacterium
SIEFIVAMLAVLKAGAAYLP

SEQ ID NO: 1079512 - protein, 27 aa, Mycobacterium
SIENGSEWVHRLAKRLKKLANQHPRSF

SEQ ID NO: 1079513 - protein, 24 aa, Mycobacterium
SIERRRLLELYGTEIIFSPAEGGS

SEQ ID NO: 1079514 - protein, 21 aa, Mycobacterium
SIGNRGLLNLGLGNAGNLNLG

SEQ ID NO: 1079515 - protein, 17 aa, Mycobacterium
SIGSLLRQAAARWPDRV

SEQ ID NO: 1079516 - protein, 25 aa, Mycobacterium
SIGVRSVCYLPLTYDHRLVDGADAG

SEQ ID NO: 1079517 - protein, 20 aa, Mycobacterium
SILAGDFARRGLDSELAPLY

SEQ ID NO: 1079518 - protein, 23 aa, Mycobacterium
SIMGIGFPPWTGGSAQYIVGYEG

SEQ ID NO: 1079519 - protein, 21 aa, Mycobacterium
SINLPYITVDADKNPLFLDEQ

SEQ ID NO: 1079520 - protein, 20 aa, Mycobacterium
SIPGGLRWTWETMKPLYTNG

SEQ ID NO: 1079521 - protein, 19 aa, Mycobacterium
SIPGRSWPAKSERARWVTP

SEQ ID NO: 1079522 - protein, 34 aa, Mycobacterium
SIQAGIINLLLDLQAGFKLSYLFVSHDLSVVKHL

SEQ ID NO: 1079523 - protein, 17 aa, Mycobacterium
SIRFDSVAIPKTHVLGA

SEQ ID NO: 1079524 - protein, 17 aa, Mycobacterium
SIRLGVPCFPDDPLHFT

SEQ ID NO: 1079525 - protein, 27 aa, Mycobacterium
SIRQWVPPFKWWRILRTRKVLEEYFID

SEQ ID NO: 1079526 - protein, 26 aa, Mycobacterium
SITAGRISYLLGLRGPAAAIDTACSS

SEQ ID NO: 1079527 - protein, 19 aa, Mycobacterium
SITATLRMVRQRPALAAWF

SEQ ID NO: 1079528 - protein, 26 aa, Mycobacterium
SIVMLHLAIKAFRPGRLPFPVMHVDT

SEQ ID NO: 1079529 - protein, 26 aa, Mycobacterium
SIYQATKFYELFVAAGFKGKCAIVTS

SEQ ID NO: 1079530 - protein, 29 aa, Mycobacterium
SKAQVLAEALRWLKQLHGRVVVIKYGGNA

SEQ ID NO: 1079531 - protein, 22 aa, Mycobacterium
SKEIERQFKKLGVKIRTGTKVE

SEQ ID NO: 1079532 - protein, 29 aa, Mycobacterium
SKELVVVRPIGFEPLQWVRALAAEDPVPS

SEQ ID NO: 1079533 - protein, 24 aa, Mycobacterium
SKERFRQLVDLVCLHAAIATGHSN

SEQ ID NO: 1079534 - protein, 23 aa, Mycobacterium
SKGEKIMLLFESANFDEAVFTDP

SEQ ID NO: 1079535 - protein, 25 aa, Mycobacterium
SKGNFYLRPIVRPVVLVAGGTGLSA

SEQ ID NO: 1079536 - protein, 24 aa, Mycobacterium
SKIFTLALVIEQRGPRELRLKVGA

SEQ ID NO: 1079537 - protein, 27 aa, Mycobacterium
SKLDDERLAFYRTLYRDHARYGAALWV

SEQ ID NO: 1079538 - protein, 29 aa, Mycobacterium
SKLRERLGFGELRWAVSGAAPIPKETLGF

SEQ ID NO: 1079539 - protein, 19 aa, Mycobacterium
SKLRFYTNVLKLGSRNPLL

SEQ ID NO: 1079540 - protein, 31 aa, Mycobacterium
SKLSSLAVPLNFAMYALNFLDKGIGFTKAAT

SEQ ID NO: 1079541 - protein, 23 aa, Mycobacterium
SKLVDGPIEAIRMLRVARSDAVK

SEQ ID NO: 1079542 - protein, 22 aa, Mycobacterium
SKPAIYRRWPSKAHLVHEAVFP

SEQ ID NO: 1079543 - protein, 19 aa, Mycobacterium
SKPLVRLRVPFTLSRNEID

SEQ ID NO: 1079544 - protein, 23 aa, Mycobacterium
SKVDGFVMLGAVSFTLEQLKSEL

SEQ ID NO: 1079545 - protein, 25 aa, Mycobacterium
SKVRPGVPVLFLDTGYHFAETIGSR

SEQ ID NO: 1079546 - protein, 20 aa, Mycobacterium
SLACALVCHPTLLVPDEPTV

SEQ ID NO: 1079547 - protein, 19 aa, Mycobacterium
SLALACDLVLASESAYFLL

SEQ ID NO: 1079548 - protein, 26 aa, Mycobacterium
SLATVKFVFDRWLSTDPPSSPIFHVQ

SEQ ID NO: 1079549 - protein, 21 aa, Mycobacterium
SLAVDGFDPARIWGADNHEPE

SEQ ID NO: 1079550 - protein, 17 aa, Mycobacterium
SLAVGGFGLCGIPEALI

SEQ ID NO: 1079551 - protein, 21 aa, Mycobacterium
SLAYFNANEGALALLRGELDL

SEQ ID NO: 1079552 - protein, 20 aa, Mycobacterium
SLDFFFRKIVRDHGQALQFV

SEQ ID NO: 1079553 - protein, 31 aa, Mycobacterium
SLDLINAPTQALLGRPLIGNGADGATVGRIG

SEQ ID NO: 1079554 - protein, 17 aa, Mycobacterium
SLDTRFAQQMKILFPIF

SEQ ID NO: 1079555 - protein, 20 aa, Mycobacterium
SLEPRWFAWVDDMHDWCISR

SEQ ID NO: 1079556 - protein, 19 aa, Mycobacterium
SLEPVAAALGEQLGRHVQL

SEQ ID NO: 1079557 - protein, 20 aa, Mycobacterium
SLEVRIRLLRDRIHQGWILT

SEQ ID NO: 1079558 - protein, 24 aa, Mycobacterium
SLFARGFLLTKRDIDWFHSQYLKG

SEQ ID NO: 1079559 - protein, 19 aa, Mycobacterium
SLFGAQFITWRGIPLIPSD

SEQ ID NO: 1079560 - protein, 20 aa, Mycobacterium
SLFSLDEWAANALALIQAMD

SEQ ID NO: 1079561 - protein, 24 aa, Mycobacterium
SLGDELMRRFNGAALESLLTRLNL

SEQ ID NO: 1079562 - protein, 25 aa, Mycobacterium
SLGLLDEFPPYDSIFDPVNRVLLPR

SEQ ID NO: 1079563 - protein, 17 aa, Mycobacterium
SLGWGLWDQASNMTGGL

SEQ ID NO: 1079564 - protein, 17 aa, Mycobacterium
SLGWKTYQLIPTDAATG

SEQ ID NO: 1079565 - protein, 25 aa, Mycobacterium
SLGWSSWAIQWLSRIPAGAPELTDH

SEQ ID NO: 1079566 - protein, 23 aa, Mycobacterium
SLHAGHLVPLLALRRFQRAGHRP

SEQ ID NO: 1079567 - protein, 25 aa, Mycobacterium
SLHALDLLLGSWPRESRTLACLPGE

SEQ ID NO: 1079568 - protein, 17 aa, Mycobacterium
SLHGQFLSRALLRSWRS

SEQ ID NO: 1079569 - protein, 18 aa, Mycobacterium
SLHLVHDWNREFVRTSPA

SEQ ID NO: 1079570 - protein, 23 aa, Mycobacterium
SLHMPDFPLLPVRVETWEGLVFV

SEQ ID NO: 1079571 - protein, 20 aa, Mycobacterium
SLHWFWPRSERHLYAELKRL

SEQ ID NO: 1079572 - protein, 19 aa, Mycobacterium
SLIALGPVPAGVPAAGAPI

SEQ ID NO: 1079573 - protein, 19 aa, Mycobacterium
SLIGAWCFVDHYGPVSAHM

SEQ ID NO: 1079574 - protein, 19 aa, Mycobacterium
SLITLEDLSAYPAKKREPL

SEQ ID NO: 1079575 - protein, 22 aa, Mycobacterium
SLLEADALPYVLDTFSYQGQIS

SEQ ID NO: 1079576 - protein, 21 aa, Mycobacterium
SLLKVLLGELALSAGVALVDG

SEQ ID NO: 1079577 - protein, 26 aa, Mycobacterium
SLLNSLGNPVLWSNSLHWAGVHVGIL

SEQ ID NO: 1079578 - protein, 27 aa, Mycobacterium
SLLRDHGLLLPIEPDTRLLSETELWQL

SEQ ID NO: 1079579 - protein, 22 aa, Mycobacterium
SLLVDTLFDLALTREMLDAMRP

SEQ ID NO: 1079580 - protein, 26 aa, Mycobacterium
SLMGAAAAPYVAWLGATATQAELAAN

SEQ ID NO: 1079581 - protein, 18 aa, Mycobacterium
SLMVKAGVQWGLFGGAVE

SEQ ID NO: 1079582 - protein, 17 aa, Mycobacterium
SLNYRVSPLHTWPAHIV

SEQ ID NO: 1079583 - protein, 34 aa, Mycobacterium; identical to SEQ ID NO: 861819

SEQ ID NO: 1079584 - protein, 30 aa, Mycobacterium; identical to SEQ ID NO: 861823

SEQ ID NO: 1079585 - protein, 19 aa, Mycobacterium
SLPGLLTILHDGGYHDTEI

SEQ ID NO: 1079586 - protein, 23 aa, Mycobacterium
SLPSVLPTALRELIRYVRPPWLR

SEQ ID NO: 1079587 - protein, 23 aa, Mycobacterium
SLPTLPQSYPWDTNPRSFDPSSN

SEQ ID NO: 1079588 - protein, 30 aa, Mycobacterium
SLQAAAFHERFLQTLFGGAAAYTAAEAASV

SEQ ID NO: 1079589 - protein, 28 aa, Mycobacterium
SLQLTVQVRIPLIGGKLERMIGTELSQL

SEQ ID NO: 1079590 - protein, 23 aa, Mycobacterium
SLRAAEAFARMWDMGVAESISLQ

SEQ ID NO: 1079591 - protein, 27 aa, Mycobacterium
SLRAFYQHFSSKDELLLALFDRTMSQT

SEQ ID NO: 1079592 - protein, 20 aa, Mycobacterium
SLREALRRSPRSDRLFCVPA

SEQ ID NO: 1079593 - protein, 21 aa, Mycobacterium
SLRERLGIHPVYKTVDTCAAE

SEQ ID NO: 1079594 - protein, 19 aa, Mycobacterium
SLRPAARRGRWACWPAPAE

SEQ ID NO: 1079595 - protein, 20 aa, Mycobacterium
SLRQKDPAVTARRRLRMICH

SEQ ID NO: 1079596 - protein, 17 aa, Mycobacterium
SLRRTRVGRFELDQAWS

SEQ ID NO: 1079597 - protein, 33 aa, Mycobacterium; identical to SEQ ID NO: 861913

SEQ ID NO: 1079598 - protein, 17 aa, Mycobacterium
SLSKLSSLAVPLNFAMY

SEQ ID NO: 1079599 - protein, 24 aa, Mycobacterium
SLTELRRLLDVVPGILIVDEAYGE

SEQ ID NO: 1079600 - protein, 17 aa, Mycobacterium
SLTLVPPAEPSSAPRDV

SEQ ID NO: 1079601 - protein, 26 aa, Mycobacterium
SLTPLEFDLLVALARKPRQVFTRDVL

SEQ ID NO: 1079602 - protein, 22 aa, Mycobacterium
SLTQLELLLITAAVAEGWAVSV

SEQ ID NO: 1079603 - protein, 23 aa, Mycobacterium
SLVAGLRLRLPIIGTDLGTFDTA

SEQ ID NO: 1079604 - protein, 30 aa, Mycobacterium; identical to SEQ ID NO: 861991

SEQ ID NO: 1079605 - protein, 17 aa, Mycobacterium
SLVNVGLLMHPDHGRPA

SEQ ID NO: 1079606 - protein, 33 aa, Mycobacterium
SLVRAVYDQLPAYALPLFVRLVQAMAHTTTFKS

SEQ ID NO: 1079607 - protein, 20 aa, Mycobacterium
SLVRKTLGIEFPGCTSATVG

SEQ ID NO: 1079608 - protein, 20 aa, Mycobacterium
SLYGVPTMFIAELGLADFAT

SEQ ID NO: 1079609 - protein, 22 aa, Mycobacterium
SLYVERAWPRHRRLSLAIEDGR

SEQ ID NO: 1079610 - protein, 18 aa, Mycobacterium
SMESLYEYGSRAGVWRVL

SEQ ID NO: 1079611 - protein, 19 aa, Mycobacterium
SMHALLNPGDTILGLSLAH

SEQ ID NO: 1079612 - protein, 23 aa, Mycobacterium
SMIEALDLLLEFKDRSAKKEIKQ

SEQ ID NO: 1079613 - protein, 18 aa, Mycobacterium
SMILDHVLGATAHLPRRP

SEQ ID NO: 1079614 - protein, 24 aa, Mycobacterium
SMLPAKYLNRLSDLLFILSRVANT

SEQ ID NO: 1079615 - protein, 26 aa, Mycobacterium
SMNSIKLPQLPLQVRTWIAEAAAVLR

SEQ ID NO: 1079616 - protein, 18 aa, Mycobacterium
SMPLLKREGRMLAIKRGA

SEQ ID NO: 1079617 - protein, 21 aa, Mycobacterium
SMPVPPPMVKLLLNNVLEQLA

SEQ ID NO: 1079618 - protein, 24 aa, Mycobacterium
SMQDRLERYCVFPNLGAEPQDAFR

SEQ ID NO: 1079619 - protein, 28 aa, Mycobacterium
SMQLPDGTLWSIPIVFDLSAADIDSYGL

SEQ ID NO: 1079620 - protein, 25 aa, Mycobacterium
SMRAGLQALAWIARGEAESTAASQP

SEQ ID NO: 1079621 - protein, 25 aa, Mycobacterium
SMSSEDAWAMIKVTPMIGVNDDPSE

SEQ ID NO: 1079622 - protein, 25 aa, Mycobacterium
SMSVHREWLLIELRTDWSPKAGADD

SEQ ID NO: 1079623 - protein, 27 aa, Mycobacterium
SNARTRFLLIGVPGPPPPRTGTDRTSA

SEQ ID NO: 1079624 - protein, 23 aa, Mycobacterium
SNARTWLFSIARRVVVDQIRYKT

SEQ ID NO: 1079625 - protein, 24 aa, Mycobacterium
SNATAFIYIGEVCRYLLNQPTKPT

SEQ ID NO: 1079626 - protein, 22 aa, Mycobacterium
SNATLWPLYHDVIVRPIYHREW

SEQ ID NO: 1079627 - protein, 22 aa, Mycobacterium
SNDLHLWRQLEFPGTNAQVSAL

SEQ ID NO: 1079628 - protein, 29 aa, Mycobacterium
SNEGFGYIPWGVFLPRTARLLAADKLADD

SEQ ID NO: 1079629 - protein, 23 aa, Mycobacterium
SNELLPGLDVIVPAIARGTTPAV

SEQ ID NO: 1079630 - protein, 25 aa, Mycobacterium
SNFDSPLSLLTPQLARLAAAGGFRN

SEQ ID NO: 1079631 - protein, 19 aa, Mycobacterium
SNFSAWVTGLRRVEAPTRA

SEQ ID NO: 1079632 - protein, 22 aa, Mycobacterium
SNGSVILERASLRLIQKVLRGP

SEQ ID NO: 1079633 - protein, 19 aa, Mycobacterium
SNIIYPPYTERAFKLARRL

SEQ ID NO: 1079634 - protein, 23 aa, Mycobacterium
SNITFEDWQRVIDVNLNGVFHTI

SEQ ID NO: 1079635 - protein, 22 aa, Mycobacterium
SNKAFYRYFAGKDDLILAVMER

SEQ ID NO: 1079636 - protein, 25 aa, Mycobacterium
SNLSCGRFLLGLGASGPRVIEGLHG

SEQ ID NO: 1079637 - protein, 24 aa, Mycobacterium
SNLTTLLEIVKKLPPRLIVSRERL

SEQ ID NO: 1079638 - protein, 17 aa, Mycobacterium
SNMSGVFSLEELLKQLA

SEQ ID NO: 1079639 - protein, 25 aa, Mycobacterium
SNNSGLPLPGLGLLGLANHGTFNEG

SEQ ID NO: 1079640 - protein, 30 aa, Mycobacterium
SNPRFEGLMTFTLAETLWLAGQGFDNLLLA

SEQ ID NO: 1079641 - protein, 26 aa, Mycobacterium
SNSGYPEHTFTWDTALRLRAALNALG

SEQ ID NO: 1079642 - protein, 24 aa, Mycobacterium
SNSKVPHISLLLGASYGAGHYGMC

SEQ ID NO: 1079643 - protein, 18 aa, Mycobacterium
SNVARRGAHLRGRRKPVL

SEQ ID NO: 1079644 - protein, 17 aa, Mycobacterium
SNVMIGSWFAGTYESPG

SEQ ID NO: 1079645 - protein, 24 aa, Mycobacterium
SNVPQSALYLADVIARAGFPDGCF

SEQ ID NO: 1079646 - protein, 17 aa, Mycobacterium
SNVQYYFDARKLVVQVS

SEQ ID NO: 1079647 - protein, 23 aa, Mycobacterium
SPDHYNGFFYRAMHPFCIGMYAS

SEQ ID NO: 1079648 - protein, 26 aa, Mycobacterium
SPDLRSWVPRFPWLGSTDAVPRCCQT

SEQ ID NO: 1079649 - protein, 25 aa, Mycobacterium
SPDQYTMVSYYRPELDGLPEMGLVG

SEQ ID NO: 1079650 - protein, 28 aa, Mycobacterium
SPDSGWIRTWLDTVLELPWNITTEDSVD

SEQ ID NO: 1079651 - protein, 21 aa, Mycobacterium
SPDTEFFWHGLREHQLLIQRC

SEQ ID NO: 1079652 - protein, 32 aa, Mycobacterium; identical to SEQ ID NO: 862284

SEQ ID NO: 1079653 - protein, 28 aa, Mycobacterium
SPEAIDPFLLDLLRLGAYQLLRTRVDAH

SEQ ID NO: 1079654 - protein, 25 aa, Mycobacterium
SPEGKSRRFAYPPNLYVVDGGAPQV

SEQ ID NO: 1079655 - protein, 25 aa, Mycobacterium
SPEHAGLFDLPRCEPSYPTVAGLAA

SEQ ID NO: 1079656 - protein, 22 aa, Mycobacterium
SPELGLAHIYLPDGLTVPLINY

SEQ ID NO: 1079657 - protein, 17 aa, Mycobacterium
SPENKAYYIAAAFPSAC

SEQ ID NO: 1079658 - protein, 21 aa, Mycobacterium
SPFGNPIPGLLDLGVGPESDS

SEQ ID NO: 1079659 - protein, 24 aa, Mycobacterium
SPGAALLCHVLLVEAGNGLVLVDT

SEQ ID NO: 1079660 - protein, 18 aa, Mycobacterium
SPGIDRPLTSEKHFRRAR

SEQ ID NO: 1079661 - protein, 19 aa, Mycobacterium
SPGLKRSSLIGGIRYYDTV

SEQ ID NO: 1079662 - protein, 24 aa, Mycobacterium
SPIKGTLPLDAWPSALRASPKEVA

SEQ ID NO: 1079663 - protein, 23 aa, Mycobacterium
SPKTTVTFFDGRTASFTVVGADP

SEQ ID NO: 1079664 - protein, 38 aa, Mycobacterium; identical to SEQ ID NO: 862395

SEQ ID NO: 1079665 - protein, 20 aa, Mycobacterium
SPLHSLQQQALTAVNAPIQA

SEQ ID NO: 1079666 - protein, 26 aa, Mycobacterium
SPLQARCGWAIGWKKDAFFGREALLA

SEQ ID NO: 1079667 - protein, 25 aa, Mycobacterium
SPLQELLNVINQQSTALLGRPLIGN

SEQ ID NO: 1079668 - protein, 21 aa, Mycobacterium
SPLVRQIFVYANGARAYPLAV

SEQ ID NO: 1079669 - protein, 22 aa, Mycobacterium
SPLVRQIYIYGNSARAYLLAVI

SEQ ID NO: 1079670 - protein, 20 aa, Mycobacterium
SPMLPALQQLPADGPDIHVV

SEQ ID NO: 1079671 - protein, 20 aa, Mycobacterium
SPPICPLPPIPPLPPTPPTP

SEQ ID NO: 1079672 - protein, 42 aa, Mycobacterium
SPPMADWLEAFVPLRTHVLVRFGRWQELIAQPLPCDRDLYCT

SEQ ID NO: 1079673 - protein, 18 aa, Mycobacterium
SPPVMLQTWTMPAPKLEG

SEQ ID NO: 1079674 - protein, 26 aa, Mycobacterium
SPQAQRMLKFAFNLLDDGLVGQQLFA

SEQ ID NO: 1079675 - protein, 28 aa, Mycobacterium
SPSARVLFVDYLTLLPPAGVGAPPLSEA

SEQ ID NO: 1079676 - protein, 26 aa, Mycobacterium
SPSGQPRLLGFHWTKIHLDDPGLGEV

SEQ ID NO: 1079677 - protein, 32 aa, Mycobacterium
SPSRAFWRHQLQGLIPCLFPATRSGTSRLEVI

SEQ ID NO: 1079678 - protein, 22 aa, Mycobacterium
SPTAAPQRRPSAGPAGLPSCTG

SEQ ID NO: 1079679 - protein, 27 aa, Mycobacterium
SPTGPAALLYTALLAWGAGRGATRGYT

SEQ ID NO: 1079680 - protein, 17 aa, Mycobacterium
SPTLLYLAAAGVGTIGI

SEQ ID NO: 1079681 - protein, 28 aa, Mycobacterium
SPVAQGWLHSFLASPPPRRAQMAAQLQA

SEQ ID NO: 1079682 - protein, 28 aa, Mycobacterium
SPVGLARFCTLRSWLSQWSYDDARGDGV

SEQ ID NO: 1079683 - protein, 29 aa, Mycobacterium
SPVNAAISALVLPSAFRPVPDPNSPTGSR

SEQ ID NO: 1079684 - protein, 20 aa, Mycobacterium
SPVRSAWLDIPSLVEAAKQT

SEQ ID NO: 1079685 - protein, 24 aa, Mycobacterium
SPYFGDRRKAFLQDLAAVTGAEVV

SEQ ID NO: 1079686 - protein, 21 aa, Mycobacterium
SQAIAAVFSTHAQAYQAASAQ

SEQ ID NO: 1079687 - protein, 25 aa, Mycobacterium
SQELSDLIFNLGIGNIGFGNLGDNN

SEQ ID NO: 1079688 - protein, 19 aa, Mycobacterium
SQFFITVGPTPHLNRRHTI

SEQ ID NO: 1079689 - protein, 18 aa, Mycobacterium
SQFLYGVDGAPLAEFCDD

SEQ ID NO: 1079690 - protein, 21 aa, Mycobacterium
SQGGLFPIAYTKGTDFRPANR

SEQ ID NO: 1079691 - protein, 21 aa, Mycobacterium
SQHAKTYQLLAAELAAIPDRF

SEQ ID NO: 1079692 - protein, 24 aa, Mycobacterium
SQIDRLMVPLLRGDQWWALGMSEP

SEQ ID NO: 1079693 - protein, 27 aa, Mycobacterium
SQLAEALLLLLCGVGFYAGFVGSYRDM

SEQ ID NO: 1079694 - protein, 22 aa, Mycobacterium
SQPVYFVQMWVAPDETGITPSY

SEQ ID NO: 1079695 - protein, 35 aa, Mycobacterium; identical to SEQ ID NO: 862648

SEQ ID NO: 1079696 - protein, 24 aa, Mycobacterium
SQRSGFPVLVIGCGEAGLLAGIKL

SEQ ID NO: 1079697 - protein, 23 aa, Mycobacterium
SQSFLAMDPPRHTKLRKLVSAAF

SEQ ID NO: 1079698 - protein, 26 aa, Mycobacterium
SQSRVMLPGWYGTGSAFEQWLAAGPE

SEQ ID NO: 1079699 - protein, 19 aa, Mycobacterium
SQVVVLYFGRSQPGPVRLC

SEQ ID NO: 1079700 - protein, 18 aa, Mycobacterium
SQYTQGYRRLRAQLAAFH

SEQ ID NO: 1079701 - protein, 27 aa, Mycobacterium
SRAAAAPTMGLLAAGADEVSVGIAALF

SEQ ID NO: 1079702 - protein, 26 aa, Mycobacterium
SRAAGDGFARYWLHNGWVTMGGEKMS

SEQ ID NO: 1079703 - protein, 23 aa, Mycobacterium
SRAAGFYRKLGWSAAGDLPDGSI

SEQ ID NO: 1079704 - protein, 25 aa, Mycobacterium
SRACEALYHFAWDEFCDWYVELAKT

SEQ ID NO: 1079705 - protein, 20 aa, Mycobacterium
SRANFAYYARRALARHPDAL

SEQ ID NO: 1079706 - protein, 19 aa, Mycobacterium
SRARWRIRQVREARRRVDE

SEQ ID NO: 1079707 - protein, 21 aa, Mycobacterium
SRATHIVVWATLDKSKGRAAI

SEQ ID NO: 1079708 - protein, 25 aa, Mycobacterium
SRATLHRYFAGRAALIDALEQLAFG

SEQ ID NO: 1079709 - protein, 18 aa, Mycobacterium
SRATLRRLYAHPRAGAPV

SEQ ID NO: 1079710 - protein, 24 aa, Mycobacterium
SRCAIGLLGLGPTPRRATAAEAAV

SEQ ID NO: 1079711 - protein, 27 aa, Mycobacterium
SRDGVFSLAAFRKIVDINLVGSFNVLR

SEQ ID NO: 1079712 - protein, 18 aa, Mycobacterium
SRDNGWLGGVFPGDEAAL

SEQ ID NO: 1079713 - protein, 24 aa, Mycobacterium
SRDQQALLELLHPNGRALIERAAT

SEQ ID NO: 1079714 - protein, 20 aa, Mycobacterium
SRDTAFFWDGVKAHELRIQR

SEQ ID NO: 1079715 - protein, 30 aa, Mycobacterium
SREIARILIQQLLEFGWRPDDSVILAAAGT

SEQ ID NO: 1079716 - protein, 19 aa, Mycobacterium
SRFSGVVRAFAGLYPGRKF

SEQ ID NO: 1079717 - protein, 29 aa, Mycobacterium
SRFVATVYERLWRPAAFYLASGVTTRAEQ

SEQ ID NO: 1079718 - protein, 29 aa, Mycobacterium
SRGLPLPIIAGNLFRFELLRTRHDLRQRA

SEQ ID NO: 1079719 - protein, 23 aa, Mycobacterium
SRIERKGLAIAALELRNVTEELA

SEQ ID NO: 1079720 - protein, 24 aa, Mycobacterium
SRIGAYQRRGAVSTLLLVAQRVPY

SEQ ID NO: 1079721 - protein, 24 aa, Mycobacterium
SRINSFGYLYVTPGFQAPEIVRTG

SEQ ID NO: 1079722 - protein, 27 aa, Mycobacterium
SRITTPLLPDDYLQLANPLWSARELRG

SEQ ID NO: 1079723 - protein, 18 aa, Mycobacterium
SRIVPGAYFDSIAFRLDR

SEQ ID NO: 1079724 - protein, 32 aa, Mycobacterium; identical to SEQ ID NO: 862839

SEQ ID NO: 1079725 - protein, 29 aa, Mycobacterium
SRLAVCLDLDWRPQFRVDLIPSYKAHRVA

SEQ ID NO: 1079726 - protein, 30 aa, Mycobacterium; identical to SEQ ID NO: 862844

SEQ ID NO: 1079727 - protein, 23 aa, Mycobacterium
SRLEAIGMQLQRSHSFFVGDPQI

SEQ ID NO: 1079728 - protein, 17 aa, Mycobacterium
SRLGALEGAGGNGGHGG

SEQ ID NO: 1079729 - protein, 24 aa, Mycobacterium
SRLHTSLLDRHRPLWELHVVEGLS

SEQ ID NO: 1079730 - protein, 21 aa, Mycobacterium
SRLTEVLAQAPARRGRHKNIP

SEQ ID NO: 1079731 - protein, 19 aa, Mycobacterium
SRLVVAGGVLMIYVATVTQ

SEQ ID NO: 1079732 - protein, 35 aa, Mycobacterium
SRMAPVYLYRFDYSTPLLKLLLVRAAHATELPYVW

SEQ ID NO: 1079733 - protein, 17 aa, Mycobacterium
SRMLLQVHDELLFEVAA

SEQ ID NO: 1079734 - protein, 18 aa, Mycobacterium
SRMPNLRCLILTSYTSDE

SEQ ID NO: 1079735 - protein, 26 aa, Mycobacterium
SRPLRGWQRRAMVKYLASQPRDFLAV

SEQ ID NO: 1079736 - protein, 19 aa, Mycobacterium
SRPVDYVESLGWLGSDVWM

SEQ ID NO: 1079737 - protein, 27 aa, Mycobacterium
SRQAIWDLVTSFKKLGIATLLTTQYLE

SEQ ID NO: 1079738 - protein, 19 aa, Mycobacterium
SRQLATLSIFANSGGKTAE

SEQ ID NO: 1079739 - protein, 23 aa, Mycobacterium
SRQLEMFLDLVGYLSATSAAFFL

SEQ ID NO: 1079740 - protein, 25 aa, Mycobacterium
SRQSLRSFYLQFDGKHELLLALFED

SEQ ID NO: 1079741 - protein, 26 aa, Mycobacterium
SRRFYESVFEWPVLIELPANADEATR

SEQ ID NO: 1079742 - protein, 18 aa, Mycobacterium
SRRGLARHYALRLTDSIV

SEQ ID NO: 1079743 - protein, 17 aa, Mycobacterium
SRRKIAPRFAAQCDFAS

SEQ ID NO: 1079744 - protein, 22 aa, Mycobacterium
SRRRWSWTSSWPGRFSTCTRAG

SEQ ID NO: 1079745 - protein, 19 aa, Mycobacterium
SRRSAWWVGAVTLSVAKII

SEQ ID NO: 1079746 - protein, 17 aa, Mycobacterium
SRRVAWSVLPPRPACSH

SEQ ID NO: 1079747 - protein, 22 aa, Mycobacterium
SRTHAFVVVHRLDNLRRSGRIG

SEQ ID NO: 1079748 - protein, 21 aa, Mycobacterium
SRVGLINWLIQDPGNPAVAAE

SEQ ID NO: 1079749 - protein, 24 aa, Mycobacterium
SRVQFGRPLAKFHAVQNLIADIAA

SEQ ID NO: 1079750 - protein, 18 aa, Mycobacterium
SRVWFLEQLQGPSAVYNI

SEQ ID NO: 1079751 - protein, 21 aa, Mycobacterium
SRYPGGLALRFARVVRYRDDK

SEQ ID NO: 1079752 - protein, 18 aa, Mycobacterium
SSAAMVGAISPYLTWLRA

SEQ ID NO: 1079753 - protein, 19 aa, Mycobacterium
SSAARHLAARWAAKEAVIK

SEQ ID NO: 1079754 - protein, 18 aa, Mycobacterium
SSADALVAAVRSKAPGDK

SEQ ID NO: 1079755 - protein, 23 aa, Mycobacterium
SSAQRFLTLDAFVAAGFQVVALL

SEQ ID NO: 1079756 - protein, 23 aa, Mycobacterium
SSDAANGAVGSRGGDGGDGGKGG

SEQ ID NO: 1079757 - protein, 28 aa, Mycobacterium
SSEAMANSIWPYVAWLRATAAATEQSAS

SEQ ID NO: 1079758 - protein, 27 aa, Mycobacterium
SSEEFFDLVWRLMRFDKHGPLDLVLYD

SEQ ID NO: 1079759 - protein, 28 aa, Mycobacterium
SSGIRGGGVLLYYDARTRSVQAYDGREV

SEQ ID NO: 1079760 - protein, 18 aa, Mycobacterium
SSGLAYLTGLPGGPPDFS

SEQ ID NO: 1079761 - protein, 17 aa, Mycobacterium
SSGLLFGNGGDGGDGGA

SEQ ID NO: 1079762 - protein, 24 aa, Mycobacterium
SSGNPYLAFAAMLMAGLDGIKNKI

SEQ ID NO: 1079763 - protein, 20 aa, Mycobacterium
SSGRWYIDCLAAAGAMSLGW

SEQ ID NO: 1079764 - protein, 24 aa, Mycobacterium
SSGSALKIFTALYGLTDVTERARV

SEQ ID NO: 1079765 - protein, 26 aa, Mycobacterium
SSGVWELFWPDFPADGLYKFRVHGAD

SEQ ID NO: 1079766 - protein, 24 aa, Mycobacterium
SSGYLDPGYPMDSAWRGALPPESG

SEQ ID NO: 1079767 - protein, 22 aa, Mycobacterium
SSIGFIAPIPDATNSAISDAVH

SEQ ID NO: 1079768 - protein, 17 aa, Mycobacterium
SSINFADVLIAFGRYPS

SEQ ID NO: 1079769 - protein, 20 aa, Mycobacterium
SSLEAFLKRRIRSHGLVTAS

SEQ ID NO: 1079770 - protein, 40 aa, Mycobacterium
SSLQSLETDLLGLINPPTMALFGRALIGNGANGAAGTGAA

SEQ ID NO: 1079771 - protein, 23 aa, Mycobacterium
SSLVTDARRRLAVAAVVEAATFT

SEQ ID NO: 1079772 - protein, 24 aa, Mycobacterium
SSLVTDARRRLAVAAVVEAATFTD

SEQ ID NO: 1079773 - protein, 29 aa, Mycobacterium
SSNGALFLVLRPLLVDYVMSMPRGPQVIY

SEQ ID NO: 1079774 - protein, 23 aa, Mycobacterium
SSNLARFDAMRYGLRIGDDGTHS

SEQ ID NO: 1079775 - protein, 17 aa, Mycobacterium
SSNLLFRRNSVTGAVEV

SEQ ID NO: 1079776 - protein, 25 aa, Mycobacterium
SSNPGINFGLGNWGNGNFGIGNRGD

SEQ ID NO: 1079777 - protein, 17 aa, Mycobacterium
SSNRLLALSTPLEFVDV

SEQ ID NO: 1079778 - protein, 22 aa, Mycobacterium
SSPDLVLLFHNGTSAGIATTKA

SEQ ID NO: 1079779 - protein, 26 aa, Mycobacterium
SSPERLRLGALARHIAEELPLLGSCT

SEQ ID NO: 1079780 - protein, 23 aa, Mycobacterium
SSPGLLQYPWGVIPDKYIARVQR

SEQ ID NO: 1079781 - protein, 31 aa, Mycobacterium; identical to SEQ ID NO: 786048

SEQ ID NO: 1079782 - protein, 21 aa, Mycobacterium
SSQLPPLFNDLIRHPVRRRVD

SEQ ID NO: 1079783 - protein, 24 aa, Mycobacterium
SSRGAWQFIAPTFAAYHQPGTSTN

SEQ ID NO: 1079784 - protein, 23 aa, Mycobacterium
SSRLETTWWEFPRDIEAPLSEVA

SEQ ID NO: 1079785 - protein, 19 aa, Mycobacterium
SSRLLAEYWAHEAALMAVE

SEQ ID NO: 1079786 - protein, 23 aa, Mycobacterium
SSRRAWVLLPDTTLILGDKVVSM

SEQ ID NO: 1079787 - protein, 23 aa, Mycobacterium
SSRRGKPAIPAWEDVLLGVRSSG

SEQ ID NO: 1079788 - protein, 21 aa, Mycobacterium
SSRVVPIAGLRHTESEWARVL

SEQ ID NO: 1079789 - protein, 25 aa, Mycobacterium
SSSEIAMFFILLVVAGNETTRNTIS

SEQ ID NO: 1079790 - protein, 26 aa, Mycobacterium
SSSRELKHLLINDLPIERQAQDVSWG

SEQ ID NO: 1079791 - protein, 24 aa, Mycobacterium
SSTAPADLVRFLDRLYSAFDALVD

SEQ ID NO: 1079792 - protein, 24 aa, Mycobacterium
SSTAWNPLPRGWYPGPQYIPVVYL

SEQ ID NO: 1079793 - protein, 30 aa, Mycobacterium
SSTGALFLVLRPLLIDYVMSMPRGPQVIYP

SEQ ID NO: 1079794 - protein, 32 aa, Mycobacterium; identical to SEQ ID NO: 370049

SEQ ID NO: 1079795 - protein, 19 aa, Mycobacterium
SSTITIGSLFGTGGTGGDG

SEQ ID NO: 1079796 - protein, 20 aa, Mycobacterium
SSTPITCETLFTLTATTAEQ

SEQ ID NO: 1079797 - protein, 22 aa, Mycobacterium
SSTRLLALLPARSMSSAPRVFG

SEQ ID NO: 1079798 - protein, 23 aa, Mycobacterium
SSTRYEWVLVDFAVTCAGAATTT

SEQ ID NO: 1079799 - protein, 24 aa, Mycobacterium
SSTTPLAGAGWTAAAPTAAPGTFM

SEQ ID NO: 1079800 - protein, 18 aa, Mycobacterium
SSTVTSAPTPYLSTFLLV

SEQ ID NO: 1079801 - protein, 26 aa, Mycobacterium
SSTYVRKPPYFEGMAAAPAPVSDITG

SEQ ID NO: 1079802 - protein, 27 aa, Mycobacterium
SSVLGPTLPNRLYWLSASLGADGTQGG

SEQ ID NO: 1079803 - protein, 25 aa, Mycobacterium
SSVPRRAIAAIPTWSTLEVQQGAHK

SEQ ID NO: 1079804 - protein, 22 aa, Mycobacterium
SSWAAPWSIDANVSALAALLKD

SEQ ID NO: 1079805 - protein, 23 aa, Mycobacterium
SSYLLPQLVGRQNAAWLLMSSEW

SEQ ID NO: 1079806 - protein, 22 aa, Mycobacterium
STAAWLYSNFYGLAKVGVNGLT

SEQ ID NO: 1079807 - protein, 30 aa, Mycobacterium; identical to SEQ ID NO: 863328

SEQ ID NO: 1079808 - protein, 21 aa, Mycobacterium
STALFLAAQAIRGGLADCTVA

SEQ ID NO: 1079809 - protein, 20 aa, Mycobacterium
STALYPPKRFLGAARNIEEG

SEQ ID NO: 1079810 - protein, 24 aa, Mycobacterium
STAPPPTEIYGGAGGPGGGASLDS

SEQ ID NO: 1079811 - protein, 26 aa, Mycobacterium
STATMAALANFFRIKSAYFTDDEYYE

SEQ ID NO: 1079812 - protein, 21 aa, Mycobacterium
STAVASLFADHAQDYRTISLE

SEQ ID NO: 1079813 - protein, 23 aa, Mycobacterium
STAVAYPAHWTTSAVDALGAALG

SEQ ID NO: 1079814 - protein, 17 aa, Mycobacterium
STCPHHLLPFTGTATIA

SEQ ID NO: 1079815 - protein, 27 aa, Mycobacterium
STDNIDYYLVLANWKLGIVLEKTYAAA

SEQ ID NO: 1079816 - protein, 32 aa, Mycobacterium; identical to SEQ ID NO: 863394

SEQ ID NO: 1079817 - protein, 24 aa, Mycobacterium
STEYDVERYFRDAPLMIVGEGTNE

SEQ ID NO: 1079818 - protein, 25 aa, Mycobacterium
STFGPYRLTRLLGRGGMGEVYEAEH

SEQ ID NO: 1079819 - protein, 22 aa, Mycobacterium
STFYGDLFPHAVRWRGVIYLEA

SEQ ID NO: 1079820 - protein, 28 aa, Mycobacterium
STGALFLVLRPLLIDYVMSMPRGPQVIY

SEQ ID NO: 1079821 - protein, 24 aa, Mycobacterium
STGDGIALALWAGVAVSDLEFIQF

SEQ ID NO: 1079822 - protein, 24 aa, Mycobacterium
STGLRPFDVQLLGALRMLAGDVIE

SEQ ID NO: 1079823 - protein, 26 aa, Mycobacterium
STGQPLDWFCLFSSGAALMGSPGQGA

SEQ ID NO: 1079824 - protein, 22 aa, Mycobacterium
STGTNLWGAFGLLAEMVADGRS

SEQ ID NO: 1079825 - protein, 22 aa, Mycobacterium
STGVLLPGGFPEQFTAELSAND

SEQ ID NO: 1079826 - protein, 23 aa, Mycobacterium
STIALGILHRLAATVAKVGVFRP

SEQ ID NO: 1079827 - protein, 30 aa, Mycobacterium
STIKFPQAAPAVNVYPIAVLSNAPQPGLAR

SEQ ID NO: 1079828 - protein, 18 aa, Mycobacterium
STIRIGLALNCEIVPWCR

SEQ ID NO: 1079829 - protein, 21 aa, Mycobacterium
STKVKKWQRIGRGRRDLHRRH

SEQ ID NO: 1079830 - protein, 26 aa, Mycobacterium
STLDKLLDMALGACDKLFVAQRDALA

SEQ ID NO: 1079831 - protein, 25 aa, Mycobacterium
STLDKLLDMALGACDTLFAAQCDAL

SEQ ID NO: 1079832 - protein, 23 aa, Mycobacterium
STMMHVGALMPFTPPDDAPADFL

SEQ ID NO: 1079833 - protein, 26 aa, Mycobacterium
STNGMLRQYFPKRTDLPRWSAEEIEA

SEQ ID NO: 1079834 - protein, 20 aa, Mycobacterium
STNHILGFPFTDHGLRLGVE

SEQ ID NO: 1079835 - protein, 19 aa, Mycobacterium
STNIPFLQAVLDDPDFQAG

SEQ ID NO: 1079836 - protein, 24 aa, Mycobacterium
STPLAVLAAFFDRLGRYEAAATIA

SEQ ID NO: 1079837 - protein, 38 aa, Mycobacterium
STPVPEYRFPGLLPGDRWCVVAVNWLRAHYDGCAAPVV

SEQ ID NO: 1079838 - protein, 20 aa, Mycobacterium
STRTFPLRSSFAPSYNMTIN

SEQ ID NO: 1079839 - protein, 28 aa, Mycobacterium
STRTRIRPHFFPFTEPSAEVDVWFASKK

SEQ ID NO: 1079840 - protein, 17 aa, Mycobacterium
STSFLALPAFPGPPRTT

SEQ ID NO: 1079841 - protein, 22 aa, Mycobacterium
STSPLHTFQQQALGAVNAPVQT

SEQ ID NO: 1079842 - protein, 28 aa, Mycobacterium
STSWDDYSWPIFKWFELAQSEIHRCWHA

SEQ ID NO: 1079843 - protein, 17 aa, Mycobacterium
STTGQFTFNGLNSGTGN

SEQ ID NO: 1079844 - protein, 20 aa, Mycobacterium
STVLFLGRHVGYPVALEGAL

SEQ ID NO: 1079845 - protein, 24 aa, Mycobacterium
STVVLIADRLLPGGVFHAATDHPG

SEQ ID NO: 1079846 - protein, 21 aa, Mycobacterium
STWDLTDWRGKPIRIGFAVHS

SEQ ID NO: 1079847 - protein, 25 aa, Mycobacterium
STWPEFFDAIRSAGYTRVSLGMQSV

SEQ ID NO: 1079848 - protein, 19 aa, Mycobacterium
STWVLGPLRRDVSRASTPA

SEQ ID NO: 1079849 - protein, 25 aa, Mycobacterium
STYDRPMHHILLTGGTGYLGAYLIR

SEQ ID NO: 1079850 - protein, 31 aa, Mycobacterium
SVAAALTPLSWPTQTLAGLAAPAAALGSVAR

SEQ ID NO: 1079851 - protein, 33 aa, Mycobacterium
SVAELIPPSLQWLRPIAPAFRPRWRDPSRDEAR

SEQ ID NO: 1079852 - protein, 25 aa, Mycobacterium
SVALGFGFRCGFLGLLHMEISRERL

SEQ ID NO: 1079853 - protein, 27 aa, Mycobacterium
SVALQAWLAGHAVAGTVLFPGAGFVEL

SEQ ID NO: 1079854 - protein, 20 aa, Mycobacterium
SVATAMIPFLEHDDANRALM

SEQ ID NO: 1079855 - protein, 26 aa, Mycobacterium
SVDLAIPMIGMLKRKAERRLIDGALK

SEQ ID NO: 1079856 - protein, 24 aa, Mycobacterium
SVDSILFITVARFFGLRGPYDNDL

SEQ ID NO: 1079857 - protein, 19 aa, Mycobacterium
SVEERIEMWLRAEGRQRVR

SEQ ID NO: 1079858 - protein, 25 aa, Mycobacterium
SVEGRGLFLRLIADADLVIENFSPR

SEQ ID NO: 1079859 - protein, 23 aa, Mycobacterium
SVEHFNWLEDLGFQFERSYFPGK

SEQ ID NO: 1079860 - protein, 23 aa, Mycobacterium
SVFGLPELSLGLIPGAGGAVSVT

SEQ ID NO: 1079861 - protein, 41 aa, Mycobacterium
SVFKFVAYAVLDPMIYFGPFTPAISPLGLPAVTVGLAGLAG

SEQ ID NO: 1079862 - protein, 38 aa, Mycobacterium; identical to SEQ ID NO: 863685

SEQ ID NO: 1079863 - protein, 26 aa, Mycobacterium
SVGLSYPPQFWPLTSGLTLNQSVAEG

SEQ ID NO: 1079864 - protein, 34 aa, Mycobacterium
SVGTVFAARPDRMSARRFWLRYAADSVGSLTLDE

SEQ ID NO: 1079865 - protein, 17 aa, Mycobacterium
SVHGQLMTLYPSMSSED

SEQ ID NO: 1079866 - protein, 26 aa, Mycobacterium
SVHKHKPLLPPPPQPPGREPVHRRNM

SEQ ID NO: 1079867 - protein, 22 aa, Mycobacterium
SVHRVVMPVVVRWGMYRGVRKN

SEQ ID NO: 1079868 - protein, 21 aa, Mycobacterium
SVHVPLRWVGPIKISGNEGQF

SEQ ID NO: 1079869 - protein, 22 aa, Mycobacterium
SVIAIDDRTLARRPAWLAACAE

SEQ ID NO: 1079870 - protein, 25 aa, Mycobacterium
SVIHSHPVWATMFAIAHQPIPACID

SEQ ID NO: 1079871 - protein, 17 aa, Mycobacterium
SVKLYGYKWPTLDGMFT

SEQ ID NO: 1079872 - protein, 17 aa, Mycobacterium
SVKYRVQRAIKRRGRPL

SEQ ID NO: 1079873 - protein, 25 aa, Mycobacterium
SVLARDLTWTALVDGGVTALAVPER

SEQ ID NO: 1079874 - protein, 25 aa, Mycobacterium
SVLARTIMLPLRTNARAKMSEVRHG

SEQ ID NO: 1079875 - protein, 17 aa, Mycobacterium
SVLCKISEVPPYNRVAA

SEQ ID NO: 1079876 - protein, 18 aa, Mycobacterium
SVLPAYLNGIGGKGVHIV

SEQ ID NO: 1079877 - protein, 18 aa, Mycobacterium
SVLRAERPVSWHPPVEDA

SEQ ID NO: 1079878 - protein, 21 aa, Mycobacterium
SVLTALLQPDHRLAVVFGAGG

SEQ ID NO: 1079879 - protein, 25 aa, Mycobacterium
SVLTSPISFLQRPARWMQLLASNCQ

SEQ ID NO: 1079880 - protein, 19 aa, Mycobacterium
SVMSFMFPNWHEFSRNVFG

SEQ ID NO: 1079881 - protein, 37 aa, Mycobacterium
SVNPLQPLLDVINAPTQLLLNRPLIGNGTDGTAANPD

SEQ ID NO: 1079882 - protein, 20 aa, Mycobacterium
SVPPAYDIAALLAAHPVSVN

SEQ ID NO: 1079883 - protein, 17 aa, Mycobacterium
SVPVGWSSAAPALTSGT

SEQ ID NO: 1079884 - protein, 29 aa, Mycobacterium
SVPWPLIREQTPSDACYILLRGEAGVYVG

SEQ ID NO: 1079885 - protein, 19 aa, Mycobacterium
SVQALINWGVAPDAGPVVV

SEQ ID NO: 1079886 - protein, 21 aa, Mycobacterium
SVQDFGAGLVALPAAYQGAFQ

SEQ ID NO: 1079887 - protein, 17 aa, Mycobacterium
SVQQALNSPGALFTHQM

SEQ ID NO: 1079888 - protein, 26 aa, Mycobacterium
SVQVGILPFPTSLQGLTLIAMGNGFG

SEQ ID NO: 1079889 - protein, 20 aa, Mycobacterium
SVRADVLAKLLLLEDRFRVD

SEQ ID NO: 1079890 - protein, 19 aa, Mycobacterium
SVRAYLKQIGKVALLNAEE

SEQ ID NO: 1079891 - protein, 28 aa, Mycobacterium
SVRMAQERTWQWLFDRITASSAATDHDR

SEQ ID NO: 1079892 - protein, 23 aa, Mycobacterium
SVRPVGPLPVQPGGPPLLVGTIG

SEQ ID NO: 1079893 - protein, 17 aa, Mycobacterium
SVRRFGRMFLAGARLTV

SEQ ID NO: 1079894 - protein, 20 aa, Mycobacterium
SVSGRRPTPGTAAYGAAKAG

SEQ ID NO: 1079895 - protein, 25 aa, Mycobacterium
SVSRYLLSQTYALLDAPRSADAGQL

SEQ ID NO: 1079896 - protein, 23 aa, Mycobacterium
SVTHIVMIGILPTLSDRQLDELF

SEQ ID NO: 1079897 - protein, 26 aa, Mycobacterium
SVTRLPAPPLPTTRLLPRPLPNREDH

SEQ ID NO: 1079898 - protein, 25 aa, Mycobacterium
SVVFDYPTVYSLTDYLATILPELET

SEQ ID NO: 1079899 - protein, 28 aa, Mycobacterium
SVVVEADWPLLAAAYRTRWSLHIVDDLL

SEQ ID NO: 1079900 - protein, 18 aa, Mycobacterium
SVWEIFGALLGAGRLVVV

SEQ ID NO: 1079901 - protein, 26 aa, Mycobacterium
SVYARVNPFGFIETPYRKVVDGVVSD

SEQ ID NO: 1079902 - protein, 24 aa, Mycobacterium
SVYRRIGRYLLGRPSPVPYTLLDM

SEQ ID NO: 1079903 - protein, 20 aa, Mycobacterium
SVYTGALFRTECPDNVVVLD

SEQ ID NO: 1079904 - protein, 19 aa, Mycobacterium
SWAPVITKVTWTSPPPFRI

SEQ ID NO: 1079905 - protein, 18 aa, Mycobacterium
SWARYWPTPKHCVPPDTA

SEQ ID NO: 1079906 - protein, 19 aa, Mycobacterium
SWATPFGEVLDWSDAPFAN

SEQ ID NO: 1079907 - protein, 17 aa, Mycobacterium
SWAVLNWNSNAIAVYDA

SEQ ID NO: 1079908 - protein, 20 aa, Mycobacterium
SWAWARIAKSRRPIGALLMD

SEQ ID NO: 1079909 - protein, 24 aa, Mycobacterium
SWFAGYRGDLAFASLIVGGGSSEY

SEQ ID NO: 1079910 - protein, 29 aa, Mycobacterium
SWFTSVIPHVLVPGLVTALRATTARRALV

SEQ ID NO: 1079911 - protein, 28 aa, Mycobacterium
SWINAADEIFWVKYHFITDQGIDFLTQE

SEQ ID NO: 1079912 - protein, 23 aa, Mycobacterium
SWLADFLPRDYYQRYPRCRWDVA

SEQ ID NO: 1079913 - protein, 19 aa, Mycobacterium
SWLATLWSEFGPNANIWNT

SEQ ID NO: 1079914 - protein, 19 aa, Mycobacterium
SWLDGYRDSWRYGVSMLAR

SEQ ID NO: 1079915 - protein, 18 aa, Mycobacterium
SWLPALKEMVPSLGANLS

SEQ ID NO: 1079916 - protein, 26 aa, Mycobacterium
SWPARWGILYHMYCYRLLYEMAAAPD

SEQ ID NO: 1079917 - protein, 26 aa, Mycobacterium
SWPRSAKLLDVLLAAGLDAPFSCREG

SEQ ID NO: 1079918 - protein, 24 aa, Mycobacterium
SWSMSTVPMWCRRQCRSGARYRPE

SEQ ID NO: 1079919 - protein, 22 aa, Mycobacterium
SWVIHGALYRVPRLKVAVIEAG

SEQ ID NO: 1079920 - protein, 21 aa, Mycobacterium
SWVPRLLWRRWSPTYYAEEDL

SEQ ID NO: 1079921 - protein, 17 aa, Mycobacterium
SYAVWDAGALTVSAPRD

SEQ ID NO: 1079922 - protein, 29 aa, Mycobacterium
SYDATLPAMRRIVAALFHDARYPADMDYV

SEQ ID NO: 1079923 - protein, 21 aa, Mycobacterium
SYDLNLFLSGIEQAINGDPAG

SEQ ID NO: 1079924 - protein, 27 aa, Mycobacterium
SYDPSRIDALLKGRRLKKPLIAAVEGP

SEQ ID NO: 1079925 - protein, 23 aa, Mycobacterium
SYFGPSFMINWLHNSYGGYKSES

SEQ ID NO: 1079926 - protein, 20 aa, Mycobacterium
SYGHTWIAPHDTNVALLPIG

SEQ ID NO: 1079927 - protein, 27 aa, Mycobacterium
SYGLNAKWPVYLSTKNTILKAYDGMFK

SEQ ID NO: 1079928 - protein, 28 aa, Mycobacterium
SYGPPASHHLRWLASANALLEIPEDDVE

SEQ ID NO: 1079929 - protein, 24 aa, Mycobacterium
SYKFDFAMIWYHASTKPSPFCGNP

SEQ ID NO: 1079930 - protein, 24 aa, Mycobacterium
SYMVPARIVTLPRLPVNANGKLDG

SEQ ID NO: 1079931 - protein, 26 aa, Mycobacterium
SYNRGDPLMFKLGVGQVIQGWDQGVQ

SEQ ID NO: 1079932 - protein, 24 aa, Mycobacterium
SYPPEAIDWLLPAGARDVLDLGAG

SEQ ID NO: 1079933 - protein, 17 aa, Mycobacterium
SYRLRMGAVGLPLQHHL

SEQ ID NO: 1079934 - protein, 24 aa, Mycobacterium
SYRTREPVRIIGELTDWAGHSPAQ

SEQ ID NO: 1079935 - protein, 17 aa, Mycobacterium
SYRVLVSDLAQLYRGAT

SEQ ID NO: 1079936 - protein, 21 aa, Mycobacterium
SYTFDKLVQVYPHVVRLRPAP

SEQ ID NO: 1079937 - protein, 22 aa, Mycobacterium
SYVNIGFWSSVPAGATEGATNR

SEQ ID NO: 1079938 - protein, 23 aa, Mycobacterium
TAAAAERVVFLFPGQGAQHVGMA

SEQ ID NO: 1079939 - protein, 20 aa, Mycobacterium
TAAAGGWFRSSRRPDREWTN

SEQ ID NO: 1079940 - protein, 20 aa, Mycobacterium
TAAALLSWLAEDFRRVLGFS

SEQ ID NO: 1079941 - protein, 17 aa, Mycobacterium
TAAALRELEREGFRGAV

SEQ ID NO: 1079942 - protein, 21 aa, Mycobacterium
TAAASPYAGWLSAAAARAAGA

SEQ ID NO: 1079943 - protein, 21 aa, Mycobacterium
TAAASYLGWLNAAAAHAEQAA

SEQ ID NO: 1079944 - protein, 22 aa, Mycobacterium
TAAEPEVVVEQADIEEIEPQEP

SEQ ID NO: 1079945 - protein, 25 aa, Mycobacterium
TAAFIDSDAWFLIRAVTAPDGASLP

SEQ ID NO: 1079946 - protein, 19 aa, Mycobacterium
TAAFLCRLQEFLGTIDGSV

SEQ ID NO: 1079947 - protein, 18 aa, Mycobacterium
TAAFRLRLAVGEDALITL

SEQ ID NO: 1079948 - protein, 35 aa, Mycobacterium; identical to SEQ ID NO: 864205

SEQ ID NO: 1079949 - protein, 40 aa, Mycobacterium; identical to SEQ ID NO: 864208

SEQ ID NO: 1079950 - protein, 22 aa, Mycobacterium
TAAKLGPFLVPATLGAPEGTVA

SEQ ID NO: 1079951 - protein, 17 aa, Mycobacterium
TAALRRLGLQPVACAGR

SEQ ID NO: 1079952 - protein, 23 aa, Mycobacterium
TAAPLDRRLLLGMLAELPAGAGV

SEQ ID NO: 1079953 - protein, 20 aa, Mycobacterium
TAAPNFAYSLFAKRLRKQAK

SEQ ID NO: 1079954 - protein, 21 aa, Mycobacterium
TAAPNFAYSLLARRLRRAQDH

SEQ ID NO: 1079955 - protein, 28 aa, Mycobacterium
TAAPTFDIFMWEIFGPLVAGARLVFNPG

SEQ ID NO: 1079956 - protein, 17 aa, Mycobacterium
TAARWIGTAANWMSCWT

SEQ ID NO: 1079957 - protein, 25 aa, Mycobacterium
TAASLHAFNLWLDEDWGFDRPDHRI

SEQ ID NO: 1079958 - protein, 17 aa, Mycobacterium
TAAWDEPFALPTEESTT

SEQ ID NO: 1079959 - protein, 31 aa, Mycobacterium
TAAWYTTATIPTAIFLANALNTGAPVIAAEG

SEQ ID NO: 1079960 - protein, 18 aa, Mycobacterium
TADGRILRVRGRGVPKRS

SEQ ID NO: 1079961 - protein, 25 aa, Mycobacterium
TADMLEPLRIYAHIPRLLNAYGRLE

SEQ ID NO: 1079962 - protein, 19 aa, Mycobacterium
TADRFTTMSPAERWQLLAT

SEQ ID NO: 1079963 - protein, 21 aa, Mycobacterium
TADWLTEAFFSLVSGAGWSVQ

SEQ ID NO: 1079964 - protein, 23 aa, Mycobacterium
TADYKRHLAAELTIRTLRSAVGR

SEQ ID NO: 1079965 - protein, 18 aa, Mycobacterium
TAEAVSAGVPLRLISVLK

SEQ ID NO: 1079966 - protein, 48 aa, Mycobacterium
TAEDRALSWLPLYHDMGLILGVLTPIFAGFPVVLADPLSFVKRPDLWL

SEQ ID NO: 1079967 - protein, 27 aa, Mycobacterium
TAELDGGYWFRSIRQTVQFAEAVRAAG

SEQ ID NO: 1079968 - protein, 26 aa, Mycobacterium
TAERGLFDFFFLAEGLRLREHRGRIH

SEQ ID NO: 1079969 - protein, 27 aa, Mycobacterium
TAESGFPMLPPLMPPPISAGSGWRKRK

SEQ ID NO: 1079970 - protein, 19 aa, Mycobacterium
TAFATWKALGAKFVAARPA

SEQ ID NO: 1079971 - protein, 21 aa, Mycobacterium
TAFLVAARRLAPGAVAPAPLG

SEQ ID NO: 1079972 - protein, 19 aa, Mycobacterium
TAFQAAHARFVEAAGKVHT

SEQ ID NO: 1079973 - protein, 23 aa, Mycobacterium
TAGAWLHVQLPEAPPPPENTPVE

SEQ ID NO: 1079974 - protein, 23 aa, Mycobacterium
TAGKWNLKTIADLAPHSANLRFA

SEQ ID NO: 1079975 - protein, 43 aa, Mycobacterium
TAGPIERFLEWYAPFANFFYDTLGLPFFGAGITSLFAATAKTA

SEQ ID NO: 1079976 - protein, 22 aa, Mycobacterium
TAGPLIDKLYRWGDSDERLGVF

SEQ ID NO: 1079977 - protein, 25 aa, Mycobacterium
TAGPQLVVPILNARFALNAANARWG

SEQ ID NO: 1079978 - protein, 24 aa, Mycobacterium
TAHATAWYGLNDLAGIKAGDRVLI

SEQ ID NO: 1079979 - protein, 29 aa, Mycobacterium
TAHGPVRFPGVPTWFSRTPGRVLGPAPQL

SEQ ID NO: 1079980 - protein, 20 aa, Mycobacterium
TAILVRRALMRLPVEQRAAV

SEQ ID NO: 1079981 - protein, 26 aa, Mycobacterium
TAIVEFPPAGTLTGIAKRELRGVPTH

SEQ ID NO: 1079982 - protein, 21 aa, Mycobacterium
TAIVELPPAGALTGIAKRELR

SEQ ID NO: 1079983 - protein, 24 aa, Mycobacterium
TAKRPLFTDFAPRLLVSHPTEVKV

SEQ ID NO: 1079984 - protein, 20 aa, Mycobacterium
TAKVGYPVRWRDYSKLVIDR

SEQ ID NO: 1079985 - protein, 23 aa, Mycobacterium
TALATPMRLVIFGGLPPVVRERF

SEQ ID NO: 1079986 - protein, 24 aa, Mycobacterium
TALDPRVVLRRLMAADPTSYGYLV

SEQ ID NO: 1079987 - protein, 17 aa, Mycobacterium
TALDRMALRAEARAHFG

SEQ ID NO: 1079988 - protein, 17 aa, Mycobacterium
TALHFVGAGMRILEIVA

SEQ ID NO: 1079989 - protein, 21 aa, Mycobacterium
TALIYHATFAPRVAEVLPELP

SEQ ID NO: 1079990 - protein, 22 aa, Mycobacterium
TALLDERLADFVPLAAPDDVFA

SEQ ID NO: 1079991 - protein, 23 aa, Mycobacterium
TALMQRFNALDQWGRFDEAFANL

SEQ ID NO: 1079992 - protein, 25 aa, Mycobacterium
TALRDLVARRTPLFEFAIRTALAES

SEQ ID NO: 1079993 - protein, 17 aa, Mycobacterium
TALRLLERKIAQQPPKK

SEQ ID NO: 1079994 - protein, 20 aa, Mycobacterium
TALTINKMCLSGIDAIALAD

SEQ ID NO: 1079995 - protein, 25 aa, Mycobacterium
TALVNGPFLELTGRPLIGNGANGYT

SEQ ID NO: 1079996 - protein, 21 aa, Mycobacterium
TAMLAKVRRAPALIKVESVVQ

SEQ ID NO: 1079997 - protein, 17 aa, Mycobacterium
TAMLYRHPKLRARFIYG

SEQ ID NO: 1079998 - protein, 27 aa, Mycobacterium
TAMSLAPLAYTLFQRAMRHDPSDTTWL

SEQ ID NO: 1079999 - protein, 29 aa, Mycobacterium
TANEALYDWNYQHQLLSIRLAEARGADIS

SEQ ID NO: 1080000 - protein, 20 aa, Mycobacterium
TANPPWAGTPALPPSTSPAS

SEQ ID NO: 1080001 - protein, 19 aa, Mycobacterium
TAPMAAWAATAAAGTPPVR

SEQ ID NO: 1080002 - protein, 24 aa, Mycobacterium
TAPRLLLEVVCARLLLPSASDAES

SEQ ID NO: 1080003 - protein, 29 aa, Mycobacterium
TAPTAWLAEGLLIYLPPEAQDRLFDNITA

SEQ ID NO: 1080004 - protein, 17 aa, Mycobacterium
TAPTLWDNSMVGGGAVA

SEQ ID NO: 1080005 - protein, 17 aa, Mycobacterium
TAPTQKFMAIWRASKPV

SEQ ID NO: 1080006 - protein, 19 aa, Mycobacterium
TAPVIIEWCQLPAGTTRQA

SEQ ID NO: 1080007 - protein, 26 aa, Mycobacterium
TAQASSVPILIHPEPRSVLGGLAAAA

SEQ ID NO: 1080008 - protein, 22 aa, Mycobacterium
TAQDPRFRFFGNIKVGEHVEAA

SEQ ID NO: 1080009 - protein, 26 aa, Mycobacterium
TAQLRSRSWWSGFDVVLLVDDWHMIV

SEQ ID NO: 1080010 - protein, 19 aa, Mycobacterium
TAQWALDRHTFGRPLASYQ

SEQ ID NO: 1080011 - protein, 25 aa, Mycobacterium
TARAALTMFLGRPDQPGRVRAVAAG

SEQ ID NO: 1080012 - protein, 18 aa, Mycobacterium
TARISLAAQRFAAAVWTA

SEQ ID NO: 1080013 - protein, 24 aa, Mycobacterium
TASKNIFRPSIMTLETIDGQEIRV

SEQ ID NO: 1080014 - protein, 24 aa, Mycobacterium
TASLALLYAARRYYRNWGATKQEA

SEQ ID NO: 1080015 - protein, 26 aa, Mycobacterium
TASLNPARFFLGMAAAGFSFDRFTNG

SEQ ID NO: 1080016 - protein, 18 aa, Mycobacterium
TASVYPLRAEAAFEYAAR

SEQ ID NO: 1080017 - protein, 24 aa, Mycobacterium
TATERWICSIFAQLFGRQRVGAED

SEQ ID NO: 1080018 - protein, 24 aa, Mycobacterium
TATGIDIFRIFDALNNLESMRPAI

SEQ ID NO: 1080019 - protein, 23 aa, Mycobacterium
TATIVPVLAAINPHLGLVVRGPS

SEQ ID NO: 1080020 - protein, 18 aa, Mycobacterium
TATLRMVLAAIQTEEVSG

SEQ ID NO: 1080021 - protein, 20 aa, Mycobacterium
TATRAPFVLLTSNATRELSE

SEQ ID NO: 1080022 - protein, 22 aa, Mycobacterium
TATRLTPFVPPPATTNLPGPLW

SEQ ID NO: 1080023 - protein, 18 aa, Mycobacterium
TATSFARRIARNTQLLLL

SEQ ID NO: 1080024 - protein, 25 aa, Mycobacterium
TATTLAWVFDLLLHHPDALRRVQEE

SEQ ID NO: 1080025 - protein, 23 aa, Mycobacterium
TATTVLVIMRPFRPRHTGADQAA

SEQ ID NO: 1080026 - protein, 30 aa, Mycobacterium; identical to SEQ ID NO: 950869

SEQ ID NO: 1080027 - protein, 25 aa, Mycobacterium
TAVEVLWRGQRLRALVALPELVAAA

SEQ ID NO: 1080028 - protein, 19 aa, Mycobacterium
TAVIARIRDWLDIDHVVVA

SEQ ID NO: 1080029 - protein, 23 aa, Mycobacterium
TAVLADLLPSYMVPTRTVFFERF

SEQ ID NO: 1080030 - protein, 27 aa, Mycobacterium
TAVLLNPMAFLQRPARWMQLMGKFRGQ

SEQ ID NO: 1080031 - protein, 21 aa, Mycobacterium
TAVPYRVPFPQVMPTQETQPA

SEQ ID NO: 1080032 - protein, 20 aa, Mycobacterium
TAVTAPDWQQGLSASVRAGL

SEQ ID NO: 1080033 - protein, 24 aa, Mycobacterium
TAWATQLRIMQSQLLAKIAAAVGN

SEQ ID NO: 1080034 - protein, 20 aa, Mycobacterium
TAWSAEGLVRYLPARAQDLL

SEQ ID NO: 1080035 - protein, 19 aa, Mycobacterium
TAWVYIDHRITPGPPRPEY

SEQ ID NO: 1080036 - protein, 25 aa, Mycobacterium
TAYEDRPTLVLPGSGKTITGTAVND

SEQ ID NO: 1080037 - protein, 32 aa, Mycobacterium
TCATSFCWWHRGARRPFWARPAKSARPWAPPT

SEQ ID NO: 1080038 - protein, 18 aa, Mycobacterium
TCCRALGIAVYDRKRPAD

SEQ ID NO: 1080039 - protein, 17 aa, Mycobacterium
TCHGRVRRLVDLGVIRG

SEQ ID NO: 1080040 - protein, 21 aa, Mycobacterium
TCYEWAILDLAILAVGAVTVP

SEQ ID NO: 1080041 - protein, 23 aa, Mycobacterium
TDAAIVVVRILGGYRAWEDGIEA

SEQ ID NO: 1080042 - protein, 25 aa, Mycobacterium
TDAILTCRLIDRPLRPSFVNGLRNE

SEQ ID NO: 1080043 - protein, 20 aa, Mycobacterium
TDALKFIDGNPYGASLVATH

SEQ ID NO: 1080044 - protein, 19 aa, Mycobacterium
TDAYARLVAMRLVASRASD

SEQ ID NO: 1080045 - protein, 19 aa, Mycobacterium
TDDGRLLARIYSESDLLVA

SEQ ID NO: 1080046 - protein, 25 aa, Mycobacterium
TDDRYYMLPMLDMWTDVFANPGKRT

SEQ ID NO: 1080047 - protein, 18 aa, Mycobacterium
TDEDLPEFYGYPAKLSST

SEQ ID NO: 1080048 - protein, 30 aa, Mycobacterium
TDEISTTIATLFCGYARDYQNLSTQLASFH

SEQ ID NO: 1080049 - protein, 31 aa, Mycobacterium
TDEISTTIATLFCGYARDYQNLSTQLASFHQ

SEQ ID NO: 1080050 - protein, 17 aa, Mycobacterium
TDELFHRHPERSEGDLA

SEQ ID NO: 1080051 - protein, 19 aa, Mycobacterium
TDEPLWSESWYADFVDAAE

SEQ ID NO: 1080052 - protein, 24 aa, Mycobacterium
TDEVVDVVLLWWRDSDGDLVDTLM

SEQ ID NO: 1080053 - protein, 23 aa, Mycobacterium
TDFGAFVALLPGRDGLVHISKLG

SEQ ID NO: 1080054 - protein, 17 aa, Mycobacterium
TDFGIARIAGGFQTSTG

SEQ ID NO: 1080055 - protein, 20 aa, Mycobacterium
TDFQRLQRELSGASPDTSDQ

SEQ ID NO: 1080056 - protein, 25 aa, Mycobacterium
TDGANWANWAKPIVMQSSWARQGDP

SEQ ID NO: 1080057 - protein, 22 aa, Mycobacterium
TDGGSTFGGQLGGAGGAGGDGG

SEQ ID NO: 1080058 - protein, 25 aa, Mycobacterium
TDGMEALLPVLRPDDHALLTDQLAE

SEQ ID NO: 1080059 - protein, 26 aa, Mycobacterium
TDGMRRLFRQFSFPGGIPSHVAAQTP

SEQ ID NO: 1080060 - protein, 34 aa, Mycobacterium
TDGREFFGLLIRICLGIAAWLRGAFATAGPQIQC

SEQ ID NO: 1080061 - protein, 23 aa, Mycobacterium
TDGRWSCVRWGTKTPPFCAEVDS

SEQ ID NO: 1080062 - protein, 23 aa, Mycobacterium
TDGTPGGWLLGDGGAGGSGGTGL

SEQ ID NO: 1080063 - protein, 20 aa, Mycobacterium
TDHELYLHPTGRLSEIAPPD

SEQ ID NO: 1080064 - protein, 20 aa, Mycobacterium
TDIPVRTYWPTVEPDWVLPV

SEQ ID NO: 1080065 - protein, 18 aa, Mycobacterium
TDKTVDLLLACHLAGCGY

SEQ ID NO: 1080066 - protein, 17 aa, Mycobacterium
TDLAGIGAALQSANGAA

SEQ ID NO: 1080067 - protein, 18 aa, Mycobacterium
TDLKLRALAWGDTTVRIA

SEQ ID NO: 1080068 - protein, 27 aa, Mycobacterium
TDNQTLAHLLKFDSILGRLPQDVSLEG

SEQ ID NO: 1080069 - protein, 23 aa, Mycobacterium
TDPGRFDVIVTDNLFGDIITDLA

SEQ ID NO: 1080070 - protein, 25 aa, Mycobacterium
TDPRSRVPALPRLDPADPLPRCRQT

SEQ ID NO: 1080071 - protein, 34 aa, Mycobacterium; identical to SEQ ID NO: 865176

SEQ ID NO: 1080072 - protein, 23 aa, Mycobacterium
TDQASWAPIGRPIANARLYIVDT

SEQ ID NO: 1080073 - protein, 17 aa, Mycobacterium
TDQIRWLFGKLLAEKPG

SEQ ID NO: 1080074 - protein, 31 aa, Mycobacterium
TDRMRVGILLLNAPWWNPALLARDIATTDVL

SEQ ID NO: 1080075 - protein, 23 aa, Mycobacterium
TDRNRMIAEPYPRLLVARDQVNQ

SEQ ID NO: 1080076 - protein, 25 aa, Mycobacterium
TDRRGLFTALAAQGFMLLAEALREA

SEQ ID NO: 1080077 - protein, 23 aa, Mycobacterium
TDRSWLDGWLLRACHGAPLCANS

SEQ ID NO: 1080078 - protein, 17 aa, Mycobacterium
TDRWLRDFFGPAAASDW

SEQ ID NO: 1080079 - protein, 23 aa, Mycobacterium
TDSPLRALILRVVDDRVVLGLNY

SEQ ID NO: 1080080 - protein, 21 aa, Mycobacterium
TDSQYLRVRAELRRLAGADGI

SEQ ID NO: 1080081 - protein, 24 aa, Mycobacterium
TDSRRKVRFLPYGIAVSVLDDSSG

SEQ ID NO: 1080082 - protein, 29 aa, Mycobacterium
TDTAGFNVPYYWWTLNMPTDHGEVELTNV

SEQ ID NO: 1080083 - protein, 22 aa, Mycobacterium
TDTELLDFNALAKIFGYPSTTE

SEQ ID NO: 1080084 - protein, 18 aa, Mycobacterium
TDVGALVAFLLSSDASFI

SEQ ID NO: 1080085 - protein, 23 aa, Mycobacterium
TDVIVYRGIALTSFYQCGDLYRV

SEQ ID NO: 1080086 - protein, 18 aa, Mycobacterium
TDWAPTSAEFRKLLAEWK

SEQ ID NO: 1080087 - protein, 20 aa, Mycobacterium
TDYDTADRLYFEPLTFEDVL

SEQ ID NO: 1080088 - protein, 19 aa, Mycobacterium
TDYLILEMSARHPGNIAAL

SEQ ID NO: 1080089 - protein, 18 aa, Mycobacterium
TEALLKRIESAAASVDRV

SEQ ID NO: 1080090 - protein, 24 aa, Mycobacterium
TEANVVNFRRQLGRLGLGHDSRRS

SEQ ID NO: 1080091 - protein, 23 aa, Mycobacterium
TEARLIAWRPSELGKTPPGHLWR

SEQ ID NO: 1080092 - protein, 20 aa, Mycobacterium
TEATVPWLVSARSRAALAGQ

SEQ ID NO: 1080093 - protein, 24 aa, Mycobacterium
TEAVAEIIELVEKLLASGAAYVLD

SEQ ID NO: 1080094 - protein, 24 aa, Mycobacterium
TEAVSAMQERLPFFADLEASQRAS

SEQ ID NO: 1080095 - protein, 19 aa, Mycobacterium
TEDSWLRSLVMSGARERYG

SEQ ID NO: 1080096 - protein, 25 aa, Mycobacterium
TEDVDGYIRVYPQIKDLIATLQAHG

SEQ ID NO: 1080097 - protein, 24 aa, Mycobacterium
TEDYWSLRPRGSQLGAWASHQSQP

SEQ ID NO: 1080098 - protein, 23 aa, Mycobacterium
TEEIKAEVLERLADTYEGREKEI

SEQ ID NO: 1080099 - protein, 17 aa, Mycobacterium
TEELRVLGLHLLHLLQT

SEQ ID NO: 1080100 - protein, 25 aa, Mycobacterium
TEESRLRAMCEARRLPAVRIGVVDQ

SEQ ID NO: 1080101 - protein, 24 aa, Mycobacterium
TEFELLRFLMRNPRRALSRTEILD

SEQ ID NO: 1080102 - protein, 23 aa, Mycobacterium
TEFNDIVAVLALYRPGPMGMNAH

SEQ ID NO: 1080103 - protein, 26 aa, Mycobacterium
TEFVVSPLKWMQILTERRATITAAPN

SEQ ID NO: 1080104 - protein, 33 aa, Mycobacterium; identical to SEQ ID NO: 865408

SEQ ID NO: 1080105 - protein, 30 aa, Mycobacterium; identical to SEQ ID NO: 865410

SEQ ID NO: 1080106 - protein, 26 aa, Mycobacterium
TEGPANPLILVFGRVSELSTCSWSTP

SEQ ID NO: 1080107 - protein, 25 aa, Mycobacterium
TEHLAVLGNPTWYARFAAQAMTDPA

SEQ ID NO: 1080108 - protein, 18 aa, Mycobacterium
TEHLIEAATYWSKTADQW

SEQ ID NO: 1080109 - protein, 28 aa, Mycobacterium
TEHPYHEPLWVPLITAYYVAQRQFDALN

SEQ ID NO: 1080110 - protein, 25 aa, Mycobacterium
TEIADQLARRRLGYGRGARMAFERD

SEQ ID NO: 1080111 - protein, 25 aa, Mycobacterium
TEIGRLVPFVEWLRDAYPEQVISVD

SEQ ID NO: 1080112 - protein, 18 aa, Mycobacterium
TEIILNLKGLVVSSEEDE

SEQ ID NO: 1080113 - protein, 31 aa, Mycobacterium
TEIRYPLNLIHLATVMWFDGPALGNELAIMQ

SEQ ID NO: 1080114 - protein, 27 aa, Mycobacterium
TELDRIFEIYPTLAGALRPGKPGEHDL

SEQ ID NO: 1080115 - protein, 29 aa, Mycobacterium
TELEPDFQRAYKELARHVQLPGFRPGKVP

SEQ ID NO: 1080116 - protein, 20 aa, Mycobacterium
TELFPLLLSVMSTGATFVRS

SEQ ID NO: 1080117 - protein, 23 aa, Mycobacterium
TELGYPELVAPLTFLAIAGRRVQ

SEQ ID NO: 1080118 - protein, 17 aa, Mycobacterium
TELRRQLKPLGRQAEVA

SEQ ID NO: 1080119 - protein, 23 aa, Mycobacterium
TELRVRCVRQLRDAMREHIEELR

SEQ ID NO: 1080120 - protein, 19 aa, Mycobacterium
TEMRSAALHFVFCELGAQA

SEQ ID NO: 1080121 - protein, 28 aa, Mycobacterium
TENYAILNDFPLFWDPQLLEHNLHLPRF

SEQ ID NO: 1080122 - protein, 30 aa, Mycobacterium
TEPDGLIMETAFLPIFASLPKPTPEQEVQW

SEQ ID NO: 1080123 - protein, 25 aa, Mycobacterium
TEPGDYIFVPPYLPHREENPDPTMP

SEQ ID NO: 1080124 - protein, 24 aa, Mycobacterium
TEPGHQLALTALALDPVVDLRMRL

SEQ ID NO: 1080125 - protein, 24 aa, Mycobacterium
TEPKARALRPYAEKLITHAKKGAL

SEQ ID NO: 1080126 - protein, 18 aa, Mycobacterium
TEPPPPTTAPPAAPLIPP

SEQ ID NO: 1080127 - protein, 30 aa, Mycobacterium
TEPWRGEPLLNYLRKMVFWAEVTPDTADLA

SEQ ID NO: 1080128 - protein, 24 aa, Mycobacterium
TEQEWLVHWPSGSAGADVAPEPVV

SEQ ID NO: 1080129 - protein, 21 aa, Mycobacterium
TEQFRTFLAKQPDLGPKQVTS

SEQ ID NO: 1080130 - protein, 26 aa, Mycobacterium
TEQLDFLRLAVLDALLVLLADTEPVP

SEQ ID NO: 1080131 - protein, 18 aa, Mycobacterium
TERRARRLARALHQWGFG

SEQ ID NO: 1080132 - protein, 30 aa, Mycobacterium
TERTDALILGPLRIHFWVCGVFEVHDGRIT

SEQ ID NO: 1080133 - protein, 26 aa, Mycobacterium
TESGFPPRIWDMLLERFGREVDRRLG

SEQ ID NO: 1080134 - protein, 24 aa, Mycobacterium
TETAIDALYWRADITDQASWAPIG

SEQ ID NO: 1080135 - protein, 25 aa, Mycobacterium
TETEQAFLVRLLSGELRQGALAGIM

SEQ ID NO: 1080136 - protein, 22 aa, Mycobacterium
TETGFATLWRAAGRRRRWLVAA

SEQ ID NO: 1080137 - protein, 20 aa, Mycobacterium
TETWPPPGVVYRKFALRADG

SEQ ID NO: 1080138 - protein, 22 aa, Mycobacterium
TEVAKLGRPLKTIVLTACNDLA

SEQ ID NO: 1080139 - protein, 23 aa, Mycobacterium
TEVAWVPIPELPSRLAYADERRL

SEQ ID NO: 1080140 - protein, 35 aa, Mycobacterium
TEVLIMDYLMHQRRLFPLIARSYALQFAQNELVSK

SEQ ID NO: 1080141 - protein, 17 aa, Mycobacterium
TEVWFPAGPVGTASVLA

SEQ ID NO: 1080142 - protein, 17 aa, Mycobacterium
TEWLKLALDEPHLLQSL

SEQ ID NO: 1080143 - protein, 17 aa, Mycobacterium
TEYRRCHYVGAGRPRER

SEQ ID NO: 1080144 - protein, 27 aa, Mycobacterium
TFAGATRGGWWAGVARDGKIGALVSDK

SEQ ID NO: 1080145 - protein, 19 aa, Mycobacterium
TFATWRERRRLIKVLRKRG

SEQ ID NO: 1080146 - protein, 19 aa, Mycobacterium
TFFERLQQTHDKRMSELGL

SEQ ID NO: 1080147 - protein, 17 aa, Mycobacterium
TFGLFAREPRRGSSPAT

SEQ ID NO: 1080148 - protein, 24 aa, Mycobacterium
TFGPIGELWYRKSGTYRGKVQNLT

SEQ ID NO: 1080149 - protein, 18 aa, Mycobacterium
TFGPLFGHIPNLVTMRGD

SEQ ID NO: 1080150 - protein, 18 aa, Mycobacterium
TFGVKRVVARIYDAKRAE

SEQ ID NO: 1080151 - protein, 19 aa, Mycobacterium
TFHAEFVQLLNSGASAYTG

SEQ ID NO: 1080152 - protein, 22 aa, Mycobacterium
TFHGLLLLRHVDELVKTGWPVL

SEQ ID NO: 1080153 - protein, 24 aa, Mycobacterium
TFHSTCVRILRNQAALIKGLNSNF

SEQ ID NO: 1080154 - protein, 18 aa, Mycobacterium
TFHTSRWDYGYTGQGLQN

SEQ ID NO: 1080155 - protein, 23 aa, Mycobacterium
TFLNTDLAVHVFRIPAGDWIGIR

SEQ ID NO: 1080156 - protein, 19 aa, Mycobacterium
TFMRLLLAAETPTSGDVRV

SEQ ID NO: 1080157 - protein, 19 aa, Mycobacterium
TFPLLSDPDRKVLAAYGAY

SEQ ID NO: 1080158 - protein, 24 aa, Mycobacterium
TFPLTIDALGIPTTLNLPMDGILV

SEQ ID NO: 1080159 - protein, 22 aa, Mycobacterium
TFQMWARPRGVAPDALFALMCG

SEQ ID NO: 1080160 - protein, 25 aa, Mycobacterium
TFRDHYLDLDLDLSDVVFLATANVI

SEQ ID NO: 1080161 - protein, 26 aa, Mycobacterium
TFRYNEVIHYWALEGGWECFANHYPS

SEQ ID NO: 1080162 - protein, 19 aa, Mycobacterium
TFSGLLQRFGRGKGCDICK

SEQ ID NO: 1080163 - protein, 22 aa, Mycobacterium
TFSKDPVFRERMKREARITGRL

SEQ ID NO: 1080164 - protein, 26 aa, Mycobacterium
TFSNLLYDIYGFDVPVGVILGPATDL

SEQ ID NO: 1080165 - protein, 20 aa, Mycobacterium
TFTGRLPQRFADRAPRVVET

SEQ ID NO: 1080166 - protein, 23 aa, Mycobacterium
TFTICSFWLVSALVEIGEVAQAK

SEQ ID NO: 1080167 - protein, 18 aa, Mycobacterium
TFTIVTFAAPGIPTPFIA

SEQ ID NO: 1080168 - protein, 19 aa, Mycobacterium
TFVPWLSTVVNVAVNDSWG

SEQ ID NO: 1080169 - protein, 23 aa, Mycobacterium
TFVRPSPRNVLWHLTAWLATGVA

SEQ ID NO: 1080170 - protein, 20 aa, Mycobacterium
TFYEWVLGPSMTYTCAVYPN

SEQ ID NO: 1080171 - protein, 20 aa, Mycobacterium
TGAALIWPAGWSVWPERVYG

SEQ ID NO: 1080172 - protein, 25 aa, Mycobacterium
TGADVSIIFVPPKFAKDAIIEAIDA

SEQ ID NO: 1080173 - protein, 33 aa, Mycobacterium
TGAFWHVDYIFMPEPFAFSMTLPLAMPGHDRGT

SEQ ID NO: 1080174 - protein, 29 aa, Mycobacterium
TGAGGISGLLLGLDGFNAPASTSALHNLQ

SEQ ID NO: 1080175 - protein, 25 aa, Mycobacterium
TGAIKGGPLLLYNSLRRPVVTARSA

SEQ ID NO: 1080176 - protein, 32 aa, Mycobacterium; identical to SEQ ID NO: 117833

SEQ ID NO: 1080177 - protein, 29 aa, Mycobacterium
TGATQPVELPFTGLNFPAGVAVDLNGNIY

SEQ ID NO: 1080178 - protein, 25 aa, Mycobacterium
TGATVALPVLRAAVAALSSMATFAE

SEQ ID NO: 1080179 - protein, 32 aa, Mycobacterium
TGCSSWYLNDDWVPEVWPFAPAEHRAMLANPD

SEQ ID NO: 1080180 - protein, 28 aa, Mycobacterium
TGDPEAFMALAARFLGPALTGVQPVRPS

SEQ ID NO: 1080181 - protein, 22 aa, Mycobacterium
TGDYLAELTMLILGRDRMKNPE

SEQ ID NO: 1080182 - protein, 20 aa, Mycobacterium
TGEIMIFVGTDFVITVRHGE

SEQ ID NO: 1080183 - protein, 21 aa, Mycobacterium
TGEPIWSSWYAGRPVLVTAND

SEQ ID NO: 1080184 - protein, 20 aa, Mycobacterium
TGERTLLAGDFVRGFVGLDS

SEQ ID NO: 1080185 - protein, 21 aa, Mycobacterium
TGFDALYDPVAPQVLLSLIDS

SEQ ID NO: 1080186 - protein, 42 aa, Mycobacterium
TGFNDIGLLINFPASQLLKFAPHPGLGPLPKDALGGGLGLAP

SEQ ID NO: 1080187 - protein, 23 aa, Mycobacterium
TGGAGGWLFGDGGIGGTGGAGAT

SEQ ID NO: 1080188 - protein, 25 aa, Mycobacterium
TGGGGLLLPLGVRSLRAYGPTRNAQ

SEQ ID NO: 1080189 - protein, 26 aa, Mycobacterium
TGGIGGHGGFFNGNGGTGGAGGFGPT

SEQ ID NO: 1080190 - protein, 17 aa, Mycobacterium
TGGLGGLAGLAGRIVDA

SEQ ID NO: 1080191 - protein, 23 aa, Mycobacterium
TGGLLFGNGGAGGGAPWGGADGG

SEQ ID NO: 1080192 - protein, 18 aa, Mycobacterium
TGGLLLGNGGAGGARRAG

SEQ ID NO: 1080193 - protein, 22 aa, Mycobacterium
TGGNAMLFGNGGAGGMGGAGAD

SEQ ID NO: 1080194 - protein, 25 aa, Mycobacterium
TGGNGGLGGLLYGSGGAGGTGGAGA

SEQ ID NO: 1080195 - protein, 25 aa, Mycobacterium
TGGNHAFYLAIPPKSFPVVCGQLHK

SEQ ID NO: 1080196 - protein, 25 aa, Mycobacterium
TGGTGGIGFNGSTTIGGGNGGDGHT

SEQ ID NO: 1080197 - protein, 25 aa, Mycobacterium
TGHAAVAGLTTLTALAAGAGSAAVI

SEQ ID NO: 1080198 - protein, 25 aa, Mycobacterium
TGHEGAEARYLWPSVFTQVADEYDR

SEQ ID NO: 1080199 - protein, 24 aa, Mycobacterium
TGHGSFVVPFFRKVRFITLAMCEP

SEQ ID NO: 1080200 - protein, 18 aa, Mycobacterium
TGHKWFTSAPMCDIFLVL

SEQ ID NO: 1080201 - protein, 17 aa, Mycobacterium
TGHPFLQHLLAHRDVTR

SEQ ID NO: 1080202 - protein, 20 aa, Mycobacterium
TGIALAMVSAARGYKCVLTM

SEQ ID NO: 1080203 - protein, 26 aa, Mycobacterium
TGIDDALALIYLLASTDADLVGIAST

SEQ ID NO: 1080204 - protein, 21 aa, Mycobacterium
TGIGMWALRYPESHNLYILDR

SEQ ID NO: 1080205 - protein, 29 aa, Mycobacterium
TGIWSLLAPAYDLAILQQWVYRPPHDEVL

SEQ ID NO: 1080206 - protein, 25 aa, Mycobacterium
TGKSVFLKSLIGLLRPERGSILIDG

SEQ ID NO: 1080207 - protein, 24 aa, Mycobacterium
TGKTAAFAIPILSKIDTTSTATQA

SEQ ID NO: 1080208 - protein, 20 aa, Mycobacterium
TGLSVLRYAIRTDIRLITSE

SEQ ID NO: 1080209 - protein, 19 aa, Mycobacterium
TGLVMRRLVDYRLSPLLAS

SEQ ID NO: 1080210 - protein, 20 aa, Mycobacterium
TGMYFWLDYADGMQPYFSVP

SEQ ID NO: 1080211 - protein, 27 aa, Mycobacterium
TGNPAPELLPLAAVGWPDGSVLPLLYG

SEQ ID NO: 1080212 - protein, 37 aa, Mycobacterium; identical to SEQ ID NO: 866163

SEQ ID NO: 1080213 - protein, 27 aa, Mycobacterium
TGPFHNRRALLDVPRLGPKAFEQCAGF

SEQ ID NO: 1080214 - protein, 19 aa, Mycobacterium
TGPIHIGGTRWAAVGDALG

SEQ ID NO: 1080215 - protein, 26 aa, Mycobacterium
TGPVEGWMPFGRVFETLAWGRRHVVM

SEQ ID NO: 1080216 - protein, 17 aa, Mycobacterium
TGPYRWWTAVGPRLSMV

SEQ ID NO: 1080217 - protein, 24 aa, Mycobacterium
TGQAGAVGGILWGNGGSGGSGAAG

SEQ ID NO: 1080218 - protein, 24 aa, Mycobacterium
TGQAGGPGGWLWGDGGDGGSGTPG

SEQ ID NO: 1080219 - protein, 33 aa, Mycobacterium; identical to SEQ ID NO: 866195

SEQ ID NO: 1080220 - protein, 25 aa, Mycobacterium
TGQVRRWRSALLPETRTRAVLMIAI

SEQ ID NO: 1080221 - protein, 28 aa, Mycobacterium
TGRFDDEQLFYLRSRGIPEEQARRLVIR

SEQ ID NO: 1080222 - protein, 24 aa, Mycobacterium
TGRHFKRLWGLPGTQLGVVSWPSE

SEQ ID NO: 1080223 - protein, 38 aa, Mycobacterium
TGRLSLSAQPWLADHAVLGVMLFPGTGFLELVIRAGDV

SEQ ID NO: 1080224 - protein, 22 aa, Mycobacterium
TGRPFLVMPYHQNDSLEALVRR

SEQ ID NO: 1080225 - protein, 17 aa, Mycobacterium
TGRPYLVEGVGEDFWPA

SEQ ID NO: 1080226 - protein, 26 aa, Mycobacterium
TGRRRPIPGLHWPWVARIGTVVMSWR

SEQ ID NO: 1080227 - protein, 24 aa, Mycobacterium
TGRVTPFAFMTPVKVAGSTVAQAT

SEQ ID NO: 1080228 - protein, 19 aa, Mycobacterium
TGSARFRNLIKAEDYDTAL

SEQ ID NO: 1080229 - protein, 17 aa, Mycobacterium
TGSNMSGVFSLEELLKQ

SEQ ID NO: 1080230 - protein, 18 aa, Mycobacterium
TGSRRQRTAYLKIDYRNI

SEQ ID NO: 1080231 - protein, 28 aa, Mycobacterium
TGSVLGMPFYLMRAIDGWSPMDGGWPAP

SEQ ID NO: 1080232 - protein, 26 aa, Mycobacterium
TGTGGLPMMPMMGGIPSMGGMGSASK

SEQ ID NO: 1080233 - protein, 25 aa, Mycobacterium
TGTGKSLAYLIPAVVRALDDNAPVV

SEQ ID NO: 1080234 - protein, 23 aa, Mycobacterium
TGTLTLRYRRGTVLGRPLRAEGR

SEQ ID NO: 1080235 - protein, 17 aa, Mycobacterium
TGTRPLREWLAALTDGI

SEQ ID NO: 1080236 - protein, 22 aa, Mycobacterium
TGTTGIPASPLRSSPAGTESKR

SEQ ID NO: 1080237 - protein, 25 aa, Mycobacterium
TGTVGDLLPILGIPGQMAQNFTNLL

SEQ ID NO: 1080238 - protein, 27 aa, Mycobacterium
TGTVVYRFTWHLPKNRTWTYDGQLKMA

SEQ ID NO: 1080239 - protein, 19 aa, Mycobacterium
TGTVYRVIGSKDKLLASIM

SEQ ID NO: 1080240 - protein, 29 aa, Mycobacterium
TGVDPGFINDLLPFALAGTCQRIEQVRCM

SEQ ID NO: 1080241 - protein, 20 aa, Mycobacterium
TGVFVGVFPARMGDRAGCPA

SEQ ID NO: 1080242 - protein, 22 aa, Mycobacterium
TGVGFPTDPGLSFGGQGGAGGR

SEQ ID NO: 1080243 - protein, 21 aa, Mycobacterium
TGVPFFDHMLTALGSHASFDL

SEQ ID NO: 1080244 - protein, 17 aa, Mycobacterium
TGVRFPTWTGKSGFAMR

SEQ ID NO: 1080245 - protein, 39 aa, Mycobacterium
TGWGHRYPAAIRLWRNAWNEFIPFLDYDTEIRKVICSTN

SEQ ID NO: 1080246 - protein, 19 aa, Mycobacterium
TGWRLHGHTSRWIQIAAEW

SEQ ID NO: 1080247 - protein, 22 aa, Mycobacterium
TGYGIHPALLDAALHPMAAALG

SEQ ID NO: 1080248 - protein, 17 aa, Mycobacterium
TGYSHAELADRLNVALA

SEQ ID NO: 1080249 - protein, 19 aa, Mycobacterium
THAALVATNFFLDSTPSPS

SEQ ID NO: 1080250 - protein, 21 aa, Mycobacterium
THAAMYQMVSAKAAAIHEHFA

SEQ ID NO: 1080251 - protein, 20 aa, Mycobacterium
THDWRGLMAHIGLPTLVLAG

SEQ ID NO: 1080252 - protein, 18 aa, Mycobacterium
THEVDMTRIVALRARAKG

SEQ ID NO: 1080253 - protein, 25 aa, Mycobacterium
THFFDEYFVFAGIRQVVILSGVAVY

SEQ ID NO: 1080254 - protein, 23 aa, Mycobacterium
THGGQLCLPFYGALVTNCGLDRT

SEQ ID NO: 1080255 - protein, 19 aa, Mycobacterium
THGLSWGFDRIFAASANHS

SEQ ID NO: 1080256 - protein, 25 aa, Mycobacterium
THGRRTQLELGGKAPFVVFDDADLD

SEQ ID NO: 1080257 - protein, 19 aa, Mycobacterium
THGTVIPKQIGVTTSTPGT

SEQ ID NO: 1080258 - protein, 32 aa, Mycobacterium; identical to SEQ ID NO: 866450

SEQ ID NO: 1080259 - protein, 23 aa, Mycobacterium
THLPDVALLDYRMPRMDGAQVAA

SEQ ID NO: 1080260 - protein, 24 aa, Mycobacterium
THMADWICFMLSDSADFLCGSVVF

SEQ ID NO: 1080261 - protein, 19 aa, Mycobacterium
THPIVAIDRRGMGMSSPID

SEQ ID NO: 1080262 - protein, 17 aa, Mycobacterium
THPKALAAFTKAGGRVV

SEQ ID NO: 1080263 - protein, 27 aa, Mycobacterium
THPLWIVRRTMVDLIRPIEFQDMLRCR

SEQ ID NO: 1080264 - protein, 17 aa, Mycobacterium
THRWFGAYGVTKSAVDH

SEQ ID NO: 1080265 - protein, 25 aa, Mycobacterium
THSHRIPDFVKLAEALGCVGLRCER

SEQ ID NO: 1080266 - protein, 28 aa, Mycobacterium
THSNALDIDLYLRIAPELFLKRCIVGGF

SEQ ID NO: 1080267 - protein, 26 aa, Mycobacterium
THVETLLLPTLHPDERLAASLLAKGL

SEQ ID NO: 1080268 - protein, 18 aa, Mycobacterium
THVLNVLHLLLPAGEEFF

SEQ ID NO: 1080269 - protein, 17 aa, Mycobacterium
THWAFADRLAREFPAVD

SEQ ID NO: 1080270 - protein, 26 aa, Mycobacterium
TIADLAWLRARGLDRALMAHVAAGKP

SEQ ID NO: 1080271 - protein, 24 aa, Mycobacterium
TIAITDHRLLVKIPAGWSDTAAAT

SEQ ID NO: 1080272 - protein, 24 aa, Mycobacterium
TIAQVAIGLLRQQLAPGQMTHGIV

SEQ ID NO: 1080273 - protein, 19 aa, Mycobacterium
TIAVLYYRAQHLAGNTAYV

SEQ ID NO: 1080274 - protein, 18 aa, Mycobacterium
TIAWLQQDIGEELRKLDA

SEQ ID NO: 1080275 - protein, 24 aa, Mycobacterium
TIDDHQNSRWIAEPLRLLDCCQET

SEQ ID NO: 1080276 - protein, 26 aa, Mycobacterium
TIDVAYRYFATPKRKFIIADTPGHIQ

SEQ ID NO: 1080277 - protein, 20 aa, Mycobacterium
TIEIHQPTFSRKAARRRAVE

SEQ ID NO: 1080278 - protein, 19 aa, Mycobacterium
TIEINLDLKRLGIENQLVV

SEQ ID NO: 1080279 - protein, 24 aa, Mycobacterium
TIFEHLGRLLIIDCGVLSPGHDEP

SEQ ID NO: 1080280 - protein, 19 aa, Mycobacterium
TIFTEVIVAPAYAPAALDQ

SEQ ID NO: 1080281 - protein, 27 aa, Mycobacterium
TIGVISWTQEGFFGRMLATIRPYRPSL

SEQ ID NO: 1080282 - protein, 25 aa, Mycobacterium
TIKQADSVLLQYPLEWPMSREAATN

SEQ ID NO: 1080283 - protein, 17 aa, Mycobacterium
TILRPQTGGQKRVTASG

SEQ ID NO: 1080284 - protein, 17 aa, Mycobacterium
TIPIPGELNRFVFAMPE

SEQ ID NO: 1080285 - protein, 32 aa, Mycobacterium
TIPVRELRRSGMLDKLLLLAGQDERPAPDAAV

SEQ ID NO: 1080286 - protein, 19 aa, Mycobacterium
TIRIDGLQFTRLAGGRPKS

SEQ ID NO: 1080287 - protein, 30 aa, Mycobacterium; identical to SEQ ID NO: 866700

SEQ ID NO: 1080288 - protein, 20 aa, Mycobacterium
TISSLPYHRVAVPVWSTGPE

SEQ ID NO: 1080289 - protein, 20 aa, Mycobacterium
TISVLEGRLAAWAVELDAAA

SEQ ID NO: 1080290 - protein, 27 aa, Mycobacterium
TITEVYDYLRLLYARAGTPHCPTCGER

SEQ ID NO: 1080291 - protein, 27 aa, Mycobacterium
TITLEDALKLLSLPRVVGTDPASGEEI

SEQ ID NO: 1080292 - protein, 26 aa, Mycobacterium
TIVDLTVIGLGRYIPRIARIAAATDL

SEQ ID NO: 1080293 - protein, 18 aa, Mycobacterium
TIVFCGVHFMAETAKILS

SEQ ID NO: 1080294 - protein, 19 aa, Mycobacterium
TIWTQCQSYFRSPSGRIVT

SEQ ID NO: 1080295 - protein, 17 aa, Mycobacterium
TIYRLYEALQVYGGAIK

SEQ ID NO: 1080296 - protein, 19 aa, Mycobacterium
TIYSFTGASPRFLLDFSRR

SEQ ID NO: 1080297 - protein, 30 aa, Mycobacterium
TKADSIVIGGGMCFTFLAAQGYSVGTSLLE

SEQ ID NO: 1080298 - protein, 23 aa, Mycobacterium
TKAKELGLTPLARIVSTGVSGLS

SEQ ID NO: 1080299 - protein, 23 aa, Mycobacterium
TKDVDLGWYTLPKGSLGGNYLKY

SEQ ID NO: 1080300 - protein, 27 aa, Mycobacterium
TKGLDRGHLSFHLHGQKLRGGYALTRI

SEQ ID NO: 1080301 - protein, 21 aa, Mycobacterium
TKGSFYWHFADMEGYRHALVE

SEQ ID NO: 1080302 - protein, 24 aa, Mycobacterium
TKHDVPMGQFRWITVVSPEDPDGT

SEQ ID NO: 1080303 - protein, 20 aa, Mycobacterium
TKKLPYSLKVLAENLLRNED

SEQ ID NO: 1080304 - protein, 19 aa, Mycobacterium
TKLPALIRQCGDLLTELVP

SEQ ID NO: 1080305 - protein, 20 aa, Mycobacterium
TKMGPALWRLLTFPVVAMLM

SEQ ID NO: 1080306 - protein, 34 aa, Mycobacterium; identical to SEQ ID NO: 866831

SEQ ID NO: 1080307 - protein, 21 aa, Mycobacterium
TKVAPAYRSSVSLSISASAAT

SEQ ID NO: 1080308 - protein, 17 aa, Mycobacterium
TKVLNRYSGRTLRFAAA

SEQ ID NO: 1080309 - protein, 24 aa, Mycobacterium
TLAALIARHRVNLIAIGNGTASRE

SEQ ID NO: 1080310 - protein, 17 aa, Mycobacterium
TLAALTLNLPTRNGRYL

SEQ ID NO: 1080311 - protein, 28 aa, Mycobacterium
TLAGARDFQRFLIGKLRDIREVVATASL

SEQ ID NO: 1080312 - protein, 19 aa, Mycobacterium
TLALIALSAKMRLDQIEQL

SEQ ID NO: 1080313 - protein, 19 aa, Mycobacterium
TLAMLQQLVADGSLWPVNG

SEQ ID NO: 1080314 - protein, 24 aa, Mycobacterium
TLAQWRFRQTRWPSSVSGAGFRVG

SEQ ID NO: 1080315 - protein, 26 aa, Mycobacterium
TLASDGSILDTWFPAPELTESGTSAT

SEQ ID NO: 1080316 - protein, 19 aa, Mycobacterium
TLCRQGQLLSWGLPATHAL

SEQ ID NO: 1080317 - protein, 25 aa, Mycobacterium
TLDAIWDDVVDRIRWLEAETGRTFG

SEQ ID NO: 1080318 - protein, 27 aa, Mycobacterium
TLDALISLVLDWKRPVKVFIETKHPVR

SEQ ID NO: 1080319 - protein, 18 aa, Mycobacterium
TLDFAGLAEALKPKSRNS

SEQ ID NO: 1080320 - protein, 25 aa, Mycobacterium
TLDKLLDMALGACDKLFVAQRDALA

SEQ ID NO: 1080321 - protein, 18 aa, Mycobacterium
TLDPNRISVLFNGSAVCI

SEQ ID NO: 1080322 - protein, 18 aa, Mycobacterium
TLDRLQTHYAGRPSPLYE

SEQ ID NO: 1080323 - protein, 29 aa, Mycobacterium
TLDSPEKEFLAPRVRALWGGKPGRPLAWH

SEQ ID NO: 1080324 - protein, 28 aa, Mycobacterium
TLDYPRGNLAFRWFLADGVPARPEVKLV

SEQ ID NO: 1080325 - protein, 33 aa, Mycobacterium; identical to SEQ ID NO: 117916

SEQ ID NO: 1080326 - protein, 26 aa, Mycobacterium
TLEHPEIWCAIIDFDNSVPAQVVARQ

SEQ ID NO: 1080327 - protein, 22 aa, Mycobacterium
TLEVLPVTEFGLRDAADGFRLM

SEQ ID NO: 1080328 - protein, 19 aa, Mycobacterium
TLFELMDVTKRTGIELTES

SEQ ID NO: 1080329 - protein, 19 aa, Mycobacterium
TLFGTYGQTYQALAAQASG

SEQ ID NO: 1080330 - protein, 18 aa, Mycobacterium
TLGCWKIGAVPIPMHWDL

SEQ ID NO: 1080331 - protein, 25 aa, Mycobacterium
TLGDTPLVGLPRLSPGWDNSPHVRL

SEQ ID NO: 1080332 - protein, 26 aa, Mycobacterium
TLGTALARLGMFAPALSYLEEPDGPV

SEQ ID NO: 1080333 - protein, 22 aa, Mycobacterium
TLGVITALDLRLHPTPSHRLTA

SEQ ID NO: 1080334 - protein, 18 aa, Mycobacterium
TLHRPVSALLADPEVPVF

SEQ ID NO: 1080335 - protein, 18 aa, Mycobacterium
TLHTALMRSCTGWPSRVW

SEQ ID NO: 1080336 - protein, 26 aa, Mycobacterium
TLIALSIFGSLAWKSGEAAAEGVAGA

SEQ ID NO: 1080337 - protein, 18 aa, Mycobacterium
TLIPRPQRMYLRFGEPID

SEQ ID NO: 1080338 - protein, 19 aa, Mycobacterium
TLITGLPGVLSRRVDPRNS

SEQ ID NO: 1080339 - protein, 32 aa, Mycobacterium; identical to SEQ ID NO: 867081

SEQ ID NO: 1080340 - protein, 22 aa, Mycobacterium
TLKVVILHRPGTELRRLTPRSS

SEQ ID NO: 1080341 - protein, 21 aa, Mycobacterium
TLLEGGTPLIAAPRLSKQTGC

SEQ ID NO: 1080342 - protein, 29 aa, Mycobacterium
TLLPEALETWPLSMFERFLPRHLEIIYEI

SEQ ID NO: 1080343 - protein, 20 aa, Mycobacterium
TLLRGHRNWQQPWLPRSAEA

SEQ ID NO: 1080344 - protein, 21 aa, Mycobacterium
TLLSGRRTFVPWLSTVVNVAV

SEQ ID NO: 1080345 - protein, 21 aa, Mycobacterium
TLLTVLPEFGVHPFEARRECT

SEQ ID NO: 1080346 - protein, 18 aa, Mycobacterium
TLMVRALGAALQLEFKRV

SEQ ID NO: 1080347 - protein, 38 aa, Mycobacterium; identical to SEQ ID NO: 867127

SEQ ID NO: 1080348 - protein, 25 aa, Mycobacterium
TLNFNRRNRLFWPTSSRIVEVIPEQ

SEQ ID NO: 1080349 - protein, 22 aa, Mycobacterium
TLPTYSFARQRFWLGEGAGRKA

SEQ ID NO: 1080350 - protein, 25 aa, Mycobacterium
TLPYDEPWGWMQPTRHAYGALLLEQ

SEQ ID NO: 1080351 - protein, 19 aa, Mycobacterium
TLRDPLNRGLRYGVKTMFS

SEQ ID NO: 1080352 - protein, 18 aa, Mycobacterium
TLRDTNAFDLAHHVVSEA

SEQ ID NO: 1080353 - protein, 25 aa, Mycobacterium
TLRGDFLWCQLFSEPGAGSDLASLR

SEQ ID NO: 1080354 - protein, 20 aa, Mycobacterium
TLRPLRPAFSVGLGARLGSG

SEQ ID NO: 1080355 - protein, 26 aa, Mycobacterium
TLSAYGVRYLFGVPGAKIDSVFDALR

SEQ ID NO: 1080356 - protein, 20 aa, Mycobacterium
TLSLMQILNSNAVNTTCLVP

SEQ ID NO: 1080357 - protein, 25 aa, Mycobacterium
TLSRRWAGPAFLLNQMLVWGFTGQV

SEQ ID NO: 1080358 - protein, 24 aa, Mycobacterium
TLSRTHPNLVRKLFSLEVPEIADG

SEQ ID NO: 1080359 - protein, 23 aa, Mycobacterium
TLSSLILDPPYGLRVQSYAPRRQ

SEQ ID NO: 1080360 - protein, 19 aa, Mycobacterium
TLSTLTWRIATNVTKLPGL

SEQ ID NO: 1080361 - protein, 29 aa, Mycobacterium
TLSWVDANVWRRVIPKSWFYNIIITGVKP

SEQ ID NO: 1080362 - protein, 17 aa, Mycobacterium
TLTANPPWAGTPALPPS

SEQ ID NO: 1080363 - protein, 18 aa, Mycobacterium
TLTLPRVRPPRPVDTERP

SEQ ID NO: 1080364 - protein, 17 aa, Mycobacterium
TLTPSKWSDFGKASDIY

SEQ ID NO: 1080365 - protein, 20 aa, Mycobacterium
TLTRCDIRVPRFATVDLTGQ

SEQ ID NO: 1080366 - protein, 27 aa, Mycobacterium
TLTRLREDVFNPPFSVPISPRLRDAAA

SEQ ID NO: 1080367 - protein, 20 aa, Mycobacterium
TLTTHPAGFNRTFRLQRHVP

SEQ ID NO: 1080368 - protein, 21 aa, Mycobacterium
TLTTLIWRTEPGKAVYRTVVA

SEQ ID NO: 1080369 - protein, 27 aa, Mycobacterium
TLVAGDVRLLLPKPADWSYAEAAAISA

SEQ ID NO: 1080370 - protein, 25 aa, Mycobacterium
TLVENFLRMTFGFPAEPYHPDPEVV

SEQ ID NO: 1080371 - protein, 21 aa, Mycobacterium
TLVGPLDWAVELDERWVILGP

SEQ ID NO: 1080372 - protein, 17 aa, Mycobacterium
TLVGVRRLYAPSCIAPR

SEQ ID NO: 1080373 - protein, 25 aa, Mycobacterium
TLVLGCTHYPLLSGLIQLVMGDNVT

SEQ ID NO: 1080374 - protein, 18 aa, Mycobacterium
TLVLPTHQQWRLAAGGEG

SEQ ID NO: 1080375 - protein, 18 aa, Mycobacterium
TLVRTPRGWRADNTDIDG

SEQ ID NO: 1080376 - protein, 19 aa, Mycobacterium
TLWAIAERFYGDGSKYQVI

SEQ ID NO: 1080377 - protein, 20 aa, Mycobacterium
TLWSCIPRSWCLRRYSELFC

SEQ ID NO: 1080378 - protein, 21 aa, Mycobacterium
TLYDMFVRTLGVSAGTYAAAE

SEQ ID NO: 1080379 - protein, 19 aa, Mycobacterium
TLYYIRLRQMALEGTEVEG

SEQ ID NO: 1080380 - protein, 18 aa, Mycobacterium
TMARLGNAAWLIGLARDR

SEQ ID NO: 1080381 - protein, 25 aa, Mycobacterium
TMDAWTLVHSWYRRFEGRRILNGTA

SEQ ID NO: 1080382 - protein, 24 aa, Mycobacterium
TMDNLHRKGWLQRERVGKAFSYWP

SEQ ID NO: 1080383 - protein, 28 aa, Mycobacterium
TMFQRTRQWILLWPNRQYSKVSRACYRG

SEQ ID NO: 1080384 - protein, 20 aa, Mycobacterium
TMGALIIGCPLAVAFATRAN

SEQ ID NO: 1080385 - protein, 22 aa, Mycobacterium
TMGCLYPNRIFLGVGTGEALNE

SEQ ID NO: 1080386 - protein, 19 aa, Mycobacterium
TMIIGVDTLPPLPTDPGDR

SEQ ID NO: 1080387 - protein, 20 aa, Mycobacterium
TMILSLVAMTHPDQLNLLLT

SEQ ID NO: 1080388 - protein, 20 aa, Mycobacterium
TMKRYRGWPGQRLAGAETRH

SEQ ID NO: 1080389 - protein, 21 aa, Mycobacterium
TMLDPFRLQDMRCKWRKWLTF

SEQ ID NO: 1080390 - protein, 17 aa, Mycobacterium
TMPLLEAWTALSALARD

SEQ ID NO: 1080391 - protein, 23 aa, Mycobacterium
TMQPIRRYHVDAAILFSDIVVPL

SEQ ID NO: 1080392 - protein, 20 aa, Mycobacterium
TMRQHPNAIPLVLTRRTVWA

SEQ ID NO: 1080393 - protein, 18 aa, Mycobacterium
TMSFLAIDDPAHLRLRTL

SEQ ID NO: 1080394 - protein, 28 aa, Mycobacterium
TMTSVVINPFFDWGYDRAPMIPYHETVI

SEQ ID NO: 1080395 - protein, 18 aa, Mycobacterium
TMVIRPYGYRIWELLQDE

SEQ ID NO: 1080396 - protein, 19 aa, Mycobacterium
TMVLLLAAANRDPAVYSRP

SEQ ID NO: 1080397 - protein, 20 aa, Mycobacterium
TMYGLFHGPQLRAIDERHGG

SEQ ID NO: 1080398 - protein, 35 aa, Mycobacterium; identical to SEQ ID NO: 371358

SEQ ID NO: 1080399 - protein, 17 aa, Mycobacterium
TNALCNLHLATGAICRP

SEQ ID NO: 1080400 - protein, 18 aa, Mycobacterium
TNAVLRQAGTAPPGGAAG

SEQ ID NO: 1080401 - protein, 27 aa, Mycobacterium
TNAVYGFTAMLINLLRDEAPTHIAAAF

SEQ ID NO: 1080402 - protein, 22 aa, Mycobacterium
TNEVALEKLIFGTDSALNGALN

SEQ ID NO: 1080403 - protein, 27 aa, Mycobacterium
TNFHNRAIAWLLRGSGYIYCDPMEACD

SEQ ID NO: 1080404 - protein, 24 aa, Mycobacterium
TNGRIGHRIPGVPPSLLLHTVGAK

SEQ ID NO: 1080405 - protein, 29 aa, Mycobacterium
TNHAAGWVRMDFIVPSRGLIGFRTDFLTL

SEQ ID NO: 1080406 - protein, 19 aa, Mycobacterium
TNHLDIEGITWLASHLQQR

SEQ ID NO: 1080407 - protein, 33 aa, Mycobacterium
TNIGWDRELAMKAYLLWLARGCMPGKLMPVEDL

SEQ ID NO: 1080408 - protein, 24 aa, Mycobacterium
TNKERPVSIFLRALARDLNASTPG

SEQ ID NO: 1080409 - protein, 34 aa, Mycobacterium
TNLDDYPTTPLPPPSPHDLAYLIYTSGTTGTPKG

SEQ ID NO: 1080410 - protein, 18 aa, Mycobacterium
TNLFLDMVRRRSRIRMEA

SEQ ID NO: 1080411 - protein, 21 aa, Mycobacterium
TNLHHALALAGRHLRRHPNAQ

SEQ ID NO: 1080412 - protein, 17 aa, Mycobacterium
TNLLLTIGVSDTTVRDS

SEQ ID NO: 1080413 - protein, 17 aa, Mycobacterium
TNLPRVLGGLGVAIIST

SEQ ID NO: 1080414 - protein, 19 aa, Mycobacterium
TNLVAQACAFINYAQGRYG

SEQ ID NO: 1080415 - protein, 18 aa, Mycobacterium
TNLYRQQMSPINTPEGSL

SEQ ID NO: 1080416 - protein, 21 aa, Mycobacterium
TNNGLVEIVPLGISKATGVRD

SEQ ID NO: 1080417 - protein, 25 aa, Mycobacterium
TNPAQWLAARGWVVEPVRNTLELEA

SEQ ID NO: 1080418 - protein, 27 aa, Mycobacterium
TNPDAAWFYPRPSPLACRIKNHVAFWN

SEQ ID NO: 1080419 - protein, 25 aa, Mycobacterium
TNPIASIFAWTRGLAHRGKLDNTPE

SEQ ID NO: 1080420 - protein, 20 aa, Mycobacterium
TNPSAPYLQAASGTDGLSGP

SEQ ID NO: 1080421 - protein, 24 aa, Mycobacterium
TNVPELMMMPYTESLTFGATRNPW

SEQ ID NO: 1080422 - protein, 45 aa, Mycobacterium
TNVSQWISGEFSKLVQFILNLVNAPSELLFGRMIIGNGADATEAG

SEQ ID NO: 1080423 - protein, 17 aa, Mycobacterium
TNWSRRYKANLEKLASG

SEQ ID NO: 1080424 - protein, 25 aa, Mycobacterium
TNYMNWNRMHLAHAQWAVAELLEAV

SEQ ID NO: 1080425 - protein, 36 aa, Mycobacterium; identical to SEQ ID NO: 867609

SEQ ID NO: 1080426 - protein, 18 aa, Mycobacterium
TPALHLRLLEDDKHFFPL

SEQ ID NO: 1080427 - protein, 32 aa, Mycobacterium
TPALIPFSGPARKVLELTFREALRLGHNYIGT

SEQ ID NO: 1080428 - protein, 25 aa, Mycobacterium
TPAPSPAPPPPEPTAPPPTAETVRP

SEQ ID NO: 1080429 - protein, 29 aa, Mycobacterium
TPARIAKYLVTHPRVLAALPILGAANRIP

SEQ ID NO: 1080430 - protein, 29 aa, Mycobacterium
TPARSVYEPAPRSPALGAGVPAPVPQFEV

SEQ ID NO: 1080431 - protein, 24 aa, Mycobacterium
TPDDLHPMQRRFAEAAAFQCGFCT

SEQ ID NO: 1080432 - protein, 27 aa, Mycobacterium
TPDDLLPEWVLPPEDIPFIYPDERIDA

SEQ ID NO: 1080433 - protein, 18 aa, Mycobacterium
TPDFIRQVDVLGLAAKAG

SEQ ID NO: 1080434 - protein, 25 aa, Mycobacterium
TPDHLLLGVLADPAALATALLRMQA

SEQ ID NO: 1080435 - protein, 32 aa, Mycobacterium
TPDNLYMIGTFRLAPGQALVLDFEPPETRYWS

SEQ ID NO: 1080436 - protein, 17 aa, Mycobacterium
TPDNPIIFNLPATVEMA

SEQ ID NO: 1080437 - protein, 23 aa, Mycobacterium
TPDWLGLPEKLGNRRAWGLATQL

SEQ ID NO: 1080438 - protein, 19 aa, Mycobacterium
TPEHPFPVWTERGGPATIV

SEQ ID NO: 1080439 - protein, 26 aa, Mycobacterium
TPELMPLPIALAHRLSRRLTEVRKNG

SEQ ID NO: 1080440 - protein, 19 aa, Mycobacterium
TPENPIIFNLPATVEMATP

SEQ ID NO: 1080441 - protein, 29 aa, Mycobacterium
TPERLRVLERLEVVARRLPAAQYALVNQL

SEQ ID NO: 1080442 - protein, 22 aa, Mycobacterium
TPERLSVIARHYLDVAALTDEE

SEQ ID NO: 1080443 - protein, 28 aa, Mycobacterium
TPEYKQVALFSATMPPAIRKITTRYLHD

SEQ ID NO: 1080444 - protein, 19 aa, Mycobacterium
TPFAYQGVFGHLAAGAVPG

SEQ ID NO: 1080445 - protein, 20 aa, Mycobacterium
TPFLEQLLAAAQRAGTRLPD

SEQ ID NO: 1080446 - protein, 24 aa, Mycobacterium
TPGFERTFVSRSLDFWNRQRYELR

SEQ ID NO: 1080447 - protein, 29 aa, Mycobacterium
TPGSPLGSALYRAFAVLLTCASALEASVA

SEQ ID NO: 1080448 - protein, 26 aa, Mycobacterium
TPGTRMYRTRDLVWWGTDGQLRYLGR

SEQ ID NO: 1080449 - protein, 30 aa, Mycobacterium; identical to SEQ ID NO: 867771

SEQ ID NO: 1080450 - protein, 18 aa, Mycobacterium
TPKRLPESLLHYMRTRGK

SEQ ID NO: 1080451 - protein, 27 aa, Mycobacterium
TPLAVDPAHPFPFVSGLSLNLAVTVRQ

SEQ ID NO: 1080452 - protein, 19 aa, Mycobacterium
TPLFDRAVISLPADKFIRL

SEQ ID NO: 1080453 - protein, 20 aa, Mycobacterium
TPLGSIPEFNRDALVSTLQD

SEQ ID NO: 1080454 - protein, 22 aa, Mycobacterium
TPLLVACDLQRPAAVNQLQVVG

SEQ ID NO: 1080455 - protein, 18 aa, Mycobacterium
TPMAYYRSNQHVGQFVDV

SEQ ID NO: 1080456 - protein, 26 aa, Mycobacterium
TPMYVGSLMILRRPRAGLSYEALLVT

SEQ ID NO: 1080457 - protein, 32 aa, Mycobacterium
TPNGGIFTRFPGMHIPFVDLTFTSPTPPDTPY

SEQ ID NO: 1080458 - protein, 24 aa, Mycobacterium
TPNPLRGMPPFSGPEGPFAAITPG

SEQ ID NO: 1080459 - protein, 28 aa, Mycobacterium
TPNSAGRYRPFYLRNLLDVVQGRKLSDA

SEQ ID NO: 1080460 - protein, 17 aa, Mycobacterium
TPPGLLHLAARAYTATG

SEQ ID NO: 1080461 - protein, 21 aa, Mycobacterium
TPPLVFHGSRFRRLAAHPATE

SEQ ID NO: 1080462 - protein, 25 aa, Mycobacterium
TPPNLVRAILQAPVDLLFNGGIGTY

SEQ ID NO: 1080463 - protein, 23 aa, Mycobacterium
TPPTIMQPHNPPYYPRLVEAGGY

SEQ ID NO: 1080464 - protein, 19 aa, Mycobacterium
TPPTVVMLAGLQGSGKTTL

SEQ ID NO: 1080465 - protein, 20 aa, Mycobacterium
TPPVEGSWAWLPDEAKGARI

SEQ ID NO: 1080466 - protein, 17 aa, Mycobacterium
TPQRRGHYLQLPKPADG

SEQ ID NO: 1080467 - protein, 19 aa, Mycobacterium
TPQTLINIRPVVAAIKEFF

SEQ ID NO: 1080468 - protein, 24 aa, Mycobacterium
TPRGIVHLLRRYDVPIAGAHVVVI

SEQ ID NO: 1080469 - protein, 23 aa, Mycobacterium
TPSPLEWGCVRFSIIQRADHFTF

SEQ ID NO: 1080470 - protein, 20 aa, Mycobacterium
TPTISFPKTPLNPGAKERSA

SEQ ID NO: 1080471 - protein, 22 aa, Mycobacterium
TPTQLLERLGFAKGQLSARVSE

SEQ ID NO: 1080472 - protein, 30 aa, Mycobacterium; identical to SEQ ID NO: 867931

SEQ ID NO: 1080473 - protein, 28 aa, Mycobacterium
TPTQWPKFVAALLAQTPVRAPWDSGCWS

SEQ ID NO: 1080474 - protein, 18 aa, Mycobacterium
TPVGWVYPDLSKPRVKAV

SEQ ID NO: 1080475 - protein, 25 aa, Mycobacterium
TPVRRMLTRWLGPTDPVLASTVFGV

SEQ ID NO: 1080476 - protein, 30 aa, Mycobacterium; identical to SEQ ID NO: 223610

SEQ ID NO: 1080477 - protein, 28 aa, Mycobacterium
TQAGQFALTYPRRLGFGLGTSVVSLSWR

SEQ ID NO: 1080478 - protein, 23 aa, Mycobacterium
TQALLGRGLIGDGAAGTASHPDG

SEQ ID NO: 1080479 - protein, 26 aa, Mycobacterium
TQAVCRLLESLGHHVEVAWPAALEDA

SEQ ID NO: 1080480 - protein, 28 aa, Mycobacterium
TQDGRIGGWARFARFHLGRKGAVHGGAL

SEQ ID NO: 1080481 - protein, 25 aa, Mycobacterium
TQESTLGLIFHWADQRELPLLDLKD

SEQ ID NO: 1080482 - protein, 26 aa, Mycobacterium
TQETFLRAIGALPRFAGRSNARTWLF

SEQ ID NO: 1080483 - protein, 25 aa, Mycobacterium
TQFGPYRLRRLLGRGGMGEVYEAHD

SEQ ID NO: 1080484 - protein, 22 aa, Mycobacterium
TQFQTRFVSALSNAGSAYAAAE

SEQ ID NO: 1080485 - protein, 21 aa, Mycobacterium
TQGEGPWHLLPNGPVVCSSES

SEQ ID NO: 1080486 - protein, 20 aa, Mycobacterium
TQHRIYALMKEFGVAAFKQY

SEQ ID NO: 1080487 - protein, 41 aa, Mycobacterium
TQLAVRTYGHVYLWNRDPSQDIWMALAQPAVAGPTPDESQG

SEQ ID NO: 1080488 - protein, 23 aa, Mycobacterium
TQLPVKPSLAHKPTPQTKPGLTA

SEQ ID NO: 1080489 - protein, 26 aa, Mycobacterium
TQLRGIARVLIFEHPELKTTLVDIEG

SEQ ID NO: 1080490 - protein, 24 aa, Mycobacterium
TQNDFVLLPDVAARLSLTAAQVAA

SEQ ID NO: 1080491 - protein, 34 aa, Mycobacterium; identical to SEQ ID NO: 868054

SEQ ID NO: 1080492 - protein, 31 aa, Mycobacterium; identical to SEQ ID NO: 868060

SEQ ID NO: 1080493 - protein, 18 aa, Mycobacterium
TQQWGWDRDVAVARLAGA

SEQ ID NO: 1080494 - protein, 20 aa, Mycobacterium
TQQWGWDRDVAVARLAGAYG

SEQ ID NO: 1080495 - protein, 23 aa, Mycobacterium
TQRAWARCGPAILLEGDSLAPCA

SEQ ID NO: 1080496 - protein, 19 aa, Mycobacterium
TQVRALLRKISGIDAVVAN

SEQ ID NO: 1080497 - protein, 23 aa, Mycobacterium
TQVSLAGRYLVYVAGASSTGISR

SEQ ID NO: 1080498 - protein, 27 aa, Mycobacterium
TRAAIKITTIFGSRYIDLHPTGAGVPP

SEQ ID NO: 1080499 - protein, 18 aa, Mycobacterium
TRADELVLLLVVHHICWD

SEQ ID NO: 1080500 - protein, 24 aa, Mycobacterium
TRAEGVACYQLFISGLLDVTDNVD

SEQ ID NO: 1080501 - protein, 27 aa, Mycobacterium
TRAERQWPLVNTYWRDLYLADDGVLDH

SEQ ID NO: 1080502 - protein, 23 aa, Mycobacterium
TRAPAFLIGRLVSWVDDLWCRAI

SEQ ID NO: 1080503 - protein, 27 aa, Mycobacterium
TRAPVEFDRVLGMLDRLASSLQVDGRG

SEQ ID NO: 1080504 - protein, 30 aa, Mycobacterium; identical to SEQ ID NO: 868163

SEQ ID NO: 1080505 - protein, 28 aa, Mycobacterium
TRAVGANVPLLGQIPLDPALVDAGDSGM

SEQ ID NO: 1080506 - protein, 20 aa, Mycobacterium
TRCLPIWLTAALLVTDVASQ

SEQ ID NO: 1080507 - protein, 26 aa, Mycobacterium
TRCNRAYLPGTLLPPGIRATADPADA

SEQ ID NO: 1080508 - protein, 27 aa, Mycobacterium
TRCNRAYLPGTLLPPGIRATADPADAL

SEQ ID NO: 1080509 - protein, 25 aa, Mycobacterium
TRCWKQIIHFTPKFTAPEPESVAKR

SEQ ID NO: 1080510 - protein, 26 aa, Mycobacterium
TRDAWVEFPIFDAKSRSLKKAFLGKA

SEQ ID NO: 1080511 - protein, 26 aa, Mycobacterium
TRDDTPHLLLPPSLLAVEPPNHTRYR

SEQ ID NO: 1080512 - protein, 33 aa, Mycobacterium; identical to SEQ ID NO: 868190

SEQ ID NO: 1080513 - protein, 24 aa, Mycobacterium
TREDQALIYRLSGDRNPLHSDPWF

SEQ ID NO: 1080514 - protein, 26 aa, Mycobacterium
TRENLQPLIFGLWQMVSEYNAARPQA

SEQ ID NO: 1080515 - protein, 19 aa, Mycobacterium
TREWLATNPARIGQAALLK

SEQ ID NO: 1080516 - protein, 18 aa, Mycobacterium
TRGLVLASAPRPARRAIV

SEQ ID NO: 1080517 - protein, 22 aa, Mycobacterium
TRGYSVMSGYWKAPERTAEVID

SEQ ID NO: 1080518 - protein, 21 aa, Mycobacterium
TRHILSVEPQVAFFGDNIPLL

SEQ ID NO: 1080519 - protein, 20 aa, Mycobacterium
TRHNLGFMVADLLAARLGAK

SEQ ID NO: 1080520 - protein, 33 aa, Mycobacterium
TRIEPLPPKRAGLLVGALYRIAKRRLGEVPEPF

SEQ ID NO: 1080521 - protein, 28 aa, Mycobacterium
TRIVVLEDAWALLKFLNDDRYAIDPKAA

SEQ ID NO: 1080522 - protein, 19 aa, Mycobacterium
TRKPLTWRSSTRIAGAFGP

SEQ ID NO: 1080523 - protein, 17 aa, Mycobacterium
TRKRRVVALKLISTQYS

SEQ ID NO: 1080524 - protein, 18 aa, Mycobacterium
TRLLAAADGWFAITLSRP

SEQ ID NO: 1080525 - protein, 18 aa, Mycobacterium
TRLRPDLRPDWPQPASGG

SEQ ID NO: 1080526 - protein, 20 aa, Mycobacterium
TRLSGFFFRGDRSLVARSAA

SEQ ID NO: 1080527 - protein, 18 aa, Mycobacterium
TRMNELLEILPAKQREIL

SEQ ID NO: 1080528 - protein, 19 aa, Mycobacterium
TRMRVALSALTMAEWFRDE

SEQ ID NO: 1080529 - protein, 23 aa, Mycobacterium
TRNPMIVSWPARITDRGGLRSQF

SEQ ID NO: 1080530 - protein, 18 aa, Mycobacterium
TRPATVLGRCSYLRDGIA

SEQ ID NO: 1080531 - protein, 17 aa, Mycobacterium
TRPIDPWAGSYYVEWLT

SEQ ID NO: 1080532 - protein, 23 aa, Mycobacterium
TRPLREWLAALTDGIALLTRVDE

SEQ ID NO: 1080533 - protein, 23 aa, Mycobacterium
TRPPAILYHVSRTLAIQPVAIGS

SEQ ID NO: 1080534 - protein, 20 aa, Mycobacterium
TRPRKTLGWKTPAEAFHEQL

SEQ ID NO: 1080535 - protein, 19 aa, Mycobacterium
TRPTLMGRPVLVGGMGGRG

SEQ ID NO: 1080536 - protein, 21 aa, Mycobacterium
TRQHIFLAPANRAEFIIKAGE

SEQ ID NO: 1080537 - protein, 17 aa, Mycobacterium
TRQLLLDVVADDQKIQV

SEQ ID NO: 1080538 - protein, 19 aa, Mycobacterium
TRQRLLDMALNHHCDPAPD

SEQ ID NO: 1080539 - protein, 18 aa, Mycobacterium
TRQVAVVQYPTLSTSKVR

SEQ ID NO: 1080540 - protein, 25 aa, Mycobacterium
TRRFDTVGYWRLYFQWASFEILPRR

SEQ ID NO: 1080541 - protein, 24 aa, Mycobacterium
TRRIGRWRTAYLALSGRTIDAGTA

SEQ ID NO: 1080542 - protein, 24 aa, Mycobacterium
TRSCKRWFGIGPAAYRAKTRVRAT

SEQ ID NO: 1080543 - protein, 29 aa, Mycobacterium
TRSFGAPMDVWWFRLPRRPDDPTGLAGIF

SEQ ID NO: 1080544 - protein, 17 aa, Mycobacterium
TRSFWIENANKVNLWLA

SEQ ID NO: 1080545 - protein, 18 aa, Mycobacterium
TRSPPIPTWICTVRKAAR

SEQ ID NO: 1080546 - protein, 18 aa, Mycobacterium
TRTIGVTPGSCGCANYTR

SEQ ID NO: 1080547 - protein, 24 aa, Mycobacterium
TRVVKVVGFVASAPGFHGQPNVIN

SEQ ID NO: 1080548 - protein, 31 aa, Mycobacterium
TRVWESQLGPDLLWLGDHVIDDLCVLPGSAY

SEQ ID NO: 1080549 - protein, 18 aa, Mycobacterium
TRYDAVWCSGMRAKLGLP

SEQ ID NO: 1080550 - protein, 37 aa, Mycobacterium
TRYQPLGVVLAVMPWNFPLWQAGRFAAPALMAGNVGL

SEQ ID NO: 1080551 - protein, 49 aa, Mycobacterium; identical to SEQ ID NO: 868478

SEQ ID NO: 1080552 - protein, 31 aa, Mycobacterium; identical to SEQ ID NO: 868479

SEQ ID NO: 1080553 - protein, 24 aa, Mycobacterium
TSAGNVQWVLGNLGAIPTVTIDYK

SEQ ID NO: 1080554 - protein, 21 aa, Mycobacterium
TSALLVAYLPASSRDEMFGAG

SEQ ID NO: 1080555 - protein, 20 aa, Mycobacterium
TSAPNVWAFGDVASWRDQMG

SEQ ID NO: 1080556 - protein, 24 aa, Mycobacterium
TSAVWAYDFAWHPAPIFQTYSVYT

SEQ ID NO: 1080557 - protein, 22 aa, Mycobacterium
TSAWTLIELLRHPDAYAAVIDE

SEQ ID NO: 1080558 - protein, 18 aa, Mycobacterium
TSDATDITAYRGWLAYLA

SEQ ID NO: 1080559 - protein, 27 aa, Mycobacterium
TSDEALARVFDYTLAIGKTPIVVNDGR

SEQ ID NO: 1080560 - protein, 28 aa, Mycobacterium
TSDIKNLLPLFAVFKPTVVVSVPRVFEK

SEQ ID NO: 1080561 - protein, 24 aa, Mycobacterium
TSDKALTIGSLIREANRLAEFATT

SEQ ID NO: 1080562 - protein, 25 aa, Mycobacterium
TSDQDLLLITVLKGAVLFVTDLARA

SEQ ID NO: 1080563 - protein, 25 aa, Mycobacterium
TSDQEVRWCPGCGDYVILNTIRNFL

SEQ ID NO: 1080564 - protein, 34 aa, Mycobacterium
TSEVEHVLATQTLPLWPFKTMAVNVDGQLPAGVS

SEQ ID NO: 1080565 - protein, 33 aa, Mycobacterium
TSFWRLDSALPGKKFRWLTVDLPPIIDIRKRLL

SEQ ID NO: 1080566 - protein, 18 aa, Mycobacterium
TSGAVLKVIVESAALLGL

SEQ ID NO: 1080567 - protein, 22 aa, Mycobacterium
TSGFGVHPALLDAALHTAVIAN

SEQ ID NO: 1080568 - protein, 18 aa, Mycobacterium
TSGGWLGPASLSMASAFW

SEQ ID NO: 1080569 - protein, 23 aa, Mycobacterium
TSGGWRIDRLPNGVFLDWQQFQS

SEQ ID NO: 1080570 - protein, 17 aa, Mycobacterium
TSGLLCTFPLERESGEV

SEQ ID NO: 1080571 - protein, 26 aa, Mycobacterium
TSGQPAISLPLEWTPEGLPLGVQLVA

SEQ ID NO: 1080572 - protein, 26 aa, Mycobacterium
TSHRDLPLRLNQWSNVVRWELRPRML

SEQ ID NO: 1080573 - protein, 17 aa, Mycobacterium
TSIIKYFGTKQALFHEA

SEQ ID NO: 1080574 - protein, 27 aa, Mycobacterium
TSKVRHLEVIALTPARLLVVVITDSGR

SEQ ID NO: 1080575 - protein, 18 aa, Mycobacterium
TSMKWRAHPADVLPLWVA

SEQ ID NO: 1080576 - protein, 24 aa, Mycobacterium
TSMPVFRYRPFAKEVEPIRLVDRT

SEQ ID NO: 1080577 - protein, 24 aa, Mycobacterium
TSMVSLTMMARLLEAVRPQTRLLL

SEQ ID NO: 1080578 - protein, 25 aa, Mycobacterium
TSNPGPIPFGPPPIYVGALGPRLTR

SEQ ID NO: 1080579 - protein, 17 aa, Mycobacterium
TSPIHTLQQQALNAMNA

SEQ ID NO: 1080580 - protein, 21 aa, Mycobacterium
TSPLQLAINAVSAPAQSLLAR

SEQ ID NO: 1080581 - protein, 22 aa, Mycobacterium
TSPRRALSELLRRGTKSMPGAD

SEQ ID NO: 1080582 - protein, 20 aa, Mycobacterium
TSPTVLKRDFGMAWGVGGWL

SEQ ID NO: 1080583 - protein, 22 aa, Mycobacterium
TSPTYVLARVHPPRGPGRPAMI

SEQ ID NO: 1080584 - protein, 21 aa, Mycobacterium
TSPYPFFEYMRRTDPVWHGAL

SEQ ID NO: 1080585 - protein, 17 aa, Mycobacterium
TSQPPADVVALLNRFFA

SEQ ID NO: 1080586 - protein, 24 aa, Mycobacterium
TSRAPRWAIAYKYPPEEAQTKLLD

SEQ ID NO: 1080587 - protein, 17 aa, Mycobacterium
TSRRPWTRPPVPGTPTT

SEQ ID NO: 1080588 - protein, 19 aa, Mycobacterium
TSRRRMMDWLSRRNGDVFA

SEQ ID NO: 1080589 - protein, 31 aa, Mycobacterium
TSSIAKYAMVLLLRRVWTATLGLAGRVATLE

SEQ ID NO: 1080590 - protein, 25 aa, Mycobacterium
TSSKPPYSIVLPPPNVTGSLHMGHA

SEQ ID NO: 1080591 - protein, 28 aa, Mycobacterium
TSSWPRRRPRRAVWIRCWTRTATSRRPW

SEQ ID NO: 1080592 - protein, 24 aa, Mycobacterium
TSTAELVALLYQAIPAPARRIGGH

SEQ ID NO: 1080593 - protein, 27 aa, Mycobacterium
TSTGLLARLFAPLRSLAGAVASGIGLI

SEQ ID NO: 1080594 - protein, 23 aa, Mycobacterium
TSTGVTWRDPAQAAALRDVLARR

SEQ ID NO: 1080595 - protein, 22 aa, Mycobacterium
TSTKWRDPYAGTPWHKHVPARI

SEQ ID NO: 1080596 - protein, 24 aa, Mycobacterium
TSVDELLTIPLAKELAWAPEEIRE

SEQ ID NO: 1080597 - protein, 21 aa, Mycobacterium
TSVHPSLWRQSTLAAKQGLYE

SEQ ID NO: 1080598 - protein, 21 aa, Mycobacterium
TSVLGTPFLQNAINGAVNTAA

SEQ ID NO: 1080599 - protein, 22 aa, Mycobacterium
TSVLTPTFRYNPAVIAQAFATM

SEQ ID NO: 1080600 - protein, 24 aa, Mycobacterium
TSVPSYNINLFLDGIQQVANGDPM

SEQ ID NO: 1080601 - protein, 37 aa, Mycobacterium
TSVQQILLDAINAPTQALLGRPLIGNGANAAPGSGAN

SEQ ID NO: 1080602 - protein, 26 aa, Mycobacterium
TSVRHPLRWHHPALVMWYPDQGSEVD

SEQ ID NO: 1080603 - protein, 25 aa, Mycobacterium
TSVVFATAFYALRDLASVQPGQRIL

SEQ ID NO: 1080604 - protein, 19 aa, Mycobacterium
TSVYFALVRTRMIEPTPML

SEQ ID NO: 1080605 - protein, 22 aa, Mycobacterium
TTACAYDHLIPGRGVGVLLDDG

SEQ ID NO: 1080606 - protein, 30 aa, Mycobacterium; identical to SEQ ID NO: 868741

SEQ ID NO: 1080607 - protein, 22 aa, Mycobacterium
TTAIDLALALHPTPAVGGVPTN

SEQ ID NO: 1080608 - protein, 24 aa, Mycobacterium
TTARMLIQFGFIERLAVAGDRRTF

SEQ ID NO: 1080609 - protein, 30 aa, Mycobacterium
TTATVLARALVKTGLRLVAAGINPIALGSG

SEQ ID NO: 1080610 - protein, 28 aa, Mycobacterium
TTDARPQQILKIVRPWADAVWDTGIEFG

SEQ ID NO: 1080611 - protein, 17 aa, Mycobacterium
TTDGDGPLPLMWGEYRP

SEQ ID NO: 1080612 - protein, 30 aa, Mycobacterium; identical to SEQ ID NO: 868775

SEQ ID NO: 1080613 - protein, 24 aa, Mycobacterium
TTDKDGIIMALLAAEILAVTGATP

SEQ ID NO: 1080614 - protein, 25 aa, Mycobacterium
TTDQLPLVSVLLGGVALGLADGPTE

SEQ ID NO: 1080615 - protein, 17 aa, Mycobacterium
TTDSAVRLTHVPTGLVV

SEQ ID NO: 1080616 - protein, 22 aa, Mycobacterium
TTDSAVRLTHVPTGLVVTCQNE

SEQ ID NO: 1080617 - protein, 25 aa, Mycobacterium
TTDTGSFRWASPRGLRLAARLVDIG

SEQ ID NO: 1080618 - protein, 29 aa, Mycobacterium
TTELPTTYRLLGRTPRRLRRLRAAPSAVV

SEQ ID NO: 1080619 - protein, 17 aa, Mycobacterium
TTELVLLARLVARTRLR

SEQ ID NO: 1080620 - protein, 28 aa, Mycobacterium
TTEPTFDIFLWEIFGPLSAGGRLVFPAL

SEQ ID NO: 1080621 - protein, 20 aa, Mycobacterium
TTFGRIGVKVWIYKGDIVGG

SEQ ID NO: 1080622 - protein, 24 aa, Mycobacterium
TTFGRIGVKVWIYKGDIVGGKREV

SEQ ID NO: 1080623 - protein, 25 aa, Mycobacterium
TTFKIKNMWGLLTVKGEFTNFGGYG

SEQ ID NO: 1080624 - protein, 21 aa, Mycobacterium
TTFPQRVLAGLLALWEDPASG

SEQ ID NO: 1080625 - protein, 26 aa, Mycobacterium
TTGARVTYLYQLFPNVMLATFPDVIA

SEQ ID NO: 1080626 - protein, 23 aa, Mycobacterium
TTGRLIMQYASQNLIPVTLELGG

SEQ ID NO: 1080627 - protein, 24 aa, Mycobacterium
TTGRLIMQYASQNLIPVTLELGGK

SEQ ID NO: 1080628 - protein, 26 aa, Mycobacterium
TTGSLAALGAMWLARRRRCVDAQQSR

SEQ ID NO: 1080629 - protein, 18 aa, Mycobacterium
TTGTGYLAPGFHGVHIHK

SEQ ID NO: 1080630 - protein, 22 aa, Mycobacterium
TTHYSPYAWRSVTYRNRDIGVR

SEQ ID NO: 1080631 - protein, 21 aa, Mycobacterium
TTIVALKYPGGVLIAGDRRST

SEQ ID NO: 1080632 - protein, 26 aa, Mycobacterium
TTLGRVLFNELLPLGYAFVNKQMHKK

SEQ ID NO: 1080633 - protein, 25 aa, Mycobacterium
TTLGYYIAFLLDTPEYRDVPMEEID

SEQ ID NO: 1080634 - protein, 19 aa, Mycobacterium
TTMIYNLTARIRSGRSKHA

SEQ ID NO: 1080635 - protein, 31 aa, Mycobacterium
TTMSPAERWQLLATAWLDLPGRPALIGSRGP

SEQ ID NO: 1080636 - protein, 33 aa, Mycobacterium
TTMTADYWYANLRQPVRFYDSIKVLVAAAEQVF

SEQ ID NO: 1080637 - protein, 17 aa, Mycobacterium
TTMVPAALVLLDSLPRT

SEQ ID NO: 1080638 - protein, 19 aa, Mycobacterium
TTNPPLLLATRHVIGDDGT

SEQ ID NO: 1080639 - protein, 19 aa, Mycobacterium
TTPEISARVLMKLKRDAEA

SEQ ID NO: 1080640 - protein, 23 aa, Mycobacterium
TTPQHWDAILGINVGGVISGSRA

SEQ ID NO: 1080641 - protein, 17 aa, Mycobacterium
TTQEIYLEVWRTASDYD

SEQ ID NO: 1080642 - protein, 19 aa, Mycobacterium
TTQPLLPPRQICAQQTMAF

SEQ ID NO: 1080643 - protein, 30 aa, Mycobacterium
TTQVLFTPEQLWPFTCNLGSLTFGQSVARG

SEQ ID NO: 1080644 - protein, 27 aa, Mycobacterium
TTRDYHPAIGFYRRLFGWQTEQVGDTD

SEQ ID NO: 1080645 - protein, 17 aa, Mycobacterium
TTRRFFEAFAASGIRRE

SEQ ID NO: 1080646 - protein, 22 aa, Mycobacterium
TTRVIDLIMPIGKGQRALIVSP

SEQ ID NO: 1080647 - protein, 18 aa, Mycobacterium
TTSLIDYNRAGVPLIEIV

SEQ ID NO: 1080648 - protein, 24 aa, Mycobacterium
TTSSKLAAKLRTASSAYQGVDEQA

SEQ ID NO: 1080649 - protein, 18 aa, Mycobacterium
TTTAITAGLAKAGGISAV

SEQ ID NO: 1080650 - protein, 17 aa, Mycobacterium
TTTPPVEGSWAWLPDEA

SEQ ID NO: 1080651 - protein, 23 aa, Mycobacterium
TTTTERILYYTGISYKIGEVHDG

SEQ ID NO: 1080652 - protein, 18 aa, Mycobacterium
TTTYLVEAGLRAAGRVAG

SEQ ID NO: 1080653 - protein, 24 aa, Mycobacterium
TTVATGLIGALRQAGRRVAPFKVG

SEQ ID NO: 1080654 - protein, 17 aa, Mycobacterium
TTVLDEEQLWGTLLASA

SEQ ID NO: 1080655 - protein, 18 aa, Mycobacterium
TTVPTTVWIATDGSSHLV

SEQ ID NO: 1080656 - protein, 23 aa, Mycobacterium
TTVRTRGARLPGVRPRRGHQRHG

SEQ ID NO: 1080657 - protein, 26 aa, Mycobacterium
TTYHMIPTENLPLLEPLRGVPFIGNT

SEQ ID NO: 1080658 - protein, 24 aa, Mycobacterium
TTYPLLLHEAYVRLYPTQVIKQAH

SEQ ID NO: 1080659 - protein, 25 aa, Mycobacterium
TVAAGHYVGWLRTSALHAAGAAAAA

SEQ ID NO: 1080660 - protein, 22 aa, Mycobacterium
TVARLLALFAEQAQLAGKARLR

SEQ ID NO: 1080661 - protein, 18 aa, Mycobacterium
TVASVYAEYQRRLRAANA

SEQ ID NO: 1080662 - protein, 25 aa, Mycobacterium
TVATLEAIKLFLSVSGMVFVIAADQ

SEQ ID NO: 1080663 - protein, 19 aa, Mycobacterium
TVDANLKLGLPADARDYGI

SEQ ID NO: 1080664 - protein, 24 aa, Mycobacterium
TVDDWYEMTFNNGAIPFGGNTTQV

SEQ ID NO: 1080665 - protein, 25 aa, Mycobacterium
TVDFYSNILGMPLIKSLDLPGGQDQ

SEQ ID NO: 1080666 - protein, 23 aa, Mycobacterium
TVDGPAFHNLGATAAWELAATIG

SEQ ID NO: 1080667 - protein, 31 aa, Mycobacterium
TVDLGYMESVIWAFRQLWDKGLAYEGYRVLP

SEQ ID NO: 1080668 - protein, 18 aa, Mycobacterium
TVDLLLSRGATDITVLCV

SEQ ID NO: 1080669 - protein, 24 aa, Mycobacterium
TVDPIDVYRILRVTNPSPYMYLIQ

SEQ ID NO: 1080670 - protein, 32 aa, Mycobacterium; identical to SEQ ID NO: 869142

SEQ ID NO: 1080671 - protein, 33 aa, Mycobacterium
TVDSISVLMTQNRVRHVPVLDGQKLIGIVSIGD

SEQ ID NO: 1080672 - protein, 26 aa, Mycobacterium
TVDYPPVNAIPSRGWFELADALTAAG

SEQ ID NO: 1080673 - protein, 24 aa, Mycobacterium
TVEAMLKAFGRDIGYRIAHHADLN

SEQ ID NO: 1080674 - protein, 24 aa, Mycobacterium
TVEDYFFVVLIHTLTYKVVSEAVG

SEQ ID NO: 1080675 - protein, 27 aa, Mycobacterium
TVESRAYKMWLPPLVDPTPLDELVARD

SEQ ID NO: 1080676 - protein, 30 aa, Mycobacterium
TVFERVPLRELPLPYPARSWRSYPRCSDSS

SEQ ID NO: 1080677 - protein, 19 aa, Mycobacterium
TVFQSILRPMHEKIVGRIA

SEQ ID NO: 1080678 - protein, 19 aa, Mycobacterium
TVGAFNLPGLAIPSLTIPS

SEQ ID NO: 1080679 - protein, 31 aa, Mycobacterium
TVGRLVFPAPMGEFPIYLDLFAARHGFGRRI

SEQ ID NO: 1080680 - protein, 26 aa, Mycobacterium
TVGRYSPYAVYLLGGDPGLLAPVRDG

SEQ ID NO: 1080681 - protein, 24 aa, Mycobacterium
TVHCVYKPVSGEQPLWDFPDGTLA

SEQ ID NO: 1080682 - protein, 32 aa, Mycobacterium
TVHPTTMRLLDELGLWERFAELPFSEVRKATL

SEQ ID NO: 1080683 - protein, 17 aa, Mycobacterium
TVHVTFRRLMRADIFGA

SEQ ID NO: 1080684 - protein, 19 aa, Mycobacterium
TVIAWHRYVADLIGQAKSE

SEQ ID NO: 1080685 - protein, 18 aa, Mycobacterium
TVIVLPGQQLRAVLVADN

SEQ ID NO: 1080686 - protein, 27 aa, Mycobacterium
TVKDLLPLLEKVIQGGKPLLIIAEDVE

SEQ ID NO: 1080687 - protein, 17 aa, Mycobacterium
TVKTFKRAGGQIWLMPH

SEQ ID NO: 1080688 - protein, 18 aa, Mycobacterium
TVLAPRREQLTGDEAHER

SEQ ID NO: 1080689 - protein, 24 aa, Mycobacterium
TVLELAEVIWRKMRPDTPFRYESD

SEQ ID NO: 1080690 - protein, 17 aa, Mycobacterium
TVLFPNNPVARESVTRY

SEQ ID NO: 1080691 - protein, 17 aa, Mycobacterium
TVLGPSRLTMEPATGRI

SEQ ID NO: 1080692 - protein, 20 aa, Mycobacterium
TVLLRTLPLVVHGSSVGAAV

SEQ ID NO: 1080693 - protein, 23 aa, Mycobacterium
TVLSAGLMLAWRCDLIVAADDTV

SEQ ID NO: 1080694 - protein, 27 aa, Mycobacterium
TVLSRNTFHWVLAFARSGLSTPAVFTE

SEQ ID NO: 1080695 - protein, 33 aa, Mycobacterium; identical to SEQ ID NO: 869306

SEQ ID NO: 1080696 - protein, 23 aa, Mycobacterium
TVLTMPVRIRTANLHSAMFSVPA

SEQ ID NO: 1080697 - protein, 19 aa, Mycobacterium
TVMAFRDGVLVITSPVPCP

SEQ ID NO: 1080698 - protein, 25 aa, Mycobacterium
TVMATPAMFIEFSRQRALSADGRCK

SEQ ID NO: 1080699 - protein, 25 aa, Mycobacterium
TVMEDYYHRPFRDLVARAADRAEAP

SEQ ID NO: 1080700 - protein, 17 aa, Mycobacterium
TVMVLPGPPSELQPMWR

SEQ ID NO: 1080701 - protein, 27 aa, Mycobacterium
TVNCLRIQLMAFAYDGAWAEYTVAQAA

SEQ ID NO: 1080702 - protein, 22 aa, Mycobacterium
TVNGWFKRVYDLGLPLNIHANG

SEQ ID NO: 1080703 - protein, 17 aa, Mycobacterium
TVNGYRGCMHACRYCFA

SEQ ID NO: 1080704 - protein, 37 aa, Mycobacterium; identical to SEQ ID NO: 869343

SEQ ID NO: 1080705 - protein, 19 aa, Mycobacterium
TVPGGLLLERRTNGITALE

SEQ ID NO: 1080706 - protein, 18 aa, Mycobacterium
TVPPFFPQGSLAAPAPST

SEQ ID NO: 1080707 - protein, 17 aa, Mycobacterium
TVPSLFMAGTKDPVLSF

SEQ ID NO: 1080708 - protein, 29 aa, Mycobacterium
TVQASMWRGMFPARLFRLGPENEPVAAFQ

SEQ ID NO: 1080709 - protein, 17 aa, Mycobacterium
TVQFPGIDIGLSKVLHA

SEQ ID NO: 1080710 - protein, 17 aa, Mycobacterium
TVQPLEKLFGTATARPV

SEQ ID NO: 1080711 - protein, 21 aa, Mycobacterium
TVRHFLSHPALVASETRRLVE

SEQ ID NO: 1080712 - protein, 21 aa, Mycobacterium
TVRPDFWELVDYATAHHVGVK

SEQ ID NO: 1080713 - protein, 30 aa, Mycobacterium; identical to SEQ ID NO: 869406

SEQ ID NO: 1080714 - protein, 24 aa, Mycobacterium
TVRRSASFAPLPRSVFEATLDLLS

SEQ ID NO: 1080715 - protein, 17 aa, Mycobacterium
TVRTFTIVTFAAPGIPT

SEQ ID NO: 1080716 - protein, 23 aa, Mycobacterium
TVRTIFDVPTPAGLAARLVERFR

SEQ ID NO: 1080717 - protein, 18 aa, Mycobacterium
TVRVVRQPWWAPIVDVGP

SEQ ID NO: 1080718 - protein, 25 aa, Mycobacterium
TVSDEAVLAAARRLRIIAATPQART

SEQ ID NO: 1080719 - protein, 33 aa, Mycobacterium
TVSSIFLMCLPDRVLAYGDCAIIPNPTVEELAD

SEQ ID NO: 1080720 - protein, 22 aa, Mycobacterium
TVSWLASDVPSLGWKTYQLIPT

SEQ ID NO: 1080721 - protein, 27 aa, Mycobacterium
TVTAGQPLIWLEAMKMEHTISAPTDGV

SEQ ID NO: 1080722 - protein, 24 aa, Mycobacterium
TVTLPGAAVWHMAWSDKDDAIDWQ

SEQ ID NO: 1080723 - protein, 17 aa, Mycobacterium
TVTPPSWRPDLQQPADL

SEQ ID NO: 1080724 - protein, 23 aa, Mycobacterium
TVTTLPGAAFFGSSTSFGIIRGG

SEQ ID NO: 1080725 - protein, 25 aa, Mycobacterium
TVTVPELLVVRRAPGVWHLVSTVSA

SEQ ID NO: 1080726 - protein, 23 aa, Mycobacterium
TVVADLVLKVLTMARPHARNVGG

SEQ ID NO: 1080727 - protein, 18 aa, Mycobacterium
TVVAKLLMLFGTDEQKST

SEQ ID NO: 1080728 - protein, 24 aa, Mycobacterium
TVVANAATRWVWLAEATNLDIDTI

SEQ ID NO: 1080729 - protein, 17 aa, Mycobacterium
TVVAYSYGLACIRNWLY

SEQ ID NO: 1080730 - protein, 24 aa, Mycobacterium
TVVERLRWKGYLKPGSRDDATEIH

SEQ ID NO: 1080731 - protein, 37 aa, Mycobacterium
TVVIYGDKSSWWAAYALWVFTLFGHPDVRSLNGGRNL

SEQ ID NO: 1080732 - protein, 25 aa, Mycobacterium
TVVQTCIIHLIRGTFRYAGRQHHTA

SEQ ID NO: 1080733 - protein, 20 aa, Mycobacterium
TVVQTCIIHLIRGTFRYPGR

SEQ ID NO: 1080734 - protein, 24 aa, Mycobacterium
TVVQTCIIHLIRGTLRYPGRQHHT

SEQ ID NO: 1080735 - protein, 19 aa, Mycobacterium
TWAPKSAGALAYRALAREF

SEQ ID NO: 1080736 - protein, 30 aa, Mycobacterium; identical to SEQ ID NO: 869564

SEQ ID NO: 1080737 - protein, 20 aa, Mycobacterium
TWEDAYAYAKFARIALDSND

SEQ ID NO: 1080738 - protein, 28 aa, Mycobacterium
TWEHDLHLYLRRVMLYRSMFGTPEEHNL

SEQ ID NO: 1080739 - protein, 18 aa, Mycobacterium
TWELFRYPGIRSDSDMHT

SEQ ID NO: 1080740 - protein, 19 aa, Mycobacterium
TWERNVLGAIPYSTNRALL

SEQ ID NO: 1080741 - protein, 22 aa, Mycobacterium
TWLASHLQQRWARNTGGLLLVT

SEQ ID NO: 1080742 - protein, 30 aa, Mycobacterium
TWNETYLCRTLPWPAYLTEAFQNLGPEIFE

SEQ ID NO: 1080743 - protein, 21 aa, Mycobacterium
TWPKLRNRPRLGVSVLAEGHD

SEQ ID NO: 1080744 - protein, 33 aa, Mycobacterium; identical to SEQ ID NO: 869611

SEQ ID NO: 1080745 - protein, 24 aa, Mycobacterium
TWQQVVLLCAYSRYLRQAGFPYSQ

SEQ ID NO: 1080746 - protein, 18 aa, Mycobacterium
TWQYWLATRSVKPEEYQF

SEQ ID NO: 1080747 - protein, 18 aa, Mycobacterium
TWRCAIVCERSSLTLWEA

SEQ ID NO: 1080748 - protein, 19 aa, Mycobacterium
TWRWTIHRKSALAAPALPV

SEQ ID NO: 1080749 - protein, 20 aa, Mycobacterium
TWTAGRPCLSIHAAIVFTSP

SEQ ID NO: 1080750 - protein, 25 aa, Mycobacterium
TWTEEQTYFFRLSAYADKLLAHYEA

SEQ ID NO: 1080751 - protein, 17 aa, Mycobacterium
TYAGKRLVRTYSGGMRR

SEQ ID NO: 1080752 - protein, 27 aa, Mycobacterium
TYAPGRAMPLTLLLHSLALGQNQFASI

SEQ ID NO: 1080753 - protein, 17 aa, Mycobacterium
TYDHRLVDGADAGRFLT

SEQ ID NO: 1080754 - protein, 23 aa, Mycobacterium
TYFNEQVFPVLTPLAVDPAHPFP

SEQ ID NO: 1080755 - protein, 21 aa, Mycobacterium
TYGQTYQALAAQASGLHQHFE

SEQ ID NO: 1080756 - protein, 27 aa, Mycobacterium
TYGRPGLVPSPLYDSLLAKVITHVHGS

SEQ ID NO: 1080757 - protein, 18 aa, Mycobacterium
TYHELLSLVVEGYRREGK

SEQ ID NO: 1080758 - protein, 37 aa, Mycobacterium
TYHKLDEFLPQFLKGCIQLGAWPLLDTTWEMAPVDFT

SEQ ID NO: 1080759 - protein, 17 aa, Mycobacterium
TYHVALPGRGEPKRAIL

SEQ ID NO: 1080760 - protein, 33 aa, Mycobacterium; identical to SEQ ID NO: 869679

SEQ ID NO: 1080761 - protein, 27 aa, Mycobacterium
TYILIPNEHLPLLQPLRGIVPDSVLDG

SEQ ID NO: 1080762 - protein, 20 aa, Mycobacterium
TYKEFELLKYLAQHAGRVFT

SEQ ID NO: 1080763 - protein, 25 aa, Mycobacterium
TYLSAAGRLLDPRPLSCAIAAVSVG

SEQ ID NO: 1080764 - protein, 17 aa, Mycobacterium
TYLYIDKKMRDHGLFQA

SEQ ID NO: 1080765 - protein, 24 aa, Mycobacterium
TYNDIVSWRWTDVPGALGVTNHLA

SEQ ID NO: 1080766 - protein, 21 aa, Mycobacterium
TYPGKRYHAVPVAPGCAQPAF

SEQ ID NO: 1080767 - protein, 21 aa, Mycobacterium
TYQDIYKFTYLRGPSGIIVML

SEQ ID NO: 1080768 - protein, 21 aa, Mycobacterium
TYQRSLDVLTAARQFGLVTKS

SEQ ID NO: 1080769 - protein, 23 aa, Mycobacterium
TYRGGQLLLALREVVIQRTGFNT

SEQ ID NO: 1080770 - protein, 26 aa, Mycobacterium
TYRQETIRMFGLPESGLAATLRSAET

SEQ ID NO: 1080771 - protein, 19 aa, Mycobacterium
TYVFQKLACEYFAHGAYEQ

SEQ ID NO: 1080772 - protein, 19 aa, Mycobacterium
VAAAGPYASWLGAAAVRAA

SEQ ID NO: 1080773 - protein, 19 aa, Mycobacterium
VAAAVFGGWLSYRSPDRQA

SEQ ID NO: 1080774 - protein, 35 aa, Mycobacterium; identical to SEQ ID NO: 869758

SEQ ID NO: 1080775 - protein, 24 aa, Mycobacterium
VAADLLSLTLLTPPGELGADIAVG

SEQ ID NO: 1080776 - protein, 35 aa, Mycobacterium; identical to SEQ ID NO: 869763

SEQ ID NO: 1080777 - protein, 20 aa, Mycobacterium
VAAFHRQLVAGLHSGAAAYT

SEQ ID NO: 1080778 - protein, 18 aa, Mycobacterium
VAAGRLLFRPAVEIEPSG

SEQ ID NO: 1080779 - protein, 17 aa, Mycobacterium
VAAGRRVGGRRRGRSGS

SEQ ID NO: 1080780 - protein, 20 aa, Mycobacterium
VAAILAFAMAVNEQRGRIDE

SEQ ID NO: 1080781 - protein, 24 aa, Mycobacterium
VAALRSIGITPDALILRCDRDVPE

SEQ ID NO: 1080782 - protein, 26 aa, Mycobacterium
VAALSELPLLLLDEGHCLRDQALDVC

SEQ ID NO: 1080783 - protein, 19 aa, Mycobacterium
VAAPYSSWLSAAAARAAGA

SEQ ID NO: 1080784 - protein, 23 aa, Mycobacterium
VAAQLREFLDSLGGLWAEGKLAD

SEQ ID NO: 1080785 - protein, 18 aa, Mycobacterium
VAAQPRIEFLQRAIDIAA

SEQ ID NO: 1080786 - protein, 18 aa, Mycobacterium
VAARVPGLLIDAPSIMRG

SEQ ID NO: 1080787 - protein, 24 aa, Mycobacterium
VACYPARFQLVLAANPCPCAPADP

SEQ ID NO: 1080788 - protein, 30 aa, Mycobacterium; identical to SEQ ID NO: 869901

SEQ ID NO: 1080789 - protein, 29 aa, Mycobacterium
VADDPVPVRVLYLGRGLPKATLFGPSEVA

SEQ ID NO: 1080790 - protein, 23 aa, Mycobacterium
VADFPRYPLNLVSTLNALAGAYY

SEQ ID NO: 1080791 - protein, 25 aa, Mycobacterium
VADGRKLPWFGPPMSAASMATARLM

SEQ ID NO: 1080792 - protein, 27 aa, Mycobacterium
VADLSFISLTTVLPALAACALPHADIV

SEQ ID NO: 1080793 - protein, 24 aa, Mycobacterium
VADQPWSLLTGPYLDALPIDPEPD

SEQ ID NO: 1080794 - protein, 17 aa, Mycobacterium
VADRGAMFDPSAVFYMS

SEQ ID NO: 1080795 - protein, 28 aa, Mycobacterium
VADRSSWSRWWPDLWLQVTEDRADKGIR

SEQ ID NO: 1080796 - protein, 18 aa, Mycobacterium
VADRWVLLDHLTRGRVVF

SEQ ID NO: 1080797 - protein, 17 aa, Mycobacterium
VADSLPGIAGNLTGLFN

SEQ ID NO: 1080798 - protein, 19 aa, Mycobacterium
VADVIWTYEQPYPAVAEIA

SEQ ID NO: 1080799 - protein, 19 aa, Mycobacterium
VAEALPRLDPALCKVMAGF

SEQ ID NO: 1080800 - protein, 30 aa, Mycobacterium; identical to SEQ ID NO: 869964

SEQ ID NO: 1080801 - protein, 28 aa, Mycobacterium
VAEIDRGTWTPAPVFAMIAQRGRVVREE

SEQ ID NO: 1080802 - protein, 24 aa, Mycobacterium
VAELLDIVGLRRSDASRYPAEFSG

SEQ ID NO: 1080803 - protein, 17 aa, Mycobacterium
VAELLLDVLGPAALDSG

SEQ ID NO: 1080804 - protein, 26 aa, Mycobacterium
VAEPVAWFTHYYWLDDDRAPEFAPCV

SEQ ID NO: 1080805 - protein, 18 aa, Mycobacterium
VAERLAAGGLQLNRFHTT

SEQ ID NO: 1080806 - protein, 25 aa, Mycobacterium
VAESGRLLAWRLNRVVDAASQLRDE

SEQ ID NO: 1080807 - protein, 25 aa, Mycobacterium
VAEWIKVVCFPERWLDLRYVGPGTG

SEQ ID NO: 1080808 - protein, 19 aa, Mycobacterium
VAFADSWKQTLRASDYAAG

SEQ ID NO: 1080809 - protein, 19 aa, Mycobacterium
VAFPRSPFVTAATAWELQE

SEQ ID NO: 1080810 - protein, 23 aa, Mycobacterium
VAFPVVALEVMRYACGDRAEEVL

SEQ ID NO: 1080811 - protein, 20 aa, Mycobacterium
VAFVGRIQPLKAPDIVLRAV

SEQ ID NO: 1080812 - protein, 26 aa, Mycobacterium
VAFVNALPVFIASDPAWAKKFKDAGV

SEQ ID NO: 1080813 - protein, 27 aa, Mycobacterium
VAGAAHFLEHLLFKSTPTRTAVDIAQA

SEQ ID NO: 1080814 - protein, 23 aa, Mycobacterium
VAGAKILRQYGIGPLPGVAMMVV

SEQ ID NO: 1080815 - protein, 28 aa, Mycobacterium
VAGGATFILATGRPPRWVRPVVEELGFT

SEQ ID NO: 1080816 - protein, 19 aa, Mycobacterium
VAGIPSYRDVLPGALQTSG

SEQ ID NO: 1080817 - protein, 22 aa, Mycobacterium
VAGLDRKALPALRHIVRIPIEE

SEQ ID NO: 1080818 - protein, 19 aa, Mycobacterium
VAGRKFRWQTLADGKPVIT

SEQ ID NO: 1080819 - protein, 25 aa, Mycobacterium
VAGRVDSTYLYSTPVRRIVADSWRR

SEQ ID NO: 1080820 - protein, 31 aa, Mycobacterium
VAGRYRSFALGRHQARILLAKNPAGWQEALS

SEQ ID NO: 1080821 - protein, 29 aa, Mycobacterium
VAGSSLTVFSGYRFLRHAAARGIPVAIIN

SEQ ID NO: 1080822 - protein, 24 aa, Mycobacterium
VAGVGMDWRAVYAGWGARLVELPT

SEQ ID NO: 1080823 - protein, 24 aa, Mycobacterium
VAHAYLTAMPMLVITGQKAVRDNR

SEQ ID NO: 1080824 - protein, 25 aa, Mycobacterium
VAHGWIPPGIALPQGVRLLPPKRRS

SEQ ID NO: 1080825 - protein, 20 aa, Mycobacterium
VAHLARLARLALTEDELDSF

SEQ ID NO: 1080826 - protein, 24 aa, Mycobacterium
VAHPNIALIKYWGKRDEEFMPPMT

SEQ ID NO: 1080827 - protein, 24 aa, Mycobacterium
VAIARAFVNRPLVLLADEPTGNLD

SEQ ID NO: 1080828 - protein, 22 aa, Mycobacterium
VAIVDVLRILLSNPAVWEKTAL

SEQ ID NO: 1080829 - protein, 22 aa, Mycobacterium
VAKLRPMPVGRHTFFTREEGVT

SEQ ID NO: 1080830 - protein, 25 aa, Mycobacterium
VAKMGEMGLFGLPFPEEYGGMGGDY

SEQ ID NO: 1080831 - protein, 24 aa, Mycobacterium
VAKNMIQAFFFDLQAINAGKSRPD

SEQ ID NO: 1080832 - protein, 24 aa, Mycobacterium
VAKPDLLQLITTDSAPIITRASAR

SEQ ID NO: 1080833 - protein, 20 aa, Mycobacterium
VAKRLWRDSGLKPADIQTAF

SEQ ID NO: 1080834 - protein, 17 aa, Mycobacterium
VAKTLLAGVPLVVVPGG

SEQ ID NO: 1080835 - protein, 19 aa, Mycobacterium
VALAHHSGYRTMISHRSGE

SEQ ID NO: 1080836 - protein, 21 aa, Mycobacterium
VALAKMILRTAARLPIMPIER

SEQ ID NO: 1080837 - protein, 20 aa, Mycobacterium
VALALAKRGLPADTALMTGA

SEQ ID NO: 1080838 - protein, 18 aa, Mycobacterium
VALCAGVLRRFLLERGEL

SEQ ID NO: 1080839 - protein, 32 aa, Mycobacterium; identical to SEQ ID NO: 870231

SEQ ID NO: 1080840 - protein, 28 aa, Mycobacterium
VALHSCAAALPWDLLQRSGISAVSVDVA

SEQ ID NO: 1080841 - protein, 18 aa, Mycobacterium
VALPGPLRRWSEGLALLI

SEQ ID NO: 1080842 - protein, 25 aa, Mycobacterium
VALQNLLPCIYLVDSGGAFLPHQDE

SEQ ID NO: 1080843 - protein, 28 aa, Mycobacterium
VALRFEAAGYRVLALFLSACSAPGHIKY

SEQ ID NO: 1080844 - protein, 23 aa, Mycobacterium
VALTIGPWTHSQLLSKGLAVSAQ

SEQ ID NO: 1080845 - protein, 23 aa, Mycobacterium
VALVNSWSAAFARYGRAVGQVLL

SEQ ID NO: 1080846 - protein, 24 aa, Mycobacterium
VALVNSWSAAFARYGRAVGQVLLT

SEQ ID NO: 1080847 - protein, 24 aa, Mycobacterium
VALVNSWSAAFARYGRTVGQVLLT

SEQ ID NO: 1080848 - protein, 21 aa, Mycobacterium
VALWGRPLIGVRAGSAAPRGP

SEQ ID NO: 1080849 - protein, 24 aa, Mycobacterium
VAMGKGEASLWLEDFRGETTATMV

SEQ ID NO: 1080850 - protein, 17 aa, Mycobacterium
VAMGYWRNPQLTERTFD

SEQ ID NO: 1080851 - protein, 34 aa, Mycobacterium; identical to SEQ ID NO: 870303

SEQ ID NO: 1080852 - protein, 29 aa, Mycobacterium
VAMTLTSRFPIVLWLSPTDLFLMYNDAYA

SEQ ID NO: 1080853 - protein, 26 aa, Mycobacterium
VANAGVFGWGRLWELTDEQWDTVIGV

SEQ ID NO: 1080854 - protein, 26 aa, Mycobacterium
VAPAIISLTLLPKLSARAAARYYLTG

SEQ ID NO: 1080855 - protein, 24 aa, Mycobacterium
VAPGQLAIAAFSPPLDKVGNSVRA

SEQ ID NO: 1080856 - protein, 28 aa, Mycobacterium
VAPIAALIRMLWCVDPHLDLLGRHRWRS

SEQ ID NO: 1080857 - protein, 17 aa, Mycobacterium
VAPLTMKPDVCWQLPIR

SEQ ID NO: 1080858 - protein, 20 aa, Mycobacterium
VAPMTFVSILAKLVQSDFFR

SEQ ID NO: 1080859 - protein, 17 aa, Mycobacterium
VAPQRLWGRAHEIAATI

SEQ ID NO: 1080860 - protein, 24 aa, Mycobacterium
VAQGISVYAALRRAADTRCETGAP

SEQ ID NO: 1080861 - protein, 18 aa, Mycobacterium
VAQLLYAGAPRTLDPIFA

SEQ ID NO: 1080862 - protein, 27 aa, Mycobacterium
VAQQPHRGFVVLPLTKRDLADVAYVQA

SEQ ID NO: 1080863 - protein, 26 aa, Mycobacterium
VAQRVPYLQVWNLTCQAAAVVPWDFD

SEQ ID NO: 1080864 - protein, 24 aa, Mycobacterium
VARAALERGIPVLRPSRPNSAEFV

SEQ ID NO: 1080865 - protein, 27 aa, Mycobacterium
VARAGKLPVTLFTAGGIATPADAAMMM

SEQ ID NO: 1080866 - protein, 19 aa, Mycobacterium
VARAVRPPTPGRRLPKSLT

SEQ ID NO: 1080867 - protein, 27 aa, Mycobacterium
VAREAILRIFGPLLDAAPTLGAGLDWK

SEQ ID NO: 1080868 - protein, 20 aa, Mycobacterium
VARFLPYFTDVIVGDLRAGK

SEQ ID NO: 1080869 - protein, 21 aa, Mycobacterium
VARGSFFPVIPVCASTGVGTL

SEQ ID NO: 1080870 - protein, 23 aa, Mycobacterium
VARHRRFRFYLNVEIGRQLSHAD

SEQ ID NO: 1080871 - protein, 17 aa, Mycobacterium
VARLNWVKQGPAPAPVT

SEQ ID NO: 1080872 - protein, 17 aa, Mycobacterium
VARLRQRFAKLQDPPSD

SEQ ID NO: 1080873 - protein, 17 aa, Mycobacterium
VARMPLARALRSAQRHD

SEQ ID NO: 1080874 - protein, 22 aa, Mycobacterium
VARPDLLALGALLHDIGKGRGA

SEQ ID NO: 1080875 - protein, 19 aa, Mycobacterium
VARPYLIPSESMEPTLHGC

SEQ ID NO: 1080876 - protein, 24 aa, Mycobacterium
VARRGGIVVLPQDLPIPAVHQTVE

SEQ ID NO: 1080877 - protein, 20 aa, Mycobacterium
VARRLAGLFASYARQRPRVL

SEQ ID NO: 1080878 - protein, 25 aa, Mycobacterium
VARRRMAQWLTAIGVEPVRKGAILL

SEQ ID NO: 1080879 - protein, 18 aa, Mycobacterium
VARTAAGVFYQRLRELYA

SEQ ID NO: 1080880 - protein, 24 aa, Mycobacterium
VARVHVRSWQWAFRGLISQDYLDN

SEQ ID NO: 1080881 - protein, 20 aa, Mycobacterium
VARWPFAVRKPRTGPPELLY

SEQ ID NO: 1080882 - protein, 17 aa, Mycobacterium
VARYALGPTLADMAIES

SEQ ID NO: 1080883 - protein, 25 aa, Mycobacterium
VASATPLPVIGVPVPLARLDGLDSL

SEQ ID NO: 1080884 - protein, 38 aa, Mycobacterium; identical to SEQ ID NO: 870487

SEQ ID NO: 1080885 - protein, 22 aa, Mycobacterium
VASFYTMYRRGPTGEYLVGVCT

SEQ ID NO: 1080886 - protein, 27 aa, Mycobacterium
VASHKYDLRAAARLGLRTAFVARPLEF

SEQ ID NO: 1080887 - protein, 26 aa, Mycobacterium
VASKGYCFQIDLTWRTVNNGFVIIEV

SEQ ID NO: 1080888 - protein, 18 aa, Mycobacterium
VASKWAVRGLTKSAALEL

SEQ ID NO: 1080889 - protein, 21 aa, Mycobacterium
VATALAWTHLGMTPPAGANQP

SEQ ID NO: 1080890 - protein, 25 aa, Mycobacterium
VATETFAPILYVLTYDDLDDAIALN

SEQ ID NO: 1080891 - protein, 25 aa, Mycobacterium
VATHLFNAMAPLGHREPGPALALLK

SEQ ID NO: 1080892 - protein, 17 aa, Mycobacterium
VATSFPSFSKRTFNLLI

SEQ ID NO: 1080893 - protein, 20 aa, Mycobacterium
VAVARLVLGPAMRIQAPPNL

SEQ ID NO: 1080894 - protein, 21 aa, Mycobacterium
VAVARLVLGPAMRIQAPPNLV

SEQ ID NO: 1080895 - protein, 24 aa, Mycobacterium
VAVASFFAKNFLPLLTSTREVIDT

SEQ ID NO: 1080896 - protein, 23 aa, Mycobacterium
VAVDFHKLLFQAISCSALLVRDA

SEQ ID NO: 1080897 - protein, 26 aa, Mycobacterium
VAVDILEMLPTPWGLVRSGVAPDHPK

SEQ ID NO: 1080898 - protein, 38 aa, Mycobacterium
VAVELGRRLPACEPALVTPLGPVLALHVGAEAVAVCVQ

SEQ ID NO: 1080899 - protein, 26 aa, Mycobacterium
VAVHDLTLAVLPGMIERRAGGILISG

SEQ ID NO: 1080900 - protein, 24 aa, Mycobacterium
VAVLLRITEVFGVDATFFSSQDDT

SEQ ID NO: 1080901 - protein, 26 aa, Mycobacterium
VAVQRALLVAIWNIATTNTGYHDPGG

SEQ ID NO: 1080902 - protein, 17 aa, Mycobacterium
VAVRYPAGINWVLAFWG

SEQ ID NO: 1080903 - protein, 29 aa, Mycobacterium
VAVSDLEFIQFHPTMLFAAGTGTGGRRPL

SEQ ID NO: 1080904 - protein, 23 aa, Mycobacterium
VAVSRLEAIFANSPLVRQIFVYA

SEQ ID NO: 1080905 - protein, 21 aa, Mycobacterium
VAVVQRGFGRPSTGRCVVVER

SEQ ID NO: 1080906 - protein, 18 aa, Mycobacterium
VAWDFIHATGFLGGQITL

SEQ ID NO: 1080907 - protein, 37 aa, Mycobacterium
VCANTWNLPYPRSVAAFPAPWLVTDKYWPPVRRIDGV

SEQ ID NO: 1080908 - protein, 25 aa, Mycobacterium
VCEYLPGKAMVMQMLVRYVDGDLGR

SEQ ID NO: 1080909 - protein, 21 aa, Mycobacterium
VCGIALPPGLVGASKFAEPLF

SEQ ID NO: 1080910 - protein, 18 aa, Mycobacterium
VCMDQFLVDLGPGPLDVA

SEQ ID NO: 1080911 - protein, 23 aa, Mycobacterium
VCQDFAHLSLIVLRGMGIPARYV

SEQ ID NO: 1080912 - protein, 18 aa, Mycobacterium
VCRRAGIPVIADGGLQYS

SEQ ID NO: 1080913 - protein, 30 aa, Mycobacterium; identical to SEQ ID NO: 870700

SEQ ID NO: 1080914 - protein, 28 aa, Mycobacterium
VDAADWAEMLMRMYVRWAEQHKYPVEVF

SEQ ID NO: 1080915 - protein, 24 aa, Mycobacterium
VDAALRIIKPLRKLIKPKVYGIEN

SEQ ID NO: 1080916 - protein, 20 aa, Mycobacterium
VDAARSWLLGTPADDWVSMA

SEQ ID NO: 1080917 - protein, 24 aa, Mycobacterium
VDADLFTFGKVMSGGLPAAAFGGR

SEQ ID NO: 1080918 - protein, 24 aa, Mycobacterium
VDADRPFVEYGLDSLGMLEMRTHI

SEQ ID NO: 1080919 - protein, 31 aa, Mycobacterium; identical to SEQ ID NO: 122924

SEQ ID NO: 1080920 - protein, 27 aa, Mycobacterium
VDAQFYWMSAKMPNDQFLLYAFDGRPA

SEQ ID NO: 1080921 - protein, 24 aa, Mycobacterium
VDASLVHHYYGTKQQLFAAAIQIP

SEQ ID NO: 1080922 - protein, 18 aa, Mycobacterium
VDCRFCHVTVTVKQLGPG

SEQ ID NO: 1080923 - protein, 22 aa, Mycobacterium
VDDALWRRFKAAQDAFFTARNA

SEQ ID NO: 1080924 - protein, 33 aa, Mycobacterium; identical to SEQ ID NO: 870779

SEQ ID NO: 1080925 - protein, 25 aa, Mycobacterium
VDDARQLWRSMAGRCGHLYTGHSVV

SEQ ID NO: 1080926 - protein, 30 aa, Mycobacterium
VDDIATFDLYSCFPVPVFNICDGLGIATDD

SEQ ID NO: 1080927 - protein, 17 aa, Mycobacterium
VDDLAAYAQPYLSRLWA

SEQ ID NO: 1080928 - protein, 23 aa, Mycobacterium
VDDLNPLIMPVDAEFRVGTMGLG

SEQ ID NO: 1080929 - protein, 18 aa, Mycobacterium
VDDPRIALLSATGSVRMG

SEQ ID NO: 1080930 - protein, 23 aa, Mycobacterium
VDDWWEYGWLFHAMNTNKRSVTL

SEQ ID NO: 1080931 - protein, 25 aa, Mycobacterium
VDEAAEMMIDLLWRGLKGAPSDREI

SEQ ID NO: 1080932 - protein, 36 aa, Mycobacterium; identical to SEQ ID NO: 870837

SEQ ID NO: 1080933 - protein, 23 aa, Mycobacterium
VDELPYLTLRLTGVASLTVDVKR

SEQ ID NO: 1080934 - protein, 30 aa, Mycobacterium; identical to SEQ ID NO: 870851

SEQ ID NO: 1080935 - protein, 23 aa, Mycobacterium
VDEVHGFRFFDNRDLLGFVDGTE

SEQ ID NO: 1080936 - protein, 23 aa, Mycobacterium
VDFVGWYNAHPHFEQMAPDLSGA

SEQ ID NO: 1080937 - protein, 25 aa, Mycobacterium
VDGDTGPTRQGWRGRLRNRMRRSGR

SEQ ID NO: 1080938 - protein, 23 aa, Mycobacterium
VDGFGYALLVNRIALVYSELSSG

SEQ ID NO: 1080939 - protein, 24 aa, Mycobacterium
VDGPATLRRLGLAATLRAGPAIVE

SEQ ID NO: 1080940 - protein, 52 aa, Mycobacterium; identical to SEQ ID NO: 870916

SEQ ID NO: 1080941 - protein, 21 aa, Mycobacterium
VDGQLVIIGMQGGIKAELNLG

SEQ ID NO: 1080942 - protein, 18 aa, Mycobacterium
VDGSPWIGNIDLSFPYLD

SEQ ID NO: 1080943 - protein, 26 aa, Mycobacterium
VDGVPTATWGWLSLATGLAVVDTVTP

SEQ ID NO: 1080944 - protein, 24 aa, Mycobacterium
VDGYPYRQRPTPIPTLEQAISAVP

SEQ ID NO: 1080945 - protein, 20 aa, Mycobacterium
VDHLFGTIWTRPGLSMRDRR

SEQ ID NO: 1080946 - protein, 17 aa, Mycobacterium
VDIPLQAYFRINTENMG

SEQ ID NO: 1080947 - protein, 25 aa, Mycobacterium
VDIRERWAIREVALHILLDGVDLRD

SEQ ID NO: 1080948 - protein, 25 aa, Mycobacterium
VDKPASALLFFLASSRILNRRKGVR

SEQ ID NO: 1080949 - protein, 27 aa, Mycobacterium
VDLAREKLLADVLRAASRDGLVSAAHD

SEQ ID NO: 1080950 - protein, 29 aa, Mycobacterium
VDLEPTFIDRLFMGSLVPLTSFTVNLDGV

SEQ ID NO: 1080951 - protein, 20 aa, Mycobacterium
VDLNVNGTMYVLKHAAREMV

SEQ ID NO: 1080952 - protein, 26 aa, Mycobacterium
VDLVILARYMQILSPTFLDAIGCPLI

SEQ ID NO: 1080953 - protein, 24 aa, Mycobacterium
VDNHGSVYVIDYHDRVLKLPAQSN

SEQ ID NO: 1080954 - protein, 22 aa, Mycobacterium
VDPDPIFIRSSPKVWTAAGVTA

SEQ ID NO: 1080955 - protein, 22 aa, Mycobacterium
VDPGMWETIVLNLLSNAVKYTM

SEQ ID NO: 1080956 - protein, 21 aa, Mycobacterium
VDPIQASSLPFFGDLELELFR

SEQ ID NO: 1080957 - protein, 30 aa, Mycobacterium
VDPPALPDPLPTGPTRRVPLGLIAGARSGD

SEQ ID NO: 1080958 - protein, 24 aa, Mycobacterium
VDPPFRAMIIQIDDDRLILGMNYH

SEQ ID NO: 1080959 - protein, 27 aa, Mycobacterium
VDPSANPYLASAAILGLALDGIQRKVS

SEQ ID NO: 1080960 - protein, 22 aa, Mycobacterium
VDPSLIYHYFGSKEGLLDAATM

SEQ ID NO: 1080961 - protein, 22 aa, Mycobacterium
VDQASGMSTFSLGLADIGQANV

SEQ ID NO: 1080962 - protein, 21 aa, Mycobacterium
VDQGLSLTLFFKDTATTRDVN

SEQ ID NO: 1080963 - protein, 19 aa, Mycobacterium
VDRACAPWGLLGEDKQATL

SEQ ID NO: 1080964 - protein, 28 aa, Mycobacterium
VDRAIDYRRDGWWKGLDSYDLVLDALGD

SEQ ID NO: 1080965 - protein, 28 aa, Mycobacterium
VDRALTILSQAQRPLIVLGKGAAYAQAD

SEQ ID NO: 1080966 - protein, 18 aa, Mycobacterium
VDRIRRRYGNSALTRAVL

SEQ ID NO: 1080967 - protein, 24 aa, Mycobacterium
VDRMWSPDIAVWRVGARRDNDKAR

SEQ ID NO: 1080968 - protein, 33 aa, Mycobacterium; identical to SEQ ID NO: 871117

SEQ ID NO: 1080969 - protein, 19 aa, Mycobacterium
VDRRRIFGPLINQENRLLT

SEQ ID NO: 1080970 - protein, 24 aa, Mycobacterium
VDRSGFAFQPLLGGLSPEEGWKSL

SEQ ID NO: 1080971 - protein, 26 aa, Mycobacterium
VDRSTIILAMWQYLLHRYTSQDTVVV

SEQ ID NO: 1080972 - protein, 21 aa, Mycobacterium
VDSLIELGGKVWRFVDTAGLR

SEQ ID NO: 1080973 - protein, 24 aa, Mycobacterium
VDSTALYPPKRFLGAARNIEEGGS

SEQ ID NO: 1080974 - protein, 20 aa, Mycobacterium
VDTAWFKGNYPPEVSIEALA

SEQ ID NO: 1080975 - protein, 27 aa, Mycobacterium
VDVDDLPRLPWWLRPMARFQADDHFIS

SEQ ID NO: 1080976 - protein, 25 aa, Mycobacterium
VDVFKEKLIRRDISMKAFDAGEPQA

SEQ ID NO: 1080977 - protein, 30 aa, Mycobacterium; identical to SEQ ID NO: 871197

SEQ ID NO: 1080978 - protein, 17 aa, Mycobacterium
VDVMRPITKFAAKIPSG

SEQ ID NO: 1080979 - protein, 23 aa, Mycobacterium
VDVRPEIALPDLTGLSVSVDAIE

SEQ ID NO: 1080980 - protein, 30 aa, Mycobacterium
VDVRYQDRLLLPLPMFHVAALTTVIMCAMR

SEQ ID NO: 1080981 - protein, 30 aa, Mycobacterium
VDVTLNGRQWLTDLHIEEGLLRLGAEAVEQ

SEQ ID NO: 1080982 - protein, 25 aa, Mycobacterium
VDWDELPRWTMIDKALGLGSPDPAE

SEQ ID NO: 1080983 - protein, 18 aa, Mycobacterium
VDWHREIVERWRAAGVRM

SEQ ID NO: 1080984 - protein, 38 aa, Mycobacterium
VDYALALSAIAAFRRAIQSWWHDGWDLLLTPTVASLPV

SEQ ID NO: 1080985 - protein, 19 aa, Mycobacterium
VDYYSFFLSGGFQGPPGRA

SEQ ID NO: 1080986 - protein, 24 aa, Mycobacterium
VEAFSLFRVSKLNCLITTSDGTVL

SEQ ID NO: 1080987 - protein, 23 aa, Mycobacterium
VEAHLQVLLAEHVQLLGEGYTLV

SEQ ID NO: 1080988 - protein, 18 aa, Mycobacterium
VEALDRHRLLSDVTRVLA

SEQ ID NO: 1080989 - protein, 24 aa, Mycobacterium
VEALIGVFDKIGVKTGIDFFDIAD

SEQ ID NO: 1080990 - protein, 25 aa, Mycobacterium
VEDFDRVIGINLRGAWLCTKHAAPK

SEQ ID NO: 1080991 - protein, 19 aa, Mycobacterium
VEDLLLFSDETLCRAIAAC

SEQ ID NO: 1080992 - protein, 28 aa, Mycobacterium
VEDRRLRQVWPRYDAMRIELAVGQLCDL

SEQ ID NO: 1080993 - protein, 22 aa, Mycobacterium
VEDTMHFAVLSGVRAWIEERPL

SEQ ID NO: 1080994 - protein, 26 aa, Mycobacterium
VEDVANMAMFLLSDAASFVTGQVINV

SEQ ID NO: 1080995 - protein, 26 aa, Mycobacterium
VEDVFPLPRELVGQGTLFLLKVVGES

SEQ ID NO: 1080996 - protein, 24 aa, Mycobacterium
VEEDGAVYQMRRWYEQFYVDAADV

SEQ ID NO: 1080997 - protein, 22 aa, Mycobacterium
VEEERRLLYVGVTRARVHLALT

SEQ ID NO: 1080998 - protein, 21 aa, Mycobacterium
VEEFGFHVGLAQLAGNALLDL

SEQ ID NO: 1080999 - protein, 21 aa, Mycobacterium
VEELLRYLSIIQNGQRRVAHE

SEQ ID NO: 1081000 - protein, 19 aa, Mycobacterium
VEETLRYEAPFRAHYRHVR

SEQ ID NO: 1081001 - protein, 23 aa, Mycobacterium
VEFMMLDRLFPRSVYYSLRMAEH

SEQ ID NO: 1081002 - protein, 23 aa, Mycobacterium
VEGFGVRLRKGDIVLPGSCTFAV

SEQ ID NO: 1081003 - protein, 23 aa, Mycobacterium
VEGRRYLDCLSAYSAVNFGHCNP

SEQ ID NO: 1081004 - protein, 26 aa, Mycobacterium
VEHFILEDWWGRWLGRWTAEEHLHAI

SEQ ID NO: 1081005 - protein, 23 aa, Mycobacterium
VEHLFREGRLLGWSTPATGVLVQ

SEQ ID NO: 1081006 - protein, 29 aa, Mycobacterium
VEHYVTTKEPWFLDAYRRAWEWADSTGWR

SEQ ID NO: 1081007 - protein, 27 aa, Mycobacterium
VEIKKQMMNWWGPIIDEYYASSEAIGS

SEQ ID NO: 1081008 - protein, 20 aa, Mycobacterium
VELAARRRPGNLEIAYLACA

SEQ ID NO: 1081009 - protein, 17 aa, Mycobacterium
VELISPEGLYRLTPRTG

SEQ ID NO: 1081010 - protein, 18 aa, Mycobacterium
VELLWKLIEQSPGLEITV

SEQ ID NO: 1081011 - protein, 25 aa, Mycobacterium
VELNADPYPMFRRLREEAPLYYNAQ

SEQ ID NO: 1081012 - protein, 17 aa, Mycobacterium
VELRRAICARFIREPRY

SEQ ID NO: 1081013 - protein, 21 aa, Mycobacterium
VELRRTAYLQRMSTVIGRRVW

SEQ ID NO: 1081014 - protein, 21 aa, Mycobacterium
VELWKQFAPDDYAKALRRVPM

SEQ ID NO: 1081015 - protein, 23 aa, Mycobacterium
VEMFAQIYNLERDPAPRPTPPLP

SEQ ID NO: 1081016 - protein, 18 aa, Mycobacterium
VEMFRKLLDQGQAGDNVG

SEQ ID NO: 1081017 - protein, 25 aa, Mycobacterium
VEMQNGFLLLMRVGDGSHLAALAVT

SEQ ID NO: 1081018 - protein, 40 aa, Mycobacterium
VENPRVHLFFGARYFCELYDLRTLWHVAAHNPWLSVSPVA

SEQ ID NO: 1081019 - protein, 17 aa, Mycobacterium
VENRGGPPRLRFVAVGR

SEQ ID NO: 1081020 - protein, 24 aa, Mycobacterium
VEPLKLMPEPVPPAPPAPLYPESP

SEQ ID NO: 1081021 - protein, 19 aa, Mycobacterium
VEPSAPLPEFWVNRARRKI

SEQ ID NO: 1081022 - protein, 29 aa, Mycobacterium
VEQPGQMRLLIVVDKLLTGFDAPSATYLY

SEQ ID NO: 1081023 - protein, 19 aa, Mycobacterium
VEQPPIVVLWASQTGTAEE

SEQ ID NO: 1081024 - protein, 24 aa, Mycobacterium
VEQRQPLWYLMPDGVVQYVFKRRL

SEQ ID NO: 1081025 - protein, 23 aa, Mycobacterium
VERAEVPWLEPLPDLMADPADPS

SEQ ID NO: 1081026 - protein, 26 aa, Mycobacterium
VERCHVSSFPAWRRASEPRWTRACTP

SEQ ID NO: 1081027 - protein, 17 aa, Mycobacterium
VERFIDVQLLIVGRGDE

SEQ ID NO: 1081028 - protein, 20 aa, Mycobacterium
VERIGLRYVLEIRVPAGVDG

SEQ ID NO: 1081029 - protein, 25 aa, Mycobacterium
VERRYRTWIRWNAAIMVHRAQRPGV

SEQ ID NO: 1081030 - protein, 24 aa, Mycobacterium
VESFGFKYGLPMDADMVMDVRFLP

SEQ ID NO: 1081031 - protein, 25 aa, Mycobacterium
VESGELPWSIVALGLSSVAPQQPPT

SEQ ID NO: 1081032 - protein, 22 aa, Mycobacterium
VESLSHPLIDHVRGRGLLLGIV

SEQ ID NO: 1081033 - protein, 17 aa, Mycobacterium
VETLGHRRGFLQFRWQR

SEQ ID NO: 1081034 - protein, 24 aa, Mycobacterium
VETMLRVPDIRALLQRHLAGRPTR

SEQ ID NO: 1081035 - protein, 24 aa, Mycobacterium
VETSKPEPLIRDPYARMLVTNANA

SEQ ID NO: 1081036 - protein, 23 aa, Mycobacterium
VETVPRVFKRIRPAFTYQRSLDV

SEQ ID NO: 1081037 - protein, 20 aa, Mycobacterium
VEVCREEMLRLGRTPVPASV

SEQ ID NO: 1081038 - protein, 34 aa, Mycobacterium; identical to SEQ ID NO: 871659

SEQ ID NO: 1081039 - protein, 21 aa, Mycobacterium
VEVLLLSELLTEALHSGAARM

SEQ ID NO: 1081040 - protein, 31 aa, Mycobacterium
VEVPELRLPVLATSLFWVSSSILNELGWRGL

SEQ ID NO: 1081041 - protein, 29 aa, Mycobacterium
VEVRLSRYSYLVSLLPPQIIKDLGAPVRL

SEQ ID NO: 1081042 - protein, 17 aa, Mycobacterium
VEVVVGENFTFGKKAAG

SEQ ID NO: 1081043 - protein, 29 aa, Mycobacterium
VEWISAVMTLLPGDLILTGTPAGVGPIED

SEQ ID NO: 1081044 - protein, 20 aa, Mycobacterium
VEYALWWRIGYHPAVVEGLR

SEQ ID NO: 1081045 - protein, 17 aa, Mycobacterium
VEYRIEYRFTRTGLQIA

SEQ ID NO: 1081046 - protein, 17 aa, Mycobacterium
VFAARLPGDPARYLRTG

SEQ ID NO: 1081047 - protein, 17 aa, Mycobacterium
VFAKTPPTVVMLAGLQG

SEQ ID NO: 1081048 - protein, 17 aa, Mycobacterium
VFAMIAVDLSRLAEDII

SEQ ID NO: 1081049 - protein, 21 aa, Mycobacterium
VFDDITLALMVHPGPTDIAGA

SEQ ID NO: 1081050 - protein, 36 aa, Mycobacterium
VFDGPTIDRPLYRFPVFGFFALSIGAAALGNARAAI

SEQ ID NO: 1081051 - protein, 18 aa, Mycobacterium
VFDGYRPWAGEIRARHTG

SEQ ID NO: 1081052 - protein, 34 aa, Mycobacterium
VFDLRPGAIIRDLNLLRPIYAPTAAYGHFGRTDV

SEQ ID NO: 1081053 - protein, 18 aa, Mycobacterium
VFEHRAVVVGVDRTQLIQ

SEQ ID NO: 1081054 - protein, 22 aa, Mycobacterium
VFGNGMLLSKHIRLIAAFDHRH

SEQ ID NO: 1081055 - protein, 18 aa, Mycobacterium
VFIEDIHPAWTLEEAVVE

SEQ ID NO: 1081056 - protein, 26 aa, Mycobacterium
VFIMGDCDQLMPEYLRFVKGVVDAQD

SEQ ID NO: 1081057 - protein, 18 aa, Mycobacterium
VFMGLGEPLANYARVLAA

SEQ ID NO: 1081058 - protein, 19 aa, Mycobacterium
VFNHWYGPIPPIKEVRDQT

SEQ ID NO: 1081059 - protein, 20 aa, Mycobacterium
VFRDMLGLHFAPTRPVEDQL

SEQ ID NO: 1081060 - protein, 20 aa, Mycobacterium
VFRIVNQLPRKVAMEMLLTG

SEQ ID NO: 1081061 - protein, 28 aa, Mycobacterium
VFSDHVALPFKWAFPRVFRAFAEEDLHH

SEQ ID NO: 1081062 - protein, 17 aa, Mycobacterium
VFTGGTLIRRTGAATRS

SEQ ID NO: 1081063 - protein, 17 aa, Mycobacterium
VFTTAYYAFVHLANVQP

SEQ ID NO: 1081064 - protein, 17 aa, Mycobacterium
VFVLAATSNPEGATIQR

SEQ ID NO: 1081065 - protein, 21 aa, Mycobacterium
VFVPQGRTFGLFAREPRRGSS

SEQ ID NO: 1081066 - protein, 26 aa, Mycobacterium
VFVQLVRSNFFGFNAPAIMAAESQYE

SEQ ID NO: 1081067 - protein, 18 aa, Mycobacterium
VFVQLVTSNLFGQNAPAI

SEQ ID NO: 1081068 - protein, 18 aa, Mycobacterium
VFVTGWRGPAVKTLTLDQ

SEQ ID NO: 1081069 - protein, 17 aa, Mycobacterium
VFVTHDFGEAVKLGDRI

SEQ ID NO: 1081070 - protein, 24 aa, Mycobacterium
VGAALGRLLIADALAQLSGEHRAV

SEQ ID NO: 1081071 - protein, 28 aa, Mycobacterium
VGAITPWNFPHQINLAKLGPALAAGNTV

SEQ ID NO: 1081072 - protein, 17 aa, Mycobacterium
VGALLGDPLLGVPFSAP

SEQ ID NO: 1081073 - protein, 28 aa, Mycobacterium
VGALNTPTQAIFGRPLIGDGANGTATSP

SEQ ID NO: 1081074 - protein, 23 aa, Mycobacterium
VGAPAGPLPAYRSDLRPPTVAPP

SEQ ID NO: 1081075 - protein, 25 aa, Mycobacterium
VGAPGLIIAAWDRRLHTGAQAARCR

SEQ ID NO: 1081076 - protein, 25 aa, Mycobacterium
VGASRKRFLGSLLAGPDGAVRPPDG

SEQ ID NO: 1081077 - protein, 18 aa, Mycobacterium
VGASWWLREQGTPVNTLQ

SEQ ID NO: 1081078 - protein, 19 aa, Mycobacterium
VGDGLRRWLSGTETTILRS

SEQ ID NO: 1081079 - protein, 23 aa, Mycobacterium
VGDHVAYLLEPIAVWAPDAPEEL

SEQ ID NO: 1081080 - protein, 26 aa, Mycobacterium
VGDNIGIVPRLLKWDKNRVAARIDEL

SEQ ID NO: 1081081 - protein, 23 aa, Mycobacterium
VGDQEFIKFRVASNSRRRTADGG

SEQ ID NO: 1081082 - protein, 20 aa, Mycobacterium
VGDVRGEGFFYGIELVKDKD

SEQ ID NO: 1081083 - protein, 19 aa, Mycobacterium
VGEAAQFLRWTAAQAPEAA

SEQ ID NO: 1081084 - protein, 30 aa, Mycobacterium
VGEFAPYVDMTLWPKFDYASAANAGIDDVT

SEQ ID NO: 1081085 - protein, 25 aa, Mycobacterium
VGEKAPLEHLLIERAYRLGVTAPEM

SEQ ID NO: 1081086 - protein, 25 aa, Mycobacterium
VGERSWRIPATAFWQSHRDAAKVCS

SEQ ID NO: 1081087 - protein, 17 aa, Mycobacterium
VGETYRRQPMIVPTVIE

SEQ ID NO: 1081088 - protein, 17 aa, Mycobacterium
VGFADFLIRDRERYRIT

SEQ ID NO: 1081089 - protein, 17 aa, Mycobacterium
VGFGNAYYDSTTGQFTF

SEQ ID NO: 1081090 - protein, 17 aa, Mycobacterium
VGFGQLPTPLTGQGSQD

SEQ ID NO: 1081091 - protein, 22 aa, Mycobacterium
VGFVGFQIPRLERRAVGALINV

SEQ ID NO: 1081092 - protein, 27 aa, Mycobacterium
VGGAGGAHHFLLGTGGAGGVGGAGGNS

SEQ ID NO: 1081093 - protein, 23 aa, Mycobacterium
VGGAGGLFGGGLGGAGGAGVSAS

SEQ ID NO: 1081094 - protein, 19 aa, Mycobacterium
VGGDWYSVTPLAHPGRIAI

SEQ ID NO: 1081095 - protein, 20 aa, Mycobacterium
VGGGAYWRGGAAAGAGATGA

SEQ ID NO: 1081096 - protein, 17 aa, Mycobacterium
VGGGWVGYLSYPDPGAD

SEQ ID NO: 1081097 - protein, 23 aa, Mycobacterium
VGGRAKYMWVSTFHSTCVRILRN

SEQ ID NO: 1081098 - protein, 20 aa, Mycobacterium
VGGRGGLVYGNGGVGGAGGQ

SEQ ID NO: 1081099 - protein, 26 aa, Mycobacterium
VGGSGGAGGLLFGNGGDGGAGGDDGV

SEQ ID NO: 1081100 - protein, 17 aa, Mycobacterium
VGGTWRANRYPGCSVDI

SEQ ID NO: 1081101 - protein, 17 aa, Mycobacterium
VGGTWRINTYPGLACDV

SEQ ID NO: 1081102 - protein, 17 aa, Mycobacterium
VGGWWCSRWWVGCDGGC

SEQ ID NO: 1081103 - protein, 21 aa, Mycobacterium
VGHDPAFVPAFDIPGAEELLN

SEQ ID NO: 1081104 - protein, 26 aa, Mycobacterium
VGHHCALPLHRKFGVAATARASFAVY

SEQ ID NO: 1081105 - protein, 17 aa, Mycobacterium
VGHTLPYTLAAEGLCGE

SEQ ID NO: 1081106 - protein, 27 aa, Mycobacterium
VGKGTLFRRFGSRAGLMMVLLDEDERA

SEQ ID NO: 1081107 - protein, 25 aa, Mycobacterium
VGKPGWPGFVSVPLAAYRRHFETSV

SEQ ID NO: 1081108 - protein, 20 aa, Mycobacterium
VGKVVLTMPDAWAAGTVLIT

SEQ ID NO: 1081109 - protein, 18 aa, Mycobacterium
VGLGSVRYLLAVGDLIIG

SEQ ID NO: 1081110 - protein, 19 aa, Mycobacterium
VGLILTQWATHLGARVIST

SEQ ID NO: 1081111 - protein, 25 aa, Mycobacterium
VGLLNVQYALKDDILYVLEANPRAS

SEQ ID NO: 1081112 - protein, 23 aa, Mycobacterium
VGLRDVLAALHWVRENIATFGGD

SEQ ID NO: 1081113 - protein, 18 aa, Mycobacterium
VGLRNWMDSAREGHLAWG

SEQ ID NO: 1081114 - protein, 30 aa, Mycobacterium; identical to SEQ ID NO: 872189

SEQ ID NO: 1081115 - protein, 21 aa, Mycobacterium
VGMALFIDLQLTVPGGNVLST

SEQ ID NO: 1081116 - protein, 26 aa, Mycobacterium
VGMGRALIGPLRIGLQRKGVPVQLNT

SEQ ID NO: 1081117 - protein, 18 aa, Mycobacterium
VGMSPMEYGPRASVADAY

SEQ ID NO: 1081118 - protein, 17 aa, Mycobacterium
VGNGPLAAFIDALGHVG

SEQ ID NO: 1081119 - protein, 25 aa, Mycobacterium
VGNGWYFRELGEVLLWRQSNKLVAG

SEQ ID NO: 1081120 - protein, 23 aa, Mycobacterium
VGNRLVGRPLTHRNPDRQLPSEG

SEQ ID NO: 1081121 - protein, 17 aa, Mycobacterium
VGNYPLSLPINGQALNI

SEQ ID NO: 1081122 - protein, 20 aa, Mycobacterium
VGPAVLLRQTSFRALAEPRL

SEQ ID NO: 1081123 - protein, 30 aa, Mycobacterium; identical to SEQ ID NO: 872228

SEQ ID NO: 1081124 - protein, 30 aa, Mycobacterium; identical to SEQ ID NO: 980168

SEQ ID NO: 1081125 - protein, 26 aa, Mycobacterium
VGPPELYAWLHYEPIPDRDDPAKALI

SEQ ID NO: 1081126 - protein, 17 aa, Mycobacterium
VGQILETHLGWVAKSGW

SEQ ID NO: 1081127 - protein, 18 aa, Mycobacterium
VGQILETHLGWVAKSGWK

SEQ ID NO: 1081128 - protein, 21 aa, Mycobacterium
VGQIYLLDNPLLAEPLVPTHV

SEQ ID NO: 1081129 - protein, 24 aa, Mycobacterium
VGQNLLDHLITPLGFDVAGDSLAA

SEQ ID NO: 1081130 - protein, 25 aa, Mycobacterium
VGRAKTWRGRVGYLLRPPGWSEVAE

SEQ ID NO: 1081131 - protein, 30 aa, Mycobacterium
VGRATAWRLTGLGLWVIAHDPYCADARHGL

SEQ ID NO: 1081132 - protein, 33 aa, Mycobacterium; identical to SEQ ID NO: 872302

SEQ ID NO: 1081133 - protein, 25 aa, Mycobacterium
VGRRLMHVLGTSAFVPDLLMRAPEV

SEQ ID NO: 1081134 - protein, 24 aa, Mycobacterium
VGRRTLYMLITTWDAAGGGPFAAS

SEQ ID NO: 1081135 - protein, 23 aa, Mycobacterium
VGRVNIMTMDYFDPSLQYEGRMG

SEQ ID NO: 1081136 - protein, 29 aa, Mycobacterium
VGSDRARFSPFQKLIILDVPDDKVDELVT

SEQ ID NO: 1081137 - protein, 25 aa, Mycobacterium
VGSEVLYRLHLDLASLSIAEFYADG

SEQ ID NO: 1081138 - protein, 28 aa, Mycobacterium
VGSGPVFLQYPWQVLPDELVKPLEDAAR

SEQ ID NO: 1081139 - protein, 18 aa, Mycobacterium
VGSLWDVVRDRRLNHRPQ

SEQ ID NO: 1081140 - protein, 26 aa, Mycobacterium
VGTEGPVPPPPRAVSVAWAVPAESCS

SEQ ID NO: 1081141 - protein, 32 aa, Mycobacterium
VGTVFAARPDRMSARRFWLRYAADSVGSLTLD

SEQ ID NO: 1081142 - protein, 24 aa, Mycobacterium
VGVFDAFVERLAPGGALVVCADDP

SEQ ID NO: 1081143 - protein, 19 aa, Mycobacterium
VGVFPILGMDWRERESQGE

SEQ ID NO: 1081144 - protein, 41 aa, Mycobacterium; identical to SEQ ID NO: 872393

SEQ ID NO: 1081145 - protein, 20 aa, Mycobacterium
VGVLVGSWHTIEGLVFSMPA

SEQ ID NO: 1081146 - protein, 31 aa, Mycobacterium
VGVQDAINAPFLQFTGRPLVGPGTDGAPGTG

SEQ ID NO: 1081147 - protein, 25 aa, Mycobacterium
VGVTAYDYMLMMSGAVRAEELDAYL

SEQ ID NO: 1081148 - protein, 18 aa, Mycobacterium
VGWPDGSVLPLLYGAPAM

SEQ ID NO: 1081149 - protein, 17 aa, Mycobacterium
VGWRRHIHRYPELGRQE

SEQ ID NO: 1081150 - protein, 19 aa, Mycobacterium
VGWYNAHPNFEHSTPDLSG

SEQ ID NO: 1081151 - protein, 28 aa, Mycobacterium
VGYDIRGLPWDVWKRELLGLGTEGLRKN

SEQ ID NO: 1081152 - protein, 19 aa, Mycobacterium
VGYTALLVAGWRALHAVGP

SEQ ID NO: 1081153 - protein, 21 aa, Mycobacterium
VHAAAYVPYAAPKVEWFGDPA

SEQ ID NO: 1081154 - protein, 22 aa, Mycobacterium
VHDFQVAGPLLPEATRSLRQIG

SEQ ID NO: 1081155 - protein, 17 aa, Mycobacterium
VHDGVIQVLALVSRRGH

SEQ ID NO: 1081156 - protein, 17 aa, Mycobacterium
VHFAALHHPCCGDLVYG

SEQ ID NO: 1081157 - protein, 27 aa, Mycobacterium
VHFKSVVYELLWFLRGDSNVGWLQQHG

SEQ ID NO: 1081158 - protein, 25 aa, Mycobacterium
VHFSQFILAEIFPGGWLPTIPTVEE

SEQ ID NO: 1081159 - protein, 32 aa, Mycobacterium; identical to SEQ ID NO: 872496

SEQ ID NO: 1081160 - protein, 21 aa, Mycobacterium
VHGYLMGGQLWRQVSERLAEW

SEQ ID NO: 1081161 - protein, 39 aa, Mycobacterium
VHHRSTYIFLADRHAGWWRAPLRWTLRGSLAVRSRLMVR

SEQ ID NO: 1081162 - protein, 20 aa, Mycobacterium
VHHTNQKVPFMLLAGDRDVQ

SEQ ID NO: 1081163 - protein, 19 aa, Mycobacterium
VHIVSQLVWPGRTVDECLA

SEQ ID NO: 1081164 - protein, 18 aa, Mycobacterium
VHLDAFNLLPYLTGEVEE

SEQ ID NO: 1081165 - protein, 18 aa, Mycobacterium
VHPIGPRNRSLPFPTLVS

SEQ ID NO: 1081166 - protein, 29 aa, Mycobacterium
VHPRGIGQVFPRRLLLGDHVIHELDIAFA

SEQ ID NO: 1081167 - protein, 22 aa, Mycobacterium
VHPRLDRKLALHPATMLVGRFD

SEQ ID NO: 1081168 - protein, 25 aa, Mycobacterium
VHQPLQFHMGVTELLGIHQIFRELT

SEQ ID NO: 1081169 - protein, 23 aa, Mycobacterium
VHQTVEFIKSRDLVLDTPVTLAP

SEQ ID NO: 1081170 - protein, 26 aa, Mycobacterium
VHRESFQIILVDTPGLHRPRTLLGKR

SEQ ID NO: 1081171 - protein, 27 aa, Mycobacterium
VHRILDEALICHLGYIRDGEPVVLPTT

SEQ ID NO: 1081172 - protein, 25 aa, Mycobacterium
VHSTTLYYPLVATPMIAPTKAYSGM

SEQ ID NO: 1081173 - protein, 22 aa, Mycobacterium
VHTHPRWIAQAFADALGPSAAE

SEQ ID NO: 1081174 - protein, 30 aa, Mycobacterium
VHTNFGRGNRFGMFVMIEGQRLLLSTAGAG

SEQ ID NO: 1081175 - protein, 21 aa, Mycobacterium
VHTWDLITALARPIVRDESGA

SEQ ID NO: 1081176 - protein, 31 aa, Mycobacterium
VHVHHNAMKAMRFGAYSSLPHETVERIAHAW

SEQ ID NO: 1081177 - protein, 17 aa, Mycobacterium
VHVTFRRLRREDVLGGR

SEQ ID NO: 1081178 - protein, 20 aa, Mycobacterium
VHVYPITTQAGIARFLADHD

SEQ ID NO: 1081179 - protein, 27 aa, Mycobacterium
VHWDDFFRPLSKPMRAFPYAADDLDMS

SEQ ID NO: 1081180 - protein, 24 aa, Mycobacterium
VIADRTQRPPPFPEDIWIPERDPG

SEQ ID NO: 1081181 - protein, 29 aa, Mycobacterium
VIAIPPQADWLDPMIALSFAAASSSRITV

SEQ ID NO: 1081182 - protein, 17 aa, Mycobacterium
VIALVRDPAAAARYAAN

SEQ ID NO: 1081183 - protein, 25 aa, Mycobacterium
VIARDSLVKTALFGSDPNWGRVLAA

SEQ ID NO: 1081184 - protein, 18 aa, Mycobacterium
VIASLTSGPWIGPSSLAM

SEQ ID NO: 1081185 - protein, 17 aa, Mycobacterium
VIASNRALLAALIATNW

SEQ ID NO: 1081186 - protein, 17 aa, Mycobacterium
VIASTFLGLVPSPATPE

SEQ ID NO: 1081187 - protein, 17 aa, Mycobacterium
VIDEPHRPLSRRRLFGI

SEQ ID NO: 1081188 - protein, 24 aa, Mycobacterium
VIDGVRAGALPPGTRLPTVRDLVG

SEQ ID NO: 1081189 - protein, 17 aa, Mycobacterium
VIDLAVGLPARPGLVRD

SEQ ID NO: 1081190 - protein, 17 aa, Mycobacterium
VIDLIMPIGKGQRALIV

SEQ ID NO: 1081191 - protein, 24 aa, Mycobacterium
VIDMLANSAFYYGALRTLAEADPQ

SEQ ID NO: 1081192 - protein, 28 aa, Mycobacterium
VIDPANNVEFFFLRPKDIAIYVGSGQLD

SEQ ID NO: 1081193 - protein, 20 aa, Mycobacterium
VIDRAPLWCAVDLRDGNQAL

SEQ ID NO: 1081194 - protein, 20 aa, Mycobacterium
VIDRTALILDIFAQHATSRE

SEQ ID NO: 1081195 - protein, 19 aa, Mycobacterium
VIEFCLGIPHLLKGEYTEG

SEQ ID NO: 1081196 - protein, 19 aa, Mycobacterium
VIELLHTIHLPVVCGVQGW

SEQ ID NO: 1081197 - protein, 20 aa, Mycobacterium
VIERSIIGFGARIGPRALVR

SEQ ID NO: 1081198 - protein, 60 aa, Mycobacterium; identical to SEQ ID NO: 872740

SEQ ID NO: 1081199 - protein, 30 aa, Mycobacterium
VIGRIRAMRMALLPERLPATEALSYGLVSA

SEQ ID NO: 1081200 - protein, 24 aa, Mycobacterium
VIGTKELIAWLPTLLGLRAGDVVV

SEQ ID NO: 1081201 - protein, 25 aa, Mycobacterium
VIGTKELIAWLPTLLGLRAGDVVVV

SEQ ID NO: 1081202 - protein, 22 aa, Mycobacterium
VIGTRSAVFAPLSDLGLVMVWA

SEQ ID NO: 1081203 - protein, 17 aa, Mycobacterium
VIGYGPIELDPSAIVLH

SEQ ID NO: 1081204 - protein, 19 aa, Mycobacterium
VIHSALLPALVGASRTTWL

SEQ ID NO: 1081205 - protein, 20 aa, Mycobacterium
VIKPGWGFSFDYQPGQYIGI

SEQ ID NO: 1081206 - protein, 18 aa, Mycobacterium
VILDVMMPGMDGFGVLRR

SEQ ID NO: 1081207 - protein, 18 aa, Mycobacterium
VILVGKMRQRLYRCNFAG

SEQ ID NO: 1081208 - protein, 24 aa, Mycobacterium
VINPFDFFIEEWAETWPAEGLTYP

SEQ ID NO: 1081209 - protein, 19 aa, Mycobacterium
VIPTESALRFIGAATFEAL

SEQ ID NO: 1081210 - protein, 17 aa, Mycobacterium
VIQWATGGVGKAAIECI

SEQ ID NO: 1081211 - protein, 24 aa, Mycobacterium
VIRDPETFRYSWGPAIAGLDTPTT

SEQ ID NO: 1081212 - protein, 18 aa, Mycobacterium
VIRFLEAGSKVKVTIMFR

SEQ ID NO: 1081213 - protein, 34 aa, Mycobacterium
VIRRGDTPLPVRTPLPVQLPEPMVEQLRQAAATQ

SEQ ID NO: 1081214 - protein, 18 aa, Mycobacterium
VIRRLTSLLLAMEHPHPT

SEQ ID NO: 1081215 - protein, 26 aa, Mycobacterium
VIRTSVPPFTWWRGIRARQLLENYFA

SEQ ID NO: 1081216 - protein, 24 aa, Mycobacterium
VISFDEAFKLVKINPLAAWSDDEV

SEQ ID NO: 1081217 - protein, 25 aa, Mycobacterium
VISQLTLKVVPLFTLHRDDELKPLA

SEQ ID NO: 1081218 - protein, 28 aa, Mycobacterium
VITGAVIIDYWGIIKANIGIRDGRIVAI

SEQ ID NO: 1081219 - protein, 23 aa, Mycobacterium
VITIEVGGRYRLADAMKAHQDLE

SEQ ID NO: 1081220 - protein, 17 aa, Mycobacterium
VITLTRRHFRDLVDVTG

SEQ ID NO: 1081221 - protein, 17 aa, Mycobacterium
VIVIMPSPKGSATLHAK

SEQ ID NO: 1081222 - protein, 25 aa, Mycobacterium
VIVRSELLTRYLPGTPAGLVDLGAF

SEQ ID NO: 1081223 - protein, 26 aa, Mycobacterium
VIVTEPVVHYLLQASGLVNRTPPAFT

SEQ ID NO: 1081224 - protein, 18 aa, Mycobacterium
VKAVVAHLIGTESFLMGV

SEQ ID NO: 1081225 - protein, 25 aa, Mycobacterium
VKDAAAYISGFFNTGSNLSGFFNTG

SEQ ID NO: 1081226 - protein, 22 aa, Mycobacterium
VKDVFVPRHRFLSYKAMNDHTA

SEQ ID NO: 1081227 - protein, 19 aa, Mycobacterium
VKEHCRTPFRQANWDRLAE

SEQ ID NO: 1081228 - protein, 22 aa, Mycobacterium
VKGMLTGPVTILAWSFVRDDQA

SEQ ID NO: 1081229 - protein, 46 aa, Mycobacterium; identical to SEQ ID NO: 872969

SEQ ID NO: 1081230 - protein, 17 aa, Mycobacterium
VKIRGFSLWGGVGIKRK

SEQ ID NO: 1081231 - protein, 20 aa, Mycobacterium
VKLMLKWPNLYYSTSAFAPK

SEQ ID NO: 1081232 - protein, 17 aa, Mycobacterium
VKMALQYWRSRGRPGKH

SEQ ID NO: 1081233 - protein, 26 aa, Mycobacterium
VKNNLQTVAALLRLQARRTTNAEGRE

SEQ ID NO: 1081234 - protein, 22 aa, Mycobacterium
VKNYVSRLLAKLGMERRTQAAV

SEQ ID NO: 1081235 - protein, 22 aa, Mycobacterium
VKPFVLAELVARVKALLRRRGA

SEQ ID NO: 1081236 - protein, 24 aa, Mycobacterium
VKPKGALYAFPRLDPEVYDIADDE

SEQ ID NO: 1081237 - protein, 19 aa, Mycobacterium
VKPSLAHKPTPQTKPSLTT

SEQ ID NO: 1081238 - protein, 20 aa, Mycobacterium
VKRRIMIGAYALSAGYYDAY

SEQ ID NO: 1081239 - protein, 28 aa, Mycobacterium
VKSARPQWLPLSHSQLAAWFQYRIEGAR

SEQ ID NO: 1081240 - protein, 19 aa, Mycobacterium
VKTSPLYRAWADASGDDPH

SEQ ID NO: 1081241 - protein, 34 aa, Mycobacterium; identical to SEQ ID NO: 224090

SEQ ID NO: 1081242 - protein, 17 aa, Mycobacterium
VKVWIYKGDIVGGKREL

SEQ ID NO: 1081243 - protein, 20 aa, Mycobacterium
VKYLASQPRDFLAVATPGSG

SEQ ID NO: 1081244 - protein, 17 aa, Mycobacterium
VLAADYPERVRSLVLIN

SEQ ID NO: 1081245 - protein, 19 aa, Mycobacterium
VLAALLLNRISLAPGEAIF

SEQ ID NO: 1081246 - protein, 26 aa, Mycobacterium
VLAALQPHFRLRPDPAPRGSAPAELW

SEQ ID NO: 1081247 - protein, 28 aa, Mycobacterium
VLAAVNAPTQAVLGRPLIGDGANGWPNT

SEQ ID NO: 1081248 - protein, 22 aa, Mycobacterium
VLADDVVAPLPLPVFDNSAMDG

SEQ ID NO: 1081249 - protein, 19 aa, Mycobacterium
VLADLPRLQVLALSGLNMA

SEQ ID NO: 1081250 - protein, 22 aa, Mycobacterium
VLADSWRMAAKALRPLPVAHKE

SEQ ID NO: 1081251 - protein, 18 aa, Mycobacterium
VLALPPGHPMADRHGVPV

SEQ ID NO: 1081252 - protein, 20 aa, Mycobacterium
VLAMCAGALRYYLIEQDALP

SEQ ID NO: 1081253 - protein, 17 aa, Mycobacterium
VLAPLGPILFSTSGIRP

SEQ ID NO: 1081254 - protein, 18 aa, Mycobacterium
VLAQARVGSYLRYGAYPY

SEQ ID NO: 1081255 - protein, 24 aa, Mycobacterium
VLARELLPERALMGDASAIVALHT

SEQ ID NO: 1081256 - protein, 17 aa, Mycobacterium
VLARKGRTLITESRLGL

SEQ ID NO: 1081257 - protein, 21 aa, Mycobacterium
VLARWPEVIASPTPSTTGRVQ

SEQ ID NO: 1081258 - protein, 28 aa, Mycobacterium
VLASESAYFLLAFTKIGLMPDGGASALI

SEQ ID NO: 1081259 - protein, 24 aa, Mycobacterium
VLATGVMPGLPPLSGGMVGFFAYD

SEQ ID NO: 1081260 - protein, 30 aa, Mycobacterium
VLATLPDPVRRRVIRSWLLAGGAIGLTDKQ

SEQ ID NO: 1081261 - protein, 17 aa, Mycobacterium
VLAVLTAEQLRHAMFPI

SEQ ID NO: 1081262 - protein, 21 aa, Mycobacterium
VLAVNTIYRGLATPGSAAALA

SEQ ID NO: 1081263 - protein, 37 aa, Mycobacterium; identical to SEQ ID NO: 873174

SEQ ID NO: 1081264 - protein, 24 aa, Mycobacterium
VLCITSPGLLFQAWQARQGRRSAD

SEQ ID NO: 1081265 - protein, 21 aa, Mycobacterium
VLDMLAPWEVLDPVSRLVVAG

SEQ ID NO: 1081266 - protein, 20 aa, Mycobacterium
VLDYERVMLRLGEGENGEPQ

SEQ ID NO: 1081267 - protein, 18 aa, Mycobacterium
VLEGRLEQLRTFEREYRT

SEQ ID NO: 1081268 - protein, 22 aa, Mycobacterium
VLELSVALALLPVLPGLAQGRS

SEQ ID NO: 1081269 - protein, 36 aa, Mycobacterium
VLETALQLGPLPPVTNAVRFAFWGDGINGAMDYVFA

SEQ ID NO: 1081270 - protein, 20 aa, Mycobacterium
VLEVLRSWLSRDGAGQLIIT

SEQ ID NO: 1081271 - protein, 26 aa, Mycobacterium
VLFSRYETLLATGARLFRAQGYPAVS

SEQ ID NO: 1081272 - protein, 28 aa, Mycobacterium
VLGAIDSVTLLPLYFELDGTFPNHEANP

SEQ ID NO: 1081273 - protein, 25 aa, Mycobacterium
VLGATAHLPRRPAYTGTLTLRYRRG

SEQ ID NO: 1081274 - protein, 29 aa, Mycobacterium
VLGAVNAPTMAVLGRPLIGDGVDAAAGSG

SEQ ID NO: 1081275 - protein, 24 aa, Mycobacterium
VLGDPALPHLFFVDGGALAVENAL

SEQ ID NO: 1081276 - protein, 28 aa, Mycobacterium
VLGFAVDGGWWVLGVHTPAAAECLRGVP

SEQ ID NO: 1081277 - protein, 19 aa, Mycobacterium
VLGGWFAVLCWNNNPRKIL

SEQ ID NO: 1081278 - protein, 17 aa, Mycobacterium
VLGLSEALRIELEPHRI

SEQ ID NO: 1081279 - protein, 21 aa, Mycobacterium
VLGPVWPRNPWTKAYRQEHLE

SEQ ID NO: 1081280 - protein, 19 aa, Mycobacterium
VLGQRPFEVQLMGAAALHL

SEQ ID NO: 1081281 - protein, 31 aa, Mycobacterium
VLGVINAPTQTLLGRPLIGDGAAGTVANPNG

SEQ ID NO: 1081282 - protein, 31 aa, Mycobacterium
VLGVVNAPAQALLGRPLIGDGAAGTAASPNG

SEQ ID NO: 1081283 - protein, 25 aa, Mycobacterium
VLGVYGPPLKFDVSLPLAAISEFAA

SEQ ID NO: 1081284 - protein, 25 aa, Mycobacterium
VLGWPRGHIMWLYEQDIQPDEERTH

SEQ ID NO: 1081285 - protein, 26 aa, Mycobacterium
VLHDGELYVCGRIKDLLILAGRNIYP

SEQ ID NO: 1081286 - protein, 22 aa, Mycobacterium
VLHIITAYHRLKLNPDLETAPR

SEQ ID NO: 1081287 - protein, 20 aa, Mycobacterium
VLHLARLTRLVLTDTELASF

SEQ ID NO: 1081288 - protein, 27 aa, Mycobacterium
VLIGKQFLYVERYMKLLAPKWQMMSDP

SEQ ID NO: 1081289 - protein, 20 aa, Mycobacterium
VLIIAYTFFGIEEIAVEIES

SEQ ID NO: 1081290 - protein, 29 aa, Mycobacterium
VLISGERVIPQWVKIRNVDGFNGSYWQGG

SEQ ID NO: 1081291 - protein, 20 aa, Mycobacterium
VLIVLIDDVGFGASSAFGGP

SEQ ID NO: 1081292 - protein, 17 aa, Mycobacterium
VLKLINWELASNDAAPS

SEQ ID NO: 1081293 - protein, 18 aa, Mycobacterium
VLLAVRRVRERPGLTIGI

SEQ ID NO: 1081294 - protein, 17 aa, Mycobacterium
VLLDRFELNARAAAVRK

SEQ ID NO: 1081295 - protein, 25 aa, Mycobacterium
VLLGDWLIQLPREVTVPAPEVVVGV

SEQ ID NO: 1081296 - protein, 17 aa, Mycobacterium
VLLHCYPYEREAGYLAQ

SEQ ID NO: 1081297 - protein, 30 aa, Mycobacterium
VLLMAVERIELFVEALLKGGRPAYTPVLVV

SEQ ID NO: 1081298 - protein, 29 aa, Mycobacterium
VLLQLPNSCRFAVALFGLLRAGAIPVMCL

SEQ ID NO: 1081299 - protein, 25 aa, Mycobacterium
VLLRNIMENPAWYTAYTPYQPEISQ

SEQ ID NO: 1081300 - protein, 17 aa, Mycobacterium
VLMFYRSANFDEEVFED

SEQ ID NO: 1081301 - protein, 23 aa, Mycobacterium
VLNLIVRLWRNAWNEFIPFLDYD

SEQ ID NO: 1081302 - protein, 18 aa, Mycobacterium
VLPALLRERGITGRDAAL

SEQ ID NO: 1081303 - protein, 18 aa, Mycobacterium
VLPDHELRRIAALCAAFD

SEQ ID NO: 1081304 - protein, 20 aa, Mycobacterium
VLPDPAPPSILFLTAGSGIT

SEQ ID NO: 1081305 - protein, 22 aa, Mycobacterium
VLPIPPTALQLSTGVAVLCYDD

SEQ ID NO: 1081306 - protein, 18 aa, Mycobacterium
VLPLLGGLAVMYGELPPL

SEQ ID NO: 1081307 - protein, 19 aa, Mycobacterium
VLPTAKFTDRVLAEVRRRG

SEQ ID NO: 1081308 - protein, 17 aa, Mycobacterium
VLQALTSPLASAASSTA

SEQ ID NO: 1081309 - protein, 18 aa, Mycobacterium
VLQRVGERSWRIPATAFW

SEQ ID NO: 1081310 - protein, 24 aa, Mycobacterium
VLRAIRGLRYAEPVRRYLLGRYTG

SEQ ID NO: 1081311 - protein, 18 aa, Mycobacterium
VLRATRSTDYLILEMSAR

SEQ ID NO: 1081312 - protein, 23 aa, Mycobacterium
VLRETLRVFLREGGSYKAAAERL

SEQ ID NO: 1081313 - protein, 17 aa, Mycobacterium
VLRIPDALPLDAAAPLL

SEQ ID NO: 1081314 - protein, 18 aa, Mycobacterium
VLRLLRDGLPTVPRSRTI

SEQ ID NO: 1081315 - protein, 21 aa, Mycobacterium
VLRLRPAPEFEAWLTGLGMAD

SEQ ID NO: 1081316 - protein, 25 aa, Mycobacterium
VLRRNLIESPAWYTAYTPYQPEISQ

SEQ ID NO: 1081317 - protein, 27 aa, Mycobacterium
VLSAVNAPSLALTGRPLIGNGADGGPG

SEQ ID NO: 1081318 - protein, 24 aa, Mycobacterium
VLSETFNVIVFQYPGRQDRAAEPS

SEQ ID NO: 1081319 - protein, 24 aa, Mycobacterium
VLSRFVDAIVWRTFGQDRLQAMAS

SEQ ID NO: 1081320 - protein, 17 aa, Mycobacterium
VLSRLLNAPVSVSATTT

SEQ ID NO: 1081321 - protein, 20 aa, Mycobacterium
VLTALLQPDHRLAVVFGAGG

SEQ ID NO: 1081322 - protein, 17 aa, Mycobacterium
VLTQCRPELIERTFEAC

SEQ ID NO: 1081323 - protein, 17 aa, Mycobacterium
VLTRRIAYLIAARGVGV

SEQ ID NO: 1081324 - protein, 20 aa, Mycobacterium
VLTTTLSDPHGYGRILRTQD

SEQ ID NO: 1081325 - protein, 19 aa, Mycobacterium
VLTWIDWSDVDTGLLEFTH

SEQ ID NO: 1081326 - protein, 31 aa, Mycobacterium
VLVAMNSLWELNLPRRDLRMLAAQLGSDVPF

SEQ ID NO: 1081327 - protein, 27 aa, Mycobacterium
VLVCFARRVLEPLGLRKAATDDLSGFA

SEQ ID NO: 1081328 - protein, 22 aa, Mycobacterium
VLVDQMLAHYLQLVDKALAEPE

SEQ ID NO: 1081329 - protein, 19 aa, Mycobacterium
VLVEHDGIPAGIVSARDLL

SEQ ID NO: 1081330 - protein, 20 aa, Mycobacterium
VLVLAGRIHAYEGHDLRHVV

SEQ ID NO: 1081331 - protein, 22 aa, Mycobacterium
VLVNEQLISPPPVTVVRLSEYP

SEQ ID NO: 1081332 - protein, 26 aa, Mycobacterium
VLVPIDAFDLIKLPPHLRVNFAVESA

SEQ ID NO: 1081333 - protein, 22 aa, Mycobacterium
VLVSGHHWGATGLKPRGPSDFL

SEQ ID NO: 1081334 - protein, 17 aa, Mycobacterium
VLVSYLPVGSEEADKFY

SEQ ID NO: 1081335 - protein, 29 aa, Mycobacterium
VLVTGYDILFFWVARMMMFGTFVGGDEVI

SEQ ID NO: 1081336 - protein, 29 aa, Mycobacterium
VLVVQRMLASRFSPRALLGTDRRLLELKE

SEQ ID NO: 1081337 - protein, 17 aa, Mycobacterium
VLVWQDMAGLSSGKAPR

SEQ ID NO: 1081338 - protein, 18 aa, Mycobacterium
VLYELMIAARTDDKLKET

SEQ ID NO: 1081339 - protein, 21 aa, Mycobacterium
VMADPLPYYRVLRDQHPVYYL

SEQ ID NO: 1081340 - protein, 24 aa, Mycobacterium
VMAEPLTYFFSDPAARDFVTGVAQ

SEQ ID NO: 1081341 - protein, 19 aa, Mycobacterium
VMAGLRRRFPSGLGQDYID

SEQ ID NO: 1081342 - protein, 25 aa, Mycobacterium
VMAMDPQQRLLLEVSWEALERTGID

SEQ ID NO: 1081343 - protein, 19 aa, Mycobacterium
VMAVFGAPAALEEHALRAC

SEQ ID NO: 1081344 - protein, 24 aa, Mycobacterium
VMDVRFLPNPHWVDELRPLTGQHQ

SEQ ID NO: 1081345 - protein, 21 aa, Mycobacterium
VMGNLEFLIFNGIHAVVGTTG

SEQ ID NO: 1081346 - protein, 19 aa, Mycobacterium
VMIGSWFAGTYESPGDLMR

SEQ ID NO: 1081347 - protein, 18 aa, Mycobacterium
VMILMLNRTEFVESVLAA

SEQ ID NO: 1081348 - protein, 17 aa, Mycobacterium
VMLSGEVGFFRGVMQLT

SEQ ID NO: 1081349 - protein, 28 aa, Mycobacterium
VMMPGLDGFEFIAAIRADPVLAATPVLM

SEQ ID NO: 1081350 - protein, 26 aa, Mycobacterium
VMPPSLLHTWFELLGPEKIVTAYGMT

SEQ ID NO: 1081351 - protein, 17 aa, Mycobacterium
VMQANLADLPLPDASMD

SEQ ID NO: 1081352 - protein, 22 aa, Mycobacterium
VMRAHQILLARVEAALRPYDLS

SEQ ID NO: 1081353 - protein, 22 aa, Mycobacterium
VMSMLRTLLRRNQITDITHLHS

SEQ ID NO: 1081354 - protein, 21 aa, Mycobacterium
VMTNEIFGPILPVLTVKSLDE

SEQ ID NO: 1081355 - protein, 24 aa, Mycobacterium
VMTQELLEFPGGVLGVALNLDEHS

SEQ ID NO: 1081356 - protein, 19 aa, Mycobacterium
VMTTLLYHMRDNGIRYGLQ

SEQ ID NO: 1081357 - protein, 18 aa, Mycobacterium
VMTTPKWVHNRIQPIAIR

SEQ ID NO: 1081358 - protein, 20 aa, Mycobacterium
VNAAYQLFHQVRRLVAVMTK

SEQ ID NO: 1081359 - protein, 21 aa, Mycobacterium
VNAGFLERLAGLGSGRAELVE

SEQ ID NO: 1081360 - protein, 27 aa, Mycobacterium
VNALNMPAEGLLGRPLIGDGTDGAPGT

SEQ ID NO: 1081361 - protein, 22 aa, Mycobacterium
VNALQPIEWRYTNDPSWVMRDK

SEQ ID NO: 1081362 - protein, 24 aa, Mycobacterium
VNALRAMLITTPDTLRSQLHGLSS

SEQ ID NO: 1081363 - protein, 20 aa, Mycobacterium
VNAVQRCVAVLFAALHGDTN

SEQ ID NO: 1081364 - protein, 24 aa, Mycobacterium
VNDGRGFFASRVIGTFVNEALAML

SEQ ID NO: 1081365 - protein, 24 aa, Mycobacterium
VNDLRLTLGVLLDVGPRGPERLPA

SEQ ID NO: 1081366 - protein, 25 aa, Mycobacterium
VNDQAWIEEYFIPTVAKRGATIIDA

SEQ ID NO: 1081367 - protein, 26 aa, Mycobacterium
VNDQPWRADLLGKRLHGALGPLVHVN

SEQ ID NO: 1081368 - protein, 26 aa, Mycobacterium
VNEMQINWVWNPPWGPDKITEDGREQ

SEQ ID NO: 1081369 - protein, 18 aa, Mycobacterium
VNKFRGDLDLLAPGLRDL

SEQ ID NO: 1081370 - protein, 19 aa, Mycobacterium
VNKVLLQGKKSLAERIVYG

SEQ ID NO: 1081371 - protein, 26 aa, Mycobacterium
VNNGSEWICYFPHPLRVVCGGISIPG

SEQ ID NO: 1081372 - protein, 29 aa, Mycobacterium
VNPAPTVRALYGRILRQRPLDVCKTAQSN

SEQ ID NO: 1081373 - protein, 24 aa, Mycobacterium
VNPCGRLPITFPVGLGQTPRPELP

SEQ ID NO: 1081374 - protein, 19 aa, Mycobacterium
VNPFLTISMFAERTAELMR

SEQ ID NO: 1081375 - protein, 23 aa, Mycobacterium
VNPRPVFVERIRLHQLAAGSGTA

SEQ ID NO: 1081376 - protein, 18 aa, Mycobacterium
VNQAFLAPARIDLAALRA

SEQ ID NO: 1081377 - protein, 19 aa, Mycobacterium
VNRLLLNNIDVVGVGWGAW

SEQ ID NO: 1081378 - protein, 28 aa, Mycobacterium
VNRRLLGKYLPELPPPGGVADLDRVAHL

SEQ ID NO: 1081379 - protein, 17 aa, Mycobacterium
VNSPLVHIGGVYRVLQC

SEQ ID NO: 1081380 - protein, 23 aa, Mycobacterium
VNSRHLVLPLETYPKLNDFGEAN

SEQ ID NO: 1081381 - protein, 22 aa, Mycobacterium
VNSRQFVLPIEQYPALTDFGDT

SEQ ID NO: 1081382 - protein, 27 aa, Mycobacterium
VNSSGTFISGFFNAGTFTPGLLETFNS

SEQ ID NO: 1081383 - protein, 24 aa, Mycobacterium
VNTAAWFVMAAIPNSVFLGHTLNA

SEQ ID NO: 1081384 - protein, 23 aa, Mycobacterium
VNTTLVWGLHDTVAPLRVPNHVW

SEQ ID NO: 1081385 - protein, 27 aa, Mycobacterium
VNVATLPFPGFPTDLQPMAIALASIAD

SEQ ID NO: 1081386 - protein, 18 aa, Mycobacterium
VNVDAKLYGLPFGDGAYG

SEQ ID NO: 1081387 - protein, 20 aa, Mycobacterium
VNVGLLMHPDHGRPALGFAT

SEQ ID NO: 1081388 - protein, 19 aa, Mycobacterium
VPAAPVAPGAPVAMAATRP

SEQ ID NO: 1081389 - protein, 22 aa, Mycobacterium
VPAARFALIERLRRLDEPTLDA

SEQ ID NO: 1081390 - protein, 25 aa, Mycobacterium
VPAELLDVVLAIVRDRPLQPVARIN

SEQ ID NO: 1081391 - protein, 18 aa, Mycobacterium
VPAGIAPAPGAGLELPTD

SEQ ID NO: 1081392 - protein, 27 aa, Mycobacterium
VPAIIAEYLGLPQLTHVRKLSVEGGKV

SEQ ID NO: 1081393 - protein, 17 aa, Mycobacterium
VPANFTSSLLLGSSAQV

SEQ ID NO: 1081394 - protein, 17 aa, Mycobacterium
VPAPVPQFEVMYLLAGC

SEQ ID NO: 1081395 - protein, 30 aa, Mycobacterium; identical to SEQ ID NO: 874087

SEQ ID NO: 1081396 - protein, 17 aa, Mycobacterium
VPAVMYGHGAEPQHLEL

SEQ ID NO: 1081397 - protein, 27 aa, Mycobacterium
VPDAQLADLLLLDDLLGIAAPGAELPR

SEQ ID NO: 1081398 - protein, 29 aa, Mycobacterium
VPDGDPQDLLLLYDLLGIADPRVELPKIA

SEQ ID NO: 1081399 - protein, 24 aa, Mycobacterium
VPDREVFLASWPREFRALVEQQRE

SEQ ID NO: 1081400 - protein, 24 aa, Mycobacterium
VPEAKRFCWNCGRPVGRSDSETKG

SEQ ID NO: 1081401 - protein, 18 aa, Mycobacterium
VPEEKWVYLRGHADLQEQ

SEQ ID NO: 1081402 - protein, 20 aa, Mycobacterium
VPEKLEIKTALWGQIDQAAP

SEQ ID NO: 1081403 - protein, 30 aa, Mycobacterium; identical to SEQ ID NO: 874139

SEQ ID NO: 1081404 - protein, 17 aa, Mycobacterium
VPEYRKDLAVRLSELDL

SEQ ID NO: 1081405 - protein, 21 aa, Mycobacterium
VPFGPDLLFAASDLPGFVLHV

SEQ ID NO: 1081406 - protein, 18 aa, Mycobacterium
VPFMLLAGDRDVQADAVS

SEQ ID NO: 1081407 - protein, 18 aa, Mycobacterium
VPFVDPLTTILDPSLPLT

SEQ ID NO: 1081408 - protein, 26 aa, Mycobacterium
VPGGRDEIWRFTPLRRLRGLHDGSAV

SEQ ID NO: 1081409 - protein, 25 aa, Mycobacterium
VPGLRALARLGIYWAQEALAFGMTK

SEQ ID NO: 1081410 - protein, 24 aa, Mycobacterium
VPGSRNWVVDPRELGLTTSVYSSV

SEQ ID NO: 1081411 - protein, 20 aa, Mycobacterium
VPGVYVAGWIKRGPSGFIGT

SEQ ID NO: 1081412 - protein, 20 aa, Mycobacterium
VPGYRNFFAVFGPYGYVGSS

SEQ ID NO: 1081413 - protein, 24 aa, Mycobacterium
VPHLHIHVFPTRHLSDFGFATVDR

SEQ ID NO: 1081414 - protein, 18 aa, Mycobacterium
VPHLPVRVQHRSGALWIL

SEQ ID NO: 1081415 - protein, 26 aa, Mycobacterium
VPLAQTPEVLLLQPWDRDQIHRLFDD

SEQ ID NO: 1081416 - protein, 25 aa, Mycobacterium
VPLEVLIAVVNRLGWTHGCELNALE

SEQ ID NO: 1081417 - protein, 22 aa, Mycobacterium
VPLPVNFEVALLFLAIGMSVTP

SEQ ID NO: 1081418 - protein, 18 aa, Mycobacterium
VPLSEMFGYVGDLRSKTQ

SEQ ID NO: 1081419 - protein, 25 aa, Mycobacterium
VPLSHDMALIAYLISPMFAGNGAVY

SEQ ID NO: 1081420 - protein, 25 aa, Mycobacterium
VPMRPDLLDLFQISELEKYYTAEEL

SEQ ID NO: 1081421 - protein, 25 aa, Mycobacterium
VPNGPAQQALLAQALDSAKLTPADI

SEQ ID NO: 1081422 - protein, 22 aa, Mycobacterium
VPNLARAALIVTLAATADGPVA

SEQ ID NO: 1081423 - protein, 31 aa, Mycobacterium; identical to SEQ ID NO: 874296

SEQ ID NO: 1081424 - protein, 24 aa, Mycobacterium
VPQCPRRWRYLSPAIPADLEGRIE

SEQ ID NO: 1081425 - protein, 18 aa, Mycobacterium
VPQMVRHVFHVSGAAAKK

SEQ ID NO: 1081426 - protein, 24 aa, Mycobacterium
VPQQFWAKVLPRVRDRYPQAWFVG

SEQ ID NO: 1081427 - protein, 26 aa, Mycobacterium
VPQRLIGLARIWEEILGRPVLDPDAD

SEQ ID NO: 1081428 - protein, 19 aa, Mycobacterium
VPREPALYQEMMSLIAQCG

SEQ ID NO: 1081429 - protein, 17 aa, Mycobacterium
VPRLAFPTATGRAVFFA

SEQ ID NO: 1081430 - protein, 22 aa, Mycobacterium
VPRRIPAFPELEGIRVLRSFDE

SEQ ID NO: 1081431 - protein, 24 aa, Mycobacterium
VPRTEWVIETPPLRQLRLDQRGLP

SEQ ID NO: 1081432 - protein, 20 aa, Mycobacterium
VPRVRAGLQALGWAGTIWAG

SEQ ID NO: 1081433 - protein, 32 aa, Mycobacterium
VPSCARWTIADLIWHVGVVHTFWRQVAVGAIT

SEQ ID NO: 1081434 - protein, 26 aa, Mycobacterium
VPSGDGLRPLRLTLSQLRLRELLVEV

SEQ ID NO: 1081435 - protein, 18 aa, Mycobacterium
VPSPLIIGRAVAHNARMW

SEQ ID NO: 1081436 - protein, 31 aa, Mycobacterium
VPSTAVSWLPFYHDMGLMLGIILPMINQDTA

SEQ ID NO: 1081437 - protein, 18 aa, Mycobacterium
VPSTPGDAYWLLRHAIAC

SEQ ID NO: 1081438 - protein, 18 aa, Mycobacterium
VPSVHDPDLAPPGKHAAS

SEQ ID NO: 1081439 - protein, 18 aa, Mycobacterium
VPTAALGGLGGAGGAGGN

SEQ ID NO: 1081440 - protein, 18 aa, Mycobacterium
VPTDLVGIFAGSGSLLPS

SEQ ID NO: 1081441 - protein, 23 aa, Mycobacterium
VPTRRGNWWYYARTFEGRQYGVH

SEQ ID NO: 1081442 - protein, 19 aa, Mycobacterium
VPTRRRVLLAEPRGYCAGV

SEQ ID NO: 1081443 - protein, 30 aa, Mycobacterium; identical to SEQ ID NO: 952042

SEQ ID NO: 1081444 - protein, 20 aa, Mycobacterium
VPVPVPVPVPVALRNRLRLA

SEQ ID NO: 1081445 - protein, 35 aa, Mycobacterium
VPVRVDIGQWEPVQLLLELGAQALHHFLDCDLQQL

SEQ ID NO: 1081446 - protein, 24 aa, Mycobacterium
VPVSATWIDIRFTLPANTVDGGIP

SEQ ID NO: 1081447 - protein, 25 aa, Mycobacterium
VPYRANMWALRALGARRVFAPCAVG

SEQ ID NO: 1081448 - protein, 18 aa, Mycobacterium
VQADRYYLKLIKHTGALI

SEQ ID NO: 1081449 - protein, 24 aa, Mycobacterium
VQAFRSHYRLVTRSLERGYYQGWD

SEQ ID NO: 1081450 - protein, 17 aa, Mycobacterium
VQALAAAAGIAIANARL

SEQ ID NO: 1081451 - protein, 18 aa, Mycobacterium
VQALGGAGGAYGAAEQAG

SEQ ID NO: 1081452 - protein, 18 aa, Mycobacterium
VQALLVALAVRGLGSCWI

SEQ ID NO: 1081453 - protein, 21 aa, Mycobacterium
VQALTFHAAAHRQLRYFWPRV

SEQ ID NO: 1081454 - protein, 23 aa, Mycobacterium
VQDPLRWLRCLTQYRGTNSGAPN

SEQ ID NO: 1081455 - protein, 23 aa, Mycobacterium
VQECPFMEFTPGYVLRVIDELPK

SEQ ID NO: 1081456 - protein, 23 aa, Mycobacterium
VQEPTVLPSRFPNLLANGSGGIA

SEQ ID NO: 1081457 - protein, 24 aa, Mycobacterium
VQFHPTGMVWPPSVKGILVTEGVR

SEQ ID NO: 1081458 - protein, 29 aa, Mycobacterium
VQGGMIPLCYDWLCGMVVSTAGIPPTRTA

SEQ ID NO: 1081459 - protein, 17 aa, Mycobacterium
VQHFQAVQLEAFRQGSR

SEQ ID NO: 1081460 - protein, 18 aa, Mycobacterium
VQIGRRLARLARTHQVIV

SEQ ID NO: 1081461 - protein, 17 aa, Mycobacterium
VQIVADFRPGPDCRLGV

SEQ ID NO: 1081462 - protein, 26 aa, Mycobacterium
VQLASGVLPIYIRTPSLLAMTAAGLD

SEQ ID NO: 1081463 - protein, 19 aa, Mycobacterium
VQLLVVPGTWESSLQDNPL

SEQ ID NO: 1081464 - protein, 20 aa, Mycobacterium
VQLLVVPGTWESSLQDNPLD

SEQ ID NO: 1081465 - protein, 26 aa, Mycobacterium
VQLMLSPFTSIALSKWSALSPTGRCK

SEQ ID NO: 1081466 - protein, 21 aa, Mycobacterium
VQMWRFVRINLKMMRIIFSGH

SEQ ID NO: 1081467 - protein, 24 aa, Mycobacterium
VQNLGKPPRMLVLLHLDGSTDRPS

SEQ ID NO: 1081468 - protein, 24 aa, Mycobacterium
VQPARMVRGLPPMLRHIDQLPTMR

SEQ ID NO: 1081469 - protein, 18 aa, Mycobacterium
VQQAIRRRAFTRALRITG

SEQ ID NO: 1081470 - protein, 26 aa, Mycobacterium
VQRDGNFVVYTADKPVWHTDTKGKKN

SEQ ID NO: 1081471 - protein, 17 aa, Mycobacterium
VQRFYVWFADFAAADTL

SEQ ID NO: 1081472 - protein, 24 aa, Mycobacterium
VQRTWRYLLVPCAIEFWDEDGGAA

SEQ ID NO: 1081473 - protein, 28 aa, Mycobacterium
VQRVADVWRLFDSLHFALRVVIAGQDGE

SEQ ID NO: 1081474 - protein, 18 aa, Mycobacterium
VQSLIRWDPVGHADAELE

SEQ ID NO: 1081475 - protein, 17 aa, Mycobacterium
VQSLRLGECDLALAGGV

SEQ ID NO: 1081476 - protein, 18 aa, Mycobacterium
VQTLSASSASYAGAEASN

SEQ ID NO: 1081477 - protein, 21 aa, Mycobacterium
VQTLTGFKWLARADADRPGTL

SEQ ID NO: 1081478 - protein, 17 aa, Mycobacterium
VQTMEASWADVAMMLSI

SEQ ID NO: 1081479 - protein, 18 aa, Mycobacterium
VQTRFFDDFFRSAAAGTK

SEQ ID NO: 1081480 - protein, 17 aa, Mycobacterium
VQTVQRSLLGQMLTSRP

SEQ ID NO: 1081481 - protein, 27 aa, Mycobacterium
VQVDQRFVFYKPVLAGDKLWARMEVHS

SEQ ID NO: 1081482 - protein, 20 aa, Mycobacterium
VQVPRRGYVPSLACGRCRAI

SEQ ID NO: 1081483 - protein, 34 aa, Mycobacterium; identical to SEQ ID NO: 874622

SEQ ID NO: 1081484 - protein, 29 aa, Mycobacterium
VRADVRAALWPLLVGNIIAARGVLRAIRG

SEQ ID NO: 1081485 - protein, 29 aa, Mycobacterium
VRAEVAVLKILALQFIMSDPRHLETQARQ

SEQ ID NO: 1081486 - protein, 21 aa, Mycobacterium
VRAILAGHLHYSTNATFVGIP

SEQ ID NO: 1081487 - protein, 21 aa, Mycobacterium
VRAKYGWTDVSRFAALGIPAV

SEQ ID NO: 1081488 - protein, 20 aa, Mycobacterium
VRARHRLTLDEGRELAVGKR

SEQ ID NO: 1081489 - protein, 17 aa, Mycobacterium
VRAVRLFGRAAPSLMYG

SEQ ID NO: 1081490 - protein, 18 aa, Mycobacterium
VRDGYAWVQPRLSPVARS

SEQ ID NO: 1081491 - protein, 31 aa, Mycobacterium
VRDIRKHVAWYLHGFPAGSDLRRALALVKTL

SEQ ID NO: 1081492 - protein, 25 aa, Mycobacterium
VRDTADLDRLLRWLKAAAGVAQTQT

SEQ ID NO: 1081493 - protein, 27 aa, Mycobacterium
VRDVRYLGSQPWPLPRSLMVGFHAVGD

SEQ ID NO: 1081494 - protein, 19 aa, Mycobacterium
VREACLWSRGLAAAGVRRR

SEQ ID NO: 1081495 - protein, 37 aa, Mycobacterium; identical to SEQ ID NO: 874737

SEQ ID NO: 1081496 - protein, 20 aa, Mycobacterium
VREHGARLLVRLAGVNDRDT

SEQ ID NO: 1081497 - protein, 31 aa, Mycobacterium
VRELVVAWGKLYPQFGTVAALNLVKCVHWPS

SEQ ID NO: 1081498 - protein, 17 aa, Mycobacterium
VRERMGVTLQLRDFVHA

SEQ ID NO: 1081499 - protein, 25 aa, Mycobacterium
VRETDRPFLMPVEDVFTITGRGTVV

SEQ ID NO: 1081500 - protein, 17 aa, Mycobacterium
VRFLTDWAGPEAMVKKL

SEQ ID NO: 1081501 - protein, 31 aa, Mycobacterium
VRGDYLNVFTTFDLTLRRIGETFFTTAYFDP

SEQ ID NO: 1081502 - protein, 26 aa, Mycobacterium
VRGGKQPRILFATQATARPPTFVLFT

SEQ ID NO: 1081503 - protein, 18 aa, Mycobacterium
VRHPLYGKIIRTTKKVKV

SEQ ID NO: 1081504 - protein, 17 aa, Mycobacterium
VRILTYGGIIQSIEVPD

SEQ ID NO: 1081505 - protein, 24 aa, Mycobacterium
VRISINALIVPLYDPVRPAEDIAV

SEQ ID NO: 1081506 - protein, 23 aa, Mycobacterium
VRKNGVLPYLRPDGKTQVTIAYE

SEQ ID NO: 1081507 - protein, 27 aa, Mycobacterium
VRLHKQAHLPYLVYLRHPTTGGVFASW

SEQ ID NO: 1081508 - protein, 18 aa, Mycobacterium
VRLLILRPGFVIGRMTEG

SEQ ID NO: 1081509 - protein, 22 aa, Mycobacterium
VRLLNMVPYFQANPRITRVEAA

SEQ ID NO: 1081510 - protein, 22 aa, Mycobacterium
VRLPHGNGETIRLARGASLSDF

SEQ ID NO: 1081511 - protein, 28 aa, Mycobacterium
VRLPRIPWAVASLRTEQRWLGRIAPQLP

SEQ ID NO: 1081512 - protein, 26 aa, Mycobacterium
VRLTGLTVKSFFLRTFDLGIGTSKYL

SEQ ID NO: 1081513 - protein, 21 aa, Mycobacterium
VRMIEAYHRLSKLNEYSAIDF

SEQ ID NO: 1081514 - protein, 23 aa, Mycobacterium
VRNLPGVHILSPDQLNTYDVLRA

SEQ ID NO: 1081515 - protein, 25 aa, Mycobacterium
VRPIPLGHHLFGVRYARTGTVANSH

SEQ ID NO: 1081516 - protein, 28 aa, Mycobacterium
VRPIVVPDIPISRIPIVLSLGSDSTSLN

SEQ ID NO: 1081517 - protein, 20 aa, Mycobacterium
VRPLFGQHVVLTNPGLQQLF

SEQ ID NO: 1081518 - protein, 23 aa, Mycobacterium
VRPPFARNVRFLPTAAAAQREGF

SEQ ID NO: 1081519 - protein, 17 aa, Mycobacterium
VRPTLAGNKIGALAITE

SEQ ID NO: 1081520 - protein, 23 aa, Mycobacterium
VRRDLTPLYVVHRQLRSMLLAQL

SEQ ID NO: 1081521 - protein, 30 aa, Mycobacterium; identical to SEQ ID NO: 874977

SEQ ID NO: 1081522 - protein, 19 aa, Mycobacterium
VRRIRDYLASYSKILDGTL

SEQ ID NO: 1081523 - protein, 25 aa, Mycobacterium
VRRRIRWRTAWPSRTRWDWMCPNRC

SEQ ID NO: 1081524 - protein, 22 aa, Mycobacterium
VRRSNFVYGSTKAGLDGFYLGL

SEQ ID NO: 1081525 - protein, 17 aa, Mycobacterium
VRRYVTDAGPLLARLHK

SEQ ID NO: 1081526 - protein, 18 aa, Mycobacterium
VRSCDLQFRQFGGHAEFA

SEQ ID NO: 1081527 - protein, 25 aa, Mycobacterium
VRSLPGNRLLAPNEYIITLSVHDAE

SEQ ID NO: 1081528 - protein, 21 aa, Mycobacterium
VRSMRYTLERLIRGLDTIAAT

SEQ ID NO: 1081529 - protein, 26 aa, Mycobacterium
VRSRLMLDIASWRRKRREELAALGDK

SEQ ID NO: 1081530 - protein, 20 aa, Mycobacterium
VRTALRVLADLGADIREVSL

SEQ ID NO: 1081531 - protein, 19 aa, Mycobacterium
VRTEPPHPGSRYTQIAVLE

SEQ ID NO: 1081532 - protein, 27 aa, Mycobacterium
VRTPRLEVGLPQPIVDIFATHHLAGLI

SEQ ID NO: 1081533 - protein, 25 aa, Mycobacterium
VRVAPMRPFRALGMGKRIASDFSSR

SEQ ID NO: 1081534 - protein, 30 aa, Mycobacterium
VRVIVALGGFAWKIALGLPGSLGAPRPRFG

SEQ ID NO: 1081535 - protein, 23 aa, Mycobacterium
VRVLRPGGYLLYTDLRPSNEIAE

SEQ ID NO: 1081536 - protein, 17 aa, Mycobacterium
VRVLYGRDPHHITEAQY

SEQ ID NO: 1081537 - protein, 26 aa, Mycobacterium
VRVRTGLQVAPFCDLVLDVAGAQVFA

SEQ ID NO: 1081538 - protein, 26 aa, Mycobacterium
VRVSMGHALLVPYARATDWPAELVAL

SEQ ID NO: 1081539 - protein, 26 aa, Mycobacterium
VRWELRPRMLLRTIEFLWQEGHSAHI

SEQ ID NO: 1081540 - protein, 22 aa, Mycobacterium
VRWFDIEPCYVYHPLNAYSEHR

SEQ ID NO: 1081541 - protein, 25 aa, Mycobacterium
VSAAIAAFFGAHAQAYQALSEQASA

SEQ ID NO: 1081542 - protein, 26 aa, Mycobacterium
VSAATVLVQSLVTLGLRTAKHGEYAS

SEQ ID NO: 1081543 - protein, 24 aa, Mycobacterium
VSAGFMRILGPQFLSKFHQRILNT

SEQ ID NO: 1081544 - protein, 26 aa, Mycobacterium
VSAGIAALFEAHGNAYQTLGAQTLAL

SEQ ID NO: 1081545 - protein, 24 aa, Mycobacterium
VSAGNVMTFLAPSTRARVLGRLRA

SEQ ID NO: 1081546 - protein, 18 aa, Mycobacterium
VSAITRWAQRHDVPLVDL

SEQ ID NO: 1081547 - protein, 24 aa, Mycobacterium
VSAKDIILALIAKIGTGGGQGHVI

SEQ ID NO: 1081548 - protein, 29 aa, Mycobacterium
VSALVSFEVFIRPALRLAMGLPDPRRPQR

SEQ ID NO: 1081549 - protein, 27 aa, Mycobacterium
VSAQAAAFHQQFVPALAAAAGSYGRTE

SEQ ID NO: 1081550 - protein, 22 aa, Mycobacterium
VSDAIALIHKRAHGVAVVVSEG

SEQ ID NO: 1081551 - protein, 19 aa, Mycobacterium
VSDEYWFSWKYFHPDTRVI

SEQ ID NO: 1081552 - protein, 28 aa, Mycobacterium
VSDRSGVITPFALLQLADRGQFFVEPGE

SEQ ID NO: 1081553 - protein, 22 aa, Mycobacterium
VSDVVAPLLQGAFELQECPAAA

SEQ ID NO: 1081554 - protein, 20 aa, Mycobacterium
VSDWLFTDTALQQATVAAVA

SEQ ID NO: 1081555 - protein, 29 aa, Mycobacterium
VSEEILTALWALIGYRIPTPTPRISYADA

SEQ ID NO: 1081556 - protein, 19 aa, Mycobacterium
VSELRDVLSSPAPVRSLLV

SEQ ID NO: 1081557 - protein, 24 aa, Mycobacterium
VSEPLTELLQRYAAQLPVALELLD

SEQ ID NO: 1081558 - protein, 27 aa, Mycobacterium
VSFATYFNAFPASYWRRWSICKSVVLR

SEQ ID NO: 1081559 - protein, 19 aa, Mycobacterium
VSFGDDPLRMLRAARFVSQ

SEQ ID NO: 1081560 - protein, 17 aa, Mycobacterium
VSFLADEVGRFIRAALA

SEQ ID NO: 1081561 - protein, 24 aa, Mycobacterium
VSGAMHRRFLDDDLADFHRVMAVN

SEQ ID NO: 1081562 - protein, 24 aa, Mycobacterium
VSGDLANWMIPGKMVKGMGGAMDL

SEQ ID NO: 1081563 - protein, 23 aa, Mycobacterium
VSGFGIHPVMLDAALHAVILASD

SEQ ID NO: 1081564 - protein, 17 aa, Mycobacterium
VSGGRPFDEACAGPWWA

SEQ ID NO: 1081565 - protein, 18 aa, Mycobacterium
VSGIYRYFSGKCEILATG

SEQ ID NO: 1081566 - protein, 17 aa, Mycobacterium
VSGPLLRREFRLGNSAM

SEQ ID NO: 1081567 - protein, 23 aa, Mycobacterium
VSGWAGYVAGVIWALRCAGHPVS

SEQ ID NO: 1081568 - protein, 17 aa, Mycobacterium
VSILSQGTRFKPAKAKE

SEQ ID NO: 1081569 - protein, 22 aa, Mycobacterium
VSKFYNLVLADCGAGLFDPVTL

SEQ ID NO: 1081570 - protein, 17 aa, Mycobacterium
VSKHWVIDEIRPARIHA

SEQ ID NO: 1081571 - protein, 25 aa, Mycobacterium
VSLDSPPFYDPWFAKARTSGAIEAR

SEQ ID NO: 1081572 - protein, 24 aa, Mycobacterium
VSLKPREWYDEKGITLRLGSAATG

SEQ ID NO: 1081573 - protein, 34 aa, Mycobacterium
VSLPRNLAHWPGFLVLYYAALRPLHDDGSLLTAI

SEQ ID NO: 1081574 - protein, 29 aa, Mycobacterium
VSLSPTEFTLLRYFVINAGTVLSKPKILD

SEQ ID NO: 1081575 - protein, 25 aa, Mycobacterium
VSLTKIANDIRWMGSGPLTGLAEIQ

SEQ ID NO: 1081576 - protein, 27 aa, Mycobacterium
VSMLPAKYLNRLSDLLFILSRVANTGN

SEQ ID NO: 1081577 - protein, 28 aa, Mycobacterium
VSMTMNGAVLPILALYVVAAEEQGVPPE

SEQ ID NO: 1081578 - protein, 23 aa, Mycobacterium
VSNASPWTFVGNRPVWTNPGCTF

SEQ ID NO: 1081579 - protein, 17 aa, Mycobacterium
VSNLPAALAHLPADIQL

SEQ ID NO: 1081580 - protein, 31 aa, Mycobacterium; identical to SEQ ID NO: 952127

SEQ ID NO: 1081581 - protein, 17 aa, Mycobacterium
VSPFLGFGSLRPLLEVA

SEQ ID NO: 1081582 - protein, 19 aa, Mycobacterium
VSPPFKQAEFDILYGRGIS

SEQ ID NO: 1081583 - protein, 20 aa, Mycobacterium
VSPTWVAQPLASATPATLAW

SEQ ID NO: 1081584 - protein, 29 aa, Mycobacterium
VSQAWRSAFLRMPYQRDALARRSVIAETF

SEQ ID NO: 1081585 - protein, 25 aa, Mycobacterium
VSRDIPVRLVYIIDPAQAPAGDRDG

SEQ ID NO: 1081586 - protein, 23 aa, Mycobacterium
VSRPTVYRRWPDTRSIISALLTS

SEQ ID NO: 1081587 - protein, 27 aa, Mycobacterium
VSRRCPALLRHGLQRRLLQRARAAWSA

SEQ ID NO: 1081588 - protein, 20 aa, Mycobacterium
VSRYLGPWVAEPQLWQDPVP

SEQ ID NO: 1081589 - protein, 25 aa, Mycobacterium
VSSCATCDGFFFRDQDIAVIGGGDS

SEQ ID NO: 1081590 - protein, 21 aa, Mycobacterium
VSSRYKAPFAFTGGSIARVTI

SEQ ID NO: 1081591 - protein, 28 aa, Mycobacterium
VSTKPGIYYPPLRNLMERRLRALERRYA

SEQ ID NO: 1081592 - protein, 17 aa, Mycobacterium
VSTNFLWAPDPGPMRLV

SEQ ID NO: 1081593 - protein, 23 aa, Mycobacterium
VSTQAMLAFTKHAGQMLALNQAA

SEQ ID NO: 1081594 - protein, 25 aa, Mycobacterium
VSTQLTMLMADHWCRAYDLSSLRVV

SEQ ID NO: 1081595 - protein, 22 aa, Mycobacterium
VSTTWPKLKGAPMLGISVLGEA

SEQ ID NO: 1081596 - protein, 18 aa, Mycobacterium
VSVAVEVSVLGGGGLTVV

SEQ ID NO: 1081597 - protein, 18 aa, Mycobacterium
VSVFAHRARLVLGQLAVA

SEQ ID NO: 1081598 - protein, 26 aa, Mycobacterium
VSVHPVFNLYNKRWPIRGESENLAPA

SEQ ID NO: 1081599 - protein, 26 aa, Mycobacterium
VSVPEEVAWRLGWIDDEQLMRRARSL

SEQ ID NO: 1081600 - protein, 23 aa, Mycobacterium
VSVQAMLDMPLEEFQRIQDTNVT

SEQ ID NO: 1081601 - protein, 20 aa, Mycobacterium
VSVRALIDFTIDTFGRLDIV

SEQ ID NO: 1081602 - protein, 17 aa, Mycobacterium
VTAMVTRILALQTKPTP

SEQ ID NO: 1081603 - protein, 23 aa, Mycobacterium
VTANGRFTIAAYAAPKSAGLWRE

SEQ ID NO: 1081604 - protein, 29 aa, Mycobacterium
VTANRAELAVLILTNLFGQSPTQATYPSG

SEQ ID NO: 1081605 - protein, 23 aa, Mycobacterium
VTAQLARWDGGVALGFDGFARLS

SEQ ID NO: 1081606 - protein, 30 aa, Mycobacterium; identical to SEQ ID NO: 875581

SEQ ID NO: 1081607 - protein, 21 aa, Mycobacterium
VTATFFNADYIKKGLTKNTRV

SEQ ID NO: 1081608 - protein, 33 aa, Mycobacterium
VTAVNELMLFDAHNPRSLIYQLERLRANLEDLP

SEQ ID NO: 1081609 - protein, 23 aa, Mycobacterium
VTAWLRTINTLGRSAFQLGVLER

SEQ ID NO: 1081610 - protein, 25 aa, Mycobacterium
VTCNSAPAVLFYLGGQLEGVITLEI

SEQ ID NO: 1081611 - protein, 26 aa, Mycobacterium
VTDDFPLAMAWAHLRILRLADGPDEV

SEQ ID NO: 1081612 - protein, 25 aa, Mycobacterium
VTDGDLLKGVRYYPGGCTTQSIVMR

SEQ ID NO: 1081613 - protein, 17 aa, Mycobacterium
VTDLARAIPLPTQFEFM

SEQ ID NO: 1081614 - protein, 31 aa, Mycobacterium
VTDREPLTDLDWARVLLLSEVTFASSLIGAG

SEQ ID NO: 1081615 - protein, 27 aa, Mycobacterium
VTDSMPALHLLPLADALGVLPVLATDV

SEQ ID NO: 1081616 - protein, 26 aa, Mycobacterium
VTELVGLARYPLPMAPVAAAEQAGQP

SEQ ID NO: 1081617 - protein, 26 aa, Mycobacterium
VTEVRMFLHHVPGLAFLPNRRPAEPN

SEQ ID NO: 1081618 - protein, 28 aa, Mycobacterium
VTFAQPYPAWRELFDNLLPAHIVKDVPG

SEQ ID NO: 1081619 - protein, 28 aa, Mycobacterium
VTFAQPYPAWRELFSNILPAHIVKDVPG

SEQ ID NO: 1081620 - protein, 27 aa, Mycobacterium
VTFIGQPLWGSIGYTLPAALGAAVAHP

SEQ ID NO: 1081621 - protein, 31 aa, Mycobacterium; identical to SEQ ID NO: 875694

SEQ ID NO: 1081622 - protein, 19 aa, Mycobacterium
VTGLDISPTALITAARRAD

SEQ ID NO: 1081623 - protein, 29 aa, Mycobacterium
VTGLSLSPTLIFDYPTPNGLANYIRAELA

SEQ ID NO: 1081624 - protein, 20 aa, Mycobacterium
VTGPYDYLLHIRVRDTADLD

SEQ ID NO: 1081625 - protein, 31 aa, Mycobacterium
VTGYLVLDQPWPSMLRGIWGDPARFHYAYWS

SEQ ID NO: 1081626 - protein, 18 aa, Mycobacterium
VTHHVPFADWVDGRVLLG

SEQ ID NO: 1081627 - protein, 21 aa, Mycobacterium
VTIDGFKVVPLVLSWSADPAK

SEQ ID NO: 1081628 - protein, 17 aa, Mycobacterium
VTISSAAKMFNCTGWKI

SEQ ID NO: 1081629 - protein, 18 aa, Mycobacterium
VTITAFHFFDQPAALREF

SEQ ID NO: 1081630 - protein, 17 aa, Mycobacterium
VTLLEKHGDFLRDFRGD

SEQ ID NO: 1081631 - protein, 19 aa, Mycobacterium
VTLMHEHVFIMTTEIAQNY

SEQ ID NO: 1081632 - protein, 23 aa, Mycobacterium
VTNANLFWGLRGGAGCVGIVTDL

SEQ ID NO: 1081633 - protein, 35 aa, Mycobacterium; identical to SEQ ID NO: 875810

SEQ ID NO: 1081634 - protein, 23 aa, Mycobacterium
VTPLQQRVLLAWLGDRDDLTVVG

SEQ ID NO: 1081635 - protein, 22 aa, Mycobacterium
VTRAIAAWLWSGRSATAVGLSP

SEQ ID NO: 1081636 - protein, 25 aa, Mycobacterium
VTRARVHLALTWALARSPGGRQGRK

SEQ ID NO: 1081637 - protein, 27 aa, Mycobacterium
VTRSTAPPRILWLDSAAPDQLVLEVRS

SEQ ID NO: 1081638 - protein, 19 aa, Mycobacterium
VTSALFEVLSKHGVELLNV

SEQ ID NO: 1081639 - protein, 27 aa, Mycobacterium
VTSLGLVQLTRKRLGTGLIEAFSTSCP

SEQ ID NO: 1081640 - protein, 17 aa, Mycobacterium
VTTALLRPTWWEGDGPP

SEQ ID NO: 1081641 - protein, 25 aa, Mycobacterium
VTTLDGAPLWTQRRSIYARGEGGFG

SEQ ID NO: 1081642 - protein, 23 aa, Mycobacterium
VTTRCLPIWLTAALLVTDVASQV

SEQ ID NO: 1081643 - protein, 24 aa, Mycobacterium
VTTSYFESKLPAGTPVVRAMPNAA

SEQ ID NO: 1081644 - protein, 18 aa, Mycobacterium
VTVILDYCSKHGIAVIPC

SEQ ID NO: 1081645 - protein, 18 aa, Mycobacterium
VTVLLPPADSRLLTRELF

SEQ ID NO: 1081646 - protein, 18 aa, Mycobacterium
VTVPVRYLRDFSAVAEVV

SEQ ID NO: 1081647 - protein, 23 aa, Mycobacterium
VTVPVSFTELALGSTLSVPTLDG

SEQ ID NO: 1081648 - protein, 22 aa, Mycobacterium
VTVQTLYLAWGSKRALLRGYLE

SEQ ID NO: 1081649 - protein, 18 aa, Mycobacterium
VTYGWLLSGLARAVTGKG

SEQ ID NO: 1081650 - protein, 17 aa, Mycobacterium
VVAAARWARSELDYLPG

SEQ ID NO: 1081651 - protein, 18 aa, Mycobacterium
VVAAMHWDGDVTGLVRSH

SEQ ID NO: 1081652 - protein, 17 aa, Mycobacterium
VVAANRSLLAALVATNF

SEQ ID NO: 1081653 - protein, 23 aa, Mycobacterium
VVAANRVLLTTLIVTNFFGQNTP

SEQ ID NO: 1081654 - protein, 18 aa, Mycobacterium
VVAARRALPQWAGVTTAE

SEQ ID NO: 1081655 - protein, 23 aa, Mycobacterium
VVADLAALLREAALRAASRASTD

SEQ ID NO: 1081656 - protein, 31 aa, Mycobacterium; identical to SEQ ID NO: 118502

SEQ ID NO: 1081657 - protein, 26 aa, Mycobacterium
VVAGTGRLLELLPRFGFDDQACELLA

SEQ ID NO: 1081658 - protein, 19 aa, Mycobacterium
VVALPMRVRFRGITTREVA

SEQ ID NO: 1081659 - protein, 24 aa, Mycobacterium
VVAMFFGLRQALRFKLRQPGTALG

SEQ ID NO: 1081660 - protein, 20 aa, Mycobacterium
VVANGTFTQTLFGDGGNGGN

SEQ ID NO: 1081661 - protein, 23 aa, Mycobacterium
VVAPLAPLHGWGPDPYLTPGLTE

SEQ ID NO: 1081662 - protein, 18 aa, Mycobacterium
VVAQANWTLWRDDNERLI

SEQ ID NO: 1081663 - protein, 28 aa, Mycobacterium
VVATITPWNYPLQMAVWKVMPALAAGCT

SEQ ID NO: 1081664 - protein, 23 aa, Mycobacterium
VVAVPVRLRPSATAGVRLPELVA

SEQ ID NO: 1081665 - protein, 25 aa, Mycobacterium
VVAVSDWMRAVPEQIRPWVPGTYVT

SEQ ID NO: 1081666 - protein, 19 aa, Mycobacterium
VVDGLLRYRLPDGSALDDT

SEQ ID NO: 1081667 - protein, 20 aa, Mycobacterium
VVDGVQALLPGYRLKHRVQF

SEQ ID NO: 1081668 - protein, 23 aa, Mycobacterium
VVDLCSRFLPAMVERGRGAVFNV

SEQ ID NO: 1081669 - protein, 23 aa, Mycobacterium
VVDLDLNLKLQPAKYRELLQEIL

SEQ ID NO: 1081670 - protein, 25 aa, Mycobacterium
VVDQRLLVKLPSGWSLAQAAGVPVA

SEQ ID NO: 1081671 - protein, 26 aa, Mycobacterium
VVDSGLTLSWLLRNLKSRQPKSLRVC

SEQ ID NO: 1081672 - protein, 24 aa, Mycobacterium
VVDTVWEAIALHTFFGIAERRGPI

SEQ ID NO: 1081673 - protein, 26 aa, Mycobacterium
VVDVFIGYLRRKLEANGGPRLLHTVR

SEQ ID NO: 1081674 - protein, 26 aa, Mycobacterium
VVEADPGQRLVLSWGWEGHGDPAPGE

SEQ ID NO: 1081675 - protein, 18 aa, Mycobacterium
VVEALKFHLRDLAVTFRF

SEQ ID NO: 1081676 - protein, 24 aa, Mycobacterium
VVEAMLLMRWSNKSSSARLLVDSD

SEQ ID NO: 1081677 - protein, 25 aa, Mycobacterium
VVELRLHLAALLADRGRHAEALGHC

SEQ ID NO: 1081678 - protein, 18 aa, Mycobacterium
VVEWPSRYLAAEVQAGAI

SEQ ID NO: 1081679 - protein, 19 aa, Mycobacterium
VVFDYRLELDAHREALEAA

SEQ ID NO: 1081680 - protein, 27 aa, Mycobacterium
VVFSQGTAIMVWTLMNVKNPKTNLLNT

SEQ ID NO: 1081681 - protein, 17 aa, Mycobacterium
VVFVGMIRYYDGRRRVL

SEQ ID NO: 1081682 - protein, 32 aa, Mycobacterium
VVGAIVAWNVPLFLAINKLGPAPLAGCTVVLK

SEQ ID NO: 1081683 - protein, 23 aa, Mycobacterium
VVGELGFFFKEPWGSSTHSLAAQ

SEQ ID NO: 1081684 - protein, 27 aa, Mycobacterium
VVGHPYVDIWQAVKPQRLGLKQWPNVP

SEQ ID NO: 1081685 - protein, 17 aa, Mycobacterium
VVGLASTGYYNTGLFNS

SEQ ID NO: 1081686 - protein, 20 aa, Mycobacterium
VVGMTLPIARDLASHRIRVM

SEQ ID NO: 1081687 - protein, 21 aa, Mycobacterium
VVGRERNVLLALMLSSQEQYS

SEQ ID NO: 1081688 - protein, 17 aa, Mycobacterium
VVGVHLALSTAPGALRT

SEQ ID NO: 1081689 - protein, 26 aa, Mycobacterium
VVIHNHPYYVCVLAALGRLPDLVHQT

SEQ ID NO: 1081690 - protein, 18 aa, Mycobacterium
VVIRGDTPHFDYVCNSVT

SEQ ID NO: 1081691 - protein, 17 aa, Mycobacterium
VVKGGRRFSFTALVIVG

SEQ ID NO: 1081692 - protein, 18 aa, Mycobacterium
VVKGGRRFSFTALVIVGD

SEQ ID NO: 1081693 - protein, 20 aa, Mycobacterium
VVLHPVFVRVSIGRGIVGVI

SEQ ID NO: 1081694 - protein, 18 aa, Mycobacterium
VVLIATGASPRILPSARP

SEQ ID NO: 1081695 - protein, 22 aa, Mycobacterium
VVLKPSPLTPLAGLALARIIHE

SEQ ID NO: 1081696 - protein, 19 aa, Mycobacterium
VVLPAELFDVPANIALMHQ

SEQ ID NO: 1081697 - protein, 17 aa, Mycobacterium
VVLPWDGRSHYLAAIYR

SEQ ID NO: 1081698 - protein, 19 aa, Mycobacterium
VVLTPARRGFFRSEPERIL

SEQ ID NO: 1081699 - protein, 25 aa, Mycobacterium
VVMASGPFHRPKLPGIPGIKDFRGH

SEQ ID NO: 1081700 - protein, 19 aa, Mycobacterium
VVMGLVSGVLRNYLADRDA

SEQ ID NO: 1081701 - protein, 22 aa, Mycobacterium
VVMPVLKKWRIFEREDFTGEGA

SEQ ID NO: 1081702 - protein, 26 aa, Mycobacterium
VVMQPFRGFRDLICTIPGIGGFTADV

SEQ ID NO: 1081703 - protein, 18 aa, Mycobacterium
VVMSWRLRTRHGLPVHDI

SEQ ID NO: 1081704 - protein, 18 aa, Mycobacterium
VVNPWSAERWAGASSSGS

SEQ ID NO: 1081705 - protein, 18 aa, Mycobacterium
VVNRVWFLDAVRGEVDVY

SEQ ID NO: 1081706 - protein, 34 aa, Mycobacterium
VVNSFSKYYAMTGWRLGWLLVPTELRRAVDCLTG

SEQ ID NO: 1081707 - protein, 27 aa, Mycobacterium
VVNSIRKTLKAIAVKSPYFGDRRKAFL

SEQ ID NO: 1081708 - protein, 19 aa, Mycobacterium
VVPGIARPGLTDDDLIAAA

SEQ ID NO: 1081709 - protein, 19 aa, Mycobacterium
VVPGKPAVVVLPGPPRELQ

SEQ ID NO: 1081710 - protein, 29 aa, Mycobacterium
VVPGKVAGGWFWIHALNSATQAATNDRDS

SEQ ID NO: 1081711 - protein, 17 aa, Mycobacterium
VVPLLPAQDFKRVGEGD

SEQ ID NO: 1081712 - protein, 24 aa, Mycobacterium
VVPPKPSASALRRVLRRARDGVAL

SEQ ID NO: 1081713 - protein, 18 aa, Mycobacterium
VVPVLNARFALNAANARW

SEQ ID NO: 1081714 - protein, 17 aa, Mycobacterium
VVQNKYGPWEWDGVLRA

SEQ ID NO: 1081715 - protein, 18 aa, Mycobacterium
VVQWVPDQFWPAHSTVAL

SEQ ID NO: 1081716 - protein, 19 aa, Mycobacterium
VVQYWIDHGVKFFRVDNPH

SEQ ID NO: 1081717 - protein, 20 aa, Mycobacterium
VVRFIVPRYVQDDPSLAGVL

SEQ ID NO: 1081718 - protein, 25 aa, Mycobacterium
VVRISLPANLIPLTGGYRAVMPGRV

SEQ ID NO: 1081719 - protein, 17 aa, Mycobacterium
VVRQLGLGAIAAHLPLS

SEQ ID NO: 1081720 - protein, 18 aa, Mycobacterium
VVRRRDLPIMYPLEVRFS

SEQ ID NO: 1081721 - protein, 24 aa, Mycobacterium
VVRRYGMAFERPGPRLRDYVLAVK

SEQ ID NO: 1081722 - protein, 17 aa, Mycobacterium
VVRVLGAIEIPVVAQEL

SEQ ID NO: 1081723 - protein, 18 aa, Mycobacterium
VVRVLGAIEIPVVVQELA

SEQ ID NO: 1081724 - protein, 27 aa, Mycobacterium
VVRWELRPRMLLRTIEFLWQEGHSAHI

SEQ ID NO: 1081725 - protein, 24 aa, Mycobacterium
VVTAAFYNFAPARVAKALPAAWDI

SEQ ID NO: 1081726 - protein, 19 aa, Mycobacterium
VVTALTPFAPLQSLVGLQS

SEQ ID NO: 1081727 - protein, 25 aa, Mycobacterium
VVTTVGPYMRYGLPLVAACAAAGTD

SEQ ID NO: 1081728 - protein, 18 aa, Mycobacterium
VVVEWGEGLAERLSERHL

SEQ ID NO: 1081729 - protein, 17 aa, Mycobacterium
VVVGENFTFGKKAAGSV

SEQ ID NO: 1081730 - protein, 25 aa, Mycobacterium
VVVIGRGVTVGRPLGLLLTRRSENA

SEQ ID NO: 1081731 - protein, 17 aa, Mycobacterium
VVVLRTFSKAYGLAGLR

SEQ ID NO: 1081732 - protein, 21 aa, Mycobacterium
VVVVSIFVNPLQFGAGEDLDA

SEQ ID NO: 1081733 - protein, 26 aa, Mycobacterium
VVVVSYLLAEGLFQERLRACGADVVT

SEQ ID NO: 1081734 - protein, 17 aa, Mycobacterium
VVWIADWADDMVHLSAH

SEQ ID NO: 1081735 - protein, 18 aa, Mycobacterium
VVWTPTPTQWGNGFLELL

SEQ ID NO: 1081736 - protein, 17 aa, Mycobacterium
VVYPHHGAALVEAIETR

SEQ ID NO: 1081737 - protein, 25 aa, Mycobacterium
VWDNTLFIYIIGDNGAAPGGGHGGV

SEQ ID NO: 1081738 - protein, 19 aa, Mycobacterium
VWELETYGALFDRLKDGKI

SEQ ID NO: 1081739 - protein, 25 aa, Mycobacterium
VWEPGDEFLPFKPTAFRMLAMSKRP

SEQ ID NO: 1081740 - protein, 26 aa, Mycobacterium
VWINDAHQINCRLLFGGYKQSGVGRE

SEQ ID NO: 1081741 - protein, 20 aa, Mycobacterium
VWKNAPLFRQLREPQSAGAC

SEQ ID NO: 1081742 - protein, 17 aa, Mycobacterium
VWRTFGQDRLQAMASTA

SEQ ID NO: 1081743 - protein, 24 aa, Mycobacterium
VWSCHLGRPLAADSSLLGAGIGSL

SEQ ID NO: 1081744 - protein, 20 aa, Mycobacterium
VWSNFGVTQQPAWAFISANG

SEQ ID NO: 1081745 - protein, 33 aa, Mycobacterium
VWTSLTTMIIPVGGAPYVLRPKGRQDYDLATTV

SEQ ID NO: 1081746 - protein, 18 aa, Mycobacterium
VYANLLAPHSIRVNSLHP

SEQ ID NO: 1081747 - protein, 17 aa, Mycobacterium
VYAPAISPLVRLAETDA

SEQ ID NO: 1081748 - protein, 24 aa, Mycobacterium
VYAPDFDLIAERLALAESTLSGAA

SEQ ID NO: 1081749 - protein, 18 aa, Mycobacterium
VYEALLAHKGIRGLVVCC

SEQ ID NO: 1081750 - protein, 26 aa, Mycobacterium
VYFAGYAMWNYLTTPYLLTREGVEVS

SEQ ID NO: 1081751 - protein, 23 aa, Mycobacterium
VYGFTAMLINLLREEAPTHIAAA

SEQ ID NO: 1081752 - protein, 18 aa, Mycobacterium
VYGSWNLHRASTGQPLDW

SEQ ID NO: 1081753 - protein, 20 aa, Mycobacterium
VYHYYASKSLILFDIYRQAA

SEQ ID NO: 1081754 - protein, 20 aa, Mycobacterium
VYIGGIQRLLEAGQTPDYMI

SEQ ID NO: 1081755 - protein, 26 aa, Mycobacterium
VYKNLAHGIVALVYRCRPLGDEAHAT

SEQ ID NO: 1081756 - protein, 29 aa, Mycobacterium
VYNAVLKRYWYHAWWFYPHSIVRGGIDKV

SEQ ID NO: 1081757 - protein, 18 aa, Mycobacterium
VYPTNDWHERETYDFFGI

SEQ ID NO: 1081758 - protein, 22 aa, Mycobacterium
VYRGAEYSVDFVPKVRIEVVVD

SEQ ID NO: 1081759 - protein, 17 aa, Mycobacterium
VYRVAAKLRLMADELIE

SEQ ID NO: 1081760 - protein, 20 aa, Mycobacterium
VYVRATRVPPIAGAAPAVPD

SEQ ID NO: 1081761 - protein, 17 aa, Mycobacterium
WAAAQPWCDGNVGMIGI

SEQ ID NO: 1081762 - protein, 26 aa, Mycobacterium
WAAWNPQRRARVLMRFIELVNQNTDE

SEQ ID NO: 1081763 - protein, 29 aa, Mycobacterium
WAGNEPGFGVPWIYNYLGAPWKTQRTVNR

SEQ ID NO: 1081764 - protein, 31 aa, Mycobacterium; identical to SEQ ID NO: 876833

SEQ ID NO: 1081765 - protein, 17 aa, Mycobacterium
WAGRVCGDTFVPVRALL

SEQ ID NO: 1081766 - protein, 18 aa, Mycobacterium
WAHYVRNGLRFPGEKGTT

SEQ ID NO: 1081767 - protein, 18 aa, Mycobacterium
WAINQSLQLGRPAQISDL

SEQ ID NO: 1081768 - protein, 18 aa, Mycobacterium
WAPAAFITACARSAWRSG

SEQ ID NO: 1081769 - protein, 18 aa, Mycobacterium
WAPRPAAEPIAAPLPPTL

SEQ ID NO: 1081770 - protein, 19 aa, Mycobacterium
WAQLQLPRVPGMEPLVMGG

SEQ ID NO: 1081771 - protein, 22 aa, Mycobacterium
WARDYWIAFDKFRRLDRVHTIQ

SEQ ID NO: 1081772 - protein, 17 aa, Mycobacterium
WAVNLPEELLHAAPNQI

SEQ ID NO: 1081773 - protein, 17 aa, Mycobacterium
WAVVQQRRSLLAAGITA

SEQ ID NO: 1081774 - protein, 23 aa, Mycobacterium
WCGYSCSLSPRPTPAACCGRSPT

SEQ ID NO: 1081775 - protein, 24 aa, Mycobacterium
WCMTLGIELLLASDIRIAAAGTRF

SEQ ID NO: 1081776 - protein, 17 aa, Mycobacterium
WCTAWGGPSTRWAPSSS

SEQ ID NO: 1081777 - protein, 18 aa, Mycobacterium
WCVRLVQGGGFAGPLFDG

SEQ ID NO: 1081778 - protein, 23 aa, Mycobacterium
WDAVLEVNLLAPQRLTEGLVGNG

SEQ ID NO: 1081779 - protein, 18 aa, Mycobacterium
WDCAVTDMLVARMPADHV

SEQ ID NO: 1081780 - protein, 29 aa, Mycobacterium
WDDIAWLRELWGGPFMLKGVMRVDDAKRA

SEQ ID NO: 1081781 - protein, 24 aa, Mycobacterium
WDGKTGDYVAIPPQRHALHAIEDS

SEQ ID NO: 1081782 - protein, 30 aa, Mycobacterium
WDHGGKGIGSLFSWTQNPGGLKPSSRGKPH

SEQ ID NO: 1081783 - protein, 19 aa, Mycobacterium
WDHNPRWKGITRTYTPQDV

SEQ ID NO: 1081784 - protein, 18 aa, Mycobacterium
WDIRRLISWIRMQEPESL

SEQ ID NO: 1081785 - protein, 21 aa, Mycobacterium
WDKRFLGKHLITAHPMGGCAT

SEQ ID NO: 1081786 - protein, 20 aa, Mycobacterium
WDLAGLFNPDPDVPGACYTR

SEQ ID NO: 1081787 - protein, 27 aa, Mycobacterium
WDLELIGRIGWTCRDVWWAATQDPRSW

SEQ ID NO: 1081788 - protein, 21 aa, Mycobacterium
WDNVRACHPVFAGDTLYASST

SEQ ID NO: 1081789 - protein, 21 aa, Mycobacterium
WDPAELRLVVADLLAKSRPSV

SEQ ID NO: 1081790 - protein, 17 aa, Mycobacterium
WDREKLGERLAKLAGGV

SEQ ID NO: 1081791 - protein, 17 aa, Mycobacterium
WDRGYCWAIRAPANSRV

SEQ ID NO: 1081792 - protein, 18 aa, Mycobacterium
WDVAVAEVGLPIAKVWGL

SEQ ID NO: 1081793 - protein, 30 aa, Mycobacterium
WDVDPALRRPGRFDRMIFVGLPDAEARAGI

SEQ ID NO: 1081794 - protein, 18 aa, Mycobacterium
WDVIGDTGIGFCLDTCHA

SEQ ID NO: 1081795 - protein, 17 aa, Mycobacterium
WDYPRPPRLEPFAGSIT

SEQ ID NO: 1081796 - protein, 18 aa, Mycobacterium
WEAPDPVWWLAHGYAVVN

SEQ ID NO: 1081797 - protein, 18 aa, Mycobacterium
WEEILGRPVLDPDADFFR

SEQ ID NO: 1081798 - protein, 18 aa, Mycobacterium
WEKPLALADVLDVGLRSS

SEQ ID NO: 1081799 - protein, 18 aa, Mycobacterium
WEPFVVRGFSPDSGSTWL

SEQ ID NO: 1081800 - protein, 37 aa, Mycobacterium; identical to SEQ ID NO: 877083

SEQ ID NO: 1081801 - protein, 18 aa, Mycobacterium
WEQMLAVWQTADGIDVYE

SEQ ID NO: 1081802 - protein, 17 aa, Mycobacterium
WEQYSYPVTLDQLLAGN

SEQ ID NO: 1081803 - protein, 32 aa, Mycobacterium; identical to SEQ ID NO: 877087

SEQ ID NO: 1081804 - protein, 22 aa, Mycobacterium
WEVTPMGPFHQWPTGSGFEYFY

SEQ ID NO: 1081805 - protein, 25 aa, Mycobacterium
WEWPEHPRFLMCTPLSHAGAAFFTP

SEQ ID NO: 1081806 - protein, 30 aa, Mycobacterium; identical to SEQ ID NO: 877103

SEQ ID NO: 1081807 - protein, 18 aa, Mycobacterium
WEYRFGDRHTAMTVLACG

SEQ ID NO: 1081808 - protein, 18 aa, Mycobacterium
WFACYDLLHRLGGSYAIQ

SEQ ID NO: 1081809 - protein, 19 aa, Mycobacterium
WFAVLCWNNNPRKILGDTA

SEQ ID NO: 1081810 - protein, 17 aa, Mycobacterium
WFGDQPFAVCQWTQPKL

SEQ ID NO: 1081811 - protein, 17 aa, Mycobacterium
WFGGFAQEHQTATAQAG

SEQ ID NO: 1081812 - protein, 18 aa, Mycobacterium
WFQLYMWRDRDRSMALVK

SEQ ID NO: 1081813 - protein, 19 aa, Mycobacterium
WFTRPAGPGPYPLVVLAHG

SEQ ID NO: 1081814 - protein, 17 aa, Mycobacterium
WFTSAPMCDIFLVLAQA

SEQ ID NO: 1081815 - protein, 28 aa, Mycobacterium
WFTSVIPHVLVPGLVTALRATTARRALV

SEQ ID NO: 1081816 - protein, 29 aa, Mycobacterium
WGALPEWPQMLLRALMFRLAVHALHPRST

SEQ ID NO: 1081817 - protein, 20 aa, Mycobacterium
WGELFNIPLTAHFLGGAVIG

SEQ ID NO: 1081818 - protein, 17 aa, Mycobacterium
WGFHEDGAASGLRAARR

SEQ ID NO: 1081819 - protein, 38 aa, Mycobacterium
WGHRYPAAIRLWRTAWNEFIPFLDYDTKIRKVICSTNA

SEQ ID NO: 1081820 - protein, 17 aa, Mycobacterium
WGILIAITVPGEHLKQA

SEQ ID NO: 1081821 - protein, 19 aa, Mycobacterium
WGIVSAPSVILASGGLGHL

SEQ ID NO: 1081822 - protein, 18 aa, Mycobacterium
WGKHLFHHYAGGPVVHVH

SEQ ID NO: 1081823 - protein, 21 aa, Mycobacterium
WGNQMRSYVLHPYQMVKDLRT

SEQ ID NO: 1081824 - protein, 34 aa, Mycobacterium; identical to SEQ ID NO: 877203

SEQ ID NO: 1081825 - protein, 21 aa, Mycobacterium
WGRRRLAYEIAKHAEGIYAVI

SEQ ID NO: 1081826 - protein, 24 aa, Mycobacterium
WGSDAYTPLAWWGSSTQRLRLGTS

SEQ ID NO: 1081827 - protein, 25 aa, Mycobacterium
WGTNGWRFRHELLREVAAELAPPSV

SEQ ID NO: 1081828 - protein, 17 aa, Mycobacterium
WGWDRDVAVARLAGAYG

SEQ ID NO: 1081829 - protein, 18 aa, Mycobacterium
WGYRGWVMSDWGGTPGWE

SEQ ID NO: 1081830 - protein, 17 aa, Mycobacterium
WHFCQRYPGAARRVIRH

SEQ ID NO: 1081831 - protein, 27 aa, Mycobacterium
WHGPGQLVGYPIIRLAQPLDVVNYVRR

SEQ ID NO: 1081832 - protein, 18 aa, Mycobacterium
WHRPTHLSDVPWNSPDCE

SEQ ID NO: 1081833 - protein, 25 aa, Mycobacterium
WHRVTRSYRWLTRGLVLASAPRPAR

SEQ ID NO: 1081834 - protein, 20 aa, Mycobacterium
WHSPEWIACKLMAADRLLVE

SEQ ID NO: 1081835 - protein, 19 aa, Mycobacterium
WHTDVTFAANYPAASILRA

SEQ ID NO: 1081836 - protein, 24 aa, Mycobacterium
WIAEGLFGYLPPEAQDRLLDNITA

SEQ ID NO: 1081837 - protein, 22 aa, Mycobacterium
WIATEYLLRRDYDGDYWLAGRR

SEQ ID NO: 1081838 - protein, 23 aa, Mycobacterium
WIATEYLLRRDYDGDYWLAGRRS

SEQ ID NO: 1081839 - protein, 17 aa, Mycobacterium
WILNGTKCWITNGGKSS

SEQ ID NO: 1081840 - protein, 20 aa, Mycobacterium
WINSWINYGINWVNSLINWA

SEQ ID NO: 1081841 - protein, 26 aa, Mycobacterium
WKGDRHGNLLYRYSAANFNPECAPAG

SEQ ID NO: 1081842 - protein, 23 aa, Mycobacterium
WKYLMALFNSKIDEHADPKVQIQ

SEQ ID NO: 1081843 - protein, 21 aa, Mycobacterium
WLADHAVGGVVIFPGAGFVEL

SEQ ID NO: 1081844 - protein, 20 aa, Mycobacterium
WLARALAQRPVSEPLFDAVL

SEQ ID NO: 1081845 - protein, 17 aa, Mycobacterium
WLAVHQKTGVRSRLMLD

SEQ ID NO: 1081846 - protein, 25 aa, Mycobacterium
WLDDQPGYLPPVRLGEVIRAAGIGE

SEQ ID NO: 1081847 - protein, 28 aa, Mycobacterium
WLDPEMTSPYAWYQYFINTSDADVIRYL

SEQ ID NO: 1081848 - protein, 28 aa, Mycobacterium
WLDPEMTSPYAWYQYFVNTADADVIRYL

SEQ ID NO: 1081849 - protein, 17 aa, Mycobacterium
WLEFNARVLALAADDSM

SEQ ID NO: 1081850 - protein, 18 aa, Mycobacterium
WLEVSGDPEVRQLILLDA

SEQ ID NO: 1081851 - protein, 17 aa, Mycobacterium
WLGGVFPGDEAALTALS

SEQ ID NO: 1081852 - protein, 19 aa, Mycobacterium
WLGLDGLAPFQVLARSIDT

SEQ ID NO: 1081853 - protein, 17 aa, Mycobacterium
WLGLHIDERHGGSGYGL

SEQ ID NO: 1081854 - protein, 32 aa, Mycobacterium
WLGPASLSMASAFWPYVTWTSMVATQAREAAS

SEQ ID NO: 1081855 - protein, 28 aa, Mycobacterium
WLGRTALDLLAPLGLPTLALASRARTIR

SEQ ID NO: 1081856 - protein, 19 aa, Mycobacterium
WLHGYLRDLIALRRSQPGE

SEQ ID NO: 1081857 - protein, 24 aa, Mycobacterium
WLLNGQKIWSSRAPFADMGFGLFR

SEQ ID NO: 1081858 - protein, 20 aa, Mycobacterium
WLPAPLGPLGVTMRLYAPRP

SEQ ID NO: 1081859 - protein, 18 aa, Mycobacterium
WLPDLALRPLGGAVIWAN

SEQ ID NO: 1081860 - protein, 20 aa, Mycobacterium
WLPPSPSNCSSRWGHWAPPS

SEQ ID NO: 1081861 - protein, 19 aa, Mycobacterium
WLRDFFGPAAASDWYKPLA

SEQ ID NO: 1081862 - protein, 27 aa, Mycobacterium
WLSTSRELPWRRPIASLNYLLSSHVWR

SEQ ID NO: 1081863 - protein, 18 aa, Mycobacterium
WLVLCCRAMEAGAQEALA

SEQ ID NO: 1081864 - protein, 27 aa, Mycobacterium
WMACTYHGRILWRPGALPAFSDDRWEF

SEQ ID NO: 1081865 - protein, 17 aa, Mycobacterium
WMALSIRLPAGVSRQSL

SEQ ID NO: 1081866 - protein, 17 aa, Mycobacterium
WMQAIADVTGRPVHVSA

SEQ ID NO: 1081867 - protein, 21 aa, Mycobacterium
WMRQHWGIENSLHWIRAVTFD

SEQ ID NO: 1081868 - protein, 17 aa, Mycobacterium
WMSVLKPIQPRLYSISS

SEQ ID NO: 1081869 - protein, 22 aa, Mycobacterium
WMTSVPMLREFLVSNLVLVLSP

SEQ ID NO: 1081870 - protein, 18 aa, Mycobacterium
WMVYVSLRREVAGKTVAY

SEQ ID NO: 1081871 - protein, 20 aa, Mycobacterium
WNEITPCNLSLDRLAKSVKE

SEQ ID NO: 1081872 - protein, 18 aa, Mycobacterium
WNLKLSHPDLLYSPTQSW

SEQ ID NO: 1081873 - protein, 21 aa, Mycobacterium
WNPAEPLEFIELPTPEPQAGE

SEQ ID NO: 1081874 - protein, 18 aa, Mycobacterium
WPALDFVRPWDSLTDDER

SEQ ID NO: 1081875 - protein, 32 aa, Mycobacterium; identical to SEQ ID NO: 877520

SEQ ID NO: 1081876 - protein, 24 aa, Mycobacterium
WPGAYGTWWQADPGADLILLYLIQ

SEQ ID NO: 1081877 - protein, 21 aa, Mycobacterium
WPGSRQYLPKPVIGATTRAFD

SEQ ID NO: 1081878 - protein, 18 aa, Mycobacterium
WPGTDRSWLDGWLLRACH

SEQ ID NO: 1081879 - protein, 17 aa, Mycobacterium
WPGVTRPTSIGGLGFSM

SEQ ID NO: 1081880 - protein, 30 aa, Mycobacterium
WPKNLSSHLMYGGWWTFPEPDIERTGLLVI

SEQ ID NO: 1081881 - protein, 22 aa, Mycobacterium
WPPMPYPDTWAVWQEDEGRKVI

SEQ ID NO: 1081882 - protein, 18 aa, Mycobacterium
WPVNGTVFAVTPTLREAY

SEQ ID NO: 1081883 - protein, 19 aa, Mycobacterium
WPVVFPELPPSPDGGPRRP

SEQ ID NO: 1081884 - protein, 20 aa, Mycobacterium
WQLMSTPTISFPKTPLNPGA

SEQ ID NO: 1081885 - protein, 17 aa, Mycobacterium
WQLRRRVLALGNVEIRQ

SEQ ID NO: 1081886 - protein, 27 aa, Mycobacterium
WQMSTIQLDFNFPERFGLEYTAADGTR

SEQ ID NO: 1081887 - protein, 17 aa, Mycobacterium
WQSFRVPCLPTDRLLNL

SEQ ID NO: 1081888 - protein, 17 aa, Mycobacterium
WQWLQDGAQVYVCGTAD

SEQ ID NO: 1081889 - protein, 26 aa, Mycobacterium
WRDARWLAVVINYRAQRWSDVVKLLT

SEQ ID NO: 1081890 - protein, 35 aa, Mycobacterium
WRDLGRPLYLHRILLQRSWIAIFWGRFAQAVEMIA

SEQ ID NO: 1081891 - protein, 25 aa, Mycobacterium
WRDPRVWWQLRNPFTPSWGEPYLEI

SEQ ID NO: 1081892 - protein, 18 aa, Mycobacterium
WRFTPLRRLRGLHDGSAV

SEQ ID NO: 1081893 - protein, 17 aa, Mycobacterium
WRGLSKVGKAVDARIIN

SEQ ID NO: 1081894 - protein, 19 aa, Mycobacterium
WRLIRVVGDYYKPGFHPSQ

SEQ ID NO: 1081895 - protein, 25 aa, Mycobacterium
WRLYTRSRFAPYVEKLLLDGARTKL

SEQ ID NO: 1081896 - protein, 17 aa, Mycobacterium
WRRAQGLPVCAIGWGAW

SEQ ID NO: 1081897 - protein, 26 aa, Mycobacterium
WSAWLVGAWWPAPPEASAAGVTYWHR

SEQ ID NO: 1081898 - protein, 19 aa, Mycobacterium
WSFLYRHIIVALRDHFRCI

SEQ ID NO: 1081899 - protein, 20 aa, Mycobacterium
WSLEVIDLRSLIPLDFETIA

SEQ ID NO: 1081900 - protein, 17 aa, Mycobacterium
WSMAVALRLAAFALLRA

SEQ ID NO: 1081901 - protein, 23 aa, Mycobacterium
WSNEQIHERFGFSEIMMGTLEKD

SEQ ID NO: 1081902 - protein, 31 aa, Mycobacterium; identical to SEQ ID NO: 877770

SEQ ID NO: 1081903 - protein, 18 aa, Mycobacterium
WSRTYARQPEILAYLESV

SEQ ID NO: 1081904 - protein, 24 aa, Mycobacterium
WSVTGIGQFLPLDGASPAIGSVGT

SEQ ID NO: 1081905 - protein, 24 aa, Mycobacterium
WSYEDPPPESVPIKGFLSFDEGVV

SEQ ID NO: 1081906 - protein, 18 aa, Mycobacterium
WTAAHGVAALLIAKPHLP

SEQ ID NO: 1081907 - protein, 20 aa, Mycobacterium
WTEVALWGQGWPLGVDRAIA

SEQ ID NO: 1081908 - protein, 29 aa, Mycobacterium
WTFDPVRRQFYWHRFFSHQPDLNYDNPAV

SEQ ID NO: 1081909 - protein, 22 aa, Mycobacterium
WTFDVLTHHWATLWPVRHRPAR

SEQ ID NO: 1081910 - protein, 19 aa, Mycobacterium
WTGPLGVTYPGVVTHGIVQ

SEQ ID NO: 1081911 - protein, 22 aa, Mycobacterium
WTGRKIAELVNEPLWRVVQAHP

SEQ ID NO: 1081912 - protein, 23 aa, Mycobacterium
WTPVTLLEGGTPLIAAPRLSEQT

SEQ ID NO: 1081913 - protein, 19 aa, Mycobacterium
WTSLIAYADWVCLAVRTNP

SEQ ID NO: 1081914 - protein, 25 aa, Mycobacterium
WTTALLHPRLVRAIALISSPHPAAL

SEQ ID NO: 1081915 - protein, 24 aa, Mycobacterium
WTTTFADALIEYAGKRRDIVAITA

SEQ ID NO: 1081916 - protein, 29 aa, Mycobacterium
WVAEAEVVDFPLHPGFAASWQGLRCAPVT

SEQ ID NO: 1081917 - protein, 18 aa, Mycobacterium
WVAFPNVEQLERAVFDMV

SEQ ID NO: 1081918 - protein, 20 aa, Mycobacterium
WVARIGTVVMSWRLRTRHGL

SEQ ID NO: 1081919 - protein, 35 aa, Mycobacterium; identical to SEQ ID NO: 877907

SEQ ID NO: 1081920 - protein, 19 aa, Mycobacterium
WVKPLPPQTLTGKTVAVVG

SEQ ID NO: 1081921 - protein, 17 aa, Mycobacterium
WVLTKGKLPTSLWIEIV

SEQ ID NO: 1081922 - protein, 22 aa, Mycobacterium
WVNRYHALVYPLVSQPAKTSDP

SEQ ID NO: 1081923 - protein, 28 aa, Mycobacterium
WVRALADLRVARLLAYRAVALRDDPTSG

SEQ ID NO: 1081924 - protein, 26 aa, Mycobacterium
WVRDSTFALWGLYTLGLDREADDFFA

SEQ ID NO: 1081925 - protein, 20 aa, Mycobacterium
WVRRRLHEVVVHRADAAIAL

SEQ ID NO: 1081926 - protein, 20 aa, Mycobacterium
WVSLFDPHRLADLLRMPDGA

SEQ ID NO: 1081927 - protein, 23 aa, Mycobacterium
WVTPRLVSKSGWRSGWRRWPRRR

SEQ ID NO: 1081928 - protein, 17 aa, Mycobacterium
WVVDPRELGLTTSVYSS

SEQ ID NO: 1081929 - protein, 18 aa, Mycobacterium
WYGLSVNGPIARSVLDTA

SEQ ID NO: 1081930 - protein, 19 aa, Mycobacterium
WYHGAPGIGLGRIGLARRG

SEQ ID NO: 1081931 - protein, 25 aa, Mycobacterium
YAALFGTWEPVVSAVPLLNMIAMDE

SEQ ID NO: 1081932 - protein, 18 aa, Mycobacterium
YAASAPRIGSPRWDSAII

SEQ ID NO: 1081933 - protein, 28 aa, Mycobacterium
YAEAARRIHLLPMLRWKCVESPLGLNHP

SEQ ID NO: 1081934 - protein, 29 aa, Mycobacterium
YAEALAEFAALRWQWHDLEVGRTAIVPDV

SEQ ID NO: 1081935 - protein, 19 aa, Mycobacterium
YAEGPLPPDAVRCPPISFL

SEQ ID NO: 1081936 - protein, 20 aa, Mycobacterium
YAFDYSVWEIFGALLGAGRL

SEQ ID NO: 1081937 - protein, 20 aa, Mycobacterium
YAFSAGGPVLWPDLEAILVV

SEQ ID NO: 1081938 - protein, 21 aa, Mycobacterium
YAGGWLFGDGGPGAAATATSA

SEQ ID NO: 1081939 - protein, 28 aa, Mycobacterium
YAIRASHAFIYVRGEVLPVLRRLQNAVA

SEQ ID NO: 1081940 - protein, 30 aa, Mycobacterium; identical to SEQ ID NO: 878125

SEQ ID NO: 1081941 - protein, 17 aa, Mycobacterium
YANALVRGVAGFLASQG

SEQ ID NO: 1081942 - protein, 22 aa, Mycobacterium
YAPFSDLIWMETGTPDLKLAKQ

SEQ ID NO: 1081943 - protein, 21 aa, Mycobacterium
YAQRRAVLLPALTSAGFSVDH

SEQ ID NO: 1081944 - protein, 21 aa, Mycobacterium
YARELASLGLPKRALVSQSTA

SEQ ID NO: 1081945 - protein, 25 aa, Mycobacterium
YAREQWRLRKLDELGWIVIRVIAGD

SEQ ID NO: 1081946 - protein, 24 aa, Mycobacterium
YARIRGRWHAALPVGRLDTAVASR

SEQ ID NO: 1081947 - protein, 22 aa, Mycobacterium
YARVLSPLHRLIRDIVGQGITE

SEQ ID NO: 1081948 - protein, 24 aa, Mycobacterium
YASSMSGFLNLSAGKWPSLVSVAQ

SEQ ID NO: 1081949 - protein, 26 aa, Mycobacterium
YATDEMRAWWGGMWADRILRSDLSAQ

SEQ ID NO: 1081950 - protein, 31 aa, Mycobacterium; identical to SEQ ID NO: 224561

SEQ ID NO: 1081951 - protein, 18 aa, Mycobacterium
YATQLMAELTDRGEKLPA

SEQ ID NO: 1081952 - protein, 29 aa, Mycobacterium
YATSASTPLFFAQAIGRFVRSRHPGETAS

SEQ ID NO: 1081953 - protein, 29 aa, Mycobacterium
YATSASTPLFFAQAIGRFVRSRRPGETAS

SEQ ID NO: 1081954 - protein, 20 aa, Mycobacterium
YAWSTILARGATSGPVGLIL

SEQ ID NO: 1081955 - protein, 28 aa, Mycobacterium
YCERNWGTGFSEHWWWGQAHDFDNADAS

SEQ ID NO: 1081956 - protein, 19 aa, Mycobacterium
YCFQVEMTWRSLNAGFAVV

SEQ ID NO: 1081957 - protein, 17 aa, Mycobacterium
YCHSTAPEIFLAAASQR

SEQ ID NO: 1081958 - protein, 17 aa, Mycobacterium
YCYASTSTSFLALPAFP

SEQ ID NO: 1081959 - protein, 27 aa, Mycobacterium
YDDYQVRIGCMWVMSFHSALVGDADQA

SEQ ID NO: 1081960 - protein, 31 aa, Mycobacterium; identical to SEQ ID NO: 878295

SEQ ID NO: 1081961 - protein, 17 aa, Mycobacterium
YDEQQSWIIMRRGRFGI

SEQ ID NO: 1081962 - protein, 20 aa, Mycobacterium
YDFFGIIFDGHPSLTRIEMP

SEQ ID NO: 1081963 - protein, 17 aa, Mycobacterium
YDGLYAKGGKWAVNPMF

SEQ ID NO: 1081964 - protein, 24 aa, Mycobacterium
YDKYHAGIVFHRGAGRTAPAGPKE

SEQ ID NO: 1081965 - protein, 21 aa, Mycobacterium
YDPARHLGGVLYLFVRGMCGP

SEQ ID NO: 1081966 - protein, 28 aa, Mycobacterium
YDQIKDLLGRELLDQRFAGMKQALEGAT

SEQ ID NO: 1081967 - protein, 21 aa, Mycobacterium
YDRFFKMCYNVLPDDGRMLLH

SEQ ID NO: 1081968 - protein, 17 aa, Mycobacterium
YDRFLELAAIRTKAVRQ

SEQ ID NO: 1081969 - protein, 30 aa, Mycobacterium; identical to SEQ ID NO: 878369

SEQ ID NO: 1081970 - protein, 24 aa, Mycobacterium
YDSQTLFLGCVLHDLGAGSAAPGK

SEQ ID NO: 1081971 - protein, 30 aa, Mycobacterium; identical to SEQ ID NO: 878393

SEQ ID NO: 1081972 - protein, 18 aa, Mycobacterium
YDVLRELGGLFADPAGAA

SEQ ID NO: 1081973 - protein, 17 aa, Mycobacterium
YDVWTPDAAPKAVVVLA

SEQ ID NO: 1081974 - protein, 18 aa, Mycobacterium
YEAFDRWGLMPRMFVGAA

SEQ ID NO: 1081975 - protein, 24 aa, Mycobacterium
YEANLVRLTELPSGSPVAVVVRQL

SEQ ID NO: 1081976 - protein, 23 aa, Mycobacterium
YEEKFGYVYLVCATGRSAEDLLE

SEQ ID NO: 1081977 - protein, 22 aa, Mycobacterium
YEFALESISKIFTLALVIEQRG

SEQ ID NO: 1081978 - protein, 32 aa, Mycobacterium; identical to SEQ ID NO: 118634

SEQ ID NO: 1081979 - protein, 20 aa, Mycobacterium
YEISDPQPLALLPEPNPGDL

SEQ ID NO: 1081980 - protein, 27 aa, Mycobacterium
YEKAHLPADAWPPTSWYADWVSGLDVF

SEQ ID NO: 1081981 - protein, 18 aa, Mycobacterium
YEMAFALTVPPPVIASNR

SEQ ID NO: 1081982 - protein, 25 aa, Mycobacterium
YENEWGWTWPLNRRVLYNRASADPQ

SEQ ID NO: 1081983 - protein, 25 aa, Mycobacterium
YEPAANFPLPPVQPTKPPKANEVKI

SEQ ID NO: 1081984 - protein, 17 aa, Mycobacterium
YEPFGLVALEAAAAGTP

SEQ ID NO: 1081985 - protein, 17 aa, Mycobacterium
YERLDARGYGYGPAFRG

SEQ ID NO: 1081986 - protein, 24 aa, Mycobacterium
YERYMKYLTGCARAFRIGYIDCNQ

SEQ ID NO: 1081987 - protein, 20 aa, Mycobacterium
YERYWLYPGAQNLANFRAHL

SEQ ID NO: 1081988 - protein, 28 aa, Mycobacterium
YESGWTFDHFYPIFSDPTGPCLEGWTTL

SEQ ID NO: 1081989 - protein, 25 aa, Mycobacterium
YETDLLRPIIDLVAARAPRGYDQGN

SEQ ID NO: 1081990 - protein, 18 aa, Mycobacterium
YFAWEAAGLRWLSDVDGG

SEQ ID NO: 1081991 - protein, 19 aa, Mycobacterium
YFDTLTMIKQLLGGLAMRR

SEQ ID NO: 1081992 - protein, 18 aa, Mycobacterium
YFEFSERLHTMPSHRVLA

SEQ ID NO: 1081993 - protein, 18 aa, Mycobacterium
YFEHCRDQWATGGPLRAF

SEQ ID NO: 1081994 - protein, 17 aa, Mycobacterium
YFERVFALQREVFPSDW

SEQ ID NO: 1081995 - protein, 26 aa, Mycobacterium
YFEVLHELKLIVDLMYEGGIARMNYS

SEQ ID NO: 1081996 - protein, 17 aa, Mycobacterium
YFLNIKGPELLNKFVGE

SEQ ID NO: 1081997 - protein, 19 aa, Mycobacterium
YFLVIYSHKDSSAIIKMDN

SEQ ID NO: 1081998 - protein, 17 aa, Mycobacterium
YFNDHGAQIDRFANSLI

SEQ ID NO: 1081999 - protein, 19 aa, Mycobacterium
YFPFDPALRDRQDLGHQPV

SEQ ID NO: 1082000 - protein, 25 aa, Mycobacterium
YFQGWTAVTKHRTPWKADAPPPFDD

SEQ ID NO: 1082001 - protein, 19 aa, Mycobacterium
YFVFAGIRQVVILSGVAVY

SEQ ID NO: 1082002 - protein, 17 aa, Mycobacterium
YFVHSYAAQRWEGSSGA

SEQ ID NO: 1082003 - protein, 27 aa, Mycobacterium
YGAENAVWRNFFLCGAAELRDGKFGTA

SEQ ID NO: 1082004 - protein, 17 aa, Mycobacterium
YGDYAFFGFFESEPDQA

SEQ ID NO: 1082005 - protein, 21 aa, Mycobacterium
YGELLGYFRQIEDVTAAWHFV

SEQ ID NO: 1082006 - protein, 26 aa, Mycobacterium
YGGMGGDYFALALALEELGKVNQSVA

SEQ ID NO: 1082007 - protein, 28 aa, Mycobacterium
YGGMGTGGRGGLGGSATLFANGAGSSVA

SEQ ID NO: 1082008 - protein, 26 aa, Mycobacterium
YGGSGGAAAGLWGAGGSGGAGGNGAD

SEQ ID NO: 1082009 - protein, 21 aa, Mycobacterium
YGHALDIPVYGVCSLDAIGGL

SEQ ID NO: 1082010 - protein, 23 aa, Mycobacterium
YGHFGQAGGFIWVDPEADLALVV

SEQ ID NO: 1082011 - protein, 22 aa, Mycobacterium
YGLIVYQEQIMFIAQKVASYTM

SEQ ID NO: 1082012 - protein, 21 aa, Mycobacterium
YGMIYFDLRPSSHAPTLELRV

SEQ ID NO: 1082013 - protein, 34 aa, Mycobacterium; identical to SEQ ID NO: 878688

SEQ ID NO: 1082014 - protein, 19 aa, Mycobacterium
YGQDRIEPLWLGSIKSNIG

SEQ ID NO: 1082015 - protein, 25 aa, Mycobacterium
YGQLAWSLRTDPRVIVIERTNVRDL

SEQ ID NO: 1082016 - protein, 19 aa, Mycobacterium
YGQRLAAFVVLEPDADLDE

SEQ ID NO: 1082017 - protein, 18 aa, Mycobacterium
YGRFTAHHAFLARMHLNL

SEQ ID NO: 1082018 - protein, 32 aa, Mycobacterium
YGRIKRQQLFLSSLLRSLISEDTLFNLNKLNN

SEQ ID NO: 1082019 - protein, 19 aa, Mycobacterium
YGRLGGGYFALAVTLEELG

SEQ ID NO: 1082020 - protein, 24 aa, Mycobacterium
YGRLVREIVLPGSSPRPYGFYFDE

SEQ ID NO: 1082021 - protein, 25 aa, Mycobacterium
YGRLWATILQHRFGGSGALAGHPIG

SEQ ID NO: 1082022 - protein, 33 aa, Mycobacterium
YGRVRRCGMVSPTVFWPIPRVYSGLVRIDRHET

SEQ ID NO: 1082023 - protein, 27 aa, Mycobacterium
YGSASILPITWAYIRMMGADGLRAASL

SEQ ID NO: 1082024 - protein, 20 aa, Mycobacterium
YGSEISWADLIIFAGNCALD

SEQ ID NO: 1082025 - protein, 26 aa, Mycobacterium
YGVLAGYPLVNLKVTLLDGAFHEVDS

SEQ ID NO: 1082026 - protein, 18 aa, Mycobacterium
YGVLHHIASRNLPIRAGW

SEQ ID NO: 1082027 - protein, 22 aa, Mycobacterium
YHDLQWTWREYLAEAAARAAGL

SEQ ID NO: 1082028 - protein, 21 aa, Mycobacterium
YHGLHAFRWVAADGSARFVRY

SEQ ID NO: 1082029 - protein, 19 aa, Mycobacterium
YHHFGGKTELFLAIFEQMA

SEQ ID NO: 1082030 - protein, 25 aa, Mycobacterium
YHINLRPGRLYPGVKSPLALEPGNP

SEQ ID NO: 1082031 - protein, 21 aa, Mycobacterium
YHLNGGDLVWQIGTGYFGCRN

SEQ ID NO: 1082032 - protein, 17 aa, Mycobacterium
YHPLTLRIEQIIASGEL

SEQ ID NO: 1082033 - protein, 18 aa, Mycobacterium
YHRDGIIEKLPRMLGTQA

SEQ ID NO: 1082034 - protein, 23 aa, Mycobacterium
YHSWPKYFAALQRLVRPGGKVAI

SEQ ID NO: 1082035 - protein, 19 aa, Mycobacterium
YHTFGGWKRSGFGDLNQHG

SEQ ID NO: 1082036 - protein, 24 aa, Mycobacterium
YHYRYAGMTWGPIDSPVIIEDAWR

SEQ ID NO: 1082037 - protein, 27 aa, Mycobacterium
YIADGTYFYVLLADGTLRVGGMLFSAG

SEQ ID NO: 1082038 - protein, 18 aa, Mycobacterium
YIDYSKHRITRDTISLLV

SEQ ID NO: 1082039 - protein, 33 aa, Mycobacterium
YIEDLLNRSGGFGTLLLLGHDWASPQATFHSYD

SEQ ID NO: 1082040 - protein, 17 aa, Mycobacterium
YIGLGNQGAAMAKRLLD

SEQ ID NO: 1082041 - protein, 17 aa, Mycobacterium
YINRAFAAVGRLLHRHD

SEQ ID NO: 1082042 - protein, 17 aa, Mycobacterium
YIVDRRVDMIITGGANV

SEQ ID NO: 1082043 - protein, 17 aa, Mycobacterium
YKLFKRYASHEGGIADT

SEQ ID NO: 1082044 - protein, 27 aa, Mycobacterium
YKLVTDTYGIYKLDFDIEGAALYNVPA

SEQ ID NO: 1082045 - protein, 19 aa, Mycobacterium
YKVIKATRFVGHLNHNELL

SEQ ID NO: 1082046 - protein, 19 aa, Mycobacterium
YLAAIYRTDLAERVDALVA

SEQ ID NO: 1082047 - protein, 19 aa, Mycobacterium
YLAAKYRRVTARRGPLRAN

SEQ ID NO: 1082048 - protein, 18 aa, Mycobacterium
YLAALIYNDKHWAAFVDA

SEQ ID NO: 1082049 - protein, 23 aa, Mycobacterium
YLAICDLMYRRQLAGASVFLGVD

SEQ ID NO: 1082050 - protein, 26 aa, Mycobacterium
YLALEWLERMDLVDGKLICLVRAKSD

SEQ ID NO: 1082051 - protein, 19 aa, Mycobacterium
YLAPGFHGVHIHKVGKCEA

SEQ ID NO: 1082052 - protein, 18 aa, Mycobacterium
YLDAWFEAVGITENVVLV

SEQ ID NO: 1082053 - protein, 20 aa, Mycobacterium
YLDRAAILAAAAKAGARLIH

SEQ ID NO: 1082054 - protein, 17 aa, Mycobacterium
YLEVWRTASDYDATKGS

SEQ ID NO: 1082055 - protein, 17 aa, Mycobacterium
YLFGVLEAGKKGAFRPL

SEQ ID NO: 1082056 - protein, 25 aa, Mycobacterium
YLGAYLIRELLIQTEARISCLVRAS

SEQ ID NO: 1082057 - protein, 19 aa, Mycobacterium
YLGTQPRDFLAVATPGSGK

SEQ ID NO: 1082058 - protein, 18 aa, Mycobacterium
YLHAKSREQVPETLWPVL

SEQ ID NO: 1082059 - protein, 20 aa, Mycobacterium
YLHLPFVSIPIPINPPPPPA

SEQ ID NO: 1082060 - protein, 25 aa, Mycobacterium
YLIDGRPVILTAPKRPAPSGPGRTR

SEQ ID NO: 1082061 - protein, 28 aa, Mycobacterium
YLIPSPTLPMLLPLEQIGVPAPILAGLN

SEQ ID NO: 1082062 - protein, 17 aa, Mycobacterium
YLIVRAGEFSRISDVLL

SEQ ID NO: 1082063 - protein, 17 aa, Mycobacterium
YLKRPLIDGPAPEPAKH

SEQ ID NO: 1082064 - protein, 18 aa, Mycobacterium
YLLGFVFSGIERALGENP

SEQ ID NO: 1082065 - protein, 22 aa, Mycobacterium
YLLLAEIVRLVSGKSLPDFLSI

SEQ ID NO: 1082066 - protein, 20 aa, Mycobacterium
YLRAGRSLPRRDRGTALLCP

SEQ ID NO: 1082067 - protein, 17 aa, Mycobacterium
YLRDIHLIRRGKIDDEG

SEQ ID NO: 1082068 - protein, 24 aa, Mycobacterium
YLSAAGRLLDPRPLSCAIAAVSVG

SEQ ID NO: 1082069 - protein, 17 aa, Mycobacterium
YLSIIQNGQRRVAHEDI

SEQ ID NO: 1082070 - protein, 23 aa, Mycobacterium
YLTAFAALWETINLEDWKCWARW

SEQ ID NO: 1082071 - protein, 25 aa, Mycobacterium
YLTDLGIRFMPTVGWAERGDLRAEG

SEQ ID NO: 1082072 - protein, 17 aa, Mycobacterium
YLTGCENFFRKGISNVG

SEQ ID NO: 1082073 - protein, 26 aa, Mycobacterium
YLTRKDIPIHYLLADTFTVCDRYFSS

SEQ ID NO: 1082074 - protein, 19 aa, Mycobacterium
YLVARTERIRLGTNILLAA

SEQ ID NO: 1082075 - protein, 18 aa, Mycobacterium
YLVEGVGEDFWPATYDHA

SEQ ID NO: 1082076 - protein, 18 aa, Mycobacterium
YLVPVLRHMAERGTGVIA

SEQ ID NO: 1082077 - protein, 18 aa, Mycobacterium
YLVRGIPPGHVGAAWRGT

SEQ ID NO: 1082078 - protein, 17 aa, Mycobacterium
YLVSEDRVTVLSARSQD

SEQ ID NO: 1082079 - protein, 17 aa, Mycobacterium
YLVVGGRRGGSAMAAAA

SEQ ID NO: 1082080 - protein, 20 aa, Mycobacterium
YMLGSRSALAWIIDRYQVKT

SEQ ID NO: 1082081 - protein, 18 aa, Mycobacterium
YMLTGVIAATEKALRRAG

SEQ ID NO: 1082082 - protein, 23 aa, Mycobacterium
YMPAHYSAGWWMDSSSSLAEAAA

SEQ ID NO: 1082083 - protein, 22 aa, Mycobacterium
YNDDFLIAHPDLAALYEADARI

SEQ ID NO: 1082084 - protein, 25 aa, Mycobacterium
YNDDITLLAVQRRAPTPPLNITEDA

SEQ ID NO: 1082085 - protein, 20 aa, Mycobacterium
YNFQFTGQRFFRIRDGRLDG

SEQ ID NO: 1082086 - protein, 35 aa, Mycobacterium; identical to SEQ ID NO: 879119

SEQ ID NO: 1082087 - protein, 29 aa, Mycobacterium
YNHYPIGWAMAFNTPYKLFKRYASHEGGI

SEQ ID NO: 1082088 - protein, 17 aa, Mycobacterium
YNKFRRGPGAFKVDFAI

SEQ ID NO: 1082089 - protein, 27 aa, Mycobacterium
YNLEFLDHIVAHPIIRWVGSANELNAG

SEQ ID NO: 1082090 - protein, 18 aa, Mycobacterium
YNMGWHKYLDARATDEQR

SEQ ID NO: 1082091 - protein, 19 aa, Mycobacterium
YNSGFRNTVYPSGTHVGNT

SEQ ID NO: 1082092 - protein, 19 aa, Mycobacterium
YNTYCVGKWHLTPMEESSM

SEQ ID NO: 1082093 - protein, 22 aa, Mycobacterium
YPDRLTVVHWLESLQGLPSATA

SEQ ID NO: 1082094 - protein, 18 aa, Mycobacterium
YPELESQQIYHMLDRVYE

SEQ ID NO: 1082095 - protein, 24 aa, Mycobacterium
YPELHGNILCIGFGGGMAAGITLL

SEQ ID NO: 1082096 - protein, 17 aa, Mycobacterium
YPERVRSLVLINASART

SEQ ID NO: 1082097 - protein, 21 aa, Mycobacterium
YPEVTLAIYASPRQTVIAGPP

SEQ ID NO: 1082098 - protein, 18 aa, Mycobacterium
YPGDAGVLAALLLNRISL

SEQ ID NO: 1082099 - protein, 20 aa, Mycobacterium
YPGTIASVAAVALYIGEVLG

SEQ ID NO: 1082100 - protein, 24 aa, Mycobacterium
YPHHVDLRAFVHLRQAPRGPVTAK

SEQ ID NO: 1082101 - protein, 23 aa, Mycobacterium
YPLGTAFRPKVWPAARRIDGAYG

SEQ ID NO: 1082102 - protein, 18 aa, Mycobacterium
YPLLAHVVLFGGGHVQRT

SEQ ID NO: 1082103 - protein, 28 aa, Mycobacterium
YPNQINNVLAFPGVFRGALDAGARRITQ

SEQ ID NO: 1082104 - protein, 25 aa, Mycobacterium
YPPEAGGYPPQPGYPPPRPQDQGGY

SEQ ID NO: 1082105 - protein, 19 aa, Mycobacterium
YPQLVPRLQFSDLVLVRSA

SEQ ID NO: 1082106 - protein, 21 aa, Mycobacterium
YPRGDFLVGDRDVLLGTLDIG

SEQ ID NO: 1082107 - protein, 19 aa, Mycobacterium
YPRVEVEVGFILAADLPGA

SEQ ID NO: 1082108 - protein, 22 aa, Mycobacterium
YPSTPLLRPIMDALLPTMPVRT

SEQ ID NO: 1082109 - protein, 25 aa, Mycobacterium
YPTGHSALLHWIGQHGLLVTEYPPG

SEQ ID NO: 1082110 - protein, 18 aa, Mycobacterium
YQAKLDWVQEFMVNELEP

SEQ ID NO: 1082111 - protein, 18 aa, Mycobacterium
YQEWLDNNLVPLEKLPSG

SEQ ID NO: 1082112 - protein, 17 aa, Mycobacterium
YQFGDIDGFWAAVLHRT

SEQ ID NO: 1082113 - protein, 18 aa, Mycobacterium
YQGTIPRTLSPLASMNLG

SEQ ID NO: 1082114 - protein, 25 aa, Mycobacterium
YQKLTGLENLQFFASLYSAPTLDPM

SEQ ID NO: 1082115 - protein, 23 aa, Mycobacterium
YQQSRWWSPRGWAHRQSAGLSAP

SEQ ID NO: 1082116 - protein, 23 aa, Mycobacterium
YQRALDEWRLLSAAALVGLVEAT

SEQ ID NO: 1082117 - protein, 27 aa, Mycobacterium
YQREDIPIHYLLADTFTICDGYFCSLI

SEQ ID NO: 1082118 - protein, 26 aa, Mycobacterium
YQTVAMPGFPNFFMMLDPHSPVGNYP

SEQ ID NO: 1082119 - protein, 26 aa, Mycobacterium
YQTVRRARLLGYEHVSLGLSSDEEKK

SEQ ID NO: 1082120 - protein, 25 aa, Mycobacterium
YQVGIADVLHRWFGDSERSIRAVFD

SEQ ID NO: 1082121 - protein, 21 aa, Mycobacterium
YQVPLWPERLLTRDNAEEIER

SEQ ID NO: 1082122 - protein, 19 aa, Mycobacterium
YRCTPMVYNWRPDGAVLDA

SEQ ID NO: 1082123 - protein, 19 aa, Mycobacterium
YRDETAPLLEFYDTEVKTV

SEQ ID NO: 1082124 - protein, 18 aa, Mycobacterium
YREGRVPLHTLRADIDYG

SEQ ID NO: 1082125 - protein, 25 aa, Mycobacterium
YRETLGFEVLPLSGGAEPPFEVLCE

SEQ ID NO: 1082126 - protein, 19 aa, Mycobacterium
YRFRARPFDLVSSPSVCEH

SEQ ID NO: 1082127 - protein, 17 aa, Mycobacterium
YRFSVPNAGTYWAHPHV

SEQ ID NO: 1082128 - protein, 22 aa, Mycobacterium
YRGAYLEQLLAGLLADLGVHTF

SEQ ID NO: 1082129 - protein, 21 aa, Mycobacterium
YRGDGHLRLLCKRAANPRPNG

SEQ ID NO: 1082130 - protein, 23 aa, Mycobacterium
YRGEPMLAPVVFTSALDLGELFA

SEQ ID NO: 1082131 - protein, 24 aa, Mycobacterium
YRGTALELLILDGRPIWEPVVHYG

SEQ ID NO: 1082132 - protein, 21 aa, Mycobacterium
YRHAFGRRLLELPAGLRDAAG

SEQ ID NO: 1082133 - protein, 17 aa, Mycobacterium
YRIHPAMLDAALQSLAA

SEQ ID NO: 1082134 - protein, 17 aa, Mycobacterium
YRKLINQGYIQAFAYTD

SEQ ID NO: 1082135 - protein, 19 aa, Mycobacterium
YRLQTFGTVTRLAAGGELG

SEQ ID NO: 1082136 - protein, 20 aa, Mycobacterium
YRMLPRATFCQPQVASFGLT

SEQ ID NO: 1082137 - protein, 20 aa, Mycobacterium
YRQLLNIKTVSRRRTPPQWF

SEQ ID NO: 1082138 - protein, 28 aa, Mycobacterium
YRSGSSLHVDWWYDTRRITAETATALAR

SEQ ID NO: 1082139 - protein, 19 aa, Mycobacterium
YRSVLNGLFAAWFADHRAE

SEQ ID NO: 1082140 - protein, 18 aa, Mycobacterium
YRVIGSKDKLLASIMRSF

SEQ ID NO: 1082141 - protein, 19 aa, Mycobacterium
YRVMVDLGLPLWDDTLATP

SEQ ID NO: 1082142 - protein, 23 aa, Mycobacterium
YRVPGIVISPFSRGGLMVHDVFD

SEQ ID NO: 1082143 - protein, 18 aa, Mycobacterium
YRVPRLKVAVIEAGSKWL

SEQ ID NO: 1082144 - protein, 20 aa, Mycobacterium
YRVRHLLDRYGSLINEVLEL

SEQ ID NO: 1082145 - protein, 42 aa, Mycobacterium
YRYASAVRHEIGVPTVFNILGPLTNPAWPRAGLIGCAFGNLA

SEQ ID NO: 1082146 - protein, 43 aa, Mycobacterium
YRYASAVRHEIGVPTVFNILGPLTNPAWPRAGLIGCAFGNLAE

SEQ ID NO: 1082147 - protein, 17 aa, Mycobacterium
YRYHPLTLRIEQIIASG

SEQ ID NO: 1082148 - protein, 20 aa, Mycobacterium
YSAFNEVHWVAPAEAVWACR

SEQ ID NO: 1082149 - protein, 22 aa, Mycobacterium
YSASGLPPAGIGAPGGAGGAGG

SEQ ID NO: 1082150 - protein, 24 aa, Mycobacterium
YSDAATTRDLLLSRLSRLVEYADR

SEQ ID NO: 1082151 - protein, 18 aa, Mycobacterium
YSGAPRPLQTLWGEVGFE

SEQ ID NO: 1082152 - protein, 20 aa, Mycobacterium
YSGPTTALTDVWRALRASMR

SEQ ID NO: 1082153 - protein, 24 aa, Mycobacterium
YSGVMGRLWLARGGTYVLANIRGG

SEQ ID NO: 1082154 - protein, 20 aa, Mycobacterium
YSHMHTNLHLLIFGAAKSGK

SEQ ID NO: 1082155 - protein, 24 aa, Mycobacterium
YSIQRSPTWILPKPDRPYSRWERW

SEQ ID NO: 1082156 - protein, 29 aa, Mycobacterium
YSKGMQMRLTFARALLNDPELLFLDEPTS

SEQ ID NO: 1082157 - protein, 26 aa, Mycobacterium
YSKNITALLDLLLTDGKLAPDFDDEV

SEQ ID NO: 1082158 - protein, 24 aa, Mycobacterium
YSNRAYLIQIRRAGAGTVLIDPVS

SEQ ID NO: 1082159 - protein, 32 aa, Mycobacterium; identical to SEQ ID NO: 879580

SEQ ID NO: 1082160 - protein, 24 aa, Mycobacterium
YSQGGLFPIAYTKGTDFRPAKRLP

SEQ ID NO: 1082161 - protein, 22 aa, Mycobacterium
YSQGGLFPIAYTKGTDFRPANR

SEQ ID NO: 1082162 - protein, 18 aa, Mycobacterium
YSRLALGIGVHDITAGYR

SEQ ID NO: 1082163 - protein, 19 aa, Mycobacterium
YSRRPYPPFMTSTLQQEAG

SEQ ID NO: 1082164 - protein, 18 aa, Mycobacterium
YSVLVVAFMAWIASRGRQ

SEQ ID NO: 1082165 - protein, 33 aa, Mycobacterium; identical to SEQ ID NO: 879612

SEQ ID NO: 1082166 - protein, 22 aa, Mycobacterium
YTAHLGGSMRRLNFAVAGAPFC

SEQ ID NO: 1082167 - protein, 17 aa, Mycobacterium
YTDEIFGPVLCMVRAHD

SEQ ID NO: 1082168 - protein, 28 aa, Mycobacterium
YTDRLIPALSDAFDAMFGYPGPTVAAIN

SEQ ID NO: 1082169 - protein, 20 aa, Mycobacterium
YTGLIYRALAFPTRMFTVLF

SEQ ID NO: 1082170 - protein, 17 aa, Mycobacterium
YTGTGPGSSAAGGLGGT

SEQ ID NO: 1082171 - protein, 18 aa, Mycobacterium
YTHGGLAELINTTLGEAV

SEQ ID NO: 1082172 - protein, 24 aa, Mycobacterium
YTIKRLPHELIRFMKTGTGRRKVL

SEQ ID NO: 1082173 - protein, 27 aa, Mycobacterium
YTPAPVVRFLARWVGRAGTKILEPSCG

SEQ ID NO: 1082174 - protein, 31 aa, Mycobacterium
YTSAIAMRYGWTWRTPLLGRFGSGYVYSSQF

SEQ ID NO: 1082175 - protein, 29 aa, Mycobacterium
YTTTDLTAASLLKSMPTAVNAPAQALFGR

SEQ ID NO: 1082176 - protein, 19 aa, Mycobacterium
YTVDRPVYVALTLPSGSGP

SEQ ID NO: 1082177 - protein, 25 aa, Mycobacterium
YTWEHDMHLYWRRAISLAASLGPTT

SEQ ID NO: 1082178 - protein, 25 aa, Mycobacterium
YTYVPTMIEYYLREKPLLANVDTYR

SEQ ID NO: 1082179 - protein, 26 aa, Mycobacterium
YVADNLPPQLITRMVDFGLAAGSRIT

SEQ ID NO: 1082180 - protein, 19 aa, Mycobacterium
YVAKFLGLSDGVIGETEQR

SEQ ID NO: 1082181 - protein, 32 aa, Mycobacterium; identical to SEQ ID NO: 879726

SEQ ID NO: 1082182 - protein, 25 aa, Mycobacterium
YVDAFIAGFVAYAKFLVRQGADAGA

SEQ ID NO: 1082183 - protein, 30 aa, Mycobacterium
YVDDVALPGMLHLAIFRSPYAHARIVSIDV

SEQ ID NO: 1082184 - protein, 25 aa, Mycobacterium
YVDNLIHGFMLAAQHLVPGGSAPGQ

SEQ ID NO: 1082185 - protein, 27 aa, Mycobacterium
YVEEMGGMNIFFVLGKGGSARLVTPEL

SEQ ID NO: 1082186 - protein, 20 aa, Mycobacterium
YVELFYGRPLTQSSWELVTD

SEQ ID NO: 1082187 - protein, 18 aa, Mycobacterium
YVFGNGQPGGSGGAGGDA

SEQ ID NO: 1082188 - protein, 21 aa, Mycobacterium
YVFRHPLIHTVAYESQLKSAR

SEQ ID NO: 1082189 - protein, 24 aa, Mycobacterium
YVGDRFPVLPMPDWMYNPIDPISI

SEQ ID NO: 1082190 - protein, 30 aa, Mycobacterium; identical to SEQ ID NO: 879782

SEQ ID NO: 1082191 - protein, 30 aa, Mycobacterium; identical to SEQ ID NO: 879786

SEQ ID NO: 1082192 - protein, 19 aa, Mycobacterium
YVHNTPIVPVFTRHDFDGP

SEQ ID NO: 1082193 - protein, 18 aa, Mycobacterium
YVIGLPPLLHMDDEELIR

SEQ ID NO: 1082194 - protein, 21 aa, Mycobacterium
YVKEDVAIRRLLSSGLERAGI

SEQ ID NO: 1082195 - protein, 20 aa, Mycobacterium
YVKEDVAIRRLLSTGLERAG

SEQ ID NO: 1082196 - protein, 21 aa, Mycobacterium
YVKEDVAIRRLLSTGLERAGI

SEQ ID NO: 1082197 - protein, 17 aa, Mycobacterium
YVLEDAPWSAFRDHDNP

SEQ ID NO: 1082198 - protein, 37 aa, Mycobacterium; identical to SEQ ID NO: 879812

SEQ ID NO: 1082199 - protein, 31 aa, Mycobacterium
YVNGKSWLMFGPFAGWSPKFLKRGHLRDLPG

SEQ ID NO: 1082200 - protein, 17 aa, Mycobacterium
YVNQRWLGGMLTNFSTV

SEQ ID NO: 1082201 - protein, 22 aa, Mycobacterium
YVPRRRTTATRVYRLAAGRRGA

SEQ ID NO: 1082202 - protein, 25 aa, Mycobacterium
YVRPRGIIYHRALGARFADLLPAAG

SEQ ID NO: 1082203 - protein, 18 aa, Mycobacterium
YVRSFYFQDPDGITLEFA

SEQ ID NO: 1082204 - protein, 25 aa, Mycobacterium
YVSMPLFHSNAVLVGWAVAVACQGS

SEQ ID NO: 1082205 - protein, 27 aa, Mycobacterium
YVTTPGSAWLFPSLCAPTGRVPTRSAA

SEQ ID NO: 1082206 - protein, 30 aa, Mycobacterium
YVTTPGSAWLLPGLFAPSPELPPPPRSEAT

SEQ ID NO: 1082207 - protein, 20 aa, Mycobacterium
YVTVTAALAGVRRGKADSIS

SEQ ID NO: 1082208 - protein, 17 aa, Mycobacterium
YVVALCGEVFPVTRAAK

SEQ ID NO: 1082209 - protein, 19 aa, Mycobacterium
YVVGLATYCASKHAVIAFT

SEQ ID NO: 1082210 - protein, 18 aa, Mycobacterium
YVVIYDLPVTFDSAQVMP

SEQ ID NO: 1082211 - protein, 17 aa, Mycobacterium
YVVRWVDQGIGCSKVPD

SEQ ID NO: 1082212 - protein, 17 aa, Mycobacterium
YWAPTATADRFTTMSPA

SEQ ID NO: 1082213 - protein, 36 aa, Mycobacterium; identical to SEQ ID NO: 879879

SEQ ID NO: 1082214 - protein, 18 aa, Mycobacterium
YWIEQSTKANLWLTDGDA

SEQ ID NO: 1082215 - protein, 19 aa, Mycobacterium
YWSHPRALVRGRFSREVYG

SEQ ID NO: 1082216 - protein, 18 aa, Mycobacterium
YWVEHVRKPVRFADGVAL

SEQ ID NO: 1082217 - protein, 17 aa, Mycobacterium
YYADFEGVLAFLQRKMA

SEQ ID NO: 1082218 - protein, 27 aa, Mycobacterium
YYAVTPSGFEWEPGWNPIVVDESTWEP

SEQ ID NO: 1082219 - protein, 17 aa, Mycobacterium
YYIIGDNGASAEGTING

SEQ ID NO: 1082220 - protein, 18 aa, Mycobacterium
YYITVDAAWRPDTVWRYR

SEQ ID NO: 1082221 - protein, 18 aa, Mycobacterium
YYNAIVWQDTRTDRIASA

SEQ ID NO: 1082222 - protein, 19 aa, Mycobacterium
YYVEHQLDVTIRRTTYRLR

SEQ ID NO: 1082223 - protein, 19 aa, Mycobacterium
YYVQYAHARLSALARNAAE

SEQ ID NO: 1082224 - protein, 17 aa, Mycobacterium
YYWAARSLGGEFTAGNE

SEQ ID NO: 1082225 - protein, 25 aa, Mycobacterium
DHNHLPLTPVPWPPPGTAAIEVDDF

SEQ ID NO: 1082226 - protein, 21 aa, Mycobacterium
YGIHPALFDAALHPLLALTQP

SEQ ID NO: 1082227 - protein, 24 aa, Mycobacterium
DDPLAMYLFDLCTLPLNLAGHCGM

SEQ ID NO: 1082228 - protein, 25 aa, Mycobacterium
FSVMVSLAALWRWAGITPDAVIGHS

SEQ ID NO: 1082229 - protein, 18 aa, Mycobacterium
HGWIHNELRRRCGGPPIA

SEQ ID NO: 1082230 - protein, 18 aa, Mycobacterium
HWPAFRRVDFLRALRDYS

SEQ ID NO: 1082231 - protein, 19 aa, Mycobacterium
PVLVDFWATWCGPCKMVAP

SEQ ID NO: 1082232 - protein, 23 aa, Mycobacterium
RRRRCGWFDAVIARYATRVNGIT

SEQ ID NO: 1082233 - protein, 17 aa, Mycobacterium
TLSGFWHWAVANLPADV

SEQ ID NO: 1082234 - protein, 22 aa, Mycobacterium
AADLTWLLSRWTCVFGTPACRG

SEQ ID NO: 1082235 - protein, 21 aa, Mycobacterium
AAFEVDWWLTFSSASSLLGTP

SEQ ID NO: 1082236 - protein, 23 aa, Mycobacterium
AAHTSRLRLLAEIDTRAVVLAAT

SEQ ID NO: 1082237 - protein, 22 aa, Mycobacterium
AALFGLPLCEPIYPTPAGLVAA

SEQ ID NO: 1082238 - protein, 18 aa, Mycobacterium
ADIWPNPWSMYRTLRDHE

SEQ ID NO: 1082239 - protein, 19 aa, Mycobacterium
ADRVVYLYNYLLAETSHVL

SEQ ID NO: 1082240 - protein, 23 aa, Mycobacterium
ADWAEMLMRMYIRWAEQHKYGVE

SEQ ID NO: 1082241 - protein, 17 aa, Mycobacterium
AEAYVIAYLPYLGWLRQ

SEQ ID NO: 1082242 - protein, 23 aa, Mycobacterium
AEQRYRFTFPRQQRGRFLCIADF

SEQ ID NO: 1082243 - protein, 23 aa, Mycobacterium
AFERRFFPIYPASTKLQSWDIYA

SEQ ID NO: 1082244 - protein, 18 aa, Mycobacterium
AFVLLALQAPVAGDLRAI

SEQ ID NO: 1082245 - protein, 23 aa, Mycobacterium
AGAVLVPWLRPSQVRVLLMAALA

SEQ ID NO: 1082246 - protein, 25 aa, Mycobacterium
AGHCPAYFLLLIKTLLQPGLRELAD

SEQ ID NO: 1082247 - protein, 21 aa, Mycobacterium
AGVAWVLMHWRLMSAERPYEA

SEQ ID NO: 1082248 - protein, 17 aa, Mycobacterium
AHFVWLRDTLRLGEKFP

SEQ ID NO: 1082249 - protein, 22 aa, Mycobacterium
AHHRLFSHVPWLASQLLGAVEA

SEQ ID NO: 1082250 - protein, 19 aa, Mycobacterium
AIADQLARRRLGYGRGARM

SEQ ID NO: 1082251 - protein, 18 aa, Mycobacterium
AIDPLLPEVAWSWLIEAL

SEQ ID NO: 1082252 - protein, 22 aa, Mycobacterium
ALDRVLIDLATYFRDALLVSAN

SEQ ID NO: 1082253 - protein, 17 aa, Mycobacterium
ALLHFLDGKKRYILAPQ

SEQ ID NO: 1082254 - protein, 18 aa, Mycobacterium
ALQEVFLMVPKLPLQRLK

SEQ ID NO: 1082255 - protein, 19 aa, Mycobacterium
AMRWFLMASPILRGGNLII

SEQ ID NO: 1082256 - protein, 22 aa, Mycobacterium
APDQLLTAVLFIDLDNFKGIND

SEQ ID NO: 1082257 - protein, 18 aa, Mycobacterium
APVLWTQRVLSTGQLRAV

SEQ ID NO: 1082258 - protein, 23 aa, Mycobacterium
AQAWTYLCMTPPVGVTGLSQPGL

SEQ ID NO: 1082259 - protein, 22 aa, Mycobacterium
AQEWFRFSWFFLVIRRDPKGLR

SEQ ID NO: 1082260 - protein, 24 aa, Mycobacterium
ARRVLIELLAWQFASPVRWIETQD

SEQ ID NO: 1082261 - protein, 17 aa, Mycobacterium
ATNYDVMFVPQGIGADL

SEQ ID NO: 1082262 - protein, 18 aa, Mycobacterium
AVGSYVPQLPWPFGLIDH

SEQ ID NO: 1082263 - protein, 18 aa, Mycobacterium
AVLSRRPRMLYDYFHQLF

SEQ ID NO: 1082264 - protein, 19 aa, Mycobacterium
AVWQRLHFGFGLPKPPMEP

SEQ ID NO: 1082265 - protein, 18 aa, Mycobacterium
AWRLYRRLGFMDIIRRHY

SEQ ID NO: 1082266 - protein, 21 aa, Mycobacterium
AYLRLHMLSHRLVAPHGLNAD

SEQ ID NO: 1082267 - protein, 17 aa, Mycobacterium
CEIVPWCRFARKNYFYP

SEQ ID NO: 1082268 - protein, 19 aa, Mycobacterium
CISRQLWWGHRIPIWYGPN

SEQ ID NO: 1082269 - protein, 18 aa, Mycobacterium
CLINVRYLSGFTGSNGAL

SEQ ID NO: 1082270 - protein, 23 aa, Mycobacterium
CNRAYLPGTLLPPGIRATADPAD

SEQ ID NO: 1082271 - protein, 24 aa, Mycobacterium
CVSGNSLVRLLFGKSIRIGDIVTG

SEQ ID NO: 1082272 - protein, 23 aa, Mycobacterium
DALDQYLRLPLRQVMWGDDEGLL

SEQ ID NO: 1082273 - protein, 18 aa, Mycobacterium
DAWVWDMYRPARFVKQVR

SEQ ID NO: 1082274 - protein, 17 aa, Mycobacterium
DCSGLVMWAYQQAGIAL

SEQ ID NO: 1082275 - protein, 21 aa, Mycobacterium
DDALNLPWLAVGAIGFISVIS

SEQ ID NO: 1082276 - protein, 18 aa, Mycobacterium
DECRIFLSMLGIGPAKHE

SEQ ID NO: 1082277 - protein, 18 aa, Mycobacterium
DIDLYLRIAPELFLKRCI

SEQ ID NO: 1082278 - protein, 17 aa, Mycobacterium
DLHLLRPIYAQTAAYGH

SEQ ID NO: 1082279 - protein, 18 aa, Mycobacterium
DLRINWVWNPPWGPDKIS

SEQ ID NO: 1082280 - protein, 23 aa, Mycobacterium
DLRSWVPRFPWLGSTDAVPRCCQ

SEQ ID NO: 1082281 - protein, 21 aa, Mycobacterium
DLYQRWPFFRSVLSNMAQVLA

SEQ ID NO: 1082282 - protein, 21 aa, Mycobacterium
DPDWIIGRYIPNLVPRPFTLA

SEQ ID NO: 1082283 - protein, 17 aa, Mycobacterium
DRGIPLLRPARPNSPVF

SEQ ID NO: 1082284 - protein, 24 aa, Mycobacterium
DRHSGWWRAPLRWMLRGSLVVRSR

SEQ ID NO: 1082285 - protein, 19 aa, Mycobacterium
DRPWRLWLPGRPEVSTYRR

SEQ ID NO: 1082286 - protein, 24 aa, Mycobacterium
DRRGKYLWFLLDTDIALVVHLGMS

SEQ ID NO: 1082287 - protein, 22 aa, Mycobacterium
DRVTLFRAWYSRRNFGQLSGSV

SEQ ID NO: 1082288 - protein, 17 aa, Mycobacterium
DTADWLWIPVRRSWRLN

SEQ ID NO: 1082289 - protein, 23 aa, Mycobacterium
DTGRWRVPLILRLDPKIGSDDIR

SEQ ID NO: 1082290 - protein, 24 aa, Mycobacterium
DTHLAWDLITYWRALLTSAVNLPP

SEQ ID NO: 1082291 - protein, 19 aa, Mycobacterium
DVAALLHWLGNGNFLLLGY

SEQ ID NO: 1082292 - protein, 20 aa, Mycobacterium
DVAILAYAAKFSSAFYGPFR

SEQ ID NO: 1082293 - protein, 24 aa, Mycobacterium
DVEAVLPTVWPIVQAVAECGADAA

SEQ ID NO: 1082294 - protein, 17 aa, Mycobacterium
DVFFRAVQYLPWHPGRC

SEQ ID NO: 1082295 - protein, 24 aa, Mycobacterium
DVMPEDLIKFGLIPEFIGRLPVIA

SEQ ID NO: 1082296 - protein, 17 aa, Mycobacterium
DYGPDLRRWLVERLGLI

SEQ ID NO: 1082297 - protein, 18 aa, Mycobacterium
EAGLLPGALIRNVGLHFI

SEQ ID NO: 1082298 - protein, 21 aa, Mycobacterium
EAIADLLRLLGPLTAADAAAW

SEQ ID NO: 1082299 - protein, 20 aa, Mycobacterium
EDLIFLRKALNRADIPFLFI

SEQ ID NO: 1082300 - protein, 21 aa, Mycobacterium
EFKAMFQMKFYALTLLHSRGV

SEQ ID NO: 1082301 - protein, 17 aa, Mycobacterium
EIRTLFGVLFQDGALFG

SEQ ID NO: 1082302 - protein, 26 aa, Mycobacterium
ELAAPVTHIWYFKGVPSRLGYLLDLA

SEQ ID NO: 1082303 - protein, 19 aa, Mycobacterium
ELFGHWWYEGPIWLQRVLR

SEQ ID NO: 1082304 - protein, 25 aa, Mycobacterium
ELVNYVRGMLYFRTKRWPDVLTQFP

SEQ ID NO: 1082305 - protein, 21 aa, Mycobacterium
EPRQRVMLPPWAAGSPGHNAQ

SEQ ID NO: 1082306 - protein, 17 aa, Mycobacterium
ERPHYMPLFVAPQPIEV

SEQ ID NO: 1082307 - protein, 18 aa, Mycobacterium
ETICRLIMLYHLDRGWAD

SEQ ID NO: 1082308 - protein, 23 aa, Mycobacterium
ETLEEYWWAAEQMLTWPDPDKPV

SEQ ID NO: 1082309 - protein, 18 aa, Mycobacterium
ETTRPLVICDLGMPRDVD

SEQ ID NO: 1082310 - protein, 27 aa, Mycobacterium
FAAVSPWWLQRRLLLSGIRAISPAVDV

SEQ ID NO: 1082311 - protein, 18 aa, Mycobacterium
FAFGVPLLQRISVTTTAR

SEQ ID NO: 1082312 - protein, 25 aa, Mycobacterium
FAVEVALFALLRFWGVVPDYVIGHS

SEQ ID NO: 1082313 - protein, 21 aa, Mycobacterium
FDDLVTPFLGLYRDDNLRPNS

SEQ ID NO: 1082314 - protein, 18 aa, Mycobacterium
FDPRWIAIDPRWIAIKDP

SEQ ID NO: 1082315 - protein, 20 aa, Mycobacterium
FDTPILVPPQAAMLGIGAIV

SEQ ID NO: 1082316 - protein, 18 aa, Mycobacterium
FEYQALLFIPSHAPFDLF

SEQ ID NO: 1082317 - protein, 26 aa, Mycobacterium
FGPYRPYPLHPLALPLLHPKQVIMLG

SEQ ID NO: 1082318 - protein, 18 aa, Mycobacterium
FHAVYWPAFLMSAGIELP

SEQ ID NO: 1082319 - protein, 18 aa, Mycobacterium
FLPLLRRLSRLLPVDVRV

SEQ ID NO: 1082320 - protein, 18 aa, Mycobacterium
FNALFLDPYLWKLQVGGK

SEQ ID NO: 1082321 - protein, 22 aa, Mycobacterium
FPDDFLLYWGLLAAMQVRTGRL

SEQ ID NO: 1082322 - protein, 19 aa, Mycobacterium
FPTLYYLTHPVLIAAASRL

SEQ ID NO: 1082323 - protein, 17 aa, Mycobacterium
FRAIGPDDFHLAYAASL

SEQ ID NO: 1082324 - protein, 18 aa, Mycobacterium
FRDFLLHPVMMDIALQTL

SEQ ID NO: 1082325 - protein, 19 aa, Mycobacterium
FRFSTFLGAFKYYTSYTLK

SEQ ID NO: 1082326 - protein, 20 aa, Mycobacterium
FTETLTWWQVYRRSMSVAYE

SEQ ID NO: 1082327 - protein, 19 aa, Mycobacterium
FTGLLLDRLLPIVGSRVIT

SEQ ID NO: 1082328 - protein, 22 aa, Mycobacterium
FTNIYFYTVLFHVLLASNSIAI

SEQ ID NO: 1082329 - protein, 25 aa, Mycobacterium
FYKWTQWIFLQIYNAWFDVAANKAR

SEQ ID NO: 1082330 - protein, 18 aa, Mycobacterium
FYLAMYWAQELATQTDDQ

SEQ ID NO: 1082331 - protein, 24 aa, Mycobacterium
GADTVLVFPFDVAIPGGFLGMAAS

SEQ ID NO: 1082332 - protein, 18 aa, Mycobacterium
GGAYFVLATGRPPRWVRP

SEQ ID NO: 1082333 - protein, 23 aa, Mycobacterium
GGILLITHYTRILRYIRPEFVHV

SEQ ID NO: 1082334 - protein, 19 aa, Mycobacterium
GGIPTLLWKLIGEIRSGDY

SEQ ID NO: 1082335 - protein, 22 aa, Mycobacterium
GGLLLPVYVRRLLNYHSMRNAQ

SEQ ID NO: 1082336 - protein, 24 aa, Mycobacterium
GIGLPLTRSLLSRAGLSIAAMWAA

SEQ ID NO: 1082337 - protein, 24 aa, Mycobacterium
GISRPTFYFYFPSKNAVLLSLLDD

SEQ ID NO: 1082338 - protein, 23 aa, Mycobacterium
GLDRVKPFWPFQVNARLVGLADS

SEQ ID NO: 1082339 - protein, 18 aa, Mycobacterium
GLFPFRRNLSLYAVDLAL

SEQ ID NO: 1082340 - protein, 22 aa, Mycobacterium
GLPVWIYQFKISPHPTIPLAST

SEQ ID NO: 1082341 - protein, 24 aa, Mycobacterium
GLTTPMSLLRFIKFILTEIFPGGR

SEQ ID NO: 1082342 - protein, 24 aa, Mycobacterium
GMALVAYRHGIPFILVAPESTGGP

SEQ ID NO: 1082343 - protein, 21 aa, Mycobacterium
GMFGNIIRLLPPLTISDELLA

SEQ ID NO: 1082344 - protein, 18 aa, Mycobacterium
GMRLLGSPLLYRYPDRQL

SEQ ID NO: 1082345 - protein, 24 aa, Mycobacterium
GMTNFQAMNFLGESPVAIGPAHQA

SEQ ID NO: 1082346 - protein, 20 aa, Mycobacterium
GNVEYFLWLRAQTDLELSTD

SEQ ID NO: 1082347 - protein, 23 aa, Mycobacterium
GNWACIVPHTWLWTTPIGAEIRA

SEQ ID NO: 1082348 - protein, 20 aa, Mycobacterium
GPYILAGWSLGGVLAYACAI

SEQ ID NO: 1082349 - protein, 31 aa, Mycobacterium
GQHISTLLLTLLFRFMRPLIEHGYVFLAQPP

SEQ ID NO: 1082350 - protein, 22 aa, Mycobacterium
GQPLDWFCLFSSGAALLGSPGQ

SEQ ID NO: 1082351 - protein, 22 aa, Mycobacterium
GREMLFPLICRYALAYHVVFIP

SEQ ID NO: 1082352 - protein, 24 aa, Mycobacterium
GRGALLQLGLLQLALRLAVENDFI

SEQ ID NO: 1082353 - protein, 20 aa, Mycobacterium
GRLLDAPLPVWTHPRLFIDT

SEQ ID NO: 1082354 - protein, 24 aa, Mycobacterium
GRSRLMPPMPLIPGRRSKPTVVVV

SEQ ID NO: 1082355 - protein, 17 aa, Mycobacterium
GSDAMRWFLMASPILRG

SEQ ID NO: 1082356 - protein, 22 aa, Mycobacterium
GTPDTWLLWNLTGGPRGGVHVT

SEQ ID NO: 1082357 - protein, 24 aa, Mycobacterium
GVSWLPFFHDMGLITVLLPSVLGH

SEQ ID NO: 1082358 - protein, 26 aa, Mycobacterium
GWYRAEALAYRLLLEGNWISFEHRRF

SEQ ID NO: 1082359 - protein, 19 aa, Mycobacterium
GYVLRRLLRRIIRSAKLLG

SEQ ID NO: 1082360 - protein, 23 aa, Mycobacterium
HCALPLHRRFALAATARASFAVY

SEQ ID NO: 1082361 - protein, 17 aa, Mycobacterium
HDNLQVHYLRHTCTSWS

SEQ ID NO: 1082362 - protein, 20 aa, Mycobacterium
HGFKALDITLPVPTRWTQVP

SEQ ID NO: 1082363 - protein, 19 aa, Mycobacterium
HLLRDKQQWWRVGRKHGLI

SEQ ID NO: 1082364 - protein, 30 aa, Mycobacterium
HMWFGNLVTMTWWDDLWLNESFATFASVLC

SEQ ID NO: 1082365 - protein, 19 aa, Mycobacterium
HNFFTPLLRNLGRCARVVV

SEQ ID NO: 1082366 - protein, 19 aa, Mycobacterium
HPMFVPWLVGPLLTGDGIH

SEQ ID NO: 1082367 - protein, 17 aa, Mycobacterium
ICYDIRFPALYTELARR

SEQ ID NO: 1082368 - protein, 18 aa, Mycobacterium
IDPYLRPLYDALYDMMDP

SEQ ID NO: 1082369 - protein, 28 aa, Mycobacterium
IDVFFEALKAPLYWIATNAGLDGAVVVD

SEQ ID NO: 1082370 - protein, 24 aa, Mycobacterium
IEFKLRDWLFARQRYWGEPFPIIY

SEQ ID NO: 1082371 - protein, 19 aa, Mycobacterium
IGFRRAAGVVAWWASVHRA

SEQ ID NO: 1082372 - protein, 23 aa, Mycobacterium
IGGVRVIRVCTFSAGLPAPEDST

SEQ ID NO: 1082373 - protein, 17 aa, Mycobacterium
IGIGFCFAPLFQPSYRY

SEQ ID NO: 1082374 - protein, 23 aa, Mycobacterium
IGVRAICYLPLTYDHRLIDGADA

SEQ ID NO: 1082375 - protein, 19 aa, Mycobacterium
IGYGLLRYMYAPTGRVFSA

SEQ ID NO: 1082376 - protein, 18 aa, Mycobacterium
IHFQEWWVRYRAQVPTHS

SEQ ID NO: 1082377 - protein, 18 aa, Mycobacterium
IHMRLPKLKGFRNRLRTE

SEQ ID NO: 1082378 - protein, 27 aa, Mycobacterium
IIHWFFGLFSHWWSRLHSFFGGIPGLS

SEQ ID NO: 1082379 - protein, 25 aa, Mycobacterium
IISDFLGPINWMRPLRAIAARHEVL

SEQ ID NO: 1082380 - protein, 17 aa, Mycobacterium
ILSLRNGLVPPLLHFDR

SEQ ID NO: 1082381 - protein, 20 aa, Mycobacterium
IMETPWLKSFAQHSRFAEAF

SEQ ID NO: 1082382 - protein, 17 aa, Mycobacterium
INPHPMFVPWLVGPLLT

SEQ ID NO: 1082383 - protein, 20 aa, Mycobacterium
IPHYGIGYGLLRYMYAPTGR

SEQ ID NO: 1082384 - protein, 17 aa, Mycobacterium
ISSPRLLFDMFWVGHCA

SEQ ID NO: 1082385 - protein, 17 aa, Mycobacterium
IVGIWHSGGARLAEGVR

SEQ ID NO: 1082386 - protein, 17 aa, Mycobacterium
IVLLTFGTGIGSAVIHN

SEQ ID NO: 1082387 - protein, 17 aa, Mycobacterium
IVPWCRFARKNYFYPDV

SEQ ID NO: 1082388 - protein, 20 aa, Mycobacterium
KALTPLVLAIWYMDDGSFTV

SEQ ID NO: 1082389 - protein, 23 aa, Mycobacterium
KDGEALFLRCNIWREAAENVAES

SEQ ID NO: 1082390 - protein, 25 aa, Mycobacterium
KDVSLILIFGWFKQLVEAATALVRP

SEQ ID NO: 1082391 - protein, 17 aa, Mycobacterium
KLPVTLFTAGGIATPAD

SEQ ID NO: 1082392 - protein, 18 aa, Mycobacterium
KNYPAYFNFLKLKLRTGG

SEQ ID NO: 1082393 - protein, 21 aa, Mycobacterium
KQPVKYFLLFSSISGLIGSRW

SEQ ID NO: 1082394 - protein, 18 aa, Mycobacterium
KSVVYELLWFLRGDSNVA

SEQ ID NO: 1082395 - protein, 22 aa, Mycobacterium
KTAPLWRVLVALSIRHVGPTAA

SEQ ID NO: 1082396 - protein, 22 aa, Mycobacterium
KVAVAFVLWPNLLLARAAVVAL

SEQ ID NO: 1082397 - protein, 20 aa, Mycobacterium
KWTKYLLDPAQIRLLRKLKH

SEQ ID NO: 1082398 - protein, 18 aa, Mycobacterium
LDKWVIYVPLEHVAAVQA

SEQ ID NO: 1082399 - protein, 25 aa, Mycobacterium
LDVASLLHRLSLKQPVKYFLLFSSI

SEQ ID NO: 1082400 - protein, 18 aa, Mycobacterium
LEDALKLLLLPRVVGVDP

SEQ ID NO: 1082401 - protein, 17 aa, Mycobacterium
LESFLFYSGFYLPMYWS

SEQ ID NO: 1082402 - protein, 18 aa, Mycobacterium
LEYIIAFLGALQAGFIAV

SEQ ID NO: 1082403 - protein, 20 aa, Mycobacterium
LFDRFGVDLPPLEGIYLAAF

SEQ ID NO: 1082404 - protein, 24 aa, Mycobacterium
LFEVENPRLLVYPLERLRTDLWQL

SEQ ID NO: 1082405 - protein, 19 aa, Mycobacterium
LFMQIPWRTEIIEGLLGAD

SEQ ID NO: 1082406 - protein, 20 aa, Mycobacterium
LGNFMNSRLGRLLLTPGRGI

SEQ ID NO: 1082407 - protein, 17 aa, Mycobacterium
LGQIPLDPALVAAGDSG

SEQ ID NO: 1082408 - protein, 25 aa, Mycobacterium
LIIGAWNYPFYLTLVPAVGAIAAGN

SEQ ID NO: 1082409 - protein, 17 aa, Mycobacterium
LLFDMFWVGHCAELAEV

SEQ ID NO: 1082410 - protein, 17 aa, Mycobacterium
LLKIGWPAEDLAGYVDG

SEQ ID NO: 1082411 - protein, 18 aa, Mycobacterium
LLKLPIPVQRRVAAGVLS

SEQ ID NO: 1082412 - protein, 18 aa, Mycobacterium
LLTQLLGLPYADAAAVCG

SEQ ID NO: 1082413 - protein, 19 aa, Mycobacterium
LPITLWPGMKIGQLCVLRL

SEQ ID NO: 1082414 - protein, 25 aa, Mycobacterium
LQPGQRLLVFLPLAHVLARALTLSA

SEQ ID NO: 1082415 - protein, 17 aa, Mycobacterium
LRIVKYLAYGWSSLRSR

SEQ ID NO: 1082416 - protein, 19 aa, Mycobacterium
LRPFRNLVYAMPPYICPPA

SEQ ID NO: 1082417 - protein, 26 aa, Mycobacterium
LRTKKSVMFIIPWGNHWIIGTTDTDW

SEQ ID NO: 1082418 - protein, 18 aa, Mycobacterium
LRVIVHGWLAFTFEVCRQ

SEQ ID NO: 1082419 - protein, 21 aa, Mycobacterium
LSHPYLDTVLFVLGVTRGEIE

SEQ ID NO: 1082420 - protein, 24 aa, Mycobacterium
LWFDPLCPWCWITSRWILEVEKVR

SEQ ID NO: 1082421 - protein, 19 aa, Mycobacterium
LYQSWAAAYLPLLQVLHTL

SEQ ID NO: 1082422 - protein, 26 aa, Mycobacterium
MLGQPVSMLIPWVVGFKLSGEIQPGV

SEQ ID NO: 1082423 - protein, 24 aa, Mycobacterium
NAIIRPFLRFFFKSWFRVEVSGIE

SEQ ID NO: 1082424 - protein, 17 aa, Mycobacterium
NARPKPLAAYLFTKSRK

SEQ ID NO: 1082425 - protein, 24 aa, Mycobacterium
NDHGVVPGLWRLDSLPLLVSATDW

SEQ ID NO: 1082426 - protein, 17 aa, Mycobacterium
NEYIITLGVHDLEKMKA

SEQ ID NO: 1082427 - protein, 17 aa, Mycobacterium
NLWHLLGSKIAAVIVVD

SEQ ID NO: 1082428 - protein, 24 aa, Mycobacterium
NNWFAAYAYWYFKLYRHDKVKLLD

SEQ ID NO: 1082429 - protein, 23 aa, Mycobacterium
NPHKVAMLGLTFDDVLLLPAASD

SEQ ID NO: 1082430 - protein, 17 aa, Mycobacterium
NSCLICRRLTIGWSSLH

SEQ ID NO: 1082431 - protein, 22 aa, Mycobacterium
NSTLAYLLKFDSILGRLPHDVS

SEQ ID NO: 1082432 - protein, 17 aa, Mycobacterium
NTRLGLFPFRRGLTFYY

SEQ ID NO: 1082433 - protein, 22 aa, Mycobacterium
PAFSGLFSPYWRSDARGAIVGL

SEQ ID NO: 1082434 - protein, 18 aa, Mycobacterium
PATLALPMRVIASVGAIL

SEQ ID NO: 1082435 - protein, 19 aa, Mycobacterium
PAYFNFLKLKLRTGGLLLN

SEQ ID NO: 1082436 - protein, 20 aa, Mycobacterium
PEQKVRWLRWLAGLWPANQD

SEQ ID NO: 1082437 - protein, 22 aa, Mycobacterium
PFFGDRRKAFLEDLAIVTGGQV

SEQ ID NO: 1082438 - protein, 17 aa, Mycobacterium
PFFGSLLEFITSGPVMA

SEQ ID NO: 1082439 - protein, 22 aa, Mycobacterium
PGDRSVHYPFPIKDLVALDDAL

SEQ ID NO: 1082440 - protein, 24 aa, Mycobacterium
PHLVKPLPFLFPLTKRWWERPYIA

SEQ ID NO: 1082441 - protein, 21 aa, Mycobacterium
PHPRWWIDLLTTEPLAFASLD

SEQ ID NO: 1082442 - protein, 23 aa, Mycobacterium
PLDLTIVSWLPFYHDMGLVLGVV

SEQ ID NO: 1082443 - protein, 21 aa, Mycobacterium
PLITNMIRLLKLPIPVQRRVA

SEQ ID NO: 1082444 - protein, 25 aa, Mycobacterium
PLLATYAFLPIVRAFTKPAGIKVQT

SEQ ID NO: 1082445 - protein, 17 aa, Mycobacterium
PLLKRLPADTPMYGFER

SEQ ID NO: 1082446 - protein, 18 aa, Mycobacterium
PMFLLYDYTFLPTGADSK

SEQ ID NO: 1082447 - protein, 18 aa, Mycobacterium
PMVLPSRFPNLLANGSGG

SEQ ID NO: 1082448 - protein, 17 aa, Mycobacterium
PPWVGPLDVLIVAGDDP

SEQ ID NO: 1082449 - protein, 17 aa, Mycobacterium
PQTRFVLRKTLAAHLPV

SEQ ID NO: 1082450 - protein, 23 aa, Mycobacterium
PRLRYWLDRLSTYGVLAYAAVVY

SEQ ID NO: 1082451 - protein, 21 aa, Mycobacterium
PRTRWLLRELVFALLVKKDHA

SEQ ID NO: 1082452 - protein, 17 aa, Mycobacterium
PVFAEDWVNLVALAVNE

SEQ ID NO: 1082453 - protein, 22 aa, Mycobacterium
PVNRVEFFFLRPKDIAIYVGSG

SEQ ID NO: 1082454 - protein, 17 aa, Mycobacterium
PVPLWQHVLVGKRLFDL

SEQ ID NO: 1082455 - protein, 17 aa, Mycobacterium
PVVFGPIAITYNVNGLS

SEQ ID NO: 1082456 - protein, 20 aa, Mycobacterium
PVVFLTALFGLADLAGIRAG

SEQ ID NO: 1082457 - protein, 23 aa, Mycobacterium
PWYLVRYWRLLKFKLANPHIITR

SEQ ID NO: 1082458 - protein, 18 aa, Mycobacterium
PYAPIIGYLNLSSPRDAG

SEQ ID NO: 1082459 - protein, 18 aa, Mycobacterium
QGDGPYILAGWSLGGVLA

SEQ ID NO: 1082460 - protein, 18 aa, Mycobacterium
QIGYSLLFRLASGSLLGL

SEQ ID NO: 1082461 - protein, 23 aa, Mycobacterium
QISKPMLYLYYGSKEDLFGACLN

SEQ ID NO: 1082462 - protein, 17 aa, Mycobacterium
QLALAWLLKRSPVMLPI

SEQ ID NO: 1082463 - protein, 28 aa, Mycobacterium
QLLVYTIDPLILRQTYPVRHAPYGLAGS

SEQ ID NO: 1082464 - protein, 18 aa, Mycobacterium
QLLYWTQVLMISRGLSLD

SEQ ID NO: 1082465 - protein, 17 aa, Mycobacterium
QLVGWLEGLFHGIQTAL

SEQ ID NO: 1082466 - protein, 22 aa, Mycobacterium
QPVLRALLDLLPIAGGSGTLSD

SEQ ID NO: 1082467 - protein, 24 aa, Mycobacterium
QRDRAKMFLLLFSSLHRQLQLARR

SEQ ID NO: 1082468 - protein, 17 aa, Mycobacterium
QRVFFGWAQMWRSKSRD

SEQ ID NO: 1082469 - protein, 23 aa, Mycobacterium
QVWRYPAFFHALLDAGVYPPCST

SEQ ID NO: 1082470 - protein, 23 aa, Mycobacterium
RARDLWYHRILPFAYNLSQRQAV

SEQ ID NO: 1082471 - protein, 17 aa, Mycobacterium
RARVYLALSWALSRTPG

SEQ ID NO: 1082472 - protein, 19 aa, Mycobacterium
RARYLILRLLERAGEQRVT

SEQ ID NO: 1082473 - protein, 18 aa, Mycobacterium
RCWLGRALCWLPRRWAEH

SEQ ID NO: 1082474 - protein, 23 aa, Mycobacterium
RDKRLLVFPVKRLADLGFHVIAT

SEQ ID NO: 1082475 - protein, 24 aa, Mycobacterium
REGVNLTFLPFIAKAAIDALKIHP

SEQ ID NO: 1082476 - protein, 18 aa, Mycobacterium
RFGGSLHLDWWYDIRRIP

SEQ ID NO: 1082477 - protein, 17 aa, Mycobacterium
RFKLVEPLRLLFKDEVR

SEQ ID NO: 1082478 - protein, 20 aa, Mycobacterium
RFNRSPLLTVYWLLGGFLRK

SEQ ID NO: 1082479 - protein, 22 aa, Mycobacterium
RGIGFIPWSPLAAGPLAAPDGP

SEQ ID NO: 1082480 - protein, 17 aa, Mycobacterium
RGWVNLHFSLLPAWRGA

SEQ ID NO: 1082481 - protein, 18 aa, Mycobacterium
RLHFGFGLPKPPMEPLAV

SEQ ID NO: 1082482 - protein, 19 aa, Mycobacterium
RLKRPWLDDYLGPDVMELN

SEQ ID NO: 1082483 - protein, 22 aa, Mycobacterium
RLTFLAVRRWFGWSAGRIINLD

SEQ ID NO: 1082484 - protein, 20 aa, Mycobacterium
RMRNSGMPVLFWLDPYRPHE

SEQ ID NO: 1082485 - protein, 17 aa, Mycobacterium
RPNFPVINFLDAGTAPL

SEQ ID NO: 1082486 - protein, 18 aa, Mycobacterium
RPTGFIPELLTRFPKELA

SEQ ID NO: 1082487 - protein, 25 aa, Mycobacterium
RPVIIGPVTFLLLSKGINGGGAPIQ

SEQ ID NO: 1082488 - protein, 28 aa, Mycobacterium
RQKRLMTLIHFWLVHRFKADTVIYVTPT

SEQ ID NO: 1082489 - protein, 19 aa, Mycobacterium
RRGLLLLVGRRRRLIKYLS

SEQ ID NO: 1082490 - protein, 21 aa, Mycobacterium
RRQILTLWQTALIRLARLQIS

SEQ ID NO: 1082491 - protein, 17 aa, Mycobacterium
RRVLLTLPILHVYGLPP

SEQ ID NO: 1082492 - protein, 20 aa, Mycobacterium
RSSWLARYWPACSATAGCLP

SEQ ID NO: 1082493 - protein, 20 aa, Mycobacterium
RVMISKMFRLLFYTPRIPPN

SEQ ID NO: 1082494 - protein, 20 aa, Mycobacterium
RVPAIALWRAQTQRAVENFP

SEQ ID NO: 1082495 - protein, 17 aa, Mycobacterium
RVQEPMVLPSRFPNLLA

SEQ ID NO: 1082496 - protein, 24 aa, Mycobacterium
RYARLFAWLGLWERRSDLAVIPAD

SEQ ID NO: 1082497 - protein, 17 aa, Mycobacterium
SAALIWRRPRWARRLQP

SEQ ID NO: 1082498 - protein, 22 aa, Mycobacterium
SAATRWVWLADALALDVPEVQK

SEQ ID NO: 1082499 - protein, 21 aa, Mycobacterium
SAELPLFRYIGGSNAHILPVP

SEQ ID NO: 1082500 - protein, 24 aa, Mycobacterium
SGSGPAYFFLLVEALVDAGVAVGL

SEQ ID NO: 1082501 - protein, 25 aa, Mycobacterium
SGYIPILGAPWLPDLVRRSPWAEMF

SEQ ID NO: 1082502 - protein, 20 aa, Mycobacterium
SHLLLDCELLEPLRARLADG

SEQ ID NO: 1082503 - protein, 25 aa, Mycobacterium
SHPGKWRVVFFWPKDFTFICPTEIA

SEQ ID NO: 1082504 - protein, 19 aa, Mycobacterium
SLRDNLWHLLGSKIAAVIV

SEQ ID NO: 1082505 - protein, 23 aa, Mycobacterium
SPPVKWPCFYGIDFPSPAELIAN

SEQ ID NO: 1082506 - protein, 17 aa, Mycobacterium
SRTHHYPFRLLSPRTMR

SEQ ID NO: 1082507 - protein, 17 aa, Mycobacterium
SVPAIKLLIRKSGARSA

SEQ ID NO: 1082508 - protein, 18 aa, Mycobacterium
SWLLALPPYHIGGLQVLV

SEQ ID NO: 1082509 - protein, 20 aa, Mycobacterium
TELDDWIYQLDWPTRPLTSE

SEQ ID NO: 1082510 - protein, 17 aa, Mycobacterium
TFVLFTTGFLEACYRRF

SEQ ID NO: 1082511 - protein, 26 aa, Mycobacterium
TGESLAYKMWLPPLLDPLPLNELIER

SEQ ID NO: 1082512 - protein, 19 aa, Mycobacterium
TGIDFAAVSPWWLQRRLLL

SEQ ID NO: 1082513 - protein, 24 aa, Mycobacterium
THNEPMIPIYIFYSMFGFQRTGDG

SEQ ID NO: 1082514 - protein, 22 aa, Mycobacterium
TINRILAYVAPILLGGPVTAVD

SEQ ID NO: 1082515 - protein, 23 aa, Mycobacterium
TLAAPFLFFLQNVRYRSIGVNYR

SEQ ID NO: 1082516 - protein, 23 aa, Mycobacterium
TLFEALLPRYLTIRVYAAMLESA

SEQ ID NO: 1082517 - protein, 18 aa, Mycobacterium
TLGFRFRPWTKCQAIADG

SEQ ID NO: 1082518 - protein, 17 aa, Mycobacterium
TLLFPFAAPRVIGDLSE

SEQ ID NO: 1082519 - protein, 17 aa, Mycobacterium
TLPAKFRDALVGGLMVT

SEQ ID NO: 1082520 - protein, 19 aa, Mycobacterium
TPLFFAQAIGRFVRSRHPG

SEQ ID NO: 1082521 - protein, 19 aa, Mycobacterium
TRAYFRGECLRRFSADIAA

SEQ ID NO: 1082522 - protein, 20 aa, Mycobacterium
TRMFTVLFALGRLPGWIAHW

SEQ ID NO: 1082523 - protein, 21 aa, Mycobacterium
TSIPVVLVPKTTVIWSCIRDT

SEQ ID NO: 1082524 - protein, 20 aa, Mycobacterium
TTVVSWLPLFHDMGLILGVC

SEQ ID NO: 1082525 - protein, 17 aa, Mycobacterium
TVVLKLLQIVRPDRVFF

SEQ ID NO: 1082526 - protein, 23 aa, Mycobacterium
TWVGEVWIYIQLLPAVDSKSLAE

SEQ ID NO: 1082527 - protein, 17 aa, Mycobacterium
TYLRPGTVLGTKGKLGA

SEQ ID NO: 1082528 - protein, 23 aa, Mycobacterium
VDDEFFIILRPAPSGTRLLLSDA

SEQ ID NO: 1082529 - protein, 23 aa, Mycobacterium
VDQPFLLSAYIDFAALRAKFDGG

SEQ ID NO: 1082530 - protein, 18 aa, Mycobacterium
VEFMLLDRLFPRSIFYSL

SEQ ID NO: 1082531 - protein, 20 aa, Mycobacterium
VFEVMVRPLIRLSLGKRQPM

SEQ ID NO: 1082532 - protein, 19 aa, Mycobacterium
VFIGYLRRKLEANSGPRLL

SEQ ID NO: 1082533 - protein, 21 aa, Mycobacterium
VFVSRLPRYFPKPLRERFTPE

SEQ ID NO: 1082534 - protein, 17 aa, Mycobacterium
VGDGFARYWLHNGWVTM

SEQ ID NO: 1082535 - protein, 17 aa, Mycobacterium
VHAGVLLRYVLLTAKRV

SEQ ID NO: 1082536 - protein, 24 aa, Mycobacterium
VKYRTLPEIILYPALFLGAARTVP

SEQ ID NO: 1082537 - protein, 20 aa, Mycobacterium
VLHLLYARFWHKVLYDLGHV

SEQ ID NO: 1082538 - protein, 20 aa, Mycobacterium
VLLPLWNAYSFLALYAPKIG

SEQ ID NO: 1082539 - protein, 23 aa, Mycobacterium
VLLSPMSFLRRPACWMQLLATTQ

SEQ ID NO: 1082540 - protein, 18 aa, Mycobacterium
VLSRMRPLFSFALGARIG

SEQ ID NO: 1082541 - protein, 19 aa, Mycobacterium
VMRRRLAALGAAMPRFMAL

SEQ ID NO: 1082542 - protein, 22 aa, Mycobacterium
VRQLILLYAPSVLGWAAFRDVA

SEQ ID NO: 1082543 - protein, 18 aa, Mycobacterium
VRTLPILYALRETGPDSE

SEQ ID NO: 1082544 - protein, 17 aa, Mycobacterium
VTGNYRAWRHFIAMRAS

SEQ ID NO: 1082545 - protein, 17 aa, Mycobacterium
VTWILHLYVVPPGAGRV

SEQ ID NO: 1082546 - protein, 22 aa, Mycobacterium
VVAPLLSRSLILQLRPLNADDI

SEQ ID NO: 1082547 - protein, 27 aa, Mycobacterium
VVLAVMPWNFPLWQTVRFAAPALMAGN

SEQ ID NO: 1082548 - protein, 19 aa, Mycobacterium
VVMTYWNPVLRYGVCAFAR

SEQ ID NO: 1082549 - protein, 18 aa, Mycobacterium
VVNRVWFLDAVLGKVDVY

SEQ ID NO: 1082550 - protein, 24 aa, Mycobacterium
VVSIPTMILFQGGQPVKRIVGAKG

SEQ ID NO: 1082551 - protein, 17 aa, Mycobacterium
VYELLWFLRGDSNVAWL

SEQ ID NO: 1082552 - protein, 18 aa, Mycobacterium
VYEPLLKRLPADTPMYGF

SEQ ID NO: 1082553 - protein, 17 aa, Mycobacterium
WEFALFEAALQRGLPVL

SEQ ID NO: 1082554 - protein, 19 aa, Mycobacterium
WETFLTSELPKWLSANRSV

SEQ ID NO: 1082555 - protein, 23 aa, Mycobacterium
WKCWARWRLIRARAPWLTDDLVA

SEQ ID NO: 1082556 - protein, 20 aa, Mycobacterium
WKVPKFYWSVFALSAFEAGM

SEQ ID NO: 1082557 - protein, 18 aa, Mycobacterium
WMHMLASEFPVFSAAPNF

SEQ ID NO: 1082558 - protein, 17 aa, Mycobacterium
WQHVLVGKRLFDLFDYD

SEQ ID NO: 1082559 - protein, 22 aa, Mycobacterium
WVNLHFSLLPAWRGAAPVQAAI

SEQ ID NO: 1082560 - protein, 25 aa, Mycobacterium
YDRSGLWPYLEKLGFYLVGYGCTTC

SEQ ID NO: 1082561 - protein, 30 aa, Mycobacterium
YFPCQNSVDLLWLLGLWLGDGHTAAPHKHM

SEQ ID NO: 1082562 - protein, 22 aa, Mycobacterium
YGCKQVEYLQWKKALMGNIRHT

SEQ ID NO: 1082563 - protein, 21 aa, Mycobacterium
YGRNFLLPHGLAIVASRGAQR

SEQ ID NO: 1082564 - protein, 27 aa, Mycobacterium
YLIPVNHLPLTLPLRYLGWSDALVDQI

SEQ ID NO: 1082565 - protein, 18 aa, Mycobacterium
YMHHYNFPPFSTGETGRV

SEQ ID NO: 1082566 - protein, 18 aa, Mycobacterium
YPVLVRPSYVLGGRGMEI

SEQ ID NO: 1082567 - protein, 17 aa, Mycobacterium
YSLLFRLASGSLLGLDR

SEQ ID NO: 1082568 - protein, 17 aa, Mycobacterium
YSLNYWYRIFDPAFETL

SEQ ID NO: 1082569 - protein, 17 aa, Mycobacterium
YVEPYRTELQRLGRPVF

SEQ ID NO: 1082570 - protein, 20 aa, Mycobacterium
YVHPEIEFFLLKAGPEDGSM

SEQ ID NO: 1082571 - protein, 24 aa, Mycobacterium
YVIAYLPYLGWLRQASVDSAVMAA

SEQ ID NO: 1082572 - protein, 24 aa, Mycobacterium
AAAAFGFPGFGGNGGLLFGKAGAD

SEQ ID NO: 1082573 - protein, 22 aa, Mycobacterium
AAAAPYVSWLNAAAVRAGEAAL

SEQ ID NO: 1082574 - protein, 20 aa, Mycobacterium
AAALAPITGLLPAGTDEVSA

SEQ ID NO: 1082575 - protein, 28 aa, Mycobacterium
AAAQLAPWQQWLQSLPGLPGQLAGSATA

SEQ ID NO: 1082576 - protein, 17 aa, Mycobacterium
AADLARMYIRYAERHGW

SEQ ID NO: 1082577 - protein, 25 aa, Mycobacterium
AAEAANVWPLQDLLGLINAPTQALL

SEQ ID NO: 1082578 - protein, 18 aa, Mycobacterium
AAFYRRCRLVTERLWPTL

SEQ ID NO: 1082579 - protein, 23 aa, Mycobacterium
AAGAPARYWAMAGPAAAVDRAAP

SEQ ID NO: 1082580 - protein, 18 aa, Mycobacterium
AAGDGFARYWLHNGWVTM

SEQ ID NO: 1082581 - protein, 26 aa, Mycobacterium
AAGLTPLRPWRSALVAALAAASDRAL

SEQ ID NO: 1082582 - protein, 24 aa, Mycobacterium
AAHHRLFSHVPWLSSQLLGAVEAY

SEQ ID NO: 1082583 - protein, 20 aa, Mycobacterium
AAIGLVDLLLAPGGNLVTVL

SEQ ID NO: 1082584 - protein, 19 aa, Mycobacterium
AAIPLLPPMMDDLMRLELR

SEQ ID NO: 1082585 - protein, 25 aa, Mycobacterium
AAISRLPLVPPLLEWLHAVRQPVVM

SEQ ID NO: 1082586 - protein, 17 aa, Mycobacterium
AALFSFHGQSYQTLGAQ

SEQ ID NO: 1082587 - protein, 18 aa, Mycobacterium
AALWPLLVGNIIAARGVL

SEQ ID NO: 1082588 - protein, 22 aa, Mycobacterium
AANAAPFQGLLGAVNAPVQTLT

SEQ ID NO: 1082589 - protein, 24 aa, Mycobacterium
AANPKIFFQIYWLGGRDAIAERVE

SEQ ID NO: 1082590 - protein, 17 aa, Mycobacterium
AANPPMIRYPIPPMIHG

SEQ ID NO: 1082591 - protein, 23 aa, Mycobacterium
AANRSAFLKLVQSNWLGLNAPAI

SEQ ID NO: 1082592 - protein, 22 aa, Mycobacterium
AAQGFAWPWSICRWVTGENPKV

SEQ ID NO: 1082593 - protein, 17 aa, Mycobacterium
AAVDGDTGPTRQGWRGR

SEQ ID NO: 1082594 - protein, 20 aa, Mycobacterium
AAVPFIQTLLARCPRLKILA

SEQ ID NO: 1082595 - protein, 17 aa, Mycobacterium
AAYALWVFTLFGHPDVR

SEQ ID NO: 1082596 - protein, 25 aa, Mycobacterium
ADADFSLSIFGLQLVKTGTANATTT

SEQ ID NO: 1082597 - protein, 24 aa, Mycobacterium
ADADVIRYLRWFTFLVAEELTELE

SEQ ID NO: 1082598 - protein, 17 aa, Mycobacterium
ADDYLRFVRLLLGDGTI

SEQ ID NO: 1082599 - protein, 23 aa, Mycobacterium
ADFDDFWRPIRSYFYWEKHCYDV

SEQ ID NO: 1082600 - protein, 20 aa, Mycobacterium
ADGTYFYVLLADGTLRVGGM

SEQ ID NO: 1082601 - protein, 19 aa, Mycobacterium
ADLLAVVARLNRLATQRIQ

SEQ ID NO: 1082602 - protein, 24 aa, Mycobacterium
ADQYGLRPLVRLVSWGLAGVAPDV

SEQ ID NO: 1082603 - protein, 26 aa, Mycobacterium
ADRHAGWWRAPLRWTLRGSLAVRSRL

SEQ ID NO: 1082604 - protein, 26 aa, Mycobacterium
ADVKFGIEPWFRYFQKVAAFPQMTMP

SEQ ID NO: 1082605 - protein, 22 aa, Mycobacterium
ADWAEMLMRMYVRWAEQHKYPV

SEQ ID NO: 1082606 - protein, 25 aa, Mycobacterium
ADYAGFIWYPQLPALDHWLQLYQRA

SEQ ID NO: 1082607 - protein, 25 aa, Mycobacterium
AEASVPWVLMHWRPVSDDNPHQVPN

SEQ ID NO: 1082608 - protein, 22 aa, Mycobacterium
AEEYYLSFLLDRANRTYLAMCS

SEQ ID NO: 1082609 - protein, 23 aa, Mycobacterium
AEEYYLSFLLDRANRTYLAMCSV

SEQ ID NO: 1082610 - protein, 23 aa, Mycobacterium
AEGGWVLPYLPKPWGRASSPVEQ

SEQ ID NO: 1082611 - protein, 18 aa, Mycobacterium
AEGLLGRPLIGDGTDGAP

SEQ ID NO: 1082612 - protein, 19 aa, Mycobacterium
AEGLLPFLPAAAQHALFTA

SEQ ID NO: 1082613 - protein, 23 aa, Mycobacterium
AEIYVPFSWFEPMWLENLGFMPE

SEQ ID NO: 1082614 - protein, 22 aa, Mycobacterium
AELRLPLVLVIDTAGPALSADA

SEQ ID NO: 1082615 - protein, 17 aa, Mycobacterium
AERPWWEWAATYERAFT

SEQ ID NO: 1082616 - protein, 24 aa, Mycobacterium
AESGFPMLPPLMPPPISAGSGWRK

SEQ ID NO: 1082617 - protein, 24 aa, Mycobacterium
AETLAFFPLWSYATPTAIELAERV

SEQ ID NO: 1082618 - protein, 23 aa, Mycobacterium
AETPVWTFLGPRPAHWWVRRRLH

SEQ ID NO: 1082619 - protein, 19 aa, Mycobacterium
AETRYWYYALQTCRLNEHR

SEQ ID NO: 1082620 - protein, 18 aa, Mycobacterium
AFCARLLGIAAQRVRVIM

SEQ ID NO: 1082621 - protein, 19 aa, Mycobacterium
AFIMMLRYPAKVTGFFGMN

SEQ ID NO: 1082622 - protein, 17 aa, Mycobacterium
AFKIPLVFVVDTPGFLP

SEQ ID NO: 1082623 - protein, 19 aa, Mycobacterium
AFNFPVAVWAWNTAVALVC

SEQ ID NO: 1082624 - protein, 20 aa, Mycobacterium
AFPRSLLERLPRLKLITIVG

SEQ ID NO: 1082625 - protein, 21 aa, Mycobacterium
AGAFFGLWQPLGHRGFEIIGE

SEQ ID NO: 1082626 - protein, 32 aa, Mycobacterium
AGALLFPGARGWITYLWVPPFASEKVRRRLRP

SEQ ID NO: 1082627 - protein, 19 aa, Mycobacterium
AGFDLAMLRAVRAAVTVPV

SEQ ID NO: 1082628 - protein, 25 aa, Mycobacterium
AGGAGGGAWLWGAGGAGGSGSGGLA

SEQ ID NO: 1082629 - protein, 21 aa, Mycobacterium
AGGAGGLLWGNGGNGGSGAAG

SEQ ID NO: 1082630 - protein, 24 aa, Mycobacterium
AGGISGLLLGLDGFNAPASTSALH

SEQ ID NO: 1082631 - protein, 22 aa, Mycobacterium
AGGRGGLLFGVGGAGGAGGDGL

SEQ ID NO: 1082632 - protein, 21 aa, Mycobacterium
AGGSAPLLGWGGNGGAGGDST

SEQ ID NO: 1082633 - protein, 22 aa, Mycobacterium
AGGTGGWWFGNGGVGGAGGAGT

SEQ ID NO: 1082634 - protein, 17 aa, Mycobacterium
AGGWFWIHALNSATQAA

SEQ ID NO: 1082635 - protein, 18 aa, Mycobacterium
AGGWLFGDGGPGAAATAT

SEQ ID NO: 1082636 - protein, 18 aa, Mycobacterium
AGIRALAGLWRSLTRKEV

SEQ ID NO: 1082637 - protein, 21 aa, Mycobacterium
AGPDALVVVLLPDGGRGYMSK

SEQ ID NO: 1082638 - protein, 24 aa, Mycobacterium
AGQPFGRALPQYGFRPTFVARPPA

SEQ ID NO: 1082639 - protein, 22 aa, Mycobacterium
AGRFGIHPALLNAALHAGLYGA

SEQ ID NO: 1082640 - protein, 18 aa, Mycobacterium
AGRRLIRFPELAAYPFVV

SEQ ID NO: 1082641 - protein, 23 aa, Mycobacterium
AGSYYVEWLTHQLAQRARAHINE

SEQ ID NO: 1082642 - protein, 23 aa, Mycobacterium
AGVDTFFVATAPRYSFVSSSLAK

SEQ ID NO: 1082643 - protein, 19 aa, Mycobacterium
AGWVRMDFIVPSRGLIGFR

SEQ ID NO: 1082644 - protein, 20 aa, Mycobacterium
AHGRPLWYLMPDGVVQYVSK

SEQ ID NO: 1082645 - protein, 23 aa, Mycobacterium
AHYAPFGLLTPAAWVALHAQRYM

SEQ ID NO: 1082646 - protein, 24 aa, Mycobacterium
AIAQQLAPWQQALALPAADADFSL

SEQ ID NO: 1082647 - protein, 23 aa, Mycobacterium
AIAYLLEILPALAYLHALGLVYN

SEQ ID NO: 1082648 - protein, 20 aa, Mycobacterium
AIHAVFLFHAIKAGLDMGIV

SEQ ID NO: 1082649 - protein, 18 aa, Mycobacterium
AIKFPNLELGLPAIDINI

SEQ ID NO: 1082650 - protein, 22 aa, Mycobacterium
AIKITTIFGSRYIDLHPTGAGV

SEQ ID NO: 1082651 - protein, 17 aa, Mycobacterium
AIKLTFVNPLITADLAT

SEQ ID NO: 1082652 - protein, 24 aa, Mycobacterium
AINAPTQTLLGRPLIGNGANGAPG

SEQ ID NO: 1082653 - protein, 20 aa, Mycobacterium
AIRLIYPRETIWRPPVLTMS

SEQ ID NO: 1082654 - protein, 17 aa, Mycobacterium
AIRLWRNAWNEFIPFLD

SEQ ID NO: 1082655 - protein, 18 aa, Mycobacterium
AIVNLLRILLSNPAVWEK

SEQ ID NO: 1082656 - protein, 18 aa, Mycobacterium
AIVRPRWLWKFGKTLRPP

SEQ ID NO: 1082657 - protein, 24 aa, Mycobacterium
AKAAPLWRVLVALSIRHVGPTAAR

SEQ ID NO: 1082658 - protein, 24 aa, Mycobacterium
AKEATYKVWFPLTNRWLGFEDAHI

SEQ ID NO: 1082659 - protein, 17 aa, Mycobacterium
ALAAFRRGTRGLAAMIA

SEQ ID NO: 1082660 - protein, 18 aa, Mycobacterium
ALAGAMRPPGAPGAPGAP

SEQ ID NO: 1082661 - protein, 21 aa, Mycobacterium
ALDIDLYLRIAPELFLKRCIV

SEQ ID NO: 1082662 - protein, 19 aa, Mycobacterium
ALDSWPVNIALLGKGNTVN

SEQ ID NO: 1082663 - protein, 19 aa, Mycobacterium
ALFHDQFVQALTTGASSYA

SEQ ID NO: 1082664 - protein, 21 aa, Mycobacterium
ALGCQGAWTGSQWLMVEEASN

SEQ ID NO: 1082665 - protein, 20 aa, Mycobacterium
ALLLDFTFDKLAQFPKAVML

SEQ ID NO: 1082666 - protein, 18 aa, Mycobacterium
ALLTLLPGSLRWLVTVDA

SEQ ID NO: 1082667 - protein, 24 aa, Mycobacterium
ALMQRFYTTSWRFAPFLWQEIEDG

SEQ ID NO: 1082668 - protein, 25 aa, Mycobacterium
ALPHPHWWFDLLTTEPLAFASLDRW

SEQ ID NO: 1082669 - protein, 22 aa, Mycobacterium
ALRDRLIVELLYATGIRVSELR

SEQ ID NO: 1082670 - protein, 19 aa, Mycobacterium
ALTGLLLDHLLPVPGSRVI

SEQ ID NO: 1082671 - protein, 19 aa, Mycobacterium
ALTPLSWPTQTLAGLAAPA

SEQ ID NO: 1082672 - protein, 17 aa, Mycobacterium
AMLTWMRSKGNLTKVGV

SEQ ID NO: 1082673 - protein, 18 aa, Mycobacterium
AMNTLFDGIAPLLADLRA

SEQ ID NO: 1082674 - protein, 19 aa, Mycobacterium
AMRMALLPERLPATEALSY

SEQ ID NO: 1082675 - protein, 25 aa, Mycobacterium
AMSAVAAPYASWLSAAAAQAAGTAG

SEQ ID NO: 1082676 - protein, 22 aa, Mycobacterium
AMTKSIRYPLRKVHLALVLWFP

SEQ ID NO: 1082677 - protein, 20 aa, Mycobacterium
AMVQPFLLAANRSSLVSLVL

SEQ ID NO: 1082678 - protein, 31 aa, Mycobacterium
AMVVKELTGASLVRHRMAARAVTAEVGARAG

SEQ ID NO: 1082679 - protein, 18 aa, Mycobacterium
AMYPLGPIFHGSGLNVTV

SEQ ID NO: 1082680 - protein, 21 aa, Mycobacterium
ANELLLYEALGLCGQGEAPKL

SEQ ID NO: 1082681 - protein, 19 aa, Mycobacterium
APAQALLGRPLIGDGADGA

SEQ ID NO: 1082682 - protein, 19 aa, Mycobacterium
APLFTVVNPPWDGVGVGAD

SEQ ID NO: 1082683 - protein, 17 aa, Mycobacterium
APLLFYLDAGIPPLSAM

SEQ ID NO: 1082684 - protein, 18 aa, Mycobacterium
APLPGMPFGQLAGNGGNG

SEQ ID NO: 1082685 - protein, 18 aa, Mycobacterium
APPLPPWPPLPPFATTLP

SEQ ID NO: 1082686 - protein, 21 aa, Mycobacterium
APPVLLIMGLGAQLLLWRTGF

SEQ ID NO: 1082687 - protein, 23 aa, Mycobacterium
APQGLLHKVVLARALQLTAETAL

SEQ ID NO: 1082688 - protein, 20 aa, Mycobacterium
APTEALLGRPLIGDGADGAP

SEQ ID NO: 1082689 - protein, 24 aa, Mycobacterium
APTFDIFMWEIFGPLVAGARLVFN

SEQ ID NO: 1082690 - protein, 20 aa, Mycobacterium
APTQALLGRPLIGNGANAAP

SEQ ID NO: 1082691 - protein, 20 aa, Mycobacterium
APTQTLLGRPLIGNGANGAP

SEQ ID NO: 1082692 - protein, 23 aa, Mycobacterium
APVWGGIHLSYVMAVPEIIEAAA

SEQ ID NO: 1082693 - protein, 25 aa, Mycobacterium
APYVDMTLWPKFDYASAANAGIDDV

SEQ ID NO: 1082694 - protein, 23 aa, Mycobacterium
AQALLGRPLIGNGDDGVAGTGQS

SEQ ID NO: 1082695 - protein, 18 aa, Mycobacterium
AQFWALIHGFVMLELAGF

SEQ ID NO: 1082696 - protein, 25 aa, Mycobacterium
AQISKPMLYLYYGSKEDLFGACLNR

SEQ ID NO: 1082697 - protein, 19 aa, Mycobacterium
AQLVGWLEGLFHGIQTALF

SEQ ID NO: 1082698 - protein, 22 aa, Mycobacterium
AQMARFHDQFVRSLSGAAQTYA

SEQ ID NO: 1082699 - protein, 19 aa, Mycobacterium
AQPWSLRYPLVDGQGNFGS

SEQ ID NO: 1082700 - protein, 18 aa, Mycobacterium
AQRHPLLGRLVYYRATRP

SEQ ID NO: 1082701 - protein, 20 aa, Mycobacterium
ARAMAMLMLALPGAVFLYNG

SEQ ID NO: 1082702 - protein, 22 aa, Mycobacterium
ARDGIVRLRPGLQLLRCRRGAE

SEQ ID NO: 1082703 - protein, 21 aa, Mycobacterium
AREKLLADVLRAASRDGLVSA

SEQ ID NO: 1082704 - protein, 24 aa, Mycobacterium
ARENALLERGLLPSPLLLDSPGVD

SEQ ID NO: 1082705 - protein, 18 aa, Mycobacterium
ARFSPFQKLIILDVPDDK

SEQ ID NO: 1082706 - protein, 26 aa, Mycobacterium
ARGPAHISYFVPAPLLTAIDPGRAEV

SEQ ID NO: 1082707 - protein, 23 aa, Mycobacterium
ARGYGYGPAFRGLTAMWARGEEL

SEQ ID NO: 1082708 - protein, 25 aa, Mycobacterium
ARKPKRLTLFLLPMDRPGFTVRPIP

SEQ ID NO: 1082709 - protein, 18 aa, Mycobacterium
ARLDLASVFLYAGSILPG

SEQ ID NO: 1082710 - protein, 19 aa, Mycobacterium
ARLVLGQALAWRGRGREAG

SEQ ID NO: 1082711 - protein, 22 aa, Mycobacterium
ARNSGMPVLFWLDPYRPHENEL

SEQ ID NO: 1082712 - protein, 17 aa, Mycobacterium
ARPFLFTDTVGFVRHLP

SEQ ID NO: 1082713 - protein, 18 aa, Mycobacterium
ARQLWRSMAGRCGHLYTG

SEQ ID NO: 1082714 - protein, 19 aa, Mycobacterium
ARVGIWSPNTWHWVVACLA

SEQ ID NO: 1082715 - protein, 25 aa, Mycobacterium
ARVKCALLGWMAFKDALAQAITANA

SEQ ID NO: 1082716 - protein, 20 aa, Mycobacterium
ARYWREAFRLPSMNLRKVAA

SEQ ID NO: 1082717 - protein, 25 aa, Mycobacterium
ASAFNGFLNLAIGLTDGVMASAGPG

SEQ ID NO: 1082718 - protein, 19 aa, Mycobacterium
ASAIPLGPDLIGKGGAGGP

SEQ ID NO: 1082719 - protein, 30 aa, Mycobacterium
ASARRFRWAYRPPLPRRWPTRWPSCWAAMH

SEQ ID NO: 1082720 - protein, 25 aa, Mycobacterium
ASESAYFLLAFTKIGLMPDGGASAL

SEQ ID NO: 1082721 - protein, 23 aa, Mycobacterium
ASLPDGVLMRRAAFGLATEIGRE

SEQ ID NO: 1082722 - protein, 30 aa, Mycobacterium; identical to SEQ ID NO: 881451

SEQ ID NO: 1082723 - protein, 27 aa, Mycobacterium
ASPGFDIFLWELFGPLVAGVRLVFMDA

SEQ ID NO: 1082724 - protein, 24 aa, Mycobacterium
ASPPVKWPCFYGIDFPSPAELIAN

SEQ ID NO: 1082725 - protein, 22 aa, Mycobacterium
ASTPLFFAQAIGRFVRSRRPGE

SEQ ID NO: 1082726 - protein, 22 aa, Mycobacterium
ASVMTHHRWLRALAVFGGLGLR

SEQ ID NO: 1082727 - protein, 20 aa, Mycobacterium
ASVPAAIRLLGALRYDVVLL

SEQ ID NO: 1082728 - protein, 17 aa, Mycobacterium
ATFQQLPFALTPGPPVP

SEQ ID NO: 1082729 - protein, 22 aa, Mycobacterium
ATGQFLWQNIFGVWPVTGEVSE

SEQ ID NO: 1082730 - protein, 27 aa, Mycobacterium
ATHNEPMIPIYIFYSMFGFQRTGDSFW

SEQ ID NO: 1082731 - protein, 21 aa, Mycobacterium
ATLFRMWLRDAVRRVATGVLE

SEQ ID NO: 1082732 - protein, 24 aa, Mycobacterium
ATRELDWWLGFSSTASLLGSPGQT

SEQ ID NO: 1082733 - protein, 23 aa, Mycobacterium
ATSGIIWRFSISATLWSCIPRSW

SEQ ID NO: 1082734 - protein, 22 aa, Mycobacterium
ATSWLVRRPPLHGLTPSAHDMA

SEQ ID NO: 1082735 - protein, 17 aa, Mycobacterium
ATVLAWSDALNAADIDT

SEQ ID NO: 1082736 - protein, 21 aa, Mycobacterium
ATVSFAWRIRLISSATIDARV

SEQ ID NO: 1082737 - protein, 22 aa, Mycobacterium
AVDGGWWVLGVHTPAAAECLRG

SEQ ID NO: 1082738 - protein, 23 aa, Mycobacterium
AVEVALYRLLESWGVRPDFVMGH

SEQ ID NO: 1082739 - protein, 17 aa, Mycobacterium
AVGTLYRYFPSKVHLLV

SEQ ID NO: 1082740 - protein, 26 aa, Mycobacterium
AVGWVPWIGILAPQINFFYYLFEPIV

SEQ ID NO: 1082741 - protein, 23 aa, Mycobacterium
AVIYFPRKVIWFLPDFTVECYHD

SEQ ID NO: 1082742 - protein, 24 aa, Mycobacterium
AVLDPMIYFGPFTPAISPLGLPAV

SEQ ID NO: 1082743 - protein, 18 aa, Mycobacterium
AVLPFASWLSATASVAEQ

SEQ ID NO: 1082744 - protein, 22 aa, Mycobacterium
AVLPHRPPLATYFLPNNRGKKS

SEQ ID NO: 1082745 - protein, 21 aa, Mycobacterium
AVLPLPMVSWLYEYGNYRRFT

SEQ ID NO: 1082746 - protein, 25 aa, Mycobacterium
AVLSRRPRMLYDYFQQLFAQVTNPP

SEQ ID NO: 1082747 - protein, 18 aa, Mycobacterium
AVWRIRRAAPLLPTVLLG

SEQ ID NO: 1082748 - protein, 18 aa, Mycobacterium
AWEFVWVVDPPLFEPAED

SEQ ID NO: 1082749 - protein, 18 aa, Mycobacterium
AWIEEYFIPTVAKRGATI

SEQ ID NO: 1082750 - protein, 23 aa, Mycobacterium
AWLDGLVAWRRAAGLPAATINWG

SEQ ID NO: 1082751 - protein, 17 aa, Mycobacterium
AWQQRWPITPVRQPRAA

SEQ ID NO: 1082752 - protein, 17 aa, Mycobacterium
AWRGFSRWLMRAYDVLV

SEQ ID NO: 1082753 - protein, 18 aa, Mycobacterium
AWSRITYWRALLTSAVDQ

SEQ ID NO: 1082754 - protein, 26 aa, Mycobacterium
AYAKKFRFPTFLGAFKYYTSYTLKTF

SEQ ID NO: 1082755 - protein, 21 aa, Mycobacterium
AYRGPWQYETLAREILLDIAA

SEQ ID NO: 1082756 - protein, 22 aa, Mycobacterium
CAVPPLIGYLNDGKLPGTYTYC

SEQ ID NO: 1082757 - protein, 18 aa, Mycobacterium
CEEAPFYTLGPLATDIAP

SEQ ID NO: 1082758 - protein, 17 aa, Mycobacterium
CGLPLFCLPPGGGISWA

SEQ ID NO: 1082759 - protein, 17 aa, Mycobacterium
CKQLLLIDQLPILGDRV

SEQ ID NO: 1082760 - protein, 20 aa, Mycobacterium
CKYMKMITPAALLRCLVEGA

SEQ ID NO: 1082761 - protein, 26 aa, Mycobacterium
CLDRYARLFAWLGLWERHTDLAVIPA

SEQ ID NO: 1082762 - protein, 24 aa, Mycobacterium
CPLTWPWNLLGWPSINVPAGFTVD

SEQ ID NO: 1082763 - protein, 24 aa, Mycobacterium
DAAALLHRLSLKVPARHFVLFSSI

SEQ ID NO: 1082764 - protein, 25 aa, Mycobacterium
DAAALLHRLSLKVPVRHFVLFSSIS

SEQ ID NO: 1082765 - protein, 22 aa, Mycobacterium
DAGDRWILHCGDAFYHVGTLDG

SEQ ID NO: 1082766 - protein, 18 aa, Mycobacterium
DAGFSALVPTRPWRWIRS

SEQ ID NO: 1082767 - protein, 18 aa, Mycobacterium
DAGLLGKGGYGGSAGLLI

SEQ ID NO: 1082768 - protein, 19 aa, Mycobacterium
DAHAPYLAWLTTTSADYAA

SEQ ID NO: 1082769 - protein, 24 aa, Mycobacterium
DALDRALIDLATYFRDALLVSAKA

SEQ ID NO: 1082770 - protein, 18 aa, Mycobacterium
DALLLVRLPYHLSSVTQV

SEQ ID NO: 1082771 - protein, 17 aa, Mycobacterium
DAPESLPLLVFPHAGAG

SEQ ID NO: 1082772 - protein, 20 aa, Mycobacterium
DAQTPTLLFPFAAPRVVGDL

SEQ ID NO: 1082773 - protein, 17 aa, Mycobacterium
DARAYRLPWPADTVVYE

SEQ ID NO: 1082774 - protein, 24 aa, Mycobacterium
DARWDSVIAVNLLAPLRLTEGLVG

SEQ ID NO: 1082775 - protein, 17 aa, Mycobacterium
DAWPPTSWYADWVSGLD

SEQ ID NO: 1082776 - protein, 29 aa, Mycobacterium
DAYDAYLRLHLLSHRLVAPHGLNAGGLFG

SEQ ID NO: 1082777 - protein, 17 aa, Mycobacterium
DCFSANELLLYEALGLC

SEQ ID NO: 1082778 - protein, 23 aa, Mycobacterium
DDDLADLFLPRPLRWLVSATRPA

SEQ ID NO: 1082779 - protein, 22 aa, Mycobacterium
DDDRFMFGYIPPVFKSQYAETA

SEQ ID NO: 1082780 - protein, 24 aa, Mycobacterium
DDPVPVRVLYLGRGLPKATLFGPS

SEQ ID NO: 1082781 - protein, 21 aa, Mycobacterium
DDRLHWWAGPWPVDERWWDPD

SEQ ID NO: 1082782 - protein, 19 aa, Mycobacterium
DDYGPDLRRWLVARLGLTE

SEQ ID NO: 1082783 - protein, 22 aa, Mycobacterium
DELAFLHPLPVRRLWEVGAKTA

SEQ ID NO: 1082784 - protein, 18 aa, Mycobacterium
DFPAPIFVIVLKGLTIRG

SEQ ID NO: 1082785 - protein, 18 aa, Mycobacterium
DFPIPIDGLYLGGAGCHG

SEQ ID NO: 1082786 - protein, 23 aa, Mycobacterium
DFTNIYFYAVLYHALRASNRIAV

SEQ ID NO: 1082787 - protein, 18 aa, Mycobacterium
DGLALPMRLALPGAVNRG

SEQ ID NO: 1082788 - protein, 19 aa, Mycobacterium
DGLVAYRRSLGLPAVGINW

SEQ ID NO: 1082789 - protein, 17 aa, Mycobacterium
DGPEWICYFPHPHRVVC

SEQ ID NO: 1082790 - protein, 31 aa, Mycobacterium
DGPTIDRPLYRFPVFGFFALSIGAAALGNAR

SEQ ID NO: 1082791 - protein, 32 aa, Mycobacterium
DGSRMYCLLRRLLFLLPPEWVHKLVFAVLRGA

SEQ ID NO: 1082792 - protein, 22 aa, Mycobacterium
DGTPGGWLLGDGGAAGLLGTGG

SEQ ID NO: 1082793 - protein, 25 aa, Mycobacterium
DHAGKWRVVFFWPKDFTFVCPTEIA

SEQ ID NO: 1082794 - protein, 22 aa, Mycobacterium
DHFEFFVFPYAETALTRTTRRS

SEQ ID NO: 1082795 - protein, 21 aa, Mycobacterium
DHFTPFTLIQLEELGFCGKGE

SEQ ID NO: 1082796 - protein, 23 aa, Mycobacterium
DHIGAIPFLLKLRSDIPVVGSKF

SEQ ID NO: 1082797 - protein, 22 aa, Mycobacterium
DHPFFARIWPFIVAHEAEPVRA

SEQ ID NO: 1082798 - protein, 23 aa, Mycobacterium
DHVALPFKWAFPRVFRAFAEEDL

SEQ ID NO: 1082799 - protein, 23 aa, Mycobacterium
DIDDEFFVILRPAPSGTRLLLSD

SEQ ID NO: 1082800 - protein, 24 aa, Mycobacterium
DIDLVFSSFFNALPIRRLGIHERA

SEQ ID NO: 1082801 - protein, 18 aa, Mycobacterium
DIFFYVYGLLHDPAYRST

SEQ ID NO: 1082802 - protein, 26 aa, Mycobacterium
DITTAPPVLAAWVATAAPGAMAGAVA

SEQ ID NO: 1082803 - protein, 24 aa, Mycobacterium
DKKRPFYFGALTWYMDRLLELVHD

SEQ ID NO: 1082804 - protein, 17 aa, Mycobacterium
DKRSLVFPVKRLADLGF

SEQ ID NO: 1082805 - protein, 17 aa, Mycobacterium
DLFGPYPLANGYTVVVT

SEQ ID NO: 1082806 - protein, 20 aa, Mycobacterium
DLFHAQFVQLLNSGASAYTG

SEQ ID NO: 1082807 - protein, 26 aa, Mycobacterium
DLIDRVVFWMLPLDDSLPWLLVDRRA

SEQ ID NO: 1082808 - protein, 25 aa, Mycobacterium
DLINAPTQALLGRPLIGNGADGATV

SEQ ID NO: 1082809 - protein, 18 aa, Mycobacterium
DLINVRYLSGFSGSNGAL

SEQ ID NO: 1082810 - protein, 17 aa, Mycobacterium
DLLLQLIFAHRLDVTEV

SEQ ID NO: 1082811 - protein, 21 aa, Mycobacterium
DLLPEWVLPPEDIPFIYPDER

SEQ ID NO: 1082812 - protein, 17 aa, Mycobacterium
DLLRRRGWPALESEHTW

SEQ ID NO: 1082813 - protein, 20 aa, Mycobacterium
DLMADWIGWLFAFDDVFDES

SEQ ID NO: 1082814 - protein, 22 aa, Mycobacterium
DLNNWSLLKWLDEPCSFYDWRR

SEQ ID NO: 1082815 - protein, 18 aa, Mycobacterium
DLPALLPSPGRPFGLYLH

SEQ ID NO: 1082816 - protein, 18 aa, Mycobacterium
DLQWWPPDALPPGTDHAL

SEQ ID NO: 1082817 - protein, 21 aa, Mycobacterium
DLRALSLPVLRSWLATAAGAG

SEQ ID NO: 1082818 - protein, 19 aa, Mycobacterium
DLTIGFFLHIPFPPVELFM

SEQ ID NO: 1082819 - protein, 18 aa, Mycobacterium
DMLLLIVAALDQSALVSM

SEQ ID NO: 1082820 - protein, 27 aa, Mycobacterium
DPAALQYWHVLGLWKLAIIAEGVMRRA

SEQ ID NO: 1082821 - protein, 23 aa, Mycobacterium
DPANNVEFFFLRPKDIAIYVGSG

SEQ ID NO: 1082822 - protein, 20 aa, Mycobacterium
DPAPLVPLYLRRPDAKPLAA

SEQ ID NO: 1082823 - protein, 23 aa, Mycobacterium
DPFHHMVVIYALFPNVVLSVTIA

SEQ ID NO: 1082824 - protein, 20 aa, Mycobacterium
DPGPLRRLIATLPALEVPRP

SEQ ID NO: 1082825 - protein, 24 aa, Mycobacterium
DPHKVAMLGLTFDDVLLLPAASDV

SEQ ID NO: 1082826 - protein, 20 aa, Mycobacterium
DPICPFAWVTSRWLLEAAQS

SEQ ID NO: 1082827 - protein, 17 aa, Mycobacterium
DPLMFKLGVGQVIQGWD

SEQ ID NO: 1082828 - protein, 24 aa, Mycobacterium
DPNGEPFWFPNWTRLVYAGDGLFC

SEQ ID NO: 1082829 - protein, 24 aa, Mycobacterium
DPRLKRPIPFLPNTVGLITGRASA

SEQ ID NO: 1082830 - protein, 21 aa, Mycobacterium
DQFMTLAKMRAARRLWARVAE

SEQ ID NO: 1082831 - protein, 23 aa, Mycobacterium
DRGPGRFFTMRLALSDIGVSDIT

SEQ ID NO: 1082832 - protein, 19 aa, Mycobacterium
DRRYPLWEMYFVEGLANHR

SEQ ID NO: 1082833 - protein, 17 aa, Mycobacterium
DSATGLAPLRWGTGFML

SEQ ID NO: 1082834 - protein, 21 aa, Mycobacterium
DSFEWLIGSPCWRAAAASRGD

SEQ ID NO: 1082835 - protein, 21 aa, Mycobacterium
DSFSGWFLTVLGAARVAFAQF

SEQ ID NO: 1082836 - protein, 20 aa, Mycobacterium
DSGPLRRLIATLPALEVSRP

SEQ ID NO: 1082837 - protein, 22 aa, Mycobacterium
DSGPLRRLIATLPALEVSRPDW

SEQ ID NO: 1082838 - protein, 19 aa, Mycobacterium
DSMFQAILPLRGKIINVEK

SEQ ID NO: 1082839 - protein, 17 aa, Mycobacterium
DSPEKEFLAPRVRALWG

SEQ ID NO: 1082840 - protein, 26 aa, Mycobacterium
DSRAAIADWLYWKHLSGLLHAALNPK

SEQ ID NO: 1082841 - protein, 20 aa, Mycobacterium
DSRAWRLPWPAGTTVFELDQ

SEQ ID NO: 1082842 - protein, 25 aa, Mycobacterium
DSWIQIEQFRLLVLRTAWLIDKHHD

SEQ ID NO: 1082843 - protein, 25 aa, Mycobacterium
DSYTELMPFRLAVLHAAWMIDTAGE

SEQ ID NO: 1082844 - protein, 18 aa, Mycobacterium
DTGRWRVPLILRLDPQVG

SEQ ID NO: 1082845 - protein, 20 aa, Mycobacterium
DTPYPPARLERLWLPGPDRL

SEQ ID NO: 1082846 - protein, 24 aa, Mycobacterium
DTTEKYWLQWRLIKDIDEHQRKQL

SEQ ID NO: 1082847 - protein, 23 aa, Mycobacterium
DTVGARLLLLRRLAHPDDTRLGP

SEQ ID NO: 1082848 - protein, 25 aa, Mycobacterium
DVALPGMLHLAIFRSPYAHARIVSI

SEQ ID NO: 1082849 - protein, 17 aa, Mycobacterium
DVALRWMREFHADGLRL

SEQ ID NO: 1082850 - protein, 25 aa, Mycobacterium
DVINAPTQLLLNRPLIGNGTDGTAA

SEQ ID NO: 1082851 - protein, 19 aa, Mycobacterium
DVLDTWFSSALWPFSTLGW

SEQ ID NO: 1082852 - protein, 18 aa, Mycobacterium
DVLLFIDNIFRFTQAGSE

SEQ ID NO: 1082853 - protein, 19 aa, Mycobacterium
DVLLPFLVTRQLICGAGKV

SEQ ID NO: 1082854 - protein, 25 aa, Mycobacterium
DVLNAPAQALFGRPLIGDGAGGAPG

SEQ ID NO: 1082855 - protein, 19 aa, Mycobacterium
DVMAALRQPGIGVIAEVKR

SEQ ID NO: 1082856 - protein, 17 aa, Mycobacterium
DVRLLLPKPADWSYAEA

SEQ ID NO: 1082857 - protein, 21 aa, Mycobacterium
DVYLRWAVAAFRLATSGVADS

SEQ ID NO: 1082858 - protein, 18 aa, Mycobacterium
EAAKPGSYFWLKGGSRPV

SEQ ID NO: 1082859 - protein, 17 aa, Mycobacterium
EAFAPVPLAWLCDIGAD

SEQ ID NO: 1082860 - protein, 18 aa, Mycobacterium
EAFIYFYPLVMMDVTRLQ

SEQ ID NO: 1082861 - protein, 23 aa, Mycobacterium
EAGWPVRVWIDLLPRQTTSAVAG

SEQ ID NO: 1082862 - protein, 25 aa, Mycobacterium
EAIDPFLLDLLRLGAYQLLRTRVDA

SEQ ID NO: 1082863 - protein, 20 aa, Mycobacterium
EAILRIFGPLLDAAPTLGAG

SEQ ID NO: 1082864 - protein, 21 aa, Mycobacterium
EALAAPLYWIATNAGLDGSVV

SEQ ID NO: 1082865 - protein, 19 aa, Mycobacterium
EALARVFDYTLAIGKTPIV

SEQ ID NO: 1082866 - protein, 17 aa, Mycobacterium
EALICHLGYIRDGEPVV

SEQ ID NO: 1082867 - protein, 18 aa, Mycobacterium
EALRWAMMRGEPLLVLAD

SEQ ID NO: 1082868 - protein, 22 aa, Mycobacterium
EAYFAALLDLPFVAVMPAATSA

SEQ ID NO: 1082869 - protein, 18 aa, Mycobacterium
EDFIGIHFFSPVDKMPLV

SEQ ID NO: 1082870 - protein, 22 aa, Mycobacterium
EDFIGIHFFSPVDKMPLVEIIK

SEQ ID NO: 1082871 - protein, 26 aa, Mycobacterium
EDPVWALIYGPPAPLRLLLVGGNTVV

SEQ ID NO: 1082872 - protein, 22 aa, Mycobacterium
EELKGLWFYYAGVYKGLPLDDR

SEQ ID NO: 1082873 - protein, 26 aa, Mycobacterium
EEQKSKWLPDLLAGRALAGFGLTEPG

SEQ ID NO: 1082874 - protein, 17 aa, Mycobacterium
EFAFPVAPWMFGAAGRE

SEQ ID NO: 1082875 - protein, 19 aa, Mycobacterium
EFDADFFGFPPLAAQVLDP

SEQ ID NO: 1082876 - protein, 23 aa, Mycobacterium
EFERRFFPIYPASTKVQSWDIFK

SEQ ID NO: 1082877 - protein, 18 aa, Mycobacterium
EFGLCRYLAAGLAVLRTV

SEQ ID NO: 1082878 - protein, 19 aa, Mycobacterium
EFHTRLAQALSAGAGAYSG

SEQ ID NO: 1082879 - protein, 17 aa, Mycobacterium
EFIQFHPTMLFAAGTGT

SEQ ID NO: 1082880 - protein, 19 aa, Mycobacterium
EFLPLVRRLARFLPADLRV

SEQ ID NO: 1082881 - protein, 18 aa, Mycobacterium
EFPFNFMLWDLDRRIRTG

SEQ ID NO: 1082882 - protein, 22 aa, Mycobacterium
EGDALLVWIPLNAANIFGGLYR

SEQ ID NO: 1082883 - protein, 25 aa, Mycobacterium
EGFGYIPWGVFLPRTARLLAADKLA

SEQ ID NO: 1082884 - protein, 20 aa, Mycobacterium
EGGGLVLLKPLRAALEDGNS

SEQ ID NO: 1082885 - protein, 24 aa, Mycobacterium
EGLELYFRRAGAWLALLHCLAATD

SEQ ID NO: 1082886 - protein, 17 aa, Mycobacterium
EGLLYERRLIHSAFATA

SEQ ID NO: 1082887 - protein, 24 aa, Mycobacterium
EGMALAMIATLPPGGHFASADISV

SEQ ID NO: 1082888 - protein, 23 aa, Mycobacterium
EGMLSPWLGLPGAADQIATWSKA

SEQ ID NO: 1082889 - protein, 17 aa, Mycobacterium
EGWFINQHIIWQVGDED

SEQ ID NO: 1082890 - protein, 17 aa, Mycobacterium
EGWMPFGRVFETLAWGR

SEQ ID NO: 1082891 - protein, 24 aa, Mycobacterium
EHAVLHLLYARFWHKVLYDLGHVS

SEQ ID NO: 1082892 - protein, 22 aa, Mycobacterium
EHPRFLHSFPPMPLQYKGLMTS

SEQ ID NO: 1082893 - protein, 22 aa, Mycobacterium
EIRTLFGVLFQDGALFGSMNLY

SEQ ID NO: 1082894 - protein, 22 aa, Mycobacterium
EKLPYILRLFDIQGLSTRSAAS

SEQ ID NO: 1082895 - protein, 28 aa, Mycobacterium
ELAAPVTHIWYFKGVPSRLGYLLDLAPK

SEQ ID NO: 1082896 - protein, 17 aa, Mycobacterium
ELARVWKLLPFEADWFS

SEQ ID NO: 1082897 - protein, 19 aa, Mycobacterium
ELDGLRLITWRGASRAEQG

SEQ ID NO: 1082898 - protein, 21 aa, Mycobacterium
ELFMQLPWRTEIIQGLLGADL

SEQ ID NO: 1082899 - protein, 23 aa, Mycobacterium
ELHYLGAALWRRGIHRVLHGFVQ

SEQ ID NO: 1082900 - protein, 24 aa, Mycobacterium
ELSDGTLRYLLWSAALLSPRPPQL

SEQ ID NO: 1082901 - protein, 19 aa, Mycobacterium
ELSQLRPLPFRLVLDGTEE

SEQ ID NO: 1082902 - protein, 20 aa, Mycobacterium
ELTERPDLFPAWDSLSEAQQ

SEQ ID NO: 1082903 - protein, 18 aa, Mycobacterium
ELVALVISNLFGQNAPAI

SEQ ID NO: 1082904 - protein, 18 aa, Mycobacterium
ELVRRLCWDWAPVAAAEI

SEQ ID NO: 1082905 - protein, 17 aa, Mycobacterium
ELWDLLPGYLIFRSIIP

SEQ ID NO: 1082906 - protein, 20 aa, Mycobacterium
ELYFPVCFELAITKGPPAAG

SEQ ID NO: 1082907 - protein, 22 aa, Mycobacterium
EMQINWVWNPPWGPDKITEDGR

SEQ ID NO: 1082908 - protein, 17 aa, Mycobacterium
ENLFFKEKRYDLARVGR

SEQ ID NO: 1082909 - protein, 20 aa, Mycobacterium
EPAFFGVRPHAVVKGGAIAW

SEQ ID NO: 1082910 - protein, 18 aa, Mycobacterium
EPHWLFPGVQWLPYEARV

SEQ ID NO: 1082911 - protein, 17 aa, Mycobacterium
EPLWVPLITAYYVAQRQ

SEQ ID NO: 1082912 - protein, 18 aa, Mycobacterium
EPLWVQLITAYYLAERQS

SEQ ID NO: 1082913 - protein, 17 aa, Mycobacterium
EPMPWNGPLFKFALFQV

SEQ ID NO: 1082914 - protein, 19 aa, Mycobacterium
EPNMRWRTFCAELLAIIEK

SEQ ID NO: 1082915 - protein, 23 aa, Mycobacterium
EPRRLARRYLLQGPIALLRAARA

SEQ ID NO: 1082916 - protein, 18 aa, Mycobacterium
EPVAWFTHYYWLDDDRAP

SEQ ID NO: 1082917 - protein, 28 aa, Mycobacterium
EPWVRDYLLLRGLLGTSILWFELDRDGN

SEQ ID NO: 1082918 - protein, 20 aa, Mycobacterium
EQLGILARFAGAALVAKEDT

SEQ ID NO: 1082919 - protein, 24 aa, Mycobacterium
ERAAPWWVILYRTGQTLAPQPSRG

SEQ ID NO: 1082920 - protein, 24 aa, Mycobacterium
ERDIRFVRLWFTDVLGFLKSVAIA

SEQ ID NO: 1082921 - protein, 23 aa, Mycobacterium
ERDLRVIIYGWLAFTFEICRQRI

SEQ ID NO: 1082922 - protein, 18 aa, Mycobacterium
ERIELFVEALLKGGRPAY

SEQ ID NO: 1082923 - protein, 26 aa, Mycobacterium
ERLGVLGLPFLFFIDAAQGRAGVLYH

SEQ ID NO: 1082924 - protein, 18 aa, Mycobacterium
ERWQLLATAWLDLPGRPA

SEQ ID NO: 1082925 - protein, 24 aa, Mycobacterium
ESAELPLFRYIGGPNAHILPVPMM

SEQ ID NO: 1082926 - protein, 24 aa, Mycobacterium
ESKRLMRDYPYLAGFLRAVRAENA

SEQ ID NO: 1082927 - protein, 22 aa, Mycobacterium
ESKRWAFYPWRKTVVSILGPRS

SEQ ID NO: 1082928 - protein, 17 aa, Mycobacterium
ESRARLFPRGLAAFIEL

SEQ ID NO: 1082929 - protein, 22 aa, Mycobacterium
ESYTRWGPIQWMAPETLLTLGA

SEQ ID NO: 1082930 - protein, 17 aa, Mycobacterium
ETDQVFGWVAFEFGLYR

SEQ ID NO: 1082931 - protein, 23 aa, Mycobacterium
ETLIALVRLRELIDRYPLRGIKG

SEQ ID NO: 1082932 - protein, 19 aa, Mycobacterium
ETTRPLVICDLGMPRDVDP

SEQ ID NO: 1082933 - protein, 25 aa, Mycobacterium
ETWVERPHYMPLFVAPQPISEPVAG

SEQ ID NO: 1082934 - protein, 18 aa, Mycobacterium
EVFRALLALILIVLRRDT

SEQ ID NO: 1082935 - protein, 25 aa, Mycobacterium
EVGKLADLVLWEPAFFGVRPHAVVK

SEQ ID NO: 1082936 - protein, 24 aa, Mycobacterium
EVMPEDLIKFGLIPEFIGRLPVVA

SEQ ID NO: 1082937 - protein, 18 aa, Mycobacterium
EVSSNVVVPYFWSDQYDV

SEQ ID NO: 1082938 - protein, 24 aa, Mycobacterium
EVSVAIAGLLRLHGQQYQQFGAHL

SEQ ID NO: 1082939 - protein, 23 aa, Mycobacterium
EVTHYLFKHPKVDFIWVTGGPKI

SEQ ID NO: 1082940 - protein, 20 aa, Mycobacterium
EVYKLRQPVLLIWGREDRVN

SEQ ID NO: 1082941 - protein, 20 aa, Mycobacterium
EWICYFPHPHRVVCGGISIL

SEQ ID NO: 1082942 - protein, 19 aa, Mycobacterium
EWICYFPHPLRVVCGGISI

SEQ ID NO: 1082943 - protein, 17 aa, Mycobacterium
EWYVARLFPGPLSADER

SEQ ID NO: 1082944 - protein, 24 aa, Mycobacterium
EYASRGTWIWPPEPSLRLIADTIE

SEQ ID NO: 1082945 - protein, 18 aa, Mycobacterium
EYEVVLEEFLDGLQGGSG

SEQ ID NO: 1082946 - protein, 20 aa, Mycobacterium
EYFLWLRAQTDRPLSDDTLS

SEQ ID NO: 1082947 - protein, 23 aa, Mycobacterium
EYSLDLFALLPLGELWVAAARNR

SEQ ID NO: 1082948 - protein, 18 aa, Mycobacterium
FARILFSLFSTPSPIRDM

SEQ ID NO: 1082949 - protein, 20 aa, Mycobacterium
FAYHGYPWLIHRLAYRRANH

SEQ ID NO: 1082950 - protein, 20 aa, Mycobacterium
FCDLGWFGVWAILDAVVPRG

SEQ ID NO: 1082951 - protein, 23 aa, Mycobacterium
FCELYDLRTLWHVAAHNPWLSVS

SEQ ID NO: 1082952 - protein, 25 aa, Mycobacterium
FDGPYFVMQWLLRQPHRAILPVAGD

SEQ ID NO: 1082953 - protein, 17 aa, Mycobacterium
FDRFGADLPPLEGIYLA

SEQ ID NO: 1082954 - protein, 25 aa, Mycobacterium
FERVPLRELPLPYPARSWRSYPRCS

SEQ ID NO: 1082955 - protein, 23 aa, Mycobacterium
FETLLALAGYYFAVGDLARSTGV

SEQ ID NO: 1082956 - protein, 17 aa, Mycobacterium
FEWLIGSQRWRESAAQR

SEQ ID NO: 1082957 - protein, 23 aa, Mycobacterium
FFDDLVTPFLGLYRDDNLRPNSS

SEQ ID NO: 1082958 - protein, 17 aa, Mycobacterium
FFFTKRKLARMAGLATA

SEQ ID NO: 1082959 - protein, 25 aa, Mycobacterium
FFGLLIRICLGIAAWLRGAFATAGP

SEQ ID NO: 1082960 - protein, 18 aa, Mycobacterium
FGELRWAVSGAAPIPKET

SEQ ID NO: 1082961 - protein, 26 aa, Mycobacterium
FGEPLLALRIPWYVTVLDLGPAGAVY

SEQ ID NO: 1082962 - protein, 17 aa, Mycobacterium
FGFFWITAVTVDGQIAV

SEQ ID NO: 1082963 - protein, 17 aa, Mycobacterium
FGHWWYEGPTWLQRVLR

SEQ ID NO: 1082964 - protein, 17 aa, Mycobacterium
FGPLRRVRAVLAAATRC

SEQ ID NO: 1082965 - protein, 17 aa, Mycobacterium
FGRLIFIGSVSGSWGIG

SEQ ID NO: 1082966 - protein, 17 aa, Mycobacterium
FGVWAILDAVVPRGSAA

SEQ ID NO: 1082967 - protein, 22 aa, Mycobacterium
FHNRRALLDVPRLGPKAFEQCA

SEQ ID NO: 1082968 - protein, 18 aa, Mycobacterium
FHQQFWRSLSGAAASYSG

SEQ ID NO: 1082969 - protein, 18 aa, Mycobacterium
FIDRLFMGSLVPLTSFTV

SEQ ID NO: 1082970 - protein, 17 aa, Mycobacterium
FIYLMQNLPQERISIAI

SEQ ID NO: 1082971 - protein, 17 aa, Mycobacterium
FKAMFQMKFYGVALFRS

SEQ ID NO: 1082972 - protein, 17 aa, Mycobacterium
FLAPLPLAAITPRWVAR

SEQ ID NO: 1082973 - protein, 17 aa, Mycobacterium
FLDLPRLALADAALSAA

SEQ ID NO: 1082974 - protein, 17 aa, Mycobacterium
FLDPYLWKLQVGGKRLV

SEQ ID NO: 1082975 - protein, 18 aa, Mycobacterium
FLHHVPGLAFLPNRRPAE

SEQ ID NO: 1082976 - protein, 17 aa, Mycobacterium
FLHIPFPPVELFMQLPW

SEQ ID NO: 1082977 - protein, 18 aa, Mycobacterium
FLHRWDPVHWLQPVSAAA

SEQ ID NO: 1082978 - protein, 18 aa, Mycobacterium
FLLHVLKSLKSTGKAAII

SEQ ID NO: 1082979 - protein, 17 aa, Mycobacterium
FLPLLRRAAGRIVVIAS

SEQ ID NO: 1082980 - protein, 26 aa, Mycobacterium
FLREIPQELLNWRRLAPKPSFSAPVS

SEQ ID NO: 1082981 - protein, 18 aa, Mycobacterium
FLSSLLRSLISEDTLFNL

SEQ ID NO: 1082982 - protein, 23 aa, Mycobacterium
FMVRNTYIYPPKPSMRIISDIFA

SEQ ID NO: 1082983 - protein, 17 aa, Mycobacterium
FMYLGWLCGAGPNNAAL

SEQ ID NO: 1082984 - protein, 17 aa, Mycobacterium
FPALLRKQLKGAPMPAP

SEQ ID NO: 1082985 - protein, 17 aa, Mycobacterium
FPAVLTPTGLTLPFGEV

SEQ ID NO: 1082986 - protein, 17 aa, Mycobacterium
FPDVLFIAGKYQIKIPP

SEQ ID NO: 1082987 - protein, 17 aa, Mycobacterium
FPYYLETYGFHSIHGRA

SEQ ID NO: 1082988 - protein, 17 aa, Mycobacterium
FQRAYKELAKQVRLPGF

SEQ ID NO: 1082989 - protein, 18 aa, Mycobacterium
FRPMLIPISIHLCEDPER

SEQ ID NO: 1082990 - protein, 27 aa, Mycobacterium
FRRDHVGFIFQFFNLIPTLTAKENVEV

SEQ ID NO: 1082991 - protein, 17 aa, Mycobacterium
FTNDYEWDLLLSKTGWS

SEQ ID NO: 1082992 - protein, 17 aa, Mycobacterium
FVIVLKGLTIRGSIVGT

SEQ ID NO: 1082993 - protein, 17 aa, Mycobacterium
FVLLALQAPVAGDLRAI

SEQ ID NO: 1082994 - protein, 17 aa, Mycobacterium
FVLVFDKAALSGDGPIN

SEQ ID NO: 1082995 - protein, 17 aa, Mycobacterium
FVRLWFTDVLGYLKSVA

SEQ ID NO: 1082996 - protein, 18 aa, Mycobacterium
FWRHQHRYWRPGPGPRFL

SEQ ID NO: 1082997 - protein, 25 aa, Mycobacterium
FYKWTQWIFLQIYNAWFDAAANKAR

SEQ ID NO: 1082998 - protein, 18 aa, Mycobacterium
FYVLLADGTLRVGGMLFS

SEQ ID NO: 1082999 - protein, 17 aa, Mycobacterium
GAAFYRDQYRRTAAGWR

SEQ ID NO: 1083000 - protein, 20 aa, Mycobacterium
GAAGSGGMFGQMGDAGDGGD

SEQ ID NO: 1083001 - protein, 23 aa, Mycobacterium
GAAHFLEHLLFKSTPTRTAVDIA

SEQ ID NO: 1083002 - protein, 17 aa, Mycobacterium
GAALPFKRRLFGQIVAA

SEQ ID NO: 1083003 - protein, 37 aa, Mycobacterium
GAAPLQPVLDLINGPTQALLGRPLIGNGTSGALGTGQ

SEQ ID NO: 1083004 - protein, 17 aa, Mycobacterium
GADLRALSLPVLRSWLA

SEQ ID NO: 1083005 - protein, 19 aa, Mycobacterium
GAELLLGTRRLAGGSSTSL

SEQ ID NO: 1083006 - protein, 33 aa, Mycobacterium
GAESDALLVQPAHTLSQAWITSPLGQVVDPVIN

SEQ ID NO: 1083007 - protein, 17 aa, Mycobacterium
GAFAARLWLPMLRAERD

SEQ ID NO: 1083008 - protein, 19 aa, Mycobacterium
GAGEWLFGPGGVGGAGGSS

SEQ ID NO: 1083009 - protein, 17 aa, Mycobacterium
GAGGFGGIGLNGSGGDG

SEQ ID NO: 1083010 - protein, 18 aa, Mycobacterium
GAGGLLFGNGGDGGAGGD

SEQ ID NO: 1083011 - protein, 24 aa, Mycobacterium
GAGGNGGWLFGQGGAGGIGGSGAA

SEQ ID NO: 1083012 - protein, 30 aa, Mycobacterium; identical to SEQ ID NO: 883399

SEQ ID NO: 1083013 - protein, 17 aa, Mycobacterium
GAMGFKFQFITLAGFHA

SEQ ID NO: 1083014 - protein, 23 aa, Mycobacterium
GANPCLLTPPPWYPIVRGTTQQA

SEQ ID NO: 1083015 - protein, 23 aa, Mycobacterium
GAQWDAALGYWQQLRTDPGAVFD

SEQ ID NO: 1083016 - protein, 21 aa, Mycobacterium
GAVTVPVNFLAHAGSDGGIGT

SEQ ID NO: 1083017 - protein, 20 aa, Mycobacterium
GAVVYFLRKLIWTVPDFTAE

SEQ ID NO: 1083018 - protein, 18 aa, Mycobacterium
GCSSRFPYYLETYGFHSI

SEQ ID NO: 1083019 - protein, 24 aa, Mycobacterium
GDARSELWFFYHLGRKLREKLSGS

SEQ ID NO: 1083020 - protein, 21 aa, Mycobacterium
GDKVLPLYLPTSDGLIGLLSQ

SEQ ID NO: 1083021 - protein, 22 aa, Mycobacterium
GDLELELFRYGLKASLNGYLGA

SEQ ID NO: 1083022 - protein, 21 aa, Mycobacterium
GDLPAFAELLSRLPWPLNKTT

SEQ ID NO: 1083023 - protein, 18 aa, Mycobacterium
GDPLLVVTINFLGLRHLT

SEQ ID NO: 1083024 - protein, 23 aa, Mycobacterium
GDPQDLLLLYDLLGIADPRVELP

SEQ ID NO: 1083025 - protein, 24 aa, Mycobacterium
GDVADALWYPLWDASIRLDHSVRT

SEQ ID NO: 1083026 - protein, 19 aa, Mycobacterium
GDVILGERLILSSGFVAVT

SEQ ID NO: 1083027 - protein, 20 aa, Mycobacterium
GDVILGERLILSSGFVAVTV

SEQ ID NO: 1083028 - protein, 20 aa, Mycobacterium
GEFLSPKWQKIWKPVVCAVQ

SEQ ID NO: 1083029 - protein, 23 aa, Mycobacterium
GERFRARFFGRNVNVPLMIIGIG

SEQ ID NO: 1083030 - protein, 22 aa, Mycobacterium
GFHDQLVRLMRAGAAAYASVEA

SEQ ID NO: 1083031 - protein, 21 aa, Mycobacterium
GFNSGFFNWGTANSGLFSLSK

SEQ ID NO: 1083032 - protein, 22 aa, Mycobacterium
GFPLFTPRFDGAFTAGLYSVAP

SEQ ID NO: 1083033 - protein, 17 aa, Mycobacterium
GFQHRRFWLGQLDAGRT

SEQ ID NO: 1083034 - protein, 22 aa, Mycobacterium
GFYGLSYWYPFQVTALGLGPIW

SEQ ID NO: 1083035 - protein, 21 aa, Mycobacterium
GFYQLMRNLPQERLALAVGAV

SEQ ID NO: 1083036 - protein, 18 aa, Mycobacterium
GGAGAMRGNGGNGGSAGT

SEQ ID NO: 1083037 - protein, 20 aa, Mycobacterium
GGAHHFLLGTGGAGGVGGAG

SEQ ID NO: 1083038 - protein, 17 aa, Mycobacterium
GGEWYVARLFPGPLSAD

SEQ ID NO: 1083039 - protein, 24 aa, Mycobacterium
GGFGGIGGNSYYAGNAGPGGQGGQ

SEQ ID NO: 1083040 - protein, 30 aa, Mycobacterium
GGHPILYVAQAWDWIFPLTEDPNYEPAAAD

SEQ ID NO: 1083041 - protein, 24 aa, Mycobacterium
GGILLITHYTRILRYIRPEFVHVF

SEQ ID NO: 1083042 - protein, 23 aa, Mycobacterium
GGKRLRPIFAYRGWPAVTTEDPD

SEQ ID NO: 1083043 - protein, 18 aa, Mycobacterium
GGLFIRMSWHAAGTYRIQ

SEQ ID NO: 1083044 - protein, 23 aa, Mycobacterium
GGNGGILGLGLPPGTAGTGGTGG

SEQ ID NO: 1083045 - protein, 26 aa, Mycobacterium
GGNPLHPLALPLLRPRQVIMLGRPTL

SEQ ID NO: 1083046 - protein, 23 aa, Mycobacterium
GGPAPIFQWLIYPRTDFAGRTRS

SEQ ID NO: 1083047 - protein, 23 aa, Mycobacterium
GGPTMFSILPRIPISRSPAYNLI

SEQ ID NO: 1083048 - protein, 24 aa, Mycobacterium
GGQEILFPALLPRAPYETTNRWTE

SEQ ID NO: 1083049 - protein, 24 aa, Mycobacterium
GGQGGFLRFLGGQGDGGAGGAGGV

SEQ ID NO: 1083050 - protein, 21 aa, Mycobacterium
GGRAALLIGFGGNGGNGGVGT

SEQ ID NO: 1083051 - protein, 20 aa, Mycobacterium
GGTAGWLYGSGGSGGAGGAG

SEQ ID NO: 1083052 - protein, 26 aa, Mycobacterium
GGTGQGGISFLAPGGQTGGDGSTGGT

SEQ ID NO: 1083053 - protein, 19 aa, Mycobacterium
GGTSGLLLGLDGFNAPAST

SEQ ID NO: 1083054 - protein, 18 aa, Mycobacterium
GHLWWIRSQLRSLLVEDV

SEQ ID NO: 1083055 - protein, 22 aa, Mycobacterium
GIALSPYRFPTGWFIVAFSSEL

SEQ ID NO: 1083056 - protein, 18 aa, Mycobacterium
GIATYLDLPLFAGRPARA

SEQ ID NO: 1083057 - protein, 23 aa, Mycobacterium
GIINAPTQALVGRPLIGNGANGT

SEQ ID NO: 1083058 - protein, 17 aa, Mycobacterium
GIPLEKWNLYSEPVHAA

SEQ ID NO: 1083059 - protein, 21 aa, Mycobacterium
GKRLVLRYRPMGLIGVIGPWN

SEQ ID NO: 1083060 - protein, 19 aa, Mycobacterium
GLANALWRLLPDRVRVLDF

SEQ ID NO: 1083061 - protein, 20 aa, Mycobacterium
GLAPLRWGTGFMLGSNRFGP

SEQ ID NO: 1083062 - protein, 23 aa, Mycobacterium
GLAVREILLLRLRALLARAHGDD

SEQ ID NO: 1083063 - protein, 17 aa, Mycobacterium
GLDSRAWRLPWPAGTTV

SEQ ID NO: 1083064 - protein, 22 aa, Mycobacterium
GLGTWWGSWRRFLPAGQGQPER

SEQ ID NO: 1083065 - protein, 18 aa, Mycobacterium
GLHFFNPVPVLPLVELVN

SEQ ID NO: 1083066 - protein, 25 aa, Mycobacterium
GLHRRYLIVLPFLTPTIASLWVGTV

SEQ ID NO: 1083067 - protein, 21 aa, Mycobacterium
GLILGSYRFSAFRSAKTAPKD

SEQ ID NO: 1083068 - protein, 25 aa, Mycobacterium
GLINAPTQTLLGRPLIGDGAAGTAT

SEQ ID NO: 1083069 - protein, 22 aa, Mycobacterium
GLLLTTLWYIREVDPTTLLLTG

SEQ ID NO: 1083070 - protein, 21 aa, Mycobacterium
GLLPIKIPIIDIAAAPGFGNS

SEQ ID NO: 1083071 - protein, 19 aa, Mycobacterium
GLMQPWRFIRITDTGLRRR

SEQ ID NO: 1083072 - protein, 18 aa, Mycobacterium
GLNSWLTGMFDRGAWRPA

SEQ ID NO: 1083073 - protein, 18 aa, Mycobacterium
GLPMMPMMGGIPSMGGMG

SEQ ID NO: 1083074 - protein, 29 aa, Mycobacterium
GLRAGIPMLIRWLWLDQPIWAAGIEELGV

SEQ ID NO: 1083075 - protein, 18 aa, Mycobacterium
GLRFPLFVKAVAGGGGRG

SEQ ID NO: 1083076 - protein, 22 aa, Mycobacterium
GLSYPPQFWPLTSGLTLNQSVA

SEQ ID NO: 1083077 - protein, 23 aa, Mycobacterium
GLTAPMSLMRFIKFILTEIFPGG

SEQ ID NO: 1083078 - protein, 20 aa, Mycobacterium
GLTPLRPWRSALVEALAVSR

SEQ ID NO: 1083079 - protein, 17 aa, Mycobacterium
GLVGVPLFDIAAAPGFG

SEQ ID NO: 1083080 - protein, 18 aa, Mycobacterium
GMGGDYFALALALEELGK

SEQ ID NO: 1083081 - protein, 17 aa, Mycobacterium
GMVFQRPNPFPAMSIRD

SEQ ID NO: 1083082 - protein, 23 aa, Mycobacterium
GNGGSGGFAFTFGTGNIIAGVGG

SEQ ID NO: 1083083 - protein, 24 aa, Mycobacterium
GNNNWFAAYAYWYFKLYGHQNVKL

SEQ ID NO: 1083084 - protein, 27 aa, Mycobacterium
GNRDLLKQLLPIVLPIVLAYIGNQLGS

SEQ ID NO: 1083085 - protein, 25 aa, Mycobacterium
GPIDRFHRRLLWPIRSSAGEVIGFG

SEQ ID NO: 1083086 - protein, 25 aa, Mycobacterium
GPIGKILRLIPLTKPLFGSYREKIA

SEQ ID NO: 1083087 - protein, 24 aa, Mycobacterium
GPIPPIAFQLLWYPSTMWDQTLPS

SEQ ID NO: 1083088 - protein, 20 aa, Mycobacterium
GPRWFEGLLWFSDMLGEAVH

SEQ ID NO: 1083089 - protein, 24 aa, Mycobacterium
GPYPERIIPCQLPWLLDPSAGAQL

SEQ ID NO: 1083090 - protein, 20 aa, Mycobacterium
GQGGWLYGNGGVGGAGGAAS

SEQ ID NO: 1083091 - protein, 31 aa, Mycobacterium; identical to SEQ ID NO: 227175

SEQ ID NO: 1083092 - protein, 17 aa, Mycobacterium
GQMPIHMRLPKLKGFRN

SEQ ID NO: 1083093 - protein, 23 aa, Mycobacterium
GQPLDWFCLFSSGAALMGSPGQG

SEQ ID NO: 1083094 - protein, 18 aa, Mycobacterium
GQPRLRPPFPAVAGLYGC

SEQ ID NO: 1083095 - protein, 20 aa, Mycobacterium
GRAALLYGVGRDGGAGGAGG

SEQ ID NO: 1083096 - protein, 20 aa, Mycobacterium
GRAGLFFGVGGTGGNGGATS

SEQ ID NO: 1083097 - protein, 25 aa, Mycobacterium
GRDAPLLHWVIFEEEYFRAGAPGRA

SEQ ID NO: 1083098 - protein, 18 aa, Mycobacterium
GRENVFFLHVSLVPHLAP

SEQ ID NO: 1083099 - protein, 23 aa, Mycobacterium
GRENVFFLHVSLVPYLAPSGELK

SEQ ID NO: 1083100 - protein, 18 aa, Mycobacterium
GRIARVLGPRGLMPNPKT

SEQ ID NO: 1083101 - protein, 21 aa, Mycobacterium
GRIKFILFRHLQAAGFAAAAY

SEQ ID NO: 1083102 - protein, 25 aa, Mycobacterium
GRPAISLPLHWTPAGLPLGVQFVGG

SEQ ID NO: 1083103 - protein, 23 aa, Mycobacterium
GRVIGVLTLLWPTPRQFDASELE

SEQ ID NO: 1083104 - protein, 18 aa, Mycobacterium
GRYSPYAVYLLGGDPGLL

SEQ ID NO: 1083105 - protein, 19 aa, Mycobacterium
GSAGLLFGSGRIGGDGGFG

SEQ ID NO: 1083106 - protein, 18 aa, Mycobacterium
GSAGLWGAGGAGGAGGAG

SEQ ID NO: 1083107 - protein, 22 aa, Mycobacterium
GSDAMRWFLMASPILRGGNLIV

SEQ ID NO: 1083108 - protein, 23 aa, Mycobacterium
GSGPAYFLLMVEALVDAGVAAGL

SEQ ID NO: 1083109 - protein, 17 aa, Mycobacterium
GSLAWTPLMTQFQLIDK

SEQ ID NO: 1083110 - protein, 22 aa, Mycobacterium
GSLGFLYDTGLYLRFRATDPDG

SEQ ID NO: 1083111 - protein, 23 aa, Mycobacterium
GSMWSQWLTLPAAAGPIVLALNA

SEQ ID NO: 1083112 - protein, 19 aa, Mycobacterium
GSQPPFGSIPAGSGGDGGN

SEQ ID NO: 1083113 - protein, 23 aa, Mycobacterium
GSRPPLLKRIVLQTAARLSPRGR

SEQ ID NO: 1083114 - protein, 20 aa, Mycobacterium
GSTIWPSASGWCWCSCRAAA

SEQ ID NO: 1083115 - protein, 18 aa, Mycobacterium
GTAGTGGFLFGLDGINGS

SEQ ID NO: 1083116 - protein, 25 aa, Mycobacterium
GTGGAMLPLLIFASARAGLPFTSIN

SEQ ID NO: 1083117 - protein, 24 aa, Mycobacterium
GTGGHGGLLIGNGGAGGIGGTRGS

SEQ ID NO: 1083118 - protein, 19 aa, Mycobacterium
GTGPRYGFRLTIMPRPLSG

SEQ ID NO: 1083119 - protein, 25 aa, Mycobacterium
GTIGPLTIPLIDIPAGPGFGNSSTS

SEQ ID NO: 1083120 - protein, 18 aa, Mycobacterium
GTMGLILRGSDELKKQVL

SEQ ID NO: 1083121 - protein, 19 aa, Mycobacterium
GTNLDPLFDVLLEHVPPPQ

SEQ ID NO: 1083122 - protein, 22 aa, Mycobacterium
GTPLWGGWITGPTWLGPEEFAR

SEQ ID NO: 1083123 - protein, 17 aa, Mycobacterium
GTSGLLLGLDGFNAPTS

SEQ ID NO: 1083124 - protein, 17 aa, Mycobacterium
GVDLLPTLLSLLGIDIP

SEQ ID NO: 1083125 - protein, 17 aa, Mycobacterium
GVFVRPAPPIRWLASDR

SEQ ID NO: 1083126 - protein, 23 aa, Mycobacterium
GVGFAYFQMDWPAVTQWLAEARN

SEQ ID NO: 1083127 - protein, 27 aa, Mycobacterium
GVGKVNVKLYWDLKISPITFSDSTISG

SEQ ID NO: 1083128 - protein, 26 aa, Mycobacterium
GVINAPTQALLGRPLIGDGTAGAPGQ

SEQ ID NO: 1083129 - protein, 25 aa, Mycobacterium
GVLNSPTQALLGRPLIRDGAAGAPG

SEQ ID NO: 1083130 - protein, 18 aa, Mycobacterium
GVMQLTHPAFLILDSPDG

SEQ ID NO: 1083131 - protein, 23 aa, Mycobacterium
GVNLTFLPFIARAVIDALKIHPN

SEQ ID NO: 1083132 - protein, 19 aa, Mycobacterium
GVQRFVMISYFGAGPNHGV

SEQ ID NO: 1083133 - protein, 22 aa, Mycobacterium
GVRDWWSMDWMWSALHLDDGTH

SEQ ID NO: 1083134 - protein, 23 aa, Mycobacterium
GVTPPPLPTVWPGSAYPLGATYD

SEQ ID NO: 1083135 - protein, 24 aa, Mycobacterium
GVVNFYGQLLQLLKNRLLLSDLRH

SEQ ID NO: 1083136 - protein, 21 aa, Mycobacterium
GVVRPDLVIGWWAAPTILEHG

SEQ ID NO: 1083137 - protein, 21 aa, Mycobacterium
GVVTTWMKLAVRDRILPDDDS

SEQ ID NO: 1083138 - protein, 17 aa, Mycobacterium
GVYAFEITALQSALSRL

SEQ ID NO: 1083139 - protein, 18 aa, Mycobacterium
GWDPLLQPGLPEPTLAWL

SEQ ID NO: 1083140 - protein, 19 aa, Mycobacterium
GWLLDYWSDRVYPLLWACV

SEQ ID NO: 1083141 - protein, 18 aa, Mycobacterium
GWLTLNWPKEYGGQDRSP

SEQ ID NO: 1083142 - protein, 17 aa, Mycobacterium
GWYGNITVLQWLSPLPG

SEQ ID NO: 1083143 - protein, 25 aa, Mycobacterium
GYEDLAWFCVRAWRFGAPASYGAGG

SEQ ID NO: 1083144 - protein, 22 aa, Mycobacterium
GYGRNFLLPRGMAIVASRGAQK

SEQ ID NO: 1083145 - protein, 20 aa, Mycobacterium
GYPVLVRPSYVLGGRGMEIV

SEQ ID NO: 1083146 - protein, 17 aa, Mycobacterium
GYRLLQRLGADVAEYGF

SEQ ID NO: 1083147 - protein, 19 aa, Mycobacterium
GYSWGPLSLMLLATAIAQQ

SEQ ID NO: 1083148 - protein, 19 aa, Mycobacterium
GYTLGNSLRRTLLSSIPGA

SEQ ID NO: 1083149 - protein, 18 aa, Mycobacterium
GYVLRRLLRRVIRSAKLL

SEQ ID NO: 1083150 - protein, 28 aa, Mycobacterium
HATDDPRPVMLWAYDPLAFNGEGKAAIA

SEQ ID NO: 1083151 - protein, 23 aa, Mycobacterium
HEADAYLGLLLAKAGLDNDAFTA

SEQ ID NO: 1083152 - protein, 17 aa, Mycobacterium
HERFLQTLFGGAAAYTA

SEQ ID NO: 1083153 - protein, 18 aa, Mycobacterium
HGDYRLDNLLFDPDLRRV

SEQ ID NO: 1083154 - protein, 20 aa, Mycobacterium
HGLLLLRHVADLVKTGWPVL

SEQ ID NO: 1083155 - protein, 17 aa, Mycobacterium
HGRAPRLWLVTEGGLVV

SEQ ID NO: 1083156 - protein, 22 aa, Mycobacterium
HGSYIFLGPGFYPGSPSGGSGG

SEQ ID NO: 1083157 - protein, 24 aa, Mycobacterium
HGVLKRILLIYREGIHRLQVGDPA

SEQ ID NO: 1083158 - protein, 23 aa, Mycobacterium
HHELHLWLPHPSAALWRSLADLH

SEQ ID NO: 1083159 - protein, 19 aa, Mycobacterium
HIDKWKFTVPFVCGATNLG

SEQ ID NO: 1083160 - protein, 21 aa, Mycobacterium
HIGAIPFLLKLRSDIPVVGSK

SEQ ID NO: 1083161 - protein, 18 aa, Mycobacterium
HLPWQWGAAWFLDQLTDG

SEQ ID NO: 1083162 - protein, 20 aa, Mycobacterium
HLQGHWLLARLGKRVLRPGG

SEQ ID NO: 1083163 - protein, 24 aa, Mycobacterium
HLVTRWLATFTFFRAALGVAAPRL

SEQ ID NO: 1083164 - protein, 30 aa, Mycobacterium; identical to SEQ ID NO: 227588

SEQ ID NO: 1083165 - protein, 17 aa, Mycobacterium
HPFLFDLQNLRGHGTGV

SEQ ID NO: 1083166 - protein, 17 aa, Mycobacterium
HPRLMPDFWEFPTVSMG

SEQ ID NO: 1083167 - protein, 19 aa, Mycobacterium
HRFLAHLPGYQGWQWAAVV

SEQ ID NO: 1083168 - protein, 29 aa, Mycobacterium
HSDYPLQALLYTVVLHRFLRWRQPGYDPA

SEQ ID NO: 1083169 - protein, 24 aa, Mycobacterium
HSRQLLAAQIIWTLARADIRGPYV

SEQ ID NO: 1083170 - protein, 23 aa, Mycobacterium
HSRRGLLLLVGRRRRLIKYISQI

SEQ ID NO: 1083171 - protein, 22 aa, Mycobacterium
HVNRWFYDCPPAFHRNLGDMYV

SEQ ID NO: 1083172 - protein, 31 aa, Mycobacterium
HVRRRHPGGLGPGRRWRRRWTGRLRRRRLVR

SEQ ID NO: 1083173 - protein, 19 aa, Mycobacterium
IAAFPRYHPRSAWWMTSVP

SEQ ID NO: 1083174 - protein, 28 aa, Mycobacterium
IADFWFDPLCPWCWITSRWILEVEKVRD

SEQ ID NO: 1083175 - protein, 21 aa, Mycobacterium
IADQLARRRLGYGRGARMAFE

SEQ ID NO: 1083176 - protein, 24 aa, Mycobacterium
IAEEYYISFLLDRANRTYLAMCSV

SEQ ID NO: 1083177 - protein, 20 aa, Mycobacterium
IAFTFAIYYLPMPAADPFDT

SEQ ID NO: 1083178 - protein, 19 aa, Mycobacterium
IANRLLPCLPTLLALSASS

SEQ ID NO: 1083179 - protein, 25 aa, Mycobacterium
IASQKYLPRWLSEGLNRLLGGEHVF

SEQ ID NO: 1083180 - protein, 24 aa, Mycobacterium
IASQLIGLAMTRYVWQIEPIASMS

SEQ ID NO: 1083181 - protein, 17 aa, Mycobacterium
IAVPLNFRLTPSEIAFL

SEQ ID NO: 1083182 - protein, 18 aa, Mycobacterium
ICHCWRAPMIAQMAKAHA

SEQ ID NO: 1083183 - protein, 17 aa, Mycobacterium
ICRIRLALRLDLSVRMA

SEQ ID NO: 1083184 - protein, 17 aa, Mycobacterium
IDAVKFTPALTGPQAQL

SEQ ID NO: 1083185 - protein, 25 aa, Mycobacterium
IDHIIGLFRLWWIPEGAAPTEGTYV

SEQ ID NO: 1083186 - protein, 23 aa, Mycobacterium
IDPRTRWLLRELVYALLVKKDHA

SEQ ID NO: 1083187 - protein, 22 aa, Mycobacterium
IDRGYPLFVEYLGILGAEIERV

SEQ ID NO: 1083188 - protein, 23 aa, Mycobacterium
IDTSLPNWWPSILAPIVAGVGAW

SEQ ID NO: 1083189 - protein, 17 aa, Mycobacterium
IDYYLVLANWKLGIVLE

SEQ ID NO: 1083190 - protein, 23 aa, Mycobacterium
IEAAFLEYLEMFYNLGIAGRAMR

SEQ ID NO: 1083191 - protein, 18 aa, Mycobacterium
IENYYLPIAAYEAALRQA

SEQ ID NO: 1083192 - protein, 18 aa, Mycobacterium
IFDAEPDFFWSPINSLED

SEQ ID NO: 1083193 - protein, 26 aa, Mycobacterium
IFDVNLWAPLMWTSLVVKAWMGEHGG

SEQ ID NO: 1083194 - protein, 18 aa, Mycobacterium
IFDYLMMSLRSLSLVMVI

SEQ ID NO: 1083195 - protein, 17 aa, Mycobacterium
IFDYLMVSLRSLPLVML

SEQ ID NO: 1083196 - protein, 18 aa, Mycobacterium
IFNLVWNTLLALGFEWGV

SEQ ID NO: 1083197 - protein, 18 aa, Mycobacterium
IGHPFWFSRRLFGELTQL

SEQ ID NO: 1083198 - protein, 19 aa, Mycobacterium
IGIHFFSPVDKMPLVEIIK

SEQ ID NO: 1083199 - protein, 18 aa, Mycobacterium
IGLPLTRDLISRAGISIA

SEQ ID NO: 1083200 - protein, 17 aa, Mycobacterium
IGTIVINGGVGGAGGSG

SEQ ID NO: 1083201 - protein, 17 aa, Mycobacterium
IGWTCRDVWWAATQDPR

SEQ ID NO: 1083202 - protein, 18 aa, Mycobacterium
IHLVFRGGLRRAGVPSTQ

SEQ ID NO: 1083203 - protein, 17 aa, Mycobacterium
IHRLFDDLEFRVLRDRL

SEQ ID NO: 1083204 - protein, 17 aa, Mycobacterium
ILDIRPFTRGHTLVLPK

SEQ ID NO: 1083205 - protein, 20 aa, Mycobacterium
ILLLNAPWWNPALLARDIAT

SEQ ID NO: 1083206 - protein, 22 aa, Mycobacterium
ILRDYLTDLFPILELGTSAKML

SEQ ID NO: 1083207 - protein, 18 aa, Mycobacterium
ILTVLALRDQVIPPTLNL

SEQ ID NO: 1083208 - protein, 19 aa, Mycobacterium
ILTVLALRDQVIPPTLNLV

SEQ ID NO: 1083209 - protein, 21 aa, Mycobacterium
INNVLAFPGVFRGALDAGARR

SEQ ID NO: 1083210 - protein, 21 aa, Mycobacterium
INRILAYVAPILLGGPVTAVD

SEQ ID NO: 1083211 - protein, 22 aa, Mycobacterium
IPPQADWLDPMIALSFAAASSS

SEQ ID NO: 1083212 - protein, 24 aa, Mycobacterium
IRALYAFKRLAWWPYSVAMRQVNV

SEQ ID NO: 1083213 - protein, 18 aa, Mycobacterium
IRFPELAAYPFVVLDRDH

SEQ ID NO: 1083214 - protein, 18 aa, Mycobacterium
IRKPWWSTPSLWVPDLFM

SEQ ID NO: 1083215 - protein, 17 aa, Mycobacterium
IRMFGLPESGLAATLRS

SEQ ID NO: 1083216 - protein, 24 aa, Mycobacterium
IRSAGAIFVGPWAPVSLGDYCAGS

SEQ ID NO: 1083217 - protein, 17 aa, Mycobacterium
IRVLAIAPSLFLTGLTA

SEQ ID NO: 1083218 - protein, 27 aa, Mycobacterium
ISAQAAAFHDQFLRALTGAGGAYAAAE

SEQ ID NO: 1083219 - protein, 17 aa, Mycobacterium
ISDVWLSNLLAWLTRRA

SEQ ID NO: 1083220 - protein, 29 aa, Mycobacterium
ISGEFSKLVQFILNLVNAPSELLFGRMII

SEQ ID NO: 1083221 - protein, 18 aa, Mycobacterium
ISPWGTWEWMAPAAAGAA

SEQ ID NO: 1083222 - protein, 23 aa, Mycobacterium
ISRPTFYFYFPSKEAVLLTLLDR

SEQ ID NO: 1083223 - protein, 18 aa, Mycobacterium
ISSGPYRFVYRKRFHKKC

SEQ ID NO: 1083224 - protein, 20 aa, Mycobacterium
ITFHEQFVRALSSAGGAYAA

SEQ ID NO: 1083225 - protein, 26 aa, Mycobacterium
ITPFNFPAMIPLWKAGPALACGNAFV

SEQ ID NO: 1083226 - protein, 22 aa, Mycobacterium
ITPWNFPHQINLAKLGPALAAG

SEQ ID NO: 1083227 - protein, 17 aa, Mycobacterium
ITVLQWLSPLPGGSVVK

SEQ ID NO: 1083228 - protein, 22 aa, Mycobacterium
ITYVALRRWLLLRLARRYGKVF

SEQ ID NO: 1083229 - protein, 18 aa, Mycobacterium
IVFLRLRKAARKNGLPVY

SEQ ID NO: 1083230 - protein, 19 aa, Mycobacterium
IVIGGGMCFTFLAAQGYSV

SEQ ID NO: 1083231 - protein, 18 aa, Mycobacterium
IVTWRFWAAKLGISVDDI

SEQ ID NO: 1083232 - protein, 18 aa, Mycobacterium
IVVVLPDFGERYLSTVLF

SEQ ID NO: 1083233 - protein, 20 aa, Mycobacterium
IWIGPRFVIPSLAMRARVRE

SEQ ID NO: 1083234 - protein, 20 aa, Mycobacterium
KAGFDLAMLRAVRAAVTVPV

SEQ ID NO: 1083235 - protein, 21 aa, Mycobacterium
KAGFDLAMLRAVRAAVTVPVI

SEQ ID NO: 1083236 - protein, 21 aa, Mycobacterium
KAHLPADAWPPTSWYADWVSG

SEQ ID NO: 1083237 - protein, 20 aa, Mycobacterium
KAQIYAWRKGIKTLYYIRLR

SEQ ID NO: 1083238 - protein, 17 aa, Mycobacterium
KAVAYLLPFIEAEKAQS

SEQ ID NO: 1083239 - protein, 24 aa, Mycobacterium
KAVGAFRLALPRTMLRFAGGREIT

SEQ ID NO: 1083240 - protein, 17 aa, Mycobacterium
KAWLGTALALKPLLRVE

SEQ ID NO: 1083241 - protein, 20 aa, Mycobacterium
KDACIFLNRPGFAGGTGCAL

SEQ ID NO: 1083242 - protein, 23 aa, Mycobacterium
KDLLPLLEKVIQGGKPLLIIAED

SEQ ID NO: 1083243 - protein, 18 aa, Mycobacterium
KEFLAPRVRALWGGKPGR

SEQ ID NO: 1083244 - protein, 21 aa, Mycobacterium
KEWHQYWIDTRLQWYVDLGID

SEQ ID NO: 1083245 - protein, 27 aa, Mycobacterium
KFDLVGWLPSYLHWYRLAMRGPVLRGT

SEQ ID NO: 1083246 - protein, 18 aa, Mycobacterium
KFFALLRDWTTRYRHGTV

SEQ ID NO: 1083247 - protein, 19 aa, Mycobacterium
KFYELFVAAGFKGKCAIVT

SEQ ID NO: 1083248 - protein, 22 aa, Mycobacterium
KGRILTAMSVFFFGLVDAPNHL

SEQ ID NO: 1083249 - protein, 21 aa, Mycobacterium
KGTLFQWLTEMYPVWGRLDAE

SEQ ID NO: 1083250 - protein, 22 aa, Mycobacterium
KGWRWHTWHLYPLHPGGSGGTV

SEQ ID NO: 1083251 - protein, 23 aa, Mycobacterium
KHLLESWIPLLALFAHAGAHDWS

SEQ ID NO: 1083252 - protein, 23 aa, Mycobacterium
KHVAWYLHGFPAGSDLRRALALV

SEQ ID NO: 1083253 - protein, 23 aa, Mycobacterium
KIDPYLRPLYDALYDMMDPELIA

SEQ ID NO: 1083254 - protein, 20 aa, Mycobacterium
KILPEFTSYRRWCELMWHRA

SEQ ID NO: 1083255 - protein, 23 aa, Mycobacterium
KKEGPLYALFLNCTLKKGPEVSN

SEQ ID NO: 1083256 - protein, 18 aa, Mycobacterium
KKFRWLTVDLPPIIDIRK

SEQ ID NO: 1083257 - protein, 20 aa, Mycobacterium
KLDLKVPRWSIRRMKTKWGS

SEQ ID NO: 1083258 - protein, 23 aa, Mycobacterium
KLLPQEWLRFGWFFLVTRHDPKG

SEQ ID NO: 1083259 - protein, 19 aa, Mycobacterium
KLREFLGTMLNLPTPEQAA

SEQ ID NO: 1083260 - protein, 19 aa, Mycobacterium
KLRIVKYLAYGWSSLRSRP

SEQ ID NO: 1083261 - protein, 25 aa, Mycobacterium
KMLYDNALLLRAYAHWARRTGDELA

SEQ ID NO: 1083262 - protein, 17 aa, Mycobacterium
KNGWLTLNWPKEYGGQD

SEQ ID NO: 1083263 - protein, 19 aa, Mycobacterium
KNLLPLFAVFKPTVVVSVP

SEQ ID NO: 1083264 - protein, 17 aa, Mycobacterium
KPAARVGIWSPNTWHWV

SEQ ID NO: 1083265 - protein, 20 aa, Mycobacterium
KPFFGSLLEFITSAPVVAAI

SEQ ID NO: 1083266 - protein, 21 aa, Mycobacterium
KPLEVVLFHHRPERYEFCVTL

SEQ ID NO: 1083267 - protein, 21 aa, Mycobacterium
KQLLLKIGWPAEDLAGYVNGE

SEQ ID NO: 1083268 - protein, 21 aa, Mycobacterium
KRYMHHYNFPPFSTGETGRVG

SEQ ID NO: 1083269 - protein, 23 aa, Mycobacterium
KSDLRGLFRWWGLYTQREQGYDG

SEQ ID NO: 1083270 - protein, 22 aa, Mycobacterium
KSVVYELLWFLRGDSNVGWLQQ

SEQ ID NO: 1083271 - protein, 23 aa, Mycobacterium
KTPTQVLLRWNLQLGNAVIFGSS

SEQ ID NO: 1083272 - protein, 25 aa, Mycobacterium
KVHEAPAYRWPLVPALALVAAMPAL

SEQ ID NO: 1083273 - protein, 18 aa, Mycobacterium
KVPTVWLLLADDADIPRG

SEQ ID NO: 1083274 - protein, 18 aa, Mycobacterium
KVPVRHFVLFSSISGLIG

SEQ ID NO: 1083275 - protein, 21 aa, Mycobacterium
KVPWTHAILPKRLVFAVAARK

SEQ ID NO: 1083276 - protein, 17 aa, Mycobacterium
KWTIVCYQPPEGMTLNG

SEQ ID NO: 1083277 - protein, 18 aa, Mycobacterium
KYLGVQAGPLWLIAHLSR

SEQ ID NO: 1083278 - protein, 23 aa, Mycobacterium
LADHAVLGVMLFPGTGFLELVIR

SEQ ID NO: 1083279 - protein, 18 aa, Mycobacterium
LADLLLLDDLLGIAAPGA

SEQ ID NO: 1083280 - protein, 23 aa, Mycobacterium
LAEFAALRWQWHDLEVGRTAIVP

SEQ ID NO: 1083281 - protein, 19 aa, Mycobacterium
LAEKDIWWCLQPFLDDEDA

SEQ ID NO: 1083282 - protein, 24 aa, Mycobacterium
LAGKATVLWFSTPWCPKCQQEAPI

SEQ ID NO: 1083283 - protein, 19 aa, Mycobacterium
LALSLLLLSPAALNTLPGL

SEQ ID NO: 1083284 - protein, 20 aa, Mycobacterium
LALTALWRHYGVTPDLVIGH

SEQ ID NO: 1083285 - protein, 25 aa, Mycobacterium
LANRNVFVQLIRTNLFGLNAPAIMA

SEQ ID NO: 1083286 - protein, 26 aa, Mycobacterium
LANYFAGALLLPYRPFLDAAASTRYD

SEQ ID NO: 1083287 - protein, 28 aa, Mycobacterium
LAPHLVKPLPFLFPLTKRGWERPYIAAG

SEQ ID NO: 1083288 - protein, 23 aa, Mycobacterium
LAPVLPLIRRLLIDDAADSGVIV

SEQ ID NO: 1083289 - protein, 17 aa, Mycobacterium
LAPVPWIDHVCAARLLA

SEQ ID NO: 1083290 - protein, 19 aa, Mycobacterium
LARLHTPLPLLAFTAWPEV

SEQ ID NO: 1083291 - protein, 20 aa, Mycobacterium
LASILPSFPALLRKQLKGAP

SEQ ID NO: 1083292 - protein, 20 aa, Mycobacterium
LASLLVAPYFRSAIESAVDS

SEQ ID NO: 1083293 - protein, 19 aa, Mycobacterium
LASLPLKRAVVLRGLLSWP

SEQ ID NO: 1083294 - protein, 24 aa, Mycobacterium
LATMAGYYLGWWDIDRSALAGSSG

SEQ ID NO: 1083295 - protein, 24 aa, Mycobacterium
LAVGHWLRRWWPASQRDDIAGLDR

SEQ ID NO: 1083296 - protein, 25 aa, Mycobacterium
LAVINAPTQALLGRPLIGNGADGTA

SEQ ID NO: 1083297 - protein, 17 aa, Mycobacterium
LAVLILTNLFGQSPTQA

SEQ ID NO: 1083298 - protein, 18 aa, Mycobacterium
LAVYRPLLEPLGLTHPQY

SEQ ID NO: 1083299 - protein, 18 aa, Mycobacterium
LAYARRVMGLPATTVNWG

SEQ ID NO: 1083300 - protein, 17 aa, Mycobacterium
LCFGFHPYLQLPGVPRT

SEQ ID NO: 1083301 - protein, 17 aa, Mycobacterium
LCNYLSTDQDRQLAVRG

SEQ ID NO: 1083302 - protein, 22 aa, Mycobacterium
LCPFDPLIFFRPRVQRLFDFHY

SEQ ID NO: 1083303 - protein, 24 aa, Mycobacterium
LCRRWYPRIYFGQPPKGLAHRALA

SEQ ID NO: 1083304 - protein, 20 aa, Mycobacterium
LCYAGPFFRYERPQAGRYRQ

SEQ ID NO: 1083305 - protein, 18 aa, Mycobacterium
LDADYWYRSIRQTVQFER

SEQ ID NO: 1083306 - protein, 26 aa, Mycobacterium
LDDEAIIAFLRLLLPAGLETTYRSSG

SEQ ID NO: 1083307 - protein, 32 aa, Mycobacterium
LDGWKDLYLPVVRLLEPVLPAGALILADNTES

SEQ ID NO: 1083308 - protein, 20 aa, Mycobacterium
LDGYLYLDCLIGRHARSAKR

SEQ ID NO: 1083309 - protein, 17 aa, Mycobacterium
LDLPDLELIFAPAPFYD

SEQ ID NO: 1083310 - protein, 18 aa, Mycobacterium
LDPRWLLDTLGLTDAART

SEQ ID NO: 1083311 - protein, 17 aa, Mycobacterium
LDRLFPRSIFYSLKLAE

SEQ ID NO: 1083312 - protein, 19 aa, Mycobacterium
LDRNLIGHIPLIGGGLSLL

SEQ ID NO: 1083313 - protein, 19 aa, Mycobacterium
LDTLLRLLHPVIPFITEAL

SEQ ID NO: 1083314 - protein, 18 aa, Mycobacterium
LDVWRRPDLAPGGRAPVL

SEQ ID NO: 1083315 - protein, 23 aa, Mycobacterium
LDYVDLYLIHWPAPAVGKYVDAF

SEQ ID NO: 1083316 - protein, 18 aa, Mycobacterium
LEAFVPLRTHVLVRFGRW

SEQ ID NO: 1083317 - protein, 18 aa, Mycobacterium
LEAPLKQIAFNGGLEPGV

SEQ ID NO: 1083318 - protein, 23 aa, Mycobacterium
LESGRLLRFPGAYSPLVARLVAE

SEQ ID NO: 1083319 - protein, 19 aa, Mycobacterium
LFDPLRAALADYLGLDFLA

SEQ ID NO: 1083320 - protein, 17 aa, Mycobacterium
LFHAVGVVFKGSGFYRT

SEQ ID NO: 1083321 - protein, 18 aa, Mycobacterium
LFIPVDRLTGWAWVPLTT

SEQ ID NO: 1083322 - protein, 17 aa, Mycobacterium
LFPLICRYALAYHVVFI

SEQ ID NO: 1083323 - protein, 19 aa, Mycobacterium
LFTNDYEWDLLLSKTGWSE

SEQ ID NO: 1083324 - protein, 17 aa, Mycobacterium
LFVWRRYHPSRPKGKAL

SEQ ID NO: 1083325 - protein, 17 aa, Mycobacterium
LGADLLAVVARLNRLAT

SEQ ID NO: 1083326 - protein, 19 aa, Mycobacterium
LGGFAWKIALGLPGSLGAP

SEQ ID NO: 1083327 - protein, 18 aa, Mycobacterium
LGGFLTLRWTYCDPPSEL

SEQ ID NO: 1083328 - protein, 18 aa, Mycobacterium
LGGNAWLLGSGGTGGTGG

SEQ ID NO: 1083329 - protein, 17 aa, Mycobacterium
LGGWLWGQAGAAGTGTP

SEQ ID NO: 1083330 - protein, 20 aa, Mycobacterium
LGIDCIWLPPFYDSPLRDGG

SEQ ID NO: 1083331 - protein, 21 aa, Mycobacterium
LGMFPLFQYWGPTANITSSRW

SEQ ID NO: 1083332 - protein, 25 aa, Mycobacterium
LGRPLYLHRILLQRSWIAIFWGRFA

SEQ ID NO: 1083333 - protein, 21 aa, Mycobacterium
LGRVPEWSPAGQPLLLIPDAA

SEQ ID NO: 1083334 - protein, 19 aa, Mycobacterium
LGRWLPEMFGTPGDPKLGA

SEQ ID NO: 1083335 - protein, 22 aa, Mycobacterium
LGYRVRRLAGRVVWLAPPDAPT

SEQ ID NO: 1083336 - protein, 21 aa, Mycobacterium
LHAPLDVLLVRKLGVPLHSEL

SEQ ID NO: 1083337 - protein, 23 aa, Mycobacterium
LHDLYQRWPFFRSVLSNMAQVMA

SEQ ID NO: 1083338 - protein, 20 aa, Mycobacterium
LHLYLRRVMLYRSMFGTPEE

SEQ ID NO: 1083339 - protein, 17 aa, Mycobacterium
LHTTAMPFILRGIALLG

SEQ ID NO: 1083340 - protein, 24 aa, Mycobacterium
LIGKRYRFHPLALSNFLVALEASV

SEQ ID NO: 1083341 - protein, 17 aa, Mycobacterium
LIGRIGWTCRDVWWAAT

SEQ ID NO: 1083342 - protein, 17 aa, Mycobacterium
LIHLATVMWFDGPALGN

SEQ ID NO: 1083343 - protein, 22 aa, Mycobacterium
LINMIPFPSFLADDFTVLDGLL

SEQ ID NO: 1083344 - protein, 19 aa, Mycobacterium
LIRAGYIRPVGPGLYSWLP

SEQ ID NO: 1083345 - protein, 19 aa, Mycobacterium
LIVIPNDRLLQMGDAAVSL

SEQ ID NO: 1083346 - protein, 20 aa, Mycobacterium
LKHRLARSLFLYALCNGWIG

SEQ ID NO: 1083347 - protein, 23 aa, Mycobacterium
LKRTYILHVPPGPPTGLVLNLHG

SEQ ID NO: 1083348 - protein, 21 aa, Mycobacterium
LKRYWYHAWWFYPHSIVRGGI

SEQ ID NO: 1083349 - protein, 24 aa, Mycobacterium
LKSVAAFRLALPRTILRFAGGREI

SEQ ID NO: 1083350 - protein, 25 aa, Mycobacterium
LKSVAAFRLALPRTILRFAGGREIT

SEQ ID NO: 1083351 - protein, 18 aa, Mycobacterium
LKWERFITAVRLLAERLG

SEQ ID NO: 1083352 - protein, 19 aa, Mycobacterium
LLALARRLLLDPAQIGPIR

SEQ ID NO: 1083353 - protein, 17 aa, Mycobacterium
LLALILIVLRRDTGAAG

SEQ ID NO: 1083354 - protein, 22 aa, Mycobacterium
LLARLFGLPYFPVTPLFPLAGP

SEQ ID NO: 1083355 - protein, 17 aa, Mycobacterium
LLASFPYPHVLSLTARL

SEQ ID NO: 1083356 - protein, 25 aa, Mycobacterium
LLAVGDLIIGWRLLVQAGVAHAALA

SEQ ID NO: 1083357 - protein, 26 aa, Mycobacterium
LLCGRMILWHVLFRFSAMYARKVPYR

SEQ ID NO: 1083358 - protein, 23 aa, Mycobacterium
LLDEAWWFPAIQWPDGRMQFMLN

SEQ ID NO: 1083359 - protein, 28 aa, Mycobacterium
LLDLINAPTQALLDRPLIGNGANGAAGT

SEQ ID NO: 1083360 - protein, 30 aa, Mycobacterium
LLGAVNAPTQVLFGRGLIGDGANGTAPGQA

SEQ ID NO: 1083361 - protein, 17 aa, Mycobacterium
LLGLDGFNAPASTSPLH

SEQ ID NO: 1083362 - protein, 18 aa, Mycobacterium
LLGRPLIGNGADGAAPGQ

SEQ ID NO: 1083363 - protein, 19 aa, Mycobacterium
LLKLPIPVQRRVAAGVLSA

SEQ ID NO: 1083364 - protein, 19 aa, Mycobacterium
LLNLLIYIKGYLDGTLTFR

SEQ ID NO: 1083365 - protein, 19 aa, Mycobacterium
LLPCLPTLLALSASSPFWA

SEQ ID NO: 1083366 - protein, 25 aa, Mycobacterium
LLSDGPVVLFFYPAAMTPGCTKEAC

SEQ ID NO: 1083367 - protein, 26 aa, Mycobacterium
LLTPGQRLLVFLPLAHVLARALTLSA

SEQ ID NO: 1083368 - protein, 20 aa, Mycobacterium
LMACLAYTWKQVVTTPLFAE

SEQ ID NO: 1083369 - protein, 25 aa, Mycobacterium
LMDGAFLSVFGVPIQVTLDGRLPEL

SEQ ID NO: 1083370 - protein, 25 aa, Mycobacterium
LMPDKPFFMYFAPGATHAPHHVPKV

SEQ ID NO: 1083371 - protein, 28 aa, Mycobacterium
LMRSRTLMRAPIWIYRARAGAVFGSRML

SEQ ID NO: 1083372 - protein, 17 aa, Mycobacterium
LMTLYPSLSSDQAWAML

SEQ ID NO: 1083373 - protein, 27 aa, Mycobacterium
LNLVNAPTQALLNRPLIGNGANGAAGT

SEQ ID NO: 1083374 - protein, 17 aa, Mycobacterium
LNYYPHLLALSASSPWW

SEQ ID NO: 1083375 - protein, 24 aa, Mycobacterium
LPATHIGGLWWILTCLMRGGLCIT

SEQ ID NO: 1083376 - protein, 22 aa, Mycobacterium
LPEGLGIIGLLIDEPKPLRLED

SEQ ID NO: 1083377 - protein, 19 aa, Mycobacterium
LPEQGAWLQPFRPLSSLLN

SEQ ID NO: 1083378 - protein, 18 aa, Mycobacterium
LPEVAWSWLVEALESRTE

SEQ ID NO: 1083379 - protein, 17 aa, Mycobacterium
LPFAWQGVSLHAAGASR

SEQ ID NO: 1083380 - protein, 18 aa, Mycobacterium
LPIDPEWGPGWHLGVVGL

SEQ ID NO: 1083381 - protein, 18 aa, Mycobacterium
LPLAPMQANLWYLQQLAP

SEQ ID NO: 1083382 - protein, 18 aa, Mycobacterium
LPNVPYFAVAYYGVLRAG

SEQ ID NO: 1083383 - protein, 20 aa, Mycobacterium
LPPAWPPRPEMLPSAPLAPL

SEQ ID NO: 1083384 - protein, 18 aa, Mycobacterium
LPPLEGIYLAAFAGQPVL

SEQ ID NO: 1083385 - protein, 23 aa, Mycobacterium
LPSLGFFVLDGWLRPVPVGVVGE

SEQ ID NO: 1083386 - protein, 21 aa, Mycobacterium
LPTPAVAYLTGAYDADFGVMI

SEQ ID NO: 1083387 - protein, 18 aa, Mycobacterium
LPWPWSLVDFALLPITWA

SEQ ID NO: 1083388 - protein, 18 aa, Mycobacterium
LQHYSVFGLLPIAVGQKS

SEQ ID NO: 1083389 - protein, 35 aa, Mycobacterium
LQSLETDLLGLINPPTMALFGRALIGNGANGAAGT

SEQ ID NO: 1083390 - protein, 21 aa, Mycobacterium
LQVLGMWLMPLRHLAVGDPEP

SEQ ID NO: 1083391 - protein, 18 aa, Mycobacterium
LRAIPWVLAWSQSRVMLP

SEQ ID NO: 1083392 - protein, 17 aa, Mycobacterium
LRALTGAGGAYAAAEAA

SEQ ID NO: 1083393 - protein, 19 aa, Mycobacterium
LRARHFVRWLTIWNDTVDA

SEQ ID NO: 1083394 - protein, 18 aa, Mycobacterium
LRCRRHVRRRHPGGLGPG

SEQ ID NO: 1083395 - protein, 22 aa, Mycobacterium
LRDLLKFDFYFADSAAFRANIA

SEQ ID NO: 1083396 - protein, 17 aa, Mycobacterium
LRFLKFLRESIFPGGEV

SEQ ID NO: 1083397 - protein, 25 aa, Mycobacterium
LRKGERLLVFLPLAHVLARSLSMSA

SEQ ID NO: 1083398 - protein, 17 aa, Mycobacterium
LRKLLPQEWLRFGWFFL

SEQ ID NO: 1083399 - protein, 19 aa, Mycobacterium
LRNEWLFGQSWGIDVAVST

SEQ ID NO: 1083400 - protein, 27 aa, Mycobacterium
LRPVLFSTFLMWVLADLFTYLPEVGDL

SEQ ID NO: 1083401 - protein, 20 aa, Mycobacterium
LRREAPISFWPPIELAGLTA

SEQ ID NO: 1083402 - protein, 19 aa, Mycobacterium
LRRRRLVRATRRHWRRRRV

SEQ ID NO: 1083403 - protein, 20 aa, Mycobacterium
LRSELKMLPALPVAELRAQA

SEQ ID NO: 1083404 - protein, 26 aa, Mycobacterium
LRSWYILYFQLPWLPERWASWVPRLL

SEQ ID NO: 1083405 - protein, 26 aa, Mycobacterium
LRTEKSVMFIIPWGSHWIIGTTDTDW

SEQ ID NO: 1083406 - protein, 20 aa, Mycobacterium
LRVLERLEVVARRLPAAQYA

SEQ ID NO: 1083407 - protein, 23 aa, Mycobacterium
LSADGIAALIRRLPRPLVVVDER

SEQ ID NO: 1083408 - protein, 24 aa, Mycobacterium
LSARMEQFYTDCVRALLTGAGAYS

SEQ ID NO: 1083409 - protein, 24 aa, Mycobacterium
LSEIRHWLMVFAQRFYSFSQFKRS

SEQ ID NO: 1083410 - protein, 25 aa, Mycobacterium
LSEQASAFHLQFVQAMTAGAGAYAG

SEQ ID NO: 1083411 - protein, 24 aa, Mycobacterium
LSEYPYMVPLIDREIRRPTYVFAA

SEQ ID NO: 1083412 - protein, 20 aa, Mycobacterium
LSFERPFDAIVGRYVLTFQA

SEQ ID NO: 1083413 - protein, 21 aa, Mycobacterium
LSIGSFRFWFIGQRWEWSDEV

SEQ ID NO: 1083414 - protein, 17 aa, Mycobacterium
LSLPLLIGFPTAIDGRV

SEQ ID NO: 1083415 - protein, 23 aa, Mycobacterium
LSTPIPITILLTQPPPVAGEDVP

SEQ ID NO: 1083416 - protein, 22 aa, Mycobacterium
LSYFPPSAWSYPPSLPASGTTA

SEQ ID NO: 1083417 - protein, 18 aa, Mycobacterium
LTFAGSLWWRTVQEIGEE

SEQ ID NO: 1083418 - protein, 19 aa, Mycobacterium
LTLTELWRSYGIQPDLVIG

SEQ ID NO: 1083419 - protein, 20 aa, Mycobacterium
LTLTELWRSYGIQPDLVIGH

SEQ ID NO: 1083420 - protein, 23 aa, Mycobacterium
LTMRFLLVELPNERWRFVITAHH

SEQ ID NO: 1083421 - protein, 19 aa, Mycobacterium
LTPLRPWRSALVEALAVSR

SEQ ID NO: 1083422 - protein, 20 aa, Mycobacterium
LTQILAWDLPLTKKISDLLA

SEQ ID NO: 1083423 - protein, 18 aa, Mycobacterium
LTREVLGAGIPLFGICFG

SEQ ID NO: 1083424 - protein, 17 aa, Mycobacterium
LTTLFPPVRPRQWLEIR

SEQ ID NO: 1083425 - protein, 19 aa, Mycobacterium
LTVARKFWDSWAPGAVLAD

SEQ ID NO: 1083426 - protein, 24 aa, Mycobacterium
LTVLRLDWLLAIPDEDWQPVAPAS

SEQ ID NO: 1083427 - protein, 18 aa, Mycobacterium
LTVYWLLGGFLRKRRNIR

SEQ ID NO: 1083428 - protein, 22 aa, Mycobacterium
LVAAVYLRLLRDLPLHTDVNDT

SEQ ID NO: 1083429 - protein, 17 aa, Mycobacterium
LVAIMPWEGHNYEDAII

SEQ ID NO: 1083430 - protein, 17 aa, Mycobacterium
LVAIWNIATTNTGYHDP

SEQ ID NO: 1083431 - protein, 18 aa, Mycobacterium
LVDGALAWFLERGGRTLL

SEQ ID NO: 1083432 - protein, 17 aa, Mycobacterium
LVEYVIMGQVLTAGAGQ

SEQ ID NO: 1083433 - protein, 20 aa, Mycobacterium
LVFHDQFVQMLNAGAGSYAA

SEQ ID NO: 1083434 - protein, 17 aa, Mycobacterium
LVHLPRGFRWLWGQTRC

SEQ ID NO: 1083435 - protein, 21 aa, Mycobacterium
LVHVYLRRALTSTELWPVSLQ

SEQ ID NO: 1083436 - protein, 19 aa, Mycobacterium
LVLFGRLYGLRKSRARQRA

SEQ ID NO: 1083437 - protein, 23 aa, Mycobacterium
LVNAPTQALFGRPLIGNGADGAA

SEQ ID NO: 1083438 - protein, 24 aa, Mycobacterium
LVNPNPMFVPWLVGPLLTGEGIHL

SEQ ID NO: 1083439 - protein, 24 aa, Mycobacterium
LVPEYIGNLLLYFDPHATVTLLDA

SEQ ID NO: 1083440 - protein, 21 aa, Mycobacterium
LVPQHLMRRLFFTAATVDAAT

SEQ ID NO: 1083441 - protein, 18 aa, Mycobacterium
LVRALQRCAWREDTRLSR

SEQ ID NO: 1083442 - protein, 17 aa, Mycobacterium
LVSWLPQYHDFGLIFMA

SEQ ID NO: 1083443 - protein, 17 aa, Mycobacterium
LVSYVRGVLYFRTKRWP

SEQ ID NO: 1083444 - protein, 24 aa, Mycobacterium
LVVVRPIGFEPLQWVRALAAEDPV

SEQ ID NO: 1083445 - protein, 18 aa, Mycobacterium
LWDTILPFAGYAFNKSHA

SEQ ID NO: 1083446 - protein, 28 aa, Mycobacterium
LWHTVPCFPTISELWLRLLEAYRDSFFV

SEQ ID NO: 1083447 - protein, 17 aa, Mycobacterium
LYFRPMLIPISIHLCED

SEQ ID NO: 1083448 - protein, 18 aa, Mycobacterium
LYIQLYLGGFGLELSDIE

SEQ ID NO: 1083449 - protein, 20 aa, Mycobacterium
LYLRDLVMALQWIQDNIAEF

SEQ ID NO: 1083450 - protein, 17 aa, Mycobacterium
LYMIGTFRLAPGQALVL

SEQ ID NO: 1083451 - protein, 22 aa, Mycobacterium
MAHFFYIHFGLPTYFKNVFEGH

SEQ ID NO: 1083452 - protein, 19 aa, Mycobacterium
MAIPFIYPPVTLTSSDGLR

SEQ ID NO: 1083453 - protein, 22 aa, Mycobacterium
MANSIWPYVAWLRATAAATEQS

SEQ ID NO: 1083454 - protein, 24 aa, Mycobacterium
MAPDRPFFAYWAPGATHAPHHVAP

SEQ ID NO: 1083455 - protein, 25 aa, Mycobacterium
MAPVYLYRFDYSTPLLKLLLVRAAH

SEQ ID NO: 1083456 - protein, 25 aa, Mycobacterium
MARFLYWGCDIWLNNPLRPLEACGT

SEQ ID NO: 1083457 - protein, 24 aa, Mycobacterium
MASAAAPYLKWLTTAAAQAGQAAT

SEQ ID NO: 1083458 - protein, 24 aa, Mycobacterium
MAWGVGGWLLTTFLQSAGAEAFVR

SEQ ID NO: 1083459 - protein, 22 aa, Mycobacterium
MAYLVKPFTVSDLVPAIELAVS

SEQ ID NO: 1083460 - protein, 17 aa, Mycobacterium
MCGVEYFGHPWEFGPRK

SEQ ID NO: 1083461 - protein, 23 aa, Mycobacterium
MDDMLWQVPYLPIDPKDVGRTYE

SEQ ID NO: 1083462 - protein, 20 aa, Mycobacterium
MEAAVFPYLAWMNITGMQAE

SEQ ID NO: 1083463 - protein, 23 aa, Mycobacterium
MELLDEVILMLRRLHQPVIAAVN

SEQ ID NO: 1083464 - protein, 24 aa, Mycobacterium
MFGTWHYWWQAHLLDCLIDAELRD

SEQ ID NO: 1083465 - protein, 19 aa, Mycobacterium
MFMDPLPQHPPYPRGQAFV

SEQ ID NO: 1083466 - protein, 22 aa, Mycobacterium
MFQRRVYFLADLPFVEVYLARE

SEQ ID NO: 1083467 - protein, 18 aa, Mycobacterium
MHLLRDKQLWWRVGRKHG

SEQ ID NO: 1083468 - protein, 18 aa, Mycobacterium
MIGTFRLAPGQALVLDFE

SEQ ID NO: 1083469 - protein, 17 aa, Mycobacterium
MIYYPLTTLMMAGIRDI

SEQ ID NO: 1083470 - protein, 23 aa, Mycobacterium
MLKQPLWFQRAQAAALMVADSVR

SEQ ID NO: 1083471 - protein, 17 aa, Mycobacterium
MLLDRLFPRSIFYSLKL

SEQ ID NO: 1083472 - protein, 19 aa, Mycobacterium
MLLDRLFPRSIFYSLKLAE

SEQ ID NO: 1083473 - protein, 19 aa, Mycobacterium
MLLVHFLRDQLRLTGTHWG

SEQ ID NO: 1083474 - protein, 17 aa, Mycobacterium
MLMLALPGAVFLYNGEE

SEQ ID NO: 1083475 - protein, 17 aa, Mycobacterium
MLRVLLYPDQMLDEAWV

SEQ ID NO: 1083476 - protein, 24 aa, Mycobacterium
MLYWQFRGTFIPKTRLTMIAPRAG

SEQ ID NO: 1083477 - protein, 20 aa, Mycobacterium
MPIHMRLPKLKGFRNRFRTE

SEQ ID NO: 1083478 - protein, 23 aa, Mycobacterium
MPWNGPLFKFALFQVASEEFNLF

SEQ ID NO: 1083479 - protein, 19 aa, Mycobacterium
MPYVLKLADLGWQAACLSD

SEQ ID NO: 1083480 - protein, 21 aa, Mycobacterium
MRSKRYFRLLDALDAIAAAYP

SEQ ID NO: 1083481 - protein, 18 aa, Mycobacterium
MSDLRFLKFLRESIFPGG

SEQ ID NO: 1083482 - protein, 26 aa, Mycobacterium
MTGWQRLHFRFGLPAPLLEPLAVERL

SEQ ID NO: 1083483 - protein, 17 aa, Mycobacterium
MTLLPGDLILTGTPAGV

SEQ ID NO: 1083484 - protein, 19 aa, Mycobacterium
MTPWIWPTMHLNPPQWIQP

SEQ ID NO: 1083485 - protein, 23 aa, Mycobacterium
MVFPPWFERFQIKYINPALKPIA

SEQ ID NO: 1083486 - protein, 17 aa, Mycobacterium
MVNHFRFIRDHQKHVKK

SEQ ID NO: 1083487 - protein, 20 aa, Mycobacterium
MVQFVPFFLGQRTPPYATAT

SEQ ID NO: 1083488 - protein, 25 aa, Mycobacterium
MVRDIWRFWYQIPILLPVIGPRVIA

SEQ ID NO: 1083489 - protein, 25 aa, Mycobacterium
NALLDLFLRIIVELFQRHWSSTEHQ

SEQ ID NO: 1083490 - protein, 26 aa, Mycobacterium
NAMWALSIPIPFIKPVGAGAGGYFAP

SEQ ID NO: 1083491 - protein, 22 aa, Mycobacterium
NAPAQALLGRPIIGNGADGAPG

SEQ ID NO: 1083492 - protein, 22 aa, Mycobacterium
NAPAQALLGRPLIGDGAAGTAA

SEQ ID NO: 1083493 - protein, 20 aa, Mycobacterium
NAPFEAAIGRDLIGNGAPGV

SEQ ID NO: 1083494 - protein, 17 aa, Mycobacterium
NAPFQALTDRPLIGNGV

SEQ ID NO: 1083495 - protein, 21 aa, Mycobacterium
NAPTQTLLGRPLIGDGAAGTV

SEQ ID NO: 1083496 - protein, 23 aa, Mycobacterium
NCEIVPWCRFARKNYFYPDMPKN

SEQ ID NO: 1083497 - protein, 18 aa, Mycobacterium
NCLAPGMWPAWWLSNDDP

SEQ ID NO: 1083498 - protein, 17 aa, Mycobacterium
NDLLPFALAGTCQRIEQ

SEQ ID NO: 1083499 - protein, 18 aa, Mycobacterium
NDQLVRLRWPCPVPGAMA

SEQ ID NO: 1083500 - protein, 23 aa, Mycobacterium
NELLKPLPLVPYTPKWLARKMEV

SEQ ID NO: 1083501 - protein, 22 aa, Mycobacterium
NETYLQFYDLLLPTIHRAVEAG

SEQ ID NO: 1083502 - protein, 21 aa, Mycobacterium
NFGLPLSILFGVAGAPVAGLD

SEQ ID NO: 1083503 - protein, 18 aa, Mycobacterium
NFMLIGAAFYRDQYRRTA

SEQ ID NO: 1083504 - protein, 19 aa, Mycobacterium
NFVVYTADKPVWHTDTKGK

SEQ ID NO: 1083505 - protein, 17 aa, Mycobacterium
NGARPFLFTDTVGFVRH

SEQ ID NO: 1083506 - protein, 26 aa, Mycobacterium
NGLPLTLWLARFLKFIQTEIFPGGHP

SEQ ID NO: 1083507 - protein, 22 aa, Mycobacterium
NGMLRQYFPKRTDLPRWSAEEI

SEQ ID NO: 1083508 - protein, 21 aa, Mycobacterium
NGPTQAIFGRPLIGDGAAGTA

SEQ ID NO: 1083509 - protein, 20 aa, Mycobacterium
NILLAALRPAAMLAKTLATM

SEQ ID NO: 1083510 - protein, 25 aa, Mycobacterium
NLAHWPGFLVLYYAALRPLHDDGSL

SEQ ID NO: 1083511 - protein, 18 aa, Mycobacterium
NLDDYPTTPLPPPSPHDL

SEQ ID NO: 1083512 - protein, 21 aa, Mycobacterium
NLGVTLGRRVALAAGAVRAES

SEQ ID NO: 1083513 - protein, 20 aa, Mycobacterium
NLIDRWWQAPASGLAAIIGA

SEQ ID NO: 1083514 - protein, 26 aa, Mycobacterium
NLPITLWPGMKIGQLCILKLTSPSEH

SEQ ID NO: 1083515 - protein, 24 aa, Mycobacterium
NPFAPLLLVLLQFQAGIKIDFRSE

SEQ ID NO: 1083516 - protein, 18 aa, Mycobacterium
NPLRGMPPFSGPEGPFAA

SEQ ID NO: 1083517 - protein, 20 aa, Mycobacterium
NPPMIRYPIPPMIHGATQSA

SEQ ID NO: 1083518 - protein, 22 aa, Mycobacterium
NQTLAHLLKFDSILGRLPQDVS

SEQ ID NO: 1083519 - protein, 23 aa, Mycobacterium
NRAWRLYRRLGFTDILRGYYFAG

SEQ ID NO: 1083520 - protein, 27 aa, Mycobacterium
NRAYTPWYLVRYWRLLKFKLANPHIIT

SEQ ID NO: 1083521 - protein, 21 aa, Mycobacterium
NRGDALAQWLISRQPQLIAAA

SEQ ID NO: 1083522 - protein, 18 aa, Mycobacterium
NRGDPLMFKLGVGQVIQG

SEQ ID NO: 1083523 - protein, 22 aa, Mycobacterium
NRRLVLLPFSWIIFIIHEKALG

SEQ ID NO: 1083524 - protein, 21 aa, Mycobacterium
NSLARWYAVPLQGPYSAAKAA

SEQ ID NO: 1083525 - protein, 24 aa, Mycobacterium
NSSGTFISGFFNAGTFTPGLLETF

SEQ ID NO: 1083526 - protein, 23 aa, Mycobacterium
NSTRARIVLFRKPIERRAKDTIE

SEQ ID NO: 1083527 - protein, 31 aa, Mycobacterium; identical to SEQ ID NO: 886683

SEQ ID NO: 1083528 - protein, 18 aa, Mycobacterium
NVNPIYNWPLPRLAVNIV

SEQ ID NO: 1083529 - protein, 19 aa, Mycobacterium
NVPTPFGLFPPVSPLTVAE

SEQ ID NO: 1083530 - protein, 19 aa, Mycobacterium
NVVVPYFWSDQYDVKIQCL

SEQ ID NO: 1083531 - protein, 23 aa, Mycobacterium
NVYYRRALMLAACFGRSVEYPQR

SEQ ID NO: 1083532 - protein, 19 aa, Mycobacterium
NYDMSMARFLYWGCDIWLN

SEQ ID NO: 1083533 - protein, 22 aa, Mycobacterium
NYSNGLLWRGDYQGLWGIDYAI

SEQ ID NO: 1083534 - protein, 19 aa, Mycobacterium
PAALLYTALLAWGAGRGAT

SEQ ID NO: 1083535 - protein, 23 aa, Mycobacterium
PADLNFLWLPLAHAFGKVMLSLP

SEQ ID NO: 1083536 - protein, 26 aa, Mycobacterium
PADPPFEGMWWLYVPMAFDDFAIVLI

SEQ ID NO: 1083537 - protein, 23 aa, Mycobacterium
PAKYLNRLSDLLFILARAANPDG

SEQ ID NO: 1083538 - protein, 19 aa, Mycobacterium
PAMAINPKDAVNAARDIAT

SEQ ID NO: 1083539 - protein, 19 aa, Mycobacterium
PAQALLGHPIIGTGGSGSQ

SEQ ID NO: 1083540 - protein, 18 aa, Mycobacterium
PAQALLGRPLIGNGANGA

SEQ ID NO: 1083541 - protein, 19 aa, Mycobacterium
PAQTLLGRPLIGNGANGAP

SEQ ID NO: 1083542 - protein, 20 aa, Mycobacterium
PAQVLLRWNLQLGNAVVFRS

SEQ ID NO: 1083543 - protein, 22 aa, Mycobacterium
PASHHLRWLASANALLEIPEDD

SEQ ID NO: 1083544 - protein, 17 aa, Mycobacterium
PASQLLKFAPHPGLGPL

SEQ ID NO: 1083545 - protein, 19 aa, Mycobacterium
PAWLVFDQRYRDRYIFAGL

SEQ ID NO: 1083546 - protein, 23 aa, Mycobacterium
PCVRALLTLLPGSLRWLVTVDAM

SEQ ID NO: 1083547 - protein, 18 aa, Mycobacterium
PDFLSIEIFRPLDLAMVV

SEQ ID NO: 1083548 - protein, 22 aa, Mycobacterium
PDGFTETLTWWQIYRRAKIVAE

SEQ ID NO: 1083549 - protein, 19 aa, Mycobacterium
PDGTPFPTLYYLTHPELTA

SEQ ID NO: 1083550 - protein, 19 aa, Mycobacterium
PDLELIFAPAPFYDEGLPA

SEQ ID NO: 1083551 - protein, 17 aa, Mycobacterium
PDPLPTGPTRRVPLGLI

SEQ ID NO: 1083552 - protein, 24 aa, Mycobacterium
PDSTLVSWLPFYHDMGLVLGVCAP

SEQ ID NO: 1083553 - protein, 25 aa, Mycobacterium
PDVATWLNKPLPPGLARWQRDHGHQ

SEQ ID NO: 1083554 - protein, 17 aa, Mycobacterium
PDVYIRCDAELSPQARA

SEQ ID NO: 1083555 - protein, 17 aa, Mycobacterium
PEDLVGMCLFLLGDQAS

SEQ ID NO: 1083556 - protein, 23 aa, Mycobacterium
PEDRFMLKDPIYGLGPRVAQLFA

SEQ ID NO: 1083557 - protein, 31 aa, Mycobacterium
PEGRGLFFRTLYPALWRFPPIKPFRGAYVLL

SEQ ID NO: 1083558 - protein, 17 aa, Mycobacterium
PENVSPLVVWLASAEAG

SEQ ID NO: 1083559 - protein, 19 aa, Mycobacterium
PEPALRLVAVARLRLLCRA

SEQ ID NO: 1083560 - protein, 21 aa, Mycobacterium
PEPYRLLVGGYRDLVQRIVDR

SEQ ID NO: 1083561 - protein, 25 aa, Mycobacterium
PERVWGWYLWRHYLVADVAPNPGHQ

SEQ ID NO: 1083562 - protein, 17 aa, Mycobacterium
PESLPLLVFPHAGAGAS

SEQ ID NO: 1083563 - protein, 20 aa, Mycobacterium
PEVSLPPWLATNLANWNTIM

SEQ ID NO: 1083564 - protein, 18 aa, Mycobacterium
PFIPLRVPKIFNLRTDPY

SEQ ID NO: 1083565 - protein, 17 aa, Mycobacterium
PFRPFQVNEQLLAAADS

SEQ ID NO: 1083566 - protein, 19 aa, Mycobacterium
PFTYLRPGTVLGTGGKLGA

SEQ ID NO: 1083567 - protein, 17 aa, Mycobacterium
PFYVWDFAERFKEDVID

SEQ ID NO: 1083568 - protein, 24 aa, Mycobacterium
PGAIIRDLNLLRPIYAPTAAYGHF

SEQ ID NO: 1083569 - protein, 18 aa, Mycobacterium
PGASYFVLVFDKAALSGD

SEQ ID NO: 1083570 - protein, 20 aa, Mycobacterium
PGGFLDFPIPIDGLYLGGAG

SEQ ID NO: 1083571 - protein, 19 aa, Mycobacterium
PGMWPAWWLSNDDPGRSGE

SEQ ID NO: 1083572 - protein, 23 aa, Mycobacterium
PGVYTYWYYTQLRFPKKQGMRID

SEQ ID NO: 1083573 - protein, 24 aa, Mycobacterium
PHDVVLFPAWVRFGPLKPSHLDPP

SEQ ID NO: 1083574 - protein, 24 aa, Mycobacterium
PHGRDELWRFTPLKRLRGLHDGSA

SEQ ID NO: 1083575 - protein, 19 aa, Mycobacterium
PHPELLRAWDLPATADGLA

SEQ ID NO: 1083576 - protein, 31 aa, Mycobacterium
PIERFLEWYAPFANFFYDTLGLPFFGAGITS

SEQ ID NO: 1083577 - protein, 17 aa, Mycobacterium
PIIAGNLFRFELLRTRH

SEQ ID NO: 1083578 - protein, 23 aa, Mycobacterium
PILPQQALLYRLCGDRNPLHSDP

SEQ ID NO: 1083579 - protein, 21 aa, Mycobacterium
PIYALPSYFMAAGTPLYAMSS

SEQ ID NO: 1083580 - protein, 23 aa, Mycobacterium
PKETWLRLLLLDDGLPRPQTQIR

SEQ ID NO: 1083581 - protein, 22 aa, Mycobacterium
PKRAGLLVGALYRIAKRRLGEV

SEQ ID NO: 1083582 - protein, 28 aa, Mycobacterium
PKRLGSFMDSRLWRLLLAPGRGIGRLVT

SEQ ID NO: 1083583 - protein, 23 aa, Mycobacterium
PKWPVLPWLPIWEPVPKDPPVPP

SEQ ID NO: 1083584 - protein, 22 aa, Mycobacterium
PLAGLHFFPAPALPAGMLSTLA

SEQ ID NO: 1083585 - protein, 19 aa, Mycobacterium
PLAMAWAHLRILRLADGPD

SEQ ID NO: 1083586 - protein, 21 aa, Mycobacterium
PLGAVAPVTRGAARPAVAPGP

SEQ ID NO: 1083587 - protein, 21 aa, Mycobacterium
PLLPEVAWSWLIEALESRIDH

SEQ ID NO: 1083588 - protein, 22 aa, Mycobacterium
PLLPEVAWSWLIEALESRIDHV

SEQ ID NO: 1083589 - protein, 17 aa, Mycobacterium
PLNFYSLYRAHDLHFIV

SEQ ID NO: 1083590 - protein, 19 aa, Mycobacterium
PLNIPVVIHLPFQGLLVPP

SEQ ID NO: 1083591 - protein, 20 aa, Mycobacterium
PLPDNIGVLNFTPGNIGSLN

SEQ ID NO: 1083592 - protein, 18 aa, Mycobacterium
PLRTHVLVRFGRWQELIA

SEQ ID NO: 1083593 - protein, 18 aa, Mycobacterium
PLTDQVFLKYWKVDPVRA

SEQ ID NO: 1083594 - protein, 21 aa, Mycobacterium
PLVLKPWTMPEPLLPMATEAH

SEQ ID NO: 1083595 - protein, 20 aa, Mycobacterium
PLYLLDFLRQSGETPIVLLH

SEQ ID NO: 1083596 - protein, 19 aa, Mycobacterium
PMFLLYDYSFLPSGATTKA

SEQ ID NO: 1083597 - protein, 17 aa, Mycobacterium
PNFWAWLIGRIKAVDPD

SEQ ID NO: 1083598 - protein, 22 aa, Mycobacterium
PNLVFQLLWYPSCVGDLALPSF

SEQ ID NO: 1083599 - protein, 32 aa, Mycobacterium
PPAPPPIKTPPRPPAPPWPTTPPVAPTVVAAP

SEQ ID NO: 1083600 - protein, 24 aa, Mycobacterium
PPASLVLFSPLIDLTFGLSAARER

SEQ ID NO: 1083601 - protein, 20 aa, Mycobacterium
PPEHLIFIFATTEPEKVLPT

SEQ ID NO: 1083602 - protein, 17 aa, Mycobacterium
PPKLAIPMRVIASVAAI

SEQ ID NO: 1083603 - protein, 20 aa, Mycobacterium
PPTFVLFTTGFLEAGYRRFL

SEQ ID NO: 1083604 - protein, 21 aa, Mycobacterium
PPWLPVVLPAPPSPPAPPCPP

SEQ ID NO: 1083605 - protein, 26 aa, Mycobacterium
PQDLPAKPVWPVPPPAPVPRAPEAPA

SEQ ID NO: 1083606 - protein, 27 aa, Mycobacterium
PQGWVNLHFSLLPAWRGAAPVQAAIAA

SEQ ID NO: 1083607 - protein, 20 aa, Mycobacterium
PQQNMWWWDVLRHGRNSEYA

SEQ ID NO: 1083608 - protein, 20 aa, Mycobacterium
PRAQALALSLLLLSPAALNT

SEQ ID NO: 1083609 - protein, 31 aa, Mycobacterium; identical to SEQ ID NO: 1062637

SEQ ID NO: 1083610 - protein, 29 aa, Mycobacterium
PRELARTVFIELLAWQFASPVRWIETQDL

SEQ ID NO: 1083611 - protein, 21 aa, Mycobacterium
PRPVPARRLPGYLLKFRRGTR

SEQ ID NO: 1083612 - protein, 20 aa, Mycobacterium
PRTWLLVATGLLRLSEATAT

SEQ ID NO: 1083613 - protein, 23 aa, Mycobacterium
PRYILWAAWHRSGLQNRWLAAID

SEQ ID NO: 1083614 - protein, 23 aa, Mycobacterium
PSGQPRLLGFHWTKIHLDDPGLG

SEQ ID NO: 1083615 - protein, 22 aa, Mycobacterium
PSHHYLAAYHWLDAGFGAHAVV

SEQ ID NO: 1083616 - protein, 18 aa, Mycobacterium
PSHKLLIRAGYIRPVGPG

SEQ ID NO: 1083617 - protein, 19 aa, Mycobacterium
PSQMLTGRPLIGNGANGVD

SEQ ID NO: 1083618 - protein, 18 aa, Mycobacterium
PSRAFWRHQLQGLIPCLF

SEQ ID NO: 1083619 - protein, 22 aa, Mycobacterium
PTDTRAYFRGECLRRFGADIAA

SEQ ID NO: 1083620 - protein, 18 aa, Mycobacterium
PTEFLLGRPLIGNGADGT

SEQ ID NO: 1083621 - protein, 24 aa, Mycobacterium
PTEFTLLRYFVINAGTVLSKPKIL

SEQ ID NO: 1083622 - protein, 21 aa, Mycobacterium
PTGSWIFRKCAAWGLGRPDTA

SEQ ID NO: 1083623 - protein, 19 aa, Mycobacterium
PTLIDLYLQGRLPLDKFVS

SEQ ID NO: 1083624 - protein, 18 aa, Mycobacterium
PTMAVLGRPLIGDGVDAA

SEQ ID NO: 1083625 - protein, 18 aa, Mycobacterium
PTNAFVMSFLGAVSALNG

SEQ ID NO: 1083626 - protein, 22 aa, Mycobacterium
PTRLHWYVPPSIRWIDRLKGVS

SEQ ID NO: 1083627 - protein, 21 aa, Mycobacterium
PTRMFTVLFALGRLPGWIAHW

SEQ ID NO: 1083628 - protein, 17 aa, Mycobacterium
PTRVWGVPAAGLWAHRL

SEQ ID NO: 1083629 - protein, 17 aa, Mycobacterium
PTSVPAFRPGAQFKAVV

SEQ ID NO: 1083630 - protein, 18 aa, Mycobacterium
PTTPLPPPSPHDLAYLIY

SEQ ID NO: 1083631 - protein, 21 aa, Mycobacterium
PVEFDRVLGMLDRLASSLQVD

SEQ ID NO: 1083632 - protein, 19 aa, Mycobacterium
PVFNAPFSNFWLTPRQHRD

SEQ ID NO: 1083633 - protein, 19 aa, Mycobacterium
PVIDKDVRRWWRSDSLWQA

SEQ ID NO: 1083634 - protein, 27 aa, Mycobacterium
PVLTTAAIGMFFPGPYRIPKASFSYKT

SEQ ID NO: 1083635 - protein, 21 aa, Mycobacterium
PVNQLIMIKLALNSALLQQGG

SEQ ID NO: 1083636 - protein, 22 aa, Mycobacterium
PVPLWQHVLVGKRLFDLFDYQA

SEQ ID NO: 1083637 - protein, 20 aa, Mycobacterium
PVQFVLLDGWKDLYLPVVRL

SEQ ID NO: 1083638 - protein, 22 aa, Mycobacterium
PVSLLGRYLGLIPKLKPVRTSR

SEQ ID NO: 1083639 - protein, 19 aa, Mycobacterium
PVTNYDVMFVPQGIGADLI

SEQ ID NO: 1083640 - protein, 18 aa, Mycobacterium
PVVIGPVTFLLLSKAVDG

SEQ ID NO: 1083641 - protein, 18 aa, Mycobacterium
PVVRFLARWVGRAGTKIL

SEQ ID NO: 1083642 - protein, 17 aa, Mycobacterium
PVYFALLARRRMDLYGA

SEQ ID NO: 1083643 - protein, 17 aa, Mycobacterium
PVYLSTKNTILKAYDGM

SEQ ID NO: 1083644 - protein, 17 aa, Mycobacterium
PWIMISAFYLKIDGCVG

SEQ ID NO: 1083645 - protein, 18 aa, Mycobacterium
PWLRRVGRWLADHPGGGV

SEQ ID NO: 1083646 - protein, 24 aa, Mycobacterium
PWPSWRTHPLLFPFLHGHSGGILR

SEQ ID NO: 1083647 - protein, 19 aa, Mycobacterium
PYCYAVDLRFLLSPPVGAT

SEQ ID NO: 1083648 - protein, 17 aa, Mycobacterium
PYPVTVGYMYIMKLHHL

SEQ ID NO: 1083649 - protein, 25 aa, Mycobacterium
PYRMASQLGMRPWRVQKAQKQARRW

SEQ ID NO: 1083650 - protein, 23 aa, Mycobacterium
QAAQFHQGLMQLLNSAGGAYAGA

SEQ ID NO: 1083651 - protein, 17 aa, Mycobacterium
QAFLPLLRRAAGRIVVI

SEQ ID NO: 1083652 - protein, 17 aa, Mycobacterium
QAITFHEQFVRALSSAG

SEQ ID NO: 1083653 - protein, 22 aa, Mycobacterium
QALKPWYGYFCKRPCFHDEYLQ

SEQ ID NO: 1083654 - protein, 17 aa, Mycobacterium
QALVFHDQFVQMLNAGA

SEQ ID NO: 1083655 - protein, 24 aa, Mycobacterium
QALYREGFFGLSWPREYGGRELAP

SEQ ID NO: 1083656 - protein, 18 aa, Mycobacterium
QATKFYELFVAAGFKGKC

SEQ ID NO: 1083657 - protein, 23 aa, Mycobacterium
QCRPYWWFLWRLADQARQTIKTA

SEQ ID NO: 1083658 - protein, 26 aa, Mycobacterium
QDAINAPFLQFTGRPLVGPGTDGAPG

SEQ ID NO: 1083659 - protein, 24 aa, Mycobacterium
QEDFIGVHFFSPVDKMPLVEIIKG

SEQ ID NO: 1083660 - protein, 24 aa, Mycobacterium
QEHDLSLWLLRVQALRSAWGTPEV

SEQ ID NO: 1083661 - protein, 22 aa, Mycobacterium
QEVAALLRWLGNGNFLLLGYQP

SEQ ID NO: 1083662 - protein, 20 aa, Mycobacterium
QGALRLLIAQRALLCKGEAL

SEQ ID NO: 1083663 - protein, 17 aa, Mycobacterium
QGFVWGMQRNYSVLVEM

SEQ ID NO: 1083664 - protein, 17 aa, Mycobacterium
QGHLLAPGAPLRRLVEG

SEQ ID NO: 1083665 - protein, 18 aa, Mycobacterium
QGIRLHAPLPAAGKLSVV

SEQ ID NO: 1083666 - protein, 19 aa, Mycobacterium
QGMLSPWLELPGAADQIAS

SEQ ID NO: 1083667 - protein, 22 aa, Mycobacterium
QGQALVFWDCYRPHDVQVKMFQ

SEQ ID NO: 1083668 - protein, 19 aa, Mycobacterium
QGTAIMVWTLMNVKNPKTN

SEQ ID NO: 1083669 - protein, 23 aa, Mycobacterium
QHQMWAAQFIKYEKPRTWLNSGG

SEQ ID NO: 1083670 - protein, 20 aa, Mycobacterium
QIGYSLLFRLASGSLLGPDR

SEQ ID NO: 1083671 - protein, 24 aa, Mycobacterium
QINFFYYLFEPIVQSGLFNTLDWL

SEQ ID NO: 1083672 - protein, 22 aa, Mycobacterium
QIRVQSAWWPVQVPAAQLAAAL

SEQ ID NO: 1083673 - protein, 23 aa, Mycobacterium
QISRTMELPVKMASKAATADTAA

SEQ ID NO: 1083674 - protein, 21 aa, Mycobacterium
QKKFFLPKIAAGDLHFSIGYS

SEQ ID NO: 1083675 - protein, 24 aa, Mycobacterium
QLAEALLLLLCGVGFYAGFVGSYR

SEQ ID NO: 1083676 - protein, 17 aa, Mycobacterium
QLELGGKAPFVVFDDAD

SEQ ID NO: 1083677 - protein, 18 aa, Mycobacterium
QLRPLIGVALQEVALDLW

SEQ ID NO: 1083678 - protein, 19 aa, Mycobacterium
QLRYISVPALVAYAGGDPW

SEQ ID NO: 1083679 - protein, 23 aa, Mycobacterium
QPAQGWMFAAMPLSFLGLNDNSL

SEQ ID NO: 1083680 - protein, 21 aa, Mycobacterium
QPASILILFAPGAPREDYFEG

SEQ ID NO: 1083681 - protein, 18 aa, Mycobacterium
QPHLTAMWYAVVDGEIWL

SEQ ID NO: 1083682 - protein, 25 aa, Mycobacterium
QPLRDIWLLRMRTALAGARGGGGDY

SEQ ID NO: 1083683 - protein, 17 aa, Mycobacterium
QPPAPTLSPRRTTRQLM

SEQ ID NO: 1083684 - protein, 20 aa, Mycobacterium
QPVELPFTGLNFPAGVAVDL

SEQ ID NO: 1083685 - protein, 19 aa, Mycobacterium
QQALHAFRKFGFQLVIVAT

SEQ ID NO: 1083686 - protein, 23 aa, Mycobacterium
QREDIPIHYLLADTFTICDGYFC

SEQ ID NO: 1083687 - protein, 22 aa, Mycobacterium
QREMLRPLRFLLTAPVTALGSS

SEQ ID NO: 1083688 - protein, 22 aa, Mycobacterium
QRFDRELWRKLIDSDILSSAAA

SEQ ID NO: 1083689 - protein, 24 aa, Mycobacterium
QRFGEHFFYILYFQQPGVADAELN

SEQ ID NO: 1083690 - protein, 20 aa, Mycobacterium
QRKLLVPFFVWVTVGLYDPP

SEQ ID NO: 1083691 - protein, 18 aa, Mycobacterium
QRWIDFLHRWDPVHWLQP

SEQ ID NO: 1083692 - protein, 23 aa, Mycobacterium
QSRRYSPWLAYGQSKLANLLFTS

SEQ ID NO: 1083693 - protein, 18 aa, Mycobacterium
QVFFVNWFRRGEDHRFLW

SEQ ID NO: 1083694 - protein, 26 aa, Mycobacterium
QVLERDVLGLVNAPAQALLGRPIIGN

SEQ ID NO: 1083695 - protein, 20 aa, Mycobacterium
QVLLPFWNAYSFLALYAPKV

SEQ ID NO: 1083696 - protein, 20 aa, Mycobacterium
QVPDYLLQVIARFARYLRES

SEQ ID NO: 1083697 - protein, 17 aa, Mycobacterium
QVVLLPEPLPTPIVAFA

SEQ ID NO: 1083698 - protein, 17 aa, Mycobacterium
QWWIDRIKACYPLLYRR

SEQ ID NO: 1083699 - protein, 19 aa, Mycobacterium
RAEIRALFRSSKVGLIAGC

SEQ ID NO: 1083700 - protein, 18 aa, Mycobacterium
RAERINRWRVATAEASYS

SEQ ID NO: 1083701 - protein, 25 aa, Mycobacterium
RAGIPTLILWIWIEQPIWLAQIKRL

SEQ ID NO: 1083702 - protein, 23 aa, Mycobacterium
RAGKLPVTLFTAGGIATPADAAM

SEQ ID NO: 1083703 - protein, 24 aa, Mycobacterium
RAGNLFLSLADRIPFALTAWTVGV

SEQ ID NO: 1083704 - protein, 18 aa, Mycobacterium
RAIIAACPLTWPWNLLGW

SEQ ID NO: 1083705 - protein, 18 aa, Mycobacterium
RAINPVLGFLLRTPLAGS

SEQ ID NO: 1083706 - protein, 24 aa, Mycobacterium
RAKLSPWIPTLKLHYVRVIPTGIT

SEQ ID NO: 1083707 - protein, 20 aa, Mycobacterium
RALAGLWRSLTRKEVFPTQP

SEQ ID NO: 1083708 - protein, 19 aa, Mycobacterium
RALSWLPLYHDMGLILGVL

SEQ ID NO: 1083709 - protein, 26 aa, Mycobacterium
RARHIHDFPALWYVPAAGLVYIAAAG

SEQ ID NO: 1083710 - protein, 19 aa, Mycobacterium
RARLFPRGLAAFIELRDQR

SEQ ID NO: 1083711 - protein, 17 aa, Mycobacterium
RARRRLAALRLLRYRML

SEQ ID NO: 1083712 - protein, 23 aa, Mycobacterium
RATAWRLTGLGLWVIAHDPYCAD

SEQ ID NO: 1083713 - protein, 17 aa, Mycobacterium
RAVFWVPPYHDFGLISG

SEQ ID NO: 1083714 - protein, 21 aa, Mycobacterium
RAVVMTYWNPVLRYGGDAFAR

SEQ ID NO: 1083715 - protein, 17 aa, Mycobacterium
RAWRLPWPDGTVVYELD

SEQ ID NO: 1083716 - protein, 18 aa, Mycobacterium
RAYRLPWPPQTVVYEIDL

SEQ ID NO: 1083717 - protein, 17 aa, Mycobacterium
RDGNFVVYTADKPVWHT

SEQ ID NO: 1083718 - protein, 22 aa, Mycobacterium
RDKIPLVMLLEGAGFRPTGVHY

SEQ ID NO: 1083719 - protein, 17 aa, Mycobacterium
RDLLLDAYLLRAMGIAG

SEQ ID NO: 1083720 - protein, 23 aa, Mycobacterium
RDPWRLDGPWRTPLIAVAHGWCM

SEQ ID NO: 1083721 - protein, 25 aa, Mycobacterium
RDRIHQGWILTALWVIDTGVTAATL

SEQ ID NO: 1083722 - protein, 18 aa, Mycobacterium
RDVLVAGDFWGGAGSVAC

SEQ ID NO: 1083723 - protein, 20 aa, Mycobacterium
RDWQRLCQKWDLASAPLDRQ

SEQ ID NO: 1083724 - protein, 18 aa, Mycobacterium
REALFKVTRWGVKGRFAG

SEQ ID NO: 1083725 - protein, 17 aa, Mycobacterium
REFVRLWEHLLTDGGFA

SEQ ID NO: 1083726 - protein, 19 aa, Mycobacterium
REGQWGAPLLFYLDAGIPP

SEQ ID NO: 1083727 - protein, 18 aa, Mycobacterium
RELPWRRPIASLNYLLSS

SEQ ID NO: 1083728 - protein, 24 aa, Mycobacterium
RERGYAYFLYPPQAPLTETAYDRL

SEQ ID NO: 1083729 - protein, 18 aa, Mycobacterium
RESWLRMVLIDAGLPVPV

SEQ ID NO: 1083730 - protein, 19 aa, Mycobacterium
RFAPFLWQEIEDGILPALY

SEQ ID NO: 1083731 - protein, 19 aa, Mycobacterium
RFHAVYWPAFLMSAGIELP

SEQ ID NO: 1083732 - protein, 18 aa, Mycobacterium
RFIGIPAAFPKLFRSEVD

SEQ ID NO: 1083733 - protein, 20 aa, Mycobacterium
RFLAAFAPFGLRPDALRPGY

SEQ ID NO: 1083734 - protein, 23 aa, Mycobacterium
RFMREVYDLFVAPHYFGDSLFGV

SEQ ID NO: 1083735 - protein, 17 aa, Mycobacterium
RFPFFDYPYIVVLVELD

SEQ ID NO: 1083736 - protein, 19 aa, Mycobacterium
RFRRSIQTILLAALGRTIA

SEQ ID NO: 1083737 - protein, 19 aa, Mycobacterium
RFSAPYLRDSLLAASALCE

SEQ ID NO: 1083738 - protein, 24 aa, Mycobacterium
RFSMNYVFALYALPGPMTISQMGR

SEQ ID NO: 1083739 - protein, 18 aa, Mycobacterium
RFVRLWFTDVLGYLKSVA

SEQ ID NO: 1083740 - protein, 20 aa, Mycobacterium
RGIHVFLRIASDWDFIEVRR

SEQ ID NO: 1083741 - protein, 17 aa, Mycobacterium
RGLFLQPVDGEPGWFHY

SEQ ID NO: 1083742 - protein, 18 aa, Mycobacterium
RGSQFYLAMYWAQELATQ

SEQ ID NO: 1083743 - protein, 19 aa, Mycobacterium
RGSQFYLAMYWAQELATQT

SEQ ID NO: 1083744 - protein, 20 aa, Mycobacterium
RGWRRWVHAVTRINFGLSPD

SEQ ID NO: 1083745 - protein, 19 aa, Mycobacterium
RGYTLRLPLDVLVVASANP

SEQ ID NO: 1083746 - protein, 29 aa, Mycobacterium
RHLPFYGRWYRFLLLWPGADKGLDAARTD

SEQ ID NO: 1083747 - protein, 18 aa, Mycobacterium
RHLSLWWTWTPGASWRHP

SEQ ID NO: 1083748 - protein, 18 aa, Mycobacterium
RHRILQRPAHFQRLLRKS

SEQ ID NO: 1083749 - protein, 19 aa, Mycobacterium
RHWRRRRVRRHRLRNGGIR

SEQ ID NO: 1083750 - protein, 18 aa, Mycobacterium
RIAQTVGWRLWMGVAFGL

SEQ ID NO: 1083751 - protein, 25 aa, Mycobacterium
RIEFKLRDWLFARQRYWGEPFPIVY

SEQ ID NO: 1083752 - protein, 19 aa, Mycobacterium
RIHLLPMLRWKCVESPLGL

SEQ ID NO: 1083753 - protein, 17 aa, Mycobacterium
RIQLMAFAYDGAWAEYT

SEQ ID NO: 1083754 - protein, 19 aa, Mycobacterium
RISTWPWPETFNGITVNGV

SEQ ID NO: 1083755 - protein, 21 aa, Mycobacterium
RITAVIPFYPYARQDKKHRGR

SEQ ID NO: 1083756 - protein, 26 aa, Mycobacterium
RIYCPDWVGLFRWLKPALSTPLGELP

SEQ ID NO: 1083757 - protein, 17 aa, Mycobacterium
RIYVTDISRWREVGDVH

SEQ ID NO: 1083758 - protein, 27 aa, Mycobacterium
RKFLADRVVRWWLPERWAFADQVPRTS

SEQ ID NO: 1083759 - protein, 22 aa, Mycobacterium
RLADAWVWDMYRPARFVKQVRV

SEQ ID NO: 1083760 - protein, 18 aa, Mycobacterium
RLAPLVYLRIDGKMFIVG

SEQ ID NO: 1083761 - protein, 19 aa, Mycobacterium
RLDMPLVDFFSRGGALKSS

SEQ ID NO: 1083762 - protein, 17 aa, Mycobacterium
RLDWPQAALRLRGWPRP

SEQ ID NO: 1083763 - protein, 18 aa, Mycobacterium
RLELFEYIHPPVIESKPM

SEQ ID NO: 1083764 - protein, 17 aa, Mycobacterium
RLFTAPVPALRLPEESM

SEQ ID NO: 1083765 - protein, 24 aa, Mycobacterium
RLGLFPFRRGLTFYYLDLALMSVT

SEQ ID NO: 1083766 - protein, 25 aa, Mycobacterium
RLGLFPFRRGLTFYYLDLALMSVTQ

SEQ ID NO: 1083767 - protein, 19 aa, Mycobacterium
RLGMMLFGPLLNLGLRHFL

SEQ ID NO: 1083768 - protein, 23 aa, Mycobacterium
RLHAKLFYQPLLESIAPAGLEIA

SEQ ID NO: 1083769 - protein, 17 aa, Mycobacterium
RLLEHRLQLQRLKRTHL

SEQ ID NO: 1083770 - protein, 18 aa, Mycobacterium
RLLLPKPADWSYAEAAAI

SEQ ID NO: 1083771 - protein, 20 aa, Mycobacterium
RLLLPLPMFHVAALTTVIMC

SEQ ID NO: 1083772 - protein, 17 aa, Mycobacterium
RLLPLRRLVTRGAIVID

SEQ ID NO: 1083773 - protein, 22 aa, Mycobacterium
RLLTLLLFDIGSFAGLAPLLSS

SEQ ID NO: 1083774 - protein, 23 aa, Mycobacterium
RLPAVTRSLLLYRYRRLLEAQRA

SEQ ID NO: 1083775 - protein, 27 aa, Mycobacterium
RLPGFRPGRAPVKLLEARFGREAMLDQ

SEQ ID NO: 1083776 - protein, 18 aa, Mycobacterium
RLPGLYRLMRIPPEAVDY

SEQ ID NO: 1083777 - protein, 17 aa, Mycobacterium
RLRPPFPAVAGLYGCPT

SEQ ID NO: 1083778 - protein, 20 aa, Mycobacterium
RLRQVWPRYDAMRIELAVGQ

SEQ ID NO: 1083779 - protein, 21 aa, Mycobacterium
RLTLPAKFRDALAGGLMVTKS

SEQ ID NO: 1083780 - protein, 17 aa, Mycobacterium
RLVLTSRQYGIEPQQLF

SEQ ID NO: 1083781 - protein, 18 aa, Mycobacterium
RLVRQIPYTVACDLLLTG

SEQ ID NO: 1083782 - protein, 20 aa, Mycobacterium
RMGELFAPFTKIAAGNPFAA

SEQ ID NO: 1083783 - protein, 17 aa, Mycobacterium
RMWSPDIAVWRVGARRD

SEQ ID NO: 1083784 - protein, 18 aa, Mycobacterium
RNMAFYNFPLRLLKRTWD

SEQ ID NO: 1083785 - protein, 25 aa, Mycobacterium
RNPYAAFFVFSLGWPTSEVPGLYLT

SEQ ID NO: 1083786 - protein, 28 aa, Mycobacterium
RNSQTWRFAPFFHALLDAGVYPPCSAFE

SEQ ID NO: 1083787 - protein, 17 aa, Mycobacterium
RPAIPPLLRGYLRLGAQ

SEQ ID NO: 1083788 - protein, 21 aa, Mycobacterium
RPDGLPVWIYQFKISPHPTIP

SEQ ID NO: 1083789 - protein, 20 aa, Mycobacterium
RPGLVPSPLYDSLLAKVITH

SEQ ID NO: 1083790 - protein, 19 aa, Mycobacterium
RPNLSPRGLRWCRRRWWRL

SEQ ID NO: 1083791 - protein, 19 aa, Mycobacterium
RPRPWYPIPLLLGGSGPRM

SEQ ID NO: 1083792 - protein, 20 aa, Mycobacterium
RPTLYRWFASKEELLATFSR

SEQ ID NO: 1083793 - protein, 21 aa, Mycobacterium
RPVPVRIYRAAPTPAPVVVYC

SEQ ID NO: 1083794 - protein, 22 aa, Mycobacterium
RQAIWPHRMFSLLAGFVEAGES

SEQ ID NO: 1083795 - protein, 29 aa, Mycobacterium
RQKRLMTLIHLWLVHRFKADAVYYVTPTE

SEQ ID NO: 1083796 - protein, 23 aa, Mycobacterium
RQLRYFWPRVVGDIGWQLLDSKF

SEQ ID NO: 1083797 - protein, 19 aa, Mycobacterium
RQLYDLDALPQHLIVVGSG

SEQ ID NO: 1083798 - protein, 24 aa, Mycobacterium
RQNRPLRWLPLEELAKPQALAQVT

SEQ ID NO: 1083799 - protein, 19 aa, Mycobacterium
RQRVLLLPLGPLAEHNMRA

SEQ ID NO: 1083800 - protein, 17 aa, Mycobacterium
RQWPLVNTYWRDLYLAD

SEQ ID NO: 1083801 - protein, 18 aa, Mycobacterium
RQYLFWTWAIYSGRLLHG

SEQ ID NO: 1083802 - protein, 24 aa, Mycobacterium
RRCRLVTERLWPTLLEPLRTRDQA

SEQ ID NO: 1083803 - protein, 24 aa, Mycobacterium
RRDWRQWWYWAPGASWRHPWGPDS

SEQ ID NO: 1083804 - protein, 20 aa, Mycobacterium
RREIGVPTVFNLLGPLTNPA

SEQ ID NO: 1083805 - protein, 22 aa, Mycobacterium
RRHAILRNFPIIGHLRFLLEAV

SEQ ID NO: 1083806 - protein, 17 aa, Mycobacterium
RRLIATLPALEVSRPDW

SEQ ID NO: 1083807 - protein, 19 aa, Mycobacterium
RRLIGLFEMLRDRSQLIII

SEQ ID NO: 1083808 - protein, 17 aa, Mycobacterium
RRPRRLLKWIYHIESRK

SEQ ID NO: 1083809 - protein, 24 aa, Mycobacterium
RRQVLRLWQTALIRLFRLQISDEI

SEQ ID NO: 1083810 - protein, 21 aa, Mycobacterium
RRRVALCKLLLSKPDLLLLDE

SEQ ID NO: 1083811 - protein, 19 aa, Mycobacterium
RRSGMLDKLLLLAGQDERP

SEQ ID NO: 1083812 - protein, 22 aa, Mycobacterium
RRVPIWLPYIRGERTPFHDPDR

SEQ ID NO: 1083813 - protein, 17 aa, Mycobacterium
RRYIIDVALRWMREFHA

SEQ ID NO: 1083814 - protein, 18 aa, Mycobacterium
RRYRTWIRWNAAIMVHRA

SEQ ID NO: 1083815 - protein, 17 aa, Mycobacterium
RSFLLRLGGIRALGFSP

SEQ ID NO: 1083816 - protein, 18 aa, Mycobacterium
RSIWWERAVGVWPDYAEY

SEQ ID NO: 1083817 - protein, 27 aa, Mycobacterium
RSLNIDFLLGYLRELLPRRPDLKLIVT

SEQ ID NO: 1083818 - protein, 19 aa, Mycobacterium
RSLVFPVKRLADLGFRVLA

SEQ ID NO: 1083819 - protein, 18 aa, Mycobacterium
RSPMDPKLYLLWAQANAT

SEQ ID NO: 1083820 - protein, 18 aa, Mycobacterium
RSRFFGKPFFQLAQALLR

SEQ ID NO: 1083821 - protein, 25 aa, Mycobacterium
RSRPLITNMIRLLKLPIPVQRRVAA

SEQ ID NO: 1083822 - protein, 26 aa, Mycobacterium
RSRTHHYPFRLLPRRTMRGLIGRICE

SEQ ID NO: 1083823 - protein, 21 aa, Mycobacterium
RTALWGIHLVFRGGLRRAGVP

SEQ ID NO: 1083824 - protein, 25 aa, Mycobacterium
RTEIDNWRWAGVPVFLRAGKALPER

SEQ ID NO: 1083825 - protein, 29 aa, Mycobacterium
RTIDINYLGPIWLLLGLLPAMRESGRGHV

SEQ ID NO: 1083826 - protein, 18 aa, Mycobacterium
RTRFLLIGVPGPPPPRTG

SEQ ID NO: 1083827 - protein, 24 aa, Mycobacterium
RTRIRPHFFPFTEPSAEVDVWFAN

SEQ ID NO: 1083828 - protein, 24 aa, Mycobacterium
RTRIRPHFFPFTEPSAEVDVWFAS

SEQ ID NO: 1083829 - protein, 19 aa, Mycobacterium
RVFISMKQPLYIAISPDNM

SEQ ID NO: 1083830 - protein, 23 aa, Mycobacterium
RVGWRWRLVWYRAVSELLTGAYD

SEQ ID NO: 1083831 - protein, 18 aa, Mycobacterium
RVPLILRLDPQVGPEDIR

SEQ ID NO: 1083832 - protein, 18 aa, Mycobacterium
RVPTFLLPANPVSALVVF

SEQ ID NO: 1083833 - protein, 20 aa, Mycobacterium
RVPVWFMRQAGRSLPEYRAL

SEQ ID NO: 1083834 - protein, 18 aa, Mycobacterium
RVQIYALIVMIWTSAAAN

SEQ ID NO: 1083835 - protein, 20 aa, Mycobacterium
RVRRHRLRNGGIRRRHRRHR

SEQ ID NO: 1083836 - protein, 24 aa, Mycobacterium
RVSARVYPALVPLSHPLATVNGAF

SEQ ID NO: 1083837 - protein, 27 aa, Mycobacterium
RVVPLDINLPWFMRGPGAVTGTFALES

SEQ ID NO: 1083838 - protein, 17 aa, Mycobacterium
RVWGVPAAGLWAHRLGD

SEQ ID NO: 1083839 - protein, 17 aa, Mycobacterium
RWHHPALVMWYPDQGSE

SEQ ID NO: 1083840 - protein, 18 aa, Mycobacterium
RWVGLYDLLWHPQRLYPP

SEQ ID NO: 1083841 - protein, 20 aa, Mycobacterium
RWWRLTVRTWCRWCFRIFSG

SEQ ID NO: 1083842 - protein, 19 aa, Mycobacterium
RYKLVWKNRLGFARLAIQH

SEQ ID NO: 1083843 - protein, 17 aa, Mycobacterium
RYLHLHPVVTMLALHDE

SEQ ID NO: 1083844 - protein, 18 aa, Mycobacterium
RYLIVNPFFHIFGYKAGC

SEQ ID NO: 1083845 - protein, 17 aa, Mycobacterium
RYLLVINGSLVNPSLRK

SEQ ID NO: 1083846 - protein, 18 aa, Mycobacterium
RYMGWFDGNPARLWQHPP

SEQ ID NO: 1083847 - protein, 18 aa, Mycobacterium
RYNEVIHYWALEGGWECF

SEQ ID NO: 1083848 - protein, 24 aa, Mycobacterium
RYNPDYLPGTLLPPGIRATADAAE

SEQ ID NO: 1083849 - protein, 21 aa, Mycobacterium
RYTWPRFVCGLPREFFAAVRA

SEQ ID NO: 1083850 - protein, 20 aa, Mycobacterium
RYYMLPMLDMWTDVFANPGK

SEQ ID NO: 1083851 - protein, 23 aa, Mycobacterium
SAAALGQVWDATAGPTAVLSDAY

SEQ ID NO: 1083852 - protein, 25 aa, Mycobacterium
SALVVFEVMVRPLIRLSLGKRQPMR

SEQ ID NO: 1083853 - protein, 26 aa, Mycobacterium
SAQMAAFHDRFMNALAGASGSYASAE

SEQ ID NO: 1083854 - protein, 19 aa, Mycobacterium
SASPLAGLLAAINAPVQSL

SEQ ID NO: 1083855 - protein, 23 aa, Mycobacterium
SAVNAPSLALTGRPLIGNGADGG

SEQ ID NO: 1083856 - protein, 19 aa, Mycobacterium
SCFMLPHILPDGTRNRMFL

SEQ ID NO: 1083857 - protein, 28 aa, Mycobacterium
SDADVIRYLRWFTFLLPEELVELEQTTV

SEQ ID NO: 1083858 - protein, 18 aa, Mycobacterium
SDCDQLMPMYLRFVKGVV

SEQ ID NO: 1083859 - protein, 21 aa, Mycobacterium
SDFDAIWWRLDVWNASAQVAN

SEQ ID NO: 1083860 - protein, 25 aa, Mycobacterium
SDLELYLFFSLLFSAGAETTRNAVA

SEQ ID NO: 1083861 - protein, 18 aa, Mycobacterium
SDLIPLCHQLALTGVDVD

SEQ ID NO: 1083862 - protein, 32 aa, Mycobacterium
SDNYAGLIFWDTELWMYPNLLLAHPEIARNII

SEQ ID NO: 1083863 - protein, 18 aa, Mycobacterium
SDRGWLLTSTPLPELRAA

SEQ ID NO: 1083864 - protein, 23 aa, Mycobacterium
SDRLLNLLIYIKGYLDGTLTFRR

SEQ ID NO: 1083865 - protein, 24 aa, Mycobacterium
SDTSLFVRPFLKYQIITVVAPNSP

SEQ ID NO: 1083866 - protein, 23 aa, Mycobacterium
SEQLSMWIWRELATLLPMMMSAV

SEQ ID NO: 1083867 - protein, 23 aa, Mycobacterium
SFASLVFYSSWFKLHHPAAFCAA

SEQ ID NO: 1083868 - protein, 22 aa, Mycobacterium
SFGAPMDVWWFRLPRRPDDPTG

SEQ ID NO: 1083869 - protein, 19 aa, Mycobacterium
SFQIILVDTPGLHRPRTLL

SEQ ID NO: 1083870 - protein, 25 aa, Mycobacterium
SGARRLVIAPWFLAPGLITDRVWKY

SEQ ID NO: 1083871 - protein, 21 aa, Mycobacterium
SGCVLLPGLPYLGLEHRAAWV

SEQ ID NO: 1083872 - protein, 17 aa, Mycobacterium
SGFWHWAVANLPADVTE

SEQ ID NO: 1083873 - protein, 19 aa, Mycobacterium
SGGWLLGNGGAGGAGGVGC

SEQ ID NO: 1083874 - protein, 23 aa, Mycobacterium
SGKTLAAFLWALDSLARCPDRTA

SEQ ID NO: 1083875 - protein, 19 aa, Mycobacterium
SHLAPFLPGHPFAPGLPQG

SEQ ID NO: 1083876 - protein, 18 aa, Mycobacterium
SHPDGYDGGFLYGSGGSG

SEQ ID NO: 1083877 - protein, 18 aa, Mycobacterium
SILPITWAYIRMMGADGL

SEQ ID NO: 1083878 - protein, 19 aa, Mycobacterium
SIRAGYAGLLHQAPTSLSA

SEQ ID NO: 1083879 - protein, 23 aa, Mycobacterium
SKGLQYPVVYLPFAFNRNIQERE

SEQ ID NO: 1083880 - protein, 24 aa, Mycobacterium
SKQAILDALIRRLDEWRSLECIRA

SEQ ID NO: 1083881 - protein, 24 aa, Mycobacterium
SLADPLAFLLRKEGFEATVVTDGP

SEQ ID NO: 1083882 - protein, 23 aa, Mycobacterium
SLADTLWSLRRLGYRSRPLWRPF

SEQ ID NO: 1083883 - protein, 23 aa, Mycobacterium
SLDSPPFYDPWFAKARTSGAIEA

SEQ ID NO: 1083884 - protein, 26 aa, Mycobacterium
SLMDTHPFMWLPMLSRVLGSAQLLPE

SEQ ID NO: 1083885 - protein, 25 aa, Mycobacterium
SLPDDFILYWGFLATAQVLTGRYSF

SEQ ID NO: 1083886 - protein, 24 aa, Mycobacterium
SLRSLPLVMLIGRPEARIPVVSFA

SEQ ID NO: 1083887 - protein, 25 aa, Mycobacterium
SLSHPYLDTVLFLLGVTRGEIEAAD

SEQ ID NO: 1083888 - protein, 24 aa, Mycobacterium
SLVERLVPDFLWISTEHTAQVSLD

SEQ ID NO: 1083889 - protein, 23 aa, Mycobacterium
SMASAFWPYVTWTSMVATQAREA

SEQ ID NO: 1083890 - protein, 24 aa, Mycobacterium
SMDRPGLLALLTRALERAGADIVW

SEQ ID NO: 1083891 - protein, 18 aa, Mycobacterium
SMRTLVWRRWPTTGLAAP

SEQ ID NO: 1083892 - protein, 18 aa, Mycobacterium
SNVFWPAVVFTLVTLLDD

SEQ ID NO: 1083893 - protein, 20 aa, Mycobacterium
SPIVGIWHSGGARLAEGVRA

SEQ ID NO: 1083894 - protein, 20 aa, Mycobacterium
SPRESYLRLFLIDAGLPRPQ

SEQ ID NO: 1083895 - protein, 19 aa, Mycobacterium
SPRGLRWCRRRWWRLTVRT

SEQ ID NO: 1083896 - protein, 22 aa, Mycobacterium
SPRPATVWIAQDGSHRLVRANV

SEQ ID NO: 1083897 - protein, 20 aa, Mycobacterium
SPYAVYLLGGDPGLLAPVRD

SEQ ID NO: 1083898 - protein, 18 aa, Mycobacterium
SQAWNLPVVFGPIAITYN

SEQ ID NO: 1083899 - protein, 19 aa, Mycobacterium
SQAWNLPVVFGPIAITYNV

SEQ ID NO: 1083900 - protein, 18 aa, Mycobacterium
SRELKHLLINDLPIERQA

SEQ ID NO: 1083901 - protein, 25 aa, Mycobacterium
SRGLVIPFWAVGFQNLGWPTGIGIA

SEQ ID NO: 1083902 - protein, 23 aa, Mycobacterium
SRLTFLAVRRWFGWSAGRIINLD

SEQ ID NO: 1083903 - protein, 24 aa, Mycobacterium
SRQRPEIDWFPWLAQQLRGASPGA

SEQ ID NO: 1083904 - protein, 18 aa, Mycobacterium
SRRHAFLASLLGIRHLVL

SEQ ID NO: 1083905 - protein, 22 aa, Mycobacterium
SRRWAGVPFYLRTGKRLGRRVT

SEQ ID NO: 1083906 - protein, 18 aa, Mycobacterium
SRYSYLVSLLPPQIIKDL

SEQ ID NO: 1083907 - protein, 18 aa, Mycobacterium
SSFQLRWAPSLRPEAGVV

SEQ ID NO: 1083908 - protein, 20 aa, Mycobacterium
SSGRGLWELAWPPLSSAGAP

SEQ ID NO: 1083909 - protein, 24 aa, Mycobacterium
SSGRIKLAWFLLNAARYMPAQLYA

SEQ ID NO: 1083910 - protein, 27 aa, Mycobacterium
SSIAKYAMVLLLRRVWTATLGLAGRVA

SEQ ID NO: 1083911 - protein, 24 aa, Mycobacterium
SSLQLLLTFPFPNFGIKQAVRGDY

SEQ ID NO: 1083912 - protein, 18 aa, Mycobacterium
SSQAALFHDQFVQALTTG

SEQ ID NO: 1083913 - protein, 22 aa, Mycobacterium
SSSGWLFVSSWKADADSLRMRP

SEQ ID NO: 1083914 - protein, 26 aa, Mycobacterium
SSYLLNGLFFSLPWYYRSGYDVLLYT

SEQ ID NO: 1083915 - protein, 27 aa, Mycobacterium
STLLESFLFYSGFYLPMYWSSRAKLTN

SEQ ID NO: 1083916 - protein, 23 aa, Mycobacterium
STVYYWMFGGWLRKRRNIRDMTK

SEQ ID NO: 1083917 - protein, 24 aa, Mycobacterium
STWLLPRLVGLARARRMLLLGEQV

SEQ ID NO: 1083918 - protein, 18 aa, Mycobacterium
STYKWETFLTSELPEWLS

SEQ ID NO: 1083919 - protein, 18 aa, Mycobacterium
SVGTPFLLLAGMEPDLKW

SEQ ID NO: 1083920 - protein, 20 aa, Mycobacterium
SVLVPFAWQGVTLHAAGASA

SEQ ID NO: 1083921 - protein, 19 aa, Mycobacterium
SVNAFYHLGWLCVWAVLEA

SEQ ID NO: 1083922 - protein, 19 aa, Mycobacterium
SVPAFRPGAQFKAVVSGAQ

SEQ ID NO: 1083923 - protein, 27 aa, Mycobacterium
SVPHYGIGYGLLRYLYAPTGRVLGAQR

SEQ ID NO: 1083924 - protein, 24 aa, Mycobacterium
SVPMYKLRRYFPPDNRPGQPPVGP

SEQ ID NO: 1083925 - protein, 29 aa, Mycobacterium
SVQAGQFHQWFTQTLSGAGLAYASAEAAN

SEQ ID NO: 1083926 - protein, 17 aa, Mycobacterium
SVVLLGCFVFASGTSST

SEQ ID NO: 1083927 - protein, 17 aa, Mycobacterium
SVWELWGPLLYGGCVVM

SEQ ID NO: 1083928 - protein, 24 aa, Mycobacterium
SWDDYSWPIFKWFELAQSEIHRCW

SEQ ID NO: 1083929 - protein, 18 aa, Mycobacterium
SWFKLHHPAAFCAALLRA

SEQ ID NO: 1083930 - protein, 21 aa, Mycobacterium
SYERGAPVVFPLIGVVPGFQK

SEQ ID NO: 1083931 - protein, 17 aa, Mycobacterium
SYFVLVFDKAALSGDGP

SEQ ID NO: 1083932 - protein, 24 aa, Mycobacterium
TADLDLDWWLTFSSVASLLGAPGQ

SEQ ID NO: 1083933 - protein, 25 aa, Mycobacterium
TAGFNVPYYWWTLNMPTDHGEVELT

SEQ ID NO: 1083934 - protein, 27 aa, Mycobacterium
TAGPGTKLLVLPPLIHGAAQWTVMTAL

SEQ ID NO: 1083935 - protein, 18 aa, Mycobacterium
TAGRISYLLGLRGPAAAI

SEQ ID NO: 1083936 - protein, 18 aa, Mycobacterium
TAMVLGEPFMLPAHIDFA

SEQ ID NO: 1083937 - protein, 19 aa, Mycobacterium
TAQLLPRPIGLIIGLQLSA

SEQ ID NO: 1083938 - protein, 23 aa, Mycobacterium
TAVAILVAIFRARPSPFYIMDEV

SEQ ID NO: 1083939 - protein, 17 aa, Mycobacterium
TAVIPFYPYARQDKKHR

SEQ ID NO: 1083940 - protein, 24 aa, Mycobacterium
TAVNAPAQALFGRPLIGNGSNGTP

SEQ ID NO: 1083941 - protein, 24 aa, Mycobacterium
TDEAPLLATYAFLPIVRAFAEPAG

SEQ ID NO: 1083942 - protein, 18 aa, Mycobacterium
TDKLGMFPLFQYWGPTAN

SEQ ID NO: 1083943 - protein, 19 aa, Mycobacterium
TDPVLAWLYVLDAWEGGLP

SEQ ID NO: 1083944 - protein, 24 aa, Mycobacterium
TDSMPALHLLPLADALGVLPVLAT

SEQ ID NO: 1083945 - protein, 20 aa, Mycobacterium
TDWAQLLEGCGFDRVLVSEH

SEQ ID NO: 1083946 - protein, 19 aa, Mycobacterium
TELPLIVIGVQRGGPSTGL

SEQ ID NO: 1083947 - protein, 17 aa, Mycobacterium
TEPFLDPLVFTGGRLKA

SEQ ID NO: 1083948 - protein, 25 aa, Mycobacterium
TEPTFDIFLWEIFGPLSAGGRLVFP

SEQ ID NO: 1083949 - protein, 18 aa, Mycobacterium
TERGLLLTTLWYIREVDP

SEQ ID NO: 1083950 - protein, 18 aa, Mycobacterium
TERTAWIAEGLLGYLPAE

SEQ ID NO: 1083951 - protein, 19 aa, Mycobacterium
TFPSWPLAHPFRRIAHNGE

SEQ ID NO: 1083952 - protein, 17 aa, Mycobacterium
TGFERFLPLLFAYDLPP

SEQ ID NO: 1083953 - protein, 17 aa, Mycobacterium
TGGWLFGDGGAGGTGGA

SEQ ID NO: 1083954 - protein, 24 aa, Mycobacterium
TGHPRPRRIWLPTSAAVRCWCCLA

SEQ ID NO: 1083955 - protein, 24 aa, Mycobacterium
TGIDPGAVSPWWLQRRLLMCGMRV

SEQ ID NO: 1083956 - protein, 25 aa, Mycobacterium
TGQGALLQLGLLQLALRLAVDNGFI

SEQ ID NO: 1083957 - protein, 23 aa, Mycobacterium
TGRQVFGTLPWHADLWLDSEDAL

SEQ ID NO: 1083958 - protein, 23 aa, Mycobacterium
TGRSWPLADVRLLAPILASKVVC

SEQ ID NO: 1083959 - protein, 24 aa, Mycobacterium
TGSLAALGAMWLARRRRCVDAQQS

SEQ ID NO: 1083960 - protein, 21 aa, Mycobacterium
THDVWRWVIDIDLWGSIHTVE

SEQ ID NO: 1083961 - protein, 21 aa, Mycobacterium
THDYFWRWDTDWFWCSRAFGA

SEQ ID NO: 1083962 - protein, 21 aa, Mycobacterium
TIATLFCGYARDYQNLSTQLA

SEQ ID NO: 1083963 - protein, 18 aa, Mycobacterium
TIIDMWLPLSWSLNMVNR

SEQ ID NO: 1083964 - protein, 18 aa, Mycobacterium
TIMTSLWFQQLQAGDRVS

SEQ ID NO: 1083965 - protein, 23 aa, Mycobacterium
TIRNDLLILLRRLHRRDGVDRIV

SEQ ID NO: 1083966 - protein, 23 aa, Mycobacterium
TITRDLWPAPYLVMNVGANMAPY

SEQ ID NO: 1083967 - protein, 23 aa, Mycobacterium
TKGRLIDYYLAVGGGPMLTALRD

SEQ ID NO: 1083968 - protein, 23 aa, Mycobacterium
TKGSPLAWLLTMAHRRAVDRVRA

SEQ ID NO: 1083969 - protein, 18 aa, Mycobacterium
TKPFLYVFNADESVLTGA

SEQ ID NO: 1083970 - protein, 18 aa, Mycobacterium
TKPKILCNYLSTDQDRQL

SEQ ID NO: 1083971 - protein, 22 aa, Mycobacterium
TKWEKLFRFLALDRLQTRLHRW

SEQ ID NO: 1083972 - protein, 23 aa, Mycobacterium
TLAQQRIWLLDRLNLGGPELCSQ

SEQ ID NO: 1083973 - protein, 30 aa, Mycobacterium; identical to SEQ ID NO: 889459

SEQ ID NO: 1083974 - protein, 17 aa, Mycobacterium
TLLFPFAAPRVVGDLSE

SEQ ID NO: 1083975 - protein, 18 aa, Mycobacterium
TLQNGLLTGIRKLARPQL

SEQ ID NO: 1083976 - protein, 24 aa, Mycobacterium
TLTEFRLFHFLVRHAGQAFTHTRL

SEQ ID NO: 1083977 - protein, 23 aa, Mycobacterium
TLTSRFPIVLWLSPTDLFLMYND

SEQ ID NO: 1083978 - protein, 18 aa, Mycobacterium
TLVSYLNKMLWILTGNFA

SEQ ID NO: 1083979 - protein, 18 aa, Mycobacterium
TMPRRAPALTAPLLVIHG

SEQ ID NO: 1083980 - protein, 24 aa, Mycobacterium
TNLKAWLYRILTNTYINSYRKKQR

SEQ ID NO: 1083981 - protein, 22 aa, Mycobacterium
TNPSPYMYLIQVPNDHGSVEFS

SEQ ID NO: 1083982 - protein, 22 aa, Mycobacterium
TPAQVLLRWNLQLGNAVVFRSA

SEQ ID NO: 1083983 - protein, 24 aa, Mycobacterium
TPGSAWLLPGLFAPSPELPPPPRS

SEQ ID NO: 1083984 - protein, 19 aa, Mycobacterium
TPTQAIFGRPLIGDGANGT

SEQ ID NO: 1083985 - protein, 20 aa, Mycobacterium
TPTQTLLGRPLIGNGADGAL

SEQ ID NO: 1083986 - protein, 29 aa, Mycobacterium
TPYSRMWGAYLSGMWLYRLSFAKAKWHSL

SEQ ID NO: 1083987 - protein, 17 aa, Mycobacterium
TQALLGRALIGNGANGA

SEQ ID NO: 1083988 - protein, 20 aa, Mycobacterium
TQALLGRGLIGDGAAGTASH

SEQ ID NO: 1083989 - protein, 22 aa, Mycobacterium
TQAWDALLPARVFAFTAGASVT

SEQ ID NO: 1083990 - protein, 17 aa, Mycobacterium
TQMAALAAMWRSFDIPP

SEQ ID NO: 1083991 - protein, 19 aa, Mycobacterium
TRRLLRHYVMLALTAMLEA

SEQ ID NO: 1083992 - protein, 25 aa, Mycobacterium
TRVRRAFWLLERFAPALGSRWATEL

SEQ ID NO: 1083993 - protein, 29 aa, Mycobacterium
TSDADVIRYLRWFTFLLPEELVELEQTTV

SEQ ID NO: 1083994 - protein, 26 aa, Mycobacterium
TSQGIAFIPWFPLASGPLAAPDGPLR

SEQ ID NO: 1083995 - protein, 20 aa, Mycobacterium
TTAMPFILRGIALLGMDSVL

SEQ ID NO: 1083996 - protein, 22 aa, Mycobacterium
TTHPLFFNIPTPGPAPADTEES

SEQ ID NO: 1083997 - protein, 23 aa, Mycobacterium
TTIATLFCGYARDYQNLSTQLAS

SEQ ID NO: 1083998 - protein, 24 aa, Mycobacterium
TTLFESFLPRYLTTRVYAAMLESA

SEQ ID NO: 1083999 - protein, 23 aa, Mycobacterium
TTLNLPMDGILVPAGPYTATIPD

SEQ ID NO: 1084000 - protein, 18 aa, Mycobacterium
TTMKPYLAPPLPGAQPAP

SEQ ID NO: 1084001 - protein, 22 aa, Mycobacterium
TTVVSWLPFFHDMGLMFGIIMP

SEQ ID NO: 1084002 - protein, 24 aa, Mycobacterium
TVARWLVLYLRRPCGQTQFAAPVW

SEQ ID NO: 1084003 - protein, 24 aa, Mycobacterium
TVCMAGLWPVWKPNNAAAPLLSAT

SEQ ID NO: 1084004 - protein, 18 aa, Mycobacterium
TVFFERFPLTANGKLDRR

SEQ ID NO: 1084005 - protein, 20 aa, Mycobacterium
TVGAYFPLGWPIACHVQGDA

SEQ ID NO: 1084006 - protein, 17 aa, Mycobacterium
TVIWRKLVLNALAGLMA

SEQ ID NO: 1084007 - protein, 17 aa, Mycobacterium
TVKSFFLRTFDLGIGTS

SEQ ID NO: 1084008 - protein, 18 aa, Mycobacterium
TVPPAPPYYPVRTAAAHI

SEQ ID NO: 1084009 - protein, 17 aa, Mycobacterium
TVYWLLGGFLRKRRNIR

SEQ ID NO: 1084010 - protein, 20 aa, Mycobacterium
TYGHVYLWNRDPSQDIWMAL

SEQ ID NO: 1084011 - protein, 25 aa, Mycobacterium
TYQFNALFLDPYLWKLQLGGKRLVQ

SEQ ID NO: 1084012 - protein, 17 aa, Mycobacterium
TYRKVFPFLLRLYHRIL

SEQ ID NO: 1084013 - protein, 20 aa, Mycobacterium
TYYMIPTEHLPLLAPLRFIP

SEQ ID NO: 1084014 - protein, 23 aa, Mycobacterium
VAAQVVPWQSVLKGLPGLASGLA

SEQ ID NO: 1084015 - protein, 22 aa, Mycobacterium
VADVWRLFDSLHFALRVVIAGQ

SEQ ID NO: 1084016 - protein, 19 aa, Mycobacterium
VANALYWIEQFHIDGLRVD

SEQ ID NO: 1084017 - protein, 18 aa, Mycobacterium
VAQGWLHSFLASPPPRRA

SEQ ID NO: 1084018 - protein, 25 aa, Mycobacterium
VAWNVPLFLAINKLGPAPLAGCTVV

SEQ ID NO: 1084019 - protein, 18 aa, Mycobacterium
VAYLLPFIEAEKAQSGST

SEQ ID NO: 1084020 - protein, 23 aa, Mycobacterium
VDDPPWHPLPFRAVFDAPLCGEI

SEQ ID NO: 1084021 - protein, 18 aa, Mycobacterium
VDGFGILKPLRYAEMLHP

SEQ ID NO: 1084022 - protein, 17 aa, Mycobacterium
VDQLLTIPLAKKLAWAP

SEQ ID NO: 1084023 - protein, 25 aa, Mycobacterium
VDRGAFHWWLVLATLRWGVICQYQA

SEQ ID NO: 1084024 - protein, 26 aa, Mycobacterium
VDRVKTWLQFPQWFYLNIPVNTMVVP

SEQ ID NO: 1084025 - protein, 19 aa, Mycobacterium
VENPKCHIAWTTLAGIGQV

SEQ ID NO: 1084026 - protein, 19 aa, Mycobacterium
VFIGYLRRKLEANGGPRLL

SEQ ID NO: 1084027 - protein, 18 aa, Mycobacterium
VFLQYPWQVLPDELVKPL

SEQ ID NO: 1084028 - protein, 30 aa, Mycobacterium; identical to SEQ ID NO: 889937

SEQ ID NO: 1084029 - protein, 23 aa, Mycobacterium
VFSEEFLLQRPLLTAIRRTEPTV

SEQ ID NO: 1084030 - protein, 17 aa, Mycobacterium
VFSRFRRAVTDTGLYKD

SEQ ID NO: 1084031 - protein, 19 aa, Mycobacterium
VFWVPPYHDFGLISGILSA

SEQ ID NO: 1084032 - protein, 29 aa, Mycobacterium
VGAITPWNFPLLLTLWKVGPAIAAGNSVV

SEQ ID NO: 1084033 - protein, 17 aa, Mycobacterium
VGALYRIAKRRLGEVPE

SEQ ID NO: 1084034 - protein, 17 aa, Mycobacterium
VGAQRHPLLGRLVYYRA

SEQ ID NO: 1084035 - protein, 19 aa, Mycobacterium
VGFKWFVDGLIGGTIGFGG

SEQ ID NO: 1084036 - protein, 24 aa, Mycobacterium
VGGAIMDMLFPPGTQARVPIAALT

SEQ ID NO: 1084037 - protein, 20 aa, Mycobacterium
VGLARYPLPMAPVAAAEQAG

SEQ ID NO: 1084038 - protein, 22 aa, Mycobacterium
VGPGLYSWLPLGLRVLRNIERV

SEQ ID NO: 1084039 - protein, 17 aa, Mycobacterium
VHAGVLLRYVPLTAKRV

SEQ ID NO: 1084040 - protein, 19 aa, Mycobacterium
VHDWGSALGFYRALRYPEQ

SEQ ID NO: 1084041 - protein, 18 aa, Mycobacterium
VHTLLWLDEIRDPDFPVL

SEQ ID NO: 1084042 - protein, 18 aa, Mycobacterium
VIIDYWGIIKANIGIRDG

SEQ ID NO: 1084043 - protein, 27 aa, Mycobacterium
VIISDFLGPINWMRPLRAISARHEVLA

SEQ ID NO: 1084044 - protein, 17 aa, Mycobacterium
VIPFYPYARQDKKHRGR

SEQ ID NO: 1084045 - protein, 17 aa, Mycobacterium
VIVALGGFAWKIALGLP

SEQ ID NO: 1084046 - protein, 17 aa, Mycobacterium
VKLLYRLERPLFFAFQC

SEQ ID NO: 1084047 - protein, 24 aa, Mycobacterium
VLAEWFLRRISLLDSLYMVPSPLI

SEQ ID NO: 1084048 - protein, 23 aa, Mycobacterium
VLATQTLPLWPFKTMAVNVDGQL

SEQ ID NO: 1084049 - protein, 31 aa, Mycobacterium
VLAVINAPTNALLGRPLIGNGTDGLAGTGAA

SEQ ID NO: 1084050 - protein, 18 aa, Mycobacterium
VLGFLLRTPLAGSLGNQL

SEQ ID NO: 1084051 - protein, 20 aa, Mycobacterium
VLIDLIRRYAPKIALIVTSH

SEQ ID NO: 1084052 - protein, 26 aa, Mycobacterium
VLIIGAWNYPFYLTLGPAVGAIAAGN

SEQ ID NO: 1084053 - protein, 17 aa, Mycobacterium
VLKILALQFIMSDPRHL

SEQ ID NO: 1084054 - protein, 26 aa, Mycobacterium
VNLGTFVAVAPWWHPIRLAHQMAYLD

SEQ ID NO: 1084055 - protein, 24 aa, Mycobacterium
VNVDGFWMLQALLDIRHVAPELRC

SEQ ID NO: 1084056 - protein, 21 aa, Mycobacterium
VPAALLCWGVSQFDADMRPDQ

SEQ ID NO: 1084057 - protein, 24 aa, Mycobacterium
VPAFSGLFAPYWRSDARGAIVGLS

SEQ ID NO: 1084058 - protein, 23 aa, Mycobacterium
VPMYKLRRYFPPGNRPGQPLLGA

SEQ ID NO: 1084059 - protein, 24 aa, Mycobacterium
VPMYKLRRYFPPGNRPGQPLLGAP

SEQ ID NO: 1084060 - protein, 17 aa, Mycobacterium
VPPLMVFVNRAQACLLI

SEQ ID NO: 1084061 - protein, 24 aa, Mycobacterium
VPVMLRPVVLAKLMDGRITVMVTG

SEQ ID NO: 1084062 - protein, 23 aa, Mycobacterium
VPWNVPQFLIMPKLIPALIAGCT

SEQ ID NO: 1084063 - protein, 18 aa, Mycobacterium
VQLTTYLRRRPAPGWMRV

SEQ ID NO: 1084064 - protein, 17 aa, Mycobacterium
VQRIPGMRAKLFDAARL

SEQ ID NO: 1084065 - protein, 17 aa, Mycobacterium
VQRPHPPIWFGGRAPKA

SEQ ID NO: 1084066 - protein, 22 aa, Mycobacterium
VQRVFFGWAQVWRTKSRDAEAI

SEQ ID NO: 1084067 - protein, 17 aa, Mycobacterium
VQTPYRYFPIEPHWLFP

SEQ ID NO: 1084068 - protein, 27 aa, Mycobacterium
VRATRIEFWAFDLLFLDGRSLLRARYR

SEQ ID NO: 1084069 - protein, 18 aa, Mycobacterium
VRATRRHWRRRRVRRHRL

SEQ ID NO: 1084070 - protein, 20 aa, Mycobacterium
VRGVLYFRTKRWPDVLAQFP

SEQ ID NO: 1084071 - protein, 19 aa, Mycobacterium
VRRGLWLTGGRRPWVALKL

SEQ ID NO: 1084072 - protein, 23 aa, Mycobacterium
VRTGLQVAPFCDLVLDVAGAQVF

SEQ ID NO: 1084073 - protein, 17 aa, Mycobacterium
VRVLEQMWLNALWGGPI

SEQ ID NO: 1084074 - protein, 24 aa, Mycobacterium
VRYIDRFLMYYVRTADRLQRTAPW

SEQ ID NO: 1084075 - protein, 24 aa, Mycobacterium
VSEIELLPITKFFPATDVAILARL

SEQ ID NO: 1084076 - protein, 20 aa, Mycobacterium
VSFEVFIRPALRLAMGLPDP

SEQ ID NO: 1084077 - protein, 23 aa, Mycobacterium
VSWLPLFHDMGMIGFLTVPMYFA

SEQ ID NO: 1084078 - protein, 22 aa, Mycobacterium
VTEPVVHYLLQASGLVNRTPPA

SEQ ID NO: 1084079 - protein, 28 aa, Mycobacterium
VTPRAPALLISRLVSWVDDLWCRAIGAA

SEQ ID NO: 1084080 - protein, 19 aa, Mycobacterium
VTPVMLLLWIRGVRFMYTV

SEQ ID NO: 1084081 - protein, 18 aa, Mycobacterium
VTTLPAYNLKLFLDGILQ

SEQ ID NO: 1084082 - protein, 18 aa, Mycobacterium
VTVALVVPLFEWYRQLLP

SEQ ID NO: 1084083 - protein, 22 aa, Mycobacterium
VVAPEAFFQFPTSKYGLALDNW

SEQ ID NO: 1084084 - protein, 21 aa, Mycobacterium
VVDPVINAPFEAAIGRDLIGN

SEQ ID NO: 1084085 - protein, 30 aa, Mycobacterium; identical to SEQ ID NO: 134875

SEQ ID NO: 1084086 - protein, 29 aa, Mycobacterium
VVGQIIPWNFPLLMATWKLAPALAAGNAV

SEQ ID NO: 1084087 - protein, 27 aa, Mycobacterium
VVLAVMPWNFPLWQAGRFAAPALMAGN

SEQ ID NO: 1084088 - protein, 17 aa, Mycobacterium
VVLLTFGTGIGSAVIND

SEQ ID NO: 1084089 - protein, 18 aa, Mycobacterium
VVPLFEWYRQLLPDRLHQ

SEQ ID NO: 1084090 - protein, 18 aa, Mycobacterium
VVRVVLSLMYWPAESEDV

SEQ ID NO: 1084091 - protein, 19 aa, Mycobacterium
VVSILTPWNFPHSLNVMKL

SEQ ID NO: 1084092 - protein, 23 aa, Mycobacterium
VVSIPTMILFKDGEPVKRIVGAK

SEQ ID NO: 1084093 - protein, 22 aa, Mycobacterium
VVSWLPLFHDMGMMGLLIIPMY

SEQ ID NO: 1084094 - protein, 18 aa, Mycobacterium
VVTPFLLPDIPVVAWWPD

SEQ ID NO: 1084095 - protein, 19 aa, Mycobacterium
VWALHQYLVGLRRRYPWLH

SEQ ID NO: 1084096 - protein, 21 aa, Mycobacterium
VWLRPFRNLVYAMPPYICAPD

SEQ ID NO: 1084097 - protein, 21 aa, Mycobacterium
VYDQLPAYALPLFVRLVQAMA

SEQ ID NO: 1084098 - protein, 18 aa, Mycobacterium
VYERLWRPAAFYLASGVT

SEQ ID NO: 1084099 - protein, 17 aa, Mycobacterium
VYRFVLRAYAAQLVQNH

SEQ ID NO: 1084100 - protein, 17 aa, Mycobacterium
WALIHGFVMLELAGFFG

SEQ ID NO: 1084101 - protein, 23 aa, Mycobacterium
WCISRQLWWGHRIPIWYGPDGEK

SEQ ID NO: 1084102 - protein, 18 aa, Mycobacterium
WCKLFPPGTLPQAVPGSP

SEQ ID NO: 1084103 - protein, 19 aa, Mycobacterium
WDLLPGYLIFRSIIPNRPP

SEQ ID NO: 1084104 - protein, 17 aa, Mycobacterium
WDRRPGWFRKVAGLATG

SEQ ID NO: 1084105 - protein, 18 aa, Mycobacterium
WEQKLDLKVPRWSIRRMK

SEQ ID NO: 1084106 - protein, 17 aa, Mycobacterium
WFVLTHLLGKPGVRNYD

SEQ ID NO: 1084107 - protein, 18 aa, Mycobacterium
WIYQLDWPTRPLTSEPGA

SEQ ID NO: 1084108 - protein, 19 aa, Mycobacterium
WIYQLDWPTRPLTSEPGAT

SEQ ID NO: 1084109 - protein, 22 aa, Mycobacterium
WKCWARWRLIRARAPWLTSDLV

SEQ ID NO: 1084110 - protein, 25 aa, Mycobacterium
WKDGEALFLRCNIWREAAENVAESL

SEQ ID NO: 1084111 - protein, 20 aa, Mycobacterium
WKYLMALFNSKIDEHADPKV

SEQ ID NO: 1084112 - protein, 17 aa, Mycobacterium
WLHGYLRDLIALRRSQP

SEQ ID NO: 1084113 - protein, 18 aa, Mycobacterium
WLRAFGAPNPRFLQRMIL

SEQ ID NO: 1084114 - protein, 19 aa, Mycobacterium
WLRELWGGPFMLKGVMRVD

SEQ ID NO: 1084115 - protein, 19 aa, Mycobacterium
WLRTMFAIMPLPVGTRDQD

SEQ ID NO: 1084116 - protein, 19 aa, Mycobacterium
WLTSWSKPGLIPVALVIVN

SEQ ID NO: 1084117 - protein, 17 aa, Mycobacterium
WMPFGRVFETLAWGRRH

SEQ ID NO: 1084118 - protein, 17 aa, Mycobacterium
WNLPVVFGPIAVTYNIS

SEQ ID NO: 1084119 - protein, 17 aa, Mycobacterium
WNYPLQMAVWKVMPALA

SEQ ID NO: 1084120 - protein, 19 aa, Mycobacterium
WPLGWGFDHFWGFPSGAAG

SEQ ID NO: 1084121 - protein, 17 aa, Mycobacterium
WQRLLFDNGWLLPGQSP

SEQ ID NO: 1084122 - protein, 19 aa, Mycobacterium
WQRSWALACQKAFAGLEVD

SEQ ID NO: 1084123 - protein, 20 aa, Mycobacterium
WRHQLQGLIPCLFPATRSGT

SEQ ID NO: 1084124 - protein, 17 aa, Mycobacterium
WRISLPAMVCYWSELAR

SEQ ID NO: 1084125 - protein, 23 aa, Mycobacterium
WSAWLVGAWWPAPPEASAAGVTY

SEQ ID NO: 1084126 - protein, 23 aa, Mycobacterium
WSLFTRLMPILPTTETSSGAGMA

SEQ ID NO: 1084127 - protein, 25 aa, Mycobacterium
WSPAGQPLLLIPDAAAALFAARANP

SEQ ID NO: 1084128 - protein, 22 aa, Mycobacterium
WSYGWSLMRIGALLRRSDMSLL

SEQ ID NO: 1084129 - protein, 18 aa, Mycobacterium
WTTLGQYADWIFCLVRTD

SEQ ID NO: 1084130 - protein, 21 aa, Mycobacterium
WVDANVWRRVIPKSWFYNIII

SEQ ID NO: 1084131 - protein, 22 aa, Mycobacterium
WVDANVWRRVIPKSWFYNIIIT

SEQ ID NO: 1084132 - protein, 20 aa, Mycobacterium
WVILRAIDALLLMPLPNRLD

SEQ ID NO: 1084133 - protein, 21 aa, Mycobacterium
WVVPKFYWTVLGVSAFLAGRQ

SEQ ID NO: 1084134 - protein, 17 aa, Mycobacterium
WWEWAATYERAFTAAYD

SEQ ID NO: 1084135 - protein, 19 aa, Mycobacterium
WWHPIRLAHQMAYLDIISN

SEQ ID NO: 1084136 - protein, 17 aa, Mycobacterium
YADWIFCLVRTDPQAPK

SEQ ID NO: 1084137 - protein, 20 aa, Mycobacterium
YAEGLRALYLYTATFQDAAV

SEQ ID NO: 1084138 - protein, 24 aa, Mycobacterium
YAFQRQRFWLPRAPTGSVDPAGLG

SEQ ID NO: 1084139 - protein, 18 aa, Mycobacterium
YAKTWRTLAKLSLPNKYL

SEQ ID NO: 1084140 - protein, 23 aa, Mycobacterium
YAPNRTGWLYPFASELVTPAEAR

SEQ ID NO: 1084141 - protein, 22 aa, Mycobacterium
YAPQRWKYLTSGLLGLQRGTDA

SEQ ID NO: 1084142 - protein, 18 aa, Mycobacterium
YCFQIDLTWRTVNNGFVI

SEQ ID NO: 1084143 - protein, 19 aa, Mycobacterium
YDDARLLVHAIRRVWKLTE

SEQ ID NO: 1084144 - protein, 20 aa, Mycobacterium
YDGFTFLTLAWLEALGICAD

SEQ ID NO: 1084145 - protein, 19 aa, Mycobacterium
YDILFFWVARMMMFGTFVG

SEQ ID NO: 1084146 - protein, 17 aa, Mycobacterium
YDRPMHHILLTGGTGYL

SEQ ID NO: 1084147 - protein, 21 aa, Mycobacterium
YDSIDPLWWGWRNHMKIFFNN

SEQ ID NO: 1084148 - protein, 17 aa, Mycobacterium
YEPAPRSPALGAGVPAP

SEQ ID NO: 1084149 - protein, 24 aa, Mycobacterium
YEPDIWWDTFRLPPYRRYTLRTYF

SEQ ID NO: 1084150 - protein, 24 aa, Mycobacterium
YGGTYNLFHYSLAKLGIEVSFVDD

SEQ ID NO: 1084151 - protein, 29 aa, Mycobacterium
YGYSYKVLGIKFNYPFNYSFDIPAITIPS

SEQ ID NO: 1084152 - protein, 22 aa, Mycobacterium
YHDLRIIDNVRYFAALYGYNRQ

SEQ ID NO: 1084153 - protein, 21 aa, Mycobacterium
YIPIIGAPWLADLVRRSPWAE

SEQ ID NO: 1084154 - protein, 24 aa, Mycobacterium
YLAFDLIHRLWLDLGHEVRYVQNV

SEQ ID NO: 1084155 - protein, 20 aa, Mycobacterium
YLCRTLPWPAYLTEAFQNLG

SEQ ID NO: 1084156 - protein, 20 aa, Mycobacterium
YLGFTQWALLQDPPPELAAA

SEQ ID NO: 1084157 - protein, 18 aa, Mycobacterium
YLGLLRFLFGLDLIDRVV

SEQ ID NO: 1084158 - protein, 17 aa, Mycobacterium
YLKPLLEGKIRSAFAIT

SEQ ID NO: 1084159 - protein, 18 aa, Mycobacterium
YLRLFLIDAGLPRPQTQL

SEQ ID NO: 1084160 - protein, 19 aa, Mycobacterium
YLSTSLFAFWIVDSAYSLD

SEQ ID NO: 1084161 - protein, 18 aa, Mycobacterium
YLTSGLLGLQRGTDAGDL

SEQ ID NO: 1084162 - protein, 18 aa, Mycobacterium
YMAARGIGFLGWNTRFRG

SEQ ID NO: 1084163 - protein, 17 aa, Mycobacterium
YMWEHDLADWHWGITGT

SEQ ID NO: 1084164 - protein, 22 aa, Mycobacterium
YPLRKVHLALVLWFPDDATDGN

SEQ ID NO: 1084165 - protein, 24 aa, Mycobacterium
YPRGNLAFRWFLADGVPARPEVKL

SEQ ID NO: 1084166 - protein, 18 aa, Mycobacterium
YRFVYRKRFHKKCETQLT

SEQ ID NO: 1084167 - protein, 25 aa, Mycobacterium
YRGAKNVLLVFFPLAFTGICQGELD

SEQ ID NO: 1084168 - protein, 25 aa, Mycobacterium
YRGHIFWDELFIFPVLNLRLPAVTR

SEQ ID NO: 1084169 - protein, 18 aa, Mycobacterium
YRLAWWPTRLPTLIVSGA

SEQ ID NO: 1084170 - protein, 17 aa, Mycobacterium
YRLPSYYRWLLYEADHR

SEQ ID NO: 1084171 - protein, 17 aa, Mycobacterium
YRRLRAKARIKFLVKDW

SEQ ID NO: 1084172 - protein, 18 aa, Mycobacterium
YRYFPIEPHWLFPGVQWL

SEQ ID NO: 1084173 - protein, 17 aa, Mycobacterium
YTLGNSLRRTLLSSIPG

SEQ ID NO: 1084174 - protein, 22 aa, Mycobacterium
YVDAHVPYLTWLTKTSADYAVT

SEQ ID NO: 1084175 - protein, 23 aa, Mycobacterium
YVHPEIEFFLLNPGPEDGTEPVP

SEQ ID NO: 1084176 - protein, 23 aa, Mycobacterium
YVTTKEPWFLDAYRRAWEWADST

SEQ ID NO: 1084177 - protein, 17 aa, Mycobacterium
YWMTPTQVRWRPFQFWP

SEQ ID NO: 1084178 - protein, 23 aa, Mycobacterium
YYAMTGWRLGWLLVPTELRRAVD

SEQ ID NO: 1084179 - protein, 29 aa, Mycobacterium
YYDKAGLWPYLEKLGFFLVGYGCTTCIGN

SEQ ID NO: 1084180 - protein, 17 aa, Mycobacterium
YYGRWLRFVTWWPIADG

SEQ ID NO: 1084181 - protein, 4 aa, Mycobacterium
ADNI

SEQ ID NO: 1084182 - protein, 5 aa, Mycobacterium
AKATA

SEQ ID NO: 1084183 - protein, 10 aa, Mycobacterium
DDEGSCETAG

SEQ ID NO: 1084184 - protein, 6 aa, Mycobacterium
EKSNEI

SEQ ID NO: 1084185 - protein, 18 aa, Mycobacterium
GGGVGGRGQTVRLLMLVV

SEQ ID NO: 1084186 - protein, 24 aa, Mycobacterium
SHGPCSTCSSSPPPTLLPRPAWTP

SEQ ID NO: 1084187 - protein, 4 aa, Mycobacterium
AGEL

SEQ ID NO: 1084188 - protein, 7 aa, Mycobacterium
AGSDSPL

SEQ ID NO: 1084189 - protein, 6 aa, Mycobacterium
ARRARQ

SEQ ID NO: 1084190 - protein, 10 aa, Mycobacterium
ASSANLGPGF

SEQ ID NO: 1084191 - protein, 6 aa, Mycobacterium
ATDQRS

SEQ ID NO: 1084192 - protein, 5 aa, Mycobacterium
CEAGG

SEQ ID NO: 1084193 - protein, 8 aa, Mycobacterium
DASASSQF

SEQ ID NO: 1084194 - protein, 8 aa, Mycobacterium
DEEGGRVS

SEQ ID NO: 1084195 - protein, 13 aa, Mycobacterium
DKARSRATGGSGL

SEQ ID NO: 1084196 - protein, 4 aa, Mycobacterium
DNPN

SEQ ID NO: 1084197 - protein, 6 aa, Mycobacterium
ESSERE

SEQ ID NO: 1084198 - protein, 7 aa, Mycobacterium
GPGPTFD

SEQ ID NO: 1084199 - protein, 6 aa, Mycobacterium
GSLTTQ

SEQ ID NO: 1084200 - protein, 7 aa, Mycobacterium
ITRTTTK

SEQ ID NO: 1084201 - protein, 6 aa, Mycobacterium
KGPDLA

SEQ ID NO: 1084202 - protein, 4 aa, Mycobacterium
LASG

SEQ ID NO: 1084203 - protein, 8 aa, Mycobacterium
LGTSGGKN

SEQ ID NO: 1084204 - protein, 8 aa, Mycobacterium
LRADPRNQ

SEQ ID NO: 1084205 - protein, 15 aa, Mycobacterium
PAAATDDSRGHGRVK

SEQ ID NO: 1084206 - protein, 8 aa, Mycobacterium
PGEAAAAR

SEQ ID NO: 1084207 - protein, 4 aa, Mycobacterium
PTDR

SEQ ID NO: 1084208 - protein, 11 aa, Mycobacterium
QAEGTDNAHEA

SEQ ID NO: 1084209 - protein, 9 aa, Mycobacterium
QSEYRQAAQ

SEQ ID NO: 1084210 - protein, 11 aa, Mycobacterium
TAGRSELQNVP

SEQ ID NO: 1084211 - protein, 4 aa, Mycobacterium
TEID

SEQ ID NO: 1084212 - protein, 4 aa, Mycobacterium
TGAA

SEQ ID NO: 1084213 - protein, 5 aa, Mycobacterium
TPAEA

SEQ ID NO: 1084214 - protein, 6 aa, Mycobacterium
VGGPSA

SEQ ID NO: 1084215 - protein, 9 aa, Mycobacterium
AAAAAATTT

SEQ ID NO: 1084216 - protein, 12 aa, Mycobacterium
AAAAPASQRLPS

SEQ ID NO: 1084217 - protein, 22 aa, Mycobacterium
AAADPANPYGTPPNPTQQLPGL

SEQ ID NO: 1084218 - protein, 13 aa, Mycobacterium
AAAGAAVQAPPAR

SEQ ID NO: 1084219 - protein, 24 aa, Mycobacterium
AAANADPAPLPPSTATAAPSPAQE

SEQ ID NO: 1084220 - protein, 6 aa, Mycobacterium
AAAPGI

SEQ ID NO: 1084221 - protein, 11 aa, Mycobacterium
AAARSGDANPL

SEQ ID NO: 1084222 - protein, 5 aa, Mycobacterium
AADTA

SEQ ID NO: 1084223 - protein, 5 aa, Mycobacterium
AAEGY

SEQ ID NO: 1084224 - protein, 15 aa, Mycobacterium
AAEKPGQQQGTGHPY

SEQ ID NO: 1084225 - protein, 11 aa, Mycobacterium
AAGAGKRLAAG

SEQ ID NO: 1084226 - protein, 8 aa, Mycobacterium
AAGGPVSA

SEQ ID NO: 1084227 - protein, 8 aa, Mycobacterium
AAGKTPVP

SEQ ID NO: 1084228 - protein, 15 aa, Mycobacterium
AAGNSVRWRMGWIGT

SEQ ID NO: 1084229 - protein, 52 aa, Mycobacterium
AAGPATAATPTPGSPTNRTAAPPTPVASPAPTTPELPATTPGFGPDAPPTQD

SEQ ID NO: 1084230 - protein, 16 aa, Mycobacterium
AAGPDGGWNKPPTPLW

SEQ ID NO: 1084231 - protein, 4 aa, Mycobacterium
AAGT

SEQ ID NO: 1084232 - protein, 17 aa, Mycobacterium
AAISRSAKSAALGRQLD

SEQ ID NO: 1084233 - protein, 12 aa, Mycobacterium
AAKRRSAADPLA

SEQ ID NO: 1084234 - protein, 9 aa, Mycobacterium
AANNPQQAT

SEQ ID NO: 1084235 - protein, 5 aa, Mycobacterium
AANPY

SEQ ID NO: 1084236 - protein, 8 aa, Mycobacterium
AAPANPSL

SEQ ID NO: 1084237 - protein, 5 aa, Mycobacterium
AAPGP

SEQ ID NO: 1084238 - protein, 4 aa, Mycobacterium
AAPP

SEQ ID NO: 1084239 - protein, 9 aa, Mycobacterium
AAPSTRGHQ

SEQ ID NO: 1084240 - protein, 19 aa, Mycobacterium
AAQGQGTSTIGGALRSRDT

SEQ ID NO: 1084241 - protein, 8 aa, Mycobacterium
AAQSLAGL

SEQ ID NO: 1084242 - protein, 6 aa, Mycobacterium
AARAAG

SEQ ID NO: 1084243 - protein, 10 aa, Mycobacterium
AARELAEETG

SEQ ID NO: 1084244 - protein, 10 aa, Mycobacterium
AARVTTDEDI

SEQ ID NO: 1084245 - protein, 8 aa, Mycobacterium
AASSDTEV

SEQ ID NO: 1084246 - protein, 7 aa, Mycobacterium
AASSGMS

SEQ ID NO: 1084247 - protein, 7 aa, Mycobacterium
ADEHNPV

SEQ ID NO: 1084248 - protein, 19 aa, Mycobacterium
ADETEVAGRGHDRGQPVPG

SEQ ID NO: 1084249 - protein, 15 aa, Mycobacterium
ADFPAGRQKLNGPQA

SEQ ID NO: 1084250 - protein, 6 aa, Mycobacterium
ADGGCG

SEQ ID NO: 1084251 - protein, 9 aa, Mycobacterium
ADGSSSIAT

SEQ ID NO: 1084252 - protein, 14 aa, Mycobacterium
ADIRPALGDPTEVA

SEQ ID NO: 1084253 - protein, 5 aa, Mycobacterium
ADLPG

SEQ ID NO: 1084254 - protein, 13 aa, Mycobacterium
ADPAPPGDSQLPA

SEQ ID NO: 1084255 - protein, 6 aa, Mycobacterium
ADPERT

SEQ ID NO: 1084256 - protein, 7 aa, Mycobacterium
ADPKLAK

SEQ ID NO: 1084257 - protein, 9 aa, Mycobacterium
ADPPAPVPE

SEQ ID NO: 1084258 - protein, 9 aa, Mycobacterium
ADPPGRDAW

SEQ ID NO: 1084259 - protein, 6 aa, Mycobacterium
ADPTAV

SEQ ID NO: 1084260 - protein, 4 aa, Mycobacterium
ADQL

SEQ ID NO: 1084261 - protein, 13 aa, Mycobacterium
ADSGTRTADYQQT

SEQ ID NO: 1084262 - protein, 14 aa, Mycobacterium
ADSTRDPVIASRTK

SEQ ID NO: 1084263 - protein, 5 aa, Mycobacterium
ADTAT

SEQ ID NO: 1084264 - protein, 7 aa, Mycobacterium
AEADAID

SEQ ID NO: 1084265 - protein, 17 aa, Mycobacterium
AECAPRHTRENAENELS

SEQ ID NO: 1084266 - protein, 8 aa, Mycobacterium
AEDGGVEL

SEQ ID NO: 1084267 - protein, 6 aa, Mycobacterium
AEGAKQ

SEQ ID NO: 1084268 - protein, 14 aa, Mycobacterium
AEKWSRIAAAIVMF

SEQ ID NO: 1084269 - protein, 9 aa, Mycobacterium
AELPGGKDV

SEQ ID NO: 1084270 - protein, 12 aa, Mycobacterium
AELSATGGLYPT

SEQ ID NO: 1084271 - protein, 9 aa, Mycobacterium
AERDEAQAR

SEQ ID NO: 1084272 - protein, 12 aa, Mycobacterium
AERSAVGGATNA

SEQ ID NO: 1084273 - protein, 6 aa, Mycobacterium
AESGAT

SEQ ID NO: 1084274 - protein, 7 aa, Mycobacterium
AESPCTV

SEQ ID NO: 1084275 - protein, 7 aa, Mycobacterium
AFEGGQR

SEQ ID NO: 1084276 - protein, 5 aa, Mycobacterium
AFGPR

SEQ ID NO: 1084277 - protein, 6 aa, Mycobacterium
AGATLT

SEQ ID NO: 1084278 - protein, 51 aa, Mycobacterium
AGCSGGTQAPTPSVSKTTNSSPTTVASSIPDAAAGETKVTIGGQPQKVSGP

SEQ ID NO: 1084279 - protein, 12 aa, Mycobacterium
AGDSEDKGLAAA

SEQ ID NO: 1084280 - protein, 10 aa, Mycobacterium
AGGADRTKSV

SEQ ID NO: 1084281 - protein, 8 aa, Mycobacterium
AGGDGGAV

SEQ ID NO: 1084282 - protein, 4 aa, Mycobacterium
AGGG

SEQ ID NO: 1084283 - protein, 5 aa, Mycobacterium
AGGGS

SEQ ID NO: 1084284 - protein, 16 aa, Mycobacterium
AGGNVSSEHGVGSNKR

SEQ ID NO: 1084285 - protein, 17 aa, Mycobacterium
AGGPPTAPVAPRNSAPV

SEQ ID NO: 1084286 - protein, 15 aa, Mycobacterium
AGGQYLGQSAVRRKF

SEQ ID NO: 1084287 - protein, 8 aa, Mycobacterium
AGGRQASA

SEQ ID NO: 1084288 - protein, 10 aa, Mycobacterium
AGPPGSKGKL

SEQ ID NO: 1084289 - protein, 7 aa, Mycobacterium
AGPRPEM

SEQ ID NO: 1084290 - protein, 10 aa, Mycobacterium
AGRDGSATGV

SEQ ID NO: 1084291 - protein, 49 aa, Mycobacterium
AGRPGDPAPNVPGTPVPLPPNAPPGARTEQLAPAAPAQDSSAPHEPREQ

SEQ ID NO: 1084292 - protein, 10 aa, Mycobacterium
AGSRLGYQES

SEQ ID NO: 1084293 - protein, 8 aa, Mycobacterium
AGTDTGPI

SEQ ID NO: 1084294 - protein, 13 aa, Mycobacterium
AGTGTRTGDYGIG

SEQ ID NO: 1084295 - protein, 9 aa, Mycobacterium
AGVPGGDEH

SEQ ID NO: 1084296 - protein, 12 aa, Mycobacterium
AGWTTTANPDLP

SEQ ID NO: 1084297 - protein, 17 aa, Mycobacterium
AHSGRTSPQPVPTRPRT

SEQ ID NO: 1084298 - protein, 8 aa, Mycobacterium
AHTHPTSG

SEQ ID NO: 1084299 - protein, 8 aa, Mycobacterium
AIEATEAE

SEQ ID NO: 1084300 - protein, 5 aa, Mycobacterium
AIGSG

SEQ ID NO: 1084301 - protein, 6 aa, Mycobacterium
AINGNS

SEQ ID NO: 1084302 - protein, 25 aa, Mycobacterium
AKGGIASGGDDGPPATEVTIESLRL

SEQ ID NO: 1084303 - protein, 8 aa, Mycobacterium
AKGPPSVT

SEQ ID NO: 1084304 - protein, 12 aa, Mycobacterium
AKLPGRKGCVGN

SEQ ID NO: 1084305 - protein, 12 aa, Mycobacterium
AKMRTSDGVTGF

SEQ ID NO: 1084306 - protein, 7 aa, Mycobacterium
AKRGANV

SEQ ID NO: 1084307 - protein, 10 aa, Mycobacterium
AKSDEHDAAA

SEQ ID NO: 1084308 - protein, 5 aa, Mycobacterium
AKTAI

SEQ ID NO: 1084309 - protein, 10 aa, Mycobacterium
ALNRPTPDRV

SEQ ID NO: 1084310 - protein, 7 aa, Mycobacterium
ALPEPAQ

SEQ ID NO: 1084311 - protein, 4 aa, Mycobacterium
AMGR

SEQ ID NO: 1084312 - protein, 6 aa, Mycobacterium
ANAASK

SEQ ID NO: 1084313 - protein, 8 aa, Mycobacterium
ANDGQAGL

SEQ ID NO: 1084314 - protein, 7 aa, Mycobacterium
ANGKPKW

SEQ ID NO: 1084315 - protein, 6 aa, Mycobacterium
ANHNGS

SEQ ID NO: 1084316 - protein, 17 aa, Mycobacterium
ANLPPCPDAGSGPGPAV

SEQ ID NO: 1084317 - protein, 8 aa, Mycobacterium
ANNPEPLN

SEQ ID NO: 1084318 - protein, 5 aa, Mycobacterium
ANPAS

SEQ ID NO: 1084319 - protein, 15 aa, Mycobacterium
ANPPRRASVNELGGS

SEQ ID NO: 1084320 - protein, 7 aa, Mycobacterium
ANPQSVD

SEQ ID NO: 1084321 - protein, 6 aa, Mycobacterium
ANPSTV

SEQ ID NO: 1084322 - protein, 17 aa, Mycobacterium
ANPVTFDGDEQARARPI

SEQ ID NO: 1084323 - protein, 8 aa, Mycobacterium
ANSAGQHA

SEQ ID NO: 1084324 - protein, 10 aa, Mycobacterium
ANSGPNTNGS

SEQ ID NO: 1084325 - protein, 8 aa, Mycobacterium
ANSTEKLR

SEQ ID NO: 1084326 - protein, 11 aa, Mycobacterium
ANVANDTDING

SEQ ID NO: 1084327 - protein, 7 aa, Mycobacterium
APAGGAY

SEQ ID NO: 1084328 - protein, 9 aa, Mycobacterium
APAGTPVRR

SEQ ID NO: 1084329 - protein, 8 aa, Mycobacterium
APATGQRI

SEQ ID NO: 1084330 - protein, 12 aa, Mycobacterium
APGARCDQPVKP

SEQ ID NO: 1084331 - protein, 15 aa, Mycobacterium
APGDSVAEVSIGPPM

SEQ ID NO: 1084332 - protein, 6 aa, Mycobacterium
APLGGS

SEQ ID NO: 1084333 - protein, 7 aa, Mycobacterium
APPASTM

SEQ ID NO: 1084334 - protein, 12 aa, Mycobacterium
APSYGVEVIGYP

SEQ ID NO: 1084335 - protein, 10 aa, Mycobacterium
APVPTDSASW

SEQ ID NO: 1084336 - protein, 7 aa, Mycobacterium
AQAAGRD

SEQ ID NO: 1084337 - protein, 9 aa, Mycobacterium
AQAPDSASI

SEQ ID NO: 1084338 - protein, 5 aa, Mycobacterium
AQGEM

SEQ ID NO: 1084339 - protein, 8 aa, Mycobacterium
AQGKRAAA

SEQ ID NO: 1084340 - protein, 6 aa, Mycobacterium
AQGTEV

SEQ ID NO: 1084341 - protein, 6 aa, Mycobacterium
AQGTVT

SEQ ID NO: 1084342 - protein, 14 aa, Mycobacterium
AQPYGGYISPGSTL

SEQ ID NO: 1084343 - protein, 7 aa, Mycobacterium
AQRGCPV

SEQ ID NO: 1084344 - protein, 9 aa, Mycobacterium
AQSARQDQH

SEQ ID NO: 1084345 - protein, 17 aa, Mycobacterium
AQSGPDGSSVELASIGA

SEQ ID NO: 1084346 - protein, 6 aa, Mycobacterium
AQTQAG

SEQ ID NO: 1084347 - protein, 14 aa, Mycobacterium
ARADSRGSGGTNNI

SEQ ID NO: 1084348 - protein, 21 aa, Mycobacterium
ARASAGYSSAARNAGDQAGRR

SEQ ID NO: 1084349 - protein, 14 aa, Mycobacterium
ARATDAYEEARETA

SEQ ID NO: 1084350 - protein, 5 aa, Mycobacterium
ARGDA

SEQ ID NO: 1084351 - protein, 9 aa, Mycobacterium
ARGETPNPC

SEQ ID NO: 1084352 - protein, 15 aa, Mycobacterium
ARLQPPSGYKDTTVP

SEQ ID NO: 1084353 - protein, 12 aa, Mycobacterium
ARPTTPKRFSSS

SEQ ID NO: 1084354 - protein, 12 aa, Mycobacterium
ARQSSPNTPHLG

SEQ ID NO: 1084355 - protein, 11 aa, Mycobacterium
ARSSQTPRDAG

SEQ ID NO: 1084356 - protein, 7 aa, Mycobacterium
ARTQNAF

SEQ ID NO: 1084357 - protein, 8 aa, Mycobacterium
ASAEADNI

SEQ ID NO: 1084358 - protein, 7 aa, Mycobacterium
ASAEAIG

SEQ ID NO: 1084359 - protein, 8 aa, Mycobacterium
ASATHNPD

SEQ ID NO: 1084360 - protein, 11 aa, Mycobacterium
ASDTQPDRDAG

SEQ ID NO: 1084361 - protein, 12 aa, Mycobacterium
ASENSAEVTPGA

SEQ ID NO: 1084362 - protein, 16 aa, Mycobacterium
ASETANQAAAAAAAYE

SEQ ID NO: 1084363 - protein, 11 aa, Mycobacterium
ASGAYRPTPTI

SEQ ID NO: 1084364 - protein, 5 aa, Mycobacterium
ASGID

SEQ ID NO: 1084365 - protein, 11 aa, Mycobacterium
ASGQSPAPAAR

SEQ ID NO: 1084366 - protein, 10 aa, Mycobacterium
ASHGKDGRVS

SEQ ID NO: 1084367 - protein, 12 aa, Mycobacterium
ASIAQTASATFP

SEQ ID NO: 1084368 - protein, 6 aa, Mycobacterium
ASIEEI

SEQ ID NO: 1084369 - protein, 18 aa, Mycobacterium
ASKTGTAEHGTDPRHTPP

SEQ ID NO: 1084370 - protein, 4 aa, Mycobacterium
ASLP

SEQ ID NO: 1084371 - protein, 7 aa, Mycobacterium
ASNPRRV

SEQ ID NO: 1084372 - protein, 35 aa, Mycobacterium
ASNRLVPSAASNAALGKTSDINPQDPATLKDGGNL

SEQ ID NO: 1084373 - protein, 7 aa, Mycobacterium
ASRPDRV

SEQ ID NO: 1084374 - protein, 8 aa, Mycobacterium
ASSDPSGL

SEQ ID NO: 1084375 - protein, 5 aa, Mycobacterium
ASTDM

SEQ ID NO: 1084376 - protein, 8 aa, Mycobacterium
ASTGSGSL

SEQ ID NO: 1084377 - protein, 26 aa, Mycobacterium
ASTTGASESAANASPAASDSVTEQHR

SEQ ID NO: 1084378 - protein, 5 aa, Mycobacterium
ASTVD

SEQ ID NO: 1084379 - protein, 9 aa, Mycobacterium
ASVDDPTGV

SEQ ID NO: 1084380 - protein, 12 aa, Mycobacterium
ASVPGTLSTRDK

SEQ ID NO: 1084381 - protein, 8 aa, Mycobacterium
ASVTDGAV

SEQ ID NO: 1084382 - protein, 5 aa, Mycobacterium
ASYKP

SEQ ID NO: 1084383 - protein, 26 aa, Mycobacterium
ATADPGQWDPTLPAAVSAGAPGDPLA

SEQ ID NO: 1084384 - protein, 8 aa, Mycobacterium
ATAGLRHA

SEQ ID NO: 1084385 - protein, 6 aa, Mycobacterium
ATASDD

SEQ ID NO: 1084386 - protein, 5 aa, Mycobacterium
ATETL

SEQ ID NO: 1084387 - protein, 12 aa, Mycobacterium
ATGDFAKQYNEK

SEQ ID NO: 1084388 - protein, 4 aa, Mycobacterium
ATGG

SEQ ID NO: 1084389 - protein, 5 aa, Mycobacterium
ATGVP

SEQ ID NO: 1084390 - protein, 8 aa, Mycobacterium
ATKAGLPA

SEQ ID NO: 1084391 - protein, 4 aa, Mycobacterium
ATMA

SEQ ID NO: 1084392 - protein, 6 aa, Mycobacterium
ATNPDE

SEQ ID NO: 1084393 - protein, 5 aa, Mycobacterium
ATQPY

SEQ ID NO: 1084394 - protein, 4 aa, Mycobacterium
ATSA

SEQ ID NO: 1084395 - protein, 9 aa, Mycobacterium
ATSTQVTAS

SEQ ID NO: 1084396 - protein, 7 aa, Mycobacterium
ATTQKPQ

SEQ ID NO: 1084397 - protein, 6 aa, Mycobacterium
ATYPPT

SEQ ID NO: 1084398 - protein, 14 aa, Mycobacterium
AVPASHEVHRDPER

SEQ ID NO: 1084399 - protein, 7 aa, Mycobacterium
AVQDGKQ

SEQ ID NO: 1084400 - protein, 8 aa, Mycobacterium
AVQVGDGE

SEQ ID NO: 1084401 - protein, 7 aa, Mycobacterium
AVSGGTV

SEQ ID NO: 1084402 - protein, 6 aa, Mycobacterium
AVSPQI

SEQ ID NO: 1084403 - protein, 8 aa, Mycobacterium
AWDRPTAT

SEQ ID NO: 1084404 - protein, 10 aa, Mycobacterium
AYGAEVSDTI

SEQ ID NO: 1084405 - protein, 9 aa, Mycobacterium
AYPSNPANI

SEQ ID NO: 1084406 - protein, 10 aa, Mycobacterium
AYSGTSPGRR

SEQ ID NO: 1084407 - protein, 8 aa, Mycobacterium
AYSPGGSL

SEQ ID NO: 1084408 - protein, 16 aa, Mycobacterium
CARSASCPLGTDPSQW

SEQ ID NO: 1084409 - protein, 10 aa, Mycobacterium
CATDRGDRHP

SEQ ID NO: 1084410 - protein, 19 aa, Mycobacterium
CGGPGAQVAAEGAENRGPM

SEQ ID NO: 1084411 - protein, 5 aa, Mycobacterium
CGRSD

SEQ ID NO: 1084412 - protein, 8 aa, Mycobacterium
CGTKTPDY

SEQ ID NO: 1084413 - protein, 13 aa, Mycobacterium
CQSPEPSEHQIHR

SEQ ID NO: 1084414 - protein, 9 aa, Mycobacterium
CQTPQAQGV

SEQ ID NO: 1084415 - protein, 5 aa, Mycobacterium
CRTQQ

SEQ ID NO: 1084416 - protein, 7 aa, Mycobacterium
CSGRDAV

SEQ ID NO: 1084417 - protein, 4 aa, Mycobacterium
CSSG

SEQ ID NO: 1084418 - protein, 13 aa, Mycobacterium
CTPRPNGPGPAAA

SEQ ID NO: 1084419 - protein, 10 aa, Mycobacterium
CTTPVGNRAT

SEQ ID NO: 1084420 - protein, 9 aa, Mycobacterium
CTYNDQPGV

SEQ ID NO: 1084421 - protein, 7 aa, Mycobacterium
DAADAKA

SEQ ID NO: 1084422 - protein, 7 aa, Mycobacterium
DAAQQKD

SEQ ID NO: 1084423 - protein, 5 aa, Mycobacterium
DACPY

SEQ ID NO: 1084424 - protein, 6 aa, Mycobacterium
DAGRRR

SEQ ID NO: 1084425 - protein, 6 aa, Mycobacterium
DAISTD

SEQ ID NO: 1084426 - protein, 8 aa, Mycobacterium
DANAAVSA

SEQ ID NO: 1084427 - protein, 10 aa, Mycobacterium
DAPAGGRGAG

SEQ ID NO: 1084428 - protein, 9 aa, Mycobacterium
DAQTTSTLK

SEQ ID NO: 1084429 - protein, 9 aa, Mycobacterium
DASGQSAPL

SEQ ID NO: 1084430 - protein, 9 aa, Mycobacterium
DASGTTDNL

SEQ ID NO: 1084431 - protein, 8 aa, Mycobacterium
DATRKTLA

SEQ ID NO: 1084432 - protein, 12 aa, Mycobacterium
DATSGQRANPHA

SEQ ID NO: 1084433 - protein, 4 aa, Mycobacterium
DDAT

SEQ ID NO: 1084434 - protein, 8 aa, Mycobacterium
DDGRAAAA

SEQ ID NO: 1084435 - protein, 25 aa, Mycobacterium
DDIERNQLGTSNVYSQESELFWINS

SEQ ID NO: 1084436 - protein, 4 aa, Mycobacterium
DDLR

SEQ ID NO: 1084437 - protein, 7 aa, Mycobacterium
DDPNSPL

SEQ ID NO: 1084438 - protein, 13 aa, Mycobacterium
DEDRQRPHTGNGA

SEQ ID NO: 1084439 - protein, 4 aa, Mycobacterium
DENE

SEQ ID NO: 1084440 - protein, 5 aa, Mycobacterium
DFDPT

SEQ ID NO: 1084441 - protein, 7 aa, Mycobacterium
DGAPLDD

SEQ ID NO: 1084442 - protein, 15 aa, Mycobacterium
DGDVGNKKVYDPRSY

SEQ ID NO: 1084443 - protein, 7 aa, Mycobacterium
DGGQQFG

SEQ ID NO: 1084444 - protein, 14 aa, Mycobacterium
DGNYNVTTDGQVAD

SEQ ID NO: 1084445 - protein, 5 aa, Mycobacterium
DGTPV

SEQ ID NO: 1084446 - protein, 14 aa, Mycobacterium
DGVPNDKYSGSPVW

SEQ ID NO: 1084447 - protein, 22 aa, Mycobacterium
DGWTTSDVAATDPGVADGAGAG

SEQ ID NO: 1084448 - protein, 8 aa, Mycobacterium
DHDQTNRL

SEQ ID NO: 1084449 - protein, 5 aa, Mycobacterium
DHDTW

SEQ ID NO: 1084450 - protein, 7 aa, Mycobacterium
DHPDTET

SEQ ID NO: 1084451 - protein, 10 aa, Mycobacterium
DIGATHKTLP

SEQ ID NO: 1084452 - protein, 30 aa, Mycobacterium
DISNTATTNCTDAITPGTSAYDNSHAASDI

SEQ ID NO: 1084453 - protein, 7 aa, Mycobacterium
DITGRRP

SEQ ID NO: 1084454 - protein, 6 aa, Mycobacterium
DKGTPF

SEQ ID NO: 1084455 - protein, 6 aa, Mycobacterium
DKPDSH

SEQ ID NO: 1084456 - protein, 7 aa, Mycobacterium
DKPGDHD

SEQ ID NO: 1084457 - protein, 7 aa, Mycobacterium
DKPGHDH

SEQ ID NO: 1084458 - protein, 9 aa, Mycobacterium
DLDEDSWQE

SEQ ID NO: 1084459 - protein, 13 aa, Mycobacterium
DLTGSRATPVEGK

SEQ ID NO: 1084460 - protein, 6 aa, Mycobacterium
DNARTI

SEQ ID NO: 1084461 - protein, 8 aa, Mycobacterium
DNGDPTNH

SEQ ID NO: 1084462 - protein, 9 aa, Mycobacterium
DNNRQAAQD

SEQ ID NO: 1084463 - protein, 5 aa, Mycobacterium
DNTGY

SEQ ID NO: 1084464 - protein, 4 aa, Mycobacterium
DPAD

SEQ ID NO: 1084465 - protein, 8 aa, Mycobacterium
DPAITNGH

SEQ ID NO: 1084466 - protein, 9 aa, Mycobacterium
DPAQTTGDT

SEQ ID NO: 1084467 - protein, 7 aa, Mycobacterium
DPDDPTP

SEQ ID NO: 1084468 - protein, 6 aa, Mycobacterium
DPHRGR

SEQ ID NO: 1084469 - protein, 9 aa, Mycobacterium
DPKAKGSKL

SEQ ID NO: 1084470 - protein, 4 aa, Mycobacterium
DPLT

SEQ ID NO: 1084471 - protein, 6 aa, Mycobacterium
DPNTGI

SEQ ID NO: 1084472 - protein, 7 aa, Mycobacterium
DPRTVNA

SEQ ID NO: 1084473 - protein, 18 aa, Mycobacterium
DPSTLGGTSPISTSSGEL

SEQ ID NO: 1084474 - protein, 11 aa, Mycobacterium
DPTGKTVVPDP

SEQ ID NO: 1084475 - protein, 11 aa, Mycobacterium
DPTLLGTSPVT

SEQ ID NO: 1084476 - protein, 5 aa, Mycobacterium
DQAQR

SEQ ID NO: 1084477 - protein, 17 aa, Mycobacterium
DQARHDSALASAAAAAI

SEQ ID NO: 1084478 - protein, 6 aa, Mycobacterium
DQQIRQ

SEQ ID NO: 1084479 - protein, 4 aa, Mycobacterium
DQTY

SEQ ID NO: 1084480 - protein, 11 aa, Mycobacterium
DQVSPSATSPI

SEQ ID NO: 1084481 - protein, 9 aa, Mycobacterium
DRDMSTPNT

SEQ ID NO: 1084482 - protein, 10 aa, Mycobacterium
DRDRAAAMGA

SEQ ID NO: 1084483 - protein, 5 aa, Mycobacterium
DREWH

SEQ ID NO: 1084484 - protein, 14 aa, Mycobacterium
DRFRPDPASRAELR

SEQ ID NO: 1084485 - protein, 22 aa, Mycobacterium
DRPAAAKQQDRDHHQTPFDTDA

SEQ ID NO: 1084486 - protein, 4 aa, Mycobacterium
DRQG

SEQ ID NO: 1084487 - protein, 20 aa, Mycobacterium
DRQKMRDQAQFESGDDPVAN

SEQ ID NO: 1084488 - protein, 5 aa, Mycobacterium
DRTTQ

SEQ ID NO: 1084489 - protein, 5 aa, Mycobacterium
DSEGM

SEQ ID NO: 1084490 - protein, 6 aa, Mycobacterium
DSGSPY

SEQ ID NO: 1084491 - protein, 7 aa, Mycobacterium
DSLFATG

SEQ ID NO: 1084492 - protein, 6 aa, Mycobacterium
DSLPQT

SEQ ID NO: 1084493 - protein, 6 aa, Mycobacterium
DSNPNV

SEQ ID NO: 1084494 - protein, 9 aa, Mycobacterium
DSNPTYEQY

SEQ ID NO: 1084495 - protein, 4 aa, Mycobacterium
DSPV

SEQ ID NO: 1084496 - protein, 5 aa, Mycobacterium
DSSVA

SEQ ID NO: 1084497 - protein, 7 aa, Mycobacterium
DSTPLSN

SEQ ID NO: 1084498 - protein, 4 aa, Mycobacterium
DSVN

SEQ ID NO: 1084499 - protein, 5 aa, Mycobacterium
DTERS

SEQ ID NO: 1084500 - protein, 19 aa, Mycobacterium
DTGSGGVPLTDDTARNGIN

SEQ ID NO: 1084501 - protein, 7 aa, Mycobacterium
DTGSGSI

SEQ ID NO: 1084502 - protein, 11 aa, Mycobacterium
DTISGTTLSSQ

SEQ ID NO: 1084503 - protein, 24 aa, Mycobacterium
DTKPPLPGGDPQSSVLNRVEYGNR

SEQ ID NO: 1084504 - protein, 6 aa, Mycobacterium
DTLTET

SEQ ID NO: 1084505 - protein, 6 aa, Mycobacterium
DTRPGR

SEQ ID NO: 1084506 - protein, 10 aa, Mycobacterium
DTTQDRRSGY

SEQ ID NO: 1084507 - protein, 14 aa, Mycobacterium
DVEPTATGAEATMS

SEQ ID NO: 1084508 - protein, 10 aa, Mycobacterium
DYTGPGSGLF

SEQ ID NO: 1084509 - protein, 8 aa, Mycobacterium
DYVPDPDP

SEQ ID NO: 1084510 - protein, 7 aa, Mycobacterium
EADGTIT

SEQ ID NO: 1084511 - protein, 7 aa, Mycobacterium
EADRQSR

SEQ ID NO: 1084512 - protein, 4 aa, Mycobacterium
EAGV

SEQ ID NO: 1084513 - protein, 5 aa, Mycobacterium
EASHL

SEQ ID NO: 1084514 - protein, 10 aa, Mycobacterium
EASSSVGKVT

SEQ ID NO: 1084515 - protein, 6 aa, Mycobacterium
EATADR

SEQ ID NO: 1084516 - protein, 6 aa, Mycobacterium
EATETT

SEQ ID NO: 1084517 - protein, 5 aa, Mycobacterium
EATGR

SEQ ID NO: 1084518 - protein, 8 aa, Mycobacterium
EAVAQSND

SEQ ID NO: 1084519 - protein, 7 aa, Mycobacterium
EDIGPEF

SEQ ID NO: 1084520 - protein, 10 aa, Mycobacterium
EDPGTPGTQD

SEQ ID NO: 1084521 - protein, 14 aa, Mycobacterium
EDPTGTTSTLYRPN

SEQ ID NO: 1084522 - protein, 4 aa, Mycobacterium
EDPV

SEQ ID NO: 1084523 - protein, 5 aa, Mycobacterium
EDTGT

SEQ ID NO: 1084524 - protein, 11 aa, Mycobacterium
EELPDEPEPGT

SEQ ID NO: 1084525 - protein, 13 aa, Mycobacterium
EGALPPPRKKSRR

SEQ ID NO: 1084526 - protein, 24 aa, Mycobacterium
EGGIGSAEAHIGDRELKNAAQKGE

SEQ ID NO: 1084527 - protein, 18 aa, Mycobacterium
EGTREAAIKQAEGNKQAQ

SEQ ID NO: 1084528 - protein, 7 aa, Mycobacterium
EHEAEPG

SEQ ID NO: 1084529 - protein, 11 aa, Mycobacterium
EISRTEEDTPL

SEQ ID NO: 1084530 - protein, 9 aa, Mycobacterium
EKASSVTEP

SEQ ID NO: 1084531 - protein, 4 aa, Mycobacterium
EKDR

SEQ ID NO: 1084532 - protein, 7 aa, Mycobacterium
EKLGSEQ

SEQ ID NO: 1084533 - protein, 5 aa, Mycobacterium
ELGAN

SEQ ID NO: 1084534 - protein, 6 aa, Mycobacterium
ELPRGD

SEQ ID NO: 1084535 - protein, 9 aa, Mycobacterium
ELPSPQDIE

SEQ ID NO: 1084536 - protein, 5 aa, Mycobacterium
ELTPA

SEQ ID NO: 1084537 - protein, 5 aa, Mycobacterium
EMSAQ

SEQ ID NO: 1084538 - protein, 8 aa, Mycobacterium
ENDGSKQW

SEQ ID NO: 1084539 - protein, 18 aa, Mycobacterium
ENSTKTGDDGWKEMLAPA

SEQ ID NO: 1084540 - protein, 25 aa, Mycobacterium
ENTNRWTATATREGNQWKISNLLQV

SEQ ID NO: 1084541 - protein, 9 aa, Mycobacterium
EPDPQRPEI

SEQ ID NO: 1084542 - protein, 6 aa, Mycobacterium
EPGPRL

SEQ ID NO: 1084543 - protein, 7 aa, Mycobacterium
EPHPVDG

SEQ ID NO: 1084544 - protein, 9 aa, Mycobacterium
EPSPASSVS

SEQ ID NO: 1084545 - protein, 8 aa, Mycobacterium
EQLDPATT

SEQ ID NO: 1084546 - protein, 8 aa, Mycobacterium
EQLVGSAA

SEQ ID NO: 1084547 - protein, 6 aa, Mycobacterium
EQSGHV

SEQ ID NO: 1084548 - protein, 7 aa, Mycobacterium
EQSNINT

SEQ ID NO: 1084549 - protein, 6 aa, Mycobacterium
EQTQAG

SEQ ID NO: 1084550 - protein, 4 aa, Mycobacterium
ERGI

SEQ ID NO: 1084551 - protein, 5 aa, Mycobacterium
ERGRA

SEQ ID NO: 1084552 - protein, 17 aa, Mycobacterium
ERPVPSNLPKPTPGMDP

SEQ ID NO: 1084553 - protein, 4 aa, Mycobacterium
ERSN

SEQ ID NO: 1084554 - protein, 9 aa, Mycobacterium
ERTEDGFGQ

SEQ ID NO: 1084555 - protein, 6 aa, Mycobacterium
ESDIPG

SEQ ID NO: 1084556 - protein, 9 aa, Mycobacterium
ESGSPSVAA

SEQ ID NO: 1084557 - protein, 4 aa, Mycobacterium
ESQD

SEQ ID NO: 1084558 - protein, 11 aa, Mycobacterium
ETAQAVGGLGP

SEQ ID NO: 1084559 - protein, 8 aa, Mycobacterium
ETYPPGST

SEQ ID NO: 1084560 - protein, 8 aa, Mycobacterium
EVADRGDY

SEQ ID NO: 1084561 - protein, 8 aa, Mycobacterium
EVRPGERL

SEQ ID NO: 1084562 - protein, 15 aa, Mycobacterium
EVSQQSVKDANTAIN

SEQ ID NO: 1084563 - protein, 15 aa, Mycobacterium
EWPDPAESLPPPYDN

SEQ ID NO: 1084564 - protein, 7 aa, Mycobacterium
EYPPRGS

SEQ ID NO: 1084565 - protein, 5 aa, Mycobacterium
FADRA

SEQ ID NO: 1084566 - protein, 6 aa, Mycobacterium
FAGQGV

SEQ ID NO: 1084567 - protein, 10 aa, Mycobacterium
FATDGDGESI

SEQ ID NO: 1084568 - protein, 11 aa, Mycobacterium
FEGHPDNAAAA

SEQ ID NO: 1084569 - protein, 5 aa, Mycobacterium
FEPST

SEQ ID NO: 1084570 - protein, 7 aa, Mycobacterium
FGEPRSA

SEQ ID NO: 1084571 - protein, 13 aa, Mycobacterium
FGKGYPDGAAPCR

SEQ ID NO: 1084572 - protein, 6 aa, Mycobacterium
FGNTGA

SEQ ID NO: 1084573 - protein, 8 aa, Mycobacterium
FGRGSNRE

SEQ ID NO: 1084574 - protein, 11 aa, Mycobacterium
FKQSEDSAAYA

SEQ ID NO: 1084575 - protein, 29 aa, Mycobacterium
FPGDQATLRSASGAGVRRKCAEKARSVNH

SEQ ID NO: 1084576 - protein, 10 aa, Mycobacterium
FPSGDRVGTT

SEQ ID NO: 1084577 - protein, 6 aa, Mycobacterium
FQPSTN

SEQ ID NO: 1084578 - protein, 4 aa, Mycobacterium
FRAA

SEQ ID NO: 1084579 - protein, 5 aa, Mycobacterium
FSPDG

SEQ ID NO: 1084580 - protein, 5 aa, Mycobacterium
FTRRD

SEQ ID NO: 1084581 - protein, 8 aa, Mycobacterium
GAAAAEVA

SEQ ID NO: 1084582 - protein, 11 aa, Mycobacterium
GAALAAAGGTD

SEQ ID NO: 1084583 - protein, 7 aa, Mycobacterium
GAAPLGP

SEQ ID NO: 1084584 - protein, 9 aa, Mycobacterium
GADNAAPVD

SEQ ID NO: 1084585 - protein, 18 aa, Mycobacterium
GADSQAIADGWLAEHPMG

SEQ ID NO: 1084586 - protein, 17 aa, Mycobacterium
GAEFQGGVGEGVQKSAG

SEQ ID NO: 1084587 - protein, 6 aa, Mycobacterium
GAEGNL

SEQ ID NO: 1084588 - protein, 8 aa, Mycobacterium
GAERLPNV

SEQ ID NO: 1084589 - protein, 6 aa, Mycobacterium
GAGEHG

SEQ ID NO: 1084590 - protein, 8 aa, Mycobacterium
GANKDRDY

SEQ ID NO: 1084591 - protein, 11 aa, Mycobacterium
GANYGAPPFNG

SEQ ID NO: 1084592 - protein, 7 aa, Mycobacterium
GAPGEDG

SEQ ID NO: 1084593 - protein, 9 aa, Mycobacterium
GAQYRATAA

SEQ ID NO: 1084594 - protein, 10 aa, Mycobacterium
GARGETGADP

SEQ ID NO: 1084595 - protein, 16 aa, Mycobacterium
GASPEQTPSPVPEQNW

SEQ ID NO: 1084596 - protein, 4 aa, Mycobacterium
GASS

SEQ ID NO: 1084597 - protein, 15 aa, Mycobacterium
GATAGPYGGPAFPAP

SEQ ID NO: 1084598 - protein, 4 aa, Mycobacterium
GATL

SEQ ID NO: 1084599 - protein, 20 aa, Mycobacterium
GATTLTSSSPGGYDPSAADA

SEQ ID NO: 1084600 - protein, 27 aa, Mycobacterium
GCSSTKPDAQEQSSSSSPASSDPALTA

SEQ ID NO: 1084601 - protein, 7 aa, Mycobacterium
GDAAISG

SEQ ID NO: 1084602 - protein, 8 aa, Mycobacterium
GDCQETSD

SEQ ID NO: 1084603 - protein, 6 aa, Mycobacterium
GDELGS

SEQ ID NO: 1084604 - protein, 12 aa, Mycobacterium
GDHGVPNQRTSA

SEQ ID NO: 1084605 - protein, 14 aa, Mycobacterium
GDPKVDGTGGPGYK

SEQ ID NO: 1084606 - protein, 18 aa, Mycobacterium
GDQYNAGRHLTPDQAKRG

SEQ ID NO: 1084607 - protein, 6 aa, Mycobacterium
GDRGAQ

SEQ ID NO: 1084608 - protein, 9 aa, Mycobacterium
GDSQTEGLW

SEQ ID NO: 1084609 - protein, 19 aa, Mycobacterium
GDTATAAQLSDNPNEAHEA

SEQ ID NO: 1084610 - protein, 7 aa, Mycobacterium
GDTETVS

SEQ ID NO: 1084611 - protein, 7 aa, Mycobacterium
GDTIPLK

SEQ ID NO: 1084612 - protein, 10 aa, Mycobacterium
GDTLPGAEGL

SEQ ID NO: 1084613 - protein, 9 aa, Mycobacterium
GDTYANSAS

SEQ ID NO: 1084614 - protein, 18 aa, Mycobacterium
GEAVQSADGHSLSRPSWS

SEQ ID NO: 1084615 - protein, 10 aa, Mycobacterium
GEGADQVPMG

SEQ ID NO: 1084616 - protein, 6 aa, Mycobacterium
GELTPS

SEQ ID NO: 1084617 - protein, 7 aa, Mycobacterium
GEPASAP

SEQ ID NO: 1084618 - protein, 7 aa, Mycobacterium
GEQVYPR

SEQ ID NO: 1084619 - protein, 6 aa, Mycobacterium
GETSGT

SEQ ID NO: 1084620 - protein, 6 aa, Mycobacterium
GEVDGK

SEQ ID NO: 1084621 - protein, 5 aa, Mycobacterium
GGAQI

SEQ ID NO: 1084622 - protein, 14 aa, Mycobacterium
GGASQVKQPEPTRW

SEQ ID NO: 1084623 - protein, 19 aa, Mycobacterium
GGDPSNAATTSSNPGGRIP

SEQ ID NO: 1084624 - protein, 11 aa, Mycobacterium
GGEEDGVAGEI

SEQ ID NO: 1084625 - protein, 5 aa, Mycobacterium
GGFGG

SEQ ID NO: 1084626 - protein, 20 aa, Mycobacterium
GGGVSGPTRGTGTGSNTVGF

SEQ ID NO: 1084627 - protein, 10 aa, Mycobacterium
GGHGTPPFGD

SEQ ID NO: 1084628 - protein, 19 aa, Mycobacterium
GGHTGQYGVGHGATSITVP

SEQ ID NO: 1084629 - protein, 4 aa, Mycobacterium
GGID

SEQ ID NO: 1084630 - protein, 7 aa, Mycobacterium
GGIDSTA

SEQ ID NO: 1084631 - protein, 14 aa, Mycobacterium
GGINDQYASPDTAF

SEQ ID NO: 1084632 - protein, 12 aa, Mycobacterium
GGIRDDDSLNAA

SEQ ID NO: 1084633 - protein, 23 aa, Mycobacterium
GGQAPALSRLGGSDWANTKTKAR

SEQ ID NO: 1084634 - protein, 8 aa, Mycobacterium
GGSFTGAE

SEQ ID NO: 1084635 - protein, 18 aa, Mycobacterium
GGSLQGPSKGVGDGANIT

SEQ ID NO: 1084636 - protein, 7 aa, Mycobacterium
GGSSEYA

SEQ ID NO: 1084637 - protein, 8 aa, Mycobacterium
GGTCPSEV

SEQ ID NO: 1084638 - protein, 7 aa, Mycobacterium
GGTVTGT

SEQ ID NO: 1084639 - protein, 6 aa, Mycobacterium
GGVSSL

SEQ ID NO: 1084640 - protein, 6 aa, Mycobacterium
GHETDR

SEQ ID NO: 1084641 - protein, 21 aa, Mycobacterium
GHGHGSGDSHTGGVTTPPLQD

SEQ ID NO: 1084642 - protein, 38 aa, Mycobacterium
GHNGSNDASISRQVPTGRGGTKDCQASGTSTNSGYPEH

SEQ ID NO: 1084643 - protein, 14 aa, Mycobacterium
GHPDPSSGTIDAPI

SEQ ID NO: 1084644 - protein, 8 aa, Mycobacterium
GIAGSASY

SEQ ID NO: 1084645 - protein, 5 aa, Mycobacterium
GIDDQ

SEQ ID NO: 1084646 - protein, 5 aa, Mycobacterium
GIDRR

SEQ ID NO: 1084647 - protein, 5 aa, Mycobacterium
GINPG

SEQ ID NO: 1084648 - protein, 13 aa, Mycobacterium
GIPGSAGATPVQN

SEQ ID NO: 1084649 - protein, 5 aa, Mycobacterium
GIPNL

SEQ ID NO: 1084650 - protein, 4 aa, Mycobacterium
GIPV

SEQ ID NO: 1084651 - protein, 15 aa, Mycobacterium
GISGPLLSHLNWTSR

SEQ ID NO: 1084652 - protein, 12 aa, Mycobacterium
GKAGSENDYGSA

SEQ ID NO: 1084653 - protein, 6 aa, Mycobacterium
GKPHAR

SEQ ID NO: 1084654 - protein, 11 aa, Mycobacterium
GKRPAAGRSGL

SEQ ID NO: 1084655 - protein, 15 aa, Mycobacterium
GKSGGAPEAVQHNKT

SEQ ID NO: 1084656 - protein, 13 aa, Mycobacterium
GKSNPSDLVEFHE

SEQ ID NO: 1084657 - protein, 12 aa, Mycobacterium
GLAGKGKQINAT

SEQ ID NO: 1084658 - protein, 10 aa, Mycobacterium
GLKPAGRGPV

SEQ ID NO: 1084659 - protein, 8 aa, Mycobacterium
GLNDQKNM

SEQ ID NO: 1084660 - protein, 6 aa, Mycobacterium
GLPSLG

SEQ ID NO: 1084661 - protein, 18 aa, Mycobacterium
GMPGNSVAQGRKAGLESA

SEQ ID NO: 1084662 - protein, 6 aa, Mycobacterium
GMTPRA

SEQ ID NO: 1084663 - protein, 13 aa, Mycobacterium
GNGNDRCDEVTTP

SEQ ID NO: 1084664 - protein, 6 aa, Mycobacterium
GNGYSI

SEQ ID NO: 1084665 - protein, 7 aa, Mycobacterium
GNSIAPY

SEQ ID NO: 1084666 - protein, 5 aa, Mycobacterium
GNTRA

SEQ ID NO: 1084667 - protein, 9 aa, Mycobacterium
GNTRPSPCR

SEQ ID NO: 1084668 - protein, 18 aa, Mycobacterium
GNVPDTTAVPAAAGTTVG

SEQ ID NO: 1084669 - protein, 12 aa, Mycobacterium
GPAPAPPTPRYV

SEQ ID NO: 1084670 - protein, 7 aa, Mycobacterium
GPGGSQH

SEQ ID NO: 1084671 - protein, 8 aa, Mycobacterium
GPIPDDKW

SEQ ID NO: 1084672 - protein, 16 aa, Mycobacterium
GPNKQAKITNSTEVTG

SEQ ID NO: 1084673 - protein, 6 aa, Mycobacterium
GPTVSE

SEQ ID NO: 1084674 - protein, 11 aa, Mycobacterium
GPVPHYPAQDG

SEQ ID NO: 1084675 - protein, 8 aa, Mycobacterium
GPVSTGNL

SEQ ID NO: 1084676 - protein, 7 aa, Mycobacterium
GQDPAER

SEQ ID NO: 1084677 - protein, 6 aa, Mycobacterium
GQDPAF

SEQ ID NO: 1084678 - protein, 22 aa, Mycobacterium
GQEGYQDNSGVVGYDPEQAQHE

SEQ ID NO: 1084679 - protein, 4 aa, Mycobacterium
GQGA

SEQ ID NO: 1084680 - protein, 4 aa, Mycobacterium
GQGQ

SEQ ID NO: 1084681 - protein, 17 aa, Mycobacterium
GQKVAAAKLSQSEGSKP

SEQ ID NO: 1084682 - protein, 11 aa, Mycobacterium
GRADDVVGPGG

SEQ ID NO: 1084683 - protein, 21 aa, Mycobacterium
GRDPRGGNVDTTINPRVQQTG

SEQ ID NO: 1084684 - protein, 6 aa, Mycobacterium
GREQTL

SEQ ID NO: 1084685 - protein, 10 aa, Mycobacterium
GRGWETDGGD

SEQ ID NO: 1084686 - protein, 5 aa, Mycobacterium
GRPET

SEQ ID NO: 1084687 - protein, 8 aa, Mycobacterium
GRRQSYPP

SEQ ID NO: 1084688 - protein, 4 aa, Mycobacterium
GRSD

SEQ ID NO: 1084689 - protein, 15 aa, Mycobacterium
GRSRATTSLGPAVDP

SEQ ID NO: 1084690 - protein, 20 aa, Mycobacterium
GRTSADDLASSTPQVPNIVD

SEQ ID NO: 1084691 - protein, 17 aa, Mycobacterium
GSAPPRCPGGTGRGVRC

SEQ ID NO: 1084692 - protein, 4 aa, Mycobacterium
GSDC

SEQ ID NO: 1084693 - protein, 9 aa, Mycobacterium
GSDLPSSAQ

SEQ ID NO: 1084694 - protein, 40 aa, Mycobacterium
GSDVNRGHTATTSISGKSADTAACGGKRTMTAEGSTAQQN

SEQ ID NO: 1084695 - protein, 6 aa, Mycobacterium
GSGESE

SEQ ID NO: 1084696 - protein, 11 aa, Mycobacterium
GSGSEKSEIEE

SEQ ID NO: 1084697 - protein, 22 aa, Mycobacterium
GSIASDYASNPGASADPNIPVP

SEQ ID NO: 1084698 - protein, 9 aa, Mycobacterium
GSKPDSEST

SEQ ID NO: 1084699 - protein, 6 aa, Mycobacterium
GSLKSS

SEQ ID NO: 1084700 - protein, 14 aa, Mycobacterium
GSPAASTPDVGPSQ

SEQ ID NO: 1084701 - protein, 10 aa, Mycobacterium
GSPKGYTHPA

SEQ ID NO: 1084702 - protein, 12 aa, Mycobacterium
GSPTSAVSPPSY

SEQ ID NO: 1084703 - protein, 23 aa, Mycobacterium
GSSGSGGLGRGGEQEGPLSPEKV

SEQ ID NO: 1084704 - protein, 10 aa, Mycobacterium
GSSKPPGSPV

SEQ ID NO: 1084705 - protein, 12 aa, Mycobacterium
GTAGNAKAAGYE

SEQ ID NO: 1084706 - protein, 8 aa, Mycobacterium
GTAGTRGL

SEQ ID NO: 1084707 - protein, 8 aa, Mycobacterium
GTASAARD

SEQ ID NO: 1084708 - protein, 5 aa, Mycobacterium
GTASV

SEQ ID NO: 1084709 - protein, 5 aa, Mycobacterium
GTELG

SEQ ID NO: 1084710 - protein, 5 aa, Mycobacterium
GTGFP

SEQ ID NO: 1084711 - protein, 14 aa, Mycobacterium
GTKPGTEVPPVSDG

SEQ ID NO: 1084712 - protein, 6 aa, Mycobacterium
GTNGCE

SEQ ID NO: 1084713 - protein, 10 aa, Mycobacterium
GTNGTAVASE

SEQ ID NO: 1084714 - protein, 8 aa, Mycobacterium
GTPGPADV

SEQ ID NO: 1084715 - protein, 6 aa, Mycobacterium
GTPPRL

SEQ ID NO: 1084716 - protein, 10 aa, Mycobacterium
GTPSGRSGAA

SEQ ID NO: 1084717 - protein, 6 aa, Mycobacterium
GTRINQ

SEQ ID NO: 1084718 - protein, 10 aa, Mycobacterium
GTRSGRPALR

SEQ ID NO: 1084719 - protein, 13 aa, Mycobacterium
GTSLDDQVLIALA

SEQ ID NO: 1084720 - protein, 5 aa, Mycobacterium
GVEGA

SEQ ID NO: 1084721 - protein, 11 aa, Mycobacterium
GVNSDAPARGL

SEQ ID NO: 1084722 - protein, 6 aa, Mycobacterium
GVPDTY

SEQ ID NO: 1084723 - protein, 12 aa, Mycobacterium
GVPNSSAPQAIG

SEQ ID NO: 1084724 - protein, 42 aa, Mycobacterium
GVPSENANATKNGNTYQITGTASGVDNTGQQIHKSFEIEVTC

SEQ ID NO: 1084725 - protein, 13 aa, Mycobacterium
GVQAGKSDRLTSG

SEQ ID NO: 1084726 - protein, 7 aa, Mycobacterium
GVTTNPS

SEQ ID NO: 1084727 - protein, 7 aa, Mycobacterium
GYDPDTF

SEQ ID NO: 1084728 - protein, 6 aa, Mycobacterium
GYQTAN

SEQ ID NO: 1084729 - protein, 4 aa, Mycobacterium
GYRI

SEQ ID NO: 1084730 - protein, 10 aa, Mycobacterium
HAADEDDAEV

SEQ ID NO: 1084731 - protein, 11 aa, Mycobacterium
HAGKGPGGASV

SEQ ID NO: 1084732 - protein, 10 aa, Mycobacterium
HANSGKNKAF

SEQ ID NO: 1084733 - protein, 5 aa, Mycobacterium
HASTK

SEQ ID NO: 1084734 - protein, 9 aa, Mycobacterium
HAVDSRGGK

SEQ ID NO: 1084735 - protein, 7 aa, Mycobacterium
HCPKDKL

SEQ ID NO: 1084736 - protein, 4 aa, Mycobacterium
HDPD

SEQ ID NO: 1084737 - protein, 4 aa, Mycobacterium
HGET

SEQ ID NO: 1084738 - protein, 6 aa, Mycobacterium
HGNDDA

SEQ ID NO: 1084739 - protein, 24 aa, Mycobacterium
HKHDTASSTASNSLTATKTPAVTP

SEQ ID NO: 1084740 - protein, 6 aa, Mycobacterium
HLQPGD

SEQ ID NO: 1084741 - protein, 4 aa, Mycobacterium
HNAG

SEQ ID NO: 1084742 - protein, 18 aa, Mycobacterium
HNQPAGHGIAVSSRLAPV

SEQ ID NO: 1084743 - protein, 7 aa, Mycobacterium
HPADGRR

SEQ ID NO: 1084744 - protein, 6 aa, Mycobacterium
HPAGDA

SEQ ID NO: 1084745 - protein, 10 aa, Mycobacterium
HPDDARLGPP

SEQ ID NO: 1084746 - protein, 4 aa, Mycobacterium
HPNA

SEQ ID NO: 1084747 - protein, 14 aa, Mycobacterium
HRHRPPSGHGIADS

SEQ ID NO: 1084748 - protein, 9 aa, Mycobacterium
HSDTDLSSA

SEQ ID NO: 1084749 - protein, 9 aa, Mycobacterium
HTGRYRGQA

SEQ ID NO: 1084750 - protein, 10 aa, Mycobacterium
HTGSPVPSAP

SEQ ID NO: 1084751 - protein, 13 aa, Mycobacterium
IAGKPNWVGALRR

SEQ ID NO: 1084752 - protein, 9 aa, Mycobacterium
IARNPGPLP

SEQ ID NO: 1084753 - protein, 11 aa, Mycobacterium
IDPPPSIQTSM

SEQ ID NO: 1084754 - protein, 9 aa, Mycobacterium
IDPSVSSIQ

SEQ ID NO: 1084755 - protein, 7 aa, Mycobacterium
IEQPPVL

SEQ ID NO: 1084756 - protein, 20 aa, Mycobacterium
IEREHRDADTPAALAGPREH

SEQ ID NO: 1084757 - protein, 9 aa, Mycobacterium
IETEEQSVN

SEQ ID NO: 1084758 - protein, 5 aa, Mycobacterium
IGPVD

SEQ ID NO: 1084759 - protein, 6 aa, Mycobacterium
IGQNGL

SEQ ID NO: 1084760 - protein, 7 aa, Mycobacterium
IGTDSAA

SEQ ID NO: 1084761 - protein, 16 aa, Mycobacterium
INPGGTGGSGGAGGSR

SEQ ID NO: 1084762 - protein, 10 aa, Mycobacterium
IPTGPAASHI

SEQ ID NO: 1084763 - protein, 17 aa, Mycobacterium
IPTPPGWSPYSNPNITP

SEQ ID NO: 1084764 - protein, 4 aa, Mycobacterium
IQVT

SEQ ID NO: 1084765 - protein, 11 aa, Mycobacterium
IRGNSDMSPQM

SEQ ID NO: 1084766 - protein, 9 aa, Mycobacterium
IRPGANDRQ

SEQ ID NO: 1084767 - protein, 25 aa, Mycobacterium
IRPGTSGSATADVSVSGPKLNPPVT

SEQ ID NO: 1084768 - protein, 7 aa, Mycobacterium
IRQRADG

SEQ ID NO: 1084769 - protein, 5 aa, Mycobacterium
ISATA

SEQ ID NO: 1084770 - protein, 7 aa, Mycobacterium
ITPPGYR

SEQ ID NO: 1084771 - protein, 4 aa, Mycobacterium
ITPT

SEQ ID NO: 1084772 - protein, 11 aa, Mycobacterium
ITSPDEPEAAV

SEQ ID NO: 1084773 - protein, 7 aa, Mycobacterium
ITSPNNM

SEQ ID NO: 1084774 - protein, 30 aa, Mycobacterium
IYPQSHDHHGSSRRSRDSPRCTVMSAGYAR

SEQ ID NO: 1084775 - protein, 9 aa, Mycobacterium
KAAEAGRDL

SEQ ID NO: 1084776 - protein, 7 aa, Mycobacterium
KAEASMT

SEQ ID NO: 1084777 - protein, 8 aa, Mycobacterium
KAGRPTPE

SEQ ID NO: 1084778 - protein, 8 aa, Mycobacterium
KASESSRV

SEQ ID NO: 1084779 - protein, 8 aa, Mycobacterium
KDAGDHAQ

SEQ ID NO: 1084780 - protein, 7 aa, Mycobacterium
KDGRHSI

SEQ ID NO: 1084781 - protein, 8 aa, Mycobacterium
KDSDAPDT

SEQ ID NO: 1084782 - protein, 6 aa, Mycobacterium
KGIGAG

SEQ ID NO: 1084783 - protein, 6 aa, Mycobacterium
KGQQRR

SEQ ID NO: 1084784 - protein, 12 aa, Mycobacterium
KGSLAAGPALSA

SEQ ID NO: 1084785 - protein, 4 aa, Mycobacterium
KKDL

SEQ ID NO: 1084786 - protein, 7 aa, Mycobacterium
KLPGQTW

SEQ ID NO: 1084787 - protein, 9 aa, Mycobacterium
KLPRSSGEM

SEQ ID NO: 1084788 - protein, 9 aa, Mycobacterium
KNLEPQDSR

SEQ ID NO: 1084789 - protein, 6 aa, Mycobacterium
KPAAVA

SEQ ID NO: 1084790 - protein, 4 aa, Mycobacterium
KPGI

SEQ ID NO: 1084791 - protein, 12 aa, Mycobacterium
KPPAPNNHYSTP

SEQ ID NO: 1084792 - protein, 7 aa, Mycobacterium
KPPLDPA

SEQ ID NO: 1084793 - protein, 6 aa, Mycobacterium
KPPYKL

SEQ ID NO: 1084794 - protein, 10 aa, Mycobacterium
KQGRTTGNSC

SEQ ID NO: 1084795 - protein, 10 aa, Mycobacterium
KQMKADREKR

SEQ ID NO: 1084796 - protein, 7 aa, Mycobacterium
KRGIDPE

SEQ ID NO: 1084797 - protein, 6 aa, Mycobacterium
KRGRPS

SEQ ID NO: 1084798 - protein, 18 aa, Mycobacterium
KRQASPGHAFGPDTPWQA

SEQ ID NO: 1084799 - protein, 5 aa, Mycobacterium
KSNVA

SEQ ID NO: 1084800 - protein, 20 aa, Mycobacterium
KSRNTEPANASMVMSGRPTP

SEQ ID NO: 1084801 - protein, 17 aa, Mycobacterium
KSSADGRVPKRPRLEPV

SEQ ID NO: 1084802 - protein, 16 aa, Mycobacterium
KSSTTTTTTPDKPIPL

SEQ ID NO: 1084803 - protein, 12 aa, Mycobacterium
KSTTPFDMTITL

SEQ ID NO: 1084804 - protein, 8 aa, Mycobacterium
KTGEAEFV

SEQ ID NO: 1084805 - protein, 7 aa, Mycobacterium
KTKPGEV

SEQ ID NO: 1084806 - protein, 16 aa, Mycobacterium
KTVSYNPTGSGAGREQ

SEQ ID NO: 1084807 - protein, 6 aa, Mycobacterium
KVGPIG

SEQ ID NO: 1084808 - protein, 6 aa, Mycobacterium
KVPANA

SEQ ID NO: 1084809 - protein, 11 aa, Mycobacterium
KVSKSLPEGMR

SEQ ID NO: 1084810 - protein, 12 aa, Mycobacterium
KVTQQKGAIPGV

SEQ ID NO: 1084811 - protein, 5 aa, Mycobacterium
KYPTT

SEQ ID NO: 1084812 - protein, 5 aa, Mycobacterium
LAAEE

SEQ ID NO: 1084813 - protein, 5 aa, Mycobacterium
LAAPI

SEQ ID NO: 1084814 - protein, 24 aa, Mycobacterium
LADASTGTARGTAAARNTYVLLSI

SEQ ID NO: 1084815 - protein, 8 aa, Mycobacterium
LADGQRGP

SEQ ID NO: 1084816 - protein, 10 aa, Mycobacterium
LAHDTDKTIA

SEQ ID NO: 1084817 - protein, 6 aa, Mycobacterium
LANERK

SEQ ID NO: 1084818 - protein, 8 aa, Mycobacterium
LAPHGSGT

SEQ ID NO: 1084819 - protein, 17 aa, Mycobacterium
LAPRDSPITKPSDLSNK

SEQ ID NO: 1084820 - protein, 6 aa, Mycobacterium
LASGDV

SEQ ID NO: 1084821 - protein, 8 aa, Mycobacterium
LATPGSVS

SEQ ID NO: 1084822 - protein, 5 aa, Mycobacterium
LDASN

SEQ ID NO: 1084823 - protein, 5 aa, Mycobacterium
LDEAT

SEQ ID NO: 1084824 - protein, 9 aa, Mycobacterium
LDGDDTAAL

SEQ ID NO: 1084825 - protein, 6 aa, Mycobacterium
LDGQPG

SEQ ID NO: 1084826 - protein, 7 aa, Mycobacterium
LDGTAKG

SEQ ID NO: 1084827 - protein, 11 aa, Mycobacterium
LDPAKARALAN

SEQ ID NO: 1084828 - protein, 10 aa, Mycobacterium
LDPGTDGTYP

SEQ ID NO: 1084829 - protein, 13 aa, Mycobacterium
LDPTGYLNAAVLF

SEQ ID NO: 1084830 - protein, 18 aa, Mycobacterium
LEPNSSSTVPCARSSWSG

SEQ ID NO: 1084831 - protein, 13 aa, Mycobacterium
LEPPYKGGPALGD

SEQ ID NO: 1084832 - protein, 6 aa, Mycobacterium
LEPSTG

SEQ ID NO: 1084833 - protein, 13 aa, Mycobacterium
LEQDNPKPGSFTK

SEQ ID NO: 1084834 - protein, 6 aa, Mycobacterium
LFPPGS

SEQ ID NO: 1084835 - protein, 9 aa, Mycobacterium
LGEGPDDLA

SEQ ID NO: 1084836 - protein, 4 aa, Mycobacterium
LGER

SEQ ID NO: 1084837 - protein, 9 aa, Mycobacterium
LGGPPEKIE

SEQ ID NO: 1084838 - protein, 14 aa, Mycobacterium
LGPAAKRCKGNPAW

SEQ ID NO: 1084839 - protein, 9 aa, Mycobacterium
LGPDPKSAV

SEQ ID NO: 1084840 - protein, 13 aa, Mycobacterium
LGPTKEQPKGPFG

SEQ ID NO: 1084841 - protein, 13 aa, Mycobacterium
LGQNTPVIAAVEG

SEQ ID NO: 1084842 - protein, 12 aa, Mycobacterium
LGRRHTKQRYNR

SEQ ID NO: 1084843 - protein, 7 aa, Mycobacterium
LGSGSIQ

SEQ ID NO: 1084844 - protein, 7 aa, Mycobacterium
LGSNASD

SEQ ID NO: 1084845 - protein, 6 aa, Mycobacterium
LGSSHT

SEQ ID NO: 1084846 - protein, 8 aa, Mycobacterium
LGTVTQGE

SEQ ID NO: 1084847 - protein, 12 aa, Mycobacterium
LHGDGGPASGRG

SEQ ID NO: 1084848 - protein, 7 aa, Mycobacterium
LKPTPEV

SEQ ID NO: 1084849 - protein, 5 aa, Mycobacterium
LKTPV

SEQ ID NO: 1084850 - protein, 8 aa, Mycobacterium
LLNGSDER

SEQ ID NO: 1084851 - protein, 15 aa, Mycobacterium
LLPTTQQAIQLSSPR

SEQ ID NO: 1084852 - protein, 5 aa, Mycobacterium
LNAEG

SEQ ID NO: 1084853 - protein, 5 aa, Mycobacterium
LNDPQ

SEQ ID NO: 1084854 - protein, 6 aa, Mycobacterium
LNEGRG

SEQ ID NO: 1084855 - protein, 6 aa, Mycobacterium
LNSPEG

SEQ ID NO: 1084856 - protein, 9 aa, Mycobacterium
LPAPSRVGA

SEQ ID NO: 1084857 - protein, 6 aa, Mycobacterium
LPDEPW

SEQ ID NO: 1084858 - protein, 5 aa, Mycobacterium
LPDMP

SEQ ID NO: 1084859 - protein, 27 aa, Mycobacterium
LPGAPVSSEAQPGDPNAPSLDPNAPYP

SEQ ID NO: 1084860 - protein, 6 aa, Mycobacterium
LPKEKI

SEQ ID NO: 1084861 - protein, 6 aa, Mycobacterium
LPMGGG

SEQ ID NO: 1084862 - protein, 17 aa, Mycobacterium
LPNSSHDWAEASGNHAQ

SEQ ID NO: 1084863 - protein, 30 aa, Mycobacterium
LPPVSGPAPAGPAAVTAGRAADGTLEGDHY

SEQ ID NO: 1084864 - protein, 16 aa, Mycobacterium
LPQDPAPAADVPTAAE

SEQ ID NO: 1084865 - protein, 20 aa, Mycobacterium
LPRDPRSAQPWNPEPLAGNY

SEQ ID NO: 1084866 - protein, 7 aa, Mycobacterium
LPSSPRQ

SEQ ID NO: 1084867 - protein, 5 aa, Mycobacterium
LPTNG

SEQ ID NO: 1084868 - protein, 31 aa, Mycobacterium
LPVQPADRIDTGELPAVGDDATVPRDSPRHT

SEQ ID NO: 1084869 - protein, 29 aa, Mycobacterium
LQAGATTSDQLTAEPTIPLPGSTATLENY

SEQ ID NO: 1084870 - protein, 7 aa, Mycobacterium
LQDGRRR

SEQ ID NO: 1084871 - protein, 13 aa, Mycobacterium
LQPGDRVNTTSGL

SEQ ID NO: 1084872 - protein, 6 aa, Mycobacterium
LQTPKA

SEQ ID NO: 1084873 - protein, 21 aa, Mycobacterium
LQTPPGPPTAYDEHPVPPPIG

SEQ ID NO: 1084874 - protein, 8 aa, Mycobacterium
LRDEKRDL

SEQ ID NO: 1084875 - protein, 22 aa, Mycobacterium
LRPEPANADYQRRIEEGASVPA

SEQ ID NO: 1084876 - protein, 18 aa, Mycobacterium
LRPGDSLPLGQSTTPYQS

SEQ ID NO: 1084877 - protein, 10 aa, Mycobacterium
LRPNKGTKDQ

SEQ ID NO: 1084878 - protein, 22 aa, Mycobacterium
LRQPGVATKQLGGADVALAVLC

SEQ ID NO: 1084879 - protein, 9 aa, Mycobacterium
LSADGSTVY

SEQ ID NO: 1084880 - protein, 9 aa, Mycobacterium
LSAKSDGSK

SEQ ID NO: 1084881 - protein, 5 aa, Mycobacterium
LSPDE

SEQ ID NO: 1084882 - protein, 11 aa, Mycobacterium
LSRGDDTGLGP

SEQ ID NO: 1084883 - protein, 21 aa, Mycobacterium
LSSGPSASDRSGSYTASSGIT

SEQ ID NO: 1084884 - protein, 8 aa, Mycobacterium
LSSPSDVT

SEQ ID NO: 1084885 - protein, 12 aa, Mycobacterium
LSSTQGWQRNPE

SEQ ID NO: 1084886 - protein, 9 aa, Mycobacterium
LSTTDPHSR

SEQ ID NO: 1084887 - protein, 9 aa, Mycobacterium
LTAEARSGV

SEQ ID NO: 1084888 - protein, 16 aa, Mycobacterium
LTASKRKFDEQRDEVN

SEQ ID NO: 1084889 - protein, 4 aa, Mycobacterium
LTND

SEQ ID NO: 1084890 - protein, 11 aa, Mycobacterium
LTPLSTSSLAG

SEQ ID NO: 1084891 - protein, 17 aa, Mycobacterium
LTQNPTAPIASKNLATS

SEQ ID NO: 1084892 - protein, 9 aa, Mycobacterium
LTQSPGDVA

SEQ ID NO: 1084893 - protein, 6 aa, Mycobacterium
LTTGDL

SEQ ID NO: 1084894 - protein, 13 aa, Mycobacterium
MDTPANSVRGSRN

SEQ ID NO: 1084895 - protein, 11 aa, Mycobacterium
MESSEGRKKYA

SEQ ID NO: 1084896 - protein, 9 aa, Mycobacterium
MKNPADSAL

SEQ ID NO: 1084897 - protein, 17 aa, Mycobacterium
MNGPSGSYLTATSPDDI

SEQ ID NO: 1084898 - protein, 8 aa, Mycobacterium
MQGQQVGP

SEQ ID NO: 1084899 - protein, 12 aa, Mycobacterium
MSGRSSPEGEKL

SEQ ID NO: 1084900 - protein, 9 aa, Mycobacterium
MTSPKCTPR

SEQ ID NO: 1084901 - protein, 7 aa, Mycobacterium
MTTLGGR

SEQ ID NO: 1084902 - protein, 13 aa, Mycobacterium
NAGANADGPLATT

SEQ ID NO: 1084903 - protein, 5 aa, Mycobacterium
NANRE

SEQ ID NO: 1084904 - protein, 26 aa, Mycobacterium
NAPGPRRSVTTDGPVDGARTDDPARP

SEQ ID NO: 1084905 - protein, 8 aa, Mycobacterium
NARNFSEA

SEQ ID NO: 1084906 - protein, 12 aa, Mycobacterium
NARREIYGILGE

SEQ ID NO: 1084907 - protein, 7 aa, Mycobacterium
NATRDSG

SEQ ID NO: 1084908 - protein, 5 aa, Mycobacterium
NAVAA

SEQ ID NO: 1084909 - protein, 4 aa, Mycobacterium
NDNL

SEQ ID NO: 1084910 - protein, 8 aa, Mycobacterium
NEGAMTPG

SEQ ID NO: 1084911 - protein, 16 aa, Mycobacterium
NEYPTDQYPPNDPKLK

SEQ ID NO: 1084912 - protein, 7 aa, Mycobacterium
NFTPKSK

SEQ ID NO: 1084913 - protein, 8 aa, Mycobacterium
NGDSNDVV

SEQ ID NO: 1084914 - protein, 4 aa, Mycobacterium
NGHA

SEQ ID NO: 1084915 - protein, 6 aa, Mycobacterium
NGPATE

SEQ ID NO: 1084916 - protein, 8 aa, Mycobacterium
NGRDQASR

SEQ ID NO: 1084917 - protein, 8 aa, Mycobacterium
NGSVVETG

SEQ ID NO: 1084918 - protein, 7 aa, Mycobacterium
NGTAKEI

SEQ ID NO: 1084919 - protein, 10 aa, Mycobacterium
NGTGKTTTVG

SEQ ID NO: 1084920 - protein, 8 aa, Mycobacterium
NGVETGRL

SEQ ID NO: 1084921 - protein, 35 aa, Mycobacterium
NGVYGQTREAKRASLVRTGDSAEDAAAQGTEAGRE

SEQ ID NO: 1084922 - protein, 10 aa, Mycobacterium
NHPPQTTRAR

SEQ ID NO: 1084923 - protein, 14 aa, Mycobacterium
NKNNRPGAGFVPQP

SEQ ID NO: 1084924 - protein, 6 aa, Mycobacterium
NNAEVT

SEQ ID NO: 1084925 - protein, 7 aa, Mycobacterium
NNDNGRQ

SEQ ID NO: 1084926 - protein, 6 aa, Mycobacterium
NNELGA

SEQ ID NO: 1084927 - protein, 8 aa, Mycobacterium
NPATTSTL

SEQ ID NO: 1084928 - protein, 13 aa, Mycobacterium
NPAVPNVGDAQRS

SEQ ID NO: 1084929 - protein, 10 aa, Mycobacterium
NPEPTPLTKN

SEQ ID NO: 1084930 - protein, 6 aa, Mycobacterium
NPGNGE

SEQ ID NO: 1084931 - protein, 11 aa, Mycobacterium
NPLRAKPSLEA

SEQ ID NO: 1084932 - protein, 24 aa, Mycobacterium
NPRFATNSGARPQGAAATTTPAAG

SEQ ID NO: 1084933 - protein, 14 aa, Mycobacterium
NPVLPTAKAAEDQT

SEQ ID NO: 1084934 - protein, 8 aa, Mycobacterium
NQATPLTT

SEQ ID NO: 1084935 - protein, 5 aa, Mycobacterium
NQLSR

SEQ ID NO: 1084936 - protein, 6 aa, Mycobacterium
NQPPPC

SEQ ID NO: 1084937 - protein, 9 aa, Mycobacterium
NREKPEVDA

SEQ ID NO: 1084938 - protein, 9 aa, Mycobacterium
NRGAATAED

SEQ ID NO: 1084939 - protein, 8 aa, Mycobacterium
NRGGGNVP

SEQ ID NO: 1084940 - protein, 9 aa, Mycobacterium
NRNDHLGAA

SEQ ID NO: 1084941 - protein, 6 aa, Mycobacterium
NRRAHG

SEQ ID NO: 1084942 - protein, 5 aa, Mycobacterium
NRSIA

SEQ ID NO: 1084943 - protein, 6 aa, Mycobacterium
NSGPIL

SEQ ID NO: 1084944 - protein, 26 aa, Mycobacterium
NSIDNGPSQSCKPRAERAVNYAGQQN

SEQ ID NO: 1084945 - protein, 10 aa, Mycobacterium
NSLESTSGHF

SEQ ID NO: 1084946 - protein, 10 aa, Mycobacterium
NSPQASTGGG

SEQ ID NO: 1084947 - protein, 8 aa, Mycobacterium
NSQLPQAR

SEQ ID NO: 1084948 - protein, 23 aa, Mycobacterium
NSSETRQWDSDSASPSHVDQKHR

SEQ ID NO: 1084949 - protein, 13 aa, Mycobacterium
NSTELPGARAALG

SEQ ID NO: 1084950 - protein, 10 aa, Mycobacterium
NTDSAGNSYG

SEQ ID NO: 1084951 - protein, 8 aa, Mycobacterium
NTGNGYYG

SEQ ID NO: 1084952 - protein, 10 aa, Mycobacterium
NTIDATGVGT

SEQ ID NO: 1084953 - protein, 5 aa, Mycobacterium
NTPHY

SEQ ID NO: 1084954 - protein, 11 aa, Mycobacterium
NTTSTSPLTKN

SEQ ID NO: 1084955 - protein, 10 aa, Mycobacterium
NTVNTMPETT

SEQ ID NO: 1084956 - protein, 9 aa, Mycobacterium
NVDAEPGRI

SEQ ID NO: 1084957 - protein, 9 aa, Mycobacterium
PAAAPGLGL

SEQ ID NO: 1084958 - protein, 6 aa, Mycobacterium
PAAGAL

SEQ ID NO: 1084959 - protein, 5 aa, Mycobacterium
PAEIN

SEQ ID NO: 1084960 - protein, 7 aa, Mycobacterium
PAGAQLS

SEQ ID NO: 1084961 - protein, 9 aa, Mycobacterium
PAPLENTPV

SEQ ID NO: 1084962 - protein, 12 aa, Mycobacterium
PAPTSPEPEGLP

SEQ ID NO: 1084963 - protein, 12 aa, Mycobacterium
PAQIQSSVEPTY

SEQ ID NO: 1084964 - protein, 4 aa, Mycobacterium
PARV

SEQ ID NO: 1084965 - protein, 9 aa, Mycobacterium
PASTAGSLG

SEQ ID NO: 1084966 - protein, 11 aa, Mycobacterium
PAVPPTMPAPA

SEQ ID NO: 1084967 - protein, 7 aa, Mycobacterium
PCGRQSR

SEQ ID NO: 1084968 - protein, 16 aa, Mycobacterium
PDGDEVLGSATIASMS

SEQ ID NO: 1084969 - protein, 9 aa, Mycobacterium
PDGSVAQTL

SEQ ID NO: 1084970 - protein, 7 aa, Mycobacterium
PDIEPIQ

SEQ ID NO: 1084971 - protein, 4 aa, Mycobacterium
PDMD

SEQ ID NO: 1084972 - protein, 8 aa, Mycobacterium
PDPGPGEA

SEQ ID NO: 1084973 - protein, 53 aa, Mycobacterium
PDPNGTRFPNGAPPPAPPVLEGTPENPGPAVPPGSPCSYTPAHPGGNNTIGDE

SEQ ID NO: 1084974 - protein, 19 aa, Mycobacterium
PEAPTTSLATTAGATVPSV

SEQ ID NO: 1084975 - protein, 10 aa, Mycobacterium
PEERSSTAES

SEQ ID NO: 1084976 - protein, 18 aa, Mycobacterium
PEGIAAGDYTTAAEDKPT

SEQ ID NO: 1084977 - protein, 6 aa, Mycobacterium
PEGTES

SEQ ID NO: 1084978 - protein, 13 aa, Mycobacterium
PEKIGHDDEPKFD

SEQ ID NO: 1084979 - protein, 13 aa, Mycobacterium
PEPASGQPARIPV

SEQ ID NO: 1084980 - protein, 6 aa, Mycobacterium
PEPETL

SEQ ID NO: 1084981 - protein, 6 aa, Mycobacterium
PEPPPI

SEQ ID NO: 1084982 - protein, 11 aa, Mycobacterium
PETSVAGEPIT

SEQ ID NO: 1084983 - protein, 7 aa, Mycobacterium
PGAPTAG

SEQ ID NO: 1084984 - protein, 6 aa, Mycobacterium
PGGGQH

SEQ ID NO: 1084985 - protein, 8 aa, Mycobacterium
PGGPGASA

SEQ ID NO: 1084986 - protein, 5 aa, Mycobacterium
PGGSQ

SEQ ID NO: 1084987 - protein, 20 aa, Mycobacterium
PGKRAASPRECRDSKPYVPL

SEQ ID NO: 1084988 - protein, 14 aa, Mycobacterium
PGLTGDDPASLSPA

SEQ ID NO: 1084989 - protein, 4 aa, Mycobacterium
PGPR

SEQ ID NO: 1084990 - protein, 5 aa, Mycobacterium
PGTHG

SEQ ID NO: 1084991 - protein, 12 aa, Mycobacterium
PGYAPGQNKNAD

SEQ ID NO: 1084992 - protein, 10 aa, Mycobacterium
PHAPDTHSPL

SEQ ID NO: 1084993 - protein, 8 aa, Mycobacterium
PHDDKQVA

SEQ ID NO: 1084994 - protein, 11 aa, Mycobacterium
PHRASAMSASA

SEQ ID NO: 1084995 - protein, 12 aa, Mycobacterium
PHSRGLGSSAAA

SEQ ID NO: 1084996 - protein, 5 aa, Mycobacterium
PIDTT

SEQ ID NO: 1084997 - protein, 12 aa, Mycobacterium
PIPASVSAPAPV

SEQ ID NO: 1084998 - protein, 10 aa, Mycobacterium
PIPTPDSSSG

SEQ ID NO: 1084999 - protein, 9 aa, Mycobacterium
PKTAETASE

SEQ ID NO: 1085000 - protein, 9 aa, Mycobacterium
PKTSVQPAD

SEQ ID NO: 1085001 - protein, 9 aa, Mycobacterium
PLPAATGYP

SEQ ID NO: 1085002 - protein, 5 aa, Mycobacterium
PLPGR

SEQ ID NO: 1085003 - protein, 13 aa, Mycobacterium
PLPPSSRSIEDPE

SEQ ID NO: 1085004 - protein, 4 aa, Mycobacterium
PLRP

SEQ ID NO: 1085005 - protein, 10 aa, Mycobacterium
PLSHRNTQPG

SEQ ID NO: 1085006 - protein, 26 aa, Mycobacterium
PMNSSGKPLRAKPQGSSTLMSQEGSV

SEQ ID NO: 1085007 - protein, 8 aa, Mycobacterium
PNAGRITN

SEQ ID NO: 1085008 - protein, 18 aa, Mycobacterium
PNDTGITNAPIGSTQGRI

SEQ ID NO: 1085009 - protein, 11 aa, Mycobacterium
PNNEKAGSGIA

SEQ ID NO: 1085010 - protein, 10 aa, Mycobacterium
PNNPGAATPL

SEQ ID NO: 1085011 - protein, 17 aa, Mycobacterium
PNPSRRGNLSASTLGLL

SEQ ID NO: 1085012 - protein, 12 aa, Mycobacterium
PPAPTLVQCCRR

SEQ ID NO: 1085013 - protein, 13 aa, Mycobacterium
PPASRGRPGPLSG

SEQ ID NO: 1085014 - protein, 8 aa, Mycobacterium
PPDREKTL

SEQ ID NO: 1085015 - protein, 4 aa, Mycobacterium
PPDY

SEQ ID NO: 1085016 - protein, 5 aa, Mycobacterium
PPEGR

SEQ ID NO: 1085017 - protein, 5 aa, Mycobacterium
PPGVD

SEQ ID NO: 1085018 - protein, 12 aa, Mycobacterium
PPLNPVQAGPSV

SEQ ID NO: 1085019 - protein, 5 aa, Mycobacterium
PPQPV

SEQ ID NO: 1085020 - protein, 16 aa, Mycobacterium
PPSWAAPSSGSASALS

SEQ ID NO: 1085021 - protein, 6 aa, Mycobacterium
PPWQGG

SEQ ID NO: 1085022 - protein, 10 aa, Mycobacterium
PQDAGNQGVS

SEQ ID NO: 1085023 - protein, 7 aa, Mycobacterium
PQEQASM

SEQ ID NO: 1085024 - protein, 7 aa, Mycobacterium
PQGALSA

SEQ ID NO: 1085025 - protein, 14 aa, Mycobacterium
PQREEEEFKSMTPA

SEQ ID NO: 1085026 - protein, 7 aa, Mycobacterium
PQSPVSL

SEQ ID NO: 1085027 - protein, 7 aa, Mycobacterium
PQSTSIA

SEQ ID NO: 1085028 - protein, 7 aa, Mycobacterium
PQVGGEA

SEQ ID NO: 1085029 - protein, 10 aa, Mycobacterium
PRAGSSGGTL

SEQ ID NO: 1085030 - protein, 10 aa, Mycobacterium
PRGVGHSTPA

SEQ ID NO: 1085031 - protein, 5 aa, Mycobacterium
PRKGQ

SEQ ID NO: 1085032 - protein, 20 aa, Mycobacterium
PRNEKIAGAANTGRLLAAIL

SEQ ID NO: 1085033 - protein, 7 aa, Mycobacterium
PRNGHTL

SEQ ID NO: 1085034 - protein, 7 aa, Mycobacterium
PRSSSAG

SEQ ID NO: 1085035 - protein, 21 aa, Mycobacterium
PRTSESRMQPNPRTQPDTVQQ

SEQ ID NO: 1085036 - protein, 16 aa, Mycobacterium
PSAGAEPGAQAHLPTG

SEQ ID NO: 1085037 - protein, 6 aa, Mycobacterium
PSGSGK

SEQ ID NO: 1085038 - protein, 11 aa, Mycobacterium
PSLGKGGNDGA

SEQ ID NO: 1085039 - protein, 10 aa, Mycobacterium
PSPVDSSDQV

SEQ ID NO: 1085040 - protein, 12 aa, Mycobacterium
PSPVTDSRHAAR

SEQ ID NO: 1085041 - protein, 14 aa, Mycobacterium
PSRVGSYQRRGSRP

SEQ ID NO: 1085042 - protein, 7 aa, Mycobacterium
PSSIDGL

SEQ ID NO: 1085043 - protein, 8 aa, Mycobacterium
PSSTNYNG

SEQ ID NO: 1085044 - protein, 5 aa, Mycobacterium
PSTGQ

SEQ ID NO: 1085045 - protein, 13 aa, Mycobacterium
PSVTSRHISGTKH

SEQ ID NO: 1085046 - protein, 11 aa, Mycobacterium
PTASAKPAAKH

SEQ ID NO: 1085047 - protein, 5 aa, Mycobacterium
PTDSH

SEQ ID NO: 1085048 - protein, 14 aa, Mycobacterium
PTLPAPQQTPTHRA

SEQ ID NO: 1085049 - protein, 15 aa, Mycobacterium
PTLPQVPSANVPGDP

SEQ ID NO: 1085050 - protein, 16 aa, Mycobacterium
PTMGTGALTSGDASEA

SEQ ID NO: 1085051 - protein, 13 aa, Mycobacterium
PTNKITGTVPTSS

SEQ ID NO: 1085052 - protein, 4 aa, Mycobacterium
PTPD

SEQ ID NO: 1085053 - protein, 11 aa, Mycobacterium
PTRVEGDSTPI

SEQ ID NO: 1085054 - protein, 5 aa, Mycobacterium
PTTAL

SEQ ID NO: 1085055 - protein, 7 aa, Mycobacterium
PTTVPGT

SEQ ID NO: 1085056 - protein, 43 aa, Mycobacterium
PTVDNGLNPAPADRLPGTPPPVSDPLSQPRSGSVQCNGQQPNT

SEQ ID NO: 1085057 - protein, 5 aa, Mycobacterium
PVATE

SEQ ID NO: 1085058 - protein, 5 aa, Mycobacterium
PVDDA

SEQ ID NO: 1085059 - protein, 25 aa, Mycobacterium
PVPPTAPRLEPGPPPTASIAGAPTS

SEQ ID NO: 1085060 - protein, 33 aa, Mycobacterium
PVPSLTGTDDPGNGLRTPGLTSPDLTNQELGTP

SEQ ID NO: 1085061 - protein, 7 aa, Mycobacterium
PVRSNGM

SEQ ID NO: 1085062 - protein, 11 aa, Mycobacterium
PVSAATSNTVT

SEQ ID NO: 1085063 - protein, 12 aa, Mycobacterium
PVTGKKFGSCPQ

SEQ ID NO: 1085064 - protein, 5 aa, Mycobacterium
PVYSA

SEQ ID NO: 1085065 - protein, 6 aa, Mycobacterium
PYLPPG

SEQ ID NO: 1085066 - protein, 17 aa, Mycobacterium
QAAARRPTEEPAISGSV

SEQ ID NO: 1085067 - protein, 9 aa, Mycobacterium
QAAPTADEV

SEQ ID NO: 1085068 - protein, 11 aa, Mycobacterium
QADPSGSQPPA

SEQ ID NO: 1085069 - protein, 9 aa, Mycobacterium
QAEPATGTV

SEQ ID NO: 1085070 - protein, 8 aa, Mycobacterium
QAKAGSGF

SEQ ID NO: 1085071 - protein, 6 aa, Mycobacterium
QAPDPI

SEQ ID NO: 1085072 - protein, 5 aa, Mycobacterium
QAPLT

SEQ ID NO: 1085073 - protein, 18 aa, Mycobacterium
QAQANRPKTRVIGPDDDP

SEQ ID NO: 1085074 - protein, 15 aa, Mycobacterium
QAQDKTDELAYTPAK

SEQ ID NO: 1085075 - protein, 10 aa, Mycobacterium
QAQGQAKAIE

SEQ ID NO: 1085076 - protein, 7 aa, Mycobacterium
QASGIDA

SEQ ID NO: 1085077 - protein, 10 aa, Mycobacterium
QASGIPPANY

SEQ ID NO: 1085078 - protein, 12 aa, Mycobacterium
QDNDEQSGQPRG

SEQ ID NO: 1085079 - protein, 13 aa, Mycobacterium
QDNTEEDCDPTAS

SEQ ID NO: 1085080 - protein, 12 aa, Mycobacterium
QDRDNMELTDPK

SEQ ID NO: 1085081 - protein, 14 aa, Mycobacterium
QEPARALGILLAAP

SEQ ID NO: 1085082 - protein, 29 aa, Mycobacterium
QEPNNPNPGASALDIPTSGVPAPAANGIT

SEQ ID NO: 1085083 - protein, 8 aa, Mycobacterium
QFREKDGR

SEQ ID NO: 1085084 - protein, 10 aa, Mycobacterium
QGCGGSPCKG

SEQ ID NO: 1085085 - protein, 22 aa, Mycobacterium
QGGSKPTLVSPDGALTAPGSVD

SEQ ID NO: 1085086 - protein, 6 aa, Mycobacterium
QGGTAG

SEQ ID NO: 1085087 - protein, 10 aa, Mycobacterium
QGSGSVAGGT

SEQ ID NO: 1085088 - protein, 6 aa, Mycobacterium
QGSREF

SEQ ID NO: 1085089 - protein, 17 aa, Mycobacterium
QGTTCQQRSVETTLEGL

SEQ ID NO: 1085090 - protein, 7 aa, Mycobacterium
QIRATGA

SEQ ID NO: 1085091 - protein, 13 aa, Mycobacterium
QKGGVGKTTSTIN

SEQ ID NO: 1085092 - protein, 6 aa, Mycobacterium
QLDDQA

SEQ ID NO: 1085093 - protein, 4 aa, Mycobacterium
QLGA

SEQ ID NO: 1085094 - protein, 9 aa, Mycobacterium
QLNQQRDDI

SEQ ID NO: 1085095 - protein, 15 aa, Mycobacterium
QLPKNTTAKIGQTSL

SEQ ID NO: 1085096 - protein, 5 aa, Mycobacterium
QLPPE

SEQ ID NO: 1085097 - protein, 6 aa, Mycobacterium
QNAATA

SEQ ID NO: 1085098 - protein, 5 aa, Mycobacterium
QNFPT

SEQ ID NO: 1085099 - protein, 7 aa, Mycobacterium
QNTPAIA

SEQ ID NO: 1085100 - protein, 5 aa, Mycobacterium
QNTTT

SEQ ID NO: 1085101 - protein, 13 aa, Mycobacterium
QPANTGFLGLRYG

SEQ ID NO: 1085102 - protein, 18 aa, Mycobacterium
QPASVGSRGRQRSSAVSV

SEQ ID NO: 1085103 - protein, 7 aa, Mycobacterium
QPETAAV

SEQ ID NO: 1085104 - protein, 6 aa, Mycobacterium
QPGDAI

SEQ ID NO: 1085105 - protein, 5 aa, Mycobacterium
QPGRS

SEQ ID NO: 1085106 - protein, 9 aa, Mycobacterium
QPIRSGDQV

SEQ ID NO: 1085107 - protein, 9 aa, Mycobacterium
QPRAPGGVG

SEQ ID NO: 1085108 - protein, 15 aa, Mycobacterium
QPTSRSRKVFEVPFQ

SEQ ID NO: 1085109 - protein, 8 aa, Mycobacterium
QQALGGDD

SEQ ID NO: 1085110 - protein, 5 aa, Mycobacterium
QRAAH

SEQ ID NO: 1085111 - protein, 7 aa, Mycobacterium
QRGTDAG

SEQ ID NO: 1085112 - protein, 9 aa, Mycobacterium
QRLADEGIG

SEQ ID NO: 1085113 - protein, 13 aa, Mycobacterium
QSAHTASADQQQR

SEQ ID NO: 1085114 - protein, 10 aa, Mycobacterium
QSASNAWDDA

SEQ ID NO: 1085115 - protein, 14 aa, Mycobacterium
QSELPREAAEYGAA

SEQ ID NO: 1085116 - protein, 10 aa, Mycobacterium
QSFGRDPETM

SEQ ID NO: 1085117 - protein, 9 aa, Mycobacterium
QSLETTKAL

SEQ ID NO: 1085118 - protein, 8 aa, Mycobacterium
QSQLDASA

SEQ ID NO: 1085119 - protein, 17 aa, Mycobacterium
QSSVSRLSSERDALASK

SEQ ID NO: 1085120 - protein, 20 aa, Mycobacterium
QTAGRGRHGRGWSASPRTQI

SEQ ID NO: 1085121 - protein, 7 aa, Mycobacterium
QTFTDRS

SEQ ID NO: 1085122 - protein, 13 aa, Mycobacterium
QTGAALSRSGRQV

SEQ ID NO: 1085123 - protein, 14 aa, Mycobacterium
QTKSDDSLKTARSA

SEQ ID NO: 1085124 - protein, 9 aa, Mycobacterium
QTLSNPSTI

SEQ ID NO: 1085125 - protein, 6 aa, Mycobacterium
QTPQGF

SEQ ID NO: 1085126 - protein, 7 aa, Mycobacterium
QTRARTD

SEQ ID NO: 1085127 - protein, 4 aa, Mycobacterium
QTRD

SEQ ID NO: 1085128 - protein, 7 aa, Mycobacterium
QTREPNV

SEQ ID NO: 1085129 - protein, 10 aa, Mycobacterium
QTSPPNPDGL

SEQ ID NO: 1085130 - protein, 7 aa, Mycobacterium
QTSSPAH

SEQ ID NO: 1085131 - protein, 6 aa, Mycobacterium
QTSTVD

SEQ ID NO: 1085132 - protein, 7 aa, Mycobacterium
QTTPGAF

SEQ ID NO: 1085133 - protein, 9 aa, Mycobacterium
QVDDSVGNR

SEQ ID NO: 1085134 - protein, 8 aa, Mycobacterium
QVKSDNAI

SEQ ID NO: 1085135 - protein, 9 aa, Mycobacterium
QVRAEAARR

SEQ ID NO: 1085136 - protein, 38 aa, Mycobacterium
QYPPSADKAAKPVKPPRAGKVPTDPATVSASMATNQGN

SEQ ID NO: 1085137 - protein, 5 aa, Mycobacterium
QYRGP

SEQ ID NO: 1085138 - protein, 10 aa, Mycobacterium
RAAPPPAATR

SEQ ID NO: 1085139 - protein, 6 aa, Mycobacterium
RADAGM

SEQ ID NO: 1085140 - protein, 11 aa, Mycobacterium
RAGDEEATNTD

SEQ ID NO: 1085141 - protein, 6 aa, Mycobacterium
RAGSIG

SEQ ID NO: 1085142 - protein, 5 aa, Mycobacterium
RALTP

SEQ ID NO: 1085143 - protein, 32 aa, Mycobacterium
RARTEQVNKESAARLAKQKADKAADDAKASMD

SEQ ID NO: 1085144 - protein, 4 aa, Mycobacterium
RASS

SEQ ID NO: 1085145 - protein, 13 aa, Mycobacterium
RAVDERVKRLIAS

SEQ ID NO: 1085146 - protein, 16 aa, Mycobacterium
RDCGATKIAKAASVPT

SEQ ID NO: 1085147 - protein, 6 aa, Mycobacterium
RDERRT

SEQ ID NO: 1085148 - protein, 6 aa, Mycobacterium
RDPADI

SEQ ID NO: 1085149 - protein, 10 aa, Mycobacterium
RDQRPDQALA

SEQ ID NO: 1085150 - protein, 6 aa, Mycobacterium
RDQSGV

SEQ ID NO: 1085151 - protein, 8 aa, Mycobacterium
RDRLQSGN

SEQ ID NO: 1085152 - protein, 6 aa, Mycobacterium
REAAES

SEQ ID NO: 1085153 - protein, 7 aa, Mycobacterium
REGGIND

SEQ ID NO: 1085154 - protein, 19 aa, Mycobacterium
REGKAAKQVRRSFDHCDDA

SEQ ID NO: 1085155 - protein, 7 aa, Mycobacterium
REKATNV

SEQ ID NO: 1085156 - protein, 15 aa, Mycobacterium
RFSSQGALKAFQSLE

SEQ ID NO: 1085157 - protein, 10 aa, Mycobacterium
RFTDAAESRA

SEQ ID NO: 1085158 - protein, 8 aa, Mycobacterium
RGAERVSA

SEQ ID NO: 1085159 - protein, 6 aa, Mycobacterium
RGAPDM

SEQ ID NO: 1085160 - protein, 8 aa, Mycobacterium
RGGISDHS

SEQ ID NO: 1085161 - protein, 19 aa, Mycobacterium
RGLAPDGHAAVGASQGGYA

SEQ ID NO: 1085162 - protein, 18 aa, Mycobacterium
RGPDELSTWSDPDIDGFS

SEQ ID NO: 1085163 - protein, 8 aa, Mycobacterium
RGQAGVAN

SEQ ID NO: 1085164 - protein, 27 aa, Mycobacterium
RGSAPDTTTVASAGELAVGTTDPCPAP

SEQ ID NO: 1085165 - protein, 4 aa, Mycobacterium
RHAR

SEQ ID NO: 1085166 - protein, 11 aa, Mycobacterium
RIDTTDNLAPS

SEQ ID NO: 1085167 - protein, 10 aa, Mycobacterium
RITPGEDAQV

SEQ ID NO: 1085168 - protein, 7 aa, Mycobacterium
RKAGATR

SEQ ID NO: 1085169 - protein, 9 aa, Mycobacterium
RKGPYPATY

SEQ ID NO: 1085170 - protein, 9 aa, Mycobacterium
RKIPSAQMR

SEQ ID NO: 1085171 - protein, 7 aa, Mycobacterium
RKKDEPV

SEQ ID NO: 1085172 - protein, 8 aa, Mycobacterium
RKNEPPGV

SEQ ID NO: 1085173 - protein, 4 aa, Mycobacterium
RLPA

SEQ ID NO: 1085174 - protein, 4 aa, Mycobacterium
RLQR

SEQ ID NO: 1085175 - protein, 4 aa, Mycobacterium
RLTA

SEQ ID NO: 1085176 - protein, 7 aa, Mycobacterium
RLTEARD

SEQ ID NO: 1085177 - protein, 8 aa, Mycobacterium
RPDDNDRV

SEQ ID NO: 1085178 - protein, 16 aa, Mycobacterium
RPDDPNGACGVASDAA

SEQ ID NO: 1085179 - protein, 12 aa, Mycobacterium
RPFPTKAEADAA

SEQ ID NO: 1085180 - protein, 10 aa, Mycobacterium
RPGDSGAPVT

SEQ ID NO: 1085181 - protein, 9 aa, Mycobacterium
RPGFDSPPQ

SEQ ID NO: 1085182 - protein, 8 aa, Mycobacterium
RPGTAEQV

SEQ ID NO: 1085183 - protein, 5 aa, Mycobacterium
RPGTV

SEQ ID NO: 1085184 - protein, 6 aa, Mycobacterium
RPSEKT

SEQ ID NO: 1085185 - protein, 6 aa, Mycobacterium
RPTTTV

SEQ ID NO: 1085186 - protein, 4 aa, Mycobacterium
RQAS

SEQ ID NO: 1085187 - protein, 6 aa, Mycobacterium
RQRRSM

SEQ ID NO: 1085188 - protein, 8 aa, Mycobacterium
RRGPRGDE

SEQ ID NO: 1085189 - protein, 8 aa, Mycobacterium
RRRNNTGV

SEQ ID NO: 1085190 - protein, 11 aa, Mycobacterium
RRRVEERREGL

SEQ ID NO: 1085191 - protein, 18 aa, Mycobacterium
RRSDRNGDANGGPHQLSL

SEQ ID NO: 1085192 - protein, 7 aa, Mycobacterium
RRTPAPR

SEQ ID NO: 1085193 - protein, 19 aa, Mycobacterium
RRVRSRQQAPHTPAQRCPP

SEQ ID NO: 1085194 - protein, 6 aa, Mycobacterium
RSADPQ

SEQ ID NO: 1085195 - protein, 12 aa, Mycobacterium
RSCRDSVGSYTK

SEQ ID NO: 1085196 - protein, 26 aa, Mycobacterium
RSIDNGQSWGTYPGTIRTASPDAIPG

SEQ ID NO: 1085197 - protein, 26 aa, Mycobacterium
RSIGGTAVKAGSHDVPRNNNSQQQYP

SEQ ID NO: 1085198 - protein, 5 aa, Mycobacterium
RSPII

SEQ ID NO: 1085199 - protein, 16 aa, Mycobacterium
RSPVGRQQRCLSWAQW

SEQ ID NO: 1085200 - protein, 6 aa, Mycobacterium
RSSGSV

SEQ ID NO: 1085201 - protein, 5 aa, Mycobacterium
RTAAN

SEQ ID NO: 1085202 - protein, 15 aa, Mycobacterium
RTAPAPQGPWSPEQP

SEQ ID NO: 1085203 - protein, 14 aa, Mycobacterium
RTDPIGDRTPETTC

SEQ ID NO: 1085204 - protein, 10 aa, Mycobacterium
RTINQQQKDL

SEQ ID NO: 1085205 - protein, 12 aa, Mycobacterium
RTKDQAGEMSER

SEQ ID NO: 1085206 - protein, 10 aa, Mycobacterium
RTSAEGAGRL

SEQ ID NO: 1085207 - protein, 9 aa, Mycobacterium
RTTTSYQQH

SEQ ID NO: 1085208 - protein, 6 aa, Mycobacterium
RTVGGV

SEQ ID NO: 1085209 - protein, 6 aa, Mycobacterium
RTWSYD

SEQ ID NO: 1085210 - protein, 9 aa, Mycobacterium
RVATGKDPL

SEQ ID NO: 1085211 - protein, 13 aa, Mycobacterium
RVNARGGPGGAPG

SEQ ID NO: 1085212 - protein, 18 aa, Mycobacterium
RWEPGSPASAGPAGGRKW

SEQ ID NO: 1085213 - protein, 9 aa, Mycobacterium
RWNDDGSAN

SEQ ID NO: 1085214 - protein, 14 aa, Mycobacterium
RYAPRADLATREEQ

SEQ ID NO: 1085215 - protein, 20 aa, Mycobacterium
RYDYTGAAPPLRSAAPLVDG

SEQ ID NO: 1085216 - protein, 7 aa, Mycobacterium
SAANNFD

SEQ ID NO: 1085217 - protein, 26 aa, Mycobacterium
SAAQGWPAQYGDASNSSYTATSGSTK

SEQ ID NO: 1085218 - protein, 10 aa, Mycobacterium
SADDAETVSR

SEQ ID NO: 1085219 - protein, 17 aa, Mycobacterium
SADEFDSDPVRYSTSQI

SEQ ID NO: 1085220 - protein, 17 aa, Mycobacterium
SADPESAVGPPPDGTYN

SEQ ID NO: 1085221 - protein, 12 aa, Mycobacterium
SAEEDEQKQLSD

SEQ ID NO: 1085222 - protein, 14 aa, Mycobacterium
SAESDVPTFRDDKN

SEQ ID NO: 1085223 - protein, 10 aa, Mycobacterium
SAPAYSPASQ

SEQ ID NO: 1085224 - protein, 32 aa, Mycobacterium; identical to SEQ ID NO: 916138

SEQ ID NO: 1085225 - protein, 4 aa, Mycobacterium
SASA

SEQ ID NO: 1085226 - protein, 11 aa, Mycobacterium
SASKARGTWQA

SEQ ID NO: 1085227 - protein, 9 aa, Mycobacterium
SASSSASAE

SEQ ID NO: 1085228 - protein, 8 aa, Mycobacterium
SCGNTDSW

SEQ ID NO: 1085229 - protein, 14 aa, Mycobacterium
SCYGTQASGSMVAP

SEQ ID NO: 1085230 - protein, 4 aa, Mycobacterium
SDAI

SEQ ID NO: 1085231 - protein, 11 aa, Mycobacterium
SDATQDSDGQF

SEQ ID NO: 1085232 - protein, 5 aa, Mycobacterium
SDESA

SEQ ID NO: 1085233 - protein, 10 aa, Mycobacterium
SDGHGGYGAS

SEQ ID NO: 1085234 - protein, 6 aa, Mycobacterium
SDGTPI

SEQ ID NO: 1085235 - protein, 6 aa, Mycobacterium
SDKRDI

SEQ ID NO: 1085236 - protein, 8 aa, Mycobacterium
SDPNKPIG

SEQ ID NO: 1085237 - protein, 7 aa, Mycobacterium
SDPRGTW

SEQ ID NO: 1085238 - protein, 10 aa, Mycobacterium
SDTIGARDKE

SEQ ID NO: 1085239 - protein, 4 aa, Mycobacterium
SDVQ

SEQ ID NO: 1085240 - protein, 8 aa, Mycobacterium
SEARGPLH

SEQ ID NO: 1085241 - protein, 10 aa, Mycobacterium
SETVRNGRPV

SEQ ID NO: 1085242 - protein, 5 aa, Mycobacterium
SGADV

SEQ ID NO: 1085243 - protein, 8 aa, Mycobacterium
SGEGADEL

SEQ ID NO: 1085244 - protein, 6 aa, Mycobacterium
SGGARP

SEQ ID NO: 1085245 - protein, 4 aa, Mycobacterium
SGGC

SEQ ID NO: 1085246 - protein, 9 aa, Mycobacterium
SGGGDNGWG

SEQ ID NO: 1085247 - protein, 9 aa, Mycobacterium
SGGGPDTRL

SEQ ID NO: 1085248 - protein, 6 aa, Mycobacterium
SGGNFA

SEQ ID NO: 1085249 - protein, 5 aa, Mycobacterium
SGGRL

SEQ ID NO: 1085250 - protein, 4 aa, Mycobacterium
SGGW

SEQ ID NO: 1085251 - protein, 12 aa, Mycobacterium
SGKLPATDTYCP

SEQ ID NO: 1085252 - protein, 7 aa, Mycobacterium
SGKYPTA

SEQ ID NO: 1085253 - protein, 15 aa, Mycobacterium
SGNLPSLPPGPGIPG

SEQ ID NO: 1085254 - protein, 4 aa, Mycobacterium
SGQP

SEQ ID NO: 1085255 - protein, 7 aa, Mycobacterium
SGSQYNL

SEQ ID NO: 1085256 - protein, 6 aa, Mycobacterium
SGTGSL

SEQ ID NO: 1085257 - protein, 5 aa, Mycobacterium
SGTLA

SEQ ID NO: 1085258 - protein, 22 aa, Mycobacterium
SGTLRTGSRGCCSKEDVSDARR

SEQ ID NO: 1085259 - protein, 8 aa, Mycobacterium
SGVSSSPF

SEQ ID NO: 1085260 - protein, 6 aa, Mycobacterium
SHDDAR

SEQ ID NO: 1085261 - protein, 7 aa, Mycobacterium
SHGKHAT

SEQ ID NO: 1085262 - protein, 9 aa, Mycobacterium
SHNPEEQAQ

SEQ ID NO: 1085263 - protein, 8 aa, Mycobacterium
SHPEYATA

SEQ ID NO: 1085264 - protein, 5 aa, Mycobacterium
SIGQR

SEQ ID NO: 1085265 - protein, 5 aa, Mycobacterium
SIPAG

SEQ ID NO: 1085266 - protein, 4 aa, Mycobacterium
SIPE

SEQ ID NO: 1085267 - protein, 13 aa, Mycobacterium
SIPGGPGSGKGAY

SEQ ID NO: 1085268 - protein, 21 aa, Mycobacterium
SIRETASQALPGLLQRLPALL

SEQ ID NO: 1085269 - protein, 6 aa, Mycobacterium
SISDLS

SEQ ID NO: 1085270 - protein, 5 aa, Mycobacterium
SKITY

SEQ ID NO: 1085271 - protein, 9 aa, Mycobacterium
SKPGTGSTF

SEQ ID NO: 1085272 - protein, 10 aa, Mycobacterium
SKSPSKTPEI

SEQ ID NO: 1085273 - protein, 7 aa, Mycobacterium
SLQNNGS

SEQ ID NO: 1085274 - protein, 11 aa, Mycobacterium
SMGKDSTPTAN

SEQ ID NO: 1085275 - protein, 12 aa, Mycobacterium
SMGKPTRPTPIG

SEQ ID NO: 1085276 - protein, 7 aa, Mycobacterium
SMGSSRE

SEQ ID NO: 1085277 - protein, 7 aa, Mycobacterium
SMRDSAT

SEQ ID NO: 1085278 - protein, 34 aa, Mycobacterium
SNHRRPGSFRNADDPCPVNDSARYDQVLEETRPA

SEQ ID NO: 1085279 - protein, 10 aa, Mycobacterium
SNKKSKQADK

SEQ ID NO: 1085280 - protein, 6 aa, Mycobacterium
SNLETE

SEQ ID NO: 1085281 - protein, 17 aa, Mycobacterium
SNNPVDKGAAKELAESI

SEQ ID NO: 1085282 - protein, 6 aa, Mycobacterium
SNQDLS

SEQ ID NO: 1085283 - protein, 5 aa, Mycobacterium
SNQEF

SEQ ID NO: 1085284 - protein, 4 aa, Mycobacterium
SPAG

SEQ ID NO: 1085285 - protein, 5 aa, Mycobacterium
SPAGE

SEQ ID NO: 1085286 - protein, 5 aa, Mycobacterium
SPDDA

SEQ ID NO: 1085287 - protein, 7 aa, Mycobacterium
SPDGKTD

SEQ ID NO: 1085288 - protein, 13 aa, Mycobacterium
SPKNPDNWKFALP

SEQ ID NO: 1085289 - protein, 6 aa, Mycobacterium
SPSSSR

SEQ ID NO: 1085290 - protein, 4 aa, Mycobacterium
SPTI

SEQ ID NO: 1085291 - protein, 16 aa, Mycobacterium
SQNPPPTSLARQNETT

SEQ ID NO: 1085292 - protein, 12 aa, Mycobacterium
SQSAGLSSMCTV

SEQ ID NO: 1085293 - protein, 7 aa, Mycobacterium
SQSGAEL

SEQ ID NO: 1085294 - protein, 4 aa, Mycobacterium
SQTG

SEQ ID NO: 1085295 - protein, 5 aa, Mycobacterium
SQTNR

SEQ ID NO: 1085296 - protein, 33 aa, Mycobacterium
SRATGKLASSSSDTTSPGLSPASPPSKPPPPVS

SEQ ID NO: 1085297 - protein, 6 aa, Mycobacterium
SRDGTR

SEQ ID NO: 1085298 - protein, 7 aa, Mycobacterium
SRFPGPI

SEQ ID NO: 1085299 - protein, 15 aa, Mycobacterium
SRMPPRGLTQAANQY

SEQ ID NO: 1085300 - protein, 11 aa, Mycobacterium
SRQRGQITASG

SEQ ID NO: 1085301 - protein, 5 aa, Mycobacterium
SRQTP

SEQ ID NO: 1085302 - protein, 8 aa, Mycobacterium
SRRRRGDN

SEQ ID NO: 1085303 - protein, 9 aa, Mycobacterium
SRSGPYLAR

SEQ ID NO: 1085304 - protein, 13 aa, Mycobacterium
SRTDAYGNPLSAE

SEQ ID NO: 1085305 - protein, 24 aa, Mycobacterium
SSAPSPPFATAAPPTSNTPPDDPC

SEQ ID NO: 1085306 - protein, 10 aa, Mycobacterium
SSATTRSRPI

SEQ ID NO: 1085307 - protein, 4 aa, Mycobacterium
SSDA

SEQ ID NO: 1085308 - protein, 8 aa, Mycobacterium
SSEFGAQG

SEQ ID NO: 1085309 - protein, 17 aa, Mycobacterium
SSGNPGKYLAPGQTITK

SEQ ID NO: 1085310 - protein, 7 aa, Mycobacterium
SSLRNDP

SEQ ID NO: 1085311 - protein, 8 aa, Mycobacterium
SSLTAQSD

SEQ ID NO: 1085312 - protein, 6 aa, Mycobacterium
SSNIDG

SEQ ID NO: 1085313 - protein, 6 aa, Mycobacterium
SSPVDG

SEQ ID NO: 1085314 - protein, 5 aa, Mycobacterium
SSQAE

SEQ ID NO: 1085315 - protein, 10 aa, Mycobacterium
SSSPAADAPG

SEQ ID NO: 1085316 - protein, 8 aa, Mycobacterium
SSSSGDEV

SEQ ID NO: 1085317 - protein, 5 aa, Mycobacterium
SSSTV

SEQ ID NO: 1085318 - protein, 9 aa, Mycobacterium
SSTGLEQAE

SEQ ID NO: 1085319 - protein, 7 aa, Mycobacterium
STASGYR

SEQ ID NO: 1085320 - protein, 20 aa, Mycobacterium
STGGSARSQIGGTPNIPKSA

SEQ ID NO: 1085321 - protein, 5 aa, Mycobacterium
STPRF

SEQ ID NO: 1085322 - protein, 5 aa, Mycobacterium
STSTT

SEQ ID NO: 1085323 - protein, 6 aa, Mycobacterium
STTNGK

SEQ ID NO: 1085324 - protein, 4 aa, Mycobacterium
STVY

SEQ ID NO: 1085325 - protein, 10 aa, Mycobacterium
SVAESQQGWS

SEQ ID NO: 1085326 - protein, 10 aa, Mycobacterium
SVFPTTEQTL

SEQ ID NO: 1085327 - protein, 6 aa, Mycobacterium
SVGGHN

SEQ ID NO: 1085328 - protein, 8 aa, Mycobacterium
SVGGKTPE

SEQ ID NO: 1085329 - protein, 10 aa, Mycobacterium
SVNSQGYTNV

SEQ ID NO: 1085330 - protein, 9 aa, Mycobacterium
SVTDDGKAE

SEQ ID NO: 1085331 - protein, 5 aa, Mycobacterium
SVTTE

SEQ ID NO: 1085332 - protein, 15 aa, Mycobacterium
SVVPGSPTVTTAPAP

SEQ ID NO: 1085333 - protein, 6 aa, Mycobacterium
SYDQPD

SEQ ID NO: 1085334 - protein, 16 aa, Mycobacterium
SYPPDLQHALDVLRAE

SEQ ID NO: 1085335 - protein, 16 aa, Mycobacterium
SYPSSRSDIGVSTCSN

SEQ ID NO: 1085336 - protein, 5 aa, Mycobacterium
TAAAD

SEQ ID NO: 1085337 - protein, 5 aa, Mycobacterium
TAAAN

SEQ ID NO: 1085338 - protein, 5 aa, Mycobacterium
TAAQN

SEQ ID NO: 1085339 - protein, 11 aa, Mycobacterium
TAARTLTASSQ

SEQ ID NO: 1085340 - protein, 9 aa, Mycobacterium
TAAVSRDDT

SEQ ID NO: 1085341 - protein, 7 aa, Mycobacterium
TADDATK

SEQ ID NO: 1085342 - protein, 8 aa, Mycobacterium
TADPANRH

SEQ ID NO: 1085343 - protein, 9 aa, Mycobacterium
TADPDGDNL

SEQ ID NO: 1085344 - protein, 4 aa, Mycobacterium
TAEH

SEQ ID NO: 1085345 - protein, 6 aa, Mycobacterium
TAEPAR

SEQ ID NO: 1085346 - protein, 24 aa, Mycobacterium
TAFDGSVKGKPAARFSCRSEKSRI

SEQ ID NO: 1085347 - protein, 7 aa, Mycobacterium
TANPPVE

SEQ ID NO: 1085348 - protein, 7 aa, Mycobacterium
TANYNGF

SEQ ID NO: 1085349 - protein, 16 aa, Mycobacterium
TAPGTGLTPPVTGSPI

SEQ ID NO: 1085350 - protein, 8 aa, Mycobacterium
TAPSASTM

SEQ ID NO: 1085351 - protein, 10 aa, Mycobacterium
TASATDGSKK

SEQ ID NO: 1085352 - protein, 6 aa, Mycobacterium
TATEKA

SEQ ID NO: 1085353 - protein, 21 aa, Mycobacterium
TATPEAFNKGQLDRPGPSAGP

SEQ ID NO: 1085354 - protein, 16 aa, Mycobacterium
TATVGGMASTNAGGLR
